United States Patent 7,888,497 (BIOINFORMATICALLY DETECTABLE GROUP OF NOVEL REGULATORY OLIGONUCLEOTIDES AND USES THEREOF) - sequence listing, part 89

SEQ ID NO: 3759225 - DNA, 22 bp, Homo sapiens
ccccactggctgtgggctccct

SEQ ID NO: 3759226 - DNA, 22 bp, Homo sapiens
ccccactggggaaataacagct

SEQ ID NO: 3759227 - DNA, 21 bp, Homo sapiens
ccccagagactcagagggagg

SEQ ID NO: 3759228 - DNA, 12 bp, Homo sapiens
ccccagagctgt

SEQ ID NO: 3759229 - DNA, 21 bp, Homo sapiens
ccccagagctgtttatggcct

SEQ ID NO: 3759230 - DNA, 21 bp, Homo sapiens
ccccagattgcaacaggctgg

SEQ ID NO: 3759231 - DNA, 12 bp, Homo sapiens
ccccagcaggtg

SEQ ID NO: 3759232 - DNA, 12 bp, Homo sapiens
ccccagcccagc

SEQ ID NO: 3759233 - DNA, 17 bp, Homo sapiens
ccccagcccagcccagc

SEQ ID NO: 3759234 - DNA, 15 bp, Homo sapiens
ccccagccctgtgga

SEQ ID NO: 3759235 - DNA, 13 bp, Homo sapiens
ccccagcctgcta

SEQ ID NO: 3759236 - DNA, 13 bp, Homo sapiens
ccccagctctgct

SEQ ID NO: 3759237 - DNA, 14 bp, Homo sapiens
ccccagctctgctt

SEQ ID NO: 3759238 - DNA, 18 bp, Homo sapiens
ccccaggccccaggaagc

SEQ ID NO: 3759239 - DNA, 19 bp, Homo sapiens
ccccaggccccaggaagcc

SEQ ID NO: 3759240 - DNA, 17 bp, Homo sapiens
ccccaggggtcccagcc

SEQ ID NO: 3759241 - DNA, 15 bp, Homo sapiens
ccccagtgcccacag

SEQ ID NO: 3759242 - DNA, 20 bp, Homo sapiens
ccccagtgcccacaggatca

SEQ ID NO: 3759243 - DNA, 22 bp, Homo sapiens
ccccataattttttttttcctt

SEQ ID NO: 3759244 - DNA, 16 bp, Homo sapiens
ccccatcccacaccct

SEQ ID NO: 3759245 - DNA, 19 bp, Homo sapiens
ccccatctctccctcccct

SEQ ID NO: 3759246 - DNA, 20 bp, Homo sapiens
ccccatgaagccacagccca

SEQ ID NO: 3759247 - DNA, 13 bp, Homo sapiens
ccccatgccaaag

SEQ ID NO: 3759248 - DNA, 12 bp, Homo sapiens
ccccatgcctgt

SEQ ID NO: 3759249 - DNA, 18 bp, Homo sapiens
ccccatgcctgtccagcc

SEQ ID NO: 3759250 - DNA, 14 bp, Homo sapiens
ccccatgtgcctgc

SEQ ID NO: 3759251 - DNA, 13 bp, Homo sapiens
ccccatttctatt

SEQ ID NO: 3759252 - DNA, 17 bp, Homo sapiens
ccccatttctatttatt

SEQ ID NO: 3759253 - DNA, 13 bp, Homo sapiens
cccccaagcctgc

SEQ ID NO: 3759254 - DNA, 14 bp, Homo sapiens
cccccaagcctgca

SEQ ID NO: 3759255 - DNA, 16 bp, Homo sapiens
cccccaaggggcagtc

SEQ ID NO: 3759256 - DNA, 18 bp, Homo sapiens
cccccacacctggccctg

SEQ ID NO: 3759257 - DNA, 15 bp, Homo sapiens
cccccaccccttccc

SEQ ID NO: 3759258 - DNA, 12 bp, Homo sapiens
cccccacccttt

SEQ ID NO: 3759259 - DNA, 13 bp, Homo sapiens
cccccagccctgt

SEQ ID NO: 3759260 - DNA, 14 bp, Homo sapiens
cccccagccctgtg

SEQ ID NO: 3759261 - DNA, 23 bp, Homo sapiens
cccccagctttgctaccaaagca

SEQ ID NO: 3759262 - DNA, 16 bp, Homo sapiens
cccccaggctgctgga

SEQ ID NO: 3759263 - DNA, 14 bp, Homo sapiens
cccccagtacctcc

SEQ ID NO: 3759264 - DNA, 15 bp, Homo sapiens
cccccgagctggggg

SEQ ID NO: 3759265 - DNA, 21 bp, Homo sapiens
cccccgagctgggggccatga

SEQ ID NO: 3759266 - DNA, 20 bp, Homo sapiens
ccccctcaggaccctcgctg

SEQ ID NO: 3759267 - DNA, 22 bp, Homo sapiens
ccccctcaggaccctcgctggc

SEQ ID NO: 3759268 - DNA, 13 bp, Homo sapiens
ccccctcccaggg

SEQ ID NO: 3759269 - DNA, 19 bp, Homo sapiens
ccccctccttcccagctgc

SEQ ID NO: 3759270 - DNA, 14 bp, Homo sapiens
ccccctctcccagt

SEQ ID NO: 3759271 - DNA, 12 bp, Homo sapiens
ccccctgcatct

SEQ ID NO: 3759272 - DNA, 16 bp, Homo sapiens
ccccctgccagtgcct

SEQ ID NO: 3759273 - DNA, 20 bp, Homo sapiens
ccccctggtggacagtcctg

SEQ ID NO: 3759274 - DNA, 23 bp, Homo sapiens
cccccttcagtgcccaccaacat

SEQ ID NO: 3759275 - DNA, 21 bp, Homo sapiens
cccccttctctgcccattccc

SEQ ID NO: 3759276 - DNA, 17 bp, Homo sapiens
cccccttctctgctcca

SEQ ID NO: 3759277 - DNA, 22 bp, Homo sapiens
cccccttctctgctccaccaca

SEQ ID NO: 3759278 - DNA, 18 bp, Homo sapiens
cccccttgccagacatgt

SEQ ID NO: 3759279 - DNA, 14 bp, Homo sapiens
ccccgagccctact

SEQ ID NO: 3759280 - DNA, 12 bp, Homo sapiens
ccccgagctggg

SEQ ID NO: 3759281 - DNA, 23 bp, Homo sapiens
ccccgaggccttctctgaaggac

SEQ ID NO: 3759282 - DNA, 17 bp, Homo sapiens
ccccgcccagctgcacc

SEQ ID NO: 3759283 - DNA, 23 bp, Homo sapiens
ccccgcccagctgcacctgccag

SEQ ID NO: 3759284 - DNA, 16 bp, Homo sapiens
ccccgccccacattcc

SEQ ID NO: 3759285 - DNA, 16 bp, Homo sapiens
ccccgccccgccccac

SEQ ID NO: 3759286 - DNA, 17 bp, Homo sapiens
ccccgcttgtccagcgc

SEQ ID NO: 3759287 - DNA, 18 bp, Homo sapiens
ccccgcttgtccagcgcc

SEQ ID NO: 3759288 - DNA, 19 bp, Homo sapiens
ccccgcttgtccagcgcct

SEQ ID NO: 3759289 - DNA, 15 bp, Homo sapiens
ccccgggctctctgc

SEQ ID NO: 3759290 - DNA, 18 bp, Homo sapiens
ccccgggctctctgctgt

SEQ ID NO: 3759291 - DNA, 23 bp, Homo sapiens
ccccgggtttggcgggccaagga

SEQ ID NO: 3759292 - DNA, 21 bp, Homo sapiens
ccccgtctggggttcagcccc

SEQ ID NO: 3759293 - DNA, 16 bp, Homo sapiens
cccctatccacccagc

SEQ ID NO: 3759294 - DNA, 19 bp, Homo sapiens
cccctatccacccagccca

SEQ ID NO: 3759295 - DNA, 15 bp, Homo sapiens
cccctcaacacctct

SEQ ID NO: 3759296 - DNA, 16 bp, Homo sapiens
cccctcaacacctctg

SEQ ID NO: 3759297 - DNA, 15 bp, Homo sapiens
cccctcaccttgcaa

SEQ ID NO: 3759298 - DNA, 14 bp, Homo sapiens
cccctcaggaccct

SEQ ID NO: 3759299 - DNA, 11 bp, Homo sapiens
cccctcccacc

SEQ ID NO: 3759300 - DNA, 12 bp, Homo sapiens
cccctcccagaa

SEQ ID NO: 3759301 - DNA, 13 bp, Homo sapiens
cccctcccagaac

SEQ ID NO: 3759302 - DNA, 14 bp, Homo sapiens
cccctcccagggcc

SEQ ID NO: 3759303 - DNA, 15 bp, Homo sapiens
cccctcccccaaccc

SEQ ID NO: 3759304 - DNA, 18 bp, Homo sapiens
cccctcccccaaccccca

SEQ ID NO: 3759305 - DNA, 17 bp, Homo sapiens
cccctccctggcctgtt

SEQ ID NO: 3759306 - DNA, 13 bp, Homo sapiens
cccctccctggct

SEQ ID NO: 3759307 - DNA, 16 bp, Homo sapiens
cccctccttcccagct

SEQ ID NO: 3759308 - DNA, 19 bp, Homo sapiens
cccctctaatgctcacgct

SEQ ID NO: 3759309 - DNA, 18 bp, Homo sapiens
cccctgacctcactgtga

SEQ ID NO: 3759310 - DNA, 21 bp, Homo sapiens
cccctgagacaaatggaggcc

SEQ ID NO: 3759311 - DNA, 15 bp, Homo sapiens
cccctgccagtgcct

SEQ ID NO: 3759312 - DNA, 16 bp, Homo sapiens
cccctgccagtgcctt

SEQ ID NO: 3759313 - DNA, 14 bp, Homo sapiens
cccctgccccgtca

SEQ ID NO: 3759314 - DNA, 14 bp, Homo sapiens
cccctgccctgctg

SEQ ID NO: 3759315 - DNA, 13 bp, Homo sapiens
cccctgctgcctc

SEQ ID NO: 3759316 - DNA, 18 bp, Homo sapiens
cccctgctgcctccccaa

SEQ ID NO: 3759317 - DNA, 18 bp, Homo sapiens
cccctggcttttcactgc

SEQ ID NO: 3759318 - DNA, 11 bp, Homo sapiens
cccctgggctc

SEQ ID NO: 3759319 - DNA, 22 bp, Homo sapiens
cccctggtggacagtcctggga

SEQ ID NO: 3759320 - DNA, 20 bp, Homo sapiens
cccctgtagactagtgccgt

SEQ ID NO: 3759321 - DNA, 15 bp, Homo sapiens
cccctgttcactcta

SEQ ID NO: 3759322 - DNA, 22 bp, Homo sapiens
ccccttcacttctgaccacact

SEQ ID NO: 3759323 - DNA, 15 bp, Homo sapiens
ccccttccccactgc

SEQ ID NO: 3759324 - DNA, 19 bp, Homo sapiens
ccccttccccactgcctgc

SEQ ID NO: 3759325 - DNA, 21 bp, Homo sapiens
ccccttccccactgcctgccc

SEQ ID NO: 3759326 - DNA, 15 bp, Homo sapiens
ccccttcgctcctgt

SEQ ID NO: 3759327 - DNA, 21 bp, Homo sapiens
ccccttctacactctcctggg

SEQ ID NO: 3759328 - DNA, 22 bp, Homo sapiens
ccccttctacactctcctgggc

SEQ ID NO: 3759329 - DNA, 23 bp, Homo sapiens
ccccttctacactctcctgggcc

SEQ ID NO: 3759330 - DNA, 13 bp, Homo sapiens
ccccttctcccac

SEQ ID NO: 3759331 - DNA, 12 bp, Homo sapiens
ccccttctctgc

SEQ ID NO: 3759332 - DNA, 18 bp, Homo sapiens
ccccttctctgcccattc

SEQ ID NO: 3759333 - DNA, 20 bp, Homo sapiens
cccctttgatgattaattca

SEQ ID NO: 3759334 - DNA, 14 bp, Homo sapiens
cccgaatagctggg

SEQ ID NO: 3759335 - DNA, 15 bp, Homo sapiens
cccgacagagggaag

SEQ ID NO: 3759336 - DNA, 22 bp, Homo sapiens
cccgagctgggggccatgagct

SEQ ID NO: 3759337 - DNA, 12 bp, Homo sapiens
cccgaggcccgc

SEQ ID NO: 3759338 - DNA, 14 bp, Homo sapiens
cccgaggctgccca

SEQ ID NO: 3759339 - DNA, 13 bp, Homo sapiens
cccgagtagctgg

SEQ ID NO: 3759340 - DNA, 16 bp, Homo sapiens
cccgcattccaggctc

SEQ ID NO: 3759341 - DNA, 22 bp, Homo sapiens
cccgcctggcagaactgagctc

SEQ ID NO: 3759342 - DNA, 15 bp, Homo sapiens
cccgcgcctccttcc

SEQ ID NO: 3759343 - DNA, 15 bp, Homo sapiens
cccgctcagccctcc

SEQ ID NO: 3759344 - DNA, 13 bp, Homo sapiens
cccgctcaggctg

SEQ ID NO: 3759345 - DNA, 20 bp, Homo sapiens
cccgctcatgggcccctctg

SEQ ID NO: 3759346 - DNA, 20 bp, Homo sapiens
cccgctttcttgctggttgt

SEQ ID NO: 3759347 - DNA, 14 bp, Homo sapiens
cccggattctggga

SEQ ID NO: 3759348 - DNA, 16 bp, Homo sapiens
cccggattctgggagg

SEQ ID NO: 3759349 - DNA, 22 bp, Homo sapiens
cccggctcgagcagtcctgcct

SEQ ID NO: 3759350 - DNA, 16 bp, Homo sapiens
cccgggctctctgctg

SEQ ID NO: 3759351 - DNA, 12 bp, Homo sapiens
cccggggcagct

SEQ ID NO: 3759352 - DNA, 14 bp, Homo sapiens
cccggggcagctgc

SEQ ID NO: 3759353 - DNA, 20 bp, Homo sapiens
cccggggcagctgccagaga

SEQ ID NO: 3759354 - DNA, 21 bp, Homo sapiens
cccggggcagctgccagagaa

SEQ ID NO: 3759355 - DNA, 18 bp, Homo sapiens
cccggtgcccaagaatag

SEQ ID NO: 3759356 - DNA, 17 bp, Homo sapiens
cccgtcaccatctcagg

SEQ ID NO: 3759357 - DNA, 12 bp, Homo sapiens
cccgtcttcagc

SEQ ID NO: 3759358 - DNA, 14 bp, Homo sapiens
cccgtcttcagcct

SEQ ID NO: 3759359 - DNA, 21 bp, Homo sapiens
cccgtgaggatgtcactcaga

SEQ ID NO: 3759360 - DNA, 13 bp, Homo sapiens
cccgtgcagactg

SEQ ID NO: 3759361 - DNA, 17 bp, Homo sapiens
cccgtgtggccccttca

SEQ ID NO: 3759362 - DNA, 19 bp, Homo sapiens
ccctaccacctccccagcc

SEQ ID NO: 3759363 - DNA, 21 bp, Homo sapiens
ccctaccgagtctcttctcca

SEQ ID NO: 3759364 - DNA, 20 bp, Homo sapiens
ccctacctcaacctgtaaat

SEQ ID NO: 3759365 - DNA, 23 bp, Homo sapiens
ccctacctgattggtgcaaccct

SEQ ID NO: 3759366 - DNA, 15 bp, Homo sapiens
ccctagggctgggtg

SEQ ID NO: 3759367 - DNA, 16 bp, Homo sapiens
ccctagggctgggtgt

SEQ ID NO: 3759368 - DNA, 16 bp, Homo sapiens
ccctatccacccagcc

SEQ ID NO: 3759369 - DNA, 19 bp, Homo sapiens
ccctatccacccagcccat

SEQ ID NO: 3759370 - DNA, 13 bp, Homo sapiens
ccctatgctgcct

SEQ ID NO: 3759371 - DNA, 17 bp, Homo sapiens
ccctatggaagcatatt

SEQ ID NO: 3759372 - DNA, 16 bp, Homo sapiens
ccctatggggatggtc

SEQ ID NO: 3759373 - DNA, 22 bp, Homo sapiens
ccctcaaggacaaagtctccag

SEQ ID NO: 3759374 - DNA, 23 bp, Homo sapiens
ccctcaaggacaaagtctccagc

SEQ ID NO: 3759375 - DNA, 13 bp, Homo sapiens
ccctcagcccctc

SEQ ID NO: 3759376 - DNA, 17 bp, Homo sapiens
ccctcagcccctcttgc

SEQ ID NO: 3759377 - DNA, 20 bp, Homo sapiens
ccctcaggaccctcgctggc

SEQ ID NO: 3759378 - DNA, 23 bp, Homo sapiens
ccctcaggaccctcgctggcccc

SEQ ID NO: 3759379 - DNA, 20 bp, Homo sapiens
ccctcaggcataggcctggg

SEQ ID NO: 3759380 - DNA, 13 bp, Homo sapiens
ccctcatctgtct

SEQ ID NO: 3759381 - DNA, 15 bp, Homo sapiens
ccctcattcaggaaa

SEQ ID NO: 3759382 - DNA, 14 bp, Homo sapiens
ccctccacatccct

SEQ ID NO: 3759383 - DNA, 15 bp, Homo sapiens
ccctccacatccctg

SEQ ID NO: 3759384 - DNA, 18 bp, Homo sapiens
ccctccacgttcacccct

SEQ ID NO: 3759385 - DNA, 13 bp, Homo sapiens
ccctccactgccc

SEQ ID NO: 3759386 - DNA, 14 bp, Homo sapiens
ccctcccaccacag

SEQ ID NO: 3759387 - DNA, 14 bp, Homo sapiens
ccctccccagggga

SEQ ID NO: 3759388 - DNA, 21 bp, Homo sapiens
ccctcccctaatgcctgcgga

SEQ ID NO: 3759389 - DNA, 12 bp, Homo sapiens
ccctccctacct

SEQ ID NO: 3759390 - DNA, 14 bp, Homo sapiens
ccctccctccttcc

SEQ ID NO: 3759391 - DNA, 19 bp, Homo sapiens
ccctccctggctcccatga

SEQ ID NO: 3759392 - DNA, 23 bp, Homo sapiens
ccctccgtggcatcaccttaggc

SEQ ID NO: 3759393 - DNA, 18 bp, Homo sapiens
ccctcctcacctctggac

SEQ ID NO: 3759394 - DNA, 11 bp, Homo sapiens
ccctccttcca

SEQ ID NO: 3759395 - DNA, 15 bp, Homo sapiens
ccctccttcccagct

SEQ ID NO: 3759396 - DNA, 16 bp, Homo sapiens
ccctccttcccagctg

SEQ ID NO: 3759397 - DNA, 17 bp, Homo sapiens
ccctccttcccagctgc

SEQ ID NO: 3759398 - DNA, 18 bp, Homo sapiens
ccctccttccttgaccag

SEQ ID NO: 3759399 - DNA, 19 bp, Homo sapiens
ccctcgaagcgcgccactc

SEQ ID NO: 3759400 - DNA, 13 bp, Homo sapiens
ccctcgctggccc

SEQ ID NO: 3759401 - DNA, 17 bp, Homo sapiens
ccctcgctggcccccac

SEQ ID NO: 3759402 - DNA, 20 bp, Homo sapiens
ccctcgctggcccccactgg

SEQ ID NO: 3759403 - DNA, 21 bp, Homo sapiens
ccctcgctggcccccactggc

SEQ ID NO: 3759404 - DNA, 19 bp, Homo sapiens
ccctctaatgctcacgctc

SEQ ID NO: 3759405 - DNA, 19 bp, Homo sapiens
ccctctagaaatttttcag

SEQ ID NO: 3759406 - DNA, 15 bp, Homo sapiens
ccctctatttagcat

SEQ ID NO: 3759407 - DNA, 11 bp, Homo sapiens
ccctctccctg

SEQ ID NO: 3759408 - DNA, 13 bp, Homo sapiens
ccctctcctgcct

SEQ ID NO: 3759409 - DNA, 13 bp, Homo sapiens
ccctctctcttct

SEQ ID NO: 3759410 - DNA, 19 bp, Homo sapiens
ccctctctcttctgctcca

SEQ ID NO: 3759411 - DNA, 22 bp, Homo sapiens
ccctctctggctaaggacaggc

SEQ ID NO: 3759412 - DNA, 14 bp, Homo sapiens
ccctctgccggctc

SEQ ID NO: 3759413 - DNA, 13 bp, Homo sapiens
ccctctgcctgtc

SEQ ID NO: 3759414 - DNA, 16 bp, Homo sapiens
ccctctgcctgtccct

SEQ ID NO: 3759415 - DNA, 23 bp, Homo sapiens
ccctctgcctgtccctctcaggc

SEQ ID NO: 3759416 - DNA, 23 bp, Homo sapiens
ccctctgctggccgggcacagct

SEQ ID NO: 3759417 - DNA, 13 bp, Homo sapiens
ccctctggccagg

SEQ ID NO: 3759418 - DNA, 18 bp, Homo sapiens
ccctctggccaggatgga

SEQ ID NO: 3759419 - DNA, 22 bp, Homo sapiens
ccctctggccaggatggagggg

SEQ ID NO: 3759420 - DNA, 17 bp, Homo sapiens
ccctctttccctccctt

SEQ ID NO: 3759421 - DNA, 20 bp, Homo sapiens
ccctctttccctcccttcct

SEQ ID NO: 3759422 - DNA, 18 bp, Homo sapiens
ccctgaaaacccagagag

SEQ ID NO: 3759423 - DNA, 17 bp, Homo sapiens
ccctgaaaacctcacat

SEQ ID NO: 3759424 - DNA, 16 bp, Homo sapiens
ccctgaaagccctgag

SEQ ID NO: 3759425 - DNA, 18 bp, Homo sapiens
ccctgaaagccctgagct

SEQ ID NO: 3759426 - DNA, 12 bp, Homo sapiens
ccctgaccctgc

SEQ ID NO: 3759427 - DNA, 15 bp, Homo sapiens
ccctgaccctgcaga

SEQ ID NO: 3759428 - DNA, 13 bp, Homo sapiens
ccctgactctctg

SEQ ID NO: 3759429 - DNA, 16 bp, Homo sapiens
ccctgaggctggactc

SEQ ID NO: 3759430 - DNA, 23 bp, Homo sapiens
ccctgaggctggactccagatct

SEQ ID NO: 3759431 - DNA, 20 bp, Homo sapiens
ccctgaggtgaaagggagct

SEQ ID NO: 3759432 - DNA, 20 bp, Homo sapiens
ccctgatcaagtcaccggag

SEQ ID NO: 3759433 - DNA, 15 bp, Homo sapiens
ccctgcaaaggactg

SEQ ID NO: 3759434 - DNA, 13 bp, Homo sapiens
ccctgcactggag

SEQ ID NO: 3759435 - DNA, 23 bp, Homo sapiens
ccctgcactggagtccagtctct

SEQ ID NO: 3759436 - DNA, 15 bp, Homo sapiens
ccctgccaccctggg

SEQ ID NO: 3759437 - DNA, 17 bp, Homo sapiens
ccctgccaccctgggga

SEQ ID NO: 3759438 - DNA, 15 bp, Homo sapiens
ccctgccagtgcctt

SEQ ID NO: 3759439 - DNA, 17 bp, Homo sapiens
ccctgcccctcccttca

SEQ ID NO: 3759440 - DNA, 17 bp, Homo sapiens
ccctgccctagctccac

SEQ ID NO: 3759441 - DNA, 12 bp, Homo sapiens
ccctgccctggt

SEQ ID NO: 3759442 - DNA, 15 bp, Homo sapiens
ccctgcctcacctct

SEQ ID NO: 3759443 - DNA, 21 bp, Homo sapiens
ccctgctctccgaccagacac

SEQ ID NO: 3759444 - DNA, 22 bp, Homo sapiens
ccctgctctccgaccagacacc

SEQ ID NO: 3759445 - DNA, 12 bp, Homo sapiens
ccctgctgcctc

SEQ ID NO: 3759446 - DNA, 14 bp, Homo sapiens
ccctgctgcctccc

SEQ ID NO: 3759447 - DNA, 13 bp, Homo sapiens
ccctgctggttca

SEQ ID NO: 3759448 - DNA, 17 bp, Homo sapiens
ccctgctttgggctgcc

SEQ ID NO: 3759449 - DNA, 20 bp, Homo sapiens
ccctgctttgggctgccctg

SEQ ID NO: 3759450 - DNA, 22 bp, Homo sapiens
ccctgctttgggctgccctggt

SEQ ID NO: 3759451 - DNA, 12 bp, Homo sapiens
ccctggagccca

SEQ ID NO: 3759452 - DNA, 13 bp, Homo sapiens
ccctggccatctc

SEQ ID NO: 3759453 - DNA, 13 bp, Homo sapiens
ccctggcctgctg

SEQ ID NO: 3759454 - DNA, 14 bp, Homo sapiens
ccctggcctgctgg

SEQ ID NO: 3759455 - DNA, 22 bp, Homo sapiens
ccctggcctgctgggctctcca

SEQ ID NO: 3759456 - DNA, 17 bp, Homo sapiens
ccctggctcccacaggc

SEQ ID NO: 3759457 - DNA, 13 bp, Homo sapiens
ccctggctcccat

SEQ ID NO: 3759458 - DNA, 14 bp, Homo sapiens
ccctggctcccatg

SEQ ID NO: 3759459 - DNA, 19 bp, Homo sapiens
ccctggcttttcactgctg

SEQ ID NO: 3759460 - DNA, 22 bp, Homo sapiens
ccctggcttttcactgctggct

SEQ ID NO: 3759461 - DNA, 15 bp, Homo sapiens
ccctgggatgtccac

SEQ ID NO: 3759462 - DNA, 18 bp, Homo sapiens
ccctgggccccaccacct

SEQ ID NO: 3759463 - DNA, 20 bp, Homo sapiens
ccctgggccccaccacctag

SEQ ID NO: 3759464 - DNA, 13 bp, Homo sapiens
ccctgggctgaga

SEQ ID NO: 3759465 - DNA, 20 bp, Homo sapiens
ccctggggctgatctcaggg

SEQ ID NO: 3759466 - DNA, 18 bp, Homo sapiens
ccctgggggaagccctgg

SEQ ID NO: 3759467 - DNA, 19 bp, Homo sapiens
ccctgggggaagccctgga

SEQ ID NO: 3759468 - DNA, 13 bp, Homo sapiens
ccctggtccttcc

SEQ ID NO: 3759469 - DNA, 15 bp, Homo sapiens
ccctggtgctgccac

SEQ ID NO: 3759470 - DNA, 21 bp, Homo sapiens
ccctggtgctgccacacttca

SEQ ID NO: 3759471 - DNA, 18 bp, Homo sapiens
ccctggtggacagtcctg

SEQ ID NO: 3759472 - DNA, 23 bp, Homo sapiens
ccctggtggacagtcctgggaga

SEQ ID NO: 3759473 - DNA, 13 bp, Homo sapiens
ccctggtggcagt

SEQ ID NO: 3759474 - DNA, 17 bp, Homo sapiens
ccctgtacaatatttaa

SEQ ID NO: 3759475 - DNA, 21 bp, Homo sapiens
ccctgtagagtgggagctgag

SEQ ID NO: 3759476 - DNA, 14 bp, Homo sapiens
ccctgtcaccaagc

SEQ ID NO: 3759477 - DNA, 14 bp, Homo sapiens
ccctgtccaaactg

SEQ ID NO: 3759478 - DNA, 15 bp, Homo sapiens
ccctgtcctcctcgg

SEQ ID NO: 3759479 - DNA, 19 bp, Homo sapiens
ccctgtctcctctctctgt

SEQ ID NO: 3759480 - DNA, 22 bp, Homo sapiens
ccctgtggtttccaaggagctg

SEQ ID NO: 3759481 - DNA, 12 bp, Homo sapiens
ccctgttcattg

SEQ ID NO: 3759482 - DNA, 19 bp, Homo sapiens
cccttacctcggtgccttc

SEQ ID NO: 3759483 - DNA, 14 bp, Homo sapiens
cccttagcagggaa

SEQ ID NO: 3759484 - DNA, 14 bp, Homo sapiens
cccttagcctccct

SEQ ID NO: 3759485 - DNA, 14 bp, Homo sapiens
cccttcaaccattc

SEQ ID NO: 3759486 - DNA, 23 bp, Homo sapiens
cccttcacttctgaccacacttc

SEQ ID NO: 3759487 - DNA, 13 bp, Homo sapiens
cccttcagtgccc

SEQ ID NO: 3759488 - DNA, 17 bp, Homo sapiens
cccttcagtgcccacca

SEQ ID NO: 3759489 - DNA, 11 bp, Homo sapiens
cccttcatttg

SEQ ID NO: 3759490 - DNA, 12 bp, Homo sapiens
cccttcccctcc

SEQ ID NO: 3759491 - DNA, 19 bp, Homo sapiens
cccttcccctccctggctc

SEQ ID NO: 3759492 - DNA, 22 bp, Homo sapiens
cccttcccctccctggctccca

SEQ ID NO: 3759493 - DNA, 15 bp, Homo sapiens
cccttccctgcaaac

SEQ ID NO: 3759494 - DNA, 17 bp, Homo sapiens
cccttcccttgagccct

SEQ ID NO: 3759495 - DNA, 13 bp, Homo sapiens
cccttcgctcctg

SEQ ID NO: 3759496 - DNA, 16 bp, Homo sapiens
cccttcgctcctgtgt

SEQ ID NO: 3759497 - DNA, 15 bp, Homo sapiens
cccttctacactctc

SEQ ID NO: 3759498 - DNA, 13 bp, Homo sapiens
cccttctcccaca

SEQ ID NO: 3759499 - DNA, 18 bp, Homo sapiens
cccttctctgcccattcc

SEQ ID NO: 3759500 - DNA, 15 bp, Homo sapiens
cccttctgtgcccag

SEQ ID NO: 3759501 - DNA, 11 bp, Homo sapiens
cccttcttttt

SEQ ID NO: 3759502 - DNA, 19 bp, Homo sapiens
cccttctttttcttctttt

SEQ ID NO: 3759503 - DNA, 22 bp, Homo sapiens
cccttgaaagtcatgaacacat

SEQ ID NO: 3759504 - DNA, 19 bp, Homo sapiens
cccttgagacctcagccat

SEQ ID NO: 3759505 - DNA, 19 bp, Homo sapiens
cccttgcagctagttttct

SEQ ID NO: 3759506 - DNA, 21 bp, Homo sapiens
cccttgcagttcagcaccacc

SEQ ID NO: 3759507 - DNA, 23 bp, Homo sapiens
cccttgcagttcagcaccaccct

SEQ ID NO: 3759508 - DNA, 12 bp, Homo sapiens
cccttgcccagg

SEQ ID NO: 3759509 - DNA, 15 bp, Homo sapiens
cccttgcccagggct

SEQ ID NO: 3759510 - DNA, 21 bp, Homo sapiens
cccttgcccagggctcagcct

SEQ ID NO: 3759511 - DNA, 22 bp, Homo sapiens
cccttgcccagggctcagcctg

SEQ ID NO: 3759512 - DNA, 17 bp, Homo sapiens
cccttggaggccagcca

SEQ ID NO: 3759513 - DNA, 17 bp, Homo sapiens
cccttggaggctgtctt

SEQ ID NO: 3759514 - DNA, 15 bp, Homo sapiens
cccttggctcaatcc

SEQ ID NO: 3759515 - DNA, 13 bp, Homo sapiens
ccctttccttcca

SEQ ID NO: 3759516 - DNA, 18 bp, Homo sapiens
ccctttccttccatccct

SEQ ID NO: 3759517 - DNA, 13 bp, Homo sapiens
ccctttgctccac

SEQ ID NO: 3759518 - DNA, 20 bp, Homo sapiens
ccctttgggaggctgaggcg

SEQ ID NO: 3759519 - DNA, 22 bp, Homo sapiens
cccttttggcccccgagctggg

SEQ ID NO: 3759520 - DNA, 20 bp, Homo sapiens
cccttttgggtttctgccct

SEQ ID NO: 3759521 - DNA, 21 bp, Homo sapiens
cccttttgttccccagcccta

SEQ ID NO: 3759522 - DNA, 18 bp, Homo sapiens
ccctttttactccccttg

SEQ ID NO: 3759523 - DNA, 16 bp, Homo sapiens
ccgaatagctgggact

SEQ ID NO: 3759524 - DNA, 17 bp, Homo sapiens
ccgaatagctgggacta

SEQ ID NO: 3759525 - DNA, 12 bp, Homo sapiens
ccgacagcctgg

SEQ ID NO: 3759526 - DNA, 22 bp, Homo sapiens
ccgacagcctggcacagggcag

SEQ ID NO: 3759527 - DNA, 17 bp, Homo sapiens
ccgaccagacaccttga

SEQ ID NO: 3759528 - DNA, 21 bp, Homo sapiens
ccgaccgaggctggagctggc

SEQ ID NO: 3759529 - DNA, 13 bp, Homo sapiens
ccgacctcagcct

SEQ ID NO: 3759530 - DNA, 18 bp, Homo sapiens
ccgagatcacgccactgc

SEQ ID NO: 3759531 - DNA, 20 bp, Homo sapiens
ccgagctggtgcattacaga

SEQ ID NO: 3759532 - DNA, 14 bp, Homo sapiens
ccgaggcagggtca

SEQ ID NO: 3759533 - DNA, 17 bp, Homo sapiens
ccgaggccttctctgaa

SEQ ID NO: 3759534 - DNA, 17 bp, Homo sapiens
ccgaggctggagctggc

SEQ ID NO: 3759535 - DNA, 17 bp, Homo sapiens
ccgagggtcctggctcc

SEQ ID NO: 3759536 - DNA, 17 bp, Homo sapiens
ccgagtagctgggacta

SEQ ID NO: 3759537 - DNA, 22 bp, Homo sapiens
ccgagtctcttctccactggat

SEQ ID NO: 3759538 - DNA, 22 bp, Homo sapiens
ccgagtggatagatgccctgct

SEQ ID NO: 3759539 - DNA, 15 bp, Homo sapiens
ccgatgctccagcca

SEQ ID NO: 3759540 - DNA, 22 bp, Homo sapiens
ccgatgctccagccaacccctg

SEQ ID NO: 3759541 - DNA, 13 bp, Homo sapiens
ccgattcaccctg

SEQ ID NO: 3759542 - DNA, 13 bp, Homo sapiens
ccgattgtaactc

SEQ ID NO: 3759543 - DNA, 17 bp, Homo sapiens
ccgcaaaacccactgac

SEQ ID NO: 3759544 - DNA, 12 bp, Homo sapiens
ccgcaggaagct

SEQ ID NO: 3759545 - DNA, 12 bp, Homo sapiens
ccgcatcttctc

SEQ ID NO: 3759546 - DNA, 14 bp, Homo sapiens
ccgcatgcagcagc

SEQ ID NO: 3759547 - DNA, 15 bp, Homo sapiens
ccgcattccctgagt

SEQ ID NO: 3759548 - DNA, 21 bp, Homo sapiens
ccgccacatccccgctggctg

SEQ ID NO: 3759549 - DNA, 14 bp, Homo sapiens
ccgccattgccacc

SEQ ID NO: 3759550 - DNA, 15 bp, Homo sapiens
ccgccattgccacca

SEQ ID NO: 3759551 - DNA, 16 bp, Homo sapiens
ccgccattgccaccag

SEQ ID NO: 3759552 - DNA, 18 bp, Homo sapiens
ccgccggccagctgggat

SEQ ID NO: 3759553 - DNA, 21 bp, Homo sapiens
ccgcctccctcccctgccctc

SEQ ID NO: 3759554 - DNA, 14 bp, Homo sapiens
ccgcctctgctggc

SEQ ID NO: 3759555 - DNA, 12 bp, Homo sapiens
ccgcctggcaga

SEQ ID NO: 3759556 - DNA, 13 bp, Homo sapiens
ccgctcagccctc

SEQ ID NO: 3759557 - DNA, 15 bp, Homo sapiens
ccgctcagccctccc

SEQ ID NO: 3759558 - DNA, 21 bp, Homo sapiens
ccgctcagccctccctgcccc

SEQ ID NO: 3759559 - DNA, 22 bp, Homo sapiens
ccgctcagccctccctgcccct

SEQ ID NO: 3759560 - DNA, 15 bp, Homo sapiens
ccgctccccagccca

SEQ ID NO: 3759561 - DNA, 14 bp, Homo sapiens
ccgctcctgtctgc

SEQ ID NO: 3759562 - DNA, 15 bp, Homo sapiens
ccgctcctgtctgcc

SEQ ID NO: 3759563 - DNA, 13 bp, Homo sapiens
ccgctgccagcac

SEQ ID NO: 3759564 - DNA, 15 bp, Homo sapiens
ccgctgccagcacag

SEQ ID NO: 3759565 - DNA, 20 bp, Homo sapiens
ccgctgcctaagtggctgct

SEQ ID NO: 3759566 - DNA, 12 bp, Homo sapiens
ccgctggctggg

SEQ ID NO: 3759567 - DNA, 18 bp, Homo sapiens
ccgctggctgggggcctc

SEQ ID NO: 3759568 - DNA, 15 bp, Homo sapiens
ccgctgttcacccac

SEQ ID NO: 3759569 - DNA, 15 bp, Homo sapiens
ccgcttctgcctgca

SEQ ID NO: 3759570 - DNA, 16 bp, Homo sapiens
ccgcttgtccagcgcc

SEQ ID NO: 3759571 - DNA, 19 bp, Homo sapiens
ccgcttgtccagcgcctag

SEQ ID NO: 3759572 - DNA, 12 bp, Homo sapiens
ccgctttctacc

SEQ ID NO: 3759573 - DNA, 15 bp, Homo sapiens
ccggaagctcctggt

SEQ ID NO: 3759574 - DNA, 19 bp, Homo sapiens
ccggaatcctgtcctcagc

SEQ ID NO: 3759575 - DNA, 22 bp, Homo sapiens
ccggaatcctgtcctcagcttc

SEQ ID NO: 3759576 - DNA, 14 bp, Homo sapiens
ccggagatgtagca

SEQ ID NO: 3759577 - DNA, 17 bp, Homo sapiens
ccggagatgtagcaaaa

SEQ ID NO: 3759578 - DNA, 17 bp, Homo sapiens
ccggagattggacggcc

SEQ ID NO: 3759579 - DNA, 16 bp, Homo sapiens
ccggagctaacactgg

SEQ ID NO: 3759580 - DNA, 19 bp, Homo sapiens
ccggagctaacactggccc

SEQ ID NO: 3759581 - DNA, 22 bp, Homo sapiens
ccggagctaacactggccccta

SEQ ID NO: 3759582 - DNA, 15 bp, Homo sapiens
ccggatcctgggtgg

SEQ ID NO: 3759583 - DNA, 22 bp, Homo sapiens
ccggcagttctgggtgctccct

SEQ ID NO: 3759584 - DNA, 15 bp, Homo sapiens
ccggccaagatgctt

SEQ ID NO: 3759585 - DNA, 12 bp, Homo sapiens
ccggccctgggg

SEQ ID NO: 3759586 - DNA, 13 bp, Homo sapiens
ccggccctggggc

SEQ ID NO: 3759587 - DNA, 22 bp, Homo sapiens
ccggctatgggggcactgagga

SEQ ID NO: 3759588 - DNA, 12 bp, Homo sapiens
ccggctccaggc

SEQ ID NO: 3759589 - DNA, 14 bp, Homo sapiens
ccggctccaggctc

SEQ ID NO: 3759590 - DNA, 13 bp, Homo sapiens
ccgggactcactg

SEQ ID NO: 3759591 - DNA, 19 bp, Homo sapiens
ccgggactcactggcagcc

SEQ ID NO: 3759592 - DNA, 22 bp, Homo sapiens
ccgggcatggtggcgcaagcct

SEQ ID NO: 3759593 - DNA, 14 bp, Homo sapiens
ccgggctctctgct

SEQ ID NO: 3759594 - DNA, 18 bp, Homo sapiens
ccggggcagctgccagag

SEQ ID NO: 3759595 - DNA, 22 bp, Homo sapiens
ccgggtttggcgggccaaggac

SEQ ID NO: 3759596 - DNA, 18 bp, Homo sapiens
ccggtcccttgagacctc

SEQ ID NO: 3759597 - DNA, 20 bp, Homo sapiens
ccggtcccttgagacctcag

SEQ ID NO: 3759598 - DNA, 22 bp, Homo sapiens
ccggtcccttgagacctcagcc

SEQ ID NO: 3759599 - DNA, 18 bp, Homo sapiens
ccgtaaagtgagcatgct

SEQ ID NO: 3759600 - DNA, 23 bp, Homo sapiens
ccgtaaagtgagcatgctttctg

SEQ ID NO: 3759601 - DNA, 18 bp, Homo sapiens
ccgtagaaatcccccttt

SEQ ID NO: 3759602 - DNA, 15 bp, Homo sapiens
ccgtagggagtacct

SEQ ID NO: 3759603 - DNA, 12 bp, Homo sapiens
ccgtatttcaga

SEQ ID NO: 3759604 - DNA, 20 bp, Homo sapiens
ccgtcagtatcaggcctgcc

SEQ ID NO: 3759605 - DNA, 15 bp, Homo sapiens
ccgtcatgttcctca

SEQ ID NO: 3759606 - DNA, 16 bp, Homo sapiens
ccgtctcatgaggggc

SEQ ID NO: 3759607 - DNA, 15 bp, Homo sapiens
ccgtcttcagcctag

SEQ ID NO: 3759608 - DNA, 13 bp, Homo sapiens
ccgtgcagactgg

SEQ ID NO: 3759609 - DNA, 15 bp, Homo sapiens
ccgtggcactgcata

SEQ ID NO: 3759610 - DNA, 23 bp, Homo sapiens
ccgtggcatcaccttaggcaggg

SEQ ID NO: 3759611 - DNA, 14 bp, Homo sapiens
ccgtggcttcccgc

SEQ ID NO: 3759612 - DNA, 15 bp, Homo sapiens
ccgtggcttcccgct

SEQ ID NO: 3759613 - DNA, 23 bp, Homo sapiens
ccgtggcttcccgctcagccctc

SEQ ID NO: 3759614 - DNA, 19 bp, Homo sapiens
ccgtgggcactgaaggctt

SEQ ID NO: 3759615 - DNA, 15 bp, Homo sapiens
ccgtgggccatggca

SEQ ID NO: 3759616 - DNA, 15 bp, Homo sapiens
ccgtgtggccccttc

SEQ ID NO: 3759617 - DNA, 17 bp, Homo sapiens
ccgttactctccaacct

SEQ ID NO: 3759618 - DNA, 20 bp, Homo sapiens
ccgttggggattggggaaga

SEQ ID NO: 3759619 - DNA, 22 bp, Homo sapiens
cctaaaaggaaatctcacccca

SEQ ID NO: 3759620 - DNA, 23 bp, Homo sapiens
cctaaaagttcataacagtgcca

SEQ ID NO: 3759621 - DNA, 23 bp, Homo sapiens
cctaaataaacacatagattcac

SEQ ID NO: 3759622 - DNA, 18 bp, Homo sapiens
cctaataaacatccttca

SEQ ID NO: 3759623 - DNA, 22 bp, Homo sapiens
cctaataaacatccttcaagaa

SEQ ID NO: 3759624 - DNA, 18 bp, Homo sapiens
cctaatacattaaagcag

SEQ ID NO: 3759625 - DNA, 17 bp, Homo sapiens
cctacaagagcagcctg

SEQ ID NO: 3759626 - DNA, 18 bp, Homo sapiens
cctacaggagtgagcact

SEQ ID NO: 3759627 - DNA, 15 bp, Homo sapiens
cctacagtggctgtc

SEQ ID NO: 3759628 - DNA, 21 bp, Homo sapiens
cctacagttgaaaaacagctg

SEQ ID NO: 3759629 - DNA, 15 bp, Homo sapiens
cctaccaacctctga

SEQ ID NO: 3759630 - DNA, 13 bp, Homo sapiens
cctaccacctccc

SEQ ID NO: 3759631 - DNA, 18 bp, Homo sapiens
cctacccaccctcctttc

SEQ ID NO: 3759632 - DNA, 16 bp, Homo sapiens
cctaccgagtctcttc

SEQ ID NO: 3759633 - DNA, 18 bp, Homo sapiens
cctacctcaacctgtaaa

SEQ ID NO: 3759634 - DNA, 21 bp, Homo sapiens
cctacctcagcctagaccctc

SEQ ID NO: 3759635 - DNA, 21 bp, Homo sapiens
cctacctgattggtgcaaccc

SEQ ID NO: 3759636 - DNA, 16 bp, Homo sapiens
cctaccttcaaagctg

SEQ ID NO: 3759637 - DNA, 21 bp, Homo sapiens
cctacgtcaaacatgaagtgt

SEQ ID NO: 3759638 - DNA, 18 bp, Homo sapiens
cctactacatcgccctcc

SEQ ID NO: 3759639 - DNA, 14 bp, Homo sapiens
cctacttttccttc

SEQ ID NO: 3759640 - DNA, 20 bp, Homo sapiens
cctagatccacacacagagg

SEQ ID NO: 3759641 - DNA, 16 bp, Homo sapiens
cctagccgacctcagc

SEQ ID NO: 3759642 - DNA, 19 bp, Homo sapiens
cctagccgacctcagcctt

SEQ ID NO: 3759643 - DNA, 20 bp, Homo sapiens
cctagcctgtgcctctggga

SEQ ID NO: 3759644 - DNA, 16 bp, Homo sapiens
cctaggaattcccagc

SEQ ID NO: 3759645 - DNA, 14 bp, Homo sapiens
cctaggccactcct

SEQ ID NO: 3759646 - DNA, 15 bp, Homo sapiens
cctaggccactcctc

SEQ ID NO: 3759647 - DNA, 16 bp, Homo sapiens
cctaggccactcctcc

SEQ ID NO: 3759648 - DNA, 18 bp, Homo sapiens
cctaggccactcctccaa

SEQ ID NO: 3759649 - DNA, 14 bp, Homo sapiens
cctagggaaaagtt

SEQ ID NO: 3759650 - DNA, 20 bp, Homo sapiens
cctagggatgttctggccct

SEQ ID NO: 3759651 - DNA, 15 bp, Homo sapiens
cctagggctgggtgt

SEQ ID NO: 3759652 - DNA, 18 bp, Homo sapiens
cctaggggtcagggacca

SEQ ID NO: 3759653 - DNA, 16 bp, Homo sapiens
cctagtcccttcccct

SEQ ID NO: 3759654 - DNA, 21 bp, Homo sapiens
cctagtcccttcccctccctg

SEQ ID NO: 3759655 - DNA, 17 bp, Homo sapiens
cctagtggggtctccct

SEQ ID NO: 3759656 - DNA, 19 bp, Homo sapiens
cctagtggggtctccctct

SEQ ID NO: 3759657 - DNA, 20 bp, Homo sapiens
cctataccccttacttagca

SEQ ID NO: 3759658 - DNA, 23 bp, Homo sapiens
cctataccccttacttagcatgc

SEQ ID NO: 3759659 - DNA, 14 bp, Homo sapiens
cctatagtcccagc

SEQ ID NO: 3759660 - DNA, 14 bp, Homo sapiens
cctatatgtagtat

SEQ ID NO: 3759661 - DNA, 15 bp, Homo sapiens
cctatcacctcccct

SEQ ID NO: 3759662 - DNA, 16 bp, Homo sapiens
cctatccacccagccc

SEQ ID NO: 3759663 - DNA, 17 bp, Homo sapiens
cctatccacccagccca

SEQ ID NO: 3759664 - DNA, 21 bp, Homo sapiens
cctatccacccagcccattct

SEQ ID NO: 3759665 - DNA, 13 bp, Homo sapiens
cctatgatcccag

SEQ ID NO: 3759666 - DNA, 14 bp, Homo sapiens
cctatgatcccagc

SEQ ID NO: 3759667 - DNA, 20 bp, Homo sapiens
cctatgctgcctaggctgac

SEQ ID NO: 3759668 - DNA, 22 bp, Homo sapiens
cctatggtataatggttgactg

SEQ ID NO: 3759669 - DNA, 16 bp, Homo sapiens
cctattgtaaatacaa

SEQ ID NO: 3759670 - DNA, 15 bp, Homo sapiens
cctcaaagcttccat

SEQ ID NO: 3759671 - DNA, 20 bp, Homo sapiens
cctcaaagcttccattccac

SEQ ID NO: 3759672 - DNA, 19 bp, Homo sapiens
cctcaaatgggtctggggg

SEQ ID NO: 3759673 - DNA, 16 bp, Homo sapiens
cctcaaccctccctca

SEQ ID NO: 3759674 - DNA, 18 bp, Homo sapiens
cctcaaccctccctcagc

SEQ ID NO: 3759675 - DNA, 21 bp, Homo sapiens
cctcaaggacttgaaagcatc

SEQ ID NO: 3759676 - DNA, 22 bp, Homo sapiens
cctcaatgtgaatcagacccta

SEQ ID NO: 3759677 - DNA, 17 bp, Homo sapiens
cctcaattcatcaatat

SEQ ID NO: 3759678 - DNA, 16 bp, Homo sapiens
cctcacatctttcaca

SEQ ID NO: 3759679 - DNA, 12 bp, Homo sapiens
cctcaccccact

SEQ ID NO: 3759680 - DNA, 17 bp, Homo sapiens
cctcacccccagctttg

SEQ ID NO: 3759681 - DNA, 13 bp, Homo sapiens
cctcacccctgcc

SEQ ID NO: 3759682 - DNA, 14 bp, Homo sapiens
cctcacccctgccc

SEQ ID NO: 3759683 - DNA, 16 bp, Homo sapiens
cctcacccctgccctg

SEQ ID NO: 3759684 - DNA, 18 bp, Homo sapiens
cctcacccctgccctggg

SEQ ID NO: 3759685 - DNA, 13 bp, Homo sapiens
cctcacctctgga

SEQ ID NO: 3759686 - DNA, 19 bp, Homo sapiens
cctcacctgggcacctggg

SEQ ID NO: 3759687 - DNA, 12 bp, Homo sapiens
cctcactgggtg

SEQ ID NO: 3759688 - DNA, 22 bp, Homo sapiens
cctcagactcatacagaaggtg

SEQ ID NO: 3759689 - DNA, 15 bp, Homo sapiens
cctcagactgctcaa

SEQ ID NO: 3759690 - DNA, 20 bp, Homo sapiens
cctcagatgcacatgagctg

SEQ ID NO: 3759691 - DNA, 14 bp, Homo sapiens
cctcagcatcctgg

SEQ ID NO: 3759692 - DNA, 16 bp, Homo sapiens
cctcagcatcctggca

SEQ ID NO: 3759693 - DNA, 14 bp, Homo sapiens
cctcagcctagacc

SEQ ID NO: 3759694 - DNA, 16 bp, Homo sapiens
cctcagcctagaccct

SEQ ID NO: 3759695 - DNA, 19 bp, Homo sapiens
cctcagcctagaccctcct

SEQ ID NO: 3759696 - DNA, 12 bp, Homo sapiens
cctcagcctccg

SEQ ID NO: 3759697 - DNA, 17 bp, Homo sapiens
cctcagctgcctcactt

SEQ ID NO: 3759698 - DNA, 19 bp, Homo sapiens
cctcagctgcctcacttcc

SEQ ID NO: 3759699 - DNA, 15 bp, Homo sapiens
cctcaggaccctcgc

SEQ ID NO: 3759700 - DNA, 17 bp, Homo sapiens
cctcaggaccctcgctg

SEQ ID NO: 3759701 - DNA, 18 bp, Homo sapiens
cctcaggaccctcgctgg

SEQ ID NO: 3759702 - DNA, 23 bp, Homo sapiens
cctcaggaccctcgctggccccc

SEQ ID NO: 3759703 - DNA, 18 bp, Homo sapiens
cctcaggctgctggagga

SEQ ID NO: 3759704 - DNA, 16 bp, Homo sapiens
cctcaggcttccttgg

SEQ ID NO: 3759705 - DNA, 17 bp, Homo sapiens
cctcaggcttccttggc

SEQ ID NO: 3759706 - DNA, 20 bp, Homo sapiens
cctcagggacagagacacct

SEQ ID NO: 3759707 - DNA, 22 bp, Homo sapiens
cctcagggacagagacacctgc

SEQ ID NO: 3759708 - DNA, 19 bp, Homo sapiens
cctcagggcagcctgcctg

SEQ ID NO: 3759709 - DNA, 18 bp, Homo sapiens
cctcaggtgagaagcaga

SEQ ID NO: 3759710 - DNA, 22 bp, Homo sapiens
cctcaggtgatccacccacctc

SEQ ID NO: 3759711 - DNA, 15 bp, Homo sapiens
cctcagtctggccct

SEQ ID NO: 3759712 - DNA, 18 bp, Homo sapiens
cctcagtggactttccac

SEQ ID NO: 3759713 - DNA, 17 bp, Homo sapiens
cctcagttcccttggcc

SEQ ID NO: 3759714 - DNA, 18 bp, Homo sapiens
cctcattagcattttgct

SEQ ID NO: 3759715 - DNA, 16 bp, Homo sapiens
cctcattcaggaaaac

SEQ ID NO: 3759716 - DNA, 21 bp, Homo sapiens
cctcattccaccttcccatgc

SEQ ID NO: 3759717 - DNA, 21 bp, Homo sapiens
cctcatttttataatgtccct

SEQ ID NO: 3759718 - DNA, 17 bp, Homo sapiens
cctccacagccgcagcc

SEQ ID NO: 3759719 - DNA, 17 bp, Homo sapiens
cctccacgttcacccct

SEQ ID NO: 3759720 - DNA, 18 bp, Homo sapiens
cctccacgttcacccctc

SEQ ID NO: 3759721 - DNA, 16 bp, Homo sapiens
cctccactccttcctg

SEQ ID NO: 3759722 - DNA, 14 bp, Homo sapiens
cctccactgccctc

SEQ ID NO: 3759723 - DNA, 12 bp, Homo sapiens
cctccagaagcc

SEQ ID NO: 3759724 - DNA, 13 bp, Homo sapiens
cctccagaagcct

SEQ ID NO: 3759725 - DNA, 19 bp, Homo sapiens
cctccagaagcctctggct

SEQ ID NO: 3759726 - DNA, 21 bp, Homo sapiens
cctccagaagcctctggctag

SEQ ID NO: 3759727 - DNA, 18 bp, Homo sapiens
cctccagctcagcagtga

SEQ ID NO: 3759728 - DNA, 12 bp, Homo sapiens
cctccagctgtt

SEQ ID NO: 3759729 - DNA, 13 bp, Homo sapiens
cctccaggcaaaa

SEQ ID NO: 3759730 - DNA, 16 bp, Homo sapiens
cctccagggccacgtg

SEQ ID NO: 3759731 - DNA, 19 bp, Homo sapiens
cctccagggccacgtgcca

SEQ ID NO: 3759732 - DNA, 14 bp, Homo sapiens
cctccatgctgcct

SEQ ID NO: 3759733 - DNA, 19 bp, Homo sapiens
cctccatgctgcctccaga

SEQ ID NO: 3759734 - DNA, 21 bp, Homo sapiens
cctccatggtgcctctggagg

SEQ ID NO: 3759735 - DNA, 23 bp, Homo sapiens
cctccatgtgggctagttgggct

SEQ ID NO: 3759736 - DNA, 21 bp, Homo sapiens
cctcccacccccttctctgct

SEQ ID NO: 3759737 - DNA, 17 bp, Homo sapiens
cctcccacctcagcctc

SEQ ID NO: 3759738 - DNA, 12 bp, Homo sapiens
cagtgcatctca

SEQ ID NO: 3759739 - DNA, 14 bp, Homo sapiens
cagtgccattgtct

SEQ ID NO: 3759740 - DNA, 18 bp, Homo sapiens
cagtgccattgtctttat

SEQ ID NO: 3759741 - DNA, 13 bp, Homo sapiens
cagtgcccacagg

SEQ ID NO: 3759742 - DNA, 17 bp, Homo sapiens
cagtgccctcattttat

SEQ ID NO: 3759743 - DNA, 18 bp, Homo sapiens
cagtgccgagaaggaagc

SEQ ID NO: 3759744 - DNA, 11 bp, Homo sapiens
cagtgcctgct

SEQ ID NO: 3759745 - DNA, 21 bp, Homo sapiens
cagtgccttacctcctgccca

SEQ ID NO: 3759746 - DNA, 22 bp, Homo sapiens
cagtgccttacctcctgcccag

SEQ ID NO: 3759747 - DNA, 23 bp, Homo sapiens
cagtgccttacctcctgcccagg

SEQ ID NO: 3759748 - DNA, 17 bp, Homo sapiens
cagtgccttccataatt

SEQ ID NO: 3759749 - DNA, 24 bp, Homo sapiens
cagtgcgcgtgcacgtggagagct

SEQ ID NO: 3759750 - DNA, 15 bp, Homo sapiens
cagtgctgtacttga

SEQ ID NO: 3759751 - DNA, 19 bp, Homo sapiens
cagtgctgtggcctgggca

SEQ ID NO: 3759752 - DNA, 15 bp, Homo sapiens
cagtgcttcagcctg

SEQ ID NO: 3759753 - DNA, 18 bp, Homo sapiens
cagtgcttcagcctgagg

SEQ ID NO: 3759754 - DNA, 23 bp, Homo sapiens
cagtggaatataaggaaagcaat

SEQ ID NO: 3759755 - DNA, 17 bp, Homo sapiens
cagtggactttccaccc

SEQ ID NO: 3759756 - DNA, 18 bp, Homo sapiens
cagtggactttccacccc

SEQ ID NO: 3759757 - DNA, 21 bp, Homo sapiens
cagtggactttccaccccctc

SEQ ID NO: 3759758 - DNA, 16 bp, Homo sapiens
cagtggattgcatttc

SEQ ID NO: 3759759 - DNA, 16 bp, Homo sapiens
cagtggcctcaaccct

SEQ ID NO: 3759760 - DNA, 18 bp, Homo sapiens
cagtggcctggctccgct

SEQ ID NO: 3759761 - DNA, 13 bp, Homo sapiens
cagtggctgtcac

SEQ ID NO: 3759762 - DNA, 19 bp, Homo sapiens
cagtgggaacgtgactgcc

SEQ ID NO: 3759763 - DNA, 11 bp, Homo sapiens
cagtgggaact

SEQ ID NO: 3759764 - DNA, 16 bp, Homo sapiens
cagtgggagctgcctg

SEQ ID NO: 3759765 - DNA, 18 bp, Homo sapiens
cagtgggagctgcctgtt

SEQ ID NO: 3759766 - DNA, 23 bp, Homo sapiens
cagtgggagctgcctgttcagct

SEQ ID NO: 3759767 - DNA, 21 bp, Homo sapiens
cagtggtgcgatctgggttca

SEQ ID NO: 3759768 - DNA, 14 bp, Homo sapiens
cagtgtctcggagg

SEQ ID NO: 3759769 - DNA, 14 bp, Homo sapiens
cagtgtcttccata

SEQ ID NO: 3759770 - DNA, 16 bp, Homo sapiens
cagtgtcttccataat

SEQ ID NO: 3759771 - DNA, 15 bp, Homo sapiens
cagtgtctttctttg

SEQ ID NO: 3759772 - DNA, 22 bp, Homo sapiens
cagtgtgatcccaagtgccagt

SEQ ID NO: 3759773 - DNA, 18 bp, Homo sapiens
cagtgtgcacgagtggga

SEQ ID NO: 3759774 - DNA, 22 bp, Homo sapiens
cagtgtgcacgagtgggaagga

SEQ ID NO: 3759775 - DNA, 13 bp, Homo sapiens
cagtgtgtctcct

SEQ ID NO: 3759776 - DNA, 15 bp, Homo sapiens
cagtgtgtctcctgc

SEQ ID NO: 3759777 - DNA, 22 bp, Homo sapiens
cagtgtgtggctttcagagcct

SEQ ID NO: 3759778 - DNA, 16 bp, Homo sapiens
cagtgttgtttgtaaa

SEQ ID NO: 3759779 - DNA, 18 bp, Homo sapiens
cagtgttgtttgtaaata

SEQ ID NO: 3759780 - DNA, 16 bp, Homo sapiens
cagttaactttcagaa

SEQ ID NO: 3759781 - DNA, 17 bp, Homo sapiens
cagttaagaaaaaaata

SEQ ID NO: 3759782 - DNA, 19 bp, Homo sapiens
cagttaagaaaaaaataat

SEQ ID NO: 3759783 - DNA, 20 bp, Homo sapiens
cagttaagaaaaaaataatt

SEQ ID NO: 3759784 - DNA, 21 bp, Homo sapiens
cagttaagaaaaaaataattt

SEQ ID NO: 3759785 - DNA, 12 bp, Homo sapiens
cagttaatcttg

SEQ ID NO: 3759786 - DNA, 15 bp, Homo sapiens
cagttactcagccct

SEQ ID NO: 3759787 - DNA, 19 bp, Homo sapiens
cagttactcagccctgggc

SEQ ID NO: 3759788 - DNA, 14 bp, Homo sapiens
cagttcaagaaagc

SEQ ID NO: 3759789 - DNA, 22 bp, Homo sapiens
cagttcacctatttcaaaaatt

SEQ ID NO: 3759790 - DNA, 23 bp, Homo sapiens
cagttcacctatttcaaaaattt

SEQ ID NO: 3759791 - DNA, 17 bp, Homo sapiens
cagttcaggagtcccaa

SEQ ID NO: 3759792 - DNA, 20 bp, Homo sapiens
cagttcccccagtacctcca

SEQ ID NO: 3759793 - DNA, 22 bp, Homo sapiens
cagttcccccagtacctccaag

SEQ ID NO: 3759794 - DNA, 15 bp, Homo sapiens
cagttcccttggcct

SEQ ID NO: 3759795 - DNA, 16 bp, Homo sapiens
cagttgcacttggcct

SEQ ID NO: 3759796 - DNA, 18 bp, Homo sapiens
cagttgggaaaatatgtc

SEQ ID NO: 3759797 - DNA, 18 bp, Homo sapiens
cagttgggtggatgcctg

SEQ ID NO: 3759798 - DNA, 15 bp, Homo sapiens
cagttggtgtgtttt

SEQ ID NO: 3759799 - DNA, 18 bp, Homo sapiens
cagtttcaattcagtgct

SEQ ID NO: 3759800 - DNA, 23 bp, Homo sapiens
cagtttcactttcacatagatgt

SEQ ID NO: 3759801 - DNA, 18 bp, Homo sapiens
cagtttgagacaggagac

SEQ ID NO: 3759802 - DNA, 21 bp, Homo sapiens
cagtttgcagaaaagcacctg

SEQ ID NO: 3759803 - DNA, 17 bp, Homo sapiens
cagttttccatgaaaac

SEQ ID NO: 3759804 - DNA, 18 bp, Homo sapiens
cagttttccatgaaaacg

SEQ ID NO: 3759805 - DNA, 19 bp, Homo sapiens
cagttttccatgaaaacgt

SEQ ID NO: 3759806 - DNA, 13 bp, Homo sapiens
cagttttccattg

SEQ ID NO: 3759807 - DNA, 18 bp, Homo sapiens
cataaaaagttaaaaaaa

SEQ ID NO: 3759808 - DNA, 14 bp, Homo sapiens
cataaactgtgtgc

SEQ ID NO: 3759809 - DNA, 15 bp, Homo sapiens
cataaactgtgtgca

SEQ ID NO: 3759810 - DNA, 18 bp, Homo sapiens
cataaaggataaactttt

SEQ ID NO: 3759811 - DNA, 23 bp, Homo sapiens
cataaaggtggtatgtgtgtgta

SEQ ID NO: 3759812 - DNA, 15 bp, Homo sapiens
cataaattgtactgt

SEQ ID NO: 3759813 - DNA, 18 bp, Homo sapiens
cataacaaataaccaacc

SEQ ID NO: 3759814 - DNA, 16 bp, Homo sapiens
cataacagtgccattg

SEQ ID NO: 3759815 - DNA, 15 bp, Homo sapiens
cataactgacaaatc

SEQ ID NO: 3759816 - DNA, 22 bp, Homo sapiens
cataactgacaaatcaagtttc

SEQ ID NO: 3759817 - DNA, 21 bp, Homo sapiens
cataagaatgaataataatta

SEQ ID NO: 3759818 - DNA, 14 bp, Homo sapiens
cataagataaatgt

SEQ ID NO: 3759819 - DNA, 21 bp, Homo sapiens
cataagcctccatttagttct

SEQ ID NO: 3759820 - DNA, 23 bp, Homo sapiens
cataagcctccatttagttcttt

SEQ ID NO: 3759821 - DNA, 21 bp, Homo sapiens
cataagggagcgtagaatctg

SEQ ID NO: 3759822 - DNA, 17 bp, Homo sapiens
cataataagctaaagag

SEQ ID NO: 3759823 - DNA, 20 bp, Homo sapiens
cataatctggactcctctgt

SEQ ID NO: 3759824 - DNA, 18 bp, Homo sapiens
cataatgttacattatta

SEQ ID NO: 3759825 - DNA, 17 bp, Homo sapiens
cataattcttgtatatt

SEQ ID NO: 3759826 - DNA, 21 bp, Homo sapiens
cataatttgtacatatgtaaa

SEQ ID NO: 3759827 - DNA, 23 bp, Homo sapiens
cataatttgtacatatgtaaaat

SEQ ID NO: 3759828 - DNA, 23 bp, Homo sapiens
catacagcacaatgttattacct

SEQ ID NO: 3759829 - DNA, 11 bp, Homo sapiens
catactctgct

SEQ ID NO: 3759830 - DNA, 23 bp, Homo sapiens
catagatgtccctttcttggcca

SEQ ID NO: 3759831 - DNA, 14 bp, Homo sapiens
catagattcacctg

SEQ ID NO: 3759832 - DNA, 15 bp, Homo sapiens
catagattcacctgt

SEQ ID NO: 3759833 - DNA, 16 bp, Homo sapiens
catagattcacctgta

SEQ ID NO: 3759834 - DNA, 15 bp, Homo sapiens
catagatttctgatt

SEQ ID NO: 3759835 - DNA, 16 bp, Homo sapiens
catagatttctgattt

SEQ ID NO: 3759836 - DNA, 19 bp, Homo sapiens
catagcagagaatgaaagg

SEQ ID NO: 3759837 - DNA, 22 bp, Homo sapiens
catagcagagaatgaaagggcc

SEQ ID NO: 3759838 - DNA, 23 bp, Homo sapiens
catagcagagaatgaaagggccc

SEQ ID NO: 3759839 - DNA, 17 bp, Homo sapiens
catagcagattttaatt

SEQ ID NO: 3759840 - DNA, 11 bp, Homo sapiens
catagcattaa

SEQ ID NO: 3759841 - DNA, 23 bp, Homo sapiens
catagcattaactaatctattgg

SEQ ID NO: 3759842 - DNA, 15 bp, Homo sapiens
catagccaccccaga

SEQ ID NO: 3759843 - DNA, 19 bp, Homo sapiens
catagctggttcctgctag

SEQ ID NO: 3759844 - DNA, 20 bp, Homo sapiens
catagctggttcctgctaga

SEQ ID NO: 3759845 - DNA, 18 bp, Homo sapiens
cataggcctgggtgctgg

SEQ ID NO: 3759846 - DNA, 18 bp, Homo sapiens
catagtaccaatcatttt

SEQ ID NO: 3759847 - DNA, 23 bp, Homo sapiens
catagtatattaaaaatggtaaa

SEQ ID NO: 3759848 - DNA, 16 bp, Homo sapiens
catagtatggtggctg

SEQ ID NO: 3759849 - DNA, 19 bp, Homo sapiens
catagtatggtggctgggt

SEQ ID NO: 3759850 - DNA, 20 bp, Homo sapiens
catagtatggtggctgggtt

SEQ ID NO: 3759851 - DNA, 18 bp, Homo sapiens
catagtattccattgtgt

SEQ ID NO: 3759852 - DNA, 19 bp, Homo sapiens
caggccagagggagtgaca

SEQ ID NO: 3759853 - DNA, 13 bp, Homo sapiens
caggccagctgtg

SEQ ID NO: 3759854 - DNA, 12 bp, Homo sapiens
caggcccaccta

SEQ ID NO: 3759855 - DNA, 13 bp, Homo sapiens
caggccccaggaa

SEQ ID NO: 3759856 - DNA, 16 bp, Homo sapiens
caggccccaggaagcc

SEQ ID NO: 3759857 - DNA, 17 bp, Homo sapiens
caggccccaggaagccg

SEQ ID NO: 3759858 - DNA, 15 bp, Homo sapiens
caggcccccaagcct

SEQ ID NO: 3759859 - DNA, 17 bp, Homo sapiens
caggcccccaagcctgc

SEQ ID NO: 3759860 - DNA, 18 bp, Homo sapiens
caggccccgcttgtccag

SEQ ID NO: 3759861 - DNA, 19 bp, Homo sapiens
caggcccctgccaccctgg

SEQ ID NO: 3759862 - DNA, 18 bp, Homo sapiens
caggcccggcgcggtggc

SEQ ID NO: 3759863 - DNA, 20 bp, Homo sapiens
caggcccggctccaggctcc

SEQ ID NO: 3759864 - DNA, 14 bp, Homo sapiens
caggcccggggctg

SEQ ID NO: 3759865 - DNA, 16 bp, Homo sapiens
caggcccggggctggc

SEQ ID NO: 3759866 - DNA, 21 bp, Homo sapiens
caggccgccccagcctctgag

SEQ ID NO: 3759867 - DNA, 19 bp, Homo sapiens
caggccggtgtgggctgtg

SEQ ID NO: 3759868 - DNA, 17 bp, Homo sapiens
caggccgtggctgccca

SEQ ID NO: 3759869 - DNA, 15 bp, Homo sapiens
caggcctccagctca

SEQ ID NO: 3759870 - DNA, 16 bp, Homo sapiens
caggcctccagctcag

SEQ ID NO: 3759871 - DNA, 14 bp, Homo sapiens
caggcctccctctc

SEQ ID NO: 3759872 - DNA, 17 bp, Homo sapiens
caggcctccctctctct

SEQ ID NO: 3759873 - DNA, 12 bp, Homo sapiens
caggcctgccag

SEQ ID NO: 3759874 - DNA, 16 bp, Homo sapiens
caggcctgggtctgtg

SEQ ID NO: 3759875 - DNA, 19 bp, Homo sapiens
caggcctgggtctgtgtct

SEQ ID NO: 3759876 - DNA, 20 bp, Homo sapiens
caggcctgggtctgtgtctc

SEQ ID NO: 3759877 - DNA, 19 bp, Homo sapiens
caggctcctttagcgccca

SEQ ID NO: 3759878 - DNA, 22 bp, Homo sapiens
caggctctgccctgccctagct

SEQ ID NO: 3759879 - DNA, 23 bp, Homo sapiens
caggctctgccctgccctagctc

SEQ ID NO: 3759880 - DNA, 16 bp, Homo sapiens
caggctgcatagaagg

SEQ ID NO: 3759881 - DNA, 17 bp, Homo sapiens
caggctgcatagaagga

SEQ ID NO: 3759882 - DNA, 21 bp, Homo sapiens
caggctgcatagaaggaggag

SEQ ID NO: 3759883 - DNA, 14 bp, Homo sapiens
caggctgctggagg

SEQ ID NO: 3759884 - DNA, 17 bp, Homo sapiens
caggctggcgtgcagtg

SEQ ID NO: 3759885 - DNA, 16 bp, Homo sapiens
caggctgggcttcagt

SEQ ID NO: 3759886 - DNA, 22 bp, Homo sapiens
caggctgggcttcagtggcagc

SEQ ID NO: 3759887 - DNA, 12 bp, Homo sapiens
caggctggtctc

SEQ ID NO: 3759888 - DNA, 13 bp, Homo sapiens
caggctggtctca

SEQ ID NO: 3759889 - DNA, 14 bp, Homo sapiens
caggctgtatccca

SEQ ID NO: 3759890 - DNA, 22 bp, Homo sapiens
caggctgtgcgctgacaaccac

SEQ ID NO: 3759891 - DNA, 16 bp, Homo sapiens
caggctgtgggcctca

SEQ ID NO: 3759892 - DNA, 16 bp, Homo sapiens
cagggaaacagctaat

SEQ ID NO: 3759893 - DNA, 14 bp, Homo sapiens
cagggaaaggctct

SEQ ID NO: 3759894 - DNA, 20 bp, Homo sapiens
cagggaacatatttaaggaa

SEQ ID NO: 3759895 - DNA, 12 bp, Homo sapiens
cagggaagccca

SEQ ID NO: 3759896 - DNA, 15 bp, Homo sapiens
cagggaagcccagct

SEQ ID NO: 3759897 - DNA, 16 bp, Homo sapiens
cagggaagcccagctc

SEQ ID NO: 3759898 - DNA, 18 bp, Homo sapiens
cagggaagcccagctcca

SEQ ID NO: 3759899 - DNA, 21 bp, Homo sapiens
cagggaagcccagctccaggg

SEQ ID NO: 3759900 - DNA, 18 bp, Homo sapiens
cagggaagtccccaggcc

SEQ ID NO: 3759901 - DNA, 14 bp, Homo sapiens
cagggacagagaca

SEQ ID NO: 3759902 - DNA, 18 bp, Homo sapiens
cagggaccaaggacccct

SEQ ID NO: 3759903 - DNA, 14 bp, Homo sapiens
cagggacccctgcc

SEQ ID NO: 3759904 - DNA, 16 bp, Homo sapiens
cagggagaggccatga

SEQ ID NO: 3759905 - DNA, 17 bp, Homo sapiens
cagggagaggccatgat

SEQ ID NO: 3759906 - DNA, 13 bp, Homo sapiens
cagggagcggaaa

SEQ ID NO: 3759907 - DNA, 19 bp, Homo sapiens
cagggagcggaaagcagct

SEQ ID NO: 3759908 - DNA, 18 bp, Homo sapiens
cagggaggaggtggcagc

SEQ ID NO: 3759909 - DNA, 20 bp, Homo sapiens
cagggaggaggtggcagccc

SEQ ID NO: 3759910 - DNA, 21 bp, Homo sapiens
cagggaggaggtggcagccct

SEQ ID NO: 3759911 - DNA, 22 bp, Homo sapiens
cagggaggaggtggcagccctg

SEQ ID NO: 3759912 - DNA, 13 bp, Homo sapiens
cagggaggggact

SEQ ID NO: 3759913 - DNA, 19 bp, Homo sapiens
cagggaggggactatttat

SEQ ID NO: 3759914 - DNA, 21 bp, Homo sapiens
cagggaggggactatttatga

SEQ ID NO: 3759915 - DNA, 17 bp, Homo sapiens
cagggaggtggctgggt

SEQ ID NO: 3759916 - DNA, 22 bp, Homo sapiens
cagggagtccgaaagggacttg

SEQ ID NO: 3759917 - DNA, 15 bp, Homo sapiens
cagggcaaggccatt

SEQ ID NO: 3759918 - DNA, 14 bp, Homo sapiens
cagggcacaccggg

SEQ ID NO: 3759919 - DNA, 21 bp, Homo sapiens
cagggcacaccgggcactcag

SEQ ID NO: 3759920 - DNA, 18 bp, Homo sapiens
cagggcaccaagcccaca

SEQ ID NO: 3759921 - DNA, 11 bp, Homo sapiens
cagggcactgc

SEQ ID NO: 3759922 - DNA, 15 bp, Homo sapiens
cagggcagcagatct

SEQ ID NO: 3759923 - DNA, 19 bp, Homo sapiens
cagggcagcctgcctggag

SEQ ID NO: 3759924 - DNA, 15 bp, Homo sapiens
cagggcatctcctgt

SEQ ID NO: 3759925 - DNA, 20 bp, Homo sapiens
cagggcatggccaggtggcc

SEQ ID NO: 3759926 - DNA, 15 bp, Homo sapiens
cagggccacgtgcca

SEQ ID NO: 3759927 - DNA, 17 bp, Homo sapiens
cagggccacgtgccagg

SEQ ID NO: 3759928 - DNA, 21 bp, Homo sapiens
cagggccacgtgccaggcccg

SEQ ID NO: 3759929 - DNA, 12 bp, Homo sapiens
cagggccactct

SEQ ID NO: 3759930 - DNA, 16 bp, Homo sapiens
cagggccactctgcct

SEQ ID NO: 3759931 - DNA, 16 bp, Homo sapiens
cagggccccagcacta

SEQ ID NO: 3759932 - DNA, 23 bp, Homo sapiens
cagggcctccagccctctcactg

SEQ ID NO: 3759933 - DNA, 13 bp, Homo sapiens
cagggccttgccc

SEQ ID NO: 3759934 - DNA, 15 bp, Homo sapiens
cagggccttgcccag

SEQ ID NO: 3759935 - DNA, 17 bp, Homo sapiens
cagggccttgcccagag

SEQ ID NO: 3759936 - DNA, 18 bp, Homo sapiens
cagggccttgcccagaga

SEQ ID NO: 3759937 - DNA, 17 bp, Homo sapiens
cagggctaccctccccc

SEQ ID NO: 3759938 - DNA, 16 bp, Homo sapiens
cagggctcagcctggt

SEQ ID NO: 3759939 - DNA, 19 bp, Homo sapiens
cagggctcagcctggtggg

SEQ ID NO: 3759940 - DNA, 12 bp, Homo sapiens
cagggctcagcg

SEQ ID NO: 3759941 - DNA, 21 bp, Homo sapiens
cagggctcagcggggacagct

SEQ ID NO: 3759942 - DNA, 23 bp, Homo sapiens
cagggctcagcggggacagctcc

SEQ ID NO: 3759943 - DNA, 19 bp, Homo sapiens
caggggaaaatcagcctgc

SEQ ID NO: 3759944 - DNA, 16 bp, Homo sapiens
caggggaatattttat

SEQ ID NO: 3759945 - DNA, 17 bp, Homo sapiens
caggggaatattttatt

SEQ ID NO: 3759946 - DNA, 15 bp, Homo sapiens
caggggaccacacct

SEQ ID NO: 3759947 - DNA, 23 bp, Homo sapiens
caggggactcagccctgaggtga

SEQ ID NO: 3759948 - DNA, 20 bp, Homo sapiens
caggggagagggtctggaga

SEQ ID NO: 3759949 - DNA, 18 bp, Homo sapiens
caggggcaaacacctgct

SEQ ID NO: 3759950 - DNA, 16 bp, Homo sapiens
cagggggccaggtgca

SEQ ID NO: 3759951 - DNA, 18 bp, Homo sapiens
caggggtcgtcaccacct

SEQ ID NO: 3759952 - DNA, 22 bp, Homo sapiens
caggggtggaggagagcctggt

SEQ ID NO: 3759953 - DNA, 14 bp, Homo sapiens
cagggtagaaaaag

SEQ ID NO: 3759954 - DNA, 23 bp, Homo sapiens
cagggtagataacctgtacttca

SEQ ID NO: 3759955 - DNA, 13 bp, Homo sapiens
cagggtagcaggt

SEQ ID NO: 3759956 - DNA, 17 bp, Homo sapiens
cagggtctcactctgtc

SEQ ID NO: 3759957 - DNA, 13 bp, Homo sapiens
cagggtcttccct

SEQ ID NO: 3759958 - DNA, 18 bp, Homo sapiens
cagggttcaaaatgtctg

SEQ ID NO: 3759959 - DNA, 15 bp, Homo sapiens
cagggttcccccagc

SEQ ID NO: 3759960 - DNA, 12 bp, Homo sapiens
cagggttggccc

SEQ ID NO: 3759961 - DNA, 16 bp, Homo sapiens
cagggttgggcccaga

SEQ ID NO: 3759962 - DNA, 20 bp, Homo sapiens
cagggttgggcccagatctg

SEQ ID NO: 3759963 - DNA, 19 bp, Homo sapiens
cagggttttatctctgtct

SEQ ID NO: 3759964 - DNA, 16 bp, Homo sapiens
caggtacagagaagga

SEQ ID NO: 3759965 - DNA, 19 bp, Homo sapiens
caggtagctgcccctggct

SEQ ID NO: 3759966 - DNA, 21 bp, Homo sapiens
caggtagctgcccctggctct

SEQ ID NO: 3759967 - DNA, 20 bp, Homo sapiens
caggtatgaccttctaggaa

SEQ ID NO: 3759968 - DNA, 23 bp, Homo sapiens
caggtatggaagggtttgtggct

SEQ ID NO: 3759969 - DNA, 15 bp, Homo sapiens
caggtcgggctcagc

SEQ ID NO: 3759970 - DNA, 16 bp, Homo sapiens
caggtcgggctcagct

SEQ ID NO: 3759971 - DNA, 13 bp, Homo sapiens
caggtctcccggg

SEQ ID NO: 3759972 - DNA, 11 bp, Homo sapiens
caggtctcctc

SEQ ID NO: 3759973 - DNA, 21 bp, Homo sapiens
caggtcttgaactcctggcct

SEQ ID NO: 3759974 - DNA, 22 bp, Homo sapiens
caggtcttgaactcctggcctc

SEQ ID NO: 3759975 - DNA, 23 bp, Homo sapiens
caggtcttgaactcctggcctca

SEQ ID NO: 3759976 - DNA, 16 bp, Homo sapiens
caggtgacagtgaggt

SEQ ID NO: 3759977 - DNA, 18 bp, Homo sapiens
caggtgaccttctgggaa

SEQ ID NO: 3759978 - DNA, 20 bp, Homo sapiens
caggtgagaagcagaggaag

SEQ ID NO: 3759979 - DNA, 16 bp, Homo sapiens
caggtgatccacccac

SEQ ID NO: 3759980 - DNA, 21 bp, Homo sapiens
caggtgatccacccacctcag

SEQ ID NO: 3759981 - DNA, 14 bp, Homo sapiens
caggtgctgccatc

SEQ ID NO: 3759982 - DNA, 19 bp, Homo sapiens
caggtggctgacccagtcc

SEQ ID NO: 3759983 - DNA, 12 bp, Homo sapiens
caggtggggagg

SEQ ID NO: 3759984 - DNA, 15 bp, Homo sapiens
caggtggggaggggg

SEQ ID NO: 3759985 - DNA, 13 bp, Homo sapiens
caggtggggcagc

SEQ ID NO: 3759986 - DNA, 20 bp, Homo sapiens
caggtggttatggagagggt

SEQ ID NO: 3759987 - DNA, 14 bp, Homo sapiens
caggtgtccccagc

SEQ ID NO: 3759988 - DNA, 15 bp, Homo sapiens
caggtgtccccagcc

SEQ ID NO: 3759989 - DNA, 16 bp, Homo sapiens
caggtgtccccagccc

SEQ ID NO: 3759990 - DNA, 18 bp, Homo sapiens
caggtgtccccagcccac

SEQ ID NO: 3759991 - DNA, 20 bp, Homo sapiens
caggtgtccccagcccactg

SEQ ID NO: 3759992 - DNA, 21 bp, Homo sapiens
caggtgtccccagcccactgg

SEQ ID NO: 3759993 - DNA, 15 bp, Homo sapiens
caggtgtccctgcac

SEQ ID NO: 3759994 - DNA, 19 bp, Homo sapiens
caggtgtccctgcacttgc

SEQ ID NO: 3759995 - DNA, 12 bp, Homo sapiens
caggtgtgaacc

SEQ ID NO: 3759996 - DNA, 22 bp, Homo sapiens
caggtgtgaaccaccacaccca

SEQ ID NO: 3759997 - DNA, 22 bp, Homo sapiens
caggtgtgagtcaccaagccca

SEQ ID NO: 3759998 - DNA, 12 bp, Homo sapiens
caggtgtttata

SEQ ID NO: 3759999 - DNA, 17 bp, Homo sapiens
caggttatactcctcct

SEQ ID NO: 3760000 - DNA, 20 bp, Homo sapiens
caggttctggttagctcagc

SEQ ID NO: 3760001 - DNA, 14 bp, Homo sapiens
caggttggtggggg

SEQ ID NO: 3760002 - DNA, 22 bp, Homo sapiens
caggttgtctgaagtcactgca

SEQ ID NO: 3760003 - DNA, 23 bp, Homo sapiens
caggttgtctgaagtcactgcac

SEQ ID NO: 3760004 - DNA, 16 bp, Homo sapiens
caggtttaagctgtta

SEQ ID NO: 3760005 - DNA, 13 bp, Homo sapiens
cagtaaagagaaa

SEQ ID NO: 3760006 - DNA, 14 bp, Homo sapiens
cagtaaagagaaac

SEQ ID NO: 3760007 - DNA, 19 bp, Homo sapiens
cagtaaagagaaactttgt

SEQ ID NO: 3760008 - DNA, 20 bp, Homo sapiens
cagtaaagagaaactttgtg

SEQ ID NO: 3760009 - DNA, 18 bp, Homo sapiens
cagtaacagggccttgct

SEQ ID NO: 3760010 - DNA, 19 bp, Homo sapiens
cagtaacttggttatacat

SEQ ID NO: 3760011 - DNA, 16 bp, Homo sapiens
cagtaagaccggaagc

SEQ ID NO: 3760012 - DNA, 18 bp, Homo sapiens
cagtaataaaacatcttt

SEQ ID NO: 3760013 - DNA, 12 bp, Homo sapiens
cagtaataactc

SEQ ID NO: 3760014 - DNA, 17 bp, Homo sapiens
cagtaatttgaggacaa

SEQ ID NO: 3760015 - DNA, 13 bp, Homo sapiens
cagtacaggcagc

SEQ ID NO: 3760016 - DNA, 20 bp, Homo sapiens
cagtacaggcagcacagaga

SEQ ID NO: 3760017 - DNA, 14 bp, Homo sapiens
cagtacccacctga

SEQ ID NO: 3760018 - DNA, 16 bp, Homo sapiens
cagtacccacctgagc

SEQ ID NO: 3760019 - DNA, 17 bp, Homo sapiens
cagtacccacctgagct

SEQ ID NO: 3760020 - DNA, 17 bp, Homo sapiens
cagtagagtcatctcca

SEQ ID NO: 3760021 - DNA, 20 bp, Homo sapiens
cagtagctgtggtgaggtgg

SEQ ID NO: 3760022 - DNA, 22 bp, Homo sapiens
cagtagtagcctccaggtttcc

SEQ ID NO: 3760023 - DNA, 17 bp, Homo sapiens
cagtatacaagataagc

SEQ ID NO: 3760024 - DNA, 14 bp, Homo sapiens
cagtatcaggcctg

SEQ ID NO: 3760025 - DNA, 16 bp, Homo sapiens
cagtatccactttgca

SEQ ID NO: 3760026 - DNA, 13 bp, Homo sapiens
cagtatctcaggg

SEQ ID NO: 3760027 - DNA, 20 bp, Homo sapiens
cagtattaaaggggggaggg

SEQ ID NO: 3760028 - DNA, 16 bp, Homo sapiens
cagtattacttctgct

SEQ ID NO: 3760029 - DNA, 19 bp, Homo sapiens
cagtattacttctgctaca

SEQ ID NO: 3760030 - DNA, 19 bp, Homo sapiens
cagtcaaaacagagatgtg

SEQ ID NO: 3760031 - DNA, 18 bp, Homo sapiens
cagtccaaatgtcctcca

SEQ ID NO: 3760032 - DNA, 22 bp, Homo sapiens
cagtccaaatgtcctccagaag

SEQ ID NO: 3760033 - DNA, 16 bp, Homo sapiens
cagtccacctgagctg

SEQ ID NO: 3760034 - DNA, 18 bp, Homo sapiens
cagtccacctgagctgcc

SEQ ID NO: 3760035 - DNA, 16 bp, Homo sapiens
cagtccatagcagaga

SEQ ID NO: 3760036 - DNA, 19 bp, Homo sapiens
cagtcccatcagagagcga

SEQ ID NO: 3760037 - DNA, 23 bp, Homo sapiens
cagtccccgtgaaggagagccct

SEQ ID NO: 3760038 - DNA, 22 bp, Homo sapiens
cagtccctgggggaagccctgg

SEQ ID NO: 3760039 - DNA, 17 bp, Homo sapiens
cagtcctgcctcagcct

SEQ ID NO: 3760040 - DNA, 19 bp, Homo sapiens
cagtcctgcctcagcctcc

SEQ ID NO: 3760041 - DNA, 18 bp, Homo sapiens
cagtcctgcctggccagg

SEQ ID NO: 3760042 - DNA, 14 bp, Homo sapiens
cagtcctgctctct

SEQ ID NO: 3760043 - DNA, 22 bp, Homo sapiens
cagtcctgctctctacccagcc

SEQ ID NO: 3760044 - DNA, 23 bp, Homo sapiens
cagtcctgctctctacccagccc

SEQ ID NO: 3760045 - DNA, 22 bp, Homo sapiens
cagtcctgggagaacctcaggc

SEQ ID NO: 3760046 - DNA, 21 bp, Homo sapiens
cagtctacccacctcagcctc

SEQ ID NO: 3760047 - DNA, 13 bp, Homo sapiens
cagtctcaggagc

SEQ ID NO: 3760048 - DNA, 19 bp, Homo sapiens
cagtctcaggagcatgggg

SEQ ID NO: 3760049 - DNA, 13 bp, Homo sapiens
cagtctcccaggc

SEQ ID NO: 3760050 - DNA, 22 bp, Homo sapiens
cagtctcgggtggctagtcaga

SEQ ID NO: 3760051 - DNA, 13 bp, Homo sapiens
cagtctgaagttt

SEQ ID NO: 3760052 - DNA, 22 bp, Homo sapiens
cagtctgatgagaactctgagc

SEQ ID NO: 3760053 - DNA, 22 bp, Homo sapiens
cagtctgattcccaagctctgc

SEQ ID NO: 3760054 - DNA, 15 bp, Homo sapiens
cagtctgctgccctc

SEQ ID NO: 3760055 - DNA, 18 bp, Homo sapiens
cagtctgctgccctccat

SEQ ID NO: 3760056 - DNA, 22 bp, Homo sapiens
cagtctgctgccctccatcccg

SEQ ID NO: 3760057 - DNA, 19 bp, Homo sapiens
cagtctggaatgcagtggt

SEQ ID NO: 3760058 - DNA, 16 bp, Homo sapiens
cagtctggaggggcat

SEQ ID NO: 3760059 - DNA, 18 bp, Homo sapiens
cagtctggaggggcatgg

SEQ ID NO: 3760060 - DNA, 11 bp, Homo sapiens
cagtcttccac

SEQ ID NO: 3760061 - DNA, 18 bp, Homo sapiens
cagtcttccacctggaag

SEQ ID NO: 3760062 - DNA, 22 bp, Homo sapiens
cagtcttccctagggctgggtg

SEQ ID NO: 3760063 - DNA, 23 bp, Homo sapiens
cagtcttccctagggctgggtgt

SEQ ID NO: 3760064 - DNA, 22 bp, Homo sapiens
cagtcttgaatttctaaaaaac

SEQ ID NO: 3760065 - DNA, 23 bp, Homo sapiens
cagtcttgaatttctaaaaaaca

SEQ ID NO: 3760066 - DNA, 14 bp, Homo sapiens
cagtgaaagcatca

SEQ ID NO: 3760067 - DNA, 23 bp, Homo sapiens
cagtgacacttcagagagctggt

SEQ ID NO: 3760068 - DNA, 20 bp, Homo sapiens
cagtgacagagttcactata

SEQ ID NO: 3760069 - DNA, 13 bp, Homo sapiens
cagtgagctgtgt

SEQ ID NO: 3760070 - DNA, 17 bp, Homo sapiens
cagtgaggcccagggag

SEQ ID NO: 3760071 - DNA, 21 bp, Homo sapiens
cagtgaggtcctgggggcctg

SEQ ID NO: 3760072 - DNA, 22 bp, Homo sapiens
cagtgagtcgaggacagggagg

SEQ ID NO: 3760073 - DNA, 15 bp, Homo sapiens
cagtgagtctcttca

SEQ ID NO: 3760074 - DNA, 16 bp, Homo sapiens
cagtgatctccatatg

SEQ ID NO: 3760075 - DNA, 21 bp, Homo sapiens
cagtgattaaggtctctcttt

SEQ ID NO: 3760076 - DNA, 18 bp, Homo sapiens
cagtgattcgagctatat

SEQ ID NO: 3760077 - DNA, 16 bp, Homo sapiens
cagtgatttttatcca

SEQ ID NO: 3760078 - DNA, 18 bp, Homo sapiens
cagtgatttttttttaga

SEQ ID NO: 3760079 - DNA, 14 bp, Homo sapiens
cagtgcagacaggc

SEQ ID NO: 3760080 - DNA, 22 bp, Homo sapiens
cagtgcagcccgtgtggcccct

SEQ ID NO: 3760081 - DNA, 12 bp, Homo sapiens
cagcacagagag

SEQ ID NO: 3760082 - DNA, 20 bp, Homo sapiens
cagcacagagagggggccac

SEQ ID NO: 3760083 - DNA, 12 bp, Homo sapiens
cagcacagagcg

SEQ ID NO: 3760084 - DNA, 18 bp, Homo sapiens
cagcacccagcaactcca

SEQ ID NO: 3760085 - DNA, 14 bp, Homo sapiens
cagcactgtctcag

SEQ ID NO: 3760086 - DNA, 23 bp, Homo sapiens
cagcactgtctcagtttcacttt

SEQ ID NO: 3760087 - DNA, 16 bp, Homo sapiens
cagcactttgggaggc

SEQ ID NO: 3760088 - DNA, 22 bp, Homo sapiens
cagcactttgggaggccaagga

SEQ ID NO: 3760089 - DNA, 22 bp, Homo sapiens
cagcactttgggaggctgaggc

SEQ ID NO: 3760090 - DNA, 23 bp, Homo sapiens
cagcactttgggaggctgaggtg

SEQ ID NO: 3760091 - DNA, 17 bp, Homo sapiens
cagcagatcccagctca

SEQ ID NO: 3760092 - DNA, 18 bp, Homo sapiens
cagcagatcccagctcac

SEQ ID NO: 3760093 - DNA, 21 bp, Homo sapiens
cagcagatcccagctcacgtc

SEQ ID NO: 3760094 - DNA, 14 bp, Homo sapiens
cagcagccagctct

SEQ ID NO: 3760095 - DNA, 12 bp, Homo sapiens
cagcagccctcc

SEQ ID NO: 3760096 - DNA, 15 bp, Homo sapiens
cagcagcctggaccc

SEQ ID NO: 3760097 - DNA, 18 bp, Homo sapiens
cagcagcctggaccctgt

SEQ ID NO: 3760098 - DNA, 12 bp, Homo sapiens
cagcagctcagg

SEQ ID NO: 3760099 - DNA, 14 bp, Homo sapiens
cagcagggcctcaa

SEQ ID NO: 3760100 - DNA, 17 bp, Homo sapiens
cagcagggcctcaaagt

SEQ ID NO: 3760101 - DNA, 14 bp, Homo sapiens
cagcatcctggcac

SEQ ID NO: 3760102 - DNA, 19 bp, Homo sapiens
cagcatcctggcacccggc

SEQ ID NO: 3760103 - DNA, 20 bp, Homo sapiens
cagcatcctggcacccggcc

SEQ ID NO: 3760104 - DNA, 13 bp, Homo sapiens
cagcatgattctt

SEQ ID NO: 3760105 - DNA, 17 bp, Homo sapiens
cagccaaacccatgagg

SEQ ID NO: 3760106 - DNA, 16 bp, Homo sapiens
cagccaaagcctcctc

SEQ ID NO: 3760107 - DNA, 21 bp, Homo sapiens
cagccaacgagtaatttattg

SEQ ID NO: 3760108 - DNA, 17 bp, Homo sapiens
cagccaccccgggctct

SEQ ID NO: 3760109 - DNA, 22 bp, Homo sapiens
cagccaccccgggctctctgct

SEQ ID NO: 3760110 - DNA, 15 bp, Homo sapiens
cagccacctctcttt

SEQ ID NO: 3760111 - DNA, 16 bp, Homo sapiens
cagccacctctctttt

SEQ ID NO: 3760112 - DNA, 15 bp, Homo sapiens
cagccacggccaggc

SEQ ID NO: 3760113 - DNA, 16 bp, Homo sapiens
cagccacggccaggcc

SEQ ID NO: 3760114 - DNA, 19 bp, Homo sapiens
cagccacggccaggccaga

SEQ ID NO: 3760115 - DNA, 17 bp, Homo sapiens
cagccagaaccccgagc

SEQ ID NO: 3760116 - DNA, 17 bp, Homo sapiens
cagccagcagccagctc

SEQ ID NO: 3760117 - DNA, 13 bp, Homo sapiens
cagccagcccagc

SEQ ID NO: 3760118 - DNA, 20 bp, Homo sapiens
cagccagcccagcccagctg

SEQ ID NO: 3760119 - DNA, 16 bp, Homo sapiens
cagccagctctcagcc

SEQ ID NO: 3760120 - DNA, 16 bp, Homo sapiens
cagccagtgacctgag

SEQ ID NO: 3760121 - DNA, 20 bp, Homo sapiens
cagccattaccatggagaca

SEQ ID NO: 3760122 - DNA, 11 bp, Homo sapiens
cagcccacccc

SEQ ID NO: 3760123 - DNA, 14 bp, Homo sapiens
cagcccacccccct

SEQ ID NO: 3760124 - DNA, 16 bp, Homo sapiens
cagcccacccccctca

SEQ ID NO: 3760125 - DNA, 17 bp, Homo sapiens
cagcccacccccctcat

SEQ ID NO: 3760126 - DNA, 14 bp, Homo sapiens
cagcccactgagaa

SEQ ID NO: 3760127 - DNA, 15 bp, Homo sapiens
cagcccagcccagct

SEQ ID NO: 3760128 - DNA, 18 bp, Homo sapiens
cagcccagcccagctgct

SEQ ID NO: 3760129 - DNA, 17 bp, Homo sapiens
cagcccagcccagctgg

SEQ ID NO: 3760130 - DNA, 17 bp, Homo sapiens
cagcccagctgctctgc

SEQ ID NO: 3760131 - DNA, 21 bp, Homo sapiens
cagcccagctgctctgcccag

SEQ ID NO: 3760132 - DNA, 18 bp, Homo sapiens
cagcccagggttccccca

SEQ ID NO: 3760133 - DNA, 19 bp, Homo sapiens
cagcccagggttcccccag

SEQ ID NO: 3760134 - DNA, 17 bp, Homo sapiens
cagcccatcttgcctcc

SEQ ID NO: 3760135 - DNA, 18 bp, Homo sapiens
cagcccatcttgcctcca

SEQ ID NO: 3760136 - DNA, 17 bp, Homo sapiens
cagcccatgcccacctg

SEQ ID NO: 3760137 - DNA, 19 bp, Homo sapiens
cagcccatgcccacctgcc

SEQ ID NO: 3760138 - DNA, 23 bp, Homo sapiens
cagcccattctctctcctgtcca

SEQ ID NO: 3760139 - DNA, 15 bp, Homo sapiens
cagccccacccagga

SEQ ID NO: 3760140 - DNA, 16 bp, Homo sapiens
cagccccacccaggag

SEQ ID NO: 3760141 - DNA, 14 bp, Homo sapiens
cagccccagcacca

SEQ ID NO: 3760142 - DNA, 13 bp, Homo sapiens
cagccccagtgcc

SEQ ID NO: 3760143 - DNA, 14 bp, Homo sapiens
cagccccagtgccc

SEQ ID NO: 3760144 - DNA, 15 bp, Homo sapiens
cagccccagtgccca

SEQ ID NO: 3760145 - DNA, 16 bp, Homo sapiens
cagccccagtgcccac

SEQ ID NO: 3760146 - DNA, 13 bp, Homo sapiens
cagccccattctg

SEQ ID NO: 3760147 - DNA, 20 bp, Homo sapiens
cagccccattctgcctgccc

SEQ ID NO: 3760148 - DNA, 24 bp, Homo sapiens
cagccccattctgcctgcccaggc

SEQ ID NO: 3760149 - DNA, 16 bp, Homo sapiens
cagccccgcgcctcct

SEQ ID NO: 3760150 - DNA, 16 bp, Homo sapiens
cagcccctcctctgcc

SEQ ID NO: 3760151 - DNA, 22 bp, Homo sapiens
cagcccctcctctgccacctcc

SEQ ID NO: 3760152 - DNA, 23 bp, Homo sapiens
cagcccctcttgccccccacccc

SEQ ID NO: 3760153 - DNA, 23 bp, Homo sapiens
cagcccctgcccctcatgccaac

SEQ ID NO: 3760154 - DNA, 17 bp, Homo sapiens
cagccccttgagaaacc

SEQ ID NO: 3760155 - DNA, 19 bp, Homo sapiens
cagcccgcatgcagcagct

SEQ ID NO: 3760156 - DNA, 21 bp, Homo sapiens
cagcccgcatgcagcagcttg

SEQ ID NO: 3760157 - DNA, 23 bp, Homo sapiens
cagcccgcatgcagcagcttgct

SEQ ID NO: 3760158 - DNA, 17 bp, Homo sapiens
cagcccgtgtggcccct

SEQ ID NO: 3760159 - DNA, 15 bp, Homo sapiens
cagccctccctgccc

SEQ ID NO: 3760160 - DNA, 16 bp, Homo sapiens
cagccctccctgcccc

SEQ ID NO: 3760161 - DNA, 18 bp, Homo sapiens
cagccctccctgcccctc

SEQ ID NO: 3760162 - DNA, 14 bp, Homo sapiens
cagccctccctgtc

SEQ ID NO: 3760163 - DNA, 18 bp, Homo sapiens
cagccctccctgtcctcc

SEQ ID NO: 3760164 - DNA, 19 bp, Homo sapiens
cagccctccctgtcctcct

SEQ ID NO: 3760165 - DNA, 22 bp, Homo sapiens
cagccctcctcaccccgtctgg

SEQ ID NO: 3760166 - DNA, 15 bp, Homo sapiens
cagccctctcactgt

SEQ ID NO: 3760167 - DNA, 20 bp, Homo sapiens
cagccctgctttgggctgcc

SEQ ID NO: 3760168 - DNA, 22 bp, Homo sapiens
cagccctgctttgggctgccct

SEQ ID NO: 3760169 - DNA, 11 bp, Homo sapiens
cagccctgggc

SEQ ID NO: 3760170 - DNA, 19 bp, Homo sapiens
cagccctgggccccaccac

SEQ ID NO: 3760171 - DNA, 20 bp, Homo sapiens
cagccctgggccccaccacc

SEQ ID NO: 3760172 - DNA, 20 bp, Homo sapiens
cagccctgtcagtgcagccc

SEQ ID NO: 3760173 - DNA, 13 bp, Homo sapiens
cagcccttagcag

SEQ ID NO: 3760174 - DNA, 19 bp, Homo sapiens
cagccctttgggaggctga

SEQ ID NO: 3760175 - DNA, 21 bp, Homo sapiens
cagccgagtggatagatgccc

SEQ ID NO: 3760176 - DNA, 16 bp, Homo sapiens
cagccgcagcctccct

SEQ ID NO: 3760177 - DNA, 13 bp, Homo sapiens
cagccgccacatc

SEQ ID NO: 3760178 - DNA, 23 bp, Homo sapiens
cagccgccacatccccgctggct

SEQ ID NO: 3760179 - DNA, 22 bp, Homo sapiens
cagccgccattgccaccaggag

SEQ ID NO: 3760180 - DNA, 23 bp, Homo sapiens
cagccgccattgccaccaggaga

SEQ ID NO: 3760181 - DNA, 12 bp, Homo sapiens
cagccgctcctg

SEQ ID NO: 3760182 - DNA, 17 bp, Homo sapiens
cagccgctcctgtctgc

SEQ ID NO: 3760183 - DNA, 18 bp, Homo sapiens
cagccgctcctgtctgcc

SEQ ID NO: 3760184 - DNA, 14 bp, Homo sapiens
cagccgcttctgac

SEQ ID NO: 3760185 - DNA, 14 bp, Homo sapiens
cagccggcacccac

SEQ ID NO: 3760186 - DNA, 14 bp, Homo sapiens
cagccggggaagac

SEQ ID NO: 3760187 - DNA, 20 bp, Homo sapiens
cagccggggcctgcctagca

SEQ ID NO: 3760188 - DNA, 20 bp, Homo sapiens
cagccgtgccttcagctcta

SEQ ID NO: 3760189 - DNA, 21 bp, Homo sapiens
cagccgtgtaaccatggaccc

SEQ ID NO: 3760190 - DNA, 16 bp, Homo sapiens
cagcctaagatgaaga

SEQ ID NO: 3760191 - DNA, 20 bp, Homo sapiens
cagcctactagggacctggg

SEQ ID NO: 3760192 - DNA, 15 bp, Homo sapiens
cagcctagccgacct

SEQ ID NO: 3760193 - DNA, 18 bp, Homo sapiens
cagcctagccgacctcag

SEQ ID NO: 3760194 - DNA, 17 bp, Homo sapiens
cagcctcaacctcctgg

SEQ ID NO: 3760195 - DNA, 21 bp, Homo sapiens
cagcctcaacctcctgggcta

SEQ ID NO: 3760196 - DNA, 14 bp, Homo sapiens
cagcctccaagctc

SEQ ID NO: 3760197 - DNA, 12 bp, Homo sapiens
cagcctccagag

SEQ ID NO: 3760198 - DNA, 18 bp, Homo sapiens
cagcctccatgctgcctc

SEQ ID NO: 3760199 - DNA, 20 bp, Homo sapiens
cagcctccatgctgcctcca

SEQ ID NO: 3760200 - DNA, 19 bp, Homo sapiens
cagcctcccaaagtgctgg

SEQ ID NO: 3760201 - DNA, 20 bp, Homo sapiens
cagcctcccaaagtgctggg

SEQ ID NO: 3760202 - DNA, 18 bp, Homo sapiens
cagcctcccacccccatc

SEQ ID NO: 3760203 - DNA, 23 bp, Homo sapiens
cagcctccccctgtcccctctat

SEQ ID NO: 3760204 - DNA, 19 bp, Homo sapiens
cagcctcccgagtagctgg

SEQ ID NO: 3760205 - DNA, 20 bp, Homo sapiens
cagcctcccgagtagctggg

SEQ ID NO: 3760206 - DNA, 17 bp, Homo sapiens
cagcctcgaactcctgg

SEQ ID NO: 3760207 - DNA, 21 bp, Homo sapiens
cagcctcgaactcctgggctc

SEQ ID NO: 3760208 - DNA, 14 bp, Homo sapiens
cagcctctcttcct

SEQ ID NO: 3760209 - DNA, 23 bp, Homo sapiens
cagcctctcttcctatcccatcc

SEQ ID NO: 3760210 - DNA, 15 bp, Homo sapiens
cagcctcttaaagct

SEQ ID NO: 3760211 - DNA, 20 bp, Homo sapiens
cagcctcttaaagctgcctg

SEQ ID NO: 3760212 - DNA, 17 bp, Homo sapiens
cagcctgcgtggctgac

SEQ ID NO: 3760213 - DNA, 23 bp, Homo sapiens
cagcctggcgaaaccccatctct

SEQ ID NO: 3760214 - DNA, 15 bp, Homo sapiens
cagcctggcttctgg

SEQ ID NO: 3760215 - DNA, 16 bp, Homo sapiens
cagcctggcttctgga

SEQ ID NO: 3760216 - DNA, 20 bp, Homo sapiens
cagcctgggcaacacagcga

SEQ ID NO: 3760217 - DNA, 16 bp, Homo sapiens
cagcctgggcaatgtg

SEQ ID NO: 3760218 - DNA, 21 bp, Homo sapiens
cagcctgggcagccaggctgc

SEQ ID NO: 3760219 - DNA, 11 bp, Homo sapiens
cagcctgggcg

SEQ ID NO: 3760220 - DNA, 16 bp, Homo sapiens
cagcctggtgggcctc

SEQ ID NO: 3760221 - DNA, 23 bp, Homo sapiens
cagcctggtgggcctcctctgtc

SEQ ID NO: 3760222 - DNA, 15 bp, Homo sapiens
cagcctgtggcatct

SEQ ID NO: 3760223 - DNA, 19 bp, Homo sapiens
cagcctgtggcatctttgc

SEQ ID NO: 3760224 - DNA, 18 bp, Homo sapiens
cagcctgtggcggtgcct

SEQ ID NO: 3760225 - DNA, 22 bp, Homo sapiens
cagcctgtggcggtgcctgggt

SEQ ID NO: 3760226 - DNA, 20 bp, Homo sapiens
cagccttccccctcccaggg

SEQ ID NO: 3760227 - DNA, 16 bp, Homo sapiens
cagccttccccttgcc

SEQ ID NO: 3760228 - DNA, 21 bp, Homo sapiens
cagccttggataatgctgttg

SEQ ID NO: 3760229 - DNA, 23 bp, Homo sapiens
cagcctttctcccaggccaggct

SEQ ID NO: 3760230 - DNA, 21 bp, Homo sapiens
cagcgaaaggatgtaaacagt

SEQ ID NO: 3760231 - DNA, 21 bp, Homo sapiens
cagcgagccctggtggcagtg

SEQ ID NO: 3760232 - DNA, 14 bp, Homo sapiens
cagcggctggtgca

SEQ ID NO: 3760233 - DNA, 18 bp, Homo sapiens
cagcggctggtgcagggc

SEQ ID NO: 3760234 - DNA, 20 bp, Homo sapiens
cagcggctggtgcagggcct

SEQ ID NO: 3760235 - DNA, 19 bp, Homo sapiens
cagcgggagacctgtgcta

SEQ ID NO: 3760236 - DNA, 14 bp, Homo sapiens
cagcggggacagct

SEQ ID NO: 3760237 - DNA, 18 bp, Homo sapiens
cagctaaagcccaacctc

SEQ ID NO: 3760238 - DNA, 15 bp, Homo sapiens
cagctaagctaggaa

SEQ ID NO: 3760239 - DNA, 15 bp, Homo sapiens
cagctaatgggacac

SEQ ID NO: 3760240 - DNA, 16 bp, Homo sapiens
cagctaatttttaagt

SEQ ID NO: 3760241 - DNA, 15 bp, Homo sapiens
cagctactcagaagc

SEQ ID NO: 3760242 - DNA, 21 bp, Homo sapiens
cagctactcagaagcctgagg

SEQ ID NO: 3760243 - DNA, 12 bp, Homo sapiens
cagctactcagg

SEQ ID NO: 3760244 - DNA, 18 bp, Homo sapiens
cagctactcaggaggctg

SEQ ID NO: 3760245 - DNA, 15 bp, Homo sapiens
cagctacttgggagg

SEQ ID NO: 3760246 - DNA, 19 bp, Homo sapiens
cagctagcaaaagaagtaa

SEQ ID NO: 3760247 - DNA, 22 bp, Homo sapiens
cagctatgggagccccagggtc

SEQ ID NO: 3760248 - DNA, 17 bp, Homo sapiens
cagctcaccagccccag

SEQ ID NO: 3760249 - DNA, 17 bp, Homo sapiens
cagctcacgtcacactt

SEQ ID NO: 3760250 - DNA, 23 bp, Homo sapiens
cagctccactctgactggcacag

SEQ ID NO: 3760251 - DNA, 13 bp, Homo sapiens
cagctccagctca

SEQ ID NO: 3760252 - DNA, 16 bp, Homo sapiens
cagctccagctcacca

SEQ ID NO: 3760253 - DNA, 20 bp, Homo sapiens
cagctccagctcaccagccc

SEQ ID NO: 3760254 - DNA, 14 bp, Homo sapiens
cagctccagctgct

SEQ ID NO: 3760255 - DNA, 19 bp, Homo sapiens
cagctcccaccccaccccc

SEQ ID NO: 3760256 - DNA, 20 bp, Homo sapiens
cagctcccaccccaccccct

SEQ ID NO: 3760257 - DNA, 22 bp, Homo sapiens
cagctcccccgacggtgggcat

SEQ ID NO: 3760258 - DNA, 19 bp, Homo sapiens
cagctccctaggagaccaa

SEQ ID NO: 3760259 - DNA, 21 bp, Homo sapiens
cagctccttctgtcctactct

SEQ ID NO: 3760260 - DNA, 23 bp, Homo sapiens
cagctccttctgtcctactctgt

SEQ ID NO: 3760261 - DNA, 15 bp, Homo sapiens
cagctctactggtct

SEQ ID NO: 3760262 - DNA, 21 bp, Homo sapiens
cagctctagacaaccctgcaa

SEQ ID NO: 3760263 - DNA, 13 bp, Homo sapiens
cagctctcagcca

SEQ ID NO: 3760264 - DNA, 14 bp, Homo sapiens
cagctctccctctg

SEQ ID NO: 3760265 - DNA, 20 bp, Homo sapiens
cagctctccctctggccctg

SEQ ID NO: 3760266 - DNA, 16 bp, Homo sapiens
cagctctgcaagaatt

SEQ ID NO: 3760267 - DNA, 13 bp, Homo sapiens
cagctctgcttgc

SEQ ID NO: 3760268 - DNA, 17 bp, Homo sapiens
cagctctgtgttgccat

SEQ ID NO: 3760269 - DNA, 16 bp, Homo sapiens
cagctcttctccaggc

SEQ ID NO: 3760270 - DNA, 22 bp, Homo sapiens
cagctcttctgccggccctggg

SEQ ID NO: 3760271 - DNA, 19 bp, Homo sapiens
cagctgactgtggccccct

SEQ ID NO: 3760272 - DNA, 21 bp, Homo sapiens
cagctgacttttctgtccgag

SEQ ID NO: 3760273 - DNA, 22 bp, Homo sapiens
cagctgagaaaatgagtgacta

SEQ ID NO: 3760274 - DNA, 15 bp, Homo sapiens
cagctgattttaaca

SEQ ID NO: 3760275 - DNA, 21 bp, Homo sapiens
cagctgattttaacaataact

SEQ ID NO: 3760276 - DNA, 20 bp, Homo sapiens
cagctgcacctgccagcctg

SEQ ID NO: 3760277 - DNA, 13 bp, Homo sapiens
cagctgccagaga

SEQ ID NO: 3760278 - DNA, 15 bp, Homo sapiens
cagctgcccccgctc

SEQ ID NO: 3760279 - DNA, 18 bp, Homo sapiens
cagctgcggtccacccag

SEQ ID NO: 3760280 - DNA, 20 bp, Homo sapiens
cagctgcggtccacccagga

SEQ ID NO: 3760281 - DNA, 15 bp, Homo sapiens
cagctgctcccctcc

SEQ ID NO: 3760282 - DNA, 14 bp, Homo sapiens
cagctgctctgccc

SEQ ID NO: 3760283 - DNA, 15 bp, Homo sapiens
cagctgctctgccca

SEQ ID NO: 3760284 - DNA, 16 bp, Homo sapiens
cagctgctctgcccag

SEQ ID NO: 3760285 - DNA, 20 bp, Homo sapiens
cagctgctctgcccagagct

SEQ ID NO: 3760286 - DNA, 22 bp, Homo sapiens
cagctgctctgcccagagctgg

SEQ ID NO: 3760287 - DNA, 11 bp, Homo sapiens
cagctgcttct

SEQ ID NO: 3760288 - DNA, 22 bp, Homo sapiens
cagctgcttttgtctatgggac

SEQ ID NO: 3760289 - DNA, 16 bp, Homo sapiens
cagctggagaagaccc

SEQ ID NO: 3760290 - DNA, 12 bp, Homo sapiens
cagctgggagaa

SEQ ID NO: 3760291 - DNA, 15 bp, Homo sapiens
cagctgggagaaggg

SEQ ID NO: 3760292 - DNA, 22 bp, Homo sapiens
cagctgggatctgactgcacgt

SEQ ID NO: 3760293 - DNA, 16 bp, Homo sapiens
cagctgggttggaaaa

SEQ ID NO: 3760294 - DNA, 17 bp, Homo sapiens
cagctgggttggaaaac

SEQ ID NO: 3760295 - DNA, 19 bp, Homo sapiens
cagctggtggtatctgagt

SEQ ID NO: 3760296 - DNA, 18 bp, Homo sapiens
cagctggttgaggtttca

SEQ ID NO: 3760297 - DNA, 12 bp, Homo sapiens
cagctgtccctg

SEQ ID NO: 3760298 - DNA, 15 bp, Homo sapiens
cagctgtccctgtca

SEQ ID NO: 3760299 - DNA, 17 bp, Homo sapiens
cagctgtccctgtcacc

SEQ ID NO: 3760300 - DNA, 18 bp, Homo sapiens
cagctgtccctgtcacca

SEQ ID NO: 3760301 - DNA, 22 bp, Homo sapiens
cagctgtccctgtcaccaagct

SEQ ID NO: 3760302 - DNA, 18 bp, Homo sapiens
cagctgtgctctggacag

SEQ ID NO: 3760303 - DNA, 22 bp, Homo sapiens
cagctgttagagtccaacgtgg

SEQ ID NO: 3760304 - DNA, 15 bp, Homo sapiens
cagctgttcagctgg

SEQ ID NO: 3760305 - DNA, 16 bp, Homo sapiens
cagctgttcagctggt

SEQ ID NO: 3760306 - DNA, 16 bp, Homo sapiens
cagcttcaccctgtca

SEQ ID NO: 3760307 - DNA, 15 bp, Homo sapiens
cagcttcagccagga

SEQ ID NO: 3760308 - DNA, 15 bp, Homo sapiens
cagcttcatttcctg

SEQ ID NO: 3760309 - DNA, 19 bp, Homo sapiens
cagcttcatttcctgtgtc

SEQ ID NO: 3760310 - DNA, 18 bp, Homo sapiens
cagcttcccctctctcct

SEQ ID NO: 3760311 - DNA, 19 bp, Homo sapiens
cagcttctcatcctgcagg

SEQ ID NO: 3760312 - DNA, 21 bp, Homo sapiens
cagcttctcatcctgcaggca

SEQ ID NO: 3760313 - DNA, 14 bp, Homo sapiens
cagcttgagggttg

SEQ ID NO: 3760314 - DNA, 19 bp, Homo sapiens
cagcttgagggttgggctg

SEQ ID NO: 3760315 - DNA, 20 bp, Homo sapiens
cagcttgagggttgggctgg

SEQ ID NO: 3760316 - DNA, 21 bp, Homo sapiens
cagcttgagggttgggctggt

SEQ ID NO: 3760317 - DNA, 13 bp, Homo sapiens
cagcttgctgcac

SEQ ID NO: 3760318 - DNA, 19 bp, Homo sapiens
cagcttgctgccctaggct

SEQ ID NO: 3760319 - DNA, 20 bp, Homo sapiens
cagcttgtaaatagctcagg

SEQ ID NO: 3760320 - DNA, 21 bp, Homo sapiens
cagcttgtaaatagctcaggt

SEQ ID NO: 3760321 - DNA, 14 bp, Homo sapiens
cagctttgccttcc

SEQ ID NO: 3760322 - DNA, 12 bp, Homo sapiens
cagctttgtttg

SEQ ID NO: 3760323 - DNA, 22 bp, Homo sapiens
cagctttgtttgttgtcagctg

SEQ ID NO: 3760324 - DNA, 16 bp, Homo sapiens
cagctttttgtctttt

SEQ ID NO: 3760325 - DNA, 15 bp, Homo sapiens
caggaaaaaaacttt

SEQ ID NO: 3760326 - DNA, 20 bp, Homo sapiens
caggaaaactgacagaggag

SEQ ID NO: 3760327 - DNA, 23 bp, Homo sapiens
caggaaaactgacagaggagggc

SEQ ID NO: 3760328 - DNA, 15 bp, Homo sapiens
caggaaaagctgctg

SEQ ID NO: 3760329 - DNA, 19 bp, Homo sapiens
caggaaaagctgctgacag

SEQ ID NO: 3760330 - DNA, 17 bp, Homo sapiens
caggaaaatcctctggc

SEQ ID NO: 3760331 - DNA, 23 bp, Homo sapiens
caggaaaattgtttgaacccagg

SEQ ID NO: 3760332 - DNA, 21 bp, Homo sapiens
caggaaagggaaggccccaca

SEQ ID NO: 3760333 - DNA, 13 bp, Homo sapiens
caggaaatatata

SEQ ID NO: 3760334 - DNA, 16 bp, Homo sapiens
caggaaatatatatgt

SEQ ID NO: 3760335 - DNA, 14 bp, Homo sapiens
caggaacagctatg

SEQ ID NO: 3760336 - DNA, 15 bp, Homo sapiens
caggaacctggacca

SEQ ID NO: 3760337 - DNA, 12 bp, Homo sapiens
caggaactgggc

SEQ ID NO: 3760338 - DNA, 14 bp, Homo sapiens
caggaagcacccca

SEQ ID NO: 3760339 - DNA, 12 bp, Homo sapiens
caggaagctcag

SEQ ID NO: 3760340 - DNA, 18 bp, Homo sapiens
caggaagctgctccgtgc

SEQ ID NO: 3760341 - DNA, 14 bp, Homo sapiens
caggaaggaagtca

SEQ ID NO: 3760342 - DNA, 13 bp, Homo sapiens
caggaaggagagc

SEQ ID NO: 3760343 - DNA, 15 bp, Homo sapiens
caggaaggagagcct

SEQ ID NO: 3760344 - DNA, 18 bp, Homo sapiens
caggaaggagagcctgct

SEQ ID NO: 3760345 - DNA, 18 bp, Homo sapiens
caggaaggatgagcattt

SEQ ID NO: 3760346 - DNA, 22 bp, Homo sapiens
caggaagggtcaaaacatttta

SEQ ID NO: 3760347 - DNA, 10 bp, Homo sapiens
caggaagtga

SEQ ID NO: 3760348 - DNA, 15 bp, Homo sapiens
caggacacggggcag

SEQ ID NO: 3760349 - DNA, 15 bp, Homo sapiens
caggacagcatggtg

SEQ ID NO: 3760350 - DNA, 12 bp, Homo sapiens
caggacaggacc

SEQ ID NO: 3760351 - DNA, 13 bp, Homo sapiens
caggacaggcccg

SEQ ID NO: 3760352 - DNA, 16 bp, Homo sapiens
caggacagtgcttcag

SEQ ID NO: 3760353 - DNA, 21 bp, Homo sapiens
caggacagtgcttcagcctga

SEQ ID NO: 3760354 - DNA, 22 bp, Homo sapiens
caggacagtgcttcagcctgag

SEQ ID NO: 3760355 - DNA, 22 bp, Homo sapiens
caggaccctcgctggcccccac

SEQ ID NO: 3760356 - DNA, 20 bp, Homo sapiens
caggacctcagagtccaggc

SEQ ID NO: 3760357 - DNA, 13 bp, Homo sapiens
caggacctcaggt

SEQ ID NO: 3760358 - DNA, 16 bp, Homo sapiens
caggactccagcccat

SEQ ID NO: 3760359 - DNA, 16 bp, Homo sapiens
caggactccctcctca

SEQ ID NO: 3760360 - DNA, 19 bp, Homo sapiens
caggactccctcctcacct

SEQ ID NO: 3760361 - DNA, 15 bp, Homo sapiens
caggactctgcctcc

SEQ ID NO: 3760362 - DNA, 11 bp, Homo sapiens
caggagaacca

SEQ ID NO: 3760363 - DNA, 15 bp, Homo sapiens
caggagagccagccc

SEQ ID NO: 3760364 - DNA, 23 bp, Homo sapiens
caggagagccagccctccctgtc

SEQ ID NO: 3760365 - DNA, 12 bp, Homo sapiens
caggagctcaga

SEQ ID NO: 3760366 - DNA, 15 bp, Homo sapiens
caggagctcttcagg

SEQ ID NO: 3760367 - DNA, 20 bp, Homo sapiens
caggagctcttcaggcctcc

SEQ ID NO: 3760368 - DNA, 14 bp, Homo sapiens
caggagctgggatc

SEQ ID NO: 3760369 - DNA, 12 bp, Homo sapiens
caggagctgggc

SEQ ID NO: 3760370 - DNA, 19 bp, Homo sapiens
caggaggactgccccgtgc

SEQ ID NO: 3760371 - DNA, 20 bp, Homo sapiens
caggaggcagaggttgcagt

SEQ ID NO: 3760372 - DNA, 15 bp, Homo sapiens
caggaggctgaggca

SEQ ID NO: 3760373 - DNA, 18 bp, Homo sapiens
caggaggctgaggcagaa

SEQ ID NO: 3760374 - DNA, 20 bp, Homo sapiens
caggaggctgaggcaggagg

SEQ ID NO: 3760375 - DNA, 13 bp, Homo sapiens
caggaggctggag

SEQ ID NO: 3760376 - DNA, 11 bp, Homo sapiens
caggagggagg

SEQ ID NO: 3760377 - DNA, 12 bp, Homo sapiens
caggagggaggg

SEQ ID NO: 3760378 - DNA, 19 bp, Homo sapiens
caggaggtggaggttgcag

SEQ ID NO: 3760379 - DNA, 20 bp, Homo sapiens
caggaggtggaggttgcagt

SEQ ID NO: 3760380 - DNA, 15 bp, Homo sapiens
caggagtcccaagga

SEQ ID NO: 3760381 - DNA, 17 bp, Homo sapiens
caggagtcccaaggaaa

SEQ ID NO: 3760382 - DNA, 19 bp, Homo sapiens
caggagttaaaaagggcag

SEQ ID NO: 3760383 - DNA, 17 bp, Homo sapiens
caggagttagaggccag

SEQ ID NO: 3760384 - DNA, 18 bp, Homo sapiens
caggagttagaggccagc

SEQ ID NO: 3760385 - DNA, 19 bp, Homo sapiens
caggagttagaggccagcc

SEQ ID NO: 3760386 - DNA, 20 bp, Homo sapiens
caggagttgtttctgaccca

SEQ ID NO: 3760387 - DNA, 21 bp, Homo sapiens
caggagtttaagaccagcctg

SEQ ID NO: 3760388 - DNA, 22 bp, Homo sapiens
caggagtttaagaccagcctgg

SEQ ID NO: 3760389 - DNA, 21 bp, Homo sapiens
caggagtttgaggctgcagcg

SEQ ID NO: 3760390 - DNA, 23 bp, Homo sapiens
caggatactctgtcagatgggaa

SEQ ID NO: 3760391 - DNA, 15 bp, Homo sapiens
caggatgaaagttcc

SEQ ID NO: 3760392 - DNA, 14 bp, Homo sapiens
caggatgcccaggg

SEQ ID NO: 3760393 - DNA, 24 bp, Homo sapiens
caggatgcccagggccactctgcc

SEQ ID NO: 3760394 - DNA, 21 bp, Homo sapiens
caggatggaggggtggtcctg

SEQ ID NO: 3760395 - DNA, 19 bp, Homo sapiens
caggcaactgaggcagaca

SEQ ID NO: 3760396 - DNA, 20 bp, Homo sapiens
caggcaactgaggcagacag

SEQ ID NO: 3760397 - DNA, 16 bp, Homo sapiens
caggcaagcacctcct

SEQ ID NO: 3760398 - DNA, 14 bp, Homo sapiens
caggcaatgctggc

SEQ ID NO: 3760399 - DNA, 15 bp, Homo sapiens
caggcaatgctggct

SEQ ID NO: 3760400 - DNA, 19 bp, Homo sapiens
caggcaatgctggctgttg

SEQ ID NO: 3760401 - DNA, 13 bp, Homo sapiens
caggcaccgagaa

SEQ ID NO: 3760402 - DNA, 16 bp, Homo sapiens
caggcacgaacccacc

SEQ ID NO: 3760403 - DNA, 17 bp, Homo sapiens
caggcactgctgcccag

SEQ ID NO: 3760404 - DNA, 23 bp, Homo sapiens
caggcactgctgcccagcctcca

SEQ ID NO: 3760405 - DNA, 12 bp, Homo sapiens
caggcagaaaga

SEQ ID NO: 3760406 - DNA, 14 bp, Homo sapiens
caggcagaaagagt

SEQ ID NO: 3760407 - DNA, 15 bp, Homo sapiens
caggcagagaatcat

SEQ ID NO: 3760408 - DNA, 13 bp, Homo sapiens
caggcagatctgt

SEQ ID NO: 3760409 - DNA, 18 bp, Homo sapiens
caggcagatctgtgcccc

SEQ ID NO: 3760410 - DNA, 19 bp, Homo sapiens
caggcagatctgtgcccca

SEQ ID NO: 3760411 - DNA, 22 bp, Homo sapiens
caggcagatctgtgccccatgc

SEQ ID NO: 3760412 - DNA, 19 bp, Homo sapiens
caggcaggaagggcaggaa

SEQ ID NO: 3760413 - DNA, 19 bp, Homo sapiens
caggcaggctgtgcgctga

SEQ ID NO: 3760414 - DNA, 14 bp, Homo sapiens
caggcaggtccagg

SEQ ID NO: 3760415 - DNA, 15 bp, Homo sapiens
caggcaggtccaggg

SEQ ID NO: 3760416 - DNA, 15 bp, Homo sapiens
caggcataggcctgg

SEQ ID NO: 3760417 - DNA, 16 bp, Homo sapiens
caggcataggcctggg

SEQ ID NO: 3760418 - DNA, 12 bp, Homo sapiens
caggcatcctcc

SEQ ID NO: 3760419 - DNA, 17 bp, Homo sapiens
caggcatggtggcccac

SEQ ID NO: 3760420 - DNA, 13 bp, Homo sapiens
caggccaacccca

SEQ ID NO: 3760421 - DNA, 23 bp, Homo sapiens
caggccaagagcagaggcagcga

SEQ ID NO: 3760422 - DNA, 18 bp, Homo sapiens
caggccacctgccccctt

SEQ ID NO: 3760423 - DNA, 15 bp, Homo sapiens
caggccagagggagt

SEQ ID NO: 3760424 - DNA, 16 bp, Homo sapiens
caggccagagggagtg

SEQ ID NO: 3760425 - DNA, 20 bp, Homo sapiens
cactcgtgtgcaacagacaa

SEQ ID NO: 3760426 - DNA, 17 bp, Homo sapiens
cactctaccctatacaa

SEQ ID NO: 3760427 - DNA, 17 bp, Homo sapiens
cactctcattccccagg

SEQ ID NO: 3760428 - DNA, 12 bp, Homo sapiens
cactctccccac

SEQ ID NO: 3760429 - DNA, 15 bp, Homo sapiens
cactctccccacact

SEQ ID NO: 3760430 - DNA, 23 bp, Homo sapiens
cactctcctgggcccctccctac

SEQ ID NO: 3760431 - DNA, 15 bp, Homo sapiens
cactctgcctctgcc

SEQ ID NO: 3760432 - DNA, 15 bp, Homo sapiens
cactctgtcgcccag

SEQ ID NO: 3760433 - DNA, 17 bp, Homo sapiens
cactcttattgcccacg

SEQ ID NO: 3760434 - DNA, 20 bp, Homo sapiens
cactcttattgcccacgctg

SEQ ID NO: 3760435 - DNA, 16 bp, Homo sapiens
cactgaagatagaaga

SEQ ID NO: 3760436 - DNA, 17 bp, Homo sapiens
cactgaagctgggattc

SEQ ID NO: 3760437 - DNA, 17 bp, Homo sapiens
cactgaagctttttagt

SEQ ID NO: 3760438 - DNA, 22 bp, Homo sapiens
cactgaaggctttcagggcctc

SEQ ID NO: 3760439 - DNA, 19 bp, Homo sapiens
cactgaagttaacagagac

SEQ ID NO: 3760440 - DNA, 14 bp, Homo sapiens
cactgaatatttat

SEQ ID NO: 3760441 - DNA, 20 bp, Homo sapiens
cactgacagcctcccacccc

SEQ ID NO: 3760442 - DNA, 13 bp, Homo sapiens
cactgactattac

SEQ ID NO: 3760443 - DNA, 14 bp, Homo sapiens
cactgaggcaggga

SEQ ID NO: 3760444 - DNA, 22 bp, Homo sapiens
cactgatctctactaccacaag

SEQ ID NO: 3760445 - DNA, 14 bp, Homo sapiens
cactgatgggcaac

SEQ ID NO: 3760446 - DNA, 16 bp, Homo sapiens
cactgatttggagata

SEQ ID NO: 3760447 - DNA, 13 bp, Homo sapiens
cactgcaacctcc

SEQ ID NO: 3760448 - DNA, 18 bp, Homo sapiens
cactgcacagtgcatctc

SEQ ID NO: 3760449 - DNA, 15 bp, Homo sapiens
cactgcaccgggcca

SEQ ID NO: 3760450 - DNA, 19 bp, Homo sapiens
cactgcaccgggccacaga

SEQ ID NO: 3760451 - DNA, 17 bp, Homo sapiens
cactgcactccagcctg

SEQ ID NO: 3760452 - DNA, 19 bp, Homo sapiens
cactgcactccagcctggg

SEQ ID NO: 3760453 - DNA, 20 bp, Homo sapiens
cactgcactccagcctgggc

SEQ ID NO: 3760454 - DNA, 13 bp, Homo sapiens
cactgcagcctca

SEQ ID NO: 3760455 - DNA, 14 bp, Homo sapiens
cactgcagcctcga

SEQ ID NO: 3760456 - DNA, 22 bp, Homo sapiens
cactgcagcctcgaactcctgg

SEQ ID NO: 3760457 - DNA, 16 bp, Homo sapiens
cactgcaggccccgct

SEQ ID NO: 3760458 - DNA, 22 bp, Homo sapiens
cactgccatggaggcacacagc

SEQ ID NO: 3760459 - DNA, 16 bp, Homo sapiens
cactgcccgagctggt

SEQ ID NO: 3760460 - DNA, 13 bp, Homo sapiens
cactgcccttctc

SEQ ID NO: 3760461 - DNA, 18 bp, Homo sapiens
cactgcctctccctggcc

SEQ ID NO: 3760462 - DNA, 20 bp, Homo sapiens
cactgccttcgatacaccgg

SEQ ID NO: 3760463 - DNA, 16 bp, Homo sapiens
cactgctaggtgggcc

SEQ ID NO: 3760464 - DNA, 12 bp, Homo sapiens
cactgctctggt

SEQ ID NO: 3760465 - DNA, 16 bp, Homo sapiens
cactgctgctgccttt

SEQ ID NO: 3760466 - DNA, 16 bp, Homo sapiens
cactggaccactgggc

SEQ ID NO: 3760467 - DNA, 16 bp, Homo sapiens
cactggagtccagtct

SEQ ID NO: 3760468 - DNA, 19 bp, Homo sapiens
cactggatgcaaagaaaat

SEQ ID NO: 3760469 - DNA, 22 bp, Homo sapiens
cactggcccctagaatcagcct

SEQ ID NO: 3760470 - DNA, 22 bp, Homo sapiens
cactggctgtcagtatgacatt

SEQ ID NO: 3760471 - DNA, 19 bp, Homo sapiens
cactggggtcctggggcct

SEQ ID NO: 3760472 - DNA, 20 bp, Homo sapiens
cactggggtcctggggcctc

SEQ ID NO: 3760473 - DNA, 15 bp, Homo sapiens
cactgggtggggtga

SEQ ID NO: 3760474 - DNA, 15 bp, Homo sapiens
cactgggttgacttt

SEQ ID NO: 3760475 - DNA, 22 bp, Homo sapiens
cactggtggcccgacagcctgg

SEQ ID NO: 3760476 - DNA, 16 bp, Homo sapiens
cactgtaaaatgaaat

SEQ ID NO: 3760477 - DNA, 22 bp, Homo sapiens
cactgtagtaaatggcaattct

SEQ ID NO: 3760478 - DNA, 16 bp, Homo sapiens
cactgtatgctggacg

SEQ ID NO: 3760479 - DNA, 23 bp, Homo sapiens
cactgtattacataaataaatta

SEQ ID NO: 3760480 - DNA, 16 bp, Homo sapiens
cactgtgaccttgact

SEQ ID NO: 3760481 - DNA, 14 bp, Homo sapiens
cactgtgccatgtg

SEQ ID NO: 3760482 - DNA, 18 bp, Homo sapiens
cactgtgccatgtgccag

SEQ ID NO: 3760483 - DNA, 17 bp, Homo sapiens
cactgttagaacactat

SEQ ID NO: 3760484 - DNA, 18 bp, Homo sapiens
cactgttgcccaggctgg

SEQ ID NO: 3760485 - DNA, 19 bp, Homo sapiens
cactgttgcccaggctggc

SEQ ID NO: 3760486 - DNA, 16 bp, Homo sapiens
cacttaaaaaatgtcc

SEQ ID NO: 3760487 - DNA, 15 bp, Homo sapiens
cacttaaatatcaat

SEQ ID NO: 3760488 - DNA, 21 bp, Homo sapiens
cacttaagactgtgtattcta

SEQ ID NO: 3760489 - DNA, 18 bp, Homo sapiens
cacttaccttcaataaag

SEQ ID NO: 3760490 - DNA, 21 bp, Homo sapiens
cacttaccttcaataaagtat

SEQ ID NO: 3760491 - DNA, 19 bp, Homo sapiens
cacttagaaattgcatttc

SEQ ID NO: 3760492 - DNA, 20 bp, Homo sapiens
cacttagaaattgcatttcc

SEQ ID NO: 3760493 - DNA, 20 bp, Homo sapiens
cacttattccccattcttcc

SEQ ID NO: 3760494 - DNA, 13 bp, Homo sapiens
cacttattgcttt

SEQ ID NO: 3760495 - DNA, 18 bp, Homo sapiens
cacttcacacacaggcaa

SEQ ID NO: 3760496 - DNA, 13 bp, Homo sapiens
cacttcagagagc

SEQ ID NO: 3760497 - DNA, 16 bp, Homo sapiens
cacttcagagagctgg

SEQ ID NO: 3760498 - DNA, 21 bp, Homo sapiens
cacttcagctgacttttctgt

SEQ ID NO: 3760499 - DNA, 23 bp, Homo sapiens
cacttcaggctcttctcctttca

SEQ ID NO: 3760500 - DNA, 19 bp, Homo sapiens
cacttccaccagcctgcac

SEQ ID NO: 3760501 - DNA, 16 bp, Homo sapiens
cacttccctacatgga

SEQ ID NO: 3760502 - DNA, 13 bp, Homo sapiens
cacttcctgtcca

SEQ ID NO: 3760503 - DNA, 23 bp, Homo sapiens
cacttcgggaggtcgaggcagga

SEQ ID NO: 3760504 - DNA, 17 bp, Homo sapiens
cacttctaaatagcaat

SEQ ID NO: 3760505 - DNA, 20 bp, Homo sapiens
cacttctgtgagacccccac

SEQ ID NO: 3760506 - DNA, 15 bp, Homo sapiens
cacttcttttataac

SEQ ID NO: 3760507 - DNA, 20 bp, Homo sapiens
cacttgagaattaccctttt

SEQ ID NO: 3760508 - DNA, 22 bp, Homo sapiens
cacttgaggtcaggagttccta

SEQ ID NO: 3760509 - DNA, 13 bp, Homo sapiens
cacttgagtccag

SEQ ID NO: 3760510 - DNA, 13 bp, Homo sapiens
cacttgcagactc

SEQ ID NO: 3760511 - DNA, 22 bp, Homo sapiens
cacttgcagactctacagaggc

SEQ ID NO: 3760512 - DNA, 18 bp, Homo sapiens
cacttgcagtggaagata

SEQ ID NO: 3760513 - DNA, 22 bp, Homo sapiens
cacttgcggatattctggactg

SEQ ID NO: 3760514 - DNA, 16 bp, Homo sapiens
cacttggcctctggat

SEQ ID NO: 3760515 - DNA, 12 bp, Homo sapiens
cacttgtacaaa

SEQ ID NO: 3760516 - DNA, 13 bp, Homo sapiens
cacttgtgtgtgg

SEQ ID NO: 3760517 - DNA, 17 bp, Homo sapiens
cactttcagtgaaagca

SEQ ID NO: 3760518 - DNA, 18 bp, Homo sapiens
cactttcagtgaaagcat

SEQ ID NO: 3760519 - DNA, 19 bp, Homo sapiens
cactttcagtgaaagcatc

SEQ ID NO: 3760520 - DNA, 17 bp, Homo sapiens
cactttcattgccagtg

SEQ ID NO: 3760521 - DNA, 22 bp, Homo sapiens
cactttccccgtgggccatggc

SEQ ID NO: 3760522 - DNA, 13 bp, Homo sapiens
cactttgggaggc

SEQ ID NO: 3760523 - DNA, 20 bp, Homo sapiens
cactttggtacatggccagt

SEQ ID NO: 3760524 - DNA, 19 bp, Homo sapiens
cagaaaaactctgggaaat

SEQ ID NO: 3760525 - DNA, 19 bp, Homo sapiens
cagaaaacaacaaaaaata

SEQ ID NO: 3760526 - DNA, 16 bp, Homo sapiens
cagaaaacagaaaaaa

SEQ ID NO: 3760527 - DNA, 17 bp, Homo sapiens
cagaaaacagaaaaaaa

SEQ ID NO: 3760528 - DNA, 19 bp, Homo sapiens
cagaaaacggttaaaactg

SEQ ID NO: 3760529 - DNA, 20 bp, Homo sapiens
cagaaaacggttaaaactgt

SEQ ID NO: 3760530 - DNA, 13 bp, Homo sapiens
cagaaaactagaa

SEQ ID NO: 3760531 - DNA, 14 bp, Homo sapiens
cagaaaagcacctg

SEQ ID NO: 3760532 - DNA, 16 bp, Homo sapiens
cagaaaagcacctgcc

SEQ ID NO: 3760533 - DNA, 17 bp, Homo sapiens
cagaaaagcacctgccg

SEQ ID NO: 3760534 - DNA, 22 bp, Homo sapiens
cagaaacatcagttactctgaa

SEQ ID NO: 3760535 - DNA, 13 bp, Homo sapiens
cagaaaccagtta

SEQ ID NO: 3760536 - DNA, 15 bp, Homo sapiens
cagaaaccagttatg

SEQ ID NO: 3760537 - DNA, 20 bp, Homo sapiens
cagaaacttgtgaagtggaa

SEQ ID NO: 3760538 - DNA, 11 bp, Homo sapiens
cagaaagagtt

SEQ ID NO: 3760539 - DNA, 12 bp, Homo sapiens
cagaaaggagac

SEQ ID NO: 3760540 - DNA, 22 bp, Homo sapiens
cagaaaggatatttaagaaaat

SEQ ID NO: 3760541 - DNA, 22 bp, Homo sapiens
cagaaagggagcagagaaggcc

SEQ ID NO: 3760542 - DNA, 23 bp, Homo sapiens
cagaaagtggccatgccaccctg

SEQ ID NO: 3760543 - DNA, 15 bp, Homo sapiens
cagaaatatgtggtt

SEQ ID NO: 3760544 - DNA, 21 bp, Homo sapiens
cagaacagcagaggttctttt

SEQ ID NO: 3760545 - DNA, 12 bp, Homo sapiens
cagaacagccgc

SEQ ID NO: 3760546 - DNA, 22 bp, Homo sapiens
cagaacccttggagccaatgga

SEQ ID NO: 3760547 - DNA, 12 bp, Homo sapiens
cagaacctcttc

SEQ ID NO: 3760548 - DNA, 14 bp, Homo sapiens
cagaacctgtcctt

SEQ ID NO: 3760549 - DNA, 17 bp, Homo sapiens
cagaactgagctcctct

SEQ ID NO: 3760550 - DNA, 23 bp, Homo sapiens
cagaactgagctcctctgggcag

SEQ ID NO: 3760551 - DNA, 24 bp, Homo sapiens
cagaactgagctcctctgggcagg

SEQ ID NO: 3760552 - DNA, 13 bp, Homo sapiens
cagaactggactc

SEQ ID NO: 3760553 - DNA, 17 bp, Homo sapiens
cagaagaattgaaccca

SEQ ID NO: 3760554 - DNA, 19 bp, Homo sapiens
cagaagaattgaacccagg

SEQ ID NO: 3760555 - DNA, 20 bp, Homo sapiens
cagaagaattgaacccagga

SEQ ID NO: 3760556 - DNA, 22 bp, Homo sapiens
cagaagaattgaacccaggagg

SEQ ID NO: 3760557 - DNA, 18 bp, Homo sapiens
cagaagacttcccagctt

SEQ ID NO: 3760558 - DNA, 21 bp, Homo sapiens
cagaagagatgggcttgtttt

SEQ ID NO: 3760559 - DNA, 15 bp, Homo sapiens
cagaagcctctggct

SEQ ID NO: 3760560 - DNA, 19 bp, Homo sapiens
cagaagcctctggctagag

SEQ ID NO: 3760561 - DNA, 14 bp, Homo sapiens
cagaagcctgaggc

SEQ ID NO: 3760562 - DNA, 15 bp, Homo sapiens
cagaagcctgaggct

SEQ ID NO: 3760563 - DNA, 18 bp, Homo sapiens
cagaaggagaaggaagga

SEQ ID NO: 3760564 - DNA, 20 bp, Homo sapiens
cagaaggagaaggaaggaga

SEQ ID NO: 3760565 - DNA, 13 bp, Homo sapiens
cagaaggccaaga

SEQ ID NO: 3760566 - DNA, 15 bp, Homo sapiens
cagaagggaaacagt

SEQ ID NO: 3760567 - DNA, 18 bp, Homo sapiens
cagaagggggccatgagg

SEQ ID NO: 3760568 - DNA, 23 bp, Homo sapiens
cagaaggtgggggttggctgggt

SEQ ID NO: 3760569 - DNA, 16 bp, Homo sapiens
cagaaggttgtgatga

SEQ ID NO: 3760570 - DNA, 20 bp, Homo sapiens
cagaagtcactcaattgttt

SEQ ID NO: 3760571 - DNA, 16 bp, Homo sapiens
cagaagtcatgaagcc

SEQ ID NO: 3760572 - DNA, 18 bp, Homo sapiens
cagaagtcatgaagccca

SEQ ID NO: 3760573 - DNA, 19 bp, Homo sapiens
cagaagtcatgaagcccaa

SEQ ID NO: 3760574 - DNA, 19 bp, Homo sapiens
cagaagtttgtcaagtcaa

SEQ ID NO: 3760575 - DNA, 23 bp, Homo sapiens
cagaataatgaatggactcaaac

SEQ ID NO: 3760576 - DNA, 15 bp, Homo sapiens
cagaatcattgctta

SEQ ID NO: 3760577 - DNA, 20 bp, Homo sapiens
cagaatcattgcttatgaca

SEQ ID NO: 3760578 - DNA, 14 bp, Homo sapiens
cagaatctgaatgt

SEQ ID NO: 3760579 - DNA, 13 bp, Homo sapiens
cagaatgtcagat

SEQ ID NO: 3760580 - DNA, 11 bp, Homo sapiens
cagaattctca

SEQ ID NO: 3760581 - DNA, 14 bp, Homo sapiens
cagaattctgctac

SEQ ID NO: 3760582 - DNA, 19 bp, Homo sapiens
cagacaaaaacagcctcac

SEQ ID NO: 3760583 - DNA, 17 bp, Homo sapiens
cagacaaaccagaagca

SEQ ID NO: 3760584 - DNA, 16 bp, Homo sapiens
cagacaacagaagtca

SEQ ID NO: 3760585 - DNA, 12 bp, Homo sapiens
cagacacacaca

SEQ ID NO: 3760586 - DNA, 15 bp, Homo sapiens
cagacacaggcccgg

SEQ ID NO: 3760587 - DNA, 18 bp, Homo sapiens
cagacacaggcccggctc

SEQ ID NO: 3760588 - DNA, 19 bp, Homo sapiens
cagacaccttgacagggca

SEQ ID NO: 3760589 - DNA, 22 bp, Homo sapiens
cagacaccttgacagggcacac

SEQ ID NO: 3760590 - DNA, 19 bp, Homo sapiens
cagacactttggaagtttg

SEQ ID NO: 3760591 - DNA, 21 bp, Homo sapiens
cagacacttttttgagtggat

SEQ ID NO: 3760592 - DNA, 21 bp, Homo sapiens
cagacagcaacggggaggcca

SEQ ID NO: 3760593 - DNA, 15 bp, Homo sapiens
cagacagcagctcag

SEQ ID NO: 3760594 - DNA, 16 bp, Homo sapiens
cagacagcagctcagg

SEQ ID NO: 3760595 - DNA, 13 bp, Homo sapiens
cagacaggagaaa

SEQ ID NO: 3760596 - DNA, 16 bp, Homo sapiens
cagacattctgccagg

SEQ ID NO: 3760597 - DNA, 17 bp, Homo sapiens
cagacatttttttccct

SEQ ID NO: 3760598 - DNA, 12 bp, Homo sapiens
cagaccccagcg

SEQ ID NO: 3760599 - DNA, 18 bp, Homo sapiens
cagacccccaccccttcc

SEQ ID NO: 3760600 - DNA, 13 bp, Homo sapiens
cagacccccactc

SEQ ID NO: 3760601 - DNA, 18 bp, Homo sapiens
cagacccctctggccagg

SEQ ID NO: 3760602 - DNA, 22 bp, Homo sapiens
cagacccctggcttttcactgc

SEQ ID NO: 3760603 - DNA, 16 bp, Homo sapiens
cagacccggctgcgtg

SEQ ID NO: 3760604 - DNA, 18 bp, Homo sapiens
cagaccctaccccaccac

SEQ ID NO: 3760605 - DNA, 13 bp, Homo sapiens
cagacctgtcttc

SEQ ID NO: 3760606 - DNA, 13 bp, Homo sapiens
cagaccttttatc

SEQ ID NO: 3760607 - DNA, 17 bp, Homo sapiens
cagacggttcaccagcc

SEQ ID NO: 3760608 - DNA, 15 bp, Homo sapiens
cagacgtccctccac

SEQ ID NO: 3760609 - DNA, 16 bp, Homo sapiens
cagactcagtttgtca

SEQ ID NO: 3760610 - DNA, 17 bp, Homo sapiens
cagactcagtttgtcag

SEQ ID NO: 3760611 - DNA, 18 bp, Homo sapiens
cagactcagtttgtcaga

SEQ ID NO: 3760612 - DNA, 16 bp, Homo sapiens
cagactcatacagaag

SEQ ID NO: 3760613 - DNA, 18 bp, Homo sapiens
cagactgcgatttgtccc

SEQ ID NO: 3760614 - DNA, 13 bp, Homo sapiens
cagactgctggga

SEQ ID NO: 3760615 - DNA, 16 bp, Homo sapiens
cagactgctgggactg

SEQ ID NO: 3760616 - DNA, 14 bp, Homo sapiens
cagactggaagcac

SEQ ID NO: 3760617 - DNA, 18 bp, Homo sapiens
cagactggaagcacagct

SEQ ID NO: 3760618 - DNA, 20 bp, Homo sapiens
cagactggaagcacagcttc

SEQ ID NO: 3760619 - DNA, 21 bp, Homo sapiens
cagactggaagcacagcttca

SEQ ID NO: 3760620 - DNA, 12 bp, Homo sapiens
cagactggaggg

SEQ ID NO: 3760621 - DNA, 19 bp, Homo sapiens
cagactggatagtccgtct

SEQ ID NO: 3760622 - DNA, 14 bp, Homo sapiens
cagacttcacactg

SEQ ID NO: 3760623 - DNA, 15 bp, Homo sapiens
cagacttcacactgc

SEQ ID NO: 3760624 - DNA, 21 bp, Homo sapiens
cagacttccctgaatgtattg

SEQ ID NO: 3760625 - DNA, 14 bp, Homo sapiens
cagacttctccaga

SEQ ID NO: 3760626 - DNA, 13 bp, Homo sapiens
cagagaaggcagg

SEQ ID NO: 3760627 - DNA, 20 bp, Homo sapiens
cagagaaggcaggaatgtgt

SEQ ID NO: 3760628 - DNA, 19 bp, Homo sapiens
cagagaatgaaagggccca

SEQ ID NO: 3760629 - DNA, 20 bp, Homo sapiens
cagagaatgaaagggcccag

SEQ ID NO: 3760630 - DNA, 21 bp, Homo sapiens
cagagaattgctgattcttga

SEQ ID NO: 3760631 - DNA, 22 bp, Homo sapiens
cagagaatttctaccatttcag

SEQ ID NO: 3760632 - DNA, 15 bp, Homo sapiens
cagagacacctgcac

SEQ ID NO: 3760633 - DNA, 18 bp, Homo sapiens
cagagacacctgcacctc

SEQ ID NO: 3760634 - DNA, 20 bp, Homo sapiens
cagagacacctgcacctccc

SEQ ID NO: 3760635 - DNA, 22 bp, Homo sapiens
cagagacacctgcacctccccc

SEQ ID NO: 3760636 - DNA, 15 bp, Homo sapiens
cagagacaggaaaat

SEQ ID NO: 3760637 - DNA, 14 bp, Homo sapiens
cagagacgcaggaa

SEQ ID NO: 3760638 - DNA, 19 bp, Homo sapiens
cagagactcagggccccag

SEQ ID NO: 3760639 - DNA, 21 bp, Homo sapiens
cagagactcagggccccagca

SEQ ID NO: 3760640 - DNA, 22 bp, Homo sapiens
cagagactcagggccccagcac

SEQ ID NO: 3760641 - DNA, 11 bp, Homo sapiens
cagagagaaac

SEQ ID NO: 3760642 - DNA, 16 bp, Homo sapiens
cagagagaatggcttt

SEQ ID NO: 3760643 - DNA, 17 bp, Homo sapiens
cagagagacagacttga

SEQ ID NO: 3760644 - DNA, 18 bp, Homo sapiens
cagagagacagacttgag

SEQ ID NO: 3760645 - DNA, 22 bp, Homo sapiens
cagagagacagacttgagaact

SEQ ID NO: 3760646 - DNA, 20 bp, Homo sapiens
cagagagcctggtgctgctg

SEQ ID NO: 3760647 - DNA, 19 bp, Homo sapiens
cagagagctggtagttagt

SEQ ID NO: 3760648 - DNA, 16 bp, Homo sapiens
cagagaggacgtgggc

SEQ ID NO: 3760649 - DNA, 20 bp, Homo sapiens
cagagaggagtcagagagaa

SEQ ID NO: 3760650 - DNA, 20 bp, Homo sapiens
cagagaggccttttggaatg

SEQ ID NO: 3760651 - DNA, 20 bp, Homo sapiens
cagagagggggccacctccc

SEQ ID NO: 3760652 - DNA, 18 bp, Homo sapiens
cagagagtggctcctccc

SEQ ID NO: 3760653 - DNA, 16 bp, Homo sapiens
cagagataaagacctt

SEQ ID NO: 3760654 - DNA, 15 bp, Homo sapiens
cagagataggcctgt

SEQ ID NO: 3760655 - DNA, 13 bp, Homo sapiens
cagagatgcctcc

SEQ ID NO: 3760656 - DNA, 16 bp, Homo sapiens
cagagatgcctccacc

SEQ ID NO: 3760657 - DNA, 18 bp, Homo sapiens
cagagatgcctccaccgc

SEQ ID NO: 3760658 - DNA, 15 bp, Homo sapiens
cagagatgggactgg

SEQ ID NO: 3760659 - DNA, 22 bp, Homo sapiens
cagagatgggactgggagggcc

SEQ ID NO: 3760660 - DNA, 20 bp, Homo sapiens
cagagcaagatcctgtcttt

SEQ ID NO: 3760661 - DNA, 16 bp, Homo sapiens
cagagcaagctttttt

SEQ ID NO: 3760662 - DNA, 14 bp, Homo sapiens
cagagcaagtgaga

SEQ ID NO: 3760663 - DNA, 16 bp, Homo sapiens
cagagccccacacgga

SEQ ID NO: 3760664 - DNA, 20 bp, Homo sapiens
cagagccccacacggaggca

SEQ ID NO: 3760665 - DNA, 12 bp, Homo sapiens
cagagcctgcag

SEQ ID NO: 3760666 - DNA, 19 bp, Homo sapiens
cagagcgtccttccccctg

SEQ ID NO: 3760667 - DNA, 21 bp, Homo sapiens
cagagctctggagccacctgt

SEQ ID NO: 3760668 - DNA, 9 bp, Homo sapiens
cagagctgg

SEQ ID NO: 3760669 - DNA, 15 bp, Homo sapiens
cagaggaagagcagg

SEQ ID NO: 3760670 - DNA, 16 bp, Homo sapiens
cagaggagagacggtg

SEQ ID NO: 3760671 - DNA, 16 bp, Homo sapiens
cagaggcacagccggg

SEQ ID NO: 3760672 - DNA, 13 bp, Homo sapiens
cagaggcagcccc

SEQ ID NO: 3760673 - DNA, 15 bp, Homo sapiens
cagaggcagccccat

SEQ ID NO: 3760674 - DNA, 22 bp, Homo sapiens
cagaggcagccccattctgcct

SEQ ID NO: 3760675 - DNA, 23 bp, Homo sapiens
cagaggcagccccattctgcctg

SEQ ID NO: 3760676 - DNA, 23 bp, Homo sapiens
cagaggcctagtcagccacatgg

SEQ ID NO: 3760677 - DNA, 13 bp, Homo sapiens
cagaggctgaggt

SEQ ID NO: 3760678 - DNA, 13 bp, Homo sapiens
cagaggctgcctc

SEQ ID NO: 3760679 - DNA, 17 bp, Homo sapiens
cagaggctggaggcagg

SEQ ID NO: 3760680 - DNA, 18 bp, Homo sapiens
cagaggctggaggcaggg

SEQ ID NO: 3760681 - DNA, 15 bp, Homo sapiens
cagaggctggcctca

SEQ ID NO: 3760682 - DNA, 16 bp, Homo sapiens
cagaggcttcttcaga

SEQ ID NO: 3760683 - DNA, 19 bp, Homo sapiens
cagagggaagaaaagagct

SEQ ID NO: 3760684 - DNA, 20 bp, Homo sapiens
cagagggagtgacagaggca

SEQ ID NO: 3760685 - DNA, 21 bp, Homo sapiens
cagagggagtgacagaggcag

SEQ ID NO: 3760686 - DNA, 15 bp, Homo sapiens
cagagggcccaggca

SEQ ID NO: 3760687 - DNA, 16 bp, Homo sapiens
cagagggcccaggcag

SEQ ID NO: 3760688 - DNA, 22 bp, Homo sapiens
cagagggcccaggcaggccacc

SEQ ID NO: 3760689 - DNA, 23 bp, Homo sapiens
cagaggggaaaccagtgtagcct

SEQ ID NO: 3760690 - DNA, 18 bp, Homo sapiens
cagaggggctttctggag

SEQ ID NO: 3760691 - DNA, 19 bp, Homo sapiens
cagaggggctttctggaga

SEQ ID NO: 3760692 - DNA, 17 bp, Homo sapiens
cagaggttgcagtgtgg

SEQ ID NO: 3760693 - DNA, 17 bp, Homo sapiens
cagagtaagctgctttt

SEQ ID NO: 3760694 - DNA, 20 bp, Homo sapiens
cagagtatttgaaaaatgta

SEQ ID NO: 3760695 - DNA, 15 bp, Homo sapiens
cagagtcagcagaac

SEQ ID NO: 3760696 - DNA, 18 bp, Homo sapiens
cagagtcggaacggagaa

SEQ ID NO: 3760697 - DNA, 23 bp, Homo sapiens
cagagtcggaacggagaaaggtg

SEQ ID NO: 3760698 - DNA, 13 bp, Homo sapiens
cagagtctcactg

SEQ ID NO: 3760699 - DNA, 20 bp, Homo sapiens
cagagtctcactgttgccca

SEQ ID NO: 3760700 - DNA, 21 bp, Homo sapiens
cagagtctcactgttgcccag

SEQ ID NO: 3760701 - DNA, 22 bp, Homo sapiens
cagagtctcactgttgcccagg

SEQ ID NO: 3760702 - DNA, 19 bp, Homo sapiens
cagagtgagaccctgtctc

SEQ ID NO: 3760703 - DNA, 20 bp, Homo sapiens
cagagtgagaccctgtctct

SEQ ID NO: 3760704 - DNA, 16 bp, Homo sapiens
cagagtgagactctgt

SEQ ID NO: 3760705 - DNA, 18 bp, Homo sapiens
cagagtgagactctgtct

SEQ ID NO: 3760706 - DNA, 14 bp, Homo sapiens
cagagtgccccacc

SEQ ID NO: 3760707 - DNA, 21 bp, Homo sapiens
cagagtgccccacctgccact

SEQ ID NO: 3760708 - DNA, 21 bp, Homo sapiens
cagagtggcctggccaggagc

SEQ ID NO: 3760709 - DNA, 22 bp, Homo sapiens
cagagtggtctttctggagagg

SEQ ID NO: 3760710 - DNA, 20 bp, Homo sapiens
cagagtgtgggaagggagag

SEQ ID NO: 3760711 - DNA, 23 bp, Homo sapiens
cagagttgtgcacatggcttagt

SEQ ID NO: 3760712 - DNA, 23 bp, Homo sapiens
cagagtttagaggaaaaaaatga

SEQ ID NO: 3760713 - DNA, 19 bp, Homo sapiens
cagataagaatgctggttt

SEQ ID NO: 3760714 - DNA, 19 bp, Homo sapiens
cagataatcagcctcttaa

SEQ ID NO: 3760715 - DNA, 23 bp, Homo sapiens
cagataatgcccagacatttttt

SEQ ID NO: 3760716 - DNA, 21 bp, Homo sapiens
cagatacaggaaaagctgctg

SEQ ID NO: 3760717 - DNA, 21 bp, Homo sapiens
cagatactggaagttttgcat

SEQ ID NO: 3760718 - DNA, 19 bp, Homo sapiens
cagatagatatatgctctg

SEQ ID NO: 3760719 - DNA, 14 bp, Homo sapiens
cagatatatttttc

SEQ ID NO: 3760720 - DNA, 19 bp, Homo sapiens
cagatatatttttcacagt

SEQ ID NO: 3760721 - DNA, 12 bp, Homo sapiens
cagatatttata

SEQ ID NO: 3760722 - DNA, 20 bp, Homo sapiens
cagatatttatatttttatt

SEQ ID NO: 3760723 - DNA, 22 bp, Homo sapiens
cagatatttatatttttatttt

SEQ ID NO: 3760724 - DNA, 23 bp, Homo sapiens
cagatcatagatttctgatttta

SEQ ID NO: 3760725 - DNA, 22 bp, Homo sapiens
cagatcccagaaggacctcctg

SEQ ID NO: 3760726 - DNA, 14 bp, Homo sapiens
cagatcccagctca

SEQ ID NO: 3760727 - DNA, 15 bp, Homo sapiens
cagatcccagctcac

SEQ ID NO: 3760728 - DNA, 12 bp, Homo sapiens
cagatcctaccc

SEQ ID NO: 3760729 - DNA, 14 bp, Homo sapiens
cagatctccaaagc

SEQ ID NO: 3760730 - DNA, 13 bp, Homo sapiens
cagatctgcaccg

SEQ ID NO: 3760731 - DNA, 18 bp, Homo sapiens
cagatctggtcccttgca

SEQ ID NO: 3760732 - DNA, 16 bp, Homo sapiens
cagatgcaaagaggca

SEQ ID NO: 3760733 - DNA, 17 bp, Homo sapiens
cagatgcaaagaggcaa

SEQ ID NO: 3760734 - DNA, 23 bp, Homo sapiens
cagatgcaaagaggcaagaggct

SEQ ID NO: 3760735 - DNA, 14 bp, Homo sapiens
cagatgcaccagcc

SEQ ID NO: 3760736 - DNA, 16 bp, Homo sapiens
cagatgcaccagccct

SEQ ID NO: 3760737 - DNA, 13 bp, Homo sapiens
cagatgccagagc

SEQ ID NO: 3760738 - DNA, 19 bp, Homo sapiens
cagatgcccagagggccca

SEQ ID NO: 3760739 - DNA, 20 bp, Homo sapiens
cagatgcccagagggcccag

SEQ ID NO: 3760740 - DNA, 22 bp, Homo sapiens
cagatgcccagagggcccaggc

SEQ ID NO: 3760741 - DNA, 16 bp, Homo sapiens
cagatgccccagagct

SEQ ID NO: 3760742 - DNA, 14 bp, Homo sapiens
cagatgcctccacc

SEQ ID NO: 3760743 - DNA, 13 bp, Homo sapiens
cagatgcttctgg

SEQ ID NO: 3760744 - DNA, 21 bp, Homo sapiens
cagatggaaccgcaggaagct

SEQ ID NO: 3760745 - DNA, 21 bp, Homo sapiens
cagatggatttgcctgtgcca

SEQ ID NO: 3760746 - DNA, 23 bp, Homo sapiens
cagatgttgaatgcccacaggca

SEQ ID NO: 3760747 - DNA, 23 bp, Homo sapiens
cagattccaggcgatgtgcaagt

SEQ ID NO: 3760748 - DNA, 14 bp, Homo sapiens
cagattcccagagc

SEQ ID NO: 3760749 - DNA, 13 bp, Homo sapiens
cagattgcctcct

SEQ ID NO: 3760750 - DNA, 19 bp, Homo sapiens
cagatttgaactcttcaat

SEQ ID NO: 3760751 - DNA, 23 bp, Homo sapiens
cagatttgaagacaaaaatactc

SEQ ID NO: 3760752 - DNA, 18 bp, Homo sapiens
cagattttacaaaagatg

SEQ ID NO: 3760753 - DNA, 19 bp, Homo sapiens
cagattttacaaaagatgt

SEQ ID NO: 3760754 - DNA, 15 bp, Homo sapiens
cagcaaaactccatc

SEQ ID NO: 3760755 - DNA, 14 bp, Homo sapiens
cagcaacacaatgt

SEQ ID NO: 3760756 - DNA, 16 bp, Homo sapiens
cagcaaccagagcact

SEQ ID NO: 3760757 - DNA, 17 bp, Homo sapiens
cagcaaccagagcactg

SEQ ID NO: 3760758 - DNA, 20 bp, Homo sapiens
cagcaaccagagcactgtat

SEQ ID NO: 3760759 - DNA, 14 bp, Homo sapiens
cagcaaccctccta

SEQ ID NO: 3760760 - DNA, 20 bp, Homo sapiens
cagcaacggggaggccaagt

SEQ ID NO: 3760761 - DNA, 14 bp, Homo sapiens
cagcaactccaact

SEQ ID NO: 3760762 - DNA, 19 bp, Homo sapiens
cagcaacttgtctttttct

SEQ ID NO: 3760763 - DNA, 12 bp, Homo sapiens
cagcaaggggct

SEQ ID NO: 3760764 - DNA, 15 bp, Homo sapiens
cagcaaggtggagtg

SEQ ID NO: 3760765 - DNA, 15 bp, Homo sapiens
cagcaagtgagagct

SEQ ID NO: 3760766 - DNA, 19 bp, Homo sapiens
cagcaagtgagagctgggt

SEQ ID NO: 3760767 - DNA, 17 bp, Homo sapiens
cagcaatatttaaggag

SEQ ID NO: 3760768 - DNA, 21 bp, Homo sapiens
cacctgccgacctcgtcctcc

SEQ ID NO: 3760769 - DNA, 17 bp, Homo sapiens
cacctgctgatgtggca

SEQ ID NO: 3760770 - DNA, 13 bp, Homo sapiens
cacctgctggccc

SEQ ID NO: 3760771 - DNA, 15 bp, Homo sapiens
cacctgctggcccct

SEQ ID NO: 3760772 - DNA, 20 bp, Homo sapiens
cacctgctggcccctcacct

SEQ ID NO: 3760773 - DNA, 20 bp, Homo sapiens
cacctggccccatgtctctc

SEQ ID NO: 3760774 - DNA, 11 bp, Homo sapiens
cacctggccct

SEQ ID NO: 3760775 - DNA, 16 bp, Homo sapiens
cacctggccctggggc

SEQ ID NO: 3760776 - DNA, 19 bp, Homo sapiens
cacctggccctggggcctg

SEQ ID NO: 3760777 - DNA, 11 bp, Homo sapiens
cacctgggcac

SEQ ID NO: 3760778 - DNA, 19 bp, Homo sapiens
cacctgggcacctggggag

SEQ ID NO: 3760779 - DNA, 15 bp, Homo sapiens
cacctggggagtggg

SEQ ID NO: 3760780 - DNA, 23 bp, Homo sapiens
cacctggggcagtcacctgccca

SEQ ID NO: 3760781 - DNA, 15 bp, Homo sapiens
cacctggtggcctct

SEQ ID NO: 3760782 - DNA, 17 bp, Homo sapiens
cacctggtggcctctgc

SEQ ID NO: 3760783 - DNA, 15 bp, Homo sapiens
cacctgtaaaacttt

SEQ ID NO: 3760784 - DNA, 23 bp, Homo sapiens
cacctgtaaaactttattttata

SEQ ID NO: 3760785 - DNA, 18 bp, Homo sapiens
cacctgtaatcccagcac

SEQ ID NO: 3760786 - DNA, 15 bp, Homo sapiens
cacctgtactcagga

SEQ ID NO: 3760787 - DNA, 14 bp, Homo sapiens
cacctgtactggag

SEQ ID NO: 3760788 - DNA, 19 bp, Homo sapiens
cacctgtagtcccagctac

SEQ ID NO: 3760789 - DNA, 15 bp, Homo sapiens
cacctgtcgcccagt

SEQ ID NO: 3760790 - DNA, 15 bp, Homo sapiens
cacctgtctcagcct

SEQ ID NO: 3760791 - DNA, 17 bp, Homo sapiens
cacctgtctcagcctcc

SEQ ID NO: 3760792 - DNA, 18 bp, Homo sapiens
cacctgtctcagcctccc

SEQ ID NO: 3760793 - DNA, 20 bp, Homo sapiens
cacctgtgagtttaaagcaa

SEQ ID NO: 3760794 - DNA, 20 bp, Homo sapiens
cacctgtttttaagctgttt

SEQ ID NO: 3760795 - DNA, 13 bp, Homo sapiens
caccttaggcagg

SEQ ID NO: 3760796 - DNA, 17 bp, Homo sapiens
caccttcaattcctggg

SEQ ID NO: 3760797 - DNA, 13 bp, Homo sapiens
caccttcccagct

SEQ ID NO: 3760798 - DNA, 15 bp, Homo sapiens
caccttcccagctct

SEQ ID NO: 3760799 - DNA, 14 bp, Homo sapiens
caccttcccatgcc

SEQ ID NO: 3760800 - DNA, 22 bp, Homo sapiens
caccttgaagaacctctcactt

SEQ ID NO: 3760801 - DNA, 13 bp, Homo sapiens
caccttgacaggg

SEQ ID NO: 3760802 - DNA, 15 bp, Homo sapiens
caccttgacagggca

SEQ ID NO: 3760803 - DNA, 17 bp, Homo sapiens
caccttgcaacacacag

SEQ ID NO: 3760804 - DNA, 21 bp, Homo sapiens
caccttgcaacacacagacac

SEQ ID NO: 3760805 - DNA, 15 bp, Homo sapiens
caccttgcagctctc

SEQ ID NO: 3760806 - DNA, 15 bp, Homo sapiens
caccttggctgcagg

SEQ ID NO: 3760807 - DNA, 12 bp, Homo sapiens
cacctttattaa

SEQ ID NO: 3760808 - DNA, 17 bp, Homo sapiens
cacctttattaaaatct

SEQ ID NO: 3760809 - DNA, 15 bp, Homo sapiens
cacctttccctaaag

SEQ ID NO: 3760810 - DNA, 20 bp, Homo sapiens
cacctttccctaaagaccct

SEQ ID NO: 3760811 - DNA, 18 bp, Homo sapiens
caccttttaactcacctc

SEQ ID NO: 3760812 - DNA, 20 bp, Homo sapiens
cacgataaataatcggccca

SEQ ID NO: 3760813 - DNA, 14 bp, Homo sapiens
cacgatgtggccct

SEQ ID NO: 3760814 - DNA, 16 bp, Homo sapiens
cacgatgtggccctgg

SEQ ID NO: 3760815 - DNA, 17 bp, Homo sapiens
cacgatgtggccctggc

SEQ ID NO: 3760816 - DNA, 22 bp, Homo sapiens
cacgcacacacacacacaggag

SEQ ID NO: 3760817 - DNA, 15 bp, Homo sapiens
cacgcacactgtctg

SEQ ID NO: 3760818 - DNA, 14 bp, Homo sapiens
cacgccactgcact

SEQ ID NO: 3760819 - DNA, 19 bp, Homo sapiens
cacgcctatgatcccagca

SEQ ID NO: 3760820 - DNA, 18 bp, Homo sapiens
cacgcctgtaatcccagc

SEQ ID NO: 3760821 - DNA, 21 bp, Homo sapiens
cacgcctgtaatcccagcagt

SEQ ID NO: 3760822 - DNA, 23 bp, Homo sapiens
cacgcgtgcacacaccagagccc

SEQ ID NO: 3760823 - DNA, 15 bp, Homo sapiens
cacgctggagtgcag

SEQ ID NO: 3760824 - DNA, 16 bp, Homo sapiens
cacgctggagtgcagt

SEQ ID NO: 3760825 - DNA, 18 bp, Homo sapiens
cacgctggagtgcagtga

SEQ ID NO: 3760826 - DNA, 13 bp, Homo sapiens
cacgctgtctcca

SEQ ID NO: 3760827 - DNA, 14 bp, Homo sapiens
cacgctgtctccag

SEQ ID NO: 3760828 - DNA, 18 bp, Homo sapiens
cacgctgtctccagaccc

SEQ ID NO: 3760829 - DNA, 20 bp, Homo sapiens
cacgctgtctccagaccccc

SEQ ID NO: 3760830 - DNA, 19 bp, Homo sapiens
cacgcttgacaggacagca

SEQ ID NO: 3760831 - DNA, 20 bp, Homo sapiens
cacggaaaatgccaatctct

SEQ ID NO: 3760832 - DNA, 16 bp, Homo sapiens
cacggaagagccttgc

SEQ ID NO: 3760833 - DNA, 20 bp, Homo sapiens
cacggcaggacaacgaggaa

SEQ ID NO: 3760834 - DNA, 23 bp, Homo sapiens
cacggcaggacaacgaggaagcc

SEQ ID NO: 3760835 - DNA, 17 bp, Homo sapiens
cacggccaggccagagg

SEQ ID NO: 3760836 - DNA, 19 bp, Homo sapiens
cacggctcactgcagcctc

SEQ ID NO: 3760837 - DNA, 14 bp, Homo sapiens
cacgtacacacaca

SEQ ID NO: 3760838 - DNA, 19 bp, Homo sapiens
cacgtagtagggtcaggcc

SEQ ID NO: 3760839 - DNA, 20 bp, Homo sapiens
cacgtagtagggtcaggcca

SEQ ID NO: 3760840 - DNA, 15 bp, Homo sapiens
cacgtctgtcttcac

SEQ ID NO: 3760841 - DNA, 18 bp, Homo sapiens
cacgtgacagtgcctggg

SEQ ID NO: 3760842 - DNA, 14 bp, Homo sapiens
cacgtgccaggccc

SEQ ID NO: 3760843 - DNA, 16 bp, Homo sapiens
cacgtgccaggcccgg

SEQ ID NO: 3760844 - DNA, 15 bp, Homo sapiens
cacgtggagagctgg

SEQ ID NO: 3760845 - DNA, 20 bp, Homo sapiens
cacgtggaggaatgctcccc

SEQ ID NO: 3760846 - DNA, 16 bp, Homo sapiens
cacgtgtgtgactcag

SEQ ID NO: 3760847 - DNA, 19 bp, Homo sapiens
cacgttccttactgcagaa

SEQ ID NO: 3760848 - DNA, 21 bp, Homo sapiens
cactaaagcaggccttttgat

SEQ ID NO: 3760849 - DNA, 18 bp, Homo sapiens
cactaaccacgctggacc

SEQ ID NO: 3760850 - DNA, 15 bp, Homo sapiens
cactaatacaccagg

SEQ ID NO: 3760851 - DNA, 17 bp, Homo sapiens
cactaatttgatgttta

SEQ ID NO: 3760852 - DNA, 16 bp, Homo sapiens
cactacactccagcct

SEQ ID NO: 3760853 - DNA, 17 bp, Homo sapiens
cactacactccagcctg

SEQ ID NO: 3760854 - DNA, 21 bp, Homo sapiens
cactacactccagcctgagca

SEQ ID NO: 3760855 - DNA, 23 bp, Homo sapiens
cactacggaatagttggctagga

SEQ ID NO: 3760856 - DNA, 15 bp, Homo sapiens
cactagaactctcca

SEQ ID NO: 3760857 - DNA, 21 bp, Homo sapiens
cactagcctctccaggaatgc

SEQ ID NO: 3760858 - DNA, 23 bp, Homo sapiens
cactaggctgggtgcccacagcc

SEQ ID NO: 3760859 - DNA, 14 bp, Homo sapiens
cactataatgtaag

SEQ ID NO: 3760860 - DNA, 18 bp, Homo sapiens
cactataatgtaagctct

SEQ ID NO: 3760861 - DNA, 14 bp, Homo sapiens
cactatagcctagg

SEQ ID NO: 3760862 - DNA, 17 bp, Homo sapiens
cactatgaagctacctc

SEQ ID NO: 3760863 - DNA, 16 bp, Homo sapiens
cactatgttgcccagg

SEQ ID NO: 3760864 - DNA, 20 bp, Homo sapiens
cactatgttgcccaggcagg

SEQ ID NO: 3760865 - DNA, 21 bp, Homo sapiens
cactatgttgcccaggcaggt

SEQ ID NO: 3760866 - DNA, 21 bp, Homo sapiens
cactattttcagaatctgaat

SEQ ID NO: 3760867 - DNA, 23 bp, Homo sapiens
cactatttttatttatatttttg

SEQ ID NO: 3760868 - DNA, 18 bp, Homo sapiens
cactcaagttcaaggacc

SEQ ID NO: 3760869 - DNA, 18 bp, Homo sapiens
cactcacagagacacagg

SEQ ID NO: 3760870 - DNA, 12 bp, Homo sapiens
cactcacatgct

SEQ ID NO: 3760871 - DNA, 15 bp, Homo sapiens
cactcactggcatct

SEQ ID NO: 3760872 - DNA, 15 bp, Homo sapiens
cactccaccacccaa

SEQ ID NO: 3760873 - DNA, 18 bp, Homo sapiens
cactccaccacccaaaag

SEQ ID NO: 3760874 - DNA, 14 bp, Homo sapiens
cactccagacccct

SEQ ID NO: 3760875 - DNA, 13 bp, Homo sapiens
cactccagcctgg

SEQ ID NO: 3760876 - DNA, 14 bp, Homo sapiens
cactccagcctggg

SEQ ID NO: 3760877 - DNA, 20 bp, Homo sapiens
cactccaggaaggggctgga

SEQ ID NO: 3760878 - DNA, 17 bp, Homo sapiens
cactcccctgcactgga

SEQ ID NO: 3760879 - DNA, 21 bp, Homo sapiens
cactccggtgtgcctgcagcc

SEQ ID NO: 3760880 - DNA, 17 bp, Homo sapiens
cactcctccctgatgta

SEQ ID NO: 3760881 - DNA, 12 bp, Homo sapiens
cactcctggggc

SEQ ID NO: 3760882 - DNA, 21 bp, Homo sapiens
cactccttcctgccacctgct

SEQ ID NO: 3760883 - DNA, 19 bp, Homo sapiens
cacaccaggctgtgggcct

SEQ ID NO: 3760884 - DNA, 22 bp, Homo sapiens
cacaccaggcttgcctgcaggc

SEQ ID NO: 3760885 - DNA, 14 bp, Homo sapiens
cacaccctgtttta

SEQ ID NO: 3760886 - DNA, 18 bp, Homo sapiens
cacacctcagttcccttg

SEQ ID NO: 3760887 - DNA, 16 bp, Homo sapiens
cacacctccctgaacc

SEQ ID NO: 3760888 - DNA, 17 bp, Homo sapiens
cacacctccctgaacca

SEQ ID NO: 3760889 - DNA, 12 bp, Homo sapiens
cacacctggccc

SEQ ID NO: 3760890 - DNA, 14 bp, Homo sapiens
cacacctggccctg

SEQ ID NO: 3760891 - DNA, 17 bp, Homo sapiens
cacacctggccctgggg

SEQ ID NO: 3760892 - DNA, 17 bp, Homo sapiens
cacacgtacttaaatga

SEQ ID NO: 3760893 - DNA, 24 bp, Homo sapiens
cacacgtctgaccctctccacccc

SEQ ID NO: 3760894 - DNA, 17 bp, Homo sapiens
cacactcagcaccccct

SEQ ID NO: 3760895 - DNA, 17 bp, Homo sapiens
cacactcccctgcactg

SEQ ID NO: 3760896 - DNA, 14 bp, Homo sapiens
cacactgaggcagg

SEQ ID NO: 3760897 - DNA, 15 bp, Homo sapiens
cacactgaggcaggg

SEQ ID NO: 3760898 - DNA, 18 bp, Homo sapiens
cacactgaggcagggaag

SEQ ID NO: 3760899 - DNA, 23 bp, Homo sapiens
cacactgtagcattacagtgggt

SEQ ID NO: 3760900 - DNA, 14 bp, Homo sapiens
cacacttcaggctc

SEQ ID NO: 3760901 - DNA, 20 bp, Homo sapiens
cacacttcaggctcttctcc

SEQ ID NO: 3760902 - DNA, 22 bp, Homo sapiens
cacacttcaggctcttctcctt

SEQ ID NO: 3760903 - DNA, 13 bp, Homo sapiens
cacacttcctgtc

SEQ ID NO: 3760904 - DNA, 16 bp, Homo sapiens
cacacttcctgtccag

SEQ ID NO: 3760905 - DNA, 19 bp, Homo sapiens
cacacttcctgtccagaga

SEQ ID NO: 3760906 - DNA, 17 bp, Homo sapiens
cacactttttaagaaat

SEQ ID NO: 3760907 - DNA, 13 bp, Homo sapiens
cacagaaacacaa

SEQ ID NO: 3760908 - DNA, 21 bp, Homo sapiens
cacagaaacacaatattttgt

SEQ ID NO: 3760909 - DNA, 14 bp, Homo sapiens
cacagaaagagagc

SEQ ID NO: 3760910 - DNA, 19 bp, Homo sapiens
cacagaaatcagaggagag

SEQ ID NO: 3760911 - DNA, 19 bp, Homo sapiens
cacagaagtgctttcttct

SEQ ID NO: 3760912 - DNA, 18 bp, Homo sapiens
cacagacattctgccagg

SEQ ID NO: 3760913 - DNA, 18 bp, Homo sapiens
cacagagagacagacttg

SEQ ID NO: 3760914 - DNA, 17 bp, Homo sapiens
cacagaggaagagcagg

SEQ ID NO: 3760915 - DNA, 17 bp, Homo sapiens
cacagatggatttgcct

SEQ ID NO: 3760916 - DNA, 14 bp, Homo sapiens
cacagcccaggcct

SEQ ID NO: 3760917 - DNA, 16 bp, Homo sapiens
cacagcccaggcctcc

SEQ ID NO: 3760918 - DNA, 15 bp, Homo sapiens
cacagcccgcatgca

SEQ ID NO: 3760919 - DNA, 17 bp, Homo sapiens
cacagcccgcatgcagc

SEQ ID NO: 3760920 - DNA, 10 bp, Homo sapiens
cacagccctg

SEQ ID NO: 3760921 - DNA, 12 bp, Homo sapiens
cacagccctgtc

SEQ ID NO: 3760922 - DNA, 21 bp, Homo sapiens
cacagccgcagcctccctctg

SEQ ID NO: 3760923 - DNA, 14 bp, Homo sapiens
cacagctctgtgtt

SEQ ID NO: 3760924 - DNA, 15 bp, Homo sapiens
cacagctcttctcca

SEQ ID NO: 3760925 - DNA, 19 bp, Homo sapiens
cacagctcttctccaggct

SEQ ID NO: 3760926 - DNA, 20 bp, Homo sapiens
cacagctcttctccaggctg

SEQ ID NO: 3760927 - DNA, 19 bp, Homo sapiens
cacagctgcagagacagag

SEQ ID NO: 3760928 - DNA, 22 bp, Homo sapiens
cacagctgtggtgaggttgggc

SEQ ID NO: 3760929 - DNA, 17 bp, Homo sapiens
cacagcttcagccagga

SEQ ID NO: 3760930 - DNA, 18 bp, Homo sapiens
cacagcttcagccaggag

SEQ ID NO: 3760931 - DNA, 21 bp, Homo sapiens
cacagcttttagtacccacct

SEQ ID NO: 3760932 - DNA, 15 bp, Homo sapiens
cacaggactctgcct

SEQ ID NO: 3760933 - DNA, 19 bp, Homo sapiens
cacaggatggtctctgcca

SEQ ID NO: 3760934 - DNA, 20 bp, Homo sapiens
cacaggcaaaatccttgctt

SEQ ID NO: 3760935 - DNA, 13 bp, Homo sapiens
cacaggcaactga

SEQ ID NO: 3760936 - DNA, 23 bp, Homo sapiens
cacaggcaactgaggcagacagc

SEQ ID NO: 3760937 - DNA, 14 bp, Homo sapiens
cacaggcagcattt

SEQ ID NO: 3760938 - DNA, 10 bp, Homo sapiens
cacaggcagg

SEQ ID NO: 3760939 - DNA, 14 bp, Homo sapiens
cacaggcaggtcca

SEQ ID NO: 3760940 - DNA, 19 bp, Homo sapiens
cacaggcaggtccagggtt

SEQ ID NO: 3760941 - DNA, 14 bp, Homo sapiens
cacaggcccggctc

SEQ ID NO: 3760942 - DNA, 16 bp, Homo sapiens
cacaggcccggctcca

SEQ ID NO: 3760943 - DNA, 17 bp, Homo sapiens
cacaggcccggctccag

SEQ ID NO: 3760944 - DNA, 18 bp, Homo sapiens
cacaggcccggctccagg

SEQ ID NO: 3760945 - DNA, 17 bp, Homo sapiens
cacaggcccttcctctc

SEQ ID NO: 3760946 - DNA, 18 bp, Homo sapiens
cacaggcccttcctctcc

SEQ ID NO: 3760947 - DNA, 14 bp, Homo sapiens
cacagggccccaga

SEQ ID NO: 3760948 - DNA, 16 bp, Homo sapiens
cacagggttgggccca

SEQ ID NO: 3760949 - DNA, 23 bp, Homo sapiens
cacagggttgggcccagatctgg

SEQ ID NO: 3760950 - DNA, 23 bp, Homo sapiens
cacaggtatgaccttctaggaag

SEQ ID NO: 3760951 - DNA, 21 bp, Homo sapiens
cacaggtgtccccagcccact

SEQ ID NO: 3760952 - DNA, 16 bp, Homo sapiens
cacagtattacttctg

SEQ ID NO: 3760953 - DNA, 18 bp, Homo sapiens
cacagtattacttctgct

SEQ ID NO: 3760954 - DNA, 19 bp, Homo sapiens
cacagtgagtcgaggacag

SEQ ID NO: 3760955 - DNA, 20 bp, Homo sapiens
cacagtgagtcgaggacagg

SEQ ID NO: 3760956 - DNA, 22 bp, Homo sapiens
cacagtgagtcgaggacaggga

SEQ ID NO: 3760957 - DNA, 17 bp, Homo sapiens
cacagtgcatctcagcc

SEQ ID NO: 3760958 - DNA, 19 bp, Homo sapiens
cacagtgcatctcagccca

SEQ ID NO: 3760959 - DNA, 14 bp, Homo sapiens
cacagtgttgccca

SEQ ID NO: 3760960 - DNA, 19 bp, Homo sapiens
cacagtgttgcccaggctg

SEQ ID NO: 3760961 - DNA, 19 bp, Homo sapiens
cacagttcctcgccctggg

SEQ ID NO: 3760962 - DNA, 20 bp, Homo sapiens
cacagttcctcgccctgggt

SEQ ID NO: 3760963 - DNA, 14 bp, Homo sapiens
cacataaaggataa

SEQ ID NO: 3760964 - DNA, 16 bp, Homo sapiens
cacatacttgagactg

SEQ ID NO: 3760965 - DNA, 23 bp, Homo sapiens
cacatagactttatgcaataaat

SEQ ID NO: 3760966 - DNA, 17 bp, Homo sapiens
cacatagattcacctgt

SEQ ID NO: 3760967 - DNA, 18 bp, Homo sapiens
cacatcagctagcaaaag

SEQ ID NO: 3760968 - DNA, 21 bp, Homo sapiens
cacatccatttcatctatttc

SEQ ID NO: 3760969 - DNA, 23 bp, Homo sapiens
cacatccatttcatctatttctg

SEQ ID NO: 3760970 - DNA, 14 bp, Homo sapiens
cacatcttccacag

SEQ ID NO: 3760971 - DNA, 22 bp, Homo sapiens
cacatcttccctagagggttcc

SEQ ID NO: 3760972 - DNA, 13 bp, Homo sapiens
cacatcttgctct

SEQ ID NO: 3760973 - DNA, 16 bp, Homo sapiens
cacatcttgctctgct

SEQ ID NO: 3760974 - DNA, 23 bp, Homo sapiens
cacatcttgctctgctgacagac

SEQ ID NO: 3760975 - DNA, 18 bp, Homo sapiens
cacatgcacgtgtgtgca

SEQ ID NO: 3760976 - DNA, 23 bp, Homo sapiens
cacatgctggacaggtctgggag

SEQ ID NO: 3760977 - DNA, 21 bp, Homo sapiens
cacatgcttgatggtttatgt

SEQ ID NO: 3760978 - DNA, 18 bp, Homo sapiens
cacatggctatgttttag

SEQ ID NO: 3760979 - DNA, 21 bp, Homo sapiens
cacatgtcagcaagtcctaag

SEQ ID NO: 3760980 - DNA, 17 bp, Homo sapiens
cacatgtgcacatgcac

SEQ ID NO: 3760981 - DNA, 20 bp, Homo sapiens
cacattatcgggagcagtgt

SEQ ID NO: 3760982 - DNA, 13 bp, Homo sapiens
cacattatttgca

SEQ ID NO: 3760983 - DNA, 17 bp, Homo sapiens
cacatttgattctgtgt

SEQ ID NO: 3760984 - DNA, 19 bp, Homo sapiens
cacatttttaaagctttcc

SEQ ID NO: 3760985 - DNA, 21 bp, Homo sapiens
cacatttttttttttaatttt

SEQ ID NO: 3760986 - DNA, 13 bp, Homo sapiens
caccaagcccaca

SEQ ID NO: 3760987 - DNA, 23 bp, Homo sapiens
caccaagcccacaggtgtcccca

SEQ ID NO: 3760988 - DNA, 15 bp, Homo sapiens
caccaagcccagtta

SEQ ID NO: 3760989 - DNA, 19 bp, Homo sapiens
caccaagctcacagttcct

SEQ ID NO: 3760990 - DNA, 15 bp, Homo sapiens
caccacacccagccc

SEQ ID NO: 3760991 - DNA, 19 bp, Homo sapiens
caccacacccagcccactt

SEQ ID NO: 3760992 - DNA, 18 bp, Homo sapiens
caccacatgtgcacatgc

SEQ ID NO: 3760993 - DNA, 13 bp, Homo sapiens
caccaccaggtct

SEQ ID NO: 3760994 - DNA, 23 bp, Homo sapiens
caccacccgctttcttgctggtt

SEQ ID NO: 3760995 - DNA, 13 bp, Homo sapiens
caccaccttccca

SEQ ID NO: 3760996 - DNA, 16 bp, Homo sapiens
caccaccttcccagct

SEQ ID NO: 3760997 - DNA, 15 bp, Homo sapiens
caccacgatgtggcc

SEQ ID NO: 3760998 - DNA, 21 bp, Homo sapiens
caccacgatgtggccctggcc

SEQ ID NO: 3760999 - DNA, 15 bp, Homo sapiens
caccacgtccagctg

SEQ ID NO: 3761000 - DNA, 20 bp, Homo sapiens
caccactaggactctgaggc

SEQ ID NO: 3761001 - DNA, 18 bp, Homo sapiens
caccactgcactccagcc

SEQ ID NO: 3761002 - DNA, 16 bp, Homo sapiens
caccacttcttttata

SEQ ID NO: 3761003 - DNA, 14 bp, Homo sapiens
caccagcagcctgg

SEQ ID NO: 3761004 - DNA, 13 bp, Homo sapiens
caccagccccagt

SEQ ID NO: 3761005 - DNA, 18 bp, Homo sapiens
caccagccccagtgccca

SEQ ID NO: 3761006 - DNA, 21 bp, Homo sapiens
caccagcccttagcagggaaa

SEQ ID NO: 3761007 - DNA, 16 bp, Homo sapiens
caccagccggggaaga

SEQ ID NO: 3761008 - DNA, 14 bp, Homo sapiens
caccagcctgcact

SEQ ID NO: 3761009 - DNA, 20 bp, Homo sapiens
caccaggcacgaacccacct

SEQ ID NO: 3761010 - DNA, 14 bp, Homo sapiens
caccaggctgctca

SEQ ID NO: 3761011 - DNA, 21 bp, Homo sapiens
caccaggctgctcagggctgg

SEQ ID NO: 3761012 - DNA, 15 bp, Homo sapiens
caccaggctgtgggc

SEQ ID NO: 3761013 - DNA, 16 bp, Homo sapiens
caccaggctgtgggcc

SEQ ID NO: 3761014 - DNA, 17 bp, Homo sapiens
caccaggctgtgggcct

SEQ ID NO: 3761015 - DNA, 18 bp, Homo sapiens
caccaggctgtgggcctc

SEQ ID NO: 3761016 - DNA, 16 bp, Homo sapiens
caccaggtagaacaca

SEQ ID NO: 3761017 - DNA, 20 bp, Homo sapiens
caccagtgaatgaaagtctt

SEQ ID NO: 3761018 - DNA, 22 bp, Homo sapiens
caccagtgaatgaaagtcttgt

SEQ ID NO: 3761019 - DNA, 15 bp, Homo sapiens
caccagtgtcctccc

SEQ ID NO: 3761020 - DNA, 19 bp, Homo sapiens
caccagtgtcctcccctca

SEQ ID NO: 3761021 - DNA, 18 bp, Homo sapiens
caccatcatgtctggcta

SEQ ID NO: 3761022 - DNA, 18 bp, Homo sapiens
caccatgtttgagctcag

SEQ ID NO: 3761023 - DNA, 22 bp, Homo sapiens
cacccaaagaggtatttatctt

SEQ ID NO: 3761024 - DNA, 15 bp, Homo sapiens
cacccacagaaagag

SEQ ID NO: 3761025 - DNA, 22 bp, Homo sapiens
cacccaccagttgaatttcatc

SEQ ID NO: 3761026 - DNA, 20 bp, Homo sapiens
cacccaccatcatgtctggc

SEQ ID NO: 3761027 - DNA, 14 bp, Homo sapiens
cacccacccagcac

SEQ ID NO: 3761028 - DNA, 13 bp, Homo sapiens
cacccacctcagc

SEQ ID NO: 3761029 - DNA, 18 bp, Homo sapiens
cacccagcaactccaact

SEQ ID NO: 3761030 - DNA, 22 bp, Homo sapiens
cacccagcccattctctctcct

SEQ ID NO: 3761031 - DNA, 14 bp, Homo sapiens
caccccacccttcc

SEQ ID NO: 3761032 - DNA, 19 bp, Homo sapiens
caccccagctgctcccctc

SEQ ID NO: 3761033 - DNA, 20 bp, Homo sapiens
caccccagctgctcccctcc

SEQ ID NO: 3761034 - DNA, 22 bp, Homo sapiens
caccccagctgctcccctccct

SEQ ID NO: 3761035 - DNA, 17 bp, Homo sapiens
caccccagtgcacccac

SEQ ID NO: 3761036 - DNA, 22 bp, Homo sapiens
caccccatagtgaccggctgct

SEQ ID NO: 3761037 - DNA, 12 bp, Homo sapiens
caccccatccca

SEQ ID NO: 3761038 - DNA, 15 bp, Homo sapiens
caccccatcccacac

SEQ ID NO: 3761039 - DNA, 11 bp, Homo sapiens
cacccccaccc

SEQ ID NO: 3761040 - DNA, 13 bp, Homo sapiens
cacccccatctct

SEQ ID NO: 3761041 - DNA, 13 bp, Homo sapiens
caccccccagaac

SEQ ID NO: 3761042 - DNA, 18 bp, Homo sapiens
caccccccagaacctgtc

SEQ ID NO: 3761043 - DNA, 16 bp, Homo sapiens
caccccctccccaggg

SEQ ID NO: 3761044 - DNA, 14 bp, Homo sapiens
caccccctccctgg

SEQ ID NO: 3761045 - DNA, 16 bp, Homo sapiens
cacccccttcagtgcc

SEQ ID NO: 3761046 - DNA, 17 bp, Homo sapiens
cacccccttcagtgccc

SEQ ID NO: 3761047 - DNA, 17 bp, Homo sapiens
cacccccttctctgctc

SEQ ID NO: 3761048 - DNA, 22 bp, Homo sapiens
cacccccttctctgctccacca

SEQ ID NO: 3761049 - DNA, 20 bp, Homo sapiens
cacccctcaacacctctgca

SEQ ID NO: 3761050 - DNA, 18 bp, Homo sapiens
caccccttccccactgcc

SEQ ID NO: 3761051 - DNA, 18 bp, Homo sapiens
cacccggcccctgctggt

SEQ ID NO: 3761052 - DNA, 21 bp, Homo sapiens
cacccggcccctgctggttca

SEQ ID NO: 3761053 - DNA, 16 bp, Homo sapiens
cacccgtggagatggg

SEQ ID NO: 3761054 - DNA, 17 bp, Homo sapiens
cacccgtggagatggga

SEQ ID NO: 3761055 - DNA, 16 bp, Homo sapiens
caccctagtcccttcc

SEQ ID NO: 3761056 - DNA, 20 bp, Homo sapiens
caccctagtcccttcccctc

SEQ ID NO: 3761057 - DNA, 15 bp, Homo sapiens
caccctctcccagga

SEQ ID NO: 3761058 - DNA, 17 bp, Homo sapiens
caccctgaaagccctga

SEQ ID NO: 3761059 - DNA, 12 bp, Homo sapiens
caccctgctctc

SEQ ID NO: 3761060 - DNA, 15 bp, Homo sapiens
caccctggggagaaa

SEQ ID NO: 3761061 - DNA, 20 bp, Homo sapiens
cacccttggaggctgtcttc

SEQ ID NO: 3761062 - DNA, 12 bp, Homo sapiens
cacccttggcct

SEQ ID NO: 3761063 - DNA, 15 bp, Homo sapiens
cacccttggcctgtc

SEQ ID NO: 3761064 - DNA, 18 bp, Homo sapiens
cacccttggcctgtctca

SEQ ID NO: 3761065 - DNA, 21 bp, Homo sapiens
caccgagagtagccgagagcc

SEQ ID NO: 3761066 - DNA, 16 bp, Homo sapiens
caccgctccccagccc

SEQ ID NO: 3761067 - DNA, 18 bp, Homo sapiens
caccgctccccagcccag

SEQ ID NO: 3761068 - DNA, 17 bp, Homo sapiens
caccgctgccagcacag

SEQ ID NO: 3761069 - DNA, 19 bp, Homo sapiens
caccgctgcctaagtggct

SEQ ID NO: 3761070 - DNA, 14 bp, Homo sapiens
caccgggcactcag

SEQ ID NO: 3761071 - DNA, 22 bp, Homo sapiens
caccgggcactcagaagacact

SEQ ID NO: 3761072 - DNA, 13 bp, Homo sapiens
caccgggcctgga

SEQ ID NO: 3761073 - DNA, 15 bp, Homo sapiens
caccggttgcttctg

SEQ ID NO: 3761074 - DNA, 19 bp, Homo sapiens
caccggttgcttctgggaa

SEQ ID NO: 3761075 - DNA, 20 bp, Homo sapiens
caccgtaaagtgagcatgct

SEQ ID NO: 3761076 - DNA, 17 bp, Homo sapiens
cacctaagtctctgtga

SEQ ID NO: 3761077 - DNA, 14 bp, Homo sapiens
cacctaatgtttat

SEQ ID NO: 3761078 - DNA, 20 bp, Homo sapiens
cacctaatgtttatgagcca

SEQ ID NO: 3761079 - DNA, 20 bp, Homo sapiens
cacctactacatcgccctcc

SEQ ID NO: 3761080 - DNA, 12 bp, Homo sapiens
cacctactgagt

SEQ ID NO: 3761081 - DNA, 16 bp, Homo sapiens
cacctaggccactcct

SEQ ID NO: 3761082 - DNA, 14 bp, Homo sapiens
cacctataaaacag

SEQ ID NO: 3761083 - DNA, 19 bp, Homo sapiens
cacctataaaacaggtcaa

SEQ ID NO: 3761084 - DNA, 14 bp, Homo sapiens
cacctataatacca

SEQ ID NO: 3761085 - DNA, 14 bp, Homo sapiens
cacctatttcaaaa

SEQ ID NO: 3761086 - DNA, 12 bp, Homo sapiens
cacctcagcctc

SEQ ID NO: 3761087 - DNA, 15 bp, Homo sapiens
cacctcagccttgga

SEQ ID NO: 3761088 - DNA, 14 bp, Homo sapiens
cacctcccagcccc

SEQ ID NO: 3761089 - DNA, 12 bp, Homo sapiens
cacctcccagga

SEQ ID NO: 3761090 - DNA, 16 bp, Homo sapiens
cacctcccatcctaat

SEQ ID NO: 3761091 - DNA, 22 bp, Homo sapiens
cacctccccccactgcaggccc

SEQ ID NO: 3761092 - DNA, 18 bp, Homo sapiens
cacctcccctatccaccc

SEQ ID NO: 3761093 - DNA, 11 bp, Homo sapiens
cacctcccctc

SEQ ID NO: 3761094 - DNA, 23 bp, Homo sapiens
cacctcccctccttgcctcctgt

SEQ ID NO: 3761095 - DNA, 18 bp, Homo sapiens
cacctcttatgcacacct

SEQ ID NO: 3761096 - DNA, 23 bp, Homo sapiens
cacctgagcccggatgcttctcc

SEQ ID NO: 3761097 - DNA, 18 bp, Homo sapiens
cacctgaggttaggagtt

SEQ ID NO: 3761098 - DNA, 19 bp, Homo sapiens
cacctgcacctccccccac

SEQ ID NO: 3761099 - DNA, 14 bp, Homo sapiens
cacctgcaggtcac

SEQ ID NO: 3761100 - DNA, 22 bp, Homo sapiens
cacctgcatccgtagttccctg

SEQ ID NO: 3761101 - DNA, 14 bp, Homo sapiens
cacctgccagcctg

SEQ ID NO: 3761102 - DNA, 16 bp, Homo sapiens
cacctgccagcctggc

SEQ ID NO: 3761103 - DNA, 13 bp, Homo sapiens
cacctgcccagat

SEQ ID NO: 3761104 - DNA, 18 bp, Homo sapiens
cacctgcccatcacaggg

SEQ ID NO: 3761105 - DNA, 14 bp, Homo sapiens
cacctgccccctgg

SEQ ID NO: 3761106 - DNA, 13 bp, Homo sapiens
cacctgccccctt

SEQ ID NO: 3761107 - DNA, 20 bp, Homo sapiens
cacctgcccccttctcccac

SEQ ID NO: 3761108 - DNA, 21 bp, Homo sapiens
cacctgcccccttctcccaca

SEQ ID NO: 3761109 - DNA, 22 bp, Homo sapiens
cacctgcccccttctcccacac

SEQ ID NO: 3761110 - DNA, 23 bp, Homo sapiens
cacctgcccccttctcccacact

SEQ ID NO: 3761111 - DNA, 13 bp, Homo sapiens
cacctgccgacct

SEQ ID NO: 3761112 - DNA, 18 bp, Homo sapiens
caaaataaagttacattg

SEQ ID NO: 3761113 - DNA, 14 bp, Homo sapiens
caaaataaattgaa

SEQ ID NO: 3761114 - DNA, 18 bp, Homo sapiens
caaaataaattgaaatat

SEQ ID NO: 3761115 - DNA, 14 bp, Homo sapiens
caaaataatgtctt

SEQ ID NO: 3761116 - DNA, 16 bp, Homo sapiens
caaaataatgtcttgt

SEQ ID NO: 3761117 - DNA, 17 bp, Homo sapiens
caaaatcacttccatag

SEQ ID NO: 3761118 - DNA, 16 bp, Homo sapiens
caaaatcattttaatg

SEQ ID NO: 3761119 - DNA, 16 bp, Homo sapiens
caaaatccttgcttat

SEQ ID NO: 3761120 - DNA, 21 bp, Homo sapiens
caaaatctgtagagcagggca

SEQ ID NO: 3761121 - DNA, 13 bp, Homo sapiens
caaaatctgtcca

SEQ ID NO: 3761122 - DNA, 15 bp, Homo sapiens
caaaattatttcaga

SEQ ID NO: 3761123 - DNA, 15 bp, Homo sapiens
caaaatttccagtac

SEQ ID NO: 3761124 - DNA, 18 bp, Homo sapiens
caaaatttccagtacctt

SEQ ID NO: 3761125 - DNA, 13 bp, Homo sapiens
caaaattttattc

SEQ ID NO: 3761126 - DNA, 15 bp, Homo sapiens
caaacaaacaagcta

SEQ ID NO: 3761127 - DNA, 20 bp, Homo sapiens
caaacaaagccagaagctga

SEQ ID NO: 3761128 - DNA, 15 bp, Homo sapiens
caaacaaatatgcaa

SEQ ID NO: 3761129 - DNA, 17 bp, Homo sapiens
caaacaaatatgcaaaa

SEQ ID NO: 3761130 - DNA, 20 bp, Homo sapiens
caaacaaccccccatcacaa

SEQ ID NO: 3761131 - DNA, 23 bp, Homo sapiens
caaacacattaagccttccacac

SEQ ID NO: 3761132 - DNA, 22 bp, Homo sapiens
caaacatcagacctgtcttcca

SEQ ID NO: 3761133 - DNA, 20 bp, Homo sapiens
caaacatgtggttaatgcca

SEQ ID NO: 3761134 - DNA, 24 bp, Homo sapiens
caaacccagtgttttaggagcatg

SEQ ID NO: 3761135 - DNA, 13 bp, Homo sapiens
caaacctgcccca

SEQ ID NO: 3761136 - DNA, 16 bp, Homo sapiens
caaacctgccccatcc

SEQ ID NO: 3761137 - DNA, 12 bp, Homo sapiens
caaacctggaga

SEQ ID NO: 3761138 - DNA, 18 bp, Homo sapiens
caaacctttattttagaa

SEQ ID NO: 3761139 - DNA, 15 bp, Homo sapiens
caaactgaagccaga

SEQ ID NO: 3761140 - DNA, 11 bp, Homo sapiens
caaactgcaat

SEQ ID NO: 3761141 - DNA, 18 bp, Homo sapiens
caaactgcctaagccctc

SEQ ID NO: 3761142 - DNA, 17 bp, Homo sapiens
caaactggcaaacttca

SEQ ID NO: 3761143 - DNA, 15 bp, Homo sapiens
caaactgtgtaactg

SEQ ID NO: 3761144 - DNA, 19 bp, Homo sapiens
caaacttaagaaacactga

SEQ ID NO: 3761145 - DNA, 23 bp, Homo sapiens
caaacttccagtgcaacactgaa

SEQ ID NO: 3761146 - DNA, 22 bp, Homo sapiens
caaagaatttcaatttgttcag

SEQ ID NO: 3761147 - DNA, 18 bp, Homo sapiens
caaagaccaaattccttg

SEQ ID NO: 3761148 - DNA, 16 bp, Homo sapiens
caaagagaatgccatt

SEQ ID NO: 3761149 - DNA, 17 bp, Homo sapiens
caaagcacattgaaaga

SEQ ID NO: 3761150 - DNA, 18 bp, Homo sapiens
caaagcacattgaaagag

SEQ ID NO: 3761151 - DNA, 22 bp, Homo sapiens
caaagcacgaaatgttattttt

SEQ ID NO: 3761152 - DNA, 14 bp, Homo sapiens
caaagccagacagc

SEQ ID NO: 3761153 - DNA, 13 bp, Homo sapiens
caaagcgggggga

SEQ ID NO: 3761154 - DNA, 15 bp, Homo sapiens
caaagctaggcctgg

SEQ ID NO: 3761155 - DNA, 17 bp, Homo sapiens
caaagctaggcctggcc

SEQ ID NO: 3761156 - DNA, 19 bp, Homo sapiens
caaagctaggcctggccag

SEQ ID NO: 3761157 - DNA, 18 bp, Homo sapiens
caaagctgacgaggctgg

SEQ ID NO: 3761158 - DNA, 22 bp, Homo sapiens
caaagctgacgaggctgggcca

SEQ ID NO: 3761159 - DNA, 15 bp, Homo sapiens
caaagcttccattcc

SEQ ID NO: 3761160 - DNA, 16 bp, Homo sapiens
caaagcttccattcca

SEQ ID NO: 3761161 - DNA, 19 bp, Homo sapiens
caaagcttgaagatcgtta

SEQ ID NO: 3761162 - DNA, 16 bp, Homo sapiens
caaaggaagtctagga

SEQ ID NO: 3761163 - DNA, 24 bp, Homo sapiens
caaaggaatggaggctctaattga

SEQ ID NO: 3761164 - DNA, 17 bp, Homo sapiens
caaagggaaatatcatt

SEQ ID NO: 3761165 - DNA, 18 bp, Homo sapiens
caaagggaaatatcattt

SEQ ID NO: 3761166 - DNA, 14 bp, Homo sapiens
caaagggagagaga

SEQ ID NO: 3761167 - DNA, 19 bp, Homo sapiens
caaagggtatcaggtgctg

SEQ ID NO: 3761168 - DNA, 20 bp, Homo sapiens
caaagggtatcaggtgctgc

SEQ ID NO: 3761169 - DNA, 23 bp, Homo sapiens
caaagggtatcaggtgctgccat

SEQ ID NO: 3761170 - DNA, 19 bp, Homo sapiens
caaagggtgaagctattta

SEQ ID NO: 3761171 - DNA, 18 bp, Homo sapiens
caaagtaaaacttgctgc

SEQ ID NO: 3761172 - DNA, 21 bp, Homo sapiens
caaagtaaaacttgctgcctg

SEQ ID NO: 3761173 - DNA, 19 bp, Homo sapiens
caaagtatcaggacgagaa

SEQ ID NO: 3761174 - DNA, 13 bp, Homo sapiens
caaagtgctggga

SEQ ID NO: 3761175 - DNA, 23 bp, Homo sapiens
caaagtgctgggattacaagcgt

SEQ ID NO: 3761176 - DNA, 23 bp, Homo sapiens
caaagtgctgggattacaggtgt

SEQ ID NO: 3761177 - DNA, 17 bp, Homo sapiens
caaagtggaaggaaaga

SEQ ID NO: 3761178 - DNA, 13 bp, Homo sapiens
caaagtggcaaaa

SEQ ID NO: 3761179 - DNA, 22 bp, Homo sapiens
caaagtgtattttataaaatta

SEQ ID NO: 3761180 - DNA, 17 bp, Homo sapiens
caaagttaacctacctg

SEQ ID NO: 3761181 - DNA, 20 bp, Homo sapiens
caaagttccctacttcctgt

SEQ ID NO: 3761182 - DNA, 17 bp, Homo sapiens
caaagttggggcaggct

SEQ ID NO: 3761183 - DNA, 22 bp, Homo sapiens
caaataaccaacccttccctga

SEQ ID NO: 3761184 - DNA, 20 bp, Homo sapiens
caaatagtttataaatgtga

SEQ ID NO: 3761185 - DNA, 17 bp, Homo sapiens
caaatatattctctttg

SEQ ID NO: 3761186 - DNA, 18 bp, Homo sapiens
caaatatattctctttgg

SEQ ID NO: 3761187 - DNA, 20 bp, Homo sapiens
caaatatattctctttggtg

SEQ ID NO: 3761188 - DNA, 13 bp, Homo sapiens
caaatattccaga

SEQ ID NO: 3761189 - DNA, 16 bp, Homo sapiens
caaatcaagtttccaa

SEQ ID NO: 3761190 - DNA, 21 bp, Homo sapiens
caaatcaagtttccaagcaaa

SEQ ID NO: 3761191 - DNA, 13 bp, Homo sapiens
caaatcagctgct

SEQ ID NO: 3761192 - DNA, 21 bp, Homo sapiens
caaatctgctttttaaagaat

SEQ ID NO: 3761193 - DNA, 18 bp, Homo sapiens
caaatgcatcaatcctgt

SEQ ID NO: 3761194 - DNA, 19 bp, Homo sapiens
caaatgctgcgcccttccc

SEQ ID NO: 3761195 - DNA, 20 bp, Homo sapiens
caaatgctgcgcccttcccc

SEQ ID NO: 3761196 - DNA, 21 bp, Homo sapiens
caaatgctgcgcccttcccca

SEQ ID NO: 3761197 - DNA, 18 bp, Homo sapiens
caaatgtaattgaataaa

SEQ ID NO: 3761198 - DNA, 18 bp, Homo sapiens
caaatgtcctccagaagc

SEQ ID NO: 3761199 - DNA, 14 bp, Homo sapiens
caaatgtgacctgt

SEQ ID NO: 3761200 - DNA, 20 bp, Homo sapiens
caaatgtgtatcggatgctt

SEQ ID NO: 3761201 - DNA, 18 bp, Homo sapiens
caaatgttacatagtgta

SEQ ID NO: 3761202 - DNA, 13 bp, Homo sapiens
caaatgttatgca

SEQ ID NO: 3761203 - DNA, 19 bp, Homo sapiens
caaattaggttttgtacaa

SEQ ID NO: 3761204 - DNA, 16 bp, Homo sapiens
caaattatcaagctaa

SEQ ID NO: 3761205 - DNA, 14 bp, Homo sapiens
caaattatcttaaa

SEQ ID NO: 3761206 - DNA, 20 bp, Homo sapiens
caaattctacaacttttcct

SEQ ID NO: 3761207 - DNA, 15 bp, Homo sapiens
caaattctgtttctt

SEQ ID NO: 3761208 - DNA, 19 bp, Homo sapiens
caaattgcttgaaagaaaa

SEQ ID NO: 3761209 - DNA, 15 bp, Homo sapiens
caaattggagcaggg

SEQ ID NO: 3761210 - DNA, 18 bp, Homo sapiens
caaattgtatctagtgca

SEQ ID NO: 3761211 - DNA, 22 bp, Homo sapiens
caaattgtatctagtgcagctg

SEQ ID NO: 3761212 - DNA, 10 bp, Homo sapiens
caacaaaaaa

SEQ ID NO: 3761213 - DNA, 13 bp, Homo sapiens
caacaaaaaataa

SEQ ID NO: 3761214 - DNA, 13 bp, Homo sapiens
caacaaaaatttg

SEQ ID NO: 3761215 - DNA, 23 bp, Homo sapiens
caacaaaaatttgaaccaaaaca

SEQ ID NO: 3761216 - DNA, 19 bp, Homo sapiens
caacaaagccaacagtcaa

SEQ ID NO: 3761217 - DNA, 21 bp, Homo sapiens
caacaaattaggttttgtaca

SEQ ID NO: 3761218 - DNA, 14 bp, Homo sapiens
caacaagagcgaaa

SEQ ID NO: 3761219 - DNA, 18 bp, Homo sapiens
caacaagggcagtggagg

SEQ ID NO: 3761220 - DNA, 14 bp, Homo sapiens
caacacaaggtggg

SEQ ID NO: 3761221 - DNA, 21 bp, Homo sapiens
caacacaaggtgggcagggag

SEQ ID NO: 3761222 - DNA, 22 bp, Homo sapiens
caacacctctgcacaagctgca

SEQ ID NO: 3761223 - DNA, 15 bp, Homo sapiens
caacagaagcttcca

SEQ ID NO: 3761224 - DNA, 14 bp, Homo sapiens
caacaggagctggg

SEQ ID NO: 3761225 - DNA, 17 bp, Homo sapiens
caacaggctgggcttca

SEQ ID NO: 3761226 - DNA, 24 bp, Homo sapiens
caacaggctgggcttcagtggcag

SEQ ID NO: 3761227 - DNA, 20 bp, Homo sapiens
caacagtagcataggaccct

SEQ ID NO: 3761228 - DNA, 14 bp, Homo sapiens
caacagttccttca

SEQ ID NO: 3761229 - DNA, 22 bp, Homo sapiens
caacagttttttatgctaatca

SEQ ID NO: 3761230 - DNA, 23 bp, Homo sapiens
caacatagtgagacccctgtctc

SEQ ID NO: 3761231 - DNA, 15 bp, Homo sapiens
caacatcaatgttca

SEQ ID NO: 3761232 - DNA, 18 bp, Homo sapiens
caacatcaatgttcattg

SEQ ID NO: 3761233 - DNA, 17 bp, Homo sapiens
caacatcccattgccct

SEQ ID NO: 3761234 - DNA, 20 bp, Homo sapiens
caacatcccattgccctggt

SEQ ID NO: 3761235 - DNA, 21 bp, Homo sapiens
caacatggtgaaaccccatct

SEQ ID NO: 3761236 - DNA, 18 bp, Homo sapiens
caacatgtataatatttt

SEQ ID NO: 3761237 - DNA, 19 bp, Homo sapiens
caaccaccgctccccagcc

SEQ ID NO: 3761238 - DNA, 20 bp, Homo sapiens
caaccaccgctccccagccc

SEQ ID NO: 3761239 - DNA, 21 bp, Homo sapiens
caaccaccgctccccagccca

SEQ ID NO: 3761240 - DNA, 14 bp, Homo sapiens
caaccactgtaaaa

SEQ ID NO: 3761241 - DNA, 17 bp, Homo sapiens
caaccactgtaaaatga

SEQ ID NO: 3761242 - DNA, 16 bp, Homo sapiens
caaccagagcactgta

SEQ ID NO: 3761243 - DNA, 18 bp, Homo sapiens
caaccagagcactgtata

SEQ ID NO: 3761244 - DNA, 20 bp, Homo sapiens
caaccagagcactgtatacc

SEQ ID NO: 3761245 - DNA, 23 bp, Homo sapiens
caaccatgagaccactgttatca

SEQ ID NO: 3761246 - DNA, 12 bp, Homo sapiens
caacccccaccc

SEQ ID NO: 3761247 - DNA, 18 bp, Homo sapiens
caacccccaccccacact

SEQ ID NO: 3761248 - DNA, 16 bp, Homo sapiens
caaccccccacctgcc

SEQ ID NO: 3761249 - DNA, 17 bp, Homo sapiens
caaccccccacctgcca

SEQ ID NO: 3761250 - DNA, 12 bp, Homo sapiens
caacccctgtgg

SEQ ID NO: 3761251 - DNA, 17 bp, Homo sapiens
caaccccttcgctcctg

SEQ ID NO: 3761252 - DNA, 22 bp, Homo sapiens
caaccctccctcagcccctctt

SEQ ID NO: 3761253 - DNA, 12 bp, Homo sapiens
caaccctgcaaa

SEQ ID NO: 3761254 - DNA, 22 bp, Homo sapiens
caaccctgcaaaggactgtttt

SEQ ID NO: 3761255 - DNA, 22 bp, Homo sapiens
caaccctgcccctgccccgtca

SEQ ID NO: 3761256 - DNA, 23 bp, Homo sapiens
caaccctgcccctgccccgtcac

SEQ ID NO: 3761257 - DNA, 19 bp, Homo sapiens
caaccctgttttatactgt

SEQ ID NO: 3761258 - DNA, 22 bp, Homo sapiens
caacccttaccccttagcctcc

SEQ ID NO: 3761259 - DNA, 21 bp, Homo sapiens
caaccgatgctccagccaacc

SEQ ID NO: 3761260 - DNA, 20 bp, Homo sapiens
caaccggggagcccccgccc

SEQ ID NO: 3761261 - DNA, 18 bp, Homo sapiens
caacctcggctcctggac

SEQ ID NO: 3761262 - DNA, 15 bp, Homo sapiens
caacctctctgatct

SEQ ID NO: 3761263 - DNA, 23 bp, Homo sapiens
caacctgctctcctcttgccact

SEQ ID NO: 3761264 - DNA, 15 bp, Homo sapiens
caacgaggaagccct

SEQ ID NO: 3761265 - DNA, 13 bp, Homo sapiens
caacgcagccctg

SEQ ID NO: 3761266 - DNA, 21 bp, Homo sapiens
caacggagagcgcctgcccct

SEQ ID NO: 3761267 - DNA, 14 bp, Homo sapiens
caacgtggcccaga

SEQ ID NO: 3761268 - DNA, 21 bp, Homo sapiens
caacgtggcccagagaagcca

SEQ ID NO: 3761269 - DNA, 15 bp, Homo sapiens
caacgtggggcagca

SEQ ID NO: 3761270 - DNA, 17 bp, Homo sapiens
caacgtggggcagcaca

SEQ ID NO: 3761271 - DNA, 17 bp, Homo sapiens
caactaggcttcagcat

SEQ ID NO: 3761272 - DNA, 19 bp, Homo sapiens
caactccagtactggagct

SEQ ID NO: 3761273 - DNA, 22 bp, Homo sapiens
caactgaaaagactcagtgttc

SEQ ID NO: 3761274 - DNA, 22 bp, Homo sapiens
caactgaaagtgtttccttcat

SEQ ID NO: 3761275 - DNA, 16 bp, Homo sapiens
caactgaacaaaaaaa

SEQ ID NO: 3761276 - DNA, 17 bp, Homo sapiens
caactgaccagcctcca

SEQ ID NO: 3761277 - DNA, 21 bp, Homo sapiens
caactgctgatgctcatggtc

SEQ ID NO: 3761278 - DNA, 13 bp, Homo sapiens
caactgctgcccc

SEQ ID NO: 3761279 - DNA, 14 bp, Homo sapiens
caactggaagcaca

SEQ ID NO: 3761280 - DNA, 18 bp, Homo sapiens
caacttcaagtgcatgct

SEQ ID NO: 3761281 - DNA, 16 bp, Homo sapiens
caacttctaattgcca

SEQ ID NO: 3761282 - DNA, 19 bp, Homo sapiens
caacttctacttctgccct

SEQ ID NO: 3761283 - DNA, 15 bp, Homo sapiens
caactttctcttgta

SEQ ID NO: 3761284 - DNA, 15 bp, Homo sapiens
caagaaactcacccc

SEQ ID NO: 3761285 - DNA, 17 bp, Homo sapiens
caagaaactcaccccca

SEQ ID NO: 3761286 - DNA, 16 bp, Homo sapiens
caagaaagccagtctt

SEQ ID NO: 3761287 - DNA, 14 bp, Homo sapiens
caagaacagcaggc

SEQ ID NO: 3761288 - DNA, 12 bp, Homo sapiens
caagaactgcat

SEQ ID NO: 3761289 - DNA, 14 bp, Homo sapiens
caagaaggctgggg

SEQ ID NO: 3761290 - DNA, 22 bp, Homo sapiens
caagaagggttttccaccctgg

SEQ ID NO: 3761291 - DNA, 21 bp, Homo sapiens
caagaattggaagctgccctg

SEQ ID NO: 3761292 - DNA, 12 bp, Homo sapiens
caagacagagac

SEQ ID NO: 3761293 - DNA, 13 bp, Homo sapiens
caagacagatgcc

SEQ ID NO: 3761294 - DNA, 18 bp, Homo sapiens
caagacattgtcaataaa

SEQ ID NO: 3761295 - DNA, 11 bp, Homo sapiens
caagaccaaaa

SEQ ID NO: 3761296 - DNA, 18 bp, Homo sapiens
caagaccaaaatgacaat

SEQ ID NO: 3761297 - DNA, 15 bp, Homo sapiens
caagactctgtctca

SEQ ID NO: 3761298 - DNA, 19 bp, Homo sapiens
caagacttcgggaaggtgt

SEQ ID NO: 3761299 - DNA, 21 bp, Homo sapiens
caagacttcgggaaggtgtct

SEQ ID NO: 3761300 - DNA, 15 bp, Homo sapiens
caagagcagcctgtg

SEQ ID NO: 3761301 - DNA, 18 bp, Homo sapiens
caagagcagcctgtggca

SEQ ID NO: 3761302 - DNA, 13 bp, Homo sapiens
caagagcccagca

SEQ ID NO: 3761303 - DNA, 12 bp, Homo sapiens
caagagccttgg

SEQ ID NO: 3761304 - DNA, 23 bp, Homo sapiens
caagagccttggtgtccacctgg

SEQ ID NO: 3761305 - DNA, 18 bp, Homo sapiens
caagagcgaaactccgtc

SEQ ID NO: 3761306 - DNA, 14 bp, Homo sapiens
caagaggagatcca

SEQ ID NO: 3761307 - DNA, 20 bp, Homo sapiens
caagaggctgttcccaccag

SEQ ID NO: 3761308 - DNA, 13 bp, Homo sapiens
caagagggcactg

SEQ ID NO: 3761309 - DNA, 15 bp, Homo sapiens
caagagggcactggt

SEQ ID NO: 3761310 - DNA, 17 bp, Homo sapiens
caagagggcactggtgg

SEQ ID NO: 3761311 - DNA, 15 bp, Homo sapiens
caagagtgattcttg

SEQ ID NO: 3761312 - DNA, 22 bp, Homo sapiens
caagatcctgtctttaaggaaa

SEQ ID NO: 3761313 - DNA, 14 bp, Homo sapiens
caagatctttcagg

SEQ ID NO: 3761314 - DNA, 20 bp, Homo sapiens
caagatgccatctgtgtcct

SEQ ID NO: 3761315 - DNA, 20 bp, Homo sapiens
caagatgcttttcaaactga

SEQ ID NO: 3761316 - DNA, 15 bp, Homo sapiens
caagatgtcagactg

SEQ ID NO: 3761317 - DNA, 17 bp, Homo sapiens
caagattcccagagaca

SEQ ID NO: 3761318 - DNA, 18 bp, Homo sapiens
caagattcccagagacag

SEQ ID NO: 3761319 - DNA, 23 bp, Homo sapiens
caagattcccagagacaggaaaa

SEQ ID NO: 3761320 - DNA, 19 bp, Homo sapiens
caagattgatcatttttat

SEQ ID NO: 3761321 - DNA, 13 bp, Homo sapiens
caagattgcttaa

SEQ ID NO: 3761322 - DNA, 15 bp, Homo sapiens
caagcaatcctcctg

SEQ ID NO: 3761323 - DNA, 17 bp, Homo sapiens
caagcaatcctcctgag

SEQ ID NO: 3761324 - DNA, 13 bp, Homo sapiens
caagcacctcctg

SEQ ID NO: 3761325 - DNA, 21 bp, Homo sapiens
caagcagattggagaaaccct

SEQ ID NO: 3761326 - DNA, 13 bp, Homo sapiens
caagcagccaagc

SEQ ID NO: 3761327 - DNA, 22 bp, Homo sapiens
caagcagccaagctccttggga

SEQ ID NO: 3761328 - DNA, 17 bp, Homo sapiens
caagcaggaagctcaga

SEQ ID NO: 3761329 - DNA, 18 bp, Homo sapiens
caagcagtctacccacct

SEQ ID NO: 3761330 - DNA, 15 bp, Homo sapiens
caagcatctcctgag

SEQ ID NO: 3761331 - DNA, 19 bp, Homo sapiens
caagccaacgacaaagcca

SEQ ID NO: 3761332 - DNA, 15 bp, Homo sapiens
caagccaagcagcca

SEQ ID NO: 3761333 - DNA, 18 bp, Homo sapiens
caagccaagcagccaagc

SEQ ID NO: 3761334 - DNA, 19 bp, Homo sapiens
caagccaagcagccaagct

SEQ ID NO: 3761335 - DNA, 19 bp, Homo sapiens
caagccagggatggggcca

SEQ ID NO: 3761336 - DNA, 22 bp, Homo sapiens
caagccagggatggggccacag

SEQ ID NO: 3761337 - DNA, 23 bp, Homo sapiens
caagcccacaggtgtccccagcc

SEQ ID NO: 3761338 - DNA, 15 bp, Homo sapiens
caagccccaggcagg

SEQ ID NO: 3761339 - DNA, 16 bp, Homo sapiens
caagccccatcctgcc

SEQ ID NO: 3761340 - DNA, 14 bp, Homo sapiens
caagccgtggcttc

SEQ ID NO: 3761341 - DNA, 22 bp, Homo sapiens
caagcctgcagtcatcttgacc

SEQ ID NO: 3761342 - DNA, 18 bp, Homo sapiens
caagcctgtaatcccagc

SEQ ID NO: 3761343 - DNA, 17 bp, Homo sapiens
caagcgaggtcaacaga

SEQ ID NO: 3761344 - DNA, 17 bp, Homo sapiens
caagcgtgagccactgc

SEQ ID NO: 3761345 - DNA, 17 bp, Homo sapiens
caagctaataaaatatc

SEQ ID NO: 3761346 - DNA, 21 bp, Homo sapiens
caagctaataaaatatcattc

SEQ ID NO: 3761347 - DNA, 22 bp, Homo sapiens
caagctaataaaatatcattca

SEQ ID NO: 3761348 - DNA, 17 bp, Homo sapiens
caagctccatctccact

SEQ ID NO: 3761349 - DNA, 17 bp, Homo sapiens
caagctccttgggaggc

SEQ ID NO: 3761350 - DNA, 14 bp, Homo sapiens
caagctctgctcct

SEQ ID NO: 3761351 - DNA, 15 bp, Homo sapiens
caagctctgctcctc

SEQ ID NO: 3761352 - DNA, 13 bp, Homo sapiens
caagctgcaccct

SEQ ID NO: 3761353 - DNA, 14 bp, Homo sapiens
caagctgcaccctc

SEQ ID NO: 3761354 - DNA, 13 bp, Homo sapiens
caagctgcctccc

SEQ ID NO: 3761355 - DNA, 15 bp, Homo sapiens
caagctgcctccctg

SEQ ID NO: 3761356 - DNA, 22 bp, Homo sapiens
caagctggtcccactcagtcca

SEQ ID NO: 3761357 - DNA, 13 bp, Homo sapiens
caagcttctttta

SEQ ID NO: 3761358 - DNA, 23 bp, Homo sapiens
caagcttttttattttttataca

SEQ ID NO: 3761359 - DNA, 22 bp, Homo sapiens
caaggaaaatagtttaggagaa

SEQ ID NO: 3761360 - DNA, 17 bp, Homo sapiens
caaggaaagccccagca

SEQ ID NO: 3761361 - DNA, 12 bp, Homo sapiens
caaggaaggaaa

SEQ ID NO: 3761362 - DNA, 16 bp, Homo sapiens
caaggaaggaaagaaa

SEQ ID NO: 3761363 - DNA, 17 bp, Homo sapiens
caaggaaggaaagaaag

SEQ ID NO: 3761364 - DNA, 23 bp, Homo sapiens
caaggaaggaaagaaagaaggaa

SEQ ID NO: 3761365 - DNA, 22 bp, Homo sapiens
caaggacaaagtctccagccca

SEQ ID NO: 3761366 - DNA, 23 bp, Homo sapiens
caaggaccaacaagggcagtgga

SEQ ID NO: 3761367 - DNA, 15 bp, Homo sapiens
caaggaccaggactc

SEQ ID NO: 3761368 - DNA, 18 bp, Homo sapiens
caaggaccaggactccct

SEQ ID NO: 3761369 - DNA, 14 bp, Homo sapiens
caaggactgccgac

SEQ ID NO: 3761370 - DNA, 18 bp, Homo sapiens
caaggacttgaaagcatc

SEQ ID NO: 3761371 - DNA, 20 bp, Homo sapiens
caaggacttgaaagcatcca

SEQ ID NO: 3761372 - DNA, 20 bp, Homo sapiens
caaggagaaacagagacagg

SEQ ID NO: 3761373 - DNA, 16 bp, Homo sapiens
caaggagaccaagtcc

SEQ ID NO: 3761374 - DNA, 13 bp, Homo sapiens
caaggagatgaag

SEQ ID NO: 3761375 - DNA, 14 bp, Homo sapiens
caaggagctgagaa

SEQ ID NO: 3761376 - DNA, 20 bp, Homo sapiens
caaggagctgagaatagaag

SEQ ID NO: 3761377 - DNA, 12 bp, Homo sapiens
caaggaggaaaa

SEQ ID NO: 3761378 - DNA, 14 bp, Homo sapiens
caaggaggaaaaac

SEQ ID NO: 3761379 - DNA, 15 bp, Homo sapiens
caaggattgctactg

SEQ ID NO: 3761380 - DNA, 20 bp, Homo sapiens
caaggattgctactgtccta

SEQ ID NO: 3761381 - DNA, 15 bp, Homo sapiens
caaggcactgtacta

SEQ ID NO: 3761382 - DNA, 20 bp, Homo sapiens
caaggccagagtggcctggc

SEQ ID NO: 3761383 - DNA, 21 bp, Homo sapiens
caaggccagagtggcctggcc

SEQ ID NO: 3761384 - DNA, 19 bp, Homo sapiens
caaggccagcaaggtggag

SEQ ID NO: 3761385 - DNA, 21 bp, Homo sapiens
caaggccagcaaggtggagtg

SEQ ID NO: 3761386 - DNA, 19 bp, Homo sapiens
caaggccgctgttcaccca

SEQ ID NO: 3761387 - DNA, 14 bp, Homo sapiens
caaggcctgtccct

SEQ ID NO: 3761388 - DNA, 12 bp, Homo sapiens
caaggctgcagt

SEQ ID NO: 3761389 - DNA, 12 bp, Homo sapiens
caagggcctctt

SEQ ID NO: 3761390 - DNA, 14 bp, Homo sapiens
caagggctgtaggt

SEQ ID NO: 3761391 - DNA, 21 bp, Homo sapiens
caaggggaatgtttgcctctg

SEQ ID NO: 3761392 - DNA, 15 bp, Homo sapiens
caagggggactgtct

SEQ ID NO: 3761393 - DNA, 16 bp, Homo sapiens
caagggtctagggaga

SEQ ID NO: 3761394 - DNA, 16 bp, Homo sapiens
caagggtggcatccca

SEQ ID NO: 3761395 - DNA, 17 bp, Homo sapiens
caaggtaaaattctaaa

SEQ ID NO: 3761396 - DNA, 19 bp, Homo sapiens
caaggtcgtttttttcatt

SEQ ID NO: 3761397 - DNA, 21 bp, Homo sapiens
caaggtctaggtggaggtggg

SEQ ID NO: 3761398 - DNA, 23 bp, Homo sapiens
caaggtgctgttgtcattgcttt

SEQ ID NO: 3761399 - DNA, 18 bp, Homo sapiens
caaggtggagtggatgcc

SEQ ID NO: 3761400 - DNA, 16 bp, Homo sapiens
caaggtgggctgagcc

SEQ ID NO: 3761401 - DNA, 19 bp, Homo sapiens
caaggtgggctgagccctg

SEQ ID NO: 3761402 - DNA, 14 bp, Homo sapiens
caagtaagaagaca

SEQ ID NO: 3761403 - DNA, 18 bp, Homo sapiens
caagtaagaagacatgaa

SEQ ID NO: 3761404 - DNA, 22 bp, Homo sapiens
caagtaagaagacatgaaccaa

SEQ ID NO: 3761405 - DNA, 11 bp, Homo sapiens
caagtaattgt

SEQ ID NO: 3761406 - DNA, 23 bp, Homo sapiens
caagtaattgtgaaaaagttaaa

SEQ ID NO: 3761407 - DNA, 16 bp, Homo sapiens
caagtactgctgtaaa

SEQ ID NO: 3761408 - DNA, 18 bp, Homo sapiens
caagtagatgcctgaact

SEQ ID NO: 3761409 - DNA, 16 bp, Homo sapiens
caagtatgaataaaga

SEQ ID NO: 3761410 - DNA, 21 bp, Homo sapiens
caagtatgaataaagacacct

SEQ ID NO: 3761411 - DNA, 15 bp, Homo sapiens
caagtatgtgagtgt

SEQ ID NO: 3761412 - DNA, 18 bp, Homo sapiens
caagtattctgcctttgc

SEQ ID NO: 3761413 - DNA, 12 bp, Homo sapiens
caagtcacaaag

SEQ ID NO: 3761414 - DNA, 16 bp, Homo sapiens
caagtcacaaaggaat

SEQ ID NO: 3761415 - DNA, 19 bp, Homo sapiens
caagtcacaaaggaatgga

SEQ ID NO: 3761416 - DNA, 22 bp, Homo sapiens
caagtcccaccggttgcttctg

SEQ ID NO: 3761417 - DNA, 18 bp, Homo sapiens
caagtccctgactctctg

SEQ ID NO: 3761418 - DNA, 20 bp, Homo sapiens
caagtccctgactctctgtg

SEQ ID NO: 3761419 - DNA, 21 bp, Homo sapiens
caagtcctcttttctgagagg

SEQ ID NO: 3761420 - DNA, 17 bp, Homo sapiens
caagtcctggctacatc

SEQ ID NO: 3761421 - DNA, 18 bp, Homo sapiens
caagtctgtgcctggagc

SEQ ID NO: 3761422 - DNA, 15 bp, Homo sapiens
caagtcttccctgat

SEQ ID NO: 3761423 - DNA, 22 bp, Homo sapiens
caagtgaaaaaggaggaagaga

SEQ ID NO: 3761424 - DNA, 23 bp, Homo sapiens
caagtgaaaaaggaggaagagaa

SEQ ID NO: 3761425 - DNA, 13 bp, Homo sapiens
caagtgaacacat

SEQ ID NO: 3761426 - DNA, 18 bp, Homo sapiens
caagtgactgtatctgtg

SEQ ID NO: 3761427 - DNA, 14 bp, Homo sapiens
caagtgagaccctg

SEQ ID NO: 3761428 - DNA, 21 bp, Homo sapiens
caagtgatcctcctgcctcag

SEQ ID NO: 3761429 - DNA, 19 bp, Homo sapiens
caagtgattctcctgcctc

SEQ ID NO: 3761430 - DNA, 21 bp, Homo sapiens
caagtgattctcctgcctcag

SEQ ID NO: 3761431 - DNA, 23 bp, Homo sapiens
caagtgccactgcccgagctggt

SEQ ID NO: 3761432 - DNA, 20 bp, Homo sapiens
caagtgccagtcttgtgtct

SEQ ID NO: 3761433 - DNA, 17 bp, Homo sapiens
caagtggcatgtgctgt

SEQ ID NO: 3761434 - DNA, 14 bp, Homo sapiens
caagtggtcaggag

SEQ ID NO: 3761435 - DNA, 17 bp, Homo sapiens
caagtgtctcagtccac

SEQ ID NO: 3761436 - DNA, 22 bp, Homo sapiens
caagtgtggtagagtgtgcctg

SEQ ID NO: 3761437 - DNA, 19 bp, Homo sapiens
caagtgtgtgcacatgtgt

SEQ ID NO: 3761438 - DNA, 22 bp, Homo sapiens
caagtgtgtgcacatgtgtgcg

SEQ ID NO: 3761439 - DNA, 17 bp, Homo sapiens
caagtgtgtgcatgtgt

SEQ ID NO: 3761440 - DNA, 20 bp, Homo sapiens
caagtgtgtgcatgtgtgcg

SEQ ID NO: 3761441 - DNA, 11 bp, Homo sapiens
caagtgtgtgt

SEQ ID NO: 3761442 - DNA, 14 bp, Homo sapiens
caagttaaataaat

SEQ ID NO: 3761443 - DNA, 19 bp, Homo sapiens
caagttagctcaggaggct

SEQ ID NO: 3761444 - DNA, 19 bp, Homo sapiens
caagttatataaagagaaa

SEQ ID NO: 3761445 - DNA, 19 bp, Homo sapiens
caagttattgacaaactct

SEQ ID NO: 3761446 - DNA, 14 bp, Homo sapiens
caagttcaaggacc

SEQ ID NO: 3761447 - DNA, 14 bp, Homo sapiens
caagttggactggg

SEQ ID NO: 3761448 - DNA, 14 bp, Homo sapiens
caagtttcagacag

SEQ ID NO: 3761449 - DNA, 13 bp, Homo sapiens
caataaaatcatg

SEQ ID NO: 3761450 - DNA, 20 bp, Homo sapiens
caataaaatgtgatttttct

SEQ ID NO: 3761451 - DNA, 21 bp, Homo sapiens
caataaaatgtgatttttctg

SEQ ID NO: 3761452 - DNA, 22 bp, Homo sapiens
caataaaatgtgatttttctga

SEQ ID NO: 3761453 - DNA, 12 bp, Homo sapiens
caataaagtatc

SEQ ID NO: 3761454 - DNA, 16 bp, Homo sapiens
caataaagtatctaca

SEQ ID NO: 3761455 - DNA, 14 bp, Homo sapiens
caataaatgtattc

SEQ ID NO: 3761456 - DNA, 15 bp, Homo sapiens
caataaatgtattca

SEQ ID NO: 3761457 - DNA, 18 bp, Homo sapiens
caataaatgtattcaaat

SEQ ID NO: 3761458 - DNA, 16 bp, Homo sapiens
caataactactgtgtt

SEQ ID NO: 3761459 - DNA, 14 bp, Homo sapiens
caataatttcaggt

SEQ ID NO: 3761460 - DNA, 17 bp, Homo sapiens
caatacagtacaggcag

SEQ ID NO: 3761461 - DNA, 12 bp, Homo sapiens
caatagagactg

SEQ ID NO: 3761462 - DNA, 15 bp, Homo sapiens
caatagagactgtag

SEQ ID NO: 3761463 - DNA, 20 bp, Homo sapiens
caatagcactttcattgcca

SEQ ID NO: 3761464 - DNA, 19 bp, Homo sapiens
caatagcagacagtgtttt

SEQ ID NO: 3761465 - DNA, 23 bp, Homo sapiens
caataggcaaaggggggaaggga

SEQ ID NO: 3761466 - DNA, 15 bp, Homo sapiens
caatagtgtgttctg

SEQ ID NO: 3761467 - DNA, 18 bp, Homo sapiens
caatataaccaatgttta

SEQ ID NO: 3761468 - DNA, 19 bp, Homo sapiens
caatataaccaatgtttaa

SEQ ID NO: 3761469 - DNA, 13 bp, Homo sapiens
caatatcctcgct

SEQ ID NO: 3761470 - DNA, 20 bp, Homo sapiens
caatatgaaggaaatgaacc

SEQ ID NO: 3761471 - DNA, 22 bp, Homo sapiens
caatattataatttttttcaat

SEQ ID NO: 3761472 - DNA, 14 bp, Homo sapiens
caatattatactaa

SEQ ID NO: 3761473 - DNA, 19 bp, Homo sapiens
caatattatactaagaaaa

SEQ ID NO: 3761474 - DNA, 21 bp, Homo sapiens
caatattatactaagaaaaga

SEQ ID NO: 3761475 - DNA, 14 bp, Homo sapiens
caatattgtttcta

SEQ ID NO: 3761476 - DNA, 19 bp, Homo sapiens
caatatttaaggagatgta

SEQ ID NO: 3761477 - DNA, 13 bp, Homo sapiens
caatatttattat

SEQ ID NO: 3761478 - DNA, 22 bp, Homo sapiens
caatatttattgtattttagta

SEQ ID NO: 3761479 - DNA, 13 bp, Homo sapiens
caatatttgtaga

SEQ ID NO: 3761480 - DNA, 17 bp, Homo sapiens
caatattttaagcatta

SEQ ID NO: 3761481 - DNA, 22 bp, Homo sapiens
caatattttccatgaaaatgca

SEQ ID NO: 3761482 - DNA, 14 bp, Homo sapiens
caatcaaatctgct

SEQ ID NO: 3761483 - DNA, 16 bp, Homo sapiens
caatcaagataaagga

SEQ ID NO: 3761484 - DNA, 16 bp, Homo sapiens
caatcccaccaaccct

SEQ ID NO: 3761485 - DNA, 23 bp, Homo sapiens
caatcccaccaaccctcagagcc

SEQ ID NO: 3761486 - DNA, 15 bp, Homo sapiens
caatcccctcattca

SEQ ID NO: 3761487 - DNA, 22 bp, Homo sapiens
caatcccctcattcaggaaaac

SEQ ID NO: 3761488 - DNA, 22 bp, Homo sapiens
caatcctaacacattatcggga

SEQ ID NO: 3761489 - DNA, 16 bp, Homo sapiens
caatcctcactgggtg

SEQ ID NO: 3761490 - DNA, 17 bp, Homo sapiens
caatcctcactgggtgg

SEQ ID NO: 3761491 - DNA, 19 bp, Homo sapiens
caatcctggctctgtggct

SEQ ID NO: 3761492 - DNA, 18 bp, Homo sapiens
caatcctgtgggtgaaga

SEQ ID NO: 3761493 - DNA, 17 bp, Homo sapiens
caatgaaagtttgcact

SEQ ID NO: 3761494 - DNA, 19 bp, Homo sapiens
caatgaaatgctctccttt

SEQ ID NO: 3761495 - DNA, 21 bp, Homo sapiens
caatgaaatgctctcctttcc

SEQ ID NO: 3761496 - DNA, 13 bp, Homo sapiens
caatgatggcaat

SEQ ID NO: 3761497 - DNA, 16 bp, Homo sapiens
caatgcagatgccaga

SEQ ID NO: 3761498 - DNA, 19 bp, Homo sapiens
caatgcagatgccagagca

SEQ ID NO: 3761499 - DNA, 13 bp, Homo sapiens
caatgctggctgt

SEQ ID NO: 3761500 - DNA, 21 bp, Homo sapiens
caatgctggctgttggctggg

SEQ ID NO: 3761501 - DNA, 22 bp, Homo sapiens
caatggagtagacccctggctg

SEQ ID NO: 3761502 - DNA, 14 bp, Homo sapiens
caatggcagccttg

SEQ ID NO: 3761503 - DNA, 15 bp, Homo sapiens
caatggcctaaactt

SEQ ID NO: 3761504 - DNA, 18 bp, Homo sapiens
caatgtcacaacctctct

SEQ ID NO: 3761505 - DNA, 21 bp, Homo sapiens
caatgtcacaacctctctgat

SEQ ID NO: 3761506 - DNA, 14 bp, Homo sapiens
caatgtcacttaaa

SEQ ID NO: 3761507 - DNA, 16 bp, Homo sapiens
caatgtcaggaacaga

SEQ ID NO: 3761508 - DNA, 19 bp, Homo sapiens
caatgtcaggaacagaagg

SEQ ID NO: 3761509 - DNA, 21 bp, Homo sapiens
caatgtcaggaacagaaggat

SEQ ID NO: 3761510 - DNA, 18 bp, Homo sapiens
caatgtgaatcagaccct

SEQ ID NO: 3761511 - DNA, 19 bp, Homo sapiens
caatgtgaatcagacccta

SEQ ID NO: 3761512 - DNA, 23 bp, Homo sapiens
caatgtgctactgattgtttcat

SEQ ID NO: 3761513 - DNA, 13 bp, Homo sapiens
caatgtttctttt

SEQ ID NO: 3761514 - DNA, 16 bp, Homo sapiens
caatgtttcttttatc

SEQ ID NO: 3761515 - DNA, 12 bp, Homo sapiens
caattaaatgta

SEQ ID NO: 3761516 - DNA, 13 bp, Homo sapiens
caattaaatgtag

SEQ ID NO: 3761517 - DNA, 14 bp, Homo sapiens
caattaaatgtagg

SEQ ID NO: 3761518 - DNA, 21 bp, Homo sapiens
caattagcaattgactgtcac

SEQ ID NO: 3761519 - DNA, 23 bp, Homo sapiens
caattatatcagtcctctttcaa

SEQ ID NO: 3761520 - DNA, 13 bp, Homo sapiens
caattatttttac

SEQ ID NO: 3761521 - DNA, 18 bp, Homo sapiens
caattccatgctataaaa

SEQ ID NO: 3761522 - DNA, 13 bp, Homo sapiens
caattcctctggg

SEQ ID NO: 3761523 - DNA, 14 bp, Homo sapiens
caattcctctggga

SEQ ID NO: 3761524 - DNA, 12 bp, Homo sapiens
caattcctgggc

SEQ ID NO: 3761525 - DNA, 23 bp, Homo sapiens
caattctcatttgtcacacactt

SEQ ID NO: 3761526 - DNA, 17 bp, Homo sapiens
caattcttacaaacatg

SEQ ID NO: 3761527 - DNA, 18 bp, Homo sapiens
caattgaacttaaataaa

SEQ ID NO: 3761528 - DNA, 17 bp, Homo sapiens
caattgtttttgttgtg

SEQ ID NO: 3761529 - DNA, 12 bp, Homo sapiens
caatttaaagca

SEQ ID NO: 3761530 - DNA, 22 bp, Homo sapiens
caatttgtcattttgaagctaa

SEQ ID NO: 3761531 - DNA, 22 bp, Homo sapiens
caattttaacacacataaagga

SEQ ID NO: 3761532 - DNA, 22 bp, Homo sapiens
caatttttacacaaacctgaaa

SEQ ID NO: 3761533 - DNA, 12 bp, Homo sapiens
cacaaaaatgaa

SEQ ID NO: 3761534 - DNA, 18 bp, Homo sapiens
cacaaacaaacaagctag

SEQ ID NO: 3761535 - DNA, 22 bp, Homo sapiens
cacaaagagagttaatcaactg

SEQ ID NO: 3761536 - DNA, 23 bp, Homo sapiens
cacaaatatttattttctttctg

SEQ ID NO: 3761537 - DNA, 15 bp, Homo sapiens
cacaaattatcttaa

SEQ ID NO: 3761538 - DNA, 12 bp, Homo sapiens
cacaacaaaaat

SEQ ID NO: 3761539 - DNA, 17 bp, Homo sapiens
cacaaccctgttttata

SEQ ID NO: 3761540 - DNA, 18 bp, Homo sapiens
cacaacctctctgatctt

SEQ ID NO: 3761541 - DNA, 17 bp, Homo sapiens
cacaaccttctgtggct

SEQ ID NO: 3761542 - DNA, 13 bp, Homo sapiens
cacaacttaaaaa

SEQ ID NO: 3761543 - DNA, 22 bp, Homo sapiens
cacaagattcccagagacagga

SEQ ID NO: 3761544 - DNA, 16 bp, Homo sapiens
cacaagctgcctccct

SEQ ID NO: 3761545 - DNA, 18 bp, Homo sapiens
cacaaggctgaccaagag

SEQ ID NO: 3761546 - DNA, 21 bp, Homo sapiens
cacaagtagatgcctgaactt

SEQ ID NO: 3761547 - DNA, 22 bp, Homo sapiens
cacaagtagatgcctgaacttg

SEQ ID NO: 3761548 - DNA, 19 bp, Homo sapiens
cacaataaatgtattcaaa

SEQ ID NO: 3761549 - DNA, 13 bp, Homo sapiens
cacaatacaataa

SEQ ID NO: 3761550 - DNA, 20 bp, Homo sapiens
cacaatcctaacacattatc

SEQ ID NO: 3761551 - DNA, 14 bp, Homo sapiens
cacacaaagagagt

SEQ ID NO: 3761552 - DNA, 14 bp, Homo sapiens
cacacaacaaaaat

SEQ ID NO: 3761553 - DNA, 14 bp, Homo sapiens
cacacacaaagaga

SEQ ID NO: 3761554 - DNA, 15 bp, Homo sapiens
cacacacaaagagag

SEQ ID NO: 3761555 - DNA, 13 bp, Homo sapiens
cacacacacacaa

SEQ ID NO: 3761556 - DNA, 15 bp, Homo sapiens
cacacacacacacag

SEQ ID NO: 3761557 - DNA, 13 bp, Homo sapiens
cacacacactcta

SEQ ID NO: 3761558 - DNA, 12 bp, Homo sapiens
cacacacagagg

SEQ ID NO: 3761559 - DNA, 21 bp, Homo sapiens
cacacacaggcaactgaggca

SEQ ID NO: 3761560 - DNA, 15 bp, Homo sapiens
cacacaccagagccc

SEQ ID NO: 3761561 - DNA, 20 bp, Homo sapiens
cacacaccagagcccacctt

SEQ ID NO: 3761562 - DNA, 22 bp, Homo sapiens
cacacagaggaagagcaggcac

SEQ ID NO: 3761563 - DNA, 13 bp, Homo sapiens
cacacagctctgt

SEQ ID NO: 3761564 - DNA, 14 bp, Homo sapiens
cacacagctctgtc

SEQ ID NO: 3761565 - DNA, 15 bp, Homo sapiens
cacacagctgcagag

SEQ ID NO: 3761566 - DNA, 23 bp, Homo sapiens
cacacagtattacttctgctaca

SEQ ID NO: 3761567 - DNA, 18 bp, Homo sapiens
cacacagtgagtcgagga

SEQ ID NO: 3761568 - DNA, 23 bp, Homo sapiens
cacacagtgagtcgaggacaggg

SEQ ID NO: 3761569 - DNA, 16 bp, Homo sapiens
atgaaggaaatgaacc

SEQ ID NO: 3761570 - DNA, 16 bp, Homo sapiens
atgaaggcaaaaaaat

SEQ ID NO: 3761571 - DNA, 19 bp, Homo sapiens
atgaaggtttctgaaaatt

SEQ ID NO: 3761572 - DNA, 19 bp, Homo sapiens
atgaagtgtgtttccttca

SEQ ID NO: 3761573 - DNA, 14 bp, Homo sapiens
atgaagtttataca

SEQ ID NO: 3761574 - DNA, 22 bp, Homo sapiens
atgaataatttcccaattagga

SEQ ID NO: 3761575 - DNA, 12 bp, Homo sapiens
atgaatatttat

SEQ ID NO: 3761576 - DNA, 15 bp, Homo sapiens
atgaatgcacactag

SEQ ID NO: 3761577 - DNA, 23 bp, Homo sapiens
atgaatggactcaaactgccttg

SEQ ID NO: 3761578 - DNA, 16 bp, Homo sapiens
atgaattaaataaacc

SEQ ID NO: 3761579 - DNA, 13 bp, Homo sapiens
atgaattaaattt

SEQ ID NO: 3761580 - DNA, 20 bp, Homo sapiens
atgaatttggagactctgtg

SEQ ID NO: 3761581 - DNA, 22 bp, Homo sapiens
atgaattttcaagtaattgtga

SEQ ID NO: 3761582 - DNA, 17 bp, Homo sapiens
atgacaaataagtggaa

SEQ ID NO: 3761583 - DNA, 16 bp, Homo sapiens
atgacaagccccaggc

SEQ ID NO: 3761584 - DNA, 20 bp, Homo sapiens
atgacaagccccaggcaggc

SEQ ID NO: 3761585 - DNA, 19 bp, Homo sapiens
atgacactcgtataagcat

SEQ ID NO: 3761586 - DNA, 14 bp, Homo sapiens
atgacactgaaatg

SEQ ID NO: 3761587 - DNA, 17 bp, Homo sapiens
atgacactgaaatgcct

SEQ ID NO: 3761588 - DNA, 21 bp, Homo sapiens
atgacagctgtccctgtcacc

SEQ ID NO: 3761589 - DNA, 23 bp, Homo sapiens
atgaccaatattatactaagaaa

SEQ ID NO: 3761590 - DNA, 20 bp, Homo sapiens
atgaccagaagggaaacagt

SEQ ID NO: 3761591 - DNA, 23 bp, Homo sapiens
atgaccctgcgaaggggccctgg

SEQ ID NO: 3761592 - DNA, 22 bp, Homo sapiens
atgacctcaccatttttgttct

SEQ ID NO: 3761593 - DNA, 19 bp, Homo sapiens
atgacctgtgaccagcact

SEQ ID NO: 3761594 - DNA, 21 bp, Homo sapiens
atgacgacaaagctgctaaat

SEQ ID NO: 3761595 - DNA, 15 bp, Homo sapiens
atgacggaagaacat

SEQ ID NO: 3761596 - DNA, 16 bp, Homo sapiens
atgacggaagaacata

SEQ ID NO: 3761597 - DNA, 21 bp, Homo sapiens
atgacggaagaacatagaact

SEQ ID NO: 3761598 - DNA, 14 bp, Homo sapiens
atgactaaagagag

SEQ ID NO: 3761599 - DNA, 20 bp, Homo sapiens
atgactaaagagagaatgta

SEQ ID NO: 3761600 - DNA, 21 bp, Homo sapiens
atgactaaagagagaatgtag

SEQ ID NO: 3761601 - DNA, 15 bp, Homo sapiens
atgactagaggcagg

SEQ ID NO: 3761602 - DNA, 17 bp, Homo sapiens
atgactcacatgatgca

SEQ ID NO: 3761603 - DNA, 15 bp, Homo sapiens
atgactggaattttt

SEQ ID NO: 3761604 - DNA, 13 bp, Homo sapiens
atgacttcccaac

SEQ ID NO: 3761605 - DNA, 14 bp, Homo sapiens
atgagaacagactg

SEQ ID NO: 3761606 - DNA, 21 bp, Homo sapiens
atgagacccattcctatttct

SEQ ID NO: 3761607 - DNA, 22 bp, Homo sapiens
atgagatctaagcctttccata

SEQ ID NO: 3761608 - DNA, 14 bp, Homo sapiens
atgagccagacaaa

SEQ ID NO: 3761609 - DNA, 16 bp, Homo sapiens
atgagcctcagcatcc

SEQ ID NO: 3761610 - DNA, 13 bp, Homo sapiens
atgagctccagac

SEQ ID NO: 3761611 - DNA, 21 bp, Homo sapiens
atgagctccagacccccagca

SEQ ID NO: 3761612 - DNA, 18 bp, Homo sapiens
atgagctttatgtaataa

SEQ ID NO: 3761613 - DNA, 22 bp, Homo sapiens
atgaggaggcagaaagcagagg

SEQ ID NO: 3761614 - DNA, 14 bp, Homo sapiens
atgaggagttgctg

SEQ ID NO: 3761615 - DNA, 21 bp, Homo sapiens
atgaggatgcagagtcagcag

SEQ ID NO: 3761616 - DNA, 22 bp, Homo sapiens
atgaggatgcagagtcagcaga

SEQ ID NO: 3761617 - DNA, 15 bp, Homo sapiens
atgaggtcagagcct

SEQ ID NO: 3761618 - DNA, 20 bp, Homo sapiens
atgaggtcagagcctgcagt

SEQ ID NO: 3761619 - DNA, 14 bp, Homo sapiens
atgaggtcccaggc

SEQ ID NO: 3761620 - DNA, 16 bp, Homo sapiens
atgaggtcccaggcag

SEQ ID NO: 3761621 - DNA, 20 bp, Homo sapiens
atgaggtcccaggcagagaa

SEQ ID NO: 3761622 - DNA, 14 bp, Homo sapiens
atgaggtctgaaat

SEQ ID NO: 3761623 - DNA, 15 bp, Homo sapiens
atgaggtgctgggag

SEQ ID NO: 3761624 - DNA, 19 bp, Homo sapiens
atgaggtgctgggagggat

SEQ ID NO: 3761625 - DNA, 22 bp, Homo sapiens
atgaggttcaactgttgattgc

SEQ ID NO: 3761626 - DNA, 17 bp, Homo sapiens
atgagtgtaacaagaaa

SEQ ID NO: 3761627 - DNA, 20 bp, Homo sapiens
atgagtgtaacaagaaagga

SEQ ID NO: 3761628 - DNA, 23 bp, Homo sapiens
atgagtgtaacaagaaaggagag

SEQ ID NO: 3761629 - DNA, 19 bp, Homo sapiens
atgagttgttttcagactc

SEQ ID NO: 3761630 - DNA, 23 bp, Homo sapiens
atgagttgttttcagactcagac

SEQ ID NO: 3761631 - DNA, 19 bp, Homo sapiens
atgagtttttgatagcttt

SEQ ID NO: 3761632 - DNA, 15 bp, Homo sapiens
atgataaaaaatttt

SEQ ID NO: 3761633 - DNA, 13 bp, Homo sapiens
atgatatgtaaac

SEQ ID NO: 3761634 - DNA, 22 bp, Homo sapiens
atgatatgtaaacataattctt

SEQ ID NO: 3761635 - DNA, 13 bp, Homo sapiens
atgatattgcata

SEQ ID NO: 3761636 - DNA, 20 bp, Homo sapiens
atgatatttttttaagtctt

SEQ ID NO: 3761637 - DNA, 15 bp, Homo sapiens
atgatcacggctcac

SEQ ID NO: 3761638 - DNA, 19 bp, Homo sapiens
atgatcacggctcactgca

SEQ ID NO: 3761639 - DNA, 21 bp, Homo sapiens
atgatccatgagtttgccctg

SEQ ID NO: 3761640 - DNA, 15 bp, Homo sapiens
atgatcttctttata

SEQ ID NO: 3761641 - DNA, 15 bp, Homo sapiens
atgatgatcctaggc

SEQ ID NO: 3761642 - DNA, 20 bp, Homo sapiens
atgatgatgtggaagaactt

SEQ ID NO: 3761643 - DNA, 17 bp, Homo sapiens
atgatggagcgcacctg

SEQ ID NO: 3761644 - DNA, 19 bp, Homo sapiens
atgattaaccacttcagct

SEQ ID NO: 3761645 - DNA, 19 bp, Homo sapiens
atgattactctttgagata

SEQ ID NO: 3761646 - DNA, 15 bp, Homo sapiens
atgattagtaaagaa

SEQ ID NO: 3761647 - DNA, 23 bp, Homo sapiens
atgattcgcccaaagccagacag

SEQ ID NO: 3761648 - DNA, 14 bp, Homo sapiens
atgatttactcatt

SEQ ID NO: 3761649 - DNA, 20 bp, Homo sapiens
atgatttccaaagagaaaaa

SEQ ID NO: 3761650 - DNA, 15 bp, Homo sapiens
atgcaaagaaaatca

SEQ ID NO: 3761651 - DNA, 15 bp, Homo sapiens
atgcaaagaggcaag

SEQ ID NO: 3761652 - DNA, 16 bp, Homo sapiens
atgcaaagaggcaaga

SEQ ID NO: 3761653 - DNA, 14 bp, Homo sapiens
atgcaaattctcaa

SEQ ID NO: 3761654 - DNA, 14 bp, Homo sapiens
atgcaacaacatgt

SEQ ID NO: 3761655 - DNA, 13 bp, Homo sapiens
atgcaaggaagga

SEQ ID NO: 3761656 - DNA, 15 bp, Homo sapiens
atgcaaggaccagga

SEQ ID NO: 3761657 - DNA, 22 bp, Homo sapiens
atgcaaggaccaggactccctc

SEQ ID NO: 3761658 - DNA, 15 bp, Homo sapiens
atgcaataaataaca

SEQ ID NO: 3761659 - DNA, 23 bp, Homo sapiens
atgcaatgagatagaagatgttt

SEQ ID NO: 3761660 - DNA, 16 bp, Homo sapiens
atgcaatgtgctactg

SEQ ID NO: 3761661 - DNA, 16 bp, Homo sapiens
atgcacaatgtcttgg

SEQ ID NO: 3761662 - DNA, 21 bp, Homo sapiens
atgcacacagtgctttccgtg

SEQ ID NO: 3761663 - DNA, 12 bp, Homo sapiens
atgcacagctgt

SEQ ID NO: 3761664 - DNA, 13 bp, Homo sapiens
atgcacatttcat

SEQ ID NO: 3761665 - DNA, 13 bp, Homo sapiens
atgcaccagccct

SEQ ID NO: 3761666 - DNA, 20 bp, Homo sapiens
atgcaccctcatacacagaa

SEQ ID NO: 3761667 - DNA, 22 bp, Homo sapiens
atgcacgtgtgcacacacacca

SEQ ID NO: 3761668 - DNA, 16 bp, Homo sapiens
atgcagagtcagcaga

SEQ ID NO: 3761669 - DNA, 17 bp, Homo sapiens
atgcagagtcagcagaa

SEQ ID NO: 3761670 - DNA, 12 bp, Homo sapiens
atgcagatgcca

SEQ ID NO: 3761671 - DNA, 14 bp, Homo sapiens
atgcagatgccaga

SEQ ID NO: 3761672 - DNA, 21 bp, Homo sapiens
atgcagcccatgcccacctgc

SEQ ID NO: 3761673 - DNA, 23 bp, Homo sapiens
atgcagcccatgcccacctgccc

SEQ ID NO: 3761674 - DNA, 22 bp, Homo sapiens
atgcagcgaaccaatatttgta

SEQ ID NO: 3761675 - DNA, 17 bp, Homo sapiens
atgcaggggcaaacacc

SEQ ID NO: 3761676 - DNA, 16 bp, Homo sapiens
atgcagtgaattgtga

SEQ ID NO: 3761677 - DNA, 19 bp, Homo sapiens
atgcataactgacaaatca

SEQ ID NO: 3761678 - DNA, 20 bp, Homo sapiens
atgcataactgacaaatcaa

SEQ ID NO: 3761679 - DNA, 22 bp, Homo sapiens
atgcataactgacaaatcaagt

SEQ ID NO: 3761680 - DNA, 22 bp, Homo sapiens
atgcatagttcccatgttaaat

SEQ ID NO: 3761681 - DNA, 17 bp, Homo sapiens
atgcatcatttcaggag

SEQ ID NO: 3761682 - DNA, 23 bp, Homo sapiens
atgcatcatttcaggagttactg

SEQ ID NO: 3761683 - DNA, 14 bp, Homo sapiens
atgcatccattcct

SEQ ID NO: 3761684 - DNA, 18 bp, Homo sapiens
atgcatccattcctcagg

SEQ ID NO: 3761685 - DNA, 22 bp, Homo sapiens
atgcatccattcctcagggaca

SEQ ID NO: 3761686 - DNA, 22 bp, Homo sapiens
atgcatctcactggatgcaaag

SEQ ID NO: 3761687 - DNA, 23 bp, Homo sapiens
atgcatggagggctgccctgtac

SEQ ID NO: 3761688 - DNA, 21 bp, Homo sapiens
atgcatggcagcaggcctgtt

SEQ ID NO: 3761689 - DNA, 21 bp, Homo sapiens
atgcattataggatcatttgt

SEQ ID NO: 3761690 - DNA, 22 bp, Homo sapiens
atgcattataggatcatttgtt

SEQ ID NO: 3761691 - DNA, 15 bp, Homo sapiens
atgcattgttgaggt

SEQ ID NO: 3761692 - DNA, 12 bp, Homo sapiens
atgcattttgca

SEQ ID NO: 3761693 - DNA, 18 bp, Homo sapiens
atgccaaagctagggtgg

SEQ ID NO: 3761694 - DNA, 19 bp, Homo sapiens
atgccaccctgttttcagc

SEQ ID NO: 3761695 - DNA, 18 bp, Homo sapiens
atgccagctcagtcccat

SEQ ID NO: 3761696 - DNA, 17 bp, Homo sapiens
atgccatctgtgggcac

SEQ ID NO: 3761697 - DNA, 19 bp, Homo sapiens
atgccatctgtgtcctggt

SEQ ID NO: 3761698 - DNA, 12 bp, Homo sapiens
atgccatttgtt

SEQ ID NO: 3761699 - DNA, 15 bp, Homo sapiens
atgccatttgtttat

SEQ ID NO: 3761700 - DNA, 22 bp, Homo sapiens
atgcccagagggcccaggcagg

SEQ ID NO: 3761701 - DNA, 17 bp, Homo sapiens
atgcccagggccactct

SEQ ID NO: 3761702 - DNA, 15 bp, Homo sapiens
atgccccagagctgt

SEQ ID NO: 3761703 - DNA, 13 bp, Homo sapiens
atgcctccaccgc

SEQ ID NO: 3761704 - DNA, 15 bp, Homo sapiens
atgcctgaacttgaa

SEQ ID NO: 3761705 - DNA, 12 bp, Homo sapiens
atgcctggtggc

SEQ ID NO: 3761706 - DNA, 13 bp, Homo sapiens
atgcctggtggca

SEQ ID NO: 3761707 - DNA, 18 bp, Homo sapiens
atgccttccagcaccctg

SEQ ID NO: 3761708 - DNA, 16 bp, Homo sapiens
atgcctttgtaagtta

SEQ ID NO: 3761709 - DNA, 23 bp, Homo sapiens
atgctaaaggttgtattgcatat

SEQ ID NO: 3761710 - DNA, 22 bp, Homo sapiens
atgctaacagttcacttgcagt

SEQ ID NO: 3761711 - DNA, 23 bp, Homo sapiens
atgctaacagttcacttgcagtg

SEQ ID NO: 3761712 - DNA, 18 bp, Homo sapiens
atgctcaggtacagagaa

SEQ ID NO: 3761713 - DNA, 19 bp, Homo sapiens
atgctcaggtacagagaag

SEQ ID NO: 3761714 - DNA, 21 bp, Homo sapiens
atgctccagccaacccctgtg

SEQ ID NO: 3761715 - DNA, 15 bp, Homo sapiens
atgctcccccatcct

SEQ ID NO: 3761716 - DNA, 20 bp, Homo sapiens
atgctcccccatcctcccct

SEQ ID NO: 3761717 - DNA, 22 bp, Homo sapiens
atgctcccccatcctccccttc

SEQ ID NO: 3761718 - DNA, 14 bp, Homo sapiens
atgctccctcccct

SEQ ID NO: 3761719 - DNA, 22 bp, Homo sapiens
atgctctctgcagccagcccag

SEQ ID NO: 3761720 - DNA, 15 bp, Homo sapiens
atgctctgcatgtta

SEQ ID NO: 3761721 - DNA, 16 bp, Homo sapiens
atgctctttacttcat

SEQ ID NO: 3761722 - DNA, 18 bp, Homo sapiens
atgctgaaacaggagaga

SEQ ID NO: 3761723 - DNA, 20 bp, Homo sapiens
atgctgactgtactcctccc

SEQ ID NO: 3761724 - DNA, 20 bp, Homo sapiens
atgctgctttaattgtgaat

SEQ ID NO: 3761725 - DNA, 23 bp, Homo sapiens
atgctggacaggtctgggagagg

SEQ ID NO: 3761726 - DNA, 11 bp, Homo sapiens
atgctggagcg

SEQ ID NO: 3761727 - DNA, 23 bp, Homo sapiens
atgctggcatttgcacctacctc

SEQ ID NO: 3761728 - DNA, 19 bp, Homo sapiens
atgctggctcccagggcca

SEQ ID NO: 3761729 - DNA, 14 bp, Homo sapiens
atgctggtgagcca

SEQ ID NO: 3761730 - DNA, 22 bp, Homo sapiens
atgctgtcaactatgatatggt

SEQ ID NO: 3761731 - DNA, 17 bp, Homo sapiens
atgctgtgctatgaatt

SEQ ID NO: 3761732 - DNA, 15 bp, Homo sapiens
atgctgttgcctcat

SEQ ID NO: 3761733 - DNA, 16 bp, Homo sapiens
atgctgttgcctcatc

SEQ ID NO: 3761734 - DNA, 14 bp, Homo sapiens
atgctgtttcagag

SEQ ID NO: 3761735 - DNA, 16 bp, Homo sapiens
atgcttattttaaaat

SEQ ID NO: 3761736 - DNA, 15 bp, Homo sapiens
atgcttcatgaaaat

SEQ ID NO: 3761737 - DNA, 22 bp, Homo sapiens
atgcttcatgaaaatcctacca

SEQ ID NO: 3761738 - DNA, 16 bp, Homo sapiens
atgcttctcactgcca

SEQ ID NO: 3761739 - DNA, 17 bp, Homo sapiens
atgcttctgacttcata

SEQ ID NO: 3761740 - DNA, 16 bp, Homo sapiens
atgcttgcctagggcc

SEQ ID NO: 3761741 - DNA, 21 bp, Homo sapiens
atgcttgcctagggcctggtc

SEQ ID NO: 3761742 - DNA, 23 bp, Homo sapiens
atgcttgcctagggcctggtcca

SEQ ID NO: 3761743 - DNA, 21 bp, Homo sapiens
atgcttgtaacaagaaaacat

SEQ ID NO: 3761744 - DNA, 12 bp, Homo sapiens
atggaaaaggaa

SEQ ID NO: 3761745 - DNA, 21 bp, Homo sapiens
atggaaaagtcttcaagggct

SEQ ID NO: 3761746 - DNA, 22 bp, Homo sapiens
atggaaacaaagtggaaggaaa

SEQ ID NO: 3761747 - DNA, 23 bp, Homo sapiens
atggaacccttttggcccccgag

SEQ ID NO: 3761748 - DNA, 17 bp, Homo sapiens
atggaaccgcaggaagc

SEQ ID NO: 3761749 - DNA, 20 bp, Homo sapiens
atggaaccgcaggaagctgc

SEQ ID NO: 3761750 - DNA, 17 bp, Homo sapiens
atggaagattttaaatt

SEQ ID NO: 3761751 - DNA, 17 bp, Homo sapiens
atggaaggtttgtatat

SEQ ID NO: 3761752 - DNA, 15 bp, Homo sapiens
atggaatacagtgtt

SEQ ID NO: 3761753 - DNA, 22 bp, Homo sapiens
atggaatacagtgttattttct

SEQ ID NO: 3761754 - DNA, 15 bp, Homo sapiens
atggacctaacattc

SEQ ID NO: 3761755 - DNA, 14 bp, Homo sapiens
atggactctacact

SEQ ID NO: 3761756 - DNA, 13 bp, Homo sapiens
atggagagagggg

SEQ ID NO: 3761757 - DNA, 15 bp, Homo sapiens
atggagagaggggaa

SEQ ID NO: 3761758 - DNA, 23 bp, Homo sapiens
atggagcgcacctgccccctggt

SEQ ID NO: 3761759 - DNA, 16 bp, Homo sapiens
atggaggaaaaccaag

SEQ ID NO: 3761760 - DNA, 15 bp, Homo sapiens
atggaggagaagaat

SEQ ID NO: 3761761 - DNA, 17 bp, Homo sapiens
atggaggagaagaattt

SEQ ID NO: 3761762 - DNA, 15 bp, Homo sapiens
atggaggaggaggca

SEQ ID NO: 3761763 - DNA, 12 bp, Homo sapiens
atggaggcctgt

SEQ ID NO: 3761764 - DNA, 16 bp, Homo sapiens
atggagggaataatac

SEQ ID NO: 3761765 - DNA, 20 bp, Homo sapiens
atggaggggtggtcctgact

SEQ ID NO: 3761766 - DNA, 18 bp, Homo sapiens
atggagtagacccctggc

SEQ ID NO: 3761767 - DNA, 18 bp, Homo sapiens
atggagtgtgtattgttc

SEQ ID NO: 3761768 - DNA, 21 bp, Homo sapiens
atggagtgtgtattgttccca

SEQ ID NO: 3761769 - DNA, 22 bp, Homo sapiens
atggatccccagtgaaaactag

SEQ ID NO: 3761770 - DNA, 14 bp, Homo sapiens
atggatggcttcta

SEQ ID NO: 3761771 - DNA, 16 bp, Homo sapiens
atggattctcagatat

SEQ ID NO: 3761772 - DNA, 18 bp, Homo sapiens
atggatttccagccaaag

SEQ ID NO: 3761773 - DNA, 13 bp, Homo sapiens
atggccctctggt

SEQ ID NO: 3761774 - DNA, 21 bp, Homo sapiens
atggccgggcgcggtggctca

SEQ ID NO: 3761775 - DNA, 15 bp, Homo sapiens
atggcctcagctgcc

SEQ ID NO: 3761776 - DNA, 18 bp, Homo sapiens
atggcctcagctgcctca

SEQ ID NO: 3761777 - DNA, 21 bp, Homo sapiens
atggctaagcttaaaaaaaac

SEQ ID NO: 3761778 - DNA, 17 bp, Homo sapiens
atggctaaggcaccagc

SEQ ID NO: 3761779 - DNA, 18 bp, Homo sapiens
atggctaatgtactgcat

SEQ ID NO: 3761780 - DNA, 22 bp, Homo sapiens
atggctccagtctgctgccctc

SEQ ID NO: 3761781 - DNA, 17 bp, Homo sapiens
atggctgtgcctctgcc

SEQ ID NO: 3761782 - DNA, 20 bp, Homo sapiens
atgggaaatgcctaagaaga

SEQ ID NO: 3761783 - DNA, 17 bp, Homo sapiens
atgggaaggagggaggt

SEQ ID NO: 3761784 - DNA, 14 bp, Homo sapiens
atgggactgggagg

SEQ ID NO: 3761785 - DNA, 15 bp, Homo sapiens
atgggactgggaggg

SEQ ID NO: 3761786 - DNA, 20 bp, Homo sapiens
atgggagctggttagaaatg

SEQ ID NO: 3761787 - DNA, 21 bp, Homo sapiens
atgggagctggttagaaatgc

SEQ ID NO: 3761788 - DNA, 23 bp, Homo sapiens
atgggattcagtgcttcttaaag

SEQ ID NO: 3761789 - DNA, 15 bp, Homo sapiens
atgggcctcctgtgt

SEQ ID NO: 3761790 - DNA, 17 bp, Homo sapiens
atgggcctcctgtgtgt

SEQ ID NO: 3761791 - DNA, 18 bp, Homo sapiens
atgggcctcctgtgtgtg

SEQ ID NO: 3761792 - DNA, 23 bp, Homo sapiens
atggggagatcggggccagaggc

SEQ ID NO: 3761793 - DNA, 17 bp, Homo sapiens
atggggccacagccaga

SEQ ID NO: 3761794 - DNA, 14 bp, Homo sapiens
atgggggatgcttc

SEQ ID NO: 3761795 - DNA, 22 bp, Homo sapiens
atggggggccaacaccagggat

SEQ ID NO: 3761796 - DNA, 21 bp, Homo sapiens
atggggttggctgggcccaga

SEQ ID NO: 3761797 - DNA, 12 bp, Homo sapiens
atgggtgtgtgt

SEQ ID NO: 3761798 - DNA, 14 bp, Homo sapiens
atgggttgcatttg

SEQ ID NO: 3761799 - DNA, 16 bp, Homo sapiens
atggtaaaattgcatg

SEQ ID NO: 3761800 - DNA, 17 bp, Homo sapiens
atggtaaaattgcatgg

SEQ ID NO: 3761801 - DNA, 14 bp, Homo sapiens
atggtaattgttgc

SEQ ID NO: 3761802 - DNA, 20 bp, Homo sapiens
atggtaatttatagtttata

SEQ ID NO: 3761803 - DNA, 19 bp, Homo sapiens
atggtagtctaaccaaatg

SEQ ID NO: 3761804 - DNA, 19 bp, Homo sapiens
atggtataatggttgactg

SEQ ID NO: 3761805 - DNA, 20 bp, Homo sapiens
atggtcaacacttaagggtt

SEQ ID NO: 3761806 - DNA, 18 bp, Homo sapiens
atggtcagacacaaacaa

SEQ ID NO: 3761807 - DNA, 15 bp, Homo sapiens
atggtccggtgtcct

SEQ ID NO: 3761808 - DNA, 14 bp, Homo sapiens
atggtcgcccagga

SEQ ID NO: 3761809 - DNA, 20 bp, Homo sapiens
atggtgaaaccccatctcta

SEQ ID NO: 3761810 - DNA, 15 bp, Homo sapiens
atggtgagcagcgga

SEQ ID NO: 3761811 - DNA, 16 bp, Homo sapiens
atggtgatgaaatgta

SEQ ID NO: 3761812 - DNA, 14 bp, Homo sapiens
atggtgcctctgga

SEQ ID NO: 3761813 - DNA, 12 bp, Homo sapiens
atggtggctggg

SEQ ID NO: 3761814 - DNA, 17 bp, Homo sapiens
atggtggctgggttgga

SEQ ID NO: 3761815 - DNA, 18 bp, Homo sapiens
atggtgtgaaagtcagat

SEQ ID NO: 3761816 - DNA, 13 bp, Homo sapiens
atggttacactgt

SEQ ID NO: 3761817 - DNA, 15 bp, Homo sapiens
atggttacactgtta

SEQ ID NO: 3761818 - DNA, 17 bp, Homo sapiens
atggttacactgttaga

SEQ ID NO: 3761819 - DNA, 20 bp, Homo sapiens
atggttcccctgttcactct

SEQ ID NO: 3761820 - DNA, 19 bp, Homo sapiens
atggttgagaaatgaataa

SEQ ID NO: 3761821 - DNA, 16 bp, Homo sapiens
atggttttcaaaataa

SEQ ID NO: 3761822 - DNA, 13 bp, Homo sapiens
atgtaaaacaaaa

SEQ ID NO: 3761823 - DNA, 19 bp, Homo sapiens
atgtaaaattttgcctaat

SEQ ID NO: 3761824 - DNA, 20 bp, Homo sapiens
atgtaaacagtgcctgctga

SEQ ID NO: 3761825 - DNA, 19 bp, Homo sapiens
atgtaaagacaaaaaacta

SEQ ID NO: 3761826 - DNA, 21 bp, Homo sapiens
atgtaaataaaggatttctag

SEQ ID NO: 3761827 - DNA, 22 bp, Homo sapiens
atgtaaataaccccattctttg

SEQ ID NO: 3761828 - DNA, 23 bp, Homo sapiens
atgtaaattaccagtaaagtgta

SEQ ID NO: 3761829 - DNA, 20 bp, Homo sapiens
atgtaactgcattgagaact

SEQ ID NO: 3761830 - DNA, 19 bp, Homo sapiens
atgtaataaaaagtatatg

SEQ ID NO: 3761831 - DNA, 15 bp, Homo sapiens
atgtaattaagtact

SEQ ID NO: 3761832 - DNA, 21 bp, Homo sapiens
atgtacaaaataaagttacat

SEQ ID NO: 3761833 - DNA, 14 bp, Homo sapiens
atgtacaatatttt

SEQ ID NO: 3761834 - DNA, 19 bp, Homo sapiens
atgtacaatattttaagca

SEQ ID NO: 3761835 - DNA, 20 bp, Homo sapiens
atgtacatttccaaattcac

SEQ ID NO: 3761836 - DNA, 21 bp, Homo sapiens
atgtacctcttttagtcattt

SEQ ID NO: 3761837 - DNA, 20 bp, Homo sapiens
atgtactcctctttacactg

SEQ ID NO: 3761838 - DNA, 16 bp, Homo sapiens
atgtactgtagttttt

SEQ ID NO: 3761839 - DNA, 19 bp, Homo sapiens
atgtactgtagtttttctt

SEQ ID NO: 3761840 - DNA, 18 bp, Homo sapiens
atgtagataaactcagaa

SEQ ID NO: 3761841 - DNA, 19 bp, Homo sapiens
atgtagataaactcagaaa

SEQ ID NO: 3761842 - DNA, 20 bp, Homo sapiens
atgtagcaaaacgcatggag

SEQ ID NO: 3761843 - DNA, 18 bp, Homo sapiens
atgtagggtaaggtgcct

SEQ ID NO: 3761844 - DNA, 17 bp, Homo sapiens
atgtaggtatgaataag

SEQ ID NO: 3761845 - DNA, 17 bp, Homo sapiens
atgtagtataaagaaaa

SEQ ID NO: 3761846 - DNA, 19 bp, Homo sapiens
atgtatatttaaaagaaag

SEQ ID NO: 3761847 - DNA, 13 bp, Homo sapiens
atgtatcaggaaa

SEQ ID NO: 3761848 - DNA, 21 bp, Homo sapiens
atgtatcaggaaatatatatg

SEQ ID NO: 3761849 - DNA, 16 bp, Homo sapiens
atgtatcatagaaatg

SEQ ID NO: 3761850 - DNA, 17 bp, Homo sapiens
atgtatcatagaaatgt

SEQ ID NO: 3761851 - DNA, 15 bp, Homo sapiens
atgtatccagtacat

SEQ ID NO: 3761852 - DNA, 20 bp, Homo sapiens
atgtatccatgggggcaggg

SEQ ID NO: 3761853 - DNA, 15 bp, Homo sapiens
atgtatctgagcagg

SEQ ID NO: 3761854 - DNA, 19 bp, Homo sapiens
atgtatgaggaatttctgt

SEQ ID NO: 3761855 - DNA, 14 bp, Homo sapiens
atgtatgattacat

SEQ ID NO: 3761856 - DNA, 20 bp, Homo sapiens
atgtatggaatacagtgtta

SEQ ID NO: 3761857 - DNA, 21 bp, Homo sapiens
atgtatggaatacagtgttat

SEQ ID NO: 3761858 - DNA, 14 bp, Homo sapiens
atgtatgtaaaaat

SEQ ID NO: 3761859 - DNA, 15 bp, Homo sapiens
atgtatgtaaaaatg

SEQ ID NO: 3761860 - DNA, 20 bp, Homo sapiens
atgtatgtttacactgtcaa

SEQ ID NO: 3761861 - DNA, 21 bp, Homo sapiens
atgtatgtttacactgtcaaa

SEQ ID NO: 3761862 - DNA, 16 bp, Homo sapiens
atgtattattctgcag

SEQ ID NO: 3761863 - DNA, 20 bp, Homo sapiens
atgtattattctgcagcatg

SEQ ID NO: 3761864 - DNA, 17 bp, Homo sapiens
atgtcaaggtgctgttg

SEQ ID NO: 3761865 - DNA, 16 bp, Homo sapiens
atgtcaccaccttccc

SEQ ID NO: 3761866 - DNA, 19 bp, Homo sapiens
atgtcaccaccttcccagc

SEQ ID NO: 3761867 - DNA, 16 bp, Homo sapiens
atgtcactaaagcagg

SEQ ID NO: 3761868 - DNA, 16 bp, Homo sapiens
atgtcagactggctgg

SEQ ID NO: 3761869 - DNA, 14 bp, Homo sapiens
atgtcagattcctt

SEQ ID NO: 3761870 - DNA, 14 bp, Homo sapiens
atgtcatcccattg

SEQ ID NO: 3761871 - DNA, 20 bp, Homo sapiens
atgtcattaaaataaataaa

SEQ ID NO: 3761872 - DNA, 13 bp, Homo sapiens
atgtcattaaatg

SEQ ID NO: 3761873 - DNA, 16 bp, Homo sapiens
atgtccctttcttggc

SEQ ID NO: 3761874 - DNA, 17 bp, Homo sapiens
atgtcctccttgttcta

SEQ ID NO: 3761875 - DNA, 17 bp, Homo sapiens
atgtctcaggtccctgc

SEQ ID NO: 3761876 - DNA, 21 bp, Homo sapiens
atgtctctcagaattcttcag

SEQ ID NO: 3761877 - DNA, 19 bp, Homo sapiens
atgtcttgggtaggcggga

SEQ ID NO: 3761878 - DNA, 17 bp, Homo sapiens
atgtctttggtcctctt

SEQ ID NO: 3761879 - DNA, 21 bp, Homo sapiens
atgtctttggtcctcttgcca

SEQ ID NO: 3761880 - DNA, 23 bp, Homo sapiens
atgtctttttaagcttatttaat

SEQ ID NO: 3761881 - DNA, 19 bp, Homo sapiens
atgtctttttttctgttaa

SEQ ID NO: 3761882 - DNA, 23 bp, Homo sapiens
atgtgaagggaaggaagaggaag

SEQ ID NO: 3761883 - DNA, 15 bp, Homo sapiens
atgtgaatcagaccc

SEQ ID NO: 3761884 - DNA, 16 bp, Homo sapiens
atgtgaatcagaccct

SEQ ID NO: 3761885 - DNA, 16 bp, Homo sapiens
atgtgacaggtaaact

SEQ ID NO: 3761886 - DNA, 19 bp, Homo sapiens
atgtgacatgcgggctggg

SEQ ID NO: 3761887 - DNA, 19 bp, Homo sapiens
atgtgagccaccgctgcca

SEQ ID NO: 3761888 - DNA, 22 bp, Homo sapiens
atgtgagtgtgtgtttgtgctg

SEQ ID NO: 3761889 - DNA, 20 bp, Homo sapiens
atgtgataaggatcagaaca

SEQ ID NO: 3761890 - DNA, 17 bp, Homo sapiens
atgtgcaaaaatttttg

SEQ ID NO: 3761891 - DNA, 16 bp, Homo sapiens
atgtgcaagtgtatgc

SEQ ID NO: 3761892 - DNA, 19 bp, Homo sapiens
atgtgcccagttaatcttg

SEQ ID NO: 3761893 - DNA, 12 bp, Homo sapiens
atgtgcccccag

SEQ ID NO: 3761894 - DNA, 22 bp, Homo sapiens
atgtgcctgcaccaggagacag

SEQ ID NO: 3761895 - DNA, 18 bp, Homo sapiens
atgtgcgtgtgtgcaagt

SEQ ID NO: 3761896 - DNA, 15 bp, Homo sapiens
atgtggaaagtgaat

SEQ ID NO: 3761897 - DNA, 22 bp, Homo sapiens
atgtggcccctgaacaagaatt

SEQ ID NO: 3761898 - DNA, 19 bp, Homo sapiens
atgtggcctaaaaatgcaa

SEQ ID NO: 3761899 - DNA, 15 bp, Homo sapiens
atgtgggaagaaaca

SEQ ID NO: 3761900 - DNA, 20 bp, Homo sapiens
atgtgggctagttgggcttc

SEQ ID NO: 3761901 - DNA, 15 bp, Homo sapiens
atgtgggtgagccag

SEQ ID NO: 3761902 - DNA, 13 bp, Homo sapiens
atgtgtaagtatt

SEQ ID NO: 3761903 - DNA, 20 bp, Homo sapiens
atgtgtatttccagtgcaat

SEQ ID NO: 3761904 - DNA, 17 bp, Homo sapiens
atgtgtattttattaca

SEQ ID NO: 3761905 - DNA, 21 bp, Homo sapiens
atgtgtcactactcacagtct

SEQ ID NO: 3761906 - DNA, 13 bp, Homo sapiens
atgtgtgagtgtg

SEQ ID NO: 3761907 - DNA, 16 bp, Homo sapiens
atgtgtgagtgtgtgc

SEQ ID NO: 3761908 - DNA, 18 bp, Homo sapiens
atgtgtgcgagtgtgtgc

SEQ ID NO: 3761909 - DNA, 17 bp, Homo sapiens
atgtgtgtatatgtatg

SEQ ID NO: 3761910 - DNA, 13 bp, Homo sapiens
atgtgtgtgtatg

SEQ ID NO: 3761911 - DNA, 16 bp, Homo sapiens
atgtgtgtgtatgcta

SEQ ID NO: 3761912 - DNA, 21 bp, Homo sapiens
atgtgtgtgtatgctactaca

SEQ ID NO: 3761913 - DNA, 18 bp, Homo sapiens
atgttaaatcccattcat

SEQ ID NO: 3761914 - DNA, 19 bp, Homo sapiens
atgttacataagataaatg

SEQ ID NO: 3761915 - DNA, 23 bp, Homo sapiens
atgttacatagtgtaggctttac

SEQ ID NO: 3761916 - DNA, 15 bp, Homo sapiens
atgttaggctgggcc

SEQ ID NO: 3761917 - DNA, 14 bp, Homo sapiens
atgttatagtgaat

SEQ ID NO: 3761918 - DNA, 20 bp, Homo sapiens
atgttatgataaaaaatttt

SEQ ID NO: 3761919 - DNA, 21 bp, Homo sapiens
atgttatgataaaaaattttg

SEQ ID NO: 3761920 - DNA, 22 bp, Homo sapiens
atgttatgataaaaaattttgt

SEQ ID NO: 3761921 - DNA, 13 bp, Homo sapiens
atgttattgaaaa

SEQ ID NO: 3761922 - DNA, 18 bp, Homo sapiens
atgttattttctgttgaa

SEQ ID NO: 3761923 - DNA, 19 bp, Homo sapiens
atgttattttttaattatt

SEQ ID NO: 3761924 - DNA, 20 bp, Homo sapiens
atgttattttttaattatta

SEQ ID NO: 3761925 - DNA, 23 bp, Homo sapiens
atgttcaaagtcaaataactcct

SEQ ID NO: 3761926 - DNA, 22 bp, Homo sapiens
atgttcaactggagacactatt

SEQ ID NO: 3761927 - DNA, 23 bp, Homo sapiens
atgttcagaaggttgctctagat

SEQ ID NO: 3761928 - DNA, 14 bp, Homo sapiens
atgttcattgtaat

SEQ ID NO: 3761929 - DNA, 21 bp, Homo sapiens
atgttcattgtaatgttactg

SEQ ID NO: 3761930 - DNA, 23 bp, Homo sapiens
atgttcattgtaatgttactgat

SEQ ID NO: 3761931 - DNA, 13 bp, Homo sapiens
atgttctctgagg

SEQ ID NO: 3761932 - DNA, 14 bp, Homo sapiens
atgttctgacatta

SEQ ID NO: 3761933 - DNA, 13 bp, Homo sapiens
atgttctggccct

SEQ ID NO: 3761934 - DNA, 14 bp, Homo sapiens
atgttctgggacac

SEQ ID NO: 3761935 - DNA, 21 bp, Homo sapiens
atgttctgtgcctgtaaacat

SEQ ID NO: 3761936 - DNA, 18 bp, Homo sapiens
atgttgaaagatcaaaag

SEQ ID NO: 3761937 - DNA, 14 bp, Homo sapiens
atgttgagggaaca

SEQ ID NO: 3761938 - DNA, 20 bp, Homo sapiens
atgttgagggaacagacagg

SEQ ID NO: 3761939 - DNA, 16 bp, Homo sapiens
atgttggccaggctgg

SEQ ID NO: 3761940 - DNA, 14 bp, Homo sapiens
atgttgttatttaa

SEQ ID NO: 3761941 - DNA, 21 bp, Homo sapiens
atgtttaaaaaagtttaaaat

SEQ ID NO: 3761942 - DNA, 22 bp, Homo sapiens
atgtttacactctttgtaagag

SEQ ID NO: 3761943 - DNA, 22 bp, Homo sapiens
atgtttacaggtggacacacaa

SEQ ID NO: 3761944 - DNA, 15 bp, Homo sapiens
atgtttatgagccag

SEQ ID NO: 3761945 - DNA, 18 bp, Homo sapiens
atgtttcttaaatgggct

SEQ ID NO: 3761946 - DNA, 14 bp, Homo sapiens
atgtttgcctctgc

SEQ ID NO: 3761947 - DNA, 17 bp, Homo sapiens
atgtttgcctctgcctc

SEQ ID NO: 3761948 - DNA, 19 bp, Homo sapiens
atgtttgcctctgcctctg

SEQ ID NO: 3761949 - DNA, 19 bp, Homo sapiens
atgtttgctcagaacacat

SEQ ID NO: 3761950 - DNA, 18 bp, Homo sapiens
atgtttggtgaactatat

SEQ ID NO: 3761951 - DNA, 16 bp, Homo sapiens
atgtttgtggcctcag

SEQ ID NO: 3761952 - DNA, 20 bp, Homo sapiens
atgttttaaatatagaattt

SEQ ID NO: 3761953 - DNA, 13 bp, Homo sapiens
atgttttgcaaac

SEQ ID NO: 3761954 - DNA, 14 bp, Homo sapiens
atgttttgtttctg

SEQ ID NO: 3761955 - DNA, 19 bp, Homo sapiens
atgttttgtttctgaaaat

SEQ ID NO: 3761956 - DNA, 20 bp, Homo sapiens
atgttttgtttctgaaaatt

SEQ ID NO: 3761957 - DNA, 21 bp, Homo sapiens
atgttttgtttctgaaaattc

SEQ ID NO: 3761958 - DNA, 21 bp, Homo sapiens
atgtttttctgccagggagct

SEQ ID NO: 3761959 - DNA, 17 bp, Homo sapiens
atgtttttcttctccct

SEQ ID NO: 3761960 - DNA, 16 bp, Homo sapiens
atgttttttattatgc

SEQ ID NO: 3761961 - DNA, 14 bp, Homo sapiens
attaaaacaatatt

SEQ ID NO: 3761962 - DNA, 21 bp, Homo sapiens
attaaaacaatattgtttcta

SEQ ID NO: 3761963 - DNA, 19 bp, Homo sapiens
attaaaataaataaatgca

SEQ ID NO: 3761964 - DNA, 13 bp, Homo sapiens
attaaaatcttaa

SEQ ID NO: 3761965 - DNA, 11 bp, Homo sapiens
attaaacaatt

SEQ ID NO: 3761966 - DNA, 19 bp, Homo sapiens
attaaacaatttattttat

SEQ ID NO: 3761967 - DNA, 13 bp, Homo sapiens
attaaattaggaa

SEQ ID NO: 3761968 - DNA, 11 bp, Homo sapiens
attaaattatg

SEQ ID NO: 3761969 - DNA, 11 bp, Homo sapiens
attaacactgc

SEQ ID NO: 3761970 - DNA, 16 bp, Homo sapiens
attaacagttttccat

SEQ ID NO: 3761971 - DNA, 21 bp, Homo sapiens
attaacattgggaaatcttat

SEQ ID NO: 3761972 - DNA, 17 bp, Homo sapiens
attaaccacttcagctg

SEQ ID NO: 3761973 - DNA, 18 bp, Homo sapiens
attaaccagaaatccagt

SEQ ID NO: 3761974 - DNA, 14 bp, Homo sapiens
attaacctggtgct

SEQ ID NO: 3761975 - DNA, 16 bp, Homo sapiens
attaacctggtgctgg

SEQ ID NO: 3761976 - DNA, 15 bp, Homo sapiens
attaacttagcatgt

SEQ ID NO: 3761977 - DNA, 13 bp, Homo sapiens
attaagaaagact

SEQ ID NO: 3761978 - DNA, 15 bp, Homo sapiens
attaagatggattct

SEQ ID NO: 3761979 - DNA, 19 bp, Homo sapiens
attaagcagtaaaaactgt

SEQ ID NO: 3761980 - DNA, 17 bp, Homo sapiens
attaaggtctctctttg

SEQ ID NO: 3761981 - DNA, 18 bp, Homo sapiens
attaagtactatgtatca

SEQ ID NO: 3761982 - DNA, 19 bp, Homo sapiens
attaagtactatgtatcaa

SEQ ID NO: 3761983 - DNA, 16 bp, Homo sapiens
attaatattcattgta

SEQ ID NO: 3761984 - DNA, 19 bp, Homo sapiens
attaatattcattgtataa

SEQ ID NO: 3761985 - DNA, 14 bp, Homo sapiens
attaatgctaaggg

SEQ ID NO: 3761986 - DNA, 15 bp, Homo sapiens
attaatgctaagggc

SEQ ID NO: 3761987 - DNA, 15 bp, Homo sapiens
attacaacagtgaga

SEQ ID NO: 3761988 - DNA, 15 bp, Homo sapiens
attacagtgggtgcc

SEQ ID NO: 3761989 - DNA, 19 bp, Homo sapiens
attacagttgcatttttat

SEQ ID NO: 3761990 - DNA, 14 bp, Homo sapiens
attacataaataaa

SEQ ID NO: 3761991 - DNA, 18 bp, Homo sapiens
attaccactgaagataga

SEQ ID NO: 3761992 - DNA, 20 bp, Homo sapiens
attaccagacggttcaccag

SEQ ID NO: 3761993 - DNA, 23 bp, Homo sapiens
attaccagacggttcaccagcct

SEQ ID NO: 3761994 - DNA, 15 bp, Homo sapiens
attaccatggagaca

SEQ ID NO: 3761995 - DNA, 15 bp, Homo sapiens
attactacaaaattt

SEQ ID NO: 3761996 - DNA, 21 bp, Homo sapiens
attactacaaaatttgaaatt

SEQ ID NO: 3761997 - DNA, 17 bp, Homo sapiens
attacttatttttgaca

SEQ ID NO: 3761998 - DNA, 18 bp, Homo sapiens
attacttatttttgacag

SEQ ID NO: 3761999 - DNA, 13 bp, Homo sapiens
attacttctgcta

SEQ ID NO: 3762000 - DNA, 21 bp, Homo sapiens
attagagcagatgacccctcc

SEQ ID NO: 3762001 - DNA, 19 bp, Homo sapiens
attagagggaggagaatga

SEQ ID NO: 3762002 - DNA, 15 bp, Homo sapiens
attagagtcagcctt

SEQ ID NO: 3762003 - DNA, 14 bp, Homo sapiens
attagcatttagtc

SEQ ID NO: 3762004 - DNA, 15 bp, Homo sapiens
attagccaggtaatg

SEQ ID NO: 3762005 - DNA, 16 bp, Homo sapiens
attagctgtgtgaaat

SEQ ID NO: 3762006 - DNA, 15 bp, Homo sapiens
attagctttactgtt

SEQ ID NO: 3762007 - DNA, 20 bp, Homo sapiens
attaggaagtgtaacagctg

SEQ ID NO: 3762008 - DNA, 21 bp, Homo sapiens
attaggaagtgtaacagctga

SEQ ID NO: 3762009 - DNA, 22 bp, Homo sapiens
attaggaagtgtaacagctgag

SEQ ID NO: 3762010 - DNA, 13 bp, Homo sapiens
attaggaataaat

SEQ ID NO: 3762011 - DNA, 16 bp, Homo sapiens
attaggaataaataaa

SEQ ID NO: 3762012 - DNA, 15 bp, Homo sapiens
attaggggttgctaa

SEQ ID NO: 3762013 - DNA, 15 bp, Homo sapiens
attaggttaactatg

SEQ ID NO: 3762014 - DNA, 20 bp, Homo sapiens
attaggttaactatgtacaa

SEQ ID NO: 3762015 - DNA, 21 bp, Homo sapiens
attaggttttgtacaattgaa

SEQ ID NO: 3762016 - DNA, 21 bp, Homo sapiens
attagtaacattcatgttcta

SEQ ID NO: 3762017 - DNA, 21 bp, Homo sapiens
attagtatgtatgtgtaccta

SEQ ID NO: 3762018 - DNA, 17 bp, Homo sapiens
attagtcatagaagaac

SEQ ID NO: 3762019 - DNA, 18 bp, Homo sapiens
attataaggactgcatgg

SEQ ID NO: 3762020 - DNA, 23 bp, Homo sapiens
attataatttttttcaatattta

SEQ ID NO: 3762021 - DNA, 17 bp, Homo sapiens
attataggatcatttgt

SEQ ID NO: 3762022 - DNA, 16 bp, Homo sapiens
attatatctaattatt

SEQ ID NO: 3762023 - DNA, 21 bp, Homo sapiens
attatattgagacaaaaatta

SEQ ID NO: 3762024 - DNA, 14 bp, Homo sapiens
attatattgcaatg

SEQ ID NO: 3762025 - DNA, 15 bp, Homo sapiens
attatcaagctaata

SEQ ID NO: 3762026 - DNA, 17 bp, Homo sapiens
attatcaagctaataaa

SEQ ID NO: 3762027 - DNA, 23 bp, Homo sapiens
attatcaagctaataaaatatca

SEQ ID NO: 3762028 - DNA, 19 bp, Homo sapiens
attatcgggagcagtgtct

SEQ ID NO: 3762029 - DNA, 21 bp, Homo sapiens
attatcgggagcagtgtcttc

SEQ ID NO: 3762030 - DNA, 15 bp, Homo sapiens
attatctatttgtat

SEQ ID NO: 3762031 - DNA, 12 bp, Homo sapiens
attatcttaaaa

SEQ ID NO: 3762032 - DNA, 18 bp, Homo sapiens
attatctttgtaattatt

SEQ ID NO: 3762033 - DNA, 15 bp, Homo sapiens
attatgacagttata

SEQ ID NO: 3762034 - DNA, 16 bp, Homo sapiens
attatgacagttatac

SEQ ID NO: 3762035 - DNA, 19 bp, Homo sapiens
attatgacagttatactgt

SEQ ID NO: 3762036 - DNA, 17 bp, Homo sapiens
attatgcaaattcccag

SEQ ID NO: 3762037 - DNA, 18 bp, Homo sapiens
attatgctgtattttctt

SEQ ID NO: 3762038 - DNA, 17 bp, Homo sapiens
attatggaagattttaa

SEQ ID NO: 3762039 - DNA, 19 bp, Homo sapiens
attatgttattgaaaaaaa

SEQ ID NO: 3762040 - DNA, 16 bp, Homo sapiens
attattattcttcata

SEQ ID NO: 3762041 - DNA, 21 bp, Homo sapiens
attattcaccatgtaaaacaa

SEQ ID NO: 3762042 - DNA, 15 bp, Homo sapiens
attattcagttaaga

SEQ ID NO: 3762043 - DNA, 21 bp, Homo sapiens
attattcagttaagaaaaaaa

SEQ ID NO: 3762044 - DNA, 13 bp, Homo sapiens
attattgctgttg

SEQ ID NO: 3762045 - DNA, 15 bp, Homo sapiens
attatttattaaatt

SEQ ID NO: 3762046 - DNA, 18 bp, Homo sapiens
attattttaaattataag

SEQ ID NO: 3762047 - DNA, 22 bp, Homo sapiens
attattttaaattataaggact

SEQ ID NO: 3762048 - DNA, 18 bp, Homo sapiens
attattttaattaggtta

SEQ ID NO: 3762049 - DNA, 16 bp, Homo sapiens
attcaagtgtacagtg

SEQ ID NO: 3762050 - DNA, 23 bp, Homo sapiens
attcaatgtttatgcaaggaagg

SEQ ID NO: 3762051 - DNA, 18 bp, Homo sapiens
attcaattcctctgggaa

SEQ ID NO: 3762052 - DNA, 19 bp, Homo sapiens
attcaatttattcaagaaa

SEQ ID NO: 3762053 - DNA, 14 bp, Homo sapiens
attcacaagctgcc

SEQ ID NO: 3762054 - DNA, 15 bp, Homo sapiens
attcacaagctgcct

SEQ ID NO: 3762055 - DNA, 22 bp, Homo sapiens
attcacaatgaaatgctctcct

SEQ ID NO: 3762056 - DNA, 15 bp, Homo sapiens
attcaccatgtaaaa

SEQ ID NO: 3762057 - DNA, 22 bp, Homo sapiens
attcaccatgtaaaacaaaaaa

SEQ ID NO: 3762058 - DNA, 19 bp, Homo sapiens
attcacccagacagctccc

SEQ ID NO: 3762059 - DNA, 12 bp, Homo sapiens
attcacctgtaa

SEQ ID NO: 3762060 - DNA, 14 bp, Homo sapiens
attcacctgtaaaa

SEQ ID NO: 3762061 - DNA, 15 bp, Homo sapiens
attcacctgtaaaac

SEQ ID NO: 3762062 - DNA, 19 bp, Homo sapiens
attcacctgtaaaacttta

SEQ ID NO: 3762063 - DNA, 20 bp, Homo sapiens
attcactgaagttctcctga

SEQ ID NO: 3762064 - DNA, 19 bp, Homo sapiens
attcagaacaccaagactt

SEQ ID NO: 3762065 - DNA, 18 bp, Homo sapiens
attcagatatatttttca

SEQ ID NO: 3762066 - DNA, 21 bp, Homo sapiens
attcagatatatttttcacag

SEQ ID NO: 3762067 - DNA, 13 bp, Homo sapiens
attcagctgcccc

SEQ ID NO: 3762068 - DNA, 19 bp, Homo sapiens
attcaggaacctggaccaa

SEQ ID NO: 3762069 - DNA, 15 bp, Homo sapiens
attcagtaataactc

SEQ ID NO: 3762070 - DNA, 19 bp, Homo sapiens
attcagtattaaagggggg

SEQ ID NO: 3762071 - DNA, 21 bp, Homo sapiens
attcagtgctgtggcctgggc

SEQ ID NO: 3762072 - DNA, 22 bp, Homo sapiens
attcagtgctgtggcctgggca

SEQ ID NO: 3762073 - DNA, 17 bp, Homo sapiens
attcagtgcttcttaaa

SEQ ID NO: 3762074 - DNA, 19 bp, Homo sapiens
attcagtgcttcttaaaga

SEQ ID NO: 3762075 - DNA, 14 bp, Homo sapiens
attcagttaagaaa

SEQ ID NO: 3762076 - DNA, 16 bp, Homo sapiens
attcagttaagaaaaa

SEQ ID NO: 3762077 - DNA, 17 bp, Homo sapiens
attcagttaagaaaaaa

SEQ ID NO: 3762078 - DNA, 22 bp, Homo sapiens
attcatctctctttaatataaa

SEQ ID NO: 3762079 - DNA, 13 bp, Homo sapiens
attcatgtttctt

SEQ ID NO: 3762080 - DNA, 19 bp, Homo sapiens
attcattgtataaaaatag

SEQ ID NO: 3762081 - DNA, 21 bp, Homo sapiens
attcattgtggttatttttat

SEQ ID NO: 3762082 - DNA, 14 bp, Homo sapiens
attccaccttaaat

SEQ ID NO: 3762083 - DNA, 12 bp, Homo sapiens
attccactggac

SEQ ID NO: 3762084 - DNA, 23 bp, Homo sapiens
attccagactgcttccaattttc

SEQ ID NO: 3762085 - DNA, 18 bp, Homo sapiens
attccagagagtggctcc

SEQ ID NO: 3762086 - DNA, 23 bp, Homo sapiens
attccagtttgtttattacttat

SEQ ID NO: 3762087 - DNA, 18 bp, Homo sapiens
attccatagtatattaaa

SEQ ID NO: 3762088 - DNA, 13 bp, Homo sapiens
attccatgaatgt

SEQ ID NO: 3762089 - DNA, 18 bp, Homo sapiens
attccatgaatgtatcag

SEQ ID NO: 3762090 - DNA, 15 bp, Homo sapiens
attccattgtgtgag

SEQ ID NO: 3762091 - DNA, 18 bp, Homo sapiens
attcccaagctctgctcc

SEQ ID NO: 3762092 - DNA, 23 bp, Homo sapiens
attcccagagacaggaaaatcct

SEQ ID NO: 3762093 - DNA, 17 bp, Homo sapiens
attcccagagcaaaata

SEQ ID NO: 3762094 - DNA, 16 bp, Homo sapiens
attcccagctgtctgt

SEQ ID NO: 3762095 - DNA, 22 bp, Homo sapiens
attcccattgaaaatgtaagta

SEQ ID NO: 3762096 - DNA, 15 bp, Homo sapiens
attcccattttgcaa

SEQ ID NO: 3762097 - DNA, 20 bp, Homo sapiens
attcccattttgcaaaattt

SEQ ID NO: 3762098 - DNA, 22 bp, Homo sapiens
attccctatcttttagttttag

SEQ ID NO: 3762099 - DNA, 19 bp, Homo sapiens
attccgtttacattttaga

SEQ ID NO: 3762100 - DNA, 17 bp, Homo sapiens
attcctacaatatatat

SEQ ID NO: 3762101 - DNA, 18 bp, Homo sapiens
attcctacaatatatatt

SEQ ID NO: 3762102 - DNA, 22 bp, Homo sapiens
attcctacaatatatattctgg

SEQ ID NO: 3762103 - DNA, 24 bp, Homo sapiens
attcctagaaactgacacatgctg

SEQ ID NO: 3762104 - DNA, 21 bp, Homo sapiens
attcctagataaaaagatggc

SEQ ID NO: 3762105 - DNA, 17 bp, Homo sapiens
attcctatatagtttat

SEQ ID NO: 3762106 - DNA, 13 bp, Homo sapiens
attcctctgggaa

SEQ ID NO: 3762107 - DNA, 13 bp, Homo sapiens
attcctgcagcct

SEQ ID NO: 3762108 - DNA, 19 bp, Homo sapiens
attcctgcagcctggaggc

SEQ ID NO: 3762109 - DNA, 15 bp, Homo sapiens
attcctgcatttgtg

SEQ ID NO: 3762110 - DNA, 24 bp, Homo sapiens
attccttagcttagacctcagcct

SEQ ID NO: 3762111 - DNA, 19 bp, Homo sapiens
attccttttcttgtttatc

SEQ ID NO: 3762112 - DNA, 15 bp, Homo sapiens
attcgagctatattt

SEQ ID NO: 3762113 - DNA, 20 bp, Homo sapiens
attcgagctatatttaagta

SEQ ID NO: 3762114 - DNA, 19 bp, Homo sapiens
attcgcccaaagccagaca

SEQ ID NO: 3762115 - DNA, 20 bp, Homo sapiens
attcgcccaaagccagacag

SEQ ID NO: 3762116 - DNA, 15 bp, Homo sapiens
attctaaatgaatgt

SEQ ID NO: 3762117 - DNA, 12 bp, Homo sapiens
attctaaccaga

SEQ ID NO: 3762118 - DNA, 19 bp, Homo sapiens
attctaaccagagcaagct

SEQ ID NO: 3762119 - DNA, 20 bp, Homo sapiens
attctaaccagagcaagctt

SEQ ID NO: 3762120 - DNA, 15 bp, Homo sapiens
attctagctttgagc

SEQ ID NO: 3762121 - DNA, 13 bp, Homo sapiens
attctaggcatcc

SEQ ID NO: 3762122 - DNA, 20 bp, Homo sapiens
attctaggcatcccagggga

SEQ ID NO: 3762123 - DNA, 23 bp, Homo sapiens
attctcaagccgcatcccagact

SEQ ID NO: 3762124 - DNA, 17 bp, Homo sapiens
attctcactccaccacc

SEQ ID NO: 3762125 - DNA, 13 bp, Homo sapiens
attctcctgcctc

SEQ ID NO: 3762126 - DNA, 21 bp, Homo sapiens
attctcctttttacccctcta

SEQ ID NO: 3762127 - DNA, 16 bp, Homo sapiens
attctctcctcagact

SEQ ID NO: 3762128 - DNA, 22 bp, Homo sapiens
attctctcctcagactgctcaa

SEQ ID NO: 3762129 - DNA, 15 bp, Homo sapiens
attctctctcctgtc

SEQ ID NO: 3762130 - DNA, 12 bp, Homo sapiens
attctcttatcc

SEQ ID NO: 3762131 - DNA, 20 bp, Homo sapiens
attctctttggtgtacaaaa

SEQ ID NO: 3762132 - DNA, 22 bp, Homo sapiens
attctgcagcatgacctgtgac

SEQ ID NO: 3762133 - DNA, 21 bp, Homo sapiens
attctgcctgcccaggcccct

SEQ ID NO: 3762134 - DNA, 20 bp, Homo sapiens
attctgcctttgcagaaaca

SEQ ID NO: 3762135 - DNA, 15 bp, Homo sapiens
attctgctacctcac

SEQ ID NO: 3762136 - DNA, 19 bp, Homo sapiens
attctgctacctcactggg

SEQ ID NO: 3762137 - DNA, 19 bp, Homo sapiens
attctggctgataaaagat

SEQ ID NO: 3762138 - DNA, 19 bp, Homo sapiens
attctgttggccagtgtga

SEQ ID NO: 3762139 - DNA, 23 bp, Homo sapiens
attcttaaaatatatttcagata

SEQ ID NO: 3762140 - DNA, 17 bp, Homo sapiens
attcttacatgttttct

SEQ ID NO: 3762141 - DNA, 20 bp, Homo sapiens
attcttagcctgtggcagta

SEQ ID NO: 3762142 - DNA, 19 bp, Homo sapiens
attcttcctagttttctcc

SEQ ID NO: 3762143 - DNA, 13 bp, Homo sapiens
attcttcctccct

SEQ ID NO: 3762144 - DNA, 12 bp, Homo sapiens
attcttctgctt

SEQ ID NO: 3762145 - DNA, 22 bp, Homo sapiens
attcttctgtacgtctgacagg

SEQ ID NO: 3762146 - DNA, 16 bp, Homo sapiens
attcttgaaagctgtg

SEQ ID NO: 3762147 - DNA, 12 bp, Homo sapiens
attcttgtatat

SEQ ID NO: 3762148 - DNA, 16 bp, Homo sapiens
attctttccattatga

SEQ ID NO: 3762149 - DNA, 22 bp, Homo sapiens
attctttccattatgattcttt

SEQ ID NO: 3762150 - DNA, 20 bp, Homo sapiens
attctttgcttgaacacagt

SEQ ID NO: 3762151 - DNA, 19 bp, Homo sapiens
attgaaaaaaattggcatt

SEQ ID NO: 3762152 - DNA, 16 bp, Homo sapiens
attgaaaatgtaagta

SEQ ID NO: 3762153 - DNA, 15 bp, Homo sapiens
attgaaagagaacca

SEQ ID NO: 3762154 - DNA, 18 bp, Homo sapiens
attgaaaggcattctctg

SEQ ID NO: 3762155 - DNA, 14 bp, Homo sapiens
attgaacccaggag

SEQ ID NO: 3762156 - DNA, 15 bp, Homo sapiens
attgaaggaaagatt

SEQ ID NO: 3762157 - DNA, 17 bp, Homo sapiens
attgaaggatgctgtct

SEQ ID NO: 3762158 - DNA, 14 bp, Homo sapiens
attgaagtaatgaa

SEQ ID NO: 3762159 - DNA, 13 bp, Homo sapiens
attgaatttaaca

SEQ ID NO: 3762160 - DNA, 16 bp, Homo sapiens
attgaatttaacaatg

SEQ ID NO: 3762161 - DNA, 14 bp, Homo sapiens
attgacaaactctc

SEQ ID NO: 3762162 - DNA, 17 bp, Homo sapiens
attgacaataatttcag

SEQ ID NO: 3762163 - DNA, 17 bp, Homo sapiens
attgacatcagcatcac

SEQ ID NO: 3762164 - DNA, 18 bp, Homo sapiens
attgacatcagcatcacc

SEQ ID NO: 3762165 - DNA, 22 bp, Homo sapiens
attgacatcagcatcacctaga

SEQ ID NO: 3762166 - DNA, 14 bp, Homo sapiens
attgagaactgcat

SEQ ID NO: 3762167 - DNA, 19 bp, Homo sapiens
attgagaagcgtatgtttt

SEQ ID NO: 3762168 - DNA, 15 bp, Homo sapiens
attgagacaaaaatt

SEQ ID NO: 3762169 - DNA, 22 bp, Homo sapiens
attgagagaatggaaaacagac

SEQ ID NO: 3762170 - DNA, 18 bp, Homo sapiens
attgatagagtgttatca

SEQ ID NO: 3762171 - DNA, 21 bp, Homo sapiens
attgatatacacggatgactt

SEQ ID NO: 3762172 - DNA, 21 bp, Homo sapiens
attgatcattttccccccact

SEQ ID NO: 3762173 - DNA, 13 bp, Homo sapiens
attgatgtgcaaa

SEQ ID NO: 3762174 - DNA, 16 bp, Homo sapiens
attgatgtgcaaaaat

SEQ ID NO: 3762175 - DNA, 15 bp, Homo sapiens
attgattgctgtgtc

SEQ ID NO: 3762176 - DNA, 16 bp, Homo sapiens
attgatttcaagacct

SEQ ID NO: 3762177 - DNA, 17 bp, Homo sapiens
attgcaacaggctgggc

SEQ ID NO: 3762178 - DNA, 16 bp, Homo sapiens
attgcaatgaaggaaa

SEQ ID NO: 3762179 - DNA, 16 bp, Homo sapiens
attgcactccagcctg

SEQ ID NO: 3762180 - DNA, 19 bp, Homo sapiens
attgcagctgggagaaggg

SEQ ID NO: 3762181 - DNA, 19 bp, Homo sapiens
attgcatgagaagccatac

SEQ ID NO: 3762182 - DNA, 20 bp, Homo sapiens
attgcatgctgctttaattg

SEQ ID NO: 3762183 - DNA, 17 bp, Homo sapiens
attgcatgggttttgta

SEQ ID NO: 3762184 - DNA, 19 bp, Homo sapiens
attgcatgggttttgtagg

SEQ ID NO: 3762185 - DNA, 18 bp, Homo sapiens
attgcattttttaaaaca

SEQ ID NO: 3762186 - DNA, 14 bp, Homo sapiens
attgccagtgtctt

SEQ ID NO: 3762187 - DNA, 20 bp, Homo sapiens
attgccagtgtctttctttg

SEQ ID NO: 3762188 - DNA, 11 bp, Homo sapiens
attgccctggt

SEQ ID NO: 3762189 - DNA, 16 bp, Homo sapiens
attgcggacagccacg

SEQ ID NO: 3762190 - DNA, 19 bp, Homo sapiens
attgcggacagccacggcc

SEQ ID NO: 3762191 - DNA, 20 bp, Homo sapiens
attgctactgtcctacccac

SEQ ID NO: 3762192 - DNA, 15 bp, Homo sapiens
attgctacttcctgc

SEQ ID NO: 3762193 - DNA, 23 bp, Homo sapiens
attgctacttcctgcctggtctc

SEQ ID NO: 3762194 - DNA, 23 bp, Homo sapiens
attgctcaagttcattgatgacc

SEQ ID NO: 3762195 - DNA, 12 bp, Homo sapiens
attgctccttga

SEQ ID NO: 3762196 - DNA, 22 bp, Homo sapiens
attgctgctccttagctgccaa

SEQ ID NO: 3762197 - DNA, 19 bp, Homo sapiens
attgctggtcttgtaagag

SEQ ID NO: 3762198 - DNA, 23 bp, Homo sapiens
attgctgtgtccaactccagtac

SEQ ID NO: 3762199 - DNA, 16 bp, Homo sapiens
attgcttaaaatagca

SEQ ID NO: 3762200 - DNA, 17 bp, Homo sapiens
attgcttaaaatagcaa

SEQ ID NO: 3762201 - DNA, 15 bp, Homo sapiens
attgcttctgtagta

SEQ ID NO: 3762202 - DNA, 22 bp, Homo sapiens
attgcttctgtagtactcctta

SEQ ID NO: 3762203 - DNA, 18 bp, Homo sapiens
attgcttgagctcaggag

SEQ ID NO: 3762204 - DNA, 15 bp, Homo sapiens
attgctttctgaaat

SEQ ID NO: 3762205 - DNA, 20 bp, Homo sapiens
attggaattaacctggtgct

SEQ ID NO: 3762206 - DNA, 18 bp, Homo sapiens
attggagagtaaaaactg

SEQ ID NO: 3762207 - DNA, 23 bp, Homo sapiens
attggctttgggttgcaggacct

SEQ ID NO: 3762208 - DNA, 16 bp, Homo sapiens
attggcttttcatgcg

SEQ ID NO: 3762209 - DNA, 13 bp, Homo sapiens
attgggaaatctt

SEQ ID NO: 3762210 - DNA, 12 bp, Homo sapiens
attggggttatt

SEQ ID NO: 3762211 - DNA, 18 bp, Homo sapiens
attgggtgggtaaattca

SEQ ID NO: 3762212 - DNA, 13 bp, Homo sapiens
attgggttcatta

SEQ ID NO: 3762213 - DNA, 18 bp, Homo sapiens
attggtaaagaatggaag

SEQ ID NO: 3762214 - DNA, 22 bp, Homo sapiens
attggttttaattgaaggaaag

SEQ ID NO: 3762215 - DNA, 13 bp, Homo sapiens
attgtaaactgta

SEQ ID NO: 3762216 - DNA, 15 bp, Homo sapiens
attgtaaactgtact

SEQ ID NO: 3762217 - DNA, 15 bp, Homo sapiens
attgtaaatacaagt

SEQ ID NO: 3762218 - DNA, 10 bp, Homo sapiens
attgtaactc

SEQ ID NO: 3762219 - DNA, 16 bp, Homo sapiens
attgtaagataaaaaa

SEQ ID NO: 3762220 - DNA, 13 bp, Homo sapiens
attgtaatgttac

SEQ ID NO: 3762221 - DNA, 17 bp, Homo sapiens
attgtaatgttactgat

SEQ ID NO: 3762222 - DNA, 20 bp, Homo sapiens
attgtacagaatcattgctt

SEQ ID NO: 3762223 - DNA, 19 bp, Homo sapiens
attgtacctctcttataga

SEQ ID NO: 3762224 - DNA, 18 bp, Homo sapiens
attgtatctagtgcagct

SEQ ID NO: 3762225 - DNA, 19 bp, Homo sapiens
attgtatctagtgcagctg

SEQ ID NO: 3762226 - DNA, 23 bp, Homo sapiens
attgtcagatattttttcagaaa

SEQ ID NO: 3762227 - DNA, 13 bp, Homo sapiens
attgtcagctact

SEQ ID NO: 3762228 - DNA, 19 bp, Homo sapiens
attgtgaattgataataaa

SEQ ID NO: 3762229 - DNA, 17 bp, Homo sapiens
attgtggctgtcagcag

SEQ ID NO: 3762230 - DNA, 14 bp, Homo sapiens
attgttaaaggcta

SEQ ID NO: 3762231 - DNA, 22 bp, Homo sapiens
attgttaagtctaaatatttcc

SEQ ID NO: 3762232 - DNA, 14 bp, Homo sapiens
attgttccaagaca

SEQ ID NO: 3762233 - DNA, 21 bp, Homo sapiens
attgttgaggtggtctgaatg

SEQ ID NO: 3762234 - DNA, 15 bp, Homo sapiens
attgtttatttatca

SEQ ID NO: 3762235 - DNA, 15 bp, Homo sapiens
attgtttgcttattg

SEQ ID NO: 3762236 - DNA, 16 bp, Homo sapiens
attgtttgcttattgt

SEQ ID NO: 3762237 - DNA, 18 bp, Homo sapiens
attgttttcagtgtacat

SEQ ID NO: 3762238 - DNA, 16 bp, Homo sapiens
attgttttttatcttt

SEQ ID NO: 3762239 - DNA, 14 bp, Homo sapiens
atttaaaacaaaca

SEQ ID NO: 3762240 - DNA, 16 bp, Homo sapiens
atttaaatattaaata

SEQ ID NO: 3762241 - DNA, 14 bp, Homo sapiens
atttaaattctttt

SEQ ID NO: 3762242 - DNA, 19 bp, Homo sapiens
atttaaattcttttttaaa

SEQ ID NO: 3762243 - DNA, 14 bp, Homo sapiens
atttaacccagctc

SEQ ID NO: 3762244 - DNA, 20 bp, Homo sapiens
atttaacttaacattctgta

SEQ ID NO: 3762245 - DNA, 21 bp, Homo sapiens
atttaacttaacattctgtaa

SEQ ID NO: 3762246 - DNA, 15 bp, Homo sapiens
atttaatgaaagact

SEQ ID NO: 3762247 - DNA, 13 bp, Homo sapiens
atttaattaaaaa

SEQ ID NO: 3762248 - DNA, 17 bp, Homo sapiens
atttaattcatgtttct

SEQ ID NO: 3762249 - DNA, 21 bp, Homo sapiens
atttaatttgccaaaataatg

SEQ ID NO: 3762250 - DNA, 22 bp, Homo sapiens
atttaatttgccaaaataatgt

SEQ ID NO: 3762251 - DNA, 21 bp, Homo sapiens
atttacaagggaagatttatg

SEQ ID NO: 3762252 - DNA, 20 bp, Homo sapiens
atttacacttttgagacttt

SEQ ID NO: 3762253 - DNA, 21 bp, Homo sapiens
atttacagcctcacttgaatg

SEQ ID NO: 3762254 - DNA, 23 bp, Homo sapiens
atttaccagcctccgtatttcag

SEQ ID NO: 3762255 - DNA, 22 bp, Homo sapiens
atttagaaagaagcccaatatt

SEQ ID NO: 3762256 - DNA, 22 bp, Homo sapiens
atttagagatgaattaaattta

SEQ ID NO: 3762257 - DNA, 19 bp, Homo sapiens
atttagagctagtctttca

SEQ ID NO: 3762258 - DNA, 15 bp, Homo sapiens
atttagggcaaggag

SEQ ID NO: 3762259 - DNA, 12 bp, Homo sapiens
atttagttcttt

SEQ ID NO: 3762260 - DNA, 19 bp, Homo sapiens
atttagtttttgtaattta

SEQ ID NO: 3762261 - DNA, 15 bp, Homo sapiens
atttataactcatca

SEQ ID NO: 3762262 - DNA, 18 bp, Homo sapiens
atttataactcatcataa

SEQ ID NO: 3762263 - DNA, 20 bp, Homo sapiens
atttataactcatcataaaa

SEQ ID NO: 3762264 - DNA, 23 bp, Homo sapiens
atttataactcatcataaaataa

SEQ ID NO: 3762265 - DNA, 12 bp, Homo sapiens
atttataatttt

SEQ ID NO: 3762266 - DNA, 14 bp, Homo sapiens
atttatactattta

SEQ ID NO: 3762267 - DNA, 17 bp, Homo sapiens
atttatagtttatacag

SEQ ID NO: 3762268 - DNA, 15 bp, Homo sapiens
atttatatatgtatt

SEQ ID NO: 3762269 - DNA, 14 bp, Homo sapiens
atttatatatttat

SEQ ID NO: 3762270 - DNA, 15 bp, Homo sapiens
atttatatatttata

SEQ ID NO: 3762271 - DNA, 18 bp, Homo sapiens
atttatatatttataact

SEQ ID NO: 3762272 - DNA, 23 bp, Homo sapiens
atttatcagtgacagagttcact

SEQ ID NO: 3762273 - DNA, 18 bp, Homo sapiens
atttatcctgaaatttca

SEQ ID NO: 3762274 - DNA, 16 bp, Homo sapiens
atttatctattgtaag

SEQ ID NO: 3762275 - DNA, 18 bp, Homo sapiens
atttatctattgtaagat

SEQ ID NO: 3762276 - DNA, 20 bp, Homo sapiens
atttatctgggattatggtt

SEQ ID NO: 3762277 - DNA, 20 bp, Homo sapiens
atttatctgtgtttttgaaa

SEQ ID NO: 3762278 - DNA, 19 bp, Homo sapiens
atttatcttgtctctgggc

SEQ ID NO: 3762279 - DNA, 19 bp, Homo sapiens
atttatgagtttttgatag

SEQ ID NO: 3762280 - DNA, 18 bp, Homo sapiens
atttatggtcaacactta

SEQ ID NO: 3762281 - DNA, 23 bp, Homo sapiens
atttatgtaaactgcattagaaa

SEQ ID NO: 3762282 - DNA, 22 bp, Homo sapiens
atttatgtgtgaggagctgctg

SEQ ID NO: 3762283 - DNA, 18 bp, Homo sapiens
atttatgttgtatagatt

SEQ ID NO: 3762284 - DNA, 18 bp, Homo sapiens
atttattaaatgtattat

SEQ ID NO: 3762285 - DNA, 15 bp, Homo sapiens
atttattaagatgga

SEQ ID NO: 3762286 - DNA, 14 bp, Homo sapiens
atttattacctctg

SEQ ID NO: 3762287 - DNA, 19 bp, Homo sapiens
atttattcaattcctctgg

SEQ ID NO: 3762288 - DNA, 13 bp, Homo sapiens
atttattgcacaa

SEQ ID NO: 3762289 - DNA, 19 bp, Homo sapiens
atttattgcttgatacttt

SEQ ID NO: 3762290 - DNA, 20 bp, Homo sapiens
atttattgcttgatactttt

SEQ ID NO: 3762291 - DNA, 19 bp, Homo sapiens
atttattgtttatttatca

SEQ ID NO: 3762292 - DNA, 12 bp, Homo sapiens
atttatttaaat

SEQ ID NO: 3762293 - DNA, 14 bp, Homo sapiens
atttatttattaag

SEQ ID NO: 3762294 - DNA, 14 bp, Homo sapiens
atttatttatttaa

SEQ ID NO: 3762295 - DNA, 18 bp, Homo sapiens
atttattttttacattat

SEQ ID NO: 3762296 - DNA, 16 bp, Homo sapiens
atttcaaaaatttgga

SEQ ID NO: 3762297 - DNA, 13 bp, Homo sapiens
atttcaaaatata

SEQ ID NO: 3762298 - DNA, 16 bp, Homo sapiens
atttcagagaggcctt

SEQ ID NO: 3762299 - DNA, 16 bp, Homo sapiens
atttcagatgctttag

SEQ ID NO: 3762300 - DNA, 14 bp, Homo sapiens
atttcaggattctc

SEQ ID NO: 3762301 - DNA, 21 bp, Homo sapiens
atttcaggttttgtaaagatg

SEQ ID NO: 3762302 - DNA, 19 bp, Homo sapiens
atttcatctatttctgaga

SEQ ID NO: 3762303 - DNA, 16 bp, Homo sapiens
atttccaaagagaaaa

SEQ ID NO: 3762304 - DNA, 13 bp, Homo sapiens
atttccagtacct

SEQ ID NO: 3762305 - DNA, 17 bp, Homo sapiens
atttccagtacctttgt

SEQ ID NO: 3762306 - DNA, 18 bp, Homo sapiens
atttcccaattaggaagt

SEQ ID NO: 3762307 - DNA, 12 bp, Homo sapiens
atttcccttctt

SEQ ID NO: 3762308 - DNA, 21 bp, Homo sapiens
atttctaaaaaacagaggcca

SEQ ID NO: 3762309 - DNA, 19 bp, Homo sapiens
atttctaactctgatgtaa

SEQ ID NO: 3762310 - DNA, 20 bp, Homo sapiens
atttctaactctgatgtaaa

SEQ ID NO: 3762311 - DNA, 21 bp, Homo sapiens
atttctaactctgatgtaaat

SEQ ID NO: 3762312 - DNA, 22 bp, Homo sapiens
atttctaactctgatgtaaatg

SEQ ID NO: 3762313 - DNA, 17 bp, Homo sapiens
atttctatttatttact

SEQ ID NO: 3762314 - DNA, 18 bp, Homo sapiens
atttctctctccagtctt

SEQ ID NO: 3762315 - DNA, 20 bp, Homo sapiens
atttctgaaatgacctcaag

SEQ ID NO: 3762316 - DNA, 11 bp, Homo sapiens
atttctgagaa

SEQ ID NO: 3762317 - DNA, 15 bp, Homo sapiens
atttctgatatagaa

SEQ ID NO: 3762318 - DNA, 17 bp, Homo sapiens
atttctgatatagaatt

SEQ ID NO: 3762319 - DNA, 11 bp, Homo sapiens
atttctgattt

SEQ ID NO: 3762320 - DNA, 16 bp, Homo sapiens
atttctgattttatgt

SEQ ID NO: 3762321 - DNA, 17 bp, Homo sapiens
atttcttgggccctcct

SEQ ID NO: 3762322 - DNA, 18 bp, Homo sapiens
atttcttgggccctcctg

SEQ ID NO: 3762323 - DNA, 19 bp, Homo sapiens
atttcttggtaagaagccg

SEQ ID NO: 3762324 - DNA, 20 bp, Homo sapiens
atttcttggtaagaagccgg

SEQ ID NO: 3762325 - DNA, 15 bp, Homo sapiens
atttgaaccaaaaca

SEQ ID NO: 3762326 - DNA, 23 bp, Homo sapiens
atttgaagctgcagtgagctgtg

SEQ ID NO: 3762327 - DNA, 14 bp, Homo sapiens
atttgaatcagcct

SEQ ID NO: 3762328 - DNA, 23 bp, Homo sapiens
atttgaatcagcctacaggcctc

SEQ ID NO: 3762329 - DNA, 18 bp, Homo sapiens
atttgaatctcaatttga

SEQ ID NO: 3762330 - DNA, 19 bp, Homo sapiens
atttgaatgaaaaatttaa

SEQ ID NO: 3762331 - DNA, 22 bp, Homo sapiens
atttgagtaatctgatcgttct

SEQ ID NO: 3762332 - DNA, 23 bp, Homo sapiens
atttgagtaatctgatcgttctt

SEQ ID NO: 3762333 - DNA, 20 bp, Homo sapiens
atttgatagtattgtgcata

SEQ ID NO: 3762334 - DNA, 17 bp, Homo sapiens
atttgatcgttccagtt

SEQ ID NO: 3762335 - DNA, 23 bp, Homo sapiens
atttgattctgtgtgttttcata

SEQ ID NO: 3762336 - DNA, 15 bp, Homo sapiens
atttgcatatgtatg

SEQ ID NO: 3762337 - DNA, 17 bp, Homo sapiens
atttgcatatgtatgac

SEQ ID NO: 3762338 - DNA, 17 bp, Homo sapiens
atttgccaaaataatgt

SEQ ID NO: 3762339 - DNA, 18 bp, Homo sapiens
atttgctttttcaccaga

SEQ ID NO: 3762340 - DNA, 13 bp, Homo sapiens
atttggaaaataa

SEQ ID NO: 3762341 - DNA, 19 bp, Homo sapiens
atttggcctgcactaattt

SEQ ID NO: 3762342 - DNA, 23 bp, Homo sapiens
atttggggtagctagaggaacca

SEQ ID NO: 3762343 - DNA, 23 bp, Homo sapiens
atttggtcaagattttgaatgct

SEQ ID NO: 3762344 - DNA, 15 bp, Homo sapiens
atttggttctaatag

SEQ ID NO: 3762345 - DNA, 23 bp, Homo sapiens
atttgtaaaaacagcattgcttt

SEQ ID NO: 3762346 - DNA, 18 bp, Homo sapiens
atttgtaataaagtatat

SEQ ID NO: 3762347 - DNA, 18 bp, Homo sapiens
atttgtacatatgtaaaa

SEQ ID NO: 3762348 - DNA, 21 bp, Homo sapiens
atttgtacatatgtaaaataa

SEQ ID NO: 3762349 - DNA, 16 bp, Homo sapiens
atttgtatatatacat

SEQ ID NO: 3762350 - DNA, 16 bp, Homo sapiens
atttgtatgttgtgaa

SEQ ID NO: 3762351 - DNA, 17 bp, Homo sapiens
atttgtcaatgacagtt

SEQ ID NO: 3762352 - DNA, 16 bp, Homo sapiens
atttgtcacagaaatc

SEQ ID NO: 3762353 - DNA, 21 bp, Homo sapiens
atttgtcacagaaatcagagg

SEQ ID NO: 3762354 - DNA, 18 bp, Homo sapiens
atttgtcgatatttccat

SEQ ID NO: 3762355 - DNA, 20 bp, Homo sapiens
atttgtgtgtgtgcaagtgt

SEQ ID NO: 3762356 - DNA, 18 bp, Homo sapiens
atttgttaaatatttaca

SEQ ID NO: 3762357 - DNA, 14 bp, Homo sapiens
atttgttataatga

SEQ ID NO: 3762358 - DNA, 15 bp, Homo sapiens
atttgttattcttaa

SEQ ID NO: 3762359 - DNA, 15 bp, Homo sapiens
atttgttggaatgaa

SEQ ID NO: 3762360 - DNA, 21 bp, Homo sapiens
atttgttttgtgttgtttgaa

SEQ ID NO: 3762361 - DNA, 17 bp, Homo sapiens
attttaaaattttatct

SEQ ID NO: 3762362 - DNA, 22 bp, Homo sapiens
attttaaattataacttaaaat

SEQ ID NO: 3762363 - DNA, 18 bp, Homo sapiens
attttaaattataaggac

SEQ ID NO: 3762364 - DNA, 15 bp, Homo sapiens
attttaagcattact

SEQ ID NO: 3762365 - DNA, 17 bp, Homo sapiens
attttaagtgctttgta

SEQ ID NO: 3762366 - DNA, 13 bp, Homo sapiens
attttaatctaat

SEQ ID NO: 3762367 - DNA, 11 bp, Homo sapiens
attttacaaaa

SEQ ID NO: 3762368 - DNA, 17 bp, Homo sapiens
attttacatttatctgt

SEQ ID NO: 3762369 - DNA, 13 bp, Homo sapiens
attttaccaagtt

SEQ ID NO: 3762370 - DNA, 18 bp, Homo sapiens
attttactactgtggaaa

SEQ ID NO: 3762371 - DNA, 14 bp, Homo sapiens
attttagcagttct

SEQ ID NO: 3762372 - DNA, 19 bp, Homo sapiens
attttagcagttctgcaaa

SEQ ID NO: 3762373 - DNA, 17 bp, Homo sapiens
attttaggcacccatcc

SEQ ID NO: 3762374 - DNA, 17 bp, Homo sapiens
attttagtatatttata

SEQ ID NO: 3762375 - DNA, 19 bp, Homo sapiens
attttataaaattaaagaa

SEQ ID NO: 3762376 - DNA, 20 bp, Homo sapiens
attttataaaattaaagaaa

SEQ ID NO: 3762377 - DNA, 12 bp, Homo sapiens
attttataattt

SEQ ID NO: 3762378 - DNA, 19 bp, Homo sapiens
attttatagctcagtttat

SEQ ID NO: 3762379 - DNA, 14 bp, Homo sapiens
attttatataataa

SEQ ID NO: 3762380 - DNA, 21 bp, Homo sapiens
attttatgccttttatttctt

SEQ ID NO: 3762381 - DNA, 12 bp, Homo sapiens
attttatgtatg

SEQ ID NO: 3762382 - DNA, 22 bp, Homo sapiens
attttatgtatgtttacactgt

SEQ ID NO: 3762383 - DNA, 23 bp, Homo sapiens
attttatgtatgtttacactgtc

SEQ ID NO: 3762384 - DNA, 23 bp, Homo sapiens
attttattcaaggtaaaattcta

SEQ ID NO: 3762385 - DNA, 18 bp, Homo sapiens
attttcaaattgtatcta

SEQ ID NO: 3762386 - DNA, 17 bp, Homo sapiens
attttcaagaaactgag

SEQ ID NO: 3762387 - DNA, 22 bp, Homo sapiens
attttcaagaaactgaggaatt

SEQ ID NO: 3762388 - DNA, 23 bp, Homo sapiens
attttcaagaaactgaggaattt

SEQ ID NO: 3762389 - DNA, 19 bp, Homo sapiens
attttcaagtaattgtgaa

SEQ ID NO: 3762390 - DNA, 14 bp, Homo sapiens
attttcaattcaaa

SEQ ID NO: 3762391 - DNA, 15 bp, Homo sapiens
attttcacataaaat

SEQ ID NO: 3762392 - DNA, 15 bp, Homo sapiens
attttcaccccaccc

SEQ ID NO: 3762393 - DNA, 21 bp, Homo sapiens
attttcacctgtttttaagct

SEQ ID NO: 3762394 - DNA, 14 bp, Homo sapiens
attttcagaatctg

SEQ ID NO: 3762395 - DNA, 20 bp, Homo sapiens
attttcagaatctgaatgta

SEQ ID NO: 3762396 - DNA, 14 bp, Homo sapiens
attttcatatgctt

SEQ ID NO: 3762397 - DNA, 23 bp, Homo sapiens
attttccacaagattcccagaga

SEQ ID NO: 3762398 - DNA, 20 bp, Homo sapiens
attttcccaatagcactttc

SEQ ID NO: 3762399 - DNA, 22 bp, Homo sapiens
attttcccaatagcactttcat

SEQ ID NO: 3762400 - DNA, 14 bp, Homo sapiens
attttccccccact

SEQ ID NO: 3762401 - DNA, 19 bp, Homo sapiens
attttccctattagagaag

SEQ ID NO: 3762402 - DNA, 12 bp, Homo sapiens
attttcctcccc

SEQ ID NO: 3762403 - DNA, 14 bp, Homo sapiens
attttcctccccag

SEQ ID NO: 3762404 - DNA, 16 bp, Homo sapiens
attttctgaaactaat

SEQ ID NO: 3762405 - DNA, 22 bp, Homo sapiens
attttctgaaactaatgaaagc

SEQ ID NO: 3762406 - DNA, 18 bp, Homo sapiens
attttctggaatacatga

SEQ ID NO: 3762407 - DNA, 19 bp, Homo sapiens
attttctggaatacatgaa

SEQ ID NO: 3762408 - DNA, 19 bp, Homo sapiens
attttctggtaggaatagc

SEQ ID NO: 3762409 - DNA, 18 bp, Homo sapiens
attttcttcatgcaatga

SEQ ID NO: 3762410 - DNA, 14 bp, Homo sapiens
attttgaagctaat

SEQ ID NO: 3762411 - DNA, 18 bp, Homo sapiens
attttgaagctaattatt

SEQ ID NO: 3762412 - DNA, 18 bp, Homo sapiens
attttgatccaagctggt

SEQ ID NO: 3762413 - DNA, 19 bp, Homo sapiens
attttgatccaagctggtc

SEQ ID NO: 3762414 - DNA, 16 bp, Homo sapiens
attttgcagcagtgag

SEQ ID NO: 3762415 - DNA, 19 bp, Homo sapiens
attttggaaaataaattat

SEQ ID NO: 3762416 - DNA, 17 bp, Homo sapiens
attttgtaaaggtgaaa

SEQ ID NO: 3762417 - DNA, 19 bp, Homo sapiens
attttgtaacgaagacaca

SEQ ID NO: 3762418 - DNA, 16 bp, Homo sapiens
attttgtatcttgatg

SEQ ID NO: 3762419 - DNA, 11 bp, Homo sapiens
attttgtttct

SEQ ID NO: 3762420 - DNA, 18 bp, Homo sapiens
atttttaatatgtaagga

SEQ ID NO: 3762421 - DNA, 20 bp, Homo sapiens
atttttaatgtttttaaata

SEQ ID NO: 3762422 - DNA, 22 bp, Homo sapiens
atttttagatggttacactgtt

SEQ ID NO: 3762423 - DNA, 12 bp, Homo sapiens
atttttatccaa

SEQ ID NO: 3762424 - DNA, 18 bp, Homo sapiens
atttttatccaatcttgt

SEQ ID NO: 3762425 - DNA, 18 bp, Homo sapiens
atttttattacccttctt

SEQ ID NO: 3762426 - DNA, 15 bp, Homo sapiens
atttttattatgcat

SEQ ID NO: 3762427 - DNA, 19 bp, Homo sapiens
atttttattatgcataact

SEQ ID NO: 3762428 - DNA, 15 bp, Homo sapiens
atttttcacttcaaa

SEQ ID NO: 3762429 - DNA, 15 bp, Homo sapiens
atttttcagatgctt

SEQ ID NO: 3762430 - DNA, 21 bp, Homo sapiens
atttttggattgacagtaact

SEQ ID NO: 3762431 - DNA, 17 bp, Homo sapiens
atttttgtttgttttgt

SEQ ID NO: 3762432 - DNA, 16 bp, Homo sapiens
attttttaaaaagcaa

SEQ ID NO: 3762433 - DNA, 18 bp, Homo sapiens
attttttaaaaagcaaaa

SEQ ID NO: 3762434 - DNA, 17 bp, Homo sapiens
attttttaaaacaagaa

SEQ ID NO: 3762435 - DNA, 11 bp, Homo sapiens
attttttaagt

SEQ ID NO: 3762436 - DNA, 18 bp, Homo sapiens
attttttaagtatttata

SEQ ID NO: 3762437 - DNA, 19 bp, Homo sapiens
attttttaagtatttatat

SEQ ID NO: 3762438 - DNA, 15 bp, Homo sapiens
attttttaattattg

SEQ ID NO: 3762439 - DNA, 16 bp, Homo sapiens
attttttattcttgtg

SEQ ID NO: 3762440 - DNA, 22 bp, Homo sapiens
attttttcagaaatatgtggtt

SEQ ID NO: 3762441 - DNA, 20 bp, Homo sapiens
atttttttctaccttgaggt

SEQ ID NO: 3762442 - DNA, 18 bp, Homo sapiens
attttttttaagtattta

SEQ ID NO: 3762443 - DNA, 15 bp, Homo sapiens
attttttttctttta

SEQ ID NO: 3762444 - DNA, 21 bp, Homo sapiens
atttttttttagaacagaaaa

SEQ ID NO: 3762445 - DNA, 20 bp, Homo sapiens
caaaaaaagttgaaggcctt

SEQ ID NO: 3762446 - DNA, 16 bp, Homo sapiens
caaaaaaataaggtgt

SEQ ID NO: 3762447 - DNA, 14 bp, Homo sapiens
caaaaaaattaaat

SEQ ID NO: 3762448 - DNA, 12 bp, Homo sapiens
caaaaaatgagc

SEQ ID NO: 3762449 - DNA, 22 bp, Homo sapiens
caaaaacagcctcacagaagaa

SEQ ID NO: 3762450 - DNA, 17 bp, Homo sapiens
caaaaacctcacccgag

SEQ ID NO: 3762451 - DNA, 17 bp, Homo sapiens
caaaaacgaaagctggg

SEQ ID NO: 3762452 - DNA, 16 bp, Homo sapiens
caaaaactacacatat

SEQ ID NO: 3762453 - DNA, 22 bp, Homo sapiens
caaaaagaatctgcatttagca

SEQ ID NO: 3762454 - DNA, 15 bp, Homo sapiens
caaaaatactctaat

SEQ ID NO: 3762455 - DNA, 18 bp, Homo sapiens
caaaaatactctaattct

SEQ ID NO: 3762456 - DNA, 21 bp, Homo sapiens
caaaaatgtacaaaataaagt

SEQ ID NO: 3762457 - DNA, 15 bp, Homo sapiens
caaaaattagccggg

SEQ ID NO: 3762458 - DNA, 17 bp, Homo sapiens
caaaaattagccgggca

SEQ ID NO: 3762459 - DNA, 20 bp, Homo sapiens
caaaaattagccgggcgtgg

SEQ ID NO: 3762460 - DNA, 19 bp, Homo sapiens
caaaaattatctatttgta

SEQ ID NO: 3762461 - DNA, 20 bp, Homo sapiens
caaaaattcacaagctgcct

SEQ ID NO: 3762462 - DNA, 23 bp, Homo sapiens
caaaaattcacaagctgcctccc

SEQ ID NO: 3762463 - DNA, 13 bp, Homo sapiens
caaaaatttttgg

SEQ ID NO: 3762464 - DNA, 15 bp, Homo sapiens
caaaaatttttggat

SEQ ID NO: 3762465 - DNA, 15 bp, Homo sapiens
caaaacattccgttt

SEQ ID NO: 3762466 - DNA, 13 bp, Homo sapiens
caaaaccacagcc

SEQ ID NO: 3762467 - DNA, 21 bp, Homo sapiens
caaaaccacagccctgtcagt

SEQ ID NO: 3762468 - DNA, 15 bp, Homo sapiens
caaaacggttttact

SEQ ID NO: 3762469 - DNA, 21 bp, Homo sapiens
caaaacggttttactgcagct

SEQ ID NO: 3762470 - DNA, 16 bp, Homo sapiens
caaaactcctgtcttt

SEQ ID NO: 3762471 - DNA, 14 bp, Homo sapiens
caaaagaagtaaca

SEQ ID NO: 3762472 - DNA, 19 bp, Homo sapiens
caaaagaagtaacaagagt

SEQ ID NO: 3762473 - DNA, 15 bp, Homo sapiens
caaaagaatcagaaa

SEQ ID NO: 3762474 - DNA, 19 bp, Homo sapiens
caaaagaatcagaaacagg

SEQ ID NO: 3762475 - DNA, 16 bp, Homo sapiens
caaaagatgcttctca

SEQ ID NO: 3762476 - DNA, 15 bp, Homo sapiens
caaaagcaaatgaga

SEQ ID NO: 3762477 - DNA, 20 bp, Homo sapiens
caaaaggcagtggggctggg

SEQ ID NO: 3762478 - DNA, 20 bp, Homo sapiens
caaaagggtttaaactgatt

SEQ ID NO: 3762479 - DNA, 19 bp, Homo sapiens
caaaaggttcactaaagca

SEQ ID NO: 3762480 - DNA, 14 bp, Homo sapiens
caaaagtgctttgg

SEQ ID NO: 3762481 - DNA, 15 bp, Homo sapiens
caaaagtgctttgga

SEQ ID NO: 3762482 - DNA, 14 bp, Homo sapiens
caaaagtttctctt

SEQ ID NO: 3762483 - DNA, 11 bp, Homo sapiens
caaaataaaaa

SEQ ID NO: 3762484 - DNA, 13 bp, Homo sapiens
aaaaaaaaagttc

SEQ ID NO: 3762485 - DNA, 13 bp, Homo sapiens
aaaaaaagacaag

SEQ ID NO: 3762486 - DNA, 11 bp, Homo sapiens
aaaaaaataag

SEQ ID NO: 3762487 - DNA, 15 bp, Homo sapiens
aaaaaacagaggcca

SEQ ID NO: 3762488 - DNA, 14 bp, Homo sapiens
aaaaaagaatgtca

SEQ ID NO: 3762489 - DNA, 13 bp, Homo sapiens
aaaaaagttgaag

SEQ ID NO: 3762490 - DNA, 12 bp, Homo sapiens
aaaaaataacac

SEQ ID NO: 3762491 - DNA, 19 bp, Homo sapiens
aaaaaatgaaatgttttaa

SEQ ID NO: 3762492 - DNA, 20 bp, Homo sapiens
aaaaacagcattgctttctg

SEQ ID NO: 3762493 - DNA, 21 bp, Homo sapiens
aaaaacagcattgctttctga

SEQ ID NO: 3762494 - DNA, 13 bp, Homo sapiens
aaaaactacacat

SEQ ID NO: 3762495 - DNA, 17 bp, Homo sapiens
aaaaacttttataaatt

SEQ ID NO: 3762496 - DNA, 15 bp, Homo sapiens
aaaaagaaaggaggg

SEQ ID NO: 3762497 - DNA, 13 bp, Homo sapiens
aaaaagcagacag

SEQ ID NO: 3762498 - DNA, 21 bp, Homo sapiens
aaaaagcagacagaagtcact

SEQ ID NO: 3762499 - DNA, 13 bp, Homo sapiens
aaaaagcagctac

SEQ ID NO: 3762500 - DNA, 14 bp, Homo sapiens
aaaaagcttttatg

SEQ ID NO: 3762501 - DNA, 21 bp, Homo sapiens
aaaaagggatccgtacattca

SEQ ID NO: 3762502 - DNA, 21 bp, Homo sapiens
aaaaagtaagtaccactcagg

SEQ ID NO: 3762503 - DNA, 22 bp, Homo sapiens
aaaaagtatcatggaaatatta

SEQ ID NO: 3762504 - DNA, 20 bp, Homo sapiens
aaaaagtcagactgctggga

SEQ ID NO: 3762505 - DNA, 15 bp, Homo sapiens
aaaaagtctctattt

SEQ ID NO: 3762506 - DNA, 17 bp, Homo sapiens
aaaaagtctctatttaa

SEQ ID NO: 3762507 - DNA, 22 bp, Homo sapiens
aaaaagtctctatttaaattct

SEQ ID NO: 3762508 - DNA, 14 bp, Homo sapiens
aaaaagtctgcatt

SEQ ID NO: 3762509 - DNA, 20 bp, Homo sapiens
aaaaagttaaaaaaaataat

SEQ ID NO: 3762510 - DNA, 13 bp, Homo sapiens
aaaaagttgaagg

SEQ ID NO: 3762511 - DNA, 21 bp, Homo sapiens
aaaaataaaaactgactcctt

SEQ ID NO: 3762512 - DNA, 21 bp, Homo sapiens
aaaaataaatttggttctaat

SEQ ID NO: 3762513 - DNA, 12 bp, Homo sapiens
aaaaataatttt

SEQ ID NO: 3762514 - DNA, 16 bp, Homo sapiens
aaaaatactctaattc

SEQ ID NO: 3762515 - DNA, 16 bp, Homo sapiens
aaaaatccagaaagaa

SEQ ID NO: 3762516 - DNA, 18 bp, Homo sapiens
aaaaatccttctaatctg

SEQ ID NO: 3762517 - DNA, 19 bp, Homo sapiens
aaaaatccttctaatctgc

SEQ ID NO: 3762518 - DNA, 11 bp, Homo sapiens
aaaaatgagaa

SEQ ID NO: 3762519 - DNA, 14 bp, Homo sapiens
aaaaatgagaacat

SEQ ID NO: 3762520 - DNA, 20 bp, Homo sapiens
aaaaatgttctattttaatt

SEQ ID NO: 3762521 - DNA, 23 bp, Homo sapiens
aaaaattacagcttcaccctgtc

SEQ ID NO: 3762522 - DNA, 18 bp, Homo sapiens
aaaaattatctatttgta

SEQ ID NO: 3762523 - DNA, 22 bp, Homo sapiens
aaaaattatctatttgtatata

SEQ ID NO: 3762524 - DNA, 14 bp, Homo sapiens
aaaaattgtgatca

SEQ ID NO: 3762525 - DNA, 23 bp, Homo sapiens
aaaaattgtttcaaaataaaaac

SEQ ID NO: 3762526 - DNA, 16 bp, Homo sapiens
aaaaatttaagcattg

SEQ ID NO: 3762527 - DNA, 18 bp, Homo sapiens
aaaaatttaagcattgtt

SEQ ID NO: 3762528 - DNA, 12 bp, Homo sapiens
aaaacaaaaaac

SEQ ID NO: 3762529 - DNA, 18 bp, Homo sapiens
aaaacaatattgtttcta

SEQ ID NO: 3762530 - DNA, 19 bp, Homo sapiens
aaaacaatatttattgtat

SEQ ID NO: 3762531 - DNA, 20 bp, Homo sapiens
aaaacaatatttattgtatt

SEQ ID NO: 3762532 - DNA, 23 bp, Homo sapiens
aaaacaatatttattgtatttta

SEQ ID NO: 3762533 - DNA, 23 bp, Homo sapiens
aaaacacagacattctgccaggc

SEQ ID NO: 3762534 - DNA, 21 bp, Homo sapiens
aaaacactaaaaataaaaatg

SEQ ID NO: 3762535 - DNA, 20 bp, Homo sapiens
aaaacagcattgctttctga

SEQ ID NO: 3762536 - DNA, 18 bp, Homo sapiens
aaaacagcctcacagaag

SEQ ID NO: 3762537 - DNA, 19 bp, Homo sapiens
aaaacaggaaaaaaacttt

SEQ ID NO: 3762538 - DNA, 18 bp, Homo sapiens
aaaacaggtggagaaatt

SEQ ID NO: 3762539 - DNA, 16 bp, Homo sapiens
aaaacatggtagaatt

SEQ ID NO: 3762540 - DNA, 20 bp, Homo sapiens
aaaacattgaagagagagct

SEQ ID NO: 3762541 - DNA, 16 bp, Homo sapiens
aaaaccattgcttcac

SEQ ID NO: 3762542 - DNA, 13 bp, Homo sapiens
aaaacctttcaaa

SEQ ID NO: 3762543 - DNA, 14 bp, Homo sapiens
aaaacgcatggagt

SEQ ID NO: 3762544 - DNA, 15 bp, Homo sapiens
aaaacgttttattgt

SEQ ID NO: 3762545 - DNA, 12 bp, Homo sapiens
aaaactacattt

SEQ ID NO: 3762546 - DNA, 15 bp, Homo sapiens
aaaactacattttaa

SEQ ID NO: 3762547 - DNA, 16 bp, Homo sapiens
aaaactacattttaac

SEQ ID NO: 3762548 - DNA, 17 bp, Homo sapiens
aaaactacattttaaca

SEQ ID NO: 3762549 - DNA, 18 bp, Homo sapiens
aaaactacattttaacat

SEQ ID NO: 3762550 - DNA, 19 bp, Homo sapiens
aaaactatatgtatggttt

SEQ ID NO: 3762551 - DNA, 23 bp, Homo sapiens
aaaactgctgactgttttctctt

SEQ ID NO: 3762552 - DNA, 21 bp, Homo sapiens
aaaacttaaccgcatcagaag

SEQ ID NO: 3762553 - DNA, 17 bp, Homo sapiens
aaaacttgtaaatgctg

SEQ ID NO: 3762554 - DNA, 15 bp, Homo sapiens
aaaactttattttat

SEQ ID NO: 3762555 - DNA, 18 bp, Homo sapiens
aaaactttattttatata

SEQ ID NO: 3762556 - DNA, 15 bp, Homo sapiens
aaaacttttataaat

SEQ ID NO: 3762557 - DNA, 17 bp, Homo sapiens
aaaacttttataaatta

SEQ ID NO: 3762558 - DNA, 18 bp, Homo sapiens
aaaacttttataaattaa

SEQ ID NO: 3762559 - DNA, 21 bp, Homo sapiens
aaaacttttataaattaaata

SEQ ID NO: 3762560 - DNA, 22 bp, Homo sapiens
aaaacttttataaattaaatat

SEQ ID NO: 3762561 - DNA, 19 bp, Homo sapiens
aaaagaaatctctagctca

SEQ ID NO: 3762562 - DNA, 20 bp, Homo sapiens
aaaagaaattccctggacca

SEQ ID NO: 3762563 - DNA, 19 bp, Homo sapiens
aaaagaatccctgttcatt

SEQ ID NO: 3762564 - DNA, 18 bp, Homo sapiens
aaaagacacttgatactt

SEQ ID NO: 3762565 - DNA, 16 bp, Homo sapiens
aaaagactcagtgttc

SEQ ID NO: 3762566 - DNA, 14 bp, Homo sapiens
aaaagatacatttg

SEQ ID NO: 3762567 - DNA, 16 bp, Homo sapiens
aaaagatacatttgta

SEQ ID NO: 3762568 - DNA, 23 bp, Homo sapiens
aaatatatatgtgtgtgtatgtt

SEQ ID NO: 3762569 - DNA, 12 bp, Homo sapiens
aaatatatgtat

SEQ ID NO: 3762570 - DNA, 14 bp, Homo sapiens
aaatatcaatcatt

SEQ ID NO: 3762571 - DNA, 18 bp, Homo sapiens
aaatatcaatcattttcc

SEQ ID NO: 3762572 - DNA, 22 bp, Homo sapiens
aaatatcaatcattttcctttt

SEQ ID NO: 3762573 - DNA, 15 bp, Homo sapiens
aaatatcagactagt

SEQ ID NO: 3762574 - DNA, 15 bp, Homo sapiens
aaatatcattcagca

SEQ ID NO: 3762575 - DNA, 18 bp, Homo sapiens
aaatatcatttatttttt

SEQ ID NO: 3762576 - DNA, 12 bp, Homo sapiens
aaatatctgaaa

SEQ ID NO: 3762577 - DNA, 19 bp, Homo sapiens
aaatatctgaaaatgtatg

SEQ ID NO: 3762578 - DNA, 23 bp, Homo sapiens
aaatatctgaaaatgtatgtgta

SEQ ID NO: 3762579 - DNA, 10 bp, Homo sapiens
aaatatgcaa

SEQ ID NO: 3762580 - DNA, 22 bp, Homo sapiens
aaatattatctttgtaattatt

SEQ ID NO: 3762581 - DNA, 17 bp, Homo sapiens
aaatattatgcaaattc

SEQ ID NO: 3762582 - DNA, 19 bp, Homo sapiens
aaatattatgcaaattccc

SEQ ID NO: 3762583 - DNA, 23 bp, Homo sapiens
aaatattattgtggaaatgaata

SEQ ID NO: 3762584 - DNA, 15 bp, Homo sapiens
aaatattgatgaaaa

SEQ ID NO: 3762585 - DNA, 21 bp, Homo sapiens
aaatatttacatatgaaattt

SEQ ID NO: 3762586 - DNA, 14 bp, Homo sapiens
aaatatttccttaa

SEQ ID NO: 3762587 - DNA, 16 bp, Homo sapiens
aaatcaagtttccaag

SEQ ID NO: 3762588 - DNA, 15 bp, Homo sapiens
aaatcacttccatag

SEQ ID NO: 3762589 - DNA, 19 bp, Homo sapiens
aaatcagcctgctccagct

SEQ ID NO: 3762590 - DNA, 23 bp, Homo sapiens
aaatcagcctgctccagctgttc

SEQ ID NO: 3762591 - DNA, 14 bp, Homo sapiens
aaatcataaactgt

SEQ ID NO: 3762592 - DNA, 23 bp, Homo sapiens
aaatcataaactgtgtgcagact

SEQ ID NO: 3762593 - DNA, 17 bp, Homo sapiens
aaatcatgtacatttct

SEQ ID NO: 3762594 - DNA, 10 bp, Homo sapiens
aaatcatgtt

SEQ ID NO: 3762595 - DNA, 13 bp, Homo sapiens
aaatcatgttatg

SEQ ID NO: 3762596 - DNA, 15 bp, Homo sapiens
aaatcccatttaaaa

SEQ ID NO: 3762597 - DNA, 15 bp, Homo sapiens
aaatcctactgaatg

SEQ ID NO: 3762598 - DNA, 14 bp, Homo sapiens
aaatccttctaatc

SEQ ID NO: 3762599 - DNA, 16 bp, Homo sapiens
aaatcctttactgtta

SEQ ID NO: 3762600 - DNA, 17 bp, Homo sapiens
aaatcctttttctttat

SEQ ID NO: 3762601 - DNA, 13 bp, Homo sapiens
aaatcgatgcagt

SEQ ID NO: 3762602 - DNA, 13 bp, Homo sapiens
aaatctcctattt

SEQ ID NO: 3762603 - DNA, 14 bp, Homo sapiens
aaatctcctatttt

SEQ ID NO: 3762604 - DNA, 15 bp, Homo sapiens
aaatctctagctcag

SEQ ID NO: 3762605 - DNA, 19 bp, Homo sapiens
aaatctctctctgttgtgt

SEQ ID NO: 3762606 - DNA, 21 bp, Homo sapiens
aaatctgtaagctctttgaaa

SEQ ID NO: 3762607 - DNA, 23 bp, Homo sapiens
aaatctgtaagctctttgaaaca

SEQ ID NO: 3762608 - DNA, 21 bp, Homo sapiens
aaatctgtccaaaggaggctg

SEQ ID NO: 3762609 - DNA, 22 bp, Homo sapiens
aaatctgtccaaaggaggctgg

SEQ ID NO: 3762610 - DNA, 22 bp, Homo sapiens
aaatctgtgcaataaaataaca

SEQ ID NO: 3762611 - DNA, 12 bp, Homo sapiens
aaatgaaatgtt

SEQ ID NO: 3762612 - DNA, 14 bp, Homo sapiens
aaatgaaatgtttt

SEQ ID NO: 3762613 - DNA, 14 bp, Homo sapiens
aaatgaaattttac

SEQ ID NO: 3762614 - DNA, 15 bp, Homo sapiens
aaatgaaattttacc

SEQ ID NO: 3762615 - DNA, 15 bp, Homo sapiens
aaatgaataatttcc

SEQ ID NO: 3762616 - DNA, 14 bp, Homo sapiens
aaatgacagatgtt

SEQ ID NO: 3762617 - DNA, 15 bp, Homo sapiens
aaatgaccaatatta

SEQ ID NO: 3762618 - DNA, 19 bp, Homo sapiens
aaatgactaaaaaacaaag

SEQ ID NO: 3762619 - DNA, 17 bp, Homo sapiens
aaatgactaaaaatatt

SEQ ID NO: 3762620 - DNA, 18 bp, Homo sapiens
aaatgagaacatgttggt

SEQ ID NO: 3762621 - DNA, 19 bp, Homo sapiens
aaatgagcctggcaagaat

SEQ ID NO: 3762622 - DNA, 23 bp, Homo sapiens
aaatgagctcgcatttgtcaatg

SEQ ID NO: 3762623 - DNA, 18 bp, Homo sapiens
aaatgagtgtgtttgtca

SEQ ID NO: 3762624 - DNA, 19 bp, Homo sapiens
aaatgatgatgtggaagaa

SEQ ID NO: 3762625 - DNA, 22 bp, Homo sapiens
aaatgatgatgtggaagaactt

SEQ ID NO: 3762626 - DNA, 14 bp, Homo sapiens
aaatgcaagatttt

SEQ ID NO: 3762627 - DNA, 16 bp, Homo sapiens
aaatgcaatatgtatt

SEQ ID NO: 3762628 - DNA, 19 bp, Homo sapiens
aaatgcatatcctgagcca

SEQ ID NO: 3762629 - DNA, 16 bp, Homo sapiens
aaatgcatccattcct

SEQ ID NO: 3762630 - DNA, 13 bp, Homo sapiens
aaatgcccagctt

SEQ ID NO: 3762631 - DNA, 16 bp, Homo sapiens
aaatgccttactttgt

SEQ ID NO: 3762632 - DNA, 20 bp, Homo sapiens
aaatgccttactttgtatga

SEQ ID NO: 3762633 - DNA, 22 bp, Homo sapiens
aaatgccttactttgtatgata

SEQ ID NO: 3762634 - DNA, 19 bp, Homo sapiens
aaatggaattcattctggt

SEQ ID NO: 3762635 - DNA, 22 bp, Homo sapiens
aaatggaggtccttctgctgga

SEQ ID NO: 3762636 - DNA, 19 bp, Homo sapiens
aaatggccatttgcttttt

SEQ ID NO: 3762637 - DNA, 19 bp, Homo sapiens
aaatggtaaaattgcatgg

SEQ ID NO: 3762638 - DNA, 23 bp, Homo sapiens
aaatggtgaaaataaaataaagc

SEQ ID NO: 3762639 - DNA, 18 bp, Homo sapiens
aaatgtaacttttgtaag

SEQ ID NO: 3762640 - DNA, 19 bp, Homo sapiens
aaatgtacaaaataaagtt

SEQ ID NO: 3762641 - DNA, 21 bp, Homo sapiens
aaatgtacaaaataaagttac

SEQ ID NO: 3762642 - DNA, 14 bp, Homo sapiens
aaatgtatcttatt

SEQ ID NO: 3762643 - DNA, 15 bp, Homo sapiens
aaatgtattcaaata

SEQ ID NO: 3762644 - DNA, 22 bp, Homo sapiens
aaatgtctgtggccttgttctc

SEQ ID NO: 3762645 - DNA, 15 bp, Homo sapiens
aaatgtggctcctgg

SEQ ID NO: 3762646 - DNA, 16 bp, Homo sapiens
aaatgtgtttaaaaca

SEQ ID NO: 3762647 - DNA, 21 bp, Homo sapiens
aaatgttacatagtgtaggct

SEQ ID NO: 3762648 - DNA, 15 bp, Homo sapiens
aaatgttctttgggg

SEQ ID NO: 3762649 - DNA, 16 bp, Homo sapiens
aaatgttttaaggctt

SEQ ID NO: 3762650 - DNA, 23 bp, Homo sapiens
aaatgtttttctgccagggagct

SEQ ID NO: 3762651 - DNA, 20 bp, Homo sapiens
aaattaaatatatgtatgta

SEQ ID NO: 3762652 - DNA, 13 bp, Homo sapiens
aaattaacactgc

SEQ ID NO: 3762653 - DNA, 14 bp, Homo sapiens
aaattaagaatgtt

SEQ ID NO: 3762654 - DNA, 14 bp, Homo sapiens
aaattagatgaact

SEQ ID NO: 3762655 - DNA, 17 bp, Homo sapiens
aaattagctgtgtgaaa

SEQ ID NO: 3762656 - DNA, 14 bp, Homo sapiens
aaattaggaataaa

SEQ ID NO: 3762657 - DNA, 15 bp, Homo sapiens
aaattaggaataaat

SEQ ID NO: 3762658 - DNA, 18 bp, Homo sapiens
aaattaggaataaataaa

SEQ ID NO: 3762659 - DNA, 17 bp, Homo sapiens
aaattaggttttgtaca

SEQ ID NO: 3762660 - DNA, 23 bp, Homo sapiens
aaattaggttttgtacaattgaa

SEQ ID NO: 3762661 - DNA, 16 bp, Homo sapiens
aaattataacttaaaa

SEQ ID NO: 3762662 - DNA, 22 bp, Homo sapiens
aaattataacttaaaatatttt

SEQ ID NO: 3762663 - DNA, 15 bp, Homo sapiens
aaattataaggactg

SEQ ID NO: 3762664 - DNA, 16 bp, Homo sapiens
aaattataaggactgc

SEQ ID NO: 3762665 - DNA, 17 bp, Homo sapiens
aaattataaggactgca

SEQ ID NO: 3762666 - DNA, 18 bp, Homo sapiens
aaattataaggactgcat

SEQ ID NO: 3762667 - DNA, 20 bp, Homo sapiens
aaattataaggactgcatgg

SEQ ID NO: 3762668 - DNA, 23 bp, Homo sapiens
aaattataaggactgcatggtaa

SEQ ID NO: 3762669 - DNA, 18 bp, Homo sapiens
aaattatcaagctaataa

SEQ ID NO: 3762670 - DNA, 16 bp, Homo sapiens
aaattatctatttgta

SEQ ID NO: 3762671 - DNA, 20 bp, Homo sapiens
aaattattttaaattataag

SEQ ID NO: 3762672 - DNA, 22 bp, Homo sapiens
aaattattttaaattataagga

SEQ ID NO: 3762673 - DNA, 16 bp, Homo sapiens
aaattcacaagctgcc

SEQ ID NO: 3762674 - DNA, 16 bp, Homo sapiens
aaattcacaatagaaa

SEQ ID NO: 3762675 - DNA, 20 bp, Homo sapiens
aaattcccagatttgaagac

SEQ ID NO: 3762676 - DNA, 12 bp, Homo sapiens
aaattcccatga

SEQ ID NO: 3762677 - DNA, 22 bp, Homo sapiens
aaattccttagcttagacctca

SEQ ID NO: 3762678 - DNA, 15 bp, Homo sapiens
aaattctacaacaca

SEQ ID NO: 3762679 - DNA, 19 bp, Homo sapiens
aaattctattacagtatgt

SEQ ID NO: 3762680 - DNA, 13 bp, Homo sapiens
aaattctgtttct

SEQ ID NO: 3762681 - DNA, 23 bp, Homo sapiens
aagactttccccatactctgtct

SEQ ID NO: 3762682 - DNA, 22 bp, Homo sapiens
aagagaaaaaaagtttgccaga

SEQ ID NO: 3762683 - DNA, 15 bp, Homo sapiens
aagagaaaattgaat

SEQ ID NO: 3762684 - DNA, 17 bp, Homo sapiens
aagagaaaattgaattt

SEQ ID NO: 3762685 - DNA, 21 bp, Homo sapiens
aagagaaaattgaatttaaca

SEQ ID NO: 3762686 - DNA, 14 bp, Homo sapiens
aagagaaactttgt

SEQ ID NO: 3762687 - DNA, 18 bp, Homo sapiens
aagagaaactttgtgcta

SEQ ID NO: 3762688 - DNA, 11 bp, Homo sapiens
aagagaaatac

SEQ ID NO: 3762689 - DNA, 20 bp, Homo sapiens
aagagaatattagctttact

SEQ ID NO: 3762690 - DNA, 15 bp, Homo sapiens
aagagagatgttttg

SEQ ID NO: 3762691 - DNA, 21 bp, Homo sapiens
aagagatatgtagaaggcaca

SEQ ID NO: 3762692 - DNA, 15 bp, Homo sapiens
aagagattcctgagc

SEQ ID NO: 3762693 - DNA, 13 bp, Homo sapiens
aagagcagcctgt

SEQ ID NO: 3762694 - DNA, 18 bp, Homo sapiens
aagagcagcctgtggcat

SEQ ID NO: 3762695 - DNA, 20 bp, Homo sapiens
aagagccttggtgtccacct

SEQ ID NO: 3762696 - DNA, 16 bp, Homo sapiens
aagagctagcgctgcc

SEQ ID NO: 3762697 - DNA, 15 bp, Homo sapiens
aagagctatacagtt

SEQ ID NO: 3762698 - DNA, 17 bp, Homo sapiens
aagagctttacaaaaag

SEQ ID NO: 3762699 - DNA, 16 bp, Homo sapiens
aagaggctgaaagagg

SEQ ID NO: 3762700 - DNA, 13 bp, Homo sapiens
aagaggctgaggc

SEQ ID NO: 3762701 - DNA, 18 bp, Homo sapiens
aagagggagaagcatgaa

SEQ ID NO: 3762702 - DNA, 15 bp, Homo sapiens
aagaggggctgggct

SEQ ID NO: 3762703 - DNA, 15 bp, Homo sapiens
aagaggtataaagct

SEQ ID NO: 3762704 - DNA, 21 bp, Homo sapiens
aagaggtatttatctttactt

SEQ ID NO: 3762705 - DNA, 19 bp, Homo sapiens
aagagtagttgatgttgca

SEQ ID NO: 3762706 - DNA, 22 bp, Homo sapiens
aagagtagttgatgttgcattt

SEQ ID NO: 3762707 - DNA, 23 bp, Homo sapiens
aagagtagttgatgttgcatttt

SEQ ID NO: 3762708 - DNA, 14 bp, Homo sapiens
aagagtgcattttc

SEQ ID NO: 3762709 - DNA, 23 bp, Homo sapiens
aagagttcttaaggattgtgata

SEQ ID NO: 3762710 - DNA, 18 bp, Homo sapiens
aagagttgtgttgttctt

SEQ ID NO: 3762711 - DNA, 13 bp, Homo sapiens
aagataaatgtgc

SEQ ID NO: 3762712 - DNA, 20 bp, Homo sapiens
aagataacaagatctttcag

SEQ ID NO: 3762713 - DNA, 19 bp, Homo sapiens
aagataatattaaggaaga

SEQ ID NO: 3762714 - DNA, 21 bp, Homo sapiens
aagataatattaaggaagaca

SEQ ID NO: 3762715 - DNA, 15 bp, Homo sapiens
aagatacaagtttca

SEQ ID NO: 3762716 - DNA, 20 bp, Homo sapiens
aagatacaagtttcagacag

SEQ ID NO: 3762717 - DNA, 14 bp, Homo sapiens
aagatacatttgta

SEQ ID NO: 3762718 - DNA, 21 bp, Homo sapiens
aagatacgactttattttctg

SEQ ID NO: 3762719 - DNA, 12 bp, Homo sapiens
aagatagaagaa

SEQ ID NO: 3762720 - DNA, 15 bp, Homo sapiens
aagataggctctgca

SEQ ID NO: 3762721 - DNA, 23 bp, Homo sapiens
aagatcaaaaggttaataaagta

SEQ ID NO: 3762722 - DNA, 23 bp, Homo sapiens
aagatctgcagggggtgtgtctg

SEQ ID NO: 3762723 - DNA, 17 bp, Homo sapiens
aagatgaaaatggaagt

SEQ ID NO: 3762724 - DNA, 14 bp, Homo sapiens
aagatgaagaggat

SEQ ID NO: 3762725 - DNA, 15 bp, Homo sapiens
aagatgacttcccaa

SEQ ID NO: 3762726 - DNA, 15 bp, Homo sapiens
aagatgcaaggacca

SEQ ID NO: 3762727 - DNA, 24 bp, Homo sapiens
aagatgcccactgaggaatgatga

SEQ ID NO: 3762728 - DNA, 16 bp, Homo sapiens
aagatgcttctcactg

SEQ ID NO: 3762729 - DNA, 19 bp, Homo sapiens
aagatgcttctcactgcca

SEQ ID NO: 3762730 - DNA, 19 bp, Homo sapiens
aagatgcttttcaaactga

SEQ ID NO: 3762731 - DNA, 21 bp, Homo sapiens
aagatggctgtgcctctgcct

SEQ ID NO: 3762732 - DNA, 23 bp, Homo sapiens
aagatggctgtgcctctgcctgt

SEQ ID NO: 3762733 - DNA, 16 bp, Homo sapiens
aagatggtatatttgg

SEQ ID NO: 3762734 - DNA, 17 bp, Homo sapiens
aagattcatccatttat

SEQ ID NO: 3762735 - DNA, 12 bp, Homo sapiens
aagattcccaga

SEQ ID NO: 3762736 - DNA, 19 bp, Homo sapiens
aagattcccagagacagga

SEQ ID NO: 3762737 - DNA, 21 bp, Homo sapiens
aagattgaaaaggaagatcag

SEQ ID NO: 3762738 - DNA, 14 bp, Homo sapiens
aagatttattttgt

SEQ ID NO: 3762739 - DNA, 21 bp, Homo sapiens
aagatttgtactacagttctt

SEQ ID NO: 3762740 - DNA, 14 bp, Homo sapiens
aagattttgaaaac

SEQ ID NO: 3762741 - DNA, 15 bp, Homo sapiens
aagattttgaaaact

SEQ ID NO: 3762742 - DNA, 19 bp, Homo sapiens
aagattttgaaatttttat

SEQ ID NO: 3762743 - DNA, 21 bp, Homo sapiens
aagattttgaatgcttcctga

SEQ ID NO: 3762744 - DNA, 21 bp, Homo sapiens
aagattttggaggagaaggac

SEQ ID NO: 3762745 - DNA, 18 bp, Homo sapiens
aagcaaaaacgaaagctg

SEQ ID NO: 3762746 - DNA, 13 bp, Homo sapiens
aagcaaaatatta

SEQ ID NO: 3762747 - DNA, 14 bp, Homo sapiens
aagcaaaatattat

SEQ ID NO: 3762748 - DNA, 11 bp, Homo sapiens
aagcaaaggtg

SEQ ID NO: 3762749 - DNA, 17 bp, Homo sapiens
aagcaaatcagaaactt

SEQ ID NO: 3762750 - DNA, 15 bp, Homo sapiens
aagcaagaaagaaac

SEQ ID NO: 3762751 - DNA, 16 bp, Homo sapiens
aagcaagatttcagat

SEQ ID NO: 3762752 - DNA, 19 bp, Homo sapiens
aagcaaggatctttcaccc

SEQ ID NO: 3762753 - DNA, 16 bp, Homo sapiens
aagcaagtagctttcc

SEQ ID NO: 3762754 - DNA, 16 bp, Homo sapiens
aagcaatcctcctgag

SEQ ID NO: 3762755 - DNA, 13 bp, Homo sapiens
aagcaattgctgc

SEQ ID NO: 3762756 - DNA, 17 bp, Homo sapiens
aagcaattgctgcatct

SEQ ID NO: 3762757 - DNA, 17 bp, Homo sapiens
aagcacagaaaactaga

SEQ ID NO: 3762758 - DNA, 14 bp, Homo sapiens
aagcaccccatgcc

SEQ ID NO: 3762759 - DNA, 15 bp, Homo sapiens
aagcacctcctgcct

SEQ ID NO: 3762760 - DNA, 17 bp, Homo sapiens
aagcacctcctgcctcg

SEQ ID NO: 3762761 - DNA, 17 bp, Homo sapiens
aagcacctgccgacctc

SEQ ID NO: 3762762 - DNA, 16 bp, Homo sapiens
aagcaccttagctggc

SEQ ID NO: 3762763 - DNA, 21 bp, Homo sapiens
aagcacgtggtaaaacacttg

SEQ ID NO: 3762764 - DNA, 21 bp, Homo sapiens
aagcactcctccctgatgtac

SEQ ID NO: 3762765 - DNA, 23 bp, Homo sapiens
aagcactcctccctgatgtacag

SEQ ID NO: 3762766 - DNA, 14 bp, Homo sapiens
aagcagatgcaaag

SEQ ID NO: 3762767 - DNA, 13 bp, Homo sapiens
aagcagctcaaag

SEQ ID NO: 3762768 - DNA, 16 bp, Homo sapiens
aagcagctcaaaggca

SEQ ID NO: 3762769 - DNA, 18 bp, Homo sapiens
aagcagctcaaaggcaca

SEQ ID NO: 3762770 - DNA, 11 bp, Homo sapiens
aagcaggaagc

SEQ ID NO: 3762771 - DNA, 12 bp, Homo sapiens
aagcaggaagct

SEQ ID NO: 3762772 - DNA, 22 bp, Homo sapiens
aagcaggttgaggggctcctgg

SEQ ID NO: 3762773 - DNA, 14 bp, Homo sapiens
aagcagtaaaaact

SEQ ID NO: 3762774 - DNA, 13 bp, Homo sapiens
aagcagtaactga

SEQ ID NO: 3762775 - DNA, 16 bp, Homo sapiens
aagcagtcacttttcc

SEQ ID NO: 3762776 - DNA, 18 bp, Homo sapiens
aagcagtgccttccataa

SEQ ID NO: 3762777 - DNA, 23 bp, Homo sapiens
aagcatattgttattatataatt

SEQ ID NO: 3762778 - DNA, 14 bp, Homo sapiens
aagcatcaaactct

SEQ ID NO: 3762779 - DNA, 14 bp, Homo sapiens
aagcatcacaaatg

SEQ ID NO: 3762780 - DNA, 16 bp, Homo sapiens
aagcatcacctcaggc

SEQ ID NO: 3762781 - DNA, 18 bp, Homo sapiens
aagcatcacctcaggcca

SEQ ID NO: 3762782 - DNA, 22 bp, Homo sapiens
aagcatcattatttgcagagac

SEQ ID NO: 3762783 - DNA, 14 bp, Homo sapiens
aagcatccatgtgt

SEQ ID NO: 3762784 - DNA, 12 bp, Homo sapiens
aagcatctcctg

SEQ ID NO: 3762785 - DNA, 16 bp, Homo sapiens
aagcatctcctgagga

SEQ ID NO: 3762786 - DNA, 17 bp, Homo sapiens
aagcatctcctgaggat

SEQ ID NO: 3762787 - DNA, 17 bp, Homo sapiens
aagcatgtctcaatagt

SEQ ID NO: 3762788 - DNA, 13 bp, Homo sapiens
aagcatgtggcat

SEQ ID NO: 3762789 - DNA, 16 bp, Homo sapiens
aagcattactcttgta

SEQ ID NO: 3762790 - DNA, 21 bp, Homo sapiens
aagcattcaatttattcaaga

SEQ ID NO: 3762791 - DNA, 22 bp, Homo sapiens
aagcattgggtgggtaaattca

SEQ ID NO: 3762792 - DNA, 11 bp, Homo sapiens
aagcattgttt

SEQ ID NO: 3762793 - DNA, 21 bp, Homo sapiens
aagcattgtttgcttattgtt

SEQ ID NO: 3762794 - DNA, 15 bp, Homo sapiens
aatagagtatatgca

SEQ ID NO: 3762795 - DNA, 16 bp, Homo sapiens
aatagagtatatgcac

SEQ ID NO: 3762796 - DNA, 19 bp, Homo sapiens
aatagagttgggacaattg

SEQ ID NO: 3762797 - DNA, 17 bp, Homo sapiens
aatagcaacatgcttca

SEQ ID NO: 3762798 - DNA, 19 bp, Homo sapiens
aatagcactttcattgcca

SEQ ID NO: 3762799 - DNA, 20 bp, Homo sapiens
aatagcactttcattgccag

SEQ ID NO: 3762800 - DNA, 20 bp, Homo sapiens
aatagcatgtcactaaagca

SEQ ID NO: 3762801 - DNA, 21 bp, Homo sapiens
aatagctatatccatgtactg

SEQ ID NO: 3762802 - DNA, 22 bp, Homo sapiens
aatagctatatccatgtactgt

SEQ ID NO: 3762803 - DNA, 13 bp, Homo sapiens
aatagctgggact

SEQ ID NO: 3762804 - DNA, 14 bp, Homo sapiens
aatagctgggacta

SEQ ID NO: 3762805 - DNA, 21 bp, Homo sapiens
aatagctttaccctcaggcat

SEQ ID NO: 3762806 - DNA, 16 bp, Homo sapiens
aatagtggccagacca

SEQ ID NO: 3762807 - DNA, 21 bp, Homo sapiens
aatagtggttcttggaaaaat

SEQ ID NO: 3762808 - DNA, 13 bp, Homo sapiens
aatagtgtgttct

SEQ ID NO: 3762809 - DNA, 15 bp, Homo sapiens
aatagtgtgttctga

SEQ ID NO: 3762810 - DNA, 13 bp, Homo sapiens
aatataaacacta

SEQ ID NO: 3762811 - DNA, 18 bp, Homo sapiens
aatataaccaatgtttaa

SEQ ID NO: 3762812 - DNA, 21 bp, Homo sapiens
aatataaccaatgtttaaaaa

SEQ ID NO: 3762813 - DNA, 19 bp, Homo sapiens
aatataaggaaagcaataa

SEQ ID NO: 3762814 - DNA, 11 bp, Homo sapiens
aatataattat

SEQ ID NO: 3762815 - DNA, 12 bp, Homo sapiens
aatataattgtt

SEQ ID NO: 3762816 - DNA, 18 bp, Homo sapiens
aatatacattcaaactta

SEQ ID NO: 3762817 - DNA, 20 bp, Homo sapiens
aatatagaatttttaatgtt

SEQ ID NO: 3762818 - DNA, 18 bp, Homo sapiens
aatatatatgttgatttc

SEQ ID NO: 3762819 - DNA, 22 bp, Homo sapiens
aatatatatgttgatttcttgt

SEQ ID NO: 3762820 - DNA, 14 bp, Homo sapiens
aatatatattctgg

SEQ ID NO: 3762821 - DNA, 14 bp, Homo sapiens
aatatattctcttt

SEQ ID NO: 3762822 - DNA, 15 bp, Homo sapiens
aatatatttaagata

SEQ ID NO: 3762823 - DNA, 20 bp, Homo sapiens
aatatatttaagataattat

SEQ ID NO: 3762824 - DNA, 15 bp, Homo sapiens
aatatatttcagata

SEQ ID NO: 3762825 - DNA, 16 bp, Homo sapiens
aatatcaatcattttc

SEQ ID NO: 3762826 - DNA, 15 bp, Homo sapiens
aatatcagactagtg

SEQ ID NO: 3762827 - DNA, 21 bp, Homo sapiens
aatatcagttactcagccctg

SEQ ID NO: 3762828 - DNA, 23 bp, Homo sapiens
aatatcatttattttttacatta

SEQ ID NO: 3762829 - DNA, 17 bp, Homo sapiens
aatatctgaaaatgtat

SEQ ID NO: 3762830 - DNA, 18 bp, Homo sapiens
aatatctgaaaatgtatg

SEQ ID NO: 3762831 - DNA, 19 bp, Homo sapiens
aatatgaacggtgagcatt

SEQ ID NO: 3762832 - DNA, 21 bp, Homo sapiens
aatatgacggaagaacataga

SEQ ID NO: 3762833 - DNA, 22 bp, Homo sapiens
aatatgctgccaaattttggcc

SEQ ID NO: 3762834 - DNA, 17 bp, Homo sapiens
aatatggactcagtttt

SEQ ID NO: 3762835 - DNA, 13 bp, Homo sapiens
aatatgtatttta

SEQ ID NO: 3762836 - DNA, 21 bp, Homo sapiens
aatatgtattttatgtatgtt

SEQ ID NO: 3762837 - DNA, 16 bp, Homo sapiens
aatatgttagcaaaga

SEQ ID NO: 3762838 - DNA, 15 bp, Homo sapiens
aatattagctttact

SEQ ID NO: 3762839 - DNA, 19 bp, Homo sapiens
aatattagctttactgttt

SEQ ID NO: 3762840 - DNA, 16 bp, Homo sapiens
aatattatactaagaa

SEQ ID NO: 3762841 - DNA, 20 bp, Homo sapiens
aatattatgcaaattcccag

SEQ ID NO: 3762842 - DNA, 16 bp, Homo sapiens
aatattgagaaagaaa

SEQ ID NO: 3762843 - DNA, 19 bp, Homo sapiens
aatattgagaaagaaacta

SEQ ID NO: 3762844 - DNA, 18 bp, Homo sapiens
aatattgatatgcttata

SEQ ID NO: 3762845 - DNA, 20 bp, Homo sapiens
aatattgttcctaagttctt

SEQ ID NO: 3762846 - DNA, 20 bp, Homo sapiens
aatatttaaaatttattgct

SEQ ID NO: 3762847 - DNA, 17 bp, Homo sapiens
aatatttaagatagttt

SEQ ID NO: 3762848 - DNA, 16 bp, Homo sapiens
aatatttaaggagatg

SEQ ID NO: 3762849 - DNA, 11 bp, Homo sapiens
aatatttataa

SEQ ID NO: 3762850 - DNA, 17 bp, Homo sapiens
aatatttatatttcact

SEQ ID NO: 3762851 - DNA, 15 bp, Homo sapiens
aatatttatgtaaac

SEQ ID NO: 3762852 - DNA, 14 bp, Homo sapiens
aatatttattacct

SEQ ID NO: 3762853 - DNA, 14 bp, Homo sapiens
aatatttattgtat

SEQ ID NO: 3762854 - DNA, 19 bp, Homo sapiens
aatatttgtcgatatttcc

SEQ ID NO: 3762855 - DNA, 14 bp, Homo sapiens
aatattttaagcat

SEQ ID NO: 3762856 - DNA, 21 bp, Homo sapiens
aatattttaagcattactctt

SEQ ID NO: 3762857 - DNA, 17 bp, Homo sapiens
aatattttattcaaggt

SEQ ID NO: 3762858 - DNA, 10 bp, Homo sapiens
aatcaaaact

SEQ ID NO: 3762859 - DNA, 22 bp, Homo sapiens
aatcaaatttgtagggtttcta

SEQ ID NO: 3762860 - DNA, 14 bp, Homo sapiens
aatcaactctaata

SEQ ID NO: 3762861 - DNA, 14 bp, Homo sapiens
aatcaactgaaagt

SEQ ID NO: 3762862 - DNA, 19 bp, Homo sapiens
aatcaagtttccaagcaaa

SEQ ID NO: 3762863 - DNA, 20 bp, Homo sapiens
aatcaagtttccaagcaaat

SEQ ID NO: 3762864 - DNA, 22 bp, Homo sapiens
aatcaatgctataactatgttg

SEQ ID NO: 3762865 - DNA, 17 bp, Homo sapiens
aatcacgaggtcaggag

SEQ ID NO: 3762866 - DNA, 15 bp, Homo sapiens
aatcactaacattat

SEQ ID NO: 3762867 - DNA, 16 bp, Homo sapiens
aatcactaacattata

SEQ ID NO: 3762868 - DNA, 22 bp, Homo sapiens
aatcactaacattatattgcaa

SEQ ID NO: 3762869 - DNA, 19 bp, Homo sapiens
aatcagaggagagacggtg

SEQ ID NO: 3762870 - DNA, 14 bp, Homo sapiens
aatcagatcatttc

SEQ ID NO: 3762871 - DNA, 15 bp, Homo sapiens
aatcagatctttatt

SEQ ID NO: 3762872 - DNA, 14 bp, Homo sapiens
aatcagattttcct

SEQ ID NO: 3762873 - DNA, 18 bp, Homo sapiens
aatcagattttcctgtgg

SEQ ID NO: 3762874 - DNA, 12 bp, Homo sapiens
aatcagcattct

SEQ ID NO: 3762875 - DNA, 19 bp, Homo sapiens
aatcagcctgctccagctg

SEQ ID NO: 3762876 - DNA, 18 bp, Homo sapiens
aatcagggaggtcatttt

SEQ ID NO: 3762877 - DNA, 22 bp, Homo sapiens
aatcatagtactctttgtagca

SEQ ID NO: 3762878 - DNA, 21 bp, Homo sapiens
aatcatataataaatgtacat

SEQ ID NO: 3762879 - DNA, 21 bp, Homo sapiens
aatcatggctaagcttaaaaa

SEQ ID NO: 3762880 - DNA, 14 bp, Homo sapiens
aatcatgtacattt

SEQ ID NO: 3762881 - DNA, 23 bp, Homo sapiens
aatcatgttatgataaaaaattt

SEQ ID NO: 3762882 - DNA, 19 bp, Homo sapiens
aatcattatttattaaatt

SEQ ID NO: 3762883 - DNA, 22 bp, Homo sapiens
aatcatttcttgggccctcctg

SEQ ID NO: 3762884 - DNA, 22 bp, Homo sapiens
aatcattttaattattattctt

SEQ ID NO: 3762885 - DNA, 23 bp, Homo sapiens
aatccaagcgaggtcaacagaga

SEQ ID NO: 3762886 - DNA, 17 bp, Homo sapiens
aatccatgttagttttt

SEQ ID NO: 3762887 - DNA, 19 bp, Homo sapiens
aatccatgttagtttttac

SEQ ID NO: 3762888 - DNA, 20 bp, Homo sapiens
aatcccattcataactttca

SEQ ID NO: 3762889 - DNA, 17 bp, Homo sapiens
aatcccatttaaaaaaa

SEQ ID NO: 3762890 - DNA, 19 bp, Homo sapiens
aatcccctcattcaggaaa

SEQ ID NO: 3762891 - DNA, 12 bp, Homo sapiens
aatccctgttca

SEQ ID NO: 3762892 - DNA, 18 bp, Homo sapiens
aatcctaccaacctctga

SEQ ID NO: 3762893 - DNA, 16 bp, Homo sapiens
aatcctcactgggtgg

SEQ ID NO: 3762894 - DNA, 14 bp, Homo sapiens
aatcctggggaaca

SEQ ID NO: 3762895 - DNA, 15 bp, Homo sapiens
aatcctgtcctcagc

SEQ ID NO: 3762896 - DNA, 16 bp, Homo sapiens
aatcctgttgaaaagc

SEQ ID NO: 3762897 - DNA, 14 bp, Homo sapiens
aatccttctaatct

SEQ ID NO: 3762898 - DNA, 20 bp, Homo sapiens
aatcctttttctttataaac

SEQ ID NO: 3762899 - DNA, 13 bp, Homo sapiens
aatcgatggggga

SEQ ID NO: 3762900 - DNA, 21 bp, Homo sapiens
aatcgatgggggatgcttcat

SEQ ID NO: 3762901 - DNA, 22 bp, Homo sapiens
aatcggatctggggctctggga

SEQ ID NO: 3762902 - DNA, 16 bp, Homo sapiens
aatcgttatgtgtgta

SEQ ID NO: 3762903 - DNA, 14 bp, Homo sapiens
aatctaaaagcttt

SEQ ID NO: 3762904 - DNA, 13 bp, Homo sapiens
aatctaagggaaa

SEQ ID NO: 3762905 - DNA, 21 bp, Homo sapiens
aatctattgggattttctaca

SEQ ID NO: 3762906 - DNA, 15 bp, Homo sapiens
aatctattgggttca

SEQ ID NO: 3762907 - DNA, 16 bp, Homo sapiens
acacctgtactggaga

SEQ ID NO: 3762908 - DNA, 17 bp, Homo sapiens
acacctgtagtcccagc

SEQ ID NO: 3762909 - DNA, 14 bp, Homo sapiens
acaccttgacaggg

SEQ ID NO: 3762910 - DNA, 22 bp, Homo sapiens
acacgaggtatgaggtctagga

SEQ ID NO: 3762911 - DNA, 15 bp, Homo sapiens
acacgcgtgcacaca

SEQ ID NO: 3762912 - DNA, 20 bp, Homo sapiens
acacgctccctccccctgcc

SEQ ID NO: 3762913 - DNA, 23 bp, Homo sapiens
acacgtacttaaatgaaagcatg

SEQ ID NO: 3762914 - DNA, 17 bp, Homo sapiens
acacgtctgaccctctc

SEQ ID NO: 3762915 - DNA, 20 bp, Homo sapiens
acacgtggaggaatgctccc

SEQ ID NO: 3762916 - DNA, 21 bp, Homo sapiens
acacgtggaggaatgctcccc

SEQ ID NO: 3762917 - DNA, 16 bp, Homo sapiens
acactaaccacgctgg

SEQ ID NO: 3762918 - DNA, 17 bp, Homo sapiens
acactaaccacgctgga

SEQ ID NO: 3762919 - DNA, 22 bp, Homo sapiens
acactagctaatatcaatagaa

SEQ ID NO: 3762920 - DNA, 22 bp, Homo sapiens
acactatggtatttgagtgttt

SEQ ID NO: 3762921 - DNA, 13 bp, Homo sapiens
acactattttcag

SEQ ID NO: 3762922 - DNA, 20 bp, Homo sapiens
acactcagcacccccttctc

SEQ ID NO: 3762923 - DNA, 22 bp, Homo sapiens
acactcagcacccccttctctg

SEQ ID NO: 3762924 - DNA, 12 bp, Homo sapiens
acactccagcct

SEQ ID NO: 3762925 - DNA, 16 bp, Homo sapiens
acactccatcagctta

SEQ ID NO: 3762926 - DNA, 16 bp, Homo sapiens
acactctcctgggccc

SEQ ID NO: 3762927 - DNA, 19 bp, Homo sapiens
acactctcctgggcccctc

SEQ ID NO: 3762928 - DNA, 22 bp, Homo sapiens
acactctcctgggcccctccct

SEQ ID NO: 3762929 - DNA, 20 bp, Homo sapiens
acactctgaattccaagtag

SEQ ID NO: 3762930 - DNA, 20 bp, Homo sapiens
acactgaaatatacacacag

SEQ ID NO: 3762931 - DNA, 19 bp, Homo sapiens
acactgaagttaacagaga

SEQ ID NO: 3762932 - DNA, 18 bp, Homo sapiens
acactgaatatttatatt

SEQ ID NO: 3762933 - DNA, 17 bp, Homo sapiens
acactgaccatccactc

SEQ ID NO: 3762934 - DNA, 17 bp, Homo sapiens
acactgttagaacacta

SEQ ID NO: 3762935 - DNA, 23 bp, Homo sapiens
acactgtttacaagaaaaaatga

SEQ ID NO: 3762936 - DNA, 13 bp, Homo sapiens
acacttaacagat

SEQ ID NO: 3762937 - DNA, 16 bp, Homo sapiens
acacttacactttatg

SEQ ID NO: 3762938 - DNA, 13 bp, Homo sapiens
acacttcagactg

SEQ ID NO: 3762939 - DNA, 13 bp, Homo sapiens
acacttcagagag

SEQ ID NO: 3762940 - DNA, 19 bp, Homo sapiens
acacttcaggctcttctcc

SEQ ID NO: 3762941 - DNA, 22 bp, Homo sapiens
acacttcaggctcttctccttt

SEQ ID NO: 3762942 - DNA, 19 bp, Homo sapiens
acacttcctgtccagagag

SEQ ID NO: 3762943 - DNA, 22 bp, Homo sapiens
acacttcttcttggtcttattt

SEQ ID NO: 3762944 - DNA, 17 bp, Homo sapiens
acacttgtccacatagg

SEQ ID NO: 3762945 - DNA, 13 bp, Homo sapiens
acacttgtgtgtg

SEQ ID NO: 3762946 - DNA, 22 bp, Homo sapiens
acacttgtgtgtgggctgtgag

SEQ ID NO: 3762947 - DNA, 23 bp, Homo sapiens
acacttgtgtgtgggctgtgagt

SEQ ID NO: 3762948 - DNA, 20 bp, Homo sapiens
acacttgttccagctctttg

SEQ ID NO: 3762949 - DNA, 22 bp, Homo sapiens
acactttggaagtttgtgttct

SEQ ID NO: 3762950 - DNA, 20 bp, Homo sapiens
acacttttcatgtgtgattt

SEQ ID NO: 3762951 - DNA, 16 bp, Homo sapiens
acagaaaaaaaacaca

SEQ ID NO: 3762952 - DNA, 20 bp, Homo sapiens
acagaaaacggttaaaactg

SEQ ID NO: 3762953 - DNA, 17 bp, Homo sapiens
acagaaaactagaattt

SEQ ID NO: 3762954 - DNA, 12 bp, Homo sapiens
acagaaacaaaa

SEQ ID NO: 3762955 - DNA, 12 bp, Homo sapiens
acagaaagagag

SEQ ID NO: 3762956 - DNA, 17 bp, Homo sapiens
acagaaagagagcactg

SEQ ID NO: 3762957 - DNA, 20 bp, Homo sapiens
acagaaatcagaggagagac

SEQ ID NO: 3762958 - DNA, 21 bp, Homo sapiens
acagaaatcagaggagagacg

SEQ ID NO: 3762959 - DNA, 13 bp, Homo sapiens
acagaagcttcca

SEQ ID NO: 3762960 - DNA, 18 bp, Homo sapiens
acagaatactagccagag

SEQ ID NO: 3762961 - DNA, 15 bp, Homo sapiens
acagaattctgctac

SEQ ID NO: 3762962 - DNA, 12 bp, Homo sapiens
acagacacacac

SEQ ID NO: 3762963 - DNA, 13 bp, Homo sapiens
acagacacaggcc

SEQ ID NO: 3762964 - DNA, 15 bp, Homo sapiens
acagacacaggcccg

SEQ ID NO: 3762965 - DNA, 17 bp, Homo sapiens
acagacacaggcccggc

SEQ ID NO: 3762966 - DNA, 18 bp, Homo sapiens
acagacacaggcccggct

SEQ ID NO: 3762967 - DNA, 13 bp, Homo sapiens
acagacaggagaa

SEQ ID NO: 3762968 - DNA, 14 bp, Homo sapiens
acagacaggagaaa

SEQ ID NO: 3762969 - DNA, 21 bp, Homo sapiens
acagacaggagaaatgcatcc

SEQ ID NO: 3762970 - DNA, 15 bp, Homo sapiens
acagacgtccctcca

SEQ ID NO: 3762971 - DNA, 16 bp, Homo sapiens
acagactattgacatc

SEQ ID NO: 3762972 - DNA, 19 bp, Homo sapiens
acagactattgacatcagc

SEQ ID NO: 3762973 - DNA, 21 bp, Homo sapiens
acagactggaagcacagcttc

SEQ ID NO: 3762974 - DNA, 15 bp, Homo sapiens
acagacttctccaga

SEQ ID NO: 3762975 - DNA, 14 bp, Homo sapiens
acagagaaggcagg

SEQ ID NO: 3762976 - DNA, 18 bp, Homo sapiens
acagagacgcaggaatgg

SEQ ID NO: 3762977 - DNA, 11 bp, Homo sapiens
acagagccagt

SEQ ID NO: 3762978 - DNA, 14 bp, Homo sapiens
acagagctgggatg

SEQ ID NO: 3762979 - DNA, 18 bp, Homo sapiens
acagagctgggatgtttc

SEQ ID NO: 3762980 - DNA, 21 bp, Homo sapiens
acagagctggttgggaagaca

SEQ ID NO: 3762981 - DNA, 17 bp, Homo sapiens
acagaggaagagcaggc

SEQ ID NO: 3762982 - DNA, 14 bp, Homo sapiens
acagaggcagcccc

SEQ ID NO: 3762983 - DNA, 19 bp, Homo sapiens
acagaggcagccccattct

SEQ ID NO: 3762984 - DNA, 23 bp, Homo sapiens
acagaggcagccccattctgcct

SEQ ID NO: 3762985 - DNA, 17 bp, Homo sapiens
acagaggccatgggcct

SEQ ID NO: 3762986 - DNA, 21 bp, Homo sapiens
acagaggccatgggcctcctg

SEQ ID NO: 3762987 - DNA, 17 bp, Homo sapiens
acagagtctcactgttg

SEQ ID NO: 3762988 - DNA, 23 bp, Homo sapiens
acagagtctcactgttgcccagg

SEQ ID NO: 3762989 - DNA, 13 bp, Homo sapiens
acagagtctgggt

SEQ ID NO: 3762990 - DNA, 18 bp, Homo sapiens
acagagtggtctttctgg

SEQ ID NO: 3762991 - DNA, 21 bp, Homo sapiens
acagagtggtctttctggaga

SEQ ID NO: 3762992 - DNA, 13 bp, Homo sapiens
acagataagcaag

SEQ ID NO: 3762993 - DNA, 15 bp, Homo sapiens
acagataagcaagag

SEQ ID NO: 3762994 - DNA, 22 bp, Homo sapiens
acagatactggaagttttgcat

SEQ ID NO: 3762995 - DNA, 16 bp, Homo sapiens
acagataggccttctt

SEQ ID NO: 3762996 - DNA, 19 bp, Homo sapiens
acagataggccttcttgtg

SEQ ID NO: 3762997 - DNA, 16 bp, Homo sapiens
acagatgcaatgtgct

SEQ ID NO: 3762998 - DNA, 18 bp, Homo sapiens
acagatgccccagagctg

SEQ ID NO: 3762999 - DNA, 19 bp, Homo sapiens
acagatgccccagagctgt

SEQ ID NO: 3763000 - DNA, 22 bp, Homo sapiens
acagatgccccagagctgttta

SEQ ID NO: 3763001 - DNA, 16 bp, Homo sapiens
acagatgggcaaatta

SEQ ID NO: 3763002 - DNA, 12 bp, Homo sapiens
acagatgttgaa

SEQ ID NO: 3763003 - DNA, 17 bp, Homo sapiens
acagattgctgcttctg

SEQ ID NO: 3763004 - DNA, 18 bp, Homo sapiens
acagcaaaactccatctc

SEQ ID NO: 3763005 - DNA, 10 bp, Homo sapiens
acagcaaatt

SEQ ID NO: 3763006 - DNA, 18 bp, Homo sapiens
acagcaaatttataattt

SEQ ID NO: 3763007 - DNA, 19 bp, Homo sapiens
acagcaaatttataatttt

SEQ ID NO: 3763008 - DNA, 17 bp, Homo sapiens
acagcaattcctcaggc

SEQ ID NO: 3763009 - DNA, 19 bp, Homo sapiens
acagcaattcctcaggcta

SEQ ID NO: 3763010 - DNA, 19 bp, Homo sapiens
acagcacaatgttattacc

SEQ ID NO: 3763011 - DNA, 17 bp, Homo sapiens
acagcagcccctgcaca

SEQ ID NO: 3763012 - DNA, 18 bp, Homo sapiens
acagccacggccaggcca

SEQ ID NO: 3763013 - DNA, 19 bp, Homo sapiens
acagcccaaagaaggaaaa

SEQ ID NO: 3763014 - DNA, 21 bp, Homo sapiens
acagcccaggcctccagctca

SEQ ID NO: 3763015 - DNA, 19 bp, Homo sapiens
acagccgctcctgtctgcc

SEQ ID NO: 3763016 - DNA, 17 bp, Homo sapiens
acagccgtcagccaaat

SEQ ID NO: 3763017 - DNA, 20 bp, Homo sapiens
acagccgtcagccaaatgta

SEQ ID NO: 3763018 - DNA, 12 bp, Homo sapiens
acagcctggcac

SEQ ID NO: 3763019 - DNA, 20 bp, Homo sapiens
acagcctgtggcggtgcctg

SEQ ID NO: 3763020 - DNA, 20 bp, Homo sapiens
acctcagttcccttggcctc

SEQ ID NO: 3763021 - DNA, 21 bp, Homo sapiens
acctcagttcccttggcctca

SEQ ID NO: 3763022 - DNA, 22 bp, Homo sapiens
acctcagttcccttggcctcag

SEQ ID NO: 3763023 - DNA, 20 bp, Homo sapiens
acctcccacaaaggagagct

SEQ ID NO: 3763024 - DNA, 13 bp, Homo sapiens
acctccccagcct

SEQ ID NO: 3763025 - DNA, 19 bp, Homo sapiens
acctccccaggccgtggct

SEQ ID NO: 3763026 - DNA, 19 bp, Homo sapiens
acctcccctccttgcctcc

SEQ ID NO: 3763027 - DNA, 22 bp, Homo sapiens
acctcccctccttgcctcctgt

SEQ ID NO: 3763028 - DNA, 15 bp, Homo sapiens
acctccctgaaccat

SEQ ID NO: 3763029 - DNA, 20 bp, Homo sapiens
acctccgcctcttgggttca

SEQ ID NO: 3763030 - DNA, 15 bp, Homo sapiens
acctcctgcccagga

SEQ ID NO: 3763031 - DNA, 19 bp, Homo sapiens
acctcctgcccaggagagc

SEQ ID NO: 3763032 - DNA, 21 bp, Homo sapiens
acctcctgcccaggagagcca

SEQ ID NO: 3763033 - DNA, 14 bp, Homo sapiens
acctcggctcctgg

SEQ ID NO: 3763034 - DNA, 19 bp, Homo sapiens
acctcggtgccttcctctt

SEQ ID NO: 3763035 - DNA, 15 bp, Homo sapiens
acctcgtcctccccc

SEQ ID NO: 3763036 - DNA, 17 bp, Homo sapiens
acctcgtgctttaagtg

SEQ ID NO: 3763037 - DNA, 23 bp, Homo sapiens
acctcgttagggaagagaaacag

SEQ ID NO: 3763038 - DNA, 22 bp, Homo sapiens
acctctcttatagaatatttat

SEQ ID NO: 3763039 - DNA, 23 bp, Homo sapiens
acctctcttatagaatatttatt

SEQ ID NO: 3763040 - DNA, 12 bp, Homo sapiens
acctctgcacaa

SEQ ID NO: 3763041 - DNA, 14 bp, Homo sapiens
acctctggactggc

SEQ ID NO: 3763042 - DNA, 15 bp, Homo sapiens
acctctggactggct

SEQ ID NO: 3763043 - DNA, 22 bp, Homo sapiens
acctctgtatttgaatcagcct

SEQ ID NO: 3763044 - DNA, 13 bp, Homo sapiens
acctcttccccag

SEQ ID NO: 3763045 - DNA, 14 bp, Homo sapiens
acctcttccccaga

SEQ ID NO: 3763046 - DNA, 23 bp, Homo sapiens
acctcttccccagaaaggagact

SEQ ID NO: 3763047 - DNA, 21 bp, Homo sapiens
acctcttttagtcattttgct

SEQ ID NO: 3763048 - DNA, 18 bp, Homo sapiens
acctcttttctgcatcat

SEQ ID NO: 3763049 - DNA, 20 bp, Homo sapiens
acctgaacacttattgcttt

SEQ ID NO: 3763050 - DNA, 19 bp, Homo sapiens
acctgaccaacatggagaa

SEQ ID NO: 3763051 - DNA, 21 bp, Homo sapiens
acctgagcccggatgcttctc

SEQ ID NO: 3763052 - DNA, 14 bp, Homo sapiens
acctgagctcccca

SEQ ID NO: 3763053 - DNA, 13 bp, Homo sapiens
acctgagctttgg

SEQ ID NO: 3763054 - DNA, 14 bp, Homo sapiens
acctgagctttgga

SEQ ID NO: 3763055 - DNA, 19 bp, Homo sapiens
acctgatgtacctgatgct

SEQ ID NO: 3763056 - DNA, 21 bp, Homo sapiens
acctgatgttaaaattccatc

SEQ ID NO: 3763057 - DNA, 15 bp, Homo sapiens
acctgcacctccccc

SEQ ID NO: 3763058 - DNA, 18 bp, Homo sapiens
acctgcacctccccccac

SEQ ID NO: 3763059 - DNA, 19 bp, Homo sapiens
acctgcacctccccccact

SEQ ID NO: 3763060 - DNA, 22 bp, Homo sapiens
acctgcacctccccccactgca

SEQ ID NO: 3763061 - DNA, 19 bp, Homo sapiens
acctgcaggccaagagcag

SEQ ID NO: 3763062 - DNA, 18 bp, Homo sapiens
acctgccactaggctggg

SEQ ID NO: 3763063 - DNA, 21 bp, Homo sapiens
acctgccagcctggcttctgg

SEQ ID NO: 3763064 - DNA, 13 bp, Homo sapiens
acctgcccaacct

SEQ ID NO: 3763065 - DNA, 21 bp, Homo sapiens
acctgcccaacctgctctcct

SEQ ID NO: 3763066 - DNA, 20 bp, Homo sapiens
acctgcccagatcccagaag

SEQ ID NO: 3763067 - DNA, 19 bp, Homo sapiens
acctgcccccttctcccac

SEQ ID NO: 3763068 - DNA, 22 bp, Homo sapiens
acctgcccccttctcccacact

SEQ ID NO: 3763069 - DNA, 17 bp, Homo sapiens
acctgccccgcccagct

SEQ ID NO: 3763070 - DNA, 21 bp, Homo sapiens
acctgcgtctcatactcacct

SEQ ID NO: 3763071 - DNA, 12 bp, Homo sapiens
acctgctctcct

SEQ ID NO: 3763072 - DNA, 16 bp, Homo sapiens
acctgctgagagaccc

SEQ ID NO: 3763073 - DNA, 22 bp, Homo sapiens
acctgctgagagacccaaggag

SEQ ID NO: 3763074 - DNA, 18 bp, Homo sapiens
acctgctgagggaccagc

SEQ ID NO: 3763075 - DNA, 17 bp, Homo sapiens
acctgctgccccagctg

SEQ ID NO: 3763076 - DNA, 18 bp, Homo sapiens
acctgctgccccagctga

SEQ ID NO: 3763077 - DNA, 17 bp, Homo sapiens
acctgctggcccctcac

SEQ ID NO: 3763078 - DNA, 19 bp, Homo sapiens
acctgctggcccctcacct

SEQ ID NO: 3763079 - DNA, 21 bp, Homo sapiens
acctgctggcccctcacctgg

SEQ ID NO: 3763080 - DNA, 14 bp, Homo sapiens
acctgggcacctgg

SEQ ID NO: 3763081 - DNA, 13 bp, Homo sapiens
acctggggagtgg

SEQ ID NO: 3763082 - DNA, 15 bp, Homo sapiens
acctggggagtggga

SEQ ID NO: 3763083 - DNA, 21 bp, Homo sapiens
acctggggtgtgggaggcccg

SEQ ID NO: 3763084 - DNA, 21 bp, Homo sapiens
acctgggtaactagggaagat

SEQ ID NO: 3763085 - DNA, 22 bp, Homo sapiens
acctgggttccctttccttcca

SEQ ID NO: 3763086 - DNA, 21 bp, Homo sapiens
acctggtcacaggactctgcc

SEQ ID NO: 3763087 - DNA, 22 bp, Homo sapiens
acctggttccggaatcctgtcc

SEQ ID NO: 3763088 - DNA, 14 bp, Homo sapiens
acctgtaaaacttt

SEQ ID NO: 3763089 - DNA, 21 bp, Homo sapiens
acctgtaaaactttattttat

SEQ ID NO: 3763090 - DNA, 15 bp, Homo sapiens
acctgtaacttttgt

SEQ ID NO: 3763091 - DNA, 20 bp, Homo sapiens
acctgtaacttttgtaaata

SEQ ID NO: 3763092 - DNA, 14 bp, Homo sapiens
acctgtactggaga

SEQ ID NO: 3763093 - DNA, 15 bp, Homo sapiens
acctgtactggagag

SEQ ID NO: 3763094 - DNA, 17 bp, Homo sapiens
acctgtagtcccagcta

SEQ ID NO: 3763095 - DNA, 20 bp, Homo sapiens
acctgtcaaacaaagccaga

SEQ ID NO: 3763096 - DNA, 18 bp, Homo sapiens
acctgtcaccgtgagcag

SEQ ID NO: 3763097 - DNA, 11 bp, Homo sapiens
acctgtccaat

SEQ ID NO: 3763098 - DNA, 14 bp, Homo sapiens
acctgtccttgcac

SEQ ID NO: 3763099 - DNA, 12 bp, Homo sapiens
acctgtcgccca

SEQ ID NO: 3763100 - DNA, 14 bp, Homo sapiens
acctgtcgcccagt

SEQ ID NO: 3763101 - DNA, 17 bp, Homo sapiens
acctgtcttccaaggag

SEQ ID NO: 3763102 - DNA, 19 bp, Homo sapiens
acctgtgagtttaaagcaa

SEQ ID NO: 3763103 - DNA, 21 bp, Homo sapiens
acctgtgctagttttacagat

SEQ ID NO: 3763104 - DNA, 21 bp, Homo sapiens
acctgtggggatttctcccag

SEQ ID NO: 3763105 - DNA, 16 bp, Homo sapiens
acctgtttttaagctg

SEQ ID NO: 3763106 - DNA, 12 bp, Homo sapiens
accttaaattaa

SEQ ID NO: 3763107 - DNA, 14 bp, Homo sapiens
accttaaattaaac

SEQ ID NO: 3763108 - DNA, 17 bp, Homo sapiens
accttaaattaaacaat

SEQ ID NO: 3763109 - DNA, 21 bp, Homo sapiens
accttaaattaaacaatttat

SEQ ID NO: 3763110 - DNA, 18 bp, Homo sapiens
accttattgtacctctct

SEQ ID NO: 3763111 - DNA, 20 bp, Homo sapiens
accttattgtacctctctta

SEQ ID NO: 3763112 - DNA, 18 bp, Homo sapiens
accttattgtacgtttaa

SEQ ID NO: 3763113 - DNA, 13 bp, Homo sapiens
accttcaataaag

SEQ ID NO: 3763114 - DNA, 15 bp, Homo sapiens
accttcaataaagta

SEQ ID NO: 3763115 - DNA, 17 bp, Homo sapiens
accttcaataaagtatc

SEQ ID NO: 3763116 - DNA, 18 bp, Homo sapiens
accttcagatcctacccc

SEQ ID NO: 3763117 - DNA, 12 bp, Homo sapiens
accttcccagct

SEQ ID NO: 3763118 - DNA, 13 bp, Homo sapiens
accttcccagctc

SEQ ID NO: 3763119 - DNA, 17 bp, Homo sapiens
accttcccagctctccc

SEQ ID NO: 3763120 - DNA, 12 bp, Homo sapiens
accttctgtggc

SEQ ID NO: 3763121 - DNA, 13 bp, Homo sapiens
accttctgtggct

SEQ ID NO: 3763122 - DNA, 21 bp, Homo sapiens
accttgaacactgggggaggg

SEQ ID NO: 3763123 - DNA, 15 bp, Homo sapiens
accttgacagggcac

SEQ ID NO: 3763124 - DNA, 14 bp, Homo sapiens
accttggctgcagg

SEQ ID NO: 3763125 - DNA, 17 bp, Homo sapiens
accttggctgcagggag

SEQ ID NO: 3763126 - DNA, 15 bp, Homo sapiens
acctttattaaaatc

SEQ ID NO: 3763127 - DNA, 23 bp, Homo sapiens
acctttattccttcatttcatct

SEQ ID NO: 3763128 - DNA, 18 bp, Homo sapiens
acctttcccatcttccaa

SEQ ID NO: 3763129 - DNA, 15 bp, Homo sapiens
acctttccctaaaga

SEQ ID NO: 3763130 - DNA, 19 bp, Homo sapiens
accttttaaatcctgttga

SEQ ID NO: 3763131 - DNA, 20 bp, Homo sapiens
accttttaaatcctgttgaa

SEQ ID NO: 3763132 - DNA, 14 bp, Homo sapiens
accttttattacat

SEQ ID NO: 3763133 - DNA, 14 bp, Homo sapiens
actctccccacact

SEQ ID NO: 3763134 - DNA, 14 bp, Homo sapiens
actctcccctctta

SEQ ID NO: 3763135 - DNA, 13 bp, Homo sapiens
actctcctgggcc

SEQ ID NO: 3763136 - DNA, 15 bp, Homo sapiens
actctcctgggcccc

SEQ ID NO: 3763137 - DNA, 21 bp, Homo sapiens
actctgaagggcatcatgcat

SEQ ID NO: 3763138 - DNA, 13 bp, Homo sapiens
actctgccagcca

SEQ ID NO: 3763139 - DNA, 12 bp, Homo sapiens
actctgcctcct

SEQ ID NO: 3763140 - DNA, 11 bp, Homo sapiens
actctgcctct

SEQ ID NO: 3763141 - DNA, 14 bp, Homo sapiens
actctgcctctgcc

SEQ ID NO: 3763142 - DNA, 16 bp, Homo sapiens
actctgcctctgcctg

SEQ ID NO: 3763143 - DNA, 17 bp, Homo sapiens
actctgctaatcatgtg

SEQ ID NO: 3763144 - DNA, 20 bp, Homo sapiens
actctgctttgactgagcag

SEQ ID NO: 3763145 - DNA, 19 bp, Homo sapiens
actctgggaaataagagag

SEQ ID NO: 3763146 - DNA, 17 bp, Homo sapiens
actctgtggggccttgg

SEQ ID NO: 3763147 - DNA, 16 bp, Homo sapiens
actctgttcctggctc

SEQ ID NO: 3763148 - DNA, 19 bp, Homo sapiens
actcttcttaacttaaatt

SEQ ID NO: 3763149 - DNA, 14 bp, Homo sapiens
actcttgacctcag

SEQ ID NO: 3763150 - DNA, 13 bp, Homo sapiens
actcttgtaagat

SEQ ID NO: 3763151 - DNA, 19 bp, Homo sapiens
actcttgtaagattttgaa

SEQ ID NO: 3763152 - DNA, 21 bp, Homo sapiens
actcttgtaagattttgaaaa

SEQ ID NO: 3763153 - DNA, 22 bp, Homo sapiens
actctttggatagcatgtcttt

SEQ ID NO: 3763154 - DNA, 17 bp, Homo sapiens
actgaaaacataaaaag

SEQ ID NO: 3763155 - DNA, 18 bp, Homo sapiens
actgaaaacataaaaagt

SEQ ID NO: 3763156 - DNA, 19 bp, Homo sapiens
actgaaaagactcagtgtt

SEQ ID NO: 3763157 - DNA, 17 bp, Homo sapiens
actgaaagtgtttcctt

SEQ ID NO: 3763158 - DNA, 15 bp, Homo sapiens
actgaaatatacaca

SEQ ID NO: 3763159 - DNA, 19 bp, Homo sapiens
actgaacatgtacactggt

SEQ ID NO: 3763160 - DNA, 19 bp, Homo sapiens
actgaagcctgcaggagtt

SEQ ID NO: 3763161 - DNA, 11 bp, Homo sapiens
actgaaggaga

SEQ ID NO: 3763162 - DNA, 13 bp, Homo sapiens
actgaaggagaag

SEQ ID NO: 3763163 - DNA, 17 bp, Homo sapiens
actgaaggtaaaattga

SEQ ID NO: 3763164 - DNA, 16 bp, Homo sapiens
actgaatgctctgtgc

SEQ ID NO: 3763165 - DNA, 22 bp, Homo sapiens
actgaatgcttctgacttcata

SEQ ID NO: 3763166 - DNA, 13 bp, Homo sapiens
actgacaaatcaa

SEQ ID NO: 3763167 - DNA, 17 bp, Homo sapiens
actgacaaatcaagttt

SEQ ID NO: 3763168 - DNA, 23 bp, Homo sapiens
actgacattgttggccaaagcca

SEQ ID NO: 3763169 - DNA, 20 bp, Homo sapiens
actgaccagcctccatgctg

SEQ ID NO: 3763170 - DNA, 15 bp, Homo sapiens
actgacccacagcct

SEQ ID NO: 3763171 - DNA, 14 bp, Homo sapiens
actgactccttaga

SEQ ID NO: 3763172 - DNA, 17 bp, Homo sapiens
actgagagatctgctgt

SEQ ID NO: 3763173 - DNA, 13 bp, Homo sapiens
actgagcagactg

SEQ ID NO: 3763174 - DNA, 21 bp, Homo sapiens
actgagctcctctgggcagga

SEQ ID NO: 3763175 - DNA, 15 bp, Homo sapiens
actgaggaccagcca

SEQ ID NO: 3763176 - DNA, 21 bp, Homo sapiens
actgaggggtctccaggagga

SEQ ID NO: 3763177 - DNA, 15 bp, Homo sapiens
actgatcatgcattg

SEQ ID NO: 3763178 - DNA, 17 bp, Homo sapiens
actgatcatgcattgtt

SEQ ID NO: 3763179 - DNA, 22 bp, Homo sapiens
actgatggctaatgtactgcat

SEQ ID NO: 3763180 - DNA, 21 bp, Homo sapiens
actgatgttaggctgggccca

SEQ ID NO: 3763181 - DNA, 22 bp, Homo sapiens
actgatgttaggctgggcccag

SEQ ID NO: 3763182 - DNA, 20 bp, Homo sapiens
actgattcataataaatatc

SEQ ID NO: 3763183 - DNA, 16 bp, Homo sapiens
actgcaagagccttgg

SEQ ID NO: 3763184 - DNA, 18 bp, Homo sapiens
actgcaagtcacaaagga

SEQ ID NO: 3763185 - DNA, 21 bp, Homo sapiens
actgcaagtcacaaaggaatg

SEQ ID NO: 3763186 - DNA, 21 bp, Homo sapiens
actgcagcctcaacctcctgg

SEQ ID NO: 3763187 - DNA, 18 bp, Homo sapiens
actgcagggactgccagt

SEQ ID NO: 3763188 - DNA, 14 bp, Homo sapiens
actgcatacaatct

SEQ ID NO: 3763189 - DNA, 22 bp, Homo sapiens
actgcataccaacctgggcaat

SEQ ID NO: 3763190 - DNA, 16 bp, Homo sapiens
actgcatatgaaagga

SEQ ID NO: 3763191 - DNA, 17 bp, Homo sapiens
actgcatggtaatttat

SEQ ID NO: 3763192 - DNA, 19 bp, Homo sapiens
actgccagtccccctgccc

SEQ ID NO: 3763193 - DNA, 19 bp, Homo sapiens
actgcccaggcctgcctgt

SEQ ID NO: 3763194 - DNA, 15 bp, Homo sapiens
actgccccaactcct

SEQ ID NO: 3763195 - DNA, 17 bp, Homo sapiens
actgccccaactcctgg

SEQ ID NO: 3763196 - DNA, 14 bp, Homo sapiens
actgcccgagctgg

SEQ ID NO: 3763197 - DNA, 20 bp, Homo sapiens
actgcccggggcagctgcca

SEQ ID NO: 3763198 - DNA, 22 bp, Homo sapiens
actgcccggggcagctgccaga

SEQ ID NO: 3763199 - DNA, 22 bp, Homo sapiens
actgccctctgttcagtaacag

SEQ ID NO: 3763200 - DNA, 23 bp, Homo sapiens
actgccgaccgaggctggagctg

SEQ ID NO: 3763201 - DNA, 16 bp, Homo sapiens
actgcctctccctggc

SEQ ID NO: 3763202 - DNA, 19 bp, Homo sapiens
actgcctctccctggccct

SEQ ID NO: 3763203 - DNA, 19 bp, Homo sapiens
actgcctgcccacccgtgg

SEQ ID NO: 3763204 - DNA, 22 bp, Homo sapiens
actgcctgcccacccgtggaga

SEQ ID NO: 3763205 - DNA, 23 bp, Homo sapiens
actgcctgcccacccgtggagat

SEQ ID NO: 3763206 - DNA, 14 bp, Homo sapiens
actgcctgggctcc

SEQ ID NO: 3763207 - DNA, 20 bp, Homo sapiens
actgctaggtgggccagccc

SEQ ID NO: 3763208 - DNA, 23 bp, Homo sapiens
actgctaggtgggccagcccctc

SEQ ID NO: 3763209 - DNA, 19 bp, Homo sapiens
actgctctaagcacacgga

SEQ ID NO: 3763210 - DNA, 19 bp, Homo sapiens
actgctgggactggccagg

SEQ ID NO: 3763211 - DNA, 20 bp, Homo sapiens
actgcttctaccaactggaa

SEQ ID NO: 3763212 - DNA, 18 bp, Homo sapiens
actgcttttaacttctga

SEQ ID NO: 3763213 - DNA, 15 bp, Homo sapiens
actgcttttggtctg

SEQ ID NO: 3763214 - DNA, 14 bp, Homo sapiens
actggaagcacaga

SEQ ID NO: 3763215 - DNA, 17 bp, Homo sapiens
actggaagcacagcttc

SEQ ID NO: 3763216 - DNA, 21 bp, Homo sapiens
actggaagcatgtaggagaat

SEQ ID NO: 3763217 - DNA, 14 bp, Homo sapiens
actggaatttttat

SEQ ID NO: 3763218 - DNA, 19 bp, Homo sapiens
actggaatttttattatgc

SEQ ID NO: 3763219 - DNA, 24 bp, Homo sapiens
actggaatttttattatgcataac

SEQ ID NO: 3763220 - DNA, 20 bp, Homo sapiens
actggaccactgggcaatga

SEQ ID NO: 3763221 - DNA, 20 bp, Homo sapiens
actggactcaggatgcccag

SEQ ID NO: 3763222 - DNA, 17 bp, Homo sapiens
actggagaagtcttaga

SEQ ID NO: 3763223 - DNA, 13 bp, Homo sapiens
actggagcaccag

SEQ ID NO: 3763224 - DNA, 19 bp, Homo sapiens
actggagcaccaggcacga

SEQ ID NO: 3763225 - DNA, 13 bp, Homo sapiens
actggagcccagg

SEQ ID NO: 3763226 - DNA, 21 bp, Homo sapiens
actggaggggacgctggtaga

SEQ ID NO: 3763227 - DNA, 12 bp, Homo sapiens
actggagtccag

SEQ ID NO: 3763228 - DNA, 17 bp, Homo sapiens
actggatgcagaaacag

SEQ ID NO: 3763229 - DNA, 13 bp, Homo sapiens
actggatttgttg

SEQ ID NO: 3763230 - DNA, 13 bp, Homo sapiens
actggcaaacttc

SEQ ID NO: 3763231 - DNA, 16 bp, Homo sapiens
actggcaaacttcaga

SEQ ID NO: 3763232 - DNA, 20 bp, Homo sapiens
actggcaaacttcagactga

SEQ ID NO: 3763233 - DNA, 14 bp, Homo sapiens
actggcagccccag

SEQ ID NO: 3763234 - DNA, 22 bp, Homo sapiens
actggcagttttccattggttt

SEQ ID NO: 3763235 - DNA, 21 bp, Homo sapiens
actggcccctagaatcagcct

SEQ ID NO: 3763236 - DNA, 17 bp, Homo sapiens
actggctggctgcagtg

SEQ ID NO: 3763237 - DNA, 17 bp, Homo sapiens
actggctgtcagtatga

SEQ ID NO: 3763238 - DNA, 21 bp, Homo sapiens
actggctttgtcccacagctt

SEQ ID NO: 3763239 - DNA, 22 bp, Homo sapiens
actgggaagataggctctgcac

SEQ ID NO: 3763240 - DNA, 23 bp, Homo sapiens
actgggaagataggctctgcaca

SEQ ID NO: 3763241 - DNA, 18 bp, Homo sapiens
actggggtcctggggcct

SEQ ID NO: 3763242 - DNA, 17 bp, Homo sapiens
actgggtacttgtggac

SEQ ID NO: 3763243 - DNA, 18 bp, Homo sapiens
actgggtacttgtggaca

SEQ ID NO: 3763244 - DNA, 19 bp, Homo sapiens
actgggtacttgtggacac

SEQ ID NO: 3763245 - DNA, 22 bp, Homo sapiens
agacaggcccaagagatgaaga

SEQ ID NO: 3763246 - DNA, 23 bp, Homo sapiens
agacaggcccaagagatgaagag

SEQ ID NO: 3763247 - DNA, 16 bp, Homo sapiens
agacagggtcctgcta

SEQ ID NO: 3763248 - DNA, 19 bp, Homo sapiens
agacagggtctgaaggact

SEQ ID NO: 3763249 - DNA, 18 bp, Homo sapiens
agacagtatataactaac

SEQ ID NO: 3763250 - DNA, 15 bp, Homo sapiens
agacagtatatttat

SEQ ID NO: 3763251 - DNA, 18 bp, Homo sapiens
agacagtatatttatagt

SEQ ID NO: 3763252 - DNA, 20 bp, Homo sapiens
agacagtcaaggagtggctt

SEQ ID NO: 3763253 - DNA, 12 bp, Homo sapiens
agacagtgatct

SEQ ID NO: 3763254 - DNA, 17 bp, Homo sapiens
agacagtgatctccata

SEQ ID NO: 3763255 - DNA, 20 bp, Homo sapiens
agacagtgatctccatatgt

SEQ ID NO: 3763256 - DNA, 21 bp, Homo sapiens
agacagtgatctccatatgtt

SEQ ID NO: 3763257 - DNA, 15 bp, Homo sapiens
agacagttcaagaaa

SEQ ID NO: 3763258 - DNA, 17 bp, Homo sapiens
agacatgaatgcacact

SEQ ID NO: 3763259 - DNA, 16 bp, Homo sapiens
agacatggcttgccac

SEQ ID NO: 3763260 - DNA, 22 bp, Homo sapiens
agacatggcttgccacagctct

SEQ ID NO: 3763261 - DNA, 19 bp, Homo sapiens
agacatggggaggaaggac

SEQ ID NO: 3763262 - DNA, 17 bp, Homo sapiens
agacatgtggtgggaca

SEQ ID NO: 3763263 - DNA, 22 bp, Homo sapiens
agacatttgtaaatgtaaaact

SEQ ID NO: 3763264 - DNA, 16 bp, Homo sapiens
agaccaagcttgtcca

SEQ ID NO: 3763265 - DNA, 17 bp, Homo sapiens
agaccaaggcgggagca

SEQ ID NO: 3763266 - DNA, 17 bp, Homo sapiens
agaccagagctctggag

SEQ ID NO: 3763267 - DNA, 19 bp, Homo sapiens
agaccagagctctggagcc

SEQ ID NO: 3763268 - DNA, 12 bp, Homo sapiens
agaccagcctgg

SEQ ID NO: 3763269 - DNA, 14 bp, Homo sapiens
agaccagcctggcc

SEQ ID NO: 3763270 - DNA, 15 bp, Homo sapiens
agacccattcctatt

SEQ ID NO: 3763271 - DNA, 14 bp, Homo sapiens
agacccccacacct

SEQ ID NO: 3763272 - DNA, 13 bp, Homo sapiens
agacccccacccc

SEQ ID NO: 3763273 - DNA, 19 bp, Homo sapiens
agacccccaccccttcccc

SEQ ID NO: 3763274 - DNA, 12 bp, Homo sapiens
agacccccactc

SEQ ID NO: 3763275 - DNA, 20 bp, Homo sapiens
agacccccagcaaccctcct

SEQ ID NO: 3763276 - DNA, 19 bp, Homo sapiens
agacccccggaacaagcct

SEQ ID NO: 3763277 - DNA, 21 bp, Homo sapiens
agacccctctggccaggatgg

SEQ ID NO: 3763278 - DNA, 22 bp, Homo sapiens
agacccctctggccaggatgga

SEQ ID NO: 3763279 - DNA, 14 bp, Homo sapiens
agacccctggcttt

SEQ ID NO: 3763280 - DNA, 14 bp, Homo sapiens
agacccctgtctcc

SEQ ID NO: 3763281 - DNA, 13 bp, Homo sapiens
agacccctgtctt

SEQ ID NO: 3763282 - DNA, 15 bp, Homo sapiens
agacccgaggaaact

SEQ ID NO: 3763283 - DNA, 14 bp, Homo sapiens
agacccggctgcgt

SEQ ID NO: 3763284 - DNA, 16 bp, Homo sapiens
agaccctaccccacca

SEQ ID NO: 3763285 - DNA, 12 bp, Homo sapiens
agaccctgtctc

SEQ ID NO: 3763286 - DNA, 17 bp, Homo sapiens
agacccttttgggtttc

SEQ ID NO: 3763287 - DNA, 12 bp, Homo sapiens
agaccggaagct

SEQ ID NO: 3763288 - DNA, 18 bp, Homo sapiens
agaccggaagctcctggt

SEQ ID NO: 3763289 - DNA, 23 bp, Homo sapiens
agaccgtcgggggctgaggggca

SEQ ID NO: 3763290 - DNA, 14 bp, Homo sapiens
agacctagggagga

SEQ ID NO: 3763291 - DNA, 19 bp, Homo sapiens
agacctagggaggacctta

SEQ ID NO: 3763292 - DNA, 16 bp, Homo sapiens
agacctatttgacata

SEQ ID NO: 3763293 - DNA, 14 bp, Homo sapiens
agacctcagcctgt

SEQ ID NO: 3763294 - DNA, 16 bp, Homo sapiens
agacctcagcctgtgc

SEQ ID NO: 3763295 - DNA, 14 bp, Homo sapiens
agacctgactcagg

SEQ ID NO: 3763296 - DNA, 20 bp, Homo sapiens
agacctgctgagggaccagc

SEQ ID NO: 3763297 - DNA, 14 bp, Homo sapiens
agacctgtcttcca

SEQ ID NO: 3763298 - DNA, 23 bp, Homo sapiens
agacctgtcttccaaggagacca

SEQ ID NO: 3763299 - DNA, 12 bp, Homo sapiens
agacctgtgcta

SEQ ID NO: 3763300 - DNA, 22 bp, Homo sapiens
agacctgtgctagttttacaga

SEQ ID NO: 3763301 - DNA, 23 bp, Homo sapiens
agacctgtgctagttttacagat

SEQ ID NO: 3763302 - DNA, 14 bp, Homo sapiens
agacgccttactgg

SEQ ID NO: 3763303 - DNA, 15 bp, Homo sapiens
agacggtgttgggag

SEQ ID NO: 3763304 - DNA, 19 bp, Homo sapiens
agacggttcaccagcctct

SEQ ID NO: 3763305 - DNA, 14 bp, Homo sapiens
agacgtccctccac

SEQ ID NO: 3763306 - DNA, 22 bp, Homo sapiens
agacgtgcacgcacactgtctg

SEQ ID NO: 3763307 - DNA, 13 bp, Homo sapiens
agactagagaaac

SEQ ID NO: 3763308 - DNA, 21 bp, Homo sapiens
agactagtgccgtagggagta

SEQ ID NO: 3763309 - DNA, 22 bp, Homo sapiens
agactagtttttattccttgtg

SEQ ID NO: 3763310 - DNA, 14 bp, Homo sapiens
agactcacctctgc

SEQ ID NO: 3763311 - DNA, 16 bp, Homo sapiens
agactcacctctgcct

SEQ ID NO: 3763312 - DNA, 17 bp, Homo sapiens
agactcacctctgcctc

SEQ ID NO: 3763313 - DNA, 16 bp, Homo sapiens
agactcagggccccag

SEQ ID NO: 3763314 - DNA, 20 bp, Homo sapiens
agactcagggccccagcact

SEQ ID NO: 3763315 - DNA, 22 bp, Homo sapiens
agactcaggttgtagtaaagaa

SEQ ID NO: 3763316 - DNA, 12 bp, Homo sapiens
agactcagtgtt

SEQ ID NO: 3763317 - DNA, 21 bp, Homo sapiens
agactccagctgggttggaaa

SEQ ID NO: 3763318 - DNA, 16 bp, Homo sapiens
agactctgaaatctca

SEQ ID NO: 3763319 - DNA, 20 bp, Homo sapiens
agactctgaaatctcagaat

SEQ ID NO: 3763320 - DNA, 16 bp, Homo sapiens
agactggatactgccc

SEQ ID NO: 3763321 - DNA, 23 bp, Homo sapiens
agactggtgagcagactggtggg

SEQ ID NO: 3763322 - DNA, 21 bp, Homo sapiens
agactgtcagcttccaaacat

SEQ ID NO: 3763323 - DNA, 23 bp, Homo sapiens
agactgtttttcagggaggtggc

SEQ ID NO: 3763324 - DNA, 15 bp, Homo sapiens
agacttcccagcttc

SEQ ID NO: 3763325 - DNA, 19 bp, Homo sapiens
agacttccctgaatgtatt

SEQ ID NO: 3763326 - DNA, 15 bp, Homo sapiens
agacttgagaacttg

SEQ ID NO: 3763327 - DNA, 20 bp, Homo sapiens
agacttgctgaatcggaatc

SEQ ID NO: 3763328 - DNA, 19 bp, Homo sapiens
agacttggtgtcctttccc

SEQ ID NO: 3763329 - DNA, 16 bp, Homo sapiens
agactttatgcaataa

SEQ ID NO: 3763330 - DNA, 20 bp, Homo sapiens
agactttcaagggaattaaa

SEQ ID NO: 3763331 - DNA, 18 bp, Homo sapiens
agactttccccatactct

SEQ ID NO: 3763332 - DNA, 12 bp, Homo sapiens
agactttttggt

SEQ ID NO: 3763333 - DNA, 19 bp, Homo sapiens
agactttttggtggatgta

SEQ ID NO: 3763334 - DNA, 20 bp, Homo sapiens
agactttttggtggatgtaa

SEQ ID NO: 3763335 - DNA, 17 bp, Homo sapiens
agagaaaccgtcctctt

SEQ ID NO: 3763336 - DNA, 12 bp, Homo sapiens
agagaaagggga

SEQ ID NO: 3763337 - DNA, 23 bp, Homo sapiens
agagaacctcacgcacctcccat

SEQ ID NO: 3763338 - DNA, 21 bp, Homo sapiens
agagaagagattgtggtttca

SEQ ID NO: 3763339 - DNA, 13 bp, Homo sapiens
agagaaggaatgt

SEQ ID NO: 3763340 - DNA, 13 bp, Homo sapiens
agagaaggcagga

SEQ ID NO: 3763341 - DNA, 20 bp, Homo sapiens
agagaaggcaggaatgtgtg

SEQ ID NO: 3763342 - DNA, 22 bp, Homo sapiens
agagaaggggaagcactcgtgt

SEQ ID NO: 3763343 - DNA, 15 bp, Homo sapiens
agagaaggggaggag

SEQ ID NO: 3763344 - DNA, 17 bp, Homo sapiens
agagaagtgcccctgct

SEQ ID NO: 3763345 - DNA, 23 bp, Homo sapiens
agagaatccctagtcttcaagca

SEQ ID NO: 3763346 - DNA, 18 bp, Homo sapiens
agagaatgaaagggccca

SEQ ID NO: 3763347 - DNA, 13 bp, Homo sapiens
agagaatgttata

SEQ ID NO: 3763348 - DNA, 22 bp, Homo sapiens
agagaatgttatagtgaattat

SEQ ID NO: 3763349 - DNA, 19 bp, Homo sapiens
agagaattgtttgaacccg

SEQ ID NO: 3763350 - DNA, 14 bp, Homo sapiens
agagacaagaagca

SEQ ID NO: 3763351 - DNA, 19 bp, Homo sapiens
agagacacctgcacctccc

SEQ ID NO: 3763352 - DNA, 20 bp, Homo sapiens
agagacacctgcacctcccc

SEQ ID NO: 3763353 - DNA, 19 bp, Homo sapiens
agagacagacttgagaact

SEQ ID NO: 3763354 - DNA, 13 bp, Homo sapiens
agagacagagagg

SEQ ID NO: 3763355 - DNA, 13 bp, Homo sapiens
agagacaggaaaa

SEQ ID NO: 3763356 - DNA, 13 bp, Homo sapiens
agagacccaagga

SEQ ID NO: 3763357 - DNA, 21 bp, Homo sapiens
agagaccgtcgggggctgagg

SEQ ID NO: 3763358 - DNA, 21 bp, Homo sapiens
agcatgctgtgattgtgccta

SEQ ID NO: 3763359 - DNA, 21 bp, Homo sapiens
agcatgtactgagccttgtaa

SEQ ID NO: 3763360 - DNA, 16 bp, Homo sapiens
agcatgtcactaaagc

SEQ ID NO: 3763361 - DNA, 18 bp, Homo sapiens
agcatgtggcatgttcat

SEQ ID NO: 3763362 - DNA, 19 bp, Homo sapiens
agcatgtgtatttccagtg

SEQ ID NO: 3763363 - DNA, 21 bp, Homo sapiens
agcatgttgagccaggcctgg

SEQ ID NO: 3763364 - DNA, 15 bp, Homo sapiens
agcattactcttgta

SEQ ID NO: 3763365 - DNA, 16 bp, Homo sapiens
agcattactcttgtaa

SEQ ID NO: 3763366 - DNA, 19 bp, Homo sapiens
agcattatgatgtgggtca

SEQ ID NO: 3763367 - DNA, 23 bp, Homo sapiens
agcattcaatttattcaagaaaa

SEQ ID NO: 3763368 - DNA, 18 bp, Homo sapiens
agcattctcactcctacc

SEQ ID NO: 3763369 - DNA, 19 bp, Homo sapiens
agcattcttgtcacaataa

SEQ ID NO: 3763370 - DNA, 15 bp, Homo sapiens
agcattgctttctga

SEQ ID NO: 3763371 - DNA, 20 bp, Homo sapiens
agcattgtggctgtcagcag

SEQ ID NO: 3763372 - DNA, 21 bp, Homo sapiens
agcattgtggctgtcagcagg

SEQ ID NO: 3763373 - DNA, 15 bp, Homo sapiens
agcattgtttgctta

SEQ ID NO: 3763374 - DNA, 17 bp, Homo sapiens
agcattgtttgcttatt

SEQ ID NO: 3763375 - DNA, 23 bp, Homo sapiens
agcattgtttgcttattgttcca

SEQ ID NO: 3763376 - DNA, 15 bp, Homo sapiens
agcatttactttgaa

SEQ ID NO: 3763377 - DNA, 13 bp, Homo sapiens
agcatttatgttt

SEQ ID NO: 3763378 - DNA, 16 bp, Homo sapiens
agcatttgtcaacaaa

SEQ ID NO: 3763379 - DNA, 15 bp, Homo sapiens
agcattttgctaaat

SEQ ID NO: 3763380 - DNA, 15 bp, Homo sapiens
agccaaagataatct

SEQ ID NO: 3763381 - DNA, 17 bp, Homo sapiens
agccaaatcaaaatatg

SEQ ID NO: 3763382 - DNA, 18 bp, Homo sapiens
agccaacagaagcttcca

SEQ ID NO: 3763383 - DNA, 21 bp, Homo sapiens
agccaacagtcaaaacagaga

SEQ ID NO: 3763384 - DNA, 19 bp, Homo sapiens
agccaaccttacttacagc

SEQ ID NO: 3763385 - DNA, 15 bp, Homo sapiens
agccaagggcctctt

SEQ ID NO: 3763386 - DNA, 17 bp, Homo sapiens
agccaagggtatccaag

SEQ ID NO: 3763387 - DNA, 21 bp, Homo sapiens
agccacactgtgggactcttc

SEQ ID NO: 3763388 - DNA, 13 bp, Homo sapiens
agccacagcccag

SEQ ID NO: 3763389 - DNA, 16 bp, Homo sapiens
agccacagcccaggcc

SEQ ID NO: 3763390 - DNA, 23 bp, Homo sapiens
agccaccatgcccagctcagagg

SEQ ID NO: 3763391 - DNA, 19 bp, Homo sapiens
agccaccccgggctctctg

SEQ ID NO: 3763392 - DNA, 20 bp, Homo sapiens
agccaccccgggctctctgc

SEQ ID NO: 3763393 - DNA, 18 bp, Homo sapiens
agccaccctcccagctct

SEQ ID NO: 3763394 - DNA, 16 bp, Homo sapiens
agccaccgctgccagc

SEQ ID NO: 3763395 - DNA, 18 bp, Homo sapiens
agccacctctctttttca

SEQ ID NO: 3763396 - DNA, 13 bp, Homo sapiens
agccacctgtccc

SEQ ID NO: 3763397 - DNA, 15 bp, Homo sapiens
agccacctgtcccac

SEQ ID NO: 3763398 - DNA, 14 bp, Homo sapiens
agccacggccaggc

SEQ ID NO: 3763399 - DNA, 18 bp, Homo sapiens
agccacggccaggccaga

SEQ ID NO: 3763400 - DNA, 17 bp, Homo sapiens
agccacgttccttactg

SEQ ID NO: 3763401 - DNA, 13 bp, Homo sapiens
agccactgaagct

SEQ ID NO: 3763402 - DNA, 21 bp, Homo sapiens
agccactgcaccgggccacag

SEQ ID NO: 3763403 - DNA, 22 bp, Homo sapiens
agccactgcaccgggccacaga

SEQ ID NO: 3763404 - DNA, 20 bp, Homo sapiens
agccagaaccccgagcccta

SEQ ID NO: 3763405 - DNA, 12 bp, Homo sapiens
agccagaagctg

SEQ ID NO: 3763406 - DNA, 21 bp, Homo sapiens
agccagacagcaacggggagg

SEQ ID NO: 3763407 - DNA, 16 bp, Homo sapiens
agccagcagccagctc

SEQ ID NO: 3763408 - DNA, 16 bp, Homo sapiens
agccagcccagcccag

SEQ ID NO: 3763409 - DNA, 22 bp, Homo sapiens
agccagccctccctgtcctcct

SEQ ID NO: 3763410 - DNA, 14 bp, Homo sapiens
agccagctctcagc

SEQ ID NO: 3763411 - DNA, 19 bp, Homo sapiens
agccagctgcagctgggct

SEQ ID NO: 3763412 - DNA, 14 bp, Homo sapiens
agccaggagctggg

SEQ ID NO: 3763413 - DNA, 12 bp, Homo sapiens
agccaggcctgg

SEQ ID NO: 3763414 - DNA, 22 bp, Homo sapiens
agccaggcctgggtctgtgtct

SEQ ID NO: 3763415 - DNA, 20 bp, Homo sapiens
agccagggatggggccacag

SEQ ID NO: 3763416 - DNA, 18 bp, Homo sapiens
agccatgaggagttgctg

SEQ ID NO: 3763417 - DNA, 20 bp, Homo sapiens
agccatgaggagttgctgtt

SEQ ID NO: 3763418 - DNA, 15 bp, Homo sapiens
agccatgtttaagat

SEQ ID NO: 3763419 - DNA, 22 bp, Homo sapiens
agccatgtttaagatttaattt

SEQ ID NO: 3763420 - DNA, 18 bp, Homo sapiens
agccattaccatggagac

SEQ ID NO: 3763421 - DNA, 14 bp, Homo sapiens
agcccaaagaagga

SEQ ID NO: 3763422 - DNA, 16 bp, Homo sapiens
agcccaaagctgttgg

SEQ ID NO: 3763423 - DNA, 15 bp, Homo sapiens
agcccaatattataa

SEQ ID NO: 3763424 - DNA, 22 bp, Homo sapiens
agcccacaggtgtccccagccc

SEQ ID NO: 3763425 - DNA, 16 bp, Homo sapiens
agcccacccccctcat

SEQ ID NO: 3763426 - DNA, 14 bp, Homo sapiens
agcccaccttggct

SEQ ID NO: 3763427 - DNA, 16 bp, Homo sapiens
agcccaccttggctca

SEQ ID NO: 3763428 - DNA, 22 bp, Homo sapiens
agcccacgttctctctgcctgt

SEQ ID NO: 3763429 - DNA, 14 bp, Homo sapiens
agcccactggatca

SEQ ID NO: 3763430 - DNA, 18 bp, Homo sapiens
agcccagcccagctgctc

SEQ ID NO: 3763431 - DNA, 16 bp, Homo sapiens
agcccagcccagctgg

SEQ ID NO: 3763432 - DNA, 16 bp, Homo sapiens
agcccagccctgttct

SEQ ID NO: 3763433 - DNA, 17 bp, Homo sapiens
agcccagccctgttctg

SEQ ID NO: 3763434 - DNA, 13 bp, Homo sapiens
agcccagctccag

SEQ ID NO: 3763435 - DNA, 15 bp, Homo sapiens
agcccagctccaggg

SEQ ID NO: 3763436 - DNA, 17 bp, Homo sapiens
agcccagctccagggcc

SEQ ID NO: 3763437 - DNA, 12 bp, Homo sapiens
agcccagctgct

SEQ ID NO: 3763438 - DNA, 14 bp, Homo sapiens
agcccagctgctct

SEQ ID NO: 3763439 - DNA, 23 bp, Homo sapiens
agcccagctgctctgcccagagc

SEQ ID NO: 3763440 - DNA, 17 bp, Homo sapiens
agcccaggaggactgcc

SEQ ID NO: 3763441 - DNA, 18 bp, Homo sapiens
agcccaggcctccagctc

SEQ ID NO: 3763442 - DNA, 22 bp, Homo sapiens
agcccaggcctccagctcagca

SEQ ID NO: 3763443 - DNA, 18 bp, Homo sapiens
agcccagggagcggaaag

SEQ ID NO: 3763444 - DNA, 21 bp, Homo sapiens
agcccagggagcggaaagcag

SEQ ID NO: 3763445 - DNA, 22 bp, Homo sapiens
agcccagggagcggaaagcagc

SEQ ID NO: 3763446 - DNA, 19 bp, Homo sapiens
agcccatcttgcctccatg

SEQ ID NO: 3763447 - DNA, 16 bp, Homo sapiens
agcccatgcccacctg

SEQ ID NO: 3763448 - DNA, 20 bp, Homo sapiens
agcccatgcccacctgccca

SEQ ID NO: 3763449 - DNA, 22 bp, Homo sapiens
agcccatgcccacctgcccatc

SEQ ID NO: 3763450 - DNA, 16 bp, Homo sapiens
agcccattctctctcc

SEQ ID NO: 3763451 - DNA, 21 bp, Homo sapiens
agcccattctctctcctgtcc

SEQ ID NO: 3763452 - DNA, 22 bp, Homo sapiens
agcccattctctctcctgtcca

SEQ ID NO: 3763453 - DNA, 21 bp, Homo sapiens
agccccaacccaaacctggag

SEQ ID NO: 3763454 - DNA, 14 bp, Homo sapiens
agccccagcccagc

SEQ ID NO: 3763455 - DNA, 16 bp, Homo sapiens
agccccaggcaggctg

SEQ ID NO: 3763456 - DNA, 13 bp, Homo sapiens
agccccattctgc

SEQ ID NO: 3763457 - DNA, 19 bp, Homo sapiens
agccccattctgcctgccc

SEQ ID NO: 3763458 - DNA, 22 bp, Homo sapiens
agcccccgccccgccccacatt

SEQ ID NO: 3763459 - DNA, 14 bp, Homo sapiens
agccccgaggcctt

SEQ ID NO: 3763460 - DNA, 16 bp, Homo sapiens
agccccgaggccttct

SEQ ID NO: 3763461 - DNA, 22 bp, Homo sapiens
agccccgaggccttctctgaag

SEQ ID NO: 3763462 - DNA, 18 bp, Homo sapiens
agcccctcctctgccacc

SEQ ID NO: 3763463 - DNA, 20 bp, Homo sapiens
agcccctcctctgccacctc

SEQ ID NO: 3763464 - DNA, 16 bp, Homo sapiens
agcccctcttgccccc

SEQ ID NO: 3763465 - DNA, 19 bp, Homo sapiens
agcccctgcccctcatgcc

SEQ ID NO: 3763466 - DNA, 20 bp, Homo sapiens
agccccttgctctcccctgc

SEQ ID NO: 3763467 - DNA, 19 bp, Homo sapiens
agcccgaggcaccagtgtc

SEQ ID NO: 3763468 - DNA, 18 bp, Homo sapiens
agcccgcacccccaccct

SEQ ID NO: 3763469 - DNA, 14 bp, Homo sapiens
agcccgcatgcagc

SEQ ID NO: 3763470 - DNA, 13 bp, Homo sapiens
agctgctcccctc

SEQ ID NO: 3763471 - DNA, 15 bp, Homo sapiens
agctgctcccctccc

SEQ ID NO: 3763472 - DNA, 16 bp, Homo sapiens
agctgctctgcccaga

SEQ ID NO: 3763473 - DNA, 19 bp, Homo sapiens
agctgctctgcccagagct

SEQ ID NO: 3763474 - DNA, 12 bp, Homo sapiens
agctgctgacag

SEQ ID NO: 3763475 - DNA, 24 bp, Homo sapiens
agctgcttttgtctatgggactca

SEQ ID NO: 3763476 - DNA, 23 bp, Homo sapiens
agctggaattttttattcttgtg

SEQ ID NO: 3763477 - DNA, 15 bp, Homo sapiens
agctggacctcacca

SEQ ID NO: 3763478 - DNA, 23 bp, Homo sapiens
agctggccgagggtcctggctcc

SEQ ID NO: 3763479 - DNA, 18 bp, Homo sapiens
agctggcgtctgtcttca

SEQ ID NO: 3763480 - DNA, 17 bp, Homo sapiens
agctgggactacaggtg

SEQ ID NO: 3763481 - DNA, 16 bp, Homo sapiens
agctgggggccatgag

SEQ ID NO: 3763482 - DNA, 21 bp, Homo sapiens
agctggtagttagtagcatgt

SEQ ID NO: 3763483 - DNA, 15 bp, Homo sapiens
agctggtcccactca

SEQ ID NO: 3763484 - DNA, 17 bp, Homo sapiens
agctggtcccactcagt

SEQ ID NO: 3763485 - DNA, 18 bp, Homo sapiens
agctggtcccactcagtc

SEQ ID NO: 3763486 - DNA, 21 bp, Homo sapiens
agctggtcccactcagtccat

SEQ ID NO: 3763487 - DNA, 17 bp, Homo sapiens
agctggtgcattacaga

SEQ ID NO: 3763488 - DNA, 19 bp, Homo sapiens
agctggtgcattacagaga

SEQ ID NO: 3763489 - DNA, 20 bp, Homo sapiens
agctggtgcattacagagag

SEQ ID NO: 3763490 - DNA, 13 bp, Homo sapiens
agctggtgggaag

SEQ ID NO: 3763491 - DNA, 21 bp, Homo sapiens
agctggtgggtgaaagaaatc

SEQ ID NO: 3763492 - DNA, 18 bp, Homo sapiens
agctggtgtctgattgtt

SEQ ID NO: 3763493 - DNA, 11 bp, Homo sapiens
agctgtatcaa

SEQ ID NO: 3763494 - DNA, 18 bp, Homo sapiens
agctgtccctgtcaccaa

SEQ ID NO: 3763495 - DNA, 20 bp, Homo sapiens
agctgtccctgtcaccaagc

SEQ ID NO: 3763496 - DNA, 15 bp, Homo sapiens
agctgtgaccctcaa

SEQ ID NO: 3763497 - DNA, 19 bp, Homo sapiens
agctgtgctctggacaggc

SEQ ID NO: 3763498 - DNA, 21 bp, Homo sapiens
agctgtgctctggacaggcat

SEQ ID NO: 3763499 - DNA, 15 bp, Homo sapiens
agctgtggttttctt

SEQ ID NO: 3763500 - DNA, 15 bp, Homo sapiens
agctgtgtccttgca

SEQ ID NO: 3763501 - DNA, 23 bp, Homo sapiens
agctgtgtgaaataccagtgtgg

SEQ ID NO: 3763502 - DNA, 18 bp, Homo sapiens
agctgtttatggcctcag

SEQ ID NO: 3763503 - DNA, 21 bp, Homo sapiens
agctgtttatggcctcagctg

SEQ ID NO: 3763504 - DNA, 14 bp, Homo sapiens
agctgttttcttct

SEQ ID NO: 3763505 - DNA, 17 bp, Homo sapiens
agcttagacctcagcct

SEQ ID NO: 3763506 - DNA, 18 bp, Homo sapiens
agcttagacctcagcctg

SEQ ID NO: 3763507 - DNA, 17 bp, Homo sapiens
agcttatcaatttgtca

SEQ ID NO: 3763508 - DNA, 22 bp, Homo sapiens
agcttatcaatttgtcattttg

SEQ ID NO: 3763509 - DNA, 19 bp, Homo sapiens
agcttatcatgctgtcttt

SEQ ID NO: 3763510 - DNA, 15 bp, Homo sapiens
agcttattaatgcta

SEQ ID NO: 3763511 - DNA, 21 bp, Homo sapiens
agcttattaatgctaagggca

SEQ ID NO: 3763512 - DNA, 22 bp, Homo sapiens
agcttattaatgctaagggcag

SEQ ID NO: 3763513 - DNA, 16 bp, Homo sapiens
agcttcaccctgtcaa

SEQ ID NO: 3763514 - DNA, 20 bp, Homo sapiens
agcttcagccaggagctggg

SEQ ID NO: 3763515 - DNA, 17 bp, Homo sapiens
agcttcatataccagca

SEQ ID NO: 3763516 - DNA, 15 bp, Homo sapiens
agcttcatgcctttg

SEQ ID NO: 3763517 - DNA, 19 bp, Homo sapiens
agcttcatttcctgtgtct

SEQ ID NO: 3763518 - DNA, 21 bp, Homo sapiens
agcttccaggaaaaaggacag

SEQ ID NO: 3763519 - DNA, 20 bp, Homo sapiens
agcttccaggctgcatagaa

SEQ ID NO: 3763520 - DNA, 23 bp, Homo sapiens
agcttctagtgatttctggggcc

SEQ ID NO: 3763521 - DNA, 22 bp, Homo sapiens
agcttctctttaactcaggact

SEQ ID NO: 3763522 - DNA, 18 bp, Homo sapiens
agcttctgacctcagcat

SEQ ID NO: 3763523 - DNA, 17 bp, Homo sapiens
agcttctgccacataaa

SEQ ID NO: 3763524 - DNA, 21 bp, Homo sapiens
agcttcttaatataactgcct

SEQ ID NO: 3763525 - DNA, 14 bp, Homo sapiens
agcttgagggttgg

SEQ ID NO: 3763526 - DNA, 23 bp, Homo sapiens
agcttgcgttagaatgaggagga

SEQ ID NO: 3763527 - DNA, 19 bp, Homo sapiens
agcttgctcttcagtggga

SEQ ID NO: 3763528 - DNA, 16 bp, Homo sapiens
agcttgctgcacccca

SEQ ID NO: 3763529 - DNA, 17 bp, Homo sapiens
agcttggaaaggaccag

SEQ ID NO: 3763530 - DNA, 23 bp, Homo sapiens
agcttggctgtagaaggagacag

SEQ ID NO: 3763531 - DNA, 18 bp, Homo sapiens
agcttgggaggcttcccc

SEQ ID NO: 3763532 - DNA, 18 bp, Homo sapiens
agcttgggtttttgttac

SEQ ID NO: 3763533 - DNA, 18 bp, Homo sapiens
agcttgtaaatagctcag

SEQ ID NO: 3763534 - DNA, 21 bp, Homo sapiens
agcttgtaaatagctcaggtg

SEQ ID NO: 3763535 - DNA, 23 bp, Homo sapiens
agcttgtccaacccgaggcccgc

SEQ ID NO: 3763536 - DNA, 22 bp, Homo sapiens
agcttgtctatggtacaaaaat

SEQ ID NO: 3763537 - DNA, 22 bp, Homo sapiens
agcttgttttgtttcatcctgt

SEQ ID NO: 3763538 - DNA, 13 bp, Homo sapiens
agctttaccctca

SEQ ID NO: 3763539 - DNA, 17 bp, Homo sapiens
agctttaccctcaggca

SEQ ID NO: 3763540 - DNA, 16 bp, Homo sapiens
agctttatgtaataat

SEQ ID NO: 3763541 - DNA, 18 bp, Homo sapiens
agctttctctgcttcagc

SEQ ID NO: 3763542 - DNA, 19 bp, Homo sapiens
agctttctctgcttcagct

SEQ ID NO: 3763543 - DNA, 10 bp, Homo sapiens
agctttgcta

SEQ ID NO: 3763544 - DNA, 14 bp, Homo sapiens
agctttggacacac

SEQ ID NO: 3763545 - DNA, 17 bp, Homo sapiens
agcttttagtacccacc

SEQ ID NO: 3763546 - DNA, 19 bp, Homo sapiens
agcttttagtacccacctg

SEQ ID NO: 3763547 - DNA, 13 bp, Homo sapiens
aggaaaaaaactt

SEQ ID NO: 3763548 - DNA, 14 bp, Homo sapiens
aggaaaaaaacttt

SEQ ID NO: 3763549 - DNA, 17 bp, Homo sapiens
aggaaaaaaacttttat

SEQ ID NO: 3763550 - DNA, 21 bp, Homo sapiens
aggaaaaaaacttttataaat

SEQ ID NO: 3763551 - DNA, 14 bp, Homo sapiens
aggaaaaaaatgac

SEQ ID NO: 3763552 - DNA, 19 bp, Homo sapiens
aggaaaaccaagccgtggc

SEQ ID NO: 3763553 - DNA, 20 bp, Homo sapiens
aggaaaaccaagccgtggct

SEQ ID NO: 3763554 - DNA, 23 bp, Homo sapiens
aggaaaaccaagccgtggcttcc

SEQ ID NO: 3763555 - DNA, 16 bp, Homo sapiens
aggaaaatagtaatgt

SEQ ID NO: 3763556 - DNA, 19 bp, Homo sapiens
aggaaaatagtttaggaga

SEQ ID NO: 3763557 - DNA, 14 bp, Homo sapiens
aggaaaatcctctg

SEQ ID NO: 3763558 - DNA, 18 bp, Homo sapiens
aggaaacatatttaagaa

SEQ ID NO: 3763559 - DNA, 21 bp, Homo sapiens
aggaaactcacctgctggccc

SEQ ID NO: 3763560 - DNA, 22 bp, Homo sapiens
aggaaactcacctgctggcccc

SEQ ID NO: 3763561 - DNA, 16 bp, Homo sapiens
aggaaagcaataaatg

SEQ ID NO: 3763562 - DNA, 20 bp, Homo sapiens
aggaaagccccagcactaac

SEQ ID NO: 3763563 - DNA, 21 bp, Homo sapiens
aggaaaggccagctggcagca

SEQ ID NO: 3763564 - DNA, 22 bp, Homo sapiens
aggaaaggccagctggcagcag

SEQ ID NO: 3763565 - DNA, 13 bp, Homo sapiens
aggaaagggaagg

SEQ ID NO: 3763566 - DNA, 17 bp, Homo sapiens
aggaaataaaaaagtct

SEQ ID NO: 3763567 - DNA, 20 bp, Homo sapiens
aggaaataaaaaagtctcta

SEQ ID NO: 3763568 - DNA, 21 bp, Homo sapiens
aggaaataaaaaagtctctat

SEQ ID NO: 3763569 - DNA, 22 bp, Homo sapiens
aggaaataaaaaagtctctatt

SEQ ID NO: 3763570 - DNA, 14 bp, Homo sapiens
aggaaataaaacct

SEQ ID NO: 3763571 - DNA, 16 bp, Homo sapiens
aggaaataaaaccttt

SEQ ID NO: 3763572 - DNA, 17 bp, Homo sapiens
aggaaataaaacctttc

SEQ ID NO: 3763573 - DNA, 20 bp, Homo sapiens
aggaaatatatatgtgtgtg

SEQ ID NO: 3763574 - DNA, 14 bp, Homo sapiens
aggaaatctcaccc

SEQ ID NO: 3763575 - DNA, 16 bp, Homo sapiens
aggaaatctcacccca

SEQ ID NO: 3763576 - DNA, 22 bp, Homo sapiens
aggaaatcttgtccagagacaa

SEQ ID NO: 3763577 - DNA, 16 bp, Homo sapiens
aggaaatgaatttctc

SEQ ID NO: 3763578 - DNA, 23 bp, Homo sapiens
aggaacacccgactcctcaaaag

SEQ ID NO: 3763579 - DNA, 19 bp, Homo sapiens
aggaacatatgaaaataca

SEQ ID NO: 3763580 - DNA, 20 bp, Homo sapiens
aggaacctggaccaaagctg

SEQ ID NO: 3763581 - DNA, 16 bp, Homo sapiens
aggaacggtaaatttc

SEQ ID NO: 3763582 - DNA, 19 bp, Homo sapiens
aggccatgtgagccaccgc

SEQ ID NO: 3763583 - DNA, 21 bp, Homo sapiens
aggcccaaattatcaagctaa

SEQ ID NO: 3763584 - DNA, 18 bp, Homo sapiens
aggccccaaaaccacagc

SEQ ID NO: 3763585 - DNA, 21 bp, Homo sapiens
aggccccaaaaccacagccct

SEQ ID NO: 3763586 - DNA, 21 bp, Homo sapiens
aggccccaaggggtttctgtt

SEQ ID NO: 3763587 - DNA, 13 bp, Homo sapiens
aggccccagagac

SEQ ID NO: 3763588 - DNA, 20 bp, Homo sapiens
aggccccagagactcagagg

SEQ ID NO: 3763589 - DNA, 14 bp, Homo sapiens
aggccccaggaagc

SEQ ID NO: 3763590 - DNA, 15 bp, Homo sapiens
aggccccgcttgtcc

SEQ ID NO: 3763591 - DNA, 17 bp, Homo sapiens
aggcccggctccaggct

SEQ ID NO: 3763592 - DNA, 18 bp, Homo sapiens
aggcccggctccaggctc

SEQ ID NO: 3763593 - DNA, 16 bp, Homo sapiens
aggcccttattttcaa

SEQ ID NO: 3763594 - DNA, 17 bp, Homo sapiens
aggccgaagaagggtcc

SEQ ID NO: 3763595 - DNA, 14 bp, Homo sapiens
aggccgccccagcc

SEQ ID NO: 3763596 - DNA, 20 bp, Homo sapiens
aggccgctgttcacccacag

SEQ ID NO: 3763597 - DNA, 16 bp, Homo sapiens
aggcctataaccccag

SEQ ID NO: 3763598 - DNA, 15 bp, Homo sapiens
aggcctcagtggact

SEQ ID NO: 3763599 - DNA, 16 bp, Homo sapiens
aggcctcagtggactt

SEQ ID NO: 3763600 - DNA, 14 bp, Homo sapiens
aggcctccagctca

SEQ ID NO: 3763601 - DNA, 22 bp, Homo sapiens
aggcctccctctctcttctgct

SEQ ID NO: 3763602 - DNA, 12 bp, Homo sapiens
aggcctctgggc

SEQ ID NO: 3763603 - DNA, 13 bp, Homo sapiens
aggcctgcctgtt

SEQ ID NO: 3763604 - DNA, 13 bp, Homo sapiens
aggcctggccaga

SEQ ID NO: 3763605 - DNA, 15 bp, Homo sapiens
aggcctggccagatg

SEQ ID NO: 3763606 - DNA, 21 bp, Homo sapiens
aggcctggccagatgcaccag

SEQ ID NO: 3763607 - DNA, 22 bp, Homo sapiens
aggcctggccagatgcaccagc

SEQ ID NO: 3763608 - DNA, 17 bp, Homo sapiens
aggcctgggtctgtgtc

SEQ ID NO: 3763609 - DNA, 19 bp, Homo sapiens
aggcctgggtctgtgtctc

SEQ ID NO: 3763610 - DNA, 23 bp, Homo sapiens
aggcctgtccctggccatctctg

SEQ ID NO: 3763611 - DNA, 17 bp, Homo sapiens
aggccttctctgaagga

SEQ ID NO: 3763612 - DNA, 13 bp, Homo sapiens
aggccttcttgtg

SEQ ID NO: 3763613 - DNA, 18 bp, Homo sapiens
aggccttcttgtgatctt

SEQ ID NO: 3763614 - DNA, 21 bp, Homo sapiens
aggccttcttgtgatcttgct

SEQ ID NO: 3763615 - DNA, 16 bp, Homo sapiens
aggccttttggaatgt

SEQ ID NO: 3763616 - DNA, 21 bp, Homo sapiens
aggcgcagtgcttctctacag

SEQ ID NO: 3763617 - DNA, 21 bp, Homo sapiens
aggcggcctttgttgctcagc

SEQ ID NO: 3763618 - DNA, 19 bp, Homo sapiens
aggctaaggcaggaaaatt

SEQ ID NO: 3763619 - DNA, 17 bp, Homo sapiens
aggctcagtctcaggag

SEQ ID NO: 3763620 - DNA, 15 bp, Homo sapiens
aggctccttcctgtc

SEQ ID NO: 3763621 - DNA, 23 bp, Homo sapiens
aggctctaaccacacagcctaca

SEQ ID NO: 3763622 - DNA, 17 bp, Homo sapiens
aggctctgcacagatgg

SEQ ID NO: 3763623 - DNA, 12 bp, Homo sapiens
aggctctgccct

SEQ ID NO: 3763624 - DNA, 13 bp, Homo sapiens
aggctcttctcct

SEQ ID NO: 3763625 - DNA, 19 bp, Homo sapiens
aggctgaccaagagagaaa

SEQ ID NO: 3763626 - DNA, 20 bp, Homo sapiens
aggctgaccaagagagaaag

SEQ ID NO: 3763627 - DNA, 17 bp, Homo sapiens
aggctgagactgcggga

SEQ ID NO: 3763628 - DNA, 14 bp, Homo sapiens
aggctgaggaaagg

SEQ ID NO: 3763629 - DNA, 15 bp, Homo sapiens
aggctgaggaaaggc

SEQ ID NO: 3763630 - DNA, 19 bp, Homo sapiens
aggctgaggaaaggccagc

SEQ ID NO: 3763631 - DNA, 11 bp, Homo sapiens
aggctgaggac

SEQ ID NO: 3763632 - DNA, 14 bp, Homo sapiens
aggctgaggcagaa

SEQ ID NO: 3763633 - DNA, 19 bp, Homo sapiens
aggctgaggcaggagaatg

SEQ ID NO: 3763634 - DNA, 11 bp, Homo sapiens
aggctgaggcg

SEQ ID NO: 3763635 - DNA, 21 bp, Homo sapiens
aggctgaggcgggtggatcac

SEQ ID NO: 3763636 - DNA, 17 bp, Homo sapiens
aggctgcagtgagccga

SEQ ID NO: 3763637 - DNA, 13 bp, Homo sapiens
aggctgcatagaa

SEQ ID NO: 3763638 - DNA, 16 bp, Homo sapiens
aggctgcatagaagga

SEQ ID NO: 3763639 - DNA, 17 bp, Homo sapiens
aggctgcatagaaggag

SEQ ID NO: 3763640 - DNA, 23 bp, Homo sapiens
aggctgcatagaaggaggagagg

SEQ ID NO: 3763641 - DNA, 17 bp, Homo sapiens
aggctgccaaggccaga

SEQ ID NO: 3763642 - DNA, 15 bp, Homo sapiens
aggctgctcagggct

SEQ ID NO: 3763643 - DNA, 15 bp, Homo sapiens
aggctgctggaggaa

SEQ ID NO: 3763644 - DNA, 16 bp, Homo sapiens
aggctgctggaggaaa

SEQ ID NO: 3763645 - DNA, 15 bp, Homo sapiens
aggctggactccaga

SEQ ID NO: 3763646 - DNA, 16 bp, Homo sapiens
aggctggactccagat

SEQ ID NO: 3763647 - DNA, 18 bp, Homo sapiens
aggctggagcccagggag

SEQ ID NO: 3763648 - DNA, 14 bp, Homo sapiens
aggctggagctggc

SEQ ID NO: 3763649 - DNA, 17 bp, Homo sapiens
aggctggagctggcgtc

SEQ ID NO: 3763650 - DNA, 15 bp, Homo sapiens
aggctggaggaaggg

SEQ ID NO: 3763651 - DNA, 15 bp, Homo sapiens
aggctggaggcaggg

SEQ ID NO: 3763652 - DNA, 16 bp, Homo sapiens
aggctggaggcagggc

SEQ ID NO: 3763653 - DNA, 20 bp, Homo sapiens
aggctggagtggagtggcgt

SEQ ID NO: 3763654 - DNA, 22 bp, Homo sapiens
aggctggattttgaattttctt

SEQ ID NO: 3763655 - DNA, 15 bp, Homo sapiens
aggctggcaggtatg

SEQ ID NO: 3763656 - DNA, 20 bp, Homo sapiens
aggctggcgtgcagtggtgc

SEQ ID NO: 3763657 - DNA, 14 bp, Homo sapiens
aggctggcttgtcc

SEQ ID NO: 3763658 - DNA, 22 bp, Homo sapiens
aggctgggcccagaggcacagc

SEQ ID NO: 3763659 - DNA, 18 bp, Homo sapiens
aggctgggcgtagtggct

SEQ ID NO: 3763660 - DNA, 18 bp, Homo sapiens
aggctgggcttcagtggc

SEQ ID NO: 3763661 - DNA, 14 bp, Homo sapiens
aggctgggtgccca

SEQ ID NO: 3763662 - DNA, 17 bp, Homo sapiens
aggctgggtgcccacag

SEQ ID NO: 3763663 - DNA, 18 bp, Homo sapiens
aggctgggtgcccacagc

SEQ ID NO: 3763664 - DNA, 21 bp, Homo sapiens
aggctgtccttacccatctgc

SEQ ID NO: 3763665 - DNA, 20 bp, Homo sapiens
aggctgtcttctcaggctct

SEQ ID NO: 3763666 - DNA, 17 bp, Homo sapiens
aggctgtttttgggtgc

SEQ ID NO: 3763667 - DNA, 22 bp, Homo sapiens
aggcttcaatttattgcacaaa

SEQ ID NO: 3763668 - DNA, 18 bp, Homo sapiens
aggcttgcataataagct

SEQ ID NO: 3763669 - DNA, 13 bp, Homo sapiens
aggctttacttag

SEQ ID NO: 3763670 - DNA, 18 bp, Homo sapiens
agggaaaggatattttct

SEQ ID NO: 3763671 - DNA, 15 bp, Homo sapiens
agggaaatatcattt

SEQ ID NO: 3763672 - DNA, 14 bp, Homo sapiens
agggaacagacagg

SEQ ID NO: 3763673 - DNA, 20 bp, Homo sapiens
agggaacagacaggagaaat

SEQ ID NO: 3763674 - DNA, 18 bp, Homo sapiens
agggaacatatttaagga

SEQ ID NO: 3763675 - DNA, 19 bp, Homo sapiens
agggaacggggtccttcaa

SEQ ID NO: 3763676 - DNA, 16 bp, Homo sapiens
agggaagaaaagagct

SEQ ID NO: 3763677 - DNA, 16 bp, Homo sapiens
agggaagatctaacat

SEQ ID NO: 3763678 - DNA, 13 bp, Homo sapiens
agggaagcccagc

SEQ ID NO: 3763679 - DNA, 14 bp, Homo sapiens
agggaagcccagct

SEQ ID NO: 3763680 - DNA, 16 bp, Homo sapiens
agggaagctggccgag

SEQ ID NO: 3763681 - DNA, 17 bp, Homo sapiens
agggaaggccacctgca

SEQ ID NO: 3763682 - DNA, 16 bp, Homo sapiens
agggaaggccccacag

SEQ ID NO: 3763683 - DNA, 20 bp, Homo sapiens
agggaaggggaggcagccgg

SEQ ID NO: 3763684 - DNA, 21 bp, Homo sapiens
agggaaggggaggcagccggc

SEQ ID NO: 3763685 - DNA, 15 bp, Homo sapiens
agggaagtccccagg

SEQ ID NO: 3763686 - DNA, 15 bp, Homo sapiens
agggaattctcttgg

SEQ ID NO: 3763687 - DNA, 14 bp, Homo sapiens
agggacatgtggaa

SEQ ID NO: 3763688 - DNA, 17 bp, Homo sapiens
agggaccaactgggccc

SEQ ID NO: 3763689 - DNA, 14 bp, Homo sapiens
agggaccaaggacc

SEQ ID NO: 3763690 - DNA, 19 bp, Homo sapiens
agggaccaaggacccctca

SEQ ID NO: 3763691 - DNA, 14 bp, Homo sapiens
agggaccagccaag

SEQ ID NO: 3763692 - DNA, 17 bp, Homo sapiens
agggactaggagcactg

SEQ ID NO: 3763693 - DNA, 20 bp, Homo sapiens
agggactcatcatttccatt

SEQ ID NO: 3763694 - DNA, 23 bp, Homo sapiens
agggactgccagtccccctgccc

SEQ ID NO: 3763695 - DNA, 21 bp, Homo sapiens
agtcctgggagaacctcaggc

SEQ ID NO: 3763696 - DNA, 17 bp, Homo sapiens
agtccttacctcttccg

SEQ ID NO: 3763697 - DNA, 21 bp, Homo sapiens
agtccttacctcttccggaga

SEQ ID NO: 3763698 - DNA, 23 bp, Homo sapiens
agtccttacctcttccggagatg

SEQ ID NO: 3763699 - DNA, 15 bp, Homo sapiens
agtccttgcaagaat

SEQ ID NO: 3763700 - DNA, 13 bp, Homo sapiens
agtcgctgaggaa

SEQ ID NO: 3763701 - DNA, 23 bp, Homo sapiens
agtctaaatatttccttaaactg

SEQ ID NO: 3763702 - DNA, 12 bp, Homo sapiens
agtctaaccaaa

SEQ ID NO: 3763703 - DNA, 13 bp, Homo sapiens
agtctaaccaaat

SEQ ID NO: 3763704 - DNA, 20 bp, Homo sapiens
agtctaaccaaatgcatcaa

SEQ ID NO: 3763705 - DNA, 14 bp, Homo sapiens
agtctacgctctcc

SEQ ID NO: 3763706 - DNA, 16 bp, Homo sapiens
agtctaggagctggga

SEQ ID NO: 3763707 - DNA, 17 bp, Homo sapiens
agtctagttcctgatga

SEQ ID NO: 3763708 - DNA, 14 bp, Homo sapiens
agtctattagccac

SEQ ID NO: 3763709 - DNA, 16 bp, Homo sapiens
agtctcactcccctcc

SEQ ID NO: 3763710 - DNA, 16 bp, Homo sapiens
agtctcactgttgccc

SEQ ID NO: 3763711 - DNA, 19 bp, Homo sapiens
agtctcactgttgcccagg

SEQ ID NO: 3763712 - DNA, 21 bp, Homo sapiens
agtctcactgttgcccaggct

SEQ ID NO: 3763713 - DNA, 13 bp, Homo sapiens
agtctcaggagca

SEQ ID NO: 3763714 - DNA, 15 bp, Homo sapiens
agtctctcttaccct

SEQ ID NO: 3763715 - DNA, 11 bp, Homo sapiens
agtctctgtga

SEQ ID NO: 3763716 - DNA, 13 bp, Homo sapiens
agtctcttctcca

SEQ ID NO: 3763717 - DNA, 19 bp, Homo sapiens
agtctcttctccactggat

SEQ ID NO: 3763718 - DNA, 21 bp, Homo sapiens
agtctcttctccactggatgg

SEQ ID NO: 3763719 - DNA, 21 bp, Homo sapiens
agtctctttaatcttcagttt

SEQ ID NO: 3763720 - DNA, 17 bp, Homo sapiens
agtctgaagtttcattt

SEQ ID NO: 3763721 - DNA, 18 bp, Homo sapiens
agtctgaagtttcattta

SEQ ID NO: 3763722 - DNA, 18 bp, Homo sapiens
agtctgattcccaagctc

SEQ ID NO: 3763723 - DNA, 17 bp, Homo sapiens
agtctggaatgcagtgg

SEQ ID NO: 3763724 - DNA, 15 bp, Homo sapiens
agtctggtttctaga

SEQ ID NO: 3763725 - DNA, 22 bp, Homo sapiens
agtctgtgcctggagctcctgg

SEQ ID NO: 3763726 - DNA, 15 bp, Homo sapiens
agtctgtgtgaaggt

SEQ ID NO: 3763727 - DNA, 23 bp, Homo sapiens
agtctgtgtgctgtggttcctgg

SEQ ID NO: 3763728 - DNA, 17 bp, Homo sapiens
agtctgtgtgggactgt

SEQ ID NO: 3763729 - DNA, 17 bp, Homo sapiens
agtcttaacatttctaa

SEQ ID NO: 3763730 - DNA, 14 bp, Homo sapiens
agtcttagatgtat

SEQ ID NO: 3763731 - DNA, 16 bp, Homo sapiens
agtcttagatgtatat

SEQ ID NO: 3763732 - DNA, 23 bp, Homo sapiens
agtcttagatgtatatatttcct

SEQ ID NO: 3763733 - DNA, 16 bp, Homo sapiens
agtcttcaagggctgc

SEQ ID NO: 3763734 - DNA, 12 bp, Homo sapiens
agtcttctcata

SEQ ID NO: 3763735 - DNA, 16 bp, Homo sapiens
agtcttgctgtggtct

SEQ ID NO: 3763736 - DNA, 23 bp, Homo sapiens
agtcttgctgtggtctctttgtg

SEQ ID NO: 3763737 - DNA, 22 bp, Homo sapiens
agtcttgtgactagtgctgaag

SEQ ID NO: 3763738 - DNA, 20 bp, Homo sapiens
agtctttcacagtaccatct

SEQ ID NO: 3763739 - DNA, 23 bp, Homo sapiens
agtctttgtaagtaaactgccct

SEQ ID NO: 3763740 - DNA, 20 bp, Homo sapiens
agtgaaaaaggaggaagaga

SEQ ID NO: 3763741 - DNA, 14 bp, Homo sapiens
agtgaaaataggta

SEQ ID NO: 3763742 - DNA, 14 bp, Homo sapiens
agtgaaagcatcac

SEQ ID NO: 3763743 - DNA, 14 bp, Homo sapiens
agtgaatttgaatg

SEQ ID NO: 3763744 - DNA, 15 bp, Homo sapiens
agtgaatttgaatga

SEQ ID NO: 3763745 - DNA, 14 bp, Homo sapiens
agtgacaaggcccc

SEQ ID NO: 3763746 - DNA, 18 bp, Homo sapiens
agtgacacttcagagagc

SEQ ID NO: 3763747 - DNA, 19 bp, Homo sapiens
agtgacagaggcagcccca

SEQ ID NO: 3763748 - DNA, 19 bp, Homo sapiens
agtgacagagttcactata

SEQ ID NO: 3763749 - DNA, 14 bp, Homo sapiens
agtgacctgaggaa

SEQ ID NO: 3763750 - DNA, 15 bp, Homo sapiens
agtgacctgaggaag

SEQ ID NO: 3763751 - DNA, 17 bp, Homo sapiens
agtgacctgaggaagcg

SEQ ID NO: 3763752 - DNA, 14 bp, Homo sapiens
agtgacgtgcacct

SEQ ID NO: 3763753 - DNA, 18 bp, Homo sapiens
agtgactcatcctcttga

SEQ ID NO: 3763754 - DNA, 23 bp, Homo sapiens
agtgactcatcctcttgaagatg

SEQ ID NO: 3763755 - DNA, 16 bp, Homo sapiens
agtgactgtatctgtg

SEQ ID NO: 3763756 - DNA, 17 bp, Homo sapiens
agtgactgtatctgtgt

SEQ ID NO: 3763757 - DNA, 18 bp, Homo sapiens
agtgagacccctgtctcc

SEQ ID NO: 3763758 - DNA, 17 bp, Homo sapiens
agtgagaccctgtctca

SEQ ID NO: 3763759 - DNA, 22 bp, Homo sapiens
agtgagactctgtctcaaaaaa

SEQ ID NO: 3763760 - DNA, 18 bp, Homo sapiens
agtgagagagacaagaag

SEQ ID NO: 3763761 - DNA, 13 bp, Homo sapiens
agtgagagggcat

SEQ ID NO: 3763762 - DNA, 18 bp, Homo sapiens
agtgagcaaacctgcccc

SEQ ID NO: 3763763 - DNA, 14 bp, Homo sapiens
agtgagcactaagg

SEQ ID NO: 3763764 - DNA, 21 bp, Homo sapiens
agtgagcctgaattttgttgc

SEQ ID NO: 3763765 - DNA, 17 bp, Homo sapiens
agtgagctgtaggtgtg

SEQ ID NO: 3763766 - DNA, 20 bp, Homo sapiens
agtgagggcttgtcattacc

SEQ ID NO: 3763767 - DNA, 15 bp, Homo sapiens
agtgagggtcagaga

SEQ ID NO: 3763768 - DNA, 16 bp, Homo sapiens
agtgaggtcctggggg

SEQ ID NO: 3763769 - DNA, 15 bp, Homo sapiens
agtgagtataactct

SEQ ID NO: 3763770 - DNA, 21 bp, Homo sapiens
agtgagtgtggctcccctcta

SEQ ID NO: 3763771 - DNA, 21 bp, Homo sapiens
agtgagttcagcctttaagat

SEQ ID NO: 3763772 - DNA, 16 bp, Homo sapiens
agtgatcaataaaatg

SEQ ID NO: 3763773 - DNA, 13 bp, Homo sapiens
agtgatcctccca

SEQ ID NO: 3763774 - DNA, 13 bp, Homo sapiens
agtgatctccata

SEQ ID NO: 3763775 - DNA, 14 bp, Homo sapiens
agtgatctccatat

SEQ ID NO: 3763776 - DNA, 16 bp, Homo sapiens
agtgatgtaccatgaa

SEQ ID NO: 3763777 - DNA, 19 bp, Homo sapiens
agtgattaaggtctctctt

SEQ ID NO: 3763778 - DNA, 22 bp, Homo sapiens
agtgattaaggtctctctttgg

SEQ ID NO: 3763779 - DNA, 19 bp, Homo sapiens
agtgattctcctgcctcag

SEQ ID NO: 3763780 - DNA, 24 bp, Homo sapiens
agtgattctcctgcctcagcctcc

SEQ ID NO: 3763781 - DNA, 21 bp, Homo sapiens
agtgatttctggggccccacc

SEQ ID NO: 3763782 - DNA, 16 bp, Homo sapiens
agtgatttttatccaa

SEQ ID NO: 3763783 - DNA, 22 bp, Homo sapiens
agtgatttttatccaatcttgt

SEQ ID NO: 3763784 - DNA, 15 bp, Homo sapiens
agtgcaacagtagca

SEQ ID NO: 3763785 - DNA, 17 bp, Homo sapiens
agtgcacccactctgct

SEQ ID NO: 3763786 - DNA, 16 bp, Homo sapiens
agtgcagacaggccat

SEQ ID NO: 3763787 - DNA, 15 bp, Homo sapiens
agtgcagcaaccaga

SEQ ID NO: 3763788 - DNA, 21 bp, Homo sapiens
agtgcagcaaccagagcactg

SEQ ID NO: 3763789 - DNA, 23 bp, Homo sapiens
agtgcagcccgtgtggccccttc

SEQ ID NO: 3763790 - DNA, 16 bp, Homo sapiens
agtgcagctgatttta

SEQ ID NO: 3763791 - DNA, 13 bp, Homo sapiens
agtgcaggctggc

SEQ ID NO: 3763792 - DNA, 14 bp, Homo sapiens
agtgcatctcagcc

SEQ ID NO: 3763793 - DNA, 15 bp, Homo sapiens
agtgcatctcagccc

SEQ ID NO: 3763794 - DNA, 22 bp, Homo sapiens
agtgcatgctctctgcagccag

SEQ ID NO: 3763795 - DNA, 20 bp, Homo sapiens
agtgccactgcccgagctgg

SEQ ID NO: 3763796 - DNA, 14 bp, Homo sapiens
agtgccattgtctt

SEQ ID NO: 3763797 - DNA, 18 bp, Homo sapiens
agtgccattgtctttata

SEQ ID NO: 3763798 - DNA, 21 bp, Homo sapiens
agtgccattgtctttatatga

SEQ ID NO: 3763799 - DNA, 17 bp, Homo sapiens
agtgcccaactgttata

SEQ ID NO: 3763800 - DNA, 16 bp, Homo sapiens
agtgcccaccaacatc

SEQ ID NO: 3763801 - DNA, 16 bp, Homo sapiens
agtgccccacctgcca

SEQ ID NO: 3763802 - DNA, 17 bp, Homo sapiens
agtgccccacctgccac

SEQ ID NO: 3763803 - DNA, 16 bp, Homo sapiens
agtgccctccacagcc

SEQ ID NO: 3763804 - DNA, 22 bp, Homo sapiens
agtgccctggggctgatctcag

SEQ ID NO: 3763805 - DNA, 22 bp, Homo sapiens
agtgccgtagggagtacctgct

SEQ ID NO: 3763806 - DNA, 12 bp, Homo sapiens
agtgcctgctga

SEQ ID NO: 3763807 - DNA, 18 bp, Homo sapiens
agtgcctgggaatgtatt

SEQ ID NO: 3763808 - DNA, 13 bp, Homo sapiens
atacattaaagca

SEQ ID NO: 3763809 - DNA, 15 bp, Homo sapiens
atacattaaagcagt

SEQ ID NO: 3763810 - DNA, 20 bp, Homo sapiens
atacatttataatgtttgct

SEQ ID NO: 3763811 - DNA, 21 bp, Homo sapiens
atacatttataatgtttgcta

SEQ ID NO: 3763812 - DNA, 17 bp, Homo sapiens
ataccaggccgccccag

SEQ ID NO: 3763813 - DNA, 12 bp, Homo sapiens
ataccagtgtgg

SEQ ID NO: 3763814 - DNA, 17 bp, Homo sapiens
ataccatcagcaaagaa

SEQ ID NO: 3763815 - DNA, 18 bp, Homo sapiens
atacctcaacctatggta

SEQ ID NO: 3763816 - DNA, 13 bp, Homo sapiens
atacgactttatt

SEQ ID NO: 3763817 - DNA, 17 bp, Homo sapiens
atacgactttattttct

SEQ ID NO: 3763818 - DNA, 13 bp, Homo sapiens
atactaaaaatca

SEQ ID NO: 3763819 - DNA, 22 bp, Homo sapiens
atactccaaccatatggatatt

SEQ ID NO: 3763820 - DNA, 13 bp, Homo sapiens
atactctaattct

SEQ ID NO: 3763821 - DNA, 14 bp, Homo sapiens
atactctaattcta

SEQ ID NO: 3763822 - DNA, 15 bp, Homo sapiens
atactctaattctaa

SEQ ID NO: 3763823 - DNA, 18 bp, Homo sapiens
atactctaattctaacca

SEQ ID NO: 3763824 - DNA, 13 bp, Homo sapiens
atactctgtcaga

SEQ ID NO: 3763825 - DNA, 15 bp, Homo sapiens
atactctgtcagatg

SEQ ID NO: 3763826 - DNA, 17 bp, Homo sapiens
atactggaagttttgca

SEQ ID NO: 3763827 - DNA, 19 bp, Homo sapiens
atactggaagttttgcatt

SEQ ID NO: 3763828 - DNA, 14 bp, Homo sapiens
atacttattcattg

SEQ ID NO: 3763829 - DNA, 22 bp, Homo sapiens
atacttcagctcacacatgaga

SEQ ID NO: 3763830 - DNA, 19 bp, Homo sapiens
atacttttttcttatttaa

SEQ ID NO: 3763831 - DNA, 20 bp, Homo sapiens
atagaaatatagccaaaaat

SEQ ID NO: 3763832 - DNA, 18 bp, Homo sapiens
atagaaggaaactagctt

SEQ ID NO: 3763833 - DNA, 19 bp, Homo sapiens
atagaatataattatcgga

SEQ ID NO: 3763834 - DNA, 13 bp, Homo sapiens
atagaatatttat

SEQ ID NO: 3763835 - DNA, 22 bp, Homo sapiens
atagaatatttattacctctga

SEQ ID NO: 3763836 - DNA, 18 bp, Homo sapiens
atagactttatgcaataa

SEQ ID NO: 3763837 - DNA, 19 bp, Homo sapiens
atagactttatgcaataaa

SEQ ID NO: 3763838 - DNA, 14 bp, Homo sapiens
atagagtgttatca

SEQ ID NO: 3763839 - DNA, 17 bp, Homo sapiens
atagataactctttgga

SEQ ID NO: 3763840 - DNA, 19 bp, Homo sapiens
atagatgtccctttcttgg

SEQ ID NO: 3763841 - DNA, 22 bp, Homo sapiens
atagatgtccctttcttggcca

SEQ ID NO: 3763842 - DNA, 15 bp, Homo sapiens
atagattagattata

SEQ ID NO: 3763843 - DNA, 22 bp, Homo sapiens
atagattcacctgtaaaacttt

SEQ ID NO: 3763844 - DNA, 23 bp, Homo sapiens
atagattggagccaccatgccca

SEQ ID NO: 3763845 - DNA, 14 bp, Homo sapiens
atagatttctgatt

SEQ ID NO: 3763846 - DNA, 21 bp, Homo sapiens
atagatttctgattttatgta

SEQ ID NO: 3763847 - DNA, 16 bp, Homo sapiens
atagcaacactctata

SEQ ID NO: 3763848 - DNA, 15 bp, Homo sapiens
atagcaacatgcttc

SEQ ID NO: 3763849 - DNA, 22 bp, Homo sapiens
atagcaagtgaatttttctcta

SEQ ID NO: 3763850 - DNA, 15 bp, Homo sapiens
atagcactttcattg

SEQ ID NO: 3763851 - DNA, 16 bp, Homo sapiens
atagcagacagtgttt

SEQ ID NO: 3763852 - DNA, 14 bp, Homo sapiens
atagcagattttaa

SEQ ID NO: 3763853 - DNA, 22 bp, Homo sapiens
atagcagattttaattttgaat

SEQ ID NO: 3763854 - DNA, 13 bp, Homo sapiens
atagcatgtaatg

SEQ ID NO: 3763855 - DNA, 19 bp, Homo sapiens
atagcattggggacatggg

SEQ ID NO: 3763856 - DNA, 16 bp, Homo sapiens
atagcgaggctctaac

SEQ ID NO: 3763857 - DNA, 22 bp, Homo sapiens
atagcgttggaattaaaacaat

SEQ ID NO: 3763858 - DNA, 15 bp, Homo sapiens
atagctacaggaagc

SEQ ID NO: 3763859 - DNA, 19 bp, Homo sapiens
atagctatatccatgtact

SEQ ID NO: 3763860 - DNA, 22 bp, Homo sapiens
atagctatatccatgtactgta

SEQ ID NO: 3763861 - DNA, 12 bp, Homo sapiens
atagctattttt

SEQ ID NO: 3763862 - DNA, 20 bp, Homo sapiens
atagctcaggtgtccctgca

SEQ ID NO: 3763863 - DNA, 13 bp, Homo sapiens
atagctcagttta

SEQ ID NO: 3763864 - DNA, 17 bp, Homo sapiens
atagctgagattcctgg

SEQ ID NO: 3763865 - DNA, 21 bp, Homo sapiens
atagctttattttttaagtat

SEQ ID NO: 3763866 - DNA, 22 bp, Homo sapiens
atagctttattttttaagtatt

SEQ ID NO: 3763867 - DNA, 18 bp, Homo sapiens
ataggaacatatgaaaat

SEQ ID NO: 3763868 - DNA, 22 bp, Homo sapiens
ataggagagagatcatgagaaa

SEQ ID NO: 3763869 - DNA, 15 bp, Homo sapiens
ataggctctgcacag

SEQ ID NO: 3763870 - DNA, 16 bp, Homo sapiens
ataggtcactcctggg

SEQ ID NO: 3763871 - DNA, 14 bp, Homo sapiens
atagtacctttgct

SEQ ID NO: 3763872 - DNA, 18 bp, Homo sapiens
atagtatggtggctgggt

SEQ ID NO: 3763873 - DNA, 22 bp, Homo sapiens
atagtattccattgtgtgagtg

SEQ ID NO: 3763874 - DNA, 14 bp, Homo sapiens
atagtcacaagagc

SEQ ID NO: 3763875 - DNA, 23 bp, Homo sapiens
atagtcaccttttaaatcctgtt

SEQ ID NO: 3763876 - DNA, 13 bp, Homo sapiens
atagtctgtgtga

SEQ ID NO: 3763877 - DNA, 12 bp, Homo sapiens
atagtgtgttct

SEQ ID NO: 3763878 - DNA, 15 bp, Homo sapiens
atagttcaaagccaa

SEQ ID NO: 3763879 - DNA, 22 bp, Homo sapiens
atagttggctaggacccctcca

SEQ ID NO: 3763880 - DNA, 13 bp, Homo sapiens
atagtttattgac

SEQ ID NO: 3763881 - DNA, 13 bp, Homo sapiens
atataaagagaaa

SEQ ID NO: 3763882 - DNA, 21 bp, Homo sapiens
atataaagagaaaattgaatt

SEQ ID NO: 3763883 - DNA, 18 bp, Homo sapiens
atataaagcatctaaact

SEQ ID NO: 3763884 - DNA, 19 bp, Homo sapiens
atataaagcatctaaactt

SEQ ID NO: 3763885 - DNA, 18 bp, Homo sapiens
atataaataaaacatttt

SEQ ID NO: 3763886 - DNA, 17 bp, Homo sapiens
atataaccaatgtttaa

SEQ ID NO: 3763887 - DNA, 20 bp, Homo sapiens
atataactgccttaaaactt

SEQ ID NO: 3763888 - DNA, 12 bp, Homo sapiens
atataataaagt

SEQ ID NO: 3763889 - DNA, 18 bp, Homo sapiens
atataattgttttttatc

SEQ ID NO: 3763890 - DNA, 21 bp, Homo sapiens
atataattgttttttatcttt

SEQ ID NO: 3763891 - DNA, 14 bp, Homo sapiens
atatacaattatat

SEQ ID NO: 3763892 - DNA, 17 bp, Homo sapiens
atatacacacacaaaga

SEQ ID NO: 3763893 - DNA, 20 bp, Homo sapiens
atatacacacacaaagagag

SEQ ID NO: 3763894 - DNA, 22 bp, Homo sapiens
atatactaagatgttcactgtg

SEQ ID NO: 3763895 - DNA, 21 bp, Homo sapiens
atatagctatttttatggaat

SEQ ID NO: 3763896 - DNA, 18 bp, Homo sapiens
atatagcttgaaacatag

SEQ ID NO: 3763897 - DNA, 15 bp, Homo sapiens
atataggaattaaga

SEQ ID NO: 3763898 - DNA, 13 bp, Homo sapiens
atatatacacaca

SEQ ID NO: 3763899 - DNA, 20 bp, Homo sapiens
atatatatgtgtgtgtatgt

SEQ ID NO: 3763900 - DNA, 23 bp, Homo sapiens
atatatattctggctgataaaag

SEQ ID NO: 3763901 - DNA, 13 bp, Homo sapiens
atatatattttaa

SEQ ID NO: 3763902 - DNA, 14 bp, Homo sapiens
atatatctatctta

SEQ ID NO: 3763903 - DNA, 15 bp, Homo sapiens
atatatctatcttat

SEQ ID NO: 3763904 - DNA, 13 bp, Homo sapiens
atatatgaggact

SEQ ID NO: 3763905 - DNA, 11 bp, Homo sapiens
atatatgtatg

SEQ ID NO: 3763906 - DNA, 12 bp, Homo sapiens
atatatgtatgt

SEQ ID NO: 3763907 - DNA, 19 bp, Homo sapiens
atatatgtatgtaaaaatg

SEQ ID NO: 3763908 - DNA, 21 bp, Homo sapiens
atatatgttttaagaggcagg

SEQ ID NO: 3763909 - DNA, 22 bp, Homo sapiens
atatatgttttaagaggcaggg

SEQ ID NO: 3763910 - DNA, 20 bp, Homo sapiens
atatattctggctgataaaa

SEQ ID NO: 3763911 - DNA, 22 bp, Homo sapiens
atatattctggctgataaaaga

SEQ ID NO: 3763912 - DNA, 10 bp, Homo sapiens
atatatttat

SEQ ID NO: 3763913 - DNA, 12 bp, Homo sapiens
atatatttataa

SEQ ID NO: 3763914 - DNA, 15 bp, Homo sapiens
atatatttataactc

SEQ ID NO: 3763915 - DNA, 16 bp, Homo sapiens
atatatttataactca

SEQ ID NO: 3763916 - DNA, 21 bp, Homo sapiens
atatatttataactcatcata

SEQ ID NO: 3763917 - DNA, 14 bp, Homo sapiens
atatatttcagata

SEQ ID NO: 3763918 - DNA, 14 bp, Homo sapiens
atatatttttcaca

SEQ ID NO: 3763919 - DNA, 15 bp, Homo sapiens
atatatttttcacag

SEQ ID NO: 3763920 - DNA, 19 bp, Homo sapiens
atatattttttaatttgat

SEQ ID NO: 3763921 - DNA, 15 bp, Homo sapiens
atcttaactctttgc

SEQ ID NO: 3763922 - DNA, 23 bp, Homo sapiens
atcttaactctttgcctttgcca

SEQ ID NO: 3763923 - DNA, 14 bp, Homo sapiens
atcttacaaagtgt

SEQ ID NO: 3763924 - DNA, 21 bp, Homo sapiens
atcttagtgcctgagagtatt

SEQ ID NO: 3763925 - DNA, 13 bp, Homo sapiens
atcttattcacat

SEQ ID NO: 3763926 - DNA, 23 bp, Homo sapiens
atcttattttcatgtatatgtgt

SEQ ID NO: 3763927 - DNA, 19 bp, Homo sapiens
atcttcaaagcttgaagat

SEQ ID NO: 3763928 - DNA, 13 bp, Homo sapiens
atcttcacttcta

SEQ ID NO: 3763929 - DNA, 21 bp, Homo sapiens
atcttccctagagggttcctg

SEQ ID NO: 3763930 - DNA, 15 bp, Homo sapiens
atcttctccatctgg

SEQ ID NO: 3763931 - DNA, 17 bp, Homo sapiens
atcttctttataattct

SEQ ID NO: 3763932 - DNA, 21 bp, Homo sapiens
atcttgaagtgatgttgttta

SEQ ID NO: 3763933 - DNA, 17 bp, Homo sapiens
atcttgaccaagcagga

SEQ ID NO: 3763934 - DNA, 22 bp, Homo sapiens
atcttgaccaagcaggaagctc

SEQ ID NO: 3763935 - DNA, 17 bp, Homo sapiens
atcttgccggtcatttt

SEQ ID NO: 3763936 - DNA, 16 bp, Homo sapiens
atcttgctctgctgac

SEQ ID NO: 3763937 - DNA, 21 bp, Homo sapiens
atcttggactgacatttagcg

SEQ ID NO: 3763938 - DNA, 18 bp, Homo sapiens
atcttggtgtgttaagag

SEQ ID NO: 3763939 - DNA, 19 bp, Homo sapiens
atcttggtgtgttaagagt

SEQ ID NO: 3763940 - DNA, 14 bp, Homo sapiens
atcttgtccccaac

SEQ ID NO: 3763941 - DNA, 17 bp, Homo sapiens
atcttgtccccaacacc

SEQ ID NO: 3763942 - DNA, 14 bp, Homo sapiens
atcttgtttccaaa

SEQ ID NO: 3763943 - DNA, 16 bp, Homo sapiens
atcttgtttctgaaaa

SEQ ID NO: 3763944 - DNA, 12 bp, Homo sapiens
atctttcaggaa

SEQ ID NO: 3763945 - DNA, 11 bp, Homo sapiens
atctttcttct

SEQ ID NO: 3763946 - DNA, 22 bp, Homo sapiens
atctttgccttgggctgctcct

SEQ ID NO: 3763947 - DNA, 13 bp, Homo sapiens
atcttttctacag

SEQ ID NO: 3763948 - DNA, 22 bp, Homo sapiens
atcttttctacagcaaatttat

SEQ ID NO: 3763949 - DNA, 11 bp, Homo sapiens
atcttttgaac

SEQ ID NO: 3763950 - DNA, 18 bp, Homo sapiens
atgaaaaatttaagcatt

SEQ ID NO: 3763951 - DNA, 20 bp, Homo sapiens
atgaaaaatttaagcattgt

SEQ ID NO: 3763952 - DNA, 15 bp, Homo sapiens
atgaaaatcctacca

SEQ ID NO: 3763953 - DNA, 17 bp, Homo sapiens
atgaaaatcctaccaac

SEQ ID NO: 3763954 - DNA, 13 bp, Homo sapiens
atgaaacagaaac

SEQ ID NO: 3763955 - DNA, 18 bp, Homo sapiens
atgaaacagaaacaaaaa

SEQ ID NO: 3763956 - DNA, 12 bp, Homo sapiens
atgaaagactgt

SEQ ID NO: 3763957 - DNA, 19 bp, Homo sapiens
atgaaagactgtacaaagt

SEQ ID NO: 3763958 - DNA, 19 bp, Homo sapiens
atgaaagatggctgtgcct

SEQ ID NO: 3763959 - DNA, 23 bp, Homo sapiens
atgaaagatggctgtgcctctgc

SEQ ID NO: 3763960 - DNA, 18 bp, Homo sapiens
atgaaagcatgtggcatg

SEQ ID NO: 3763961 - DNA, 15 bp, Homo sapiens
atgaaagggcccaga

SEQ ID NO: 3763962 - DNA, 22 bp, Homo sapiens
atgaaattgtctagcagagcag

SEQ ID NO: 3763963 - DNA, 17 bp, Homo sapiens
atgaaatttaatatagc

SEQ ID NO: 3763964 - DNA, 21 bp, Homo sapiens
atgaaatttaatatagctatt

SEQ ID NO: 3763965 - DNA, 16 bp, Homo sapiens
atgaaattttaccaag

SEQ ID NO: 3763966 - DNA, 20 bp, Homo sapiens
atgaaccacatcttgctctg

SEQ ID NO: 3763967 - DNA, 22 bp, Homo sapiens
atgaaccacatcttgctctgct

SEQ ID NO: 3763968 - DNA, 15 bp, Homo sapiens
atgaacggccttgct

SEQ ID NO: 3763969 - DNA, 16 bp, Homo sapiens
atgaacggtgagcatt

SEQ ID NO: 3763970 - DNA, 14 bp, Homo sapiens
atgaactcaacttt

SEQ ID NO: 3763971 - DNA, 16 bp, Homo sapiens
atgaactcttaatcaa

SEQ ID NO: 3763972 - DNA, 19 bp, Homo sapiens
atgaactggaggccaggaa

SEQ ID NO: 3763973 - DNA, 19 bp, Homo sapiens
atgaagaaaaaatacattt

SEQ ID NO: 3763974 - DNA, 20 bp, Homo sapiens
atgaagaaaaaatacatttt

SEQ ID NO: 3763975 - DNA, 21 bp, Homo sapiens
atgaagataccatcagcaaag

SEQ ID NO: 3763976 - DNA, 22 bp, Homo sapiens
atgaagatgtttcaaaaaatct

SEQ ID NO: 3763977 - DNA, 20 bp, Homo sapiens
atgaagattattttttatga

SEQ ID NO: 3763978 - DNA, 12 bp, Homo sapiens
atgaagcccaag

SEQ ID NO: 3763979 - DNA, 16 bp, Homo sapiens
atgaagcccaataaac

SEQ ID NO: 3763980 - DNA, 15 bp, Homo sapiens
atgaagctacctcaa

SEQ ID NO: 3763981 - DNA, 17 bp, Homo sapiens
atgaagggaaaggatat

SEQ ID NO: 3763982 - DNA, 19 bp, Homo sapiens
atgaagtaacttgtcttaa

SEQ ID NO: 3763983 - DNA, 21 bp, Homo sapiens
atgaagtaacttgtcttaaat

SEQ ID NO: 3763984 - DNA, 23 bp, Homo sapiens
atgaagtgtgtttccttcagtgc

SEQ ID NO: 3763985 - DNA, 15 bp, Homo sapiens
atgaagttgtaggta

SEQ ID NO: 3763986 - DNA, 15 bp, Homo sapiens
atgaagtttatacag

SEQ ID NO: 3763987 - DNA, 16 bp, Homo sapiens
atgaagtttatacagt

SEQ ID NO: 3763988 - DNA, 17 bp, Homo sapiens
atgaataaagacaccta

SEQ ID NO: 3763989 - DNA, 20 bp, Homo sapiens
atgaatgaggtcccaggcag

SEQ ID NO: 3763990 - DNA, 15 bp, Homo sapiens
atgaatgtatcagga

SEQ ID NO: 3763991 - DNA, 22 bp, Homo sapiens
atgaatgtttacactctttgta

SEQ ID NO: 3763992 - DNA, 18 bp, Homo sapiens
atgaattttcaagtaatt

SEQ ID NO: 3763993 - DNA, 23 bp, Homo sapiens
atgaattttgtttggacttcttt

SEQ ID NO: 3763994 - DNA, 21 bp, Homo sapiens
atgaatttttttcatcttctc

SEQ ID NO: 3763995 - DNA, 22 bp, Homo sapiens
atgaatttttttcatcttctct

SEQ ID NO: 3763996 - DNA, 23 bp, Homo sapiens
atgaatttttttcatcttctctg

SEQ ID NO: 3763997 - DNA, 16 bp, Homo sapiens
atgacaacttctaatt

SEQ ID NO: 3763998 - DNA, 18 bp, Homo sapiens
atgacaagccccaggcag

SEQ ID NO: 3763999 - DNA, 14 bp, Homo sapiens
atgacaatgatgat

SEQ ID NO: 3764000 - DNA, 16 bp, Homo sapiens
atgacagatgttgaat

SEQ ID NO: 3764001 - DNA, 15 bp, Homo sapiens
atgacagctgtccct

SEQ ID NO: 3764002 - DNA, 17 bp, Homo sapiens
atgacaggatgtttgct

SEQ ID NO: 3764003 - DNA, 22 bp, Homo sapiens
atgacagttatactgtcggttt

SEQ ID NO: 3764004 - DNA, 18 bp, Homo sapiens
atgacatcacttgtacaa

SEQ ID NO: 3764005 - DNA, 24 bp, Homo sapiens
atgacatcttcaaagcttgaagat

SEQ ID NO: 3764006 - DNA, 12 bp, Homo sapiens
atgacccaggct

SEQ ID NO: 3764007 - DNA, 16 bp, Homo sapiens
atgacgacaaagctgc

SEQ ID NO: 3764008 - DNA, 19 bp, Homo sapiens
atgacgacgacaacgatga

SEQ ID NO: 3764009 - DNA, 16 bp, Homo sapiens
atgactaaaaatatta

SEQ ID NO: 3764010 - DNA, 23 bp, Homo sapiens
atgactaaaaatattataactta

SEQ ID NO: 3764011 - DNA, 15 bp, Homo sapiens
atgactaaagagaga

SEQ ID NO: 3764012 - DNA, 17 bp, Homo sapiens
atgactaaagagagaat

SEQ ID NO: 3764013 - DNA, 19 bp, Homo sapiens
atgactaaagagagaatgt

SEQ ID NO: 3764014 - DNA, 22 bp, Homo sapiens
atgactagaggcagggagggga

SEQ ID NO: 3764015 - DNA, 13 bp, Homo sapiens
atgactgcatttt

SEQ ID NO: 3764016 - DNA, 17 bp, Homo sapiens
atgactggaatttttat

SEQ ID NO: 3764017 - DNA, 13 bp, Homo sapiens
atgagaacagact

SEQ ID NO: 3764018 - DNA, 21 bp, Homo sapiens
atgagaacatgttggtattta

SEQ ID NO: 3764019 - DNA, 14 bp, Homo sapiens
atgagaactctgag

SEQ ID NO: 3764020 - DNA, 16 bp, Homo sapiens
atgagactgaactgtg

SEQ ID NO: 3764021 - DNA, 15 bp, Homo sapiens
atgagatagaagatg

SEQ ID NO: 3764022 - DNA, 19 bp, Homo sapiens
atgagatcccgcctcttct

SEQ ID NO: 3764023 - DNA, 15 bp, Homo sapiens
atgagcctcagcatc

SEQ ID NO: 3764024 - DNA, 12 bp, Homo sapiens
atgagcctggca

SEQ ID NO: 3764025 - DNA, 13 bp, Homo sapiens
atgagcctggcaa

SEQ ID NO: 3764026 - DNA, 16 bp, Homo sapiens
atgagctcatgtagca

SEQ ID NO: 3764027 - DNA, 16 bp, Homo sapiens
atgagctccagacccc

SEQ ID NO: 3764028 - DNA, 14 bp, Homo sapiens
atgagctcctcttc

SEQ ID NO: 3764029 - DNA, 22 bp, Homo sapiens
atgagctcctcttcctggcttc

SEQ ID NO: 3764030 - DNA, 22 bp, Homo sapiens
atgagctcgcatttgtcaatga

SEQ ID NO: 3764031 - DNA, 20 bp, Homo sapiens
atgagctttatgtaataatg

SEQ ID NO: 3764032 - DNA, 14 bp, Homo sapiens
atgaggaggaagga

SEQ ID NO: 3764033 - DNA, 20 bp, Homo sapiens
atgaggatgcagagtcagca

SEQ ID NO: 3764034 - DNA, 14 bp, Homo sapiens
attccccattcttc

SEQ ID NO: 3764035 - DNA, 21 bp, Homo sapiens
attcccctatctctagaattt

SEQ ID NO: 3764036 - DNA, 21 bp, Homo sapiens
attccctatcttttagtttta

SEQ ID NO: 3764037 - DNA, 14 bp, Homo sapiens
attccgtttacatt

SEQ ID NO: 3764038 - DNA, 13 bp, Homo sapiens
attcctctgccag

SEQ ID NO: 3764039 - DNA, 12 bp, Homo sapiens
attcctctggga

SEQ ID NO: 3764040 - DNA, 22 bp, Homo sapiens
attcctctgggaatgttacatt

SEQ ID NO: 3764041 - DNA, 19 bp, Homo sapiens
attcctgaatgaaatatca

SEQ ID NO: 3764042 - DNA, 14 bp, Homo sapiens
attcctgcagcctg

SEQ ID NO: 3764043 - DNA, 17 bp, Homo sapiens
attcctgcagcctggag

SEQ ID NO: 3764044 - DNA, 10 bp, Homo sapiens
attcctgggc

SEQ ID NO: 3764045 - DNA, 20 bp, Homo sapiens
attccttagcttagacctca

SEQ ID NO: 3764046 - DNA, 21 bp, Homo sapiens
attccttagcttagacctcag

SEQ ID NO: 3764047 - DNA, 22 bp, Homo sapiens
attccttagcttagacctcagc

SEQ ID NO: 3764048 - DNA, 23 bp, Homo sapiens
attccttagcttagacctcagcc

SEQ ID NO: 3764049 - DNA, 12 bp, Homo sapiens
attccttgtgaa

SEQ ID NO: 3764050 - DNA, 11 bp, Homo sapiens
attcctttccc

SEQ ID NO: 3764051 - DNA, 14 bp, Homo sapiens
attcctttcccttt

SEQ ID NO: 3764052 - DNA, 15 bp, Homo sapiens
attcctttcccttta

SEQ ID NO: 3764053 - DNA, 15 bp, Homo sapiens
attccttttcttgtt

SEQ ID NO: 3764054 - DNA, 18 bp, Homo sapiens
attccttttgtgtacagt

SEQ ID NO: 3764055 - DNA, 21 bp, Homo sapiens
attcgtgcagcatatgaggat

SEQ ID NO: 3764056 - DNA, 21 bp, Homo sapiens
attctaaataaaatataattg

SEQ ID NO: 3764057 - DNA, 17 bp, Homo sapiens
attctaaccagagcaag

SEQ ID NO: 3764058 - DNA, 13 bp, Homo sapiens
attctactttgag

SEQ ID NO: 3764059 - DNA, 21 bp, Homo sapiens
attctcaagccgcatcccaga

SEQ ID NO: 3764060 - DNA, 14 bp, Homo sapiens
attctcagaatctc

SEQ ID NO: 3764061 - DNA, 18 bp, Homo sapiens
attctcagaatctcaaat

SEQ ID NO: 3764062 - DNA, 20 bp, Homo sapiens
attctcagaatctcaaataa

SEQ ID NO: 3764063 - DNA, 16 bp, Homo sapiens
attctcagatatttat

SEQ ID NO: 3764064 - DNA, 11 bp, Homo sapiens
attctcctgcc

SEQ ID NO: 3764065 - DNA, 15 bp, Homo sapiens
attctctctcctgta

SEQ ID NO: 3764066 - DNA, 14 bp, Homo sapiens
attctcttatccaa

SEQ ID NO: 3764067 - DNA, 15 bp, Homo sapiens
attctcttatccaac

SEQ ID NO: 3764068 - DNA, 17 bp, Homo sapiens
attctcttggctggctt

SEQ ID NO: 3764069 - DNA, 12 bp, Homo sapiens
attctctttggt

SEQ ID NO: 3764070 - DNA, 14 bp, Homo sapiens
attctgccaggccc

SEQ ID NO: 3764071 - DNA, 23 bp, Homo sapiens
attctgccaggcccccaagcctg

SEQ ID NO: 3764072 - DNA, 19 bp, Homo sapiens
attctgcctgcccaggccc

SEQ ID NO: 3764073 - DNA, 20 bp, Homo sapiens
attctgcctgcccaggcccc

SEQ ID NO: 3764074 - DNA, 18 bp, Homo sapiens
attctgctcacatatctg

SEQ ID NO: 3764075 - DNA, 19 bp, Homo sapiens
attctgctcacatatctgt

SEQ ID NO: 3764076 - DNA, 22 bp, Homo sapiens
attctgctcacatatctgtcat

SEQ ID NO: 3764077 - DNA, 18 bp, Homo sapiens
attctggctgataaaaga

SEQ ID NO: 3764078 - DNA, 14 bp, Homo sapiens
attctgtaaaatgt

SEQ ID NO: 3764079 - DNA, 17 bp, Homo sapiens
attctgtgtgttttcat

SEQ ID NO: 3764080 - DNA, 22 bp, Homo sapiens
attctgtgtgttttcataataa

SEQ ID NO: 3764081 - DNA, 20 bp, Homo sapiens
attcttaaaatatatttcag

SEQ ID NO: 3764082 - DNA, 16 bp, Homo sapiens
attcttacaaacatgt

SEQ ID NO: 3764083 - DNA, 17 bp, Homo sapiens
attcttacaaacatgtg

SEQ ID NO: 3764084 - DNA, 21 bp, Homo sapiens
attcttacaaacatgtggtta

SEQ ID NO: 3764085 - DNA, 15 bp, Homo sapiens
attcttacatgtttt

SEQ ID NO: 3764086 - DNA, 14 bp, Homo sapiens
attcttctgcttca

SEQ ID NO: 3764087 - DNA, 20 bp, Homo sapiens
attcttctgcttcagcctcc

SEQ ID NO: 3764088 - DNA, 13 bp, Homo sapiens
attcttgagttta

SEQ ID NO: 3764089 - DNA, 19 bp, Homo sapiens
attcttgtgaatatgtaca

SEQ ID NO: 3764090 - DNA, 15 bp, Homo sapiens
attctttaatagaag

SEQ ID NO: 3764091 - DNA, 19 bp, Homo sapiens
attctttcaataacgaagt

SEQ ID NO: 3764092 - DNA, 19 bp, Homo sapiens
attctttgcttgaacacag

SEQ ID NO: 3764093 - DNA, 19 bp, Homo sapiens
attctttgggcgttggtca

SEQ ID NO: 3764094 - DNA, 14 bp, Homo sapiens
attgaaaaaaattg

SEQ ID NO: 3764095 - DNA, 22 bp, Homo sapiens
attgaaaaaaattggcattaaa

SEQ ID NO: 3764096 - DNA, 14 bp, Homo sapiens
attgaaaaggaaga

SEQ ID NO: 3764097 - DNA, 18 bp, Homo sapiens
attgaaagagaaccagtt

SEQ ID NO: 3764098 - DNA, 22 bp, Homo sapiens
attgaacaagttgtttcattga

SEQ ID NO: 3764099 - DNA, 15 bp, Homo sapiens
attgaacccaggagg

SEQ ID NO: 3764100 - DNA, 19 bp, Homo sapiens
attgaacttaaataaatgt

SEQ ID NO: 3764101 - DNA, 15 bp, Homo sapiens
attgaagtaatgaat

SEQ ID NO: 3764102 - DNA, 19 bp, Homo sapiens
attgaataaagttgaagct

SEQ ID NO: 3764103 - DNA, 13 bp, Homo sapiens
attgaattttcaa

SEQ ID NO: 3764104 - DNA, 20 bp, Homo sapiens
attgacaataatttcaggtt

SEQ ID NO: 3764105 - DNA, 20 bp, Homo sapiens
attgacagtaacttggttat

SEQ ID NO: 3764106 - DNA, 14 bp, Homo sapiens
attgaccaagaact

SEQ ID NO: 3764107 - DNA, 17 bp, Homo sapiens
attgaccaagaactgca

SEQ ID NO: 3764108 - DNA, 18 bp, Homo sapiens
attgactatcaaactgaa

SEQ ID NO: 3764109 - DNA, 18 bp, Homo sapiens
attgagaactgcatatgt

SEQ ID NO: 3764110 - DNA, 13 bp, Homo sapiens
attgagaatttta

SEQ ID NO: 3764111 - DNA, 18 bp, Homo sapiens
attgagacaaaaattatc

SEQ ID NO: 3764112 - DNA, 13 bp, Homo sapiens
attgataataaac

SEQ ID NO: 3764113 - DNA, 14 bp, Homo sapiens
attgatatgaaaaa

SEQ ID NO: 3764114 - DNA, 17 bp, Homo sapiens
attgatatgaaaaatat

SEQ ID NO: 3764115 - DNA, 17 bp, Homo sapiens
attgatatgcttataca

SEQ ID NO: 3764116 - DNA, 18 bp, Homo sapiens
attgatcattttcccccc

SEQ ID NO: 3764117 - DNA, 13 bp, Homo sapiens
attgatggggaag

SEQ ID NO: 3764118 - DNA, 16 bp, Homo sapiens
attgatggggaaggag

SEQ ID NO: 3764119 - DNA, 18 bp, Homo sapiens
attgatgtgcaaaaattt

SEQ ID NO: 3764120 - DNA, 13 bp, Homo sapiens
attgatttcaaga

SEQ ID NO: 3764121 - DNA, 19 bp, Homo sapiens
attgcaacaggctgggctt

SEQ ID NO: 3764122 - DNA, 17 bp, Homo sapiens
attgcaattttaacaca

SEQ ID NO: 3764123 - DNA, 16 bp, Homo sapiens
attgcatatatacata

SEQ ID NO: 3764124 - DNA, 16 bp, Homo sapiens
attgcatttcctgaca

SEQ ID NO: 3764125 - DNA, 17 bp, Homo sapiens
attgcatttcctgacag

SEQ ID NO: 3764126 - DNA, 21 bp, Homo sapiens
attgcattttttaaaacaaga

SEQ ID NO: 3764127 - DNA, 14 bp, Homo sapiens
attgccaccaggag

SEQ ID NO: 3764128 - DNA, 14 bp, Homo sapiens
attgccagtgacat

SEQ ID NO: 3764129 - DNA, 18 bp, Homo sapiens
attgccagtgtctttctt

SEQ ID NO: 3764130 - DNA, 17 bp, Homo sapiens
attgcccacgctggagt

SEQ ID NO: 3764131 - DNA, 21 bp, Homo sapiens
attgcccacgctggagtgcag

SEQ ID NO: 3764132 - DNA, 15 bp, Homo sapiens
attgctactgtccta

SEQ ID NO: 3764133 - DNA, 21 bp, Homo sapiens
attgctgctccttagctgcca

SEQ ID NO: 3764134 - DNA, 12 bp, Homo sapiens
attgctgcttga

SEQ ID NO: 3764135 - DNA, 15 bp, Homo sapiens
attgctggtcttgta

SEQ ID NO: 3764136 - DNA, 16 bp, Homo sapiens
attgctggtcttgtaa

SEQ ID NO: 3764137 - DNA, 18 bp, Homo sapiens
attgctggtcttgtaaga

SEQ ID NO: 3764138 - DNA, 21 bp, Homo sapiens
attgctgtgtccaactccagt

SEQ ID NO: 3764139 - DNA, 22 bp, Homo sapiens
attgctgtgtccaactccagta

SEQ ID NO: 3764140 - DNA, 16 bp, Homo sapiens
attgcttgaaagaaaa

SEQ ID NO: 3764141 - DNA, 17 bp, Homo sapiens
attgcttgagcccagga

SEQ ID NO: 3764142 - DNA, 15 bp, Homo sapiens
attgcttgatacttt

SEQ ID NO: 3764143 - DNA, 14 bp, Homo sapiens
attgcttgcacaaa

SEQ ID NO: 3764144 - DNA, 17 bp, Homo sapiens
attgctttctgaaatta

SEQ ID NO: 3764145 - DNA, 15 bp, Homo sapiens
attgctttgaaacta

SEQ ID NO: 3764146 - DNA, 16 bp, Homo sapiens
attggaattaacctgg

SEQ ID NO: 3764147 - DNA, 19 bp, Homo sapiens
attggaattaacctggtgc

SEQ ID NO: 3764148 - DNA, 21 bp, Homo sapiens
caacctctctgatcttgtgct

SEQ ID NO: 3764149 - DNA, 23 bp, Homo sapiens
caacctgaccaacatggagaaac

SEQ ID NO: 3764150 - DNA, 21 bp, Homo sapiens
caacctgctctcctcttgcca

SEQ ID NO: 3764151 - DNA, 21 bp, Homo sapiens
caacctgtaaattattttaaa

SEQ ID NO: 3764152 - DNA, 14 bp, Homo sapiens
caaccttacttaca

SEQ ID NO: 3764153 - DNA, 16 bp, Homo sapiens
caaccttctgtggctc

SEQ ID NO: 3764154 - DNA, 20 bp, Homo sapiens
caaccttctgtggctcacag

SEQ ID NO: 3764155 - DNA, 13 bp, Homo sapiens
caacgaaaagcac

SEQ ID NO: 3764156 - DNA, 20 bp, Homo sapiens
caacgaagaaaaaaaataac

SEQ ID NO: 3764157 - DNA, 17 bp, Homo sapiens
caacgtggcccagagaa

SEQ ID NO: 3764158 - DNA, 20 bp, Homo sapiens
caacgtggcccagagaagcc

SEQ ID NO: 3764159 - DNA, 18 bp, Homo sapiens
caacgtggggcagcacag

SEQ ID NO: 3764160 - DNA, 19 bp, Homo sapiens
caactatattatcatgcaa

SEQ ID NO: 3764161 - DNA, 19 bp, Homo sapiens
caactatgatttggaaaat

SEQ ID NO: 3764162 - DNA, 17 bp, Homo sapiens
caactccagtactggag

SEQ ID NO: 3764163 - DNA, 20 bp, Homo sapiens
caactccagtactggagctt

SEQ ID NO: 3764164 - DNA, 14 bp, Homo sapiens
caactcctggaagc

SEQ ID NO: 3764165 - DNA, 17 bp, Homo sapiens
caactcctggaagctgt

SEQ ID NO: 3764166 - DNA, 14 bp, Homo sapiens
caactgaaaagact

SEQ ID NO: 3764167 - DNA, 15 bp, Homo sapiens
caactgaaagtgttt

SEQ ID NO: 3764168 - DNA, 19 bp, Homo sapiens
caactgaaagtgtttcctt

SEQ ID NO: 3764169 - DNA, 15 bp, Homo sapiens
caactgaacaaaaaa

SEQ ID NO: 3764170 - DNA, 17 bp, Homo sapiens
caactgaacaaaaaaat

SEQ ID NO: 3764171 - DNA, 14 bp, Homo sapiens
caactgaggcagac

SEQ ID NO: 3764172 - DNA, 17 bp, Homo sapiens
caactgctgatgctcat

SEQ ID NO: 3764173 - DNA, 21 bp, Homo sapiens
caactggccctcttcttactt

SEQ ID NO: 3764174 - DNA, 13 bp, Homo sapiens
caactgggcccaa

SEQ ID NO: 3764175 - DNA, 16 bp, Homo sapiens
caacttcaagtgcatg

SEQ ID NO: 3764176 - DNA, 22 bp, Homo sapiens
caacttcaagtgcatgctctct

SEQ ID NO: 3764177 - DNA, 23 bp, Homo sapiens
caacttcccagttcaggagtccc

SEQ ID NO: 3764178 - DNA, 20 bp, Homo sapiens
caacttctttttattttctt

SEQ ID NO: 3764179 - DNA, 18 bp, Homo sapiens
caacttgagcatgttact

SEQ ID NO: 3764180 - DNA, 17 bp, Homo sapiens
caacttgtctttttctg

SEQ ID NO: 3764181 - DNA, 22 bp, Homo sapiens
caacttgtctttttctggactg

SEQ ID NO: 3764182 - DNA, 15 bp, Homo sapiens
caagaaagccagtct

SEQ ID NO: 3764183 - DNA, 13 bp, Homo sapiens
caagaaagtttcc

SEQ ID NO: 3764184 - DNA, 21 bp, Homo sapiens
caagaactgaaaacataaaaa

SEQ ID NO: 3764185 - DNA, 23 bp, Homo sapiens
caagaactgcatggacctaacat

SEQ ID NO: 3764186 - DNA, 12 bp, Homo sapiens
caagaaggctgg

SEQ ID NO: 3764187 - DNA, 19 bp, Homo sapiens
caagaagtcaaagtaaaac

SEQ ID NO: 3764188 - DNA, 18 bp, Homo sapiens
caagaatagatgctgact

SEQ ID NO: 3764189 - DNA, 18 bp, Homo sapiens
caagaatcagtgcaaaga

SEQ ID NO: 3764190 - DNA, 22 bp, Homo sapiens
caagaatttcttggtaagaagc

SEQ ID NO: 3764191 - DNA, 22 bp, Homo sapiens
caagaatttgatcgttccagtt

SEQ ID NO: 3764192 - DNA, 22 bp, Homo sapiens
caagacagatgccccagagctg

SEQ ID NO: 3764193 - DNA, 14 bp, Homo sapiens
caagacattgtcaa

SEQ ID NO: 3764194 - DNA, 14 bp, Homo sapiens
caagaccagcctgg

SEQ ID NO: 3764195 - DNA, 14 bp, Homo sapiens
caagaccctgtctc

SEQ ID NO: 3764196 - DNA, 21 bp, Homo sapiens
caagacccttttgggtttctg

SEQ ID NO: 3764197 - DNA, 18 bp, Homo sapiens
caagactctttggacact

SEQ ID NO: 3764198 - DNA, 21 bp, Homo sapiens
caagacttggtgtcctttccc

SEQ ID NO: 3764199 - DNA, 19 bp, Homo sapiens
caagagaaggggaagcact

SEQ ID NO: 3764200 - DNA, 14 bp, Homo sapiens
caagagagaaagaa

SEQ ID NO: 3764201 - DNA, 13 bp, Homo sapiens
caagagagatgtt

SEQ ID NO: 3764202 - DNA, 16 bp, Homo sapiens
caagagcagaggcagc

SEQ ID NO: 3764203 - DNA, 21 bp, Homo sapiens
caagagcagcctgtggcatct

SEQ ID NO: 3764204 - DNA, 19 bp, Homo sapiens
caagagcccagcagggcct

SEQ ID NO: 3764205 - DNA, 21 bp, Homo sapiens
caagagccttggtgtccacct

SEQ ID NO: 3764206 - DNA, 12 bp, Homo sapiens
caagagctgagg

SEQ ID NO: 3764207 - DNA, 15 bp, Homo sapiens
caagaggctgaggca

SEQ ID NO: 3764208 - DNA, 19 bp, Homo sapiens
caagagggcactggtggcc

SEQ ID NO: 3764209 - DNA, 12 bp, Homo sapiens
caagagggtctg

SEQ ID NO: 3764210 - DNA, 14 bp, Homo sapiens
caagataaaggaca

SEQ ID NO: 3764211 - DNA, 18 bp, Homo sapiens
caagataaaggacagtga

SEQ ID NO: 3764212 - DNA, 12 bp, Homo sapiens
caagatctttca

SEQ ID NO: 3764213 - DNA, 19 bp, Homo sapiens
caagatgagagaactggag

SEQ ID NO: 3764214 - DNA, 16 bp, Homo sapiens
caagatgtcagactgg

SEQ ID NO: 3764215 - DNA, 17 bp, Homo sapiens
caagatgtcagactggc

SEQ ID NO: 3764216 - DNA, 15 bp, Homo sapiens
caagattcccagaga

SEQ ID NO: 3764217 - DNA, 21 bp, Homo sapiens
caagattgcttaaaatagcaa

SEQ ID NO: 3764218 - DNA, 12 bp, Homo sapiens
caagatttcaga

SEQ ID NO: 3764219 - DNA, 18 bp, Homo sapiens
caagattttccacaagat

SEQ ID NO: 3764220 - DNA, 22 bp, Homo sapiens
caagattttgaatgcttcctga

SEQ ID NO: 3764221 - DNA, 14 bp, Homo sapiens
caagcaatcctcct

SEQ ID NO: 3764222 - DNA, 15 bp, Homo sapiens
caagcacctcctgcc

SEQ ID NO: 3764223 - DNA, 16 bp, Homo sapiens
caagcacctcctgcct

SEQ ID NO: 3764224 - DNA, 17 bp, Homo sapiens
caagcacctcctgcctc

SEQ ID NO: 3764225 - DNA, 18 bp, Homo sapiens
caagcacctcctgcctcg

SEQ ID NO: 3764226 - DNA, 13 bp, Homo sapiens
caagcaggaagct

SEQ ID NO: 3764227 - DNA, 13 bp, Homo sapiens
caagcatctcctg

SEQ ID NO: 3764228 - DNA, 18 bp, Homo sapiens
caagcatctcctgaggat

SEQ ID NO: 3764229 - DNA, 13 bp, Homo sapiens
caagccaagcagc

SEQ ID NO: 3764230 - DNA, 23 bp, Homo sapiens
caagccagggatggggccacagc

SEQ ID NO: 3764231 - DNA, 18 bp, Homo sapiens
caagccccaggcaggctg

SEQ ID NO: 3764232 - DNA, 14 bp, Homo sapiens
caagccctgagagt

SEQ ID NO: 3764233 - DNA, 17 bp, Homo sapiens
caagccgtggcttcccg

SEQ ID NO: 3764234 - DNA, 21 bp, Homo sapiens
caagcctgtaatcccagctac

SEQ ID NO: 3764235 - DNA, 20 bp, Homo sapiens
caagcgaggtcaacagagaa

SEQ ID NO: 3764236 - DNA, 15 bp, Homo sapiens
caagcgattcttctg

SEQ ID NO: 3764237 - DNA, 17 bp, Homo sapiens
caagcgattcttctgct

SEQ ID NO: 3764238 - DNA, 18 bp, Homo sapiens
caagcgattcttctgctt

SEQ ID NO: 3764239 - DNA, 22 bp, Homo sapiens
caagcgattcttctgcttcagc

SEQ ID NO: 3764240 - DNA, 16 bp, Homo sapiens
caagctaataaaatat

SEQ ID NO: 3764241 - DNA, 20 bp, Homo sapiens
caagctcacagttcctcgcc

SEQ ID NO: 3764242 - DNA, 22 bp, Homo sapiens
caagctcacagttcctcgccct

SEQ ID NO: 3764243 - DNA, 21 bp, Homo sapiens
caagctccatctccactccag

SEQ ID NO: 3764244 - DNA, 13 bp, Homo sapiens
caagctctgctcc

SEQ ID NO: 3764245 - DNA, 20 bp, Homo sapiens
caagctgcaccctcaggcag

SEQ ID NO: 3764246 - DNA, 22 bp, Homo sapiens
caagctgcaccctcaggcaggt

SEQ ID NO: 3764247 - DNA, 14 bp, Homo sapiens
caagctgctgtggc

SEQ ID NO: 3764248 - DNA, 23 bp, Homo sapiens
caagctggtcccactcagtccat

SEQ ID NO: 3764249 - DNA, 17 bp, Homo sapiens
caagcttgtccaacccg

SEQ ID NO: 3764250 - DNA, 13 bp, Homo sapiens
caagcttttttat

SEQ ID NO: 3764251 - DNA, 17 bp, Homo sapiens
caaggaatgcctgtgcc

SEQ ID NO: 3764252 - DNA, 21 bp, Homo sapiens
caaggaatgcctgtgccaata

SEQ ID NO: 3764253 - DNA, 11 bp, Homo sapiens
caaggacaaag

SEQ ID NO: 3764254 - DNA, 18 bp, Homo sapiens
caaggacaaagtctccag

SEQ ID NO: 3764255 - DNA, 19 bp, Homo sapiens
caaggacaaagtctccagc

SEQ ID NO: 3764256 - DNA, 21 bp, Homo sapiens
caaggaccaacaagggcagtg

SEQ ID NO: 3764257 - DNA, 14 bp, Homo sapiens
caaggaccaggact

SEQ ID NO: 3764258 - DNA, 20 bp, Homo sapiens
caaggaccaggactccctcc

SEQ ID NO: 3764259 - DNA, 17 bp, Homo sapiens
caaggacccctcacctt

SEQ ID NO: 3764260 - DNA, 20 bp, Homo sapiens
caaggacccctcaccttgca

SEQ ID NO: 3764261 - DNA, 16 bp, Homo sapiens
cacagaaaccaatttt

SEQ ID NO: 3764262 - DNA, 22 bp, Homo sapiens
cacagaaagactgagctcaagg

SEQ ID NO: 3764263 - DNA, 13 bp, Homo sapiens
cacagaaagagag

SEQ ID NO: 3764264 - DNA, 18 bp, Homo sapiens
cacagaaagagagcactg

SEQ ID NO: 3764265 - DNA, 16 bp, Homo sapiens
cacagacgtccctcca

SEQ ID NO: 3764266 - DNA, 20 bp, Homo sapiens
cacagagaaagtacttctcc

SEQ ID NO: 3764267 - DNA, 21 bp, Homo sapiens
cacagagaaagtacttctcca

SEQ ID NO: 3764268 - DNA, 14 bp, Homo sapiens
cacagagacacagg

SEQ ID NO: 3764269 - DNA, 22 bp, Homo sapiens
cacagagacccccggaacaagc

SEQ ID NO: 3764270 - DNA, 23 bp, Homo sapiens
cacagagacccccggaacaagcc

SEQ ID NO: 3764271 - DNA, 10 bp, Homo sapiens
cacagagaga

SEQ ID NO: 3764272 - DNA, 22 bp, Homo sapiens
cacagagagacagacttgagaa

SEQ ID NO: 3764273 - DNA, 19 bp, Homo sapiens
cacagagcgtccttccccc

SEQ ID NO: 3764274 - DNA, 13 bp, Homo sapiens
cacagaggaagag

SEQ ID NO: 3764275 - DNA, 15 bp, Homo sapiens
cacagaggaagagca

SEQ ID NO: 3764276 - DNA, 13 bp, Homo sapiens
cacagaggctgcc

SEQ ID NO: 3764277 - DNA, 18 bp, Homo sapiens
cacagagtggtctttctg

SEQ ID NO: 3764278 - DNA, 22 bp, Homo sapiens
cacagagtggtctttctggaga

SEQ ID NO: 3764279 - DNA, 14 bp, Homo sapiens
cacagatcacagct

SEQ ID NO: 3764280 - DNA, 11 bp, Homo sapiens
cacagatgcct

SEQ ID NO: 3764281 - DNA, 12 bp, Homo sapiens
cacagatggatt

SEQ ID NO: 3764282 - DNA, 18 bp, Homo sapiens
cacagcaattcctcaggc

SEQ ID NO: 3764283 - DNA, 15 bp, Homo sapiens
cacagcacactcagc

SEQ ID NO: 3764284 - DNA, 13 bp, Homo sapiens
cacagccagaacc

SEQ ID NO: 3764285 - DNA, 19 bp, Homo sapiens
cacagccagaaccccgagc

SEQ ID NO: 3764286 - DNA, 19 bp, Homo sapiens
cacagcccaaagaaggaaa

SEQ ID NO: 3764287 - DNA, 21 bp, Homo sapiens
cacagcccaggcctccagctc

SEQ ID NO: 3764288 - DNA, 18 bp, Homo sapiens
cacagcccgcatgcagca

SEQ ID NO: 3764289 - DNA, 21 bp, Homo sapiens
cacagcccgcatgcagcagct

SEQ ID NO: 3764290 - DNA, 23 bp, Homo sapiens
cacagcccgcatgcagcagcttg

SEQ ID NO: 3764291 - DNA, 14 bp, Homo sapiens
cacagccctgtcag

SEQ ID NO: 3764292 - DNA, 21 bp, Homo sapiens
cacagccctgtcagtgcagcc

SEQ ID NO: 3764293 - DNA, 14 bp, Homo sapiens
cacagccgcagcct

SEQ ID NO: 3764294 - DNA, 22 bp, Homo sapiens
cacagccgcagcctccctctga

SEQ ID NO: 3764295 - DNA, 15 bp, Homo sapiens
cacagctcccacccc

SEQ ID NO: 3764296 - DNA, 16 bp, Homo sapiens
cacagctcccacccca

SEQ ID NO: 3764297 - DNA, 22 bp, Homo sapiens
cacagctcccaccccaccccct

SEQ ID NO: 3764298 - DNA, 11 bp, Homo sapiens
cacagctctgt

SEQ ID NO: 3764299 - DNA, 14 bp, Homo sapiens
cacagctctgtcct

SEQ ID NO: 3764300 - DNA, 10 bp, Homo sapiens
cacagctctt

SEQ ID NO: 3764301 - DNA, 18 bp, Homo sapiens
cacagctcttctccaggc

SEQ ID NO: 3764302 - DNA, 21 bp, Homo sapiens
cacagctcttctccaggctgt

SEQ ID NO: 3764303 - DNA, 19 bp, Homo sapiens
cacagcttcagccaggagc

SEQ ID NO: 3764304 - DNA, 23 bp, Homo sapiens
cacagcttcccctctctcctcct

SEQ ID NO: 3764305 - DNA, 22 bp, Homo sapiens
cacaggaggagaaatctcactt

SEQ ID NO: 3764306 - DNA, 12 bp, Homo sapiens
cacaggatcagt

SEQ ID NO: 3764307 - DNA, 16 bp, Homo sapiens
cacaggatcagtctga

SEQ ID NO: 3764308 - DNA, 20 bp, Homo sapiens
cacaggatggtctctgccat

SEQ ID NO: 3764309 - DNA, 14 bp, Homo sapiens
cacaggcaactgag

SEQ ID NO: 3764310 - DNA, 18 bp, Homo sapiens
cacaggcaactgaggcag

SEQ ID NO: 3764311 - DNA, 19 bp, Homo sapiens
cacaggcaactgaggcaga

SEQ ID NO: 3764312 - DNA, 20 bp, Homo sapiens
cacaggcccggctccaggct

SEQ ID NO: 3764313 - DNA, 19 bp, Homo sapiens
cacaggcccttcctctcca

SEQ ID NO: 3764314 - DNA, 13 bp, Homo sapiens
cacagggcagagc

SEQ ID NO: 3764315 - DNA, 14 bp, Homo sapiens
cacagggcagagcc

SEQ ID NO: 3764316 - DNA, 13 bp, Homo sapiens
cacagggctaaga

SEQ ID NO: 3764317 - DNA, 14 bp, Homo sapiens
cacagggttgggcc

SEQ ID NO: 3764318 - DNA, 15 bp, Homo sapiens
cacaggtgtttatac

SEQ ID NO: 3764319 - DNA, 19 bp, Homo sapiens
cacaggttcatgccaccat

SEQ ID NO: 3764320 - DNA, 22 bp, Homo sapiens
cacagtgaaggctgtccttacc

SEQ ID NO: 3764321 - DNA, 19 bp, Homo sapiens
cacagtgggagccagggct

SEQ ID NO: 3764322 - DNA, 13 bp, Homo sapiens
cacagtgtgtttg

SEQ ID NO: 3764323 - DNA, 10 bp, Homo sapiens
cacagtgttt

SEQ ID NO: 3764324 - DNA, 19 bp, Homo sapiens
cacagtttcttccattccc

SEQ ID NO: 3764325 - DNA, 18 bp, Homo sapiens
cacataaaggataaactt

SEQ ID NO: 3764326 - DNA, 13 bp, Homo sapiens
cacataacagaat

SEQ ID NO: 3764327 - DNA, 21 bp, Homo sapiens
cacatagactttatgcaataa

SEQ ID NO: 3764328 - DNA, 22 bp, Homo sapiens
cacatagattcacctgtaaaac

SEQ ID NO: 3764329 - DNA, 18 bp, Homo sapiens
cacatagcatgtaatggt

SEQ ID NO: 3764330 - DNA, 12 bp, Homo sapiens
cacatatctgtc

SEQ ID NO: 3764331 - DNA, 18 bp, Homo sapiens
cacatccaggcaatggcc

SEQ ID NO: 3764332 - DNA, 16 bp, Homo sapiens
cacatccccgctggct

SEQ ID NO: 3764333 - DNA, 20 bp, Homo sapiens
cacatccggaggagaagaag

SEQ ID NO: 3764334 - DNA, 14 bp, Homo sapiens
cacatcctccgtcc

SEQ ID NO: 3764335 - DNA, 18 bp, Homo sapiens
cacatcctccgtccagcc

SEQ ID NO: 3764336 - DNA, 21 bp, Homo sapiens
cacatctgcattttcacccca

SEQ ID NO: 3764337 - DNA, 17 bp, Homo sapiens
cacatcttgctctgctg

SEQ ID NO: 3764338 - DNA, 18 bp, Homo sapiens
cacatcttgctctgctga

SEQ ID NO: 3764339 - DNA, 12 bp, Homo sapiens
cacatctttcac

SEQ ID NO: 3764340 - DNA, 14 bp, Homo sapiens
cacatgctggacag

SEQ ID NO: 3764341 - DNA, 19 bp, Homo sapiens
cacatgctggacaggtctg

SEQ ID NO: 3764342 - DNA, 11 bp, Homo sapiens
cacatgtgtgc

SEQ ID NO: 3764343 - DNA, 19 bp, Homo sapiens
cacattaatatttgctgac

SEQ ID NO: 3764344 - DNA, 22 bp, Homo sapiens
cacattatcgggagcagtgtct

SEQ ID NO: 3764345 - DNA, 16 bp, Homo sapiens
cacattcaataagcat

SEQ ID NO: 3764346 - DNA, 18 bp, Homo sapiens
cacatttccccagacctg

SEQ ID NO: 3764347 - DNA, 18 bp, Homo sapiens
cacatttttttttttaat

SEQ ID NO: 3764348 - DNA, 22 bp, Homo sapiens
cacatttttttttttaattttg

SEQ ID NO: 3764349 - DNA, 15 bp, Homo sapiens
caccaagaaagcagg

SEQ ID NO: 3764350 - DNA, 14 bp, Homo sapiens
caccaagcccacag

SEQ ID NO: 3764351 - DNA, 13 bp, Homo sapiens
caccaagcccagt

SEQ ID NO: 3764352 - DNA, 13 bp, Homo sapiens
caccacacccagc

SEQ ID NO: 3764353 - DNA, 17 bp, Homo sapiens
caccacacccagcccac

SEQ ID NO: 3764354 - DNA, 21 bp, Homo sapiens
caccacatcctccgtccagcc

SEQ ID NO: 3764355 - DNA, 15 bp, Homo sapiens
caccacatgtgcaca

SEQ ID NO: 3764356 - DNA, 15 bp, Homo sapiens
caccaccaggtctcc

SEQ ID NO: 3764357 - DNA, 11 bp, Homo sapiens
caccacccaaa

SEQ ID NO: 3764358 - DNA, 22 bp, Homo sapiens
caccacctaggccactcctcca

SEQ ID NO: 3764359 - DNA, 18 bp, Homo sapiens
caccaccttcccagctct

SEQ ID NO: 3764360 - DNA, 22 bp, Homo sapiens
caccaccttcccagctctccct

SEQ ID NO: 3764361 - DNA, 18 bp, Homo sapiens
caccacgatgtggccctg

SEQ ID NO: 3764362 - DNA, 22 bp, Homo sapiens
caccacgatgtggccctggcct

SEQ ID NO: 3764363 - DNA, 18 bp, Homo sapiens
caccagagcccaccttgg

SEQ ID NO: 3764364 - DNA, 15 bp, Homo sapiens
caccagcagcctgga

SEQ ID NO: 3764365 - DNA, 17 bp, Homo sapiens
caccagccccagtgccc

SEQ ID NO: 3764366 - DNA, 19 bp, Homo sapiens
caccagcccttagcaggga

SEQ ID NO: 3764367 - DNA, 20 bp, Homo sapiens
caccagcctttctcccaggc

SEQ ID NO: 3764368 - DNA, 12 bp, Homo sapiens
caccaggaatgt

SEQ ID NO: 3764369 - DNA, 23 bp, Homo sapiens
caccaggaatgttaaagtcagtg

SEQ ID NO: 3764370 - DNA, 16 bp, Homo sapiens
caccaggagaaccact

SEQ ID NO: 3764371 - DNA, 17 bp, Homo sapiens
caccaggagaaccacta

SEQ ID NO: 3764372 - DNA, 14 bp, Homo sapiens
caccaggagacaga

SEQ ID NO: 3764373 - DNA, 19 bp, Homo sapiens
caccaggcacgaacccacc

SEQ ID NO: 3764374 - DNA, 16 bp, Homo sapiens
cactccagacccctgg

SEQ ID NO: 3764375 - DNA, 12 bp, Homo sapiens
cactccagcctg

SEQ ID NO: 3764376 - DNA, 13 bp, Homo sapiens
cactccagcctga

SEQ ID NO: 3764377 - DNA, 14 bp, Homo sapiens
cactccagcctgag

SEQ ID NO: 3764378 - DNA, 21 bp, Homo sapiens
cactccagcctgggcgacaga

SEQ ID NO: 3764379 - DNA, 16 bp, Homo sapiens
cactccagcctgggtg

SEQ ID NO: 3764380 - DNA, 14 bp, Homo sapiens
cactccccaccttc

SEQ ID NO: 3764381 - DNA, 19 bp, Homo sapiens
cactcccttcccataagct

SEQ ID NO: 3764382 - DNA, 19 bp, Homo sapiens
cactccggtgtgcctgcag

SEQ ID NO: 3764383 - DNA, 20 bp, Homo sapiens
cactccggtgtgcctgcagc

SEQ ID NO: 3764384 - DNA, 13 bp, Homo sapiens
cactcctacctgg

SEQ ID NO: 3764385 - DNA, 14 bp, Homo sapiens
cactcctacctggt

SEQ ID NO: 3764386 - DNA, 18 bp, Homo sapiens
cactcctccctgatgtac

SEQ ID NO: 3764387 - DNA, 11 bp, Homo sapiens
cactcctgggg

SEQ ID NO: 3764388 - DNA, 13 bp, Homo sapiens
cactcctgtacac

SEQ ID NO: 3764389 - DNA, 17 bp, Homo sapiens
cactccttcctgccacc

SEQ ID NO: 3764390 - DNA, 18 bp, Homo sapiens
cactccttcctgccacct

SEQ ID NO: 3764391 - DNA, 18 bp, Homo sapiens
cactctcattccccaggt

SEQ ID NO: 3764392 - DNA, 14 bp, Homo sapiens
cactctccccacac

SEQ ID NO: 3764393 - DNA, 12 bp, Homo sapiens
cactctcctggg

SEQ ID NO: 3764394 - DNA, 15 bp, Homo sapiens
cactctcctgggccc

SEQ ID NO: 3764395 - DNA, 16 bp, Homo sapiens
cactctcctgggcccc

SEQ ID NO: 3764396 - DNA, 18 bp, Homo sapiens
cactctcctgggcccctc

SEQ ID NO: 3764397 - DNA, 19 bp, Homo sapiens
cactctgactggcacagtc

SEQ ID NO: 3764398 - DNA, 23 bp, Homo sapiens
cactctgagtttaccatttgtaa

SEQ ID NO: 3764399 - DNA, 16 bp, Homo sapiens
cactctgtcgcccagt

SEQ ID NO: 3764400 - DNA, 19 bp, Homo sapiens
cactctgtcgcccagtctg

SEQ ID NO: 3764401 - DNA, 20 bp, Homo sapiens
cactctgtcgcccagtctgg

SEQ ID NO: 3764402 - DNA, 22 bp, Homo sapiens
cactcttattgcccacgctgga

SEQ ID NO: 3764403 - DNA, 17 bp, Homo sapiens
cactgaagatagaagaa

SEQ ID NO: 3764404 - DNA, 13 bp, Homo sapiens
cactgaagctggg

SEQ ID NO: 3764405 - DNA, 21 bp, Homo sapiens
cactgaaggctttcagggcct

SEQ ID NO: 3764406 - DNA, 23 bp, Homo sapiens
cactgaattaatgacagagccag

SEQ ID NO: 3764407 - DNA, 19 bp, Homo sapiens
cactgacacaaaaagtaga

SEQ ID NO: 3764408 - DNA, 15 bp, Homo sapiens
cactgacagcctccc

SEQ ID NO: 3764409 - DNA, 16 bp, Homo sapiens
cactgacagcctccca

SEQ ID NO: 3764410 - DNA, 23 bp, Homo sapiens
cactgacattgttggccaaagcc

SEQ ID NO: 3764411 - DNA, 23 bp, Homo sapiens
cactgaccatccactctaccctc

SEQ ID NO: 3764412 - DNA, 14 bp, Homo sapiens
cactgacccacagc

SEQ ID NO: 3764413 - DNA, 19 bp, Homo sapiens
cactgacccacagcctctg

SEQ ID NO: 3764414 - DNA, 18 bp, Homo sapiens
cactgaggcagggaagtc

SEQ ID NO: 3764415 - DNA, 19 bp, Homo sapiens
cactgatggaaacaaagtg

SEQ ID NO: 3764416 - DNA, 20 bp, Homo sapiens
cactgatggaaacaaagtgg

SEQ ID NO: 3764417 - DNA, 15 bp, Homo sapiens
cactgcaacaggaac

SEQ ID NO: 3764418 - DNA, 23 bp, Homo sapiens
cactgcaacctccgcctcttggg

SEQ ID NO: 3764419 - DNA, 15 bp, Homo sapiens
cactgcaagagcctt

SEQ ID NO: 3764420 - DNA, 18 bp, Homo sapiens
cactgcaagagccttggt

SEQ ID NO: 3764421 - DNA, 20 bp, Homo sapiens
cactgcaagagccttggtgt

SEQ ID NO: 3764422 - DNA, 22 bp, Homo sapiens
cactgcacagtgcatctcagcc

SEQ ID NO: 3764423 - DNA, 14 bp, Homo sapiens
cactgcaccgggcc

SEQ ID NO: 3764424 - DNA, 16 bp, Homo sapiens
cactgcaccgggccac

SEQ ID NO: 3764425 - DNA, 18 bp, Homo sapiens
cactgcactccagcctgg

SEQ ID NO: 3764426 - DNA, 20 bp, Homo sapiens
cactgcactccagcctgggt

SEQ ID NO: 3764427 - DNA, 13 bp, Homo sapiens
cactgcactctag

SEQ ID NO: 3764428 - DNA, 19 bp, Homo sapiens
cactgcagcctcaacctcc

SEQ ID NO: 3764429 - DNA, 20 bp, Homo sapiens
cactgcagcctcaacctcct

SEQ ID NO: 3764430 - DNA, 13 bp, Homo sapiens
cactgcagcctcg

SEQ ID NO: 3764431 - DNA, 13 bp, Homo sapiens
cactgcaggcccc

SEQ ID NO: 3764432 - DNA, 11 bp, Homo sapiens
cactgccacac

SEQ ID NO: 3764433 - DNA, 19 bp, Homo sapiens
cactgccatggaggcacac

SEQ ID NO: 3764434 - DNA, 17 bp, Homo sapiens
cactgccctctgttcag

SEQ ID NO: 3764435 - DNA, 15 bp, Homo sapiens
cactgcctctggaat

SEQ ID NO: 3764436 - DNA, 10 bp, Homo sapiens
cactgcctgc

SEQ ID NO: 3764437 - DNA, 14 bp, Homo sapiens
cactgcctgcccac

SEQ ID NO: 3764438 - DNA, 22 bp, Homo sapiens
cactgccttcgatacaccgggc

SEQ ID NO: 3764439 - DNA, 13 bp, Homo sapiens
cactgctggctgc

SEQ ID NO: 3764440 - DNA, 21 bp, Homo sapiens
cactgctggctgccttagaac

SEQ ID NO: 3764441 - DNA, 12 bp, Homo sapiens
cactggagccca

SEQ ID NO: 3764442 - DNA, 13 bp, Homo sapiens
cactggagcccag

SEQ ID NO: 3764443 - DNA, 14 bp, Homo sapiens
cactggagcccagg

SEQ ID NO: 3764444 - DNA, 23 bp, Homo sapiens
cactggatgcaaagaaaatcaga

SEQ ID NO: 3764445 - DNA, 15 bp, Homo sapiens
cactggatgcagaaa

SEQ ID NO: 3764446 - DNA, 16 bp, Homo sapiens
cactggcaatgaaaaa

SEQ ID NO: 3764447 - DNA, 17 bp, Homo sapiens
cactggcagccccagca

SEQ ID NO: 3764448 - DNA, 19 bp, Homo sapiens
cactggcagccccagcacc

SEQ ID NO: 3764449 - DNA, 18 bp, Homo sapiens
cactggctgtgggctccc

SEQ ID NO: 3764450 - DNA, 13 bp, Homo sapiens
cactgggcttcta

SEQ ID NO: 3764451 - DNA, 14 bp, Homo sapiens
cactgggggagggg

SEQ ID NO: 3764452 - DNA, 18 bp, Homo sapiens
cactgggtggggtgagga

SEQ ID NO: 3764453 - DNA, 21 bp, Homo sapiens
cactgggtggggtgaggacca

SEQ ID NO: 3764454 - DNA, 17 bp, Homo sapiens
cactgtaaaatgaaatt

SEQ ID NO: 3764455 - DNA, 18 bp, Homo sapiens
cactgtaaaatgaaatta

SEQ ID NO: 3764456 - DNA, 21 bp, Homo sapiens
cactgtagcattacagtgggt

SEQ ID NO: 3764457 - DNA, 22 bp, Homo sapiens
cactgtataccccgtgaagcat

SEQ ID NO: 3764458 - DNA, 18 bp, Homo sapiens
cactgtcactgtttctct

SEQ ID NO: 3764459 - DNA, 14 bp, Homo sapiens
cactgtcttgaaga

SEQ ID NO: 3764460 - DNA, 13 bp, Homo sapiens
cactgtgaagaga

SEQ ID NO: 3764461 - DNA, 15 bp, Homo sapiens
cactgtgccatgtgc

SEQ ID NO: 3764462 - DNA, 14 bp, Homo sapiens
cactgttagaacac

SEQ ID NO: 3764463 - DNA, 21 bp, Homo sapiens
cactgttagaacactattttc

SEQ ID NO: 3764464 - DNA, 23 bp, Homo sapiens
cactgttagaacactattttcag

SEQ ID NO: 3764465 - DNA, 19 bp, Homo sapiens
cactgttctgaaagtgact

SEQ ID NO: 3764466 - DNA, 14 bp, Homo sapiens
cactgttgcccagg

SEQ ID NO: 3764467 - DNA, 15 bp, Homo sapiens
cactgttgcccaggc

SEQ ID NO: 3764468 - DNA, 16 bp, Homo sapiens
cactgttgcccaggct

SEQ ID NO: 3764469 - DNA, 17 bp, Homo sapiens
cactgtttacaagaaaa

SEQ ID NO: 3764470 - DNA, 14 bp, Homo sapiens
cactgtttctctgc

SEQ ID NO: 3764471 - DNA, 14 bp, Homo sapiens
cacttaaaaaatgt

SEQ ID NO: 3764472 - DNA, 13 bp, Homo sapiens
cacttaacagatg

SEQ ID NO: 3764473 - DNA, 16 bp, Homo sapiens
cacttacactttatgc

SEQ ID NO: 3764474 - DNA, 21 bp, Homo sapiens
cacttacagataggccttctt

SEQ ID NO: 3764475 - DNA, 23 bp, Homo sapiens
cacttacagataggccttcttgt

SEQ ID NO: 3764476 - DNA, 15 bp, Homo sapiens
cacttaccttcaata

SEQ ID NO: 3764477 - DNA, 22 bp, Homo sapiens
cacttaccttcaataaagtatc

SEQ ID NO: 3764478 - DNA, 17 bp, Homo sapiens
cacttagaaattgcatt

SEQ ID NO: 3764479 - DNA, 24 bp, Homo sapiens
cacttagaaattgcatttcctgac

SEQ ID NO: 3764480 - DNA, 14 bp, Homo sapiens
cacttcaccctgga

SEQ ID NO: 3764481 - DNA, 22 bp, Homo sapiens
cacttcagggttctcctctccc

SEQ ID NO: 3764482 - DNA, 20 bp, Homo sapiens
cacttccaccagcctgcact

SEQ ID NO: 3764483 - DNA, 17 bp, Homo sapiens
cacttcctacaagagca

SEQ ID NO: 3764484 - DNA, 12 bp, Homo sapiens
cacttcctgtcc

SEQ ID NO: 3764485 - DNA, 18 bp, Homo sapiens
cacttcctgtccagagag

SEQ ID NO: 3764486 - DNA, 18 bp, Homo sapiens
cacttctaaatgaagtgc

SEQ ID NO: 3764487 - DNA, 14 bp, Homo sapiens
cagcccagcccagc

SEQ ID NO: 3764488 - DNA, 19 bp, Homo sapiens
cagcccagctgctctgccc

SEQ ID NO: 3764489 - DNA, 23 bp, Homo sapiens
cagcccagctgctctgcccagag

SEQ ID NO: 3764490 - DNA, 13 bp, Homo sapiens
cagcccaggcctc

SEQ ID NO: 3764491 - DNA, 20 bp, Homo sapiens
cagcccaggcctccagctca

SEQ ID NO: 3764492 - DNA, 17 bp, Homo sapiens
cagcccagggttccccc

SEQ ID NO: 3764493 - DNA, 15 bp, Homo sapiens
cagcccatgcccacc

SEQ ID NO: 3764494 - DNA, 16 bp, Homo sapiens
cagcccatgcccacct

SEQ ID NO: 3764495 - DNA, 18 bp, Homo sapiens
cagcccattctctctcct

SEQ ID NO: 3764496 - DNA, 21 bp, Homo sapiens
cagcccattctctctcctgtc

SEQ ID NO: 3764497 - DNA, 14 bp, Homo sapiens
cagccccacccagg

SEQ ID NO: 3764498 - DNA, 14 bp, Homo sapiens
cagccccagcccag

SEQ ID NO: 3764499 - DNA, 17 bp, Homo sapiens
cagccccagtgcccaca

SEQ ID NO: 3764500 - DNA, 18 bp, Homo sapiens
cagccccagtgcccacag

SEQ ID NO: 3764501 - DNA, 14 bp, Homo sapiens
cagccccattctgc

SEQ ID NO: 3764502 - DNA, 16 bp, Homo sapiens
cagccccattctgcct

SEQ ID NO: 3764503 - DNA, 18 bp, Homo sapiens
cagccccattctgcctgc

SEQ ID NO: 3764504 - DNA, 23 bp, Homo sapiens
cagccccattctgcctgcccagg

SEQ ID NO: 3764505 - DNA, 14 bp, Homo sapiens
cagcccctcccacc

SEQ ID NO: 3764506 - DNA, 12 bp, Homo sapiens
cagcccctcctc

SEQ ID NO: 3764507 - DNA, 15 bp, Homo sapiens
cagcccctcctctgc

SEQ ID NO: 3764508 - DNA, 22 bp, Homo sapiens
cagcccctcttgccccccaccc

SEQ ID NO: 3764509 - DNA, 15 bp, Homo sapiens
cagcccgcatgcagc

SEQ ID NO: 3764510 - DNA, 18 bp, Homo sapiens
cagcccgtgtggcccctt

SEQ ID NO: 3764511 - DNA, 17 bp, Homo sapiens
cagccctccctgcccct

SEQ ID NO: 3764512 - DNA, 20 bp, Homo sapiens
cagccctccctgtcctcctc

SEQ ID NO: 3764513 - DNA, 21 bp, Homo sapiens
cagccctccctgtcctcctcg

SEQ ID NO: 3764514 - DNA, 16 bp, Homo sapiens
cagccctcctcacccc

SEQ ID NO: 3764515 - DNA, 18 bp, Homo sapiens
cagccctctcactgtgtc

SEQ ID NO: 3764516 - DNA, 12 bp, Homo sapiens
cagccctgaggt

SEQ ID NO: 3764517 - DNA, 12 bp, Homo sapiens
cagccctgggcc

SEQ ID NO: 3764518 - DNA, 17 bp, Homo sapiens
cagccctgggccccacc

SEQ ID NO: 3764519 - DNA, 16 bp, Homo sapiens
cagccctgtcagtgca

SEQ ID NO: 3764520 - DNA, 21 bp, Homo sapiens
cagccctgtcagtgcagcccg

SEQ ID NO: 3764521 - DNA, 20 bp, Homo sapiens
cagccctttgggaggctgag

SEQ ID NO: 3764522 - DNA, 23 bp, Homo sapiens
cagccctttgggaggctgaggcg

SEQ ID NO: 3764523 - DNA, 21 bp, Homo sapiens
cagccgccattgccaccagga

SEQ ID NO: 3764524 - DNA, 20 bp, Homo sapiens
cagccgctcctgtctgccag

SEQ ID NO: 3764525 - DNA, 22 bp, Homo sapiens
cagccgctcctgtctgccagcc

SEQ ID NO: 3764526 - DNA, 18 bp, Homo sapiens
cagccgcttctgactgct

SEQ ID NO: 3764527 - DNA, 15 bp, Homo sapiens
cagccggggcctgcc

SEQ ID NO: 3764528 - DNA, 16 bp, Homo sapiens
cagccggggcctgcct

SEQ ID NO: 3764529 - DNA, 17 bp, Homo sapiens
cagccggggcctgccta

SEQ ID NO: 3764530 - DNA, 18 bp, Homo sapiens
cagccgtcagccaaatgt

SEQ ID NO: 3764531 - DNA, 9 bp, Homo sapiens
cagccgtgc

SEQ ID NO: 3764532 - DNA, 18 bp, Homo sapiens
cagccgtgccttcagctc

SEQ ID NO: 3764533 - DNA, 14 bp, Homo sapiens
cagcctacaggcct

SEQ ID NO: 3764534 - DNA, 16 bp, Homo sapiens
cagcctacaggcctca

SEQ ID NO: 3764535 - DNA, 22 bp, Homo sapiens
cagcctactagggacctgggga

SEQ ID NO: 3764536 - DNA, 19 bp, Homo sapiens
cagcctagccgacctcagc

SEQ ID NO: 3764537 - DNA, 20 bp, Homo sapiens
cagcctagccgacctcagcc

SEQ ID NO: 3764538 - DNA, 22 bp, Homo sapiens
cagcctagccgacctcagcctt

SEQ ID NO: 3764539 - DNA, 19 bp, Homo sapiens
cagcctaggggtcagggac

SEQ ID NO: 3764540 - DNA, 18 bp, Homo sapiens
cagcctcaacctcctggg

SEQ ID NO: 3764541 - DNA, 20 bp, Homo sapiens
cagcctcaacctcctgggct

SEQ ID NO: 3764542 - DNA, 13 bp, Homo sapiens
cagcctcacagaa

SEQ ID NO: 3764543 - DNA, 20 bp, Homo sapiens
cagcctccaagctccatctc

SEQ ID NO: 3764544 - DNA, 14 bp, Homo sapiens
cagcctcccacccc

SEQ ID NO: 3764545 - DNA, 20 bp, Homo sapiens
cagcctcccgaatagctggg

SEQ ID NO: 3764546 - DNA, 22 bp, Homo sapiens
cagcctcccgaatagctgggac

SEQ ID NO: 3764547 - DNA, 23 bp, Homo sapiens
cagcctcccgagtagctgggact

SEQ ID NO: 3764548 - DNA, 21 bp, Homo sapiens
cagcctccctctgacctgcag

SEQ ID NO: 3764549 - DNA, 19 bp, Homo sapiens
cagcctccgtatttcagac

SEQ ID NO: 3764550 - DNA, 22 bp, Homo sapiens
cagcctcgaactcctgggctca

SEQ ID NO: 3764551 - DNA, 22 bp, Homo sapiens
cagcctctcttcctatcccatc

SEQ ID NO: 3764552 - DNA, 23 bp, Homo sapiens
cagcctctcttggtttccttcct

SEQ ID NO: 3764553 - DNA, 17 bp, Homo sapiens
cagcctctgaaaaccaa

SEQ ID NO: 3764554 - DNA, 12 bp, Homo sapiens
cagcctctgaag

SEQ ID NO: 3764555 - DNA, 20 bp, Homo sapiens
cagcctctgaagttggacag

SEQ ID NO: 3764556 - DNA, 21 bp, Homo sapiens
cagcctctgaagttggacagc

SEQ ID NO: 3764557 - DNA, 18 bp, Homo sapiens
cagcctctgagcccctgg

SEQ ID NO: 3764558 - DNA, 21 bp, Homo sapiens
cagcctctgagcccctgggac

SEQ ID NO: 3764559 - DNA, 11 bp, Homo sapiens
cagcctcttaa

SEQ ID NO: 3764560 - DNA, 15 bp, Homo sapiens
cagcctgaggctgag

SEQ ID NO: 3764561 - DNA, 15 bp, Homo sapiens
cagcctgcgtggctg

SEQ ID NO: 3764562 - DNA, 18 bp, Homo sapiens
cagcctgcgtggctgacc

SEQ ID NO: 3764563 - DNA, 21 bp, Homo sapiens
cagcctgcgtggctgaccccc

SEQ ID NO: 3764564 - DNA, 19 bp, Homo sapiens
cagcctgctaattccccag

SEQ ID NO: 3764565 - DNA, 17 bp, Homo sapiens
cagcctgctccagctgt

SEQ ID NO: 3764566 - DNA, 19 bp, Homo sapiens
cagcctgctccagctgttc

SEQ ID NO: 3764567 - DNA, 15 bp, Homo sapiens
cagcctggaccctgt

SEQ ID NO: 3764568 - DNA, 19 bp, Homo sapiens
cagcctggaccctgtggat

SEQ ID NO: 3764569 - DNA, 21 bp, Homo sapiens
cagcctggcacagggcagtgg

SEQ ID NO: 3764570 - DNA, 21 bp, Homo sapiens
cagcctggcttctggagccct

SEQ ID NO: 3764571 - DNA, 20 bp, Homo sapiens
cagcctgggcaacagagcaa

SEQ ID NO: 3764572 - DNA, 17 bp, Homo sapiens
cagcctgggcagccagg

SEQ ID NO: 3764573 - DNA, 20 bp, Homo sapiens
cagcctgggcagccaggctg

SEQ ID NO: 3764574 - DNA, 15 bp, Homo sapiens
cagcctgggcgacag

SEQ ID NO: 3764575 - DNA, 14 bp, Homo sapiens
cagcctgtgctgcc

SEQ ID NO: 3764576 - DNA, 16 bp, Homo sapiens
cagcctgtgctgcccg

SEQ ID NO: 3764577 - DNA, 12 bp, Homo sapiens
cagcctgtggca

SEQ ID NO: 3764578 - DNA, 19 bp, Homo sapiens
cagcctgtggcggtgcctg

SEQ ID NO: 3764579 - DNA, 21 bp, Homo sapiens
cagcctgtggcggtgcctggg

SEQ ID NO: 3764580 - DNA, 21 bp, Homo sapiens
cagccttccccttgcccaggg

SEQ ID NO: 3764581 - DNA, 17 bp, Homo sapiens
cagcctttctcccaggc

SEQ ID NO: 3764582 - DNA, 20 bp, Homo sapiens
cagcctttctcccaggccag

SEQ ID NO: 3764583 - DNA, 19 bp, Homo sapiens
cagcctttgatcaggtggg

SEQ ID NO: 3764584 - DNA, 22 bp, Homo sapiens
cagcctttgatcaggtggggag

SEQ ID NO: 3764585 - DNA, 13 bp, Homo sapiens
cagcgagccctgg

SEQ ID NO: 3764586 - DNA, 20 bp, Homo sapiens
cagcgagccctggtggcagt

SEQ ID NO: 3764587 - DNA, 23 bp, Homo sapiens
cagcgcctagtggggtctccctc

SEQ ID NO: 3764588 - DNA, 19 bp, Homo sapiens
cagcggggacagctccttc

SEQ ID NO: 3764589 - DNA, 21 bp, Homo sapiens
cagcggggacagctccttctg

SEQ ID NO: 3764590 - DNA, 18 bp, Homo sapiens
cagcggggccccagggct

SEQ ID NO: 3764591 - DNA, 15 bp, Homo sapiens
cagcggtttggggag

SEQ ID NO: 3764592 - DNA, 15 bp, Homo sapiens
cagcgtactcatcat

SEQ ID NO: 3764593 - DNA, 22 bp, Homo sapiens
cagctaaagcccaacctcctga

SEQ ID NO: 3764594 - DNA, 16 bp, Homo sapiens
cagctaatgggacact

SEQ ID NO: 3764595 - DNA, 20 bp, Homo sapiens
cagctactcaagaggctgag

SEQ ID NO: 3764596 - DNA, 14 bp, Homo sapiens
cagctactcagaag

SEQ ID NO: 3764597 - DNA, 16 bp, Homo sapiens
cagctacttgggaggc

SEQ ID NO: 3764598 - DNA, 13 bp, Homo sapiens
cagctagagcttc

SEQ ID NO: 3764599 - DNA, 13 bp, Homo sapiens
cagtacccacctg

SEQ ID NO: 3764600 - DNA, 19 bp, Homo sapiens
cagtacccacctgagcttt

SEQ ID NO: 3764601 - DNA, 15 bp, Homo sapiens
cagtacctttgtcac

SEQ ID NO: 3764602 - DNA, 17 bp, Homo sapiens
cagtacctttgtcacaa

SEQ ID NO: 3764603 - DNA, 18 bp, Homo sapiens
cagtagaaataatatgca

SEQ ID NO: 3764604 - DNA, 15 bp, Homo sapiens
cagtatatttatagt

SEQ ID NO: 3764605 - DNA, 19 bp, Homo sapiens
cagtatgttcaaagtcaaa

SEQ ID NO: 3764606 - DNA, 19 bp, Homo sapiens
cagtattaaaggggggagg

SEQ ID NO: 3764607 - DNA, 21 bp, Homo sapiens
cagtattaaaggggggagggg

SEQ ID NO: 3764608 - DNA, 17 bp, Homo sapiens
cagtcacctgcccagat

SEQ ID NO: 3764609 - DNA, 21 bp, Homo sapiens
cagtcatcttgaccaagcagg

SEQ ID NO: 3764610 - DNA, 22 bp, Homo sapiens
cagtcatcttgaccaagcagga

SEQ ID NO: 3764611 - DNA, 24 bp, Homo sapiens
cagtcatggcaccaaagccaccag

SEQ ID NO: 3764612 - DNA, 21 bp, Homo sapiens
cagtccaaatgtcctccagaa

SEQ ID NO: 3764613 - DNA, 15 bp, Homo sapiens
cagtccacctgagct

SEQ ID NO: 3764614 - DNA, 20 bp, Homo sapiens
cagtccacctgagctgccat

SEQ ID NO: 3764615 - DNA, 16 bp, Homo sapiens
cagtccccctgcccca

SEQ ID NO: 3764616 - DNA, 21 bp, Homo sapiens
cagtccctgggggaagccctg

SEQ ID NO: 3764617 - DNA, 13 bp, Homo sapiens
cagtcctctttca

SEQ ID NO: 3764618 - DNA, 12 bp, Homo sapiens
cagtcctgcctg

SEQ ID NO: 3764619 - DNA, 14 bp, Homo sapiens
cagtcctgcctggc

SEQ ID NO: 3764620 - DNA, 15 bp, Homo sapiens
cagtcctgcctggcc

SEQ ID NO: 3764621 - DNA, 16 bp, Homo sapiens
cagtcctgcctggcca

SEQ ID NO: 3764622 - DNA, 18 bp, Homo sapiens
cagtcctgctctctaccc

SEQ ID NO: 3764623 - DNA, 23 bp, Homo sapiens
cagtctacccacctcagcctcct

SEQ ID NO: 3764624 - DNA, 13 bp, Homo sapiens
cagtctagttcct

SEQ ID NO: 3764625 - DNA, 17 bp, Homo sapiens
cagtctcacccagactc

SEQ ID NO: 3764626 - DNA, 18 bp, Homo sapiens
cagtctcaggagcatggg

SEQ ID NO: 3764627 - DNA, 14 bp, Homo sapiens
cagtctcccaggcc

SEQ ID NO: 3764628 - DNA, 21 bp, Homo sapiens
cagtctcccaggccccctgca

SEQ ID NO: 3764629 - DNA, 22 bp, Homo sapiens
cagtctctcttacccttctgtg

SEQ ID NO: 3764630 - DNA, 19 bp, Homo sapiens
cagtctctttaatcttcag

SEQ ID NO: 3764631 - DNA, 20 bp, Homo sapiens
cagtctctttaatcttcagt

SEQ ID NO: 3764632 - DNA, 21 bp, Homo sapiens
cagtctgattcccaagctctg

SEQ ID NO: 3764633 - DNA, 12 bp, Homo sapiens
cagtctggaggg

SEQ ID NO: 3764634 - DNA, 21 bp, Homo sapiens
cagtctggaggggcatggcca

SEQ ID NO: 3764635 - DNA, 16 bp, Homo sapiens
cagtcttccacctgga

SEQ ID NO: 3764636 - DNA, 19 bp, Homo sapiens
cagtcttccacctggaagc

SEQ ID NO: 3764637 - DNA, 20 bp, Homo sapiens
cagtcttccctagggctggg

SEQ ID NO: 3764638 - DNA, 13 bp, Homo sapiens
cagtgaaaactag

SEQ ID NO: 3764639 - DNA, 20 bp, Homo sapiens
cagtgaattgtgtaggagag

SEQ ID NO: 3764640 - DNA, 17 bp, Homo sapiens
cagtgacacttcagaga

SEQ ID NO: 3764641 - DNA, 18 bp, Homo sapiens
cagtgacagagttcacta

SEQ ID NO: 3764642 - DNA, 15 bp, Homo sapiens
cagtgacatgagact

SEQ ID NO: 3764643 - DNA, 14 bp, Homo sapiens
cagtgacctgagga

SEQ ID NO: 3764644 - DNA, 16 bp, Homo sapiens
cagtgacctgaggaag

SEQ ID NO: 3764645 - DNA, 19 bp, Homo sapiens
cagtgacctgaggaagcgt

SEQ ID NO: 3764646 - DNA, 16 bp, Homo sapiens
cagtgacgtgcacctg

SEQ ID NO: 3764647 - DNA, 20 bp, Homo sapiens
cagtgactgtggccatggtc

SEQ ID NO: 3764648 - DNA, 13 bp, Homo sapiens
cagtgagccaaga

SEQ ID NO: 3764649 - DNA, 12 bp, Homo sapiens
cagtgagcctga

SEQ ID NO: 3764650 - DNA, 13 bp, Homo sapiens
cagtgagctgaga

SEQ ID NO: 3764651 - DNA, 22 bp, Homo sapiens
cagtgagcttggaaaggaccag

SEQ ID NO: 3764652 - DNA, 20 bp, Homo sapiens
cagtgaggtcctgggggcct

SEQ ID NO: 3764653 - DNA, 23 bp, Homo sapiens
cagtgaggtcctgggggcctgac

SEQ ID NO: 3764654 - DNA, 19 bp, Homo sapiens
cagtgagtcgaggacaggg

SEQ ID NO: 3764655 - DNA, 23 bp, Homo sapiens
cagtgagtcgaggacagggaggt

SEQ ID NO: 3764656 - DNA, 13 bp, Homo sapiens
cagtgatctccat

SEQ ID NO: 3764657 - DNA, 23 bp, Homo sapiens
cagtgatgtaccatgaaacaaag

SEQ ID NO: 3764658 - DNA, 19 bp, Homo sapiens
cagtgattcgagctatatt

SEQ ID NO: 3764659 - DNA, 15 bp, Homo sapiens
cagtgcaacactgaa

SEQ ID NO: 3764660 - DNA, 15 bp, Homo sapiens
cagtgcagacaggcc

SEQ ID NO: 3764661 - DNA, 21 bp, Homo sapiens
cagtgcagacaggccatgtga

SEQ ID NO: 3764662 - DNA, 20 bp, Homo sapiens
cagtgcagcaaccagagcac

SEQ ID NO: 3764663 - DNA, 23 bp, Homo sapiens
cagtgcagcaaccagagcactgt

SEQ ID NO: 3764664 - DNA, 15 bp, Homo sapiens
cagtgcatctcagcc

SEQ ID NO: 3764665 - DNA, 19 bp, Homo sapiens
cagtgccaagcacagtgcc

SEQ ID NO: 3764666 - DNA, 22 bp, Homo sapiens
cagtgccattgtctttatatga

SEQ ID NO: 3764667 - DNA, 12 bp, Homo sapiens
cagtgcccacag

SEQ ID NO: 3764668 - DNA, 18 bp, Homo sapiens
cagtgcccacaggatcag

SEQ ID NO: 3764669 - DNA, 21 bp, Homo sapiens
cagtgcccacaggatcagtct

SEQ ID NO: 3764670 - DNA, 16 bp, Homo sapiens
cagtgcccaccaacat

SEQ ID NO: 3764671 - DNA, 21 bp, Homo sapiens
cagtgcccaccaacatcccat

SEQ ID NO: 3764672 - DNA, 10 bp, Homo sapiens
cagtgcctgc

SEQ ID NO: 3764673 - DNA, 13 bp, Homo sapiens
cagtgcctgctga

SEQ ID NO: 3764674 - DNA, 14 bp, Homo sapiens
cagtgcctgggaat

SEQ ID NO: 3764675 - DNA, 18 bp, Homo sapiens
cagtgcctgggaatgtat

SEQ ID NO: 3764676 - DNA, 18 bp, Homo sapiens
cagtgccttacctcctgc

SEQ ID NO: 3764677 - DNA, 19 bp, Homo sapiens
cagtgccttacctcctgcc

SEQ ID NO: 3764678 - DNA, 14 bp, Homo sapiens
cagtgccttccata

SEQ ID NO: 3764679 - DNA, 16 bp, Homo sapiens
cagtgccttccataat

SEQ ID NO: 3764680 - DNA, 23 bp, Homo sapiens
cagtgcctttcttctctccagtg

SEQ ID NO: 3764681 - DNA, 21 bp, Homo sapiens
cagtgcgggaggaatttctga

SEQ ID NO: 3764682 - DNA, 15 bp, Homo sapiens
cagtgctgtggcctg

SEQ ID NO: 3764683 - DNA, 17 bp, Homo sapiens
cagtgctgtggcctggg

SEQ ID NO: 3764684 - DNA, 18 bp, Homo sapiens
cagtgctgtggcctgggc

SEQ ID NO: 3764685 - DNA, 14 bp, Homo sapiens
cagtgcttcagcct

SEQ ID NO: 3764686 - DNA, 20 bp, Homo sapiens
cagtgcttgagtttggggaa

SEQ ID NO: 3764687 - DNA, 19 bp, Homo sapiens
cagtggaacagcgggagac

SEQ ID NO: 3764688 - DNA, 22 bp, Homo sapiens
cagtggacaccaggagtccctg

SEQ ID NO: 3764689 - DNA, 20 bp, Homo sapiens
cagtggactttccaccccct

SEQ ID NO: 3764690 - DNA, 12 bp, Homo sapiens
cagtggcagctg

SEQ ID NO: 3764691 - DNA, 14 bp, Homo sapiens
cagtggcagctgct

SEQ ID NO: 3764692 - DNA, 15 bp, Homo sapiens
cagtggcagctgctt

SEQ ID NO: 3764693 - DNA, 19 bp, Homo sapiens
cagtggcctcaaccctccc

SEQ ID NO: 3764694 - DNA, 14 bp, Homo sapiens
cagtggcctggctc

SEQ ID NO: 3764695 - DNA, 20 bp, Homo sapiens
cagtggctcacgcctatgat

SEQ ID NO: 3764696 - DNA, 20 bp, Homo sapiens
cagtgggaacgtgactgccc

SEQ ID NO: 3764697 - DNA, 21 bp, Homo sapiens
cagtgggaacgtgactgcccc

SEQ ID NO: 3764698 - DNA, 22 bp, Homo sapiens
cagtgggaacgtgactgcccca

SEQ ID NO: 3764699 - DNA, 19 bp, Homo sapiens
cagtgggacagggcatggc

SEQ ID NO: 3764700 - DNA, 17 bp, Homo sapiens
cagtgggagctgcctgt

SEQ ID NO: 3764701 - DNA, 20 bp, Homo sapiens
cagtggtgcgatctgggttc

SEQ ID NO: 3764702 - DNA, 21 bp, Homo sapiens
cagtggttctacaatctattt

SEQ ID NO: 3764703 - DNA, 20 bp, Homo sapiens
cagtgtacatggaataacat

SEQ ID NO: 3764704 - DNA, 14 bp, Homo sapiens
cagtgtagccccaa

SEQ ID NO: 3764705 - DNA, 21 bp, Homo sapiens
cagtgtagccccaagaaggct

SEQ ID NO: 3764706 - DNA, 20 bp, Homo sapiens
cagtgtcctcccctcaagga

SEQ ID NO: 3764707 - DNA, 23 bp, Homo sapiens
cagtgtctgtatcggagacagtg

SEQ ID NO: 3764708 - DNA, 24 bp, Homo sapiens
cagtgtctgtatcggagacagtga

SEQ ID NO: 3764709 - DNA, 18 bp, Homo sapiens
cagtgtcttccataatgt

SEQ ID NO: 3764710 - DNA, 18 bp, Homo sapiens
cagtgtgatcccaagtgc

SEQ ID NO: 3764711 - DNA, 17 bp, Homo sapiens
catgttacctcctataa

SEQ ID NO: 3764712 - DNA, 17 bp, Homo sapiens
catgttactgaccagca

SEQ ID NO: 3764713 - DNA, 16 bp, Homo sapiens
catgttcccttctcct

SEQ ID NO: 3764714 - DNA, 15 bp, Homo sapiens
catgttctctgagga

SEQ ID NO: 3764715 - DNA, 14 bp, Homo sapiens
catgttggccaggc

SEQ ID NO: 3764716 - DNA, 16 bp, Homo sapiens
catgttggccaggctg

SEQ ID NO: 3764717 - DNA, 17 bp, Homo sapiens
catgttggccaggctgg

SEQ ID NO: 3764718 - DNA, 18 bp, Homo sapiens
catgttggccaggctggt

SEQ ID NO: 3764719 - DNA, 20 bp, Homo sapiens
catgttggtatttatctatt

SEQ ID NO: 3764720 - DNA, 11 bp, Homo sapiens
catgtttaaga

SEQ ID NO: 3764721 - DNA, 14 bp, Homo sapiens
catgtttaagattt

SEQ ID NO: 3764722 - DNA, 23 bp, Homo sapiens
catgtttgagctcagacccccac

SEQ ID NO: 3764723 - DNA, 18 bp, Homo sapiens
cattaaagcatttacttt

SEQ ID NO: 3764724 - DNA, 13 bp, Homo sapiens
cattaacagtttt

SEQ ID NO: 3764725 - DNA, 21 bp, Homo sapiens
cattaacagttttccatgaaa

SEQ ID NO: 3764726 - DNA, 23 bp, Homo sapiens
cattaacagttttccatgaaaac

SEQ ID NO: 3764727 - DNA, 18 bp, Homo sapiens
cattaactaatctattgg

SEQ ID NO: 3764728 - DNA, 17 bp, Homo sapiens
cattaacttagcatgtg

SEQ ID NO: 3764729 - DNA, 13 bp, Homo sapiens
cattaagcatcac

SEQ ID NO: 3764730 - DNA, 16 bp, Homo sapiens
cattaagccttccaca

SEQ ID NO: 3764731 - DNA, 16 bp, Homo sapiens
cattaatatttgctga

SEQ ID NO: 3764732 - DNA, 13 bp, Homo sapiens
cattacagagagg

SEQ ID NO: 3764733 - DNA, 22 bp, Homo sapiens
cattacagagaggagaaacaca

SEQ ID NO: 3764734 - DNA, 21 bp, Homo sapiens
cattacattccttgataatgt

SEQ ID NO: 3764735 - DNA, 18 bp, Homo sapiens
cattaccagacggttcac

SEQ ID NO: 3764736 - DNA, 14 bp, Homo sapiens
cattactcttgtaa

SEQ ID NO: 3764737 - DNA, 17 bp, Homo sapiens
cattactcttgtaagat

SEQ ID NO: 3764738 - DNA, 22 bp, Homo sapiens
cattactcttgtaagattttga

SEQ ID NO: 3764739 - DNA, 23 bp, Homo sapiens
cattactcttgtaagattttgaa

SEQ ID NO: 3764740 - DNA, 18 bp, Homo sapiens
cattagaaattagctgtg

SEQ ID NO: 3764741 - DNA, 13 bp, Homo sapiens
cattataaacgtg

SEQ ID NO: 3764742 - DNA, 20 bp, Homo sapiens
cattataactgaaggagaag

SEQ ID NO: 3764743 - DNA, 15 bp, Homo sapiens
cattatattgcaatg

SEQ ID NO: 3764744 - DNA, 20 bp, Homo sapiens
cattatcgccttttgacagc

SEQ ID NO: 3764745 - DNA, 20 bp, Homo sapiens
cattatcgggagcagtgtct

SEQ ID NO: 3764746 - DNA, 21 bp, Homo sapiens
cattatcgggagcagtgtctt

SEQ ID NO: 3764747 - DNA, 23 bp, Homo sapiens
cattatcgggagcagtgtcttcc

SEQ ID NO: 3764748 - DNA, 19 bp, Homo sapiens
cattatctaactgtgctca

SEQ ID NO: 3764749 - DNA, 22 bp, Homo sapiens
cattatgatgtgggtcaaggaa

SEQ ID NO: 3764750 - DNA, 14 bp, Homo sapiens
cattatgattcttt

SEQ ID NO: 3764751 - DNA, 17 bp, Homo sapiens
cattattggaattaacc

SEQ ID NO: 3764752 - DNA, 13 bp, Homo sapiens
cattatttgcatg

SEQ ID NO: 3764753 - DNA, 16 bp, Homo sapiens
cattcaaaagttgaaa

SEQ ID NO: 3764754 - DNA, 16 bp, Homo sapiens
cattcaagtcagctct

SEQ ID NO: 3764755 - DNA, 21 bp, Homo sapiens
cattcaataagcatcaaactc

SEQ ID NO: 3764756 - DNA, 22 bp, Homo sapiens
cattcaataagcatcaaactct

SEQ ID NO: 3764757 - DNA, 14 bp, Homo sapiens
cattcacccagaca

SEQ ID NO: 3764758 - DNA, 18 bp, Homo sapiens
cattcacttgcatttctt

SEQ ID NO: 3764759 - DNA, 13 bp, Homo sapiens
cattcatctcatt

SEQ ID NO: 3764760 - DNA, 22 bp, Homo sapiens
cattccaccttcccatgccctg

SEQ ID NO: 3764761 - DNA, 18 bp, Homo sapiens
cattccatgtgcccagtt

SEQ ID NO: 3764762 - DNA, 17 bp, Homo sapiens
cattccccaggtggctg

SEQ ID NO: 3764763 - DNA, 18 bp, Homo sapiens
cattccctgagtcaccag

SEQ ID NO: 3764764 - DNA, 21 bp, Homo sapiens
cattccctgagtcaccaggaa

SEQ ID NO: 3764765 - DNA, 21 bp, Homo sapiens
cattcctaacacagcatgtgt

SEQ ID NO: 3764766 - DNA, 13 bp, Homo sapiens
cattcctcaggga

SEQ ID NO: 3764767 - DNA, 16 bp, Homo sapiens
cattcctcagggacag

SEQ ID NO: 3764768 - DNA, 13 bp, Homo sapiens
cattcctgaaaga

SEQ ID NO: 3764769 - DNA, 15 bp, Homo sapiens
cattcctggagcccg

SEQ ID NO: 3764770 - DNA, 18 bp, Homo sapiens
cattcctggagcccgagg

SEQ ID NO: 3764771 - DNA, 17 bp, Homo sapiens
cattctcaagccctgca

SEQ ID NO: 3764772 - DNA, 14 bp, Homo sapiens
cattctcactccta

SEQ ID NO: 3764773 - DNA, 17 bp, Homo sapiens
cattctcactcctacct

SEQ ID NO: 3764774 - DNA, 13 bp, Homo sapiens
cattctctgaaga

SEQ ID NO: 3764775 - DNA, 13 bp, Homo sapiens
cattctgcctgcc

SEQ ID NO: 3764776 - DNA, 15 bp, Homo sapiens
cattctgcctgccca

SEQ ID NO: 3764777 - DNA, 17 bp, Homo sapiens
cattctgcctgcccagg

SEQ ID NO: 3764778 - DNA, 18 bp, Homo sapiens
cattctgcctgcccaggc

SEQ ID NO: 3764779 - DNA, 19 bp, Homo sapiens
cattctgcctgcccaggcc

SEQ ID NO: 3764780 - DNA, 12 bp, Homo sapiens
cattctggtctc

SEQ ID NO: 3764781 - DNA, 15 bp, Homo sapiens
cattcttagcctgtg

SEQ ID NO: 3764782 - DNA, 22 bp, Homo sapiens
cattcttagcctgtggcagtaa

SEQ ID NO: 3764783 - DNA, 18 bp, Homo sapiens
cattcttcctagttttct

SEQ ID NO: 3764784 - DNA, 15 bp, Homo sapiens
cattctttgcttgaa

SEQ ID NO: 3764785 - DNA, 22 bp, Homo sapiens
cattgaaagagaaccagtttca

SEQ ID NO: 3764786 - DNA, 19 bp, Homo sapiens
cattgaccaagaactgcat

SEQ ID NO: 3764787 - DNA, 20 bp, Homo sapiens
cattgaccaagaactgcatg

SEQ ID NO: 3764788 - DNA, 18 bp, Homo sapiens
cattgactatcaaactga

SEQ ID NO: 3764789 - DNA, 22 bp, Homo sapiens
cattgactatcaaactgaagcc

SEQ ID NO: 3764790 - DNA, 18 bp, Homo sapiens
cattgagaactgcatatg

SEQ ID NO: 3764791 - DNA, 17 bp, Homo sapiens
cattgatatgaaaaata

SEQ ID NO: 3764792 - DNA, 18 bp, Homo sapiens
cattgatatgaaaaatat

SEQ ID NO: 3764793 - DNA, 14 bp, Homo sapiens
cattgatggggaag

SEQ ID NO: 3764794 - DNA, 16 bp, Homo sapiens
cattgatggggaagga

SEQ ID NO: 3764795 - DNA, 15 bp, Homo sapiens
cattgattgctgtgt

SEQ ID NO: 3764796 - DNA, 18 bp, Homo sapiens
cattgcagtctgcttctg

SEQ ID NO: 3764797 - DNA, 13 bp, Homo sapiens
cattgccaccagg

SEQ ID NO: 3764798 - DNA, 17 bp, Homo sapiens
cattgccagtgtctttc

SEQ ID NO: 3764799 - DNA, 12 bp, Homo sapiens
cattgccctggt

SEQ ID NO: 3764800 - DNA, 14 bp, Homo sapiens
cattgcctgcggtc

SEQ ID NO: 3764801 - DNA, 21 bp, Homo sapiens
cattgcggacagccacggcca

SEQ ID NO: 3764802 - DNA, 22 bp, Homo sapiens
cattgctgctccttagctgcca

SEQ ID NO: 3764803 - DNA, 23 bp, Homo sapiens
cattgctgctccttagctgccaa

SEQ ID NO: 3764804 - DNA, 20 bp, Homo sapiens
cattgctggtcttgtaagag

SEQ ID NO: 3764805 - DNA, 20 bp, Homo sapiens
cattgcttcacaacccatct

SEQ ID NO: 3764806 - DNA, 17 bp, Homo sapiens
cattgtaatgttactga

SEQ ID NO: 3764807 - DNA, 16 bp, Homo sapiens
cattgtagagcttctg

SEQ ID NO: 3764808 - DNA, 21 bp, Homo sapiens
cattgtagagcttctggcact

SEQ ID NO: 3764809 - DNA, 23 bp, Homo sapiens
cattgtggttatttttatacagt

SEQ ID NO: 3764810 - DNA, 18 bp, Homo sapiens
cattgttgaggtggtctg

SEQ ID NO: 3764811 - DNA, 18 bp, Homo sapiens
cattgttggccaaagcca

SEQ ID NO: 3764812 - DNA, 18 bp, Homo sapiens
cattgtttgcttattgtt

SEQ ID NO: 3764813 - DNA, 19 bp, Homo sapiens
cattgtttgcttattgttc

SEQ ID NO: 3764814 - DNA, 22 bp, Homo sapiens
cattgtttgcttattgttccaa

SEQ ID NO: 3764815 - DNA, 12 bp, Homo sapiens
catttacacttt

SEQ ID NO: 3764816 - DNA, 22 bp, Homo sapiens
catttacccttcttttctgact

SEQ ID NO: 3764817 - DNA, 20 bp, Homo sapiens
catttagttctttgttattt

SEQ ID NO: 3764818 - DNA, 17 bp, Homo sapiens
catttataatgtttgct

SEQ ID NO: 3764819 - DNA, 21 bp, Homo sapiens
catttataatgtttgctattg

SEQ ID NO: 3764820 - DNA, 12 bp, Homo sapiens
catttatctgta

SEQ ID NO: 3764821 - DNA, 16 bp, Homo sapiens
catttatgaagcaagc

SEQ ID NO: 3764822 - DNA, 20 bp, Homo sapiens
catttatggtcaacacttaa

SEQ ID NO: 3764823 - DNA, 16 bp, Homo sapiens
catttattctgctcac

SEQ ID NO: 3764824 - DNA, 23 bp, Homo sapiens
ccagccagcagccagctctcagc

SEQ ID NO: 3764825 - DNA, 17 bp, Homo sapiens
ccagcccacttctgcca

SEQ ID NO: 3764826 - DNA, 12 bp, Homo sapiens
ccagcccagccc

SEQ ID NO: 3764827 - DNA, 12 bp, Homo sapiens
ccagcccagctg

SEQ ID NO: 3764828 - DNA, 14 bp, Homo sapiens
ccagcccagctgct

SEQ ID NO: 3764829 - DNA, 19 bp, Homo sapiens
ccagcccagctgctctgcc

SEQ ID NO: 3764830 - DNA, 17 bp, Homo sapiens
ccagccccacccaggag

SEQ ID NO: 3764831 - DNA, 18 bp, Homo sapiens
ccagccccacccaggagg

SEQ ID NO: 3764832 - DNA, 13 bp, Homo sapiens
ccagccccagtgc

SEQ ID NO: 3764833 - DNA, 17 bp, Homo sapiens
ccagccccagtgcccac

SEQ ID NO: 3764834 - DNA, 13 bp, Homo sapiens
ccagcccctccca

SEQ ID NO: 3764835 - DNA, 14 bp, Homo sapiens
ccagcccctcccac

SEQ ID NO: 3764836 - DNA, 20 bp, Homo sapiens
ccagcccctcccaccacagc

SEQ ID NO: 3764837 - DNA, 14 bp, Homo sapiens
ccagccctccctgt

SEQ ID NO: 3764838 - DNA, 16 bp, Homo sapiens
ccagccctccctgtcc

SEQ ID NO: 3764839 - DNA, 20 bp, Homo sapiens
ccagccctccctgtcctcct

SEQ ID NO: 3764840 - DNA, 14 bp, Homo sapiens
ccagccctgtggaa

SEQ ID NO: 3764841 - DNA, 15 bp, Homo sapiens
ccagccctgtggaag

SEQ ID NO: 3764842 - DNA, 20 bp, Homo sapiens
ccagccctttgggaggctga

SEQ ID NO: 3764843 - DNA, 17 bp, Homo sapiens
ccagcctaagatgaaga

SEQ ID NO: 3764844 - DNA, 21 bp, Homo sapiens
ccagcctccaagctccatctc

SEQ ID NO: 3764845 - DNA, 21 bp, Homo sapiens
ccagcctctgagcccctggga

SEQ ID NO: 3764846 - DNA, 11 bp, Homo sapiens
ccagcctggcc

SEQ ID NO: 3764847 - DNA, 12 bp, Homo sapiens
ccagcctggcca

SEQ ID NO: 3764848 - DNA, 18 bp, Homo sapiens
ccagcctggcttctggag

SEQ ID NO: 3764849 - DNA, 23 bp, Homo sapiens
ccagcctgggcagccaggctgcc

SEQ ID NO: 3764850 - DNA, 16 bp, Homo sapiens
ccagcctgggcgacag

SEQ ID NO: 3764851 - DNA, 19 bp, Homo sapiens
ccagcctgggcgacagagc

SEQ ID NO: 3764852 - DNA, 13 bp, Homo sapiens
ccagcctgggtga

SEQ ID NO: 3764853 - DNA, 14 bp, Homo sapiens
ccagcgagccctgg

SEQ ID NO: 3764854 - DNA, 15 bp, Homo sapiens
ccagcgagccctggt

SEQ ID NO: 3764855 - DNA, 22 bp, Homo sapiens
ccagcggctggtgcagggcctc

SEQ ID NO: 3764856 - DNA, 21 bp, Homo sapiens
ccagctaaggacatttcccag

SEQ ID NO: 3764857 - DNA, 20 bp, Homo sapiens
ccagctactcaagaggctga

SEQ ID NO: 3764858 - DNA, 17 bp, Homo sapiens
ccagctactcagaagcc

SEQ ID NO: 3764859 - DNA, 23 bp, Homo sapiens
ccagctactcagaagcctgaggc

SEQ ID NO: 3764860 - DNA, 17 bp, Homo sapiens
ccagctactcaggaggc

SEQ ID NO: 3764861 - DNA, 19 bp, Homo sapiens
ccagctactcaggaggctg

SEQ ID NO: 3764862 - DNA, 21 bp, Homo sapiens
ccagctactccggaggctgag

SEQ ID NO: 3764863 - DNA, 15 bp, Homo sapiens
ccagctcaccagccc

SEQ ID NO: 3764864 - DNA, 22 bp, Homo sapiens
ccagctcaccagccccagtgcc

SEQ ID NO: 3764865 - DNA, 14 bp, Homo sapiens
ccagctccagggcc

SEQ ID NO: 3764866 - DNA, 14 bp, Homo sapiens
ccagctccctagga

SEQ ID NO: 3764867 - DNA, 19 bp, Homo sapiens
ccagctctagacaaccctg

SEQ ID NO: 3764868 - DNA, 17 bp, Homo sapiens
ccagctctccctctggc

SEQ ID NO: 3764869 - DNA, 14 bp, Homo sapiens
ccagctctggcttc

SEQ ID NO: 3764870 - DNA, 13 bp, Homo sapiens
ccagctgactgtg

SEQ ID NO: 3764871 - DNA, 18 bp, Homo sapiens
ccagctgcacctgccagc

SEQ ID NO: 3764872 - DNA, 19 bp, Homo sapiens
ccagctgcacctgccagcc

SEQ ID NO: 3764873 - DNA, 22 bp, Homo sapiens
ccagctgcacctgccagcctgg

SEQ ID NO: 3764874 - DNA, 14 bp, Homo sapiens
ccagctgctcccct

SEQ ID NO: 3764875 - DNA, 12 bp, Homo sapiens
ccagctgctctg

SEQ ID NO: 3764876 - DNA, 13 bp, Homo sapiens
ccagctgctctgc

SEQ ID NO: 3764877 - DNA, 23 bp, Homo sapiens
ccagctgctctgcccagagctgg

SEQ ID NO: 3764878 - DNA, 17 bp, Homo sapiens
ccagctgggttggaaaa

SEQ ID NO: 3764879 - DNA, 18 bp, Homo sapiens
ccagctgtgctctggaca

SEQ ID NO: 3764880 - DNA, 20 bp, Homo sapiens
ccagctgtgctctggacagg

SEQ ID NO: 3764881 - DNA, 14 bp, Homo sapiens
ccagcttgctcttc

SEQ ID NO: 3764882 - DNA, 16 bp, Homo sapiens
ccagcttgttatttat

SEQ ID NO: 3764883 - DNA, 14 bp, Homo sapiens
ccaggaacctcctc

SEQ ID NO: 3764884 - DNA, 20 bp, Homo sapiens
ccaggaagccgtgccctgcc

SEQ ID NO: 3764885 - DNA, 16 bp, Homo sapiens
ccaggaaggggctgga

SEQ ID NO: 3764886 - DNA, 14 bp, Homo sapiens
ccaggacaggacca

SEQ ID NO: 3764887 - DNA, 13 bp, Homo sapiens
ccaggacaggccc

SEQ ID NO: 3764888 - DNA, 15 bp, Homo sapiens
ccaggacaggcccgg

SEQ ID NO: 3764889 - DNA, 14 bp, Homo sapiens
ccaggactccctcc

SEQ ID NO: 3764890 - DNA, 16 bp, Homo sapiens
ccaggactccctcctc

SEQ ID NO: 3764891 - DNA, 22 bp, Homo sapiens
ccaggactccctcctcacctct

SEQ ID NO: 3764892 - DNA, 18 bp, Homo sapiens
ccaggagagccagccctc

SEQ ID NO: 3764893 - DNA, 19 bp, Homo sapiens
ccaggagccccgaggcctt

SEQ ID NO: 3764894 - DNA, 16 bp, Homo sapiens
ccaggagctgggcaga

SEQ ID NO: 3764895 - DNA, 21 bp, Homo sapiens
ccaggagctgggcagaaggcc

SEQ ID NO: 3764896 - DNA, 17 bp, Homo sapiens
ccaggagtttgagacca

SEQ ID NO: 3764897 - DNA, 17 bp, Homo sapiens
ccaggcaacttgggaac

SEQ ID NO: 3764898 - DNA, 23 bp, Homo sapiens
ccaggcaatggcctaaacttcag

SEQ ID NO: 3764899 - DNA, 16 bp, Homo sapiens
ccaggcacccaaaccc

SEQ ID NO: 3764900 - DNA, 18 bp, Homo sapiens
ccaggcacgaacccacct

SEQ ID NO: 3764901 - DNA, 19 bp, Homo sapiens
ccaggcacgaacccacctg

SEQ ID NO: 3764902 - DNA, 22 bp, Homo sapiens
ccaggcacgaacccacctgctg

SEQ ID NO: 3764903 - DNA, 16 bp, Homo sapiens
ccaggcactgctgccc

SEQ ID NO: 3764904 - DNA, 13 bp, Homo sapiens
ccaggcagatctg

SEQ ID NO: 3764905 - DNA, 17 bp, Homo sapiens
ccaggcagatctgtgcc

SEQ ID NO: 3764906 - DNA, 21 bp, Homo sapiens
ccaggcagatctgtgccccat

SEQ ID NO: 3764907 - DNA, 14 bp, Homo sapiens
ccaggcaggtcttg

SEQ ID NO: 3764908 - DNA, 21 bp, Homo sapiens
ccaggccagagggagtgacag

SEQ ID NO: 3764909 - DNA, 21 bp, Homo sapiens
ccaggccccaaaaccacagcc

SEQ ID NO: 3764910 - DNA, 16 bp, Homo sapiens
ccaggccccaggaagc

SEQ ID NO: 3764911 - DNA, 13 bp, Homo sapiens
ccaggcccctgcc

SEQ ID NO: 3764912 - DNA, 14 bp, Homo sapiens
ccaggcccctgcca

SEQ ID NO: 3764913 - DNA, 19 bp, Homo sapiens
ccaggcccctgccaccctg

SEQ ID NO: 3764914 - DNA, 23 bp, Homo sapiens
ccaggcccctgccaccctgggga

SEQ ID NO: 3764915 - DNA, 15 bp, Homo sapiens
ccaggcccggggctg

SEQ ID NO: 3764916 - DNA, 16 bp, Homo sapiens
ccaggcccggggctgg

SEQ ID NO: 3764917 - DNA, 21 bp, Homo sapiens
ccaggcccggggctggcggct

SEQ ID NO: 3764918 - DNA, 21 bp, Homo sapiens
ccaggccgccccagcctctga

SEQ ID NO: 3764919 - DNA, 16 bp, Homo sapiens
ccaggccgtggctgcc

SEQ ID NO: 3764920 - DNA, 17 bp, Homo sapiens
ccaggcctgggtctgtg

SEQ ID NO: 3764921 - DNA, 19 bp, Homo sapiens
ccaggcctgggtctgtgtc

SEQ ID NO: 3764922 - DNA, 20 bp, Homo sapiens
ccaggcctgggtctgtgtct

SEQ ID NO: 3764923 - DNA, 14 bp, Homo sapiens
ccaggctcctccct

SEQ ID NO: 3764924 - DNA, 22 bp, Homo sapiens
ccaggctccttcctgtcttcct

SEQ ID NO: 3764925 - DNA, 20 bp, Homo sapiens
ccaggctcctttagcgccca

SEQ ID NO: 3764926 - DNA, 17 bp, Homo sapiens
ccaggctctaaagccaa

SEQ ID NO: 3764927 - DNA, 17 bp, Homo sapiens
ccaggctgcatagaagg

SEQ ID NO: 3764928 - DNA, 15 bp, Homo sapiens
ccaggctgcctgagc

SEQ ID NO: 3764929 - DNA, 14 bp, Homo sapiens
ccagggagaggcca

SEQ ID NO: 3764930 - DNA, 17 bp, Homo sapiens
ccagggagaggccatga

SEQ ID NO: 3764931 - DNA, 18 bp, Homo sapiens
ccagggagcaagacagag

SEQ ID NO: 3764932 - DNA, 13 bp, Homo sapiens
ccagggccacgtg

SEQ ID NO: 3764933 - DNA, 14 bp, Homo sapiens
ccagggccagggcc

SEQ ID NO: 3764934 - DNA, 11 bp, Homo sapiens
ccagggctcag

SEQ ID NO: 3764935 - DNA, 12 bp, Homo sapiens
ccagggctcagc

SEQ ID NO: 3764936 - DNA, 14 bp, Homo sapiens
ccagggctcagcct

SEQ ID NO: 3764937 - DNA, 16 bp, Homo sapiens
ccagggctcagcctgg

SEQ ID NO: 3764938 - DNA, 22 bp, Homo sapiens
cccatgaagacaggacagtgct

SEQ ID NO: 3764939 - DNA, 16 bp, Homo sapiens
cccatgaagccacagc

SEQ ID NO: 3764940 - DNA, 17 bp, Homo sapiens
cccatgtctacacagat

SEQ ID NO: 3764941 - DNA, 22 bp, Homo sapiens
cccatgtgcctgcaccaggaga

SEQ ID NO: 3764942 - DNA, 14 bp, Homo sapiens
cccatgtgtgagtg

SEQ ID NO: 3764943 - DNA, 19 bp, Homo sapiens
cccatgtgtgagtgtgtgc

SEQ ID NO: 3764944 - DNA, 14 bp, Homo sapiens
cccattccccagcc

SEQ ID NO: 3764945 - DNA, 17 bp, Homo sapiens
cccattctctctcctgt

SEQ ID NO: 3764946 - DNA, 18 bp, Homo sapiens
cccattctctctcctgtc

SEQ ID NO: 3764947 - DNA, 20 bp, Homo sapiens
cccattctgcctgcccaggc

SEQ ID NO: 3764948 - DNA, 20 bp, Homo sapiens
cccattcttcctagttttct

SEQ ID NO: 3764949 - DNA, 21 bp, Homo sapiens
cccattcttcctagttttctc

SEQ ID NO: 3764950 - DNA, 20 bp, Homo sapiens
cccattctttgcttgaacac

SEQ ID NO: 3764951 - DNA, 21 bp, Homo sapiens
cccattctttgcttgaacaca

SEQ ID NO: 3764952 - DNA, 12 bp, Homo sapiens
cccattgtcttc

SEQ ID NO: 3764953 - DNA, 18 bp, Homo sapiens
cccatttcacacctgaaa

SEQ ID NO: 3764954 - DNA, 21 bp, Homo sapiens
cccatttctaaaggcctcttc

SEQ ID NO: 3764955 - DNA, 12 bp, Homo sapiens
cccattttgcaa

SEQ ID NO: 3764956 - DNA, 22 bp, Homo sapiens
cccattttgcaaaatttccagt

SEQ ID NO: 3764957 - DNA, 11 bp, Homo sapiens
ccccaaagtgg

SEQ ID NO: 3764958 - DNA, 13 bp, Homo sapiens
ccccaacccccac

SEQ ID NO: 3764959 - DNA, 23 bp, Homo sapiens
ccccaaccctgcccctgccccgt

SEQ ID NO: 3764960 - DNA, 20 bp, Homo sapiens
ccccaacgaaaagcacatcc

SEQ ID NO: 3764961 - DNA, 14 bp, Homo sapiens
ccccaagaaggctg

SEQ ID NO: 3764962 - DNA, 23 bp, Homo sapiens
ccccaagacctctatatttgctc

SEQ ID NO: 3764963 - DNA, 23 bp, Homo sapiens
ccccaagacttggtgtcctttcc

SEQ ID NO: 3764964 - DNA, 14 bp, Homo sapiens
ccccaagctgtttt

SEQ ID NO: 3764965 - DNA, 17 bp, Homo sapiens
ccccaagctgttttctt

SEQ ID NO: 3764966 - DNA, 15 bp, Homo sapiens
ccccaaggagggaga

SEQ ID NO: 3764967 - DNA, 16 bp, Homo sapiens
ccccacacctcagttc

SEQ ID NO: 3764968 - DNA, 23 bp, Homo sapiens
ccccaccacgatgtggccctggc

SEQ ID NO: 3764969 - DNA, 14 bp, Homo sapiens
ccccaccccacact

SEQ ID NO: 3764970 - DNA, 14 bp, Homo sapiens
ccccaccctttggg

SEQ ID NO: 3764971 - DNA, 21 bp, Homo sapiens
ccccactcacagagacacagg

SEQ ID NO: 3764972 - DNA, 15 bp, Homo sapiens
ccccactctccccac

SEQ ID NO: 3764973 - DNA, 15 bp, Homo sapiens
ccccactgacagcct

SEQ ID NO: 3764974 - DNA, 16 bp, Homo sapiens
ccccactgcctgccca

SEQ ID NO: 3764975 - DNA, 12 bp, Homo sapiens
ccccactggctg

SEQ ID NO: 3764976 - DNA, 20 bp, Homo sapiens
ccccactggctgtgggctcc

SEQ ID NO: 3764977 - DNA, 15 bp, Homo sapiens
ccccagaacctgtcc

SEQ ID NO: 3764978 - DNA, 21 bp, Homo sapiens
ccccagaacctgtccttgcac

SEQ ID NO: 3764979 - DNA, 19 bp, Homo sapiens
ccccagacctgagctcccc

SEQ ID NO: 3764980 - DNA, 10 bp, Homo sapiens
ccccagagac

SEQ ID NO: 3764981 - DNA, 22 bp, Homo sapiens
ccccagagctgtttatggcctc

SEQ ID NO: 3764982 - DNA, 22 bp, Homo sapiens
ccccagagtgtgggaagggaga

SEQ ID NO: 3764983 - DNA, 20 bp, Homo sapiens
ccccagattgcaacaggctg

SEQ ID NO: 3764984 - DNA, 17 bp, Homo sapiens
ccccagcaagtgagagc

SEQ ID NO: 3764985 - DNA, 11 bp, Homo sapiens
ccccagcaggt

SEQ ID NO: 3764986 - DNA, 18 bp, Homo sapiens
ccccagcccactggatca

SEQ ID NO: 3764987 - DNA, 11 bp, Homo sapiens
ccccagcccag

SEQ ID NO: 3764988 - DNA, 18 bp, Homo sapiens
ccccagcccagcccagct

SEQ ID NO: 3764989 - DNA, 21 bp, Homo sapiens
ccccagcccagggttccccca

SEQ ID NO: 3764990 - DNA, 14 bp, Homo sapiens
ccccagccctgtgg

SEQ ID NO: 3764991 - DNA, 19 bp, Homo sapiens
ccccagcctaagatgaaga

SEQ ID NO: 3764992 - DNA, 16 bp, Homo sapiens
ccccagcctctcttcc

SEQ ID NO: 3764993 - DNA, 11 bp, Homo sapiens
ccccaggcagg

SEQ ID NO: 3764994 - DNA, 14 bp, Homo sapiens
ccccaggcaggctg

SEQ ID NO: 3764995 - DNA, 23 bp, Homo sapiens
ccccaggcaggctgtgcgctgac

SEQ ID NO: 3764996 - DNA, 20 bp, Homo sapiens
ccccaggtggctgacccagt

SEQ ID NO: 3764997 - DNA, 21 bp, Homo sapiens
ccccaggtggctgacccagtc

SEQ ID NO: 3764998 - DNA, 22 bp, Homo sapiens
ccccaggtggttatggagaggg

SEQ ID NO: 3764999 - DNA, 16 bp, Homo sapiens
ccccagtaagccactg

SEQ ID NO: 3765000 - DNA, 20 bp, Homo sapiens
ccccagtacctccaagcaag

SEQ ID NO: 3765001 - DNA, 16 bp, Homo sapiens
ccccagtgcacccact

SEQ ID NO: 3765002 - DNA, 14 bp, Homo sapiens
ccccagtgcccaca

SEQ ID NO: 3765003 - DNA, 16 bp, Homo sapiens
ccccagtgcccacagg

SEQ ID NO: 3765004 - DNA, 18 bp, Homo sapiens
ccccatcacaaacttaaa

SEQ ID NO: 3765005 - DNA, 13 bp, Homo sapiens
ccccatcctcccc

SEQ ID NO: 3765006 - DNA, 17 bp, Homo sapiens
ccccatcctccccttcc

SEQ ID NO: 3765007 - DNA, 14 bp, Homo sapiens
ccccatctctacta

SEQ ID NO: 3765008 - DNA, 21 bp, Homo sapiens
ccccatgcctgtccagcctgg

SEQ ID NO: 3765009 - DNA, 15 bp, Homo sapiens
ccccatgtctctcag

SEQ ID NO: 3765010 - DNA, 23 bp, Homo sapiens
ccccatgtgcctgcaccaggaga

SEQ ID NO: 3765011 - DNA, 17 bp, Homo sapiens
ccccattagagtcagcc

SEQ ID NO: 3765012 - DNA, 21 bp, Homo sapiens
ccccattctgcctgcccaggc

SEQ ID NO: 3765013 - DNA, 21 bp, Homo sapiens
ccccattcttcctagttttct

SEQ ID NO: 3765014 - DNA, 23 bp, Homo sapiens
ccccattcttcctagttttctcc

SEQ ID NO: 3765015 - DNA, 23 bp, Homo sapiens
cccccaaccaagtggctcccaca

SEQ ID NO: 3765016 - DNA, 23 bp, Homo sapiens
cccccaaggggcagtctggaggg

SEQ ID NO: 3765017 - DNA, 12 bp, Homo sapiens
cccccaccccct

SEQ ID NO: 3765018 - DNA, 13 bp, Homo sapiens
cccccactggctg

SEQ ID NO: 3765019 - DNA, 15 bp, Homo sapiens
cccccactggctgtg

SEQ ID NO: 3765020 - DNA, 21 bp, Homo sapiens
cccccactggctgtgggctcc

SEQ ID NO: 3765021 - DNA, 15 bp, Homo sapiens
cccccagaacctgtc

SEQ ID NO: 3765022 - DNA, 12 bp, Homo sapiens
cccccagccctg

SEQ ID NO: 3765023 - DNA, 12 bp, Homo sapiens
ccccccactctc

SEQ ID NO: 3765024 - DNA, 12 bp, Homo sapiens
ccccccactgca

SEQ ID NO: 3765025 - DNA, 18 bp, Homo sapiens
ccccctcaggaccctcgc

SEQ ID NO: 3765026 - DNA, 19 bp, Homo sapiens
ccccctcaggaccctcgct

SEQ ID NO: 3765027 - DNA, 18 bp, Homo sapiens
ccccctccttcccagctg

SEQ ID NO: 3765028 - DNA, 21 bp, Homo sapiens
ccccctccttcccagctgccc

SEQ ID NO: 3765029 - DNA, 19 bp, Homo sapiens
ccccctgccccttctacac

SEQ ID NO: 3765030 - DNA, 21 bp, Homo sapiens
ccccctggtggacagtcctgg

SEQ ID NO: 3765031 - DNA, 23 bp, Homo sapiens
ccccctggtggacagtcctggga

SEQ ID NO: 3765032 - DNA, 15 bp, Homo sapiens
cccccttcagtgccc

SEQ ID NO: 3765033 - DNA, 13 bp, Homo sapiens
cccccttctccca

SEQ ID NO: 3765034 - DNA, 17 bp, Homo sapiens
cccccttctcccacact

SEQ ID NO: 3765035 - DNA, 15 bp, Homo sapiens
cccccttctctgctc

SEQ ID NO: 3765036 - DNA, 17 bp, Homo sapiens
ccccgccccacattccg

SEQ ID NO: 3765037 - DNA, 15 bp, Homo sapiens
ccccgcttgtccagc

SEQ ID NO: 3765038 - DNA, 17 bp, Homo sapiens
ccccgggctctctgctg

SEQ ID NO: 3765039 - DNA, 24 bp, Homo sapiens
ccccggtcccttgagacctcagcc

SEQ ID NO: 3765040 - DNA, 20 bp, Homo sapiens
ccccgtctggggttcagccc

SEQ ID NO: 3765041 - DNA, 15 bp, Homo sapiens
ccccgtgcagactgg

SEQ ID NO: 3765042 - DNA, 19 bp, Homo sapiens
ccccgtgcagactggaggg

SEQ ID NO: 3765043 - DNA, 18 bp, Homo sapiens
cccctaatgcctgcggag

SEQ ID NO: 3765044 - DNA, 21 bp, Homo sapiens
cccctatccacccagcccatt

SEQ ID NO: 3765045 - DNA, 23 bp, Homo sapiens
cccctcaaggacaaagtctccag

SEQ ID NO: 3765046 - DNA, 14 bp, Homo sapiens
cccctcaccttgca

SEQ ID NO: 3765047 - DNA, 22 bp, Homo sapiens
cccctcaggaccctcgctggcc

SEQ ID NO: 3765048 - DNA, 23 bp, Homo sapiens
cccctccaatcccaccaaccctc

SEQ ID NO: 3765049 - DNA, 12 bp, Homo sapiens
cccctccatgtg

SEQ ID NO: 3765050 - DNA, 12 bp, Homo sapiens
cccctcccacca

SEQ ID NO: 3765051 - DNA, 14 bp, Homo sapiens
cctaagtctctgtg

SEQ ID NO: 3765052 - DNA, 15 bp, Homo sapiens
cctaagtctctgtga

SEQ ID NO: 3765053 - DNA, 15 bp, Homo sapiens
cctaagtggctgctg

SEQ ID NO: 3765054 - DNA, 15 bp, Homo sapiens
cctaagttcttagat

SEQ ID NO: 3765055 - DNA, 16 bp, Homo sapiens
cctaatacattaaagc

SEQ ID NO: 3765056 - DNA, 20 bp, Homo sapiens
cctaatacattaaagcagtc

SEQ ID NO: 3765057 - DNA, 21 bp, Homo sapiens
cctaatccctgggcattgctt

SEQ ID NO: 3765058 - DNA, 18 bp, Homo sapiens
cctaatgagaagtcaaca

SEQ ID NO: 3765059 - DNA, 19 bp, Homo sapiens
cctaatgtttatgagccag

SEQ ID NO: 3765060 - DNA, 19 bp, Homo sapiens
cctacaagagcagcctgtg

SEQ ID NO: 3765061 - DNA, 21 bp, Homo sapiens
cctacaagagcagcctgtggc

SEQ ID NO: 3765062 - DNA, 21 bp, Homo sapiens
cctacaccattatcttggaaa

SEQ ID NO: 3765063 - DNA, 14 bp, Homo sapiens
cctaccacagtgtc

SEQ ID NO: 3765064 - DNA, 16 bp, Homo sapiens
cctaccacagtgtctg

SEQ ID NO: 3765065 - DNA, 13 bp, Homo sapiens
cctaccccaccac

SEQ ID NO: 3765066 - DNA, 14 bp, Homo sapiens
cctaccccaccacg

SEQ ID NO: 3765067 - DNA, 21 bp, Homo sapiens
cctaccgagtctcttctccac

SEQ ID NO: 3765068 - DNA, 23 bp, Homo sapiens
cctaccgagtctcttctccactg

SEQ ID NO: 3765069 - DNA, 21 bp, Homo sapiens
cctaccggcaatttccggcca

SEQ ID NO: 3765070 - DNA, 17 bp, Homo sapiens
cctacctcaacctgtaa

SEQ ID NO: 3765071 - DNA, 22 bp, Homo sapiens
cctacctcaacctgtaaattat

SEQ ID NO: 3765072 - DNA, 13 bp, Homo sapiens
cctacctcagcct

SEQ ID NO: 3765073 - DNA, 18 bp, Homo sapiens
cctacctcagcctagacc

SEQ ID NO: 3765074 - DNA, 16 bp, Homo sapiens
cctacctgtgcctgac

SEQ ID NO: 3765075 - DNA, 15 bp, Homo sapiens
cctaccttcaaagct

SEQ ID NO: 3765076 - DNA, 20 bp, Homo sapiens
cctacgtcaaacatgaagtg

SEQ ID NO: 3765077 - DNA, 17 bp, Homo sapiens
cctactacatcgccctc

SEQ ID NO: 3765078 - DNA, 17 bp, Homo sapiens
cctacttccaggttctg

SEQ ID NO: 3765079 - DNA, 13 bp, Homo sapiens
cctacttcctgtg

SEQ ID NO: 3765080 - DNA, 16 bp, Homo sapiens
cctacttcttttgctc

SEQ ID NO: 3765081 - DNA, 22 bp, Homo sapiens
cctacttcttttgctcttagct

SEQ ID NO: 3765082 - DNA, 16 bp, Homo sapiens
cctagaccctcctcct

SEQ ID NO: 3765083 - DNA, 15 bp, Homo sapiens
cctagccgacctcag

SEQ ID NO: 3765084 - DNA, 20 bp, Homo sapiens
cctagccgacctcagccttc

SEQ ID NO: 3765085 - DNA, 23 bp, Homo sapiens
cctagcctgtgcctctgggactg

SEQ ID NO: 3765086 - DNA, 11 bp, Homo sapiens
cctagctgtgt

SEQ ID NO: 3765087 - DNA, 17 bp, Homo sapiens
cctagctgtgtgcagtc

SEQ ID NO: 3765088 - DNA, 23 bp, Homo sapiens
cctaggacatgttcccttctcct

SEQ ID NO: 3765089 - DNA, 23 bp, Homo sapiens
cctaggccacaccatctcctttc

SEQ ID NO: 3765090 - DNA, 19 bp, Homo sapiens
cctaggccactcctccaaa

SEQ ID NO: 3765091 - DNA, 20 bp, Homo sapiens
cctaggccactcctccaaag

SEQ ID NO: 3765092 - DNA, 13 bp, Homo sapiens
cctaggcctggca

SEQ ID NO: 3765093 - DNA, 18 bp, Homo sapiens
cctaggctccaccccatc

SEQ ID NO: 3765094 - DNA, 16 bp, Homo sapiens
cctagggcctggtcca

SEQ ID NO: 3765095 - DNA, 14 bp, Homo sapiens
cctagggctgggtg

SEQ ID NO: 3765096 - DNA, 13 bp, Homo sapiens
cctaggtgacaga

SEQ ID NO: 3765097 - DNA, 14 bp, Homo sapiens
cctagtcagccaca

SEQ ID NO: 3765098 - DNA, 14 bp, Homo sapiens
cctagtcccttccc

SEQ ID NO: 3765099 - DNA, 23 bp, Homo sapiens
cctagtggggtctccctctcctg

SEQ ID NO: 3765100 - DNA, 24 bp, Homo sapiens
cctagtggggtctccctctcctgc

SEQ ID NO: 3765101 - DNA, 21 bp, Homo sapiens
cctagttcatccaatcctcac

SEQ ID NO: 3765102 - DNA, 13 bp, Homo sapiens
cctagttcttcat

SEQ ID NO: 3765103 - DNA, 16 bp, Homo sapiens
cctagtttgtgagaaa

SEQ ID NO: 3765104 - DNA, 17 bp, Homo sapiens
cctagtttgtgagaaac

SEQ ID NO: 3765105 - DNA, 15 bp, Homo sapiens
cctagttttctcctc

SEQ ID NO: 3765106 - DNA, 19 bp, Homo sapiens
cctagttttctcctcccag

SEQ ID NO: 3765107 - DNA, 13 bp, Homo sapiens
cctatagtcccag

SEQ ID NO: 3765108 - DNA, 16 bp, Homo sapiens
cctatatagtttattg

SEQ ID NO: 3765109 - DNA, 18 bp, Homo sapiens
cctatattgttttcagtg

SEQ ID NO: 3765110 - DNA, 18 bp, Homo sapiens
cctatcacctcccctcct

SEQ ID NO: 3765111 - DNA, 17 bp, Homo sapiens
cctatcagaagtttctc

SEQ ID NO: 3765112 - DNA, 13 bp, Homo sapiens
cctatcccatccc

SEQ ID NO: 3765113 - DNA, 14 bp, Homo sapiens
cctatcccatccca

SEQ ID NO: 3765114 - DNA, 18 bp, Homo sapiens
cctatcttttagttttag

SEQ ID NO: 3765115 - DNA, 15 bp, Homo sapiens
cctatgatcccagca

SEQ ID NO: 3765116 - DNA, 16 bp, Homo sapiens
cctcaacacctctgca

SEQ ID NO: 3765117 - DNA, 21 bp, Homo sapiens
cctcaaccctccctcagcccc

SEQ ID NO: 3765118 - DNA, 22 bp, Homo sapiens
cctcaaccctccctcagcccct

SEQ ID NO: 3765119 - DNA, 14 bp, Homo sapiens
cctcaacctgtaaa

SEQ ID NO: 3765120 - DNA, 13 bp, Homo sapiens
cctcaacctgtga

SEQ ID NO: 3765121 - DNA, 14 bp, Homo sapiens
cctcaacctgtgat

SEQ ID NO: 3765122 - DNA, 21 bp, Homo sapiens
cctcaactcacctaatgttta

SEQ ID NO: 3765123 - DNA, 21 bp, Homo sapiens
cctcaaggacaaagtctccag

SEQ ID NO: 3765124 - DNA, 23 bp, Homo sapiens
cctcaaggacaaagtctccagcc

SEQ ID NO: 3765125 - DNA, 12 bp, Homo sapiens
cctcaaggactt

SEQ ID NO: 3765126 - DNA, 22 bp, Homo sapiens
cctcaaggacttgaaagcatcc

SEQ ID NO: 3765127 - DNA, 23 bp, Homo sapiens
cctcacacacaatgtgtctgaga

SEQ ID NO: 3765128 - DNA, 17 bp, Homo sapiens
cctcaccccgtctgggg

SEQ ID NO: 3765129 - DNA, 17 bp, Homo sapiens
cctcacccctgccctgg

SEQ ID NO: 3765130 - DNA, 17 bp, Homo sapiens
cctcacctctgccattt

SEQ ID NO: 3765131 - DNA, 12 bp, Homo sapiens
cctcacctctgg

SEQ ID NO: 3765132 - DNA, 22 bp, Homo sapiens
cctcacctctggactggctaga

SEQ ID NO: 3765133 - DNA, 22 bp, Homo sapiens
cctcacctgggcacctggggag

SEQ ID NO: 3765134 - DNA, 17 bp, Homo sapiens
cctcacgcacctcccat

SEQ ID NO: 3765135 - DNA, 15 bp, Homo sapiens
cctcagagccccgca

SEQ ID NO: 3765136 - DNA, 17 bp, Homo sapiens
cctcagagtccaggccc

SEQ ID NO: 3765137 - DNA, 17 bp, Homo sapiens
cctcagcatcctggcac

SEQ ID NO: 3765138 - DNA, 16 bp, Homo sapiens
cctcagccatgaggag

SEQ ID NO: 3765139 - DNA, 14 bp, Homo sapiens
cctcagcccctctt

SEQ ID NO: 3765140 - DNA, 19 bp, Homo sapiens
cctcagcccctcttgcccc

SEQ ID NO: 3765141 - DNA, 20 bp, Homo sapiens
cctcagcctagaccctcctc

SEQ ID NO: 3765142 - DNA, 11 bp, Homo sapiens
cctcagcctcc

SEQ ID NO: 3765143 - DNA, 22 bp, Homo sapiens
cctcagcctcccaaagtgctgg

SEQ ID NO: 3765144 - DNA, 12 bp, Homo sapiens
cctcagcctgtg

SEQ ID NO: 3765145 - DNA, 16 bp, Homo sapiens
cctcagcctgtgctgc

SEQ ID NO: 3765146 - DNA, 14 bp, Homo sapiens
cctcagctgcctca

SEQ ID NO: 3765147 - DNA, 15 bp, Homo sapiens
cctcagctgcctcac

SEQ ID NO: 3765148 - DNA, 13 bp, Homo sapiens
cctcaggaccctc

SEQ ID NO: 3765149 - DNA, 19 bp, Homo sapiens
cctcaggaccctcgctggc

SEQ ID NO: 3765150 - DNA, 22 bp, Homo sapiens
cctcaggaccctcgctggcccc

SEQ ID NO: 3765151 - DNA, 13 bp, Homo sapiens
cctcaggcaggaa

SEQ ID NO: 3765152 - DNA, 19 bp, Homo sapiens
cctcaggcaggaagggcag

SEQ ID NO: 3765153 - DNA, 18 bp, Homo sapiens
cctcaggcataggcctgg

SEQ ID NO: 3765154 - DNA, 14 bp, Homo sapiens
cctcaggctgctgg

SEQ ID NO: 3765155 - DNA, 16 bp, Homo sapiens
cctcaggctgctggag

SEQ ID NO: 3765156 - DNA, 21 bp, Homo sapiens
cctcagggacagagacacctg

SEQ ID NO: 3765157 - DNA, 24 bp, Homo sapiens
cctcagggacagagacacctgcac

SEQ ID NO: 3765158 - DNA, 18 bp, Homo sapiens
cctcagggcagcctgcct

SEQ ID NO: 3765159 - DNA, 23 bp, Homo sapiens
cctcagggcagcctgcctggagt

SEQ ID NO: 3765160 - DNA, 20 bp, Homo sapiens
cctcaggtgagaagcagagg

SEQ ID NO: 3765161 - DNA, 19 bp, Homo sapiens
cctcaggtgatccacccac

SEQ ID NO: 3765162 - DNA, 19 bp, Homo sapiens
cctcaggtttgcctgaggg

SEQ ID NO: 3765163 - DNA, 11 bp, Homo sapiens
cctcagtgcca

SEQ ID NO: 3765164 - DNA, 18 bp, Homo sapiens
cctggccccatgtctctc

SEQ ID NO: 3765165 - DNA, 14 bp, Homo sapiens
cctggcccccagct

SEQ ID NO: 3765166 - DNA, 11 bp, Homo sapiens
cctggcctgtt

SEQ ID NO: 3765167 - DNA, 14 bp, Homo sapiens
cctggctacatccc

SEQ ID NO: 3765168 - DNA, 23 bp, Homo sapiens
cctggctcccacaggcccttcct

SEQ ID NO: 3765169 - DNA, 21 bp, Homo sapiens
cctggctcccatgaccatact

SEQ ID NO: 3765170 - DNA, 22 bp, Homo sapiens
cctggctcccatgaccatactg

SEQ ID NO: 3765171 - DNA, 21 bp, Homo sapiens
cctggctccgtccaggagcct

SEQ ID NO: 3765172 - DNA, 23 bp, Homo sapiens
cctggctcctgaggggcatctgc

SEQ ID NO: 3765173 - DNA, 17 bp, Homo sapiens
cctggctctgtggcttg

SEQ ID NO: 3765174 - DNA, 17 bp, Homo sapiens
cctggcttctggagccc

SEQ ID NO: 3765175 - DNA, 23 bp, Homo sapiens
cctggcttctggagcccttgggt

SEQ ID NO: 3765176 - DNA, 18 bp, Homo sapiens
cctggcttgtaactccac

SEQ ID NO: 3765177 - DNA, 20 bp, Homo sapiens
cctggcttgtaactccacca

SEQ ID NO: 3765178 - DNA, 17 bp, Homo sapiens
cctggctttgcccaacc

SEQ ID NO: 3765179 - DNA, 21 bp, Homo sapiens
cctggctttgcccaacctcag

SEQ ID NO: 3765180 - DNA, 16 bp, Homo sapiens
cctggcttttcactgc

SEQ ID NO: 3765181 - DNA, 23 bp, Homo sapiens
cctggcttttcactgctggctgc

SEQ ID NO: 3765182 - DNA, 20 bp, Homo sapiens
cctgggaaccttcctgtctt

SEQ ID NO: 3765183 - DNA, 16 bp, Homo sapiens
cctgggagtgagctgg

SEQ ID NO: 3765184 - DNA, 20 bp, Homo sapiens
cctgggcacctggggagtgg

SEQ ID NO: 3765185 - DNA, 13 bp, Homo sapiens
cctgggcagaaag

SEQ ID NO: 3765186 - DNA, 17 bp, Homo sapiens
cctgggcagccaggctg

SEQ ID NO: 3765187 - DNA, 23 bp, Homo sapiens
cctgggcagccaggctgccaagg

SEQ ID NO: 3765188 - DNA, 13 bp, Homo sapiens
cctgggccccacc

SEQ ID NO: 3765189 - DNA, 15 bp, Homo sapiens
cctgggccccaccac

SEQ ID NO: 3765190 - DNA, 15 bp, Homo sapiens
cctgggcccctccct

SEQ ID NO: 3765191 - DNA, 18 bp, Homo sapiens
cctgggcccctccctacc

SEQ ID NO: 3765192 - DNA, 12 bp, Homo sapiens
cctgggctctgc

SEQ ID NO: 3765193 - DNA, 14 bp, Homo sapiens
cctgggctctgccc

SEQ ID NO: 3765194 - DNA, 24 bp, Homo sapiens
cctgggctctgccccagctctggc

SEQ ID NO: 3765195 - DNA, 22 bp, Homo sapiens
cctgggctgagagaacctcacg

SEQ ID NO: 3765196 - DNA, 15 bp, Homo sapiens
cctggggagaaagta

SEQ ID NO: 3765197 - DNA, 23 bp, Homo sapiens
cctggggagtgggacagagtctg

SEQ ID NO: 3765198 - DNA, 22 bp, Homo sapiens
cctggggcctcggagcctcatc

SEQ ID NO: 3765199 - DNA, 20 bp, Homo sapiens
cctggggctaggctggagcc

SEQ ID NO: 3765200 - DNA, 22 bp, Homo sapiens
cctggggctaggctggagccca

SEQ ID NO: 3765201 - DNA, 18 bp, Homo sapiens
cctggggctctgtgcagg

SEQ ID NO: 3765202 - DNA, 18 bp, Homo sapiens
cctgggggaagccctgga

SEQ ID NO: 3765203 - DNA, 22 bp, Homo sapiens
cctgggggttctttcttcctct

SEQ ID NO: 3765204 - DNA, 15 bp, Homo sapiens
cctgggtctgtgtct

SEQ ID NO: 3765205 - DNA, 23 bp, Homo sapiens
cctgggtgctggctgcccagacc

SEQ ID NO: 3765206 - DNA, 16 bp, Homo sapiens
cctgggtggggctgct

SEQ ID NO: 3765207 - DNA, 21 bp, Homo sapiens
cctgggtggggctgctcctcc

SEQ ID NO: 3765208 - DNA, 18 bp, Homo sapiens
cctgggtggtctgcaggc

SEQ ID NO: 3765209 - DNA, 20 bp, Homo sapiens
cctgggtggtctgcaggcag

SEQ ID NO: 3765210 - DNA, 22 bp, Homo sapiens
cctgggtggtctgcaggcaggg

SEQ ID NO: 3765211 - DNA, 20 bp, Homo sapiens
cctgggttccaatcctggct

SEQ ID NO: 3765212 - DNA, 21 bp, Homo sapiens
cctggtatgggtttctcccag

SEQ ID NO: 3765213 - DNA, 14 bp, Homo sapiens
cctggtccagggaa

SEQ ID NO: 3765214 - DNA, 15 bp, Homo sapiens
cctggtccttccagg

SEQ ID NO: 3765215 - DNA, 13 bp, Homo sapiens
cctggtctcctgc

SEQ ID NO: 3765216 - DNA, 16 bp, Homo sapiens
cctggtctcctgcccc

SEQ ID NO: 3765217 - DNA, 22 bp, Homo sapiens
cctggtctcctgcccccacacc

SEQ ID NO: 3765218 - DNA, 9 bp, Homo sapiens
cctggtgct

SEQ ID NO: 3765219 - DNA, 19 bp, Homo sapiens
cctggtggacagtcctggg

SEQ ID NO: 3765220 - DNA, 18 bp, Homo sapiens
cctggtggcagtgggagc

SEQ ID NO: 3765221 - DNA, 19 bp, Homo sapiens
cctggtggcagtgggagct

SEQ ID NO: 3765222 - DNA, 20 bp, Homo sapiens
cctggtggcagtgggagctg

SEQ ID NO: 3765223 - DNA, 21 bp, Homo sapiens
cctggtggcagtgggagctgc

SEQ ID NO: 3765224 - DNA, 17 bp, Homo sapiens
cctggtggcctctgccc

SEQ ID NO: 3765225 - DNA, 20 bp, Homo sapiens
cctggtgggcctcctctgtc

SEQ ID NO: 3765226 - DNA, 18 bp, Homo sapiens
cctggtttcactggccca

SEQ ID NO: 3765227 - DNA, 17 bp, Homo sapiens
cctgtaaattattttaa

SEQ ID NO: 3765228 - DNA, 15 bp, Homo sapiens
cctgtaatcccagca

SEQ ID NO: 3765229 - DNA, 23 bp, Homo sapiens
cctgtaatcccagcactttggga

SEQ ID NO: 3765230 - DNA, 15 bp, Homo sapiens
cctgtacaatattta

SEQ ID NO: 3765231 - DNA, 12 bp, Homo sapiens
cctgtacttttt

SEQ ID NO: 3765232 - DNA, 22 bp, Homo sapiens
cctgtagacctagggaggacct

SEQ ID NO: 3765233 - DNA, 15 bp, Homo sapiens
cctgtagagtgggag

SEQ ID NO: 3765234 - DNA, 16 bp, Homo sapiens
cctgtagagtgggagc

SEQ ID NO: 3765235 - DNA, 16 bp, Homo sapiens
cctgtagtcccagcta

SEQ ID NO: 3765236 - DNA, 15 bp, Homo sapiens
cctgtagttaggaaa

SEQ ID NO: 3765237 - DNA, 19 bp, Homo sapiens
cctgtcaaacaaagccaga

SEQ ID NO: 3765238 - DNA, 22 bp, Homo sapiens
cctgtcaaacaaagccagaagc

SEQ ID NO: 3765239 - DNA, 23 bp, Homo sapiens
cctgtcaaacaaagccagaagct

SEQ ID NO: 3765240 - DNA, 14 bp, Homo sapiens
cctgtcaccaagct

SEQ ID NO: 3765241 - DNA, 19 bp, Homo sapiens
cctgtccaaactgcctaag

SEQ ID NO: 3765242 - DNA, 23 bp, Homo sapiens
cctgtccaaactgcctaagccct

SEQ ID NO: 3765243 - DNA, 23 bp, Homo sapiens
cctgtccaacctaacccctttcc

SEQ ID NO: 3765244 - DNA, 12 bp, Homo sapiens
cctgtcccacct

SEQ ID NO: 3765245 - DNA, 13 bp, Homo sapiens
cctgtcccacctc

SEQ ID NO: 3765246 - DNA, 14 bp, Homo sapiens
cctgtcccacctca

SEQ ID NO: 3765247 - DNA, 22 bp, Homo sapiens
cctgtccccctgagatcagagt

SEQ ID NO: 3765248 - DNA, 22 bp, Homo sapiens
cctgtccctctcaggcatgcct

SEQ ID NO: 3765249 - DNA, 15 bp, Homo sapiens
cctgtccgccctctt

SEQ ID NO: 3765250 - DNA, 12 bp, Homo sapiens
cctgtccttgca

SEQ ID NO: 3765251 - DNA, 18 bp, Homo sapiens
cctgtcgtgccagtcctg

SEQ ID NO: 3765252 - DNA, 21 bp, Homo sapiens
cctgtctaggtcagtacccac

SEQ ID NO: 3765253 - DNA, 14 bp, Homo sapiens
cctgtctcagcctc

SEQ ID NO: 3765254 - DNA, 15 bp, Homo sapiens
cctgtctcagcctcc

SEQ ID NO: 3765255 - DNA, 16 bp, Homo sapiens
cctgtctcagcctccc

SEQ ID NO: 3765256 - DNA, 17 bp, Homo sapiens
cctgtctcatccccagg

SEQ ID NO: 3765257 - DNA, 18 bp, Homo sapiens
cctgtctcatccccaggg

SEQ ID NO: 3765258 - DNA, 15 bp, Homo sapiens
cctgtctcccctctg

SEQ ID NO: 3765259 - DNA, 17 bp, Homo sapiens
cctgtctcccctctgct

SEQ ID NO: 3765260 - DNA, 19 bp, Homo sapiens
cctgtctcccctctgctgg

SEQ ID NO: 3765261 - DNA, 21 bp, Homo sapiens
cctgtctcctttgcaggctca

SEQ ID NO: 3765262 - DNA, 14 bp, Homo sapiens
cctgtctgccagcc

SEQ ID NO: 3765263 - DNA, 19 bp, Homo sapiens
cctgtcttcctgcattcac

SEQ ID NO: 3765264 - DNA, 19 bp, Homo sapiens
cctgtgaaatagttcaaag

SEQ ID NO: 3765265 - DNA, 16 bp, Homo sapiens
cctgtgaccagcactg

SEQ ID NO: 3765266 - DNA, 17 bp, Homo sapiens
cctgtgaggcaggggcg

SEQ ID NO: 3765267 - DNA, 21 bp, Homo sapiens
cctgtgccacccaccagggcg

SEQ ID NO: 3765268 - DNA, 15 bp, Homo sapiens
cctgtgcctcctcac

SEQ ID NO: 3765269 - DNA, 20 bp, Homo sapiens
cctgtgcctcctcaccccca

SEQ ID NO: 3765270 - DNA, 21 bp, Homo sapiens
cctgtgcctcctcacccccag

SEQ ID NO: 3765271 - DNA, 15 bp, Homo sapiens
cctgtgcctctggga

SEQ ID NO: 3765272 - DNA, 17 bp, Homo sapiens
cctgtgcctctgggact

SEQ ID NO: 3765273 - DNA, 20 bp, Homo sapiens
cctgtgcctctgggactgga

SEQ ID NO: 3765274 - DNA, 13 bp, Homo sapiens
cctgtgctagttt

SEQ ID NO: 3765275 - DNA, 18 bp, Homo sapiens
cctgtggagcccgcaccc

SEQ ID NO: 3765276 - DNA, 16 bp, Homo sapiens
cgggggctgaggggca

SEQ ID NO: 3765277 - DNA, 11 bp, Homo sapiens
cggggggaggg

SEQ ID NO: 3765278 - DNA, 22 bp, Homo sapiens
cggggggagggttggggagggg

SEQ ID NO: 3765279 - DNA, 19 bp, Homo sapiens
cgggtggatcacctgaggt

SEQ ID NO: 3765280 - DNA, 19 bp, Homo sapiens
cggtcccttgagacctcag

SEQ ID NO: 3765281 - DNA, 21 bp, Homo sapiens
cggtgagaggggaacagactg

SEQ ID NO: 3765282 - DNA, 20 bp, Homo sapiens
cggtggctcacgcctgtaat

SEQ ID NO: 3765283 - DNA, 22 bp, Homo sapiens
cggtggttgttggggcttcttg

SEQ ID NO: 3765284 - DNA, 15 bp, Homo sapiens
cggtgtccatttata

SEQ ID NO: 3765285 - DNA, 17 bp, Homo sapiens
cggtgtgcctgcagccc

SEQ ID NO: 3765286 - DNA, 16 bp, Homo sapiens
cggtgtgggctgtgtc

SEQ ID NO: 3765287 - DNA, 14 bp, Homo sapiens
cggttcaccagcct

SEQ ID NO: 3765288 - DNA, 15 bp, Homo sapiens
cggttcaccagcctc

SEQ ID NO: 3765289 - DNA, 15 bp, Homo sapiens
cggttgcttctggga

SEQ ID NO: 3765290 - DNA, 17 bp, Homo sapiens
cgtacattcaatgttta

SEQ ID NO: 3765291 - DNA, 22 bp, Homo sapiens
cgtagaatctgtgtagacgaag

SEQ ID NO: 3765292 - DNA, 17 bp, Homo sapiens
cgtagtagggtcaggcc

SEQ ID NO: 3765293 - DNA, 15 bp, Homo sapiens
cgtattggtccagct

SEQ ID NO: 3765294 - DNA, 20 bp, Homo sapiens
cgtcacagtgtggggaagcc

SEQ ID NO: 3765295 - DNA, 22 bp, Homo sapiens
cgtcacagtgtggggaagccca

SEQ ID NO: 3765296 - DNA, 18 bp, Homo sapiens
cgtcaccatctcaggcca

SEQ ID NO: 3765297 - DNA, 20 bp, Homo sapiens
cgtcaccatctcaggccacc

SEQ ID NO: 3765298 - DNA, 21 bp, Homo sapiens
cgtcaccatctcaggccacct

SEQ ID NO: 3765299 - DNA, 17 bp, Homo sapiens
cgtcagtatcaggcctg

SEQ ID NO: 3765300 - DNA, 15 bp, Homo sapiens
cgtcatgttcctcaa

SEQ ID NO: 3765301 - DNA, 22 bp, Homo sapiens
cgtcctccccctgccagtgcct

SEQ ID NO: 3765302 - DNA, 20 bp, Homo sapiens
cgtcctgccacctggggcag

SEQ ID NO: 3765303 - DNA, 13 bp, Homo sapiens
cgtctgacaggca

SEQ ID NO: 3765304 - DNA, 22 bp, Homo sapiens
cgtctgacaggcaatgctggct

SEQ ID NO: 3765305 - DNA, 17 bp, Homo sapiens
cgtgaagtatactgtat

SEQ ID NO: 3765306 - DNA, 16 bp, Homo sapiens
cgtgacagtgcctggg

SEQ ID NO: 3765307 - DNA, 14 bp, Homo sapiens
cgtgactcacccaa

SEQ ID NO: 3765308 - DNA, 18 bp, Homo sapiens
cgtgactcacccaagcat

SEQ ID NO: 3765309 - DNA, 23 bp, Homo sapiens
cgtgactgtattatacatgggta

SEQ ID NO: 3765310 - DNA, 12 bp, Homo sapiens
cgtgagaagcat

SEQ ID NO: 3765311 - DNA, 23 bp, Homo sapiens
cgtgagagtgtcttcacggcagg

SEQ ID NO: 3765312 - DNA, 20 bp, Homo sapiens
cgtgagccactgcaccgggc

SEQ ID NO: 3765313 - DNA, 19 bp, Homo sapiens
cgtgaggatgtcactcaga

SEQ ID NO: 3765314 - DNA, 18 bp, Homo sapiens
cgtgcaaaacatgctacc

SEQ ID NO: 3765315 - DNA, 14 bp, Homo sapiens
cgtgcacacaccag

SEQ ID NO: 3765316 - DNA, 19 bp, Homo sapiens
cgtgcacacaccagagccc

SEQ ID NO: 3765317 - DNA, 22 bp, Homo sapiens
cgtgcacacaccagagcccacc

SEQ ID NO: 3765318 - DNA, 17 bp, Homo sapiens
cgtgcacgtggagagct

SEQ ID NO: 3765319 - DNA, 20 bp, Homo sapiens
cgtgcacgtggagagctggt

SEQ ID NO: 3765320 - DNA, 14 bp, Homo sapiens
cgtgcactctgcta

SEQ ID NO: 3765321 - DNA, 21 bp, Homo sapiens
cgtgcagtggtgcgatctggg

SEQ ID NO: 3765322 - DNA, 10 bp, Homo sapiens
cgtgccctct

SEQ ID NO: 3765323 - DNA, 15 bp, Homo sapiens
cgtgccttcagctct

SEQ ID NO: 3765324 - DNA, 17 bp, Homo sapiens
cgtggagagctggtgcc

SEQ ID NO: 3765325 - DNA, 12 bp, Homo sapiens
cgtggagaggga

SEQ ID NO: 3765326 - DNA, 15 bp, Homo sapiens
cgtggagccagggag

SEQ ID NO: 3765327 - DNA, 15 bp, Homo sapiens
cgtggcccagagaag

SEQ ID NO: 3765328 - DNA, 17 bp, Homo sapiens
cgtggctgacccccctc

SEQ ID NO: 3765329 - DNA, 21 bp, Homo sapiens
cgtggctgcccacacacccca

SEQ ID NO: 3765330 - DNA, 21 bp, Homo sapiens
cgtggcttcccgctcagccct

SEQ ID NO: 3765331 - DNA, 14 bp, Homo sapiens
cgtggcttctgatg

SEQ ID NO: 3765332 - DNA, 21 bp, Homo sapiens
cgtggcttctgatgaatcttg

SEQ ID NO: 3765333 - DNA, 18 bp, Homo sapiens
cgtggggcagcacagaga

SEQ ID NO: 3765334 - DNA, 20 bp, Homo sapiens
cgtggggcagcacagagagg

SEQ ID NO: 3765335 - DNA, 21 bp, Homo sapiens
cgtggtgatcaattaaatgta

SEQ ID NO: 3765336 - DNA, 15 bp, Homo sapiens
cgtggtgatttagca

SEQ ID NO: 3765337 - DNA, 18 bp, Homo sapiens
cgtgtgcacacacaccac

SEQ ID NO: 3765338 - DNA, 16 bp, Homo sapiens
cgtgtgtgttgtctga

SEQ ID NO: 3765339 - DNA, 11 bp, Homo sapiens
cgttaacattg

SEQ ID NO: 3765340 - DNA, 17 bp, Homo sapiens
cgttaactgtgtatgta

SEQ ID NO: 3765341 - DNA, 14 bp, Homo sapiens
cgttaccaggcagg

SEQ ID NO: 3765342 - DNA, 17 bp, Homo sapiens
cgttagggaagagaaac

SEQ ID NO: 3765343 - DNA, 12 bp, Homo sapiens
cgttcatttgtg

SEQ ID NO: 3765344 - DNA, 18 bp, Homo sapiens
cgttgaagaggaagggca

SEQ ID NO: 3765345 - DNA, 17 bp, Homo sapiens
cgttggaattaaaacaa

SEQ ID NO: 3765346 - DNA, 13 bp, Homo sapiens
cgtttaaagttct

SEQ ID NO: 3765347 - DNA, 9 bp, Homo sapiens
cgtttgttt

SEQ ID NO: 3765348 - DNA, 13 bp, Homo sapiens
cgtttgtttgttt

SEQ ID NO: 3765349 - DNA, 15 bp, Homo sapiens
cgttttggaagctct

SEQ ID NO: 3765350 - DNA, 14 bp, Homo sapiens
cgttttgtttgaaa

SEQ ID NO: 3765351 - DNA, 15 bp, Homo sapiens
cgtttttttcattcc

SEQ ID NO: 3765352 - DNA, 11 bp, Homo sapiens
ctaaaaaacag

SEQ ID NO: 3765353 - DNA, 17 bp, Homo sapiens
ctaaaaaacagaggcca

SEQ ID NO: 3765354 - DNA, 23 bp, Homo sapiens
ctaaaaggtatgcaatcaaatct

SEQ ID NO: 3765355 - DNA, 22 bp, Homo sapiens
ctaaaagttcataacagtgcca

SEQ ID NO: 3765356 - DNA, 13 bp, Homo sapiens
ctaaaatagccac

SEQ ID NO: 3765357 - DNA, 23 bp, Homo sapiens
ctaaaatatttattttttttaag

SEQ ID NO: 3765358 - DNA, 20 bp, Homo sapiens
ctaaacgagtcaatcccctc

SEQ ID NO: 3765359 - DNA, 17 bp, Homo sapiens
ctaaactttaatatgta

SEQ ID NO: 3765360 - DNA, 18 bp, Homo sapiens
ctaaagagagaatgtaga

SEQ ID NO: 3765361 - DNA, 13 bp, Homo sapiens
ctaaagcaggcct

SEQ ID NO: 3765362 - DNA, 18 bp, Homo sapiens
ctaaagcagtggacacca

SEQ ID NO: 3765363 - DNA, 14 bp, Homo sapiens
ctaaaggaaaaaac

SEQ ID NO: 3765364 - DNA, 13 bp, Homo sapiens
ctaaaggcctctt

SEQ ID NO: 3765365 - DNA, 21 bp, Homo sapiens
ctaaagtaaaaagggaattat

SEQ ID NO: 3765366 - DNA, 23 bp, Homo sapiens
ctaaataaagcttgcaacaaaat

SEQ ID NO: 3765367 - DNA, 15 bp, Homo sapiens
ctaaatatttcctta

SEQ ID NO: 3765368 - DNA, 21 bp, Homo sapiens
ctaaatcctttactgttagtc

SEQ ID NO: 3765369 - DNA, 16 bp, Homo sapiens
ctaaatctcctatttt

SEQ ID NO: 3765370 - DNA, 18 bp, Homo sapiens
ctaaatctgtaagctctt

SEQ ID NO: 3765371 - DNA, 12 bp, Homo sapiens
ctaaatgaatgt

SEQ ID NO: 3765372 - DNA, 14 bp, Homo sapiens
ctaaatgaatgttt

SEQ ID NO: 3765373 - DNA, 13 bp, Homo sapiens
ctaaatgccctgc

SEQ ID NO: 3765374 - DNA, 18 bp, Homo sapiens
ctaaatggtcgcccagga

SEQ ID NO: 3765375 - DNA, 20 bp, Homo sapiens
ctaaatggtcgcccaggaga

SEQ ID NO: 3765376 - DNA, 14 bp, Homo sapiens
ctaaatttcttcct

SEQ ID NO: 3765377 - DNA, 15 bp, Homo sapiens
ctaaatttcttccta

SEQ ID NO: 3765378 - DNA, 16 bp, Homo sapiens
ctaacaaccaaagact

SEQ ID NO: 3765379 - DNA, 17 bp, Homo sapiens
ctaacacagcatgtgta

SEQ ID NO: 3765380 - DNA, 17 bp, Homo sapiens
ctaacacatttttaaag

SEQ ID NO: 3765381 - DNA, 17 bp, Homo sapiens
ctaacagataagcaaga

SEQ ID NO: 3765382 - DNA, 15 bp, Homo sapiens
ctaacaggggctggt

SEQ ID NO: 3765383 - DNA, 23 bp, Homo sapiens
ctaacatataatgttgttattta

SEQ ID NO: 3765384 - DNA, 15 bp, Homo sapiens
ctaacattatattgc

SEQ ID NO: 3765385 - DNA, 16 bp, Homo sapiens
ctaacattatattgca

SEQ ID NO: 3765386 - DNA, 14 bp, Homo sapiens
ctaaccacacagcc

SEQ ID NO: 3765387 - DNA, 14 bp, Homo sapiens
ctaaccacgctgga

SEQ ID NO: 3765388 - DNA, 17 bp, Homo sapiens
ctaaccacgctggacct

SEQ ID NO: 3765389 - DNA, 21 bp, Homo sapiens
ctaaccagggaagctgtccct

SEQ ID NO: 3765390 - DNA, 14 bp, Homo sapiens
ctcacttcaccctg

SEQ ID NO: 3765391 - DNA, 17 bp, Homo sapiens
ctcagaacacattcttt

SEQ ID NO: 3765392 - DNA, 15 bp, Homo sapiens
ctcagaagcctgagg

SEQ ID NO: 3765393 - DNA, 16 bp, Homo sapiens
ctcagaagcctgaggc

SEQ ID NO: 3765394 - DNA, 18 bp, Homo sapiens
ctcagaagcctgaggctg

SEQ ID NO: 3765395 - DNA, 16 bp, Homo sapiens
ctcagaatctcaaata

SEQ ID NO: 3765396 - DNA, 19 bp, Homo sapiens
ctcagaatctttccttcct

SEQ ID NO: 3765397 - DNA, 22 bp, Homo sapiens
ctcagacaggaaagggaaggcc

SEQ ID NO: 3765398 - DNA, 14 bp, Homo sapiens
ctcagacccccact

SEQ ID NO: 3765399 - DNA, 22 bp, Homo sapiens
ctcagacccccactctcattcc

SEQ ID NO: 3765400 - DNA, 23 bp, Homo sapiens
ctcagacccccactctcattccc

SEQ ID NO: 3765401 - DNA, 17 bp, Homo sapiens
ctcagactcatacagaa

SEQ ID NO: 3765402 - DNA, 13 bp, Homo sapiens
ctcagactgctca

SEQ ID NO: 3765403 - DNA, 23 bp, Homo sapiens
ctcagagaatttctaccatttca

SEQ ID NO: 3765404 - DNA, 18 bp, Homo sapiens
ctcagagggttgttctcc

SEQ ID NO: 3765405 - DNA, 18 bp, Homo sapiens
ctcagagtccaggcccca

SEQ ID NO: 3765406 - DNA, 21 bp, Homo sapiens
ctcagatgcacatgagctggc

SEQ ID NO: 3765407 - DNA, 13 bp, Homo sapiens
ctcagcagccctc

SEQ ID NO: 3765408 - DNA, 14 bp, Homo sapiens
ctcagcagccctcc

SEQ ID NO: 3765409 - DNA, 16 bp, Homo sapiens
ctcagcagccctcctc

SEQ ID NO: 3765410 - DNA, 17 bp, Homo sapiens
ctcagcagccctcctca

SEQ ID NO: 3765411 - DNA, 18 bp, Homo sapiens
ctcagcagccctcctcac

SEQ ID NO: 3765412 - DNA, 20 bp, Homo sapiens
ctcagccaaccttacttaca

SEQ ID NO: 3765413 - DNA, 16 bp, Homo sapiens
ctcagcccacccccct

SEQ ID NO: 3765414 - DNA, 19 bp, Homo sapiens
ctcagcccacccccctcat

SEQ ID NO: 3765415 - DNA, 11 bp, Homo sapiens
ctcagccccag

SEQ ID NO: 3765416 - DNA, 15 bp, Homo sapiens
ctcagccccagccca

SEQ ID NO: 3765417 - DNA, 16 bp, Homo sapiens
ctcagccccagcccag

SEQ ID NO: 3765418 - DNA, 13 bp, Homo sapiens
ctcagcccctctt

SEQ ID NO: 3765419 - DNA, 14 bp, Homo sapiens
ctcagccctccctg

SEQ ID NO: 3765420 - DNA, 20 bp, Homo sapiens
ctcagccctccctgcccctc

SEQ ID NO: 3765421 - DNA, 11 bp, Homo sapiens
ctcagccctgg

SEQ ID NO: 3765422 - DNA, 13 bp, Homo sapiens
ctcagcctcccag

SEQ ID NO: 3765423 - DNA, 20 bp, Homo sapiens
ctcagcctcccagagtgctg

SEQ ID NO: 3765424 - DNA, 22 bp, Homo sapiens
ctcagcctcccgaatagctggg

SEQ ID NO: 3765425 - DNA, 23 bp, Homo sapiens
ctcagcctcccgaatagctggga

SEQ ID NO: 3765426 - DNA, 15 bp, Homo sapiens
ctcagcctcctgtgt

SEQ ID NO: 3765427 - DNA, 15 bp, Homo sapiens
ctcagccttggataa

SEQ ID NO: 3765428 - DNA, 14 bp, Homo sapiens
ctcagcgaatgaat

SEQ ID NO: 3765429 - DNA, 16 bp, Homo sapiens
ctcagcggggacagct

SEQ ID NO: 3765430 - DNA, 23 bp, Homo sapiens
ctcagcggggacagctccttctg

SEQ ID NO: 3765431 - DNA, 15 bp, Homo sapiens
ctcagctcccaaggc

SEQ ID NO: 3765432 - DNA, 15 bp, Homo sapiens
ctcagctctggctca

SEQ ID NO: 3765433 - DNA, 18 bp, Homo sapiens
ctcagctgcctcacttcc

SEQ ID NO: 3765434 - DNA, 21 bp, Homo sapiens
ctcaggaccctcgctggcccc

SEQ ID NO: 3765435 - DNA, 16 bp, Homo sapiens
ctcaggactccagccc

SEQ ID NO: 3765436 - DNA, 17 bp, Homo sapiens
ctcaggactccagccca

SEQ ID NO: 3765437 - DNA, 15 bp, Homo sapiens
ctcaggactcctctc

SEQ ID NO: 3765438 - DNA, 16 bp, Homo sapiens
ctcaggactcctctcc

SEQ ID NO: 3765439 - DNA, 13 bp, Homo sapiens
ctcaggaggctga

SEQ ID NO: 3765440 - DNA, 17 bp, Homo sapiens
ctcaggaggctgaggca

SEQ ID NO: 3765441 - DNA, 23 bp, Homo sapiens
ctcaggagtttgagaccaacctg

SEQ ID NO: 3765442 - DNA, 15 bp, Homo sapiens
ctcaggcaggtggga

SEQ ID NO: 3765443 - DNA, 18 bp, Homo sapiens
ctcaggcaggtgggatgg

SEQ ID NO: 3765444 - DNA, 17 bp, Homo sapiens
ctcaggcatcattccac

SEQ ID NO: 3765445 - DNA, 18 bp, Homo sapiens
ctcaggcatcattccacc

SEQ ID NO: 3765446 - DNA, 19 bp, Homo sapiens
ctcaggccaacaagccaac

SEQ ID NO: 3765447 - DNA, 19 bp, Homo sapiens
ctcaggccacctgccccct

SEQ ID NO: 3765448 - DNA, 23 bp, Homo sapiens
ctcaggccacctgcccccttctc

SEQ ID NO: 3765449 - DNA, 20 bp, Homo sapiens
ctcaggcgatccacctgtct

SEQ ID NO: 3765450 - DNA, 21 bp, Homo sapiens
ctcaggcgatccacctgtctc

SEQ ID NO: 3765451 - DNA, 16 bp, Homo sapiens
ctcaggctgctggagg

SEQ ID NO: 3765452 - DNA, 17 bp, Homo sapiens
ctcaggcttccttggca

SEQ ID NO: 3765453 - DNA, 20 bp, Homo sapiens
ctcagggaagcccagctcca

SEQ ID NO: 3765454 - DNA, 19 bp, Homo sapiens
ctcagggacagagacacct

SEQ ID NO: 3765455 - DNA, 23 bp, Homo sapiens
ctcagggacagagacacctgcac

SEQ ID NO: 3765456 - DNA, 20 bp, Homo sapiens
ctcagggcagcctgcctgga

SEQ ID NO: 3765457 - DNA, 13 bp, Homo sapiens
ctcagggccccag

SEQ ID NO: 3765458 - DNA, 18 bp, Homo sapiens
ctcagggccccagcacta

SEQ ID NO: 3765459 - DNA, 14 bp, Homo sapiens
ctcagggcctggtc

SEQ ID NO: 3765460 - DNA, 15 bp, Homo sapiens
ctcagggcctggtcg

SEQ ID NO: 3765461 - DNA, 16 bp, Homo sapiens
ctcagggctgacacgt

SEQ ID NO: 3765462 - DNA, 17 bp, Homo sapiens
ctcaggggcgtgtggct

SEQ ID NO: 3765463 - DNA, 16 bp, Homo sapiens
ctcaggtacagagaag

SEQ ID NO: 3765464 - DNA, 19 bp, Homo sapiens
ctcaggtacagagaaggaa

SEQ ID NO: 3765465 - DNA, 21 bp, Homo sapiens
ctcaggtacagagaaggaatg

SEQ ID NO: 3765466 - DNA, 17 bp, Homo sapiens
ctcaggtccctgcaggg

SEQ ID NO: 3765467 - DNA, 22 bp, Homo sapiens
ctcaggtgatccacccacctca

SEQ ID NO: 3765468 - DNA, 23 bp, Homo sapiens
ctcaggtgatccacccacctcag

SEQ ID NO: 3765469 - DNA, 16 bp, Homo sapiens
ctcaggtgtccctgca

SEQ ID NO: 3765470 - DNA, 17 bp, Homo sapiens
ctcaggtgtccctgcac

SEQ ID NO: 3765471 - DNA, 19 bp, Homo sapiens
ctcaggttgtagtaaagaa

SEQ ID NO: 3765472 - DNA, 22 bp, Homo sapiens
ctcaggttgtagtaaagaaatt

SEQ ID NO: 3765473 - DNA, 17 bp, Homo sapiens
ctcagtccacctgagct

SEQ ID NO: 3765474 - DNA, 14 bp, Homo sapiens
ctcagtctcaggag

SEQ ID NO: 3765475 - DNA, 17 bp, Homo sapiens
ctcagtctggcccttcc

SEQ ID NO: 3765476 - DNA, 18 bp, Homo sapiens
ctcagtctggcccttcct

SEQ ID NO: 3765477 - DNA, 20 bp, Homo sapiens
ctcagtcttccctagggctg

SEQ ID NO: 3765478 - DNA, 22 bp, Homo sapiens
ctcagtggactttccaccccct

SEQ ID NO: 3765479 - DNA, 14 bp, Homo sapiens
ctcagtgtcattta

SEQ ID NO: 3765480 - DNA, 21 bp, Homo sapiens
ctcagttcctgcagcagagcc

SEQ ID NO: 3765481 - DNA, 17 bp, Homo sapiens
ctcagttttatcatttt

SEQ ID NO: 3765482 - DNA, 18 bp, Homo sapiens
ctcagttttatcattttc

SEQ ID NO: 3765483 - DNA, 22 bp, Homo sapiens
ctcatactcacctcaccccact

SEQ ID NO: 3765484 - DNA, 20 bp, Homo sapiens
ctcatagccccggtgtgcgg

SEQ ID NO: 3765485 - DNA, 19 bp, Homo sapiens
ctcatagggaagacctgct

SEQ ID NO: 3765486 - DNA, 20 bp, Homo sapiens
ctcatagtatggtggctggg

SEQ ID NO: 3765487 - DNA, 19 bp, Homo sapiens
ctcatatatatctatctta

SEQ ID NO: 3765488 - DNA, 20 bp, Homo sapiens
ctcatattcctgcagcctgg

SEQ ID NO: 3765489 - DNA, 23 bp, Homo sapiens
ctcatccccaggggtcccagcca

SEQ ID NO: 3765490 - DNA, 17 bp, Homo sapiens
ctcatccgaggcagggt

SEQ ID NO: 3765491 - DNA, 14 bp, Homo sapiens
ctcatcctgcaggc

SEQ ID NO: 3765492 - DNA, 22 bp, Homo sapiens
ctcatgaggggcccgagcagaa

SEQ ID NO: 3765493 - DNA, 12 bp, Homo sapiens
ctcatgggcccc

SEQ ID NO: 3765494 - DNA, 20 bp, Homo sapiens
ctcatggtccccatggcatg

SEQ ID NO: 3765495 - DNA, 23 bp, Homo sapiens
ctcatggtgaggcttaacaatgt

SEQ ID NO: 3765496 - DNA, 16 bp, Homo sapiens
ctcattacggctcctc

SEQ ID NO: 3765497 - DNA, 12 bp, Homo sapiens
ctcattccccag

SEQ ID NO: 3765498 - DNA, 13 bp, Homo sapiens
ctcattcctgcct

SEQ ID NO: 3765499 - DNA, 17 bp, Homo sapiens
ctcattcctgcctgtct

SEQ ID NO: 3765500 - DNA, 12 bp, Homo sapiens
ctcattcttctg

SEQ ID NO: 3765501 - DNA, 14 bp, Homo sapiens
ctcattcttctgta

SEQ ID NO: 3765502 - DNA, 18 bp, Homo sapiens
ctcatttgtcacacactt

SEQ ID NO: 3765503 - DNA, 15 bp, Homo sapiens
ctctgcattctagta

SEQ ID NO: 3765504 - DNA, 10 bp, Homo sapiens
ctctgccacc

SEQ ID NO: 3765505 - DNA, 12 bp, Homo sapiens
ctctgccacctc

SEQ ID NO: 3765506 - DNA, 13 bp, Homo sapiens
ctctgcccagagc

SEQ ID NO: 3765507 - DNA, 15 bp, Homo sapiens
ctctgcccagagctg

SEQ ID NO: 3765508 - DNA, 14 bp, Homo sapiens
ctctgcccattccc

SEQ ID NO: 3765509 - DNA, 18 bp, Homo sapiens
ctctgcccattccccagc

SEQ ID NO: 3765510 - DNA, 19 bp, Homo sapiens
ctctgcccattccccagcc

SEQ ID NO: 3765511 - DNA, 17 bp, Homo sapiens
ctctgccccagctctgg

SEQ ID NO: 3765512 - DNA, 18 bp, Homo sapiens
ctctgccccagctctggc

SEQ ID NO: 3765513 - DNA, 21 bp, Homo sapiens
ctctgccccagctctggcttc

SEQ ID NO: 3765514 - DNA, 20 bp, Homo sapiens
ctctgccctccctccttcct

SEQ ID NO: 3765515 - DNA, 17 bp, Homo sapiens
ctctgccctgccctagc

SEQ ID NO: 3765516 - DNA, 16 bp, Homo sapiens
ctctgcctgcattctg

SEQ ID NO: 3765517 - DNA, 22 bp, Homo sapiens
ctctgcctgcattctgccgtgt

SEQ ID NO: 3765518 - DNA, 13 bp, Homo sapiens
ctctgcctgtccc

SEQ ID NO: 3765519 - DNA, 19 bp, Homo sapiens
ctctgcctgtccctctcag

SEQ ID NO: 3765520 - DNA, 20 bp, Homo sapiens
ctctgcctgtccctctcagg

SEQ ID NO: 3765521 - DNA, 20 bp, Homo sapiens
ctctgcctgtgagccagtct

SEQ ID NO: 3765522 - DNA, 13 bp, Homo sapiens
ctctgctccacca

SEQ ID NO: 3765523 - DNA, 15 bp, Homo sapiens
ctctgctccaccaca

SEQ ID NO: 3765524 - DNA, 18 bp, Homo sapiens
ctctgctccaccacatcc

SEQ ID NO: 3765525 - DNA, 14 bp, Homo sapiens
ctctgctgaaggtt

SEQ ID NO: 3765526 - DNA, 14 bp, Homo sapiens
ctctgctgacagac

SEQ ID NO: 3765527 - DNA, 17 bp, Homo sapiens
ctctgctgacagacaca

SEQ ID NO: 3765528 - DNA, 20 bp, Homo sapiens
ctctgctgacagacacaggc

SEQ ID NO: 3765529 - DNA, 22 bp, Homo sapiens
ctctgctgacagacacaggccc

SEQ ID NO: 3765530 - DNA, 23 bp, Homo sapiens
ctctgctgacagacacaggcccg

SEQ ID NO: 3765531 - DNA, 15 bp, Homo sapiens
ctctgctgccatggc

SEQ ID NO: 3765532 - DNA, 20 bp, Homo sapiens
ctctgctggccgggcacagc

SEQ ID NO: 3765533 - DNA, 21 bp, Homo sapiens
ctctgctggccgggcacagct

SEQ ID NO: 3765534 - DNA, 16 bp, Homo sapiens
ctctgctggtcttcaa

SEQ ID NO: 3765535 - DNA, 17 bp, Homo sapiens
ctctgctggtcttcaat

SEQ ID NO: 3765536 - DNA, 15 bp, Homo sapiens
ctctgcttcagcttg

SEQ ID NO: 3765537 - DNA, 13 bp, Homo sapiens
ctctgcttgccga

SEQ ID NO: 3765538 - DNA, 21 bp, Homo sapiens
ctctgcttgccgaaactggaa

SEQ ID NO: 3765539 - DNA, 24 bp, Homo sapiens
ctctgctttgactgagcagactgg

SEQ ID NO: 3765540 - DNA, 21 bp, Homo sapiens
ctctggaagagaggaatgcct

SEQ ID NO: 3765541 - DNA, 16 bp, Homo sapiens
ctctggacaggcatgt

SEQ ID NO: 3765542 - DNA, 16 bp, Homo sapiens
ctctggagccacctgt

SEQ ID NO: 3765543 - DNA, 15 bp, Homo sapiens
ctctggccaggatgg

SEQ ID NO: 3765544 - DNA, 11 bp, Homo sapiens
ctctggcctct

SEQ ID NO: 3765545 - DNA, 14 bp, Homo sapiens
ctctggctagaggc

SEQ ID NO: 3765546 - DNA, 23 bp, Homo sapiens
ctctgggccaagtcaaagacatt

SEQ ID NO: 3765547 - DNA, 19 bp, Homo sapiens
ctctggtgacaccagcctt

SEQ ID NO: 3765548 - DNA, 16 bp, Homo sapiens
ctctggttcttcattt

SEQ ID NO: 3765549 - DNA, 22 bp, Homo sapiens
ctctgtcctgggagtgagctgg

SEQ ID NO: 3765550 - DNA, 13 bp, Homo sapiens
ctctgtcgcccag

SEQ ID NO: 3765551 - DNA, 18 bp, Homo sapiens
ctctgtcgcccagtctgg

SEQ ID NO: 3765552 - DNA, 20 bp, Homo sapiens
ctctgtctaccatctccctc

SEQ ID NO: 3765553 - DNA, 21 bp, Homo sapiens
ctctgtctaccatctccctcg

SEQ ID NO: 3765554 - DNA, 14 bp, Homo sapiens
ctctgtgactgatg

SEQ ID NO: 3765555 - DNA, 20 bp, Homo sapiens
ctctgtgcacttatttatga

SEQ ID NO: 3765556 - DNA, 15 bp, Homo sapiens
ctctgtgtcaggtgg

SEQ ID NO: 3765557 - DNA, 20 bp, Homo sapiens
ctctgtgtcaggtggggcag

SEQ ID NO: 3765558 - DNA, 23 bp, Homo sapiens
ctctgtgtcaggtggggcagctt

SEQ ID NO: 3765559 - DNA, 17 bp, Homo sapiens
ctcttaaaaaataaaaa

SEQ ID NO: 3765560 - DNA, 23 bp, Homo sapiens
ctcttacccttctgtgcccagct

SEQ ID NO: 3765561 - DNA, 16 bp, Homo sapiens
ctcttatagaatattt

SEQ ID NO: 3765562 - DNA, 17 bp, Homo sapiens
ctcttatagaatattta

SEQ ID NO: 3765563 - DNA, 18 bp, Homo sapiens
ctcttatgccatttgttt

SEQ ID NO: 3765564 - DNA, 16 bp, Homo sapiens
ctcttattcagtaaaa

SEQ ID NO: 3765565 - DNA, 14 bp, Homo sapiens
ctcttcaatctctt

SEQ ID NO: 3765566 - DNA, 11 bp, Homo sapiens
ctcttcagaaa

SEQ ID NO: 3765567 - DNA, 18 bp, Homo sapiens
ctcttcaggcctccctct

SEQ ID NO: 3765568 - DNA, 12 bp, Homo sapiens
ctcttccccaga

SEQ ID NO: 3765569 - DNA, 21 bp, Homo sapiens
ctcttccccagaaaggagact

SEQ ID NO: 3765570 - DNA, 16 bp, Homo sapiens
ctcttccccctctccc

SEQ ID NO: 3765571 - DNA, 18 bp, Homo sapiens
ctcttccccctctcccag

SEQ ID NO: 3765572 - DNA, 15 bp, Homo sapiens
ctcttcctatcccat

SEQ ID NO: 3765573 - DNA, 17 bp, Homo sapiens
ctcttcctatcccatcc

SEQ ID NO: 3765574 - DNA, 18 bp, Homo sapiens
ctcttccttgctgtgtca

SEQ ID NO: 3765575 - DNA, 15 bp, Homo sapiens
ctcttctccactgga

SEQ ID NO: 3765576 - DNA, 17 bp, Homo sapiens
ctcttctccactggatg

SEQ ID NO: 3765577 - DNA, 12 bp, Homo sapiens
ctcttctgctcc

SEQ ID NO: 3765578 - DNA, 16 bp, Homo sapiens
ctcttctgctccaccc

SEQ ID NO: 3765579 - DNA, 18 bp, Homo sapiens
ctcttctgctccaccctt

SEQ ID NO: 3765580 - DNA, 20 bp, Homo sapiens
ctcttctgctccacccttgg

SEQ ID NO: 3765581 - DNA, 19 bp, Homo sapiens
ctcttcttaacttaaattt

SEQ ID NO: 3765582 - DNA, 20 bp, Homo sapiens
ctcttcttccaggtagctga

SEQ ID NO: 3765583 - DNA, 17 bp, Homo sapiens
ctcttcttcttcagaag

SEQ ID NO: 3765584 - DNA, 18 bp, Homo sapiens
ctcttcttcttcagaaga

SEQ ID NO: 3765585 - DNA, 14 bp, Homo sapiens
ctcttgagcctggg

SEQ ID NO: 3765586 - DNA, 16 bp, Homo sapiens
ctcttgagcctgggag

SEQ ID NO: 3765587 - DNA, 14 bp, Homo sapiens
ctcttgcagagaag

SEQ ID NO: 3765588 - DNA, 15 bp, Homo sapiens
ctcttgcagagaagc

SEQ ID NO: 3765589 - DNA, 17 bp, Homo sapiens
ctcttgccactgcctct

SEQ ID NO: 3765590 - DNA, 19 bp, Homo sapiens
ctcttgccccccaccccag

SEQ ID NO: 3765591 - DNA, 20 bp, Homo sapiens
ctcttgccccccaccccagc

SEQ ID NO: 3765592 - DNA, 22 bp, Homo sapiens
ctcttgccccccaccccagcct

SEQ ID NO: 3765593 - DNA, 15 bp, Homo sapiens
ctcttgggctgagac

SEQ ID NO: 3765594 - DNA, 18 bp, Homo sapiens
ctcttgggctgagactgg

SEQ ID NO: 3765595 - DNA, 12 bp, Homo sapiens
ctcttgtaagat

SEQ ID NO: 3765596 - DNA, 23 bp, Homo sapiens
ctcttgtaagattttgaaaacta

SEQ ID NO: 3765597 - DNA, 16 bp, Homo sapiens
ctctttaactcaggac

SEQ ID NO: 3765598 - DNA, 21 bp, Homo sapiens
ctctttaagagttagtttctt

SEQ ID NO: 3765599 - DNA, 16 bp, Homo sapiens
ctctttaatcttcagt

SEQ ID NO: 3765600 - DNA, 21 bp, Homo sapiens
ctctttaatgtcacaggcagg

SEQ ID NO: 3765601 - DNA, 23 bp, Homo sapiens
ctctttaatgtcacaggcaggtc

SEQ ID NO: 3765602 - DNA, 21 bp, Homo sapiens
ctctttcagaaaacagaaaaa

SEQ ID NO: 3765603 - DNA, 13 bp, Homo sapiens
ctctttccctccc

SEQ ID NO: 3765604 - DNA, 17 bp, Homo sapiens
ctctttccctcccttcc

SEQ ID NO: 3765605 - DNA, 12 bp, Homo sapiens
ctctttctgggc

SEQ ID NO: 3765606 - DNA, 13 bp, Homo sapiens
ctctttgaaacaa

SEQ ID NO: 3765607 - DNA, 22 bp, Homo sapiens
ctctttgaaatagtctgtgtga

SEQ ID NO: 3765608 - DNA, 23 bp, Homo sapiens
ctctttgacaattcctagataaa

SEQ ID NO: 3765609 - DNA, 15 bp, Homo sapiens
ctctttgagatagaa

SEQ ID NO: 3765610 - DNA, 15 bp, Homo sapiens
ctctttggacactca

SEQ ID NO: 3765611 - DNA, 12 bp, Homo sapiens
ctctttgtaaga

SEQ ID NO: 3765612 - DNA, 23 bp, Homo sapiens
ctcttttcctacttttccttccc

SEQ ID NO: 3765613 - DNA, 22 bp, Homo sapiens
ctcttttcctttggtccttcaa

SEQ ID NO: 3765614 - DNA, 13 bp, Homo sapiens
ctcttttctcttt

SEQ ID NO: 3765615 - DNA, 20 bp, Homo sapiens
ctcttttgaatccatgcttg

SEQ ID NO: 3765616 - DNA, 17 bp, Homo sapiens
ctgccgcaacagttttt

SEQ ID NO: 3765617 - DNA, 15 bp, Homo sapiens
ctgccgcaccccaga

SEQ ID NO: 3765618 - DNA, 16 bp, Homo sapiens
ctgccggccctggggc

SEQ ID NO: 3765619 - DNA, 14 bp, Homo sapiens
ctgccggctctggc

SEQ ID NO: 3765620 - DNA, 22 bp, Homo sapiens
ctgccgtgggcctgtcgtgcca

SEQ ID NO: 3765621 - DNA, 23 bp, Homo sapiens
ctgccgtgggcctgtcgtgccag

SEQ ID NO: 3765622 - DNA, 13 bp, Homo sapiens
ctgcctaagccct

SEQ ID NO: 3765623 - DNA, 18 bp, Homo sapiens
ctgcctaagtggctgctg

SEQ ID NO: 3765624 - DNA, 19 bp, Homo sapiens
ctgcctagcactcacatgc

SEQ ID NO: 3765625 - DNA, 19 bp, Homo sapiens
ctgcctaggaattcccagc

SEQ ID NO: 3765626 - DNA, 16 bp, Homo sapiens
ctgcctaggctgacct

SEQ ID NO: 3765627 - DNA, 14 bp, Homo sapiens
ctgcctcacttcct

SEQ ID NO: 3765628 - DNA, 19 bp, Homo sapiens
ctgcctcagcctcccaaag

SEQ ID NO: 3765629 - DNA, 14 bp, Homo sapiens
ctgcctccagaatg

SEQ ID NO: 3765630 - DNA, 14 bp, Homo sapiens
ctgcctccccaacc

SEQ ID NO: 3765631 - DNA, 16 bp, Homo sapiens
ctgcctccccaaccct

SEQ ID NO: 3765632 - DNA, 18 bp, Homo sapiens
ctgcctccccaaccctgc

SEQ ID NO: 3765633 - DNA, 19 bp, Homo sapiens
ctgcctccccaaccctgcc

SEQ ID NO: 3765634 - DNA, 14 bp, Homo sapiens
ctgcctcgaactgg

SEQ ID NO: 3765635 - DNA, 15 bp, Homo sapiens
ctgcctcgaactggc

SEQ ID NO: 3765636 - DNA, 18 bp, Homo sapiens
ctgcctcgaactggctgc

SEQ ID NO: 3765637 - DNA, 22 bp, Homo sapiens
ctgcctctcccatcacttccct

SEQ ID NO: 3765638 - DNA, 23 bp, Homo sapiens
ctgcctctcccatcacttcccta

SEQ ID NO: 3765639 - DNA, 16 bp, Homo sapiens
ctgcctctccctggcc

SEQ ID NO: 3765640 - DNA, 18 bp, Homo sapiens
ctgcctctccctggccct

SEQ ID NO: 3765641 - DNA, 15 bp, Homo sapiens
ctgcctctgacacac

SEQ ID NO: 3765642 - DNA, 17 bp, Homo sapiens
ctgcctctgacacacag

SEQ ID NO: 3765643 - DNA, 18 bp, Homo sapiens
ctgcctctgacacacagc

SEQ ID NO: 3765644 - DNA, 21 bp, Homo sapiens
ctgcctctgacacacagctct

SEQ ID NO: 3765645 - DNA, 17 bp, Homo sapiens
ctgcctctgcctgcatt

SEQ ID NO: 3765646 - DNA, 19 bp, Homo sapiens
ctgcctcttaaataaacct

SEQ ID NO: 3765647 - DNA, 16 bp, Homo sapiens
ctgcctgaagtcacac

SEQ ID NO: 3765648 - DNA, 18 bp, Homo sapiens
ctgcctgaagtcacacag

SEQ ID NO: 3765649 - DNA, 23 bp, Homo sapiens
ctgcctgaagtcacacagtgagt

SEQ ID NO: 3765650 - DNA, 20 bp, Homo sapiens
ctgcctgagcacctcccagc

SEQ ID NO: 3765651 - DNA, 15 bp, Homo sapiens
ctgcctgcacccctg

SEQ ID NO: 3765652 - DNA, 21 bp, Homo sapiens
ctgcctgcagtactttacctc

SEQ ID NO: 3765653 - DNA, 16 bp, Homo sapiens
ctgcctgcccacccgt

SEQ ID NO: 3765654 - DNA, 14 bp, Homo sapiens
ctgcctgcccaggc

SEQ ID NO: 3765655 - DNA, 20 bp, Homo sapiens
ctgcctggaagagcagccct

SEQ ID NO: 3765656 - DNA, 12 bp, Homo sapiens
ctgcctggagcc

SEQ ID NO: 3765657 - DNA, 15 bp, Homo sapiens
ctgcctggagcccca

SEQ ID NO: 3765658 - DNA, 16 bp, Homo sapiens
ctgcctggccaggcag

SEQ ID NO: 3765659 - DNA, 21 bp, Homo sapiens
ctgcctggccaggcagatctg

SEQ ID NO: 3765660 - DNA, 14 bp, Homo sapiens
ctgcctggccccca

SEQ ID NO: 3765661 - DNA, 22 bp, Homo sapiens
ctgcctgggttccaatcctggc

SEQ ID NO: 3765662 - DNA, 13 bp, Homo sapiens
ctgcctgtagtta

SEQ ID NO: 3765663 - DNA, 17 bp, Homo sapiens
ctgcctgtagttaggaa

SEQ ID NO: 3765664 - DNA, 19 bp, Homo sapiens
ctgcctgtagttaggaaat

SEQ ID NO: 3765665 - DNA, 20 bp, Homo sapiens
ctgcctgtccctctcaggca

SEQ ID NO: 3765666 - DNA, 15 bp, Homo sapiens
ctgcctgtgagccag

SEQ ID NO: 3765667 - DNA, 12 bp, Homo sapiens
ctgcctgtgctg

SEQ ID NO: 3765668 - DNA, 15 bp, Homo sapiens
ctgcctgttcagctc

SEQ ID NO: 3765669 - DNA, 19 bp, Homo sapiens
ctgcctgttcagctccagc

SEQ ID NO: 3765670 - DNA, 15 bp, Homo sapiens
ctgcctgttcccatt

SEQ ID NO: 3765671 - DNA, 19 bp, Homo sapiens
ctgcctgttcccattcttg

SEQ ID NO: 3765672 - DNA, 20 bp, Homo sapiens
ctgccttcgttaactgtgta

SEQ ID NO: 3765673 - DNA, 24 bp, Homo sapiens
ctgccttcttcggggaactcctgg

SEQ ID NO: 3765674 - DNA, 16 bp, Homo sapiens
ctgccttgaagccact

SEQ ID NO: 3765675 - DNA, 22 bp, Homo sapiens
ctgccttgaagccactgaagct

SEQ ID NO: 3765676 - DNA, 18 bp, Homo sapiens
ctgcctttgcagaaacag

SEQ ID NO: 3765677 - DNA, 21 bp, Homo sapiens
ctgcggaatgaaccacatctt

SEQ ID NO: 3765678 - DNA, 14 bp, Homo sapiens
ctgcggcatcagat

SEQ ID NO: 3765679 - DNA, 17 bp, Homo sapiens
ctgcgggatggtcctgg

SEQ ID NO: 3765680 - DNA, 19 bp, Homo sapiens
ctgcgggatggtcctgggg

SEQ ID NO: 3765681 - DNA, 22 bp, Homo sapiens
ctgcgggatggtcctggggctc

SEQ ID NO: 3765682 - DNA, 16 bp, Homo sapiens
ctgcggtccacccagg

SEQ ID NO: 3765683 - DNA, 17 bp, Homo sapiens
ctgcgtggctgaccccc

SEQ ID NO: 3765684 - DNA, 17 bp, Homo sapiens
ctgctaaatctcctatt

SEQ ID NO: 3765685 - DNA, 19 bp, Homo sapiens
ctgctaaatctcctatttt

SEQ ID NO: 3765686 - DNA, 21 bp, Homo sapiens
ctgctaacttggagccccagt

SEQ ID NO: 3765687 - DNA, 23 bp, Homo sapiens
ctgctaatcatgtgggtgagcca

SEQ ID NO: 3765688 - DNA, 16 bp, Homo sapiens
ctgctaattccccaga

SEQ ID NO: 3765689 - DNA, 13 bp, Homo sapiens
ctgctacctcact

SEQ ID NO: 3765690 - DNA, 14 bp, Homo sapiens
ctgctacctcactg

SEQ ID NO: 3765691 - DNA, 15 bp, Homo sapiens
ctgctacctcactgg

SEQ ID NO: 3765692 - DNA, 17 bp, Homo sapiens
ctgctacctcactgggg

SEQ ID NO: 3765693 - DNA, 14 bp, Homo sapiens
ctgctagcacttgg

SEQ ID NO: 3765694 - DNA, 15 bp, Homo sapiens
ctgctaggtgggcca

SEQ ID NO: 3765695 - DNA, 17 bp, Homo sapiens
ctgctatttcccaagct

SEQ ID NO: 3765696 - DNA, 15 bp, Homo sapiens
ctgctattttactgt

SEQ ID NO: 3765697 - DNA, 17 bp, Homo sapiens
ctgctattttactgtct

SEQ ID NO: 3765698 - DNA, 14 bp, Homo sapiens
ctgctcacatatct

SEQ ID NO: 3765699 - DNA, 16 bp, Homo sapiens
ctgctcacatatctgt

SEQ ID NO: 3765700 - DNA, 11 bp, Homo sapiens
ctgctccacca

SEQ ID NO: 3765701 - DNA, 19 bp, Homo sapiens
ctgctccacccttggcctg

SEQ ID NO: 3765702 - DNA, 14 bp, Homo sapiens
ctgctccagctgtt

SEQ ID NO: 3765703 - DNA, 15 bp, Homo sapiens
ctgctccagctgttc

SEQ ID NO: 3765704 - DNA, 13 bp, Homo sapiens
ctgctcccccacc

SEQ ID NO: 3765705 - DNA, 17 bp, Homo sapiens
ctgctcccccaccccct

SEQ ID NO: 3765706 - DNA, 22 bp, Homo sapiens
ctgctcccccaccccctcccca

SEQ ID NO: 3765707 - DNA, 12 bp, Homo sapiens
ctgctcctccag

SEQ ID NO: 3765708 - DNA, 13 bp, Homo sapiens
ctgctcctccagg

SEQ ID NO: 3765709 - DNA, 16 bp, Homo sapiens
ctgctcctccagggcc

SEQ ID NO: 3765710 - DNA, 17 bp, Homo sapiens
ctgctcctccagggcca

SEQ ID NO: 3765711 - DNA, 17 bp, Homo sapiens
ctgctccttagctgcca

SEQ ID NO: 3765712 - DNA, 16 bp, Homo sapiens
ctgctctctacccagc

SEQ ID NO: 3765713 - DNA, 20 bp, Homo sapiens
ctgctctctacccagcccat

SEQ ID NO: 3765714 - DNA, 12 bp, Homo sapiens
ctgctctggtta

SEQ ID NO: 3765715 - DNA, 21 bp, Homo sapiens
ctgctcttatgccatttgttt

SEQ ID NO: 3765716 - DNA, 18 bp, Homo sapiens
ctgctgaaggaataaatt

SEQ ID NO: 3765717 - DNA, 22 bp, Homo sapiens
ctgctgaatgatttccaaagag

SEQ ID NO: 3765718 - DNA, 15 bp, Homo sapiens
ctgctgacagacaca

SEQ ID NO: 3765719 - DNA, 11 bp, Homo sapiens
ctgctgacagt

SEQ ID NO: 3765720 - DNA, 16 bp, Homo sapiens
ctgctgacctccacag

SEQ ID NO: 3765721 - DNA, 19 bp, Homo sapiens
ctgctgacctccacagctt

SEQ ID NO: 3765722 - DNA, 22 bp, Homo sapiens
ctgctgagagacccaaggagga

SEQ ID NO: 3765723 - DNA, 18 bp, Homo sapiens
ctgctgagggaccagcca

SEQ ID NO: 3765724 - DNA, 22 bp, Homo sapiens
ctgctgccatggcgtgtccctc

SEQ ID NO: 3765725 - DNA, 12 bp, Homo sapiens
ctgctgccctcc

SEQ ID NO: 3765726 - DNA, 17 bp, Homo sapiens
ctgctgccctccatccc

SEQ ID NO: 3765727 - DNA, 19 bp, Homo sapiens
ctgctgccgcctcccagcc

SEQ ID NO: 3765728 - DNA, 20 bp, Homo sapiens
ctgctgccgcctcccagcct

SEQ ID NO: 3765729 - DNA, 15 bp, Homo sapiens
ctgttgattgcagga

SEQ ID NO: 3765730 - DNA, 13 bp, Homo sapiens
ctgttgccacaac

SEQ ID NO: 3765731 - DNA, 13 bp, Homo sapiens
ctgttgccagaga

SEQ ID NO: 3765732 - DNA, 14 bp, Homo sapiens
ctgttgcccaggct

SEQ ID NO: 3765733 - DNA, 17 bp, Homo sapiens
ctgttgcccaggctggc

SEQ ID NO: 3765734 - DNA, 18 bp, Homo sapiens
ctgttgcccaggctggcg

SEQ ID NO: 3765735 - DNA, 12 bp, Homo sapiens
ctgttgcctcat

SEQ ID NO: 3765736 - DNA, 15 bp, Homo sapiens
ctgttggccagtgtg

SEQ ID NO: 3765737 - DNA, 19 bp, Homo sapiens
ctgttggctgggggcctca

SEQ ID NO: 3765738 - DNA, 22 bp, Homo sapiens
ctgttgtgtacgtggagaggga

SEQ ID NO: 3765739 - DNA, 13 bp, Homo sapiens
ctgttgttgttaa

SEQ ID NO: 3765740 - DNA, 12 bp, Homo sapiens
ctgttttaaatt

SEQ ID NO: 3765741 - DNA, 12 bp, Homo sapiens
ctgttttactgc

SEQ ID NO: 3765742 - DNA, 17 bp, Homo sapiens
ctgttttactgctttta

SEQ ID NO: 3765743 - DNA, 15 bp, Homo sapiens
cttaaaaaaaactca

SEQ ID NO: 3765744 - DNA, 14 bp, Homo sapiens
cttaaaaaaataaa

SEQ ID NO: 3765745 - DNA, 15 bp, Homo sapiens
cttaaaaaaatgaca

SEQ ID NO: 3765746 - DNA, 17 bp, Homo sapiens
cttaaaaaaatgacaga

SEQ ID NO: 3765747 - DNA, 13 bp, Homo sapiens
cttaaaaaatgtc

SEQ ID NO: 3765748 - DNA, 18 bp, Homo sapiens
cttaaaaagtctgcatta

SEQ ID NO: 3765749 - DNA, 20 bp, Homo sapiens
cttaaaaatcattgattgtc

SEQ ID NO: 3765750 - DNA, 18 bp, Homo sapiens
cttaaaatattcctgcat

SEQ ID NO: 3765751 - DNA, 14 bp, Homo sapiens
cttaaactgtgtgg

SEQ ID NO: 3765752 - DNA, 18 bp, Homo sapiens
cttaaagctgcctgtagt

SEQ ID NO: 3765753 - DNA, 23 bp, Homo sapiens
cttaaataaaagaaatgcacaat

SEQ ID NO: 3765754 - DNA, 13 bp, Homo sapiens
cttaaatatcaat

SEQ ID NO: 3765755 - DNA, 20 bp, Homo sapiens
cttaaattaaacaatttatt

SEQ ID NO: 3765756 - DNA, 21 bp, Homo sapiens
cttaaattaaacaatttattt

SEQ ID NO: 3765757 - DNA, 16 bp, Homo sapiens
cttaaattttaattta

SEQ ID NO: 3765758 - DNA, 17 bp, Homo sapiens
cttaaattttaatttat

SEQ ID NO: 3765759 - DNA, 18 bp, Homo sapiens
cttaaattttaatttatt

SEQ ID NO: 3765760 - DNA, 23 bp, Homo sapiens
cttaacaaaccctcgtttctgat

SEQ ID NO: 3765761 - DNA, 24 bp, Homo sapiens
cttaacatttctaactctgatgta

SEQ ID NO: 3765762 - DNA, 20 bp, Homo sapiens
cttaaccccagtaagccact

SEQ ID NO: 3765763 - DNA, 21 bp, Homo sapiens
cttaactctttgcctttgcca

SEQ ID NO: 3765764 - DNA, 16 bp, Homo sapiens
cttaactggagcccca

SEQ ID NO: 3765765 - DNA, 22 bp, Homo sapiens
cttaacttaaattttaatttat

SEQ ID NO: 3765766 - DNA, 19 bp, Homo sapiens
cttaagaccacctcaaatt

SEQ ID NO: 3765767 - DNA, 12 bp, Homo sapiens
cttaagcttccg

SEQ ID NO: 3765768 - DNA, 15 bp, Homo sapiens
cttaagtatcagaaa

SEQ ID NO: 3765769 - DNA, 17 bp, Homo sapiens
cttaataaattcagata

SEQ ID NO: 3765770 - DNA, 18 bp, Homo sapiens
cttaataaattcagatat

SEQ ID NO: 3765771 - DNA, 17 bp, Homo sapiens
cttaatagtatttatga

SEQ ID NO: 3765772 - DNA, 21 bp, Homo sapiens
cttaatgatccgttccattgc

SEQ ID NO: 3765773 - DNA, 14 bp, Homo sapiens
cttaattttcagta

SEQ ID NO: 3765774 - DNA, 20 bp, Homo sapiens
cttacacaagactttcccca

SEQ ID NO: 3765775 - DNA, 20 bp, Homo sapiens
cttacacccacagtggaaag

SEQ ID NO: 3765776 - DNA, 22 bp, Homo sapiens
cttacagataggccttcttgtg

SEQ ID NO: 3765777 - DNA, 17 bp, Homo sapiens
cttacatgagaacagac

SEQ ID NO: 3765778 - DNA, 21 bp, Homo sapiens
cttacatgttttctttgcttt

SEQ ID NO: 3765779 - DNA, 20 bp, Homo sapiens
cttacattagcagtttgctt

SEQ ID NO: 3765780 - DNA, 15 bp, Homo sapiens
cttaccaaaggatag

SEQ ID NO: 3765781 - DNA, 23 bp, Homo sapiens
cttacccatctgcacccccctgg

SEQ ID NO: 3765782 - DNA, 20 bp, Homo sapiens
cttaccccttagcctccctg

SEQ ID NO: 3765783 - DNA, 13 bp, Homo sapiens
cttacccttctgt

SEQ ID NO: 3765784 - DNA, 20 bp, Homo sapiens
cttacccttctgtgcccagc

SEQ ID NO: 3765785 - DNA, 18 bp, Homo sapiens
cttacctcccacctttgg

SEQ ID NO: 3765786 - DNA, 13 bp, Homo sapiens
cttacctcggtgc

SEQ ID NO: 3765787 - DNA, 21 bp, Homo sapiens
cttacctcggtgccttcctct

SEQ ID NO: 3765788 - DNA, 13 bp, Homo sapiens
cttacctcttccg

SEQ ID NO: 3765789 - DNA, 21 bp, Homo sapiens
cttaccttcaataaagtatct

SEQ ID NO: 3765790 - DNA, 18 bp, Homo sapiens
cttactacatgtgggagc

SEQ ID NO: 3765791 - DNA, 13 bp, Homo sapiens
cttacttacagca

SEQ ID NO: 3765792 - DNA, 13 bp, Homo sapiens
cttactttgtatg

SEQ ID NO: 3765793 - DNA, 19 bp, Homo sapiens
cttactttgtatgatattc

SEQ ID NO: 3765794 - DNA, 17 bp, Homo sapiens
cttagaagtcacacagt

SEQ ID NO: 3765795 - DNA, 20 bp, Homo sapiens
cttagaagtggaccaggaca

SEQ ID NO: 3765796 - DNA, 21 bp, Homo sapiens
cttagaagtggaccaggacag

SEQ ID NO: 3765797 - DNA, 15 bp, Homo sapiens
cttagacctcagcct

SEQ ID NO: 3765798 - DNA, 18 bp, Homo sapiens
cttagacctcagcctgtg

SEQ ID NO: 3765799 - DNA, 17 bp, Homo sapiens
cttagatatctttttat

SEQ ID NO: 3765800 - DNA, 19 bp, Homo sapiens
cttagatgtatatatttcc

SEQ ID NO: 3765801 - DNA, 18 bp, Homo sapiens
cttagcagggaaacagct

SEQ ID NO: 3765802 - DNA, 14 bp, Homo sapiens
cttagcagtgattt

SEQ ID NO: 3765803 - DNA, 17 bp, Homo sapiens
cttagctgtctgctcag

SEQ ID NO: 3765804 - DNA, 14 bp, Homo sapiens
cttagcttagacct

SEQ ID NO: 3765805 - DNA, 18 bp, Homo sapiens
cttagcttagacctcagc

SEQ ID NO: 3765806 - DNA, 23 bp, Homo sapiens
cttagcttagacctcagcctgtg

SEQ ID NO: 3765807 - DNA, 14 bp, Homo sapiens
cttaggcagggaag

SEQ ID NO: 3765808 - DNA, 17 bp, Homo sapiens
cttaggcatgcacagct

SEQ ID NO: 3765809 - DNA, 21 bp, Homo sapiens
cttaggttggcaaaaaggcag

SEQ ID NO: 3765810 - DNA, 21 bp, Homo sapiens
cttagtcttctcatagcatta

SEQ ID NO: 3765811 - DNA, 19 bp, Homo sapiens
cttagtgcggacaagtttt

SEQ ID NO: 3765812 - DNA, 23 bp, Homo sapiens
cttatagtcaatgtttcttttat

SEQ ID NO: 3765813 - DNA, 19 bp, Homo sapiens
cttatatttttaataaaag

SEQ ID NO: 3765814 - DNA, 15 bp, Homo sapiens
cttatcgaaactcat

SEQ ID NO: 3765815 - DNA, 17 bp, Homo sapiens
cttatctgtgcgtgaaa

SEQ ID NO: 3765816 - DNA, 16 bp, Homo sapiens
cttatcttacaaagtg

SEQ ID NO: 3765817 - DNA, 17 bp, Homo sapiens
cttatcttacaaagtgt

SEQ ID NO: 3765818 - DNA, 18 bp, Homo sapiens
cttatgaatatttataac

SEQ ID NO: 3765819 - DNA, 21 bp, Homo sapiens
cttatgacatcacttgtacaa

SEQ ID NO: 3765820 - DNA, 15 bp, Homo sapiens
cttatgccatttgtt

SEQ ID NO: 3765821 - DNA, 13 bp, Homo sapiens
cttattgcccacg

SEQ ID NO: 3765822 - DNA, 13 bp, Homo sapiens
cttattgtacctc

SEQ ID NO: 3765823 - DNA, 13 bp, Homo sapiens
cttattgttccaa

SEQ ID NO: 3765824 - DNA, 14 bp, Homo sapiens
cttattgttccaag

SEQ ID NO: 3765825 - DNA, 15 bp, Homo sapiens
cttattgttccaaga

SEQ ID NO: 3765826 - DNA, 17 bp, Homo sapiens
cttattgttccaagaca

SEQ ID NO: 3765827 - DNA, 23 bp, Homo sapiens
cttattttaaaattttatctctt

SEQ ID NO: 3765828 - DNA, 19 bp, Homo sapiens
cttcaaatattatgcaggg

SEQ ID NO: 3765829 - DNA, 16 bp, Homo sapiens
cttcaacatcaatgtt

SEQ ID NO: 3765830 - DNA, 19 bp, Homo sapiens
cttcaacatcaatgttcat

SEQ ID NO: 3765831 - DNA, 20 bp, Homo sapiens
cttcaacatcaatgttcatt

SEQ ID NO: 3765832 - DNA, 16 bp, Homo sapiens
cttcaaccattcccca

SEQ ID NO: 3765833 - DNA, 23 bp, Homo sapiens
cttcaactgaccagcctccatgc

SEQ ID NO: 3765834 - DNA, 16 bp, Homo sapiens
cttcaagttagctcag

SEQ ID NO: 3765835 - DNA, 19 bp, Homo sapiens
cttcaagttagctcaggag

SEQ ID NO: 3765836 - DNA, 15 bp, Homo sapiens
cttcaattcctgggc

SEQ ID NO: 3765837 - DNA, 16 bp, Homo sapiens
cttcaattcctgggcc

SEQ ID NO: 3765838 - DNA, 18 bp, Homo sapiens
cttcaatttattgcacaa

SEQ ID NO: 3765839 - DNA, 17 bp, Homo sapiens
cttcacacacaggcaac

SEQ ID NO: 3765840 - DNA, 21 bp, Homo sapiens
cttcacacacaggcaactgag

SEQ ID NO: 3765841 - DNA, 12 bp, Homo sapiens
cttcacagtgtt

SEQ ID NO: 3765842 - DNA, 21 bp, Homo sapiens
gaaagtcttgtgactagtgct

SEQ ID NO: 3765843 - DNA, 22 bp, Homo sapiens
gaaagtcttgtgactagtgctg

SEQ ID NO: 3765844 - DNA, 17 bp, Homo sapiens
gaaagtgaatttgaatg

SEQ ID NO: 3765845 - DNA, 19 bp, Homo sapiens
gaaagtgaatttgaatgaa

SEQ ID NO: 3765846 - DNA, 17 bp, Homo sapiens
gaaagttacaaattgct

SEQ ID NO: 3765847 - DNA, 17 bp, Homo sapiens
gaaagttccttatgtat

SEQ ID NO: 3765848 - DNA, 20 bp, Homo sapiens
gaaagtttccccaccagtga

SEQ ID NO: 3765849 - DNA, 16 bp, Homo sapiens
gaaataaaaaagtctc

SEQ ID NO: 3765850 - DNA, 19 bp, Homo sapiens
gaaataaaaaagtctctat

SEQ ID NO: 3765851 - DNA, 17 bp, Homo sapiens
gaaataaatagctatat

SEQ ID NO: 3765852 - DNA, 15 bp, Homo sapiens
gaaataaatgcccca

SEQ ID NO: 3765853 - DNA, 13 bp, Homo sapiens
gaaataataaatc

SEQ ID NO: 3765854 - DNA, 16 bp, Homo sapiens
gaaatactacttacca

SEQ ID NO: 3765855 - DNA, 18 bp, Homo sapiens
gaaatagacagtatattt

SEQ ID NO: 3765856 - DNA, 18 bp, Homo sapiens
gaaatagttcaaagccaa

SEQ ID NO: 3765857 - DNA, 14 bp, Homo sapiens
gaaatatatatgtg

SEQ ID NO: 3765858 - DNA, 20 bp, Homo sapiens
gaaatatcagttactcagcc

SEQ ID NO: 3765859 - DNA, 22 bp, Homo sapiens
gaaatatcagttactcagccct

SEQ ID NO: 3765860 - DNA, 12 bp, Homo sapiens
gaaatatcattt

SEQ ID NO: 3765861 - DNA, 17 bp, Homo sapiens
gaaatatgcacaatagc

SEQ ID NO: 3765862 - DNA, 18 bp, Homo sapiens
gaaatatgcacaatagca

SEQ ID NO: 3765863 - DNA, 13 bp, Homo sapiens
gaaatatgcatct

SEQ ID NO: 3765864 - DNA, 19 bp, Homo sapiens
gaaatattaaaccctggat

SEQ ID NO: 3765865 - DNA, 16 bp, Homo sapiens
gaaatattatgcaaat

SEQ ID NO: 3765866 - DNA, 21 bp, Homo sapiens
gaaatattatgcaaattccca

SEQ ID NO: 3765867 - DNA, 22 bp, Homo sapiens
gaaatattatgcaaattcccag

SEQ ID NO: 3765868 - DNA, 23 bp, Homo sapiens
gaaatattatgcaaattcccaga

SEQ ID NO: 3765869 - DNA, 19 bp, Homo sapiens
gaaatcatgttatgataaa

SEQ ID NO: 3765870 - DNA, 19 bp, Homo sapiens
gaaatcctcaattcatcaa

SEQ ID NO: 3765871 - DNA, 19 bp, Homo sapiens
gaaatctcacttttctcca

SEQ ID NO: 3765872 - DNA, 21 bp, Homo sapiens
gaaatctgtgcaataaaataa

SEQ ID NO: 3765873 - DNA, 19 bp, Homo sapiens
gaaatgcattttattcttt

SEQ ID NO: 3765874 - DNA, 18 bp, Homo sapiens
gaaatgcctaagaagatg

SEQ ID NO: 3765875 - DNA, 16 bp, Homo sapiens
gaaatgccttactttg

SEQ ID NO: 3765876 - DNA, 17 bp, Homo sapiens
gaaatgccttactttgt

SEQ ID NO: 3765877 - DNA, 17 bp, Homo sapiens
gaaatgtctggagaata

SEQ ID NO: 3765878 - DNA, 22 bp, Homo sapiens
gaaatgttattttttaattatt

SEQ ID NO: 3765879 - DNA, 13 bp, Homo sapiens
gaaattagggccc

SEQ ID NO: 3765880 - DNA, 13 bp, Homo sapiens
gaaattccctgga

SEQ ID NO: 3765881 - DNA, 18 bp, Homo sapiens
gaaattccctggaccaga

SEQ ID NO: 3765882 - DNA, 16 bp, Homo sapiens
gaaattggaagagcac

SEQ ID NO: 3765883 - DNA, 14 bp, Homo sapiens
gaaattggctggat

SEQ ID NO: 3765884 - DNA, 23 bp, Homo sapiens
gaaatttcagattcccagagcaa

SEQ ID NO: 3765885 - DNA, 12 bp, Homo sapiens
gaaattttacca

SEQ ID NO: 3765886 - DNA, 13 bp, Homo sapiens
gaaattttaccaa

SEQ ID NO: 3765887 - DNA, 14 bp, Homo sapiens
gaaattttaccaag

SEQ ID NO: 3765888 - DNA, 20 bp, Homo sapiens
gaaatttttcagatgcttct

SEQ ID NO: 3765889 - DNA, 21 bp, Homo sapiens
gaacaacctcggctcctggac

SEQ ID NO: 3765890 - DNA, 19 bp, Homo sapiens
gaacaactaggcttcagca

SEQ ID NO: 3765891 - DNA, 13 bp, Homo sapiens
gaacaagtgaaca

SEQ ID NO: 3765892 - DNA, 19 bp, Homo sapiens
gaacaagttgtttcattga

SEQ ID NO: 3765893 - DNA, 18 bp, Homo sapiens
gaacaccaagacttgaag

SEQ ID NO: 3765894 - DNA, 21 bp, Homo sapiens
gaacactattttcagaatctg

SEQ ID NO: 3765895 - DNA, 23 bp, Homo sapiens
gaacactgcactcttaagcttcc

SEQ ID NO: 3765896 - DNA, 16 bp, Homo sapiens
gaacactgggggaggg

SEQ ID NO: 3765897 - DNA, 18 bp, Homo sapiens
gaacactgggggagggga

SEQ ID NO: 3765898 - DNA, 14 bp, Homo sapiens
gaacagaaaacaac

SEQ ID NO: 3765899 - DNA, 23 bp, Homo sapiens
gaacagaaaacaacaaaaaataa

SEQ ID NO: 3765900 - DNA, 13 bp, Homo sapiens
gaacagaaatacc

SEQ ID NO: 3765901 - DNA, 17 bp, Homo sapiens
gaacagacaacagaagt

SEQ ID NO: 3765902 - DNA, 15 bp, Homo sapiens
gaacagactggaagc

SEQ ID NO: 3765903 - DNA, 16 bp, Homo sapiens
gaacagactggaagca

SEQ ID NO: 3765904 - DNA, 18 bp, Homo sapiens
gaacagataatccctgta

SEQ ID NO: 3765905 - DNA, 14 bp, Homo sapiens
gaacagcgggagac

SEQ ID NO: 3765906 - DNA, 16 bp, Homo sapiens
gaacagcgggagacct

SEQ ID NO: 3765907 - DNA, 17 bp, Homo sapiens
gaacagtgtttcccata

SEQ ID NO: 3765908 - DNA, 21 bp, Homo sapiens
gaacagtgtttcccataattt

SEQ ID NO: 3765909 - DNA, 20 bp, Homo sapiens
gaacagttaagcagccgcca

SEQ ID NO: 3765910 - DNA, 19 bp, Homo sapiens
gaacatagactagagaaac

SEQ ID NO: 3765911 - DNA, 20 bp, Homo sapiens
gaacatccaaggagaaacag

SEQ ID NO: 3765912 - DNA, 13 bp, Homo sapiens
gaacatgaagcca

SEQ ID NO: 3765913 - DNA, 16 bp, Homo sapiens
gaaccaaaacattccg

SEQ ID NO: 3765914 - DNA, 24 bp, Homo sapiens
gaaccaagtggaccttgagaccac

SEQ ID NO: 3765915 - DNA, 12 bp, Homo sapiens
gaaccagagcca

SEQ ID NO: 3765916 - DNA, 14 bp, Homo sapiens
gaacccacactgca

SEQ ID NO: 3765917 - DNA, 12 bp, Homo sapiens
gaacccacctgc

SEQ ID NO: 3765918 - DNA, 16 bp, Homo sapiens
gaacccaggaggtgga

SEQ ID NO: 3765919 - DNA, 17 bp, Homo sapiens
gaaccccaaggagggag

SEQ ID NO: 3765920 - DNA, 23 bp, Homo sapiens
gaaccctggtgaggaagctccag

SEQ ID NO: 3765921 - DNA, 18 bp, Homo sapiens
gaacccttttggcccccg

SEQ ID NO: 3765922 - DNA, 13 bp, Homo sapiens
gaaccgcaggaag

SEQ ID NO: 3765923 - DNA, 14 bp, Homo sapiens
gaaccgcaggaagc

SEQ ID NO: 3765924 - DNA, 16 bp, Homo sapiens
gaacctcacgcacctc

SEQ ID NO: 3765925 - DNA, 14 bp, Homo sapiens
gaacctcaggcttc

SEQ ID NO: 3765926 - DNA, 20 bp, Homo sapiens
gaacctgtccttgcacactc

SEQ ID NO: 3765927 - DNA, 21 bp, Homo sapiens
gaacgacaatagctttaccct

SEQ ID NO: 3765928 - DNA, 15 bp, Homo sapiens
gaacgccagtctccc

SEQ ID NO: 3765929 - DNA, 16 bp, Homo sapiens
gaacgccagtctccca

SEQ ID NO: 3765930 - DNA, 21 bp, Homo sapiens
gaacgccagtctcccaggccc

SEQ ID NO: 3765931 - DNA, 22 bp, Homo sapiens
gaacgccagtctcccaggcccc

SEQ ID NO: 3765932 - DNA, 19 bp, Homo sapiens
gaacggaacgttggacttt

SEQ ID NO: 3765933 - DNA, 15 bp, Homo sapiens
gaactaataaaagca

SEQ ID NO: 3765934 - DNA, 14 bp, Homo sapiens
gaactaatttctgt

SEQ ID NO: 3765935 - DNA, 19 bp, Homo sapiens
gaactagccttatttctca

SEQ ID NO: 3765936 - DNA, 15 bp, Homo sapiens
gaactattggagggt

SEQ ID NO: 3765937 - DNA, 15 bp, Homo sapiens
gaactcaactttgac

SEQ ID NO: 3765938 - DNA, 21 bp, Homo sapiens
gaactcccaagaacagcaggc

SEQ ID NO: 3765939 - DNA, 16 bp, Homo sapiens
gaactcctaaatcaag

SEQ ID NO: 3765940 - DNA, 23 bp, Homo sapiens
gaactctagggatagtcaccttt

SEQ ID NO: 3765941 - DNA, 17 bp, Homo sapiens
gaactctctccacccta

SEQ ID NO: 3765942 - DNA, 13 bp, Homo sapiens
gaactcttaatca

SEQ ID NO: 3765943 - DNA, 20 bp, Homo sapiens
gaactcttaatcaaatagca

SEQ ID NO: 3765944 - DNA, 21 bp, Homo sapiens
gaactgagctcctctgggcag

SEQ ID NO: 3765945 - DNA, 15 bp, Homo sapiens
gaactgcatatgttt

SEQ ID NO: 3765946 - DNA, 23 bp, Homo sapiens
gaactgcatggacctaacattcg

SEQ ID NO: 3765947 - DNA, 23 bp, Homo sapiens
gaactggactcaggatgcccagg

SEQ ID NO: 3765948 - DNA, 18 bp, Homo sapiens
gaacttaaataaatgtca

SEQ ID NO: 3765949 - DNA, 17 bp, Homo sapiens
gaacttggggaacaagg

SEQ ID NO: 3765950 - DNA, 16 bp, Homo sapiens
gaagaaaaaaaataac

SEQ ID NO: 3765951 - DNA, 17 bp, Homo sapiens
gaagaaaaaaaataaca

SEQ ID NO: 3765952 - DNA, 18 bp, Homo sapiens
gaagaaaaaaaataacac

SEQ ID NO: 3765953 - DNA, 13 bp, Homo sapiens
gaagaaatgaaat

SEQ ID NO: 3765954 - DNA, 14 bp, Homo sapiens
gaagaaatgaaatt

SEQ ID NO: 3765955 - DNA, 21 bp, Homo sapiens
gacttctttcaaattgagaga

SEQ ID NO: 3765956 - DNA, 22 bp, Homo sapiens
gacttctttcaaattgagagaa

SEQ ID NO: 3765957 - DNA, 14 bp, Homo sapiens
gacttgaaagcatc

SEQ ID NO: 3765958 - DNA, 16 bp, Homo sapiens
gacttgaaagcatcca

SEQ ID NO: 3765959 - DNA, 19 bp, Homo sapiens
gacttgaaagcatccatgt

SEQ ID NO: 3765960 - DNA, 23 bp, Homo sapiens
gacttgagaaacaaataatttgt

SEQ ID NO: 3765961 - DNA, 14 bp, Homo sapiens
gacttggaagctcc

SEQ ID NO: 3765962 - DNA, 14 bp, Homo sapiens
gacttggtctgatt

SEQ ID NO: 3765963 - DNA, 23 bp, Homo sapiens
gacttggtgtcctttccctccac

SEQ ID NO: 3765964 - DNA, 13 bp, Homo sapiens
gactttccacccc

SEQ ID NO: 3765965 - DNA, 18 bp, Homo sapiens
gactttccaccccctccc

SEQ ID NO: 3765966 - DNA, 23 bp, Homo sapiens
gactttctcagcctctgaatatg

SEQ ID NO: 3765967 - DNA, 18 bp, Homo sapiens
gacttttcgttaacattg

SEQ ID NO: 3765968 - DNA, 19 bp, Homo sapiens
gacttttcgttaacattga

SEQ ID NO: 3765969 - DNA, 13 bp, Homo sapiens
gagaaaagacatg

SEQ ID NO: 3765970 - DNA, 12 bp, Homo sapiens
gagaaaattgaa

SEQ ID NO: 3765971 - DNA, 14 bp, Homo sapiens
gagaaaattgaatt

SEQ ID NO: 3765972 - DNA, 19 bp, Homo sapiens
gagaaacagagacaggccc

SEQ ID NO: 3765973 - DNA, 22 bp, Homo sapiens
gagaaaccgtcctctttttcca

SEQ ID NO: 3765974 - DNA, 18 bp, Homo sapiens
gagaaagaagtaggcatg

SEQ ID NO: 3765975 - DNA, 16 bp, Homo sapiens
gagaaaggttgaagca

SEQ ID NO: 3765976 - DNA, 22 bp, Homo sapiens
gagaaagtacttctccaccctg

SEQ ID NO: 3765977 - DNA, 14 bp, Homo sapiens
gagaacctcaggct

SEQ ID NO: 3765978 - DNA, 20 bp, Homo sapiens
gagaactagtggtggctctg

SEQ ID NO: 3765979 - DNA, 19 bp, Homo sapiens
gagaactgcatatgtttcg

SEQ ID NO: 3765980 - DNA, 15 bp, Homo sapiens
gagaagaatattgtt

SEQ ID NO: 3765981 - DNA, 20 bp, Homo sapiens
gagaagaattttcagacccc

SEQ ID NO: 3765982 - DNA, 23 bp, Homo sapiens
gagaagcaagaaagaaacccgac

SEQ ID NO: 3765983 - DNA, 18 bp, Homo sapiens
gagaagcagtgagccgca

SEQ ID NO: 3765984 - DNA, 21 bp, Homo sapiens
gagaagcgtatgttttttatt

SEQ ID NO: 3765985 - DNA, 21 bp, Homo sapiens
gagaaggaaggagactcacct

SEQ ID NO: 3765986 - DNA, 16 bp, Homo sapiens
gagaaggaatgtcttt

SEQ ID NO: 3765987 - DNA, 15 bp, Homo sapiens
gagaagggatggagg

SEQ ID NO: 3765988 - DNA, 15 bp, Homo sapiens
gagaaggtccttaat

SEQ ID NO: 3765989 - DNA, 18 bp, Homo sapiens
gagaagtcaaacatttca

SEQ ID NO: 3765990 - DNA, 17 bp, Homo sapiens
gagaagtgcccctgctg

SEQ ID NO: 3765991 - DNA, 16 bp, Homo sapiens
gagaataattctttga

SEQ ID NO: 3765992 - DNA, 20 bp, Homo sapiens
gagaatcagatcatttcaaa

SEQ ID NO: 3765993 - DNA, 15 bp, Homo sapiens
gagaatggaaaacag

SEQ ID NO: 3765994 - DNA, 16 bp, Homo sapiens
gagaattcagctgccc

SEQ ID NO: 3765995 - DNA, 18 bp, Homo sapiens
gagaattcagctgccccc

SEQ ID NO: 3765996 - DNA, 22 bp, Homo sapiens
gagaattcttacatgttttctt

SEQ ID NO: 3765997 - DNA, 21 bp, Homo sapiens
gagaatttctaccatttcaga

SEQ ID NO: 3765998 - DNA, 19 bp, Homo sapiens
gagacaaacacctcccagg

SEQ ID NO: 3765999 - DNA, 22 bp, Homo sapiens
gagacaaacacctcccaggaga

SEQ ID NO: 3766000 - DNA, 23 bp, Homo sapiens
gagacaatgcagatgccagagca

SEQ ID NO: 3766001 - DNA, 21 bp, Homo sapiens
gagacacctcagagccccgca

SEQ ID NO: 3766002 - DNA, 13 bp, Homo sapiens
gagacacctgcac

SEQ ID NO: 3766003 - DNA, 20 bp, Homo sapiens
gagacacctgcacctccccc

SEQ ID NO: 3766004 - DNA, 21 bp, Homo sapiens
gagacacctgcacctcccccc

SEQ ID NO: 3766005 - DNA, 20 bp, Homo sapiens
gagacagacagagaaggcag

SEQ ID NO: 3766006 - DNA, 14 bp, Homo sapiens
gagacagagctggt

SEQ ID NO: 3766007 - DNA, 14 bp, Homo sapiens
gagacagggtcctg

SEQ ID NO: 3766008 - DNA, 22 bp, Homo sapiens
gagacagggttttgccatgttg

SEQ ID NO: 3766009 - DNA, 16 bp, Homo sapiens
gagaccaacctgacca

SEQ ID NO: 3766010 - DNA, 17 bp, Homo sapiens
gagaccaagtcctggct

SEQ ID NO: 3766011 - DNA, 14 bp, Homo sapiens
gagaccagcctggc

SEQ ID NO: 3766012 - DNA, 12 bp, Homo sapiens
gagacccccaca

SEQ ID NO: 3766013 - DNA, 14 bp, Homo sapiens
gagacccccacacc

SEQ ID NO: 3766014 - DNA, 23 bp, Homo sapiens
gagacccccacacctcagttccc

SEQ ID NO: 3766015 - DNA, 13 bp, Homo sapiens
gagacccctgtct

SEQ ID NO: 3766016 - DNA, 21 bp, Homo sapiens
gagaccctgtctcaaaaaaag

SEQ ID NO: 3766017 - DNA, 20 bp, Homo sapiens
gagaccgtcgggggctgagg

SEQ ID NO: 3766018 - DNA, 16 bp, Homo sapiens
gagacggagtcccacc

SEQ ID NO: 3766019 - DNA, 15 bp, Homo sapiens
gagactcacctctgc

SEQ ID NO: 3766020 - DNA, 16 bp, Homo sapiens
gagactcacctctgcc

SEQ ID NO: 3766021 - DNA, 19 bp, Homo sapiens
gagactcacctctgcctca

SEQ ID NO: 3766022 - DNA, 14 bp, Homo sapiens
gagactcagacagg

SEQ ID NO: 3766023 - DNA, 15 bp, Homo sapiens
gagactcagagggag

SEQ ID NO: 3766024 - DNA, 21 bp, Homo sapiens
gagactcagggccccagcact

SEQ ID NO: 3766025 - DNA, 13 bp, Homo sapiens
gagactctgtctc

SEQ ID NO: 3766026 - DNA, 12 bp, Homo sapiens
gagactctgtgg

SEQ ID NO: 3766027 - DNA, 22 bp, Homo sapiens
gagactgcgggatggtcctggg

SEQ ID NO: 3766028 - DNA, 23 bp, Homo sapiens
gagactgcgggatggtcctgggg

SEQ ID NO: 3766029 - DNA, 13 bp, Homo sapiens
gagactgtagatt

SEQ ID NO: 3766030 - DNA, 22 bp, Homo sapiens
gagagaaagtgtgagcaaacta

SEQ ID NO: 3766031 - DNA, 17 bp, Homo sapiens
gagagacaagaagcaaa

SEQ ID NO: 3766032 - DNA, 19 bp, Homo sapiens
gagagacccaaggaggaaa

SEQ ID NO: 3766033 - DNA, 23 bp, Homo sapiens
gagagagaagtgcccctgctgcc

SEQ ID NO: 3766034 - DNA, 12 bp, Homo sapiens
gagagaggggaa

SEQ ID NO: 3766035 - DNA, 15 bp, Homo sapiens
gagagatcatgagaa

SEQ ID NO: 3766036 - DNA, 13 bp, Homo sapiens
gagagatctgctg

SEQ ID NO: 3766037 - DNA, 13 bp, Homo sapiens
gagagccagccct

SEQ ID NO: 3766038 - DNA, 20 bp, Homo sapiens
gagagccagccctccctgtc

SEQ ID NO: 3766039 - DNA, 13 bp, Homo sapiens
gagagcccagcca

SEQ ID NO: 3766040 - DNA, 21 bp, Homo sapiens
gagagctagcagcagggaggg

SEQ ID NO: 3766041 - DNA, 17 bp, Homo sapiens
gagagctggtgcccgga

SEQ ID NO: 3766042 - DNA, 23 bp, Homo sapiens
gagagctttctgtccttttggca

SEQ ID NO: 3766043 - DNA, 14 bp, Homo sapiens
gagaggagaaacac

SEQ ID NO: 3766044 - DNA, 14 bp, Homo sapiens
gagaggcaatgatt

SEQ ID NO: 3766045 - DNA, 13 bp, Homo sapiens
gagaggcagagtg

SEQ ID NO: 3766046 - DNA, 13 bp, Homo sapiens
gagagggtctgga

SEQ ID NO: 3766047 - DNA, 18 bp, Homo sapiens
gagagggtctggagaagc

SEQ ID NO: 3766048 - DNA, 19 bp, Homo sapiens
gagaggtcaagcccaggag

SEQ ID NO: 3766049 - DNA, 17 bp, Homo sapiens
gagaggtcttttttaaa

SEQ ID NO: 3766050 - DNA, 19 bp, Homo sapiens
gagaggttataggtcactc

SEQ ID NO: 3766051 - DNA, 17 bp, Homo sapiens
gagaggttgtctgtggc

SEQ ID NO: 3766052 - DNA, 14 bp, Homo sapiens
gagagtctgtctca

SEQ ID NO: 3766053 - DNA, 18 bp, Homo sapiens
gagagtgcaacagtagca

SEQ ID NO: 3766054 - DNA, 22 bp, Homo sapiens
gagagttaatcaactgaaagtg

SEQ ID NO: 3766055 - DNA, 15 bp, Homo sapiens
gagataatatgagaa

SEQ ID NO: 3766056 - DNA, 21 bp, Homo sapiens
gagataccaagatgccatctg

SEQ ID NO: 3766057 - DNA, 20 bp, Homo sapiens
gagatcaaccccttcgctcc

SEQ ID NO: 3766058 - DNA, 14 bp, Homo sapiens
gagatcagcctggg

SEQ ID NO: 3766059 - DNA, 16 bp, Homo sapiens
gagatcagcctgggca

SEQ ID NO: 3766060 - DNA, 22 bp, Homo sapiens
gagatcgtgccgttactctcca

SEQ ID NO: 3766061 - DNA, 20 bp, Homo sapiens
gagatctaagcctttccata

SEQ ID NO: 3766062 - DNA, 16 bp, Homo sapiens
gagatgaattaaattt

SEQ ID NO: 3766063 - DNA, 14 bp, Homo sapiens
gagatgcctccacc

SEQ ID NO: 3766064 - DNA, 15 bp, Homo sapiens
gagatgcctccaccg

SEQ ID NO: 3766065 - DNA, 22 bp, Homo sapiens
gagatgcctccaccgctgccta

SEQ ID NO: 3766066 - DNA, 23 bp, Homo sapiens
gagatgcctccaccgctgcctaa

SEQ ID NO: 3766067 - DNA, 23 bp, Homo sapiens
gagatggaacccttttggccccc

SEQ ID NO: 3766068 - DNA, 21 bp, Homo sapiens
gattatataaagacctataaa

SEQ ID NO: 3766069 - DNA, 18 bp, Homo sapiens
gattatattgagacaaaa

SEQ ID NO: 3766070 - DNA, 12 bp, Homo sapiens
gattattggaaa

SEQ ID NO: 3766071 - DNA, 17 bp, Homo sapiens
gattcaattttctttaa

SEQ ID NO: 3766072 - DNA, 22 bp, Homo sapiens
gattcacaatgaaatgctctcc

SEQ ID NO: 3766073 - DNA, 14 bp, Homo sapiens
gattcacatctgca

SEQ ID NO: 3766074 - DNA, 13 bp, Homo sapiens
gattcacctgtaa

SEQ ID NO: 3766075 - DNA, 19 bp, Homo sapiens
gattcacctgtaaaacttt

SEQ ID NO: 3766076 - DNA, 22 bp, Homo sapiens
gattcacctgtaaaactttatt

SEQ ID NO: 3766077 - DNA, 19 bp, Homo sapiens
gattccagagagtggctcc

SEQ ID NO: 3766078 - DNA, 19 bp, Homo sapiens
gattccatctccttgtctt

SEQ ID NO: 3766079 - DNA, 17 bp, Homo sapiens
gattcccaagctctgct

SEQ ID NO: 3766080 - DNA, 14 bp, Homo sapiens
gattcccagagaca

SEQ ID NO: 3766081 - DNA, 21 bp, Homo sapiens
gattcccagagacaggaaaat

SEQ ID NO: 3766082 - DNA, 19 bp, Homo sapiens
gattcccagagcaaaataa

SEQ ID NO: 3766083 - DNA, 16 bp, Homo sapiens
gattcccattgaaaat

SEQ ID NO: 3766084 - DNA, 19 bp, Homo sapiens
gattctaatttttaagcaa

SEQ ID NO: 3766085 - DNA, 23 bp, Homo sapiens
gattctaccacacagcagcagtt

SEQ ID NO: 3766086 - DNA, 11 bp, Homo sapiens
gattctcagat

SEQ ID NO: 3766087 - DNA, 19 bp, Homo sapiens
gattctcctgcctcagcct

SEQ ID NO: 3766088 - DNA, 19 bp, Homo sapiens
gattctgtgtgttttcata

SEQ ID NO: 3766089 - DNA, 17 bp, Homo sapiens
gattcttcctccctccc

SEQ ID NO: 3766090 - DNA, 13 bp, Homo sapiens
gattcttctgctt

SEQ ID NO: 3766091 - DNA, 20 bp, Homo sapiens
gattcttctgcttcagcctc

SEQ ID NO: 3766092 - DNA, 15 bp, Homo sapiens
gattgacagtaactt

SEQ ID NO: 3766093 - DNA, 15 bp, Homo sapiens
gattgcaacaggctg

SEQ ID NO: 3766094 - DNA, 18 bp, Homo sapiens
gattgcaacaggctgggc

SEQ ID NO: 3766095 - DNA, 22 bp, Homo sapiens
gattgcattagaaatagacagt

SEQ ID NO: 3766096 - DNA, 16 bp, Homo sapiens
gattgcgcaaaactga

SEQ ID NO: 3766097 - DNA, 16 bp, Homo sapiens
gattggacggcctgat

SEQ ID NO: 3766098 - DNA, 20 bp, Homo sapiens
gattggttttaattgaagga

SEQ ID NO: 3766099 - DNA, 23 bp, Homo sapiens
gattggttttaattgaaggaaag

SEQ ID NO: 3766100 - DNA, 21 bp, Homo sapiens
gattgtacagaatcattgctt

SEQ ID NO: 3766101 - DNA, 22 bp, Homo sapiens
gattgtacagaatcattgctta

SEQ ID NO: 3766102 - DNA, 21 bp, Homo sapiens
gattgttaagtctaaatattt

SEQ ID NO: 3766103 - DNA, 17 bp, Homo sapiens
gattgtttgctctgaga

SEQ ID NO: 3766104 - DNA, 19 bp, Homo sapiens
gatttaataacataacaaa

SEQ ID NO: 3766105 - DNA, 19 bp, Homo sapiens
gatttacagcctcacttga

SEQ ID NO: 3766106 - DNA, 22 bp, Homo sapiens
gatttacccagaatgtcagatt

SEQ ID NO: 3766107 - DNA, 22 bp, Homo sapiens
gatttagtgaaagctagagata

SEQ ID NO: 3766108 - DNA, 17 bp, Homo sapiens
gatttatcacacaaagc

SEQ ID NO: 3766109 - DNA, 17 bp, Homo sapiens
gatttatgttgtataga

SEQ ID NO: 3766110 - DNA, 21 bp, Homo sapiens
gatttcatttcaactgtttgc

SEQ ID NO: 3766111 - DNA, 11 bp, Homo sapiens
gatttctgatt

SEQ ID NO: 3766112 - DNA, 21 bp, Homo sapiens
gatttgctatcaaaataaatt

SEQ ID NO: 3766113 - DNA, 14 bp, Homo sapiens
gatttgtcccaggt

SEQ ID NO: 3766114 - DNA, 17 bp, Homo sapiens
gatttgttttagaatga

SEQ ID NO: 3766115 - DNA, 13 bp, Homo sapiens
gattttaattttg

SEQ ID NO: 3766116 - DNA, 19 bp, Homo sapiens
gattttacaattgaaatga

SEQ ID NO: 3766117 - DNA, 22 bp, Homo sapiens
gattttacatttatctgtacat

SEQ ID NO: 3766118 - DNA, 15 bp, Homo sapiens
gattttcagccctca

SEQ ID NO: 3766119 - DNA, 21 bp, Homo sapiens
gattttgaaaactacatttta

SEQ ID NO: 3766120 - DNA, 14 bp, Homo sapiens
gcaaaaatttttgg

SEQ ID NO: 3766121 - DNA, 16 bp, Homo sapiens
gcaaaaccattgcttc

SEQ ID NO: 3766122 - DNA, 14 bp, Homo sapiens
gcaaaagaagtaac

SEQ ID NO: 3766123 - DNA, 20 bp, Homo sapiens
gcaaaataattttaaacaaa

SEQ ID NO: 3766124 - DNA, 10 bp, Homo sapiens
gcaaaatttc

SEQ ID NO: 3766125 - DNA, 17 bp, Homo sapiens
gcaaacacacaaaggta

SEQ ID NO: 3766126 - DNA, 17 bp, Homo sapiens
gcaaacctgccccatcc

SEQ ID NO: 3766127 - DNA, 20 bp, Homo sapiens
gcaaacttaagaaacactga

SEQ ID NO: 3766128 - DNA, 22 bp, Homo sapiens
gcaaagaatttcaatttgttca

SEQ ID NO: 3766129 - DNA, 15 bp, Homo sapiens
gcaaagacagaagcc

SEQ ID NO: 3766130 - DNA, 16 bp, Homo sapiens
gcaaagacagaagcct

SEQ ID NO: 3766131 - DNA, 17 bp, Homo sapiens
gcaaagacagaagcctc

SEQ ID NO: 3766132 - DNA, 14 bp, Homo sapiens
gcaaagaggcaaga

SEQ ID NO: 3766133 - DNA, 20 bp, Homo sapiens
gcaaaggggtcccatagagg

SEQ ID NO: 3766134 - DNA, 23 bp, Homo sapiens
gcaaagttccctacttcctgtga

SEQ ID NO: 3766135 - DNA, 16 bp, Homo sapiens
gcaaatgtgacctgtg

SEQ ID NO: 3766136 - DNA, 15 bp, Homo sapiens
gcaaatgtggctcct

SEQ ID NO: 3766137 - DNA, 15 bp, Homo sapiens
gcaaatgttacatag

SEQ ID NO: 3766138 - DNA, 19 bp, Homo sapiens
gcaacagacaagtgactgt

SEQ ID NO: 3766139 - DNA, 15 bp, Homo sapiens
gcaacaggctgggct

SEQ ID NO: 3766140 - DNA, 19 bp, Homo sapiens
gcaacaggctgggcttcag

SEQ ID NO: 3766141 - DNA, 15 bp, Homo sapiens
gcaacccccagcctg

SEQ ID NO: 3766142 - DNA, 16 bp, Homo sapiens
gcaacccccagcctgc

SEQ ID NO: 3766143 - DNA, 19 bp, Homo sapiens
gcaacctccgcctcttggg

SEQ ID NO: 3766144 - DNA, 16 bp, Homo sapiens
gcaactgaacaaaaaa

SEQ ID NO: 3766145 - DNA, 19 bp, Homo sapiens
gcaacttgtctttttctgg

SEQ ID NO: 3766146 - DNA, 21 bp, Homo sapiens
gcaacttgtctttttctggac

SEQ ID NO: 3766147 - DNA, 17 bp, Homo sapiens
gcaagaaagaaacccga

SEQ ID NO: 3766148 - DNA, 15 bp, Homo sapiens
gcaagaatttgatcg

SEQ ID NO: 3766149 - DNA, 16 bp, Homo sapiens
gcaagaccctgtctct

SEQ ID NO: 3766150 - DNA, 23 bp, Homo sapiens
gcaagagccttggtgtccacctg

SEQ ID NO: 3766151 - DNA, 13 bp, Homo sapiens
gcaagattgctta

SEQ ID NO: 3766152 - DNA, 14 bp, Homo sapiens
gcaagcacatctgc

SEQ ID NO: 3766153 - DNA, 16 bp, Homo sapiens
gcaagcacctcctgcc

SEQ ID NO: 3766154 - DNA, 21 bp, Homo sapiens
gcaagcactgcatgggcaagc

SEQ ID NO: 3766155 - DNA, 17 bp, Homo sapiens
gcaagcttggctgtaga

SEQ ID NO: 3766156 - DNA, 19 bp, Homo sapiens
gcaagcttttttatttttt

SEQ ID NO: 3766157 - DNA, 13 bp, Homo sapiens
gcaaggaaggaaa

SEQ ID NO: 3766158 - DNA, 16 bp, Homo sapiens
gcaagtcacaaaggaa

SEQ ID NO: 3766159 - DNA, 17 bp, Homo sapiens
gcaagtctggatctggg

SEQ ID NO: 3766160 - DNA, 20 bp, Homo sapiens
gcaagtgaatttttctctaa

SEQ ID NO: 3766161 - DNA, 16 bp, Homo sapiens
gcaagtgagagctggg

SEQ ID NO: 3766162 - DNA, 19 bp, Homo sapiens
gcaagtgagagctgggtgt

SEQ ID NO: 3766163 - DNA, 21 bp, Homo sapiens
gcaagtgagcaaacctgcccc

SEQ ID NO: 3766164 - DNA, 21 bp, Homo sapiens
gcaagtgtatgcacgtgtgca

SEQ ID NO: 3766165 - DNA, 15 bp, Homo sapiens
gcaagtgtctgtgtg

SEQ ID NO: 3766166 - DNA, 23 bp, Homo sapiens
gcaagtgtgtgcacatgtgtgcg

SEQ ID NO: 3766167 - DNA, 15 bp, Homo sapiens
gcaatagagactgta

SEQ ID NO: 3766168 - DNA, 17 bp, Homo sapiens
gcaatagagactgtaga

SEQ ID NO: 3766169 - DNA, 13 bp, Homo sapiens
gcaatagtgtgtt

SEQ ID NO: 3766170 - DNA, 21 bp, Homo sapiens
gcaatccatgttagtttttac

SEQ ID NO: 3766171 - DNA, 12 bp, Homo sapiens
gcaatcctcctg

SEQ ID NO: 3766172 - DNA, 16 bp, Homo sapiens
gcaatgacatcttcaa

SEQ ID NO: 3766173 - DNA, 16 bp, Homo sapiens
gcaatgattactcttt

SEQ ID NO: 3766174 - DNA, 13 bp, Homo sapiens
gcaatggcagcct

SEQ ID NO: 3766175 - DNA, 14 bp, Homo sapiens
gcaatgttatcttg

SEQ ID NO: 3766176 - DNA, 18 bp, Homo sapiens
gcaatttccttttttgtt

SEQ ID NO: 3766177 - DNA, 21 bp, Homo sapiens
gcaattttaacacacataaag

SEQ ID NO: 3766178 - DNA, 23 bp, Homo sapiens
gcaattttaacacacataaagga

SEQ ID NO: 3766179 - DNA, 21 bp, Homo sapiens
gcacaaaatataaagcatcta

SEQ ID NO: 3766180 - DNA, 13 bp, Homo sapiens
gcacaaatattta

SEQ ID NO: 3766181 - DNA, 17 bp, Homo sapiens
gccaccatggccagcca

SEQ ID NO: 3766182 - DNA, 21 bp, Homo sapiens
gccaccccgggctctctgctg

SEQ ID NO: 3766183 - DNA, 15 bp, Homo sapiens
gccacccctccttcc

SEQ ID NO: 3766184 - DNA, 16 bp, Homo sapiens
gccaccctcccagctc

SEQ ID NO: 3766185 - DNA, 18 bp, Homo sapiens
gccaccctcccagctctg

SEQ ID NO: 3766186 - DNA, 11 bp, Homo sapiens
gccacctcccc

SEQ ID NO: 3766187 - DNA, 12 bp, Homo sapiens
gccacctcccct

SEQ ID NO: 3766188 - DNA, 17 bp, Homo sapiens
gccacctcccctatcca

SEQ ID NO: 3766189 - DNA, 20 bp, Homo sapiens
gccacctcccctatccaccc

SEQ ID NO: 3766190 - DNA, 21 bp, Homo sapiens
gccacctcccctatccaccca

SEQ ID NO: 3766191 - DNA, 16 bp, Homo sapiens
gccacctgcccccttc

SEQ ID NO: 3766192 - DNA, 17 bp, Homo sapiens
gccacctgcccccttct

SEQ ID NO: 3766193 - DNA, 17 bp, Homo sapiens
gccacctggggcagtca

SEQ ID NO: 3766194 - DNA, 14 bp, Homo sapiens
gccacggcagccta

SEQ ID NO: 3766195 - DNA, 19 bp, Homo sapiens
gccacggccaggccagagg

SEQ ID NO: 3766196 - DNA, 18 bp, Homo sapiens
gccacgtgccaggcccgg

SEQ ID NO: 3766197 - DNA, 16 bp, Homo sapiens
gccacgttccttactg

SEQ ID NO: 3766198 - DNA, 22 bp, Homo sapiens
gccacgttccttactgcagaat

SEQ ID NO: 3766199 - DNA, 18 bp, Homo sapiens
gccactacactccagcct

SEQ ID NO: 3766200 - DNA, 19 bp, Homo sapiens
gccactacactccagcctg

SEQ ID NO: 3766201 - DNA, 20 bp, Homo sapiens
gccactacactccagcctga

SEQ ID NO: 3766202 - DNA, 16 bp, Homo sapiens
gccactccagacccct

SEQ ID NO: 3766203 - DNA, 21 bp, Homo sapiens
gccactccagacccctggctt

SEQ ID NO: 3766204 - DNA, 18 bp, Homo sapiens
gccactcgcttcccccat

SEQ ID NO: 3766205 - DNA, 17 bp, Homo sapiens
gccactctgcctctgcc

SEQ ID NO: 3766206 - DNA, 23 bp, Homo sapiens
gccactctgttcctggctcagcc

SEQ ID NO: 3766207 - DNA, 20 bp, Homo sapiens
gccactgcaccgggccacag

SEQ ID NO: 3766208 - DNA, 19 bp, Homo sapiens
gccactgcactccagcctg

SEQ ID NO: 3766209 - DNA, 17 bp, Homo sapiens
gccactgcccgagctgg

SEQ ID NO: 3766210 - DNA, 18 bp, Homo sapiens
gccactgcccgagctggt

SEQ ID NO: 3766211 - DNA, 19 bp, Homo sapiens
gccactgcccgagctggtg

SEQ ID NO: 3766212 - DNA, 16 bp, Homo sapiens
gccactgcctcttcct

SEQ ID NO: 3766213 - DNA, 23 bp, Homo sapiens
gccactttggtacatggccagtg

SEQ ID NO: 3766214 - DNA, 23 bp, Homo sapiens
gccacttttgactagggattcag

SEQ ID NO: 3766215 - DNA, 16 bp, Homo sapiens
gccagaacagtttgta

SEQ ID NO: 3766216 - DNA, 18 bp, Homo sapiens
gccagaagggggccatga

SEQ ID NO: 3766217 - DNA, 19 bp, Homo sapiens
gccagaccagagctctgga

SEQ ID NO: 3766218 - DNA, 20 bp, Homo sapiens
gccagaggcagaaccctggt

SEQ ID NO: 3766219 - DNA, 17 bp, Homo sapiens
gccagagggagtgacag

SEQ ID NO: 3766220 - DNA, 19 bp, Homo sapiens
gccagagggagtgacagag

SEQ ID NO: 3766221 - DNA, 22 bp, Homo sapiens
gccagagggagtgacagaggca

SEQ ID NO: 3766222 - DNA, 23 bp, Homo sapiens
gccagagggagtgacagaggcag

SEQ ID NO: 3766223 - DNA, 15 bp, Homo sapiens
gccagagtggcctgg

SEQ ID NO: 3766224 - DNA, 13 bp, Homo sapiens
gccagatctgtta

SEQ ID NO: 3766225 - DNA, 22 bp, Homo sapiens
gccagatgcacatccctggaag

SEQ ID NO: 3766226 - DNA, 16 bp, Homo sapiens
gccagatgcaccagcc

SEQ ID NO: 3766227 - DNA, 13 bp, Homo sapiens
gccagcagccagc

SEQ ID NO: 3766228 - DNA, 19 bp, Homo sapiens
gccagcagccagctctcag

SEQ ID NO: 3766229 - DNA, 20 bp, Homo sapiens
gccagcagccagctctcagc

SEQ ID NO: 3766230 - DNA, 19 bp, Homo sapiens
gccagccagcagccagctc

SEQ ID NO: 3766231 - DNA, 19 bp, Homo sapiens
gccagccagtgacctgagg

SEQ ID NO: 3766232 - DNA, 17 bp, Homo sapiens
gccagccccacccagga

SEQ ID NO: 3766233 - DNA, 18 bp, Homo sapiens
gccagccccacccaggag

SEQ ID NO: 3766234 - DNA, 13 bp, Homo sapiens
gccagccctccct

SEQ ID NO: 3766235 - DNA, 14 bp, Homo sapiens
gccagccctccctg

SEQ ID NO: 3766236 - DNA, 22 bp, Homo sapiens
gccagccctccctgtcctcctc

SEQ ID NO: 3766237 - DNA, 21 bp, Homo sapiens
gccagcctggcttctggagcc

SEQ ID NO: 3766238 - DNA, 22 bp, Homo sapiens
gccagcctggcttctggagccc

SEQ ID NO: 3766239 - DNA, 14 bp, Homo sapiens
gccagctctcagcc

SEQ ID NO: 3766240 - DNA, 20 bp, Homo sapiens
gccaggagctcttcaggcct

SEQ ID NO: 3766241 - DNA, 22 bp, Homo sapiens
gccaggagctcttcaggcctcc

SEQ ID NO: 3766242 - DNA, 23 bp, Homo sapiens
gccaggagctgggcagaaggcca

SEQ ID NO: 3766243 - DNA, 14 bp, Homo sapiens
gccaggcagatctg

SEQ ID NO: 3766244 - DNA, 18 bp, Homo sapiens
gccaggcccggggctggc

SEQ ID NO: 3766245 - DNA, 14 bp, Homo sapiens
gccaggcctgggtc

SEQ ID NO: 3766246 - DNA, 18 bp, Homo sapiens
gccaggctcaggccatgg

SEQ ID NO: 3766247 - DNA, 14 bp, Homo sapiens
gccaggctccttcc

SEQ ID NO: 3766248 - DNA, 14 bp, Homo sapiens
gccaggctgccaag

SEQ ID NO: 3766249 - DNA, 15 bp, Homo sapiens
gccagggccctgcag

SEQ ID NO: 3766250 - DNA, 17 bp, Homo sapiens
gccagggccctgcagag

SEQ ID NO: 3766251 - DNA, 23 bp, Homo sapiens
gccaggggaaaatcagcctgctc

SEQ ID NO: 3766252 - DNA, 14 bp, Homo sapiens
gccagtcctgcctg

SEQ ID NO: 3766253 - DNA, 17 bp, Homo sapiens
gccagtcctgcctggcc

SEQ ID NO: 3766254 - DNA, 18 bp, Homo sapiens
gccagtcctgcctggcca

SEQ ID NO: 3766255 - DNA, 14 bp, Homo sapiens
gccagtctcccagg

SEQ ID NO: 3766256 - DNA, 15 bp, Homo sapiens
gccagtctcccaggc

SEQ ID NO: 3766257 - DNA, 17 bp, Homo sapiens
gccagtgccttacctcc

SEQ ID NO: 3766258 - DNA, 20 bp, Homo sapiens
gccagtgccttacctcctgc

SEQ ID NO: 3766259 - DNA, 23 bp, Homo sapiens
gccagtgccttacctcctgccca

SEQ ID NO: 3766260 - DNA, 12 bp, Homo sapiens
gccagtgtcttt

SEQ ID NO: 3766261 - DNA, 13 bp, Homo sapiens
gccagtgtctttc

SEQ ID NO: 3766262 - DNA, 14 bp, Homo sapiens
gccagtgtctttct

SEQ ID NO: 3766263 - DNA, 15 bp, Homo sapiens
gccagtgtctttctt

SEQ ID NO: 3766264 - DNA, 18 bp, Homo sapiens
gccagtgtctttctttgg

SEQ ID NO: 3766265 - DNA, 20 bp, Homo sapiens
gccagtgtgatcccaagtgc

SEQ ID NO: 3766266 - DNA, 14 bp, Homo sapiens
gccatccaggttca

SEQ ID NO: 3766267 - DNA, 18 bp, Homo sapiens
gccatcggtcctgtctcc

SEQ ID NO: 3766268 - DNA, 16 bp, Homo sapiens
gccatcttgaagtgat

SEQ ID NO: 3766269 - DNA, 20 bp, Homo sapiens
gccatgaactggaggccagg

SEQ ID NO: 3766270 - DNA, 19 bp, Homo sapiens
gccatgacaacttctaatt

SEQ ID NO: 3766271 - DNA, 23 bp, Homo sapiens
gccatgacaacttctaattgcca

SEQ ID NO: 3766272 - DNA, 19 bp, Homo sapiens
gccatgagctccagacccc

SEQ ID NO: 3766273 - DNA, 20 bp, Homo sapiens
gccatgaggcctcagtggac

SEQ ID NO: 3766274 - DNA, 18 bp, Homo sapiens
gccatgccagcttatctc

SEQ ID NO: 3766275 - DNA, 14 bp, Homo sapiens
gccatgctcctggc

SEQ ID NO: 3766276 - DNA, 18 bp, Homo sapiens
gccatggacagaagaagg

SEQ ID NO: 3766277 - DNA, 20 bp, Homo sapiens
gccatggactctacactgtg

SEQ ID NO: 3766278 - DNA, 22 bp, Homo sapiens
gccatggactctacactgtgaa

SEQ ID NO: 3766279 - DNA, 17 bp, Homo sapiens
gccatggcgtgtccctc

SEQ ID NO: 3766280 - DNA, 22 bp, Homo sapiens
gccatggcgtgtccctctcgga

SEQ ID NO: 3766281 - DNA, 14 bp, Homo sapiens
gccatgtgagccac

SEQ ID NO: 3766282 - DNA, 13 bp, Homo sapiens
gccattaccatgg

SEQ ID NO: 3766283 - DNA, 18 bp, Homo sapiens
gccattaccatggagaca

SEQ ID NO: 3766284 - DNA, 21 bp, Homo sapiens
gccattgcactccagcctggg

SEQ ID NO: 3766285 - DNA, 17 bp, Homo sapiens
gccattgccaccaggag

SEQ ID NO: 3766286 - DNA, 14 bp, Homo sapiens
gccattgtctttat

SEQ ID NO: 3766287 - DNA, 18 bp, Homo sapiens
gccattgtctttatatga

SEQ ID NO: 3766288 - DNA, 21 bp, Homo sapiens
gccatttatgtgagtgtgtgt

SEQ ID NO: 3766289 - DNA, 16 bp, Homo sapiens
gcccaaagccagacag

SEQ ID NO: 3766290 - DNA, 22 bp, Homo sapiens
gcccaaattatcaagctaataa

SEQ ID NO: 3766291 - DNA, 13 bp, Homo sapiens
gcccaacctcagc

SEQ ID NO: 3766292 - DNA, 13 bp, Homo sapiens
gcccaacctcctg

SEQ ID NO: 3766293 - DNA, 19 bp, Homo sapiens
gcggagacggagtcccacc

SEQ ID NO: 3766294 - DNA, 19 bp, Homo sapiens
gcggccgcattccctgagt

SEQ ID NO: 3766295 - DNA, 16 bp, Homo sapiens
gcggcctttggcttca

SEQ ID NO: 3766296 - DNA, 13 bp, Homo sapiens
gcggctactcagc

SEQ ID NO: 3766297 - DNA, 20 bp, Homo sapiens
gcggctactcagcagccctc

SEQ ID NO: 3766298 - DNA, 22 bp, Homo sapiens
gcggctcaaaaggaaaccaagt

SEQ ID NO: 3766299 - DNA, 23 bp, Homo sapiens
gcggctgagtcatgatctccctg

SEQ ID NO: 3766300 - DNA, 15 bp, Homo sapiens
gcggctggcagccca

SEQ ID NO: 3766301 - DNA, 19 bp, Homo sapiens
gcgggaccggtacagaaag

SEQ ID NO: 3766302 - DNA, 16 bp, Homo sapiens
gcgggagacctgtgct

SEQ ID NO: 3766303 - DNA, 22 bp, Homo sapiens
gcgggaggatgttctgggacac

SEQ ID NO: 3766304 - DNA, 15 bp, Homo sapiens
gcgggcacaataaat

SEQ ID NO: 3766305 - DNA, 15 bp, Homo sapiens
gcgggccaaggactg

SEQ ID NO: 3766306 - DNA, 14 bp, Homo sapiens
gcgggctgggcagc

SEQ ID NO: 3766307 - DNA, 13 bp, Homo sapiens
gcggggacagctc

SEQ ID NO: 3766308 - DNA, 19 bp, Homo sapiens
gcggggacagctccttctg

SEQ ID NO: 3766309 - DNA, 11 bp, Homo sapiens
gcggggggagg

SEQ ID NO: 3766310 - DNA, 16 bp, Homo sapiens
gcggtacaaaggaaaa

SEQ ID NO: 3766311 - DNA, 14 bp, Homo sapiens
gcggtccacccagg

SEQ ID NO: 3766312 - DNA, 14 bp, Homo sapiens
gcggtttggggagc

SEQ ID NO: 3766313 - DNA, 17 bp, Homo sapiens
gcgtcctgacggcgccc

SEQ ID NO: 3766314 - DNA, 21 bp, Homo sapiens
gcgtccttccccctgtagact

SEQ ID NO: 3766315 - DNA, 16 bp, Homo sapiens
gcgtgaaggccgagaa

SEQ ID NO: 3766316 - DNA, 15 bp, Homo sapiens
gcgtgagccactgca

SEQ ID NO: 3766317 - DNA, 16 bp, Homo sapiens
gcgtgagccactgcac

SEQ ID NO: 3766318 - DNA, 23 bp, Homo sapiens
gcgtgagccactgcaccgggcca

SEQ ID NO: 3766319 - DNA, 18 bp, Homo sapiens
gcgtgaggatgggaagga

SEQ ID NO: 3766320 - DNA, 23 bp, Homo sapiens
gcgtgcacacaccagagcccacc

SEQ ID NO: 3766321 - DNA, 18 bp, Homo sapiens
gcgtgtgcgtgcatgtgc

SEQ ID NO: 3766322 - DNA, 11 bp, Homo sapiens
gcgtgtggctc

SEQ ID NO: 3766323 - DNA, 19 bp, Homo sapiens
gcgtgtggctcacgtgtgt

SEQ ID NO: 3766324 - DNA, 21 bp, Homo sapiens
gcgtgtggctcacgtgtgtga

SEQ ID NO: 3766325 - DNA, 17 bp, Homo sapiens
gcgtgtgtccatgtgtg

SEQ ID NO: 3766326 - DNA, 18 bp, Homo sapiens
gcgtgtgtccatgtgtgt

SEQ ID NO: 3766327 - DNA, 22 bp, Homo sapiens
gcgttattggtcggcagccttc

SEQ ID NO: 3766328 - DNA, 19 bp, Homo sapiens
gctaaatcctttactgtta

SEQ ID NO: 3766329 - DNA, 23 bp, Homo sapiens
gctaaatggtcgcccaggagaca

SEQ ID NO: 3766330 - DNA, 18 bp, Homo sapiens
gctaaatgtaagaatcat

SEQ ID NO: 3766331 - DNA, 13 bp, Homo sapiens
gctaaatgtgaat

SEQ ID NO: 3766332 - DNA, 15 bp, Homo sapiens
gctaacactggcccc

SEQ ID NO: 3766333 - DNA, 19 bp, Homo sapiens
gctaacagttcacttgcag

SEQ ID NO: 3766334 - DNA, 22 bp, Homo sapiens
gctaacccccttctactgagcc

SEQ ID NO: 3766335 - DNA, 13 bp, Homo sapiens
gctaactggaagc

SEQ ID NO: 3766336 - DNA, 15 bp, Homo sapiens
gctaaggcaccagcc

SEQ ID NO: 3766337 - DNA, 13 bp, Homo sapiens
gctaagtgaaaag

SEQ ID NO: 3766338 - DNA, 22 bp, Homo sapiens
gctaagtgatcctcccacctca

SEQ ID NO: 3766339 - DNA, 23 bp, Homo sapiens
gctaagtgatcctcccacctcag

SEQ ID NO: 3766340 - DNA, 23 bp, Homo sapiens
gctaataaaatatcattcagcaa

SEQ ID NO: 3766341 - DNA, 17 bp, Homo sapiens
gctaatcagcattctca

SEQ ID NO: 3766342 - DNA, 22 bp, Homo sapiens
gctaatcagcattctcactcct

SEQ ID NO: 3766343 - DNA, 22 bp, Homo sapiens
gctaatcatgtgggtgagccag

SEQ ID NO: 3766344 - DNA, 13 bp, Homo sapiens
gctaatgggacac

SEQ ID NO: 3766345 - DNA, 15 bp, Homo sapiens
gctaatgggacacta

SEQ ID NO: 3766346 - DNA, 20 bp, Homo sapiens
gctacaaatactcttaggaa

SEQ ID NO: 3766347 - DNA, 21 bp, Homo sapiens
gctacaggaagcaccccatgc

SEQ ID NO: 3766348 - DNA, 16 bp, Homo sapiens
gctactaatgatgttt

SEQ ID NO: 3766349 - DNA, 21 bp, Homo sapiens
gctactcaagaggctgaggca

SEQ ID NO: 3766350 - DNA, 23 bp, Homo sapiens
gctactcactcaagttcaaggac

SEQ ID NO: 3766351 - DNA, 14 bp, Homo sapiens
gctactcagaagcc

SEQ ID NO: 3766352 - DNA, 15 bp, Homo sapiens
gctactcagaagcct

SEQ ID NO: 3766353 - DNA, 18 bp, Homo sapiens
gctactcagaagcctgag

SEQ ID NO: 3766354 - DNA, 12 bp, Homo sapiens
gctactcagcag

SEQ ID NO: 3766355 - DNA, 18 bp, Homo sapiens
gctactcagcagccctcc

SEQ ID NO: 3766356 - DNA, 19 bp, Homo sapiens
gctactcagcagccctcct

SEQ ID NO: 3766357 - DNA, 21 bp, Homo sapiens
gctactcagcagccctcctca

SEQ ID NO: 3766358 - DNA, 22 bp, Homo sapiens
gctactcagcagccctcctcac

SEQ ID NO: 3766359 - DNA, 15 bp, Homo sapiens
gctactcaggaggct

SEQ ID NO: 3766360 - DNA, 16 bp, Homo sapiens
gctactcaggaggctg

SEQ ID NO: 3766361 - DNA, 20 bp, Homo sapiens
gctactgtcctacccaccct

SEQ ID NO: 3766362 - DNA, 20 bp, Homo sapiens
gctacttcctgcctggtctc

SEQ ID NO: 3766363 - DNA, 21 bp, Homo sapiens
gctacttcctgcctggtctcc

SEQ ID NO: 3766364 - DNA, 20 bp, Homo sapiens
gctagaagtgggccaggaca

SEQ ID NO: 3766365 - DNA, 20 bp, Homo sapiens
gctagagatatggcagcgaa

SEQ ID NO: 3766366 - DNA, 21 bp, Homo sapiens
gctagagatatggcagcgaaa

SEQ ID NO: 3766367 - DNA, 19 bp, Homo sapiens
gctagaggccagccccacc

SEQ ID NO: 3766368 - DNA, 21 bp, Homo sapiens
gctagaggccagccccaccca

SEQ ID NO: 3766369 - DNA, 13 bp, Homo sapiens
gctagagtcctca

SEQ ID NO: 3766370 - DNA, 22 bp, Homo sapiens
gctagcagcagggagggcttct

SEQ ID NO: 3766371 - DNA, 20 bp, Homo sapiens
gctagcgctgccgcacccca

SEQ ID NO: 3766372 - DNA, 21 bp, Homo sapiens
gctagcgctgccgcaccccag

SEQ ID NO: 3766373 - DNA, 22 bp, Homo sapiens
gctaggacccctccatgtgggc

SEQ ID NO: 3766374 - DNA, 15 bp, Homo sapiens
gctagggtggccctt

SEQ ID NO: 3766375 - DNA, 18 bp, Homo sapiens
gctagtcagagagagtgt

SEQ ID NO: 3766376 - DNA, 15 bp, Homo sapiens
gctagttttacagat

SEQ ID NO: 3766377 - DNA, 21 bp, Homo sapiens
gctagttttacagattgcctc

SEQ ID NO: 3766378 - DNA, 18 bp, Homo sapiens
gctatagctacaggaagc

SEQ ID NO: 3766379 - DNA, 22 bp, Homo sapiens
gctatatttaagtattcaagaa

SEQ ID NO: 3766380 - DNA, 23 bp, Homo sapiens
gctatcaaaataaattgaaatat

SEQ ID NO: 3766381 - DNA, 13 bp, Homo sapiens
gctatgggagccc

SEQ ID NO: 3766382 - DNA, 17 bp, Homo sapiens
gctattattttcactgt

SEQ ID NO: 3766383 - DNA, 22 bp, Homo sapiens
gctattgatataaataaaacat

SEQ ID NO: 3766384 - DNA, 16 bp, Homo sapiens
gctatttcccaagctg

SEQ ID NO: 3766385 - DNA, 15 bp, Homo sapiens
gctatttttatggaa

SEQ ID NO: 3766386 - DNA, 14 bp, Homo sapiens
gctcaaaaggaaac

SEQ ID NO: 3766387 - DNA, 18 bp, Homo sapiens
gctcaagcaatcctcctg

SEQ ID NO: 3766388 - DNA, 17 bp, Homo sapiens
gctcaaggcgtgaggat

SEQ ID NO: 3766389 - DNA, 22 bp, Homo sapiens
gctcaagtcctcttttctgaga

SEQ ID NO: 3766390 - DNA, 20 bp, Homo sapiens
gctcaagtcttccctgatca

SEQ ID NO: 3766391 - DNA, 19 bp, Homo sapiens
gctcaatattcctgaatga

SEQ ID NO: 3766392 - DNA, 14 bp, Homo sapiens
gctcacacatgaga

SEQ ID NO: 3766393 - DNA, 17 bp, Homo sapiens
gctcacagactggagac

SEQ ID NO: 3766394 - DNA, 16 bp, Homo sapiens
gctcacagttcctcgc

SEQ ID NO: 3766395 - DNA, 17 bp, Homo sapiens
gctcacagttcctcgcc

SEQ ID NO: 3766396 - DNA, 21 bp, Homo sapiens
gctcacagttcctcgccctgg

SEQ ID NO: 3766397 - DNA, 16 bp, Homo sapiens
gctcacatatctgtca

SEQ ID NO: 3766398 - DNA, 14 bp, Homo sapiens
gctcaccagcccca

SEQ ID NO: 3766399 - DNA, 15 bp, Homo sapiens
gctcaccagccccag

SEQ ID NO: 3766400 - DNA, 18 bp, Homo sapiens
gctcaccagccccagtgc

SEQ ID NO: 3766401 - DNA, 21 bp, Homo sapiens
gctcacgcctgtaatcccagc

SEQ ID NO: 3766402 - DNA, 15 bp, Homo sapiens
gctcacgtcacactt

SEQ ID NO: 3766403 - DNA, 13 bp, Homo sapiens
gctcactgcagcc

SEQ ID NO: 3766404 - DNA, 16 bp, Homo sapiens
gctcactgcagcctca

SEQ ID NO: 3766405 - DNA, 16 bp, Homo sapiens
ggaatgttaaagtcag

SEQ ID NO: 3766406 - DNA, 19 bp, Homo sapiens
ggaatgtttgcctctgcct

SEQ ID NO: 3766407 - DNA, 17 bp, Homo sapiens
ggaattaaaacaatgtc

SEQ ID NO: 3766408 - DNA, 22 bp, Homo sapiens
ggaattctcttggctggcttcc

SEQ ID NO: 3766409 - DNA, 20 bp, Homo sapiens
ggaattgacttcgactgtga

SEQ ID NO: 3766410 - DNA, 23 bp, Homo sapiens
ggaattggtggcagattttacaa

SEQ ID NO: 3766411 - DNA, 15 bp, Homo sapiens
ggaattttttattct

SEQ ID NO: 3766412 - DNA, 18 bp, Homo sapiens
ggacaaagtctccagccc

SEQ ID NO: 3766413 - DNA, 15 bp, Homo sapiens
ggacacagctcttct

SEQ ID NO: 3766414 - DNA, 22 bp, Homo sapiens
ggacactaaccacgctggacct

SEQ ID NO: 3766415 - DNA, 17 bp, Homo sapiens
ggacactcaaaagctgg

SEQ ID NO: 3766416 - DNA, 22 bp, Homo sapiens
ggacactcaaaagctgggcagg

SEQ ID NO: 3766417 - DNA, 14 bp, Homo sapiens
ggacagaagaaggc

SEQ ID NO: 3766418 - DNA, 20 bp, Homo sapiens
ggacagagacacctgcacct

SEQ ID NO: 3766419 - DNA, 21 bp, Homo sapiens
ggacagagacacctgcacctc

SEQ ID NO: 3766420 - DNA, 13 bp, Homo sapiens
ggacagatcatag

SEQ ID NO: 3766421 - DNA, 23 bp, Homo sapiens
ggacagatcatagatttctgatt

SEQ ID NO: 3766422 - DNA, 15 bp, Homo sapiens
ggacagcaaaaccat

SEQ ID NO: 3766423 - DNA, 19 bp, Homo sapiens
ggacagccacggccaggcc

SEQ ID NO: 3766424 - DNA, 20 bp, Homo sapiens
ggacagccacggccaggcca

SEQ ID NO: 3766425 - DNA, 21 bp, Homo sapiens
ggacagccacggccaggccag

SEQ ID NO: 3766426 - DNA, 22 bp, Homo sapiens
ggacagcctgtggcggtgcctg

SEQ ID NO: 3766427 - DNA, 11 bp, Homo sapiens
ggacagctcct

SEQ ID NO: 3766428 - DNA, 13 bp, Homo sapiens
ggacaggcagaaa

SEQ ID NO: 3766429 - DNA, 13 bp, Homo sapiens
ggacaggcaggtg

SEQ ID NO: 3766430 - DNA, 22 bp, Homo sapiens
ggacaggcccggcgcggtggct

SEQ ID NO: 3766431 - DNA, 15 bp, Homo sapiens
ggacagggcatggcc

SEQ ID NO: 3766432 - DNA, 20 bp, Homo sapiens
ggacaggtctgggagaggca

SEQ ID NO: 3766433 - DNA, 14 bp, Homo sapiens
ggacagtgcttcag

SEQ ID NO: 3766434 - DNA, 16 bp, Homo sapiens
ggacagtgcttcagcc

SEQ ID NO: 3766435 - DNA, 18 bp, Homo sapiens
ggacagtgcttcagcctg

SEQ ID NO: 3766436 - DNA, 20 bp, Homo sapiens
ggacagtgcttcagcctgag

SEQ ID NO: 3766437 - DNA, 16 bp, Homo sapiens
ggacatgttcccttct

SEQ ID NO: 3766438 - DNA, 20 bp, Homo sapiens
ggacattgcggacagccacg

SEQ ID NO: 3766439 - DNA, 18 bp, Homo sapiens
ggaccaacaagggcagtg

SEQ ID NO: 3766440 - DNA, 12 bp, Homo sapiens
ggaccagatgct

SEQ ID NO: 3766441 - DNA, 14 bp, Homo sapiens
ggaccaggacagga

SEQ ID NO: 3766442 - DNA, 17 bp, Homo sapiens
ggaccaggacaggacca

SEQ ID NO: 3766443 - DNA, 13 bp, Homo sapiens
ggacccctgccct

SEQ ID NO: 3766444 - DNA, 22 bp, Homo sapiens
ggaccctttccttccttccctg

SEQ ID NO: 3766445 - DNA, 17 bp, Homo sapiens
ggaccgagtagaggcat

SEQ ID NO: 3766446 - DNA, 19 bp, Homo sapiens
ggacctcaggtgagaagca

SEQ ID NO: 3766447 - DNA, 13 bp, Homo sapiens
ggacctcctgagc

SEQ ID NO: 3766448 - DNA, 16 bp, Homo sapiens
ggacctcgtgctttaa

SEQ ID NO: 3766449 - DNA, 12 bp, Homo sapiens
ggacctctgggc

SEQ ID NO: 3766450 - DNA, 15 bp, Homo sapiens
ggaccttatctgtgc

SEQ ID NO: 3766451 - DNA, 18 bp, Homo sapiens
ggaccttgaactgggtac

SEQ ID NO: 3766452 - DNA, 18 bp, Homo sapiens
ggacggcattcctgctta

SEQ ID NO: 3766453 - DNA, 21 bp, Homo sapiens
ggacggcctgatgctccctcc

SEQ ID NO: 3766454 - DNA, 14 bp, Homo sapiens
ggactattataatt

SEQ ID NO: 3766455 - DNA, 15 bp, Homo sapiens
ggactcaatgcactg

SEQ ID NO: 3766456 - DNA, 22 bp, Homo sapiens
ggactcaatgcactgacattgt

SEQ ID NO: 3766457 - DNA, 15 bp, Homo sapiens
ggactcactggcagc

SEQ ID NO: 3766458 - DNA, 20 bp, Homo sapiens
ggactcaggatgcccagggc

SEQ ID NO: 3766459 - DNA, 11 bp, Homo sapiens
ggactctgagg

SEQ ID NO: 3766460 - DNA, 11 bp, Homo sapiens
ggactctgcct

SEQ ID NO: 3766461 - DNA, 17 bp, Homo sapiens
ggactgaagcctgcagg

SEQ ID NO: 3766462 - DNA, 19 bp, Homo sapiens
ggactgaagcctgcaggag

SEQ ID NO: 3766463 - DNA, 19 bp, Homo sapiens
ggactgcatggtaatttat

SEQ ID NO: 3766464 - DNA, 21 bp, Homo sapiens
ggactgccagtccccctgccc

SEQ ID NO: 3766465 - DNA, 21 bp, Homo sapiens
ggactgccccgtgcagactgg

SEQ ID NO: 3766466 - DNA, 17 bp, Homo sapiens
ggactggagtccctgtg

SEQ ID NO: 3766467 - DNA, 22 bp, Homo sapiens
ggactggctagagtcctcactc

SEQ ID NO: 3766468 - DNA, 20 bp, Homo sapiens
ggactgggttgcgtcctgac

SEQ ID NO: 3766469 - DNA, 13 bp, Homo sapiens
ggactgtacacac

SEQ ID NO: 3766470 - DNA, 19 bp, Homo sapiens
ggactgtacacactttatt

SEQ ID NO: 3766471 - DNA, 22 bp, Homo sapiens
ggactgtacacactttatttac

SEQ ID NO: 3766472 - DNA, 20 bp, Homo sapiens
ggactgtctttcagatacat

SEQ ID NO: 3766473 - DNA, 23 bp, Homo sapiens
ggactgttgacatccaagcttcc

SEQ ID NO: 3766474 - DNA, 14 bp, Homo sapiens
ggacttggaagctc

SEQ ID NO: 3766475 - DNA, 15 bp, Homo sapiens
ggacttggaagctcc

SEQ ID NO: 3766476 - DNA, 17 bp, Homo sapiens
ggacttggaagctccgc

SEQ ID NO: 3766477 - DNA, 16 bp, Homo sapiens
ggacttgtgtctctgt

SEQ ID NO: 3766478 - DNA, 20 bp, Homo sapiens
ggactttatagatcagccag

SEQ ID NO: 3766479 - DNA, 23 bp, Homo sapiens
ggactttcttttcgccgtggctg

SEQ ID NO: 3766480 - DNA, 13 bp, Homo sapiens
ggagaaacagaga

SEQ ID NO: 3766481 - DNA, 14 bp, Homo sapiens
ggagaaaccagctt

SEQ ID NO: 3766482 - DNA, 22 bp, Homo sapiens
ggagaagaattttcagacccca

SEQ ID NO: 3766483 - DNA, 16 bp, Homo sapiens
ggagaagcagtgagcc

SEQ ID NO: 3766484 - DNA, 19 bp, Homo sapiens
ggagaagcagtgagccgca

SEQ ID NO: 3766485 - DNA, 13 bp, Homo sapiens
ggagaagcatgaa

SEQ ID NO: 3766486 - DNA, 17 bp, Homo sapiens
ggagaagcggctggcag

SEQ ID NO: 3766487 - DNA, 17 bp, Homo sapiens
ggagaaggaaggagact

SEQ ID NO: 3766488 - DNA, 22 bp, Homo sapiens
ggagacaatgcagatgccagag

SEQ ID NO: 3766489 - DNA, 18 bp, Homo sapiens
ggagacagtgatctccat

SEQ ID NO: 3766490 - DNA, 13 bp, Homo sapiens
ggagacctgtgct

SEQ ID NO: 3766491 - DNA, 10 bp, Homo sapiens
ggagactaga

SEQ ID NO: 3766492 - DNA, 16 bp, Homo sapiens
ggagactcacctctgc

SEQ ID NO: 3766493 - DNA, 21 bp, Homo sapiens
ggagactcacctctgcctcaa

SEQ ID NO: 3766494 - DNA, 20 bp, Homo sapiens
ggagagaaggggaggagggc

SEQ ID NO: 3766495 - DNA, 12 bp, Homo sapiens
ggagagagggga

SEQ ID NO: 3766496 - DNA, 21 bp, Homo sapiens
ggagagaggggaataatagaa

SEQ ID NO: 3766497 - DNA, 12 bp, Homo sapiens
ggagagccagcc

SEQ ID NO: 3766498 - DNA, 12 bp, Homo sapiens
ggagagcccagc

SEQ ID NO: 3766499 - DNA, 17 bp, Homo sapiens
ggagagctagcagcagg

SEQ ID NO: 3766500 - DNA, 19 bp, Homo sapiens
ggagagggacagcccactg

SEQ ID NO: 3766501 - DNA, 21 bp, Homo sapiens
ggagagggatgaggtgctggg

SEQ ID NO: 3766502 - DNA, 24 bp, Homo sapiens
ggagagggatgaggtgctgggagg

SEQ ID NO: 3766503 - DNA, 18 bp, Homo sapiens
ggagagggtctggagaag

SEQ ID NO: 3766504 - DNA, 22 bp, Homo sapiens
ggagatatttatggggggagaa

SEQ ID NO: 3766505 - DNA, 18 bp, Homo sapiens
ggagatcggggccagagg

SEQ ID NO: 3766506 - DNA, 13 bp, Homo sapiens
ggagatggggaga

SEQ ID NO: 3766507 - DNA, 13 bp, Homo sapiens
ggagatgtaagag

SEQ ID NO: 3766508 - DNA, 16 bp, Homo sapiens
ggagatgtagcaaaac

SEQ ID NO: 3766509 - DNA, 12 bp, Homo sapiens
ggagcagagaag

SEQ ID NO: 3766510 - DNA, 14 bp, Homo sapiens
ggagcagagaaggc

SEQ ID NO: 3766511 - DNA, 13 bp, Homo sapiens
ggagcagtgtctt

SEQ ID NO: 3766512 - DNA, 18 bp, Homo sapiens
ggagcagtgtcttccata

SEQ ID NO: 3766513 - DNA, 20 bp, Homo sapiens
ggagcatctcttgaggccag

SEQ ID NO: 3766514 - DNA, 21 bp, Homo sapiens
ggagcatctcttgaggccagg

SEQ ID NO: 3766515 - DNA, 17 bp, Homo sapiens
ggagccaaatgtggcat

SEQ ID NO: 3766516 - DNA, 13 bp, Homo sapiens
ggagccacctgtc

SEQ ID NO: 3766517 - DNA, 16 bp, Homo sapiens
ggagccacctgtccca

SEQ ID NO: 3766518 - DNA, 12 bp, Homo sapiens
gggagagagaga

SEQ ID NO: 3766519 - DNA, 14 bp, Homo sapiens
gggagagccagctc

SEQ ID NO: 3766520 - DNA, 19 bp, Homo sapiens
gggagatcggggccagagg

SEQ ID NO: 3766521 - DNA, 13 bp, Homo sapiens
gggagcagagaca

SEQ ID NO: 3766522 - DNA, 20 bp, Homo sapiens
gggagcagtgtcttccataa

SEQ ID NO: 3766523 - DNA, 16 bp, Homo sapiens
gggagccccagggtct

SEQ ID NO: 3766524 - DNA, 21 bp, Homo sapiens
gggagccccagggtcttccct

SEQ ID NO: 3766525 - DNA, 22 bp, Homo sapiens
gggagcccccgccccgccccac

SEQ ID NO: 3766526 - DNA, 16 bp, Homo sapiens
gggagcgtagaatctg

SEQ ID NO: 3766527 - DNA, 12 bp, Homo sapiens
gggagctctgca

SEQ ID NO: 3766528 - DNA, 20 bp, Homo sapiens
gggaggaggtggcagccctg

SEQ ID NO: 3766529 - DNA, 17 bp, Homo sapiens
gggaggatcactggagc

SEQ ID NO: 3766530 - DNA, 21 bp, Homo sapiens
gggaggattgcttgagctcag

SEQ ID NO: 3766531 - DNA, 16 bp, Homo sapiens
gggaggccccactggg

SEQ ID NO: 3766532 - DNA, 20 bp, Homo sapiens
gggaggcggagcttgcagtg

SEQ ID NO: 3766533 - DNA, 13 bp, Homo sapiens
gggaggcttcccc

SEQ ID NO: 3766534 - DNA, 23 bp, Homo sapiens
gggaggggcggcaggagggaggt

SEQ ID NO: 3766535 - DNA, 21 bp, Homo sapiens
gggagggggttacaaactgca

SEQ ID NO: 3766536 - DNA, 18 bp, Homo sapiens
gggaggtcaaggctgcag

SEQ ID NO: 3766537 - DNA, 15 bp, Homo sapiens
gggaggtcgaggcag

SEQ ID NO: 3766538 - DNA, 18 bp, Homo sapiens
gggaggtcgaggcaggag

SEQ ID NO: 3766539 - DNA, 15 bp, Homo sapiens
gggaggtcgaggtag

SEQ ID NO: 3766540 - DNA, 16 bp, Homo sapiens
gggaggtcgaggtagg

SEQ ID NO: 3766541 - DNA, 14 bp, Homo sapiens
gggatcacagggcc

SEQ ID NO: 3766542 - DNA, 17 bp, Homo sapiens
gggatctgtgcccagag

SEQ ID NO: 3766543 - DNA, 17 bp, Homo sapiens
gggatgactagaggcag

SEQ ID NO: 3766544 - DNA, 23 bp, Homo sapiens
gggatgactagaggcagggaggg

SEQ ID NO: 3766545 - DNA, 13 bp, Homo sapiens
gggatgagaaagg

SEQ ID NO: 3766546 - DNA, 15 bp, Homo sapiens
gggatggaaaaggaa

SEQ ID NO: 3766547 - DNA, 15 bp, Homo sapiens
gggatggaggagaag

SEQ ID NO: 3766548 - DNA, 16 bp, Homo sapiens
gggatggtcctggggc

SEQ ID NO: 3766549 - DNA, 11 bp, Homo sapiens
gggatgtctta

SEQ ID NO: 3766550 - DNA, 15 bp, Homo sapiens
gggattacaggtgtg

SEQ ID NO: 3766551 - DNA, 16 bp, Homo sapiens
gggattcaggctgctt

SEQ ID NO: 3766552 - DNA, 17 bp, Homo sapiens
gggatttctcccagctc

SEQ ID NO: 3766553 - DNA, 18 bp, Homo sapiens
gggcaacccccagcctgc

SEQ ID NO: 3766554 - DNA, 17 bp, Homo sapiens
gggcacgctgtgggcag

SEQ ID NO: 3766555 - DNA, 19 bp, Homo sapiens
gggcactcagaagacactg

SEQ ID NO: 3766556 - DNA, 20 bp, Homo sapiens
gggcactttaaatgaagcta

SEQ ID NO: 3766557 - DNA, 22 bp, Homo sapiens
gggcagaacagccgctcctgtc

SEQ ID NO: 3766558 - DNA, 14 bp, Homo sapiens
gggcagaggctgga

SEQ ID NO: 3766559 - DNA, 16 bp, Homo sapiens
gggcagaggctggagg

SEQ ID NO: 3766560 - DNA, 20 bp, Homo sapiens
gggcagcatagcaagacaca

SEQ ID NO: 3766561 - DNA, 18 bp, Homo sapiens
gggcagctgccagagaag

SEQ ID NO: 3766562 - DNA, 18 bp, Homo sapiens
gggcaggagggccctacc

SEQ ID NO: 3766563 - DNA, 11 bp, Homo sapiens
gggcaggcagt

SEQ ID NO: 3766564 - DNA, 17 bp, Homo sapiens
gggcaggtgggagcttg

SEQ ID NO: 3766565 - DNA, 17 bp, Homo sapiens
gggcaggttggtggggg

SEQ ID NO: 3766566 - DNA, 14 bp, Homo sapiens
gggcagtggaggtg

SEQ ID NO: 3766567 - DNA, 20 bp, Homo sapiens
gggcatctgcccctccccca

SEQ ID NO: 3766568 - DNA, 20 bp, Homo sapiens
gggcatggacgttcggggca

SEQ ID NO: 3766569 - DNA, 20 bp, Homo sapiens
gggcatggccaggtggccac

SEQ ID NO: 3766570 - DNA, 18 bp, Homo sapiens
gggcattgatggggaagg

SEQ ID NO: 3766571 - DNA, 14 bp, Homo sapiens
gggcattgctttcc

SEQ ID NO: 3766572 - DNA, 11 bp, Homo sapiens
gggccaacacc

SEQ ID NO: 3766573 - DNA, 16 bp, Homo sapiens
gggccacctccccagg

SEQ ID NO: 3766574 - DNA, 16 bp, Homo sapiens
gggccactctgcctct

SEQ ID NO: 3766575 - DNA, 20 bp, Homo sapiens
gggccagtcctgcctggcca

SEQ ID NO: 3766576 - DNA, 21 bp, Homo sapiens
gggccagtcctgcctggccag

SEQ ID NO: 3766577 - DNA, 19 bp, Homo sapiens
gggcccaagacagatgccc

SEQ ID NO: 3766578 - DNA, 17 bp, Homo sapiens
gggcccagagagggtgg

SEQ ID NO: 3766579 - DNA, 13 bp, Homo sapiens
gggcccaggcagg

SEQ ID NO: 3766580 - DNA, 22 bp, Homo sapiens
gggccccaaacgggctgccctg

SEQ ID NO: 3766581 - DNA, 10 bp, Homo sapiens
gggcccctcc

SEQ ID NO: 3766582 - DNA, 20 bp, Homo sapiens
gggcccctccctacctcaac

SEQ ID NO: 3766583 - DNA, 16 bp, Homo sapiens
gggcccgcctggcaga

SEQ ID NO: 3766584 - DNA, 20 bp, Homo sapiens
gggcccgcctggcagaactg

SEQ ID NO: 3766585 - DNA, 12 bp, Homo sapiens
gggccctcctga

SEQ ID NO: 3766586 - DNA, 23 bp, Homo sapiens
gggccctcctgaaacttacacac

SEQ ID NO: 3766587 - DNA, 22 bp, Homo sapiens
gggcctagatccacacacagag

SEQ ID NO: 3766588 - DNA, 13 bp, Homo sapiens
gggcctcactcca

SEQ ID NO: 3766589 - DNA, 14 bp, Homo sapiens
gggcctcagtgcca

SEQ ID NO: 3766590 - DNA, 21 bp, Homo sapiens
gggcctcctctgtccagggcc

SEQ ID NO: 3766591 - DNA, 13 bp, Homo sapiens
gggcctcctgtgt

SEQ ID NO: 3766592 - DNA, 23 bp, Homo sapiens
gggcctcttgcggtcccttctta

SEQ ID NO: 3766593 - DNA, 23 bp, Homo sapiens
gggcctgacctccccctccttcc

SEQ ID NO: 3766594 - DNA, 18 bp, Homo sapiens
gggcctggtcgttttcaa

SEQ ID NO: 3766595 - DNA, 20 bp, Homo sapiens
gggcctgtacaaaagggaca

SEQ ID NO: 3766596 - DNA, 23 bp, Homo sapiens
gggcctgtacaaaagggacatga

SEQ ID NO: 3766597 - DNA, 16 bp, Homo sapiens
gggcctgtcgtgccag

SEQ ID NO: 3766598 - DNA, 16 bp, Homo sapiens
gggccttaaaagccat

SEQ ID NO: 3766599 - DNA, 22 bp, Homo sapiens
gggccttgcccagagatgcctc

SEQ ID NO: 3766600 - DNA, 15 bp, Homo sapiens
gggctagttgggctt

SEQ ID NO: 3766601 - DNA, 18 bp, Homo sapiens
gggctagttgggcttcct

SEQ ID NO: 3766602 - DNA, 10 bp, Homo sapiens
gggctcagca

SEQ ID NO: 3766603 - DNA, 18 bp, Homo sapiens
gggctcagcaaaagatgc

SEQ ID NO: 3766604 - DNA, 17 bp, Homo sapiens
gggctcagcggggacag

SEQ ID NO: 3766605 - DNA, 14 bp, Homo sapiens
gggctcagctctgg

SEQ ID NO: 3766606 - DNA, 18 bp, Homo sapiens
gggctcagctctggctca

SEQ ID NO: 3766607 - DNA, 13 bp, Homo sapiens
gggctcccttcct

SEQ ID NO: 3766608 - DNA, 12 bp, Homo sapiens
gggctcctggaa

SEQ ID NO: 3766609 - DNA, 20 bp, Homo sapiens
gggctcctggaaaggctcag

SEQ ID NO: 3766610 - DNA, 23 bp, Homo sapiens
gggctcctggaaaggctcagtct

SEQ ID NO: 3766611 - DNA, 14 bp, Homo sapiens
gggctctccacctc

SEQ ID NO: 3766612 - DNA, 17 bp, Homo sapiens
gggctctccacctcagc

SEQ ID NO: 3766613 - DNA, 19 bp, Homo sapiens
gggctctccacctcagcct

SEQ ID NO: 3766614 - DNA, 19 bp, Homo sapiens
gggctctctgctgtacata

SEQ ID NO: 3766615 - DNA, 11 bp, Homo sapiens
gggctctgccc

SEQ ID NO: 3766616 - DNA, 21 bp, Homo sapiens
gggctctgccccagctctggc

SEQ ID NO: 3766617 - DNA, 18 bp, Homo sapiens
gggctgagagaacctcac

SEQ ID NO: 3766618 - DNA, 13 bp, Homo sapiens
gggctgagccctg

SEQ ID NO: 3766619 - DNA, 18 bp, Homo sapiens
gggctgatctcagggaag

SEQ ID NO: 3766620 - DNA, 12 bp, Homo sapiens
gggctgccctgc

SEQ ID NO: 3766621 - DNA, 13 bp, Homo sapiens
gggctgccctggt

SEQ ID NO: 3766622 - DNA, 14 bp, Homo sapiens
gggctgccctggtg

SEQ ID NO: 3766623 - DNA, 17 bp, Homo sapiens
gggctggccagttggaa

SEQ ID NO: 3766624 - DNA, 13 bp, Homo sapiens
gggctgggcagct

SEQ ID NO: 3766625 - DNA, 11 bp, Homo sapiens
gggctggggca

SEQ ID NO: 3766626 - DNA, 21 bp, Homo sapiens
ggggaatattttattcaaggt

SEQ ID NO: 3766627 - DNA, 12 bp, Homo sapiens
ggggacagctcc

SEQ ID NO: 3766628 - DNA, 23 bp, Homo sapiens
ggggacgctggtagagatggagg

SEQ ID NO: 3766629 - DNA, 11 bp, Homo sapiens
ggggagaaagt

SEQ ID NO: 3766630 - DNA, 19 bp, Homo sapiens
ggggagatcggggccagag

SEQ ID NO: 3766631 - DNA, 12 bp, Homo sapiens
ggggaggagggc

SEQ ID NO: 3766632 - DNA, 23 bp, Homo sapiens
gtagaaatatctgaaaatgtatg

SEQ ID NO: 3766633 - DNA, 23 bp, Homo sapiens
gtagaaattttacaataggtgct

SEQ ID NO: 3766634 - DNA, 22 bp, Homo sapiens
gtagaacacaaggtcatttgct

SEQ ID NO: 3766635 - DNA, 19 bp, Homo sapiens
gtagaacgtaaccacggaa

SEQ ID NO: 3766636 - DNA, 15 bp, Homo sapiens
gtagaaggagacaga

SEQ ID NO: 3766637 - DNA, 17 bp, Homo sapiens
gtagaagggttatattt

SEQ ID NO: 3766638 - DNA, 21 bp, Homo sapiens
gtagaagtcttagatgtatat

SEQ ID NO: 3766639 - DNA, 14 bp, Homo sapiens
gtagaatctgtgta

SEQ ID NO: 3766640 - DNA, 16 bp, Homo sapiens
gtagacccctggctgg

SEQ ID NO: 3766641 - DNA, 21 bp, Homo sapiens
gtagacctgtgagaaaacgtt

SEQ ID NO: 3766642 - DNA, 20 bp, Homo sapiens
gtagacgtgcacgcacactg

SEQ ID NO: 3766643 - DNA, 13 bp, Homo sapiens
gtagagaaacact

SEQ ID NO: 3766644 - DNA, 13 bp, Homo sapiens
gtagagacagggt

SEQ ID NO: 3766645 - DNA, 15 bp, Homo sapiens
gtagagatggaggag

SEQ ID NO: 3766646 - DNA, 16 bp, Homo sapiens
gtagagatggaggagg

SEQ ID NO: 3766647 - DNA, 11 bp, Homo sapiens
gtagagccagg

SEQ ID NO: 3766648 - DNA, 15 bp, Homo sapiens
gtagagtcatctcca

SEQ ID NO: 3766649 - DNA, 12 bp, Homo sapiens
gtagatagaaat

SEQ ID NO: 3766650 - DNA, 14 bp, Homo sapiens
gtagatagaaataa

SEQ ID NO: 3766651 - DNA, 14 bp, Homo sapiens
gtagattgcttctg

SEQ ID NO: 3766652 - DNA, 15 bp, Homo sapiens
gtagatttgttttgt

SEQ ID NO: 3766653 - DNA, 21 bp, Homo sapiens
gtagattttaaaagttattaa

SEQ ID NO: 3766654 - DNA, 21 bp, Homo sapiens
gtagcaatcagattttcctgt

SEQ ID NO: 3766655 - DNA, 18 bp, Homo sapiens
gtagccaaggtgggctga

SEQ ID NO: 3766656 - DNA, 19 bp, Homo sapiens
gtagccaaggtgggctgag

SEQ ID NO: 3766657 - DNA, 15 bp, Homo sapiens
gtagccctggccaga

SEQ ID NO: 3766658 - DNA, 21 bp, Homo sapiens
gtagcctcgccgtctgtgaat

SEQ ID NO: 3766659 - DNA, 15 bp, Homo sapiens
gtagccttgcccgga

SEQ ID NO: 3766660 - DNA, 14 bp, Homo sapiens
gtagctagaggaac

SEQ ID NO: 3766661 - DNA, 15 bp, Homo sapiens
gtagctagaggaacc

SEQ ID NO: 3766662 - DNA, 23 bp, Homo sapiens
gtagctcctcaactcacctaatg

SEQ ID NO: 3766663 - DNA, 12 bp, Homo sapiens
gtagctgcccct

SEQ ID NO: 3766664 - DNA, 15 bp, Homo sapiens
gtagctgcccctggc

SEQ ID NO: 3766665 - DNA, 21 bp, Homo sapiens
gtagctgggactacaggcacc

SEQ ID NO: 3766666 - DNA, 11 bp, Homo sapiens
gtagcttctga

SEQ ID NO: 3766667 - DNA, 12 bp, Homo sapiens
gtagctttgctc

SEQ ID NO: 3766668 - DNA, 18 bp, Homo sapiens
gtaggaacggtaaatttc

SEQ ID NO: 3766669 - DNA, 23 bp, Homo sapiens
gtaggcatgagggatcacagggc

SEQ ID NO: 3766670 - DNA, 16 bp, Homo sapiens
gtagggcgggaggatg

SEQ ID NO: 3766671 - DNA, 15 bp, Homo sapiens
gtaggggtgtgtgtg

SEQ ID NO: 3766672 - DNA, 12 bp, Homo sapiens
gtagggtttcta

SEQ ID NO: 3766673 - DNA, 15 bp, Homo sapiens
gtaggtgatttgaag

SEQ ID NO: 3766674 - DNA, 22 bp, Homo sapiens
gtagtactcctgcaaaatttta

SEQ ID NO: 3766675 - DNA, 16 bp, Homo sapiens
gtagtataaagaaaag

SEQ ID NO: 3766676 - DNA, 18 bp, Homo sapiens
gtagtctaaccaaatgca

SEQ ID NO: 3766677 - DNA, 16 bp, Homo sapiens
gtagttaggaaataaa

SEQ ID NO: 3766678 - DNA, 16 bp, Homo sapiens
gtataaagctcagaag

SEQ ID NO: 3766679 - DNA, 20 bp, Homo sapiens
gtataacacaatatgaatac

SEQ ID NO: 3766680 - DNA, 23 bp, Homo sapiens
gtataagtccttgcaagaatcag

SEQ ID NO: 3766681 - DNA, 12 bp, Homo sapiens
gtatataatttt

SEQ ID NO: 3766682 - DNA, 14 bp, Homo sapiens
gtatatatacataa

SEQ ID NO: 3766683 - DNA, 16 bp, Homo sapiens
gtatatatacataaca

SEQ ID NO: 3766684 - DNA, 17 bp, Homo sapiens
gtatatatacataacag

SEQ ID NO: 3766685 - DNA, 14 bp, Homo sapiens
gtatatctgggctg

SEQ ID NO: 3766686 - DNA, 22 bp, Homo sapiens
gtatatgtcaagccataattgt

SEQ ID NO: 3766687 - DNA, 13 bp, Homo sapiens
gtatatgtctcag

SEQ ID NO: 3766688 - DNA, 21 bp, Homo sapiens
gtatatgtctcaggtccctgc

SEQ ID NO: 3766689 - DNA, 14 bp, Homo sapiens
gtatattaaaaatg

SEQ ID NO: 3766690 - DNA, 15 bp, Homo sapiens
gtatattaaaaatgg

SEQ ID NO: 3766691 - DNA, 16 bp, Homo sapiens
gtatattcatttcaaa

SEQ ID NO: 3766692 - DNA, 13 bp, Homo sapiens
gtatatttatagt

SEQ ID NO: 3766693 - DNA, 22 bp, Homo sapiens
gtatatttttgtttgttttgtg

SEQ ID NO: 3766694 - DNA, 21 bp, Homo sapiens
gtatatttttttctaagagaa

SEQ ID NO: 3766695 - DNA, 21 bp, Homo sapiens
gtatcaggaaatatatatgtg

SEQ ID NO: 3766696 - DNA, 18 bp, Homo sapiens
gtatcaggtgctgccatc

SEQ ID NO: 3766697 - DNA, 22 bp, Homo sapiens
gtatcaggtgctgccatccagg

SEQ ID NO: 3766698 - DNA, 15 bp, Homo sapiens
gtatcatagaaatgt

SEQ ID NO: 3766699 - DNA, 19 bp, Homo sapiens
gtatccactttgcacagct

SEQ ID NO: 3766700 - DNA, 19 bp, Homo sapiens
gtatcccatgagcctcagc

SEQ ID NO: 3766701 - DNA, 16 bp, Homo sapiens
gtatcctgcccagtgt

SEQ ID NO: 3766702 - DNA, 20 bp, Homo sapiens
gtatcgggggctggggcagg

SEQ ID NO: 3766703 - DNA, 16 bp, Homo sapiens
gtatctagtgcagctg

SEQ ID NO: 3766704 - DNA, 18 bp, Homo sapiens
gtatctagtgcagctgat

SEQ ID NO: 3766705 - DNA, 15 bp, Homo sapiens
gtatctcctcgcaag

SEQ ID NO: 3766706 - DNA, 22 bp, Homo sapiens
gtatctttgggtctttgataaa

SEQ ID NO: 3766707 - DNA, 22 bp, Homo sapiens
gtatgaaagatggctgtgcctc

SEQ ID NO: 3766708 - DNA, 23 bp, Homo sapiens
gtatgaaagatggctgtgcctct

SEQ ID NO: 3766709 - DNA, 20 bp, Homo sapiens
gtatgatcacggctcactgc

SEQ ID NO: 3766710 - DNA, 22 bp, Homo sapiens
gtatgatcacggctcactgcag

SEQ ID NO: 3766711 - DNA, 15 bp, Homo sapiens
gtatgggtgtgtgtt

SEQ ID NO: 3766712 - DNA, 16 bp, Homo sapiens
gtatggtggctgggtt

SEQ ID NO: 3766713 - DNA, 13 bp, Homo sapiens
gtatgtctccagt

SEQ ID NO: 3766714 - DNA, 21 bp, Homo sapiens
gtatgttgtgaagatgtttgc

SEQ ID NO: 3766715 - DNA, 14 bp, Homo sapiens
gtatgtttacactg

SEQ ID NO: 3766716 - DNA, 13 bp, Homo sapiens
gtattaaagacag

SEQ ID NO: 3766717 - DNA, 14 bp, Homo sapiens
gtattaatattcat

SEQ ID NO: 3766718 - DNA, 15 bp, Homo sapiens
gtattattctgcagc

SEQ ID NO: 3766719 - DNA, 16 bp, Homo sapiens
gtattattctgcagca

SEQ ID NO: 3766720 - DNA, 18 bp, Homo sapiens
gtattcaagaaagccagt

SEQ ID NO: 3766721 - DNA, 20 bp, Homo sapiens
gtattccaccttaaattaaa

SEQ ID NO: 3766722 - DNA, 18 bp, Homo sapiens
gtattccagtttgtttat

SEQ ID NO: 3766723 - DNA, 19 bp, Homo sapiens
gtattcccattagaccaag

SEQ ID NO: 3766724 - DNA, 18 bp, Homo sapiens
gtattctagttttgtcaa

SEQ ID NO: 3766725 - DNA, 12 bp, Homo sapiens
gtattggcaaag

SEQ ID NO: 3766726 - DNA, 13 bp, Homo sapiens
gtattggcaaaga

SEQ ID NO: 3766727 - DNA, 11 bp, Homo sapiens
gtattgttccc

SEQ ID NO: 3766728 - DNA, 14 bp, Homo sapiens
gtattgttcccagt

SEQ ID NO: 3766729 - DNA, 18 bp, Homo sapiens
gtatttaattgtaaactg

SEQ ID NO: 3766730 - DNA, 20 bp, Homo sapiens
gtatttaattgtaaactgta

SEQ ID NO: 3766731 - DNA, 15 bp, Homo sapiens
gtatttatatattta

SEQ ID NO: 3766732 - DNA, 16 bp, Homo sapiens
gtatttatatatttat

SEQ ID NO: 3766733 - DNA, 18 bp, Homo sapiens
gtatttatctattgtaag

SEQ ID NO: 3766734 - DNA, 20 bp, Homo sapiens
gtatttatctattgtaagat

SEQ ID NO: 3766735 - DNA, 17 bp, Homo sapiens
gtatttattttcctccc

SEQ ID NO: 3766736 - DNA, 18 bp, Homo sapiens
gtatttattttcctcccc

SEQ ID NO: 3766737 - DNA, 11 bp, Homo sapiens
gtatttcagac

SEQ ID NO: 3766738 - DNA, 17 bp, Homo sapiens
gtatttgagacattcca

SEQ ID NO: 3766739 - DNA, 18 bp, Homo sapiens
gtattttataaaattaaa

SEQ ID NO: 3766740 - DNA, 22 bp, Homo sapiens
gtattttataaaattaaagaaa

SEQ ID NO: 3766741 - DNA, 10 bp, Homo sapiens
gtattttatt

SEQ ID NO: 3766742 - DNA, 19 bp, Homo sapiens
gtattttgtttttgtctta

SEQ ID NO: 3766743 - DNA, 14 bp, Homo sapiens
gtcaaaaggtgcct

SEQ ID NO: 3766744 - DNA, 15 bp, Homo sapiens
gtcaaaaggtgcctg

SEQ ID NO: 3766745 - DNA, 16 bp, Homo sapiens
gtcaaacatgaagtgt

SEQ ID NO: 3766746 - DNA, 14 bp, Homo sapiens
gtgcaacccttacc

SEQ ID NO: 3766747 - DNA, 20 bp, Homo sapiens
gtgcaagtatgtgagtgtgt

SEQ ID NO: 3766748 - DNA, 18 bp, Homo sapiens
gtgcaagtgtctgtgtgc

SEQ ID NO: 3766749 - DNA, 22 bp, Homo sapiens
gtgcaagtgtgtgcacatgtgt

SEQ ID NO: 3766750 - DNA, 20 bp, Homo sapiens
gtgcaagtgtgtgcatgtgt

SEQ ID NO: 3766751 - DNA, 22 bp, Homo sapiens
gtgcaattgtaggggtgtgtgt

SEQ ID NO: 3766752 - DNA, 20 bp, Homo sapiens
gtgcacaaatatttattttc

SEQ ID NO: 3766753 - DNA, 12 bp, Homo sapiens
gtgcacacacca

SEQ ID NO: 3766754 - DNA, 15 bp, Homo sapiens
gtgcacggccagctg

SEQ ID NO: 3766755 - DNA, 20 bp, Homo sapiens
gtgcactctgctaatcatgt

SEQ ID NO: 3766756 - DNA, 22 bp, Homo sapiens
gtgcagacaggccatgtgagcc

SEQ ID NO: 3766757 - DNA, 23 bp, Homo sapiens
gtgcagacaggccatgtgagcca

SEQ ID NO: 3766758 - DNA, 16 bp, Homo sapiens
gtgcagcaaccagagc

SEQ ID NO: 3766759 - DNA, 15 bp, Homo sapiens
gtgcagcatatgagg

SEQ ID NO: 3766760 - DNA, 13 bp, Homo sapiens
gtgcagctgattt

SEQ ID NO: 3766761 - DNA, 18 bp, Homo sapiens
gtgcagctgattttaaca

SEQ ID NO: 3766762 - DNA, 23 bp, Homo sapiens
gtgcagggaggaggtggcagccc

SEQ ID NO: 3766763 - DNA, 22 bp, Homo sapiens
gtgcatgaaggtttctgaaaat

SEQ ID NO: 3766764 - DNA, 18 bp, Homo sapiens
gtgcatgggtgaagggag

SEQ ID NO: 3766765 - DNA, 14 bp, Homo sapiens
gtgcatgtgtgtgc

SEQ ID NO: 3766766 - DNA, 15 bp, Homo sapiens
gtgcatgtgtgtgct

SEQ ID NO: 3766767 - DNA, 18 bp, Homo sapiens
gtgcatgtgtgtgctcag

SEQ ID NO: 3766768 - DNA, 14 bp, Homo sapiens
gtgccaagcacagt

SEQ ID NO: 3766769 - DNA, 16 bp, Homo sapiens
gtgccaagcacagtgc

SEQ ID NO: 3766770 - DNA, 20 bp, Homo sapiens
gtgccactgcccgagctggt

SEQ ID NO: 3766771 - DNA, 21 bp, Homo sapiens
gtgccactgcccgagctggtg

SEQ ID NO: 3766772 - DNA, 23 bp, Homo sapiens
gtgccactgcccgagctggtgca

SEQ ID NO: 3766773 - DNA, 20 bp, Homo sapiens
gtgcccacaggatcagtctg

SEQ ID NO: 3766774 - DNA, 23 bp, Homo sapiens
gtgcccaccaacatcccattgcc

SEQ ID NO: 3766775 - DNA, 13 bp, Homo sapiens
gtgcccagctcag

SEQ ID NO: 3766776 - DNA, 16 bp, Homo sapiens
gtgcccagttaatctt

SEQ ID NO: 3766777 - DNA, 17 bp, Homo sapiens
gtgcccagttaatcttg

SEQ ID NO: 3766778 - DNA, 18 bp, Homo sapiens
gtgccccatgcctgtcca

SEQ ID NO: 3766779 - DNA, 21 bp, Homo sapiens
gtgccccatgcctgtccagcc

SEQ ID NO: 3766780 - DNA, 13 bp, Homo sapiens
gtgccccccttgc

SEQ ID NO: 3766781 - DNA, 20 bp, Homo sapiens
gtgcccctgctgcctcccca

SEQ ID NO: 3766782 - DNA, 22 bp, Homo sapiens
gtgccgtagggagtacctgctg

SEQ ID NO: 3766783 - DNA, 15 bp, Homo sapiens
gtgccgttactctcc

SEQ ID NO: 3766784 - DNA, 22 bp, Homo sapiens
gtgccgttactctccaacctgg

SEQ ID NO: 3766785 - DNA, 18 bp, Homo sapiens
gtgcctatagtcccagct

SEQ ID NO: 3766786 - DNA, 13 bp, Homo sapiens
gtgcctctgcctg

SEQ ID NO: 3766787 - DNA, 22 bp, Homo sapiens
gtgcctctggaggcctctgggc

SEQ ID NO: 3766788 - DNA, 12 bp, Homo sapiens
gtgcctctggga

SEQ ID NO: 3766789 - DNA, 15 bp, Homo sapiens
gtgcctctgggactg

SEQ ID NO: 3766790 - DNA, 17 bp, Homo sapiens
gtgcctgcaccaggaga

SEQ ID NO: 3766791 - DNA, 19 bp, Homo sapiens
gtgcctgcaccaggagaca

SEQ ID NO: 3766792 - DNA, 21 bp, Homo sapiens
gtgcctgcaccaggagacaga

SEQ ID NO: 3766793 - DNA, 19 bp, Homo sapiens
gtgcctggagctcctggga

SEQ ID NO: 3766794 - DNA, 17 bp, Homo sapiens
gtgcctgggtggggctg

SEQ ID NO: 3766795 - DNA, 23 bp, Homo sapiens
gtgcctgggtggggctgctcctc

SEQ ID NO: 3766796 - DNA, 19 bp, Homo sapiens
gtgccttacctcctgccca

SEQ ID NO: 3766797 - DNA, 19 bp, Homo sapiens
gtgccttcttattctcact

SEQ ID NO: 3766798 - DNA, 23 bp, Homo sapiens
gtgccttcttattctcactccac

SEQ ID NO: 3766799 - DNA, 22 bp, Homo sapiens
gtgcgctgacaaccaccgctcc

SEQ ID NO: 3766800 - DNA, 17 bp, Homo sapiens
gtgcgggcacaataaat

SEQ ID NO: 3766801 - DNA, 14 bp, Homo sapiens
gtgcgtgaaacaca

SEQ ID NO: 3766802 - DNA, 16 bp, Homo sapiens
gtgctaaattttcagt

SEQ ID NO: 3766803 - DNA, 23 bp, Homo sapiens
gtgctaaccacgtctgtcttcac

SEQ ID NO: 3766804 - DNA, 21 bp, Homo sapiens
gtgctacatgacgacaaagct

SEQ ID NO: 3766805 - DNA, 16 bp, Homo sapiens
gtgctactgattgttt

SEQ ID NO: 3766806 - DNA, 13 bp, Homo sapiens
gtgctcagggctg

SEQ ID NO: 3766807 - DNA, 15 bp, Homo sapiens
gtgctccctaccacc

SEQ ID NO: 3766808 - DNA, 13 bp, Homo sapiens
gtgctctggacag

SEQ ID NO: 3766809 - DNA, 15 bp, Homo sapiens
gtgctctggacaggc

SEQ ID NO: 3766810 - DNA, 18 bp, Homo sapiens
gtgctctggacaggcatg

SEQ ID NO: 3766811 - DNA, 19 bp, Homo sapiens
gtgctgaatggttttcaaa

SEQ ID NO: 3766812 - DNA, 23 bp, Homo sapiens
gtgctgagttggtgttgacatgt

SEQ ID NO: 3766813 - DNA, 20 bp, Homo sapiens
gtgctgatcgtgctaaattt

SEQ ID NO: 3766814 - DNA, 22 bp, Homo sapiens
gtgctgatcgtgctaaattttc

SEQ ID NO: 3766815 - DNA, 15 bp, Homo sapiens
gtgctgccatccagg

SEQ ID NO: 3766816 - DNA, 18 bp, Homo sapiens
gtgctgccatccaggttc

SEQ ID NO: 3766817 - DNA, 19 bp, Homo sapiens
gtgctgccatccaggttca

SEQ ID NO: 3766818 - DNA, 18 bp, Homo sapiens
gtgctgcccgtcttcagc

SEQ ID NO: 3766819 - DNA, 18 bp, Homo sapiens
gtgctggctgcccagacc

SEQ ID NO: 3766820 - DNA, 21 bp, Homo sapiens
gtgctgggattacaagcgtga

SEQ ID NO: 3766821 - DNA, 11 bp, Homo sapiens
gtgctgtggcc

SEQ ID NO: 3766822 - DNA, 16 bp, Homo sapiens
gtgctgtggcctgggc

SEQ ID NO: 3766823 - DNA, 19 bp, Homo sapiens
gtgctgttgtcattgcttt

SEQ ID NO: 3766824 - DNA, 19 bp, Homo sapiens
gtgcttattctcaaagcag

SEQ ID NO: 3766825 - DNA, 22 bp, Homo sapiens
gtgctttccgtggcactgcata

SEQ ID NO: 3766826 - DNA, 15 bp, Homo sapiens
gtgcttttaaatgca

SEQ ID NO: 3766827 - DNA, 13 bp, Homo sapiens
gtggaaaaatatt

SEQ ID NO: 3766828 - DNA, 14 bp, Homo sapiens
gtggaaaaatattt

SEQ ID NO: 3766829 - DNA, 23 bp, Homo sapiens
gtggaaagcctctgctgccatgg

SEQ ID NO: 3766830 - DNA, 19 bp, Homo sapiens
gtggaaagtgaatttgaat

SEQ ID NO: 3766831 - DNA, 15 bp, Homo sapiens
gtggaaccaggaacc

SEQ ID NO: 3766832 - DNA, 14 bp, Homo sapiens
gtggacacagctct

SEQ ID NO: 3766833 - DNA, 18 bp, Homo sapiens
gtggacacagctcttctc

SEQ ID NO: 3766834 - DNA, 13 bp, Homo sapiens
gtggaccaggaca

SEQ ID NO: 3766835 - DNA, 22 bp, Homo sapiens
gtggagagggatgaggtgctgg

SEQ ID NO: 3766836 - DNA, 23 bp, Homo sapiens
gtggagcccgcacccccaccctt

SEQ ID NO: 3766837 - DNA, 16 bp, Homo sapiens
gtggaggaatgctccc

SEQ ID NO: 3766838 - DNA, 23 bp, Homo sapiens
gtggaggaatgctcccccatcct

SEQ ID NO: 3766839 - DNA, 15 bp, Homo sapiens
gtggatcacagaggc

SEQ ID NO: 3766840 - DNA, 20 bp, Homo sapiens
gtggatgcctggtggcagct

SEQ ID NO: 3766841 - DNA, 21 bp, Homo sapiens
gtggatgcctggtggcagctg

SEQ ID NO: 3766842 - DNA, 19 bp, Homo sapiens
gtggcaccagcagcctgga

SEQ ID NO: 3766843 - DNA, 17 bp, Homo sapiens
gtggcagaagtgtttca

SEQ ID NO: 3766844 - DNA, 21 bp, Homo sapiens
gtggcagataatcagcctctt

SEQ ID NO: 3766845 - DNA, 19 bp, Homo sapiens
gtggcagtgggagctgcct

SEQ ID NO: 3766846 - DNA, 20 bp, Homo sapiens
gtggcatcaccttaggcagg

SEQ ID NO: 3766847 - DNA, 16 bp, Homo sapiens
gtggcatcccagtggc

SEQ ID NO: 3766848 - DNA, 21 bp, Homo sapiens
gtggccactccagacccctgg

SEQ ID NO: 3766849 - DNA, 17 bp, Homo sapiens
gtggccagaccagagct

SEQ ID NO: 3766850 - DNA, 18 bp, Homo sapiens
gtggcccgacagcctggc

SEQ ID NO: 3766851 - DNA, 16 bp, Homo sapiens
gtggccctggcctgct

SEQ ID NO: 3766852 - DNA, 19 bp, Homo sapiens
gtggcctcaaccctccctc

SEQ ID NO: 3766853 - DNA, 11 bp, Homo sapiens
gtggcctcaga

SEQ ID NO: 3766854 - DNA, 13 bp, Homo sapiens
gtggcctcagaat

SEQ ID NO: 3766855 - DNA, 17 bp, Homo sapiens
gtggccttccccagcct

SEQ ID NO: 3766856 - DNA, 20 bp, Homo sapiens
gtggcgactctatagactct

SEQ ID NO: 3766857 - DNA, 13 bp, Homo sapiens
gtggcggtgcctg

SEQ ID NO: 3766858 - DNA, 20 bp, Homo sapiens
taacagggtaaattattcag

SEQ ID NO: 3766859 - DNA, 14 bp, Homo sapiens
taacagttttccat

SEQ ID NO: 3766860 - DNA, 15 bp, Homo sapiens
taacagttttccatg

SEQ ID NO: 3766861 - DNA, 19 bp, Homo sapiens
taacataatttgtacatat

SEQ ID NO: 3766862 - DNA, 23 bp, Homo sapiens
taacatataatgttgttatttaa

SEQ ID NO: 3766863 - DNA, 16 bp, Homo sapiens
taacatcttctttcct

SEQ ID NO: 3766864 - DNA, 17 bp, Homo sapiens
taacattatattgcaat

SEQ ID NO: 3766865 - DNA, 22 bp, Homo sapiens
taacattctgtaaaatgtctgt

SEQ ID NO: 3766866 - DNA, 19 bp, Homo sapiens
taaccacgtctgtcttcac

SEQ ID NO: 3766867 - DNA, 20 bp, Homo sapiens
taaccacgtctgtcttcaca

SEQ ID NO: 3766868 - DNA, 13 bp, Homo sapiens
taaccagagcaag

SEQ ID NO: 3766869 - DNA, 19 bp, Homo sapiens
taaccccaaaatgaagatt

SEQ ID NO: 3766870 - DNA, 13 bp, Homo sapiens
taaccccagctcc

SEQ ID NO: 3766871 - DNA, 16 bp, Homo sapiens
taaccccattctttgc

SEQ ID NO: 3766872 - DNA, 16 bp, Homo sapiens
taacccctttcctgcg

SEQ ID NO: 3766873 - DNA, 20 bp, Homo sapiens
taacctcagtgtcatttatg

SEQ ID NO: 3766874 - DNA, 19 bp, Homo sapiens
taacctggtgctggatatt

SEQ ID NO: 3766875 - DNA, 16 bp, Homo sapiens
taacgaagttgggcaa

SEQ ID NO: 3766876 - DNA, 23 bp, Homo sapiens
taactaatctattgggttcatta

SEQ ID NO: 3766877 - DNA, 15 bp, Homo sapiens
taactactgtgttcc

SEQ ID NO: 3766878 - DNA, 16 bp, Homo sapiens
taactactgtgttcct

SEQ ID NO: 3766879 - DNA, 15 bp, Homo sapiens
taactagcttggaaa

SEQ ID NO: 3766880 - DNA, 22 bp, Homo sapiens
taactcaatattttccatgaaa

SEQ ID NO: 3766881 - DNA, 21 bp, Homo sapiens
taactcaggactccagcccat

SEQ ID NO: 3766882 - DNA, 22 bp, Homo sapiens
taactccaccaacccatcagaa

SEQ ID NO: 3766883 - DNA, 22 bp, Homo sapiens
taactctaattcccattttgca

SEQ ID NO: 3766884 - DNA, 16 bp, Homo sapiens
taactctgatgtaaat

SEQ ID NO: 3766885 - DNA, 17 bp, Homo sapiens
taactctgatgtaaatg

SEQ ID NO: 3766886 - DNA, 19 bp, Homo sapiens
taactctgatgtaaatgaa

SEQ ID NO: 3766887 - DNA, 16 bp, Homo sapiens
taactgaaggagaagg

SEQ ID NO: 3766888 - DNA, 14 bp, Homo sapiens
taactgacaaatca

SEQ ID NO: 3766889 - DNA, 18 bp, Homo sapiens
taactgacaaatcaagtt

SEQ ID NO: 3766890 - DNA, 20 bp, Homo sapiens
taactgacaaatcaagtttc

SEQ ID NO: 3766891 - DNA, 13 bp, Homo sapiens
taactgacaactt

SEQ ID NO: 3766892 - DNA, 23 bp, Homo sapiens
taactgccatcaagatgagagaa

SEQ ID NO: 3766893 - DNA, 17 bp, Homo sapiens
taactgcccaaagcagc

SEQ ID NO: 3766894 - DNA, 24 bp, Homo sapiens
taactggcagttttccattggttt

SEQ ID NO: 3766895 - DNA, 11 bp, Homo sapiens
taactgtgtat

SEQ ID NO: 3766896 - DNA, 14 bp, Homo sapiens
taactgtgtatgta

SEQ ID NO: 3766897 - DNA, 19 bp, Homo sapiens
taactgtgtatgtacatat

SEQ ID NO: 3766898 - DNA, 23 bp, Homo sapiens
taacttctgatagcgttggaatt

SEQ ID NO: 3766899 - DNA, 16 bp, Homo sapiens
taacttggagccccag

SEQ ID NO: 3766900 - DNA, 15 bp, Homo sapiens
taacttggttataca

SEQ ID NO: 3766901 - DNA, 20 bp, Homo sapiens
taacttggttatacatgaca

SEQ ID NO: 3766902 - DNA, 13 bp, Homo sapiens
taacttgtcttaa

SEQ ID NO: 3766903 - DNA, 17 bp, Homo sapiens
taacttgtcttaaataa

SEQ ID NO: 3766904 - DNA, 15 bp, Homo sapiens
taactttatcacatt

SEQ ID NO: 3766905 - DNA, 17 bp, Homo sapiens
taactttatcacattat

SEQ ID NO: 3766906 - DNA, 16 bp, Homo sapiens
taacttttgtgtgaaa

SEQ ID NO: 3766907 - DNA, 15 bp, Homo sapiens
taagaaaaaaataat

SEQ ID NO: 3766908 - DNA, 20 bp, Homo sapiens
taagaaaaaataacacacat

SEQ ID NO: 3766909 - DNA, 21 bp, Homo sapiens
taagaaaagatacgactttat

SEQ ID NO: 3766910 - DNA, 14 bp, Homo sapiens
taagaaaatacaat

SEQ ID NO: 3766911 - DNA, 20 bp, Homo sapiens
taagaaacacactgaggcag

SEQ ID NO: 3766912 - DNA, 21 bp, Homo sapiens
taagaaacacactgaggcagg

SEQ ID NO: 3766913 - DNA, 18 bp, Homo sapiens
taagaaagtgaagcaaat

SEQ ID NO: 3766914 - DNA, 21 bp, Homo sapiens
taagaaataggaaagactttc

SEQ ID NO: 3766915 - DNA, 14 bp, Homo sapiens
taagaagacatgaa

SEQ ID NO: 3766916 - DNA, 19 bp, Homo sapiens
taagaagagactgggaaga

SEQ ID NO: 3766917 - DNA, 14 bp, Homo sapiens
taagaagatgactt

SEQ ID NO: 3766918 - DNA, 21 bp, Homo sapiens
taagaatcattgtaaacatta

SEQ ID NO: 3766919 - DNA, 21 bp, Homo sapiens
taagaatgctggttttcctaa

SEQ ID NO: 3766920 - DNA, 20 bp, Homo sapiens
taagacatactccttccatc

SEQ ID NO: 3766921 - DNA, 15 bp, Homo sapiens
taagactgtgtattc

SEQ ID NO: 3766922 - DNA, 18 bp, Homo sapiens
taagagaagctactttgt

SEQ ID NO: 3766923 - DNA, 14 bp, Homo sapiens
taagagaatgttat

SEQ ID NO: 3766924 - DNA, 16 bp, Homo sapiens
taagagctagcgctgc

SEQ ID NO: 3766925 - DNA, 12 bp, Homo sapiens
taagagctatac

SEQ ID NO: 3766926 - DNA, 19 bp, Homo sapiens
taagagctttacaaaaaga

SEQ ID NO: 3766927 - DNA, 15 bp, Homo sapiens
taagaggatgaagtg

SEQ ID NO: 3766928 - DNA, 21 bp, Homo sapiens
taagagttagtttctttggga

SEQ ID NO: 3766929 - DNA, 12 bp, Homo sapiens
taagataattat

SEQ ID NO: 3766930 - DNA, 18 bp, Homo sapiens
taagatggattctcagat

SEQ ID NO: 3766931 - DNA, 22 bp, Homo sapiens
taagatggattctcagatattt

SEQ ID NO: 3766932 - DNA, 17 bp, Homo sapiens
taagatgttcactgtgg

SEQ ID NO: 3766933 - DNA, 14 bp, Homo sapiens
taagattcatattt

SEQ ID NO: 3766934 - DNA, 14 bp, Homo sapiens
taagattccagaga

SEQ ID NO: 3766935 - DNA, 16 bp, Homo sapiens
taagattccttttctt

SEQ ID NO: 3766936 - DNA, 14 bp, Homo sapiens
taagatttaatttg

SEQ ID NO: 3766937 - DNA, 12 bp, Homo sapiens
taagatttaccc

SEQ ID NO: 3766938 - DNA, 17 bp, Homo sapiens
taagattttgaaaacta

SEQ ID NO: 3766939 - DNA, 23 bp, Homo sapiens
taagcaacatctagcaaatgtta

SEQ ID NO: 3766940 - DNA, 15 bp, Homo sapiens
taagcagtaaaaact

SEQ ID NO: 3766941 - DNA, 15 bp, Homo sapiens
taagcatcaaactct

SEQ ID NO: 3766942 - DNA, 18 bp, Homo sapiens
taagcattactcttgtaa

SEQ ID NO: 3766943 - DNA, 19 bp, Homo sapiens
taagcattactcttgtaag

SEQ ID NO: 3766944 - DNA, 15 bp, Homo sapiens
taagcattgtttgct

SEQ ID NO: 3766945 - DNA, 19 bp, Homo sapiens
taagcattgtttgcttatt

SEQ ID NO: 3766946 - DNA, 20 bp, Homo sapiens
taagcattgtttgcttattg

SEQ ID NO: 3766947 - DNA, 10 bp, Homo sapiens
taagccaagg

SEQ ID NO: 3766948 - DNA, 19 bp, Homo sapiens
taagcctccatttagttct

SEQ ID NO: 3766949 - DNA, 22 bp, Homo sapiens
taagcgctagaggaagcagcca

SEQ ID NO: 3766950 - DNA, 23 bp, Homo sapiens
taagctaggatgttgctcagaag

SEQ ID NO: 3766951 - DNA, 21 bp, Homo sapiens
taagctattcagtaataactc

SEQ ID NO: 3766952 - DNA, 14 bp, Homo sapiens
taagctctttgaaa

SEQ ID NO: 3766953 - DNA, 16 bp, Homo sapiens
taagctgtttccatag

SEQ ID NO: 3766954 - DNA, 16 bp, Homo sapiens
taagcttatgtcagac

SEQ ID NO: 3766955 - DNA, 16 bp, Homo sapiens
taagcttccaggaaaa

SEQ ID NO: 3766956 - DNA, 23 bp, Homo sapiens
taagcttccaggctgcatagaag

SEQ ID NO: 3766957 - DNA, 17 bp, Homo sapiens
taaggaaaaaaagacaa

SEQ ID NO: 3766958 - DNA, 13 bp, Homo sapiens
taaggaagaaaaa

SEQ ID NO: 3766959 - DNA, 13 bp, Homo sapiens
taaggaagacaat

SEQ ID NO: 3766960 - DNA, 12 bp, Homo sapiens
taaggactgcat

SEQ ID NO: 3766961 - DNA, 12 bp, Homo sapiens
taaggatgggaa

SEQ ID NO: 3766962 - DNA, 20 bp, Homo sapiens
taaggcaactgaacaaaaaa

SEQ ID NO: 3766963 - DNA, 16 bp, Homo sapiens
taaggccgaagaaggg

SEQ ID NO: 3766964 - DNA, 13 bp, Homo sapiens
taaggctgaggaa

SEQ ID NO: 3766965 - DNA, 14 bp, Homo sapiens
taaggcttcaattt

SEQ ID NO: 3766966 - DNA, 20 bp, Homo sapiens
taagggttagtttacaatca

SEQ ID NO: 3766967 - DNA, 12 bp, Homo sapiens
taagtaaactaa

SEQ ID NO: 3766968 - DNA, 14 bp, Homo sapiens
taagtaaactaatg

SEQ ID NO: 3766969 - DNA, 14 bp, Homo sapiens
taagtaaatgtctg

SEQ ID NO: 3766970 - DNA, 17 bp, Homo sapiens
taagtactatgtatcaa

SEQ ID NO: 3766971 - DNA, 14 bp, Homo sapiens
tagaacactatttt

SEQ ID NO: 3766972 - DNA, 16 bp, Homo sapiens
tagaacactattttca

SEQ ID NO: 3766973 - DNA, 23 bp, Homo sapiens
tagaacactattttcagaatctg

SEQ ID NO: 3766974 - DNA, 12 bp, Homo sapiens
tagaacagaaaa

SEQ ID NO: 3766975 - DNA, 13 bp, Homo sapiens
tagaacagaaaac

SEQ ID NO: 3766976 - DNA, 14 bp, Homo sapiens
tagaacagaaaaca

SEQ ID NO: 3766977 - DNA, 15 bp, Homo sapiens
tagaacagaaaacaa

SEQ ID NO: 3766978 - DNA, 22 bp, Homo sapiens
tagaactcagttttaactagaa

SEQ ID NO: 3766979 - DNA, 23 bp, Homo sapiens
tagaactctccatcttattttca

SEQ ID NO: 3766980 - DNA, 22 bp, Homo sapiens
tagaagaacatccaaggagaaa

SEQ ID NO: 3766981 - DNA, 12 bp, Homo sapiens
tagaagaactgc

SEQ ID NO: 3766982 - DNA, 15 bp, Homo sapiens
tagaagatgtttgct

SEQ ID NO: 3766983 - DNA, 15 bp, Homo sapiens
tagaaggagacagag

SEQ ID NO: 3766984 - DNA, 17 bp, Homo sapiens
tagaaggatgtacattt

SEQ ID NO: 3766985 - DNA, 21 bp, Homo sapiens
tagaaggatgtacatttccaa

SEQ ID NO: 3766986 - DNA, 19 bp, Homo sapiens
tagaagggccagtcctgcc

SEQ ID NO: 3766987 - DNA, 17 bp, Homo sapiens
tagaagtcttagatgta

SEQ ID NO: 3766988 - DNA, 16 bp, Homo sapiens
tagaagtggaccagga

SEQ ID NO: 3766989 - DNA, 12 bp, Homo sapiens
tagaatatttat

SEQ ID NO: 3766990 - DNA, 21 bp, Homo sapiens
tagaatgatttcatgctatct

SEQ ID NO: 3766991 - DNA, 15 bp, Homo sapiens
tagaatttattcaat

SEQ ID NO: 3766992 - DNA, 23 bp, Homo sapiens
tagaatttattcaattcctctgg

SEQ ID NO: 3766993 - DNA, 15 bp, Homo sapiens
tagacaaatctaagg

SEQ ID NO: 3766994 - DNA, 20 bp, Homo sapiens
tagacacaggatagataact

SEQ ID NO: 3766995 - DNA, 11 bp, Homo sapiens
tagacctcagc

SEQ ID NO: 3766996 - DNA, 16 bp, Homo sapiens
tagacctcagcctgtg

SEQ ID NO: 3766997 - DNA, 20 bp, Homo sapiens
tagacctcagcctgtgctgc

SEQ ID NO: 3766998 - DNA, 18 bp, Homo sapiens
tagactttagaaataaat

SEQ ID NO: 3766999 - DNA, 19 bp, Homo sapiens
tagagaaaccgtcctcttt

SEQ ID NO: 3767000 - DNA, 16 bp, Homo sapiens
tagagagagaccactt

SEQ ID NO: 3767001 - DNA, 14 bp, Homo sapiens
tagagatggaggag

SEQ ID NO: 3767002 - DNA, 19 bp, Homo sapiens
tagagatggggaaagaatt

SEQ ID NO: 3767003 - DNA, 14 bp, Homo sapiens
tagagcagggcaag

SEQ ID NO: 3767004 - DNA, 15 bp, Homo sapiens
tagagcttctggcac

SEQ ID NO: 3767005 - DNA, 19 bp, Homo sapiens
tagaggcagggaggggact

SEQ ID NO: 3767006 - DNA, 15 bp, Homo sapiens
tagaggccagcctgg

SEQ ID NO: 3767007 - DNA, 13 bp, Homo sapiens
tagagggttcctg

SEQ ID NO: 3767008 - DNA, 14 bp, Homo sapiens
tagagtatatgcac

SEQ ID NO: 3767009 - DNA, 13 bp, Homo sapiens
tagagtcagcctt

SEQ ID NO: 3767010 - DNA, 22 bp, Homo sapiens
tagagtcatctccatcagctgt

SEQ ID NO: 3767011 - DNA, 13 bp, Homo sapiens
tagagtcctcact

SEQ ID NO: 3767012 - DNA, 15 bp, Homo sapiens
tagataaaaagatgg

SEQ ID NO: 3767013 - DNA, 15 bp, Homo sapiens
tagatatctttttat

SEQ ID NO: 3767014 - DNA, 19 bp, Homo sapiens
tagatatctttttattgat

SEQ ID NO: 3767015 - DNA, 15 bp, Homo sapiens
tagatgaactcaact

SEQ ID NO: 3767016 - DNA, 14 bp, Homo sapiens
tagatgctgactgt

SEQ ID NO: 3767017 - DNA, 16 bp, Homo sapiens
tagatggttacactgt

SEQ ID NO: 3767018 - DNA, 20 bp, Homo sapiens
tagatgtagataaactcaga

SEQ ID NO: 3767019 - DNA, 12 bp, Homo sapiens
tagatgtatata

SEQ ID NO: 3767020 - DNA, 20 bp, Homo sapiens
tagattagatcttttaagcc

SEQ ID NO: 3767021 - DNA, 16 bp, Homo sapiens
tagattcacctgtaaa

SEQ ID NO: 3767022 - DNA, 16 bp, Homo sapiens
tagattgcttctgtag

SEQ ID NO: 3767023 - DNA, 18 bp, Homo sapiens
tagatttctgattttatg

SEQ ID NO: 3767024 - DNA, 13 bp, Homo sapiens
tagatttgttttg

SEQ ID NO: 3767025 - DNA, 14 bp, Homo sapiens
tagatttgttttgt

SEQ ID NO: 3767026 - DNA, 17 bp, Homo sapiens
tagattttaatcaaatt

SEQ ID NO: 3767027 - DNA, 18 bp, Homo sapiens
tagattttaatcaaattt

SEQ ID NO: 3767028 - DNA, 22 bp, Homo sapiens
tagcaaaacgcatggagtgtgt

SEQ ID NO: 3767029 - DNA, 14 bp, Homo sapiens
tagcaaaagaagta

SEQ ID NO: 3767030 - DNA, 12 bp, Homo sapiens
tagcaagacaca

SEQ ID NO: 3767031 - DNA, 16 bp, Homo sapiens
tagcaaggcatgatgt

SEQ ID NO: 3767032 - DNA, 18 bp, Homo sapiens
tagcaagtgaatttttct

SEQ ID NO: 3767033 - DNA, 16 bp, Homo sapiens
tagcacgtttaaagtt

SEQ ID NO: 3767034 - DNA, 15 bp, Homo sapiens
tagcactcacatgct

SEQ ID NO: 3767035 - DNA, 17 bp, Homo sapiens
tagcactcacatgctgg

SEQ ID NO: 3767036 - DNA, 17 bp, Homo sapiens
tagcactttcattgcca

SEQ ID NO: 3767037 - DNA, 23 bp, Homo sapiens
tagcactttcattgccagtgtct

SEQ ID NO: 3767038 - DNA, 16 bp, Homo sapiens
tagcactttgggaggc

SEQ ID NO: 3767039 - DNA, 15 bp, Homo sapiens
tagcagacagtgttt

SEQ ID NO: 3767040 - DNA, 22 bp, Homo sapiens
tagcaggactgaattgtcccca

SEQ ID NO: 3767041 - DNA, 17 bp, Homo sapiens
tagcaggtaccactgat

SEQ ID NO: 3767042 - DNA, 20 bp, Homo sapiens
tagcagttctgcaaatagaa

SEQ ID NO: 3767043 - DNA, 16 bp, Homo sapiens
tagcatgaagacagag

SEQ ID NO: 3767044 - DNA, 16 bp, Homo sapiens
tagcatgacaagcccc

SEQ ID NO: 3767045 - DNA, 17 bp, Homo sapiens
tagcatgacaagcccca

SEQ ID NO: 3767046 - DNA, 21 bp, Homo sapiens
tagcatgacaagccccaggca

SEQ ID NO: 3767047 - DNA, 13 bp, Homo sapiens
tagccactcagga

SEQ ID NO: 3767048 - DNA, 18 bp, Homo sapiens
tagccacttaccttcaat

SEQ ID NO: 3767049 - DNA, 23 bp, Homo sapiens
tagccacttaccttcaataaagt

SEQ ID NO: 3767050 - DNA, 21 bp, Homo sapiens
tagccccaacccaaacctgga

SEQ ID NO: 3767051 - DNA, 18 bp, Homo sapiens
tagccccaagaaggctgg

SEQ ID NO: 3767052 - DNA, 20 bp, Homo sapiens
tagccccaagaaggctgggg

SEQ ID NO: 3767053 - DNA, 16 bp, Homo sapiens
tagccctggccagagg

SEQ ID NO: 3767054 - DNA, 19 bp, Homo sapiens
tagccgggcatggtggcgc

SEQ ID NO: 3767055 - DNA, 17 bp, Homo sapiens
tagcctgcctcttctct

SEQ ID NO: 3767056 - DNA, 19 bp, Homo sapiens
tagcgaggctctaaccaca

SEQ ID NO: 3767057 - DNA, 14 bp, Homo sapiens
tagcgcccagttgg

SEQ ID NO: 3767058 - DNA, 14 bp, Homo sapiens
tagctagaagtggg

SEQ ID NO: 3767059 - DNA, 14 bp, Homo sapiens
tagctagaggaacc

SEQ ID NO: 3767060 - DNA, 18 bp, Homo sapiens
tagctatatccatgtact

SEQ ID NO: 3767061 - DNA, 19 bp, Homo sapiens
tagctatttttatggaatt

SEQ ID NO: 3767062 - DNA, 20 bp, Homo sapiens
tagctccacaccctctccca

SEQ ID NO: 3767063 - DNA, 21 bp, Homo sapiens
tagctccccgcttctgcctgc

SEQ ID NO: 3767064 - DNA, 13 bp, Homo sapiens
tagctctttcctt

SEQ ID NO: 3767065 - DNA, 21 bp, Homo sapiens
tagctgacccagccccttgag

SEQ ID NO: 3767066 - DNA, 12 bp, Homo sapiens
tagctgccaagt

SEQ ID NO: 3767067 - DNA, 15 bp, Homo sapiens
tagctgggactacag

SEQ ID NO: 3767068 - DNA, 19 bp, Homo sapiens
tagctgggactacaggcac

SEQ ID NO: 3767069 - DNA, 20 bp, Homo sapiens
tagctgggactacaggcacc

SEQ ID NO: 3767070 - DNA, 18 bp, Homo sapiens
tagctgggactacaggtg

SEQ ID NO: 3767071 - DNA, 21 bp, Homo sapiens
tagctgtctgctcagacagaa

SEQ ID NO: 3767072 - DNA, 14 bp, Homo sapiens
tagctgtggtgagg

SEQ ID NO: 3767073 - DNA, 20 bp, Homo sapiens
tagctgttatttctattttt

SEQ ID NO: 3767074 - DNA, 16 bp, Homo sapiens
tagctgttgagctgtt

SEQ ID NO: 3767075 - DNA, 23 bp, Homo sapiens
tagcttaagaggcctgtgattat

SEQ ID NO: 3767076 - DNA, 17 bp, Homo sapiens
tagcttacatgagaaca

SEQ ID NO: 3767077 - DNA, 19 bp, Homo sapiens
tagcttacatgagaacaga

SEQ ID NO: 3767078 - DNA, 23 bp, Homo sapiens
tagcttagacctcagcctgtgct

SEQ ID NO: 3767079 - DNA, 18 bp, Homo sapiens
tagcttatcaatttgtca

SEQ ID NO: 3767080 - DNA, 20 bp, Homo sapiens
tagcttatcaatttgtcatt

SEQ ID NO: 3767081 - DNA, 17 bp, Homo sapiens
tagcttctgacctcagc

SEQ ID NO: 3767082 - DNA, 19 bp, Homo sapiens
tagcttgataaagggccaa

SEQ ID NO: 3767083 - DNA, 19 bp, Homo sapiens
tagcttgggaggcttcccc

SEQ ID NO: 3767084 - DNA, 15 bp, Homo sapiens
tataaatatatttaa

SEQ ID NO: 3767085 - DNA, 15 bp, Homo sapiens
tataaatcaatgtca

SEQ ID NO: 3767086 - DNA, 13 bp, Homo sapiens
tataaattaaata

SEQ ID NO: 3767087 - DNA, 19 bp, Homo sapiens
tataaattaaatatatgta

SEQ ID NO: 3767088 - DNA, 21 bp, Homo sapiens
tataaccaatgtttaaaaaag

SEQ ID NO: 3767089 - DNA, 20 bp, Homo sapiens
tataaccatggttttcctga

SEQ ID NO: 3767090 - DNA, 15 bp, Homo sapiens
tataaccccagctcc

SEQ ID NO: 3767091 - DNA, 14 bp, Homo sapiens
tataactagtcctt

SEQ ID NO: 3767092 - DNA, 17 bp, Homo sapiens
tataactcatcataaaa

SEQ ID NO: 3767093 - DNA, 19 bp, Homo sapiens
tataactgccttaaaactt

SEQ ID NO: 3767094 - DNA, 18 bp, Homo sapiens
tataacttaaaatatttt

SEQ ID NO: 3767095 - DNA, 22 bp, Homo sapiens
tataaggaaagcaataaatgaa

SEQ ID NO: 3767096 - DNA, 23 bp, Homo sapiens
tataaggaaagcaataaatgaat

SEQ ID NO: 3767097 - DNA, 11 bp, Homo sapiens
tataaggactg

SEQ ID NO: 3767098 - DNA, 21 bp, Homo sapiens
tataaggactgcatggtaatt

SEQ ID NO: 3767099 - DNA, 17 bp, Homo sapiens
tataatatactatattt

SEQ ID NO: 3767100 - DNA, 22 bp, Homo sapiens
tataatatttttaattaaataa

SEQ ID NO: 3767101 - DNA, 15 bp, Homo sapiens
tataatgctggagcg

SEQ ID NO: 3767102 - DNA, 14 bp, Homo sapiens
tataatgtaagctc

SEQ ID NO: 3767103 - DNA, 20 bp, Homo sapiens
tataatgtaagctctactga

SEQ ID NO: 3767104 - DNA, 18 bp, Homo sapiens
tataatgttgttatttaa

SEQ ID NO: 3767105 - DNA, 15 bp, Homo sapiens
tataattgtttttta

SEQ ID NO: 3767106 - DNA, 17 bp, Homo sapiens
tataattttatgaatgt

SEQ ID NO: 3767107 - DNA, 20 bp, Homo sapiens
tataatttttttatgttttg

SEQ ID NO: 3767108 - DNA, 22 bp, Homo sapiens
tataatttttttatgttttgtt

SEQ ID NO: 3767109 - DNA, 17 bp, Homo sapiens
tatacaagataagcttc

SEQ ID NO: 3767110 - DNA, 20 bp, Homo sapiens
tatacacacacaaagagagt

SEQ ID NO: 3767111 - DNA, 21 bp, Homo sapiens
tatacacttacactttatgca

SEQ ID NO: 3767112 - DNA, 23 bp, Homo sapiens
tatacagtagtgagaagaatatt

SEQ ID NO: 3767113 - DNA, 22 bp, Homo sapiens
tatacagttttcctaaatgtat

SEQ ID NO: 3767114 - DNA, 23 bp, Homo sapiens
tatacataacagggtaaattatt

SEQ ID NO: 3767115 - DNA, 15 bp, Homo sapiens
tatacatgacactga

SEQ ID NO: 3767116 - DNA, 20 bp, Homo sapiens
tatacatgacactgaaatgc

SEQ ID NO: 3767117 - DNA, 14 bp, Homo sapiens
tatacatttgataa

SEQ ID NO: 3767118 - DNA, 20 bp, Homo sapiens
tataccccgtgaagcatcca

SEQ ID NO: 3767119 - DNA, 19 bp, Homo sapiens
tataccccttacttagcat

SEQ ID NO: 3767120 - DNA, 15 bp, Homo sapiens
tatactaagaaaaga

SEQ ID NO: 3767121 - DNA, 19 bp, Homo sapiens
tatactaagatgttcactg

SEQ ID NO: 3767122 - DNA, 22 bp, Homo sapiens
tatagaataatgtgggaagaaa

SEQ ID NO: 3767123 - DNA, 11 bp, Homo sapiens
tatagactcta

SEQ ID NO: 3767124 - DNA, 18 bp, Homo sapiens
tatagatcacataacaga

SEQ ID NO: 3767125 - DNA, 22 bp, Homo sapiens
tatagatcacataacagaatgc

SEQ ID NO: 3767126 - DNA, 23 bp, Homo sapiens
tatagatcacataacagaatgca

SEQ ID NO: 3767127 - DNA, 13 bp, Homo sapiens
tatagatcagcca

SEQ ID NO: 3767128 - DNA, 23 bp, Homo sapiens
tatagcaatccatgttagttttt

SEQ ID NO: 3767129 - DNA, 20 bp, Homo sapiens
tatagcctaggtgacagagt

SEQ ID NO: 3767130 - DNA, 13 bp, Homo sapiens
tatagctattttt

SEQ ID NO: 3767131 - DNA, 16 bp, Homo sapiens
tatagcttgaaacata

SEQ ID NO: 3767132 - DNA, 16 bp, Homo sapiens
tatagtacctttgctc

SEQ ID NO: 3767133 - DNA, 20 bp, Homo sapiens
tatagtacctttgctcttgc

SEQ ID NO: 3767134 - DNA, 17 bp, Homo sapiens
tatagtgtagaaaagaa

SEQ ID NO: 3767135 - DNA, 14 bp, Homo sapiens
tatataaagagaaa

SEQ ID NO: 3767136 - DNA, 15 bp, Homo sapiens
tatataaagagaaaa

SEQ ID NO: 3767137 - DNA, 22 bp, Homo sapiens
tatataattacatatttgcata

SEQ ID NO: 3767138 - DNA, 14 bp, Homo sapiens
tatataattatgtt

SEQ ID NO: 3767139 - DNA, 17 bp, Homo sapiens
tatataattatgttatt

SEQ ID NO: 3767140 - DNA, 17 bp, Homo sapiens
tatatacaataacataa

SEQ ID NO: 3767141 - DNA, 18 bp, Homo sapiens
tatatacacacacaaaga

SEQ ID NO: 3767142 - DNA, 17 bp, Homo sapiens
tatatagtttactattt

SEQ ID NO: 3767143 - DNA, 19 bp, Homo sapiens
tatatatacataacagggt

SEQ ID NO: 3767144 - DNA, 13 bp, Homo sapiens
tatatatagaatc

SEQ ID NO: 3767145 - DNA, 14 bp, Homo sapiens
tatatatgtgtgtg

SEQ ID NO: 3767146 - DNA, 13 bp, Homo sapiens
tatatatttataa

SEQ ID NO: 3767147 - DNA, 14 bp, Homo sapiens
tatatattttaatt

SEQ ID NO: 3767148 - DNA, 15 bp, Homo sapiens
tatatctatcttata

SEQ ID NO: 3767149 - DNA, 20 bp, Homo sapiens
tatatctgggctggccagtt

SEQ ID NO: 3767150 - DNA, 13 bp, Homo sapiens
tatatgaacatag

SEQ ID NO: 3767151 - DNA, 19 bp, Homo sapiens
tatatgtgtgtgtatgttt

SEQ ID NO: 3767152 - DNA, 11 bp, Homo sapiens
tatatgtttta

SEQ ID NO: 3767153 - DNA, 19 bp, Homo sapiens
tatatgttttaagaggcag

SEQ ID NO: 3767154 - DNA, 14 bp, Homo sapiens
tatattaaaaatgg

SEQ ID NO: 3767155 - DNA, 17 bp, Homo sapiens
tatattaaaaatggtaa

SEQ ID NO: 3767156 - DNA, 23 bp, Homo sapiens
tatattagcatttagtccaatgt

SEQ ID NO: 3767157 - DNA, 14 bp, Homo sapiens
tatattatcatgca

SEQ ID NO: 3767158 - DNA, 13 bp, Homo sapiens
tatattctctttg

SEQ ID NO: 3767159 - DNA, 15 bp, Homo sapiens
tatatttaacaagat

SEQ ID NO: 3767160 - DNA, 21 bp, Homo sapiens
tatatttagattgttaaaata

SEQ ID NO: 3767161 - DNA, 14 bp, Homo sapiens
tatatttataactc

SEQ ID NO: 3767162 - DNA, 22 bp, Homo sapiens
tatattttaacctgcataaaaa

SEQ ID NO: 3767163 - DNA, 14 bp, Homo sapiens
tatattttaatttg

SEQ ID NO: 3767164 - DNA, 15 bp, Homo sapiens
tatatttttgtttgt

SEQ ID NO: 3767165 - DNA, 20 bp, Homo sapiens
tatatttttgtttgttttgt

SEQ ID NO: 3767166 - DNA, 22 bp, Homo sapiens
tatattttttaatttgatgaaa

SEQ ID NO: 3767167 - DNA, 19 bp, Homo sapiens
tatcaaaactttcttttct

SEQ ID NO: 3767168 - DNA, 18 bp, Homo sapiens
tatcaaaataaattgaaa

SEQ ID NO: 3767169 - DNA, 21 bp, Homo sapiens
tatcaaaataaattgaaatat

SEQ ID NO: 3767170 - DNA, 18 bp, Homo sapiens
tatcaaacagctcaggct

SEQ ID NO: 3767171 - DNA, 13 bp, Homo sapiens
tatcaagctaata

SEQ ID NO: 3767172 - DNA, 23 bp, Homo sapiens
tatcaagctaataaaatatcatt

SEQ ID NO: 3767173 - DNA, 15 bp, Homo sapiens
tatcaagtggcatgt

SEQ ID NO: 3767174 - DNA, 17 bp, Homo sapiens
tatcaagtggcatgtgc

SEQ ID NO: 3767175 - DNA, 19 bp, Homo sapiens
tatcaataaatagaccatt

SEQ ID NO: 3767176 - DNA, 14 bp, Homo sapiens
tatcaatttgtcat

SEQ ID NO: 3767177 - DNA, 16 bp, Homo sapiens
tatcaatttgtcattt

SEQ ID NO: 3767178 - DNA, 21 bp, Homo sapiens
tatcaatttgtcattttgaag

SEQ ID NO: 3767179 - DNA, 15 bp, Homo sapiens
tatcacctcccctcc

SEQ ID NO: 3767180 - DNA, 10 bp, Homo sapiens
tatcagaatt

SEQ ID NO: 3767181 - DNA, 17 bp, Homo sapiens
tatcaggtgctgccatc

SEQ ID NO: 3767182 - DNA, 20 bp, Homo sapiens
tatcaggtgctgccatccag

SEQ ID NO: 3767183 - DNA, 15 bp, Homo sapiens
tatcagtgacagagt

SEQ ID NO: 3767184 - DNA, 22 bp, Homo sapiens
tatcagtgacagagttcactat

SEQ ID NO: 3767185 - DNA, 15 bp, Homo sapiens
tatcagttactcagc

SEQ ID NO: 3767186 - DNA, 21 bp, Homo sapiens
tatcagttactcagccctggg

SEQ ID NO: 3767187 - DNA, 17 bp, Homo sapiens
tatcatgcaaatgctgt

SEQ ID NO: 3767188 - DNA, 18 bp, Homo sapiens
tatcatgcccctgtactc

SEQ ID NO: 3767189 - DNA, 23 bp, Homo sapiens
tatcatggaaatattatgcaaat

SEQ ID NO: 3767190 - DNA, 13 bp, Homo sapiens
tatcattcagcaa

SEQ ID NO: 3767191 - DNA, 14 bp, Homo sapiens
tatcattccaaagg

SEQ ID NO: 3767192 - DNA, 20 bp, Homo sapiens
tatcatttattttttacatt

SEQ ID NO: 3767193 - DNA, 14 bp, Homo sapiens
tatccacccagccc

SEQ ID NO: 3767194 - DNA, 21 bp, Homo sapiens
tatccactgtttattcaacaa

SEQ ID NO: 3767195 - DNA, 17 bp, Homo sapiens
tatccatgggggcaggg

SEQ ID NO: 3767196 - DNA, 20 bp, Homo sapiens
tatccatgggggcagggcat

SEQ ID NO: 3767197 - DNA, 20 bp, Homo sapiens
tcacagtgtggggaagccca

SEQ ID NO: 3767198 - DNA, 11 bp, Homo sapiens
tcacagtgttt

SEQ ID NO: 3767199 - DNA, 16 bp, Homo sapiens
tcacagttcctcgccc

SEQ ID NO: 3767200 - DNA, 17 bp, Homo sapiens
tcacagttcctcgccct

SEQ ID NO: 3767201 - DNA, 19 bp, Homo sapiens
tcacagttcctcgccctgg

SEQ ID NO: 3767202 - DNA, 16 bp, Homo sapiens
tcacataacagaatgc

SEQ ID NO: 3767203 - DNA, 22 bp, Homo sapiens
tcacatctttcacacttccacc

SEQ ID NO: 3767204 - DNA, 20 bp, Homo sapiens
tcacattaatatttgctgac

SEQ ID NO: 3767205 - DNA, 16 bp, Homo sapiens
tcacattatttgcatg

SEQ ID NO: 3767206 - DNA, 19 bp, Homo sapiens
tcacatttattctgctcac

SEQ ID NO: 3767207 - DNA, 20 bp, Homo sapiens
tcaccaaatcagctgctact

SEQ ID NO: 3767208 - DNA, 13 bp, Homo sapiens
tcaccaagcccag

SEQ ID NO: 3767209 - DNA, 16 bp, Homo sapiens
tcaccagccccagtgc

SEQ ID NO: 3767210 - DNA, 18 bp, Homo sapiens
tcaccagtgtgtggcttt

SEQ ID NO: 3767211 - DNA, 15 bp, Homo sapiens
tcaccatctcaggcc

SEQ ID NO: 3767212 - DNA, 23 bp, Homo sapiens
tcaccatctcaggccacctgccc

SEQ ID NO: 3767213 - DNA, 23 bp, Homo sapiens
tcaccatgtaaaacaaaaaacaa

SEQ ID NO: 3767214 - DNA, 17 bp, Homo sapiens
tcacccacagaaagaga

SEQ ID NO: 3767215 - DNA, 15 bp, Homo sapiens
tcacccacagggcta

SEQ ID NO: 3767216 - DNA, 16 bp, Homo sapiens
tcacccagacagctcc

SEQ ID NO: 3767217 - DNA, 17 bp, Homo sapiens
tcacccagacagctccc

SEQ ID NO: 3767218 - DNA, 17 bp, Homo sapiens
tcacccatgaagacagg

SEQ ID NO: 3767219 - DNA, 12 bp, Homo sapiens
tcaccccatccc

SEQ ID NO: 3767220 - DNA, 19 bp, Homo sapiens
tcacccccaaggggcagtc

SEQ ID NO: 3767221 - DNA, 16 bp, Homo sapiens
tcacccctgccctggg

SEQ ID NO: 3767222 - DNA, 16 bp, Homo sapiens
tcacccgaggctgccc

SEQ ID NO: 3767223 - DNA, 15 bp, Homo sapiens
tcaccctacctgtgc

SEQ ID NO: 3767224 - DNA, 13 bp, Homo sapiens
tcaccctgtcaag

SEQ ID NO: 3767225 - DNA, 13 bp, Homo sapiens
tcaccctgtccaa

SEQ ID NO: 3767226 - DNA, 23 bp, Homo sapiens
tcaccgagagtagccgagagcct

SEQ ID NO: 3767227 - DNA, 19 bp, Homo sapiens
tcacctaagtctctgtgaa

SEQ ID NO: 3767228 - DNA, 14 bp, Homo sapiens
tcacctaatgttta

SEQ ID NO: 3767229 - DNA, 22 bp, Homo sapiens
tcacctaatgtttatgagccag

SEQ ID NO: 3767230 - DNA, 18 bp, Homo sapiens
tcacctagaaacttgtta

SEQ ID NO: 3767231 - DNA, 15 bp, Homo sapiens
tcacctcccctcctt

SEQ ID NO: 3767232 - DNA, 12 bp, Homo sapiens
tcacctctgcct

SEQ ID NO: 3767233 - DNA, 13 bp, Homo sapiens
tcacctctgcctc

SEQ ID NO: 3767234 - DNA, 14 bp, Homo sapiens
tcacctctgcctca

SEQ ID NO: 3767235 - DNA, 16 bp, Homo sapiens
tcacctgaagactcat

SEQ ID NO: 3767236 - DNA, 23 bp, Homo sapiens
tcacctgaagactcattcttctg

SEQ ID NO: 3767237 - DNA, 17 bp, Homo sapiens
tcacctgaggtcgggag

SEQ ID NO: 3767238 - DNA, 21 bp, Homo sapiens
tcacctgctggcccctcacct

SEQ ID NO: 3767239 - DNA, 19 bp, Homo sapiens
tcacctggggtgtgggagg

SEQ ID NO: 3767240 - DNA, 16 bp, Homo sapiens
tcacctgtaaaacttt

SEQ ID NO: 3767241 - DNA, 17 bp, Homo sapiens
tcacctgtaaaacttta

SEQ ID NO: 3767242 - DNA, 18 bp, Homo sapiens
tcacctgtaaaactttat

SEQ ID NO: 3767243 - DNA, 19 bp, Homo sapiens
tcacctgtttttaagctgt

SEQ ID NO: 3767244 - DNA, 19 bp, Homo sapiens
tcaccttttaaatcctgtt

SEQ ID NO: 3767245 - DNA, 22 bp, Homo sapiens
tcaccttttaaatcctgttgaa

SEQ ID NO: 3767246 - DNA, 13 bp, Homo sapiens
tcacgccactgca

SEQ ID NO: 3767247 - DNA, 14 bp, Homo sapiens
tcacgccactgcac

SEQ ID NO: 3767248 - DNA, 17 bp, Homo sapiens
tcacgccactgcactcc

SEQ ID NO: 3767249 - DNA, 19 bp, Homo sapiens
tcacgcctatgatcccagc

SEQ ID NO: 3767250 - DNA, 19 bp, Homo sapiens
tcacgcctgtaatcctagc

SEQ ID NO: 3767251 - DNA, 20 bp, Homo sapiens
tcacgcctgtaatcctagca

SEQ ID NO: 3767252 - DNA, 17 bp, Homo sapiens
tcacggaagagccttgc

SEQ ID NO: 3767253 - DNA, 23 bp, Homo sapiens
tcacggcaggacaacgaggaagc

SEQ ID NO: 3767254 - DNA, 13 bp, Homo sapiens
tcacggctcactg

SEQ ID NO: 3767255 - DNA, 20 bp, Homo sapiens
tcacggctcactgcagcctc

SEQ ID NO: 3767256 - DNA, 18 bp, Homo sapiens
tcacgggcagtagctgtg

SEQ ID NO: 3767257 - DNA, 13 bp, Homo sapiens
tcacgtcacactt

SEQ ID NO: 3767258 - DNA, 16 bp, Homo sapiens
tcacgtgtgtgactca

SEQ ID NO: 3767259 - DNA, 19 bp, Homo sapiens
tcactaacattatattgca

SEQ ID NO: 3767260 - DNA, 21 bp, Homo sapiens
tcactaacattatattgcaat

SEQ ID NO: 3767261 - DNA, 22 bp, Homo sapiens
tcactaacattatattgcaatg

SEQ ID NO: 3767262 - DNA, 22 bp, Homo sapiens
tcactactcacagtctctttaa

SEQ ID NO: 3767263 - DNA, 17 bp, Homo sapiens
tcactataaatggtgtt

SEQ ID NO: 3767264 - DNA, 18 bp, Homo sapiens
tcactatgttgcccaggc

SEQ ID NO: 3767265 - DNA, 20 bp, Homo sapiens
tcactatgttgcccaggcag

SEQ ID NO: 3767266 - DNA, 21 bp, Homo sapiens
tcactatgttgcccaggcagg

SEQ ID NO: 3767267 - DNA, 18 bp, Homo sapiens
tcactatttttatttata

SEQ ID NO: 3767268 - DNA, 14 bp, Homo sapiens
tcactcaattgttt

SEQ ID NO: 3767269 - DNA, 13 bp, Homo sapiens
tcactccaccacc

SEQ ID NO: 3767270 - DNA, 20 bp, Homo sapiens
tcactcccttctccttgata

SEQ ID NO: 3767271 - DNA, 19 bp, Homo sapiens
tcactccggtgtgcctgca

SEQ ID NO: 3767272 - DNA, 21 bp, Homo sapiens
tcactccggtgtgcctgcagc

SEQ ID NO: 3767273 - DNA, 23 bp, Homo sapiens
tcactccggtgtgcctgcagccc

SEQ ID NO: 3767274 - DNA, 15 bp, Homo sapiens
tcactcctacctggt

SEQ ID NO: 3767275 - DNA, 13 bp, Homo sapiens
tcactcctggggc

SEQ ID NO: 3767276 - DNA, 20 bp, Homo sapiens
tcactctacttagcatgtcc

SEQ ID NO: 3767277 - DNA, 18 bp, Homo sapiens
tcactgcaagctccgcct

SEQ ID NO: 3767278 - DNA, 24 bp, Homo sapiens
tcactgcacagtgcatctcagccc

SEQ ID NO: 3767279 - DNA, 12 bp, Homo sapiens
tcactgcagcct

SEQ ID NO: 3767280 - DNA, 13 bp, Homo sapiens
tcactgcagcctc

SEQ ID NO: 3767281 - DNA, 15 bp, Homo sapiens
tcactgcagcctcga

SEQ ID NO: 3767282 - DNA, 21 bp, Homo sapiens
tcactgcctctccctggccct

SEQ ID NO: 3767283 - DNA, 12 bp, Homo sapiens
tcactgctggct

SEQ ID NO: 3767284 - DNA, 14 bp, Homo sapiens
tcactgctggctgc

SEQ ID NO: 3767285 - DNA, 15 bp, Homo sapiens
tcactgctggctgcc

SEQ ID NO: 3767286 - DNA, 11 bp, Homo sapiens
tcactggagcc

SEQ ID NO: 3767287 - DNA, 12 bp, Homo sapiens
tcactggagccc

SEQ ID NO: 3767288 - DNA, 14 bp, Homo sapiens
tcactggagcccag

SEQ ID NO: 3767289 - DNA, 18 bp, Homo sapiens
tcactggcagccccagca

SEQ ID NO: 3767290 - DNA, 19 bp, Homo sapiens
tcactggcagccccagcac

SEQ ID NO: 3767291 - DNA, 20 bp, Homo sapiens
tcactggggtcctggggcct

SEQ ID NO: 3767292 - DNA, 11 bp, Homo sapiens
tcactgggtgg

SEQ ID NO: 3767293 - DNA, 20 bp, Homo sapiens
tcactgggtggggtgaggac

SEQ ID NO: 3767294 - DNA, 19 bp, Homo sapiens
tcactggtagaccaaaata

SEQ ID NO: 3767295 - DNA, 14 bp, Homo sapiens
tcactgttgcccag

SEQ ID NO: 3767296 - DNA, 17 bp, Homo sapiens
tcactgttgcccaggct

SEQ ID NO: 3767297 - DNA, 23 bp, Homo sapiens
tcactgttgcccaggctggcgtg

SEQ ID NO: 3767298 - DNA, 13 bp, Homo sapiens
tcacttctaaatg

SEQ ID NO: 3767299 - DNA, 16 bp, Homo sapiens
tcacttctaaatgcat

SEQ ID NO: 3767300 - DNA, 11 bp, Homo sapiens
tcacttgcagt

SEQ ID NO: 3767301 - DNA, 13 bp, Homo sapiens
tcacttgtacaaa

SEQ ID NO: 3767302 - DNA, 16 bp, Homo sapiens
tcacttgtacaaaata

SEQ ID NO: 3767303 - DNA, 17 bp, Homo sapiens
tcacttgtgcagtgttg

SEQ ID NO: 3767304 - DNA, 13 bp, Homo sapiens
tcacttttcctcc

SEQ ID NO: 3767305 - DNA, 13 bp, Homo sapiens
tcacttttctgta

SEQ ID NO: 3767306 - DNA, 12 bp, Homo sapiens
tcagaaaacaga

SEQ ID NO: 3767307 - DNA, 22 bp, Homo sapiens
tcagaaaccagttatgtgaatg

SEQ ID NO: 3767308 - DNA, 17 bp, Homo sapiens
tcagaaacttgtgaagt

SEQ ID NO: 3767309 - DNA, 18 bp, Homo sapiens
tcagaaacttgtgaagtg

SEQ ID NO: 3767310 - DNA, 15 bp, Homo sapiens
tcagaaatgtctgga

SEQ ID NO: 3767311 - DNA, 23 bp, Homo sapiens
tccagccaaagcctcctccagcc

SEQ ID NO: 3767312 - DNA, 16 bp, Homo sapiens
tccagccaacccctgt

SEQ ID NO: 3767313 - DNA, 12 bp, Homo sapiens
tccagcccattg

SEQ ID NO: 3767314 - DNA, 20 bp, Homo sapiens
tccagccgccattgccacca

SEQ ID NO: 3767315 - DNA, 13 bp, Homo sapiens
tccagcctgagca

SEQ ID NO: 3767316 - DNA, 19 bp, Homo sapiens
tccagcctgggcagccagg

SEQ ID NO: 3767317 - DNA, 22 bp, Homo sapiens
tccagcctgggcagccaggctg

SEQ ID NO: 3767318 - DNA, 23 bp, Homo sapiens
tccagcctgggcagccaggctgc

SEQ ID NO: 3767319 - DNA, 17 bp, Homo sapiens
tccagcctgggcgacag

SEQ ID NO: 3767320 - DNA, 12 bp, Homo sapiens
tccagcctgggt

SEQ ID NO: 3767321 - DNA, 24 bp, Homo sapiens
tccagcctgggtgacagagcaagt

SEQ ID NO: 3767322 - DNA, 14 bp, Homo sapiens
tccagctcaccagc

SEQ ID NO: 3767323 - DNA, 15 bp, Homo sapiens
tccagctcaccagcc

SEQ ID NO: 3767324 - DNA, 20 bp, Homo sapiens
tccagctgttgagcccctcc

SEQ ID NO: 3767325 - DNA, 19 bp, Homo sapiens
tccagcttgctcttcagtg

SEQ ID NO: 3767326 - DNA, 16 bp, Homo sapiens
tccaggaaaaaggaca

SEQ ID NO: 3767327 - DNA, 17 bp, Homo sapiens
tccaggaaaaaggacag

SEQ ID NO: 3767328 - DNA, 23 bp, Homo sapiens
tccaggaaaaaggacaggcagaa

SEQ ID NO: 3767329 - DNA, 21 bp, Homo sapiens
tccaggccatcagaggcctag

SEQ ID NO: 3767330 - DNA, 10 bp, Homo sapiens
tccaggctcc

SEQ ID NO: 3767331 - DNA, 12 bp, Homo sapiens
tccaggctcctt

SEQ ID NO: 3767332 - DNA, 21 bp, Homo sapiens
tccaggctgtatcccatgagc

SEQ ID NO: 3767333 - DNA, 12 bp, Homo sapiens
tccagggaagct

SEQ ID NO: 3767334 - DNA, 16 bp, Homo sapiens
tccagggaagctggcc

SEQ ID NO: 3767335 - DNA, 17 bp, Homo sapiens
tccagggaagctggccg

SEQ ID NO: 3767336 - DNA, 13 bp, Homo sapiens
tccagggccctga

SEQ ID NO: 3767337 - DNA, 17 bp, Homo sapiens
tccagggccctgagctc

SEQ ID NO: 3767338 - DNA, 17 bp, Homo sapiens
tccaggggatgggaggt

SEQ ID NO: 3767339 - DNA, 19 bp, Homo sapiens
tccaggtcgggctcagctc

SEQ ID NO: 3767340 - DNA, 22 bp, Homo sapiens
tccaggtcgggctcagctctgg

SEQ ID NO: 3767341 - DNA, 17 bp, Homo sapiens
tccagtcctgctctcta

SEQ ID NO: 3767342 - DNA, 16 bp, Homo sapiens
tccagtctgctgccct

SEQ ID NO: 3767343 - DNA, 13 bp, Homo sapiens
tccagtcttccac

SEQ ID NO: 3767344 - DNA, 19 bp, Homo sapiens
tccagtcttccacctggaa

SEQ ID NO: 3767345 - DNA, 20 bp, Homo sapiens
tccagtcttccacctggaag

SEQ ID NO: 3767346 - DNA, 22 bp, Homo sapiens
tccagtggaagaagaaaacact

SEQ ID NO: 3767347 - DNA, 22 bp, Homo sapiens
tccataatctggactcctctgt

SEQ ID NO: 3767348 - DNA, 17 bp, Homo sapiens
tccataattatgacagt

SEQ ID NO: 3767349 - DNA, 17 bp, Homo sapiens
tccatagtatattaaaa

SEQ ID NO: 3767350 - DNA, 21 bp, Homo sapiens
tccatagtatattaaaaatgg

SEQ ID NO: 3767351 - DNA, 14 bp, Homo sapiens
tccatccatctcca

SEQ ID NO: 3767352 - DNA, 14 bp, Homo sapiens
tccatccctacccc

SEQ ID NO: 3767353 - DNA, 18 bp, Homo sapiens
tccatgaaaacgttttat

SEQ ID NO: 3767354 - DNA, 16 bp, Homo sapiens
tccatgaaaatgcaac

SEQ ID NO: 3767355 - DNA, 12 bp, Homo sapiens
tccatgaatgta

SEQ ID NO: 3767356 - DNA, 21 bp, Homo sapiens
tccatgaatgtatcaggaaat

SEQ ID NO: 3767357 - DNA, 19 bp, Homo sapiens
tccatgagtttgccctggt

SEQ ID NO: 3767358 - DNA, 15 bp, Homo sapiens
tccatggtgcctctg

SEQ ID NO: 3767359 - DNA, 16 bp, Homo sapiens
tccatggtgcctctgg

SEQ ID NO: 3767360 - DNA, 16 bp, Homo sapiens
tccatgtactgtagtt

SEQ ID NO: 3767361 - DNA, 21 bp, Homo sapiens
tccatgtactgtagtttttct

SEQ ID NO: 3767362 - DNA, 16 bp, Homo sapiens
tccatgtgcccagtta

SEQ ID NO: 3767363 - DNA, 11 bp, Homo sapiens
tccatgtgtgt

SEQ ID NO: 3767364 - DNA, 18 bp, Homo sapiens
tccatgtgtgtgcaagtg

SEQ ID NO: 3767365 - DNA, 18 bp, Homo sapiens
tccatgttagtttttact

SEQ ID NO: 3767366 - DNA, 15 bp, Homo sapiens
tccattatgattctt

SEQ ID NO: 3767367 - DNA, 22 bp, Homo sapiens
tccattggtttacctgtgaaat

SEQ ID NO: 3767368 - DNA, 20 bp, Homo sapiens
tccatttcgcccctcattta

SEQ ID NO: 3767369 - DNA, 21 bp, Homo sapiens
tcccaaactaagctatgtgaa

SEQ ID NO: 3767370 - DNA, 16 bp, Homo sapiens
tcccaaagagctgcct

SEQ ID NO: 3767371 - DNA, 13 bp, Homo sapiens
tcccaaagtgctg

SEQ ID NO: 3767372 - DNA, 14 bp, Homo sapiens
tcccaaagtgctgg

SEQ ID NO: 3767373 - DNA, 21 bp, Homo sapiens
tcccaagaacagcaggcccac

SEQ ID NO: 3767374 - DNA, 15 bp, Homo sapiens
tcccaagctctgctc

SEQ ID NO: 3767375 - DNA, 17 bp, Homo sapiens
tcccaagctctgctcct

SEQ ID NO: 3767376 - DNA, 22 bp, Homo sapiens
tcccaaggaaagccccagcact

SEQ ID NO: 3767377 - DNA, 23 bp, Homo sapiens
tcccaaggcaaggggtgcctggg

SEQ ID NO: 3767378 - DNA, 14 bp, Homo sapiens
tcccaattaggaag

SEQ ID NO: 3767379 - DNA, 22 bp, Homo sapiens
tcccacactgctaggtgggcca

SEQ ID NO: 3767380 - DNA, 21 bp, Homo sapiens
tcccacaggcccttcctctcc

SEQ ID NO: 3767381 - DNA, 22 bp, Homo sapiens
tcccaccaggctgctcagggct

SEQ ID NO: 3767382 - DNA, 13 bp, Homo sapiens
tcccaccccaccc

SEQ ID NO: 3767383 - DNA, 22 bp, Homo sapiens
tcccaccccacccccttcagtg

SEQ ID NO: 3767384 - DNA, 18 bp, Homo sapiens
tcccaccggttgcttctg

SEQ ID NO: 3767385 - DNA, 16 bp, Homo sapiens
tcccaccttggctgca

SEQ ID NO: 3767386 - DNA, 20 bp, Homo sapiens
tcccacggaaaatgccaatc

SEQ ID NO: 3767387 - DNA, 14 bp, Homo sapiens
tcccactcctagga

SEQ ID NO: 3767388 - DNA, 19 bp, Homo sapiens
tcccagaacacactccatc

SEQ ID NO: 3767389 - DNA, 20 bp, Homo sapiens
tcccagaacacactccatca

SEQ ID NO: 3767390 - DNA, 18 bp, Homo sapiens
tcccagaaggacctcctg

SEQ ID NO: 3767391 - DNA, 20 bp, Homo sapiens
tcccagagacaggaaaatcc

SEQ ID NO: 3767392 - DNA, 20 bp, Homo sapiens
tcccagatttcagtcttttc

SEQ ID NO: 3767393 - DNA, 16 bp, Homo sapiens
tcccagcactttggga

SEQ ID NO: 3767394 - DNA, 21 bp, Homo sapiens
tcccagcactttgggaggcca

SEQ ID NO: 3767395 - DNA, 24 bp, Homo sapiens
tcccagccaccccgggctctctgc

SEQ ID NO: 3767396 - DNA, 15 bp, Homo sapiens
tcccagcccaaagct

SEQ ID NO: 3767397 - DNA, 22 bp, Homo sapiens
tcccagccctttgggaggctga

SEQ ID NO: 3767398 - DNA, 14 bp, Homo sapiens
tcccagcctgtggt

SEQ ID NO: 3767399 - DNA, 15 bp, Homo sapiens
tcccagcctgtggtt

SEQ ID NO: 3767400 - DNA, 19 bp, Homo sapiens
tcccagcggctggtgcagg

SEQ ID NO: 3767401 - DNA, 23 bp, Homo sapiens
tcccagcggctggtgcagggcct

SEQ ID NO: 3767402 - DNA, 16 bp, Homo sapiens
tcccagctactcagaa

SEQ ID NO: 3767403 - DNA, 16 bp, Homo sapiens
tcccagctactcagga

SEQ ID NO: 3767404 - DNA, 17 bp, Homo sapiens
tcccagctactcaggag

SEQ ID NO: 3767405 - DNA, 16 bp, Homo sapiens
tcccagctactcggga

SEQ ID NO: 3767406 - DNA, 20 bp, Homo sapiens
tcccagctctagacaaccct

SEQ ID NO: 3767407 - DNA, 16 bp, Homo sapiens
tcccagctctccctct

SEQ ID NO: 3767408 - DNA, 19 bp, Homo sapiens
tcccagctctccctctggc

SEQ ID NO: 3767409 - DNA, 22 bp, Homo sapiens
tcccagctctccctctggccct

SEQ ID NO: 3767410 - DNA, 13 bp, Homo sapiens
tcccagctgcccc

SEQ ID NO: 3767411 - DNA, 17 bp, Homo sapiens
tcccagctgtgctctgg

SEQ ID NO: 3767412 - DNA, 20 bp, Homo sapiens
tcccagctgtgctctggaca

SEQ ID NO: 3767413 - DNA, 21 bp, Homo sapiens
tcccagctgtgctctggacag

SEQ ID NO: 3767414 - DNA, 23 bp, Homo sapiens
tcccagctgtgctctggacaggc

SEQ ID NO: 3767415 - DNA, 18 bp, Homo sapiens
tcccaggcgccccttccc

SEQ ID NO: 3767416 - DNA, 20 bp, Homo sapiens
tcccagggccagggccctgc

SEQ ID NO: 3767417 - DNA, 21 bp, Homo sapiens
tcccagggccagggccctgca

SEQ ID NO: 3767418 - DNA, 21 bp, Homo sapiens
tcccagggctactcactcaag

SEQ ID NO: 3767419 - DNA, 15 bp, Homo sapiens
tcccagtgacacttc

SEQ ID NO: 3767420 - DNA, 19 bp, Homo sapiens
tcccagtgacacttcagag

SEQ ID NO: 3767421 - DNA, 20 bp, Homo sapiens
tcccagtgacacttcagaga

SEQ ID NO: 3767422 - DNA, 22 bp, Homo sapiens
tcccagtggcctcaaccctccc

SEQ ID NO: 3767423 - DNA, 19 bp, Homo sapiens
tgagtggggagacacctca

SEQ ID NO: 3767424 - DNA, 16 bp, Homo sapiens
tgagtgtggctcccct

SEQ ID NO: 3767425 - DNA, 17 bp, Homo sapiens
tgagtgtggctcccctc

SEQ ID NO: 3767426 - DNA, 18 bp, Homo sapiens
tgagtgtggctcccctct

SEQ ID NO: 3767427 - DNA, 22 bp, Homo sapiens
tgagtgtttttactacagttgt

SEQ ID NO: 3767428 - DNA, 17 bp, Homo sapiens
tgagttcataccctgtt

SEQ ID NO: 3767429 - DNA, 23 bp, Homo sapiens
tgagttgacttgacagaacactg

SEQ ID NO: 3767430 - DNA, 20 bp, Homo sapiens
tgagtttaccatttgtaata

SEQ ID NO: 3767431 - DNA, 21 bp, Homo sapiens
tgagtttagtgatctgaacag

SEQ ID NO: 3767432 - DNA, 16 bp, Homo sapiens
tgagtttcctcaggct

SEQ ID NO: 3767433 - DNA, 14 bp, Homo sapiens
tgagtttgccctgg

SEQ ID NO: 3767434 - DNA, 20 bp, Homo sapiens
tgagttttgttttaaaatta

SEQ ID NO: 3767435 - DNA, 13 bp, Homo sapiens
tgagtttttgata

SEQ ID NO: 3767436 - DNA, 17 bp, Homo sapiens
tgataaaagatacattt

SEQ ID NO: 3767437 - DNA, 21 bp, Homo sapiens
tgatacccatagcttccatga

SEQ ID NO: 3767438 - DNA, 14 bp, Homo sapiens
tgatacttgttttc

SEQ ID NO: 3767439 - DNA, 23 bp, Homo sapiens
tgatagcaagtgaatttttctct

SEQ ID NO: 3767440 - DNA, 16 bp, Homo sapiens
tgatagcgttggaatt

SEQ ID NO: 3767441 - DNA, 13 bp, Homo sapiens
tgatagctttatt

SEQ ID NO: 3767442 - DNA, 21 bp, Homo sapiens
tgatatcatgcccctgtactc

SEQ ID NO: 3767443 - DNA, 15 bp, Homo sapiens
tgatatgaaaaatat

SEQ ID NO: 3767444 - DNA, 16 bp, Homo sapiens
tgatatgcatttcctg

SEQ ID NO: 3767445 - DNA, 21 bp, Homo sapiens
tgatattccccccacttaaga

SEQ ID NO: 3767446 - DNA, 22 bp, Homo sapiens
tgatattttcaacgcagccctg

SEQ ID NO: 3767447 - DNA, 23 bp, Homo sapiens
tgatattttcaacgcagccctgc

SEQ ID NO: 3767448 - DNA, 20 bp, Homo sapiens
tgatatttttttaagtcttt

SEQ ID NO: 3767449 - DNA, 21 bp, Homo sapiens
tgatcaataaaatgtgatttt

SEQ ID NO: 3767450 - DNA, 14 bp, Homo sapiens
tgatcaattaaatg

SEQ ID NO: 3767451 - DNA, 15 bp, Homo sapiens
tgatcaattaaatgt

SEQ ID NO: 3767452 - DNA, 13 bp, Homo sapiens
tgatcacggctca

SEQ ID NO: 3767453 - DNA, 21 bp, Homo sapiens
tgatcacggctcactgcagcc

SEQ ID NO: 3767454 - DNA, 24 bp, Homo sapiens
tgatcatccactgtgccatgtgcc

SEQ ID NO: 3767455 - DNA, 15 bp, Homo sapiens
tgatcatgcattgtt

SEQ ID NO: 3767456 - DNA, 17 bp, Homo sapiens
tgatcatgcattgttga

SEQ ID NO: 3767457 - DNA, 23 bp, Homo sapiens
tgatcatgcattgttgaggtggt

SEQ ID NO: 3767458 - DNA, 20 bp, Homo sapiens
tgatcattttccccccactc

SEQ ID NO: 3767459 - DNA, 21 bp, Homo sapiens
tgatcattttccccccactct

SEQ ID NO: 3767460 - DNA, 21 bp, Homo sapiens
tgatccaagctggtcccactc

SEQ ID NO: 3767461 - DNA, 17 bp, Homo sapiens
tgatccacccacctcag

SEQ ID NO: 3767462 - DNA, 18 bp, Homo sapiens
tgatccacccacctcagc

SEQ ID NO: 3767463 - DNA, 19 bp, Homo sapiens
tgatccacccacctcagcc

SEQ ID NO: 3767464 - DNA, 14 bp, Homo sapiens
tgatccatccatct

SEQ ID NO: 3767465 - DNA, 16 bp, Homo sapiens
tgatccatccatctcc

SEQ ID NO: 3767466 - DNA, 16 bp, Homo sapiens
tgatcctcccacctca

SEQ ID NO: 3767467 - DNA, 18 bp, Homo sapiens
tgatcctcccacctcagc

SEQ ID NO: 3767468 - DNA, 20 bp, Homo sapiens
tgatcctcccacctcagcct

SEQ ID NO: 3767469 - DNA, 12 bp, Homo sapiens
tgatctcaggga

SEQ ID NO: 3767470 - DNA, 16 bp, Homo sapiens
tgatctcagggaagcc

SEQ ID NO: 3767471 - DNA, 22 bp, Homo sapiens
tgatctcagggaagcccagctc

SEQ ID NO: 3767472 - DNA, 16 bp, Homo sapiens
tgatctccatatgtta

SEQ ID NO: 3767473 - DNA, 17 bp, Homo sapiens
tgatctccctgccgcct

SEQ ID NO: 3767474 - DNA, 18 bp, Homo sapiens
tgatctccgtggctttgg

SEQ ID NO: 3767475 - DNA, 20 bp, Homo sapiens
tgatctctactaccacaagg

SEQ ID NO: 3767476 - DNA, 21 bp, Homo sapiens
tgatctctactaccacaagga

SEQ ID NO: 3767477 - DNA, 22 bp, Homo sapiens
tgatctctactaccacaaggaa

SEQ ID NO: 3767478 - DNA, 22 bp, Homo sapiens
tgatctgtatatacaataacat

SEQ ID NO: 3767479 - DNA, 15 bp, Homo sapiens
tgatctgtgggcaca

SEQ ID NO: 3767480 - DNA, 20 bp, Homo sapiens
tgatcttgctctatctcaca

SEQ ID NO: 3767481 - DNA, 15 bp, Homo sapiens
tgatcttgtgacata

SEQ ID NO: 3767482 - DNA, 16 bp, Homo sapiens
tgatctttgcagacag

SEQ ID NO: 3767483 - DNA, 23 bp, Homo sapiens
tgatctttgcagacaggcaagca

SEQ ID NO: 3767484 - DNA, 19 bp, Homo sapiens
tgatgaaagctgattactg

SEQ ID NO: 3767485 - DNA, 22 bp, Homo sapiens
tgatgaaatgaggtcagagcct

SEQ ID NO: 3767486 - DNA, 23 bp, Homo sapiens
tgatgaaatgaggtcagagcctg

SEQ ID NO: 3767487 - DNA, 18 bp, Homo sapiens
tgatgaactcttaatcaa

SEQ ID NO: 3767488 - DNA, 18 bp, Homo sapiens
tgatgaagaaaagtgggc

SEQ ID NO: 3767489 - DNA, 17 bp, Homo sapiens
tgatgaagggaggaggt

SEQ ID NO: 3767490 - DNA, 13 bp, Homo sapiens
tgatgaatcttgc

SEQ ID NO: 3767491 - DNA, 15 bp, Homo sapiens
tgatgactggaattt

SEQ ID NO: 3767492 - DNA, 17 bp, Homo sapiens
tgatgagtgtaacaaga

SEQ ID NO: 3767493 - DNA, 22 bp, Homo sapiens
tgatgagtgtaacaagaaagga

SEQ ID NO: 3767494 - DNA, 14 bp, Homo sapiens
tgatgatcctaggc

SEQ ID NO: 3767495 - DNA, 22 bp, Homo sapiens
tgatgatctttgcagacaggca

SEQ ID NO: 3767496 - DNA, 15 bp, Homo sapiens
tgatgatgataatga

SEQ ID NO: 3767497 - DNA, 18 bp, Homo sapiens
tgatgccacacagagtgg

SEQ ID NO: 3767498 - DNA, 14 bp, Homo sapiens
tgatgctccctccc

SEQ ID NO: 3767499 - DNA, 22 bp, Homo sapiens
tgatgctccctcccctgccctg

SEQ ID NO: 3767500 - DNA, 20 bp, Homo sapiens
tgatgctgtgctatgaattt

SEQ ID NO: 3767501 - DNA, 14 bp, Homo sapiens
tgatggaaacaaag

SEQ ID NO: 3767502 - DNA, 22 bp, Homo sapiens
tgatggcaccactgcactccag

SEQ ID NO: 3767503 - DNA, 21 bp, Homo sapiens
tgatgggcaacccccagcctg

SEQ ID NO: 3767504 - DNA, 22 bp, Homo sapiens
tgatgggcaacccccagcctgc

SEQ ID NO: 3767505 - DNA, 17 bp, Homo sapiens
tgatggggaaggaggct

SEQ ID NO: 3767506 - DNA, 20 bp, Homo sapiens
tgatgtaccatgaaacaaag

SEQ ID NO: 3767507 - DNA, 18 bp, Homo sapiens
tgatgtcacatcttggca

SEQ ID NO: 3767508 - DNA, 19 bp, Homo sapiens
tgatgtcccaacttgtaaa

SEQ ID NO: 3767509 - DNA, 23 bp, Homo sapiens
tgatgtctttgttaagactgctg

SEQ ID NO: 3767510 - DNA, 14 bp, Homo sapiens
tgatgtgcaaaaat

SEQ ID NO: 3767511 - DNA, 14 bp, Homo sapiens
tgatgtggcaactg

SEQ ID NO: 3767512 - DNA, 16 bp, Homo sapiens
tgatgtgttatctctt

SEQ ID NO: 3767513 - DNA, 14 bp, Homo sapiens
tgatgttaaaattc

SEQ ID NO: 3767514 - DNA, 10 bp, Homo sapiens
tgatgttaac

SEQ ID NO: 3767515 - DNA, 17 bp, Homo sapiens
tgatgttaggctgggcc

SEQ ID NO: 3767516 - DNA, 17 bp, Homo sapiens
tgatgttgagggaacag

SEQ ID NO: 3767517 - DNA, 18 bp, Homo sapiens
tgatgttgtttaacataa

SEQ ID NO: 3767518 - DNA, 13 bp, Homo sapiens
tgatgtttgtcct

SEQ ID NO: 3767519 - DNA, 14 bp, Homo sapiens
tgattactctttga

SEQ ID NO: 3767520 - DNA, 13 bp, Homo sapiens
tgattactgtcaa

SEQ ID NO: 3767521 - DNA, 16 bp, Homo sapiens
tgattatttatcacat

SEQ ID NO: 3767522 - DNA, 17 bp, Homo sapiens
tgattatttatcacata

SEQ ID NO: 3767523 - DNA, 16 bp, Homo sapiens
tgattccatctccttg

SEQ ID NO: 3767524 - DNA, 15 bp, Homo sapiens
tgattcccaagctct

SEQ ID NO: 3767525 - DNA, 16 bp, Homo sapiens
tgattcccaagctctg

SEQ ID NO: 3767526 - DNA, 23 bp, Homo sapiens
tgattcccaagctctgctcctct

SEQ ID NO: 3767527 - DNA, 18 bp, Homo sapiens
tgattccctcctgctact

SEQ ID NO: 3767528 - DNA, 15 bp, Homo sapiens
tgattcgagctatat

SEQ ID NO: 3767529 - DNA, 16 bp, Homo sapiens
tgattcgcccaaagcc

SEQ ID NO: 3767530 - DNA, 22 bp, Homo sapiens
tgattcgcccaaagccagacag

SEQ ID NO: 3767531 - DNA, 19 bp, Homo sapiens
tgattctcctgcctcagcc

SEQ ID NO: 3767532 - DNA, 20 bp, Homo sapiens
tgattctcctgcctcagcct

SEQ ID NO: 3767533 - DNA, 23 bp, Homo sapiens
tgattctttaatagaagttttat

SEQ ID NO: 3767534 - DNA, 14 bp, Homo sapiens
tgattctttgttac

SEQ ID NO: 3767535 - DNA, 15 bp, Homo sapiens
tgctggttttcctaa

SEQ ID NO: 3767536 - DNA, 14 bp, Homo sapiens
tgctgtagatgctg

SEQ ID NO: 3767537 - DNA, 18 bp, Homo sapiens
tgctgtattttcttttta

SEQ ID NO: 3767538 - DNA, 18 bp, Homo sapiens
tgctgtccggtggagatc

SEQ ID NO: 3767539 - DNA, 14 bp, Homo sapiens
tgctgtggtctctt

SEQ ID NO: 3767540 - DNA, 16 bp, Homo sapiens
tgctgtggttcctggg

SEQ ID NO: 3767541 - DNA, 16 bp, Homo sapiens
tgctgtgtaacactgt

SEQ ID NO: 3767542 - DNA, 18 bp, Homo sapiens
tgctgtgtccaactccag

SEQ ID NO: 3767543 - DNA, 23 bp, Homo sapiens
tgctgttgtcattgctttactgg

SEQ ID NO: 3767544 - DNA, 11 bp, Homo sapiens
tgctgtttcct

SEQ ID NO: 3767545 - DNA, 18 bp, Homo sapiens
tgcttaaaaatcattgat

SEQ ID NO: 3767546 - DNA, 19 bp, Homo sapiens
tgcttaaaaatcattgatt

SEQ ID NO: 3767547 - DNA, 16 bp, Homo sapiens
tgcttattgttccaag

SEQ ID NO: 3767548 - DNA, 17 bp, Homo sapiens
tgcttattttaaaattt

SEQ ID NO: 3767549 - DNA, 18 bp, Homo sapiens
tgcttcaaactaacacat

SEQ ID NO: 3767550 - DNA, 19 bp, Homo sapiens
tgcttcaaactaacacatt

SEQ ID NO: 3767551 - DNA, 14 bp, Homo sapiens
tgcttcaactgtct

SEQ ID NO: 3767552 - DNA, 15 bp, Homo sapiens
tgcttcacaacccat

SEQ ID NO: 3767553 - DNA, 14 bp, Homo sapiens
tgcttcagcctgag

SEQ ID NO: 3767554 - DNA, 21 bp, Homo sapiens
tgcttcatagctggttcctgc

SEQ ID NO: 3767555 - DNA, 17 bp, Homo sapiens
tgcttcatgaaaatcct

SEQ ID NO: 3767556 - DNA, 15 bp, Homo sapiens
tgcttccctctgcct

SEQ ID NO: 3767557 - DNA, 20 bp, Homo sapiens
tgcttccctctgcctgtccc

SEQ ID NO: 3767558 - DNA, 17 bp, Homo sapiens
tgcttctccatgagaca

SEQ ID NO: 3767559 - DNA, 14 bp, Homo sapiens
tgcttctgggaagg

SEQ ID NO: 3767560 - DNA, 20 bp, Homo sapiens
tgcttctgtagtactcctta

SEQ ID NO: 3767561 - DNA, 22 bp, Homo sapiens
tgcttcttcccttaaaatttat

SEQ ID NO: 3767562 - DNA, 20 bp, Homo sapiens
tgcttgaacacagtattttc

SEQ ID NO: 3767563 - DNA, 14 bp, Homo sapiens
tgcttgagcccagg

SEQ ID NO: 3767564 - DNA, 21 bp, Homo sapiens
tgcttgaggcaactcatctta

SEQ ID NO: 3767565 - DNA, 15 bp, Homo sapiens
tgcttgatggtttat

SEQ ID NO: 3767566 - DNA, 20 bp, Homo sapiens
tgcttgccgaaactggaagt

SEQ ID NO: 3767567 - DNA, 23 bp, Homo sapiens
tgcttgtaacaagaaaacataag

SEQ ID NO: 3767568 - DNA, 17 bp, Homo sapiens
tgcttgtccctgcccag

SEQ ID NO: 3767569 - DNA, 20 bp, Homo sapiens
tgctttaattgtgaattgat

SEQ ID NO: 3767570 - DNA, 19 bp, Homo sapiens
tgctttcatcttggtcaca

SEQ ID NO: 3767571 - DNA, 20 bp, Homo sapiens
tgctttccgtggcactgcat

SEQ ID NO: 3767572 - DNA, 18 bp, Homo sapiens
tgctttctttgtttggct

SEQ ID NO: 3767573 - DNA, 20 bp, Homo sapiens
tgctttgactgagcagactg

SEQ ID NO: 3767574 - DNA, 22 bp, Homo sapiens
tgctttgactgagcagactggt

SEQ ID NO: 3767575 - DNA, 16 bp, Homo sapiens
tgctttgggctgccct

SEQ ID NO: 3767576 - DNA, 21 bp, Homo sapiens
tgctttgggctgccctggtgc

SEQ ID NO: 3767577 - DNA, 20 bp, Homo sapiens
tggaaaaatagcctgcctct

SEQ ID NO: 3767578 - DNA, 15 bp, Homo sapiens
tggaaaaggaagact

SEQ ID NO: 3767579 - DNA, 16 bp, Homo sapiens
tggaaaaggaagacta

SEQ ID NO: 3767580 - DNA, 18 bp, Homo sapiens
tggaaaaggaagactaga

SEQ ID NO: 3767581 - DNA, 11 bp, Homo sapiens
tggaaaataaa

SEQ ID NO: 3767582 - DNA, 16 bp, Homo sapiens
tggaaaataaattatt

SEQ ID NO: 3767583 - DNA, 16 bp, Homo sapiens
tggaaacaaagtggaa

SEQ ID NO: 3767584 - DNA, 21 bp, Homo sapiens
tggaaacaaagtggaaggaaa

SEQ ID NO: 3767585 - DNA, 22 bp, Homo sapiens
tggaaacttttcttaaaaagtt

SEQ ID NO: 3767586 - DNA, 16 bp, Homo sapiens
tggaaagcatcacctc

SEQ ID NO: 3767587 - DNA, 21 bp, Homo sapiens
tggaaagcatcacctcaggcc

SEQ ID NO: 3767588 - DNA, 13 bp, Homo sapiens
tggaaaggctcag

SEQ ID NO: 3767589 - DNA, 17 bp, Homo sapiens
tggaaaggctcagtctc

SEQ ID NO: 3767590 - DNA, 17 bp, Homo sapiens
tggaaagtgaatttgaa

SEQ ID NO: 3767591 - DNA, 23 bp, Homo sapiens
tggaaagtgaatttgaatgaaaa

SEQ ID NO: 3767592 - DNA, 13 bp, Homo sapiens
tggaaatattatg

SEQ ID NO: 3767593 - DNA, 19 bp, Homo sapiens
tggaacagcgggagacctg

SEQ ID NO: 3767594 - DNA, 14 bp, Homo sapiens
tggaacatccttgg

SEQ ID NO: 3767595 - DNA, 18 bp, Homo sapiens
tggaacccttttggcccc

SEQ ID NO: 3767596 - DNA, 19 bp, Homo sapiens
tggaaccgcaggaagctgc

SEQ ID NO: 3767597 - DNA, 16 bp, Homo sapiens
tggaactctagggata

SEQ ID NO: 3767598 - DNA, 22 bp, Homo sapiens
tggaagatttgcccatttacac

SEQ ID NO: 3767599 - DNA, 19 bp, Homo sapiens
tggaagcatgtaggagaat

SEQ ID NO: 3767600 - DNA, 13 bp, Homo sapiens
tggaagccctcct

SEQ ID NO: 3767601 - DNA, 15 bp, Homo sapiens
tggaagccctccttc

SEQ ID NO: 3767602 - DNA, 16 bp, Homo sapiens
tggaagccctccttcc

SEQ ID NO: 3767603 - DNA, 18 bp, Homo sapiens
tggaagtgagggtcagag

SEQ ID NO: 3767604 - DNA, 16 bp, Homo sapiens
tggaagtttgtgttct

SEQ ID NO: 3767605 - DNA, 23 bp, Homo sapiens
tggaagtttgtgttctgtttgtt

SEQ ID NO: 3767606 - DNA, 15 bp, Homo sapiens
tggaataacatgtaa

SEQ ID NO: 3767607 - DNA, 19 bp, Homo sapiens
tggaataacatgtaattaa

SEQ ID NO: 3767608 - DNA, 15 bp, Homo sapiens
tggaatacagtgtta

SEQ ID NO: 3767609 - DNA, 21 bp, Homo sapiens
tggaatctagaagaaatgaaa

SEQ ID NO: 3767610 - DNA, 20 bp, Homo sapiens
tggaatcttctctttgacaa

SEQ ID NO: 3767611 - DNA, 21 bp, Homo sapiens
tggaatgtggcccctgaacaa

SEQ ID NO: 3767612 - DNA, 15 bp, Homo sapiens
tggaattaaaacaat

SEQ ID NO: 3767613 - DNA, 16 bp, Homo sapiens
tggaattaacctggtg

SEQ ID NO: 3767614 - DNA, 17 bp, Homo sapiens
tggaattaacctggtgc

SEQ ID NO: 3767615 - DNA, 18 bp, Homo sapiens
tggaattaacctggtgct

SEQ ID NO: 3767616 - DNA, 19 bp, Homo sapiens
tggaattaacctggtgctg

SEQ ID NO: 3767617 - DNA, 15 bp, Homo sapiens
tggaattctgttcat

SEQ ID NO: 3767618 - DNA, 16 bp, Homo sapiens
tggaattgcttaccaa

SEQ ID NO: 3767619 - DNA, 18 bp, Homo sapiens
tggaatttttattatgca

SEQ ID NO: 3767620 - DNA, 23 bp, Homo sapiens
tggaatttttattatgcataact

SEQ ID NO: 3767621 - DNA, 20 bp, Homo sapiens
tggaattttttattcttgtg

SEQ ID NO: 3767622 - DNA, 16 bp, Homo sapiens
tggacaatcatgaaat

SEQ ID NO: 3767623 - DNA, 14 bp, Homo sapiens
tggacacacacagc

SEQ ID NO: 3767624 - DNA, 23 bp, Homo sapiens
tggacacagctcttctccaggct

SEQ ID NO: 3767625 - DNA, 18 bp, Homo sapiens
tggacagcaaaaccattg

SEQ ID NO: 3767626 - DNA, 22 bp, Homo sapiens
tggacaggtctgggagaggcag

SEQ ID NO: 3767627 - DNA, 14 bp, Homo sapiens
tggacagtcctggg

SEQ ID NO: 3767628 - DNA, 16 bp, Homo sapiens
tggacagtcctgggag

SEQ ID NO: 3767629 - DNA, 17 bp, Homo sapiens
tggacagtcctgggaga

SEQ ID NO: 3767630 - DNA, 20 bp, Homo sapiens
tggacattaagcatcacaaa

SEQ ID NO: 3767631 - DNA, 19 bp, Homo sapiens
tggaccactgggcaatgat

SEQ ID NO: 3767632 - DNA, 14 bp, Homo sapiens
tggaccagatgctg

SEQ ID NO: 3767633 - DNA, 20 bp, Homo sapiens
tggacccagggatgacatgt

SEQ ID NO: 3767634 - DNA, 23 bp, Homo sapiens
tggaccctgtggatgataaaaca

SEQ ID NO: 3767635 - DNA, 14 bp, Homo sapiens
tggactcctctgtc

SEQ ID NO: 3767636 - DNA, 21 bp, Homo sapiens
tggactctacactgtgaactt

SEQ ID NO: 3767637 - DNA, 16 bp, Homo sapiens
tggactctcccctctt

SEQ ID NO: 3767638 - DNA, 17 bp, Homo sapiens
tggactctcccctctta

SEQ ID NO: 3767639 - DNA, 21 bp, Homo sapiens
tggactgggttgcgtcctgac

SEQ ID NO: 3767640 - DNA, 15 bp, Homo sapiens
tggactgtcatagaa

SEQ ID NO: 3767641 - DNA, 21 bp, Homo sapiens
tggactgtgatgccacacaga

SEQ ID NO: 3767642 - DNA, 20 bp, Homo sapiens
tggactttccaccccctccc

SEQ ID NO: 3767643 - DNA, 17 bp, Homo sapiens
tggagaaacccttgaaa

SEQ ID NO: 3767644 - DNA, 23 bp, Homo sapiens
tggagaacgccagtctcccaggc

SEQ ID NO: 3767645 - DNA, 16 bp, Homo sapiens
tggagaataattcttt

SEQ ID NO: 3767646 - DNA, 20 bp, Homo sapiens
tggagacaatgcagatgcca

SEQ ID NO: 3767647 - DNA, 16 bp, Homo sapiens
tgggactgggagggcc

SEQ ID NO: 3767648 - DNA, 14 bp, Homo sapiens
tgggactgtacaca

SEQ ID NO: 3767649 - DNA, 15 bp, Homo sapiens
tgggactgtacacac

SEQ ID NO: 3767650 - DNA, 14 bp, Homo sapiens
tgggagaacctcag

SEQ ID NO: 3767651 - DNA, 23 bp, Homo sapiens
tgggagaacctcaggcttccttg

SEQ ID NO: 3767652 - DNA, 23 bp, Homo sapiens
tgggagaagggggtcaaagcaag

SEQ ID NO: 3767653 - DNA, 18 bp, Homo sapiens
tgggagactgctgagtca

SEQ ID NO: 3767654 - DNA, 18 bp, Homo sapiens
tgggagagcccagccatt

SEQ ID NO: 3767655 - DNA, 13 bp, Homo sapiens
tgggagccccagg

SEQ ID NO: 3767656 - DNA, 22 bp, Homo sapiens
tgggagccccagggtcttccct

SEQ ID NO: 3767657 - DNA, 23 bp, Homo sapiens
tgggagccccagggtcttcccta

SEQ ID NO: 3767658 - DNA, 23 bp, Homo sapiens
tgggagcctcataaagatggctt

SEQ ID NO: 3767659 - DNA, 13 bp, Homo sapiens
tgggagctgcctg

SEQ ID NO: 3767660 - DNA, 21 bp, Homo sapiens
tgggagctgcctgttcagctc

SEQ ID NO: 3767661 - DNA, 20 bp, Homo sapiens
tgggagctggttagaaatgc

SEQ ID NO: 3767662 - DNA, 12 bp, Homo sapiens
tgggaggaaaag

SEQ ID NO: 3767663 - DNA, 20 bp, Homo sapiens
tgggaggaaaagaaaagagg

SEQ ID NO: 3767664 - DNA, 15 bp, Homo sapiens
tgggaggaaatttga

SEQ ID NO: 3767665 - DNA, 11 bp, Homo sapiens
tgggaggaagc

SEQ ID NO: 3767666 - DNA, 18 bp, Homo sapiens
tgggaggatctcttgagc

SEQ ID NO: 3767667 - DNA, 21 bp, Homo sapiens
tgggaggatctcttgagcctg

SEQ ID NO: 3767668 - DNA, 18 bp, Homo sapiens
tgggagggatagaggggg

SEQ ID NO: 3767669 - DNA, 18 bp, Homo sapiens
tgggaggtcaaggctgca

SEQ ID NO: 3767670 - DNA, 13 bp, Homo sapiens
tgggatctgactg

SEQ ID NO: 3767671 - DNA, 14 bp, Homo sapiens
tgggatgcttgcct

SEQ ID NO: 3767672 - DNA, 16 bp, Homo sapiens
tgggatggaggagaag

SEQ ID NO: 3767673 - DNA, 16 bp, Homo sapiens
tgggatgtcttatttt

SEQ ID NO: 3767674 - DNA, 14 bp, Homo sapiens
tgggatgtttctgt

SEQ ID NO: 3767675 - DNA, 14 bp, Homo sapiens
tgggcaaacaggca

SEQ ID NO: 3767676 - DNA, 16 bp, Homo sapiens
tgggcaacccccagcc

SEQ ID NO: 3767677 - DNA, 20 bp, Homo sapiens
tgggcaacccccagcctgct

SEQ ID NO: 3767678 - DNA, 21 bp, Homo sapiens
tgggcaacccccagcctgcta

SEQ ID NO: 3767679 - DNA, 17 bp, Homo sapiens
tgggcacctataatacc

SEQ ID NO: 3767680 - DNA, 15 bp, Homo sapiens
tgggcacctggggag

SEQ ID NO: 3767681 - DNA, 19 bp, Homo sapiens
tgggcacgctgtgggcagg

SEQ ID NO: 3767682 - DNA, 17 bp, Homo sapiens
tgggcagaaggccaaga

SEQ ID NO: 3767683 - DNA, 16 bp, Homo sapiens
tgggcagcatagcaag

SEQ ID NO: 3767684 - DNA, 17 bp, Homo sapiens
tgggcagctgaacagtg

SEQ ID NO: 3767685 - DNA, 16 bp, Homo sapiens
tgggcaggacctcaga

SEQ ID NO: 3767686 - DNA, 17 bp, Homo sapiens
tgggcagggaggcacca

SEQ ID NO: 3767687 - DNA, 12 bp, Homo sapiens
tgggcattgctt

SEQ ID NO: 3767688 - DNA, 13 bp, Homo sapiens
tgggccagcccct

SEQ ID NO: 3767689 - DNA, 14 bp, Homo sapiens
tgggccagcccctc

SEQ ID NO: 3767690 - DNA, 16 bp, Homo sapiens
tgggccagcccctccc

SEQ ID NO: 3767691 - DNA, 23 bp, Homo sapiens
tgggccagcccctcccaccacag

SEQ ID NO: 3767692 - DNA, 18 bp, Homo sapiens
tgggccaggacaggcccg

SEQ ID NO: 3767693 - DNA, 19 bp, Homo sapiens
tgggcccagaggcacagcc

SEQ ID NO: 3767694 - DNA, 18 bp, Homo sapiens
tgggccccaccacctagg

SEQ ID NO: 3767695 - DNA, 14 bp, Homo sapiens
tgggcccctcccta

SEQ ID NO: 3767696 - DNA, 19 bp, Homo sapiens
tgggcccctccctacctca

SEQ ID NO: 3767697 - DNA, 16 bp, Homo sapiens
tgggcctcaaggactt

SEQ ID NO: 3767698 - DNA, 20 bp, Homo sapiens
tgggcctcctctgtccaggg

SEQ ID NO: 3767699 - DNA, 16 bp, Homo sapiens
tgggcctcctgtgtgt

SEQ ID NO: 3767700 - DNA, 16 bp, Homo sapiens
tgggcctgtcgtgcca

SEQ ID NO: 3767701 - DNA, 14 bp, Homo sapiens
tgggctcccttcct

SEQ ID NO: 3767702 - DNA, 14 bp, Homo sapiens
tgggctctccacct

SEQ ID NO: 3767703 - DNA, 15 bp, Homo sapiens
tgggctctccacctc

SEQ ID NO: 3767704 - DNA, 21 bp, Homo sapiens
tgggctctccacctcagcctt

SEQ ID NO: 3767705 - DNA, 15 bp, Homo sapiens
tgggctctgccccag

SEQ ID NO: 3767706 - DNA, 17 bp, Homo sapiens
tgggctctgccccagct

SEQ ID NO: 3767707 - DNA, 19 bp, Homo sapiens
tgggctctgccccagctct

SEQ ID NO: 3767708 - DNA, 15 bp, Homo sapiens
tgggctgagactgga

SEQ ID NO: 3767709 - DNA, 16 bp, Homo sapiens
tgggctgagccctggc

SEQ ID NO: 3767710 - DNA, 17 bp, Homo sapiens
tgggctgagccctggca

SEQ ID NO: 3767711 - DNA, 15 bp, Homo sapiens
tgggctgccctggtg

SEQ ID NO: 3767712 - DNA, 16 bp, Homo sapiens
tgggctgccctggtgc

SEQ ID NO: 3767713 - DNA, 20 bp, Homo sapiens
tgggctgccctggtgctgcc

SEQ ID NO: 3767714 - DNA, 15 bp, Homo sapiens
tgggctgctcctcat

SEQ ID NO: 3767715 - DNA, 17 bp, Homo sapiens
tgggctggtgtcacctg

SEQ ID NO: 3767716 - DNA, 15 bp, Homo sapiens
tgggctgtgagtgta

SEQ ID NO: 3767717 - DNA, 17 bp, Homo sapiens
tgggcttcagtggcagc

SEQ ID NO: 3767718 - DNA, 18 bp, Homo sapiens
tgggcttcagtggcagct

SEQ ID NO: 3767719 - DNA, 20 bp, Homo sapiens
tgggcttcagtggcagctgc

SEQ ID NO: 3767720 - DNA, 22 bp, Homo sapiens
tgggcttcagtggcagctgctt

SEQ ID NO: 3767721 - DNA, 19 bp, Homo sapiens
tgggcttccatttgtgtgt

SEQ ID NO: 3767722 - DNA, 23 bp, Homo sapiens
tgggcttccatttgtgtgtgtgc

SEQ ID NO: 3767723 - DNA, 21 bp, Homo sapiens
tgggcttgtctgtagatttta

SEQ ID NO: 3767724 - DNA, 14 bp, Homo sapiens
tgggcttgttttct

SEQ ID NO: 3767725 - DNA, 20 bp, Homo sapiens
tgggctttgattccatctcc

SEQ ID NO: 3767726 - DNA, 19 bp, Homo sapiens
tggggaacaagggtggcat

SEQ ID NO: 3767727 - DNA, 18 bp, Homo sapiens
tggggaagcttcttaaat

SEQ ID NO: 3767728 - DNA, 20 bp, Homo sapiens
tggggacgtcctgccacctg

SEQ ID NO: 3767729 - DNA, 23 bp, Homo sapiens
tggggagacataaccactgcttc

SEQ ID NO: 3767730 - DNA, 15 bp, Homo sapiens
tggggagcagagaca

SEQ ID NO: 3767731 - DNA, 17 bp, Homo sapiens
tggggagcagagacact

SEQ ID NO: 3767732 - DNA, 15 bp, Homo sapiens
tggggatgagaaagg

SEQ ID NO: 3767733 - DNA, 15 bp, Homo sapiens
tggggatttctccca

SEQ ID NO: 3767734 - DNA, 13 bp, Homo sapiens
tggggcagcacag

SEQ ID NO: 3767735 - DNA, 18 bp, Homo sapiens
tggggcagcacagagagg

SEQ ID NO: 3767736 - DNA, 22 bp, Homo sapiens
tggggcagcacagagagggggc

SEQ ID NO: 3767737 - DNA, 16 bp, Homo sapiens
tggggcagcttgaggg

SEQ ID NO: 3767738 - DNA, 16 bp, Homo sapiens
tggggccacagccaga

SEQ ID NO: 3767739 - DNA, 15 bp, Homo sapiens
tggggctctgtgcag

SEQ ID NO: 3767740 - DNA, 18 bp, Homo sapiens
tggggctgatctcaggga

SEQ ID NO: 3767741 - DNA, 11 bp, Homo sapiens
tggggctgggg

SEQ ID NO: 3767742 - DNA, 22 bp, Homo sapiens
tgggggcagcctgcgtggctga

SEQ ID NO: 3767743 - DNA, 17 bp, Homo sapiens
tgggggcagggcatgac

SEQ ID NO: 3767744 - DNA, 21 bp, Homo sapiens
tgggggcctcactccaggaag

SEQ ID NO: 3767745 - DNA, 19 bp, Homo sapiens
tgggggcctgacctccccc

SEQ ID NO: 3767746 - DNA, 15 bp, Homo sapiens
tggggggccaacacc

SEQ ID NO: 3767747 - DNA, 17 bp, Homo sapiens
tggggggccaacaccag

SEQ ID NO: 3767748 - DNA, 19 bp, Homo sapiens
tggggggctgaggtgggag

SEQ ID NO: 3767749 - DNA, 19 bp, Homo sapiens
tgggggttctttcttcctc

SEQ ID NO: 3767750 - DNA, 14 bp, Homo sapiens
tggggtacccactg

SEQ ID NO: 3767751 - DNA, 20 bp, Homo sapiens
tggggtacccactgctctgg

SEQ ID NO: 3767752 - DNA, 18 bp, Homo sapiens
tggggtagctagaggaac

SEQ ID NO: 3767753 - DNA, 19 bp, Homo sapiens
tggggtctccctctcctgc

SEQ ID NO: 3767754 - DNA, 15 bp, Homo sapiens
tggggtgtgggaggc

SEQ ID NO: 3767755 - DNA, 15 bp, Homo sapiens
tggggttcagcccct

SEQ ID NO: 3767756 - DNA, 19 bp, Homo sapiens
tggggttcagcccctcctc

SEQ ID NO: 3767757 - DNA, 22 bp, Homo sapiens
tggggttcagcccctcctctgc

SEQ ID NO: 3767758 - DNA, 19 bp, Homo sapiens
tggggttgcatcagaaatg

SEQ ID NO: 3767759 - DNA, 18 bp, Homo sapiens
tggggttggctgggccca

SEQ ID NO: 3767760 - DNA, 20 bp, Homo sapiens
tgtctccctataatgctgga

SEQ ID NO: 3767761 - DNA, 19 bp, Homo sapiens
tgtctcctttgcaggctca

SEQ ID NO: 3767762 - DNA, 16 bp, Homo sapiens
tgtctgaagtcactgc

SEQ ID NO: 3767763 - DNA, 15 bp, Homo sapiens
tgtctgccagccagc

SEQ ID NO: 3767764 - DNA, 18 bp, Homo sapiens
tgtctgccagccagcagc

SEQ ID NO: 3767765 - DNA, 22 bp, Homo sapiens
tgtctggaggggagctctgtct

SEQ ID NO: 3767766 - DNA, 21 bp, Homo sapiens
tgtctgtgtgcaagtgtgtgc

SEQ ID NO: 3767767 - DNA, 14 bp, Homo sapiens
tgtcttaaataaaa

SEQ ID NO: 3767768 - DNA, 14 bp, Homo sapiens
tgtcttaattaagt

SEQ ID NO: 3767769 - DNA, 20 bp, Homo sapiens
tgtcttaattaagtaaacta

SEQ ID NO: 3767770 - DNA, 22 bp, Homo sapiens
tgtcttaattaagtaaactaat

SEQ ID NO: 3767771 - DNA, 21 bp, Homo sapiens
tgtcttcaatttgtataaaat

SEQ ID NO: 3767772 - DNA, 19 bp, Homo sapiens
tgtcttcatccttagcaac

SEQ ID NO: 3767773 - DNA, 21 bp, Homo sapiens
tgtcttcatccttagcaacag

SEQ ID NO: 3767774 - DNA, 17 bp, Homo sapiens
tgtcttcctgcattcac

SEQ ID NO: 3767775 - DNA, 20 bp, Homo sapiens
tgtcttgcaatggcagcctt

SEQ ID NO: 3767776 - DNA, 21 bp, Homo sapiens
tgtcttgcaatggcagccttg

SEQ ID NO: 3767777 - DNA, 17 bp, Homo sapiens
tgtcttgttaatattct

SEQ ID NO: 3767778 - DNA, 15 bp, Homo sapiens
tgtctttaaggaaaa

SEQ ID NO: 3767779 - DNA, 10 bp, Homo sapiens
tgtctttggt

SEQ ID NO: 3767780 - DNA, 20 bp, Homo sapiens
tgtctttttctggactgaag

SEQ ID NO: 3767781 - DNA, 21 bp, Homo sapiens
tgtgaaatagttcaaagccaa

SEQ ID NO: 3767782 - DNA, 21 bp, Homo sapiens
tgtgaaccaccacacccagcc

SEQ ID NO: 3767783 - DNA, 22 bp, Homo sapiens
tgtgaaccaccacacccagccc

SEQ ID NO: 3767784 - DNA, 21 bp, Homo sapiens
tgtgaacgatttagaaagaag

SEQ ID NO: 3767785 - DNA, 17 bp, Homo sapiens
tgtgaagatgtttgcaa

SEQ ID NO: 3767786 - DNA, 14 bp, Homo sapiens
tgtgaagggaagga

SEQ ID NO: 3767787 - DNA, 14 bp, Homo sapiens
tgtgaatcagaccc

SEQ ID NO: 3767788 - DNA, 15 bp, Homo sapiens
tgtgaatgtgactac

SEQ ID NO: 3767789 - DNA, 19 bp, Homo sapiens
tgtgaattgaaatgttcgt

SEQ ID NO: 3767790 - DNA, 21 bp, Homo sapiens
tgtgacaaggattgctactgt

SEQ ID NO: 3767791 - DNA, 17 bp, Homo sapiens
tgtgacatgcgggctgg

SEQ ID NO: 3767792 - DNA, 20 bp, Homo sapiens
tgtgactgatgttaggctgg

SEQ ID NO: 3767793 - DNA, 23 bp, Homo sapiens
tgtgactgatgttaggctgggcc

SEQ ID NO: 3767794 - DNA, 14 bp, Homo sapiens
tgtgagaaaacgtt

SEQ ID NO: 3767795 - DNA, 15 bp, Homo sapiens
tgtgagacccccaca

SEQ ID NO: 3767796 - DNA, 18 bp, Homo sapiens
tgtgagacccccacacct

SEQ ID NO: 3767797 - DNA, 23 bp, Homo sapiens
tgtgaggcccatggttgagaaat

SEQ ID NO: 3767798 - DNA, 21 bp, Homo sapiens
tgtgaggtgcagagtgcccag

SEQ ID NO: 3767799 - DNA, 19 bp, Homo sapiens
tgtgagtaagagctggtgt

SEQ ID NO: 3767800 - DNA, 20 bp, Homo sapiens
tgtgagtgtaagtgtgagta

SEQ ID NO: 3767801 - DNA, 19 bp, Homo sapiens
tgtgagtgtgtgtttgtgc

SEQ ID NO: 3767802 - DNA, 18 bp, Homo sapiens
tgtgataaggatcagaac

SEQ ID NO: 3767803 - DNA, 14 bp, Homo sapiens
tgtgatattaacag

SEQ ID NO: 3767804 - DNA, 18 bp, Homo sapiens
tgtgatcccaagtgccag

SEQ ID NO: 3767805 - DNA, 18 bp, Homo sapiens
tgtgatcttgctctatct

SEQ ID NO: 3767806 - DNA, 14 bp, Homo sapiens
tgtgatgaggggag

SEQ ID NO: 3767807 - DNA, 17 bp, Homo sapiens
tgtgatgccacacagag

SEQ ID NO: 3767808 - DNA, 13 bp, Homo sapiens
tgtgcaaaaattt

SEQ ID NO: 3767809 - DNA, 17 bp, Homo sapiens
tgtgcaaaaatttttgg

SEQ ID NO: 3767810 - DNA, 14 bp, Homo sapiens
tgtgcaacagacaa

SEQ ID NO: 3767811 - DNA, 18 bp, Homo sapiens
tgtgcaagtatgtgagtg

SEQ ID NO: 3767812 - DNA, 15 bp, Homo sapiens
tgtgcaagtgtctgt

SEQ ID NO: 3767813 - DNA, 20 bp, Homo sapiens
tgtgcaagtgtctgtgtgca

SEQ ID NO: 3767814 - DNA, 16 bp, Homo sapiens
tgtgcacatgcacgtg

SEQ ID NO: 3767815 - DNA, 21 bp, Homo sapiens
tgtgcacgagtgggaaggact

SEQ ID NO: 3767816 - DNA, 14 bp, Homo sapiens
tgtgcacgtacaca

SEQ ID NO: 3767817 - DNA, 17 bp, Homo sapiens
tgtgcacttatttatga

SEQ ID NO: 3767818 - DNA, 18 bp, Homo sapiens
tgtgcagactcaataaaa

SEQ ID NO: 3767819 - DNA, 22 bp, Homo sapiens
tgtgcagactcaataaaatcat

SEQ ID NO: 3767820 - DNA, 13 bp, Homo sapiens
tgtgcatgggtga

SEQ ID NO: 3767821 - DNA, 16 bp, Homo sapiens
tgtgccacccaccagg

SEQ ID NO: 3767822 - DNA, 12 bp, Homo sapiens
tgtgccatgtgc

SEQ ID NO: 3767823 - DNA, 14 bp, Homo sapiens
tgtgcccagctcag

SEQ ID NO: 3767824 - DNA, 17 bp, Homo sapiens
tgtgcctatagtcccag

SEQ ID NO: 3767825 - DNA, 20 bp, Homo sapiens
tgtgcctatagtcccagcta

SEQ ID NO: 3767826 - DNA, 15 bp, Homo sapiens
tgtgcctcctcaccc

SEQ ID NO: 3767827 - DNA, 13 bp, Homo sapiens
tgtgcctctgcct

SEQ ID NO: 3767828 - DNA, 16 bp, Homo sapiens
tgtgcctgcaccagga

SEQ ID NO: 3767829 - DNA, 18 bp, Homo sapiens
tgtgcctgcaccaggaga

SEQ ID NO: 3767830 - DNA, 17 bp, Homo sapiens
tgtgcctggagctcctg

SEQ ID NO: 3767831 - DNA, 14 bp, Homo sapiens
tgtgcgcctacagg

SEQ ID NO: 3767832 - DNA, 15 bp, Homo sapiens
tgtgcggtgcataca

SEQ ID NO: 3767833 - DNA, 13 bp, Homo sapiens
tgtgcgtgaaaca

SEQ ID NO: 3767834 - DNA, 15 bp, Homo sapiens
tgtgcgtgcatgtgc

SEQ ID NO: 3767835 - DNA, 12 bp, Homo sapiens
tgtgctctgatc

SEQ ID NO: 3767836 - DNA, 22 bp, Homo sapiens
tgtgctctgatcatccactgtg

SEQ ID NO: 3767837 - DNA, 16 bp, Homo sapiens
tgtgctctggacaggc

SEQ ID NO: 3767838 - DNA, 20 bp, Homo sapiens
tgtgctgcccgtcttcagcc

SEQ ID NO: 3767839 - DNA, 16 bp, Homo sapiens
tgtggaaaaatattta

SEQ ID NO: 3767840 - DNA, 15 bp, Homo sapiens
tgtggaaagcctctg

SEQ ID NO: 3767841 - DNA, 17 bp, Homo sapiens
tgtggaaagcctctgct

SEQ ID NO: 3767842 - DNA, 19 bp, Homo sapiens
tgtggaaagtgaatttgaa

SEQ ID NO: 3767843 - DNA, 23 bp, Homo sapiens
tgtggaaagtgaatttgaatgaa

SEQ ID NO: 3767844 - DNA, 13 bp, Homo sapiens
tgtggacacagct

SEQ ID NO: 3767845 - DNA, 15 bp, Homo sapiens
tgtggacacagctct

SEQ ID NO: 3767846 - DNA, 19 bp, Homo sapiens
tgtggacacagctcttctc

SEQ ID NO: 3767847 - DNA, 15 bp, Homo sapiens
tgtggactgtgatgc

SEQ ID NO: 3767848 - DNA, 19 bp, Homo sapiens
tgtggagagtgcaacagta

SEQ ID NO: 3767849 - DNA, 20 bp, Homo sapiens
tgtggagcacaaaagcctct

SEQ ID NO: 3767850 - DNA, 14 bp, Homo sapiens
tgtggcacattttt

SEQ ID NO: 3767851 - DNA, 19 bp, Homo sapiens
tgtggcagtaaagagaaac

SEQ ID NO: 3767852 - DNA, 21 bp, Homo sapiens
tgtggcagtaaagagaaactt

SEQ ID NO: 3767853 - DNA, 21 bp, Homo sapiens
tgtggcatctttgccttgggc

SEQ ID NO: 3767854 - DNA, 16 bp, Homo sapiens
tgtggccaaaggaggg

SEQ ID NO: 3767855 - DNA, 11 bp, Homo sapiens
tgtggcctcag

SEQ ID NO: 3767856 - DNA, 10 bp, Homo sapiens
tgtggctcac

SEQ ID NO: 3767857 - DNA, 23 bp, Homo sapiens
tgtggctcccctctatttagcat

SEQ ID NO: 3767858 - DNA, 18 bp, Homo sapiens
tgtggctgggggcaggag

SEQ ID NO: 3767859 - DNA, 19 bp, Homo sapiens
tgtggctgtcagcaggaag

SEQ ID NO: 3767860 - DNA, 19 bp, Homo sapiens
tgtggcttgctagctatgt

SEQ ID NO: 3767861 - DNA, 15 bp, Homo sapiens
tgtgggaagggagag

SEQ ID NO: 3767862 - DNA, 21 bp, Homo sapiens
tgtgggactgtacacacttta

SEQ ID NO: 3767863 - DNA, 21 bp, Homo sapiens
tgtgggcctcaaggacttgaa

SEQ ID NO: 3767864 - DNA, 16 bp, Homo sapiens
tgtggggatttctccc

SEQ ID NO: 3767865 - DNA, 12 bp, Homo sapiens
tgtggggccttg

SEQ ID NO: 3767866 - DNA, 21 bp, Homo sapiens
tgtgggtacagagaggtcaag

SEQ ID NO: 3767867 - DNA, 13 bp, Homo sapiens
tgtgggtgagcca

SEQ ID NO: 3767868 - DNA, 19 bp, Homo sapiens
tgtggtgaggttgggcagc

SEQ ID NO: 3767869 - DNA, 14 bp, Homo sapiens
tgtggttaatgcca

SEQ ID NO: 3767870 - DNA, 21 bp, Homo sapiens
tgtggttacagtgcagacagg

SEQ ID NO: 3767871 - DNA, 18 bp, Homo sapiens
tgtggttatttttataca

SEQ ID NO: 3767872 - DNA, 15 bp, Homo sapiens
tgtggtttagtgtaa

SEQ ID NO: 3767873 - DNA, 16 bp, Homo sapiens
ttagctgtgtgaaata

SEQ ID NO: 3767874 - DNA, 21 bp, Homo sapiens
ttagctgttatttctattttt

SEQ ID NO: 3767875 - DNA, 16 bp, Homo sapiens
ttagcttagacctcag

SEQ ID NO: 3767876 - DNA, 11 bp, Homo sapiens
ttaggaaataa

SEQ ID NO: 3767877 - DNA, 20 bp, Homo sapiens
ttaggaaataaaacctttca

SEQ ID NO: 3767878 - DNA, 21 bp, Homo sapiens
ttaggagagaaggtaggggtt

SEQ ID NO: 3767879 - DNA, 21 bp, Homo sapiens
ttaggagttcgagaccagcct

SEQ ID NO: 3767880 - DNA, 13 bp, Homo sapiens
ttaggcagcagct

SEQ ID NO: 3767881 - DNA, 14 bp, Homo sapiens
ttaggcagggaagt

SEQ ID NO: 3767882 - DNA, 17 bp, Homo sapiens
ttaggctgggcccagag

SEQ ID NO: 3767883 - DNA, 16 bp, Homo sapiens
ttagggaagagaaaca

SEQ ID NO: 3767884 - DNA, 12 bp, Homo sapiens
ttagggaggggt

SEQ ID NO: 3767885 - DNA, 13 bp, Homo sapiens
ttaggtcaagaag

SEQ ID NO: 3767886 - DNA, 14 bp, Homo sapiens
ttaggtttaacata

SEQ ID NO: 3767887 - DNA, 19 bp, Homo sapiens
ttaggtttttttgtatagt

SEQ ID NO: 3767888 - DNA, 14 bp, Homo sapiens
ttagtacccacctg

SEQ ID NO: 3767889 - DNA, 18 bp, Homo sapiens
ttagtacccacctgagct

SEQ ID NO: 3767890 - DNA, 15 bp, Homo sapiens
ttagtactatatctg

SEQ ID NO: 3767891 - DNA, 18 bp, Homo sapiens
ttagtactatatctgttt

SEQ ID NO: 3767892 - DNA, 19 bp, Homo sapiens
ttagtactatatctgtttt

SEQ ID NO: 3767893 - DNA, 13 bp, Homo sapiens
ttagtagcatgtt

SEQ ID NO: 3767894 - DNA, 23 bp, Homo sapiens
ttagtatctaacatgtatcccaa

SEQ ID NO: 3767895 - DNA, 16 bp, Homo sapiens
ttagtcatagaagaac

SEQ ID NO: 3767896 - DNA, 14 bp, Homo sapiens
ttagtcttctcata

SEQ ID NO: 3767897 - DNA, 15 bp, Homo sapiens
ttagtgtaaaaatga

SEQ ID NO: 3767898 - DNA, 17 bp, Homo sapiens
ttagtgtaaaaatgaga

SEQ ID NO: 3767899 - DNA, 14 bp, Homo sapiens
ttagtgtcacttac

SEQ ID NO: 3767900 - DNA, 21 bp, Homo sapiens
ttagtgtttgggtatattcat

SEQ ID NO: 3767901 - DNA, 16 bp, Homo sapiens
ttagttcctcattagc

SEQ ID NO: 3767902 - DNA, 14 bp, Homo sapiens
ttagttccttgagt

SEQ ID NO: 3767903 - DNA, 15 bp, Homo sapiens
ttagttctttgttat

SEQ ID NO: 3767904 - DNA, 17 bp, Homo sapiens
ttagtttacaatcagcc

SEQ ID NO: 3767905 - DNA, 14 bp, Homo sapiens
ttagtttctttggg

SEQ ID NO: 3767906 - DNA, 14 bp, Homo sapiens
ttataaaattaaag

SEQ ID NO: 3767907 - DNA, 11 bp, Homo sapiens
ttataaattaa

SEQ ID NO: 3767908 - DNA, 12 bp, Homo sapiens
ttataaattaaa

SEQ ID NO: 3767909 - DNA, 13 bp, Homo sapiens
ttataaattaaat

SEQ ID NO: 3767910 - DNA, 18 bp, Homo sapiens
ttataaattaaatatatg

SEQ ID NO: 3767911 - DNA, 18 bp, Homo sapiens
ttataactcatcataaaa

SEQ ID NO: 3767912 - DNA, 18 bp, Homo sapiens
ttataactgaaggagaag

SEQ ID NO: 3767913 - DNA, 22 bp, Homo sapiens
ttataaggactgcatggtaatt

SEQ ID NO: 3767914 - DNA, 20 bp, Homo sapiens
ttataatcttccatacttct

SEQ ID NO: 3767915 - DNA, 21 bp, Homo sapiens
ttatacaggggaatattttat

SEQ ID NO: 3767916 - DNA, 18 bp, Homo sapiens
ttatacagttttaaagaa

SEQ ID NO: 3767917 - DNA, 19 bp, Homo sapiens
ttatacagttttaaagaat

SEQ ID NO: 3767918 - DNA, 23 bp, Homo sapiens
ttatacatgacactgaaatgcct

SEQ ID NO: 3767919 - DNA, 14 bp, Homo sapiens
ttatagaaagttca

SEQ ID NO: 3767920 - DNA, 15 bp, Homo sapiens
ttatagacaaataat

SEQ ID NO: 3767921 - DNA, 16 bp, Homo sapiens
ttatagccgaaatgat

SEQ ID NO: 3767922 - DNA, 17 bp, Homo sapiens
ttataggtcactcctgg

SEQ ID NO: 3767923 - DNA, 20 bp, Homo sapiens
ttatagtggtgttttaaaga

SEQ ID NO: 3767924 - DNA, 22 bp, Homo sapiens
ttatataaagagaaaattgaat

SEQ ID NO: 3767925 - DNA, 16 bp, Homo sapiens
ttatataattatgtta

SEQ ID NO: 3767926 - DNA, 14 bp, Homo sapiens
ttatatagcttgaa

SEQ ID NO: 3767927 - DNA, 15 bp, Homo sapiens
ttatatatttataac

SEQ ID NO: 3767928 - DNA, 19 bp, Homo sapiens
ttatatcagtcctctttca

SEQ ID NO: 3767929 - DNA, 15 bp, Homo sapiens
ttatatgtatccagt

SEQ ID NO: 3767930 - DNA, 21 bp, Homo sapiens
ttatatgtatccagtacattt

SEQ ID NO: 3767931 - DNA, 19 bp, Homo sapiens
ttatattttactactgtgg

SEQ ID NO: 3767932 - DNA, 12 bp, Homo sapiens
ttatattttcaa

SEQ ID NO: 3767933 - DNA, 19 bp, Homo sapiens
ttatatttttaataaaagt

SEQ ID NO: 3767934 - DNA, 13 bp, Homo sapiens
ttatcaagctaat

SEQ ID NO: 3767935 - DNA, 20 bp, Homo sapiens
ttatcaagctaataaaatat

SEQ ID NO: 3767936 - DNA, 19 bp, Homo sapiens
ttatcacacaaagcagaat

SEQ ID NO: 3767937 - DNA, 18 bp, Homo sapiens
ttatcactgacacaaaaa

SEQ ID NO: 3767938 - DNA, 11 bp, Homo sapiens
ttatcatgcaa

SEQ ID NO: 3767939 - DNA, 14 bp, Homo sapiens
ttatccaatcttgt

SEQ ID NO: 3767940 - DNA, 23 bp, Homo sapiens
ttatcccttccttttagcctagt

SEQ ID NO: 3767941 - DNA, 17 bp, Homo sapiens
ttatcctgaaatttcag

SEQ ID NO: 3767942 - DNA, 16 bp, Homo sapiens
ttatcggaagcagtgc

SEQ ID NO: 3767943 - DNA, 19 bp, Homo sapiens
ttatcgggagcagtgtctt

SEQ ID NO: 3767944 - DNA, 23 bp, Homo sapiens
ttatcgggagcagtgtcttccat

SEQ ID NO: 3767945 - DNA, 18 bp, Homo sapiens
ttatctaatcatgaaact

SEQ ID NO: 3767946 - DNA, 21 bp, Homo sapiens
ttatctccccttcacatgcat

SEQ ID NO: 3767947 - DNA, 19 bp, Homo sapiens
ttatctgtgcgtgaaacac

SEQ ID NO: 3767948 - DNA, 17 bp, Homo sapiens
ttatcttgtctctgggc

SEQ ID NO: 3767949 - DNA, 18 bp, Homo sapiens
ttatgaagaaaaaataca

SEQ ID NO: 3767950 - DNA, 17 bp, Homo sapiens
ttatgaatatttataac

SEQ ID NO: 3767951 - DNA, 19 bp, Homo sapiens
ttatgaatatttataacag

SEQ ID NO: 3767952 - DNA, 22 bp, Homo sapiens
ttatgaatatttataacagcat

SEQ ID NO: 3767953 - DNA, 18 bp, Homo sapiens
ttatgagctcatgtagca

SEQ ID NO: 3767954 - DNA, 15 bp, Homo sapiens
ttatgagtttttgat

SEQ ID NO: 3767955 - DNA, 19 bp, Homo sapiens
ttatgataaaaaattttgt

SEQ ID NO: 3767956 - DNA, 21 bp, Homo sapiens
ttatgatatttttttaagtct

SEQ ID NO: 3767957 - DNA, 20 bp, Homo sapiens
ttatgatgtgggtcaaggaa

SEQ ID NO: 3767958 - DNA, 17 bp, Homo sapiens
ttatgcaaggaaggaaa

SEQ ID NO: 3767959 - DNA, 18 bp, Homo sapiens
ttatgcaaggaaggaaag

SEQ ID NO: 3767960 - DNA, 12 bp, Homo sapiens
ttatgcaataaa

SEQ ID NO: 3767961 - DNA, 17 bp, Homo sapiens
ttatgcataactgacaa

SEQ ID NO: 3767962 - DNA, 11 bp, Homo sapiens
ttatgcatctg

SEQ ID NO: 3767963 - DNA, 14 bp, Homo sapiens
ttatgctcagggtc

SEQ ID NO: 3767964 - DNA, 21 bp, Homo sapiens
ttatgctgtattttcttttta

SEQ ID NO: 3767965 - DNA, 22 bp, Homo sapiens
ttatggaagattttaaattcac

SEQ ID NO: 3767966 - DNA, 13 bp, Homo sapiens
ttatggcctcagc

SEQ ID NO: 3767967 - DNA, 18 bp, Homo sapiens
ttatggcctcagctgcct

SEQ ID NO: 3767968 - DNA, 23 bp, Homo sapiens
ttatgggaaccccttcatcctct

SEQ ID NO: 3767969 - DNA, 19 bp, Homo sapiens
ttatgtgtgaggagctgct

SEQ ID NO: 3767970 - DNA, 22 bp, Homo sapiens
ttatgtgtgtatatgtatgtgt

SEQ ID NO: 3767971 - DNA, 16 bp, Homo sapiens
ttatgttttgtttctg

SEQ ID NO: 3767972 - DNA, 19 bp, Homo sapiens
ttattaacaaattatgtta

SEQ ID NO: 3767973 - DNA, 21 bp, Homo sapiens
ttattaagatggattctcaga

SEQ ID NO: 3767974 - DNA, 14 bp, Homo sapiens
ttattaatgctaag

SEQ ID NO: 3767975 - DNA, 16 bp, Homo sapiens
ttattaatgctaaggg

SEQ ID NO: 3767976 - DNA, 19 bp, Homo sapiens
ttattacatccttgtggca

SEQ ID NO: 3767977 - DNA, 20 bp, Homo sapiens
ttattacatccttgtggcac

SEQ ID NO: 3767978 - DNA, 12 bp, Homo sapiens
ttattacatctt

SEQ ID NO: 3767979 - DNA, 18 bp, Homo sapiens
ttattacatctttcacat

SEQ ID NO: 3767980 - DNA, 18 bp, Homo sapiens
ttattacccttctttcca

SEQ ID NO: 3767981 - DNA, 13 bp, Homo sapiens
ttattacctctga

SEQ ID NO: 3767982 - DNA, 20 bp, Homo sapiens
ttattagtaagaaaacatca

SEQ ID NO: 3767983 - DNA, 15 bp, Homo sapiens
ttattcaaggtaaaa

SEQ ID NO: 3767984 - DNA, 19 bp, Homo sapiens
ttattcaccatgtaaaaca

SEQ ID NO: 3767985 - DNA, 22 bp, Homo sapiens
ttattcctatatagtttattga

SEQ ID NO: 3767986 - DNA, 17 bp, Homo sapiens
ttcccccacttttctct

SEQ ID NO: 3767987 - DNA, 20 bp, Homo sapiens
ttcccccagccctgtggaag

SEQ ID NO: 3767988 - DNA, 21 bp, Homo sapiens
ttcccccagtacctccaagca

SEQ ID NO: 3767989 - DNA, 21 bp, Homo sapiens
ttccccccactctccccacac

SEQ ID NO: 3767990 - DNA, 19 bp, Homo sapiens
ttccccctccaatcccacc

SEQ ID NO: 3767991 - DNA, 14 bp, Homo sapiens
ttccccctctccca

SEQ ID NO: 3767992 - DNA, 17 bp, Homo sapiens
ttccccctctcccagtt

SEQ ID NO: 3767993 - DNA, 16 bp, Homo sapiens
ttccccggtcccttga

SEQ ID NO: 3767994 - DNA, 17 bp, Homo sapiens
ttccccggtcccttgag

SEQ ID NO: 3767995 - DNA, 19 bp, Homo sapiens
ttcccctaacctcattccc

SEQ ID NO: 3767996 - DNA, 17 bp, Homo sapiens
ttcccctgttcactcta

SEQ ID NO: 3767997 - DNA, 22 bp, Homo sapiens
ttccccttgcccagggctcagc

SEQ ID NO: 3767998 - DNA, 23 bp, Homo sapiens
ttccccttgcccagggctcagcc

SEQ ID NO: 3767999 - DNA, 16 bp, Homo sapiens
ttcccgctcagccctc

SEQ ID NO: 3768000 - DNA, 18 bp, Homo sapiens
ttcccgctcagccctccc

SEQ ID NO: 3768001 - DNA, 14 bp, Homo sapiens
ttccctacctcagg

SEQ ID NO: 3768002 - DNA, 13 bp, Homo sapiens
ttccctacttcct

SEQ ID NO: 3768003 - DNA, 17 bp, Homo sapiens
ttccctacttcctgtga

SEQ ID NO: 3768004 - DNA, 15 bp, Homo sapiens
ttccctattagagaa

SEQ ID NO: 3768005 - DNA, 22 bp, Homo sapiens
ttccctcaaagcttccattcca

SEQ ID NO: 3768006 - DNA, 20 bp, Homo sapiens
ttccctcacctttcccatct

SEQ ID NO: 3768007 - DNA, 13 bp, Homo sapiens
ttccctctgcctg

SEQ ID NO: 3768008 - DNA, 21 bp, Homo sapiens
ttccctctgcctgtccctctc

SEQ ID NO: 3768009 - DNA, 23 bp, Homo sapiens
ttccctgaaaacctcacatgcat

SEQ ID NO: 3768010 - DNA, 15 bp, Homo sapiens
ttccctgaatgtatt

SEQ ID NO: 3768011 - DNA, 16 bp, Homo sapiens
ttccctgagtcaccag

SEQ ID NO: 3768012 - DNA, 18 bp, Homo sapiens
ttccctgagtcaccagga

SEQ ID NO: 3768013 - DNA, 17 bp, Homo sapiens
ttccctgcttaatgaaa

SEQ ID NO: 3768014 - DNA, 12 bp, Homo sapiens
ttccctggacca

SEQ ID NO: 3768015 - DNA, 19 bp, Homo sapiens
ttccctggaccagatgctg

SEQ ID NO: 3768016 - DNA, 17 bp, Homo sapiens
ttcccttctccttccaa

SEQ ID NO: 3768017 - DNA, 15 bp, Homo sapiens
ttcccttgagccctc

SEQ ID NO: 3768018 - DNA, 16 bp, Homo sapiens
ttcccttggcctcaga

SEQ ID NO: 3768019 - DNA, 21 bp, Homo sapiens
ttccctttagcacgtttaaag

SEQ ID NO: 3768020 - DNA, 15 bp, Homo sapiens
ttccctttccttcca

SEQ ID NO: 3768021 - DNA, 20 bp, Homo sapiens
ttccgacaaccgatgctcca

SEQ ID NO: 3768022 - DNA, 23 bp, Homo sapiens
ttccgacaaccgatgctccagcc

SEQ ID NO: 3768023 - DNA, 14 bp, Homo sapiens
ttcctaaatgcagt

SEQ ID NO: 3768024 - DNA, 16 bp, Homo sapiens
ttcctaaatgcagtga

SEQ ID NO: 3768025 - DNA, 22 bp, Homo sapiens
ttcctacaagagcagcctgtgg

SEQ ID NO: 3768026 - DNA, 15 bp, Homo sapiens
ttcctagttttctcc

SEQ ID NO: 3768027 - DNA, 22 bp, Homo sapiens
ttcctatatagtttattgacaa

SEQ ID NO: 3768028 - DNA, 17 bp, Homo sapiens
ttcctatcccatcccat

SEQ ID NO: 3768029 - DNA, 16 bp, Homo sapiens
ttcctcattcctgaaa

SEQ ID NO: 3768030 - DNA, 12 bp, Homo sapiens
ttcctccccagc

SEQ ID NO: 3768031 - DNA, 14 bp, Homo sapiens
ttcctccccagcag

SEQ ID NO: 3768032 - DNA, 23 bp, Homo sapiens
ttcctccccattagagtcagcct

SEQ ID NO: 3768033 - DNA, 12 bp, Homo sapiens
ttcctccctccc

SEQ ID NO: 3768034 - DNA, 19 bp, Homo sapiens
ttcctccctccctctttcc

SEQ ID NO: 3768035 - DNA, 22 bp, Homo sapiens
ttcctccctccctctttccctc

SEQ ID NO: 3768036 - DNA, 13 bp, Homo sapiens
ttcctctttccat

SEQ ID NO: 3768037 - DNA, 12 bp, Homo sapiens
ttcctgaaagaa

SEQ ID NO: 3768038 - DNA, 15 bp, Homo sapiens
ttcctgaaatgcagt

SEQ ID NO: 3768039 - DNA, 17 bp, Homo sapiens
ttcctgatgacccaggc

SEQ ID NO: 3768040 - DNA, 18 bp, Homo sapiens
ttcctgatgacccaggct

SEQ ID NO: 3768041 - DNA, 21 bp, Homo sapiens
ttcctgcagcagagcctggaa

SEQ ID NO: 3768042 - DNA, 14 bp, Homo sapiens
ttcctgcagcctgg

SEQ ID NO: 3768043 - DNA, 16 bp, Homo sapiens
ttcctgctagaaatgg

SEQ ID NO: 3768044 - DNA, 19 bp, Homo sapiens
ttcctggagagtctcactc

SEQ ID NO: 3768045 - DNA, 14 bp, Homo sapiens
ttcctggagcccga

SEQ ID NO: 3768046 - DNA, 15 bp, Homo sapiens
ttcctggcaatagtg

SEQ ID NO: 3768047 - DNA, 15 bp, Homo sapiens
ttcctggggtgccct

SEQ ID NO: 3768048 - DNA, 22 bp, Homo sapiens
ttcctggggtgccctccactgc

SEQ ID NO: 3768049 - DNA, 16 bp, Homo sapiens
ttccttaaactgtgtg

SEQ ID NO: 3768050 - DNA, 14 bp, Homo sapiens
ttccttagcattgt

SEQ ID NO: 3768051 - DNA, 23 bp, Homo sapiens
ttccttatgtatatttaaaagaa

SEQ ID NO: 3768052 - DNA, 17 bp, Homo sapiens
ttccttcacatcctgtg

SEQ ID NO: 3768053 - DNA, 15 bp, Homo sapiens
ttccttcagcttcca

SEQ ID NO: 3768054 - DNA, 14 bp, Homo sapiens
ttccttctcatctg

SEQ ID NO: 3768055 - DNA, 15 bp, Homo sapiens
ttccttgataatgtt

SEQ ID NO: 3768056 - DNA, 14 bp, Homo sapiens
ttccttggggcagg

SEQ ID NO: 3768057 - DNA, 15 bp, Homo sapiens
ttccttgtatttaaa

SEQ ID NO: 3768058 - DNA, 21 bp, Homo sapiens
ttccttttaaaacacttccat

SEQ ID NO: 3768059 - DNA, 20 bp, Homo sapiens
ttcgatgggcccaattctta

SEQ ID NO: 3768060 - DNA, 21 bp, Homo sapiens
ttcgatgggcccaattcttac

SEQ ID NO: 3768061 - DNA, 19 bp, Homo sapiens
ttcgctcctgtgtcttgca

SEQ ID NO: 3768062 - DNA, 18 bp, Homo sapiens
ttcgtgaagtatactgta

SEQ ID NO: 3768063 - DNA, 22 bp, Homo sapiens
ttcgtggtgatcaattaaatgt

SEQ ID NO: 3768064 - DNA, 19 bp, Homo sapiens
ttcgttaactgtgtatgta

SEQ ID NO: 3768065 - DNA, 11 bp, Homo sapiens
ttcgtttgttt

SEQ ID NO: 3768066 - DNA, 13 bp, Homo sapiens
ttctaaaaaacag

SEQ ID NO: 3768067 - DNA, 22 bp, Homo sapiens
ttctaaataaaatataattgtt

SEQ ID NO: 3768068 - DNA, 23 bp, Homo sapiens
ttctaaataaaatataattgttt

SEQ ID NO: 3768069 - DNA, 13 bp, Homo sapiens
ttctaaatagcaa

SEQ ID NO: 3768070 - DNA, 12 bp, Homo sapiens
ttctaaatgaat

SEQ ID NO: 3768071 - DNA, 15 bp, Homo sapiens
ttctaaatgaatgtt

SEQ ID NO: 3768072 - DNA, 20 bp, Homo sapiens
ttctaaatgcatatcctgag

SEQ ID NO: 3768073 - DNA, 17 bp, Homo sapiens
ttctaactctgatgtaa

SEQ ID NO: 3768074 - DNA, 15 bp, Homo sapiens
ttctaataaaacaaa

SEQ ID NO: 3768075 - DNA, 13 bp, Homo sapiens
ttctaatctgcta

SEQ ID NO: 3768076 - DNA, 15 bp, Homo sapiens
ttctaatctgctatg

SEQ ID NO: 3768077 - DNA, 15 bp, Homo sapiens
ttctaattgccatgt

SEQ ID NO: 3768078 - DNA, 17 bp, Homo sapiens
ttctacactctcctggg

SEQ ID NO: 3768079 - DNA, 16 bp, Homo sapiens
ttctacagcaaattta

SEQ ID NO: 3768080 - DNA, 17 bp, Homo sapiens
ttctacagcaaatttat

SEQ ID NO: 3768081 - DNA, 20 bp, Homo sapiens
ttctacagcaaatttataat

SEQ ID NO: 3768082 - DNA, 18 bp, Homo sapiens
ttctaccatttcagagag

SEQ ID NO: 3768083 - DNA, 13 bp, Homo sapiens
ttctactgcttct

SEQ ID NO: 3768084 - DNA, 21 bp, Homo sapiens
ttctagagagggaattctctt

SEQ ID NO: 3768085 - DNA, 17 bp, Homo sapiens
ttctagttgaggagttt

SEQ ID NO: 3768086 - DNA, 20 bp, Homo sapiens
ttctagttgaggagtttcct

SEQ ID NO: 3768087 - DNA, 14 bp, Homo sapiens
ttctattaaaagtg

SEQ ID NO: 3768088 - DNA, 17 bp, Homo sapiens
ttctattctctcctcag

SEQ ID NO: 3768089 - DNA, 16 bp, Homo sapiens
ttctatttaagtgtac

SEQ ID NO: 3768090 - DNA, 14 bp, Homo sapiens
ttctcaagccctgc

SEQ ID NO: 3768091 - DNA, 23 bp, Homo sapiens
ttctcaagccgcatcccagactt

SEQ ID NO: 3768092 - DNA, 19 bp, Homo sapiens
ttctcacagtgggagccag

SEQ ID NO: 3768093 - DNA, 15 bp, Homo sapiens
ttctcactccaccac

SEQ ID NO: 3768094 - DNA, 16 bp, Homo sapiens
ttctcactccaccacc

SEQ ID NO: 3768095 - DNA, 21 bp, Homo sapiens
ttctcactgccatgccagctt

SEQ ID NO: 3768096 - DNA, 13 bp, Homo sapiens
ttctcagaatctc

SEQ ID NO: 3768097 - DNA, 22 bp, Homo sapiens
ttctcagaatctcaaataacta

SEQ ID NO: 3768098 - DNA, 16 bp, Homo sapiens
ttctcatagccccggt

SEQ ID NO: 3768099 - DNA, 15 bp, Homo sapiens
ttgtagagccagggt

SEQ ID NO: 3768100 - DNA, 12 bp, Homo sapiens
ttgtataaaaat

SEQ ID NO: 3768101 - DNA, 20 bp, Homo sapiens
ttgtataaaaatagaagaat

SEQ ID NO: 3768102 - DNA, 20 bp, Homo sapiens
ttgtataccttgtaatttga

SEQ ID NO: 3768103 - DNA, 15 bp, Homo sapiens
ttgtatagtaaagtg

SEQ ID NO: 3768104 - DNA, 16 bp, Homo sapiens
ttgtatattgtcagat

SEQ ID NO: 3768105 - DNA, 19 bp, Homo sapiens
ttgtatattgtcagatatt

SEQ ID NO: 3768106 - DNA, 20 bp, Homo sapiens
ttgtatctagtgcagctgat

SEQ ID NO: 3768107 - DNA, 16 bp, Homo sapiens
ttgtattaaagacaga

SEQ ID NO: 3768108 - DNA, 20 bp, Homo sapiens
ttgtattttatttttttctc

SEQ ID NO: 3768109 - DNA, 20 bp, Homo sapiens
ttgtcaagtctctgctggcc

SEQ ID NO: 3768110 - DNA, 13 bp, Homo sapiens
ttgtcacaataaa

SEQ ID NO: 3768111 - DNA, 23 bp, Homo sapiens
ttgtcacaatcctaacacattat

SEQ ID NO: 3768112 - DNA, 17 bp, Homo sapiens
ttgtcacacactttggc

SEQ ID NO: 3768113 - DNA, 17 bp, Homo sapiens
ttgtcacagaaatcaga

SEQ ID NO: 3768114 - DNA, 12 bp, Homo sapiens
ttgtcagacttt

SEQ ID NO: 3768115 - DNA, 21 bp, Homo sapiens
ttgtcatataagattcatatt

SEQ ID NO: 3768116 - DNA, 19 bp, Homo sapiens
ttgtcatctttcttctatt

SEQ ID NO: 3768117 - DNA, 21 bp, Homo sapiens
ttgtcatctttcttctatttt

SEQ ID NO: 3768118 - DNA, 13 bp, Homo sapiens
ttgtcattttgaa

SEQ ID NO: 3768119 - DNA, 15 bp, Homo sapiens
ttgtcattttgaagc

SEQ ID NO: 3768120 - DNA, 14 bp, Homo sapiens
ttgtcccacagctt

SEQ ID NO: 3768121 - DNA, 20 bp, Homo sapiens
ttgtcccactcaagccaagc

SEQ ID NO: 3768122 - DNA, 14 bp, Homo sapiens
ttgtctatgggact

SEQ ID NO: 3768123 - DNA, 13 bp, Homo sapiens
ttgtctcagagca

SEQ ID NO: 3768124 - DNA, 19 bp, Homo sapiens
ttgtctctatgccagctca

SEQ ID NO: 3768125 - DNA, 20 bp, Homo sapiens
ttgtctgaagtcactgcaca

SEQ ID NO: 3768126 - DNA, 16 bp, Homo sapiens
ttgtctttatatgaac

SEQ ID NO: 3768127 - DNA, 23 bp, Homo sapiens
ttgtctttgtaatgtcaccacct

SEQ ID NO: 3768128 - DNA, 19 bp, Homo sapiens
ttgtgaagaaaaataaagt

SEQ ID NO: 3768129 - DNA, 17 bp, Homo sapiens
ttgtgaagatgtttgca

SEQ ID NO: 3768130 - DNA, 22 bp, Homo sapiens
ttgtgactagtgctgaagctta

SEQ ID NO: 3768131 - DNA, 11 bp, Homo sapiens
ttgtgagagcg

SEQ ID NO: 3768132 - DNA, 20 bp, Homo sapiens
ttgtgaggcccatggttgag

SEQ ID NO: 3768133 - DNA, 14 bp, Homo sapiens
ttgtgatcttgctc

SEQ ID NO: 3768134 - DNA, 18 bp, Homo sapiens
ttgtgatgtcccaacttg

SEQ ID NO: 3768135 - DNA, 11 bp, Homo sapiens
ttgtgcagaga

SEQ ID NO: 3768136 - DNA, 13 bp, Homo sapiens
ttgtggcctcaga

SEQ ID NO: 3768137 - DNA, 13 bp, Homo sapiens
ttgtggcctggga

SEQ ID NO: 3768138 - DNA, 14 bp, Homo sapiens
ttgtggttattttt

SEQ ID NO: 3768139 - DNA, 13 bp, Homo sapiens
ttgtggtttgttg

SEQ ID NO: 3768140 - DNA, 20 bp, Homo sapiens
ttgtgtaagagaatgttgaa

SEQ ID NO: 3768141 - DNA, 22 bp, Homo sapiens
ttgtgtaataaagtgttttcag

SEQ ID NO: 3768142 - DNA, 15 bp, Homo sapiens
ttgtgtacagtgtgt

SEQ ID NO: 3768143 - DNA, 17 bp, Homo sapiens
ttgtgtactctggcctc

SEQ ID NO: 3768144 - DNA, 18 bp, Homo sapiens
ttgtgtactctggcctct

SEQ ID NO: 3768145 - DNA, 21 bp, Homo sapiens
ttgtgtttttaatttatttat

SEQ ID NO: 3768146 - DNA, 14 bp, Homo sapiens
ttgttaactttggg

SEQ ID NO: 3768147 - DNA, 15 bp, Homo sapiens
ttgttaatattcttt

SEQ ID NO: 3768148 - DNA, 19 bp, Homo sapiens
ttgttaatgaaaatgtcag

SEQ ID NO: 3768149 - DNA, 19 bp, Homo sapiens
ttgttaatggtttgaatat

SEQ ID NO: 3768150 - DNA, 22 bp, Homo sapiens
ttgttattacatccttgtggca

SEQ ID NO: 3768151 - DNA, 14 bp, Homo sapiens
ttgttattatataa

SEQ ID NO: 3768152 - DNA, 20 bp, Homo sapiens
ttgttcctaagttcttagat

SEQ ID NO: 3768153 - DNA, 18 bp, Homo sapiens
ttgttctctctatggtaa

SEQ ID NO: 3768154 - DNA, 20 bp, Homo sapiens
ttgttgataaattccactgg

SEQ ID NO: 3768155 - DNA, 21 bp, Homo sapiens
ttgttgataaattccactgga

SEQ ID NO: 3768156 - DNA, 19 bp, Homo sapiens
ttgttgcaagtactgctgt

SEQ ID NO: 3768157 - DNA, 21 bp, Homo sapiens
ttgttgttaatgaaaatgtca

SEQ ID NO: 3768158 - DNA, 23 bp, Homo sapiens
ttgtttaacataaattgtactgt

SEQ ID NO: 3768159 - DNA, 13 bp, Homo sapiens
ttgtttatcagca

SEQ ID NO: 3768160 - DNA, 17 bp, Homo sapiens
ttgtttatttttatata

SEQ ID NO: 3768161 - DNA, 12 bp, Homo sapiens
ttgtttctgaaa

SEQ ID NO: 3768162 - DNA, 12 bp, Homo sapiens
ttgtttcttcca

SEQ ID NO: 3768163 - DNA, 15 bp, Homo sapiens
ttgtttcttccaaag

SEQ ID NO: 3768164 - DNA, 23 bp, Homo sapiens
ttgtttggatcaaaatctgtaga

SEQ ID NO: 3768165 - DNA, 20 bp, Homo sapiens
ttgtttggggatgagaaagg

SEQ ID NO: 3768166 - DNA, 21 bp, Homo sapiens
ttgtttgggtatcctgcccag

SEQ ID NO: 3768167 - DNA, 16 bp, Homo sapiens
ttgttttcagtgtaca

SEQ ID NO: 3768168 - DNA, 13 bp, Homo sapiens
ttgtttttccttg

SEQ ID NO: 3768169 - DNA, 21 bp, Homo sapiens
ttgtttttccttgtatttaaa

SEQ ID NO: 3768170 - DNA, 21 bp, Homo sapiens
ttgttttttaaagtcttgctg

SEQ ID NO: 3768171 - DNA, 14 bp, Homo sapiens
ttgttttttagttc

SEQ ID NO: 3768172 - DNA, 13 bp, Homo sapiens
tttaaaaaagttt

SEQ ID NO: 3768173 - DNA, 18 bp, Homo sapiens
tttaaaaaagtttaaaat

SEQ ID NO: 3768174 - DNA, 21 bp, Homo sapiens
tttaaaaaagtttaaaatgta

SEQ ID NO: 3768175 - DNA, 23 bp, Homo sapiens
tttaaaaatacagatagatatat

SEQ ID NO: 3768176 - DNA, 16 bp, Homo sapiens
tttaaaaatcataaac

SEQ ID NO: 3768177 - DNA, 20 bp, Homo sapiens
tttaaaacaagaaagtttcc

SEQ ID NO: 3768178 - DNA, 18 bp, Homo sapiens
tttaaaatcactaacatt

SEQ ID NO: 3768179 - DNA, 17 bp, Homo sapiens
tttaaaattttatctct

SEQ ID NO: 3768180 - DNA, 16 bp, Homo sapiens
tttaaaggggcagaaa

SEQ ID NO: 3768181 - DNA, 16 bp, Homo sapiens
tttaaatatattttca

SEQ ID NO: 3768182 - DNA, 12 bp, Homo sapiens
tttaaatcctgt

SEQ ID NO: 3768183 - DNA, 20 bp, Homo sapiens
tttaaatcctgttgaaaagc

SEQ ID NO: 3768184 - DNA, 18 bp, Homo sapiens
tttaaatgcataaatgca

SEQ ID NO: 3768185 - DNA, 20 bp, Homo sapiens
tttaaattataacttaaaat

SEQ ID NO: 3768186 - DNA, 15 bp, Homo sapiens
tttaaattataagga

SEQ ID NO: 3768187 - DNA, 16 bp, Homo sapiens
tttaaattataaggac

SEQ ID NO: 3768188 - DNA, 18 bp, Homo sapiens
tttaaattataaggactg

SEQ ID NO: 3768189 - DNA, 19 bp, Homo sapiens
tttaaattcacaatagaaa

SEQ ID NO: 3768190 - DNA, 21 bp, Homo sapiens
tttaaattttcttcagttggt

SEQ ID NO: 3768191 - DNA, 22 bp, Homo sapiens
tttaaattttcttcagttggtg

SEQ ID NO: 3768192 - DNA, 20 bp, Homo sapiens
tttaacaataactactgtgt

SEQ ID NO: 3768193 - DNA, 23 bp, Homo sapiens
tttaacaataactactgtgttcc

SEQ ID NO: 3768194 - DNA, 14 bp, Homo sapiens
tttaacaatgcgaa

SEQ ID NO: 3768195 - DNA, 18 bp, Homo sapiens
tttaacaatgcgaatggt

SEQ ID NO: 3768196 - DNA, 17 bp, Homo sapiens
tttaactagaatttatt

SEQ ID NO: 3768197 - DNA, 24 bp, Homo sapiens
tttaactcaatattttccatgaaa

SEQ ID NO: 3768198 - DNA, 19 bp, Homo sapiens
tttaactttatcacattat

SEQ ID NO: 3768199 - DNA, 16 bp, Homo sapiens
tttaagaaaatacaat

SEQ ID NO: 3768200 - DNA, 22 bp, Homo sapiens
tttaagaaaatacaataaacta

SEQ ID NO: 3768201 - DNA, 17 bp, Homo sapiens
tttaagattccttttct

SEQ ID NO: 3768202 - DNA, 22 bp, Homo sapiens
tttaagattccttttcttgttt

SEQ ID NO: 3768203 - DNA, 11 bp, Homo sapiens
tttaagattta

SEQ ID NO: 3768204 - DNA, 20 bp, Homo sapiens
tttaagcattactcttgtaa

SEQ ID NO: 3768205 - DNA, 21 bp, Homo sapiens
tttaagcattactcttgtaag

SEQ ID NO: 3768206 - DNA, 21 bp, Homo sapiens
tttaagcattgtttgcttatt

SEQ ID NO: 3768207 - DNA, 23 bp, Homo sapiens
tttaagcattgtttgcttattgt

SEQ ID NO: 3768208 - DNA, 11 bp, Homo sapiens
tttaagctgtt

SEQ ID NO: 3768209 - DNA, 18 bp, Homo sapiens
tttaagctgtttccatag

SEQ ID NO: 3768210 - DNA, 15 bp, Homo sapiens
tttaaggaagaaaaa

SEQ ID NO: 3768211 - DNA, 16 bp, Homo sapiens
tttaaggaagaaaaat

SEQ ID NO: 3768212 - DNA, 20 bp, Homo sapiens
ttttcagtttcaattcagtg

SEQ ID NO: 3768213 - DNA, 12 bp, Homo sapiens
ttttcataataa

SEQ ID NO: 3768214 - DNA, 21 bp, Homo sapiens
ttttcattccatgtgcccagt

SEQ ID NO: 3768215 - DNA, 22 bp, Homo sapiens
ttttccacaagattcccagaga

SEQ ID NO: 3768216 - DNA, 19 bp, Homo sapiens
ttttccatgaaaatgcaac

SEQ ID NO: 3768217 - DNA, 20 bp, Homo sapiens
ttttcccagatacttcccat

SEQ ID NO: 3768218 - DNA, 18 bp, Homo sapiens
ttttccccccactctccc

SEQ ID NO: 3768219 - DNA, 18 bp, Homo sapiens
ttttccctattagagaag

SEQ ID NO: 3768220 - DNA, 15 bp, Homo sapiens
ttttcctaaatgtat

SEQ ID NO: 3768221 - DNA, 17 bp, Homo sapiens
ttttcctagccctctca

SEQ ID NO: 3768222 - DNA, 12 bp, Homo sapiens
ttttcctgtgga

SEQ ID NO: 3768223 - DNA, 19 bp, Homo sapiens
ttttcgaagctcagcccac

SEQ ID NO: 3768224 - DNA, 17 bp, Homo sapiens
ttttcgtgcactctgct

SEQ ID NO: 3768225 - DNA, 15 bp, Homo sapiens
ttttctacagcaaat

SEQ ID NO: 3768226 - DNA, 16 bp, Homo sapiens
ttttctacagcaaatt

SEQ ID NO: 3768227 - DNA, 14 bp, Homo sapiens
ttttctcctcccag

SEQ ID NO: 3768228 - DNA, 19 bp, Homo sapiens
ttttctcctcccaggaact

SEQ ID NO: 3768229 - DNA, 14 bp, Homo sapiens
ttttctctttctcc

SEQ ID NO: 3768230 - DNA, 23 bp, Homo sapiens
ttttctgttgaagtttacaatca

SEQ ID NO: 3768231 - DNA, 13 bp, Homo sapiens
ttttcttctccct

SEQ ID NO: 3768232 - DNA, 15 bp, Homo sapiens
ttttcttgtttatca

SEQ ID NO: 3768233 - DNA, 18 bp, Homo sapiens
ttttcttgtttatcagca

SEQ ID NO: 3768234 - DNA, 16 bp, Homo sapiens
ttttctttgtgtagct

SEQ ID NO: 3768235 - DNA, 19 bp, Homo sapiens
ttttctttgtgtagctttg

SEQ ID NO: 3768236 - DNA, 18 bp, Homo sapiens
ttttgaaaactacatttt

SEQ ID NO: 3768237 - DNA, 23 bp, Homo sapiens
ttttgaaaactacattttaacat

SEQ ID NO: 3768238 - DNA, 21 bp, Homo sapiens
ttttgaactaataaaagcata

SEQ ID NO: 3768239 - DNA, 21 bp, Homo sapiens
ttttgaagctaattattttaa

SEQ ID NO: 3768240 - DNA, 16 bp, Homo sapiens
ttttgaatccatgctt

SEQ ID NO: 3768241 - DNA, 18 bp, Homo sapiens
ttttgaatgcttcctgac

SEQ ID NO: 3768242 - DNA, 23 bp, Homo sapiens
ttttgacagtgttgaaaatgttc

SEQ ID NO: 3768243 - DNA, 15 bp, Homo sapiens
ttttgatagctttat

SEQ ID NO: 3768244 - DNA, 22 bp, Homo sapiens
ttttgatttaataacataacaa

SEQ ID NO: 3768245 - DNA, 13 bp, Homo sapiens
ttttgcatttatg

SEQ ID NO: 3768246 - DNA, 23 bp, Homo sapiens
ttttgccatgttggccaggctgg

SEQ ID NO: 3768247 - DNA, 19 bp, Homo sapiens
ttttgctgtttattaaaaa

SEQ ID NO: 3768248 - DNA, 18 bp, Homo sapiens
ttttgctgtttcctttta

SEQ ID NO: 3768249 - DNA, 16 bp, Homo sapiens
ttttggaatctagaag

SEQ ID NO: 3768250 - DNA, 15 bp, Homo sapiens
ttttggccaaagtgt

SEQ ID NO: 3768251 - DNA, 17 bp, Homo sapiens
ttttggtggatgtaaat

SEQ ID NO: 3768252 - DNA, 16 bp, Homo sapiens
ttttgtaaaggtgaaa

SEQ ID NO: 3768253 - DNA, 14 bp, Homo sapiens
ttttgtaattttct

SEQ ID NO: 3768254 - DNA, 17 bp, Homo sapiens
ttttgtaattttcttga

SEQ ID NO: 3768255 - DNA, 22 bp, Homo sapiens
ttttgtgaaatgaaaacatgta

SEQ ID NO: 3768256 - DNA, 21 bp, Homo sapiens
ttttgtgatgtcccaacttgt

SEQ ID NO: 3768257 - DNA, 16 bp, Homo sapiens
ttttgttacctttatg

SEQ ID NO: 3768258 - DNA, 15 bp, Homo sapiens
ttttgttccacaagt

SEQ ID NO: 3768259 - DNA, 14 bp, Homo sapiens
tttttaaaaagcaa

SEQ ID NO: 3768260 - DNA, 20 bp, Homo sapiens
tttttaaattttcttcagtt

SEQ ID NO: 3768261 - DNA, 22 bp, Homo sapiens
tttttaactcaatattttccat

SEQ ID NO: 3768262 - DNA, 18 bp, Homo sapiens
tttttaataaaaaggcac

SEQ ID NO: 3768263 - DNA, 17 bp, Homo sapiens
tttttagatggttacac

SEQ ID NO: 3768264 - DNA, 11 bp, Homo sapiens
tttttatcttt

SEQ ID NO: 3768265 - DNA, 17 bp, Homo sapiens
tttttatcttttctaca

SEQ ID NO: 3768266 - DNA, 21 bp, Homo sapiens
tttttccatcataattctaat

SEQ ID NO: 3768267 - DNA, 14 bp, Homo sapiens
tttttcctgtcctt

SEQ ID NO: 3768268 - DNA, 17 bp, Homo sapiens
tttttccttgtatttaa

SEQ ID NO: 3768269 - DNA, 11 bp, Homo sapiens
tttttcctttt

SEQ ID NO: 3768270 - DNA, 16 bp, Homo sapiens
tttttctttataaact

SEQ ID NO: 3768271 - DNA, 20 bp, Homo sapiens
tttttgtagagccagggtct

SEQ ID NO: 3768272 - DNA, 16 bp, Homo sapiens
tttttgtttgttttgt

SEQ ID NO: 3768273 - DNA, 13 bp, Homo sapiens
ttttttagaacag

SEQ ID NO: 3768274 - DNA, 13 bp, Homo sapiens
ttttttatctttt

SEQ ID NO: 3768275 - DNA, 11 bp, Homo sapiens
ttttttattct

SEQ ID NO: 3768276 - DNA, 11 bp, Homo sapiens
ttttttctacc

SEQ ID NO: 3768277 - DNA, 13 bp, Homo sapiens
tttttttaaaatc

SEQ ID NO: 3768278 - DNA, 14 bp, Homo sapiens
tttttttttaaata

SEQ ID NO: 3768279 - DNA, 16 bp, Homo sapiens
acagacttgagaactt

SEQ ID NO: 3768280 - DNA, 21 bp, Homo sapiens
acagagaaggaatgtctttgg

SEQ ID NO: 3768281 - DNA, 14 bp, Homo sapiens
acagagacacctgc

SEQ ID NO: 3768282 - DNA, 21 bp, Homo sapiens
acagagacacctgcacctccc

SEQ ID NO: 3768283 - DNA, 23 bp, Homo sapiens
acagagacaggcccaagagatga

SEQ ID NO: 3768284 - DNA, 20 bp, Homo sapiens
acagagagacagacttgaga

SEQ ID NO: 3768285 - DNA, 15 bp, Homo sapiens
acagagcaagactct

SEQ ID NO: 3768286 - DNA, 20 bp, Homo sapiens
acagagcgtccttccccctg

SEQ ID NO: 3768287 - DNA, 20 bp, Homo sapiens
acagagctgacaaaattttg

SEQ ID NO: 3768288 - DNA, 10 bp, Homo sapiens
acagagctgg

SEQ ID NO: 3768289 - DNA, 20 bp, Homo sapiens
acagaggagggcgtgactca

SEQ ID NO: 3768290 - DNA, 23 bp, Homo sapiens
acagaggccatgggcctcctgtg

SEQ ID NO: 3768291 - DNA, 12 bp, Homo sapiens
acagagtctcac

SEQ ID NO: 3768292 - DNA, 15 bp, Homo sapiens
acagagtgagactct

SEQ ID NO: 3768293 - DNA, 19 bp, Homo sapiens
acagagtggtctttctgga

SEQ ID NO: 3768294 - DNA, 20 bp, Homo sapiens
acagataagcaagagagatg

SEQ ID NO: 3768295 - DNA, 21 bp, Homo sapiens
acagataagcaagagagatgt

SEQ ID NO: 3768296 - DNA, 20 bp, Homo sapiens
acagatagatatatgctctg

SEQ ID NO: 3768297 - DNA, 20 bp, Homo sapiens
acagatcatagatttctgat

SEQ ID NO: 3768298 - DNA, 21 bp, Homo sapiens
acagatcatagatttctgatt

SEQ ID NO: 3768299 - DNA, 17 bp, Homo sapiens
acagatctccaaagctt

SEQ ID NO: 3768300 - DNA, 22 bp, Homo sapiens
acagatctctgctttggaaatc

SEQ ID NO: 3768301 - DNA, 17 bp, Homo sapiens
acagatgcaatgtgcta

SEQ ID NO: 3768302 - DNA, 21 bp, Homo sapiens
acagatgccccagagctgttt

SEQ ID NO: 3768303 - DNA, 12 bp, Homo sapiens
acagatgcctcc

SEQ ID NO: 3768304 - DNA, 15 bp, Homo sapiens
acagattgcctcctt

SEQ ID NO: 3768305 - DNA, 20 bp, Homo sapiens
acagatttggtgaatttgaa

SEQ ID NO: 3768306 - DNA, 15 bp, Homo sapiens
acagcaaaaccattg

SEQ ID NO: 3768307 - DNA, 20 bp, Homo sapiens
acagcaaaaccattgcttca

SEQ ID NO: 3768308 - DNA, 15 bp, Homo sapiens
acagcagaggttctt

SEQ ID NO: 3768309 - DNA, 18 bp, Homo sapiens
acagcagcccctgcacaa

SEQ ID NO: 3768310 - DNA, 17 bp, Homo sapiens
acagcagcctctgaagt

SEQ ID NO: 3768311 - DNA, 18 bp, Homo sapiens
acagcagcctctgaagtt

SEQ ID NO: 3768312 - DNA, 14 bp, Homo sapiens
acagcagctcaggc

SEQ ID NO: 3768313 - DNA, 15 bp, Homo sapiens
acagcagctcaggca

SEQ ID NO: 3768314 - DNA, 16 bp, Homo sapiens
acagcagctcaggcac

SEQ ID NO: 3768315 - DNA, 15 bp, Homo sapiens
acagcaggcccacct

SEQ ID NO: 3768316 - DNA, 19 bp, Homo sapiens
acagcaggcccacctacct

SEQ ID NO: 3768317 - DNA, 12 bp, Homo sapiens
acagcattgctt

SEQ ID NO: 3768318 - DNA, 13 bp, Homo sapiens
acagcattgcttt

SEQ ID NO: 3768319 - DNA, 19 bp, Homo sapiens
acagccacggccaggccag

SEQ ID NO: 3768320 - DNA, 15 bp, Homo sapiens
acagcccaggcctcc

SEQ ID NO: 3768321 - DNA, 20 bp, Homo sapiens
acagcccaggcctccagctc

SEQ ID NO: 3768322 - DNA, 15 bp, Homo sapiens
acagcccgcatgcag

SEQ ID NO: 3768323 - DNA, 22 bp, Homo sapiens
acagcccgcatgcagcagcttg

SEQ ID NO: 3768324 - DNA, 21 bp, Homo sapiens
acagccctgtcagtgcagccc

SEQ ID NO: 3768325 - DNA, 22 bp, Homo sapiens
acagccgcagcctccctctgac

SEQ ID NO: 3768326 - DNA, 23 bp, Homo sapiens
acagccgctcctgtctgccagcc

SEQ ID NO: 3768327 - DNA, 24 bp, Homo sapiens
acagccgctcctgtctgccagcca

SEQ ID NO: 3768328 - DNA, 14 bp, Homo sapiens
acagcctcacagaa

SEQ ID NO: 3768329 - DNA, 17 bp, Homo sapiens
acagcctcacagaagaa

SEQ ID NO: 3768330 - DNA, 11 bp, Homo sapiens
acagcctggca

SEQ ID NO: 3768331 - DNA, 21 bp, Homo sapiens
acagcctgtggcggtgcctgg

SEQ ID NO: 3768332 - DNA, 15 bp, Homo sapiens
acagctaatgggaca

SEQ ID NO: 3768333 - DNA, 19 bp, Homo sapiens
acagctaatgggacactaa

SEQ ID NO: 3768334 - DNA, 16 bp, Homo sapiens
acagctaccatgacaa

SEQ ID NO: 3768335 - DNA, 21 bp, Homo sapiens
acagctatgggagccccaggg

SEQ ID NO: 3768336 - DNA, 20 bp, Homo sapiens
acagctcaagtcttccctga

SEQ ID NO: 3768337 - DNA, 13 bp, Homo sapiens
acagctcaggctg

SEQ ID NO: 3768338 - DNA, 13 bp, Homo sapiens
acagctcccaccc

SEQ ID NO: 3768339 - DNA, 14 bp, Homo sapiens
acagctcccacccc

SEQ ID NO: 3768340 - DNA, 18 bp, Homo sapiens
acagctcccaccccaccc

SEQ ID NO: 3768341 - DNA, 14 bp, Homo sapiens
acagctccctctgc

SEQ ID NO: 3768342 - DNA, 12 bp, Homo sapiens
acagctccttct

SEQ ID NO: 3768343 - DNA, 16 bp, Homo sapiens
acagctccttctgtcc

SEQ ID NO: 3768344 - DNA, 23 bp, Homo sapiens
acagctccttctgtcctactctg

SEQ ID NO: 3768345 - DNA, 13 bp, Homo sapiens
acagctctagaca

SEQ ID NO: 3768346 - DNA, 17 bp, Homo sapiens
acagctctgtcctggga

SEQ ID NO: 3768347 - DNA, 19 bp, Homo sapiens
acagctctgtgttgccatg

SEQ ID NO: 3768348 - DNA, 15 bp, Homo sapiens
acagctgcagagaca

SEQ ID NO: 3768349 - DNA, 17 bp, Homo sapiens
acagctgcagagacaga

SEQ ID NO: 3768350 - DNA, 15 bp, Homo sapiens
acagctgtccctgtc

SEQ ID NO: 3768351 - DNA, 18 bp, Homo sapiens
acagctgtccctgtcacc

SEQ ID NO: 3768352 - DNA, 17 bp, Homo sapiens
acagcttcagccaggag

SEQ ID NO: 3768353 - DNA, 22 bp, Homo sapiens
acagcttcagccaggagctggg

SEQ ID NO: 3768354 - DNA, 17 bp, Homo sapiens
acagcttcatgcctttg

SEQ ID NO: 3768355 - DNA, 20 bp, Homo sapiens
acagcttcatgcctttgtaa

SEQ ID NO: 3768356 - DNA, 17 bp, Homo sapiens
acagcttcatttcctgt

SEQ ID NO: 3768357 - DNA, 22 bp, Homo sapiens
acagcttcccctctctcctcct

SEQ ID NO: 3768358 - DNA, 20 bp, Homo sapiens
acagcttctcatcctgcagg

SEQ ID NO: 3768359 - DNA, 21 bp, Homo sapiens
acagcttctcatcctgcaggc

SEQ ID NO: 3768360 - DNA, 23 bp, Homo sapiens
acagcttttagtacccacctgag

SEQ ID NO: 3768361 - DNA, 22 bp, Homo sapiens
gctggagcccagggagcggaaa

SEQ ID NO: 3768362 - DNA, 18 bp, Homo sapiens
gctggagtgcagtgagcc

SEQ ID NO: 3768363 - DNA, 20 bp, Homo sapiens
gctggagtgcagtggtgcga

SEQ ID NO: 3768364 - DNA, 14 bp, Homo sapiens
gctggatctcccag

SEQ ID NO: 3768365 - DNA, 21 bp, Homo sapiens
gctggatgctccttccaacag

SEQ ID NO: 3768366 - DNA, 14 bp, Homo sapiens
gctggcccccactg

SEQ ID NO: 3768367 - DNA, 22 bp, Homo sapiens
gctggcccccactggctgtggg

SEQ ID NO: 3768368 - DNA, 23 bp, Homo sapiens
gctggcccctcacctgggcacct

SEQ ID NO: 3768369 - DNA, 19 bp, Homo sapiens
gctggccctggctcccaca

SEQ ID NO: 3768370 - DNA, 16 bp, Homo sapiens
gctggcctcagactca

SEQ ID NO: 3768371 - DNA, 16 bp, Homo sapiens
gctggctcccagggcc

SEQ ID NO: 3768372 - DNA, 17 bp, Homo sapiens
gctggctcccagggcca

SEQ ID NO: 3768373 - DNA, 16 bp, Homo sapiens
gctggctgggcatgga

SEQ ID NO: 3768374 - DNA, 21 bp, Homo sapiens
gctggctgggggcctcactcc

SEQ ID NO: 3768375 - DNA, 17 bp, Homo sapiens
gctggctgttggctggg

SEQ ID NO: 3768376 - DNA, 23 bp, Homo sapiens
gctggctgttggctgggggcctc

SEQ ID NO: 3768377 - DNA, 13 bp, Homo sapiens
gctgggactacag

SEQ ID NO: 3768378 - DNA, 14 bp, Homo sapiens
gctgggactggcca

SEQ ID NO: 3768379 - DNA, 22 bp, Homo sapiens
gctgggagaagggggtcaaagc

SEQ ID NO: 3768380 - DNA, 18 bp, Homo sapiens
gctgggatagaggggtca

SEQ ID NO: 3768381 - DNA, 22 bp, Homo sapiens
gctgggatctgactgcacgtgg

SEQ ID NO: 3768382 - DNA, 14 bp, Homo sapiens
gctgggcagctgtt

SEQ ID NO: 3768383 - DNA, 14 bp, Homo sapiens
gctgggcaggttgg

SEQ ID NO: 3768384 - DNA, 14 bp, Homo sapiens
gctgggcccagaag

SEQ ID NO: 3768385 - DNA, 13 bp, Homo sapiens
gctgggcccagag

SEQ ID NO: 3768386 - DNA, 18 bp, Homo sapiens
gctgggcccagaggcaca

SEQ ID NO: 3768387 - DNA, 14 bp, Homo sapiens
gctgggctctccac

SEQ ID NO: 3768388 - DNA, 15 bp, Homo sapiens
gctgggctctccacc

SEQ ID NO: 3768389 - DNA, 19 bp, Homo sapiens
gctgggctctccacctcag

SEQ ID NO: 3768390 - DNA, 19 bp, Homo sapiens
gctgggcttcagtggcagc

SEQ ID NO: 3768391 - DNA, 22 bp, Homo sapiens
gctgggcttcagtggcagctgc

SEQ ID NO: 3768392 - DNA, 23 bp, Homo sapiens
gctgggggaagaagctctctcct

SEQ ID NO: 3768393 - DNA, 21 bp, Homo sapiens
gctgggggcagcctgcgtggc

SEQ ID NO: 3768394 - DNA, 20 bp, Homo sapiens
gctgggggcaggagggccct

SEQ ID NO: 3768395 - DNA, 15 bp, Homo sapiens
gctgggggcctcagt

SEQ ID NO: 3768396 - DNA, 18 bp, Homo sapiens
gctgggggcctcagtgcc

SEQ ID NO: 3768397 - DNA, 20 bp, Homo sapiens
gctgggggcctcagtgccac

SEQ ID NO: 3768398 - DNA, 17 bp, Homo sapiens
gctgggtgcccacagcc

SEQ ID NO: 3768399 - DNA, 21 bp, Homo sapiens
gctgggtggcaccagcagcct

SEQ ID NO: 3768400 - DNA, 15 bp, Homo sapiens
gctggtaagggccaa

SEQ ID NO: 3768401 - DNA, 18 bp, Homo sapiens
gctggtagagatggagga

SEQ ID NO: 3768402 - DNA, 13 bp, Homo sapiens
gctggtagttagt

SEQ ID NO: 3768403 - DNA, 15 bp, Homo sapiens
gctggtcactgccat

SEQ ID NO: 3768404 - DNA, 13 bp, Homo sapiens
gctggtgcattac

SEQ ID NO: 3768405 - DNA, 22 bp, Homo sapiens
gctggtgcattacagagaggag

SEQ ID NO: 3768406 - DNA, 14 bp, Homo sapiens
gctggtgcccggag

SEQ ID NO: 3768407 - DNA, 19 bp, Homo sapiens
gctggtgggcaccaagagc

SEQ ID NO: 3768408 - DNA, 15 bp, Homo sapiens
gctggtgtcacctga

SEQ ID NO: 3768409 - DNA, 16 bp, Homo sapiens
gctggtgtcacctgaa

SEQ ID NO: 3768410 - DNA, 14 bp, Homo sapiens
gctggttagaaatg

SEQ ID NO: 3768411 - DNA, 15 bp, Homo sapiens
gctggttcagggttg

SEQ ID NO: 3768412 - DNA, 12 bp, Homo sapiens
gctggttttcct

SEQ ID NO: 3768413 - DNA, 14 bp, Homo sapiens
gctgtaaaatcttg

SEQ ID NO: 3768414 - DNA, 14 bp, Homo sapiens
gctgtaaataaatg

SEQ ID NO: 3768415 - DNA, 13 bp, Homo sapiens
gctgtaggtgtgc

SEQ ID NO: 3768416 - DNA, 19 bp, Homo sapiens
gctgtatcccatgagcctc

SEQ ID NO: 3768417 - DNA, 20 bp, Homo sapiens
gctgtatcccatgagcctca

SEQ ID NO: 3768418 - DNA, 23 bp, Homo sapiens
gctgtatcccatgagcctcagca

SEQ ID NO: 3768419 - DNA, 19 bp, Homo sapiens
gctgtattagtcacagaga

SEQ ID NO: 3768420 - DNA, 16 bp, Homo sapiens
gctgtcctaggccaca

SEQ ID NO: 3768421 - DNA, 14 bp, Homo sapiens
gctgtctccagacc

SEQ ID NO: 3768422 - DNA, 20 bp, Homo sapiens
gctgtcttctcaggctctgc

SEQ ID NO: 3768423 - DNA, 19 bp, Homo sapiens
gctgtgaccctcaattcat

SEQ ID NO: 3768424 - DNA, 22 bp, Homo sapiens
gctgtgagtgtaagtgtgagta

SEQ ID NO: 3768425 - DNA, 14 bp, Homo sapiens
gctgtgcctctgcc

SEQ ID NO: 3768426 - DNA, 15 bp, Homo sapiens
gctgtgctctggaca

SEQ ID NO: 3768427 - DNA, 13 bp, Homo sapiens
gctgtgggcaggt

SEQ ID NO: 3768428 - DNA, 14 bp, Homo sapiens
gctgtgggcaggtg

SEQ ID NO: 3768429 - DNA, 23 bp, Homo sapiens
gctgtgggcaggtgggagcttga

SEQ ID NO: 3768430 - DNA, 13 bp, Homo sapiens
gctgtgggctccc

SEQ ID NO: 3768431 - DNA, 14 bp, Homo sapiens
gctgtgggctccct

SEQ ID NO: 3768432 - DNA, 15 bp, Homo sapiens
gctgtgggctccctt

SEQ ID NO: 3768433 - DNA, 18 bp, Homo sapiens
gctgtgggctcccttcct

SEQ ID NO: 3768434 - DNA, 13 bp, Homo sapiens
gctgtggtctctt

SEQ ID NO: 3768435 - DNA, 15 bp, Homo sapiens
gctgtggttcctggg

SEQ ID NO: 3768436 - DNA, 14 bp, Homo sapiens
gctgtggttttctt

SEQ ID NO: 3768437 - DNA, 22 bp, Homo sapiens
gctgtggttttcttttgccatg

SEQ ID NO: 3768438 - DNA, 23 bp, Homo sapiens
gctgtggttttcttttgccatga

SEQ ID NO: 3768439 - DNA, 19 bp, Homo sapiens
gctgtgtccttgcacctgc

SEQ ID NO: 3768440 - DNA, 21 bp, Homo sapiens
gctgtgtccttgcacctgcat

SEQ ID NO: 3768441 - DNA, 23 bp, Homo sapiens
gctgtgtccttgcacctgcatcc

SEQ ID NO: 3768442 - DNA, 18 bp, Homo sapiens
gctgttatttctattttt

SEQ ID NO: 3768443 - DNA, 20 bp, Homo sapiens
gctgttcacccacagggcta

SEQ ID NO: 3768444 - DNA, 14 bp, Homo sapiens
gctgttcagctggt

SEQ ID NO: 3768445 - DNA, 13 bp, Homo sapiens
gctgttggctggg

SEQ ID NO: 3768446 - DNA, 23 bp, Homo sapiens
gctgtttatggcctcagctgcct

SEQ ID NO: 3768447 - DNA, 12 bp, Homo sapiens
gctgtttgtcat

SEQ ID NO: 3768448 - DNA, 20 bp, Homo sapiens
gctgtttgtttgacaaagaa

SEQ ID NO: 3768449 - DNA, 17 bp, Homo sapiens
gctgttttccctgacct

SEQ ID NO: 3768450 - DNA, 15 bp, Homo sapiens
gcttaaaacttttca

SEQ ID NO: 3768451 - DNA, 18 bp, Homo sapiens
gcttagacctcagcctgt

SEQ ID NO: 3768452 - DNA, 19 bp, Homo sapiens
gcttagacctcagcctgtg

SEQ ID NO: 3768453 - DNA, 23 bp, Homo sapiens
gcttagacctcagcctgtgctgc

SEQ ID NO: 3768454 - DNA, 20 bp, Homo sapiens
gcttatacacttacacttta

SEQ ID NO: 3768455 - DNA, 17 bp, Homo sapiens
gcttatcaataaacctg

SEQ ID NO: 3768456 - DNA, 23 bp, Homo sapiens
gcttatcaatttgtcattttgaa

SEQ ID NO: 3768457 - DNA, 23 bp, Homo sapiens
gcttatgacatcacttgtacaaa

SEQ ID NO: 3768458 - DNA, 19 bp, Homo sapiens
gcttattaatgctaagggc

SEQ ID NO: 3768459 - DNA, 17 bp, Homo sapiens
gcttattgttccaagac

SEQ ID NO: 3768460 - DNA, 21 bp, Homo sapiens
gcttattgttccaagacattg

SEQ ID NO: 3768461 - DNA, 18 bp, Homo sapiens
gcttcaagtctgtgcctg

SEQ ID NO: 3768462 - DNA, 23 bp, Homo sapiens
gcttcaagtctgtgcctggagct

SEQ ID NO: 3768463 - DNA, 15 bp, Homo sapiens
gcttcaccctgtcaa

SEQ ID NO: 3768464 - DNA, 20 bp, Homo sapiens
gcttcacggaagagccttgc

SEQ ID NO: 3768465 - DNA, 12 bp, Homo sapiens
gcttcagcctga

SEQ ID NO: 3768466 - DNA, 15 bp, Homo sapiens
gcttcagtggcagct

SEQ ID NO: 3768467 - DNA, 20 bp, Homo sapiens
gcttcagtggcagctgcttt

SEQ ID NO: 3768468 - DNA, 20 bp, Homo sapiens
gcttcatgaaaatcctacca

SEQ ID NO: 3768469 - DNA, 15 bp, Homo sapiens
gcttcatgcctttgt

SEQ ID NO: 3768470 - DNA, 22 bp, Homo sapiens
gcttcattcaagtcagctcttc

SEQ ID NO: 3768471 - DNA, 21 bp, Homo sapiens
gcttccacgtactgcagcctc

SEQ ID NO: 3768472 - DNA, 17 bp, Homo sapiens
gctcagcggggacagct

SEQ ID NO: 3768473 - DNA, 20 bp, Homo sapiens
gctcagcggggacagctcct

SEQ ID NO: 3768474 - DNA, 20 bp, Homo sapiens
gctcaggcctataaccccag

SEQ ID NO: 3768475 - DNA, 24 bp, Homo sapiens
gctcaggcgatccacctgtctcag

SEQ ID NO: 3768476 - DNA, 17 bp, Homo sapiens
gctcaggtacagagaag

SEQ ID NO: 3768477 - DNA, 21 bp, Homo sapiens
gctcaggtacagagaaggaat

SEQ ID NO: 3768478 - DNA, 14 bp, Homo sapiens
gctcaggtgtccct

SEQ ID NO: 3768479 - DNA, 16 bp, Homo sapiens
gctcaggtgtccctgc

SEQ ID NO: 3768480 - DNA, 12 bp, Homo sapiens
gctcagtcccat

SEQ ID NO: 3768481 - DNA, 20 bp, Homo sapiens
gctcatgggcccctctgact

SEQ ID NO: 3768482 - DNA, 22 bp, Homo sapiens
gctcatgggcccctctgactcc

SEQ ID NO: 3768483 - DNA, 15 bp, Homo sapiens
gctcatggtccccat

SEQ ID NO: 3768484 - DNA, 16 bp, Homo sapiens
gctccacaccctctcc

SEQ ID NO: 3768485 - DNA, 16 bp, Homo sapiens
gctccaccccactcac

SEQ ID NO: 3768486 - DNA, 16 bp, Homo sapiens
gctccacccttggcct

SEQ ID NO: 3768487 - DNA, 16 bp, Homo sapiens
gctccagccaacccct

SEQ ID NO: 3768488 - DNA, 18 bp, Homo sapiens
gctccagccaacccctgt

SEQ ID NO: 3768489 - DNA, 13 bp, Homo sapiens
gctccagctcacc

SEQ ID NO: 3768490 - DNA, 20 bp, Homo sapiens
gctccagctcaccagcccca

SEQ ID NO: 3768491 - DNA, 16 bp, Homo sapiens
gctccaggctccttta

SEQ ID NO: 3768492 - DNA, 24 bp, Homo sapiens
gctccaggctcctttagcgcccag

SEQ ID NO: 3768493 - DNA, 17 bp, Homo sapiens
gctccagtcctgctctc

SEQ ID NO: 3768494 - DNA, 21 bp, Homo sapiens
gctccagtcctgctctctacc

SEQ ID NO: 3768495 - DNA, 20 bp, Homo sapiens
gctccagtctgctgccctcc

SEQ ID NO: 3768496 - DNA, 14 bp, Homo sapiens
gctccatctccact

SEQ ID NO: 3768497 - DNA, 23 bp, Homo sapiens
gctcccaacacaaggtgggcagg

SEQ ID NO: 3768498 - DNA, 13 bp, Homo sapiens
gctcccacagaac

SEQ ID NO: 3768499 - DNA, 15 bp, Homo sapiens
gctcccacaggccct

SEQ ID NO: 3768500 - DNA, 21 bp, Homo sapiens
gctcccacaggcccttcctct

SEQ ID NO: 3768501 - DNA, 14 bp, Homo sapiens
gctcccagggccat

SEQ ID NO: 3768502 - DNA, 13 bp, Homo sapiens
gctccccagtgaa

SEQ ID NO: 3768503 - DNA, 18 bp, Homo sapiens
gctcccctttcgcccaca

SEQ ID NO: 3768504 - DNA, 20 bp, Homo sapiens
gctcccgggactcactggca

SEQ ID NO: 3768505 - DNA, 15 bp, Homo sapiens
gctccctaccacctc

SEQ ID NO: 3768506 - DNA, 16 bp, Homo sapiens
gctccctaccacctcc

SEQ ID NO: 3768507 - DNA, 19 bp, Homo sapiens
gctccctatgttgcccagg

SEQ ID NO: 3768508 - DNA, 13 bp, Homo sapiens
gctccctccccct

SEQ ID NO: 3768509 - DNA, 23 bp, Homo sapiens
gctccctcccctgccctggtcca

SEQ ID NO: 3768510 - DNA, 23 bp, Homo sapiens
gctccctctgcctgaaccttcca

SEQ ID NO: 3768511 - DNA, 14 bp, Homo sapiens
gctcccttcctccc

SEQ ID NO: 3768512 - DNA, 13 bp, Homo sapiens
gctccgcctctgc

SEQ ID NO: 3768513 - DNA, 14 bp, Homo sapiens
gctccgcctctgct

SEQ ID NO: 3768514 - DNA, 14 bp, Homo sapiens
gctccgctgtgtgg

SEQ ID NO: 3768515 - DNA, 18 bp, Homo sapiens
gctccgctttctacccag

SEQ ID NO: 3768516 - DNA, 23 bp, Homo sapiens
gctccgtccaggagcctgtgcct

SEQ ID NO: 3768517 - DNA, 22 bp, Homo sapiens
gctccgtgagtgaaccatcatt

SEQ ID NO: 3768518 - DNA, 15 bp, Homo sapiens
gctcctccagggcca

SEQ ID NO: 3768519 - DNA, 19 bp, Homo sapiens
gctcctctccccagcaagt

SEQ ID NO: 3768520 - DNA, 11 bp, Homo sapiens
gctcctctggg

SEQ ID NO: 3768521 - DNA, 14 bp, Homo sapiens
gctcctctgggcag

SEQ ID NO: 3768522 - DNA, 18 bp, Homo sapiens
gctcctgaggggcatctg

SEQ ID NO: 3768523 - DNA, 15 bp, Homo sapiens
gctcctggcccactg

SEQ ID NO: 3768524 - DNA, 18 bp, Homo sapiens
gctcctggcccactgcat

SEQ ID NO: 3768525 - DNA, 20 bp, Homo sapiens
gctcctggcccactgcatcg

SEQ ID NO: 3768526 - DNA, 12 bp, Homo sapiens
gctcctgggaag

SEQ ID NO: 3768527 - DNA, 20 bp, Homo sapiens
gctcctgtctgccagccagc

SEQ ID NO: 3768528 - DNA, 21 bp, Homo sapiens
gctcctgtctgccagccagca

SEQ ID NO: 3768529 - DNA, 12 bp, Homo sapiens
gctcctgtgtct

SEQ ID NO: 3768530 - DNA, 13 bp, Homo sapiens
gctccttagctgc

SEQ ID NO: 3768531 - DNA, 18 bp, Homo sapiens
gctccttagctgccaagc

SEQ ID NO: 3768532 - DNA, 21 bp, Homo sapiens
gctcgagcagtcctgcctcag

SEQ ID NO: 3768533 - DNA, 12 bp, Homo sapiens
gctcggtggacc

SEQ ID NO: 3768534 - DNA, 21 bp, Homo sapiens
gctcgtcggggggacagctcc

SEQ ID NO: 3768535 - DNA, 20 bp, Homo sapiens
gctctacagctaatcagcat

SEQ ID NO: 3768536 - DNA, 22 bp, Homo sapiens
gctctacagctaatcagcattc

SEQ ID NO: 3768537 - DNA, 16 bp, Homo sapiens
gctctagacaaccctg

SEQ ID NO: 3768538 - DNA, 21 bp, Homo sapiens
gctctagcctgggcaacaaca

SEQ ID NO: 3768539 - DNA, 18 bp, Homo sapiens
gctctcaagttatcaggg

SEQ ID NO: 3768540 - DNA, 11 bp, Homo sapiens
gctctcagcca

SEQ ID NO: 3768541 - DNA, 17 bp, Homo sapiens
gctctcagccaacgagt

SEQ ID NO: 3768542 - DNA, 18 bp, Homo sapiens
gctctccacctcagcctt

SEQ ID NO: 3768543 - DNA, 11 bp, Homo sapiens
gctctccctct

SEQ ID NO: 3768544 - DNA, 19 bp, Homo sapiens
gctctccgaccagacacct

SEQ ID NO: 3768545 - DNA, 15 bp, Homo sapiens
gctctcctcttgcca

SEQ ID NO: 3768546 - DNA, 19 bp, Homo sapiens
gctctcctcttgccactgc

SEQ ID NO: 3768547 - DNA, 17 bp, Homo sapiens
gctctctgcagccagcc

SEQ ID NO: 3768548 - DNA, 19 bp, Homo sapiens
gctctctgcagccagccca

SEQ ID NO: 3768549 - DNA, 13 bp, Homo sapiens
gctctctgctgta

SEQ ID NO: 3768550 - DNA, 15 bp, Homo sapiens
gctctgaaagccagc

SEQ ID NO: 3768551 - DNA, 17 bp, Homo sapiens
gctctgaaagccagctg

SEQ ID NO: 3768552 - DNA, 21 bp, Homo sapiens
gctctgagcaaatgtggctcc

SEQ ID NO: 3768553 - DNA, 23 bp, Homo sapiens
gctctgcaagaattgaagcagga

SEQ ID NO: 3768554 - DNA, 12 bp, Homo sapiens
gctctgcacaga

SEQ ID NO: 3768555 - DNA, 18 bp, Homo sapiens
gctctgcacagatggatt

SEQ ID NO: 3768556 - DNA, 18 bp, Homo sapiens
gctctgcccagagctggg

SEQ ID NO: 3768557 - DNA, 21 bp, Homo sapiens
gctctgcccagagctgggtga

SEQ ID NO: 3768558 - DNA, 15 bp, Homo sapiens
gctctgccccagctc

SEQ ID NO: 3768559 - DNA, 14 bp, Homo sapiens
gctctgctcctctc

SEQ ID NO: 3768560 - DNA, 19 bp, Homo sapiens
gctctgctcctctccccag

SEQ ID NO: 3768561 - DNA, 23 bp, Homo sapiens
gctctgctgacagacacaggccc

SEQ ID NO: 3768562 - DNA, 18 bp, Homo sapiens
gctctggagccacctgtc

SEQ ID NO: 3768563 - DNA, 20 bp, Homo sapiens
gctctggagccacctgtccc

SEQ ID NO: 3768564 - DNA, 22 bp, Homo sapiens
gctctggagccacctgtcccac

SEQ ID NO: 3768565 - DNA, 14 bp, Homo sapiens
gctctggctcacag

SEQ ID NO: 3768566 - DNA, 21 bp, Homo sapiens
gctctggctctccccaatatc

SEQ ID NO: 3768567 - DNA, 16 bp, Homo sapiens
gctctgtcctgggagt

SEQ ID NO: 3768568 - DNA, 16 bp, Homo sapiens
gctctgtgttgccatg

SEQ ID NO: 3768569 - DNA, 17 bp, Homo sapiens
gctctgtgttgccatgt

SEQ ID NO: 3768570 - DNA, 12 bp, Homo sapiens
gctcttcaggcc

SEQ ID NO: 3768571 - DNA, 12 bp, Homo sapiens
gctcttctccag

SEQ ID NO: 3768572 - DNA, 16 bp, Homo sapiens
gctcttctccaggctg

SEQ ID NO: 3768573 - DNA, 21 bp, Homo sapiens
gctcttctcctttcacaacct

SEQ ID NO: 3768574 - DNA, 14 bp, Homo sapiens
gctcttctgccggc

SEQ ID NO: 3768575 - DNA, 21 bp, Homo sapiens
gctcttctgccggccctgggg

SEQ ID NO: 3768576 - DNA, 18 bp, Homo sapiens
gctcttgcagagaagcct

SEQ ID NO: 3768577 - DNA, 13 bp, Homo sapiens
gctctttctgggc

SEQ ID NO: 3768578 - DNA, 17 bp, Homo sapiens
gctctttgaaacaactt

SEQ ID NO: 3768579 - DNA, 15 bp, Homo sapiens
gctcttttcaatgaa

SEQ ID NO: 3768580 - DNA, 16 bp, Homo sapiens
gctgaaacaggagaga

SEQ ID NO: 3768581 - DNA, 15 bp, Homo sapiens
aatctcaaataacta

SEQ ID NO: 3768582 - DNA, 14 bp, Homo sapiens
aatctcaatttgag

SEQ ID NO: 3768583 - DNA, 22 bp, Homo sapiens
aatctcaccccatcccacaccc

SEQ ID NO: 3768584 - DNA, 22 bp, Homo sapiens
aatctcagcaatgattactctt

SEQ ID NO: 3768585 - DNA, 21 bp, Homo sapiens
aatctcctatttttttaaaat

SEQ ID NO: 3768586 - DNA, 14 bp, Homo sapiens
aatctctctctgtt

SEQ ID NO: 3768587 - DNA, 13 bp, Homo sapiens
aatctgaatgtaa

SEQ ID NO: 3768588 - DNA, 16 bp, Homo sapiens
aatctgatcgttcttt

SEQ ID NO: 3768589 - DNA, 15 bp, Homo sapiens
aatctggactcctct

SEQ ID NO: 3768590 - DNA, 17 bp, Homo sapiens
aatctggactcctctgt

SEQ ID NO: 3768591 - DNA, 18 bp, Homo sapiens
aatctggactcctctgtc

SEQ ID NO: 3768592 - DNA, 20 bp, Homo sapiens
aatcttcagttttatcttta

SEQ ID NO: 3768593 - DNA, 13 bp, Homo sapiens
aatcttgaaaatg

SEQ ID NO: 3768594 - DNA, 21 bp, Homo sapiens
aatcttttttagcataaaatt

SEQ ID NO: 3768595 - DNA, 21 bp, Homo sapiens
aatgaaaaatttaagcattgt

SEQ ID NO: 3768596 - DNA, 22 bp, Homo sapiens
aatgaaaaatttaagcattgtt

SEQ ID NO: 3768597 - DNA, 12 bp, Homo sapiens
aatgaaaatgtc

SEQ ID NO: 3768598 - DNA, 14 bp, Homo sapiens
aatgaaaatgtcag

SEQ ID NO: 3768599 - DNA, 20 bp, Homo sapiens
aatgaaagactgtacaaagt

SEQ ID NO: 3768600 - DNA, 19 bp, Homo sapiens
aatgaaagtcttgtgacta

SEQ ID NO: 3768601 - DNA, 21 bp, Homo sapiens
aatgaaatcctgcttcagtgt

SEQ ID NO: 3768602 - DNA, 24 bp, Homo sapiens
gtgatcttgctctatctcacagca

SEQ ID NO: 3768603 - DNA, 22 bp, Homo sapiens
gtgatcttggcttactgcagcc

SEQ ID NO: 3768604 - DNA, 13 bp, Homo sapiens
gtgatgcctccct

SEQ ID NO: 3768605 - DNA, 16 bp, Homo sapiens
gtgatggttcccctgt

SEQ ID NO: 3768606 - DNA, 13 bp, Homo sapiens
gtgattaaggtct

SEQ ID NO: 3768607 - DNA, 22 bp, Homo sapiens
gtgattagagggaggagaatga

SEQ ID NO: 3768608 - DNA, 17 bp, Homo sapiens
gtgattctcctgcctca

SEQ ID NO: 3768609 - DNA, 20 bp, Homo sapiens
gtgattctcctgcctcagcc

SEQ ID NO: 3768610 - DNA, 22 bp, Homo sapiens
gtgatttttatccaatcttgtt

SEQ ID NO: 3768611 - DNA, 15 bp, Homo sapiens
gtgatttttttttag

SEQ ID NO: 3768612 - DNA, 14 bp, Homo sapiens
gtgcaaaaattttt

SEQ ID NO: 3768613 - DNA, 19 bp, Homo sapiens
gtgcaaaacatgctacctg

SEQ ID NO: 3768614 - DNA, 23 bp, Homo sapiens
gtgcaacccttaccccttagcct

SEQ ID NO: 3768615 - DNA, 15 bp, Homo sapiens
gtgcaagtgtgtgca

SEQ ID NO: 3768616 - DNA, 16 bp, Homo sapiens
gtgcaataaaataaca

SEQ ID NO: 3768617 - DNA, 14 bp, Homo sapiens
gtgcacacaccaga

SEQ ID NO: 3768618 - DNA, 22 bp, Homo sapiens
gtgcacagacgtccctccacgt

SEQ ID NO: 3768619 - DNA, 18 bp, Homo sapiens
gtgcacctgtactcagga

SEQ ID NO: 3768620 - DNA, 15 bp, Homo sapiens
gtgcacgtggagagc

SEQ ID NO: 3768621 - DNA, 16 bp, Homo sapiens
gtgcacgtggagagct

SEQ ID NO: 3768622 - DNA, 16 bp, Homo sapiens
gtgcagagtgcccaga

SEQ ID NO: 3768623 - DNA, 17 bp, Homo sapiens
gtgcagcatatgaggat

SEQ ID NO: 3768624 - DNA, 20 bp, Homo sapiens
gtgcagcccgtgtggcccct

SEQ ID NO: 3768625 - DNA, 21 bp, Homo sapiens
gtgcagcccgtgtggcccctt

SEQ ID NO: 3768626 - DNA, 12 bp, Homo sapiens
gtgcagctgatt

SEQ ID NO: 3768627 - DNA, 19 bp, Homo sapiens
gtgcagtggcccccacaga

SEQ ID NO: 3768628 - DNA, 20 bp, Homo sapiens
gtgcagtggtgcgatctggg

SEQ ID NO: 3768629 - DNA, 23 bp, Homo sapiens
gtgcagtggtgcgatctgggttc

SEQ ID NO: 3768630 - DNA, 14 bp, Homo sapiens
gtgcatctcagccc

SEQ ID NO: 3768631 - DNA, 13 bp, Homo sapiens
gtgcatgctctct

SEQ ID NO: 3768632 - DNA, 15 bp, Homo sapiens
gtgcatgctctctgc

SEQ ID NO: 3768633 - DNA, 16 bp, Homo sapiens
gtgcatgctctctgca

SEQ ID NO: 3768634 - DNA, 18 bp, Homo sapiens
gtgcatgctctctgcagc

SEQ ID NO: 3768635 - DNA, 19 bp, Homo sapiens
gtgcatgctctctgcagcc

SEQ ID NO: 3768636 - DNA, 13 bp, Homo sapiens
gtgcatgggtgaa

SEQ ID NO: 3768637 - DNA, 16 bp, Homo sapiens
gtgcattacagagagg

SEQ ID NO: 3768638 - DNA, 16 bp, Homo sapiens
gtgcatttttgtgaaa

SEQ ID NO: 3768639 - DNA, 18 bp, Homo sapiens
gtgcatttttgtgaaatg

SEQ ID NO: 3768640 - DNA, 19 bp, Homo sapiens
gtgccaagcacagtgcctg

SEQ ID NO: 3768641 - DNA, 18 bp, Homo sapiens
gtgccacccaccagggcg

SEQ ID NO: 3768642 - DNA, 18 bp, Homo sapiens
gtgccactgcccgagctg

SEQ ID NO: 3768643 - DNA, 22 bp, Homo sapiens
gtgccactgcccgagctggtgc

SEQ ID NO: 3768644 - DNA, 12 bp, Homo sapiens
gtgccaggcccg

SEQ ID NO: 3768645 - DNA, 17 bp, Homo sapiens
gtgccaggcccggggct

SEQ ID NO: 3768646 - DNA, 19 bp, Homo sapiens
gtgccaggcccggggctgg

SEQ ID NO: 3768647 - DNA, 22 bp, Homo sapiens
gtgccaggtttttggtctgacc

SEQ ID NO: 3768648 - DNA, 13 bp, Homo sapiens
gtgccattgtctt

SEQ ID NO: 3768649 - DNA, 14 bp, Homo sapiens
gtgccattgtcttt

SEQ ID NO: 3768650 - DNA, 15 bp, Homo sapiens
gtgccattgtcttta

SEQ ID NO: 3768651 - DNA, 19 bp, Homo sapiens
gtgcccacagcccgcatgc

SEQ ID NO: 3768652 - DNA, 22 bp, Homo sapiens
gtgcccagaactggactcagga

SEQ ID NO: 3768653 - DNA, 20 bp, Homo sapiens
gtgcccagagatgggactgg

SEQ ID NO: 3768654 - DNA, 14 bp, Homo sapiens
gtgccccacctgcc

SEQ ID NO: 3768655 - DNA, 19 bp, Homo sapiens
gtgcccctgctgcctcccc

SEQ ID NO: 3768656 - DNA, 15 bp, Homo sapiens
gtgccctccactgcc

SEQ ID NO: 3768657 - DNA, 12 bp, Homo sapiens
gtgccctgcccc

SEQ ID NO: 3768658 - DNA, 16 bp, Homo sapiens
gtgcccttggaggcca

SEQ ID NO: 3768659 - DNA, 18 bp, Homo sapiens
gtgccgttactctccaac

SEQ ID NO: 3768660 - DNA, 15 bp, Homo sapiens
gtgcctctgcctgtc

SEQ ID NO: 3768661 - DNA, 21 bp, Homo sapiens
gtgcctctggaggcctctggg

SEQ ID NO: 3768662 - DNA, 14 bp, Homo sapiens
gtgcctctgggact

SEQ ID NO: 3768663 - DNA, 14 bp, Homo sapiens
gtgcctgcaccagg

SEQ ID NO: 3768664 - DNA, 17 bp, Homo sapiens
gtgcctggagctcctgg

SEQ ID NO: 3768665 - DNA, 18 bp, Homo sapiens
gtgcctggagctcctggg

SEQ ID NO: 3768666 - DNA, 20 bp, Homo sapiens
gtgcctgggtggggctgctc

SEQ ID NO: 3768667 - DNA, 21 bp, Homo sapiens
gtgcctgggtggggctgctcc

SEQ ID NO: 3768668 - DNA, 17 bp, Homo sapiens
gtgcctgtgaggcaggg

SEQ ID NO: 3768669 - DNA, 15 bp, Homo sapiens
gtgccttcagctcta

SEQ ID NO: 3768670 - DNA, 22 bp, Homo sapiens
gtgccttccataattatgacag

SEQ ID NO: 3768671 - DNA, 20 bp, Homo sapiens
gtgcctttcctgttcagcat

SEQ ID NO: 3768672 - DNA, 21 bp, Homo sapiens
gtgcctttcctgttcagcatt

SEQ ID NO: 3768673 - DNA, 21 bp, Homo sapiens
gtgcctttgagtttcctcagg

SEQ ID NO: 3768674 - DNA, 14 bp, Homo sapiens
gtgcgagtgtgtgc

SEQ ID NO: 3768675 - DNA, 21 bp, Homo sapiens
gtgcgatctgggttcactgca

SEQ ID NO: 3768676 - DNA, 22 bp, Homo sapiens
gtgctaaatggtcgcccaggag

SEQ ID NO: 3768677 - DNA, 18 bp, Homo sapiens
gtgctccctaccacctcc

SEQ ID NO: 3768678 - DNA, 16 bp, Homo sapiens
gtgctctgatcatcca

SEQ ID NO: 3768679 - DNA, 17 bp, Homo sapiens
gtgctctggacaggcat

SEQ ID NO: 3768680 - DNA, 14 bp, Homo sapiens
gtgctgaagcttat

SEQ ID NO: 3768681 - DNA, 21 bp, Homo sapiens
gtgctgaagcttattaatgct

SEQ ID NO: 3768682 - DNA, 20 bp, Homo sapiens
gtgctgaatggttttcaaaa

SEQ ID NO: 3768683 - DNA, 22 bp, Homo sapiens
gtgctgccatccaggttcagct

SEQ ID NO: 3768684 - DNA, 19 bp, Homo sapiens
gtgctgcccgtcttcagcc

SEQ ID NO: 3768685 - DNA, 21 bp, Homo sapiens
gtgctgcccgtcttcagccta

SEQ ID NO: 3768686 - DNA, 14 bp, Homo sapiens
gtgctgctgctgct

SEQ ID NO: 3768687 - DNA, 15 bp, Homo sapiens
gtgctgctgctgctg

SEQ ID NO: 3768688 - DNA, 13 bp, Homo sapiens
gtgctgcttccct

SEQ ID NO: 3768689 - DNA, 16 bp, Homo sapiens
gtgctgcttccctctg

SEQ ID NO: 3768690 - DNA, 15 bp, Homo sapiens
gtgctgggagggata

SEQ ID NO: 3768691 - DNA, 15 bp, Homo sapiens
gtgctgtgaccattt

SEQ ID NO: 3768692 - DNA, 18 bp, Homo sapiens
gtgctgtgaccatttata

SEQ ID NO: 3768693 - DNA, 21 bp, Homo sapiens
gtgcttattctcaaagcagga

SEQ ID NO: 3768694 - DNA, 13 bp, Homo sapiens
gtgcttcagcctg

SEQ ID NO: 3768695 - DNA, 22 bp, Homo sapiens
gtgcttgtttgctcacctgggg

SEQ ID NO: 3768696 - DNA, 18 bp, Homo sapiens
gtggaaaaatagcctgcc

SEQ ID NO: 3768697 - DNA, 15 bp, Homo sapiens
gtggaaaaatattta

SEQ ID NO: 3768698 - DNA, 13 bp, Homo sapiens
gtggaaagggtgc

SEQ ID NO: 3768699 - DNA, 16 bp, Homo sapiens
gtggaaagtgaatttg

SEQ ID NO: 3768700 - DNA, 16 bp, Homo sapiens
gtggaagccctccttc

SEQ ID NO: 3768701 - DNA, 17 bp, Homo sapiens
gtggaagccctccttcc

SEQ ID NO: 3768702 - DNA, 18 bp, Homo sapiens
gtggaagccctccttcca

SEQ ID NO: 3768703 - DNA, 12 bp, Homo sapiens
gtggaaggaaag

SEQ ID NO: 3768704 - DNA, 18 bp, Homo sapiens
gtggaatataaggaaagc

SEQ ID NO: 3768705 - DNA, 22 bp, Homo sapiens
gtggacacagctcttctccagg

SEQ ID NO: 3768706 - DNA, 22 bp, Homo sapiens
gtggacaccaggagtccctggt

SEQ ID NO: 3768707 - DNA, 13 bp, Homo sapiens
gtggacagtcctg

SEQ ID NO: 3768708 - DNA, 18 bp, Homo sapiens
aagttcttagatatcttt

SEQ ID NO: 3768709 - DNA, 17 bp, Homo sapiens
aagttgaaattaaccat

SEQ ID NO: 3768710 - DNA, 17 bp, Homo sapiens
aagttgaagctaagatt

SEQ ID NO: 3768711 - DNA, 19 bp, Homo sapiens
aagttggcttctgtttcta

SEQ ID NO: 3768712 - DNA, 17 bp, Homo sapiens
aagttgggcaatataac

SEQ ID NO: 3768713 - DNA, 20 bp, Homo sapiens
aagttgggcaatataaccaa

SEQ ID NO: 3768714 - DNA, 15 bp, Homo sapiens
aagtttaaaatgtat

SEQ ID NO: 3768715 - DNA, 18 bp, Homo sapiens
aagtttatacagtacagt

SEQ ID NO: 3768716 - DNA, 13 bp, Homo sapiens
aagtttccaagca

SEQ ID NO: 3768717 - DNA, 15 bp, Homo sapiens
aagtttccaagcaaa

SEQ ID NO: 3768718 - DNA, 16 bp, Homo sapiens
aagtttccaagcaaat

SEQ ID NO: 3768719 - DNA, 19 bp, Homo sapiens
aagtttccaagcaaatgtt

SEQ ID NO: 3768720 - DNA, 22 bp, Homo sapiens
aagtttccaagcaaatgttaca

SEQ ID NO: 3768721 - DNA, 24 bp, Homo sapiens
aagtttccaagcaaatgttacata

SEQ ID NO: 3768722 - DNA, 15 bp, Homo sapiens
aagtttgatttcatt

SEQ ID NO: 3768723 - DNA, 15 bp, Homo sapiens
aagtttgtgttctgt

SEQ ID NO: 3768724 - DNA, 15 bp, Homo sapiens
aagttttgcatttat

SEQ ID NO: 3768725 - DNA, 14 bp, Homo sapiens
aataaaaaccaaga

SEQ ID NO: 3768726 - DNA, 22 bp, Homo sapiens
aataaaaaccaagaagatgtct

SEQ ID NO: 3768727 - DNA, 21 bp, Homo sapiens
aataaaaactgactccttaga

SEQ ID NO: 3768728 - DNA, 11 bp, Homo sapiens
aataaaaaggc

SEQ ID NO: 3768729 - DNA, 18 bp, Homo sapiens
aataaaaaggcacctata

SEQ ID NO: 3768730 - DNA, 16 bp, Homo sapiens
aataaaaataaatttg

SEQ ID NO: 3768731 - DNA, 17 bp, Homo sapiens
aataaaaattaaggcaa

SEQ ID NO: 3768732 - DNA, 17 bp, Homo sapiens
aataaaacattttcaca

SEQ ID NO: 3768733 - DNA, 13 bp, Homo sapiens
aataaaaccagct

SEQ ID NO: 3768734 - DNA, 22 bp, Homo sapiens
aataaaacctttcaaatttcac

SEQ ID NO: 3768735 - DNA, 19 bp, Homo sapiens
aataaaagaaatgcacaat

SEQ ID NO: 3768736 - DNA, 14 bp, Homo sapiens
aataaaataacaga

SEQ ID NO: 3768737 - DNA, 18 bp, Homo sapiens
aataaaataacagactgt

SEQ ID NO: 3768738 - DNA, 17 bp, Homo sapiens
aataaaatatcattcag

SEQ ID NO: 3768739 - DNA, 18 bp, Homo sapiens
aataaaatatcattcagc

SEQ ID NO: 3768740 - DNA, 20 bp, Homo sapiens
aataaaatatcattcagcaa

SEQ ID NO: 3768741 - DNA, 21 bp, Homo sapiens
aataaaatatcattcagcaac

SEQ ID NO: 3768742 - DNA, 22 bp, Homo sapiens
aataaacacatagattcacctg

SEQ ID NO: 3768743 - DNA, 13 bp, Homo sapiens
aataaacatcctt

SEQ ID NO: 3768744 - DNA, 23 bp, Homo sapiens
aataaacatccttcaagaactct

SEQ ID NO: 3768745 - DNA, 15 bp, Homo sapiens
aataaactattggaa

SEQ ID NO: 3768746 - DNA, 15 bp, Homo sapiens
aataaagcctgcttt

SEQ ID NO: 3768747 - DNA, 20 bp, Homo sapiens
aataaagtattccaccttaa

SEQ ID NO: 3768748 - DNA, 13 bp, Homo sapiens
aataaagtgtttt

SEQ ID NO: 3768749 - DNA, 12 bp, Homo sapiens
aataaataaatg

SEQ ID NO: 3768750 - DNA, 14 bp, Homo sapiens
aataaataaatgca

SEQ ID NO: 3768751 - DNA, 16 bp, Homo sapiens
aataaatacattcttg

SEQ ID NO: 3768752 - DNA, 19 bp, Homo sapiens
aataaatagctatatccat

SEQ ID NO: 3768753 - DNA, 14 bp, Homo sapiens
aataaatatttatg

SEQ ID NO: 3768754 - DNA, 15 bp, Homo sapiens
aataaatcatgttaa

SEQ ID NO: 3768755 - DNA, 20 bp, Homo sapiens
aataaatctggtagaaaaat

SEQ ID NO: 3768756 - DNA, 17 bp, Homo sapiens
aataaatgcaatatgta

SEQ ID NO: 3768757 - DNA, 19 bp, Homo sapiens
aataaatgcaatatgtatt

SEQ ID NO: 3768758 - DNA, 14 bp, Homo sapiens
aataaatgtacctg

SEQ ID NO: 3768759 - DNA, 13 bp, Homo sapiens
aataaatgtcatt

SEQ ID NO: 3768760 - DNA, 20 bp, Homo sapiens
aataaattgcatgctgcttt

SEQ ID NO: 3768761 - DNA, 18 bp, Homo sapiens
aataaatttggttctaat

SEQ ID NO: 3768762 - DNA, 12 bp, Homo sapiens
aataacacacat

SEQ ID NO: 3768763 - DNA, 16 bp, Homo sapiens
aataacacagagagac

SEQ ID NO: 3768764 - DNA, 23 bp, Homo sapiens
aataacacagagagacagacttg

SEQ ID NO: 3768765 - DNA, 20 bp, Homo sapiens
aataacataatttgtacata

SEQ ID NO: 3768766 - DNA, 22 bp, Homo sapiens
aataacatgtaattaagtacta

SEQ ID NO: 3768767 - DNA, 16 bp, Homo sapiens
aataaccccaaaatga

SEQ ID NO: 3768768 - DNA, 18 bp, Homo sapiens
aataacctcaaagtgact

SEQ ID NO: 3768769 - DNA, 19 bp, Homo sapiens
aataactctgtggcattat

SEQ ID NO: 3768770 - DNA, 13 bp, Homo sapiens
aataataaattgc

SEQ ID NO: 3768771 - DNA, 12 bp, Homo sapiens
aataatatgcat

SEQ ID NO: 3768772 - DNA, 13 bp, Homo sapiens
aataatatgcatt

SEQ ID NO: 3768773 - DNA, 15 bp, Homo sapiens
aataatatgcattgt

SEQ ID NO: 3768774 - DNA, 14 bp, Homo sapiens
aataatctttgggt

SEQ ID NO: 3768775 - DNA, 16 bp, Homo sapiens
aataatgtgggaagaa

SEQ ID NO: 3768776 - DNA, 14 bp, Homo sapiens
aataattctttgat

SEQ ID NO: 3768777 - DNA, 21 bp, Homo sapiens
aatacaaaaaattagccgggc

SEQ ID NO: 3768778 - DNA, 20 bp, Homo sapiens
aatacaaaaattagccgggc

SEQ ID NO: 3768779 - DNA, 21 bp, Homo sapiens
aatacaaacatatttgttaaa

SEQ ID NO: 3768780 - DNA, 19 bp, Homo sapiens
aatacagaaattagccggg

SEQ ID NO: 3768781 - DNA, 16 bp, Homo sapiens
aatacagggcattttg

SEQ ID NO: 3768782 - DNA, 13 bp, Homo sapiens
aatacatgcatct

SEQ ID NO: 3768783 - DNA, 16 bp, Homo sapiens
aatacattaaagcagt

SEQ ID NO: 3768784 - DNA, 20 bp, Homo sapiens
aataccaaaattatttcaga

SEQ ID NO: 3768785 - DNA, 21 bp, Homo sapiens
aatacccatgtctacacagat

SEQ ID NO: 3768786 - DNA, 20 bp, Homo sapiens
aatacgccagaactgcttta

SEQ ID NO: 3768787 - DNA, 14 bp, Homo sapiens
aatactagccagag

SEQ ID NO: 3768788 - DNA, 13 bp, Homo sapiens
aatactctaattc

SEQ ID NO: 3768789 - DNA, 17 bp, Homo sapiens
aatactctaattctaac

SEQ ID NO: 3768790 - DNA, 22 bp, Homo sapiens
aatacttatatttttaataaaa

SEQ ID NO: 3768791 - DNA, 17 bp, Homo sapiens
aatacttattcattgtg

SEQ ID NO: 3768792 - DNA, 23 bp, Homo sapiens
aatacttattcattgtggttatt

SEQ ID NO: 3768793 - DNA, 22 bp, Homo sapiens
gtgtcacctgaagactcattct

SEQ ID NO: 3768794 - DNA, 22 bp, Homo sapiens
gaggatctcttgagcctgggag

SEQ ID NO: 3768795 - DNA, 21 bp, Homo sapiens
gaggatgcagagtcagcagaa

SEQ ID NO: 3768796 - DNA, 12 bp, Homo sapiens
gaggatggagag

SEQ ID NO: 3768797 - DNA, 14 bp, Homo sapiens
gaggatggagagag

SEQ ID NO: 3768798 - DNA, 15 bp, Homo sapiens
gaggatgggaaggag

SEQ ID NO: 3768799 - DNA, 19 bp, Homo sapiens
gaggatgggaaggagggag

SEQ ID NO: 3768800 - DNA, 22 bp, Homo sapiens
gaggatttaagggatggaaaag

SEQ ID NO: 3768801 - DNA, 23 bp, Homo sapiens
gaggcaatgtcaggaacagaagg

SEQ ID NO: 3768802 - DNA, 19 bp, Homo sapiens
gaggcagaaagcagaggct

SEQ ID NO: 3768803 - DNA, 20 bp, Homo sapiens
gaggcagaaagcagaggctg

SEQ ID NO: 3768804 - DNA, 23 bp, Homo sapiens
gaggcagaaagcagaggctggcc

SEQ ID NO: 3768805 - DNA, 23 bp, Homo sapiens
gaggcagaaccctggtgaggaag

SEQ ID NO: 3768806 - DNA, 21 bp, Homo sapiens
gaggcagccccattctgcctg

SEQ ID NO: 3768807 - DNA, 14 bp, Homo sapiens
gaggcaggctccag

SEQ ID NO: 3768808 - DNA, 14 bp, Homo sapiens
gaggcagggaagtc

SEQ ID NO: 3768809 - DNA, 17 bp, Homo sapiens
gaggcagggaggggact

SEQ ID NO: 3768810 - DNA, 17 bp, Homo sapiens
gaggcagggccttgccc

SEQ ID NO: 3768811 - DNA, 18 bp, Homo sapiens
gaggcagggccttgccca

SEQ ID NO: 3768812 - DNA, 21 bp, Homo sapiens
gaggcagggccttgcccagag

SEQ ID NO: 3768813 - DNA, 17 bp, Homo sapiens
gaggccaaggtgggagg

SEQ ID NO: 3768814 - DNA, 17 bp, Homo sapiens
gaggccaagtgcaggct

SEQ ID NO: 3768815 - DNA, 13 bp, Homo sapiens
gaggccagcccca

SEQ ID NO: 3768816 - DNA, 20 bp, Homo sapiens
gaggccagccccacccagga

SEQ ID NO: 3768817 - DNA, 21 bp, Homo sapiens
gaggccagccccacccaggag

SEQ ID NO: 3768818 - DNA, 13 bp, Homo sapiens
gaggccagcctgg

SEQ ID NO: 3768819 - DNA, 22 bp, Homo sapiens
gaggccaggagtttgagaccag

SEQ ID NO: 3768820 - DNA, 14 bp, Homo sapiens
gaggccatgggcct

SEQ ID NO: 3768821 - DNA, 17 bp, Homo sapiens
gaggccatgggcctcct

SEQ ID NO: 3768822 - DNA, 18 bp, Homo sapiens
gaggccatgggcctcctg

SEQ ID NO: 3768823 - DNA, 23 bp, Homo sapiens
gaggccatgggcctcctgtgtgt

SEQ ID NO: 3768824 - DNA, 20 bp, Homo sapiens
gaggcccgcatgcggcccag

SEQ ID NO: 3768825 - DNA, 19 bp, Homo sapiens
gaggccgggtgctcagggc

SEQ ID NO: 3768826 - DNA, 13 bp, Homo sapiens
gaggcctctgggc

SEQ ID NO: 3768827 - DNA, 16 bp, Homo sapiens
gaggccttctctgaag

SEQ ID NO: 3768828 - DNA, 22 bp, Homo sapiens
gaggctgagcctacagatgaac

SEQ ID NO: 3768829 - DNA, 16 bp, Homo sapiens
gaggctgaggcagaag

SEQ ID NO: 3768830 - DNA, 15 bp, Homo sapiens
gaggctgaggcagga

SEQ ID NO: 3768831 - DNA, 16 bp, Homo sapiens
gaggctgaggcaggag

SEQ ID NO: 3768832 - DNA, 14 bp, Homo sapiens
gaggctgcagtcag

SEQ ID NO: 3768833 - DNA, 19 bp, Homo sapiens
gaggctggactccagatct

SEQ ID NO: 3768834 - DNA, 15 bp, Homo sapiens
gaggctggaggaagg

SEQ ID NO: 3768835 - DNA, 17 bp, Homo sapiens
gaggctgggccaagcca

SEQ ID NO: 3768836 - DNA, 20 bp, Homo sapiens
gaggctgtcttctcaggctc

SEQ ID NO: 3768837 - DNA, 18 bp, Homo sapiens
gagggaacagacaggaga

SEQ ID NO: 3768838 - DNA, 17 bp, Homo sapiens
gagggaccaactgggcc

SEQ ID NO: 3768839 - DNA, 16 bp, Homo sapiens
gagggaccagccaaga

SEQ ID NO: 3768840 - DNA, 15 bp, Homo sapiens
gagggagcttagcca

SEQ ID NO: 3768841 - DNA, 13 bp, Homo sapiens
gagggagggggct

SEQ ID NO: 3768842 - DNA, 13 bp, Homo sapiens
gagggagtgacag

SEQ ID NO: 3768843 - DNA, 21 bp, Homo sapiens
gagggagtgacagaggcagcc

SEQ ID NO: 3768844 - DNA, 16 bp, Homo sapiens
gagggataagcaaaag

SEQ ID NO: 3768845 - DNA, 23 bp, Homo sapiens
gagggatcacagggccccagaag

SEQ ID NO: 3768846 - DNA, 17 bp, Homo sapiens
gagggatgctgcctgag

SEQ ID NO: 3768847 - DNA, 14 bp, Homo sapiens
gagggcagaggctg

SEQ ID NO: 3768848 - DNA, 18 bp, Homo sapiens
gagggcatgcgcacaagg

SEQ ID NO: 3768849 - DNA, 22 bp, Homo sapiens
gagggcatgcgcacaaggctga

SEQ ID NO: 3768850 - DNA, 13 bp, Homo sapiens
gagggcccaggca

SEQ ID NO: 3768851 - DNA, 15 bp, Homo sapiens
gagggccctacctga

SEQ ID NO: 3768852 - DNA, 22 bp, Homo sapiens
gaggggactatttatgaaggca

SEQ ID NO: 3768853 - DNA, 22 bp, Homo sapiens
gagggggccacctccccaggcc

SEQ ID NO: 3768854 - DNA, 18 bp, Homo sapiens
gaggggtctccaggagga

SEQ ID NO: 3768855 - DNA, 13 bp, Homo sapiens
gagggtcaggaag

SEQ ID NO: 3768856 - DNA, 16 bp, Homo sapiens
gagggtcaggaaggat

SEQ ID NO: 3768857 - DNA, 15 bp, Homo sapiens
gagggtcctggctcc

SEQ ID NO: 3768858 - DNA, 24 bp, Homo sapiens
gagggtctggagaagcagtgagcc

SEQ ID NO: 3768859 - DNA, 18 bp, Homo sapiens
gagggtgggagagcccag

SEQ ID NO: 3768860 - DNA, 15 bp, Homo sapiens
gagggttagggaggg

SEQ ID NO: 3768861 - DNA, 12 bp, Homo sapiens
gagggttcctgt

SEQ ID NO: 3768862 - DNA, 13 bp, Homo sapiens
gaggtcaggagtt

SEQ ID NO: 3768863 - DNA, 22 bp, Homo sapiens
gaggtcaggagttagaggccag

SEQ ID NO: 3768864 - DNA, 18 bp, Homo sapiens
gaggtctcttgagggagc

SEQ ID NO: 3768865 - DNA, 22 bp, Homo sapiens
gaggtcttttgacatgtggaaa

SEQ ID NO: 3768866 - DNA, 22 bp, Homo sapiens
gaggtgctgtagatgctgggcc

SEQ ID NO: 3768867 - DNA, 19 bp, Homo sapiens
gaggtggaggttgcagtga

SEQ ID NO: 3768868 - DNA, 14 bp, Homo sapiens
gaggtggctgcctg

SEQ ID NO: 3768869 - DNA, 16 bp, Homo sapiens
gaggtgggatatccct

SEQ ID NO: 3768870 - DNA, 17 bp, Homo sapiens
gaggtggtctgaatgtt

SEQ ID NO: 3768871 - DNA, 20 bp, Homo sapiens
gaggtggtctgaatgttctg

SEQ ID NO: 3768872 - DNA, 19 bp, Homo sapiens
gaggttaaggctgaggaaa

SEQ ID NO: 3768873 - DNA, 17 bp, Homo sapiens
gaggttcatttcaaata

SEQ ID NO: 3768874 - DNA, 19 bp, Homo sapiens
gaggttgcagtgagctgag

SEQ ID NO: 3768875 - DNA, 15 bp, Homo sapiens
gagtaagctgctttt

SEQ ID NO: 3768876 - DNA, 17 bp, Homo sapiens
gagtacctgctgcccca

SEQ ID NO: 3768877 - DNA, 22 bp, Homo sapiens
gagtacctgctgccccagctga

SEQ ID NO: 3768878 - DNA, 17 bp, Homo sapiens
gagtagaaagacagagc

SEQ ID NO: 3768879 - DNA, 20 bp, Homo sapiens
gagtagaaagacagagctgg

SEQ ID NO: 3768880 - DNA, 17 bp, Homo sapiens
gagtagacccctggctg

SEQ ID NO: 3768881 - DNA, 12 bp, Homo sapiens
gagtagctggga

SEQ ID NO: 3768882 - DNA, 19 bp, Homo sapiens
gagtagctgggactacagg

SEQ ID NO: 3768883 - DNA, 20 bp, Homo sapiens
gagtagttgatgttgcattt

SEQ ID NO: 3768884 - DNA, 14 bp, Homo sapiens
gagtcaaaacactt

SEQ ID NO: 3768885 - DNA, 19 bp, Homo sapiens
gagtcaatcccctcattca

SEQ ID NO: 3768886 - DNA, 14 bp, Homo sapiens
gagtcaccaggaat

SEQ ID NO: 3768887 - DNA, 12 bp, Homo sapiens
gagtcactgcct

SEQ ID NO: 3768888 - DNA, 21 bp, Homo sapiens
gagtcactgcctctccctggc

SEQ ID NO: 3768889 - DNA, 19 bp, Homo sapiens
gagtcatgatctccctgcc

SEQ ID NO: 3768890 - DNA, 20 bp, Homo sapiens
gagtcatgatctccctgccg

SEQ ID NO: 3768891 - DNA, 15 bp, Homo sapiens
gagtcccaaggaaag

SEQ ID NO: 3768892 - DNA, 18 bp, Homo sapiens
gagtcccaaggaaagccc

SEQ ID NO: 3768893 - DNA, 12 bp, Homo sapiens
gagtcccacctt

SEQ ID NO: 3768894 - DNA, 21 bp, Homo sapiens
gagtcccaccttggctgcagg

SEQ ID NO: 3768895 - DNA, 14 bp, Homo sapiens
gagtcccgtcagga

SEQ ID NO: 3768896 - DNA, 22 bp, Homo sapiens
gagtcccttccaggccatcaga

SEQ ID NO: 3768897 - DNA, 16 bp, Homo sapiens
gagtcctcactcccag

SEQ ID NO: 3768898 - DNA, 19 bp, Homo sapiens
gagtctcactgttgcccag

SEQ ID NO: 3768899 - DNA, 20 bp, Homo sapiens
gagtctcactgttgcccagg

SEQ ID NO: 3768900 - DNA, 23 bp, Homo sapiens
gagtctcactgttgcccaggctg

SEQ ID NO: 3768901 - DNA, 12 bp, Homo sapiens
gagtctcttctc

SEQ ID NO: 3768902 - DNA, 17 bp, Homo sapiens
gagtctcttctccactg

SEQ ID NO: 3768903 - DNA, 18 bp, Homo sapiens
gagtctcttctccactgg

SEQ ID NO: 3768904 - DNA, 16 bp, Homo sapiens
gagtcttgcagtgatt

SEQ ID NO: 3768905 - DNA, 23 bp, Homo sapiens
gagtctttgtaagtaaactgccc

SEQ ID NO: 3768906 - DNA, 15 bp, Homo sapiens
gagtgaaccatcatt

SEQ ID NO: 3768907 - DNA, 16 bp, Homo sapiens
gagtgacagaggcagc

SEQ ID NO: 3768908 - DNA, 17 bp, Homo sapiens
gagtgacagaggcagcc

SEQ ID NO: 3768909 - DNA, 18 bp, Homo sapiens
gagtgacagaggcagccc

SEQ ID NO: 3768910 - DNA, 20 bp, Homo sapiens
gagtgacagaggcagcccca

SEQ ID NO: 3768911 - DNA, 13 bp, Homo sapiens
gagtgagaccctg

SEQ ID NO: 3768912 - DNA, 24 bp, Homo sapiens
gagtgagcactaaggtgtgctctg

SEQ ID NO: 3768913 - DNA, 22 bp, Homo sapiens
gagtgatacaacttcaagtgca

SEQ ID NO: 3768914 - DNA, 12 bp, Homo sapiens
gagtgcagtgag

SEQ ID NO: 3768915 - DNA, 19 bp, Homo sapiens
gagtgccccacctgccact

SEQ ID NO: 3768916 - DNA, 19 bp, Homo sapiens
gagtggaggttaaggctga

SEQ ID NO: 3768917 - DNA, 13 bp, Homo sapiens
gagtggcctggcc

SEQ ID NO: 3768918 - DNA, 18 bp, Homo sapiens
gagtgggacagagtctgg

SEQ ID NO: 3768919 - DNA, 21 bp, Homo sapiens
gagtggtctttctggagaggt

SEQ ID NO: 3768920 - DNA, 14 bp, Homo sapiens
gagtgtaacaagaa

SEQ ID NO: 3768921 - DNA, 14 bp, Homo sapiens
gagtgtaagtgtga

SEQ ID NO: 3768922 - DNA, 17 bp, Homo sapiens
gagtgtaagtgtgagta

SEQ ID NO: 3768923 - DNA, 20 bp, Homo sapiens
gagtgtaagtgtgagtaaga

SEQ ID NO: 3768924 - DNA, 17 bp, Homo sapiens
gagtgtgcctgaagtcc

SEQ ID NO: 3768925 - DNA, 12 bp, Homo sapiens
gagtgtgggaag

SEQ ID NO: 3768926 - DNA, 16 bp, Homo sapiens
gagtgtgtattgttcc

SEQ ID NO: 3768927 - DNA, 19 bp, Homo sapiens
gagtgtgtgtttgtgctga

SEQ ID NO: 3768928 - DNA, 18 bp, Homo sapiens
gagttagaggccagcctg

SEQ ID NO: 3768929 - DNA, 18 bp, Homo sapiens
gagttaggctattcacaa

SEQ ID NO: 3768930 - DNA, 15 bp, Homo sapiens
gagttcagctgcttc

SEQ ID NO: 3768931 - DNA, 18 bp, Homo sapiens
gagttcgagaccagcctg

SEQ ID NO: 3768932 - DNA, 20 bp, Homo sapiens
gagttcgagaccagcctggc

SEQ ID NO: 3768933 - DNA, 19 bp, Homo sapiens
gagttcgaggctgcagtca

SEQ ID NO: 3768934 - DNA, 16 bp, Homo sapiens
gagttgattcagctct

SEQ ID NO: 3768935 - DNA, 17 bp, Homo sapiens
gagttgattcagctctg

SEQ ID NO: 3768936 - DNA, 18 bp, Homo sapiens
gagttgattcagctctgc

SEQ ID NO: 3768937 - DNA, 18 bp, Homo sapiens
gagttgtgttgttctttt

SEQ ID NO: 3768938 - DNA, 16 bp, Homo sapiens
gagttgttttcagact

SEQ ID NO: 3768939 - DNA, 17 bp, Homo sapiens
gagtttaagaccagcct

SEQ ID NO: 3768940 - DNA, 20 bp, Homo sapiens
gagtttaccatttgtaataa

SEQ ID NO: 3768941 - DNA, 23 bp, Homo sapiens
gagtttaccatttgtaataaagt

SEQ ID NO: 3768942 - DNA, 15 bp, Homo sapiens
gagtttcctaaaagt

SEQ ID NO: 3768943 - DNA, 15 bp, Homo sapiens
gagtttcctcaggct

SEQ ID NO: 3768944 - DNA, 13 bp, Homo sapiens
gagtttgccctgg

SEQ ID NO: 3768945 - DNA, 14 bp, Homo sapiens
gagttttcttcctt

SEQ ID NO: 3768946 - DNA, 13 bp, Homo sapiens
gagttttgtttta

SEQ ID NO: 3768947 - DNA, 19 bp, Homo sapiens
gagtttttatggggctgaa

SEQ ID NO: 3768948 - DNA, 18 bp, Homo sapiens
gataaataatcggcccac

SEQ ID NO: 3768949 - DNA, 18 bp, Homo sapiens
gataaatcagtggttatt

SEQ ID NO: 3768950 - DNA, 13 bp, Homo sapiens
gataaattataag

SEQ ID NO: 3768951 - DNA, 21 bp, Homo sapiens
gataacctgtacttcaagtta

SEQ ID NO: 3768952 - DNA, 11 bp, Homo sapiens
gataactctcc

SEQ ID NO: 3768953 - DNA, 16 bp, Homo sapiens
gataagagttggctgg

SEQ ID NO: 3768954 - DNA, 15 bp, Homo sapiens
gataatgctgttgcc

SEQ ID NO: 3768955 - DNA, 19 bp, Homo sapiens
gataatgctgttgcctcat

SEQ ID NO: 3768956 - DNA, 14 bp, Homo sapiens
gataattataatat

SEQ ID NO: 3768957 - DNA, 19 bp, Homo sapiens
gatacaagtttcagacagg

SEQ ID NO: 3768958 - DNA, 19 bp, Homo sapiens
gatacacccaaagtatcag

SEQ ID NO: 3768959 - DNA, 21 bp, Homo sapiens
gatacacccaaagtatcagga

SEQ ID NO: 3768960 - DNA, 22 bp, Homo sapiens
gatacactgaagttaacagaga

SEQ ID NO: 3768961 - DNA, 18 bp, Homo sapiens
gatacaggaaaagctgct

SEQ ID NO: 3768962 - DNA, 17 bp, Homo sapiens
gatacatgtctttctcc

SEQ ID NO: 3768963 - DNA, 19 bp, Homo sapiens
gataccaagatgccatctg

SEQ ID NO: 3768964 - DNA, 17 bp, Homo sapiens
gataccaggttgaaaga

SEQ ID NO: 3768965 - DNA, 16 bp, Homo sapiens
gatacgcatcagacag

SEQ ID NO: 3768966 - DNA, 17 bp, Homo sapiens
gatactctgtcagatgg

SEQ ID NO: 3768967 - DNA, 16 bp, Homo sapiens
gatagaaataaatagc

SEQ ID NO: 3768968 - DNA, 14 bp, Homo sapiens
gatagaagaactgc

SEQ ID NO: 3768969 - DNA, 15 bp, Homo sapiens
gatagataactcttt

SEQ ID NO: 3768970 - DNA, 17 bp, Homo sapiens
gatagataactctttgg

SEQ ID NO: 3768971 - DNA, 20 bp, Homo sapiens
gatagcaagtgaatttttct

SEQ ID NO: 3768972 - DNA, 14 bp, Homo sapiens
gatagcatgtcttt

SEQ ID NO: 3768973 - DNA, 14 bp, Homo sapiens
gatagcgttggaat

SEQ ID NO: 3768974 - DNA, 23 bp, Homo sapiens
gataggcctgtgggccagattgc

SEQ ID NO: 3768975 - DNA, 13 bp, Homo sapiens
gatataaataaaa

SEQ ID NO: 3768976 - DNA, 18 bp, Homo sapiens
gatatacacggatgactt

SEQ ID NO: 3768977 - DNA, 20 bp, Homo sapiens
gatatatgtgtttttcacat

SEQ ID NO: 3768978 - DNA, 15 bp, Homo sapiens
gatatatttttcaca

SEQ ID NO: 3768979 - DNA, 17 bp, Homo sapiens
gatatatttttcacagt

SEQ ID NO: 3768980 - DNA, 15 bp, Homo sapiens
gatatcttgaaatga

SEQ ID NO: 3768981 - DNA, 22 bp, Homo sapiens
gatatctttttattgatgtgca

SEQ ID NO: 3768982 - DNA, 15 bp, Homo sapiens
gatatgaaaaatatg

SEQ ID NO: 3768983 - DNA, 12 bp, Homo sapiens
gatattccatag

SEQ ID NO: 3768984 - DNA, 21 bp, Homo sapiens
gatattccatagtatattaaa

SEQ ID NO: 3768985 - DNA, 16 bp, Homo sapiens
gatattccatgaatgt

SEQ ID NO: 3768986 - DNA, 17 bp, Homo sapiens
gatattgtgaagtacat

SEQ ID NO: 3768987 - DNA, 16 bp, Homo sapiens
gatatttccatcatta

SEQ ID NO: 3768988 - DNA, 12 bp, Homo sapiens
gatattttcaaa

SEQ ID NO: 3768989 - DNA, 18 bp, Homo sapiens
gatattttcaaattgtat

SEQ ID NO: 3768990 - DNA, 20 bp, Homo sapiens
gatattttcaaattgtatct

SEQ ID NO: 3768991 - DNA, 22 bp, Homo sapiens
gatattttcaacgcagccctgc

SEQ ID NO: 3768992 - DNA, 23 bp, Homo sapiens
gatattttcaacgcagccctgct

SEQ ID NO: 3768993 - DNA, 20 bp, Homo sapiens
gatattttcttccaagcaaa

SEQ ID NO: 3768994 - DNA, 21 bp, Homo sapiens
gatattttttcagaaatatgt

SEQ ID NO: 3768995 - DNA, 23 bp, Homo sapiens
gatcaaaaggttaataaagtaat

SEQ ID NO: 3768996 - DNA, 21 bp, Homo sapiens
gatcaaaatctgtagagcagg

SEQ ID NO: 3768997 - DNA, 22 bp, Homo sapiens
gatcaaaccccgaccacctgcc

SEQ ID NO: 3768998 - DNA, 22 bp, Homo sapiens
gatcaaccccttcgctcctgtg

SEQ ID NO: 3768999 - DNA, 14 bp, Homo sapiens
gatcaagaaagtgt

SEQ ID NO: 3769000 - DNA, 18 bp, Homo sapiens
gatcaataaaatgtgatt

SEQ ID NO: 3769001 - DNA, 15 bp, Homo sapiens
gatcaattaaatgta

SEQ ID NO: 3769002 - DNA, 13 bp, Homo sapiens
gatcacagggccc

SEQ ID NO: 3769003 - DNA, 18 bp, Homo sapiens
gatcacataacagaatgc

SEQ ID NO: 3769004 - DNA, 14 bp, Homo sapiens
gatcacctgaggtt

SEQ ID NO: 3769005 - DNA, 14 bp, Homo sapiens
gatcacgccactgc

SEQ ID NO: 3769006 - DNA, 12 bp, Homo sapiens
gatcactggagc

SEQ ID NO: 3769007 - DNA, 13 bp, Homo sapiens
gatcactggagcc

SEQ ID NO: 3769008 - DNA, 14 bp, Homo sapiens
gatcactggagccc

SEQ ID NO: 3769009 - DNA, 20 bp, Homo sapiens
gatcagaaagtaatttcttc

SEQ ID NO: 3769010 - DNA, 12 bp, Homo sapiens
gatcagcctggg

SEQ ID NO: 3769011 - DNA, 17 bp, Homo sapiens
gatcagctgtttgtcat

SEQ ID NO: 3769012 - DNA, 14 bp, Homo sapiens
gatcaggtggggag

SEQ ID NO: 3769013 - DNA, 18 bp, Homo sapiens
gatcagttataagtagca

SEQ ID NO: 3769014 - DNA, 21 bp, Homo sapiens
gatcatccactgtgccatgtg

SEQ ID NO: 3769015 - DNA, 10 bp, Homo sapiens
gatcatgaga

SEQ ID NO: 3769016 - DNA, 13 bp, Homo sapiens
gatcatgcattgt

SEQ ID NO: 3769017 - DNA, 21 bp, Homo sapiens
gatcatggctcactgcagcct

SEQ ID NO: 3769018 - DNA, 18 bp, Homo sapiens
gatcatttgttggaatga

SEQ ID NO: 3769019 - DNA, 22 bp, Homo sapiens
gatccacccacctcagcctccc

SEQ ID NO: 3769020 - DNA, 22 bp, Homo sapiens
gcaggacctcagagtccaggcc

SEQ ID NO: 3769021 - DNA, 13 bp, Homo sapiens
gcaggagctcaga

SEQ ID NO: 3769022 - DNA, 18 bp, Homo sapiens
gcaggagctcagatgaag

SEQ ID NO: 3769023 - DNA, 13 bp, Homo sapiens
gcaggcagggctg

SEQ ID NO: 3769024 - DNA, 20 bp, Homo sapiens
gcaggccaagtcaggccctt

SEQ ID NO: 3769025 - DNA, 22 bp, Homo sapiens
gcaggccagctgtggttttctt

SEQ ID NO: 3769026 - DNA, 22 bp, Homo sapiens
gcaggcggcctttgttgctcag

SEQ ID NO: 3769027 - DNA, 13 bp, Homo sapiens
gcagggaaacagc

SEQ ID NO: 3769028 - DNA, 22 bp, Homo sapiens
gcagggaaaggctctgaaagcc

SEQ ID NO: 3769029 - DNA, 20 bp, Homo sapiens
gcagggaaggggaggcagcc

SEQ ID NO: 3769030 - DNA, 19 bp, Homo sapiens
gcagggaggcaccattcag

SEQ ID NO: 3769031 - DNA, 15 bp, Homo sapiens
gcagggaggggacta

SEQ ID NO: 3769032 - DNA, 19 bp, Homo sapiens
gcagggcatctcctgtgca

SEQ ID NO: 3769033 - DNA, 22 bp, Homo sapiens
gcagggcatctcctgtgcatgg

SEQ ID NO: 3769034 - DNA, 18 bp, Homo sapiens
gcagggccttgcccagag

SEQ ID NO: 3769035 - DNA, 19 bp, Homo sapiens
gcagggctcagcggggaca

SEQ ID NO: 3769036 - DNA, 12 bp, Homo sapiens
gcagggctctga

SEQ ID NO: 3769037 - DNA, 16 bp, Homo sapiens
gcagggtcaggagagg

SEQ ID NO: 3769038 - DNA, 21 bp, Homo sapiens
gcaggtcactgaaacttcaag

SEQ ID NO: 3769039 - DNA, 15 bp, Homo sapiens
gcaggtgacagtgag

SEQ ID NO: 3769040 - DNA, 16 bp, Homo sapiens
gcaggtgacagtgagg

SEQ ID NO: 3769041 - DNA, 17 bp, Homo sapiens
gcaggtgaccttctggg

SEQ ID NO: 3769042 - DNA, 21 bp, Homo sapiens
gcaggtgcccctctctccatc

SEQ ID NO: 3769043 - DNA, 19 bp, Homo sapiens
gcaggttgaggggctcctg

SEQ ID NO: 3769044 - DNA, 20 bp, Homo sapiens
gcaggttgaggggctcctgg

SEQ ID NO: 3769045 - DNA, 14 bp, Homo sapiens
gcagtaaaaactgt

SEQ ID NO: 3769046 - DNA, 14 bp, Homo sapiens
gcagtaaagagaaa

SEQ ID NO: 3769047 - DNA, 15 bp, Homo sapiens
gcagtaaagagaaac

SEQ ID NO: 3769048 - DNA, 17 bp, Homo sapiens
gcagtcctgcctcagcc

SEQ ID NO: 3769049 - DNA, 18 bp, Homo sapiens
gcagtctcgggtggctag

SEQ ID NO: 3769050 - DNA, 21 bp, Homo sapiens
gcagtgagccgcatcttctcc

SEQ ID NO: 3769051 - DNA, 18 bp, Homo sapiens
gcagtgagtctcttcaga

SEQ ID NO: 3769052 - DNA, 22 bp, Homo sapiens
gcagtgcgcgtgcacgtggaga

SEQ ID NO: 3769053 - DNA, 11 bp, Homo sapiens
gcagtgggagc

SEQ ID NO: 3769054 - DNA, 14 bp, Homo sapiens
gcagtgggagctgc

SEQ ID NO: 3769055 - DNA, 15 bp, Homo sapiens
gcagtgggagctgcc

SEQ ID NO: 3769056 - DNA, 15 bp, Homo sapiens
gcagtggggctgggg

SEQ ID NO: 3769057 - DNA, 11 bp, Homo sapiens
gcagtgtcttc

SEQ ID NO: 3769058 - DNA, 14 bp, Homo sapiens
gcagtgtcttccat

SEQ ID NO: 3769059 - DNA, 16 bp, Homo sapiens
gcagtgtgtctcctgc

SEQ ID NO: 3769060 - DNA, 11 bp, Homo sapiens
gcagttctgca

SEQ ID NO: 3769061 - DNA, 15 bp, Homo sapiens
gcagttctgcaaata

SEQ ID NO: 3769062 - DNA, 19 bp, Homo sapiens
gcagttctgcaaatagaaa

SEQ ID NO: 3769063 - DNA, 19 bp, Homo sapiens
gcagttctgggtgctccct

SEQ ID NO: 3769064 - DNA, 22 bp, Homo sapiens
gcagttggccagagagcctggt

SEQ ID NO: 3769065 - DNA, 14 bp, Homo sapiens
gcagtttgggaggt

SEQ ID NO: 3769066 - DNA, 19 bp, Homo sapiens
gcataactgacaaatcaag

SEQ ID NO: 3769067 - DNA, 21 bp, Homo sapiens
gcataactgacaaatcaagtt

SEQ ID NO: 3769068 - DNA, 12 bp, Homo sapiens
gcatagaaggag

SEQ ID NO: 3769069 - DNA, 20 bp, Homo sapiens
gcatagtaccaatcatttta

SEQ ID NO: 3769070 - DNA, 21 bp, Homo sapiens
gcatagtattccattgtgtga

SEQ ID NO: 3769071 - DNA, 23 bp, Homo sapiens
gcatagtattccattgtgtgagt

SEQ ID NO: 3769072 - DNA, 15 bp, Homo sapiens
gcatatcctgagcca

SEQ ID NO: 3769073 - DNA, 15 bp, Homo sapiens
gcatattgttattat

SEQ ID NO: 3769074 - DNA, 23 bp, Homo sapiens
gcatatttatagcaatccatgtt

SEQ ID NO: 3769075 - DNA, 15 bp, Homo sapiens
gcatcacagggcaga

SEQ ID NO: 3769076 - DNA, 16 bp, Homo sapiens
gcatcacagggcagag

SEQ ID NO: 3769077 - DNA, 14 bp, Homo sapiens
gcatcacctcaggc

SEQ ID NO: 3769078 - DNA, 20 bp, Homo sapiens
gcatcaccttaggcagggaa

SEQ ID NO: 3769079 - DNA, 22 bp, Homo sapiens
gcatcaccttaggcagggaagt

SEQ ID NO: 3769080 - DNA, 13 bp, Homo sapiens
gcatcagaaatgt

SEQ ID NO: 3769081 - DNA, 18 bp, Homo sapiens
gcatcattccaccatggc

SEQ ID NO: 3769082 - DNA, 16 bp, Homo sapiens
gcatccattcctcagg

SEQ ID NO: 3769083 - DNA, 13 bp, Homo sapiens
gcatcccagggga

SEQ ID NO: 3769084 - DNA, 15 bp, Homo sapiens
gcatcccaggggacc

SEQ ID NO: 3769085 - DNA, 21 bp, Homo sapiens
gcatcccaggggaccacacct

SEQ ID NO: 3769086 - DNA, 15 bp, Homo sapiens
gcatcccagtggcct

SEQ ID NO: 3769087 - DNA, 17 bp, Homo sapiens
gcatccctgaggctgga

SEQ ID NO: 3769088 - DNA, 20 bp, Homo sapiens
gcatccctgaggctggactc

SEQ ID NO: 3769089 - DNA, 17 bp, Homo sapiens
gcatccgtagttccctg

SEQ ID NO: 3769090 - DNA, 20 bp, Homo sapiens
gcatcctcagttcctgcagc

SEQ ID NO: 3769091 - DNA, 21 bp, Homo sapiens
gcatcctcagttcctgcagca

SEQ ID NO: 3769092 - DNA, 18 bp, Homo sapiens
gcatcctccacaatagca

SEQ ID NO: 3769093 - DNA, 22 bp, Homo sapiens
gcatccttaagtatcagaaagc

SEQ ID NO: 3769094 - DNA, 20 bp, Homo sapiens
gcatccttttctgcagaggg

SEQ ID NO: 3769095 - DNA, 22 bp, Homo sapiens
gcatctcctgaggatcagaaag

SEQ ID NO: 3769096 - DNA, 23 bp, Homo sapiens
gcatctcctgaggatcagaaagt

SEQ ID NO: 3769097 - DNA, 15 bp, Homo sapiens
gcatctcctgtgcat

SEQ ID NO: 3769098 - DNA, 17 bp, Homo sapiens
gcatctcttgaggccag

SEQ ID NO: 3769099 - DNA, 21 bp, Homo sapiens
gcatctcttgaggccaggagt

SEQ ID NO: 3769100 - DNA, 14 bp, Homo sapiens
gcatctgacacaaa

SEQ ID NO: 3769101 - DNA, 17 bp, Homo sapiens
gcatctgacacaaaaaa

SEQ ID NO: 3769102 - DNA, 12 bp, Homo sapiens
gcatctgcaccc

SEQ ID NO: 3769103 - DNA, 12 bp, Homo sapiens
gcatctgcccct

SEQ ID NO: 3769104 - DNA, 15 bp, Homo sapiens
gcatctgcccctccc

SEQ ID NO: 3769105 - DNA, 15 bp, Homo sapiens
gcatcttactgaagg

SEQ ID NO: 3769106 - DNA, 23 bp, Homo sapiens
gcatctttgccttgggctgctcc

SEQ ID NO: 3769107 - DNA, 17 bp, Homo sapiens
gcatgacaagccccagg

SEQ ID NO: 3769108 - DNA, 16 bp, Homo sapiens
gcatgacctgtgacca

SEQ ID NO: 3769109 - DNA, 21 bp, Homo sapiens
gcatgagggatcacagggccc

SEQ ID NO: 3769110 - DNA, 20 bp, Homo sapiens
gcatgatgttaaccagaata

SEQ ID NO: 3769111 - DNA, 14 bp, Homo sapiens
gcatgcacagctgt

SEQ ID NO: 3769112 - DNA, 13 bp, Homo sapiens
gcatgcagaaagg

SEQ ID NO: 3769113 - DNA, 18 bp, Homo sapiens
gcatgcagaaagggagca

SEQ ID NO: 3769114 - DNA, 21 bp, Homo sapiens
gccactgcaccgggccacaga

SEQ ID NO: 3769115 - DNA, 23 bp, Homo sapiens
gccactgcaccgggccacagaga

SEQ ID NO: 3769116 - DNA, 21 bp, Homo sapiens
gccactgcactatagcctagg

SEQ ID NO: 3769117 - DNA, 19 bp, Homo sapiens
gccactgcactccaatctg

SEQ ID NO: 3769118 - DNA, 20 bp, Homo sapiens
gccactgcactccagcctgg

SEQ ID NO: 3769119 - DNA, 19 bp, Homo sapiens
gccactgcataccaacctg

SEQ ID NO: 3769120 - DNA, 21 bp, Homo sapiens
gccactgcccgagctggtgca

SEQ ID NO: 3769121 - DNA, 13 bp, Homo sapiens
gccactgcctctt

SEQ ID NO: 3769122 - DNA, 18 bp, Homo sapiens
gccactgtgaagagaacc

SEQ ID NO: 3769123 - DNA, 19 bp, Homo sapiens
gccactgtgaagagaacca

SEQ ID NO: 3769124 - DNA, 21 bp, Homo sapiens
gccacttaccttcaataaagt

SEQ ID NO: 3769125 - DNA, 21 bp, Homo sapiens
gccacttgatgacccccaacc

SEQ ID NO: 3769126 - DNA, 21 bp, Homo sapiens
gccactttggtacatggccag

SEQ ID NO: 3769127 - DNA, 21 bp, Homo sapiens
gccagaagtttgtcaagtcaa

SEQ ID NO: 3769128 - DNA, 14 bp, Homo sapiens
gccagacatgtggt

SEQ ID NO: 3769129 - DNA, 13 bp, Homo sapiens
gccagaccagagc

SEQ ID NO: 3769130 - DNA, 14 bp, Homo sapiens
gccagaccagagct

SEQ ID NO: 3769131 - DNA, 23 bp, Homo sapiens
gccagaggcagaaccctggtgag

SEQ ID NO: 3769132 - DNA, 18 bp, Homo sapiens
gccagagggagtgacaga

SEQ ID NO: 3769133 - DNA, 17 bp, Homo sapiens
gccagagtggcctggcc

SEQ ID NO: 3769134 - DNA, 22 bp, Homo sapiens
gccagagtggcctggccaggag

SEQ ID NO: 3769135 - DNA, 24 bp, Homo sapiens
gccagagtggcctggccaggagct

SEQ ID NO: 3769136 - DNA, 14 bp, Homo sapiens
gccagatgcaccag

SEQ ID NO: 3769137 - DNA, 15 bp, Homo sapiens
gccagatgcaccagc

SEQ ID NO: 3769138 - DNA, 15 bp, Homo sapiens
gccagcaaggtggag

SEQ ID NO: 3769139 - DNA, 18 bp, Homo sapiens
gccagcaaggtggagtgg

SEQ ID NO: 3769140 - DNA, 15 bp, Homo sapiens
gccagcagccagctc

SEQ ID NO: 3769141 - DNA, 18 bp, Homo sapiens
gccagcagccagctctca

SEQ ID NO: 3769142 - DNA, 16 bp, Homo sapiens
gccagccagcagccag

SEQ ID NO: 3769143 - DNA, 14 bp, Homo sapiens
gccagccccaccca

SEQ ID NO: 3769144 - DNA, 11 bp, Homo sapiens
gccagcccctc

SEQ ID NO: 3769145 - DNA, 12 bp, Homo sapiens
gccagcccctcc

SEQ ID NO: 3769146 - DNA, 16 bp, Homo sapiens
gccagcccctcccacc

SEQ ID NO: 3769147 - DNA, 15 bp, Homo sapiens
gccagccctccctgt

SEQ ID NO: 3769148 - DNA, 17 bp, Homo sapiens
gccagccctccctgtcc

SEQ ID NO: 3769149 - DNA, 20 bp, Homo sapiens
gccagccctccctgtcctcc

SEQ ID NO: 3769150 - DNA, 23 bp, Homo sapiens
gccagccctccctgtcctcctcg

SEQ ID NO: 3769151 - DNA, 11 bp, Homo sapiens
gccagcctggc

SEQ ID NO: 3769152 - DNA, 12 bp, Homo sapiens
gccagcctggct

SEQ ID NO: 3769153 - DNA, 17 bp, Homo sapiens
gccagcctggcttctgg

SEQ ID NO: 3769154 - DNA, 20 bp, Homo sapiens
gccagcctggcttctggagc

SEQ ID NO: 3769155 - DNA, 14 bp, Homo sapiens
gccagctgcagctg

SEQ ID NO: 3769156 - DNA, 19 bp, Homo sapiens
gccagctgcagctgggctg

SEQ ID NO: 3769157 - DNA, 20 bp, Homo sapiens
gccagctgcagctgggctgt

SEQ ID NO: 3769158 - DNA, 18 bp, Homo sapiens
gccagctgcatctactca

SEQ ID NO: 3769159 - DNA, 20 bp, Homo sapiens
gccagctgccgaccagagcc

SEQ ID NO: 3769160 - DNA, 17 bp, Homo sapiens
gccagctggcagcagag

SEQ ID NO: 3769161 - DNA, 21 bp, Homo sapiens
gccagctgggatctgactgca

SEQ ID NO: 3769162 - DNA, 18 bp, Homo sapiens
gccagcttgttatttata

SEQ ID NO: 3769163 - DNA, 14 bp, Homo sapiens
gccaggacaggccc

SEQ ID NO: 3769164 - DNA, 15 bp, Homo sapiens
gccaggacaggcccg

SEQ ID NO: 3769165 - DNA, 17 bp, Homo sapiens
gccaggaccgccaaaga

SEQ ID NO: 3769166 - DNA, 15 bp, Homo sapiens
gccaggcagatctgt

SEQ ID NO: 3769167 - DNA, 21 bp, Homo sapiens
gccaggcagatctgtgcccca

SEQ ID NO: 3769168 - DNA, 23 bp, Homo sapiens
gccaggcagatctgtgccccatg

SEQ ID NO: 3769169 - DNA, 13 bp, Homo sapiens
gccaggccagagg

SEQ ID NO: 3769170 - DNA, 16 bp, Homo sapiens
gccaggcccggggctg

SEQ ID NO: 3769171 - DNA, 17 bp, Homo sapiens
gccaggcccggggctgg

SEQ ID NO: 3769172 - DNA, 18 bp, Homo sapiens
gccaggctccttcctgtc

SEQ ID NO: 3769173 - DNA, 19 bp, Homo sapiens
gccaggctccttcctgtct

SEQ ID NO: 3769174 - DNA, 15 bp, Homo sapiens
gccagggatggggcc

SEQ ID NO: 3769175 - DNA, 19 bp, Homo sapiens
gccagggatggggccacag

SEQ ID NO: 3769176 - DNA, 13 bp, Homo sapiens
gccagggccctgc

SEQ ID NO: 3769177 - DNA, 16 bp, Homo sapiens
gccagggccctgcaga

SEQ ID NO: 3769178 - DNA, 17 bp, Homo sapiens
gccaggggaaaatcagc

SEQ ID NO: 3769179 - DNA, 22 bp, Homo sapiens
gccaggggaaaatcagcctgct

SEQ ID NO: 3769180 - DNA, 14 bp, Homo sapiens
gccaggtgcagtgg

SEQ ID NO: 3769181 - DNA, 17 bp, Homo sapiens
gccaggtttttggtctg

SEQ ID NO: 3769182 - DNA, 15 bp, Homo sapiens
gccagtctagttcct

SEQ ID NO: 3769183 - DNA, 13 bp, Homo sapiens
gccagtctcccag

SEQ ID NO: 3769184 - DNA, 13 bp, Homo sapiens
gccagtcttgtgt

SEQ ID NO: 3769185 - DNA, 17 bp, Homo sapiens
gccagtgaccaaccttt

SEQ ID NO: 3769186 - DNA, 19 bp, Homo sapiens
gccagtgatgctaaaggtt

SEQ ID NO: 3769187 - DNA, 10 bp, Homo sapiens
gccagtgcct

SEQ ID NO: 3769188 - DNA, 11 bp, Homo sapiens
gccagtgcctt

SEQ ID NO: 3769189 - DNA, 15 bp, Homo sapiens
gccagtgccttacct

SEQ ID NO: 3769190 - DNA, 13 bp, Homo sapiens
gccagtgtgacaa

SEQ ID NO: 3769191 - DNA, 17 bp, Homo sapiens
gccagtgtgatcccaag

SEQ ID NO: 3769192 - DNA, 20 bp, Homo sapiens
gccatattctgttggccagt

SEQ ID NO: 3769193 - DNA, 19 bp, Homo sapiens
gccatccaggttcagcttg

SEQ ID NO: 3769194 - DNA, 13 bp, Homo sapiens
gccatctgtgggc

SEQ ID NO: 3769195 - DNA, 17 bp, Homo sapiens
gccatctgtgggcacgc

SEQ ID NO: 3769196 - DNA, 15 bp, Homo sapiens
gccatgaactggagg

SEQ ID NO: 3769197 - DNA, 17 bp, Homo sapiens
gccatgagctccagacc

SEQ ID NO: 3769198 - DNA, 18 bp, Homo sapiens
gccatgagctccagaccc

SEQ ID NO: 3769199 - DNA, 22 bp, Homo sapiens
gccatgagctccagacccccag

SEQ ID NO: 3769200 - DNA, 20 bp, Homo sapiens
gccatgaggagttgctgttt

SEQ ID NO: 3769201 - DNA, 19 bp, Homo sapiens
gccatgaggcctcagtgga

SEQ ID NO: 3769202 - DNA, 13 bp, Homo sapiens
gccatgccagctt

SEQ ID NO: 3769203 - DNA, 19 bp, Homo sapiens
gccatgccagcttatctca

SEQ ID NO: 3769204 - DNA, 18 bp, Homo sapiens
gccatggaggcacacagc

SEQ ID NO: 3769205 - DNA, 16 bp, Homo sapiens
gccatgggcctcctgt

SEQ ID NO: 3769206 - DNA, 17 bp, Homo sapiens
gccatgtgaagagggag

SEQ ID NO: 3769207 - DNA, 18 bp, Homo sapiens
gccatgtgagccaccgct

SEQ ID NO: 3769208 - DNA, 20 bp, Homo sapiens
gccatgtgagccaccgctgc

SEQ ID NO: 3769209 - DNA, 14 bp, Homo sapiens
gccatgtgccaggt

SEQ ID NO: 3769210 - DNA, 14 bp, Homo sapiens
gccatgttggccag

SEQ ID NO: 3769211 - DNA, 17 bp, Homo sapiens
gccatgttggccaggct

SEQ ID NO: 3769212 - DNA, 18 bp, Homo sapiens
gccatgttggccaggctg

SEQ ID NO: 3769213 - DNA, 19 bp, Homo sapiens
gccatgttggccaggctgg

SEQ ID NO: 3769214 - DNA, 15 bp, Homo sapiens
gccatgtttaagatt

SEQ ID NO: 3769215 - DNA, 16 bp, Homo sapiens
gccatgtttaagattt

SEQ ID NO: 3769216 - DNA, 16 bp, Homo sapiens
gccattaccatggaga

SEQ ID NO: 3769217 - DNA, 14 bp, Homo sapiens
gccattccaacagc

SEQ ID NO: 3769218 - DNA, 18 bp, Homo sapiens
gccattctcaagccctgc

SEQ ID NO: 3769219 - DNA, 14 bp, Homo sapiens
gcccaaatctgcct

SEQ ID NO: 3769220 - DNA, 17 bp, Homo sapiens
gcccaaattatcaagct

SEQ ID NO: 3769221 - DNA, 19 bp, Homo sapiens
gcccaaattatcaagctaa

SEQ ID NO: 3769222 - DNA, 20 bp, Homo sapiens
gcccaaattatcaagctaat

SEQ ID NO: 3769223 - DNA, 12 bp, Homo sapiens
gcccaatattat

SEQ ID NO: 3769224 - DNA, 17 bp, Homo sapiens
gcccacagcccgcatgc

SEQ ID NO: 3769225 - DNA, 17 bp, Homo sapiens
gcccacagctcccaccc

SEQ ID NO: 3769226 - DNA, 13 bp, Homo sapiens
gcccacaggatca

SEQ ID NO: 3769227 - DNA, 17 bp, Homo sapiens
gcccacaggtgtcccca

SEQ ID NO: 3769228 - DNA, 12 bp, Homo sapiens
gatctccaaagc

SEQ ID NO: 3769229 - DNA, 15 bp, Homo sapiens
gatctcccagggcta

SEQ ID NO: 3769230 - DNA, 18 bp, Homo sapiens
gatctccctgccgcctca

SEQ ID NO: 3769231 - DNA, 14 bp, Homo sapiens
gatctgactgcacg

SEQ ID NO: 3769232 - DNA, 17 bp, Homo sapiens
gatctgatgcaagcaag

SEQ ID NO: 3769233 - DNA, 19 bp, Homo sapiens
gatctgggaactcccaaga

SEQ ID NO: 3769234 - DNA, 17 bp, Homo sapiens
gatctgggaccctttcc

SEQ ID NO: 3769235 - DNA, 15 bp, Homo sapiens
gatctgtatatacaa

SEQ ID NO: 3769236 - DNA, 19 bp, Homo sapiens
gatcttggcttactgcagc

SEQ ID NO: 3769237 - DNA, 14 bp, Homo sapiens
gatcttgtgctcag

SEQ ID NO: 3769238 - DNA, 17 bp, Homo sapiens
gatcttgtgctcagcat

SEQ ID NO: 3769239 - DNA, 19 bp, Homo sapiens
gatctttcacccacagaaa

SEQ ID NO: 3769240 - DNA, 23 bp, Homo sapiens
gatctttcacccacagaaagaga

SEQ ID NO: 3769241 - DNA, 12 bp, Homo sapiens
gatctttcagga

SEQ ID NO: 3769242 - DNA, 16 bp, Homo sapiens
gatgaaagttccccca

SEQ ID NO: 3769243 - DNA, 15 bp, Homo sapiens
gatgaaatgaggtca

SEQ ID NO: 3769244 - DNA, 20 bp, Homo sapiens
gatgaagaaaagtgggccag

SEQ ID NO: 3769245 - DNA, 19 bp, Homo sapiens
gatgaagttatctggcttc

SEQ ID NO: 3769246 - DNA, 13 bp, Homo sapiens
gatgacccaggct

SEQ ID NO: 3769247 - DNA, 19 bp, Homo sapiens
gatgacctaacctaagcaa

SEQ ID NO: 3769248 - DNA, 12 bp, Homo sapiens
gatgactaaaat

SEQ ID NO: 3769249 - DNA, 18 bp, Homo sapiens
gatgactaaaatatttat

SEQ ID NO: 3769250 - DNA, 16 bp, Homo sapiens
gatgactagaggcagg

SEQ ID NO: 3769251 - DNA, 14 bp, Homo sapiens
gatgactgagtcct

SEQ ID NO: 3769252 - DNA, 17 bp, Homo sapiens
gatgactgagtcctcgt

SEQ ID NO: 3769253 - DNA, 12 bp, Homo sapiens
gatgagcattta

SEQ ID NO: 3769254 - DNA, 17 bp, Homo sapiens
gatgaggtgctgggagg

SEQ ID NO: 3769255 - DNA, 19 bp, Homo sapiens
gatgataatgatgatgacg

SEQ ID NO: 3769256 - DNA, 20 bp, Homo sapiens
gatgatcagctgtttgtcat

SEQ ID NO: 3769257 - DNA, 22 bp, Homo sapiens
gatgatccatgagtttgccctg

SEQ ID NO: 3769258 - DNA, 14 bp, Homo sapiens
gatgatctttgcag

SEQ ID NO: 3769259 - DNA, 22 bp, Homo sapiens
gatgatgcttgtaacaagaaaa

SEQ ID NO: 3769260 - DNA, 13 bp, Homo sapiens
gatgattgtacag

SEQ ID NO: 3769261 - DNA, 14 bp, Homo sapiens
gatgcaaagaaaat

SEQ ID NO: 3769262 - DNA, 14 bp, Homo sapiens
gatgcaaagaggca

SEQ ID NO: 3769263 - DNA, 16 bp, Homo sapiens
gatgcaaagaggcaag

SEQ ID NO: 3769264 - DNA, 17 bp, Homo sapiens
gatgcaaagaggcaaga

SEQ ID NO: 3769265 - DNA, 19 bp, Homo sapiens
gatgcaaggaccaggactc

SEQ ID NO: 3769266 - DNA, 16 bp, Homo sapiens
gatgcacatccctgga

SEQ ID NO: 3769267 - DNA, 13 bp, Homo sapiens
gatgcaccagccc

SEQ ID NO: 3769268 - DNA, 18 bp, Homo sapiens
gatgccatctgtgggcac

SEQ ID NO: 3769269 - DNA, 18 bp, Homo sapiens
gatgcccagagggcccag

SEQ ID NO: 3769270 - DNA, 20 bp, Homo sapiens
gatgcccagagggcccaggc

SEQ ID NO: 3769271 - DNA, 22 bp, Homo sapiens
gatgcccagagggcccaggcag

SEQ ID NO: 3769272 - DNA, 21 bp, Homo sapiens
gatgcccagggccactctgcc

SEQ ID NO: 3769273 - DNA, 16 bp, Homo sapiens
gatgccccagagctgt

SEQ ID NO: 3769274 - DNA, 23 bp, Homo sapiens
gatgcctcatgatatgtcagggc

SEQ ID NO: 3769275 - DNA, 16 bp, Homo sapiens
gatgcctccaccgctg

SEQ ID NO: 3769276 - DNA, 19 bp, Homo sapiens
gatgcctccctgaccctgc

SEQ ID NO: 3769277 - DNA, 22 bp, Homo sapiens
gatgcctccctgaccctgcaga

SEQ ID NO: 3769278 - DNA, 23 bp, Homo sapiens
gatgctcaggtacagagaaggaa

SEQ ID NO: 3769279 - DNA, 13 bp, Homo sapiens
gatgctccagcca

SEQ ID NO: 3769280 - DNA, 20 bp, Homo sapiens
gatgctccctcccctgccct

SEQ ID NO: 3769281 - DNA, 21 bp, Homo sapiens
gatgctccctcccctgccctg

SEQ ID NO: 3769282 - DNA, 23 bp, Homo sapiens
gatgctgccagggcgccatcgcc

SEQ ID NO: 3769283 - DNA, 12 bp, Homo sapiens
gatgctgcctga

SEQ ID NO: 3769284 - DNA, 16 bp, Homo sapiens
gatgctggatgctcct

SEQ ID NO: 3769285 - DNA, 24 bp, Homo sapiens
gatgcttgcctagggcctggtcca

SEQ ID NO: 3769286 - DNA, 15 bp, Homo sapiens
gatggaaaaggaaga

SEQ ID NO: 3769287 - DNA, 22 bp, Homo sapiens
gatggaaccgcaggaagctgct

SEQ ID NO: 3769288 - DNA, 16 bp, Homo sapiens
gatggagagaggggaa

SEQ ID NO: 3769289 - DNA, 23 bp, Homo sapiens
gatggaggaaaaccaagccgtgg

SEQ ID NO: 3769290 - DNA, 11 bp, Homo sapiens
gatggaggagg

SEQ ID NO: 3769291 - DNA, 22 bp, Homo sapiens
gatggaggggtggtcctgactc

SEQ ID NO: 3769292 - DNA, 22 bp, Homo sapiens
gatggatttccagccaaagcct

SEQ ID NO: 3769293 - DNA, 14 bp, Homo sapiens
gatggatttgcctg

SEQ ID NO: 3769294 - DNA, 14 bp, Homo sapiens
gatggcgctaggca

SEQ ID NO: 3769295 - DNA, 16 bp, Homo sapiens
gatggcttttgtttct

SEQ ID NO: 3769296 - DNA, 15 bp, Homo sapiens
gatgggactgggagg

SEQ ID NO: 3769297 - DNA, 17 bp, Homo sapiens
gatgggactgggagggc

SEQ ID NO: 3769298 - DNA, 22 bp, Homo sapiens
gatgggcaacccccagcctgct

SEQ ID NO: 3769299 - DNA, 13 bp, Homo sapiens
gatggttcccctg

SEQ ID NO: 3769300 - DNA, 20 bp, Homo sapiens
gatgtaaacagtgcctgctg

SEQ ID NO: 3769301 - DNA, 15 bp, Homo sapiens
gatgtacatttccaa

SEQ ID NO: 3769302 - DNA, 22 bp, Homo sapiens
gatgtacatttccaaattcaca

SEQ ID NO: 3769303 - DNA, 18 bp, Homo sapiens
gatgtcccaacttgtaaa

SEQ ID NO: 3769304 - DNA, 20 bp, Homo sapiens
gatgtcttatttttagatgg

SEQ ID NO: 3769305 - DNA, 21 bp, Homo sapiens
gatgtgcatttttgtgaaatg

SEQ ID NO: 3769306 - DNA, 14 bp, Homo sapiens
gatgtggccctggc

SEQ ID NO: 3769307 - DNA, 21 bp, Homo sapiens
gatgtggccctggcctgctgg

SEQ ID NO: 3769308 - DNA, 17 bp, Homo sapiens
gatgtgtcttcaatttg

SEQ ID NO: 3769309 - DNA, 16 bp, Homo sapiens
gatgttaggctgggcc

SEQ ID NO: 3769310 - DNA, 18 bp, Homo sapiens
gatgttcactgtggcatt

SEQ ID NO: 3769311 - DNA, 14 bp, Homo sapiens
gatgttctggccct

SEQ ID NO: 3769312 - DNA, 13 bp, Homo sapiens
gatgtttgtggcc

SEQ ID NO: 3769313 - DNA, 14 bp, Homo sapiens
gatgtttgtggcct

SEQ ID NO: 3769314 - DNA, 18 bp, Homo sapiens
gatgtttgtggcctcaga

SEQ ID NO: 3769315 - DNA, 18 bp, Homo sapiens
gattaaccacttcagctg

SEQ ID NO: 3769316 - DNA, 21 bp, Homo sapiens
gattaaccacttcagctgact

SEQ ID NO: 3769317 - DNA, 17 bp, Homo sapiens
gattaaggtctctcttt

SEQ ID NO: 3769318 - DNA, 23 bp, Homo sapiens
gattactctttgagatagaagaa

SEQ ID NO: 3769319 - DNA, 21 bp, Homo sapiens
gattagaaatgaccaatatta

SEQ ID NO: 3769320 - DNA, 19 bp, Homo sapiens
gattagcaagttacagtga

SEQ ID NO: 3769321 - DNA, 17 bp, Homo sapiens
gattatattgagacaaa

SEQ ID NO: 3769322 - DNA, 20 bp, Homo sapiens
gattattagccaggtaatgt

SEQ ID NO: 3769323 - DNA, 23 bp, Homo sapiens
gattattccctgtacaatattta

SEQ ID NO: 3769324 - DNA, 18 bp, Homo sapiens
gattcacaatgaaatgct

SEQ ID NO: 3769325 - DNA, 14 bp, Homo sapiens
gattcacctgtaaa

SEQ ID NO: 3769326 - DNA, 15 bp, Homo sapiens
gattcacctgtaaaa

SEQ ID NO: 3769327 - DNA, 16 bp, Homo sapiens
gattcacctgtaaaac

SEQ ID NO: 3769328 - DNA, 17 bp, Homo sapiens
gattcatatttacttct

SEQ ID NO: 3769329 - DNA, 15 bp, Homo sapiens
gcacaaatatttatt

SEQ ID NO: 3769330 - DNA, 19 bp, Homo sapiens
gcacaaggctgaccaagag

SEQ ID NO: 3769331 - DNA, 12 bp, Homo sapiens
gcacaatgtctt

SEQ ID NO: 3769332 - DNA, 19 bp, Homo sapiens
gcacacacacacacaggag

SEQ ID NO: 3769333 - DNA, 14 bp, Homo sapiens
gcacacaccagagc

SEQ ID NO: 3769334 - DNA, 15 bp, Homo sapiens
gcacacaccagagcc

SEQ ID NO: 3769335 - DNA, 18 bp, Homo sapiens
gcacacaccagagcccac

SEQ ID NO: 3769336 - DNA, 14 bp, Homo sapiens
gcacaccgggcact

SEQ ID NO: 3769337 - DNA, 21 bp, Homo sapiens
gcacactcagcacccccttct

SEQ ID NO: 3769338 - DNA, 23 bp, Homo sapiens
gcacactcagcacccccttctct

SEQ ID NO: 3769339 - DNA, 15 bp, Homo sapiens
gcacactcccctgca

SEQ ID NO: 3769340 - DNA, 20 bp, Homo sapiens
gcacactcccctgcactgga

SEQ ID NO: 3769341 - DNA, 16 bp, Homo sapiens
gcacagaaaactagaa

SEQ ID NO: 3769342 - DNA, 12 bp, Homo sapiens
gcacagaaggag

SEQ ID NO: 3769343 - DNA, 18 bp, Homo sapiens
gcacagacgtccctccac

SEQ ID NO: 3769344 - DNA, 15 bp, Homo sapiens
gcacagatggatttg

SEQ ID NO: 3769345 - DNA, 19 bp, Homo sapiens
gcacagatggatttgcctg

SEQ ID NO: 3769346 - DNA, 12 bp, Homo sapiens
gcacagctgtgg

SEQ ID NO: 3769347 - DNA, 16 bp, Homo sapiens
gcacagcttcatttcc

SEQ ID NO: 3769348 - DNA, 23 bp, Homo sapiens
gcacagcttcatttcctgtgtct

SEQ ID NO: 3769349 - DNA, 16 bp, Homo sapiens
gcacagggcagtggga

SEQ ID NO: 3769350 - DNA, 14 bp, Homo sapiens
gcacatagagaggg

SEQ ID NO: 3769351 - DNA, 22 bp, Homo sapiens
gcacatttccccagacctgagc

SEQ ID NO: 3769352 - DNA, 13 bp, Homo sapiens
gcaccaagcccac

SEQ ID NO: 3769353 - DNA, 17 bp, Homo sapiens
gcaccaagcccacaggt

SEQ ID NO: 3769354 - DNA, 16 bp, Homo sapiens
gcaccaccaggtctcc

SEQ ID NO: 3769355 - DNA, 20 bp, Homo sapiens
gcaccaccctagtcccttcc

SEQ ID NO: 3769356 - DNA, 22 bp, Homo sapiens
gcaccaccctagtcccttcccc

SEQ ID NO: 3769357 - DNA, 23 bp, Homo sapiens
gcaccaccctagtcccttcccct

SEQ ID NO: 3769358 - DNA, 13 bp, Homo sapiens
gcaccagcagcct

SEQ ID NO: 3769359 - DNA, 16 bp, Homo sapiens
gcaccagcagcctgga

SEQ ID NO: 3769360 - DNA, 12 bp, Homo sapiens
gcaccaggagac

SEQ ID NO: 3769361 - DNA, 13 bp, Homo sapiens
gcaccagggaaga

SEQ ID NO: 3769362 - DNA, 20 bp, Homo sapiens
gcaccagtgtcctcccctca

SEQ ID NO: 3769363 - DNA, 12 bp, Homo sapiens
gcaccataactt

SEQ ID NO: 3769364 - DNA, 20 bp, Homo sapiens
gcaccatctctgattttcaa

SEQ ID NO: 3769365 - DNA, 15 bp, Homo sapiens
gcacccatcctagag

SEQ ID NO: 3769366 - DNA, 13 bp, Homo sapiens
gcacccccaccct

SEQ ID NO: 3769367 - DNA, 14 bp, Homo sapiens
gcacccccctgggc

SEQ ID NO: 3769368 - DNA, 17 bp, Homo sapiens
gcacccggcccctgctg

SEQ ID NO: 3769369 - DNA, 19 bp, Homo sapiens
gcacccggcccctgctggt

SEQ ID NO: 3769370 - DNA, 19 bp, Homo sapiens
gcaccctcgatgaagccca

SEQ ID NO: 3769371 - DNA, 21 bp, Homo sapiens
gcacctatagtcccagctact

SEQ ID NO: 3769372 - DNA, 12 bp, Homo sapiens
gcacctcccagc

SEQ ID NO: 3769373 - DNA, 11 bp, Homo sapiens
gcacctcccat

SEQ ID NO: 3769374 - DNA, 17 bp, Homo sapiens
gcacctcccatcctaat

SEQ ID NO: 3769375 - DNA, 13 bp, Homo sapiens
gcacctcccccca

SEQ ID NO: 3769376 - DNA, 18 bp, Homo sapiens
gcacctgccccctggtgg

SEQ ID NO: 3769377 - DNA, 19 bp, Homo sapiens
gcacctgtcgcccagtgcc

SEQ ID NO: 3769378 - DNA, 16 bp, Homo sapiens
gcacgaacccacctgc

SEQ ID NO: 3769379 - DNA, 19 bp, Homo sapiens
gcacgaacccacctgctga

SEQ ID NO: 3769380 - DNA, 15 bp, Homo sapiens
gcacgcacactgtct

SEQ ID NO: 3769381 - DNA, 14 bp, Homo sapiens
gcacgtgtgtgcac

SEQ ID NO: 3769382 - DNA, 18 bp, Homo sapiens
gcactaaggtgtgctctg

SEQ ID NO: 3769383 - DNA, 15 bp, Homo sapiens
gcactataatgtaag

SEQ ID NO: 3769384 - DNA, 22 bp, Homo sapiens
gcactatagcctaggtgacaga

SEQ ID NO: 3769385 - DNA, 16 bp, Homo sapiens
gcactcagaagacact

SEQ ID NO: 3769386 - DNA, 15 bp, Homo sapiens
gcactccagcctggg

SEQ ID NO: 3769387 - DNA, 18 bp, Homo sapiens
gcactctagccggagtga

SEQ ID NO: 3769388 - DNA, 12 bp, Homo sapiens
gcactgacattg

SEQ ID NO: 3769389 - DNA, 20 bp, Homo sapiens
gcactgacccacagcctctg

SEQ ID NO: 3769390 - DNA, 15 bp, Homo sapiens
gcactgctgcccagc

SEQ ID NO: 3769391 - DNA, 14 bp, Homo sapiens
gcactggagtccag

SEQ ID NO: 3769392 - DNA, 18 bp, Homo sapiens
gcactgggttgactttca

SEQ ID NO: 3769393 - DNA, 19 bp, Homo sapiens
gcactgtctcagtttcact

SEQ ID NO: 3769394 - DNA, 22 bp, Homo sapiens
gcacttacagataggccttctt

SEQ ID NO: 3769395 - DNA, 22 bp, Homo sapiens
gcacttgcacgcccatgtgtga

SEQ ID NO: 3769396 - DNA, 16 bp, Homo sapiens
gcacttggagccaagg

SEQ ID NO: 3769397 - DNA, 22 bp, Homo sapiens
gcacttggagccaagggttcag

SEQ ID NO: 3769398 - DNA, 21 bp, Homo sapiens
gcactttcattgccagtgtct

SEQ ID NO: 3769399 - DNA, 20 bp, Homo sapiens
gcactttgggaggccgaggc

SEQ ID NO: 3769400 - DNA, 21 bp, Homo sapiens
gcactttgggaggctgaggcg

SEQ ID NO: 3769401 - DNA, 16 bp, Homo sapiens
gcagaaccctggtgag

SEQ ID NO: 3769402 - DNA, 18 bp, Homo sapiens
gcagaactgagctcctct

SEQ ID NO: 3769403 - DNA, 14 bp, Homo sapiens
gcagaatagtattt

SEQ ID NO: 3769404 - DNA, 13 bp, Homo sapiens
gcagacagcagct

SEQ ID NO: 3769405 - DNA, 17 bp, Homo sapiens
gcagacagcagctcagg

SEQ ID NO: 3769406 - DNA, 19 bp, Homo sapiens
gcagacatgtgcacttgaa

SEQ ID NO: 3769407 - DNA, 18 bp, Homo sapiens
gcagactctacagaggcc

SEQ ID NO: 3769408 - DNA, 13 bp, Homo sapiens
gcagactggaggg

SEQ ID NO: 3769409 - DNA, 13 bp, Homo sapiens
gcagactggtggg

SEQ ID NO: 3769410 - DNA, 22 bp, Homo sapiens
gcagagaatgaaagggcccaga

SEQ ID NO: 3769411 - DNA, 14 bp, Homo sapiens
gcagagtcagcaga

SEQ ID NO: 3769412 - DNA, 14 bp, Homo sapiens
gcagagtgccccac

SEQ ID NO: 3769413 - DNA, 21 bp, Homo sapiens
gcagagtgccccacctgccac

SEQ ID NO: 3769414 - DNA, 13 bp, Homo sapiens
gcagatgatccat

SEQ ID NO: 3769415 - DNA, 15 bp, Homo sapiens
gcagatgcaaagagg

SEQ ID NO: 3769416 - DNA, 16 bp, Homo sapiens
gcagatgcaaagaggc

SEQ ID NO: 3769417 - DNA, 20 bp, Homo sapiens
gcagatttagtgaaagctag

SEQ ID NO: 3769418 - DNA, 17 bp, Homo sapiens
gcagattttacaaaaga

SEQ ID NO: 3769419 - DNA, 15 bp, Homo sapiens
gcagcaaccagagca

SEQ ID NO: 3769420 - DNA, 16 bp, Homo sapiens
gcagcaaccagagcac

SEQ ID NO: 3769421 - DNA, 18 bp, Homo sapiens
gcagcaaccagagcactg

SEQ ID NO: 3769422 - DNA, 20 bp, Homo sapiens
gcagcaaccagagcactgta

SEQ ID NO: 3769423 - DNA, 14 bp, Homo sapiens
gcagcaggcctgtt

SEQ ID NO: 3769424 - DNA, 15 bp, Homo sapiens
gcagcatctgctaat

SEQ ID NO: 3769425 - DNA, 21 bp, Homo sapiens
gcagccaaacccatgaggcaa

SEQ ID NO: 3769426 - DNA, 17 bp, Homo sapiens
gcagccaagctccttgg

SEQ ID NO: 3769427 - DNA, 15 bp, Homo sapiens
gcagccagcccagcc

SEQ ID NO: 3769428 - DNA, 16 bp, Homo sapiens
gcagccagctctcagc

SEQ ID NO: 3769429 - DNA, 17 bp, Homo sapiens
gcagccaggctgccaag

SEQ ID NO: 3769430 - DNA, 15 bp, Homo sapiens
gcagcccatgcccac

SEQ ID NO: 3769431 - DNA, 21 bp, Homo sapiens
gcagcccgtgtggccccttca

SEQ ID NO: 3769432 - DNA, 18 bp, Homo sapiens
gcagccctcctcaccccg

SEQ ID NO: 3769433 - DNA, 14 bp, Homo sapiens
gcagccgtgccttc

SEQ ID NO: 3769434 - DNA, 15 bp, Homo sapiens
gcagccgtgccttca

SEQ ID NO: 3769435 - DNA, 17 bp, Homo sapiens
gcagccgtgccttcagc

SEQ ID NO: 3769436 - DNA, 16 bp, Homo sapiens
gcagcctactagggac

SEQ ID NO: 3769437 - DNA, 23 bp, Homo sapiens
gcagcctactagggacctgggga

SEQ ID NO: 3769438 - DNA, 20 bp, Homo sapiens
gcagcctcaacctcctgggc

SEQ ID NO: 3769439 - DNA, 22 bp, Homo sapiens
gcagcctcaacctcctgggcta

SEQ ID NO: 3769440 - DNA, 16 bp, Homo sapiens
gcagcctccctctgac

SEQ ID NO: 3769441 - DNA, 22 bp, Homo sapiens
gcagcctccctctgacctgcag

SEQ ID NO: 3769442 - DNA, 23 bp, Homo sapiens
gcagcctccctctgacctgcagg

SEQ ID NO: 3769443 - DNA, 14 bp, Homo sapiens
gcctgttgcccttt

SEQ ID NO: 3769444 - DNA, 16 bp, Homo sapiens
gccttaaaactttaat

SEQ ID NO: 3769445 - DNA, 19 bp, Homo sapiens
gccttaaaagccatcatgt

SEQ ID NO: 3769446 - DNA, 20 bp, Homo sapiens
gccttacctcctgcccagga

SEQ ID NO: 3769447 - DNA, 16 bp, Homo sapiens
gccttactttgtatga

SEQ ID NO: 3769448 - DNA, 22 bp, Homo sapiens
gccttccacgctgtctccagac

SEQ ID NO: 3769449 - DNA, 14 bp, Homo sapiens
gccttccataatta

SEQ ID NO: 3769450 - DNA, 21 bp, Homo sapiens
gccttccataattatgacagt

SEQ ID NO: 3769451 - DNA, 16 bp, Homo sapiens
gccttccccagcctct

SEQ ID NO: 3769452 - DNA, 17 bp, Homo sapiens
gccttccccagcctctt

SEQ ID NO: 3769453 - DNA, 23 bp, Homo sapiens
gccttccccctcccagggccagg

SEQ ID NO: 3769454 - DNA, 16 bp, Homo sapiens
gccttccccttgccca

SEQ ID NO: 3769455 - DNA, 23 bp, Homo sapiens
gccttcgatacaccgggcctgga

SEQ ID NO: 3769456 - DNA, 22 bp, Homo sapiens
gccttcttcggggaactcctgg

SEQ ID NO: 3769457 - DNA, 12 bp, Homo sapiens
gccttgcccaga

SEQ ID NO: 3769458 - DNA, 15 bp, Homo sapiens
gccttgcccagagat

SEQ ID NO: 3769459 - DNA, 22 bp, Homo sapiens
gccttgcccagagatgcctcca

SEQ ID NO: 3769460 - DNA, 21 bp, Homo sapiens
gccttggataatgctgttgcc

SEQ ID NO: 3769461 - DNA, 23 bp, Homo sapiens
gccttggataatgctgttgcctc

SEQ ID NO: 3769462 - DNA, 14 bp, Homo sapiens
gccttgggctgctc

SEQ ID NO: 3769463 - DNA, 16 bp, Homo sapiens
gccttgggctgctcct

SEQ ID NO: 3769464 - DNA, 18 bp, Homo sapiens
gccttggtctaacttttg

SEQ ID NO: 3769465 - DNA, 19 bp, Homo sapiens
gccttggtgtccacctggc

SEQ ID NO: 3769466 - DNA, 22 bp, Homo sapiens
gccttggtgtccacctggcccc

SEQ ID NO: 3769467 - DNA, 18 bp, Homo sapiens
gccttggttcccttgtgt

SEQ ID NO: 3769468 - DNA, 22 bp, Homo sapiens
gcctttccataaggaatgtagc

SEQ ID NO: 3769469 - DNA, 18 bp, Homo sapiens
gcctttctcccaggccag

SEQ ID NO: 3769470 - DNA, 22 bp, Homo sapiens
gcctttgagtttcctcaggctg

SEQ ID NO: 3769471 - DNA, 15 bp, Homo sapiens
gcctttgcctccccg

SEQ ID NO: 3769472 - DNA, 14 bp, Homo sapiens
gcgaaggggccctg

SEQ ID NO: 3769473 - DNA, 15 bp, Homo sapiens
gcgaaggggccctgg

SEQ ID NO: 3769474 - DNA, 16 bp, Homo sapiens
gcgaaggggccctggt

SEQ ID NO: 3769475 - DNA, 17 bp, Homo sapiens
gcgacggagagaaaaaa

SEQ ID NO: 3769476 - DNA, 20 bp, Homo sapiens
gcgagaacctaagtttcagt

SEQ ID NO: 3769477 - DNA, 18 bp, Homo sapiens
gcgagactccgtctcaaa

SEQ ID NO: 3769478 - DNA, 23 bp, Homo sapiens
gcgagatggggtggggtggagaa

SEQ ID NO: 3769479 - DNA, 14 bp, Homo sapiens
gcgaggggagggtg

SEQ ID NO: 3769480 - DNA, 18 bp, Homo sapiens
gcgaggtcaacagagaag

SEQ ID NO: 3769481 - DNA, 22 bp, Homo sapiens
gcgaggtcaacagagaaggcag

SEQ ID NO: 3769482 - DNA, 23 bp, Homo sapiens
gcgaggtcaacagagaaggcagg

SEQ ID NO: 3769483 - DNA, 18 bp, Homo sapiens
gcgatcatggctcactgc

SEQ ID NO: 3769484 - DNA, 20 bp, Homo sapiens
gcgatcatggctcactgcag

SEQ ID NO: 3769485 - DNA, 21 bp, Homo sapiens
gcgatccacctgtctcagcct

SEQ ID NO: 3769486 - DNA, 19 bp, Homo sapiens
gcgatgaatttggagactc

SEQ ID NO: 3769487 - DNA, 14 bp, Homo sapiens
gcgattcttctgct

SEQ ID NO: 3769488 - DNA, 17 bp, Homo sapiens
gcgattcttctgcttca

SEQ ID NO: 3769489 - DNA, 22 bp, Homo sapiens
gcgattcttctgcttcagcctc

SEQ ID NO: 3769490 - DNA, 23 bp, Homo sapiens
gcgattcttctgcttcagcctcc

SEQ ID NO: 3769491 - DNA, 12 bp, Homo sapiens
gcgcaagcctgt

SEQ ID NO: 3769492 - DNA, 21 bp, Homo sapiens
gcgcaagcctgtaatcccagc

SEQ ID NO: 3769493 - DNA, 17 bp, Homo sapiens
gcgcacaaggctgacca

SEQ ID NO: 3769494 - DNA, 12 bp, Homo sapiens
gcgcacctgccc

SEQ ID NO: 3769495 - DNA, 17 bp, Homo sapiens
gcgcacctgccccctgg

SEQ ID NO: 3769496 - DNA, 18 bp, Homo sapiens
gcgcagtgcttctctaca

SEQ ID NO: 3769497 - DNA, 22 bp, Homo sapiens
gcgccactacactccagcctga

SEQ ID NO: 3769498 - DNA, 23 bp, Homo sapiens
gcgccactcgcttcccccatagc

SEQ ID NO: 3769499 - DNA, 21 bp, Homo sapiens
gcgcctacaggagtgagcact

SEQ ID NO: 3769500 - DNA, 15 bp, Homo sapiens
gcgcctccttccttg

SEQ ID NO: 3769501 - DNA, 17 bp, Homo sapiens
gcgcctgcccctcccag

SEQ ID NO: 3769502 - DNA, 18 bp, Homo sapiens
gcgcctgcccctcccaga

SEQ ID NO: 3769503 - DNA, 14 bp, Homo sapiens
gcgcgccactcgct

SEQ ID NO: 3769504 - DNA, 16 bp, Homo sapiens
gcgctctagcctgggc

SEQ ID NO: 3769505 - DNA, 19 bp, Homo sapiens
gcgctgacaaccaccgctc

SEQ ID NO: 3769506 - DNA, 21 bp, Homo sapiens
gcgctgccgcaccccagagtg

SEQ ID NO: 3769507 - DNA, 19 bp, Homo sapiens
gcggaatgaaccacatctt

SEQ ID NO: 3769508 - DNA, 23 bp, Homo sapiens
gcggacagccacggccaggccag

SEQ ID NO: 3769509 - DNA, 16 bp, Homo sapiens
gcggagcttgcagtga

SEQ ID NO: 3769510 - DNA, 16 bp, Homo sapiens
gcggaggttgcaggga

SEQ ID NO: 3769511 - DNA, 22 bp, Homo sapiens
gcggcaggagggaggtttgtga

SEQ ID NO: 3769512 - DNA, 17 bp, Homo sapiens
gcggccgcattccctga

SEQ ID NO: 3769513 - DNA, 18 bp, Homo sapiens
gcggccgcattccctgag

SEQ ID NO: 3769514 - DNA, 14 bp, Homo sapiens
gcgggaaggagggt

SEQ ID NO: 3769515 - DNA, 17 bp, Homo sapiens
gcgggagacctgtgcta

SEQ ID NO: 3769516 - DNA, 21 bp, Homo sapiens
gcgggaggatgttctgggaca

SEQ ID NO: 3769517 - DNA, 16 bp, Homo sapiens
gcgggatggtcctggg

SEQ ID NO: 3769518 - DNA, 13 bp, Homo sapiens
gcgggccaaggac

SEQ ID NO: 3769519 - DNA, 14 bp, Homo sapiens
gcggggacagctcc

SEQ ID NO: 3769520 - DNA, 17 bp, Homo sapiens
gcggggacagctccttc

SEQ ID NO: 3769521 - DNA, 19 bp, Homo sapiens
gctcaggtgtccctgcact

SEQ ID NO: 3769522 - DNA, 21 bp, Homo sapiens
gctcagtaatttgaggacaac

SEQ ID NO: 3769523 - DNA, 14 bp, Homo sapiens
gctcagtctcagga

SEQ ID NO: 3769524 - DNA, 17 bp, Homo sapiens
gctcagtctcaggagca

SEQ ID NO: 3769525 - DNA, 18 bp, Homo sapiens
gctcatggtccccatggc

SEQ ID NO: 3769526 - DNA, 15 bp, Homo sapiens
gctcatgtagcaatc

SEQ ID NO: 3769527 - DNA, 21 bp, Homo sapiens
gctccacaccctctcccagga

SEQ ID NO: 3769528 - DNA, 12 bp, Homo sapiens
gctccaccacat

SEQ ID NO: 3769529 - DNA, 15 bp, Homo sapiens
gctccaccccactca

SEQ ID NO: 3769530 - DNA, 19 bp, Homo sapiens
gctccaccccactcacaga

SEQ ID NO: 3769531 - DNA, 20 bp, Homo sapiens
gctccaccccactcacagag

SEQ ID NO: 3769532 - DNA, 17 bp, Homo sapiens
gctccacccttggcctg

SEQ ID NO: 3769533 - DNA, 22 bp, Homo sapiens
gctccacccttggcctgtctca

SEQ ID NO: 3769534 - DNA, 14 bp, Homo sapiens
gctccagaccccca

SEQ ID NO: 3769535 - DNA, 15 bp, Homo sapiens
gctccagacccccag

SEQ ID NO: 3769536 - DNA, 18 bp, Homo sapiens
gctccagctcaccagccc

SEQ ID NO: 3769537 - DNA, 21 bp, Homo sapiens
gctccagctgctctgtcttct

SEQ ID NO: 3769538 - DNA, 12 bp, Homo sapiens
gctccaggctcc

SEQ ID NO: 3769539 - DNA, 13 bp, Homo sapiens
gctccaggctcct

SEQ ID NO: 3769540 - DNA, 23 bp, Homo sapiens
gctccaggctcctttagcgccca

SEQ ID NO: 3769541 - DNA, 15 bp, Homo sapiens
gctccagggccagat

SEQ ID NO: 3769542 - DNA, 23 bp, Homo sapiens
gctccagtcctgctctctaccca

SEQ ID NO: 3769543 - DNA, 21 bp, Homo sapiens
gctccagtctgctgccctcca

SEQ ID NO: 3769544 - DNA, 14 bp, Homo sapiens
gctccccagcccag

SEQ ID NO: 3769545 - DNA, 14 bp, Homo sapiens
gctcccccatcctc

SEQ ID NO: 3769546 - DNA, 17 bp, Homo sapiens
gctcccccatcctcccc

SEQ ID NO: 3769547 - DNA, 18 bp, Homo sapiens
gctccctccccctgcccc

SEQ ID NO: 3769548 - DNA, 22 bp, Homo sapiens
gctccctccccctgccccttct

SEQ ID NO: 3769549 - DNA, 17 bp, Homo sapiens
gctccctcccctgccct

SEQ ID NO: 3769550 - DNA, 15 bp, Homo sapiens
gctcccttgtgcgtg

SEQ ID NO: 3769551 - DNA, 22 bp, Homo sapiens
gctccgctttctacccagcgag

SEQ ID NO: 3769552 - DNA, 23 bp, Homo sapiens
gctccgctttctacccagcgagc

SEQ ID NO: 3769553 - DNA, 14 bp, Homo sapiens
gctcctccagggcc

SEQ ID NO: 3769554 - DNA, 22 bp, Homo sapiens
gctcctgaggggcatctgcccc

SEQ ID NO: 3769555 - DNA, 22 bp, Homo sapiens
gctcctggaaaggctcagtctc

SEQ ID NO: 3769556 - DNA, 14 bp, Homo sapiens
gctcctggcccact

SEQ ID NO: 3769557 - DNA, 19 bp, Homo sapiens
gctcctggtcttgagatgt

SEQ ID NO: 3769558 - DNA, 19 bp, Homo sapiens
gctcctgtctgccagccag

SEQ ID NO: 3769559 - DNA, 13 bp, Homo sapiens
gctcctgtgtctt

SEQ ID NO: 3769560 - DNA, 13 bp, Homo sapiens
gctccttctgtcc

SEQ ID NO: 3769561 - DNA, 13 bp, Homo sapiens
gctccttgggagg

SEQ ID NO: 3769562 - DNA, 14 bp, Homo sapiens
gctccttgggaggc

SEQ ID NO: 3769563 - DNA, 22 bp, Homo sapiens
gctccttgggaggccccactgg

SEQ ID NO: 3769564 - DNA, 12 bp, Homo sapiens
gctctaattgaa

SEQ ID NO: 3769565 - DNA, 11 bp, Homo sapiens
gctctcagaag

SEQ ID NO: 3769566 - DNA, 14 bp, Homo sapiens
gctctccacctcag

SEQ ID NO: 3769567 - DNA, 15 bp, Homo sapiens
gctctccacctcagc

SEQ ID NO: 3769568 - DNA, 19 bp, Homo sapiens
gctctcccctgccctgctg

SEQ ID NO: 3769569 - DNA, 14 bp, Homo sapiens
gctctccctctggc

SEQ ID NO: 3769570 - DNA, 20 bp, Homo sapiens
gctctccctctggccctgcc

SEQ ID NO: 3769571 - DNA, 19 bp, Homo sapiens
gctctcgggttgtgtgtct

SEQ ID NO: 3769572 - DNA, 13 bp, Homo sapiens
gctctctacccag

SEQ ID NO: 3769573 - DNA, 15 bp, Homo sapiens
gctctctgcagccag

SEQ ID NO: 3769574 - DNA, 20 bp, Homo sapiens
gctctctgcagccagcccag

SEQ ID NO: 3769575 - DNA, 21 bp, Homo sapiens
gctctctgcagccagcccagc

SEQ ID NO: 3769576 - DNA, 11 bp, Homo sapiens
gctctctgctg

SEQ ID NO: 3769577 - DNA, 23 bp, Homo sapiens
gctctgaagtcacatcacaggac

SEQ ID NO: 3769578 - DNA, 18 bp, Homo sapiens
gctctgaggactgcacca

SEQ ID NO: 3769579 - DNA, 11 bp, Homo sapiens
gctctgcacag

SEQ ID NO: 3769580 - DNA, 15 bp, Homo sapiens
gctctgcacagatgg

SEQ ID NO: 3769581 - DNA, 14 bp, Homo sapiens
gctctgcccagagc

SEQ ID NO: 3769582 - DNA, 16 bp, Homo sapiens
gctctgcccagagctg

SEQ ID NO: 3769583 - DNA, 21 bp, Homo sapiens
gctctgctcctctccccagca

SEQ ID NO: 3769584 - DNA, 14 bp, Homo sapiens
gctctgctgacaga

SEQ ID NO: 3769585 - DNA, 19 bp, Homo sapiens
gctctgctgacagacacag

SEQ ID NO: 3769586 - DNA, 20 bp, Homo sapiens
gctctgctgacagacacagg

SEQ ID NO: 3769587 - DNA, 13 bp, Homo sapiens
gctctgcttgccg

SEQ ID NO: 3769588 - DNA, 15 bp, Homo sapiens
gctctggaagagagg

SEQ ID NO: 3769589 - DNA, 14 bp, Homo sapiens
gctctggacaggca

SEQ ID NO: 3769590 - DNA, 21 bp, Homo sapiens
gctctggacaggcatgttctc

SEQ ID NO: 3769591 - DNA, 16 bp, Homo sapiens
gctctggagccacctg

SEQ ID NO: 3769592 - DNA, 15 bp, Homo sapiens
gctctggctcacaga

SEQ ID NO: 3769593 - DNA, 14 bp, Homo sapiens
gctctgtcctggga

SEQ ID NO: 3769594 - DNA, 15 bp, Homo sapiens
gctcttcaggcctcc

SEQ ID NO: 3769595 - DNA, 18 bp, Homo sapiens
gctcttcaggcctccctc

SEQ ID NO: 3769596 - DNA, 19 bp, Homo sapiens
gctcttcagtgggagaaaa

SEQ ID NO: 3769597 - DNA, 13 bp, Homo sapiens
gctcttctccttt

SEQ ID NO: 3769598 - DNA, 17 bp, Homo sapiens
gctcttctcctttcaca

SEQ ID NO: 3769599 - DNA, 23 bp, Homo sapiens
gctcttctcctttcacaaccttc

SEQ ID NO: 3769600 - DNA, 14 bp, Homo sapiens
gctctttctgggcc

SEQ ID NO: 3769601 - DNA, 23 bp, Homo sapiens
gctctttgaaatagtctgtgtga

SEQ ID NO: 3769602 - DNA, 13 bp, Homo sapiens
gctctttggtaga

SEQ ID NO: 3769603 - DNA, 18 bp, Homo sapiens
gctctttggtagaaaagg

SEQ ID NO: 3769604 - DNA, 18 bp, Homo sapiens
gctgaaacaggagagaaa

SEQ ID NO: 3769605 - DNA, 12 bp, Homo sapiens
gctgaaatactg

SEQ ID NO: 3769606 - DNA, 12 bp, Homo sapiens
gctgaacatcac

SEQ ID NO: 3769607 - DNA, 21 bp, Homo sapiens
gctgacaaccaccgctcccca

SEQ ID NO: 3769608 - DNA, 23 bp, Homo sapiens
gctgacaaccaccgctccccagc

SEQ ID NO: 3769609 - DNA, 19 bp, Homo sapiens
gctgacacgtccaccccag

SEQ ID NO: 3769610 - DNA, 13 bp, Homo sapiens
gctgacagacaca

SEQ ID NO: 3769611 - DNA, 14 bp, Homo sapiens
gctgacagacacag

SEQ ID NO: 3769612 - DNA, 16 bp, Homo sapiens
gctgacagacacaggc

SEQ ID NO: 3769613 - DNA, 22 bp, Homo sapiens
gctgacccagccccttgagaaa

SEQ ID NO: 3769614 - DNA, 13 bp, Homo sapiens
gctgacccagtcc

SEQ ID NO: 3769615 - DNA, 13 bp, Homo sapiens
gctgacccccctc

SEQ ID NO: 3769616 - DNA, 15 bp, Homo sapiens
gctgacctccacagc

SEQ ID NO: 3769617 - DNA, 15 bp, Homo sapiens
gctgacgaggctggg

SEQ ID NO: 3769618 - DNA, 17 bp, Homo sapiens
gctgacgaggctgggcc

SEQ ID NO: 3769619 - DNA, 19 bp, Homo sapiens
gctgactgtactcctccca

SEQ ID NO: 3769620 - DNA, 13 bp, Homo sapiens
gctgactgtggcc

SEQ ID NO: 3769621 - DNA, 18 bp, Homo sapiens
gctgactttgctctttct

SEQ ID NO: 3769622 - DNA, 13 bp, Homo sapiens
gctgagaatagaa

SEQ ID NO: 3769623 - DNA, 18 bp, Homo sapiens
gctgagaatagaaggaaa

SEQ ID NO: 3769624 - DNA, 19 bp, Homo sapiens
gctgagaatagaaggaaac

SEQ ID NO: 3769625 - DNA, 19 bp, Homo sapiens
gctgagactggatactgcc

SEQ ID NO: 3769626 - DNA, 17 bp, Homo sapiens
gctgagcaccaggggat

SEQ ID NO: 3769627 - DNA, 15 bp, Homo sapiens
gctgagccctggcag

SEQ ID NO: 3769628 - DNA, 16 bp, Homo sapiens
gctgagccctggcagg

SEQ ID NO: 3769629 - DNA, 15 bp, Homo sapiens
gctgaggaaaggcca

SEQ ID NO: 3769630 - DNA, 16 bp, Homo sapiens
gctgaggaaaggccag

SEQ ID NO: 3769631 - DNA, 17 bp, Homo sapiens
gctgaggaaaggccagc

SEQ ID NO: 3769632 - DNA, 21 bp, Homo sapiens
gctgaggaaaggccagctggc

SEQ ID NO: 3769633 - DNA, 22 bp, Homo sapiens
gctgaggaaaggccagctggca

SEQ ID NO: 3769634 - DNA, 18 bp, Homo sapiens
gctgaggatttcaagcct

SEQ ID NO: 3769635 - DNA, 16 bp, Homo sapiens
gcccagctccagggcc

SEQ ID NO: 3769636 - DNA, 14 bp, Homo sapiens
gcccagctgcacct

SEQ ID NO: 3769637 - DNA, 15 bp, Homo sapiens
gcccagctgcacctg

SEQ ID NO: 3769638 - DNA, 10 bp, Homo sapiens
gcccaggaga

SEQ ID NO: 3769639 - DNA, 19 bp, Homo sapiens
gcccaggagagccagccct

SEQ ID NO: 3769640 - DNA, 15 bp, Homo sapiens
gcccaggatggcttt

SEQ ID NO: 3769641 - DNA, 14 bp, Homo sapiens
gcccaggcaggcca

SEQ ID NO: 3769642 - DNA, 16 bp, Homo sapiens
gcccaggcaggtcttg

SEQ ID NO: 3769643 - DNA, 17 bp, Homo sapiens
gcccaggcccctgccac

SEQ ID NO: 3769644 - DNA, 22 bp, Homo sapiens
gcccaggcccctgccaccctgg

SEQ ID NO: 3769645 - DNA, 23 bp, Homo sapiens
gcccaggcccctgccaccctggg

SEQ ID NO: 3769646 - DNA, 17 bp, Homo sapiens
gcccaggcctccagctc

SEQ ID NO: 3769647 - DNA, 11 bp, Homo sapiens
gcccaggctgg

SEQ ID NO: 3769648 - DNA, 20 bp, Homo sapiens
gcccaggctggcgtgcagtg

SEQ ID NO: 3769649 - DNA, 22 bp, Homo sapiens
gcccaggctggcgtgcagtggt

SEQ ID NO: 3769650 - DNA, 18 bp, Homo sapiens
gcccagggagaggccatg

SEQ ID NO: 3769651 - DNA, 19 bp, Homo sapiens
gcccagggagaggccatga

SEQ ID NO: 3769652 - DNA, 20 bp, Homo sapiens
gcccagggagcggaaagcag

SEQ ID NO: 3769653 - DNA, 23 bp, Homo sapiens
gcccagggagcggaaagcagctc

SEQ ID NO: 3769654 - DNA, 17 bp, Homo sapiens
gcccagggatttgtcct

SEQ ID NO: 3769655 - DNA, 15 bp, Homo sapiens
gcccagggccactct

SEQ ID NO: 3769656 - DNA, 12 bp, Homo sapiens
gcccagggctca

SEQ ID NO: 3769657 - DNA, 18 bp, Homo sapiens
gcccagggctcagcctgg

SEQ ID NO: 3769658 - DNA, 17 bp, Homo sapiens
gcccagggttcccccag

SEQ ID NO: 3769659 - DNA, 19 bp, Homo sapiens
gcccagggttcccccagcc

SEQ ID NO: 3769660 - DNA, 20 bp, Homo sapiens
gcccagggttcccccagccc

SEQ ID NO: 3769661 - DNA, 18 bp, Homo sapiens
gcccagtgccctggggct

SEQ ID NO: 3769662 - DNA, 17 bp, Homo sapiens
gcccagtgttgtttgta

SEQ ID NO: 3769663 - DNA, 22 bp, Homo sapiens
gcccatcacagggttgggccca

SEQ ID NO: 3769664 - DNA, 16 bp, Homo sapiens
gcccatcttgcctcca

SEQ ID NO: 3769665 - DNA, 19 bp, Homo sapiens
gcccatgcccacctgccca

SEQ ID NO: 3769666 - DNA, 20 bp, Homo sapiens
gcccatgggagctggttaga

SEQ ID NO: 3769667 - DNA, 14 bp, Homo sapiens
gcccattctctctc

SEQ ID NO: 3769668 - DNA, 15 bp, Homo sapiens
gcccattctctctcc

SEQ ID NO: 3769669 - DNA, 21 bp, Homo sapiens
gcccatttacacttttgagac

SEQ ID NO: 3769670 - DNA, 16 bp, Homo sapiens
gccccaaaaccacagc

SEQ ID NO: 3769671 - DNA, 20 bp, Homo sapiens
gccccaaaaccacagccctg

SEQ ID NO: 3769672 - DNA, 22 bp, Homo sapiens
gccccaaaaccacagccctgtc

SEQ ID NO: 3769673 - DNA, 23 bp, Homo sapiens
gccccaaaaccacagccctgtca

SEQ ID NO: 3769674 - DNA, 19 bp, Homo sapiens
gccccaaacaaatatgcaa

SEQ ID NO: 3769675 - DNA, 15 bp, Homo sapiens
gccccaaaggaagct

SEQ ID NO: 3769676 - DNA, 18 bp, Homo sapiens
gccccaacccaaacctgg

SEQ ID NO: 3769677 - DNA, 21 bp, Homo sapiens
gccccaacccaaacctggaga

SEQ ID NO: 3769678 - DNA, 17 bp, Homo sapiens
gccccaagaaggctggg

SEQ ID NO: 3769679 - DNA, 13 bp, Homo sapiens
gccccaccaccta

SEQ ID NO: 3769680 - DNA, 14 bp, Homo sapiens
gccccaccacctag

SEQ ID NO: 3769681 - DNA, 15 bp, Homo sapiens
gccccaccacctagg

SEQ ID NO: 3769682 - DNA, 14 bp, Homo sapiens
gccccacctgccac

SEQ ID NO: 3769683 - DNA, 15 bp, Homo sapiens
gccccacctttatta

SEQ ID NO: 3769684 - DNA, 20 bp, Homo sapiens
gccccacctttattaaaatc

SEQ ID NO: 3769685 - DNA, 18 bp, Homo sapiens
gccccactgcccttctca

SEQ ID NO: 3769686 - DNA, 12 bp, Homo sapiens
gccccagagctg

SEQ ID NO: 3769687 - DNA, 17 bp, Homo sapiens
gccccagcactaaagca

SEQ ID NO: 3769688 - DNA, 15 bp, Homo sapiens
gccccaggcaggctg

SEQ ID NO: 3769689 - DNA, 16 bp, Homo sapiens
gccccagggctaccct

SEQ ID NO: 3769690 - DNA, 20 bp, Homo sapiens
gccccagggtcttccctacc

SEQ ID NO: 3769691 - DNA, 14 bp, Homo sapiens
gccccagtgcccac

SEQ ID NO: 3769692 - DNA, 21 bp, Homo sapiens
gccccataattttttttttcc

SEQ ID NO: 3769693 - DNA, 16 bp, Homo sapiens
gccccatgcctgtcca

SEQ ID NO: 3769694 - DNA, 17 bp, Homo sapiens
gccccatgcctgtccag

SEQ ID NO: 3769695 - DNA, 23 bp, Homo sapiens
gccccatgcctgtccagcctggg

SEQ ID NO: 3769696 - DNA, 18 bp, Homo sapiens
gccccatgtctctcagaa

SEQ ID NO: 3769697 - DNA, 15 bp, Homo sapiens
gccccattctgcctg

SEQ ID NO: 3769698 - DNA, 14 bp, Homo sapiens
gcccccaagcctgc

SEQ ID NO: 3769699 - DNA, 17 bp, Homo sapiens
gcccccacacctggccc

SEQ ID NO: 3769700 - DNA, 23 bp, Homo sapiens
gcccccacagaaagactgagctc

SEQ ID NO: 3769701 - DNA, 23 bp, Homo sapiens
gcccccagtgtgcacgagtggga

SEQ ID NO: 3769702 - DNA, 13 bp, Homo sapiens
gcccccgccccgc

SEQ ID NO: 3769703 - DNA, 16 bp, Homo sapiens
gcccccgccccgcccc

SEQ ID NO: 3769704 - DNA, 15 bp, Homo sapiens
gcccccgctcatggg

SEQ ID NO: 3769705 - DNA, 18 bp, Homo sapiens
gcccccttctcccacact

SEQ ID NO: 3769706 - DNA, 23 bp, Homo sapiens
gccccgaggccttctctgaagga

SEQ ID NO: 3769707 - DNA, 13 bp, Homo sapiens
gccccgccccaca

SEQ ID NO: 3769708 - DNA, 15 bp, Homo sapiens
gccccgtcaccatct

SEQ ID NO: 3769709 - DNA, 17 bp, Homo sapiens
gcccctattagctcttt

SEQ ID NO: 3769710 - DNA, 17 bp, Homo sapiens
gcccctcacctgggcac

SEQ ID NO: 3769711 - DNA, 13 bp, Homo sapiens
gcccctcccacca

SEQ ID NO: 3769712 - DNA, 15 bp, Homo sapiens
gcccctcccaccaca

SEQ ID NO: 3769713 - DNA, 12 bp, Homo sapiens
gcccctccccca

SEQ ID NO: 3769714 - DNA, 21 bp, Homo sapiens
gcccctcccccaacccccacc

SEQ ID NO: 3769715 - DNA, 23 bp, Homo sapiens
gcccctcccccaacccccacccc

SEQ ID NO: 3769716 - DNA, 16 bp, Homo sapiens
gcccctccctacctca

SEQ ID NO: 3769717 - DNA, 14 bp, Homo sapiens
gcccctcccttcaa

SEQ ID NO: 3769718 - DNA, 22 bp, Homo sapiens
gcccctcctctgccacctcccc

SEQ ID NO: 3769719 - DNA, 15 bp, Homo sapiens
gcccctgccaccctg

SEQ ID NO: 3769720 - DNA, 12 bp, Homo sapiens
gcccctgccccg

SEQ ID NO: 3769721 - DNA, 14 bp, Homo sapiens
gcccctgccccgtc

SEQ ID NO: 3769722 - DNA, 20 bp, Homo sapiens
gcccctgccccgtcaccatc

SEQ ID NO: 3769723 - DNA, 19 bp, Homo sapiens
gcccctgcccctcatgcca

SEQ ID NO: 3769724 - DNA, 19 bp, Homo sapiens
gcccctgctgcctccccaa

SEQ ID NO: 3769725 - DNA, 12 bp, Homo sapiens
gcccctgctggt

SEQ ID NO: 3769726 - DNA, 15 bp, Homo sapiens
gcccctgctggttca

SEQ ID NO: 3769727 - DNA, 20 bp, Homo sapiens
gccccttcacttctgaccac

SEQ ID NO: 3769728 - DNA, 12 bp, Homo sapiens
gccccttccccc

SEQ ID NO: 3769729 - DNA, 19 bp, Homo sapiens
gccccttctacactctcct

SEQ ID NO: 3769730 - DNA, 22 bp, Homo sapiens
gccccttctacactctcctggg

SEQ ID NO: 3769731 - DNA, 20 bp, Homo sapiens
gccccttgctctcccctgcc

SEQ ID NO: 3769732 - DNA, 18 bp, Homo sapiens
gcccctttttactcccct

SEQ ID NO: 3769733 - DNA, 16 bp, Homo sapiens
gcccgcatgcagcagc

SEQ ID NO: 3769734 - DNA, 15 bp, Homo sapiens
gcccggattctggga

SEQ ID NO: 3769735 - DNA, 16 bp, Homo sapiens
gcccggattctgggag

SEQ ID NO: 3769736 - DNA, 17 bp, Homo sapiens
gcccggattctgggagg

SEQ ID NO: 3769737 - DNA, 13 bp, Homo sapiens
gcccggctccagg

SEQ ID NO: 3769738 - DNA, 17 bp, Homo sapiens
gcccggctccaggctcc

SEQ ID NO: 3769739 - DNA, 18 bp, Homo sapiens
gcccggctccaggctcct

SEQ ID NO: 3769740 - DNA, 22 bp, Homo sapiens
gcccggggcagctgccagagaa

SEQ ID NO: 3769741 - DNA, 14 bp, Homo sapiens
gcccgtcttcagcc

SEQ ID NO: 3769742 - DNA, 17 bp, Homo sapiens
gcccgtcttcagcctag

SEQ ID NO: 3769743 - DNA, 18 bp, Homo sapiens
gcccgtcttcagcctagc

SEQ ID NO: 3769744 - DNA, 18 bp, Homo sapiens
gcccgtgtggccccttca

SEQ ID NO: 3769745 - DNA, 21 bp, Homo sapiens
gccctaagattgaaaaggaag

SEQ ID NO: 3769746 - DNA, 13 bp, Homo sapiens
gccctagagcaca

SEQ ID NO: 3769747 - DNA, 22 bp, Homo sapiens
gccctcaggtcagggtgaggat

SEQ ID NO: 3769748 - DNA, 23 bp, Homo sapiens
gccctcaggtcagggtgaggatg

SEQ ID NO: 3769749 - DNA, 20 bp, Homo sapiens
gccctcattacggctcctct

SEQ ID NO: 3769750 - DNA, 14 bp, Homo sapiens
gccctccacagccg

SEQ ID NO: 3769751 - DNA, 15 bp, Homo sapiens
gccctccactgccct

SEQ ID NO: 3769752 - DNA, 15 bp, Homo sapiens
gccctccctgcccct

SEQ ID NO: 3769753 - DNA, 21 bp, Homo sapiens
gccctccctgtcctcctcgga

SEQ ID NO: 3769754 - DNA, 18 bp, Homo sapiens
gccctcgggcgagtcact

SEQ ID NO: 3769755 - DNA, 14 bp, Homo sapiens
gccctcttcttact

SEQ ID NO: 3769756 - DNA, 22 bp, Homo sapiens
gccctgaggtgaaagggagcta

SEQ ID NO: 3769757 - DNA, 13 bp, Homo sapiens
gccctgcagaggg

SEQ ID NO: 3769758 - DNA, 15 bp, Homo sapiens
gccctgccctagctc

SEQ ID NO: 3769759 - DNA, 16 bp, Homo sapiens
gccctgccctagctcc

SEQ ID NO: 3769760 - DNA, 15 bp, Homo sapiens
gccctgcccttcagc

SEQ ID NO: 3769761 - DNA, 19 bp, Homo sapiens
gccctgctttgggctgccc

SEQ ID NO: 3769762 - DNA, 22 bp, Homo sapiens
gccctgctttgggctgccctgg

SEQ ID NO: 3769763 - DNA, 18 bp, Homo sapiens
gccctggatttcagaaag

SEQ ID NO: 3769764 - DNA, 13 bp, Homo sapiens
gccctggccagag

SEQ ID NO: 3769765 - DNA, 12 bp, Homo sapiens
gccctggcctgc

SEQ ID NO: 3769766 - DNA, 13 bp, Homo sapiens
gccctggcctgct

SEQ ID NO: 3769767 - DNA, 20 bp, Homo sapiens
gccctggctcccacaggccc

SEQ ID NO: 3769768 - DNA, 13 bp, Homo sapiens
gccctggggcctg

SEQ ID NO: 3769769 - DNA, 21 bp, Homo sapiens
gccctgggtctaaggggttgg

SEQ ID NO: 3769770 - DNA, 16 bp, Homo sapiens
gccctggtccagggaa

SEQ ID NO: 3769771 - DNA, 17 bp, Homo sapiens
gccctggtccagggaag

SEQ ID NO: 3769772 - DNA, 20 bp, Homo sapiens
gccctggtccagggaagctg

SEQ ID NO: 3769773 - DNA, 17 bp, Homo sapiens
gccctggtggcagtggg

SEQ ID NO: 3769774 - DNA, 22 bp, Homo sapiens
gccctggtggcagtgggagctg

SEQ ID NO: 3769775 - DNA, 18 bp, Homo sapiens
gccctggtttcactggcc

SEQ ID NO: 3769776 - DNA, 21 bp, Homo sapiens
gccctgtatcaacccagaaac

SEQ ID NO: 3769777 - DNA, 14 bp, Homo sapiens
gccctgtcagtgca

SEQ ID NO: 3769778 - DNA, 17 bp, Homo sapiens
gccctgtggaagggact

SEQ ID NO: 3769779 - DNA, 22 bp, Homo sapiens
gcccttagcagggaaacagcta

SEQ ID NO: 3769780 - DNA, 16 bp, Homo sapiens
gcccttcacagtgttt

SEQ ID NO: 3769781 - DNA, 12 bp, Homo sapiens
gcccttccatgt

SEQ ID NO: 3769782 - DNA, 14 bp, Homo sapiens
gcccttcctctcca

SEQ ID NO: 3769783 - DNA, 15 bp, Homo sapiens
gcccttcctctccac

SEQ ID NO: 3769784 - DNA, 19 bp, Homo sapiens
gcccttcctctccactgcc

SEQ ID NO: 3769785 - DNA, 22 bp, Homo sapiens
gcccttcctctccactgccttc

SEQ ID NO: 3769786 - DNA, 17 bp, Homo sapiens
gcccttgagctccccaa

SEQ ID NO: 3769787 - DNA, 20 bp, Homo sapiens
gcccttgcagttcagcacca

SEQ ID NO: 3769788 - DNA, 21 bp, Homo sapiens
gcccttgcagttcagcaccac

SEQ ID NO: 3769789 - DNA, 24 bp, Homo sapiens
gccctttggagaacgccagtctcc

SEQ ID NO: 3769790 - DNA, 12 bp, Homo sapiens
gccgaaactgga

SEQ ID NO: 3769791 - DNA, 19 bp, Homo sapiens
gccgaagaagggtccttcc

SEQ ID NO: 3769792 - DNA, 22 bp, Homo sapiens
gccgaagaagggtccttccctc

SEQ ID NO: 3769793 - DNA, 14 bp, Homo sapiens
gccgaccagagccc

SEQ ID NO: 3769794 - DNA, 11 bp, Homo sapiens
gccgacctcag

SEQ ID NO: 3769795 - DNA, 21 bp, Homo sapiens
gccgacctcgtcctccccctg

SEQ ID NO: 3769796 - DNA, 14 bp, Homo sapiens
gccgagaagcaaga

SEQ ID NO: 3769797 - DNA, 22 bp, Homo sapiens
gccgagacatggcttgccacag

SEQ ID NO: 3769798 - DNA, 15 bp, Homo sapiens
gccgagagcctgctc

SEQ ID NO: 3769799 - DNA, 17 bp, Homo sapiens
gccgagagcctgctccc

SEQ ID NO: 3769800 - DNA, 16 bp, Homo sapiens
gccgagggtcctggct

SEQ ID NO: 3769801 - DNA, 23 bp, Homo sapiens
gccgcaccccagagtgtgggaag

SEQ ID NO: 3769802 - DNA, 15 bp, Homo sapiens
gccgcatcttctcca

SEQ ID NO: 3769803 - DNA, 18 bp, Homo sapiens
gccgcattccctgagtca

SEQ ID NO: 3769804 - DNA, 17 bp, Homo sapiens
gccgccattgccaccag

SEQ ID NO: 3769805 - DNA, 21 bp, Homo sapiens
gccgccattgccaccaggaga

SEQ ID NO: 3769806 - DNA, 19 bp, Homo sapiens
gccgccccagcctctgagc

SEQ ID NO: 3769807 - DNA, 13 bp, Homo sapiens
gccgcctcaatgt

SEQ ID NO: 3769808 - DNA, 15 bp, Homo sapiens
gccgcctcccagcct

SEQ ID NO: 3769809 - DNA, 19 bp, Homo sapiens
gccgcctgcgggctgcccc

SEQ ID NO: 3769810 - DNA, 15 bp, Homo sapiens
gccgctcctgtctgc

SEQ ID NO: 3769811 - DNA, 22 bp, Homo sapiens
gccgctcctgtctgccagccag

SEQ ID NO: 3769812 - DNA, 20 bp, Homo sapiens
gccgggaacagacaacagaa

SEQ ID NO: 3769813 - DNA, 12 bp, Homo sapiens
gccgggcacagc

SEQ ID NO: 3769814 - DNA, 23 bp, Homo sapiens
gccgggcatggtggcgcaagcct

SEQ ID NO: 3769815 - DNA, 19 bp, Homo sapiens
gccgggcgtggtggcgggc

SEQ ID NO: 3769816 - DNA, 12 bp, Homo sapiens
gccggtcatttt

SEQ ID NO: 3769817 - DNA, 18 bp, Homo sapiens
gccgtcagccaaatgtaa

SEQ ID NO: 3769818 - DNA, 15 bp, Homo sapiens
gccgtggctgcggca

SEQ ID NO: 3769819 - DNA, 11 bp, Homo sapiens
gccgtggcttc

SEQ ID NO: 3769820 - DNA, 13 bp, Homo sapiens
gccgtggcttccc

SEQ ID NO: 3769821 - DNA, 15 bp, Homo sapiens
gccgtggcttcccgc

SEQ ID NO: 3769822 - DNA, 20 bp, Homo sapiens
gccgttactctccaacctgg

SEQ ID NO: 3769823 - DNA, 16 bp, Homo sapiens
gcctaagtggctgctg

SEQ ID NO: 3769824 - DNA, 17 bp, Homo sapiens
gcctaagtggctgctga

SEQ ID NO: 3769825 - DNA, 18 bp, Homo sapiens
gcctaatacattaaagca

SEQ ID NO: 3769826 - DNA, 18 bp, Homo sapiens
gcctactagggacctggg

SEQ ID NO: 3769827 - DNA, 22 bp, Homo sapiens
gcctactagggacctggggaag

SEQ ID NO: 3769828 - DNA, 23 bp, Homo sapiens
gcctagcactcacatgctggaca

SEQ ID NO: 3769829 - DNA, 15 bp, Homo sapiens
gcctagccgacctca

SEQ ID NO: 3769830 - DNA, 17 bp, Homo sapiens
gcctagccgacctcagc

SEQ ID NO: 3769831 - DNA, 20 bp, Homo sapiens
gcctagccgacctcagcctt

SEQ ID NO: 3769832 - DNA, 17 bp, Homo sapiens
gcctaggaattcccagc

SEQ ID NO: 3769833 - DNA, 17 bp, Homo sapiens
gcctagggcctggtcca

SEQ ID NO: 3769834 - DNA, 17 bp, Homo sapiens
gcctaggggtcagggac

SEQ ID NO: 3769835 - DNA, 20 bp, Homo sapiens
gcctaggtgacagagtgaga

SEQ ID NO: 3769836 - DNA, 18 bp, Homo sapiens
gcctagtcagccacatgg

SEQ ID NO: 3769837 - DNA, 19 bp, Homo sapiens
gcctagtggggtctccctc

SEQ ID NO: 3769838 - DNA, 17 bp, Homo sapiens
gcctagttcatccaatc

SEQ ID NO: 3769839 - DNA, 21 bp, Homo sapiens
gcctagttcatccaatcctca

SEQ ID NO: 3769840 - DNA, 22 bp, Homo sapiens
gcctatgtgcatgcagcatcta

SEQ ID NO: 3769841 - DNA, 21 bp, Homo sapiens
gcctcaaccctccctcagccc

SEQ ID NO: 3769842 - DNA, 16 bp, Homo sapiens
gcctcaacctcctggg

SEQ ID NO: 3769843 - DNA, 17 bp, Homo sapiens
gcctcaacctcctgggc

SEQ ID NO: 3769844 - DNA, 21 bp, Homo sapiens
gcctcaagtgattctcctgcc

SEQ ID NO: 3769845 - DNA, 24 bp, Homo sapiens
gcctcaagtgattctcctgcctca

SEQ ID NO: 3769846 - DNA, 22 bp, Homo sapiens
gcctcaatgtgaatcagaccct

SEQ ID NO: 3769847 - DNA, 16 bp, Homo sapiens
gcctcacagaagaata

SEQ ID NO: 3769848 - DNA, 16 bp, Homo sapiens
gcctcacttgaatgtg

SEQ ID NO: 3769849 - DNA, 18 bp, Homo sapiens
gcctcacttgaatgtgtc

SEQ ID NO: 3769850 - DNA, 20 bp, Homo sapiens
gcctcacttgaatgtgtcac

SEQ ID NO: 3769851 - DNA, 16 bp, Homo sapiens
gcctcagactcataca

SEQ ID NO: 3769852 - DNA, 12 bp, Homo sapiens
gcctcagcctcc

SEQ ID NO: 3769853 - DNA, 19 bp, Homo sapiens
gcctcagctgcctcacttc

SEQ ID NO: 3769854 - DNA, 22 bp, Homo sapiens
gcctcagggcagcctgcctgga

SEQ ID NO: 3769855 - DNA, 15 bp, Homo sapiens
gcctcagtgccacta

SEQ ID NO: 3769856 - DNA, 13 bp, Homo sapiens
gcctccagctcag

SEQ ID NO: 3769857 - DNA, 15 bp, Homo sapiens
gcctccagctcagca

SEQ ID NO: 3769858 - DNA, 16 bp, Homo sapiens
gcctccagctcagcag

SEQ ID NO: 3769859 - DNA, 11 bp, Homo sapiens
gcctccatgct

SEQ ID NO: 3769860 - DNA, 16 bp, Homo sapiens
gcctccatggtgcctc

SEQ ID NO: 3769861 - DNA, 19 bp, Homo sapiens
gcctccatggtgcctctgg

SEQ ID NO: 3769862 - DNA, 23 bp, Homo sapiens
gcctccattcctggagcccgagg

SEQ ID NO: 3769863 - DNA, 16 bp, Homo sapiens
gcctccattctgacca

SEQ ID NO: 3769864 - DNA, 16 bp, Homo sapiens
gcctcccaaagtgctg

SEQ ID NO: 3769865 - DNA, 19 bp, Homo sapiens
gcctcccaaagtgctggga

SEQ ID NO: 3769866 - DNA, 13 bp, Homo sapiens
gcctcccagcctg

SEQ ID NO: 3769867 - DNA, 19 bp, Homo sapiens
gcctccccaaccctgcccc

SEQ ID NO: 3769868 - DNA, 20 bp, Homo sapiens
gcctccccaaccctgcccct

SEQ ID NO: 3769869 - DNA, 22 bp, Homo sapiens
gcctccccaaccctgcccctgc

SEQ ID NO: 3769870 - DNA, 15 bp, Homo sapiens
gcctcccgagtagct

SEQ ID NO: 3769871 - DNA, 18 bp, Homo sapiens
gcctcccgagtagctggg

SEQ ID NO: 3769872 - DNA, 23 bp, Homo sapiens
gcctccctctctcttctgctcca

SEQ ID NO: 3769873 - DNA, 21 bp, Homo sapiens
gcctccctctgacctgcaggc

SEQ ID NO: 3769874 - DNA, 20 bp, Homo sapiens
gcctccctgttgaagctctg

SEQ ID NO: 3769875 - DNA, 17 bp, Homo sapiens
gcctcctcacccccagc

SEQ ID NO: 3769876 - DNA, 18 bp, Homo sapiens
gcctcctcacccccagct

SEQ ID NO: 3769877 - DNA, 21 bp, Homo sapiens
gcctcctcacccccagctttg

SEQ ID NO: 3769878 - DNA, 13 bp, Homo sapiens
gcctcctctgtcc

SEQ ID NO: 3769879 - DNA, 16 bp, Homo sapiens
gcctcgaactcctggg

SEQ ID NO: 3769880 - DNA, 21 bp, Homo sapiens
gcctcgaactcctgggctcaa

SEQ ID NO: 3769881 - DNA, 16 bp, Homo sapiens
gcctctccctggccct

SEQ ID NO: 3769882 - DNA, 15 bp, Homo sapiens
gcctctcttcctatc

SEQ ID NO: 3769883 - DNA, 23 bp, Homo sapiens
gcctctcttcctatcccatccca

SEQ ID NO: 3769884 - DNA, 18 bp, Homo sapiens
gcctctgaagttggacag

SEQ ID NO: 3769885 - DNA, 19 bp, Homo sapiens
gcctctgaagttggacagc

SEQ ID NO: 3769886 - DNA, 19 bp, Homo sapiens
gcctctgacacacagctct

SEQ ID NO: 3769887 - DNA, 12 bp, Homo sapiens
gcctctgcattc

SEQ ID NO: 3769888 - DNA, 15 bp, Homo sapiens
gcctctgccccgtct

SEQ ID NO: 3769889 - DNA, 12 bp, Homo sapiens
gcctctgcctct

SEQ ID NO: 3769890 - DNA, 13 bp, Homo sapiens
gcctctgcctgtg

SEQ ID NO: 3769891 - DNA, 15 bp, Homo sapiens
gcctctgctgccatg

SEQ ID NO: 3769892 - DNA, 12 bp, Homo sapiens
gcctctgctggc

SEQ ID NO: 3769893 - DNA, 13 bp, Homo sapiens
gcctctggctaga

SEQ ID NO: 3769894 - DNA, 19 bp, Homo sapiens
gcctctggctagaggccag

SEQ ID NO: 3769895 - DNA, 22 bp, Homo sapiens
gcctctggctagaggccagccc

SEQ ID NO: 3769896 - DNA, 23 bp, Homo sapiens
gcctctggctagaggccagcccc

SEQ ID NO: 3769897 - DNA, 14 bp, Homo sapiens
gcctctgggactgg

SEQ ID NO: 3769898 - DNA, 21 bp, Homo sapiens
gcctctgtcatatcttcacaa

SEQ ID NO: 3769899 - DNA, 20 bp, Homo sapiens
gcctcttaaagctgcctgta

SEQ ID NO: 3769900 - DNA, 22 bp, Homo sapiens
gcctcttaaagctgcctgtagt

SEQ ID NO: 3769901 - DNA, 22 bp, Homo sapiens
gcctcttcctccctcattccac

SEQ ID NO: 3769902 - DNA, 15 bp, Homo sapiens
gcctcttcttcttca

SEQ ID NO: 3769903 - DNA, 23 bp, Homo sapiens
gcctgaccctacttcttttgctc

SEQ ID NO: 3769904 - DNA, 22 bp, Homo sapiens
gcctgagcaacagagtgagacc

SEQ ID NO: 3769905 - DNA, 20 bp, Homo sapiens
gcctgagcacctcccagccc

SEQ ID NO: 3769906 - DNA, 14 bp, Homo sapiens
gcctgaggctgaga

SEQ ID NO: 3769907 - DNA, 14 bp, Homo sapiens
gcctgaggctggga

SEQ ID NO: 3769908 - DNA, 14 bp, Homo sapiens
gcctgatgctccct

SEQ ID NO: 3769909 - DNA, 12 bp, Homo sapiens
gcctgcccaggc

SEQ ID NO: 3769910 - DNA, 22 bp, Homo sapiens
gcctgcccaggcccctgccacc

SEQ ID NO: 3769911 - DNA, 23 bp, Homo sapiens
gcctgccccaaacaaatatgcaa

SEQ ID NO: 3769912 - DNA, 22 bp, Homo sapiens
gcctgcctagcactcacatgct

SEQ ID NO: 3769913 - DNA, 16 bp, Homo sapiens
gcctgcctcttctcta

SEQ ID NO: 3769914 - DNA, 17 bp, Homo sapiens
gcctgcctgttcccatt

SEQ ID NO: 3769915 - DNA, 15 bp, Homo sapiens
gcctgccttcgttaa

SEQ ID NO: 3769916 - DNA, 16 bp, Homo sapiens
gcctgcggtcaaggcc

SEQ ID NO: 3769917 - DNA, 17 bp, Homo sapiens
gcctgcggtcaaggcca

SEQ ID NO: 3769918 - DNA, 13 bp, Homo sapiens
gcctgctccagct

SEQ ID NO: 3769919 - DNA, 11 bp, Homo sapiens
gcctgctcccc

SEQ ID NO: 3769920 - DNA, 11 bp, Homo sapiens
gcctgctgcat

SEQ ID NO: 3769921 - DNA, 21 bp, Homo sapiens
gcctgctgggctctccacctc

SEQ ID NO: 3769922 - DNA, 23 bp, Homo sapiens
gcctgctgggctctccacctcag

SEQ ID NO: 3769923 - DNA, 15 bp, Homo sapiens
gcctggaagagcagc

SEQ ID NO: 3769924 - DNA, 17 bp, Homo sapiens
gcctggaagagcagccc

SEQ ID NO: 3769925 - DNA, 14 bp, Homo sapiens
gcctggaccctgtg

SEQ ID NO: 3769926 - DNA, 11 bp, Homo sapiens
gcctggagccc

SEQ ID NO: 3769927 - DNA, 13 bp, Homo sapiens
gcctggagcccca

SEQ ID NO: 3769928 - DNA, 20 bp, Homo sapiens
gcctggagctcctgggaagg

SEQ ID NO: 3769929 - DNA, 19 bp, Homo sapiens
gcctggcacagggcagtgg

SEQ ID NO: 3769930 - DNA, 18 bp, Homo sapiens
gcctggcagaactgagct

SEQ ID NO: 3769931 - DNA, 19 bp, Homo sapiens
gcctggcagaactgagctc

SEQ ID NO: 3769932 - DNA, 22 bp, Homo sapiens
gcctggcagaactgagctcctc

SEQ ID NO: 3769933 - DNA, 15 bp, Homo sapiens
gcctggccagatgca

SEQ ID NO: 3769934 - DNA, 14 bp, Homo sapiens
gcctggccaggagc

SEQ ID NO: 3769935 - DNA, 15 bp, Homo sapiens
gcctggccaggcaga

SEQ ID NO: 3769936 - DNA, 17 bp, Homo sapiens
gcctggccaggcagatc

SEQ ID NO: 3769937 - DNA, 23 bp, Homo sapiens
gcctggccaggcagatctgtgcc

SEQ ID NO: 3769938 - DNA, 18 bp, Homo sapiens
gcctggcccccagctgtg

SEQ ID NO: 3769939 - DNA, 23 bp, Homo sapiens
gcctggcttctggagcccttggg

SEQ ID NO: 3769940 - DNA, 20 bp, Homo sapiens
gcctgggcaacacagcgaga

SEQ ID NO: 3769941 - DNA, 20 bp, Homo sapiens
gcctgggcaacagagcaaga

SEQ ID NO: 3769942 - DNA, 20 bp, Homo sapiens
gcctgggcgacagagcgaga

SEQ ID NO: 3769943 - DNA, 16 bp, Homo sapiens
gcctgggtctgtgtct

SEQ ID NO: 3769944 - DNA, 23 bp, Homo sapiens
gcctgggtgacaaagtgagactc

SEQ ID NO: 3769945 - DNA, 12 bp, Homo sapiens
gcctgggtgctg

SEQ ID NO: 3769946 - DNA, 17 bp, Homo sapiens
gcctgggtgctggctgc

SEQ ID NO: 3769947 - DNA, 15 bp, Homo sapiens
gcctgggtggggctg

SEQ ID NO: 3769948 - DNA, 20 bp, Homo sapiens
gcctgggtggggctgctcct

SEQ ID NO: 3769949 - DNA, 22 bp, Homo sapiens
gcctggtccatgatggagtcag

SEQ ID NO: 3769950 - DNA, 15 bp, Homo sapiens
gcctggtccctggga

SEQ ID NO: 3769951 - DNA, 19 bp, Homo sapiens
gcctggtctcctgccccca

SEQ ID NO: 3769952 - DNA, 16 bp, Homo sapiens
gcctggtggcagctgc

SEQ ID NO: 3769953 - DNA, 17 bp, Homo sapiens
gcctggtggcagctgcg

SEQ ID NO: 3769954 - DNA, 18 bp, Homo sapiens
gcctggtggcagctgcgg

SEQ ID NO: 3769955 - DNA, 19 bp, Homo sapiens
gcctggtggcagctgcggt

SEQ ID NO: 3769956 - DNA, 21 bp, Homo sapiens
gcctggtggcagctgcggtcc

SEQ ID NO: 3769957 - DNA, 14 bp, Homo sapiens
gcctggttagaggc

SEQ ID NO: 3769958 - DNA, 15 bp, Homo sapiens
gcctgtaatcccagc

SEQ ID NO: 3769959 - DNA, 18 bp, Homo sapiens
gcctgtaatcccagctac

SEQ ID NO: 3769960 - DNA, 19 bp, Homo sapiens
gcctgtaatcccagctact

SEQ ID NO: 3769961 - DNA, 17 bp, Homo sapiens
gcctgtagttaggaaat

SEQ ID NO: 3769962 - DNA, 19 bp, Homo sapiens
gcctgtagttaggaaataa

SEQ ID NO: 3769963 - DNA, 22 bp, Homo sapiens
gcctgtagttaggaaataaaac

SEQ ID NO: 3769964 - DNA, 12 bp, Homo sapiens
gcctgtccagcc

SEQ ID NO: 3769965 - DNA, 15 bp, Homo sapiens
gcctgtccagcctgg

SEQ ID NO: 3769966 - DNA, 13 bp, Homo sapiens
gcctgtccctggc

SEQ ID NO: 3769967 - DNA, 21 bp, Homo sapiens
gcctgtccctggccatctctg

SEQ ID NO: 3769968 - DNA, 14 bp, Homo sapiens
gcctgtcgtgccag

SEQ ID NO: 3769969 - DNA, 18 bp, Homo sapiens
gcctgtctcatccccagg

SEQ ID NO: 3769970 - DNA, 22 bp, Homo sapiens
gcctgtctcctttgcaggctca

SEQ ID NO: 3769971 - DNA, 19 bp, Homo sapiens
gcctgtgccacccaccagg

SEQ ID NO: 3769972 - DNA, 16 bp, Homo sapiens
gcctgtgcctctggga

SEQ ID NO: 3769973 - DNA, 17 bp, Homo sapiens
gcctgtgcctctgggac

SEQ ID NO: 3769974 - DNA, 14 bp, Homo sapiens
gcctgtgctgcccg

SEQ ID NO: 3769975 - DNA, 22 bp, Homo sapiens
gcctgtggcagtaaagagaaac

SEQ ID NO: 3769976 - DNA, 21 bp, Homo sapiens
gcctgtgtgacatcagtggca

SEQ ID NO: 3769977 - DNA, 22 bp, Homo sapiens
gcctgtgtgacatcagtggcat

SEQ ID NO: 3769978 - DNA, 15 bp, Homo sapiens
gcctgttcagctcca

SEQ ID NO: 3769979 - DNA, 15 bp, Homo sapiens
ggcgcccccagtgtg

SEQ ID NO: 3769980 - DNA, 15 bp, Homo sapiens
ggcgcggtggctcac

SEQ ID NO: 3769981 - DNA, 19 bp, Homo sapiens
ggcgcggtggctcacgcct

SEQ ID NO: 3769982 - DNA, 23 bp, Homo sapiens
ggcggctactcagcagccctcct

SEQ ID NO: 3769983 - DNA, 17 bp, Homo sapiens
ggcgggccaaggactgc

SEQ ID NO: 3769984 - DNA, 15 bp, Homo sapiens
ggcgtgactcaccca

SEQ ID NO: 3769985 - DNA, 17 bp, Homo sapiens
ggcgtgactcacccaag

SEQ ID NO: 3769986 - DNA, 19 bp, Homo sapiens
ggctaagagctagcgctgc

SEQ ID NO: 3769987 - DNA, 15 bp, Homo sapiens
ggctaaggcaccagc

SEQ ID NO: 3769988 - DNA, 16 bp, Homo sapiens
ggctaaggcaccagcc

SEQ ID NO: 3769989 - DNA, 12 bp, Homo sapiens
ggctaccctccc

SEQ ID NO: 3769990 - DNA, 23 bp, Homo sapiens
ggctactcactcaagttcaagga

SEQ ID NO: 3769991 - DNA, 20 bp, Homo sapiens
ggctactcagcagccctcct

SEQ ID NO: 3769992 - DNA, 14 bp, Homo sapiens
ggctagagtcctca

SEQ ID NO: 3769993 - DNA, 13 bp, Homo sapiens
ggctaggtacaca

SEQ ID NO: 3769994 - DNA, 18 bp, Homo sapiens
ggctagtcagagagagtg

SEQ ID NO: 3769995 - DNA, 16 bp, Homo sapiens
ggctagttgggcttcc

SEQ ID NO: 3769996 - DNA, 20 bp, Homo sapiens
ggctatagctacaggaagca

SEQ ID NO: 3769997 - DNA, 15 bp, Homo sapiens
ggctatttaccaggg

SEQ ID NO: 3769998 - DNA, 23 bp, Homo sapiens
ggctcaagcagtctacccacctc

SEQ ID NO: 3769999 - DNA, 15 bp, Homo sapiens
ggctcaagtcctctt

SEQ ID NO: 3770000 - DNA, 22 bp, Homo sapiens
ggctcacgcctgtaatcccagc

SEQ ID NO: 3770001 - DNA, 18 bp, Homo sapiens
ggctcactgcagcctcga

SEQ ID NO: 3770002 - DNA, 21 bp, Homo sapiens
ggctcagcggggacagctcct

SEQ ID NO: 3770003 - DNA, 23 bp, Homo sapiens
ggctcagcggggacagctccttc

SEQ ID NO: 3770004 - DNA, 13 bp, Homo sapiens
ggctcagctctgg

SEQ ID NO: 3770005 - DNA, 21 bp, Homo sapiens
ggctcagctctggctcacaga

SEQ ID NO: 3770006 - DNA, 17 bp, Homo sapiens
ggctcatattcctgcag

SEQ ID NO: 3770007 - DNA, 22 bp, Homo sapiens
ggctcatattcctgcagcctgg

SEQ ID NO: 3770008 - DNA, 13 bp, Homo sapiens
ggctccaggctcc

SEQ ID NO: 3770009 - DNA, 16 bp, Homo sapiens
ggctccaggctccttt

SEQ ID NO: 3770010 - DNA, 17 bp, Homo sapiens
ggctcccacaggccctt

SEQ ID NO: 3770011 - DNA, 15 bp, Homo sapiens
ggctccgaacaccct

SEQ ID NO: 3770012 - DNA, 15 bp, Homo sapiens
ggctccgctgtgtgg

SEQ ID NO: 3770013 - DNA, 24 bp, Homo sapiens
ggctccgtcagtatcaggcctgcc

SEQ ID NO: 3770014 - DNA, 14 bp, Homo sapiens
ggctcctccctccc

SEQ ID NO: 3770015 - DNA, 21 bp, Homo sapiens
ggctcctctctaacctccttt

SEQ ID NO: 3770016 - DNA, 22 bp, Homo sapiens
ggctcgtcggggggacagctcc

SEQ ID NO: 3770017 - DNA, 14 bp, Homo sapiens
ggctctccacctca

SEQ ID NO: 3770018 - DNA, 15 bp, Homo sapiens
ggctctccacctcag

SEQ ID NO: 3770019 - DNA, 19 bp, Homo sapiens
ggctctccacctcagcctt

SEQ ID NO: 3770020 - DNA, 22 bp, Homo sapiens
ggctctccacctcagccttgga

SEQ ID NO: 3770021 - DNA, 19 bp, Homo sapiens
ggagactagattgcctttg

SEQ ID NO: 3770022 - DNA, 22 bp, Homo sapiens
ggagactagatttatgaataca

SEQ ID NO: 3770023 - DNA, 19 bp, Homo sapiens
ggagactcacctctgcctc

SEQ ID NO: 3770024 - DNA, 21 bp, Homo sapiens
ggagactccatgagaagccgt

SEQ ID NO: 3770025 - DNA, 16 bp, Homo sapiens
ggagactctgtggggc

SEQ ID NO: 3770026 - DNA, 12 bp, Homo sapiens
ggagagaaaaaa

SEQ ID NO: 3770027 - DNA, 13 bp, Homo sapiens
ggagagaaaaaag

SEQ ID NO: 3770028 - DNA, 15 bp, Homo sapiens
ggagagaaaaaagaa

SEQ ID NO: 3770029 - DNA, 18 bp, Homo sapiens
ggagagaaggggaggagg

SEQ ID NO: 3770030 - DNA, 21 bp, Homo sapiens
ggagagaaggggaggagggcg

SEQ ID NO: 3770031 - DNA, 14 bp, Homo sapiens
ggagagagactcca

SEQ ID NO: 3770032 - DNA, 14 bp, Homo sapiens
ggagagccagccct

SEQ ID NO: 3770033 - DNA, 18 bp, Homo sapiens
ggagagccagccctccct

SEQ ID NO: 3770034 - DNA, 12 bp, Homo sapiens
ggagagcctggt

SEQ ID NO: 3770035 - DNA, 20 bp, Homo sapiens
ggagagcgcctgcccctccc

SEQ ID NO: 3770036 - DNA, 15 bp, Homo sapiens
ggagagctagcagca

SEQ ID NO: 3770037 - DNA, 21 bp, Homo sapiens
ggagagctagcagcagggagg

SEQ ID NO: 3770038 - DNA, 17 bp, Homo sapiens
ggagagctggtgcccgg

SEQ ID NO: 3770039 - DNA, 16 bp, Homo sapiens
ggagaggcagagtgcc

SEQ ID NO: 3770040 - DNA, 23 bp, Homo sapiens
ggagagggaaacgtgccctctgt

SEQ ID NO: 3770041 - DNA, 22 bp, Homo sapiens
ggagagggacagcccactgaga

SEQ ID NO: 3770042 - DNA, 15 bp, Homo sapiens
ggagaggggcacagg

SEQ ID NO: 3770043 - DNA, 20 bp, Homo sapiens
ggagagggtctggagaagca

SEQ ID NO: 3770044 - DNA, 14 bp, Homo sapiens
ggagatgtaagagc

SEQ ID NO: 3770045 - DNA, 14 bp, Homo sapiens
ggagattcagactg

SEQ ID NO: 3770046 - DNA, 20 bp, Homo sapiens
ggagcaaaatcgatgcagtg

SEQ ID NO: 3770047 - DNA, 15 bp, Homo sapiens
ggagcaagacagaga

SEQ ID NO: 3770048 - DNA, 12 bp, Homo sapiens
ggagcagtgtct

SEQ ID NO: 3770049 - DNA, 14 bp, Homo sapiens
ggagccccactgcc

SEQ ID NO: 3770050 - DNA, 20 bp, Homo sapiens
ggagccccagggtcttccct

SEQ ID NO: 3770051 - DNA, 16 bp, Homo sapiens
ggagccccgaggcctt

SEQ ID NO: 3770052 - DNA, 14 bp, Homo sapiens
ggagcccgcacccc

SEQ ID NO: 3770053 - DNA, 18 bp, Homo sapiens
ggagcccgcacccccacc

SEQ ID NO: 3770054 - DNA, 20 bp, Homo sapiens
ggagcctccactgcctctgg

SEQ ID NO: 3770055 - DNA, 16 bp, Homo sapiens
ggagcggaaagcagct

SEQ ID NO: 3770056 - DNA, 19 bp, Homo sapiens
ggagctaacactggcccct

SEQ ID NO: 3770057 - DNA, 11 bp, Homo sapiens
ggagctcctgg

SEQ ID NO: 3770058 - DNA, 12 bp, Homo sapiens
ggagctcctggg

SEQ ID NO: 3770059 - DNA, 21 bp, Homo sapiens
ggagctgcctgttcagctcca

SEQ ID NO: 3770060 - DNA, 21 bp, Homo sapiens
ggagctgggacacttaacaga

SEQ ID NO: 3770061 - DNA, 18 bp, Homo sapiens
ggagctgggcagaaggcc

SEQ ID NO: 3770062 - DNA, 19 bp, Homo sapiens
ggagctgggcagaaggcca

SEQ ID NO: 3770063 - DNA, 18 bp, Homo sapiens
ggagcttacctcccacct

SEQ ID NO: 3770064 - DNA, 21 bp, Homo sapiens
ggagcttagccaatgtgggag

SEQ ID NO: 3770065 - DNA, 17 bp, Homo sapiens
ggagcttctctttaact

SEQ ID NO: 3770066 - DNA, 12 bp, Homo sapiens
ggaggaagagaa

SEQ ID NO: 3770067 - DNA, 13 bp, Homo sapiens
ggaggaaggagag

SEQ ID NO: 3770068 - DNA, 22 bp, Homo sapiens
ggaggaaggagcctatggcatc

SEQ ID NO: 3770069 - DNA, 22 bp, Homo sapiens
ggaggaatcgaggaaccagagc

SEQ ID NO: 3770070 - DNA, 16 bp, Homo sapiens
ggaggaatgctccccc

SEQ ID NO: 3770071 - DNA, 14 bp, Homo sapiens
ggaggacctctggg

SEQ ID NO: 3770072 - DNA, 20 bp, Homo sapiens
ggaggaggtggcagccctgt

SEQ ID NO: 3770073 - DNA, 17 bp, Homo sapiens
ggaggatcactggagcc

SEQ ID NO: 3770074 - DNA, 20 bp, Homo sapiens
ggaggatcactggagcccag

SEQ ID NO: 3770075 - DNA, 21 bp, Homo sapiens
ggaggatctcttgagcctggg

SEQ ID NO: 3770076 - DNA, 20 bp, Homo sapiens
ggaggatcttttgaacccag

SEQ ID NO: 3770077 - DNA, 13 bp, Homo sapiens
ggcattcctgctt

SEQ ID NO: 3770078 - DNA, 19 bp, Homo sapiens
ggccaaacatcagacctgt

SEQ ID NO: 3770079 - DNA, 21 bp, Homo sapiens
ggccaaaggagggtcaggaag

SEQ ID NO: 3770080 - DNA, 15 bp, Homo sapiens
ggccaacaccaggga

SEQ ID NO: 3770081 - DNA, 13 bp, Homo sapiens
ggccaagaggctg

SEQ ID NO: 3770082 - DNA, 11 bp, Homo sapiens
ggccaaggact

SEQ ID NO: 3770083 - DNA, 16 bp, Homo sapiens
ggccaagtcccaccgg

SEQ ID NO: 3770084 - DNA, 18 bp, Homo sapiens
ggccaagtgcaggctggc

SEQ ID NO: 3770085 - DNA, 20 bp, Homo sapiens
ggccaagtgcaggctggcac

SEQ ID NO: 3770086 - DNA, 11 bp, Homo sapiens
ggccacctgca

SEQ ID NO: 3770087 - DNA, 12 bp, Homo sapiens
ggccacgtgcca

SEQ ID NO: 3770088 - DNA, 23 bp, Homo sapiens
ggccacgtgggcaaacaggcagt

SEQ ID NO: 3770089 - DNA, 15 bp, Homo sapiens
ggccactctgcctct

SEQ ID NO: 3770090 - DNA, 15 bp, Homo sapiens
ggccagaccagagct

SEQ ID NO: 3770091 - DNA, 18 bp, Homo sapiens
ggccagaccagagctctg

SEQ ID NO: 3770092 - DNA, 23 bp, Homo sapiens
ggccagaccagagctctggagcc

SEQ ID NO: 3770093 - DNA, 19 bp, Homo sapiens
ggccagaggcagaaccctg

SEQ ID NO: 3770094 - DNA, 15 bp, Homo sapiens
ggccagagtggcctg

SEQ ID NO: 3770095 - DNA, 20 bp, Homo sapiens
ggccagagtggcctggccag

SEQ ID NO: 3770096 - DNA, 21 bp, Homo sapiens
ggccagatgcacatccctgga

SEQ ID NO: 3770097 - DNA, 23 bp, Homo sapiens
ggccagatgcacatccctggaag

SEQ ID NO: 3770098 - DNA, 15 bp, Homo sapiens
ggccagatgcaccag

SEQ ID NO: 3770099 - DNA, 17 bp, Homo sapiens
ggccagatgcaccagcc

SEQ ID NO: 3770100 - DNA, 22 bp, Homo sapiens
ggccagcaaggtggagtggatg

SEQ ID NO: 3770101 - DNA, 16 bp, Homo sapiens
ggccagccccacccag

SEQ ID NO: 3770102 - DNA, 21 bp, Homo sapiens
ggccagcccctcccaccacag

SEQ ID NO: 3770103 - DNA, 23 bp, Homo sapiens
ggccagcccctcccaccacagca

SEQ ID NO: 3770104 - DNA, 14 bp, Homo sapiens
ggccagctggcagc

SEQ ID NO: 3770105 - DNA, 17 bp, Homo sapiens
ggccagctggcagcaga

SEQ ID NO: 3770106 - DNA, 18 bp, Homo sapiens
ggccagctggcagcagag

SEQ ID NO: 3770107 - DNA, 23 bp, Homo sapiens
ggccaggacagagctgacaaaat

SEQ ID NO: 3770108 - DNA, 15 bp, Homo sapiens
ggccaggacaggccc

SEQ ID NO: 3770109 - DNA, 20 bp, Homo sapiens
ggccaggagtttgagaccag

SEQ ID NO: 3770110 - DNA, 16 bp, Homo sapiens
ggccaggatggagggg

SEQ ID NO: 3770111 - DNA, 16 bp, Homo sapiens
ggccaggctccttcct

SEQ ID NO: 3770112 - DNA, 11 bp, Homo sapiens
ggccaggctgg

SEQ ID NO: 3770113 - DNA, 16 bp, Homo sapiens
ggccaggctggtctca

SEQ ID NO: 3770114 - DNA, 16 bp, Homo sapiens
ggccagggccctgcag

SEQ ID NO: 3770115 - DNA, 18 bp, Homo sapiens
ggccagggccctgcagag

SEQ ID NO: 3770116 - DNA, 22 bp, Homo sapiens
ggccagtcctgcctggccaggc

SEQ ID NO: 3770117 - DNA, 20 bp, Homo sapiens
ggccagtgtgacaaggattg

SEQ ID NO: 3770118 - DNA, 16 bp, Homo sapiens
ggccatcccaaggtct

SEQ ID NO: 3770119 - DNA, 23 bp, Homo sapiens
ggccatgaccactttccccgtgg

SEQ ID NO: 3770120 - DNA, 16 bp, Homo sapiens
ggccatgagctccaga

SEQ ID NO: 3770121 - DNA, 21 bp, Homo sapiens
ggccatgagctccagaccccc

SEQ ID NO: 3770122 - DNA, 21 bp, Homo sapiens
ggccatgaggcctcagtggac

SEQ ID NO: 3770123 - DNA, 17 bp, Homo sapiens
ggatgggaaggagggag

SEQ ID NO: 3770124 - DNA, 14 bp, Homo sapiens
ggatggtcctgggg

SEQ ID NO: 3770125 - DNA, 16 bp, Homo sapiens
ggatggtcctggggct

SEQ ID NO: 3770126 - DNA, 22 bp, Homo sapiens
ggatggtcctggggctctgtgc

SEQ ID NO: 3770127 - DNA, 16 bp, Homo sapiens
ggatgtaaacagtgcc

SEQ ID NO: 3770128 - DNA, 22 bp, Homo sapiens
ggatgtatccatgggggcaggg

SEQ ID NO: 3770129 - DNA, 13 bp, Homo sapiens
ggatgttctggga

SEQ ID NO: 3770130 - DNA, 16 bp, Homo sapiens
ggatgttctgggacac

SEQ ID NO: 3770131 - DNA, 14 bp, Homo sapiens
ggatgttgctcaga

SEQ ID NO: 3770132 - DNA, 15 bp, Homo sapiens
ggattcaggctgctt

SEQ ID NO: 3770133 - DNA, 20 bp, Homo sapiens
ggatttcatgatttcatttc

SEQ ID NO: 3770134 - DNA, 12 bp, Homo sapiens
ggattttcagcc

SEQ ID NO: 3770135 - DNA, 16 bp, Homo sapiens
ggcaaaatccttgctt

SEQ ID NO: 3770136 - DNA, 13 bp, Homo sapiens
ggcaaacaggcag

SEQ ID NO: 3770137 - DNA, 22 bp, Homo sapiens
ggcaaagcacgaaatgttattt

SEQ ID NO: 3770138 - DNA, 20 bp, Homo sapiens
ggcaacacagcgagactccg

SEQ ID NO: 3770139 - DNA, 12 bp, Homo sapiens
ggcaacagagca

SEQ ID NO: 3770140 - DNA, 22 bp, Homo sapiens
ggcaacatgcctgctttagaat

SEQ ID NO: 3770141 - DNA, 16 bp, Homo sapiens
ggcaacccccagcctg

SEQ ID NO: 3770142 - DNA, 19 bp, Homo sapiens
ggcaacccccagcctgcta

SEQ ID NO: 3770143 - DNA, 16 bp, Homo sapiens
ggcaacgaagaaaaaa

SEQ ID NO: 3770144 - DNA, 17 bp, Homo sapiens
ggcaacgaagaaaaaaa

SEQ ID NO: 3770145 - DNA, 16 bp, Homo sapiens
ggcaacgcacaaaaca

SEQ ID NO: 3770146 - DNA, 19 bp, Homo sapiens
ggcaactgaacaaaaaaat

SEQ ID NO: 3770147 - DNA, 19 bp, Homo sapiens
ggcaactgaggcagacagc

SEQ ID NO: 3770148 - DNA, 23 bp, Homo sapiens
ggcaactgaggcagacagcagct

SEQ ID NO: 3770149 - DNA, 22 bp, Homo sapiens
ggcaactgctgatgctcatggt

SEQ ID NO: 3770150 - DNA, 22 bp, Homo sapiens
ggcaagcttggctgtagaagga

SEQ ID NO: 3770151 - DNA, 15 bp, Homo sapiens
ggcaatgctggctgt

SEQ ID NO: 3770152 - DNA, 12 bp, Homo sapiens
ggcacaataaat

SEQ ID NO: 3770153 - DNA, 18 bp, Homo sapiens
ggcacaccgggcactcag

SEQ ID NO: 3770154 - DNA, 21 bp, Homo sapiens
ggcacagaaacacaatatttt

SEQ ID NO: 3770155 - DNA, 23 bp, Homo sapiens
ggcacagccggggcctgcctagc

SEQ ID NO: 3770156 - DNA, 18 bp, Homo sapiens
ggcacagcggggccccag

SEQ ID NO: 3770157 - DNA, 12 bp, Homo sapiens
ggcacagctgtg

SEQ ID NO: 3770158 - DNA, 18 bp, Homo sapiens
ggcacattttttttttta

SEQ ID NO: 3770159 - DNA, 16 bp, Homo sapiens
ggcaccaaagccacca

SEQ ID NO: 3770160 - DNA, 22 bp, Homo sapiens
ggcaccactgcactccagcctg

SEQ ID NO: 3770161 - DNA, 16 bp, Homo sapiens
ggcacccacccagcac

SEQ ID NO: 3770162 - DNA, 15 bp, Homo sapiens
ggcacccggcccctg

SEQ ID NO: 3770163 - DNA, 16 bp, Homo sapiens
ggcacccggcccctgc

SEQ ID NO: 3770164 - DNA, 18 bp, Homo sapiens
ggcacccggcccctgctg

SEQ ID NO: 3770165 - DNA, 20 bp, Homo sapiens
ggcacccggcccctgctggt

SEQ ID NO: 3770166 - DNA, 22 bp, Homo sapiens
ggcacccggcccctgctggttc

SEQ ID NO: 3770167 - DNA, 14 bp, Homo sapiens
ggcaccgagaatgt

SEQ ID NO: 3770168 - DNA, 22 bp, Homo sapiens
ggcacctatagtcccagctact

SEQ ID NO: 3770169 - DNA, 20 bp, Homo sapiens
ggcacgaacccacctgctga

SEQ ID NO: 3770170 - DNA, 18 bp, Homo sapiens
ggcacgctgtgggcaggt

SEQ ID NO: 3770171 - DNA, 23 bp, Homo sapiens
ggcactcagaagacactgatggg

SEQ ID NO: 3770172 - DNA, 17 bp, Homo sapiens
ggcactgagatatttat

SEQ ID NO: 3770173 - DNA, 13 bp, Homo sapiens
ggcactgtggcct

SEQ ID NO: 3770174 - DNA, 10 bp, Homo sapiens
ggcagaaaga

SEQ ID NO: 3770175 - DNA, 19 bp, Homo sapiens
ggcagaaagcagaggctgg

SEQ ID NO: 3770176 - DNA, 14 bp, Homo sapiens
ggcagaacagccgc

SEQ ID NO: 3770177 - DNA, 18 bp, Homo sapiens
ggcagaacagccgctcct

SEQ ID NO: 3770178 - DNA, 20 bp, Homo sapiens
ggcagaacagccgctcctgt

SEQ ID NO: 3770179 - DNA, 21 bp, Homo sapiens
ggcagaactgagctcctctgg

SEQ ID NO: 3770180 - DNA, 13 bp, Homo sapiens
ggcagacagcagc

SEQ ID NO: 3770181 - DNA, 14 bp, Homo sapiens
ggcagacagcagct

SEQ ID NO: 3770182 - DNA, 15 bp, Homo sapiens
ggcagacagcagctc

SEQ ID NO: 3770183 - DNA, 18 bp, Homo sapiens
ggcagacagcagctcagg

SEQ ID NO: 3770184 - DNA, 19 bp, Homo sapiens
ggcagaggctggaggcagg

SEQ ID NO: 3770185 - DNA, 21 bp, Homo sapiens
ggcagagtgccccacctgcca

SEQ ID NO: 3770186 - DNA, 23 bp, Homo sapiens
ggcagatacaggaaaagctgctg

SEQ ID NO: 3770187 - DNA, 24 bp, Homo sapiens
ggcagatttagtgaaagctagaga

SEQ ID NO: 3770188 - DNA, 16 bp, Homo sapiens
ggcagattttacaaaa

SEQ ID NO: 3770189 - DNA, 21 bp, Homo sapiens
ggcagcacagagacccccgga

SEQ ID NO: 3770190 - DNA, 21 bp, Homo sapiens
ggcagcaggcctgttgctttt

SEQ ID NO: 3770191 - DNA, 19 bp, Homo sapiens
ggcagccaaacccatgagg

SEQ ID NO: 3770192 - DNA, 20 bp, Homo sapiens
ggcagccaaacccatgaggc

SEQ ID NO: 3770193 - DNA, 12 bp, Homo sapiens
ggcagccaggct

SEQ ID NO: 3770194 - DNA, 19 bp, Homo sapiens
ggcagccaggctgccaagg

SEQ ID NO: 3770195 - DNA, 20 bp, Homo sapiens
ggcagccccattctgcctgc

SEQ ID NO: 3770196 - DNA, 18 bp, Homo sapiens
ggcagccgtgccttcagc

SEQ ID NO: 3770197 - DNA, 22 bp, Homo sapiens
ggcagccgtgccttcagctcta

SEQ ID NO: 3770198 - DNA, 21 bp, Homo sapiens
ggcagcctactagggacctgg

SEQ ID NO: 3770199 - DNA, 22 bp, Homo sapiens
ggcagcctactagggacctggg

SEQ ID NO: 3770200 - DNA, 24 bp, Homo sapiens
ggcagctgcggtccacccaggagc

SEQ ID NO: 3770201 - DNA, 17 bp, Homo sapiens
ggcagcttgagggttgg

SEQ ID NO: 3770202 - DNA, 20 bp, Homo sapiens
ggcaggacaacgaggaagcc

SEQ ID NO: 3770203 - DNA, 13 bp, Homo sapiens
ggcaggagctcag

SEQ ID NO: 3770204 - DNA, 23 bp, Homo sapiens
ggcagggaaggggaggcagccgg

SEQ ID NO: 3770205 - DNA, 19 bp, Homo sapiens
ggcagggccttgcccagag

SEQ ID NO: 3770206 - DNA, 17 bp, Homo sapiens
ggcagggtctcactctg

SEQ ID NO: 3770207 - DNA, 21 bp, Homo sapiens
ggcagggtgggatggaggaga

SEQ ID NO: 3770208 - DNA, 17 bp, Homo sapiens
ggcaggtgacagtgagg

SEQ ID NO: 3770209 - DNA, 19 bp, Homo sapiens
ggcaggtgacagtgaggtc

SEQ ID NO: 3770210 - DNA, 12 bp, Homo sapiens
ggcaggtgggag

SEQ ID NO: 3770211 - DNA, 16 bp, Homo sapiens
ggcaggtgggagcttg

SEQ ID NO: 3770212 - DNA, 19 bp, Homo sapiens
ggcagtcacctgcccagat

SEQ ID NO: 3770213 - DNA, 14 bp, Homo sapiens
ggcagttggccaga

SEQ ID NO: 3770214 - DNA, 13 bp, Homo sapiens
ggcatcacagggc

SEQ ID NO: 3770215 - DNA, 14 bp, Homo sapiens
ggcatcacagggca

SEQ ID NO: 3770216 - DNA, 22 bp, Homo sapiens
ggcatcacagggcagagccggg

SEQ ID NO: 3770217 - DNA, 23 bp, Homo sapiens
ggcatcacagggcagagccggga

SEQ ID NO: 3770218 - DNA, 23 bp, Homo sapiens
ggcatcaccttaggcagggaagt

SEQ ID NO: 3770219 - DNA, 21 bp, Homo sapiens
ggcatcccagtggcctcaacc

SEQ ID NO: 3770220 - DNA, 15 bp, Homo sapiens
ggcatctgacacaaa

SEQ ID NO: 3770221 - DNA, 14 bp, Homo sapiens
ggcatctgcccctc

SEQ ID NO: 3770222 - DNA, 13 bp, Homo sapiens
ggcatctggcctt

SEQ ID NO: 3770223 - DNA, 16 bp, Homo sapiens
ggcatctttgccttgg

SEQ ID NO: 3770224 - DNA, 19 bp, Homo sapiens
ggcatctttgccttgggct

SEQ ID NO: 3770225 - DNA, 20 bp, Homo sapiens
ggcatctttgctatggggac

SEQ ID NO: 3770226 - DNA, 15 bp, Homo sapiens
ggcatgcacagctgt

SEQ ID NO: 3770227 - DNA, 19 bp, Homo sapiens
ggcatgcgcacaaggctga

SEQ ID NO: 3770228 - DNA, 22 bp, Homo sapiens
ggcatgctggctcccagggcca

SEQ ID NO: 3770229 - DNA, 12 bp, Homo sapiens
ggcatgctgggg

SEQ ID NO: 3770230 - DNA, 14 bp, Homo sapiens
ggcatgctggggca

SEQ ID NO: 3770231 - DNA, 17 bp, Homo sapiens
ggcatggccaggtggcc

SEQ ID NO: 3770232 - DNA, 19 bp, Homo sapiens
ggcatgggggcctcagggc

SEQ ID NO: 3770233 - DNA, 23 bp, Homo sapiens
ggcatgggggcctcagggcagcc

SEQ ID NO: 3770234 - DNA, 19 bp, Homo sapiens
ggcatggtacggagatgtt

SEQ ID NO: 3770235 - DNA, 22 bp, Homo sapiens
ggcatggtggcgcaagcctgta

SEQ ID NO: 3770236 - DNA, 20 bp, Homo sapiens
ggcatgttctctgaggacac

SEQ ID NO: 3770237 - DNA, 14 bp, Homo sapiens
ggaagaacatagaa

SEQ ID NO: 3770238 - DNA, 14 bp, Homo sapiens
ggaagagaaacagg

SEQ ID NO: 3770239 - DNA, 17 bp, Homo sapiens
ggaagataggctctgca

SEQ ID NO: 3770240 - DNA, 18 bp, Homo sapiens
ggaagataggctctgcac

SEQ ID NO: 3770241 - DNA, 21 bp, Homo sapiens
ggaagataggctctgcacaga

SEQ ID NO: 3770242 - DNA, 20 bp, Homo sapiens
ggaagcagtgccttccataa

SEQ ID NO: 3770243 - DNA, 17 bp, Homo sapiens
ggaagcatgtaggagaa

SEQ ID NO: 3770244 - DNA, 21 bp, Homo sapiens
ggaagccaccctcccagctct

SEQ ID NO: 3770245 - DNA, 22 bp, Homo sapiens
ggaagccaccctcccagctctg

SEQ ID NO: 3770246 - DNA, 23 bp, Homo sapiens
ggaagccaccctcccagctctga

SEQ ID NO: 3770247 - DNA, 12 bp, Homo sapiens
ggaagccctcct

SEQ ID NO: 3770248 - DNA, 23 bp, Homo sapiens
ggaagcgatgaatttggagactc

SEQ ID NO: 3770249 - DNA, 15 bp, Homo sapiens
ggaagctgctccgtg

SEQ ID NO: 3770250 - DNA, 14 bp, Homo sapiens
ggaaggagagcctg

SEQ ID NO: 3770251 - DNA, 15 bp, Homo sapiens
ggaaggagagcctgc

SEQ ID NO: 3770252 - DNA, 17 bp, Homo sapiens
ggaaggagagcctgctg

SEQ ID NO: 3770253 - DNA, 18 bp, Homo sapiens
ggaaggccacctgcaggt

SEQ ID NO: 3770254 - DNA, 17 bp, Homo sapiens
ggaaggctgagaggaga

SEQ ID NO: 3770255 - DNA, 14 bp, Homo sapiens
ggaagggcaaaacc

SEQ ID NO: 3770256 - DNA, 20 bp, Homo sapiens
ggaaggggctggactggctg

SEQ ID NO: 3770257 - DNA, 18 bp, Homo sapiens
ggaagggtttgtggctgg

SEQ ID NO: 3770258 - DNA, 18 bp, Homo sapiens
ggaagtccccaggcccca

SEQ ID NO: 3770259 - DNA, 23 bp, Homo sapiens
ggaagtccccaggccccaggaag

SEQ ID NO: 3770260 - DNA, 14 bp, Homo sapiens
ggaagtctaggagc

SEQ ID NO: 3770261 - DNA, 18 bp, Homo sapiens
ggaagtgacaaggcccca

SEQ ID NO: 3770262 - DNA, 19 bp, Homo sapiens
ggaagtgacaaggccccag

SEQ ID NO: 3770263 - DNA, 21 bp, Homo sapiens
ggaagtgacaaggccccagag

SEQ ID NO: 3770264 - DNA, 22 bp, Homo sapiens
ggaagtgacaaggccccagaga

SEQ ID NO: 3770265 - DNA, 17 bp, Homo sapiens
ggaagtgtaacagctga

SEQ ID NO: 3770266 - DNA, 19 bp, Homo sapiens
ggaagtgtaacagctgagg

SEQ ID NO: 3770267 - DNA, 20 bp, Homo sapiens
ggaataaggccttaatatgt

SEQ ID NO: 3770268 - DNA, 14 bp, Homo sapiens
ggaatagcatgtca

SEQ ID NO: 3770269 - DNA, 17 bp, Homo sapiens
ggaatagcatgtcacta

SEQ ID NO: 3770270 - DNA, 15 bp, Homo sapiens
ggaatattttattca

SEQ ID NO: 3770271 - DNA, 19 bp, Homo sapiens
ggaatattttattcaaggt

SEQ ID NO: 3770272 - DNA, 22 bp, Homo sapiens
ggaatcaagatgtcagactggc

SEQ ID NO: 3770273 - DNA, 19 bp, Homo sapiens
ggaatctagaagaaatgaa

SEQ ID NO: 3770274 - DNA, 16 bp, Homo sapiens
ggaatgcggcaagaag

SEQ ID NO: 3770275 - DNA, 15 bp, Homo sapiens
ggaatggcacagccc

SEQ ID NO: 3770276 - DNA, 14 bp, Homo sapiens
ggaattaaaacaat

SEQ ID NO: 3770277 - DNA, 14 bp, Homo sapiens
ggaattaacctggt

SEQ ID NO: 3770278 - DNA, 16 bp, Homo sapiens
ggaattaacctggtgc

SEQ ID NO: 3770279 - DNA, 20 bp, Homo sapiens
ggaattcatctctctttaat

SEQ ID NO: 3770280 - DNA, 17 bp, Homo sapiens
ggacaaagtctccagcc

SEQ ID NO: 3770281 - DNA, 17 bp, Homo sapiens
ggacaaatttaaaacaa

SEQ ID NO: 3770282 - DNA, 15 bp, Homo sapiens
ggacaacgaggaagc

SEQ ID NO: 3770283 - DNA, 22 bp, Homo sapiens
ggacaaggctagatcatgaaga

SEQ ID NO: 3770284 - DNA, 19 bp, Homo sapiens
ggacaatcatgaaatatgc

SEQ ID NO: 3770285 - DNA, 21 bp, Homo sapiens
ggacaatcatgaaatatgcat

SEQ ID NO: 3770286 - DNA, 13 bp, Homo sapiens
ggacacacaaggt

SEQ ID NO: 3770287 - DNA, 14 bp, Homo sapiens
ggacacagctcttc

SEQ ID NO: 3770288 - DNA, 18 bp, Homo sapiens
ggacacctgtactggaga

SEQ ID NO: 3770289 - DNA, 19 bp, Homo sapiens
ggacacctgtactggagag

SEQ ID NO: 3770290 - DNA, 21 bp, Homo sapiens
ggacacctgtactggagagca

SEQ ID NO: 3770291 - DNA, 22 bp, Homo sapiens
ggacacggggcagtggcaacct

SEQ ID NO: 3770292 - DNA, 17 bp, Homo sapiens
ggacactaaccacgctg

SEQ ID NO: 3770293 - DNA, 14 bp, Homo sapiens
ggacagagacacct

SEQ ID NO: 3770294 - DNA, 20 bp, Homo sapiens
ggacagcaaaaccattgctt

SEQ ID NO: 3770295 - DNA, 21 bp, Homo sapiens
ggacagcaaaaccattgcttc

SEQ ID NO: 3770296 - DNA, 22 bp, Homo sapiens
ggacagcaaaaccattgcttca

SEQ ID NO: 3770297 - DNA, 20 bp, Homo sapiens
gctgccttagaacctttctt

SEQ ID NO: 3770298 - DNA, 15 bp, Homo sapiens
gctgcggcacccttg

SEQ ID NO: 3770299 - DNA, 16 bp, Homo sapiens
gctgcggtccacccag

SEQ ID NO: 3770300 - DNA, 21 bp, Homo sapiens
gctgcggtccacccaggagcc

SEQ ID NO: 3770301 - DNA, 13 bp, Homo sapiens
gctgcgtctccca

SEQ ID NO: 3770302 - DNA, 18 bp, Homo sapiens
gctgctaaatctcctatt

SEQ ID NO: 3770303 - DNA, 15 bp, Homo sapiens
gctgctaatcttcag

SEQ ID NO: 3770304 - DNA, 19 bp, Homo sapiens
gctgctagcacttggagcc

SEQ ID NO: 3770305 - DNA, 15 bp, Homo sapiens
gctgctcctccaggg

SEQ ID NO: 3770306 - DNA, 19 bp, Homo sapiens
gctgctccttagctgccaa

SEQ ID NO: 3770307 - DNA, 15 bp, Homo sapiens
gctgctctgcccaga

SEQ ID NO: 3770308 - DNA, 16 bp, Homo sapiens
gctgctctgcccagag

SEQ ID NO: 3770309 - DNA, 17 bp, Homo sapiens
gctgctctgcccagagc

SEQ ID NO: 3770310 - DNA, 21 bp, Homo sapiens
gctgctctgcccagagctggg

SEQ ID NO: 3770311 - DNA, 12 bp, Homo sapiens
gctgctgacagt

SEQ ID NO: 3770312 - DNA, 18 bp, Homo sapiens
gctgctgacctccacagc

SEQ ID NO: 3770313 - DNA, 19 bp, Homo sapiens
gctgctgacctccacagct

SEQ ID NO: 3770314 - DNA, 12 bp, Homo sapiens
gctgctgctgct

SEQ ID NO: 3770315 - DNA, 14 bp, Homo sapiens
gctgctggaggaaa

SEQ ID NO: 3770316 - DNA, 22 bp, Homo sapiens
gctgcttttccctaagccaagg

SEQ ID NO: 3770317 - DNA, 12 bp, Homo sapiens
gctgcttttcct

SEQ ID NO: 3770318 - DNA, 23 bp, Homo sapiens
gctgcttttccttggggcaggca

SEQ ID NO: 3770319 - DNA, 13 bp, Homo sapiens
gctggaagggtca

SEQ ID NO: 3770320 - DNA, 14 bp, Homo sapiens
gctggacaggtctg

SEQ ID NO: 3770321 - DNA, 17 bp, Homo sapiens
gctggacctcaccaagc

SEQ ID NO: 3770322 - DNA, 12 bp, Homo sapiens
gctggactggct

SEQ ID NO: 3770323 - DNA, 12 bp, Homo sapiens
gctggagcggct

SEQ ID NO: 3770324 - DNA, 12 bp, Homo sapiens
gctggaggcagg

SEQ ID NO: 3770325 - DNA, 16 bp, Homo sapiens
gctggaggcagggcct

SEQ ID NO: 3770326 - DNA, 21 bp, Homo sapiens
gctggaggcagggccttgccc

SEQ ID NO: 3770327 - DNA, 19 bp, Homo sapiens
gctggagtgcagtggtgcg

SEQ ID NO: 3770328 - DNA, 22 bp, Homo sapiens
gctggatgctccttccaacagg

SEQ ID NO: 3770329 - DNA, 15 bp, Homo sapiens
gctggcaaagacaga

SEQ ID NO: 3770330 - DNA, 23 bp, Homo sapiens
gctggcacatttccccagacctg

SEQ ID NO: 3770331 - DNA, 14 bp, Homo sapiens
gctggcccagccaa

SEQ ID NO: 3770332 - DNA, 12 bp, Homo sapiens
gctggcccccac

SEQ ID NO: 3770333 - DNA, 15 bp, Homo sapiens
gctggcccccactgg

SEQ ID NO: 3770334 - DNA, 17 bp, Homo sapiens
gctggcccccactggct

SEQ ID NO: 3770335 - DNA, 21 bp, Homo sapiens
gctggcccccactggctgtgg

SEQ ID NO: 3770336 - DNA, 24 bp, Homo sapiens
gctggcccccactggctgtgggct

SEQ ID NO: 3770337 - DNA, 20 bp, Homo sapiens
gctggccgagggtcctggct

SEQ ID NO: 3770338 - DNA, 15 bp, Homo sapiens
gctggccgggcacag

SEQ ID NO: 3770339 - DNA, 14 bp, Homo sapiens
gctggcgtgcagtg

SEQ ID NO: 3770340 - DNA, 19 bp, Homo sapiens
gctggctgcccagacccct

SEQ ID NO: 3770341 - DNA, 11 bp, Homo sapiens
gctggctgcct

SEQ ID NO: 3770342 - DNA, 14 bp, Homo sapiens
gctggctgccttag

SEQ ID NO: 3770343 - DNA, 20 bp, Homo sapiens
gctggctgccttagaacctt

SEQ ID NO: 3770344 - DNA, 11 bp, Homo sapiens
gctggctgggg

SEQ ID NO: 3770345 - DNA, 18 bp, Homo sapiens
gctggctgttggctgggg

SEQ ID NO: 3770346 - DNA, 20 bp, Homo sapiens
gctggctgttggctgggggc

SEQ ID NO: 3770347 - DNA, 18 bp, Homo sapiens
gctgggactacaggcacc

SEQ ID NO: 3770348 - DNA, 17 bp, Homo sapiens
gctgggatctgactgca

SEQ ID NO: 3770349 - DNA, 19 bp, Homo sapiens
gctgggcaacatgcctgct

SEQ ID NO: 3770350 - DNA, 13 bp, Homo sapiens
gctgggcagctgt

SEQ ID NO: 3770351 - DNA, 15 bp, Homo sapiens
gctgggcccagaggc

SEQ ID NO: 3770352 - DNA, 19 bp, Homo sapiens
gctgggcccagaggcacag

SEQ ID NO: 3770353 - DNA, 20 bp, Homo sapiens
gctgggcccagaggcacagc

SEQ ID NO: 3770354 - DNA, 20 bp, Homo sapiens
gctgggctctccacctcagc

SEQ ID NO: 3770355 - DNA, 17 bp, Homo sapiens
gctgggcttcagtggca

SEQ ID NO: 3770356 - DNA, 20 bp, Homo sapiens
gctgggcttcagtggcagct

SEQ ID NO: 3770357 - DNA, 17 bp, Homo sapiens
gctggggcaagtccctg

SEQ ID NO: 3770358 - DNA, 20 bp, Homo sapiens
gctgggggcagcctgcgtgg

SEQ ID NO: 3770359 - DNA, 16 bp, Homo sapiens
gctgggggccatgagc

SEQ ID NO: 3770360 - DNA, 23 bp, Homo sapiens
gctgggggccatgagctccagac

SEQ ID NO: 3770361 - DNA, 13 bp, Homo sapiens
gctgggggcctca

SEQ ID NO: 3770362 - DNA, 19 bp, Homo sapiens
gctgggggcctcagtgcca

SEQ ID NO: 3770363 - DNA, 22 bp, Homo sapiens
gctgggtgtattaggactggct

SEQ ID NO: 3770364 - DNA, 14 bp, Homo sapiens
gctggtagagatgg

SEQ ID NO: 3770365 - DNA, 15 bp, Homo sapiens
gctggtagagatgga

SEQ ID NO: 3770366 - DNA, 21 bp, Homo sapiens
gctggtagagatggaggagga

SEQ ID NO: 3770367 - DNA, 23 bp, Homo sapiens
gctggtagagatggaggaggagg

SEQ ID NO: 3770368 - DNA, 17 bp, Homo sapiens
gtacagacgtatgctta

SEQ ID NO: 3770369 - DNA, 17 bp, Homo sapiens
gtacagattgctgcttc

SEQ ID NO: 3770370 - DNA, 19 bp, Homo sapiens
gtacagattgctgcttctg

SEQ ID NO: 3770371 - DNA, 15 bp, Homo sapiens
gtacaggcagcacag

SEQ ID NO: 3770372 - DNA, 16 bp, Homo sapiens
gtacagtgtgtaaagt

SEQ ID NO: 3770373 - DNA, 21 bp, Homo sapiens
gtacagttgggaaaatatgtc

SEQ ID NO: 3770374 - DNA, 17 bp, Homo sapiens
gtacatactttttcaag

SEQ ID NO: 3770375 - DNA, 23 bp, Homo sapiens
gtacatactttttcaagattgat

SEQ ID NO: 3770376 - DNA, 18 bp, Homo sapiens
gtacatagttatttattt

SEQ ID NO: 3770377 - DNA, 13 bp, Homo sapiens
gtacatttctgaa

SEQ ID NO: 3770378 - DNA, 17 bp, Homo sapiens
gtacatttctgaaatga

SEQ ID NO: 3770379 - DNA, 13 bp, Homo sapiens
gtacattttcata

SEQ ID NO: 3770380 - DNA, 15 bp, Homo sapiens
gtacattttcatatg

SEQ ID NO: 3770381 - DNA, 21 bp, Homo sapiens
gtaccaatcattttaattatt

SEQ ID NO: 3770382 - DNA, 14 bp, Homo sapiens
gtaccactcaggcc

SEQ ID NO: 3770383 - DNA, 20 bp, Homo sapiens
gtaccatgaaacaaagctgc

SEQ ID NO: 3770384 - DNA, 14 bp, Homo sapiens
gtacccacctgagc

SEQ ID NO: 3770385 - DNA, 15 bp, Homo sapiens
gtacccacctgagct

SEQ ID NO: 3770386 - DNA, 14 bp, Homo sapiens
gtacccactgctct

SEQ ID NO: 3770387 - DNA, 16 bp, Homo sapiens
gtacccactgctctgg

SEQ ID NO: 3770388 - DNA, 18 bp, Homo sapiens
gtaccccagctctgcttg

SEQ ID NO: 3770389 - DNA, 18 bp, Homo sapiens
gtaccttgaacactgggg

SEQ ID NO: 3770390 - DNA, 17 bp, Homo sapiens
gtacgtctgacaggcaa

SEQ ID NO: 3770391 - DNA, 15 bp, Homo sapiens
gtactacaatttaaa

SEQ ID NO: 3770392 - DNA, 20 bp, Homo sapiens
gtactactagatgtctttag

SEQ ID NO: 3770393 - DNA, 13 bp, Homo sapiens
gtactatatctgt

SEQ ID NO: 3770394 - DNA, 20 bp, Homo sapiens
gtactcatcatcaaccctaa

SEQ ID NO: 3770395 - DNA, 21 bp, Homo sapiens
gtactcctgcaaaattttata

SEQ ID NO: 3770396 - DNA, 14 bp, Homo sapiens
gtactctggcctct

SEQ ID NO: 3770397 - DNA, 19 bp, Homo sapiens
gtacttaaatgaaagcatg

SEQ ID NO: 3770398 - DNA, 19 bp, Homo sapiens
gtacttagcagctatctct

SEQ ID NO: 3770399 - DNA, 18 bp, Homo sapiens
gtacttctccaccctgct

SEQ ID NO: 3770400 - DNA, 20 bp, Homo sapiens
gtacttctccaccctgctct

SEQ ID NO: 3770401 - DNA, 22 bp, Homo sapiens
gtacttttggaatctagaagaa

SEQ ID NO: 3770402 - DNA, 18 bp, Homo sapiens
gtagaaagacagagctgg

SEQ ID NO: 3770403 - DNA, 16 bp, Homo sapiens
gtagaaataatatgca

SEQ ID NO: 3770404 - DNA, 20 bp, Homo sapiens
gtagaaatccccctttctct

SEQ ID NO: 3770405 - DNA, 13 bp, Homo sapiens
gtagaaggagaca

SEQ ID NO: 3770406 - DNA, 19 bp, Homo sapiens
gtagacacaggatagataa

SEQ ID NO: 3770407 - DNA, 17 bp, Homo sapiens
gtagacccctggctggt

SEQ ID NO: 3770408 - DNA, 17 bp, Homo sapiens
gtagacctagggaggac

SEQ ID NO: 3770409 - DNA, 23 bp, Homo sapiens
gtagacgtgcacgcacactgtct

SEQ ID NO: 3770410 - DNA, 11 bp, Homo sapiens
gtagagacagg

SEQ ID NO: 3770411 - DNA, 12 bp, Homo sapiens
gtagagacaggg

SEQ ID NO: 3770412 - DNA, 17 bp, Homo sapiens
gtagagatggaggagga

SEQ ID NO: 3770413 - DNA, 15 bp, Homo sapiens
gtagagccagggtct

SEQ ID NO: 3770414 - DNA, 18 bp, Homo sapiens
gtagagccagggtctcac

SEQ ID NO: 3770415 - DNA, 13 bp, Homo sapiens
gtagagtgggagc

SEQ ID NO: 3770416 - DNA, 15 bp, Homo sapiens
gtagagtgggagctg

SEQ ID NO: 3770417 - DNA, 13 bp, Homo sapiens
gtagatagaaata

SEQ ID NO: 3770418 - DNA, 16 bp, Homo sapiens
gtagattgcttctgta

SEQ ID NO: 3770419 - DNA, 17 bp, Homo sapiens
gtagcaggtaccactga

SEQ ID NO: 3770420 - DNA, 13 bp, Homo sapiens
gtagcatacattt

SEQ ID NO: 3770421 - DNA, 12 bp, Homo sapiens
gtagcatgagag

SEQ ID NO: 3770422 - DNA, 21 bp, Homo sapiens
gtagcatgttgagccaggcct

SEQ ID NO: 3770423 - DNA, 23 bp, Homo sapiens
gtagccccaagaaggctggggct

SEQ ID NO: 3770424 - DNA, 17 bp, Homo sapiens
gtagccctggccagagg

SEQ ID NO: 3770425 - DNA, 22 bp, Homo sapiens
gtagctctaggagggctggcaa

SEQ ID NO: 3770426 - DNA, 12 bp, Homo sapiens
gtagctgggact

SEQ ID NO: 3770427 - DNA, 18 bp, Homo sapiens
gtagctgtggtgaggtgg

SEQ ID NO: 3770428 - DNA, 18 bp, Homo sapiens
gtaggaaggttaatgttc

SEQ ID NO: 3770429 - DNA, 17 bp, Homo sapiens
gtaggctttacttagct

SEQ ID NO: 3770430 - DNA, 18 bp, Homo sapiens
gtagggagtacctgctgc

SEQ ID NO: 3770431 - DNA, 21 bp, Homo sapiens
gtagggcgggaggatgttctg

SEQ ID NO: 3770432 - DNA, 22 bp, Homo sapiens
gtagggcgggaggatgttctgg

SEQ ID NO: 3770433 - DNA, 17 bp, Homo sapiens
gtagggtaaggtgcctt

SEQ ID NO: 3770434 - DNA, 16 bp, Homo sapiens
gtagggttataataat

SEQ ID NO: 3770435 - DNA, 21 bp, Homo sapiens
gtagtactcctgcaaaatttt

SEQ ID NO: 3770436 - DNA, 12 bp, Homo sapiens
gtagtcccagct

SEQ ID NO: 3770437 - DNA, 15 bp, Homo sapiens
gtagtctaaccaaat

SEQ ID NO: 3770438 - DNA, 11 bp, Homo sapiens
gtagttaggaa

SEQ ID NO: 3770439 - DNA, 13 bp, Homo sapiens
gtagttaggaaat

SEQ ID NO: 3770440 - DNA, 15 bp, Homo sapiens
gtagttaggaaataa

SEQ ID NO: 3770441 - DNA, 22 bp, Homo sapiens
gtagttaggaaataaaaccttt

SEQ ID NO: 3770442 - DNA, 17 bp, Homo sapiens
gtagtttttcttcaaca

SEQ ID NO: 3770443 - DNA, 12 bp, Homo sapiens
gtataatatttt

SEQ ID NO: 3770444 - DNA, 19 bp, Homo sapiens
gtataatggttgactgggt

SEQ ID NO: 3770445 - DNA, 22 bp, Homo sapiens
gtataattttttaaagttactt

SEQ ID NO: 3770446 - DNA, 18 bp, Homo sapiens
gtatacaagataagcttc

SEQ ID NO: 3770447 - DNA, 14 bp, Homo sapiens
gtatatatagaatc

SEQ ID NO: 3770448 - DNA, 16 bp, Homo sapiens
gtatatcagtatctga

SEQ ID NO: 3770449 - DNA, 16 bp, Homo sapiens
gtatatgtatgtgtgt

SEQ ID NO: 3770450 - DNA, 15 bp, Homo sapiens
gtatatgtctcaggt

SEQ ID NO: 3770451 - DNA, 16 bp, Homo sapiens
gtatattaaaaatggt

SEQ ID NO: 3770452 - DNA, 21 bp, Homo sapiens
gtatattaaaaatggtaaaat

SEQ ID NO: 3770453 - DNA, 19 bp, Homo sapiens
gtatatttatataattatg

SEQ ID NO: 3770454 - DNA, 17 bp, Homo sapiens
gtatatttttgtttgtt

SEQ ID NO: 3770455 - DNA, 19 bp, Homo sapiens
gtatcaaacagctcaggct

SEQ ID NO: 3770456 - DNA, 18 bp, Homo sapiens
gtatcaacccagaaacac

SEQ ID NO: 3770457 - DNA, 18 bp, Homo sapiens
gtatcaggcctgccagac

SEQ ID NO: 3770458 - DNA, 12 bp, Homo sapiens
gtatcatagaaa

SEQ ID NO: 3770459 - DNA, 14 bp, Homo sapiens
gtatcatatattta

SEQ ID NO: 3770460 - DNA, 18 bp, Homo sapiens
gtatccactgtttattca

SEQ ID NO: 3770461 - DNA, 17 bp, Homo sapiens
gtatccagtacatttaa

SEQ ID NO: 3770462 - DNA, 18 bp, Homo sapiens
gtatccagtacatttaat

SEQ ID NO: 3770463 - DNA, 17 bp, Homo sapiens
gtatcctgcccagtgtt

SEQ ID NO: 3770464 - DNA, 17 bp, Homo sapiens
gtatcgggggctggggc

SEQ ID NO: 3770465 - DNA, 15 bp, Homo sapiens
gtatctagtgcagct

SEQ ID NO: 3770466 - DNA, 14 bp, Homo sapiens
gtatctgggaactg

SEQ ID NO: 3770467 - DNA, 18 bp, Homo sapiens
gtatgactaaagagagaa

SEQ ID NO: 3770468 - DNA, 18 bp, Homo sapiens
gtatgtcaactttatgca

SEQ ID NO: 3770469 - DNA, 14 bp, Homo sapiens
gtatgtgccattta

SEQ ID NO: 3770470 - DNA, 15 bp, Homo sapiens
gtatgtgtgtgtatg

SEQ ID NO: 3770471 - DNA, 16 bp, Homo sapiens
gtatgtgtgtgtatgc

SEQ ID NO: 3770472 - DNA, 14 bp, Homo sapiens
gtatgtttgcacac

SEQ ID NO: 3770473 - DNA, 14 bp, Homo sapiens
gtattaaagggggg

SEQ ID NO: 3770474 - DNA, 15 bp, Homo sapiens
gtattacttctgcta

SEQ ID NO: 3770475 - DNA, 14 bp, Homo sapiens
gtattcaagaaagc

SEQ ID NO: 3770476 - DNA, 19 bp, Homo sapiens
gtattccaccttaaattaa

SEQ ID NO: 3770477 - DNA, 22 bp, Homo sapiens
gtattccaccttaaattaaaca

SEQ ID NO: 3770478 - DNA, 20 bp, Homo sapiens
gtattccttttgtgtacagt

SEQ ID NO: 3770479 - DNA, 23 bp, Homo sapiens
gtattccttttgtgtacagtgtg

SEQ ID NO: 3770480 - DNA, 11 bp, Homo sapiens
gtattctgtac

SEQ ID NO: 3770481 - DNA, 16 bp, Homo sapiens
gtattgtgattatcaa

SEQ ID NO: 3770482 - DNA, 16 bp, Homo sapiens
gtatttaattgtaaac

SEQ ID NO: 3770483 - DNA, 19 bp, Homo sapiens
gtatttaattgtaaactgt

SEQ ID NO: 3770484 - DNA, 17 bp, Homo sapiens
gtatttatatatttata

SEQ ID NO: 3770485 - DNA, 19 bp, Homo sapiens
gtatttatctattgtaaga

SEQ ID NO: 3770486 - DNA, 19 bp, Homo sapiens
gtatttattttcctcccca

SEQ ID NO: 3770487 - DNA, 20 bp, Homo sapiens
gtatttattttcctccccag

SEQ ID NO: 3770488 - DNA, 23 bp, Homo sapiens
gtatttattttcctccccagcag

SEQ ID NO: 3770489 - DNA, 15 bp, Homo sapiens
gtatttgaatcagcc

SEQ ID NO: 3770490 - DNA, 14 bp, Homo sapiens
gtatttgttaatgg

SEQ ID NO: 3770491 - DNA, 21 bp, Homo sapiens
gtattttataaaattaaagaa

SEQ ID NO: 3770492 - DNA, 23 bp, Homo sapiens
gtattttatgtatgtttacactg

SEQ ID NO: 3770493 - DNA, 22 bp, Homo sapiens
gtattttgtttttgtcttaaaa

SEQ ID NO: 3770494 - DNA, 15 bp, Homo sapiens
gtcaaacatgaagtg

SEQ ID NO: 3770495 - DNA, 17 bp, Homo sapiens
gtcaaacgtgaaaatgc

SEQ ID NO: 3770496 - DNA, 16 bp, Homo sapiens
gtcaaactgtagaaat

SEQ ID NO: 3770497 - DNA, 21 bp, Homo sapiens
gtcaacaagtatgaataaaga

SEQ ID NO: 3770498 - DNA, 19 bp, Homo sapiens
gtcaagagggtctgaggaa

SEQ ID NO: 3770499 - DNA, 14 bp, Homo sapiens
gtcaagcccaggag

SEQ ID NO: 3770500 - DNA, 11 bp, Homo sapiens
gtcaaggccag

SEQ ID NO: 3770501 - DNA, 12 bp, Homo sapiens
gtcaaggccagc

SEQ ID NO: 3770502 - DNA, 13 bp, Homo sapiens
gtcaaggccagca

SEQ ID NO: 3770503 - DNA, 21 bp, Homo sapiens
gtcaagtctctgctggcccag

SEQ ID NO: 3770504 - DNA, 19 bp, Homo sapiens
gtcaatacagtacaggcag

SEQ ID NO: 3770505 - DNA, 21 bp, Homo sapiens
gtcaatacagtacaggcagca

SEQ ID NO: 3770506 - DNA, 16 bp, Homo sapiens
gtcaatcccctcattc

SEQ ID NO: 3770507 - DNA, 17 bp, Homo sapiens
gtcaatcccctcattca

SEQ ID NO: 3770508 - DNA, 16 bp, Homo sapiens
gtcaatcctgtgggtg

SEQ ID NO: 3770509 - DNA, 11 bp, Homo sapiens
gtcacaataaa

SEQ ID NO: 3770510 - DNA, 20 bp, Homo sapiens
gtcacacagtattacttctg

SEQ ID NO: 3770511 - DNA, 18 bp, Homo sapiens
gtcacaggactctgcctc

SEQ ID NO: 3770512 - DNA, 19 bp, Homo sapiens
gtcacaggactctgcctcc

SEQ ID NO: 3770513 - DNA, 13 bp, Homo sapiens
gtcacaggcaggt

SEQ ID NO: 3770514 - DNA, 14 bp, Homo sapiens
gtcacatacaatta

SEQ ID NO: 3770515 - DNA, 15 bp, Homo sapiens
gtcaccaagcccagt

SEQ ID NO: 3770516 - DNA, 19 bp, Homo sapiens
gtcaccaccttcccagctc

SEQ ID NO: 3770517 - DNA, 22 bp, Homo sapiens
gtcaccaccttcccagctctcc

SEQ ID NO: 3770518 - DNA, 19 bp, Homo sapiens
gtcaccggatcctgggtgg

SEQ ID NO: 3770519 - DNA, 23 bp, Homo sapiens
gtcaccggatcctgggtggtctg

SEQ ID NO: 3770520 - DNA, 17 bp, Homo sapiens
gtcaccttttaaatcct

SEQ ID NO: 3770521 - DNA, 19 bp, Homo sapiens
gtcaccttttaaatcctgt

SEQ ID NO: 3770522 - DNA, 22 bp, Homo sapiens
gtcactaaagcaggccttttga

SEQ ID NO: 3770523 - DNA, 17 bp, Homo sapiens
gtcactactcacagtct

SEQ ID NO: 3770524 - DNA, 22 bp, Homo sapiens
gtcactactcacagtctcttta

SEQ ID NO: 3770525 - DNA, 23 bp, Homo sapiens
gtcactcaacaaaagtgctttgg

SEQ ID NO: 3770526 - DNA, 12 bp, Homo sapiens
gtcactcctggg

SEQ ID NO: 3770527 - DNA, 20 bp, Homo sapiens
gtcactgccatggaggcaca

SEQ ID NO: 3770528 - DNA, 20 bp, Homo sapiens
gtcactgcctctccctggcc

SEQ ID NO: 3770529 - DNA, 21 bp, Homo sapiens
gtcactggtagaccaaaataa

SEQ ID NO: 3770530 - DNA, 17 bp, Homo sapiens
gtcactgttccttgtca

SEQ ID NO: 3770531 - DNA, 15 bp, Homo sapiens
gtcactgtttctctg

SEQ ID NO: 3770532 - DNA, 15 bp, Homo sapiens
gtcagactgctggga

SEQ ID NO: 3770533 - DNA, 16 bp, Homo sapiens
gtcagagcctgcagtt

SEQ ID NO: 3770534 - DNA, 19 bp, Homo sapiens
gtcagagtaagctgctttt

SEQ ID NO: 3770535 - DNA, 13 bp, Homo sapiens
gtcagcaggaagc

SEQ ID NO: 3770536 - DNA, 16 bp, Homo sapiens
gtcagcttgctgccct

SEQ ID NO: 3770537 - DNA, 20 bp, Homo sapiens
gtcagcttgctgccctaggc

SEQ ID NO: 3770538 - DNA, 15 bp, Homo sapiens
gtcaggaacagaagg

SEQ ID NO: 3770539 - DNA, 16 bp, Homo sapiens
gtcaggaacagaagga

SEQ ID NO: 3770540 - DNA, 17 bp, Homo sapiens
gtcaggaacagaaggat

SEQ ID NO: 3770541 - DNA, 22 bp, Homo sapiens
gtcaggagttgtttctgaccca

SEQ ID NO: 3770542 - DNA, 16 bp, Homo sapiens
gtcaggccacggcagc

SEQ ID NO: 3770543 - DNA, 14 bp, Homo sapiens
gtcagggaccaagg

SEQ ID NO: 3770544 - DNA, 16 bp, Homo sapiens
gtcagggaccaaggac

SEQ ID NO: 3770545 - DNA, 21 bp, Homo sapiens
gtcagggaccaaggacccctc

SEQ ID NO: 3770546 - DNA, 18 bp, Homo sapiens
gtcagtacccacctgagc

SEQ ID NO: 3770547 - DNA, 20 bp, Homo sapiens
gtcagtacccacctgagctt

SEQ ID NO: 3770548 - DNA, 16 bp, Homo sapiens
gtcagtatcaggcctg

SEQ ID NO: 3770549 - DNA, 22 bp, Homo sapiens
gtcagtcatgatggcaccactg

SEQ ID NO: 3770550 - DNA, 16 bp, Homo sapiens
gtcagtgcagcccgtg

SEQ ID NO: 3770551 - DNA, 16 bp, Homo sapiens
gtcataccaggccgcc

SEQ ID NO: 3770552 - DNA, 13 bp, Homo sapiens
gtcatatcttcac

SEQ ID NO: 3770553 - DNA, 19 bp, Homo sapiens
gtcatcgtaggtgatttga

SEQ ID NO: 3770554 - DNA, 17 bp, Homo sapiens
gtcatgatctccctgcc

SEQ ID NO: 3770555 - DNA, 19 bp, Homo sapiens
gtcatgatctccctgccgc

SEQ ID NO: 3770556 - DNA, 21 bp, Homo sapiens
gtcatggtttcttggagggcc

SEQ ID NO: 3770557 - DNA, 14 bp, Homo sapiens
gtcattaaaataaa

SEQ ID NO: 3770558 - DNA, 11 bp, Homo sapiens
gtcattaaatg

SEQ ID NO: 3770559 - DNA, 21 bp, Homo sapiens
gtcattttaactttatcacat

SEQ ID NO: 3770560 - DNA, 14 bp, Homo sapiens
gtcattttgaagct

SEQ ID NO: 3770561 - DNA, 20 bp, Homo sapiens
gtccaaaggaggctggcagg

SEQ ID NO: 3770562 - DNA, 17 bp, Homo sapiens
gtccaacctaacccctt

SEQ ID NO: 3770563 - DNA, 21 bp, Homo sapiens
gtccaacctaacccctttcct

SEQ ID NO: 3770564 - DNA, 20 bp, Homo sapiens
gtccaacgtggggcagcaca

SEQ ID NO: 3770565 - DNA, 12 bp, Homo sapiens
gtccaactccag

SEQ ID NO: 3770566 - DNA, 13 bp, Homo sapiens
gtccaactccagt

SEQ ID NO: 3770567 - DNA, 14 bp, Homo sapiens
gtccaactccagta

SEQ ID NO: 3770568 - DNA, 15 bp, Homo sapiens
gtccaagtgtgtgtg

SEQ ID NO: 3770569 - DNA, 19 bp, Homo sapiens
gtccaatttgtaaaaacag

SEQ ID NO: 3770570 - DNA, 17 bp, Homo sapiens
gtccacagatgcctcca

SEQ ID NO: 3770571 - DNA, 17 bp, Homo sapiens
gtccaccaatagaatga

SEQ ID NO: 3770572 - DNA, 14 bp, Homo sapiens
gtccacccaggagc

SEQ ID NO: 3770573 - DNA, 23 bp, Homo sapiens
gtccacccaggagccccgaggcc

SEQ ID NO: 3770574 - DNA, 12 bp, Homo sapiens
gtccactgtcac

SEQ ID NO: 3770575 - DNA, 20 bp, Homo sapiens
gtccactgtcactgtttctc

SEQ ID NO: 3770576 - DNA, 20 bp, Homo sapiens
gtccagagagagaagtgccc

SEQ ID NO: 3770577 - DNA, 22 bp, Homo sapiens
gtccagagagagaagtgcccct

SEQ ID NO: 3770578 - DNA, 14 bp, Homo sapiens
gtccagcttgctct

SEQ ID NO: 3770579 - DNA, 16 bp, Homo sapiens
gtccagcttgctcttc

SEQ ID NO: 3770580 - DNA, 13 bp, Homo sapiens
gtccaggagcctg

SEQ ID NO: 3770581 - DNA, 20 bp, Homo sapiens
gtccagggaagctggccgag

SEQ ID NO: 3770582 - DNA, 15 bp, Homo sapiens
gtccagggccctgag

SEQ ID NO: 3770583 - DNA, 20 bp, Homo sapiens
gtccagggccctgagctcgg

SEQ ID NO: 3770584 - DNA, 18 bp, Homo sapiens
gtccaggtcgggctcagc

SEQ ID NO: 3770585 - DNA, 23 bp, Homo sapiens
gtccaggtcgggctcagctctgg

SEQ ID NO: 3770586 - DNA, 16 bp, Homo sapiens
gtccagtctcttctgc

SEQ ID NO: 3770587 - DNA, 15 bp, Homo sapiens
gtcccaacttgtaaa

SEQ ID NO: 3770588 - DNA, 12 bp, Homo sapiens
gtcccacagctt

SEQ ID NO: 3770589 - DNA, 15 bp, Homo sapiens
gtcccacagcttggg

SEQ ID NO: 3770590 - DNA, 19 bp, Homo sapiens
gtcccaccggttgcttctg

SEQ ID NO: 3770591 - DNA, 20 bp, Homo sapiens
gtcccaccggttgcttctgg

SEQ ID NO: 3770592 - DNA, 22 bp, Homo sapiens
gtcccaccggttgcttctggga

SEQ ID NO: 3770593 - DNA, 23 bp, Homo sapiens
gtcccacctcaaatgggtctggg

SEQ ID NO: 3770594 - DNA, 20 bp, Homo sapiens
gtcccaccttggctgcaggg

SEQ ID NO: 3770595 - DNA, 21 bp, Homo sapiens
gtcccaccttggctgcaggga

SEQ ID NO: 3770596 - DNA, 16 bp, Homo sapiens
gtcccactcaagccaa

SEQ ID NO: 3770597 - DNA, 14 bp, Homo sapiens
gtcccagccacccc

SEQ ID NO: 3770598 - DNA, 14 bp, Homo sapiens
gtcccagctactcg

SEQ ID NO: 3770599 - DNA, 15 bp, Homo sapiens
gtccccagcccactg

SEQ ID NO: 3770600 - DNA, 13 bp, Homo sapiens
gtccctctcaggc

SEQ ID NO: 3770601 - DNA, 20 bp, Homo sapiens
gtccctgactctctgtgacc

SEQ ID NO: 3770602 - DNA, 19 bp, Homo sapiens
gtccctgcacttgcagact

SEQ ID NO: 3770603 - DNA, 19 bp, Homo sapiens
gtcccttcccctccctggc

SEQ ID NO: 3770604 - DNA, 19 bp, Homo sapiens
gtcccttctcttaatttaa

SEQ ID NO: 3770605 - DNA, 16 bp, Homo sapiens
gtcccttgagacctca

SEQ ID NO: 3770606 - DNA, 18 bp, Homo sapiens
gtcccttgagacctcagc

SEQ ID NO: 3770607 - DNA, 20 bp, Homo sapiens
gtcccttgagacctcagcca

SEQ ID NO: 3770608 - DNA, 19 bp, Homo sapiens
gtccgccctcttcccctct

SEQ ID NO: 3770609 - DNA, 17 bp, Homo sapiens
gtccggtgtccttttca

SEQ ID NO: 3770610 - DNA, 24 bp, Homo sapiens
gtccggtgtccttttcactacacc

SEQ ID NO: 3770611 - DNA, 13 bp, Homo sapiens
gtcctacccaccc

SEQ ID NO: 3770612 - DNA, 21 bp, Homo sapiens
gtcctactttacatatgcttt

SEQ ID NO: 3770613 - DNA, 23 bp, Homo sapiens
gtcctagcttgggaggcttcccc

SEQ ID NO: 3770614 - DNA, 18 bp, Homo sapiens
gtcctcacatctttcaca

SEQ ID NO: 3770615 - DNA, 17 bp, Homo sapiens
gtcctcagcttcttaat

SEQ ID NO: 3770616 - DNA, 22 bp, Homo sapiens
gtcctccagaagcctctggcta

SEQ ID NO: 3770617 - DNA, 15 bp, Homo sapiens
gtcctccccctgcca

SEQ ID NO: 3770618 - DNA, 16 bp, Homo sapiens
gtcctccccctgccag

SEQ ID NO: 3770619 - DNA, 20 bp, Homo sapiens
gtcctccccctgccagtgcc

SEQ ID NO: 3770620 - DNA, 21 bp, Homo sapiens
gtcctccccctgccagtgcct

SEQ ID NO: 3770621 - DNA, 16 bp, Homo sapiens
gtcctctttcagaaaa

SEQ ID NO: 3770622 - DNA, 17 bp, Homo sapiens
gtcctctttcagaaaac

SEQ ID NO: 3770623 - DNA, 23 bp, Homo sapiens
gtcctctttcagaaaacagaaaa

SEQ ID NO: 3770624 - DNA, 16 bp, Homo sapiens
gtcctgacctgtctca

SEQ ID NO: 3770625 - DNA, 21 bp, Homo sapiens
gtcctgacggcgcccccagtg

SEQ ID NO: 3770626 - DNA, 19 bp, Homo sapiens
gtcctgcctggccaggcag

SEQ ID NO: 3770627 - DNA, 20 bp, Homo sapiens
gtcctgcctggccaggcaga

SEQ ID NO: 3770628 - DNA, 22 bp, Homo sapiens
gtcctgctctctacccagccca

SEQ ID NO: 3770629 - DNA, 15 bp, Homo sapiens
gtcctggctacatcc

SEQ ID NO: 3770630 - DNA, 11 bp, Homo sapiens
gtcctggctcc

SEQ ID NO: 3770631 - DNA, 17 bp, Homo sapiens
gtcctggctcctgaggg

SEQ ID NO: 3770632 - DNA, 16 bp, Homo sapiens
gtcctgggagtgagct

SEQ ID NO: 3770633 - DNA, 19 bp, Homo sapiens
gtcctgggagtgagctggt

SEQ ID NO: 3770634 - DNA, 14 bp, Homo sapiens
gtcctggggcctcg

SEQ ID NO: 3770635 - DNA, 22 bp, Homo sapiens
gtcctggggcctcggagcctca

SEQ ID NO: 3770636 - DNA, 17 bp, Homo sapiens
gtcctggggctctgtgc

SEQ ID NO: 3770637 - DNA, 14 bp, Homo sapiens
gtcctgggggcctg

SEQ ID NO: 3770638 - DNA, 18 bp, Homo sapiens
gtcctgggggcctgacct

SEQ ID NO: 3770639 - DNA, 20 bp, Homo sapiens
gtcctgtcggagccctgtct

SEQ ID NO: 3770640 - DNA, 21 bp, Homo sapiens
gtcctgtcggagccctgtctc

SEQ ID NO: 3770641 - DNA, 12 bp, Homo sapiens
gtccttccctct

SEQ ID NO: 3770642 - DNA, 18 bp, Homo sapiens
gtccttctctcacctcct

SEQ ID NO: 3770643 - DNA, 14 bp, Homo sapiens
gtccttgcacctgc

SEQ ID NO: 3770644 - DNA, 17 bp, Homo sapiens
gtccttgcacctgcatc

SEQ ID NO: 3770645 - DNA, 22 bp, Homo sapiens
gtccttttgtaccatggtgtga

SEQ ID NO: 3770646 - DNA, 14 bp, Homo sapiens
gtcgaggacaggga

SEQ ID NO: 3770647 - DNA, 13 bp, Homo sapiens
gtcgcccaggaga

SEQ ID NO: 3770648 - DNA, 13 bp, Homo sapiens
gtcgcccagtctg

SEQ ID NO: 3770649 - DNA, 16 bp, Homo sapiens
gtcggagccctgtctc

SEQ ID NO: 3770650 - DNA, 12 bp, Homo sapiens
gtcgggctcagc

SEQ ID NO: 3770651 - DNA, 14 bp, Homo sapiens
gtcgggggctgagg

SEQ ID NO: 3770652 - DNA, 22 bp, Homo sapiens
gtcgtggcagataatcagcctc

SEQ ID NO: 3770653 - DNA, 14 bp, Homo sapiens
gtcgtgggtgtgtg

SEQ ID NO: 3770654 - DNA, 12 bp, Homo sapiens
gtctagggagag

SEQ ID NO: 3770655 - DNA, 14 bp, Homo sapiens
gtctagggagagac

SEQ ID NO: 3770656 - DNA, 22 bp, Homo sapiens
gtctagttcctgatgacccagg

SEQ ID NO: 3770657 - DNA, 14 bp, Homo sapiens
gtctcaaaaaaaca

SEQ ID NO: 3770658 - DNA, 20 bp, Homo sapiens
gtctcaaactcctgggctca

SEQ ID NO: 3770659 - DNA, 18 bp, Homo sapiens
gtctcactatgttgccca

SEQ ID NO: 3770660 - DNA, 19 bp, Homo sapiens
gtctcactatgttgcccag

SEQ ID NO: 3770661 - DNA, 21 bp, Homo sapiens
gtctcactatgttgcccaggc

SEQ ID NO: 3770662 - DNA, 22 bp, Homo sapiens
gtctcactctgtcgcccagtct

SEQ ID NO: 3770663 - DNA, 13 bp, Homo sapiens
gtctcactgttgc

SEQ ID NO: 3770664 - DNA, 19 bp, Homo sapiens
gtctcactgttgcccaggc

SEQ ID NO: 3770665 - DNA, 22 bp, Homo sapiens
gtctcactgttgcccaggctgg

SEQ ID NO: 3770666 - DNA, 23 bp, Homo sapiens
gtctcactgttgcccaggctggc

SEQ ID NO: 3770667 - DNA, 16 bp, Homo sapiens
gtctcagtccacctga

SEQ ID NO: 3770668 - DNA, 15 bp, Homo sapiens
gtctcatccccaggg

SEQ ID NO: 3770669 - DNA, 20 bp, Homo sapiens
gtctccagacccccacccct

SEQ ID NO: 3770670 - DNA, 21 bp, Homo sapiens
gtctccctctcctgcctactc

SEQ ID NO: 3770671 - DNA, 14 bp, Homo sapiens
gtctcctgcatgca

SEQ ID NO: 3770672 - DNA, 13 bp, Homo sapiens
gtctcctgccccc

SEQ ID NO: 3770673 - DNA, 15 bp, Homo sapiens
gtctcctgcccccac

SEQ ID NO: 3770674 - DNA, 19 bp, Homo sapiens
gtctcctgcccccacacct

SEQ ID NO: 3770675 - DNA, 23 bp, Homo sapiens
gtctcgctttgttgcccaggctg

SEQ ID NO: 3770676 - DNA, 17 bp, Homo sapiens
gtctctatgccagctca

SEQ ID NO: 3770677 - DNA, 13 bp, Homo sapiens
gtctctatttaaa

SEQ ID NO: 3770678 - DNA, 17 bp, Homo sapiens
gtctctatttaaattct

SEQ ID NO: 3770679 - DNA, 20 bp, Homo sapiens
gtctctatttaaattctttt

SEQ ID NO: 3770680 - DNA, 21 bp, Homo sapiens
gtctctatttaaattcttttt

SEQ ID NO: 3770681 - DNA, 23 bp, Homo sapiens
gtctctctattaccactgaagat

SEQ ID NO: 3770682 - DNA, 22 bp, Homo sapiens
gtctctgccatgaactggaggc

SEQ ID NO: 3770683 - DNA, 12 bp, Homo sapiens
gtctctgctgaa

SEQ ID NO: 3770684 - DNA, 15 bp, Homo sapiens
gtctctgctggccca

SEQ ID NO: 3770685 - DNA, 11 bp, Homo sapiens
gtctcttcaga

SEQ ID NO: 3770686 - DNA, 16 bp, Homo sapiens
gtctcttctccactgg

SEQ ID NO: 3770687 - DNA, 13 bp, Homo sapiens
gtctcttgaggga

SEQ ID NO: 3770688 - DNA, 17 bp, Homo sapiens
gtctctttaatcttcag

SEQ ID NO: 3770689 - DNA, 19 bp, Homo sapiens
gtctctttaatgtcacagg

SEQ ID NO: 3770690 - DNA, 22 bp, Homo sapiens
gtctctttaatgtcacaggcag

SEQ ID NO: 3770691 - DNA, 23 bp, Homo sapiens
gtctctttaatgtcacaggcagg

SEQ ID NO: 3770692 - DNA, 14 bp, Homo sapiens
gtctgaagcagatg

SEQ ID NO: 3770693 - DNA, 21 bp, Homo sapiens
gtctgaaggactggattggcc

SEQ ID NO: 3770694 - DNA, 22 bp, Homo sapiens
gtctgaaggactggattggcca

SEQ ID NO: 3770695 - DNA, 15 bp, Homo sapiens
gtctgaatgttctga

SEQ ID NO: 3770696 - DNA, 20 bp, Homo sapiens
gtctgaatgttctgacatta

SEQ ID NO: 3770697 - DNA, 21 bp, Homo sapiens
gtctgacaggcaatgctggct

SEQ ID NO: 3770698 - DNA, 22 bp, Homo sapiens
gtctgacaggcaatgctggctg

SEQ ID NO: 3770699 - DNA, 13 bp, Homo sapiens
gtctgacccactg

SEQ ID NO: 3770700 - DNA, 17 bp, Homo sapiens
gtctgattcccaagctc

SEQ ID NO: 3770701 - DNA, 20 bp, Homo sapiens
gtctgattggttttaattga

SEQ ID NO: 3770702 - DNA, 15 bp, Homo sapiens
gtctgccagccagca

SEQ ID NO: 3770703 - DNA, 23 bp, Homo sapiens
gtctgctcagacagaacccctac

SEQ ID NO: 3770704 - DNA, 15 bp, Homo sapiens
gtctgctgccctcca

SEQ ID NO: 3770705 - DNA, 18 bp, Homo sapiens
gtctgctgccctccatcc

SEQ ID NO: 3770706 - DNA, 19 bp, Homo sapiens
gtctggacattcagaacac

SEQ ID NO: 3770707 - DNA, 17 bp, Homo sapiens
gtctggagaagcagtga

SEQ ID NO: 3770708 - DNA, 18 bp, Homo sapiens
gtctggagaataattctt

SEQ ID NO: 3770709 - DNA, 11 bp, Homo sapiens
gtctggagggg

SEQ ID NO: 3770710 - DNA, 23 bp, Homo sapiens
gtctggaggggagctctgtctgt

SEQ ID NO: 3770711 - DNA, 16 bp, Homo sapiens
gtctgggagaggcaga

SEQ ID NO: 3770712 - DNA, 17 bp, Homo sapiens
gtctgggagaggcagag

SEQ ID NO: 3770713 - DNA, 19 bp, Homo sapiens
gtctgggagaggcagagtg

SEQ ID NO: 3770714 - DNA, 17 bp, Homo sapiens
gtctggggttcagcccc

SEQ ID NO: 3770715 - DNA, 18 bp, Homo sapiens
gtctggggttcagcccct

SEQ ID NO: 3770716 - DNA, 12 bp, Homo sapiens
gtctgtaatgac

SEQ ID NO: 3770717 - DNA, 20 bp, Homo sapiens
gtctgtatcggagacagtga

SEQ ID NO: 3770718 - DNA, 22 bp, Homo sapiens
gtctgtcttcacagctctgtgt

SEQ ID NO: 3770719 - DNA, 13 bp, Homo sapiens
gtctgtgcctgga

SEQ ID NO: 3770720 - DNA, 17 bp, Homo sapiens
gtctgtgcctggagctc

SEQ ID NO: 3770721 - DNA, 17 bp, Homo sapiens
gtctgtgtgctgtggtt

SEQ ID NO: 3770722 - DNA, 18 bp, Homo sapiens
gtctgtgtgggactgtac

SEQ ID NO: 3770723 - DNA, 20 bp, Homo sapiens
gtctgtgtgggactgtacac

SEQ ID NO: 3770724 - DNA, 22 bp, Homo sapiens
gtctgtgttgcgtgtcgtgggt

SEQ ID NO: 3770725 - DNA, 20 bp, Homo sapiens
gtcttaaataaaagaaatgc

SEQ ID NO: 3770726 - DNA, 19 bp, Homo sapiens
gtcttagaagtggaccagg

SEQ ID NO: 3770727 - DNA, 20 bp, Homo sapiens
gtcttagaagtggaccagga

SEQ ID NO: 3770728 - DNA, 23 bp, Homo sapiens
gtcttagaagtggaccaggacag

SEQ ID NO: 3770729 - DNA, 18 bp, Homo sapiens
gtcttagacttgaaatac

SEQ ID NO: 3770730 - DNA, 15 bp, Homo sapiens
gtcttagatgtatat

SEQ ID NO: 3770731 - DNA, 14 bp, Homo sapiens
gtcttatttattat

SEQ ID NO: 3770732 - DNA, 14 bp, Homo sapiens
gtcttatttttaga

SEQ ID NO: 3770733 - DNA, 14 bp, Homo sapiens
gtcttcaagggctt

SEQ ID NO: 3770734 - DNA, 17 bp, Homo sapiens
gtcttcacagctctgtg

SEQ ID NO: 3770735 - DNA, 16 bp, Homo sapiens
gtcttcatccttagca

SEQ ID NO: 3770736 - DNA, 13 bp, Homo sapiens
gtcttccaaggag

SEQ ID NO: 3770737 - DNA, 16 bp, Homo sapiens
gtcttccacctggaag

SEQ ID NO: 3770738 - DNA, 17 bp, Homo sapiens
gtcttccctagggctgg

SEQ ID NO: 3770739 - DNA, 18 bp, Homo sapiens
gtcttctcaggctctgcc

SEQ ID NO: 3770740 - DNA, 20 bp, Homo sapiens
gtcttctttgcccacaatgc

SEQ ID NO: 3770741 - DNA, 18 bp, Homo sapiens
gtcttgaactcctggcct

SEQ ID NO: 3770742 - DNA, 17 bp, Homo sapiens
gtcttgatttgttttag

SEQ ID NO: 3770743 - DNA, 20 bp, Homo sapiens
gtcttgcaatggcagccttg

SEQ ID NO: 3770744 - DNA, 20 bp, Homo sapiens
gtcttgtgactagtgctgaa

SEQ ID NO: 3770745 - DNA, 21 bp, Homo sapiens
gtcttgtgactagtgctgaag

SEQ ID NO: 3770746 - DNA, 21 bp, Homo sapiens
gtctttactccatgaagggtc

SEQ ID NO: 3770747 - DNA, 19 bp, Homo sapiens
gtctttcacagtaccatct

SEQ ID NO: 3770748 - DNA, 13 bp, Homo sapiens
gtctttctggaga

SEQ ID NO: 3770749 - DNA, 13 bp, Homo sapiens
gtctttgataaag

SEQ ID NO: 3770750 - DNA, 18 bp, Homo sapiens
gtctttgtaatgtcacca

SEQ ID NO: 3770751 - DNA, 19 bp, Homo sapiens
gtctttgtaatgtcaccac

SEQ ID NO: 3770752 - DNA, 16 bp, Homo sapiens
gtcttttgacatgtgg

SEQ ID NO: 3770753 - DNA, 19 bp, Homo sapiens
gtcttttgacatgtggaaa

SEQ ID NO: 3770754 - DNA, 20 bp, Homo sapiens
gtctttttaagcttatttaa

SEQ ID NO: 3770755 - DNA, 19 bp, Homo sapiens
gtctttttttctgttaatt

SEQ ID NO: 3770756 - DNA, 20 bp, Homo sapiens
gtgaaaaaagcttttatgag

SEQ ID NO: 3770757 - DNA, 14 bp, Homo sapiens
gtgaaaagaaaaat

SEQ ID NO: 3770758 - DNA, 23 bp, Homo sapiens
gtgaaaagaaaaatgagcctggc

SEQ ID NO: 3770759 - DNA, 21 bp, Homo sapiens
gtgaaaataggtatacagtgg

SEQ ID NO: 3770760 - DNA, 16 bp, Homo sapiens
gtgaaacacaccaggc

SEQ ID NO: 3770761 - DNA, 20 bp, Homo sapiens
gtgaaacacaccaggctgtg

SEQ ID NO: 3770762 - DNA, 15 bp, Homo sapiens
gtgaaagaaatcatg

SEQ ID NO: 3770763 - DNA, 17 bp, Homo sapiens
gtgaaagaaatcatgtt

SEQ ID NO: 3770764 - DNA, 20 bp, Homo sapiens
gtgaaagaaatcatgttatg

SEQ ID NO: 3770765 - DNA, 21 bp, Homo sapiens
gtgaaagaaatcatgttatga

SEQ ID NO: 3770766 - DNA, 21 bp, Homo sapiens
gtgaaatagttcaaagccaag

SEQ ID NO: 3770767 - DNA, 9 bp, Homo sapiens
gtgaaatct

SEQ ID NO: 3770768 - DNA, 19 bp, Homo sapiens
gtgaacaagtgaacacatt

SEQ ID NO: 3770769 - DNA, 22 bp, Homo sapiens
gtgaaccaccacacccagccca

SEQ ID NO: 3770770 - DNA, 16 bp, Homo sapiens
gtgaacgatttagaaa

SEQ ID NO: 3770771 - DNA, 19 bp, Homo sapiens
gtgaacttgggccactgtg

SEQ ID NO: 3770772 - DNA, 15 bp, Homo sapiens
gtgaagcatccaggc

SEQ ID NO: 3770773 - DNA, 23 bp, Homo sapiens
gtgaatctgcattttctgggttc

SEQ ID NO: 3770774 - DNA, 16 bp, Homo sapiens
gtgaattgataataaa

SEQ ID NO: 3770775 - DNA, 19 bp, Homo sapiens
gtgaattgtgaccaagtta

SEQ ID NO: 3770776 - DNA, 14 bp, Homo sapiens
gtgaatttgaatct

SEQ ID NO: 3770777 - DNA, 15 bp, Homo sapiens
gtgaatttttctcta

SEQ ID NO: 3770778 - DNA, 16 bp, Homo sapiens
gtgaatttttctctaa

SEQ ID NO: 3770779 - DNA, 17 bp, Homo sapiens
gtgaatttttttttcct

SEQ ID NO: 3770780 - DNA, 13 bp, Homo sapiens
gtgacaaggcccc

SEQ ID NO: 3770781 - DNA, 18 bp, Homo sapiens
gtgacaaggccccagaga

SEQ ID NO: 3770782 - DNA, 16 bp, Homo sapiens
gtgacaattttgtaca

SEQ ID NO: 3770783 - DNA, 21 bp, Homo sapiens
gtgacacttcagagagctggt

SEQ ID NO: 3770784 - DNA, 18 bp, Homo sapiens
gtgacagaggcagcccca

SEQ ID NO: 3770785 - DNA, 20 bp, Homo sapiens
gtgacagagtgagactctgt

SEQ ID NO: 3770786 - DNA, 17 bp, Homo sapiens
gtgacagtgcctgggaa

SEQ ID NO: 3770787 - DNA, 18 bp, Homo sapiens
gtgacagtggattgcatt

SEQ ID NO: 3770788 - DNA, 18 bp, Homo sapiens
gtgacatcagtggcatgg

SEQ ID NO: 3770789 - DNA, 20 bp, Homo sapiens
gtgacatgcgggctgggcag

SEQ ID NO: 3770790 - DNA, 17 bp, Homo sapiens
gtgaccaatgatggtca

SEQ ID NO: 3770791 - DNA, 12 bp, Homo sapiens
gtgacctctgcc

SEQ ID NO: 3770792 - DNA, 16 bp, Homo sapiens
gtgacctgaggaagcg

SEQ ID NO: 3770793 - DNA, 23 bp, Homo sapiens
gtgacctgaggatttaagggatg

SEQ ID NO: 3770794 - DNA, 14 bp, Homo sapiens
gtgactagtgctga

SEQ ID NO: 3770795 - DNA, 17 bp, Homo sapiens
gtgactagtgctgaagc

SEQ ID NO: 3770796 - DNA, 21 bp, Homo sapiens
gtgactagtgctgaagcttat

SEQ ID NO: 3770797 - DNA, 22 bp, Homo sapiens
gtgactagtgctgaagcttatt

SEQ ID NO: 3770798 - DNA, 15 bp, Homo sapiens
gtgactcacccaagc

SEQ ID NO: 3770799 - DNA, 18 bp, Homo sapiens
gtgactcatcctcttgaa

SEQ ID NO: 3770800 - DNA, 16 bp, Homo sapiens
gtgactgccccaactc

SEQ ID NO: 3770801 - DNA, 15 bp, Homo sapiens
gtgactgtatctgtg

SEQ ID NO: 3770802 - DNA, 14 bp, Homo sapiens
gtgagaagaatatt

SEQ ID NO: 3770803 - DNA, 16 bp, Homo sapiens
gtgagacccccacacc

SEQ ID NO: 3770804 - DNA, 14 bp, Homo sapiens
gtgagactctgtct

SEQ ID NO: 3770805 - DNA, 16 bp, Homo sapiens
gtgagactctgtctca

SEQ ID NO: 3770806 - DNA, 18 bp, Homo sapiens
gtgagactctgtctcaaa

SEQ ID NO: 3770807 - DNA, 18 bp, Homo sapiens
gtgagagcgaggctgagc

SEQ ID NO: 3770808 - DNA, 16 bp, Homo sapiens
gtgagaggggaacaga

SEQ ID NO: 3770809 - DNA, 12 bp, Homo sapiens
gtgagcagtgtg

SEQ ID NO: 3770810 - DNA, 22 bp, Homo sapiens
gtgagcattgtggctgtcagca

SEQ ID NO: 3770811 - DNA, 15 bp, Homo sapiens
gtgagccactgcacc

SEQ ID NO: 3770812 - DNA, 18 bp, Homo sapiens
gtgagccgcatcttctcc

SEQ ID NO: 3770813 - DNA, 16 bp, Homo sapiens
gtgaggaccactcctg

SEQ ID NO: 3770814 - DNA, 14 bp, Homo sapiens
gtgaggagctgctg

SEQ ID NO: 3770815 - DNA, 15 bp, Homo sapiens
gtgaggagctgctgg

SEQ ID NO: 3770816 - DNA, 18 bp, Homo sapiens
gtgaggagctgctggctt

SEQ ID NO: 3770817 - DNA, 18 bp, Homo sapiens
gtgagggtcagagaggag

SEQ ID NO: 3770818 - DNA, 12 bp, Homo sapiens
gtgaggtcctgg

SEQ ID NO: 3770819 - DNA, 16 bp, Homo sapiens
gtgaggtcctgggggc

SEQ ID NO: 3770820 - DNA, 20 bp, Homo sapiens
gtgaggtcctgggggcctga

SEQ ID NO: 3770821 - DNA, 14 bp, Homo sapiens
gtgagtaagagctg

SEQ ID NO: 3770822 - DNA, 22 bp, Homo sapiens
gtgagtcgaggacagggaggtg

SEQ ID NO: 3770823 - DNA, 16 bp, Homo sapiens
gtgagtgtggctcccc

SEQ ID NO: 3770824 - DNA, 19 bp, Homo sapiens
gtgatcaataaaatgtgat

SEQ ID NO: 3770825 - DNA, 20 bp, Homo sapiens
gtgatcagaccataatgtta

SEQ ID NO: 3770826 - DNA, 15 bp, Homo sapiens
gtgatccacccacct

SEQ ID NO: 3770827 - DNA, 19 bp, Homo sapiens
gtttatacagttttaaaga

SEQ ID NO: 3770828 - DNA, 14 bp, Homo sapiens
gtttatattttcaa

SEQ ID NO: 3770829 - DNA, 21 bp, Homo sapiens
gtttatgataataaaggcacc

SEQ ID NO: 3770830 - DNA, 13 bp, Homo sapiens
gtttatggcctca

SEQ ID NO: 3770831 - DNA, 17 bp, Homo sapiens
gtttattacttatttgg

SEQ ID NO: 3770832 - DNA, 23 bp, Homo sapiens
gtttcaaaataaaaaccaagaag

SEQ ID NO: 3770833 - DNA, 15 bp, Homo sapiens
gtttcaattcagtgc

SEQ ID NO: 3770834 - DNA, 18 bp, Homo sapiens
gtttcagtaataaaacat

SEQ ID NO: 3770835 - DNA, 17 bp, Homo sapiens
gtttcataggagacaca

SEQ ID NO: 3770836 - DNA, 15 bp, Homo sapiens
gtttcccataatttt

SEQ ID NO: 3770837 - DNA, 15 bp, Homo sapiens
gtttccccaccagtg

SEQ ID NO: 3770838 - DNA, 15 bp, Homo sapiens
gtttcctaaaagttc

SEQ ID NO: 3770839 - DNA, 14 bp, Homo sapiens
gtttcctcaggctg

SEQ ID NO: 3770840 - DNA, 14 bp, Homo sapiens
gtttccttcagtgc

SEQ ID NO: 3770841 - DNA, 23 bp, Homo sapiens
gtttctattctctcctcagactg

SEQ ID NO: 3770842 - DNA, 15 bp, Homo sapiens
gtttctccccctggg

SEQ ID NO: 3770843 - DNA, 17 bp, Homo sapiens
gtttctccccctgggct

SEQ ID NO: 3770844 - DNA, 15 bp, Homo sapiens
gtttctctgctgttg

SEQ ID NO: 3770845 - DNA, 16 bp, Homo sapiens
gtttctgaaaattcca

SEQ ID NO: 3770846 - DNA, 19 bp, Homo sapiens
gtttctgacccactgatct

SEQ ID NO: 3770847 - DNA, 23 bp, Homo sapiens
gtttcttttataaaaaaaatgaa

SEQ ID NO: 3770848 - DNA, 13 bp, Homo sapiens
gtttgaatataaa

SEQ ID NO: 3770849 - DNA, 15 bp, Homo sapiens
gtttgagctcagacc

SEQ ID NO: 3770850 - DNA, 16 bp, Homo sapiens
gtttgagctcagaccc

SEQ ID NO: 3770851 - DNA, 16 bp, Homo sapiens
gtttgaggctgcagcg

SEQ ID NO: 3770852 - DNA, 15 bp, Homo sapiens
gtttgatttcattaa

SEQ ID NO: 3770853 - DNA, 21 bp, Homo sapiens
gtttgattttagctgcagaac

SEQ ID NO: 3770854 - DNA, 15 bp, Homo sapiens
gtttgcacacttgtg

SEQ ID NO: 3770855 - DNA, 19 bp, Homo sapiens
gtttgcagaaaagcacctg

SEQ ID NO: 3770856 - DNA, 21 bp, Homo sapiens
gtttgcagaaaagcacctgcc

SEQ ID NO: 3770857 - DNA, 22 bp, Homo sapiens
gtttgcagaaaagcacctgccg

SEQ ID NO: 3770858 - DNA, 13 bp, Homo sapiens
gtttgcctctgcc

SEQ ID NO: 3770859 - DNA, 14 bp, Homo sapiens
gtttgcctgagggc

SEQ ID NO: 3770860 - DNA, 18 bp, Homo sapiens
gtttgccttctactttta

SEQ ID NO: 3770861 - DNA, 15 bp, Homo sapiens
gtttgctcagaacac

SEQ ID NO: 3770862 - DNA, 18 bp, Homo sapiens
gtttgctcagaacacatt

SEQ ID NO: 3770863 - DNA, 13 bp, Homo sapiens
gtttgcttattgt

SEQ ID NO: 3770864 - DNA, 14 bp, Homo sapiens
gtttgcttattgtt

SEQ ID NO: 3770865 - DNA, 15 bp, Homo sapiens
gtttgcttattgttc

SEQ ID NO: 3770866 - DNA, 17 bp, Homo sapiens
gtttgcttattgttcca

SEQ ID NO: 3770867 - DNA, 18 bp, Homo sapiens
gtttgcttattgttccaa

SEQ ID NO: 3770868 - DNA, 19 bp, Homo sapiens
gtttgcttcaactgtctcc

SEQ ID NO: 3770869 - DNA, 18 bp, Homo sapiens
gtttggcgggccaaggac

SEQ ID NO: 3770870 - DNA, 13 bp, Homo sapiens
gtttgtatattgt

SEQ ID NO: 3770871 - DNA, 15 bp, Homo sapiens
gtttgtctgtcttca

SEQ ID NO: 3770872 - DNA, 20 bp, Homo sapiens
gtttgtggctgggggcagga

SEQ ID NO: 3770873 - DNA, 20 bp, Homo sapiens
gtttgtgttctgtttgttaa

SEQ ID NO: 3770874 - DNA, 22 bp, Homo sapiens
gtttgtgttctgtttgttaaaa

SEQ ID NO: 3770875 - DNA, 13 bp, Homo sapiens
gtttgttaaaact

SEQ ID NO: 3770876 - DNA, 15 bp, Homo sapiens
gtttgttaaaactgg

SEQ ID NO: 3770877 - DNA, 20 bp, Homo sapiens
gtttgtttctccccctgggc

SEQ ID NO: 3770878 - DNA, 11 bp, Homo sapiens
gtttgtttgtt

SEQ ID NO: 3770879 - DNA, 16 bp, Homo sapiens
gtttgtttgttttgtt

SEQ ID NO: 3770880 - DNA, 19 bp, Homo sapiens
gttttaaatttatttcaaa

SEQ ID NO: 3770881 - DNA, 19 bp, Homo sapiens
gttttaactagaatttatt

SEQ ID NO: 3770882 - DNA, 16 bp, Homo sapiens
gttttaaggaagaaaa

SEQ ID NO: 3770883 - DNA, 13 bp, Homo sapiens
gttttagaaaaca

SEQ ID NO: 3770884 - DNA, 14 bp, Homo sapiens
gttttagttgcaga

SEQ ID NO: 3770885 - DNA, 13 bp, Homo sapiens
gttttattgtgtt

SEQ ID NO: 3770886 - DNA, 11 bp, Homo sapiens
gttttcactct

SEQ ID NO: 3770887 - DNA, 12 bp, Homo sapiens
gttttcactctt

SEQ ID NO: 3770888 - DNA, 21 bp, Homo sapiens
gttttcagaacctcttcccca

SEQ ID NO: 3770889 - DNA, 17 bp, Homo sapiens
gttttcagtgtacatgg

SEQ ID NO: 3770890 - DNA, 16 bp, Homo sapiens
gttttcatgtaaataa

SEQ ID NO: 3770891 - DNA, 17 bp, Homo sapiens
gttttccatgaaaacgt

SEQ ID NO: 3770892 - DNA, 16 bp, Homo sapiens
gttttcctaaatgtat

SEQ ID NO: 3770893 - DNA, 24 bp, Homo sapiens
gttttcctaaatgtatacctgtaa

SEQ ID NO: 3770894 - DNA, 22 bp, Homo sapiens
gttttcctataatataataaat

SEQ ID NO: 3770895 - DNA, 23 bp, Homo sapiens
gttttcgaagctcagcccacccc

SEQ ID NO: 3770896 - DNA, 12 bp, Homo sapiens
gttttctcttga

SEQ ID NO: 3770897 - DNA, 20 bp, Homo sapiens
gttttcttcccatcactgga

SEQ ID NO: 3770898 - DNA, 19 bp, Homo sapiens
gttttcttccttgtaaatt

SEQ ID NO: 3770899 - DNA, 17 bp, Homo sapiens
gttttcttttgccatga

SEQ ID NO: 3770900 - DNA, 23 bp, Homo sapiens
gttttgaggtttccttcagacag

SEQ ID NO: 3770901 - DNA, 19 bp, Homo sapiens
gttttgatttaataacata

SEQ ID NO: 3770902 - DNA, 16 bp, Homo sapiens
gttttgccatgttggc

SEQ ID NO: 3770903 - DNA, 16 bp, Homo sapiens
gttttgctgtttcctt

SEQ ID NO: 3770904 - DNA, 17 bp, Homo sapiens
gttttgtcaaactgtag

SEQ ID NO: 3770905 - DNA, 24 bp, Homo sapiens
gttttgtcaaactgtagaaatgat

SEQ ID NO: 3770906 - DNA, 19 bp, Homo sapiens
gttttgtggaggagctcag

SEQ ID NO: 3770907 - DNA, 17 bp, Homo sapiens
gttttgtgtaacatatt

SEQ ID NO: 3770908 - DNA, 17 bp, Homo sapiens
gttttgttttaaaatta

SEQ ID NO: 3770909 - DNA, 14 bp, Homo sapiens
gttttgttttttag

SEQ ID NO: 3770910 - DNA, 20 bp, Homo sapiens
gttttgttttttagttccca

SEQ ID NO: 3770911 - DNA, 14 bp, Homo sapiens
gtttttaagctgtt

SEQ ID NO: 3770912 - DNA, 15 bp, Homo sapiens
gtttttaagctgttt

SEQ ID NO: 3770913 - DNA, 16 bp, Homo sapiens
gtttttactacagttg

SEQ ID NO: 3770914 - DNA, 17 bp, Homo sapiens
gtttttactttctgttg

SEQ ID NO: 3770915 - DNA, 17 bp, Homo sapiens
gtttttccactactgct

SEQ ID NO: 3770916 - DNA, 19 bp, Homo sapiens
gtttttccttgtatttaaa

SEQ ID NO: 3770917 - DNA, 14 bp, Homo sapiens
gtttttctgccagg

SEQ ID NO: 3770918 - DNA, 17 bp, Homo sapiens
gtttttctgccagggag

SEQ ID NO: 3770919 - DNA, 18 bp, Homo sapiens
gtttttgatagctttatt

SEQ ID NO: 3770920 - DNA, 16 bp, Homo sapiens
gtttttgtcttaaaaa

SEQ ID NO: 3770921 - DNA, 23 bp, Homo sapiens
gttttttatcttttctacagcaa

SEQ ID NO: 3770922 - DNA, 15 bp, Homo sapiens
gttttttatgctaat

SEQ ID NO: 3770923 - DNA, 14 bp, Homo sapiens
gttttttcctgagc

SEQ ID NO: 3770924 - DNA, 18 bp, Homo sapiens
gttttttttaaataaaag

SEQ ID NO: 3770925 - DNA, 19 bp, Homo sapiens
gtttttttttcctgtcctt

SEQ ID NO: 3770926 - DNA, 16 bp, Homo sapiens
taaaaaaaataataaa

SEQ ID NO: 3770927 - DNA, 17 bp, Homo sapiens
taaaaaaaataataaat

SEQ ID NO: 3770928 - DNA, 13 bp, Homo sapiens
taaaaaaaatgaa

SEQ ID NO: 3770929 - DNA, 20 bp, Homo sapiens
taaaaaaaatgaaatgtttt

SEQ ID NO: 3770930 - DNA, 13 bp, Homo sapiens
taaaaaaatgaca

SEQ ID NO: 3770931 - DNA, 14 bp, Homo sapiens
taaaaaacaaagaa

SEQ ID NO: 3770932 - DNA, 19 bp, Homo sapiens
taaaaaacaaagaagacaa

SEQ ID NO: 3770933 - DNA, 12 bp, Homo sapiens
taaaaaagtctc

SEQ ID NO: 3770934 - DNA, 14 bp, Homo sapiens
taaaaaagtctcta

SEQ ID NO: 3770935 - DNA, 20 bp, Homo sapiens
taaaaaagtctctatttaaa

SEQ ID NO: 3770936 - DNA, 15 bp, Homo sapiens
taaaaaattttgtaa

SEQ ID NO: 3770937 - DNA, 14 bp, Homo sapiens
taaaaaccaagaag

SEQ ID NO: 3770938 - DNA, 20 bp, Homo sapiens
taaaaagggcagggcatctc

SEQ ID NO: 3770939 - DNA, 21 bp, Homo sapiens
taaaaagttaaaaaaaataat

SEQ ID NO: 3770940 - DNA, 17 bp, Homo sapiens
taaaaataaatttggtt

SEQ ID NO: 3770941 - DNA, 15 bp, Homo sapiens
taaaaatacaaacaa

SEQ ID NO: 3770942 - DNA, 20 bp, Homo sapiens
taaaaatcataaactgtgtg

SEQ ID NO: 3770943 - DNA, 15 bp, Homo sapiens
taaaaatcatagtac

SEQ ID NO: 3770944 - DNA, 15 bp, Homo sapiens
taaaaatgaggtact

SEQ ID NO: 3770945 - DNA, 17 bp, Homo sapiens
taaaaatggtaaaattg

SEQ ID NO: 3770946 - DNA, 15 bp, Homo sapiens
taaaacaaaaaacaa

SEQ ID NO: 3770947 - DNA, 21 bp, Homo sapiens
taaaacaaaaaacaatattta

SEQ ID NO: 3770948 - DNA, 22 bp, Homo sapiens
taaaacaaaaaacaatatttat

SEQ ID NO: 3770949 - DNA, 18 bp, Homo sapiens
gggaaggacttggcgcgc

SEQ ID NO: 3770950 - DNA, 15 bp, Homo sapiens
gggaaggccacctgc

SEQ ID NO: 3770951 - DNA, 16 bp, Homo sapiens
gggaagggagagcggg

SEQ ID NO: 3770952 - DNA, 12 bp, Homo sapiens
gggaaggtcacc

SEQ ID NO: 3770953 - DNA, 14 bp, Homo sapiens
gggaagtccccagg

SEQ ID NO: 3770954 - DNA, 20 bp, Homo sapiens
gggaatgtattattctgcag

SEQ ID NO: 3770955 - DNA, 19 bp, Homo sapiens
gggaatgtttgcctctgcc

SEQ ID NO: 3770956 - DNA, 12 bp, Homo sapiens
gggaattctctt

SEQ ID NO: 3770957 - DNA, 22 bp, Homo sapiens
gggaattgaggtctgctcggcc

SEQ ID NO: 3770958 - DNA, 19 bp, Homo sapiens
gggacaaatttaaaacaaa

SEQ ID NO: 3770959 - DNA, 18 bp, Homo sapiens
gggacagagacacctgca

SEQ ID NO: 3770960 - DNA, 13 bp, Homo sapiens
gggacagctcctt

SEQ ID NO: 3770961 - DNA, 15 bp, Homo sapiens
gggacagctccttct

SEQ ID NO: 3770962 - DNA, 21 bp, Homo sapiens
gggacagctccttctgtccta

SEQ ID NO: 3770963 - DNA, 16 bp, Homo sapiens
gggaccaactgggccc

SEQ ID NO: 3770964 - DNA, 14 bp, Homo sapiens
gggaccagccaaga

SEQ ID NO: 3770965 - DNA, 16 bp, Homo sapiens
gggaccctttccttcc

SEQ ID NO: 3770966 - DNA, 18 bp, Homo sapiens
gggaccggtacagaaagg

SEQ ID NO: 3770967 - DNA, 23 bp, Homo sapiens
gggacgtcctgccacctggggca

SEQ ID NO: 3770968 - DNA, 17 bp, Homo sapiens
gggactaaatgccctgc

SEQ ID NO: 3770969 - DNA, 16 bp, Homo sapiens
gggactcaatgcactg

SEQ ID NO: 3770970 - DNA, 16 bp, Homo sapiens
gggactcactggcagc

SEQ ID NO: 3770971 - DNA, 18 bp, Homo sapiens
gggactcactggcagccc

SEQ ID NO: 3770972 - DNA, 13 bp, Homo sapiens
gggactgggaggg

SEQ ID NO: 3770973 - DNA, 15 bp, Homo sapiens
gggactgggagggcc

SEQ ID NO: 3770974 - DNA, 17 bp, Homo sapiens
gggactgggagggccca

SEQ ID NO: 3770975 - DNA, 13 bp, Homo sapiens
gggactgtacaca

SEQ ID NO: 3770976 - DNA, 15 bp, Homo sapiens
gggacttggaagctc

SEQ ID NO: 3770977 - DNA, 23 bp, Homo sapiens
gggacttggaagctccgctttct

SEQ ID NO: 3770978 - DNA, 14 bp, Homo sapiens
gggagaacctcagg

SEQ ID NO: 3770979 - DNA, 16 bp, Homo sapiens
gggagaacctcaggct

SEQ ID NO: 3770980 - DNA, 13 bp, Homo sapiens
gggagagaccctt

SEQ ID NO: 3770981 - DNA, 12 bp, Homo sapiens
gggagagccagc

SEQ ID NO: 3770982 - DNA, 15 bp, Homo sapiens
gggagagccagctcc

SEQ ID NO: 3770983 - DNA, 11 bp, Homo sapiens
gggagcagtgt

SEQ ID NO: 3770984 - DNA, 12 bp, Homo sapiens
gggagcccccgc

SEQ ID NO: 3770985 - DNA, 13 bp, Homo sapiens
gggagctgcctgt

SEQ ID NO: 3770986 - DNA, 21 bp, Homo sapiens
gggagctgcctgttcagctcc

SEQ ID NO: 3770987 - DNA, 24 bp, Homo sapiens
gggaggaaatttgaatgggtccat

SEQ ID NO: 3770988 - DNA, 20 bp, Homo sapiens
ggtcaagtaagaagacatga

SEQ ID NO: 3770989 - DNA, 22 bp, Homo sapiens
ggtcacaaatcctaaaagaagc

SEQ ID NO: 3770990 - DNA, 13 bp, Homo sapiens
ggtcagagcctgc

SEQ ID NO: 3770991 - DNA, 14 bp, Homo sapiens
ggtcagagcctgca

SEQ ID NO: 3770992 - DNA, 22 bp, Homo sapiens
ggtcaggagttagaggccagcc

SEQ ID NO: 3770993 - DNA, 13 bp, Homo sapiens
ggtccacccagga

SEQ ID NO: 3770994 - DNA, 16 bp, Homo sapiens
ggtccacccaggagcc

SEQ ID NO: 3770995 - DNA, 19 bp, Homo sapiens
ggtccacccaggagccccg

SEQ ID NO: 3770996 - DNA, 17 bp, Homo sapiens
ggtccagcttgctcttc

SEQ ID NO: 3770997 - DNA, 12 bp, Homo sapiens
ggtcccactcag

SEQ ID NO: 3770998 - DNA, 14 bp, Homo sapiens
ggtcccaggcagag

SEQ ID NO: 3770999 - DNA, 23 bp, Homo sapiens
ggtcctagaaattccccaccctg

SEQ ID NO: 3771000 - DNA, 22 bp, Homo sapiens
ggtcctgctatttcccaagctg

SEQ ID NO: 3771001 - DNA, 12 bp, Homo sapiens
ggtcctggctcc

SEQ ID NO: 3771002 - DNA, 16 bp, Homo sapiens
ggtcctggctcctgag

SEQ ID NO: 3771003 - DNA, 16 bp, Homo sapiens
ggtcctgggggcctga

SEQ ID NO: 3771004 - DNA, 21 bp, Homo sapiens
ggtcctgggggcctgacctcc

SEQ ID NO: 3771005 - DNA, 15 bp, Homo sapiens
ggtccttccaggccc

SEQ ID NO: 3771006 - DNA, 15 bp, Homo sapiens
ggtccttccctctcc

SEQ ID NO: 3771007 - DNA, 19 bp, Homo sapiens
ggtccttccctctccccaa

SEQ ID NO: 3771008 - DNA, 14 bp, Homo sapiens
ggtcgtttttttca

SEQ ID NO: 3771009 - DNA, 14 bp, Homo sapiens
ggtctagggagaga

SEQ ID NO: 3771010 - DNA, 18 bp, Homo sapiens
ggtctcacagtgttgccc

SEQ ID NO: 3771011 - DNA, 21 bp, Homo sapiens
ggtctcacagtgttgcccagg

SEQ ID NO: 3771012 - DNA, 16 bp, Homo sapiens
ggtctcactctgtcgc

SEQ ID NO: 3771013 - DNA, 22 bp, Homo sapiens
ggtctcactctgtcgcccagtc

SEQ ID NO: 3771014 - DNA, 23 bp, Homo sapiens
ggtctcactctgtcgcccagtct

SEQ ID NO: 3771015 - DNA, 19 bp, Homo sapiens
ggtctcctctttgttttgt

SEQ ID NO: 3771016 - DNA, 19 bp, Homo sapiens
ggtctcgctttgttgccca

SEQ ID NO: 3771017 - DNA, 19 bp, Homo sapiens
ggtctctctctctctacaa

SEQ ID NO: 3771018 - DNA, 15 bp, Homo sapiens
ggtctctctttggac

SEQ ID NO: 3771019 - DNA, 21 bp, Homo sapiens
ggtctctgccatgaactggag

SEQ ID NO: 3771020 - DNA, 23 bp, Homo sapiens
ggtctctgccatgaactggaggc

SEQ ID NO: 3771021 - DNA, 12 bp, Homo sapiens
ggtctgaaatgg

SEQ ID NO: 3771022 - DNA, 14 bp, Homo sapiens
ggtctgaatgttct

SEQ ID NO: 3771023 - DNA, 20 bp, Homo sapiens
ggtctgggagaggcagagtg

SEQ ID NO: 3771024 - DNA, 20 bp, Homo sapiens
ggtctgggggtcaggaggca

SEQ ID NO: 3771025 - DNA, 13 bp, Homo sapiens
ggtctgtgtctct

SEQ ID NO: 3771026 - DNA, 20 bp, Homo sapiens
ggtcttccctacctcaggca

SEQ ID NO: 3771027 - DNA, 22 bp, Homo sapiens
ggtcttgaactcctggcctcaa

SEQ ID NO: 3771028 - DNA, 18 bp, Homo sapiens
ggtctttaaaatattgtt

SEQ ID NO: 3771029 - DNA, 17 bp, Homo sapiens
ggtcttttgacatgtgg

SEQ ID NO: 3771030 - DNA, 13 bp, Homo sapiens
ggtgaaagggagc

SEQ ID NO: 3771031 - DNA, 16 bp, Homo sapiens
ggtgagaggggaacag

SEQ ID NO: 3771032 - DNA, 13 bp, Homo sapiens
ggtgagccagtgg

SEQ ID NO: 3771033 - DNA, 17 bp, Homo sapiens
ggtgaggaagctccagt

SEQ ID NO: 3771034 - DNA, 18 bp, Homo sapiens
ggtgaggaccactcctgt

SEQ ID NO: 3771035 - DNA, 19 bp, Homo sapiens
ggtgatcaattaaatgtag

SEQ ID NO: 3771036 - DNA, 24 bp, Homo sapiens
ggtgatccacccacctcagcctcc

SEQ ID NO: 3771037 - DNA, 12 bp, Homo sapiens
ggtgcaaatcct

SEQ ID NO: 3771038 - DNA, 19 bp, Homo sapiens
ggtgcagagtgcccagaac

SEQ ID NO: 3771039 - DNA, 18 bp, Homo sapiens
ggtgcccttggaggccag

SEQ ID NO: 3771040 - DNA, 18 bp, Homo sapiens
ggtgcctgggtggggctg

SEQ ID NO: 3771041 - DNA, 23 bp, Homo sapiens
ggtgcctgggtggggctgctcct

SEQ ID NO: 3771042 - DNA, 18 bp, Homo sapiens
ggtgcctgtgaggcaggg

SEQ ID NO: 3771043 - DNA, 22 bp, Homo sapiens
ggtgcctttcctgttcagcatt

SEQ ID NO: 3771044 - DNA, 14 bp, Homo sapiens
ggtgctgcttccct

SEQ ID NO: 3771045 - DNA, 21 bp, Homo sapiens
ggtgcttgttccctctccctg

SEQ ID NO: 3771046 - DNA, 13 bp, Homo sapiens
ggtggaagccctc

SEQ ID NO: 3771047 - DNA, 19 bp, Homo sapiens
ggtggaagccctccttcca

SEQ ID NO: 3771048 - DNA, 14 bp, Homo sapiens
ggtggacccaggga

SEQ ID NO: 3771049 - DNA, 13 bp, Homo sapiens
ggtggaggagagc

SEQ ID NO: 3771050 - DNA, 20 bp, Homo sapiens
ggtggaggttgcagtgagct

SEQ ID NO: 3771051 - DNA, 15 bp, Homo sapiens
ggtggagttgaaaga

SEQ ID NO: 3771052 - DNA, 15 bp, Homo sapiens
ggtggatcacagagg

SEQ ID NO: 3771053 - DNA, 16 bp, Homo sapiens
ggtggatcacctgagg

SEQ ID NO: 3771054 - DNA, 13 bp, Homo sapiens
ggtggatgcctgg

SEQ ID NO: 3771055 - DNA, 13 bp, Homo sapiens
ggtggatgtaaat

SEQ ID NO: 3771056 - DNA, 15 bp, Homo sapiens
ggtggcagccctgta

SEQ ID NO: 3771057 - DNA, 11 bp, Homo sapiens
ggtggcagctg

SEQ ID NO: 3771058 - DNA, 16 bp, Homo sapiens
ggtggcagtgggagct

SEQ ID NO: 3771059 - DNA, 15 bp, Homo sapiens
ggtggcatacgcctg

SEQ ID NO: 3771060 - DNA, 14 bp, Homo sapiens
ggtggcccctgcct

SEQ ID NO: 3771061 - DNA, 17 bp, Homo sapiens
ggtggcccgacagcctg

SEQ ID NO: 3771062 - DNA, 21 bp, Homo sapiens
ggtggcgactctatagactct

SEQ ID NO: 3771063 - DNA, 19 bp, Homo sapiens
ggtggcgggcacctatagt

SEQ ID NO: 3771064 - DNA, 14 bp, Homo sapiens
ggtggctctggaat

SEQ ID NO: 3771065 - DNA, 19 bp, Homo sapiens
ggtggctgacccagtccct

SEQ ID NO: 3771066 - DNA, 22 bp, Homo sapiens
ggtggctgacccagtccctggg

SEQ ID NO: 3771067 - DNA, 23 bp, Homo sapiens
ggtggctgacccagtccctgggg

SEQ ID NO: 3771068 - DNA, 15 bp, Homo sapiens
ggtgggagagcccag

SEQ ID NO: 3771069 - DNA, 16 bp, Homo sapiens
ggtgggagagcccagc

SEQ ID NO: 3771070 - DNA, 20 bp, Homo sapiens
ggtgggaggattgcttgagc

SEQ ID NO: 3771071 - DNA, 20 bp, Homo sapiens
ggtgggcagatcacgaggtc

SEQ ID NO: 3771072 - DNA, 15 bp, Homo sapiens
ggtgggctgagccct

SEQ ID NO: 3771073 - DNA, 18 bp, Homo sapiens
ggtgggctgagccctggc

SEQ ID NO: 3771074 - DNA, 20 bp, Homo sapiens
taaaacaagaaagtttcccc

SEQ ID NO: 3771075 - DNA, 12 bp, Homo sapiens
taaaacatcttt

SEQ ID NO: 3771076 - DNA, 19 bp, Homo sapiens
taaaaccccatctctacta

SEQ ID NO: 3771077 - DNA, 10 bp, Homo sapiens
taaaaccttt

SEQ ID NO: 3771078 - DNA, 14 bp, Homo sapiens
taaaacctttcaaa

SEQ ID NO: 3771079 - DNA, 16 bp, Homo sapiens
taaaacctttcaaatt

SEQ ID NO: 3771080 - DNA, 20 bp, Homo sapiens
taaaacttgatgtgttatct

SEQ ID NO: 3771081 - DNA, 17 bp, Homo sapiens
taaaactttattttata

SEQ ID NO: 3771082 - DNA, 14 bp, Homo sapiens
taaaactttgctgc

SEQ ID NO: 3771083 - DNA, 16 bp, Homo sapiens
taaaactttgctgcca

SEQ ID NO: 3771084 - DNA, 20 bp, Homo sapiens
taaaagcagcatctgctaat

SEQ ID NO: 3771085 - DNA, 17 bp, Homo sapiens
taaaagcataaatgcaa

SEQ ID NO: 3771086 - DNA, 12 bp, Homo sapiens
taaaaggagcca

SEQ ID NO: 3771087 - DNA, 13 bp, Homo sapiens
taaaagtgatcaa

SEQ ID NO: 3771088 - DNA, 15 bp, Homo sapiens
taaaagtgatcaata

SEQ ID NO: 3771089 - DNA, 14 bp, Homo sapiens
taaaagttcataac

SEQ ID NO: 3771090 - DNA, 21 bp, Homo sapiens
taaaagttcataacagtgcca

SEQ ID NO: 3771091 - DNA, 16 bp, Homo sapiens
taaaagttttctccaa

SEQ ID NO: 3771092 - DNA, 16 bp, Homo sapiens
taaaataacagactgt

SEQ ID NO: 3771093 - DNA, 24 bp, Homo sapiens
taaaataactagtgttgcttggac

SEQ ID NO: 3771094 - DNA, 17 bp, Homo sapiens
taaaataaggatttttc

SEQ ID NO: 3771095 - DNA, 22 bp, Homo sapiens
taaaataaggatttttctctta

SEQ ID NO: 3771096 - DNA, 17 bp, Homo sapiens
taaaatatatttcagat

SEQ ID NO: 3771097 - DNA, 15 bp, Homo sapiens
taaaatatcattcag

SEQ ID NO: 3771098 - DNA, 11 bp, Homo sapiens
taaaatcacta

SEQ ID NO: 3771099 - DNA, 19 bp, Homo sapiens
taaaatcttggcacagaaa

SEQ ID NO: 3771100 - DNA, 16 bp, Homo sapiens
taaaatggtgttttca

SEQ ID NO: 3771101 - DNA, 16 bp, Homo sapiens
taaaattaaagctgaa

SEQ ID NO: 3771102 - DNA, 19 bp, Homo sapiens
taaaattaaagctgaaaac

SEQ ID NO: 3771103 - DNA, 10 bp, Homo sapiens
taaaattaag

SEQ ID NO: 3771104 - DNA, 15 bp, Homo sapiens
taaaattaagaatgt

SEQ ID NO: 3771105 - DNA, 18 bp, Homo sapiens
taaaattaagaatgttct

SEQ ID NO: 3771106 - DNA, 13 bp, Homo sapiens
taaaattctaaat

SEQ ID NO: 3771107 - DNA, 18 bp, Homo sapiens
taaacaaactgtgtaact

SEQ ID NO: 3771108 - DNA, 19 bp, Homo sapiens
taaacaaatgtatgattac

SEQ ID NO: 3771109 - DNA, 18 bp, Homo sapiens
taaacaatttattttatt

SEQ ID NO: 3771110 - DNA, 13 bp, Homo sapiens
taaacacatagat

SEQ ID NO: 3771111 - DNA, 20 bp, Homo sapiens
taaacacatagattcacctg

SEQ ID NO: 3771112 - DNA, 23 bp, Homo sapiens
taaacagcttcatgcctttgtaa

SEQ ID NO: 3771113 - DNA, 20 bp, Homo sapiens
taaacagtgagcctgaattt

SEQ ID NO: 3771114 - DNA, 23 bp, Homo sapiens
taaacagtgagcctgaattttgt

SEQ ID NO: 3771115 - DNA, 16 bp, Homo sapiens
taaacatcacacacac

SEQ ID NO: 3771116 - DNA, 18 bp, Homo sapiens
taaacattgaagtaatga

SEQ ID NO: 3771117 - DNA, 19 bp, Homo sapiens
taaacccagtagtggtgac

SEQ ID NO: 3771118 - DNA, 14 bp, Homo sapiens
taaactaggaaaat

SEQ ID NO: 3771119 - DNA, 23 bp, Homo sapiens
taaactcaaaatatttgtacata

SEQ ID NO: 3771120 - DNA, 12 bp, Homo sapiens
taaactcatttc

SEQ ID NO: 3771121 - DNA, 15 bp, Homo sapiens
taaactgccctgtct

SEQ ID NO: 3771122 - DNA, 19 bp, Homo sapiens
taaactgtcctctttcaga

SEQ ID NO: 3771123 - DNA, 22 bp, Homo sapiens
taaactgtgtggactgtgatgc

SEQ ID NO: 3771124 - DNA, 18 bp, Homo sapiens
taaactttagagtagcat

SEQ ID NO: 3771125 - DNA, 12 bp, Homo sapiens
taaagaaaactg

SEQ ID NO: 3771126 - DNA, 12 bp, Homo sapiens
taaagaaaataa

SEQ ID NO: 3771127 - DNA, 14 bp, Homo sapiens
taaagaaaataaaa

SEQ ID NO: 3771128 - DNA, 15 bp, Homo sapiens
taaagaatcattatt

SEQ ID NO: 3771129 - DNA, 15 bp, Homo sapiens
taaagacacctactg

SEQ ID NO: 3771130 - DNA, 16 bp, Homo sapiens
taaagagaaaattgaa

SEQ ID NO: 3771131 - DNA, 17 bp, Homo sapiens
taaagagaaaattgaat

SEQ ID NO: 3771132 - DNA, 23 bp, Homo sapiens
taaagagaaaattgaatttaaca

SEQ ID NO: 3771133 - DNA, 11 bp, Homo sapiens
taaagagaaac

SEQ ID NO: 3771134 - DNA, 13 bp, Homo sapiens
taaagatattatt

SEQ ID NO: 3771135 - DNA, 15 bp, Homo sapiens
taaagatattattca

SEQ ID NO: 3771136 - DNA, 18 bp, Homo sapiens
taaagcatctaaacttta

SEQ ID NO: 3771137 - DNA, 23 bp, Homo sapiens
taaagcattcaatttattcaaga

SEQ ID NO: 3771138 - DNA, 16 bp, Homo sapiens
taaagccaaaggtcta

SEQ ID NO: 3771139 - DNA, 22 bp, Homo sapiens
taaaggagaaggcatgaaattg

SEQ ID NO: 3771140 - DNA, 15 bp, Homo sapiens
taaaggctaccttat

SEQ ID NO: 3771141 - DNA, 20 bp, Homo sapiens
taaaggtgaaaaaagctttt

SEQ ID NO: 3771142 - DNA, 23 bp, Homo sapiens
taaaggtggtatgtgtgtgtatg

SEQ ID NO: 3771143 - DNA, 20 bp, Homo sapiens
taaaggtggtgaggcaataa

SEQ ID NO: 3771144 - DNA, 19 bp, Homo sapiens
taaaggttattttctcctg

SEQ ID NO: 3771145 - DNA, 20 bp, Homo sapiens
taaaggttgacaataaatgt

SEQ ID NO: 3771146 - DNA, 21 bp, Homo sapiens
taaagtagattagatctttta

SEQ ID NO: 3771147 - DNA, 14 bp, Homo sapiens
taaagtattccacc

SEQ ID NO: 3771148 - DNA, 18 bp, Homo sapiens
taaagtcaggtccaattt

SEQ ID NO: 3771149 - DNA, 16 bp, Homo sapiens
taaagtgtaaatcctt

SEQ ID NO: 3771150 - DNA, 15 bp, Homo sapiens
taaagttacattgct

SEQ ID NO: 3771151 - DNA, 17 bp, Homo sapiens
taaagttctgagtgttt

SEQ ID NO: 3771152 - DNA, 21 bp, Homo sapiens
taaataaaaaataataataca

SEQ ID NO: 3771153 - DNA, 23 bp, Homo sapiens
taaataaaaaataataatacaag

SEQ ID NO: 3771154 - DNA, 21 bp, Homo sapiens
taaataaaacattttcacaca

SEQ ID NO: 3771155 - DNA, 19 bp, Homo sapiens
taaataaaagcagcatctg

SEQ ID NO: 3771156 - DNA, 18 bp, Homo sapiens
taaataaatgtcattaaa

SEQ ID NO: 3771157 - DNA, 13 bp, Homo sapiens
taaataagagatt

SEQ ID NO: 3771158 - DNA, 18 bp, Homo sapiens
taaatacacaacacacac

SEQ ID NO: 3771159 - DNA, 18 bp, Homo sapiens
taaatagagtatatgcac

SEQ ID NO: 3771160 - DNA, 16 bp, Homo sapiens
taaatagctatatcca

SEQ ID NO: 3771161 - DNA, 18 bp, Homo sapiens
taaatagctatatccatg

SEQ ID NO: 3771162 - DNA, 19 bp, Homo sapiens
taaatagctatatccatgt

SEQ ID NO: 3771163 - DNA, 20 bp, Homo sapiens
taaatagctatatccatgta

SEQ ID NO: 3771164 - DNA, 20 bp, Homo sapiens
taaatagtaaaaataaaatt

SEQ ID NO: 3771165 - DNA, 16 bp, Homo sapiens
taaatatatgtatgta

SEQ ID NO: 3771166 - DNA, 22 bp, Homo sapiens
taaatatctgtacttcttcgat

SEQ ID NO: 3771167 - DNA, 18 bp, Homo sapiens
taaatatcttctgatttg

SEQ ID NO: 3771168 - DNA, 21 bp, Homo sapiens
taaatatttacatatgaaatt

SEQ ID NO: 3771169 - DNA, 23 bp, Homo sapiens
taaatcaatgtcacttaaaggct

SEQ ID NO: 3771170 - DNA, 21 bp, Homo sapiens
taaatcatgttaatcctagct

SEQ ID NO: 3771171 - DNA, 19 bp, Homo sapiens
taaatcctttttctttata

SEQ ID NO: 3771172 - DNA, 17 bp, Homo sapiens
taaatctcctatttttt

SEQ ID NO: 3771173 - DNA, 17 bp, Homo sapiens
taaatctgttcaaggaa

SEQ ID NO: 3771174 - DNA, 12 bp, Homo sapiens
taaatgaatgtt

SEQ ID NO: 3771175 - DNA, 17 bp, Homo sapiens
taaatgaggggcctcag

SEQ ID NO: 3771176 - DNA, 15 bp, Homo sapiens
taaatgcaatatgta

SEQ ID NO: 3771177 - DNA, 22 bp, Homo sapiens
taaatgcagcgaaccaatattt

SEQ ID NO: 3771178 - DNA, 13 bp, Homo sapiens
taaatgccctgct

SEQ ID NO: 3771179 - DNA, 17 bp, Homo sapiens
taaatgtaaagacaaaa

SEQ ID NO: 3771180 - DNA, 16 bp, Homo sapiens
taaatgtaagaatcat

SEQ ID NO: 3771181 - DNA, 19 bp, Homo sapiens
taaatgtatcttattcaca

SEQ ID NO: 3771182 - DNA, 20 bp, Homo sapiens
taaatgtctagttgtaacac

SEQ ID NO: 3771183 - DNA, 22 bp, Homo sapiens
taaattaaacaatttattttat

SEQ ID NO: 3771184 - DNA, 15 bp, Homo sapiens
taaattaaataaaat

SEQ ID NO: 3771185 - DNA, 16 bp, Homo sapiens
taaattaaataaaata

SEQ ID NO: 3771186 - DNA, 13 bp, Homo sapiens
taaattaaatata

SEQ ID NO: 3771187 - DNA, 17 bp, Homo sapiens
taaattaggaataaata

SEQ ID NO: 3771188 - DNA, 21 bp, Homo sapiens
taaattaggaataaataaaaa

SEQ ID NO: 3771189 - DNA, 22 bp, Homo sapiens
taaattataacttaaaatattt

SEQ ID NO: 3771190 - DNA, 13 bp, Homo sapiens
taaattataagga

SEQ ID NO: 3771191 - DNA, 16 bp, Homo sapiens
taaattatactggaga

SEQ ID NO: 3771192 - DNA, 19 bp, Homo sapiens
taaattatagtgtagaaaa

SEQ ID NO: 3771193 - DNA, 20 bp, Homo sapiens
taaattattatgacaccttt

SEQ ID NO: 3771194 - DNA, 23 bp, Homo sapiens
taaattcaaccactgtaaaatga

SEQ ID NO: 3771195 - DNA, 23 bp, Homo sapiens
taaattcagatatatttttcaca

SEQ ID NO: 3771196 - DNA, 13 bp, Homo sapiens
taaattccactgg

SEQ ID NO: 3771197 - DNA, 14 bp, Homo sapiens
taaattccactgga

SEQ ID NO: 3771198 - DNA, 18 bp, Homo sapiens
taaattcttttttaaatt

SEQ ID NO: 3771199 - DNA, 19 bp, Homo sapiens
taaattcttttttaaattt

SEQ ID NO: 3771200 - DNA, 20 bp, Homo sapiens
taaattcttttttaaatttt

SEQ ID NO: 3771201 - DNA, 20 bp, Homo sapiens
taaattgaaatataatgcaa

SEQ ID NO: 3771202 - DNA, 15 bp, Homo sapiens
taaatttatttcaaa

SEQ ID NO: 3771203 - DNA, 23 bp, Homo sapiens
taacaaaccctcgtttctgatta

SEQ ID NO: 3771204 - DNA, 16 bp, Homo sapiens
taacaactatgatttg

SEQ ID NO: 3771205 - DNA, 14 bp, Homo sapiens
taacaagaaactca

SEQ ID NO: 3771206 - DNA, 13 bp, Homo sapiens
taacaagaaagga

SEQ ID NO: 3771207 - DNA, 14 bp, Homo sapiens
taacaagaaaggag

SEQ ID NO: 3771208 - DNA, 13 bp, Homo sapiens
taacaagagtgat

SEQ ID NO: 3771209 - DNA, 20 bp, Homo sapiens
taacaagagtgattcttgct

SEQ ID NO: 3771210 - DNA, 16 bp, Homo sapiens
taacaagatctttcag

SEQ ID NO: 3771211 - DNA, 11 bp, Homo sapiens
taacaaggaat

SEQ ID NO: 3771212 - DNA, 12 bp, Homo sapiens
taacaaggaatg

SEQ ID NO: 3771213 - DNA, 19 bp, Homo sapiens
taacaaggaatgcctgtgc

SEQ ID NO: 3771214 - DNA, 22 bp, Homo sapiens
taacaaggaatgcctgtgccaa

SEQ ID NO: 3771215 - DNA, 18 bp, Homo sapiens
taacaataactactgtgt

SEQ ID NO: 3771216 - DNA, 21 bp, Homo sapiens
taacaataactactgtgttcc

SEQ ID NO: 3771217 - DNA, 12 bp, Homo sapiens
taacaatgtctt

SEQ ID NO: 3771218 - DNA, 12 bp, Homo sapiens
taacacagagag

SEQ ID NO: 3771219 - DNA, 16 bp, Homo sapiens
taacacagagagacag

SEQ ID NO: 3771220 - DNA, 11 bp, Homo sapiens
taacacattat

SEQ ID NO: 3771221 - DNA, 23 bp, Homo sapiens
taacacatttttaaagctttccc

SEQ ID NO: 3771222 - DNA, 17 bp, Homo sapiens
taacactagtctgtgtg

SEQ ID NO: 3771223 - DNA, 23 bp, Homo sapiens
taacactagtctgtgtgctgtgg

SEQ ID NO: 3771224 - DNA, 16 bp, Homo sapiens
taacactataaaggtt

SEQ ID NO: 3771225 - DNA, 13 bp, Homo sapiens
taacactggcccc

SEQ ID NO: 3771226 - DNA, 15 bp, Homo sapiens
taacactggccccta

SEQ ID NO: 3771227 - DNA, 23 bp, Homo sapiens
taacagcattcttgtcacaataa

SEQ ID NO: 3771228 - DNA, 18 bp, Homo sapiens
taacagctaccatgacaa

SEQ ID NO: 3771229 - DNA, 12 bp, Homo sapiens
taacagctgagg

SEQ ID NO: 3771230 - DNA, 14 bp, Homo sapiens
taacaggatgaaag

SEQ ID NO: 3771231 - DNA, 15 bp, Homo sapiens
taacagggccttgct

SEQ ID NO: 3771232 - DNA, 16 bp, Homo sapiens
taacagggccttgcta

SEQ ID NO: 3771233 - DNA, 15 bp, Homo sapiens
taacagggtaaatta

SEQ ID NO: 3771234 - DNA, 13 bp, Homo sapiens
taacaggtctcct

SEQ ID NO: 3771235 - DNA, 19 bp, Homo sapiens
taacaggtctcctcttaaa

SEQ ID NO: 3771236 - DNA, 15 bp, Homo sapiens
taacagtcttactgc

SEQ ID NO: 3771237 - DNA, 14 bp, Homo sapiens
taacagtgccattg

SEQ ID NO: 3771238 - DNA, 19 bp, Homo sapiens
taacagtgccattgtcttt

SEQ ID NO: 3771239 - DNA, 20 bp, Homo sapiens
taacagtgccattgtcttta

SEQ ID NO: 3771240 - DNA, 23 bp, Homo sapiens
taacagtgccattgtctttatat

SEQ ID NO: 3771241 - DNA, 17 bp, Homo sapiens
taacagttttccatgaa

SEQ ID NO: 3771242 - DNA, 20 bp, Homo sapiens
taacagttttccatgaaaac

SEQ ID NO: 3771243 - DNA, 18 bp, Homo sapiens
taacataaattgtactgt

SEQ ID NO: 3771244 - DNA, 13 bp, Homo sapiens
taacatataatat

SEQ ID NO: 3771245 - DNA, 20 bp, Homo sapiens
taacatataatatatgtttt

SEQ ID NO: 3771246 - DNA, 14 bp, Homo sapiens
taacatataatgtt

SEQ ID NO: 3771247 - DNA, 19 bp, Homo sapiens
taacatgtaattaagtact

SEQ ID NO: 3771248 - DNA, 15 bp, Homo sapiens
taacatgtatcccaa

SEQ ID NO: 3771249 - DNA, 16 bp, Homo sapiens
taacattatattgcaa

SEQ ID NO: 3771250 - DNA, 16 bp, Homo sapiens
taacattcgatctcat

SEQ ID NO: 3771251 - DNA, 15 bp, Homo sapiens
taacattgaccaaga

SEQ ID NO: 3771252 - DNA, 19 bp, Homo sapiens
taacattgaccaagaactg

SEQ ID NO: 3771253 - DNA, 21 bp, Homo sapiens
taacattgaccaagaactgca

SEQ ID NO: 3771254 - DNA, 22 bp, Homo sapiens
taacatttctaactctgatgta

SEQ ID NO: 3771255 - DNA, 23 bp, Homo sapiens
taacatttctaactctgatgtaa

SEQ ID NO: 3771256 - DNA, 21 bp, Homo sapiens
taaccaaatgcatcaatcctg

SEQ ID NO: 3771257 - DNA, 20 bp, Homo sapiens
taaccacttaaaaaatgtcc

SEQ ID NO: 3771258 - DNA, 21 bp, Homo sapiens
taaccagggcaccaagcccac

SEQ ID NO: 3771259 - DNA, 15 bp, Homo sapiens
taaccccaaaatgaa

SEQ ID NO: 3771260 - DNA, 14 bp, Homo sapiens
taaccccattcttt

SEQ ID NO: 3771261 - DNA, 15 bp, Homo sapiens
taaccccattctttg

SEQ ID NO: 3771262 - DNA, 12 bp, Homo sapiens
taacccctttcc

SEQ ID NO: 3771263 - DNA, 19 bp, Homo sapiens
taacctcagtgtcatttat

SEQ ID NO: 3771264 - DNA, 11 bp, Homo sapiens
taacctccttt

SEQ ID NO: 3771265 - DNA, 12 bp, Homo sapiens
taacctggtgct

SEQ ID NO: 3771266 - DNA, 18 bp, Homo sapiens
taacctggtgctggatat

SEQ ID NO: 3771267 - DNA, 22 bp, Homo sapiens
taacctggtgctggatattttc

SEQ ID NO: 3771268 - DNA, 19 bp, Homo sapiens
taacctgtacttcaagtta

SEQ ID NO: 3771269 - DNA, 23 bp, Homo sapiens
taacgacttcagggcagggctct

SEQ ID NO: 3771270 - DNA, 22 bp, Homo sapiens
taactaatctattgggttcatt

SEQ ID NO: 3771271 - DNA, 15 bp, Homo sapiens
taactagaatttatt

SEQ ID NO: 3771272 - DNA, 17 bp, Homo sapiens
taactagtgttgcttgg

SEQ ID NO: 3771273 - DNA, 22 bp, Homo sapiens
taactcagaaacatcagttact

SEQ ID NO: 3771274 - DNA, 15 bp, Homo sapiens
taactcaggactcca

SEQ ID NO: 3771275 - DNA, 20 bp, Homo sapiens
taactcaggactccagccca

SEQ ID NO: 3771276 - DNA, 15 bp, Homo sapiens
taactcatcataaaa

SEQ ID NO: 3771277 - DNA, 17 bp, Homo sapiens
taactcatcataaaata

SEQ ID NO: 3771278 - DNA, 11 bp, Homo sapiens
taactccacca

SEQ ID NO: 3771279 - DNA, 14 bp, Homo sapiens
taactctgatgtaa

SEQ ID NO: 3771280 - DNA, 21 bp, Homo sapiens
taactctttgcctttgccacc

SEQ ID NO: 3771281 - DNA, 15 bp, Homo sapiens
taactgaaggagaag

SEQ ID NO: 3771282 - DNA, 15 bp, Homo sapiens
taactgacaaatcaa

SEQ ID NO: 3771283 - DNA, 16 bp, Homo sapiens
taactgcatttttaga

SEQ ID NO: 3771284 - DNA, 23 bp, Homo sapiens
taactggcagttttccattggtt

SEQ ID NO: 3771285 - DNA, 15 bp, Homo sapiens
taactgtgtatgtac

SEQ ID NO: 3771286 - DNA, 18 bp, Homo sapiens
taacttaaaaaaatgaca

SEQ ID NO: 3771287 - DNA, 19 bp, Homo sapiens
taacttggttatacatgac

SEQ ID NO: 3771288 - DNA, 13 bp, Homo sapiens
taactttcagaag

SEQ ID NO: 3771289 - DNA, 19 bp, Homo sapiens
taactttcattaaagcatt

SEQ ID NO: 3771290 - DNA, 13 bp, Homo sapiens
taacttttgtaag

SEQ ID NO: 3771291 - DNA, 22 bp, Homo sapiens
taagaaaaaaataattttatga

SEQ ID NO: 3771292 - DNA, 17 bp, Homo sapiens
taagaaaatacaataaa

SEQ ID NO: 3771293 - DNA, 19 bp, Homo sapiens
taagaaaatacaataaact

SEQ ID NO: 3771294 - DNA, 19 bp, Homo sapiens
taagaaaccaatcaagata

SEQ ID NO: 3771295 - DNA, 15 bp, Homo sapiens
taagaaagtgaagca

SEQ ID NO: 3771296 - DNA, 12 bp, Homo sapiens
taagaagagact

SEQ ID NO: 3771297 - DNA, 15 bp, Homo sapiens
taagaatgctggttt

SEQ ID NO: 3771298 - DNA, 22 bp, Homo sapiens
taagaatgctggttttcctaaa

SEQ ID NO: 3771299 - DNA, 17 bp, Homo sapiens
taagaattttaaatatt

SEQ ID NO: 3771300 - DNA, 13 bp, Homo sapiens
taagaccagcctg

SEQ ID NO: 3771301 - DNA, 23 bp, Homo sapiens
taagaccggaagctcctggtatg

SEQ ID NO: 3771302 - DNA, 23 bp, Homo sapiens
taagagaatgttatagtgaatta

SEQ ID NO: 3771303 - DNA, 18 bp, Homo sapiens
taagagctagcgctgccg

SEQ ID NO: 3771304 - DNA, 20 bp, Homo sapiens
taagagctagcgctgccgca

SEQ ID NO: 3771305 - DNA, 14 bp, Homo sapiens
taagagctatacag

SEQ ID NO: 3771306 - DNA, 14 bp, Homo sapiens
taagagctggtgtc

SEQ ID NO: 3771307 - DNA, 23 bp, Homo sapiens
taagatacaagtttcagacaggg

SEQ ID NO: 3771308 - DNA, 15 bp, Homo sapiens
taagatggattctca

SEQ ID NO: 3771309 - DNA, 21 bp, Homo sapiens
taagatggattctcagatatt

SEQ ID NO: 3771310 - DNA, 20 bp, Homo sapiens
taagatgtgtcttcaatttg

SEQ ID NO: 3771311 - DNA, 14 bp, Homo sapiens
taagattccttttc

SEQ ID NO: 3771312 - DNA, 21 bp, Homo sapiens
taagatttaatttgccaaaat

SEQ ID NO: 3771313 - DNA, 13 bp, Homo sapiens
taagatttaccca

SEQ ID NO: 3771314 - DNA, 13 bp, Homo sapiens
taagattttgaaa

SEQ ID NO: 3771315 - DNA, 22 bp, Homo sapiens
taagattttgaaaactacattt

SEQ ID NO: 3771316 - DNA, 13 bp, Homo sapiens
taagcaagagaga

SEQ ID NO: 3771317 - DNA, 17 bp, Homo sapiens
taagcattactcttgta

SEQ ID NO: 3771318 - DNA, 12 bp, Homo sapiens
taagcattgttt

SEQ ID NO: 3771319 - DNA, 21 bp, Homo sapiens
taagcctccatttagttcttt

SEQ ID NO: 3771320 - DNA, 16 bp, Homo sapiens
taagcctttccataag

SEQ ID NO: 3771321 - DNA, 22 bp, Homo sapiens
taagctaacccccttctactga

SEQ ID NO: 3771322 - DNA, 13 bp, Homo sapiens
taagctatgtgaa

SEQ ID NO: 3771323 - DNA, 17 bp, Homo sapiens
taagctctttgaaacaa

SEQ ID NO: 3771324 - DNA, 21 bp, Homo sapiens
taagctctttgaaacaacttt

SEQ ID NO: 3771325 - DNA, 12 bp, Homo sapiens
taagctgctttt

SEQ ID NO: 3771326 - DNA, 20 bp, Homo sapiens
taagcttccaggaaaaagga

SEQ ID NO: 3771327 - DNA, 16 bp, Homo sapiens
taaggaaagcaataaa

SEQ ID NO: 3771328 - DNA, 10 bp, Homo sapiens
taaggactgc

SEQ ID NO: 3771329 - DNA, 19 bp, Homo sapiens
taaggagatgtaagagctt

SEQ ID NO: 3771330 - DNA, 19 bp, Homo sapiens
taaggatcagaacagcaga

SEQ ID NO: 3771331 - DNA, 18 bp, Homo sapiens
taaggatgggaaggaggg

SEQ ID NO: 3771332 - DNA, 15 bp, Homo sapiens
taaggattgtgatat

SEQ ID NO: 3771333 - DNA, 13 bp, Homo sapiens
taaggtgccttct

SEQ ID NO: 3771334 - DNA, 13 bp, Homo sapiens
taagtaaactgcc

SEQ ID NO: 3771335 - DNA, 16 bp, Homo sapiens
taagtaaatgtctgtg

SEQ ID NO: 3771336 - DNA, 16 bp, Homo sapiens
taagtattcaagaaag

SEQ ID NO: 3771337 - DNA, 20 bp, Homo sapiens
taagtatttaggtttttgtt

SEQ ID NO: 3771338 - DNA, 15 bp, Homo sapiens
taagtatttatatat

SEQ ID NO: 3771339 - DNA, 19 bp, Homo sapiens
taagtatttcagatgcttt

SEQ ID NO: 3771340 - DNA, 21 bp, Homo sapiens
taagtatttcagatgctttag

SEQ ID NO: 3771341 - DNA, 22 bp, Homo sapiens
taagtccctgccccctcccctt

SEQ ID NO: 3771342 - DNA, 23 bp, Homo sapiens
taagtccctgccccctccccttc

SEQ ID NO: 3771343 - DNA, 12 bp, Homo sapiens
taagtctctgtg

SEQ ID NO: 3771344 - DNA, 16 bp, Homo sapiens
taagtgaaaaggtcat

SEQ ID NO: 3771345 - DNA, 15 bp, Homo sapiens
taagtgagagagaca

SEQ ID NO: 3771346 - DNA, 15 bp, Homo sapiens
taagtgctttgtaat

SEQ ID NO: 3771347 - DNA, 13 bp, Homo sapiens
taagtggctgctg

SEQ ID NO: 3771348 - DNA, 15 bp, Homo sapiens
taagtgtactaatta

SEQ ID NO: 3771349 - DNA, 14 bp, Homo sapiens
taagttcttagata

SEQ ID NO: 3771350 - DNA, 17 bp, Homo sapiens
taagttcttagatatct

SEQ ID NO: 3771351 - DNA, 20 bp, Homo sapiens
taagttggcttctgtttcta

SEQ ID NO: 3771352 - DNA, 17 bp, Homo sapiens
taagtttcagttgattt

SEQ ID NO: 3771353 - DNA, 14 bp, Homo sapiens
taagtttctgggac

SEQ ID NO: 3771354 - DNA, 13 bp, Homo sapiens
taataaaaaggca

SEQ ID NO: 3771355 - DNA, 15 bp, Homo sapiens
taataaaatatcatt

SEQ ID NO: 3771356 - DNA, 18 bp, Homo sapiens
taataaaatatcattcag

SEQ ID NO: 3771357 - DNA, 15 bp, Homo sapiens
taataaactgtgttt

SEQ ID NO: 3771358 - DNA, 14 bp, Homo sapiens
taataaagtatata

SEQ ID NO: 3771359 - DNA, 13 bp, Homo sapiens
taataaagtattc

SEQ ID NO: 3771360 - DNA, 16 bp, Homo sapiens
taataaagtgttttca

SEQ ID NO: 3771361 - DNA, 20 bp, Homo sapiens
taataaagtgttttcagagc

SEQ ID NO: 3771362 - DNA, 15 bp, Homo sapiens
taataaatatttatg

SEQ ID NO: 3771363 - DNA, 19 bp, Homo sapiens
taataaatgtacattaatt

SEQ ID NO: 3771364 - DNA, 13 bp, Homo sapiens
taataatgtgaat

SEQ ID NO: 3771365 - DNA, 18 bp, Homo sapiens
taataggaaaaacggaag

SEQ ID NO: 3771366 - DNA, 16 bp, Homo sapiens
taatatactatattta

SEQ ID NO: 3771367 - DNA, 16 bp, Homo sapiens
taatatatgttttaaa

SEQ ID NO: 3771368 - DNA, 15 bp, Homo sapiens
taatatgtattttat

SEQ ID NO: 3771369 - DNA, 19 bp, Homo sapiens
taatatgtattttatgtat

SEQ ID NO: 3771370 - DNA, 20 bp, Homo sapiens
taatattctttcaataacga

SEQ ID NO: 3771371 - DNA, 14 bp, Homo sapiens
taatattgagaaag

SEQ ID NO: 3771372 - DNA, 21 bp, Homo sapiens
taatattgatatgcttataca

SEQ ID NO: 3771373 - DNA, 14 bp, Homo sapiens
taatatttgctgac

SEQ ID NO: 3771374 - DNA, 14 bp, Homo sapiens
taatatttttaatt

SEQ ID NO: 3771375 - DNA, 18 bp, Homo sapiens
taatcaactgaaagtgtt

SEQ ID NO: 3771376 - DNA, 20 bp, Homo sapiens
taatcagcaagaatttgatc

SEQ ID NO: 3771377 - DNA, 12 bp, Homo sapiens
taatcagcctct

SEQ ID NO: 3771378 - DNA, 13 bp, Homo sapiens
taatcagcctctt

SEQ ID NO: 3771379 - DNA, 22 bp, Homo sapiens
taatcatataataaatgtacat

SEQ ID NO: 3771380 - DNA, 21 bp, Homo sapiens
taatcatgtgggtgagccagt

SEQ ID NO: 3771381 - DNA, 22 bp, Homo sapiens
taatcatttcttgggccctcct

SEQ ID NO: 3771382 - DNA, 20 bp, Homo sapiens
taatcccagctactcaggag

SEQ ID NO: 3771383 - DNA, 17 bp, Homo sapiens
taatcccgattcaccct

SEQ ID NO: 3771384 - DNA, 14 bp, Homo sapiens
taatccctgggcat

SEQ ID NO: 3771385 - DNA, 19 bp, Homo sapiens
taatccctgggcattgctt

SEQ ID NO: 3771386 - DNA, 18 bp, Homo sapiens
taatcgttatgtgtgtat

SEQ ID NO: 3771387 - DNA, 17 bp, Homo sapiens
taatctaattctaagga

SEQ ID NO: 3771388 - DNA, 22 bp, Homo sapiens
taatctactccttgtaaagact

SEQ ID NO: 3771389 - DNA, 22 bp, Homo sapiens
taatctagaacacaggcaaaat

SEQ ID NO: 3771390 - DNA, 18 bp, Homo sapiens
taatctattgggttcatt

SEQ ID NO: 3771391 - DNA, 19 bp, Homo sapiens
taatctattgggttcatta

SEQ ID NO: 3771392 - DNA, 20 bp, Homo sapiens
taatctattgggttcattat

SEQ ID NO: 3771393 - DNA, 18 bp, Homo sapiens
taatctcctcttttatct

SEQ ID NO: 3771394 - DNA, 17 bp, Homo sapiens
taatcttaatctgttta

SEQ ID NO: 3771395 - DNA, 14 bp, Homo sapiens
taatcttgctttct

SEQ ID NO: 3771396 - DNA, 15 bp, Homo sapiens
taatcttgctttctt

SEQ ID NO: 3771397 - DNA, 17 bp, Homo sapiens
taatcttgtttctgaaa

SEQ ID NO: 3771398 - DNA, 12 bp, Homo sapiens
taatctttgggt

SEQ ID NO: 3771399 - DNA, 19 bp, Homo sapiens
taatgaaagactgtacaaa

SEQ ID NO: 3771400 - DNA, 22 bp, Homo sapiens
taatgaaagactgtacaaagta

SEQ ID NO: 3771401 - DNA, 23 bp, Homo sapiens
taatgaaagactgtacaaagtag

SEQ ID NO: 3771402 - DNA, 15 bp, Homo sapiens
taatgacagagccag

SEQ ID NO: 3771403 - DNA, 17 bp, Homo sapiens
taatgcatgttaggaaa

SEQ ID NO: 3771404 - DNA, 21 bp, Homo sapiens
taatgctaaatgtaagaatca

SEQ ID NO: 3771405 - DNA, 13 bp, Homo sapiens
taatgctggagcg

SEQ ID NO: 3771406 - DNA, 14 bp, Homo sapiens
taatgctgttgcct

SEQ ID NO: 3771407 - DNA, 15 bp, Homo sapiens
taatggggcggtgag

SEQ ID NO: 3771408 - DNA, 13 bp, Homo sapiens
taatgtactgcat

SEQ ID NO: 3771409 - DNA, 15 bp, Homo sapiens
taatgtcacaggcag

SEQ ID NO: 3771410 - DNA, 21 bp, Homo sapiens
taatgtcaccaccttcccagc

SEQ ID NO: 3771411 - DNA, 13 bp, Homo sapiens
taatgtcttgtta

SEQ ID NO: 3771412 - DNA, 14 bp, Homo sapiens
taatgtcttgttaa

SEQ ID NO: 3771413 - DNA, 22 bp, Homo sapiens
taatgtcttgttaatattcttt

SEQ ID NO: 3771414 - DNA, 11 bp, Homo sapiens
taatgtgaact

SEQ ID NO: 3771415 - DNA, 14 bp, Homo sapiens
taatgttgttattt

SEQ ID NO: 3771416 - DNA, 16 bp, Homo sapiens
taatgtttatgagcca

SEQ ID NO: 3771417 - DNA, 22 bp, Homo sapiens
taatgtttatgagccagacaaa

SEQ ID NO: 3771418 - DNA, 14 bp, Homo sapiens
taattaaaaaattt

SEQ ID NO: 3771419 - DNA, 14 bp, Homo sapiens
taattaagtactat

SEQ ID NO: 3771420 - DNA, 21 bp, Homo sapiens
tagcaaaattcttaagtatgt

SEQ ID NO: 3771421 - DNA, 17 bp, Homo sapiens
tagcaagacacatccct

SEQ ID NO: 3771422 - DNA, 18 bp, Homo sapiens
tagcaagacacatcccta

SEQ ID NO: 3771423 - DNA, 24 bp, Homo sapiens
tagcaagattgcttaaaatagcaa

SEQ ID NO: 3771424 - DNA, 18 bp, Homo sapiens
tagcactcacatgctgga

SEQ ID NO: 3771425 - DNA, 13 bp, Homo sapiens
tagcactgagcaa

SEQ ID NO: 3771426 - DNA, 15 bp, Homo sapiens
tagcactttcattgc

SEQ ID NO: 3771427 - DNA, 20 bp, Homo sapiens
tagcactttcattgccagtg

SEQ ID NO: 3771428 - DNA, 18 bp, Homo sapiens
tagcagattttaattttg

SEQ ID NO: 3771429 - DNA, 21 bp, Homo sapiens
tagcatacatttataatgttt

SEQ ID NO: 3771430 - DNA, 20 bp, Homo sapiens
tagcatgttgagccaggcct

SEQ ID NO: 3771431 - DNA, 21 bp, Homo sapiens
tagccaaggtgggctgagccc

SEQ ID NO: 3771432 - DNA, 14 bp, Homo sapiens
tagccaatgtggga

SEQ ID NO: 3771433 - DNA, 20 bp, Homo sapiens
tagccacaaaattgggaaag

SEQ ID NO: 3771434 - DNA, 14 bp, Homo sapiens
tagccatcttgaag

SEQ ID NO: 3771435 - DNA, 22 bp, Homo sapiens
tagccccaacccaaacctggag

SEQ ID NO: 3771436 - DNA, 19 bp, Homo sapiens
tagcccccaggctgctgga

SEQ ID NO: 3771437 - DNA, 15 bp, Homo sapiens
tagccgacctcagcc

SEQ ID NO: 3771438 - DNA, 17 bp, Homo sapiens
tagccgagagcctgctc

SEQ ID NO: 3771439 - DNA, 14 bp, Homo sapiens
tagcctggcttggg

SEQ ID NO: 3771440 - DNA, 23 bp, Homo sapiens
tagcctgtggcagtaaagagaaa

SEQ ID NO: 3771441 - DNA, 21 bp, Homo sapiens
tagccttagaagtcacacagt

SEQ ID NO: 3771442 - DNA, 21 bp, Homo sapiens
tagcgctgccgcaccccagag

SEQ ID NO: 3771443 - DNA, 23 bp, Homo sapiens
tagcgttggaattaaaacaatgt

SEQ ID NO: 3771444 - DNA, 13 bp, Homo sapiens
tagctaatggaaa

SEQ ID NO: 3771445 - DNA, 15 bp, Homo sapiens
tagctacaggaagca

SEQ ID NO: 3771446 - DNA, 19 bp, Homo sapiens
tagctagaagtgggccagg

SEQ ID NO: 3771447 - DNA, 20 bp, Homo sapiens
tagctagaagtgggccagga

SEQ ID NO: 3771448 - DNA, 13 bp, Homo sapiens
tagctagaggaac

SEQ ID NO: 3771449 - DNA, 16 bp, Homo sapiens
tagctatatccatgta

SEQ ID NO: 3771450 - DNA, 21 bp, Homo sapiens
tagctatatccatgtactgta

SEQ ID NO: 3771451 - DNA, 19 bp, Homo sapiens
tagctcagccccagcccag

SEQ ID NO: 3771452 - DNA, 20 bp, Homo sapiens
tagctcaggtgtccctgcac

SEQ ID NO: 3771453 - DNA, 21 bp, Homo sapiens
tagctcaggtgtccctgcact

SEQ ID NO: 3771454 - DNA, 11 bp, Homo sapiens
tagctcagttt

SEQ ID NO: 3771455 - DNA, 12 bp, Homo sapiens
tagctcagttta

SEQ ID NO: 3771456 - DNA, 21 bp, Homo sapiens
tagctctaggagggctggcaa

SEQ ID NO: 3771457 - DNA, 23 bp, Homo sapiens
tagctgacccagccccttgagaa

SEQ ID NO: 3771458 - DNA, 11 bp, Homo sapiens
tagctgagtgt

SEQ ID NO: 3771459 - DNA, 14 bp, Homo sapiens
tagctgccaagccc

SEQ ID NO: 3771460 - DNA, 16 bp, Homo sapiens
tagctgccaagcccca

SEQ ID NO: 3771461 - DNA, 11 bp, Homo sapiens
tagctgggact

SEQ ID NO: 3771462 - DNA, 18 bp, Homo sapiens
tagctgtggtgaggtggg

SEQ ID NO: 3771463 - DNA, 17 bp, Homo sapiens
tagctgttatttctatt

SEQ ID NO: 3771464 - DNA, 17 bp, Homo sapiens
tagctgttgagctgttt

SEQ ID NO: 3771465 - DNA, 14 bp, Homo sapiens
tagcttatcaattt

SEQ ID NO: 3771466 - DNA, 13 bp, Homo sapiens
tagcttctgacct

SEQ ID NO: 3771467 - DNA, 19 bp, Homo sapiens
tagcttctgacctcagcat

SEQ ID NO: 3771468 - DNA, 16 bp, Homo sapiens
tagcttgcaccttgtc

SEQ ID NO: 3771469 - DNA, 20 bp, Homo sapiens
tagcttggaaactggatgag

SEQ ID NO: 3771470 - DNA, 18 bp, Homo sapiens
tagctttattttttaagt

SEQ ID NO: 3771471 - DNA, 23 bp, Homo sapiens
taggaaatcttgtccagagacaa

SEQ ID NO: 3771472 - DNA, 16 bp, Homo sapiens
taggaacatatgaaaa

SEQ ID NO: 3771473 - DNA, 19 bp, Homo sapiens
taggaagagaaaccaggga

SEQ ID NO: 3771474 - DNA, 15 bp, Homo sapiens
taggaaggttaatgt

SEQ ID NO: 3771475 - DNA, 17 bp, Homo sapiens
taggaagtgtaacagct

SEQ ID NO: 3771476 - DNA, 18 bp, Homo sapiens
taggaagtgtaacagctg

SEQ ID NO: 3771477 - DNA, 19 bp, Homo sapiens
taggaagtgtaacagctga

SEQ ID NO: 3771478 - DNA, 15 bp, Homo sapiens
taggaatagcatgtc

SEQ ID NO: 3771479 - DNA, 22 bp, Homo sapiens
taggagaattgcttgaacctgg

SEQ ID NO: 3771480 - DNA, 21 bp, Homo sapiens
taggagagagatcatgagaaa

SEQ ID NO: 3771481 - DNA, 16 bp, Homo sapiens
taggagataccaggtt

SEQ ID NO: 3771482 - DNA, 20 bp, Homo sapiens
taggaggaccagagctactg

SEQ ID NO: 3771483 - DNA, 23 bp, Homo sapiens
taggagttcgagaccagcctggc

SEQ ID NO: 3771484 - DNA, 18 bp, Homo sapiens
taggcacccatcctagag

SEQ ID NO: 3771485 - DNA, 16 bp, Homo sapiens
taggcatcccagggga

SEQ ID NO: 3771486 - DNA, 20 bp, Homo sapiens
taggcctgggtgctggctgc

SEQ ID NO: 3771487 - DNA, 13 bp, Homo sapiens
taggccttcttgt

SEQ ID NO: 3771488 - DNA, 14 bp, Homo sapiens
taggccttcttgtg

SEQ ID NO: 3771489 - DNA, 20 bp, Homo sapiens
taggctctgcacagatggat

SEQ ID NO: 3771490 - DNA, 16 bp, Homo sapiens
taggctggagcccagg

SEQ ID NO: 3771491 - DNA, 19 bp, Homo sapiens
taggctggagcccagggag

SEQ ID NO: 3771492 - DNA, 18 bp, Homo sapiens
taggctgggcccagaggc

SEQ ID NO: 3771493 - DNA, 14 bp, Homo sapiens
taggctttacttag

SEQ ID NO: 3771494 - DNA, 11 bp, Homo sapiens
tagggaaaaac

SEQ ID NO: 3771495 - DNA, 21 bp, Homo sapiens
tagggaaaaaccagcgtgtga

SEQ ID NO: 3771496 - DNA, 16 bp, Homo sapiens
tagggaaaagttcata

SEQ ID NO: 3771497 - DNA, 14 bp, Homo sapiens
tagggaagagaaac

SEQ ID NO: 3771498 - DNA, 15 bp, Homo sapiens
tagggaagagaaaca

SEQ ID NO: 3771499 - DNA, 15 bp, Homo sapiens
tagggacctggggaa

SEQ ID NO: 3771500 - DNA, 13 bp, Homo sapiens
tagggacttaaaa

SEQ ID NO: 3771501 - DNA, 18 bp, Homo sapiens
tagggagtacctgctgcc

SEQ ID NO: 3771502 - DNA, 21 bp, Homo sapiens
tagggatagtcaccttttaaa

SEQ ID NO: 3771503 - DNA, 23 bp, Homo sapiens
tagggctacaaaacctgatgtta

SEQ ID NO: 3771504 - DNA, 13 bp, Homo sapiens
taggggttgctaa

SEQ ID NO: 3771505 - DNA, 18 bp, Homo sapiens
tagggtaaggtgccttct

SEQ ID NO: 3771506 - DNA, 17 bp, Homo sapiens
tagggttataataatgt

SEQ ID NO: 3771507 - DNA, 13 bp, Homo sapiens
taggtacttttgg

SEQ ID NO: 3771508 - DNA, 14 bp, Homo sapiens
taggtatacagtgg

SEQ ID NO: 3771509 - DNA, 15 bp, Homo sapiens
taggtatgaataagt

SEQ ID NO: 3771510 - DNA, 22 bp, Homo sapiens
taggtcagtacccacctgagct

SEQ ID NO: 3771511 - DNA, 17 bp, Homo sapiens
taggtgtgggggaagca

SEQ ID NO: 3771512 - DNA, 23 bp, Homo sapiens
taggttaactatgtacaatattt

SEQ ID NO: 3771513 - DNA, 12 bp, Homo sapiens
taggttctaaaa

SEQ ID NO: 3771514 - DNA, 13 bp, Homo sapiens
taggtttaacata

SEQ ID NO: 3771515 - DNA, 15 bp, Homo sapiens
taggtttttttgtat

SEQ ID NO: 3771516 - DNA, 19 bp, Homo sapiens
taggtttttttgtatagta

SEQ ID NO: 3771517 - DNA, 15 bp, Homo sapiens
tagtaaaaatacaaa

SEQ ID NO: 3771518 - DNA, 12 bp, Homo sapiens
tagtaaagaaat

SEQ ID NO: 3771519 - DNA, 13 bp, Homo sapiens
tagtaaagaaatg

SEQ ID NO: 3771520 - DNA, 15 bp, Homo sapiens
tagtaatgttttata

SEQ ID NO: 3771521 - DNA, 21 bp, Homo sapiens
tagtacataaaggtggtatgt

SEQ ID NO: 3771522 - DNA, 16 bp, Homo sapiens
tagtaccaatcatttt

SEQ ID NO: 3771523 - DNA, 23 bp, Homo sapiens
tagtaccaatcattttaattatt

SEQ ID NO: 3771524 - DNA, 13 bp, Homo sapiens
tagtacccacctg

SEQ ID NO: 3771525 - DNA, 23 bp, Homo sapiens
tagtactatatctgttttactgc

SEQ ID NO: 3771526 - DNA, 19 bp, Homo sapiens
tagtactcctgcaaaattt

SEQ ID NO: 3771527 - DNA, 13 bp, Homo sapiens
tagtagagacagg

SEQ ID NO: 3771528 - DNA, 14 bp, Homo sapiens
tagtataaagaaaa

SEQ ID NO: 3771529 - DNA, 16 bp, Homo sapiens
tagtataaagaaaagt

SEQ ID NO: 3771530 - DNA, 16 bp, Homo sapiens
tagtatattaaaaatg

SEQ ID NO: 3771531 - DNA, 18 bp, Homo sapiens
tagtatattaaaaatggt

SEQ ID NO: 3771532 - DNA, 18 bp, Homo sapiens
tagtatatttatataatt

SEQ ID NO: 3771533 - DNA, 16 bp, Homo sapiens
tagtatttatttaatg

SEQ ID NO: 3771534 - DNA, 14 bp, Homo sapiens
tagtcaccttttaa

SEQ ID NO: 3771535 - DNA, 21 bp, Homo sapiens
tagtcaccttttaaatcctgt

SEQ ID NO: 3771536 - DNA, 22 bp, Homo sapiens
tagtcaccttttaaatcctgtt

SEQ ID NO: 3771537 - DNA, 14 bp, Homo sapiens
tagtcatagaagaa

SEQ ID NO: 3771538 - DNA, 13 bp, Homo sapiens
tagtcattttgct

SEQ ID NO: 3771539 - DNA, 22 bp, Homo sapiens
tagtccaatgtctttttaagct

SEQ ID NO: 3771540 - DNA, 14 bp, Homo sapiens
tagtcccttcccct

SEQ ID NO: 3771541 - DNA, 16 bp, Homo sapiens
tagtcccttcccctcc

SEQ ID NO: 3771542 - DNA, 23 bp, Homo sapiens
tagtcccttcccctccctggctc

SEQ ID NO: 3771543 - DNA, 22 bp, Homo sapiens
tagtctgtgtgggactgtacac

SEQ ID NO: 3771544 - DNA, 12 bp, Homo sapiens
tagtcttctcat

SEQ ID NO: 3771545 - DNA, 12 bp, Homo sapiens
tagtctttcaca

SEQ ID NO: 3771546 - DNA, 18 bp, Homo sapiens
tagtgagaagaatattgt

SEQ ID NO: 3771547 - DNA, 13 bp, Homo sapiens
tagtgatggttcc

SEQ ID NO: 3771548 - DNA, 20 bp, Homo sapiens
tagtgcagctgattttaaca

SEQ ID NO: 3771549 - DNA, 22 bp, Homo sapiens
tagtgcctgagagtatttaggc

SEQ ID NO: 3771550 - DNA, 15 bp, Homo sapiens
tagtgctgaagctta

SEQ ID NO: 3771551 - DNA, 22 bp, Homo sapiens
tagtgctgaagcttattaatgc

SEQ ID NO: 3771552 - DNA, 19 bp, Homo sapiens
tagtggccagaccagagct

SEQ ID NO: 3771553 - DNA, 21 bp, Homo sapiens
tagtgtaggctttacttagct

SEQ ID NO: 3771554 - DNA, 19 bp, Homo sapiens
tagtgtgttctgattagaa

SEQ ID NO: 3771555 - DNA, 20 bp, Homo sapiens
tagtgtgttctgattagaaa

SEQ ID NO: 3771556 - DNA, 16 bp, Homo sapiens
tagttaggaaataaaa

SEQ ID NO: 3771557 - DNA, 22 bp, Homo sapiens
tagttaggaaataaaacctttc

SEQ ID NO: 3771558 - DNA, 15 bp, Homo sapiens
tagttagtagcatgt

SEQ ID NO: 3771559 - DNA, 15 bp, Homo sapiens
tagttcagacacttt

SEQ ID NO: 3771560 - DNA, 18 bp, Homo sapiens
tagttcatccaatcctca

SEQ ID NO: 3771561 - DNA, 18 bp, Homo sapiens
tagttgcagactcagttt

SEQ ID NO: 3771562 - DNA, 15 bp, Homo sapiens
tagttgctccgcctc

SEQ ID NO: 3771563 - DNA, 15 bp, Homo sapiens
tagtttactatttta

SEQ ID NO: 3771564 - DNA, 12 bp, Homo sapiens
tagtttgcagtt

SEQ ID NO: 3771565 - DNA, 14 bp, Homo sapiens
tagttttagttgca

SEQ ID NO: 3771566 - DNA, 20 bp, Homo sapiens
tagtttttaatcgtacattt

SEQ ID NO: 3771567 - DNA, 17 bp, Homo sapiens
tagtttttgtaatttat

SEQ ID NO: 3771568 - DNA, 19 bp, Homo sapiens
tataaaaaaaatgaaatgt

SEQ ID NO: 3771569 - DNA, 17 bp, Homo sapiens
tataaaacaggtcaata

SEQ ID NO: 3771570 - DNA, 15 bp, Homo sapiens
tataaactttagagt

SEQ ID NO: 3771571 - DNA, 15 bp, Homo sapiens
tataaagagaaaatt

SEQ ID NO: 3771572 - DNA, 15 bp, Homo sapiens
tataaagcatctaaa

SEQ ID NO: 3771573 - DNA, 21 bp, Homo sapiens
tataaatgaagtttatacagt

SEQ ID NO: 3771574 - DNA, 24 bp, Homo sapiens
tataaatgaagtttatacagtaca

SEQ ID NO: 3771575 - DNA, 12 bp, Homo sapiens
tataaattaaat

SEQ ID NO: 3771576 - DNA, 22 bp, Homo sapiens
tataaattaaatatatgtatgt

SEQ ID NO: 3771577 - DNA, 23 bp, Homo sapiens
tataaattaaatatatgtatgta

SEQ ID NO: 3771578 - DNA, 19 bp, Homo sapiens
tataaccaacttttctatt

SEQ ID NO: 3771579 - DNA, 16 bp, Homo sapiens
tataactagctagaag

SEQ ID NO: 3771580 - DNA, 18 bp, Homo sapiens
tataactcatcataaaat

SEQ ID NO: 3771581 - DNA, 20 bp, Homo sapiens
tataactcatcataaaataa

SEQ ID NO: 3771582 - DNA, 20 bp, Homo sapiens
tataactgccttaaaacttt

SEQ ID NO: 3771583 - DNA, 10 bp, Homo sapiens
tataaggact

SEQ ID NO: 3771584 - DNA, 13 bp, Homo sapiens
tataaggactgca

SEQ ID NO: 3771585 - DNA, 14 bp, Homo sapiens
tataaggactgcat

SEQ ID NO: 3771586 - DNA, 13 bp, Homo sapiens
tataatatatgtt

SEQ ID NO: 3771587 - DNA, 17 bp, Homo sapiens
tataatatatgttttaa

SEQ ID NO: 3771588 - DNA, 18 bp, Homo sapiens
tataatgaatgaaacatt

SEQ ID NO: 3771589 - DNA, 20 bp, Homo sapiens
tataatgtcattaaacatga

SEQ ID NO: 3771590 - DNA, 19 bp, Homo sapiens
tataatgttgttatttaaa

SEQ ID NO: 3771591 - DNA, 18 bp, Homo sapiens
tataattacatatttgca

SEQ ID NO: 3771592 - DNA, 17 bp, Homo sapiens
tataattatgttattga

SEQ ID NO: 3771593 - DNA, 17 bp, Homo sapiens
tataattctactttgag

SEQ ID NO: 3771594 - DNA, 21 bp, Homo sapiens
tataatttttttcaatattta

SEQ ID NO: 3771595 - DNA, 19 bp, Homo sapiens
tatacacacacaaagagag

SEQ ID NO: 3771596 - DNA, 16 bp, Homo sapiens
tatacaggggaatatt

SEQ ID NO: 3771597 - DNA, 19 bp, Homo sapiens
tatacaggggaatatttta

SEQ ID NO: 3771598 - DNA, 16 bp, Homo sapiens
tatacatgacactgaa

SEQ ID NO: 3771599 - DNA, 22 bp, Homo sapiens
tatacatgacactgaaatgcct

SEQ ID NO: 3771600 - DNA, 23 bp, Homo sapiens
tatacatgacactgaaatgcctt

SEQ ID NO: 3771601 - DNA, 16 bp, Homo sapiens
tatactatatttatgg

SEQ ID NO: 3771602 - DNA, 16 bp, Homo sapiens
tatactggagaagtct

SEQ ID NO: 3771603 - DNA, 16 bp, Homo sapiens
tatactgtacttaata

SEQ ID NO: 3771604 - DNA, 17 bp, Homo sapiens
tatacttttttcttatt

SEQ ID NO: 3771605 - DNA, 19 bp, Homo sapiens
tatacttttttcttattta

SEQ ID NO: 3771606 - DNA, 21 bp, Homo sapiens
tatagaattgcaattttaaca

SEQ ID NO: 3771607 - DNA, 18 bp, Homo sapiens
tatagaatttttaatgtt

SEQ ID NO: 3771608 - DNA, 16 bp, Homo sapiens
tatagacccgaggaaa

SEQ ID NO: 3771609 - DNA, 22 bp, Homo sapiens
tatagctacaggaagcacccca

SEQ ID NO: 3771610 - DNA, 12 bp, Homo sapiens
tatagctatttt

SEQ ID NO: 3771611 - DNA, 19 bp, Homo sapiens
tataggaacatatgaaaat

SEQ ID NO: 3771612 - DNA, 17 bp, Homo sapiens
tataggtcactcctggg

SEQ ID NO: 3771613 - DNA, 20 bp, Homo sapiens
tatagtcccagctactcaga

SEQ ID NO: 3771614 - DNA, 16 bp, Homo sapiens
tatagtttactatttt

SEQ ID NO: 3771615 - DNA, 16 bp, Homo sapiens
tatataaagagaaaat

SEQ ID NO: 3771616 - DNA, 23 bp, Homo sapiens
tatataaagagaaaattgaattt

SEQ ID NO: 3771617 - DNA, 21 bp, Homo sapiens
tatatacacacacaaagagag

SEQ ID NO: 3771618 - DNA, 15 bp, Homo sapiens
tatatacatatatat

SEQ ID NO: 3771619 - DNA, 19 bp, Homo sapiens
tatatatgttgatttcttg

SEQ ID NO: 3771620 - DNA, 21 bp, Homo sapiens
tatatattctggctgataaaa

SEQ ID NO: 3771621 - DNA, 16 bp, Homo sapiens
tatatccatgtactgt

SEQ ID NO: 3771622 - DNA, 15 bp, Homo sapiens
tatatgtatccagta

SEQ ID NO: 3771623 - DNA, 11 bp, Homo sapiens
tatatgtatgt

SEQ ID NO: 3771624 - DNA, 12 bp, Homo sapiens
tatatgtatgta

SEQ ID NO: 3771625 - DNA, 16 bp, Homo sapiens
tatatgtatgtaaaaa

SEQ ID NO: 3771626 - DNA, 13 bp, Homo sapiens
tatatgtgtgtgt

SEQ ID NO: 3771627 - DNA, 22 bp, Homo sapiens
tatatgtgtgtgtatgtttgca

SEQ ID NO: 3771628 - DNA, 18 bp, Homo sapiens
tatatgtgtttttcacat

SEQ ID NO: 3771629 - DNA, 22 bp, Homo sapiens
tatattaaaaatggtaaaattg

SEQ ID NO: 3771630 - DNA, 22 bp, Homo sapiens
tatattatcatgcaaatgctgt

SEQ ID NO: 3771631 - DNA, 14 bp, Homo sapiens
tatattctctttgg

SEQ ID NO: 3771632 - DNA, 22 bp, Homo sapiens
tatattctctttggtgtacaaa

SEQ ID NO: 3771633 - DNA, 14 bp, Homo sapiens
tatattgagacaaa

SEQ ID NO: 3771634 - DNA, 14 bp, Homo sapiens
tatattgcaatgaa

SEQ ID NO: 3771635 - DNA, 22 bp, Homo sapiens
tatatttaagtattcaagaaag

SEQ ID NO: 3771636 - DNA, 15 bp, Homo sapiens
tatatttataactca

SEQ ID NO: 3771637 - DNA, 18 bp, Homo sapiens
tatatttatataattatg

SEQ ID NO: 3771638 - DNA, 21 bp, Homo sapiens
tatattttcaattcaaaaatg

SEQ ID NO: 3771639 - DNA, 22 bp, Homo sapiens
tatattttcaattcaaaaatgt

SEQ ID NO: 3771640 - DNA, 17 bp, Homo sapiens
tatatttttgtttgttt

SEQ ID NO: 3771641 - DNA, 21 bp, Homo sapiens
tatatttttgtttgttttgtg

SEQ ID NO: 3771642 - DNA, 15 bp, Homo sapiens
tatcaaacagctcag

SEQ ID NO: 3771643 - DNA, 16 bp, Homo sapiens
tatcaacccagaaaca

SEQ ID NO: 3771644 - DNA, 17 bp, Homo sapiens
tatcaacccagaaacac

SEQ ID NO: 3771645 - DNA, 15 bp, Homo sapiens
tatcaagctaataaa

SEQ ID NO: 3771646 - DNA, 18 bp, Homo sapiens
tatcaagtggcatgtgct

SEQ ID NO: 3771647 - DNA, 19 bp, Homo sapiens
tatcaatttgtcattttga

SEQ ID NO: 3771648 - DNA, 13 bp, Homo sapiens
tatcacacttctg

SEQ ID NO: 3771649 - DNA, 17 bp, Homo sapiens
tatcacacttctgtgag

SEQ ID NO: 3771650 - DNA, 13 bp, Homo sapiens
tatcacctcccct

SEQ ID NO: 3771651 - DNA, 14 bp, Homo sapiens
tatcacctcccctc

SEQ ID NO: 3771652 - DNA, 16 bp, Homo sapiens
tatcacctcccctcct

SEQ ID NO: 3771653 - DNA, 20 bp, Homo sapiens
tatcacctcccctccttgcc

SEQ ID NO: 3771654 - DNA, 17 bp, Homo sapiens
tatcagaattctcagaa

SEQ ID NO: 3771655 - DNA, 19 bp, Homo sapiens
tatcaggtgctgccatcca

SEQ ID NO: 3771656 - DNA, 16 bp, Homo sapiens
tatcagtgacagagtt

SEQ ID NO: 3771657 - DNA, 20 bp, Homo sapiens
tatcagtgacagagttcact

SEQ ID NO: 3771658 - DNA, 15 bp, Homo sapiens
tatcatagaaatgta

SEQ ID NO: 3771659 - DNA, 18 bp, Homo sapiens
tatcatagaaatgtaact

SEQ ID NO: 3771660 - DNA, 23 bp, Homo sapiens
tatcatagaaatgtaacttttgt

SEQ ID NO: 3771661 - DNA, 15 bp, Homo sapiens
tatcatatatttaat

SEQ ID NO: 3771662 - DNA, 15 bp, Homo sapiens
tatcatgcaaatgct

SEQ ID NO: 3771663 - DNA, 16 bp, Homo sapiens
tatcatgcaaatgctg

SEQ ID NO: 3771664 - DNA, 14 bp, Homo sapiens
tatcatggaaatat

SEQ ID NO: 3771665 - DNA, 14 bp, Homo sapiens
tatcattttctgca

SEQ ID NO: 3771666 - DNA, 14 bp, Homo sapiens
tatccaatcttgtt

SEQ ID NO: 3771667 - DNA, 19 bp, Homo sapiens
tatccacccagcccattct

SEQ ID NO: 3771668 - DNA, 20 bp, Homo sapiens
tatccacccagcccattctc

SEQ ID NO: 3771669 - DNA, 15 bp, Homo sapiens
tatccactttgcaca

SEQ ID NO: 3771670 - DNA, 18 bp, Homo sapiens
tatccatgggggcagggc

SEQ ID NO: 3771671 - DNA, 15 bp, Homo sapiens
tatccatgtactgta

SEQ ID NO: 3771672 - DNA, 19 bp, Homo sapiens
tatcccacggaaaatgcca

SEQ ID NO: 3771673 - DNA, 16 bp, Homo sapiens
tatcctatctctccaa

SEQ ID NO: 3771674 - DNA, 16 bp, Homo sapiens
tatcctcgctcccggg

SEQ ID NO: 3771675 - DNA, 14 bp, Homo sapiens
tatcctgaaatttc

SEQ ID NO: 3771676 - DNA, 16 bp, Homo sapiens
tatcctgaaatttcag

SEQ ID NO: 3771677 - DNA, 10 bp, Homo sapiens
tatcctgccc

SEQ ID NO: 3771678 - DNA, 16 bp, Homo sapiens
tatcctgcccagtgtt

SEQ ID NO: 3771679 - DNA, 14 bp, Homo sapiens
tatcgagtttgcaa

SEQ ID NO: 3771680 - DNA, 17 bp, Homo sapiens
tatcgccttttgacagc

SEQ ID NO: 3771681 - DNA, 14 bp, Homo sapiens
tatcggaagcagtg

SEQ ID NO: 3771682 - DNA, 15 bp, Homo sapiens
tatcggaagcagtgc

SEQ ID NO: 3771683 - DNA, 16 bp, Homo sapiens
tatcgggaacagtgtt

SEQ ID NO: 3771684 - DNA, 18 bp, Homo sapiens
tatcgggagcagtgtctt

SEQ ID NO: 3771685 - DNA, 16 bp, Homo sapiens
tatctaaccagtgatt

SEQ ID NO: 3771686 - DNA, 13 bp, Homo sapiens
tatctaatcatga

SEQ ID NO: 3771687 - DNA, 20 bp, Homo sapiens
tatctagtgcagctgatttt

SEQ ID NO: 3771688 - DNA, 18 bp, Homo sapiens
tatctattgtaagataaa

SEQ ID NO: 3771689 - DNA, 13 bp, Homo sapiens
tatctcagggcct

SEQ ID NO: 3771690 - DNA, 23 bp, Homo sapiens
tatctcttttgaatccatgcttg

SEQ ID NO: 3771691 - DNA, 15 bp, Homo sapiens
tatctgttttactgc

SEQ ID NO: 3771692 - DNA, 20 bp, Homo sapiens
tatctgttttactgctttta

SEQ ID NO: 3771693 - DNA, 19 bp, Homo sapiens
tatcttacaaagtgtattt

SEQ ID NO: 3771694 - DNA, 17 bp, Homo sapiens
tatcttcgttcttgtta

SEQ ID NO: 3771695 - DNA, 17 bp, Homo sapiens
tatcttggactgacatt

SEQ ID NO: 3771696 - DNA, 23 bp, Homo sapiens
tatcttggtgaatttttttttcc

SEQ ID NO: 3771697 - DNA, 17 bp, Homo sapiens
tatcttgtctctgggct

SEQ ID NO: 3771698 - DNA, 17 bp, Homo sapiens
tatctttgtaattattt

SEQ ID NO: 3771699 - DNA, 13 bp, Homo sapiens
tatcttttctaca

SEQ ID NO: 3771700 - DNA, 15 bp, Homo sapiens
tatctttttattgat

SEQ ID NO: 3771701 - DNA, 20 bp, Homo sapiens
tatgaaagatggctgtgcct

SEQ ID NO: 3771702 - DNA, 22 bp, Homo sapiens
tatgaaagatggctgtgcctct

SEQ ID NO: 3771703 - DNA, 23 bp, Homo sapiens
tatgaaagatggctgtgcctctg

SEQ ID NO: 3771704 - DNA, 21 bp, Homo sapiens
tatgaagctacctcaaacttc

SEQ ID NO: 3771705 - DNA, 12 bp, Homo sapiens
tatgaatacagg

SEQ ID NO: 3771706 - DNA, 20 bp, Homo sapiens
tatgacgcggctcaaaagga

SEQ ID NO: 3771707 - DNA, 16 bp, Homo sapiens
tatgacggaagaacat

SEQ ID NO: 3771708 - DNA, 19 bp, Homo sapiens
tatgacggaagaacataga

SEQ ID NO: 3771709 - DNA, 12 bp, Homo sapiens
tatgactaaaga

SEQ ID NO: 3771710 - DNA, 16 bp, Homo sapiens
tatgactaaagagaga

SEQ ID NO: 3771711 - DNA, 18 bp, Homo sapiens
tatgactaaagagagaat

SEQ ID NO: 3771712 - DNA, 19 bp, Homo sapiens
tatgactaaagagagaatg

SEQ ID NO: 3771713 - DNA, 16 bp, Homo sapiens
tatgagccagacaaat

SEQ ID NO: 3771714 - DNA, 19 bp, Homo sapiens
tatgagccagacaaatgga

SEQ ID NO: 3771715 - DNA, 17 bp, Homo sapiens
tatgaggacttgtgtct

SEQ ID NO: 3771716 - DNA, 15 bp, Homo sapiens
tatgagggaaaatga

SEQ ID NO: 3771717 - DNA, 21 bp, Homo sapiens
tatgataaaaaattttgtaat

SEQ ID NO: 3771718 - DNA, 22 bp, Homo sapiens
tatgatatttttttaagtcttt

SEQ ID NO: 3771719 - DNA, 21 bp, Homo sapiens
tatgatcacggctcactgcag

SEQ ID NO: 3771720 - DNA, 14 bp, Homo sapiens
tatgcaaattccca

SEQ ID NO: 3771721 - DNA, 16 bp, Homo sapiens
tatgcaataaataaca

SEQ ID NO: 3771722 - DNA, 20 bp, Homo sapiens
tatgcataactgacaaatca

SEQ ID NO: 3771723 - DNA, 23 bp, Homo sapiens
tatgcataactgacaaatcaagt

SEQ ID NO: 3771724 - DNA, 17 bp, Homo sapiens
tatgcatcatttcagga

SEQ ID NO: 3771725 - DNA, 18 bp, Homo sapiens
tatgcatcatttcaggag

SEQ ID NO: 3771726 - DNA, 17 bp, Homo sapiens
tatgccagctcagtccc

SEQ ID NO: 3771727 - DNA, 16 bp, Homo sapiens
tatgctgccaaatttt

SEQ ID NO: 3771728 - DNA, 22 bp, Homo sapiens
tatgctgccaaattttggccaa

SEQ ID NO: 3771729 - DNA, 15 bp, Homo sapiens
tatgctgtattttct

SEQ ID NO: 3771730 - DNA, 17 bp, Homo sapiens
tatgcttattttaaaat

SEQ ID NO: 3771731 - DNA, 17 bp, Homo sapiens
tatggaaataaatgtat

SEQ ID NO: 3771732 - DNA, 14 bp, Homo sapiens
tatggaatacagtg

SEQ ID NO: 3771733 - DNA, 17 bp, Homo sapiens
tatggaatacagtgtta

SEQ ID NO: 3771734 - DNA, 23 bp, Homo sapiens
tatggaatacagtgttattttct

SEQ ID NO: 3771735 - DNA, 22 bp, Homo sapiens
tatggaattacatgtaaaacat

SEQ ID NO: 3771736 - DNA, 15 bp, Homo sapiens
tatggattttctaag

SEQ ID NO: 3771737 - DNA, 14 bp, Homo sapiens
tatggcagcgaaag

SEQ ID NO: 3771738 - DNA, 16 bp, Homo sapiens
tatggcagtgtctttc

SEQ ID NO: 3771739 - DNA, 16 bp, Homo sapiens
tatgggagccccaggg

SEQ ID NO: 3771740 - DNA, 20 bp, Homo sapiens
tatggggctgaacggggaga

SEQ ID NO: 3771741 - DNA, 19 bp, Homo sapiens
tatggggggccaacaccag

SEQ ID NO: 3771742 - DNA, 14 bp, Homo sapiens
tatggtatttgagt

SEQ ID NO: 3771743 - DNA, 20 bp, Homo sapiens
tatggtcatctttttctcta

SEQ ID NO: 3771744 - DNA, 19 bp, Homo sapiens
tatgtaaaataaaattatg

SEQ ID NO: 3771745 - DNA, 14 bp, Homo sapiens
tatgtaaaattttg

SEQ ID NO: 3771746 - DNA, 23 bp, Homo sapiens
tatgtaaactgcattagaaatta

SEQ ID NO: 3771747 - DNA, 18 bp, Homo sapiens
tatgtacaatattttaag

SEQ ID NO: 3771748 - DNA, 20 bp, Homo sapiens
tatgtacaatattttaagca

SEQ ID NO: 3771749 - DNA, 14 bp, Homo sapiens
tatgtacatatata

SEQ ID NO: 3771750 - DNA, 19 bp, Homo sapiens
tatgtatatttaaaagaaa

SEQ ID NO: 3771751 - DNA, 16 bp, Homo sapiens
tatgtatgtaaaaatg

SEQ ID NO: 3771752 - DNA, 17 bp, Homo sapiens
tatgtcaactttatgca

SEQ ID NO: 3771753 - DNA, 22 bp, Homo sapiens
tatgtgaatatggactcagttt

SEQ ID NO: 3771754 - DNA, 22 bp, Homo sapiens
tatgtgaatgatctctctgaat

SEQ ID NO: 3771755 - DNA, 13 bp, Homo sapiens
tatgtgagtgtgt

SEQ ID NO: 3771756 - DNA, 15 bp, Homo sapiens
tatgtgtgaggagct

SEQ ID NO: 3771757 - DNA, 16 bp, Homo sapiens
tatgtgtgaggagctg

SEQ ID NO: 3771758 - DNA, 21 bp, Homo sapiens
tatgtgtgaggagctgctggc

SEQ ID NO: 3771759 - DNA, 12 bp, Homo sapiens
tatgtgtgtata

SEQ ID NO: 3771760 - DNA, 19 bp, Homo sapiens
tatgtgtgtatatgtatgt

SEQ ID NO: 3771761 - DNA, 13 bp, Homo sapiens
tatgtgtgtgtat

SEQ ID NO: 3771762 - DNA, 17 bp, Homo sapiens
tatgtgtttttcacatt

SEQ ID NO: 3771763 - DNA, 14 bp, Homo sapiens
tatgttgataaaag

SEQ ID NO: 3771764 - DNA, 17 bp, Homo sapiens
taattaagtactatgta

SEQ ID NO: 3771765 - DNA, 20 bp, Homo sapiens
taattaagtactatgtatca

SEQ ID NO: 3771766 - DNA, 17 bp, Homo sapiens
taattacatatttgcat

SEQ ID NO: 3771767 - DNA, 12 bp, Homo sapiens
taattagagcag

SEQ ID NO: 3771768 - DNA, 17 bp, Homo sapiens
taattaggttaactatg

SEQ ID NO: 3771769 - DNA, 22 bp, Homo sapiens
taattaggttaactatgtacaa

SEQ ID NO: 3771770 - DNA, 19 bp, Homo sapiens
taattatcgggaacagtgt

SEQ ID NO: 3771771 - DNA, 20 bp, Homo sapiens
taattatcgggaacagtgtt

SEQ ID NO: 3771772 - DNA, 23 bp, Homo sapiens
taattatcgggaacagtgtttcc

SEQ ID NO: 3771773 - DNA, 21 bp, Homo sapiens
taattatgacagttatactgt

SEQ ID NO: 3771774 - DNA, 15 bp, Homo sapiens
taattatgttattga

SEQ ID NO: 3771775 - DNA, 16 bp, Homo sapiens
taattcccattttgca

SEQ ID NO: 3771776 - DNA, 19 bp, Homo sapiens
taattcccattttgcaaaa

SEQ ID NO: 3771777 - DNA, 20 bp, Homo sapiens
taattcccattttgcaaaat

SEQ ID NO: 3771778 - DNA, 11 bp, Homo sapiens
taattctaaat

SEQ ID NO: 3771779 - DNA, 16 bp, Homo sapiens
taattctaaccagagc

SEQ ID NO: 3771780 - DNA, 17 bp, Homo sapiens
taattctaaccagagca

SEQ ID NO: 3771781 - DNA, 21 bp, Homo sapiens
taattctaaggaatatgagct

SEQ ID NO: 3771782 - DNA, 16 bp, Homo sapiens
taattcttgtatatta

SEQ ID NO: 3771783 - DNA, 14 bp, Homo sapiens
taattgaaggaaag

SEQ ID NO: 3771784 - DNA, 22 bp, Homo sapiens
taattgaaggaaagatttgtac

SEQ ID NO: 3771785 - DNA, 12 bp, Homo sapiens
taattgagaagc

SEQ ID NO: 3771786 - DNA, 23 bp, Homo sapiens
taattgccactgagagatctgct

SEQ ID NO: 3771787 - DNA, 12 bp, Homo sapiens
taattgtaaact

SEQ ID NO: 3771788 - DNA, 15 bp, Homo sapiens
taattgtaaactgta

SEQ ID NO: 3771789 - DNA, 16 bp, Homo sapiens
taattgttgctaatct

SEQ ID NO: 3771790 - DNA, 22 bp, Homo sapiens
taattgttttttatcttttcta

SEQ ID NO: 3771791 - DNA, 14 bp, Homo sapiens
taatttaatgcatg

SEQ ID NO: 3771792 - DNA, 14 bp, Homo sapiens
taatttatgagttt

SEQ ID NO: 3771793 - DNA, 18 bp, Homo sapiens
taatttgaggacaaccat

SEQ ID NO: 3771794 - DNA, 22 bp, Homo sapiens
taatttgaggacaaccattcca

SEQ ID NO: 3771795 - DNA, 22 bp, Homo sapiens
taatttgatagtattgtgcata

SEQ ID NO: 3771796 - DNA, 14 bp, Homo sapiens
taatttgatgttta

SEQ ID NO: 3771797 - DNA, 14 bp, Homo sapiens
taatttgtgtaata

SEQ ID NO: 3771798 - DNA, 20 bp, Homo sapiens
taattttatgaactgcatgt

SEQ ID NO: 3771799 - DNA, 12 bp, Homo sapiens
taattttcttga

SEQ ID NO: 3771800 - DNA, 19 bp, Homo sapiens
taattttgtaaaggtgaaa

SEQ ID NO: 3771801 - DNA, 17 bp, Homo sapiens
taatttttcacttcaaa

SEQ ID NO: 3771802 - DNA, 19 bp, Homo sapiens
taattttttagagagctgt

SEQ ID NO: 3771803 - DNA, 18 bp, Homo sapiens
tacaaaagggacatgaaa

SEQ ID NO: 3771804 - DNA, 18 bp, Homo sapiens
tacaaaataaagttacat

SEQ ID NO: 3771805 - DNA, 19 bp, Homo sapiens
tacaaaataaagttacatt

SEQ ID NO: 3771806 - DNA, 12 bp, Homo sapiens
tacaaacatatt

SEQ ID NO: 3771807 - DNA, 14 bp, Homo sapiens
tacaaaggaaaaag

SEQ ID NO: 3771808 - DNA, 17 bp, Homo sapiens
tacaaagtgtattttat

SEQ ID NO: 3771809 - DNA, 19 bp, Homo sapiens
tacaaatactcttaggaag

SEQ ID NO: 3771810 - DNA, 21 bp, Homo sapiens
tacaagcgtgagccactgcac

SEQ ID NO: 3771811 - DNA, 14 bp, Homo sapiens
tacaaggcaacata

SEQ ID NO: 3771812 - DNA, 19 bp, Homo sapiens
tacaagggaagatttatgt

SEQ ID NO: 3771813 - DNA, 16 bp, Homo sapiens
tacaagtttcagacag

SEQ ID NO: 3771814 - DNA, 13 bp, Homo sapiens
tacaataaactat

SEQ ID NO: 3771815 - DNA, 19 bp, Homo sapiens
tacaataaactattggaaa

SEQ ID NO: 3771816 - DNA, 15 bp, Homo sapiens
tacaatattttaagc

SEQ ID NO: 3771817 - DNA, 13 bp, Homo sapiens
tacaatctattta

SEQ ID NO: 3771818 - DNA, 17 bp, Homo sapiens
tacaatctatttattgg

SEQ ID NO: 3771819 - DNA, 21 bp, Homo sapiens
tacaattgtaaaactgaggca

SEQ ID NO: 3771820 - DNA, 16 bp, Homo sapiens
tacacacacaaagaga

SEQ ID NO: 3771821 - DNA, 18 bp, Homo sapiens
tacacaccttatatttac

SEQ ID NO: 3771822 - DNA, 21 bp, Homo sapiens
tacacagactattgacatcag

SEQ ID NO: 3771823 - DNA, 20 bp, Homo sapiens
tacaccagagataatatgag

SEQ ID NO: 3771824 - DNA, 19 bp, Homo sapiens
tacaccattatcttggaaa

SEQ ID NO: 3771825 - DNA, 24 bp, Homo sapiens
tacacctcgttagggaagagaaac

SEQ ID NO: 3771826 - DNA, 16 bp, Homo sapiens
tacactccagcctgag

SEQ ID NO: 3771827 - DNA, 17 bp, Homo sapiens
tacactccagcctgagc

SEQ ID NO: 3771828 - DNA, 21 bp, Homo sapiens
tacactctcaaagcaaataat

SEQ ID NO: 3771829 - DNA, 13 bp, Homo sapiens
tacactctcctgg

SEQ ID NO: 3771830 - DNA, 14 bp, Homo sapiens
tacactctcctggg

SEQ ID NO: 3771831 - DNA, 18 bp, Homo sapiens
tacactctcctgggcccc

SEQ ID NO: 3771832 - DNA, 12 bp, Homo sapiens
tacactcttata

SEQ ID NO: 3771833 - DNA, 13 bp, Homo sapiens
tacactcttatag

SEQ ID NO: 3771834 - DNA, 16 bp, Homo sapiens
tacactctttgtaaga

SEQ ID NO: 3771835 - DNA, 20 bp, Homo sapiens
tacactgaagttaacagaga

SEQ ID NO: 3771836 - DNA, 17 bp, Homo sapiens
tacactgaatatttata

SEQ ID NO: 3771837 - DNA, 18 bp, Homo sapiens
tacactgaatatttatat

SEQ ID NO: 3771838 - DNA, 15 bp, Homo sapiens
tacactgtcaaacat

SEQ ID NO: 3771839 - DNA, 12 bp, Homo sapiens
tacactgtgaac

SEQ ID NO: 3771840 - DNA, 18 bp, Homo sapiens
tacactgttagaacacta

SEQ ID NO: 3771841 - DNA, 21 bp, Homo sapiens
tacactgttagaacactattt

SEQ ID NO: 3771842 - DNA, 13 bp, Homo sapiens
tacactttatgca

SEQ ID NO: 3771843 - DNA, 16 bp, Homo sapiens
tacagacgtatgctta

SEQ ID NO: 3771844 - DNA, 17 bp, Homo sapiens
tacagacgtatgcttat

SEQ ID NO: 3771845 - DNA, 15 bp, Homo sapiens
tacagacttctccag

SEQ ID NO: 3771846 - DNA, 16 bp, Homo sapiens
tacagagaggagaaac

SEQ ID NO: 3771847 - DNA, 20 bp, Homo sapiens
tacagagaggagaaacacat

SEQ ID NO: 3771848 - DNA, 18 bp, Homo sapiens
tacagaggccatgggcct

SEQ ID NO: 3771849 - DNA, 13 bp, Homo sapiens
tacagataggcct

SEQ ID NO: 3771850 - DNA, 16 bp, Homo sapiens
tacagcaaatttataa

SEQ ID NO: 3771851 - DNA, 18 bp, Homo sapiens
tacagctaatcagcattc

SEQ ID NO: 3771852 - DNA, 14 bp, Homo sapiens
tacagcttcaccct

SEQ ID NO: 3771853 - DNA, 18 bp, Homo sapiens
tacagctttcatgattag

SEQ ID NO: 3771854 - DNA, 19 bp, Homo sapiens
tacaggggaatattttatt

SEQ ID NO: 3771855 - DNA, 21 bp, Homo sapiens
tacaggggaatattttattca

SEQ ID NO: 3771856 - DNA, 22 bp, Homo sapiens
tacaggggaatattttattcaa

SEQ ID NO: 3771857 - DNA, 19 bp, Homo sapiens
tacagggtagataacctgt

SEQ ID NO: 3771858 - DNA, 21 bp, Homo sapiens
tacaggtaaggtgagggaata

SEQ ID NO: 3771859 - DNA, 21 bp, Homo sapiens
tacagtagtgagaagaatatt

SEQ ID NO: 3771860 - DNA, 13 bp, Homo sapiens
tacagtattctgt

SEQ ID NO: 3771861 - DNA, 16 bp, Homo sapiens
tacagtgttattttct

SEQ ID NO: 3771862 - DNA, 19 bp, Homo sapiens
tacagtgttattttctttg

SEQ ID NO: 3771863 - DNA, 17 bp, Homo sapiens
tacagttgaaaaacagc

SEQ ID NO: 3771864 - DNA, 13 bp, Homo sapiens
tacataaaggtgg

SEQ ID NO: 3771865 - DNA, 23 bp, Homo sapiens
tacataacagggtaaattattca

SEQ ID NO: 3771866 - DNA, 16 bp, Homo sapiens
tacataagataaatgt

SEQ ID NO: 3771867 - DNA, 19 bp, Homo sapiens
tacataagataaatgtgct

SEQ ID NO: 3771868 - DNA, 16 bp, Homo sapiens
tacatactttttcaag

SEQ ID NO: 3771869 - DNA, 23 bp, Homo sapiens
tacatagtgtaggctttacttag

SEQ ID NO: 3771870 - DNA, 23 bp, Homo sapiens
tacatattaggaaaatatgggtt

SEQ ID NO: 3771871 - DNA, 14 bp, Homo sapiens
tacatattctttaa

SEQ ID NO: 3771872 - DNA, 17 bp, Homo sapiens
tacatatttgagactag

SEQ ID NO: 3771873 - DNA, 13 bp, Homo sapiens
tacatcccagcct

SEQ ID NO: 3771874 - DNA, 21 bp, Homo sapiens
tacatccttgtggcacatttt

SEQ ID NO: 3771875 - DNA, 14 bp, Homo sapiens
tacatcgccctcca

SEQ ID NO: 3771876 - DNA, 14 bp, Homo sapiens
tacatctttcacat

SEQ ID NO: 3771877 - DNA, 15 bp, Homo sapiens
tacatctttcacatt

SEQ ID NO: 3771878 - DNA, 13 bp, Homo sapiens
tacatgaaacaga

SEQ ID NO: 3771879 - DNA, 15 bp, Homo sapiens
tacatgaaacagaaa

SEQ ID NO: 3771880 - DNA, 18 bp, Homo sapiens
tacatgacactgaaatgc

SEQ ID NO: 3771881 - DNA, 19 bp, Homo sapiens
tacatgacactgaaatgcc

SEQ ID NO: 3771882 - DNA, 23 bp, Homo sapiens
tacatgacgacaaagctgctaaa

SEQ ID NO: 3771883 - DNA, 14 bp, Homo sapiens
tacatgcatacact

SEQ ID NO: 3771884 - DNA, 14 bp, Homo sapiens
tacatgcatttgag

SEQ ID NO: 3771885 - DNA, 19 bp, Homo sapiens
tacatggaataacatgtaa

SEQ ID NO: 3771886 - DNA, 13 bp, Homo sapiens
tacatgtgggagc

SEQ ID NO: 3771887 - DNA, 13 bp, Homo sapiens
tacattaaagcag

SEQ ID NO: 3771888 - DNA, 23 bp, Homo sapiens
tacattaattattattgctgttg

SEQ ID NO: 3771889 - DNA, 24 bp, Homo sapiens
tacattatctaactgtgctcaaga

SEQ ID NO: 3771890 - DNA, 22 bp, Homo sapiens
tacattgctggtcttgtaagag

SEQ ID NO: 3771891 - DNA, 19 bp, Homo sapiens
tacattgtttgtctgtctt

SEQ ID NO: 3771892 - DNA, 23 bp, Homo sapiens
tacattgtttgtctgtcttcata

SEQ ID NO: 3771893 - DNA, 16 bp, Homo sapiens
tacatttaattgagaa

SEQ ID NO: 3771894 - DNA, 21 bp, Homo sapiens
tacatttcacctactttgtaa

SEQ ID NO: 3771895 - DNA, 16 bp, Homo sapiens
tacatttgtatgttgt

SEQ ID NO: 3771896 - DNA, 23 bp, Homo sapiens
tacatttgtatgttgtgaagatg

SEQ ID NO: 3771897 - DNA, 16 bp, Homo sapiens
tacattttaacatgga

SEQ ID NO: 3771898 - DNA, 14 bp, Homo sapiens
tacattttatatta

SEQ ID NO: 3771899 - DNA, 18 bp, Homo sapiens
taccaaaatgtccaccaa

SEQ ID NO: 3771900 - DNA, 22 bp, Homo sapiens
taccaatcattttaattattat

SEQ ID NO: 3771901 - DNA, 18 bp, Homo sapiens
taccacaatgcagtgcct

SEQ ID NO: 3771902 - DNA, 13 bp, Homo sapiens
taccacagtgtct

SEQ ID NO: 3771903 - DNA, 10 bp, Homo sapiens
taccacctcc

SEQ ID NO: 3771904 - DNA, 14 bp, Homo sapiens
taccaggtgttcta

SEQ ID NO: 3771905 - DNA, 17 bp, Homo sapiens
taccatcccctgtagag

SEQ ID NO: 3771906 - DNA, 12 bp, Homo sapiens
taccatttcaga

SEQ ID NO: 3771907 - DNA, 13 bp, Homo sapiens
taccatttgtaat

SEQ ID NO: 3771908 - DNA, 18 bp, Homo sapiens
taccatttgtaataaagt

SEQ ID NO: 3771909 - DNA, 20 bp, Homo sapiens
taccatttgtaataaagtat

SEQ ID NO: 3771910 - DNA, 14 bp, Homo sapiens
tacccacctgagct

SEQ ID NO: 3771911 - DNA, 23 bp, Homo sapiens
tacccacctgagctttggacgca

SEQ ID NO: 3771912 - DNA, 12 bp, Homo sapiens
tacccactgctc

SEQ ID NO: 3771913 - DNA, 13 bp, Homo sapiens
tacccactgctct

SEQ ID NO: 3771914 - DNA, 22 bp, Homo sapiens
tacccagaatgtcagattcctt

SEQ ID NO: 3771915 - DNA, 13 bp, Homo sapiens
tacccagcccatc

SEQ ID NO: 3771916 - DNA, 14 bp, Homo sapiens
tacccagcccatct

SEQ ID NO: 3771917 - DNA, 16 bp, Homo sapiens
tacccagcccatcttg

SEQ ID NO: 3771918 - DNA, 18 bp, Homo sapiens
taccccagctctgcttgc

SEQ ID NO: 3771919 - DNA, 19 bp, Homo sapiens
taccccttagcctccctga

SEQ ID NO: 3771920 - DNA, 13 bp, Homo sapiens
taccctcccaccc

SEQ ID NO: 3771921 - DNA, 14 bp, Homo sapiens
tacccttaagctag

SEQ ID NO: 3771922 - DNA, 19 bp, Homo sapiens
tacccttctgtgcccagct

SEQ ID NO: 3771923 - DNA, 21 bp, Homo sapiens
tacccttctttccatttctct

SEQ ID NO: 3771924 - DNA, 20 bp, Homo sapiens
tacccttggctcaatcctct

SEQ ID NO: 3771925 - DNA, 17 bp, Homo sapiens
taccgagtctcttctcc

SEQ ID NO: 3771926 - DNA, 22 bp, Homo sapiens
taccgagtctcttctccactgg

SEQ ID NO: 3771927 - DNA, 23 bp, Homo sapiens
tacctaaaaggaaatctcacccc

SEQ ID NO: 3771928 - DNA, 15 bp, Homo sapiens
tacctaattagagca

SEQ ID NO: 3771929 - DNA, 20 bp, Homo sapiens
tacctaattagagcagatga

SEQ ID NO: 3771930 - DNA, 16 bp, Homo sapiens
tacctagatttacagc

SEQ ID NO: 3771931 - DNA, 16 bp, Homo sapiens
tacctataatcctcat

SEQ ID NO: 3771932 - DNA, 11 bp, Homo sapiens
tacctcagcct

SEQ ID NO: 3771933 - DNA, 14 bp, Homo sapiens
tacctcagcctaga

SEQ ID NO: 3771934 - DNA, 14 bp, Homo sapiens
tacctcaggcagga

SEQ ID NO: 3771935 - DNA, 15 bp, Homo sapiens
tacctcaggcaggaa

SEQ ID NO: 3771936 - DNA, 15 bp, Homo sapiens
tacctccaagcaagt

SEQ ID NO: 3771937 - DNA, 11 bp, Homo sapiens
tacctcctgcc

SEQ ID NO: 3771938 - DNA, 13 bp, Homo sapiens
tacctcctgccca

SEQ ID NO: 3771939 - DNA, 15 bp, Homo sapiens
tacctcctgcccagg

SEQ ID NO: 3771940 - DNA, 18 bp, Homo sapiens
tacctcggtgccttcctc

SEQ ID NO: 3771941 - DNA, 21 bp, Homo sapiens
tacctctcttatagaatattt

SEQ ID NO: 3771942 - DNA, 21 bp, Homo sapiens
tacctgaacacttattgcttt

SEQ ID NO: 3771943 - DNA, 14 bp, Homo sapiens
taccttcaaagctg

SEQ ID NO: 3771944 - DNA, 13 bp, Homo sapiens
taccttcaataaa

SEQ ID NO: 3771945 - DNA, 16 bp, Homo sapiens
taccttcaataaagta

SEQ ID NO: 3771946 - DNA, 16 bp, Homo sapiens
tacctttatggtttct

SEQ ID NO: 3771947 - DNA, 14 bp, Homo sapiens
taccttttctcttc

SEQ ID NO: 3771948 - DNA, 24 bp, Homo sapiens
tacgctccatcgctgtcatctcag

SEQ ID NO: 3771949 - DNA, 13 bp, Homo sapiens
tacgctctccttt

SEQ ID NO: 3771950 - DNA, 21 bp, Homo sapiens
tacgctctcctttctttctaa

SEQ ID NO: 3771951 - DNA, 15 bp, Homo sapiens
tactaagaaaagata

SEQ ID NO: 3771952 - DNA, 14 bp, Homo sapiens
tactaaggaatctt

SEQ ID NO: 3771953 - DNA, 19 bp, Homo sapiens
tactaataatcttgtttct

SEQ ID NO: 3771954 - DNA, 14 bp, Homo sapiens
tactaatgatgttt

SEQ ID NO: 3771955 - DNA, 15 bp, Homo sapiens
tactaattaacatat

SEQ ID NO: 3771956 - DNA, 16 bp, Homo sapiens
tactacaaaaaagttg

SEQ ID NO: 3771957 - DNA, 13 bp, Homo sapiens
tactacaaaattt

SEQ ID NO: 3771958 - DNA, 18 bp, Homo sapiens
tactacaaaatttgaaat

SEQ ID NO: 3771959 - DNA, 14 bp, Homo sapiens
tactaccacaagga

SEQ ID NO: 3771960 - DNA, 18 bp, Homo sapiens
tactactagatgtcttta

SEQ ID NO: 3771961 - DNA, 13 bp, Homo sapiens
tactactcctgta

SEQ ID NO: 3771962 - DNA, 15 bp, Homo sapiens
tactagggacctggg

SEQ ID NO: 3771963 - DNA, 19 bp, Homo sapiens
tactagtctgtgtgggact

SEQ ID NO: 3771964 - DNA, 20 bp, Homo sapiens
tactatatctgttttactgc

SEQ ID NO: 3771965 - DNA, 12 bp, Homo sapiens
tactatgtatca

SEQ ID NO: 3771966 - DNA, 16 bp, Homo sapiens
tactatgtatcaatga

SEQ ID NO: 3771967 - DNA, 18 bp, Homo sapiens
tactattttacttctaga

SEQ ID NO: 3771968 - DNA, 15 bp, Homo sapiens
tactcaagaggctga

SEQ ID NO: 3771969 - DNA, 15 bp, Homo sapiens
tactcacagtctctt

SEQ ID NO: 3771970 - DNA, 14 bp, Homo sapiens
tactcacctcaccc

SEQ ID NO: 3771971 - DNA, 16 bp, Homo sapiens
tactcagaagcctgag

SEQ ID NO: 3771972 - DNA, 14 bp, Homo sapiens
tactcagcagccct

SEQ ID NO: 3771973 - DNA, 16 bp, Homo sapiens
tactcagcagccctcc

SEQ ID NO: 3771974 - DNA, 18 bp, Homo sapiens
tactcagcagccctcctc

SEQ ID NO: 3771975 - DNA, 13 bp, Homo sapiens
tactcagccctgg

SEQ ID NO: 3771976 - DNA, 21 bp, Homo sapiens
tactcatatatatctatctta

SEQ ID NO: 3771977 - DNA, 23 bp, Homo sapiens
tactcatatatatctatcttata

SEQ ID NO: 3771978 - DNA, 16 bp, Homo sapiens
tactccccttgagctg

SEQ ID NO: 3771979 - DNA, 14 bp, Homo sapiens
tactcctacctcag

SEQ ID NO: 3771980 - DNA, 15 bp, Homo sapiens
tactcctacctcagc

SEQ ID NO: 3771981 - DNA, 17 bp, Homo sapiens
tactcctacctcagcct

SEQ ID NO: 3771982 - DNA, 12 bp, Homo sapiens
tactcctcccag

SEQ ID NO: 3771983 - DNA, 22 bp, Homo sapiens
tactcctgcaaaattttatagc

SEQ ID NO: 3771984 - DNA, 21 bp, Homo sapiens
tactccttaagaacacaaagc

SEQ ID NO: 3771985 - DNA, 22 bp, Homo sapiens
tactccttaagaacacaaagcg

SEQ ID NO: 3771986 - DNA, 13 bp, Homo sapiens
tactctaattcta

SEQ ID NO: 3771987 - DNA, 14 bp, Homo sapiens
tactctaattctaa

SEQ ID NO: 3771988 - DNA, 15 bp, Homo sapiens
tactctaattctaac

SEQ ID NO: 3771989 - DNA, 16 bp, Homo sapiens
tactctaattctaacc

SEQ ID NO: 3771990 - DNA, 16 bp, Homo sapiens
tactctaccctcttag

SEQ ID NO: 3771991 - DNA, 21 bp, Homo sapiens
tactctgaaattgtaactaaa

SEQ ID NO: 3771992 - DNA, 22 bp, Homo sapiens
tactctgaagggcatcatgcat

SEQ ID NO: 3771993 - DNA, 19 bp, Homo sapiens
tactctgttccttcacatc

SEQ ID NO: 3771994 - DNA, 21 bp, Homo sapiens
tactcttaggaagagaaacca

SEQ ID NO: 3771995 - DNA, 19 bp, Homo sapiens
tactcttgtaagattttga

SEQ ID NO: 3771996 - DNA, 20 bp, Homo sapiens
tactcttgtaagattttgaa

SEQ ID NO: 3771997 - DNA, 15 bp, Homo sapiens
tactgagccttgtaa

SEQ ID NO: 3771998 - DNA, 18 bp, Homo sapiens
tactgagccttgtaattc

SEQ ID NO: 3771999 - DNA, 17 bp, Homo sapiens
tactgagcttctctgtg

SEQ ID NO: 3772000 - DNA, 16 bp, Homo sapiens
tactgatcatgcattg

SEQ ID NO: 3772001 - DNA, 20 bp, Homo sapiens
tactgcagcctttgcctccc

SEQ ID NO: 3772002 - DNA, 22 bp, Homo sapiens
tactgcagcctttgcctccccg

SEQ ID NO: 3772003 - DNA, 11 bp, Homo sapiens
tactgccaaag

SEQ ID NO: 3772004 - DNA, 20 bp, Homo sapiens
tactgcccaggcctgcctgt

SEQ ID NO: 3772005 - DNA, 21 bp, Homo sapiens
tactgcccaggcctgcctgtt

SEQ ID NO: 3772006 - DNA, 19 bp, Homo sapiens
tactgcccggggcagctgc

SEQ ID NO: 3772007 - DNA, 21 bp, Homo sapiens
tactgcctctacagttaatag

SEQ ID NO: 3772008 - DNA, 23 bp, Homo sapiens
tactgcttctaccaactggaagc

SEQ ID NO: 3772009 - DNA, 15 bp, Homo sapiens
tactgcttttaactt

SEQ ID NO: 3772010 - DNA, 17 bp, Homo sapiens
tactggaagttttgcat

SEQ ID NO: 3772011 - DNA, 14 bp, Homo sapiens
tactggagaagtct

SEQ ID NO: 3772012 - DNA, 23 bp, Homo sapiens
tactgggaaagggattttcagcc

SEQ ID NO: 3772013 - DNA, 14 bp, Homo sapiens
tactgtaaagaatt

SEQ ID NO: 3772014 - DNA, 15 bp, Homo sapiens
tactgtagtttttct

SEQ ID NO: 3772015 - DNA, 11 bp, Homo sapiens
tactgtcaata

SEQ ID NO: 3772016 - DNA, 13 bp, Homo sapiens
tactgtcaataaa

SEQ ID NO: 3772017 - DNA, 14 bp, Homo sapiens
tactgtcaataaac

SEQ ID NO: 3772018 - DNA, 14 bp, Homo sapiens
tacttaataaattc

SEQ ID NO: 3772019 - DNA, 18 bp, Homo sapiens
tacttagcaaagttttac

SEQ ID NO: 3772020 - DNA, 15 bp, Homo sapiens
tacttagcagctatc

SEQ ID NO: 3772021 - DNA, 22 bp, Homo sapiens
tacttagcttatcaatttgtca

SEQ ID NO: 3772022 - DNA, 12 bp, Homo sapiens
tacttattcatt

SEQ ID NO: 3772023 - DNA, 14 bp, Homo sapiens
tacttattcattgt

SEQ ID NO: 3772024 - DNA, 13 bp, Homo sapiens
tacttattccaga

SEQ ID NO: 3772025 - DNA, 20 bp, Homo sapiens
tacttatttttgacagtgtt

SEQ ID NO: 3772026 - DNA, 21 bp, Homo sapiens
tacttcaagttaaagtgaata

SEQ ID NO: 3772027 - DNA, 12 bp, Homo sapiens
tacttcctgcct

SEQ ID NO: 3772028 - DNA, 16 bp, Homo sapiens
tacttcttatacattt

SEQ ID NO: 3772029 - DNA, 15 bp, Homo sapiens
tacttgctgctattt

SEQ ID NO: 3772030 - DNA, 15 bp, Homo sapiens
tacttgtggacacag

SEQ ID NO: 3772031 - DNA, 22 bp, Homo sapiens
tacttgttcaaaatatgttctt

SEQ ID NO: 3772032 - DNA, 15 bp, Homo sapiens
tacttgtttcagagt

SEQ ID NO: 3772033 - DNA, 17 bp, Homo sapiens
tactttacatatgcttt

SEQ ID NO: 3772034 - DNA, 23 bp, Homo sapiens
tactttgatattttcaacgcagc

SEQ ID NO: 3772035 - DNA, 16 bp, Homo sapiens
tactttgtatgatatt

SEQ ID NO: 3772036 - DNA, 20 bp, Homo sapiens
tacttttggaatctagaaga

SEQ ID NO: 3772037 - DNA, 15 bp, Homo sapiens
tagaaaacaggaaaa

SEQ ID NO: 3772038 - DNA, 16 bp, Homo sapiens
tagaaaagaactggaa

SEQ ID NO: 3772039 - DNA, 19 bp, Homo sapiens
tagaaactcaccatgtaaa

SEQ ID NO: 3772040 - DNA, 14 bp, Homo sapiens
tagaaagaagccca

SEQ ID NO: 3772041 - DNA, 17 bp, Homo sapiens
tagaaagacagagctgg

SEQ ID NO: 3772042 - DNA, 16 bp, Homo sapiens
tagaaataaatagcta

SEQ ID NO: 3772043 - DNA, 20 bp, Homo sapiens
tagaaatatctgaaaatgta

SEQ ID NO: 3772044 - DNA, 14 bp, Homo sapiens
tagaaattttacaa

SEQ ID NO: 3772045 - DNA, 22 bp, Homo sapiens
tagaaattttacaataggtgct

SEQ ID NO: 3772046 - DNA, 13 bp, Homo sapiens
tagaacactattt

SEQ ID NO: 3772047 - DNA, 17 bp, Homo sapiens
tagaacactattttcag

SEQ ID NO: 3772048 - DNA, 19 bp, Homo sapiens
tagaacactattttcagaa

SEQ ID NO: 3772049 - DNA, 20 bp, Homo sapiens
tagaacactattttcagaat

SEQ ID NO: 3772050 - DNA, 21 bp, Homo sapiens
tagaacactattttcagaatc

SEQ ID NO: 3772051 - DNA, 23 bp, Homo sapiens
tagaacagaaaacaacaaaaaat

SEQ ID NO: 3772052 - DNA, 14 bp, Homo sapiens
tagaacatccctgc

SEQ ID NO: 3772053 - DNA, 16 bp, Homo sapiens
tagaacttgaccccct

SEQ ID NO: 3772054 - DNA, 15 bp, Homo sapiens
tagaagaaaaaagaa

SEQ ID NO: 3772055 - DNA, 19 bp, Homo sapiens
tagaagaaatgaaatttta

SEQ ID NO: 3772056 - DNA, 20 bp, Homo sapiens
tagaagaaatgaaattttac

SEQ ID NO: 3772057 - DNA, 18 bp, Homo sapiens
tagaagaacatccaagga

SEQ ID NO: 3772058 - DNA, 14 bp, Homo sapiens
tagaagatgtttgc

SEQ ID NO: 3772059 - DNA, 11 bp, Homo sapiens
tagaaggaaac

SEQ ID NO: 3772060 - DNA, 22 bp, Homo sapiens
tagaagggccagtcctgcctgg

SEQ ID NO: 3772061 - DNA, 16 bp, Homo sapiens
tagaagtcttagatgt

SEQ ID NO: 3772062 - DNA, 19 bp, Homo sapiens
tagaagtgggccaggacag

SEQ ID NO: 3772063 - DNA, 20 bp, Homo sapiens
tagaagtgggccaggacagg

SEQ ID NO: 3772064 - DNA, 22 bp, Homo sapiens
tagaataatgtgggaagaaaca

SEQ ID NO: 3772065 - DNA, 20 bp, Homo sapiens
tagaatatttattacctctg

SEQ ID NO: 3772066 - DNA, 20 bp, Homo sapiens
tagaatttattcaattcctc

SEQ ID NO: 3772067 - DNA, 19 bp, Homo sapiens
tagacatttgtaaatgtaa

SEQ ID NO: 3772068 - DNA, 13 bp, Homo sapiens
tagaccaaaataa

SEQ ID NO: 3772069 - DNA, 18 bp, Homo sapiens
tagaccaagcttgtccaa

SEQ ID NO: 3772070 - DNA, 14 bp, Homo sapiens
tagacccctggctg

SEQ ID NO: 3772071 - DNA, 15 bp, Homo sapiens
tagacccctggctgg

SEQ ID NO: 3772072 - DNA, 19 bp, Homo sapiens
tagacctagggaggacctt

SEQ ID NO: 3772073 - DNA, 22 bp, Homo sapiens
tagacctagggaggaccttatc

SEQ ID NO: 3772074 - DNA, 12 bp, Homo sapiens
tagacctcagcc

SEQ ID NO: 3772075 - DNA, 14 bp, Homo sapiens
tagacctcagcctg

SEQ ID NO: 3772076 - DNA, 14 bp, Homo sapiens
tagactagagaaac

SEQ ID NO: 3772077 - DNA, 17 bp, Homo sapiens
tagactttatgcaataa

SEQ ID NO: 3772078 - DNA, 21 bp, Homo sapiens
tagagaaaccgtcctcttttt

SEQ ID NO: 3772079 - DNA, 13 bp, Homo sapiens
tagagaaggaccc

SEQ ID NO: 3772080 - DNA, 22 bp, Homo sapiens
tagagaaggacccggaggggcc

SEQ ID NO: 3772081 - DNA, 15 bp, Homo sapiens
tagagatgcctccct

SEQ ID NO: 3772082 - DNA, 17 bp, Homo sapiens
tagagcacactgtagca

SEQ ID NO: 3772083 - DNA, 14 bp, Homo sapiens
tagagccagggtct

SEQ ID NO: 3772084 - DNA, 17 bp, Homo sapiens
tagaggaaaaaaatgac

SEQ ID NO: 3772085 - DNA, 20 bp, Homo sapiens
tagaggccagccccacccag

SEQ ID NO: 3772086 - DNA, 16 bp, Homo sapiens
tagaggccagcctggc

SEQ ID NO: 3772087 - DNA, 23 bp, Homo sapiens
tagagggaggagaatgagcctcg

SEQ ID NO: 3772088 - DNA, 17 bp, Homo sapiens
tagagggtgctgcccca

SEQ ID NO: 3772089 - DNA, 14 bp, Homo sapiens
tagaggttttatga

SEQ ID NO: 3772090 - DNA, 21 bp, Homo sapiens
tagagtcatctccatcagctg

SEQ ID NO: 3772091 - DNA, 22 bp, Homo sapiens
tagagtccaacgtggggcagca

SEQ ID NO: 3772092 - DNA, 14 bp, Homo sapiens
tagataactctttg

SEQ ID NO: 3772093 - DNA, 16 bp, Homo sapiens
tagataactctttgga

SEQ ID NO: 3772094 - DNA, 19 bp, Homo sapiens
tagatatatgctctgcatg

SEQ ID NO: 3772095 - DNA, 17 bp, Homo sapiens
tagatcacataacagaa

SEQ ID NO: 3772096 - DNA, 16 bp, Homo sapiens
tagatcacgagatcaa

SEQ ID NO: 3772097 - DNA, 13 bp, Homo sapiens
tagatcagaacag

SEQ ID NO: 3772098 - DNA, 18 bp, Homo sapiens
tagatccacacacagagg

SEQ ID NO: 3772099 - DNA, 18 bp, Homo sapiens
tagatggttacactgtta

SEQ ID NO: 3772100 - DNA, 21 bp, Homo sapiens
tagatggttacactgttagaa

SEQ ID NO: 3772101 - DNA, 19 bp, Homo sapiens
tagatggtttgagcctgag

SEQ ID NO: 3772102 - DNA, 23 bp, Homo sapiens
tagatgtagataaactcagaaat

SEQ ID NO: 3772103 - DNA, 21 bp, Homo sapiens
tagatgtctttaggcagcagc

SEQ ID NO: 3772104 - DNA, 22 bp, Homo sapiens
tagatgtgcatttttgtgaaat

SEQ ID NO: 3772105 - DNA, 22 bp, Homo sapiens
tagattatattgagacaaaaat

SEQ ID NO: 3772106 - DNA, 12 bp, Homo sapiens
tagattcacctg

SEQ ID NO: 3772107 - DNA, 13 bp, Homo sapiens
tagattcacctgt

SEQ ID NO: 3772108 - DNA, 16 bp, Homo sapiens
tagattgttaaaataa

SEQ ID NO: 3772109 - DNA, 17 bp, Homo sapiens
tagcaaaagaagtaaca

SEQ ID NO: 3772110 - DNA, 20 bp, Homo sapiens
tcactatttttatttatatt

SEQ ID NO: 3772111 - DNA, 16 bp, Homo sapiens
tcactccaccacccaa

SEQ ID NO: 3772112 - DNA, 23 bp, Homo sapiens
tcactccaggaaggggctggact

SEQ ID NO: 3772113 - DNA, 16 bp, Homo sapiens
tcactcccctcctttc

SEQ ID NO: 3772114 - DNA, 17 bp, Homo sapiens
tcactcccctcctttcc

SEQ ID NO: 3772115 - DNA, 18 bp, Homo sapiens
tcactcccttctccttga

SEQ ID NO: 3772116 - DNA, 17 bp, Homo sapiens
tcactccggtgtgcctg

SEQ ID NO: 3772117 - DNA, 20 bp, Homo sapiens
tcactccggtgtgcctgcag

SEQ ID NO: 3772118 - DNA, 11 bp, Homo sapiens
tcactcctggg

SEQ ID NO: 3772119 - DNA, 12 bp, Homo sapiens
tcactcctgggg

SEQ ID NO: 3772120 - DNA, 15 bp, Homo sapiens
tcactcgcccccggg

SEQ ID NO: 3772121 - DNA, 22 bp, Homo sapiens
tcactctgtcgcccagtctgga

SEQ ID NO: 3772122 - DNA, 17 bp, Homo sapiens
tcactcttattgcccac

SEQ ID NO: 3772123 - DNA, 15 bp, Homo sapiens
tcactgcacagtgca

SEQ ID NO: 3772124 - DNA, 14 bp, Homo sapiens
tcactgcagcctca

SEQ ID NO: 3772125 - DNA, 15 bp, Homo sapiens
tcactgcagcctcaa

SEQ ID NO: 3772126 - DNA, 18 bp, Homo sapiens
tcactgccatgccagctt

SEQ ID NO: 3772127 - DNA, 12 bp, Homo sapiens
tcactgcctctc

SEQ ID NO: 3772128 - DNA, 19 bp, Homo sapiens
tcactgcctctccctggcc

SEQ ID NO: 3772129 - DNA, 13 bp, Homo sapiens
tcactgctggctg

SEQ ID NO: 3772130 - DNA, 17 bp, Homo sapiens
tcactgctggctgcctt

SEQ ID NO: 3772131 - DNA, 18 bp, Homo sapiens
tcactggagcaccaggca

SEQ ID NO: 3772132 - DNA, 22 bp, Homo sapiens
tcactggagcaccaggcacgaa

SEQ ID NO: 3772133 - DNA, 13 bp, Homo sapiens
tcactggagccca

SEQ ID NO: 3772134 - DNA, 16 bp, Homo sapiens
tcactggcaatgaaaa

SEQ ID NO: 3772135 - DNA, 15 bp, Homo sapiens
tcactggcagcccca

SEQ ID NO: 3772136 - DNA, 15 bp, Homo sapiens
tcactggcatctttg

SEQ ID NO: 3772137 - DNA, 21 bp, Homo sapiens
tcactggggtcctggggcctc

SEQ ID NO: 3772138 - DNA, 18 bp, Homo sapiens
tcactggtagaccaaaat

SEQ ID NO: 3772139 - DNA, 20 bp, Homo sapiens
tcactgtagaatgatttcat

SEQ ID NO: 3772140 - DNA, 16 bp, Homo sapiens
tcactgttgcccaggc

SEQ ID NO: 3772141 - DNA, 17 bp, Homo sapiens
tcacttacctagattta

SEQ ID NO: 3772142 - DNA, 17 bp, Homo sapiens
tcacttcctacaagagc

SEQ ID NO: 3772143 - DNA, 18 bp, Homo sapiens
tcacttctgaccacactt

SEQ ID NO: 3772144 - DNA, 19 bp, Homo sapiens
tcactttcacatagatgtc

SEQ ID NO: 3772145 - DNA, 12 bp, Homo sapiens
tcactttgctct

SEQ ID NO: 3772146 - DNA, 18 bp, Homo sapiens
tcagaaacatcagttact

SEQ ID NO: 3772147 - DNA, 15 bp, Homo sapiens
tcagaaacttgtgaa

SEQ ID NO: 3772148 - DNA, 16 bp, Homo sapiens
tcagaaacttgtgaag

SEQ ID NO: 3772149 - DNA, 16 bp, Homo sapiens
tcagaaagtaatttct

SEQ ID NO: 3772150 - DNA, 14 bp, Homo sapiens
tcagaaatttaatt

SEQ ID NO: 3772151 - DNA, 15 bp, Homo sapiens
tcagaacctcttccc

SEQ ID NO: 3772152 - DNA, 18 bp, Homo sapiens
tcagaacctcttccccag

SEQ ID NO: 3772153 - DNA, 19 bp, Homo sapiens
tcagaagtttctcagctcc

SEQ ID NO: 3772154 - DNA, 20 bp, Homo sapiens
tcagaattctcagaatctca

SEQ ID NO: 3772155 - DNA, 13 bp, Homo sapiens
tcagacacaaaca

SEQ ID NO: 3772156 - DNA, 14 bp, Homo sapiens
tcagacactttgga

SEQ ID NO: 3772157 - DNA, 14 bp, Homo sapiens
tcagacccccactc

SEQ ID NO: 3772158 - DNA, 13 bp, Homo sapiens
tcagaccctaccc

SEQ ID NO: 3772159 - DNA, 16 bp, Homo sapiens
tcagaccctaccccac

SEQ ID NO: 3772160 - DNA, 18 bp, Homo sapiens
tcagaccctaccccacca

SEQ ID NO: 3772161 - DNA, 14 bp, Homo sapiens
tcagactgaacatg

SEQ ID NO: 3772162 - DNA, 13 bp, Homo sapiens
tcagactgctggg

SEQ ID NO: 3772163 - DNA, 14 bp, Homo sapiens
tcagactgctggga

SEQ ID NO: 3772164 - DNA, 21 bp, Homo sapiens
tcagactgctgggactggcca

SEQ ID NO: 3772165 - DNA, 23 bp, Homo sapiens
tcagactgctgggactggccagg

SEQ ID NO: 3772166 - DNA, 13 bp, Homo sapiens
tcagactggctgg

SEQ ID NO: 3772167 - DNA, 21 bp, Homo sapiens
tcagactggctggctgcagtg

SEQ ID NO: 3772168 - DNA, 23 bp, Homo sapiens
tcagagaatttctaccatttcag

SEQ ID NO: 3772169 - DNA, 20 bp, Homo sapiens
tcagagacaggaagtcttca

SEQ ID NO: 3772170 - DNA, 19 bp, Homo sapiens
tcagagactcagggcccca

SEQ ID NO: 3772171 - DNA, 14 bp, Homo sapiens
tcagagagctggta

SEQ ID NO: 3772172 - DNA, 17 bp, Homo sapiens
tcagagaggagtcagag

SEQ ID NO: 3772173 - DNA, 20 bp, Homo sapiens
tcagagaggagtcagagaga

SEQ ID NO: 3772174 - DNA, 21 bp, Homo sapiens
tcagagaggccttttggaatg

SEQ ID NO: 3772175 - DNA, 19 bp, Homo sapiens
tcagagcaggtgctggctc

SEQ ID NO: 3772176 - DNA, 13 bp, Homo sapiens
tcagagcctgcag

SEQ ID NO: 3772177 - DNA, 18 bp, Homo sapiens
tcagagcctgcagttatt

SEQ ID NO: 3772178 - DNA, 14 bp, Homo sapiens
tcagagggaggaat

SEQ ID NO: 3772179 - DNA, 18 bp, Homo sapiens
tcagaggtagggctgcca

SEQ ID NO: 3772180 - DNA, 13 bp, Homo sapiens
tcagagtccaggc

SEQ ID NO: 3772181 - DNA, 16 bp, Homo sapiens
tcagagtccaggcccc

SEQ ID NO: 3772182 - DNA, 18 bp, Homo sapiens
tcagatatatttttcaca

SEQ ID NO: 3772183 - DNA, 14 bp, Homo sapiens
tcagatcctacccc

SEQ ID NO: 3772184 - DNA, 15 bp, Homo sapiens
tcagatgactagaaa

SEQ ID NO: 3772185 - DNA, 18 bp, Homo sapiens
tcagatgcacatgagctg

SEQ ID NO: 3772186 - DNA, 22 bp, Homo sapiens
tcagatgcccagagggcccagg

SEQ ID NO: 3772187 - DNA, 18 bp, Homo sapiens
tcagatgcttctgggaga

SEQ ID NO: 3772188 - DNA, 21 bp, Homo sapiens
tcagatggaaccgcaggaagc

SEQ ID NO: 3772189 - DNA, 22 bp, Homo sapiens
tcagatggaaccgcaggaagct

SEQ ID NO: 3772190 - DNA, 15 bp, Homo sapiens
tcagcaaaagatgct

SEQ ID NO: 3772191 - DNA, 13 bp, Homo sapiens
tcagcaatattta

SEQ ID NO: 3772192 - DNA, 19 bp, Homo sapiens
tcagcaatatttaaggaga

SEQ ID NO: 3772193 - DNA, 15 bp, Homo sapiens
tcagcaccaccctag

SEQ ID NO: 3772194 - DNA, 23 bp, Homo sapiens
tcagcacccccttctctgcccat

SEQ ID NO: 3772195 - DNA, 17 bp, Homo sapiens
tcagcagccctcctcac

SEQ ID NO: 3772196 - DNA, 16 bp, Homo sapiens
tcagcatcctggcacc

SEQ ID NO: 3772197 - DNA, 18 bp, Homo sapiens
tcagcatcctggcacccg

SEQ ID NO: 3772198 - DNA, 23 bp, Homo sapiens
tcagccaaatgtaattgaataaa

SEQ ID NO: 3772199 - DNA, 18 bp, Homo sapiens
tcagcccacccccctcat

SEQ ID NO: 3772200 - DNA, 18 bp, Homo sapiens
tcagcccctcctctgcca

SEQ ID NO: 3772201 - DNA, 21 bp, Homo sapiens
tcagcccctcctctgccacct

SEQ ID NO: 3772202 - DNA, 12 bp, Homo sapiens
tcagcccctctt

SEQ ID NO: 3772203 - DNA, 14 bp, Homo sapiens
tcagccctccctgc

SEQ ID NO: 3772204 - DNA, 17 bp, Homo sapiens
tcagccctccctgcccc

SEQ ID NO: 3772205 - DNA, 12 bp, Homo sapiens
tcagccctgggc

SEQ ID NO: 3772206 - DNA, 18 bp, Homo sapiens
tcagccctgggccccacc

SEQ ID NO: 3772207 - DNA, 22 bp, Homo sapiens
tcagccctgggccccaccacct

SEQ ID NO: 3772208 - DNA, 19 bp, Homo sapiens
tcagcctacaggcctcaca

SEQ ID NO: 3772209 - DNA, 19 bp, Homo sapiens
tcagcctagccgacctcag

SEQ ID NO: 3772210 - DNA, 22 bp, Homo sapiens
tcagcctagccgacctcagcct

SEQ ID NO: 3772211 - DNA, 14 bp, Homo sapiens
tcagcctcccaaag

SEQ ID NO: 3772212 - DNA, 21 bp, Homo sapiens
tcagcctcccaaagtgctggg

SEQ ID NO: 3772213 - DNA, 22 bp, Homo sapiens
tcagcctcccaaagtgctggga

SEQ ID NO: 3772214 - DNA, 20 bp, Homo sapiens
tcagcctcccaagtagctgg

SEQ ID NO: 3772215 - DNA, 20 bp, Homo sapiens
tcagcctcccgaatagctgg

SEQ ID NO: 3772216 - DNA, 20 bp, Homo sapiens
tcagcctccggagtagctgg

SEQ ID NO: 3772217 - DNA, 14 bp, Homo sapiens
tcagcctcctgtgt

SEQ ID NO: 3772218 - DNA, 12 bp, Homo sapiens
tcagcctcttaa

SEQ ID NO: 3772219 - DNA, 16 bp, Homo sapiens
tcagcctgctccagct

SEQ ID NO: 3772220 - DNA, 10 bp, Homo sapiens
tcagcctggg

SEQ ID NO: 3772221 - DNA, 24 bp, Homo sapiens
tcagccttccccctcccagggcca

SEQ ID NO: 3772222 - DNA, 14 bp, Homo sapiens
tcagcggggacagc

SEQ ID NO: 3772223 - DNA, 20 bp, Homo sapiens
tcagcggggacagctccttc

SEQ ID NO: 3772224 - DNA, 21 bp, Homo sapiens
tcagcggggacagctccttct

SEQ ID NO: 3772225 - DNA, 16 bp, Homo sapiens
tatgttgcccaggcag

SEQ ID NO: 3772226 - DNA, 19 bp, Homo sapiens
tatgttgcccaggcaggtc

SEQ ID NO: 3772227 - DNA, 20 bp, Homo sapiens
tatgttgtgaagatgtttgc

SEQ ID NO: 3772228 - DNA, 14 bp, Homo sapiens
tatgtttgcacact

SEQ ID NO: 3772229 - DNA, 19 bp, Homo sapiens
tatgttttaagaggcaggg

SEQ ID NO: 3772230 - DNA, 18 bp, Homo sapiens
tatgtttttgtgtatttg

SEQ ID NO: 3772231 - DNA, 14 bp, Homo sapiens
tattaaaaatggta

SEQ ID NO: 3772232 - DNA, 13 bp, Homo sapiens
tattaaagggggg

SEQ ID NO: 3772233 - DNA, 22 bp, Homo sapiens
tattaaattttttaaaaagcaa

SEQ ID NO: 3772234 - DNA, 16 bp, Homo sapiens
tattaagaaagactat

SEQ ID NO: 3772235 - DNA, 16 bp, Homo sapiens
tattaagatggattct

SEQ ID NO: 3772236 - DNA, 19 bp, Homo sapiens
tattaagatggattctcag

SEQ ID NO: 3772237 - DNA, 20 bp, Homo sapiens
tattaagatggattctcaga

SEQ ID NO: 3772238 - DNA, 14 bp, Homo sapiens
tattaatgctaagg

SEQ ID NO: 3772239 - DNA, 21 bp, Homo sapiens
tattacacaaatacttattca

SEQ ID NO: 3772240 - DNA, 14 bp, Homo sapiens
tattacataaataa

SEQ ID NO: 3772241 - DNA, 18 bp, Homo sapiens
tattacatccttgtggca

SEQ ID NO: 3772242 - DNA, 12 bp, Homo sapiens
tattacatcttt

SEQ ID NO: 3772243 - DNA, 13 bp, Homo sapiens
tattacttctgct

SEQ ID NO: 3772244 - DNA, 16 bp, Homo sapiens
tattagctttactgtt

SEQ ID NO: 3772245 - DNA, 19 bp, Homo sapiens
tattataatttttttcaat

SEQ ID NO: 3772246 - DNA, 15 bp, Homo sapiens
tattatactaagaaa

SEQ ID NO: 3772247 - DNA, 18 bp, Homo sapiens
tattatactaagaaaaga

SEQ ID NO: 3772248 - DNA, 18 bp, Homo sapiens
tattattcaccatgtaaa

SEQ ID NO: 3772249 - DNA, 20 bp, Homo sapiens
tattcaagaaagccagtctt

SEQ ID NO: 3772250 - DNA, 15 bp, Homo sapiens
tattcaattcctctg

SEQ ID NO: 3772251 - DNA, 14 bp, Homo sapiens
tattcagtaaaaaa

SEQ ID NO: 3772252 - DNA, 15 bp, Homo sapiens
tattcagtgctgtgg

SEQ ID NO: 3772253 - DNA, 18 bp, Homo sapiens
tattcagttggtaagctt

SEQ ID NO: 3772254 - DNA, 16 bp, Homo sapiens
tattccatagtatatt

SEQ ID NO: 3772255 - DNA, 18 bp, Homo sapiens
tattccatatattagcat

SEQ ID NO: 3772256 - DNA, 17 bp, Homo sapiens
tattccccattcttcct

SEQ ID NO: 3772257 - DNA, 14 bp, Homo sapiens
tattcctgaatgaa

SEQ ID NO: 3772258 - DNA, 20 bp, Homo sapiens
tattcctgaatgaaatatca

SEQ ID NO: 3772259 - DNA, 17 bp, Homo sapiens
tattcctgcatttgtga

SEQ ID NO: 3772260 - DNA, 21 bp, Homo sapiens
tattcctgcatttgtgaaatg

SEQ ID NO: 3772261 - DNA, 19 bp, Homo sapiens
tattccttttgtgtacagt

SEQ ID NO: 3772262 - DNA, 20 bp, Homo sapiens
tattccttttgtgtacagtg

SEQ ID NO: 3772263 - DNA, 16 bp, Homo sapiens
tattctcaaagcagga

SEQ ID NO: 3772264 - DNA, 13 bp, Homo sapiens
tattctcactcca

SEQ ID NO: 3772265 - DNA, 14 bp, Homo sapiens
tattctcactccac

SEQ ID NO: 3772266 - DNA, 15 bp, Homo sapiens
tattctcactccacc

SEQ ID NO: 3772267 - DNA, 20 bp, Homo sapiens
tattctgcctttgcagaaac

SEQ ID NO: 3772268 - DNA, 12 bp, Homo sapiens
tattcttgtgaa

SEQ ID NO: 3772269 - DNA, 22 bp, Homo sapiens
tattcttgtgaatatgtacata

SEQ ID NO: 3772270 - DNA, 13 bp, Homo sapiens
tattgaaaaaaat

SEQ ID NO: 3772271 - DNA, 13 bp, Homo sapiens
tattgacaataat

SEQ ID NO: 3772272 - DNA, 17 bp, Homo sapiens
tattgacaataatttca

SEQ ID NO: 3772273 - DNA, 18 bp, Homo sapiens
tattgagaattttaaatt

SEQ ID NO: 3772274 - DNA, 14 bp, Homo sapiens
tattgatgtgcaaa

SEQ ID NO: 3772275 - DNA, 19 bp, Homo sapiens
tattgatgtgcaaaaattt

SEQ ID NO: 3772276 - DNA, 17 bp, Homo sapiens
tattgcaatgaaggaaa

SEQ ID NO: 3772277 - DNA, 15 bp, Homo sapiens
tattgcatatgcata

SEQ ID NO: 3772278 - DNA, 14 bp, Homo sapiens
tattgcccacgctg

SEQ ID NO: 3772279 - DNA, 15 bp, Homo sapiens
tattgcccacgctgg

SEQ ID NO: 3772280 - DNA, 18 bp, Homo sapiens
tattgctacttcctgcct

SEQ ID NO: 3772281 - DNA, 21 bp, Homo sapiens
tattgcttgatacttttgaca

SEQ ID NO: 3772282 - DNA, 16 bp, Homo sapiens
tattgggttcattatt

SEQ ID NO: 3772283 - DNA, 18 bp, Homo sapiens
tattgggttcattattgg

SEQ ID NO: 3772284 - DNA, 20 bp, Homo sapiens
tattgggttcattattggaa

SEQ ID NO: 3772285 - DNA, 16 bp, Homo sapiens
tattgtaaatacaagt

SEQ ID NO: 3772286 - DNA, 12 bp, Homo sapiens
tattgtaagata

SEQ ID NO: 3772287 - DNA, 13 bp, Homo sapiens
tattgtacctctc

SEQ ID NO: 3772288 - DNA, 17 bp, Homo sapiens
tattgtgaagtacatat

SEQ ID NO: 3772289 - DNA, 23 bp, Homo sapiens
tattgttccaagacattgtcaat

SEQ ID NO: 3772290 - DNA, 17 bp, Homo sapiens
tattgttcccagtgaca

SEQ ID NO: 3772291 - DNA, 21 bp, Homo sapiens
tattgttcctaagttcttaga

SEQ ID NO: 3772292 - DNA, 22 bp, Homo sapiens
tattgttttcagtgtacatgga

SEQ ID NO: 3772293 - DNA, 13 bp, Homo sapiens
tatttaaagacaa

SEQ ID NO: 3772294 - DNA, 22 bp, Homo sapiens
tatttaaatattaaatatgtta

SEQ ID NO: 3772295 - DNA, 16 bp, Homo sapiens
tatttaaattcttttt

SEQ ID NO: 3772296 - DNA, 20 bp, Homo sapiens
tatttaagatagttttgcca

SEQ ID NO: 3772297 - DNA, 14 bp, Homo sapiens
tatttaaggagatg

SEQ ID NO: 3772298 - DNA, 22 bp, Homo sapiens
tatttaaggagatgtaagagct

SEQ ID NO: 3772299 - DNA, 16 bp, Homo sapiens
tatttaagtattcaag

SEQ ID NO: 3772300 - DNA, 21 bp, Homo sapiens
tatttaatgaaagactgtaca

SEQ ID NO: 3772301 - DNA, 16 bp, Homo sapiens
tatttaattgtaaact

SEQ ID NO: 3772302 - DNA, 20 bp, Homo sapiens
tatttaattgtaaactgtac

SEQ ID NO: 3772303 - DNA, 21 bp, Homo sapiens
tatttacatatgaaatttaat

SEQ ID NO: 3772304 - DNA, 14 bp, Homo sapiens
tatttactgagctt

SEQ ID NO: 3772305 - DNA, 23 bp, Homo sapiens
tatttactgagcttctctgtgaa

SEQ ID NO: 3772306 - DNA, 17 bp, Homo sapiens
tatttaggcagattgaa

SEQ ID NO: 3772307 - DNA, 18 bp, Homo sapiens
tatttagggaactgcttg

SEQ ID NO: 3772308 - DNA, 19 bp, Homo sapiens
tatttataaatatatttaa

SEQ ID NO: 3772309 - DNA, 18 bp, Homo sapiens
tatttataacagcattct

SEQ ID NO: 3772310 - DNA, 13 bp, Homo sapiens
tatttataactca

SEQ ID NO: 3772311 - DNA, 21 bp, Homo sapiens
tatttataactcatcataaaa

SEQ ID NO: 3772312 - DNA, 14 bp, Homo sapiens
tatttataagcaga

SEQ ID NO: 3772313 - DNA, 17 bp, Homo sapiens
tatttataatacatttc

SEQ ID NO: 3772314 - DNA, 18 bp, Homo sapiens
tatttatagcaatccatg

SEQ ID NO: 3772315 - DNA, 18 bp, Homo sapiens
tatttatataattatgtt

SEQ ID NO: 3772316 - DNA, 18 bp, Homo sapiens
tatttatatatttataac

SEQ ID NO: 3772317 - DNA, 19 bp, Homo sapiens
tatttatatatttataact

SEQ ID NO: 3772318 - DNA, 16 bp, Homo sapiens
tatttatatttcacta

SEQ ID NO: 3772319 - DNA, 13 bp, Homo sapiens
tatttatcagtga

SEQ ID NO: 3772320 - DNA, 15 bp, Homo sapiens
tatttatcagtgaca

SEQ ID NO: 3772321 - DNA, 18 bp, Homo sapiens
tatttatcagtgacagag

SEQ ID NO: 3772322 - DNA, 21 bp, Homo sapiens
tatttatctgtagtaaactat

SEQ ID NO: 3772323 - DNA, 12 bp, Homo sapiens
tatttatcttta

SEQ ID NO: 3772324 - DNA, 13 bp, Homo sapiens
tatttattaagat

SEQ ID NO: 3772325 - DNA, 16 bp, Homo sapiens
tatttattacctctga

SEQ ID NO: 3772326 - DNA, 19 bp, Homo sapiens
tatttattattttcacctg

SEQ ID NO: 3772327 - DNA, 13 bp, Homo sapiens
tatttattgtatt

SEQ ID NO: 3772328 - DNA, 13 bp, Homo sapiens
tatttatttactg

SEQ ID NO: 3772329 - DNA, 13 bp, Homo sapiens
tatttatttatgg

SEQ ID NO: 3772330 - DNA, 18 bp, Homo sapiens
tatttattttcctcccca

SEQ ID NO: 3772331 - DNA, 15 bp, Homo sapiens
tatttcaaaaatttg

SEQ ID NO: 3772332 - DNA, 16 bp, Homo sapiens
tatttcaaaaatttgg

SEQ ID NO: 3772333 - DNA, 20 bp, Homo sapiens
tatttcaaaaatttggaatt

SEQ ID NO: 3772334 - DNA, 22 bp, Homo sapiens
tatttcaaaaatttggaattct

SEQ ID NO: 3772335 - DNA, 15 bp, Homo sapiens
tatttcgaaagctgc

SEQ ID NO: 3772336 - DNA, 11 bp, Homo sapiens
tatttctgaga

SEQ ID NO: 3772337 - DNA, 20 bp, Homo sapiens
tatttcttaaacaaatgtat

SEQ ID NO: 3772338 - DNA, 16 bp, Homo sapiens
tatttgcactgtagcc

SEQ ID NO: 3772339 - DNA, 22 bp, Homo sapiens
tatttggggttgcatcagaaat

SEQ ID NO: 3772340 - DNA, 17 bp, Homo sapiens
tatttggtactgtattt

SEQ ID NO: 3772341 - DNA, 22 bp, Homo sapiens
tattttaaattataaggactgc

SEQ ID NO: 3772342 - DNA, 19 bp, Homo sapiens
tattttaattaggttaact

SEQ ID NO: 3772343 - DNA, 19 bp, Homo sapiens
tattttaatttatgagttt

SEQ ID NO: 3772344 - DNA, 16 bp, Homo sapiens
tattttactactgtgg

SEQ ID NO: 3772345 - DNA, 18 bp, Homo sapiens
tattttacttctagagat

SEQ ID NO: 3772346 - DNA, 11 bp, Homo sapiens
tattttattca

SEQ ID NO: 3772347 - DNA, 22 bp, Homo sapiens
tattttcaaattgtatctagtg

SEQ ID NO: 3772348 - DNA, 21 bp, Homo sapiens
tattttcaattcaaaaatgta

SEQ ID NO: 3772349 - DNA, 22 bp, Homo sapiens
tattttcaattcaaaaatgtac

SEQ ID NO: 3772350 - DNA, 16 bp, Homo sapiens
tattttccatgaaaat

SEQ ID NO: 3772351 - DNA, 15 bp, Homo sapiens
tattttcctccccag

SEQ ID NO: 3772352 - DNA, 14 bp, Homo sapiens
tattttctttgaaa

SEQ ID NO: 3772353 - DNA, 20 bp, Homo sapiens
tattttgtaaactcaaaata

SEQ ID NO: 3772354 - DNA, 21 bp, Homo sapiens
tattttgtaaactcaaaatat

SEQ ID NO: 3772355 - DNA, 20 bp, Homo sapiens
tatttttagatggttacact

SEQ ID NO: 3772356 - DNA, 23 bp, Homo sapiens
tatttttagatggttacactgtt

SEQ ID NO: 3772357 - DNA, 23 bp, Homo sapiens
tatttttatatagcttgaaacat

SEQ ID NO: 3772358 - DNA, 17 bp, Homo sapiens
tatttttatttgtttgt

SEQ ID NO: 3772359 - DNA, 17 bp, Homo sapiens
tatttttgtagagccag

SEQ ID NO: 3772360 - DNA, 18 bp, Homo sapiens
tatttttgtttgttttgt

SEQ ID NO: 3772361 - DNA, 13 bp, Homo sapiens
tattttttaagta

SEQ ID NO: 3772362 - DNA, 21 bp, Homo sapiens
tattttttaagtatttatata

SEQ ID NO: 3772363 - DNA, 15 bp, Homo sapiens
tattttttaattatt

SEQ ID NO: 3772364 - DNA, 16 bp, Homo sapiens
tattttttaattattg

SEQ ID NO: 3772365 - DNA, 16 bp, Homo sapiens
tattttttaatttgat

SEQ ID NO: 3772366 - DNA, 18 bp, Homo sapiens
tatttttttaaaatcact

SEQ ID NO: 3772367 - DNA, 19 bp, Homo sapiens
tatttttttaaaatcacta

SEQ ID NO: 3772368 - DNA, 23 bp, Homo sapiens
tatttttttaaaatcactaacat

SEQ ID NO: 3772369 - DNA, 23 bp, Homo sapiens
tatttttttctaccttgaggtct

SEQ ID NO: 3772370 - DNA, 14 bp, Homo sapiens
tatttttttctctc

SEQ ID NO: 3772371 - DNA, 23 bp, Homo sapiens
tcaaaaagtctacgctctccttt

SEQ ID NO: 3772372 - DNA, 14 bp, Homo sapiens
tcaaaacacttgta

SEQ ID NO: 3772373 - DNA, 24 bp, Homo sapiens
tcaaaacacttgtaattttgtatc

SEQ ID NO: 3772374 - DNA, 18 bp, Homo sapiens
tcaaaacggggcagccaa

SEQ ID NO: 3772375 - DNA, 22 bp, Homo sapiens
tcaaaacggttttactgcagct

SEQ ID NO: 3772376 - DNA, 18 bp, Homo sapiens
tcaaaactcatttcctat

SEQ ID NO: 3772377 - DNA, 19 bp, Homo sapiens
tcaaaagaatcagaaacag

SEQ ID NO: 3772378 - DNA, 15 bp, Homo sapiens
tcaaaaggaaaccaa

SEQ ID NO: 3772379 - DNA, 23 bp, Homo sapiens
tcaaaaggtgcctgtgaggcagg

SEQ ID NO: 3772380 - DNA, 16 bp, Homo sapiens
tcaaaagttgaaatta

SEQ ID NO: 3772381 - DNA, 13 bp, Homo sapiens
tcaaaataaaaac

SEQ ID NO: 3772382 - DNA, 14 bp, Homo sapiens
tcaaaataaattga

SEQ ID NO: 3772383 - DNA, 17 bp, Homo sapiens
tcaaaatatttgtacat

SEQ ID NO: 3772384 - DNA, 14 bp, Homo sapiens
tcaaacaaagccag

SEQ ID NO: 3772385 - DNA, 22 bp, Homo sapiens
tcaaaccagtatacaagataag

SEQ ID NO: 3772386 - DNA, 19 bp, Homo sapiens
tcaaaccccgaccacctgc

SEQ ID NO: 3772387 - DNA, 20 bp, Homo sapiens
tcaaaccccgaccacctgcc

SEQ ID NO: 3772388 - DNA, 15 bp, Homo sapiens
tcaaacgtgaaaatg

SEQ ID NO: 3772389 - DNA, 16 bp, Homo sapiens
tcaaacgtgaaaatgc

SEQ ID NO: 3772390 - DNA, 16 bp, Homo sapiens
tcaaactgaagccaga

SEQ ID NO: 3772391 - DNA, 23 bp, Homo sapiens
tcaaagaggttttaaaaaaatcc

SEQ ID NO: 3772392 - DNA, 17 bp, Homo sapiens
tcaaagctgaagccgcc

SEQ ID NO: 3772393 - DNA, 21 bp, Homo sapiens
tcaaagcttccattccacatc

SEQ ID NO: 3772394 - DNA, 14 bp, Homo sapiens
tcaaagcttgaaga

SEQ ID NO: 3772395 - DNA, 16 bp, Homo sapiens
tcaaatgttttgcaaa

SEQ ID NO: 3772396 - DNA, 22 bp, Homo sapiens
tcaaatgttttgcaaacatcac

SEQ ID NO: 3772397 - DNA, 13 bp, Homo sapiens
tcaaatttaaagg

SEQ ID NO: 3772398 - DNA, 12 bp, Homo sapiens
tcaaatttcaca

SEQ ID NO: 3772399 - DNA, 23 bp, Homo sapiens
tcaaatttgtagggtttctaggt

SEQ ID NO: 3772400 - DNA, 23 bp, Homo sapiens
tcaacacttaagggttttagaaa

SEQ ID NO: 3772401 - DNA, 22 bp, Homo sapiens
tcaacagagaaggcaggaatgt

SEQ ID NO: 3772402 - DNA, 16 bp, Homo sapiens
tcaacatcaatgttca

SEQ ID NO: 3772403 - DNA, 21 bp, Homo sapiens
tcaacatcaatgttcattgta

SEQ ID NO: 3772404 - DNA, 23 bp, Homo sapiens
tcaacatcaatgttcattgtaat

SEQ ID NO: 3772405 - DNA, 15 bp, Homo sapiens
tcaacatgttactga

SEQ ID NO: 3772406 - DNA, 20 bp, Homo sapiens
tcaacatgttactgaccagc

SEQ ID NO: 3772407 - DNA, 21 bp, Homo sapiens
tcaacatgttactgaccagca

SEQ ID NO: 3772408 - DNA, 22 bp, Homo sapiens
tcaacatgttactgaccagcaa

SEQ ID NO: 3772409 - DNA, 23 bp, Homo sapiens
tcaaccactgtaaaatgaaatta

SEQ ID NO: 3772410 - DNA, 14 bp, Homo sapiens
tcaaccagcagatg

SEQ ID NO: 3772411 - DNA, 15 bp, Homo sapiens
tcaaccattccccat

SEQ ID NO: 3772412 - DNA, 18 bp, Homo sapiens
tcaacccccatttctatt

SEQ ID NO: 3772413 - DNA, 20 bp, Homo sapiens
tcaaccccttcgctcctgtg

SEQ ID NO: 3772414 - DNA, 18 bp, Homo sapiens
tcaaccctaaaaagcaga

SEQ ID NO: 3772415 - DNA, 22 bp, Homo sapiens
tcaaccctaaaaagcagagctt

SEQ ID NO: 3772416 - DNA, 19 bp, Homo sapiens
tcaaccctccctcagcccc

SEQ ID NO: 3772417 - DNA, 20 bp, Homo sapiens
tcaaccctccctcagcccct

SEQ ID NO: 3772418 - DNA, 21 bp, Homo sapiens
tcaaccctccctcagcccctc

SEQ ID NO: 3772419 - DNA, 23 bp, Homo sapiens
tcaaccctccctcagcccctctt

SEQ ID NO: 3772420 - DNA, 15 bp, Homo sapiens
tcaacctcctgggct

SEQ ID NO: 3772421 - DNA, 16 bp, Homo sapiens
tcaacctcctgggcta

SEQ ID NO: 3772422 - DNA, 16 bp, Homo sapiens
tcaacctgtaaattat

SEQ ID NO: 3772423 - DNA, 15 bp, Homo sapiens
tcaacgcagccctgc

SEQ ID NO: 3772424 - DNA, 18 bp, Homo sapiens
tcaactgaccagcctcca

SEQ ID NO: 3772425 - DNA, 24 bp, Homo sapiens
tcaactgaccagcctccatgctgc

SEQ ID NO: 3772426 - DNA, 17 bp, Homo sapiens
tcaagaaactgaggaat

SEQ ID NO: 3772427 - DNA, 20 bp, Homo sapiens
tcaagaaactgaggaatttt

SEQ ID NO: 3772428 - DNA, 21 bp, Homo sapiens
tcaagaaagcttcaaactgca

SEQ ID NO: 3772429 - DNA, 13 bp, Homo sapiens
tcaagaccagcct

SEQ ID NO: 3772430 - DNA, 22 bp, Homo sapiens
tcaagacccttttgggtttctg

SEQ ID NO: 3772431 - DNA, 12 bp, Homo sapiens
tcaagaggctga

SEQ ID NO: 3772432 - DNA, 21 bp, Homo sapiens
tcaagaggttctcgactggag

SEQ ID NO: 3772433 - DNA, 13 bp, Homo sapiens
tcaagataaagga

SEQ ID NO: 3772434 - DNA, 16 bp, Homo sapiens
tcaagattttgaatgc

SEQ ID NO: 3772435 - DNA, 18 bp, Homo sapiens
tcaagattttgaatgctt

SEQ ID NO: 3772436 - DNA, 16 bp, Homo sapiens
tcaagcaatcctcctg

SEQ ID NO: 3772437 - DNA, 23 bp, Homo sapiens
tcaagcatctcctgaggatcaga

SEQ ID NO: 3772438 - DNA, 20 bp, Homo sapiens
tcaagccaagcagccaagct

SEQ ID NO: 3772439 - DNA, 12 bp, Homo sapiens
tcaagccctgca

SEQ ID NO: 3772440 - DNA, 14 bp, Homo sapiens
tcaagcctgcctag

SEQ ID NO: 3772441 - DNA, 21 bp, Homo sapiens
tcaagcgattcttctgcttca

SEQ ID NO: 3772442 - DNA, 23 bp, Homo sapiens
tcaaggaccaacaagggcagtgg

SEQ ID NO: 3772443 - DNA, 15 bp, Homo sapiens
tcaaggcctgtccct

SEQ ID NO: 3772444 - DNA, 15 bp, Homo sapiens
tcaaggtaaaattct

SEQ ID NO: 3772445 - DNA, 17 bp, Homo sapiens
tcaaggtaaaattctaa

SEQ ID NO: 3772446 - DNA, 22 bp, Homo sapiens
tcaagtaagaagacatgaacca

SEQ ID NO: 3772447 - DNA, 22 bp, Homo sapiens
tcaagtcctcttttctgagagg

SEQ ID NO: 3772448 - DNA, 19 bp, Homo sapiens
tcaagtcctgcctcttaaa

SEQ ID NO: 3772449 - DNA, 20 bp, Homo sapiens
tcaagtcctgcctcttaaat

SEQ ID NO: 3772450 - DNA, 18 bp, Homo sapiens
tcaagtccttacctcttc

SEQ ID NO: 3772451 - DNA, 20 bp, Homo sapiens
tcaagtctgtgcctggagct

SEQ ID NO: 3772452 - DNA, 15 bp, Homo sapiens
tcaagtgaatctaaa

SEQ ID NO: 3772453 - DNA, 16 bp, Homo sapiens
tcaagtgattctcctg

SEQ ID NO: 3772454 - DNA, 21 bp, Homo sapiens
tcaagtgattctcctgcctca

SEQ ID NO: 3772455 - DNA, 22 bp, Homo sapiens
tcaagtgattctcctgcctcag

SEQ ID NO: 3772456 - DNA, 19 bp, Homo sapiens
tcaagtgcatgctctctgc

SEQ ID NO: 3772457 - DNA, 22 bp, Homo sapiens
tcaagtgcatgctctctgcagc

SEQ ID NO: 3772458 - DNA, 16 bp, Homo sapiens
tcaagttaacaaggaa

SEQ ID NO: 3772459 - DNA, 19 bp, Homo sapiens
tcaagttaacaaggaatgc

SEQ ID NO: 3772460 - DNA, 16 bp, Homo sapiens
tcaagttgcacactca

SEQ ID NO: 3772461 - DNA, 13 bp, Homo sapiens
tcaataaaatgtg

SEQ ID NO: 3772462 - DNA, 15 bp, Homo sapiens
tcaataaaatgtgat

SEQ ID NO: 3772463 - DNA, 23 bp, Homo sapiens
tcaataaacagcttcatgccttt

SEQ ID NO: 3772464 - DNA, 17 bp, Homo sapiens
tcaataaagtatctaca

SEQ ID NO: 3772465 - DNA, 19 bp, Homo sapiens
tcaatagtaaaagataaca

SEQ ID NO: 3772466 - DNA, 23 bp, Homo sapiens
tcaatatgaaggaaatgaaccac

SEQ ID NO: 3772467 - DNA, 14 bp, Homo sapiens
tcaatattcctgaa

SEQ ID NO: 3772468 - DNA, 17 bp, Homo sapiens
tcaatattcctgaatga

SEQ ID NO: 3772469 - DNA, 21 bp, Homo sapiens
tcaatattcctgaatgaaata

SEQ ID NO: 3772470 - DNA, 13 bp, Homo sapiens
tcaatatttatta

SEQ ID NO: 3772471 - DNA, 15 bp, Homo sapiens
tcaatattttccatg

SEQ ID NO: 3772472 - DNA, 17 bp, Homo sapiens
tcaatattttccatgaa

SEQ ID NO: 3772473 - DNA, 18 bp, Homo sapiens
tcaatattttccatgaaa

SEQ ID NO: 3772474 - DNA, 19 bp, Homo sapiens
tcaatccagcggttctcaa

SEQ ID NO: 3772475 - DNA, 17 bp, Homo sapiens
tcaatcccctcattcag

SEQ ID NO: 3772476 - DNA, 18 bp, Homo sapiens
tcaatgcactgacattgt

SEQ ID NO: 3772477 - DNA, 17 bp, Homo sapiens
tcaatgctataactatg

SEQ ID NO: 3772478 - DNA, 15 bp, Homo sapiens
tcaatgtgaatcaga

SEQ ID NO: 3772479 - DNA, 12 bp, Homo sapiens
tcaatgttcatt

SEQ ID NO: 3772480 - DNA, 18 bp, Homo sapiens
tcaatgttcattgtaatg

SEQ ID NO: 3772481 - DNA, 21 bp, Homo sapiens
tcaatgtttatgcaaggaagg

SEQ ID NO: 3772482 - DNA, 18 bp, Homo sapiens
tcaatgtttcttctaggt

SEQ ID NO: 3772483 - DNA, 15 bp, Homo sapiens
tcaattcaaaaatgt

SEQ ID NO: 3772484 - DNA, 14 bp, Homo sapiens
tcaattcctctggg

SEQ ID NO: 3772485 - DNA, 13 bp, Homo sapiens
tcaattcctgggc

SEQ ID NO: 3772486 - DNA, 20 bp, Homo sapiens
tcaatttattcaagaaaagt

SEQ ID NO: 3772487 - DNA, 17 bp, Homo sapiens
tcaatttattgcacaaa

SEQ ID NO: 3772488 - DNA, 18 bp, Homo sapiens
tcaatttccaagagctga

SEQ ID NO: 3772489 - DNA, 13 bp, Homo sapiens
tcaatttgtcatt

SEQ ID NO: 3772490 - DNA, 14 bp, Homo sapiens
tcaatttgtcattt

SEQ ID NO: 3772491 - DNA, 17 bp, Homo sapiens
tcaatttgtcattttga

SEQ ID NO: 3772492 - DNA, 23 bp, Homo sapiens
tcacaaatgatattaaaaattgg

SEQ ID NO: 3772493 - DNA, 20 bp, Homo sapiens
tcacaagctgcctccctgtc

SEQ ID NO: 3772494 - DNA, 14 bp, Homo sapiens
tcacaatagaaact

SEQ ID NO: 3772495 - DNA, 23 bp, Homo sapiens
tcacaatgaaatgctctcctttc

SEQ ID NO: 3772496 - DNA, 15 bp, Homo sapiens
tcacacactttggct

SEQ ID NO: 3772497 - DNA, 23 bp, Homo sapiens
tcacacagtgagtcgaggacagg

SEQ ID NO: 3772498 - DNA, 22 bp, Homo sapiens
tcacaccaggcttgcctgcagg

SEQ ID NO: 3772499 - DNA, 18 bp, Homo sapiens
tcacaccataactaggta

SEQ ID NO: 3772500 - DNA, 22 bp, Homo sapiens
tcacacttctgtgagaccccca

SEQ ID NO: 3772501 - DNA, 16 bp, Homo sapiens
tcacagactggagaca

SEQ ID NO: 3772502 - DNA, 22 bp, Homo sapiens
tcacagagacacagggcatcca

SEQ ID NO: 3772503 - DNA, 17 bp, Homo sapiens
tcacagaggcttcttca

SEQ ID NO: 3772504 - DNA, 16 bp, Homo sapiens
tcacagcacactcagc

SEQ ID NO: 3772505 - DNA, 13 bp, Homo sapiens
tcacagcctctga

SEQ ID NO: 3772506 - DNA, 22 bp, Homo sapiens
tcacagcttatttcctcatttt

SEQ ID NO: 3772507 - DNA, 16 bp, Homo sapiens
tcacagcttcagccag

SEQ ID NO: 3772508 - DNA, 16 bp, Homo sapiens
tcacaggactctgcct

SEQ ID NO: 3772509 - DNA, 14 bp, Homo sapiens
tcacagggttgggc

SEQ ID NO: 3772510 - DNA, 16 bp, Homo sapiens
tcacagggttgggccc

SEQ ID NO: 3772511 - DNA, 19 bp, Homo sapiens
tcacagggttgggcccaga

SEQ ID NO: 3772512 - DNA, 23 bp, Homo sapiens
tcacagggttgggcccagatctg

SEQ ID NO: 3772513 - DNA, 24 bp, Homo sapiens
tcacagggttgggcccagatctgg

SEQ ID NO: 3772514 - DNA, 19 bp, Homo sapiens
tcacagtcacatgcttgat

SEQ ID NO: 3772515 - DNA, 13 bp, Homo sapiens
tcacagtgtgttt

SEQ ID NO: 3772516 - DNA, 13 bp, Homo sapiens
tcacagttcctcg

SEQ ID NO: 3772517 - DNA, 14 bp, Homo sapiens
tcacagttcctcgc

SEQ ID NO: 3772518 - DNA, 21 bp, Homo sapiens
tcacagttcctcgccctgggt

SEQ ID NO: 3772519 - DNA, 12 bp, Homo sapiens
tcacatatctgt

SEQ ID NO: 3772520 - DNA, 22 bp, Homo sapiens
tcacatcatgctgttttatcct

SEQ ID NO: 3772521 - DNA, 18 bp, Homo sapiens
tcacatcctgtgtttcta

SEQ ID NO: 3772522 - DNA, 19 bp, Homo sapiens
tcacatcctgtgtttctag

SEQ ID NO: 3772523 - DNA, 14 bp, Homo sapiens
tcacatctttcaca

SEQ ID NO: 3772524 - DNA, 14 bp, Homo sapiens
tcacatgctggaca

SEQ ID NO: 3772525 - DNA, 15 bp, Homo sapiens
tcacattatttgcat

SEQ ID NO: 3772526 - DNA, 21 bp, Homo sapiens
tcaccaaatcagctgctacta

SEQ ID NO: 3772527 - DNA, 22 bp, Homo sapiens
tcaccaagctcacagttcctcg

SEQ ID NO: 3772528 - DNA, 18 bp, Homo sapiens
tcaccaccttcccagctc

SEQ ID NO: 3772529 - DNA, 21 bp, Homo sapiens
tcaccacttcaatagatcaaa

SEQ ID NO: 3772530 - DNA, 15 bp, Homo sapiens
tcaccagatttgcta

SEQ ID NO: 3772531 - DNA, 13 bp, Homo sapiens
tcaccagccccag

SEQ ID NO: 3772532 - DNA, 22 bp, Homo sapiens
tcaccagccccagtgcccacag

SEQ ID NO: 3772533 - DNA, 21 bp, Homo sapiens
tcaccatctcaggccacctgc

SEQ ID NO: 3772534 - DNA, 21 bp, Homo sapiens
tcaccatgtaaaacaaaaaac

SEQ ID NO: 3772535 - DNA, 13 bp, Homo sapiens
tcacccccaaggg

SEQ ID NO: 3772536 - DNA, 18 bp, Homo sapiens
tcacccccagctttgcta

SEQ ID NO: 3772537 - DNA, 13 bp, Homo sapiens
tcacccctgccct

SEQ ID NO: 3772538 - DNA, 19 bp, Homo sapiens
tcacccgaggctgcccact

SEQ ID NO: 3772539 - DNA, 20 bp, Homo sapiens
tcaccgagagtagccgagag

SEQ ID NO: 3772540 - DNA, 17 bp, Homo sapiens
tcacctaagtctctgtg

SEQ ID NO: 3772541 - DNA, 15 bp, Homo sapiens
tcacctgaggtcggg

SEQ ID NO: 3772542 - DNA, 11 bp, Homo sapiens
tcacctgctgg

SEQ ID NO: 3772543 - DNA, 17 bp, Homo sapiens
tcacctgctggcccctc

SEQ ID NO: 3772544 - DNA, 19 bp, Homo sapiens
tcacctgctggcccctcac

SEQ ID NO: 3772545 - DNA, 20 bp, Homo sapiens
tcacctgctggcccctcacc

SEQ ID NO: 3772546 - DNA, 14 bp, Homo sapiens
tcacctgggcacct

SEQ ID NO: 3772547 - DNA, 17 bp, Homo sapiens
tcacctgggcacctggg

SEQ ID NO: 3772548 - DNA, 14 bp, Homo sapiens
tcacctgtaaaact

SEQ ID NO: 3772549 - DNA, 18 bp, Homo sapiens
tcacctgtttttaagctg

SEQ ID NO: 3772550 - DNA, 19 bp, Homo sapiens
tcaccttgcaacacacaga

SEQ ID NO: 3772551 - DNA, 21 bp, Homo sapiens
tcaccttgcaacacacagaca

SEQ ID NO: 3772552 - DNA, 14 bp, Homo sapiens
tcacctttcccatc

SEQ ID NO: 3772553 - DNA, 16 bp, Homo sapiens
tcaccttttaaatcct

SEQ ID NO: 3772554 - DNA, 18 bp, Homo sapiens
tcaccttttaaatcctgt

SEQ ID NO: 3772555 - DNA, 22 bp, Homo sapiens
tcacgccactgcactccagcct

SEQ ID NO: 3772556 - DNA, 21 bp, Homo sapiens
tcacgcctgtaatcccagcag

SEQ ID NO: 3772557 - DNA, 13 bp, Homo sapiens
tcacgcctgtgca

SEQ ID NO: 3772558 - DNA, 14 bp, Homo sapiens
tcacggaagagcct

SEQ ID NO: 3772559 - DNA, 22 bp, Homo sapiens
tcacggcaggacaacgaggaag

SEQ ID NO: 3772560 - DNA, 15 bp, Homo sapiens
tcacggctcactgca

SEQ ID NO: 3772561 - DNA, 22 bp, Homo sapiens
tcacgggagatttcttgttgct

SEQ ID NO: 3772562 - DNA, 17 bp, Homo sapiens
tcacgtaagatacaagt

SEQ ID NO: 3772563 - DNA, 17 bp, Homo sapiens
tcacgtgtgtgactcag

SEQ ID NO: 3772564 - DNA, 12 bp, Homo sapiens
tcactaacatta

SEQ ID NO: 3772565 - DNA, 15 bp, Homo sapiens
tcactaacattatat

SEQ ID NO: 3772566 - DNA, 16 bp, Homo sapiens
tcactaacattatatt

SEQ ID NO: 3772567 - DNA, 12 bp, Homo sapiens
tcccctgccctg

SEQ ID NO: 3772568 - DNA, 23 bp, Homo sapiens
tcccctgccctgctgccgcctcc

SEQ ID NO: 3772569 - DNA, 24 bp, Homo sapiens
tcccctgccctggtccagggaagc

SEQ ID NO: 3772570 - DNA, 22 bp, Homo sapiens
tcccctgtagagtgggagctga

SEQ ID NO: 3772571 - DNA, 22 bp, Homo sapiens
tccccttcgcgtatttcaggat

SEQ ID NO: 3772572 - DNA, 14 bp, Homo sapiens
tccccttgagctga

SEQ ID NO: 3772573 - DNA, 15 bp, Homo sapiens
tccccttgagctgag

SEQ ID NO: 3772574 - DNA, 20 bp, Homo sapiens
tccccttgcccagggctcag

SEQ ID NO: 3772575 - DNA, 24 bp, Homo sapiens
tccccttgcccagggctcagcctg

SEQ ID NO: 3772576 - DNA, 23 bp, Homo sapiens
tcccgaaccccaaggagggagat

SEQ ID NO: 3772577 - DNA, 18 bp, Homo sapiens
tcccgaatagctgggact

SEQ ID NO: 3772578 - DNA, 15 bp, Homo sapiens
tcccgattgtaactc

SEQ ID NO: 3772579 - DNA, 22 bp, Homo sapiens
tcccgggactcactggcagccc

SEQ ID NO: 3772580 - DNA, 18 bp, Homo sapiens
tccctaaaaacacagaca

SEQ ID NO: 3772581 - DNA, 18 bp, Homo sapiens
tccctaccacctccccag

SEQ ID NO: 3772582 - DNA, 19 bp, Homo sapiens
tccctaccccctaagagcc

SEQ ID NO: 3772583 - DNA, 20 bp, Homo sapiens
tccctaccccctaagagcca

SEQ ID NO: 3772584 - DNA, 19 bp, Homo sapiens
tccctaccgagtctcttct

SEQ ID NO: 3772585 - DNA, 21 bp, Homo sapiens
tccctaccgagtctcttctcc

SEQ ID NO: 3772586 - DNA, 23 bp, Homo sapiens
tccctaccgagtctcttctccac

SEQ ID NO: 3772587 - DNA, 22 bp, Homo sapiens
tccctacctcaacctgtaaatt

SEQ ID NO: 3772588 - DNA, 13 bp, Homo sapiens
tccctacctcagg

SEQ ID NO: 3772589 - DNA, 15 bp, Homo sapiens
tccctacctcaggca

SEQ ID NO: 3772590 - DNA, 17 bp, Homo sapiens
tccctacttcctgtgac

SEQ ID NO: 3772591 - DNA, 18 bp, Homo sapiens
tccctagagggttcctgt

SEQ ID NO: 3772592 - DNA, 20 bp, Homo sapiens
tccctagagggttcctgtag

SEQ ID NO: 3772593 - DNA, 15 bp, Homo sapiens
tccctaggagaccaa

SEQ ID NO: 3772594 - DNA, 15 bp, Homo sapiens
tccctagggctgggt

SEQ ID NO: 3772595 - DNA, 18 bp, Homo sapiens
tccctagtcttcaagcag

SEQ ID NO: 3772596 - DNA, 20 bp, Homo sapiens
tccctatcactgaagctttt

SEQ ID NO: 3772597 - DNA, 15 bp, Homo sapiens
tccctcagcccctct

SEQ ID NO: 3772598 - DNA, 17 bp, Homo sapiens
tccctcagcccctcttg

SEQ ID NO: 3772599 - DNA, 16 bp, Homo sapiens
tccctcagtgccctca

SEQ ID NO: 3772600 - DNA, 13 bp, Homo sapiens
tccctcccctgcc

SEQ ID NO: 3772601 - DNA, 16 bp, Homo sapiens
tccctcccctgccatt

SEQ ID NO: 3772602 - DNA, 16 bp, Homo sapiens
tccctcccctgccctc

SEQ ID NO: 3772603 - DNA, 17 bp, Homo sapiens
tccctcccctgccctcg

SEQ ID NO: 3772604 - DNA, 14 bp, Homo sapiens
tccctccctctgcc

SEQ ID NO: 3772605 - DNA, 16 bp, Homo sapiens
tccctccctctgccgg

SEQ ID NO: 3772606 - DNA, 17 bp, Homo sapiens
tccctccctctttccct

SEQ ID NO: 3772607 - DNA, 18 bp, Homo sapiens
tccctcccttcctctttc

SEQ ID NO: 3772608 - DNA, 17 bp, Homo sapiens
tccctcctcacctctgg

SEQ ID NO: 3772609 - DNA, 15 bp, Homo sapiens
tccctcctctgtccc

SEQ ID NO: 3772610 - DNA, 20 bp, Homo sapiens
tccctcgaacccacactgca

SEQ ID NO: 3772611 - DNA, 19 bp, Homo sapiens
tccctctctcttctgctcc

SEQ ID NO: 3772612 - DNA, 17 bp, Homo sapiens
tccctctgacctgcagg

SEQ ID NO: 3772613 - DNA, 13 bp, Homo sapiens
tccctctgccggc

SEQ ID NO: 3772614 - DNA, 19 bp, Homo sapiens
tccctctggccctgccttc

SEQ ID NO: 3772615 - DNA, 20 bp, Homo sapiens
tccctctggccctgccttct

SEQ ID NO: 3772616 - DNA, 18 bp, Homo sapiens
tccctctttccctccctt

SEQ ID NO: 3772617 - DNA, 18 bp, Homo sapiens
tccctgaaaacccagaga

SEQ ID NO: 3772618 - DNA, 17 bp, Homo sapiens
tccctgacctccctcta

SEQ ID NO: 3772619 - DNA, 16 bp, Homo sapiens
tccctgactctctgtg

SEQ ID NO: 3772620 - DNA, 20 bp, Homo sapiens
tccctgactctctgtgacct

SEQ ID NO: 3772621 - DNA, 20 bp, Homo sapiens
tccctgaggctggactccag

SEQ ID NO: 3772622 - DNA, 15 bp, Homo sapiens
tccctgagtcaccag

SEQ ID NO: 3772623 - DNA, 17 bp, Homo sapiens
tccctgagtcaccagga

SEQ ID NO: 3772624 - DNA, 12 bp, Homo sapiens
tccctgatgtac

SEQ ID NO: 3772625 - DNA, 17 bp, Homo sapiens
tccctgccccctcccct

SEQ ID NO: 3772626 - DNA, 14 bp, Homo sapiens
tccctgcccctccc

SEQ ID NO: 3772627 - DNA, 18 bp, Homo sapiens
tccctgcccctcccttca

SEQ ID NO: 3772628 - DNA, 19 bp, Homo sapiens
tccctgcccctcccttcaa

SEQ ID NO: 3772629 - DNA, 23 bp, Homo sapiens
tccctgcctcacctctgccattt

SEQ ID NO: 3772630 - DNA, 11 bp, Homo sapiens
tccctggacca

SEQ ID NO: 3772631 - DNA, 17 bp, Homo sapiens
tccctggaccagatgct

SEQ ID NO: 3772632 - DNA, 18 bp, Homo sapiens
tccctggaccagatgctg

SEQ ID NO: 3772633 - DNA, 16 bp, Homo sapiens
tccctggccatctctg

SEQ ID NO: 3772634 - DNA, 14 bp, Homo sapiens
tccctggcctgttc

SEQ ID NO: 3772635 - DNA, 14 bp, Homo sapiens
tccctggctcccat

SEQ ID NO: 3772636 - DNA, 21 bp, Homo sapiens
tccctggcttgtaactccacc

SEQ ID NO: 3772637 - DNA, 17 bp, Homo sapiens
tccctgggcattgcttt

SEQ ID NO: 3772638 - DNA, 18 bp, Homo sapiens
tccctgggggaagccctg

SEQ ID NO: 3772639 - DNA, 19 bp, Homo sapiens
tccctgggggaagccctgg

SEQ ID NO: 3772640 - DNA, 22 bp, Homo sapiens
tccctgtcaccaagctcacagt

SEQ ID NO: 3772641 - DNA, 14 bp, Homo sapiens
tccctgtccacccc

SEQ ID NO: 3772642 - DNA, 12 bp, Homo sapiens
tccctgtcccag

SEQ ID NO: 3772643 - DNA, 14 bp, Homo sapiens
tccctgtcctcctc

SEQ ID NO: 3772644 - DNA, 15 bp, Homo sapiens
tccctgtcctcctcg

SEQ ID NO: 3772645 - DNA, 22 bp, Homo sapiens
tcccttcaaccattccccatgg

SEQ ID NO: 3772646 - DNA, 12 bp, Homo sapiens
tcccttcccctc

SEQ ID NO: 3772647 - DNA, 20 bp, Homo sapiens
tcccttcccctccctggctc

SEQ ID NO: 3772648 - DNA, 17 bp, Homo sapiens
tcccttctttttcttct

SEQ ID NO: 3772649 - DNA, 16 bp, Homo sapiens
tcccttgagacctcag

SEQ ID NO: 3772650 - DNA, 14 bp, Homo sapiens
tcccttggcctcag

SEQ ID NO: 3772651 - DNA, 20 bp, Homo sapiens
tccctttagcacgtttaaag

SEQ ID NO: 3772652 - DNA, 21 bp, Homo sapiens
tccctttcacaaaattttatt

SEQ ID NO: 3772653 - DNA, 19 bp, Homo sapiens
tccctttccttccatccct

SEQ ID NO: 3772654 - DNA, 23 bp, Homo sapiens
tccctttccttccatccctaccc

SEQ ID NO: 3772655 - DNA, 11 bp, Homo sapiens
tccctttgctc

SEQ ID NO: 3772656 - DNA, 19 bp, Homo sapiens
tcccttttacatactgctg

SEQ ID NO: 3772657 - DNA, 14 bp, Homo sapiens
tccgaggcagggtc

SEQ ID NO: 3772658 - DNA, 14 bp, Homo sapiens
tccgcctcttgggt

SEQ ID NO: 3772659 - DNA, 15 bp, Homo sapiens
tccggaatcctgtcc

SEQ ID NO: 3772660 - DNA, 15 bp, Homo sapiens
tccggagatgtagca

SEQ ID NO: 3772661 - DNA, 14 bp, Homo sapiens
tccgtagttccctg

SEQ ID NO: 3772662 - DNA, 15 bp, Homo sapiens
tccgtgagcagtgtg

SEQ ID NO: 3772663 - DNA, 23 bp, Homo sapiens
tccgtgagcagtgtgtctcctgc

SEQ ID NO: 3772664 - DNA, 20 bp, Homo sapiens
tccgtgagtgaaccatcatt

SEQ ID NO: 3772665 - DNA, 19 bp, Homo sapiens
tccgtgatccatccatctc

SEQ ID NO: 3772666 - DNA, 24 bp, Homo sapiens
tccgtgcttgtttgctcacctggg

SEQ ID NO: 3772667 - DNA, 19 bp, Homo sapiens
tccgtttccaggtgtttat

SEQ ID NO: 3772668 - DNA, 13 bp, Homo sapiens
tcctaaaagttca

SEQ ID NO: 3772669 - DNA, 16 bp, Homo sapiens
tcctaagctattcagt

SEQ ID NO: 3772670 - DNA, 18 bp, Homo sapiens
tcctaagctattcagtaa

SEQ ID NO: 3772671 - DNA, 20 bp, Homo sapiens
tcctaagctattcagtaata

SEQ ID NO: 3772672 - DNA, 21 bp, Homo sapiens
tcctaagctattcagtaataa

SEQ ID NO: 3772673 - DNA, 20 bp, Homo sapiens
tcctaagttcttagatatct

SEQ ID NO: 3772674 - DNA, 14 bp, Homo sapiens
tcctaatcatccaa

SEQ ID NO: 3772675 - DNA, 22 bp, Homo sapiens
tcctacaagagcagcctgtggc

SEQ ID NO: 3772676 - DNA, 23 bp, Homo sapiens
tcctacaagagcagcctgtggca

SEQ ID NO: 3772677 - DNA, 15 bp, Homo sapiens
tcctacaatatatat

SEQ ID NO: 3772678 - DNA, 12 bp, Homo sapiens
tcctactctgtg

SEQ ID NO: 3772679 - DNA, 17 bp, Homo sapiens
tcctacttttccttccc

SEQ ID NO: 3772680 - DNA, 22 bp, Homo sapiens
tcctagaaattccccaccctga

SEQ ID NO: 3772681 - DNA, 15 bp, Homo sapiens
tcccaaagagctgcc

SEQ ID NO: 3772682 - DNA, 16 bp, Homo sapiens
tcccaaagtgctggga

SEQ ID NO: 3772683 - DNA, 21 bp, Homo sapiens
tcccaaagtgctgggattaca

SEQ ID NO: 3772684 - DNA, 19 bp, Homo sapiens
tcccaacacaaggtgggca

SEQ ID NO: 3772685 - DNA, 22 bp, Homo sapiens
tcccaagagaaggggaagcact

SEQ ID NO: 3772686 - DNA, 14 bp, Homo sapiens
tcccaagctctgct

SEQ ID NO: 3772687 - DNA, 22 bp, Homo sapiens
tcccaagctggagtgcagtggt

SEQ ID NO: 3772688 - DNA, 12 bp, Homo sapiens
tcccaaggaaag

SEQ ID NO: 3772689 - DNA, 18 bp, Homo sapiens
tcccaaggaaagccccag

SEQ ID NO: 3772690 - DNA, 17 bp, Homo sapiens
tcccaagtgccagtctt

SEQ ID NO: 3772691 - DNA, 23 bp, Homo sapiens
tcccaatagcactttcattgcca

SEQ ID NO: 3772692 - DNA, 15 bp, Homo sapiens
tcccaattaggaagt

SEQ ID NO: 3772693 - DNA, 16 bp, Homo sapiens
tcccacaaaggagagc

SEQ ID NO: 3772694 - DNA, 13 bp, Homo sapiens
tcccacaccctgg

SEQ ID NO: 3772695 - DNA, 15 bp, Homo sapiens
tcccacaggcccttc

SEQ ID NO: 3772696 - DNA, 19 bp, Homo sapiens
tcccaccaaccctcagagc

SEQ ID NO: 3772697 - DNA, 15 bp, Homo sapiens
tcccaccacagcagg

SEQ ID NO: 3772698 - DNA, 17 bp, Homo sapiens
tcccaccaggctgctca

SEQ ID NO: 3772699 - DNA, 16 bp, Homo sapiens
tcccaccccaccccct

SEQ ID NO: 3772700 - DNA, 18 bp, Homo sapiens
tcccaccccacccccttc

SEQ ID NO: 3772701 - DNA, 20 bp, Homo sapiens
tcccaccccacccccttcag

SEQ ID NO: 3772702 - DNA, 17 bp, Homo sapiens
tcccacccccttctctg

SEQ ID NO: 3772703 - DNA, 19 bp, Homo sapiens
tcccacccccttctctgct

SEQ ID NO: 3772704 - DNA, 22 bp, Homo sapiens
tcccacccccttctctgctcca

SEQ ID NO: 3772705 - DNA, 19 bp, Homo sapiens
tcccaccggttgcttctgg

SEQ ID NO: 3772706 - DNA, 21 bp, Homo sapiens
tcccaccggttgcttctggga

SEQ ID NO: 3772707 - DNA, 14 bp, Homo sapiens
tcccacctcagcct

SEQ ID NO: 3772708 - DNA, 13 bp, Homo sapiens
tcccaccttggct

SEQ ID NO: 3772709 - DNA, 17 bp, Homo sapiens
tcccaccttggctgcag

SEQ ID NO: 3772710 - DNA, 18 bp, Homo sapiens
tcccaccttggctgcagg

SEQ ID NO: 3772711 - DNA, 22 bp, Homo sapiens
tcccactcacaacagctgcctg

SEQ ID NO: 3772712 - DNA, 14 bp, Homo sapiens
tcccactcagtcca

SEQ ID NO: 3772713 - DNA, 15 bp, Homo sapiens
tcccacttgcccctg

SEQ ID NO: 3772714 - DNA, 17 bp, Homo sapiens
tcccagaacacactcca

SEQ ID NO: 3772715 - DNA, 16 bp, Homo sapiens
tcccagatacttgggg

SEQ ID NO: 3772716 - DNA, 18 bp, Homo sapiens
tcccagatacttgggggg

SEQ ID NO: 3772717 - DNA, 18 bp, Homo sapiens
tcccagcactttgggagg

SEQ ID NO: 3772718 - DNA, 19 bp, Homo sapiens
tcccagcactttgggaggc

SEQ ID NO: 3772719 - DNA, 21 bp, Homo sapiens
tcccagcactttgggaggccg

SEQ ID NO: 3772720 - DNA, 12 bp, Homo sapiens
tcccagccaccc

SEQ ID NO: 3772721 - DNA, 14 bp, Homo sapiens
tcccagccaccccg

SEQ ID NO: 3772722 - DNA, 20 bp, Homo sapiens
tcccagccaccccgggctct

SEQ ID NO: 3772723 - DNA, 13 bp, Homo sapiens
tcccagcccctgc

SEQ ID NO: 3772724 - DNA, 19 bp, Homo sapiens
tcccagcccctgcccctca

SEQ ID NO: 3772725 - DNA, 20 bp, Homo sapiens
tcccagcggctggtgcaggg

SEQ ID NO: 3772726 - DNA, 19 bp, Homo sapiens
tcccagctactcagaagcc

SEQ ID NO: 3772727 - DNA, 16 bp, Homo sapiens
tcccagctacttggga

SEQ ID NO: 3772728 - DNA, 18 bp, Homo sapiens
tcccagctacttgggagg

SEQ ID NO: 3772729 - DNA, 23 bp, Homo sapiens
tcccagctctccctctggccctg

SEQ ID NO: 3772730 - DNA, 17 bp, Homo sapiens
tcccagctgcccctccc

SEQ ID NO: 3772731 - DNA, 11 bp, Homo sapiens
tcccaggaact

SEQ ID NO: 3772732 - DNA, 16 bp, Homo sapiens
tcccaggcgccccttc

SEQ ID NO: 3772733 - DNA, 16 bp, Homo sapiens
tcccagggccagggcc

SEQ ID NO: 3772734 - DNA, 22 bp, Homo sapiens
tcccagggccagggccctgcag

SEQ ID NO: 3772735 - DNA, 22 bp, Homo sapiens
tcccagtgccgagaaggaagcc

SEQ ID NO: 3772736 - DNA, 18 bp, Homo sapiens
tcccagtggcctcaaccc

SEQ ID NO: 3772737 - DNA, 19 bp, Homo sapiens
tcccagtggcctcaaccct

SEQ ID NO: 3772738 - DNA, 20 bp, Homo sapiens
tcccagtggcctcaaccctc

SEQ ID NO: 3772739 - DNA, 15 bp, Homo sapiens
tcccagttcaggagt

SEQ ID NO: 3772740 - DNA, 15 bp, Homo sapiens
tcccataagctatag

SEQ ID NO: 3772741 - DNA, 22 bp, Homo sapiens
tcccatcccagctgaaatactg

SEQ ID NO: 3772742 - DNA, 13 bp, Homo sapiens
tcccatcccatcc

SEQ ID NO: 3772743 - DNA, 15 bp, Homo sapiens
tcccatcccatccca

SEQ ID NO: 3772744 - DNA, 16 bp, Homo sapiens
tcccatcccatcccat

SEQ ID NO: 3772745 - DNA, 17 bp, Homo sapiens
tcccatcccatcccatc

SEQ ID NO: 3772746 - DNA, 15 bp, Homo sapiens
tcccatgagcctcag

SEQ ID NO: 3772747 - DNA, 18 bp, Homo sapiens
tcccatgagcctcagcat

SEQ ID NO: 3772748 - DNA, 19 bp, Homo sapiens
tcccatgagcctcagcatc

SEQ ID NO: 3772749 - DNA, 22 bp, Homo sapiens
tcccatgagcctcagcatcctg

SEQ ID NO: 3772750 - DNA, 12 bp, Homo sapiens
tcccatgccctg

SEQ ID NO: 3772751 - DNA, 20 bp, Homo sapiens
tcccattgaaaatgtaagta

SEQ ID NO: 3772752 - DNA, 15 bp, Homo sapiens
tcccattgccctggt

SEQ ID NO: 3772753 - DNA, 19 bp, Homo sapiens
tcccattgtcttctgacct

SEQ ID NO: 3772754 - DNA, 13 bp, Homo sapiens
tcccatttcctgt

SEQ ID NO: 3772755 - DNA, 14 bp, Homo sapiens
tcccatttcttaat

SEQ ID NO: 3772756 - DNA, 19 bp, Homo sapiens
tcccattttcagactgctt

SEQ ID NO: 3772757 - DNA, 13 bp, Homo sapiens
tcccattttgcaa

SEQ ID NO: 3772758 - DNA, 22 bp, Homo sapiens
tcccattttgcaaaatttccag

SEQ ID NO: 3772759 - DNA, 19 bp, Homo sapiens
tcccattttggaagttttc

SEQ ID NO: 3772760 - DNA, 15 bp, Homo sapiens
tccccaccaccccag

SEQ ID NO: 3772761 - DNA, 23 bp, Homo sapiens
tccccaccctgaaagccctgagc

SEQ ID NO: 3772762 - DNA, 16 bp, Homo sapiens
tccccactgacagcct

SEQ ID NO: 3772763 - DNA, 14 bp, Homo sapiens
tccccactgcctgc

SEQ ID NO: 3772764 - DNA, 13 bp, Homo sapiens
tccccagacctga

SEQ ID NO: 3772765 - DNA, 22 bp, Homo sapiens
tccccagattgcaacaggctgg

SEQ ID NO: 3772766 - DNA, 23 bp, Homo sapiens
tccccagattgcaacaggctggg

SEQ ID NO: 3772767 - DNA, 21 bp, Homo sapiens
tccccagcaagtgagagctgg

SEQ ID NO: 3772768 - DNA, 12 bp, Homo sapiens
tccccagcctct

SEQ ID NO: 3772769 - DNA, 13 bp, Homo sapiens
tccccaggcccca

SEQ ID NO: 3772770 - DNA, 19 bp, Homo sapiens
tccccaggccgtggctgcc

SEQ ID NO: 3772771 - DNA, 14 bp, Homo sapiens
tccccaggggagag

SEQ ID NO: 3772772 - DNA, 18 bp, Homo sapiens
tccccaggggtcccagcc

SEQ ID NO: 3772773 - DNA, 22 bp, Homo sapiens
tccccaggggtcccagccaccc

SEQ ID NO: 3772774 - DNA, 15 bp, Homo sapiens
tccccaggtggctga

SEQ ID NO: 3772775 - DNA, 20 bp, Homo sapiens
tccccaggtggctgacccag

SEQ ID NO: 3772776 - DNA, 23 bp, Homo sapiens
tccccatggcatgggggcctcag

SEQ ID NO: 3772777 - DNA, 22 bp, Homo sapiens
tccccatgtgcctgcaccagga

SEQ ID NO: 3772778 - DNA, 22 bp, Homo sapiens
tccccattcttcctagttttct

SEQ ID NO: 3772779 - DNA, 16 bp, Homo sapiens
tcccccagccctgtgg

SEQ ID NO: 3772780 - DNA, 17 bp, Homo sapiens
tcccccagccctgtgga

SEQ ID NO: 3772781 - DNA, 18 bp, Homo sapiens
tcccccatcctccccttc

SEQ ID NO: 3772782 - DNA, 21 bp, Homo sapiens
tcccccatcctccccttccct

SEQ ID NO: 3772783 - DNA, 18 bp, Homo sapiens
tccccccactgcaggccc

SEQ ID NO: 3772784 - DNA, 10 bp, Homo sapiens
tccccctggg

SEQ ID NO: 3772785 - DNA, 15 bp, Homo sapiens
tccccctgggctctg

SEQ ID NO: 3772786 - DNA, 18 bp, Homo sapiens
tccccctgtagactagtg

SEQ ID NO: 3772787 - DNA, 16 bp, Homo sapiens
tccccgcattccaggc

SEQ ID NO: 3772788 - DNA, 15 bp, Homo sapiens
tccccgctggctggg

SEQ ID NO: 3772789 - DNA, 16 bp, Homo sapiens
tccccggctcaagtga

SEQ ID NO: 3772790 - DNA, 17 bp, Homo sapiens
tcccctatccacccagc

SEQ ID NO: 3772791 - DNA, 15 bp, Homo sapiens
tcccctccctggctc

SEQ ID NO: 3772792 - DNA, 12 bp, Homo sapiens
tcccctccttgc

SEQ ID NO: 3772793 - DNA, 20 bp, Homo sapiens
tcccctccttgcctcctgtg

SEQ ID NO: 3772794 - DNA, 14 bp, Homo sapiens
tcccctctgctggc

SEQ ID NO: 3772795 - DNA, 13 bp, Homo sapiens
tcccctgccattt

SEQ ID NO: 3772796 - DNA, 23 bp, Homo sapiens
tcagcggggacagctccttctgt

SEQ ID NO: 3772797 - DNA, 22 bp, Homo sapiens
tcagctagcaaaagaagtaaca

SEQ ID NO: 3772798 - DNA, 20 bp, Homo sapiens
tcagctatttactgccaaag

SEQ ID NO: 3772799 - DNA, 24 bp, Homo sapiens
tcagctccagctcaccagccccag

SEQ ID NO: 3772800 - DNA, 16 bp, Homo sapiens
tcagctgcccccgctc

SEQ ID NO: 3772801 - DNA, 21 bp, Homo sapiens
tcagctgcccccgctcatggg

SEQ ID NO: 3772802 - DNA, 14 bp, Homo sapiens
tcagctgcctcact

SEQ ID NO: 3772803 - DNA, 15 bp, Homo sapiens
tcagctgctactact

SEQ ID NO: 3772804 - DNA, 12 bp, Homo sapiens
tcagctgcttct

SEQ ID NO: 3772805 - DNA, 14 bp, Homo sapiens
tcagcttcttaata

SEQ ID NO: 3772806 - DNA, 22 bp, Homo sapiens
tcagcttgtaaatagctcaggt

SEQ ID NO: 3772807 - DNA, 15 bp, Homo sapiens
tcagctttgccttcc

SEQ ID NO: 3772808 - DNA, 22 bp, Homo sapiens
tcagctttgccttccacgctgt

SEQ ID NO: 3772809 - DNA, 18 bp, Homo sapiens
tcagctttttgtcttttc

SEQ ID NO: 3772810 - DNA, 21 bp, Homo sapiens
tcaggaaaactgacagaggag

SEQ ID NO: 3772811 - DNA, 20 bp, Homo sapiens
tcaggaaatatatatgtgtg

SEQ ID NO: 3772812 - DNA, 13 bp, Homo sapiens
tcaggaacactct

SEQ ID NO: 3772813 - DNA, 15 bp, Homo sapiens
tcaggaacctggacc

SEQ ID NO: 3772814 - DNA, 17 bp, Homo sapiens
tcaggaacctggaccaa

SEQ ID NO: 3772815 - DNA, 23 bp, Homo sapiens
tcaggaacctggaccaaagctga

SEQ ID NO: 3772816 - DNA, 16 bp, Homo sapiens
tcaggaaggatgagca

SEQ ID NO: 3772817 - DNA, 13 bp, Homo sapiens
tcaggacactaat

SEQ ID NO: 3772818 - DNA, 14 bp, Homo sapiens
tcaggactcctctc

SEQ ID NO: 3772819 - DNA, 15 bp, Homo sapiens
tcaggagaggggcag

SEQ ID NO: 3772820 - DNA, 17 bp, Homo sapiens
tcaggagaggggcagaa

SEQ ID NO: 3772821 - DNA, 20 bp, Homo sapiens
tcaggagaggggcagaacag

SEQ ID NO: 3772822 - DNA, 18 bp, Homo sapiens
tcaggaggctgaggcaga

SEQ ID NO: 3772823 - DNA, 15 bp, Homo sapiens
tcaggaggctgaggg

SEQ ID NO: 3772824 - DNA, 20 bp, Homo sapiens
tcaggagtcccaaggaaagc

SEQ ID NO: 3772825 - DNA, 20 bp, Homo sapiens
tcaggagttagaggccagcc

SEQ ID NO: 3772826 - DNA, 18 bp, Homo sapiens
tcaggatactctgtcaga

SEQ ID NO: 3772827 - DNA, 16 bp, Homo sapiens
tcaggatcaagaaagt

SEQ ID NO: 3772828 - DNA, 16 bp, Homo sapiens
tcaggatgcccagggc

SEQ ID NO: 3772829 - DNA, 23 bp, Homo sapiens
tcaggattctcctttttacccct

SEQ ID NO: 3772830 - DNA, 13 bp, Homo sapiens
tcaggcaggaagg

SEQ ID NO: 3772831 - DNA, 16 bp, Homo sapiens
tcaggcataggcctgg

SEQ ID NO: 3772832 - DNA, 15 bp, Homo sapiens
tcaggcatgcctgtg

SEQ ID NO: 3772833 - DNA, 15 bp, Homo sapiens
tcaggccatggctcc

SEQ ID NO: 3772834 - DNA, 19 bp, Homo sapiens
tcaggcccttattttcaag

SEQ ID NO: 3772835 - DNA, 18 bp, Homo sapiens
tcaggcctataaccccag

SEQ ID NO: 3772836 - DNA, 21 bp, Homo sapiens
tcaggcgatccacctgtctca

SEQ ID NO: 3772837 - DNA, 13 bp, Homo sapiens
tcaggctctgccc

SEQ ID NO: 3772838 - DNA, 19 bp, Homo sapiens
tcaggctctgccctgccct

SEQ ID NO: 3772839 - DNA, 16 bp, Homo sapiens
tcaggctgctggagga

SEQ ID NO: 3772840 - DNA, 21 bp, Homo sapiens
tcagggaacatatttaaggaa

SEQ ID NO: 3772841 - DNA, 20 bp, Homo sapiens
tcagggaagcccagctccag

SEQ ID NO: 3772842 - DNA, 21 bp, Homo sapiens
tcagggaagcccagctccagg

SEQ ID NO: 3772843 - DNA, 23 bp, Homo sapiens
tcagggaccaaggacccctcacc

SEQ ID NO: 3772844 - DNA, 12 bp, Homo sapiens
tcagggacccct

SEQ ID NO: 3772845 - DNA, 21 bp, Homo sapiens
tcagggagtgggctaagcacg

SEQ ID NO: 3772846 - DNA, 22 bp, Homo sapiens
tcagggctgacacgtccacccc

SEQ ID NO: 3772847 - DNA, 16 bp, Homo sapiens
tcaggggactcagccc

SEQ ID NO: 3772848 - DNA, 18 bp, Homo sapiens
tcaggggactcagccctg

SEQ ID NO: 3772849 - DNA, 12 bp, Homo sapiens
tcaggggtgtgc

SEQ ID NO: 3772850 - DNA, 16 bp, Homo sapiens
tcaggtaacaggcaga

SEQ ID NO: 3772851 - DNA, 17 bp, Homo sapiens
tcaggtacagagaagga

SEQ ID NO: 3772852 - DNA, 19 bp, Homo sapiens
tcaggtacagagaaggaat

SEQ ID NO: 3772853 - DNA, 18 bp, Homo sapiens
tcaggtcagggtgaggat

SEQ ID NO: 3772854 - DNA, 16 bp, Homo sapiens
tcaggtcctcagagaa

SEQ ID NO: 3772855 - DNA, 16 bp, Homo sapiens
tcaggtgagaagcaga

SEQ ID NO: 3772856 - DNA, 21 bp, Homo sapiens
tcaggtgagaagcagaggaag

SEQ ID NO: 3772857 - DNA, 23 bp, Homo sapiens
tcaggtgagaagcagaggaagga

SEQ ID NO: 3772858 - DNA, 16 bp, Homo sapiens
tcaggtgatccaccca

SEQ ID NO: 3772859 - DNA, 20 bp, Homo sapiens
tcaggtgctgccatccaggt

SEQ ID NO: 3772860 - DNA, 16 bp, Homo sapiens
tcaggtggggcagctt

SEQ ID NO: 3772861 - DNA, 20 bp, Homo sapiens
tcaggtggggcagcttgagg

SEQ ID NO: 3772862 - DNA, 17 bp, Homo sapiens
tcaggtttgcctgaggg

SEQ ID NO: 3772863 - DNA, 15 bp, Homo sapiens
tcagtaacagggcct

SEQ ID NO: 3772864 - DNA, 12 bp, Homo sapiens
tcagtaataaaa

SEQ ID NO: 3772865 - DNA, 13 bp, Homo sapiens
tcagtaataaaac

SEQ ID NO: 3772866 - DNA, 15 bp, Homo sapiens
tcagtacccacctga

SEQ ID NO: 3772867 - DNA, 16 bp, Homo sapiens
tcagtataatttttta

SEQ ID NO: 3772868 - DNA, 17 bp, Homo sapiens
tcagtcccatcagagag

SEQ ID NO: 3772869 - DNA, 18 bp, Homo sapiens
tcagtccccgtgaaggag

SEQ ID NO: 3772870 - DNA, 17 bp, Homo sapiens
tcagtctgattcccaag

SEQ ID NO: 3772871 - DNA, 20 bp, Homo sapiens
tcagtctgcacttaaatatc

SEQ ID NO: 3772872 - DNA, 11 bp, Homo sapiens
tcagtgacaga

SEQ ID NO: 3772873 - DNA, 15 bp, Homo sapiens
tcagtgacagagttc

SEQ ID NO: 3772874 - DNA, 14 bp, Homo sapiens
tcagtgaggcccag

SEQ ID NO: 3772875 - DNA, 18 bp, Homo sapiens
tcagtgaggcccagggag

SEQ ID NO: 3772876 - DNA, 16 bp, Homo sapiens
tcagtgcccaactgtt

SEQ ID NO: 3772877 - DNA, 19 bp, Homo sapiens
tcagtgctgctgaactaat

SEQ ID NO: 3772878 - DNA, 15 bp, Homo sapiens
tcagtgcttcgcaga

SEQ ID NO: 3772879 - DNA, 12 bp, Homo sapiens
tcagtgcttctt

SEQ ID NO: 3772880 - DNA, 19 bp, Homo sapiens
tcagtggactttccacccc

SEQ ID NO: 3772881 - DNA, 15 bp, Homo sapiens
tcagtggcagctgct

SEQ ID NO: 3772882 - DNA, 20 bp, Homo sapiens
tcagtggcatggctccagtc

SEQ ID NO: 3772883 - DNA, 15 bp, Homo sapiens
tcagtgggaacgtga

SEQ ID NO: 3772884 - DNA, 22 bp, Homo sapiens
tcagtgggaacgtgactgcccc

SEQ ID NO: 3772885 - DNA, 12 bp, Homo sapiens
tcagtgggagaa

SEQ ID NO: 3772886 - DNA, 21 bp, Homo sapiens
tcagtgtatggaaataaatgt

SEQ ID NO: 3772887 - DNA, 23 bp, Homo sapiens
tcagtgttaaaaaatttttgaaa

SEQ ID NO: 3772888 - DNA, 15 bp, Homo sapiens
tcagttactcagccc

SEQ ID NO: 3772889 - DNA, 17 bp, Homo sapiens
tcagttactcagccctg

SEQ ID NO: 3772890 - DNA, 16 bp, Homo sapiens
tcagttactctgaagg

SEQ ID NO: 3772891 - DNA, 17 bp, Homo sapiens
tcagttactctgaaggg

SEQ ID NO: 3772892 - DNA, 20 bp, Homo sapiens
tcagttcccccagtacctcc

SEQ ID NO: 3772893 - DNA, 15 bp, Homo sapiens
tcagttcccttggcc

SEQ ID NO: 3772894 - DNA, 17 bp, Homo sapiens
tcagttcccttggcctc

SEQ ID NO: 3772895 - DNA, 23 bp, Homo sapiens
tcagtttatccaaggtgtaactc

SEQ ID NO: 3772896 - DNA, 19 bp, Homo sapiens
tcagtttgctagcagaaat

SEQ ID NO: 3772897 - DNA, 14 bp, Homo sapiens
tcagttttatcttt

SEQ ID NO: 3772898 - DNA, 12 bp, Homo sapiens
tcataaaataaa

SEQ ID NO: 3772899 - DNA, 16 bp, Homo sapiens
tcataaactgtgtgca

SEQ ID NO: 3772900 - DNA, 16 bp, Homo sapiens
tcataacagtgccatt

SEQ ID NO: 3772901 - DNA, 20 bp, Homo sapiens
tcataacagtgccattgtct

SEQ ID NO: 3772902 - DNA, 19 bp, Homo sapiens
tcataataaatatctgtac

SEQ ID NO: 3772903 - DNA, 16 bp, Homo sapiens
tcatacagaaggtggg

SEQ ID NO: 3772904 - DNA, 22 bp, Homo sapiens
tcataccaggccgccccagcct

SEQ ID NO: 3772905 - DNA, 22 bp, Homo sapiens
tcatagaaatgtaacttttgta

SEQ ID NO: 3772906 - DNA, 23 bp, Homo sapiens
tcatagaaatgtaacttttgtaa

SEQ ID NO: 3772907 - DNA, 21 bp, Homo sapiens
tcatagctggttcctgctaga

SEQ ID NO: 3772908 - DNA, 17 bp, Homo sapiens
tcatagggtctcttcag

SEQ ID NO: 3772909 - DNA, 18 bp, Homo sapiens
tcatagggtctcttcagg

SEQ ID NO: 3772910 - DNA, 20 bp, Homo sapiens
tcatagggtctcttcaggtt

SEQ ID NO: 3772911 - DNA, 21 bp, Homo sapiens
tcatagggtctcttcaggttc

SEQ ID NO: 3772912 - DNA, 20 bp, Homo sapiens
tcatagtactctttgtagca

SEQ ID NO: 3772913 - DNA, 14 bp, Homo sapiens
tcatatatatacat

SEQ ID NO: 3772914 - DNA, 22 bp, Homo sapiens
tcatatatggggggccaacacc

SEQ ID NO: 3772915 - DNA, 23 bp, Homo sapiens
tcatatttacttcttatacattt

SEQ ID NO: 3772916 - DNA, 13 bp, Homo sapiens
tcatcataaaata

SEQ ID NO: 3772917 - DNA, 15 bp, Homo sapiens
tcatcataaaataaa

SEQ ID NO: 3772918 - DNA, 19 bp, Homo sapiens
tcatccaatcctcactggg

SEQ ID NO: 3772919 - DNA, 22 bp, Homo sapiens
tcatccaatcctcactgggtgg

SEQ ID NO: 3772920 - DNA, 17 bp, Homo sapiens
tcatccactgtgccatg

SEQ ID NO: 3772921 - DNA, 18 bp, Homo sapiens
tcatccactgtgccatgt

SEQ ID NO: 3772922 - DNA, 21 bp, Homo sapiens
tcatccctatgggattcagtg

SEQ ID NO: 3772923 - DNA, 19 bp, Homo sapiens
tcatccggcagcctggatg

SEQ ID NO: 3772924 - DNA, 18 bp, Homo sapiens
tcatccttagcaacagcc

SEQ ID NO: 3772925 - DNA, 19 bp, Homo sapiens
tcatccttttctcctatct

SEQ ID NO: 3772926 - DNA, 20 bp, Homo sapiens
tcatcgtaggtgatttgaag

SEQ ID NO: 3772927 - DNA, 17 bp, Homo sapiens
tcatctaccttttctct

SEQ ID NO: 3772928 - DNA, 17 bp, Homo sapiens
tcatctatttctgagaa

SEQ ID NO: 3772929 - DNA, 13 bp, Homo sapiens
tcatctccatcag

SEQ ID NO: 3772930 - DNA, 16 bp, Homo sapiens
tcatctccatcagctg

SEQ ID NO: 3772931 - DNA, 17 bp, Homo sapiens
tcatctccatcagctgt

SEQ ID NO: 3772932 - DNA, 23 bp, Homo sapiens
tcatcttaggttggcaaaaaggc

SEQ ID NO: 3772933 - DNA, 13 bp, Homo sapiens
tcatcttctctgg

SEQ ID NO: 3772934 - DNA, 21 bp, Homo sapiens
tcatcttgaccaagcaggaag

SEQ ID NO: 3772935 - DNA, 22 bp, Homo sapiens
tcatgaaaatcctaccaacctc

SEQ ID NO: 3772936 - DNA, 13 bp, Homo sapiens
tcatgatctccct

SEQ ID NO: 3772937 - DNA, 16 bp, Homo sapiens
tcatgatctccctgcc

SEQ ID NO: 3772938 - DNA, 17 bp, Homo sapiens
tcatgatctccctgccg

SEQ ID NO: 3772939 - DNA, 18 bp, Homo sapiens
tcatgatctccctgccgc

SEQ ID NO: 3772940 - DNA, 13 bp, Homo sapiens
tcatgattagcaa

SEQ ID NO: 3772941 - DNA, 17 bp, Homo sapiens
tcatgatttcatttcaa

SEQ ID NO: 3772942 - DNA, 13 bp, Homo sapiens
tcatgcaatgaca

SEQ ID NO: 3772943 - DNA, 16 bp, Homo sapiens
tcatgcaatgacatct

SEQ ID NO: 3772944 - DNA, 18 bp, Homo sapiens
tcatgccaaccccgccct

SEQ ID NO: 3772945 - DNA, 17 bp, Homo sapiens
tcatgcccaagccctga

SEQ ID NO: 3772946 - DNA, 15 bp, Homo sapiens
tcatggaaatattat

SEQ ID NO: 3772947 - DNA, 21 bp, Homo sapiens
tcatggctaagcttaaaaaaa

SEQ ID NO: 3772948 - DNA, 14 bp, Homo sapiens
tcatgtaaataaat

SEQ ID NO: 3772949 - DNA, 15 bp, Homo sapiens
tcatgtaaataaata

SEQ ID NO: 3772950 - DNA, 16 bp, Homo sapiens
tcatgtgggtgagcca

SEQ ID NO: 3772951 - DNA, 17 bp, Homo sapiens
tcatgtgggtgagccag

SEQ ID NO: 3772952 - DNA, 20 bp, Homo sapiens
tcatgtgggtgagccagtgg

SEQ ID NO: 3772953 - DNA, 22 bp, Homo sapiens
tcatgtgggtgagccagtggaa

SEQ ID NO: 3772954 - DNA, 13 bp, Homo sapiens
tcatgttcctcaa

SEQ ID NO: 3772955 - DNA, 13 bp, Homo sapiens
tcattaccacagg

SEQ ID NO: 3772956 - DNA, 19 bp, Homo sapiens
tcattattggaattaacct

SEQ ID NO: 3772957 - DNA, 18 bp, Homo sapiens
tcattatttattaaattt

SEQ ID NO: 3772958 - DNA, 21 bp, Homo sapiens
tcattcaacccacctgcgtct

SEQ ID NO: 3772959 - DNA, 10 bp, Homo sapiens
tcattcagca

SEQ ID NO: 3772960 - DNA, 12 bp, Homo sapiens
tcattcaggaaa

SEQ ID NO: 3772961 - DNA, 13 bp, Homo sapiens
tcattcaggaaaa

SEQ ID NO: 3772962 - DNA, 17 bp, Homo sapiens
tcattcagtattaaagg

SEQ ID NO: 3772963 - DNA, 18 bp, Homo sapiens
tcattccatgtgcccagt

SEQ ID NO: 3772964 - DNA, 19 bp, Homo sapiens
tcattccatgtgcccagtt

SEQ ID NO: 3772965 - DNA, 14 bp, Homo sapiens
tcattccccaggtg

SEQ ID NO: 3772966 - DNA, 23 bp, Homo sapiens
tcattccccaggtggctgaccca

SEQ ID NO: 3772967 - DNA, 18 bp, Homo sapiens
tcattcctaacacagcat

SEQ ID NO: 3772968 - DNA, 14 bp, Homo sapiens
tcattcctgaaaga

SEQ ID NO: 3772969 - DNA, 22 bp, Homo sapiens
tcattcctgaaagaaacagtta

SEQ ID NO: 3772970 - DNA, 19 bp, Homo sapiens
tcattcctgcctgtctcct

SEQ ID NO: 3772971 - DNA, 23 bp, Homo sapiens
tcattccttgagaaaaacaatga

SEQ ID NO: 3772972 - DNA, 18 bp, Homo sapiens
tcattcttgaaagctgtg

SEQ ID NO: 3772973 - DNA, 18 bp, Homo sapiens
tcattgatatgaaaaata

SEQ ID NO: 3772974 - DNA, 15 bp, Homo sapiens
tcattgccagtgtct

SEQ ID NO: 3772975 - DNA, 20 bp, Homo sapiens
tcattgccagtgtctttctt

SEQ ID NO: 3772976 - DNA, 23 bp, Homo sapiens
tcattgccagtgtctttctttgg

SEQ ID NO: 3772977 - DNA, 17 bp, Homo sapiens
tcattgccttaactgga

SEQ ID NO: 3772978 - DNA, 20 bp, Homo sapiens
tcattgccttaactggagcc

SEQ ID NO: 3772979 - DNA, 23 bp, Homo sapiens
tcattgccttaactggagcccca

SEQ ID NO: 3772980 - DNA, 11 bp, Homo sapiens
tcattgcttta

SEQ ID NO: 3772981 - DNA, 14 bp, Homo sapiens
tcattgtataaaaa

SEQ ID NO: 3772982 - DNA, 15 bp, Homo sapiens
tcattgtataaaaat

SEQ ID NO: 3772983 - DNA, 16 bp, Homo sapiens
tcattgtataaaaata

SEQ ID NO: 3772984 - DNA, 17 bp, Homo sapiens
tcattgtataaaaatag

SEQ ID NO: 3772985 - DNA, 13 bp, Homo sapiens
tcattgtggttat

SEQ ID NO: 3772986 - DNA, 16 bp, Homo sapiens
tcattgtttggcattg

SEQ ID NO: 3772987 - DNA, 15 bp, Homo sapiens
tcatttatccctcaa

SEQ ID NO: 3772988 - DNA, 16 bp, Homo sapiens
tcatttgatgctaaat

SEQ ID NO: 3772989 - DNA, 16 bp, Homo sapiens
tcatttgtcacacact

SEQ ID NO: 3772990 - DNA, 16 bp, Homo sapiens
tcatttgtgtgctcat

SEQ ID NO: 3772991 - DNA, 15 bp, Homo sapiens
tcattttccccccac

SEQ ID NO: 3772992 - DNA, 11 bp, Homo sapiens
tcattttgaag

SEQ ID NO: 3772993 - DNA, 18 bp, Homo sapiens
tcattttgaagctaatta

SEQ ID NO: 3772994 - DNA, 17 bp, Homo sapiens
tcattttgcttcatagc

SEQ ID NO: 3772995 - DNA, 14 bp, Homo sapiens
tcatttttataacc

SEQ ID NO: 3772996 - DNA, 15 bp, Homo sapiens
tcatttttataacca

SEQ ID NO: 3772997 - DNA, 21 bp, Homo sapiens
tccaaacctcctgttagctgt

SEQ ID NO: 3772998 - DNA, 19 bp, Homo sapiens
tccaaactaccttccagtt

SEQ ID NO: 3772999 - DNA, 15 bp, Homo sapiens
tccaaagctttcctg

SEQ ID NO: 3773000 - DNA, 17 bp, Homo sapiens
tccaaagctttcctgga

SEQ ID NO: 3773001 - DNA, 13 bp, Homo sapiens
tccaaaggaggct

SEQ ID NO: 3773002 - DNA, 15 bp, Homo sapiens
tccaaaggaggctgg

SEQ ID NO: 3773003 - DNA, 22 bp, Homo sapiens
tccaaatgtcctccagaagcct

SEQ ID NO: 3773004 - DNA, 19 bp, Homo sapiens
tccaacagctcaagtcttc

SEQ ID NO: 3773005 - DNA, 14 bp, Homo sapiens
tccaacaggagctg

SEQ ID NO: 3773006 - DNA, 15 bp, Homo sapiens
tccaacccatgatga

SEQ ID NO: 3773007 - DNA, 14 bp, Homo sapiens
tccaacgtggccca

SEQ ID NO: 3773008 - DNA, 17 bp, Homo sapiens
tccaacgtggggcagca

SEQ ID NO: 3773009 - DNA, 18 bp, Homo sapiens
tccaacgtggggcagcac

SEQ ID NO: 3773010 - DNA, 11 bp, Homo sapiens
tccaactccag

SEQ ID NO: 3773011 - DNA, 11 bp, Homo sapiens
tccaagacatt

SEQ ID NO: 3773012 - DNA, 15 bp, Homo sapiens
tccaagacattgtca

SEQ ID NO: 3773013 - DNA, 16 bp, Homo sapiens
tccaagacattgtcaa

SEQ ID NO: 3773014 - DNA, 17 bp, Homo sapiens
tccaagacattgtcaat

SEQ ID NO: 3773015 - DNA, 18 bp, Homo sapiens
tccaagcaaatgttacat

SEQ ID NO: 3773016 - DNA, 19 bp, Homo sapiens
tccaagcaaatgttacata

SEQ ID NO: 3773017 - DNA, 23 bp, Homo sapiens
tccaagcaagtagctttccacat

SEQ ID NO: 3773018 - DNA, 11 bp, Homo sapiens
tccaagctggt

SEQ ID NO: 3773019 - DNA, 16 bp, Homo sapiens
tccaagctggtcccac

SEQ ID NO: 3773020 - DNA, 15 bp, Homo sapiens
tccaaggagaaacag

SEQ ID NO: 3773021 - DNA, 20 bp, Homo sapiens
tccaaggagaaacagagaca

SEQ ID NO: 3773022 - DNA, 23 bp, Homo sapiens
tccaaggagaaacagagacaggc

SEQ ID NO: 3773023 - DNA, 15 bp, Homo sapiens
tccaaggagctgaga

SEQ ID NO: 3773024 - DNA, 21 bp, Homo sapiens
tccaaggagctgagaatagaa

SEQ ID NO: 3773025 - DNA, 14 bp, Homo sapiens
tccaagtgtgtgtg

SEQ ID NO: 3773026 - DNA, 16 bp, Homo sapiens
tccaagttggactggg

SEQ ID NO: 3773027 - DNA, 17 bp, Homo sapiens
tccaatcctcactgggt

SEQ ID NO: 3773028 - DNA, 14 bp, Homo sapiens
tccaatcttgtttc

SEQ ID NO: 3773029 - DNA, 22 bp, Homo sapiens
tccaattttctggaatacatga

SEQ ID NO: 3773030 - DNA, 16 bp, Homo sapiens
tccacaagattcccag

SEQ ID NO: 3773031 - DNA, 13 bp, Homo sapiens
tccacacacagag

SEQ ID NO: 3773032 - DNA, 19 bp, Homo sapiens
tccacacacagaggaagag

SEQ ID NO: 3773033 - DNA, 23 bp, Homo sapiens
tccacactcacctctaaaacagt

SEQ ID NO: 3773034 - DNA, 14 bp, Homo sapiens
tccacagtgactcc

SEQ ID NO: 3773035 - DNA, 16 bp, Homo sapiens
tccaccagcctgcact

SEQ ID NO: 3773036 - DNA, 24 bp, Homo sapiens
tccaccatggctaaggcaccagcc

SEQ ID NO: 3773037 - DNA, 12 bp, Homo sapiens
tccacccacctc

SEQ ID NO: 3773038 - DNA, 15 bp, Homo sapiens
tccacccaggagccc

SEQ ID NO: 3773039 - DNA, 17 bp, Homo sapiens
tccacccaggagccccg

SEQ ID NO: 3773040 - DNA, 20 bp, Homo sapiens
tccacccaggagccccgagg

SEQ ID NO: 3773041 - DNA, 18 bp, Homo sapiens
tccacccccgcctccctc

SEQ ID NO: 3773042 - DNA, 13 bp, Homo sapiens
tccaccccctccc

SEQ ID NO: 3773043 - DNA, 18 bp, Homo sapiens
tccaccccctccctggcc

SEQ ID NO: 3773044 - DNA, 20 bp, Homo sapiens
tccaccccctccctggcctg

SEQ ID NO: 3773045 - DNA, 21 bp, Homo sapiens
tccaccccctccctggcctgt

SEQ ID NO: 3773046 - DNA, 12 bp, Homo sapiens
tccaccctgctc

SEQ ID NO: 3773047 - DNA, 12 bp, Homo sapiens
tccaccctggaa

SEQ ID NO: 3773048 - DNA, 15 bp, Homo sapiens
tccacccttggcctg

SEQ ID NO: 3773049 - DNA, 19 bp, Homo sapiens
tccacccttggcctgtctc

SEQ ID NO: 3773050 - DNA, 13 bp, Homo sapiens
tccaccgctgcct

SEQ ID NO: 3773051 - DNA, 12 bp, Homo sapiens
tccacctcagcc

SEQ ID NO: 3773052 - DNA, 17 bp, Homo sapiens
tccacctcagccttgga

SEQ ID NO: 3773053 - DNA, 16 bp, Homo sapiens
tccacctgtctcagcc

SEQ ID NO: 3773054 - DNA, 16 bp, Homo sapiens
tccaccttcccatgcc

SEQ ID NO: 3773055 - DNA, 16 bp, Homo sapiens
tccacgctgtctccag

SEQ ID NO: 3773056 - DNA, 17 bp, Homo sapiens
tccacgctgtctccaga

SEQ ID NO: 3773057 - DNA, 21 bp, Homo sapiens
tccacgctgtctccagacccc

SEQ ID NO: 3773058 - DNA, 17 bp, Homo sapiens
tccacgttcacccctcc

SEQ ID NO: 3773059 - DNA, 13 bp, Homo sapiens
tccactccttcct

SEQ ID NO: 3773060 - DNA, 20 bp, Homo sapiens
tccactctaccctcccaccc

SEQ ID NO: 3773061 - DNA, 21 bp, Homo sapiens
tccactctaccctcccacccc

SEQ ID NO: 3773062 - DNA, 13 bp, Homo sapiens
tccactgccttcg

SEQ ID NO: 3773063 - DNA, 15 bp, Homo sapiens
tccactgccttcgat

SEQ ID NO: 3773064 - DNA, 22 bp, Homo sapiens
tccactgtcactgtttctctgc

SEQ ID NO: 3773065 - DNA, 14 bp, Homo sapiens
tccagaaaggatat

SEQ ID NO: 3773066 - DNA, 17 bp, Homo sapiens
tccagaaaggatattta

SEQ ID NO: 3773067 - DNA, 19 bp, Homo sapiens
tccagaaaggatatttaag

SEQ ID NO: 3773068 - DNA, 22 bp, Homo sapiens
tccagaaaggatatttaagaaa

SEQ ID NO: 3773069 - DNA, 16 bp, Homo sapiens
tccagaagcctctggc

SEQ ID NO: 3773070 - DNA, 16 bp, Homo sapiens
tccagaattgaccttt

SEQ ID NO: 3773071 - DNA, 13 bp, Homo sapiens
tccagacccccac

SEQ ID NO: 3773072 - DNA, 14 bp, Homo sapiens
tccagacccccacc

SEQ ID NO: 3773073 - DNA, 17 bp, Homo sapiens
tccagacccccacccct

SEQ ID NO: 3773074 - DNA, 15 bp, Homo sapiens
tccagacccccagca

SEQ ID NO: 3773075 - DNA, 21 bp, Homo sapiens
tccagacccccagcaaccctc

SEQ ID NO: 3773076 - DNA, 17 bp, Homo sapiens
tccagacccctggcttt

SEQ ID NO: 3773077 - DNA, 15 bp, Homo sapiens
tccagacccggctgc

SEQ ID NO: 3773078 - DNA, 19 bp, Homo sapiens
tccagagagagaagtgccc

SEQ ID NO: 3773079 - DNA, 17 bp, Homo sapiens
tccagagagtggctcct

SEQ ID NO: 3773080 - DNA, 19 bp, Homo sapiens
tccagagagtggctcctcc

SEQ ID NO: 3773081 - DNA, 13 bp, Homo sapiens
tccagccaacccc

SEQ ID NO: 3773082 - DNA, 14 bp, Homo sapiens
tccagccaacccct

SEQ ID NO: 3773083 - DNA, 18 bp, Homo sapiens
tccagccgccattgccac

SEQ ID NO: 3773084 - DNA, 21 bp, Homo sapiens
tccagccgccattgccaccag

SEQ ID NO: 3773085 - DNA, 23 bp, Homo sapiens
tccagccgccattgccaccagga

SEQ ID NO: 3773086 - DNA, 13 bp, Homo sapiens
tccagcctgggca

SEQ ID NO: 3773087 - DNA, 13 bp, Homo sapiens
tccagcctgggtg

SEQ ID NO: 3773088 - DNA, 16 bp, Homo sapiens
tccagctcaccagccc

SEQ ID NO: 3773089 - DNA, 16 bp, Homo sapiens
tccagcttgctcttca

SEQ ID NO: 3773090 - DNA, 17 bp, Homo sapiens
tccagcttgctcttcag

SEQ ID NO: 3773091 - DNA, 17 bp, Homo sapiens
tccaggaaggggctgga

SEQ ID NO: 3773092 - DNA, 22 bp, Homo sapiens
tccaggaatgcctcctccctgg

SEQ ID NO: 3773093 - DNA, 18 bp, Homo sapiens
tccaggagcctgtgcctc

SEQ ID NO: 3773094 - DNA, 22 bp, Homo sapiens
tccaggcaatggcctaaacttc

SEQ ID NO: 3773095 - DNA, 22 bp, Homo sapiens
tccaggcctgtgaggtgcagag

SEQ ID NO: 3773096 - DNA, 18 bp, Homo sapiens
tccagggaagctggccga

SEQ ID NO: 3773097 - DNA, 23 bp, Homo sapiens
tccagggaagctggccgagggtc

SEQ ID NO: 3773098 - DNA, 20 bp, Homo sapiens
tccaggtttaagctgttact

SEQ ID NO: 3773099 - DNA, 21 bp, Homo sapiens
tccagtactggagcttctctt

SEQ ID NO: 3773100 - DNA, 15 bp, Homo sapiens
tccagtcctgctctc

SEQ ID NO: 3773101 - DNA, 21 bp, Homo sapiens
tccagtcctgctctctaccca

SEQ ID NO: 3773102 - DNA, 14 bp, Homo sapiens
tccagtctgctgcc

SEQ ID NO: 3773103 - DNA, 22 bp, Homo sapiens
tccagtctgctgccctccatcc

SEQ ID NO: 3773104 - DNA, 18 bp, Homo sapiens
tccagtgcaacactgaag

SEQ ID NO: 3773105 - DNA, 16 bp, Homo sapiens
tccagtggcctggctc

SEQ ID NO: 3773106 - DNA, 23 bp, Homo sapiens
tccagtggcctggctccgctgtg

SEQ ID NO: 3773107 - DNA, 12 bp, Homo sapiens
tccagtttgttt

SEQ ID NO: 3773108 - DNA, 23 bp, Homo sapiens
tccataatctggactcctctgtc

SEQ ID NO: 3773109 - DNA, 19 bp, Homo sapiens
tccataattatgacagtta

SEQ ID NO: 3773110 - DNA, 20 bp, Homo sapiens
tccatagtatattaaaaatg

SEQ ID NO: 3773111 - DNA, 18 bp, Homo sapiens
tccatatattagcattta

SEQ ID NO: 3773112 - DNA, 14 bp, Homo sapiens
tccatatctaacca

SEQ ID NO: 3773113 - DNA, 22 bp, Homo sapiens
tccatcagcttaggggctgctg

SEQ ID NO: 3773114 - DNA, 15 bp, Homo sapiens
tccatccatctccag

SEQ ID NO: 3773115 - DNA, 15 bp, Homo sapiens
tccatcccagcggct

SEQ ID NO: 3773116 - DNA, 22 bp, Homo sapiens
tccatccctaccccctaagagc

SEQ ID NO: 3773117 - DNA, 19 bp, Homo sapiens
tccatgaaaacgttttatt

SEQ ID NO: 3773118 - DNA, 13 bp, Homo sapiens
tccatgaatgtat

SEQ ID NO: 3773119 - DNA, 16 bp, Homo sapiens
tccatgaatgtatcag

SEQ ID NO: 3773120 - DNA, 15 bp, Homo sapiens
tccatgatggagtca

SEQ ID NO: 3773121 - DNA, 17 bp, Homo sapiens
tccatgctataaaaact

SEQ ID NO: 3773122 - DNA, 20 bp, Homo sapiens
tccatgggaaactttccctt

SEQ ID NO: 3773123 - DNA, 17 bp, Homo sapiens
tccatgggggcagggca

SEQ ID NO: 3773124 - DNA, 20 bp, Homo sapiens
tccatgtactgtagtttttc

SEQ ID NO: 3773125 - DNA, 14 bp, Homo sapiens
tccatgtagcagga

SEQ ID NO: 3773126 - DNA, 15 bp, Homo sapiens
tccatgtagcaggac

SEQ ID NO: 3773127 - DNA, 16 bp, Homo sapiens
tccatgtcgcctctgc

SEQ ID NO: 3773128 - DNA, 14 bp, Homo sapiens
tccatgtgcccagt

SEQ ID NO: 3773129 - DNA, 20 bp, Homo sapiens
tccatgtgggctagttgggc

SEQ ID NO: 3773130 - DNA, 14 bp, Homo sapiens
tccatgtgtgtgca

SEQ ID NO: 3773131 - DNA, 19 bp, Homo sapiens
tccatgttagtttttactt

SEQ ID NO: 3773132 - DNA, 22 bp, Homo sapiens
tccattaacttagcatgtgttg

SEQ ID NO: 3773133 - DNA, 11 bp, Homo sapiens
tccattattta

SEQ ID NO: 3773134 - DNA, 14 bp, Homo sapiens
tccattatttatat

SEQ ID NO: 3773135 - DNA, 15 bp, Homo sapiens
tccattatttatatt

SEQ ID NO: 3773136 - DNA, 14 bp, Homo sapiens
tccattcctcaggg

SEQ ID NO: 3773137 - DNA, 12 bp, Homo sapiens
tccatttctctc

SEQ ID NO: 3773138 - DNA, 16 bp, Homo sapiens
tccatttctctctcca

SEQ ID NO: 3773139 - DNA, 14 bp, Homo sapiens
tccatttgtgtgtg

SEQ ID NO: 3773140 - DNA, 13 bp, Homo sapiens
tcctgtctgccag

SEQ ID NO: 3773141 - DNA, 17 bp, Homo sapiens
tcctgtctttaaggaaa

SEQ ID NO: 3773142 - DNA, 18 bp, Homo sapiens
tcctgtctttaaggaaaa

SEQ ID NO: 3773143 - DNA, 15 bp, Homo sapiens
tcctgtgcatgggtg

SEQ ID NO: 3773144 - DNA, 20 bp, Homo sapiens
tcctgtgcatgggtgaaggg

SEQ ID NO: 3773145 - DNA, 18 bp, Homo sapiens
tcctgtggagatgacttg

SEQ ID NO: 3773146 - DNA, 22 bp, Homo sapiens
tcctgtgtaatcatttcttggg

SEQ ID NO: 3773147 - DNA, 18 bp, Homo sapiens
tcctgtgtggtttagtgt

SEQ ID NO: 3773148 - DNA, 13 bp, Homo sapiens
tcctgtgtgtgcg

SEQ ID NO: 3773149 - DNA, 18 bp, Homo sapiens
tcctgtgtgtgcgcctac

SEQ ID NO: 3773150 - DNA, 12 bp, Homo sapiens
tcctgtgtttct

SEQ ID NO: 3773151 - DNA, 19 bp, Homo sapiens
tcctgtgtttctagggaaa

SEQ ID NO: 3773152 - DNA, 14 bp, Homo sapiens
tcctgttcagcatt

SEQ ID NO: 3773153 - DNA, 16 bp, Homo sapiens
tcctgttcagcattct

SEQ ID NO: 3773154 - DNA, 18 bp, Homo sapiens
tcctgttcagcattctta

SEQ ID NO: 3773155 - DNA, 20 bp, Homo sapiens
tcctgttgttatggaaactg

SEQ ID NO: 3773156 - DNA, 19 bp, Homo sapiens
tcctgtttttgttaacttt

SEQ ID NO: 3773157 - DNA, 15 bp, Homo sapiens
tccttaaactgtgtg

SEQ ID NO: 3773158 - DNA, 18 bp, Homo sapiens
tccttacccatctgcacc

SEQ ID NO: 3773159 - DNA, 17 bp, Homo sapiens
tccttacctcttccgga

SEQ ID NO: 3773160 - DNA, 18 bp, Homo sapiens
tccttagcttagacctca

SEQ ID NO: 3773161 - DNA, 19 bp, Homo sapiens
tccttagcttagacctcag

SEQ ID NO: 3773162 - DNA, 15 bp, Homo sapiens
tccttagtcttctca

SEQ ID NO: 3773163 - DNA, 22 bp, Homo sapiens
tccttagtcttctcatagcatt

SEQ ID NO: 3773164 - DNA, 17 bp, Homo sapiens
tccttatcgaaactcat

SEQ ID NO: 3773165 - DNA, 22 bp, Homo sapiens
tccttatgtatatttaaaagaa

SEQ ID NO: 3773166 - DNA, 14 bp, Homo sapiens
tccttcacatcctg

SEQ ID NO: 3773167 - DNA, 13 bp, Homo sapiens
tccttccaggccc

SEQ ID NO: 3773168 - DNA, 16 bp, Homo sapiens
tccttccaggccccca

SEQ ID NO: 3773169 - DNA, 21 bp, Homo sapiens
tccttcccagctgcccctccc

SEQ ID NO: 3773170 - DNA, 12 bp, Homo sapiens
tccttccctggc

SEQ ID NO: 3773171 - DNA, 21 bp, Homo sapiens
tccttcctcacaccaggcttg

SEQ ID NO: 3773172 - DNA, 20 bp, Homo sapiens
tccttctctcacctcctaaa

SEQ ID NO: 3773173 - DNA, 12 bp, Homo sapiens
tccttctgtcct

SEQ ID NO: 3773174 - DNA, 19 bp, Homo sapiens
tccttctgtcctactctgt

SEQ ID NO: 3773175 - DNA, 13 bp, Homo sapiens
tccttgaccagca

SEQ ID NO: 3773176 - DNA, 21 bp, Homo sapiens
tccttgaccagcagatcccag

SEQ ID NO: 3773177 - DNA, 22 bp, Homo sapiens
tccttgatctgtatatacaata

SEQ ID NO: 3773178 - DNA, 18 bp, Homo sapiens
tccttgcctcctgtgtaa

SEQ ID NO: 3773179 - DNA, 21 bp, Homo sapiens
tccttgctgtcctaggccaca

SEQ ID NO: 3773180 - DNA, 17 bp, Homo sapiens
tccttggcatgccttcc

SEQ ID NO: 3773181 - DNA, 14 bp, Homo sapiens
tccttggggcaggc

SEQ ID NO: 3773182 - DNA, 16 bp, Homo sapiens
tccttggggcaggcag

SEQ ID NO: 3773183 - DNA, 13 bp, Homo sapiens
tccttgtcactgg

SEQ ID NO: 3773184 - DNA, 16 bp, Homo sapiens
tccttgtggcacattt

SEQ ID NO: 3773185 - DNA, 17 bp, Homo sapiens
tcctttaaatccttcca

SEQ ID NO: 3773186 - DNA, 16 bp, Homo sapiens
tcctttaccctcatct

SEQ ID NO: 3773187 - DNA, 17 bp, Homo sapiens
tcctttaccctcatctg

SEQ ID NO: 3773188 - DNA, 13 bp, Homo sapiens
tcctttcccttta

SEQ ID NO: 3773189 - DNA, 15 bp, Homo sapiens
tcctttgcaggctca

SEQ ID NO: 3773190 - DNA, 13 bp, Homo sapiens
tcctttgggaaag

SEQ ID NO: 3773191 - DNA, 13 bp, Homo sapiens
tccttttagccta

SEQ ID NO: 3773192 - DNA, 18 bp, Homo sapiens
tccttttcgcaggattct

SEQ ID NO: 3773193 - DNA, 13 bp, Homo sapiens
tccttttcttgtt

SEQ ID NO: 3773194 - DNA, 18 bp, Homo sapiens
tccttttcttgtttatca

SEQ ID NO: 3773195 - DNA, 23 bp, Homo sapiens
tccttttcttgtttatcagcagt

SEQ ID NO: 3773196 - DNA, 17 bp, Homo sapiens
tccttttgtgtacagtg

SEQ ID NO: 3773197 - DNA, 14 bp, Homo sapiens
tcctttttctttat

SEQ ID NO: 3773198 - DNA, 15 bp, Homo sapiens
tcgaagctcagccca

SEQ ID NO: 3773199 - DNA, 19 bp, Homo sapiens
tcgaagctcagcccacccc

SEQ ID NO: 3773200 - DNA, 17 bp, Homo sapiens
tcgaccaattcaaccct

SEQ ID NO: 3773201 - DNA, 15 bp, Homo sapiens
tcgagaccagcctgg

SEQ ID NO: 3773202 - DNA, 16 bp, Homo sapiens
tcgagaccagcctggc

SEQ ID NO: 3773203 - DNA, 17 bp, Homo sapiens
tcgagcagtcctgcctc

SEQ ID NO: 3773204 - DNA, 21 bp, Homo sapiens
tcgagcagtcctgcctcagcc

SEQ ID NO: 3773205 - DNA, 19 bp, Homo sapiens
tcgagctatatttaagtat

SEQ ID NO: 3773206 - DNA, 17 bp, Homo sapiens
tcgaggaaccagagcca

SEQ ID NO: 3773207 - DNA, 18 bp, Homo sapiens
tcgaggcccagcgacctc

SEQ ID NO: 3773208 - DNA, 19 bp, Homo sapiens
tcgatgaagcccaataaac

SEQ ID NO: 3773209 - DNA, 17 bp, Homo sapiens
tcgatgggggatgcttc

SEQ ID NO: 3773210 - DNA, 19 bp, Homo sapiens
tcgatgggggatgcttcat

SEQ ID NO: 3773211 - DNA, 22 bp, Homo sapiens
tcgatgggggatgcttcatgtg

SEQ ID NO: 3773212 - DNA, 18 bp, Homo sapiens
tcgccacccctccttcct

SEQ ID NO: 3773213 - DNA, 18 bp, Homo sapiens
tcgcccaaagccagacag

SEQ ID NO: 3773214 - DNA, 19 bp, Homo sapiens
tcgcccagtctggaatgca

SEQ ID NO: 3773215 - DNA, 14 bp, Homo sapiens
tcgctcctgtgtct

SEQ ID NO: 3773216 - DNA, 14 bp, Homo sapiens
tcgcttcccccata

SEQ ID NO: 3773217 - DNA, 15 bp, Homo sapiens
tcgcttcccccatag

SEQ ID NO: 3773218 - DNA, 14 bp, Homo sapiens
tcggagacagtgat

SEQ ID NO: 3773219 - DNA, 14 bp, Homo sapiens
tcggagccctgtct

SEQ ID NO: 3773220 - DNA, 20 bp, Homo sapiens
tcggagggaattgaggtctg

SEQ ID NO: 3773221 - DNA, 22 bp, Homo sapiens
tcggagggaattgaggtctgct

SEQ ID NO: 3773222 - DNA, 10 bp, Homo sapiens
tcggattaga

SEQ ID NO: 3773223 - DNA, 12 bp, Homo sapiens
tcggcccacagc

SEQ ID NO: 3773224 - DNA, 23 bp, Homo sapiens
tcggcccacagctcccaccccac

SEQ ID NO: 3773225 - DNA, 21 bp, Homo sapiens
tcgggaggtcgaggcaggagg

SEQ ID NO: 3773226 - DNA, 15 bp, Homo sapiens
tcggggaactcctgg

SEQ ID NO: 3773227 - DNA, 14 bp, Homo sapiens
tcggtcctgtctcc

SEQ ID NO: 3773228 - DNA, 18 bp, Homo sapiens
tcggtcctgtctcccctc

SEQ ID NO: 3773229 - DNA, 15 bp, Homo sapiens
tcgtgcactctgcta

SEQ ID NO: 3773230 - DNA, 20 bp, Homo sapiens
tcgtgcactctgctaatcat

SEQ ID NO: 3773231 - DNA, 19 bp, Homo sapiens
tcgtgcagcatatgaggat

SEQ ID NO: 3773232 - DNA, 20 bp, Homo sapiens
tcgtggcagataatcagcct

SEQ ID NO: 3773233 - DNA, 23 bp, Homo sapiens
tcgtggcagataatcagcctctt

SEQ ID NO: 3773234 - DNA, 19 bp, Homo sapiens
tcgtggccttccccagcct

SEQ ID NO: 3773235 - DNA, 22 bp, Homo sapiens
tcgtggtgatcaattaaatgta

SEQ ID NO: 3773236 - DNA, 21 bp, Homo sapiens
tcgttaactgtgtatgtacat

SEQ ID NO: 3773237 - DNA, 20 bp, Homo sapiens
tcgttagggaagagaaacag

SEQ ID NO: 3773238 - DNA, 19 bp, Homo sapiens
tcgttagtatctaacatgt

SEQ ID NO: 3773239 - DNA, 15 bp, Homo sapiens
tcgttcttgttctgt

SEQ ID NO: 3773240 - DNA, 17 bp, Homo sapiens
tcgttcttgttctgttt

SEQ ID NO: 3773241 - DNA, 17 bp, Homo sapiens
tcgtttgaatcacagta

SEQ ID NO: 3773242 - DNA, 14 bp, Homo sapiens
tcgtttgtttgttt

SEQ ID NO: 3773243 - DNA, 14 bp, Homo sapiens
tctaaagtaaaaag

SEQ ID NO: 3773244 - DNA, 17 bp, Homo sapiens
tctaaataaaatataat

SEQ ID NO: 3773245 - DNA, 13 bp, Homo sapiens
tctaaatgaagtg

SEQ ID NO: 3773246 - DNA, 16 bp, Homo sapiens
tctaacaggggctggt

SEQ ID NO: 3773247 - DNA, 14 bp, Homo sapiens
tctaaccaaatgca

SEQ ID NO: 3773248 - DNA, 13 bp, Homo sapiens
tctaacctccttt

SEQ ID NO: 3773249 - DNA, 19 bp, Homo sapiens
tctaactagaaatctgcca

SEQ ID NO: 3773250 - DNA, 17 bp, Homo sapiens
tctaactgtgctcaaga

SEQ ID NO: 3773251 - DNA, 22 bp, Homo sapiens
tctaaggaagatcactttgctc

SEQ ID NO: 3773252 - DNA, 18 bp, Homo sapiens
tctaagtgtttcataaat

SEQ ID NO: 3773253 - DNA, 14 bp, Homo sapiens
tctaatatgtaaca

SEQ ID NO: 3773254 - DNA, 11 bp, Homo sapiens
tctaattctaa

SEQ ID NO: 3773255 - DNA, 12 bp, Homo sapiens
tctaattctaac

SEQ ID NO: 3773256 - DNA, 13 bp, Homo sapiens
tctaattctaacc

SEQ ID NO: 3773257 - DNA, 21 bp, Homo sapiens
tctaattctaaccagagcaag

SEQ ID NO: 3773258 - DNA, 16 bp, Homo sapiens
tctaatttttaagcaa

SEQ ID NO: 3773259 - DNA, 19 bp, Homo sapiens
tctacaagtattctgcctt

SEQ ID NO: 3773260 - DNA, 14 bp, Homo sapiens
tctacactgtgaac

SEQ ID NO: 3773261 - DNA, 21 bp, Homo sapiens
tctacagaggccatgggcctc

SEQ ID NO: 3773262 - DNA, 17 bp, Homo sapiens
tctacagatgtcccatt

SEQ ID NO: 3773263 - DNA, 17 bp, Homo sapiens
tctacagcaaatttata

SEQ ID NO: 3773264 - DNA, 20 bp, Homo sapiens
tctacagctaatcagcattc

SEQ ID NO: 3773265 - DNA, 16 bp, Homo sapiens
tctacatattctttaa

SEQ ID NO: 3773266 - DNA, 20 bp, Homo sapiens
tctaccaactggaagcacag

SEQ ID NO: 3773267 - DNA, 15 bp, Homo sapiens
tctaccatctccctc

SEQ ID NO: 3773268 - DNA, 15 bp, Homo sapiens
tctaccatttcagag

SEQ ID NO: 3773269 - DNA, 17 bp, Homo sapiens
tctaccattttctggtt

SEQ ID NO: 3773270 - DNA, 16 bp, Homo sapiens
tctacccagcccatct

SEQ ID NO: 3773271 - DNA, 15 bp, Homo sapiens
tctaccctcccaccc

SEQ ID NO: 3773272 - DNA, 16 bp, Homo sapiens
tctaccctcccacccc

SEQ ID NO: 3773273 - DNA, 18 bp, Homo sapiens
tctaccctcccaccccct

SEQ ID NO: 3773274 - DNA, 16 bp, Homo sapiens
tctacgctctcctttc

SEQ ID NO: 3773275 - DNA, 18 bp, Homo sapiens
tctactcatatatatcta

SEQ ID NO: 3773276 - DNA, 17 bp, Homo sapiens
tctactcctacctcagc

SEQ ID NO: 3773277 - DNA, 18 bp, Homo sapiens
tctactctagggaaaaac

SEQ ID NO: 3773278 - DNA, 18 bp, Homo sapiens
tctactgaggtgctatgt

SEQ ID NO: 3773279 - DNA, 23 bp, Homo sapiens
tctactggtcttgtggaattggg

SEQ ID NO: 3773280 - DNA, 13 bp, Homo sapiens
tctagaacacagg

SEQ ID NO: 3773281 - DNA, 20 bp, Homo sapiens
tctagaacatccctgccagc

SEQ ID NO: 3773282 - DNA, 21 bp, Homo sapiens
tctagaacatccctgccagct

SEQ ID NO: 3773283 - DNA, 19 bp, Homo sapiens
tctagaagaaatgaaattt

SEQ ID NO: 3773284 - DNA, 20 bp, Homo sapiens
tctagaagactgtcagcttc

SEQ ID NO: 3773285 - DNA, 19 bp, Homo sapiens
tctagaatttatcacactt

SEQ ID NO: 3773286 - DNA, 17 bp, Homo sapiens
tctagacaaccctgcaa

SEQ ID NO: 3773287 - DNA, 21 bp, Homo sapiens
tctagattaccccctcattgt

SEQ ID NO: 3773288 - DNA, 15 bp, Homo sapiens
tctagcaaatgttat

SEQ ID NO: 3773289 - DNA, 16 bp, Homo sapiens
tctagcaaatgttatg

SEQ ID NO: 3773290 - DNA, 16 bp, Homo sapiens
tctagctaatggaaaa

SEQ ID NO: 3773291 - DNA, 18 bp, Homo sapiens
tctagctgttgagctgtt

SEQ ID NO: 3773292 - DNA, 20 bp, Homo sapiens
tctaggagctgggaggaaaa

SEQ ID NO: 3773293 - DNA, 17 bp, Homo sapiens
tctagggaaatgaaaga

SEQ ID NO: 3773294 - DNA, 19 bp, Homo sapiens
tctagggaaggccacctgc

SEQ ID NO: 3773295 - DNA, 17 bp, Homo sapiens
tctagggagagaccctt

SEQ ID NO: 3773296 - DNA, 20 bp, Homo sapiens
tctaggtcaaggcctgtccc

SEQ ID NO: 3773297 - DNA, 18 bp, Homo sapiens
tctaggtcagtacccacc

SEQ ID NO: 3773298 - DNA, 17 bp, Homo sapiens
tctaggtggagttgaaa

SEQ ID NO: 3773299 - DNA, 22 bp, Homo sapiens
tctagtacttgggagacctgta

SEQ ID NO: 3773300 - DNA, 19 bp, Homo sapiens
tctagtgcagctgatttta

SEQ ID NO: 3773301 - DNA, 22 bp, Homo sapiens
tctagtgcagctgattttaaca

SEQ ID NO: 3773302 - DNA, 14 bp, Homo sapiens
tctagttgaggagt

SEQ ID NO: 3773303 - DNA, 19 bp, Homo sapiens
tctagttgaggagtttcct

SEQ ID NO: 3773304 - DNA, 13 bp, Homo sapiens
tctatagactcta

SEQ ID NO: 3773305 - DNA, 16 bp, Homo sapiens
tctatagactctagga

SEQ ID NO: 3773306 - DNA, 20 bp, Homo sapiens
tctataggaacatatgaaaa

SEQ ID NO: 3773307 - DNA, 14 bp, Homo sapiens
tctatcagagaaaa

SEQ ID NO: 3773308 - DNA, 19 bp, Homo sapiens
tctatcgagtttgcaatgt

SEQ ID NO: 3773309 - DNA, 14 bp, Homo sapiens
tctatctcacagca

SEQ ID NO: 3773310 - DNA, 18 bp, Homo sapiens
tctatctcacagcacact

SEQ ID NO: 3773311 - DNA, 16 bp, Homo sapiens
tctatcttatatagtt

SEQ ID NO: 3773312 - DNA, 14 bp, Homo sapiens
tctatgccagctca

SEQ ID NO: 3773313 - DNA, 12 bp, Homo sapiens
tctatgggactc

SEQ ID NO: 3773314 - DNA, 13 bp, Homo sapiens
tctatggtaaaga

SEQ ID NO: 3773315 - DNA, 22 bp, Homo sapiens
tctatggtaaagatattattca

SEQ ID NO: 3773316 - DNA, 13 bp, Homo sapiens
tctattgtaagat

SEQ ID NO: 3773317 - DNA, 14 bp, Homo sapiens
tctatttaaattct

SEQ ID NO: 3773318 - DNA, 13 bp, Homo sapiens
tctatttagcatg

SEQ ID NO: 3773319 - DNA, 22 bp, Homo sapiens
tctatttgtatatatacataac

SEQ ID NO: 3773320 - DNA, 13 bp, Homo sapiens
tctcaaaaaataa

SEQ ID NO: 3773321 - DNA, 21 bp, Homo sapiens
tctcacagtgggagccagggc

SEQ ID NO: 3773322 - DNA, 22 bp, Homo sapiens
tctcacagtgggagccagggct

SEQ ID NO: 3773323 - DNA, 15 bp, Homo sapiens
tctcaccccatccca

SEQ ID NO: 3773324 - DNA, 21 bp, Homo sapiens
tctcaccccatcccacaccct

SEQ ID NO: 3773325 - DNA, 16 bp, Homo sapiens
tctcactatgttgccc

SEQ ID NO: 3773326 - DNA, 22 bp, Homo sapiens
tctcactatgttgcccaggcag

SEQ ID NO: 3773327 - DNA, 23 bp, Homo sapiens
tctcactatgttgcccaggcagg

SEQ ID NO: 3773328 - DNA, 15 bp, Homo sapiens
tctcactccaccacc

SEQ ID NO: 3773329 - DNA, 18 bp, Homo sapiens
tctcactcccttctcctt

SEQ ID NO: 3773330 - DNA, 23 bp, Homo sapiens
tctcactctgtcgcccagtctgg

SEQ ID NO: 3773331 - DNA, 17 bp, Homo sapiens
tctcactggatgcaaag

SEQ ID NO: 3773332 - DNA, 13 bp, Homo sapiens
tctcactgtgtcc

SEQ ID NO: 3773333 - DNA, 14 bp, Homo sapiens
tctcactgttgccc

SEQ ID NO: 3773334 - DNA, 19 bp, Homo sapiens
tctcactgttgcccaggct

SEQ ID NO: 3773335 - DNA, 21 bp, Homo sapiens
tctcagccgcttctgactgct

SEQ ID NO: 3773336 - DNA, 21 bp, Homo sapiens
tctcaggacctagggatgttc

SEQ ID NO: 3773337 - DNA, 15 bp, Homo sapiens
tctcaggagcatggg

SEQ ID NO: 3773338 - DNA, 14 bp, Homo sapiens
tctcaggctctgcc

SEQ ID NO: 3773339 - DNA, 16 bp, Homo sapiens
tctcagggaagcccag

SEQ ID NO: 3773340 - DNA, 22 bp, Homo sapiens
tctcagggaagcccagctccag

SEQ ID NO: 3773341 - DNA, 14 bp, Homo sapiens
tctcagggcctggt

SEQ ID NO: 3773342 - DNA, 19 bp, Homo sapiens
tctcagggcctggtcgttt

SEQ ID NO: 3773343 - DNA, 15 bp, Homo sapiens
tctcaggtccctgca

SEQ ID NO: 3773344 - DNA, 15 bp, Homo sapiens
tctcagtcagtaatt

SEQ ID NO: 3773345 - DNA, 13 bp, Homo sapiens
tctcagtttcact

SEQ ID NO: 3773346 - DNA, 13 bp, Homo sapiens
tctcatagcatta

SEQ ID NO: 3773347 - DNA, 20 bp, Homo sapiens
tctcatagcattaactaatc

SEQ ID NO: 3773348 - DNA, 24 bp, Homo sapiens
tctcatagcattaactaatctatt

SEQ ID NO: 3773349 - DNA, 14 bp, Homo sapiens
tctcatccccaggg

SEQ ID NO: 3773350 - DNA, 12 bp, Homo sapiens
tctcattcagta

SEQ ID NO: 3773351 - DNA, 17 bp, Homo sapiens
tctcattcagtattaaa

SEQ ID NO: 3773352 - DNA, 12 bp, Homo sapiens
tctccaccctgc

SEQ ID NO: 3773353 - DNA, 14 bp, Homo sapiens
tctccaccctgctc

SEQ ID NO: 3773354 - DNA, 17 bp, Homo sapiens
tctccaccctgctctcc

SEQ ID NO: 3773355 - DNA, 15 bp, Homo sapiens
tctccacctcagcct

SEQ ID NO: 3773356 - DNA, 17 bp, Homo sapiens
tctccacctcagccttg

SEQ ID NO: 3773357 - DNA, 19 bp, Homo sapiens
tctccagacccccacccct

SEQ ID NO: 3773358 - DNA, 11 bp, Homo sapiens
tctccaggctg

SEQ ID NO: 3773359 - DNA, 21 bp, Homo sapiens
tctccagggagcaagacagag

SEQ ID NO: 3773360 - DNA, 19 bp, Homo sapiens
tctcccactagacaagtcc

SEQ ID NO: 3773361 - DNA, 18 bp, Homo sapiens
tctcccaggccaggctcc

SEQ ID NO: 3773362 - DNA, 21 bp, Homo sapiens
tctcccatcttaactctttgc

SEQ ID NO: 3773363 - DNA, 12 bp, Homo sapiens
tctccccctggg

SEQ ID NO: 3773364 - DNA, 17 bp, Homo sapiens
tctcccctgccctgctg

SEQ ID NO: 3773365 - DNA, 12 bp, Homo sapiens
tctccctctggc

SEQ ID NO: 3773366 - DNA, 14 bp, Homo sapiens
tctccctctggccc

SEQ ID NO: 3773367 - DNA, 16 bp, Homo sapiens
tctccctctggccctg

SEQ ID NO: 3773368 - DNA, 17 bp, Homo sapiens
tctccctctggccctgc

SEQ ID NO: 3773369 - DNA, 20 bp, Homo sapiens
tctccctctggccctgcctt

SEQ ID NO: 3773370 - DNA, 14 bp, Homo sapiens
tctccctgccgcct

SEQ ID NO: 3773371 - DNA, 17 bp, Homo sapiens
tctccgaccagacacct

SEQ ID NO: 3773372 - DNA, 14 bp, Homo sapiens
tctcctcctgccca

SEQ ID NO: 3773373 - DNA, 16 bp, Homo sapiens
tctcctcctgcccacc

SEQ ID NO: 3773374 - DNA, 16 bp, Homo sapiens
tctcctctcccctcta

SEQ ID NO: 3773375 - DNA, 22 bp, Homo sapiens
tctcctcttaaaaaataaaaac

SEQ ID NO: 3773376 - DNA, 19 bp, Homo sapiens
tctcctgggcccctcccta

SEQ ID NO: 3773377 - DNA, 23 bp, Homo sapiens
tctcctgtgcatgggtgaaggga

SEQ ID NO: 3773378 - DNA, 17 bp, Homo sapiens
tctcctttgcaggctca

SEQ ID NO: 3773379 - DNA, 19 bp, Homo sapiens
tctcggagtatctgggaac

SEQ ID NO: 3773380 - DNA, 21 bp, Homo sapiens
tctctaactcagaaacatcag

SEQ ID NO: 3773381 - DNA, 19 bp, Homo sapiens
tctctacagatgtcccatt

SEQ ID NO: 3773382 - DNA, 20 bp, Homo sapiens
tctctacagatgtcccattt

SEQ ID NO: 3773383 - DNA, 17 bp, Homo sapiens
tctctactaccacaagg

SEQ ID NO: 3773384 - DNA, 19 bp, Homo sapiens
tctctactaccacaaggaa

SEQ ID NO: 3773385 - DNA, 19 bp, Homo sapiens
tctctactcctacctcagc

SEQ ID NO: 3773386 - DNA, 20 bp, Homo sapiens
tctctactcctacctcagcc

SEQ ID NO: 3773387 - DNA, 21 bp, Homo sapiens
tctctactcctacctcagcct

SEQ ID NO: 3773388 - DNA, 13 bp, Homo sapiens
tctctagaatttt

SEQ ID NO: 3773389 - DNA, 14 bp, Homo sapiens
tctctatttaaatt

SEQ ID NO: 3773390 - DNA, 16 bp, Homo sapiens
tctctatttaaattct

SEQ ID NO: 3773391 - DNA, 17 bp, Homo sapiens
tctctatttaaattctt

SEQ ID NO: 3773392 - DNA, 20 bp, Homo sapiens
tctctccatcagaggacacc

SEQ ID NO: 3773393 - DNA, 21 bp, Homo sapiens
tctctccctcccctgccattt

SEQ ID NO: 3773394 - DNA, 20 bp, Homo sapiens
tctctccctccctttgaaat

SEQ ID NO: 3773395 - DNA, 16 bp, Homo sapiens
tctctcctcagactgc

SEQ ID NO: 3773396 - DNA, 14 bp, Homo sapiens
tctctcctgtactt

SEQ ID NO: 3773397 - DNA, 22 bp, Homo sapiens
tctctctactcctacctcagcc

SEQ ID NO: 3773398 - DNA, 12 bp, Homo sapiens
tctctctcctgt

SEQ ID NO: 3773399 - DNA, 22 bp, Homo sapiens
tctctctcctgtactttttcca

SEQ ID NO: 3773400 - DNA, 14 bp, Homo sapiens
tctctctctacaaa

SEQ ID NO: 3773401 - DNA, 15 bp, Homo sapiens
tctctctgcctgtga

SEQ ID NO: 3773402 - DNA, 12 bp, Homo sapiens
tctctctggaaa

SEQ ID NO: 3773403 - DNA, 13 bp, Homo sapiens
tctctctttggac

SEQ ID NO: 3773404 - DNA, 14 bp, Homo sapiens
tctctgaggacact

SEQ ID NO: 3773405 - DNA, 17 bp, Homo sapiens
tctctgaggacactaac

SEQ ID NO: 3773406 - DNA, 19 bp, Homo sapiens
tctctgattttcaaagctt

SEQ ID NO: 3773407 - DNA, 21 bp, Homo sapiens
tctctgcctgtgagccagtct

SEQ ID NO: 3773408 - DNA, 13 bp, Homo sapiens
tctctgctgaagg

SEQ ID NO: 3773409 - DNA, 12 bp, Homo sapiens
tctctgctggcc

SEQ ID NO: 3773410 - DNA, 14 bp, Homo sapiens
tctctgcttcagct

SEQ ID NO: 3773411 - DNA, 16 bp, Homo sapiens
tctctggaaaggagga

SEQ ID NO: 3773412 - DNA, 16 bp, Homo sapiens
tctctggcgacagttt

SEQ ID NO: 3773413 - DNA, 22 bp, Homo sapiens
tctctggcgacagttttccttc

SEQ ID NO: 3773414 - DNA, 21 bp, Homo sapiens
tctctgggcttggggcttcct

SEQ ID NO: 3773415 - DNA, 22 bp, Homo sapiens
tctctgtaataaactcatttct

SEQ ID NO: 3773416 - DNA, 15 bp, Homo sapiens
tctctgtctaccatc

SEQ ID NO: 3773417 - DNA, 14 bp, Homo sapiens
tctcttcaggttct

SEQ ID NO: 3773418 - DNA, 15 bp, Homo sapiens
tctcttcaggttctt

SEQ ID NO: 3773419 - DNA, 16 bp, Homo sapiens
tctcttcaggttctta

SEQ ID NO: 3773420 - DNA, 23 bp, Homo sapiens
tctcttcaggttcttagtgtcac

SEQ ID NO: 3773421 - DNA, 15 bp, Homo sapiens
tctcttcctatccca

SEQ ID NO: 3773422 - DNA, 15 bp, Homo sapiens
tctcttctccactgg

SEQ ID NO: 3773423 - DNA, 16 bp, Homo sapiens
tctcttctccactgga

SEQ ID NO: 3773424 - DNA, 19 bp, Homo sapiens
tctcttctgctccaccctt

SEQ ID NO: 3773425 - DNA, 18 bp, Homo sapiens
tctcttgaggccaggagt

SEQ ID NO: 3773426 - DNA, 17 bp, Homo sapiens
tctcttggtttccttcc

SEQ ID NO: 3773427 - DNA, 22 bp, Homo sapiens
tctctttaatgtcacaggcagg

SEQ ID NO: 3773428 - DNA, 23 bp, Homo sapiens
tctctttctccttagtcttctca

SEQ ID NO: 3773429 - DNA, 21 bp, Homo sapiens
tctctttggactctcccctct

SEQ ID NO: 3773430 - DNA, 15 bp, Homo sapiens
tctgaaactaatgaa

SEQ ID NO: 3773431 - DNA, 12 bp, Homo sapiens
tctgaaagccac

SEQ ID NO: 3773432 - DNA, 15 bp, Homo sapiens
tctgaacacgaagct

SEQ ID NO: 3773433 - DNA, 22 bp, Homo sapiens
tctgaagagtgggtttcacaag

SEQ ID NO: 3773434 - DNA, 21 bp, Homo sapiens
tctgaaggacattgcggacag

SEQ ID NO: 3773435 - DNA, 16 bp, Homo sapiens
tctgaagtcactgcac

SEQ ID NO: 3773436 - DNA, 18 bp, Homo sapiens
tctgaagtttcatttatg

SEQ ID NO: 3773437 - DNA, 17 bp, Homo sapiens
tctgaatacctctttga

SEQ ID NO: 3773438 - DNA, 20 bp, Homo sapiens
tctgaatgtaatttgtgtaa

SEQ ID NO: 3773439 - DNA, 23 bp, Homo sapiens
tctgaatgtaatttgtgtaataa

SEQ ID NO: 3773440 - DNA, 12 bp, Homo sapiens
tctgaatgttct

SEQ ID NO: 3773441 - DNA, 14 bp, Homo sapiens
tctgaatgttctga

SEQ ID NO: 3773442 - DNA, 19 bp, Homo sapiens
tctgaatgttctgacatta

SEQ ID NO: 3773443 - DNA, 23 bp, Homo sapiens
tctgaatgttctgacattaacag

SEQ ID NO: 3773444 - DNA, 14 bp, Homo sapiens
tctgacacaaaaaa

SEQ ID NO: 3773445 - DNA, 22 bp, Homo sapiens
tctgacattaacagttttccat

SEQ ID NO: 3773446 - DNA, 14 bp, Homo sapiens
tctgaccatttcag

SEQ ID NO: 3773447 - DNA, 15 bp, Homo sapiens
tctgacccactgctt

SEQ ID NO: 3773448 - DNA, 19 bp, Homo sapiens
tctgaccctgcttcaaata

SEQ ID NO: 3773449 - DNA, 12 bp, Homo sapiens
tctgacctgcag

SEQ ID NO: 3773450 - DNA, 17 bp, Homo sapiens
tctgacctgcaggccaa

SEQ ID NO: 3773451 - DNA, 12 bp, Homo sapiens
tctgactcccaa

SEQ ID NO: 3773452 - DNA, 19 bp, Homo sapiens
tctgactcccaaagagctg

SEQ ID NO: 3773453 - DNA, 23 bp, Homo sapiens
tctgacttccccgcattccaggc

SEQ ID NO: 3773454 - DNA, 24 bp, Homo sapiens
tctgagatcaaaacggttttactg

SEQ ID NO: 3773455 - DNA, 20 bp, Homo sapiens
tctgagattattttaatcta

SEQ ID NO: 3773456 - DNA, 15 bp, Homo sapiens
tctgagcccctggga

SEQ ID NO: 3773457 - DNA, 16 bp, Homo sapiens
tctgagcccctgggac

SEQ ID NO: 3773458 - DNA, 21 bp, Homo sapiens
tctgaggaatcaacagggcag

SEQ ID NO: 3773459 - DNA, 16 bp, Homo sapiens
tctgaggaatccagac

SEQ ID NO: 3773460 - DNA, 21 bp, Homo sapiens
tctgaggaatccagacccggc

SEQ ID NO: 3773461 - DNA, 23 bp, Homo sapiens
tctgaggaatccagacccggctg

SEQ ID NO: 3773462 - DNA, 23 bp, Homo sapiens
tctgaggcctcctctctcagttt

SEQ ID NO: 3773463 - DNA, 23 bp, Homo sapiens
tctgagtatctcctcgcaagctg

SEQ ID NO: 3773464 - DNA, 12 bp, Homo sapiens
tctgatgaatct

SEQ ID NO: 3773465 - DNA, 16 bp, Homo sapiens
tctgatgcaagcaaga

SEQ ID NO: 3773466 - DNA, 15 bp, Homo sapiens
tctgatgtaaatgaa

SEQ ID NO: 3773467 - DNA, 21 bp, Homo sapiens
tctgattcccaagctctgctc

SEQ ID NO: 3773468 - DNA, 14 bp, Homo sapiens
tctgcaaatagaaa

SEQ ID NO: 3773469 - DNA, 16 bp, Homo sapiens
tctgcaaatagaaaac

SEQ ID NO: 3773470 - DNA, 20 bp, Homo sapiens
tctgcaagcacatctgcatt

SEQ ID NO: 3773471 - DNA, 18 bp, Homo sapiens
tctgcacccccctgggct

SEQ ID NO: 3773472 - DNA, 16 bp, Homo sapiens
tctgcaccttatctta

SEQ ID NO: 3773473 - DNA, 19 bp, Homo sapiens
tctgcaggatgattgtaca

SEQ ID NO: 3773474 - DNA, 14 bp, Homo sapiens
tctgcaggcagggc

SEQ ID NO: 3773475 - DNA, 19 bp, Homo sapiens
tctgcatcatctgtagata

SEQ ID NO: 3773476 - DNA, 16 bp, Homo sapiens
tctgcattctagtact

SEQ ID NO: 3773477 - DNA, 14 bp, Homo sapiens
tctgcatttagcac

SEQ ID NO: 3773478 - DNA, 17 bp, Homo sapiens
tctgcattttcacccca

SEQ ID NO: 3773479 - DNA, 21 bp, Homo sapiens
tctgcattttctgaaactaat

SEQ ID NO: 3773480 - DNA, 16 bp, Homo sapiens
tctgcattttctgggt

SEQ ID NO: 3773481 - DNA, 23 bp, Homo sapiens
tctgccacctcccctatccaccc

SEQ ID NO: 3773482 - DNA, 13 bp, Homo sapiens
tctgccagccaca

SEQ ID NO: 3773483 - DNA, 17 bp, Homo sapiens
tctgccagccagcagcc

SEQ ID NO: 3773484 - DNA, 14 bp, Homo sapiens
tctgccagggagct

SEQ ID NO: 3773485 - DNA, 18 bp, Homo sapiens
tctgcccacattggaccc

SEQ ID NO: 3773486 - DNA, 18 bp, Homo sapiens
tctgcccagagctgggtg

SEQ ID NO: 3773487 - DNA, 16 bp, Homo sapiens
tctgccccagctctgg

SEQ ID NO: 3773488 - DNA, 20 bp, Homo sapiens
tctgccccagctctggcttc

SEQ ID NO: 3773489 - DNA, 22 bp, Homo sapiens
tctgcccctcccccaaccccca

SEQ ID NO: 3773490 - DNA, 16 bp, Homo sapiens
tctgccggccctgggg

SEQ ID NO: 3773491 - DNA, 16 bp, Homo sapiens
tctgcctcaatgtgaa

SEQ ID NO: 3773492 - DNA, 21 bp, Homo sapiens
tctgcctcaatgtgaatcaga

SEQ ID NO: 3773493 - DNA, 20 bp, Homo sapiens
tctgcctgaagtcacacagt

SEQ ID NO: 3773494 - DNA, 22 bp, Homo sapiens
tctgcctgcccaggcccctgcc

SEQ ID NO: 3773495 - DNA, 17 bp, Homo sapiens
tctgcctgtgagccagt

SEQ ID NO: 3773496 - DNA, 13 bp, Homo sapiens
tctgcctttgcag

SEQ ID NO: 3773497 - DNA, 22 bp, Homo sapiens
tctgcgtggttcctttctcagc

SEQ ID NO: 3773498 - DNA, 22 bp, Homo sapiens
tctgctaagctcaaggcgtgag

SEQ ID NO: 3773499 - DNA, 14 bp, Homo sapiens
tctgctaataaaac

SEQ ID NO: 3773500 - DNA, 19 bp, Homo sapiens
tctgctcacatatctgtca

SEQ ID NO: 3773501 - DNA, 20 bp, Homo sapiens
tctgctcacatatctgtcat

SEQ ID NO: 3773502 - DNA, 10 bp, Homo sapiens
tctgctccac

SEQ ID NO: 3773503 - DNA, 18 bp, Homo sapiens
tctgctccacccttggcc

SEQ ID NO: 3773504 - DNA, 21 bp, Homo sapiens
tctgctcctctccccagcaag

SEQ ID NO: 3773505 - DNA, 15 bp, Homo sapiens
tctgctcggccgtct

SEQ ID NO: 3773506 - DNA, 21 bp, Homo sapiens
tctgctgacagacacaggccc

SEQ ID NO: 3773507 - DNA, 18 bp, Homo sapiens
tctgctgccctccatccc

SEQ ID NO: 3773508 - DNA, 18 bp, Homo sapiens
tctgctggataaaatgag

SEQ ID NO: 3773509 - DNA, 23 bp, Homo sapiens
tctgctggccgggcacagctgtg

SEQ ID NO: 3773510 - DNA, 17 bp, Homo sapiens
tctgctggtcttcaatt

SEQ ID NO: 3773511 - DNA, 13 bp, Homo sapiens
tctgcttcagctt

SEQ ID NO: 3773512 - DNA, 14 bp, Homo sapiens
tctgcttcagcttg

SEQ ID NO: 3773513 - DNA, 15 bp, Homo sapiens
tctgcttctgcacct

SEQ ID NO: 3773514 - DNA, 14 bp, Homo sapiens
tctggaaaggagga

SEQ ID NO: 3773515 - DNA, 14 bp, Homo sapiens
tctggaatacatga

SEQ ID NO: 3773516 - DNA, 22 bp, Homo sapiens
tctggaatacatgaaatataga

SEQ ID NO: 3773517 - DNA, 15 bp, Homo sapiens
tctggaatgtaatca

SEQ ID NO: 3773518 - DNA, 16 bp, Homo sapiens
tctggaatgtaatcaa

SEQ ID NO: 3773519 - DNA, 22 bp, Homo sapiens
tctggaatgtaatcaatgtttc

SEQ ID NO: 3773520 - DNA, 20 bp, Homo sapiens
tctggactgaagcctgcagg

SEQ ID NO: 3773521 - DNA, 11 bp, Homo sapiens
tctggagaagc

SEQ ID NO: 3773522 - DNA, 15 bp, Homo sapiens
tctggagaagcagtg

SEQ ID NO: 3773523 - DNA, 16 bp, Homo sapiens
tctggagaagcagtga

SEQ ID NO: 3773524 - DNA, 13 bp, Homo sapiens
tctggagccacct

SEQ ID NO: 3773525 - DNA, 20 bp, Homo sapiens
tctggagccacctgtcccac

SEQ ID NO: 3773526 - DNA, 13 bp, Homo sapiens
tctggagcccttg

SEQ ID NO: 3773527 - DNA, 15 bp, Homo sapiens
tctggaggcctctgg

SEQ ID NO: 3773528 - DNA, 16 bp, Homo sapiens
tctggaggcctctggg

SEQ ID NO: 3773529 - DNA, 17 bp, Homo sapiens
tctggaggcctctgggc

SEQ ID NO: 3773530 - DNA, 14 bp, Homo sapiens
tctggatctgggac

SEQ ID NO: 3773531 - DNA, 18 bp, Homo sapiens
tctggcgacagttttcct

SEQ ID NO: 3773532 - DNA, 18 bp, Homo sapiens
tctggctgaacactggca

SEQ ID NO: 3773533 - DNA, 21 bp, Homo sapiens
tctggctggctaactggaagc

SEQ ID NO: 3773534 - DNA, 19 bp, Homo sapiens
tctggcttcaaatattatg

SEQ ID NO: 3773535 - DNA, 18 bp, Homo sapiens
tctgggaactgtgccttt

SEQ ID NO: 3773536 - DNA, 12 bp, Homo sapiens
tctgggacacag

SEQ ID NO: 3773537 - DNA, 13 bp, Homo sapiens
tctgggacacagt

SEQ ID NO: 3773538 - DNA, 19 bp, Homo sapiens
tctgggaccctttccttcc

SEQ ID NO: 3773539 - DNA, 13 bp, Homo sapiens
tctgggacctcag

SEQ ID NO: 3773540 - DNA, 16 bp, Homo sapiens
tctgggccaagttcct

SEQ ID NO: 3773541 - DNA, 17 bp, Homo sapiens
tctgggctgctacccag

SEQ ID NO: 3773542 - DNA, 19 bp, Homo sapiens
tctgggcttggggcttcct

SEQ ID NO: 3773543 - DNA, 15 bp, Homo sapiens
tctggggctctggga

SEQ ID NO: 3773544 - DNA, 16 bp, Homo sapiens
tctggggttcagcccc

SEQ ID NO: 3773545 - DNA, 23 bp, Homo sapiens
tctggggttcagcccctcctctg

SEQ ID NO: 3773546 - DNA, 16 bp, Homo sapiens
tctgggttcactgcaa

SEQ ID NO: 3773547 - DNA, 16 bp, Homo sapiens
tctgggttctgggtgg

SEQ ID NO: 3773548 - DNA, 16 bp, Homo sapiens
tctggtagatagaaat

SEQ ID NO: 3773549 - DNA, 18 bp, Homo sapiens
tctggtagatagaaataa

SEQ ID NO: 3773550 - DNA, 13 bp, Homo sapiens
tctggtcccttgc

SEQ ID NO: 3773551 - DNA, 15 bp, Homo sapiens
tctggtctctctatt

SEQ ID NO: 3773552 - DNA, 18 bp, Homo sapiens
tctggtgacaccagcctt

SEQ ID NO: 3773553 - DNA, 16 bp, Homo sapiens
tctggtggtctctgct

SEQ ID NO: 3773554 - DNA, 18 bp, Homo sapiens
tctggttagctcagcccc

SEQ ID NO: 3773555 - DNA, 23 bp, Homo sapiens
tctgtaataaactcatttctagc

SEQ ID NO: 3773556 - DNA, 17 bp, Homo sapiens
tctgtacgtctgacagg

SEQ ID NO: 3773557 - DNA, 13 bp, Homo sapiens
tctgtagctcctc

SEQ ID NO: 3773558 - DNA, 23 bp, Homo sapiens
tctgtagctcctcaactcaccta

SEQ ID NO: 3773559 - DNA, 19 bp, Homo sapiens
tctgtagtactccttaaga

SEQ ID NO: 3773560 - DNA, 23 bp, Homo sapiens
tctgtatttatgtgtgaggagct

SEQ ID NO: 3773561 - DNA, 18 bp, Homo sapiens
tctgtcatatcttcacaa

SEQ ID NO: 3773562 - DNA, 23 bp, Homo sapiens
tctgtcatttgagcagggctcag

SEQ ID NO: 3773563 - DNA, 17 bp, Homo sapiens
tctgtccaaaggaggct

SEQ ID NO: 3773564 - DNA, 19 bp, Homo sapiens
tctgtccaaaggaggctgg

SEQ ID NO: 3773565 - DNA, 19 bp, Homo sapiens
tctgtccagggccctgagc

SEQ ID NO: 3773566 - DNA, 20 bp, Homo sapiens
tctgtcctactctgtgtcag

SEQ ID NO: 3773567 - DNA, 14 bp, Homo sapiens
tctgtcgcccagtc

SEQ ID NO: 3773568 - DNA, 16 bp, Homo sapiens
tctgtcgcccagtctg

SEQ ID NO: 3773569 - DNA, 17 bp, Homo sapiens
tctgtcgcccagtctgg

SEQ ID NO: 3773570 - DNA, 22 bp, Homo sapiens
tctgtctccctataatgctgga

SEQ ID NO: 3773571 - DNA, 12 bp, Homo sapiens
tctgtcttcaca

SEQ ID NO: 3773572 - DNA, 14 bp, Homo sapiens
tctgtcttcacagc

SEQ ID NO: 3773573 - DNA, 15 bp, Homo sapiens
tctgtcttcacagct

SEQ ID NO: 3773574 - DNA, 12 bp, Homo sapiens
tctgtgcaataa

SEQ ID NO: 3773575 - DNA, 13 bp, Homo sapiens
tctgtgcccagct

SEQ ID NO: 3773576 - DNA, 16 bp, Homo sapiens
tctgtgcccagctcag

SEQ ID NO: 3773577 - DNA, 14 bp, Homo sapiens
tctgtgccccatgc

SEQ ID NO: 3773578 - DNA, 16 bp, Homo sapiens
tctgtgcgtgaaacac

SEQ ID NO: 3773579 - DNA, 15 bp, Homo sapiens
tctgtggccttgttc

SEQ ID NO: 3773580 - DNA, 17 bp, Homo sapiens
tctgtgtcaggtggggc

SEQ ID NO: 3773581 - DNA, 22 bp, Homo sapiens
tctgtgtcaggtggggcagctt

SEQ ID NO: 3773582 - DNA, 12 bp, Homo sapiens
tctgtgtctctt

SEQ ID NO: 3773583 - DNA, 17 bp, Homo sapiens
tctgttaagtggtttca

SEQ ID NO: 3773584 - DNA, 16 bp, Homo sapiens
tctgttcaaggaatca

SEQ ID NO: 3773585 - DNA, 22 bp, Homo sapiens
tctgttcacttttcctccctca

SEQ ID NO: 3773586 - DNA, 12 bp, Homo sapiens
tctgttgaagtt

SEQ ID NO: 3773587 - DNA, 19 bp, Homo sapiens
tctgttggccagtgtgaca

SEQ ID NO: 3773588 - DNA, 12 bp, Homo sapiens
tctgtttgttaa

SEQ ID NO: 3773589 - DNA, 13 bp, Homo sapiens
tctgtttgttaaa

SEQ ID NO: 3773590 - DNA, 14 bp, Homo sapiens
tctgtttgttaaaa

SEQ ID NO: 3773591 - DNA, 16 bp, Homo sapiens
tctgtttttaaaaatc

SEQ ID NO: 3773592 - DNA, 13 bp, Homo sapiens
tcttaaaaagtgg

SEQ ID NO: 3773593 - DNA, 22 bp, Homo sapiens
tcttaaaaagttataaccaact

SEQ ID NO: 3773594 - DNA, 19 bp, Homo sapiens
tcttaaagctgcctgtagt

SEQ ID NO: 3773595 - DNA, 20 bp, Homo sapiens
tcttaaagctgcctgtagtt

SEQ ID NO: 3773596 - DNA, 21 bp, Homo sapiens
tcttaaagctgcctgtagtta

SEQ ID NO: 3773597 - DNA, 15 bp, Homo sapiens
tcttaaataaaagaa

SEQ ID NO: 3773598 - DNA, 19 bp, Homo sapiens
tcttaaataaaagaaatgc

SEQ ID NO: 3773599 - DNA, 22 bp, Homo sapiens
tcttaaataaaagaaatgcaca

SEQ ID NO: 3773600 - DNA, 15 bp, Homo sapiens
tcttaaataaacctt

SEQ ID NO: 3773601 - DNA, 18 bp, Homo sapiens
tcttaatataactgcctt

SEQ ID NO: 3773602 - DNA, 19 bp, Homo sapiens
tcttaatataactgcctta

SEQ ID NO: 3773603 - DNA, 14 bp, Homo sapiens
tcttaattaagtaa

SEQ ID NO: 3773604 - DNA, 20 bp, Homo sapiens
tcttaattaagtaaactaat

SEQ ID NO: 3773605 - DNA, 23 bp, Homo sapiens
tcttaatttaatcttttttatgt

SEQ ID NO: 3773606 - DNA, 14 bp, Homo sapiens
tcttacatgttttc

SEQ ID NO: 3773607 - DNA, 20 bp, Homo sapiens
tcttacccttctgtgcccag

SEQ ID NO: 3773608 - DNA, 23 bp, Homo sapiens
tcttacctgtatgtctccagtat

SEQ ID NO: 3773609 - DNA, 23 bp, Homo sapiens
tcttactattaagcagtaaaaac

SEQ ID NO: 3773610 - DNA, 13 bp, Homo sapiens
tcttactgaaggt

SEQ ID NO: 3773611 - DNA, 12 bp, Homo sapiens
tcttactgcttg

SEQ ID NO: 3773612 - DNA, 20 bp, Homo sapiens
tcttacttattatcttcagg

SEQ ID NO: 3773613 - DNA, 19 bp, Homo sapiens
tcttagaagtggaccagga

SEQ ID NO: 3773614 - DNA, 23 bp, Homo sapiens
tcttagacttgaaatactactta

SEQ ID NO: 3773615 - DNA, 15 bp, Homo sapiens
tcttagctgtctgct

SEQ ID NO: 3773616 - DNA, 18 bp, Homo sapiens
tcttagctgtctgctcag

SEQ ID NO: 3773617 - DNA, 14 bp, Homo sapiens
tcttagtgcctgag

SEQ ID NO: 3773618 - DNA, 15 bp, Homo sapiens
tcttatacatttgat

SEQ ID NO: 3773619 - DNA, 13 bp, Homo sapiens
tcttatagaaagt

SEQ ID NO: 3773620 - DNA, 19 bp, Homo sapiens
tcttatagaatatttatta

SEQ ID NO: 3773621 - DNA, 22 bp, Homo sapiens
tcttatccaacatcaacatctt

SEQ ID NO: 3773622 - DNA, 14 bp, Homo sapiens
tcttatgcaatttc

SEQ ID NO: 3773623 - DNA, 18 bp, Homo sapiens
tcttatgtacctctttta

SEQ ID NO: 3773624 - DNA, 18 bp, Homo sapiens
tcttattcagtaaaaaac

SEQ ID NO: 3773625 - DNA, 18 bp, Homo sapiens
tcttattgcccacgctgg

SEQ ID NO: 3773626 - DNA, 20 bp, Homo sapiens
tcttcaacatcaatgttcat

SEQ ID NO: 3773627 - DNA, 23 bp, Homo sapiens
tcttcaacatcaatgttcattgt

SEQ ID NO: 3773628 - DNA, 16 bp, Homo sapiens
tcttcaactgaccagc

SEQ ID NO: 3773629 - DNA, 19 bp, Homo sapiens
tcttcaactgaccagcctc

SEQ ID NO: 3773630 - DNA, 20 bp, Homo sapiens
tcttcaatttgtataaaatg

SEQ ID NO: 3773631 - DNA, 23 bp, Homo sapiens
tcttcacctaagtctctgtgaat

SEQ ID NO: 3773632 - DNA, 16 bp, Homo sapiens
tcttcagccacctctc

SEQ ID NO: 3773633 - DNA, 15 bp, Homo sapiens
tcttcagtaagccgt

SEQ ID NO: 3773634 - DNA, 16 bp, Homo sapiens
tcttcagtaagccgtg

SEQ ID NO: 3773635 - DNA, 20 bp, Homo sapiens
tcttcatccggcagcctgga

SEQ ID NO: 3773636 - DNA, 21 bp, Homo sapiens
tcttcatccttagcaacagcc

SEQ ID NO: 3773637 - DNA, 17 bp, Homo sapiens
tcttcccatcactggag

SEQ ID NO: 3773638 - DNA, 14 bp, Homo sapiens
tcttccccactccc

SEQ ID NO: 3773639 - DNA, 16 bp, Homo sapiens
tcttccccctctccca

SEQ ID NO: 3773640 - DNA, 19 bp, Homo sapiens
tcttcccgaaccccaagga

SEQ ID NO: 3773641 - DNA, 19 bp, Homo sapiens
tcttccctacagttgaaaa

SEQ ID NO: 3773642 - DNA, 14 bp, Homo sapiens
tcttccctacctca

SEQ ID NO: 3773643 - DNA, 13 bp, Homo sapiens
tcttcccttaaaa

SEQ ID NO: 3773644 - DNA, 19 bp, Homo sapiens
tcttcccttttacatactg

SEQ ID NO: 3773645 - DNA, 22 bp, Homo sapiens
tcttcccttttacatactgctg

SEQ ID NO: 3773646 - DNA, 21 bp, Homo sapiens
tcttcctagttttctcctccc

SEQ ID NO: 3773647 - DNA, 16 bp, Homo sapiens
tcttcctatcccatcc

SEQ ID NO: 3773648 - DNA, 17 bp, Homo sapiens
tcttcctatcccatccc

SEQ ID NO: 3773649 - DNA, 15 bp, Homo sapiens
tcttcctccctccct

SEQ ID NO: 3773650 - DNA, 11 bp, Homo sapiens
tcttcctctgc

SEQ ID NO: 3773651 - DNA, 14 bp, Homo sapiens
tcttctaccaccca

SEQ ID NO: 3773652 - DNA, 12 bp, Homo sapiens
tcttctcaaagg

SEQ ID NO: 3773653 - DNA, 16 bp, Homo sapiens
tcttctcatagcatta

SEQ ID NO: 3773654 - DNA, 17 bp, Homo sapiens
tcttctcatagcattaa

SEQ ID NO: 3773655 - DNA, 18 bp, Homo sapiens
tcttctcatagcattaac

SEQ ID NO: 3773656 - DNA, 13 bp, Homo sapiens
tcttctccactgg

SEQ ID NO: 3773657 - DNA, 16 bp, Homo sapiens
tcttctccactggatg

SEQ ID NO: 3773658 - DNA, 19 bp, Homo sapiens
tcttctccatcctaccaca

SEQ ID NO: 3773659 - DNA, 14 bp, Homo sapiens
tcttctccatctgg

SEQ ID NO: 3773660 - DNA, 13 bp, Homo sapiens
tcttctgctccac

SEQ ID NO: 3773661 - DNA, 17 bp, Homo sapiens
tcttctgctccaccctt

SEQ ID NO: 3773662 - DNA, 20 bp, Homo sapiens
tcttctgctccacccttggc

SEQ ID NO: 3773663 - DNA, 22 bp, Homo sapiens
tcttctgcttcagcctcccgag

SEQ ID NO: 3773664 - DNA, 23 bp, Homo sapiens
tcttctgtacgtctgacaggcaa

SEQ ID NO: 3773665 - DNA, 13 bp, Homo sapiens
tcttcttaactta

SEQ ID NO: 3773666 - DNA, 15 bp, Homo sapiens
tcttcttacatgcat

SEQ ID NO: 3773667 - DNA, 14 bp, Homo sapiens
tcttcttcagaaga

SEQ ID NO: 3773668 - DNA, 16 bp, Homo sapiens
tcttcttcagaagaca

SEQ ID NO: 3773669 - DNA, 15 bp, Homo sapiens
tcttcttcttcagaa

SEQ ID NO: 3773670 - DNA, 13 bp, Homo sapiens
tcttgaaatgaaa

SEQ ID NO: 3773671 - DNA, 17 bp, Homo sapiens
tcttgaactcctggcct

SEQ ID NO: 3773672 - DNA, 21 bp, Homo sapiens
tcttgaagtgatgttgtttaa

SEQ ID NO: 3773673 - DNA, 16 bp, Homo sapiens
tcttgagcctgggagg

SEQ ID NO: 3773674 - DNA, 15 bp, Homo sapiens
tcttgaggccaggag

SEQ ID NO: 3773675 - DNA, 21 bp, Homo sapiens
tcttgagttttgttttaaaat

SEQ ID NO: 3773676 - DNA, 21 bp, Homo sapiens
tcttgatttgttttagaatga

SEQ ID NO: 3773677 - DNA, 13 bp, Homo sapiens
tcttgcaatggca

SEQ ID NO: 3773678 - DNA, 19 bp, Homo sapiens
tcttgcaatggcagccttg

SEQ ID NO: 3773679 - DNA, 14 bp, Homo sapiens
tcttgcagtgatta

SEQ ID NO: 3773680 - DNA, 16 bp, Homo sapiens
tcttgccactgcctct

SEQ ID NO: 3773681 - DNA, 21 bp, Homo sapiens
tcttgctctatctcacagcac

SEQ ID NO: 3773682 - DNA, 11 bp, Homo sapiens
tcttgctctgc

SEQ ID NO: 3773683 - DNA, 12 bp, Homo sapiens
tcttgctctgct

SEQ ID NO: 3773684 - DNA, 15 bp, Homo sapiens
tcttgctctgctgac

SEQ ID NO: 3773685 - DNA, 14 bp, Homo sapiens
tcttgctttctttg

SEQ ID NO: 3773686 - DNA, 16 bp, Homo sapiens
tcttggctggcttcct

SEQ ID NO: 3773687 - DNA, 19 bp, Homo sapiens
tcttggcttactgcagcct

SEQ ID NO: 3773688 - DNA, 12 bp, Homo sapiens
tcttggctttgt

SEQ ID NO: 3773689 - DNA, 13 bp, Homo sapiens
tcttggctttgtt

SEQ ID NO: 3773690 - DNA, 14 bp, Homo sapiens
tcttggtaagaagc

SEQ ID NO: 3773691 - DNA, 15 bp, Homo sapiens
tcttggtttccttcc

SEQ ID NO: 3773692 - DNA, 17 bp, Homo sapiens
tcttgtaagattttgaa

SEQ ID NO: 3773693 - DNA, 15 bp, Homo sapiens
tcttgtaagcaaaag

SEQ ID NO: 3773694 - DNA, 16 bp, Homo sapiens
tcttgtcacaataaat

SEQ ID NO: 3773695 - DNA, 14 bp, Homo sapiens
tcttgtctctgggc

SEQ ID NO: 3773696 - DNA, 18 bp, Homo sapiens
tcttgtgaatatgtacat

SEQ ID NO: 3773697 - DNA, 16 bp, Homo sapiens
tcttgtgactagtgct

SEQ ID NO: 3773698 - DNA, 17 bp, Homo sapiens
tcttgttaatattcttt

SEQ ID NO: 3773699 - DNA, 20 bp, Homo sapiens
tcttgttaatattctttcaa

SEQ ID NO: 3773700 - DNA, 13 bp, Homo sapiens
tcttgttctgttt

SEQ ID NO: 3773701 - DNA, 16 bp, Homo sapiens
tcttgttctgttttgt

SEQ ID NO: 3773702 - DNA, 22 bp, Homo sapiens
tcttgtttttccactactgcta

SEQ ID NO: 3773703 - DNA, 16 bp, Homo sapiens
tctttaactcaggact

SEQ ID NO: 3773704 - DNA, 15 bp, Homo sapiens
tctttaatgtcacag

SEQ ID NO: 3773705 - DNA, 18 bp, Homo sapiens
tctttaatgtcacaggca

SEQ ID NO: 3773706 - DNA, 19 bp, Homo sapiens
tctttaatgtcacaggcag

SEQ ID NO: 3773707 - DNA, 20 bp, Homo sapiens
tctttaatgtcacaggcagg

SEQ ID NO: 3773708 - DNA, 12 bp, Homo sapiens
tctttatatgaa

SEQ ID NO: 3773709 - DNA, 23 bp, Homo sapiens
tctttcacacttccaccagcctg

SEQ ID NO: 3773710 - DNA, 23 bp, Homo sapiens
tctttcacccacagaaagagagc

SEQ ID NO: 3773711 - DNA, 11 bp, Homo sapiens
tctttcagaaa

SEQ ID NO: 3773712 - DNA, 15 bp, Homo sapiens
tctttcagaaaacag

SEQ ID NO: 3773713 - DNA, 20 bp, Homo sapiens
tctttcagaaaacagaaaaa

SEQ ID NO: 3773714 - DNA, 14 bp, Homo sapiens
tcctagataaaaag

SEQ ID NO: 3773715 - DNA, 15 bp, Homo sapiens
tcctagataaaaaga

SEQ ID NO: 3773716 - DNA, 17 bp, Homo sapiens
tcctagataaaaagatg

SEQ ID NO: 3773717 - DNA, 22 bp, Homo sapiens
tcctagcttgggaggcttcccc

SEQ ID NO: 3773718 - DNA, 13 bp, Homo sapiens
tcctagttttctc

SEQ ID NO: 3773719 - DNA, 20 bp, Homo sapiens
tcctagttttctcctcccag

SEQ ID NO: 3773720 - DNA, 20 bp, Homo sapiens
tcctataatataataaatat

SEQ ID NO: 3773721 - DNA, 23 bp, Homo sapiens
tcctatattgttttcagtgtaca

SEQ ID NO: 3773722 - DNA, 17 bp, Homo sapiens
tcctatcacctcccctc

SEQ ID NO: 3773723 - DNA, 19 bp, Homo sapiens
tcctatttctggaatggaa

SEQ ID NO: 3773724 - DNA, 12 bp, Homo sapiens
tcctcacctctg

SEQ ID NO: 3773725 - DNA, 13 bp, Homo sapiens
tcctcacctctgg

SEQ ID NO: 3773726 - DNA, 16 bp, Homo sapiens
tcctcacctctggact

SEQ ID NO: 3773727 - DNA, 12 bp, Homo sapiens
tcctcactccca

SEQ ID NO: 3773728 - DNA, 14 bp, Homo sapiens
tcctcactcccagt

SEQ ID NO: 3773729 - DNA, 15 bp, Homo sapiens
tcctcactgggtggg

SEQ ID NO: 3773730 - DNA, 22 bp, Homo sapiens
tcctcactgggtggggtgagga

SEQ ID NO: 3773731 - DNA, 18 bp, Homo sapiens
tcctcattagcattttgc

SEQ ID NO: 3773732 - DNA, 21 bp, Homo sapiens
tcctcatttggggtagctaga

SEQ ID NO: 3773733 - DNA, 22 bp, Homo sapiens
tcctcatttttataatgtccct

SEQ ID NO: 3773734 - DNA, 16 bp, Homo sapiens
tcctccagaagcctct

SEQ ID NO: 3773735 - DNA, 13 bp, Homo sapiens
tcctcccacctca

SEQ ID NO: 3773736 - DNA, 15 bp, Homo sapiens
tcctcccacctcagc

SEQ ID NO: 3773737 - DNA, 18 bp, Homo sapiens
tcctcccacctcagcctc

SEQ ID NO: 3773738 - DNA, 21 bp, Homo sapiens
tcctcccacctcagcctcccg

SEQ ID NO: 3773739 - DNA, 13 bp, Homo sapiens
tcctccccagcag

SEQ ID NO: 3773740 - DNA, 16 bp, Homo sapiens
tcctccccagcaggtg

SEQ ID NO: 3773741 - DNA, 13 bp, Homo sapiens
tcctccccctgcc

SEQ ID NO: 3773742 - DNA, 14 bp, Homo sapiens
tcctcccctcaagg

SEQ ID NO: 3773743 - DNA, 17 bp, Homo sapiens
tcctccctgatgtacag

SEQ ID NO: 3773744 - DNA, 19 bp, Homo sapiens
tcctccctgggcagaaagt

SEQ ID NO: 3773745 - DNA, 14 bp, Homo sapiens
tcctccgtccagcc

SEQ ID NO: 3773746 - DNA, 16 bp, Homo sapiens
tcctccgtccagccgc

SEQ ID NO: 3773747 - DNA, 18 bp, Homo sapiens
tcctccgtccagccgcca

SEQ ID NO: 3773748 - DNA, 19 bp, Homo sapiens
tcctccttgtcttggcagc

SEQ ID NO: 3773749 - DNA, 14 bp, Homo sapiens
tcctcgcaagctgg

SEQ ID NO: 3773750 - DNA, 16 bp, Homo sapiens
tcctcgcaagctgggt

SEQ ID NO: 3773751 - DNA, 16 bp, Homo sapiens
tcctcggatcaccgag

SEQ ID NO: 3773752 - DNA, 19 bp, Homo sapiens
tcctctcatccttttctcc

SEQ ID NO: 3773753 - DNA, 16 bp, Homo sapiens
tcctctccactgcctt

SEQ ID NO: 3773754 - DNA, 17 bp, Homo sapiens
tcctctccactgccttc

SEQ ID NO: 3773755 - DNA, 20 bp, Homo sapiens
tcctctccgcagttcctgtc

SEQ ID NO: 3773756 - DNA, 18 bp, Homo sapiens
tcctctctaacctccttt

SEQ ID NO: 3773757 - DNA, 15 bp, Homo sapiens
tcctctgccacctcc

SEQ ID NO: 3773758 - DNA, 18 bp, Homo sapiens
tcctctgccacctcccct

SEQ ID NO: 3773759 - DNA, 23 bp, Homo sapiens
tcctctggctggctaactggaag

SEQ ID NO: 3773760 - DNA, 20 bp, Homo sapiens
tcctctgggcaggacctcag

SEQ ID NO: 3773761 - DNA, 19 bp, Homo sapiens
tcctcttgccactgcctct

SEQ ID NO: 3773762 - DNA, 12 bp, Homo sapiens
tcctcttgccat

SEQ ID NO: 3773763 - DNA, 14 bp, Homo sapiens
tcctcttgccatct

SEQ ID NO: 3773764 - DNA, 18 bp, Homo sapiens
tcctctttcagaaaacag

SEQ ID NO: 3773765 - DNA, 21 bp, Homo sapiens
tcctcttttatcttggactga

SEQ ID NO: 3773766 - DNA, 19 bp, Homo sapiens
tcctgaaacttacacacaa

SEQ ID NO: 3773767 - DNA, 18 bp, Homo sapiens
tcctgaaagaaacagtta

SEQ ID NO: 3773768 - DNA, 21 bp, Homo sapiens
tcctgaaagaaacagttaact

SEQ ID NO: 3773769 - DNA, 20 bp, Homo sapiens
tcctgacctgtctcaccatg

SEQ ID NO: 3773770 - DNA, 12 bp, Homo sapiens
tcctgagcttgg

SEQ ID NO: 3773771 - DNA, 16 bp, Homo sapiens
tcctgagcttggccag

SEQ ID NO: 3773772 - DNA, 15 bp, Homo sapiens
tcctgaggggcatct

SEQ ID NO: 3773773 - DNA, 22 bp, Homo sapiens
tcctgaggggcatctgcccctc

SEQ ID NO: 3773774 - DNA, 15 bp, Homo sapiens
tcctgatgacccagg

SEQ ID NO: 3773775 - DNA, 14 bp, Homo sapiens
tcctgcagcctgga

SEQ ID NO: 3773776 - DNA, 13 bp, Homo sapiens
tcctgcccaggag

SEQ ID NO: 3773777 - DNA, 16 bp, Homo sapiens
tcctgcccaggagagc

SEQ ID NO: 3773778 - DNA, 19 bp, Homo sapiens
tcctgcccagtgttgtttg

SEQ ID NO: 3773779 - DNA, 22 bp, Homo sapiens
tcctgcccagtgttgtttgtaa

SEQ ID NO: 3773780 - DNA, 19 bp, Homo sapiens
tcctgcccccacacctggc

SEQ ID NO: 3773781 - DNA, 21 bp, Homo sapiens
tcctgcccccacacctggccc

SEQ ID NO: 3773782 - DNA, 22 bp, Homo sapiens
tcctgccgcccgaggtggctgc

SEQ ID NO: 3773783 - DNA, 12 bp, Homo sapiens
tcctgcctggcc

SEQ ID NO: 3773784 - DNA, 23 bp, Homo sapiens
tcctgcctggtctcctgccccca

SEQ ID NO: 3773785 - DNA, 12 bp, Homo sapiens
tcctgcctgtgc

SEQ ID NO: 3773786 - DNA, 14 bp, Homo sapiens
tcctgcctgtgctg

SEQ ID NO: 3773787 - DNA, 20 bp, Homo sapiens
tcctgcgggcttttccccgg

SEQ ID NO: 3773788 - DNA, 23 bp, Homo sapiens
tcctgcgggcttttccccggtcc

SEQ ID NO: 3773789 - DNA, 18 bp, Homo sapiens
tcctgctactctgttcct

SEQ ID NO: 3773790 - DNA, 13 bp, Homo sapiens
tcctgctagaaat

SEQ ID NO: 3773791 - DNA, 18 bp, Homo sapiens
tcctgctctctacccagc

SEQ ID NO: 3773792 - DNA, 22 bp, Homo sapiens
tcctgctctctacccagcccat

SEQ ID NO: 3773793 - DNA, 24 bp, Homo sapiens
tcctgctctctacccagcccatct

SEQ ID NO: 3773794 - DNA, 16 bp, Homo sapiens
tcctggaaaggctcag

SEQ ID NO: 3773795 - DNA, 19 bp, Homo sapiens
tcctggaaaggctcagtct

SEQ ID NO: 3773796 - DNA, 15 bp, Homo sapiens
tcctggaaatattaa

SEQ ID NO: 3773797 - DNA, 19 bp, Homo sapiens
tcctggagagtctcactcc

SEQ ID NO: 3773798 - DNA, 21 bp, Homo sapiens
tcctggagcccgaggcaccag

SEQ ID NO: 3773799 - DNA, 19 bp, Homo sapiens
tcctggcacccggcccctg

SEQ ID NO: 3773800 - DNA, 21 bp, Homo sapiens
tcctggcacccggcccctgct

SEQ ID NO: 3773801 - DNA, 17 bp, Homo sapiens
tcctggcccactgcatc

SEQ ID NO: 3773802 - DNA, 20 bp, Homo sapiens
tcctggctacatcccagcct

SEQ ID NO: 3773803 - DNA, 24 bp, Homo sapiens
tcctggctacatcccagcctgtgg

SEQ ID NO: 3773804 - DNA, 15 bp, Homo sapiens
tcctggctttgccca

SEQ ID NO: 3773805 - DNA, 23 bp, Homo sapiens
tcctggctttgcccaacctcagc

SEQ ID NO: 3773806 - DNA, 23 bp, Homo sapiens
tcctgggagaacctcaggcttcc

SEQ ID NO: 3773807 - DNA, 18 bp, Homo sapiens
tcctgggagtgagctggt

SEQ ID NO: 3773808 - DNA, 15 bp, Homo sapiens
tcctgggcccctccc

SEQ ID NO: 3773809 - DNA, 16 bp, Homo sapiens
tcctgggcccctccct

SEQ ID NO: 3773810 - DNA, 17 bp, Homo sapiens
tcctgggcccctcccta

SEQ ID NO: 3773811 - DNA, 19 bp, Homo sapiens
tcctgggcccctccctacc

SEQ ID NO: 3773812 - DNA, 20 bp, Homo sapiens
tcctgggcccctccctacct

SEQ ID NO: 3773813 - DNA, 21 bp, Homo sapiens
tcctggggcctcggagcctca

SEQ ID NO: 3773814 - DNA, 15 bp, Homo sapiens
tcctggggcctcttg

SEQ ID NO: 3773815 - DNA, 15 bp, Homo sapiens
tcctggggctctgtg

SEQ ID NO: 3773816 - DNA, 21 bp, Homo sapiens
tcctgggggttctttcttcct

SEQ ID NO: 3773817 - DNA, 17 bp, Homo sapiens
tcctggggtgccctcca

SEQ ID NO: 3773818 - DNA, 22 bp, Homo sapiens
tcctggtatgggtttctcccag

SEQ ID NO: 3773819 - DNA, 20 bp, Homo sapiens
tcctgtagacctagggagga

SEQ ID NO: 3773820 - DNA, 23 bp, Homo sapiens
tcctgtagacctagggaggacct

SEQ ID NO: 3773821 - DNA, 11 bp, Homo sapiens
tcctgtagccc

SEQ ID NO: 3773822 - DNA, 13 bp, Homo sapiens
tcctgtagcccta

SEQ ID NO: 3773823 - DNA, 20 bp, Homo sapiens
tcctgtccaacctaacccct

SEQ ID NO: 3773824 - DNA, 18 bp, Homo sapiens
tcctgtcccttctcttaa

SEQ ID NO: 3773825 - DNA, 19 bp, Homo sapiens
tcctgtccgccctcttccc

SEQ ID NO: 3773826 - DNA, 22 bp, Homo sapiens
tcctgtccgccctcttcccctc

SEQ ID NO: 3773827 - DNA, 16 bp, Homo sapiens
tcctgtctcccctctg

SEQ ID NO: 3773828 - DNA, 13 bp, Homo sapiens
ggttgcagggagc

SEQ ID NO: 3773829 - DNA, 16 bp, Homo sapiens
ggttgctcacagctgt

SEQ ID NO: 3773830 - DNA, 18 bp, Homo sapiens
ggttggcaaaaaggcagg

SEQ ID NO: 3773831 - DNA, 15 bp, Homo sapiens
ggttggctgggccca

SEQ ID NO: 3773832 - DNA, 17 bp, Homo sapiens
ggttgggcccagatctg

SEQ ID NO: 3773833 - DNA, 15 bp, Homo sapiens
ggttgtcactcaaca

SEQ ID NO: 3773834 - DNA, 13 bp, Homo sapiens
ggtttaagctgtt

SEQ ID NO: 3773835 - DNA, 22 bp, Homo sapiens
ggtttacattcatctcattcca

SEQ ID NO: 3773836 - DNA, 18 bp, Homo sapiens
ggtttagtgtaaaaatga

SEQ ID NO: 3773837 - DNA, 18 bp, Homo sapiens
ggtttgaatataaacact

SEQ ID NO: 3773838 - DNA, 16 bp, Homo sapiens
ggtttgcctgagggcg

SEQ ID NO: 3773839 - DNA, 19 bp, Homo sapiens
ggtttggcgggccaaggac

SEQ ID NO: 3773840 - DNA, 19 bp, Homo sapiens
ggtttgtgtttgagtttta

SEQ ID NO: 3773841 - DNA, 15 bp, Homo sapiens
ggttttatattttta

SEQ ID NO: 3773842 - DNA, 23 bp, Homo sapiens
ggttttgccatgttggccaggct

SEQ ID NO: 3773843 - DNA, 18 bp, Homo sapiens
gtaaaaacagcattgctt

SEQ ID NO: 3773844 - DNA, 21 bp, Homo sapiens
gtaaaaacagcattgctttct

SEQ ID NO: 3773845 - DNA, 23 bp, Homo sapiens
gtaaaaacagcattgctttctga

SEQ ID NO: 3773846 - DNA, 12 bp, Homo sapiens
gtaaaaatgaga

SEQ ID NO: 3773847 - DNA, 16 bp, Homo sapiens
gtaaaaatgagaacat

SEQ ID NO: 3773848 - DNA, 14 bp, Homo sapiens
gtaaaataaaatta

SEQ ID NO: 3773849 - DNA, 12 bp, Homo sapiens
gtaaaattctaa

SEQ ID NO: 3773850 - DNA, 13 bp, Homo sapiens
gtaaaattctaaa

SEQ ID NO: 3773851 - DNA, 16 bp, Homo sapiens
gtaaaattgaaaggca

SEQ ID NO: 3773852 - DNA, 13 bp, Homo sapiens
gtaaacagtgcct

SEQ ID NO: 3773853 - DNA, 16 bp, Homo sapiens
gtaaacgctgtcccta

SEQ ID NO: 3773854 - DNA, 16 bp, Homo sapiens
gtaaacgtttcagtaa

SEQ ID NO: 3773855 - DNA, 23 bp, Homo sapiens
gtaaactaatgagtttcttttat

SEQ ID NO: 3773856 - DNA, 15 bp, Homo sapiens
gtaaactatttatct

SEQ ID NO: 3773857 - DNA, 23 bp, Homo sapiens
gtaaactcaaaatatttgtacat

SEQ ID NO: 3773858 - DNA, 13 bp, Homo sapiens
gtaaactgccctg

SEQ ID NO: 3773859 - DNA, 14 bp, Homo sapiens
gtaaagagaaactt

SEQ ID NO: 3773860 - DNA, 20 bp, Homo sapiens
gtaaagagaaactttgtgct

SEQ ID NO: 3773861 - DNA, 19 bp, Homo sapiens
gtaaagtgtaacatatgca

SEQ ID NO: 3773862 - DNA, 21 bp, Homo sapiens
gtaaataaccccattctttgc

SEQ ID NO: 3773863 - DNA, 20 bp, Homo sapiens
gtaaatacaagttctattta

SEQ ID NO: 3773864 - DNA, 19 bp, Homo sapiens
gtaaatacacaacacacac

SEQ ID NO: 3773865 - DNA, 12 bp, Homo sapiens
gtaaatatttat

SEQ ID NO: 3773866 - DNA, 15 bp, Homo sapiens
gtaaatcctttttct

SEQ ID NO: 3773867 - DNA, 22 bp, Homo sapiens
gtaaatgtctgtggccttgttc

SEQ ID NO: 3773868 - DNA, 23 bp, Homo sapiens
gtaaattaccagtaaagtgtaac

SEQ ID NO: 3773869 - DNA, 17 bp, Homo sapiens
gtaaattattttaaatt

SEQ ID NO: 3773870 - DNA, 14 bp, Homo sapiens
gtaacaagaaaaca

SEQ ID NO: 3773871 - DNA, 15 bp, Homo sapiens
gtaacaagaaaacat

SEQ ID NO: 3773872 - DNA, 16 bp, Homo sapiens
gtaacaagaaaggaga

SEQ ID NO: 3773873 - DNA, 16 bp, Homo sapiens
gtaacaagccacccca

SEQ ID NO: 3773874 - DNA, 16 bp, Homo sapiens
gtaacagctgaggtct

SEQ ID NO: 3773875 - DNA, 22 bp, Homo sapiens
gtaacaggaaaattttaaaaat

SEQ ID NO: 3773876 - DNA, 14 bp, Homo sapiens
gtaacaggtctcct

SEQ ID NO: 3773877 - DNA, 15 bp, Homo sapiens
gtaacatatgcaaac

SEQ ID NO: 3773878 - DNA, 17 bp, Homo sapiens
gtaacattcatgttcta

SEQ ID NO: 3773879 - DNA, 18 bp, Homo sapiens
gtaacctgagatggccct

SEQ ID NO: 3773880 - DNA, 19 bp, Homo sapiens
gtaactctaattcccattt

SEQ ID NO: 3773881 - DNA, 13 bp, Homo sapiens
gtaactgacaact

SEQ ID NO: 3773882 - DNA, 22 bp, Homo sapiens
gtaactgcattgagaactgcat

SEQ ID NO: 3773883 - DNA, 18 bp, Homo sapiens
gtaacttggttatacatg

SEQ ID NO: 3773884 - DNA, 23 bp, Homo sapiens
gtaacttggttatacatgacact

SEQ ID NO: 3773885 - DNA, 19 bp, Homo sapiens
gtaacttttgtaaatacac

SEQ ID NO: 3773886 - DNA, 17 bp, Homo sapiens
gtaacttttgtaagaca

SEQ ID NO: 3773887 - DNA, 11 bp, Homo sapiens
gtaagaagccg

SEQ ID NO: 3773888 - DNA, 13 bp, Homo sapiens
gtaagagaatgtt

SEQ ID NO: 3773889 - DNA, 16 bp, Homo sapiens
gtaagagctggtgtct

SEQ ID NO: 3773890 - DNA, 17 bp, Homo sapiens
gtaagagctttacaaaa

SEQ ID NO: 3773891 - DNA, 11 bp, Homo sapiens
gtaagctcttt

SEQ ID NO: 3773892 - DNA, 14 bp, Homo sapiens
gtaaggaatgcttg

SEQ ID NO: 3773893 - DNA, 14 bp, Homo sapiens
gtaaggtgagggaa

SEQ ID NO: 3773894 - DNA, 15 bp, Homo sapiens
gtaagtaaatgtctg

SEQ ID NO: 3773895 - DNA, 23 bp, Homo sapiens
gtaagtaattatcgggaacagtg

SEQ ID NO: 3773896 - DNA, 13 bp, Homo sapiens
gtaataaactcat

SEQ ID NO: 3773897 - DNA, 19 bp, Homo sapiens
gtaataaagtgttttcaga

SEQ ID NO: 3773898 - DNA, 20 bp, Homo sapiens
gtaatcatttcttgggccct

SEQ ID NO: 3773899 - DNA, 13 bp, Homo sapiens
gtaatcccagcag

SEQ ID NO: 3773900 - DNA, 23 bp, Homo sapiens
gtaatcctagcactttgggaggc

SEQ ID NO: 3773901 - DNA, 18 bp, Homo sapiens
gtaatcgttatgtgtgta

SEQ ID NO: 3773902 - DNA, 20 bp, Homo sapiens
gtaatgtcaccaccttccca

SEQ ID NO: 3773903 - DNA, 23 bp, Homo sapiens
gtaatgttactgatcatgcattg

SEQ ID NO: 3773904 - DNA, 14 bp, Homo sapiens
gtaattaagtacta

SEQ ID NO: 3773905 - DNA, 21 bp, Homo sapiens
gtaattatcgggaacagtgtt

SEQ ID NO: 3773906 - DNA, 12 bp, Homo sapiens
gtaattctaaat

SEQ ID NO: 3773907 - DNA, 16 bp, Homo sapiens
gtaatttgaggacaac

SEQ ID NO: 3773908 - DNA, 21 bp, Homo sapiens
gtaatttgtgtaataaagtgt

SEQ ID NO: 3773909 - DNA, 18 bp, Homo sapiens
gtaattttcttgatgact

SEQ ID NO: 3773910 - DNA, 14 bp, Homo sapiens
gtacaaaagggaca

SEQ ID NO: 3773911 - DNA, 21 bp, Homo sapiens
gtacaaaataaagttacattg

SEQ ID NO: 3773912 - DNA, 13 bp, Homo sapiens
gtacaaggcatgg

SEQ ID NO: 3773913 - DNA, 18 bp, Homo sapiens
gtacaatattttaagcat

SEQ ID NO: 3773914 - DNA, 19 bp, Homo sapiens
gtacacgtaaatctgttca

SEQ ID NO: 3773915 - DNA, 15 bp, Homo sapiens
gtacactgaatattt

SEQ ID NO: 3773916 - DNA, 17 bp, Homo sapiens
gtacagaatcattgctt

SEQ ID NO: 3773917 - DNA, 21 bp, Homo sapiens
gtacagaatcattgcttatga

SEQ ID NO: 3773918 - DNA, 15 bp, Homo sapiens
tgcatagtcccagct

SEQ ID NO: 3773919 - DNA, 17 bp, Homo sapiens
tgcatatatacatatat

SEQ ID NO: 3773920 - DNA, 17 bp, Homo sapiens
tgcatatcctgagccat

SEQ ID NO: 3773921 - DNA, 18 bp, Homo sapiens
tgcatatcctgagccatc

SEQ ID NO: 3773922 - DNA, 13 bp, Homo sapiens
tgcatatgtttcg

SEQ ID NO: 3773923 - DNA, 14 bp, Homo sapiens
tgcatcagaaatgt

SEQ ID NO: 3773924 - DNA, 17 bp, Homo sapiens
tgcatcatctgtagata

SEQ ID NO: 3773925 - DNA, 18 bp, Homo sapiens
tgcatccattcctcaggg

SEQ ID NO: 3773926 - DNA, 20 bp, Homo sapiens
tgcatccattcctcagggac

SEQ ID NO: 3773927 - DNA, 19 bp, Homo sapiens
tgcatccgtagttccctga

SEQ ID NO: 3773928 - DNA, 16 bp, Homo sapiens
tgcatccgtgagcagt

SEQ ID NO: 3773929 - DNA, 13 bp, Homo sapiens
tgcatctcagccc

SEQ ID NO: 3773930 - DNA, 14 bp, Homo sapiens
tgcatctcagccca

SEQ ID NO: 3773931 - DNA, 18 bp, Homo sapiens
tgcatcttactgaaggta

SEQ ID NO: 3773932 - DNA, 21 bp, Homo sapiens
tgcatgaaggtttctgaaaat

SEQ ID NO: 3773933 - DNA, 14 bp, Homo sapiens
tgcatgccgctgca

SEQ ID NO: 3773934 - DNA, 17 bp, Homo sapiens
tgcatgctctctgcagc

SEQ ID NO: 3773935 - DNA, 16 bp, Homo sapiens
tctttccatttctctc

SEQ ID NO: 3773936 - DNA, 20 bp, Homo sapiens
tctttccctgcttaatgaaa

SEQ ID NO: 3773937 - DNA, 24 bp, Homo sapiens
tctttctccttagtcttctcatag

SEQ ID NO: 3773938 - DNA, 16 bp, Homo sapiens
tctttctgatgtcaaa

SEQ ID NO: 3773939 - DNA, 16 bp, Homo sapiens
tctttcttcctctgct

SEQ ID NO: 3773940 - DNA, 19 bp, Homo sapiens
tctttctttggtgcctttc

SEQ ID NO: 3773941 - DNA, 14 bp, Homo sapiens
tctttgaaacaact

SEQ ID NO: 3773942 - DNA, 21 bp, Homo sapiens
tctttgaaatagtctgtgtga

SEQ ID NO: 3773943 - DNA, 23 bp, Homo sapiens
tctttgacctcaacctgtgatga

SEQ ID NO: 3773944 - DNA, 17 bp, Homo sapiens
tctttgagatagaagaa

SEQ ID NO: 3773945 - DNA, 18 bp, Homo sapiens
tctttgagatagaagaac

SEQ ID NO: 3773946 - DNA, 20 bp, Homo sapiens
tctttgatacttgttcaaaa

SEQ ID NO: 3773947 - DNA, 17 bp, Homo sapiens
tctttggacactcacac

SEQ ID NO: 3773948 - DNA, 22 bp, Homo sapiens
tctttggactctcccctcttat

SEQ ID NO: 3773949 - DNA, 22 bp, Homo sapiens
tctttggtgcctttcctgttca

SEQ ID NO: 3773950 - DNA, 21 bp, Homo sapiens
tctttgtaagtaaactgccct

SEQ ID NO: 3773951 - DNA, 23 bp, Homo sapiens
tctttgtaatgtcaccaccttcc

SEQ ID NO: 3773952 - DNA, 14 bp, Homo sapiens
tctttgtggcttcc

SEQ ID NO: 3773953 - DNA, 15 bp, Homo sapiens
tctttgtgtagcttt

SEQ ID NO: 3773954 - DNA, 18 bp, Homo sapiens
tcttttactcatgatctt

SEQ ID NO: 3773955 - DNA, 24 bp, Homo sapiens
tcttttataaaaaaaatgaaatgt

SEQ ID NO: 3773956 - DNA, 19 bp, Homo sapiens
tcttttataactagtcctt

SEQ ID NO: 3773957 - DNA, 12 bp, Homo sapiens
tcttttctacag

SEQ ID NO: 3773958 - DNA, 19 bp, Homo sapiens
tcttttgaatccatgcttg

SEQ ID NO: 3773959 - DNA, 20 bp, Homo sapiens
tcttttgaatccatgcttgg

SEQ ID NO: 3773960 - DNA, 13 bp, Homo sapiens
tcttttgacatgt

SEQ ID NO: 3773961 - DNA, 20 bp, Homo sapiens
tcttttgacatgtggaaagt

SEQ ID NO: 3773962 - DNA, 13 bp, Homo sapiens
tcttttgccatga

SEQ ID NO: 3773963 - DNA, 21 bp, Homo sapiens
tcttttgcccttcacagtgtt

SEQ ID NO: 3773964 - DNA, 14 bp, Homo sapiens
tctttttaagctta

SEQ ID NO: 3773965 - DNA, 17 bp, Homo sapiens
tcttttttaaattttct

SEQ ID NO: 3773966 - DNA, 20 bp, Homo sapiens
tcttttttagcataaaattt

SEQ ID NO: 3773967 - DNA, 14 bp, Homo sapiens
tgaaaaaaaagttt

SEQ ID NO: 3773968 - DNA, 20 bp, Homo sapiens
tgaaaaaaattggcattaaa

SEQ ID NO: 3773969 - DNA, 20 bp, Homo sapiens
tgaaaaaggaggaagagaaa

SEQ ID NO: 3773970 - DNA, 18 bp, Homo sapiens
tgaaaaatttaagcattg

SEQ ID NO: 3773971 - DNA, 23 bp, Homo sapiens
tgaaaacatggtagaattggaga

SEQ ID NO: 3773972 - DNA, 14 bp, Homo sapiens
tgaaaacatgtaat

SEQ ID NO: 3773973 - DNA, 13 bp, Homo sapiens
tgaaaacctcaca

SEQ ID NO: 3773974 - DNA, 16 bp, Homo sapiens
tgaaaacgttttattg

SEQ ID NO: 3773975 - DNA, 19 bp, Homo sapiens
tgaaaactacattttaaca

SEQ ID NO: 3773976 - DNA, 22 bp, Homo sapiens
tgaaaagaaaaatgagcctggc

SEQ ID NO: 3773977 - DNA, 16 bp, Homo sapiens
tgaaaagccatgttta

SEQ ID NO: 3773978 - DNA, 20 bp, Homo sapiens
tgaaaagccatgtttaagat

SEQ ID NO: 3773979 - DNA, 15 bp, Homo sapiens
tgaaaatcctaccaa

SEQ ID NO: 3773980 - DNA, 21 bp, Homo sapiens
tgaaaatgcaacaacatgtat

SEQ ID NO: 3773981 - DNA, 22 bp, Homo sapiens
tgaaaatgtaagtaaatgtctg

SEQ ID NO: 3773982 - DNA, 15 bp, Homo sapiens
tgaaaatgtcagaaa

SEQ ID NO: 3773983 - DNA, 14 bp, Homo sapiens
tgaaaattaacact

SEQ ID NO: 3773984 - DNA, 20 bp, Homo sapiens
tgaaaattaggatttcatga

SEQ ID NO: 3773985 - DNA, 20 bp, Homo sapiens
tgaaaattccagaaaggata

SEQ ID NO: 3773986 - DNA, 14 bp, Homo sapiens
tgaaacaaagctgc

SEQ ID NO: 3773987 - DNA, 17 bp, Homo sapiens
tgaaacacaccaggctg

SEQ ID NO: 3773988 - DNA, 18 bp, Homo sapiens
tgaaacacaccaggctgt

SEQ ID NO: 3773989 - DNA, 21 bp, Homo sapiens
tgaaacaggagagaaagggga

SEQ ID NO: 3773990 - DNA, 20 bp, Homo sapiens
tgaaagaaacagttaacttt

SEQ ID NO: 3773991 - DNA, 14 bp, Homo sapiens
tgaaagaaatcatg

SEQ ID NO: 3773992 - DNA, 12 bp, Homo sapiens
tgaaagaccttc

SEQ ID NO: 3773993 - DNA, 18 bp, Homo sapiens
tgaaagactgtacaaagt

SEQ ID NO: 3773994 - DNA, 18 bp, Homo sapiens
tgaaagagaaccagtttc

SEQ ID NO: 3773995 - DNA, 19 bp, Homo sapiens
tgaaagatggctgtgcctc

SEQ ID NO: 3773996 - DNA, 23 bp, Homo sapiens
tgaaagatggctgtgcctctgcc

SEQ ID NO: 3773997 - DNA, 15 bp, Homo sapiens
tgaaagcatccatgt

SEQ ID NO: 3773998 - DNA, 17 bp, Homo sapiens
tgaaagcatccatgtgt

SEQ ID NO: 3773999 - DNA, 22 bp, Homo sapiens
tgaaagggagctatcaggaaca

SEQ ID NO: 3774000 - DNA, 16 bp, Homo sapiens
tgaaagggcccagaga

SEQ ID NO: 3774001 - DNA, 15 bp, Homo sapiens
tgaaaggtttacatt

SEQ ID NO: 3774002 - DNA, 15 bp, Homo sapiens
tgaaagtataactga

SEQ ID NO: 3774003 - DNA, 20 bp, Homo sapiens
tgaaagtcttgtgactagtg

SEQ ID NO: 3774004 - DNA, 21 bp, Homo sapiens
tgaaagtcttgtgactagtgc

SEQ ID NO: 3774005 - DNA, 17 bp, Homo sapiens
tgaaagtttgcactgta

SEQ ID NO: 3774006 - DNA, 20 bp, Homo sapiens
tgaaagttttcagaacctct

SEQ ID NO: 3774007 - DNA, 13 bp, Homo sapiens
tgaaatagtctgt

SEQ ID NO: 3774008 - DNA, 19 bp, Homo sapiens
tgaaatagttcaaagccaa

SEQ ID NO: 3774009 - DNA, 16 bp, Homo sapiens
tgaaatctcagaattc

SEQ ID NO: 3774010 - DNA, 19 bp, Homo sapiens
tgaaatctcagaattcctt

SEQ ID NO: 3774011 - DNA, 17 bp, Homo sapiens
tgaaatctgtgcaataa

SEQ ID NO: 3774012 - DNA, 18 bp, Homo sapiens
tgaaatctgtgcaataaa

SEQ ID NO: 3774013 - DNA, 14 bp, Homo sapiens
tgaaatgaaaacat

SEQ ID NO: 3774014 - DNA, 19 bp, Homo sapiens
tgaaatgacctcaagatgt

SEQ ID NO: 3774015 - DNA, 21 bp, Homo sapiens
tgaaatgaggtcagagcctgc

SEQ ID NO: 3774016 - DNA, 23 bp, Homo sapiens
tgaaatgaggtcagagcctgcag

SEQ ID NO: 3774017 - DNA, 18 bp, Homo sapiens
tgaaatgccttactttgt

SEQ ID NO: 3774018 - DNA, 19 bp, Homo sapiens
tgaaatgccttactttgta

SEQ ID NO: 3774019 - DNA, 21 bp, Homo sapiens
tgaaatgccttactttgtatg

SEQ ID NO: 3774020 - DNA, 22 bp, Homo sapiens
tgaaatgccttactttgtatga

SEQ ID NO: 3774021 - DNA, 16 bp, Homo sapiens
tgaaatggaggtcctt

SEQ ID NO: 3774022 - DNA, 18 bp, Homo sapiens
tgaaattaaccatagatg

SEQ ID NO: 3774023 - DNA, 22 bp, Homo sapiens
tgaaatttcagattcccagagc

SEQ ID NO: 3774024 - DNA, 19 bp, Homo sapiens
tgaaattttaccaagttat

SEQ ID NO: 3774025 - DNA, 20 bp, Homo sapiens
tgaaatttttattaaattat

SEQ ID NO: 3774026 - DNA, 12 bp, Homo sapiens
tgaacaagaatt

SEQ ID NO: 3774027 - DNA, 19 bp, Homo sapiens
tgaacaagttgtttcattg

SEQ ID NO: 3774028 - DNA, 11 bp, Homo sapiens
tgaacacagta

SEQ ID NO: 3774029 - DNA, 15 bp, Homo sapiens
tgaacacagtatttt

SEQ ID NO: 3774030 - DNA, 14 bp, Homo sapiens
tgaaccaaaacatt

SEQ ID NO: 3774031 - DNA, 22 bp, Homo sapiens
tgaaccacatcttgctctgctg

SEQ ID NO: 3774032 - DNA, 23 bp, Homo sapiens
tgaaccacatcttgctctgctga

SEQ ID NO: 3774033 - DNA, 21 bp, Homo sapiens
tgaaccatcattataaacgtg

SEQ ID NO: 3774034 - DNA, 15 bp, Homo sapiens
tgaacccttgcttgc

SEQ ID NO: 3774035 - DNA, 13 bp, Homo sapiens
tgaacggccttgc

SEQ ID NO: 3774036 - DNA, 15 bp, Homo sapiens
tgaactcttaatcaa

SEQ ID NO: 3774037 - DNA, 21 bp, Homo sapiens
tgaactcttaatcaaatagca

SEQ ID NO: 3774038 - DNA, 18 bp, Homo sapiens
tgaactcttcaatctctt

SEQ ID NO: 3774039 - DNA, 23 bp, Homo sapiens
tgaactctttctggcctgccttc

SEQ ID NO: 3774040 - DNA, 23 bp, Homo sapiens
tgaactgggtacttgtggacaca

SEQ ID NO: 3774041 - DNA, 17 bp, Homo sapiens
tgaagaaaaaatacatt

SEQ ID NO: 3774042 - DNA, 18 bp, Homo sapiens
tgaagaaaaaatacattt

SEQ ID NO: 3774043 - DNA, 19 bp, Homo sapiens
tgaagaaaaaatacatttt

SEQ ID NO: 3774044 - DNA, 11 bp, Homo sapiens
tgaagaagaga

SEQ ID NO: 3774045 - DNA, 22 bp, Homo sapiens
tgaagaagctaaatcctttact

SEQ ID NO: 3774046 - DNA, 17 bp, Homo sapiens
tgaagacaaaaatactc

SEQ ID NO: 3774047 - DNA, 21 bp, Homo sapiens
tgaagacaaaaatactctaat

SEQ ID NO: 3774048 - DNA, 14 bp, Homo sapiens
tgaagacaggacag

SEQ ID NO: 3774049 - DNA, 19 bp, Homo sapiens
tgaagactcattcttctgt

SEQ ID NO: 3774050 - DNA, 19 bp, Homo sapiens
tgaagagtgggtttcacaa

SEQ ID NO: 3774051 - DNA, 15 bp, Homo sapiens
tgaagatagaagaaa

SEQ ID NO: 3774052 - DNA, 17 bp, Homo sapiens
tgaagatagaagaaaaa

SEQ ID NO: 3774053 - DNA, 21 bp, Homo sapiens
tgaagatatcttgaaatgaaa

SEQ ID NO: 3774054 - DNA, 16 bp, Homo sapiens
tgaagatgtctaatag

SEQ ID NO: 3774055 - DNA, 15 bp, Homo sapiens
tgaagatgtttgcaa

SEQ ID NO: 3774056 - DNA, 15 bp, Homo sapiens
tgaagcaaacacatt

SEQ ID NO: 3774057 - DNA, 14 bp, Homo sapiens
tgaagcaaatcaga

SEQ ID NO: 3774058 - DNA, 19 bp, Homo sapiens
tgaagcagatgcaaagagg

SEQ ID NO: 3774059 - DNA, 22 bp, Homo sapiens
tgaagcagatgcaaagaggcaa

SEQ ID NO: 3774060 - DNA, 22 bp, Homo sapiens
tgaagccacagcccaggcctcc

SEQ ID NO: 3774061 - DNA, 17 bp, Homo sapiens
tgaagccgccaggaccg

SEQ ID NO: 3774062 - DNA, 14 bp, Homo sapiens
tgaagctaattatt

SEQ ID NO: 3774063 - DNA, 18 bp, Homo sapiens
tgaagctaattattttaa

SEQ ID NO: 3774064 - DNA, 19 bp, Homo sapiens
tgaagctatttatctgtag

SEQ ID NO: 3774065 - DNA, 17 bp, Homo sapiens
tgaagcttattaatgct

SEQ ID NO: 3774066 - DNA, 18 bp, Homo sapiens
tgaagcttattaatgcta

SEQ ID NO: 3774067 - DNA, 23 bp, Homo sapiens
tgaagcttattaatgctaagggc

SEQ ID NO: 3774068 - DNA, 16 bp, Homo sapiens
tgaagggagagccagc

SEQ ID NO: 3774069 - DNA, 16 bp, Homo sapiens
tgaaggtcttgatttg

SEQ ID NO: 3774070 - DNA, 17 bp, Homo sapiens
tgaagtaacttgtctta

SEQ ID NO: 3774071 - DNA, 18 bp, Homo sapiens
tgaagtaacttgtcttaa

SEQ ID NO: 3774072 - DNA, 23 bp, Homo sapiens
tgaagtgatgttgtttaacataa

SEQ ID NO: 3774073 - DNA, 16 bp, Homo sapiens
tgaagtgtgtttcctt

SEQ ID NO: 3774074 - DNA, 18 bp, Homo sapiens
tgaagtgtgtttccttca

SEQ ID NO: 3774075 - DNA, 22 bp, Homo sapiens
tgaagtgtgtttccttcagtgc

SEQ ID NO: 3774076 - DNA, 16 bp, Homo sapiens
tgaataaagacaccta

SEQ ID NO: 3774077 - DNA, 19 bp, Homo sapiens
tgaataaattctataggaa

SEQ ID NO: 3774078 - DNA, 12 bp, Homo sapiens
tgaataatacag

SEQ ID NO: 3774079 - DNA, 16 bp, Homo sapiens
tgaatataaacactat

SEQ ID NO: 3774080 - DNA, 18 bp, Homo sapiens
tgaatatattataatctt

SEQ ID NO: 3774081 - DNA, 19 bp, Homo sapiens
tgaatcatggtttttctta

SEQ ID NO: 3774082 - DNA, 15 bp, Homo sapiens
tgaatcctaagggct

SEQ ID NO: 3774083 - DNA, 12 bp, Homo sapiens
tgaatctattgg

SEQ ID NO: 3774084 - DNA, 14 bp, Homo sapiens
tgaatcttgcgttt

SEQ ID NO: 3774085 - DNA, 19 bp, Homo sapiens
tgaatgaaaaatttaagca

SEQ ID NO: 3774086 - DNA, 20 bp, Homo sapiens
tgaatgaaaaatttaagcat

SEQ ID NO: 3774087 - DNA, 22 bp, Homo sapiens
tgaatgaaaaatttaagcattg

SEQ ID NO: 3774088 - DNA, 21 bp, Homo sapiens
tgaatgaaagtcttgtgacta

SEQ ID NO: 3774089 - DNA, 18 bp, Homo sapiens
tgaatgaggtcccaggca

SEQ ID NO: 3774090 - DNA, 19 bp, Homo sapiens
tgaatgatttccaaagaga

SEQ ID NO: 3774091 - DNA, 13 bp, Homo sapiens
tgaatgcggccca

SEQ ID NO: 3774092 - DNA, 15 bp, Homo sapiens
tgaatgtaatttgtg

SEQ ID NO: 3774093 - DNA, 20 bp, Homo sapiens
tgaatgtaatttgtgtaata

SEQ ID NO: 3774094 - DNA, 16 bp, Homo sapiens
tgaatgtatcaggaaa

SEQ ID NO: 3774095 - DNA, 14 bp, Homo sapiens
tgaatgtgtcacta

SEQ ID NO: 3774096 - DNA, 14 bp, Homo sapiens
tgaatgttctgaca

SEQ ID NO: 3774097 - DNA, 15 bp, Homo sapiens
tgaatgttctgacat

SEQ ID NO: 3774098 - DNA, 16 bp, Homo sapiens
tgaatgttctgacatt

SEQ ID NO: 3774099 - DNA, 17 bp, Homo sapiens
tgaatgttctgacatta

SEQ ID NO: 3774100 - DNA, 23 bp, Homo sapiens
tgaatgttctgacattaacagtt

SEQ ID NO: 3774101 - DNA, 22 bp, Homo sapiens
tgaatgtttacactctttgtaa

SEQ ID NO: 3774102 - DNA, 17 bp, Homo sapiens
tgaattaaataaaccct

SEQ ID NO: 3774103 - DNA, 13 bp, Homo sapiens
tgaatttctaaaa

SEQ ID NO: 3774104 - DNA, 15 bp, Homo sapiens
tgaatttgaatgaaa

SEQ ID NO: 3774105 - DNA, 16 bp, Homo sapiens
tgaatttgaatgaaaa

SEQ ID NO: 3774106 - DNA, 18 bp, Homo sapiens
tgaattttcaagcatctc

SEQ ID NO: 3774107 - DNA, 13 bp, Homo sapiens
tgaatttttctct

SEQ ID NO: 3774108 - DNA, 22 bp, Homo sapiens
tgaatttttctctaactcagaa

SEQ ID NO: 3774109 - DNA, 21 bp, Homo sapiens
tgaatttttttcatcttctct

SEQ ID NO: 3774110 - DNA, 16 bp, Homo sapiens
tgaatttttttttcct

SEQ ID NO: 3774111 - DNA, 20 bp, Homo sapiens
tgaatttttttttcctagcc

SEQ ID NO: 3774112 - DNA, 14 bp, Homo sapiens
tgacaaaattttgc

SEQ ID NO: 3774113 - DNA, 15 bp, Homo sapiens
tgacaaagaaaccca

SEQ ID NO: 3774114 - DNA, 19 bp, Homo sapiens
tgacaacttctaattgcca

SEQ ID NO: 3774115 - DNA, 21 bp, Homo sapiens
tgacaagccccaggcaggctg

SEQ ID NO: 3774116 - DNA, 14 bp, Homo sapiens
tgacaaggccccag

SEQ ID NO: 3774117 - DNA, 18 bp, Homo sapiens
tgacaatcaactctaata

SEQ ID NO: 3774118 - DNA, 13 bp, Homo sapiens
tgacaccagcctt

SEQ ID NO: 3774119 - DNA, 15 bp, Homo sapiens
tgacaccagcctttc

SEQ ID NO: 3774120 - DNA, 16 bp, Homo sapiens
tgacacggccatgacc

SEQ ID NO: 3774121 - DNA, 18 bp, Homo sapiens
tgacactgaaatgcctta

SEQ ID NO: 3774122 - DNA, 20 bp, Homo sapiens
tgacactttgccagaaagca

SEQ ID NO: 3774123 - DNA, 16 bp, Homo sapiens
tgacagaacactgtct

SEQ ID NO: 3774124 - DNA, 21 bp, Homo sapiens
tgacagaacactgtcttgaag

SEQ ID NO: 3774125 - DNA, 20 bp, Homo sapiens
tgacagacacaggcccggct

SEQ ID NO: 3774126 - DNA, 14 bp, Homo sapiens
tgacagaggcagcc

SEQ ID NO: 3774127 - DNA, 15 bp, Homo sapiens
tgacagaggcagccc

SEQ ID NO: 3774128 - DNA, 23 bp, Homo sapiens
tgacagaggcagccccattctgc

SEQ ID NO: 3774129 - DNA, 19 bp, Homo sapiens
tgacagagtgagactctgt

SEQ ID NO: 3774130 - DNA, 15 bp, Homo sapiens
tgacagagttcacta

SEQ ID NO: 3774131 - DNA, 19 bp, Homo sapiens
tgacagatgttgaatgccc

SEQ ID NO: 3774132 - DNA, 12 bp, Homo sapiens
tgacagcctccc

SEQ ID NO: 3774133 - DNA, 19 bp, Homo sapiens
tgacagcctcccaccccca

SEQ ID NO: 3774134 - DNA, 14 bp, Homo sapiens
tgacagctgtccct

SEQ ID NO: 3774135 - DNA, 13 bp, Homo sapiens
tgacagctgtgct

SEQ ID NO: 3774136 - DNA, 11 bp, Homo sapiens
tgacagggcac

SEQ ID NO: 3774137 - DNA, 21 bp, Homo sapiens
tgacagggcacaccgggcact

SEQ ID NO: 3774138 - DNA, 22 bp, Homo sapiens
tgacagtaacttggttatacat

SEQ ID NO: 3774139 - DNA, 19 bp, Homo sapiens
tgacagtgaggtcctgggg

SEQ ID NO: 3774140 - DNA, 21 bp, Homo sapiens
tgacagtgcctgggaatgtat

SEQ ID NO: 3774141 - DNA, 20 bp, Homo sapiens
tgacatcacttgtacaaaat

SEQ ID NO: 3774142 - DNA, 23 bp, Homo sapiens
tgacatcacttgtacaaaataaa

SEQ ID NO: 3774143 - DNA, 14 bp, Homo sapiens
tgacatcagcatca

SEQ ID NO: 3774144 - DNA, 17 bp, Homo sapiens
tgacatcagtggcatgg

SEQ ID NO: 3774145 - DNA, 13 bp, Homo sapiens
tgacatccaagct

SEQ ID NO: 3774146 - DNA, 17 bp, Homo sapiens
tgacatccaagcttcct

SEQ ID NO: 3774147 - DNA, 12 bp, Homo sapiens
tgacatctcttt

SEQ ID NO: 3774148 - DNA, 13 bp, Homo sapiens
tgacatctctttg

SEQ ID NO: 3774149 - DNA, 16 bp, Homo sapiens
tgacatcttcaaagct

SEQ ID NO: 3774150 - DNA, 14 bp, Homo sapiens
tgacatgatcgctt

SEQ ID NO: 3774151 - DNA, 17 bp, Homo sapiens
tgacatgcgggctgggc

SEQ ID NO: 3774152 - DNA, 16 bp, Homo sapiens
tgacatgtccctacac

SEQ ID NO: 3774153 - DNA, 14 bp, Homo sapiens
tgacatgtggaaag

SEQ ID NO: 3774154 - DNA, 21 bp, Homo sapiens
tgacatgtggaaagtgaattt

SEQ ID NO: 3774155 - DNA, 15 bp, Homo sapiens
tgacatgtgtcaagc

SEQ ID NO: 3774156 - DNA, 13 bp, Homo sapiens
tgacattaacagt

SEQ ID NO: 3774157 - DNA, 21 bp, Homo sapiens
tgacattaacagttttccatg

SEQ ID NO: 3774158 - DNA, 22 bp, Homo sapiens
tgacattaacagttttccatga

SEQ ID NO: 3774159 - DNA, 21 bp, Homo sapiens
tgacattgttggccaaagcca

SEQ ID NO: 3774160 - DNA, 23 bp, Homo sapiens
tgaccaacatggagaaaccctgt

SEQ ID NO: 3774161 - DNA, 22 bp, Homo sapiens
tgaccaaccttttcccaaccat

SEQ ID NO: 3774162 - DNA, 14 bp, Homo sapiens
tgaccaagaactgc

SEQ ID NO: 3774163 - DNA, 15 bp, Homo sapiens
tgaccaagaactgca

SEQ ID NO: 3774164 - DNA, 18 bp, Homo sapiens
tgaccaagagagaaagaa

SEQ ID NO: 3774165 - DNA, 14 bp, Homo sapiens
tgaccaagcaggaa

SEQ ID NO: 3774166 - DNA, 21 bp, Homo sapiens
tgaccacgctttctagctgtt

SEQ ID NO: 3774167 - DNA, 22 bp, Homo sapiens
tgaccacgctttctagctgttg

SEQ ID NO: 3774168 - DNA, 17 bp, Homo sapiens
tgaccagcagatcccag

SEQ ID NO: 3774169 - DNA, 18 bp, Homo sapiens
tgaccagcagatcccagc

SEQ ID NO: 3774170 - DNA, 21 bp, Homo sapiens
tgaccagcagatcccagctca

SEQ ID NO: 3774171 - DNA, 22 bp, Homo sapiens
tgaccagcctccatgctgcctc

SEQ ID NO: 3774172 - DNA, 16 bp, Homo sapiens
tgaccatactgaggga

SEQ ID NO: 3774173 - DNA, 22 bp, Homo sapiens
tgaccatccactctaccctccc

SEQ ID NO: 3774174 - DNA, 19 bp, Homo sapiens
tgacccagccccttgagaa

SEQ ID NO: 3774175 - DNA, 23 bp, Homo sapiens
tgacccagccccttgagaaacct

SEQ ID NO: 3774176 - DNA, 16 bp, Homo sapiens
tgacccaggctgcctg

SEQ ID NO: 3774177 - DNA, 15 bp, Homo sapiens
tgacccagtccctgg

SEQ ID NO: 3774178 - DNA, 14 bp, Homo sapiens
tgacccccctcagg

SEQ ID NO: 3774179 - DNA, 12 bp, Homo sapiens
tgaccctccctt

SEQ ID NO: 3774180 - DNA, 16 bp, Homo sapiens
tgaccctcccttcctg

SEQ ID NO: 3774181 - DNA, 22 bp, Homo sapiens
tgaccctgcgaaggggccctgg

SEQ ID NO: 3774182 - DNA, 23 bp, Homo sapiens
tgaccctgcgaaggggccctggt

SEQ ID NO: 3774183 - DNA, 14 bp, Homo sapiens
tgaccggaggcaaa

SEQ ID NO: 3774184 - DNA, 18 bp, Homo sapiens
tgacctcaacctgtgatg

SEQ ID NO: 3774185 - DNA, 21 bp, Homo sapiens
tgacctcaagatgtcctcctt

SEQ ID NO: 3774186 - DNA, 15 bp, Homo sapiens
tgacctccacagctt

SEQ ID NO: 3774187 - DNA, 18 bp, Homo sapiens
tgacctccccctccttcc

SEQ ID NO: 3774188 - DNA, 21 bp, Homo sapiens
tgacctctataattgccactg

SEQ ID NO: 3774189 - DNA, 12 bp, Homo sapiens
tgacctctgcct

SEQ ID NO: 3774190 - DNA, 14 bp, Homo sapiens
tgacctgaggaagc

SEQ ID NO: 3774191 - DNA, 18 bp, Homo sapiens
tgatcagctgtttgtcat

SEQ ID NO: 3774192 - DNA, 13 bp, Homo sapiens
tgatcatgcattg

SEQ ID NO: 3774193 - DNA, 16 bp, Homo sapiens
tgatcatgcattgttg

SEQ ID NO: 3774194 - DNA, 16 bp, Homo sapiens
tgatcattttcccccc

SEQ ID NO: 3774195 - DNA, 19 bp, Homo sapiens
tgatcattttccccccact

SEQ ID NO: 3774196 - DNA, 12 bp, Homo sapiens
tgatcattttta

SEQ ID NO: 3774197 - DNA, 14 bp, Homo sapiens
tgatccaagctggt

SEQ ID NO: 3774198 - DNA, 15 bp, Homo sapiens
tgatccacccacctc

SEQ ID NO: 3774199 - DNA, 20 bp, Homo sapiens
tgatccacccacctcagcct

SEQ ID NO: 3774200 - DNA, 19 bp, Homo sapiens
tgatcccaagtgccagtct

SEQ ID NO: 3774201 - DNA, 13 bp, Homo sapiens
tgatcccagcact

SEQ ID NO: 3774202 - DNA, 22 bp, Homo sapiens
tgatccgttccattgcaagctt

SEQ ID NO: 3774203 - DNA, 22 bp, Homo sapiens
tgatcctaatgaatgcataaaa

SEQ ID NO: 3774204 - DNA, 15 bp, Homo sapiens
tgatcgtgctaaatt

SEQ ID NO: 3774205 - DNA, 22 bp, Homo sapiens
tgatcgtgctaaattttcagta

SEQ ID NO: 3774206 - DNA, 17 bp, Homo sapiens
tgatcgttctttctagc

SEQ ID NO: 3774207 - DNA, 21 bp, Homo sapiens
tgatctcagggaagcccagct

SEQ ID NO: 3774208 - DNA, 19 bp, Homo sapiens
tgatctccatatgttacac

SEQ ID NO: 3774209 - DNA, 16 bp, Homo sapiens
tgatctccctgccgcc

SEQ ID NO: 3774210 - DNA, 18 bp, Homo sapiens
tgatctctactaccacaa

SEQ ID NO: 3774211 - DNA, 21 bp, Homo sapiens
tgatctgatgcaagcaagaaa

SEQ ID NO: 3774212 - DNA, 22 bp, Homo sapiens
tgatctgggaactcccaagaac

SEQ ID NO: 3774213 - DNA, 15 bp, Homo sapiens
tgatctgtatataca

SEQ ID NO: 3774214 - DNA, 19 bp, Homo sapiens
tgatctgtatatacaataa

SEQ ID NO: 3774215 - DNA, 18 bp, Homo sapiens
tgatcttgctctatctca

SEQ ID NO: 3774216 - DNA, 18 bp, Homo sapiens
tgatcttgtgctcagcat

SEQ ID NO: 3774217 - DNA, 19 bp, Homo sapiens
tgatcttgtgctcagcatg

SEQ ID NO: 3774218 - DNA, 18 bp, Homo sapiens
tgatctttgcagacaggc

SEQ ID NO: 3774219 - DNA, 19 bp, Homo sapiens
tgatctttgcagacaggca

SEQ ID NO: 3774220 - DNA, 12 bp, Homo sapiens
tgatgaatcttg

SEQ ID NO: 3774221 - DNA, 17 bp, Homo sapiens
tgatgactggaattttt

SEQ ID NO: 3774222 - DNA, 20 bp, Homo sapiens
tgatgactggaatttttatt

SEQ ID NO: 3774223 - DNA, 15 bp, Homo sapiens
tgatgagctcctctt

SEQ ID NO: 3774224 - DNA, 16 bp, Homo sapiens
tgatgagctcctcttc

SEQ ID NO: 3774225 - DNA, 19 bp, Homo sapiens
tgatgagtgtaacaagaaa

SEQ ID NO: 3774226 - DNA, 19 bp, Homo sapiens
tgatgatctttgcagacag

SEQ ID NO: 3774227 - DNA, 17 bp, Homo sapiens
tgatgcacatttcatgt

SEQ ID NO: 3774228 - DNA, 15 bp, Homo sapiens
tgatgctccctcccc

SEQ ID NO: 3774229 - DNA, 21 bp, Homo sapiens
tgatgctccctcccctgccct

SEQ ID NO: 3774230 - DNA, 15 bp, Homo sapiens
tgatgctggatgctc

SEQ ID NO: 3774231 - DNA, 20 bp, Homo sapiens
tgatgctggatgctccttcc

SEQ ID NO: 3774232 - DNA, 22 bp, Homo sapiens
tgatgcttgtaacaagaaaaca

SEQ ID NO: 3774233 - DNA, 15 bp, Homo sapiens
tgatggaaacaaagt

SEQ ID NO: 3774234 - DNA, 23 bp, Homo sapiens
tgatggaaacaaagtggaaggaa

SEQ ID NO: 3774235 - DNA, 15 bp, Homo sapiens
tgatggcaattttgt

SEQ ID NO: 3774236 - DNA, 15 bp, Homo sapiens
tgatggtgatgaaat

SEQ ID NO: 3774237 - DNA, 16 bp, Homo sapiens
tgatggtgatgaaatg

SEQ ID NO: 3774238 - DNA, 18 bp, Homo sapiens
tgatggtttatgttgacc

SEQ ID NO: 3774239 - DNA, 19 bp, Homo sapiens
tgatgtaaatgaagtaact

SEQ ID NO: 3774240 - DNA, 15 bp, Homo sapiens
tgatgtacagttggg

SEQ ID NO: 3774241 - DNA, 15 bp, Homo sapiens
tgatgtacctgatgc

SEQ ID NO: 3774242 - DNA, 15 bp, Homo sapiens
tgatgtccctatgga

SEQ ID NO: 3774243 - DNA, 16 bp, Homo sapiens
tgatgtccctatggaa

SEQ ID NO: 3774244 - DNA, 17 bp, Homo sapiens
tgatgtgcaaaaatttt

SEQ ID NO: 3774245 - DNA, 18 bp, Homo sapiens
tgatgtgcaaaaattttt

SEQ ID NO: 3774246 - DNA, 18 bp, Homo sapiens
tgatgtggcaactgctga

SEQ ID NO: 3774247 - DNA, 17 bp, Homo sapiens
tgatgttaaaattccat

SEQ ID NO: 3774248 - DNA, 16 bp, Homo sapiens
tgatgtttgtggcctc

SEQ ID NO: 3774249 - DNA, 18 bp, Homo sapiens
tgattaaggtctctcttt

SEQ ID NO: 3774250 - DNA, 14 bp, Homo sapiens
tgattacacagttg

SEQ ID NO: 3774251 - DNA, 16 bp, Homo sapiens
tgattactctttgaga

SEQ ID NO: 3774252 - DNA, 16 bp, Homo sapiens
tgattactgtcaataa

SEQ ID NO: 3774253 - DNA, 19 bp, Homo sapiens
tgattactgtcaataaaca

SEQ ID NO: 3774254 - DNA, 23 bp, Homo sapiens
tgattactgtcaataaacagctt

SEQ ID NO: 3774255 - DNA, 13 bp, Homo sapiens
tgattagcaagtt

SEQ ID NO: 3774256 - DNA, 18 bp, Homo sapiens
tgattagcaagttacagt

SEQ ID NO: 3774257 - DNA, 12 bp, Homo sapiens
tgattcacagtg

SEQ ID NO: 3774258 - DNA, 13 bp, Homo sapiens
tgattcagctctg

SEQ ID NO: 3774259 - DNA, 19 bp, Homo sapiens
tgattcatgccaattagca

SEQ ID NO: 3774260 - DNA, 13 bp, Homo sapiens
tgattccatctcc

SEQ ID NO: 3774261 - DNA, 18 bp, Homo sapiens
tgattcccaagctctgct

SEQ ID NO: 3774262 - DNA, 19 bp, Homo sapiens
tgattcccaagctctgctc

SEQ ID NO: 3774263 - DNA, 21 bp, Homo sapiens
tgattcccaagctctgctcct

SEQ ID NO: 3774264 - DNA, 17 bp, Homo sapiens
tgattccctcctgctac

SEQ ID NO: 3774265 - DNA, 16 bp, Homo sapiens
tgattcgagctatatt

SEQ ID NO: 3774266 - DNA, 15 bp, Homo sapiens
tgattctcctgcctc

SEQ ID NO: 3774267 - DNA, 15 bp, Homo sapiens
tgattcttgagttta

SEQ ID NO: 3774268 - DNA, 20 bp, Homo sapiens
tgattcttgagtttagtgat

SEQ ID NO: 3774269 - DNA, 20 bp, Homo sapiens
tgattggcaggagttggaag

SEQ ID NO: 3774270 - DNA, 21 bp, Homo sapiens
tgattggtgcaacccttaccc

SEQ ID NO: 3774271 - DNA, 16 bp, Homo sapiens
tgattggttttaattg

SEQ ID NO: 3774272 - DNA, 14 bp, Homo sapiens
tgattgtcagctac

SEQ ID NO: 3774273 - DNA, 14 bp, Homo sapiens
tgatttaataacat

SEQ ID NO: 3774274 - DNA, 17 bp, Homo sapiens
tgatttagcaggaagct

SEQ ID NO: 3774275 - DNA, 18 bp, Homo sapiens
tgatttatcacacaaagc

SEQ ID NO: 3774276 - DNA, 22 bp, Homo sapiens
tgatttatctgagtcaactcct

SEQ ID NO: 3774277 - DNA, 18 bp, Homo sapiens
tgatttcaggatactctg

SEQ ID NO: 3774278 - DNA, 14 bp, Homo sapiens
tgatttccaaagag

SEQ ID NO: 3774279 - DNA, 18 bp, Homo sapiens
tgatttccaaagagaaaa

SEQ ID NO: 3774280 - DNA, 17 bp, Homo sapiens
tgatttcttgtaacatc

SEQ ID NO: 3774281 - DNA, 15 bp, Homo sapiens
tgatttgtactgaaa

SEQ ID NO: 3774282 - DNA, 14 bp, Homo sapiens
tgattttaacaata

SEQ ID NO: 3774283 - DNA, 17 bp, Homo sapiens
tgattttaacaataact

SEQ ID NO: 3774284 - DNA, 22 bp, Homo sapiens
tgattttaacaataactactgt

SEQ ID NO: 3774285 - DNA, 16 bp, Homo sapiens
tgcaaaatttccagta

SEQ ID NO: 3774286 - DNA, 22 bp, Homo sapiens
tgcaaacatggggttggctggg

SEQ ID NO: 3774287 - DNA, 12 bp, Homo sapiens
tgcaaagatttg

SEQ ID NO: 3774288 - DNA, 23 bp, Homo sapiens
tgcaaagttccctacttcctgtg

SEQ ID NO: 3774289 - DNA, 20 bp, Homo sapiens
tgcaaattcccagatttgaa

SEQ ID NO: 3774290 - DNA, 13 bp, Homo sapiens
tgcaacaaaattc

SEQ ID NO: 3774291 - DNA, 13 bp, Homo sapiens
tgcaacaacatgt

SEQ ID NO: 3774292 - DNA, 12 bp, Homo sapiens
tgcaacacacag

SEQ ID NO: 3774293 - DNA, 14 bp, Homo sapiens
tgcaacacacagac

SEQ ID NO: 3774294 - DNA, 13 bp, Homo sapiens
tgcaacagacaag

SEQ ID NO: 3774295 - DNA, 13 bp, Homo sapiens
tgcaacaggctgg

SEQ ID NO: 3774296 - DNA, 15 bp, Homo sapiens
tgcaacaggctgggc

SEQ ID NO: 3774297 - DNA, 16 bp, Homo sapiens
tgcaacaggctgggct

SEQ ID NO: 3774298 - DNA, 14 bp, Homo sapiens
tgcaacagtagcat

SEQ ID NO: 3774299 - DNA, 15 bp, Homo sapiens
tgcaacccttacccc

SEQ ID NO: 3774300 - DNA, 14 bp, Homo sapiens
tgcaacctgttgat

SEQ ID NO: 3774301 - DNA, 23 bp, Homo sapiens
tgcaagagccttggtgtccacct

SEQ ID NO: 3774302 - DNA, 13 bp, Homo sapiens
tgcaaggaccagg

SEQ ID NO: 3774303 - DNA, 11 bp, Homo sapiens
tgcaaggcact

SEQ ID NO: 3774304 - DNA, 17 bp, Homo sapiens
tgcaaggcactgtacta

SEQ ID NO: 3774305 - DNA, 21 bp, Homo sapiens
ttatgagtttttgatagcttt

SEQ ID NO: 3774306 - DNA, 21 bp, Homo sapiens
ttatgataaaaaattttgtaa

SEQ ID NO: 3774307 - DNA, 18 bp, Homo sapiens
ttatgatatttttttaag

SEQ ID NO: 3774308 - DNA, 22 bp, Homo sapiens
ttatgcaaggaaggaaagaaag

SEQ ID NO: 3774309 - DNA, 20 bp, Homo sapiens
ttatgcagcttccttttgag

SEQ ID NO: 3774310 - DNA, 16 bp, Homo sapiens
ttatgcatcatttcag

SEQ ID NO: 3774311 - DNA, 15 bp, Homo sapiens
ttatgccttttattt

SEQ ID NO: 3774312 - DNA, 17 bp, Homo sapiens
ttatggttttgtgatgt

SEQ ID NO: 3774313 - DNA, 17 bp, Homo sapiens
ttatgtaataatgtgaa

SEQ ID NO: 3774314 - DNA, 19 bp, Homo sapiens
ttatgtatgtttacactgt

SEQ ID NO: 3774315 - DNA, 19 bp, Homo sapiens
ttatgtctgctgaataata

SEQ ID NO: 3774316 - DNA, 23 bp, Homo sapiens
ttatgtgaatgatctctctgaat

SEQ ID NO: 3774317 - DNA, 18 bp, Homo sapiens
ttatgtgtatgtgccatt

SEQ ID NO: 3774318 - DNA, 19 bp, Homo sapiens
ttatgtgtatgtgccattt

SEQ ID NO: 3774319 - DNA, 18 bp, Homo sapiens
ttatgttattgaaaaaaa

SEQ ID NO: 3774320 - DNA, 17 bp, Homo sapiens
ttatgttgtatagatta

SEQ ID NO: 3774321 - DNA, 19 bp, Homo sapiens
ttatgttttgtttctgaaa

SEQ ID NO: 3774322 - DNA, 20 bp, Homo sapiens
ttattaaaacagaaattaat

SEQ ID NO: 3774323 - DNA, 22 bp, Homo sapiens
ttattaaaacagaaattaatct

SEQ ID NO: 3774324 - DNA, 19 bp, Homo sapiens
ttattaagatggattctca

SEQ ID NO: 3774325 - DNA, 23 bp, Homo sapiens
ttattaagatggattctcagata

SEQ ID NO: 3774326 - DNA, 13 bp, Homo sapiens
ttattaatgctaa

SEQ ID NO: 3774327 - DNA, 17 bp, Homo sapiens
ttattacatccttgtgg

SEQ ID NO: 3774328 - DNA, 18 bp, Homo sapiens
ttattacatccttgtggc

SEQ ID NO: 3774329 - DNA, 15 bp, Homo sapiens
ttattacctctgata

SEQ ID NO: 3774330 - DNA, 14 bp, Homo sapiens
ttattacttatttg

SEQ ID NO: 3774331 - DNA, 19 bp, Homo sapiens
ttattatgcataactgaca

SEQ ID NO: 3774332 - DNA, 19 bp, Homo sapiens
ttattcaattcctctggga

SEQ ID NO: 3774333 - DNA, 20 bp, Homo sapiens
ttattcaccatgtaaaacaa

SEQ ID NO: 3774334 - DNA, 17 bp, Homo sapiens
ttattcagttaagaaaa

SEQ ID NO: 3774335 - DNA, 12 bp, Homo sapiens
ttattcattgtg

SEQ ID NO: 3774336 - DNA, 19 bp, Homo sapiens
ttattccctttcacaaaat

SEQ ID NO: 3774337 - DNA, 20 bp, Homo sapiens
ttattcctatatagtttatt

SEQ ID NO: 3774338 - DNA, 16 bp, Homo sapiens
ttattctcaaagcagg

SEQ ID NO: 3774339 - DNA, 17 bp, Homo sapiens
ttattctcactccacca

SEQ ID NO: 3774340 - DNA, 14 bp, Homo sapiens
ttattgacaataat

SEQ ID NO: 3774341 - DNA, 16 bp, Homo sapiens
ttattggaattaacct

SEQ ID NO: 3774342 - DNA, 22 bp, Homo sapiens
ttattggaattaacctggtgct

SEQ ID NO: 3774343 - DNA, 14 bp, Homo sapiens
ttattgtacctctc

SEQ ID NO: 3774344 - DNA, 16 bp, Homo sapiens
ttattgttccaagaca

SEQ ID NO: 3774345 - DNA, 22 bp, Homo sapiens
ttatttactgagcttctctgtg

SEQ ID NO: 3774346 - DNA, 17 bp, Homo sapiens
ttatttagggaactgct

SEQ ID NO: 3774347 - DNA, 16 bp, Homo sapiens
ttatttagttccttga

SEQ ID NO: 3774348 - DNA, 13 bp, Homo sapiens
ttatttattaaga

SEQ ID NO: 3774349 - DNA, 15 bp, Homo sapiens
ttatttattggagat

SEQ ID NO: 3774350 - DNA, 15 bp, Homo sapiens
ttatttgcagagaca

SEQ ID NO: 3774351 - DNA, 18 bp, Homo sapiens
ttattttattttagcagt

SEQ ID NO: 3774352 - DNA, 16 bp, Homo sapiens
ttattttcctccccag

SEQ ID NO: 3774353 - DNA, 12 bp, Homo sapiens
ttattttctggt

SEQ ID NO: 3774354 - DNA, 17 bp, Homo sapiens
ttatttttagacagagt

SEQ ID NO: 3774355 - DNA, 18 bp, Homo sapiens
ttatttttagacagagtc

SEQ ID NO: 3774356 - DNA, 13 bp, Homo sapiens
ttatttttagatg

SEQ ID NO: 3774357 - DNA, 15 bp, Homo sapiens
ttatttttatacagt

SEQ ID NO: 3774358 - DNA, 16 bp, Homo sapiens
ttatttttatacagta

SEQ ID NO: 3774359 - DNA, 17 bp, Homo sapiens
ttatttttatacagtag

SEQ ID NO: 3774360 - DNA, 22 bp, Homo sapiens
ttatttttatacagtagtgaga

SEQ ID NO: 3774361 - DNA, 23 bp, Homo sapiens
ttatttttgtttcttccaaagca

SEQ ID NO: 3774362 - DNA, 16 bp, Homo sapiens
ttattttttaattatt

SEQ ID NO: 3774363 - DNA, 14 bp, Homo sapiens
ttattttttacatt

SEQ ID NO: 3774364 - DNA, 18 bp, Homo sapiens
ttattttttacattatta

SEQ ID NO: 3774365 - DNA, 15 bp, Homo sapiens
ttattttttatacag

SEQ ID NO: 3774366 - DNA, 11 bp, Homo sapiens
ttcaaaaatgt

SEQ ID NO: 3774367 - DNA, 16 bp, Homo sapiens
ttcaaaaatgtacaaa

SEQ ID NO: 3774368 - DNA, 13 bp, Homo sapiens
ttcaaaaatttgg

SEQ ID NO: 3774369 - DNA, 21 bp, Homo sapiens
ttcaaaagaatcagaaacagg

SEQ ID NO: 3774370 - DNA, 14 bp, Homo sapiens
ttcaaaataaaaac

SEQ ID NO: 3774371 - DNA, 18 bp, Homo sapiens
ttcaaaatgtctgtagct

SEQ ID NO: 3774372 - DNA, 23 bp, Homo sapiens
ttcaaagccaagtttatatacaa

SEQ ID NO: 3774373 - DNA, 16 bp, Homo sapiens
ttcaaagcttgaagat

SEQ ID NO: 3774374 - DNA, 19 bp, Homo sapiens
ttcaaatgggctgctgctt

SEQ ID NO: 3774375 - DNA, 18 bp, Homo sapiens
ttcaaattgagagaatgg

SEQ ID NO: 3774376 - DNA, 19 bp, Homo sapiens
ttcaacatcaatgttcatt

SEQ ID NO: 3774377 - DNA, 14 bp, Homo sapiens
ttcaacgcagccct

SEQ ID NO: 3774378 - DNA, 19 bp, Homo sapiens
ttcaagaaaagtaagccct

SEQ ID NO: 3774379 - DNA, 13 bp, Homo sapiens
ttcaagaaactga

SEQ ID NO: 3774380 - DNA, 20 bp, Homo sapiens
ttcaagaaactgaggaattt

SEQ ID NO: 3774381 - DNA, 21 bp, Homo sapiens
ttcaagaaagccagtcttaac

SEQ ID NO: 3774382 - DNA, 18 bp, Homo sapiens
ttcaaggtaaaattctaa

SEQ ID NO: 3774383 - DNA, 20 bp, Homo sapiens
ttcaaggtaaaattctaaat

SEQ ID NO: 3774384 - DNA, 16 bp, Homo sapiens
ttcaagtcacctcctt

SEQ ID NO: 3774385 - DNA, 13 bp, Homo sapiens
ttcaagttaaagt

SEQ ID NO: 3774386 - DNA, 14 bp, Homo sapiens
ttcaataaagtatc

SEQ ID NO: 3774387 - DNA, 19 bp, Homo sapiens
ttcaataaagtatctacat

SEQ ID NO: 3774388 - DNA, 11 bp, Homo sapiens
ttcaatattta

SEQ ID NO: 3774389 - DNA, 13 bp, Homo sapiens
ttcaattcagtgc

SEQ ID NO: 3774390 - DNA, 12 bp, Homo sapiens
ttcaattcctct

SEQ ID NO: 3774391 - DNA, 18 bp, Homo sapiens
ttcaattctcatttgtca

SEQ ID NO: 3774392 - DNA, 19 bp, Homo sapiens
ttcaatttattcaagaaaa

SEQ ID NO: 3774393 - DNA, 17 bp, Homo sapiens
ttcaatttattgcacaa

SEQ ID NO: 3774394 - DNA, 20 bp, Homo sapiens
ttcaatttattgcacaaaat

SEQ ID NO: 3774395 - DNA, 21 bp, Homo sapiens
ttcacaaccttctgtggctca

SEQ ID NO: 3774396 - DNA, 18 bp, Homo sapiens
ttcacaagctgcctccct

SEQ ID NO: 3774397 - DNA, 20 bp, Homo sapiens
ttcacacttccaccagcctg

SEQ ID NO: 3774398 - DNA, 12 bp, Homo sapiens
ttcacagtgttt

SEQ ID NO: 3774399 - DNA, 22 bp, Homo sapiens
ttcacagtgtttcgacagctga

SEQ ID NO: 3774400 - DNA, 18 bp, Homo sapiens
ttcacagtttcttccatt

SEQ ID NO: 3774401 - DNA, 17 bp, Homo sapiens
ttcacatagatgtccct

SEQ ID NO: 3774402 - DNA, 22 bp, Homo sapiens
ttcaccacatgtgcacatgcac

SEQ ID NO: 3774403 - DNA, 22 bp, Homo sapiens
ttcaccatgtaaaacaaaaaac

SEQ ID NO: 3774404 - DNA, 19 bp, Homo sapiens
ttcacccacagaaagagag

SEQ ID NO: 3774405 - DNA, 13 bp, Homo sapiens
ttcaccccaccct

SEQ ID NO: 3774406 - DNA, 14 bp, Homo sapiens
ttcaccccaccctt

SEQ ID NO: 3774407 - DNA, 17 bp, Homo sapiens
ttcacctaagtctctgt

SEQ ID NO: 3774408 - DNA, 19 bp, Homo sapiens
ttcacctaagtctctgtga

SEQ ID NO: 3774409 - DNA, 14 bp, Homo sapiens
ttcacctgtaaaac

SEQ ID NO: 3774410 - DNA, 17 bp, Homo sapiens
ttcacggaagagccttg

SEQ ID NO: 3774411 - DNA, 13 bp, Homo sapiens
ttcactaaagcag

SEQ ID NO: 3774412 - DNA, 23 bp, Homo sapiens
ttcactacccatcggtgtccatt

SEQ ID NO: 3774413 - DNA, 13 bp, Homo sapiens
ttcactccagcct

SEQ ID NO: 3774414 - DNA, 22 bp, Homo sapiens
ttcactccggtgtgcctgcagc

SEQ ID NO: 3774415 - DNA, 13 bp, Homo sapiens
ttcactgctggct

SEQ ID NO: 3774416 - DNA, 16 bp, Homo sapiens
ttcactgctggctgcc

SEQ ID NO: 3774417 - DNA, 19 bp, Homo sapiens
ttcactttcacatagatgt

SEQ ID NO: 3774418 - DNA, 22 bp, Homo sapiens
ttcagaaaacagaaaaaaaaca

SEQ ID NO: 3774419 - DNA, 12 bp, Homo sapiens
ttcagaagagat

SEQ ID NO: 3774420 - DNA, 14 bp, Homo sapiens
tgtctttctttggt

SEQ ID NO: 3774421 - DNA, 15 bp, Homo sapiens
tgtctttggtcctct

SEQ ID NO: 3774422 - DNA, 20 bp, Homo sapiens
tgtctttggtcctcttgcca

SEQ ID NO: 3774423 - DNA, 17 bp, Homo sapiens
tgtctttttctggactg

SEQ ID NO: 3774424 - DNA, 23 bp, Homo sapiens
tgtctttttctggactgaagcct

SEQ ID NO: 3774425 - DNA, 21 bp, Homo sapiens
tgtgaaagtcagatgcccaga

SEQ ID NO: 3774426 - DNA, 14 bp, Homo sapiens
tgtgaaatgaaaac

SEQ ID NO: 3774427 - DNA, 16 bp, Homo sapiens
tgtgaaccaccacacc

SEQ ID NO: 3774428 - DNA, 20 bp, Homo sapiens
tgtgaaccaccacacccagc

SEQ ID NO: 3774429 - DNA, 14 bp, Homo sapiens
tgtgaagagaacca

SEQ ID NO: 3774430 - DNA, 18 bp, Homo sapiens
tgtgaagagggagaagca

SEQ ID NO: 3774431 - DNA, 22 bp, Homo sapiens
tgtgaagatcacgttccttccc

SEQ ID NO: 3774432 - DNA, 12 bp, Homo sapiens
tgtgaataaatt

SEQ ID NO: 3774433 - DNA, 18 bp, Homo sapiens
tgtgacatattatgtctt

SEQ ID NO: 3774434 - DNA, 19 bp, Homo sapiens
tgtgacatgcgggctgggc

SEQ ID NO: 3774435 - DNA, 21 bp, Homo sapiens
tgtgacatgcgggctgggcag

SEQ ID NO: 3774436 - DNA, 14 bp, Homo sapiens
tgtgaccagcactg

SEQ ID NO: 3774437 - DNA, 15 bp, Homo sapiens
tgtgactagtgctga

SEQ ID NO: 3774438 - DNA, 16 bp, Homo sapiens
tgtgactagtgctgaa

SEQ ID NO: 3774439 - DNA, 17 bp, Homo sapiens
tgtgactagtgctgaag

SEQ ID NO: 3774440 - DNA, 18 bp, Homo sapiens
tgtgacttcagctctgtt

SEQ ID NO: 3774441 - DNA, 14 bp, Homo sapiens
tgtgagacccccac

SEQ ID NO: 3774442 - DNA, 16 bp, Homo sapiens
tgtgagacccccacac

SEQ ID NO: 3774443 - DNA, 14 bp, Homo sapiens
tgtgagcaagaagt

SEQ ID NO: 3774444 - DNA, 16 bp, Homo sapiens
tgtgagccaccgctgc

SEQ ID NO: 3774445 - DNA, 14 bp, Homo sapiens
tgtgagccagtcta

SEQ ID NO: 3774446 - DNA, 13 bp, Homo sapiens
tgtgaggagctgc

SEQ ID NO: 3774447 - DNA, 14 bp, Homo sapiens
tgtgaggagctgct

SEQ ID NO: 3774448 - DNA, 17 bp, Homo sapiens
tgtgaggagctgctggc

SEQ ID NO: 3774449 - DNA, 21 bp, Homo sapiens
tgtgagtcaccaagcccagtt

SEQ ID NO: 3774450 - DNA, 16 bp, Homo sapiens
tgtgagtgtaagtgtg

SEQ ID NO: 3774451 - DNA, 20 bp, Homo sapiens
tgtgagtgtgtccaagtgtg

SEQ ID NO: 3774452 - DNA, 16 bp, Homo sapiens
tgtgagtttaaagcaa

SEQ ID NO: 3774453 - DNA, 20 bp, Homo sapiens
tgtgatcaggctatgtatgg

SEQ ID NO: 3774454 - DNA, 23 bp, Homo sapiens
tgtgatcccaagtgccagtcttg

SEQ ID NO: 3774455 - DNA, 22 bp, Homo sapiens
tgtgatgatgaaatgaggtcag

SEQ ID NO: 3774456 - DNA, 15 bp, Homo sapiens
tgtgcaaaaattttt

SEQ ID NO: 3774457 - DNA, 15 bp, Homo sapiens
tgtgcaacagacaag

SEQ ID NO: 3774458 - DNA, 17 bp, Homo sapiens
tgtgcaagtatgtgagt

SEQ ID NO: 3774459 - DNA, 22 bp, Homo sapiens
tgtgcacatgcacgtgtgtgca

SEQ ID NO: 3774460 - DNA, 19 bp, Homo sapiens
tgtgcagactcaataaaat

SEQ ID NO: 3774461 - DNA, 23 bp, Homo sapiens
tgtgcagactcaataaaatcatg

SEQ ID NO: 3774462 - DNA, 19 bp, Homo sapiens
tgtgcatagagccacgtat

SEQ ID NO: 3774463 - DNA, 22 bp, Homo sapiens
tgtgcatgtgtgcgagtgtgtg

SEQ ID NO: 3774464 - DNA, 14 bp, Homo sapiens
tgtgcatgtgtgtg

SEQ ID NO: 3774465 - DNA, 21 bp, Homo sapiens
tgtgcatttttgtgaaatgaa

SEQ ID NO: 3774466 - DNA, 22 bp, Homo sapiens
tgtgcatttttgtgaaatgaaa

SEQ ID NO: 3774467 - DNA, 20 bp, Homo sapiens
tgtgccaggtttttggtctg

SEQ ID NO: 3774468 - DNA, 21 bp, Homo sapiens
tgtgcccagttaatcttgctt

SEQ ID NO: 3774469 - DNA, 14 bp, Homo sapiens
tgtgccccatgcct

SEQ ID NO: 3774470 - DNA, 19 bp, Homo sapiens
tgtgccccatgcctgtcca

SEQ ID NO: 3774471 - DNA, 22 bp, Homo sapiens
tgtgcccccagacgcacgtggg

SEQ ID NO: 3774472 - DNA, 17 bp, Homo sapiens
tgtgcctctgggactgg

SEQ ID NO: 3774473 - DNA, 12 bp, Homo sapiens
tgtgcctgcagc

SEQ ID NO: 3774474 - DNA, 18 bp, Homo sapiens
tgtgcctggagctcctgg

SEQ ID NO: 3774475 - DNA, 19 bp, Homo sapiens
tgtgcctggagctcctggg

SEQ ID NO: 3774476 - DNA, 14 bp, Homo sapiens
tgtgcgtgaaacac

SEQ ID NO: 3774477 - DNA, 16 bp, Homo sapiens
tgtgcgtgaaacacac

SEQ ID NO: 3774478 - DNA, 22 bp, Homo sapiens
tgtgctcatgcattgcttgtgt

SEQ ID NO: 3774479 - DNA, 18 bp, Homo sapiens
tgtgctctggacaggcat

SEQ ID NO: 3774480 - DNA, 19 bp, Homo sapiens
tgtgctctggacaggcatg

SEQ ID NO: 3774481 - DNA, 17 bp, Homo sapiens
tgtgctgtggttcctgg

SEQ ID NO: 3774482 - DNA, 14 bp, Homo sapiens
tgtggaaaaatatt

SEQ ID NO: 3774483 - DNA, 19 bp, Homo sapiens
tgtggaaagcctctgctgc

SEQ ID NO: 3774484 - DNA, 16 bp, Homo sapiens
tgtggaaagtgaattt

SEQ ID NO: 3774485 - DNA, 14 bp, Homo sapiens
tgtggactgtgatg

SEQ ID NO: 3774486 - DNA, 23 bp, Homo sapiens
tgtggagaaactgtagtctcagg

SEQ ID NO: 3774487 - DNA, 12 bp, Homo sapiens
tgtggagaagcg

SEQ ID NO: 3774488 - DNA, 16 bp, Homo sapiens
tgtggcagctgtctca

SEQ ID NO: 3774489 - DNA, 22 bp, Homo sapiens
tgtggcagtaaagagaaacttt

SEQ ID NO: 3774490 - DNA, 22 bp, Homo sapiens
tgtggccatggtccccaagacc

SEQ ID NO: 3774491 - DNA, 17 bp, Homo sapiens
tgtggcccctgaacaag

SEQ ID NO: 3774492 - DNA, 13 bp, Homo sapiens
tgtggccccttca

SEQ ID NO: 3774493 - DNA, 12 bp, Homo sapiens
tgtggccctggc

SEQ ID NO: 3774494 - DNA, 14 bp, Homo sapiens
tgtggccctggcct

SEQ ID NO: 3774495 - DNA, 20 bp, Homo sapiens
tgtggccttccatttatatg

SEQ ID NO: 3774496 - DNA, 14 bp, Homo sapiens
tgtggctcccctct

SEQ ID NO: 3774497 - DNA, 15 bp, Homo sapiens
tgtggctcccctcta

SEQ ID NO: 3774498 - DNA, 14 bp, Homo sapiens
tgtggctgctagca

SEQ ID NO: 3774499 - DNA, 21 bp, Homo sapiens
tgtggctgggggcaggagggc

SEQ ID NO: 3774500 - DNA, 21 bp, Homo sapiens
tgtggctgtcagcaggaagca

SEQ ID NO: 3774501 - DNA, 17 bp, Homo sapiens
tgtggctttcagagcct

SEQ ID NO: 3774502 - DNA, 18 bp, Homo sapiens
tgtgggaatgcggcaaga

SEQ ID NO: 3774503 - DNA, 19 bp, Homo sapiens
tgtgggaatgcggcaagaa

SEQ ID NO: 3774504 - DNA, 13 bp, Homo sapiens
tgtgggactgtac

SEQ ID NO: 3774505 - DNA, 19 bp, Homo sapiens
tgtgggactgtacacactt

SEQ ID NO: 3774506 - DNA, 20 bp, Homo sapiens
tgtgggactgtacacacttt

SEQ ID NO: 3774507 - DNA, 13 bp, Homo sapiens
tgtgggagcagcg

SEQ ID NO: 3774508 - DNA, 22 bp, Homo sapiens
tgtgggctagttgggcttcctc

SEQ ID NO: 3774509 - DNA, 13 bp, Homo sapiens
tgtgggctccctt

SEQ ID NO: 3774510 - DNA, 13 bp, Homo sapiens
tgtgggctgtgag

SEQ ID NO: 3774511 - DNA, 14 bp, Homo sapiens
tgtgggctgtgagt

SEQ ID NO: 3774512 - DNA, 15 bp, Homo sapiens
tgtgggtacctgtat

SEQ ID NO: 3774513 - DNA, 15 bp, Homo sapiens
tgtgggtcaaggaat

SEQ ID NO: 3774514 - DNA, 22 bp, Homo sapiens
tgtggtagggacttaaaaaact

SEQ ID NO: 3774515 - DNA, 17 bp, Homo sapiens
tgtggtagttaataaaa

SEQ ID NO: 3774516 - DNA, 20 bp, Homo sapiens
tgtggttatttttatacagt

SEQ ID NO: 3774517 - DNA, 19 bp, Homo sapiens
tgtggttgacttatgggcc

SEQ ID NO: 3774518 - DNA, 15 bp, Homo sapiens
tgttgcccaggctgg

SEQ ID NO: 3774519 - DNA, 13 bp, Homo sapiens
tgttggaaaagaa

SEQ ID NO: 3774520 - DNA, 19 bp, Homo sapiens
tgttggataaatcagtggt

SEQ ID NO: 3774521 - DNA, 20 bp, Homo sapiens
tgttggataaatcagtggtt

SEQ ID NO: 3774522 - DNA, 15 bp, Homo sapiens
tgttggccaaagcca

SEQ ID NO: 3774523 - DNA, 16 bp, Homo sapiens
tgttggccaggctggt

SEQ ID NO: 3774524 - DNA, 21 bp, Homo sapiens
tgttgtaaatatttatgtaaa

SEQ ID NO: 3774525 - DNA, 15 bp, Homo sapiens
tgttgtcagcatctt

SEQ ID NO: 3774526 - DNA, 14 bp, Homo sapiens
tgttgtcagctgaa

SEQ ID NO: 3774527 - DNA, 16 bp, Homo sapiens
tgttgtggtttgttgc

SEQ ID NO: 3774528 - DNA, 21 bp, Homo sapiens
tgttgtgtacgtggagaggga

SEQ ID NO: 3774529 - DNA, 17 bp, Homo sapiens
tgttgttaatgaaaatg

SEQ ID NO: 3774530 - DNA, 18 bp, Homo sapiens
tgttgttaatgaaaatgt

SEQ ID NO: 3774531 - DNA, 11 bp, Homo sapiens
tgttgttattt

SEQ ID NO: 3774532 - DNA, 15 bp, Homo sapiens
tgttgtttgtaaata

SEQ ID NO: 3774533 - DNA, 21 bp, Homo sapiens
tgttgtttgtaaataagagat

SEQ ID NO: 3774534 - DNA, 18 bp, Homo sapiens
tgtttaaaaaagtttaaa

SEQ ID NO: 3774535 - DNA, 14 bp, Homo sapiens
tgtttaagatttaa

SEQ ID NO: 3774536 - DNA, 20 bp, Homo sapiens
tgtttaagatttaatttgcc

SEQ ID NO: 3774537 - DNA, 21 bp, Homo sapiens
tgtttaagatttaatttgcca

SEQ ID NO: 3774538 - DNA, 22 bp, Homo sapiens
tgtttaagatttaatttgccaa

SEQ ID NO: 3774539 - DNA, 15 bp, Homo sapiens
tgtcaactttatgca

SEQ ID NO: 3774540 - DNA, 16 bp, Homo sapiens
tgtcaaggtgctgttg

SEQ ID NO: 3774541 - DNA, 19 bp, Homo sapiens
tgtcaagtctctgctggcc

SEQ ID NO: 3774542 - DNA, 19 bp, Homo sapiens
tgtcaagttaacaaggaat

SEQ ID NO: 3774543 - DNA, 12 bp, Homo sapiens
tgtcaataaaca

SEQ ID NO: 3774544 - DNA, 18 bp, Homo sapiens
tgtcacaacctctctgat

SEQ ID NO: 3774545 - DNA, 13 bp, Homo sapiens
tgtcacaataaat

SEQ ID NO: 3774546 - DNA, 21 bp, Homo sapiens
tgtcacaatcctaacacatta

SEQ ID NO: 3774547 - DNA, 18 bp, Homo sapiens
tgtcacagaaatcagagg

SEQ ID NO: 3774548 - DNA, 13 bp, Homo sapiens
tgtcacaggcagg

SEQ ID NO: 3774549 - DNA, 14 bp, Homo sapiens
tgtcacaggcaggt

SEQ ID NO: 3774550 - DNA, 22 bp, Homo sapiens
tgtcaccgtgagcagctttgga

SEQ ID NO: 3774551 - DNA, 23 bp, Homo sapiens
tgtcaccgtgagcagctttggaa

SEQ ID NO: 3774552 - DNA, 14 bp, Homo sapiens
tgtcactaaagcag

SEQ ID NO: 3774553 - DNA, 16 bp, Homo sapiens
tgtcactactcacagt

SEQ ID NO: 3774554 - DNA, 23 bp, Homo sapiens
tgtcactggtagaccaaaataaa

SEQ ID NO: 3774555 - DNA, 23 bp, Homo sapiens
tgtcagactttaaagaataatat

SEQ ID NO: 3774556 - DNA, 12 bp, Homo sapiens
tgtcagagctgg

SEQ ID NO: 3774557 - DNA, 21 bp, Homo sapiens
tgtcagatattttttcagaaa

SEQ ID NO: 3774558 - DNA, 18 bp, Homo sapiens
tgtcagcatcttctcact

SEQ ID NO: 3774559 - DNA, 16 bp, Homo sapiens
tgtcaggtggggcagc

SEQ ID NO: 3774560 - DNA, 17 bp, Homo sapiens
tgtcaggtggggcagct

SEQ ID NO: 3774561 - DNA, 14 bp, Homo sapiens
tgtcagtgcagccc

SEQ ID NO: 3774562 - DNA, 23 bp, Homo sapiens
tgtcataccaggccgccccagcc

SEQ ID NO: 3774563 - DNA, 15 bp, Homo sapiens
tgtcatagaaattac

SEQ ID NO: 3774564 - DNA, 20 bp, Homo sapiens
tgtcatctaccttttctctt

SEQ ID NO: 3774565 - DNA, 13 bp, Homo sapiens
tgtcatctcagct

SEQ ID NO: 3774566 - DNA, 15 bp, Homo sapiens
tgtcatctcagtgct

SEQ ID NO: 3774567 - DNA, 16 bp, Homo sapiens
tgtcatttgagcaggg

SEQ ID NO: 3774568 - DNA, 20 bp, Homo sapiens
tgtcatttgagcagggctca

SEQ ID NO: 3774569 - DNA, 21 bp, Homo sapiens
tgtcatttgagcagggctcag

SEQ ID NO: 3774570 - DNA, 17 bp, Homo sapiens
tgtcattttgaagctaa

SEQ ID NO: 3774571 - DNA, 18 bp, Homo sapiens
tgtcattttgaagctaat

SEQ ID NO: 3774572 - DNA, 15 bp, Homo sapiens
tgtcatttttgcagt

SEQ ID NO: 3774573 - DNA, 15 bp, Homo sapiens
tgtccaaactgccta

SEQ ID NO: 3774574 - DNA, 18 bp, Homo sapiens
tgtccaacccgaggcccg

SEQ ID NO: 3774575 - DNA, 21 bp, Homo sapiens
tgtccaacctaacccctttcc

SEQ ID NO: 3774576 - DNA, 13 bp, Homo sapiens
tgtccaactccag

SEQ ID NO: 3774577 - DNA, 14 bp, Homo sapiens
tgtccacagatgcc

SEQ ID NO: 3774578 - DNA, 18 bp, Homo sapiens
tgtccacagatgcctcca

SEQ ID NO: 3774579 - DNA, 20 bp, Homo sapiens
tgtccacagatgcctccacc

SEQ ID NO: 3774580 - DNA, 12 bp, Homo sapiens
tgtccagcctgg

SEQ ID NO: 3774581 - DNA, 14 bp, Homo sapiens
tgtccagcctgggc

SEQ ID NO: 3774582 - DNA, 22 bp, Homo sapiens
tgtccagcctgggcagccaggc

SEQ ID NO: 3774583 - DNA, 23 bp, Homo sapiens
tgtccagcctgggcagccaggct

SEQ ID NO: 3774584 - DNA, 14 bp, Homo sapiens
tgtccagcgcctag

SEQ ID NO: 3774585 - DNA, 13 bp, Homo sapiens
tgtccagggccct

SEQ ID NO: 3774586 - DNA, 15 bp, Homo sapiens
tgtccatgtgtgtgc

SEQ ID NO: 3774587 - DNA, 23 bp, Homo sapiens
tgtcccaaaaagaaaggagggga

SEQ ID NO: 3774588 - DNA, 12 bp, Homo sapiens
tgtcccacagct

SEQ ID NO: 3774589 - DNA, 14 bp, Homo sapiens
tgtcccacagcttg

SEQ ID NO: 3774590 - DNA, 17 bp, Homo sapiens
tgtcccacagcttgggg

SEQ ID NO: 3774591 - DNA, 17 bp, Homo sapiens
tgtcccaggtcctcact

SEQ ID NO: 3774592 - DNA, 13 bp, Homo sapiens
tgtccccagccca

SEQ ID NO: 3774593 - DNA, 14 bp, Homo sapiens
tgtccccctgagat

SEQ ID NO: 3774594 - DNA, 17 bp, Homo sapiens
tgtcccgattgtaactc

SEQ ID NO: 3774595 - DNA, 16 bp, Homo sapiens
tgtccctctctctgga

SEQ ID NO: 3774596 - DNA, 13 bp, Homo sapiens
tgtccctgtcacc

SEQ ID NO: 3774597 - DNA, 21 bp, Homo sapiens
tgtccctgtcaccaagctcac

SEQ ID NO: 3774598 - DNA, 12 bp, Homo sapiens
tgtccgccctct

SEQ ID NO: 3774599 - DNA, 13 bp, Homo sapiens
tgtccgccctctt

SEQ ID NO: 3774600 - DNA, 12 bp, Homo sapiens
tgtcctactctg

SEQ ID NO: 3774601 - DNA, 17 bp, Homo sapiens
tgtcctactctgtgtca

SEQ ID NO: 3774602 - DNA, 20 bp, Homo sapiens
tgtcctccagaagcctctgg

SEQ ID NO: 3774603 - DNA, 21 bp, Homo sapiens
tgtcctccagaagcctctggc

SEQ ID NO: 3774604 - DNA, 19 bp, Homo sapiens
tgtcctctttcagaaaaca

SEQ ID NO: 3774605 - DNA, 12 bp, Homo sapiens
tgtcctgggagt

SEQ ID NO: 3774606 - DNA, 19 bp, Homo sapiens
tgtcctgggagtgagctgg

SEQ ID NO: 3774607 - DNA, 21 bp, Homo sapiens
tgtccttctctcacctcctaa

SEQ ID NO: 3774608 - DNA, 13 bp, Homo sapiens
tgtccttgcacct

SEQ ID NO: 3774609 - DNA, 14 bp, Homo sapiens
tgtcgcccagtctg

SEQ ID NO: 3774610 - DNA, 14 bp, Homo sapiens
tgtcgcctctgcat

SEQ ID NO: 3774611 - DNA, 15 bp, Homo sapiens
tgtctatgggactca

SEQ ID NO: 3774612 - DNA, 21 bp, Homo sapiens
tgtctcaaaaaaagaaaaaga

SEQ ID NO: 3774613 - DNA, 19 bp, Homo sapiens
tgtctcaagagggcactgg

SEQ ID NO: 3774614 - DNA, 20 bp, Homo sapiens
tgtctcaagagggcactggt

SEQ ID NO: 3774615 - DNA, 21 bp, Homo sapiens
tgtctcaagagggcactggtg

SEQ ID NO: 3774616 - DNA, 15 bp, Homo sapiens
tgtctcagcctccca

SEQ ID NO: 3774617 - DNA, 16 bp, Homo sapiens
tgtctcaggtccctgc

SEQ ID NO: 3774618 - DNA, 16 bp, Homo sapiens
tgtctcatccccaggg

SEQ ID NO: 3774619 - DNA, 11 bp, Homo sapiens
tgtctccagac

SEQ ID NO: 3774620 - DNA, 16 bp, Homo sapiens
tgtctccagaccccca

SEQ ID NO: 3774621 - DNA, 23 bp, Homo sapiens
tgtctccagacccccaccccttc

SEQ ID NO: 3774622 - DNA, 21 bp, Homo sapiens
tgtctcccagggccttaaaag

SEQ ID NO: 3774623 - DNA, 12 bp, Homo sapiens
tgtctcccctct

SEQ ID NO: 3774624 - DNA, 13 bp, Homo sapiens
tgtctctcagaat

SEQ ID NO: 3774625 - DNA, 18 bp, Homo sapiens
tgtctctggcgtgtgggt

SEQ ID NO: 3774626 - DNA, 19 bp, Homo sapiens
tgtctctggcgtgtgggta

SEQ ID NO: 3774627 - DNA, 19 bp, Homo sapiens
tgtctgaagtcactgcaca

SEQ ID NO: 3774628 - DNA, 19 bp, Homo sapiens
tgtctgccagccagcagcc

SEQ ID NO: 3774629 - DNA, 21 bp, Homo sapiens
tgtctgcgtggttcctttctc

SEQ ID NO: 3774630 - DNA, 21 bp, Homo sapiens
tgtctggtggtggcaccatct

SEQ ID NO: 3774631 - DNA, 17 bp, Homo sapiens
tgtctgtagctcctcaa

SEQ ID NO: 3774632 - DNA, 15 bp, Homo sapiens
tgtctgtgtcagcct

SEQ ID NO: 3774633 - DNA, 12 bp, Homo sapiens
tgtctgtgtgca

SEQ ID NO: 3774634 - DNA, 16 bp, Homo sapiens
tgtcttaattaagtaa

SEQ ID NO: 3774635 - DNA, 18 bp, Homo sapiens
tgtcttaattaagtaaac

SEQ ID NO: 3774636 - DNA, 16 bp, Homo sapiens
tgtcttatttttagat

SEQ ID NO: 3774637 - DNA, 23 bp, Homo sapiens
tgtcttatttttagatggttaca

SEQ ID NO: 3774638 - DNA, 15 bp, Homo sapiens
tgtcttcatagcaga

SEQ ID NO: 3774639 - DNA, 16 bp, Homo sapiens
tgtcttccaaggagac

SEQ ID NO: 3774640 - DNA, 12 bp, Homo sapiens
tgtcttccataa

SEQ ID NO: 3774641 - DNA, 13 bp, Homo sapiens
tgtcttccataat

SEQ ID NO: 3774642 - DNA, 14 bp, Homo sapiens
tgctgccctaggct

SEQ ID NO: 3774643 - DNA, 19 bp, Homo sapiens
tgctgccgcctcccagcct

SEQ ID NO: 3774644 - DNA, 13 bp, Homo sapiens
tgctgcctcccca

SEQ ID NO: 3774645 - DNA, 17 bp, Homo sapiens
tgctgcctccccaaccc

SEQ ID NO: 3774646 - DNA, 15 bp, Homo sapiens
tgctgcgcccttccc

SEQ ID NO: 3774647 - DNA, 19 bp, Homo sapiens
tgctgctattttactgtct

SEQ ID NO: 3774648 - DNA, 17 bp, Homo sapiens
tgctgcttccctctgcc

SEQ ID NO: 3774649 - DNA, 20 bp, Homo sapiens
tgctgcttccctctgcctgt

SEQ ID NO: 3774650 - DNA, 19 bp, Homo sapiens
tgctgcttgaggcaactca

SEQ ID NO: 3774651 - DNA, 19 bp, Homo sapiens
ttgcccagagatgcctcca

SEQ ID NO: 3774652 - DNA, 14 bp, Homo sapiens
ttgcccaggcaggt

SEQ ID NO: 3774653 - DNA, 11 bp, Homo sapiens
ttgcccaggct

SEQ ID NO: 3774654 - DNA, 18 bp, Homo sapiens
ttgcccaggctggtctca

SEQ ID NO: 3774655 - DNA, 16 bp, Homo sapiens
ttgcccatttacactt

SEQ ID NO: 3774656 - DNA, 16 bp, Homo sapiens
ttgccccccaccccag

SEQ ID NO: 3774657 - DNA, 19 bp, Homo sapiens
ttgccccccaccccagcct

SEQ ID NO: 3774658 - DNA, 10 bp, Homo sapiens
ttgccctggt

SEQ ID NO: 3774659 - DNA, 23 bp, Homo sapiens
ttgccctggtttcactggcccaa

SEQ ID NO: 3774660 - DNA, 14 bp, Homo sapiens
ttgcccttcacagt

SEQ ID NO: 3774661 - DNA, 16 bp, Homo sapiens
ttgccgaaactggaag

SEQ ID NO: 3774662 - DNA, 19 bp, Homo sapiens
ttgcctgcggtcaaggcca

SEQ ID NO: 3774663 - DNA, 22 bp, Homo sapiens
ttgcctgcgttttggaagctct

SEQ ID NO: 3774664 - DNA, 12 bp, Homo sapiens
ttgcctgtgcca

SEQ ID NO: 3774665 - DNA, 20 bp, Homo sapiens
ttgccttaaaagaaatctct

SEQ ID NO: 3774666 - DNA, 16 bp, Homo sapiens
ttgccttaactggagc

SEQ ID NO: 3774667 - DNA, 17 bp, Homo sapiens
ttgcctttgttttgatg

SEQ ID NO: 3774668 - DNA, 21 bp, Homo sapiens
ttgcgtggaattgtgctgagt

SEQ ID NO: 3774669 - DNA, 22 bp, Homo sapiens
ttgctcaagttcattgatgacc

SEQ ID NO: 3774670 - DNA, 14 bp, Homo sapiens
ttgctgaaagatct

SEQ ID NO: 3774671 - DNA, 23 bp, Homo sapiens
ttgctgctattttactgtcttaa

SEQ ID NO: 3774672 - DNA, 21 bp, Homo sapiens
ttgctgctccttagctgccaa

SEQ ID NO: 3774673 - DNA, 16 bp, Homo sapiens
ttgctgcttgaggcaa

SEQ ID NO: 3774674 - DNA, 23 bp, Homo sapiens
ttgctgcttttccttggggcagg

SEQ ID NO: 3774675 - DNA, 18 bp, Homo sapiens
ttgctggtcttgtaagag

SEQ ID NO: 3774676 - DNA, 11 bp, Homo sapiens
ttgctgtccta

SEQ ID NO: 3774677 - DNA, 15 bp, Homo sapiens
ttgctgtcctaggcc

SEQ ID NO: 3774678 - DNA, 16 bp, Homo sapiens
ttgcttattgttccaa

SEQ ID NO: 3774679 - DNA, 16 bp, Homo sapiens
ttgcttgaacacagta

SEQ ID NO: 3774680 - DNA, 19 bp, Homo sapiens
ttgcttgaacacagtattt

SEQ ID NO: 3774681 - DNA, 21 bp, Homo sapiens
ttgcttgaacacagtattttc

SEQ ID NO: 3774682 - DNA, 14 bp, Homo sapiens
ttgcttgagcccag

SEQ ID NO: 3774683 - DNA, 16 bp, Homo sapiens
ttgcttggactattat

SEQ ID NO: 3774684 - DNA, 15 bp, Homo sapiens
ttgctttctgaaatt

SEQ ID NO: 3774685 - DNA, 14 bp, Homo sapiens
ttgcttttttatgg

SEQ ID NO: 3774686 - DNA, 14 bp, Homo sapiens
ttggaaaagaatac

SEQ ID NO: 3774687 - DNA, 19 bp, Homo sapiens
ttggaaaagaatacagaaa

SEQ ID NO: 3774688 - DNA, 12 bp, Homo sapiens
ttggaaaataaa

SEQ ID NO: 3774689 - DNA, 15 bp, Homo sapiens
ttggaaaataaatca

SEQ ID NO: 3774690 - DNA, 17 bp, Homo sapiens
ttggaaaataaattatt

SEQ ID NO: 3774691 - DNA, 21 bp, Homo sapiens
ttggaatctagaagaaatgaa

SEQ ID NO: 3774692 - DNA, 16 bp, Homo sapiens
ttggaattaaaacaat

SEQ ID NO: 3774693 - DNA, 18 bp, Homo sapiens
ttggaattaaaacaatgt

SEQ ID NO: 3774694 - DNA, 20 bp, Homo sapiens
ttggaattaacctggtgctg

SEQ ID NO: 3774695 - DNA, 17 bp, Homo sapiens
ttggacacacacagctt

SEQ ID NO: 3774696 - DNA, 23 bp, Homo sapiens
ttggacatgtccatgaccagaag

SEQ ID NO: 3774697 - DNA, 18 bp, Homo sapiens
ttggacattaagcatcac

SEQ ID NO: 3774698 - DNA, 17 bp, Homo sapiens
ttggacctcgtgcttta

SEQ ID NO: 3774699 - DNA, 17 bp, Homo sapiens
ttggacgcacacagctt

SEQ ID NO: 3774700 - DNA, 21 bp, Homo sapiens
ttggacggcctgatgctccct

SEQ ID NO: 3774701 - DNA, 20 bp, Homo sapiens
ttggagataatctagaacac

SEQ ID NO: 3774702 - DNA, 15 bp, Homo sapiens
ttggaggccagccag

SEQ ID NO: 3774703 - DNA, 17 bp, Homo sapiens
ttggaggcctttcatcc

SEQ ID NO: 3774704 - DNA, 22 bp, Homo sapiens
ttggagggcccacttgtatcct

SEQ ID NO: 3774705 - DNA, 18 bp, Homo sapiens
ttgttttaaaattaaagc

SEQ ID NO: 3774706 - DNA, 18 bp, Homo sapiens
ttgttttcttctgtatgt

SEQ ID NO: 3774707 - DNA, 14 bp, Homo sapiens
ttgttttgttttaa

SEQ ID NO: 3774708 - DNA, 22 bp, Homo sapiens
tttaaaaaaatacagtattctg

SEQ ID NO: 3774709 - DNA, 16 bp, Homo sapiens
tttaaaaaagtttaaa

SEQ ID NO: 3774710 - DNA, 12 bp, Homo sapiens
tttaaaaatcat

SEQ ID NO: 3774711 - DNA, 15 bp, Homo sapiens
tttaaaacaagaaag

SEQ ID NO: 3774712 - DNA, 21 bp, Homo sapiens
tttaaaacaagaaagtttccc

SEQ ID NO: 3774713 - DNA, 19 bp, Homo sapiens
tttaaaagacacacttgtc

SEQ ID NO: 3774714 - DNA, 19 bp, Homo sapiens
tttaaaatcactaacatta

SEQ ID NO: 3774715 - DNA, 20 bp, Homo sapiens
tttaaaatcactaacattat

SEQ ID NO: 3774716 - DNA, 18 bp, Homo sapiens
tttaaacctatactcact

SEQ ID NO: 3774717 - DNA, 15 bp, Homo sapiens
tttaaactgattcat

SEQ ID NO: 3774718 - DNA, 23 bp, Homo sapiens
tttaaagaatcattatttattaa

SEQ ID NO: 3774719 - DNA, 17 bp, Homo sapiens
tttaaagagaatgtaga

SEQ ID NO: 3774720 - DNA, 16 bp, Homo sapiens
tttaaagtagattaga

SEQ ID NO: 3774721 - DNA, 15 bp, Homo sapiens
tttaaagtcttgctg

SEQ ID NO: 3774722 - DNA, 13 bp, Homo sapiens
tttaaagttctgt

SEQ ID NO: 3774723 - DNA, 17 bp, Homo sapiens
tttaaatcctgttgaaa

SEQ ID NO: 3774724 - DNA, 17 bp, Homo sapiens
tttaaattataaggact

SEQ ID NO: 3774725 - DNA, 20 bp, Homo sapiens
tttaaattataaggactgca

SEQ ID NO: 3774726 - DNA, 21 bp, Homo sapiens
tttaaattataaggactgcat

SEQ ID NO: 3774727 - DNA, 22 bp, Homo sapiens
tttaaattataaggactgcatg

SEQ ID NO: 3774728 - DNA, 14 bp, Homo sapiens
tttaaatttcaaat

SEQ ID NO: 3774729 - DNA, 17 bp, Homo sapiens
tttaaattttcttcagt

SEQ ID NO: 3774730 - DNA, 18 bp, Homo sapiens
tttaacaataactactgt

SEQ ID NO: 3774731 - DNA, 21 bp, Homo sapiens
tttaacaataactactgtgtt

SEQ ID NO: 3774732 - DNA, 18 bp, Homo sapiens
tttaacacacataaagga

SEQ ID NO: 3774733 - DNA, 22 bp, Homo sapiens
tttaacataaaggttattttct

SEQ ID NO: 3774734 - DNA, 15 bp, Homo sapiens
tttaactagaattta

SEQ ID NO: 3774735 - DNA, 18 bp, Homo sapiens
tttaagaaaaaataacac

SEQ ID NO: 3774736 - DNA, 11 bp, Homo sapiens
tttaagaaaat

SEQ ID NO: 3774737 - DNA, 22 bp, Homo sapiens
tttaagacagtcccatcaaaac

SEQ ID NO: 3774738 - DNA, 14 bp, Homo sapiens
tttaagaggcaggg

SEQ ID NO: 3774739 - DNA, 15 bp, Homo sapiens
tttaagataaattat

SEQ ID NO: 3774740 - DNA, 14 bp, Homo sapiens
tttaagcattgttt

SEQ ID NO: 3774741 - DNA, 13 bp, Homo sapiens
tttaagctgtttc

SEQ ID NO: 3774742 - DNA, 17 bp, Homo sapiens
tttaagggtttgtggaa

SEQ ID NO: 3774743 - DNA, 13 bp, Homo sapiens
tttaagtatttag

SEQ ID NO: 3774744 - DNA, 15 bp, Homo sapiens
tttaagtatttatat

SEQ ID NO: 3774745 - DNA, 20 bp, Homo sapiens
tttaataaaaaggcacctat

SEQ ID NO: 3774746 - DNA, 19 bp, Homo sapiens
tttaataacataacaaata

SEQ ID NO: 3774747 - DNA, 13 bp, Homo sapiens
tttaatatgtatt

SEQ ID NO: 3774748 - DNA, 15 bp, Homo sapiens
tttaatattgagaaa

SEQ ID NO: 3774749 - DNA, 22 bp, Homo sapiens
tttaatattgagaaagaaacta

SEQ ID NO: 3774750 - DNA, 13 bp, Homo sapiens
tttaatcaaattt

SEQ ID NO: 3774751 - DNA, 21 bp, Homo sapiens
tttaatccagaattgaccttt

SEQ ID NO: 3774752 - DNA, 12 bp, Homo sapiens
tttaatcgtaca

SEQ ID NO: 3774753 - DNA, 19 bp, Homo sapiens
tttaatggggtgcacctgt

SEQ ID NO: 3774754 - DNA, 21 bp, Homo sapiens
tttaattaggggttgctaaga

SEQ ID NO: 3774755 - DNA, 14 bp, Homo sapiens
tttaattattattc

SEQ ID NO: 3774756 - DNA, 23 bp, Homo sapiens
tttaattattattcttcataaca

SEQ ID NO: 3774757 - DNA, 13 bp, Homo sapiens
tttaattattgtt

SEQ ID NO: 3774758 - DNA, 14 bp, Homo sapiens
tttaattcatgttt

SEQ ID NO: 3774759 - DNA, 15 bp, Homo sapiens
tttaattgaaggaaa

SEQ ID NO: 3774760 - DNA, 16 bp, Homo sapiens
tttaattgaaggaaag

SEQ ID NO: 3774761 - DNA, 12 bp, Homo sapiens
tttaattgtaaa

SEQ ID NO: 3774762 - DNA, 18 bp, Homo sapiens
tttaatttgatgaaagct

SEQ ID NO: 3774763 - DNA, 19 bp, Homo sapiens
tttaatttgatgaaagctg

SEQ ID NO: 3774764 - DNA, 14 bp, Homo sapiens
tttaattttgtaaa

SEQ ID NO: 3774765 - DNA, 19 bp, Homo sapiens
tttaatttttttgagacag

SEQ ID NO: 3774766 - DNA, 13 bp, Homo sapiens
tttacaaaagatg

SEQ ID NO: 3774767 - DNA, 21 bp, Homo sapiens
tttacaagaaaaaatgaattt

SEQ ID NO: 3774768 - DNA, 16 bp, Homo sapiens
tttacaattgaaatga

SEQ ID NO: 3774769 - DNA, 16 bp, Homo sapiens
tttacactctttgtaa

SEQ ID NO: 3774770 - DNA, 19 bp, Homo sapiens
tttacacttttgagacttt

SEQ ID NO: 3774771 - DNA, 16 bp, Homo sapiens
tttacagctgcctgca

SEQ ID NO: 3774772 - DNA, 18 bp, Homo sapiens
tttacatttatctgtaca

SEQ ID NO: 3774773 - DNA, 17 bp, Homo sapiens
tttaccaagttatataa

SEQ ID NO: 3774774 - DNA, 22 bp, Homo sapiens
tttaccactgctgtgaacaagt

SEQ ID NO: 3774775 - DNA, 20 bp, Homo sapiens
tttaccatttgtaataaagt

SEQ ID NO: 3774776 - DNA, 20 bp, Homo sapiens
tttacccttcttttctgact

SEQ ID NO: 3774777 - DNA, 21 bp, Homo sapiens
tttactactgtggaaaaatat

SEQ ID NO: 3774778 - DNA, 23 bp, Homo sapiens
tttactactgtggaaaaatattt

SEQ ID NO: 3774779 - DNA, 12 bp, Homo sapiens
tttactcccctt

SEQ ID NO: 3774780 - DNA, 18 bp, Homo sapiens
tttactgagcttctctgt

SEQ ID NO: 3774781 - DNA, 21 bp, Homo sapiens
tttactgagcttctctgtgaa

SEQ ID NO: 3774782 - DNA, 16 bp, Homo sapiens
tttactgcagctttgt

SEQ ID NO: 3774783 - DNA, 21 bp, Homo sapiens
tttactgtcttaattaagtaa

SEQ ID NO: 3774784 - DNA, 14 bp, Homo sapiens
tttactgtttgtta

SEQ ID NO: 3774785 - DNA, 15 bp, Homo sapiens
tttacttcttataca

SEQ ID NO: 3774786 - DNA, 19 bp, Homo sapiens
tttacttcttatacatttg

SEQ ID NO: 3774787 - DNA, 15 bp, Homo sapiens
tttactttgtgttca

SEQ ID NO: 3774788 - DNA, 11 bp, Homo sapiens
tttagaaactt

SEQ ID NO: 3774789 - DNA, 19 bp, Homo sapiens
tttagaaacttatcttaca

SEQ ID NO: 3774790 - DNA, 23 bp, Homo sapiens
tttagaaagaagcccaatattat

SEQ ID NO: 3774791 - DNA, 14 bp, Homo sapiens
tttagaaatataat

SEQ ID NO: 3774792 - DNA, 15 bp, Homo sapiens
tttagaacagaaaac

SEQ ID NO: 3774793 - DNA, 16 bp, Homo sapiens
tttagaacagaaaaca

SEQ ID NO: 3774794 - DNA, 23 bp, Homo sapiens
tttagaacagaaaacaacaaaaa

SEQ ID NO: 3774795 - DNA, 16 bp, Homo sapiens
tttagacaaatctaag

SEQ ID NO: 3774796 - DNA, 21 bp, Homo sapiens
tttagacaaatctaagggaaa

SEQ ID NO: 3774797 - DNA, 12 bp, Homo sapiens
tttagacagagt

SEQ ID NO: 3774798 - DNA, 19 bp, Homo sapiens
tttagaccctattgctgct

SEQ ID NO: 3774799 - DNA, 22 bp, Homo sapiens
tttagagataagagttggctgg

SEQ ID NO: 3774800 - DNA, 14 bp, Homo sapiens
tttagatggttaca

SEQ ID NO: 3774801 - DNA, 18 bp, Homo sapiens
tttagcagttctgcaaat

SEQ ID NO: 3774802 - DNA, 23 bp, Homo sapiens
tttagcatgacaagccccaggca

SEQ ID NO: 3774803 - DNA, 12 bp, Homo sapiens
tttagcatgtgt

SEQ ID NO: 3774804 - DNA, 15 bp, Homo sapiens
tttagcctagttcat

SEQ ID NO: 3774805 - DNA, 11 bp, Homo sapiens
tttaggagaaa

SEQ ID NO: 3774806 - DNA, 15 bp, Homo sapiens
tttagtgtaaaaatg

SEQ ID NO: 3774807 - DNA, 18 bp, Homo sapiens
tttagtgtaaaaatgaga

SEQ ID NO: 3774808 - DNA, 19 bp, Homo sapiens
tttagttgcagaaacattt

SEQ ID NO: 3774809 - DNA, 19 bp, Homo sapiens
tttataaaaaaaatgaaat

SEQ ID NO: 3774810 - DNA, 18 bp, Homo sapiens
tttataaaattaaagaaa

SEQ ID NO: 3774811 - DNA, 19 bp, Homo sapiens
tttataaaattaaagaaaa

SEQ ID NO: 3774812 - DNA, 20 bp, Homo sapiens
tttataaaattaaagaaaat

SEQ ID NO: 3774813 - DNA, 16 bp, Homo sapiens
tttataaattaaatat

SEQ ID NO: 3774814 - DNA, 18 bp, Homo sapiens
tttataaattaaatatat

SEQ ID NO: 3774815 - DNA, 16 bp, Homo sapiens
tttataactcatcata

SEQ ID NO: 3774816 - DNA, 18 bp, Homo sapiens
tttataactcatcataaa

SEQ ID NO: 3774817 - DNA, 20 bp, Homo sapiens
tttataactcatcataaaat

SEQ ID NO: 3774818 - DNA, 17 bp, Homo sapiens
ttgaagagagagctgag

SEQ ID NO: 3774819 - DNA, 22 bp, Homo sapiens
ttgaagatatcttgaaatgaaa

SEQ ID NO: 3774820 - DNA, 13 bp, Homo sapiens
ttgaagccactga

SEQ ID NO: 3774821 - DNA, 17 bp, Homo sapiens
ttgaagctaattatttt

SEQ ID NO: 3774822 - DNA, 14 bp, Homo sapiens
ttgaaggatgctgt

SEQ ID NO: 3774823 - DNA, 19 bp, Homo sapiens
ttgaaggtcttgatttgtt

SEQ ID NO: 3774824 - DNA, 17 bp, Homo sapiens
ttgaagtaatgaatttt

SEQ ID NO: 3774825 - DNA, 22 bp, Homo sapiens
ttgaagtgaaatctgtgcaata

SEQ ID NO: 3774826 - DNA, 16 bp, Homo sapiens
ttgaatataaacacta

SEQ ID NO: 3774827 - DNA, 22 bp, Homo sapiens
ttgaatatttgtcgatatttcc

SEQ ID NO: 3774828 - DNA, 13 bp, Homo sapiens
ttgaatcacagta

SEQ ID NO: 3774829 - DNA, 17 bp, Homo sapiens
ttgaatccatgcttggg

SEQ ID NO: 3774830 - DNA, 21 bp, Homo sapiens
ttgaatgaaaaatttaagcat

SEQ ID NO: 3774831 - DNA, 15 bp, Homo sapiens
ttgaatgggtccatt

SEQ ID NO: 3774832 - DNA, 22 bp, Homo sapiens
ttgaattaaattaggaataaat

SEQ ID NO: 3774833 - DNA, 12 bp, Homo sapiens
ttgaatttaaca

SEQ ID NO: 3774834 - DNA, 14 bp, Homo sapiens
ttgaatttaacaat

SEQ ID NO: 3774835 - DNA, 16 bp, Homo sapiens
ttgaatttaacaatgc

SEQ ID NO: 3774836 - DNA, 22 bp, Homo sapiens
ttgaattttcaagcatctcctg

SEQ ID NO: 3774837 - DNA, 13 bp, Homo sapiens
ttgacaaactctc

SEQ ID NO: 3774838 - DNA, 14 bp, Homo sapiens
ttgacagaacactg

SEQ ID NO: 3774839 - DNA, 16 bp, Homo sapiens
ttgacagtaacttggt

SEQ ID NO: 3774840 - DNA, 23 bp, Homo sapiens
ttgacagtaacttggttatacat

SEQ ID NO: 3774841 - DNA, 14 bp, Homo sapiens
ttgacatgtggaaa

SEQ ID NO: 3774842 - DNA, 22 bp, Homo sapiens
ttgacatgtggaaagtgaattt

SEQ ID NO: 3774843 - DNA, 14 bp, Homo sapiens
ttgaccaagaactg

SEQ ID NO: 3774844 - DNA, 16 bp, Homo sapiens
ttgaccaagaactgca

SEQ ID NO: 3774845 - DNA, 17 bp, Homo sapiens
ttgaccaagaactgcat

SEQ ID NO: 3774846 - DNA, 21 bp, Homo sapiens
ttgaccaagaactgcatggac

SEQ ID NO: 3774847 - DNA, 20 bp, Homo sapiens
ttgaccaagcaggaagctca

SEQ ID NO: 3774848 - DNA, 22 bp, Homo sapiens
ttgaccagcagatcccagctca

SEQ ID NO: 3774849 - DNA, 22 bp, Homo sapiens
ttgactagaaaatttaaaacat

SEQ ID NO: 3774850 - DNA, 21 bp, Homo sapiens
ttgacttgacagaacactgtc

SEQ ID NO: 3774851 - DNA, 13 bp, Homo sapiens
ttgactttcaggt

SEQ ID NO: 3774852 - DNA, 15 bp, Homo sapiens
ttgactttcaggtac

SEQ ID NO: 3774853 - DNA, 21 bp, Homo sapiens
ttgactttcaggtactaaata

SEQ ID NO: 3774854 - DNA, 20 bp, Homo sapiens
ttgagaaacaaataatttgt

SEQ ID NO: 3774855 - DNA, 22 bp, Homo sapiens
ttgagaaaccttattgtacctc

SEQ ID NO: 3774856 - DNA, 15 bp, Homo sapiens
ttgagaaatgaataa

SEQ ID NO: 3774857 - DNA, 21 bp, Homo sapiens
ttgagaactgcatatgtttcg

SEQ ID NO: 3774858 - DNA, 13 bp, Homo sapiens
ttgagacaaaaat

SEQ ID NO: 3774859 - DNA, 16 bp, Homo sapiens
ttgagacaaaaattat

SEQ ID NO: 3774860 - DNA, 15 bp, Homo sapiens
ttgagacctcagcca

SEQ ID NO: 3774861 - DNA, 16 bp, Homo sapiens
ttgagacttcaagctt

SEQ ID NO: 3774862 - DNA, 15 bp, Homo sapiens
ttgagatcagcctgg

SEQ ID NO: 3774863 - DNA, 12 bp, Homo sapiens
ttgagcagggct

SEQ ID NO: 3774864 - DNA, 20 bp, Homo sapiens
ttgagcgtgaatctgtatct

SEQ ID NO: 3774865 - DNA, 23 bp, Homo sapiens
ttgagctcagacccccactctca

SEQ ID NO: 3774866 - DNA, 12 bp, Homo sapiens
ttgagctgtttt

SEQ ID NO: 3774867 - DNA, 13 bp, Homo sapiens
ttgaggccaggag

SEQ ID NO: 3774868 - DNA, 14 bp, Homo sapiens
ttgaggctgcagcg

SEQ ID NO: 3774869 - DNA, 21 bp, Homo sapiens
ttgaggtaggagaattgcttg

SEQ ID NO: 3774870 - DNA, 16 bp, Homo sapiens
ttgaggtcaagtaaga

SEQ ID NO: 3774871 - DNA, 17 bp, Homo sapiens
ttgaggtcttttgacat

SEQ ID NO: 3774872 - DNA, 18 bp, Homo sapiens
ttgaggtcttttgacatg

SEQ ID NO: 3774873 - DNA, 19 bp, Homo sapiens
ttgaggtcttttgacatgt

SEQ ID NO: 3774874 - DNA, 20 bp, Homo sapiens
ttgagttgattcagctctgc

SEQ ID NO: 3774875 - DNA, 12 bp, Homo sapiens
ttgagttttgtt

SEQ ID NO: 3774876 - DNA, 17 bp, Homo sapiens
ttatataattatgttat

SEQ ID NO: 3774877 - DNA, 13 bp, Homo sapiens
ttatatagcttga

SEQ ID NO: 3774878 - DNA, 18 bp, Homo sapiens
ttatatagcttgaaacat

SEQ ID NO: 3774879 - DNA, 14 bp, Homo sapiens
ttatatatttataa

SEQ ID NO: 3774880 - DNA, 20 bp, Homo sapiens
ttatatatttataactcatc

SEQ ID NO: 3774881 - DNA, 20 bp, Homo sapiens
ttatatgtatccagtacatt

SEQ ID NO: 3774882 - DNA, 23 bp, Homo sapiens
ttatatgtatccagtacatttaa

SEQ ID NO: 3774883 - DNA, 21 bp, Homo sapiens
ttatattccatatattagcat

SEQ ID NO: 3774884 - DNA, 18 bp, Homo sapiens
ttatattgagacaaaaat

SEQ ID NO: 3774885 - DNA, 17 bp, Homo sapiens
ttatatttttaataaaa

SEQ ID NO: 3774886 - DNA, 16 bp, Homo sapiens
ttatcaaaactttctt

SEQ ID NO: 3774887 - DNA, 19 bp, Homo sapiens
ttatcaattacaacagtga

SEQ ID NO: 3774888 - DNA, 14 bp, Homo sapiens
ttatcaatttgtca

SEQ ID NO: 3774889 - DNA, 21 bp, Homo sapiens
ttatcaatttgtcattttgaa

SEQ ID NO: 3774890 - DNA, 23 bp, Homo sapiens
ttatcaatttgtcattttgaagc

SEQ ID NO: 3774891 - DNA, 13 bp, Homo sapiens
ttatcacacaaag

SEQ ID NO: 3774892 - DNA, 21 bp, Homo sapiens
ttatcagtcataactaaataa

SEQ ID NO: 3774893 - DNA, 23 bp, Homo sapiens
ttatcagtcataactaaataaag

SEQ ID NO: 3774894 - DNA, 16 bp, Homo sapiens
ttatcatgcaaatgct

SEQ ID NO: 3774895 - DNA, 13 bp, Homo sapiens
ttatcatgctgtc

SEQ ID NO: 3774896 - DNA, 16 bp, Homo sapiens
ttatcctgaaatttca

SEQ ID NO: 3774897 - DNA, 14 bp, Homo sapiens
ttatcggaagcagt

SEQ ID NO: 3774898 - DNA, 15 bp, Homo sapiens
ttatcggaagcagtg

SEQ ID NO: 3774899 - DNA, 22 bp, Homo sapiens
ttatctaatcatgaaactccct

SEQ ID NO: 3774900 - DNA, 16 bp, Homo sapiens
ttatctattgtaagat

SEQ ID NO: 3774901 - DNA, 18 bp, Homo sapiens
ttatctattgtaagataa

SEQ ID NO: 3774902 - DNA, 15 bp, Homo sapiens
ttatcttaaagcact

SEQ ID NO: 3774903 - DNA, 17 bp, Homo sapiens
ttatcttggactgacat

SEQ ID NO: 3774904 - DNA, 16 bp, Homo sapiens
ttatcttgtctctggg

SEQ ID NO: 3774905 - DNA, 12 bp, Homo sapiens
ttatcttttgag

SEQ ID NO: 3774906 - DNA, 18 bp, Homo sapiens
ttatgaaaggtttacatt

SEQ ID NO: 3774907 - DNA, 22 bp, Homo sapiens
ttatgaactgcatgtataaatg

SEQ ID NO: 3774908 - DNA, 23 bp, Homo sapiens
ttatgaactgcatgtataaatga

SEQ ID NO: 3774909 - DNA, 18 bp, Homo sapiens
ttatgacatcacttgtac

SEQ ID NO: 3774910 - DNA, 14 bp, Homo sapiens
ttactcagccctgg

SEQ ID NO: 3774911 - DNA, 17 bp, Homo sapiens
ttactcatgatcttgtg

SEQ ID NO: 3774912 - DNA, 17 bp, Homo sapiens
ttactcattatcgcctt

SEQ ID NO: 3774913 - DNA, 11 bp, Homo sapiens
ttactcccctt

SEQ ID NO: 3774914 - DNA, 20 bp, Homo sapiens
ttactccccttgagctgaga

SEQ ID NO: 3774915 - DNA, 22 bp, Homo sapiens
ttactcttgtaagattttgaaa

SEQ ID NO: 3774916 - DNA, 18 bp, Homo sapiens
ttactgaaggtaaaattg

SEQ ID NO: 3774917 - DNA, 20 bp, Homo sapiens
ttactgaaggtaaaattgaa

SEQ ID NO: 3774918 - DNA, 14 bp, Homo sapiens
ttactgagcttctc

SEQ ID NO: 3774919 - DNA, 13 bp, Homo sapiens
ttactgatcatgc

SEQ ID NO: 3774920 - DNA, 15 bp, Homo sapiens
ttactgatcatgcat

SEQ ID NO: 3774921 - DNA, 16 bp, Homo sapiens
ttactgatcatgcatt

SEQ ID NO: 3774922 - DNA, 21 bp, Homo sapiens
ttactgatcatgcattgttga

SEQ ID NO: 3774923 - DNA, 21 bp, Homo sapiens
ttactgggttggaagaaatat

SEQ ID NO: 3774924 - DNA, 14 bp, Homo sapiens
ttactgtcaataaa

SEQ ID NO: 3774925 - DNA, 17 bp, Homo sapiens
ttactgtcaataaacag

SEQ ID NO: 3774926 - DNA, 18 bp, Homo sapiens
ttactgtcaataaacagc

SEQ ID NO: 3774927 - DNA, 15 bp, Homo sapiens
ttactgtcttaatta

SEQ ID NO: 3774928 - DNA, 18 bp, Homo sapiens
ttactgttagtcatttgc

SEQ ID NO: 3774929 - DNA, 15 bp, Homo sapiens
ttactgtttgttatg

SEQ ID NO: 3774930 - DNA, 13 bp, Homo sapiens
ttacttagcatgc

SEQ ID NO: 3774931 - DNA, 11 bp, Homo sapiens
ttacttctgct

SEQ ID NO: 3774932 - DNA, 12 bp, Homo sapiens
ttacttctgcta

SEQ ID NO: 3774933 - DNA, 18 bp, Homo sapiens
ttactttctgttgccaca

SEQ ID NO: 3774934 - DNA, 13 bp, Homo sapiens
ttactttgtatga

SEQ ID NO: 3774935 - DNA, 14 bp, Homo sapiens
ttactttgtgttca

SEQ ID NO: 3774936 - DNA, 19 bp, Homo sapiens
ttagaaacttatcttacaa

SEQ ID NO: 3774937 - DNA, 14 bp, Homo sapiens
ttagaaatataatt

SEQ ID NO: 3774938 - DNA, 17 bp, Homo sapiens
ttagaaattgcatttcc

SEQ ID NO: 3774939 - DNA, 12 bp, Homo sapiens
ttagaacactat

SEQ ID NO: 3774940 - DNA, 17 bp, Homo sapiens
ttagaacactattttca

SEQ ID NO: 3774941 - DNA, 15 bp, Homo sapiens
ttcagaatctgaatg

SEQ ID NO: 3774942 - DNA, 21 bp, Homo sapiens
ttcagaatctgaatgtaattt

SEQ ID NO: 3774943 - DNA, 16 bp, Homo sapiens
ttcagacactttggaa

SEQ ID NO: 3774944 - DNA, 10 bp, Homo sapiens
ttcagacccc

SEQ ID NO: 3774945 - DNA, 15 bp, Homo sapiens
ttcagaccccagcgg

SEQ ID NO: 3774946 - DNA, 13 bp, Homo sapiens
ttcagactcagac

SEQ ID NO: 3774947 - DNA, 21 bp, Homo sapiens
ttcagagactcagggccccag

SEQ ID NO: 3774948 - DNA, 13 bp, Homo sapiens
ttcagagagctgg

SEQ ID NO: 3774949 - DNA, 17 bp, Homo sapiens
ttcagatcagtgcttga

SEQ ID NO: 3774950 - DNA, 15 bp, Homo sapiens
ttcagatcctacccc

SEQ ID NO: 3774951 - DNA, 21 bp, Homo sapiens
ttcagattcccagagcaaaat

SEQ ID NO: 3774952 - DNA, 19 bp, Homo sapiens
ttcagcattcttagcctgt

SEQ ID NO: 3774953 - DNA, 16 bp, Homo sapiens
ttcagcccctcctctg

SEQ ID NO: 3774954 - DNA, 20 bp, Homo sapiens
ttcagctaagctaggaatga

SEQ ID NO: 3774955 - DNA, 21 bp, Homo sapiens
ttcagctggttgaggtttcaa

SEQ ID NO: 3774956 - DNA, 22 bp, Homo sapiens
ttcagcttgtaaatagctcagg

SEQ ID NO: 3774957 - DNA, 15 bp, Homo sapiens
ttcaggctcttctcc

SEQ ID NO: 3774958 - DNA, 16 bp, Homo sapiens
ttcaggctgcttggga

SEQ ID NO: 3774959 - DNA, 19 bp, Homo sapiens
ttcaggggactcagccctg

SEQ ID NO: 3774960 - DNA, 19 bp, Homo sapiens
ttcagggttggcccctgcc

SEQ ID NO: 3774961 - DNA, 22 bp, Homo sapiens
ttcagggttggcccctgcccgg

SEQ ID NO: 3774962 - DNA, 15 bp, Homo sapiens
ttcaggtaacaggca

SEQ ID NO: 3774963 - DNA, 14 bp, Homo sapiens
ttcaggtactaaat

SEQ ID NO: 3774964 - DNA, 19 bp, Homo sapiens
ttcaggttttgtaaagatg

SEQ ID NO: 3774965 - DNA, 15 bp, Homo sapiens
ttcagtaaaaaacaa

SEQ ID NO: 3774966 - DNA, 14 bp, Homo sapiens
ttcagtaagccgtg

SEQ ID NO: 3774967 - DNA, 16 bp, Homo sapiens
ttcagtaataaaacat

SEQ ID NO: 3774968 - DNA, 16 bp, Homo sapiens
ttcagtataatttaac

SEQ ID NO: 3774969 - DNA, 13 bp, Homo sapiens
ttcagtctttcat

SEQ ID NO: 3774970 - DNA, 16 bp, Homo sapiens
ttcagtgaaagcatca

SEQ ID NO: 3774971 - DNA, 14 bp, Homo sapiens
ttcagtgcccacca

SEQ ID NO: 3774972 - DNA, 16 bp, Homo sapiens
ttcagtggcagctgct

SEQ ID NO: 3774973 - DNA, 17 bp, Homo sapiens
ttcagtggcagctgctt

SEQ ID NO: 3774974 - DNA, 20 bp, Homo sapiens
ttcagtgtatggaaataaat

SEQ ID NO: 3774975 - DNA, 14 bp, Homo sapiens
ttcagttaagaaaa

SEQ ID NO: 3774976 - DNA, 16 bp, Homo sapiens
ttcagttaagaaaaaa

SEQ ID NO: 3774977 - DNA, 16 bp, Homo sapiens
ttcagttgattttaca

SEQ ID NO: 3774978 - DNA, 19 bp, Homo sapiens
ttcagttggctgacttcca

SEQ ID NO: 3774979 - DNA, 14 bp, Homo sapiens
ttcataactttcat

SEQ ID NO: 3774980 - DNA, 22 bp, Homo sapiens
ttcatagctggttcctgctaga

SEQ ID NO: 3774981 - DNA, 15 bp, Homo sapiens
ttcatcagtgttaaa

SEQ ID NO: 3774982 - DNA, 21 bp, Homo sapiens
ttcatccaatcctcactgggt

SEQ ID NO: 3774983 - DNA, 13 bp, Homo sapiens
ttcatccttagca

SEQ ID NO: 3774984 - DNA, 17 bp, Homo sapiens
ttcatctatttctgaga

SEQ ID NO: 3774985 - DNA, 20 bp, Homo sapiens
ttcatcttccaactcaaact

SEQ ID NO: 3774986 - DNA, 17 bp, Homo sapiens
ttcatgaaaatcctacc

SEQ ID NO: 3774987 - DNA, 23 bp, Homo sapiens
ttcatgatttcatttcaactgtt

SEQ ID NO: 3774988 - DNA, 21 bp, Homo sapiens
ttcatgcaatgacatcttcaa

SEQ ID NO: 3774989 - DNA, 12 bp, Homo sapiens
ttcatgtttctt

SEQ ID NO: 3774990 - DNA, 13 bp, Homo sapiens
ttcattattggaa

SEQ ID NO: 3774991 - DNA, 20 bp, Homo sapiens
ttcattattggaattaacct

SEQ ID NO: 3774992 - DNA, 19 bp, Homo sapiens
ttcattcttgaaagctgtg

SEQ ID NO: 3774993 - DNA, 18 bp, Homo sapiens
ttcattgtaatgttactg

SEQ ID NO: 3774994 - DNA, 17 bp, Homo sapiens
ttcattgtggttatttt

SEQ ID NO: 3774995 - DNA, 21 bp, Homo sapiens
ttcattgtggttatttttata

SEQ ID NO: 3774996 - DNA, 24 bp, Homo sapiens
ttcattgtggttatttttatacag

SEQ ID NO: 3774997 - DNA, 22 bp, Homo sapiens
ttcatttagagctagtctttca

SEQ ID NO: 3774998 - DNA, 13 bp, Homo sapiens
ttcatttcatcta

SEQ ID NO: 3774999 - DNA, 15 bp, Homo sapiens
ttcatttcctgtgtc

SEQ ID NO: 3775000 - DNA, 16 bp, Homo sapiens
ttcatttcctgtgtct

SEQ ID NO: 3775001 - DNA, 16 bp, Homo sapiens
ttcatttgatgctaaa

SEQ ID NO: 3775002 - DNA, 19 bp, Homo sapiens
ttcatttggaaataagctg

SEQ ID NO: 3775003 - DNA, 16 bp, Homo sapiens
ttcatttgttattctt

SEQ ID NO: 3775004 - DNA, 13 bp, Homo sapiens
ttcatttttccta

SEQ ID NO: 3775005 - DNA, 15 bp, Homo sapiens
ttcatttttcctaac

SEQ ID NO: 3775006 - DNA, 15 bp, Homo sapiens
ttccaactgctgccc

SEQ ID NO: 3775007 - DNA, 16 bp, Homo sapiens
ttccaactgctgcccc

SEQ ID NO: 3775008 - DNA, 16 bp, Homo sapiens
ttccaagacattgtca

SEQ ID NO: 3775009 - DNA, 19 bp, Homo sapiens
ttccaagacattgtcaata

SEQ ID NO: 3775010 - DNA, 15 bp, Homo sapiens
tttcacccacagaaa

SEQ ID NO: 3775011 - DNA, 22 bp, Homo sapiens
tttcaccccacccttcccctcc

SEQ ID NO: 3775012 - DNA, 17 bp, Homo sapiens
tttcacctactttgtaa

SEQ ID NO: 3775013 - DNA, 20 bp, Homo sapiens
tttcacctactttgtaagtg

SEQ ID NO: 3775014 - DNA, 22 bp, Homo sapiens
tttcacctgtttttaagctgtt

SEQ ID NO: 3775015 - DNA, 23 bp, Homo sapiens
tttcacctgtttttaagctgttt

SEQ ID NO: 3775016 - DNA, 22 bp, Homo sapiens
tttcactgctggctgccttaga

SEQ ID NO: 3775017 - DNA, 12 bp, Homo sapiens
tttcagaaaaca

SEQ ID NO: 3775018 - DNA, 11 bp, Homo sapiens
tttcagaatct

SEQ ID NO: 3775019 - DNA, 10 bp, Homo sapiens
tttcagaccc

SEQ ID NO: 3775020 - DNA, 13 bp, Homo sapiens
tttcagactgctt

SEQ ID NO: 3775021 - DNA, 16 bp, Homo sapiens
tttcagatgcttctgg

SEQ ID NO: 3775022 - DNA, 20 bp, Homo sapiens
tttcagattcccagagcaaa

SEQ ID NO: 3775023 - DNA, 21 bp, Homo sapiens
tttcagcaatatttaaggaga

SEQ ID NO: 3775024 - DNA, 13 bp, Homo sapiens
tttcaggatactc

SEQ ID NO: 3775025 - DNA, 20 bp, Homo sapiens
tttcaggatactctgtcaga

SEQ ID NO: 3775026 - DNA, 22 bp, Homo sapiens
tttcagggaggtggctgggttt

SEQ ID NO: 3775027 - DNA, 21 bp, Homo sapiens
tttcaggggtcgtcaccacct

SEQ ID NO: 3775028 - DNA, 18 bp, Homo sapiens
tttcaggtgtttagttgc

SEQ ID NO: 3775029 - DNA, 20 bp, Homo sapiens
tttcagtaataaaacatctt

SEQ ID NO: 3775030 - DNA, 16 bp, Homo sapiens
tttcagtgctgctgaa

SEQ ID NO: 3775031 - DNA, 13 bp, Homo sapiens
tttcagtgtacat

SEQ ID NO: 3775032 - DNA, 14 bp, Homo sapiens
tttcagtgtacatg

SEQ ID NO: 3775033 - DNA, 13 bp, Homo sapiens
tttcatctatttc

SEQ ID NO: 3775034 - DNA, 16 bp, Homo sapiens
tttcatgctatctctg

SEQ ID NO: 3775035 - DNA, 19 bp, Homo sapiens
tttcatgctatctctgtgt

SEQ ID NO: 3775036 - DNA, 14 bp, Homo sapiens
tttcatgtaaataa

SEQ ID NO: 3775037 - DNA, 16 bp, Homo sapiens
tttcattaaagcattt

SEQ ID NO: 3775038 - DNA, 22 bp, Homo sapiens
tttcattgactatcaaactgaa

SEQ ID NO: 3775039 - DNA, 22 bp, Homo sapiens
tttcattgatatgaaaaatatg

SEQ ID NO: 3775040 - DNA, 13 bp, Homo sapiens
tttcattgccagt

SEQ ID NO: 3775041 - DNA, 13 bp, Homo sapiens
tttccaagagctg

SEQ ID NO: 3775042 - DNA, 16 bp, Homo sapiens
tttccaagagctgagg

SEQ ID NO: 3775043 - DNA, 20 bp, Homo sapiens
tttccaagcaaatgttacat

SEQ ID NO: 3775044 - DNA, 17 bp, Homo sapiens
tttccacatttgtcaca

SEQ ID NO: 3775045 - DNA, 19 bp, Homo sapiens
tttccaggtttaagctgtt

SEQ ID NO: 3775046 - DNA, 16 bp, Homo sapiens
tttccatgaaaacgtt

SEQ ID NO: 3775047 - DNA, 19 bp, Homo sapiens
tttccatgactgcatttta

SEQ ID NO: 3775048 - DNA, 12 bp, Homo sapiens
tttcccataatt

SEQ ID NO: 3775049 - DNA, 13 bp, Homo sapiens
tttccccccactc

SEQ ID NO: 3775050 - DNA, 19 bp, Homo sapiens
tttcccttttgtaagttga

SEQ ID NO: 3775051 - DNA, 16 bp, Homo sapiens
tttccgtggcactgca

SEQ ID NO: 3775052 - DNA, 18 bp, Homo sapiens
tttcctaacaggattaga

SEQ ID NO: 3775053 - DNA, 15 bp, Homo sapiens
tttcctacttttcct

SEQ ID NO: 3775054 - DNA, 10 bp, Homo sapiens
aaaatagcca

SEQ ID NO: 3775055 - DNA, 12 bp, Homo sapiens
aaaatagcctgc

SEQ ID NO: 3775056 - DNA, 19 bp, Homo sapiens
aaaatattataacttaaaa

SEQ ID NO: 3775057 - DNA, 11 bp, Homo sapiens
aaaatcactaa

SEQ ID NO: 3775058 - DNA, 16 bp, Homo sapiens
aaaatcatgtacattt

SEQ ID NO: 3775059 - DNA, 17 bp, Homo sapiens
aaaatcatgtacatttc

SEQ ID NO: 3775060 - DNA, 18 bp, Homo sapiens
aaaatcatgtacatttct

SEQ ID NO: 3775061 - DNA, 15 bp, Homo sapiens
aaaatccttctaatc

SEQ ID NO: 3775062 - DNA, 20 bp, Homo sapiens
aaaatccttgcttatgacat

SEQ ID NO: 3775063 - DNA, 15 bp, Homo sapiens
aaaatgaaatgtttt

SEQ ID NO: 3775064 - DNA, 16 bp, Homo sapiens
aaaatgaaatgtttta

SEQ ID NO: 3775065 - DNA, 15 bp, Homo sapiens
aaaatgagaacatgt

SEQ ID NO: 3775066 - DNA, 14 bp, Homo sapiens
aaaatgagcctggc

SEQ ID NO: 3775067 - DNA, 23 bp, Homo sapiens
aaaatgagctcgcatttgtcaat

SEQ ID NO: 3775068 - DNA, 21 bp, Homo sapiens
aaaatgagttacctacatttt

SEQ ID NO: 3775069 - DNA, 23 bp, Homo sapiens
aaaatgattttacttagcaatgt

SEQ ID NO: 3775070 - DNA, 21 bp, Homo sapiens
aaaatgctgtattagtcacag

SEQ ID NO: 3775071 - DNA, 23 bp, Homo sapiens
aaaatgtataagttgaggcattt

SEQ ID NO: 3775072 - DNA, 12 bp, Homo sapiens
aaaatgtctgta

SEQ ID NO: 3775073 - DNA, 21 bp, Homo sapiens
aaaattaaggcaactgaacaa

SEQ ID NO: 3775074 - DNA, 15 bp, Homo sapiens
aaaattatctatttg

SEQ ID NO: 3775075 - DNA, 17 bp, Homo sapiens
aaaattatctatttgta

SEQ ID NO: 3775076 - DNA, 14 bp, Homo sapiens
aaaattatttcaga

SEQ ID NO: 3775077 - DNA, 19 bp, Homo sapiens
aaaattatttcagaaatgt

SEQ ID NO: 3775078 - DNA, 12 bp, Homo sapiens
aaaattccagaa

SEQ ID NO: 3775079 - DNA, 20 bp, Homo sapiens
aaaattccagaaaggatatt

SEQ ID NO: 3775080 - DNA, 21 bp, Homo sapiens
aaaattccatcccatcatctt

SEQ ID NO: 3775081 - DNA, 20 bp, Homo sapiens
aaaattctaaataaaatata

SEQ ID NO: 3775082 - DNA, 13 bp, Homo sapiens
aaaattcttggaa

SEQ ID NO: 3775083 - DNA, 13 bp, Homo sapiens
aaaattgaattta

SEQ ID NO: 3775084 - DNA, 17 bp, Homo sapiens
aaaattgaatttaacaa

SEQ ID NO: 3775085 - DNA, 23 bp, Homo sapiens
aaaattgatatacttttttctta

SEQ ID NO: 3775086 - DNA, 14 bp, Homo sapiens
aaaatttaagcatt

SEQ ID NO: 3775087 - DNA, 18 bp, Homo sapiens
aaaatttgaaatttagct

SEQ ID NO: 3775088 - DNA, 14 bp, Homo sapiens
aaaatttgaaccaa

SEQ ID NO: 3775089 - DNA, 23 bp, Homo sapiens
aaaatttgaaccaaaacattccg

SEQ ID NO: 3775090 - DNA, 13 bp, Homo sapiens
aaaatttggaatt

SEQ ID NO: 3775091 - DNA, 21 bp, Homo sapiens
aaaattttataaaattaagca

SEQ ID NO: 3775092 - DNA, 18 bp, Homo sapiens
aaaattttgtaattttct

SEQ ID NO: 3775093 - DNA, 14 bp, Homo sapiens
aaacaaaaaacaat

SEQ ID NO: 3775094 - DNA, 23 bp, Homo sapiens
aaacaaaaattcacaagctgcct

SEQ ID NO: 3775095 - DNA, 13 bp, Homo sapiens
aaacaaagccaga

SEQ ID NO: 3775096 - DNA, 17 bp, Homo sapiens
aaacaagaaagtttccc

SEQ ID NO: 3775097 - DNA, 16 bp, Homo sapiens
aaacaataaatgtgca

SEQ ID NO: 3775098 - DNA, 17 bp, Homo sapiens
aaacaatatttattgta

SEQ ID NO: 3775099 - DNA, 12 bp, Homo sapiens
aaacaatttatt

SEQ ID NO: 3775100 - DNA, 13 bp, Homo sapiens
aaacaatttattt

SEQ ID NO: 3775101 - DNA, 14 bp, Homo sapiens
aaacacaatatttt

SEQ ID NO: 3775102 - DNA, 17 bp, Homo sapiens
aaacacaccaggctgtg

SEQ ID NO: 3775103 - DNA, 18 bp, Homo sapiens
aaacacaccaggctgtgg

SEQ ID NO: 3775104 - DNA, 19 bp, Homo sapiens
aaacacactgaggcaggga

SEQ ID NO: 3775105 - DNA, 12 bp, Homo sapiens
aaacacagagag

SEQ ID NO: 3775106 - DNA, 13 bp, Homo sapiens
aaacagaaaaaaa

SEQ ID NO: 3775107 - DNA, 17 bp, Homo sapiens
aaacagaaaaaaaacac

SEQ ID NO: 3775108 - DNA, 21 bp, Homo sapiens
aaacagaaacaaaaacactaa

SEQ ID NO: 3775109 - DNA, 16 bp, Homo sapiens
aaacagagacaggccc

SEQ ID NO: 3775110 - DNA, 22 bp, Homo sapiens
aaacagatttggtgaatttgaa

SEQ ID NO: 3775111 - DNA, 18 bp, Homo sapiens
aaacagcattgctttctg

SEQ ID NO: 3775112 - DNA, 22 bp, Homo sapiens
aaacagccgtcagccaaatgta

SEQ ID NO: 3775113 - DNA, 23 bp, Homo sapiens
aaacagccgtcagccaaatgtaa

SEQ ID NO: 3775114 - DNA, 21 bp, Homo sapiens
aaacagcgctgggtccacccc

SEQ ID NO: 3775115 - DNA, 16 bp, Homo sapiens
aaacaggaaaaaaact

SEQ ID NO: 3775116 - DNA, 20 bp, Homo sapiens
aaacaggaaaaaaactttta

SEQ ID NO: 3775117 - DNA, 21 bp, Homo sapiens
aaacaggcagttggccagaga

SEQ ID NO: 3775118 - DNA, 17 bp, Homo sapiens
aaacaggtcaatacagt

SEQ ID NO: 3775119 - DNA, 14 bp, Homo sapiens
aaacagttaacttt

SEQ ID NO: 3775120 - DNA, 18 bp, Homo sapiens
aaacagttaactttcaga

SEQ ID NO: 3775121 - DNA, 16 bp, Homo sapiens
aaacataagagagcct

SEQ ID NO: 3775122 - DNA, 16 bp, Homo sapiens
aaacatcagacctgtc

SEQ ID NO: 3775123 - DNA, 19 bp, Homo sapiens
aaacatcagttactctgaa

SEQ ID NO: 3775124 - DNA, 22 bp, Homo sapiens
aaacatcagttactctgaaggg

SEQ ID NO: 3775125 - DNA, 22 bp, Homo sapiens
aaacatggggttggctgggccc

SEQ ID NO: 3775126 - DNA, 16 bp, Homo sapiens
aaacatgttagaagca

SEQ ID NO: 3775127 - DNA, 20 bp, Homo sapiens
aaacattgaagtaatgaatt

SEQ ID NO: 3775128 - DNA, 17 bp, Homo sapiens
aaacattgttttgtgta

SEQ ID NO: 3775129 - DNA, 14 bp, Homo sapiens
aaaccaagccgtgg

SEQ ID NO: 3775130 - DNA, 15 bp, Homo sapiens
aaaccatgcaaatgc

SEQ ID NO: 3775131 - DNA, 15 bp, Homo sapiens
aaaccattgcttcac

SEQ ID NO: 3775132 - DNA, 20 bp, Homo sapiens
aaaccccacctttattcctt

SEQ ID NO: 3775133 - DNA, 16 bp, Homo sapiens
aaaccctattggtaaa

SEQ ID NO: 3775134 - DNA, 16 bp, Homo sapiens
aaacccttgaaaagac

SEQ ID NO: 3775135 - DNA, 16 bp, Homo sapiens
aaaccgccaaggctgg

SEQ ID NO: 3775136 - DNA, 16 bp, Homo sapiens
aaaccttattgtacct

SEQ ID NO: 3775137 - DNA, 19 bp, Homo sapiens
aaacctttcaaatttcaca

SEQ ID NO: 3775138 - DNA, 19 bp, Homo sapiens
aaacgagtcaatcccctca

SEQ ID NO: 3775139 - DNA, 20 bp, Homo sapiens
aaacgcatggagtgtgtatt

SEQ ID NO: 3775140 - DNA, 21 bp, Homo sapiens
aaacgtttcagtaataaaaca

SEQ ID NO: 3775141 - DNA, 17 bp, Homo sapiens
aaacgttttgtttgaaa

SEQ ID NO: 3775142 - DNA, 20 bp, Homo sapiens
aaactaacagataagcaaga

SEQ ID NO: 3775143 - DNA, 16 bp, Homo sapiens
aaactaatattttatg

SEQ ID NO: 3775144 - DNA, 15 bp, Homo sapiens
aaactacattttaac

SEQ ID NO: 3775145 - DNA, 16 bp, Homo sapiens
aaactagaatttcatt

SEQ ID NO: 3775146 - DNA, 23 bp, Homo sapiens
aaactagacttgaggaaaccagg

SEQ ID NO: 3775147 - DNA, 19 bp, Homo sapiens
aaactagcttacatgagaa

SEQ ID NO: 3775148 - DNA, 16 bp, Homo sapiens
aaactatcttggtgaa

SEQ ID NO: 3775149 - DNA, 21 bp, Homo sapiens
aaactcaaaatatttgtacat

SEQ ID NO: 3775150 - DNA, 18 bp, Homo sapiens
aaactcaccatgtaaaag

SEQ ID NO: 3775151 - DNA, 14 bp, Homo sapiens
aaactctgggaaat

SEQ ID NO: 3775152 - DNA, 22 bp, Homo sapiens
aaactctgggaaataagagaga

SEQ ID NO: 3775153 - DNA, 17 bp, Homo sapiens
aaactcttgacctcagg

SEQ ID NO: 3775154 - DNA, 23 bp, Homo sapiens
aaactgagactcagacaggaaag

SEQ ID NO: 3775155 - DNA, 14 bp, Homo sapiens
aaactgaggaattt

SEQ ID NO: 3775156 - DNA, 14 bp, Homo sapiens
aaactggaagttat

SEQ ID NO: 3775157 - DNA, 17 bp, Homo sapiens
aaactgtcaaagaatca

SEQ ID NO: 3775158 - DNA, 15 bp, Homo sapiens
aaactgtcctctttc

SEQ ID NO: 3775159 - DNA, 23 bp, Homo sapiens
aaactgttctctattagacttta

SEQ ID NO: 3775160 - DNA, 14 bp, Homo sapiens
aaacttaagaaaca

SEQ ID NO: 3775161 - DNA, 14 bp, Homo sapiens
aaacttatcttaca

SEQ ID NO: 3775162 - DNA, 16 bp, Homo sapiens
aaacttcaagcaccag

SEQ ID NO: 3775163 - DNA, 19 bp, Homo sapiens
aaacttccagtgcaacact

SEQ ID NO: 3775164 - DNA, 14 bp, Homo sapiens
aaactttaatatgt

SEQ ID NO: 3775165 - DNA, 21 bp, Homo sapiens
aaactttagagtagcatgaga

SEQ ID NO: 3775166 - DNA, 15 bp, Homo sapiens
aaactttattttata

SEQ ID NO: 3775167 - DNA, 20 bp, Homo sapiens
aacagccgctcctgtctgcc

SEQ ID NO: 3775168 - DNA, 22 bp, Homo sapiens
aacagccgtcagccaaatgtaa

SEQ ID NO: 3775169 - DNA, 20 bp, Homo sapiens
aacagcgggagacctgtgct

SEQ ID NO: 3775170 - DNA, 21 bp, Homo sapiens
aacagcgggagacctgtgcta

SEQ ID NO: 3775171 - DNA, 15 bp, Homo sapiens
aacagctaccatgac

SEQ ID NO: 3775172 - DNA, 18 bp, Homo sapiens
aacagctatgggagcccc

SEQ ID NO: 3775173 - DNA, 19 bp, Homo sapiens
aacagctatgggagcccca

SEQ ID NO: 3775174 - DNA, 21 bp, Homo sapiens
aacagctgaggtctcttgagg

SEQ ID NO: 3775175 - DNA, 20 bp, Homo sapiens
aacagcttcatgcctttgta

SEQ ID NO: 3775176 - DNA, 20 bp, Homo sapiens
aacaggaccacaaaaatgaa

SEQ ID NO: 3775177 - DNA, 21 bp, Homo sapiens
aacaggagctgggatcctaag

SEQ ID NO: 3775178 - DNA, 16 bp, Homo sapiens
aacaggattagacagt

SEQ ID NO: 3775179 - DNA, 11 bp, Homo sapiens
aacaggcagat

SEQ ID NO: 3775180 - DNA, 22 bp, Homo sapiens
aacaggctgggcttcagtggca

SEQ ID NO: 3775181 - DNA, 22 bp, Homo sapiens
aacagggtgttgtcagcatctt

SEQ ID NO: 3775182 - DNA, 13 bp, Homo sapiens
aacaggtctcctc

SEQ ID NO: 3775183 - DNA, 17 bp, Homo sapiens
aacaggtctcctcttaa

SEQ ID NO: 3775184 - DNA, 14 bp, Homo sapiens
aacaggtggagaaa

SEQ ID NO: 3775185 - DNA, 14 bp, Homo sapiens
aacagtaaatgtgc

SEQ ID NO: 3775186 - DNA, 13 bp, Homo sapiens
aacagtgagcctg

SEQ ID NO: 3775187 - DNA, 12 bp, Homo sapiens
aacagtgcctgc

SEQ ID NO: 3775188 - DNA, 15 bp, Homo sapiens
aacagtgtttcccat

SEQ ID NO: 3775189 - DNA, 23 bp, Homo sapiens
aacagtgtttcccataattttct

SEQ ID NO: 3775190 - DNA, 18 bp, Homo sapiens
aacagttaactttcagaa

SEQ ID NO: 3775191 - DNA, 19 bp, Homo sapiens
aacagttaagcagccgcca

SEQ ID NO: 3775192 - DNA, 13 bp, Homo sapiens
aacagtttgtaca

SEQ ID NO: 3775193 - DNA, 14 bp, Homo sapiens
aacagttttccatg

SEQ ID NO: 3775194 - DNA, 17 bp, Homo sapiens
aacagttttccatgaaa

SEQ ID NO: 3775195 - DNA, 22 bp, Homo sapiens
aacataaaaagttaaaaaaaat

SEQ ID NO: 3775196 - DNA, 17 bp, Homo sapiens
aacataattcttgtata

SEQ ID NO: 3775197 - DNA, 17 bp, Homo sapiens
aacatataatatatgtt

SEQ ID NO: 3775198 - DNA, 17 bp, Homo sapiens
aacatatgcaaacataa

SEQ ID NO: 3775199 - DNA, 17 bp, Homo sapiens
aacatatttaagaaata

SEQ ID NO: 3775200 - DNA, 22 bp, Homo sapiens
aacatatttgttaaatatttac

SEQ ID NO: 3775201 - DNA, 17 bp, Homo sapiens
aacatcagacctgtctt

SEQ ID NO: 3775202 - DNA, 18 bp, Homo sapiens
aacatctttccagtcctt

SEQ ID NO: 3775203 - DNA, 22 bp, Homo sapiens
aacatgcctgccccaaacaaat

SEQ ID NO: 3775204 - DNA, 22 bp, Homo sapiens
aacatggaactcattcctgcct

SEQ ID NO: 3775205 - DNA, 12 bp, Homo sapiens
aacatgttggta

SEQ ID NO: 3775206 - DNA, 19 bp, Homo sapiens
aacatgttggtatttatct

SEQ ID NO: 3775207 - DNA, 22 bp, Homo sapiens
aacatgtttttcttctccctca

SEQ ID NO: 3775208 - DNA, 16 bp, Homo sapiens
aacattgaagtaatga

SEQ ID NO: 3775209 - DNA, 17 bp, Homo sapiens
aacattgaccaagaact

SEQ ID NO: 3775210 - DNA, 22 bp, Homo sapiens
aacattgaccaagaactgcatg

SEQ ID NO: 3775211 - DNA, 23 bp, Homo sapiens
aacattgaccaagaactgcatgg

SEQ ID NO: 3775212 - DNA, 15 bp, Homo sapiens
aacattgttttgtgt

SEQ ID NO: 3775213 - DNA, 15 bp, Homo sapiens
aaccaaatgcatcaa

SEQ ID NO: 3775214 - DNA, 16 bp, Homo sapiens
aaccaagtcatgtgca

SEQ ID NO: 3775215 - DNA, 15 bp, Homo sapiens
aaccaatcaagataa

SEQ ID NO: 3775216 - DNA, 15 bp, Homo sapiens
aaccacagccctgtc

SEQ ID NO: 3775217 - DNA, 13 bp, Homo sapiens
aaccacatcttgc

SEQ ID NO: 3775218 - DNA, 18 bp, Homo sapiens
aaccacatcttgctctgc

SEQ ID NO: 3775219 - DNA, 20 bp, Homo sapiens
aaccacatcttgctctgctg

SEQ ID NO: 3775220 - DNA, 19 bp, Homo sapiens
aaccaccacacccagccca

SEQ ID NO: 3775221 - DNA, 16 bp, Homo sapiens
aaccaccgctccccag

SEQ ID NO: 3775222 - DNA, 21 bp, Homo sapiens
aaccacgtctgtcttcacagc

SEQ ID NO: 3775223 - DNA, 12 bp, Homo sapiens
aaccactgcttc

SEQ ID NO: 3775224 - DNA, 16 bp, Homo sapiens
aaccactgtaaaatga

SEQ ID NO: 3775225 - DNA, 13 bp, Homo sapiens
aaccagagcactg

SEQ ID NO: 3775226 - DNA, 21 bp, Homo sapiens
aaccagggagcccctttgatg

SEQ ID NO: 3775227 - DNA, 17 bp, Homo sapiens
aaccagggcaccaagcc

SEQ ID NO: 3775228 - DNA, 16 bp, Homo sapiens
aaccagtatacaagat

SEQ ID NO: 3775229 - DNA, 17 bp, Homo sapiens
aaccagtatacaagata

SEQ ID NO: 3775230 - DNA, 15 bp, Homo sapiens
aaccagtctgaagtt

SEQ ID NO: 3775231 - DNA, 21 bp, Homo sapiens
aaccagtctgaagtttcattt

SEQ ID NO: 3775232 - DNA, 12 bp, Homo sapiens
aaccattgcttc

SEQ ID NO: 3775233 - DNA, 15 bp, Homo sapiens
aaccattgcttcact

SEQ ID NO: 3775234 - DNA, 16 bp, Homo sapiens
aaccattgcttcacta

SEQ ID NO: 3775235 - DNA, 13 bp, Homo sapiens
aacccaaacctgg

SEQ ID NO: 3775236 - DNA, 14 bp, Homo sapiens
aacccaaacctgga

SEQ ID NO: 3775237 - DNA, 22 bp, Homo sapiens
aacccaaggtgggtagatcacg

SEQ ID NO: 3775238 - DNA, 11 bp, Homo sapiens
aacccaggagg

SEQ ID NO: 3775239 - DNA, 17 bp, Homo sapiens
aacccatcagaaggaga

SEQ ID NO: 3775240 - DNA, 11 bp, Homo sapiens
aacccccaccc

SEQ ID NO: 3775241 - DNA, 15 bp, Homo sapiens
aacccccaccccaca

SEQ ID NO: 3775242 - DNA, 18 bp, Homo sapiens
aacccccaccccacactt

SEQ ID NO: 3775243 - DNA, 11 bp, Homo sapiens
aacccctttcc

SEQ ID NO: 3775244 - DNA, 15 bp, Homo sapiens
aacccgaggcccgca

SEQ ID NO: 3775245 - DNA, 15 bp, Homo sapiens
aaccctattggtaaa

SEQ ID NO: 3775246 - DNA, 12 bp, Homo sapiens
aaccctcagagc

SEQ ID NO: 3775247 - DNA, 13 bp, Homo sapiens
aaccctccctcag

SEQ ID NO: 3775248 - DNA, 19 bp, Homo sapiens
aaccctccctcagcccctc

SEQ ID NO: 3775249 - DNA, 23 bp, Homo sapiens
aaccctccctcagcccctcttgc

SEQ ID NO: 3775250 - DNA, 21 bp, Homo sapiens
aaccctcctatcacctcccct

SEQ ID NO: 3775251 - DNA, 23 bp, Homo sapiens
aaccctgttttatactgtactta

SEQ ID NO: 3775252 - DNA, 21 bp, Homo sapiens
aaccgatgctccagccaaccc

SEQ ID NO: 3775253 - DNA, 21 bp, Homo sapiens
aaccgcaggaagctgctccgt

SEQ ID NO: 3775254 - DNA, 15 bp, Homo sapiens
aaccgtcaataggca

SEQ ID NO: 3775255 - DNA, 22 bp, Homo sapiens
aacctaaatttggttctaggcc

SEQ ID NO: 3775256 - DNA, 22 bp, Homo sapiens
aacctcacgcacctcccatcct

SEQ ID NO: 3775257 - DNA, 18 bp, Homo sapiens
aacctctcacttcaccct

SEQ ID NO: 3775258 - DNA, 15 bp, Homo sapiens
aacctctctgatctt

SEQ ID NO: 3775259 - DNA, 19 bp, Homo sapiens
aacctgacaaaaaaaaagt

SEQ ID NO: 3775260 - DNA, 18 bp, Homo sapiens
aacctgatgttaaaattc

SEQ ID NO: 3775261 - DNA, 14 bp, Homo sapiens
aacctggtgctgga

SEQ ID NO: 3775262 - DNA, 15 bp, Homo sapiens
aacctgtaaattatt

SEQ ID NO: 3775263 - DNA, 17 bp, Homo sapiens
aacctgtaaattatttt

SEQ ID NO: 3775264 - DNA, 15 bp, Homo sapiens
aacctgtccttgcac

SEQ ID NO: 3775265 - DNA, 16 bp, Homo sapiens
aaccttacttacagca

SEQ ID NO: 3775266 - DNA, 15 bp, Homo sapiens
aaccttattgtacct

SEQ ID NO: 3775267 - DNA, 17 bp, Homo sapiens
aaccttattgtacctct

SEQ ID NO: 3775268 - DNA, 12 bp, Homo sapiens
aacgaaaagcac

SEQ ID NO: 3775269 - DNA, 13 bp, Homo sapiens
aacgaaagctggg

SEQ ID NO: 3775270 - DNA, 12 bp, Homo sapiens
aacgaagaaaaa

SEQ ID NO: 3775271 - DNA, 12 bp, Homo sapiens
aacgaagttggg

SEQ ID NO: 3775272 - DNA, 23 bp, Homo sapiens
aacgacaaagccaaactctgcca

SEQ ID NO: 3775273 - DNA, 14 bp, Homo sapiens
aacgacaatagctt

SEQ ID NO: 3775274 - DNA, 17 bp, Homo sapiens
aacgatgatgcttgtaa

SEQ ID NO: 3775275 - DNA, 13 bp, Homo sapiens
aacgatttagaaa

SEQ ID NO: 3775276 - DNA, 11 bp, Homo sapiens
aacgcagccct

SEQ ID NO: 3775277 - DNA, 16 bp, Homo sapiens
aacgcagccctgcttt

SEQ ID NO: 3775278 - DNA, 21 bp, Homo sapiens
aacgcatggagtgtgtattgt

SEQ ID NO: 3775279 - DNA, 22 bp, Homo sapiens
aacgcatggagtgtgtattgtt

SEQ ID NO: 3775280 - DNA, 15 bp, Homo sapiens
aacgccagtctccca

SEQ ID NO: 3775281 - DNA, 15 bp, Homo sapiens
aaggccttaatatgt

SEQ ID NO: 3775282 - DNA, 16 bp, Homo sapiens
aaggctcagtctcagg

SEQ ID NO: 3775283 - DNA, 15 bp, Homo sapiens
aaggctgaccaagag

SEQ ID NO: 3775284 - DNA, 19 bp, Homo sapiens
aaggctgaccaagagagaa

SEQ ID NO: 3775285 - DNA, 14 bp, Homo sapiens
aaggctggggctat

SEQ ID NO: 3775286 - DNA, 14 bp, Homo sapiens
aagggaaacagtca

SEQ ID NO: 3775287 - DNA, 14 bp, Homo sapiens
aagggaaatatcat

SEQ ID NO: 3775288 - DNA, 14 bp, Homo sapiens
aagggaatgcatta

SEQ ID NO: 3775289 - DNA, 24 bp, Homo sapiens
aagggagcactgggttgactttca

SEQ ID NO: 3775290 - DNA, 18 bp, Homo sapiens
aagggagctatcaggaac

SEQ ID NO: 3775291 - DNA, 15 bp, Homo sapiens
aagggattttcagcc

SEQ ID NO: 3775292 - DNA, 23 bp, Homo sapiens
aagggattttcagccctcagaat

SEQ ID NO: 3775293 - DNA, 22 bp, Homo sapiens
aagggcaggaaggagagcctgc

SEQ ID NO: 3775294 - DNA, 14 bp, Homo sapiens
aagggcagtggagg

SEQ ID NO: 3775295 - DNA, 13 bp, Homo sapiens
aagggcccagaga

SEQ ID NO: 3775296 - DNA, 15 bp, Homo sapiens
aagggcccagagagg

SEQ ID NO: 3775297 - DNA, 21 bp, Homo sapiens
aagggcttacacgtggaggaa

SEQ ID NO: 3775298 - DNA, 18 bp, Homo sapiens
aaggggaagcactcgtgt

SEQ ID NO: 3775299 - DNA, 23 bp, Homo sapiens
aaggggaatgtttgcctctgcct

SEQ ID NO: 3775300 - DNA, 13 bp, Homo sapiens
aaggggaggaggg

SEQ ID NO: 3775301 - DNA, 15 bp, Homo sapiens
aaggggaggagggcg

SEQ ID NO: 3775302 - DNA, 13 bp, Homo sapiens
aaggggccctggt

SEQ ID NO: 3775303 - DNA, 14 bp, Homo sapiens
aaggggccctggtc

SEQ ID NO: 3775304 - DNA, 21 bp, Homo sapiens
aaggggccctggtccttccag

SEQ ID NO: 3775305 - DNA, 17 bp, Homo sapiens
aagggtatcaggtgctg

SEQ ID NO: 3775306 - DNA, 19 bp, Homo sapiens
aagggtccttccctctccc

SEQ ID NO: 3775307 - DNA, 18 bp, Homo sapiens
aagggtctagggagagac

SEQ ID NO: 3775308 - DNA, 17 bp, Homo sapiens
aaggtaaaacaaatcag

SEQ ID NO: 3775309 - DNA, 14 bp, Homo sapiens
aaggtaaaattcta

SEQ ID NO: 3775310 - DNA, 16 bp, Homo sapiens
aaggtaaaattctaaa

SEQ ID NO: 3775311 - DNA, 12 bp, Homo sapiens
aaggtagttttt

SEQ ID NO: 3775312 - DNA, 22 bp, Homo sapiens
aaggtagtttttacctaccaca

SEQ ID NO: 3775313 - DNA, 11 bp, Homo sapiens
aaggtataatt

SEQ ID NO: 3775314 - DNA, 18 bp, Homo sapiens
aaggtattaaattgatgt

SEQ ID NO: 3775315 - DNA, 20 bp, Homo sapiens
aaggtcgtttttttcattcc

SEQ ID NO: 3775316 - DNA, 20 bp, Homo sapiens
aaggtgctgttgtcattgct

SEQ ID NO: 3775317 - DNA, 22 bp, Homo sapiens
aaggtgggggttggctgggtac

SEQ ID NO: 3775318 - DNA, 16 bp, Homo sapiens
aaggtggtatgtgtgt

SEQ ID NO: 3775319 - DNA, 20 bp, Homo sapiens
aaggtggtatgtgtgtgtat

SEQ ID NO: 3775320 - DNA, 15 bp, Homo sapiens
aaggttaataaagta

SEQ ID NO: 3775321 - DNA, 17 bp, Homo sapiens
aaggttcactaaagcag

SEQ ID NO: 3775322 - DNA, 21 bp, Homo sapiens
aaggttcttcccttttacata

SEQ ID NO: 3775323 - DNA, 17 bp, Homo sapiens
aaggtttgtatattgtc

SEQ ID NO: 3775324 - DNA, 20 bp, Homo sapiens
aaggttttcctcttctattt

SEQ ID NO: 3775325 - DNA, 18 bp, Homo sapiens
aagtaacttgtcttaaat

SEQ ID NO: 3775326 - DNA, 13 bp, Homo sapiens
aagtaagaagaca

SEQ ID NO: 3775327 - DNA, 14 bp, Homo sapiens
aagtaagaagacat

SEQ ID NO: 3775328 - DNA, 18 bp, Homo sapiens
aagtaagtaccactcagg

SEQ ID NO: 3775329 - DNA, 22 bp, Homo sapiens
aagtaattatcgggaacagtgt

SEQ ID NO: 3775330 - DNA, 16 bp, Homo sapiens
aagtaatttcttctca

SEQ ID NO: 3775331 - DNA, 13 bp, Homo sapiens
aagtactatgtat

SEQ ID NO: 3775332 - DNA, 17 bp, Homo sapiens
aagtactgctgtaaata

SEQ ID NO: 3775333 - DNA, 20 bp, Homo sapiens
aagtactgctgtaaataaat

SEQ ID NO: 3775334 - DNA, 23 bp, Homo sapiens
aagtactgctgtaaataaatgct

SEQ ID NO: 3775335 - DNA, 21 bp, Homo sapiens
aagtacttctccaccctgctc

SEQ ID NO: 3775336 - DNA, 22 bp, Homo sapiens
aagtacttctccaccctgctct

SEQ ID NO: 3775337 - DNA, 19 bp, Homo sapiens
aagtaggggttgtgggtga

SEQ ID NO: 3775338 - DNA, 18 bp, Homo sapiens
aagtatactgtattttta

SEQ ID NO: 3775339 - DNA, 13 bp, Homo sapiens
aagtatatattta

SEQ ID NO: 3775340 - DNA, 21 bp, Homo sapiens
aagtatcatggaaatattatg

SEQ ID NO: 3775341 - DNA, 13 bp, Homo sapiens
aagtatgtgagtg

SEQ ID NO: 3775342 - DNA, 18 bp, Homo sapiens
aagtatgtgagtgtgtcc

SEQ ID NO: 3775343 - DNA, 15 bp, Homo sapiens
aagtattccacctta

SEQ ID NO: 3775344 - DNA, 16 bp, Homo sapiens
aagtattccaccttaa

SEQ ID NO: 3775345 - DNA, 17 bp, Homo sapiens
aagtattccaccttaaa

SEQ ID NO: 3775346 - DNA, 20 bp, Homo sapiens
aagtattccaccttaaatta

SEQ ID NO: 3775347 - DNA, 21 bp, Homo sapiens
aagtattccaccttaaattaa

SEQ ID NO: 3775348 - DNA, 22 bp, Homo sapiens
aagtattcctttcctgatcact

SEQ ID NO: 3775349 - DNA, 20 bp, Homo sapiens
aagtattctgcctttgcaga

SEQ ID NO: 3775350 - DNA, 21 bp, Homo sapiens
aagtattcttatttaatgaaa

SEQ ID NO: 3775351 - DNA, 11 bp, Homo sapiens
aagtatttagg

SEQ ID NO: 3775352 - DNA, 16 bp, Homo sapiens
aagtatttatatattt

SEQ ID NO: 3775353 - DNA, 20 bp, Homo sapiens
aagtatttatatatttataa

SEQ ID NO: 3775354 - DNA, 23 bp, Homo sapiens
aagtatttatatatttataactc

SEQ ID NO: 3775355 - DNA, 22 bp, Homo sapiens
aagtcaaccaatgtagaaagct

SEQ ID NO: 3775356 - DNA, 18 bp, Homo sapiens
aagtcacaaaggaatgga

SEQ ID NO: 3775357 - DNA, 17 bp, Homo sapiens
aagtcacatcacaggac

SEQ ID NO: 3775358 - DNA, 19 bp, Homo sapiens
aagtcacatcacaggacac

SEQ ID NO: 3775359 - DNA, 21 bp, Homo sapiens
aagtcactcaattgtttttgt

SEQ ID NO: 3775360 - DNA, 19 bp, Homo sapiens
aagtcagctttgccttcca

SEQ ID NO: 3775361 - DNA, 15 bp, Homo sapiens
aagtcaggtccaatt

SEQ ID NO: 3775362 - DNA, 21 bp, Homo sapiens
aagtcagtgcccaactgttat

SEQ ID NO: 3775363 - DNA, 15 bp, Homo sapiens
aagtcatgaagccca

SEQ ID NO: 3775364 - DNA, 14 bp, Homo sapiens
aagtcatgtgcatt

SEQ ID NO: 3775365 - DNA, 18 bp, Homo sapiens
aagtcattttaactttat

SEQ ID NO: 3775366 - DNA, 23 bp, Homo sapiens
aagtcccaccggttgcttctggg

SEQ ID NO: 3775367 - DNA, 18 bp, Homo sapiens
aagtccccaggccccagg

SEQ ID NO: 3775368 - DNA, 21 bp, Homo sapiens
aagtccccaggccccaggaag

SEQ ID NO: 3775369 - DNA, 13 bp, Homo sapiens
aagtccctgcccc

SEQ ID NO: 3775370 - DNA, 17 bp, Homo sapiens
aagtcctacaagctaaa

SEQ ID NO: 3775371 - DNA, 15 bp, Homo sapiens
aagtcctggctacat

SEQ ID NO: 3775372 - DNA, 17 bp, Homo sapiens
aagtctaaatatttcct

SEQ ID NO: 3775373 - DNA, 14 bp, Homo sapiens
aagtctccttcccc

SEQ ID NO: 3775374 - DNA, 13 bp, Homo sapiens
aagtctctattta

SEQ ID NO: 3775375 - DNA, 14 bp, Homo sapiens
aagtctctatttaa

SEQ ID NO: 3775376 - DNA, 15 bp, Homo sapiens
aagtctctgctggcc

SEQ ID NO: 3775377 - DNA, 16 bp, Homo sapiens
aagtctgcattacatt

SEQ ID NO: 3775378 - DNA, 18 bp, Homo sapiens
aagtctggatctgggacc

SEQ ID NO: 3775379 - DNA, 15 bp, Homo sapiens
aagtctgtgcctgga

SEQ ID NO: 3775380 - DNA, 23 bp, Homo sapiens
aagtctgtgcctggagctcctgg

SEQ ID NO: 3775381 - DNA, 18 bp, Homo sapiens
aagtcttagatgtatata

SEQ ID NO: 3775382 - DNA, 21 bp, Homo sapiens
aagtcttcaagggctgcttca

SEQ ID NO: 3775383 - DNA, 19 bp, Homo sapiens
aagtcttgtgactagtgct

SEQ ID NO: 3775384 - DNA, 21 bp, Homo sapiens
aagtcttgtgactagtgctga

SEQ ID NO: 3775385 - DNA, 22 bp, Homo sapiens
aagtcttgtgactagtgctgaa

SEQ ID NO: 3775386 - DNA, 12 bp, Homo sapiens
aagtgaaatctg

SEQ ID NO: 3775387 - DNA, 19 bp, Homo sapiens
aagtgaacacattgtgtca

SEQ ID NO: 3775388 - DNA, 17 bp, Homo sapiens
aagtgaatttgaatgaa

SEQ ID NO: 3775389 - DNA, 19 bp, Homo sapiens
aagtgaatttgaatgaaaa

SEQ ID NO: 3775390 - DNA, 17 bp, Homo sapiens
aagtgaatttttctcta

SEQ ID NO: 3775391 - DNA, 21 bp, Homo sapiens
aagtgacaaggccccagagac

SEQ ID NO: 3775392 - DNA, 15 bp, Homo sapiens
aagtgaccaaggagg

SEQ ID NO: 3775393 - DNA, 18 bp, Homo sapiens
aagtgagcaaacctgccc

SEQ ID NO: 3775394 - DNA, 14 bp, Homo sapiens
aagtgatcaataaa

SEQ ID NO: 3775395 - DNA, 18 bp, Homo sapiens
aagtgatcctcctgcctc

SEQ ID NO: 3775396 - DNA, 16 bp, Homo sapiens
aagtgattctcctgcc

SEQ ID NO: 3775397 - DNA, 17 bp, Homo sapiens
aagtgcaggctggcacc

SEQ ID NO: 3775398 - DNA, 16 bp, Homo sapiens
aagtgcatgctctctg

SEQ ID NO: 3775399 - DNA, 23 bp, Homo sapiens
aagtgccactgcccgagctggtg

SEQ ID NO: 3775400 - DNA, 21 bp, Homo sapiens
aagtgccagtcttgtgtctgc

SEQ ID NO: 3775401 - DNA, 19 bp, Homo sapiens
aagtgcccctgctgcctcc

SEQ ID NO: 3775402 - DNA, 18 bp, Homo sapiens
aagtgcctacattatcta

SEQ ID NO: 3775403 - DNA, 12 bp, Homo sapiens
aagtgctgggat

SEQ ID NO: 3775404 - DNA, 14 bp, Homo sapiens
aagtgctttaaaaa

SEQ ID NO: 3775405 - DNA, 12 bp, Homo sapiens
aagtggaaggaa

SEQ ID NO: 3775406 - DNA, 13 bp, Homo sapiens
aagtggaaggaaa

SEQ ID NO: 3775407 - DNA, 16 bp, Homo sapiens
aagtggaccaggacag

SEQ ID NO: 3775408 - DNA, 16 bp, Homo sapiens
aagtgggccaggacag

SEQ ID NO: 3775409 - DNA, 15 bp, Homo sapiens
aagtgtaacagctga

SEQ ID NO: 3775410 - DNA, 16 bp, Homo sapiens
aagtgtaacagctgag

SEQ ID NO: 3775411 - DNA, 21 bp, Homo sapiens
aagtgtaacatatgcaaacat

SEQ ID NO: 3775412 - DNA, 11 bp, Homo sapiens
aagtgtaactg

SEQ ID NO: 3775413 - DNA, 14 bp, Homo sapiens
aagtgtactaatta

SEQ ID NO: 3775414 - DNA, 17 bp, Homo sapiens
aagtgtccgagaactaa

SEQ ID NO: 3775415 - DNA, 12 bp, Homo sapiens
aagtgtgtatgt

SEQ ID NO: 3775416 - DNA, 22 bp, Homo sapiens
aagtgtgtatgtgcgtgtgtgc

SEQ ID NO: 3775417 - DNA, 23 bp, Homo sapiens
aagtgtttcataaatttgagagt

SEQ ID NO: 3775418 - DNA, 15 bp, Homo sapiens
aagtgttttcagagc

SEQ ID NO: 3775419 - DNA, 17 bp, Homo sapiens
aagttaaaaaaaataat

SEQ ID NO: 3775420 - DNA, 21 bp, Homo sapiens
aagttaaaaaaaataataaat

SEQ ID NO: 3775421 - DNA, 14 bp, Homo sapiens
aagttaaataaatc

SEQ ID NO: 3775422 - DNA, 15 bp, Homo sapiens
aagttaacaaggaat

SEQ ID NO: 3775423 - DNA, 17 bp, Homo sapiens
aagttaacaaggaatgc

SEQ ID NO: 3775424 - DNA, 20 bp, Homo sapiens
aagttacaaattgcttgaaa

SEQ ID NO: 3775425 - DNA, 15 bp, Homo sapiens
aagttacttattcta

SEQ ID NO: 3775426 - DNA, 18 bp, Homo sapiens
aagttataaatcaatgtc

SEQ ID NO: 3775427 - DNA, 20 bp, Homo sapiens
aagttataaatcaatgtcac

SEQ ID NO: 3775428 - DNA, 19 bp, Homo sapiens
aagttatataaagagaaaa

SEQ ID NO: 3775429 - DNA, 20 bp, Homo sapiens
aagttatataaagagaaaat

SEQ ID NO: 3775430 - DNA, 22 bp, Homo sapiens
aagttatataaagagaaaattg

SEQ ID NO: 3775431 - DNA, 23 bp, Homo sapiens
aagttatataaagagaaaattga

SEQ ID NO: 3775432 - DNA, 18 bp, Homo sapiens
aagttattaatttcttca

SEQ ID NO: 3775433 - DNA, 14 bp, Homo sapiens
aagttccctacttc

SEQ ID NO: 3775434 - DNA, 17 bp, Homo sapiens
aagttccctacttcctg

SEQ ID NO: 3775435 - DNA, 12 bp, Homo sapiens
aagttctgtgta

SEQ ID NO: 3775436 - DNA, 14 bp, Homo sapiens
aagttcttagatat

SEQ ID NO: 3775437 - DNA, 23 bp, Homo sapiens
aagttcttagatatctttttatt

SEQ ID NO: 3775438 - DNA, 20 bp, Homo sapiens
aagttgaaagagtcctattt

SEQ ID NO: 3775439 - DNA, 18 bp, Homo sapiens
aagttgaagctaagattt

SEQ ID NO: 3775440 - DNA, 18 bp, Homo sapiens
aagttgatggtgatgaaa

SEQ ID NO: 3775441 - DNA, 22 bp, Homo sapiens
aagttgcagtgagctgatatca

SEQ ID NO: 3775442 - DNA, 23 bp, Homo sapiens
aagttgcgacggagagaaaaaag

SEQ ID NO: 3775443 - DNA, 13 bp, Homo sapiens
aagttggactggg

SEQ ID NO: 3775444 - DNA, 17 bp, Homo sapiens
aagttggcttctgtttc

SEQ ID NO: 3775445 - DNA, 21 bp, Homo sapiens
aagttggcttctgtttctagt

SEQ ID NO: 3775446 - DNA, 19 bp, Homo sapiens
aagttgggcaatataacca

SEQ ID NO: 3775447 - DNA, 15 bp, Homo sapiens
aagttgtttcattga

SEQ ID NO: 3775448 - DNA, 13 bp, Homo sapiens
aagtttaaaatgt

SEQ ID NO: 3775449 - DNA, 17 bp, Homo sapiens
aagtttaaaatgtataa

SEQ ID NO: 3775450 - DNA, 18 bp, Homo sapiens
aagtttacaatcaaagga

SEQ ID NO: 3775451 - DNA, 19 bp, Homo sapiens
aagtttacaatcaaaggaa

SEQ ID NO: 3775452 - DNA, 23 bp, Homo sapiens
aagtttataagaggatgaagtga

SEQ ID NO: 3775453 - DNA, 17 bp, Homo sapiens
aagtttccccaccagtg

SEQ ID NO: 3775454 - DNA, 21 bp, Homo sapiens
aagtttgcactgtatgctgga

SEQ ID NO: 3775455 - DNA, 19 bp, Homo sapiens
aagtttgtgttctgtttgt

SEQ ID NO: 3775456 - DNA, 22 bp, Homo sapiens
aagtttgtgttctgtttgttaa

SEQ ID NO: 3775457 - DNA, 11 bp, Homo sapiens
aagttttcagg

SEQ ID NO: 3775458 - DNA, 19 bp, Homo sapiens
aataaaaactgactcctta

SEQ ID NO: 3775459 - DNA, 13 bp, Homo sapiens
aataaaaaggcac

SEQ ID NO: 3775460 - DNA, 19 bp, Homo sapiens
aataaaaattaaggcaact

SEQ ID NO: 3775461 - DNA, 13 bp, Homo sapiens
aataaaacctttc

SEQ ID NO: 3775462 - DNA, 14 bp, Homo sapiens
aataaaacctttca

SEQ ID NO: 3775463 - DNA, 18 bp, Homo sapiens
aataaaagcagcatctgc

SEQ ID NO: 3775464 - DNA, 12 bp, Homo sapiens
aataaaataacc

SEQ ID NO: 3775465 - DNA, 15 bp, Homo sapiens
aataaaatataattg

SEQ ID NO: 3775466 - DNA, 21 bp, Homo sapiens
aataaaatataattgtttttt

SEQ ID NO: 3775467 - DNA, 12 bp, Homo sapiens
aataaaatatca

SEQ ID NO: 3775468 - DNA, 14 bp, Homo sapiens
aataaaatgtgatt

SEQ ID NO: 3775469 - DNA, 21 bp, Homo sapiens
aataaaatgtgatttttctga

SEQ ID NO: 3775470 - DNA, 23 bp, Homo sapiens
aataaaattaaagctgaaaactg

SEQ ID NO: 3775471 - DNA, 17 bp, Homo sapiens
aataaaattaagaatgt

SEQ ID NO: 3775472 - DNA, 13 bp, Homo sapiens
aataaacaaataa

SEQ ID NO: 3775473 - DNA, 18 bp, Homo sapiens
aataaacacatagattca

SEQ ID NO: 3775474 - DNA, 21 bp, Homo sapiens
aataaacacatagattcacct

SEQ ID NO: 3775475 - DNA, 22 bp, Homo sapiens
aataaacagcttcatgcctttg

SEQ ID NO: 3775476 - DNA, 17 bp, Homo sapiens
aataaactgtgtttact

SEQ ID NO: 3775477 - DNA, 14 bp, Homo sapiens
aataaagtaattat

SEQ ID NO: 3775478 - DNA, 14 bp, Homo sapiens
aataaagtatctac

SEQ ID NO: 3775479 - DNA, 11 bp, Homo sapiens
aataaagtatt

SEQ ID NO: 3775480 - DNA, 16 bp, Homo sapiens
aataaagtgttttcag

SEQ ID NO: 3775481 - DNA, 17 bp, Homo sapiens
aataaagtgttttcaga

SEQ ID NO: 3775482 - DNA, 20 bp, Homo sapiens
aataaatgtatcttattcac

SEQ ID NO: 3775483 - DNA, 20 bp, Homo sapiens
aataaatgtgaaattctgtc

SEQ ID NO: 3775484 - DNA, 21 bp, Homo sapiens
aataaattgcatgctgcttta

SEQ ID NO: 3775485 - DNA, 20 bp, Homo sapiens
aataacacacatataaacat

SEQ ID NO: 3775486 - DNA, 16 bp, Homo sapiens
aataacataacaaata

SEQ ID NO: 3775487 - DNA, 17 bp, Homo sapiens
aataacataacaaataa

SEQ ID NO: 3775488 - DNA, 19 bp, Homo sapiens
aataacatgtaattaagta

SEQ ID NO: 3775489 - DNA, 14 bp, Homo sapiens
aataaccacttaaa

SEQ ID NO: 3775490 - DNA, 22 bp, Homo sapiens
aataaccccattctttgcttga

SEQ ID NO: 3775491 - DNA, 14 bp, Homo sapiens
aataactactgtgt

SEQ ID NO: 3775492 - DNA, 19 bp, Homo sapiens
aataactagtgttgcttgg

SEQ ID NO: 3775493 - DNA, 21 bp, Homo sapiens
aataagagaagctactttgtt

SEQ ID NO: 3775494 - DNA, 13 bp, Homo sapiens
aataagagatttg

SEQ ID NO: 3775495 - DNA, 16 bp, Homo sapiens
aataagatacatcaca

SEQ ID NO: 3775496 - DNA, 14 bp, Homo sapiens
aataaggatttttc

SEQ ID NO: 3775497 - DNA, 17 bp, Homo sapiens
aataaggccttaatatg

SEQ ID NO: 3775498 - DNA, 13 bp, Homo sapiens
aataataaacttt

SEQ ID NO: 3775499 - DNA, 11 bp, Homo sapiens
aataataatta

SEQ ID NO: 3775500 - DNA, 18 bp, Homo sapiens
aataatacctaagccttc

SEQ ID NO: 3775501 - DNA, 14 bp, Homo sapiens
aataatcttgtttc

SEQ ID NO: 3775502 - DNA, 21 bp, Homo sapiens
aataatgtgggaagaaacaaa

SEQ ID NO: 3775503 - DNA, 19 bp, Homo sapiens
aataatgttaacatggaca

SEQ ID NO: 3775504 - DNA, 21 bp, Homo sapiens
aataattttaggcacccatcc

SEQ ID NO: 3775505 - DNA, 14 bp, Homo sapiens
aataattttatgaa

SEQ ID NO: 3775506 - DNA, 20 bp, Homo sapiens
aatacaaacatatttgttaa

SEQ ID NO: 3775507 - DNA, 21 bp, Homo sapiens
aattgaattttcaagcatctc

SEQ ID NO: 3775508 - DNA, 18 bp, Homo sapiens
aattgacttcgactgtga

SEQ ID NO: 3775509 - DNA, 20 bp, Homo sapiens
aattgagaagcgtatgtttt

SEQ ID NO: 3775510 - DNA, 22 bp, Homo sapiens
aattgagagaatggaaaacaga

SEQ ID NO: 3775511 - DNA, 19 bp, Homo sapiens
aattgatttcccttcttct

SEQ ID NO: 3775512 - DNA, 22 bp, Homo sapiens
aattgcatgctgctttaattgt

SEQ ID NO: 3775513 - DNA, 21 bp, Homo sapiens
aattgcattttttaaaacaag

SEQ ID NO: 3775514 - DNA, 12 bp, Homo sapiens
aattgctccttg

SEQ ID NO: 3775515 - DNA, 19 bp, Homo sapiens
aattgcttaccaaaggata

SEQ ID NO: 3775516 - DNA, 15 bp, Homo sapiens
aattgcttgaaagaa

SEQ ID NO: 3775517 - DNA, 16 bp, Homo sapiens
aattgcttgtttgctt

SEQ ID NO: 3775518 - DNA, 20 bp, Homo sapiens
aattggaagctgccctgccc

SEQ ID NO: 3775519 - DNA, 13 bp, Homo sapiens
aattggcattaaa

SEQ ID NO: 3775520 - DNA, 17 bp, Homo sapiens
aattggcattaaaactt

SEQ ID NO: 3775521 - DNA, 14 bp, Homo sapiens
aattgtaaactgta

SEQ ID NO: 3775522 - DNA, 13 bp, Homo sapiens
aattgtatctagt

SEQ ID NO: 3775523 - DNA, 20 bp, Homo sapiens
aattgtgccgagaaaagcat

SEQ ID NO: 3775524 - DNA, 13 bp, Homo sapiens
aattgtgtggtca

SEQ ID NO: 3775525 - DNA, 15 bp, Homo sapiens
aatttaaaacaaaca

SEQ ID NO: 3775526 - DNA, 15 bp, Homo sapiens
aatttaacaatgcga

SEQ ID NO: 3775527 - DNA, 14 bp, Homo sapiens
aatttaatatagct

SEQ ID NO: 3775528 - DNA, 19 bp, Homo sapiens
aatttacatactctgctta

SEQ ID NO: 3775529 - DNA, 15 bp, Homo sapiens
aatttataaaaatta

SEQ ID NO: 3775530 - DNA, 15 bp, Homo sapiens
aatttatacaatatc

SEQ ID NO: 3775531 - DNA, 20 bp, Homo sapiens
aatttatgagtttttgatag

SEQ ID NO: 3775532 - DNA, 12 bp, Homo sapiens
aatttattcaat

SEQ ID NO: 3775533 - DNA, 16 bp, Homo sapiens
aatttattgcttgata

SEQ ID NO: 3775534 - DNA, 17 bp, Homo sapiens
aatttatttatactatt

SEQ ID NO: 3775535 - DNA, 15 bp, Homo sapiens
aatttcaatttgttc

SEQ ID NO: 3775536 - DNA, 14 bp, Homo sapiens
aatttcacattaat

SEQ ID NO: 3775537 - DNA, 22 bp, Homo sapiens
aatttcaggttttgtaaagatg

SEQ ID NO: 3775538 - DNA, 16 bp, Homo sapiens
aatttctaccatttca

SEQ ID NO: 3775539 - DNA, 18 bp, Homo sapiens
aatttctaccatttcaga

SEQ ID NO: 3775540 - DNA, 22 bp, Homo sapiens
aatttctgtgtctaaatttctt

SEQ ID NO: 3775541 - DNA, 20 bp, Homo sapiens
aatttcttggtaagaagccg

SEQ ID NO: 3775542 - DNA, 13 bp, Homo sapiens
aatttgaaccaaa

SEQ ID NO: 3775543 - DNA, 16 bp, Homo sapiens
aatttgaaccaaaaca

SEQ ID NO: 3775544 - DNA, 23 bp, Homo sapiens
aatttgaaccaaaacattccgtt

SEQ ID NO: 3775545 - DNA, 20 bp, Homo sapiens
aatttgagttggatcatcta

SEQ ID NO: 3775546 - DNA, 20 bp, Homo sapiens
aatttgatacatatgtgaat

SEQ ID NO: 3775547 - DNA, 21 bp, Homo sapiens
aatttgatacatatgtgaata

SEQ ID NO: 3775548 - DNA, 17 bp, Homo sapiens
aatttgatgaaagctga

SEQ ID NO: 3775549 - DNA, 20 bp, Homo sapiens
aatttgccaaaataatgtct

SEQ ID NO: 3775550 - DNA, 15 bp, Homo sapiens
aatttggaattctgt

SEQ ID NO: 3775551 - DNA, 18 bp, Homo sapiens
aatttgggggaaaattta

SEQ ID NO: 3775552 - DNA, 16 bp, Homo sapiens
aatttggttctaatag

SEQ ID NO: 3775553 - DNA, 24 bp, Homo sapiens
aatttgtaaaaacagcattgcttt

SEQ ID NO: 3775554 - DNA, 16 bp, Homo sapiens
aatttgtcattttgaa

SEQ ID NO: 3775555 - DNA, 18 bp, Homo sapiens
aatttgtcattttgaagc

SEQ ID NO: 3775556 - DNA, 16 bp, Homo sapiens
aatttgtgtaataaag

SEQ ID NO: 3775557 - DNA, 20 bp, Homo sapiens
aatttgtgtaataaagtgtt

SEQ ID NO: 3775558 - DNA, 22 bp, Homo sapiens
aatttgtgtaataaagtgtttt

SEQ ID NO: 3775559 - DNA, 12 bp, Homo sapiens
aattttaaatta

SEQ ID NO: 3775560 - DNA, 17 bp, Homo sapiens
aattttaagattccttt

SEQ ID NO: 3775561 - DNA, 14 bp, Homo sapiens
aattttaccaagtt

SEQ ID NO: 3775562 - DNA, 17 bp, Homo sapiens
aattttaccaagttata

SEQ ID NO: 3775563 - DNA, 22 bp, Homo sapiens
aattttatgaactgcatgtata

SEQ ID NO: 3775564 - DNA, 12 bp, Homo sapiens
aattttattcct

SEQ ID NO: 3775565 - DNA, 19 bp, Homo sapiens
aattttcaagcatctcctg

SEQ ID NO: 3775566 - DNA, 14 bp, Homo sapiens
aattttcttcatgc

SEQ ID NO: 3775567 - DNA, 13 bp, Homo sapiens
aattttcttgatg

SEQ ID NO: 3775568 - DNA, 21 bp, Homo sapiens
aattttctttttaataaaaag

SEQ ID NO: 3775569 - DNA, 17 bp, Homo sapiens
aattttgtaaaggtgaa

SEQ ID NO: 3775570 - DNA, 15 bp, Homo sapiens
aattttgtaacgaag

SEQ ID NO: 3775571 - DNA, 16 bp, Homo sapiens
aattttgtaattttct

SEQ ID NO: 3775572 - DNA, 14 bp, Homo sapiens
aattttgtacaaat

SEQ ID NO: 3775573 - DNA, 16 bp, Homo sapiens
aatttttattatgcat

SEQ ID NO: 3775574 - DNA, 19 bp, Homo sapiens
aatttttcagatgcttctg

SEQ ID NO: 3775575 - DNA, 23 bp, Homo sapiens
aatttttcattgatatgaaaaat

SEQ ID NO: 3775576 - DNA, 13 bp, Homo sapiens
aatttttgaaaag

SEQ ID NO: 3775577 - DNA, 18 bp, Homo sapiens
aatttttggattgacagt

SEQ ID NO: 3775578 - DNA, 19 bp, Homo sapiens
aatttttggattgacagta

SEQ ID NO: 3775579 - DNA, 17 bp, Homo sapiens
aattttttattcttgtg

SEQ ID NO: 3775580 - DNA, 18 bp, Homo sapiens
aatttttttatgttttgt

SEQ ID NO: 3775581 - DNA, 23 bp, Homo sapiens
aatttttttatgttttgtttctg

SEQ ID NO: 3775582 - DNA, 15 bp, Homo sapiens
aatttttttcaatat

SEQ ID NO: 3775583 - DNA, 19 bp, Homo sapiens
aatttttttttcctagccc

SEQ ID NO: 3775584 - DNA, 21 bp, Homo sapiens
acaaaaacagcctcacagaag

SEQ ID NO: 3775585 - DNA, 16 bp, Homo sapiens
acaaaaagcataaaaa

SEQ ID NO: 3775586 - DNA, 14 bp, Homo sapiens
acaaaaagcttccc

SEQ ID NO: 3775587 - DNA, 22 bp, Homo sapiens
acaaaaaggtaaaactttttat

SEQ ID NO: 3775588 - DNA, 21 bp, Homo sapiens
acaaaaatactctaattctaa

SEQ ID NO: 3775589 - DNA, 22 bp, Homo sapiens
acaaaaatgaaagcatgtctca

SEQ ID NO: 3775590 - DNA, 17 bp, Homo sapiens
acaaaaattcacaagct

SEQ ID NO: 3775591 - DNA, 11 bp, Homo sapiens
acaaaagatgt

SEQ ID NO: 3775592 - DNA, 16 bp, Homo sapiens
acaaaagtgctttgga

SEQ ID NO: 3775593 - DNA, 12 bp, Homo sapiens
acaaaataaaca

SEQ ID NO: 3775594 - DNA, 23 bp, Homo sapiens
acaaaatataaagcatctaaact

SEQ ID NO: 3775595 - DNA, 20 bp, Homo sapiens
acaaaatgtagggttataat

SEQ ID NO: 3775596 - DNA, 13 bp, Homo sapiens
acaaacaaacaag

SEQ ID NO: 3775597 - DNA, 18 bp, Homo sapiens
acaaacaagctaggtgct

SEQ ID NO: 3775598 - DNA, 22 bp, Homo sapiens
acaaacatatttgttaaatatt

SEQ ID NO: 3775599 - DNA, 14 bp, Homo sapiens
acaaaccagaagca

SEQ ID NO: 3775600 - DNA, 14 bp, Homo sapiens
acaaactgcaatag

SEQ ID NO: 3775601 - DNA, 19 bp, Homo sapiens
acaaactgcaatagagact

SEQ ID NO: 3775602 - DNA, 20 bp, Homo sapiens
acaaactgcaatagagactg

SEQ ID NO: 3775603 - DNA, 18 bp, Homo sapiens
acaaagacaaattctgtt

SEQ ID NO: 3775604 - DNA, 24 bp, Homo sapiens
acaaagatgtttgtcagatatgat

SEQ ID NO: 3775605 - DNA, 18 bp, Homo sapiens
acaaagcccttccatgtc

SEQ ID NO: 3775606 - DNA, 13 bp, Homo sapiens
acaaagctgctaa

SEQ ID NO: 3775607 - DNA, 24 bp, Homo sapiens
acaaaggttgagatgtaaaaggta

SEQ ID NO: 3775608 - DNA, 21 bp, Homo sapiens
acaaaggttttcctcttctat

SEQ ID NO: 3775609 - DNA, 15 bp, Homo sapiens
acaaatacttattca

SEQ ID NO: 3775610 - DNA, 17 bp, Homo sapiens
acaaatacttattcatt

SEQ ID NO: 3775611 - DNA, 21 bp, Homo sapiens
acaaatagtcggattagaaat

SEQ ID NO: 3775612 - DNA, 11 bp, Homo sapiens
acaaatatgca

SEQ ID NO: 3775613 - DNA, 18 bp, Homo sapiens
acaaatatttattttctt

SEQ ID NO: 3775614 - DNA, 17 bp, Homo sapiens
acaaatcaagtttccaa

SEQ ID NO: 3775615 - DNA, 20 bp, Homo sapiens
acaaatcaagtttccaagca

SEQ ID NO: 3775616 - DNA, 13 bp, Homo sapiens
acaaatgtatgat

SEQ ID NO: 3775617 - DNA, 12 bp, Homo sapiens
acaaattctgtt

SEQ ID NO: 3775618 - DNA, 16 bp, Homo sapiens
acaaattctgtttctt

SEQ ID NO: 3775619 - DNA, 18 bp, Homo sapiens
acaaattgcttgaaagaa

SEQ ID NO: 3775620 - DNA, 17 bp, Homo sapiens
acagctctgtgttgcca

SEQ ID NO: 3775621 - DNA, 16 bp, Homo sapiens
acagctgaggtctctt

SEQ ID NO: 3775622 - DNA, 22 bp, Homo sapiens
acagctgaggtctcttgaggga

SEQ ID NO: 3775623 - DNA, 21 bp, Homo sapiens
acagctgcagagacagagagg

SEQ ID NO: 3775624 - DNA, 14 bp, Homo sapiens
acagctgtccctgt

SEQ ID NO: 3775625 - DNA, 17 bp, Homo sapiens
acagcttcaccctgtca

SEQ ID NO: 3775626 - DNA, 15 bp, Homo sapiens
acagcttcagccagg

SEQ ID NO: 3775627 - DNA, 18 bp, Homo sapiens
acagcttcagccaggagc

SEQ ID NO: 3775628 - DNA, 19 bp, Homo sapiens
acagcttcatttcctgtgt

SEQ ID NO: 3775629 - DNA, 22 bp, Homo sapiens
acagcttttagtacccacctga

SEQ ID NO: 3775630 - DNA, 16 bp, Homo sapiens
acaggaaaagctgctg

SEQ ID NO: 3775631 - DNA, 18 bp, Homo sapiens
acaggaaaagctgctgac

SEQ ID NO: 3775632 - DNA, 20 bp, Homo sapiens
acaggaaaagctgctgacag

SEQ ID NO: 3775633 - DNA, 18 bp, Homo sapiens
acaggaaaatcctctggc

SEQ ID NO: 3775634 - DNA, 16 bp, Homo sapiens
acaggaaagggaaggc

SEQ ID NO: 3775635 - DNA, 19 bp, Homo sapiens
acaggaaagggaaggcccc

SEQ ID NO: 3775636 - DNA, 15 bp, Homo sapiens
acaggaagcacccca

SEQ ID NO: 3775637 - DNA, 15 bp, Homo sapiens
acaggactctgcctc

SEQ ID NO: 3775638 - DNA, 11 bp, Homo sapiens
acaggagaaat

SEQ ID NO: 3775639 - DNA, 19 bp, Homo sapiens
acaggagagaaaggggatg

SEQ ID NO: 3775640 - DNA, 17 bp, Homo sapiens
acaggatgaaagttccc

SEQ ID NO: 3775641 - DNA, 18 bp, Homo sapiens
acaggcaactgaggcaga

SEQ ID NO: 3775642 - DNA, 22 bp, Homo sapiens
acaggcaactgaggcagacagc

SEQ ID NO: 3775643 - DNA, 15 bp, Homo sapiens
acaggcaagcacctc

SEQ ID NO: 3775644 - DNA, 18 bp, Homo sapiens
acaggcaagcacctcctg

SEQ ID NO: 3775645 - DNA, 16 bp, Homo sapiens
acaggcaatgctggct

SEQ ID NO: 3775646 - DNA, 23 bp, Homo sapiens
acaggcacccaccatcatgtctg

SEQ ID NO: 3775647 - DNA, 14 bp, Homo sapiens
acaggcaccgagaa

SEQ ID NO: 3775648 - DNA, 20 bp, Homo sapiens
acaggcaccgagaatgttgt

SEQ ID NO: 3775649 - DNA, 21 bp, Homo sapiens
acaggcaccgagaatgttgta

SEQ ID NO: 3775650 - DNA, 14 bp, Homo sapiens
acaggcagaaagag

SEQ ID NO: 3775651 - DNA, 15 bp, Homo sapiens
acaggcagatacagg

SEQ ID NO: 3775652 - DNA, 13 bp, Homo sapiens
acaggcaggtcca

SEQ ID NO: 3775653 - DNA, 14 bp, Homo sapiens
acaggcatgttctc

SEQ ID NO: 3775654 - DNA, 18 bp, Homo sapiens
acaggcatgttctctgag

SEQ ID NO: 3775655 - DNA, 18 bp, Homo sapiens
acaggcccaagagatgaa

SEQ ID NO: 3775656 - DNA, 16 bp, Homo sapiens
acaggcccggctccag

SEQ ID NO: 3775657 - DNA, 19 bp, Homo sapiens
acaggcctcacacacaatg

SEQ ID NO: 3775658 - DNA, 14 bp, Homo sapiens
acaggctgggcttc

SEQ ID NO: 3775659 - DNA, 22 bp, Homo sapiens
acaggggaatattttattcaag

SEQ ID NO: 3775660 - DNA, 17 bp, Homo sapiens
acagggtagcaggtacc

SEQ ID NO: 3775661 - DNA, 14 bp, Homo sapiens
acaggtctcctctt

SEQ ID NO: 3775662 - DNA, 18 bp, Homo sapiens
acaggtggacacacaagg

SEQ ID NO: 3775663 - DNA, 17 bp, Homo sapiens
acaggtgtccccagccc

SEQ ID NO: 3775664 - DNA, 23 bp, Homo sapiens
acaggtgtgaaccaccacaccca

SEQ ID NO: 3775665 - DNA, 23 bp, Homo sapiens
acaggtgtgagtcaccaagccca

SEQ ID NO: 3775666 - DNA, 14 bp, Homo sapiens
acaggtgtttatac

SEQ ID NO: 3775667 - DNA, 14 bp, Homo sapiens
acagtaacttggtt

SEQ ID NO: 3775668 - DNA, 17 bp, Homo sapiens
acagtaacttggttata

SEQ ID NO: 3775669 - DNA, 20 bp, Homo sapiens
acagtaacttggttatacat

SEQ ID NO: 3775670 - DNA, 13 bp, Homo sapiens
acagtacaggcag

SEQ ID NO: 3775671 - DNA, 17 bp, Homo sapiens
acagtagtgagaagaat

SEQ ID NO: 3775672 - DNA, 20 bp, Homo sapiens
acagtagtgagaagaatatt

SEQ ID NO: 3775673 - DNA, 22 bp, Homo sapiens
acagtatggtaactttgcaaat

SEQ ID NO: 3775674 - DNA, 18 bp, Homo sapiens
acagtcaaaacagagatg

SEQ ID NO: 3775675 - DNA, 18 bp, Homo sapiens
acagtcaaggagtggctt

SEQ ID NO: 3775676 - DNA, 22 bp, Homo sapiens
acagtcaaggagtggcttacta

SEQ ID NO: 3775677 - DNA, 14 bp, Homo sapiens
acagtctctttaat

SEQ ID NO: 3775678 - DNA, 12 bp, Homo sapiens
acagtgagcctg

SEQ ID NO: 3775679 - DNA, 17 bp, Homo sapiens
acagtgagcctgaattt

SEQ ID NO: 3775680 - DNA, 21 bp, Homo sapiens
acagtgagcctgaattttgtt

SEQ ID NO: 3775681 - DNA, 15 bp, Homo sapiens
acagtgaggtcctgg

SEQ ID NO: 3775682 - DNA, 18 bp, Homo sapiens
acagtgaggtcctggggg

SEQ ID NO: 3775683 - DNA, 18 bp, Homo sapiens
acagtgatctccatatgt

SEQ ID NO: 3775684 - DNA, 21 bp, Homo sapiens
acagtgatctccatatgttac

SEQ ID NO: 3775685 - DNA, 22 bp, Homo sapiens
acagtgatctccatatgttaca

SEQ ID NO: 3775686 - DNA, 21 bp, Homo sapiens
acagtgcaagtgagtataact

SEQ ID NO: 3775687 - DNA, 13 bp, Homo sapiens
acagtgcagacag

SEQ ID NO: 3775688 - DNA, 15 bp, Homo sapiens
acagtgccattgtct

SEQ ID NO: 3775689 - DNA, 14 bp, Homo sapiens
acagtgcctgctga

SEQ ID NO: 3775690 - DNA, 21 bp, Homo sapiens
acagtgcctgggaatgtatta

SEQ ID NO: 3775691 - DNA, 21 bp, Homo sapiens
acagtgcttcagcctgaggct

SEQ ID NO: 3775692 - DNA, 14 bp, Homo sapiens
acagtgggagccag

SEQ ID NO: 3775693 - DNA, 15 bp, Homo sapiens
acagtgggagccagg

SEQ ID NO: 3775694 - DNA, 16 bp, Homo sapiens
acagtgggagccaggg

SEQ ID NO: 3775695 - DNA, 19 bp, Homo sapiens
acagtggttctacaatcta

SEQ ID NO: 3775696 - DNA, 15 bp, Homo sapiens
acagtgtggtagtta

SEQ ID NO: 3775697 - DNA, 20 bp, Homo sapiens
acagttcaagaaagcttcaa

SEQ ID NO: 3775698 - DNA, 15 bp, Homo sapiens
acagttcctcgccct

SEQ ID NO: 3775699 - DNA, 15 bp, Homo sapiens
acagttgctgtcata

SEQ ID NO: 3775700 - DNA, 21 bp, Homo sapiens
acagttgctgtcataagaatg

SEQ ID NO: 3775701 - DNA, 20 bp, Homo sapiens
acagttgggaaaatatgtcc

SEQ ID NO: 3775702 - DNA, 20 bp, Homo sapiens
acagttttcctaaatgtata

SEQ ID NO: 3775703 - DNA, 22 bp, Homo sapiens
acagttttccttctcatctgtg

SEQ ID NO: 3775704 - DNA, 12 bp, Homo sapiens
acataaaaagtt

SEQ ID NO: 3775705 - DNA, 18 bp, Homo sapiens
acataacagaatgcacca

SEQ ID NO: 3775706 - DNA, 16 bp, Homo sapiens
acatacaattattttt

SEQ ID NO: 3775707 - DNA, 13 bp, Homo sapiens
cgctgatatatgt

SEQ ID NO: 3775708 - DNA, 19 bp, Homo sapiens
cgctgcaacctgttgatag

SEQ ID NO: 3775709 - DNA, 17 bp, Homo sapiens
cgctgccagcacagagc

SEQ ID NO: 3775710 - DNA, 13 bp, Homo sapiens
cgctgccgcaccc

SEQ ID NO: 3775711 - DNA, 20 bp, Homo sapiens
cgctgccgcaccccagagtg

SEQ ID NO: 3775712 - DNA, 20 bp, Homo sapiens
cgctgcctaagtggctgctg

SEQ ID NO: 3775713 - DNA, 19 bp, Homo sapiens
cgctggaccttgaactggg

SEQ ID NO: 3775714 - DNA, 16 bp, Homo sapiens
cgctggcccccactgg

SEQ ID NO: 3775715 - DNA, 20 bp, Homo sapiens
cgctggctgggggcctcact

SEQ ID NO: 3775716 - DNA, 23 bp, Homo sapiens
cgctggtagagatggaggaggag

SEQ ID NO: 3775717 - DNA, 23 bp, Homo sapiens
cgctgtccctagtaaaaatacaa

SEQ ID NO: 3775718 - DNA, 15 bp, Homo sapiens
cgctgtctccagacc

SEQ ID NO: 3775719 - DNA, 14 bp, Homo sapiens
cgctgttcacccac

SEQ ID NO: 3775720 - DNA, 12 bp, Homo sapiens
cgcttctctgtg

SEQ ID NO: 3775721 - DNA, 12 bp, Homo sapiens
cggaaagcagct

SEQ ID NO: 3775722 - DNA, 16 bp, Homo sapiens
cggaacgttggacttt

SEQ ID NO: 3775723 - DNA, 14 bp, Homo sapiens
cggaagcagtgcct

SEQ ID NO: 3775724 - DNA, 18 bp, Homo sapiens
cggaaggctggctgggca

SEQ ID NO: 3775725 - DNA, 20 bp, Homo sapiens
cggaatgaaccacatcttgc

SEQ ID NO: 3775726 - DNA, 22 bp, Homo sapiens
cggacagccacggccaggccag

SEQ ID NO: 3775727 - DNA, 15 bp, Homo sapiens
cggagacagtgatct

SEQ ID NO: 3775728 - DNA, 17 bp, Homo sapiens
cggagacggagtcccac

SEQ ID NO: 3775729 - DNA, 16 bp, Homo sapiens
cggagagaaaaaagaa

SEQ ID NO: 3775730 - DNA, 21 bp, Homo sapiens
cggagcctcatccgaggcagg

SEQ ID NO: 3775731 - DNA, 20 bp, Homo sapiens
cggagctaacactggcccct

SEQ ID NO: 3775732 - DNA, 20 bp, Homo sapiens
cggaggctgaggcaggagaa

SEQ ID NO: 3775733 - DNA, 15 bp, Homo sapiens
cggaggggcctggca

SEQ ID NO: 3775734 - DNA, 16 bp, Homo sapiens
cggaggggcctggcag

SEQ ID NO: 3775735 - DNA, 23 bp, Homo sapiens
cggagttcggaaaccgtcctgtg

SEQ ID NO: 3775736 - DNA, 14 bp, Homo sapiens
cggatcctgggtgg

SEQ ID NO: 3775737 - DNA, 15 bp, Homo sapiens
cggcactgtggcctt

SEQ ID NO: 3775738 - DNA, 11 bp, Homo sapiens
cggcagagagg

SEQ ID NO: 3775739 - DNA, 21 bp, Homo sapiens
cggcagttctgggtgctccct

SEQ ID NO: 3775740 - DNA, 17 bp, Homo sapiens
cggcccccatgcaaggt

SEQ ID NO: 3775741 - DNA, 19 bp, Homo sapiens
cggcccctgctggttcagg

SEQ ID NO: 3775742 - DNA, 11 bp, Homo sapiens
cggccctgggg

SEQ ID NO: 3775743 - DNA, 22 bp, Homo sapiens
cggcctccgtccaggagcctgg

SEQ ID NO: 3775744 - DNA, 16 bp, Homo sapiens
cggcctgatgctccct

SEQ ID NO: 3775745 - DNA, 20 bp, Homo sapiens
cggcgcggtggctcacgcct

SEQ ID NO: 3775746 - DNA, 14 bp, Homo sapiens
cggctactcagcag

SEQ ID NO: 3775747 - DNA, 18 bp, Homo sapiens
cggctactcagcagccct

SEQ ID NO: 3775748 - DNA, 18 bp, Homo sapiens
cggctcactgcagcctca

SEQ ID NO: 3775749 - DNA, 19 bp, Homo sapiens
cggctcactgcagcctcaa

SEQ ID NO: 3775750 - DNA, 13 bp, Homo sapiens
cggctccaggctc

SEQ ID NO: 3775751 - DNA, 15 bp, Homo sapiens
cggctccaggctcct

SEQ ID NO: 3775752 - DNA, 23 bp, Homo sapiens
cggctcctctctaacctccttta

SEQ ID NO: 3775753 - DNA, 21 bp, Homo sapiens
cggctcctggactcattgctt

SEQ ID NO: 3775754 - DNA, 20 bp, Homo sapiens
cggctcgagcagtcctgcct

SEQ ID NO: 3775755 - DNA, 20 bp, Homo sapiens
cggctgagtcatgatctccc

SEQ ID NO: 3775756 - DNA, 23 bp, Homo sapiens
cggctgagtcatgatctccctgc

SEQ ID NO: 3775757 - DNA, 14 bp, Homo sapiens
cggctggcagccca

SEQ ID NO: 3775758 - DNA, 23 bp, Homo sapiens
cggctggcagcccacccctcaac

SEQ ID NO: 3775759 - DNA, 22 bp, Homo sapiens
cgggaacagtgtttcccataat

SEQ ID NO: 3775760 - DNA, 21 bp, Homo sapiens
cgggacgagaccctacaggag

SEQ ID NO: 3775761 - DNA, 20 bp, Homo sapiens
cgggagcagtgtcttccata

SEQ ID NO: 3775762 - DNA, 23 bp, Homo sapiens
cgggagcagtgtcttccataatg

SEQ ID NO: 3775763 - DNA, 14 bp, Homo sapiens
cgggagcatctctt

SEQ ID NO: 3775764 - DNA, 18 bp, Homo sapiens
cgggaggaatttctgagt

SEQ ID NO: 3775765 - DNA, 20 bp, Homo sapiens
cgggaggatgttctgggaca

SEQ ID NO: 3775766 - DNA, 21 bp, Homo sapiens
cgggaggatgttctgggacac

SEQ ID NO: 3775767 - DNA, 23 bp, Homo sapiens
cgggaggatgttctgggacacag

SEQ ID NO: 3775768 - DNA, 22 bp, Homo sapiens
cgggaggcagaggttgcagtgt

SEQ ID NO: 3775769 - DNA, 22 bp, Homo sapiens
cgggaggcggagcttgcagtga

SEQ ID NO: 3775770 - DNA, 20 bp, Homo sapiens
cgggaggtcgaggcaggagg

SEQ ID NO: 3775771 - DNA, 14 bp, Homo sapiens
cgggcacagctgtg

SEQ ID NO: 3775772 - DNA, 14 bp, Homo sapiens
cgggcactcagaag

SEQ ID NO: 3775773 - DNA, 22 bp, Homo sapiens
cgggcactcagaagacactgat

SEQ ID NO: 3775774 - DNA, 14 bp, Homo sapiens
cgggccaaggactg

SEQ ID NO: 3775775 - DNA, 20 bp, Homo sapiens
cgggccaaggactgccgacc

SEQ ID NO: 3775776 - DNA, 19 bp, Homo sapiens
cgggcgagtcactgcctct

SEQ ID NO: 3775777 - DNA, 14 bp, Homo sapiens
cgggctcagctctg

SEQ ID NO: 3775778 - DNA, 15 bp, Homo sapiens
cgggctcagctctgg

SEQ ID NO: 3775779 - DNA, 14 bp, Homo sapiens
cgggctgggcagct

SEQ ID NO: 3775780 - DNA, 17 bp, Homo sapiens
cgggctgggcagctgtt

SEQ ID NO: 3775781 - DNA, 15 bp, Homo sapiens
cgggcttttccccgg

SEQ ID NO: 3775782 - DNA, 22 bp, Homo sapiens
cggggacagctccttctgtcct

SEQ ID NO: 3775783 - DNA, 23 bp, Homo sapiens
cggggacagctccttctgtccta

SEQ ID NO: 3775784 - DNA, 13 bp, Homo sapiens
cggggaggccaag

SEQ ID NO: 3775785 - DNA, 21 bp, Homo sapiens
cggggaggccaagtgcaggct

SEQ ID NO: 3775786 - DNA, 23 bp, Homo sapiens
cggggaggccaagtgcaggctgg

SEQ ID NO: 3775787 - DNA, 14 bp, Homo sapiens
cggggccagaggca

SEQ ID NO: 3775788 - DNA, 15 bp, Homo sapiens
cggggccccagggct

SEQ ID NO: 3775789 - DNA, 16 bp, Homo sapiens
cggggcctgcctagca

SEQ ID NO: 3775790 - DNA, 13 bp, Homo sapiens
cgggggctggggc

SEQ ID NO: 3775791 - DNA, 18 bp, Homo sapiens
cgggtgctcagggctgac

SEQ ID NO: 3775792 - DNA, 18 bp, Homo sapiens
cgggtggatcacctgagg

SEQ ID NO: 3775793 - DNA, 16 bp, Homo sapiens
cgggttgtgtgtctgt

SEQ ID NO: 3775794 - DNA, 15 bp, Homo sapiens
cggtccacccaggag

SEQ ID NO: 3775795 - DNA, 20 bp, Homo sapiens
cggtccacccaggagccccg

SEQ ID NO: 3775796 - DNA, 19 bp, Homo sapiens
cggtgcctgggtggggctg

SEQ ID NO: 3775797 - DNA, 20 bp, Homo sapiens
cggtgcctgggtggggctgc

SEQ ID NO: 3775798 - DNA, 13 bp, Homo sapiens
cggtggctaaagg

SEQ ID NO: 3775799 - DNA, 19 bp, Homo sapiens
cggtgggcatttgtgaggc

SEQ ID NO: 3775800 - DNA, 16 bp, Homo sapiens
cggttcaccagcctct

SEQ ID NO: 3775801 - DNA, 20 bp, Homo sapiens
cgtaaatacacaacacacac

SEQ ID NO: 3775802 - DNA, 20 bp, Homo sapiens
cgtagccaaggtgggctgag

SEQ ID NO: 3775803 - DNA, 19 bp, Homo sapiens
cgtagctatccggacagag

SEQ ID NO: 3775804 - DNA, 21 bp, Homo sapiens
cgtagtgtagatttgttttgt

SEQ ID NO: 3775805 - DNA, 22 bp, Homo sapiens
cgtagttccctgaaaacccaga

SEQ ID NO: 3775806 - DNA, 16 bp, Homo sapiens
cgtcaccatctcaggc

SEQ ID NO: 3775807 - DNA, 17 bp, Homo sapiens
cgtcagaagcacccagg

SEQ ID NO: 3775808 - DNA, 21 bp, Homo sapiens
cgtccagccgccattgccacc

SEQ ID NO: 3775809 - DNA, 13 bp, Homo sapiens
cgtcctccccctg

SEQ ID NO: 3775810 - DNA, 16 bp, Homo sapiens
cgtcctccccctgcca

SEQ ID NO: 3775811 - DNA, 23 bp, Homo sapiens
cgtcctgacggcgcccccagtgt

SEQ ID NO: 3775812 - DNA, 19 bp, Homo sapiens
cgtcgggggctgaggggca

SEQ ID NO: 3775813 - DNA, 19 bp, Homo sapiens
cgtctaagtcatgagctga

SEQ ID NO: 3775814 - DNA, 16 bp, Homo sapiens
cgtctcatactcacct

SEQ ID NO: 3775815 - DNA, 22 bp, Homo sapiens
cgtctctccctccctttgaaat

SEQ ID NO: 3775816 - DNA, 14 bp, Homo sapiens
cgtctgacaggcaa

SEQ ID NO: 3775817 - DNA, 20 bp, Homo sapiens
cgtctgacaggcaatgctgg

SEQ ID NO: 3775818 - DNA, 16 bp, Homo sapiens
cgtctgaccctctcca

SEQ ID NO: 3775819 - DNA, 14 bp, Homo sapiens
ctcagcctcccaaa

SEQ ID NO: 3775820 - DNA, 21 bp, Homo sapiens
ctcagcctcccaaagtgctgg

SEQ ID NO: 3775821 - DNA, 19 bp, Homo sapiens
ctcagcctcccgaatagct

SEQ ID NO: 3775822 - DNA, 19 bp, Homo sapiens
ctcagcctggtgggcctcc

SEQ ID NO: 3775823 - DNA, 13 bp, Homo sapiens
ctcagcctgtgct

SEQ ID NO: 3775824 - DNA, 22 bp, Homo sapiens
ctcagccttccccttgcccagg

SEQ ID NO: 3775825 - DNA, 11 bp, Homo sapiens
ctcagccttgg

SEQ ID NO: 3775826 - DNA, 13 bp, Homo sapiens
ctcagcggggaca

SEQ ID NO: 3775827 - DNA, 15 bp, Homo sapiens
ctcagcggggacagc

SEQ ID NO: 3775828 - DNA, 18 bp, Homo sapiens
ctcagcggggacagctcc

SEQ ID NO: 3775829 - DNA, 12 bp, Homo sapiens
ctcagctctggc

SEQ ID NO: 3775830 - DNA, 12 bp, Homo sapiens
ctcagctgcctc

SEQ ID NO: 3775831 - DNA, 14 bp, Homo sapiens
ctcagctgcctcac

SEQ ID NO: 3775832 - DNA, 21 bp, Homo sapiens
ctcagctttttgtcttttctg

SEQ ID NO: 3775833 - DNA, 14 bp, Homo sapiens
ctcaggaccctcgc

SEQ ID NO: 3775834 - DNA, 22 bp, Homo sapiens
ctcaggaccctcgctggccccc

SEQ ID NO: 3775835 - DNA, 12 bp, Homo sapiens
ctcaggacctag

SEQ ID NO: 3775836 - DNA, 15 bp, Homo sapiens
ctcaggactccagcc

SEQ ID NO: 3775837 - DNA, 14 bp, Homo sapiens
ctcaggaggctgag

SEQ ID NO: 3775838 - DNA, 15 bp, Homo sapiens
ctcaggaggctgagg

SEQ ID NO: 3775839 - DNA, 19 bp, Homo sapiens
ctcaggaggctgaggcaga

SEQ ID NO: 3775840 - DNA, 20 bp, Homo sapiens
ctcaggaggctgaggcagaa

SEQ ID NO: 3775841 - DNA, 20 bp, Homo sapiens
ctcaggaggctgaggcagga

SEQ ID NO: 3775842 - DNA, 16 bp, Homo sapiens
ctcaggaggctgaggg

SEQ ID NO: 3775843 - DNA, 16 bp, Homo sapiens
ctcaggcataggcctg

SEQ ID NO: 3775844 - DNA, 17 bp, Homo sapiens
ctcaggcataggcctgg

SEQ ID NO: 3775845 - DNA, 20 bp, Homo sapiens
ctcaggcataggcctgggtg

SEQ ID NO: 3775846 - DNA, 16 bp, Homo sapiens
ctcaggcatgcctgtg

SEQ ID NO: 3775847 - DNA, 18 bp, Homo sapiens
ctcaggccaggtgcagtg

SEQ ID NO: 3775848 - DNA, 13 bp, Homo sapiens
ctcaggctctgcc

SEQ ID NO: 3775849 - DNA, 13 bp, Homo sapiens
ctcaggctgctgg

SEQ ID NO: 3775850 - DNA, 15 bp, Homo sapiens
ctcaggctgctggag

SEQ ID NO: 3775851 - DNA, 17 bp, Homo sapiens
ctcaggctgctggagga

SEQ ID NO: 3775852 - DNA, 20 bp, Homo sapiens
ctcaggctgtttttgggtgc

SEQ ID NO: 3775853 - DNA, 18 bp, Homo sapiens
ctcagggaagcccagctc

SEQ ID NO: 3775854 - DNA, 23 bp, Homo sapiens
ctcagggaagcccagctccaggg

SEQ ID NO: 3775855 - DNA, 14 bp, Homo sapiens
ctcagggacagaga

SEQ ID NO: 3775856 - DNA, 16 bp, Homo sapiens
ctcagggcagcctgcc

SEQ ID NO: 3775857 - DNA, 12 bp, Homo sapiens
ctcagggcccca

SEQ ID NO: 3775858 - DNA, 14 bp, Homo sapiens
ctcagggccccagc

SEQ ID NO: 3775859 - DNA, 19 bp, Homo sapiens
ctcaggtcagggtgaggat

SEQ ID NO: 3775860 - DNA, 20 bp, Homo sapiens
ctcaggtcagggtgaggatg

SEQ ID NO: 3775861 - DNA, 20 bp, Homo sapiens
ctcaggtgagaagcagagga

SEQ ID NO: 3775862 - DNA, 20 bp, Homo sapiens
ctcaggtgatccacccacct

SEQ ID NO: 3775863 - DNA, 20 bp, Homo sapiens
ctcaggtttgcctgagggcg

SEQ ID NO: 3775864 - DNA, 18 bp, Homo sapiens
ctcagtagtcagactgga

SEQ ID NO: 3775865 - DNA, 16 bp, Homo sapiens
ctcagtccacctgagc

SEQ ID NO: 3775866 - DNA, 18 bp, Homo sapiens
ctcagtccacctgagctg

SEQ ID NO: 3775867 - DNA, 17 bp, Homo sapiens
ctcagtccatagcagag

SEQ ID NO: 3775868 - DNA, 15 bp, Homo sapiens
ctcagtctcaggagc

SEQ ID NO: 3775869 - DNA, 13 bp, Homo sapiens
ctcagtcttccct

SEQ ID NO: 3775870 - DNA, 20 bp, Homo sapiens
ctcagtggactttccacccc

SEQ ID NO: 3775871 - DNA, 17 bp, Homo sapiens
ctcagtgtcatttatga

SEQ ID NO: 3775872 - DNA, 22 bp, Homo sapiens
ctcagtgtcatttatgaaaaga

SEQ ID NO: 3775873 - DNA, 16 bp, Homo sapiens
ctcagttcccttggcc

SEQ ID NO: 3775874 - DNA, 17 bp, Homo sapiens
ctcagttcccttggcct

SEQ ID NO: 3775875 - DNA, 13 bp, Homo sapiens
ctcagtttgtcag

SEQ ID NO: 3775876 - DNA, 20 bp, Homo sapiens
ctcataagctactgatgaga

SEQ ID NO: 3775877 - DNA, 14 bp, Homo sapiens
ctcatagcattaac

SEQ ID NO: 3775878 - DNA, 14 bp, Homo sapiens
ctcatagggaagac

SEQ ID NO: 3775879 - DNA, 18 bp, Homo sapiens
ctcatagtatggtggctg

SEQ ID NO: 3775880 - DNA, 21 bp, Homo sapiens
ctcatagtatggtggctgggt

SEQ ID NO: 3775881 - DNA, 22 bp, Homo sapiens
ctcatattcctgcagcctggag

SEQ ID NO: 3775882 - DNA, 24 bp, Homo sapiens
ctcatattcctgcagcctggaggc

SEQ ID NO: 3775883 - DNA, 16 bp, Homo sapiens
ctcatcataaaataaa

SEQ ID NO: 3775884 - DNA, 23 bp, Homo sapiens
ctcatctgtctggaggggagctc

SEQ ID NO: 3775885 - DNA, 12 bp, Homo sapiens
ctcatctgtgat

SEQ ID NO: 3775886 - DNA, 18 bp, Homo sapiens
ctcatcttagtgcctgag

SEQ ID NO: 3775887 - DNA, 20 bp, Homo sapiens
ctcatgatcttgtgacatat

SEQ ID NO: 3775888 - DNA, 21 bp, Homo sapiens
ctcattatcgccttttgacag

SEQ ID NO: 3775889 - DNA, 19 bp, Homo sapiens
ctcattcagtattaaaggg

SEQ ID NO: 3775890 - DNA, 18 bp, Homo sapiens
ctcattccaccttcccat

SEQ ID NO: 3775891 - DNA, 21 bp, Homo sapiens
ctcattccaccttcccatgcc

SEQ ID NO: 3775892 - DNA, 13 bp, Homo sapiens
ctcattccccagg

SEQ ID NO: 3775893 - DNA, 18 bp, Homo sapiens
ctcattcctgcctgtctc

SEQ ID NO: 3775894 - DNA, 20 bp, Homo sapiens
ctcattcctgcctgtctcct

SEQ ID NO: 3775895 - DNA, 13 bp, Homo sapiens
ctcattcttctgt

SEQ ID NO: 3775896 - DNA, 23 bp, Homo sapiens
ctcattcttctgtacgtctgaca

SEQ ID NO: 3775897 - DNA, 15 bp, Homo sapiens
ctcattgtaaacaaa

SEQ ID NO: 3775898 - DNA, 14 bp, Homo sapiens
ctcatttctagcag

SEQ ID NO: 3775899 - DNA, 20 bp, Homo sapiens
ctcatttggggtagctagag

SEQ ID NO: 3775900 - DNA, 17 bp, Homo sapiens
ctcatttgtcacacact

SEQ ID NO: 3775901 - DNA, 21 bp, Homo sapiens
ctcatttgtcacacactttgg

SEQ ID NO: 3775902 - DNA, 14 bp, Homo sapiens
ctccaagctccatc

SEQ ID NO: 3775903 - DNA, 17 bp, Homo sapiens
ctccacaccctctccca

SEQ ID NO: 3775904 - DNA, 20 bp, Homo sapiens
ctccacaccctctcccagga

SEQ ID NO: 3775905 - DNA, 20 bp, Homo sapiens
ctccaccaacccatcagaag

SEQ ID NO: 3775906 - DNA, 13 bp, Homo sapiens
ctccaccacccaa

SEQ ID NO: 3775907 - DNA, 18 bp, Homo sapiens
ctccaccccactcacaga

SEQ ID NO: 3775908 - DNA, 16 bp, Homo sapiens
ctccaccccccagaac

SEQ ID NO: 3775909 - DNA, 21 bp, Homo sapiens
ctccaccccccagaacctgtc

SEQ ID NO: 3775910 - DNA, 12 bp, Homo sapiens
ctccacccttgg

SEQ ID NO: 3775911 - DNA, 14 bp, Homo sapiens
ctccacccttggcc

SEQ ID NO: 3775912 - DNA, 16 bp, Homo sapiens
ctccacccttggcctg

SEQ ID NO: 3775913 - DNA, 12 bp, Homo sapiens
ctccacctcagc

SEQ ID NO: 3775914 - DNA, 16 bp, Homo sapiens
ctccacctcagccttg

SEQ ID NO: 3775915 - DNA, 11 bp, Homo sapiens
ctccactgcct

SEQ ID NO: 3775916 - DNA, 16 bp, Homo sapiens
ctccactgcctctgga

SEQ ID NO: 3775917 - DNA, 13 bp, Homo sapiens
ctccactgccttc

SEQ ID NO: 3775918 - DNA, 16 bp, Homo sapiens
ctccactgccttcgat

SEQ ID NO: 3775919 - DNA, 16 bp, Homo sapiens
ctccactggatggagg

SEQ ID NO: 3775920 - DNA, 15 bp, Homo sapiens
ctccagaagcctctg

SEQ ID NO: 3775921 - DNA, 20 bp, Homo sapiens
ctccagaagcctctggctag

SEQ ID NO: 3775922 - DNA, 17 bp, Homo sapiens
ctccagacccaccacac

SEQ ID NO: 3775923 - DNA, 22 bp, Homo sapiens
ctccagacccccaccccttccc

SEQ ID NO: 3775924 - DNA, 16 bp, Homo sapiens
ctccagacccccagca

SEQ ID NO: 3775925 - DNA, 14 bp, Homo sapiens
ctccagacccctgg

SEQ ID NO: 3775926 - DNA, 20 bp, Homo sapiens
ctccagacccctggcttttc

SEQ ID NO: 3775927 - DNA, 19 bp, Homo sapiens
ctccagccaacccctgtgg

SEQ ID NO: 3775928 - DNA, 13 bp, Homo sapiens
ctccagcccacgt

SEQ ID NO: 3775929 - DNA, 14 bp, Homo sapiens
ctccagctcaccag

SEQ ID NO: 3775930 - DNA, 16 bp, Homo sapiens
ctccagctcaccagcc

SEQ ID NO: 3775931 - DNA, 13 bp, Homo sapiens
ctccagctcagca

SEQ ID NO: 3775932 - DNA, 13 bp, Homo sapiens
ctccagctgttca

SEQ ID NO: 3775933 - DNA, 16 bp, Homo sapiens
ctctccagtcttccac

SEQ ID NO: 3775934 - DNA, 13 bp, Homo sapiens
ctctcccaggacc

SEQ ID NO: 3775935 - DNA, 21 bp, Homo sapiens
ctctccccaatatcctcgctc

SEQ ID NO: 3775936 - DNA, 14 bp, Homo sapiens
ctctccccagcaag

SEQ ID NO: 3775937 - DNA, 17 bp, Homo sapiens
ctctccctcccctgcca

SEQ ID NO: 3775938 - DNA, 21 bp, Homo sapiens
ctctccctctggccctgcctt

SEQ ID NO: 3775939 - DNA, 16 bp, Homo sapiens
ctctccgaccagacac

SEQ ID NO: 3775940 - DNA, 15 bp, Homo sapiens
ctctcctcttgccac

SEQ ID NO: 3775941 - DNA, 16 bp, Homo sapiens
ctctcctcttgccact

SEQ ID NO: 3775942 - DNA, 13 bp, Homo sapiens
ctctcctgggccc

SEQ ID NO: 3775943 - DNA, 20 bp, Homo sapiens
ctctcctgggcccctcccta

SEQ ID NO: 3775944 - DNA, 21 bp, Homo sapiens
ctctcctgggcccctccctac

SEQ ID NO: 3775945 - DNA, 22 bp, Homo sapiens
ctctcctgggcccctccctacc

SEQ ID NO: 3775946 - DNA, 12 bp, Homo sapiens
ctctcctgtcca

SEQ ID NO: 3775947 - DNA, 19 bp, Homo sapiens
ctctcctttggccattcca

SEQ ID NO: 3775948 - DNA, 16 bp, Homo sapiens
ctctctacccagccca

SEQ ID NO: 3775949 - DNA, 19 bp, Homo sapiens
ctctctactcctacctcag

SEQ ID NO: 3775950 - DNA, 20 bp, Homo sapiens
ctctctactcctacctcagc

SEQ ID NO: 3775951 - DNA, 21 bp, Homo sapiens
ctctctcttctgctccaccct

SEQ ID NO: 3775952 - DNA, 23 bp, Homo sapiens
ctctctgatcttgtgctcagcat

SEQ ID NO: 3775953 - DNA, 17 bp, Homo sapiens
ctctctgcagccagccc

SEQ ID NO: 3775954 - DNA, 18 bp, Homo sapiens
ctctctgcctgtgagcca

SEQ ID NO: 3775955 - DNA, 16 bp, Homo sapiens
ctctctggaaaggagg

SEQ ID NO: 3775956 - DNA, 16 bp, Homo sapiens
ctctctgtaataaact

SEQ ID NO: 3775957 - DNA, 15 bp, Homo sapiens
ctctcttacccttct

SEQ ID NO: 3775958 - DNA, 22 bp, Homo sapiens
ctctcttacccttctgtgccca

SEQ ID NO: 3775959 - DNA, 21 bp, Homo sapiens
ctctcttatagaatatttatt

SEQ ID NO: 3775960 - DNA, 16 bp, Homo sapiens
ctctcttcctatccca

SEQ ID NO: 3775961 - DNA, 21 bp, Homo sapiens
ctctcttcctatcccatccca

SEQ ID NO: 3775962 - DNA, 12 bp, Homo sapiens
ctctcttctgct

SEQ ID NO: 3775963 - DNA, 14 bp, Homo sapiens
ctctcttctgctcc

SEQ ID NO: 3775964 - DNA, 15 bp, Homo sapiens
ctctgaacttcagct

SEQ ID NO: 3775965 - DNA, 16 bp, Homo sapiens
ctctgaagttggacag

SEQ ID NO: 3775966 - DNA, 17 bp, Homo sapiens
ctctgaagttggacagc

SEQ ID NO: 3775967 - DNA, 18 bp, Homo sapiens
ctctgaagttggacagca

SEQ ID NO: 3775968 - DNA, 14 bp, Homo sapiens
ctctgacacacagc

SEQ ID NO: 3775969 - DNA, 17 bp, Homo sapiens
ctctgaccgaaacagcg

SEQ ID NO: 3775970 - DNA, 22 bp, Homo sapiens
ctctgaccgaaacagcgctggg

SEQ ID NO: 3775971 - DNA, 12 bp, Homo sapiens
ctctgaggacac

SEQ ID NO: 3775972 - DNA, 16 bp, Homo sapiens
ctctgagtatctcctc

SEQ ID NO: 3775973 - DNA, 17 bp, Homo sapiens
ctctgagtatctcctcg

SEQ ID NO: 3775974 - DNA, 12 bp, Homo sapiens
ctctgagtgtga

SEQ ID NO: 3775975 - DNA, 22 bp, Homo sapiens
ctctgagtttaccatttgtaat

SEQ ID NO: 3775976 - DNA, 15 bp, Homo sapiens
ctctgatcaagtatt

SEQ ID NO: 3775977 - DNA, 13 bp, Homo sapiens
ctctgatcttgtg

SEQ ID NO: 3775978 - DNA, 10 bp, Homo sapiens
ctctgcacaa

SEQ ID NO: 3775979 - DNA, 19 bp, Homo sapiens
ctctgcacaagctgcaccc

SEQ ID NO: 3775980 - DNA, 15 bp, Homo sapiens
ctctgcagccagccc

SEQ ID NO: 3775981 - DNA, 17 bp, Homo sapiens
ctctgcagccagcccag

SEQ ID NO: 3775982 - DNA, 19 bp, Homo sapiens
ctctgcagccagcccagcc

SEQ ID NO: 3775983 - DNA, 18 bp, Homo sapiens
ctctgccacctcccctat

SEQ ID NO: 3775984 - DNA, 14 bp, Homo sapiens
ctctgccagccaca

SEQ ID NO: 3775985 - DNA, 19 bp, Homo sapiens
ctctgccccagctctggct

SEQ ID NO: 3775986 - DNA, 16 bp, Homo sapiens
ctctgccctgccctag

SEQ ID NO: 3775987 - DNA, 19 bp, Homo sapiens
ctctgccctgccctagctc

SEQ ID NO: 3775988 - DNA, 23 bp, Homo sapiens
ctctgccctgccctagctccaca

SEQ ID NO: 3775989 - DNA, 13 bp, Homo sapiens
ctctgccggctct

SEQ ID NO: 3775990 - DNA, 14 bp, Homo sapiens
ctctgcctcctctt

SEQ ID NO: 3775991 - DNA, 15 bp, Homo sapiens
ctctgcctcctcttc

SEQ ID NO: 3775992 - DNA, 18 bp, Homo sapiens
ctctgcctgaaccttcca

SEQ ID NO: 3775993 - DNA, 19 bp, Homo sapiens
ctctgctccaccacatcct

SEQ ID NO: 3775994 - DNA, 20 bp, Homo sapiens
ctctgctcctctccccagca

SEQ ID NO: 3775995 - DNA, 21 bp, Homo sapiens
ctctgctcctctccccagcaa

SEQ ID NO: 3775996 - DNA, 16 bp, Homo sapiens
ctctgctgacagacac

SEQ ID NO: 3775997 - DNA, 14 bp, Homo sapiens
ctctgctggcccag

SEQ ID NO: 3775998 - DNA, 18 bp, Homo sapiens
ctctgctggcccagccaa

SEQ ID NO: 3775999 - DNA, 22 bp, Homo sapiens
ctctgctggccgggcacagctg

SEQ ID NO: 3776000 - DNA, 13 bp, Homo sapiens
ctctgcttcagct

SEQ ID NO: 3776001 - DNA, 20 bp, Homo sapiens
ctctgcttgccgaaactgga

SEQ ID NO: 3776002 - DNA, 19 bp, Homo sapiens
ctctgctttgactgagcag

SEQ ID NO: 3776003 - DNA, 15 bp, Homo sapiens
ctctgctttggaaat

SEQ ID NO: 3776004 - DNA, 21 bp, Homo sapiens
ctctggaatgacatgtgtcaa

SEQ ID NO: 3776005 - DNA, 14 bp, Homo sapiens
ctctggacaggcat

SEQ ID NO: 3776006 - DNA, 13 bp, Homo sapiens
ctctggactggct

SEQ ID NO: 3776007 - DNA, 15 bp, Homo sapiens
ctctggactggctag

SEQ ID NO: 3776008 - DNA, 19 bp, Homo sapiens
ctctggactggctagagtc

SEQ ID NO: 3776009 - DNA, 13 bp, Homo sapiens
ctctggaggcctc

SEQ ID NO: 3776010 - DNA, 16 bp, Homo sapiens
ctctggaggcctctgg

SEQ ID NO: 3776011 - DNA, 17 bp, Homo sapiens
ctctggaggcctctggg

SEQ ID NO: 3776012 - DNA, 20 bp, Homo sapiens
ctctggaggcctctgggcct

SEQ ID NO: 3776013 - DNA, 19 bp, Homo sapiens
ctctggccaggatggaggg

SEQ ID NO: 3776014 - DNA, 14 bp, Homo sapiens
ctctggccctgcct

SEQ ID NO: 3776015 - DNA, 15 bp, Homo sapiens
ctctggccctgcctt

SEQ ID NO: 3776016 - DNA, 18 bp, Homo sapiens
ctctggccctgccttctt

SEQ ID NO: 3776017 - DNA, 16 bp, Homo sapiens
ctctggctagaggcca

SEQ ID NO: 3776018 - DNA, 20 bp, Homo sapiens
ctctggctagaggccagccc

SEQ ID NO: 3776019 - DNA, 21 bp, Homo sapiens
ctctggctagaggccagcccc

SEQ ID NO: 3776020 - DNA, 15 bp, Homo sapiens
ctctggctcacagac

SEQ ID NO: 3776021 - DNA, 10 bp, Homo sapiens
ctctgggctt

SEQ ID NO: 3776022 - DNA, 20 bp, Homo sapiens
ctctggtgacaccagccttt

SEQ ID NO: 3776023 - DNA, 13 bp, Homo sapiens
ctctgtcagatgg

SEQ ID NO: 3776024 - DNA, 16 bp, Homo sapiens
ctctgtcatatcttca

SEQ ID NO: 3776025 - DNA, 12 bp, Homo sapiens
ctctgtccaggc

SEQ ID NO: 3776026 - DNA, 14 bp, Homo sapiens
ctctgtccagggcc

SEQ ID NO: 3776027 - DNA, 20 bp, Homo sapiens
ctctgtccagggccctgagc

SEQ ID NO: 3776028 - DNA, 21 bp, Homo sapiens
ctctgtccagggccctgagct

SEQ ID NO: 3776029 - DNA, 13 bp, Homo sapiens
ctctgtcctggga

SEQ ID NO: 3776030 - DNA, 17 bp, Homo sapiens
ctctgtcgcccagtctg

SEQ ID NO: 3776031 - DNA, 15 bp, Homo sapiens
ctctgtctaccatct

SEQ ID NO: 3776032 - DNA, 19 bp, Homo sapiens
ctctgtctcaaaaataaat

SEQ ID NO: 3776033 - DNA, 22 bp, Homo sapiens
ctctgtctgagtaagaaacaga

SEQ ID NO: 3776034 - DNA, 23 bp, Homo sapiens
ctctgtcttctttgcccacaatg

SEQ ID NO: 3776035 - DNA, 15 bp, Homo sapiens
ctctgtgacctgccc

SEQ ID NO: 3776036 - DNA, 22 bp, Homo sapiens
ctctgtgcttttaaatgcataa

SEQ ID NO: 3776037 - DNA, 15 bp, Homo sapiens
ctctgtgtgcacaaa

SEQ ID NO: 3776038 - DNA, 14 bp, Homo sapiens
ctctgttcctggct

SEQ ID NO: 3776039 - DNA, 22 bp, Homo sapiens
ctctgttccttcacatcctgtg

SEQ ID NO: 3776040 - DNA, 22 bp, Homo sapiens
ctctgttgtgttcgttcttgtt

SEQ ID NO: 3776041 - DNA, 19 bp, Homo sapiens
ctcttaaaaaataaaaact

SEQ ID NO: 3776042 - DNA, 15 bp, Homo sapiens
ctcttacccttctgt

SEQ ID NO: 3776043 - DNA, 20 bp, Homo sapiens
ctcttacccttctgtgccca

SEQ ID NO: 3776044 - DNA, 22 bp, Homo sapiens
ctcttacccttctgtgcccagc

SEQ ID NO: 3776045 - DNA, 13 bp, Homo sapiens
ctcttagaaaaac

SEQ ID NO: 3776046 - DNA, 16 bp, Homo sapiens
ctgccccagctctggc

SEQ ID NO: 3776047 - DNA, 18 bp, Homo sapiens
ctgccccagctctggctt

SEQ ID NO: 3776048 - DNA, 19 bp, Homo sapiens
ctgccccagctctggcttc

SEQ ID NO: 3776049 - DNA, 19 bp, Homo sapiens
ctgccccagggctcccggc

SEQ ID NO: 3776050 - DNA, 12 bp, Homo sapiens
ctgccccatccc

SEQ ID NO: 3776051 - DNA, 19 bp, Homo sapiens
ctgcccccacacctggccc

SEQ ID NO: 3776052 - DNA, 17 bp, Homo sapiens
ctgccccctccccttca

SEQ ID NO: 3776053 - DNA, 12 bp, Homo sapiens
ctgccccctggt

SEQ ID NO: 3776054 - DNA, 22 bp, Homo sapiens
ctgccccctggtggacagtcct

SEQ ID NO: 3776055 - DNA, 18 bp, Homo sapiens
ctgcccccttctcccaca

SEQ ID NO: 3776056 - DNA, 17 bp, Homo sapiens
ctgccccgtgcagactg

SEQ ID NO: 3776057 - DNA, 19 bp, Homo sapiens
ctgccccgtgcagactgga

SEQ ID NO: 3776058 - DNA, 22 bp, Homo sapiens
ctgccccgtgcagactggaggg

SEQ ID NO: 3776059 - DNA, 16 bp, Homo sapiens
ctgcccctcccagaac

SEQ ID NO: 3776060 - DNA, 13 bp, Homo sapiens
ctgcccctccccc

SEQ ID NO: 3776061 - DNA, 13 bp, Homo sapiens
ctgcccctccctt

SEQ ID NO: 3776062 - DNA, 17 bp, Homo sapiens
ctgcccctgccccgtca

SEQ ID NO: 3776063 - DNA, 16 bp, Homo sapiens
ctgcccctggctctga

SEQ ID NO: 3776064 - DNA, 18 bp, Homo sapiens
ctgccccttctacactct

SEQ ID NO: 3776065 - DNA, 22 bp, Homo sapiens
ctgccccttctacactctcctg

SEQ ID NO: 3776066 - DNA, 24 bp, Homo sapiens
ctgccccttctacactctcctggg

SEQ ID NO: 3776067 - DNA, 21 bp, Homo sapiens
ctgcccgagctggtgcattac

SEQ ID NO: 3776068 - DNA, 13 bp, Homo sapiens
ctgcccggcaggg

SEQ ID NO: 3776069 - DNA, 20 bp, Homo sapiens
ctgcccggcagggtcctaga

SEQ ID NO: 3776070 - DNA, 16 bp, Homo sapiens
ctgcccggctgcccac

SEQ ID NO: 3776071 - DNA, 21 bp, Homo sapiens
ctgcccggggcagctgccaga

SEQ ID NO: 3776072 - DNA, 17 bp, Homo sapiens
ctgcccgtcttcagcct

SEQ ID NO: 3776073 - DNA, 15 bp, Homo sapiens
ctgccctagctccac

SEQ ID NO: 3776074 - DNA, 17 bp, Homo sapiens
ctgccctccctccttcc

SEQ ID NO: 3776075 - DNA, 18 bp, Homo sapiens
ctgccctccctccttcct

SEQ ID NO: 3776076 - DNA, 13 bp, Homo sapiens
ctgccctctgttc

SEQ ID NO: 3776077 - DNA, 13 bp, Homo sapiens
ctgccctgccact

SEQ ID NO: 3776078 - DNA, 16 bp, Homo sapiens
ctgccctgccactttg

SEQ ID NO: 3776079 - DNA, 11 bp, Homo sapiens
ctgccctgccc

SEQ ID NO: 3776080 - DNA, 22 bp, Homo sapiens
ctgccctgctgccgcctcccag

SEQ ID NO: 3776081 - DNA, 21 bp, Homo sapiens
ctgccctgggatgtccacaga

SEQ ID NO: 3776082 - DNA, 24 bp, Homo sapiens
ctgccctgggatgtccacagatgc

SEQ ID NO: 3776083 - DNA, 15 bp, Homo sapiens
ctgccctggtccagg

SEQ ID NO: 3776084 - DNA, 15 bp, Homo sapiens
ctgccctggtgctgc

SEQ ID NO: 3776085 - DNA, 16 bp, Homo sapiens
ctgccctggtgctgcc

SEQ ID NO: 3776086 - DNA, 19 bp, Homo sapiens
ctgccctggtgctgccaca

SEQ ID NO: 3776087 - DNA, 20 bp, Homo sapiens
ctgccctggtgctgccacac

SEQ ID NO: 3776088 - DNA, 13 bp, Homo sapiens
ctgccctgtaccc

SEQ ID NO: 3776089 - DNA, 21 bp, Homo sapiens
ctgcccttcagcatcctcagt

SEQ ID NO: 3776090 - DNA, 17 bp, Homo sapiens
ctgcccttgtcccactc

SEQ ID NO: 3776091 - DNA, 23 bp, Homo sapiens
ctgcccttgtcccactcaagcca

SEQ ID NO: 3776092 - DNA, 16 bp, Homo sapiens
ctgccgaccagagccc

SEQ ID NO: 3776093 - DNA, 14 bp, Homo sapiens
ctgccgcaccccag

SEQ ID NO: 3776094 - DNA, 18 bp, Homo sapiens
ctgccgcctcccagcctg

SEQ ID NO: 3776095 - DNA, 23 bp, Homo sapiens
ctgccggttcttaaatccatcct

SEQ ID NO: 3776096 - DNA, 14 bp, Homo sapiens
ctgccgtgtgccct

SEQ ID NO: 3776097 - DNA, 14 bp, Homo sapiens
ctgcctaagtggct

SEQ ID NO: 3776098 - DNA, 16 bp, Homo sapiens
ctgcctaagtggctgc

SEQ ID NO: 3776099 - DNA, 17 bp, Homo sapiens
ctgcctagcactcacat

SEQ ID NO: 3776100 - DNA, 22 bp, Homo sapiens
ctgcctagcactcacatgctgg

SEQ ID NO: 3776101 - DNA, 23 bp, Homo sapiens
ctgcctagcactcacatgctgga

SEQ ID NO: 3776102 - DNA, 15 bp, Homo sapiens
ctgcctattgcagct

SEQ ID NO: 3776103 - DNA, 21 bp, Homo sapiens
ctgcctattgcagctgggaga

SEQ ID NO: 3776104 - DNA, 22 bp, Homo sapiens
ctgcctattgcagctgggagaa

SEQ ID NO: 3776105 - DNA, 21 bp, Homo sapiens
ctgcctcaatgtgaatcagac

SEQ ID NO: 3776106 - DNA, 24 bp, Homo sapiens
ctgcctcaatgtgaatcagaccct

SEQ ID NO: 3776107 - DNA, 12 bp, Homo sapiens
ctgcctcagcct

SEQ ID NO: 3776108 - DNA, 15 bp, Homo sapiens
ctgcctccccaaccc

SEQ ID NO: 3776109 - DNA, 13 bp, Homo sapiens
ctgcctcctcttc

SEQ ID NO: 3776110 - DNA, 17 bp, Homo sapiens
ctgcctcgaactggctg

SEQ ID NO: 3776111 - DNA, 20 bp, Homo sapiens
ctgcctcgaactggctgcaa

SEQ ID NO: 3776112 - DNA, 18 bp, Homo sapiens
ctgcctctcggtggccag

SEQ ID NO: 3776113 - DNA, 23 bp, Homo sapiens
ctgcctctgacacacagctctgt

SEQ ID NO: 3776114 - DNA, 13 bp, Homo sapiens
ctgcctcttctct

SEQ ID NO: 3776115 - DNA, 15 bp, Homo sapiens
ctgcctcttctctac

SEQ ID NO: 3776116 - DNA, 17 bp, Homo sapiens
ctgcctgaaccttccat

SEQ ID NO: 3776117 - DNA, 19 bp, Homo sapiens
ctgcctgaagtcacacagt

SEQ ID NO: 3776118 - DNA, 13 bp, Homo sapiens
ctgcctgcccagg

SEQ ID NO: 3776119 - DNA, 16 bp, Homo sapiens
ctgcctgcccaggccc

SEQ ID NO: 3776120 - DNA, 20 bp, Homo sapiens
ctgcctgcccaggcccctgc

SEQ ID NO: 3776121 - DNA, 19 bp, Homo sapiens
ctgcctggaagagcagccc

SEQ ID NO: 3776122 - DNA, 12 bp, Homo sapiens
ctgcctggccag

SEQ ID NO: 3776123 - DNA, 15 bp, Homo sapiens
ctgcctggccaggca

SEQ ID NO: 3776124 - DNA, 17 bp, Homo sapiens
ctgcctggccaggcaga

SEQ ID NO: 3776125 - DNA, 20 bp, Homo sapiens
ctgcctggcccccagctgtg

SEQ ID NO: 3776126 - DNA, 21 bp, Homo sapiens
ctgcctggtctcctgccccca

SEQ ID NO: 3776127 - DNA, 15 bp, Homo sapiens
ctgcctgtagttagg

SEQ ID NO: 3776128 - DNA, 22 bp, Homo sapiens
ctgcctgtagttaggaaataaa

SEQ ID NO: 3776129 - DNA, 18 bp, Homo sapiens
ctgcctgtccctctcagg

SEQ ID NO: 3776130 - DNA, 17 bp, Homo sapiens
ctgcctgtgagccagtc

SEQ ID NO: 3776131 - DNA, 14 bp, Homo sapiens
ctgcctgtgctgtg

SEQ ID NO: 3776132 - DNA, 17 bp, Homo sapiens
ctgcctgttcagctcca

SEQ ID NO: 3776133 - DNA, 18 bp, Homo sapiens
ctgcctgttcagctccag

SEQ ID NO: 3776134 - DNA, 20 bp, Homo sapiens
ctgcctgttcagctccagct

SEQ ID NO: 3776135 - DNA, 13 bp, Homo sapiens
ctgccttcgttaa

SEQ ID NO: 3776136 - DNA, 19 bp, Homo sapiens
ctgccttcgttaactgtgt

SEQ ID NO: 3776137 - DNA, 21 bp, Homo sapiens
ctgcctttgcagaaacagatt

SEQ ID NO: 3776138 - DNA, 13 bp, Homo sapiens
ctgcgcccttccc

SEQ ID NO: 3776139 - DNA, 16 bp, Homo sapiens
ctgcgcccttccccag

SEQ ID NO: 3776140 - DNA, 20 bp, Homo sapiens
ctgcggaatgaaccacatct

SEQ ID NO: 3776141 - DNA, 21 bp, Homo sapiens
ctgcggcacccttgcgctttt

SEQ ID NO: 3776142 - DNA, 18 bp, Homo sapiens
ctgcggtccacccaggag

SEQ ID NO: 3776143 - DNA, 20 bp, Homo sapiens
ctgcggtccacccaggagcc

SEQ ID NO: 3776144 - DNA, 23 bp, Homo sapiens
ctgcggtccacccaggagccccg

SEQ ID NO: 3776145 - DNA, 13 bp, Homo sapiens
ctgcgtctgtgtt

SEQ ID NO: 3776146 - DNA, 16 bp, Homo sapiens
ctgcgtggctgacccc

SEQ ID NO: 3776147 - DNA, 20 bp, Homo sapiens
ctgcgtggctgacccccctc

SEQ ID NO: 3776148 - DNA, 20 bp, Homo sapiens
ctgcgttttggaagctctga

SEQ ID NO: 3776149 - DNA, 20 bp, Homo sapiens
ctgctaaatctcctattttt

SEQ ID NO: 3776150 - DNA, 20 bp, Homo sapiens
ctgctaacttggagccccag

SEQ ID NO: 3776151 - DNA, 23 bp, Homo sapiens
ctgctaacttggagccccagtgc

SEQ ID NO: 3776152 - DNA, 14 bp, Homo sapiens
ctgctaatcttcag

SEQ ID NO: 3776153 - DNA, 18 bp, Homo sapiens
ctgctaatcttcagggca

SEQ ID NO: 3776154 - DNA, 23 bp, Homo sapiens
ctgctacaaatactcttaggaag

SEQ ID NO: 3776155 - DNA, 12 bp, Homo sapiens
ctgctacctcac

SEQ ID NO: 3776156 - DNA, 17 bp, Homo sapiens
ctgctactctgttcctt

SEQ ID NO: 3776157 - DNA, 18 bp, Homo sapiens
ctgctactctgttccttc

SEQ ID NO: 3776158 - DNA, 21 bp, Homo sapiens
ctgctaggtgggccagcccct

SEQ ID NO: 3776159 - DNA, 17 bp, Homo sapiens
ctgtgcatgggtgaagg

SEQ ID NO: 3776160 - DNA, 16 bp, Homo sapiens
ctgtgccatgtgccag

SEQ ID NO: 3776161 - DNA, 18 bp, Homo sapiens
ctgtgccatgtgccaggt

SEQ ID NO: 3776162 - DNA, 13 bp, Homo sapiens
ctgtgcccagctc

SEQ ID NO: 3776163 - DNA, 14 bp, Homo sapiens
ctgtgcccagctca

SEQ ID NO: 3776164 - DNA, 15 bp, Homo sapiens
ctgtgcccagctcag

SEQ ID NO: 3776165 - DNA, 14 bp, Homo sapiens
ctgtgcctctgcct

SEQ ID NO: 3776166 - DNA, 15 bp, Homo sapiens
ctgtgcctctgcctg

SEQ ID NO: 3776167 - DNA, 17 bp, Homo sapiens
ctgtgcctctgcctgtc

SEQ ID NO: 3776168 - DNA, 13 bp, Homo sapiens
ctgtgcctggagc

SEQ ID NO: 3776169 - DNA, 20 bp, Homo sapiens
ctgtgcctggagctcctggg

SEQ ID NO: 3776170 - DNA, 15 bp, Homo sapiens
ctgtgctatgaattt

SEQ ID NO: 3776171 - DNA, 17 bp, Homo sapiens
ctgtgctctggacaggc

SEQ ID NO: 3776172 - DNA, 19 bp, Homo sapiens
ctgtgctctggacaggcat

SEQ ID NO: 3776173 - DNA, 20 bp, Homo sapiens
ctgtgctgcccgtcttcagc

SEQ ID NO: 3776174 - DNA, 14 bp, Homo sapiens
ctgtggaagggact

SEQ ID NO: 3776175 - DNA, 23 bp, Homo sapiens
ctgtggcagtaaagagaaacttt

SEQ ID NO: 3776176 - DNA, 22 bp, Homo sapiens
ctgtggccatggtccccaagac

SEQ ID NO: 3776177 - DNA, 14 bp, Homo sapiens
ctgtggcggtgcct

SEQ ID NO: 3776178 - DNA, 15 bp, Homo sapiens
ctgtggcggtgcctg

SEQ ID NO: 3776179 - DNA, 17 bp, Homo sapiens
ctgtggctgctagcact

SEQ ID NO: 3776180 - DNA, 14 bp, Homo sapiens
ctgtgggctccctt

SEQ ID NO: 3776181 - DNA, 17 bp, Homo sapiens
ctgtggggatttctccc

SEQ ID NO: 3776182 - DNA, 18 bp, Homo sapiens
ctgtggggatttctccca

SEQ ID NO: 3776183 - DNA, 20 bp, Homo sapiens
ctgtggggatttctcccagc

SEQ ID NO: 3776184 - DNA, 15 bp, Homo sapiens
ctgtggttcctgggg

SEQ ID NO: 3776185 - DNA, 19 bp, Homo sapiens
ctgtggtttccaaggagct

SEQ ID NO: 3776186 - DNA, 21 bp, Homo sapiens
ctgtggttttcttttgccatg

SEQ ID NO: 3776187 - DNA, 13 bp, Homo sapiens
ctgtgtagctggg

SEQ ID NO: 3776188 - DNA, 13 bp, Homo sapiens
ctgtgtatgtaca

SEQ ID NO: 3776189 - DNA, 14 bp, Homo sapiens
ctgtgtatgtacat

SEQ ID NO: 3776190 - DNA, 18 bp, Homo sapiens
ctgtgtatgtacatatat

SEQ ID NO: 3776191 - DNA, 18 bp, Homo sapiens
ctgtgtccaactccagta

SEQ ID NO: 3776192 - DNA, 15 bp, Homo sapiens
ctgtgtccctctctc

SEQ ID NO: 3776193 - DNA, 16 bp, Homo sapiens
ctgtgtccctctctct

SEQ ID NO: 3776194 - DNA, 20 bp, Homo sapiens
ctgtgtcctggttagcagag

SEQ ID NO: 3776195 - DNA, 16 bp, Homo sapiens
ctgtgtccttgcacct

SEQ ID NO: 3776196 - DNA, 16 bp, Homo sapiens
ctgtgtcttgcaatgg

SEQ ID NO: 3776197 - DNA, 21 bp, Homo sapiens
ctgtgtcttgcaatggcagcc

SEQ ID NO: 3776198 - DNA, 19 bp, Homo sapiens
ctgtgtgaaataccagtgt

SEQ ID NO: 3776199 - DNA, 18 bp, Homo sapiens
ctgtgtgcaagtgtgtgc

SEQ ID NO: 3776200 - DNA, 13 bp, Homo sapiens
ctgtgtgctgtgg

SEQ ID NO: 3776201 - DNA, 16 bp, Homo sapiens
ctgtgtggactgtgat

SEQ ID NO: 3776202 - DNA, 21 bp, Homo sapiens
ctgtgtgggactgtacacact

SEQ ID NO: 3776203 - DNA, 23 bp, Homo sapiens
ctgtgtggtttagtgtaaaaatg

SEQ ID NO: 3776204 - DNA, 18 bp, Homo sapiens
ctgtgtgtgcgcctacag

SEQ ID NO: 3776205 - DNA, 22 bp, Homo sapiens
ctgtgttcttgccactgcactc

SEQ ID NO: 3776206 - DNA, 16 bp, Homo sapiens
ctgttagctgttattt

SEQ ID NO: 3776207 - DNA, 15 bp, Homo sapiens
ctgttcactctactt

SEQ ID NO: 3776208 - DNA, 15 bp, Homo sapiens
ctgttcagctccagc

SEQ ID NO: 3776209 - DNA, 12 bp, Homo sapiens
ctgttcagctgg

SEQ ID NO: 3776210 - DNA, 18 bp, Homo sapiens
ctgttcccaaattttcta

SEQ ID NO: 3776211 - DNA, 21 bp, Homo sapiens
ctgttccttcacatcctgtgt

SEQ ID NO: 3776212 - DNA, 17 bp, Homo sapiens
ctgttgccagagatgga

SEQ ID NO: 3776213 - DNA, 12 bp, Homo sapiens
ctgttgcccagg

SEQ ID NO: 3776214 - DNA, 15 bp, Homo sapiens
ctgttgcccaggctg

SEQ ID NO: 3776215 - DNA, 21 bp, Homo sapiens
ctgttgccctttctgtaccat

SEQ ID NO: 3776216 - DNA, 12 bp, Homo sapiens
ctgttggccagt

SEQ ID NO: 3776217 - DNA, 14 bp, Homo sapiens
ctgttggctggggg

SEQ ID NO: 3776218 - DNA, 17 bp, Homo sapiens
ctgttgtcattgcttta

SEQ ID NO: 3776219 - DNA, 15 bp, Homo sapiens
ctgttgtgttcgttc

SEQ ID NO: 3776220 - DNA, 17 bp, Homo sapiens
ctgttgtgttcgttctt

SEQ ID NO: 3776221 - DNA, 20 bp, Homo sapiens
ctgtttacaagaaaaaatga

SEQ ID NO: 3776222 - DNA, 13 bp, Homo sapiens
ctgtttatggcct

SEQ ID NO: 3776223 - DNA, 18 bp, Homo sapiens
ctgtttatggcctcagct

SEQ ID NO: 3776224 - DNA, 22 bp, Homo sapiens
ctgtttatggcctcagctgcct

SEQ ID NO: 3776225 - DNA, 17 bp, Homo sapiens
ctgtttcaacacagacc

SEQ ID NO: 3776226 - DNA, 13 bp, Homo sapiens
ctgtttcctttta

SEQ ID NO: 3776227 - DNA, 15 bp, Homo sapiens
ctgtttccttttatg

SEQ ID NO: 3776228 - DNA, 20 bp, Homo sapiens
ctgtttctattctctcctca

SEQ ID NO: 3776229 - DNA, 13 bp, Homo sapiens
ctgtttctctgct

SEQ ID NO: 3776230 - DNA, 14 bp, Homo sapiens
ctgtttctctgctg

SEQ ID NO: 3776231 - DNA, 17 bp, Homo sapiens
ctgtttctgcttgctct

SEQ ID NO: 3776232 - DNA, 14 bp, Homo sapiens
ctgtttgttaaaac

SEQ ID NO: 3776233 - DNA, 12 bp, Homo sapiens
ctgtttgttatg

SEQ ID NO: 3776234 - DNA, 15 bp, Homo sapiens
ctgttttactgcttt

SEQ ID NO: 3776235 - DNA, 14 bp, Homo sapiens
ctgttttatactgt

SEQ ID NO: 3776236 - DNA, 13 bp, Homo sapiens
ctgttttccctga

SEQ ID NO: 3776237 - DNA, 13 bp, Homo sapiens
ctgttttctcttg

SEQ ID NO: 3776238 - DNA, 14 bp, Homo sapiens
ctgttttctcttga

SEQ ID NO: 3776239 - DNA, 17 bp, Homo sapiens
ctgttttctcttgagag

SEQ ID NO: 3776240 - DNA, 18 bp, Homo sapiens
ctgttttcttctattcca

SEQ ID NO: 3776241 - DNA, 18 bp, Homo sapiens
ctgtttttaagctgtttc

SEQ ID NO: 3776242 - DNA, 19 bp, Homo sapiens
ctgtttttaagctgtttcc

SEQ ID NO: 3776243 - DNA, 18 bp, Homo sapiens
ctgttttttcctgagctt

SEQ ID NO: 3776244 - DNA, 12 bp, Homo sapiens
cttaaaaaactt

SEQ ID NO: 3776245 - DNA, 17 bp, Homo sapiens
cttaaaaaataaaaact

SEQ ID NO: 3776246 - DNA, 14 bp, Homo sapiens
cttaaaaagttata

SEQ ID NO: 3776247 - DNA, 14 bp, Homo sapiens
cttaaaacaacact

SEQ ID NO: 3776248 - DNA, 17 bp, Homo sapiens
cttaaaagccatcatgt

SEQ ID NO: 3776249 - DNA, 22 bp, Homo sapiens
cttaaaatagcaacactctata

SEQ ID NO: 3776250 - DNA, 13 bp, Homo sapiens
cttaaaatatttt

SEQ ID NO: 3776251 - DNA, 14 bp, Homo sapiens
cttaaaatatttta

SEQ ID NO: 3776252 - DNA, 14 bp, Homo sapiens
cttaaacaaatgta

SEQ ID NO: 3776253 - DNA, 15 bp, Homo sapiens
cttaaactgtgtgga

SEQ ID NO: 3776254 - DNA, 23 bp, Homo sapiens
cttaaagctgcctgtagttagga

SEQ ID NO: 3776255 - DNA, 22 bp, Homo sapiens
cttaaataaaagaaatgcacaa

SEQ ID NO: 3776256 - DNA, 21 bp, Homo sapiens
cttaaataataaacagtggaa

SEQ ID NO: 3776257 - DNA, 11 bp, Homo sapiens
cttaaattaaa

SEQ ID NO: 3776258 - DNA, 14 bp, Homo sapiens
cttaaattaaacaa

SEQ ID NO: 3776259 - DNA, 17 bp, Homo sapiens
cttaaattaaacaattt

SEQ ID NO: 3776260 - DNA, 11 bp, Homo sapiens
cttaagaacac

SEQ ID NO: 3776261 - DNA, 20 bp, Homo sapiens
cttaagaccacctcaaattt

SEQ ID NO: 3776262 - DNA, 21 bp, Homo sapiens
cttaagaccacctcaaattta

SEQ ID NO: 3776263 - DNA, 23 bp, Homo sapiens
cttaagaccacctcaaatttaaa

SEQ ID NO: 3776264 - DNA, 20 bp, Homo sapiens
cttaaggattgtgatatttt

SEQ ID NO: 3776265 - DNA, 12 bp, Homo sapiens
cttaataaattc

SEQ ID NO: 3776266 - DNA, 21 bp, Homo sapiens
cttaattaagtaaactaatga

SEQ ID NO: 3776267 - DNA, 13 bp, Homo sapiens
cttacacacaaaa

SEQ ID NO: 3776268 - DNA, 11 bp, Homo sapiens
cttacacccac

SEQ ID NO: 3776269 - DNA, 21 bp, Homo sapiens
cttacagataggccttcttgt

SEQ ID NO: 3776270 - DNA, 23 bp, Homo sapiens
cttacagataggccttcttgtga

SEQ ID NO: 3776271 - DNA, 16 bp, Homo sapiens
cttacagcataaggga

SEQ ID NO: 3776272 - DNA, 16 bp, Homo sapiens
cttacatgagaacaga

SEQ ID NO: 3776273 - DNA, 13 bp, Homo sapiens
cttctgtgcccag

SEQ ID NO: 3776274 - DNA, 14 bp, Homo sapiens
cttctgtgcccagc

SEQ ID NO: 3776275 - DNA, 17 bp, Homo sapiens
cttctgtgcccagctca

SEQ ID NO: 3776276 - DNA, 18 bp, Homo sapiens
cttctgtgcccagctcag

SEQ ID NO: 3776277 - DNA, 15 bp, Homo sapiens
cttctgtggctcaca

SEQ ID NO: 3776278 - DNA, 12 bp, Homo sapiens
cttctgtttcta

SEQ ID NO: 3776279 - DNA, 14 bp, Homo sapiens
cttctgtttctagt

SEQ ID NO: 3776280 - DNA, 16 bp, Homo sapiens
cttcttaaatgagaag

SEQ ID NO: 3776281 - DNA, 21 bp, Homo sapiens
cttcttaaccccagtaagcca

SEQ ID NO: 3776282 - DNA, 18 bp, Homo sapiens
cttcttaatataactgcc

SEQ ID NO: 3776283 - DNA, 20 bp, Homo sapiens
cttcttaatataactgcctt

SEQ ID NO: 3776284 - DNA, 13 bp, Homo sapiens
cttcttacatgca

SEQ ID NO: 3776285 - DNA, 15 bp, Homo sapiens
cttcttacatgcatt

SEQ ID NO: 3776286 - DNA, 20 bp, Homo sapiens
cttcttcagaagacactgca

SEQ ID NO: 3776287 - DNA, 18 bp, Homo sapiens
cttcttcagatcagtgct

SEQ ID NO: 3776288 - DNA, 21 bp, Homo sapiens
cttcttcggggaactcctgga

SEQ ID NO: 3776289 - DNA, 19 bp, Homo sapiens
cttcttctgtcatctacct

SEQ ID NO: 3776290 - DNA, 16 bp, Homo sapiens
cttcttggtcttattt

SEQ ID NO: 3776291 - DNA, 22 bp, Homo sapiens
cttctttataattctactttga

SEQ ID NO: 3776292 - DNA, 18 bp, Homo sapiens
cttgaaagcatccatgtg

SEQ ID NO: 3776293 - DNA, 17 bp, Homo sapiens
cttgaaagtcatgaaca

SEQ ID NO: 3776294 - DNA, 16 bp, Homo sapiens
cttgaacacagtattt

SEQ ID NO: 3776295 - DNA, 15 bp, Homo sapiens
cttgaacaccacgct

SEQ ID NO: 3776296 - DNA, 13 bp, Homo sapiens
cttgaacactggg

SEQ ID NO: 3776297 - DNA, 15 bp, Homo sapiens
cttgaacccaggaga

SEQ ID NO: 3776298 - DNA, 13 bp, Homo sapiens
cttgaactcctgg

SEQ ID NO: 3776299 - DNA, 14 bp, Homo sapiens
cttgaactcctggc

SEQ ID NO: 3776300 - DNA, 17 bp, Homo sapiens
cttgaactcctggcctc

SEQ ID NO: 3776301 - DNA, 19 bp, Homo sapiens
cttgaactcctggcctcaa

SEQ ID NO: 3776302 - DNA, 13 bp, Homo sapiens
cttgaagatcgtt

SEQ ID NO: 3776303 - DNA, 13 bp, Homo sapiens
cttgaagccaagt

SEQ ID NO: 3776304 - DNA, 23 bp, Homo sapiens
cttgaaggatctgtttttaaaaa

SEQ ID NO: 3776305 - DNA, 14 bp, Homo sapiens
cttgaattcataga

SEQ ID NO: 3776306 - DNA, 20 bp, Homo sapiens
cttgaatttctaaaaaacag

SEQ ID NO: 3776307 - DNA, 17 bp, Homo sapiens
cttgacaatagaacatt

SEQ ID NO: 3776308 - DNA, 19 bp, Homo sapiens
cttgacataatttcactga

SEQ ID NO: 3776309 - DNA, 20 bp, Homo sapiens
cttgaccaagcaggaagctc

SEQ ID NO: 3776310 - DNA, 19 bp, Homo sapiens
cttgaccagcagatcccag

SEQ ID NO: 3776311 - DNA, 22 bp, Homo sapiens
cttgaccagcagatcccagctc

SEQ ID NO: 3776312 - DNA, 11 bp, Homo sapiens
cttgagaaacc

SEQ ID NO: 3776313 - DNA, 13 bp, Homo sapiens
cttgagaaacctt

SEQ ID NO: 3776314 - DNA, 16 bp, Homo sapiens
cttgagacctcagcca

SEQ ID NO: 3776315 - DNA, 18 bp, Homo sapiens
cttgagacctcagccatg

SEQ ID NO: 3776316 - DNA, 17 bp, Homo sapiens
cttgagactgttttgaa

SEQ ID NO: 3776317 - DNA, 22 bp, Homo sapiens
cttgagactgttttgaatttgg

SEQ ID NO: 3776318 - DNA, 14 bp, Homo sapiens
cttgagagggtgga

SEQ ID NO: 3776319 - DNA, 13 bp, Homo sapiens
cttgagcccagga

SEQ ID NO: 3776320 - DNA, 15 bp, Homo sapiens
cttgagcctgggagg

SEQ ID NO: 3776321 - DNA, 14 bp, Homo sapiens
cttgagctccccaa

SEQ ID NO: 3776322 - DNA, 18 bp, Homo sapiens
cttgagggcaagagccac

SEQ ID NO: 3776323 - DNA, 15 bp, Homo sapiens
cttgagggttgggct

SEQ ID NO: 3776324 - DNA, 17 bp, Homo sapiens
cttgagggttgggctgg

SEQ ID NO: 3776325 - DNA, 22 bp, Homo sapiens
cttgaggtcttttgacatgtgg

SEQ ID NO: 3776326 - DNA, 16 bp, Homo sapiens
cttgataaagggccaa

SEQ ID NO: 3776327 - DNA, 17 bp, Homo sapiens
cttgataatgttgtggt

SEQ ID NO: 3776328 - DNA, 21 bp, Homo sapiens
cttgatttatcacacaaagca

SEQ ID NO: 3776329 - DNA, 22 bp, Homo sapiens
cttgatttatcacacaaagcag

SEQ ID NO: 3776330 - DNA, 15 bp, Homo sapiens
cttgcaacacacaga

SEQ ID NO: 3776331 - DNA, 22 bp, Homo sapiens
cttgcacactcccctgcactgg

SEQ ID NO: 3776332 - DNA, 12 bp, Homo sapiens
cttgcacctgca

SEQ ID NO: 3776333 - DNA, 21 bp, Homo sapiens
cttgcagactctacagaggcc

SEQ ID NO: 3776334 - DNA, 22 bp, Homo sapiens
cttgcagctctccccttctctg

SEQ ID NO: 3776335 - DNA, 22 bp, Homo sapiens
cttgcagttcagcaccacccta

SEQ ID NO: 3776336 - DNA, 14 bp, Homo sapiens
cttgccacagctct

SEQ ID NO: 3776337 - DNA, 15 bp, Homo sapiens
cttgccactgcactc

SEQ ID NO: 3776338 - DNA, 16 bp, Homo sapiens
cttgccagacatgtgg

SEQ ID NO: 3776339 - DNA, 13 bp, Homo sapiens
cttgcccagagat

SEQ ID NO: 3776340 - DNA, 21 bp, Homo sapiens
cttgcccagagatgcctccac

SEQ ID NO: 3776341 - DNA, 21 bp, Homo sapiens
cttgcccagggctcagcctgg

SEQ ID NO: 3776342 - DNA, 13 bp, Homo sapiens
cttgccccccacc

SEQ ID NO: 3776343 - DNA, 16 bp, Homo sapiens
cttgccccccacccca

SEQ ID NO: 3776344 - DNA, 18 bp, Homo sapiens
cttgccgaaactggaagt

SEQ ID NO: 3776345 - DNA, 20 bp, Homo sapiens
cttgccgaaactggaagtta

SEQ ID NO: 3776346 - DNA, 16 bp, Homo sapiens
cttgcctagggcctgg

SEQ ID NO: 3776347 - DNA, 20 bp, Homo sapiens
cttgcctagggcctggtcca

SEQ ID NO: 3776348 - DNA, 15 bp, Homo sapiens
cttgcctcctgtgta

SEQ ID NO: 3776349 - DNA, 16 bp, Homo sapiens
cttgctacctcaaggg

SEQ ID NO: 3776350 - DNA, 23 bp, Homo sapiens
cttgctagctatgtgaccttgag

SEQ ID NO: 3776351 - DNA, 20 bp, Homo sapiens
cttgctctatctcacagcac

SEQ ID NO: 3776352 - DNA, 22 bp, Homo sapiens
cttgctctatctcacagcacac

SEQ ID NO: 3776353 - DNA, 20 bp, Homo sapiens
cttgctctcccctgccctgc

SEQ ID NO: 3776354 - DNA, 13 bp, Homo sapiens
cttgctctgctga

SEQ ID NO: 3776355 - DNA, 17 bp, Homo sapiens
cttgctctgctgacaga

SEQ ID NO: 3776356 - DNA, 19 bp, Homo sapiens
cttgctcttcagtgggaga

SEQ ID NO: 3776357 - DNA, 20 bp, Homo sapiens
cttgctgaatcggaatctct

SEQ ID NO: 3776358 - DNA, 16 bp, Homo sapiens
cttgctgccctaggct

SEQ ID NO: 3776359 - DNA, 16 bp, Homo sapiens
cttgctgtcctaggcc

SEQ ID NO: 3776360 - DNA, 20 bp, Homo sapiens
cttgctgtcctaggccacac

SEQ ID NO: 3776361 - DNA, 21 bp, Homo sapiens
cttgctttctttgtttggctg

SEQ ID NO: 3776362 - DNA, 22 bp, Homo sapiens
cttggaaaaatccagaaagaaa

SEQ ID NO: 3776363 - DNA, 15 bp, Homo sapiens
cttggaaaggaccag

SEQ ID NO: 3776364 - DNA, 13 bp, Homo sapiens
cttggagccccag

SEQ ID NO: 3776365 - DNA, 17 bp, Homo sapiens
cttggaggagatgggga

SEQ ID NO: 3776366 - DNA, 22 bp, Homo sapiens
cttggataatgctgttgcctca

SEQ ID NO: 3776367 - DNA, 18 bp, Homo sapiens
cttggcatcacagggcag

SEQ ID NO: 3776368 - DNA, 17 bp, Homo sapiens
cttggcctgtctcatcc

SEQ ID NO: 3776369 - DNA, 22 bp, Homo sapiens
cttggcctgtctcatccccagg

SEQ ID NO: 3776370 - DNA, 17 bp, Homo sapiens
cttggcgtggagccagg

SEQ ID NO: 3776371 - DNA, 21 bp, Homo sapiens
cttggctcaatcctctaagct

SEQ ID NO: 3776372 - DNA, 18 bp, Homo sapiens
cttgggaatggatcctgg

SEQ ID NO: 3776373 - DNA, 20 bp, Homo sapiens
cttgggactaaatgccctgc

SEQ ID NO: 3776374 - DNA, 22 bp, Homo sapiens
cttgggaggccccactggggaa

SEQ ID NO: 3776375 - DNA, 15 bp, Homo sapiens
cttgggaggcttccc

SEQ ID NO: 3776376 - DNA, 23 bp, Homo sapiens
cttgggcttccatttgtgtgtgt

SEQ ID NO: 3776377 - DNA, 15 bp, Homo sapiens
cttggggcaggcagt

SEQ ID NO: 3776378 - DNA, 24 bp, Homo sapiens
cttgggggatgactagaggcaggg

SEQ ID NO: 3776379 - DNA, 15 bp, Homo sapiens
cttggggggctgagg

SEQ ID NO: 3776380 - DNA, 23 bp, Homo sapiens
cttgggtcccccacgtgacagtg

SEQ ID NO: 3776381 - DNA, 21 bp, Homo sapiens
cttgggtgtaacaggtctcct

SEQ ID NO: 3776382 - DNA, 17 bp, Homo sapiens
cttgggtttttgttacc

SEQ ID NO: 3776383 - DNA, 14 bp, Homo sapiens
cttggtcacataca

SEQ ID NO: 3776384 - DNA, 15 bp, Homo sapiens
cttggtccttgattt

SEQ ID NO: 3776385 - DNA, 20 bp, Homo sapiens
cttggtctgatttcaggata

SEQ ID NO: 3776386 - DNA, 23 bp, Homo sapiens
gaaaatatgtccatatctaacca

SEQ ID NO: 3776387 - DNA, 14 bp, Homo sapiens
gaaaatcagcctgc

SEQ ID NO: 3776388 - DNA, 11 bp, Homo sapiens
gaaaatcatat

SEQ ID NO: 3776389 - DNA, 14 bp, Homo sapiens
gaaaatcctaccaa

SEQ ID NO: 3776390 - DNA, 23 bp, Homo sapiens
gaaaatgagtttttatggggctg

SEQ ID NO: 3776391 - DNA, 19 bp, Homo sapiens
gaaaatgttttgtaagaaa

SEQ ID NO: 3776392 - DNA, 14 bp, Homo sapiens
gaaaattccagaaa

SEQ ID NO: 3776393 - DNA, 13 bp, Homo sapiens
gaaaattgaattt

SEQ ID NO: 3776394 - DNA, 18 bp, Homo sapiens
gaaaattgaatttaacaa

SEQ ID NO: 3776395 - DNA, 14 bp, Homo sapiens
gaaaattttaaaaa

SEQ ID NO: 3776396 - DNA, 23 bp, Homo sapiens
gaaacaaagtggaaggaaagatg

SEQ ID NO: 3776397 - DNA, 16 bp, Homo sapiens
gaaacacactgaggca

SEQ ID NO: 3776398 - DNA, 14 bp, Homo sapiens
gaaacagaaacaaa

SEQ ID NO: 3776399 - DNA, 22 bp, Homo sapiens
gaaacagaaacaaaaacactaa

SEQ ID NO: 3776400 - DNA, 19 bp, Homo sapiens
gaaacagagacaggcccaa

SEQ ID NO: 3776401 - DNA, 22 bp, Homo sapiens
gaaacaggaccacaaaaatgaa

SEQ ID NO: 3776402 - DNA, 13 bp, Homo sapiens
gaaacaggagaga

SEQ ID NO: 3776403 - DNA, 17 bp, Homo sapiens
gaaacaggagagaaagg

SEQ ID NO: 3776404 - DNA, 22 bp, Homo sapiens
gaaaccagcttttactgttttt

SEQ ID NO: 3776405 - DNA, 19 bp, Homo sapiens
gaaaccagtgtagccttgc

SEQ ID NO: 3776406 - DNA, 17 bp, Homo sapiens
gaaaccccatctctact

SEQ ID NO: 3776407 - DNA, 22 bp, Homo sapiens
gaaactagacttgaggaaacca

SEQ ID NO: 3776408 - DNA, 20 bp, Homo sapiens
gaaactagcttacatgagaa

SEQ ID NO: 3776409 - DNA, 24 bp, Homo sapiens
gaaactagcttacatgagaacaga

SEQ ID NO: 3776410 - DNA, 20 bp, Homo sapiens
gaaactcaccatgtaaaaga

SEQ ID NO: 3776411 - DNA, 19 bp, Homo sapiens
gaaactcacctgctggccc

SEQ ID NO: 3776412 - DNA, 23 bp, Homo sapiens
gaaactcacctgctggcccctca

SEQ ID NO: 3776413 - DNA, 18 bp, Homo sapiens
gaaactccgtcttagaag

SEQ ID NO: 3776414 - DNA, 22 bp, Homo sapiens
gaaactccgtcttagaagtgga

SEQ ID NO: 3776415 - DNA, 16 bp, Homo sapiens
gaaactgacacatgct

SEQ ID NO: 3776416 - DNA, 18 bp, Homo sapiens
gaaactgaggaattttct

SEQ ID NO: 3776417 - DNA, 16 bp, Homo sapiens
gaaactggaagttatt

SEQ ID NO: 3776418 - DNA, 17 bp, Homo sapiens
gaaactgttgccagaga

SEQ ID NO: 3776419 - DNA, 23 bp, Homo sapiens
gaaactgttgccagagatggagg

SEQ ID NO: 3776420 - DNA, 14 bp, Homo sapiens
gaaacttacacaca

SEQ ID NO: 3776421 - DNA, 19 bp, Homo sapiens
gaaacttatcttacaaagt

SEQ ID NO: 3776422 - DNA, 21 bp, Homo sapiens
gaaacttatcttacaaagtgt

SEQ ID NO: 3776423 - DNA, 13 bp, Homo sapiens
gaaacttccaaga

SEQ ID NO: 3776424 - DNA, 14 bp, Homo sapiens
gaaactttcccttt

SEQ ID NO: 3776425 - DNA, 17 bp, Homo sapiens
gaaagaaatcatgttat

SEQ ID NO: 3776426 - DNA, 11 bp, Homo sapiens
gaaagaaggaa

SEQ ID NO: 3776427 - DNA, 14 bp, Homo sapiens
gaaagacagagctg

SEQ ID NO: 3776428 - DNA, 16 bp, Homo sapiens
gaaagacagagctggg

SEQ ID NO: 3776429 - DNA, 16 bp, Homo sapiens
gaaagatcaaaaggtt

SEQ ID NO: 3776430 - DNA, 23 bp, Homo sapiens
gaaagatgctcaggtacagagaa

SEQ ID NO: 3776431 - DNA, 22 bp, Homo sapiens
gaaagatggctgtgcctctgcc

SEQ ID NO: 3776432 - DNA, 20 bp, Homo sapiens
gaaagcagctcaaaggcaca

SEQ ID NO: 3776433 - DNA, 19 bp, Homo sapiens
gaaagcatcacctcaggcc

SEQ ID NO: 3776434 - DNA, 17 bp, Homo sapiens
gaaagcatccatgtgtg

SEQ ID NO: 3776435 - DNA, 17 bp, Homo sapiens
gaaagccctgagctttc

SEQ ID NO: 3776436 - DNA, 21 bp, Homo sapiens
gaaagccctgagctttctgct

SEQ ID NO: 3776437 - DNA, 15 bp, Homo sapiens
gaaaggagtagaaaa

SEQ ID NO: 3776438 - DNA, 16 bp, Homo sapiens
gaaaggagtagaaaaa

SEQ ID NO: 3776439 - DNA, 20 bp, Homo sapiens
gaaaggatatttaagaaaat

SEQ ID NO: 3776440 - DNA, 22 bp, Homo sapiens
gaaaggatatttaagaaaatac

SEQ ID NO: 3776441 - DNA, 19 bp, Homo sapiens
gaaaggctcagtctcagga

SEQ ID NO: 3776442 - DNA, 21 bp, Homo sapiens
gaaaggctcagtctcaggagc

SEQ ID NO: 3776443 - DNA, 19 bp, Homo sapiens
gaaaggctctgaaagccag

SEQ ID NO: 3776444 - DNA, 20 bp, Homo sapiens
gaaaggggcaggagctcaga

SEQ ID NO: 3776445 - DNA, 16 bp, Homo sapiens
gaaaggtttacattgt

SEQ ID NO: 3776446 - DNA, 15 bp, Homo sapiens
gaaagtaatttcttc

SEQ ID NO: 3776447 - DNA, 21 bp, Homo sapiens
gaaagtacttctccaccctgc

SEQ ID NO: 3776448 - DNA, 17 bp, Homo sapiens
gaaagtcagatgcccag

SEQ ID NO: 3776449 - DNA, 20 bp, Homo sapiens
gaaagtcttgtgactagtgc

SEQ ID NO: 3776450 - DNA, 13 bp, Homo sapiens
gaaagtgaatttg

SEQ ID NO: 3776451 - DNA, 16 bp, Homo sapiens
gaaagtgaatttgaat

SEQ ID NO: 3776452 - DNA, 23 bp, Homo sapiens
gaaagtgaatttgaatgaaaaat

SEQ ID NO: 3776453 - DNA, 23 bp, Homo sapiens
gaaagtttccccaccagtgaatg

SEQ ID NO: 3776454 - DNA, 22 bp, Homo sapiens
gaaagttttcagaacctcttcc

SEQ ID NO: 3776455 - DNA, 14 bp, Homo sapiens
gaaataaatagcta

SEQ ID NO: 3776456 - DNA, 15 bp, Homo sapiens
gaaataaatagctat

SEQ ID NO: 3776457 - DNA, 12 bp, Homo sapiens
gaaataaatgta

SEQ ID NO: 3776458 - DNA, 21 bp, Homo sapiens
gaaataaatgtatcatagaaa

SEQ ID NO: 3776459 - DNA, 17 bp, Homo sapiens
gaaataataaatctggt

SEQ ID NO: 3776460 - DNA, 19 bp, Homo sapiens
gaaataatgtacatctggc

SEQ ID NO: 3776461 - DNA, 21 bp, Homo sapiens
gaaatacaattctacattgtc

SEQ ID NO: 3776462 - DNA, 20 bp, Homo sapiens
gaaatacgccagaactgctt

SEQ ID NO: 3776463 - DNA, 15 bp, Homo sapiens
gaaatagtctgtgtg

SEQ ID NO: 3776464 - DNA, 23 bp, Homo sapiens
gaaatatatatgtgtgtgtatgt

SEQ ID NO: 3776465 - DNA, 17 bp, Homo sapiens
gaaatattatgcaaatt

SEQ ID NO: 3776466 - DNA, 18 bp, Homo sapiens
gaaatattatgcaaattc

SEQ ID NO: 3776467 - DNA, 19 bp, Homo sapiens
gaaatattatgcaaattcc

SEQ ID NO: 3776468 - DNA, 11 bp, Homo sapiens
gaaatcatgtt

SEQ ID NO: 3776469 - DNA, 12 bp, Homo sapiens
gaaatcatgtta

SEQ ID NO: 3776470 - DNA, 21 bp, Homo sapiens
gaaatcatgttatgataaaaa

SEQ ID NO: 3776471 - DNA, 19 bp, Homo sapiens
gaaatgaaaacatgtaata

SEQ ID NO: 3776472 - DNA, 13 bp, Homo sapiens
gaaatgaataatt

SEQ ID NO: 3776473 - DNA, 19 bp, Homo sapiens
gaaatgaataatttcccaa

SEQ ID NO: 3776474 - DNA, 14 bp, Homo sapiens
gaaatgaccaatat

SEQ ID NO: 3776475 - DNA, 18 bp, Homo sapiens
gaaatgaggtcagagcct

SEQ ID NO: 3776476 - DNA, 21 bp, Homo sapiens
gaaatgcattttattctttaa

SEQ ID NO: 3776477 - DNA, 22 bp, Homo sapiens
gaaatgccttactttgtatgat

SEQ ID NO: 3776478 - DNA, 15 bp, Homo sapiens
gaaatgtctggagaa

SEQ ID NO: 3776479 - DNA, 18 bp, Homo sapiens
gaaatgtctggagaataa

SEQ ID NO: 3776480 - DNA, 21 bp, Homo sapiens
gaaatgttattttttaattat

SEQ ID NO: 3776481 - DNA, 19 bp, Homo sapiens
gaaattactacaaaatttg

SEQ ID NO: 3776482 - DNA, 19 bp, Homo sapiens
gaaattagctgtgtgaaat

SEQ ID NO: 3776483 - DNA, 15 bp, Homo sapiens
gaaattccctggacc

SEQ ID NO: 3776484 - DNA, 22 bp, Homo sapiens
gaaattccctggaccagatgct

SEQ ID NO: 3776485 - DNA, 23 bp, Homo sapiens
gaaattccctggaccagatgctg

SEQ ID NO: 3776486 - DNA, 22 bp, Homo sapiens
gaaattgtttaagtgttgtaaa

SEQ ID NO: 3776487 - DNA, 13 bp, Homo sapiens
gaaatttaaaaga

SEQ ID NO: 3776488 - DNA, 22 bp, Homo sapiens
gaaatttaatatagctattttt

SEQ ID NO: 3776489 - DNA, 16 bp, Homo sapiens
gaaatttaattcatgt

SEQ ID NO: 3776490 - DNA, 21 bp, Homo sapiens
gaaatttaattcatgtttctt

SEQ ID NO: 3776491 - DNA, 23 bp, Homo sapiens
gaaatttaattcatgtttcttaa

SEQ ID NO: 3776492 - DNA, 19 bp, Homo sapiens
gaaatttttattaaattat

SEQ ID NO: 3776493 - DNA, 16 bp, Homo sapiens
gaacaacctcggctcc

SEQ ID NO: 3776494 - DNA, 15 bp, Homo sapiens
gaacaactactgtga

SEQ ID NO: 3776495 - DNA, 21 bp, Homo sapiens
gaacaactaggcttcagcata

SEQ ID NO: 3776496 - DNA, 13 bp, Homo sapiens
gaacaagcctaaa

SEQ ID NO: 3776497 - DNA, 20 bp, Homo sapiens
gaacacacccatcatctgac

SEQ ID NO: 3776498 - DNA, 21 bp, Homo sapiens
gacagagacacctgcacctcc

SEQ ID NO: 3776499 - DNA, 22 bp, Homo sapiens
gacagagacacctgcacctccc

SEQ ID NO: 3776500 - DNA, 18 bp, Homo sapiens
gacagagaggacgtgggc

SEQ ID NO: 3776501 - DNA, 19 bp, Homo sapiens
gacagagccccaccctcag

SEQ ID NO: 3776502 - DNA, 20 bp, Homo sapiens
gacagagctggttgggaaga

SEQ ID NO: 3776503 - DNA, 12 bp, Homo sapiens
gacagaggaggg

SEQ ID NO: 3776504 - DNA, 16 bp, Homo sapiens
gacagaggcagcccca

SEQ ID NO: 3776505 - DNA, 17 bp, Homo sapiens
gacagaggcagccccat

SEQ ID NO: 3776506 - DNA, 13 bp, Homo sapiens
gacagagggaaga

SEQ ID NO: 3776507 - DNA, 19 bp, Homo sapiens
gacagagggaagaaaagag

SEQ ID NO: 3776508 - DNA, 20 bp, Homo sapiens
gacagatcatagatttctga

SEQ ID NO: 3776509 - DNA, 21 bp, Homo sapiens
gacagatcatagatttctgat

SEQ ID NO: 3776510 - DNA, 21 bp, Homo sapiens
gacagatctctgctttggaaa

SEQ ID NO: 3776511 - DNA, 20 bp, Homo sapiens
gacagcaaaaccattgcttc

SEQ ID NO: 3776512 - DNA, 22 bp, Homo sapiens
gacagcaaaaccattgcttcac

SEQ ID NO: 3776513 - DNA, 19 bp, Homo sapiens
gacagcaacggggaggcca

SEQ ID NO: 3776514 - DNA, 14 bp, Homo sapiens
gacagcagctcagg

SEQ ID NO: 3776515 - DNA, 15 bp, Homo sapiens
gacagcagctcaggc

SEQ ID NO: 3776516 - DNA, 14 bp, Homo sapiens
gacagccacggcca

SEQ ID NO: 3776517 - DNA, 11 bp, Homo sapiens
gacagcctccc

SEQ ID NO: 3776518 - DNA, 18 bp, Homo sapiens
gacagcctccccctgtcc

SEQ ID NO: 3776519 - DNA, 20 bp, Homo sapiens
gacagcctccccctgtcccc

SEQ ID NO: 3776520 - DNA, 19 bp, Homo sapiens
gacagcctggcacagggca

SEQ ID NO: 3776521 - DNA, 22 bp, Homo sapiens
gacagcctgtggcggtgcctgg

SEQ ID NO: 3776522 - DNA, 23 bp, Homo sapiens
gacagcctgtggcggtgcctggg

SEQ ID NO: 3776523 - DNA, 11 bp, Homo sapiens
gacagctcctt

SEQ ID NO: 3776524 - DNA, 13 bp, Homo sapiens
gacagctccttct

SEQ ID NO: 3776525 - DNA, 16 bp, Homo sapiens
gacagctccttctgtc

SEQ ID NO: 3776526 - DNA, 21 bp, Homo sapiens
gacagcttctcatcctgcagg

SEQ ID NO: 3776527 - DNA, 12 bp, Homo sapiens
gacaggaaaggg

SEQ ID NO: 3776528 - DNA, 17 bp, Homo sapiens
gacaggaaagggaaggc

SEQ ID NO: 3776529 - DNA, 16 bp, Homo sapiens
gacaggacagcatggt

SEQ ID NO: 3776530 - DNA, 15 bp, Homo sapiens
gacaggacctgacta

SEQ ID NO: 3776531 - DNA, 20 bp, Homo sapiens
gacaggacgggcttgggctt

SEQ ID NO: 3776532 - DNA, 11 bp, Homo sapiens
gacaggagaaa

SEQ ID NO: 3776533 - DNA, 13 bp, Homo sapiens
gacaggcaagcac

SEQ ID NO: 3776534 - DNA, 21 bp, Homo sapiens
gacaggcaagcacctcctgcc

SEQ ID NO: 3776535 - DNA, 14 bp, Homo sapiens
gacaggcaatgctg

SEQ ID NO: 3776536 - DNA, 18 bp, Homo sapiens
gacaggcaatgctggctg

SEQ ID NO: 3776537 - DNA, 23 bp, Homo sapiens
gacaggcaatgctggctgttggc

SEQ ID NO: 3776538 - DNA, 19 bp, Homo sapiens
gacaggcatgttctctgag

SEQ ID NO: 3776539 - DNA, 22 bp, Homo sapiens
gacaggcatgttctctgaggac

SEQ ID NO: 3776540 - DNA, 14 bp, Homo sapiens
gacaggcccaagag

SEQ ID NO: 3776541 - DNA, 19 bp, Homo sapiens
gacagggacccacttcaca

SEQ ID NO: 3776542 - DNA, 15 bp, Homo sapiens
gacagggcatggcca

SEQ ID NO: 3776543 - DNA, 14 bp, Homo sapiens
gacagggtcctgct

SEQ ID NO: 3776544 - DNA, 15 bp, Homo sapiens
gacagtaacttggtt

SEQ ID NO: 3776545 - DNA, 17 bp, Homo sapiens
gacagtcaaggagtggc

SEQ ID NO: 3776546 - DNA, 19 bp, Homo sapiens
gacagtcaaggagtggctt

SEQ ID NO: 3776547 - DNA, 13 bp, Homo sapiens
gacagtcctggga

SEQ ID NO: 3776548 - DNA, 15 bp, Homo sapiens
gacagtgatctccat

SEQ ID NO: 3776549 - DNA, 21 bp, Homo sapiens
gacagtgatctccatatgtta

SEQ ID NO: 3776550 - DNA, 16 bp, Homo sapiens
gacagtgcctatactg

SEQ ID NO: 3776551 - DNA, 19 bp, Homo sapiens
gacagtgcttcagcctgag

SEQ ID NO: 3776552 - DNA, 20 bp, Homo sapiens
gacagtgcttcagcctgagg

SEQ ID NO: 3776553 - DNA, 14 bp, Homo sapiens
gacagttcaagaaa

SEQ ID NO: 3776554 - DNA, 15 bp, Homo sapiens
gacagttcatatgta

SEQ ID NO: 3776555 - DNA, 13 bp, Homo sapiens
gacatcagtggca

SEQ ID NO: 3776556 - DNA, 19 bp, Homo sapiens
gacatcagtggcatggctc

SEQ ID NO: 3776557 - DNA, 16 bp, Homo sapiens
gacatccaagcttcct

SEQ ID NO: 3776558 - DNA, 16 bp, Homo sapiens
gacatccgttgtgctt

SEQ ID NO: 3776559 - DNA, 21 bp, Homo sapiens
gacatctgtttctaaatgttt

SEQ ID NO: 3776560 - DNA, 16 bp, Homo sapiens
gacatcttagtatttg

SEQ ID NO: 3776561 - DNA, 14 bp, Homo sapiens
gacatgcgggctgg

SEQ ID NO: 3776562 - DNA, 20 bp, Homo sapiens
gacatgcgggctgggcagct

SEQ ID NO: 3776563 - DNA, 16 bp, Homo sapiens
gacatggacccggagc

SEQ ID NO: 3776564 - DNA, 21 bp, Homo sapiens
gacatggcttgccacagctct

SEQ ID NO: 3776565 - DNA, 15 bp, Homo sapiens
gacatgttcccttct

SEQ ID NO: 3776566 - DNA, 16 bp, Homo sapiens
gacatgttcccttctc

SEQ ID NO: 3776567 - DNA, 13 bp, Homo sapiens
gacattaaataat

SEQ ID NO: 3776568 - DNA, 18 bp, Homo sapiens
gacattaacagttttcca

SEQ ID NO: 3776569 - DNA, 14 bp, Homo sapiens
gacattctgccagg

SEQ ID NO: 3776570 - DNA, 22 bp, Homo sapiens
gacattctgccaggcccccaag

SEQ ID NO: 3776571 - DNA, 15 bp, Homo sapiens
gacattgcggacagc

SEQ ID NO: 3776572 - DNA, 15 bp, Homo sapiens
gacattgtcaataaa

SEQ ID NO: 3776573 - DNA, 19 bp, Homo sapiens
gacattgttggccaaagcc

SEQ ID NO: 3776574 - DNA, 14 bp, Homo sapiens
gaccaaaaaaataa

SEQ ID NO: 3776575 - DNA, 22 bp, Homo sapiens
gaccaaattccttggcatgcct

SEQ ID NO: 3776576 - DNA, 17 bp, Homo sapiens
gaccaacatggagaaac

SEQ ID NO: 3776577 - DNA, 13 bp, Homo sapiens
gaccaacctgacc

SEQ ID NO: 3776578 - DNA, 14 bp, Homo sapiens
gaccaacctgacca

SEQ ID NO: 3776579 - DNA, 18 bp, Homo sapiens
gaccaagagagaaagaag

SEQ ID NO: 3776580 - DNA, 16 bp, Homo sapiens
gaccaaggacccctca

SEQ ID NO: 3776581 - DNA, 17 bp, Homo sapiens
gaccaaggacccctcac

SEQ ID NO: 3776582 - DNA, 19 bp, Homo sapiens
gaccaaggacccctcacct

SEQ ID NO: 3776583 - DNA, 21 bp, Homo sapiens
gaccaagttataaatcaatgt

SEQ ID NO: 3776584 - DNA, 17 bp, Homo sapiens
gaccacacctccctgaa

SEQ ID NO: 3776585 - DNA, 20 bp, Homo sapiens
gaccacacctccctgaacca

SEQ ID NO: 3776586 - DNA, 21 bp, Homo sapiens
gaccagaaatcaaaaagggaa

SEQ ID NO: 3776587 - DNA, 15 bp, Homo sapiens
gaccagagctctgga

SEQ ID NO: 3776588 - DNA, 20 bp, Homo sapiens
gaccagcaacttgtcttttt

SEQ ID NO: 3776589 - DNA, 17 bp, Homo sapiens
gaccagcactgtctcag

SEQ ID NO: 3776590 - DNA, 22 bp, Homo sapiens
gaccagcctccatgctgcctcc

SEQ ID NO: 3776591 - DNA, 13 bp, Homo sapiens
gaccagcctggcc

SEQ ID NO: 3776592 - DNA, 19 bp, Homo sapiens
gaccaggactccctcctca

SEQ ID NO: 3776593 - DNA, 15 bp, Homo sapiens
gaccagtggtgcctt

SEQ ID NO: 3776594 - DNA, 21 bp, Homo sapiens
gaccatccactctaccctccc

SEQ ID NO: 3776595 - DNA, 16 bp, Homo sapiens
gaccattgtctcagag

SEQ ID NO: 3776596 - DNA, 14 bp, Homo sapiens
gacccaaggaggaa

SEQ ID NO: 3776597 - DNA, 12 bp, Homo sapiens
gacccactgctt

SEQ ID NO: 3776598 - DNA, 14 bp, Homo sapiens
gacccagtccctgg

SEQ ID NO: 3776599 - DNA, 17 bp, Homo sapiens
gacccatcacgcctgtg

SEQ ID NO: 3776600 - DNA, 18 bp, Homo sapiens
gacccccaccccttcccc

SEQ ID NO: 3776601 - DNA, 23 bp, Homo sapiens
gacccccactctcattccccagg

SEQ ID NO: 3776602 - DNA, 15 bp, Homo sapiens
gacccctctggccag

SEQ ID NO: 3776603 - DNA, 16 bp, Homo sapiens
gacccctctggccagg

SEQ ID NO: 3776604 - DNA, 18 bp, Homo sapiens
gacccctctggccaggat

SEQ ID NO: 3776605 - DNA, 20 bp, Homo sapiens
gacccctctggccaggatgg

SEQ ID NO: 3776606 - DNA, 12 bp, Homo sapiens
gacccctggctg

SEQ ID NO: 3776607 - DNA, 13 bp, Homo sapiens
gacccctgtctcc

SEQ ID NO: 3776608 - DNA, 12 bp, Homo sapiens
gacccctgtctt

SEQ ID NO: 3776609 - DNA, 21 bp, Homo sapiens
gacccggagctaacactggcc

SEQ ID NO: 3776610 - DNA, 22 bp, Homo sapiens
gacccggagctaacactggccc

SEQ ID NO: 3776611 - DNA, 17 bp, Homo sapiens
gaggaagagaaaaaata

SEQ ID NO: 3776612 - DNA, 19 bp, Homo sapiens
gaggaagagtgcaaaacat

SEQ ID NO: 3776613 - DNA, 21 bp, Homo sapiens
gaggaagctccagtcctgctc

SEQ ID NO: 3776614 - DNA, 20 bp, Homo sapiens
gaggaatcaacagggcagca

SEQ ID NO: 3776615 - DNA, 15 bp, Homo sapiens
gaggaatccagaccc

SEQ ID NO: 3776616 - DNA, 15 bp, Homo sapiens
gaggaatgctccccc

SEQ ID NO: 3776617 - DNA, 13 bp, Homo sapiens
gaggacagggagg

SEQ ID NO: 3776618 - DNA, 23 bp, Homo sapiens
gaggacagggaggtgaccccagg

SEQ ID NO: 3776619 - DNA, 15 bp, Homo sapiens
gaggacctctgggct

SEQ ID NO: 3776620 - DNA, 15 bp, Homo sapiens
gaggacgtgggcggc

SEQ ID NO: 3776621 - DNA, 22 bp, Homo sapiens
gaggacgtgggcggcagagagg

SEQ ID NO: 3776622 - DNA, 23 bp, Homo sapiens
gaggactgttgacatccaagctt

SEQ ID NO: 3776623 - DNA, 17 bp, Homo sapiens
gaggacttgtgtctctg

SEQ ID NO: 3776624 - DNA, 22 bp, Homo sapiens
gaggacttgtgtctctgtgctt

SEQ ID NO: 3776625 - DNA, 20 bp, Homo sapiens
gaggacttttctttgtggct

SEQ ID NO: 3776626 - DNA, 9 bp, Homo sapiens
gaggagaaa

SEQ ID NO: 3776627 - DNA, 20 bp, Homo sapiens
gaggagaagaattttcagac

SEQ ID NO: 3776628 - DNA, 18 bp, Homo sapiens
gaggagctcaggacacta

SEQ ID NO: 3776629 - DNA, 13 bp, Homo sapiens
gaggagctgctgg

SEQ ID NO: 3776630 - DNA, 21 bp, Homo sapiens
gaggagcttgggggatgacta

SEQ ID NO: 3776631 - DNA, 14 bp, Homo sapiens
gaggaggaggaggt

SEQ ID NO: 3776632 - DNA, 18 bp, Homo sapiens
gaggaggcaattgggatg

SEQ ID NO: 3776633 - DNA, 17 bp, Homo sapiens
gaggaggtttaggtcaa

SEQ ID NO: 3776634 - DNA, 20 bp, Homo sapiens
gaggagtttcctaaaagttc

SEQ ID NO: 3776635 - DNA, 16 bp, Homo sapiens
gaggatcactggagcc

SEQ ID NO: 3776636 - DNA, 16 bp, Homo sapiens
gaggatcagaaagtaa

SEQ ID NO: 3776637 - DNA, 19 bp, Homo sapiens
gaggatctcttgagcctgg

SEQ ID NO: 3776638 - DNA, 20 bp, Homo sapiens
gaggatgtcactcagatgga

SEQ ID NO: 3776639 - DNA, 12 bp, Homo sapiens
gaggatgttctg

SEQ ID NO: 3776640 - DNA, 17 bp, Homo sapiens
gaggatgttctgggaca

SEQ ID NO: 3776641 - DNA, 16 bp, Homo sapiens
gaggattctatgaggc

SEQ ID NO: 3776642 - DNA, 18 bp, Homo sapiens
gaggattgcttgagccca

SEQ ID NO: 3776643 - DNA, 16 bp, Homo sapiens
gaggattgcttgagct

SEQ ID NO: 3776644 - DNA, 17 bp, Homo sapiens
gaggatttcaagcctgc

SEQ ID NO: 3776645 - DNA, 13 bp, Homo sapiens
gaggcaagagaat

SEQ ID NO: 3776646 - DNA, 17 bp, Homo sapiens
gaggcacatgtcagcaa

SEQ ID NO: 3776647 - DNA, 19 bp, Homo sapiens
gaggcaccagtgtcctccc

SEQ ID NO: 3776648 - DNA, 18 bp, Homo sapiens
gaggcaccattcaggaac

SEQ ID NO: 3776649 - DNA, 21 bp, Homo sapiens
gaggcaccattcaggaacctg

SEQ ID NO: 3776650 - DNA, 15 bp, Homo sapiens
gaggcagacagcagc

SEQ ID NO: 3776651 - DNA, 21 bp, Homo sapiens
gaggcagacagcagctcaggc

SEQ ID NO: 3776652 - DNA, 16 bp, Homo sapiens
gaggcagagtgcccca

SEQ ID NO: 3776653 - DNA, 22 bp, Homo sapiens
gaggcagagtgccccacctgcc

SEQ ID NO: 3776654 - DNA, 13 bp, Homo sapiens
gaggcagccccat

SEQ ID NO: 3776655 - DNA, 19 bp, Homo sapiens
gaggcagccccattctgcc

SEQ ID NO: 3776656 - DNA, 23 bp, Homo sapiens
gaggcagccccattctgcctgcc

SEQ ID NO: 3776657 - DNA, 23 bp, Homo sapiens
gaggcaggaggattgcttgagcc

SEQ ID NO: 3776658 - DNA, 16 bp, Homo sapiens
gaggcagggaggggac

SEQ ID NO: 3776659 - DNA, 15 bp, Homo sapiens
gaggcaggggcggag

SEQ ID NO: 3776660 - DNA, 19 bp, Homo sapiens
gaggcagggtctcactctg

SEQ ID NO: 3776661 - DNA, 20 bp, Homo sapiens
gaggcagggtctcactctgt

SEQ ID NO: 3776662 - DNA, 22 bp, Homo sapiens
gaggcagggtctcactctgtcg

SEQ ID NO: 3776663 - DNA, 16 bp, Homo sapiens
gaggccagccccaccc

SEQ ID NO: 3776664 - DNA, 18 bp, Homo sapiens
gaggccagccccacccag

SEQ ID NO: 3776665 - DNA, 12 bp, Homo sapiens
gaggccaggagt

SEQ ID NO: 3776666 - DNA, 23 bp, Homo sapiens
gaggccatgattcgcccaaagcc

SEQ ID NO: 3776667 - DNA, 20 bp, Homo sapiens
gaggccatgggcctcctgtg

SEQ ID NO: 3776668 - DNA, 16 bp, Homo sapiens
gaggcctcagtggact

SEQ ID NO: 3776669 - DNA, 20 bp, Homo sapiens
gaggcggagcttgcagtgag

SEQ ID NO: 3776670 - DNA, 19 bp, Homo sapiens
gaggcgggtggatcacttg

SEQ ID NO: 3776671 - DNA, 20 bp, Homo sapiens
gaggctattattttcactgt

SEQ ID NO: 3776672 - DNA, 22 bp, Homo sapiens
gaggctctaattgaattttcaa

SEQ ID NO: 3776673 - DNA, 12 bp, Homo sapiens
gaggctgaggca

SEQ ID NO: 3776674 - DNA, 18 bp, Homo sapiens
gaggctgaggcaggagaa

SEQ ID NO: 3776675 - DNA, 18 bp, Homo sapiens
gaggctgaggtgggcaga

SEQ ID NO: 3776676 - DNA, 14 bp, Homo sapiens
gaggctgcctctcc

SEQ ID NO: 3776677 - DNA, 21 bp, Homo sapiens
gaggctggactccagatctgc

SEQ ID NO: 3776678 - DNA, 23 bp, Homo sapiens
gaggctggactccagatctgcac

SEQ ID NO: 3776679 - DNA, 15 bp, Homo sapiens
gaggctggcctcaga

SEQ ID NO: 3776680 - DNA, 23 bp, Homo sapiens
gaggctgggccaagccagggatg

SEQ ID NO: 3776681 - DNA, 15 bp, Homo sapiens
gaggcttaacaatgt

SEQ ID NO: 3776682 - DNA, 17 bp, Homo sapiens
gaggcttgtcagagctg

SEQ ID NO: 3776683 - DNA, 21 bp, Homo sapiens
gaggcttgtcagagctgggag

SEQ ID NO: 3776684 - DNA, 12 bp, Homo sapiens
gagggaccagcc

SEQ ID NO: 3776685 - DNA, 13 bp, Homo sapiens
gagggagaaggga

SEQ ID NO: 3776686 - DNA, 12 bp, Homo sapiens
gagggagatgga

SEQ ID NO: 3776687 - DNA, 16 bp, Homo sapiens
gagggagtgacagagg

SEQ ID NO: 3776688 - DNA, 18 bp, Homo sapiens
gagggagtgacagaggca

SEQ ID NO: 3776689 - DNA, 14 bp, Homo sapiens
gagggatcacaggg

SEQ ID NO: 3776690 - DNA, 20 bp, Homo sapiens
gagggatgctgcctgagtca

SEQ ID NO: 3776691 - DNA, 15 bp, Homo sapiens
gagggatgtggagca

SEQ ID NO: 3776692 - DNA, 12 bp, Homo sapiens
gagggcactggt

SEQ ID NO: 3776693 - DNA, 16 bp, Homo sapiens
gagggcactggtggcc

SEQ ID NO: 3776694 - DNA, 18 bp, Homo sapiens
gagggcactggtggcccg

SEQ ID NO: 3776695 - DNA, 22 bp, Homo sapiens
gagggctccctatgttgcccag

SEQ ID NO: 3776696 - DNA, 19 bp, Homo sapiens
gaggggaataatagaagaa

SEQ ID NO: 3776697 - DNA, 13 bp, Homo sapiens
gaggggagctctg

SEQ ID NO: 3776698 - DNA, 18 bp, Homo sapiens
gaggggagctctgtctgt

SEQ ID NO: 3776699 - DNA, 22 bp, Homo sapiens
gaggggcatctgcccctccccc

SEQ ID NO: 3776700 - DNA, 14 bp, Homo sapiens
gaggggcctcaggt

SEQ ID NO: 3776701 - DNA, 18 bp, Homo sapiens
gaggggcctggcagccgt

SEQ ID NO: 3776702 - DNA, 21 bp, Homo sapiens
gaggggcggcaggagggaggt

SEQ ID NO: 3776703 - DNA, 15 bp, Homo sapiens
gaggggctcctggaa

SEQ ID NO: 3776704 - DNA, 17 bp, Homo sapiens
gaggggctttctggaga

SEQ ID NO: 3776705 - DNA, 18 bp, Homo sapiens
gagggggccacctcccca

SEQ ID NO: 3776706 - DNA, 20 bp, Homo sapiens
gagggggccacctccccagg

SEQ ID NO: 3776707 - DNA, 21 bp, Homo sapiens
gagggggctatagctacagga

SEQ ID NO: 3776708 - DNA, 15 bp, Homo sapiens
gagggggttacaaac

SEQ ID NO: 3776709 - DNA, 20 bp, Homo sapiens
gagggggttacaaactgcaa

SEQ ID NO: 3776710 - DNA, 15 bp, Homo sapiens
gagggtcagagagga

SEQ ID NO: 3776711 - DNA, 17 bp, Homo sapiens
gagggtcctggctcctg

SEQ ID NO: 3776712 - DNA, 13 bp, Homo sapiens
gagggtgctgccc

SEQ ID NO: 3776713 - DNA, 13 bp, Homo sapiens
gagggtggcaggt

SEQ ID NO: 3776714 - DNA, 14 bp, Homo sapiens
gagggtggtgacct

SEQ ID NO: 3776715 - DNA, 21 bp, Homo sapiens
gagggtggtgacctctgcctg

SEQ ID NO: 3776716 - DNA, 14 bp, Homo sapiens
gagggttggggagg

SEQ ID NO: 3776717 - DNA, 17 bp, Homo sapiens
gagggttgttctcctag

SEQ ID NO: 3776718 - DNA, 16 bp, Homo sapiens
gaggtagttaagggat

SEQ ID NO: 3776719 - DNA, 13 bp, Homo sapiens
gaggtatgaggtc

SEQ ID NO: 3776720 - DNA, 18 bp, Homo sapiens
gaggtatggaaagaacca

SEQ ID NO: 3776721 - DNA, 15 bp, Homo sapiens
gaggtcaacagagaa

SEQ ID NO: 3776722 - DNA, 16 bp, Homo sapiens
gaggtcaacagagaag

SEQ ID NO: 3776723 - DNA, 15 bp, Homo sapiens
gaggtcaagcccagg

SEQ ID NO: 3776724 - DNA, 21 bp, Homo sapiens
gattttaaattcacaatagaa

SEQ ID NO: 3776725 - DNA, 23 bp, Homo sapiens
gattttaacaataactactgtgt

SEQ ID NO: 3776726 - DNA, 15 bp, Homo sapiens
gattttaattttgaa

SEQ ID NO: 3776727 - DNA, 11 bp, Homo sapiens
gattttcagcc

SEQ ID NO: 3776728 - DNA, 21 bp, Homo sapiens
gattttgaaatttttattaaa

SEQ ID NO: 3776729 - DNA, 19 bp, Homo sapiens
gattttgatccaagctggt

SEQ ID NO: 3776730 - DNA, 14 bp, Homo sapiens
gatttttatccaat

SEQ ID NO: 3776731 - DNA, 20 bp, Homo sapiens
gattttttacagctgcctgc

SEQ ID NO: 3776732 - DNA, 21 bp, Homo sapiens
gatttttttttagaacagaaa

SEQ ID NO: 3776733 - DNA, 23 bp, Homo sapiens
gatttttttttagaacagaaaac

SEQ ID NO: 3776734 - DNA, 17 bp, Homo sapiens
gcaaaaacgaaagctgg

SEQ ID NO: 3776735 - DNA, 14 bp, Homo sapiens
gcaaaaaggcagga

SEQ ID NO: 3776736 - DNA, 17 bp, Homo sapiens
gcaaaacatgctacctg

SEQ ID NO: 3776737 - DNA, 17 bp, Homo sapiens
gcaaaaccattgcttca

SEQ ID NO: 3776738 - DNA, 16 bp, Homo sapiens
gcaaaagatgcttctc

SEQ ID NO: 3776739 - DNA, 21 bp, Homo sapiens
gcaaaaggcagtggggctggg

SEQ ID NO: 3776740 - DNA, 20 bp, Homo sapiens
gcaaaaggttcactaaagca

SEQ ID NO: 3776741 - DNA, 21 bp, Homo sapiens
gcaaaaggttcactaaagcag

SEQ ID NO: 3776742 - DNA, 16 bp, Homo sapiens
gcaaaattttatagct

SEQ ID NO: 3776743 - DNA, 13 bp, Homo sapiens
gcaaacacctgct

SEQ ID NO: 3776744 - DNA, 21 bp, Homo sapiens
gcaaagactattcccttctaa

SEQ ID NO: 3776745 - DNA, 13 bp, Homo sapiens
gcaaagaggcaag

SEQ ID NO: 3776746 - DNA, 12 bp, Homo sapiens
gcaaagcattga

SEQ ID NO: 3776747 - DNA, 20 bp, Homo sapiens
gcaaaggactgttttttcct

SEQ ID NO: 3776748 - DNA, 20 bp, Homo sapiens
gcaaagtgaagacactggct

SEQ ID NO: 3776749 - DNA, 17 bp, Homo sapiens
gcaaatagaaaacagga

SEQ ID NO: 3776750 - DNA, 21 bp, Homo sapiens
gcaaatagaaaacaggaaaaa

SEQ ID NO: 3776751 - DNA, 23 bp, Homo sapiens
gcaaatggtggttgtttcttcca

SEQ ID NO: 3776752 - DNA, 13 bp, Homo sapiens
gcaaatttataat

SEQ ID NO: 3776753 - DNA, 16 bp, Homo sapiens
gcaaatttataatttt

SEQ ID NO: 3776754 - DNA, 17 bp, Homo sapiens
gcaacagtagcatagga

SEQ ID NO: 3776755 - DNA, 23 bp, Homo sapiens
gcaacatgcttcatgaaaatcct

SEQ ID NO: 3776756 - DNA, 20 bp, Homo sapiens
gcaaccacaggcagcattta

SEQ ID NO: 3776757 - DNA, 16 bp, Homo sapiens
gcaaccagagcactgt

SEQ ID NO: 3776758 - DNA, 18 bp, Homo sapiens
gcaaccagagcactgtat

SEQ ID NO: 3776759 - DNA, 17 bp, Homo sapiens
gcaacccccagcctgct

SEQ ID NO: 3776760 - DNA, 18 bp, Homo sapiens
gcaacctccgcctcttgg

SEQ ID NO: 3776761 - DNA, 20 bp, Homo sapiens
gcaacctccgcctcttgggt

SEQ ID NO: 3776762 - DNA, 23 bp, Homo sapiens
gcaacgaagaaaaaaaataacac

SEQ ID NO: 3776763 - DNA, 18 bp, Homo sapiens
gcaactgcattggctttg

SEQ ID NO: 3776764 - DNA, 22 bp, Homo sapiens
gcaacttgtctttttctggact

SEQ ID NO: 3776765 - DNA, 14 bp, Homo sapiens
gcaagaaggaattg

SEQ ID NO: 3776766 - DNA, 19 bp, Homo sapiens
gcaagagaattgcttgaac

SEQ ID NO: 3776767 - DNA, 14 bp, Homo sapiens
gcaagagagatgtt

SEQ ID NO: 3776768 - DNA, 13 bp, Homo sapiens
gcaagagccttgg

SEQ ID NO: 3776769 - DNA, 22 bp, Homo sapiens
gcaagagccttggtgtccacct

SEQ ID NO: 3776770 - DNA, 14 bp, Homo sapiens
gcaagattgcttaa

SEQ ID NO: 3776771 - DNA, 18 bp, Homo sapiens
gcaagcaagaaacactgg

SEQ ID NO: 3776772 - DNA, 19 bp, Homo sapiens
gcaagcctgtaatcccagc

SEQ ID NO: 3776773 - DNA, 13 bp, Homo sapiens
gcaagctgggtaa

SEQ ID NO: 3776774 - DNA, 22 bp, Homo sapiens
gcaagcttggctgtagaaggag

SEQ ID NO: 3776775 - DNA, 15 bp, Homo sapiens
gcaaggaaggaaaga

SEQ ID NO: 3776776 - DNA, 15 bp, Homo sapiens
gcaaggaccaggact

SEQ ID NO: 3776777 - DNA, 21 bp, Homo sapiens
gcaaggaccaggactccctcc

SEQ ID NO: 3776778 - DNA, 16 bp, Homo sapiens
gcaaggggaaaatctc

SEQ ID NO: 3776779 - DNA, 14 bp, Homo sapiens
gcaaggggtgcctg

SEQ ID NO: 3776780 - DNA, 16 bp, Homo sapiens
gcaaggggtgcctggg

SEQ ID NO: 3776781 - DNA, 18 bp, Homo sapiens
gcaaggtggagtggatgc

SEQ ID NO: 3776782 - DNA, 23 bp, Homo sapiens
gcaaggtggagtggatgcctcag

SEQ ID NO: 3776783 - DNA, 18 bp, Homo sapiens
gcaagtagctttccacat

SEQ ID NO: 3776784 - DNA, 20 bp, Homo sapiens
gcaagtcacaaaggaatgga

SEQ ID NO: 3776785 - DNA, 12 bp, Homo sapiens
gcaagtcaggac

SEQ ID NO: 3776786 - DNA, 15 bp, Homo sapiens
gcaagtgagagctgg

SEQ ID NO: 3776787 - DNA, 12 bp, Homo sapiens
gcaataaatgaa

SEQ ID NO: 3776788 - DNA, 13 bp, Homo sapiens
gcaatccatgtta

SEQ ID NO: 3776789 - DNA, 13 bp, Homo sapiens
gcaatcctcctga

SEQ ID NO: 3776790 - DNA, 14 bp, Homo sapiens
gcaatcctcctgag

SEQ ID NO: 3776791 - DNA, 15 bp, Homo sapiens
gcaatgaaaaattct

SEQ ID NO: 3776792 - DNA, 16 bp, Homo sapiens
gcaatgaaaaattctc

SEQ ID NO: 3776793 - DNA, 13 bp, Homo sapiens
gcaatgaaggaaa

SEQ ID NO: 3776794 - DNA, 20 bp, Homo sapiens
gcaatgagtgtgttggcttg

SEQ ID NO: 3776795 - DNA, 14 bp, Homo sapiens
gcaatgctggctgt

SEQ ID NO: 3776796 - DNA, 18 bp, Homo sapiens
gcaatgtcacaacctctc

SEQ ID NO: 3776797 - DNA, 14 bp, Homo sapiens
gcaatgtgataaaa

SEQ ID NO: 3776798 - DNA, 14 bp, Homo sapiens
gcaattgggatggc

SEQ ID NO: 3776799 - DNA, 16 bp, Homo sapiens
gcaatttatacaatat

SEQ ID NO: 3776800 - DNA, 19 bp, Homo sapiens
gcaatttatacaatatcat

SEQ ID NO: 3776801 - DNA, 16 bp, Homo sapiens
gcacaaatatttattt

SEQ ID NO: 3776802 - DNA, 12 bp, Homo sapiens
gcacacacacac

SEQ ID NO: 3776803 - DNA, 16 bp, Homo sapiens
gcacacacacacacag

SEQ ID NO: 3776804 - DNA, 20 bp, Homo sapiens
gcacacacacacacaggagg

SEQ ID NO: 3776805 - DNA, 12 bp, Homo sapiens
gcacacaccaga

SEQ ID NO: 3776806 - DNA, 16 bp, Homo sapiens
gcacacaccagagccc

SEQ ID NO: 3776807 - DNA, 19 bp, Homo sapiens
gcacacaccagagcccacc

SEQ ID NO: 3776808 - DNA, 13 bp, Homo sapiens
gcacacacctgta

SEQ ID NO: 3776809 - DNA, 21 bp, Homo sapiens
gcacacacctgtagtcccagc

SEQ ID NO: 3776810 - DNA, 23 bp, Homo sapiens
gcacacagcttttagtacccacc

SEQ ID NO: 3776811 - DNA, 13 bp, Homo sapiens
gcacactgtctgc

SEQ ID NO: 3776812 - DNA, 13 bp, Homo sapiens
gcacagaaaacta

SEQ ID NO: 3776813 - DNA, 22 bp, Homo sapiens
gcacagatggatttgcctgtgc

SEQ ID NO: 3776814 - DNA, 21 bp, Homo sapiens
gcacagcggggccccagggct

SEQ ID NO: 3776815 - DNA, 21 bp, Homo sapiens
gcacagcttcatttcctgtgt

SEQ ID NO: 3776816 - DNA, 14 bp, Homo sapiens
gcacagtgcctgca

SEQ ID NO: 3776817 - DNA, 19 bp, Homo sapiens
gcacatccaggcaatggcc

SEQ ID NO: 3776818 - DNA, 13 bp, Homo sapiens
gcacatccctgga

SEQ ID NO: 3776819 - DNA, 13 bp, Homo sapiens
gcacatctgcatt

SEQ ID NO: 3776820 - DNA, 19 bp, Homo sapiens
gcacatgcctgtagtccca

SEQ ID NO: 3776821 - DNA, 12 bp, Homo sapiens
gcacatgtgtgc

SEQ ID NO: 3776822 - DNA, 16 bp, Homo sapiens
gcacatttccccagac

SEQ ID NO: 3776823 - DNA, 17 bp, Homo sapiens
gcaccaagagccaatgg

SEQ ID NO: 3776824 - DNA, 16 bp, Homo sapiens
gcaccaagcccacagg

SEQ ID NO: 3776825 - DNA, 14 bp, Homo sapiens
gcaccaccaggtct

SEQ ID NO: 3776826 - DNA, 20 bp, Homo sapiens
gcaccactgcactccagcct

SEQ ID NO: 3776827 - DNA, 23 bp, Homo sapiens
gcaccactgcactccagcctggg

SEQ ID NO: 3776828 - DNA, 14 bp, Homo sapiens
gcaccagcagcctg

SEQ ID NO: 3776829 - DNA, 21 bp, Homo sapiens
gcaccaggcacgaacccacct

SEQ ID NO: 3776830 - DNA, 23 bp, Homo sapiens
gcaccaggcacgaacccacctgc

SEQ ID NO: 3776831 - DNA, 15 bp, Homo sapiens
gcaccattcaggaac

SEQ ID NO: 3776832 - DNA, 16 bp, Homo sapiens
gcaccattcaggaacc

SEQ ID NO: 3776833 - DNA, 14 bp, Homo sapiens
gcaccattgctgct

SEQ ID NO: 3776834 - DNA, 22 bp, Homo sapiens
gcaccattgctgctccttagct

SEQ ID NO: 3776835 - DNA, 19 bp, Homo sapiens
gcacccacccagcacccag

SEQ ID NO: 3776836 - DNA, 22 bp, Homo sapiens
gcacccacccagcacccagcaa

SEQ ID NO: 3776837 - DNA, 15 bp, Homo sapiens
gccatctgtgggcac

SEQ ID NO: 3776838 - DNA, 18 bp, Homo sapiens
gccatctgtgtcctggtt

SEQ ID NO: 3776839 - DNA, 16 bp, Homo sapiens
gccatgaactggaggc

SEQ ID NO: 3776840 - DNA, 23 bp, Homo sapiens
gccatgagctccagacccccagc

SEQ ID NO: 3776841 - DNA, 16 bp, Homo sapiens
gccatgaggcctcagt

SEQ ID NO: 3776842 - DNA, 20 bp, Homo sapiens
gccatgattcgcccaaagcc

SEQ ID NO: 3776843 - DNA, 14 bp, Homo sapiens
gccatgccaccctg

SEQ ID NO: 3776844 - DNA, 16 bp, Homo sapiens
gccatggaggcacaca

SEQ ID NO: 3776845 - DNA, 22 bp, Homo sapiens
gccatgttggccaggctggtct

SEQ ID NO: 3776846 - DNA, 14 bp, Homo sapiens
gccatgtttaagat

SEQ ID NO: 3776847 - DNA, 17 bp, Homo sapiens
gccatgtttaagattta

SEQ ID NO: 3776848 - DNA, 16 bp, Homo sapiens
gccattctcaagccct

SEQ ID NO: 3776849 - DNA, 14 bp, Homo sapiens
gccattgcactcca

SEQ ID NO: 3776850 - DNA, 15 bp, Homo sapiens
gccattgcactccag

SEQ ID NO: 3776851 - DNA, 18 bp, Homo sapiens
gccattgcactccagcct

SEQ ID NO: 3776852 - DNA, 19 bp, Homo sapiens
gccattgccaccaggagaa

SEQ ID NO: 3776853 - DNA, 12 bp, Homo sapiens
gccattgtcttt

SEQ ID NO: 3776854 - DNA, 13 bp, Homo sapiens
gccattgtcttta

SEQ ID NO: 3776855 - DNA, 20 bp, Homo sapiens
gccatttgcaccctccgcct

SEQ ID NO: 3776856 - DNA, 21 bp, Homo sapiens
gcccaaattatcaagctaata

SEQ ID NO: 3776857 - DNA, 23 bp, Homo sapiens
gcccaaattatcaagctaataaa

SEQ ID NO: 3776858 - DNA, 23 bp, Homo sapiens
gcccaaccggggagcccccgccc

SEQ ID NO: 3776859 - DNA, 17 bp, Homo sapiens
gcccaacctcagcaacc

SEQ ID NO: 3776860 - DNA, 14 bp, Homo sapiens
gcccaacctgctct

SEQ ID NO: 3776861 - DNA, 21 bp, Homo sapiens
gcccaagaatagatgctgact

SEQ ID NO: 3776862 - DNA, 13 bp, Homo sapiens
gcccacacacccc

SEQ ID NO: 3776863 - DNA, 22 bp, Homo sapiens
gcccacagcccgcatgcagcag

SEQ ID NO: 3776864 - DNA, 16 bp, Homo sapiens
gcccacagctcccacc

SEQ ID NO: 3776865 - DNA, 12 bp, Homo sapiens
gcccacagtctg

SEQ ID NO: 3776866 - DNA, 23 bp, Homo sapiens
gcccacatgtgtccatcccagcg

SEQ ID NO: 3776867 - DNA, 22 bp, Homo sapiens
gcccacctaccttcaaagctga

SEQ ID NO: 3776868 - DNA, 13 bp, Homo sapiens
gcccacctgccca

SEQ ID NO: 3776869 - DNA, 17 bp, Homo sapiens
gcccacgctggagtgca

SEQ ID NO: 3776870 - DNA, 19 bp, Homo sapiens
gcccacgctggagtgcagt

SEQ ID NO: 3776871 - DNA, 13 bp, Homo sapiens
gcccacttctgcc

SEQ ID NO: 3776872 - DNA, 23 bp, Homo sapiens
gcccagaattcccagctgtctgt

SEQ ID NO: 3776873 - DNA, 16 bp, Homo sapiens
gcccagacccctctgg

SEQ ID NO: 3776874 - DNA, 21 bp, Homo sapiens
gcccagacccctctggccagg

SEQ ID NO: 3776875 - DNA, 15 bp, Homo sapiens
gcccagagagggtgg

SEQ ID NO: 3776876 - DNA, 17 bp, Homo sapiens
gcccagagatgcctcca

SEQ ID NO: 3776877 - DNA, 12 bp, Homo sapiens
gcccagagctgg

SEQ ID NO: 3776878 - DNA, 19 bp, Homo sapiens
gcccagagctgggtgagtg

SEQ ID NO: 3776879 - DNA, 15 bp, Homo sapiens
gcccagatcccagaa

SEQ ID NO: 3776880 - DNA, 21 bp, Homo sapiens
gcccagccattaccatggaga

SEQ ID NO: 3776881 - DNA, 22 bp, Homo sapiens
gcccagccattaccatggagac

SEQ ID NO: 3776882 - DNA, 16 bp, Homo sapiens
gcccagcccagctgct

SEQ ID NO: 3776883 - DNA, 15 bp, Homo sapiens
gcccagcccagctgg

SEQ ID NO: 3776884 - DNA, 12 bp, Homo sapiens
gcccagctcagt

SEQ ID NO: 3776885 - DNA, 14 bp, Homo sapiens
gcccagctccaggg

SEQ ID NO: 3776886 - DNA, 15 bp, Homo sapiens
gcccagctccagggc

SEQ ID NO: 3776887 - DNA, 18 bp, Homo sapiens
gcccagctccagggccag

SEQ ID NO: 3776888 - DNA, 23 bp, Homo sapiens
gcccagctgcacctgccagcctg

SEQ ID NO: 3776889 - DNA, 11 bp, Homo sapiens
gcccagctgct

SEQ ID NO: 3776890 - DNA, 13 bp, Homo sapiens
gcccagctgctct

SEQ ID NO: 3776891 - DNA, 18 bp, Homo sapiens
gcccagctgctctgccca

SEQ ID NO: 3776892 - DNA, 18 bp, Homo sapiens
gcccaggagagccagccc

SEQ ID NO: 3776893 - DNA, 20 bp, Homo sapiens
gcccaggagagccagccctc

SEQ ID NO: 3776894 - DNA, 13 bp, Homo sapiens
gcccaggcaggtc

SEQ ID NO: 3776895 - DNA, 11 bp, Homo sapiens
gcccaggcccc

SEQ ID NO: 3776896 - DNA, 21 bp, Homo sapiens
gcccaggcctccagctcagca

SEQ ID NO: 3776897 - DNA, 15 bp, Homo sapiens
gcccaggctggcgtg

SEQ ID NO: 3776898 - DNA, 16 bp, Homo sapiens
gcccaggctggcgtgc

SEQ ID NO: 3776899 - DNA, 16 bp, Homo sapiens
gcccagggagcggaaa

SEQ ID NO: 3776900 - DNA, 17 bp, Homo sapiens
gcccagggagcggaaag

SEQ ID NO: 3776901 - DNA, 20 bp, Homo sapiens
gcccagggccactctgcctc

SEQ ID NO: 3776902 - DNA, 15 bp, Homo sapiens
gcccagggctcagcc

SEQ ID NO: 3776903 - DNA, 16 bp, Homo sapiens
gcccagggctcagcct

SEQ ID NO: 3776904 - DNA, 16 bp, Homo sapiens
gcccagggttccccca

SEQ ID NO: 3776905 - DNA, 21 bp, Homo sapiens
gcccagggttcccccagccct

SEQ ID NO: 3776906 - DNA, 22 bp, Homo sapiens
gcccagggttcccccagccctg

SEQ ID NO: 3776907 - DNA, 18 bp, Homo sapiens
gcccagtgttgtttgtaa

SEQ ID NO: 3776908 - DNA, 23 bp, Homo sapiens
gcccagtgttgtttgtaaataag

SEQ ID NO: 3776909 - DNA, 15 bp, Homo sapiens
gcccagttaatcttg

SEQ ID NO: 3776910 - DNA, 21 bp, Homo sapiens
gcccagttgggtggatgcctg

SEQ ID NO: 3776911 - DNA, 17 bp, Homo sapiens
gcccatcaattatagaa

SEQ ID NO: 3776912 - DNA, 17 bp, Homo sapiens
gcccatcacagggttgg

SEQ ID NO: 3776913 - DNA, 18 bp, Homo sapiens
gcccatcctgtctgttca

SEQ ID NO: 3776914 - DNA, 22 bp, Homo sapiens
gcccatctatgtcccttgctgt

SEQ ID NO: 3776915 - DNA, 20 bp, Homo sapiens
gcccatcttgcctccatggt

SEQ ID NO: 3776916 - DNA, 14 bp, Homo sapiens
gcccatgcccacct

SEQ ID NO: 3776917 - DNA, 15 bp, Homo sapiens
gcccatgcccacctg

SEQ ID NO: 3776918 - DNA, 13 bp, Homo sapiens
gcccatgtgtgag

SEQ ID NO: 3776919 - DNA, 22 bp, Homo sapiens
gcccatttcacacctgaaaatg

SEQ ID NO: 3776920 - DNA, 19 bp, Homo sapiens
gccccaaaaccacagccct

SEQ ID NO: 3776921 - DNA, 20 bp, Homo sapiens
gccccaaacgggctgccctg

SEQ ID NO: 3776922 - DNA, 15 bp, Homo sapiens
gccccaactcctgga

SEQ ID NO: 3776923 - DNA, 18 bp, Homo sapiens
gccccaactcctggaagc

SEQ ID NO: 3776924 - DNA, 22 bp, Homo sapiens
gccccaactcctggaagctgtg

SEQ ID NO: 3776925 - DNA, 21 bp, Homo sapiens
gccccaagaaggctggggcta

SEQ ID NO: 3776926 - DNA, 22 bp, Homo sapiens
gccccaaggggtttctgtttct

SEQ ID NO: 3776927 - DNA, 18 bp, Homo sapiens
gccccaccacctaggcca

SEQ ID NO: 3776928 - DNA, 12 bp, Homo sapiens
gccccacctgcc

SEQ ID NO: 3776929 - DNA, 15 bp, Homo sapiens
gccccacctgccact

SEQ ID NO: 3776930 - DNA, 17 bp, Homo sapiens
gccccacctgccactag

SEQ ID NO: 3776931 - DNA, 15 bp, Homo sapiens
gccccagaaggcagg

SEQ ID NO: 3776932 - DNA, 17 bp, Homo sapiens
gccccagagactcagag

SEQ ID NO: 3776933 - DNA, 14 bp, Homo sapiens
gccccagagctgtt

SEQ ID NO: 3776934 - DNA, 22 bp, Homo sapiens
gccccagagctgtttatggcct

SEQ ID NO: 3776935 - DNA, 19 bp, Homo sapiens
gccccagcaccaccaggtc

SEQ ID NO: 3776936 - DNA, 19 bp, Homo sapiens
gccccagcactaaagcagt

SEQ ID NO: 3776937 - DNA, 14 bp, Homo sapiens
gccccagctctggc

SEQ ID NO: 3776938 - DNA, 18 bp, Homo sapiens
gccccagggctaccctcc

SEQ ID NO: 3776939 - DNA, 17 bp, Homo sapiens
gccccagggtcttccct

SEQ ID NO: 3776940 - DNA, 23 bp, Homo sapiens
gccccagggtcttccctacctca

SEQ ID NO: 3776941 - DNA, 14 bp, Homo sapiens
gccccagtgccaag

SEQ ID NO: 3776942 - DNA, 16 bp, Homo sapiens
gccccagtgcccacag

SEQ ID NO: 3776943 - DNA, 15 bp, Homo sapiens
gccccatcagctcca

SEQ ID NO: 3776944 - DNA, 16 bp, Homo sapiens
gccccatgtctctcag

SEQ ID NO: 3776945 - DNA, 14 bp, Homo sapiens
gccccattctgcct

SEQ ID NO: 3776946 - DNA, 17 bp, Homo sapiens
gccccattctgcctgcc

SEQ ID NO: 3776947 - DNA, 20 bp, Homo sapiens
gccccattctgcctgcccag

SEQ ID NO: 3776948 - DNA, 21 bp, Homo sapiens
gccccattctgcctgcccagg

SEQ ID NO: 3776949 - DNA, 23 bp, Homo sapiens
gccccattctgcctgcccaggcc

SEQ ID NO: 3776950 - DNA, 19 bp, Homo sapiens
gcggacagccacggccagg

SEQ ID NO: 3776951 - DNA, 14 bp, Homo sapiens
gcggacgggctgtc

SEQ ID NO: 3776952 - DNA, 15 bp, Homo sapiens
gcggaggttgcaggg

SEQ ID NO: 3776953 - DNA, 12 bp, Homo sapiens
gcggcagagagg

SEQ ID NO: 3776954 - DNA, 14 bp, Homo sapiens
gcggcaggagggag

SEQ ID NO: 3776955 - DNA, 15 bp, Homo sapiens
gcggccgcattccct

SEQ ID NO: 3776956 - DNA, 20 bp, Homo sapiens
gcggcctttgttgctcagca

SEQ ID NO: 3776957 - DNA, 19 bp, Homo sapiens
gcggctactcagcagccct

SEQ ID NO: 3776958 - DNA, 21 bp, Homo sapiens
gcggctactcagcagccctcc

SEQ ID NO: 3776959 - DNA, 19 bp, Homo sapiens
gcggctcaaaaggaaacca

SEQ ID NO: 3776960 - DNA, 20 bp, Homo sapiens
gcgggaccggtacagaaagg

SEQ ID NO: 3776961 - DNA, 23 bp, Homo sapiens
gcgggacgagaccctacaggaga

SEQ ID NO: 3776962 - DNA, 17 bp, Homo sapiens
gcgggccaaggactgcc

SEQ ID NO: 3776963 - DNA, 12 bp, Homo sapiens
gcggggacagct

SEQ ID NO: 3776964 - DNA, 13 bp, Homo sapiens
gcggtccacccag

SEQ ID NO: 3776965 - DNA, 18 bp, Homo sapiens
gcggtccacccaggagcc

SEQ ID NO: 3776966 - DNA, 22 bp, Homo sapiens
gcggtcccctccgccaggcgag

SEQ ID NO: 3776967 - DNA, 17 bp, Homo sapiens
gcgtccttccccctgta

SEQ ID NO: 3776968 - DNA, 23 bp, Homo sapiens
gcgtctcccatcttaactctttg

SEQ ID NO: 3776969 - DNA, 11 bp, Homo sapiens
gcgtgaaacac

SEQ ID NO: 3776970 - DNA, 13 bp, Homo sapiens
gcgtgaaggccga

SEQ ID NO: 3776971 - DNA, 14 bp, Homo sapiens
gcgtgactcaccca

SEQ ID NO: 3776972 - DNA, 18 bp, Homo sapiens
gcgtgcacacaccagagc

SEQ ID NO: 3776973 - DNA, 20 bp, Homo sapiens
gcgtgcacacaccagagccc

SEQ ID NO: 3776974 - DNA, 15 bp, Homo sapiens
gcgtggttcctttct

SEQ ID NO: 3776975 - DNA, 14 bp, Homo sapiens
gcgtgtggctcacg

SEQ ID NO: 3776976 - DNA, 18 bp, Homo sapiens
gcgttagaatgaggagga

SEQ ID NO: 3776977 - DNA, 22 bp, Homo sapiens
gcgttagaatgaggaggaagga

SEQ ID NO: 3776978 - DNA, 21 bp, Homo sapiens
gctaacccccttctactgagc

SEQ ID NO: 3776979 - DNA, 19 bp, Homo sapiens
gctaagagtgtcctaggag

SEQ ID NO: 3776980 - DNA, 18 bp, Homo sapiens
gctaagcttaaaaaaaac

SEQ ID NO: 3776981 - DNA, 17 bp, Homo sapiens
gctaataaaatatcatt

SEQ ID NO: 3776982 - DNA, 18 bp, Homo sapiens
gctaataaaatatcattc

SEQ ID NO: 3776983 - DNA, 17 bp, Homo sapiens
gctaattattttaatta

SEQ ID NO: 3776984 - DNA, 20 bp, Homo sapiens
gctaatttatcctgaaattt

SEQ ID NO: 3776985 - DNA, 19 bp, Homo sapiens
gctacaggaagcaccccat

SEQ ID NO: 3776986 - DNA, 23 bp, Homo sapiens
gctacagggcgagactctgtctc

SEQ ID NO: 3776987 - DNA, 17 bp, Homo sapiens
gctacccacttctaaat

SEQ ID NO: 3776988 - DNA, 21 bp, Homo sapiens
gctacccaggaggctgaggtg

SEQ ID NO: 3776989 - DNA, 17 bp, Homo sapiens
gctacctcaagggggac

SEQ ID NO: 3776990 - DNA, 14 bp, Homo sapiens
gctacctcactggg

SEQ ID NO: 3776991 - DNA, 18 bp, Homo sapiens
gctacctgatcccactcc

SEQ ID NO: 3776992 - DNA, 18 bp, Homo sapiens
gctactaatgatgttttc

SEQ ID NO: 3776993 - DNA, 22 bp, Homo sapiens
gctactcactcaagttcaagga

SEQ ID NO: 3776994 - DNA, 19 bp, Homo sapiens
gctactcagaagcctgagg

SEQ ID NO: 3776995 - DNA, 21 bp, Homo sapiens
gctactcagaagcctgaggct

SEQ ID NO: 3776996 - DNA, 11 bp, Homo sapiens
gctactcagca

SEQ ID NO: 3776997 - DNA, 14 bp, Homo sapiens
gctactccggaggc

SEQ ID NO: 3776998 - DNA, 18 bp, Homo sapiens
gctagaggaagcagccaa

SEQ ID NO: 3776999 - DNA, 18 bp, Homo sapiens
gctagaggccagccccac

SEQ ID NO: 3777000 - DNA, 20 bp, Homo sapiens
gctagaggccagccccaccc

SEQ ID NO: 3777001 - DNA, 20 bp, Homo sapiens
gctagagtcctcactcccag

SEQ ID NO: 3777002 - DNA, 23 bp, Homo sapiens
gctagcagaaatctagaagactg

SEQ ID NO: 3777003 - DNA, 14 bp, Homo sapiens
gctagcgctgccgc

SEQ ID NO: 3777004 - DNA, 23 bp, Homo sapiens
gctagcgctgccgcaccccagag

SEQ ID NO: 3777005 - DNA, 12 bp, Homo sapiens
gctaggaatgaa

SEQ ID NO: 3777006 - DNA, 13 bp, Homo sapiens
gctaggaatgaaa

SEQ ID NO: 3777007 - DNA, 18 bp, Homo sapiens
gctaggaatgaaatcctg

SEQ ID NO: 3777008 - DNA, 20 bp, Homo sapiens
gctaggacccctccatgtgg

SEQ ID NO: 3777009 - DNA, 18 bp, Homo sapiens
gctaggatgttgctcaga

SEQ ID NO: 3777010 - DNA, 14 bp, Homo sapiens
gctaggcctggcca

SEQ ID NO: 3777011 - DNA, 15 bp, Homo sapiens
gctaggcctggccag

SEQ ID NO: 3777012 - DNA, 16 bp, Homo sapiens
gctaggcctggccaga

SEQ ID NO: 3777013 - DNA, 19 bp, Homo sapiens
gctaggtgctaattaataa

SEQ ID NO: 3777014 - DNA, 19 bp, Homo sapiens
gctaggtgggccagcccct

SEQ ID NO: 3777015 - DNA, 20 bp, Homo sapiens
gctaggtgggccagcccctc

SEQ ID NO: 3777016 - DNA, 21 bp, Homo sapiens
gctaggtgggccagcccctcc

SEQ ID NO: 3777017 - DNA, 15 bp, Homo sapiens
gctagtctttcacag

SEQ ID NO: 3777018 - DNA, 14 bp, Homo sapiens
gctagttgaatcta

SEQ ID NO: 3777019 - DNA, 14 bp, Homo sapiens
gctagttgggcttc

SEQ ID NO: 3777020 - DNA, 21 bp, Homo sapiens
gctagttgggcttcctcatag

SEQ ID NO: 3777021 - DNA, 17 bp, Homo sapiens
gctatatccatgtactg

SEQ ID NO: 3777022 - DNA, 18 bp, Homo sapiens
gctatatccatgtactgt

SEQ ID NO: 3777023 - DNA, 21 bp, Homo sapiens
gctatatccatgtactgtagt

SEQ ID NO: 3777024 - DNA, 21 bp, Homo sapiens
gctatatttaagtattcaaga

SEQ ID NO: 3777025 - DNA, 23 bp, Homo sapiens
gctatctctcagtgaactgtgag

SEQ ID NO: 3777026 - DNA, 13 bp, Homo sapiens
gctatctctgtgt

SEQ ID NO: 3777027 - DNA, 18 bp, Homo sapiens
gctatggatggcttctaa

SEQ ID NO: 3777028 - DNA, 22 bp, Homo sapiens
gctatggattttctaaggaaga

SEQ ID NO: 3777029 - DNA, 18 bp, Homo sapiens
gctatgggagccccaggg

SEQ ID NO: 3777030 - DNA, 19 bp, Homo sapiens
gctatgggagccccagggt

SEQ ID NO: 3777031 - DNA, 18 bp, Homo sapiens
gctatggggagaaaagac

SEQ ID NO: 3777032 - DNA, 18 bp, Homo sapiens
gctattcagtaataactc

SEQ ID NO: 3777033 - DNA, 21 bp, Homo sapiens
gctattcagttggtaagcttc

SEQ ID NO: 3777034 - DNA, 16 bp, Homo sapiens
gctattgacaagtcat

SEQ ID NO: 3777035 - DNA, 21 bp, Homo sapiens
gctatttcccaagctggagtg

SEQ ID NO: 3777036 - DNA, 17 bp, Homo sapiens
gctattttactgtctta

SEQ ID NO: 3777037 - DNA, 15 bp, Homo sapiens
gctcaaaaaatgagc

SEQ ID NO: 3777038 - DNA, 22 bp, Homo sapiens
gctcaagcagtctacccacctc

SEQ ID NO: 3777039 - DNA, 14 bp, Homo sapiens
gctcaatcctctaa

SEQ ID NO: 3777040 - DNA, 15 bp, Homo sapiens
gctcacacatgagat

SEQ ID NO: 3777041 - DNA, 14 bp, Homo sapiens
gctcacacctgtaa

SEQ ID NO: 3777042 - DNA, 15 bp, Homo sapiens
gctcacagttcctcg

SEQ ID NO: 3777043 - DNA, 13 bp, Homo sapiens
gctcaccagcccc

SEQ ID NO: 3777044 - DNA, 20 bp, Homo sapiens
gctcaccagccccagtgccc

SEQ ID NO: 3777045 - DNA, 23 bp, Homo sapiens
gctcaccagccccagtgcccaca

SEQ ID NO: 3777046 - DNA, 11 bp, Homo sapiens
gctcacctggg

SEQ ID NO: 3777047 - DNA, 12 bp, Homo sapiens
gctcacctgggg

SEQ ID NO: 3777048 - DNA, 13 bp, Homo sapiens
gctcacctggggt

SEQ ID NO: 3777049 - DNA, 22 bp, Homo sapiens
gctcacctggggtgtgggaggc

SEQ ID NO: 3777050 - DNA, 22 bp, Homo sapiens
gctcacgcctatgatcccagca

SEQ ID NO: 3777051 - DNA, 13 bp, Homo sapiens
gctcacgtgtgtg

SEQ ID NO: 3777052 - DNA, 15 bp, Homo sapiens
gctcagaagtgacca

SEQ ID NO: 3777053 - DNA, 15 bp, Homo sapiens
gctcagacccccact

SEQ ID NO: 3777054 - DNA, 18 bp, Homo sapiens
gctcagatgaagagaaat

SEQ ID NO: 3777055 - DNA, 17 bp, Homo sapiens
gctcagcaaaagatgct

SEQ ID NO: 3777056 - DNA, 18 bp, Homo sapiens
gctcagcccacccccctc

SEQ ID NO: 3777057 - DNA, 11 bp, Homo sapiens
gctcagcctgg

SEQ ID NO: 3777058 - DNA, 15 bp, Homo sapiens
gctcagcctggtggg

SEQ ID NO: 3777059 - DNA, 12 bp, Homo sapiens
gctcagctctgg

SEQ ID NO: 3777060 - DNA, 14 bp, Homo sapiens
gctcagctctggct

SEQ ID NO: 3777061 - DNA, 16 bp, Homo sapiens
gctcagctctggctca

SEQ ID NO: 3777062 - DNA, 16 bp, Homo sapiens
gctcaggaggcttgga

SEQ ID NO: 3777063 - DNA, 12 bp, Homo sapiens
gcttctgcctgc

SEQ ID NO: 3777064 - DNA, 14 bp, Homo sapiens
gcttctggagccct

SEQ ID NO: 3777065 - DNA, 12 bp, Homo sapiens
gcttctgggaag

SEQ ID NO: 3777066 - DNA, 15 bp, Homo sapiens
gcttcttaaagagtt

SEQ ID NO: 3777067 - DNA, 14 bp, Homo sapiens
gcttcttaaatgag

SEQ ID NO: 3777068 - DNA, 19 bp, Homo sapiens
gcttcttcagatcagtgct

SEQ ID NO: 3777069 - DNA, 19 bp, Homo sapiens
gcttcttcccttaaaattt

SEQ ID NO: 3777070 - DNA, 20 bp, Homo sapiens
gcttcttcccttaaaattta

SEQ ID NO: 3777071 - DNA, 20 bp, Homo sapiens
gcttgaaagaaaatatgcat

SEQ ID NO: 3777072 - DNA, 16 bp, Homo sapiens
gcttgaacacagtatt

SEQ ID NO: 3777073 - DNA, 21 bp, Homo sapiens
gcttgaagatcgttagtatct

SEQ ID NO: 3777074 - DNA, 15 bp, Homo sapiens
gcttgacaggacagc

SEQ ID NO: 3777075 - DNA, 16 bp, Homo sapiens
gcttgacaggacagca

SEQ ID NO: 3777076 - DNA, 15 bp, Homo sapiens
gcttgagcccaggag

SEQ ID NO: 3777077 - DNA, 16 bp, Homo sapiens
gcttgagcccaggagt

SEQ ID NO: 3777078 - DNA, 20 bp, Homo sapiens
gcttgagggttgggctggtg

SEQ ID NO: 3777079 - DNA, 22 bp, Homo sapiens
gcttgagggttgggctggtgtc

SEQ ID NO: 3777080 - DNA, 15 bp, Homo sapiens
gcttgcataataagc

SEQ ID NO: 3777081 - DNA, 15 bp, Homo sapiens
gcttgccacagctct

SEQ ID NO: 3777082 - DNA, 17 bp, Homo sapiens
gcttgccgaaactggaa

SEQ ID NO: 3777083 - DNA, 13 bp, Homo sapiens
gcttgcctagggc

SEQ ID NO: 3777084 - DNA, 17 bp, Homo sapiens
gcttgcctagggcctgg

SEQ ID NO: 3777085 - DNA, 21 bp, Homo sapiens
gcttgcctagggcctggtcca

SEQ ID NO: 3777086 - DNA, 22 bp, Homo sapiens
gcttgcgttagaatgaggagga

SEQ ID NO: 3777087 - DNA, 16 bp, Homo sapiens
gcttgctagctatgtg

SEQ ID NO: 3777088 - DNA, 23 bp, Homo sapiens
gcttgctcttcagtgggagaaaa

SEQ ID NO: 3777089 - DNA, 23 bp, Homo sapiens
gcttgggcttccatttgtgtgtg

SEQ ID NO: 3777090 - DNA, 16 bp, Homo sapiens
gcttggggcttcctaa

SEQ ID NO: 3777091 - DNA, 18 bp, Homo sapiens
gcttgtaaatagctcagg

SEQ ID NO: 3777092 - DNA, 16 bp, Homo sapiens
gcttgtaacaagaaaa

SEQ ID NO: 3777093 - DNA, 17 bp, Homo sapiens
gcttgtaacaagaaaac

SEQ ID NO: 3777094 - DNA, 14 bp, Homo sapiens
gcttgtcagagctg

SEQ ID NO: 3777095 - DNA, 16 bp, Homo sapiens
gcttgtcagagctggg

SEQ ID NO: 3777096 - DNA, 16 bp, Homo sapiens
gcttgtccagcgccta

SEQ ID NO: 3777097 - DNA, 16 bp, Homo sapiens
gcttgtcccctcctca

SEQ ID NO: 3777098 - DNA, 16 bp, Homo sapiens
gcttgtgatctgggaa

SEQ ID NO: 3777099 - DNA, 15 bp, Homo sapiens
gcttgttatttataa

SEQ ID NO: 3777100 - DNA, 21 bp, Homo sapiens
gcttgtttgctcacctggggt

SEQ ID NO: 3777101 - DNA, 16 bp, Homo sapiens
gctttactgtttgtta

SEQ ID NO: 3777102 - DNA, 21 bp, Homo sapiens
gctttattttttaagtattta

SEQ ID NO: 3777103 - DNA, 13 bp, Homo sapiens
gctttcagagcct

SEQ ID NO: 3777104 - DNA, 14 bp, Homo sapiens
gctttcagggcctc

SEQ ID NO: 3777105 - DNA, 18 bp, Homo sapiens
gctttcagggcctccagc

SEQ ID NO: 3777106 - DNA, 23 bp, Homo sapiens
gctttcccccacttttctctcta

SEQ ID NO: 3777107 - DNA, 22 bp, Homo sapiens
gctttcctttttcccaataaat

SEQ ID NO: 3777108 - DNA, 20 bp, Homo sapiens
gctttctctgcttcagcttg

SEQ ID NO: 3777109 - DNA, 17 bp, Homo sapiens
gctttcttgctggttgt

SEQ ID NO: 3777110 - DNA, 17 bp, Homo sapiens
gctttgattccatctcc

SEQ ID NO: 3777111 - DNA, 21 bp, Homo sapiens
gctttgatttagattgagtaa

SEQ ID NO: 3777112 - DNA, 22 bp, Homo sapiens
gctttgcattcctacaaagatg

SEQ ID NO: 3777113 - DNA, 18 bp, Homo sapiens
gctttgcccaacctcagc

SEQ ID NO: 3777114 - DNA, 13 bp, Homo sapiens
gctttgccttcca

SEQ ID NO: 3777115 - DNA, 18 bp, Homo sapiens
gctttgccttccacgctg

SEQ ID NO: 3777116 - DNA, 22 bp, Homo sapiens
gctttgccttccacgctgtctc

SEQ ID NO: 3777117 - DNA, 18 bp, Homo sapiens
gctttggacacacacagc

SEQ ID NO: 3777118 - DNA, 19 bp, Homo sapiens
gctttggacacacacagct

SEQ ID NO: 3777119 - DNA, 16 bp, Homo sapiens
gctttgggctgccctg

SEQ ID NO: 3777120 - DNA, 16 bp, Homo sapiens
gctttggtttaaaaga

SEQ ID NO: 3777121 - DNA, 15 bp, Homo sapiens
gctttgtatgcactt

SEQ ID NO: 3777122 - DNA, 15 bp, Homo sapiens
gctttgtcccacagc

SEQ ID NO: 3777123 - DNA, 16 bp, Homo sapiens
gctttgtcccacagct

SEQ ID NO: 3777124 - DNA, 19 bp, Homo sapiens
gctttgtcccacagcttgg

SEQ ID NO: 3777125 - DNA, 21 bp, Homo sapiens
gctttgtttgttgtcagctga

SEQ ID NO: 3777126 - DNA, 23 bp, Homo sapiens
gcttttagtacccacctgagctt

SEQ ID NO: 3777127 - DNA, 12 bp, Homo sapiens
gcttttcactgc

SEQ ID NO: 3777128 - DNA, 13 bp, Homo sapiens
gcttttcactgct

SEQ ID NO: 3777129 - DNA, 18 bp, Homo sapiens
gcttttcactgctggctg

SEQ ID NO: 3777130 - DNA, 22 bp, Homo sapiens
gcttttccttggggcaggcagt

SEQ ID NO: 3777131 - DNA, 23 bp, Homo sapiens
gcttttccttggggcaggcagtg

SEQ ID NO: 3777132 - DNA, 21 bp, Homo sapiens
gcttttgctggtcactgccat

SEQ ID NO: 3777133 - DNA, 15 bp, Homo sapiens
gcttttggtctgtgt

SEQ ID NO: 3777134 - DNA, 13 bp, Homo sapiens
ggaaaaaaacttt

SEQ ID NO: 3777135 - DNA, 21 bp, Homo sapiens
ggaaaaacatctgaaagccac

SEQ ID NO: 3777136 - DNA, 15 bp, Homo sapiens
ggaaaaatagcctgc

SEQ ID NO: 3777137 - DNA, 13 bp, Homo sapiens
ggaaaaatattta

SEQ ID NO: 3777138 - DNA, 14 bp, Homo sapiens
ggaaaaatatttaa

SEQ ID NO: 3777139 - DNA, 14 bp, Homo sapiens
ggaaaagaatacag

SEQ ID NO: 3777140 - DNA, 18 bp, Homo sapiens
ggaaaagaatacagaaag

SEQ ID NO: 3777141 - DNA, 18 bp, Homo sapiens
ggaaaagctgctgacagt

SEQ ID NO: 3777142 - DNA, 20 bp, Homo sapiens
ggaaaagctgctgacagtgt

SEQ ID NO: 3777143 - DNA, 14 bp, Homo sapiens
ggaaaataaattat

SEQ ID NO: 3777144 - DNA, 15 bp, Homo sapiens
ggaaaatcagcctgc

SEQ ID NO: 3777145 - DNA, 18 bp, Homo sapiens
ggaaaattttaaaaatac

SEQ ID NO: 3777146 - DNA, 22 bp, Homo sapiens
ggaaacaaagtggaaggaaaga

SEQ ID NO: 3777147 - DNA, 20 bp, Homo sapiens
ggaaacagctaatgggacac

SEQ ID NO: 3777148 - DNA, 17 bp, Homo sapiens
ggaaaccaagtggtcag

SEQ ID NO: 3777149 - DNA, 15 bp, Homo sapiens
ggaaacgtgccctct

SEQ ID NO: 3777150 - DNA, 21 bp, Homo sapiens
ggaaactcacctgctggcccc

SEQ ID NO: 3777151 - DNA, 22 bp, Homo sapiens
ggaaactcacctgctggcccct

SEQ ID NO: 3777152 - DNA, 18 bp, Homo sapiens
ggaaactgttgccagaga

SEQ ID NO: 3777153 - DNA, 21 bp, Homo sapiens
ggaaacttccaagacctgact

SEQ ID NO: 3777154 - DNA, 15 bp, Homo sapiens
ggaaagcaataaatg

SEQ ID NO: 3777155 - DNA, 14 bp, Homo sapiens
ggaaagcagctcaa

SEQ ID NO: 3777156 - DNA, 19 bp, Homo sapiens
ggaaagcagctcaaaggca

SEQ ID NO: 3777157 - DNA, 21 bp, Homo sapiens
ggaaaggagtagaaaaagcag

SEQ ID NO: 3777158 - DNA, 19 bp, Homo sapiens
ggaaaggctcagtctcagg

SEQ ID NO: 3777159 - DNA, 23 bp, Homo sapiens
ggaaagggattttcagccctcag

SEQ ID NO: 3777160 - DNA, 18 bp, Homo sapiens
ggaaagtgaatttgaatg

SEQ ID NO: 3777161 - DNA, 15 bp, Homo sapiens
ggaaataaaaaagtc

SEQ ID NO: 3777162 - DNA, 19 bp, Homo sapiens
ggaaataaaaaagtctcta

SEQ ID NO: 3777163 - DNA, 19 bp, Homo sapiens
ggaaataaaacctttcaaa

SEQ ID NO: 3777164 - DNA, 22 bp, Homo sapiens
ggaaatatcagttactcagccc

SEQ ID NO: 3777165 - DNA, 15 bp, Homo sapiens
ggaaatgaaagaaag

SEQ ID NO: 3777166 - DNA, 13 bp, Homo sapiens
ggaacagaaggat

SEQ ID NO: 3777167 - DNA, 19 bp, Homo sapiens
ggaacagaaggatgaatga

SEQ ID NO: 3777168 - DNA, 20 bp, Homo sapiens
ggaacagacaacagaagtca

SEQ ID NO: 3777169 - DNA, 16 bp, Homo sapiens
ggaacagacaggagaa

SEQ ID NO: 3777170 - DNA, 17 bp, Homo sapiens
ggaacagactggaagca

SEQ ID NO: 3777171 - DNA, 19 bp, Homo sapiens
ggaacagactggaagcaca

SEQ ID NO: 3777172 - DNA, 19 bp, Homo sapiens
ggaacagctatgggagccc

SEQ ID NO: 3777173 - DNA, 19 bp, Homo sapiens
ggaacctggaccaaagctg

SEQ ID NO: 3777174 - DNA, 17 bp, Homo sapiens
ggaacgtgactgcccca

SEQ ID NO: 3777175 - DNA, 18 bp, Homo sapiens
ggaactagactgcctggg

SEQ ID NO: 3777176 - DNA, 23 bp, Homo sapiens
ggcagctgcggtccacccaggag

SEQ ID NO: 3777177 - DNA, 16 bp, Homo sapiens
ggcaggaaggagagcc

SEQ ID NO: 3777178 - DNA, 18 bp, Homo sapiens
ggcaggacaacgaggaag

SEQ ID NO: 3777179 - DNA, 21 bp, Homo sapiens
ggcaggacaacgaggaagccc

SEQ ID NO: 3777180 - DNA, 14 bp, Homo sapiens
ggcaggagctcaga

SEQ ID NO: 3777181 - DNA, 14 bp, Homo sapiens
ggcaggagggaggt

SEQ ID NO: 3777182 - DNA, 10 bp, Homo sapiens
ggcaggcagt

SEQ ID NO: 3777183 - DNA, 15 bp, Homo sapiens
ggcaggccagctgtg

SEQ ID NO: 3777184 - DNA, 18 bp, Homo sapiens
ggcagggccttgcccaga

SEQ ID NO: 3777185 - DNA, 21 bp, Homo sapiens
ggcagggccttgcccagagat

SEQ ID NO: 3777186 - DNA, 13 bp, Homo sapiens
ggcagggctctga

SEQ ID NO: 3777187 - DNA, 12 bp, Homo sapiens
ggcaggggcgga

SEQ ID NO: 3777188 - DNA, 15 bp, Homo sapiens
ggcaggggtggagga

SEQ ID NO: 3777189 - DNA, 15 bp, Homo sapiens
ggcagggtcaggaga

SEQ ID NO: 3777190 - DNA, 17 bp, Homo sapiens
ggcagggtcaggagagg

SEQ ID NO: 3777191 - DNA, 12 bp, Homo sapiens
ggcagggtccta

SEQ ID NO: 3777192 - DNA, 23 bp, Homo sapiens
ggcaggtcttgaactcctggcct

SEQ ID NO: 3777193 - DNA, 16 bp, Homo sapiens
ggcaggtgacagtgag

SEQ ID NO: 3777194 - DNA, 16 bp, Homo sapiens
ggcaggtgaccttctg

SEQ ID NO: 3777195 - DNA, 17 bp, Homo sapiens
ggcaggttggtgggggc

SEQ ID NO: 3777196 - DNA, 19 bp, Homo sapiens
ggcagtaaagagaaacttt

SEQ ID NO: 3777197 - DNA, 16 bp, Homo sapiens
ggcagtctggaggggc

SEQ ID NO: 3777198 - DNA, 16 bp, Homo sapiens
ggcagtgcagcaacca

SEQ ID NO: 3777199 - DNA, 21 bp, Homo sapiens
ggcagtgcagcaaccagagca

SEQ ID NO: 3777200 - DNA, 17 bp, Homo sapiens
ggcagtgcgggaggaat

SEQ ID NO: 3777201 - DNA, 21 bp, Homo sapiens
ggcagtgggacagggcatggc

SEQ ID NO: 3777202 - DNA, 15 bp, Homo sapiens
ggcagtggggctggg

SEQ ID NO: 3777203 - DNA, 18 bp, Homo sapiens
ggcagtggggctgggggt

SEQ ID NO: 3777204 - DNA, 20 bp, Homo sapiens
ggcagttagagatgcctccc

SEQ ID NO: 3777205 - DNA, 21 bp, Homo sapiens
ggcatagctccccgcttctgc

SEQ ID NO: 3777206 - DNA, 14 bp, Homo sapiens
ggcataggcctggg

SEQ ID NO: 3777207 - DNA, 16 bp, Homo sapiens
ggcataggcctgggtg

SEQ ID NO: 3777208 - DNA, 16 bp, Homo sapiens
ggcatcacagggcaga

SEQ ID NO: 3777209 - DNA, 17 bp, Homo sapiens
ggcatcacagggcagag

SEQ ID NO: 3777210 - DNA, 18 bp, Homo sapiens
ggcatcaccttaggcagg

SEQ ID NO: 3777211 - DNA, 20 bp, Homo sapiens
ggcatcaccttaggcaggga

SEQ ID NO: 3777212 - DNA, 20 bp, Homo sapiens
ggcatccttcctcacaccag

SEQ ID NO: 3777213 - DNA, 14 bp, Homo sapiens
ggcatctcctgtgc

SEQ ID NO: 3777214 - DNA, 17 bp, Homo sapiens
ggcatctgacacaaaaa

SEQ ID NO: 3777215 - DNA, 14 bp, Homo sapiens
ggcatgcctgtgtg

SEQ ID NO: 3777216 - DNA, 16 bp, Homo sapiens
ggcatgcctgtgtgac

SEQ ID NO: 3777217 - DNA, 21 bp, Homo sapiens
ggcatgtgcctatagtcccag

SEQ ID NO: 3777218 - DNA, 23 bp, Homo sapiens
ggcatgttctctgaggacactaa

SEQ ID NO: 3777219 - DNA, 16 bp, Homo sapiens
ggcattgatggggaag

SEQ ID NO: 3777220 - DNA, 12 bp, Homo sapiens
ggcattgctttc

SEQ ID NO: 3777221 - DNA, 20 bp, Homo sapiens
ggcattggttccctttgctc

SEQ ID NO: 3777222 - DNA, 17 bp, Homo sapiens
ggccaaacatcagacct

SEQ ID NO: 3777223 - DNA, 22 bp, Homo sapiens
ggccaaaggagggtcaggaagg

SEQ ID NO: 3777224 - DNA, 21 bp, Homo sapiens
ggccaaatatattctctttgg

SEQ ID NO: 3777225 - DNA, 13 bp, Homo sapiens
ggccaacatggta

SEQ ID NO: 3777226 - DNA, 15 bp, Homo sapiens
ggccaaggactgccg

SEQ ID NO: 3777227 - DNA, 13 bp, Homo sapiens
ggccaaggtggga

SEQ ID NO: 3777228 - DNA, 14 bp, Homo sapiens
ggccaagtcccacc

SEQ ID NO: 3777229 - DNA, 12 bp, Homo sapiens
ggccacagccag

SEQ ID NO: 3777230 - DNA, 12 bp, Homo sapiens
ggccacctgcag

SEQ ID NO: 3777231 - DNA, 17 bp, Homo sapiens
ggccacgtgccaggccc

SEQ ID NO: 3777232 - DNA, 18 bp, Homo sapiens
ggccacgtgccaggcccg

SEQ ID NO: 3777233 - DNA, 12 bp, Homo sapiens
ggccactcctcc

SEQ ID NO: 3777234 - DNA, 20 bp, Homo sapiens
ggccactctgcctctgcctg

SEQ ID NO: 3777235 - DNA, 20 bp, Homo sapiens
ggccactgtgaagagaacca

SEQ ID NO: 3777236 - DNA, 14 bp, Homo sapiens
ggccagaccagagc

SEQ ID NO: 3777237 - DNA, 16 bp, Homo sapiens
ggccagaccagagctc

SEQ ID NO: 3777238 - DNA, 21 bp, Homo sapiens
ggccagagagcctggtgctgc

SEQ ID NO: 3777239 - DNA, 22 bp, Homo sapiens
ggccagagagcctggtgctgct

SEQ ID NO: 3777240 - DNA, 16 bp, Homo sapiens
ggccagagtggcctgg

SEQ ID NO: 3777241 - DNA, 18 bp, Homo sapiens
ggccagagtggcctggcc

SEQ ID NO: 3777242 - DNA, 16 bp, Homo sapiens
ggccagatgcaccagc

SEQ ID NO: 3777243 - DNA, 12 bp, Homo sapiens
ggccagcagctt

SEQ ID NO: 3777244 - DNA, 13 bp, Homo sapiens
ggccagcagcttg

SEQ ID NO: 3777245 - DNA, 13 bp, Homo sapiens
ggccagccccacc

SEQ ID NO: 3777246 - DNA, 20 bp, Homo sapiens
ggccagccccacccaggagg

SEQ ID NO: 3777247 - DNA, 15 bp, Homo sapiens
ggccagcccctccca

SEQ ID NO: 3777248 - DNA, 18 bp, Homo sapiens
ggccagcccctcccacca

SEQ ID NO: 3777249 - DNA, 20 bp, Homo sapiens
ggccagctgggatctgactg

SEQ ID NO: 3777250 - DNA, 23 bp, Homo sapiens
ggccagctgggatctgactgcac

SEQ ID NO: 3777251 - DNA, 13 bp, Homo sapiens
ggccaggagctct

SEQ ID NO: 3777252 - DNA, 23 bp, Homo sapiens
ggccaggagtttaagaccagcct

SEQ ID NO: 3777253 - DNA, 14 bp, Homo sapiens
ggccaggccagagg

SEQ ID NO: 3777254 - DNA, 12 bp, Homo sapiens
ggccaggctggt

SEQ ID NO: 3777255 - DNA, 13 bp, Homo sapiens
ggccagggccctg

SEQ ID NO: 3777256 - DNA, 17 bp, Homo sapiens
ggccagggccctgcaga

SEQ ID NO: 3777257 - DNA, 19 bp, Homo sapiens
ggccaggtggccactccag

SEQ ID NO: 3777258 - DNA, 17 bp, Homo sapiens
ggccaggtttctgccca

SEQ ID NO: 3777259 - DNA, 16 bp, Homo sapiens
ggccagtcctgcctgg

SEQ ID NO: 3777260 - DNA, 21 bp, Homo sapiens
ggccagtcctgcctggccagg

SEQ ID NO: 3777261 - DNA, 16 bp, Homo sapiens
ggccagtgtgacaagg

SEQ ID NO: 3777262 - DNA, 17 bp, Homo sapiens
ggccatgaactttgtcc

SEQ ID NO: 3777263 - DNA, 17 bp, Homo sapiens
ggccatgagctccagac

SEQ ID NO: 3777264 - DNA, 21 bp, Homo sapiens
ggccatgtgagccaccgctgc

SEQ ID NO: 3777265 - DNA, 23 bp, Homo sapiens
ggcccaacacaattcttcttcca

SEQ ID NO: 3777266 - DNA, 13 bp, Homo sapiens
ggcccacagctcc

SEQ ID NO: 3777267 - DNA, 14 bp, Homo sapiens
ggcccacagctccc

SEQ ID NO: 3777268 - DNA, 17 bp, Homo sapiens
ggcccacagctcccacc

SEQ ID NO: 3777269 - DNA, 21 bp, Homo sapiens
ggcccacctaccttcaaagct

SEQ ID NO: 3777270 - DNA, 12 bp, Homo sapiens
ggcccagagagg

SEQ ID NO: 3777271 - DNA, 12 bp, Homo sapiens
ggcccagaggca

SEQ ID NO: 3777272 - DNA, 14 bp, Homo sapiens
ggcccagaggcaca

SEQ ID NO: 3777273 - DNA, 16 bp, Homo sapiens
ggcccagcgacctcgg

SEQ ID NO: 3777274 - DNA, 20 bp, Homo sapiens
ggcccagggagaggccatga

SEQ ID NO: 3777275 - DNA, 14 bp, Homo sapiens
ggccccaccaccta

SEQ ID NO: 3777276 - DNA, 12 bp, Homo sapiens
ggccccactggg

SEQ ID NO: 3777277 - DNA, 14 bp, Homo sapiens
ggccccagagactc

SEQ ID NO: 3777278 - DNA, 18 bp, Homo sapiens
ggccccagagactcagag

SEQ ID NO: 3777279 - DNA, 16 bp, Homo sapiens
ggccccagcactaaag

SEQ ID NO: 3777280 - DNA, 13 bp, Homo sapiens
ggccccaggaagc

SEQ ID NO: 3777281 - DNA, 14 bp, Homo sapiens
ggccccaggaagcc

SEQ ID NO: 3777282 - DNA, 17 bp, Homo sapiens
ggccccagggctaccct

SEQ ID NO: 3777283 - DNA, 18 bp, Homo sapiens
ggcccccactggctgtgg

SEQ ID NO: 3777284 - DNA, 12 bp, Homo sapiens
ggcccccagctg

SEQ ID NO: 3777285 - DNA, 15 bp, Homo sapiens
ggcccccagctgtgg

SEQ ID NO: 3777286 - DNA, 17 bp, Homo sapiens
ggcccctccctacctca

SEQ ID NO: 3777287 - DNA, 13 bp, Homo sapiens
ggcccctgccacc

SEQ ID NO: 3777288 - DNA, 13 bp, Homo sapiens
ggcccctgcccgg

SEQ ID NO: 3777289 - DNA, 14 bp, Homo sapiens
ggcccctgccttgg

SEQ ID NO: 3777290 - DNA, 12 bp, Homo sapiens
gtaataaagtat

SEQ ID NO: 3777291 - DNA, 15 bp, Homo sapiens
gtaataaagtatata

SEQ ID NO: 3777292 - DNA, 17 bp, Homo sapiens
gtaataaagtatataat

SEQ ID NO: 3777293 - DNA, 17 bp, Homo sapiens
gtaataaagtgttttca

SEQ ID NO: 3777294 - DNA, 18 bp, Homo sapiens
gtaataaagtgttttcag

SEQ ID NO: 3777295 - DNA, 16 bp, Homo sapiens
gtaataatgtgaatca

SEQ ID NO: 3777296 - DNA, 14 bp, Homo sapiens
gtaatcaatgtttc

SEQ ID NO: 3777297 - DNA, 22 bp, Homo sapiens
gtaatcatttcttgggccctcc

SEQ ID NO: 3777298 - DNA, 14 bp, Homo sapiens
gtaatcccagcact

SEQ ID NO: 3777299 - DNA, 18 bp, Homo sapiens
gtaatcccagctactcag

SEQ ID NO: 3777300 - DNA, 16 bp, Homo sapiens
gtaatcgttatgtgtg

SEQ ID NO: 3777301 - DNA, 17 bp, Homo sapiens
gtaatctgatcgttctt

SEQ ID NO: 3777302 - DNA, 21 bp, Homo sapiens
gtaatgaatttttatgatatt

SEQ ID NO: 3777303 - DNA, 18 bp, Homo sapiens
gtaatgatgtcgtttgaa

SEQ ID NO: 3777304 - DNA, 22 bp, Homo sapiens
gtaatgtcaccaccttcccagc

SEQ ID NO: 3777305 - DNA, 13 bp, Homo sapiens
gtaatgttactga

SEQ ID NO: 3777306 - DNA, 17 bp, Homo sapiens
gtaattaagtactatgt

SEQ ID NO: 3777307 - DNA, 14 bp, Homo sapiens
gtaattctaaatga

SEQ ID NO: 3777308 - DNA, 15 bp, Homo sapiens
gtaattgaacttatc

SEQ ID NO: 3777309 - DNA, 16 bp, Homo sapiens
gtaattgaataaagtt

SEQ ID NO: 3777310 - DNA, 16 bp, Homo sapiens
gtaatttgtgtaataa

SEQ ID NO: 3777311 - DNA, 13 bp, Homo sapiens
gtaattttcttga

SEQ ID NO: 3777312 - DNA, 16 bp, Homo sapiens
gtacaaaagggacatg

SEQ ID NO: 3777313 - DNA, 22 bp, Homo sapiens
gtacaataagtgtttttgtatt

SEQ ID NO: 3777314 - DNA, 13 bp, Homo sapiens
gtacaatatttaa

SEQ ID NO: 3777315 - DNA, 14 bp, Homo sapiens
gtacaatatttaaa

SEQ ID NO: 3777316 - DNA, 14 bp, Homo sapiens
gtacaatattttaa

SEQ ID NO: 3777317 - DNA, 19 bp, Homo sapiens
gtacaatattttaagcatt

SEQ ID NO: 3777318 - DNA, 24 bp, Homo sapiens
gtacaatattttaagcattactct

SEQ ID NO: 3777319 - DNA, 15 bp, Homo sapiens
gtacacagactattg

SEQ ID NO: 3777320 - DNA, 18 bp, Homo sapiens
gtacagaatcattgctta

SEQ ID NO: 3777321 - DNA, 20 bp, Homo sapiens
gtacagattgctgcttctgc

SEQ ID NO: 3777322 - DNA, 22 bp, Homo sapiens
gtacataaaggtggtatgtgtg

SEQ ID NO: 3777323 - DNA, 16 bp, Homo sapiens
gtacatactttttcaa

SEQ ID NO: 3777324 - DNA, 17 bp, Homo sapiens
gtacattcaatgtttat

SEQ ID NO: 3777325 - DNA, 14 bp, Homo sapiens
gtaccaatcatttt

SEQ ID NO: 3777326 - DNA, 20 bp, Homo sapiens
gtaccatagcgctgctctta

SEQ ID NO: 3777327 - DNA, 17 bp, Homo sapiens
gtacccacctgagcttt

SEQ ID NO: 3777328 - DNA, 13 bp, Homo sapiens
gtacccactgctc

SEQ ID NO: 3777329 - DNA, 15 bp, Homo sapiens
gtacccactgctctg

SEQ ID NO: 3777330 - DNA, 13 bp, Homo sapiens
gtacctaagggag

SEQ ID NO: 3777331 - DNA, 12 bp, Homo sapiens
gtacctgctgcc

SEQ ID NO: 3777332 - DNA, 19 bp, Homo sapiens
gtacctgctgccccagctg

SEQ ID NO: 3777333 - DNA, 14 bp, Homo sapiens
gtaccttgaacact

SEQ ID NO: 3777334 - DNA, 23 bp, Homo sapiens
gtacctttgctcttgcagagaag

SEQ ID NO: 3777335 - DNA, 15 bp, Homo sapiens
gtacgtggagaggga

SEQ ID NO: 3777336 - DNA, 23 bp, Homo sapiens
gtactaaggaatctttctgcttt

SEQ ID NO: 3777337 - DNA, 12 bp, Homo sapiens
gtactacaattt

SEQ ID NO: 3777338 - DNA, 15 bp, Homo sapiens
gtactactagatgtc

SEQ ID NO: 3777339 - DNA, 21 bp, Homo sapiens
gtactactagatgtctttagg

SEQ ID NO: 3777340 - DNA, 22 bp, Homo sapiens
gtactagggggaagtgacaagg

SEQ ID NO: 3777341 - DNA, 13 bp, Homo sapiens
gtactatgtatca

SEQ ID NO: 3777342 - DNA, 17 bp, Homo sapiens
gtactcaggaggctgag

SEQ ID NO: 3777343 - DNA, 15 bp, Homo sapiens
gtactcctgcaaaat

SEQ ID NO: 3777344 - DNA, 13 bp, Homo sapiens
gtactctggcctc

SEQ ID NO: 3777345 - DNA, 15 bp, Homo sapiens
gtactctggcctctg

SEQ ID NO: 3777346 - DNA, 13 bp, Homo sapiens
gtactgcagcctc

SEQ ID NO: 3777347 - DNA, 19 bp, Homo sapiens
gtactggctgatggagtaa

SEQ ID NO: 3777348 - DNA, 23 bp, Homo sapiens
gtactgtgtacagaattctgcta

SEQ ID NO: 3777349 - DNA, 15 bp, Homo sapiens
gtacttaataaattc

SEQ ID NO: 3777350 - DNA, 14 bp, Homo sapiens
gtacttccactgat

SEQ ID NO: 3777351 - DNA, 18 bp, Homo sapiens
gtacttgctgctatttta

SEQ ID NO: 3777352 - DNA, 16 bp, Homo sapiens
gtacttgtggacacag

SEQ ID NO: 3777353 - DNA, 20 bp, Homo sapiens
gtacttgtggacacagctct

SEQ ID NO: 3777354 - DNA, 14 bp, Homo sapiens
gtagaaatgatgat

SEQ ID NO: 3777355 - DNA, 18 bp, Homo sapiens
gtagaacgtaaccacgga

SEQ ID NO: 3777356 - DNA, 14 bp, Homo sapiens
gtagaccaaaataa

SEQ ID NO: 3777357 - DNA, 15 bp, Homo sapiens
gtagaccaaaataaa

SEQ ID NO: 3777358 - DNA, 14 bp, Homo sapiens
gtagacccctggct

SEQ ID NO: 3777359 - DNA, 16 bp, Homo sapiens
gtagacctagggagga

SEQ ID NO: 3777360 - DNA, 13 bp, Homo sapiens
gtagactagtgcc

SEQ ID NO: 3777361 - DNA, 16 bp, Homo sapiens
gtagagggtgctgccc

SEQ ID NO: 3777362 - DNA, 23 bp, Homo sapiens
gtagagtcatctccatcagctgt

SEQ ID NO: 3777363 - DNA, 15 bp, Homo sapiens
gtagcagtagatgca

SEQ ID NO: 3777364 - DNA, 15 bp, Homo sapiens
gtagcattacagtgg

SEQ ID NO: 3777365 - DNA, 21 bp, Homo sapiens
gtagccccaagaaggctgggg

SEQ ID NO: 3777366 - DNA, 23 bp, Homo sapiens
gtagccttgcccggattctggga

SEQ ID NO: 3777367 - DNA, 17 bp, Homo sapiens
gtagctagaggaaccaa

SEQ ID NO: 3777368 - DNA, 18 bp, Homo sapiens
gtagctgggactacaggc

SEQ ID NO: 3777369 - DNA, 19 bp, Homo sapiens
gtagctgggactacaggca

SEQ ID NO: 3777370 - DNA, 21 bp, Homo sapiens
gtaggaacggtaaatttctgt

SEQ ID NO: 3777371 - DNA, 17 bp, Homo sapiens
gtaggcatgagggatca

SEQ ID NO: 3777372 - DNA, 20 bp, Homo sapiens
gtaggcatgagggatcacag

SEQ ID NO: 3777373 - DNA, 21 bp, Homo sapiens
gtagggagtacctgctgcccc

SEQ ID NO: 3777374 - DNA, 12 bp, Homo sapiens
gtagggctgact

SEQ ID NO: 3777375 - DNA, 21 bp, Homo sapiens
gtagggctgccaccaaggtga

SEQ ID NO: 3777376 - DNA, 21 bp, Homo sapiens
gtagggtcaggccacggcagc

SEQ ID NO: 3777377 - DNA, 22 bp, Homo sapiens
gtagggtcaggccacggcagcc

SEQ ID NO: 3777378 - DNA, 20 bp, Homo sapiens
gtagtactccttaagaacac

SEQ ID NO: 3777379 - DNA, 18 bp, Homo sapiens
gtagtagggtcaggccac

SEQ ID NO: 3777380 - DNA, 14 bp, Homo sapiens
gtagtctaaccaaa

SEQ ID NO: 3777381 - DNA, 19 bp, Homo sapiens
gtagtctaaccaaatgcat

SEQ ID NO: 3777382 - DNA, 15 bp, Homo sapiens
gtagtgagaagaata

SEQ ID NO: 3777383 - DNA, 20 bp, Homo sapiens
gtagttaggaaataaaacct

SEQ ID NO: 3777384 - DNA, 16 bp, Homo sapiens
gtagttagtagcatgt

SEQ ID NO: 3777385 - DNA, 20 bp, Homo sapiens
gtagttccctgaaaacccag

SEQ ID NO: 3777386 - DNA, 23 bp, Homo sapiens
gtagttccctgaaaacccagaga

SEQ ID NO: 3777387 - DNA, 16 bp, Homo sapiens
gtataaactgatggat

SEQ ID NO: 3777388 - DNA, 14 bp, Homo sapiens
gtataaagaaaagt

SEQ ID NO: 3777389 - DNA, 12 bp, Homo sapiens
gtataaagaaca

SEQ ID NO: 3777390 - DNA, 23 bp, Homo sapiens
gtataaatgaagtttatacagta

SEQ ID NO: 3777391 - DNA, 18 bp, Homo sapiens
gtatacaacatgatttta

SEQ ID NO: 3777392 - DNA, 21 bp, Homo sapiens
gtatataatttttttatgttt

SEQ ID NO: 3777393 - DNA, 17 bp, Homo sapiens
gtatatgtatgtgtgta

SEQ ID NO: 3777394 - DNA, 18 bp, Homo sapiens
gtatattaaaaatggtaa

SEQ ID NO: 3777395 - DNA, 14 bp, Homo sapiens
gtatattcatttca

SEQ ID NO: 3777396 - DNA, 22 bp, Homo sapiens
gtatatttatagtcacaagagc

SEQ ID NO: 3777397 - DNA, 17 bp, Homo sapiens
gtatatttatataatta

SEQ ID NO: 3777398 - DNA, 17 bp, Homo sapiens
gtatcaacccagaaaca

SEQ ID NO: 3777399 - DNA, 19 bp, Homo sapiens
gtatcaagtggcatgtgct

SEQ ID NO: 3777400 - DNA, 22 bp, Homo sapiens
gtatcaggcctgccagacggca

SEQ ID NO: 3777401 - DNA, 16 bp, Homo sapiens
gtatcatatatttaat

SEQ ID NO: 3777402 - DNA, 21 bp, Homo sapiens
gtatcccatgagcctcagcat

SEQ ID NO: 3777403 - DNA, 11 bp, Homo sapiens
gtctctctttg

SEQ ID NO: 3777404 - DNA, 13 bp, Homo sapiens
gtctctgctggcc

SEQ ID NO: 3777405 - DNA, 16 bp, Homo sapiens
gtctctgctggcccag

SEQ ID NO: 3777406 - DNA, 15 bp, Homo sapiens
gtctcttctccactg

SEQ ID NO: 3777407 - DNA, 17 bp, Homo sapiens
gtctcttctccactgga

SEQ ID NO: 3777408 - DNA, 18 bp, Homo sapiens
gtctcttctccactggat

SEQ ID NO: 3777409 - DNA, 18 bp, Homo sapiens
gtctctttaatgtcacag

SEQ ID NO: 3777410 - DNA, 13 bp, Homo sapiens
gtctgaatgttct

SEQ ID NO: 3777411 - DNA, 17 bp, Homo sapiens
gtctgaatgttctgaca

SEQ ID NO: 3777412 - DNA, 15 bp, Homo sapiens
gtctgacaggcaatg

SEQ ID NO: 3777413 - DNA, 15 bp, Homo sapiens
gtctgacccactgct

SEQ ID NO: 3777414 - DNA, 18 bp, Homo sapiens
gtctgagccaaagagaat

SEQ ID NO: 3777415 - DNA, 22 bp, Homo sapiens
gtctgatttcaggatactctgt

SEQ ID NO: 3777416 - DNA, 14 bp, Homo sapiens
gtctgcacttaaat

SEQ ID NO: 3777417 - DNA, 21 bp, Homo sapiens
gtctgcattttctgaaactaa

SEQ ID NO: 3777418 - DNA, 17 bp, Homo sapiens
gtctgccagccagcagc

SEQ ID NO: 3777419 - DNA, 19 bp, Homo sapiens
gtctgctgaataataaact

SEQ ID NO: 3777420 - DNA, 22 bp, Homo sapiens
gtctggatctgggaccctttcc

SEQ ID NO: 3777421 - DNA, 23 bp, Homo sapiens
gtctggggttcagcccctcctct

SEQ ID NO: 3777422 - DNA, 16 bp, Homo sapiens
gtctgtgcctggagct

SEQ ID NO: 3777423 - DNA, 16 bp, Homo sapiens
gtctgtgtgggactgt

SEQ ID NO: 3777424 - DNA, 13 bp, Homo sapiens
gtcttaaataaaa

SEQ ID NO: 3777425 - DNA, 16 bp, Homo sapiens
gtcttaacttctcccc

SEQ ID NO: 3777426 - DNA, 16 bp, Homo sapiens
gtcttagcagtgattt

SEQ ID NO: 3777427 - DNA, 15 bp, Homo sapiens
gtcttatttttagat

SEQ ID NO: 3777428 - DNA, 15 bp, Homo sapiens
gtcttcaagggctgc

SEQ ID NO: 3777429 - DNA, 15 bp, Homo sapiens
gtcttcacggcagga

SEQ ID NO: 3777430 - DNA, 22 bp, Homo sapiens
gtcttcagagataggcctgtgg

SEQ ID NO: 3777431 - DNA, 12 bp, Homo sapiens
gtcttcagccta

SEQ ID NO: 3777432 - DNA, 15 bp, Homo sapiens
gtcttcagcctagcc

SEQ ID NO: 3777433 - DNA, 18 bp, Homo sapiens
gtcttcagggggccaggt

SEQ ID NO: 3777434 - DNA, 13 bp, Homo sapiens
gtcttccataatg

SEQ ID NO: 3777435 - DNA, 15 bp, Homo sapiens
gtcttccataatgta

SEQ ID NO: 3777436 - DNA, 17 bp, Homo sapiens
gtcttccataatgtata

SEQ ID NO: 3777437 - DNA, 16 bp, Homo sapiens
gtcttccctacctcag

SEQ ID NO: 3777438 - DNA, 21 bp, Homo sapiens
gtcttccctacctcaggcagg

SEQ ID NO: 3777439 - DNA, 19 bp, Homo sapiens
gtcttccctagggctgggt

SEQ ID NO: 3777440 - DNA, 18 bp, Homo sapiens
gtcttcctgaaatgcagt

SEQ ID NO: 3777441 - DNA, 17 bp, Homo sapiens
gtcttcctgcattcacc

SEQ ID NO: 3777442 - DNA, 16 bp, Homo sapiens
gtcttctcatagcatt

SEQ ID NO: 3777443 - DNA, 16 bp, Homo sapiens
gtcttcttacatgcat

SEQ ID NO: 3777444 - DNA, 17 bp, Homo sapiens
gtcttctttgcccacaa

SEQ ID NO: 3777445 - DNA, 18 bp, Homo sapiens
gtcttgcaatggcagcct

SEQ ID NO: 3777446 - DNA, 19 bp, Homo sapiens
gtcttgcaatggcagcctt

SEQ ID NO: 3777447 - DNA, 19 bp, Homo sapiens
gtcttgcagtgattaaggt

SEQ ID NO: 3777448 - DNA, 21 bp, Homo sapiens
gtcttgtaagagctatacagt

SEQ ID NO: 3777449 - DNA, 13 bp, Homo sapiens
gtcttgtgactag

SEQ ID NO: 3777450 - DNA, 15 bp, Homo sapiens
gtctttctttggtgc

SEQ ID NO: 3777451 - DNA, 22 bp, Homo sapiens
gtctttctttggtgcctttcct

SEQ ID NO: 3777452 - DNA, 15 bp, Homo sapiens
gtctttggttcagct

SEQ ID NO: 3777453 - DNA, 23 bp, Homo sapiens
gtctttgtaagtaaactgccctg

SEQ ID NO: 3777454 - DNA, 16 bp, Homo sapiens
gtctttgtaatgtcac

SEQ ID NO: 3777455 - DNA, 15 bp, Homo sapiens
gtctttttaagctta

SEQ ID NO: 3777456 - DNA, 16 bp, Homo sapiens
gtctttttctggactg

SEQ ID NO: 3777457 - DNA, 17 bp, Homo sapiens
gtgaaacacaccaggct

SEQ ID NO: 3777458 - DNA, 18 bp, Homo sapiens
gtgaaacacaccaggctg

SEQ ID NO: 3777459 - DNA, 21 bp, Homo sapiens
gtgaaacacaccaggctgtgg

SEQ ID NO: 3777460 - DNA, 13 bp, Homo sapiens
gtgaaagaaatca

SEQ ID NO: 3777461 - DNA, 20 bp, Homo sapiens
gtgaaagcatcacttgggat

SEQ ID NO: 3777462 - DNA, 22 bp, Homo sapiens
gtgaaataccaacctgaagaca

SEQ ID NO: 3777463 - DNA, 17 bp, Homo sapiens
gtgaaataccagtgtgg

SEQ ID NO: 3777464 - DNA, 19 bp, Homo sapiens
gtgaaccaccacacccagc

SEQ ID NO: 3777465 - DNA, 21 bp, Homo sapiens
gtgaaccaccacacccagccc

SEQ ID NO: 3777466 - DNA, 19 bp, Homo sapiens
gtgaagagggagaagcatg

SEQ ID NO: 3777467 - DNA, 15 bp, Homo sapiens
gtgaagatgtttgca

SEQ ID NO: 3777468 - DNA, 16 bp, Homo sapiens
gtgaagcatccaggca

SEQ ID NO: 3777469 - DNA, 17 bp, Homo sapiens
gtgaagcatccaggcac

SEQ ID NO: 3777470 - DNA, 17 bp, Homo sapiens
gtgaagtatactgtatt

SEQ ID NO: 3777471 - DNA, 23 bp, Homo sapiens
gtgaataatacagtatctcaggg

SEQ ID NO: 3777472 - DNA, 15 bp, Homo sapiens
gtgaatctaaaagct

SEQ ID NO: 3777473 - DNA, 21 bp, Homo sapiens
gtgaatgatgatcctaggcat

SEQ ID NO: 3777474 - DNA, 19 bp, Homo sapiens
gtgaattatcccttttctt

SEQ ID NO: 3777475 - DNA, 14 bp, Homo sapiens
gtgaattgataata

SEQ ID NO: 3777476 - DNA, 13 bp, Homo sapiens
gtgaatttgaatg

SEQ ID NO: 3777477 - DNA, 14 bp, Homo sapiens
gtgaatttgaatga

SEQ ID NO: 3777478 - DNA, 14 bp, Homo sapiens
gtgaatttttctct

SEQ ID NO: 3777479 - DNA, 19 bp, Homo sapiens
gtgacaaggccccagagac

SEQ ID NO: 3777480 - DNA, 20 bp, Homo sapiens
gtgacacttcagagagctgg

SEQ ID NO: 3777481 - DNA, 12 bp, Homo sapiens
gtgacagaggca

SEQ ID NO: 3777482 - DNA, 13 bp, Homo sapiens
gtgacagaggcag

SEQ ID NO: 3777483 - DNA, 18 bp, Homo sapiens
gtgacagagttcactata

SEQ ID NO: 3777484 - DNA, 14 bp, Homo sapiens
gtgacatcagtggc

SEQ ID NO: 3777485 - DNA, 21 bp, Homo sapiens
gtgacatgcgggctgggcagc

SEQ ID NO: 3777486 - DNA, 19 bp, Homo sapiens
gtgaccaagttataaatca

SEQ ID NO: 3777487 - DNA, 15 bp, Homo sapiens
gtgaccatttataat

SEQ ID NO: 3777488 - DNA, 14 bp, Homo sapiens
gtgacctgaggaag

SEQ ID NO: 3777489 - DNA, 23 bp, Homo sapiens
gtgacctgccccgcccagctgca

SEQ ID NO: 3777490 - DNA, 11 bp, Homo sapiens
gtgactagtgc

SEQ ID NO: 3777491 - DNA, 13 bp, Homo sapiens
gtgactagtgctg

SEQ ID NO: 3777492 - DNA, 20 bp, Homo sapiens
gtgactcgagtcacactcaa

SEQ ID NO: 3777493 - DNA, 23 bp, Homo sapiens
gtgactgccccaactcctggaag

SEQ ID NO: 3777494 - DNA, 17 bp, Homo sapiens
gtgagacccccacacct

SEQ ID NO: 3777495 - DNA, 22 bp, Homo sapiens
gtgagaccctgtctcaaaaaaa

SEQ ID NO: 3777496 - DNA, 12 bp, Homo sapiens
gtgagagctggg

SEQ ID NO: 3777497 - DNA, 13 bp, Homo sapiens
gtgagagtgagct

SEQ ID NO: 3777498 - DNA, 17 bp, Homo sapiens
gtgagcaaacctgcccc

SEQ ID NO: 3777499 - DNA, 21 bp, Homo sapiens
gtgagcactaaggtgtgctct

SEQ ID NO: 3777500 - DNA, 17 bp, Homo sapiens
gtgagcagactggtggg

SEQ ID NO: 3777501 - DNA, 14 bp, Homo sapiens
gtgagccaccgctg

SEQ ID NO: 3777502 - DNA, 18 bp, Homo sapiens
gtgagccaccgctgccag

SEQ ID NO: 3777503 - DNA, 21 bp, Homo sapiens
gtgagccgcatcttctccatc

SEQ ID NO: 3777504 - DNA, 21 bp, Homo sapiens
gtgaggataacacaagtaaaa

SEQ ID NO: 3777505 - DNA, 18 bp, Homo sapiens
gtgaggatgtcactcaga

SEQ ID NO: 3777506 - DNA, 22 bp, Homo sapiens
gtgaggatgtcactcagatgga

SEQ ID NO: 3777507 - DNA, 17 bp, Homo sapiens
gtgaggcaggggcggag

SEQ ID NO: 3777508 - DNA, 21 bp, Homo sapiens
gtgaggcttaacaatgtcttg

SEQ ID NO: 3777509 - DNA, 22 bp, Homo sapiens
gtgagggcttgtcattaccaga

SEQ ID NO: 3777510 - DNA, 21 bp, Homo sapiens
gtgaggggtatatctgggctg

SEQ ID NO: 3777511 - DNA, 16 bp, Homo sapiens
gtgagtaagagctggt

SEQ ID NO: 3777512 - DNA, 19 bp, Homo sapiens
gtgagtcaccaagcccagt

SEQ ID NO: 3777513 - DNA, 13 bp, Homo sapiens
gtgagtgtgtgca

SEQ ID NO: 3777514 - DNA, 15 bp, Homo sapiens
gtgagtgtgtgcaag

SEQ ID NO: 3777515 - DNA, 20 bp, Homo sapiens
gtgagtgtgtgtttgtgctg

SEQ ID NO: 3777516 - DNA, 18 bp, Homo sapiens
gttcagcccctcctctgc

SEQ ID NO: 3777517 - DNA, 22 bp, Homo sapiens
gttcagcccctcctctgccacc

SEQ ID NO: 3777518 - DNA, 17 bp, Homo sapiens
gttcagctccagctcac

SEQ ID NO: 3777519 - DNA, 18 bp, Homo sapiens
gttcaggggactcagccc

SEQ ID NO: 3777520 - DNA, 19 bp, Homo sapiens
gttcaggggactcagccct

SEQ ID NO: 3777521 - DNA, 22 bp, Homo sapiens
gttcagggttggcccctgcccg

SEQ ID NO: 3777522 - DNA, 14 bp, Homo sapiens
gttcagtaccacat

SEQ ID NO: 3777523 - DNA, 17 bp, Homo sapiens
gttcatagggtctcttc

SEQ ID NO: 3777524 - DNA, 13 bp, Homo sapiens
gttcatcagtgtt

SEQ ID NO: 3777525 - DNA, 21 bp, Homo sapiens
gttcatcagtgttaaaaaatt

SEQ ID NO: 3777526 - DNA, 20 bp, Homo sapiens
gttcatccaatcctcactgg

SEQ ID NO: 3777527 - DNA, 22 bp, Homo sapiens
gttcatccaatcctcactgggt

SEQ ID NO: 3777528 - DNA, 14 bp, Homo sapiens
gttcatgagaatct

SEQ ID NO: 3777529 - DNA, 19 bp, Homo sapiens
gttcattgtaatgttactg

SEQ ID NO: 3777530 - DNA, 23 bp, Homo sapiens
gttcattgtaatgttactgatca

SEQ ID NO: 3777531 - DNA, 21 bp, Homo sapiens
gttccaagacattgtcaataa

SEQ ID NO: 3777532 - DNA, 12 bp, Homo sapiens
gttccagctctt

SEQ ID NO: 3777533 - DNA, 14 bp, Homo sapiens
gttcccatgttaaa

SEQ ID NO: 3777534 - DNA, 13 bp, Homo sapiens
gttcccccagccc

SEQ ID NO: 3777535 - DNA, 14 bp, Homo sapiens
gttcccccagccct

SEQ ID NO: 3777536 - DNA, 17 bp, Homo sapiens
gttcccccagccctgtg

SEQ ID NO: 3777537 - DNA, 17 bp, Homo sapiens
gttcccctgttcactct

SEQ ID NO: 3777538 - DNA, 18 bp, Homo sapiens
gttcccctgttcactcta

SEQ ID NO: 3777539 - DNA, 18 bp, Homo sapiens
gttcccttggcctcagaa

SEQ ID NO: 3777540 - DNA, 19 bp, Homo sapiens
gttccctttccttccatcc

SEQ ID NO: 3777541 - DNA, 13 bp, Homo sapiens
gttccctttgctc

SEQ ID NO: 3777542 - DNA, 20 bp, Homo sapiens
gttccctttgctccacccca

SEQ ID NO: 3777543 - DNA, 14 bp, Homo sapiens
gttcctaagttctt

SEQ ID NO: 3777544 - DNA, 16 bp, Homo sapiens
gttcctcgccctgggt

SEQ ID NO: 3777545 - DNA, 16 bp, Homo sapiens
gttcctgctagaaatg

SEQ ID NO: 3777546 - DNA, 13 bp, Homo sapiens
gttcctggcaata

SEQ ID NO: 3777547 - DNA, 16 bp, Homo sapiens
gttcctggctcagcct

SEQ ID NO: 3777548 - DNA, 19 bp, Homo sapiens
gttcctggggtgccctcca

SEQ ID NO: 3777549 - DNA, 14 bp, Homo sapiens
gttccttactgcag

SEQ ID NO: 3777550 - DNA, 15 bp, Homo sapiens
gttccttactgcaga

SEQ ID NO: 3777551 - DNA, 16 bp, Homo sapiens
gttcgagaccagcctg

SEQ ID NO: 3777552 - DNA, 20 bp, Homo sapiens
gttcgagaccagcctggcca

SEQ ID NO: 3777553 - DNA, 19 bp, Homo sapiens
gttctaaaaattgtgatca

SEQ ID NO: 3777554 - DNA, 15 bp, Homo sapiens
gttctacaatctatt

SEQ ID NO: 3777555 - DNA, 20 bp, Homo sapiens
gttctacaatctatttattg

SEQ ID NO: 3777556 - DNA, 18 bp, Homo sapiens
gttctcctctcccctcta

SEQ ID NO: 3777557 - DNA, 13 bp, Homo sapiens
gttctctctgcct

SEQ ID NO: 3777558 - DNA, 14 bp, Homo sapiens
gttctctgaggaca

SEQ ID NO: 3777559 - DNA, 15 bp, Homo sapiens
gttctgacattaaca

SEQ ID NO: 3777560 - DNA, 21 bp, Homo sapiens
gttctgacattaacagttttc

SEQ ID NO: 3777561 - DNA, 23 bp, Homo sapiens
gttctgacattaacagttttcca

SEQ ID NO: 3777562 - DNA, 14 bp, Homo sapiens
gttctgagtgtttt

SEQ ID NO: 3777563 - DNA, 21 bp, Homo sapiens
gttctgcaaatagaaaacagg

SEQ ID NO: 3777564 - DNA, 12 bp, Homo sapiens
gttctgggacac

SEQ ID NO: 3777565 - DNA, 14 bp, Homo sapiens
gttctgggacacag

SEQ ID NO: 3777566 - DNA, 16 bp, Homo sapiens
gttctgggacacagtt

SEQ ID NO: 3777567 - DNA, 14 bp, Homo sapiens
gttctggggcccct

SEQ ID NO: 3777568 - DNA, 15 bp, Homo sapiens
gttctggggcccctt

SEQ ID NO: 3777569 - DNA, 17 bp, Homo sapiens
gttctgtctcatatgat

SEQ ID NO: 3777570 - DNA, 23 bp, Homo sapiens
gttctgtgtatttaattgtaaac

SEQ ID NO: 3777571 - DNA, 17 bp, Homo sapiens
gttctgtttgttaaaac

SEQ ID NO: 3777572 - DNA, 12 bp, Homo sapiens
gttctgttttgt

SEQ ID NO: 3777573 - DNA, 13 bp, Homo sapiens
gttctgttttgtt

SEQ ID NO: 3777574 - DNA, 22 bp, Homo sapiens
gttcttacctgtatgtctccag

SEQ ID NO: 3777575 - DNA, 14 bp, Homo sapiens
gttcttcatctaag

SEQ ID NO: 3777576 - DNA, 18 bp, Homo sapiens
gttcttgttctgttttgt

SEQ ID NO: 3777577 - DNA, 14 bp, Homo sapiens
gttctttcttcctc

SEQ ID NO: 3777578 - DNA, 15 bp, Homo sapiens
gttgaaaagccatgt

SEQ ID NO: 3777579 - DNA, 22 bp, Homo sapiens
gttgaaaagccatgtttaagat

SEQ ID NO: 3777580 - DNA, 23 bp, Homo sapiens
gttgaaaagccatgtttaagatt

SEQ ID NO: 3777581 - DNA, 20 bp, Homo sapiens
gttgacacggccatgaccac

SEQ ID NO: 3777582 - DNA, 19 bp, Homo sapiens
gttgacttgacagaacact

SEQ ID NO: 3777583 - DNA, 14 bp, Homo sapiens
gttgactttcaggt

SEQ ID NO: 3777584 - DNA, 23 bp, Homo sapiens
gttgagccaggcctgggtctgtg

SEQ ID NO: 3777585 - DNA, 13 bp, Homo sapiens
gttgagctgtttt

SEQ ID NO: 3777586 - DNA, 21 bp, Homo sapiens
gttgagcttcatataccagca

SEQ ID NO: 3777587 - DNA, 20 bp, Homo sapiens
gttgaggtggaagccctcct

SEQ ID NO: 3777588 - DNA, 23 bp, Homo sapiens
gttgaggtggaagccctccttcc

SEQ ID NO: 3777589 - DNA, 16 bp, Homo sapiens
gttgaggtggtctgaa

SEQ ID NO: 3777590 - DNA, 21 bp, Homo sapiens
gttgataaattccactggact

SEQ ID NO: 3777591 - DNA, 22 bp, Homo sapiens
gttgatagcaagtgaatttttc

SEQ ID NO: 3777592 - DNA, 23 bp, Homo sapiens
gttgatagcaagtgaatttttct

SEQ ID NO: 3777593 - DNA, 20 bp, Homo sapiens
gttgatatttcgaaagctgc

SEQ ID NO: 3777594 - DNA, 22 bp, Homo sapiens
gttgatgatctttgcagacagg

SEQ ID NO: 3777595 - DNA, 15 bp, Homo sapiens
gttgcaaggccgctg

SEQ ID NO: 3777596 - DNA, 15 bp, Homo sapiens
gttgcagtgagctga

SEQ ID NO: 3777597 - DNA, 16 bp, Homo sapiens
gttgcagtgagctgag

SEQ ID NO: 3777598 - DNA, 14 bp, Homo sapiens
gttgcatcagaaat

SEQ ID NO: 3777599 - DNA, 18 bp, Homo sapiens
gttgccaaacagccacac

SEQ ID NO: 3777600 - DNA, 17 bp, Homo sapiens
gttgccagagatggagg

SEQ ID NO: 3777601 - DNA, 14 bp, Homo sapiens
gttgcccaggcagg

SEQ ID NO: 3777602 - DNA, 15 bp, Homo sapiens
gttgcccaggcaggt

SEQ ID NO: 3777603 - DNA, 17 bp, Homo sapiens
gttgcccaggcaggtct

SEQ ID NO: 3777604 - DNA, 23 bp, Homo sapiens
gttgcccaggcaggtcttgaact

SEQ ID NO: 3777605 - DNA, 16 bp, Homo sapiens
gttgcctaataaacat

SEQ ID NO: 3777606 - DNA, 22 bp, Homo sapiens
gttgctcagcaaggggctctgc

SEQ ID NO: 3777607 - DNA, 20 bp, Homo sapiens
gttgctccgcctctgctggc

SEQ ID NO: 3777608 - DNA, 19 bp, Homo sapiens
gttgctgtcataagaatga

SEQ ID NO: 3777609 - DNA, 22 bp, Homo sapiens
gttggaaaagaatacagaaaga

SEQ ID NO: 3777610 - DNA, 14 bp, Homo sapiens
gttggcaaaaaggc

SEQ ID NO: 3777611 - DNA, 13 bp, Homo sapiens
gttggccaggctg

SEQ ID NO: 3777612 - DNA, 17 bp, Homo sapiens
gttggccaggctggtct

SEQ ID NO: 3777613 - DNA, 13 bp, Homo sapiens
gttggcccctgcc

SEQ ID NO: 3777614 - DNA, 14 bp, Homo sapiens
gttggcccctgccc

SEQ ID NO: 3777615 - DNA, 20 bp, Homo sapiens
gttggcccctgcccggctgc

SEQ ID NO: 3777616 - DNA, 20 bp, Homo sapiens
gttggctgacttccacacct

SEQ ID NO: 3777617 - DNA, 14 bp, Homo sapiens
gttgggaagacatg

SEQ ID NO: 3777618 - DNA, 22 bp, Homo sapiens
gttgggagccctttggagaacg

SEQ ID NO: 3777619 - DNA, 16 bp, Homo sapiens
gttgggagcctgaaat

SEQ ID NO: 3777620 - DNA, 13 bp, Homo sapiens
gttgggcccagat

SEQ ID NO: 3777621 - DNA, 13 bp, Homo sapiens
gttggtagtttct

SEQ ID NO: 3777622 - DNA, 16 bp, Homo sapiens
gttggtcggtgggttg

SEQ ID NO: 3777623 - DNA, 12 bp, Homo sapiens
gttgtcagctga

SEQ ID NO: 3777624 - DNA, 14 bp, Homo sapiens
gttgtcattgcttt

SEQ ID NO: 3777625 - DNA, 15 bp, Homo sapiens
gttgtcattgcttta

SEQ ID NO: 3777626 - DNA, 19 bp, Homo sapiens
gttgtctgaagtcactgca

SEQ ID NO: 3777627 - DNA, 15 bp, Homo sapiens
gttgtgaagatgttt

SEQ ID NO: 3777628 - DNA, 21 bp, Homo sapiens
gttgtggagagtgcaacagta

SEQ ID NO: 3777629 - DNA, 11 bp, Homo sapiens
taaaaatgcaa

SEQ ID NO: 3777630 - DNA, 16 bp, Homo sapiens
taaaaatggtaaaatt

SEQ ID NO: 3777631 - DNA, 19 bp, Homo sapiens
taaaaattaaggcaactga

SEQ ID NO: 3777632 - DNA, 17 bp, Homo sapiens
taaaaattgtgatcaga

SEQ ID NO: 3777633 - DNA, 13 bp, Homo sapiens
taaaacaaaaaac

SEQ ID NO: 3777634 - DNA, 17 bp, Homo sapiens
taaaacaaaaaacaata

SEQ ID NO: 3777635 - DNA, 19 bp, Homo sapiens
taaaacaagaaagtttccc

SEQ ID NO: 3777636 - DNA, 14 bp, Homo sapiens
taaaacaatattgt

SEQ ID NO: 3777637 - DNA, 19 bp, Homo sapiens
taaaacacttccataatct

SEQ ID NO: 3777638 - DNA, 17 bp, Homo sapiens
taaaacattttcacaca

SEQ ID NO: 3777639 - DNA, 13 bp, Homo sapiens
taaaacccaagtg

SEQ ID NO: 3777640 - DNA, 13 bp, Homo sapiens
taaaacctttcaa

SEQ ID NO: 3777641 - DNA, 20 bp, Homo sapiens
taaaacctttcaaatttcac

SEQ ID NO: 3777642 - DNA, 21 bp, Homo sapiens
taaaacctttcaaatttcaca

SEQ ID NO: 3777643 - DNA, 13 bp, Homo sapiens
taaaactttaatc

SEQ ID NO: 3777644 - DNA, 13 bp, Homo sapiens
taaaactttttat

SEQ ID NO: 3777645 - DNA, 23 bp, Homo sapiens
taaaactttttatattttataca

SEQ ID NO: 3777646 - DNA, 15 bp, Homo sapiens
taaaagaaatctcta

SEQ ID NO: 3777647 - DNA, 22 bp, Homo sapiens
taaaagaaatgcacaatgtctt

SEQ ID NO: 3777648 - DNA, 23 bp, Homo sapiens
taaaagataacaagatctttcag

SEQ ID NO: 3777649 - DNA, 13 bp, Homo sapiens
taaaagatcgcag

SEQ ID NO: 3777650 - DNA, 15 bp, Homo sapiens
taaaagcataaatgc

SEQ ID NO: 3777651 - DNA, 15 bp, Homo sapiens
taaaagccatcatgt

SEQ ID NO: 3777652 - DNA, 20 bp, Homo sapiens
taaaagccatcatgtaaatt

SEQ ID NO: 3777653 - DNA, 21 bp, Homo sapiens
taaaaggtatgcaatcaaatc

SEQ ID NO: 3777654 - DNA, 22 bp, Homo sapiens
taaaaggtattaaattgatgtt

SEQ ID NO: 3777655 - DNA, 13 bp, Homo sapiens
taaaataaataaa

SEQ ID NO: 3777656 - DNA, 20 bp, Homo sapiens
taaaataaccccgggcaaga

SEQ ID NO: 3777657 - DNA, 21 bp, Homo sapiens
taaaataactagtgttgcttg

SEQ ID NO: 3777658 - DNA, 15 bp, Homo sapiens
taaaatagccactta

SEQ ID NO: 3777659 - DNA, 23 bp, Homo sapiens
taaaatagccacttaccttcaat

SEQ ID NO: 3777660 - DNA, 22 bp, Homo sapiens
taaaatataattgttttttatc

SEQ ID NO: 3777661 - DNA, 16 bp, Homo sapiens
taaaatatcattcagc

SEQ ID NO: 3777662 - DNA, 18 bp, Homo sapiens
taaaatatcattcagcaa

SEQ ID NO: 3777663 - DNA, 22 bp, Homo sapiens
taaaatattcctgcatttgtga

SEQ ID NO: 3777664 - DNA, 16 bp, Homo sapiens
taaaatcactaacatt

SEQ ID NO: 3777665 - DNA, 20 bp, Homo sapiens
taaaatcactaacattatat

SEQ ID NO: 3777666 - DNA, 15 bp, Homo sapiens
taaaatcatgtacat

SEQ ID NO: 3777667 - DNA, 13 bp, Homo sapiens
taaaatcttaaac

SEQ ID NO: 3777668 - DNA, 15 bp, Homo sapiens
taaaatgtataagtt

SEQ ID NO: 3777669 - DNA, 18 bp, Homo sapiens
taaaatgtgatttttctg

SEQ ID NO: 3777670 - DNA, 19 bp, Homo sapiens
taaaatgtgatttttctga

SEQ ID NO: 3777671 - DNA, 12 bp, Homo sapiens
taaaattaaaga

SEQ ID NO: 3777672 - DNA, 12 bp, Homo sapiens
taaaattctaaa

SEQ ID NO: 3777673 - DNA, 14 bp, Homo sapiens
taaaattctaaata

SEQ ID NO: 3777674 - DNA, 13 bp, Homo sapiens
taaaattgaaagg

SEQ ID NO: 3777675 - DNA, 22 bp, Homo sapiens
taaaattgcatgggttttgtag

SEQ ID NO: 3777676 - DNA, 17 bp, Homo sapiens
taaaattttatctctta

SEQ ID NO: 3777677 - DNA, 16 bp, Homo sapiens
taaaattttgcctaat

SEQ ID NO: 3777678 - DNA, 19 bp, Homo sapiens
taaacaaactgtgtaactg

SEQ ID NO: 3777679 - DNA, 12 bp, Homo sapiens
taaacagtgcct

SEQ ID NO: 3777680 - DNA, 13 bp, Homo sapiens
taaacagtgcctg

SEQ ID NO: 3777681 - DNA, 17 bp, Homo sapiens
taaacagtgcctgctga

SEQ ID NO: 3777682 - DNA, 20 bp, Homo sapiens
taaacataattcttgtatat

SEQ ID NO: 3777683 - DNA, 16 bp, Homo sapiens
taaaccgccaaggctg

SEQ ID NO: 3777684 - DNA, 18 bp, Homo sapiens
taaaccgccaaggctggg

SEQ ID NO: 3777685 - DNA, 22 bp, Homo sapiens
taaacgtgatgatcagctgttt

SEQ ID NO: 3777686 - DNA, 22 bp, Homo sapiens
taaacgtttcagtaataaaaca

SEQ ID NO: 3777687 - DNA, 17 bp, Homo sapiens
taaactaggaaaattgg

SEQ ID NO: 3777688 - DNA, 20 bp, Homo sapiens
taaactatcttggtgaattt

SEQ ID NO: 3777689 - DNA, 21 bp, Homo sapiens
taaactatcttggtgaatttt

SEQ ID NO: 3777690 - DNA, 22 bp, Homo sapiens
taaactatcttggtgaattttt

SEQ ID NO: 3777691 - DNA, 14 bp, Homo sapiens
taaactcaaaatat

SEQ ID NO: 3777692 - DNA, 22 bp, Homo sapiens
taaactcaaaatatttgtacat

SEQ ID NO: 3777693 - DNA, 17 bp, Homo sapiens
taaactcatttctagca

SEQ ID NO: 3777694 - DNA, 23 bp, Homo sapiens
taaactgtcctctttcagaaaac

SEQ ID NO: 3777695 - DNA, 13 bp, Homo sapiens
taaactgtgtgca

SEQ ID NO: 3777696 - DNA, 12 bp, Homo sapiens
taaactgtgttt

SEQ ID NO: 3777697 - DNA, 13 bp, Homo sapiens
taaactgtgttta

SEQ ID NO: 3777698 - DNA, 17 bp, Homo sapiens
taaacttttagaaactt

SEQ ID NO: 3777699 - DNA, 14 bp, Homo sapiens
taaagaaggtttca

SEQ ID NO: 3777700 - DNA, 15 bp, Homo sapiens
taaagacaaagacaa

SEQ ID NO: 3777701 - DNA, 13 bp, Homo sapiens
taaagagaaaatt

SEQ ID NO: 3777702 - DNA, 14 bp, Homo sapiens
taaagagaaaattg

SEQ ID NO: 3777703 - DNA, 15 bp, Homo sapiens
taaagagaaactttg

SEQ ID NO: 3777704 - DNA, 20 bp, Homo sapiens
taaagagaaactttgtgcta

SEQ ID NO: 3777705 - DNA, 17 bp, Homo sapiens
taaagaggctgaaagag

SEQ ID NO: 3777706 - DNA, 20 bp, Homo sapiens
taaagaggctgaaagaggcc

SEQ ID NO: 3777707 - DNA, 14 bp, Homo sapiens
taaagatattattc

SEQ ID NO: 3777708 - DNA, 22 bp, Homo sapiens
taaagatgcaaggaccaggact

SEQ ID NO: 3777709 - DNA, 13 bp, Homo sapiens
taaagatggcttt

SEQ ID NO: 3777710 - DNA, 18 bp, Homo sapiens
taaagcaggccttttgat

SEQ ID NO: 3777711 - DNA, 16 bp, Homo sapiens
taaagcatctaaactt

SEQ ID NO: 3777712 - DNA, 18 bp, Homo sapiens
taaagccaaaggtctaga

SEQ ID NO: 3777713 - DNA, 11 bp, Homo sapiens
taaagccaagg

SEQ ID NO: 3777714 - DNA, 16 bp, Homo sapiens
taaagcctgcttttta

SEQ ID NO: 3777715 - DNA, 16 bp, Homo sapiens
taaagctgcctgtagt

SEQ ID NO: 3777716 - DNA, 17 bp, Homo sapiens
taaagctgcctgtagtt

SEQ ID NO: 3777717 - DNA, 18 bp, Homo sapiens
taaagctgcctgtagtta

SEQ ID NO: 3777718 - DNA, 14 bp, Homo sapiens
taaaggacagtgaa

SEQ ID NO: 3777719 - DNA, 20 bp, Homo sapiens
taaaggctatacttgtcttg

SEQ ID NO: 3777720 - DNA, 14 bp, Homo sapiens
taaaggggggaggg

SEQ ID NO: 3777721 - DNA, 21 bp, Homo sapiens
taaaggtggtatgtgtgtgta

SEQ ID NO: 3777722 - DNA, 22 bp, Homo sapiens
taaaggtggtatgtgtgtgtat

SEQ ID NO: 3777723 - DNA, 21 bp, Homo sapiens
taaaggtggtgaggcaataaa

SEQ ID NO: 3777724 - DNA, 21 bp, Homo sapiens
taaagtaaaaagggaattatg

SEQ ID NO: 3777725 - DNA, 14 bp, Homo sapiens
taaagtatatattt

SEQ ID NO: 3777726 - DNA, 17 bp, Homo sapiens
taaagtcaggtccaatt

SEQ ID NO: 3777727 - DNA, 13 bp, Homo sapiens
taaagtgtattat

SEQ ID NO: 3777728 - DNA, 18 bp, Homo sapiens
taaagtgtattataacag

SEQ ID NO: 3777729 - DNA, 17 bp, Homo sapiens
taaagtgtgtttctatg

SEQ ID NO: 3777730 - DNA, 15 bp, Homo sapiens
taaagtgttttcaga

SEQ ID NO: 3777731 - DNA, 12 bp, Homo sapiens
taaagttctgtg

SEQ ID NO: 3777732 - DNA, 13 bp, Homo sapiens
taaagttctgtgt

SEQ ID NO: 3777733 - DNA, 14 bp, Homo sapiens
taaagttctgtgta

SEQ ID NO: 3777734 - DNA, 20 bp, Homo sapiens
taaagttgaagctaagattt

SEQ ID NO: 3777735 - DNA, 20 bp, Homo sapiens
taaataaaaaataataatac

SEQ ID NO: 3777736 - DNA, 14 bp, Homo sapiens
taaataaaaatgga

SEQ ID NO: 3777737 - DNA, 21 bp, Homo sapiens
taaataaaagaaatgcacaat

SEQ ID NO: 3777738 - DNA, 14 bp, Homo sapiens
taaataaaagcagc

SEQ ID NO: 3777739 - DNA, 15 bp, Homo sapiens
taaataaaagcagca

SEQ ID NO: 3777740 - DNA, 11 bp, Homo sapiens
taaataaaata

SEQ ID NO: 3777741 - DNA, 17 bp, Homo sapiens
taaataaaatataattg

SEQ ID NO: 3777742 - DNA, 23 bp, Homo sapiens
taaataaacacatagattcacct

SEQ ID NO: 3777743 - DNA, 20 bp, Homo sapiens
tacagtagtgagaagaatat

SEQ ID NO: 3777744 - DNA, 15 bp, Homo sapiens
tacagtgcagacagg

SEQ ID NO: 3777745 - DNA, 16 bp, Homo sapiens
tacagtgcagacaggc

SEQ ID NO: 3777746 - DNA, 13 bp, Homo sapiens
tacagtggttcta

SEQ ID NO: 3777747 - DNA, 20 bp, Homo sapiens
tacagttgaaaaacagctga

SEQ ID NO: 3777748 - DNA, 20 bp, Homo sapiens
tacagttgttttttgaaaac

SEQ ID NO: 3777749 - DNA, 14 bp, Homo sapiens
tacagttttcctaa

SEQ ID NO: 3777750 - DNA, 19 bp, Homo sapiens
tacagttttcctaaatgta

SEQ ID NO: 3777751 - DNA, 17 bp, Homo sapiens
tacataagataaatgtg

SEQ ID NO: 3777752 - DNA, 18 bp, Homo sapiens
tacataagataaatgtgc

SEQ ID NO: 3777753 - DNA, 12 bp, Homo sapiens
tacatacttttt

SEQ ID NO: 3777754 - DNA, 17 bp, Homo sapiens
tacatactttttcaaga

SEQ ID NO: 3777755 - DNA, 22 bp, Homo sapiens
tacatagtgtaggctttactta

SEQ ID NO: 3777756 - DNA, 16 bp, Homo sapiens
tacatatgtaaaataa

SEQ ID NO: 3777757 - DNA, 19 bp, Homo sapiens
tacatattaggaaaatatg

SEQ ID NO: 3777758 - DNA, 19 bp, Homo sapiens
tacatatttgcatatgtat

SEQ ID NO: 3777759 - DNA, 12 bp, Homo sapiens
tacatccttgtg

SEQ ID NO: 3777760 - DNA, 13 bp, Homo sapiens
tacatccttgtgg

SEQ ID NO: 3777761 - DNA, 20 bp, Homo sapiens
tacatctttcacattggcta

SEQ ID NO: 3777762 - DNA, 21 bp, Homo sapiens
tacatgaaacagaaacaaaaa

SEQ ID NO: 3777763 - DNA, 17 bp, Homo sapiens
tacatgacactgaaatg

SEQ ID NO: 3777764 - DNA, 22 bp, Homo sapiens
tacatgcagcccatgcccacct

SEQ ID NO: 3777765 - DNA, 14 bp, Homo sapiens
tacatggaataaca

SEQ ID NO: 3777766 - DNA, 19 bp, Homo sapiens
tacatgtaaaacattatct

SEQ ID NO: 3777767 - DNA, 15 bp, Homo sapiens
tacattaaagcagtc

SEQ ID NO: 3777768 - DNA, 22 bp, Homo sapiens
tacattaattattattgctgtt

SEQ ID NO: 3777769 - DNA, 21 bp, Homo sapiens
tacattatctaactgtgctca

SEQ ID NO: 3777770 - DNA, 20 bp, Homo sapiens
tacattccttgataatgttg

SEQ ID NO: 3777771 - DNA, 22 bp, Homo sapiens
tacattccttgataatgttgtg

SEQ ID NO: 3777772 - DNA, 17 bp, Homo sapiens
tacattgctggtcttgt

SEQ ID NO: 3777773 - DNA, 16 bp, Homo sapiens
tacatttctgaaatga

SEQ ID NO: 3777774 - DNA, 13 bp, Homo sapiens
tacattttaacat

SEQ ID NO: 3777775 - DNA, 16 bp, Homo sapiens
taccaagttatataaa

SEQ ID NO: 3777776 - DNA, 18 bp, Homo sapiens
taccaagttatataaaga

SEQ ID NO: 3777777 - DNA, 15 bp, Homo sapiens
taccaatcattttaa

SEQ ID NO: 3777778 - DNA, 20 bp, Homo sapiens
taccaatcattttaattatt

SEQ ID NO: 3777779 - DNA, 18 bp, Homo sapiens
taccactgaagatagaag

SEQ ID NO: 3777780 - DNA, 19 bp, Homo sapiens
taccactgaagatagaaga

SEQ ID NO: 3777781 - DNA, 23 bp, Homo sapiens
taccagacggttcaccagcctct

SEQ ID NO: 3777782 - DNA, 22 bp, Homo sapiens
taccagctactccggaggctga

SEQ ID NO: 3777783 - DNA, 22 bp, Homo sapiens
taccaggccgccccagcctctg

SEQ ID NO: 3777784 - DNA, 15 bp, Homo sapiens
taccataatgtattt

SEQ ID NO: 3777785 - DNA, 19 bp, Homo sapiens
taccatagcgctgctctta

SEQ ID NO: 3777786 - DNA, 14 bp, Homo sapiens
taccatttgtaata

SEQ ID NO: 3777787 - DNA, 14 bp, Homo sapiens
tacccacctcagcc

SEQ ID NO: 3777788 - DNA, 15 bp, Homo sapiens
tacccacctcagcct

SEQ ID NO: 3777789 - DNA, 15 bp, Homo sapiens
tacccacctgagctt

SEQ ID NO: 3777790 - DNA, 18 bp, Homo sapiens
tacccacctgagctttgg

SEQ ID NO: 3777791 - DNA, 18 bp, Homo sapiens
tacccagcgagccctggt

SEQ ID NO: 3777792 - DNA, 20 bp, Homo sapiens
tacccatcggtgtccattta

SEQ ID NO: 3777793 - DNA, 21 bp, Homo sapiens
tacccatcggtgtccatttat

SEQ ID NO: 3777794 - DNA, 19 bp, Homo sapiens
tacccatgtctacacagat

SEQ ID NO: 3777795 - DNA, 21 bp, Homo sapiens
tacccattcgtggtgatcaat

SEQ ID NO: 3777796 - DNA, 22 bp, Homo sapiens
taccccaccacgatgtggccct

SEQ ID NO: 3777797 - DNA, 18 bp, Homo sapiens
taccccttacttagcatg

SEQ ID NO: 3777798 - DNA, 23 bp, Homo sapiens
taccctcaggcataggcctgggt

SEQ ID NO: 3777799 - DNA, 20 bp, Homo sapiens
taccctggcactataatgta

SEQ ID NO: 3777800 - DNA, 22 bp, Homo sapiens
taccctggcactataatgtaag

SEQ ID NO: 3777801 - DNA, 18 bp, Homo sapiens
tacccttctgtgcccagc

SEQ ID NO: 3777802 - DNA, 21 bp, Homo sapiens
tacccttctgtgcccagctca

SEQ ID NO: 3777803 - DNA, 22 bp, Homo sapiens
tacccttctttccatttctctc

SEQ ID NO: 3777804 - DNA, 17 bp, Homo sapiens
tacctaattagagcaga

SEQ ID NO: 3777805 - DNA, 18 bp, Homo sapiens
tacctaccacagtgtctg

SEQ ID NO: 3777806 - DNA, 16 bp, Homo sapiens
tacctcaacctgtaaa

SEQ ID NO: 3777807 - DNA, 11 bp, Homo sapiens
tacctcctcct

SEQ ID NO: 3777808 - DNA, 16 bp, Homo sapiens
tacctcctgcccagga

SEQ ID NO: 3777809 - DNA, 23 bp, Homo sapiens
tacctctcttatagaatatttat

SEQ ID NO: 3777810 - DNA, 15 bp, Homo sapiens
taccttcaaagctga

SEQ ID NO: 3777811 - DNA, 17 bp, Homo sapiens
taccttcaataaagtat

SEQ ID NO: 3777812 - DNA, 15 bp, Homo sapiens
taccttcagatccta

SEQ ID NO: 3777813 - DNA, 15 bp, Homo sapiens
taccttgaggtcttt

SEQ ID NO: 3777814 - DNA, 17 bp, Homo sapiens
taccttgcatctcacag

SEQ ID NO: 3777815 - DNA, 15 bp, Homo sapiens
taccttttctcttca

SEQ ID NO: 3777816 - DNA, 15 bp, Homo sapiens
tacgactttattttc

SEQ ID NO: 3777817 - DNA, 17 bp, Homo sapiens
tacgactttattttctg

SEQ ID NO: 3777818 - DNA, 19 bp, Homo sapiens
tacgctctcctttctttct

SEQ ID NO: 3777819 - DNA, 16 bp, Homo sapiens
tacgtagtgtagattt

SEQ ID NO: 3777820 - DNA, 13 bp, Homo sapiens
tacgtatgagacg

SEQ ID NO: 3777821 - DNA, 16 bp, Homo sapiens
tacgtctgacaggcaa

SEQ ID NO: 3777822 - DNA, 14 bp, Homo sapiens
tacgttaccaggca

SEQ ID NO: 3777823 - DNA, 15 bp, Homo sapiens
tactaaaaatacaaa

SEQ ID NO: 3777824 - DNA, 17 bp, Homo sapiens
tactaaagcaaagcaaa

SEQ ID NO: 3777825 - DNA, 13 bp, Homo sapiens
tactaactttcct

SEQ ID NO: 3777826 - DNA, 13 bp, Homo sapiens
tactaatgatgtt

SEQ ID NO: 3777827 - DNA, 16 bp, Homo sapiens
tactaatgatgttttc

SEQ ID NO: 3777828 - DNA, 17 bp, Homo sapiens
tactacatcgccctcca

SEQ ID NO: 3777829 - DNA, 18 bp, Homo sapiens
tactaggcagttagagat

SEQ ID NO: 3777830 - DNA, 14 bp, Homo sapiens
tactagttacacat

SEQ ID NO: 3777831 - DNA, 22 bp, Homo sapiens
tactagttcagacactttggaa

SEQ ID NO: 3777832 - DNA, 14 bp, Homo sapiens
tactatgtatcaat

SEQ ID NO: 3777833 - DNA, 20 bp, Homo sapiens
tactattaagcagtaaaaac

SEQ ID NO: 3777834 - DNA, 22 bp, Homo sapiens
tactattaagcagtaaaaactg

SEQ ID NO: 3777835 - DNA, 19 bp, Homo sapiens
tactattttacttctagag

SEQ ID NO: 3777836 - DNA, 21 bp, Homo sapiens
tactcacagtctctttaatct

SEQ ID NO: 3777837 - DNA, 24 bp, Homo sapiens
tactcaccttgaacaccacgcttg

SEQ ID NO: 3777838 - DNA, 15 bp, Homo sapiens
tactcagcagccctc

SEQ ID NO: 3777839 - DNA, 19 bp, Homo sapiens
tactcagcagccctcctca

SEQ ID NO: 3777840 - DNA, 16 bp, Homo sapiens
tactcagccctgggcc

SEQ ID NO: 3777841 - DNA, 22 bp, Homo sapiens
tactcagccctgggccccacca

SEQ ID NO: 3777842 - DNA, 12 bp, Homo sapiens
tactcaggaggc

SEQ ID NO: 3777843 - DNA, 22 bp, Homo sapiens
tactcaggaggctgaggcagaa

SEQ ID NO: 3777844 - DNA, 19 bp, Homo sapiens
tactcatatatatctatct

SEQ ID NO: 3777845 - DNA, 14 bp, Homo sapiens
tactcattcaggga

SEQ ID NO: 3777846 - DNA, 10 bp, Homo sapiens
tactcccctt

SEQ ID NO: 3777847 - DNA, 12 bp, Homo sapiens
tactcctgcaaa

SEQ ID NO: 3777848 - DNA, 14 bp, Homo sapiens
tactcctgcaaaat

SEQ ID NO: 3777849 - DNA, 17 bp, Homo sapiens
tactcctgcaaaatttt

SEQ ID NO: 3777850 - DNA, 21 bp, Homo sapiens
tactctaattctaaccagagc

SEQ ID NO: 3777851 - DNA, 22 bp, Homo sapiens
tactctaccctcttagaaaaac

SEQ ID NO: 3777852 - DNA, 14 bp, Homo sapiens
tactctccaacctg

SEQ ID NO: 3777853 - DNA, 12 bp, Homo sapiens
tactctggcctc

SEQ ID NO: 3777854 - DNA, 12 bp, Homo sapiens
tactctgtgtca

SEQ ID NO: 3777855 - DNA, 14 bp, Homo sapiens
tactcttgtaagat

SEQ ID NO: 3777856 - DNA, 19 bp, Homo sapiens
tatattgagacaaaaatta

SEQ ID NO: 3777857 - DNA, 14 bp, Homo sapiens
tatatttaaaagaa

SEQ ID NO: 3777858 - DNA, 12 bp, Homo sapiens
tatatttataac

SEQ ID NO: 3777859 - DNA, 21 bp, Homo sapiens
tatatttataactcatcataa

SEQ ID NO: 3777860 - DNA, 22 bp, Homo sapiens
tatatttataactcatcataaa

SEQ ID NO: 3777861 - DNA, 15 bp, Homo sapiens
tatatttttcacagt

SEQ ID NO: 3777862 - DNA, 16 bp, Homo sapiens
tatcaaactgaagcca

SEQ ID NO: 3777863 - DNA, 14 bp, Homo sapiens
tatcaatcattttc

SEQ ID NO: 3777864 - DNA, 18 bp, Homo sapiens
tatcagagtatccactgt

SEQ ID NO: 3777865 - DNA, 17 bp, Homo sapiens
tatcagtgacagagttc

SEQ ID NO: 3777866 - DNA, 18 bp, Homo sapiens
tatcatggaaatattatg

SEQ ID NO: 3777867 - DNA, 16 bp, Homo sapiens
tatcatgtcaaacgtg

SEQ ID NO: 3777868 - DNA, 12 bp, Homo sapiens
tatcattcagca

SEQ ID NO: 3777869 - DNA, 19 bp, Homo sapiens
tatccaacatcaacatctt

SEQ ID NO: 3777870 - DNA, 12 bp, Homo sapiens
tatccacccagc

SEQ ID NO: 3777871 - DNA, 15 bp, Homo sapiens
tatccacccagccca

SEQ ID NO: 3777872 - DNA, 18 bp, Homo sapiens
tatccactttgcacagct

SEQ ID NO: 3777873 - DNA, 19 bp, Homo sapiens
tatccatgggggcagggca

SEQ ID NO: 3777874 - DNA, 21 bp, Homo sapiens
tatcccacggaaaatgccaat

SEQ ID NO: 3777875 - DNA, 16 bp, Homo sapiens
tatcccatcccatccc

SEQ ID NO: 3777876 - DNA, 14 bp, Homo sapiens
tatcccttcctttt

SEQ ID NO: 3777877 - DNA, 13 bp, Homo sapiens
tatcctgagccat

SEQ ID NO: 3777878 - DNA, 15 bp, Homo sapiens
tatcctgcccagtgt

SEQ ID NO: 3777879 - DNA, 17 bp, Homo sapiens
tatcctggctttgccca

SEQ ID NO: 3777880 - DNA, 16 bp, Homo sapiens
tatcgagtttgcaatg

SEQ ID NO: 3777881 - DNA, 16 bp, Homo sapiens
tatcgatctcttattt

SEQ ID NO: 3777882 - DNA, 14 bp, Homo sapiens
tatcgggaacagtg

SEQ ID NO: 3777883 - DNA, 17 bp, Homo sapiens
tatcgggaacagtgttt

SEQ ID NO: 3777884 - DNA, 16 bp, Homo sapiens
tatcgggggctggggc

SEQ ID NO: 3777885 - DNA, 23 bp, Homo sapiens
tatctaaaccatatgaacatata

SEQ ID NO: 3777886 - DNA, 16 bp, Homo sapiens
tatctaaatgttgaaa

SEQ ID NO: 3777887 - DNA, 15 bp, Homo sapiens
tatctaaccagtgat

SEQ ID NO: 3777888 - DNA, 19 bp, Homo sapiens
tatctaaccagtgattcga

SEQ ID NO: 3777889 - DNA, 15 bp, Homo sapiens
tatctcagggcctgg

SEQ ID NO: 3777890 - DNA, 18 bp, Homo sapiens
tatctctgtgtgcacaaa

SEQ ID NO: 3777891 - DNA, 22 bp, Homo sapiens
tatctcttttgaatccatgctt

SEQ ID NO: 3777892 - DNA, 15 bp, Homo sapiens
tatctgaaaatgtat

SEQ ID NO: 3777893 - DNA, 22 bp, Homo sapiens
tatctgtacatactttttcaag

SEQ ID NO: 3777894 - DNA, 23 bp, Homo sapiens
tatctgtcatttgagcagggctc

SEQ ID NO: 3777895 - DNA, 19 bp, Homo sapiens
tatctgtgaaatgctggca

SEQ ID NO: 3777896 - DNA, 18 bp, Homo sapiens
tatctgtgcgtgaaacac

SEQ ID NO: 3777897 - DNA, 20 bp, Homo sapiens
tatctgtgtttttgaaatat

SEQ ID NO: 3777898 - DNA, 18 bp, Homo sapiens
tatctgttttactgcttt

SEQ ID NO: 3777899 - DNA, 14 bp, Homo sapiens
tatcttaaagcact

SEQ ID NO: 3777900 - DNA, 15 bp, Homo sapiens
tatcttcgttcttgt

SEQ ID NO: 3777901 - DNA, 14 bp, Homo sapiens
tatcttctgatttg

SEQ ID NO: 3777902 - DNA, 20 bp, Homo sapiens
tatcttggactgacatttag

SEQ ID NO: 3777903 - DNA, 15 bp, Homo sapiens
tatcttgtctctggg

SEQ ID NO: 3777904 - DNA, 22 bp, Homo sapiens
tatcttgtttttccactactgc

SEQ ID NO: 3777905 - DNA, 14 bp, Homo sapiens
tatcttttctacag

SEQ ID NO: 3777906 - DNA, 14 bp, Homo sapiens
tatcttttgagaac

SEQ ID NO: 3777907 - DNA, 16 bp, Homo sapiens
tatctttttattgatg

SEQ ID NO: 3777908 - DNA, 15 bp, Homo sapiens
tatgaagaagagagt

SEQ ID NO: 3777909 - DNA, 12 bp, Homo sapiens
tatgaataacat

SEQ ID NO: 3777910 - DNA, 19 bp, Homo sapiens
tatgacatcacttgtacaa

SEQ ID NO: 3777911 - DNA, 23 bp, Homo sapiens
tatgacatcacttgtacaaaata

SEQ ID NO: 3777912 - DNA, 24 bp, Homo sapiens
tatgacatcacttgtacaaaataa

SEQ ID NO: 3777913 - DNA, 18 bp, Homo sapiens
tatgaccttctaggaagc

SEQ ID NO: 3777914 - DNA, 21 bp, Homo sapiens
tatgactaaagagagaatgta

SEQ ID NO: 3777915 - DNA, 12 bp, Homo sapiens
tatgagactttc

SEQ ID NO: 3777916 - DNA, 17 bp, Homo sapiens
tatgagctcatgtagca

SEQ ID NO: 3777917 - DNA, 23 bp, Homo sapiens
tatgaggacttgtgtctctgtgc

SEQ ID NO: 3777918 - DNA, 19 bp, Homo sapiens
tatgaggtctaggaacata

SEQ ID NO: 3777919 - DNA, 21 bp, Homo sapiens
tatgagtttttgatagcttta

SEQ ID NO: 3777920 - DNA, 15 bp, Homo sapiens
tatgataaaaaattt

SEQ ID NO: 3777921 - DNA, 19 bp, Homo sapiens
tatgataaaaaattttgta

SEQ ID NO: 3777922 - DNA, 20 bp, Homo sapiens
tatgataaaaaattttgtaa

SEQ ID NO: 3777923 - DNA, 20 bp, Homo sapiens
tatgatattccatagtatat

SEQ ID NO: 3777924 - DNA, 18 bp, Homo sapiens
tatgatattgcatatgca

SEQ ID NO: 3777925 - DNA, 15 bp, Homo sapiens
tatgatcgcgccact

SEQ ID NO: 3777926 - DNA, 18 bp, Homo sapiens
tatgatttggaaaataaa

SEQ ID NO: 3777927 - DNA, 15 bp, Homo sapiens
tatgcaaattcccag

SEQ ID NO: 3777928 - DNA, 14 bp, Homo sapiens
tatgcaataaataa

SEQ ID NO: 3777929 - DNA, 14 bp, Homo sapiens
tatgcataaagtca

SEQ ID NO: 3777930 - DNA, 15 bp, Homo sapiens
tatgcataaagtcag

SEQ ID NO: 3777931 - DNA, 14 bp, Homo sapiens
tatgccatttgttt

SEQ ID NO: 3777932 - DNA, 13 bp, Homo sapiens
tatgctaatcagg

SEQ ID NO: 3777933 - DNA, 16 bp, Homo sapiens
tatgctactacaaaaa

SEQ ID NO: 3777934 - DNA, 14 bp, Homo sapiens
tatgctctgcatgt

SEQ ID NO: 3777935 - DNA, 19 bp, Homo sapiens
tatgctctgcatgttacat

SEQ ID NO: 3777936 - DNA, 13 bp, Homo sapiens
tatgctgtatttt

SEQ ID NO: 3777937 - DNA, 22 bp, Homo sapiens
tatgcttatacacttacacttt

SEQ ID NO: 3777938 - DNA, 19 bp, Homo sapiens
tatgcttattttaaaattt

SEQ ID NO: 3777939 - DNA, 13 bp, Homo sapiens
tatggaactctct

SEQ ID NO: 3777940 - DNA, 24 bp, Homo sapiens
tatggaatacagtgttattttctt

SEQ ID NO: 3777941 - DNA, 15 bp, Homo sapiens
tatgggagccccagg

SEQ ID NO: 3777942 - DNA, 23 bp, Homo sapiens
tatggggggccaacaccagggat

SEQ ID NO: 3777943 - DNA, 20 bp, Homo sapiens
tatggtataatggttgactg

SEQ ID NO: 3777944 - DNA, 22 bp, Homo sapiens
tatggtcaacacttaagggttt

SEQ ID NO: 3777945 - DNA, 18 bp, Homo sapiens
tatgtaaacataattctt

SEQ ID NO: 3777946 - DNA, 24 bp, Homo sapiens
tatgtaactgcattgagaactgca

SEQ ID NO: 3777947 - DNA, 15 bp, Homo sapiens
tatgtaataatgtga

SEQ ID NO: 3777948 - DNA, 21 bp, Homo sapiens
tatgtactcctctttacactg

SEQ ID NO: 3777949 - DNA, 14 bp, Homo sapiens
tatgtattttatgt

SEQ ID NO: 3777950 - DNA, 19 bp, Homo sapiens
tatgtattttatgtatgtt

SEQ ID NO: 3777951 - DNA, 15 bp, Homo sapiens
tatgtccatatctaa

SEQ ID NO: 3777952 - DNA, 19 bp, Homo sapiens
tatgtgacaattttgtaca

SEQ ID NO: 3777953 - DNA, 23 bp, Homo sapiens
tatgtgagtgtgtgtttgtgctg

SEQ ID NO: 3777954 - DNA, 21 bp, Homo sapiens
tatgtgtgtatgggtgtgtgt

SEQ ID NO: 3777955 - DNA, 15 bp, Homo sapiens
tatgtgtttttcaca

SEQ ID NO: 3777956 - DNA, 19 bp, Homo sapiens
tatgttaacctcagtgtca

SEQ ID NO: 3777957 - DNA, 20 bp, Homo sapiens
tatgttaacctcagtgtcat

SEQ ID NO: 3777958 - DNA, 14 bp, Homo sapiens
tatgttattgaaaa

SEQ ID NO: 3777959 - DNA, 20 bp, Homo sapiens
tatgttgcccaggcaggtct

SEQ ID NO: 3777960 - DNA, 15 bp, Homo sapiens
tatgttgtgaagatg

SEQ ID NO: 3777961 - DNA, 13 bp, Homo sapiens
tatgtttacactg

SEQ ID NO: 3777962 - DNA, 15 bp, Homo sapiens
tatgtttacactgtc

SEQ ID NO: 3777963 - DNA, 16 bp, Homo sapiens
tatgtttacactgtca

SEQ ID NO: 3777964 - DNA, 19 bp, Homo sapiens
tatgtttgcacacttgtgt

SEQ ID NO: 3777965 - DNA, 18 bp, Homo sapiens
tatgttttagcatgtgtt

SEQ ID NO: 3777966 - DNA, 20 bp, Homo sapiens
tattaaaaatggtaaaattg

SEQ ID NO: 3777967 - DNA, 22 bp, Homo sapiens
tattaaaacagaaattaatctt

SEQ ID NO: 3777968 - DNA, 10 bp, Homo sapiens
tattaaaatc

SEQ ID NO: 3777969 - DNA, 14 bp, Homo sapiens
tcaattccacctgc

SEQ ID NO: 3777970 - DNA, 15 bp, Homo sapiens
tcaattcctctggga

SEQ ID NO: 3777971 - DNA, 17 bp, Homo sapiens
tcaattcctgggcccca

SEQ ID NO: 3777972 - DNA, 23 bp, Homo sapiens
tcaatttattgcacaaaatataa

SEQ ID NO: 3777973 - DNA, 13 bp, Homo sapiens
tcaatttccaaga

SEQ ID NO: 3777974 - DNA, 20 bp, Homo sapiens
tcaatttccaagagctgagg

SEQ ID NO: 3777975 - DNA, 15 bp, Homo sapiens
tcaatttgtcatttt

SEQ ID NO: 3777976 - DNA, 20 bp, Homo sapiens
tcaatttgtcattttgaagc

SEQ ID NO: 3777977 - DNA, 21 bp, Homo sapiens
tcacaaaggaatggaggctct

SEQ ID NO: 3777978 - DNA, 16 bp, Homo sapiens
tcacaacaacctggtc

SEQ ID NO: 3777979 - DNA, 17 bp, Homo sapiens
tcacaagagcccagcag

SEQ ID NO: 3777980 - DNA, 12 bp, Homo sapiens
tcacaagctgcc

SEQ ID NO: 3777981 - DNA, 15 bp, Homo sapiens
tcacaagctgcctcc

SEQ ID NO: 3777982 - DNA, 16 bp, Homo sapiens
tcacaagctgcctccc

SEQ ID NO: 3777983 - DNA, 23 bp, Homo sapiens
tcacaagctgcctccctgtccac

SEQ ID NO: 3777984 - DNA, 22 bp, Homo sapiens
tcacaaggcattcaagtgtaca

SEQ ID NO: 3777985 - DNA, 22 bp, Homo sapiens
tcacaagtgaaaaacatccaga

SEQ ID NO: 3777986 - DNA, 14 bp, Homo sapiens
tcacacaaagcaga

SEQ ID NO: 3777987 - DNA, 21 bp, Homo sapiens
tcacacagtattacttctgct

SEQ ID NO: 3777988 - DNA, 13 bp, Homo sapiens
tcacacagtgagt

SEQ ID NO: 3777989 - DNA, 21 bp, Homo sapiens
tcacaccaggcttgcctgcag

SEQ ID NO: 3777990 - DNA, 21 bp, Homo sapiens
tcacacctgaaaatgttagtg

SEQ ID NO: 3777991 - DNA, 22 bp, Homo sapiens
tcacacgtctggcttcacagat

SEQ ID NO: 3777992 - DNA, 16 bp, Homo sapiens
tcacacttctgtgaga

SEQ ID NO: 3777993 - DNA, 16 bp, Homo sapiens
tcacagaaatcagagg

SEQ ID NO: 3777994 - DNA, 21 bp, Homo sapiens
tcacagaaatcagaggagaga

SEQ ID NO: 3777995 - DNA, 11 bp, Homo sapiens
tcacagaagaa

SEQ ID NO: 3777996 - DNA, 14 bp, Homo sapiens
tcacagactggaga

SEQ ID NO: 3777997 - DNA, 15 bp, Homo sapiens
tcacagagacacagg

SEQ ID NO: 3777998 - DNA, 21 bp, Homo sapiens
tcacagatgtgtgattcacag

SEQ ID NO: 3777999 - DNA, 23 bp, Homo sapiens
tcacagatgtgtgattcacagtg

SEQ ID NO: 3778000 - DNA, 15 bp, Homo sapiens
tcacagcttcagcca

SEQ ID NO: 3778001 - DNA, 17 bp, Homo sapiens
tcacagcttcagccagg

SEQ ID NO: 3778002 - DNA, 18 bp, Homo sapiens
tcacaggactctgcctcc

SEQ ID NO: 3778003 - DNA, 19 bp, Homo sapiens
tcacaggcaggtccagggt

SEQ ID NO: 3778004 - DNA, 19 bp, Homo sapiens
tcacagggcagagccggga

SEQ ID NO: 3778005 - DNA, 23 bp, Homo sapiens
tcacagggccccagaaggcaggg

SEQ ID NO: 3778006 - DNA, 18 bp, Homo sapiens
tcacagtctctttaatct

SEQ ID NO: 3778007 - DNA, 18 bp, Homo sapiens
tcacagtgggagccaggg

SEQ ID NO: 3778008 - DNA, 17 bp, Homo sapiens
tcacagtgttgcccagg

SEQ ID NO: 3778009 - DNA, 22 bp, Homo sapiens
tcacagttcctcgccctgggtc

SEQ ID NO: 3778010 - DNA, 15 bp, Homo sapiens
tcacataacagaatg

SEQ ID NO: 3778011 - DNA, 17 bp, Homo sapiens
tcacatagagtgatctt

SEQ ID NO: 3778012 - DNA, 15 bp, Homo sapiens
tcacatagatgtccc

SEQ ID NO: 3778013 - DNA, 15 bp, Homo sapiens
tcacatatctgtcat

SEQ ID NO: 3778014 - DNA, 17 bp, Homo sapiens
tcacatcctgtgtttct

SEQ ID NO: 3778015 - DNA, 17 bp, Homo sapiens
tcacatctttcacactt

SEQ ID NO: 3778016 - DNA, 23 bp, Homo sapiens
tcacatgctggacaggtctggga

SEQ ID NO: 3778017 - DNA, 19 bp, Homo sapiens
tcacattaatatttgctga

SEQ ID NO: 3778018 - DNA, 14 bp, Homo sapiens
tcacatttattctg

SEQ ID NO: 3778019 - DNA, 12 bp, Homo sapiens
tcaccaagctca

SEQ ID NO: 3778020 - DNA, 16 bp, Homo sapiens
tcaccaagctcacagt

SEQ ID NO: 3778021 - DNA, 20 bp, Homo sapiens
tcaccaagctcacagttcct

SEQ ID NO: 3778022 - DNA, 21 bp, Homo sapiens
tcaccaagctcacagttcctc

SEQ ID NO: 3778023 - DNA, 16 bp, Homo sapiens
tcaccacatgtgcaca

SEQ ID NO: 3778024 - DNA, 13 bp, Homo sapiens
tcaccacctctcc

SEQ ID NO: 3778025 - DNA, 16 bp, Homo sapiens
tcaccaccttcccagc

SEQ ID NO: 3778026 - DNA, 17 bp, Homo sapiens
tcaccagccccagtgcc

SEQ ID NO: 3778027 - DNA, 22 bp, Homo sapiens
tcaccaggaatgttaaagtcag

SEQ ID NO: 3778028 - DNA, 23 bp, Homo sapiens
tcaccagtgtgtggctttcagag

SEQ ID NO: 3778029 - DNA, 14 bp, Homo sapiens
tcaccatctcaggc

SEQ ID NO: 3778030 - DNA, 17 bp, Homo sapiens
tcaccatgtaaaacaaa

SEQ ID NO: 3778031 - DNA, 20 bp, Homo sapiens
tcaccatgtaaaacaaaaaa

SEQ ID NO: 3778032 - DNA, 15 bp, Homo sapiens
tcacccacagaaaga

SEQ ID NO: 3778033 - DNA, 11 bp, Homo sapiens
tcacccacagg

SEQ ID NO: 3778034 - DNA, 14 bp, Homo sapiens
tcacccacagggct

SEQ ID NO: 3778035 - DNA, 22 bp, Homo sapiens
tcacccacagggctaagagcta

SEQ ID NO: 3778036 - DNA, 19 bp, Homo sapiens
tcaccccatcccacaccct

SEQ ID NO: 3778037 - DNA, 13 bp, Homo sapiens
tcacccccagctt

SEQ ID NO: 3778038 - DNA, 14 bp, Homo sapiens
tcaccccgtctggg

SEQ ID NO: 3778039 - DNA, 17 bp, Homo sapiens
tcacccctccacccttg

SEQ ID NO: 3778040 - DNA, 17 bp, Homo sapiens
tcacccctgccctggga

SEQ ID NO: 3778041 - DNA, 21 bp, Homo sapiens
tcaccctgtccaaactgccta

SEQ ID NO: 3778042 - DNA, 15 bp, Homo sapiens
tcaccggatcctggg

SEQ ID NO: 3778043 - DNA, 21 bp, Homo sapiens
tcacctaatgtttatgagcca

SEQ ID NO: 3778044 - DNA, 14 bp, Homo sapiens
tcacctagaaactt

SEQ ID NO: 3778045 - DNA, 18 bp, Homo sapiens
tcacctcaggccaggtgc

SEQ ID NO: 3778046 - DNA, 13 bp, Homo sapiens
tcacctcccctcc

SEQ ID NO: 3778047 - DNA, 17 bp, Homo sapiens
tcacctcccctccttgc

SEQ ID NO: 3778048 - DNA, 16 bp, Homo sapiens
tcacctctctcactga

SEQ ID NO: 3778049 - DNA, 18 bp, Homo sapiens
tcacctctggactggcta

SEQ ID NO: 3778050 - DNA, 19 bp, Homo sapiens
tcacctctggactggctag

SEQ ID NO: 3778051 - DNA, 22 bp, Homo sapiens
tcacctgagcccggatgcttct

SEQ ID NO: 3778052 - DNA, 23 bp, Homo sapiens
tcacctgagcccggatgcttctc

SEQ ID NO: 3778053 - DNA, 19 bp, Homo sapiens
tcacctgagtcaccctacc

SEQ ID NO: 3778054 - DNA, 20 bp, Homo sapiens
tcacctgggcacctggggag

SEQ ID NO: 3778055 - DNA, 21 bp, Homo sapiens
tcacctgtttttaagctgttt

SEQ ID NO: 3778056 - DNA, 22 bp, Homo sapiens
tcacctgtttttaagctgtttc

SEQ ID NO: 3778057 - DNA, 15 bp, Homo sapiens
tcaccttaggcaggg

SEQ ID NO: 3778058 - DNA, 20 bp, Homo sapiens
tcaccttaggcagggaagtg

SEQ ID NO: 3778059 - DNA, 18 bp, Homo sapiens
tcaccttgcaacacacag

SEQ ID NO: 3778060 - DNA, 17 bp, Homo sapiens
tcacctttccctaaaga

SEQ ID NO: 3778061 - DNA, 12 bp, Homo sapiens
tcaccttttaaa

SEQ ID NO: 3778062 - DNA, 23 bp, Homo sapiens
tcaccttttaaatcctgttgaaa

SEQ ID NO: 3778063 - DNA, 15 bp, Homo sapiens
tcacgcacctcccat

SEQ ID NO: 3778064 - DNA, 20 bp, Homo sapiens
tcacgcctgtaatcccagca

SEQ ID NO: 3778065 - DNA, 16 bp, Homo sapiens
tcacgcctgtgcagtg

SEQ ID NO: 3778066 - DNA, 12 bp, Homo sapiens
tcacgtgtgtga

SEQ ID NO: 3778067 - DNA, 14 bp, Homo sapiens
tcactaacattata

SEQ ID NO: 3778068 - DNA, 19 bp, Homo sapiens
tcactactcacagtctctt

SEQ ID NO: 3778069 - DNA, 13 bp, Homo sapiens
tcactatgcattt

SEQ ID NO: 3778070 - DNA, 15 bp, Homo sapiens
tcactatgcatttta

SEQ ID NO: 3778071 - DNA, 17 bp, Homo sapiens
tcactcaagttcaagga

SEQ ID NO: 3778072 - DNA, 14 bp, Homo sapiens
tcactcagatggaa

SEQ ID NO: 3778073 - DNA, 14 bp, Homo sapiens
tcactccaccaccc

SEQ ID NO: 3778074 - DNA, 15 bp, Homo sapiens
tcactccaccaccca

SEQ ID NO: 3778075 - DNA, 14 bp, Homo sapiens
tcactcccagtcca

SEQ ID NO: 3778076 - DNA, 16 bp, Homo sapiens
tcactcccttctcctt

SEQ ID NO: 3778077 - DNA, 23 bp, Homo sapiens
tcactcccttctccttgataaca

SEQ ID NO: 3778078 - DNA, 14 bp, Homo sapiens
tcactccggtgtgc

SEQ ID NO: 3778079 - DNA, 22 bp, Homo sapiens
tcactccggtgtgcctgcagcc

SEQ ID NO: 3778080 - DNA, 19 bp, Homo sapiens
tcactctacttagcatgtc

SEQ ID NO: 3778081 - DNA, 19 bp, Homo sapiens
tcactctgtcgcccagtct

SEQ ID NO: 3778082 - DNA, 14 bp, Homo sapiens
tcatatatatctat

SEQ ID NO: 3778083 - DNA, 15 bp, Homo sapiens
tcatatcttcacaat

SEQ ID NO: 3778084 - DNA, 13 bp, Homo sapiens
tcatatgcttcaa

SEQ ID NO: 3778085 - DNA, 15 bp, Homo sapiens
tcatatttacttctt

SEQ ID NO: 3778086 - DNA, 12 bp, Homo sapiens
tcatcagtgtta

SEQ ID NO: 3778087 - DNA, 19 bp, Homo sapiens
tcatcataaaataaagtat

SEQ ID NO: 3778088 - DNA, 14 bp, Homo sapiens
tcatcatcctaagc

SEQ ID NO: 3778089 - DNA, 21 bp, Homo sapiens
tcatccactgtgccatgtgcc

SEQ ID NO: 3778090 - DNA, 14 bp, Homo sapiens
tcatccccaccttg

SEQ ID NO: 3778091 - DNA, 15 bp, Homo sapiens
tcatccggcagcctg

SEQ ID NO: 3778092 - DNA, 13 bp, Homo sapiens
tcatcctgcaggc

SEQ ID NO: 3778093 - DNA, 13 bp, Homo sapiens
tcatccttttctc

SEQ ID NO: 3778094 - DNA, 15 bp, Homo sapiens
tcatctatttctgag

SEQ ID NO: 3778095 - DNA, 16 bp, Homo sapiens
tcatctatttctgaga

SEQ ID NO: 3778096 - DNA, 22 bp, Homo sapiens
tcatcttggtactactagatgt

SEQ ID NO: 3778097 - DNA, 14 bp, Homo sapiens
tcatgaaatatgca

SEQ ID NO: 3778098 - DNA, 22 bp, Homo sapiens
tcatgaacacatcagctagcaa

SEQ ID NO: 3778099 - DNA, 14 bp, Homo sapiens
tcatgatctccctg

SEQ ID NO: 3778100 - DNA, 15 bp, Homo sapiens
tcatgatctccctgc

SEQ ID NO: 3778101 - DNA, 22 bp, Homo sapiens
tcatgatctccctgccgcctca

SEQ ID NO: 3778102 - DNA, 16 bp, Homo sapiens
tcatgatcttgtgaca

SEQ ID NO: 3778103 - DNA, 17 bp, Homo sapiens
tcatgatcttgtgacat

SEQ ID NO: 3778104 - DNA, 18 bp, Homo sapiens
tcatgatcttgtgacata

SEQ ID NO: 3778105 - DNA, 23 bp, Homo sapiens
tcatgatttcatttcaactgttt

SEQ ID NO: 3778106 - DNA, 15 bp, Homo sapiens
tcatgcaatgacatc

SEQ ID NO: 3778107 - DNA, 18 bp, Homo sapiens
tcatgcatagtcccagct

SEQ ID NO: 3778108 - DNA, 12 bp, Homo sapiens
tcatgcattgtt

SEQ ID NO: 3778109 - DNA, 19 bp, Homo sapiens
tcatgccaccatggccagc

SEQ ID NO: 3778110 - DNA, 16 bp, Homo sapiens
tcatgcctttgtaagt

SEQ ID NO: 3778111 - DNA, 15 bp, Homo sapiens
tcatgctatctctgt

SEQ ID NO: 3778112 - DNA, 22 bp, Homo sapiens
tcatgggttatgtgtatgtgcc

SEQ ID NO: 3778113 - DNA, 18 bp, Homo sapiens
tcatggtccccatggcat

SEQ ID NO: 3778114 - DNA, 15 bp, Homo sapiens
tcatggtgaggctta

SEQ ID NO: 3778115 - DNA, 22 bp, Homo sapiens
tcatggtgaggcttaacaatgt

SEQ ID NO: 3778116 - DNA, 23 bp, Homo sapiens
tcatggtgggttcaggggactca

SEQ ID NO: 3778117 - DNA, 20 bp, Homo sapiens
tcatgtaacttccctgaaaa

SEQ ID NO: 3778118 - DNA, 13 bp, Homo sapiens
tcatgtctggcta

SEQ ID NO: 3778119 - DNA, 22 bp, Homo sapiens
tcatgttaatcctagctgtgtg

SEQ ID NO: 3778120 - DNA, 15 bp, Homo sapiens
tcatgtttcttaaat

SEQ ID NO: 3778121 - DNA, 22 bp, Homo sapiens
tcattataatgtcattaaacat

SEQ ID NO: 3778122 - DNA, 11 bp, Homo sapiens
tcattatttat

SEQ ID NO: 3778123 - DNA, 16 bp, Homo sapiens
tcattatttgcagaga

SEQ ID NO: 3778124 - DNA, 21 bp, Homo sapiens
tcattccaacttcccagttca

SEQ ID NO: 3778125 - DNA, 16 bp, Homo sapiens
tcattccatgtgccca

SEQ ID NO: 3778126 - DNA, 17 bp, Homo sapiens
tcattccatgtgcccag

SEQ ID NO: 3778127 - DNA, 20 bp, Homo sapiens
tcattccatgtgcccagtta

SEQ ID NO: 3778128 - DNA, 20 bp, Homo sapiens
tcattcctgaaagaaacagt

SEQ ID NO: 3778129 - DNA, 17 bp, Homo sapiens
tcattcttgaaagctgt

SEQ ID NO: 3778130 - DNA, 16 bp, Homo sapiens
tcattgatatgaaaaa

SEQ ID NO: 3778131 - DNA, 17 bp, Homo sapiens
tcattgatatgaaaaat

SEQ ID NO: 3778132 - DNA, 17 bp, Homo sapiens
tcattgccagtgtcttt

SEQ ID NO: 3778133 - DNA, 22 bp, Homo sapiens
tcattgccagtgtctttctttg

SEQ ID NO: 3778134 - DNA, 12 bp, Homo sapiens
tcattgctttac

SEQ ID NO: 3778135 - DNA, 16 bp, Homo sapiens
tcattgtaaacaaact

SEQ ID NO: 3778136 - DNA, 23 bp, Homo sapiens
tcattgtggttatttttatacag

SEQ ID NO: 3778137 - DNA, 11 bp, Homo sapiens
tcatttatgat

SEQ ID NO: 3778138 - DNA, 19 bp, Homo sapiens
tcatttcaaatacatcttt

SEQ ID NO: 3778139 - DNA, 22 bp, Homo sapiens
tcatttcctatgtaactgcatt

SEQ ID NO: 3778140 - DNA, 13 bp, Homo sapiens
tcatttcctgtgt

SEQ ID NO: 3778141 - DNA, 13 bp, Homo sapiens
tcatttcttgggc

SEQ ID NO: 3778142 - DNA, 14 bp, Homo sapiens
tcatttgtcacaca

SEQ ID NO: 3778143 - DNA, 13 bp, Homo sapiens
tcattttaattat

SEQ ID NO: 3778144 - DNA, 22 bp, Homo sapiens
tcattttggtaaaatacttctt

SEQ ID NO: 3778145 - DNA, 23 bp, Homo sapiens
tccaaagaattatgcatctgcta

SEQ ID NO: 3778146 - DNA, 23 bp, Homo sapiens
tccaaaggaatctccagttttca

SEQ ID NO: 3778147 - DNA, 22 bp, Homo sapiens
tccaaaggaggatggcatataa

SEQ ID NO: 3778148 - DNA, 16 bp, Homo sapiens
tccaacaggagctggg

SEQ ID NO: 3778149 - DNA, 17 bp, Homo sapiens
tccaaccccccacctgc

SEQ ID NO: 3778150 - DNA, 16 bp, Homo sapiens
tccaacccgaggcccg

SEQ ID NO: 3778151 - DNA, 20 bp, Homo sapiens
tccaacctaacccctttcct

SEQ ID NO: 3778152 - DNA, 17 bp, Homo sapiens
tccaacctggacaacaa

SEQ ID NO: 3778153 - DNA, 12 bp, Homo sapiens
tccaactccagt

SEQ ID NO: 3778154 - DNA, 24 bp, Homo sapiens
tccaactcttccccctctcccagt

SEQ ID NO: 3778155 - DNA, 12 bp, Homo sapiens
tccaactgctgc

SEQ ID NO: 3778156 - DNA, 16 bp, Homo sapiens
tccaactgctgcccca

SEQ ID NO: 3778157 - DNA, 19 bp, Homo sapiens
tccaagcaagtagctttcc

SEQ ID NO: 3778158 - DNA, 21 bp, Homo sapiens
tccaagcgaggtcaacagaga

SEQ ID NO: 3778159 - DNA, 23 bp, Homo sapiens
tccaagcgaggtcaacagagaag

SEQ ID NO: 3778160 - DNA, 18 bp, Homo sapiens
tccaagctccatctccac

SEQ ID NO: 3778161 - DNA, 20 bp, Homo sapiens
tccaagctggtcccactcag

SEQ ID NO: 3778162 - DNA, 21 bp, Homo sapiens
tccaagctggtcccactcagt

SEQ ID NO: 3778163 - DNA, 19 bp, Homo sapiens
tccaaggagaaacagagac

SEQ ID NO: 3778164 - DNA, 23 bp, Homo sapiens
tccaaggagctgagaatagaagg

SEQ ID NO: 3778165 - DNA, 18 bp, Homo sapiens
tccaagggtactaaggaa

SEQ ID NO: 3778166 - DNA, 23 bp, Homo sapiens
tccaataaatgtgaaattctgtc

SEQ ID NO: 3778167 - DNA, 18 bp, Homo sapiens
tccaatcccaccaaccct

SEQ ID NO: 3778168 - DNA, 16 bp, Homo sapiens
tccaatcctcactggg

SEQ ID NO: 3778169 - DNA, 18 bp, Homo sapiens
tccaatcctcactgggtg

SEQ ID NO: 3778170 - DNA, 22 bp, Homo sapiens
tccaatttgtaaaaacagcatt

SEQ ID NO: 3778171 - DNA, 14 bp, Homo sapiens
tccaattttctgga

SEQ ID NO: 3778172 - DNA, 18 bp, Homo sapiens
tccacaagattcccagag

SEQ ID NO: 3778173 - DNA, 20 bp, Homo sapiens
tccacaagattcccagagac

SEQ ID NO: 3778174 - DNA, 23 bp, Homo sapiens
tccacaagattcccagagacagg

SEQ ID NO: 3778175 - DNA, 18 bp, Homo sapiens
tccacaagttaaataaat

SEQ ID NO: 3778176 - DNA, 14 bp, Homo sapiens
tccacacacagagg

SEQ ID NO: 3778177 - DNA, 17 bp, Homo sapiens
tccacagatgcctccac

SEQ ID NO: 3778178 - DNA, 16 bp, Homo sapiens
tccacagccgcagcct

SEQ ID NO: 3778179 - DNA, 17 bp, Homo sapiens
tccacagccgcagcctc

SEQ ID NO: 3778180 - DNA, 18 bp, Homo sapiens
tccacagccgcagcctcc

SEQ ID NO: 3778181 - DNA, 15 bp, Homo sapiens
tccacaggtctcaga

SEQ ID NO: 3778182 - DNA, 16 bp, Homo sapiens
tccacataggtttaga

SEQ ID NO: 3778183 - DNA, 18 bp, Homo sapiens
tccaccaacccatcagaa

SEQ ID NO: 3778184 - DNA, 17 bp, Homo sapiens
tccaccaagaaagcagg

SEQ ID NO: 3778185 - DNA, 13 bp, Homo sapiens
tccaccacccaaa

SEQ ID NO: 3778186 - DNA, 17 bp, Homo sapiens
tccacccacctcagcct

SEQ ID NO: 3778187 - DNA, 12 bp, Homo sapiens
tccacccagccc

SEQ ID NO: 3778188 - DNA, 14 bp, Homo sapiens
tccacccaggagcc

SEQ ID NO: 3778189 - DNA, 12 bp, Homo sapiens
tccaccccactc

SEQ ID NO: 3778190 - DNA, 23 bp, Homo sapiens
tccacccccgcctccctcccctg

SEQ ID NO: 3778191 - DNA, 15 bp, Homo sapiens
tccaccccctccctg

SEQ ID NO: 3778192 - DNA, 19 bp, Homo sapiens
tccaccccctccctggcct

SEQ ID NO: 3778193 - DNA, 13 bp, Homo sapiens
tccacctcagcct

SEQ ID NO: 3778194 - DNA, 13 bp, Homo sapiens
tccacctggaagc

SEQ ID NO: 3778195 - DNA, 16 bp, Homo sapiens
tcccgagtagctggga

SEQ ID NO: 3778196 - DNA, 21 bp, Homo sapiens
tcccgcctcttcttcttcaga

SEQ ID NO: 3778197 - DNA, 14 bp, Homo sapiens
tcccgctcagccct

SEQ ID NO: 3778198 - DNA, 15 bp, Homo sapiens
tcccgctcagccctc

SEQ ID NO: 3778199 - DNA, 16 bp, Homo sapiens
tcccgctcagccctcc

SEQ ID NO: 3778200 - DNA, 20 bp, Homo sapiens
tcccgctcagccctccctgc

SEQ ID NO: 3778201 - DNA, 21 bp, Homo sapiens
tcccgggactcactggcagcc

SEQ ID NO: 3778202 - DNA, 14 bp, Homo sapiens
tcccggggctccac

SEQ ID NO: 3778203 - DNA, 22 bp, Homo sapiens
tcccgtgcaaaacatgctacct

SEQ ID NO: 3778204 - DNA, 15 bp, Homo sapiens
tccctaagccaaggg

SEQ ID NO: 3778205 - DNA, 20 bp, Homo sapiens
tccctaagccaagggcctct

SEQ ID NO: 3778206 - DNA, 20 bp, Homo sapiens
tccctaatttaacccagctc

SEQ ID NO: 3778207 - DNA, 13 bp, Homo sapiens
tccctaccacctc

SEQ ID NO: 3778208 - DNA, 11 bp, Homo sapiens
tccctacctca

SEQ ID NO: 3778209 - DNA, 21 bp, Homo sapiens
tccctacctcaacctgtaaat

SEQ ID NO: 3778210 - DNA, 17 bp, Homo sapiens
tccctacctcaggcagg

SEQ ID NO: 3778211 - DNA, 19 bp, Homo sapiens
tccctaccttgaaagaaga

SEQ ID NO: 3778212 - DNA, 19 bp, Homo sapiens
tccctagagggttcctgta

SEQ ID NO: 3778213 - DNA, 14 bp, Homo sapiens
tccctagggctggg

SEQ ID NO: 3778214 - DNA, 16 bp, Homo sapiens
tccctattagagaaga

SEQ ID NO: 3778215 - DNA, 16 bp, Homo sapiens
tccctcagcccctctt

SEQ ID NO: 3778216 - DNA, 23 bp, Homo sapiens
tccctcattccaccttcccatgc

SEQ ID NO: 3778217 - DNA, 23 bp, Homo sapiens
tccctccactccttcctgccacc

SEQ ID NO: 3778218 - DNA, 15 bp, Homo sapiens
tccctcccctgccct

SEQ ID NO: 3778219 - DNA, 19 bp, Homo sapiens
tccctcccctgccctggtc

SEQ ID NO: 3778220 - DNA, 15 bp, Homo sapiens
tccctccctctttcc

SEQ ID NO: 3778221 - DNA, 22 bp, Homo sapiens
tccctcgctgcacaaatactcc

SEQ ID NO: 3778222 - DNA, 22 bp, Homo sapiens
tccctctcaggcatgcctgtgt

SEQ ID NO: 3778223 - DNA, 23 bp, Homo sapiens
tccctctcaggcatgcctgtgtg

SEQ ID NO: 3778224 - DNA, 12 bp, Homo sapiens
tccctctccctg

SEQ ID NO: 3778225 - DNA, 13 bp, Homo sapiens
tccctctcctgcc

SEQ ID NO: 3778226 - DNA, 14 bp, Homo sapiens
tccctctcctgcct

SEQ ID NO: 3778227 - DNA, 15 bp, Homo sapiens
tccctctcctgccta

SEQ ID NO: 3778228 - DNA, 16 bp, Homo sapiens
tccctctcctgcctac

SEQ ID NO: 3778229 - DNA, 16 bp, Homo sapiens
tccctctctctggaaa

SEQ ID NO: 3778230 - DNA, 20 bp, Homo sapiens
tccctctctcttctgctcca

SEQ ID NO: 3778231 - DNA, 13 bp, Homo sapiens
tccctctgacctg

SEQ ID NO: 3778232 - DNA, 18 bp, Homo sapiens
tccctctgcctgtccctc

SEQ ID NO: 3778233 - DNA, 16 bp, Homo sapiens
tccctctggccctgcc

SEQ ID NO: 3778234 - DNA, 18 bp, Homo sapiens
tccctctggccctgcctt

SEQ ID NO: 3778235 - DNA, 11 bp, Homo sapiens
tccctctttcc

SEQ ID NO: 3778236 - DNA, 13 bp, Homo sapiens
tccctctttccct

SEQ ID NO: 3778237 - DNA, 16 bp, Homo sapiens
tccctgaaaacccaga

SEQ ID NO: 3778238 - DNA, 19 bp, Homo sapiens
tccctgaaaacccagagag

SEQ ID NO: 3778239 - DNA, 20 bp, Homo sapiens
tccctgaaaacccagagagg

SEQ ID NO: 3778240 - DNA, 14 bp, Homo sapiens
tccctgaccctgca

SEQ ID NO: 3778241 - DNA, 18 bp, Homo sapiens
tccctgactctctgtgac

SEQ ID NO: 3778242 - DNA, 16 bp, Homo sapiens
tccctgatgtacagtt

SEQ ID NO: 3778243 - DNA, 15 bp, Homo sapiens
tccctgccagcaccc

SEQ ID NO: 3778244 - DNA, 13 bp, Homo sapiens
tccctgccagctc

SEQ ID NO: 3778245 - DNA, 14 bp, Homo sapiens
tccctgccgcctca

SEQ ID NO: 3778246 - DNA, 18 bp, Homo sapiens
tccctggaaggacatcca

SEQ ID NO: 3778247 - DNA, 14 bp, Homo sapiens
tccctggccatctc

SEQ ID NO: 3778248 - DNA, 15 bp, Homo sapiens
tccctggccatctct

SEQ ID NO: 3778249 - DNA, 13 bp, Homo sapiens
tccctggcctgtt

SEQ ID NO: 3778250 - DNA, 18 bp, Homo sapiens
tccctggcctgttctgtt

SEQ ID NO: 3778251 - DNA, 15 bp, Homo sapiens
tccctggctctcaga

SEQ ID NO: 3778252 - DNA, 18 bp, Homo sapiens
tccctggcttgtaactcc

SEQ ID NO: 3778253 - DNA, 19 bp, Homo sapiens
tccctggcttgtaactcca

SEQ ID NO: 3778254 - DNA, 12 bp, Homo sapiens
tccctgggcatt

SEQ ID NO: 3778255 - DNA, 14 bp, Homo sapiens
tccctgtcaccaag

SEQ ID NO: 3778256 - DNA, 12 bp, Homo sapiens
tccctgtcctcc

SEQ ID NO: 3778257 - DNA, 14 bp, Homo sapiens
tccctgttgaagct

SEQ ID NO: 3778258 - DNA, 15 bp, Homo sapiens
tcccttcctctttcc

SEQ ID NO: 3778259 - DNA, 16 bp, Homo sapiens
tcccttcctctttcca

SEQ ID NO: 3778260 - DNA, 16 bp, Homo sapiens
tcccttctactgcttc

SEQ ID NO: 3778261 - DNA, 19 bp, Homo sapiens
tcccttctactgcttctac

SEQ ID NO: 3778262 - DNA, 20 bp, Homo sapiens
tcccttctccttgataacag

SEQ ID NO: 3778263 - DNA, 13 bp, Homo sapiens
tcccttgagacct

SEQ ID NO: 3778264 - DNA, 15 bp, Homo sapiens
tcccttgtgtgtgtg

SEQ ID NO: 3778265 - DNA, 21 bp, Homo sapiens
tccctttcttggccagttatc

SEQ ID NO: 3778266 - DNA, 14 bp, Homo sapiens
tccctttgctccac

SEQ ID NO: 3778267 - DNA, 15 bp, Homo sapiens
tccctttgctccacc

SEQ ID NO: 3778268 - DNA, 14 bp, Homo sapiens
tcccttttcttgac

SEQ ID NO: 3778269 - DNA, 18 bp, Homo sapiens
tcccttttgtaagttgag

SEQ ID NO: 3778270 - DNA, 23 bp, Homo sapiens
tccgacaaccgatgctccagcca

SEQ ID NO: 3778271 - DNA, 13 bp, Homo sapiens
tccgaggcagggt

SEQ ID NO: 3778272 - DNA, 17 bp, Homo sapiens
tccgccttcactccggt

SEQ ID NO: 3778273 - DNA, 18 bp, Homo sapiens
tccggcagttctgggtgc

SEQ ID NO: 3778274 - DNA, 17 bp, Homo sapiens
tccggtccctgtcccag

SEQ ID NO: 3778275 - DNA, 15 bp, Homo sapiens
tccggtgtgcctgca

SEQ ID NO: 3778276 - DNA, 15 bp, Homo sapiens
tccgtatttcagact

SEQ ID NO: 3778277 - DNA, 23 bp, Homo sapiens
tccgtgatccatccatctccagg

SEQ ID NO: 3778278 - DNA, 15 bp, Homo sapiens
tcctaaaacaaatag

SEQ ID NO: 3778279 - DNA, 15 bp, Homo sapiens
tcctaaatgcagtga

SEQ ID NO: 3778280 - DNA, 16 bp, Homo sapiens
tcctaacacagcatgt

SEQ ID NO: 3778281 - DNA, 21 bp, Homo sapiens
tcctaaggcacccacaaataa

SEQ ID NO: 3778282 - DNA, 18 bp, Homo sapiens
tcctacaagagcagcctg

SEQ ID NO: 3778283 - DNA, 20 bp, Homo sapiens
tcctacaagagcagcctgtg

SEQ ID NO: 3778284 - DNA, 14 bp, Homo sapiens
tcctacatacagca

SEQ ID NO: 3778285 - DNA, 12 bp, Homo sapiens
tcctacctcagc

SEQ ID NO: 3778286 - DNA, 14 bp, Homo sapiens
tcctacctcagcct

SEQ ID NO: 3778287 - DNA, 13 bp, Homo sapiens
tcctactctgtgt

SEQ ID NO: 3778288 - DNA, 18 bp, Homo sapiens
tcctactttacatatgct

SEQ ID NO: 3778289 - DNA, 16 bp, Homo sapiens
tcctagaaattcccca

SEQ ID NO: 3778290 - DNA, 22 bp, Homo sapiens
tcctagagaaaacttgaattca

SEQ ID NO: 3778291 - DNA, 14 bp, Homo sapiens
tcctagctgtgtgc

SEQ ID NO: 3778292 - DNA, 19 bp, Homo sapiens
tcctaggcatttgctgaat

SEQ ID NO: 3778293 - DNA, 15 bp, Homo sapiens
tcctatatagtttat

SEQ ID NO: 3778294 - DNA, 19 bp, Homo sapiens
tcctatcacctcccctcct

SEQ ID NO: 3778295 - DNA, 14 bp, Homo sapiens
tcctatcccatccc

SEQ ID NO: 3778296 - DNA, 16 bp, Homo sapiens
tcctatttgcactgta

SEQ ID NO: 3778297 - DNA, 14 bp, Homo sapiens
tcctatttttttaa

SEQ ID NO: 3778298 - DNA, 22 bp, Homo sapiens
tcctatttttttaaaatcacta

SEQ ID NO: 3778299 - DNA, 23 bp, Homo sapiens
tcctcaactcacctaatgtttat

SEQ ID NO: 3778300 - DNA, 13 bp, Homo sapiens
tcctcacccccag

SEQ ID NO: 3778301 - DNA, 22 bp, Homo sapiens
tcctcaccctgatttcttgctt

SEQ ID NO: 3778302 - DNA, 15 bp, Homo sapiens
tcctcacctctggac

SEQ ID NO: 3778303 - DNA, 11 bp, Homo sapiens
tcctcagactg

SEQ ID NO: 3778304 - DNA, 17 bp, Homo sapiens
tcctcagagaatttcta

SEQ ID NO: 3778305 - DNA, 19 bp, Homo sapiens
tcctcaggctgctggagga

SEQ ID NO: 3778306 - DNA, 16 bp, Homo sapiens
tcctcagggacagaga

SEQ ID NO: 3778307 - DNA, 17 bp, Homo sapiens
tcctcattagcattttg

SEQ ID NO: 3778308 - DNA, 23 bp, Homo sapiens
tcctcatttggggtagctagagg

SEQ ID NO: 3778309 - DNA, 18 bp, Homo sapiens
tctccctataatgctgga

SEQ ID NO: 3778310 - DNA, 21 bp, Homo sapiens
tctccctataatgctggagcg

SEQ ID NO: 3778311 - DNA, 23 bp, Homo sapiens
tctccctcagtctggcccttcct

SEQ ID NO: 3778312 - DNA, 16 bp, Homo sapiens
tctccctctcctgcct

SEQ ID NO: 3778313 - DNA, 17 bp, Homo sapiens
tctccctctcctgccta

SEQ ID NO: 3778314 - DNA, 21 bp, Homo sapiens
tctccctctcctgcctactca

SEQ ID NO: 3778315 - DNA, 15 bp, Homo sapiens
tctccctctggccct

SEQ ID NO: 3778316 - DNA, 19 bp, Homo sapiens
tctccctctggccctgcct

SEQ ID NO: 3778317 - DNA, 13 bp, Homo sapiens
tctccctggccct

SEQ ID NO: 3778318 - DNA, 23 bp, Homo sapiens
tctccgaccagacaccttgacag

SEQ ID NO: 3778319 - DNA, 17 bp, Homo sapiens
tctcctccatactcagg

SEQ ID NO: 3778320 - DNA, 13 bp, Homo sapiens
tctcctctcccct

SEQ ID NO: 3778321 - DNA, 23 bp, Homo sapiens
tctcctcttaaaaaataaaaact

SEQ ID NO: 3778322 - DNA, 17 bp, Homo sapiens
tctcctctttgttttgt

SEQ ID NO: 3778323 - DNA, 13 bp, Homo sapiens
tctcctgcatgca

SEQ ID NO: 3778324 - DNA, 16 bp, Homo sapiens
tctcctgcccccacac

SEQ ID NO: 3778325 - DNA, 21 bp, Homo sapiens
tctcctgcccccacacctggc

SEQ ID NO: 3778326 - DNA, 12 bp, Homo sapiens
tctcctgcctac

SEQ ID NO: 3778327 - DNA, 14 bp, Homo sapiens
tctcctgcctactc

SEQ ID NO: 3778328 - DNA, 15 bp, Homo sapiens
tctcctgcctcagcc

SEQ ID NO: 3778329 - DNA, 17 bp, Homo sapiens
tctcctgcctcagcctc

SEQ ID NO: 3778330 - DNA, 21 bp, Homo sapiens
tctcctggaaatattaagaaa

SEQ ID NO: 3778331 - DNA, 14 bp, Homo sapiens
tctcctgtccaacc

SEQ ID NO: 3778332 - DNA, 18 bp, Homo sapiens
tctccttagtcttctcat

SEQ ID NO: 3778333 - DNA, 19 bp, Homo sapiens
tctccttagtcttctcata

SEQ ID NO: 3778334 - DNA, 15 bp, Homo sapiens
tctccttccaactgc

SEQ ID NO: 3778335 - DNA, 16 bp, Homo sapiens
tctccttgataacagc

SEQ ID NO: 3778336 - DNA, 17 bp, Homo sapiens
tctccttgataacagct

SEQ ID NO: 3778337 - DNA, 19 bp, Homo sapiens
tctccttgccctagatgag

SEQ ID NO: 3778338 - DNA, 16 bp, Homo sapiens
tctcctttcacaacct

SEQ ID NO: 3778339 - DNA, 15 bp, Homo sapiens
tctcctttctttcta

SEQ ID NO: 3778340 - DNA, 17 bp, Homo sapiens
tctcggaaggctggctg

SEQ ID NO: 3778341 - DNA, 14 bp, Homo sapiens
tctctaacctcctt

SEQ ID NO: 3778342 - DNA, 22 bp, Homo sapiens
tctctaactcagaaacatcagt

SEQ ID NO: 3778343 - DNA, 15 bp, Homo sapiens
tctctacaaaaagca

SEQ ID NO: 3778344 - DNA, 22 bp, Homo sapiens
tctctactaaaaatacaaacaa

SEQ ID NO: 3778345 - DNA, 20 bp, Homo sapiens
tctctactaccacaaggaaa

SEQ ID NO: 3778346 - DNA, 17 bp, Homo sapiens
tctctagaattttaagt

SEQ ID NO: 3778347 - DNA, 19 bp, Homo sapiens
tctctagggaaggccacct

SEQ ID NO: 3778348 - DNA, 21 bp, Homo sapiens
tctctagggaaggccacctgc

SEQ ID NO: 3778349 - DNA, 22 bp, Homo sapiens
tctctatggtaaagatattatt

SEQ ID NO: 3778350 - DNA, 18 bp, Homo sapiens
tctctatttaaattcttt

SEQ ID NO: 3778351 - DNA, 19 bp, Homo sapiens
tctctccatcagaggacac

SEQ ID NO: 3778352 - DNA, 14 bp, Homo sapiens
tctctcctgtccaa

SEQ ID NO: 3778353 - DNA, 19 bp, Homo sapiens
tctctctactcctacctca

SEQ ID NO: 3778354 - DNA, 20 bp, Homo sapiens
tctctctactcctacctcag

SEQ ID NO: 3778355 - DNA, 14 bp, Homo sapiens
tctctctattacca

SEQ ID NO: 3778356 - DNA, 13 bp, Homo sapiens
tctctctctacaa

SEQ ID NO: 3778357 - DNA, 14 bp, Homo sapiens
tctctctctgttgt

SEQ ID NO: 3778358 - DNA, 13 bp, Homo sapiens
tctctctgttgtg

SEQ ID NO: 3778359 - DNA, 16 bp, Homo sapiens
tctctcttctgctcca

SEQ ID NO: 3778360 - DNA, 19 bp, Homo sapiens
tctctcttctgctccaccc

SEQ ID NO: 3778361 - DNA, 20 bp, Homo sapiens
tctctcttctgctccaccct

SEQ ID NO: 3778362 - DNA, 14 bp, Homo sapiens
tctctgaatcctaa

SEQ ID NO: 3778363 - DNA, 23 bp, Homo sapiens
tctctgagctccagtggaagaag

SEQ ID NO: 3778364 - DNA, 14 bp, Homo sapiens
tctctgatcttgtg

SEQ ID NO: 3778365 - DNA, 19 bp, Homo sapiens
tctctgatcttgtgctcag

SEQ ID NO: 3778366 - DNA, 15 bp, Homo sapiens
tctctgcagccagcc

SEQ ID NO: 3778367 - DNA, 17 bp, Homo sapiens
tctctgcagccagccca

SEQ ID NO: 3778368 - DNA, 19 bp, Homo sapiens
tctctgcagccagcccagc

SEQ ID NO: 3778369 - DNA, 12 bp, Homo sapiens
tctctgctccac

SEQ ID NO: 3778370 - DNA, 14 bp, Homo sapiens
tctctgctccacca

SEQ ID NO: 3778371 - DNA, 15 bp, Homo sapiens
tctctgctccaccac

SEQ ID NO: 3778372 - DNA, 14 bp, Homo sapiens
tctctgctggccca

SEQ ID NO: 3778373 - DNA, 15 bp, Homo sapiens
tctctgctggcccag

SEQ ID NO: 3778374 - DNA, 16 bp, Homo sapiens
tctctgtgaacgattt

SEQ ID NO: 3778375 - DNA, 11 bp, Homo sapiens
tctctgtgctt

SEQ ID NO: 3778376 - DNA, 15 bp, Homo sapiens
tctcttacccttctg

SEQ ID NO: 3778377 - DNA, 21 bp, Homo sapiens
tctcttacccttctgtgccca

SEQ ID NO: 3778378 - DNA, 15 bp, Homo sapiens
tctcttatagaatat

SEQ ID NO: 3778379 - DNA, 11 bp, Homo sapiens
tctcttctcca

SEQ ID NO: 3778380 - DNA, 14 bp, Homo sapiens
tctcttctgctcca

SEQ ID NO: 3778381 - DNA, 16 bp, Homo sapiens
tctcttctgctccacc

SEQ ID NO: 3778382 - DNA, 17 bp, Homo sapiens
tctcttctgctccaccc

SEQ ID NO: 3778383 - DNA, 13 bp, Homo sapiens
tctcttgagcctg

SEQ ID NO: 3778384 - DNA, 17 bp, Homo sapiens
tctcttgagcctgggag

SEQ ID NO: 3778385 - DNA, 13 bp, Homo sapiens
tctcttgagggag

SEQ ID NO: 3778386 - DNA, 22 bp, Homo sapiens
tctcttgcctaagtattccttt

SEQ ID NO: 3778387 - DNA, 15 bp, Homo sapiens
tctctttaactcagg

SEQ ID NO: 3778388 - DNA, 17 bp, Homo sapiens
tctctttaactcaggac

SEQ ID NO: 3778389 - DNA, 16 bp, Homo sapiens
tctctttaatcttcag

SEQ ID NO: 3778390 - DNA, 20 bp, Homo sapiens
tctctttaatcttcagtttt

SEQ ID NO: 3778391 - DNA, 20 bp, Homo sapiens
tctctttaatgtcacaggca

SEQ ID NO: 3778392 - DNA, 15 bp, Homo sapiens
tctctttggactctc

SEQ ID NO: 3778393 - DNA, 15 bp, Homo sapiens
tctcttttcaaaaca

SEQ ID NO: 3778394 - DNA, 16 bp, Homo sapiens
tctcttttcaaaacat

SEQ ID NO: 3778395 - DNA, 16 bp, Homo sapiens
tctgaaaatgtatgtg

SEQ ID NO: 3778396 - DNA, 17 bp, Homo sapiens
tctgaaaattaacactg

SEQ ID NO: 3778397 - DNA, 19 bp, Homo sapiens
tctgaaaattaacactgct

SEQ ID NO: 3778398 - DNA, 23 bp, Homo sapiens
tctgaaaattccagaaaggatat

SEQ ID NO: 3778399 - DNA, 13 bp, Homo sapiens
tctgaaactaatg

SEQ ID NO: 3778400 - DNA, 17 bp, Homo sapiens
tctgaaactaatgaaag

SEQ ID NO: 3778401 - DNA, 15 bp, Homo sapiens
tctgaacttcagcta

SEQ ID NO: 3778402 - DNA, 13 bp, Homo sapiens
tctgaaggactgg

SEQ ID NO: 3778403 - DNA, 15 bp, Homo sapiens
tctgaagtcactgca

SEQ ID NO: 3778404 - DNA, 14 bp, Homo sapiens
tctgaagttggaca

SEQ ID NO: 3778405 - DNA, 19 bp, Homo sapiens
tctgaatacctctttgaaa

SEQ ID NO: 3778406 - DNA, 13 bp, Homo sapiens
tctgaatcctaag

SEQ ID NO: 3778407 - DNA, 14 bp, Homo sapiens
tctgaatgtaattt

SEQ ID NO: 3778408 - DNA, 13 bp, Homo sapiens
tctgaatgttctg

SEQ ID NO: 3778409 - DNA, 22 bp, Homo sapiens
tctgaatgttctgacattaaca

SEQ ID NO: 3778410 - DNA, 12 bp, Homo sapiens
tctgacacacag

SEQ ID NO: 3778411 - DNA, 16 bp, Homo sapiens
tctgacacacagctct

SEQ ID NO: 3778412 - DNA, 20 bp, Homo sapiens
tctgacacctattttagaca

SEQ ID NO: 3778413 - DNA, 12 bp, Homo sapiens
tctgacaggcaa

SEQ ID NO: 3778414 - DNA, 23 bp, Homo sapiens
tctgacattaacagttttccatg

SEQ ID NO: 3778415 - DNA, 18 bp, Homo sapiens
tctgaccatttcaggggt

SEQ ID NO: 3778416 - DNA, 14 bp, Homo sapiens
tctgacctgcaggc

SEQ ID NO: 3778417 - DNA, 16 bp, Homo sapiens
tctgacctgcaggcca

SEQ ID NO: 3778418 - DNA, 21 bp, Homo sapiens
tctgacctgcaggccaagagc

SEQ ID NO: 3778419 - DNA, 22 bp, Homo sapiens
tctgactctccgcggtggttgt

SEQ ID NO: 3778420 - DNA, 17 bp, Homo sapiens
tctgagaaggtccttaa

SEQ ID NO: 3778421 - DNA, 18 bp, Homo sapiens
tctgagaaggtccttaat

SEQ ID NO: 3778422 - DNA, 18 bp, Homo sapiens
tctgagaggacttttctt

SEQ ID NO: 3778423 - DNA, 18 bp, Homo sapiens
tgacagctgtccctgtca

SEQ ID NO: 3778424 - DNA, 20 bp, Homo sapiens
tgacagctgtccctgtcacc

SEQ ID NO: 3778425 - DNA, 20 bp, Homo sapiens
tgacaggcaatgctggctgt

SEQ ID NO: 3778426 - DNA, 22 bp, Homo sapiens
tgacagggcacaccgggcactc

SEQ ID NO: 3778427 - DNA, 20 bp, Homo sapiens
tgacagtgaggtcctggggg

SEQ ID NO: 3778428 - DNA, 17 bp, Homo sapiens
tgacataacactataaa

SEQ ID NO: 3778429 - DNA, 16 bp, Homo sapiens
tgacatattatgtctt

SEQ ID NO: 3778430 - DNA, 15 bp, Homo sapiens
tgacatatttttgct

SEQ ID NO: 3778431 - DNA, 14 bp, Homo sapiens
tgacatctctttga

SEQ ID NO: 3778432 - DNA, 22 bp, Homo sapiens
tgacatgcgggctgggcagctg

SEQ ID NO: 3778433 - DNA, 17 bp, Homo sapiens
tgaccaacagttccttc

SEQ ID NO: 3778434 - DNA, 16 bp, Homo sapiens
tgaccaagaactgcat

SEQ ID NO: 3778435 - DNA, 18 bp, Homo sapiens
tgaccaagaactgcatgg

SEQ ID NO: 3778436 - DNA, 17 bp, Homo sapiens
tgaccaagagagaaaga

SEQ ID NO: 3778437 - DNA, 15 bp, Homo sapiens
tgaccaagcaggaag

SEQ ID NO: 3778438 - DNA, 16 bp, Homo sapiens
tgaccaagcaggaagc

SEQ ID NO: 3778439 - DNA, 22 bp, Homo sapiens
tgaccagcagatcccagctcac

SEQ ID NO: 3778440 - DNA, 23 bp, Homo sapiens
tgaccagcctccatgctgcctcc

SEQ ID NO: 3778441 - DNA, 20 bp, Homo sapiens
tgaccagttgcacttggcct

SEQ ID NO: 3778442 - DNA, 19 bp, Homo sapiens
tgaccatccactctaccct

SEQ ID NO: 3778443 - DNA, 23 bp, Homo sapiens
tgaccatccactctaccctccca

SEQ ID NO: 3778444 - DNA, 13 bp, Homo sapiens
tgacccacagcct

SEQ ID NO: 3778445 - DNA, 18 bp, Homo sapiens
tgacccagccccttgaga

SEQ ID NO: 3778446 - DNA, 12 bp, Homo sapiens
tgacccaggctg

SEQ ID NO: 3778447 - DNA, 19 bp, Homo sapiens
tgacccaggctgcctgagc

SEQ ID NO: 3778448 - DNA, 14 bp, Homo sapiens
tgacccagtccctg

SEQ ID NO: 3778449 - DNA, 16 bp, Homo sapiens
tgacccagtccctggg

SEQ ID NO: 3778450 - DNA, 22 bp, Homo sapiens
tgacccccaaccaagtggctcc

SEQ ID NO: 3778451 - DNA, 15 bp, Homo sapiens
tgacccccctcagga

SEQ ID NO: 3778452 - DNA, 19 bp, Homo sapiens
tgaccctcaattcatattt

SEQ ID NO: 3778453 - DNA, 13 bp, Homo sapiens
tgaccctcccttc

SEQ ID NO: 3778454 - DNA, 16 bp, Homo sapiens
tgaccctgatcagtct

SEQ ID NO: 3778455 - DNA, 12 bp, Homo sapiens
tgaccctgcaga

SEQ ID NO: 3778456 - DNA, 17 bp, Homo sapiens
tgacctcaacctgtgat

SEQ ID NO: 3778457 - DNA, 20 bp, Homo sapiens
tgacctcaggtgatccaccc

SEQ ID NO: 3778458 - DNA, 21 bp, Homo sapiens
tgacctcaggtgatccaccca

SEQ ID NO: 3778459 - DNA, 14 bp, Homo sapiens
tgacctccacagct

SEQ ID NO: 3778460 - DNA, 17 bp, Homo sapiens
tgacctccacagcttcc

SEQ ID NO: 3778461 - DNA, 13 bp, Homo sapiens
tgacctccctcta

SEQ ID NO: 3778462 - DNA, 14 bp, Homo sapiens
tgacctctgcctga

SEQ ID NO: 3778463 - DNA, 15 bp, Homo sapiens
tgacctgaggaagcg

SEQ ID NO: 3778464 - DNA, 11 bp, Homo sapiens
tgacctgcagg

SEQ ID NO: 3778465 - DNA, 20 bp, Homo sapiens
tgacctgcaggccaagagca

SEQ ID NO: 3778466 - DNA, 19 bp, Homo sapiens
tgacctgccaggcacactg

SEQ ID NO: 3778467 - DNA, 13 bp, Homo sapiens
tgacctgccccgc

SEQ ID NO: 3778468 - DNA, 14 bp, Homo sapiens
tgacctgtgtcact

SEQ ID NO: 3778469 - DNA, 14 bp, Homo sapiens
tgaccttctgggaa

SEQ ID NO: 3778470 - DNA, 20 bp, Homo sapiens
tgaccttgaactcctgggct

SEQ ID NO: 3778471 - DNA, 20 bp, Homo sapiens
tgaccttttgacttaaagca

SEQ ID NO: 3778472 - DNA, 20 bp, Homo sapiens
tgacgacaaagctgctaaat

SEQ ID NO: 3778473 - DNA, 15 bp, Homo sapiens
tgacgaggctgggcc

SEQ ID NO: 3778474 - DNA, 18 bp, Homo sapiens
tgacggaagaacatagaa

SEQ ID NO: 3778475 - DNA, 22 bp, Homo sapiens
tgacggaaggacctatgtttgc

SEQ ID NO: 3778476 - DNA, 15 bp, Homo sapiens
tgacggcgcccccag

SEQ ID NO: 3778477 - DNA, 19 bp, Homo sapiens
tgacggcgcccccagtgtg

SEQ ID NO: 3778478 - DNA, 14 bp, Homo sapiens
tgactaaaaatatt

SEQ ID NO: 3778479 - DNA, 22 bp, Homo sapiens
tgactaaaaatattataactta

SEQ ID NO: 3778480 - DNA, 14 bp, Homo sapiens
tgactaaaatattt

SEQ ID NO: 3778481 - DNA, 19 bp, Homo sapiens
tgactagacgttcatttgt

SEQ ID NO: 3778482 - DNA, 18 bp, Homo sapiens
tgactagggattcaggct

SEQ ID NO: 3778483 - DNA, 21 bp, Homo sapiens
tgactagggattcaggctgct

SEQ ID NO: 3778484 - DNA, 18 bp, Homo sapiens
tgactagtgctgaagctt

SEQ ID NO: 3778485 - DNA, 12 bp, Homo sapiens
tgactcacccaa

SEQ ID NO: 3778486 - DNA, 16 bp, Homo sapiens
tgactcagatgtctct

SEQ ID NO: 3778487 - DNA, 13 bp, Homo sapiens
tgactcatcctct

SEQ ID NO: 3778488 - DNA, 18 bp, Homo sapiens
tgactcgagtcacactca

SEQ ID NO: 3778489 - DNA, 21 bp, Homo sapiens
tgactcgtatatgtctcaggt

SEQ ID NO: 3778490 - DNA, 15 bp, Homo sapiens
tgactctctgtgacc

SEQ ID NO: 3778491 - DNA, 20 bp, Homo sapiens
tgactcttgttttcagtttc

SEQ ID NO: 3778492 - DNA, 22 bp, Homo sapiens
tgactgcacgtggcttctgatg

SEQ ID NO: 3778493 - DNA, 19 bp, Homo sapiens
tgactgccccaactcctgg

SEQ ID NO: 3778494 - DNA, 15 bp, Homo sapiens
tgactgctgattctc

SEQ ID NO: 3778495 - DNA, 19 bp, Homo sapiens
tgactggaatttttattat

SEQ ID NO: 3778496 - DNA, 23 bp, Homo sapiens
tgactggaatttttattatgcat

SEQ ID NO: 3778497 - DNA, 22 bp, Homo sapiens
tgactgtactcctcccaggcgc

SEQ ID NO: 3778498 - DNA, 15 bp, Homo sapiens
tgactgtatctgtgt

SEQ ID NO: 3778499 - DNA, 16 bp, Homo sapiens
tgactgtatctgtgta

SEQ ID NO: 3778500 - DNA, 18 bp, Homo sapiens
tgactgtatctgtgtaga

SEQ ID NO: 3778501 - DNA, 19 bp, Homo sapiens
tgactgtatctgtgtagac

SEQ ID NO: 3778502 - DNA, 13 bp, Homo sapiens
tgactgtcactgt

SEQ ID NO: 3778503 - DNA, 17 bp, Homo sapiens
tgactgtcactgttcct

SEQ ID NO: 3778504 - DNA, 22 bp, Homo sapiens
tgactgttttttaaactaggaa

SEQ ID NO: 3778505 - DNA, 17 bp, Homo sapiens
tgacttgacagaacact

SEQ ID NO: 3778506 - DNA, 12 bp, Homo sapiens
tgactttcaggt

SEQ ID NO: 3778507 - DNA, 13 bp, Homo sapiens
tgactttcaggta

SEQ ID NO: 3778508 - DNA, 22 bp, Homo sapiens
tgacttttctgtccgagctttg

SEQ ID NO: 3778509 - DNA, 21 bp, Homo sapiens
tgagaaaacgttttgtttgaa

SEQ ID NO: 3778510 - DNA, 20 bp, Homo sapiens
tgagaaacatctcaataaag

SEQ ID NO: 3778511 - DNA, 20 bp, Homo sapiens
tgagaaatgaataatttccc

SEQ ID NO: 3778512 - DNA, 17 bp, Homo sapiens
tgagaactgcatatgtt

SEQ ID NO: 3778513 - DNA, 21 bp, Homo sapiens
tgagaagaatattgttcctaa

SEQ ID NO: 3778514 - DNA, 17 bp, Homo sapiens
tgagaaggaatttgagt

SEQ ID NO: 3778515 - DNA, 17 bp, Homo sapiens
tgagaatcagatcattt

SEQ ID NO: 3778516 - DNA, 23 bp, Homo sapiens
tgagaattcagctgcccccgctc

SEQ ID NO: 3778517 - DNA, 23 bp, Homo sapiens
tgagaattttaaattataactta

SEQ ID NO: 3778518 - DNA, 15 bp, Homo sapiens
tgagacaaaaattat

SEQ ID NO: 3778519 - DNA, 18 bp, Homo sapiens
tgagacaaaaattatcta

SEQ ID NO: 3778520 - DNA, 17 bp, Homo sapiens
tgagacccccacacctc

SEQ ID NO: 3778521 - DNA, 22 bp, Homo sapiens
tgagacccccacacctcagttc

SEQ ID NO: 3778522 - DNA, 14 bp, Homo sapiens
tgagaccctgtctc

SEQ ID NO: 3778523 - DNA, 15 bp, Homo sapiens
tgagaccctgtctct

SEQ ID NO: 3778524 - DNA, 17 bp, Homo sapiens
tgagacctcagccatga

SEQ ID NO: 3778525 - DNA, 14 bp, Homo sapiens
tgagactctgtctc

SEQ ID NO: 3778526 - DNA, 18 bp, Homo sapiens
tgagactgggtctcgctt

SEQ ID NO: 3778527 - DNA, 14 bp, Homo sapiens
tgagactttttggt

SEQ ID NO: 3778528 - DNA, 18 bp, Homo sapiens
tgagagaattgtatcatt

SEQ ID NO: 3778529 - DNA, 21 bp, Homo sapiens
tgagagcagtttggtttctag

SEQ ID NO: 3778530 - DNA, 23 bp, Homo sapiens
tgagagcagtttggtttctagca

SEQ ID NO: 3778531 - DNA, 14 bp, Homo sapiens
tgagaggggaacag

SEQ ID NO: 3778532 - DNA, 19 bp, Homo sapiens
tgagaggggaacagactgg

SEQ ID NO: 3778533 - DNA, 24 bp, Homo sapiens
tgagagtgtcttcacggcaggaca

SEQ ID NO: 3778534 - DNA, 16 bp, Homo sapiens
tgagatagaagaactg

SEQ ID NO: 3778535 - DNA, 19 bp, Homo sapiens
tgagatagaagaactgcaa

SEQ ID NO: 3778536 - DNA, 15 bp, Homo sapiens
tgcattttttaaaac

SEQ ID NO: 3778537 - DNA, 17 bp, Homo sapiens
tgcattttttaaaacaa

SEQ ID NO: 3778538 - DNA, 19 bp, Homo sapiens
tgcattttttaaaacaaga

SEQ ID NO: 3778539 - DNA, 13 bp, Homo sapiens
tgccaaaataatg

SEQ ID NO: 3778540 - DNA, 23 bp, Homo sapiens
tgccaaattttggccaaagtgtt

SEQ ID NO: 3778541 - DNA, 20 bp, Homo sapiens
tgccaaggccagagtggcct

SEQ ID NO: 3778542 - DNA, 23 bp, Homo sapiens
tgccaataaaagttttctccaac

SEQ ID NO: 3778543 - DNA, 20 bp, Homo sapiens
tgccaatgaggtctgaaatg

SEQ ID NO: 3778544 - DNA, 15 bp, Homo sapiens
tgccaattagcaatt

SEQ ID NO: 3778545 - DNA, 20 bp, Homo sapiens
tgccacacagagtggtcttt

SEQ ID NO: 3778546 - DNA, 23 bp, Homo sapiens
tgccacacagagtggtctttctg

SEQ ID NO: 3778547 - DNA, 13 bp, Homo sapiens
tgccacacttcag

SEQ ID NO: 3778548 - DNA, 14 bp, Homo sapiens
tgccaccaggagaa

SEQ ID NO: 3778549 - DNA, 20 bp, Homo sapiens
tgccaccctggggagaaagt

SEQ ID NO: 3778550 - DNA, 21 bp, Homo sapiens
tgccacctcccctatccaccc

SEQ ID NO: 3778551 - DNA, 22 bp, Homo sapiens
tgccacctcccctatccaccca

SEQ ID NO: 3778552 - DNA, 10 bp, Homo sapiens
tgccacctgc

SEQ ID NO: 3778553 - DNA, 19 bp, Homo sapiens
tgccacctggggcagtcac

SEQ ID NO: 3778554 - DNA, 14 bp, Homo sapiens
tgccactgcactcc

SEQ ID NO: 3778555 - DNA, 21 bp, Homo sapiens
tgccactgcccgagctggtgc

SEQ ID NO: 3778556 - DNA, 18 bp, Homo sapiens
tgccactgcctcttcctc

SEQ ID NO: 3778557 - DNA, 20 bp, Homo sapiens
tgccactgcctcttcctccc

SEQ ID NO: 3778558 - DNA, 20 bp, Homo sapiens
tgccacttcactccagcctg

SEQ ID NO: 3778559 - DNA, 21 bp, Homo sapiens
tgccagacggcacccacccag

SEQ ID NO: 3778560 - DNA, 23 bp, Homo sapiens
tgccagagcaaagggccaggaag

SEQ ID NO: 3778561 - DNA, 21 bp, Homo sapiens
tgccagatgcctttatggctg

SEQ ID NO: 3778562 - DNA, 16 bp, Homo sapiens
tgccagcacccccacg

SEQ ID NO: 3778563 - DNA, 12 bp, Homo sapiens
tgccagccagca

SEQ ID NO: 3778564 - DNA, 23 bp, Homo sapiens
tgccagccagcagccagctctca

SEQ ID NO: 3778565 - DNA, 20 bp, Homo sapiens
tgccagcctggcttctggag

SEQ ID NO: 3778566 - DNA, 22 bp, Homo sapiens
tgccagcctggcttctggagcc

SEQ ID NO: 3778567 - DNA, 18 bp, Homo sapiens
tgccagcttatctcaggg

SEQ ID NO: 3778568 - DNA, 11 bp, Homo sapiens
tgccagggagc

SEQ ID NO: 3778569 - DNA, 20 bp, Homo sapiens
tgccagtccccctgccccag

SEQ ID NO: 3778570 - DNA, 11 bp, Homo sapiens
tgccagtgcct

SEQ ID NO: 3778571 - DNA, 22 bp, Homo sapiens
tgccagtgccttacctcctgcc

SEQ ID NO: 3778572 - DNA, 12 bp, Homo sapiens
tgccagtgtctt

SEQ ID NO: 3778573 - DNA, 14 bp, Homo sapiens
tgccagtgtctttc

SEQ ID NO: 3778574 - DNA, 15 bp, Homo sapiens
tgccatattctgttg

SEQ ID NO: 3778575 - DNA, 17 bp, Homo sapiens
tgccatattctgttggc

SEQ ID NO: 3778576 - DNA, 12 bp, Homo sapiens
tgccatccaggt

SEQ ID NO: 3778577 - DNA, 15 bp, Homo sapiens
tgccatccaggttca

SEQ ID NO: 3778578 - DNA, 20 bp, Homo sapiens
tgccatccaggttcagcttg

SEQ ID NO: 3778579 - DNA, 21 bp, Homo sapiens
tgccatccaggttcagcttgt

SEQ ID NO: 3778580 - DNA, 16 bp, Homo sapiens
tgccatctgtgtcctg

SEQ ID NO: 3778581 - DNA, 20 bp, Homo sapiens
tgccatctgtgtcctggtta

SEQ ID NO: 3778582 - DNA, 22 bp, Homo sapiens
tgccatgaactggaggccagga

SEQ ID NO: 3778583 - DNA, 16 bp, Homo sapiens
tgccatggaggcacac

SEQ ID NO: 3778584 - DNA, 18 bp, Homo sapiens
tgccatgtacagtatgtt

SEQ ID NO: 3778585 - DNA, 16 bp, Homo sapiens
tgccatgttggccagg

SEQ ID NO: 3778586 - DNA, 19 bp, Homo sapiens
tgccatgttggccaggctg

SEQ ID NO: 3778587 - DNA, 18 bp, Homo sapiens
tgccatgttttgccaccc

SEQ ID NO: 3778588 - DNA, 13 bp, Homo sapiens
tgccattgtcttt

SEQ ID NO: 3778589 - DNA, 16 bp, Homo sapiens
tgccatttgcaccctc

SEQ ID NO: 3778590 - DNA, 19 bp, Homo sapiens
tgccatttgcaccctccgc

SEQ ID NO: 3778591 - DNA, 21 bp, Homo sapiens
tgccatttgcaccctccgcct

SEQ ID NO: 3778592 - DNA, 23 bp, Homo sapiens
tgcccaaagcagcacttataaat

SEQ ID NO: 3778593 - DNA, 14 bp, Homo sapiens
tgcccaacctcagc

SEQ ID NO: 3778594 - DNA, 22 bp, Homo sapiens
tgcccaacctgctctcctcttg

SEQ ID NO: 3778595 - DNA, 24 bp, Homo sapiens
tgcccaacctgctctcctcttgcc

SEQ ID NO: 3778596 - DNA, 22 bp, Homo sapiens
tgcccaagaatagatgctgact

SEQ ID NO: 3778597 - DNA, 23 bp, Homo sapiens
tgcccaagaatagatgctgactg

SEQ ID NO: 3778598 - DNA, 16 bp, Homo sapiens
tgcccacaggatcagt

SEQ ID NO: 3778599 - DNA, 19 bp, Homo sapiens
tgcccacaggatcagtctg

SEQ ID NO: 3778600 - DNA, 20 bp, Homo sapiens
tgcccacaggatcagtctga

SEQ ID NO: 3778601 - DNA, 21 bp, Homo sapiens
tgcccagaactggactcagga

SEQ ID NO: 3778602 - DNA, 11 bp, Homo sapiens
tgcccagagat

SEQ ID NO: 3778603 - DNA, 19 bp, Homo sapiens
tgcccagagatgcctccac

SEQ ID NO: 3778604 - DNA, 22 bp, Homo sapiens
tgcccagagatgcctccaccgc

SEQ ID NO: 3778605 - DNA, 15 bp, Homo sapiens
tgcccagagatggga

SEQ ID NO: 3778606 - DNA, 11 bp, Homo sapiens
tgcccagagct

SEQ ID NO: 3778607 - DNA, 21 bp, Homo sapiens
tgcccagagggcccaggcagg

SEQ ID NO: 3778608 - DNA, 23 bp, Homo sapiens
tgcccagagggcccaggcaggcc

SEQ ID NO: 3778609 - DNA, 17 bp, Homo sapiens
tgcccagatcccagaag

SEQ ID NO: 3778610 - DNA, 22 bp, Homo sapiens
tgcccagatcccagaaggacct

SEQ ID NO: 3778611 - DNA, 16 bp, Homo sapiens
tgcccaggagagccag

SEQ ID NO: 3778612 - DNA, 16 bp, Homo sapiens
tgcccaggcaggtctt

SEQ ID NO: 3778613 - DNA, 14 bp, Homo sapiens
tgcccaggcccctg

SEQ ID NO: 3778614 - DNA, 13 bp, Homo sapiens
tgcccaggctggc

SEQ ID NO: 3778615 - DNA, 21 bp, Homo sapiens
tgcccagggccactctgcctc

SEQ ID NO: 3778616 - DNA, 16 bp, Homo sapiens
tgcccagggctcagcc

SEQ ID NO: 3778617 - DNA, 21 bp, Homo sapiens
tgcccagggctcagcctggtg

SEQ ID NO: 3778618 - DNA, 19 bp, Homo sapiens
tgcccagtgttgtttgtaa

SEQ ID NO: 3778619 - DNA, 20 bp, Homo sapiens
tgcccagtgttgtttgtaaa

SEQ ID NO: 3778620 - DNA, 14 bp, Homo sapiens
tgcccagttaatct

SEQ ID NO: 3778621 - DNA, 20 bp, Homo sapiens
tgcccagttaatcttgcttt

SEQ ID NO: 3778622 - DNA, 16 bp, Homo sapiens
tgcccatgggagctgg

SEQ ID NO: 3778623 - DNA, 20 bp, Homo sapiens
tgccccaaacaaatatgcaa

SEQ ID NO: 3778624 - DNA, 22 bp, Homo sapiens
tgccccaaaggaagctttctct

SEQ ID NO: 3778625 - DNA, 14 bp, Homo sapiens
tgccccacctgcca

SEQ ID NO: 3778626 - DNA, 15 bp, Homo sapiens
tgccccacctgccac

SEQ ID NO: 3778627 - DNA, 13 bp, Homo sapiens
tgccccagagctg

SEQ ID NO: 3778628 - DNA, 14 bp, Homo sapiens
tgccccagagctgt

SEQ ID NO: 3778629 - DNA, 15 bp, Homo sapiens
tgccccagagctgtt

SEQ ID NO: 3778630 - DNA, 13 bp, Homo sapiens
tgccccagctctg

SEQ ID NO: 3778631 - DNA, 18 bp, Homo sapiens
tgccccagctgactgtgg

SEQ ID NO: 3778632 - DNA, 23 bp, Homo sapiens
tgccccatgaagccacagcccag

SEQ ID NO: 3778633 - DNA, 12 bp, Homo sapiens
tgccccatgcct

SEQ ID NO: 3778634 - DNA, 17 bp, Homo sapiens
tgcccccacacctggcc

SEQ ID NO: 3778635 - DNA, 17 bp, Homo sapiens
tgccccccaccccagcc

SEQ ID NO: 3778636 - DNA, 18 bp, Homo sapiens
tgccccccttgccagaca

SEQ ID NO: 3778637 - DNA, 22 bp, Homo sapiens
tgcccccgctcatgggcccctc

SEQ ID NO: 3778638 - DNA, 21 bp, Homo sapiens
tgccccctggtggacagtcct

SEQ ID NO: 3778639 - DNA, 13 bp, Homo sapiens
tgcccccttctcc

SEQ ID NO: 3778640 - DNA, 15 bp, Homo sapiens
tgcccccttctccca

SEQ ID NO: 3778641 - DNA, 16 bp, Homo sapiens
tgcccccttctcccac

SEQ ID NO: 3778642 - DNA, 13 bp, Homo sapiens
tgccccgcccagc

SEQ ID NO: 3778643 - DNA, 17 bp, Homo sapiens
tgccccgtcaccatctc

SEQ ID NO: 3778644 - DNA, 21 bp, Homo sapiens
tgccccgtgcagactggaggg

SEQ ID NO: 3778645 - DNA, 12 bp, Homo sapiens
tgcccctccccc

SEQ ID NO: 3778646 - DNA, 21 bp, Homo sapiens
tgcccctcccccaacccccac

SEQ ID NO: 3778647 - DNA, 16 bp, Homo sapiens
tgcccctcccttcaac

SEQ ID NO: 3778648 - DNA, 19 bp, Homo sapiens
tgccttgggctgctcctca

SEQ ID NO: 3778649 - DNA, 10 bp, Homo sapiens
tgcctttcct

SEQ ID NO: 3778650 - DNA, 13 bp, Homo sapiens
tgcctttcctgtt

SEQ ID NO: 3778651 - DNA, 21 bp, Homo sapiens
tgcctttgagtttcctcaggc

SEQ ID NO: 3778652 - DNA, 18 bp, Homo sapiens
tgcctttgcagaaacaga

SEQ ID NO: 3778653 - DNA, 19 bp, Homo sapiens
tgcgaaaggatgaaagtga

SEQ ID NO: 3778654 - DNA, 22 bp, Homo sapiens
tgcgaatggttccattctctct

SEQ ID NO: 3778655 - DNA, 16 bp, Homo sapiens
tgcgacggagagaaaa

SEQ ID NO: 3778656 - DNA, 17 bp, Homo sapiens
tgcgagtgtgtgcatgt

SEQ ID NO: 3778657 - DNA, 21 bp, Homo sapiens
tgcgagtgtgtgcatgtgtgt

SEQ ID NO: 3778658 - DNA, 15 bp, Homo sapiens
tgcgatcatggctca

SEQ ID NO: 3778659 - DNA, 14 bp, Homo sapiens
tgcgatctgggttc

SEQ ID NO: 3778660 - DNA, 21 bp, Homo sapiens
tgcgatctgggttcactgcaa

SEQ ID NO: 3778661 - DNA, 16 bp, Homo sapiens
tgcgcacaacttaaaa

SEQ ID NO: 3778662 - DNA, 18 bp, Homo sapiens
tgcgccattgcactccag

SEQ ID NO: 3778663 - DNA, 21 bp, Homo sapiens
tgcgccattgcactccagcct

SEQ ID NO: 3778664 - DNA, 14 bp, Homo sapiens
tgcgcctacaggag

SEQ ID NO: 3778665 - DNA, 18 bp, Homo sapiens
tgcgcgttctgaaatatt

SEQ ID NO: 3778666 - DNA, 21 bp, Homo sapiens
tgcggacagccacggccaggc

SEQ ID NO: 3778667 - DNA, 22 bp, Homo sapiens
tgcggacagccacggccaggcc

SEQ ID NO: 3778668 - DNA, 23 bp, Homo sapiens
tgcggacagccacggccaggcca

SEQ ID NO: 3778669 - DNA, 17 bp, Homo sapiens
tgcggcctttggcttca

SEQ ID NO: 3778670 - DNA, 16 bp, Homo sapiens
tgcgggcacaataaat

SEQ ID NO: 3778671 - DNA, 13 bp, Homo sapiens
tgcgggctgggca

SEQ ID NO: 3778672 - DNA, 18 bp, Homo sapiens
tgcggtccacccaggagc

SEQ ID NO: 3778673 - DNA, 15 bp, Homo sapiens
tgcgtacgtttcctg

SEQ ID NO: 3778674 - DNA, 22 bp, Homo sapiens
tgcgtgaaacacaccaggctgt

SEQ ID NO: 3778675 - DNA, 20 bp, Homo sapiens
tgctaaatggtcgcccagga

SEQ ID NO: 3778676 - DNA, 21 bp, Homo sapiens
tgctaaatggtcgcccaggag

SEQ ID NO: 3778677 - DNA, 15 bp, Homo sapiens
tgctaaatgtgaatg

SEQ ID NO: 3778678 - DNA, 21 bp, Homo sapiens
tgctaaattttcagtagggct

SEQ ID NO: 3778679 - DNA, 23 bp, Homo sapiens
tgctaaccacgtctgtcttcaca

SEQ ID NO: 3778680 - DNA, 22 bp, Homo sapiens
tgctaagaagcgagcactgacc

SEQ ID NO: 3778681 - DNA, 22 bp, Homo sapiens
tgctaatcagggaggtcatttt

SEQ ID NO: 3778682 - DNA, 23 bp, Homo sapiens
tgctaatcagggaggtcattttg

SEQ ID NO: 3778683 - DNA, 23 bp, Homo sapiens
tgctaatcatgtgggtgagccag

SEQ ID NO: 3778684 - DNA, 24 bp, Homo sapiens
tgctacatgacgacaaagctgcta

SEQ ID NO: 3778685 - DNA, 21 bp, Homo sapiens
tgctactgtcctacccaccct

SEQ ID NO: 3778686 - DNA, 15 bp, Homo sapiens
tgctacttcctgcct

SEQ ID NO: 3778687 - DNA, 20 bp, Homo sapiens
tgctaggtgggccagcccct

SEQ ID NO: 3778688 - DNA, 21 bp, Homo sapiens
tgctaggtgggccagcccctc

SEQ ID NO: 3778689 - DNA, 16 bp, Homo sapiens
tgctatctctgtgtgc

SEQ ID NO: 3778690 - DNA, 13 bp, Homo sapiens
tgctatgaatgat

SEQ ID NO: 3778691 - DNA, 12 bp, Homo sapiens
tgctatggggag

SEQ ID NO: 3778692 - DNA, 12 bp, Homo sapiens
tgctattttact

SEQ ID NO: 3778693 - DNA, 15 bp, Homo sapiens
tgctattttactgtc

SEQ ID NO: 3778694 - DNA, 19 bp, Homo sapiens
tgctattttactgtcttaa

SEQ ID NO: 3778695 - DNA, 19 bp, Homo sapiens
tgctcacactccacatccc

SEQ ID NO: 3778696 - DNA, 13 bp, Homo sapiens
tgctcacctgggg

SEQ ID NO: 3778697 - DNA, 13 bp, Homo sapiens
tgctcagacagaa

SEQ ID NO: 3778698 - DNA, 13 bp, Homo sapiens
tgctcagcatgat

SEQ ID NO: 3778699 - DNA, 17 bp, Homo sapiens
tgctcagcttctccaac

SEQ ID NO: 3778700 - DNA, 22 bp, Homo sapiens
tgctcaggtacagagaaggaat

SEQ ID NO: 3778701 - DNA, 22 bp, Homo sapiens
tgctcatcattccttgagaaaa

SEQ ID NO: 3778702 - DNA, 14 bp, Homo sapiens
tgctcatttcatgg

SEQ ID NO: 3778703 - DNA, 23 bp, Homo sapiens
tgctccacccttggcctgtctca

SEQ ID NO: 3778704 - DNA, 15 bp, Homo sapiens
tgctccagccaaccc

SEQ ID NO: 3778705 - DNA, 19 bp, Homo sapiens
tgctccagctgttcagctg

SEQ ID NO: 3778706 - DNA, 14 bp, Homo sapiens
tgctcccccacccc

SEQ ID NO: 3778707 - DNA, 21 bp, Homo sapiens
tgctcccccaccccctcccca

SEQ ID NO: 3778708 - DNA, 15 bp, Homo sapiens
tgctcccccatcctc

SEQ ID NO: 3778709 - DNA, 19 bp, Homo sapiens
tgctcccccatcctcccct

SEQ ID NO: 3778710 - DNA, 17 bp, Homo sapiens
tgctcccctccctcctc

SEQ ID NO: 3778711 - DNA, 18 bp, Homo sapiens
tgctccgcctctgctggc

SEQ ID NO: 3778712 - DNA, 11 bp, Homo sapiens
tgctcctccag

SEQ ID NO: 3778713 - DNA, 16 bp, Homo sapiens
tgctcctccagggcca

SEQ ID NO: 3778714 - DNA, 21 bp, Homo sapiens
tgctcctccagggccacgtgc

SEQ ID NO: 3778715 - DNA, 19 bp, Homo sapiens
tgctccttccaacaggagc

SEQ ID NO: 3778716 - DNA, 18 bp, Homo sapiens
tgctctaagcacacggag

SEQ ID NO: 3778717 - DNA, 17 bp, Homo sapiens
tgctctatctcacagca

SEQ ID NO: 3778718 - DNA, 16 bp, Homo sapiens
tgctctcccctgccct

SEQ ID NO: 3778719 - DNA, 17 bp, Homo sapiens
tgctctcccctgccctg

SEQ ID NO: 3778720 - DNA, 14 bp, Homo sapiens
tgctctcctcttgc

SEQ ID NO: 3778721 - DNA, 18 bp, Homo sapiens
tgctctcctcttgccact

SEQ ID NO: 3778722 - DNA, 12 bp, Homo sapiens
tgctctcctttc

SEQ ID NO: 3778723 - DNA, 17 bp, Homo sapiens
tgctctctacccagccc

SEQ ID NO: 3778724 - DNA, 13 bp, Homo sapiens
tgctctctgcagc

SEQ ID NO: 3778725 - DNA, 15 bp, Homo sapiens
tgctctctgcagcca

SEQ ID NO: 3778726 - DNA, 22 bp, Homo sapiens
tgctctgatcatccactgtgcc

SEQ ID NO: 3778727 - DNA, 15 bp, Homo sapiens
tgctctgctgacaga

SEQ ID NO: 3778728 - DNA, 13 bp, Homo sapiens
tgctcttcagtgg

SEQ ID NO: 3778729 - DNA, 18 bp, Homo sapiens
tgctgaacaaaaaataaa

SEQ ID NO: 3778730 - DNA, 20 bp, Homo sapiens
tgctgaagcttattaatgct

SEQ ID NO: 3778731 - DNA, 21 bp, Homo sapiens
tgctgaagcttattaatgcta

SEQ ID NO: 3778732 - DNA, 22 bp, Homo sapiens
tgctgaagcttattaatgctaa

SEQ ID NO: 3778733 - DNA, 23 bp, Homo sapiens
tgctgaaggaataaattgctcct

SEQ ID NO: 3778734 - DNA, 18 bp, Homo sapiens
tgctgaatacagaggcaa

SEQ ID NO: 3778735 - DNA, 22 bp, Homo sapiens
tgctgaatggttttcaaaataa

SEQ ID NO: 3778736 - DNA, 16 bp, Homo sapiens
tgctgacagacacagg

SEQ ID NO: 3778737 - DNA, 19 bp, Homo sapiens
tgctgacagacacaggccc

SEQ ID NO: 3778738 - DNA, 22 bp, Homo sapiens
tgctgacagacacaggcccggc

SEQ ID NO: 3778739 - DNA, 14 bp, Homo sapiens
tgctgactgtactc

SEQ ID NO: 3778740 - DNA, 19 bp, Homo sapiens
tgctgactgtactcctccc

SEQ ID NO: 3778741 - DNA, 17 bp, Homo sapiens
tgctgagagacccaagg

SEQ ID NO: 3778742 - DNA, 21 bp, Homo sapiens
tgctgagagacccaaggagga

SEQ ID NO: 3778743 - DNA, 19 bp, Homo sapiens
tgctgagggaccagccaag

SEQ ID NO: 3778744 - DNA, 16 bp, Homo sapiens
tgctgccacacttcag

SEQ ID NO: 3778745 - DNA, 19 bp, Homo sapiens
tgctgccacacttcaggct

SEQ ID NO: 3778746 - DNA, 22 bp, Homo sapiens
tgctgccacacttcaggctctt

SEQ ID NO: 3778747 - DNA, 14 bp, Homo sapiens
tgctgcccagcctc

SEQ ID NO: 3778748 - DNA, 13 bp, Homo sapiens
tgctgccccagct

SEQ ID NO: 3778749 - DNA, 17 bp, Homo sapiens
tgctgccccatgaagcc

SEQ ID NO: 3778750 - DNA, 20 bp, Homo sapiens
tgctgccccatgaagccaca

SEQ ID NO: 3778751 - DNA, 13 bp, Homo sapiens
tgctgccctccat

SEQ ID NO: 3778752 - DNA, 16 bp, Homo sapiens
tgctgccgcctcccag

SEQ ID NO: 3778753 - DNA, 13 bp, Homo sapiens
tgctgcctaggct

SEQ ID NO: 3778754 - DNA, 18 bp, Homo sapiens
tgctgcctaggctgacct

SEQ ID NO: 3778755 - DNA, 14 bp, Homo sapiens
tgctgcctccagaa

SEQ ID NO: 3778756 - DNA, 14 bp, Homo sapiens
tgctgcctgagtca

SEQ ID NO: 3778757 - DNA, 15 bp, Homo sapiens
tgctgcgtctcccat

SEQ ID NO: 3778758 - DNA, 16 bp, Homo sapiens
tgctgctattttactg

SEQ ID NO: 3778759 - DNA, 17 bp, Homo sapiens
tgctgctccttagctgc

SEQ ID NO: 3778760 - DNA, 18 bp, Homo sapiens
tgctgctccttagctgcc

SEQ ID NO: 3778761 - DNA, 18 bp, Homo sapiens
tgggactgtacacacttt

SEQ ID NO: 3778762 - DNA, 21 bp, Homo sapiens
tgggactgtacacactttatt

SEQ ID NO: 3778763 - DNA, 15 bp, Homo sapiens
tgggagaacctcagg

SEQ ID NO: 3778764 - DNA, 21 bp, Homo sapiens
tgggagaattcttacatgttt

SEQ ID NO: 3778765 - DNA, 22 bp, Homo sapiens
tgggagaattcttacatgtttt

SEQ ID NO: 3778766 - DNA, 18 bp, Homo sapiens
tgggagacctgtaatcat

SEQ ID NO: 3778767 - DNA, 16 bp, Homo sapiens
tgggagaggcagagtg

SEQ ID NO: 3778768 - DNA, 15 bp, Homo sapiens
tgggagccctttgga

SEQ ID NO: 3778769 - DNA, 12 bp, Homo sapiens
tgggagctgcct

SEQ ID NO: 3778770 - DNA, 19 bp, Homo sapiens
tgggagctggttagaaatg

SEQ ID NO: 3778771 - DNA, 16 bp, Homo sapiens
tgggagcttgggaatg

SEQ ID NO: 3778772 - DNA, 24 bp, Homo sapiens
tgggaggaagcaggttgaggggct

SEQ ID NO: 3778773 - DNA, 16 bp, Homo sapiens
tgggaggatctcttga

SEQ ID NO: 3778774 - DNA, 22 bp, Homo sapiens
tgggaggatctcttgagcctgg

SEQ ID NO: 3778775 - DNA, 20 bp, Homo sapiens
tgggaggattctatgaggca

SEQ ID NO: 3778776 - DNA, 18 bp, Homo sapiens
tgggaggattgcttgagc

SEQ ID NO: 3778777 - DNA, 18 bp, Homo sapiens
tgggaggccccactgggg

SEQ ID NO: 3778778 - DNA, 20 bp, Homo sapiens
tgggaggccccactggggaa

SEQ ID NO: 3778779 - DNA, 14 bp, Homo sapiens
tgggaggctgaggc

SEQ ID NO: 3778780 - DNA, 14 bp, Homo sapiens
tgggaggctgaggt

SEQ ID NO: 3778781 - DNA, 23 bp, Homo sapiens
tgggaggtcaaggctgcagtgag

SEQ ID NO: 3778782 - DNA, 23 bp, Homo sapiens
tgggataaagatgcaaggaccag

SEQ ID NO: 3778783 - DNA, 14 bp, Homo sapiens
tgggatctgactgc

SEQ ID NO: 3778784 - DNA, 16 bp, Homo sapiens
tgggatctgactgcac

SEQ ID NO: 3778785 - DNA, 19 bp, Homo sapiens
tgggatgcttgcctagggc

SEQ ID NO: 3778786 - DNA, 19 bp, Homo sapiens
tgggatgtccacagatgcc

SEQ ID NO: 3778787 - DNA, 10 bp, Homo sapiens
tgggattgct

SEQ ID NO: 3778788 - DNA, 12 bp, Homo sapiens
tgggcaacagag

SEQ ID NO: 3778789 - DNA, 14 bp, Homo sapiens
tgggcaacagagca

SEQ ID NO: 3778790 - DNA, 17 bp, Homo sapiens
tgggcaatataaccaat

SEQ ID NO: 3778791 - DNA, 18 bp, Homo sapiens
tgggcaatataaccaatg

SEQ ID NO: 3778792 - DNA, 22 bp, Homo sapiens
tgggcaatataaccaatgttta

SEQ ID NO: 3778793 - DNA, 19 bp, Homo sapiens
tgggcaatgatggcaattt

SEQ ID NO: 3778794 - DNA, 22 bp, Homo sapiens
tgggcaccaagagccaatggag

SEQ ID NO: 3778795 - DNA, 19 bp, Homo sapiens
tgggcacctggggagtggg

SEQ ID NO: 3778796 - DNA, 18 bp, Homo sapiens
tgggcagcatagcaagac

SEQ ID NO: 3778797 - DNA, 17 bp, Homo sapiens
tgggcattgatggggaa

SEQ ID NO: 3778798 - DNA, 13 bp, Homo sapiens
tgggcattgcttt

SEQ ID NO: 3778799 - DNA, 15 bp, Homo sapiens
tgggcattgctttcc

SEQ ID NO: 3778800 - DNA, 15 bp, Homo sapiens
tgggcatttgtgagg

SEQ ID NO: 3778801 - DNA, 16 bp, Homo sapiens
tgggcatttgtgaggc

SEQ ID NO: 3778802 - DNA, 15 bp, Homo sapiens
tgggccaagccaggg

SEQ ID NO: 3778803 - DNA, 20 bp, Homo sapiens
tgggccaagtcaaagacatt

SEQ ID NO: 3778804 - DNA, 18 bp, Homo sapiens
tgggccagcccctcccac

SEQ ID NO: 3778805 - DNA, 20 bp, Homo sapiens
tgggccagcccctcccacca

SEQ ID NO: 3778806 - DNA, 22 bp, Homo sapiens
tgggccagcccctcccaccaca

SEQ ID NO: 3778807 - DNA, 23 bp, Homo sapiens
tgggcccaagacagatgccccag

SEQ ID NO: 3778808 - DNA, 17 bp, Homo sapiens
tgggcccagaggcacag

SEQ ID NO: 3778809 - DNA, 13 bp, Homo sapiens
tgggcccagatct

SEQ ID NO: 3778810 - DNA, 14 bp, Homo sapiens
tgggcccagatctg

SEQ ID NO: 3778811 - DNA, 23 bp, Homo sapiens
tgggccccaccacctaggccact

SEQ ID NO: 3778812 - DNA, 11 bp, Homo sapiens
tgggcccctcc

SEQ ID NO: 3778813 - DNA, 16 bp, Homo sapiens
tgggcccctccctacc

SEQ ID NO: 3778814 - DNA, 18 bp, Homo sapiens
tgggcccctccctacctc

SEQ ID NO: 3778815 - DNA, 11 bp, Homo sapiens
tgggccctcct

SEQ ID NO: 3778816 - DNA, 17 bp, Homo sapiens
tgggcctgtcgtgccag

SEQ ID NO: 3778817 - DNA, 21 bp, Homo sapiens
tgggcctgtcgtgccagtcct

SEQ ID NO: 3778818 - DNA, 16 bp, Homo sapiens
tgggctagttgggctt

SEQ ID NO: 3778819 - DNA, 23 bp, Homo sapiens
tgggctcaagcaatcctcctgag

SEQ ID NO: 3778820 - DNA, 16 bp, Homo sapiens
tgggctcaagcagtct

SEQ ID NO: 3778821 - DNA, 19 bp, Homo sapiens
tgggctcccttcctcccaa

SEQ ID NO: 3778822 - DNA, 17 bp, Homo sapiens
tgggctcccttgtgcgt

SEQ ID NO: 3778823 - DNA, 19 bp, Homo sapiens
tgggctctccacctcagcc

SEQ ID NO: 3778824 - DNA, 12 bp, Homo sapiens
tgggctctgccc

SEQ ID NO: 3778825 - DNA, 12 bp, Homo sapiens
tgggctgagccc

SEQ ID NO: 3778826 - DNA, 18 bp, Homo sapiens
tgggctgagccctggcag

SEQ ID NO: 3778827 - DNA, 13 bp, Homo sapiens
tgggctgccctgg

SEQ ID NO: 3778828 - DNA, 14 bp, Homo sapiens
tgggctgccctggt

SEQ ID NO: 3778829 - DNA, 17 bp, Homo sapiens
tgggctgctacccagaa

SEQ ID NO: 3778830 - DNA, 12 bp, Homo sapiens
tgggctgtgagt

SEQ ID NO: 3778831 - DNA, 19 bp, Homo sapiens
tgggcttcagtggcagctg

SEQ ID NO: 3778832 - DNA, 16 bp, Homo sapiens
tggggaagactgtggc

SEQ ID NO: 3778833 - DNA, 13 bp, Homo sapiens
tggggaaggaggc

SEQ ID NO: 3778834 - DNA, 17 bp, Homo sapiens
tggggacagagcagaac

SEQ ID NO: 3778835 - DNA, 21 bp, Homo sapiens
tggggacgtcctgccacctgg

SEQ ID NO: 3778836 - DNA, 12 bp, Homo sapiens
tggggagaaagt

SEQ ID NO: 3778837 - DNA, 19 bp, Homo sapiens
tggggaggggcggcaggag

SEQ ID NO: 3778838 - DNA, 17 bp, Homo sapiens
tggggataaaggagaag

SEQ ID NO: 3778839 - DNA, 17 bp, Homo sapiens
tggggatttctcccagc

SEQ ID NO: 3778840 - DNA, 16 bp, Homo sapiens
tggggcagcacagaga

SEQ ID NO: 3778841 - DNA, 14 bp, Homo sapiens
tggggcaggcagtg

SEQ ID NO: 3778842 - DNA, 17 bp, Homo sapiens
tggggcaggctggctgg

SEQ ID NO: 3778843 - DNA, 13 bp, Homo sapiens
tggggccacagcc

SEQ ID NO: 3778844 - DNA, 18 bp, Homo sapiens
tggggcctagatccacac

SEQ ID NO: 3778845 - DNA, 19 bp, Homo sapiens
tggggctgatctcagggaa

SEQ ID NO: 3778846 - DNA, 20 bp, Homo sapiens
tggggctgatctcagggaag

SEQ ID NO: 3778847 - DNA, 22 bp, Homo sapiens
tggggctgatctcagggaagcc

SEQ ID NO: 3778848 - DNA, 14 bp, Homo sapiens
tggggctgctcctc

SEQ ID NO: 3778849 - DNA, 21 bp, Homo sapiens
tggggctgctcctccagggcc

SEQ ID NO: 3778850 - DNA, 14 bp, Homo sapiens
tgggggaagccctg

SEQ ID NO: 3778851 - DNA, 21 bp, Homo sapiens
tgggggatcacagcctctgaa

SEQ ID NO: 3778852 - DNA, 16 bp, Homo sapiens
tgggggcagagggcag

SEQ ID NO: 3778853 - DNA, 19 bp, Homo sapiens
tgggggcagcctgcgtggc

SEQ ID NO: 3778854 - DNA, 22 bp, Homo sapiens
tgggggcaggagggccctacct

SEQ ID NO: 3778855 - DNA, 16 bp, Homo sapiens
tgggggcctcagtgcc

SEQ ID NO: 3778856 - DNA, 20 bp, Homo sapiens
tgggggttctttcttcctct

SEQ ID NO: 3778857 - DNA, 22 bp, Homo sapiens
tgggggttctttcttcctctgc

SEQ ID NO: 3778858 - DNA, 15 bp, Homo sapiens
tggggtacccactgc

SEQ ID NO: 3778859 - DNA, 16 bp, Homo sapiens
tggggtacccactgct

SEQ ID NO: 3778860 - DNA, 17 bp, Homo sapiens
tggggtacccactgctc

SEQ ID NO: 3778861 - DNA, 18 bp, Homo sapiens
tggggtacccactgctct

SEQ ID NO: 3778862 - DNA, 20 bp, Homo sapiens
tggggtagctagaggaacca

SEQ ID NO: 3778863 - DNA, 16 bp, Homo sapiens
tggggtcctggggcct

SEQ ID NO: 3778864 - DNA, 23 bp, Homo sapiens
tggggtctcacagtgttgcccag

SEQ ID NO: 3778865 - DNA, 17 bp, Homo sapiens
tggggttcagcccctcc

SEQ ID NO: 3778866 - DNA, 21 bp, Homo sapiens
tggggttcagcccctcctctg

SEQ ID NO: 3778867 - DNA, 18 bp, Homo sapiens
tgggtaatcgatggggga

SEQ ID NO: 3778868 - DNA, 23 bp, Homo sapiens
tgggtacttgtggacacagctct

SEQ ID NO: 3778869 - DNA, 17 bp, Homo sapiens
tgggtatcaaacagctc

SEQ ID NO: 3778870 - DNA, 22 bp, Homo sapiens
tgggtctcgctttgttgcccag

SEQ ID NO: 3778871 - DNA, 23 bp, Homo sapiens
tgggtgaccagttgcacttggcc

SEQ ID NO: 3778872 - DNA, 12 bp, Homo sapiens
tgggtgagccag

SEQ ID NO: 3778873 - DNA, 16 bp, Homo sapiens
tgggtgcccacagccc

SEQ ID NO: 3778874 - DNA, 19 bp, Homo sapiens
tgtatattgtcagatattt

SEQ ID NO: 3778875 - DNA, 18 bp, Homo sapiens
tgtatatttaaaagaaag

SEQ ID NO: 3778876 - DNA, 15 bp, Homo sapiens
tgtatatttaaggta

SEQ ID NO: 3778877 - DNA, 18 bp, Homo sapiens
tgtatcaacccagaaaca

SEQ ID NO: 3778878 - DNA, 17 bp, Homo sapiens
tgtatccagtacattta

SEQ ID NO: 3778879 - DNA, 19 bp, Homo sapiens
tgtatccatgggggcaggg

SEQ ID NO: 3778880 - DNA, 19 bp, Homo sapiens
tgtatctagtgcagctgat

SEQ ID NO: 3778881 - DNA, 18 bp, Homo sapiens
tgtatgcacgtgtgcaca

SEQ ID NO: 3778882 - DNA, 16 bp, Homo sapiens
tgtatgccaagtgaga

SEQ ID NO: 3778883 - DNA, 18 bp, Homo sapiens
tgtatgccaagtgagaag

SEQ ID NO: 3778884 - DNA, 16 bp, Homo sapiens
tgtatggaatacagtg

SEQ ID NO: 3778885 - DNA, 18 bp, Homo sapiens
tgtatggaatacagtgtt

SEQ ID NO: 3778886 - DNA, 14 bp, Homo sapiens
tgtatgtgtaagta

SEQ ID NO: 3778887 - DNA, 14 bp, Homo sapiens
tgtatgtgtgtatg

SEQ ID NO: 3778888 - DNA, 21 bp, Homo sapiens
tgtattaatattcattgtata

SEQ ID NO: 3778889 - DNA, 21 bp, Homo sapiens
tgtattacataaataaattaa

SEQ ID NO: 3778890 - DNA, 19 bp, Homo sapiens
tgtattaggactggctttg

SEQ ID NO: 3778891 - DNA, 21 bp, Homo sapiens
tgtattaggtgtcatttccat

SEQ ID NO: 3778892 - DNA, 17 bp, Homo sapiens
tgtattcagtgagggtc

SEQ ID NO: 3778893 - DNA, 18 bp, Homo sapiens
tgtattcccacccctgga

SEQ ID NO: 3778894 - DNA, 17 bp, Homo sapiens
tgtattgcgtcttagca

SEQ ID NO: 3778895 - DNA, 19 bp, Homo sapiens
tgtattgttcccagtgaca

SEQ ID NO: 3778896 - DNA, 19 bp, Homo sapiens
tgtatttaattgtaaactg

SEQ ID NO: 3778897 - DNA, 22 bp, Homo sapiens
tgtatttaattgtaaactgtac

SEQ ID NO: 3778898 - DNA, 18 bp, Homo sapiens
tgtatttattttcctccc

SEQ ID NO: 3778899 - DNA, 19 bp, Homo sapiens
tgtatttattttcctcccc

SEQ ID NO: 3778900 - DNA, 18 bp, Homo sapiens
tgtatttgttaatggttt

SEQ ID NO: 3778901 - DNA, 19 bp, Homo sapiens
tgtattttataaaattaaa

SEQ ID NO: 3778902 - DNA, 13 bp, Homo sapiens
tgtattttatgta

SEQ ID NO: 3778903 - DNA, 11 bp, Homo sapiens
tgtattttatt

SEQ ID NO: 3778904 - DNA, 17 bp, Homo sapiens
tgtcaaacaaagccaga

SEQ ID NO: 3778905 - DNA, 18 bp, Homo sapiens
tgtcaaactgtagaaatg

SEQ ID NO: 3778906 - DNA, 14 bp, Homo sapiens
tgtcaagaaagagc

SEQ ID NO: 3778907 - DNA, 19 bp, Homo sapiens
tgtcaagagggtctgagga

SEQ ID NO: 3778908 - DNA, 15 bp, Homo sapiens
tgtcaagccataatt

SEQ ID NO: 3778909 - DNA, 13 bp, Homo sapiens
tgtcaaggtgctg

SEQ ID NO: 3778910 - DNA, 17 bp, Homo sapiens
tgtcaagtctctgctgg

SEQ ID NO: 3778911 - DNA, 18 bp, Homo sapiens
tgtcaagtctctgctggc

SEQ ID NO: 3778912 - DNA, 18 bp, Homo sapiens
tgtcaagttaacaaggaa

SEQ ID NO: 3778913 - DNA, 20 bp, Homo sapiens
tgtcaagttaacaaggaatg

SEQ ID NO: 3778914 - DNA, 16 bp, Homo sapiens
tgtcaataaacagctt

SEQ ID NO: 3778915 - DNA, 23 bp, Homo sapiens
tgtcaataaacagcttcatgcct

SEQ ID NO: 3778916 - DNA, 14 bp, Homo sapiens
tgtcacaatcctaa

SEQ ID NO: 3778917 - DNA, 19 bp, Homo sapiens
tgtcacaatcctaacacat

SEQ ID NO: 3778918 - DNA, 12 bp, Homo sapiens
tgtcacaggcag

SEQ ID NO: 3778919 - DNA, 18 bp, Homo sapiens
tgtcaccaccttcccagc

SEQ ID NO: 3778920 - DNA, 18 bp, Homo sapiens
tgtcaccggatcctgggt

SEQ ID NO: 3778921 - DNA, 17 bp, Homo sapiens
tgtcactgacacacacg

SEQ ID NO: 3778922 - DNA, 21 bp, Homo sapiens
tgtcactggtagaccaaaata

SEQ ID NO: 3778923 - DNA, 18 bp, Homo sapiens
tgtcactgtttctctgct

SEQ ID NO: 3778924 - DNA, 19 bp, Homo sapiens
tgtcagaaaaacaataaga

SEQ ID NO: 3778925 - DNA, 22 bp, Homo sapiens
tgtcagaaaaacaataagagcg

SEQ ID NO: 3778926 - DNA, 20 bp, Homo sapiens
tgtcagaggcacaaaagggt

SEQ ID NO: 3778927 - DNA, 14 bp, Homo sapiens
tgtcataagaatga

SEQ ID NO: 3778928 - DNA, 16 bp, Homo sapiens
tgtcatagaaattaca

SEQ ID NO: 3778929 - DNA, 23 bp, Homo sapiens
tgtcatctttcttctattttatt

SEQ ID NO: 3778930 - DNA, 18 bp, Homo sapiens
tgtcattaaaataaataa

SEQ ID NO: 3778931 - DNA, 19 bp, Homo sapiens
tgtcattaaaataaataaa

SEQ ID NO: 3778932 - DNA, 23 bp, Homo sapiens
tgtcattaaatggggctcacaaa

SEQ ID NO: 3778933 - DNA, 19 bp, Homo sapiens
tgtcatttgagcagggctc

SEQ ID NO: 3778934 - DNA, 22 bp, Homo sapiens
tgtcatttgagcagggctcagc

SEQ ID NO: 3778935 - DNA, 12 bp, Homo sapiens
tgtcattttgaa

SEQ ID NO: 3778936 - DNA, 15 bp, Homo sapiens
tgtcattttgaagct

SEQ ID NO: 3778937 - DNA, 19 bp, Homo sapiens
tgtcattttgaagctaatt

SEQ ID NO: 3778938 - DNA, 22 bp, Homo sapiens
tgtccaaactgcctaagccctc

SEQ ID NO: 3778939 - DNA, 15 bp, Homo sapiens
tgtccaactccagta

SEQ ID NO: 3778940 - DNA, 13 bp, Homo sapiens
tgtccacctggcc

SEQ ID NO: 3778941 - DNA, 13 bp, Homo sapiens
tgtccagagacaa

SEQ ID NO: 3778942 - DNA, 23 bp, Homo sapiens
tgtccagagagagaagtgcccct

SEQ ID NO: 3778943 - DNA, 19 bp, Homo sapiens
tgtccaggcactgctgccc

SEQ ID NO: 3778944 - DNA, 19 bp, Homo sapiens
tgtccagggccctgagctc

SEQ ID NO: 3778945 - DNA, 12 bp, Homo sapiens
tgtccatgtgtg

SEQ ID NO: 3778946 - DNA, 16 bp, Homo sapiens
tgtccatgtgtgtgca

SEQ ID NO: 3778947 - DNA, 12 bp, Homo sapiens
tgtccatttata

SEQ ID NO: 3778948 - DNA, 13 bp, Homo sapiens
tgtcccacagctt

SEQ ID NO: 3778949 - DNA, 14 bp, Homo sapiens
tgtccccagcccac

SEQ ID NO: 3778950 - DNA, 16 bp, Homo sapiens
tgtccccagcccactg

SEQ ID NO: 3778951 - DNA, 19 bp, Homo sapiens
tgtccccagtttgcagaaa

SEQ ID NO: 3778952 - DNA, 20 bp, Homo sapiens
tgtccccctgagatcagagt

SEQ ID NO: 3778953 - DNA, 21 bp, Homo sapiens
tgtccccctgagatcagagtc

SEQ ID NO: 3778954 - DNA, 23 bp, Homo sapiens
tgtcccctatggggatggtccac

SEQ ID NO: 3778955 - DNA, 21 bp, Homo sapiens
tgtcccctcctcactcccttc

SEQ ID NO: 3778956 - DNA, 16 bp, Homo sapiens
tgtcccgattgtaact

SEQ ID NO: 3778957 - DNA, 12 bp, Homo sapiens
tgtccctacacc

SEQ ID NO: 3778958 - DNA, 20 bp, Homo sapiens
tgtccctaccgagtctcttc

SEQ ID NO: 3778959 - DNA, 22 bp, Homo sapiens
tgtccctaccgagtctcttctc

SEQ ID NO: 3778960 - DNA, 21 bp, Homo sapiens
tgtccctagtaaaaatacaaa

SEQ ID NO: 3778961 - DNA, 17 bp, Homo sapiens
tgtccctatgcatatca

SEQ ID NO: 3778962 - DNA, 21 bp, Homo sapiens
tgtccctcactgttgaatttt

SEQ ID NO: 3778963 - DNA, 11 bp, Homo sapiens
tgtccctctca

SEQ ID NO: 3778964 - DNA, 21 bp, Homo sapiens
tgtccctctcggaaggctggc

SEQ ID NO: 3778965 - DNA, 14 bp, Homo sapiens
tgtccctgcacttg

SEQ ID NO: 3778966 - DNA, 20 bp, Homo sapiens
tgtccctgcacttgcagact

SEQ ID NO: 3778967 - DNA, 23 bp, Homo sapiens
tgtccctgcacttgcagactcta

SEQ ID NO: 3778968 - DNA, 16 bp, Homo sapiens
tgtccctggccatctc

SEQ ID NO: 3778969 - DNA, 20 bp, Homo sapiens
tgtccctttctgtgtgaaga

SEQ ID NO: 3778970 - DNA, 17 bp, Homo sapiens
tgtccctttcttggcca

SEQ ID NO: 3778971 - DNA, 22 bp, Homo sapiens
tgtccgagaactaaagccaagg

SEQ ID NO: 3778972 - DNA, 16 bp, Homo sapiens
tgtcctacccaccctc

SEQ ID NO: 3778973 - DNA, 20 bp, Homo sapiens
tgtcctacccaccctccttt

SEQ ID NO: 3778974 - DNA, 20 bp, Homo sapiens
tgtcctaggagtatcctcat

SEQ ID NO: 3778975 - DNA, 16 bp, Homo sapiens
tgtcctccagaagcct

SEQ ID NO: 3778976 - DNA, 17 bp, Homo sapiens
tgtcctccagaagcctc

SEQ ID NO: 3778977 - DNA, 19 bp, Homo sapiens
tgtcctccagaagcctctg

SEQ ID NO: 3778978 - DNA, 11 bp, Homo sapiens
tgtcctcctcg

SEQ ID NO: 3778979 - DNA, 16 bp, Homo sapiens
tgtcctctttcagaaa

SEQ ID NO: 3778980 - DNA, 17 bp, Homo sapiens
tgtcctctttcagaaaa

SEQ ID NO: 3778981 - DNA, 21 bp, Homo sapiens
tgtcctctttcagaaaacaga

SEQ ID NO: 3778982 - DNA, 17 bp, Homo sapiens
tgtcctgacctgtctca

SEQ ID NO: 3778983 - DNA, 15 bp, Homo sapiens
tgtccttgcacctgc

SEQ ID NO: 3778984 - DNA, 14 bp, Homo sapiens
tgtccttggggaca

SEQ ID NO: 3778985 - DNA, 19 bp, Homo sapiens
tgtcgatatttccatcatt

SEQ ID NO: 3778986 - DNA, 22 bp, Homo sapiens
tgtcgattaaaatcactctcag

SEQ ID NO: 3778987 - DNA, 14 bp, Homo sapiens
ttaagcattgtttg

SEQ ID NO: 3778988 - DNA, 19 bp, Homo sapiens
ttaagcattgtttgcttat

SEQ ID NO: 3778989 - DNA, 22 bp, Homo sapiens
ttaagcattgtttgcttattgt

SEQ ID NO: 3778990 - DNA, 20 bp, Homo sapiens
ttaaggattgtgatattttt

SEQ ID NO: 3778991 - DNA, 15 bp, Homo sapiens
ttaaggcaactgaac

SEQ ID NO: 3778992 - DNA, 20 bp, Homo sapiens
ttaaggcaactgaacaaaaa

SEQ ID NO: 3778993 - DNA, 18 bp, Homo sapiens
ttaaggcccaacattaaa

SEQ ID NO: 3778994 - DNA, 16 bp, Homo sapiens
ttaaggtctctctttg

SEQ ID NO: 3778995 - DNA, 11 bp, Homo sapiens
ttaagtattta

SEQ ID NO: 3778996 - DNA, 19 bp, Homo sapiens
ttaagtctaaatatttcct

SEQ ID NO: 3778997 - DNA, 18 bp, Homo sapiens
ttaagttagggaatggca

SEQ ID NO: 3778998 - DNA, 18 bp, Homo sapiens
ttaagttggcttctgttt

SEQ ID NO: 3778999 - DNA, 18 bp, Homo sapiens
ttaagttttttatagaga

SEQ ID NO: 3779000 - DNA, 16 bp, Homo sapiens
ttaataaaacactatt

SEQ ID NO: 3779001 - DNA, 18 bp, Homo sapiens
ttaataaaacactatttt

SEQ ID NO: 3779002 - DNA, 22 bp, Homo sapiens
ttaataaagacgatttgtcagt

SEQ ID NO: 3779003 - DNA, 24 bp, Homo sapiens
ttaataatcagcaagaatttgatc

SEQ ID NO: 3779004 - DNA, 23 bp, Homo sapiens
ttaatataactgccttaaaactt

SEQ ID NO: 3779005 - DNA, 13 bp, Homo sapiens
ttaatatgtattt

SEQ ID NO: 3779006 - DNA, 19 bp, Homo sapiens
ttaatatgtattttatgta

SEQ ID NO: 3779007 - DNA, 22 bp, Homo sapiens
ttaatatgtattttatgtatgt

SEQ ID NO: 3779008 - DNA, 22 bp, Homo sapiens
ttaatattcattgtataaaaat

SEQ ID NO: 3779009 - DNA, 20 bp, Homo sapiens
ttaatatttgctgacagctg

SEQ ID NO: 3779010 - DNA, 20 bp, Homo sapiens
ttaatcaggtcctcagagaa

SEQ ID NO: 3779011 - DNA, 17 bp, Homo sapiens
ttaatccacacatcagt

SEQ ID NO: 3779012 - DNA, 22 bp, Homo sapiens
ttaatctggtttatttttgttc

SEQ ID NO: 3779013 - DNA, 17 bp, Homo sapiens
ttaatcttcagttttat

SEQ ID NO: 3779014 - DNA, 14 bp, Homo sapiens
ttaatgaaaatgtc

SEQ ID NO: 3779015 - DNA, 19 bp, Homo sapiens
ttaatgaaagactgtacaa

SEQ ID NO: 3779016 - DNA, 13 bp, Homo sapiens
ttaatgctaaggg

SEQ ID NO: 3779017 - DNA, 14 bp, Homo sapiens
ttaattaagtaaac

SEQ ID NO: 3779018 - DNA, 16 bp, Homo sapiens
ttaattaagtaaacta

SEQ ID NO: 3779019 - DNA, 19 bp, Homo sapiens
ttaattaggggttgctaag

SEQ ID NO: 3779020 - DNA, 13 bp, Homo sapiens
ttaattaggttaa

SEQ ID NO: 3779021 - DNA, 14 bp, Homo sapiens
ttaattattattta

SEQ ID NO: 3779022 - DNA, 13 bp, Homo sapiens
ttaattattgttt

SEQ ID NO: 3779023 - DNA, 14 bp, Homo sapiens
ttaattcatgtttc

SEQ ID NO: 3779024 - DNA, 12 bp, Homo sapiens
ttaattgtaaac

SEQ ID NO: 3779025 - DNA, 14 bp, Homo sapiens
ttaattgtaaactg

SEQ ID NO: 3779026 - DNA, 22 bp, Homo sapiens
ttaattgtgaattgataataaa

SEQ ID NO: 3779027 - DNA, 18 bp, Homo sapiens
ttaatttatgagtttttg

SEQ ID NO: 3779028 - DNA, 20 bp, Homo sapiens
ttaatttatgagtttttgat

SEQ ID NO: 3779029 - DNA, 18 bp, Homo sapiens
ttaatttgccaaaataat

SEQ ID NO: 3779030 - DNA, 12 bp, Homo sapiens
ttacaaacatgt

SEQ ID NO: 3779031 - DNA, 14 bp, Homo sapiens
ttacaaactgcaat

SEQ ID NO: 3779032 - DNA, 17 bp, Homo sapiens
ttacaagaaaaaatgaa

SEQ ID NO: 3779033 - DNA, 20 bp, Homo sapiens
ttacaagcgtgagccactgc

SEQ ID NO: 3779034 - DNA, 14 bp, Homo sapiens
ttacaattgaaatg

SEQ ID NO: 3779035 - DNA, 22 bp, Homo sapiens
ttacacctcgttagggaagaga

SEQ ID NO: 3779036 - DNA, 23 bp, Homo sapiens
ttacacgtggaggaatgctcccc

SEQ ID NO: 3779037 - DNA, 14 bp, Homo sapiens
ttacactctttgta

SEQ ID NO: 3779038 - DNA, 15 bp, Homo sapiens
ttacactctttgtaa

SEQ ID NO: 3779039 - DNA, 17 bp, Homo sapiens
ttacactgttagaacac

SEQ ID NO: 3779040 - DNA, 20 bp, Homo sapiens
ttacactgttagaacactat

SEQ ID NO: 3779041 - DNA, 14 bp, Homo sapiens
ttacagagaggaga

SEQ ID NO: 3779042 - DNA, 18 bp, Homo sapiens
ttacagagaggagaaaca

SEQ ID NO: 3779043 - DNA, 20 bp, Homo sapiens
ttacagagaggagaaacaca

SEQ ID NO: 3779044 - DNA, 16 bp, Homo sapiens
ttacagattgcctcct

SEQ ID NO: 3779045 - DNA, 14 bp, Homo sapiens
ttacagctgcctgc

SEQ ID NO: 3779046 - DNA, 18 bp, Homo sapiens
ttacaggtggacacacaa

SEQ ID NO: 3779047 - DNA, 18 bp, Homo sapiens
ttacagtgcagacaggcc

SEQ ID NO: 3779048 - DNA, 18 bp, Homo sapiens
ttacatctgttttaaatt

SEQ ID NO: 3779049 - DNA, 22 bp, Homo sapiens
ttacatggttaaggtaaagtaa

SEQ ID NO: 3779050 - DNA, 18 bp, Homo sapiens
ttacatgttttctttgct

SEQ ID NO: 3779051 - DNA, 22 bp, Homo sapiens
ttacattgctggtcttgtaaga

SEQ ID NO: 3779052 - DNA, 17 bp, Homo sapiens
ttacattgtttgtctgt

SEQ ID NO: 3779053 - DNA, 22 bp, Homo sapiens
ttaccactgaagatagaagaaa

SEQ ID NO: 3779054 - DNA, 21 bp, Homo sapiens
ttaccagcctccgtatttcag

SEQ ID NO: 3779055 - DNA, 22 bp, Homo sapiens
ttaccagcctccgtatttcaga

SEQ ID NO: 3779056 - DNA, 16 bp, Homo sapiens
ttaccagtaaagtgta

SEQ ID NO: 3779057 - DNA, 22 bp, Homo sapiens
ttaccagtaaagtgtaacatat

SEQ ID NO: 3779058 - DNA, 16 bp, Homo sapiens
ttacccttctgtgccc

SEQ ID NO: 3779059 - DNA, 17 bp, Homo sapiens
ttacccttctgtgccca

SEQ ID NO: 3779060 - DNA, 21 bp, Homo sapiens
ttacccttctgtgcccagctc

SEQ ID NO: 3779061 - DNA, 22 bp, Homo sapiens
ttacccttctgtgcccagctca

SEQ ID NO: 3779062 - DNA, 18 bp, Homo sapiens
ttacctgggcattcttgt

SEQ ID NO: 3779063 - DNA, 13 bp, Homo sapiens
ttacctgtgaaat

SEQ ID NO: 3779064 - DNA, 19 bp, Homo sapiens
ttaccttcaataaagtatc

SEQ ID NO: 3779065 - DNA, 20 bp, Homo sapiens
ttacgcacacgtacttaaat

SEQ ID NO: 3779066 - DNA, 20 bp, Homo sapiens
ttacggttttccaggtttaa

SEQ ID NO: 3779067 - DNA, 15 bp, Homo sapiens
ttactacagttgttt

SEQ ID NO: 3779068 - DNA, 18 bp, Homo sapiens
ttactacatgtgggagct

SEQ ID NO: 3779069 - DNA, 21 bp, Homo sapiens
ttactatcatgtcaaacgtga

SEQ ID NO: 3779070 - DNA, 22 bp, Homo sapiens
ttactatcctggctttgcccaa

SEQ ID NO: 3779071 - DNA, 14 bp, Homo sapiens
ttactattaagcag

SEQ ID NO: 3779072 - DNA, 21 bp, Homo sapiens
ttactcaaagttaacctacct

SEQ ID NO: 3779073 - DNA, 12 bp, Homo sapiens
ttactcagccct

SEQ ID NO: 3779074 - DNA, 16 bp, Homo sapiens
ttactctccaacctgg

SEQ ID NO: 3779075 - DNA, 19 bp, Homo sapiens
ttactctccaacctggaca

SEQ ID NO: 3779076 - DNA, 16 bp, Homo sapiens
ttactcttgtaagatt

SEQ ID NO: 3779077 - DNA, 21 bp, Homo sapiens
ttactcttgtaagattttgaa

SEQ ID NO: 3779078 - DNA, 12 bp, Homo sapiens
ttactgaccagc

SEQ ID NO: 3779079 - DNA, 13 bp, Homo sapiens
ttactgagcttct

SEQ ID NO: 3779080 - DNA, 19 bp, Homo sapiens
ttactgatcatgcattgtt

SEQ ID NO: 3779081 - DNA, 21 bp, Homo sapiens
ttactgccaaagggaaatatc

SEQ ID NO: 3779082 - DNA, 20 bp, Homo sapiens
ttactgtcaataaacagctt

SEQ ID NO: 3779083 - DNA, 12 bp, Homo sapiens
ttactgtcttaa

SEQ ID NO: 3779084 - DNA, 14 bp, Homo sapiens
ttacttagcaatgt

SEQ ID NO: 3779085 - DNA, 21 bp, Homo sapiens
ttacttagcttatcaatttgt

SEQ ID NO: 3779086 - DNA, 18 bp, Homo sapiens
ttacttaggtgtggggga

SEQ ID NO: 3779087 - DNA, 23 bp, Homo sapiens
ttacttcttatacatttgataaa

SEQ ID NO: 3779088 - DNA, 11 bp, Homo sapiens
ttactttgtat

SEQ ID NO: 3779089 - DNA, 15 bp, Homo sapiens
ttactttgtatgata

SEQ ID NO: 3779090 - DNA, 22 bp, Homo sapiens
ttagaaagaagcccaatattat

SEQ ID NO: 3779091 - DNA, 22 bp, Homo sapiens
ttagaaataaagcatctcattt

SEQ ID NO: 3779092 - DNA, 13 bp, Homo sapiens
ttagaaatagaca

SEQ ID NO: 3779093 - DNA, 17 bp, Homo sapiens
ttagaaatgaccaatat

SEQ ID NO: 3779094 - DNA, 16 bp, Homo sapiens
ttagaaatgcagaatc

SEQ ID NO: 3779095 - DNA, 19 bp, Homo sapiens
ttagaacactattttcaga

SEQ ID NO: 3779096 - DNA, 20 bp, Homo sapiens
ttagaacactattttcagaa

SEQ ID NO: 3779097 - DNA, 16 bp, Homo sapiens
ttagaacagaaaacaa

SEQ ID NO: 3779098 - DNA, 13 bp, Homo sapiens
ttagaacctttct

SEQ ID NO: 3779099 - DNA, 21 bp, Homo sapiens
ttagaatcagccttgaaacat

SEQ ID NO: 3779100 - DNA, 21 bp, Homo sapiens
ttcccgctcagccctccctgc

SEQ ID NO: 3779101 - DNA, 15 bp, Homo sapiens
ttccctaagccaagg

SEQ ID NO: 3779102 - DNA, 13 bp, Homo sapiens
ttccctacctcag

SEQ ID NO: 3779103 - DNA, 14 bp, Homo sapiens
ttccctacttcctg

SEQ ID NO: 3779104 - DNA, 18 bp, Homo sapiens
ttccctagggctgggtgt

SEQ ID NO: 3779105 - DNA, 13 bp, Homo sapiens
ttccctatctttt

SEQ ID NO: 3779106 - DNA, 20 bp, Homo sapiens
ttccctcccttcctctttcc

SEQ ID NO: 3779107 - DNA, 14 bp, Homo sapiens
ttccctctccctgt

SEQ ID NO: 3779108 - DNA, 18 bp, Homo sapiens
ttccctctgcctgtccct

SEQ ID NO: 3779109 - DNA, 14 bp, Homo sapiens
ttcccttaaaattt

SEQ ID NO: 3779110 - DNA, 18 bp, Homo sapiens
ttcccttcaaggtcattt

SEQ ID NO: 3779111 - DNA, 14 bp, Homo sapiens
ttcccttgagccct

SEQ ID NO: 3779112 - DNA, 11 bp, Homo sapiens
ttcccttggcc

SEQ ID NO: 3779113 - DNA, 15 bp, Homo sapiens
ttcccttggcctcag

SEQ ID NO: 3779114 - DNA, 22 bp, Homo sapiens
ttccgacaaccgatgctccagc

SEQ ID NO: 3779115 - DNA, 13 bp, Homo sapiens
ttccgtttacatt

SEQ ID NO: 3779116 - DNA, 14 bp, Homo sapiens
ttcctaacacagca

SEQ ID NO: 3779117 - DNA, 18 bp, Homo sapiens
ttcctaacacagcatgtg

SEQ ID NO: 3779118 - DNA, 19 bp, Homo sapiens
ttcctaacacagcatgtgt

SEQ ID NO: 3779119 - DNA, 17 bp, Homo sapiens
ttcctaaggcacccaca

SEQ ID NO: 3779120 - DNA, 14 bp, Homo sapiens
ttcctaagttctta

SEQ ID NO: 3779121 - DNA, 17 bp, Homo sapiens
ttcctagataaaaagat

SEQ ID NO: 3779122 - DNA, 14 bp, Homo sapiens
ttcctagccctctc

SEQ ID NO: 3779123 - DNA, 18 bp, Homo sapiens
ttcctagccctctcacat

SEQ ID NO: 3779124 - DNA, 16 bp, Homo sapiens
ttcctatcccatccca

SEQ ID NO: 3779125 - DNA, 18 bp, Homo sapiens
ttcctatcccatcccatc

SEQ ID NO: 3779126 - DNA, 15 bp, Homo sapiens
ttcctatttcttata

SEQ ID NO: 3779127 - DNA, 21 bp, Homo sapiens
ttcctcacaccaggcttgcct

SEQ ID NO: 3779128 - DNA, 14 bp, Homo sapiens
ttcctcgccctggg

SEQ ID NO: 3779129 - DNA, 21 bp, Homo sapiens
ttcctctcatccttttctcct

SEQ ID NO: 3779130 - DNA, 14 bp, Homo sapiens
ttcctctccactgc

SEQ ID NO: 3779131 - DNA, 16 bp, Homo sapiens
ttcctctccactgcct

SEQ ID NO: 3779132 - DNA, 19 bp, Homo sapiens
ttcctctccactgccttcg

SEQ ID NO: 3779133 - DNA, 13 bp, Homo sapiens
ttcctcttcccca

SEQ ID NO: 3779134 - DNA, 11 bp, Homo sapiens
ttcctctttcc

SEQ ID NO: 3779135 - DNA, 13 bp, Homo sapiens
ttcctgagcttgg

SEQ ID NO: 3779136 - DNA, 13 bp, Homo sapiens
ttcctgatgaccc

SEQ ID NO: 3779137 - DNA, 21 bp, Homo sapiens
ttcctgatgacccaggctgcc

SEQ ID NO: 3779138 - DNA, 18 bp, Homo sapiens
ttcctgccgcaacagttt

SEQ ID NO: 3779139 - DNA, 16 bp, Homo sapiens
ttcctgcctggtctcc

SEQ ID NO: 3779140 - DNA, 20 bp, Homo sapiens
ttcctggagcccgaggcacc

SEQ ID NO: 3779141 - DNA, 20 bp, Homo sapiens
ttcctggcaatagtgtgttc

SEQ ID NO: 3779142 - DNA, 23 bp, Homo sapiens
ttcctggcaatagtgtgttctga

SEQ ID NO: 3779143 - DNA, 18 bp, Homo sapiens
ttcctgtccgccctcttc

SEQ ID NO: 3779144 - DNA, 23 bp, Homo sapiens
ttcctgtccttctctcacctcct

SEQ ID NO: 3779145 - DNA, 17 bp, Homo sapiens
ttcctgttcagcattct

SEQ ID NO: 3779146 - DNA, 15 bp, Homo sapiens
ttccttaaactgtgt

SEQ ID NO: 3779147 - DNA, 17 bp, Homo sapiens
ttccttaaactgtgtgg

SEQ ID NO: 3779148 - DNA, 16 bp, Homo sapiens
ttccttactgcagaat

SEQ ID NO: 3779149 - DNA, 22 bp, Homo sapiens
ttccttagcttagacctcagcc

SEQ ID NO: 3779150 - DNA, 12 bp, Homo sapiens
ttccttccctgg

SEQ ID NO: 3779151 - DNA, 13 bp, Homo sapiens
ttccttccctggc

SEQ ID NO: 3779152 - DNA, 16 bp, Homo sapiens
ttccttctcatctgtg

SEQ ID NO: 3779153 - DNA, 17 bp, Homo sapiens
ttccttgagaaaaacaa

SEQ ID NO: 3779154 - DNA, 15 bp, Homo sapiens
ttccttggggcaggc

SEQ ID NO: 3779155 - DNA, 18 bp, Homo sapiens
ttccttggggcaggcagt

SEQ ID NO: 3779156 - DNA, 16 bp, Homo sapiens
ttcctttccctttagc

SEQ ID NO: 3779157 - DNA, 20 bp, Homo sapiens
ttccttttaaaacacttcca

SEQ ID NO: 3779158 - DNA, 22 bp, Homo sapiens
ttccttttaaaacacttccata

SEQ ID NO: 3779159 - DNA, 18 bp, Homo sapiens
ttcgagaccaacctgacc

SEQ ID NO: 3779160 - DNA, 22 bp, Homo sapiens
ttcgagctatatttaagtattc

SEQ ID NO: 3779161 - DNA, 13 bp, Homo sapiens
ttcgctcctgtgt

SEQ ID NO: 3779162 - DNA, 14 bp, Homo sapiens
ttcgggccctgcct

SEQ ID NO: 3779163 - DNA, 17 bp, Homo sapiens
ttcggggaactcctgga

SEQ ID NO: 3779164 - DNA, 17 bp, Homo sapiens
ttcgtgaagtatactgt

SEQ ID NO: 3779165 - DNA, 15 bp, Homo sapiens
ttcgtgcactctgct

SEQ ID NO: 3779166 - DNA, 17 bp, Homo sapiens
ttcgtggtgatcaatta

SEQ ID NO: 3779167 - DNA, 17 bp, Homo sapiens
ttcgttcttgttagtac

SEQ ID NO: 3779168 - DNA, 18 bp, Homo sapiens
ttcgtttgtttgttttgt

SEQ ID NO: 3779169 - DNA, 12 bp, Homo sapiens
ttcgttttggtt

SEQ ID NO: 3779170 - DNA, 20 bp, Homo sapiens
ttctaaaggcctcttccttg

SEQ ID NO: 3779171 - DNA, 23 bp, Homo sapiens
ttctaaatgcatatcctgagcca

SEQ ID NO: 3779172 - DNA, 16 bp, Homo sapiens
ttctaactctgatgta

SEQ ID NO: 3779173 - DNA, 23 bp, Homo sapiens
ttctaactctgatgtaaatgaag

SEQ ID NO: 3779174 - DNA, 14 bp, Homo sapiens
ttctaatctgctat

SEQ ID NO: 3779175 - DNA, 14 bp, Homo sapiens
ttctaattgccatg

SEQ ID NO: 3779176 - DNA, 16 bp, Homo sapiens
ttctacaatctattta

SEQ ID NO: 3779177 - DNA, 11 bp, Homo sapiens
ttctacactct

SEQ ID NO: 3779178 - DNA, 15 bp, Homo sapiens
ttctacagcaaattt

SEQ ID NO: 3779179 - DNA, 19 bp, Homo sapiens
ttctacagcaaatttataa

SEQ ID NO: 3779180 - DNA, 14 bp, Homo sapiens
ttctacatttcacc

SEQ ID NO: 3779181 - DNA, 22 bp, Homo sapiens
ttctacatttcacctactttgt

SEQ ID NO: 3779182 - DNA, 21 bp, Homo sapiens
ttctaccacacagcagcagtt

SEQ ID NO: 3779183 - DNA, 15 bp, Homo sapiens
ttctaccatttcaga

SEQ ID NO: 3779184 - DNA, 21 bp, Homo sapiens
ttctacccagcgagccctggt

SEQ ID NO: 3779185 - DNA, 13 bp, Homo sapiens
ttctacgccaggg

SEQ ID NO: 3779186 - DNA, 15 bp, Homo sapiens
ttctactcatatata

SEQ ID NO: 3779187 - DNA, 19 bp, Homo sapiens
ttctagcatgaagacagag

SEQ ID NO: 3779188 - DNA, 20 bp, Homo sapiens
ttctagctgttgagctgttt

SEQ ID NO: 3779189 - DNA, 13 bp, Homo sapiens
ttctagttttgtc

SEQ ID NO: 3779190 - DNA, 20 bp, Homo sapiens
ttctataggaacatatgaaa

SEQ ID NO: 3779191 - DNA, 18 bp, Homo sapiens
ttctattaaaagtgggaa

SEQ ID NO: 3779192 - DNA, 13 bp, Homo sapiens
ttctatttaagtg

SEQ ID NO: 3779193 - DNA, 16 bp, Homo sapiens
ttctattttgtaaact

SEQ ID NO: 3779194 - DNA, 15 bp, Homo sapiens
ttctcaagccctgca

SEQ ID NO: 3779195 - DNA, 21 bp, Homo sapiens
ttctcacagtgggagccaggg

SEQ ID NO: 3779196 - DNA, 14 bp, Homo sapiens
ttctcactccacca

SEQ ID NO: 3779197 - DNA, 18 bp, Homo sapiens
ttctcactcctacctggt

SEQ ID NO: 3779198 - DNA, 20 bp, Homo sapiens
ttctcagatatttatatttt

SEQ ID NO: 3779199 - DNA, 13 bp, Homo sapiens
ttctcagctccca

SEQ ID NO: 3779200 - DNA, 20 bp, Homo sapiens
ttctcaggctctgccctgcc

SEQ ID NO: 3779201 - DNA, 18 bp, Homo sapiens
ttctcatagcattaacta

SEQ ID NO: 3779202 - DNA, 21 bp, Homo sapiens
ttctcatagcattaactaatc

SEQ ID NO: 3779203 - DNA, 17 bp, Homo sapiens
ttctcatagccccggtg

SEQ ID NO: 3779204 - DNA, 19 bp, Homo sapiens
ttctccagacccaccacac

SEQ ID NO: 3779205 - DNA, 13 bp, Homo sapiens
ttctcccacactg

SEQ ID NO: 3779206 - DNA, 14 bp, Homo sapiens
ttctccccctgggc

SEQ ID NO: 3779207 - DNA, 13 bp, Homo sapiens
ttctcctcccagg

SEQ ID NO: 3779208 - DNA, 18 bp, Homo sapiens
ttctccttgataacagct

SEQ ID NO: 3779209 - DNA, 20 bp, Homo sapiens
ttctctcggagtatctggga

SEQ ID NO: 3779210 - DNA, 20 bp, Homo sapiens
ttctctctatggtaaagata

SEQ ID NO: 3779211 - DNA, 22 bp, Homo sapiens
ttctctgagtatctcctcgcaa

SEQ ID NO: 3779212 - DNA, 11 bp, Homo sapiens
ttctctgctcc

SEQ ID NO: 3779213 - DNA, 11 bp, Homo sapiens
ttctctgcttc

SEQ ID NO: 3779214 - DNA, 20 bp, Homo sapiens
ttgtatgatcctaatgaatg

SEQ ID NO: 3779215 - DNA, 14 bp, Homo sapiens
ttgtcagactttaa

SEQ ID NO: 3779216 - DNA, 13 bp, Homo sapiens
ttgtcagagctgg

SEQ ID NO: 3779217 - DNA, 15 bp, Homo sapiens
ttgtcagagctggga

SEQ ID NO: 3779218 - DNA, 16 bp, Homo sapiens
ttgtcattttgaagct

SEQ ID NO: 3779219 - DNA, 19 bp, Homo sapiens
ttgtcattttgaagctaat

SEQ ID NO: 3779220 - DNA, 21 bp, Homo sapiens
ttgtccaacccgaggcccgca

SEQ ID NO: 3779221 - DNA, 13 bp, Homo sapiens
ttgtccagcgcct

SEQ ID NO: 3779222 - DNA, 17 bp, Homo sapiens
ttgtctgaagtcactgc

SEQ ID NO: 3779223 - DNA, 18 bp, Homo sapiens
ttgtctgaagtcactgca

SEQ ID NO: 3779224 - DNA, 15 bp, Homo sapiens
ttgtcttaaaaagtg

SEQ ID NO: 3779225 - DNA, 17 bp, Homo sapiens
ttgtcttaaataaaaga

SEQ ID NO: 3779226 - DNA, 14 bp, Homo sapiens
ttgtctttatatga

SEQ ID NO: 3779227 - DNA, 20 bp, Homo sapiens
ttgtctttgttcttctacca

SEQ ID NO: 3779228 - DNA, 14 bp, Homo sapiens
ttgtgaaatgatgg

SEQ ID NO: 3779229 - DNA, 13 bp, Homo sapiens
ttgtgaatgtgac

SEQ ID NO: 3779230 - DNA, 16 bp, Homo sapiens
ttgtgaccaagttata

SEQ ID NO: 3779231 - DNA, 21 bp, Homo sapiens
ttgtgagaaacatctcaataa

SEQ ID NO: 3779232 - DNA, 15 bp, Homo sapiens
ttgtgatcttgctct

SEQ ID NO: 3779233 - DNA, 22 bp, Homo sapiens
ttgtgctgatcgtgctaaattt

SEQ ID NO: 3779234 - DNA, 14 bp, Homo sapiens
ttgtgctgatgaga

SEQ ID NO: 3779235 - DNA, 21 bp, Homo sapiens
ttgtggaaaatgaaaattagg

SEQ ID NO: 3779236 - DNA, 18 bp, Homo sapiens
ttgtggaaagcctctgct

SEQ ID NO: 3779237 - DNA, 22 bp, Homo sapiens
ttgtggaggagctcaggacact

SEQ ID NO: 3779238 - DNA, 12 bp, Homo sapiens
ttgtggcctcag

SEQ ID NO: 3779239 - DNA, 15 bp, Homo sapiens
ttgtggctgtcagca

SEQ ID NO: 3779240 - DNA, 13 bp, Homo sapiens
ttgtggttaatct

SEQ ID NO: 3779241 - DNA, 19 bp, Homo sapiens
ttgtggttatttttataca

SEQ ID NO: 3779242 - DNA, 12 bp, Homo sapiens
ttgtgtgtgtgc

SEQ ID NO: 3779243 - DNA, 21 bp, Homo sapiens
ttgtgtgttatttaaatgagt

SEQ ID NO: 3779244 - DNA, 13 bp, Homo sapiens
ttgtgttcacctt

SEQ ID NO: 3779245 - DNA, 20 bp, Homo sapiens
ttgttaaaactggcatctga

SEQ ID NO: 3779246 - DNA, 16 bp, Homo sapiens
ttgttaaaataactag

SEQ ID NO: 3779247 - DNA, 11 bp, Homo sapiens
ttgttaacttt

SEQ ID NO: 3779248 - DNA, 17 bp, Homo sapiens
ttgttaagatatgatgt

SEQ ID NO: 3779249 - DNA, 12 bp, Homo sapiens
ttgttaccttta

SEQ ID NO: 3779250 - DNA, 14 bp, Homo sapiens
ttgttatggcttaa

SEQ ID NO: 3779251 - DNA, 19 bp, Homo sapiens
ttgttatggcttaatgaca

SEQ ID NO: 3779252 - DNA, 20 bp, Homo sapiens
ttgttcaaaatatgttcttt

SEQ ID NO: 3779253 - DNA, 16 bp, Homo sapiens
ttgttccaagacattg

SEQ ID NO: 3779254 - DNA, 21 bp, Homo sapiens
ttgttccaagacattgtcaat

SEQ ID NO: 3779255 - DNA, 21 bp, Homo sapiens
ttgttccacaagttaaataaa

SEQ ID NO: 3779256 - DNA, 17 bp, Homo sapiens
ttgttctctctatggta

SEQ ID NO: 3779257 - DNA, 15 bp, Homo sapiens
ttgttctttcagaaa

SEQ ID NO: 3779258 - DNA, 14 bp, Homo sapiens
ttgttgaggtggtc

SEQ ID NO: 3779259 - DNA, 21 bp, Homo sapiens
ttgttgaggtggtctgaatgt

SEQ ID NO: 3779260 - DNA, 16 bp, Homo sapiens
ttgtttctccccctgg

SEQ ID NO: 3779261 - DNA, 11 bp, Homo sapiens
ttgtttcttcc

SEQ ID NO: 3779262 - DNA, 13 bp, Homo sapiens
ttgtttgcttatt

SEQ ID NO: 3779263 - DNA, 15 bp, Homo sapiens
ttgtttgcttattgt

SEQ ID NO: 3779264 - DNA, 13 bp, Homo sapiens
ttgtttgtaaata

SEQ ID NO: 3779265 - DNA, 10 bp, Homo sapiens
ttgtttgttt

SEQ ID NO: 3779266 - DNA, 13 bp, Homo sapiens
ttgttttcagtgt

SEQ ID NO: 3779267 - DNA, 23 bp, Homo sapiens
ttgttttgatgtttgtggcctca

SEQ ID NO: 3779268 - DNA, 12 bp, Homo sapiens
ttgtttttatga

SEQ ID NO: 3779269 - DNA, 22 bp, Homo sapiens
ttgtttttccttgtatttaaat

SEQ ID NO: 3779270 - DNA, 16 bp, Homo sapiens
ttgttttttaaagtct

SEQ ID NO: 3779271 - DNA, 14 bp, Homo sapiens
ttgttttttatctt

SEQ ID NO: 3779272 - DNA, 19 bp, Homo sapiens
ttgttttttttttccactt

SEQ ID NO: 3779273 - DNA, 14 bp, Homo sapiens
tttaaaaaagttta

SEQ ID NO: 3779274 - DNA, 13 bp, Homo sapiens
tttaaaaatcata

SEQ ID NO: 3779275 - DNA, 15 bp, Homo sapiens
tttaaaaatcataaa

SEQ ID NO: 3779276 - DNA, 11 bp, Homo sapiens
tttaaaacaaa

SEQ ID NO: 3779277 - DNA, 12 bp, Homo sapiens
tttaaaagacac

SEQ ID NO: 3779278 - DNA, 14 bp, Homo sapiens
tttaaaagacactg

SEQ ID NO: 3779279 - DNA, 15 bp, Homo sapiens
tttaaaagttattaa

SEQ ID NO: 3779280 - DNA, 13 bp, Homo sapiens
tttaaaatcacta

SEQ ID NO: 3779281 - DNA, 11 bp, Homo sapiens
tttaaaatgta

SEQ ID NO: 3779282 - DNA, 12 bp, Homo sapiens
tttaaaatgtat

SEQ ID NO: 3779283 - DNA, 20 bp, Homo sapiens
tttaaaatgtataagttgag

SEQ ID NO: 3779284 - DNA, 17 bp, Homo sapiens
tttaaagaatcattatt

SEQ ID NO: 3779285 - DNA, 13 bp, Homo sapiens
tttaaagaatgct

SEQ ID NO: 3779286 - DNA, 17 bp, Homo sapiens
tttaaagtgtattataa

SEQ ID NO: 3779287 - DNA, 21 bp, Homo sapiens
tttaaattcacaatagaaact

SEQ ID NO: 3779288 - DNA, 23 bp, Homo sapiens
tttaacaactatgatttggaaaa

SEQ ID NO: 3779289 - DNA, 22 bp, Homo sapiens
tttaacaataactactgtgttc

SEQ ID NO: 3779290 - DNA, 22 bp, Homo sapiens
tttaagaaaaaataacacacat

SEQ ID NO: 3779291 - DNA, 12 bp, Homo sapiens
tttaagaaaata

SEQ ID NO: 3779292 - DNA, 20 bp, Homo sapiens
tttaagaaaatacaataaac

SEQ ID NO: 3779293 - DNA, 21 bp, Homo sapiens
tttaagaaaatacaataaact

SEQ ID NO: 3779294 - DNA, 16 bp, Homo sapiens
tttaagaccagcctgg

SEQ ID NO: 3779295 - DNA, 15 bp, Homo sapiens
tttaagataattata

SEQ ID NO: 3779296 - DNA, 15 bp, Homo sapiens
tttaagcattactct

SEQ ID NO: 3779297 - DNA, 16 bp, Homo sapiens
tttaagcattactctt

SEQ ID NO: 3779298 - DNA, 20 bp, Homo sapiens
tttaagcccatcaattatag

SEQ ID NO: 3779299 - DNA, 12 bp, Homo sapiens
tttaagctgttt

SEQ ID NO: 3779300 - DNA, 16 bp, Homo sapiens
tttaaggcttcaattt

SEQ ID NO: 3779301 - DNA, 22 bp, Homo sapiens
tttaagggtttgtggaaaatga

SEQ ID NO: 3779302 - DNA, 16 bp, Homo sapiens
tttaaggtttttactg

SEQ ID NO: 3779303 - DNA, 12 bp, Homo sapiens
tttaagtattta

SEQ ID NO: 3779304 - DNA, 13 bp, Homo sapiens
tttaagtatttat

SEQ ID NO: 3779305 - DNA, 14 bp, Homo sapiens
tttaagtatttata

SEQ ID NO: 3779306 - DNA, 20 bp, Homo sapiens
tttaagtatttatatattta

SEQ ID NO: 3779307 - DNA, 18 bp, Homo sapiens
tttaagtgctttgtaatg

SEQ ID NO: 3779308 - DNA, 14 bp, Homo sapiens
tttaagtgtaactg

SEQ ID NO: 3779309 - DNA, 16 bp, Homo sapiens
tttaatgaaagactgt

SEQ ID NO: 3779310 - DNA, 21 bp, Homo sapiens
tttaatgaaagactgtacaaa

SEQ ID NO: 3779311 - DNA, 23 bp, Homo sapiens
tttaattattatttatatatgta

SEQ ID NO: 3779312 - DNA, 23 bp, Homo sapiens
tttaattcatgtttcttaaatgg

SEQ ID NO: 3779313 - DNA, 19 bp, Homo sapiens
tttaattgtaaactgtact

SEQ ID NO: 3779314 - DNA, 16 bp, Homo sapiens
tttaatttatgagttt

SEQ ID NO: 3779315 - DNA, 16 bp, Homo sapiens
tttaatttatttatta

SEQ ID NO: 3779316 - DNA, 13 bp, Homo sapiens
tttacaaaaagac

SEQ ID NO: 3779317 - DNA, 21 bp, Homo sapiens
tttacaatcagccacattcta

SEQ ID NO: 3779318 - DNA, 20 bp, Homo sapiens
tttacagctttcatgattag

SEQ ID NO: 3779319 - DNA, 19 bp, Homo sapiens
tttacatggggttttcaat

SEQ ID NO: 3779320 - DNA, 20 bp, Homo sapiens
tttaccaagttatataaaga

SEQ ID NO: 3779321 - DNA, 23 bp, Homo sapiens
tttaccatttgtaataaagtata

SEQ ID NO: 3779322 - DNA, 23 bp, Homo sapiens
tttacccagaatgtcagattcct

SEQ ID NO: 3779323 - DNA, 13 bp, Homo sapiens
tttacccttggct

SEQ ID NO: 3779324 - DNA, 21 bp, Homo sapiens
tttacctgtgcgttactaatt

SEQ ID NO: 3779325 - DNA, 13 bp, Homo sapiens
tttactcattatc

SEQ ID NO: 3779326 - DNA, 13 bp, Homo sapiens
tttactccccttg

SEQ ID NO: 3779327 - DNA, 17 bp, Homo sapiens
tttactgagcttctctg

SEQ ID NO: 3779328 - DNA, 20 bp, Homo sapiens
ttttgatttgtactgaaaaa

SEQ ID NO: 3779329 - DNA, 14 bp, Homo sapiens
ttttgcagcagtga

SEQ ID NO: 3779330 - DNA, 21 bp, Homo sapiens
ttttgcagcccagacaaatgt

SEQ ID NO: 3779331 - DNA, 19 bp, Homo sapiens
ttttgcatttgaataaagc

SEQ ID NO: 3779332 - DNA, 18 bp, Homo sapiens
ttttgcccttcacagtgt

SEQ ID NO: 3779333 - DNA, 17 bp, Homo sapiens
ttttggccaaagtgtta

SEQ ID NO: 3779334 - DNA, 19 bp, Homo sapiens
ttttggcccccgagctggg

SEQ ID NO: 3779335 - DNA, 15 bp, Homo sapiens
ttttggtctgtgtga

SEQ ID NO: 3779336 - DNA, 14 bp, Homo sapiens
ttttggttaagttg

SEQ ID NO: 3779337 - DNA, 14 bp, Homo sapiens
ttttgtaagacaaa

SEQ ID NO: 3779338 - DNA, 19 bp, Homo sapiens
ttttgtagagccagggtct

SEQ ID NO: 3779339 - DNA, 15 bp, Homo sapiens
ttttgtaggtacttt

SEQ ID NO: 3779340 - DNA, 19 bp, Homo sapiens
ttttgtaggtacttttgga

SEQ ID NO: 3779341 - DNA, 16 bp, Homo sapiens
ttttgtatagtaaagt

SEQ ID NO: 3779342 - DNA, 18 bp, Homo sapiens
ttttgtatagtaaagtga

SEQ ID NO: 3779343 - DNA, 24 bp, Homo sapiens
ttttgtgaaatgaaaacatgtaat

SEQ ID NO: 3779344 - DNA, 21 bp, Homo sapiens
ttttgttccacaagttaaata

SEQ ID NO: 3779345 - DNA, 16 bp, Homo sapiens
ttttgtttcatcctgt

SEQ ID NO: 3779346 - DNA, 15 bp, Homo sapiens
ttttgtttcttccaa

SEQ ID NO: 3779347 - DNA, 16 bp, Homo sapiens
ttttgttttaaaatta

SEQ ID NO: 3779348 - DNA, 14 bp, Homo sapiens
tttttaaatatatt

SEQ ID NO: 3779349 - DNA, 20 bp, Homo sapiens
tttttaaatgatgttgaata

SEQ ID NO: 3779350 - DNA, 21 bp, Homo sapiens
tttttaatatgtaaggaatgc

SEQ ID NO: 3779351 - DNA, 16 bp, Homo sapiens
tttttaatttatttat

SEQ ID NO: 3779352 - DNA, 22 bp, Homo sapiens
tttttacctaccacagtgtctg

SEQ ID NO: 3779353 - DNA, 22 bp, Homo sapiens
tttttagacagagtctcactgt

SEQ ID NO: 3779354 - DNA, 13 bp, Homo sapiens
tttttatcttttc

SEQ ID NO: 3779355 - DNA, 13 bp, Homo sapiens
tttttattatgca

SEQ ID NO: 3779356 - DNA, 15 bp, Homo sapiens
tttttattatgcata

SEQ ID NO: 3779357 - DNA, 11 bp, Homo sapiens
tttttattctt

SEQ ID NO: 3779358 - DNA, 15 bp, Homo sapiens
tttttattgatgtgc

SEQ ID NO: 3779359 - DNA, 19 bp, Homo sapiens
tttttatttgtttgtgcat

SEQ ID NO: 3779360 - DNA, 14 bp, Homo sapiens
tttttcagaaatat

SEQ ID NO: 3779361 - DNA, 21 bp, Homo sapiens
tttttcagcagactatgaata

SEQ ID NO: 3779362 - DNA, 21 bp, Homo sapiens
tttttcattgatatgaaaaat

SEQ ID NO: 3779363 - DNA, 17 bp, Homo sapiens
tttttcgtttgtttgtt

SEQ ID NO: 3779364 - DNA, 14 bp, Homo sapiens
tttttgatagcttt

SEQ ID NO: 3779365 - DNA, 15 bp, Homo sapiens
tttttgggatgtctt

SEQ ID NO: 3779366 - DNA, 15 bp, Homo sapiens
tttttggtggatgta

SEQ ID NO: 3779367 - DNA, 18 bp, Homo sapiens
tttttggtggatgtaaat

SEQ ID NO: 3779368 - DNA, 19 bp, Homo sapiens
tttttgtagagccagggtc

SEQ ID NO: 3779369 - DNA, 13 bp, Homo sapiens
tttttgtcttttc

SEQ ID NO: 3779370 - DNA, 15 bp, Homo sapiens
tttttgtgtatttgt

SEQ ID NO: 3779371 - DNA, 17 bp, Homo sapiens
tttttgttgtgttctgt

SEQ ID NO: 3779372 - DNA, 17 bp, Homo sapiens
ttttttaagtatttata

SEQ ID NO: 3779373 - DNA, 11 bp, Homo sapiens
ttttttataca

SEQ ID NO: 3779374 - DNA, 16 bp, Homo sapiens
ttttttatgctaatca

SEQ ID NO: 3779375 - DNA, 15 bp, Homo sapiens
ttttttatgttttgt

SEQ ID NO: 3779376 - DNA, 13 bp, Homo sapiens
ttttttcgtttgt

SEQ ID NO: 3779377 - DNA, 20 bp, Homo sapiens
aaagccaaatcaaaatatgt

SEQ ID NO: 3779378 - DNA, 23 bp, Homo sapiens
aaagccaagtttatatacaatta

SEQ ID NO: 3779379 - DNA, 19 bp, Homo sapiens
aaagccagctgccgaccag

SEQ ID NO: 3779380 - DNA, 16 bp, Homo sapiens
aaagccatcatgtaaa

SEQ ID NO: 3779381 - DNA, 20 bp, Homo sapiens
aaagccatcatgtaaattac

SEQ ID NO: 3779382 - DNA, 16 bp, Homo sapiens
aaagcccaacctcctg

SEQ ID NO: 3779383 - DNA, 17 bp, Homo sapiens
aaagctaggcctggcca

SEQ ID NO: 3779384 - DNA, 18 bp, Homo sapiens
aaagctaggcctggccag

SEQ ID NO: 3779385 - DNA, 15 bp, Homo sapiens
aaagctgaagccgcc

SEQ ID NO: 3779386 - DNA, 19 bp, Homo sapiens
aaagctgacgaggctgggc

SEQ ID NO: 3779387 - DNA, 19 bp, Homo sapiens
aaagctgattactgtcaat

SEQ ID NO: 3779388 - DNA, 16 bp, Homo sapiens
aaagctgcctgtagtt

SEQ ID NO: 3779389 - DNA, 17 bp, Homo sapiens
aaagctgcctgtagtta

SEQ ID NO: 3779390 - DNA, 23 bp, Homo sapiens
aaagctgcctgtagttaggaaat

SEQ ID NO: 3779391 - DNA, 15 bp, Homo sapiens
aaagcttgttaagat

SEQ ID NO: 3779392 - DNA, 14 bp, Homo sapiens
aaagcttttatgag

SEQ ID NO: 3779393 - DNA, 22 bp, Homo sapiens
aaaggaaaaagtatcatggaaa

SEQ ID NO: 3779394 - DNA, 18 bp, Homo sapiens
aaaggaaaatagtaatgt

SEQ ID NO: 3779395 - DNA, 17 bp, Homo sapiens
aaaggaaatctcacccc

SEQ ID NO: 3779396 - DNA, 13 bp, Homo sapiens
aaaggaagactag

SEQ ID NO: 3779397 - DNA, 22 bp, Homo sapiens
aaaggaagctttctctgcttca

SEQ ID NO: 3779398 - DNA, 22 bp, Homo sapiens
aaaggacaccttttaactcacc

SEQ ID NO: 3779399 - DNA, 19 bp, Homo sapiens
aaaggatatttaagaaaat

SEQ ID NO: 3779400 - DNA, 19 bp, Homo sapiens
aaaggatgtaaacagtgcc

SEQ ID NO: 3779401 - DNA, 21 bp, Homo sapiens
aaaggatgtaaacagtgcctg

SEQ ID NO: 3779402 - DNA, 18 bp, Homo sapiens
aaaggattcatgtggaat

SEQ ID NO: 3779403 - DNA, 12 bp, Homo sapiens
aaaggcacagtg

SEQ ID NO: 3779404 - DNA, 17 bp, Homo sapiens
aaaggcacctataaaac

SEQ ID NO: 3779405 - DNA, 16 bp, Homo sapiens
aaaggcattctctgaa

SEQ ID NO: 3779406 - DNA, 20 bp, Homo sapiens
aaaggccagctggcagcaga

SEQ ID NO: 3779407 - DNA, 21 bp, Homo sapiens
aaaggcgcagtgcttctctac

SEQ ID NO: 3779408 - DNA, 17 bp, Homo sapiens
aaaggctaccttattgt

SEQ ID NO: 3779409 - DNA, 19 bp, Homo sapiens
aaaggctaggtacacagct

SEQ ID NO: 3779410 - DNA, 21 bp, Homo sapiens
aaaggctcagtctcaggagca

SEQ ID NO: 3779411 - DNA, 20 bp, Homo sapiens
aaaggctctgaaagccagct

SEQ ID NO: 3779412 - DNA, 22 bp, Homo sapiens
aaagggagcagagaaggccagg

SEQ ID NO: 3779413 - DNA, 18 bp, Homo sapiens
aaagggagctatcaggaa

SEQ ID NO: 3779414 - DNA, 14 bp, Homo sapiens
aaaggggggagggg

SEQ ID NO: 3779415 - DNA, 10 bp, Homo sapiens
aaagggtgaa

SEQ ID NO: 3779416 - DNA, 14 bp, Homo sapiens
aaaggtataatttt

SEQ ID NO: 3779417 - DNA, 17 bp, Homo sapiens
aaaggtggtatgtgtgt

SEQ ID NO: 3779418 - DNA, 21 bp, Homo sapiens
aaaggtggtatgtgtgtgtat

SEQ ID NO: 3779419 - DNA, 22 bp, Homo sapiens
aaaggtggtatgtgtgtgtatg

SEQ ID NO: 3779420 - DNA, 18 bp, Homo sapiens
aaaggttattttctcctg

SEQ ID NO: 3779421 - DNA, 17 bp, Homo sapiens
aaaggttcactaaagca

SEQ ID NO: 3779422 - DNA, 22 bp, Homo sapiens
aaagtagaagtcttagatgtat

SEQ ID NO: 3779423 - DNA, 15 bp, Homo sapiens
aaagtatatatttat

SEQ ID NO: 3779424 - DNA, 14 bp, Homo sapiens
aaagtatatgttag

SEQ ID NO: 3779425 - DNA, 22 bp, Homo sapiens
aaagtatcatggaaatattatg

SEQ ID NO: 3779426 - DNA, 14 bp, Homo sapiens
aaagtctctattta

SEQ ID NO: 3779427 - DNA, 20 bp, Homo sapiens
aaagtctctatttaaattct

SEQ ID NO: 3779428 - DNA, 19 bp, Homo sapiens
aaagtctgcattacattcc

SEQ ID NO: 3779429 - DNA, 15 bp, Homo sapiens
aaagtcttgtgacta

SEQ ID NO: 3779430 - DNA, 22 bp, Homo sapiens
aaagtcttgtgactagtgctga

SEQ ID NO: 3779431 - DNA, 23 bp, Homo sapiens
aaagtcttgtgactagtgctgaa

SEQ ID NO: 3779432 - DNA, 13 bp, Homo sapiens
aaagtgaagcaaa

SEQ ID NO: 3779433 - DNA, 12 bp, Homo sapiens
aaagtgaatttg

SEQ ID NO: 3779434 - DNA, 15 bp, Homo sapiens
aaagtgaatttgaat

SEQ ID NO: 3779435 - DNA, 19 bp, Homo sapiens
aaagtgaatttgaatgaaa

SEQ ID NO: 3779436 - DNA, 19 bp, Homo sapiens
aaagtgagcatgctttctg

SEQ ID NO: 3779437 - DNA, 15 bp, Homo sapiens
aaagtgataatttct

SEQ ID NO: 3779438 - DNA, 11 bp, Homo sapiens
aaagtgctggg

SEQ ID NO: 3779439 - DNA, 13 bp, Homo sapiens
aaagtggaaggaa

SEQ ID NO: 3779440 - DNA, 14 bp, Homo sapiens
aaagtggaaggaaa

SEQ ID NO: 3779441 - DNA, 11 bp, Homo sapiens
aaagtgtatta

SEQ ID NO: 3779442 - DNA, 14 bp, Homo sapiens
aaagtgttttcaga

SEQ ID NO: 3779443 - DNA, 23 bp, Homo sapiens
aaagttccctacttcctgtgact

SEQ ID NO: 3779444 - DNA, 21 bp, Homo sapiens
aaagttctgtgtatttaattg

SEQ ID NO: 3779445 - DNA, 12 bp, Homo sapiens
aaagttgaaatt

SEQ ID NO: 3779446 - DNA, 16 bp, Homo sapiens
aaagtttaaaatgtat

SEQ ID NO: 3779447 - DNA, 22 bp, Homo sapiens
aaagtttccccaccagtgaatg

SEQ ID NO: 3779448 - DNA, 13 bp, Homo sapiens
aaataaaaaagtc

SEQ ID NO: 3779449 - DNA, 18 bp, Homo sapiens
aaataaaaaagtctctat

SEQ ID NO: 3779450 - DNA, 12 bp, Homo sapiens
aaataaaacatt

SEQ ID NO: 3779451 - DNA, 13 bp, Homo sapiens
aaataaaaccttt

SEQ ID NO: 3779452 - DNA, 13 bp, Homo sapiens
aaataaaagcagc

SEQ ID NO: 3779453 - DNA, 14 bp, Homo sapiens
aaataaaataaagc

SEQ ID NO: 3779454 - DNA, 13 bp, Homo sapiens
aaataaaatataa

SEQ ID NO: 3779455 - DNA, 23 bp, Homo sapiens
aaataaacacatagattcacctg

SEQ ID NO: 3779456 - DNA, 15 bp, Homo sapiens
aaataaagcatctca

SEQ ID NO: 3779457 - DNA, 16 bp, Homo sapiens
aaataaagtatatata

SEQ ID NO: 3779458 - DNA, 20 bp, Homo sapiens
aaataaatagctatatccat

SEQ ID NO: 3779459 - DNA, 16 bp, Homo sapiens
aaataaattgaaatat

SEQ ID NO: 3779460 - DNA, 19 bp, Homo sapiens
aaataaatttggttctaat

SEQ ID NO: 3779461 - DNA, 17 bp, Homo sapiens
aaataactagtgttgct

SEQ ID NO: 3779462 - DNA, 15 bp, Homo sapiens
aaataacttcaagca

SEQ ID NO: 3779463 - DNA, 14 bp, Homo sapiens
aaataagagatttg

SEQ ID NO: 3779464 - DNA, 12 bp, Homo sapiens
aaataataaatc

SEQ ID NO: 3779465 - DNA, 21 bp, Homo sapiens
aaataatgtcttgttaatatt

SEQ ID NO: 3779466 - DNA, 17 bp, Homo sapiens
aaataattgatttcaag

SEQ ID NO: 3779467 - DNA, 14 bp, Homo sapiens
aaataattttaaac

SEQ ID NO: 3779468 - DNA, 18 bp, Homo sapiens
aaataattttaaacaaag

SEQ ID NO: 3779469 - DNA, 15 bp, Homo sapiens
aaataattttatgaa

SEQ ID NO: 3779470 - DNA, 13 bp, Homo sapiens
aaatacaataaac

SEQ ID NO: 3779471 - DNA, 14 bp, Homo sapiens
aaatacaataaact

SEQ ID NO: 3779472 - DNA, 15 bp, Homo sapiens
aaatacaataaacta

SEQ ID NO: 3779473 - DNA, 17 bp, Homo sapiens
aaatacagatagatata

SEQ ID NO: 3779474 - DNA, 23 bp, Homo sapiens
aaataccaaaattatttcagaaa

SEQ ID NO: 3779475 - DNA, 17 bp, Homo sapiens
aaataccagtgtggttt

SEQ ID NO: 3779476 - DNA, 17 bp, Homo sapiens
aaatactctaattctaa

SEQ ID NO: 3779477 - DNA, 18 bp, Homo sapiens
aaatactctaattctaac

SEQ ID NO: 3779478 - DNA, 22 bp, Homo sapiens
aaatactctaattctaaccaga

SEQ ID NO: 3779479 - DNA, 22 bp, Homo sapiens
aaatactgtttttaacaactat

SEQ ID NO: 3779480 - DNA, 17 bp, Homo sapiens
aaatacttattcattgt

SEQ ID NO: 3779481 - DNA, 18 bp, Homo sapiens
aaatagaaaacaggaaaa

SEQ ID NO: 3779482 - DNA, 19 bp, Homo sapiens
aaatagacagtatatttat

SEQ ID NO: 3779483 - DNA, 17 bp, Homo sapiens
aaatagagtatatgcac

SEQ ID NO: 3779484 - DNA, 23 bp, Homo sapiens
aaatagccacttaccttcaataa

SEQ ID NO: 3779485 - DNA, 13 bp, Homo sapiens
aaatagtaaaaat

SEQ ID NO: 3779486 - DNA, 19 bp, Homo sapiens
aaatagtggttcttggaaa

SEQ ID NO: 3779487 - DNA, 19 bp, Homo sapiens
aaatataaagcatctaaac

SEQ ID NO: 3779488 - DNA, 14 bp, Homo sapiens
aaatataattgaca

SEQ ID NO: 3779489 - DNA, 13 bp, Homo sapiens
aaatatagaattt

SEQ ID NO: 3779490 - DNA, 12 bp, Homo sapiens
aactcacctgct

SEQ ID NO: 3779491 - DNA, 15 bp, Homo sapiens
aactcaggactccag

SEQ ID NO: 3779492 - DNA, 20 bp, Homo sapiens
aactcaggactccagcccat

SEQ ID NO: 3779493 - DNA, 12 bp, Homo sapiens
aactcatttcta

SEQ ID NO: 3779494 - DNA, 15 bp, Homo sapiens
aactccaccaaccca

SEQ ID NO: 3779495 - DNA, 23 bp, Homo sapiens
aactccaccaacccatcagaagg

SEQ ID NO: 3779496 - DNA, 13 bp, Homo sapiens
aactcccaagaac

SEQ ID NO: 3779497 - DNA, 16 bp, Homo sapiens
aactcctcattgtaaa

SEQ ID NO: 3779498 - DNA, 23 bp, Homo sapiens
aactctatgggtatcaaacagct

SEQ ID NO: 3779499 - DNA, 21 bp, Homo sapiens
aactctgatgtaaatgaagta

SEQ ID NO: 3779500 - DNA, 22 bp, Homo sapiens
aactctgatgtaaatgaagtaa

SEQ ID NO: 3779501 - DNA, 16 bp, Homo sapiens
aactctgtggcattat

SEQ ID NO: 3779502 - DNA, 11 bp, Homo sapiens
aactgaaaaca

SEQ ID NO: 3779503 - DNA, 19 bp, Homo sapiens
aactgaaaacaagccatga

SEQ ID NO: 3779504 - DNA, 18 bp, Homo sapiens
aactgacaaatcaagttt

SEQ ID NO: 3779505 - DNA, 23 bp, Homo sapiens
aactgacacatgctgaacatcac

SEQ ID NO: 3779506 - DNA, 15 bp, Homo sapiens
aactgaccctccctt

SEQ ID NO: 3779507 - DNA, 13 bp, Homo sapiens
aactgaggaattt

SEQ ID NO: 3779508 - DNA, 20 bp, Homo sapiens
aactgaggcagacagcagct

SEQ ID NO: 3779509 - DNA, 16 bp, Homo sapiens
aactgcaagtcacaaa

SEQ ID NO: 3779510 - DNA, 19 bp, Homo sapiens
aactgcaagtcacaaagga

SEQ ID NO: 3779511 - DNA, 14 bp, Homo sapiens
aactgcatgtataa

SEQ ID NO: 3779512 - DNA, 18 bp, Homo sapiens
aactgcatgtataaatga

SEQ ID NO: 3779513 - DNA, 16 bp, Homo sapiens
aactgcattggctttg

SEQ ID NO: 3779514 - DNA, 14 bp, Homo sapiens
aactgcccaaagca

SEQ ID NO: 3779515 - DNA, 14 bp, Homo sapiens
aactgccctgtcta

SEQ ID NO: 3779516 - DNA, 20 bp, Homo sapiens
aactgctgactgttttctct

SEQ ID NO: 3779517 - DNA, 20 bp, Homo sapiens
aactgctttatcccacggaa

SEQ ID NO: 3779518 - DNA, 16 bp, Homo sapiens
aactggaagttattta

SEQ ID NO: 3779519 - DNA, 13 bp, Homo sapiens
aactggactcagg

SEQ ID NO: 3779520 - DNA, 15 bp, Homo sapiens
aactggactcaggat

SEQ ID NO: 3779521 - DNA, 21 bp, Homo sapiens
aactggactcaggatgcccag

SEQ ID NO: 3779522 - DNA, 12 bp, Homo sapiens
aactggagcccc

SEQ ID NO: 3779523 - DNA, 21 bp, Homo sapiens
aactggtttgttgcagccaaa

SEQ ID NO: 3779524 - DNA, 19 bp, Homo sapiens
aactgtagaaatgatgatg

SEQ ID NO: 3779525 - DNA, 21 bp, Homo sapiens
aactgtcaaagaatcaatcca

SEQ ID NO: 3779526 - DNA, 17 bp, Homo sapiens
aactgtcctctttcaga

SEQ ID NO: 3779527 - DNA, 19 bp, Homo sapiens
aactgtcctctttcagaaa

SEQ ID NO: 3779528 - DNA, 21 bp, Homo sapiens
aactgtcctctttcagaaaac

SEQ ID NO: 3779529 - DNA, 13 bp, Homo sapiens
aactgtgtaactg

SEQ ID NO: 3779530 - DNA, 15 bp, Homo sapiens
aactgttgccagaga

SEQ ID NO: 3779531 - DNA, 13 bp, Homo sapiens
aacttaaaatatt

SEQ ID NO: 3779532 - DNA, 16 bp, Homo sapiens
aacttaaaatatttta

SEQ ID NO: 3779533 - DNA, 19 bp, Homo sapiens
aacttaaataaatgtcatt

SEQ ID NO: 3779534 - DNA, 13 bp, Homo sapiens
aacttaaataata

SEQ ID NO: 3779535 - DNA, 22 bp, Homo sapiens
aacttaaccgcatcagaagcct

SEQ ID NO: 3779536 - DNA, 15 bp, Homo sapiens
aacttaagaaacact

SEQ ID NO: 3779537 - DNA, 19 bp, Homo sapiens
aacttacctgggcattctt

SEQ ID NO: 3779538 - DNA, 19 bp, Homo sapiens
aacttatcctaaaacaaat

SEQ ID NO: 3779539 - DNA, 12 bp, Homo sapiens
aacttcatttga

SEQ ID NO: 3779540 - DNA, 14 bp, Homo sapiens
aacttggaaatagt

SEQ ID NO: 3779541 - DNA, 15 bp, Homo sapiens
aacttgtaaatgctg

SEQ ID NO: 3779542 - DNA, 12 bp, Homo sapiens
aactttaatatg

SEQ ID NO: 3779543 - DNA, 19 bp, Homo sapiens
aactttaatatgtatttta

SEQ ID NO: 3779544 - DNA, 16 bp, Homo sapiens
aacttttataaattaa

SEQ ID NO: 3779545 - DNA, 17 bp, Homo sapiens
aacttttataaattaaa

SEQ ID NO: 3779546 - DNA, 11 bp, Homo sapiens
aacttttgtaa

SEQ ID NO: 3779547 - DNA, 14 bp, Homo sapiens
aacttttttcttta

SEQ ID NO: 3779548 - DNA, 18 bp, Homo sapiens
aagaaaaaaaataacaca

SEQ ID NO: 3779549 - DNA, 19 bp, Homo sapiens
aagaaaaaatattttccct

SEQ ID NO: 3779550 - DNA, 13 bp, Homo sapiens
aagaaaaagaaaa

SEQ ID NO: 3779551 - DNA, 11 bp, Homo sapiens
aagaaaacact

SEQ ID NO: 3779552 - DNA, 20 bp, Homo sapiens
aagaaaagaatccctgttca

SEQ ID NO: 3779553 - DNA, 22 bp, Homo sapiens
aagaaaaggttcttactgcttg

SEQ ID NO: 3779554 - DNA, 14 bp, Homo sapiens
aagaaaataaaatt

SEQ ID NO: 3779555 - DNA, 15 bp, Homo sapiens
aagaaaataaaatta

SEQ ID NO: 3779556 - DNA, 13 bp, Homo sapiens
aagaaacaaaccc

SEQ ID NO: 3779557 - DNA, 13 bp, Homo sapiens
aagaaagaaggaa

SEQ ID NO: 3779558 - DNA, 22 bp, Homo sapiens
aagaaagactatctaaatgttg

SEQ ID NO: 3779559 - DNA, 21 bp, Homo sapiens
aagaaaggggcaggagctcag

SEQ ID NO: 3779560 - DNA, 14 bp, Homo sapiens
aagaaatgaaattt

SEQ ID NO: 3779561 - DNA, 14 bp, Homo sapiens
aagaaatgcacaat

SEQ ID NO: 3779562 - DNA, 15 bp, Homo sapiens
aagaaattccctgga

SEQ ID NO: 3779563 - DNA, 21 bp, Homo sapiens
aagaacacaaagcggggggag

SEQ ID NO: 3779564 - DNA, 19 bp, Homo sapiens
aagaacaccctatattttg

SEQ ID NO: 3779565 - DNA, 21 bp, Homo sapiens
aagaacaccctatattttgca

SEQ ID NO: 3779566 - DNA, 12 bp, Homo sapiens
aagaacatagaa

SEQ ID NO: 3779567 - DNA, 16 bp, Homo sapiens
aagaacatagaactct

SEQ ID NO: 3779568 - DNA, 18 bp, Homo sapiens
aagaactgcatggaccta

SEQ ID NO: 3779569 - DNA, 13 bp, Homo sapiens
aagaactggaaac

SEQ ID NO: 3779570 - DNA, 17 bp, Homo sapiens
aagaagatgacttccca

SEQ ID NO: 3779571 - DNA, 19 bp, Homo sapiens
aagaaggaaatgaatttct

SEQ ID NO: 3779572 - DNA, 12 bp, Homo sapiens
aagaaggctggg

SEQ ID NO: 3779573 - DNA, 24 bp, Homo sapiens
aagaagggtccttccctctcccca

SEQ ID NO: 3779574 - DNA, 23 bp, Homo sapiens
aagaaggtttcagaaagaagtgg

SEQ ID NO: 3779575 - DNA, 16 bp, Homo sapiens
aagaagtgtccgagaa

SEQ ID NO: 3779576 - DNA, 19 bp, Homo sapiens
aagaagtgtccgagaacta

SEQ ID NO: 3779577 - DNA, 21 bp, Homo sapiens
aagaataatatgctgccaaat

SEQ ID NO: 3779578 - DNA, 22 bp, Homo sapiens
aagaatcattatttattaaatt

SEQ ID NO: 3779579 - DNA, 23 bp, Homo sapiens
aagaatcattgtaaacattagtt

SEQ ID NO: 3779580 - DNA, 15 bp, Homo sapiens
aagaatgctggtttt

SEQ ID NO: 3779581 - DNA, 18 bp, Homo sapiens
aagaatgctggttttcct

SEQ ID NO: 3779582 - DNA, 18 bp, Homo sapiens
aagaattgaacccaggag

SEQ ID NO: 3779583 - DNA, 19 bp, Homo sapiens
aagaattgaacccaggagg

SEQ ID NO: 3779584 - DNA, 23 bp, Homo sapiens
aagaatttcttggtaagaagccg

SEQ ID NO: 3779585 - DNA, 13 bp, Homo sapiens
aagaatttttaaa

SEQ ID NO: 3779586 - DNA, 18 bp, Homo sapiens
aagacaaattctgtttct

SEQ ID NO: 3779587 - DNA, 21 bp, Homo sapiens
aagacaacattaaaacaatat

SEQ ID NO: 3779588 - DNA, 21 bp, Homo sapiens
aagacagagacgcaggaatgg

SEQ ID NO: 3779589 - DNA, 22 bp, Homo sapiens
aagacagagccccaccctcaga

SEQ ID NO: 3779590 - DNA, 15 bp, Homo sapiens
aagacagagctggga

SEQ ID NO: 3779591 - DNA, 17 bp, Homo sapiens
aagacagatgccccaga

SEQ ID NO: 3779592 - DNA, 18 bp, Homo sapiens
aagacatgaatgcacact

SEQ ID NO: 3779593 - DNA, 19 bp, Homo sapiens
aagaccaaaatgacaatga

SEQ ID NO: 3779594 - DNA, 12 bp, Homo sapiens
aagaccagtcca

SEQ ID NO: 3779595 - DNA, 20 bp, Homo sapiens
aagacccttttgggtttctg

SEQ ID NO: 3779596 - DNA, 18 bp, Homo sapiens
aagaccggaagctcctgg

SEQ ID NO: 3779597 - DNA, 19 bp, Homo sapiens
aagaccggaagctcctggt

SEQ ID NO: 3779598 - DNA, 21 bp, Homo sapiens
aagaccttctccaaatgagat

SEQ ID NO: 3779599 - DNA, 20 bp, Homo sapiens
aagactagaggcttgcataa

SEQ ID NO: 3779600 - DNA, 17 bp, Homo sapiens
aagactatctaaatgtt

SEQ ID NO: 3779601 - DNA, 12 bp, Homo sapiens
aagactgtggct

SEQ ID NO: 3779602 - DNA, 15 bp, Homo sapiens
aagactgtggctgct

SEQ ID NO: 3779603 - DNA, 20 bp, Homo sapiens
aagtggaccttgagaccaca

SEQ ID NO: 3779604 - DNA, 17 bp, Homo sapiens
aagtgtaacagctgagg

SEQ ID NO: 3779605 - DNA, 19 bp, Homo sapiens
aagtgtaagaaacacactg

SEQ ID NO: 3779606 - DNA, 18 bp, Homo sapiens
aagtgtatgcacgtgtgc

SEQ ID NO: 3779607 - DNA, 21 bp, Homo sapiens
aagtgtattttataaaattaa

SEQ ID NO: 3779608 - DNA, 11 bp, Homo sapiens
aagtgtgagta

SEQ ID NO: 3779609 - DNA, 19 bp, Homo sapiens
aagtgtgagtaagagctgg

SEQ ID NO: 3779610 - DNA, 13 bp, Homo sapiens
aagtgtggtagag

SEQ ID NO: 3779611 - DNA, 13 bp, Homo sapiens
aagtgtgtgtgcg

SEQ ID NO: 3779612 - DNA, 17 bp, Homo sapiens
aagtgtgtttccttcag

SEQ ID NO: 3779613 - DNA, 23 bp, Homo sapiens
aagtgttggctaatgaagggaaa

SEQ ID NO: 3779614 - DNA, 14 bp, Homo sapiens
aagtgttttcagag

SEQ ID NO: 3779615 - DNA, 18 bp, Homo sapiens
aagttaaaaaaaataata

SEQ ID NO: 3779616 - DNA, 12 bp, Homo sapiens
aagttaaataaa

SEQ ID NO: 3779617 - DNA, 14 bp, Homo sapiens
aagttaaattttat

SEQ ID NO: 3779618 - DNA, 13 bp, Homo sapiens
aagttaacagaga

SEQ ID NO: 3779619 - DNA, 11 bp, Homo sapiens
aagttaagaat

SEQ ID NO: 3779620 - DNA, 23 bp, Homo sapiens
aagttacattgctggtcttgtaa

SEQ ID NO: 3779621 - DNA, 18 bp, Homo sapiens
aagttactatcctggctt

SEQ ID NO: 3779622 - DNA, 21 bp, Homo sapiens
aagttatataaagagaaaatt

SEQ ID NO: 3779623 - DNA, 19 bp, Homo sapiens
aagttattaatattttaat

SEQ ID NO: 3779624 - DNA, 18 bp, Homo sapiens
aagttattgacaaactct

SEQ ID NO: 3779625 - DNA, 15 bp, Homo sapiens
aagttatttcttgtt

SEQ ID NO: 3779626 - DNA, 19 bp, Homo sapiens
aagttatttcttgtttgtt

SEQ ID NO: 3779627 - DNA, 20 bp, Homo sapiens
aagttcccccatcagttccc

SEQ ID NO: 3779628 - DNA, 20 bp, Homo sapiens
aagttccctacttcctgtga

SEQ ID NO: 3779629 - DNA, 20 bp, Homo sapiens
aagttccttatgtatattta

SEQ ID NO: 3779630 - DNA, 15 bp, Homo sapiens
aagttctatttaagt

SEQ ID NO: 3779631 - DNA, 17 bp, Homo sapiens
aagttctatttaagtgt

SEQ ID NO: 3779632 - DNA, 17 bp, Homo sapiens
aagttctgtgtatttaa

SEQ ID NO: 3779633 - DNA, 15 bp, Homo sapiens
aagttcttagatatc

SEQ ID NO: 3779634 - DNA, 14 bp, Homo sapiens
aagttgaggcattt

SEQ ID NO: 3779635 - DNA, 16 bp, Homo sapiens
aagttgaggcatttgg

SEQ ID NO: 3779636 - DNA, 14 bp, Homo sapiens
aagttgcgacggag

SEQ ID NO: 3779637 - DNA, 20 bp, Homo sapiens
aagttgcgacggagagaaaa

SEQ ID NO: 3779638 - DNA, 22 bp, Homo sapiens
aagttgcgacggagagaaaaaa

SEQ ID NO: 3779639 - DNA, 11 bp, Homo sapiens
aagttggcttc

SEQ ID NO: 3779640 - DNA, 16 bp, Homo sapiens
aagttggcttctgttt

SEQ ID NO: 3779641 - DNA, 16 bp, Homo sapiens
aagttgggagcctgaa

SEQ ID NO: 3779642 - DNA, 16 bp, Homo sapiens
aagttgggcaatataa

SEQ ID NO: 3779643 - DNA, 14 bp, Homo sapiens
aagtttaaaatgta

SEQ ID NO: 3779644 - DNA, 17 bp, Homo sapiens
aagtttagattttaatc

SEQ ID NO: 3779645 - DNA, 20 bp, Homo sapiens
aagtttcactgacttagaac

SEQ ID NO: 3779646 - DNA, 12 bp, Homo sapiens
aagtttcattta

SEQ ID NO: 3779647 - DNA, 13 bp, Homo sapiens
aagtttcatttat

SEQ ID NO: 3779648 - DNA, 20 bp, Homo sapiens
aagtttccaagcaaatgtta

SEQ ID NO: 3779649 - DNA, 20 bp, Homo sapiens
aagtttgagatcagcctggg

SEQ ID NO: 3779650 - DNA, 21 bp, Homo sapiens
aagtttgtgttctgtttgtta

SEQ ID NO: 3779651 - DNA, 23 bp, Homo sapiens
aagttttcagaacctcttcccca

SEQ ID NO: 3779652 - DNA, 15 bp, Homo sapiens
aataaaaaagtctct

SEQ ID NO: 3779653 - DNA, 12 bp, Homo sapiens
aataaaaccttt

SEQ ID NO: 3779654 - DNA, 15 bp, Homo sapiens
aataaaacctttcaa

SEQ ID NO: 3779655 - DNA, 12 bp, Homo sapiens
aataaaatataa

SEQ ID NO: 3779656 - DNA, 14 bp, Homo sapiens
aataaaatatcatt

SEQ ID NO: 3779657 - DNA, 15 bp, Homo sapiens
aataaaatatcattc

SEQ ID NO: 3779658 - DNA, 16 bp, Homo sapiens
aataaaatatcattca

SEQ ID NO: 3779659 - DNA, 19 bp, Homo sapiens
aataaaatatcattcagca

SEQ ID NO: 3779660 - DNA, 11 bp, Homo sapiens
aataaaatcat

SEQ ID NO: 3779661 - DNA, 16 bp, Homo sapiens
aataaaatcttgaaaa

SEQ ID NO: 3779662 - DNA, 21 bp, Homo sapiens
aataaacagcttcatgccttt

SEQ ID NO: 3779663 - DNA, 22 bp, Homo sapiens
aataaactgtcctctttcagaa

SEQ ID NO: 3779664 - DNA, 15 bp, Homo sapiens
aataaagtatataat

SEQ ID NO: 3779665 - DNA, 16 bp, Homo sapiens
aataaagtatctacat

SEQ ID NO: 3779666 - DNA, 19 bp, Homo sapiens
aataaagtattccacctta

SEQ ID NO: 3779667 - DNA, 15 bp, Homo sapiens
aataaagtgttttca

SEQ ID NO: 3779668 - DNA, 19 bp, Homo sapiens
aataaagtgttttcagagc

SEQ ID NO: 3779669 - DNA, 19 bp, Homo sapiens
aataaagttctgagtgttt

SEQ ID NO: 3779670 - DNA, 13 bp, Homo sapiens
aataaataacagt

SEQ ID NO: 3779671 - DNA, 21 bp, Homo sapiens
aataaatgtatcttattcaca

SEQ ID NO: 3779672 - DNA, 21 bp, Homo sapiens
aataaattaaataaaataacc

SEQ ID NO: 3779673 - DNA, 20 bp, Homo sapiens
aataaattgctccttgacat

SEQ ID NO: 3779674 - DNA, 21 bp, Homo sapiens
aataaatttggttctaataga

SEQ ID NO: 3779675 - DNA, 19 bp, Homo sapiens
aataacaatgtgctctcgg

SEQ ID NO: 3779676 - DNA, 12 bp, Homo sapiens
aataacatgtaa

SEQ ID NO: 3779677 - DNA, 17 bp, Homo sapiens
aataaccccaaaatgaa

SEQ ID NO: 3779678 - DNA, 15 bp, Homo sapiens
aataactaaaaggta

SEQ ID NO: 3779679 - DNA, 13 bp, Homo sapiens
aataactactgtg

SEQ ID NO: 3779680 - DNA, 16 bp, Homo sapiens
aataactactgtgttc

SEQ ID NO: 3779681 - DNA, 17 bp, Homo sapiens
aataactactgtgttcc

SEQ ID NO: 3779682 - DNA, 19 bp, Homo sapiens
aataactactgtgttcctg

SEQ ID NO: 3779683 - DNA, 17 bp, Homo sapiens
aataagcatcaaactct

SEQ ID NO: 3779684 - DNA, 22 bp, Homo sapiens
aataagttaactattttatttt

SEQ ID NO: 3779685 - DNA, 11 bp, Homo sapiens
aataataaatc

SEQ ID NO: 3779686 - DNA, 14 bp, Homo sapiens
aataataaattgca

SEQ ID NO: 3779687 - DNA, 11 bp, Homo sapiens
aataatatgca

SEQ ID NO: 3779688 - DNA, 13 bp, Homo sapiens
aataatcggccca

SEQ ID NO: 3779689 - DNA, 15 bp, Homo sapiens
aataatcttgtttct

SEQ ID NO: 3779690 - DNA, 22 bp, Homo sapiens
aataatgaatggactcaaactg

SEQ ID NO: 3779691 - DNA, 15 bp, Homo sapiens
aataatgtcttgtta

SEQ ID NO: 3779692 - DNA, 18 bp, Homo sapiens
aataatgtcttgttaata

SEQ ID NO: 3779693 - DNA, 15 bp, Homo sapiens
aataatgtgaatcat

SEQ ID NO: 3779694 - DNA, 18 bp, Homo sapiens
aataattatccagagttt

SEQ ID NO: 3779695 - DNA, 15 bp, Homo sapiens
aataattctttgatt

SEQ ID NO: 3779696 - DNA, 20 bp, Homo sapiens
aataattgatttcaagacct

SEQ ID NO: 3779697 - DNA, 22 bp, Homo sapiens
aataatttcccaattaggaagt

SEQ ID NO: 3779698 - DNA, 16 bp, Homo sapiens
aataattttaaacaaa

SEQ ID NO: 3779699 - DNA, 23 bp, Homo sapiens
aataattttatgaactgcatgta

SEQ ID NO: 3779700 - DNA, 15 bp, Homo sapiens
aatacaagatacttt

SEQ ID NO: 3779701 - DNA, 12 bp, Homo sapiens
aatacaataaac

SEQ ID NO: 3779702 - DNA, 23 bp, Homo sapiens
aatacacatagcatgtaatggta

SEQ ID NO: 3779703 - DNA, 24 bp, Homo sapiens
aatacagccaaagataatctctca

SEQ ID NO: 3779704 - DNA, 15 bp, Homo sapiens
aatacagtacaggca

SEQ ID NO: 3779705 - DNA, 16 bp, Homo sapiens
aatacagtattctgta

SEQ ID NO: 3779706 - DNA, 15 bp, Homo sapiens
aatacattaaagcag

SEQ ID NO: 3779707 - DNA, 15 bp, Homo sapiens
aatacattctgcttt

SEQ ID NO: 3779708 - DNA, 12 bp, Homo sapiens
aatacattttat

SEQ ID NO: 3779709 - DNA, 19 bp, Homo sapiens
aatacctctttgaaagaag

SEQ ID NO: 3779710 - DNA, 15 bp, Homo sapiens
aatactctaattcta

SEQ ID NO: 3779711 - DNA, 23 bp, Homo sapiens
aatactcttaggaagagaaacca

SEQ ID NO: 3779712 - DNA, 18 bp, Homo sapiens
aatactgatggtgcattt

SEQ ID NO: 3779713 - DNA, 17 bp, Homo sapiens
aatagaaaacaggaaaa

SEQ ID NO: 3779714 - DNA, 22 bp, Homo sapiens
aatagaacattgattgctgtgt

SEQ ID NO: 3779715 - DNA, 17 bp, Homo sapiens
aatagaatataattatc

SEQ ID NO: 3779716 - DNA, 20 bp, Homo sapiens
aatagaatataattatcgga

SEQ ID NO: 3779717 - DNA, 16 bp, Homo sapiens
aatttatgagtttttg

SEQ ID NO: 3779718 - DNA, 19 bp, Homo sapiens
aatttatgagtttttgata

SEQ ID NO: 3779719 - DNA, 14 bp, Homo sapiens
aatttattgcacaa

SEQ ID NO: 3779720 - DNA, 20 bp, Homo sapiens
aatttatttatactatttag

SEQ ID NO: 3779721 - DNA, 17 bp, Homo sapiens
aatttatttattaagat

SEQ ID NO: 3779722 - DNA, 22 bp, Homo sapiens
aatttatttattaagatggatt

SEQ ID NO: 3779723 - DNA, 20 bp, Homo sapiens
aatttattttattttagcag

SEQ ID NO: 3779724 - DNA, 20 bp, Homo sapiens
aatttcaggttttgtaaaga

SEQ ID NO: 3779725 - DNA, 15 bp, Homo sapiens
aatttccagtacctt

SEQ ID NO: 3779726 - DNA, 17 bp, Homo sapiens
aatttccagtacctttg

SEQ ID NO: 3779727 - DNA, 20 bp, Homo sapiens
aatttccagtacctttgtca

SEQ ID NO: 3779728 - DNA, 19 bp, Homo sapiens
aatttcccaattaggaagt

SEQ ID NO: 3779729 - DNA, 18 bp, Homo sapiens
aatttcgccgttgaagag

SEQ ID NO: 3779730 - DNA, 13 bp, Homo sapiens
aatttcttcctat

SEQ ID NO: 3779731 - DNA, 17 bp, Homo sapiens
aatttcttggtaagaag

SEQ ID NO: 3779732 - DNA, 14 bp, Homo sapiens
aatttgaaatttag

SEQ ID NO: 3779733 - DNA, 15 bp, Homo sapiens
aatttgaatgaaaaa

SEQ ID NO: 3779734 - DNA, 13 bp, Homo sapiens
aatttgaggacaa

SEQ ID NO: 3779735 - DNA, 14 bp, Homo sapiens
aatttgaggacaac

SEQ ID NO: 3779736 - DNA, 24 bp, Homo sapiens
aatttgagtaatctgatcgttctt

SEQ ID NO: 3779737 - DNA, 21 bp, Homo sapiens
aatttgatagtattgtgcata

SEQ ID NO: 3779738 - DNA, 16 bp, Homo sapiens
aatttgccaaaataat

SEQ ID NO: 3779739 - DNA, 18 bp, Homo sapiens
aatttgccaaaataatgt

SEQ ID NO: 3779740 - DNA, 18 bp, Homo sapiens
aatttggcctgcactaat

SEQ ID NO: 3779741 - DNA, 22 bp, Homo sapiens
aatttggttctaatagaactca

SEQ ID NO: 3779742 - DNA, 17 bp, Homo sapiens
aatttggttctaggccg

SEQ ID NO: 3779743 - DNA, 15 bp, Homo sapiens
aatttgtataaaatg

SEQ ID NO: 3779744 - DNA, 14 bp, Homo sapiens
aatttgtcattttg

SEQ ID NO: 3779745 - DNA, 17 bp, Homo sapiens
aatttgtcattttgaag

SEQ ID NO: 3779746 - DNA, 22 bp, Homo sapiens
aatttgtcattttgaagctaat

SEQ ID NO: 3779747 - DNA, 13 bp, Homo sapiens
aatttgtgtaata

SEQ ID NO: 3779748 - DNA, 19 bp, Homo sapiens
aatttgtgtaataaagtgt

SEQ ID NO: 3779749 - DNA, 14 bp, Homo sapiens
aattttaaacaaag

SEQ ID NO: 3779750 - DNA, 17 bp, Homo sapiens
aattttaaataaaagtg

SEQ ID NO: 3779751 - DNA, 19 bp, Homo sapiens
aattttaagtgctttgtaa

SEQ ID NO: 3779752 - DNA, 22 bp, Homo sapiens
aattttaagtgctttgtaatgg

SEQ ID NO: 3779753 - DNA, 20 bp, Homo sapiens
aattttatgaactgcatgta

SEQ ID NO: 3779754 - DNA, 12 bp, Homo sapiens
aattttatgaat

SEQ ID NO: 3779755 - DNA, 15 bp, Homo sapiens
aattttcaagtaatt

SEQ ID NO: 3779756 - DNA, 19 bp, Homo sapiens
aattttcaagtaattgtga

SEQ ID NO: 3779757 - DNA, 17 bp, Homo sapiens
aattttcagaccccagc

SEQ ID NO: 3779758 - DNA, 20 bp, Homo sapiens
aattttcagtataatttaac

SEQ ID NO: 3779759 - DNA, 13 bp, Homo sapiens
aattttcttcatg

SEQ ID NO: 3779760 - DNA, 19 bp, Homo sapiens
aattttcttcatgcaatga

SEQ ID NO: 3779761 - DNA, 22 bp, Homo sapiens
aattttcttcatgcaatgacat

SEQ ID NO: 3779762 - DNA, 12 bp, Homo sapiens
aattttcttgat

SEQ ID NO: 3779763 - DNA, 19 bp, Homo sapiens
aattttcttgatgactgga

SEQ ID NO: 3779764 - DNA, 23 bp, Homo sapiens
aattttctttaaccagtctgaag

SEQ ID NO: 3779765 - DNA, 17 bp, Homo sapiens
aattttggccaaagtgt

SEQ ID NO: 3779766 - DNA, 22 bp, Homo sapiens
aattttggccaaagtgttaatc

SEQ ID NO: 3779767 - DNA, 13 bp, Homo sapiens
aattttgtaattt

SEQ ID NO: 3779768 - DNA, 17 bp, Homo sapiens
aattttgtaattttctt

SEQ ID NO: 3779769 - DNA, 13 bp, Homo sapiens
aattttgtacaaa

SEQ ID NO: 3779770 - DNA, 16 bp, Homo sapiens
aattttgtgcccccat

SEQ ID NO: 3779771 - DNA, 13 bp, Homo sapiens
aattttgttgctg

SEQ ID NO: 3779772 - DNA, 14 bp, Homo sapiens
aatttttacagaat

SEQ ID NO: 3779773 - DNA, 18 bp, Homo sapiens
aatttttattaaattatg

SEQ ID NO: 3779774 - DNA, 19 bp, Homo sapiens
aatttttattatgcataac

SEQ ID NO: 3779775 - DNA, 15 bp, Homo sapiens
aatttttcagatgct

SEQ ID NO: 3779776 - DNA, 20 bp, Homo sapiens
aatttttcattgatatgaaa

SEQ ID NO: 3779777 - DNA, 20 bp, Homo sapiens
aatttttctctaactcagaa

SEQ ID NO: 3779778 - DNA, 15 bp, Homo sapiens
aattttttaaaaagc

SEQ ID NO: 3779779 - DNA, 23 bp, Homo sapiens
aattttttattcttgtgaatatg

SEQ ID NO: 3779780 - DNA, 17 bp, Homo sapiens
aatttttttgagacaga

SEQ ID NO: 3779781 - DNA, 14 bp, Homo sapiens
acaaaaaacaatat

SEQ ID NO: 3779782 - DNA, 17 bp, Homo sapiens
acaaaaaacaatattta

SEQ ID NO: 3779783 - DNA, 18 bp, Homo sapiens
acaaaaaacaatatttat

SEQ ID NO: 3779784 - DNA, 15 bp, Homo sapiens
acaaaaacagcctca

SEQ ID NO: 3779785 - DNA, 20 bp, Homo sapiens
acaaaaatactctaattcta

SEQ ID NO: 3779786 - DNA, 11 bp, Homo sapiens
acaaaaattat

SEQ ID NO: 3779787 - DNA, 12 bp, Homo sapiens
acaaaaattatc

SEQ ID NO: 3779788 - DNA, 14 bp, Homo sapiens
acaaaacatttttg

SEQ ID NO: 3779789 - DNA, 22 bp, Homo sapiens
acaaaatataaagcatctaaac

SEQ ID NO: 3779790 - DNA, 15 bp, Homo sapiens
acaaaatggaattca

SEQ ID NO: 3779791 - DNA, 14 bp, Homo sapiens
acaaacaaacaagc

SEQ ID NO: 3779792 - DNA, 21 bp, Homo sapiens
acaaacaaccccccatcacaa

SEQ ID NO: 3779793 - DNA, 18 bp, Homo sapiens
acaaacaattaactgagc

SEQ ID NO: 3779794 - DNA, 15 bp, Homo sapiens
acaaacacctcccag

SEQ ID NO: 3779795 - DNA, 19 bp, Homo sapiens
acaaacatatttgttaaat

SEQ ID NO: 3779796 - DNA, 19 bp, Homo sapiens
acaaacatgtggttaatgc

SEQ ID NO: 3779797 - DNA, 18 bp, Homo sapiens
acaaagaagacaacatta

SEQ ID NO: 3779798 - DNA, 22 bp, Homo sapiens
acaaagatgtttgtcagatatg

SEQ ID NO: 3779799 - DNA, 21 bp, Homo sapiens
acaaagcagaatagtattttt

SEQ ID NO: 3779800 - DNA, 17 bp, Homo sapiens
acaaagccaacagtcaa

SEQ ID NO: 3779801 - DNA, 11 bp, Homo sapiens
acaaagccaga

SEQ ID NO: 3779802 - DNA, 16 bp, Homo sapiens
acaaagccagaagctg

SEQ ID NO: 3779803 - DNA, 17 bp, Homo sapiens
acaaagctgctaaatct

SEQ ID NO: 3779804 - DNA, 19 bp, Homo sapiens
acaaaggtataattttatg

SEQ ID NO: 3779805 - DNA, 14 bp, Homo sapiens
acaaagtctccagc

SEQ ID NO: 3779806 - DNA, 15 bp, Homo sapiens
acaaagtggaaggaa

SEQ ID NO: 3779807 - DNA, 14 bp, Homo sapiens
acaaagtgtattca

SEQ ID NO: 3779808 - DNA, 23 bp, Homo sapiens
acaaagtgtattttataaaatta

SEQ ID NO: 3779809 - DNA, 16 bp, Homo sapiens
acaaataataagcaaa

SEQ ID NO: 3779810 - DNA, 16 bp, Homo sapiens
acaaatacttattcat

SEQ ID NO: 3779811 - DNA, 21 bp, Homo sapiens
acaaatacttattcattgtgg

SEQ ID NO: 3779812 - DNA, 12 bp, Homo sapiens
acaaatatgcaa

SEQ ID NO: 3779813 - DNA, 12 bp, Homo sapiens
acaaatatttat

SEQ ID NO: 3779814 - DNA, 15 bp, Homo sapiens
acaaatcaagtttcc

SEQ ID NO: 3779815 - DNA, 19 bp, Homo sapiens
acaaatcaagtttccaagc

SEQ ID NO: 3779816 - DNA, 19 bp, Homo sapiens
acaaatctaagggaaaaag

SEQ ID NO: 3779817 - DNA, 20 bp, Homo sapiens
acaaattaggttttgtacaa

SEQ ID NO: 3779818 - DNA, 16 bp, Homo sapiens
acaaattggagcaggg

SEQ ID NO: 3779819 - DNA, 15 bp, Homo sapiens
acaaatttaaaacaa

SEQ ID NO: 3779820 - DNA, 10 bp, Homo sapiens
acaacaaaaa

SEQ ID NO: 3779821 - DNA, 14 bp, Homo sapiens
acaacaaaaaataa

SEQ ID NO: 3779822 - DNA, 17 bp, Homo sapiens
acaacaaaaagcttccc

SEQ ID NO: 3779823 - DNA, 11 bp, Homo sapiens
acaacaaaaat

SEQ ID NO: 3779824 - DNA, 15 bp, Homo sapiens
acaacaaaaatttga

SEQ ID NO: 3779825 - DNA, 11 bp, Homo sapiens
acaacagaagt

SEQ ID NO: 3779826 - DNA, 17 bp, Homo sapiens
acaaccactcattcaaa

SEQ ID NO: 3779827 - DNA, 11 bp, Homo sapiens
acaacccatct

SEQ ID NO: 3779828 - DNA, 17 bp, Homo sapiens
acaaccctgttttatac

SEQ ID NO: 3779829 - DNA, 18 bp, Homo sapiens
acaaccctgttttatact

SEQ ID NO: 3779830 - DNA, 19 bp, Homo sapiens
acaaccgatgctccagcca

SEQ ID NO: 3779831 - DNA, 21 bp, Homo sapiens
acatagtgatggttcccctgt

SEQ ID NO: 3779832 - DNA, 23 bp, Homo sapiens
acatagtgtaggctttacttagc

SEQ ID NO: 3779833 - DNA, 18 bp, Homo sapiens
acatatgaaatttaatat

SEQ ID NO: 3779834 - DNA, 14 bp, Homo sapiens
acatattatgtctt

SEQ ID NO: 3779835 - DNA, 19 bp, Homo sapiens
acatatttgttaaatattt

SEQ ID NO: 3779836 - DNA, 18 bp, Homo sapiens
acatcaacatcttggtca

SEQ ID NO: 3779837 - DNA, 16 bp, Homo sapiens
acatcaatgttcattg

SEQ ID NO: 3779838 - DNA, 18 bp, Homo sapiens
acatcaatgttcattgta

SEQ ID NO: 3779839 - DNA, 13 bp, Homo sapiens
acatcacacacac

SEQ ID NO: 3779840 - DNA, 21 bp, Homo sapiens
acatcagacctgtcttccaag

SEQ ID NO: 3779841 - DNA, 20 bp, Homo sapiens
acatcagtggcatggctcca

SEQ ID NO: 3779842 - DNA, 14 bp, Homo sapiens
acatccaaggagaa

SEQ ID NO: 3779843 - DNA, 18 bp, Homo sapiens
acatcccagcctgtggtt

SEQ ID NO: 3779844 - DNA, 14 bp, Homo sapiens
acatccccaccctt

SEQ ID NO: 3779845 - DNA, 16 bp, Homo sapiens
acatccccgctggctg

SEQ ID NO: 3779846 - DNA, 15 bp, Homo sapiens
acatccctgccagct

SEQ ID NO: 3779847 - DNA, 14 bp, Homo sapiens
acatcctccgtcca

SEQ ID NO: 3779848 - DNA, 20 bp, Homo sapiens
acatccttgtggcacatttt

SEQ ID NO: 3779849 - DNA, 21 bp, Homo sapiens
acatctcctccatactcagga

SEQ ID NO: 3779850 - DNA, 16 bp, Homo sapiens
acatctgttttaaatt

SEQ ID NO: 3779851 - DNA, 17 bp, Homo sapiens
acatctgttttaaattt

SEQ ID NO: 3779852 - DNA, 13 bp, Homo sapiens
acatcttcaaagc

SEQ ID NO: 3779853 - DNA, 16 bp, Homo sapiens
acatcttcagcaaata

SEQ ID NO: 3779854 - DNA, 11 bp, Homo sapiens
acatcttccac

SEQ ID NO: 3779855 - DNA, 22 bp, Homo sapiens
acatcttgctctgctgacagac

SEQ ID NO: 3779856 - DNA, 14 bp, Homo sapiens
acatcttggcaggg

SEQ ID NO: 3779857 - DNA, 19 bp, Homo sapiens
acatcttggtcagatttga

SEQ ID NO: 3779858 - DNA, 14 bp, Homo sapiens
acatctttcacact

SEQ ID NO: 3779859 - DNA, 19 bp, Homo sapiens
acatgaagtgtgtttcctt

SEQ ID NO: 3779860 - DNA, 15 bp, Homo sapiens
acatgacactgaaat

SEQ ID NO: 3779861 - DNA, 23 bp, Homo sapiens
acatgacactgaaatgccttact

SEQ ID NO: 3779862 - DNA, 19 bp, Homo sapiens
acatgacgacaaagctgct

SEQ ID NO: 3779863 - DNA, 13 bp, Homo sapiens
acatgcacgtgtg

SEQ ID NO: 3779864 - DNA, 18 bp, Homo sapiens
acatgcagcccatgccca

SEQ ID NO: 3779865 - DNA, 22 bp, Homo sapiens
acatgcagcccatgcccacctg

SEQ ID NO: 3779866 - DNA, 16 bp, Homo sapiens
acatgcatacatacac

SEQ ID NO: 3779867 - DNA, 17 bp, Homo sapiens
acatgcatttgaggtca

SEQ ID NO: 3779868 - DNA, 21 bp, Homo sapiens
acatgcatttgaggtcaagta

SEQ ID NO: 3779869 - DNA, 16 bp, Homo sapiens
acatgcgggctgggca

SEQ ID NO: 3779870 - DNA, 21 bp, Homo sapiens
acatgctgaacatcacagctt

SEQ ID NO: 3779871 - DNA, 22 bp, Homo sapiens
acatgctggacaggtctgggag

SEQ ID NO: 3779872 - DNA, 17 bp, Homo sapiens
acatggaactcattcct

SEQ ID NO: 3779873 - DNA, 12 bp, Homo sapiens
acatggacccgg

SEQ ID NO: 3779874 - DNA, 13 bp, Homo sapiens
acatggacccgga

SEQ ID NO: 3779875 - DNA, 14 bp, Homo sapiens
acatggccagtgtg

SEQ ID NO: 3779876 - DNA, 14 bp, Homo sapiens
acatggcttagttt

SEQ ID NO: 3779877 - DNA, 20 bp, Homo sapiens
acatggggagtgtttcatgg

SEQ ID NO: 3779878 - DNA, 17 bp, Homo sapiens
acatggggttggctggg

SEQ ID NO: 3779879 - DNA, 21 bp, Homo sapiens
acatggggttggctgggccca

SEQ ID NO: 3779880 - DNA, 20 bp, Homo sapiens
acatggttgtgacctgagga

SEQ ID NO: 3779881 - DNA, 17 bp, Homo sapiens
acatgtaataaaaagta

SEQ ID NO: 3779882 - DNA, 19 bp, Homo sapiens
acatgtaataaaaagtata

SEQ ID NO: 3779883 - DNA, 15 bp, Homo sapiens
acatgtccctacacc

SEQ ID NO: 3779884 - DNA, 19 bp, Homo sapiens
acatgtgtcaagctgcttg

SEQ ID NO: 3779885 - DNA, 17 bp, Homo sapiens
acatgttactgaccagc

SEQ ID NO: 3779886 - DNA, 15 bp, Homo sapiens
acatgttcccttctc

SEQ ID NO: 3779887 - DNA, 15 bp, Homo sapiens
acattaaaacaatat

SEQ ID NO: 3779888 - DNA, 12 bp, Homo sapiens
acattaaataat

SEQ ID NO: 3779889 - DNA, 11 bp, Homo sapiens
acattaacagt

SEQ ID NO: 3779890 - DNA, 20 bp, Homo sapiens
acattaacagttttccatga

SEQ ID NO: 3779891 - DNA, 16 bp, Homo sapiens
acattaagcatcacaa

SEQ ID NO: 3779892 - DNA, 17 bp, Homo sapiens
acattaagccttccaca

SEQ ID NO: 3779893 - DNA, 19 bp, Homo sapiens
acattagttctatttctat

SEQ ID NO: 3779894 - DNA, 19 bp, Homo sapiens
acattatcgggagcagtgt

SEQ ID NO: 3779895 - DNA, 21 bp, Homo sapiens
acattatcgggagcagtgtct

SEQ ID NO: 3779896 - DNA, 20 bp, Homo sapiens
acattatctaactgtgctca

SEQ ID NO: 3779897 - DNA, 23 bp, Homo sapiens
acattcaagattaaactgagtga

SEQ ID NO: 3779898 - DNA, 23 bp, Homo sapiens
acattccgtttacattttagaca

SEQ ID NO: 3779899 - DNA, 14 bp, Homo sapiens
acattcgatctcat

SEQ ID NO: 3779900 - DNA, 21 bp, Homo sapiens
acattcgatctcattcagtat

SEQ ID NO: 3779901 - DNA, 20 bp, Homo sapiens
acattctgacatcttagtat

SEQ ID NO: 3779902 - DNA, 12 bp, Homo sapiens
acattctgcttt

SEQ ID NO: 3779903 - DNA, 12 bp, Homo sapiens
acattgaaagag

SEQ ID NO: 3779904 - DNA, 19 bp, Homo sapiens
acattgaagtaatgaattt

SEQ ID NO: 3779905 - DNA, 16 bp, Homo sapiens
acattgaccaagaact

SEQ ID NO: 3779906 - DNA, 16 bp, Homo sapiens
acattgcagtctgctt

SEQ ID NO: 3779907 - DNA, 17 bp, Homo sapiens
acattgggaaatcttat

SEQ ID NO: 3779908 - DNA, 13 bp, Homo sapiens
acattgtcaataa

SEQ ID NO: 3779909 - DNA, 11 bp, Homo sapiens
acatttaattg

SEQ ID NO: 3779910 - DNA, 15 bp, Homo sapiens
acatttaattgagaa

SEQ ID NO: 3779911 - DNA, 24 bp, Homo sapiens
acatttcacctactttgtaagtga

SEQ ID NO: 3779912 - DNA, 16 bp, Homo sapiens
acatttcatgtattcc

SEQ ID NO: 3779913 - DNA, 13 bp, Homo sapiens
acatttcccaggg

SEQ ID NO: 3779914 - DNA, 14 bp, Homo sapiens
acatttgggtaaat

SEQ ID NO: 3779915 - DNA, 20 bp, Homo sapiens
acatttgtatgttgtgaaga

SEQ ID NO: 3779916 - DNA, 18 bp, Homo sapiens
acatttgtcacagaaatc

SEQ ID NO: 3779917 - DNA, 15 bp, Homo sapiens
acattttaatgcacc

SEQ ID NO: 3779918 - DNA, 16 bp, Homo sapiens
acattttagacagtaa

SEQ ID NO: 3779919 - DNA, 15 bp, Homo sapiens
acattttcacacaat

SEQ ID NO: 3779920 - DNA, 15 bp, Homo sapiens
accaaaagaacaaga

SEQ ID NO: 3779921 - DNA, 16 bp, Homo sapiens
accaacagttccttca

SEQ ID NO: 3779922 - DNA, 22 bp, Homo sapiens
accaacatcccattgccctggt

SEQ ID NO: 3779923 - DNA, 16 bp, Homo sapiens
accaacatggagaaac

SEQ ID NO: 3779924 - DNA, 22 bp, Homo sapiens
accaacccatcagaaggagaag

SEQ ID NO: 3779925 - DNA, 11 bp, Homo sapiens
accaactggaa

SEQ ID NO: 3779926 - DNA, 20 bp, Homo sapiens
accaactggccctcttctta

SEQ ID NO: 3779927 - DNA, 11 bp, Homo sapiens
accaagaagat

SEQ ID NO: 3779928 - DNA, 16 bp, Homo sapiens
accaagaagatgtctt

SEQ ID NO: 3779929 - DNA, 13 bp, Homo sapiens
accaagagagaaa

SEQ ID NO: 3779930 - DNA, 15 bp, Homo sapiens
accaagagagaaaga

SEQ ID NO: 3779931 - DNA, 20 bp, Homo sapiens
accaagagagaaagaagtag

SEQ ID NO: 3779932 - DNA, 16 bp, Homo sapiens
accaagatgccatctg

SEQ ID NO: 3779933 - DNA, 24 bp, Homo sapiens
accaagcaggaagctcagactggt

SEQ ID NO: 3779934 - DNA, 14 bp, Homo sapiens
accaagctgctgtg

SEQ ID NO: 3779935 - DNA, 13 bp, Homo sapiens
accaaggacccct

SEQ ID NO: 3779936 - DNA, 20 bp, Homo sapiens
accaagtcctggctacatcc

SEQ ID NO: 3779937 - DNA, 23 bp, Homo sapiens
accaagtcctggctacatcccag

SEQ ID NO: 3779938 - DNA, 23 bp, Homo sapiens
accaagttggaacatccttggaa

SEQ ID NO: 3779939 - DNA, 13 bp, Homo sapiens
accaatcatttta

SEQ ID NO: 3779940 - DNA, 20 bp, Homo sapiens
accaatcattttaattatta

SEQ ID NO: 3779941 - DNA, 12 bp, Homo sapiens
accacaaggaaa

SEQ ID NO: 3779942 - DNA, 17 bp, Homo sapiens
accacacagaggctgcc

SEQ ID NO: 3779943 - DNA, 20 bp, Homo sapiens
accacacccagcccacttct

SEQ ID NO: 3779944 - DNA, 18 bp, Homo sapiens
accccaaagccccttgct

SEQ ID NO: 3779945 - DNA, 21 bp, Homo sapiens
accccacacttgttccagctc

SEQ ID NO: 3779946 - DNA, 22 bp, Homo sapiens
accccaccacgatgtggccctg

SEQ ID NO: 3779947 - DNA, 21 bp, Homo sapiens
accccacccccttcagtgccc

SEQ ID NO: 3779948 - DNA, 19 bp, Homo sapiens
accccacccttcccctcct

SEQ ID NO: 3779949 - DNA, 18 bp, Homo sapiens
accccactcacagagaca

SEQ ID NO: 3779950 - DNA, 13 bp, Homo sapiens
accccagagtgtg

SEQ ID NO: 3779951 - DNA, 23 bp, Homo sapiens
accccattctttgcttgaacaca

SEQ ID NO: 3779952 - DNA, 15 bp, Homo sapiens
acccccaccccacac

SEQ ID NO: 3779953 - DNA, 14 bp, Homo sapiens
acccccaccccttc

SEQ ID NO: 3779954 - DNA, 15 bp, Homo sapiens
acccccaccccttcc

SEQ ID NO: 3779955 - DNA, 13 bp, Homo sapiens
acccccagcctgc

SEQ ID NO: 3779956 - DNA, 14 bp, Homo sapiens
acccccagctttgc

SEQ ID NO: 3779957 - DNA, 18 bp, Homo sapiens
acccccatttctatttat

SEQ ID NO: 3779958 - DNA, 14 bp, Homo sapiens
accccccaagctgt

SEQ ID NO: 3779959 - DNA, 20 bp, Homo sapiens
accccccagaacctgtcctt

SEQ ID NO: 3779960 - DNA, 15 bp, Homo sapiens
accccctccctggcc

SEQ ID NO: 3779961 - DNA, 16 bp, Homo sapiens
accccctccctggcct

SEQ ID NO: 3779962 - DNA, 14 bp, Homo sapiens
accccctctagaaa

SEQ ID NO: 3779963 - DNA, 19 bp, Homo sapiens
acccccttctactgagcct

SEQ ID NO: 3779964 - DNA, 18 bp, Homo sapiens
acccccttctctgcccat

SEQ ID NO: 3779965 - DNA, 16 bp, Homo sapiens
acccccttctctgctc

SEQ ID NO: 3779966 - DNA, 23 bp, Homo sapiens
acccccttctctgctccaccaca

SEQ ID NO: 3779967 - DNA, 18 bp, Homo sapiens
accccgggctctctgctg

SEQ ID NO: 3779968 - DNA, 16 bp, Homo sapiens
acccctacatgaaaca

SEQ ID NO: 3779969 - DNA, 20 bp, Homo sapiens
acccctcacaggagcttact

SEQ ID NO: 3779970 - DNA, 15 bp, Homo sapiens
acccctcaccttgca

SEQ ID NO: 3779971 - DNA, 21 bp, Homo sapiens
acccctccttccttgaccagc

SEQ ID NO: 3779972 - DNA, 18 bp, Homo sapiens
acccctctaccaagctgt

SEQ ID NO: 3779973 - DNA, 15 bp, Homo sapiens
acccctctggccagg

SEQ ID NO: 3779974 - DNA, 15 bp, Homo sapiens
acccctgccctggga

SEQ ID NO: 3779975 - DNA, 15 bp, Homo sapiens
acccctggcttttca

SEQ ID NO: 3779976 - DNA, 15 bp, Homo sapiens
accccttccccactg

SEQ ID NO: 3779977 - DNA, 23 bp, Homo sapiens
accccttccccactgcctgccca

SEQ ID NO: 3779978 - DNA, 15 bp, Homo sapiens
accccttcgctcctg

SEQ ID NO: 3779979 - DNA, 19 bp, Homo sapiens
accccttcgctcctgtgtc

SEQ ID NO: 3779980 - DNA, 20 bp, Homo sapiens
accccttcgctcctgtgtct

SEQ ID NO: 3779981 - DNA, 12 bp, Homo sapiens
acccctttcctg

SEQ ID NO: 3779982 - DNA, 21 bp, Homo sapiens
acccgacagagggaagaaaag

SEQ ID NO: 3779983 - DNA, 14 bp, Homo sapiens
acccgaggcccgca

SEQ ID NO: 3779984 - DNA, 14 bp, Homo sapiens
acccggcccctgct

SEQ ID NO: 3779985 - DNA, 21 bp, Homo sapiens
acccggcggtcccctccgcca

SEQ ID NO: 3779986 - DNA, 15 bp, Homo sapiens
accctaccccaccac

SEQ ID NO: 3779987 - DNA, 16 bp, Homo sapiens
accctacctgtgcctg

SEQ ID NO: 3779988 - DNA, 17 bp, Homo sapiens
accctatatgtagtata

SEQ ID NO: 3779989 - DNA, 13 bp, Homo sapiens
accctattgctgc

SEQ ID NO: 3779990 - DNA, 13 bp, Homo sapiens
accctcccagctc

SEQ ID NO: 3779991 - DNA, 19 bp, Homo sapiens
accctccctcagcccctct

SEQ ID NO: 3779992 - DNA, 22 bp, Homo sapiens
accctccgccttcactccggtg

SEQ ID NO: 3779993 - DNA, 16 bp, Homo sapiens
accctcgaagcgcgcc

SEQ ID NO: 3779994 - DNA, 12 bp, Homo sapiens
accctcgctggc

SEQ ID NO: 3779995 - DNA, 15 bp, Homo sapiens
accctcgctggcccc

SEQ ID NO: 3779996 - DNA, 16 bp, Homo sapiens
accctctccaccccat

SEQ ID NO: 3779997 - DNA, 13 bp, Homo sapiens
accctgcccctgc

SEQ ID NO: 3779998 - DNA, 20 bp, Homo sapiens
accctgcgaaggggccctgg

SEQ ID NO: 3779999 - DNA, 16 bp, Homo sapiens
accctggatcagtcct

SEQ ID NO: 3780000 - DNA, 20 bp, Homo sapiens
accctggtgaggaagctcca

SEQ ID NO: 3780001 - DNA, 20 bp, Homo sapiens
accctgtcaagttaacaagg

SEQ ID NO: 3780002 - DNA, 21 bp, Homo sapiens
accctgtcaagttaacaagga

SEQ ID NO: 3780003 - DNA, 18 bp, Homo sapiens
acccttaccccttagcct

SEQ ID NO: 3780004 - DNA, 19 bp, Homo sapiens
acccttaccccttagcctc

SEQ ID NO: 3780005 - DNA, 22 bp, Homo sapiens
acccttcccctccttctccctt

SEQ ID NO: 3780006 - DNA, 20 bp, Homo sapiens
acccttcccttgagccctct

SEQ ID NO: 3780007 - DNA, 13 bp, Homo sapiens
acccttctgtgcc

SEQ ID NO: 3780008 - DNA, 16 bp, Homo sapiens
acccttctgtgcccag

SEQ ID NO: 3780009 - DNA, 17 bp, Homo sapiens
acccttctgtgcccagc

SEQ ID NO: 3780010 - DNA, 13 bp, Homo sapiens
acccttgaaaaga

SEQ ID NO: 3780011 - DNA, 21 bp, Homo sapiens
acccttggaggctgtcttctc

SEQ ID NO: 3780012 - DNA, 17 bp, Homo sapiens
accctttccttccttcc

SEQ ID NO: 3780013 - DNA, 18 bp, Homo sapiens
accctttccttccttccc

SEQ ID NO: 3780014 - DNA, 17 bp, Homo sapiens
accgagagtagccgaga

SEQ ID NO: 3780015 - DNA, 17 bp, Homo sapiens
accgaggctggagctgg

SEQ ID NO: 3780016 - DNA, 18 bp, Homo sapiens
accgagtctcttctccac

SEQ ID NO: 3780017 - DNA, 19 bp, Homo sapiens
accgctgccagcacagagc

SEQ ID NO: 3780018 - DNA, 14 bp, Homo sapiens
accggatcctgggt

SEQ ID NO: 3780019 - DNA, 18 bp, Homo sapiens
accggcaatttccggcca

SEQ ID NO: 3780020 - DNA, 21 bp, Homo sapiens
accgggctgggagctctgcag

SEQ ID NO: 3780021 - DNA, 16 bp, Homo sapiens
accggttgcttctggg

SEQ ID NO: 3780022 - DNA, 15 bp, Homo sapiens
accgtcctctttttc

SEQ ID NO: 3780023 - DNA, 11 bp, Homo sapiens
acctaacattc

SEQ ID NO: 3780024 - DNA, 12 bp, Homo sapiens
acctaacattcg

SEQ ID NO: 3780025 - DNA, 14 bp, Homo sapiens
acctaagtctctgt

SEQ ID NO: 3780026 - DNA, 16 bp, Homo sapiens
acctaagtctctgtga

SEQ ID NO: 3780027 - DNA, 12 bp, Homo sapiens
acctaatgttta

SEQ ID NO: 3780028 - DNA, 19 bp, Homo sapiens
acctaatgtttatgagcca

SEQ ID NO: 3780029 - DNA, 20 bp, Homo sapiens
acctaatgtttatgagccag

SEQ ID NO: 3780030 - DNA, 19 bp, Homo sapiens
acctaattagagcagatga

SEQ ID NO: 3780031 - DNA, 13 bp, Homo sapiens
acctacagaatac

SEQ ID NO: 3780032 - DNA, 15 bp, Homo sapiens
acctaccacagtgtc

SEQ ID NO: 3780033 - DNA, 19 bp, Homo sapiens
acctaccacagtgtctgta

SEQ ID NO: 3780034 - DNA, 17 bp, Homo sapiens
acctagggaggacctta

SEQ ID NO: 3780035 - DNA, 20 bp, Homo sapiens
acctagggatgttctggccc

SEQ ID NO: 3780036 - DNA, 15 bp, Homo sapiens
acctataaaacaggt

SEQ ID NO: 3780037 - DNA, 18 bp, Homo sapiens
acctataaaacaggtcaa

SEQ ID NO: 3780038 - DNA, 16 bp, Homo sapiens
acctatagtcccagct

SEQ ID NO: 3780039 - DNA, 17 bp, Homo sapiens
acctatttcaaaaattt

SEQ ID NO: 3780040 - DNA, 18 bp, Homo sapiens
acctatttcaaaaatttg

SEQ ID NO: 3780041 - DNA, 20 bp, Homo sapiens
acctatttcaaaaatttgga

SEQ ID NO: 3780042 - DNA, 22 bp, Homo sapiens
acctcaacccccatttctattt

SEQ ID NO: 3780043 - DNA, 19 bp, Homo sapiens
acctcaacctgtaaattat

SEQ ID NO: 3780044 - DNA, 20 bp, Homo sapiens
acctcaagggggactgtctt

SEQ ID NO: 3780045 - DNA, 17 bp, Homo sapiens
acctcaccaagctgctg

SEQ ID NO: 3780046 - DNA, 18 bp, Homo sapiens
acctcacgcacctcccat

SEQ ID NO: 3780047 - DNA, 23 bp, Homo sapiens
acctcactggggtcctggggcct

SEQ ID NO: 3780048 - DNA, 15 bp, Homo sapiens
acctcagcctagacc

SEQ ID NO: 3780049 - DNA, 11 bp, Homo sapiens
acctcagcctc

SEQ ID NO: 3780050 - DNA, 19 bp, Homo sapiens
acctcagcctgtgctgccc

SEQ ID NO: 3780051 - DNA, 14 bp, Homo sapiens
acctcagccttgga

SEQ ID NO: 3780052 - DNA, 20 bp, Homo sapiens
acctcaggccaggtgcagtg

SEQ ID NO: 3780053 - DNA, 21 bp, Homo sapiens
acctcaggccaggtgcagtgg

SEQ ID NO: 3780054 - DNA, 21 bp, Homo sapiens
acctcaggtgatccacccacc

SEQ ID NO: 3780055 - DNA, 21 bp, Homo sapiens
acctcagtgtcatttatgaaa

SEQ ID NO: 3780056 - DNA, 19 bp, Homo sapiens
acctcagttcccttggcct

SEQ ID NO: 3780057 - DNA, 16 bp, Homo sapiens
actatgatttggaaaa

SEQ ID NO: 3780058 - DNA, 16 bp, Homo sapiens
actatgcacaatttaa

SEQ ID NO: 3780059 - DNA, 18 bp, Homo sapiens
actatgtacaatatttta

SEQ ID NO: 3780060 - DNA, 20 bp, Homo sapiens
actattaagcagtaaaaact

SEQ ID NO: 3780061 - DNA, 21 bp, Homo sapiens
actattataatttaatgcatg

SEQ ID NO: 3780062 - DNA, 19 bp, Homo sapiens
actattggagggtgggaga

SEQ ID NO: 3780063 - DNA, 20 bp, Homo sapiens
actatttagtttttgtaatt

SEQ ID NO: 3780064 - DNA, 21 bp, Homo sapiens
actatttagtttttgtaattt

SEQ ID NO: 3780065 - DNA, 12 bp, Homo sapiens
actatttatctg

SEQ ID NO: 3780066 - DNA, 19 bp, Homo sapiens
actatttgcttatttaata

SEQ ID NO: 3780067 - DNA, 11 bp, Homo sapiens
actattttatt

SEQ ID NO: 3780068 - DNA, 13 bp, Homo sapiens
actattttcagaa

SEQ ID NO: 3780069 - DNA, 14 bp, Homo sapiens
actattttcagaat

SEQ ID NO: 3780070 - DNA, 16 bp, Homo sapiens
actattttcagaatct

SEQ ID NO: 3780071 - DNA, 17 bp, Homo sapiens
actattttcagaatctg

SEQ ID NO: 3780072 - DNA, 18 bp, Homo sapiens
actatttttcagaatctc

SEQ ID NO: 3780073 - DNA, 16 bp, Homo sapiens
actcaaactcttaaaa

SEQ ID NO: 3780074 - DNA, 17 bp, Homo sapiens
actcaaactcttaaaac

SEQ ID NO: 3780075 - DNA, 17 bp, Homo sapiens
actcaacatgttactga

SEQ ID NO: 3780076 - DNA, 20 bp, Homo sapiens
actcaacatgttactgacca

SEQ ID NO: 3780077 - DNA, 16 bp, Homo sapiens
actcaagccaagcagc

SEQ ID NO: 3780078 - DNA, 19 bp, Homo sapiens
actcaagccaagcagccaa

SEQ ID NO: 3780079 - DNA, 15 bp, Homo sapiens
actcaagttcaagga

SEQ ID NO: 3780080 - DNA, 15 bp, Homo sapiens
actcaataaaatcat

SEQ ID NO: 3780081 - DNA, 12 bp, Homo sapiens
actcaatatttt

SEQ ID NO: 3780082 - DNA, 15 bp, Homo sapiens
actcaatattttcca

SEQ ID NO: 3780083 - DNA, 22 bp, Homo sapiens
actcaatattttccatgaaaat

SEQ ID NO: 3780084 - DNA, 18 bp, Homo sapiens
actcacagagacacaggg

SEQ ID NO: 3780085 - DNA, 20 bp, Homo sapiens
actcacatttattctgctca

SEQ ID NO: 3780086 - DNA, 12 bp, Homo sapiens
actcacccaagc

SEQ ID NO: 3780087 - DNA, 17 bp, Homo sapiens
actcacctaatgtttat

SEQ ID NO: 3780088 - DNA, 23 bp, Homo sapiens
actcacctaatgtttatgagcca

SEQ ID NO: 3780089 - DNA, 16 bp, Homo sapiens
actcacctctaaaaca

SEQ ID NO: 3780090 - DNA, 16 bp, Homo sapiens
actcacctctgcctca

SEQ ID NO: 3780091 - DNA, 17 bp, Homo sapiens
actcacctctgcctcaa

SEQ ID NO: 3780092 - DNA, 13 bp, Homo sapiens
actcacctgctgg

SEQ ID NO: 3780093 - DNA, 16 bp, Homo sapiens
actcacctgctggccc

SEQ ID NO: 3780094 - DNA, 15 bp, Homo sapiens
actcactggcagccc

SEQ ID NO: 3780095 - DNA, 20 bp, Homo sapiens
actcactggcagccccagca

SEQ ID NO: 3780096 - DNA, 15 bp, Homo sapiens
actcagaaacatcag

SEQ ID NO: 3780097 - DNA, 17 bp, Homo sapiens
actcagaagacactgat

SEQ ID NO: 3780098 - DNA, 14 bp, Homo sapiens
actcagagggagga

SEQ ID NO: 3780099 - DNA, 13 bp, Homo sapiens
actcagccctggg

SEQ ID NO: 3780100 - DNA, 22 bp, Homo sapiens
actcagccctgggccccaccac

SEQ ID NO: 3780101 - DNA, 14 bp, Homo sapiens
actcaggactccag

SEQ ID NO: 3780102 - DNA, 15 bp, Homo sapiens
actcaggactccagc

SEQ ID NO: 3780103 - DNA, 16 bp, Homo sapiens
actcaggactccagcc

SEQ ID NO: 3780104 - DNA, 14 bp, Homo sapiens
actcaggatgccca

SEQ ID NO: 3780105 - DNA, 16 bp, Homo sapiens
actcaggatgcccagg

SEQ ID NO: 3780106 - DNA, 18 bp, Homo sapiens
actcaggatgcccagggc

SEQ ID NO: 3780107 - DNA, 15 bp, Homo sapiens
actcagggccccagc

SEQ ID NO: 3780108 - DNA, 21 bp, Homo sapiens
actcaggttgtagtaaagaaa

SEQ ID NO: 3780109 - DNA, 14 bp, Homo sapiens
actcagtttgtcag

SEQ ID NO: 3780110 - DNA, 9 bp, Homo sapiens
actcatcat

SEQ ID NO: 3780111 - DNA, 12 bp, Homo sapiens
actcatcataaa

SEQ ID NO: 3780112 - DNA, 14 bp, Homo sapiens
actcatcataaaat

SEQ ID NO: 3780113 - DNA, 21 bp, Homo sapiens
actcatgatcttgtgacatat

SEQ ID NO: 3780114 - DNA, 13 bp, Homo sapiens
actcattcaaaag

SEQ ID NO: 3780115 - DNA, 21 bp, Homo sapiens
actcattcaaaagttgaaatt

SEQ ID NO: 3780116 - DNA, 23 bp, Homo sapiens
actcattcagggatagcactgag

SEQ ID NO: 3780117 - DNA, 16 bp, Homo sapiens
actcatttcctatgta

SEQ ID NO: 3780118 - DNA, 13 bp, Homo sapiens
actccaccaccca

SEQ ID NO: 3780119 - DNA, 13 bp, Homo sapiens
actccagatctgc

SEQ ID NO: 3780120 - DNA, 19 bp, Homo sapiens
actccagcctgagcaacag

SEQ ID NO: 3780121 - DNA, 21 bp, Homo sapiens
actccagcctgggcaacacag

SEQ ID NO: 3780122 - DNA, 23 bp, Homo sapiens
actccagcctgggcaacagagca

SEQ ID NO: 3780123 - DNA, 18 bp, Homo sapiens
actccagcctgggcgaca

SEQ ID NO: 3780124 - DNA, 20 bp, Homo sapiens
actccagcctgggcgacaga

SEQ ID NO: 3780125 - DNA, 20 bp, Homo sapiens
actccaggaaggggctggac

SEQ ID NO: 3780126 - DNA, 14 bp, Homo sapiens
actccatcagctta

SEQ ID NO: 3780127 - DNA, 14 bp, Homo sapiens
actccatgagaagc

SEQ ID NO: 3780128 - DNA, 20 bp, Homo sapiens
actccatgttggctagcctc

SEQ ID NO: 3780129 - DNA, 15 bp, Homo sapiens
actcccaaagagctg

SEQ ID NO: 3780130 - DNA, 16 bp, Homo sapiens
actcccaaagagctgc

SEQ ID NO: 3780131 - DNA, 17 bp, Homo sapiens
actcccaagaacagcag

SEQ ID NO: 3780132 - DNA, 15 bp, Homo sapiens
actcccaagctggac

SEQ ID NO: 3780133 - DNA, 22 bp, Homo sapiens
actcccagtccaaatgtcctcc

SEQ ID NO: 3780134 - DNA, 16 bp, Homo sapiens
actcccctgcactgga

SEQ ID NO: 3780135 - DNA, 22 bp, Homo sapiens
actcccctgcactggagtccag

SEQ ID NO: 3780136 - DNA, 17 bp, Homo sapiens
actccccttgagctgag

SEQ ID NO: 3780137 - DNA, 20 bp, Homo sapiens
actccccttgagctgagatg

SEQ ID NO: 3780138 - DNA, 13 bp, Homo sapiens
actccctcctcac

SEQ ID NO: 3780139 - DNA, 16 bp, Homo sapiens
actccctcctcacctc

SEQ ID NO: 3780140 - DNA, 19 bp, Homo sapiens
actccctcctcacctctgg

SEQ ID NO: 3780141 - DNA, 15 bp, Homo sapiens
actccggtgtgcctg

SEQ ID NO: 3780142 - DNA, 17 bp, Homo sapiens
actcctacctcagccta

SEQ ID NO: 3780143 - DNA, 20 bp, Homo sapiens
actcctcaaaagcaaatgag

SEQ ID NO: 3780144 - DNA, 21 bp, Homo sapiens
actcctcaaaagcaaatgaga

SEQ ID NO: 3780145 - DNA, 16 bp, Homo sapiens
actcctccctgatgta

SEQ ID NO: 3780146 - DNA, 17 bp, Homo sapiens
actcctccctgatgtac

SEQ ID NO: 3780147 - DNA, 13 bp, Homo sapiens
actcctctgtcca

SEQ ID NO: 3780148 - DNA, 14 bp, Homo sapiens
actcctctgtccag

SEQ ID NO: 3780149 - DNA, 13 bp, Homo sapiens
actcctgcaaaat

SEQ ID NO: 3780150 - DNA, 12 bp, Homo sapiens
actcctggcctc

SEQ ID NO: 3780151 - DNA, 21 bp, Homo sapiens
actcctgggctcaagcagtct

SEQ ID NO: 3780152 - DNA, 17 bp, Homo sapiens
actcctgtacactgaat

SEQ ID NO: 3780153 - DNA, 12 bp, Homo sapiens
actccttagaga

SEQ ID NO: 3780154 - DNA, 21 bp, Homo sapiens
actccttcctgccacctgctg

SEQ ID NO: 3780155 - DNA, 18 bp, Homo sapiens
actcgagtcacactcaag

SEQ ID NO: 3780156 - DNA, 12 bp, Homo sapiens
actcgcttcccc

SEQ ID NO: 3780157 - DNA, 14 bp, Homo sapiens
actcgtatatgtct

SEQ ID NO: 3780158 - DNA, 22 bp, Homo sapiens
actctaattcccattttgcaaa

SEQ ID NO: 3780159 - DNA, 21 bp, Homo sapiens
actctaattctaaccagagca

SEQ ID NO: 3780160 - DNA, 17 bp, Homo sapiens
actctacccatattaca

SEQ ID NO: 3780161 - DNA, 13 bp, Homo sapiens
actctaccctccc

SEQ ID NO: 3780162 - DNA, 16 bp, Homo sapiens
actctaccctcccacc

SEQ ID NO: 3780163 - DNA, 18 bp, Homo sapiens
actctaccctcccacccc

SEQ ID NO: 3780164 - DNA, 20 bp, Homo sapiens
actctacttagcatgtccct

SEQ ID NO: 3780165 - DNA, 21 bp, Homo sapiens
actctacttagcatgtcccta

SEQ ID NO: 3780166 - DNA, 15 bp, Homo sapiens
actctcattccccag

SEQ ID NO: 3780167 - DNA, 17 bp, Homo sapiens
actctcattccccaggt

SEQ ID NO: 3780168 - DNA, 14 bp, Homo sapiens
actctccaacctgg

SEQ ID NO: 3780169 - DNA, 10 bp, Homo sapiens
actctcccca

SEQ ID NO: 3780170 - DNA, 11 bp, Homo sapiens
actctccccac

SEQ ID NO: 3780171 - DNA, 17 bp, Homo sapiens
agaactgcatggaccta

SEQ ID NO: 3780172 - DNA, 23 bp, Homo sapiens
agaactgcatggacctaacattc

SEQ ID NO: 3780173 - DNA, 17 bp, Homo sapiens
agaactggactcaggat

SEQ ID NO: 3780174 - DNA, 21 bp, Homo sapiens
agaacttttggtaagggaaaa

SEQ ID NO: 3780175 - DNA, 17 bp, Homo sapiens
agaagaaaaaagaatgt

SEQ ID NO: 3780176 - DNA, 17 bp, Homo sapiens
agaagaaatgaaatttt

SEQ ID NO: 3780177 - DNA, 13 bp, Homo sapiens
agaagaacatcca

SEQ ID NO: 3780178 - DNA, 21 bp, Homo sapiens
agaagaaggaaatgaatttct

SEQ ID NO: 3780179 - DNA, 20 bp, Homo sapiens
agaagaatacaaacatattt

SEQ ID NO: 3780180 - DNA, 22 bp, Homo sapiens
agaagaattttcagaccccagc

SEQ ID NO: 3780181 - DNA, 23 bp, Homo sapiens
agaagaattttcagaccccagcg

SEQ ID NO: 3780182 - DNA, 22 bp, Homo sapiens
agaagagaatattagctttact

SEQ ID NO: 3780183 - DNA, 18 bp, Homo sapiens
agaagagactctttgcat

SEQ ID NO: 3780184 - DNA, 13 bp, Homo sapiens
agaagcatgaaaa

SEQ ID NO: 3780185 - DNA, 21 bp, Homo sapiens
agaagcccaatattataattt

SEQ ID NO: 3780186 - DNA, 18 bp, Homo sapiens
agaagccgggaacagaca

SEQ ID NO: 3780187 - DNA, 14 bp, Homo sapiens
agaagccgtgggtg

SEQ ID NO: 3780188 - DNA, 15 bp, Homo sapiens
agaagcctattgtaa

SEQ ID NO: 3780189 - DNA, 15 bp, Homo sapiens
agaagctgagcacca

SEQ ID NO: 3780190 - DNA, 16 bp, Homo sapiens
agaaggaaaaggcagg

SEQ ID NO: 3780191 - DNA, 17 bp, Homo sapiens
agaaggaagtgaagagg

SEQ ID NO: 3780192 - DNA, 14 bp, Homo sapiens
agaaggaatgtctt

SEQ ID NO: 3780193 - DNA, 18 bp, Homo sapiens
agaaggaggagagggaaa

SEQ ID NO: 3780194 - DNA, 14 bp, Homo sapiens
agaaggatgaatga

SEQ ID NO: 3780195 - DNA, 17 bp, Homo sapiens
agaaggccaagaggctg

SEQ ID NO: 3780196 - DNA, 16 bp, Homo sapiens
agaaggctggggctat

SEQ ID NO: 3780197 - DNA, 21 bp, Homo sapiens
agaagggggtcaaagcaagga

SEQ ID NO: 3780198 - DNA, 21 bp, Homo sapiens
agaagggttttccaccctgga

SEQ ID NO: 3780199 - DNA, 21 bp, Homo sapiens
agaaggtattccttttgtgta

SEQ ID NO: 3780200 - DNA, 20 bp, Homo sapiens
agaaggtgggggttggctgg

SEQ ID NO: 3780201 - DNA, 20 bp, Homo sapiens
agaaggttgctctagattga

SEQ ID NO: 3780202 - DNA, 20 bp, Homo sapiens
agaagtaacaagagtgattc

SEQ ID NO: 3780203 - DNA, 17 bp, Homo sapiens
agaagtaggcatgaggg

SEQ ID NO: 3780204 - DNA, 21 bp, Homo sapiens
agaagtaggcatgagggatca

SEQ ID NO: 3780205 - DNA, 18 bp, Homo sapiens
agaagtgaccaaggagga

SEQ ID NO: 3780206 - DNA, 13 bp, Homo sapiens
agaagtgcccctg

SEQ ID NO: 3780207 - DNA, 20 bp, Homo sapiens
agaagtggggacagagcaga

SEQ ID NO: 3780208 - DNA, 19 bp, Homo sapiens
agaagttaagcaacatcta

SEQ ID NO: 3780209 - DNA, 18 bp, Homo sapiens
agaagtttagattttaat

SEQ ID NO: 3780210 - DNA, 19 bp, Homo sapiens
agaagtttctttaaagacg

SEQ ID NO: 3780211 - DNA, 15 bp, Homo sapiens
agaagtttgtcaagt

SEQ ID NO: 3780212 - DNA, 13 bp, Homo sapiens
agaataatctttg

SEQ ID NO: 3780213 - DNA, 16 bp, Homo sapiens
agaataatctttgggt

SEQ ID NO: 3780214 - DNA, 22 bp, Homo sapiens
agaataatgtgggaagaaacaa

SEQ ID NO: 3780215 - DNA, 16 bp, Homo sapiens
agaatagaaggaaact

SEQ ID NO: 3780216 - DNA, 15 bp, Homo sapiens
agaatataattatcg

SEQ ID NO: 3780217 - DNA, 17 bp, Homo sapiens
agaatataattatcgga

SEQ ID NO: 3780218 - DNA, 23 bp, Homo sapiens
agaatataattatcggaagcagt

SEQ ID NO: 3780219 - DNA, 14 bp, Homo sapiens
agaatattgttcct

SEQ ID NO: 3780220 - DNA, 15 bp, Homo sapiens
agaatattgttccta

SEQ ID NO: 3780221 - DNA, 16 bp, Homo sapiens
agaatcagtgcaaaga

SEQ ID NO: 3780222 - DNA, 14 bp, Homo sapiens
agaatcatacttag

SEQ ID NO: 3780223 - DNA, 16 bp, Homo sapiens
agaatccctgttcatt

SEQ ID NO: 3780224 - DNA, 21 bp, Homo sapiens
agaatcgatgggggatgcttc

SEQ ID NO: 3780225 - DNA, 23 bp, Homo sapiens
agaatcgatgggggatgcttcat

SEQ ID NO: 3780226 - DNA, 12 bp, Homo sapiens
agaatctttcct

SEQ ID NO: 3780227 - DNA, 19 bp, Homo sapiens
agaatctttccttcctctc

SEQ ID NO: 3780228 - DNA, 20 bp, Homo sapiens
agaatgaaattgctgaaaga

SEQ ID NO: 3780229 - DNA, 14 bp, Homo sapiens
agaatgagagtgtg

SEQ ID NO: 3780230 - DNA, 12 bp, Homo sapiens
agaatgagcctc

SEQ ID NO: 3780231 - DNA, 17 bp, Homo sapiens
agaatgaggaggaagga

SEQ ID NO: 3780232 - DNA, 18 bp, Homo sapiens
agaatgctggttttccta

SEQ ID NO: 3780233 - DNA, 19 bp, Homo sapiens
agaatgttatagtgaatta

SEQ ID NO: 3780234 - DNA, 16 bp, Homo sapiens
agaatgttttccttct

SEQ ID NO: 3780235 - DNA, 15 bp, Homo sapiens
agaattcagctgccc

SEQ ID NO: 3780236 - DNA, 16 bp, Homo sapiens
agaattcagctgcccc

SEQ ID NO: 3780237 - DNA, 17 bp, Homo sapiens
agaattcagctgccccc

SEQ ID NO: 3780238 - DNA, 15 bp, Homo sapiens
agaattcccagctgt

SEQ ID NO: 3780239 - DNA, 20 bp, Homo sapiens
agaattctgctacctcactg

SEQ ID NO: 3780240 - DNA, 17 bp, Homo sapiens
agaattcttacatgttt

SEQ ID NO: 3780241 - DNA, 20 bp, Homo sapiens
agaattcttacatgttttct

SEQ ID NO: 3780242 - DNA, 17 bp, Homo sapiens
agaattgaacccaggag

SEQ ID NO: 3780243 - DNA, 18 bp, Homo sapiens
agaattgaacccaggagg

SEQ ID NO: 3780244 - DNA, 21 bp, Homo sapiens
agaattgatttcccttcttct

SEQ ID NO: 3780245 - DNA, 21 bp, Homo sapiens
agaatttatcacacttctgtg

SEQ ID NO: 3780246 - DNA, 16 bp, Homo sapiens
agaatttcaatttgtt

SEQ ID NO: 3780247 - DNA, 13 bp, Homo sapiens
agaatttcttggt

SEQ ID NO: 3780248 - DNA, 22 bp, Homo sapiens
agaatttcttggtaagaagccg

SEQ ID NO: 3780249 - DNA, 19 bp, Homo sapiens
agacaaaaaactatatgta

SEQ ID NO: 3780250 - DNA, 17 bp, Homo sapiens
agacaaaaacagcctca

SEQ ID NO: 3780251 - DNA, 22 bp, Homo sapiens
agacaaaaatactctaattcta

SEQ ID NO: 3780252 - DNA, 14 bp, Homo sapiens
agacaaaaattatc

SEQ ID NO: 3780253 - DNA, 21 bp, Homo sapiens
agacaaaaattatctatttgt

SEQ ID NO: 3780254 - DNA, 16 bp, Homo sapiens
agacaaaccagaagca

SEQ ID NO: 3780255 - DNA, 18 bp, Homo sapiens
agacaaaggttttcctct

SEQ ID NO: 3780256 - DNA, 14 bp, Homo sapiens
agacaaatggagga

SEQ ID NO: 3780257 - DNA, 17 bp, Homo sapiens
agacaaattctgtttct

SEQ ID NO: 3780258 - DNA, 18 bp, Homo sapiens
agacaaattctgtttctt

SEQ ID NO: 3780259 - DNA, 14 bp, Homo sapiens
agacaaccctgcaa

SEQ ID NO: 3780260 - DNA, 16 bp, Homo sapiens
agacaatgcagatgcc

SEQ ID NO: 3780261 - DNA, 12 bp, Homo sapiens
agacacacacac

SEQ ID NO: 3780262 - DNA, 13 bp, Homo sapiens
agacacacacaca

SEQ ID NO: 3780263 - DNA, 14 bp, Homo sapiens
agacacagaacaca

SEQ ID NO: 3780264 - DNA, 16 bp, Homo sapiens
agacacagaacacaga

SEQ ID NO: 3780265 - DNA, 14 bp, Homo sapiens
agacacctgcacct

SEQ ID NO: 3780266 - DNA, 16 bp, Homo sapiens
agacacctgcacctcc

SEQ ID NO: 3780267 - DNA, 22 bp, Homo sapiens
agacaccttgacagggcacacc

SEQ ID NO: 3780268 - DNA, 20 bp, Homo sapiens
agacactgaaatatacacac

SEQ ID NO: 3780269 - DNA, 20 bp, Homo sapiens
agacactgccacacagggtc

SEQ ID NO: 3780270 - DNA, 20 bp, Homo sapiens
agacacttctaaatgaagtg

SEQ ID NO: 3780271 - DNA, 15 bp, Homo sapiens
agacactttggaagt

SEQ ID NO: 3780272 - DNA, 17 bp, Homo sapiens
agacagaacccctacat

SEQ ID NO: 3780273 - DNA, 14 bp, Homo sapiens
agacagacacacac

SEQ ID NO: 3780274 - DNA, 15 bp, Homo sapiens
agacagacacacaca

SEQ ID NO: 3780275 - DNA, 16 bp, Homo sapiens
agacagacacacacac

SEQ ID NO: 3780276 - DNA, 22 bp, Homo sapiens
agacagagccccaccctcagat

SEQ ID NO: 3780277 - DNA, 24 bp, Homo sapiens
agacagagccccaccctcagatgc

SEQ ID NO: 3780278 - DNA, 21 bp, Homo sapiens
agacagagctggttgggaaga

SEQ ID NO: 3780279 - DNA, 12 bp, Homo sapiens
agacagcagctc

SEQ ID NO: 3780280 - DNA, 18 bp, Homo sapiens
agacaggacctgactatt

SEQ ID NO: 3780281 - DNA, 20 bp, Homo sapiens
agacaggcaagcacctcctg

SEQ ID NO: 3780282 - DNA, 20 bp, Homo sapiens
agacaggccatgtgagccac

SEQ ID NO: 3780283 - DNA, 15 bp, Homo sapiens
agacaggcccaagag

SEQ ID NO: 3780284 - DNA, 21 bp, Homo sapiens
agcaaaaccaaatattccaga

SEQ ID NO: 3780285 - DNA, 16 bp, Homo sapiens
agcaaaaccattgctt

SEQ ID NO: 3780286 - DNA, 20 bp, Homo sapiens
agcaaaaccattgcttcact

SEQ ID NO: 3780287 - DNA, 16 bp, Homo sapiens
agcaaaagaagtaaca

SEQ ID NO: 3780288 - DNA, 14 bp, Homo sapiens
agcaaacctgcccc

SEQ ID NO: 3780289 - DNA, 20 bp, Homo sapiens
agcaaatcagaaacttgtga

SEQ ID NO: 3780290 - DNA, 17 bp, Homo sapiens
agcaaatgttatgcata

SEQ ID NO: 3780291 - DNA, 19 bp, Homo sapiens
agcaaatttataattttaa

SEQ ID NO: 3780292 - DNA, 21 bp, Homo sapiens
agcaacacaatgttattcgtt

SEQ ID NO: 3780293 - DNA, 23 bp, Homo sapiens
agcaacagagtgagaccctgtct

SEQ ID NO: 3780294 - DNA, 21 bp, Homo sapiens
agcaacatctagcaaatgtta

SEQ ID NO: 3780295 - DNA, 17 bp, Homo sapiens
agcaaccagagcactgt

SEQ ID NO: 3780296 - DNA, 18 bp, Homo sapiens
agcaaccagagcactgta

SEQ ID NO: 3780297 - DNA, 22 bp, Homo sapiens
agcaaccctcctatcacctccc

SEQ ID NO: 3780298 - DNA, 21 bp, Homo sapiens
agcaacttgtctttttctgga

SEQ ID NO: 3780299 - DNA, 12 bp, Homo sapiens
agcaagaaagaa

SEQ ID NO: 3780300 - DNA, 15 bp, Homo sapiens
agcaagaaagaaacc

SEQ ID NO: 3780301 - DNA, 15 bp, Homo sapiens
agcaagacagagacg

SEQ ID NO: 3780302 - DNA, 12 bp, Homo sapiens
agcaagactctg

SEQ ID NO: 3780303 - DNA, 12 bp, Homo sapiens
agcaagagagat

SEQ ID NO: 3780304 - DNA, 14 bp, Homo sapiens
agcaagatttcaga

SEQ ID NO: 3780305 - DNA, 15 bp, Homo sapiens
agcaaggggctctgc

SEQ ID NO: 3780306 - DNA, 14 bp, Homo sapiens
agcaagtgaatttt

SEQ ID NO: 3780307 - DNA, 13 bp, Homo sapiens
agcaagtgagagc

SEQ ID NO: 3780308 - DNA, 16 bp, Homo sapiens
agcaagtgagagctgg

SEQ ID NO: 3780309 - DNA, 18 bp, Homo sapiens
agcaagtgagagctgggt

SEQ ID NO: 3780310 - DNA, 14 bp, Homo sapiens
agcaataaatgaat

SEQ ID NO: 3780311 - DNA, 17 bp, Homo sapiens
agcaatatttaaggaga

SEQ ID NO: 3780312 - DNA, 21 bp, Homo sapiens
agcaatcagattttcctgtgg

SEQ ID NO: 3780313 - DNA, 17 bp, Homo sapiens
agcaatccatgttagtt

SEQ ID NO: 3780314 - DNA, 20 bp, Homo sapiens
agcaatccatgttagttttt

SEQ ID NO: 3780315 - DNA, 22 bp, Homo sapiens
agcaatccatgttagtttttac

SEQ ID NO: 3780316 - DNA, 14 bp, Homo sapiens
agcaatcctcctga

SEQ ID NO: 3780317 - DNA, 23 bp, Homo sapiens
agcaattccatgctataaaaact

SEQ ID NO: 3780318 - DNA, 17 bp, Homo sapiens
agcaattgctgcatctt

SEQ ID NO: 3780319 - DNA, 16 bp, Homo sapiens
agcaattgtgtggtca

SEQ ID NO: 3780320 - DNA, 20 bp, Homo sapiens
agcaatttatacaatatcat

SEQ ID NO: 3780321 - DNA, 21 bp, Homo sapiens
agcaatttcgccgttgaagag

SEQ ID NO: 3780322 - DNA, 16 bp, Homo sapiens
agcacaaaagcctctc

SEQ ID NO: 3780323 - DNA, 19 bp, Homo sapiens
agcacactgtagcattaca

SEQ ID NO: 3780324 - DNA, 15 bp, Homo sapiens
agcacagaaaactag

SEQ ID NO: 3780325 - DNA, 23 bp, Homo sapiens
agcacagagagggggccacctcc

SEQ ID NO: 3780326 - DNA, 14 bp, Homo sapiens
agcacagtgcctgc

SEQ ID NO: 3780327 - DNA, 15 bp, Homo sapiens
agcacagtgcctgca

SEQ ID NO: 3780328 - DNA, 14 bp, Homo sapiens
agcacatccaggca

SEQ ID NO: 3780329 - DNA, 23 bp, Homo sapiens
agcacatctgcattttcacccca

SEQ ID NO: 3780330 - DNA, 13 bp, Homo sapiens
agcaccagggaag

SEQ ID NO: 3780331 - DNA, 20 bp, Homo sapiens
agcacccccacgccctcatt

SEQ ID NO: 3780332 - DNA, 14 bp, Homo sapiens
agcacctcccagcc

SEQ ID NO: 3780333 - DNA, 16 bp, Homo sapiens
agcacctcccagcccc

SEQ ID NO: 3780334 - DNA, 22 bp, Homo sapiens
agcacctcccagcccctgcccc

SEQ ID NO: 3780335 - DNA, 16 bp, Homo sapiens
agcacctgccgacctc

SEQ ID NO: 3780336 - DNA, 19 bp, Homo sapiens
agcacctgccgacctcgtc

SEQ ID NO: 3780337 - DNA, 14 bp, Homo sapiens
agcactaaagcagt

SEQ ID NO: 3780338 - DNA, 20 bp, Homo sapiens
agcactaaagcagtggacac

SEQ ID NO: 3780339 - DNA, 16 bp, Homo sapiens
agcactaacgtaaata

SEQ ID NO: 3780340 - DNA, 19 bp, Homo sapiens
agcactaaggtgtgctctg

SEQ ID NO: 3780341 - DNA, 19 bp, Homo sapiens
agcactcctccctgatgta

SEQ ID NO: 3780342 - DNA, 19 bp, Homo sapiens
agcactctgagtttaccat

SEQ ID NO: 3780343 - DNA, 16 bp, Homo sapiens
agcactgagcaaagca

SEQ ID NO: 3780344 - DNA, 12 bp, Homo sapiens
agcactgtatac

SEQ ID NO: 3780345 - DNA, 20 bp, Homo sapiens
agcactgtctcagtttcact

SEQ ID NO: 3780346 - DNA, 17 bp, Homo sapiens
agcacttggagccaagg

SEQ ID NO: 3780347 - DNA, 16 bp, Homo sapiens
agcactttcattgcca

SEQ ID NO: 3780348 - DNA, 19 bp, Homo sapiens
agcactttcattgccagtg

SEQ ID NO: 3780349 - DNA, 23 bp, Homo sapiens
agcactttgggaggccaaggtgg

SEQ ID NO: 3780350 - DNA, 16 bp, Homo sapiens
agcactttgggaggct

SEQ ID NO: 3780351 - DNA, 19 bp, Homo sapiens
agcagactggtgagcagac

SEQ ID NO: 3780352 - DNA, 22 bp, Homo sapiens
agcagagaatgaaagggcccag

SEQ ID NO: 3780353 - DNA, 15 bp, Homo sapiens
agcagagacactaac

SEQ ID NO: 3780354 - DNA, 16 bp, Homo sapiens
agcagatcccagctca

SEQ ID NO: 3780355 - DNA, 17 bp, Homo sapiens
agcagatgacccctccc

SEQ ID NO: 3780356 - DNA, 17 bp, Homo sapiens
agcagatgcaaagaggc

SEQ ID NO: 3780357 - DNA, 20 bp, Homo sapiens
agcagattggagaaaccctt

SEQ ID NO: 3780358 - DNA, 16 bp, Homo sapiens
agcagcaacacaatgt

SEQ ID NO: 3780359 - DNA, 18 bp, Homo sapiens
agcagccctcctcacccc

SEQ ID NO: 3780360 - DNA, 13 bp, Homo sapiens
agcagcctgtggc

SEQ ID NO: 3780361 - DNA, 17 bp, Homo sapiens
agcagcggtttggggag

SEQ ID NO: 3780362 - DNA, 23 bp, Homo sapiens
agcagcggtttggggagcagaga

SEQ ID NO: 3780363 - DNA, 19 bp, Homo sapiens
agcagctatctctcagtga

SEQ ID NO: 3780364 - DNA, 20 bp, Homo sapiens
agcagctcaaaggcacagtg

SEQ ID NO: 3780365 - DNA, 13 bp, Homo sapiens
agcagctcaggca

SEQ ID NO: 3780366 - DNA, 22 bp, Homo sapiens
agcaggatagttgctccgcctc

SEQ ID NO: 3780367 - DNA, 16 bp, Homo sapiens
agcaggcacatggagg

SEQ ID NO: 3780368 - DNA, 15 bp, Homo sapiens
agcagggaaacagct

SEQ ID NO: 3780369 - DNA, 20 bp, Homo sapiens
agcagggagggcttctgcca

SEQ ID NO: 3780370 - DNA, 18 bp, Homo sapiens
agcagggtagtctggttt

SEQ ID NO: 3780371 - DNA, 14 bp, Homo sapiens
agcaggtggggagg

SEQ ID NO: 3780372 - DNA, 21 bp, Homo sapiens
agcaggttgaggggctcctgg

SEQ ID NO: 3780373 - DNA, 22 bp, Homo sapiens
agcaggttgaggggctcctgga

SEQ ID NO: 3780374 - DNA, 17 bp, Homo sapiens
agcaggtttttctcctc

SEQ ID NO: 3780375 - DNA, 15 bp, Homo sapiens
agcagtaaaaactgt

SEQ ID NO: 3780376 - DNA, 17 bp, Homo sapiens
agcagtgccttccataa

SEQ ID NO: 3780377 - DNA, 20 bp, Homo sapiens
agcagtgccttccataatta

SEQ ID NO: 3780378 - DNA, 17 bp, Homo sapiens
agcagtgtcttccataa

SEQ ID NO: 3780379 - DNA, 15 bp, Homo sapiens
agcagtgtgtctcct

SEQ ID NO: 3780380 - DNA, 16 bp, Homo sapiens
agcagttctgcaaata

SEQ ID NO: 3780381 - DNA, 17 bp, Homo sapiens
agcagttgttattacat

SEQ ID NO: 3780382 - DNA, 15 bp, Homo sapiens
agcagtttgaaattg

SEQ ID NO: 3780383 - DNA, 14 bp, Homo sapiens
agcagtttgctttg

SEQ ID NO: 3780384 - DNA, 23 bp, Homo sapiens
agcataagtttctgggacctcag

SEQ ID NO: 3780385 - DNA, 13 bp, Homo sapiens
agcatacatttat

SEQ ID NO: 3780386 - DNA, 16 bp, Homo sapiens
agcatcacctcaggcc

SEQ ID NO: 3780387 - DNA, 15 bp, Homo sapiens
agcatcctcagttcc

SEQ ID NO: 3780388 - DNA, 13 bp, Homo sapiens
agcatcctggcac

SEQ ID NO: 3780389 - DNA, 14 bp, Homo sapiens
agcatcctggcacc

SEQ ID NO: 3780390 - DNA, 23 bp, Homo sapiens
agcatctcctgaggatcagaaag

SEQ ID NO: 3780391 - DNA, 19 bp, Homo sapiens
agcatctcttgaggccagg

SEQ ID NO: 3780392 - DNA, 22 bp, Homo sapiens
agcatctcttgaggccaggagt

SEQ ID NO: 3780393 - DNA, 23 bp, Homo sapiens
agcatcttcacttctaaatgcat

SEQ ID NO: 3780394 - DNA, 12 bp, Homo sapiens
agcatgaagaca

SEQ ID NO: 3780395 - DNA, 22 bp, Homo sapiens
agcatgacctgtgaccagcact

SEQ ID NO: 3780396 - DNA, 19 bp, Homo sapiens
agcatgcacaaagtgtatt

SEQ ID NO: 3780397 - DNA, 18 bp, Homo sapiens
aggaactgggcctgttgc

SEQ ID NO: 3780398 - DNA, 14 bp, Homo sapiens
aggaagagaaacca

SEQ ID NO: 3780399 - DNA, 23 bp, Homo sapiens
aggaagagcaggcacatggagga

SEQ ID NO: 3780400 - DNA, 17 bp, Homo sapiens
aggaagctcagactggt

SEQ ID NO: 3780401 - DNA, 19 bp, Homo sapiens
aggaagctccagtcctgct

SEQ ID NO: 3780402 - DNA, 20 bp, Homo sapiens
aggaagctccagtcctgctc

SEQ ID NO: 3780403 - DNA, 17 bp, Homo sapiens
aggaagctttctctgct

SEQ ID NO: 3780404 - DNA, 18 bp, Homo sapiens
aggaagctttctctgctt

SEQ ID NO: 3780405 - DNA, 12 bp, Homo sapiens
aggaaggaaaga

SEQ ID NO: 3780406 - DNA, 19 bp, Homo sapiens
aggaaggagactcacctct

SEQ ID NO: 3780407 - DNA, 18 bp, Homo sapiens
aggaaggagagcctgctg

SEQ ID NO: 3780408 - DNA, 14 bp, Homo sapiens
aggaaggatgagca

SEQ ID NO: 3780409 - DNA, 15 bp, Homo sapiens
aggaaggctgagagg

SEQ ID NO: 3780410 - DNA, 22 bp, Homo sapiens
aggaaggctgagaggagagaga

SEQ ID NO: 3780411 - DNA, 16 bp, Homo sapiens
aggaaggggctggact

SEQ ID NO: 3780412 - DNA, 17 bp, Homo sapiens
aggaagtctaggagctg

SEQ ID NO: 3780413 - DNA, 21 bp, Homo sapiens
aggaataaataaaaatggata

SEQ ID NO: 3780414 - DNA, 14 bp, Homo sapiens
aggaataaggcctt

SEQ ID NO: 3780415 - DNA, 18 bp, Homo sapiens
aggaatagcatgtcacta

SEQ ID NO: 3780416 - DNA, 20 bp, Homo sapiens
aggaatatgacggaagaaca

SEQ ID NO: 3780417 - DNA, 22 bp, Homo sapiens
aggaatatgacggaagaacata

SEQ ID NO: 3780418 - DNA, 15 bp, Homo sapiens
aggaatcaacagggc

SEQ ID NO: 3780419 - DNA, 19 bp, Homo sapiens
aggaatcgaggaaccagag

SEQ ID NO: 3780420 - DNA, 20 bp, Homo sapiens
aggaatcgaggaaccagagc

SEQ ID NO: 3780421 - DNA, 16 bp, Homo sapiens
aggaatgcctgtgcca

SEQ ID NO: 3780422 - DNA, 21 bp, Homo sapiens
aggaatgcctgtgccaataaa

SEQ ID NO: 3780423 - DNA, 20 bp, Homo sapiens
aggaatgctaacagttcact

SEQ ID NO: 3780424 - DNA, 12 bp, Homo sapiens
aggaatgctccc

SEQ ID NO: 3780425 - DNA, 13 bp, Homo sapiens
aggaatgctcccc

SEQ ID NO: 3780426 - DNA, 14 bp, Homo sapiens
aggaatgctccccc

SEQ ID NO: 3780427 - DNA, 18 bp, Homo sapiens
aggaatggaggctctaat

SEQ ID NO: 3780428 - DNA, 18 bp, Homo sapiens
aggaatgtagctggtttc

SEQ ID NO: 3780429 - DNA, 15 bp, Homo sapiens
aggaatgtctttggt

SEQ ID NO: 3780430 - DNA, 22 bp, Homo sapiens
aggaatgttaaagtcagtggga

SEQ ID NO: 3780431 - DNA, 22 bp, Homo sapiens
aggaattcccagcccaaagctg

SEQ ID NO: 3780432 - DNA, 12 bp, Homo sapiens
aggaattgactt

SEQ ID NO: 3780433 - DNA, 19 bp, Homo sapiens
aggaatttgaagctgcagt

SEQ ID NO: 3780434 - DNA, 14 bp, Homo sapiens
aggaattttctttg

SEQ ID NO: 3780435 - DNA, 16 bp, Homo sapiens
aggaattttctttgtg

SEQ ID NO: 3780436 - DNA, 14 bp, Homo sapiens
aggacaaccattcc

SEQ ID NO: 3780437 - DNA, 14 bp, Homo sapiens
aggacaacgaggaa

SEQ ID NO: 3780438 - DNA, 16 bp, Homo sapiens
aggacaacgaggaagc

SEQ ID NO: 3780439 - DNA, 17 bp, Homo sapiens
aggacaacgaggaagcc

SEQ ID NO: 3780440 - DNA, 19 bp, Homo sapiens
aggacacctgtactggaga

SEQ ID NO: 3780441 - DNA, 16 bp, Homo sapiens
aggacaggcagaaaga

SEQ ID NO: 3780442 - DNA, 17 bp, Homo sapiens
aggacagtgcttcagcc

SEQ ID NO: 3780443 - DNA, 22 bp, Homo sapiens
aggacagtgcttcagcctgagg

SEQ ID NO: 3780444 - DNA, 20 bp, Homo sapiens
aggacataaattagaggtct

SEQ ID NO: 3780445 - DNA, 21 bp, Homo sapiens
aggacatgatggagcgcacct

SEQ ID NO: 3780446 - DNA, 16 bp, Homo sapiens
aggacatgttcccttc

SEQ ID NO: 3780447 - DNA, 17 bp, Homo sapiens
aggacattgcggacagc

SEQ ID NO: 3780448 - DNA, 22 bp, Homo sapiens
aggaccactcctgtacactgaa

SEQ ID NO: 3780449 - DNA, 21 bp, Homo sapiens
aggacccggaggggcctggca

SEQ ID NO: 3780450 - DNA, 19 bp, Homo sapiens
aggacctagggatgttctg

SEQ ID NO: 3780451 - DNA, 13 bp, Homo sapiens
aggacctcaggtg

SEQ ID NO: 3780452 - DNA, 14 bp, Homo sapiens
aggacctcaggtga

SEQ ID NO: 3780453 - DNA, 14 bp, Homo sapiens
aggacctctgggct

SEQ ID NO: 3780454 - DNA, 18 bp, Homo sapiens
aggactccctcctcacct

SEQ ID NO: 3780455 - DNA, 19 bp, Homo sapiens
aggactccctcctcacctc

SEQ ID NO: 3780456 - DNA, 13 bp, Homo sapiens
aggactctgaggc

SEQ ID NO: 3780457 - DNA, 17 bp, Homo sapiens
aggactgaattgtcccc

SEQ ID NO: 3780458 - DNA, 20 bp, Homo sapiens
aggactgaattgtccccagt

SEQ ID NO: 3780459 - DNA, 19 bp, Homo sapiens
aggactgcaccattgctgc

SEQ ID NO: 3780460 - DNA, 20 bp, Homo sapiens
aggactgcaccattgctgct

SEQ ID NO: 3780461 - DNA, 13 bp, Homo sapiens
aggactgccgacc

SEQ ID NO: 3780462 - DNA, 17 bp, Homo sapiens
aggactggattggccaa

SEQ ID NO: 3780463 - DNA, 18 bp, Homo sapiens
aggactgttttttcctga

SEQ ID NO: 3780464 - DNA, 21 bp, Homo sapiens
aggactgttttttcctgagct

SEQ ID NO: 3780465 - DNA, 13 bp, Homo sapiens
aggacttgccctc

SEQ ID NO: 3780466 - DNA, 20 bp, Homo sapiens
aggactttatagatcagcca

SEQ ID NO: 3780467 - DNA, 14 bp, Homo sapiens
aggagaaacacatc

SEQ ID NO: 3780468 - DNA, 12 bp, Homo sapiens
aggagaaggaag

SEQ ID NO: 3780469 - DNA, 15 bp, Homo sapiens
aggagaatgagcctc

SEQ ID NO: 3780470 - DNA, 13 bp, Homo sapiens
aggagaattgctt

SEQ ID NO: 3780471 - DNA, 17 bp, Homo sapiens
aggagaccaaggcggga

SEQ ID NO: 3780472 - DNA, 11 bp, Homo sapiens
aggagactcac

SEQ ID NO: 3780473 - DNA, 15 bp, Homo sapiens
aggagactcacctct

SEQ ID NO: 3780474 - DNA, 23 bp, Homo sapiens
aggagagacggtgttgggagccc

SEQ ID NO: 3780475 - DNA, 14 bp, Homo sapiens
aggagagccagccc

SEQ ID NO: 3780476 - DNA, 15 bp, Homo sapiens
aggagagccagccct

SEQ ID NO: 3780477 - DNA, 15 bp, Homo sapiens
aggagagcctgctgc

SEQ ID NO: 3780478 - DNA, 18 bp, Homo sapiens
aggagagcctgctgcatg

SEQ ID NO: 3780479 - DNA, 12 bp, Homo sapiens
aggagagcctgg

SEQ ID NO: 3780480 - DNA, 13 bp, Homo sapiens
aggagagcctggt

SEQ ID NO: 3780481 - DNA, 15 bp, Homo sapiens
aggagaggagagggg

SEQ ID NO: 3780482 - DNA, 18 bp, Homo sapiens
aggagagggaaaatgttt

SEQ ID NO: 3780483 - DNA, 14 bp, Homo sapiens
aggagaggggcaca

SEQ ID NO: 3780484 - DNA, 17 bp, Homo sapiens
aggagagtcttgcagtg

SEQ ID NO: 3780485 - DNA, 21 bp, Homo sapiens
aggagagtcttgcagtgatta

SEQ ID NO: 3780486 - DNA, 14 bp, Homo sapiens
aggagatgggcctt

SEQ ID NO: 3780487 - DNA, 17 bp, Homo sapiens
aggagccccgaggcctt

SEQ ID NO: 3780488 - DNA, 22 bp, Homo sapiens
aggagccccgaggccttctctg

SEQ ID NO: 3780489 - DNA, 18 bp, Homo sapiens
aggagctgagaatagaag

SEQ ID NO: 3780490 - DNA, 20 bp, Homo sapiens
aggagctgggcagaaggcca

SEQ ID NO: 3780491 - DNA, 17 bp, Homo sapiens
aggagcttacctcccac

SEQ ID NO: 3780492 - DNA, 23 bp, Homo sapiens
aggaggattgcttgagcccagga

SEQ ID NO: 3780493 - DNA, 20 bp, Homo sapiens
aggaggcagaaagcagaggc

SEQ ID NO: 3780494 - DNA, 18 bp, Homo sapiens
aggaggctggaggaaggg

SEQ ID NO: 3780495 - DNA, 13 bp, Homo sapiens
aggaggctggcag

SEQ ID NO: 3780496 - DNA, 13 bp, Homo sapiens
aggaggctggctt

SEQ ID NO: 3780497 - DNA, 20 bp, Homo sapiens
aggaggcttggaaagcatca

SEQ ID NO: 3780498 - DNA, 15 bp, Homo sapiens
aggagggagggggct

SEQ ID NO: 3780499 - DNA, 22 bp, Homo sapiens
aggagggcgtgactcacccaag

SEQ ID NO: 3780500 - DNA, 17 bp, Homo sapiens
aggagggtcaggaagga

SEQ ID NO: 3780501 - DNA, 18 bp, Homo sapiens
aggagggtcaggaaggat

SEQ ID NO: 3780502 - DNA, 18 bp, Homo sapiens
aggagggttagggagggg

SEQ ID NO: 3780503 - DNA, 20 bp, Homo sapiens
aggaggtggaggctgcagtg

SEQ ID NO: 3780504 - DNA, 20 bp, Homo sapiens
aggaggtggaggttgcagtg

SEQ ID NO: 3780505 - DNA, 20 bp, Homo sapiens
aggaggtggcagccctgtag

SEQ ID NO: 3780506 - DNA, 21 bp, Homo sapiens
aggaggtggcagccctgtagg

SEQ ID NO: 3780507 - DNA, 14 bp, Homo sapiens
aggagtcagagaga

SEQ ID NO: 3780508 - DNA, 16 bp, Homo sapiens
aggagtgtggccacgt

SEQ ID NO: 3780509 - DNA, 20 bp, Homo sapiens
aggagttagaggccagcctg

SEQ ID NO: 3780510 - DNA, 15 bp, Homo sapiens
agggttgggctggtg

SEQ ID NO: 3780511 - DNA, 15 bp, Homo sapiens
agggttggggagggg

SEQ ID NO: 3780512 - DNA, 22 bp, Homo sapiens
agggttttgccatgttggccag

SEQ ID NO: 3780513 - DNA, 23 bp, Homo sapiens
agggttttgccatgttggccagg

SEQ ID NO: 3780514 - DNA, 19 bp, Homo sapiens
aggtaaaattctaaataaa

SEQ ID NO: 3780515 - DNA, 19 bp, Homo sapiens
aggtaaaattgaaaggcat

SEQ ID NO: 3780516 - DNA, 14 bp, Homo sapiens
aggtaacaggcaga

SEQ ID NO: 3780517 - DNA, 16 bp, Homo sapiens
aggtaacaggcagata

SEQ ID NO: 3780518 - DNA, 19 bp, Homo sapiens
aggtaccccagctctgctt

SEQ ID NO: 3780519 - DNA, 21 bp, Homo sapiens
aggtaccccagctctgcttgc

SEQ ID NO: 3780520 - DNA, 13 bp, Homo sapiens
aggtactctcctg

SEQ ID NO: 3780521 - DNA, 16 bp, Homo sapiens
aggtagccctggccag

SEQ ID NO: 3780522 - DNA, 21 bp, Homo sapiens
aggtagccctggccagaggct

SEQ ID NO: 3780523 - DNA, 19 bp, Homo sapiens
aggtagctgaaaggggaag

SEQ ID NO: 3780524 - DNA, 21 bp, Homo sapiens
aggtatcattttctgcattta

SEQ ID NO: 3780525 - DNA, 23 bp, Homo sapiens
aggtatgaccttctaggaagctc

SEQ ID NO: 3780526 - DNA, 22 bp, Homo sapiens
aggtatggaagggtttgtggct

SEQ ID NO: 3780527 - DNA, 19 bp, Homo sapiens
aggtcaacagagaaggcag

SEQ ID NO: 3780528 - DNA, 21 bp, Homo sapiens
aggtcaaggctgcagtgagcc

SEQ ID NO: 3780529 - DNA, 22 bp, Homo sapiens
aggtcaagtaagaagacatgaa

SEQ ID NO: 3780530 - DNA, 23 bp, Homo sapiens
aggtcaatacagtacaggcagca

SEQ ID NO: 3780531 - DNA, 12 bp, Homo sapiens
aggtcagagcct

SEQ ID NO: 3780532 - DNA, 15 bp, Homo sapiens
aggtcagagcctgca

SEQ ID NO: 3780533 - DNA, 15 bp, Homo sapiens
aggtcagtacccacc

SEQ ID NO: 3780534 - DNA, 16 bp, Homo sapiens
aggtccaatttgtaaa

SEQ ID NO: 3780535 - DNA, 16 bp, Homo sapiens
aggtcccaaggcaagg

SEQ ID NO: 3780536 - DNA, 12 bp, Homo sapiens
aggtcccaggca

SEQ ID NO: 3780537 - DNA, 22 bp, Homo sapiens
aggtcctgggggcctgacctcc

SEQ ID NO: 3780538 - DNA, 14 bp, Homo sapiens
aggtcgaggcagga

SEQ ID NO: 3780539 - DNA, 14 bp, Homo sapiens
aggtcgggctcagc

SEQ ID NO: 3780540 - DNA, 21 bp, Homo sapiens
aggtctccccatgtgcctgca

SEQ ID NO: 3780541 - DNA, 16 bp, Homo sapiens
aggtctctctttggac

SEQ ID NO: 3780542 - DNA, 15 bp, Homo sapiens
aggtctgaaatggag

SEQ ID NO: 3780543 - DNA, 20 bp, Homo sapiens
aggtctgacacgtctgccta

SEQ ID NO: 3780544 - DNA, 19 bp, Homo sapiens
aggtctgggagaggcagag

SEQ ID NO: 3780545 - DNA, 22 bp, Homo sapiens
aggtctgggagaggcagagtgc

SEQ ID NO: 3780546 - DNA, 16 bp, Homo sapiens
aggtcttgaactcctg

SEQ ID NO: 3780547 - DNA, 23 bp, Homo sapiens
aggtcttgaactcctggcctcaa

SEQ ID NO: 3780548 - DNA, 19 bp, Homo sapiens
aggtcttttgacatgtgga

SEQ ID NO: 3780549 - DNA, 21 bp, Homo sapiens
aggtgaaagggagctatcagg

SEQ ID NO: 3780550 - DNA, 13 bp, Homo sapiens
aggtgaccccagg

SEQ ID NO: 3780551 - DNA, 14 bp, Homo sapiens
aggtgatccaccca

SEQ ID NO: 3780552 - DNA, 11 bp, Homo sapiens
aggtgcagtgg

SEQ ID NO: 3780553 - DNA, 16 bp, Homo sapiens
aggtgcagtggctcac

SEQ ID NO: 3780554 - DNA, 21 bp, Homo sapiens
aggtgcatctggggaactaga

SEQ ID NO: 3780555 - DNA, 17 bp, Homo sapiens
aggtgcccctctctcca

SEQ ID NO: 3780556 - DNA, 18 bp, Homo sapiens
aggtgcctgtgaggcagg

SEQ ID NO: 3780557 - DNA, 20 bp, Homo sapiens
aggtgcctgtgaggcagggg

SEQ ID NO: 3780558 - DNA, 22 bp, Homo sapiens
aggtgcctgtgaggcaggggcg

SEQ ID NO: 3780559 - DNA, 22 bp, Homo sapiens
aggtgccttcttattctcactc

SEQ ID NO: 3780560 - DNA, 23 bp, Homo sapiens
aggtgctaaatggtcgcccagga

SEQ ID NO: 3780561 - DNA, 13 bp, Homo sapiens
aggtgctgggagg

SEQ ID NO: 3780562 - DNA, 23 bp, Homo sapiens
aggtgcttattctcaaagcagga

SEQ ID NO: 3780563 - DNA, 13 bp, Homo sapiens
aggtggaagccct

SEQ ID NO: 3780564 - DNA, 15 bp, Homo sapiens
aggtggaagccctcc

SEQ ID NO: 3780565 - DNA, 21 bp, Homo sapiens
aggtggaagccctccttccac

SEQ ID NO: 3780566 - DNA, 16 bp, Homo sapiens
aggtggatcacagagg

SEQ ID NO: 3780567 - DNA, 17 bp, Homo sapiens
aggtggccactccagac

SEQ ID NO: 3780568 - DNA, 18 bp, Homo sapiens
aggtggctgcctggagcc

SEQ ID NO: 3780569 - DNA, 19 bp, Homo sapiens
aggtgggcactggattagt

SEQ ID NO: 3780570 - DNA, 18 bp, Homo sapiens
aggtgggccagcccctcc

SEQ ID NO: 3780571 - DNA, 22 bp, Homo sapiens
aggtgggccttgctacctcaag

SEQ ID NO: 3780572 - DNA, 18 bp, Homo sapiens
aggtgggctgagccctgg

SEQ ID NO: 3780573 - DNA, 11 bp, Homo sapiens
aggtggggagg

SEQ ID NO: 3780574 - DNA, 22 bp, Homo sapiens
aggtggggagggggtttggggg

SEQ ID NO: 3780575 - DNA, 23 bp, Homo sapiens
aggtggggcagcttgagggttgg

SEQ ID NO: 3780576 - DNA, 14 bp, Homo sapiens
aggtgggggttggc

SEQ ID NO: 3780577 - DNA, 18 bp, Homo sapiens
aggtgggggttggctggg

SEQ ID NO: 3780578 - DNA, 21 bp, Homo sapiens
aggtggggtctttgtgagagt

SEQ ID NO: 3780579 - DNA, 22 bp, Homo sapiens
aggtggggtctttgtgagagtg

SEQ ID NO: 3780580 - DNA, 19 bp, Homo sapiens
aggtgggttttcttcccat

SEQ ID NO: 3780581 - DNA, 21 bp, Homo sapiens
aggtgggttttcttcccatca

SEQ ID NO: 3780582 - DNA, 14 bp, Homo sapiens
aggtggtctgaatg

SEQ ID NO: 3780583 - DNA, 17 bp, Homo sapiens
aggtgtcatttccatta

SEQ ID NO: 3780584 - DNA, 19 bp, Homo sapiens
aggtgtccccagcccactg

SEQ ID NO: 3780585 - DNA, 17 bp, Homo sapiens
aggtgtgaaccaccaca

SEQ ID NO: 3780586 - DNA, 11 bp, Homo sapiens
aggtgtttata

SEQ ID NO: 3780587 - DNA, 14 bp, Homo sapiens
aggtgtttatacag

SEQ ID NO: 3780588 - DNA, 22 bp, Homo sapiens
aggttaactatgtacaatattt

SEQ ID NO: 3780589 - DNA, 16 bp, Homo sapiens
aggttattttctcctg

SEQ ID NO: 3780590 - DNA, 11 bp, Homo sapiens
aggttctaaaa

SEQ ID NO: 3780591 - DNA, 19 bp, Homo sapiens
aggttctggttagctcagc

SEQ ID NO: 3780592 - DNA, 21 bp, Homo sapiens
aggttctggttagctcagccc

SEQ ID NO: 3780593 - DNA, 16 bp, Homo sapiens
aggttcttactgcttg

SEQ ID NO: 3780594 - DNA, 17 bp, Homo sapiens
aggttcttagtgtcact

SEQ ID NO: 3780595 - DNA, 19 bp, Homo sapiens
aggttcttcccttttacat

SEQ ID NO: 3780596 - DNA, 12 bp, Homo sapiens
aggttgcaggga

SEQ ID NO: 3780597 - DNA, 14 bp, Homo sapiens
aggttgcagtgagc

SEQ ID NO: 3780598 - DNA, 18 bp, Homo sapiens
aggttgcagtgagccaag

SEQ ID NO: 3780599 - DNA, 19 bp, Homo sapiens
aggttgggagccaaatgtg

SEQ ID NO: 3780600 - DNA, 17 bp, Homo sapiens
aggttgtaaatgtgttt

SEQ ID NO: 3780601 - DNA, 17 bp, Homo sapiens
aggttgtagtaaagaaa

SEQ ID NO: 3780602 - DNA, 15 bp, Homo sapiens
aggtttaacataaag

SEQ ID NO: 3780603 - DNA, 17 bp, Homo sapiens
aggtttaacataaaggt

SEQ ID NO: 3780604 - DNA, 14 bp, Homo sapiens
aggtttaagctgtt

SEQ ID NO: 3780605 - DNA, 21 bp, Homo sapiens
aggtttgtatgatgtagtttt

SEQ ID NO: 3780606 - DNA, 22 bp, Homo sapiens
aggttttcctcttctattttgt

SEQ ID NO: 3780607 - DNA, 19 bp, Homo sapiens
aggtttttgtttgtttcct

SEQ ID NO: 3780608 - DNA, 22 bp, Homo sapiens
aggtttttttgtatagtaaagt

SEQ ID NO: 3780609 - DNA, 19 bp, Homo sapiens
agtaaaaatacaaaaatta

SEQ ID NO: 3780610 - DNA, 14 bp, Homo sapiens
agtaaaacttgctg

SEQ ID NO: 3780611 - DNA, 14 bp, Homo sapiens
agtaaactatttat

SEQ ID NO: 3780612 - DNA, 13 bp, Homo sapiens
agtaaagaaatga

SEQ ID NO: 3780613 - DNA, 20 bp, Homo sapiens
agtaaagaaatttaaaagac

SEQ ID NO: 3780614 - DNA, 13 bp, Homo sapiens
agtaaagagaaac

SEQ ID NO: 3780615 - DNA, 18 bp, Homo sapiens
agtaaagagaaactttgt

SEQ ID NO: 3780616 - DNA, 19 bp, Homo sapiens
agtaaagtgataatttctg

SEQ ID NO: 3780617 - DNA, 22 bp, Homo sapiens
agtaacaagagtgattcttgct

SEQ ID NO: 3780618 - DNA, 19 bp, Homo sapiens
agtaactgccatcaagatg

SEQ ID NO: 3780619 - DNA, 15 bp, Homo sapiens
agtaacttggttata

SEQ ID NO: 3780620 - DNA, 18 bp, Homo sapiens
agtaacttggttatacat

SEQ ID NO: 3780621 - DNA, 21 bp, Homo sapiens
agtaagaaagtgaagcaaatc

SEQ ID NO: 3780622 - DNA, 16 bp, Homo sapiens
agttcataacagtgcc

SEQ ID NO: 3780623 - DNA, 20 bp, Homo sapiens
agttcataacagtgccattg

SEQ ID NO: 3780624 - DNA, 20 bp, Homo sapiens
agttcatccaatcctcactg

SEQ ID NO: 3780625 - DNA, 14 bp, Homo sapiens
agttccctgaaaac

SEQ ID NO: 3780626 - DNA, 21 bp, Homo sapiens
agttccctgaaaacccagaga

SEQ ID NO: 3780627 - DNA, 24 bp, Homo sapiens
agttccctgaaaacccagagagga

SEQ ID NO: 3780628 - DNA, 15 bp, Homo sapiens
agttcccttggcctc

SEQ ID NO: 3780629 - DNA, 16 bp, Homo sapiens
agttcccttggcctca

SEQ ID NO: 3780630 - DNA, 17 bp, Homo sapiens
agttcccttggcctcag

SEQ ID NO: 3780631 - DNA, 23 bp, Homo sapiens
agttcctcattagcattttgcta

SEQ ID NO: 3780632 - DNA, 12 bp, Homo sapiens
agttcctcgccc

SEQ ID NO: 3780633 - DNA, 14 bp, Homo sapiens
agttcctcgccctg

SEQ ID NO: 3780634 - DNA, 17 bp, Homo sapiens
agttcctcgccctgggt

SEQ ID NO: 3780635 - DNA, 18 bp, Homo sapiens
agttcctgatgacccagg

SEQ ID NO: 3780636 - DNA, 21 bp, Homo sapiens
agttcctgtcccttctcttaa

SEQ ID NO: 3780637 - DNA, 23 bp, Homo sapiens
agttcctgtcccttctcttaatt

SEQ ID NO: 3780638 - DNA, 20 bp, Homo sapiens
agttccttgatctgtatata

SEQ ID NO: 3780639 - DNA, 18 bp, Homo sapiens
agttcgagaccaacctga

SEQ ID NO: 3780640 - DNA, 19 bp, Homo sapiens
agttcgagaccagcctggc

SEQ ID NO: 3780641 - DNA, 15 bp, Homo sapiens
agttctgcaaataga

SEQ ID NO: 3780642 - DNA, 18 bp, Homo sapiens
agttctgcaaatagaaaa

SEQ ID NO: 3780643 - DNA, 17 bp, Homo sapiens
agttctgggtgctccct

SEQ ID NO: 3780644 - DNA, 21 bp, Homo sapiens
agttctgtgtatttaattgta

SEQ ID NO: 3780645 - DNA, 14 bp, Homo sapiens
agttcttagatatc

SEQ ID NO: 3780646 - DNA, 15 bp, Homo sapiens
agttcttagatatct

SEQ ID NO: 3780647 - DNA, 21 bp, Homo sapiens
agttcttagatatctttttat

SEQ ID NO: 3780648 - DNA, 15 bp, Homo sapiens
agttgaggagtttcc

SEQ ID NO: 3780649 - DNA, 16 bp, Homo sapiens
agttgatgttgcattt

SEQ ID NO: 3780650 - DNA, 23 bp, Homo sapiens
agttgattcagctctgcaagaat

SEQ ID NO: 3780651 - DNA, 11 bp, Homo sapiens
agttgcagaaa

SEQ ID NO: 3780652 - DNA, 16 bp, Homo sapiens
agttgcagattcattt

SEQ ID NO: 3780653 - DNA, 20 bp, Homo sapiens
agttgcgacggagagaaaaa

SEQ ID NO: 3780654 - DNA, 21 bp, Homo sapiens
agttgcgacggagagaaaaaa

SEQ ID NO: 3780655 - DNA, 22 bp, Homo sapiens
agttgcgacggagagaaaaaag

SEQ ID NO: 3780656 - DNA, 16 bp, Homo sapiens
agttggctaggacccc

SEQ ID NO: 3780657 - DNA, 15 bp, Homo sapiens
agttggcttctgttt

SEQ ID NO: 3780658 - DNA, 23 bp, Homo sapiens
agttgggaacttcagatggacct

SEQ ID NO: 3780659 - DNA, 13 bp, Homo sapiens
agttgggcttcct

SEQ ID NO: 3780660 - DNA, 17 bp, Homo sapiens
agttggtaagcttccag

SEQ ID NO: 3780661 - DNA, 13 bp, Homo sapiens
agttggtgtgttt

SEQ ID NO: 3780662 - DNA, 23 bp, Homo sapiens
agttggtgtgtttttgggatgtc

SEQ ID NO: 3780663 - DNA, 15 bp, Homo sapiens
agttgtatctctttt

SEQ ID NO: 3780664 - DNA, 16 bp, Homo sapiens
agttgtatctcttttg

SEQ ID NO: 3780665 - DNA, 20 bp, Homo sapiens
agttgtcccgattgtaactc

SEQ ID NO: 3780666 - DNA, 18 bp, Homo sapiens
agttgtgcacatggctta

SEQ ID NO: 3780667 - DNA, 16 bp, Homo sapiens
agttgtgtactctggc

SEQ ID NO: 3780668 - DNA, 18 bp, Homo sapiens
agttgtgtactctggcct

SEQ ID NO: 3780669 - DNA, 19 bp, Homo sapiens
agttgtgtactctggcctc

SEQ ID NO: 3780670 - DNA, 13 bp, Homo sapiens
agttgtttcattg

SEQ ID NO: 3780671 - DNA, 15 bp, Homo sapiens
agttgtttcattgac

SEQ ID NO: 3780672 - DNA, 19 bp, Homo sapiens
agttgttttcagactcaga

SEQ ID NO: 3780673 - DNA, 17 bp, Homo sapiens
agtttaccatttgtaat

SEQ ID NO: 3780674 - DNA, 15 bp, Homo sapiens
agtttactattttac

SEQ ID NO: 3780675 - DNA, 22 bp, Homo sapiens
agtttatacagttttaaagaat

SEQ ID NO: 3780676 - DNA, 22 bp, Homo sapiens
agtttcaagtatccttgttgac

SEQ ID NO: 3780677 - DNA, 16 bp, Homo sapiens
agtttcaattcagtgc

SEQ ID NO: 3780678 - DNA, 13 bp, Homo sapiens
agtttcagacagg

SEQ ID NO: 3780679 - DNA, 14 bp, Homo sapiens
agtttcagacaggg

SEQ ID NO: 3780680 - DNA, 17 bp, Homo sapiens
agtttccaagcaaatgt

SEQ ID NO: 3780681 - DNA, 20 bp, Homo sapiens
agtttccaagcaaatgttac

SEQ ID NO: 3780682 - DNA, 22 bp, Homo sapiens
agtttccaagcaaatgttacat

SEQ ID NO: 3780683 - DNA, 15 bp, Homo sapiens
agtttcctaaaagtt

SEQ ID NO: 3780684 - DNA, 23 bp, Homo sapiens
agtttcctcaggctgctggagga

SEQ ID NO: 3780685 - DNA, 15 bp, Homo sapiens
agtttctcagctccc

SEQ ID NO: 3780686 - DNA, 16 bp, Homo sapiens
agtttcttcaatctga

SEQ ID NO: 3780687 - DNA, 18 bp, Homo sapiens
agtttgagatcagcctgg

SEQ ID NO: 3780688 - DNA, 14 bp, Homo sapiens
agtttgaggctgca

SEQ ID NO: 3780689 - DNA, 13 bp, Homo sapiens
agtttgcagaaaa

SEQ ID NO: 3780690 - DNA, 14 bp, Homo sapiens
agtttgcagaaaag

SEQ ID NO: 3780691 - DNA, 21 bp, Homo sapiens
agtttgccctggtttcactgg

SEQ ID NO: 3780692 - DNA, 20 bp, Homo sapiens
agtttgggggttttgctgtt

SEQ ID NO: 3780693 - DNA, 19 bp, Homo sapiens
agtttgtgaatgtgactac

SEQ ID NO: 3780694 - DNA, 13 bp, Homo sapiens
agtttgtgatttt

SEQ ID NO: 3780695 - DNA, 19 bp, Homo sapiens
agtttgtgattttacattt

SEQ ID NO: 3780696 - DNA, 18 bp, Homo sapiens
agttttaactagaattta

SEQ ID NO: 3780697 - DNA, 13 bp, Homo sapiens
agttttacagatt

SEQ ID NO: 3780698 - DNA, 20 bp, Homo sapiens
agttttacagattgcctcct

SEQ ID NO: 3780699 - DNA, 22 bp, Homo sapiens
agttttcactcttattgcccac

SEQ ID NO: 3780700 - DNA, 21 bp, Homo sapiens
agttttcagaacctcttcccc

SEQ ID NO: 3780701 - DNA, 12 bp, Homo sapiens
agttttccatga

SEQ ID NO: 3780702 - DNA, 13 bp, Homo sapiens
agttttccatgaa

SEQ ID NO: 3780703 - DNA, 16 bp, Homo sapiens
agttttccatgaaaac

SEQ ID NO: 3780704 - DNA, 12 bp, Homo sapiens
agttttccttct

SEQ ID NO: 3780705 - DNA, 14 bp, Homo sapiens
agttttccttctca

SEQ ID NO: 3780706 - DNA, 18 bp, Homo sapiens
agttttccttctcatctg

SEQ ID NO: 3780707 - DNA, 16 bp, Homo sapiens
agttttgcatttatgg

SEQ ID NO: 3780708 - DNA, 19 bp, Homo sapiens
agttttgccagaacagttt

SEQ ID NO: 3780709 - DNA, 16 bp, Homo sapiens
agtttttactttctgt

SEQ ID NO: 3780710 - DNA, 17 bp, Homo sapiens
agtttttatggggctga

SEQ ID NO: 3780711 - DNA, 18 bp, Homo sapiens
agtttttattccttgtga

SEQ ID NO: 3780712 - DNA, 16 bp, Homo sapiens
agtttttgatagcttt

SEQ ID NO: 3780713 - DNA, 18 bp, Homo sapiens
agttttttctcttgggct

SEQ ID NO: 3780714 - DNA, 14 bp, Homo sapiens
ataaaaaagtctct

SEQ ID NO: 3780715 - DNA, 16 bp, Homo sapiens
ataaaaaagtctctat

SEQ ID NO: 3780716 - DNA, 14 bp, Homo sapiens
ataaaaaataataa

SEQ ID NO: 3780717 - DNA, 18 bp, Homo sapiens
ataaaaaattttgtaatt

SEQ ID NO: 3780718 - DNA, 13 bp, Homo sapiens
ataaaaataaatt

SEQ ID NO: 3780719 - DNA, 20 bp, Homo sapiens
ataaaacattttcacacaat

SEQ ID NO: 3780720 - DNA, 13 bp, Homo sapiens
ataaaacctttca

SEQ ID NO: 3780721 - DNA, 20 bp, Homo sapiens
ataaaacctttcaaatttca

SEQ ID NO: 3780722 - DNA, 17 bp, Homo sapiens
ataaaactttgctgcca

SEQ ID NO: 3780723 - DNA, 21 bp, Homo sapiens
ataaaagaaatgcacaatgtc

SEQ ID NO: 3780724 - DNA, 18 bp, Homo sapiens
ataaaagatacatttgta

SEQ ID NO: 3780725 - DNA, 15 bp, Homo sapiens
ataaaagcataaatg

SEQ ID NO: 3780726 - DNA, 16 bp, Homo sapiens
ataaaagttgcaaagg

SEQ ID NO: 3780727 - DNA, 13 bp, Homo sapiens
ataaaatatcatt

SEQ ID NO: 3780728 - DNA, 17 bp, Homo sapiens
ataaaatatcattcagc

SEQ ID NO: 3780729 - DNA, 20 bp, Homo sapiens
ataaaatatcattcagcaac

SEQ ID NO: 3780730 - DNA, 18 bp, Homo sapiens
ataaaatcatgtacattt

SEQ ID NO: 3780731 - DNA, 22 bp, Homo sapiens
ataaaatggtgttttcatgtaa

SEQ ID NO: 3780732 - DNA, 20 bp, Homo sapiens
ataaaatgtgatttttctga

SEQ ID NO: 3780733 - DNA, 18 bp, Homo sapiens
ataaaattaaagaaaata

SEQ ID NO: 3780734 - DNA, 16 bp, Homo sapiens
ataaaattaaagctga

SEQ ID NO: 3780735 - DNA, 19 bp, Homo sapiens
atcaatttgtcattttgaa

SEQ ID NO: 3780736 - DNA, 21 bp, Homo sapiens
atcacagcctctgaaaaccaa

SEQ ID NO: 3780737 - DNA, 12 bp, Homo sapiens
atcacagggcag

SEQ ID NO: 3780738 - DNA, 15 bp, Homo sapiens
atcacagggcagagc

SEQ ID NO: 3780739 - DNA, 16 bp, Homo sapiens
atcacagggccccaga

SEQ ID NO: 3780740 - DNA, 21 bp, Homo sapiens
atcacagggccccagaaggca

SEQ ID NO: 3780741 - DNA, 23 bp, Homo sapiens
atcacagggttgggcccagatct

SEQ ID NO: 3780742 - DNA, 17 bp, Homo sapiens
atcacatagtgaaagtt

SEQ ID NO: 3780743 - DNA, 22 bp, Homo sapiens
atcacattatttgcatgttacc

SEQ ID NO: 3780744 - DNA, 13 bp, Homo sapiens
atcaccagacagg

SEQ ID NO: 3780745 - DNA, 15 bp, Homo sapiens
atcacctcccctcct

SEQ ID NO: 3780746 - DNA, 17 bp, Homo sapiens
atcacgccactgcacta

SEQ ID NO: 3780747 - DNA, 15 bp, Homo sapiens
atcacggctcactgc

SEQ ID NO: 3780748 - DNA, 18 bp, Homo sapiens
atcacggctcactgcagc

SEQ ID NO: 3780749 - DNA, 22 bp, Homo sapiens
atcacggctcactgcagcctca

SEQ ID NO: 3780750 - DNA, 17 bp, Homo sapiens
atcactggagcccagga

SEQ ID NO: 3780751 - DNA, 16 bp, Homo sapiens
atcactggcaatgaaa

SEQ ID NO: 3780752 - DNA, 23 bp, Homo sapiens
atcactggcaatgaaaaattctc

SEQ ID NO: 3780753 - DNA, 19 bp, Homo sapiens
atcacttgaggtcaggagt

SEQ ID NO: 3780754 - DNA, 21 bp, Homo sapiens
atcacttgtacaaaataaaca

SEQ ID NO: 3780755 - DNA, 23 bp, Homo sapiens
atcagaaatgtctggagaataat

SEQ ID NO: 3780756 - DNA, 13 bp, Homo sapiens
atcagaacagcag

SEQ ID NO: 3780757 - DNA, 17 bp, Homo sapiens
atcagaagcctattgta

SEQ ID NO: 3780758 - DNA, 14 bp, Homo sapiens
atcagaccctaccc

SEQ ID NO: 3780759 - DNA, 18 bp, Homo sapiens
atcagaccctaccccacc

SEQ ID NO: 3780760 - DNA, 15 bp, Homo sapiens
atcagacctgtcttc

SEQ ID NO: 3780761 - DNA, 22 bp, Homo sapiens
atcagatcatttcaaaactcat

SEQ ID NO: 3780762 - DNA, 15 bp, Homo sapiens
atcagccacattcta

SEQ ID NO: 3780763 - DNA, 16 bp, Homo sapiens
atcagcctacaggcct

SEQ ID NO: 3780764 - DNA, 11 bp, Homo sapiens
atcagcctctt

SEQ ID NO: 3780765 - DNA, 18 bp, Homo sapiens
atcagcctgctccagctg

SEQ ID NO: 3780766 - DNA, 20 bp, Homo sapiens
atcagcctgggcaatgtgat

SEQ ID NO: 3780767 - DNA, 21 bp, Homo sapiens
atcagcctgggcaatgtgata

SEQ ID NO: 3780768 - DNA, 21 bp, Homo sapiens
atcagctagcaaaagaagtaa

SEQ ID NO: 3780769 - DNA, 18 bp, Homo sapiens
atcagggaggtcattttg

SEQ ID NO: 3780770 - DNA, 16 bp, Homo sapiens
atcaggtcctcagaga

SEQ ID NO: 3780771 - DNA, 20 bp, Homo sapiens
atcaggtcctcagagaattt

SEQ ID NO: 3780772 - DNA, 19 bp, Homo sapiens
atcagtcataactaaataa

SEQ ID NO: 3780773 - DNA, 19 bp, Homo sapiens
atcagtgttaaaaaatttt

SEQ ID NO: 3780774 - DNA, 15 bp, Homo sapiens
atcagttactcagcc

SEQ ID NO: 3780775 - DNA, 21 bp, Homo sapiens
atcagttactcagccctgggc

SEQ ID NO: 3780776 - DNA, 18 bp, Homo sapiens
atcagttactctgaaggg

SEQ ID NO: 3780777 - DNA, 19 bp, Homo sapiens
atcagttgcgcgttctgaa

SEQ ID NO: 3780778 - DNA, 13 bp, Homo sapiens
atcataaaataaa

SEQ ID NO: 3780779 - DNA, 16 bp, Homo sapiens
atcataaactgtgtgc

SEQ ID NO: 3780780 - DNA, 12 bp, Homo sapiens
atcatagaaatg

SEQ ID NO: 3780781 - DNA, 17 bp, Homo sapiens
atcatagatttctgatt

SEQ ID NO: 3780782 - DNA, 20 bp, Homo sapiens
atcatagatttctgatttta

SEQ ID NO: 3780783 - DNA, 12 bp, Homo sapiens
atcatagtacag

SEQ ID NO: 3780784 - DNA, 23 bp, Homo sapiens
atcatccactgtgccatgtgcca

SEQ ID NO: 3780785 - DNA, 15 bp, Homo sapiens
atcatcctaagctat

SEQ ID NO: 3780786 - DNA, 15 bp, Homo sapiens
atcatgaaatatgca

SEQ ID NO: 3780787 - DNA, 19 bp, Homo sapiens
atcatgcaaatgctgtatt

SEQ ID NO: 3780788 - DNA, 19 bp, Homo sapiens
atcatggctaagcttaaaa

SEQ ID NO: 3780789 - DNA, 14 bp, Homo sapiens
atcatgtacatttc

SEQ ID NO: 3780790 - DNA, 18 bp, Homo sapiens
atcatgttaatcctagct

SEQ ID NO: 3780791 - DNA, 22 bp, Homo sapiens
atcatgttatgataaaaaattt

SEQ ID NO: 3780792 - DNA, 20 bp, Homo sapiens
atcattataactgaaggaga

SEQ ID NO: 3780793 - DNA, 11 bp, Homo sapiens
atcattgctta

SEQ ID NO: 3780794 - DNA, 17 bp, Homo sapiens
atcatttgaacaactag

SEQ ID NO: 3780795 - DNA, 13 bp, Homo sapiens
atcattttccccc

SEQ ID NO: 3780796 - DNA, 15 bp, Homo sapiens
atcattttcccccca

SEQ ID NO: 3780797 - DNA, 22 bp, Homo sapiens
atccaatgctcaagaaacaact

SEQ ID NO: 3780798 - DNA, 16 bp, Homo sapiens
atccacacacagagga

SEQ ID NO: 3780799 - DNA, 15 bp, Homo sapiens
atccacccacctcag

SEQ ID NO: 3780800 - DNA, 14 bp, Homo sapiens
atccacccagccca

SEQ ID NO: 3780801 - DNA, 15 bp, Homo sapiens
atccacccagcccat

SEQ ID NO: 3780802 - DNA, 13 bp, Homo sapiens
atccacctgtctc

SEQ ID NO: 3780803 - DNA, 16 bp, Homo sapiens
atccactctaccctcc

SEQ ID NO: 3780804 - DNA, 18 bp, Homo sapiens
atccactctaccctccca

SEQ ID NO: 3780805 - DNA, 19 bp, Homo sapiens
atccactctaccctcccac

SEQ ID NO: 3780806 - DNA, 20 bp, Homo sapiens
atccactctaccctcccacc

SEQ ID NO: 3780807 - DNA, 13 bp, Homo sapiens
atccagaaagaaa

SEQ ID NO: 3780808 - DNA, 14 bp, Homo sapiens
atccagaaagaaaa

SEQ ID NO: 3780809 - DNA, 15 bp, Homo sapiens
atccagaaagaaaaa

SEQ ID NO: 3780810 - DNA, 19 bp, Homo sapiens
atccagccggaggccagag

SEQ ID NO: 3780811 - DNA, 17 bp, Homo sapiens
atccaggttcagcttgt

SEQ ID NO: 3780812 - DNA, 16 bp, Homo sapiens
atccagtacatttaat

SEQ ID NO: 3780813 - DNA, 18 bp, Homo sapiens
atccagtacatttaattg

SEQ ID NO: 3780814 - DNA, 14 bp, Homo sapiens
atccatccatctcc

SEQ ID NO: 3780815 - DNA, 15 bp, Homo sapiens
atccatccatctcca

SEQ ID NO: 3780816 - DNA, 16 bp, Homo sapiens
atccatgggggcaggg

SEQ ID NO: 3780817 - DNA, 20 bp, Homo sapiens
atccatgtactgtagttttt

SEQ ID NO: 3780818 - DNA, 22 bp, Homo sapiens
atccatgtactgtagtttttct

SEQ ID NO: 3780819 - DNA, 20 bp, Homo sapiens
atccatgttagtttttactt

SEQ ID NO: 3780820 - DNA, 14 bp, Homo sapiens
atccattcctcagg

SEQ ID NO: 3780821 - DNA, 22 bp, Homo sapiens
atccattcctcagggacagaga

SEQ ID NO: 3780822 - DNA, 22 bp, Homo sapiens
atccatttcatctatttctgag

SEQ ID NO: 3780823 - DNA, 15 bp, Homo sapiens
atcccaagtgccagt

SEQ ID NO: 3780824 - DNA, 23 bp, Homo sapiens
atcccacggaaaatgccaatctc

SEQ ID NO: 3780825 - DNA, 19 bp, Homo sapiens
atcccagcactttgggagg

SEQ ID NO: 3780826 - DNA, 22 bp, Homo sapiens
atcccagcactttgggaggctg

SEQ ID NO: 3780827 - DNA, 17 bp, Homo sapiens
atcccagctactcagga

SEQ ID NO: 3780828 - DNA, 18 bp, Homo sapiens
atcccagctactcaggag

SEQ ID NO: 3780829 - DNA, 20 bp, Homo sapiens
atcccagctactcaggaggc

SEQ ID NO: 3780830 - DNA, 13 bp, Homo sapiens
atcccagctcacg

SEQ ID NO: 3780831 - DNA, 20 bp, Homo sapiens
atcccaggggaccacacctc

SEQ ID NO: 3780832 - DNA, 11 bp, Homo sapiens
atcccatccca

SEQ ID NO: 3780833 - DNA, 13 bp, Homo sapiens
atcccatcccatc

SEQ ID NO: 3780834 - DNA, 14 bp, Homo sapiens
atcccatcccatcc

SEQ ID NO: 3780835 - DNA, 15 bp, Homo sapiens
atcccatcccatccc

SEQ ID NO: 3780836 - DNA, 15 bp, Homo sapiens
atcccatcccgctct

SEQ ID NO: 3780837 - DNA, 13 bp, Homo sapiens
atcccatgagcct

SEQ ID NO: 3780838 - DNA, 17 bp, Homo sapiens
atcccatgagcctcagc

SEQ ID NO: 3780839 - DNA, 14 bp, Homo sapiens
atcccattgccctg

SEQ ID NO: 3780840 - DNA, 14 bp, Homo sapiens
atcccatttaaaaa

SEQ ID NO: 3780841 - DNA, 13 bp, Homo sapiens
atccccacccttg

SEQ ID NO: 3780842 - DNA, 23 bp, Homo sapiens
atccccaggggtcccagccaccc

SEQ ID NO: 3780843 - DNA, 16 bp, Homo sapiens
atcccgctcttttcct

SEQ ID NO: 3780844 - DNA, 14 bp, Homo sapiens
atccctacccccta

SEQ ID NO: 3780845 - DNA, 19 bp, Homo sapiens
atccctagtcttcaagcag

SEQ ID NO: 3780846 - DNA, 16 bp, Homo sapiens
atccctgaggctggac

SEQ ID NO: 3780847 - DNA, 15 bp, Homo sapiens
atccctgccagctct

SEQ ID NO: 3780848 - DNA, 16 bp, Homo sapiens
atggaatacagtgtta

SEQ ID NO: 3780849 - DNA, 17 bp, Homo sapiens
atggaatacagtgttat

SEQ ID NO: 3780850 - DNA, 17 bp, Homo sapiens
atggaattgcttaccaa

SEQ ID NO: 3780851 - DNA, 19 bp, Homo sapiens
atggacagaagaaggcagc

SEQ ID NO: 3780852 - DNA, 14 bp, Homo sapiens
atggacatgatctt

SEQ ID NO: 3780853 - DNA, 21 bp, Homo sapiens
atggacccaatatttaccaga

SEQ ID NO: 3780854 - DNA, 13 bp, Homo sapiens
atggacctaacat

SEQ ID NO: 3780855 - DNA, 14 bp, Homo sapiens
atggacctaacatt

SEQ ID NO: 3780856 - DNA, 18 bp, Homo sapiens
atggactctacactgtga

SEQ ID NO: 3780857 - DNA, 20 bp, Homo sapiens
atggagactccatgagaagc

SEQ ID NO: 3780858 - DNA, 18 bp, Homo sapiens
atggagactgtctcaaga

SEQ ID NO: 3780859 - DNA, 22 bp, Homo sapiens
atggaggaaaaccaagccgtgg

SEQ ID NO: 3780860 - DNA, 12 bp, Homo sapiens
atggaggcacac

SEQ ID NO: 3780861 - DNA, 18 bp, Homo sapiens
atggaggctatgtggagt

SEQ ID NO: 3780862 - DNA, 22 bp, Homo sapiens
atggaggggtggtcctgactca

SEQ ID NO: 3780863 - DNA, 22 bp, Homo sapiens
atggagtagacccctggctggt

SEQ ID NO: 3780864 - DNA, 16 bp, Homo sapiens
atggatcctggaggat

SEQ ID NO: 3780865 - DNA, 12 bp, Homo sapiens
atggatgtgctt

SEQ ID NO: 3780866 - DNA, 15 bp, Homo sapiens
atggatttccagcca

SEQ ID NO: 3780867 - DNA, 14 bp, Homo sapiens
atggatttgcctgt

SEQ ID NO: 3780868 - DNA, 16 bp, Homo sapiens
atggcagcaggcctgt

SEQ ID NO: 3780869 - DNA, 13 bp, Homo sapiens
atggcctcagctg

SEQ ID NO: 3780870 - DNA, 19 bp, Homo sapiens
atggcctgccttgaagcca

SEQ ID NO: 3780871 - DNA, 20 bp, Homo sapiens
atggcctgccttgaagccac

SEQ ID NO: 3780872 - DNA, 19 bp, Homo sapiens
atggcgattcccattgaaa

SEQ ID NO: 3780873 - DNA, 20 bp, Homo sapiens
atggcgtgtccctctcggaa

SEQ ID NO: 3780874 - DNA, 18 bp, Homo sapiens
atggctaaggcaccagcc

SEQ ID NO: 3780875 - DNA, 19 bp, Homo sapiens
atggctcactgcagcctcg

SEQ ID NO: 3780876 - DNA, 23 bp, Homo sapiens
atggctccagtctgctgccctcc

SEQ ID NO: 3780877 - DNA, 18 bp, Homo sapiens
atggctgactttgctctt

SEQ ID NO: 3780878 - DNA, 16 bp, Homo sapiens
atggctgtgcctctgc

SEQ ID NO: 3780879 - DNA, 20 bp, Homo sapiens
atggctgtgcctctgcctgt

SEQ ID NO: 3780880 - DNA, 16 bp, Homo sapiens
atggcttagttttcat

SEQ ID NO: 3780881 - DNA, 14 bp, Homo sapiens
atggcttctaacaa

SEQ ID NO: 3780882 - DNA, 20 bp, Homo sapiens
atggcttttgtttcttccct

SEQ ID NO: 3780883 - DNA, 19 bp, Homo sapiens
atgggaaggagggaggtat

SEQ ID NO: 3780884 - DNA, 17 bp, Homo sapiens
atgggactgggagggcc

SEQ ID NO: 3780885 - DNA, 13 bp, Homo sapiens
atgggagccccag

SEQ ID NO: 3780886 - DNA, 15 bp, Homo sapiens
atggggagaaaagac

SEQ ID NO: 3780887 - DNA, 13 bp, Homo sapiens
atggggccacagc

SEQ ID NO: 3780888 - DNA, 16 bp, Homo sapiens
atgggggcctcagggc

SEQ ID NO: 3780889 - DNA, 15 bp, Homo sapiens
atggggggtatattt

SEQ ID NO: 3780890 - DNA, 18 bp, Homo sapiens
atggggttggctgggccc

SEQ ID NO: 3780891 - DNA, 17 bp, Homo sapiens
atgggtagagaaacact

SEQ ID NO: 3780892 - DNA, 23 bp, Homo sapiens
atgggtagcttctgacctcagca

SEQ ID NO: 3780893 - DNA, 16 bp, Homo sapiens
atgggtatcaaacagc

SEQ ID NO: 3780894 - DNA, 23 bp, Homo sapiens
atggtaaaagttacttattctag

SEQ ID NO: 3780895 - DNA, 15 bp, Homo sapiens
atggtaaaattgcat

SEQ ID NO: 3780896 - DNA, 16 bp, Homo sapiens
atggtagtctaaccaa

SEQ ID NO: 3780897 - DNA, 21 bp, Homo sapiens
atggtatatttggtactgtat

SEQ ID NO: 3780898 - DNA, 23 bp, Homo sapiens
atggtatcaataaatagaccatt

SEQ ID NO: 3780899 - DNA, 15 bp, Homo sapiens
atggtatttgagaca

SEQ ID NO: 3780900 - DNA, 16 bp, Homo sapiens
atggtatttgagacat

SEQ ID NO: 3780901 - DNA, 14 bp, Homo sapiens
atggtgatgaaatg

SEQ ID NO: 3780902 - DNA, 17 bp, Homo sapiens
atggtgatgaaatgtaa

SEQ ID NO: 3780903 - DNA, 13 bp, Homo sapiens
atggtgcctctgg

SEQ ID NO: 3780904 - DNA, 15 bp, Homo sapiens
atggtgcctctggag

SEQ ID NO: 3780905 - DNA, 21 bp, Homo sapiens
atggtgttttcatgtaaataa

SEQ ID NO: 3780906 - DNA, 16 bp, Homo sapiens
atggttacactgttag

SEQ ID NO: 3780907 - DNA, 19 bp, Homo sapiens
atggttcccctgttcactc

SEQ ID NO: 3780908 - DNA, 21 bp, Homo sapiens
atggtttgaatataaacacta

SEQ ID NO: 3780909 - DNA, 17 bp, Homo sapiens
atggtttgcaaggaagc

SEQ ID NO: 3780910 - DNA, 14 bp, Homo sapiens
atggttttcaaaat

SEQ ID NO: 3780911 - DNA, 12 bp, Homo sapiens
atgtaaaacaaa

SEQ ID NO: 3780912 - DNA, 14 bp, Homo sapiens
atgtaaaacaaaaa

SEQ ID NO: 3780913 - DNA, 15 bp, Homo sapiens
atgtaaaacaaaaaa

SEQ ID NO: 3780914 - DNA, 20 bp, Homo sapiens
atgtaaaacaaaaaacaata

SEQ ID NO: 3780915 - DNA, 16 bp, Homo sapiens
atgtaaacagtgcctg

SEQ ID NO: 3780916 - DNA, 13 bp, Homo sapiens
atgtaaagacaaa

SEQ ID NO: 3780917 - DNA, 13 bp, Homo sapiens
atgtaagaatcat

SEQ ID NO: 3780918 - DNA, 16 bp, Homo sapiens
atgtaataatgtgaat

SEQ ID NO: 3780919 - DNA, 15 bp, Homo sapiens
atgtaatcaatgttt

SEQ ID NO: 3780920 - DNA, 15 bp, Homo sapiens
atgtaattgaataaa

SEQ ID NO: 3780921 - DNA, 18 bp, Homo sapiens
atgtaatttgtgtaataa

SEQ ID NO: 3780922 - DNA, 20 bp, Homo sapiens
atgtacaatattttaagcat

SEQ ID NO: 3780923 - DNA, 14 bp, Homo sapiens
atgtacctctttta

SEQ ID NO: 3780924 - DNA, 15 bp, Homo sapiens
atgtacctcttttag

SEQ ID NO: 3780925 - DNA, 22 bp, Homo sapiens
atgtagatattgtgaagtacat

SEQ ID NO: 3780926 - DNA, 17 bp, Homo sapiens
atgtagatgtgcatttt

SEQ ID NO: 3780927 - DNA, 21 bp, Homo sapiens
atgtagcaatcagattttcct

SEQ ID NO: 3780928 - DNA, 14 bp, Homo sapiens
atgtagctggtttc

SEQ ID NO: 3780929 - DNA, 16 bp, Homo sapiens
atgtaggtatgaataa

SEQ ID NO: 3780930 - DNA, 17 bp, Homo sapiens
atgtataaagaacaagg

SEQ ID NO: 3780931 - DNA, 14 bp, Homo sapiens
atgtataatatttt

SEQ ID NO: 3780932 - DNA, 16 bp, Homo sapiens
atgtatatgtgttcat

SEQ ID NO: 3780933 - DNA, 12 bp, Homo sapiens
atgtatcaatga

SEQ ID NO: 3780934 - DNA, 18 bp, Homo sapiens
atgtatggaatacagtgt

SEQ ID NO: 3780935 - DNA, 12 bp, Homo sapiens
atgtatgtaaaa

SEQ ID NO: 3780936 - DNA, 16 bp, Homo sapiens
atgtatgtgtaagtat

SEQ ID NO: 3780937 - DNA, 15 bp, Homo sapiens
atgtatgtgtgtatg

SEQ ID NO: 3780938 - DNA, 17 bp, Homo sapiens
atgtatgtttacactgt

SEQ ID NO: 3780939 - DNA, 17 bp, Homo sapiens
atgtattaatattcatt

SEQ ID NO: 3780940 - DNA, 15 bp, Homo sapiens
atgtattttatgtat

SEQ ID NO: 3780941 - DNA, 16 bp, Homo sapiens
atgtcaactttatgca

SEQ ID NO: 3780942 - DNA, 16 bp, Homo sapiens
atgtcacaggcaggtc

SEQ ID NO: 3780943 - DNA, 19 bp, Homo sapiens
atgtcacaggcaggtccag

SEQ ID NO: 3780944 - DNA, 15 bp, Homo sapiens
atgtcaccaccttcc

SEQ ID NO: 3780945 - DNA, 18 bp, Homo sapiens
atgtcaccaccttcccag

SEQ ID NO: 3780946 - DNA, 23 bp, Homo sapiens
atgtcagaaaaacaataagagcg

SEQ ID NO: 3780947 - DNA, 15 bp, Homo sapiens
atgtcagattccttt

SEQ ID NO: 3780948 - DNA, 18 bp, Homo sapiens
atgtcagattcctttccc

SEQ ID NO: 3780949 - DNA, 15 bp, Homo sapiens
atgtcaggaacagaa

SEQ ID NO: 3780950 - DNA, 16 bp, Homo sapiens
atgtcattaaacatga

SEQ ID NO: 3780951 - DNA, 21 bp, Homo sapiens
atgtccctacacccctcccct

SEQ ID NO: 3780952 - DNA, 24 bp, Homo sapiens
atgtccctaccgagtctcttctcc

SEQ ID NO: 3780953 - DNA, 20 bp, Homo sapiens
atgtccctttcttggccagt

SEQ ID NO: 3780954 - DNA, 16 bp, Homo sapiens
atgtcctccagaagcc

SEQ ID NO: 3780955 - DNA, 20 bp, Homo sapiens
atgtcctccagaagcctctg

SEQ ID NO: 3780956 - DNA, 23 bp, Homo sapiens
atgtcctccagaagcctctggct

SEQ ID NO: 3780957 - DNA, 15 bp, Homo sapiens
atgtcgcctctgcat

SEQ ID NO: 3780958 - DNA, 13 bp, Homo sapiens
atgtctctcagaa

SEQ ID NO: 3780959 - DNA, 23 bp, Homo sapiens
atgtctctttaatgtcacaggca

SEQ ID NO: 3780960 - DNA, 16 bp, Homo sapiens
atgtctgtagctcctc

SEQ ID NO: 3780961 - DNA, 19 bp, Homo sapiens
atgtctgtagctcctcaac

SEQ ID NO: 3780962 - DNA, 19 bp, Homo sapiens
attggacattaagcatcac

SEQ ID NO: 3780963 - DNA, 19 bp, Homo sapiens
attggcaaagatgtgggga

SEQ ID NO: 3780964 - DNA, 16 bp, Homo sapiens
attgggattttctaca

SEQ ID NO: 3780965 - DNA, 19 bp, Homo sapiens
attggggaagactgtggct

SEQ ID NO: 3780966 - DNA, 17 bp, Homo sapiens
attggtccagcttgctc

SEQ ID NO: 3780967 - DNA, 16 bp, Homo sapiens
attggttccctttgct

SEQ ID NO: 3780968 - DNA, 17 bp, Homo sapiens
attgtaaaactgaggca

SEQ ID NO: 3780969 - DNA, 23 bp, Homo sapiens
attgtaaacaaactgtgtaactg

SEQ ID NO: 3780970 - DNA, 14 bp, Homo sapiens
attgtaaactgtac

SEQ ID NO: 3780971 - DNA, 13 bp, Homo sapiens
attgtacaacctg

SEQ ID NO: 3780972 - DNA, 19 bp, Homo sapiens
attgtacacaccttatatt

SEQ ID NO: 3780973 - DNA, 15 bp, Homo sapiens
attgtacgtttaaag

SEQ ID NO: 3780974 - DNA, 15 bp, Homo sapiens
attgtatctagtgca

SEQ ID NO: 3780975 - DNA, 14 bp, Homo sapiens
attgtattttagta

SEQ ID NO: 3780976 - DNA, 14 bp, Homo sapiens
attgtctttatatg

SEQ ID NO: 3780977 - DNA, 15 bp, Homo sapiens
attgtgaagtacata

SEQ ID NO: 3780978 - DNA, 16 bp, Homo sapiens
attgtgaccaagttat

SEQ ID NO: 3780979 - DNA, 16 bp, Homo sapiens
attgtgagccaccacg

SEQ ID NO: 3780980 - DNA, 23 bp, Homo sapiens
attgtgatcagaccataatgtta

SEQ ID NO: 3780981 - DNA, 18 bp, Homo sapiens
attgtggctgtcagcagg

SEQ ID NO: 3780982 - DNA, 19 bp, Homo sapiens
attgtggctgtcagcagga

SEQ ID NO: 3780983 - DNA, 16 bp, Homo sapiens
attgtgtgttatttaa

SEQ ID NO: 3780984 - DNA, 15 bp, Homo sapiens
attgttaaaataact

SEQ ID NO: 3780985 - DNA, 12 bp, Homo sapiens
attgttccaaga

SEQ ID NO: 3780986 - DNA, 16 bp, Homo sapiens
attgttccaagacatt

SEQ ID NO: 3780987 - DNA, 18 bp, Homo sapiens
attgttccaagacattgt

SEQ ID NO: 3780988 - DNA, 20 bp, Homo sapiens
attgttccaagacattgtca

SEQ ID NO: 3780989 - DNA, 16 bp, Homo sapiens
attgttcccagtgaca

SEQ ID NO: 3780990 - DNA, 17 bp, Homo sapiens
attgttcctaagttctt

SEQ ID NO: 3780991 - DNA, 20 bp, Homo sapiens
attgttgaggtggtctgaat

SEQ ID NO: 3780992 - DNA, 21 bp, Homo sapiens
attgtttaagtgttgtaaata

SEQ ID NO: 3780993 - DNA, 14 bp, Homo sapiens
attgtttgcttatt

SEQ ID NO: 3780994 - DNA, 19 bp, Homo sapiens
attgtttgcttattgttcc

SEQ ID NO: 3780995 - DNA, 22 bp, Homo sapiens
attgtttgcttattgttccaag

SEQ ID NO: 3780996 - DNA, 21 bp, Homo sapiens
attgtttggggatgagaaagg

SEQ ID NO: 3780997 - DNA, 17 bp, Homo sapiens
attgttttcagtgtaca

SEQ ID NO: 3780998 - DNA, 15 bp, Homo sapiens
atttaaaagacactg

SEQ ID NO: 3780999 - DNA, 16 bp, Homo sapiens
atttaaagacaaagac

SEQ ID NO: 3781000 - DNA, 21 bp, Homo sapiens
atttaaaggctaccttattgt

SEQ ID NO: 3781001 - DNA, 19 bp, Homo sapiens
atttaaatgtaaagacaaa

SEQ ID NO: 3781002 - DNA, 13 bp, Homo sapiens
atttaactggctt

SEQ ID NO: 3781003 - DNA, 20 bp, Homo sapiens
atttaagaaaatacaataaa

SEQ ID NO: 3781004 - DNA, 21 bp, Homo sapiens
atttaagaaaatacaataaac

SEQ ID NO: 3781005 - DNA, 15 bp, Homo sapiens
atttaagatagtttt

SEQ ID NO: 3781006 - DNA, 11 bp, Homo sapiens
atttaagcatt

SEQ ID NO: 3781007 - DNA, 14 bp, Homo sapiens
atttaagcattgtt

SEQ ID NO: 3781008 - DNA, 19 bp, Homo sapiens
atttaaggagatgtaagag

SEQ ID NO: 3781009 - DNA, 18 bp, Homo sapiens
atttaagtattcaagaaa

SEQ ID NO: 3781010 - DNA, 19 bp, Homo sapiens
atttaatatagctattttt

SEQ ID NO: 3781011 - DNA, 16 bp, Homo sapiens
atttaatgaaagactg

SEQ ID NO: 3781012 - DNA, 18 bp, Homo sapiens
atttaattgtaaactgta

SEQ ID NO: 3781013 - DNA, 19 bp, Homo sapiens
atttaatttttttgagaca

SEQ ID NO: 3781014 - DNA, 23 bp, Homo sapiens
atttaatttttttgagacagagt

SEQ ID NO: 3781015 - DNA, 18 bp, Homo sapiens
atttacaagggaagattt

SEQ ID NO: 3781016 - DNA, 14 bp, Homo sapiens
atttacatatgaaa

SEQ ID NO: 3781017 - DNA, 15 bp, Homo sapiens
atttacatatgaaat

SEQ ID NO: 3781018 - DNA, 21 bp, Homo sapiens
atttacatatgaaatttaata

SEQ ID NO: 3781019 - DNA, 19 bp, Homo sapiens
atttacccagaatgtcaga

SEQ ID NO: 3781020 - DNA, 21 bp, Homo sapiens
atttactgagcttctctgtga

SEQ ID NO: 3781021 - DNA, 16 bp, Homo sapiens
atttacttcttataca

SEQ ID NO: 3781022 - DNA, 15 bp, Homo sapiens
atttactttgaattt

SEQ ID NO: 3781023 - DNA, 17 bp, Homo sapiens
atttagagatgaattaa

SEQ ID NO: 3781024 - DNA, 23 bp, Homo sapiens
atttagagatgaattaaatttaa

SEQ ID NO: 3781025 - DNA, 18 bp, Homo sapiens
atttagattgttaaaata

SEQ ID NO: 3781026 - DNA, 15 bp, Homo sapiens
atttagctgtatcaa

SEQ ID NO: 3781027 - DNA, 19 bp, Homo sapiens
atttagctgtatcaaacta

SEQ ID NO: 3781028 - DNA, 12 bp, Homo sapiens
atttaggaactt

SEQ ID NO: 3781029 - DNA, 16 bp, Homo sapiens
atttagggaactgctt

SEQ ID NO: 3781030 - DNA, 16 bp, Homo sapiens
atttagttctttgtta

SEQ ID NO: 3781031 - DNA, 13 bp, Homo sapiens
atttataactcat

SEQ ID NO: 3781032 - DNA, 17 bp, Homo sapiens
atttataactcatcata

SEQ ID NO: 3781033 - DNA, 14 bp, Homo sapiens
atttataagcagat

SEQ ID NO: 3781034 - DNA, 17 bp, Homo sapiens
atttataagcagattta

SEQ ID NO: 3781035 - DNA, 14 bp, Homo sapiens
atttataatgtttg

SEQ ID NO: 3781036 - DNA, 16 bp, Homo sapiens
atttatagtttataca

SEQ ID NO: 3781037 - DNA, 14 bp, Homo sapiens
atttatataattat

SEQ ID NO: 3781038 - DNA, 22 bp, Homo sapiens
atttatataattatgttattga

SEQ ID NO: 3781039 - DNA, 19 bp, Homo sapiens
atttatatatttataactc

SEQ ID NO: 3781040 - DNA, 17 bp, Homo sapiens
atttatcagtgacagag

SEQ ID NO: 3781041 - DNA, 19 bp, Homo sapiens
atttatcctgaaatttcag

SEQ ID NO: 3781042 - DNA, 17 bp, Homo sapiens
atttatctattgtaaga

SEQ ID NO: 3781043 - DNA, 12 bp, Homo sapiens
atttatgtagat

SEQ ID NO: 3781044 - DNA, 14 bp, Homo sapiens
atttatgtagatgt

SEQ ID NO: 3781045 - DNA, 20 bp, Homo sapiens
atttatgtagatgtgcattt

SEQ ID NO: 3781046 - DNA, 21 bp, Homo sapiens
atttatgtagatgtgcatttt

SEQ ID NO: 3781047 - DNA, 18 bp, Homo sapiens
atttatgtgtgaggagct

SEQ ID NO: 3781048 - DNA, 19 bp, Homo sapiens
atttatgtgtgaggagctg

SEQ ID NO: 3781049 - DNA, 16 bp, Homo sapiens
atttattaagatggat

SEQ ID NO: 3781050 - DNA, 22 bp, Homo sapiens
atttattaagatggattctcag

SEQ ID NO: 3781051 - DNA, 15 bp, Homo sapiens
atttattacctctga

SEQ ID NO: 3781052 - DNA, 14 bp, Homo sapiens
atttattctgctca

SEQ ID NO: 3781053 - DNA, 18 bp, Homo sapiens
atttattgctacttcctg

SEQ ID NO: 3781054 - DNA, 22 bp, Homo sapiens
atttattgtttatttatcagtg

SEQ ID NO: 3781055 - DNA, 14 bp, Homo sapiens
atttatttaaattt

SEQ ID NO: 3781056 - DNA, 24 bp, Homo sapiens
atttatttactgagcttctctgtg

SEQ ID NO: 3781057 - DNA, 16 bp, Homo sapiens
atttatttattaagat

SEQ ID NO: 3781058 - DNA, 17 bp, Homo sapiens
atttatttattaagatg

SEQ ID NO: 3781059 - DNA, 14 bp, Homo sapiens
atttatttcaaaaa

SEQ ID NO: 3781060 - DNA, 12 bp, Homo sapiens
atttattttatt

SEQ ID NO: 3781061 - DNA, 14 bp, Homo sapiens
atttattttttaca

SEQ ID NO: 3781062 - DNA, 12 bp, Homo sapiens
atttcaaaaatt

SEQ ID NO: 3781063 - DNA, 17 bp, Homo sapiens
atttcaaaaatttggaa

SEQ ID NO: 3781064 - DNA, 19 bp, Homo sapiens
atttcaaaaatttggaatt

SEQ ID NO: 3781065 - DNA, 15 bp, Homo sapiens
atttcaagaccttct

SEQ ID NO: 3781066 - DNA, 17 bp, Homo sapiens
atttcaatttgttcagt

SEQ ID NO: 3781067 - DNA, 13 bp, Homo sapiens
atttcacattaat

SEQ ID NO: 3781068 - DNA, 21 bp, Homo sapiens
atttcacattaatatttgctg

SEQ ID NO: 3781069 - DNA, 14 bp, Homo sapiens
atttcactattttt

SEQ ID NO: 3781070 - DNA, 22 bp, Homo sapiens
atttcaggatactctgtcagat

SEQ ID NO: 3781071 - DNA, 19 bp, Homo sapiens
atttcaggggtcgtcacca

SEQ ID NO: 3781072 - DNA, 19 bp, Homo sapiens
atttcagtcttttcctgtt

SEQ ID NO: 3781073 - DNA, 16 bp, Homo sapiens
atttcatctatttctg

SEQ ID NO: 3781074 - DNA, 18 bp, Homo sapiens
atttcatttcaactgttt

SEQ ID NO: 3781075 - DNA, 19 bp, Homo sapiens
caaactcttgacctcaggt

SEQ ID NO: 3781076 - DNA, 15 bp, Homo sapiens
caaactgcaatagag

SEQ ID NO: 3781077 - DNA, 19 bp, Homo sapiens
caaactgcaatagagactg

SEQ ID NO: 3781078 - DNA, 20 bp, Homo sapiens
caaactgcaatagagactgt

SEQ ID NO: 3781079 - DNA, 18 bp, Homo sapiens
caaactgtgtaactgccc

SEQ ID NO: 3781080 - DNA, 19 bp, Homo sapiens
caaagaaggaaaaggcagg

SEQ ID NO: 3781081 - DNA, 17 bp, Homo sapiens
caaagaaggaattctag

SEQ ID NO: 3781082 - DNA, 14 bp, Homo sapiens
caaagaatgccttg

SEQ ID NO: 3781083 - DNA, 15 bp, Homo sapiens
caaagaatgccttga

SEQ ID NO: 3781084 - DNA, 14 bp, Homo sapiens
caaagacagaagcc

SEQ ID NO: 3781085 - DNA, 16 bp, Homo sapiens
caaagacttagtatat

SEQ ID NO: 3781086 - DNA, 20 bp, Homo sapiens
caaagacttagtatattttc

SEQ ID NO: 3781087 - DNA, 14 bp, Homo sapiens
caaagaggcaagag

SEQ ID NO: 3781088 - DNA, 15 bp, Homo sapiens
caaagaggcaagagg

SEQ ID NO: 3781089 - DNA, 21 bp, Homo sapiens
caaagaggttttaaaaaaatc

SEQ ID NO: 3781090 - DNA, 20 bp, Homo sapiens
caaagccaaagctaggcctg

SEQ ID NO: 3781091 - DNA, 14 bp, Homo sapiens
caaagccagaagct

SEQ ID NO: 3781092 - DNA, 15 bp, Homo sapiens
caaagccagacagca

SEQ ID NO: 3781093 - DNA, 18 bp, Homo sapiens
caaagcccttccatgtcg

SEQ ID NO: 3781094 - DNA, 17 bp, Homo sapiens
caaagcctcctccagcc

SEQ ID NO: 3781095 - DNA, 16 bp, Homo sapiens
caaagcggggggaggg

SEQ ID NO: 3781096 - DNA, 13 bp, Homo sapiens
caaagctaggcct

SEQ ID NO: 3781097 - DNA, 21 bp, Homo sapiens
caaagctagggtggcccttgc

SEQ ID NO: 3781098 - DNA, 22 bp, Homo sapiens
caaagctagggtggcccttgca

SEQ ID NO: 3781099 - DNA, 20 bp, Homo sapiens
caaagcttccattccacatc

SEQ ID NO: 3781100 - DNA, 17 bp, Homo sapiens
caaagctttcctggaga

SEQ ID NO: 3781101 - DNA, 20 bp, Homo sapiens
caaaggaagctttctctgct

SEQ ID NO: 3781102 - DNA, 17 bp, Homo sapiens
caaaggaggctggcagg

SEQ ID NO: 3781103 - DNA, 15 bp, Homo sapiens
caaagggaaatatca

SEQ ID NO: 3781104 - DNA, 22 bp, Homo sapiens
caaagggagcactgggttgact

SEQ ID NO: 3781105 - DNA, 24 bp, Homo sapiens
caaagggtacttccactgatggaa

SEQ ID NO: 3781106 - DNA, 16 bp, Homo sapiens
caaagggtatcaggtg

SEQ ID NO: 3781107 - DNA, 21 bp, Homo sapiens
caaagggtatcaggtgctgcc

SEQ ID NO: 3781108 - DNA, 20 bp, Homo sapiens
caaagggtgaagctatttat

SEQ ID NO: 3781109 - DNA, 19 bp, Homo sapiens
caaagtgtattttataaaa

SEQ ID NO: 3781110 - DNA, 23 bp, Homo sapiens
caaagtgtattttataaaattaa

SEQ ID NO: 3781111 - DNA, 21 bp, Homo sapiens
caaagttccctacttcctgtg

SEQ ID NO: 3781112 - DNA, 14 bp, Homo sapiens
caaatactcttagg

SEQ ID NO: 3781113 - DNA, 15 bp, Homo sapiens
caaatacttattcat

SEQ ID NO: 3781114 - DNA, 14 bp, Homo sapiens
caaatagaaaacag

SEQ ID NO: 3781115 - DNA, 15 bp, Homo sapiens
caaatatattctctt

SEQ ID NO: 3781116 - DNA, 15 bp, Homo sapiens
caaatatttattttc

SEQ ID NO: 3781117 - DNA, 23 bp, Homo sapiens
caaatctaagggaaaaagccttg

SEQ ID NO: 3781118 - DNA, 14 bp, Homo sapiens
caaatggaggaata

SEQ ID NO: 3781119 - DNA, 20 bp, Homo sapiens
caaatggtggttgtttcttc

SEQ ID NO: 3781120 - DNA, 23 bp, Homo sapiens
caaatggtggttgtttcttccaa

SEQ ID NO: 3781121 - DNA, 17 bp, Homo sapiens
caaatgtgacctgtgtc

SEQ ID NO: 3781122 - DNA, 14 bp, Homo sapiens
caaatgtggctcct

SEQ ID NO: 3781123 - DNA, 21 bp, Homo sapiens
caaattaggttttgtacaatt

SEQ ID NO: 3781124 - DNA, 18 bp, Homo sapiens
caaattatcaagctaata

SEQ ID NO: 3781125 - DNA, 20 bp, Homo sapiens
caaattatcaagctaataaa

SEQ ID NO: 3781126 - DNA, 21 bp, Homo sapiens
caaattcccagatttgaagac

SEQ ID NO: 3781127 - DNA, 16 bp, Homo sapiens
caaattcgcaaacttt

SEQ ID NO: 3781128 - DNA, 22 bp, Homo sapiens
caaattctgcttgcttgctttt

SEQ ID NO: 3781129 - DNA, 14 bp, Homo sapiens
caaatttaaaacaa

SEQ ID NO: 3781130 - DNA, 14 bp, Homo sapiens
caaatttataattt

SEQ ID NO: 3781131 - DNA, 11 bp, Homo sapiens
caaatttcaca

SEQ ID NO: 3781132 - DNA, 17 bp, Homo sapiens
caacaaaaagcttcccc

SEQ ID NO: 3781133 - DNA, 16 bp, Homo sapiens
caacacaaggtgggca

SEQ ID NO: 3781134 - DNA, 18 bp, Homo sapiens
caacacaatgttattcgt

SEQ ID NO: 3781135 - DNA, 14 bp, Homo sapiens
caacacacacactc

SEQ ID NO: 3781136 - DNA, 20 bp, Homo sapiens
caacacctctgcacaagctg

SEQ ID NO: 3781137 - DNA, 22 bp, Homo sapiens
caacaccttcagaggctgaggt

SEQ ID NO: 3781138 - DNA, 22 bp, Homo sapiens
caacactcacatttattctgct

SEQ ID NO: 3781139 - DNA, 22 bp, Homo sapiens
caacagaagtcatgaagcccaa

SEQ ID NO: 3781140 - DNA, 23 bp, Homo sapiens
caacagaagtcatgaagcccaag

SEQ ID NO: 3781141 - DNA, 18 bp, Homo sapiens
caacagagaaggcaggaa

SEQ ID NO: 3781142 - DNA, 23 bp, Homo sapiens
caacagagtgagaccctgtctct

SEQ ID NO: 3781143 - DNA, 22 bp, Homo sapiens
caacagctcaagtcttccctga

SEQ ID NO: 3781144 - DNA, 20 bp, Homo sapiens
caacaggctgggcttcagtg

SEQ ID NO: 3781145 - DNA, 14 bp, Homo sapiens
caacagtcaaaaca

SEQ ID NO: 3781146 - DNA, 17 bp, Homo sapiens
caacatcaatgttcatt

SEQ ID NO: 3781147 - DNA, 18 bp, Homo sapiens
caacatcccattgccctg

SEQ ID NO: 3781148 - DNA, 19 bp, Homo sapiens
caacatcccattgccctgg

SEQ ID NO: 3781149 - DNA, 20 bp, Homo sapiens
caacatgcctgctttagaat

SEQ ID NO: 3781150 - DNA, 22 bp, Homo sapiens
caacatgcttcatgaaaatcct

SEQ ID NO: 3781151 - DNA, 13 bp, Homo sapiens
caacatggagaaa

SEQ ID NO: 3781152 - DNA, 22 bp, Homo sapiens
caacatggagaaaccctgtctc

SEQ ID NO: 3781153 - DNA, 23 bp, Homo sapiens
caacatggagaaaccctgtctct

SEQ ID NO: 3781154 - DNA, 19 bp, Homo sapiens
caacatgtataatattttt

SEQ ID NO: 3781155 - DNA, 20 bp, Homo sapiens
caacatgttactgaccagca

SEQ ID NO: 3781156 - DNA, 20 bp, Homo sapiens
caacattaaaacaatattgt

SEQ ID NO: 3781157 - DNA, 20 bp, Homo sapiens
caaccaagtcatgtgcattt

SEQ ID NO: 3781158 - DNA, 14 bp, Homo sapiens
caaccaccgctccc

SEQ ID NO: 3781159 - DNA, 22 bp, Homo sapiens
caaccaccgctccccagcccag

SEQ ID NO: 3781160 - DNA, 19 bp, Homo sapiens
caaccagattgtcagctcc

SEQ ID NO: 3781161 - DNA, 22 bp, Homo sapiens
caaccatatggatattagtcat

SEQ ID NO: 3781162 - DNA, 18 bp, Homo sapiens
caaccatcaaagtggcaa

SEQ ID NO: 3781163 - DNA, 18 bp, Homo sapiens
caaccatgagaccactgt

SEQ ID NO: 3781164 - DNA, 13 bp, Homo sapiens
caaccattccaga

SEQ ID NO: 3781165 - DNA, 14 bp, Homo sapiens
caaccattccccat

SEQ ID NO: 3781166 - DNA, 16 bp, Homo sapiens
caacccaaacctggag

SEQ ID NO: 3781167 - DNA, 20 bp, Homo sapiens
caacccatctacccctggat

SEQ ID NO: 3781168 - DNA, 22 bp, Homo sapiens
caacccatgatgagctcctctt

SEQ ID NO: 3781169 - DNA, 11 bp, Homo sapiens
caacccccacc

SEQ ID NO: 3781170 - DNA, 13 bp, Homo sapiens
caacccccacccc

SEQ ID NO: 3781171 - DNA, 23 bp, Homo sapiens
caacccccaccccacacttgttc

SEQ ID NO: 3781172 - DNA, 16 bp, Homo sapiens
caacccccatttctat

SEQ ID NO: 3781173 - DNA, 22 bp, Homo sapiens
caaccccttcgctcctgtgtct

SEQ ID NO: 3781174 - DNA, 21 bp, Homo sapiens
caaccctcagagccaccccta

SEQ ID NO: 3781175 - DNA, 14 bp, Homo sapiens
caaccctccctcag

SEQ ID NO: 3781176 - DNA, 18 bp, Homo sapiens
caaccctccctcagcccc

SEQ ID NO: 3781177 - DNA, 19 bp, Homo sapiens
caaccctccctcagcccct

SEQ ID NO: 3781178 - DNA, 21 bp, Homo sapiens
caaccctccctcagcccctct

SEQ ID NO: 3781179 - DNA, 19 bp, Homo sapiens
caaccctcctatcacctcc

SEQ ID NO: 3781180 - DNA, 11 bp, Homo sapiens
caaccctgcaa

SEQ ID NO: 3781181 - DNA, 16 bp, Homo sapiens
caaccctgcccctgcc

SEQ ID NO: 3781182 - DNA, 20 bp, Homo sapiens
caacccttaccccttagcct

SEQ ID NO: 3781183 - DNA, 13 bp, Homo sapiens
caacctaaatttg

SEQ ID NO: 3781184 - DNA, 11 bp, Homo sapiens
caacctcagca

SEQ ID NO: 3781185 - DNA, 14 bp, Homo sapiens
caacctcagcaacc

SEQ ID NO: 3781186 - DNA, 20 bp, Homo sapiens
caacctcggctcctggactc

SEQ ID NO: 3781187 - DNA, 21 bp, Homo sapiens
caccaggcacgaacccacctg

SEQ ID NO: 3781188 - DNA, 22 bp, Homo sapiens
caccaggcacgaacccacctgc

SEQ ID NO: 3781189 - DNA, 23 bp, Homo sapiens
caccaggcacgaacccacctgct

SEQ ID NO: 3781190 - DNA, 24 bp, Homo sapiens
caccaggcacgaacccacctgctg

SEQ ID NO: 3781191 - DNA, 16 bp, Homo sapiens
caccagggatggtact

SEQ ID NO: 3781192 - DNA, 22 bp, Homo sapiens
caccaggtctcccgggaagcca

SEQ ID NO: 3781193 - DNA, 21 bp, Homo sapiens
caccagtgtgtggctttcaga

SEQ ID NO: 3781194 - DNA, 13 bp, Homo sapiens
caccatctcaggc

SEQ ID NO: 3781195 - DNA, 19 bp, Homo sapiens
caccatctcaggccacctg

SEQ ID NO: 3781196 - DNA, 22 bp, Homo sapiens
caccatctcaggccacctgccc

SEQ ID NO: 3781197 - DNA, 12 bp, Homo sapiens
caccatggccag

SEQ ID NO: 3781198 - DNA, 18 bp, Homo sapiens
caccatgtaaaacaaaaa

SEQ ID NO: 3781199 - DNA, 19 bp, Homo sapiens
caccatgtaaaacaaaaaa

SEQ ID NO: 3781200 - DNA, 18 bp, Homo sapiens
caccatgtacatagcttg

SEQ ID NO: 3781201 - DNA, 22 bp, Homo sapiens
caccatgtttgagctcagaccc

SEQ ID NO: 3781202 - DNA, 15 bp, Homo sapiens
caccattcaggaacc

SEQ ID NO: 3781203 - DNA, 13 bp, Homo sapiens
caccattgctgct

SEQ ID NO: 3781204 - DNA, 14 bp, Homo sapiens
cacccaaaagtcaa

SEQ ID NO: 3781205 - DNA, 23 bp, Homo sapiens
cacccaaaagtcaaaaggtgcct

SEQ ID NO: 3781206 - DNA, 15 bp, Homo sapiens
cacccaaaccccggg

SEQ ID NO: 3781207 - DNA, 13 bp, Homo sapiens
cacccacagggct

SEQ ID NO: 3781208 - DNA, 12 bp, Homo sapiens
cacccacctcag

SEQ ID NO: 3781209 - DNA, 18 bp, Homo sapiens
cacccacctcagcctccc

SEQ ID NO: 3781210 - DNA, 14 bp, Homo sapiens
cacccagacagctc

SEQ ID NO: 3781211 - DNA, 22 bp, Homo sapiens
cacccagacagctccctctgcc

SEQ ID NO: 3781212 - DNA, 16 bp, Homo sapiens
cacccagcccacttct

SEQ ID NO: 3781213 - DNA, 12 bp, Homo sapiens
cacccagcccat

SEQ ID NO: 3781214 - DNA, 15 bp, Homo sapiens
cacccagcccattct

SEQ ID NO: 3781215 - DNA, 16 bp, Homo sapiens
cacccaggagccccga

SEQ ID NO: 3781216 - DNA, 14 bp, Homo sapiens
cacccatgaagaca

SEQ ID NO: 3781217 - DNA, 22 bp, Homo sapiens
cacccatgaagacaggacagtg

SEQ ID NO: 3781218 - DNA, 14 bp, Homo sapiens
caccccactcacag

SEQ ID NO: 3781219 - DNA, 17 bp, Homo sapiens
caccccactcacagaga

SEQ ID NO: 3781220 - DNA, 13 bp, Homo sapiens
caccccagctgct

SEQ ID NO: 3781221 - DNA, 18 bp, Homo sapiens
caccccagtgcacccact

SEQ ID NO: 3781222 - DNA, 21 bp, Homo sapiens
caccccatcccacaccctgga

SEQ ID NO: 3781223 - DNA, 15 bp, Homo sapiens
caccccatgccaaag

SEQ ID NO: 3781224 - DNA, 12 bp, Homo sapiens
cacccccaaggg

SEQ ID NO: 3781225 - DNA, 14 bp, Homo sapiens
caccccccaagctg

SEQ ID NO: 3781226 - DNA, 15 bp, Homo sapiens
caccccccaagctgt

SEQ ID NO: 3781227 - DNA, 13 bp, Homo sapiens
caccccctccctg

SEQ ID NO: 3781228 - DNA, 16 bp, Homo sapiens
caccccctccctggcc

SEQ ID NO: 3781229 - DNA, 23 bp, Homo sapiens
caccccctccctggcctgttctg

SEQ ID NO: 3781230 - DNA, 18 bp, Homo sapiens
cacccccttctctgctcc

SEQ ID NO: 3781231 - DNA, 18 bp, Homo sapiens
caccccgggctctctgct

SEQ ID NO: 3781232 - DNA, 23 bp, Homo sapiens
caccccgtctggggttcagcccc

SEQ ID NO: 3781233 - DNA, 14 bp, Homo sapiens
cacccctaaagaga

SEQ ID NO: 3781234 - DNA, 15 bp, Homo sapiens
cacccctaaagagat

SEQ ID NO: 3781235 - DNA, 12 bp, Homo sapiens
cacccctccttc

SEQ ID NO: 3781236 - DNA, 14 bp, Homo sapiens
cacccctccttcct

SEQ ID NO: 3781237 - DNA, 23 bp, Homo sapiens
cacccctccttccttgaccagca

SEQ ID NO: 3781238 - DNA, 16 bp, Homo sapiens
cacccctgccctggga

SEQ ID NO: 3781239 - DNA, 16 bp, Homo sapiens
cacccgaggctgccca

SEQ ID NO: 3781240 - DNA, 13 bp, Homo sapiens
cacccggcccctg

SEQ ID NO: 3781241 - DNA, 17 bp, Homo sapiens
cacccggcccctgctgg

SEQ ID NO: 3781242 - DNA, 17 bp, Homo sapiens
caccctagtcccttccc

SEQ ID NO: 3781243 - DNA, 14 bp, Homo sapiens
caccctcccagctc

SEQ ID NO: 3781244 - DNA, 15 bp, Homo sapiens
caccctcccagctct

SEQ ID NO: 3781245 - DNA, 16 bp, Homo sapiens
caccctcgaagcgcgc

SEQ ID NO: 3781246 - DNA, 19 bp, Homo sapiens
caccctcgaagcgcgccac

SEQ ID NO: 3781247 - DNA, 23 bp, Homo sapiens
caccctcgaagcgcgccactcgc

SEQ ID NO: 3781248 - DNA, 11 bp, Homo sapiens
caccctggaat

SEQ ID NO: 3781249 - DNA, 22 bp, Homo sapiens
caccctgtcaagttaacaagga

SEQ ID NO: 3781250 - DNA, 20 bp, Homo sapiens
caccctgtccaaactgccta

SEQ ID NO: 3781251 - DNA, 17 bp, Homo sapiens
cacccttggaggctgtc

SEQ ID NO: 3781252 - DNA, 13 bp, Homo sapiens
cacccttggcctg

SEQ ID NO: 3781253 - DNA, 23 bp, Homo sapiens
cacccttggcctgtctcatcccc

SEQ ID NO: 3781254 - DNA, 13 bp, Homo sapiens
caccgagaatgtt

SEQ ID NO: 3781255 - DNA, 18 bp, Homo sapiens
caccgagagtagccgaga

SEQ ID NO: 3781256 - DNA, 19 bp, Homo sapiens
caccgccggccagctggga

SEQ ID NO: 3781257 - DNA, 13 bp, Homo sapiens
caccgctccccag

SEQ ID NO: 3781258 - DNA, 14 bp, Homo sapiens
caccgctccccagc

SEQ ID NO: 3781259 - DNA, 17 bp, Homo sapiens
caccgctccccagccca

SEQ ID NO: 3781260 - DNA, 13 bp, Homo sapiens
caccgctgccagc

SEQ ID NO: 3781261 - DNA, 22 bp, Homo sapiens
caccggatcctgggtggtctgc

SEQ ID NO: 3781262 - DNA, 18 bp, Homo sapiens
caccgggccacagagaaa

SEQ ID NO: 3781263 - DNA, 15 bp, Homo sapiens
caccgtggctaagag

SEQ ID NO: 3781264 - DNA, 15 bp, Homo sapiens
cacctaagtctctgt

SEQ ID NO: 3781265 - DNA, 19 bp, Homo sapiens
cacctaccttcaaagctga

SEQ ID NO: 3781266 - DNA, 13 bp, Homo sapiens
cacctagatcaga

SEQ ID NO: 3781267 - DNA, 17 bp, Homo sapiens
cacctaggccactcctc

SEQ ID NO: 3781268 - DNA, 19 bp, Homo sapiens
cacctaggccactcctcca

SEQ ID NO: 3781269 - DNA, 16 bp, Homo sapiens
cacctataaaacaggt

SEQ ID NO: 3781270 - DNA, 13 bp, Homo sapiens
cacctcagagccc

SEQ ID NO: 3781271 - DNA, 21 bp, Homo sapiens
cacctcagttcccttggcctc

SEQ ID NO: 3781272 - DNA, 10 bp, Homo sapiens
cacctcccag

SEQ ID NO: 3781273 - DNA, 16 bp, Homo sapiens
cacctcccagcccctg

SEQ ID NO: 3781274 - DNA, 14 bp, Homo sapiens
cacctccccagcct

SEQ ID NO: 3781275 - DNA, 16 bp, Homo sapiens
cacctccccccactgc

SEQ ID NO: 3781276 - DNA, 17 bp, Homo sapiens
cacctccccccactgca

SEQ ID NO: 3781277 - DNA, 23 bp, Homo sapiens
cacctccccccactgcaggcccc

SEQ ID NO: 3781278 - DNA, 13 bp, Homo sapiens
cacctcccctatc

SEQ ID NO: 3781279 - DNA, 14 bp, Homo sapiens
cacctcccctatcc

SEQ ID NO: 3781280 - DNA, 14 bp, Homo sapiens
cacctcccctcctt

SEQ ID NO: 3781281 - DNA, 14 bp, Homo sapiens
cacctcctgcctcg

SEQ ID NO: 3781282 - DNA, 17 bp, Homo sapiens
cacctctggactggcta

SEQ ID NO: 3781283 - DNA, 19 bp, Homo sapiens
cacctctggactggctaga

SEQ ID NO: 3781284 - DNA, 23 bp, Homo sapiens
cacctgaagactcattcttctgt

SEQ ID NO: 3781285 - DNA, 10 bp, Homo sapiens
cacctgagct

SEQ ID NO: 3781286 - DNA, 14 bp, Homo sapiens
cacctgagctttgg

SEQ ID NO: 3781287 - DNA, 20 bp, Homo sapiens
cacctgagctttggacgcac

SEQ ID NO: 3781288 - DNA, 14 bp, Homo sapiens
cacctgcacctccc

SEQ ID NO: 3781289 - DNA, 15 bp, Homo sapiens
cacctgcacctcccc

SEQ ID NO: 3781290 - DNA, 17 bp, Homo sapiens
cacctgcacctcccccc

SEQ ID NO: 3781291 - DNA, 18 bp, Homo sapiens
cacctgccactaggctgg

SEQ ID NO: 3781292 - DNA, 21 bp, Homo sapiens
cacctgccactaggctgggtg

SEQ ID NO: 3781293 - DNA, 13 bp, Homo sapiens
cacctgccagcct

SEQ ID NO: 3781294 - DNA, 17 bp, Homo sapiens
cacctgccagcctggct

SEQ ID NO: 3781295 - DNA, 22 bp, Homo sapiens
cacctgccagcctggcttctgg

SEQ ID NO: 3781296 - DNA, 22 bp, Homo sapiens
cacctgccatttgcaccctccg

SEQ ID NO: 3781297 - DNA, 13 bp, Homo sapiens
cacctgcccaacc

SEQ ID NO: 3781298 - DNA, 15 bp, Homo sapiens
cacctgcccccttct

SEQ ID NO: 3781299 - DNA, 19 bp, Homo sapiens
cacctgctgagagacccaa

SEQ ID NO: 3781300 - DNA, 17 bp, Homo sapiens
cacctgctggcccctca

SEQ ID NO: 3781301 - DNA, 12 bp, Homo sapiens
cagacccggctg

SEQ ID NO: 3781302 - DNA, 22 bp, Homo sapiens
cagacctaggatttcatgattt

SEQ ID NO: 3781303 - DNA, 12 bp, Homo sapiens
cagacctgagct

SEQ ID NO: 3781304 - DNA, 17 bp, Homo sapiens
cagacctgagctcccca

SEQ ID NO: 3781305 - DNA, 22 bp, Homo sapiens
cagacctgagctccccaccacc

SEQ ID NO: 3781306 - DNA, 14 bp, Homo sapiens
cagacctgtcttcc

SEQ ID NO: 3781307 - DNA, 15 bp, Homo sapiens
cagacggcacccacc

SEQ ID NO: 3781308 - DNA, 19 bp, Homo sapiens
cagacggttcaccagcctc

SEQ ID NO: 3781309 - DNA, 14 bp, Homo sapiens
cagactcaataaaa

SEQ ID NO: 3781310 - DNA, 18 bp, Homo sapiens
cagactcatacagaaggt

SEQ ID NO: 3781311 - DNA, 23 bp, Homo sapiens
cagactctacagaggccatgggc

SEQ ID NO: 3781312 - DNA, 20 bp, Homo sapiens
cagactgacaaatgtgtatc

SEQ ID NO: 3781313 - DNA, 15 bp, Homo sapiens
cagactgctgggact

SEQ ID NO: 3781314 - DNA, 20 bp, Homo sapiens
cagactgctgggactggcca

SEQ ID NO: 3781315 - DNA, 23 bp, Homo sapiens
cagactgctgggactggccaggt

SEQ ID NO: 3781316 - DNA, 14 bp, Homo sapiens
cagactgcttccaa

SEQ ID NO: 3781317 - DNA, 14 bp, Homo sapiens
cagactgctttaaa

SEQ ID NO: 3781318 - DNA, 13 bp, Homo sapiens
cagactggaagca

SEQ ID NO: 3781319 - DNA, 11 bp, Homo sapiens
cagactggagg

SEQ ID NO: 3781320 - DNA, 21 bp, Homo sapiens
cagactggcctgaggagcagc

SEQ ID NO: 3781321 - DNA, 17 bp, Homo sapiens
cagactggtgagcagac

SEQ ID NO: 3781322 - DNA, 20 bp, Homo sapiens
cagactggtgagcagactgg

SEQ ID NO: 3781323 - DNA, 19 bp, Homo sapiens
cagagaaagtacttctcca

SEQ ID NO: 3781324 - DNA, 14 bp, Homo sapiens
cagagaaggaatgt

SEQ ID NO: 3781325 - DNA, 15 bp, Homo sapiens
cagagaaggcagcag

SEQ ID NO: 3781326 - DNA, 14 bp, Homo sapiens
cagagaaggcagga

SEQ ID NO: 3781327 - DNA, 18 bp, Homo sapiens
cagagaaggccaggggct

SEQ ID NO: 3781328 - DNA, 15 bp, Homo sapiens
cagagaattctctta

SEQ ID NO: 3781329 - DNA, 21 bp, Homo sapiens
cagagacaggaaaatcctctg

SEQ ID NO: 3781330 - DNA, 22 bp, Homo sapiens
cagagacaggaaaatcctctgg

SEQ ID NO: 3781331 - DNA, 23 bp, Homo sapiens
cagagacaggaaaatcctctggc

SEQ ID NO: 3781332 - DNA, 22 bp, Homo sapiens
cagagacaggaagtcttcaggg

SEQ ID NO: 3781333 - DNA, 19 bp, Homo sapiens
cagagacaggcccaagaga

SEQ ID NO: 3781334 - DNA, 13 bp, Homo sapiens
cagagacgcagga

SEQ ID NO: 3781335 - DNA, 23 bp, Homo sapiens
cagagactcagggccccagcact

SEQ ID NO: 3781336 - DNA, 22 bp, Homo sapiens
cagagagagaagtgcccctgct

SEQ ID NO: 3781337 - DNA, 23 bp, Homo sapiens
cagagagagaagtgcccctgctg

SEQ ID NO: 3781338 - DNA, 12 bp, Homo sapiens
cagagagctggt

SEQ ID NO: 3781339 - DNA, 17 bp, Homo sapiens
cagagaggacgtgggcg

SEQ ID NO: 3781340 - DNA, 17 bp, Homo sapiens
cagagaggagaaacaca

SEQ ID NO: 3781341 - DNA, 21 bp, Homo sapiens
cagagaggagaaacacatctt

SEQ ID NO: 3781342 - DNA, 14 bp, Homo sapiens
cagagagtggctcc

SEQ ID NO: 3781343 - DNA, 14 bp, Homo sapiens
cagagatgcctcca

SEQ ID NO: 3781344 - DNA, 19 bp, Homo sapiens
cagagatgcctccaccgct

SEQ ID NO: 3781345 - DNA, 21 bp, Homo sapiens
cagagatgcctccaccgctgc

SEQ ID NO: 3781346 - DNA, 23 bp, Homo sapiens
cagagatgggactgggagggccc

SEQ ID NO: 3781347 - DNA, 14 bp, Homo sapiens
cagagcaaaataat

SEQ ID NO: 3781348 - DNA, 17 bp, Homo sapiens
cagagcaaagggccagg

SEQ ID NO: 3781349 - DNA, 20 bp, Homo sapiens
cagagcaagactctgtctca

SEQ ID NO: 3781350 - DNA, 20 bp, Homo sapiens
cagagcaagcttttttattt

SEQ ID NO: 3781351 - DNA, 15 bp, Homo sapiens
cagagcaggggcagg

SEQ ID NO: 3781352 - DNA, 11 bp, Homo sapiens
cagagccatgg

SEQ ID NO: 3781353 - DNA, 15 bp, Homo sapiens
cagagcccaccttgg

SEQ ID NO: 3781354 - DNA, 20 bp, Homo sapiens
cagagcccaccttggctcaa

SEQ ID NO: 3781355 - DNA, 23 bp, Homo sapiens
cagagccccacacggaggcatct

SEQ ID NO: 3781356 - DNA, 20 bp, Homo sapiens
cagagcctcctttctggctt

SEQ ID NO: 3781357 - DNA, 22 bp, Homo sapiens
cagagcgtccttccccctgtag

SEQ ID NO: 3781358 - DNA, 23 bp, Homo sapiens
cagagcgtccttccccctgtaga

SEQ ID NO: 3781359 - DNA, 19 bp, Homo sapiens
cagagctctggagccacct

SEQ ID NO: 3781360 - DNA, 10 bp, Homo sapiens
cagagctggg

SEQ ID NO: 3781361 - DNA, 14 bp, Homo sapiens
cagagctgggaggg

SEQ ID NO: 3781362 - DNA, 20 bp, Homo sapiens
cagagctgggatgtttctgt

SEQ ID NO: 3781363 - DNA, 19 bp, Homo sapiens
cagagctgtttatggcctc

SEQ ID NO: 3781364 - DNA, 20 bp, Homo sapiens
cagagctgtttatggcctca

SEQ ID NO: 3781365 - DNA, 14 bp, Homo sapiens
cagaggaagagcag

SEQ ID NO: 3781366 - DNA, 13 bp, Homo sapiens
cagaggaaggaga

SEQ ID NO: 3781367 - DNA, 23 bp, Homo sapiens
cagaggacacctgtactggagag

SEQ ID NO: 3781368 - DNA, 21 bp, Homo sapiens
cagaggcacagccggggcctg

SEQ ID NO: 3781369 - DNA, 18 bp, Homo sapiens
cagaggcagaaccctggt

SEQ ID NO: 3781370 - DNA, 20 bp, Homo sapiens
cagaggcagccccattctgc

SEQ ID NO: 3781371 - DNA, 19 bp, Homo sapiens
cagaggccatgggcctcct

SEQ ID NO: 3781372 - DNA, 20 bp, Homo sapiens
cagaggccatgggcctcctg

SEQ ID NO: 3781373 - DNA, 21 bp, Homo sapiens
cagaggccatgggcctcctgt

SEQ ID NO: 3781374 - DNA, 20 bp, Homo sapiens
cagaggctattattttcact

SEQ ID NO: 3781375 - DNA, 14 bp, Homo sapiens
cagaggctggaggc

SEQ ID NO: 3781376 - DNA, 16 bp, Homo sapiens
cagaggctggaggcag

SEQ ID NO: 3781377 - DNA, 19 bp, Homo sapiens
cagaggctggaggcagggc

SEQ ID NO: 3781378 - DNA, 21 bp, Homo sapiens
cagaggctggaggcagggcct

SEQ ID NO: 3781379 - DNA, 14 bp, Homo sapiens
cagaggctggcctc

SEQ ID NO: 3781380 - DNA, 15 bp, Homo sapiens
cagaggcttcttcag

SEQ ID NO: 3781381 - DNA, 19 bp, Homo sapiens
cagagggactttgtataga

SEQ ID NO: 3781382 - DNA, 22 bp, Homo sapiens
cagagggagtgacagaggcagc

SEQ ID NO: 3781383 - DNA, 23 bp, Homo sapiens
cagagggagtgacagaggcagcc

SEQ ID NO: 3781384 - DNA, 16 bp, Homo sapiens
cagagggcagaggctg

SEQ ID NO: 3781385 - DNA, 18 bp, Homo sapiens
cagagggcagaggctgga

SEQ ID NO: 3781386 - DNA, 13 bp, Homo sapiens
cagagggcccagg

SEQ ID NO: 3781387 - DNA, 18 bp, Homo sapiens
cagagggcccaggcaggc

SEQ ID NO: 3781388 - DNA, 23 bp, Homo sapiens
cagaggggtgggttcctcttccc

SEQ ID NO: 3781389 - DNA, 18 bp, Homo sapiens
cagaggtagggctgccac

SEQ ID NO: 3781390 - DNA, 18 bp, Homo sapiens
cagaggtggctctggaat

SEQ ID NO: 3781391 - DNA, 13 bp, Homo sapiens
cagagtcagcaga

SEQ ID NO: 3781392 - DNA, 19 bp, Homo sapiens
cagagtctcactgttgccc

SEQ ID NO: 3781393 - DNA, 23 bp, Homo sapiens
cagagtctcactgttgcccaggc

SEQ ID NO: 3781394 - DNA, 17 bp, Homo sapiens
cagagtgagactctgtc

SEQ ID NO: 3781395 - DNA, 20 bp, Homo sapiens
cagagtgagactctgtctca

SEQ ID NO: 3781396 - DNA, 13 bp, Homo sapiens
cagagtgcccaga

SEQ ID NO: 3781397 - DNA, 15 bp, Homo sapiens
cagagtggcctggcc

SEQ ID NO: 3781398 - DNA, 22 bp, Homo sapiens
cagagtggcctggccaggagct

SEQ ID NO: 3781399 - DNA, 23 bp, Homo sapiens
cagagtggcctggccaggagctc

SEQ ID NO: 3781400 - DNA, 21 bp, Homo sapiens
cagagtggtctttctggagag

SEQ ID NO: 3781401 - DNA, 23 bp, Homo sapiens
cagagtgtggccttcggacaact

SEQ ID NO: 3781402 - DNA, 14 bp, Homo sapiens
cagagttcactata

SEQ ID NO: 3781403 - DNA, 20 bp, Homo sapiens
cagagttcactataaatggt

SEQ ID NO: 3781404 - DNA, 16 bp, Homo sapiens
cagataatcagcctct

SEQ ID NO: 3781405 - DNA, 17 bp, Homo sapiens
cagataatcagcctctt

SEQ ID NO: 3781406 - DNA, 15 bp, Homo sapiens
cagataatccctgta

SEQ ID NO: 3781407 - DNA, 22 bp, Homo sapiens
cagatacaggaaaagctgctga

SEQ ID NO: 3781408 - DNA, 23 bp, Homo sapiens
cagatacaggaaaagctgctgac

SEQ ID NO: 3781409 - DNA, 18 bp, Homo sapiens
cagatactggaagttttg

SEQ ID NO: 3781410 - DNA, 22 bp, Homo sapiens
cagatactggaagttttgcatt

SEQ ID NO: 3781411 - DNA, 17 bp, Homo sapiens
cagataggccttcttgt

SEQ ID NO: 3781412 - DNA, 19 bp, Homo sapiens
cagataggccttcttgtga

SEQ ID NO: 3781413 - DNA, 12 bp, Homo sapiens
caggagacatcc

SEQ ID NO: 3781414 - DNA, 17 bp, Homo sapiens
caggagagccagccctc

SEQ ID NO: 3781415 - DNA, 17 bp, Homo sapiens
caggagaggggcagaac

SEQ ID NO: 3781416 - DNA, 20 bp, Homo sapiens
caggagatggaagttgcagt

SEQ ID NO: 3781417 - DNA, 16 bp, Homo sapiens
caggagccccgaggcc

SEQ ID NO: 3781418 - DNA, 22 bp, Homo sapiens
caggagccccgaggccttctct

SEQ ID NO: 3781419 - DNA, 23 bp, Homo sapiens
caggagccccgaggccttctctg

SEQ ID NO: 3781420 - DNA, 15 bp, Homo sapiens
caggagcctgtgcct

SEQ ID NO: 3781421 - DNA, 16 bp, Homo sapiens
caggagcctgtgcctc

SEQ ID NO: 3781422 - DNA, 19 bp, Homo sapiens
caggagctcttcaggcctc

SEQ ID NO: 3781423 - DNA, 22 bp, Homo sapiens
caggagctcttcaggcctccct

SEQ ID NO: 3781424 - DNA, 15 bp, Homo sapiens
caggagctgggcaga

SEQ ID NO: 3781425 - DNA, 23 bp, Homo sapiens
caggagctgggcagaaggccaag

SEQ ID NO: 3781426 - DNA, 19 bp, Homo sapiens
caggaggatcacttgagtc

SEQ ID NO: 3781427 - DNA, 12 bp, Homo sapiens
caggaggctgag

SEQ ID NO: 3781428 - DNA, 17 bp, Homo sapiens
caggaggctgaggcagg

SEQ ID NO: 3781429 - DNA, 21 bp, Homo sapiens
caggaggcttggaaagcatca

SEQ ID NO: 3781430 - DNA, 22 bp, Homo sapiens
caggaggggagtgaggcaggtg

SEQ ID NO: 3781431 - DNA, 15 bp, Homo sapiens
caggaggtggaggtt

SEQ ID NO: 3781432 - DNA, 16 bp, Homo sapiens
caggagtcccaaggaa

SEQ ID NO: 3781433 - DNA, 19 bp, Homo sapiens
caggagtcccaaggaaagc

SEQ ID NO: 3781434 - DNA, 13 bp, Homo sapiens
caggagtccctgg

SEQ ID NO: 3781435 - DNA, 14 bp, Homo sapiens
caggagtccctggt

SEQ ID NO: 3781436 - DNA, 21 bp, Homo sapiens
caggagttagaggccagcctg

SEQ ID NO: 3781437 - DNA, 22 bp, Homo sapiens
caggagttcaagaccagcctgg

SEQ ID NO: 3781438 - DNA, 18 bp, Homo sapiens
caggagttcgaggctgca

SEQ ID NO: 3781439 - DNA, 16 bp, Homo sapiens
caggagttggaagtgt

SEQ ID NO: 3781440 - DNA, 21 bp, Homo sapiens
caggagtttgagaccaacctg

SEQ ID NO: 3781441 - DNA, 18 bp, Homo sapiens
caggagtttgaggctgca

SEQ ID NO: 3781442 - DNA, 17 bp, Homo sapiens
caggatactctgtcaga

SEQ ID NO: 3781443 - DNA, 17 bp, Homo sapiens
caggatagataactctt

SEQ ID NO: 3781444 - DNA, 13 bp, Homo sapiens
caggatcagtctg

SEQ ID NO: 3781445 - DNA, 14 bp, Homo sapiens
caggatcagtctga

SEQ ID NO: 3781446 - DNA, 15 bp, Homo sapiens
caggatgaccctgcg

SEQ ID NO: 3781447 - DNA, 13 bp, Homo sapiens
caggatgcccagg

SEQ ID NO: 3781448 - DNA, 17 bp, Homo sapiens
caggatgcccagggcca

SEQ ID NO: 3781449 - DNA, 19 bp, Homo sapiens
caggatgcccagggccact

SEQ ID NO: 3781450 - DNA, 15 bp, Homo sapiens
caggatggaggggtg

SEQ ID NO: 3781451 - DNA, 23 bp, Homo sapiens
caggatggaggggtggtcctgac

SEQ ID NO: 3781452 - DNA, 21 bp, Homo sapiens
caggatggcaaccagaccatt

SEQ ID NO: 3781453 - DNA, 18 bp, Homo sapiens
caggattcttcctccctc

SEQ ID NO: 3781454 - DNA, 20 bp, Homo sapiens
caggattcttcctccctccc

SEQ ID NO: 3781455 - DNA, 18 bp, Homo sapiens
caggcaaaatccttgctt

SEQ ID NO: 3781456 - DNA, 15 bp, Homo sapiens
caggcaactgaggca

SEQ ID NO: 3781457 - DNA, 17 bp, Homo sapiens
caggcaactgaggcaga

SEQ ID NO: 3781458 - DNA, 22 bp, Homo sapiens
caggcaactgaggcagacagca

SEQ ID NO: 3781459 - DNA, 14 bp, Homo sapiens
caggcaagcacctc

SEQ ID NO: 3781460 - DNA, 15 bp, Homo sapiens
caggcaatggcctaa

SEQ ID NO: 3781461 - DNA, 17 bp, Homo sapiens
caggcaccgagaatgtt

SEQ ID NO: 3781462 - DNA, 17 bp, Homo sapiens
caggcacgaacccacct

SEQ ID NO: 3781463 - DNA, 20 bp, Homo sapiens
caggcacgaacccacctgct

SEQ ID NO: 3781464 - DNA, 16 bp, Homo sapiens
caggcactgctgccca

SEQ ID NO: 3781465 - DNA, 14 bp, Homo sapiens
caggcagagaatca

SEQ ID NO: 3781466 - DNA, 15 bp, Homo sapiens
caggcagatctgtgc

SEQ ID NO: 3781467 - DNA, 21 bp, Homo sapiens
caggcagatctgtgccccatg

SEQ ID NO: 3781468 - DNA, 22 bp, Homo sapiens
caggcagctttttctctcccac

SEQ ID NO: 3781469 - DNA, 20 bp, Homo sapiens
caggcaggaaggctgagagg

SEQ ID NO: 3781470 - DNA, 18 bp, Homo sapiens
caggcaggaagggcagga

SEQ ID NO: 3781471 - DNA, 17 bp, Homo sapiens
caggcagggctgactct

SEQ ID NO: 3781472 - DNA, 13 bp, Homo sapiens
caggcaggtccag

SEQ ID NO: 3781473 - DNA, 13 bp, Homo sapiens
caggcaggtcttg

SEQ ID NO: 3781474 - DNA, 15 bp, Homo sapiens
caggcaggtgggatg

SEQ ID NO: 3781475 - DNA, 17 bp, Homo sapiens
caggcagttggccagag

SEQ ID NO: 3781476 - DNA, 14 bp, Homo sapiens
caggcataggcctg

SEQ ID NO: 3781477 - DNA, 22 bp, Homo sapiens
caggcatcattccaccatggct

SEQ ID NO: 3781478 - DNA, 14 bp, Homo sapiens
caggcatgcctgtg

SEQ ID NO: 3781479 - DNA, 20 bp, Homo sapiens
caggcatgttctctgaggac

SEQ ID NO: 3781480 - DNA, 18 bp, Homo sapiens
caggccaagagcagaggc

SEQ ID NO: 3781481 - DNA, 21 bp, Homo sapiens
caggccaagagcagaggcagc

SEQ ID NO: 3781482 - DNA, 23 bp, Homo sapiens
caggccaccatattcagtgctgt

SEQ ID NO: 3781483 - DNA, 13 bp, Homo sapiens
caggccacctgcc

SEQ ID NO: 3781484 - DNA, 23 bp, Homo sapiens
caggccacctgcccccttctccc

SEQ ID NO: 3781485 - DNA, 21 bp, Homo sapiens
caggccagagggagtgacaga

SEQ ID NO: 3781486 - DNA, 15 bp, Homo sapiens
caggccaggtgcagt

SEQ ID NO: 3781487 - DNA, 17 bp, Homo sapiens
caggccatgtgagccac

SEQ ID NO: 3781488 - DNA, 23 bp, Homo sapiens
caggcccaaattatcaagctaat

SEQ ID NO: 3781489 - DNA, 22 bp, Homo sapiens
caggccccaaaaccacagccct

SEQ ID NO: 3781490 - DNA, 15 bp, Homo sapiens
caggccccaggaagc

SEQ ID NO: 3781491 - DNA, 13 bp, Homo sapiens
caggcccccaagc

SEQ ID NO: 3781492 - DNA, 19 bp, Homo sapiens
caggcccccaagcctgcag

SEQ ID NO: 3781493 - DNA, 15 bp, Homo sapiens
caggccccctgcatc

SEQ ID NO: 3781494 - DNA, 15 bp, Homo sapiens
caggcccggctccag

SEQ ID NO: 3781495 - DNA, 15 bp, Homo sapiens
caggcccggggctgg

SEQ ID NO: 3781496 - DNA, 21 bp, Homo sapiens
caggcccttattttcaagaaa

SEQ ID NO: 3781497 - DNA, 15 bp, Homo sapiens
caggcccttcctctc

SEQ ID NO: 3781498 - DNA, 20 bp, Homo sapiens
caggcccttcctctccactg

SEQ ID NO: 3781499 - DNA, 16 bp, Homo sapiens
caggccgccccagcct

SEQ ID NO: 3781500 - DNA, 18 bp, Homo sapiens
caggccgccccagcctct

SEQ ID NO: 3781501 - DNA, 20 bp, Homo sapiens
caggccgccccagcctctga

SEQ ID NO: 3781502 - DNA, 15 bp, Homo sapiens
caggccgtggctgcc

SEQ ID NO: 3781503 - DNA, 17 bp, Homo sapiens
caggcctccagctcagc

SEQ ID NO: 3781504 - DNA, 19 bp, Homo sapiens
caggcctccagctcagcag

SEQ ID NO: 3781505 - DNA, 22 bp, Homo sapiens
caggcctccctctctcttctgc

SEQ ID NO: 3781506 - DNA, 18 bp, Homo sapiens
caggcctgccagacggca

SEQ ID NO: 3781507 - DNA, 20 bp, Homo sapiens
caggcctgcctgttcccatt

SEQ ID NO: 3781508 - DNA, 14 bp, Homo sapiens
caggcctgttgctt

SEQ ID NO: 3781509 - DNA, 20 bp, Homo sapiens
caggcgatccacctgtctca

SEQ ID NO: 3781510 - DNA, 13 bp, Homo sapiens
caggctcctccct

SEQ ID NO: 3781511 - DNA, 14 bp, Homo sapiens
caggctcctccctc

SEQ ID NO: 3781512 - DNA, 17 bp, Homo sapiens
caggctccttcctgtct

SEQ ID NO: 3781513 - DNA, 18 bp, Homo sapiens
caggctccttcctgtctt

SEQ ID NO: 3781514 - DNA, 21 bp, Homo sapiens
caggctcctttagcgcccagt

SEQ ID NO: 3781515 - DNA, 13 bp, Homo sapiens
caggctctgccct

SEQ ID NO: 3781516 - DNA, 14 bp, Homo sapiens
caggctctgccctg

SEQ ID NO: 3781517 - DNA, 21 bp, Homo sapiens
caggctgccaaggccagagtg

SEQ ID NO: 3781518 - DNA, 18 bp, Homo sapiens
caggctgctcagggctgg

SEQ ID NO: 3781519 - DNA, 12 bp, Homo sapiens
caggctgctgga

SEQ ID NO: 3781520 - DNA, 16 bp, Homo sapiens
caggctgctggaggaa

SEQ ID NO: 3781521 - DNA, 15 bp, Homo sapiens
caggctgcttgggat

SEQ ID NO: 3781522 - DNA, 14 bp, Homo sapiens
caggctgggcttca

SEQ ID NO: 3781523 - DNA, 15 bp, Homo sapiens
caggctgggcttcag

SEQ ID NO: 3781524 - DNA, 22 bp, Homo sapiens
caggctgtatcccatgagcctc

SEQ ID NO: 3781525 - DNA, 23 bp, Homo sapiens
caggctgtatcccatgagcctca

SEQ ID NO: 3781526 - DNA, 22 bp, Homo sapiens
catcacagggttgggcccagat

SEQ ID NO: 3781527 - DNA, 15 bp, Homo sapiens
catcacctcaggcca

SEQ ID NO: 3781528 - DNA, 17 bp, Homo sapiens
catcaccttaggcaggg

SEQ ID NO: 3781529 - DNA, 22 bp, Homo sapiens
catcaccttaggcagggaagtg

SEQ ID NO: 3781530 - DNA, 15 bp, Homo sapiens
catcacgcctgtgca

SEQ ID NO: 3781531 - DNA, 15 bp, Homo sapiens
catcacttgtacaaa

SEQ ID NO: 3781532 - DNA, 19 bp, Homo sapiens
catcacttgtacaaaataa

SEQ ID NO: 3781533 - DNA, 12 bp, Homo sapiens
catcagaaatgt

SEQ ID NO: 3781534 - DNA, 11 bp, Homo sapiens
catcagaagga

SEQ ID NO: 3781535 - DNA, 15 bp, Homo sapiens
catcagaaggagaag

SEQ ID NO: 3781536 - DNA, 15 bp, Homo sapiens
catcagacctgtctt

SEQ ID NO: 3781537 - DNA, 14 bp, Homo sapiens
catcagctccagct

SEQ ID NO: 3781538 - DNA, 23 bp, Homo sapiens
catcagctgtaagaagagactgg

SEQ ID NO: 3781539 - DNA, 23 bp, Homo sapiens
catcagcttaggggctgctgacc

SEQ ID NO: 3781540 - DNA, 17 bp, Homo sapiens
catcagttcccccagta

SEQ ID NO: 3781541 - DNA, 14 bp, Homo sapiens
catcataaaataaa

SEQ ID NO: 3781542 - DNA, 16 bp, Homo sapiens
catcatcctaagctat

SEQ ID NO: 3781543 - DNA, 13 bp, Homo sapiens
catcatctgtaga

SEQ ID NO: 3781544 - DNA, 22 bp, Homo sapiens
catcattccttgagaaaaacaa

SEQ ID NO: 3781545 - DNA, 14 bp, Homo sapiens
catccaaggagaaa

SEQ ID NO: 3781546 - DNA, 21 bp, Homo sapiens
catccaaggagaaacagagac

SEQ ID NO: 3781547 - DNA, 17 bp, Homo sapiens
catccaataggaatgct

SEQ ID NO: 3781548 - DNA, 21 bp, Homo sapiens
catccaataggaatgctaaca

SEQ ID NO: 3781549 - DNA, 13 bp, Homo sapiens
catccaatcctca

SEQ ID NO: 3781550 - DNA, 15 bp, Homo sapiens
catccaatcctcact

SEQ ID NO: 3781551 - DNA, 14 bp, Homo sapiens
catccaatgctcaa

SEQ ID NO: 3781552 - DNA, 14 bp, Homo sapiens
catccactctaccc

SEQ ID NO: 3781553 - DNA, 18 bp, Homo sapiens
catccactctaccctccc

SEQ ID NO: 3781554 - DNA, 14 bp, Homo sapiens
catccactgtgcca

SEQ ID NO: 3781555 - DNA, 17 bp, Homo sapiens
catccactgtgccatgt

SEQ ID NO: 3781556 - DNA, 17 bp, Homo sapiens
catccaggttcagcttg

SEQ ID NO: 3781557 - DNA, 23 bp, Homo sapiens
catccagtctcccaacttgtatt

SEQ ID NO: 3781558 - DNA, 16 bp, Homo sapiens
catccatgtgtggact

SEQ ID NO: 3781559 - DNA, 17 bp, Homo sapiens
catccatgtgtggactc

SEQ ID NO: 3781560 - DNA, 18 bp, Homo sapiens
catccatgttccgagaag

SEQ ID NO: 3781561 - DNA, 15 bp, Homo sapiens
catccattcctcagg

SEQ ID NO: 3781562 - DNA, 19 bp, Homo sapiens
catccatttcatctatttc

SEQ ID NO: 3781563 - DNA, 16 bp, Homo sapiens
catcccagcctgtggt

SEQ ID NO: 3781564 - DNA, 13 bp, Homo sapiens
catcccagcggct

SEQ ID NO: 3781565 - DNA, 19 bp, Homo sapiens
catcccaggggaccacacc

SEQ ID NO: 3781566 - DNA, 16 bp, Homo sapiens
catcccatcccatccc

SEQ ID NO: 3781567 - DNA, 12 bp, Homo sapiens
catcccattgcc

SEQ ID NO: 3781568 - DNA, 17 bp, Homo sapiens
catcccattgccctggt

SEQ ID NO: 3781569 - DNA, 18 bp, Homo sapiens
catccccaggggtcccag

SEQ ID NO: 3781570 - DNA, 23 bp, Homo sapiens
catcccgacatggacccggagct

SEQ ID NO: 3781571 - DNA, 18 bp, Homo sapiens
catcccgctcttttccta

SEQ ID NO: 3781572 - DNA, 20 bp, Homo sapiens
catcccgtgcaaaacatgct

SEQ ID NO: 3781573 - DNA, 15 bp, Homo sapiens
catccctgccagctc

SEQ ID NO: 3781574 - DNA, 15 bp, Homo sapiens
catccgaggcagggt

SEQ ID NO: 3781575 - DNA, 15 bp, Homo sapiens
catccggcagcctgg

SEQ ID NO: 3781576 - DNA, 17 bp, Homo sapiens
catccgtagttccctga

SEQ ID NO: 3781577 - DNA, 17 bp, Homo sapiens
catccgtgagcagtgtg

SEQ ID NO: 3781578 - DNA, 19 bp, Homo sapiens
catcctccccttccctgca

SEQ ID NO: 3781579 - DNA, 20 bp, Homo sapiens
catcctccccttccctgcaa

SEQ ID NO: 3781580 - DNA, 19 bp, Homo sapiens
catcctccgtccagccgcc

SEQ ID NO: 3781581 - DNA, 20 bp, Homo sapiens
catcctccgtccagccgcca

SEQ ID NO: 3781582 - DNA, 22 bp, Homo sapiens
catcctggcacccggcccctgc

SEQ ID NO: 3781583 - DNA, 22 bp, Homo sapiens
catcctgtgtttctagggaaat

SEQ ID NO: 3781584 - DNA, 21 bp, Homo sapiens
catccttcaagaactctgggc

SEQ ID NO: 3781585 - DNA, 18 bp, Homo sapiens
catccttcctcacaccag

SEQ ID NO: 3781586 - DNA, 17 bp, Homo sapiens
catccttttctcctatc

SEQ ID NO: 3781587 - DNA, 18 bp, Homo sapiens
catccttttctcctatct

SEQ ID NO: 3781588 - DNA, 22 bp, Homo sapiens
catcggtcctgtctcccctctg

SEQ ID NO: 3781589 - DNA, 14 bp, Homo sapiens
catctaataaaaaa

SEQ ID NO: 3781590 - DNA, 15 bp, Homo sapiens
catctaccctccgat

SEQ ID NO: 3781591 - DNA, 19 bp, Homo sapiens
catctaccttttctcttca

SEQ ID NO: 3781592 - DNA, 18 bp, Homo sapiens
catctagcaaatgttatg

SEQ ID NO: 3781593 - DNA, 20 bp, Homo sapiens
catctatcgagtttgcaatg

SEQ ID NO: 3781594 - DNA, 19 bp, Homo sapiens
catctcactggatgcaaag

SEQ ID NO: 3781595 - DNA, 18 bp, Homo sapiens
catctcagtgctgtaaaa

SEQ ID NO: 3781596 - DNA, 22 bp, Homo sapiens
catctccagggagcaagacaga

SEQ ID NO: 3781597 - DNA, 22 bp, Homo sapiens
catctccctcgaacccacactg

SEQ ID NO: 3781598 - DNA, 23 bp, Homo sapiens
catctccctcgaacccacactgc

SEQ ID NO: 3781599 - DNA, 22 bp, Homo sapiens
catctcctgaggatcagaaagt

SEQ ID NO: 3781600 - DNA, 16 bp, Homo sapiens
catctctccctcccct

SEQ ID NO: 3781601 - DNA, 20 bp, Homo sapiens
catctctccctcccctgcca

SEQ ID NO: 3781602 - DNA, 21 bp, Homo sapiens
catctctctactcctacctca

SEQ ID NO: 3781603 - DNA, 15 bp, Homo sapiens
catctgacacaaaaa

SEQ ID NO: 3781604 - DNA, 19 bp, Homo sapiens
catctgcacccccctgggc

SEQ ID NO: 3781605 - DNA, 19 bp, Homo sapiens
catctgcattttcacccca

SEQ ID NO: 3781606 - DNA, 13 bp, Homo sapiens
catctgcccctcc

SEQ ID NO: 3781607 - DNA, 14 bp, Homo sapiens
catctgcccctccc

SEQ ID NO: 3781608 - DNA, 15 bp, Homo sapiens
catctgcccctcccc

SEQ ID NO: 3781609 - DNA, 17 bp, Homo sapiens
catctgcccctccccca

SEQ ID NO: 3781610 - DNA, 19 bp, Homo sapiens
catctgcccctcccccaac

SEQ ID NO: 3781611 - DNA, 12 bp, Homo sapiens
catctgctaata

SEQ ID NO: 3781612 - DNA, 17 bp, Homo sapiens
catctgctactgtgtca

SEQ ID NO: 3781613 - DNA, 15 bp, Homo sapiens
catctggccttacac

SEQ ID NO: 3781614 - DNA, 17 bp, Homo sapiens
catctgtgggcacgctg

SEQ ID NO: 3781615 - DNA, 13 bp, Homo sapiens
catcttaactctt

SEQ ID NO: 3781616 - DNA, 15 bp, Homo sapiens
catcttaactctttg

SEQ ID NO: 3781617 - DNA, 16 bp, Homo sapiens
catcttaactctttgc

SEQ ID NO: 3781618 - DNA, 20 bp, Homo sapiens
catcttagtatttgcatatt

SEQ ID NO: 3781619 - DNA, 20 bp, Homo sapiens
catcttattttcatgtatat

SEQ ID NO: 3781620 - DNA, 14 bp, Homo sapiens
catcttcaaagctt

SEQ ID NO: 3781621 - DNA, 23 bp, Homo sapiens
catcttccccaacgaaaagcaca

SEQ ID NO: 3781622 - DNA, 16 bp, Homo sapiens
catcttctcactccct

SEQ ID NO: 3781623 - DNA, 16 bp, Homo sapiens
catcttctccatctgg

SEQ ID NO: 3781624 - DNA, 14 bp, Homo sapiens
catcttgaagtgat

SEQ ID NO: 3781625 - DNA, 22 bp, Homo sapiens
catcttgaagtgatgttgttta

SEQ ID NO: 3781626 - DNA, 21 bp, Homo sapiens
catcttgaccaagcaggaagc

SEQ ID NO: 3781627 - DNA, 23 bp, Homo sapiens
catcttgaccaagcaggaagctc

SEQ ID NO: 3781628 - DNA, 13 bp, Homo sapiens
catcttgcctcca

SEQ ID NO: 3781629 - DNA, 13 bp, Homo sapiens
catcttgctctgc

SEQ ID NO: 3781630 - DNA, 14 bp, Homo sapiens
catcttgctctgct

SEQ ID NO: 3781631 - DNA, 15 bp, Homo sapiens
catgaaaaagcagct

SEQ ID NO: 3781632 - DNA, 22 bp, Homo sapiens
catgaaaaccattacctgactt

SEQ ID NO: 3781633 - DNA, 16 bp, Homo sapiens
catgaaaatcctacca

SEQ ID NO: 3781634 - DNA, 13 bp, Homo sapiens
catgaaacagaaa

SEQ ID NO: 3781635 - DNA, 22 bp, Homo sapiens
catgaaatatagatcagttata

SEQ ID NO: 3781636 - DNA, 15 bp, Homo sapiens
catgaagacaggaca

SEQ ID NO: 3781637 - DNA, 22 bp, Homo sapiens
catgaagcccaagtgaaatcaa

SEQ ID NO: 3781638 - DNA, 20 bp, Homo sapiens
catgaagtgtgtttccttca

SEQ ID NO: 3781639 - DNA, 17 bp, Homo sapiens
ccactctccccacacta

SEQ ID NO: 3781640 - DNA, 15 bp, Homo sapiens
ccactgaagctggga

SEQ ID NO: 3781641 - DNA, 15 bp, Homo sapiens
ccactgacagcctcc

SEQ ID NO: 3781642 - DNA, 16 bp, Homo sapiens
ccactgacagcctccc

SEQ ID NO: 3781643 - DNA, 19 bp, Homo sapiens
ccactgacagcctcccacc

SEQ ID NO: 3781644 - DNA, 19 bp, Homo sapiens
ccactgagagatctgctgt

SEQ ID NO: 3781645 - DNA, 15 bp, Homo sapiens
ccactgatggaaaca

SEQ ID NO: 3781646 - DNA, 21 bp, Homo sapiens
ccactgatggaaacaaagtgg

SEQ ID NO: 3781647 - DNA, 14 bp, Homo sapiens
ccactgcaccgggc

SEQ ID NO: 3781648 - DNA, 19 bp, Homo sapiens
ccactgcaccgggccacag

SEQ ID NO: 3781649 - DNA, 20 bp, Homo sapiens
ccactgcactccagcctggg

SEQ ID NO: 3781650 - DNA, 23 bp, Homo sapiens
ccactgcactccagcctgggtga

SEQ ID NO: 3781651 - DNA, 19 bp, Homo sapiens
ccactgcactctagccgga

SEQ ID NO: 3781652 - DNA, 17 bp, Homo sapiens
ccactgcaggccccgct

SEQ ID NO: 3781653 - DNA, 23 bp, Homo sapiens
ccactgcatcgtttcatcttcca

SEQ ID NO: 3781654 - DNA, 20 bp, Homo sapiens
ccactgcccgagctggtgca

SEQ ID NO: 3781655 - DNA, 13 bp, Homo sapiens
ccactgcctcttc

SEQ ID NO: 3781656 - DNA, 12 bp, Homo sapiens
ccactgcctgcc

SEQ ID NO: 3781657 - DNA, 15 bp, Homo sapiens
ccactgcctgcccac

SEQ ID NO: 3781658 - DNA, 17 bp, Homo sapiens
ccactgcctgcccaccc

SEQ ID NO: 3781659 - DNA, 16 bp, Homo sapiens
ccactggacttgagct

SEQ ID NO: 3781660 - DNA, 16 bp, Homo sapiens
ccactggctgtgggct

SEQ ID NO: 3781661 - DNA, 17 bp, Homo sapiens
ccactggctgtgggctc

SEQ ID NO: 3781662 - DNA, 18 bp, Homo sapiens
ccactggctgtgggctcc

SEQ ID NO: 3781663 - DNA, 22 bp, Homo sapiens
ccactggctgtgggctcccttc

SEQ ID NO: 3781664 - DNA, 11 bp, Homo sapiens
ccactggggaa

SEQ ID NO: 3781665 - DNA, 22 bp, Homo sapiens
ccactggggaaataacagctgt

SEQ ID NO: 3781666 - DNA, 19 bp, Homo sapiens
ccactgtcactgtttctct

SEQ ID NO: 3781667 - DNA, 22 bp, Homo sapiens
ccactgtcactgtttctctgct

SEQ ID NO: 3781668 - DNA, 23 bp, Homo sapiens
ccactgtcactgtttctctgctg

SEQ ID NO: 3781669 - DNA, 15 bp, Homo sapiens
ccactgtgccatgtg

SEQ ID NO: 3781670 - DNA, 16 bp, Homo sapiens
ccactgtgccatgtgc

SEQ ID NO: 3781671 - DNA, 14 bp, Homo sapiens
ccactgttatcaaa

SEQ ID NO: 3781672 - DNA, 16 bp, Homo sapiens
ccacttaaaaaatgtc

SEQ ID NO: 3781673 - DNA, 17 bp, Homo sapiens
ccacttaaaaaatgtcc

SEQ ID NO: 3781674 - DNA, 12 bp, Homo sapiens
ccacttacctag

SEQ ID NO: 3781675 - DNA, 21 bp, Homo sapiens
ccacttcagggttctcctctc

SEQ ID NO: 3781676 - DNA, 23 bp, Homo sapiens
ccacttgacactattcactaaaa

SEQ ID NO: 3781677 - DNA, 21 bp, Homo sapiens
ccacttggaggcctttcatcc

SEQ ID NO: 3781678 - DNA, 16 bp, Homo sapiens
ccagaaaggatattta

SEQ ID NO: 3781679 - DNA, 20 bp, Homo sapiens
ccagaaaggatatttaagaa

SEQ ID NO: 3781680 - DNA, 23 bp, Homo sapiens
ccagaaaggatatttaagaaaat

SEQ ID NO: 3781681 - DNA, 17 bp, Homo sapiens
ccagaacacactccatc

SEQ ID NO: 3781682 - DNA, 19 bp, Homo sapiens
ccagaacacactccatcag

SEQ ID NO: 3781683 - DNA, 19 bp, Homo sapiens
ccagaagcctctggctaga

SEQ ID NO: 3781684 - DNA, 20 bp, Homo sapiens
ccagaagcctctggctagag

SEQ ID NO: 3781685 - DNA, 23 bp, Homo sapiens
ccagaatgtcagattcctttccc

SEQ ID NO: 3781686 - DNA, 21 bp, Homo sapiens
ccagaattcccagctgtctgt

SEQ ID NO: 3781687 - DNA, 20 bp, Homo sapiens
ccagacaccttgacagggca

SEQ ID NO: 3781688 - DNA, 19 bp, Homo sapiens
ccagacatgtggtgggaca

SEQ ID NO: 3781689 - DNA, 13 bp, Homo sapiens
ccagaccagagct

SEQ ID NO: 3781690 - DNA, 16 bp, Homo sapiens
ccagaccagagctctg

SEQ ID NO: 3781691 - DNA, 18 bp, Homo sapiens
ccagaccattgtctcaga

SEQ ID NO: 3781692 - DNA, 21 bp, Homo sapiens
ccagacccccaccccttcccc

SEQ ID NO: 3781693 - DNA, 17 bp, Homo sapiens
ccagacccctctggcca

SEQ ID NO: 3781694 - DNA, 19 bp, Homo sapiens
ccagacccctctggccagg

SEQ ID NO: 3781695 - DNA, 21 bp, Homo sapiens
ccagacccctctggccaggat

SEQ ID NO: 3781696 - DNA, 23 bp, Homo sapiens
ccagacccctctggccaggatgg

SEQ ID NO: 3781697 - DNA, 13 bp, Homo sapiens
ccagacctgagct

SEQ ID NO: 3781698 - DNA, 18 bp, Homo sapiens
ccagacgcacgtgggtct

SEQ ID NO: 3781699 - DNA, 20 bp, Homo sapiens
ccagagagagaagtgcccct

SEQ ID NO: 3781700 - DNA, 22 bp, Homo sapiens
ccagagagagaagtgcccctgc

SEQ ID NO: 3781701 - DNA, 13 bp, Homo sapiens
ccagagagggtgg

SEQ ID NO: 3781702 - DNA, 23 bp, Homo sapiens
ccagagagggtggtgacctctgc

SEQ ID NO: 3781703 - DNA, 14 bp, Homo sapiens
ccagagagtggctc

SEQ ID NO: 3781704 - DNA, 15 bp, Homo sapiens
ccagagagtggctcc

SEQ ID NO: 3781705 - DNA, 18 bp, Homo sapiens
ccagagagtggctcctcc

SEQ ID NO: 3781706 - DNA, 14 bp, Homo sapiens
ccagagatgcctcc

SEQ ID NO: 3781707 - DNA, 22 bp, Homo sapiens
ccagagatggaggttctctcgg

SEQ ID NO: 3781708 - DNA, 16 bp, Homo sapiens
ccagagcaagcttttt

SEQ ID NO: 3781709 - DNA, 14 bp, Homo sapiens
ccagagcactgtat

SEQ ID NO: 3781710 - DNA, 14 bp, Homo sapiens
ccagagcccacctt

SEQ ID NO: 3781711 - DNA, 16 bp, Homo sapiens
ccagagcccaccttgg

SEQ ID NO: 3781712 - DNA, 18 bp, Homo sapiens
ccagagccccacacggag

SEQ ID NO: 3781713 - DNA, 12 bp, Homo sapiens
ccagagctctgg

SEQ ID NO: 3781714 - DNA, 15 bp, Homo sapiens
ccagagctgggtgag

SEQ ID NO: 3781715 - DNA, 21 bp, Homo sapiens
ccagagctgtttatggcctca

SEQ ID NO: 3781716 - DNA, 21 bp, Homo sapiens
ccagaggcacagccggggcct

SEQ ID NO: 3781717 - DNA, 19 bp, Homo sapiens
ccagaggctattattttca

SEQ ID NO: 3781718 - DNA, 21 bp, Homo sapiens
ccagagggagtgacagaggca

SEQ ID NO: 3781719 - DNA, 15 bp, Homo sapiens
ccagagggcccaggc

SEQ ID NO: 3781720 - DNA, 13 bp, Homo sapiens
ccagagtggcctg

SEQ ID NO: 3781721 - DNA, 14 bp, Homo sapiens
ccagagtggcctgg

SEQ ID NO: 3781722 - DNA, 16 bp, Homo sapiens
ccagagtggcctggcc

SEQ ID NO: 3781723 - DNA, 18 bp, Homo sapiens
ccagagtggcctggccag

SEQ ID NO: 3781724 - DNA, 23 bp, Homo sapiens
ccagagtggcctggccaggagct

SEQ ID NO: 3781725 - DNA, 16 bp, Homo sapiens
ccagatcccagaagga

SEQ ID NO: 3781726 - DNA, 18 bp, Homo sapiens
ccagatgcaccagccctt

SEQ ID NO: 3781727 - DNA, 23 bp, Homo sapiens
ccagatgcaccagcccttagcag

SEQ ID NO: 3781728 - DNA, 18 bp, Homo sapiens
ccagattgcaacaggctg

SEQ ID NO: 3781729 - DNA, 21 bp, Homo sapiens
ccagattgcaacaggctgggc

SEQ ID NO: 3781730 - DNA, 21 bp, Homo sapiens
ccagatttgctaatttatcct

SEQ ID NO: 3781731 - DNA, 17 bp, Homo sapiens
ccagcaaccctcctatc

SEQ ID NO: 3781732 - DNA, 18 bp, Homo sapiens
ccagcaaccctcctatca

SEQ ID NO: 3781733 - DNA, 21 bp, Homo sapiens
ccagcaacttgtctttttctg

SEQ ID NO: 3781734 - DNA, 20 bp, Homo sapiens
ccagcaagtgagagctgggt

SEQ ID NO: 3781735 - DNA, 18 bp, Homo sapiens
ccagcaccaccaggtctc

SEQ ID NO: 3781736 - DNA, 19 bp, Homo sapiens
ccagcaccaccaggtctcc

SEQ ID NO: 3781737 - DNA, 18 bp, Homo sapiens
ccagcactaaagcagtgg

SEQ ID NO: 3781738 - DNA, 14 bp, Homo sapiens
ccagcactttggga

SEQ ID NO: 3781739 - DNA, 21 bp, Homo sapiens
ccagcactttgggaggccaag

SEQ ID NO: 3781740 - DNA, 23 bp, Homo sapiens
ccagcactttgggaggccaagga

SEQ ID NO: 3781741 - DNA, 18 bp, Homo sapiens
ccagcagccagctctcag

SEQ ID NO: 3781742 - DNA, 20 bp, Homo sapiens
ccagcagccagctctcagcc

SEQ ID NO: 3781743 - DNA, 11 bp, Homo sapiens
ccagcagcctg

SEQ ID NO: 3781744 - DNA, 14 bp, Homo sapiens
ccagcagcctggac

SEQ ID NO: 3781745 - DNA, 21 bp, Homo sapiens
ccagcatccttttctgcagag

SEQ ID NO: 3781746 - DNA, 17 bp, Homo sapiens
ccagccaaaccctgtct

SEQ ID NO: 3781747 - DNA, 18 bp, Homo sapiens
ccagccaaagcctcctcc

SEQ ID NO: 3781748 - DNA, 13 bp, Homo sapiens
ccagccaacccct

SEQ ID NO: 3781749 - DNA, 19 bp, Homo sapiens
ccagccaacccctgtggag

SEQ ID NO: 3781750 - DNA, 13 bp, Homo sapiens
ccagccaccccgg

SEQ ID NO: 3781751 - DNA, 21 bp, Homo sapiens
cccagaattcccagctgtctg

SEQ ID NO: 3781752 - DNA, 20 bp, Homo sapiens
cccagacagctccctctgcc

SEQ ID NO: 3781753 - DNA, 19 bp, Homo sapiens
cccagacccctctggccag

SEQ ID NO: 3781754 - DNA, 17 bp, Homo sapiens
cccagagacaggaaaat

SEQ ID NO: 3781755 - DNA, 17 bp, Homo sapiens
cccagagatgcctccac

SEQ ID NO: 3781756 - DNA, 23 bp, Homo sapiens
cccagagatgcctccaccgctgc

SEQ ID NO: 3781757 - DNA, 20 bp, Homo sapiens
cccagagatgggactgggag

SEQ ID NO: 3781758 - DNA, 11 bp, Homo sapiens
cccagagctgt

SEQ ID NO: 3781759 - DNA, 13 bp, Homo sapiens
cccagagggccca

SEQ ID NO: 3781760 - DNA, 16 bp, Homo sapiens
cccagagggcccaggc

SEQ ID NO: 3781761 - DNA, 18 bp, Homo sapiens
cccagagggcccaggcag

SEQ ID NO: 3781762 - DNA, 23 bp, Homo sapiens
cccagagtgtgggaagggagagc

SEQ ID NO: 3781763 - DNA, 20 bp, Homo sapiens
cccagatctggtcccttgca

SEQ ID NO: 3781764 - DNA, 20 bp, Homo sapiens
cccagcaagtgagagctggg

SEQ ID NO: 3781765 - DNA, 17 bp, Homo sapiens
cccagcaccaccaggtc

SEQ ID NO: 3781766 - DNA, 13 bp, Homo sapiens
cccagcacccagc

SEQ ID NO: 3781767 - DNA, 15 bp, Homo sapiens
cccagcacccagcaa

SEQ ID NO: 3781768 - DNA, 19 bp, Homo sapiens
cccagccaccccgggctct

SEQ ID NO: 3781769 - DNA, 18 bp, Homo sapiens
cccagccattaccatgga

SEQ ID NO: 3781770 - DNA, 20 bp, Homo sapiens
cccagccattaccatggaga

SEQ ID NO: 3781771 - DNA, 14 bp, Homo sapiens
cccagcccacttct

SEQ ID NO: 3781772 - DNA, 19 bp, Homo sapiens
cccagcccacttctgccat

SEQ ID NO: 3781773 - DNA, 17 bp, Homo sapiens
cccagcccagcccagct

SEQ ID NO: 3781774 - DNA, 13 bp, Homo sapiens
cccagcccagctg

SEQ ID NO: 3781775 - DNA, 15 bp, Homo sapiens
cccagcccagctgct

SEQ ID NO: 3781776 - DNA, 18 bp, Homo sapiens
cccagcccagctgctctg

SEQ ID NO: 3781777 - DNA, 21 bp, Homo sapiens
cccagcccagggttcccccag

SEQ ID NO: 3781778 - DNA, 21 bp, Homo sapiens
cccagcccatcttgcctccat

SEQ ID NO: 3781779 - DNA, 21 bp, Homo sapiens
cccagcccattctctctcctg

SEQ ID NO: 3781780 - DNA, 16 bp, Homo sapiens
cccagccctgtggaag

SEQ ID NO: 3781781 - DNA, 21 bp, Homo sapiens
cccagccctttgggaggctga

SEQ ID NO: 3781782 - DNA, 21 bp, Homo sapiens
cccagcctctcttcctatccc

SEQ ID NO: 3781783 - DNA, 15 bp, Homo sapiens
cccagcgagccctgg

SEQ ID NO: 3781784 - DNA, 17 bp, Homo sapiens
cccagcgagccctggtg

SEQ ID NO: 3781785 - DNA, 18 bp, Homo sapiens
cccagcgagccctggtgg

SEQ ID NO: 3781786 - DNA, 19 bp, Homo sapiens
cccagcgagccctggtggc

SEQ ID NO: 3781787 - DNA, 23 bp, Homo sapiens
cccagcgagccctggtggcagtg

SEQ ID NO: 3781788 - DNA, 17 bp, Homo sapiens
cccagcggctggtgcag

SEQ ID NO: 3781789 - DNA, 21 bp, Homo sapiens
cccagctactcaagaggctga

SEQ ID NO: 3781790 - DNA, 17 bp, Homo sapiens
cccagctactcagaagc

SEQ ID NO: 3781791 - DNA, 22 bp, Homo sapiens
cccagctactcagaagcctgag

SEQ ID NO: 3781792 - DNA, 23 bp, Homo sapiens
cccagctactcagaagcctgagg

SEQ ID NO: 3781793 - DNA, 13 bp, Homo sapiens
cccagctccaggg

SEQ ID NO: 3781794 - DNA, 16 bp, Homo sapiens
cccagctccagggcca

SEQ ID NO: 3781795 - DNA, 17 bp, Homo sapiens
cccagctctccctctgg

SEQ ID NO: 3781796 - DNA, 20 bp, Homo sapiens
cccagctctgcttgccgaaa

SEQ ID NO: 3781797 - DNA, 13 bp, Homo sapiens
cccagctgcacct

SEQ ID NO: 3781798 - DNA, 14 bp, Homo sapiens
cccagctgcccctc

SEQ ID NO: 3781799 - DNA, 17 bp, Homo sapiens
cccagctgcccctccct

SEQ ID NO: 3781800 - DNA, 21 bp, Homo sapiens
cccagctgcccctccctgcca

SEQ ID NO: 3781801 - DNA, 14 bp, Homo sapiens
cccagctgctctgc

SEQ ID NO: 3781802 - DNA, 18 bp, Homo sapiens
cccagctgctctgcccag

SEQ ID NO: 3781803 - DNA, 20 bp, Homo sapiens
cccagctgctctgcccagag

SEQ ID NO: 3781804 - DNA, 19 bp, Homo sapiens
cccagctggtgggaagcgt

SEQ ID NO: 3781805 - DNA, 22 bp, Homo sapiens
cccagctggtgggaagcgtctg

SEQ ID NO: 3781806 - DNA, 23 bp, Homo sapiens
cccagctgtctgtgtcagcctgt

SEQ ID NO: 3781807 - DNA, 22 bp, Homo sapiens
cccaggaatttgaagctgcagt

SEQ ID NO: 3781808 - DNA, 22 bp, Homo sapiens
cccaggagagccagccctccct

SEQ ID NO: 3781809 - DNA, 13 bp, Homo sapiens
cccaggagccccg

SEQ ID NO: 3781810 - DNA, 23 bp, Homo sapiens
cccaggcaggtcttgaactcctg

SEQ ID NO: 3781811 - DNA, 18 bp, Homo sapiens
cccaggccccaggaagcc

SEQ ID NO: 3781812 - DNA, 16 bp, Homo sapiens
cccaggccccctgcat

SEQ ID NO: 3781813 - DNA, 18 bp, Homo sapiens
cccaggcccctgccaccc

SEQ ID NO: 3781814 - DNA, 16 bp, Homo sapiens
cccaggcctccagctc

SEQ ID NO: 3781815 - DNA, 17 bp, Homo sapiens
cccaggctggcgtgcag

SEQ ID NO: 3781816 - DNA, 18 bp, Homo sapiens
cccaggctggcgtgcagt

SEQ ID NO: 3781817 - DNA, 19 bp, Homo sapiens
cccaggctggcgtgcagtg

SEQ ID NO: 3781818 - DNA, 20 bp, Homo sapiens
cccaggctggcgtgcagtgg

SEQ ID NO: 3781819 - DNA, 16 bp, Homo sapiens
cccaggctggtctcaa

SEQ ID NO: 3781820 - DNA, 22 bp, Homo sapiens
cccagggagcggaaagcagctc

SEQ ID NO: 3781821 - DNA, 18 bp, Homo sapiens
cccagggccactctgcct

SEQ ID NO: 3781822 - DNA, 18 bp, Homo sapiens
cccagggccagggccctg

SEQ ID NO: 3781823 - DNA, 21 bp, Homo sapiens
cccagggctaccctcccccag

SEQ ID NO: 3781824 - DNA, 15 bp, Homo sapiens
cccagggctcagcct

SEQ ID NO: 3781825 - DNA, 20 bp, Homo sapiens
cccagggctcagcctggtgg

SEQ ID NO: 3781826 - DNA, 13 bp, Homo sapiens
cccaggggagagg

SEQ ID NO: 3781827 - DNA, 15 bp, Homo sapiens
cccaggggagagggt

SEQ ID NO: 3781828 - DNA, 22 bp, Homo sapiens
cccaggggagagggtctggaga

SEQ ID NO: 3781829 - DNA, 24 bp, Homo sapiens
cccaggggagagggtctggagaag

SEQ ID NO: 3781830 - DNA, 16 bp, Homo sapiens
cccaggggtcccagcc

SEQ ID NO: 3781831 - DNA, 18 bp, Homo sapiens
cccaggggtcccagccac

SEQ ID NO: 3781832 - DNA, 23 bp, Homo sapiens
cccagggtcttccctacctcagg

SEQ ID NO: 3781833 - DNA, 19 bp, Homo sapiens
cccagggttaatagggcct

SEQ ID NO: 3781834 - DNA, 23 bp, Homo sapiens
cccagtccaaatgtcctccagaa

SEQ ID NO: 3781835 - DNA, 16 bp, Homo sapiens
cccagtccctggggga

SEQ ID NO: 3781836 - DNA, 18 bp, Homo sapiens
cccagtctggaatgcagt

SEQ ID NO: 3781837 - DNA, 19 bp, Homo sapiens
cccagtctggaatgcagtg

SEQ ID NO: 3781838 - DNA, 20 bp, Homo sapiens
cccagtctggaatgcagtgg

SEQ ID NO: 3781839 - DNA, 13 bp, Homo sapiens
cccagtgacactt

SEQ ID NO: 3781840 - DNA, 15 bp, Homo sapiens
cccagtgcacccact

SEQ ID NO: 3781841 - DNA, 22 bp, Homo sapiens
cccagtgccaagcacagtgcct

SEQ ID NO: 3781842 - DNA, 13 bp, Homo sapiens
cccagtgcccaca

SEQ ID NO: 3781843 - DNA, 15 bp, Homo sapiens
cccagtgcccacagg

SEQ ID NO: 3781844 - DNA, 21 bp, Homo sapiens
cccagtgcccacaggatcagt

SEQ ID NO: 3781845 - DNA, 23 bp, Homo sapiens
cccagtgccctggggctgatctc

SEQ ID NO: 3781846 - DNA, 18 bp, Homo sapiens
cccagtggcctcaaccct

SEQ ID NO: 3781847 - DNA, 19 bp, Homo sapiens
cccagtggcctcaaccctc

SEQ ID NO: 3781848 - DNA, 21 bp, Homo sapiens
cccagtggcctcaaccctccc

SEQ ID NO: 3781849 - DNA, 18 bp, Homo sapiens
cccagtgttgtttgtaaa

SEQ ID NO: 3781850 - DNA, 21 bp, Homo sapiens
cccagtgttgtttgtaaataa

SEQ ID NO: 3781851 - DNA, 17 bp, Homo sapiens
cccagtgttttaggagc

SEQ ID NO: 3781852 - DNA, 22 bp, Homo sapiens
cccagttcaggagtcccaagga

SEQ ID NO: 3781853 - DNA, 14 bp, Homo sapiens
cccagttgggtgga

SEQ ID NO: 3781854 - DNA, 23 bp, Homo sapiens
cccagtttgcagaaaagcacctg

SEQ ID NO: 3781855 - DNA, 22 bp, Homo sapiens
cccataattttttttttccttt

SEQ ID NO: 3781856 - DNA, 22 bp, Homo sapiens
cccatcacagggttgggcccag

SEQ ID NO: 3781857 - DNA, 14 bp, Homo sapiens
cccatcagaaggag

SEQ ID NO: 3781858 - DNA, 13 bp, Homo sapiens
cccatcccacacc

SEQ ID NO: 3781859 - DNA, 12 bp, Homo sapiens
cccatcctcccc

SEQ ID NO: 3781860 - DNA, 15 bp, Homo sapiens
cccatcctccccttc

SEQ ID NO: 3781861 - DNA, 19 bp, Homo sapiens
cccatcggtgtccatttat

SEQ ID NO: 3781862 - DNA, 23 bp, Homo sapiens
cccatctctccctcccctgccat

SEQ ID NO: 3781863 - DNA, 17 bp, Homo sapiens
ccctccgtgatccatcc

SEQ ID NO: 3781864 - DNA, 13 bp, Homo sapiens
ccctcctcacccc

SEQ ID NO: 3781865 - DNA, 14 bp, Homo sapiens
ccctcctcaccccg

SEQ ID NO: 3781866 - DNA, 13 bp, Homo sapiens
ccctcctcacctc

SEQ ID NO: 3781867 - DNA, 22 bp, Homo sapiens
ccctcctcccttctactgcttc

SEQ ID NO: 3781868 - DNA, 16 bp, Homo sapiens
ccctcctctgccacct

SEQ ID NO: 3781869 - DNA, 19 bp, Homo sapiens
ccctccttcccagctgccc

SEQ ID NO: 3781870 - DNA, 16 bp, Homo sapiens
ccctccttccttgacc

SEQ ID NO: 3781871 - DNA, 17 bp, Homo sapiens
ccctccttgcctcctgt

SEQ ID NO: 3781872 - DNA, 15 bp, Homo sapiens
ccctcgctggccccc

SEQ ID NO: 3781873 - DNA, 18 bp, Homo sapiens
ccctcgctggcccccact

SEQ ID NO: 3781874 - DNA, 17 bp, Homo sapiens
ccctcgggcgagtcact

SEQ ID NO: 3781875 - DNA, 21 bp, Homo sapiens
ccctctcaggcatgcctgtgt

SEQ ID NO: 3781876 - DNA, 12 bp, Homo sapiens
ccctctcctgcc

SEQ ID NO: 3781877 - DNA, 17 bp, Homo sapiens
ccctctcctgcctactc

SEQ ID NO: 3781878 - DNA, 23 bp, Homo sapiens
ccctctctcttctgctccaccct

SEQ ID NO: 3781879 - DNA, 14 bp, Homo sapiens
ccctctgcctgtcc

SEQ ID NO: 3781880 - DNA, 14 bp, Homo sapiens
ccctctggccctgc

SEQ ID NO: 3781881 - DNA, 12 bp, Homo sapiens
ccctctttccct

SEQ ID NO: 3781882 - DNA, 14 bp, Homo sapiens
ccctgaaaacccag

SEQ ID NO: 3781883 - DNA, 17 bp, Homo sapiens
ccctgaaaacccagaga

SEQ ID NO: 3781884 - DNA, 17 bp, Homo sapiens
ccctgacctccctctaa

SEQ ID NO: 3781885 - DNA, 16 bp, Homo sapiens
ccctgagacaaatgga

SEQ ID NO: 3781886 - DNA, 23 bp, Homo sapiens
ccctgagacaaatggaggcctgt

SEQ ID NO: 3781887 - DNA, 18 bp, Homo sapiens
ccctgagatcagagtcct

SEQ ID NO: 3781888 - DNA, 16 bp, Homo sapiens
ccctgagctttctgct

SEQ ID NO: 3781889 - DNA, 18 bp, Homo sapiens
ccctgaggtgaaagggag

SEQ ID NO: 3781890 - DNA, 16 bp, Homo sapiens
ccctgagtcaccagga

SEQ ID NO: 3781891 - DNA, 12 bp, Homo sapiens
ccctgcacttgc

SEQ ID NO: 3781892 - DNA, 20 bp, Homo sapiens
ccctgcagagatgcggtggc

SEQ ID NO: 3781893 - DNA, 12 bp, Homo sapiens
ccctgccaccct

SEQ ID NO: 3781894 - DNA, 17 bp, Homo sapiens
ccctgccagcaccccca

SEQ ID NO: 3781895 - DNA, 16 bp, Homo sapiens
ccctgcccctcatgcc

SEQ ID NO: 3781896 - DNA, 18 bp, Homo sapiens
ccctgcccctcccttcaa

SEQ ID NO: 3781897 - DNA, 19 bp, Homo sapiens
ccctgcccctcccttcaac

SEQ ID NO: 3781898 - DNA, 23 bp, Homo sapiens
ccctgcccctcccttcaaccatt

SEQ ID NO: 3781899 - DNA, 13 bp, Homo sapiens
ccctgcccctgcc

SEQ ID NO: 3781900 - DNA, 18 bp, Homo sapiens
ccctgccccttctacact

SEQ ID NO: 3781901 - DNA, 23 bp, Homo sapiens
ccctgccccttctacactctcct

SEQ ID NO: 3781902 - DNA, 14 bp, Homo sapiens
ccctgcccggctgc

SEQ ID NO: 3781903 - DNA, 17 bp, Homo sapiens
ccctgcccggctgcgga

SEQ ID NO: 3781904 - DNA, 14 bp, Homo sapiens
ccctgccctagctc

SEQ ID NO: 3781905 - DNA, 16 bp, Homo sapiens
ccctgccctagctcca

SEQ ID NO: 3781906 - DNA, 13 bp, Homo sapiens
ccctgccctggga

SEQ ID NO: 3781907 - DNA, 18 bp, Homo sapiens
ccctgccctggtccaggg

SEQ ID NO: 3781908 - DNA, 14 bp, Homo sapiens
ccctgccgcctcaa

SEQ ID NO: 3781909 - DNA, 19 bp, Homo sapiens
ccctgcgaaggggccctgg

SEQ ID NO: 3781910 - DNA, 22 bp, Homo sapiens
ccctgctgccgcctcccagcct

SEQ ID NO: 3781911 - DNA, 16 bp, Homo sapiens
ccctgctgcctcccca

SEQ ID NO: 3781912 - DNA, 20 bp, Homo sapiens
ccctgctggttcagggttgg

SEQ ID NO: 3781913 - DNA, 18 bp, Homo sapiens
ccctggagcctccactgc

SEQ ID NO: 3781914 - DNA, 23 bp, Homo sapiens
ccctggatcagtcctttgatcag

SEQ ID NO: 3781915 - DNA, 22 bp, Homo sapiens
ccctggatgaagttatctggct

SEQ ID NO: 3781916 - DNA, 20 bp, Homo sapiens
ccctggcaggatgaccctgc

SEQ ID NO: 3781917 - DNA, 22 bp, Homo sapiens
ccctggcaggatgaccctgcga

SEQ ID NO: 3781918 - DNA, 13 bp, Homo sapiens
ccctggccagagg

SEQ ID NO: 3781919 - DNA, 19 bp, Homo sapiens
ccctggcctgttctgtttt

SEQ ID NO: 3781920 - DNA, 20 bp, Homo sapiens
ccctggctcccacaggccct

SEQ ID NO: 3781921 - DNA, 22 bp, Homo sapiens
ccctggctggtaagggccaagt

SEQ ID NO: 3781922 - DNA, 19 bp, Homo sapiens
ccctggcttgtaactccac

SEQ ID NO: 3781923 - DNA, 14 bp, Homo sapiens
ccctgggccccacc

SEQ ID NO: 3781924 - DNA, 16 bp, Homo sapiens
ccctgggccccaccac

SEQ ID NO: 3781925 - DNA, 22 bp, Homo sapiens
ccctgggccccaccacctaggc

SEQ ID NO: 3781926 - DNA, 13 bp, Homo sapiens
ccctgggctctgc

SEQ ID NO: 3781927 - DNA, 15 bp, Homo sapiens
ccctgggctctgccc

SEQ ID NO: 3781928 - DNA, 16 bp, Homo sapiens
ccctgggctctgcccc

SEQ ID NO: 3781929 - DNA, 17 bp, Homo sapiens
ccctgggggaagccctg

SEQ ID NO: 3781930 - DNA, 16 bp, Homo sapiens
ccctggtccttccagg

SEQ ID NO: 3781931 - DNA, 14 bp, Homo sapiens
ccctggtgaggaag

SEQ ID NO: 3781932 - DNA, 13 bp, Homo sapiens
ccctggtgctgcc

SEQ ID NO: 3781933 - DNA, 14 bp, Homo sapiens
ccctggtgctgcca

SEQ ID NO: 3781934 - DNA, 19 bp, Homo sapiens
ccctggtggacagtcctgg

SEQ ID NO: 3781935 - DNA, 14 bp, Homo sapiens
ccctggtggcagtg

SEQ ID NO: 3781936 - DNA, 21 bp, Homo sapiens
ccctggtggcagtgggagctg

SEQ ID NO: 3781937 - DNA, 18 bp, Homo sapiens
ccctggttatattctcac

SEQ ID NO: 3781938 - DNA, 19 bp, Homo sapiens
ccctggttatattctcacg

SEQ ID NO: 3781939 - DNA, 15 bp, Homo sapiens
ccctggtttcactgg

SEQ ID NO: 3781940 - DNA, 23 bp, Homo sapiens
ccctgtattcccacccctggact

SEQ ID NO: 3781941 - DNA, 23 bp, Homo sapiens
ccctgtctaggtcagtacccacc

SEQ ID NO: 3781942 - DNA, 23 bp, Homo sapiens
ccctgtctcaaaaaaagaaaaag

SEQ ID NO: 3781943 - DNA, 13 bp, Homo sapiens
ccctgttcattgt

SEQ ID NO: 3781944 - DNA, 14 bp, Homo sapiens
ccctgttttatact

SEQ ID NO: 3781945 - DNA, 17 bp, Homo sapiens
cccttaccccttagcct

SEQ ID NO: 3781946 - DNA, 12 bp, Homo sapiens
cccttattttca

SEQ ID NO: 3781947 - DNA, 22 bp, Homo sapiens
cccttcacttctgaccacactt

SEQ ID NO: 3781948 - DNA, 19 bp, Homo sapiens
cccttcccttgagccctct

SEQ ID NO: 3781949 - DNA, 13 bp, Homo sapiens
cccttcctctcca

SEQ ID NO: 3781950 - DNA, 16 bp, Homo sapiens
cccttcctctccactg

SEQ ID NO: 3781951 - DNA, 14 bp, Homo sapiens
cccttctactgctt

SEQ ID NO: 3781952 - DNA, 16 bp, Homo sapiens
cccttctactgcttct

SEQ ID NO: 3781953 - DNA, 14 bp, Homo sapiens
cccttctcccacac

SEQ ID NO: 3781954 - DNA, 13 bp, Homo sapiens
cccttctctgctc

SEQ ID NO: 3781955 - DNA, 14 bp, Homo sapiens
cccttctctgctcc

SEQ ID NO: 3781956 - DNA, 16 bp, Homo sapiens
cccttctctgctccac

SEQ ID NO: 3781957 - DNA, 16 bp, Homo sapiens
cccttctgtgcccagc

SEQ ID NO: 3781958 - DNA, 18 bp, Homo sapiens
cccttctgtgcccagctc

SEQ ID NO: 3781959 - DNA, 20 bp, Homo sapiens
cccttctgtgcccagctcag

SEQ ID NO: 3781960 - DNA, 12 bp, Homo sapiens
cccttctttcca

SEQ ID NO: 3781961 - DNA, 21 bp, Homo sapiens
cccttgaaagtcatgaacaca

SEQ ID NO: 3781962 - DNA, 23 bp, Homo sapiens
cccttgacgtcaagtctccttcc

SEQ ID NO: 3781963 - DNA, 14 bp, Homo sapiens
cccttgagaaacct

SEQ ID NO: 3781964 - DNA, 14 bp, Homo sapiens
cccttgagacctca

SEQ ID NO: 3781965 - DNA, 15 bp, Homo sapiens
cccttgagacctcag

SEQ ID NO: 3781966 - DNA, 17 bp, Homo sapiens
cccttgagacctcagcc

SEQ ID NO: 3781967 - DNA, 20 bp, Homo sapiens
cccttgagacctcagccatg

SEQ ID NO: 3781968 - DNA, 17 bp, Homo sapiens
cccttgagccctctatg

SEQ ID NO: 3781969 - DNA, 18 bp, Homo sapiens
cccttgagctccccaaaa

SEQ ID NO: 3781970 - DNA, 19 bp, Homo sapiens
cccttgcagttcagcacca

SEQ ID NO: 3781971 - DNA, 13 bp, Homo sapiens
cccttgccagaca

SEQ ID NO: 3781972 - DNA, 19 bp, Homo sapiens
cccttgcccagggctcagc

SEQ ID NO: 3781973 - DNA, 13 bp, Homo sapiens
cccttggaggcca

SEQ ID NO: 3781974 - DNA, 12 bp, Homo sapiens
cccttggcctca

SEQ ID NO: 3781975 - DNA, 13 bp, Homo sapiens
cccttggcctcag

SEQ ID NO: 3781976 - DNA, 15 bp, Homo sapiens
cccttgtcccactca

SEQ ID NO: 3781977 - DNA, 16 bp, Homo sapiens
cctcagtggactttcc

SEQ ID NO: 3781978 - DNA, 20 bp, Homo sapiens
cctcagtggactttccaccc

SEQ ID NO: 3781979 - DNA, 23 bp, Homo sapiens
cctcagtggactttccaccccct

SEQ ID NO: 3781980 - DNA, 18 bp, Homo sapiens
cctcagttcccttggcct

SEQ ID NO: 3781981 - DNA, 19 bp, Homo sapiens
cctcagttcccttggcctc

SEQ ID NO: 3781982 - DNA, 22 bp, Homo sapiens
cctcagttcccttggcctcaga

SEQ ID NO: 3781983 - DNA, 21 bp, Homo sapiens
cctcatagtatggtggctggg

SEQ ID NO: 3781984 - DNA, 22 bp, Homo sapiens
cctcatagtatggtggctgggt

SEQ ID NO: 3781985 - DNA, 14 bp, Homo sapiens
cctcatctgtctgg

SEQ ID NO: 3781986 - DNA, 19 bp, Homo sapiens
cctcattacggctcctctc

SEQ ID NO: 3781987 - DNA, 13 bp, Homo sapiens
cctcattcaggaa

SEQ ID NO: 3781988 - DNA, 13 bp, Homo sapiens
cctcattcctgaa

SEQ ID NO: 3781989 - DNA, 16 bp, Homo sapiens
cctcatttatccctca

SEQ ID NO: 3781990 - DNA, 20 bp, Homo sapiens
cctcatttatccctcaaccc

SEQ ID NO: 3781991 - DNA, 21 bp, Homo sapiens
cctccaagctccatctccact

SEQ ID NO: 3781992 - DNA, 15 bp, Homo sapiens
cctccacagccgcag

SEQ ID NO: 3781993 - DNA, 16 bp, Homo sapiens
cctccacagccgcagc

SEQ ID NO: 3781994 - DNA, 11 bp, Homo sapiens
cctccacagct

SEQ ID NO: 3781995 - DNA, 17 bp, Homo sapiens
cctccaccccccagaac

SEQ ID NO: 3781996 - DNA, 13 bp, Homo sapiens
cctccaccgctgc

SEQ ID NO: 3781997 - DNA, 15 bp, Homo sapiens
cctccactccttcct

SEQ ID NO: 3781998 - DNA, 13 bp, Homo sapiens
cctccactgccct

SEQ ID NO: 3781999 - DNA, 15 bp, Homo sapiens
cctccactgccctct

SEQ ID NO: 3782000 - DNA, 22 bp, Homo sapiens
cctccagaagcctctggctaga

SEQ ID NO: 3782001 - DNA, 13 bp, Homo sapiens
cctccagctcagc

SEQ ID NO: 3782002 - DNA, 15 bp, Homo sapiens
cctccatggtgcctc

SEQ ID NO: 3782003 - DNA, 15 bp, Homo sapiens
cctccattctgacca

SEQ ID NO: 3782004 - DNA, 16 bp, Homo sapiens
cctcccaaagtgctgg

SEQ ID NO: 3782005 - DNA, 22 bp, Homo sapiens
cctcccaaggggcccaaattct

SEQ ID NO: 3782006 - DNA, 14 bp, Homo sapiens
cctcccaccacagc

SEQ ID NO: 3782007 - DNA, 15 bp, Homo sapiens
cctcccaccacagca

SEQ ID NO: 3782008 - DNA, 13 bp, Homo sapiens
cctcccaccccca

SEQ ID NO: 3782009 - DNA, 13 bp, Homo sapiens
cctcccaccccct

SEQ ID NO: 3782010 - DNA, 20 bp, Homo sapiens
cctcccacccccttctctgc

SEQ ID NO: 3782011 - DNA, 11 bp, Homo sapiens
cctcccacctt

SEQ ID NO: 3782012 - DNA, 13 bp, Homo sapiens
cctcccacctttg

SEQ ID NO: 3782013 - DNA, 12 bp, Homo sapiens
cctcccagctct

SEQ ID NO: 3782014 - DNA, 13 bp, Homo sapiens
cctcccagctctg

SEQ ID NO: 3782015 - DNA, 14 bp, Homo sapiens
cctcccagctctga

SEQ ID NO: 3782016 - DNA, 21 bp, Homo sapiens
cctccccaaccctgcccctgc

SEQ ID NO: 3782017 - DNA, 13 bp, Homo sapiens
cctccccaggccg

SEQ ID NO: 3782018 - DNA, 12 bp, Homo sapiens
cctccccagggg

SEQ ID NO: 3782019 - DNA, 20 bp, Homo sapiens
cctccccattagagtcagcc

SEQ ID NO: 3782020 - DNA, 19 bp, Homo sapiens
cctcccccaacccccaccc

SEQ ID NO: 3782021 - DNA, 15 bp, Homo sapiens
cctcccccagagggg

SEQ ID NO: 3782022 - DNA, 14 bp, Homo sapiens
cctccccctccttc

SEQ ID NO: 3782023 - DNA, 21 bp, Homo sapiens
cctccccctccttcccagctg

SEQ ID NO: 3782024 - DNA, 12 bp, Homo sapiens
cctccccctgcc

SEQ ID NO: 3782025 - DNA, 15 bp, Homo sapiens
cctccccgcaccccc

SEQ ID NO: 3782026 - DNA, 23 bp, Homo sapiens
cctccccggctcgagcagtcctg

SEQ ID NO: 3782027 - DNA, 22 bp, Homo sapiens
cctcccctatccacccagccca

SEQ ID NO: 3782028 - DNA, 14 bp, Homo sapiens
cctcccctcaagga

SEQ ID NO: 3782029 - DNA, 14 bp, Homo sapiens
cctcccctgccctc

SEQ ID NO: 3782030 - DNA, 15 bp, Homo sapiens
cctcccctgccctcg

SEQ ID NO: 3782031 - DNA, 17 bp, Homo sapiens
cctcccgaatagctggg

SEQ ID NO: 3782032 - DNA, 21 bp, Homo sapiens
cctcccgagtagctgggacta

SEQ ID NO: 3782033 - DNA, 13 bp, Homo sapiens
cctccctacctca

SEQ ID NO: 3782034 - DNA, 18 bp, Homo sapiens
cctccctacctcaacctg

SEQ ID NO: 3782035 - DNA, 12 bp, Homo sapiens
cctccctcagcc

SEQ ID NO: 3782036 - DNA, 15 bp, Homo sapiens
cctccctcagcccct

SEQ ID NO: 3782037 - DNA, 15 bp, Homo sapiens
cctccctccctcttt

SEQ ID NO: 3782038 - DNA, 16 bp, Homo sapiens
cctccctcctctgtcc

SEQ ID NO: 3782039 - DNA, 18 bp, Homo sapiens
cctccctctctcttctgc

SEQ ID NO: 3782040 - DNA, 20 bp, Homo sapiens
cctccctctctcttctgctc

SEQ ID NO: 3782041 - DNA, 13 bp, Homo sapiens
cctccctctttcc

SEQ ID NO: 3782042 - DNA, 18 bp, Homo sapiens
cctccctgcccctccctt

SEQ ID NO: 3782043 - DNA, 22 bp, Homo sapiens
cctccctgcccctcccttcaac

SEQ ID NO: 3782044 - DNA, 20 bp, Homo sapiens
cctccctggagcctccactg

SEQ ID NO: 3782045 - DNA, 13 bp, Homo sapiens
cctccctggctcc

SEQ ID NO: 3782046 - DNA, 14 bp, Homo sapiens
cctccctggctccc

SEQ ID NO: 3782047 - DNA, 15 bp, Homo sapiens
cctccctggctccca

SEQ ID NO: 3782048 - DNA, 16 bp, Homo sapiens
cctccctggctcccat

SEQ ID NO: 3782049 - DNA, 18 bp, Homo sapiens
cctccctggctcccatga

SEQ ID NO: 3782050 - DNA, 12 bp, Homo sapiens
cctccctgtcct

SEQ ID NO: 3782051 - DNA, 15 bp, Homo sapiens
cctccctgtcctcct

SEQ ID NO: 3782052 - DNA, 21 bp, Homo sapiens
cctccctgttgaagctctggt

SEQ ID NO: 3782053 - DNA, 15 bp, Homo sapiens
cctcccttggcgtgg

SEQ ID NO: 3782054 - DNA, 23 bp, Homo sapiens
cctccgccattctcaagccctgc

SEQ ID NO: 3782055 - DNA, 13 bp, Homo sapiens
cctccgcctcttg

SEQ ID NO: 3782056 - DNA, 15 bp, Homo sapiens
cctccgtatttcaga

SEQ ID NO: 3782057 - DNA, 19 bp, Homo sapiens
cctcctatcagaagtttct

SEQ ID NO: 3782058 - DNA, 15 bp, Homo sapiens
cctcctcacctctgg

SEQ ID NO: 3782059 - DNA, 15 bp, Homo sapiens
cctcctccacaccag

SEQ ID NO: 3782060 - DNA, 15 bp, Homo sapiens
cctcctctgccacct

SEQ ID NO: 3782061 - DNA, 12 bp, Homo sapiens
cctcctctgtcc

SEQ ID NO: 3782062 - DNA, 15 bp, Homo sapiens
cctcctctgtccagg

SEQ ID NO: 3782063 - DNA, 16 bp, Homo sapiens
cctcctctgtccaggg

SEQ ID NO: 3782064 - DNA, 14 bp, Homo sapiens
cctcctctgtccct

SEQ ID NO: 3782065 - DNA, 20 bp, Homo sapiens
cctcctgaaacttacacaca

SEQ ID NO: 3782066 - DNA, 23 bp, Homo sapiens
cctcctgcccaggagagccagcc

SEQ ID NO: 3782067 - DNA, 14 bp, Homo sapiens
cctcctgggctaag

SEQ ID NO: 3782068 - DNA, 17 bp, Homo sapiens
cctcctgtgtagctggg

SEQ ID NO: 3782069 - DNA, 13 bp, Homo sapiens
cctcctgtgtgtg

SEQ ID NO: 3782070 - DNA, 15 bp, Homo sapiens
cctcctgtgtgtgcg

SEQ ID NO: 3782071 - DNA, 21 bp, Homo sapiens
cctccttcccagctgcccctc

SEQ ID NO: 3782072 - DNA, 15 bp, Homo sapiens
cctccttccttgacc

SEQ ID NO: 3782073 - DNA, 15 bp, Homo sapiens
cctccttctcccttt

SEQ ID NO: 3782074 - DNA, 16 bp, Homo sapiens
cctccttctccctttt

SEQ ID NO: 3782075 - DNA, 16 bp, Homo sapiens
cctcgaacccacactg

SEQ ID NO: 3782076 - DNA, 14 bp, Homo sapiens
cctcgcaagctggg

SEQ ID NO: 3782077 - DNA, 14 bp, Homo sapiens
cctcgctggccccc

SEQ ID NO: 3782078 - DNA, 16 bp, Homo sapiens
cctcgctggcccccac

SEQ ID NO: 3782079 - DNA, 16 bp, Homo sapiens
cctcggagcctcatcc

SEQ ID NO: 3782080 - DNA, 17 bp, Homo sapiens
cctcggatcaccgagag

SEQ ID NO: 3782081 - DNA, 19 bp, Homo sapiens
cctcgggcgagtcactgcc

SEQ ID NO: 3782082 - DNA, 17 bp, Homo sapiens
cctctaacaggggctgg

SEQ ID NO: 3782083 - DNA, 21 bp, Homo sapiens
cctctaacaggggctggtggg

SEQ ID NO: 3782084 - DNA, 15 bp, Homo sapiens
cctctagtgccctcc

SEQ ID NO: 3782085 - DNA, 12 bp, Homo sapiens
cctctccactgc

SEQ ID NO: 3782086 - DNA, 13 bp, Homo sapiens
cctctccactgcc

SEQ ID NO: 3782087 - DNA, 13 bp, Homo sapiens
cctctcccaggac

SEQ ID NO: 3782088 - DNA, 14 bp, Homo sapiens
cctctcccaggacc

SEQ ID NO: 3782089 - DNA, 12 bp, Homo sapiens
cctctcccagtt

SEQ ID NO: 3782090 - DNA, 12 bp, Homo sapiens
cctctcccatca

SEQ ID NO: 3782091 - DNA, 22 bp, Homo sapiens
cctctccccaagacttggtgtc

SEQ ID NO: 3782092 - DNA, 22 bp, Homo sapiens
cctgtggcagtaaagagaaact

SEQ ID NO: 3782093 - DNA, 18 bp, Homo sapiens
cctgtggcatctttgcct

SEQ ID NO: 3782094 - DNA, 19 bp, Homo sapiens
cctgtggggatttctccca

SEQ ID NO: 3782095 - DNA, 20 bp, Homo sapiens
cctgtggggatttctcccag

SEQ ID NO: 3782096 - DNA, 22 bp, Homo sapiens
cctgtggggatttctcccagct

SEQ ID NO: 3782097 - DNA, 16 bp, Homo sapiens
cctgtggttacagtgc

SEQ ID NO: 3782098 - DNA, 20 bp, Homo sapiens
cctgtggtttccaaggagct

SEQ ID NO: 3782099 - DNA, 21 bp, Homo sapiens
cctgtgtcttgcaatggcagc

SEQ ID NO: 3782100 - DNA, 22 bp, Homo sapiens
cctgtgtcttgcaatggcagcc

SEQ ID NO: 3782101 - DNA, 19 bp, Homo sapiens
cctgtgtggtttagtgtaa

SEQ ID NO: 3782102 - DNA, 22 bp, Homo sapiens
cctgtgtggtttagtgtaaaaa

SEQ ID NO: 3782103 - DNA, 20 bp, Homo sapiens
cctgtgtgtgcgcctacagg

SEQ ID NO: 3782104 - DNA, 23 bp, Homo sapiens
cctgttacctaattagagcagat

SEQ ID NO: 3782105 - DNA, 21 bp, Homo sapiens
cctgttcactctacttagcat

SEQ ID NO: 3782106 - DNA, 15 bp, Homo sapiens
cctgttcagctccag

SEQ ID NO: 3782107 - DNA, 16 bp, Homo sapiens
cctgttcattgtaagc

SEQ ID NO: 3782108 - DNA, 12 bp, Homo sapiens
cctgttcccatt

SEQ ID NO: 3782109 - DNA, 12 bp, Homo sapiens
cctgttgaaaag

SEQ ID NO: 3782110 - DNA, 22 bp, Homo sapiens
cctgttgaaaagccatgtttaa

SEQ ID NO: 3782111 - DNA, 19 bp, Homo sapiens
cctgtttttaagctgtttc

SEQ ID NO: 3782112 - DNA, 13 bp, Homo sapiens
ccttaaattaaac

SEQ ID NO: 3782113 - DNA, 23 bp, Homo sapiens
ccttaactggagccccatcagct

SEQ ID NO: 3782114 - DNA, 16 bp, Homo sapiens
ccttaagtatcagaaa

SEQ ID NO: 3782115 - DNA, 18 bp, Homo sapiens
ccttacacctcgttaggg

SEQ ID NO: 3782116 - DNA, 22 bp, Homo sapiens
ccttacacctcgttagggaaga

SEQ ID NO: 3782117 - DNA, 13 bp, Homo sapiens
ccttacctcctgc

SEQ ID NO: 3782118 - DNA, 14 bp, Homo sapiens
ccttacctcctgcc

SEQ ID NO: 3782119 - DNA, 17 bp, Homo sapiens
ccttagaagtcacacag

SEQ ID NO: 3782120 - DNA, 16 bp, Homo sapiens
ccttagagacatcaaa

SEQ ID NO: 3782121 - DNA, 17 bp, Homo sapiens
ccttagcaacagccgag

SEQ ID NO: 3782122 - DNA, 18 bp, Homo sapiens
ccttagccagttgtatat

SEQ ID NO: 3782123 - DNA, 15 bp, Homo sapiens
ccttagcctccctga

SEQ ID NO: 3782124 - DNA, 22 bp, Homo sapiens
ccttagctggcattacagctgg

SEQ ID NO: 3782125 - DNA, 22 bp, Homo sapiens
ccttagcttagacctcagcctg

SEQ ID NO: 3782126 - DNA, 23 bp, Homo sapiens
ccttagcttagacctcagcctgt

SEQ ID NO: 3782127 - DNA, 14 bp, Homo sapiens
ccttcaaccattcc

SEQ ID NO: 3782128 - DNA, 14 bp, Homo sapiens
ccttcaataaagta

SEQ ID NO: 3782129 - DNA, 14 bp, Homo sapiens
ccttcaattcctgg

SEQ ID NO: 3782130 - DNA, 16 bp, Homo sapiens
ccttcaattcctgggc

SEQ ID NO: 3782131 - DNA, 20 bp, Homo sapiens
ccttcaattcctgggcccca

SEQ ID NO: 3782132 - DNA, 18 bp, Homo sapiens
ccttcacaccataactag

SEQ ID NO: 3782133 - DNA, 13 bp, Homo sapiens
ccttcagatccta

SEQ ID NO: 3782134 - DNA, 14 bp, Homo sapiens
ccttcagatcctac

SEQ ID NO: 3782135 - DNA, 20 bp, Homo sapiens
ccttcagatcctacccctga

SEQ ID NO: 3782136 - DNA, 16 bp, Homo sapiens
ccttcagtgcccacca

SEQ ID NO: 3782137 - DNA, 18 bp, Homo sapiens
ccttcagtgcccaccaac

SEQ ID NO: 3782138 - DNA, 20 bp, Homo sapiens
ccttcattgccttaactgga

SEQ ID NO: 3782139 - DNA, 19 bp, Homo sapiens
ccttcatttctgatataga

SEQ ID NO: 3782140 - DNA, 22 bp, Homo sapiens
ccttcatttctgatatagaatt

SEQ ID NO: 3782141 - DNA, 19 bp, Homo sapiens
ccttcatttggcattcccc

SEQ ID NO: 3782142 - DNA, 19 bp, Homo sapiens
ccttccaactgctgcccca

SEQ ID NO: 3782143 - DNA, 16 bp, Homo sapiens
ccttccacggactcaa

SEQ ID NO: 3782144 - DNA, 17 bp, Homo sapiens
ccttccacggactcaag

SEQ ID NO: 3782145 - DNA, 16 bp, Homo sapiens
ccttccagcaccctgc

SEQ ID NO: 3782146 - DNA, 23 bp, Homo sapiens
ccttccatagcctaatccctggg

SEQ ID NO: 3782147 - DNA, 19 bp, Homo sapiens
ccttccatccctaccccct

SEQ ID NO: 3782148 - DNA, 17 bp, Homo sapiens
ccttccatctcgccacc

SEQ ID NO: 3782149 - DNA, 20 bp, Homo sapiens
ccttccatgtcgcctctgca

SEQ ID NO: 3782150 - DNA, 12 bp, Homo sapiens
ccttcccagctc

SEQ ID NO: 3782151 - DNA, 13 bp, Homo sapiens
ccttcccagctgc

SEQ ID NO: 3782152 - DNA, 16 bp, Homo sapiens
ccttccccctcccagg

SEQ ID NO: 3782153 - DNA, 17 bp, Homo sapiens
ccttccccctcccaggg

SEQ ID NO: 3782154 - DNA, 11 bp, Homo sapiens
ccttccctggc

SEQ ID NO: 3782155 - DNA, 16 bp, Homo sapiens
ccttcccttgagccct

SEQ ID NO: 3782156 - DNA, 22 bp, Homo sapiens
ccttcctctcatccttttctcc

SEQ ID NO: 3782157 - DNA, 15 bp, Homo sapiens
ccttcctctccactg

SEQ ID NO: 3782158 - DNA, 16 bp, Homo sapiens
ccttcctctccactgc

SEQ ID NO: 3782159 - DNA, 17 bp, Homo sapiens
ccttcctctccactgcc

SEQ ID NO: 3782160 - DNA, 14 bp, Homo sapiens
ccttcctctttcca

SEQ ID NO: 3782161 - DNA, 14 bp, Homo sapiens
ccttccttccctgg

SEQ ID NO: 3782162 - DNA, 14 bp, Homo sapiens
ccttccttcttgct

SEQ ID NO: 3782163 - DNA, 13 bp, Homo sapiens
ccttcgctcctgt

SEQ ID NO: 3782164 - DNA, 16 bp, Homo sapiens
ccttctacactctcct

SEQ ID NO: 3782165 - DNA, 17 bp, Homo sapiens
ccttctacactctcctg

SEQ ID NO: 3782166 - DNA, 20 bp, Homo sapiens
ccttctacactctcctgggc

SEQ ID NO: 3782167 - DNA, 21 bp, Homo sapiens
ccttctacactctcctgggcc

SEQ ID NO: 3782168 - DNA, 17 bp, Homo sapiens
ccttctccttccaactg

SEQ ID NO: 3782169 - DNA, 16 bp, Homo sapiens
ccttctctcacctcct

SEQ ID NO: 3782170 - DNA, 17 bp, Homo sapiens
ccttctctcacctccta

SEQ ID NO: 3782171 - DNA, 19 bp, Homo sapiens
ccttctctcacctcctaaa

SEQ ID NO: 3782172 - DNA, 18 bp, Homo sapiens
ccttctctgcccattccc

SEQ ID NO: 3782173 - DNA, 19 bp, Homo sapiens
ccttctctgcccattcccc

SEQ ID NO: 3782174 - DNA, 17 bp, Homo sapiens
ccttctctgctccacca

SEQ ID NO: 3782175 - DNA, 14 bp, Homo sapiens
ccttctcttaattt

SEQ ID NO: 3782176 - DNA, 13 bp, Homo sapiens
ccttctgtgccca

SEQ ID NO: 3782177 - DNA, 15 bp, Homo sapiens
ccttctgtgcccagc

SEQ ID NO: 3782178 - DNA, 16 bp, Homo sapiens
ccttctgtgcccagct

SEQ ID NO: 3782179 - DNA, 21 bp, Homo sapiens
ccttctgtgcccagctcagtc

SEQ ID NO: 3782180 - DNA, 20 bp, Homo sapiens
ccttcttattctcactccac

SEQ ID NO: 3782181 - DNA, 22 bp, Homo sapiens
ccttcttattctcactccacca

SEQ ID NO: 3782182 - DNA, 21 bp, Homo sapiens
ccttcttcggggaactcctgg

SEQ ID NO: 3782183 - DNA, 22 bp, Homo sapiens
ccttcttcggggaactcctgga

SEQ ID NO: 3782184 - DNA, 14 bp, Homo sapiens
ccttgaactgggta

SEQ ID NO: 3782185 - DNA, 17 bp, Homo sapiens
ccttgaagaacctctca

SEQ ID NO: 3782186 - DNA, 13 bp, Homo sapiens
ccttgaagatatc

SEQ ID NO: 3782187 - DNA, 19 bp, Homo sapiens
ccttgaagccactgaagct

SEQ ID NO: 3782188 - DNA, 14 bp, Homo sapiens
ccttgacagggcac

SEQ ID NO: 3782189 - DNA, 15 bp, Homo sapiens
ccttgacagggcaca

SEQ ID NO: 3782190 - DNA, 23 bp, Homo sapiens
ccttgacattgtagagcttctgg

SEQ ID NO: 3782191 - DNA, 20 bp, Homo sapiens
ccttgaccagcagatcccag

SEQ ID NO: 3782192 - DNA, 21 bp, Homo sapiens
ccttgaccagcagatcccagc

SEQ ID NO: 3782193 - DNA, 23 bp, Homo sapiens
ccttgaccagcagatcccagctc

SEQ ID NO: 3782194 - DNA, 17 bp, Homo sapiens
ccttgagacctcagcca

SEQ ID NO: 3782195 - DNA, 18 bp, Homo sapiens
ccttgagacctcagccat

SEQ ID NO: 3782196 - DNA, 17 bp, Homo sapiens
ccttgagggcaagagcc

SEQ ID NO: 3782197 - DNA, 23 bp, Homo sapiens
ccttgaggtcttttgacatgtgg

SEQ ID NO: 3782198 - DNA, 20 bp, Homo sapiens
ccttgagttgattcagctct

SEQ ID NO: 3782199 - DNA, 22 bp, Homo sapiens
ccttgagttgattcagctctgc

SEQ ID NO: 3782200 - DNA, 21 bp, Homo sapiens
ccttgatttatcacacaaagc

SEQ ID NO: 3782201 - DNA, 22 bp, Homo sapiens
ccttgcaacacacagacacacg

SEQ ID NO: 3782202 - DNA, 13 bp, Homo sapiens
ccttgcacctgca

SEQ ID NO: 3782203 - DNA, 22 bp, Homo sapiens
ccttgcagttcagcaccaccct

SEQ ID NO: 3782204 - DNA, 22 bp, Homo sapiens
ctaacctaagcaaaaccactga

SEQ ID NO: 3782205 - DNA, 19 bp, Homo sapiens
ctaactcagaaacatcagt

SEQ ID NO: 3782206 - DNA, 21 bp, Homo sapiens
ctaactctgatgtaaatgaag

SEQ ID NO: 3782207 - DNA, 20 bp, Homo sapiens
ctaactgctacaaatactct

SEQ ID NO: 3782208 - DNA, 16 bp, Homo sapiens
ctaactttccttcatt

SEQ ID NO: 3782209 - DNA, 23 bp, Homo sapiens
ctaagaaaagatacgactttatt

SEQ ID NO: 3782210 - DNA, 22 bp, Homo sapiens
ctaagaaagcccttaggaagaa

SEQ ID NO: 3782211 - DNA, 18 bp, Homo sapiens
ctaagagtgtcctaggag

SEQ ID NO: 3782212 - DNA, 14 bp, Homo sapiens
ctaagccaagggcc

SEQ ID NO: 3782213 - DNA, 16 bp, Homo sapiens
ctaagcctttccataa

SEQ ID NO: 3782214 - DNA, 23 bp, Homo sapiens
ctaaggaagatcactttgctctg

SEQ ID NO: 3782215 - DNA, 19 bp, Homo sapiens
ctaaggtcattaccacagg

SEQ ID NO: 3782216 - DNA, 15 bp, Homo sapiens
ctaaggtgtgctctg

SEQ ID NO: 3782217 - DNA, 16 bp, Homo sapiens
ctaagtccctgccccc

SEQ ID NO: 3782218 - DNA, 14 bp, Homo sapiens
ctaagtgaaaaggt

SEQ ID NO: 3782219 - DNA, 20 bp, Homo sapiens
ctaagtgatcctcccacctc

SEQ ID NO: 3782220 - DNA, 13 bp, Homo sapiens
ctaagtttcagtt

SEQ ID NO: 3782221 - DNA, 20 bp, Homo sapiens
ctaataaaatatcattcagc

SEQ ID NO: 3782222 - DNA, 23 bp, Homo sapiens
ctaataaaatatcattcagcaac

SEQ ID NO: 3782223 - DNA, 19 bp, Homo sapiens
ctaatcagcattctcactc

SEQ ID NO: 3782224 - DNA, 20 bp, Homo sapiens
ctaatcagggaggtcatttt

SEQ ID NO: 3782225 - DNA, 21 bp, Homo sapiens
ctaatcagggaggtcattttg

SEQ ID NO: 3782226 - DNA, 14 bp, Homo sapiens
ctaatcatgaaact

SEQ ID NO: 3782227 - DNA, 20 bp, Homo sapiens
ctaatcatgtgggtgagcca

SEQ ID NO: 3782228 - DNA, 18 bp, Homo sapiens
ctaatctattgggttcat

SEQ ID NO: 3782229 - DNA, 20 bp, Homo sapiens
ctaatctattgggttcatta

SEQ ID NO: 3782230 - DNA, 23 bp, Homo sapiens
ctaatgaagggaaaggatatttt

SEQ ID NO: 3782231 - DNA, 19 bp, Homo sapiens
ctaatgaatgcataaaatg

SEQ ID NO: 3782232 - DNA, 13 bp, Homo sapiens
ctaatgatgtttt

SEQ ID NO: 3782233 - DNA, 13 bp, Homo sapiens
ctaatgggacact

SEQ ID NO: 3782234 - DNA, 14 bp, Homo sapiens
ctaatgtactgcat

SEQ ID NO: 3782235 - DNA, 19 bp, Homo sapiens
ctaatgtgcctagttcttt

SEQ ID NO: 3782236 - DNA, 20 bp, Homo sapiens
ctaatgtttatgagccagac

SEQ ID NO: 3782237 - DNA, 19 bp, Homo sapiens
ctaattcccattttgcaaa

SEQ ID NO: 3782238 - DNA, 24 bp, Homo sapiens
ctaattctaaccagagcaagcttt

SEQ ID NO: 3782239 - DNA, 23 bp, Homo sapiens
ctaatttatcctgaaatttcaga

SEQ ID NO: 3782240 - DNA, 21 bp, Homo sapiens
ctaatttctgtgtctaaattt

SEQ ID NO: 3782241 - DNA, 17 bp, Homo sapiens
ctacaaaatttgaaatt

SEQ ID NO: 3782242 - DNA, 17 bp, Homo sapiens
ctacaagagcagcctgt

SEQ ID NO: 3782243 - DNA, 23 bp, Homo sapiens
ctacaagagcagcctgtggcatc

SEQ ID NO: 3782244 - DNA, 16 bp, Homo sapiens
ctacactccagcctga

SEQ ID NO: 3782245 - DNA, 18 bp, Homo sapiens
ctacactccagcctgagc

SEQ ID NO: 3782246 - DNA, 14 bp, Homo sapiens
ctacactctcctgg

SEQ ID NO: 3782247 - DNA, 16 bp, Homo sapiens
ctacactctcctgggc

SEQ ID NO: 3782248 - DNA, 17 bp, Homo sapiens
ctacagacattaaataa

SEQ ID NO: 3782249 - DNA, 19 bp, Homo sapiens
ctacagacattaaataatc

SEQ ID NO: 3782250 - DNA, 21 bp, Homo sapiens
ctacagacttctccagaccca

SEQ ID NO: 3782251 - DNA, 18 bp, Homo sapiens
ctacagaggccatgggcc

SEQ ID NO: 3782252 - DNA, 20 bp, Homo sapiens
ctacagaggccatgggcctc

SEQ ID NO: 3782253 - DNA, 16 bp, Homo sapiens
ctacagcaaatttata

SEQ ID NO: 3782254 - DNA, 20 bp, Homo sapiens
ctacagcaaatttataattt

SEQ ID NO: 3782255 - DNA, 22 bp, Homo sapiens
ctacagcaaatttataatttta

SEQ ID NO: 3782256 - DNA, 18 bp, Homo sapiens
ctacaggaagcaccccat

SEQ ID NO: 3782257 - DNA, 14 bp, Homo sapiens
ctacaggagtgagc

SEQ ID NO: 3782258 - DNA, 17 bp, Homo sapiens
ctacaggcacccaccat

SEQ ID NO: 3782259 - DNA, 12 bp, Homo sapiens
ctacaggcctca

SEQ ID NO: 3782260 - DNA, 19 bp, Homo sapiens
ctacagttgaaaaacagct

SEQ ID NO: 3782261 - DNA, 21 bp, Homo sapiens
ctacagttgaaaaacagctga

SEQ ID NO: 3782262 - DNA, 22 bp, Homo sapiens
ctacagttgaaaaacagctgag

SEQ ID NO: 3782263 - DNA, 20 bp, Homo sapiens
ctacatacgtctttcacagt

SEQ ID NO: 3782264 - DNA, 15 bp, Homo sapiens
ctacatcccagcctg

SEQ ID NO: 3782265 - DNA, 17 bp, Homo sapiens
ctacatcccagcctgtg

SEQ ID NO: 3782266 - DNA, 17 bp, Homo sapiens
ctacatcgccctccaca

SEQ ID NO: 3782267 - DNA, 15 bp, Homo sapiens
ctacatgaaacagaa

SEQ ID NO: 3782268 - DNA, 18 bp, Homo sapiens
ctacatgacgacaaagct

SEQ ID NO: 3782269 - DNA, 22 bp, Homo sapiens
ctacatgcaaggcactgtacta

SEQ ID NO: 3782270 - DNA, 14 bp, Homo sapiens
ctacatgcagccca

SEQ ID NO: 3782271 - DNA, 15 bp, Homo sapiens
ctacatgcagcccat

SEQ ID NO: 3782272 - DNA, 17 bp, Homo sapiens
ctacatgtgggagcttt

SEQ ID NO: 3782273 - DNA, 14 bp, Homo sapiens
ctacattttaacat

SEQ ID NO: 3782274 - DNA, 15 bp, Homo sapiens
ctacattttaacatg

SEQ ID NO: 3782275 - DNA, 15 bp, Homo sapiens
ctaccaaagcacctt

SEQ ID NO: 3782276 - DNA, 16 bp, Homo sapiens
ctaccacaaggaaaat

SEQ ID NO: 3782277 - DNA, 11 bp, Homo sapiens
ctaccacctcc

SEQ ID NO: 3782278 - DNA, 15 bp, Homo sapiens
ctaccaggtgttcta

SEQ ID NO: 3782279 - DNA, 13 bp, Homo sapiens
ctaccatttcaga

SEQ ID NO: 3782280 - DNA, 16 bp, Homo sapiens
ctacccacttctaaat

SEQ ID NO: 3782281 - DNA, 23 bp, Homo sapiens
ctacccatcggtgtccatttata

SEQ ID NO: 3782282 - DNA, 14 bp, Homo sapiens
ctaccccaccacga

SEQ ID NO: 3782283 - DNA, 16 bp, Homo sapiens
ctaccctcccaccccc

SEQ ID NO: 3782284 - DNA, 19 bp, Homo sapiens
ctaccctcccacccccttc

SEQ ID NO: 3782285 - DNA, 15 bp, Homo sapiens
ctacctcaacctgta

SEQ ID NO: 3782286 - DNA, 12 bp, Homo sapiens
ctacctcagcct

SEQ ID NO: 3782287 - DNA, 23 bp, Homo sapiens
ctacctcaggcaggaagggcagg

SEQ ID NO: 3782288 - DNA, 15 bp, Homo sapiens
ctacctgatcccact

SEQ ID NO: 3782289 - DNA, 18 bp, Homo sapiens
ctaccttccagttcctca

SEQ ID NO: 3782290 - DNA, 13 bp, Homo sapiens
ctaccttttctct

SEQ ID NO: 3782291 - DNA, 15 bp, Homo sapiens
ctactaaaaatacaa

SEQ ID NO: 3782292 - DNA, 18 bp, Homo sapiens
ctactaaaaatacaaaca

SEQ ID NO: 3782293 - DNA, 19 bp, Homo sapiens
ctactaaaaatacaaacaa

SEQ ID NO: 3782294 - DNA, 13 bp, Homo sapiens
ctactaatgatgt

SEQ ID NO: 3782295 - DNA, 14 bp, Homo sapiens
ctactaatgatgtt

SEQ ID NO: 3782296 - DNA, 18 bp, Homo sapiens
ctactacatcgccctcca

SEQ ID NO: 3782297 - DNA, 21 bp, Homo sapiens
ctactagggacctggggaagc

SEQ ID NO: 3782298 - DNA, 18 bp, Homo sapiens
ctactatgccagatgcct

SEQ ID NO: 3782299 - DNA, 14 bp, Homo sapiens
ctactcactcaagt

SEQ ID NO: 3782300 - DNA, 16 bp, Homo sapiens
ctactcactcaagttc

SEQ ID NO: 3782301 - DNA, 17 bp, Homo sapiens
ctactcagcagccctcc

SEQ ID NO: 3782302 - DNA, 18 bp, Homo sapiens
ctactcagcagccctcct

SEQ ID NO: 3782303 - DNA, 19 bp, Homo sapiens
ctactcagcagccctcctc

SEQ ID NO: 3782304 - DNA, 16 bp, Homo sapiens
ctactcaggaggctga

SEQ ID NO: 3782305 - DNA, 15 bp, Homo sapiens
ctactcctacctcag

SEQ ID NO: 3782306 - DNA, 12 bp, Homo sapiens
ctactctgtgtc

SEQ ID NO: 3782307 - DNA, 16 bp, Homo sapiens
ctactctgtgtcaggt

SEQ ID NO: 3782308 - DNA, 21 bp, Homo sapiens
ctactctgtgtcaggtggggc

SEQ ID NO: 3782309 - DNA, 16 bp, Homo sapiens
ctactctgttccttca

SEQ ID NO: 3782310 - DNA, 22 bp, Homo sapiens
ctactctgttccttcacatcct

SEQ ID NO: 3782311 - DNA, 22 bp, Homo sapiens
ctactgcttctaccaactggaa

SEQ ID NO: 3782312 - DNA, 14 bp, Homo sapiens
ctactgtggaaaaa

SEQ ID NO: 3782313 - DNA, 13 bp, Homo sapiens
ctactgtgttcct

SEQ ID NO: 3782314 - DNA, 15 bp, Homo sapiens
ctactgtgttcctgg

SEQ ID NO: 3782315 - DNA, 19 bp, Homo sapiens
ctacttaccatatgtgctt

SEQ ID NO: 3782316 - DNA, 22 bp, Homo sapiens
ctacttagcatgtccctaccga

SEQ ID NO: 3782317 - DNA, 18 bp, Homo sapiens
ctcattttaggcaaatat

SEQ ID NO: 3782318 - DNA, 11 bp, Homo sapiens
ctccaaagctt

SEQ ID NO: 3782319 - DNA, 22 bp, Homo sapiens
ctccaaaggaagtctaggagct

SEQ ID NO: 3782320 - DNA, 12 bp, Homo sapiens
ctccaacaataa

SEQ ID NO: 3782321 - DNA, 23 bp, Homo sapiens
ctccaagcaagtagctttccaca

SEQ ID NO: 3782322 - DNA, 15 bp, Homo sapiens
ctccaaggtggggtc

SEQ ID NO: 3782323 - DNA, 15 bp, Homo sapiens
ctccacagccgcagc

SEQ ID NO: 3782324 - DNA, 13 bp, Homo sapiens
ctccaccacatcc

SEQ ID NO: 3782325 - DNA, 12 bp, Homo sapiens
ctccaccaccca

SEQ ID NO: 3782326 - DNA, 16 bp, Homo sapiens
ctccaccacccaaaag

SEQ ID NO: 3782327 - DNA, 22 bp, Homo sapiens
ctccaccccccagaacctgtcc

SEQ ID NO: 3782328 - DNA, 17 bp, Homo sapiens
ctccacccttggcctgt

SEQ ID NO: 3782329 - DNA, 15 bp, Homo sapiens
ctccaccgctgccta

SEQ ID NO: 3782330 - DNA, 16 bp, Homo sapiens
ctccaccgctgcctaa

SEQ ID NO: 3782331 - DNA, 18 bp, Homo sapiens
ctccacctcagccttgga

SEQ ID NO: 3782332 - DNA, 16 bp, Homo sapiens
ctccacgttcacccct

SEQ ID NO: 3782333 - DNA, 12 bp, Homo sapiens
ctccactgccct

SEQ ID NO: 3782334 - DNA, 15 bp, Homo sapiens
ctccactgccttcga

SEQ ID NO: 3782335 - DNA, 17 bp, Homo sapiens
ctccagaagcctctggc

SEQ ID NO: 3782336 - DNA, 18 bp, Homo sapiens
ctccagacccccacccct

SEQ ID NO: 3782337 - DNA, 15 bp, Homo sapiens
ctccagacccctggc

SEQ ID NO: 3782338 - DNA, 18 bp, Homo sapiens
ctccagacccctggcttt

SEQ ID NO: 3782339 - DNA, 21 bp, Homo sapiens
ctccagacccctggcttttca

SEQ ID NO: 3782340 - DNA, 13 bp, Homo sapiens
ctccagatctgca

SEQ ID NO: 3782341 - DNA, 21 bp, Homo sapiens
ctccagccaacccctgtggag

SEQ ID NO: 3782342 - DNA, 20 bp, Homo sapiens
ctccagcctgggcaacacag

SEQ ID NO: 3782343 - DNA, 19 bp, Homo sapiens
ctccagctcaccagcccca

SEQ ID NO: 3782344 - DNA, 14 bp, Homo sapiens
ctccagctcagcag

SEQ ID NO: 3782345 - DNA, 20 bp, Homo sapiens
ctccagctgctctgtcttct

SEQ ID NO: 3782346 - DNA, 19 bp, Homo sapiens
ctccagctgggttggaaaa

SEQ ID NO: 3782347 - DNA, 19 bp, Homo sapiens
ctccagctgttcagctggt

SEQ ID NO: 3782348 - DNA, 15 bp, Homo sapiens
ctccaggaaggggct

SEQ ID NO: 3782349 - DNA, 18 bp, Homo sapiens
ctccaggaaggggctgga

SEQ ID NO: 3782350 - DNA, 22 bp, Homo sapiens
ctccaggctgtatcccatgagc

SEQ ID NO: 3782351 - DNA, 15 bp, Homo sapiens
ctccagggagcaaga

SEQ ID NO: 3782352 - DNA, 18 bp, Homo sapiens
ctccagggagcaagacag

SEQ ID NO: 3782353 - DNA, 22 bp, Homo sapiens
ctccaggtcctctacttaatga

SEQ ID NO: 3782354 - DNA, 21 bp, Homo sapiens
ctccagtactggagcttctct

SEQ ID NO: 3782355 - DNA, 17 bp, Homo sapiens
ctccagttttcagttga

SEQ ID NO: 3782356 - DNA, 17 bp, Homo sapiens
ctccatgagttttttct

SEQ ID NO: 3782357 - DNA, 12 bp, Homo sapiens
ctccatggtgcc

SEQ ID NO: 3782358 - DNA, 14 bp, Homo sapiens
ctccatgtgggcta

SEQ ID NO: 3782359 - DNA, 17 bp, Homo sapiens
ctccattcctggagccc

SEQ ID NO: 3782360 - DNA, 14 bp, Homo sapiens
ctccattctgacca

SEQ ID NO: 3782361 - DNA, 16 bp, Homo sapiens
ctccattgttttgcct

SEQ ID NO: 3782362 - DNA, 14 bp, Homo sapiens
ctcccaaagagctg

SEQ ID NO: 3782363 - DNA, 18 bp, Homo sapiens
ctcccaaagtgctgggat

SEQ ID NO: 3782364 - DNA, 17 bp, Homo sapiens
ctcccaagaacagcagg

SEQ ID NO: 3782365 - DNA, 13 bp, Homo sapiens
ctcccaccacagc

SEQ ID NO: 3782366 - DNA, 19 bp, Homo sapiens
ctcccaccacagcaggtgt

SEQ ID NO: 3782367 - DNA, 19 bp, Homo sapiens
ctcccaccccacccccttc

SEQ ID NO: 3782368 - DNA, 20 bp, Homo sapiens
ctcccacccccatctctccc

SEQ ID NO: 3782369 - DNA, 22 bp, Homo sapiens
ctcccacccccatctctccctc

SEQ ID NO: 3782370 - DNA, 18 bp, Homo sapiens
ctcccacccccttctctg

SEQ ID NO: 3782371 - DNA, 12 bp, Homo sapiens
ctcccacctcag

SEQ ID NO: 3782372 - DNA, 16 bp, Homo sapiens
ctcccacctcagcctc

SEQ ID NO: 3782373 - DNA, 17 bp, Homo sapiens
ctcccacctcagcctcc

SEQ ID NO: 3782374 - DNA, 16 bp, Homo sapiens
ctcccagaacacactc

SEQ ID NO: 3782375 - DNA, 24 bp, Homo sapiens
ctcccagaacacactccatcagct

SEQ ID NO: 3782376 - DNA, 22 bp, Homo sapiens
ctcccagatttcagtcttttcc

SEQ ID NO: 3782377 - DNA, 23 bp, Homo sapiens
ctcccagctctagacaaccctgc

SEQ ID NO: 3782378 - DNA, 18 bp, Homo sapiens
ctcccaggccccctgcat

SEQ ID NO: 3782379 - DNA, 22 bp, Homo sapiens
ctcccaggcgccccttccccct

SEQ ID NO: 3782380 - DNA, 12 bp, Homo sapiens
ctcccagggcca

SEQ ID NO: 3782381 - DNA, 22 bp, Homo sapiens
ctcccagggccagggccctgca

SEQ ID NO: 3782382 - DNA, 18 bp, Homo sapiens
ctcccatcttaactcttt

SEQ ID NO: 3782383 - DNA, 20 bp, Homo sapiens
ctcccatcttaactctttgc

SEQ ID NO: 3782384 - DNA, 16 bp, Homo sapiens
ctcccatgaccatact

SEQ ID NO: 3782385 - DNA, 19 bp, Homo sapiens
ctccccaccaccccagctg

SEQ ID NO: 3782386 - DNA, 21 bp, Homo sapiens
ctccccaccttcaattcctgg

SEQ ID NO: 3782387 - DNA, 19 bp, Homo sapiens
ctccccagcaggtggggag

SEQ ID NO: 3782388 - DNA, 15 bp, Homo sapiens
ctccccagcccaggg

SEQ ID NO: 3782389 - DNA, 23 bp, Homo sapiens
ctcccccaacccccaccccacac

SEQ ID NO: 3782390 - DNA, 15 bp, Homo sapiens
ctcccccatcctccc

SEQ ID NO: 3782391 - DNA, 13 bp, Homo sapiens
ctccccctgccag

SEQ ID NO: 3782392 - DNA, 11 bp, Homo sapiens
ctccccctggg

SEQ ID NO: 3782393 - DNA, 12 bp, Homo sapiens
ctccccctgggc

SEQ ID NO: 3782394 - DNA, 13 bp, Homo sapiens
ctccccctgggct

SEQ ID NO: 3782395 - DNA, 14 bp, Homo sapiens
ctccccggctcgag

SEQ ID NO: 3782396 - DNA, 16 bp, Homo sapiens
ctcccctaatgcctgc

SEQ ID NO: 3782397 - DNA, 18 bp, Homo sapiens
ctcccctatccacccagc

SEQ ID NO: 3782398 - DNA, 19 bp, Homo sapiens
ctcccctatccacccagcc

SEQ ID NO: 3782399 - DNA, 15 bp, Homo sapiens
ctcccctccttgcct

SEQ ID NO: 3782400 - DNA, 16 bp, Homo sapiens
ctcccctccttgcctc

SEQ ID NO: 3782401 - DNA, 19 bp, Homo sapiens
ctcccctccttgcctcctg

SEQ ID NO: 3782402 - DNA, 22 bp, Homo sapiens
ctcccctccttgcctcctgtgt

SEQ ID NO: 3782403 - DNA, 18 bp, Homo sapiens
ctcccctcttatgtacct

SEQ ID NO: 3782404 - DNA, 14 bp, Homo sapiens
ctcccctgccctgg

SEQ ID NO: 3782405 - DNA, 11 bp, Homo sapiens
ctccccttccc

SEQ ID NO: 3782406 - DNA, 16 bp, Homo sapiens
ctccccttccctgcaa

SEQ ID NO: 3782407 - DNA, 19 bp, Homo sapiens
ctcccgaatagctgggact

SEQ ID NO: 3782408 - DNA, 23 bp, Homo sapiens
ctcccgaatagctgggactacag

SEQ ID NO: 3782409 - DNA, 15 bp, Homo sapiens
ctcccgagtagctgg

SEQ ID NO: 3782410 - DNA, 16 bp, Homo sapiens
ctcccgagtagctggg

SEQ ID NO: 3782411 - DNA, 20 bp, Homo sapiens
ctcccgagtagctgggacta

SEQ ID NO: 3782412 - DNA, 20 bp, Homo sapiens
ctcccggctatgggggcact

SEQ ID NO: 3782413 - DNA, 22 bp, Homo sapiens
ctccctaccacctccccagcct

SEQ ID NO: 3782414 - DNA, 16 bp, Homo sapiens
ctccctataatgctgg

SEQ ID NO: 3782415 - DNA, 14 bp, Homo sapiens
ctccctcaacccca

SEQ ID NO: 3782416 - DNA, 12 bp, Homo sapiens
ctccctcagccc

SEQ ID NO: 3782417 - DNA, 14 bp, Homo sapiens
ctccctcagtgccc

SEQ ID NO: 3782418 - DNA, 13 bp, Homo sapiens
ctccctcattcca

SEQ ID NO: 3782419 - DNA, 18 bp, Homo sapiens
ctccctcccctgccattt

SEQ ID NO: 3782420 - DNA, 19 bp, Homo sapiens
ctccctccttccttcttgc

SEQ ID NO: 3782421 - DNA, 21 bp, Homo sapiens
ctccctcgaacccacactgca

SEQ ID NO: 3782422 - DNA, 20 bp, Homo sapiens
ctccctctctcttctgctcc

SEQ ID NO: 3782423 - DNA, 22 bp, Homo sapiens
ctccctctctcttctgctccac

SEQ ID NO: 3782424 - DNA, 18 bp, Homo sapiens
ctccctctgacctgcagg

SEQ ID NO: 3782425 - DNA, 14 bp, Homo sapiens
ctccctctgccggc

SEQ ID NO: 3782426 - DNA, 17 bp, Homo sapiens
ctccctctggccctgcc

SEQ ID NO: 3782427 - DNA, 19 bp, Homo sapiens
ctccctctggccctgcctt

SEQ ID NO: 3782428 - DNA, 20 bp, Homo sapiens
ctccctctggccctgccttc

SEQ ID NO: 3782429 - DNA, 19 bp, Homo sapiens
ctccctgaaccatccctga

SEQ ID NO: 3782430 - DNA, 21 bp, Homo sapiens
ctctttttccatcataattct

SEQ ID NO: 3782431 - DNA, 14 bp, Homo sapiens
ctctttttgttttt

SEQ ID NO: 3782432 - DNA, 14 bp, Homo sapiens
ctgaaaacccagag

SEQ ID NO: 3782433 - DNA, 22 bp, Homo sapiens
ctgaaaatgtttttctgccagg

SEQ ID NO: 3782434 - DNA, 17 bp, Homo sapiens
ctgaaaattaacactgc

SEQ ID NO: 3782435 - DNA, 14 bp, Homo sapiens
ctgaaacaggagag

SEQ ID NO: 3782436 - DNA, 15 bp, Homo sapiens
ctgaaactaatgaaa

SEQ ID NO: 3782437 - DNA, 16 bp, Homo sapiens
ctgaaagaaacagtta

SEQ ID NO: 3782438 - DNA, 20 bp, Homo sapiens
ctgaaagaaacagttaactt

SEQ ID NO: 3782439 - DNA, 21 bp, Homo sapiens
ctgaaagaaacagttaacttt

SEQ ID NO: 3782440 - DNA, 11 bp, Homo sapiens
ctgaaagccac

SEQ ID NO: 3782441 - DNA, 15 bp, Homo sapiens
ctgaaagccctgagc

SEQ ID NO: 3782442 - DNA, 16 bp, Homo sapiens
ctgaaagccctgagct

SEQ ID NO: 3782443 - DNA, 23 bp, Homo sapiens
ctgaaagccctgagctttctgct

SEQ ID NO: 3782444 - DNA, 18 bp, Homo sapiens
ctgaaagtgtttccttca

SEQ ID NO: 3782445 - DNA, 19 bp, Homo sapiens
ctgaaatatacacacagca

SEQ ID NO: 3782446 - DNA, 18 bp, Homo sapiens
ctgaaatgccttactttg

SEQ ID NO: 3782447 - DNA, 11 bp, Homo sapiens
ctgaacaaaaa

SEQ ID NO: 3782448 - DNA, 13 bp, Homo sapiens
ctgaacaaaaaaa

SEQ ID NO: 3782449 - DNA, 20 bp, Homo sapiens
ctgaacacttttgttgtaaa

SEQ ID NO: 3782450 - DNA, 14 bp, Homo sapiens
ctgaacagccaaat

SEQ ID NO: 3782451 - DNA, 17 bp, Homo sapiens
ctgaacatcacagctta

SEQ ID NO: 3782452 - DNA, 14 bp, Homo sapiens
ctgaaccttccatc

SEQ ID NO: 3782453 - DNA, 16 bp, Homo sapiens
ctgaaccttccatctc

SEQ ID NO: 3782454 - DNA, 19 bp, Homo sapiens
ctgaactgatgggtttctc

SEQ ID NO: 3782455 - DNA, 13 bp, Homo sapiens
ctgaacttcagct

SEQ ID NO: 3782456 - DNA, 13 bp, Homo sapiens
ctgaagaacagta

SEQ ID NO: 3782457 - DNA, 23 bp, Homo sapiens
ctgaagacaccgttcattcaggc

SEQ ID NO: 3782458 - DNA, 21 bp, Homo sapiens
ctgaagatacatgtctttctc

SEQ ID NO: 3782459 - DNA, 15 bp, Homo sapiens
ctgaagatagaagaa

SEQ ID NO: 3782460 - DNA, 21 bp, Homo sapiens
ctgaagatagaagaaaaaaga

SEQ ID NO: 3782461 - DNA, 22 bp, Homo sapiens
ctgaagatagaagaaaaaagaa

SEQ ID NO: 3782462 - DNA, 13 bp, Homo sapiens
ctgaagcctgcag

SEQ ID NO: 3782463 - DNA, 12 bp, Homo sapiens
ctgaaggagaag

SEQ ID NO: 3782464 - DNA, 21 bp, Homo sapiens
ctgaaggggttctcacagtgg

SEQ ID NO: 3782465 - DNA, 17 bp, Homo sapiens
ctgaagtcacacagtga

SEQ ID NO: 3782466 - DNA, 21 bp, Homo sapiens
ctgaagtcacacagtgagtcg

SEQ ID NO: 3782467 - DNA, 19 bp, Homo sapiens
ctgaagtcacatcacagga

SEQ ID NO: 3782468 - DNA, 13 bp, Homo sapiens
ctgaagtcactgc

SEQ ID NO: 3782469 - DNA, 16 bp, Homo sapiens
ctgaagtcactgcaca

SEQ ID NO: 3782470 - DNA, 17 bp, Homo sapiens
ctgaagtcactgcacag

SEQ ID NO: 3782471 - DNA, 22 bp, Homo sapiens
ctgaagtcactgcacagtgcat

SEQ ID NO: 3782472 - DNA, 22 bp, Homo sapiens
ctgaagtcccagatacttgggg

SEQ ID NO: 3782473 - DNA, 16 bp, Homo sapiens
ctgaagttaacagaga

SEQ ID NO: 3782474 - DNA, 16 bp, Homo sapiens
ctgaatacattctgct

SEQ ID NO: 3782475 - DNA, 18 bp, Homo sapiens
ctgaatacctctttgaaa

SEQ ID NO: 3782476 - DNA, 20 bp, Homo sapiens
ctgaatacctctttgaaaga

SEQ ID NO: 3782477 - DNA, 16 bp, Homo sapiens
ctgaatagctcccaga

SEQ ID NO: 3782478 - DNA, 23 bp, Homo sapiens
ctgaatagctcccagatttcagt

SEQ ID NO: 3782479 - DNA, 16 bp, Homo sapiens
ctgaatatttatattt

SEQ ID NO: 3782480 - DNA, 17 bp, Homo sapiens
ctgaatgaaatatcaga

SEQ ID NO: 3782481 - DNA, 20 bp, Homo sapiens
ctgaatgaacaacctcggct

SEQ ID NO: 3782482 - DNA, 12 bp, Homo sapiens
ctgaatgctctg

SEQ ID NO: 3782483 - DNA, 14 bp, Homo sapiens
ctgaatgtaatttg

SEQ ID NO: 3782484 - DNA, 11 bp, Homo sapiens
ctgaatgtatt

SEQ ID NO: 3782485 - DNA, 11 bp, Homo sapiens
ctgaatgttct

SEQ ID NO: 3782486 - DNA, 18 bp, Homo sapiens
ctgaatgttctgacatta

SEQ ID NO: 3782487 - DNA, 22 bp, Homo sapiens
ctgaattaatgacagagccagt

SEQ ID NO: 3782488 - DNA, 21 bp, Homo sapiens
ctgaatttggcctgcactaat

SEQ ID NO: 3782489 - DNA, 20 bp, Homo sapiens
ctgacaaccaccgctcccca

SEQ ID NO: 3782490 - DNA, 13 bp, Homo sapiens
ctgacaacttgaa

SEQ ID NO: 3782491 - DNA, 21 bp, Homo sapiens
ctgacaatcaactctaatagt

SEQ ID NO: 3782492 - DNA, 18 bp, Homo sapiens
ctgacacaaaaaaagttg

SEQ ID NO: 3782493 - DNA, 18 bp, Homo sapiens
ctgacacaaaaagtagat

SEQ ID NO: 3782494 - DNA, 13 bp, Homo sapiens
ctgacacacagct

SEQ ID NO: 3782495 - DNA, 15 bp, Homo sapiens
ctgacacacagctct

SEQ ID NO: 3782496 - DNA, 21 bp, Homo sapiens
ctgacacatgctgaacatcac

SEQ ID NO: 3782497 - DNA, 14 bp, Homo sapiens
ctgacacgtccacc

SEQ ID NO: 3782498 - DNA, 15 bp, Homo sapiens
ctgacagacacaggc

SEQ ID NO: 3782499 - DNA, 18 bp, Homo sapiens
ctgacagacacaggcccg

SEQ ID NO: 3782500 - DNA, 13 bp, Homo sapiens
ctgacagcctccc

SEQ ID NO: 3782501 - DNA, 17 bp, Homo sapiens
ctgacaggcaatgctgg

SEQ ID NO: 3782502 - DNA, 20 bp, Homo sapiens
ctgacaggcaatgctggctg

SEQ ID NO: 3782503 - DNA, 21 bp, Homo sapiens
ctgacaggcaatgctggctgt

SEQ ID NO: 3782504 - DNA, 21 bp, Homo sapiens
ctgacatcttagtatttgcat

SEQ ID NO: 3782505 - DNA, 15 bp, Homo sapiens
ctgacattaacagtt

SEQ ID NO: 3782506 - DNA, 17 bp, Homo sapiens
ctgaccaagagagaaag

SEQ ID NO: 3782507 - DNA, 16 bp, Homo sapiens
ctgaccacacttcctg

SEQ ID NO: 3782508 - DNA, 20 bp, Homo sapiens
ctgaccacacttcctgtcca

SEQ ID NO: 3782509 - DNA, 21 bp, Homo sapiens
ctgaccagcctccatgctgcc

SEQ ID NO: 3782510 - DNA, 23 bp, Homo sapiens
ctgaccagcctccatgctgcctc

SEQ ID NO: 3782511 - DNA, 16 bp, Homo sapiens
ctgaccatccactcta

SEQ ID NO: 3782512 - DNA, 22 bp, Homo sapiens
ctgaccatccactctaccctcc

SEQ ID NO: 3782513 - DNA, 15 bp, Homo sapiens
ctgacccactgatct

SEQ ID NO: 3782514 - DNA, 13 bp, Homo sapiens
ctgacccactgct

SEQ ID NO: 3782515 - DNA, 19 bp, Homo sapiens
ctgacccccctcaggaccc

SEQ ID NO: 3782516 - DNA, 19 bp, Homo sapiens
ctgaccctgcttcaaatat

SEQ ID NO: 3782517 - DNA, 15 bp, Homo sapiens
ctgacctccacagct

SEQ ID NO: 3782518 - DNA, 14 bp, Homo sapiens
ctgacctccccctc

SEQ ID NO: 3782519 - DNA, 17 bp, Homo sapiens
ctgacctccccctcctt

SEQ ID NO: 3782520 - DNA, 18 bp, Homo sapiens
ctgacctccccctccttc

SEQ ID NO: 3782521 - DNA, 22 bp, Homo sapiens
ctgacctccccctccttcccag

SEQ ID NO: 3782522 - DNA, 13 bp, Homo sapiens
ctgacctgcaggc

SEQ ID NO: 3782523 - DNA, 21 bp, Homo sapiens
ctgaccttgaactcctgggct

SEQ ID NO: 3782524 - DNA, 13 bp, Homo sapiens
ctgacgaggctgg

SEQ ID NO: 3782525 - DNA, 15 bp, Homo sapiens
ctgacgaggctgggc

SEQ ID NO: 3782526 - DNA, 20 bp, Homo sapiens
ctgacgaggctgggccaagc

SEQ ID NO: 3782527 - DNA, 22 bp, Homo sapiens
ctgacggcgcccccagtgtgca

SEQ ID NO: 3782528 - DNA, 23 bp, Homo sapiens
ctgactagaagggccagtcctgc

SEQ ID NO: 3782529 - DNA, 19 bp, Homo sapiens
ctgactcccaaagagctgc

SEQ ID NO: 3782530 - DNA, 20 bp, Homo sapiens
ctgactcccaaagagctgcc

SEQ ID NO: 3782531 - DNA, 23 bp, Homo sapiens
ctgactcccaaagagctgcctaa

SEQ ID NO: 3782532 - DNA, 17 bp, Homo sapiens
ctgactgtactcctccc

SEQ ID NO: 3782533 - DNA, 17 bp, Homo sapiens
ctgactgtggccccctc

SEQ ID NO: 3782534 - DNA, 19 bp, Homo sapiens
ctgactgtggccccctccg

SEQ ID NO: 3782535 - DNA, 19 bp, Homo sapiens
ctgagaaaacgaaactgct

SEQ ID NO: 3782536 - DNA, 18 bp, Homo sapiens
ctgagaaggggaggacct

SEQ ID NO: 3782537 - DNA, 18 bp, Homo sapiens
ctgagaagtcaaacattt

SEQ ID NO: 3782538 - DNA, 17 bp, Homo sapiens
ctgagaatagaaggaaa

SEQ ID NO: 3782539 - DNA, 24 bp, Homo sapiens
ctgagaatagaaggaaactagctt

SEQ ID NO: 3782540 - DNA, 15 bp, Homo sapiens
ctgagagacccaagg

SEQ ID NO: 3782541 - DNA, 17 bp, Homo sapiens
ctgagagacccaaggag

SEQ ID NO: 3782542 - DNA, 22 bp, Homo sapiens
ctgagaggacttttctttgtgg

SEQ ID NO: 3782543 - DNA, 21 bp, Homo sapiens
ctggccccatgtctctcagaa

SEQ ID NO: 3782544 - DNA, 13 bp, Homo sapiens
ctggcccccactg

SEQ ID NO: 3782545 - DNA, 14 bp, Homo sapiens
ctggcccccactgg

SEQ ID NO: 3782546 - DNA, 22 bp, Homo sapiens
ctggcccccactggctgtgggc

SEQ ID NO: 3782547 - DNA, 12 bp, Homo sapiens
ctggccctcttc

SEQ ID NO: 3782548 - DNA, 15 bp, Homo sapiens
ctggccctcttctta

SEQ ID NO: 3782549 - DNA, 11 bp, Homo sapiens
ctggccctggg

SEQ ID NO: 3782550 - DNA, 15 bp, Homo sapiens
ctggccctggggcct

SEQ ID NO: 3782551 - DNA, 17 bp, Homo sapiens
ctggccctggggcctgt

SEQ ID NO: 3782552 - DNA, 19 bp, Homo sapiens
ctggccctggggcctgtac

SEQ ID NO: 3782553 - DNA, 11 bp, Homo sapiens
ctggcctctgt

SEQ ID NO: 3782554 - DNA, 14 bp, Homo sapiens
ctggcctctgtcat

SEQ ID NO: 3782555 - DNA, 21 bp, Homo sapiens
ctggcctgaggagcagcagtt

SEQ ID NO: 3782556 - DNA, 15 bp, Homo sapiens
ctggcctgctgggct

SEQ ID NO: 3782557 - DNA, 19 bp, Homo sapiens
ctggcctgctgggctctcc

SEQ ID NO: 3782558 - DNA, 20 bp, Homo sapiens
ctggcgacagttttccttct

SEQ ID NO: 3782559 - DNA, 17 bp, Homo sapiens
ctggcggctactcagca

SEQ ID NO: 3782560 - DNA, 23 bp, Homo sapiens
ctggcgtctgtcttcaagggctt

SEQ ID NO: 3782561 - DNA, 15 bp, Homo sapiens
ctggcgtgcagtggt

SEQ ID NO: 3782562 - DNA, 16 bp, Homo sapiens
ctggctaactggaagc

SEQ ID NO: 3782563 - DNA, 19 bp, Homo sapiens
ctggctacatcccagcctg

SEQ ID NO: 3782564 - DNA, 23 bp, Homo sapiens
ctggctagaggccagccccaccc

SEQ ID NO: 3782565 - DNA, 16 bp, Homo sapiens
ctggctagagtcctca

SEQ ID NO: 3782566 - DNA, 20 bp, Homo sapiens
ctggctagagtcctcactcc

SEQ ID NO: 3782567 - DNA, 22 bp, Homo sapiens
ctggctagagtcctcactccca

SEQ ID NO: 3782568 - DNA, 12 bp, Homo sapiens
ctggctcacaga

SEQ ID NO: 3782569 - DNA, 18 bp, Homo sapiens
ctggctcacagactggag

SEQ ID NO: 3782570 - DNA, 19 bp, Homo sapiens
ctggctcacagactggaga

SEQ ID NO: 3782571 - DNA, 21 bp, Homo sapiens
ctggctcagcctcaaatgcag

SEQ ID NO: 3782572 - DNA, 21 bp, Homo sapiens
ctggctcatattcctgcagcc

SEQ ID NO: 3782573 - DNA, 24 bp, Homo sapiens
ctggctcatattcctgcagcctgg

SEQ ID NO: 3782574 - DNA, 15 bp, Homo sapiens
ctggctcccacaggc

SEQ ID NO: 3782575 - DNA, 19 bp, Homo sapiens
ctggctcccacaggccctt

SEQ ID NO: 3782576 - DNA, 14 bp, Homo sapiens
ctggctcccagggc

SEQ ID NO: 3782577 - DNA, 16 bp, Homo sapiens
ctggctcccagggcca

SEQ ID NO: 3782578 - DNA, 17 bp, Homo sapiens
ctggctccgctgtgtgg

SEQ ID NO: 3782579 - DNA, 20 bp, Homo sapiens
ctggctccgtccaggagcct

SEQ ID NO: 3782580 - DNA, 14 bp, Homo sapiens
ctggctcctgaggg

SEQ ID NO: 3782581 - DNA, 14 bp, Homo sapiens
ctggctgccttaga

SEQ ID NO: 3782582 - DNA, 19 bp, Homo sapiens
ctggctgccttagaacctt

SEQ ID NO: 3782583 - DNA, 22 bp, Homo sapiens
ctggctgggggcctcactccag

SEQ ID NO: 3782584 - DNA, 19 bp, Homo sapiens
ctggctgtgggctcccttc

SEQ ID NO: 3782585 - DNA, 21 bp, Homo sapiens
ctggctgtgggctcccttcct

SEQ ID NO: 3782586 - DNA, 16 bp, Homo sapiens
ctggctgttggctggg

SEQ ID NO: 3782587 - DNA, 18 bp, Homo sapiens
ctggctgttggctggggg

SEQ ID NO: 3782588 - DNA, 15 bp, Homo sapiens
ctggctttgtcccac

SEQ ID NO: 3782589 - DNA, 19 bp, Homo sapiens
ctggcttttcactgctggc

SEQ ID NO: 3782590 - DNA, 21 bp, Homo sapiens
ctgggaactcccaagaacagc

SEQ ID NO: 3782591 - DNA, 17 bp, Homo sapiens
ctgggaagataggctct

SEQ ID NO: 3782592 - DNA, 22 bp, Homo sapiens
ctgggaagataggctctgcaca

SEQ ID NO: 3782593 - DNA, 22 bp, Homo sapiens
ctgggaaggctactcaccttga

SEQ ID NO: 3782594 - DNA, 22 bp, Homo sapiens
ctgggaatgtattattctgcag

SEQ ID NO: 3782595 - DNA, 23 bp, Homo sapiens
ctgggaatgtattattctgcagc

SEQ ID NO: 3782596 - DNA, 14 bp, Homo sapiens
ctgggactggccag

SEQ ID NO: 3782597 - DNA, 23 bp, Homo sapiens
ctgggagaggcagagtgccccac

SEQ ID NO: 3782598 - DNA, 13 bp, Homo sapiens
ctgggaggaaaag

SEQ ID NO: 3782599 - DNA, 14 bp, Homo sapiens
ctgggaggaagcag

SEQ ID NO: 3782600 - DNA, 13 bp, Homo sapiens
ctgggagggccca

SEQ ID NO: 3782601 - DNA, 20 bp, Homo sapiens
ctgggagggcccacttcagg

SEQ ID NO: 3782602 - DNA, 13 bp, Homo sapiens
ctgggagtgagct

SEQ ID NO: 3782603 - DNA, 15 bp, Homo sapiens
ctgggatagaggggt

SEQ ID NO: 3782604 - DNA, 13 bp, Homo sapiens
ctgggatcctaag

SEQ ID NO: 3782605 - DNA, 17 bp, Homo sapiens
ctgggatctgactgcac

SEQ ID NO: 3782606 - DNA, 14 bp, Homo sapiens
ctgggatgtttctg

SEQ ID NO: 3782607 - DNA, 20 bp, Homo sapiens
ctgggattacaggtgtgaac

SEQ ID NO: 3782608 - DNA, 16 bp, Homo sapiens
ctgggcacctggggag

SEQ ID NO: 3782609 - DNA, 13 bp, Homo sapiens
ctgggcagaaggc

SEQ ID NO: 3782610 - DNA, 17 bp, Homo sapiens
ctgggcagaaggccaag

SEQ ID NO: 3782611 - DNA, 13 bp, Homo sapiens
ctgggcagacctt

SEQ ID NO: 3782612 - DNA, 15 bp, Homo sapiens
ctgggcagccaggct

SEQ ID NO: 3782613 - DNA, 14 bp, Homo sapiens
ctgggcccagaggc

SEQ ID NO: 3782614 - DNA, 24 bp, Homo sapiens
ctgggccccaaacgggctgccctg

SEQ ID NO: 3782615 - DNA, 13 bp, Homo sapiens
ctgggccccacca

SEQ ID NO: 3782616 - DNA, 16 bp, Homo sapiens
ctgggccccaccacct

SEQ ID NO: 3782617 - DNA, 16 bp, Homo sapiens
ctgggcccctccctac

SEQ ID NO: 3782618 - DNA, 22 bp, Homo sapiens
ctgggcccctccctacctcaac

SEQ ID NO: 3782619 - DNA, 23 bp, Homo sapiens
ctgggcgtagtggctcacacctg

SEQ ID NO: 3782620 - DNA, 17 bp, Homo sapiens
ctgggctcaagcagtct

SEQ ID NO: 3782621 - DNA, 14 bp, Homo sapiens
ctgggctctccacc

SEQ ID NO: 3782622 - DNA, 20 bp, Homo sapiens
ctgggctctccacctcagcc

SEQ ID NO: 3782623 - DNA, 21 bp, Homo sapiens
ctgggctctccacctcagcct

SEQ ID NO: 3782624 - DNA, 17 bp, Homo sapiens
ctgggctctgccccagc

SEQ ID NO: 3782625 - DNA, 18 bp, Homo sapiens
ctgggctctgccccagct

SEQ ID NO: 3782626 - DNA, 23 bp, Homo sapiens
ctgggctctgccccagctctggc

SEQ ID NO: 3782627 - DNA, 13 bp, Homo sapiens
ctgggctgagaga

SEQ ID NO: 3782628 - DNA, 17 bp, Homo sapiens
ctgggctgccatgtgaa

SEQ ID NO: 3782629 - DNA, 20 bp, Homo sapiens
ctgggcttcagtggcagctg

SEQ ID NO: 3782630 - DNA, 17 bp, Homo sapiens
ctggggagtgggacaga

SEQ ID NO: 3782631 - DNA, 15 bp, Homo sapiens
ctggggccccaccgt

SEQ ID NO: 3782632 - DNA, 12 bp, Homo sapiens
ctggggcccctt

SEQ ID NO: 3782633 - DNA, 15 bp, Homo sapiens
ctggggctctgggat

SEQ ID NO: 3782634 - DNA, 17 bp, Homo sapiens
ctggggctctgtgcagg

SEQ ID NO: 3782635 - DNA, 20 bp, Homo sapiens
ctggggctgatctcagggaa

SEQ ID NO: 3782636 - DNA, 23 bp, Homo sapiens
ctggggctgatctcagggaagcc

SEQ ID NO: 3782637 - DNA, 16 bp, Homo sapiens
ctgggggccatgagct

SEQ ID NO: 3782638 - DNA, 17 bp, Homo sapiens
ctgggggccatgagctc

SEQ ID NO: 3782639 - DNA, 23 bp, Homo sapiens
ctgggggccatgagctccagacc

SEQ ID NO: 3782640 - DNA, 14 bp, Homo sapiens
ctgggggcctcact

SEQ ID NO: 3782641 - DNA, 18 bp, Homo sapiens
ctgggggcctcagtgcca

SEQ ID NO: 3782642 - DNA, 16 bp, Homo sapiens
ctgggggcctgacctc

SEQ ID NO: 3782643 - DNA, 16 bp, Homo sapiens
ctgggggtcaggaggc

SEQ ID NO: 3782644 - DNA, 23 bp, Homo sapiens
ctgggggttctttcttcctctgc

SEQ ID NO: 3782645 - DNA, 15 bp, Homo sapiens
ctggggtcctggggc

SEQ ID NO: 3782646 - DNA, 18 bp, Homo sapiens
ctggggtcctggggcctc

SEQ ID NO: 3782647 - DNA, 14 bp, Homo sapiens
ctggggtgccctcc

SEQ ID NO: 3782648 - DNA, 16 bp, Homo sapiens
ctggggtgtgggaggc

SEQ ID NO: 3782649 - DNA, 15 bp, Homo sapiens
ctggggttcagcccc

SEQ ID NO: 3782650 - DNA, 19 bp, Homo sapiens
ctggggttcagcccctcct

SEQ ID NO: 3782651 - DNA, 22 bp, Homo sapiens
ctggggttcagcccctcctctg

SEQ ID NO: 3782652 - DNA, 23 bp, Homo sapiens
ctgggtacttgtggacacagctc

SEQ ID NO: 3782653 - DNA, 21 bp, Homo sapiens
ctgggtccaggggatgggagg

SEQ ID NO: 3782654 - DNA, 17 bp, Homo sapiens
ctgggtctgtgtctctt

SEQ ID NO: 3782655 - DNA, 23 bp, Homo sapiens
ctgggtgacagagcaagactctg

SEQ ID NO: 3782656 - DNA, 15 bp, Homo sapiens
cttcaccctggagcc

SEQ ID NO: 3782657 - DNA, 18 bp, Homo sapiens
cttcacctaagtctctgt

SEQ ID NO: 3782658 - DNA, 19 bp, Homo sapiens
cttcacctaagtctctgtg

SEQ ID NO: 3782659 - DNA, 20 bp, Homo sapiens
cttcacctaagtctctgtga

SEQ ID NO: 3782660 - DNA, 15 bp, Homo sapiens
cttcacggaagagcc

SEQ ID NO: 3782661 - DNA, 19 bp, Homo sapiens
cttcactccggtgtgcctg

SEQ ID NO: 3782662 - DNA, 17 bp, Homo sapiens
cttcactcgcccccggg

SEQ ID NO: 3782663 - DNA, 14 bp, Homo sapiens
cttcagagagctgg

SEQ ID NO: 3782664 - DNA, 15 bp, Homo sapiens
cttcagagagctggt

SEQ ID NO: 3782665 - DNA, 21 bp, Homo sapiens
cttcagcctagccgacctcag

SEQ ID NO: 3782666 - DNA, 16 bp, Homo sapiens
cttcagcctcccgagt

SEQ ID NO: 3782667 - DNA, 14 bp, Homo sapiens
cttcagcctgaggc

SEQ ID NO: 3782668 - DNA, 15 bp, Homo sapiens
cttcagcctgaggct

SEQ ID NO: 3782669 - DNA, 19 bp, Homo sapiens
cttcagctgacttttctgt

SEQ ID NO: 3782670 - DNA, 14 bp, Homo sapiens
cttcagcttgcttc

SEQ ID NO: 3782671 - DNA, 12 bp, Homo sapiens
cttcaggcctcc

SEQ ID NO: 3782672 - DNA, 15 bp, Homo sapiens
cttcaggcctccctc

SEQ ID NO: 3782673 - DNA, 14 bp, Homo sapiens
cttcaggctcttct

SEQ ID NO: 3782674 - DNA, 19 bp, Homo sapiens
cttcaggctcttctccttt

SEQ ID NO: 3782675 - DNA, 19 bp, Homo sapiens
cttcagggcactgctgctg

SEQ ID NO: 3782676 - DNA, 18 bp, Homo sapiens
cttcagggcagggctctg

SEQ ID NO: 3782677 - DNA, 22 bp, Homo sapiens
cttcaggggagtcccgtcagga

SEQ ID NO: 3782678 - DNA, 23 bp, Homo sapiens
cttcaggggagtcccgtcaggac

SEQ ID NO: 3782679 - DNA, 14 bp, Homo sapiens
cttcagggggccag

SEQ ID NO: 3782680 - DNA, 15 bp, Homo sapiens
cttcagggggccagg

SEQ ID NO: 3782681 - DNA, 14 bp, Homo sapiens
cttcagggttctcc

SEQ ID NO: 3782682 - DNA, 20 bp, Homo sapiens
cttcagggttctcctctccc

SEQ ID NO: 3782683 - DNA, 18 bp, Homo sapiens
cttcaggtcaggagttcg

SEQ ID NO: 3782684 - DNA, 19 bp, Homo sapiens
cttcaggttcttagtgtca

SEQ ID NO: 3782685 - DNA, 15 bp, Homo sapiens
cttcagtgcccacca

SEQ ID NO: 3782686 - DNA, 17 bp, Homo sapiens
cttcagtggcagctgct

SEQ ID NO: 3782687 - DNA, 18 bp, Homo sapiens
cttcagtgggagaaaaca

SEQ ID NO: 3782688 - DNA, 20 bp, Homo sapiens
cttcagtgtatggaaataaa

SEQ ID NO: 3782689 - DNA, 20 bp, Homo sapiens
cttcagttggtgtgtttttg

SEQ ID NO: 3782690 - DNA, 15 bp, Homo sapiens
cttcataacaatttt

SEQ ID NO: 3782691 - DNA, 19 bp, Homo sapiens
cttcatcccactccaactc

SEQ ID NO: 3782692 - DNA, 18 bp, Homo sapiens
cttcatgaaaatcctacc

SEQ ID NO: 3782693 - DNA, 19 bp, Homo sapiens
cttcatgaaaatcctacca

SEQ ID NO: 3782694 - DNA, 16 bp, Homo sapiens
cttcatgcctttgtaa

SEQ ID NO: 3782695 - DNA, 19 bp, Homo sapiens
cttcatgcctttgtaagtt

SEQ ID NO: 3782696 - DNA, 21 bp, Homo sapiens
cttcattcaagtcagctcttc

SEQ ID NO: 3782697 - DNA, 21 bp, Homo sapiens
cttcattcttgaaagctgtgg

SEQ ID NO: 3782698 - DNA, 20 bp, Homo sapiens
cttcatttctgatatagaat

SEQ ID NO: 3782699 - DNA, 21 bp, Homo sapiens
cttcatttctgatatagaatt

SEQ ID NO: 3782700 - DNA, 13 bp, Homo sapiens
cttcatttggaga

SEQ ID NO: 3782701 - DNA, 14 bp, Homo sapiens
cttcatttttccta

SEQ ID NO: 3782702 - DNA, 17 bp, Homo sapiens
cttccaactgctgcccc

SEQ ID NO: 3782703 - DNA, 19 bp, Homo sapiens
cttccaactgctgccccaa

SEQ ID NO: 3782704 - DNA, 14 bp, Homo sapiens
cttccaagacctga

SEQ ID NO: 3782705 - DNA, 15 bp, Homo sapiens
cttccaaggagacca

SEQ ID NO: 3782706 - DNA, 18 bp, Homo sapiens
cttccaaggagaccaagt

SEQ ID NO: 3782707 - DNA, 17 bp, Homo sapiens
cttccacaggtctcaga

SEQ ID NO: 3782708 - DNA, 16 bp, Homo sapiens
cttccaccagcctgca

SEQ ID NO: 3782709 - DNA, 21 bp, Homo sapiens
cttccaccagcctgcactact

SEQ ID NO: 3782710 - DNA, 20 bp, Homo sapiens
cttccacgctgtctccagac

SEQ ID NO: 3782711 - DNA, 19 bp, Homo sapiens
cttccacgtactgcagcct

SEQ ID NO: 3782712 - DNA, 20 bp, Homo sapiens
cttccacgtactgcagcctc

SEQ ID NO: 3782713 - DNA, 15 bp, Homo sapiens
cttccagcaccctgc

SEQ ID NO: 3782714 - DNA, 16 bp, Homo sapiens
cttccagcaccctgca

SEQ ID NO: 3782715 - DNA, 14 bp, Homo sapiens
cttccaggccatca

SEQ ID NO: 3782716 - DNA, 23 bp, Homo sapiens
cttccataatgtataaagaacaa

SEQ ID NO: 3782717 - DNA, 11 bp, Homo sapiens
cttccataatt

SEQ ID NO: 3782718 - DNA, 12 bp, Homo sapiens
cttccatagtga

SEQ ID NO: 3782719 - DNA, 15 bp, Homo sapiens
cttccatctcgccac

SEQ ID NO: 3782720 - DNA, 16 bp, Homo sapiens
cttccatgtcgcctct

SEQ ID NO: 3782721 - DNA, 15 bp, Homo sapiens
cttcccagctctccc

SEQ ID NO: 3782722 - DNA, 12 bp, Homo sapiens
cttcccagctgc

SEQ ID NO: 3782723 - DNA, 22 bp, Homo sapiens
cttcccagttcaggagtcccaa

SEQ ID NO: 3782724 - DNA, 23 bp, Homo sapiens
cttcccagttcaggagtcccaag

SEQ ID NO: 3782725 - DNA, 16 bp, Homo sapiens
cttcccatcactggag

SEQ ID NO: 3782726 - DNA, 17 bp, Homo sapiens
cttcccatcactggagc

SEQ ID NO: 3782727 - DNA, 11 bp, Homo sapiens
cttccccactg

SEQ ID NO: 3782728 - DNA, 16 bp, Homo sapiens
cttccccactgcctgc

SEQ ID NO: 3782729 - DNA, 20 bp, Homo sapiens
cttccccactgcctgcccac

SEQ ID NO: 3782730 - DNA, 13 bp, Homo sapiens
cttccccagcctc

SEQ ID NO: 3782731 - DNA, 18 bp, Homo sapiens
cttcccccatagccaccc

SEQ ID NO: 3782732 - DNA, 15 bp, Homo sapiens
cttccccctccaatc

SEQ ID NO: 3782733 - DNA, 16 bp, Homo sapiens
cttccccctctcccag

SEQ ID NO: 3782734 - DNA, 17 bp, Homo sapiens
cttccccctctcccagt

SEQ ID NO: 3782735 - DNA, 14 bp, Homo sapiens
cttcccctccctgg

SEQ ID NO: 3782736 - DNA, 13 bp, Homo sapiens
cttcccctttccc

SEQ ID NO: 3782737 - DNA, 18 bp, Homo sapiens
cttcccgctcagccctcc

SEQ ID NO: 3782738 - DNA, 23 bp, Homo sapiens
cttcccgctcagccctccctgcc

SEQ ID NO: 3782739 - DNA, 18 bp, Homo sapiens
cttccctagggctgggtg

SEQ ID NO: 3782740 - DNA, 19 bp, Homo sapiens
cttccctagggctgggtgt

SEQ ID NO: 3782741 - DNA, 16 bp, Homo sapiens
cttccctctccccaag

SEQ ID NO: 3782742 - DNA, 13 bp, Homo sapiens
cttccctctgcct

SEQ ID NO: 3782743 - DNA, 16 bp, Homo sapiens
cttcccttaaaattta

SEQ ID NO: 3782744 - DNA, 20 bp, Homo sapiens
cttcccttaaaatttatatg

SEQ ID NO: 3782745 - DNA, 15 bp, Homo sapiens
cttcccttgagccct

SEQ ID NO: 3782746 - DNA, 16 bp, Homo sapiens
cttcccttgagccctc

SEQ ID NO: 3782747 - DNA, 18 bp, Homo sapiens
cttcctacaagagcagcc

SEQ ID NO: 3782748 - DNA, 22 bp, Homo sapiens
cttcctagttttctcctcccag

SEQ ID NO: 3782749 - DNA, 14 bp, Homo sapiens
cttcctatcccatc

SEQ ID NO: 3782750 - DNA, 15 bp, Homo sapiens
cttcctcaccctgat

SEQ ID NO: 3782751 - DNA, 22 bp, Homo sapiens
cttcctctcatccttttctcct

SEQ ID NO: 3782752 - DNA, 21 bp, Homo sapiens
cttcctctccactgccttcga

SEQ ID NO: 3782753 - DNA, 12 bp, Homo sapiens
cttcctctgctg

SEQ ID NO: 3782754 - DNA, 13 bp, Homo sapiens
cttcctctgctga

SEQ ID NO: 3782755 - DNA, 17 bp, Homo sapiens
cttcctgccacctgctg

SEQ ID NO: 3782756 - DNA, 20 bp, Homo sapiens
cttcctggggcatctggcga

SEQ ID NO: 3782757 - DNA, 14 bp, Homo sapiens
cttcctgtccgccc

SEQ ID NO: 3782758 - DNA, 17 bp, Homo sapiens
cttccttgctgtcctag

SEQ ID NO: 3782759 - DNA, 20 bp, Homo sapiens
cttccttgctgtcctaggcc

SEQ ID NO: 3782760 - DNA, 19 bp, Homo sapiens
cttccttggcatcacaggg

SEQ ID NO: 3782761 - DNA, 13 bp, Homo sapiens
cttcctttcagaa

SEQ ID NO: 3782762 - DNA, 23 bp, Homo sapiens
cttcgaggtggatcacagaggct

SEQ ID NO: 3782763 - DNA, 13 bp, Homo sapiens
cttcgctcctgtg

SEQ ID NO: 3782764 - DNA, 17 bp, Homo sapiens
cttcgctcctgtgtctt

SEQ ID NO: 3782765 - DNA, 18 bp, Homo sapiens
cttcggggaactcctgga

SEQ ID NO: 3782766 - DNA, 17 bp, Homo sapiens
cttcgttaactgtgtat

SEQ ID NO: 3782767 - DNA, 13 bp, Homo sapiens
cttcgttttggtt

SEQ ID NO: 3782768 - DNA, 16 bp, Homo sapiens
cttctaattgccatgt

SEQ ID NO: 3782769 - DNA, 13 bp, Homo sapiens
cttctacactctc

SEQ ID NO: 3782770 - DNA, 15 bp, Homo sapiens
gaagaaatgaaattt

SEQ ID NO: 3782771 - DNA, 16 bp, Homo sapiens
gaagaaatgaaatttt

SEQ ID NO: 3782772 - DNA, 23 bp, Homo sapiens
gaagaaatgaaattttaccaagt

SEQ ID NO: 3782773 - DNA, 13 bp, Homo sapiens
gaagaacatagaa

SEQ ID NO: 3782774 - DNA, 20 bp, Homo sapiens
gaagaatattgttcctaagt

SEQ ID NO: 3782775 - DNA, 19 bp, Homo sapiens
gaagaattgaacccaggag

SEQ ID NO: 3782776 - DNA, 20 bp, Homo sapiens
gaagacaaaaatactctaat

SEQ ID NO: 3782777 - DNA, 16 bp, Homo sapiens
gaagacactgatgggc

SEQ ID NO: 3782778 - DNA, 15 bp, Homo sapiens
gaagacaggacagtg

SEQ ID NO: 3782779 - DNA, 22 bp, Homo sapiens
gaagacatggggaggaaggaca

SEQ ID NO: 3782780 - DNA, 16 bp, Homo sapiens
gaagactcattcttct

SEQ ID NO: 3782781 - DNA, 17 bp, Homo sapiens
gaagactcattcttctg

SEQ ID NO: 3782782 - DNA, 21 bp, Homo sapiens
gaagactcattcttctgtacg

SEQ ID NO: 3782783 - DNA, 12 bp, Homo sapiens
gaagactgtggc

SEQ ID NO: 3782784 - DNA, 18 bp, Homo sapiens
gaagagcaggcacatgga

SEQ ID NO: 3782785 - DNA, 14 bp, Homo sapiens
gaagagtgagaggg

SEQ ID NO: 3782786 - DNA, 13 bp, Homo sapiens
gaagataggctct

SEQ ID NO: 3782787 - DNA, 15 bp, Homo sapiens
gaagataggctctgc

SEQ ID NO: 3782788 - DNA, 18 bp, Homo sapiens
gaagataggctctgcaca

SEQ ID NO: 3782789 - DNA, 20 bp, Homo sapiens
gaagataggctctgcacaga

SEQ ID NO: 3782790 - DNA, 18 bp, Homo sapiens
gaagatcgttagtatcta

SEQ ID NO: 3782791 - DNA, 21 bp, Homo sapiens
gaagcaaaaacgaaagctggg

SEQ ID NO: 3782792 - DNA, 16 bp, Homo sapiens
gaagcaacgaagggaa

SEQ ID NO: 3782793 - DNA, 16 bp, Homo sapiens
gaagcaccataacttt

SEQ ID NO: 3782794 - DNA, 16 bp, Homo sapiens
gaagcaccccatgcca

SEQ ID NO: 3782795 - DNA, 19 bp, Homo sapiens
gaagcacgtggtaaaacac

SEQ ID NO: 3782796 - DNA, 23 bp, Homo sapiens
gaagcagatgcaaagaggcaaga

SEQ ID NO: 3782797 - DNA, 15 bp, Homo sapiens
gaagcagtgagccgc

SEQ ID NO: 3782798 - DNA, 18 bp, Homo sapiens
gaagcagtgccttccata

SEQ ID NO: 3782799 - DNA, 19 bp, Homo sapiens
gaagcagtgccttccataa

SEQ ID NO: 3782800 - DNA, 17 bp, Homo sapiens
gaagcatttactttgtg

SEQ ID NO: 3782801 - DNA, 12 bp, Homo sapiens
gaagccaccctc

SEQ ID NO: 3782802 - DNA, 17 bp, Homo sapiens
gaagccaccctcccagc

SEQ ID NO: 3782803 - DNA, 18 bp, Homo sapiens
gaagccaccctcccagct

SEQ ID NO: 3782804 - DNA, 20 bp, Homo sapiens
gaagccaccctcccagctct

SEQ ID NO: 3782805 - DNA, 22 bp, Homo sapiens
gaagccaccctcccagctctga

SEQ ID NO: 3782806 - DNA, 18 bp, Homo sapiens
gaagccactgaagctggg

SEQ ID NO: 3782807 - DNA, 13 bp, Homo sapiens
gaagcccagctcc

SEQ ID NO: 3782808 - DNA, 14 bp, Homo sapiens
gaagccctccttcc

SEQ ID NO: 3782809 - DNA, 15 bp, Homo sapiens
gaagccctccttcca

SEQ ID NO: 3782810 - DNA, 18 bp, Homo sapiens
gaagccctggatttcaga

SEQ ID NO: 3782811 - DNA, 16 bp, Homo sapiens
gaagccgtgccctgcc

SEQ ID NO: 3782812 - DNA, 12 bp, Homo sapiens
gaagcctctggc

SEQ ID NO: 3782813 - DNA, 14 bp, Homo sapiens
gaagcctctggcta

SEQ ID NO: 3782814 - DNA, 15 bp, Homo sapiens
gaagcctgcaggagt

SEQ ID NO: 3782815 - DNA, 16 bp, Homo sapiens
gaagcgagcactgacc

SEQ ID NO: 3782816 - DNA, 13 bp, Homo sapiens
gaagcgtatgttt

SEQ ID NO: 3782817 - DNA, 14 bp, Homo sapiens
gaagcgtatgtttt

SEQ ID NO: 3782818 - DNA, 13 bp, Homo sapiens
gaagctaattatt

SEQ ID NO: 3782819 - DNA, 13 bp, Homo sapiens
gaagctcagccca

SEQ ID NO: 3782820 - DNA, 14 bp, Homo sapiens
gaagctcagcccac

SEQ ID NO: 3782821 - DNA, 19 bp, Homo sapiens
gaagctcagcccacccccc

SEQ ID NO: 3782822 - DNA, 19 bp, Homo sapiens
gaagctccgctttctaccc

SEQ ID NO: 3782823 - DNA, 15 bp, Homo sapiens
gaagctctgaagtca

SEQ ID NO: 3782824 - DNA, 19 bp, Homo sapiens
gaagctgagcaccagggga

SEQ ID NO: 3782825 - DNA, 17 bp, Homo sapiens
gaagctggccgagggtc

SEQ ID NO: 3782826 - DNA, 17 bp, Homo sapiens
gaagcttattaatgcta

SEQ ID NO: 3782827 - DNA, 19 bp, Homo sapiens
gaaggaaagaaagaaggaa

SEQ ID NO: 3782828 - DNA, 23 bp, Homo sapiens
gaaggaaataaaaaagtctctat

SEQ ID NO: 3782829 - DNA, 13 bp, Homo sapiens
gaaggaagacttt

SEQ ID NO: 3782830 - DNA, 19 bp, Homo sapiens
gaaggacattgcggacagc

SEQ ID NO: 3782831 - DNA, 20 bp, Homo sapiens
gaaggacattgcggacagcc

SEQ ID NO: 3782832 - DNA, 22 bp, Homo sapiens
gaaggacccggaggggcctggc

SEQ ID NO: 3782833 - DNA, 15 bp, Homo sapiens
gaaggacctcctgag

SEQ ID NO: 3782834 - DNA, 20 bp, Homo sapiens
gaaggactggattggccaaa

SEQ ID NO: 3782835 - DNA, 18 bp, Homo sapiens
gaaggagacagagctggt

SEQ ID NO: 3782836 - DNA, 22 bp, Homo sapiens
gaaggagactcacctctgcctc

SEQ ID NO: 3782837 - DNA, 13 bp, Homo sapiens
gaaggagagcctg

SEQ ID NO: 3782838 - DNA, 15 bp, Homo sapiens
gaaggagagcctgct

SEQ ID NO: 3782839 - DNA, 18 bp, Homo sapiens
gaaggaggaggaggaggt

SEQ ID NO: 3782840 - DNA, 22 bp, Homo sapiens
gaaggatctgtttttaaaaatc

SEQ ID NO: 3782841 - DNA, 14 bp, Homo sapiens
gaaggatgagcatt

SEQ ID NO: 3782842 - DNA, 17 bp, Homo sapiens
gaaggcagcaggtggca

SEQ ID NO: 3782843 - DNA, 13 bp, Homo sapiens
gaaggcagggaaa

SEQ ID NO: 3782844 - DNA, 16 bp, Homo sapiens
gaaggccacctgcagg

SEQ ID NO: 3782845 - DNA, 17 bp, Homo sapiens
gaaggccacctgcaggt

SEQ ID NO: 3782846 - DNA, 13 bp, Homo sapiens
gaaggctggctgg

SEQ ID NO: 3782847 - DNA, 18 bp, Homo sapiens
gaaggctggggctattta

SEQ ID NO: 3782848 - DNA, 22 bp, Homo sapiens
gaagggcaggaaggagagcctg

SEQ ID NO: 3782849 - DNA, 18 bp, Homo sapiens
gaagggcatcatgcatct

SEQ ID NO: 3782850 - DNA, 20 bp, Homo sapiens
gaagggccagtcctgcctgg

SEQ ID NO: 3782851 - DNA, 17 bp, Homo sapiens
gaaggggaggagggcgg

SEQ ID NO: 3782852 - DNA, 19 bp, Homo sapiens
gaaggggctggactggctg

SEQ ID NO: 3782853 - DNA, 20 bp, Homo sapiens
gaagggggccatgaggcctc

SEQ ID NO: 3782854 - DNA, 22 bp, Homo sapiens
gaagggggccatgaggcctcag

SEQ ID NO: 3782855 - DNA, 18 bp, Homo sapiens
gaaggggggttgcagtgg

SEQ ID NO: 3782856 - DNA, 23 bp, Homo sapiens
gaaggggggttgcagtggagagg

SEQ ID NO: 3782857 - DNA, 20 bp, Homo sapiens
gaagggggtcaaagcaagga

SEQ ID NO: 3782858 - DNA, 14 bp, Homo sapiens
gaagggtccttccc

SEQ ID NO: 3782859 - DNA, 15 bp, Homo sapiens
gaagggtttgtggct

SEQ ID NO: 3782860 - DNA, 13 bp, Homo sapiens
gaaggtcttgatt

SEQ ID NO: 3782861 - DNA, 16 bp, Homo sapiens
gaaggtttgtatattg

SEQ ID NO: 3782862 - DNA, 17 bp, Homo sapiens
gaagtaacttgtcttaa

SEQ ID NO: 3782863 - DNA, 13 bp, Homo sapiens
gaagtaatgaatt

SEQ ID NO: 3782864 - DNA, 19 bp, Homo sapiens
gaagtcatgaagcccaagt

SEQ ID NO: 3782865 - DNA, 16 bp, Homo sapiens
gaagtccccaggcccc

SEQ ID NO: 3782866 - DNA, 16 bp, Homo sapiens
gaagtctaggagctgg

SEQ ID NO: 3782867 - DNA, 21 bp, Homo sapiens
gaagtgaaatctgtgcaataa

SEQ ID NO: 3782868 - DNA, 18 bp, Homo sapiens
gaagtgacaaggccccag

SEQ ID NO: 3782869 - DNA, 23 bp, Homo sapiens
gaagtgacaaggccccagagact

SEQ ID NO: 3782870 - DNA, 18 bp, Homo sapiens
gaagtgcaaatttgatac

SEQ ID NO: 3782871 - DNA, 14 bp, Homo sapiens
gaagtgcccctgct

SEQ ID NO: 3782872 - DNA, 23 bp, Homo sapiens
gaagtgcccctgctgcctcccca

SEQ ID NO: 3782873 - DNA, 15 bp, Homo sapiens
gaagtgtaacagctg

SEQ ID NO: 3782874 - DNA, 23 bp, Homo sapiens
gaagtgtaacagctgaggtctct

SEQ ID NO: 3782875 - DNA, 18 bp, Homo sapiens
gaagttactgttatagag

SEQ ID NO: 3782876 - DNA, 23 bp, Homo sapiens
gaagttggacagcaaaaccattg

SEQ ID NO: 3782877 - DNA, 22 bp, Homo sapiens
gaagttggagtgagtgtggctc

SEQ ID NO: 3782878 - DNA, 14 bp, Homo sapiens
gaataaagttgaag

SEQ ID NO: 3782879 - DNA, 16 bp, Homo sapiens
gaataaagttgaagct

SEQ ID NO: 3782880 - DNA, 15 bp, Homo sapiens
gaataaattgctcct

SEQ ID NO: 3782881 - DNA, 14 bp, Homo sapiens
gaataacatgtaat

SEQ ID NO: 3782882 - DNA, 18 bp, Homo sapiens
gaataacatgtaattaag

SEQ ID NO: 3782883 - DNA, 20 bp, Homo sapiens
gagatggaagttgcagtgag

SEQ ID NO: 3782884 - DNA, 12 bp, Homo sapiens
gagatggaggag

SEQ ID NO: 3782885 - DNA, 16 bp, Homo sapiens
gagatggaggaggagg

SEQ ID NO: 3782886 - DNA, 14 bp, Homo sapiens
gagatggggtgggg

SEQ ID NO: 3782887 - DNA, 15 bp, Homo sapiens
gagattatgttcttt

SEQ ID NO: 3782888 - DNA, 14 bp, Homo sapiens
gagattcagactgt

SEQ ID NO: 3782889 - DNA, 18 bp, Homo sapiens
gagattgcaccactgcac

SEQ ID NO: 3782890 - DNA, 14 bp, Homo sapiens
gagcaaacctgccc

SEQ ID NO: 3782891 - DNA, 22 bp, Homo sapiens
gagcaaaggggtcccatagagg

SEQ ID NO: 3782892 - DNA, 20 bp, Homo sapiens
gagcaaagtgaagacactgg

SEQ ID NO: 3782893 - DNA, 12 bp, Homo sapiens
gagcaagactct

SEQ ID NO: 3782894 - DNA, 14 bp, Homo sapiens
gagcaagactctgt

SEQ ID NO: 3782895 - DNA, 20 bp, Homo sapiens
gagcaagcatttatgtttat

SEQ ID NO: 3782896 - DNA, 12 bp, Homo sapiens
gagcacctccca

SEQ ID NO: 3782897 - DNA, 13 bp, Homo sapiens
gagcactgggttg

SEQ ID NO: 3782898 - DNA, 19 bp, Homo sapiens
gagcagactggtgagcaga

SEQ ID NO: 3782899 - DNA, 20 bp, Homo sapiens
gagcagactggtgagcagac

SEQ ID NO: 3782900 - DNA, 12 bp, Homo sapiens
gagcagagacac

SEQ ID NO: 3782901 - DNA, 24 bp, Homo sapiens
gagcagagacatgactcagcctgt

SEQ ID NO: 3782902 - DNA, 11 bp, Homo sapiens
gagcagcctgt

SEQ ID NO: 3782903 - DNA, 13 bp, Homo sapiens
gagcagcctgtgg

SEQ ID NO: 3782904 - DNA, 14 bp, Homo sapiens
gagcagcctgtggc

SEQ ID NO: 3782905 - DNA, 20 bp, Homo sapiens
gagcagggacagatcataga

SEQ ID NO: 3782906 - DNA, 13 bp, Homo sapiens
gagcaggggcagg

SEQ ID NO: 3782907 - DNA, 16 bp, Homo sapiens
gagcaggggcagggtg

SEQ ID NO: 3782908 - DNA, 16 bp, Homo sapiens
gagcagtcctgcctca

SEQ ID NO: 3782909 - DNA, 18 bp, Homo sapiens
gagcagtgtcttccataa

SEQ ID NO: 3782910 - DNA, 16 bp, Homo sapiens
gagcagtgtgtctcct

SEQ ID NO: 3782911 - DNA, 18 bp, Homo sapiens
gagcatctcttgaggcca

SEQ ID NO: 3782912 - DNA, 22 bp, Homo sapiens
gagcatctcttgaggccaggag

SEQ ID NO: 3782913 - DNA, 23 bp, Homo sapiens
gagcatctcttgaggccaggagt

SEQ ID NO: 3782914 - DNA, 21 bp, Homo sapiens
gagcatggggataaaggagaa

SEQ ID NO: 3782915 - DNA, 20 bp, Homo sapiens
gagccaacagaagcttccat

SEQ ID NO: 3782916 - DNA, 23 bp, Homo sapiens
gagccaagggttcagagactcag

SEQ ID NO: 3782917 - DNA, 15 bp, Homo sapiens
gagccaccgctgcca

SEQ ID NO: 3782918 - DNA, 20 bp, Homo sapiens
gagccacctgtcccacctca

SEQ ID NO: 3782919 - DNA, 12 bp, Homo sapiens
gagccagccctc

SEQ ID NO: 3782920 - DNA, 14 bp, Homo sapiens
gagccagccctccc

SEQ ID NO: 3782921 - DNA, 20 bp, Homo sapiens
gagccagccctccctgtcct

SEQ ID NO: 3782922 - DNA, 21 bp, Homo sapiens
gagccagccctccctgtcctc

SEQ ID NO: 3782923 - DNA, 23 bp, Homo sapiens
gagccagtggaacagcgggagac

SEQ ID NO: 3782924 - DNA, 15 bp, Homo sapiens
gagcccaccttggct

SEQ ID NO: 3782925 - DNA, 22 bp, Homo sapiens
gagcccagccattaccatggag

SEQ ID NO: 3782926 - DNA, 17 bp, Homo sapiens
gagcccagccctgttct

SEQ ID NO: 3782927 - DNA, 19 bp, Homo sapiens
gagccccactgcccttctc

SEQ ID NO: 3782928 - DNA, 23 bp, Homo sapiens
gagcccgcacccccaccctttgg

SEQ ID NO: 3782929 - DNA, 18 bp, Homo sapiens
gagccctggtggcagtgg

SEQ ID NO: 3782930 - DNA, 22 bp, Homo sapiens
gagccgagatcacgccactgca

SEQ ID NO: 3782931 - DNA, 19 bp, Homo sapiens
gagcctcagcatcctggca

SEQ ID NO: 3782932 - DNA, 20 bp, Homo sapiens
gagcctcagcatcctggcac

SEQ ID NO: 3782933 - DNA, 21 bp, Homo sapiens
gagcctcagcatcctggcacc

SEQ ID NO: 3782934 - DNA, 20 bp, Homo sapiens
gagcctcatccgaggcaggg

SEQ ID NO: 3782935 - DNA, 15 bp, Homo sapiens
gagcctgcagttatt

SEQ ID NO: 3782936 - DNA, 19 bp, Homo sapiens
gagcctgcggcctgctgga

SEQ ID NO: 3782937 - DNA, 13 bp, Homo sapiens
gagcctgctcccc

SEQ ID NO: 3782938 - DNA, 21 bp, Homo sapiens
gagcctgggaggtcaaggctg

SEQ ID NO: 3782939 - DNA, 22 bp, Homo sapiens
gagccttggtgtccacctggcc

SEQ ID NO: 3782940 - DNA, 16 bp, Homo sapiens
gagcgcatcaggcctg

SEQ ID NO: 3782941 - DNA, 18 bp, Homo sapiens
gagcgcctgcccctccca

SEQ ID NO: 3782942 - DNA, 16 bp, Homo sapiens
gagcggaaagcagctc

SEQ ID NO: 3782943 - DNA, 14 bp, Homo sapiens
gagctaacactggc

SEQ ID NO: 3782944 - DNA, 19 bp, Homo sapiens
gagctaacactggccccta

SEQ ID NO: 3782945 - DNA, 23 bp, Homo sapiens
gagctatatttaagtattcaaga

SEQ ID NO: 3782946 - DNA, 18 bp, Homo sapiens
gagctcagacccccactc

SEQ ID NO: 3782947 - DNA, 20 bp, Homo sapiens
gagctcagacccccactctc

SEQ ID NO: 3782948 - DNA, 14 bp, Homo sapiens
gagctcaggacact

SEQ ID NO: 3782949 - DNA, 17 bp, Homo sapiens
gagctcaggacactaat

SEQ ID NO: 3782950 - DNA, 15 bp, Homo sapiens
gagctccagaccccc

SEQ ID NO: 3782951 - DNA, 19 bp, Homo sapiens
gagctccagacccccagca

SEQ ID NO: 3782952 - DNA, 20 bp, Homo sapiens
gagctccagacccccagcaa

SEQ ID NO: 3782953 - DNA, 22 bp, Homo sapiens
gagctccagacccccagcaacc

SEQ ID NO: 3782954 - DNA, 20 bp, Homo sapiens
gagctccccaccaccccagc

SEQ ID NO: 3782955 - DNA, 18 bp, Homo sapiens
gagctcctctgggcagga

SEQ ID NO: 3782956 - DNA, 15 bp, Homo sapiens
gagctcggtggaccc

SEQ ID NO: 3782957 - DNA, 16 bp, Homo sapiens
gagctctgcagagcag

SEQ ID NO: 3782958 - DNA, 13 bp, Homo sapiens
gagctctggagcc

SEQ ID NO: 3782959 - DNA, 17 bp, Homo sapiens
gagctctggagccacct

SEQ ID NO: 3782960 - DNA, 19 bp, Homo sapiens
gagctctggagccacctgt

SEQ ID NO: 3782961 - DNA, 19 bp, Homo sapiens
gagctcttcaggcctccct

SEQ ID NO: 3782962 - DNA, 15 bp, Homo sapiens
gagctgagaatagaa

SEQ ID NO: 3782963 - DNA, 10 bp, Homo sapiens
gagctgagat

SEQ ID NO: 3782964 - DNA, 16 bp, Homo sapiens
gagctgagcagggaga

SEQ ID NO: 3782965 - DNA, 20 bp, Homo sapiens
gagctgccatccagggatgc

SEQ ID NO: 3782966 - DNA, 19 bp, Homo sapiens
gagctgcctaagaggcaat

SEQ ID NO: 3782967 - DNA, 22 bp, Homo sapiens
gagctgcctgttcagctccagc

SEQ ID NO: 3782968 - DNA, 16 bp, Homo sapiens
gagctgctggcttgca

SEQ ID NO: 3782969 - DNA, 21 bp, Homo sapiens
gagctgctggcttgcagtgcg

SEQ ID NO: 3782970 - DNA, 16 bp, Homo sapiens
gagctgggatcctaag

SEQ ID NO: 3782971 - DNA, 12 bp, Homo sapiens
gagctggggaag

SEQ ID NO: 3782972 - DNA, 18 bp, Homo sapiens
gagctgggggccatgagc

SEQ ID NO: 3782973 - DNA, 24 bp, Homo sapiens
gagctgggggccatgagctccaga

SEQ ID NO: 3782974 - DNA, 18 bp, Homo sapiens
gagctggttgggaagaca

SEQ ID NO: 3782975 - DNA, 19 bp, Homo sapiens
gagctgtttatggcctcag

SEQ ID NO: 3782976 - DNA, 20 bp, Homo sapiens
gagctgtttatggcctcagc

SEQ ID NO: 3782977 - DNA, 16 bp, Homo sapiens
gagcttacctcccacc

SEQ ID NO: 3782978 - DNA, 17 bp, Homo sapiens
gagcttagccaatgtgg

SEQ ID NO: 3782979 - DNA, 22 bp, Homo sapiens
gagcttcaagtctgtgcctgga

SEQ ID NO: 3782980 - DNA, 21 bp, Homo sapiens
gagcttctctttaactcagga

SEQ ID NO: 3782981 - DNA, 14 bp, Homo sapiens
gagcttctggcact

SEQ ID NO: 3782982 - DNA, 15 bp, Homo sapiens
gagcttggccagaag

SEQ ID NO: 3782983 - DNA, 15 bp, Homo sapiens
gagctttcaaagaag

SEQ ID NO: 3782984 - DNA, 22 bp, Homo sapiens
gagctttctgctatcaaagagg

SEQ ID NO: 3782985 - DNA, 14 bp, Homo sapiens
gagctttggacaca

SEQ ID NO: 3782986 - DNA, 21 bp, Homo sapiens
gagctttggacacacacagct

SEQ ID NO: 3782987 - DNA, 18 bp, Homo sapiens
gagctttggacgcacaca

SEQ ID NO: 3782988 - DNA, 23 bp, Homo sapiens
gaggaaaaccaagccgtggcttc

SEQ ID NO: 3782989 - DNA, 14 bp, Homo sapiens
gaggaaactcacct

SEQ ID NO: 3782990 - DNA, 14 bp, Homo sapiens
gaggaaaggccagc

SEQ ID NO: 3782991 - DNA, 15 bp, Homo sapiens
gaggaaccagagcca

SEQ ID NO: 3782992 - DNA, 13 bp, Homo sapiens
gaggaaggggggt

SEQ ID NO: 3782993 - DNA, 17 bp, Homo sapiens
gaggaatgatgaagctt

SEQ ID NO: 3782994 - DNA, 15 bp, Homo sapiens
gaggacaaccattcc

SEQ ID NO: 3782995 - DNA, 20 bp, Homo sapiens
gaggacacctgtactggaga

SEQ ID NO: 3782996 - DNA, 14 bp, Homo sapiens
gcacaaatatttat

SEQ ID NO: 3782997 - DNA, 14 bp, Homo sapiens
gcacaagctgcacc

SEQ ID NO: 3782998 - DNA, 22 bp, Homo sapiens
gcacaagctgcaccctcaggca

SEQ ID NO: 3782999 - DNA, 14 bp, Homo sapiens
gcacaatgtcttgg

SEQ ID NO: 3783000 - DNA, 14 bp, Homo sapiens
gcacacacacacac

SEQ ID NO: 3783001 - DNA, 17 bp, Homo sapiens
gcacacacacacacagg

SEQ ID NO: 3783002 - DNA, 20 bp, Homo sapiens
gcacacaccagagcccacct

SEQ ID NO: 3783003 - DNA, 21 bp, Homo sapiens
gcacacagcttttagtaccca

SEQ ID NO: 3783004 - DNA, 20 bp, Homo sapiens
gcacaccgggcactcagaag

SEQ ID NO: 3783005 - DNA, 17 bp, Homo sapiens
gcacacgtcatgtttct

SEQ ID NO: 3783006 - DNA, 21 bp, Homo sapiens
gcacactcccctgcactggag

SEQ ID NO: 3783007 - DNA, 12 bp, Homo sapiens
gcacactgtagc

SEQ ID NO: 3783008 - DNA, 15 bp, Homo sapiens
gcacagagagggggc

SEQ ID NO: 3783009 - DNA, 17 bp, Homo sapiens
gcacagagagggggcca

SEQ ID NO: 3783010 - DNA, 18 bp, Homo sapiens
gcacagagcgtccttccc

SEQ ID NO: 3783011 - DNA, 19 bp, Homo sapiens
gcacagagcgtccttcccc

SEQ ID NO: 3783012 - DNA, 22 bp, Homo sapiens
gcacagagcgtccttccccctg

SEQ ID NO: 3783013 - DNA, 24 bp, Homo sapiens
gcacagatggatttgcctgtgcca

SEQ ID NO: 3783014 - DNA, 17 bp, Homo sapiens
gcacagcccaaagaagg

SEQ ID NO: 3783015 - DNA, 16 bp, Homo sapiens
gcacagccggggcctg

SEQ ID NO: 3783016 - DNA, 13 bp, Homo sapiens
gcacagtgcatct

SEQ ID NO: 3783017 - DNA, 15 bp, Homo sapiens
gcacagtgcatctca

SEQ ID NO: 3783018 - DNA, 21 bp, Homo sapiens
gcacagtgcatctcagcccac

SEQ ID NO: 3783019 - DNA, 22 bp, Homo sapiens
gcacatggaggagcttggggga

SEQ ID NO: 3783020 - DNA, 19 bp, Homo sapiens
gcacatttccccagacctg

SEQ ID NO: 3783021 - DNA, 22 bp, Homo sapiens
gcacatttttttttttaatttt

SEQ ID NO: 3783022 - DNA, 14 bp, Homo sapiens
gcaccaagcccaca

SEQ ID NO: 3783023 - DNA, 15 bp, Homo sapiens
gcaccaccaggtctc

SEQ ID NO: 3783024 - DNA, 20 bp, Homo sapiens
gcaccaccaggtctcccggg

SEQ ID NO: 3783025 - DNA, 11 bp, Homo sapiens
gcaccacccta

SEQ ID NO: 3783026 - DNA, 14 bp, Homo sapiens
gcaccactctcctt

SEQ ID NO: 3783027 - DNA, 19 bp, Homo sapiens
gcaccactgcactccagcc

SEQ ID NO: 3783028 - DNA, 21 bp, Homo sapiens
gcaccactgcactccagcctg

SEQ ID NO: 3783029 - DNA, 22 bp, Homo sapiens
gcaccactgcactccagcctgg

SEQ ID NO: 3783030 - DNA, 17 bp, Homo sapiens
gcaccagccggggaaga

SEQ ID NO: 3783031 - DNA, 20 bp, Homo sapiens
gcaccaggcacgaacccacc

SEQ ID NO: 3783032 - DNA, 22 bp, Homo sapiens
gcaccattcaggaacctggacc

SEQ ID NO: 3783033 - DNA, 23 bp, Homo sapiens
gcaccattcaggaacctggacca

SEQ ID NO: 3783034 - DNA, 19 bp, Homo sapiens
gcacccacaagtgccactg

SEQ ID NO: 3783035 - DNA, 18 bp, Homo sapiens
gcacccccaccctttggg

SEQ ID NO: 3783036 - DNA, 14 bp, Homo sapiens
gcaccccccaagct

SEQ ID NO: 3783037 - DNA, 21 bp, Homo sapiens
gcacccccctgggctgagaga

SEQ ID NO: 3783038 - DNA, 18 bp, Homo sapiens
gcacccggcccctgctgg

SEQ ID NO: 3783039 - DNA, 19 bp, Homo sapiens
gcaccgccggccagctggg

SEQ ID NO: 3783040 - DNA, 14 bp, Homo sapiens
gcaccgccttctct

SEQ ID NO: 3783041 - DNA, 14 bp, Homo sapiens
gcaccgggccacag

SEQ ID NO: 3783042 - DNA, 21 bp, Homo sapiens
gcacctactacatcgccctcc

SEQ ID NO: 3783043 - DNA, 18 bp, Homo sapiens
gcacctatagtcccagct

SEQ ID NO: 3783044 - DNA, 17 bp, Homo sapiens
gcacctccccccactgc

SEQ ID NO: 3783045 - DNA, 19 bp, Homo sapiens
gcacctccccccactgcag

SEQ ID NO: 3783046 - DNA, 21 bp, Homo sapiens
gcacctccccccactgcaggc

SEQ ID NO: 3783047 - DNA, 23 bp, Homo sapiens
gcacctccccccactgcaggccc

SEQ ID NO: 3783048 - DNA, 14 bp, Homo sapiens
gcacctcctgcctc

SEQ ID NO: 3783049 - DNA, 22 bp, Homo sapiens
gcacctgcatccgtagttccct

SEQ ID NO: 3783050 - DNA, 13 bp, Homo sapiens
gcacctgccagcc

SEQ ID NO: 3783051 - DNA, 22 bp, Homo sapiens
gcacctgccagcctggcttctg

SEQ ID NO: 3783052 - DNA, 19 bp, Homo sapiens
gcacctgtactcaggaggc

SEQ ID NO: 3783053 - DNA, 15 bp, Homo sapiens
gcacgaaatgttatt

SEQ ID NO: 3783054 - DNA, 15 bp, Homo sapiens
gcacgaacccacctg

SEQ ID NO: 3783055 - DNA, 23 bp, Homo sapiens
gcacgaacccacctgctgagaga

SEQ ID NO: 3783056 - DNA, 15 bp, Homo sapiens
gcacgcccatgtgtg

SEQ ID NO: 3783057 - DNA, 12 bp, Homo sapiens
gcacgctgtggg

SEQ ID NO: 3783058 - DNA, 15 bp, Homo sapiens
gcacgtggagagctg

SEQ ID NO: 3783059 - DNA, 20 bp, Homo sapiens
gcacgtggagagctggtgcc

SEQ ID NO: 3783060 - DNA, 23 bp, Homo sapiens
gcacgtgggtcttcagggggcca

SEQ ID NO: 3783061 - DNA, 18 bp, Homo sapiens
gcacgtggtaaaacactt

SEQ ID NO: 3783062 - DNA, 15 bp, Homo sapiens
gcacgtttaaagttc

SEQ ID NO: 3783063 - DNA, 19 bp, Homo sapiens
gcacgtttaaagttctgtg

SEQ ID NO: 3783064 - DNA, 17 bp, Homo sapiens
gcactaaggtgtgctct

SEQ ID NO: 3783065 - DNA, 19 bp, Homo sapiens
gcactaaggtgtgctctga

SEQ ID NO: 3783066 - DNA, 20 bp, Homo sapiens
gcactaaggtgtgctctgat

SEQ ID NO: 3783067 - DNA, 21 bp, Homo sapiens
gcactaattctgcatctgggc

SEQ ID NO: 3783068 - DNA, 19 bp, Homo sapiens
gcactaatttgatgtttac

SEQ ID NO: 3783069 - DNA, 21 bp, Homo sapiens
gcactactccctcaaagcaca

SEQ ID NO: 3783070 - DNA, 22 bp, Homo sapiens
gcactataatgtaagctctact

SEQ ID NO: 3783071 - DNA, 13 bp, Homo sapiens
gcactcacatgct

SEQ ID NO: 3783072 - DNA, 17 bp, Homo sapiens
gcactcagaagacactg

SEQ ID NO: 3783073 - DNA, 20 bp, Homo sapiens
gcactcagaagacactgatg

SEQ ID NO: 3783074 - DNA, 12 bp, Homo sapiens
gcactccagcct

SEQ ID NO: 3783075 - DNA, 14 bp, Homo sapiens
gcactccggaggta

SEQ ID NO: 3783076 - DNA, 19 bp, Homo sapiens
gcactcctccctgatgtac

SEQ ID NO: 3783077 - DNA, 16 bp, Homo sapiens
gcactcttaagcttcc

SEQ ID NO: 3783078 - DNA, 21 bp, Homo sapiens
gcactgagatatttattgttt

SEQ ID NO: 3783079 - DNA, 17 bp, Homo sapiens
gcactgaggaccagcca

SEQ ID NO: 3783080 - DNA, 14 bp, Homo sapiens
gcactgctgcccag

SEQ ID NO: 3783081 - DNA, 18 bp, Homo sapiens
gcactgctgcccagcctc

SEQ ID NO: 3783082 - DNA, 14 bp, Homo sapiens
gcactggtggcccg

SEQ ID NO: 3783083 - DNA, 23 bp, Homo sapiens
gcactggtggcccgacagcctgg

SEQ ID NO: 3783084 - DNA, 13 bp, Homo sapiens
gcactgtggcctt

SEQ ID NO: 3783085 - DNA, 21 bp, Homo sapiens
gcacttaaatatcaatcattt

SEQ ID NO: 3783086 - DNA, 22 bp, Homo sapiens
gcacttcgggaggtcgaggcag

SEQ ID NO: 3783087 - DNA, 21 bp, Homo sapiens
gcacttgcacgcccatgtgtg

SEQ ID NO: 3783088 - DNA, 18 bp, Homo sapiens
gcacttggagacttgtat

SEQ ID NO: 3783089 - DNA, 14 bp, Homo sapiens
gcacttggcctctg

SEQ ID NO: 3783090 - DNA, 15 bp, Homo sapiens
gcagaaaagcacctg

SEQ ID NO: 3783091 - DNA, 18 bp, Homo sapiens
gcagaaaagcacctgccg

SEQ ID NO: 3783092 - DNA, 20 bp, Homo sapiens
gcagaaaagcacctgccgac

SEQ ID NO: 3783093 - DNA, 16 bp, Homo sapiens
gcagaaaattgcctaa

SEQ ID NO: 3783094 - DNA, 16 bp, Homo sapiens
gcagaaagcagaggct

SEQ ID NO: 3783095 - DNA, 18 bp, Homo sapiens
gcagaaagcagaggctgg

SEQ ID NO: 3783096 - DNA, 20 bp, Homo sapiens
gcagaacagttaagcagccg

SEQ ID NO: 3783097 - DNA, 23 bp, Homo sapiens
gcagaagaattgaacccaggagg

SEQ ID NO: 3783098 - DNA, 13 bp, Homo sapiens
gcagaagctctcg

SEQ ID NO: 3783099 - DNA, 23 bp, Homo sapiens
gcagaagctctcgatggacaatg

SEQ ID NO: 3783100 - DNA, 23 bp, Homo sapiens
gcagaatcctaggctccacccca

SEQ ID NO: 3783101 - DNA, 18 bp, Homo sapiens
gcagacagcagctcaggc

SEQ ID NO: 3783102 - DNA, 21 bp, Homo sapiens
gcagacagcagctcaggcaca

SEQ ID NO: 3783103 - DNA, 13 bp, Homo sapiens
gcagacaggcaag

SEQ ID NO: 3783104 - DNA, 23 bp, Homo sapiens
gcagacaggcaagcacctcctgc

SEQ ID NO: 3783105 - DNA, 21 bp, Homo sapiens
gcagacaggccatgtgagcca

SEQ ID NO: 3783106 - DNA, 15 bp, Homo sapiens
gcagactggagggga

SEQ ID NO: 3783107 - DNA, 16 bp, Homo sapiens
gcagagaagccttggt

SEQ ID NO: 3783108 - DNA, 14 bp, Homo sapiens
gcccaacctcctga

SEQ ID NO: 3783109 - DNA, 24 bp, Homo sapiens
gcccaacctgctctcctcttgcca

SEQ ID NO: 3783110 - DNA, 22 bp, Homo sapiens
gcccaattcttacaaacatgtg

SEQ ID NO: 3783111 - DNA, 14 bp, Homo sapiens
gcccacagcccgca

SEQ ID NO: 3783112 - DNA, 19 bp, Homo sapiens
gcccacagctcccacccca

SEQ ID NO: 3783113 - DNA, 18 bp, Homo sapiens
gcccacaggtgtccccag

SEQ ID NO: 3783114 - DNA, 22 bp, Homo sapiens
gcccacaggtgtccccagccca

SEQ ID NO: 3783115 - DNA, 19 bp, Homo sapiens
gcccacagtctgacttccc

SEQ ID NO: 3783116 - DNA, 13 bp, Homo sapiens
gcccacccccctc

SEQ ID NO: 3783117 - DNA, 15 bp, Homo sapiens
gcccacccctcaaca

SEQ ID NO: 3783118 - DNA, 20 bp, Homo sapiens
gcccacctgcccatcacagg

SEQ ID NO: 3783119 - DNA, 17 bp, Homo sapiens
gcccaccttggctcaag

SEQ ID NO: 3783120 - DNA, 18 bp, Homo sapiens
gcccaccttggctcaagt

SEQ ID NO: 3783121 - DNA, 16 bp, Homo sapiens
gcccacgctggagtgc

SEQ ID NO: 3783122 - DNA, 18 bp, Homo sapiens
gcccacgttctctctgcc

SEQ ID NO: 3783123 - DNA, 23 bp, Homo sapiens
gcccacgttctctctgcctgtga

SEQ ID NO: 3783124 - DNA, 13 bp, Homo sapiens
gcccacttcaggg

SEQ ID NO: 3783125 - DNA, 14 bp, Homo sapiens
gcccacttctgcca

SEQ ID NO: 3783126 - DNA, 18 bp, Homo sapiens
gcccagaattcccagctg

SEQ ID NO: 3783127 - DNA, 20 bp, Homo sapiens
gcccagacccctctggccag

SEQ ID NO: 3783128 - DNA, 15 bp, Homo sapiens
gcccagagaagccaa

SEQ ID NO: 3783129 - DNA, 18 bp, Homo sapiens
gcccagagatgcctccac

SEQ ID NO: 3783130 - DNA, 22 bp, Homo sapiens
gcccagagatgcctccaccgct

SEQ ID NO: 3783131 - DNA, 22 bp, Homo sapiens
gcccagagatgggactgggagg

SEQ ID NO: 3783132 - DNA, 13 bp, Homo sapiens
gcccagagctggg

SEQ ID NO: 3783133 - DNA, 14 bp, Homo sapiens
gcccagaggcacag

SEQ ID NO: 3783134 - DNA, 13 bp, Homo sapiens
gcccagagggccc

SEQ ID NO: 3783135 - DNA, 15 bp, Homo sapiens
gcccagagggcccag

SEQ ID NO: 3783136 - DNA, 20 bp, Homo sapiens
gcccagagggcccaggcagg

SEQ ID NO: 3783137 - DNA, 21 bp, Homo sapiens
gcccagagggcccaggcaggc

SEQ ID NO: 3783138 - DNA, 17 bp, Homo sapiens
gcccagccaaaccctgt

SEQ ID NO: 3783139 - DNA, 23 bp, Homo sapiens
gcccagccattaccatggagaca

SEQ ID NO: 3783140 - DNA, 12 bp, Homo sapiens
gcccagcccagc

SEQ ID NO: 3783141 - DNA, 14 bp, Homo sapiens
gcccagctgctctg

SEQ ID NO: 3783142 - DNA, 15 bp, Homo sapiens
gcccagctgctctgc

SEQ ID NO: 3783143 - DNA, 22 bp, Homo sapiens
gcccagctgctctgcccagagc

SEQ ID NO: 3783144 - DNA, 23 bp, Homo sapiens
gcccagctgctctgcccagagct

SEQ ID NO: 3783145 - DNA, 11 bp, Homo sapiens
gcccaggagac

SEQ ID NO: 3783146 - DNA, 21 bp, Homo sapiens
gcccaggagagccagccctcc

SEQ ID NO: 3783147 - DNA, 22 bp, Homo sapiens
gcccaggagtttgaggctgcag

SEQ ID NO: 3783148 - DNA, 12 bp, Homo sapiens
gcccaggcaggt

SEQ ID NO: 3783149 - DNA, 13 bp, Homo sapiens
gcccaggcccctg

SEQ ID NO: 3783150 - DNA, 15 bp, Homo sapiens
gcccaggcccctgcc

SEQ ID NO: 3783151 - DNA, 20 bp, Homo sapiens
gcccaggcccctgccaccct

SEQ ID NO: 3783152 - DNA, 21 bp, Homo sapiens
gcccaggcccctgccaccctg

SEQ ID NO: 3783153 - DNA, 15 bp, Homo sapiens
gcccaggcctccagc

SEQ ID NO: 3783154 - DNA, 16 bp, Homo sapiens
gcccaggcctccagct

SEQ ID NO: 3783155 - DNA, 17 bp, Homo sapiens
gcccaggcctgcctgtt

SEQ ID NO: 3783156 - DNA, 12 bp, Homo sapiens
gcccaggctggc

SEQ ID NO: 3783157 - DNA, 13 bp, Homo sapiens
gcccagggccact

SEQ ID NO: 3783158 - DNA, 19 bp, Homo sapiens
gcccagggccactctgcct

SEQ ID NO: 3783159 - DNA, 17 bp, Homo sapiens
gcccagggctcagcctg

SEQ ID NO: 3783160 - DNA, 23 bp, Homo sapiens
gcccagggttcccccagccctgt

SEQ ID NO: 3783161 - DNA, 20 bp, Homo sapiens
gcccagtctggaatgcagtg

SEQ ID NO: 3783162 - DNA, 17 bp, Homo sapiens
gcccagtgccctggggc

SEQ ID NO: 3783163 - DNA, 15 bp, Homo sapiens
gcccagttgggtgga

SEQ ID NO: 3783164 - DNA, 13 bp, Homo sapiens
gcccatcacaggg

SEQ ID NO: 3783165 - DNA, 21 bp, Homo sapiens
gcccatcttgcctccatggtg

SEQ ID NO: 3783166 - DNA, 14 bp, Homo sapiens
gcccatgtgtgagt

SEQ ID NO: 3783167 - DNA, 15 bp, Homo sapiens
gcccatgtgtgagtg

SEQ ID NO: 3783168 - DNA, 20 bp, Homo sapiens
gcccatgtgtgagtgtgtgc

SEQ ID NO: 3783169 - DNA, 22 bp, Homo sapiens
gcccattccccagcctctcttc

SEQ ID NO: 3783170 - DNA, 23 bp, Homo sapiens
gcccattcctctgccaggctcta

SEQ ID NO: 3783171 - DNA, 15 bp, Homo sapiens
gccccaaaaccacag

SEQ ID NO: 3783172 - DNA, 21 bp, Homo sapiens
gccccaaaaccacagccctgt

SEQ ID NO: 3783173 - DNA, 19 bp, Homo sapiens
gccccaacccaaacctgga

SEQ ID NO: 3783174 - DNA, 22 bp, Homo sapiens
gccccaacccaaacctggagat

SEQ ID NO: 3783175 - DNA, 17 bp, Homo sapiens
gccccaactcctggaag

SEQ ID NO: 3783176 - DNA, 20 bp, Homo sapiens
gccccacacggaggcatctg

SEQ ID NO: 3783177 - DNA, 11 bp, Homo sapiens
gccccaccacc

SEQ ID NO: 3783178 - DNA, 12 bp, Homo sapiens
gccccacccagg

SEQ ID NO: 3783179 - DNA, 15 bp, Homo sapiens
gccccacccaggagg

SEQ ID NO: 3783180 - DNA, 15 bp, Homo sapiens
gccccaccctcagat

SEQ ID NO: 3783181 - DNA, 18 bp, Homo sapiens
gccccaccctcagatgca

SEQ ID NO: 3783182 - DNA, 21 bp, Homo sapiens
gccccacctttattaaaatct

SEQ ID NO: 3783183 - DNA, 23 bp, Homo sapiens
gccccacctttattaaaatctta

SEQ ID NO: 3783184 - DNA, 12 bp, Homo sapiens
gccccactgccc

SEQ ID NO: 3783185 - DNA, 15 bp, Homo sapiens
gccccagagactcag

SEQ ID NO: 3783186 - DNA, 13 bp, Homo sapiens
gccccagagctgt

SEQ ID NO: 3783187 - DNA, 18 bp, Homo sapiens
gccccagcaccaccaggt

SEQ ID NO: 3783188 - DNA, 19 bp, Homo sapiens
gccccagcactaacgtaaa

SEQ ID NO: 3783189 - DNA, 14 bp, Homo sapiens
gccccagcccagcc

SEQ ID NO: 3783190 - DNA, 19 bp, Homo sapiens
gccccagctgactgtggcc

SEQ ID NO: 3783191 - DNA, 14 bp, Homo sapiens
gccccaggaagccg

SEQ ID NO: 3783192 - DNA, 12 bp, Homo sapiens
gccccaggcagg

SEQ ID NO: 3783193 - DNA, 19 bp, Homo sapiens
gccccaggcaggctgtgcg

SEQ ID NO: 3783194 - DNA, 21 bp, Homo sapiens
gccccagggtcttccctacct

SEQ ID NO: 3783195 - DNA, 15 bp, Homo sapiens
gccccagtgcccaca

SEQ ID NO: 3783196 - DNA, 17 bp, Homo sapiens
gccccagtgcccacagg

SEQ ID NO: 3783197 - DNA, 21 bp, Homo sapiens
gccccagtgcccacaggatca

SEQ ID NO: 3783198 - DNA, 16 bp, Homo sapiens
gccccatcagctccag

SEQ ID NO: 3783199 - DNA, 14 bp, Homo sapiens
gccccatgaagcca

SEQ ID NO: 3783200 - DNA, 19 bp, Homo sapiens
gccccatgaagccacagcc

SEQ ID NO: 3783201 - DNA, 14 bp, Homo sapiens
gccccatgcctgtc

SEQ ID NO: 3783202 - DNA, 20 bp, Homo sapiens
gccccatgcctgtccagcct

SEQ ID NO: 3783203 - DNA, 15 bp, Homo sapiens
gccccatgtctctca

SEQ ID NO: 3783204 - DNA, 18 bp, Homo sapiens
gccccattctgcctgccc

SEQ ID NO: 3783205 - DNA, 16 bp, Homo sapiens
gcccccacacctggcc

SEQ ID NO: 3783206 - DNA, 19 bp, Homo sapiens
gcccccacacctggccctg

SEQ ID NO: 3783207 - DNA, 13 bp, Homo sapiens
gcccccactggct

SEQ ID NO: 3783208 - DNA, 12 bp, Homo sapiens
gcccccagacgc

SEQ ID NO: 3783209 - DNA, 18 bp, Homo sapiens
gcccccagctgtgggtac

SEQ ID NO: 3783210 - DNA, 14 bp, Homo sapiens
gcccccgagctggg

SEQ ID NO: 3783211 - DNA, 21 bp, Homo sapiens
gccccctggtggacagtcctg

SEQ ID NO: 3783212 - DNA, 17 bp, Homo sapiens
gcccccttctcccacac

SEQ ID NO: 3783213 - DNA, 16 bp, Homo sapiens
gccccgcttgtccagc

SEQ ID NO: 3783214 - DNA, 18 bp, Homo sapiens
gccccgcttgtccagcgc

SEQ ID NO: 3783215 - DNA, 19 bp, Homo sapiens
gccccgcttgtccagcgcc

SEQ ID NO: 3783216 - DNA, 16 bp, Homo sapiens
gccccggtgtgcggtg

SEQ ID NO: 3783217 - DNA, 18 bp, Homo sapiens
gccccgtcaccatctcag

SEQ ID NO: 3783218 - DNA, 21 bp, Homo sapiens
gccccgtcaccatctcaggcc

SEQ ID NO: 3783219 - DNA, 15 bp, Homo sapiens
gccccgtgcagactg

SEQ ID NO: 3783220 - DNA, 20 bp, Homo sapiens
gccccgtgcagactggaggg

SEQ ID NO: 3783221 - DNA, 14 bp, Homo sapiens
gctcagaacacatt

SEQ ID NO: 3783222 - DNA, 23 bp, Homo sapiens
gctcagacccccactctcattcc

SEQ ID NO: 3783223 - DNA, 23 bp, Homo sapiens
gctcagagggttgttctcctaga

SEQ ID NO: 3783224 - DNA, 14 bp, Homo sapiens
gctcagcccacccc

SEQ ID NO: 3783225 - DNA, 17 bp, Homo sapiens
gctcagcccacccccct

SEQ ID NO: 3783226 - DNA, 12 bp, Homo sapiens
gctcagccctcc

SEQ ID NO: 3783227 - DNA, 19 bp, Homo sapiens
gctcagccctccctgcccc

SEQ ID NO: 3783228 - DNA, 15 bp, Homo sapiens
gctcagcggggacag

SEQ ID NO: 3783229 - DNA, 16 bp, Homo sapiens
gctcagcggggacagc

SEQ ID NO: 3783230 - DNA, 18 bp, Homo sapiens
gctcagcggggacagctc

SEQ ID NO: 3783231 - DNA, 19 bp, Homo sapiens
gctcagcggggacagctcc

SEQ ID NO: 3783232 - DNA, 21 bp, Homo sapiens
gctcagcggggacagctcctt

SEQ ID NO: 3783233 - DNA, 22 bp, Homo sapiens
gctcagcggggacagctccttc

SEQ ID NO: 3783234 - DNA, 15 bp, Homo sapiens
gctcagctctggctc

SEQ ID NO: 3783235 - DNA, 18 bp, Homo sapiens
gctcagctctggctcaca

SEQ ID NO: 3783236 - DNA, 20 bp, Homo sapiens
gctcagctctggctcacaga

SEQ ID NO: 3783237 - DNA, 21 bp, Homo sapiens
gctcagctctggctcacagac

SEQ ID NO: 3783238 - DNA, 21 bp, Homo sapiens
gctcagctttttgtcttttct

SEQ ID NO: 3783239 - DNA, 13 bp, Homo sapiens
gctcaggaggctt

SEQ ID NO: 3783240 - DNA, 15 bp, Homo sapiens
gctcaggaggcttgg

SEQ ID NO: 3783241 - DNA, 19 bp, Homo sapiens
gctcaggcgatccacctgt

SEQ ID NO: 3783242 - DNA, 22 bp, Homo sapiens
gctcaggcgatccacctgtctc

SEQ ID NO: 3783243 - DNA, 20 bp, Homo sapiens
gctcaggtacagagaaggaa

SEQ ID NO: 3783244 - DNA, 17 bp, Homo sapiens
gctcaggtgtccctgca

SEQ ID NO: 3783245 - DNA, 18 bp, Homo sapiens
gctcaggtgtccctgcac

SEQ ID NO: 3783246 - DNA, 23 bp, Homo sapiens
gctcagtcccatcagagagcgag

SEQ ID NO: 3783247 - DNA, 16 bp, Homo sapiens
gctcatattcctgcag

SEQ ID NO: 3783248 - DNA, 20 bp, Homo sapiens
gctcatattcctgcagcctg

SEQ ID NO: 3783249 - DNA, 16 bp, Homo sapiens
gctcatgggcccctct

SEQ ID NO: 3783250 - DNA, 21 bp, Homo sapiens
gctcatgggcccctctgactc

SEQ ID NO: 3783251 - DNA, 21 bp, Homo sapiens
gctcattataatgtcattaaa

SEQ ID NO: 3783252 - DNA, 19 bp, Homo sapiens
gctccacaccctctcccag

SEQ ID NO: 3783253 - DNA, 19 bp, Homo sapiens
gctccaccaagaaagcagg

SEQ ID NO: 3783254 - DNA, 15 bp, Homo sapiens
gctccaccacatcct

SEQ ID NO: 3783255 - DNA, 13 bp, Homo sapiens
gctccaccccact

SEQ ID NO: 3783256 - DNA, 11 bp, Homo sapiens
gctccaccctt

SEQ ID NO: 3783257 - DNA, 13 bp, Homo sapiens
gctccacccttgg

SEQ ID NO: 3783258 - DNA, 15 bp, Homo sapiens
gctccacccttggcc

SEQ ID NO: 3783259 - DNA, 19 bp, Homo sapiens
gctccaccttgcagctctc

SEQ ID NO: 3783260 - DNA, 17 bp, Homo sapiens
gctccagacccccagca

SEQ ID NO: 3783261 - DNA, 17 bp, Homo sapiens
gctccagccaacccctg

SEQ ID NO: 3783262 - DNA, 14 bp, Homo sapiens
gctccagctcacca

SEQ ID NO: 3783263 - DNA, 17 bp, Homo sapiens
gctccagctcaccagcc

SEQ ID NO: 3783264 - DNA, 20 bp, Homo sapiens
gctccagctgctctgtcttc

SEQ ID NO: 3783265 - DNA, 11 bp, Homo sapiens
gctccagctgt

SEQ ID NO: 3783266 - DNA, 20 bp, Homo sapiens
gctccagctgttcagctggt

SEQ ID NO: 3783267 - DNA, 21 bp, Homo sapiens
gctccagctgttcagctggtt

SEQ ID NO: 3783268 - DNA, 13 bp, Homo sapiens
gctccagggccag

SEQ ID NO: 3783269 - DNA, 14 bp, Homo sapiens
gctccagtcctgct

SEQ ID NO: 3783270 - DNA, 17 bp, Homo sapiens
gctccagtctgctgccc

SEQ ID NO: 3783271 - DNA, 18 bp, Homo sapiens
gctccagtctgctgccct

SEQ ID NO: 3783272 - DNA, 12 bp, Homo sapiens
gctccagtggaa

SEQ ID NO: 3783273 - DNA, 21 bp, Homo sapiens
gctccagtggaagaagaaaac

SEQ ID NO: 3783274 - DNA, 17 bp, Homo sapiens
gctcccacaggcccttc

SEQ ID NO: 3783275 - DNA, 20 bp, Homo sapiens
gctcccacaggcccttcctc

SEQ ID NO: 3783276 - DNA, 18 bp, Homo sapiens
gctcccaccccaccccct

SEQ ID NO: 3783277 - DNA, 21 bp, Homo sapiens
gctcccaccccacccccttca

SEQ ID NO: 3783278 - DNA, 15 bp, Homo sapiens
gctccccagcccagg

SEQ ID NO: 3783279 - DNA, 20 bp, Homo sapiens
gctcccccaccccctcccca

SEQ ID NO: 3783280 - DNA, 22 bp, Homo sapiens
gctcccccaccccctccccagg

SEQ ID NO: 3783281 - DNA, 16 bp, Homo sapiens
gctcccccatcctccc

SEQ ID NO: 3783282 - DNA, 19 bp, Homo sapiens
gctcccctctatttagcat

SEQ ID NO: 3783283 - DNA, 20 bp, Homo sapiens
gctccctaccacctccccag

SEQ ID NO: 3783284 - DNA, 13 bp, Homo sapiens
gctccgctgtgtg

SEQ ID NO: 3783285 - DNA, 21 bp, Homo sapiens
gctccgctttctacccagcga

SEQ ID NO: 3783286 - DNA, 24 bp, Homo sapiens
gctccgctttctacccagcgagcc

SEQ ID NO: 3783287 - DNA, 18 bp, Homo sapiens
gctcctcaactcacctaa

SEQ ID NO: 3783288 - DNA, 18 bp, Homo sapiens
gctcctccagggccacgt

SEQ ID NO: 3783289 - DNA, 22 bp, Homo sapiens
gctcctccagggccacgtgcca

SEQ ID NO: 3783290 - DNA, 14 bp, Homo sapiens
gctcctcccggtgc

SEQ ID NO: 3783291 - DNA, 21 bp, Homo sapiens
gctcctccctccctctgccgg

SEQ ID NO: 3783292 - DNA, 15 bp, Homo sapiens
gctcctctccccagc

SEQ ID NO: 3783293 - DNA, 16 bp, Homo sapiens
gctcctctgggcagga

SEQ ID NO: 3783294 - DNA, 19 bp, Homo sapiens
gctcctctgggcaggacct

SEQ ID NO: 3783295 - DNA, 21 bp, Homo sapiens
gctcctgaggggcatctgccc

SEQ ID NO: 3783296 - DNA, 18 bp, Homo sapiens
gctcctggaaaggctcag

SEQ ID NO: 3783297 - DNA, 23 bp, Homo sapiens
gctcctggaaaggctcagtctca

SEQ ID NO: 3783298 - DNA, 17 bp, Homo sapiens
gctcctggactcattgc

SEQ ID NO: 3783299 - DNA, 19 bp, Homo sapiens
gctcctggactcattgctt

SEQ ID NO: 3783300 - DNA, 22 bp, Homo sapiens
gctcctgggaaggctactcacc

SEQ ID NO: 3783301 - DNA, 14 bp, Homo sapiens
gctcctgtctgcca

SEQ ID NO: 3783302 - DNA, 18 bp, Homo sapiens
gctcctgtctgccagcca

SEQ ID NO: 3783303 - DNA, 15 bp, Homo sapiens
gctccttagctgcca

SEQ ID NO: 3783304 - DNA, 13 bp, Homo sapiens
gctccttcctgtc

SEQ ID NO: 3783305 - DNA, 21 bp, Homo sapiens
gctccttctgtcctactctgt

SEQ ID NO: 3783306 - DNA, 21 bp, Homo sapiens
gctccttgggaggccccactg

SEQ ID NO: 3783307 - DNA, 20 bp, Homo sapiens
gctcgagcagtcctgcctca

SEQ ID NO: 3783308 - DNA, 17 bp, Homo sapiens
gctcggtggacccaggg

SEQ ID NO: 3783309 - DNA, 18 bp, Homo sapiens
gctcggtggacccaggga

SEQ ID NO: 3783310 - DNA, 23 bp, Homo sapiens
gctctagattgagagaagagaca

SEQ ID NO: 3783311 - DNA, 14 bp, Homo sapiens
gctctagcctgggc

SEQ ID NO: 3783312 - DNA, 12 bp, Homo sapiens
gctctcagaagg

SEQ ID NO: 3783313 - DNA, 10 bp, Homo sapiens
gctctcagcc

SEQ ID NO: 3783314 - DNA, 13 bp, Homo sapiens
gctctccacctca

SEQ ID NO: 3783315 - DNA, 16 bp, Homo sapiens
gctctccacctcagcc

SEQ ID NO: 3783316 - DNA, 17 bp, Homo sapiens
gctctccacctcagcct

SEQ ID NO: 3783317 - DNA, 20 bp, Homo sapiens
gctctccacctcagccttgg

SEQ ID NO: 3783318 - DNA, 21 bp, Homo sapiens
gctctccacctcagccttgga

SEQ ID NO: 3783319 - DNA, 16 bp, Homo sapiens
gctctcccctgccctg

SEQ ID NO: 3783320 - DNA, 17 bp, Homo sapiens
gctctccctctggccct

SEQ ID NO: 3783321 - DNA, 18 bp, Homo sapiens
gctctccctctggccctg

SEQ ID NO: 3783322 - DNA, 19 bp, Homo sapiens
gctctccctctggccctgc

SEQ ID NO: 3783323 - DNA, 21 bp, Homo sapiens
gctctccctctggccctgcct

SEQ ID NO: 3783324 - DNA, 16 bp, Homo sapiens
gctctcctttctttct

SEQ ID NO: 3783325 - DNA, 20 bp, Homo sapiens
gctctctacccagcccatct

SEQ ID NO: 3783326 - DNA, 13 bp, Homo sapiens
gctctctgcagcc

SEQ ID NO: 3783327 - DNA, 20 bp, Homo sapiens
gctctgagcaaatgtggctc

SEQ ID NO: 3783328 - DNA, 20 bp, Homo sapiens
gctctgatcatccactgtgc

SEQ ID NO: 3783329 - DNA, 21 bp, Homo sapiens
gctctgatcatccactgtgcc

SEQ ID NO: 3783330 - DNA, 22 bp, Homo sapiens
gctctgatcatccactgtgcca

SEQ ID NO: 3783331 - DNA, 13 bp, Homo sapiens
gctctgcacagat

SEQ ID NO: 3783332 - DNA, 13 bp, Homo sapiens
gctctgcccagag

SEQ ID NO: 3783333 - DNA, 12 bp, Homo sapiens
ggagccccaggg

SEQ ID NO: 3783334 - DNA, 13 bp, Homo sapiens
ggagccccagggt

SEQ ID NO: 3783335 - DNA, 13 bp, Homo sapiens
ggagcccccgccc

SEQ ID NO: 3783336 - DNA, 20 bp, Homo sapiens
ggagcccccgccccgcccca

SEQ ID NO: 3783337 - DNA, 21 bp, Homo sapiens
ggagcccgaggcaccagtgtc

SEQ ID NO: 3783338 - DNA, 13 bp, Homo sapiens
ggagcccttgggt

SEQ ID NO: 3783339 - DNA, 21 bp, Homo sapiens
ggagccgagatcacgccactg

SEQ ID NO: 3783340 - DNA, 21 bp, Homo sapiens
ggagcgcacctgccccctggt

SEQ ID NO: 3783341 - DNA, 16 bp, Homo sapiens
ggagctaacactggcc

SEQ ID NO: 3783342 - DNA, 18 bp, Homo sapiens
ggagctcttcaggcctcc

SEQ ID NO: 3783343 - DNA, 20 bp, Homo sapiens
ggagctgagaatagaaggaa

SEQ ID NO: 3783344 - DNA, 12 bp, Homo sapiens
ggagctgcctgt

SEQ ID NO: 3783345 - DNA, 13 bp, Homo sapiens
ggagctgctggct

SEQ ID NO: 3783346 - DNA, 23 bp, Homo sapiens
ggagctgctggcttgcagtgcgc

SEQ ID NO: 3783347 - DNA, 14 bp, Homo sapiens
ggagctgggaggaa

SEQ ID NO: 3783348 - DNA, 15 bp, Homo sapiens
ggagctgggaggaaa

SEQ ID NO: 3783349 - DNA, 20 bp, Homo sapiens
ggagctttcaaagaaggaat

SEQ ID NO: 3783350 - DNA, 20 bp, Homo sapiens
ggaggaaccgaaaggccaaa

SEQ ID NO: 3783351 - DNA, 19 bp, Homo sapiens
ggaggaatcgaggaaccag

SEQ ID NO: 3783352 - DNA, 20 bp, Homo sapiens
ggaggaatcgaggaaccaga

SEQ ID NO: 3783353 - DNA, 21 bp, Homo sapiens
ggaggaatcgaggaaccagag

SEQ ID NO: 3783354 - DNA, 23 bp, Homo sapiens
ggaggaatcgaggaaccagagcc

SEQ ID NO: 3783355 - DNA, 21 bp, Homo sapiens
ggaggaatttctgagtggcca

SEQ ID NO: 3783356 - DNA, 16 bp, Homo sapiens
ggaggaccaaaaaaat

SEQ ID NO: 3783357 - DNA, 12 bp, Homo sapiens
ggaggaccttat

SEQ ID NO: 3783358 - DNA, 14 bp, Homo sapiens
ggaggagagcctgg

SEQ ID NO: 3783359 - DNA, 17 bp, Homo sapiens
ggaggagcttgggggat

SEQ ID NO: 3783360 - DNA, 13 bp, Homo sapiens
ggaggaggaggca

SEQ ID NO: 3783361 - DNA, 19 bp, Homo sapiens
ggaggagggcggggggcac

SEQ ID NO: 3783362 - DNA, 23 bp, Homo sapiens
ggaggaggtttaggtcaagaaga

SEQ ID NO: 3783363 - DNA, 16 bp, Homo sapiens
ggaggatcactggagc

SEQ ID NO: 3783364 - DNA, 19 bp, Homo sapiens
ggaggatcactggagccca

SEQ ID NO: 3783365 - DNA, 23 bp, Homo sapiens
ggaggatcacttgagtccagaag

SEQ ID NO: 3783366 - DNA, 12 bp, Homo sapiens
ggaggatggaga

SEQ ID NO: 3783367 - DNA, 18 bp, Homo sapiens
ggaggatgttctgggaca

SEQ ID NO: 3783368 - DNA, 22 bp, Homo sapiens
ggaggattgcttgagcccagga

SEQ ID NO: 3783369 - DNA, 21 bp, Homo sapiens
ggaggcagaaagcagaggctg

SEQ ID NO: 3783370 - DNA, 13 bp, Homo sapiens
ggaggcagggcct

SEQ ID NO: 3783371 - DNA, 20 bp, Homo sapiens
ggaggccaaggtgggaggat

SEQ ID NO: 3783372 - DNA, 15 bp, Homo sapiens
ggaggctgaggcagg

SEQ ID NO: 3783373 - DNA, 19 bp, Homo sapiens
ggaggctgaggcaggagga

SEQ ID NO: 3783374 - DNA, 17 bp, Homo sapiens
ggaggcttgtcagagct

SEQ ID NO: 3783375 - DNA, 19 bp, Homo sapiens
ggaggcttgtcagagctgg

SEQ ID NO: 3783376 - DNA, 20 bp, Homo sapiens
ggaggcttgtcagagctggg

SEQ ID NO: 3783377 - DNA, 11 bp, Homo sapiens
ggaggggagct

SEQ ID NO: 3783378 - DNA, 14 bp, Homo sapiens
ggaggggagctctg

SEQ ID NO: 3783379 - DNA, 16 bp, Homo sapiens
ggagggggttacaaac

SEQ ID NO: 3783380 - DNA, 15 bp, Homo sapiens
ggagggtggcaggtg

SEQ ID NO: 3783381 - DNA, 22 bp, Homo sapiens
ggaggtattcgtaaggatggga

SEQ ID NO: 3783382 - DNA, 15 bp, Homo sapiens
ggaggtcgaggcagg

SEQ ID NO: 3783383 - DNA, 14 bp, Homo sapiens
ggaggtgaccccag

SEQ ID NO: 3783384 - DNA, 13 bp, Homo sapiens
ggaggtggctggg

SEQ ID NO: 3783385 - DNA, 12 bp, Homo sapiens
ggaggttgcagg

SEQ ID NO: 3783386 - DNA, 14 bp, Homo sapiens
ggaggttgcaggga

SEQ ID NO: 3783387 - DNA, 21 bp, Homo sapiens
ggaggttgcagtgagctgaga

SEQ ID NO: 3783388 - DNA, 17 bp, Homo sapiens
ggagtcatctcaaccat

SEQ ID NO: 3783389 - DNA, 16 bp, Homo sapiens
ggagtcccaaggaaag

SEQ ID NO: 3783390 - DNA, 17 bp, Homo sapiens
ggagtcccaaggaaagc

SEQ ID NO: 3783391 - DNA, 16 bp, Homo sapiens
ggagtgacagaggcag

SEQ ID NO: 3783392 - DNA, 21 bp, Homo sapiens
ggagtgacagaggcagcccca

SEQ ID NO: 3783393 - DNA, 21 bp, Homo sapiens
ggagtgagtgtggctcccctc

SEQ ID NO: 3783394 - DNA, 12 bp, Homo sapiens
ggagtgcagtga

SEQ ID NO: 3783395 - DNA, 12 bp, Homo sapiens
ggagtgggacag

SEQ ID NO: 3783396 - DNA, 15 bp, Homo sapiens
ggagttagaggccag

SEQ ID NO: 3783397 - DNA, 15 bp, Homo sapiens
ggagttcctaacagg

SEQ ID NO: 3783398 - DNA, 15 bp, Homo sapiens
ggagttcgaggctgc

SEQ ID NO: 3783399 - DNA, 19 bp, Homo sapiens
ggagttcttcttctcctag

SEQ ID NO: 3783400 - DNA, 21 bp, Homo sapiens
ggagttggaagtgtgtgatct

SEQ ID NO: 3783401 - DNA, 19 bp, Homo sapiens
ggataaacttttagaaact

SEQ ID NO: 3783402 - DNA, 20 bp, Homo sapiens
ggataatgctgttgcctcat

SEQ ID NO: 3783403 - DNA, 18 bp, Homo sapiens
ggatactctgtcagatgg

SEQ ID NO: 3783404 - DNA, 17 bp, Homo sapiens
ggatagataactctttg

SEQ ID NO: 3783405 - DNA, 13 bp, Homo sapiens
ggatatgtggaga

SEQ ID NO: 3783406 - DNA, 22 bp, Homo sapiens
ggatcaaaccccgaccacctgc

SEQ ID NO: 3783407 - DNA, 14 bp, Homo sapiens
ggatcactggagcc

SEQ ID NO: 3783408 - DNA, 18 bp, Homo sapiens
ggatcactggagcccagg

SEQ ID NO: 3783409 - DNA, 12 bp, Homo sapiens
ggatcagaaagt

SEQ ID NO: 3783410 - DNA, 21 bp, Homo sapiens
ggatcagtctgattcccaagc

SEQ ID NO: 3783411 - DNA, 18 bp, Homo sapiens
ggatctaccagcataaat

SEQ ID NO: 3783412 - DNA, 19 bp, Homo sapiens
ggatctgggaccctttcct

SEQ ID NO: 3783413 - DNA, 21 bp, Homo sapiens
ggatctggtagggggaaaatg

SEQ ID NO: 3783414 - DNA, 22 bp, Homo sapiens
ggatctttcacccacagaaaga

SEQ ID NO: 3783415 - DNA, 18 bp, Homo sapiens
ggatgaatgaggtcccag

SEQ ID NO: 3783416 - DNA, 21 bp, Homo sapiens
ggatgaattccaaattctgct

SEQ ID NO: 3783417 - DNA, 15 bp, Homo sapiens
ggatgacatgtccct

SEQ ID NO: 3783418 - DNA, 16 bp, Homo sapiens
ggatgaggtgctggga

SEQ ID NO: 3783419 - DNA, 13 bp, Homo sapiens
ggatgcctggtgg

SEQ ID NO: 3783420 - DNA, 22 bp, Homo sapiens
ggatgcttcatgtgaacgtggg

SEQ ID NO: 3783421 - DNA, 14 bp, Homo sapiens
ggatggggccacag

SEQ ID NO: 3783422 - DNA, 23 bp, Homo sapiens
ggatggtactagggggaagtgac

SEQ ID NO: 3783423 - DNA, 19 bp, Homo sapiens
ggatgtaaacagtgcctgc

SEQ ID NO: 3783424 - DNA, 16 bp, Homo sapiens
ggatgtacatttccaa

SEQ ID NO: 3783425 - DNA, 18 bp, Homo sapiens
ggatgtatatgtcatctc

SEQ ID NO: 3783426 - DNA, 18 bp, Homo sapiens
ggatgtcactcagatgga

SEQ ID NO: 3783427 - DNA, 15 bp, Homo sapiens
ggatgttctggccct

SEQ ID NO: 3783428 - DNA, 23 bp, Homo sapiens
ggattacaagcgtgagccactgc

SEQ ID NO: 3783429 - DNA, 16 bp, Homo sapiens
ggattcttcctccctc

SEQ ID NO: 3783430 - DNA, 18 bp, Homo sapiens
ggattctttccattatga

SEQ ID NO: 3783431 - DNA, 17 bp, Homo sapiens
ggattgctactgtccta

SEQ ID NO: 3783432 - DNA, 16 bp, Homo sapiens
ggattgctatgaatga

SEQ ID NO: 3783433 - DNA, 12 bp, Homo sapiens
ggattggggaag

SEQ ID NO: 3783434 - DNA, 18 bp, Homo sapiens
ggattggggaagactgtg

SEQ ID NO: 3783435 - DNA, 20 bp, Homo sapiens
ggattgtatcaagtggcatg

SEQ ID NO: 3783436 - DNA, 19 bp, Homo sapiens
ggatttgggttggaagtga

SEQ ID NO: 3783437 - DNA, 21 bp, Homo sapiens
ggattttgatccaagctggtc

SEQ ID NO: 3783438 - DNA, 17 bp, Homo sapiens
ggcaaacttcagactga

SEQ ID NO: 3783439 - DNA, 16 bp, Homo sapiens
ggcaaagacagaagcc

SEQ ID NO: 3783440 - DNA, 20 bp, Homo sapiens
ggcaaccacaggcagcattt

SEQ ID NO: 3783441 - DNA, 15 bp, Homo sapiens
ggcaaccttgtctct

SEQ ID NO: 3783442 - DNA, 15 bp, Homo sapiens
ggcaactgaggcaga

SEQ ID NO: 3783443 - DNA, 13 bp, Homo sapiens
ggcaactgctgat

SEQ ID NO: 3783444 - DNA, 19 bp, Homo sapiens
ggcaagcacctcctgcctc

SEQ ID NO: 3783445 - DNA, 17 bp, Homo sapiens
ggcaaggggtgcctggg

SEQ ID NO: 3783446 - DNA, 19 bp, Homo sapiens
ggggaggatcactggagcc

SEQ ID NO: 3783447 - DNA, 13 bp, Homo sapiens
ggggaggccaagt

SEQ ID NO: 3783448 - DNA, 21 bp, Homo sapiens
ggggaggccaagtgcaggctg

SEQ ID NO: 3783449 - DNA, 16 bp, Homo sapiens
ggggagtctgaagcag

SEQ ID NO: 3783450 - DNA, 15 bp, Homo sapiens
ggggatttctcccag

SEQ ID NO: 3783451 - DNA, 18 bp, Homo sapiens
ggggcagagggcagaggc

SEQ ID NO: 3783452 - DNA, 21 bp, Homo sapiens
ggggcagccaaacccatgagg

SEQ ID NO: 3783453 - DNA, 14 bp, Homo sapiens
ggggcagctgccag

SEQ ID NO: 3783454 - DNA, 14 bp, Homo sapiens
ggggccatgaggcc

SEQ ID NO: 3783455 - DNA, 12 bp, Homo sapiens
ggggccctggtc

SEQ ID NO: 3783456 - DNA, 21 bp, Homo sapiens
ggggccctggtccttccaggc

SEQ ID NO: 3783457 - DNA, 12 bp, Homo sapiens
ggggcctcaggt

SEQ ID NO: 3783458 - DNA, 15 bp, Homo sapiens
ggggcctcagtgcca

SEQ ID NO: 3783459 - DNA, 23 bp, Homo sapiens
ggggctctgccctccctccttcc

SEQ ID NO: 3783460 - DNA, 14 bp, Homo sapiens
ggggctgaggggca

SEQ ID NO: 3783461 - DNA, 15 bp, Homo sapiens
ggggctgctcctcca

SEQ ID NO: 3783462 - DNA, 21 bp, Homo sapiens
ggggctgctgacctccacagc

SEQ ID NO: 3783463 - DNA, 12 bp, Homo sapiens
ggggctggggca

SEQ ID NO: 3783464 - DNA, 15 bp, Homo sapiens
ggggctggggcagga

SEQ ID NO: 3783465 - DNA, 16 bp, Homo sapiens
ggggctggggcaggag

SEQ ID NO: 3783466 - DNA, 14 bp, Homo sapiens
gggggagggggagg

SEQ ID NO: 3783467 - DNA, 12 bp, Homo sapiens
gggggcagaggg

SEQ ID NO: 3783468 - DNA, 17 bp, Homo sapiens
gggggccacctccccag

SEQ ID NO: 3783469 - DNA, 21 bp, Homo sapiens
gggggcctcagggcagcctgc

SEQ ID NO: 3783470 - DNA, 15 bp, Homo sapiens
gggggcctcagtgcc

SEQ ID NO: 3783471 - DNA, 22 bp, Homo sapiens
gggggctatagctacaggaagc

SEQ ID NO: 3783472 - DNA, 20 bp, Homo sapiens
gggggctgcctggcccccag

SEQ ID NO: 3783473 - DNA, 13 bp, Homo sapiens
gggggctggggca

SEQ ID NO: 3783474 - DNA, 22 bp, Homo sapiens
ggggtaaaattccttagcttag

SEQ ID NO: 3783475 - DNA, 17 bp, Homo sapiens
ggggtcaaagcaaggat

SEQ ID NO: 3783476 - DNA, 15 bp, Homo sapiens
ggggtctccaggagg

SEQ ID NO: 3783477 - DNA, 17 bp, Homo sapiens
ggggttacaaactgcaa

SEQ ID NO: 3783478 - DNA, 16 bp, Homo sapiens
ggggttcagcccctcc

SEQ ID NO: 3783479 - DNA, 22 bp, Homo sapiens
ggggttctttcttcctctgctg

SEQ ID NO: 3783480 - DNA, 22 bp, Homo sapiens
gggtagcaggtaccactgattt

SEQ ID NO: 3783481 - DNA, 21 bp, Homo sapiens
gggtagcttctgacctcagca

SEQ ID NO: 3783482 - DNA, 13 bp, Homo sapiens
gggtatattcatt

SEQ ID NO: 3783483 - DNA, 10 bp, Homo sapiens
gggtatcctg

SEQ ID NO: 3783484 - DNA, 13 bp, Homo sapiens
gggtcaggaagga

SEQ ID NO: 3783485 - DNA, 19 bp, Homo sapiens
gggtcaggaaggatgagca

SEQ ID NO: 3783486 - DNA, 18 bp, Homo sapiens
gggtcagggaccaaggac

SEQ ID NO: 3783487 - DNA, 13 bp, Homo sapiens
gggtcctggctcc

SEQ ID NO: 3783488 - DNA, 18 bp, Homo sapiens
gggtctccaggaggagac

SEQ ID NO: 3783489 - DNA, 14 bp, Homo sapiens
gggtgaaagaaatc

SEQ ID NO: 3783490 - DNA, 14 bp, Homo sapiens
gggtgaagggagag

SEQ ID NO: 3783491 - DNA, 14 bp, Homo sapiens
gggtgaggataaca

SEQ ID NO: 3783492 - DNA, 14 bp, Homo sapiens
gggtgcagcagtga

SEQ ID NO: 3783493 - DNA, 15 bp, Homo sapiens
gggtgcagctgagaa

SEQ ID NO: 3783494 - DNA, 18 bp, Homo sapiens
gggtgccctccactgccc

SEQ ID NO: 3783495 - DNA, 16 bp, Homo sapiens
gggtgctccctaccac

SEQ ID NO: 3783496 - DNA, 23 bp, Homo sapiens
gggtgctgcttccctctgcctgt

SEQ ID NO: 3783497 - DNA, 19 bp, Homo sapiens
gggtgctggctgcccagac

SEQ ID NO: 3783498 - DNA, 16 bp, Homo sapiens
gggtggctagtcagag

SEQ ID NO: 3783499 - DNA, 12 bp, Homo sapiens
gggtggggctgc

SEQ ID NO: 3783500 - DNA, 14 bp, Homo sapiens
gggtggggctgctc

SEQ ID NO: 3783501 - DNA, 16 bp, Homo sapiens
gggtggggtagggctg

SEQ ID NO: 3783502 - DNA, 13 bp, Homo sapiens
gggtggtcctgac

SEQ ID NO: 3783503 - DNA, 18 bp, Homo sapiens
gggtgtaacaggtctcct

SEQ ID NO: 3783504 - DNA, 19 bp, Homo sapiens
gggtgtaacaggtctcctc

SEQ ID NO: 3783505 - DNA, 14 bp, Homo sapiens
gggtgtgtgtttgt

SEQ ID NO: 3783506 - DNA, 22 bp, Homo sapiens
gggttcaagcgattcttctgct

SEQ ID NO: 3783507 - DNA, 23 bp, Homo sapiens
gggttcaagcgattcttctgctt

SEQ ID NO: 3783508 - DNA, 19 bp, Homo sapiens
gggttcagagactcagggc

SEQ ID NO: 3783509 - DNA, 13 bp, Homo sapiens
gggttcagcccct

SEQ ID NO: 3783510 - DNA, 16 bp, Homo sapiens
gggttcagcccctcct

SEQ ID NO: 3783511 - DNA, 21 bp, Homo sapiens
gggttcagcccctcctctgcc

SEQ ID NO: 3783512 - DNA, 17 bp, Homo sapiens
gggttcattattggaat

SEQ ID NO: 3783513 - DNA, 14 bp, Homo sapiens
gggttcccccagcc

SEQ ID NO: 3783514 - DNA, 18 bp, Homo sapiens
gggttcgtggaaagggtg

SEQ ID NO: 3783515 - DNA, 17 bp, Homo sapiens
gggttctttcttcctct

SEQ ID NO: 3783516 - DNA, 19 bp, Homo sapiens
gggttctttcttcctctgc

SEQ ID NO: 3783517 - DNA, 20 bp, Homo sapiens
gggttgcgtcctgacggcgc

SEQ ID NO: 3783518 - DNA, 16 bp, Homo sapiens
gggttggcccctgccc

SEQ ID NO: 3783519 - DNA, 20 bp, Homo sapiens
gggtttggcgggccaaggac

SEQ ID NO: 3783520 - DNA, 14 bp, Homo sapiens
gggttttatatttt

SEQ ID NO: 3783521 - DNA, 13 bp, Homo sapiens
ggtaaaatacttc

SEQ ID NO: 3783522 - DNA, 14 bp, Homo sapiens
ggtaaaattgcatg

SEQ ID NO: 3783523 - DNA, 20 bp, Homo sapiens
ggtaacaggcagatacagga

SEQ ID NO: 3783524 - DNA, 23 bp, Homo sapiens
ggtaagaagccgggaacagacaa

SEQ ID NO: 3783525 - DNA, 17 bp, Homo sapiens
ggtaagagaatgttata

SEQ ID NO: 3783526 - DNA, 18 bp, Homo sapiens
ggtaagcttccaggaaaa

SEQ ID NO: 3783527 - DNA, 13 bp, Homo sapiens
ggtaaggtgcctt

SEQ ID NO: 3783528 - DNA, 14 bp, Homo sapiens
ggtaccactgattt

SEQ ID NO: 3783529 - DNA, 11 bp, Homo sapiens
ggtacccactg

SEQ ID NO: 3783530 - DNA, 18 bp, Homo sapiens
ggtactaataatcttgtt

SEQ ID NO: 3783531 - DNA, 20 bp, Homo sapiens
ggtacttgtggacacagctc

SEQ ID NO: 3783532 - DNA, 15 bp, Homo sapiens
ggtagccctggccag

SEQ ID NO: 3783533 - DNA, 18 bp, Homo sapiens
ggtagctgcccctggctc

SEQ ID NO: 3783534 - DNA, 14 bp, Homo sapiens
ggtagcttttccct

SEQ ID NO: 3783535 - DNA, 21 bp, Homo sapiens
ggtaggaatagcatgtcacta

SEQ ID NO: 3783536 - DNA, 17 bp, Homo sapiens
ggtataatggttgactg

SEQ ID NO: 3783537 - DNA, 21 bp, Homo sapiens
ggtatcaaacagctcaggctg

SEQ ID NO: 3783538 - DNA, 14 bp, Homo sapiens
ggtatcaggtgctg

SEQ ID NO: 3783539 - DNA, 14 bp, Homo sapiens
ggtatgcaatcaaa

SEQ ID NO: 3783540 - DNA, 14 bp, Homo sapiens
ggtatgtgtgtgta

SEQ ID NO: 3783541 - DNA, 20 bp, Homo sapiens
ggtatttatctattgtaaga

SEQ ID NO: 3783542 - DNA, 23 bp, Homo sapiens
ggtcaacatcttttacattctgc

SEQ ID NO: 3783543 - DNA, 23 bp, Homo sapiens
ggtcaacttgagcatgttactga

SEQ ID NO: 3783544 - DNA, 18 bp, Homo sapiens
ggtcaaggcctgtccctg

SEQ ID NO: 3783545 - DNA, 13 bp, Homo sapiens
ggtcactcctggg

SEQ ID NO: 3783546 - DNA, 19 bp, Homo sapiens
ggtcactgaaacttcaagc

SEQ ID NO: 3783547 - DNA, 11 bp, Homo sapiens
ggtcagagcct

SEQ ID NO: 3783548 - DNA, 15 bp, Homo sapiens
ggtcagagcctgcag

SEQ ID NO: 3783549 - DNA, 16 bp, Homo sapiens
ggtcagagcctgcagt

SEQ ID NO: 3783550 - DNA, 19 bp, Homo sapiens
ggtcagagtaagctgcttt

SEQ ID NO: 3783551 - DNA, 15 bp, Homo sapiens
ggtcaggaggcaggg

SEQ ID NO: 3783552 - DNA, 21 bp, Homo sapiens
ggtcaggagttagaggccagc

SEQ ID NO: 3783553 - DNA, 20 bp, Homo sapiens
ggtcaggttatactcctcct

SEQ ID NO: 3783554 - DNA, 17 bp, Homo sapiens
ggtcagtacccacctga

SEQ ID NO: 3783555 - DNA, 21 bp, Homo sapiens
ggtcagtacccacctgagctt

SEQ ID NO: 3783556 - DNA, 17 bp, Homo sapiens
ggtccacccaggagccc

SEQ ID NO: 3783557 - DNA, 20 bp, Homo sapiens
ggtccacccaggagccccga

SEQ ID NO: 3783558 - DNA, 22 bp, Homo sapiens
ggtccacccaggagccccgagg

SEQ ID NO: 3783559 - DNA, 14 bp, Homo sapiens
ggtccaccccatgt

SEQ ID NO: 3783560 - DNA, 13 bp, Homo sapiens
gtcaaagtaaaac

SEQ ID NO: 3783561 - DNA, 19 bp, Homo sapiens
gtcaacagagaaggcagga

SEQ ID NO: 3783562 - DNA, 23 bp, Homo sapiens
gtcaacagagaaggcaggaatgt

SEQ ID NO: 3783563 - DNA, 17 bp, Homo sapiens
gtcaacttgagcatgtt

SEQ ID NO: 3783564 - DNA, 15 bp, Homo sapiens
gtcaaggagtggctt

SEQ ID NO: 3783565 - DNA, 15 bp, Homo sapiens
gtcaagtaagaagac

SEQ ID NO: 3783566 - DNA, 13 bp, Homo sapiens
gtcaagtcaacca

SEQ ID NO: 3783567 - DNA, 18 bp, Homo sapiens
gtcaagtgaaaaaggagg

SEQ ID NO: 3783568 - DNA, 19 bp, Homo sapiens
gtcaagtgaaaaaggagga

SEQ ID NO: 3783569 - DNA, 17 bp, Homo sapiens
gtcaagttaacaaggaa

SEQ ID NO: 3783570 - DNA, 18 bp, Homo sapiens
gtcaagttaacaaggaat

SEQ ID NO: 3783571 - DNA, 11 bp, Homo sapiens
gtcaagttatt

SEQ ID NO: 3783572 - DNA, 18 bp, Homo sapiens
gtcaagttattaatttct

SEQ ID NO: 3783573 - DNA, 21 bp, Homo sapiens
gtcacaaatcctaaaagaagc

SEQ ID NO: 3783574 - DNA, 21 bp, Homo sapiens
gtcacacagtattacttctgc

SEQ ID NO: 3783575 - DNA, 12 bp, Homo sapiens
gtcacatgcttg

SEQ ID NO: 3783576 - DNA, 22 bp, Homo sapiens
gtcaccaaatcagctgctacta

SEQ ID NO: 3783577 - DNA, 12 bp, Homo sapiens
gtcaccaagccc

SEQ ID NO: 3783578 - DNA, 17 bp, Homo sapiens
gtcaccaagctcacagt

SEQ ID NO: 3783579 - DNA, 20 bp, Homo sapiens
gtcaccaccttcccagctct

SEQ ID NO: 3783580 - DNA, 15 bp, Homo sapiens
gtcaccatctcaggc

SEQ ID NO: 3783581 - DNA, 21 bp, Homo sapiens
gtcaccatctcaggccacctg

SEQ ID NO: 3783582 - DNA, 15 bp, Homo sapiens
gtcacccggccccca

SEQ ID NO: 3783583 - DNA, 23 bp, Homo sapiens
gtcacctgcccagatcccagaag

SEQ ID NO: 3783584 - DNA, 14 bp, Homo sapiens
gtcaccttttaaat

SEQ ID NO: 3783585 - DNA, 21 bp, Homo sapiens
gtcaccttttaaatcctgttg

SEQ ID NO: 3783586 - DNA, 23 bp, Homo sapiens
gtcactacgtgactgtggcacac

SEQ ID NO: 3783587 - DNA, 23 bp, Homo sapiens
gtcactgcctctccctggccctc

SEQ ID NO: 3783588 - DNA, 16 bp, Homo sapiens
gtcactgtttctctgc

SEQ ID NO: 3783589 - DNA, 20 bp, Homo sapiens
gtcacttacctagatttaca

SEQ ID NO: 3783590 - DNA, 20 bp, Homo sapiens
gtcagaataataagaggtgc

SEQ ID NO: 3783591 - DNA, 14 bp, Homo sapiens
gtcagactgctggg

SEQ ID NO: 3783592 - DNA, 24 bp, Homo sapiens
gtcagactgctgggactggccagg

SEQ ID NO: 3783593 - DNA, 15 bp, Homo sapiens
gtcagactttaaaga

SEQ ID NO: 3783594 - DNA, 12 bp, Homo sapiens
gtcagagagaat

SEQ ID NO: 3783595 - DNA, 19 bp, Homo sapiens
gtcagagaggagtcagaga

SEQ ID NO: 3783596 - DNA, 13 bp, Homo sapiens
gtcagagctggga

SEQ ID NO: 3783597 - DNA, 14 bp, Homo sapiens
gtcagagctgggag

SEQ ID NO: 3783598 - DNA, 18 bp, Homo sapiens
gtcagagtaagctgcttt

SEQ ID NO: 3783599 - DNA, 18 bp, Homo sapiens
gtcagatgggaagacatg

SEQ ID NO: 3783600 - DNA, 16 bp, Homo sapiens
gtcagattcctttccc

SEQ ID NO: 3783601 - DNA, 21 bp, Homo sapiens
gtcagcaagtcctaagcctgt

SEQ ID NO: 3783602 - DNA, 14 bp, Homo sapiens
gtcagctactaatg

SEQ ID NO: 3783603 - DNA, 17 bp, Homo sapiens
gtcagctactaatgatg

SEQ ID NO: 3783604 - DNA, 17 bp, Homo sapiens
gtcagctttgccttcca

SEQ ID NO: 3783605 - DNA, 18 bp, Homo sapiens
gtcagctttgccttccac

SEQ ID NO: 3783606 - DNA, 13 bp, Homo sapiens
gtcaggagttcct

SEQ ID NO: 3783607 - DNA, 23 bp, Homo sapiens
gtcaggagttcgagaccagcctg

SEQ ID NO: 3783608 - DNA, 18 bp, Homo sapiens
gtcaggtggggcagcttg

SEQ ID NO: 3783609 - DNA, 22 bp, Homo sapiens
gtcaggtggggcagcttgaggg

SEQ ID NO: 3783610 - DNA, 14 bp, Homo sapiens
gtcagtatgacatt

SEQ ID NO: 3783611 - DNA, 19 bp, Homo sapiens
gtcagtcatgatggcacca

SEQ ID NO: 3783612 - DNA, 14 bp, Homo sapiens
gtcagtgaggccca

SEQ ID NO: 3783613 - DNA, 21 bp, Homo sapiens
gtcatataagattcatattta

SEQ ID NO: 3783614 - DNA, 18 bp, Homo sapiens
gtcatctaccttttctct

SEQ ID NO: 3783615 - DNA, 19 bp, Homo sapiens
gtcatctccatcagctgta

SEQ ID NO: 3783616 - DNA, 20 bp, Homo sapiens
gtcatcttgaccaagcagga

SEQ ID NO: 3783617 - DNA, 22 bp, Homo sapiens
gtcatcttgaccaagcaggaag

SEQ ID NO: 3783618 - DNA, 14 bp, Homo sapiens
gtcatgaagcccaa

SEQ ID NO: 3783619 - DNA, 14 bp, Homo sapiens
gtcatgatctccct

SEQ ID NO: 3783620 - DNA, 15 bp, Homo sapiens
gtcatgatctccctg

SEQ ID NO: 3783621 - DNA, 16 bp, Homo sapiens
gtcatgatctccctgc

SEQ ID NO: 3783622 - DNA, 20 bp, Homo sapiens
gtcatgatctccctgccgcc

SEQ ID NO: 3783623 - DNA, 22 bp, Homo sapiens
gtcatgatctccctgccgcctc

SEQ ID NO: 3783624 - DNA, 21 bp, Homo sapiens
gtcattatgagaggcaatgat

SEQ ID NO: 3783625 - DNA, 16 bp, Homo sapiens
gtcattgctttactgg

SEQ ID NO: 3783626 - DNA, 17 bp, Homo sapiens
gtcatttgagcagggct

SEQ ID NO: 3783627 - DNA, 19 bp, Homo sapiens
gtcatttgagcagggctca

SEQ ID NO: 3783628 - DNA, 22 bp, Homo sapiens
gtcatttgagcagggctcagcg

SEQ ID NO: 3783629 - DNA, 21 bp, Homo sapiens
gtcatttgcgcacaacttaaa

SEQ ID NO: 3783630 - DNA, 12 bp, Homo sapiens
gtcattttgaag

SEQ ID NO: 3783631 - DNA, 21 bp, Homo sapiens
gtccaaactgcctaagccctc

SEQ ID NO: 3783632 - DNA, 21 bp, Homo sapiens
gtccaacgtggggcagcacag

SEQ ID NO: 3783633 - DNA, 19 bp, Homo sapiens
gtccaagtgtgtgtgcgtg

SEQ ID NO: 3783634 - DNA, 15 bp, Homo sapiens
gtccacagatgcctc

SEQ ID NO: 3783635 - DNA, 12 bp, Homo sapiens
gtccacccagga

SEQ ID NO: 3783636 - DNA, 13 bp, Homo sapiens
gtccacccaggag

SEQ ID NO: 3783637 - DNA, 13 bp, Homo sapiens
gtccagcctgggc

SEQ ID NO: 3783638 - DNA, 17 bp, Homo sapiens
gtccaggccccaaaacc

SEQ ID NO: 3783639 - DNA, 22 bp, Homo sapiens
gtcccaaggcaaggggtgcctg

SEQ ID NO: 3783640 - DNA, 11 bp, Homo sapiens
gtcccacagct

SEQ ID NO: 3783641 - DNA, 23 bp, Homo sapiens
gtcccaccttggctgcagggagt

SEQ ID NO: 3783642 - DNA, 22 bp, Homo sapiens
gtcccactcaagccaagcagcc

SEQ ID NO: 3783643 - DNA, 17 bp, Homo sapiens
gtcccagatacttgggg

SEQ ID NO: 3783644 - DNA, 21 bp, Homo sapiens
gtcccagccaccccgggctct

SEQ ID NO: 3783645 - DNA, 22 bp, Homo sapiens
gtcccagctactcagaagcctg

SEQ ID NO: 3783646 - DNA, 12 bp, Homo sapiens
gtcccagtgccg

SEQ ID NO: 3783647 - DNA, 20 bp, Homo sapiens
gtccccaggccccaggaagc

SEQ ID NO: 3783648 - DNA, 18 bp, Homo sapiens
gtccccagtttgcagaaa

SEQ ID NO: 3783649 - DNA, 19 bp, Homo sapiens
gtccccagtttgcagaaaa

SEQ ID NO: 3783650 - DNA, 16 bp, Homo sapiens
gtccctacacccctcc

SEQ ID NO: 3783651 - DNA, 18 bp, Homo sapiens
gtccctgactctctgtga

SEQ ID NO: 3783652 - DNA, 21 bp, Homo sapiens
gtccctgcacttgcagactct

SEQ ID NO: 3783653 - DNA, 15 bp, Homo sapiens
gtccctggccatctc

SEQ ID NO: 3783654 - DNA, 16 bp, Homo sapiens
gtcccttccaggccat

SEQ ID NO: 3783655 - DNA, 14 bp, Homo sapiens
gtcccttgagacct

SEQ ID NO: 3783656 - DNA, 21 bp, Homo sapiens
gtccggtccctgtcccagtgc

SEQ ID NO: 3783657 - DNA, 14 bp, Homo sapiens
gtccgtttactcca

SEQ ID NO: 3783658 - DNA, 15 bp, Homo sapiens
gtcctacccaccctc

SEQ ID NO: 3783659 - DNA, 16 bp, Homo sapiens
gtcctacccaccctcc

SEQ ID NO: 3783660 - DNA, 15 bp, Homo sapiens
gtcctactctgtgtc

SEQ ID NO: 3783661 - DNA, 23 bp, Homo sapiens
gtcctagaaattccccaccctga

SEQ ID NO: 3783662 - DNA, 18 bp, Homo sapiens
gtcctagccactcaggag

SEQ ID NO: 3783663 - DNA, 22 bp, Homo sapiens
gtcctaggccacaccatctcct

SEQ ID NO: 3783664 - DNA, 14 bp, Homo sapiens
gtcctcactcccag

SEQ ID NO: 3783665 - DNA, 16 bp, Homo sapiens
gtcctcactcccagtc

SEQ ID NO: 3783666 - DNA, 17 bp, Homo sapiens
gtcctcactcccagtcc

SEQ ID NO: 3783667 - DNA, 13 bp, Homo sapiens
gtcctccagaagc

SEQ ID NO: 3783668 - DNA, 14 bp, Homo sapiens
gtcctccagaagcc

SEQ ID NO: 3783669 - DNA, 18 bp, Homo sapiens
gtcctccagaagcctctg

SEQ ID NO: 3783670 - DNA, 20 bp, Homo sapiens
gtcctccagaagcctctggc

SEQ ID NO: 3783671 - DNA, 21 bp, Homo sapiens
gtcctccagaagcctctggct

SEQ ID NO: 3783672 - DNA, 17 bp, Homo sapiens
gtcctccccctgccagt

SEQ ID NO: 3783673 - DNA, 16 bp, Homo sapiens
gtggctaatggtgtaa

SEQ ID NO: 3783674 - DNA, 14 bp, Homo sapiens
gtggctcacgcctg

SEQ ID NO: 3783675 - DNA, 20 bp, Homo sapiens
gtggctcacgtgtgtgactc

SEQ ID NO: 3783676 - DNA, 12 bp, Homo sapiens
gtggctcccctc

SEQ ID NO: 3783677 - DNA, 14 bp, Homo sapiens
gtggctcccctcta

SEQ ID NO: 3783678 - DNA, 22 bp, Homo sapiens
gtggctcccctctatttagcat

SEQ ID NO: 3783679 - DNA, 23 bp, Homo sapiens
gtggctcccctctatttagcatg

SEQ ID NO: 3783680 - DNA, 14 bp, Homo sapiens
gtggctgacccagt

SEQ ID NO: 3783681 - DNA, 17 bp, Homo sapiens
gtggctgctagcacttg

SEQ ID NO: 3783682 - DNA, 19 bp, Homo sapiens
gtggctgctagcacttgga

SEQ ID NO: 3783683 - DNA, 14 bp, Homo sapiens
gtggctgtcagcag

SEQ ID NO: 3783684 - DNA, 20 bp, Homo sapiens
gtggcttactacatgtggga

SEQ ID NO: 3783685 - DNA, 17 bp, Homo sapiens
gtgggaacgtgactgcc

SEQ ID NO: 3783686 - DNA, 21 bp, Homo sapiens
gtgggaagaaacaaacccgtt

SEQ ID NO: 3783687 - DNA, 17 bp, Homo sapiens
gtgggaagcgtctgtcc

SEQ ID NO: 3783688 - DNA, 23 bp, Homo sapiens
gtgggaaggacttggcgcgccct

SEQ ID NO: 3783689 - DNA, 15 bp, Homo sapiens
gtgggactgtacaca

SEQ ID NO: 3783690 - DNA, 14 bp, Homo sapiens
gtgggagagcccag

SEQ ID NO: 3783691 - DNA, 15 bp, Homo sapiens
gtgggagagcccagc

SEQ ID NO: 3783692 - DNA, 19 bp, Homo sapiens
gtgggagcagcggtttggg

SEQ ID NO: 3783693 - DNA, 14 bp, Homo sapiens
gtgggagctgcctg

SEQ ID NO: 3783694 - DNA, 20 bp, Homo sapiens
gtgggcacgctgtgggcagg

SEQ ID NO: 3783695 - DNA, 23 bp, Homo sapiens
gtgggcacgctgtgggcaggtgg

SEQ ID NO: 3783696 - DNA, 17 bp, Homo sapiens
gtgggccagcccctccc

SEQ ID NO: 3783697 - DNA, 18 bp, Homo sapiens
gtgggccaggacaggccc

SEQ ID NO: 3783698 - DNA, 17 bp, Homo sapiens
gtgggccagtgtgggaa

SEQ ID NO: 3783699 - DNA, 19 bp, Homo sapiens
gtgggcctcaaggacttga

SEQ ID NO: 3783700 - DNA, 18 bp, Homo sapiens
gtgggctgagccctggca

SEQ ID NO: 3783701 - DNA, 22 bp, Homo sapiens
gtggggaagagaaatacaagat

SEQ ID NO: 3783702 - DNA, 22 bp, Homo sapiens
gtggggacgtcctgccacctgg

SEQ ID NO: 3783703 - DNA, 16 bp, Homo sapiens
gtggggatttctccca

SEQ ID NO: 3783704 - DNA, 17 bp, Homo sapiens
gtggggatttctcccag

SEQ ID NO: 3783705 - DNA, 12 bp, Homo sapiens
gtggggcagcac

SEQ ID NO: 3783706 - DNA, 13 bp, Homo sapiens
gtggggcagcttg

SEQ ID NO: 3783707 - DNA, 13 bp, Homo sapiens
gtggggccttggt

SEQ ID NO: 3783708 - DNA, 12 bp, Homo sapiens
gtggggctgctc

SEQ ID NO: 3783709 - DNA, 17 bp, Homo sapiens
gtgggggcagagggcag

SEQ ID NO: 3783710 - DNA, 21 bp, Homo sapiens
gtggggtctccctctcctgcc

SEQ ID NO: 3783711 - DNA, 13 bp, Homo sapiens
gtgggtcttcagg

SEQ ID NO: 3783712 - DNA, 21 bp, Homo sapiens
gtgggtcttcagggggccagg

SEQ ID NO: 3783713 - DNA, 17 bp, Homo sapiens
gtggtaagagaatgtta

SEQ ID NO: 3783714 - DNA, 14 bp, Homo sapiens
gtggtctgaatgtt

SEQ ID NO: 3783715 - DNA, 20 bp, Homo sapiens
gtggtctgaatgttctgaca

SEQ ID NO: 3783716 - DNA, 15 bp, Homo sapiens
gtggtctgcaggcag

SEQ ID NO: 3783717 - DNA, 17 bp, Homo sapiens
gtggtctttctggagag

SEQ ID NO: 3783718 - DNA, 19 bp, Homo sapiens
gtggtgatcaattaaatgt

SEQ ID NO: 3783719 - DNA, 22 bp, Homo sapiens
gtggtggaaacttttcttaaaa

SEQ ID NO: 3783720 - DNA, 18 bp, Homo sapiens
gtggtggcccacgcctgt

SEQ ID NO: 3783721 - DNA, 18 bp, Homo sapiens
gtggtggctcacgcctgt

SEQ ID NO: 3783722 - DNA, 18 bp, Homo sapiens
gtggtttagtgtaaaaat

SEQ ID NO: 3783723 - DNA, 23 bp, Homo sapiens
gtggtttcagcaatatttaagga

SEQ ID NO: 3783724 - DNA, 12 bp, Homo sapiens
gtgtaaaaatga

SEQ ID NO: 3783725 - DNA, 19 bp, Homo sapiens
gtgtaacaggtctcctctt

SEQ ID NO: 3783726 - DNA, 23 bp, Homo sapiens
gtgtaacctgagatggccctctg

SEQ ID NO: 3783727 - DNA, 19 bp, Homo sapiens
gtgtaactgcccaaagcag

SEQ ID NO: 3783728 - DNA, 20 bp, Homo sapiens
gtgtaactgcccaaagcagc

SEQ ID NO: 3783729 - DNA, 18 bp, Homo sapiens
gtgtaactggcagttttc

SEQ ID NO: 3783730 - DNA, 12 bp, Homo sapiens
gtgtaagagaat

SEQ ID NO: 3783731 - DNA, 15 bp, Homo sapiens
gtgtaataaagtgtt

SEQ ID NO: 3783732 - DNA, 16 bp, Homo sapiens
gtgtactctggcctct

SEQ ID NO: 3783733 - DNA, 14 bp, Homo sapiens
gtgtactgtaaaga

SEQ ID NO: 3783734 - DNA, 17 bp, Homo sapiens
gtgtagccttgcccgga

SEQ ID NO: 3783735 - DNA, 15 bp, Homo sapiens
gtgtaggctttactt

SEQ ID NO: 3783736 - DNA, 17 bp, Homo sapiens
gtgtatatgtatgtgtg

SEQ ID NO: 3783737 - DNA, 19 bp, Homo sapiens
gtgtatgctactacaaaaa

SEQ ID NO: 3783738 - DNA, 22 bp, Homo sapiens
gtgtatgtttgcacacttgtgt

SEQ ID NO: 3783739 - DNA, 21 bp, Homo sapiens
gtgtatttattttcctcccca

SEQ ID NO: 3783740 - DNA, 22 bp, Homo sapiens
gtgtatttattttcctccccag

SEQ ID NO: 3783741 - DNA, 14 bp, Homo sapiens
gtgtcaggtggggc

SEQ ID NO: 3783742 - DNA, 20 bp, Homo sapiens
gtgtcaggtggggcagcttg

SEQ ID NO: 3783743 - DNA, 23 bp, Homo sapiens
gtgtcatatatggggggccaaca

SEQ ID NO: 3783744 - DNA, 18 bp, Homo sapiens
gtgtcatttatgaaaaga

SEQ ID NO: 3783745 - DNA, 14 bp, Homo sapiens
gtgtccaactccag

SEQ ID NO: 3783746 - DNA, 16 bp, Homo sapiens
gtgtccctgcacttgc

SEQ ID NO: 3783747 - DNA, 18 bp, Homo sapiens
gtgtccctgcacttgcag

SEQ ID NO: 3783748 - DNA, 18 bp, Homo sapiens
gtgtccttgcacctgcat

SEQ ID NO: 3783749 - DNA, 19 bp, Homo sapiens
gtgtccttgcacctgcatc

SEQ ID NO: 3783750 - DNA, 22 bp, Homo sapiens
gtgtctcagtccacctgagctg

SEQ ID NO: 3783751 - DNA, 15 bp, Homo sapiens
gtgtctcctgcatgc

SEQ ID NO: 3783752 - DNA, 23 bp, Homo sapiens
gtgtctcctgcatgcagaaaggg

SEQ ID NO: 3783753 - DNA, 22 bp, Homo sapiens
gtgtctcttttctctttctcct

SEQ ID NO: 3783754 - DNA, 21 bp, Homo sapiens
gtgtctttctttggtgccttt

SEQ ID NO: 3783755 - DNA, 22 bp, Homo sapiens
gtgtctttctttggtgcctttc

SEQ ID NO: 3783756 - DNA, 18 bp, Homo sapiens
gtgtgaggagctgctggc

SEQ ID NO: 3783757 - DNA, 19 bp, Homo sapiens
gtgtgaggagctgctggct

SEQ ID NO: 3783758 - DNA, 11 bp, Homo sapiens
gtgtgagtgtg

SEQ ID NO: 3783759 - DNA, 19 bp, Homo sapiens
gtgtgatcccaagtgccag

SEQ ID NO: 3783760 - DNA, 15 bp, Homo sapiens
gtgtgcaacagacaa

SEQ ID NO: 3783761 - DNA, 13 bp, Homo sapiens
gtgtgcctgcagc

SEQ ID NO: 3783762 - DNA, 15 bp, Homo sapiens
gtgtgcctgcagccc

SEQ ID NO: 3783763 - DNA, 15 bp, Homo sapiens
gtgtggactgtgatg

SEQ ID NO: 3783764 - DNA, 19 bp, Homo sapiens
gtgtggctcacgtgtgtga

SEQ ID NO: 3783765 - DNA, 16 bp, Homo sapiens
gtgtgggtacctgtat

SEQ ID NO: 3783766 - DNA, 17 bp, Homo sapiens
gtgtgggtacctgtatt

SEQ ID NO: 3783767 - DNA, 15 bp, Homo sapiens
gtgtggtttagtgta

SEQ ID NO: 3783768 - DNA, 17 bp, Homo sapiens
gtgtggtttagtgtaaa

SEQ ID NO: 3783769 - DNA, 22 bp, Homo sapiens
gtgtggtttagtgtaaaaatga

SEQ ID NO: 3783770 - DNA, 22 bp, Homo sapiens
gtgtgtctgttcacttttcctc

SEQ ID NO: 3783771 - DNA, 13 bp, Homo sapiens
gtgtgtgtgtgtg

SEQ ID NO: 3783772 - DNA, 14 bp, Homo sapiens
gtgtgtgtgtgtgt

SEQ ID NO: 3783773 - DNA, 15 bp, Homo sapiens
gtgttcctggcaata

SEQ ID NO: 3783774 - DNA, 11 bp, Homo sapiens
gtgttcgttct

SEQ ID NO: 3783775 - DNA, 15 bp, Homo sapiens
gtgttcgttcttgtt

SEQ ID NO: 3783776 - DNA, 17 bp, Homo sapiens
gtgttctgtttgttaaa

SEQ ID NO: 3783777 - DNA, 22 bp, Homo sapiens
gtgttggcttgtgatctgggaa

SEQ ID NO: 3783778 - DNA, 20 bp, Homo sapiens
gtgtttccttcatttctgat

SEQ ID NO: 3783779 - DNA, 12 bp, Homo sapiens
gtgtttgtgtga

SEQ ID NO: 3783780 - DNA, 18 bp, Homo sapiens
gtgttttaaagagaatgt

SEQ ID NO: 3783781 - DNA, 15 bp, Homo sapiens
gtgtttttaactcaa

SEQ ID NO: 3783782 - DNA, 15 bp, Homo sapiens
gtgtttttgaaatat

SEQ ID NO: 3783783 - DNA, 22 bp, Homo sapiens
gtgtttttttttcgtttgtttg

SEQ ID NO: 3783784 - DNA, 13 bp, Homo sapiens
gttaacaaggaat

SEQ ID NO: 3783785 - DNA, 22 bp, Homo sapiens
gttaacaaggaatgcctgtgcc

SEQ ID NO: 3783786 - DNA, 14 bp, Homo sapiens
taagtattcaagaa

SEQ ID NO: 3783787 - DNA, 20 bp, Homo sapiens
taagtattcttatttaatga

SEQ ID NO: 3783788 - DNA, 17 bp, Homo sapiens
taagtatttatatattt

SEQ ID NO: 3783789 - DNA, 15 bp, Homo sapiens
taagtccctgccccc

SEQ ID NO: 3783790 - DNA, 17 bp, Homo sapiens
taagtccctgccccctc

SEQ ID NO: 3783791 - DNA, 18 bp, Homo sapiens
taagtccctgccccctcc

SEQ ID NO: 3783792 - DNA, 18 bp, Homo sapiens
taagtctaaatatttcct

SEQ ID NO: 3783793 - DNA, 11 bp, Homo sapiens
taagtctctgt

SEQ ID NO: 3783794 - DNA, 13 bp, Homo sapiens
taagtgctttgta

SEQ ID NO: 3783795 - DNA, 20 bp, Homo sapiens
taagttatttcttgtttgtt

SEQ ID NO: 3783796 - DNA, 19 bp, Homo sapiens
taagttcttagatatcttt

SEQ ID NO: 3783797 - DNA, 17 bp, Homo sapiens
taagttgaatggcctgc

SEQ ID NO: 3783798 - DNA, 15 bp, Homo sapiens
taagttgaggcattt

SEQ ID NO: 3783799 - DNA, 16 bp, Homo sapiens
taagtttgatttcatt

SEQ ID NO: 3783800 - DNA, 18 bp, Homo sapiens
taagtttgtgaatgtgac

SEQ ID NO: 3783801 - DNA, 12 bp, Homo sapiens
taataaaatatc

SEQ ID NO: 3783802 - DNA, 14 bp, Homo sapiens
taataaactgtgtt

SEQ ID NO: 3783803 - DNA, 14 bp, Homo sapiens
taataaagatgctc

SEQ ID NO: 3783804 - DNA, 16 bp, Homo sapiens
taataaagatgctctt

SEQ ID NO: 3783805 - DNA, 15 bp, Homo sapiens
taataaagtattcca

SEQ ID NO: 3783806 - DNA, 18 bp, Homo sapiens
taataaagtattccacct

SEQ ID NO: 3783807 - DNA, 19 bp, Homo sapiens
taataaagtgttttcagag

SEQ ID NO: 3783808 - DNA, 16 bp, Homo sapiens
taataaatatttatgt

SEQ ID NO: 3783809 - DNA, 16 bp, Homo sapiens
taataaattgcatgct

SEQ ID NO: 3783810 - DNA, 14 bp, Homo sapiens
taataataatgttt

SEQ ID NO: 3783811 - DNA, 12 bp, Homo sapiens
taataatacaag

SEQ ID NO: 3783812 - DNA, 12 bp, Homo sapiens
taataatcttgt

SEQ ID NO: 3783813 - DNA, 16 bp, Homo sapiens
taataattttttaatt

SEQ ID NO: 3783814 - DNA, 14 bp, Homo sapiens
taatacaaaggctt

SEQ ID NO: 3783815 - DNA, 16 bp, Homo sapiens
taatacattaaagcag

SEQ ID NO: 3783816 - DNA, 18 bp, Homo sapiens
taatacattaaagcagtc

SEQ ID NO: 3783817 - DNA, 21 bp, Homo sapiens
taatagaatataattatcgga

SEQ ID NO: 3783818 - DNA, 21 bp, Homo sapiens
taatataactgccttaaaact

SEQ ID NO: 3783819 - DNA, 23 bp, Homo sapiens
taatataactgccttaaaacttt

SEQ ID NO: 3783820 - DNA, 15 bp, Homo sapiens
taatatcaatagaag

SEQ ID NO: 3783821 - DNA, 12 bp, Homo sapiens
taatatgagaat

SEQ ID NO: 3783822 - DNA, 18 bp, Homo sapiens
taatatgctgccaaattt

SEQ ID NO: 3783823 - DNA, 21 bp, Homo sapiens
taatatgtattttatgtatgt

SEQ ID NO: 3783824 - DNA, 21 bp, Homo sapiens
taatatgttaacctcagtgtc

SEQ ID NO: 3783825 - DNA, 23 bp, Homo sapiens
taatatgttaacctcagtgtcat

SEQ ID NO: 3783826 - DNA, 14 bp, Homo sapiens
taatattctttcaa

SEQ ID NO: 3783827 - DNA, 18 bp, Homo sapiens
taatcaatgtttcttcta

SEQ ID NO: 3783828 - DNA, 15 bp, Homo sapiens
taatcagcctcttaa

SEQ ID NO: 3783829 - DNA, 22 bp, Homo sapiens
taatcagtgtagccccaagaag

SEQ ID NO: 3783830 - DNA, 15 bp, Homo sapiens
taatcatataataaa

SEQ ID NO: 3783831 - DNA, 20 bp, Homo sapiens
taatcatgtgggtgagccag

SEQ ID NO: 3783832 - DNA, 12 bp, Homo sapiens
taatcatttctt

SEQ ID NO: 3783833 - DNA, 19 bp, Homo sapiens
taatcatttcttgggccct

SEQ ID NO: 3783834 - DNA, 19 bp, Homo sapiens
taatcccagcactttggga

SEQ ID NO: 3783835 - DNA, 19 bp, Homo sapiens
taatcccagctacttggga

SEQ ID NO: 3783836 - DNA, 20 bp, Homo sapiens
taatccctgggcattgcttt

SEQ ID NO: 3783837 - DNA, 15 bp, Homo sapiens
taatcggcccacagc

SEQ ID NO: 3783838 - DNA, 19 bp, Homo sapiens
taatcgttatgtgtgtata

SEQ ID NO: 3783839 - DNA, 14 bp, Homo sapiens
taatctagaacaca

SEQ ID NO: 3783840 - DNA, 20 bp, Homo sapiens
taatctgatcgttctttcta

SEQ ID NO: 3783841 - DNA, 18 bp, Homo sapiens
taatctgctatgcttgaa

SEQ ID NO: 3783842 - DNA, 15 bp, Homo sapiens
taatctggactcctc

SEQ ID NO: 3783843 - DNA, 18 bp, Homo sapiens
taatctggactcctctgt

SEQ ID NO: 3783844 - DNA, 20 bp, Homo sapiens
taatctggactcctctgtcc

SEQ ID NO: 3783845 - DNA, 21 bp, Homo sapiens
taatctggactcctctgtcca

SEQ ID NO: 3783846 - DNA, 20 bp, Homo sapiens
taatcttaggggagagcttt

SEQ ID NO: 3783847 - DNA, 16 bp, Homo sapiens
taatcttcagttttat

SEQ ID NO: 3783848 - DNA, 14 bp, Homo sapiens
taatgaaagactgt

SEQ ID NO: 3783849 - DNA, 18 bp, Homo sapiens
taatgaaagactgtacaa

SEQ ID NO: 3783850 - DNA, 17 bp, Homo sapiens
taatgaatgaaacattt

SEQ ID NO: 3783851 - DNA, 16 bp, Homo sapiens
taatgcatgttaggaa

SEQ ID NO: 3783852 - DNA, 19 bp, Homo sapiens
taatgcccagacatttttt

SEQ ID NO: 3783853 - DNA, 20 bp, Homo sapiens
taatggaaaatgattttact

SEQ ID NO: 3783854 - DNA, 15 bp, Homo sapiens
taatggtttgaatat

SEQ ID NO: 3783855 - DNA, 15 bp, Homo sapiens
taatgtcaccacctt

SEQ ID NO: 3783856 - DNA, 22 bp, Homo sapiens
taatgtcaccaccttcccagct

SEQ ID NO: 3783857 - DNA, 20 bp, Homo sapiens
taatgtcttgttaatattct

SEQ ID NO: 3783858 - DNA, 13 bp, Homo sapiens
taatgtgaactag

SEQ ID NO: 3783859 - DNA, 19 bp, Homo sapiens
taatgtgaactagctggaa

SEQ ID NO: 3783860 - DNA, 17 bp, Homo sapiens
taatgtgggaagaaaca

SEQ ID NO: 3783861 - DNA, 14 bp, Homo sapiens
taatgttactgatc

SEQ ID NO: 3783862 - DNA, 15 bp, Homo sapiens
taatgttactgatca

SEQ ID NO: 3783863 - DNA, 18 bp, Homo sapiens
taatgttgttatttaaag

SEQ ID NO: 3783864 - DNA, 15 bp, Homo sapiens
taatgtttatgagcc

SEQ ID NO: 3783865 - DNA, 17 bp, Homo sapiens
taatgtttatgagccag

SEQ ID NO: 3783866 - DNA, 13 bp, Homo sapiens
taatgtttgctat

SEQ ID NO: 3783867 - DNA, 21 bp, Homo sapiens
taattaaataaaaatctgtgg

SEQ ID NO: 3783868 - DNA, 23 bp, Homo sapiens
taattataccgctatcattccaa

SEQ ID NO: 3783869 - DNA, 17 bp, Homo sapiens
taattatcggaagcagt

SEQ ID NO: 3783870 - DNA, 18 bp, Homo sapiens
taattatcgggaacagtg

SEQ ID NO: 3783871 - DNA, 19 bp, Homo sapiens
taattatgttattgaaaaa

SEQ ID NO: 3783872 - DNA, 12 bp, Homo sapiens
taattattattt

SEQ ID NO: 3783873 - DNA, 20 bp, Homo sapiens
taattattttaattaggtta

SEQ ID NO: 3783874 - DNA, 16 bp, Homo sapiens
taattccatatgctgt

SEQ ID NO: 3783875 - DNA, 23 bp, Homo sapiens
taattcccattttgcaaaatttc

SEQ ID NO: 3783876 - DNA, 15 bp, Homo sapiens
taattccctatcttt

SEQ ID NO: 3783877 - DNA, 19 bp, Homo sapiens
taattctaaccagagcaag

SEQ ID NO: 3783878 - DNA, 23 bp, Homo sapiens
taattctaaccagagcaagcttt

SEQ ID NO: 3783879 - DNA, 15 bp, Homo sapiens
taattcttgtatatt

SEQ ID NO: 3783880 - DNA, 12 bp, Homo sapiens
taattctttgat

SEQ ID NO: 3783881 - DNA, 21 bp, Homo sapiens
taattgagaagcgtatgtttt

SEQ ID NO: 3783882 - DNA, 14 bp, Homo sapiens
taattgatttcaag

SEQ ID NO: 3783883 - DNA, 19 bp, Homo sapiens
taattgatttcaagacctt

SEQ ID NO: 3783884 - DNA, 11 bp, Homo sapiens
taattgccatg

SEQ ID NO: 3783885 - DNA, 18 bp, Homo sapiens
taattggtccgatctttg

SEQ ID NO: 3783886 - DNA, 18 bp, Homo sapiens
taattgtaaactgtacta

SEQ ID NO: 3783887 - DNA, 21 bp, Homo sapiens
taattgttttttatcttttct

SEQ ID NO: 3783888 - DNA, 16 bp, Homo sapiens
taatttaacccagctc

SEQ ID NO: 3783889 - DNA, 21 bp, Homo sapiens
taatttaatgcatgttaggaa

SEQ ID NO: 3783890 - DNA, 12 bp, Homo sapiens
taatttatttat

SEQ ID NO: 3783891 - DNA, 18 bp, Homo sapiens
taatttatttattaagat

SEQ ID NO: 3783892 - DNA, 22 bp, Homo sapiens
taatttctgtgtctaaatttct

SEQ ID NO: 3783893 - DNA, 15 bp, Homo sapiens
taatttcttctcaaa

SEQ ID NO: 3783894 - DNA, 15 bp, Homo sapiens
taatttgactagaaa

SEQ ID NO: 3783895 - DNA, 16 bp, Homo sapiens
taatttgactagaaaa

SEQ ID NO: 3783896 - DNA, 16 bp, Homo sapiens
taatttgatgaaagct

SEQ ID NO: 3783897 - DNA, 18 bp, Homo sapiens
taatttgatgaaagctga

SEQ ID NO: 3783898 - DNA, 13 bp, Homo sapiens
taatttgtgtaat

SEQ ID NO: 3783899 - DNA, 19 bp, Homo sapiens
taattttaagattcctttt

SEQ ID NO: 3783900 - DNA, 14 bp, Homo sapiens
tagctttaccctca

SEQ ID NO: 3783901 - DNA, 15 bp, Homo sapiens
tagctttaccctcag

SEQ ID NO: 3783902 - DNA, 19 bp, Homo sapiens
tagctttactgtttgttat

SEQ ID NO: 3783903 - DNA, 19 bp, Homo sapiens
tagctttattttttaagta

SEQ ID NO: 3783904 - DNA, 22 bp, Homo sapiens
tagctttattttttaagtattt

SEQ ID NO: 3783905 - DNA, 23 bp, Homo sapiens
taggaaaattggacattaagcat

SEQ ID NO: 3783906 - DNA, 14 bp, Homo sapiens
taggaaataaaacc

SEQ ID NO: 3783907 - DNA, 16 bp, Homo sapiens
taggaaataaaacctt

SEQ ID NO: 3783908 - DNA, 17 bp, Homo sapiens
taggaaataaaaccttt

SEQ ID NO: 3783909 - DNA, 14 bp, Homo sapiens
taggaagagaaacc

SEQ ID NO: 3783910 - DNA, 20 bp, Homo sapiens
taggaagtgtaacagctgag

SEQ ID NO: 3783911 - DNA, 21 bp, Homo sapiens
taggaagtgtaacagctgagg

SEQ ID NO: 3783912 - DNA, 23 bp, Homo sapiens
taggaatagcatgtcactaaagc

SEQ ID NO: 3783913 - DNA, 20 bp, Homo sapiens
taggacatgttcccttctcc

SEQ ID NO: 3783914 - DNA, 15 bp, Homo sapiens
taggactctgaggct

SEQ ID NO: 3783915 - DNA, 16 bp, Homo sapiens
taggactctgaggctc

SEQ ID NO: 3783916 - DNA, 19 bp, Homo sapiens
taggagacacatccagcaa

SEQ ID NO: 3783917 - DNA, 21 bp, Homo sapiens
taggagaccaaggcgggagca

SEQ ID NO: 3783918 - DNA, 14 bp, Homo sapiens
taggagagaaggta

SEQ ID NO: 3783919 - DNA, 22 bp, Homo sapiens
taggagataccaggttgaaaga

SEQ ID NO: 3783920 - DNA, 21 bp, Homo sapiens
taggagttcgagaccagcctg

SEQ ID NO: 3783921 - DNA, 19 bp, Homo sapiens
taggcacccatcctagaga

SEQ ID NO: 3783922 - DNA, 21 bp, Homo sapiens
taggcatgagggatcacaggg

SEQ ID NO: 3783923 - DNA, 20 bp, Homo sapiens
taggcatttgctgaatacag

SEQ ID NO: 3783924 - DNA, 15 bp, Homo sapiens
taggcctggccagat

SEQ ID NO: 3783925 - DNA, 18 bp, Homo sapiens
taggcctggccagatgca

SEQ ID NO: 3783926 - DNA, 13 bp, Homo sapiens
taggcctgggtgc

SEQ ID NO: 3783927 - DNA, 19 bp, Homo sapiens
taggcctgggtgctggctg

SEQ ID NO: 3783928 - DNA, 16 bp, Homo sapiens
taggccttcttgtgat

SEQ ID NO: 3783929 - DNA, 16 bp, Homo sapiens
taggcgggaaggaggg

SEQ ID NO: 3783930 - DNA, 14 bp, Homo sapiens
taggctattcacaa

SEQ ID NO: 3783931 - DNA, 22 bp, Homo sapiens
taggctccgtcagtatcaggcc

SEQ ID NO: 3783932 - DNA, 21 bp, Homo sapiens
taggctctgcacagatggatt

SEQ ID NO: 3783933 - DNA, 17 bp, Homo sapiens
taggctgggcccagagg

SEQ ID NO: 3783934 - DNA, 11 bp, Homo sapiens
taggctgggtg

SEQ ID NO: 3783935 - DNA, 12 bp, Homo sapiens
taggcttttgtt

SEQ ID NO: 3783936 - DNA, 16 bp, Homo sapiens
tagggacctggggaag

SEQ ID NO: 3783937 - DNA, 18 bp, Homo sapiens
tagggacctggggaagca

SEQ ID NO: 3783938 - DNA, 14 bp, Homo sapiens
tagggacttaaaaa

SEQ ID NO: 3783939 - DNA, 21 bp, Homo sapiens
tagggaggcctttagcttaag

SEQ ID NO: 3783940 - DNA, 23 bp, Homo sapiens
tagggatagtcaccttttaaatc

SEQ ID NO: 3783941 - DNA, 15 bp, Homo sapiens
tagggattcaggctg

SEQ ID NO: 3783942 - DNA, 14 bp, Homo sapiens
taggtcagtgaggc

SEQ ID NO: 3783943 - DNA, 16 bp, Homo sapiens
taggtggatcacctga

SEQ ID NO: 3783944 - DNA, 20 bp, Homo sapiens
taggtgggccagcccctccc

SEQ ID NO: 3783945 - DNA, 21 bp, Homo sapiens
taggtgggccagcccctccca

SEQ ID NO: 3783946 - DNA, 18 bp, Homo sapiens
taggttaactatgtacaa

SEQ ID NO: 3783947 - DNA, 14 bp, Homo sapiens
tagtaaagaaatga

SEQ ID NO: 3783948 - DNA, 16 bp, Homo sapiens
tagtaagaaaacatca

SEQ ID NO: 3783949 - DNA, 23 bp, Homo sapiens
tagtacaggtaaggtgagggaat

SEQ ID NO: 3783950 - DNA, 12 bp, Homo sapiens
tagtacataaag

SEQ ID NO: 3783951 - DNA, 17 bp, Homo sapiens
tagtacccacctgagct

SEQ ID NO: 3783952 - DNA, 20 bp, Homo sapiens
tagtaccttcagatcctacc

SEQ ID NO: 3783953 - DNA, 14 bp, Homo sapiens
tagtacctttgctc

SEQ ID NO: 3783954 - DNA, 17 bp, Homo sapiens
tagtactatatctgttt

SEQ ID NO: 3783955 - DNA, 17 bp, Homo sapiens
tagtactccttaagaac

SEQ ID NO: 3783956 - DNA, 15 bp, Homo sapiens
tagtagaaattttac

SEQ ID NO: 3783957 - DNA, 19 bp, Homo sapiens
tagtagaaattttacaata

SEQ ID NO: 3783958 - DNA, 20 bp, Homo sapiens
tagtagaaattttacaatag

SEQ ID NO: 3783959 - DNA, 14 bp, Homo sapiens
tagtagagacaggg

SEQ ID NO: 3783960 - DNA, 15 bp, Homo sapiens
tagtagagacagggt

SEQ ID NO: 3783961 - DNA, 12 bp, Homo sapiens
tagtagatttta

SEQ ID NO: 3783962 - DNA, 22 bp, Homo sapiens
tagtagggtgagggataagcaa

SEQ ID NO: 3783963 - DNA, 13 bp, Homo sapiens
tagtatattaaaa

SEQ ID NO: 3783964 - DNA, 20 bp, Homo sapiens
tagtcaccttttaaatcctg

SEQ ID NO: 3783965 - DNA, 18 bp, Homo sapiens
tagtccaatgtcttttta

SEQ ID NO: 3783966 - DNA, 21 bp, Homo sapiens
tagtcccagctactcagaagc

SEQ ID NO: 3783967 - DNA, 15 bp, Homo sapiens
tagtcccttcccctc

SEQ ID NO: 3783968 - DNA, 17 bp, Homo sapiens
tagtctaaccaaatgca

SEQ ID NO: 3783969 - DNA, 14 bp, Homo sapiens
tagtctattagcca

SEQ ID NO: 3783970 - DNA, 13 bp, Homo sapiens
tagtctggtttct

SEQ ID NO: 3783971 - DNA, 23 bp, Homo sapiens
tagtctgtgtgggactgtacaca

SEQ ID NO: 3783972 - DNA, 17 bp, Homo sapiens
tagtcttcaagcagatt

SEQ ID NO: 3783973 - DNA, 18 bp, Homo sapiens
tagtcttctcatagcatt

SEQ ID NO: 3783974 - DNA, 19 bp, Homo sapiens
tagtgagaagaatattgtt

SEQ ID NO: 3783975 - DNA, 15 bp, Homo sapiens
tagtgagacccctgt

SEQ ID NO: 3783976 - DNA, 17 bp, Homo sapiens
tagtgatctgaacagaa

SEQ ID NO: 3783977 - DNA, 13 bp, Homo sapiens
tagtgcagctgat

SEQ ID NO: 3783978 - DNA, 22 bp, Homo sapiens
tagtgcagctgattttaacaat

SEQ ID NO: 3783979 - DNA, 17 bp, Homo sapiens
tagtgccctccacagcc

SEQ ID NO: 3783980 - DNA, 14 bp, Homo sapiens
tagtgcggacaagt

SEQ ID NO: 3783981 - DNA, 12 bp, Homo sapiens
tagtgctgaagc

SEQ ID NO: 3783982 - DNA, 18 bp, Homo sapiens
tagtgctgaagcttatta

SEQ ID NO: 3783983 - DNA, 15 bp, Homo sapiens
tagtggatgttctga

SEQ ID NO: 3783984 - DNA, 18 bp, Homo sapiens
tagtggggtctccctctc

SEQ ID NO: 3783985 - DNA, 20 bp, Homo sapiens
tagtggggtctccctctcct

SEQ ID NO: 3783986 - DNA, 23 bp, Homo sapiens
tagtggggtctccctctcctgcc

SEQ ID NO: 3783987 - DNA, 22 bp, Homo sapiens
tagtggtgttttaaagagaatg

SEQ ID NO: 3783988 - DNA, 13 bp, Homo sapiens
tagtgtaaaaatg

SEQ ID NO: 3783989 - DNA, 16 bp, Homo sapiens
tagtgtaaaaatgaga

SEQ ID NO: 3783990 - DNA, 22 bp, Homo sapiens
tagtgtaaaaatgagaacatgt

SEQ ID NO: 3783991 - DNA, 14 bp, Homo sapiens
tagtgtaggcttta

SEQ ID NO: 3783992 - DNA, 17 bp, Homo sapiens
tagtgtcacttacctag

SEQ ID NO: 3783993 - DNA, 15 bp, Homo sapiens
tagtgtgttctgatt

SEQ ID NO: 3783994 - DNA, 23 bp, Homo sapiens
tagttaatattgtgaagaaaaat

SEQ ID NO: 3783995 - DNA, 23 bp, Homo sapiens
tagttccctgaaaacccagagag

SEQ ID NO: 3783996 - DNA, 20 bp, Homo sapiens
tagttctatttctatcccaa

SEQ ID NO: 3783997 - DNA, 16 bp, Homo sapiens
tagttgcaattgaatt

SEQ ID NO: 3783998 - DNA, 13 bp, Homo sapiens
tagtttaggagaa

SEQ ID NO: 3783999 - DNA, 14 bp, Homo sapiens
tagtttaggagaaa

SEQ ID NO: 3784000 - DNA, 13 bp, Homo sapiens
tagtttgtgagaa

SEQ ID NO: 3784001 - DNA, 17 bp, Homo sapiens
tagttttagttgcagaa

SEQ ID NO: 3784002 - DNA, 23 bp, Homo sapiens
tagttttcatacacagcctgggc

SEQ ID NO: 3784003 - DNA, 13 bp, Homo sapiens
tagttttgtcaaa

SEQ ID NO: 3784004 - DNA, 17 bp, Homo sapiens
tagtttttcttcaacat

SEQ ID NO: 3784005 - DNA, 15 bp, Homo sapiens
tataaaaaaaatgaa

SEQ ID NO: 3784006 - DNA, 16 bp, Homo sapiens
tataaaaaaaatgaaa

SEQ ID NO: 3784007 - DNA, 18 bp, Homo sapiens
tataaaattaaagaaaat

SEQ ID NO: 3784008 - DNA, 14 bp, Homo sapiens
tataaacactatat

SEQ ID NO: 3784009 - DNA, 22 bp, Homo sapiens
tataaactttagagtagcatga

SEQ ID NO: 3784010 - DNA, 15 bp, Homo sapiens
tataaagaacaaggt

SEQ ID NO: 3784011 - DNA, 18 bp, Homo sapiens
tataaagagaaaattgaa

SEQ ID NO: 3784012 - DNA, 22 bp, Homo sapiens
tataaagagaaaattgaattta

SEQ ID NO: 3784013 - DNA, 23 bp, Homo sapiens
tattacacaaatacttattcatt

SEQ ID NO: 3784014 - DNA, 23 bp, Homo sapiens
tattacatccttgtggcacattt

SEQ ID NO: 3784015 - DNA, 17 bp, Homo sapiens
tattacatctttcacat

SEQ ID NO: 3784016 - DNA, 23 bp, Homo sapiens
tattacttatttttgacagtgtt

SEQ ID NO: 3784017 - DNA, 16 bp, Homo sapiens
tattagactttagaaa

SEQ ID NO: 3784018 - DNA, 23 bp, Homo sapiens
tattagccacaaaattgggaaag

SEQ ID NO: 3784019 - DNA, 16 bp, Homo sapiens
tattataacttaaaaa

SEQ ID NO: 3784020 - DNA, 13 bp, Homo sapiens
tattatctttgta

SEQ ID NO: 3784021 - DNA, 15 bp, Homo sapiens
tattatgcaaattcc

SEQ ID NO: 3784022 - DNA, 16 bp, Homo sapiens
tattatgcaaattccc

SEQ ID NO: 3784023 - DNA, 19 bp, Homo sapiens
tattatgcaaattcccaga

SEQ ID NO: 3784024 - DNA, 19 bp, Homo sapiens
tattattcaccatgtaaaa

SEQ ID NO: 3784025 - DNA, 13 bp, Homo sapiens
tattattctgcag

SEQ ID NO: 3784026 - DNA, 16 bp, Homo sapiens
tattattttcacctgt

SEQ ID NO: 3784027 - DNA, 17 bp, Homo sapiens
tattcaagaaagccagt

SEQ ID NO: 3784028 - DNA, 11 bp, Homo sapiens
tattcaaggta

SEQ ID NO: 3784029 - DNA, 19 bp, Homo sapiens
tattcaaggtaaaattcta

SEQ ID NO: 3784030 - DNA, 19 bp, Homo sapiens
tattcaccatgtaaaacaa

SEQ ID NO: 3784031 - DNA, 20 bp, Homo sapiens
tattcaccatgtaaaacaaa

SEQ ID NO: 3784032 - DNA, 18 bp, Homo sapiens
tattccaccttaaattaa

SEQ ID NO: 3784033 - DNA, 19 bp, Homo sapiens
tattccaccttaaattaaa

SEQ ID NO: 3784034 - DNA, 23 bp, Homo sapiens
tattccatagtatattaaaaatg

SEQ ID NO: 3784035 - DNA, 22 bp, Homo sapiens
tattccatgaatgtatcaggaa

SEQ ID NO: 3784036 - DNA, 23 bp, Homo sapiens
tattccatgaatgtatcaggaaa

SEQ ID NO: 3784037 - DNA, 22 bp, Homo sapiens
tattcccctatctctagaattt

SEQ ID NO: 3784038 - DNA, 21 bp, Homo sapiens
tattcctatatagtttattga

SEQ ID NO: 3784039 - DNA, 22 bp, Homo sapiens
tattcctatatagtttattgac

SEQ ID NO: 3784040 - DNA, 19 bp, Homo sapiens
tattcctgcatttgtgaaa

SEQ ID NO: 3784041 - DNA, 16 bp, Homo sapiens
tattctcactccacca

SEQ ID NO: 3784042 - DNA, 13 bp, Homo sapiens
tattctctttggt

SEQ ID NO: 3784043 - DNA, 14 bp, Homo sapiens
tattgacaaactct

SEQ ID NO: 3784044 - DNA, 15 bp, Homo sapiens
tattgacaaactctc

SEQ ID NO: 3784045 - DNA, 20 bp, Homo sapiens
tattgatgtgcaaaaatttt

SEQ ID NO: 3784046 - DNA, 13 bp, Homo sapiens
tattgcccacgct

SEQ ID NO: 3784047 - DNA, 19 bp, Homo sapiens
tattgctgtgtaacactgt

SEQ ID NO: 3784048 - DNA, 22 bp, Homo sapiens
tattggaaatttgttataatga

SEQ ID NO: 3784049 - DNA, 23 bp, Homo sapiens
tattggaggaccaaaaaaataag

SEQ ID NO: 3784050 - DNA, 14 bp, Homo sapiens
tattggcaaagatg

SEQ ID NO: 3784051 - DNA, 22 bp, Homo sapiens
tattggtccagcttgctcttca

SEQ ID NO: 3784052 - DNA, 16 bp, Homo sapiens
tattgtacgtttaaag

SEQ ID NO: 3784053 - DNA, 17 bp, Homo sapiens
tattgtgtgttatttaa

SEQ ID NO: 3784054 - DNA, 17 bp, Homo sapiens
tattgttccaagacatt

SEQ ID NO: 3784055 - DNA, 18 bp, Homo sapiens
tattgttccaagacattg

SEQ ID NO: 3784056 - DNA, 13 bp, Homo sapiens
tattgttcccagt

SEQ ID NO: 3784057 - DNA, 21 bp, Homo sapiens
tattgttcccagtgacacttc

SEQ ID NO: 3784058 - DNA, 14 bp, Homo sapiens
tattgttcctaagt

SEQ ID NO: 3784059 - DNA, 18 bp, Homo sapiens
tattgttcctaagttctt

SEQ ID NO: 3784060 - DNA, 18 bp, Homo sapiens
tattgttttcagtgtaca

SEQ ID NO: 3784061 - DNA, 20 bp, Homo sapiens
tattgttttcagtgtacatg

SEQ ID NO: 3784062 - DNA, 23 bp, Homo sapiens
tatttaaaagaaagcctcagaga

SEQ ID NO: 3784063 - DNA, 12 bp, Homo sapiens
tatttaaagaca

SEQ ID NO: 3784064 - DNA, 18 bp, Homo sapiens
tatttaaagacaaagaca

SEQ ID NO: 3784065 - DNA, 13 bp, Homo sapiens
tatttaaattctt

SEQ ID NO: 3784066 - DNA, 21 bp, Homo sapiens
tatttaagaaaatacaataaa

SEQ ID NO: 3784067 - DNA, 22 bp, Homo sapiens
tatttaagaaaatacaataaac

SEQ ID NO: 3784068 - DNA, 17 bp, Homo sapiens
tatttaagataattata

SEQ ID NO: 3784069 - DNA, 16 bp, Homo sapiens
tatttaagcttatgtc

SEQ ID NO: 3784070 - DNA, 15 bp, Homo sapiens
tatttaagtattcaa

SEQ ID NO: 3784071 - DNA, 18 bp, Homo sapiens
tatttaagtattcaagaa

SEQ ID NO: 3784072 - DNA, 17 bp, Homo sapiens
tatttaattgtaaactg

SEQ ID NO: 3784073 - DNA, 23 bp, Homo sapiens
tatttaatttttttgagacagag

SEQ ID NO: 3784074 - DNA, 17 bp, Homo sapiens
tatttacatatgaaatt

SEQ ID NO: 3784075 - DNA, 21 bp, Homo sapiens
tatttactgagcttctctgtg

SEQ ID NO: 3784076 - DNA, 11 bp, Homo sapiens
tatttagcatg

SEQ ID NO: 3784077 - DNA, 17 bp, Homo sapiens
tatttagggaactgctt

SEQ ID NO: 3784078 - DNA, 20 bp, Homo sapiens
tatttataacaacctaaatt

SEQ ID NO: 3784079 - DNA, 22 bp, Homo sapiens
tatttataactcatcataaaat

SEQ ID NO: 3784080 - DNA, 16 bp, Homo sapiens
tatttatatatgtatt

SEQ ID NO: 3784081 - DNA, 13 bp, Homo sapiens
tatttatatattt

SEQ ID NO: 3784082 - DNA, 21 bp, Homo sapiens
tatttatatttttattttatt

SEQ ID NO: 3784083 - DNA, 13 bp, Homo sapiens
tatttattaaatt

SEQ ID NO: 3784084 - DNA, 15 bp, Homo sapiens
tatttattacctctg

SEQ ID NO: 3784085 - DNA, 14 bp, Homo sapiens
tatttatttaaatt

SEQ ID NO: 3784086 - DNA, 14 bp, Homo sapiens
tatttatttatgga

SEQ ID NO: 3784087 - DNA, 17 bp, Homo sapiens
tatttattttcctcccc

SEQ ID NO: 3784088 - DNA, 15 bp, Homo sapiens
tatttccttaaactg

SEQ ID NO: 3784089 - DNA, 21 bp, Homo sapiens
tatttctgagaaggtccttaa

SEQ ID NO: 3784090 - DNA, 14 bp, Homo sapiens
tatttcttgtttgt

SEQ ID NO: 3784091 - DNA, 14 bp, Homo sapiens
tatttgagacattc

SEQ ID NO: 3784092 - DNA, 15 bp, Homo sapiens
tatttgcatatgtat

SEQ ID NO: 3784093 - DNA, 20 bp, Homo sapiens
tatttgttaatggtttgaat

SEQ ID NO: 3784094 - DNA, 18 bp, Homo sapiens
tattttaaattataagga

SEQ ID NO: 3784095 - DNA, 20 bp, Homo sapiens
tattttaaattataaggact

SEQ ID NO: 3784096 - DNA, 21 bp, Homo sapiens
tattttaaattataaggactg

SEQ ID NO: 3784097 - DNA, 18 bp, Homo sapiens
tattttaacctgcataaa

SEQ ID NO: 3784098 - DNA, 15 bp, Homo sapiens
tattttactgtctta

SEQ ID NO: 3784099 - DNA, 17 bp, Homo sapiens
tattttactgtcttaat

SEQ ID NO: 3784100 - DNA, 21 bp, Homo sapiens
tattttagacaaatctaaggg

SEQ ID NO: 3784101 - DNA, 13 bp, Homo sapiens
tattttagcagtt

SEQ ID NO: 3784102 - DNA, 20 bp, Homo sapiens
tattttagcagttctgcaaa

SEQ ID NO: 3784103 - DNA, 21 bp, Homo sapiens
tattttagcagttctgcaaat

SEQ ID NO: 3784104 - DNA, 22 bp, Homo sapiens
tattttagcagttctgcaaata

SEQ ID NO: 3784105 - DNA, 14 bp, Homo sapiens
tattttatgtatgt

SEQ ID NO: 3784106 - DNA, 16 bp, Homo sapiens
tattttattcaaggta

SEQ ID NO: 3784107 - DNA, 13 bp, Homo sapiens
tattttattccct

SEQ ID NO: 3784108 - DNA, 21 bp, Homo sapiens
tattttcaacgcagccctgct

SEQ ID NO: 3784109 - DNA, 13 bp, Homo sapiens
tattttcagaatc

SEQ ID NO: 3784110 - DNA, 18 bp, Homo sapiens
tattttcccaatagcact

SEQ ID NO: 3784111 - DNA, 22 bp, Homo sapiens
tattttccctattagagaagag

SEQ ID NO: 3784112 - DNA, 22 bp, Homo sapiens
tattttctggtagatagaaata

SEQ ID NO: 3784113 - DNA, 13 bp, Homo sapiens
tattttgtaaact

SEQ ID NO: 3784114 - DNA, 21 bp, Homo sapiens
tattttgttttgtgcagagat

SEQ ID NO: 3784115 - DNA, 22 bp, Homo sapiens
tatttttagatggttacactgt

SEQ ID NO: 3784116 - DNA, 13 bp, Homo sapiens
tatttttatttgt

SEQ ID NO: 3784117 - DNA, 20 bp, Homo sapiens
tatttttgtaattttaaata

SEQ ID NO: 3784118 - DNA, 23 bp, Homo sapiens
tattttttaatttgatgaaagct

SEQ ID NO: 3784119 - DNA, 17 bp, Homo sapiens
tatttttttaaaatcac

SEQ ID NO: 3784120 - DNA, 15 bp, Homo sapiens
tatttttttctacct

SEQ ID NO: 3784121 - DNA, 14 bp, Homo sapiens
tcaaaaaaagaaaa

SEQ ID NO: 3784122 - DNA, 15 bp, Homo sapiens
tcaaaaaaagaaaaa

SEQ ID NO: 3784123 - DNA, 17 bp, Homo sapiens
tcaaaacacttgtaatt

SEQ ID NO: 3784124 - DNA, 17 bp, Homo sapiens
tcaaaaggaaaccaagt

SEQ ID NO: 3784125 - DNA, 21 bp, Homo sapiens
tcagaaatgtctggagaataa

SEQ ID NO: 3784126 - DNA, 21 bp, Homo sapiens
tcagaaatttaattcatgttt

SEQ ID NO: 3784127 - DNA, 19 bp, Homo sapiens
tcagaacaccaagacttga

SEQ ID NO: 3784128 - DNA, 16 bp, Homo sapiens
tcagaacctcttcccc

SEQ ID NO: 3784129 - DNA, 20 bp, Homo sapiens
tcagaacctcttccccagaa

SEQ ID NO: 3784130 - DNA, 14 bp, Homo sapiens
tcagaagacactga

SEQ ID NO: 3784131 - DNA, 20 bp, Homo sapiens
tcagaagcctattgtaaata

SEQ ID NO: 3784132 - DNA, 22 bp, Homo sapiens
tcagaagcctattgtaaataca

SEQ ID NO: 3784133 - DNA, 15 bp, Homo sapiens
tcagaagcctgaggc

SEQ ID NO: 3784134 - DNA, 12 bp, Homo sapiens
tcagaaggagaa

SEQ ID NO: 3784135 - DNA, 18 bp, Homo sapiens
tcagaaggagaaggaagg

SEQ ID NO: 3784136 - DNA, 18 bp, Homo sapiens
tcagaatctgaatgtaat

SEQ ID NO: 3784137 - DNA, 21 bp, Homo sapiens
tcagaatctttccttcctctc

SEQ ID NO: 3784138 - DNA, 15 bp, Homo sapiens
tcagaccataatgtt

SEQ ID NO: 3784139 - DNA, 12 bp, Homo sapiens
tcagaccccagc

SEQ ID NO: 3784140 - DNA, 17 bp, Homo sapiens
tcagaccccagcggctg

SEQ ID NO: 3784141 - DNA, 14 bp, Homo sapiens
tcagaccctacccc

SEQ ID NO: 3784142 - DNA, 16 bp, Homo sapiens
tcagacctgtcttcca

SEQ ID NO: 3784143 - DNA, 17 bp, Homo sapiens
tcagacctgtcttccaa

SEQ ID NO: 3784144 - DNA, 22 bp, Homo sapiens
tcagacctgtcttccaaggaga

SEQ ID NO: 3784145 - DNA, 23 bp, Homo sapiens
tcagacctgtcttccaaggagac

SEQ ID NO: 3784146 - DNA, 14 bp, Homo sapiens
tcagactagtgaca

SEQ ID NO: 3784147 - DNA, 23 bp, Homo sapiens
tcagactttaaagaataatatgc

SEQ ID NO: 3784148 - DNA, 23 bp, Homo sapiens
tcagagacaggaagtcttcaggg

SEQ ID NO: 3784149 - DNA, 17 bp, Homo sapiens
tcagagactcagggccc

SEQ ID NO: 3784150 - DNA, 19 bp, Homo sapiens
tcagagagaatggctttgg

SEQ ID NO: 3784151 - DNA, 22 bp, Homo sapiens
tcagagagcgagcgctacccac

SEQ ID NO: 3784152 - DNA, 16 bp, Homo sapiens
tcagagagctggtagt

SEQ ID NO: 3784153 - DNA, 22 bp, Homo sapiens
tcagagaggccttttggaatgt

SEQ ID NO: 3784154 - DNA, 14 bp, Homo sapiens
tcagagcctgcagt

SEQ ID NO: 3784155 - DNA, 15 bp, Homo sapiens
tcagagctgggaggg

SEQ ID NO: 3784156 - DNA, 23 bp, Homo sapiens
tcagaggacacctgtactggaga

SEQ ID NO: 3784157 - DNA, 15 bp, Homo sapiens
tcagaggctgaggtg

SEQ ID NO: 3784158 - DNA, 21 bp, Homo sapiens
tcagagggaaagtaaatattt

SEQ ID NO: 3784159 - DNA, 21 bp, Homo sapiens
tcagatattttttcagaaata

SEQ ID NO: 3784160 - DNA, 22 bp, Homo sapiens
tcagatattttttcagaaatat

SEQ ID NO: 3784161 - DNA, 21 bp, Homo sapiens
tcagatcatttcaaaactcat

SEQ ID NO: 3784162 - DNA, 12 bp, Homo sapiens
tcagatcctacc

SEQ ID NO: 3784163 - DNA, 14 bp, Homo sapiens
tcagatgcccagag

SEQ ID NO: 3784164 - DNA, 13 bp, Homo sapiens
tcagatgcttctg

SEQ ID NO: 3784165 - DNA, 20 bp, Homo sapiens
tcagatggaaccgcaggaag

SEQ ID NO: 3784166 - DNA, 18 bp, Homo sapiens
tcagatgggaagacatga

SEQ ID NO: 3784167 - DNA, 19 bp, Homo sapiens
tcagattcccagagcaaaa

SEQ ID NO: 3784168 - DNA, 21 bp, Homo sapiens
tcagatttgaactcttcaatc

SEQ ID NO: 3784169 - DNA, 13 bp, Homo sapiens
tcagcaccaccct

SEQ ID NO: 3784170 - DNA, 14 bp, Homo sapiens
tcagcagccctcct

SEQ ID NO: 3784171 - DNA, 15 bp, Homo sapiens
tcagcagccctcctc

SEQ ID NO: 3784172 - DNA, 14 bp, Homo sapiens
tcagcaggaagcaa

SEQ ID NO: 3784173 - DNA, 17 bp, Homo sapiens
tcagcaggaagcaacga

SEQ ID NO: 3784174 - DNA, 18 bp, Homo sapiens
tcagcatcctcagttcct

SEQ ID NO: 3784175 - DNA, 15 bp, Homo sapiens
tcagcatcctggcac

SEQ ID NO: 3784176 - DNA, 17 bp, Homo sapiens
tcagcattctcactcct

SEQ ID NO: 3784177 - DNA, 21 bp, Homo sapiens
tcagcattcttagcctgtggc

SEQ ID NO: 3784178 - DNA, 22 bp, Homo sapiens
tcagccaaatgtaattgaataa

SEQ ID NO: 3784179 - DNA, 12 bp, Homo sapiens
tcagccaggagc

SEQ ID NO: 3784180 - DNA, 21 bp, Homo sapiens
tcagccatgaggagttgctgt

SEQ ID NO: 3784181 - DNA, 16 bp, Homo sapiens
tcagccccagcccagc

SEQ ID NO: 3784182 - DNA, 17 bp, Homo sapiens
tcagccccagcccagcc

SEQ ID NO: 3784183 - DNA, 12 bp, Homo sapiens
tcagcccctcct

SEQ ID NO: 3784184 - DNA, 19 bp, Homo sapiens
tcagcccctcctctgccac

SEQ ID NO: 3784185 - DNA, 11 bp, Homo sapiens
tcagcccctct

SEQ ID NO: 3784186 - DNA, 18 bp, Homo sapiens
tcagccctccctgcccct

SEQ ID NO: 3784187 - DNA, 14 bp, Homo sapiens
tcagccctgccctt

SEQ ID NO: 3784188 - DNA, 23 bp, Homo sapiens
tcagccctgggccccaccaccta

SEQ ID NO: 3784189 - DNA, 23 bp, Homo sapiens
tcagccgtgtaaccatggaccca

SEQ ID NO: 3784190 - DNA, 18 bp, Homo sapiens
tcagcctagccgacctca

SEQ ID NO: 3784191 - DNA, 20 bp, Homo sapiens
tcagcctagccgacctcagc

SEQ ID NO: 3784192 - DNA, 21 bp, Homo sapiens
tcagcctcccgaatagctggg

SEQ ID NO: 3784193 - DNA, 20 bp, Homo sapiens
tcagcctcccgagtagctgg

SEQ ID NO: 3784194 - DNA, 13 bp, Homo sapiens
tcagcctcctgtg

SEQ ID NO: 3784195 - DNA, 21 bp, Homo sapiens
tcagcctcttaaagctgcctg

SEQ ID NO: 3784196 - DNA, 22 bp, Homo sapiens
tcagcctcttaaagctgcctgt

SEQ ID NO: 3784197 - DNA, 19 bp, Homo sapiens
tcagcctgctccagctgtt

SEQ ID NO: 3784198 - DNA, 12 bp, Homo sapiens
tcagcctgggca

SEQ ID NO: 3784199 - DNA, 14 bp, Homo sapiens
tcagcctggtgggc

SEQ ID NO: 3784200 - DNA, 18 bp, Homo sapiens
tcagcctggtgggcctcc

SEQ ID NO: 3784201 - DNA, 19 bp, Homo sapiens
tcagcctggtgggcctcct

SEQ ID NO: 3784202 - DNA, 17 bp, Homo sapiens
tcagcctgtgctgcccg

SEQ ID NO: 3784203 - DNA, 22 bp, Homo sapiens
tcagccttccccctcccagggc

SEQ ID NO: 3784204 - DNA, 22 bp, Homo sapiens
tcagccttccccttgcccaggg

SEQ ID NO: 3784205 - DNA, 23 bp, Homo sapiens
tcagccttccccttgcccagggc

SEQ ID NO: 3784206 - DNA, 15 bp, Homo sapiens
tcagcggggacagct

SEQ ID NO: 3784207 - DNA, 18 bp, Homo sapiens
tcagcggggacagctcct

SEQ ID NO: 3784208 - DNA, 20 bp, Homo sapiens
tcagctactaatgatgtttt

SEQ ID NO: 3784209 - DNA, 19 bp, Homo sapiens
tcagctatttactgccaaa

SEQ ID NO: 3784210 - DNA, 12 bp, Homo sapiens
tcagctccagct

SEQ ID NO: 3784211 - DNA, 13 bp, Homo sapiens
tcagctccagctg

SEQ ID NO: 3784212 - DNA, 23 bp, Homo sapiens
tcagctctgcaagaattgaagca

SEQ ID NO: 3784213 - DNA, 16 bp, Homo sapiens
tcagctctggctcaca

SEQ ID NO: 3784214 - DNA, 17 bp, Homo sapiens
tcagctctggctcacag

SEQ ID NO: 3784215 - DNA, 22 bp, Homo sapiens
tcagctcttctccatcctacca

SEQ ID NO: 3784216 - DNA, 16 bp, Homo sapiens
tcagctgaacctgggt

SEQ ID NO: 3784217 - DNA, 12 bp, Homo sapiens
tcagctgccccc

SEQ ID NO: 3784218 - DNA, 24 bp, Homo sapiens
tcagctgcctcacttcctacaaga

SEQ ID NO: 3784219 - DNA, 21 bp, Homo sapiens
tcagctggcactgtctctgct

SEQ ID NO: 3784220 - DNA, 15 bp, Homo sapiens
tcagctgtttgtcat

SEQ ID NO: 3784221 - DNA, 16 bp, Homo sapiens
tcagctgtttgtcata

SEQ ID NO: 3784222 - DNA, 20 bp, Homo sapiens
tcagcttgtaaatagctcag

SEQ ID NO: 3784223 - DNA, 20 bp, Homo sapiens
tcagctttttgtcttttctg

SEQ ID NO: 3784224 - DNA, 22 bp, Homo sapiens
tcaggaaaactgacagaggagg

SEQ ID NO: 3784225 - DNA, 21 bp, Homo sapiens
tcaggaaatatatatgtgtgt

SEQ ID NO: 3784226 - DNA, 14 bp, Homo sapiens
tcaggaacagaagg

SEQ ID NO: 3784227 - DNA, 16 bp, Homo sapiens
tcaggaacagaaggat

SEQ ID NO: 3784228 - DNA, 17 bp, Homo sapiens
tcaggaaggatgagcat

SEQ ID NO: 3784229 - DNA, 12 bp, Homo sapiens
tcaggacactaa

SEQ ID NO: 3784230 - DNA, 17 bp, Homo sapiens
tcaggaccctcgctggc

SEQ ID NO: 3784231 - DNA, 21 bp, Homo sapiens
tcaggaccctcgctggccccc

SEQ ID NO: 3784232 - DNA, 22 bp, Homo sapiens
tcaggaccctcgctggccccca

SEQ ID NO: 3784233 - DNA, 14 bp, Homo sapiens
tcaggactccagcc

SEQ ID NO: 3784234 - DNA, 18 bp, Homo sapiens
tcaggactccagcccatt

SEQ ID NO: 3784235 - DNA, 23 bp, Homo sapiens
tcaggaggaaggcttacacccac

SEQ ID NO: 3784236 - DNA, 13 bp, Homo sapiens
tcaggaggctgga

SEQ ID NO: 3784237 - DNA, 14 bp, Homo sapiens
tcccatcaaaactc

SEQ ID NO: 3784238 - DNA, 18 bp, Homo sapiens
tcccatcccatcccgctc

SEQ ID NO: 3784239 - DNA, 15 bp, Homo sapiens
tcccatcccgctctt

SEQ ID NO: 3784240 - DNA, 20 bp, Homo sapiens
tcccatcccgctcttttcct

SEQ ID NO: 3784241 - DNA, 21 bp, Homo sapiens
tcccatcttaactctttgcct

SEQ ID NO: 3784242 - DNA, 14 bp, Homo sapiens
tcccattgaaaatg

SEQ ID NO: 3784243 - DNA, 13 bp, Homo sapiens
tcccattgccctg

SEQ ID NO: 3784244 - DNA, 14 bp, Homo sapiens
tcccattgccctgg

SEQ ID NO: 3784245 - DNA, 18 bp, Homo sapiens
tcccattttggaagtttt

SEQ ID NO: 3784246 - DNA, 16 bp, Homo sapiens
tccccaaccctgcccc

SEQ ID NO: 3784247 - DNA, 17 bp, Homo sapiens
tccccaaccctgcccct

SEQ ID NO: 3784248 - DNA, 19 bp, Homo sapiens
tccccaaccctgcccctgc

SEQ ID NO: 3784249 - DNA, 12 bp, Homo sapiens
tccccaccctga

SEQ ID NO: 3784250 - DNA, 20 bp, Homo sapiens
tccccaccttcaattcctgg

SEQ ID NO: 3784251 - DNA, 18 bp, Homo sapiens
tccccagattgcaacagg

SEQ ID NO: 3784252 - DNA, 19 bp, Homo sapiens
tccccagcaggtggggagg

SEQ ID NO: 3784253 - DNA, 14 bp, Homo sapiens
tccccagcccactg

SEQ ID NO: 3784254 - DNA, 12 bp, Homo sapiens
tccccagcccag

SEQ ID NO: 3784255 - DNA, 22 bp, Homo sapiens
tccccagcccagggttccccca

SEQ ID NO: 3784256 - DNA, 14 bp, Homo sapiens
tccccagcctctct

SEQ ID NO: 3784257 - DNA, 17 bp, Homo sapiens
tccccagcctctcttcc

SEQ ID NO: 3784258 - DNA, 20 bp, Homo sapiens
tccccaggccccaggaagcc

SEQ ID NO: 3784259 - DNA, 21 bp, Homo sapiens
tccccaggccgtggctgccca

SEQ ID NO: 3784260 - DNA, 23 bp, Homo sapiens
tccccaggccgtggctgcccaca

SEQ ID NO: 3784261 - DNA, 20 bp, Homo sapiens
tccccaggggtcccagccac

SEQ ID NO: 3784262 - DNA, 23 bp, Homo sapiens
tccccaggggtcccagccacccc

SEQ ID NO: 3784263 - DNA, 19 bp, Homo sapiens
tccccaggtggctgaccca

SEQ ID NO: 3784264 - DNA, 16 bp, Homo sapiens
tccccatactctgtct

SEQ ID NO: 3784265 - DNA, 18 bp, Homo sapiens
tccccatactctgtctcc

SEQ ID NO: 3784266 - DNA, 17 bp, Homo sapiens
tccccattcttcctagt

SEQ ID NO: 3784267 - DNA, 13 bp, Homo sapiens
tcccccaaagtgg

SEQ ID NO: 3784268 - DNA, 20 bp, Homo sapiens
tcccccaacccccaccccac

SEQ ID NO: 3784269 - DNA, 21 bp, Homo sapiens
tcccccaccccctccccaggg

SEQ ID NO: 3784270 - DNA, 11 bp, Homo sapiens
tcccccagccc

SEQ ID NO: 3784271 - DNA, 12 bp, Homo sapiens
tcccccagccct

SEQ ID NO: 3784272 - DNA, 16 bp, Homo sapiens
tcccccagtacctcca

SEQ ID NO: 3784273 - DNA, 12 bp, Homo sapiens
tcccccatagcc

SEQ ID NO: 3784274 - DNA, 17 bp, Homo sapiens
tcccccatcctcccctt

SEQ ID NO: 3784275 - DNA, 19 bp, Homo sapiens
tccccccactgcaggcccc

SEQ ID NO: 3784276 - DNA, 23 bp, Homo sapiens
tccccccactgcaggccccgctt

SEQ ID NO: 3784277 - DNA, 20 bp, Homo sapiens
tcccccgcaatgtgccccca

SEQ ID NO: 3784278 - DNA, 21 bp, Homo sapiens
tcccccgcaatgtgcccccag

SEQ ID NO: 3784279 - DNA, 18 bp, Homo sapiens
tccccctcccagggccag

SEQ ID NO: 3784280 - DNA, 18 bp, Homo sapiens
tccccctgccagtgcctt

SEQ ID NO: 3784281 - DNA, 13 bp, Homo sapiens
tccccctgcccca

SEQ ID NO: 3784282 - DNA, 12 bp, Homo sapiens
tccccctgggct

SEQ ID NO: 3784283 - DNA, 20 bp, Homo sapiens
tccccctgggctctgcccca

SEQ ID NO: 3784284 - DNA, 18 bp, Homo sapiens
tccccgcattccaggctc

SEQ ID NO: 3784285 - DNA, 17 bp, Homo sapiens
tccccgctggctggggg

SEQ ID NO: 3784286 - DNA, 13 bp, Homo sapiens
tccccggctcgag

SEQ ID NO: 3784287 - DNA, 21 bp, Homo sapiens
tcccctatccacccagcccat

SEQ ID NO: 3784288 - DNA, 19 bp, Homo sapiens
tcccctatggggatggtcc

SEQ ID NO: 3784289 - DNA, 13 bp, Homo sapiens
tcccctcattcag

SEQ ID NO: 3784290 - DNA, 14 bp, Homo sapiens
tcccctccctcctc

SEQ ID NO: 3784291 - DNA, 16 bp, Homo sapiens
tcccctccctcctctg

SEQ ID NO: 3784292 - DNA, 21 bp, Homo sapiens
tcccctccctggctcccatga

SEQ ID NO: 3784293 - DNA, 14 bp, Homo sapiens
tcccctcctcactc

SEQ ID NO: 3784294 - DNA, 21 bp, Homo sapiens
tcccctcttatgtacctcttt

SEQ ID NO: 3784295 - DNA, 14 bp, Homo sapiens
tcccctgcactgga

SEQ ID NO: 3784296 - DNA, 23 bp, Homo sapiens
tcccctgcccccagaccttttat

SEQ ID NO: 3784297 - DNA, 13 bp, Homo sapiens
tcccctgccctgg

SEQ ID NO: 3784298 - DNA, 15 bp, Homo sapiens
tcccctgccctggtc

SEQ ID NO: 3784299 - DNA, 17 bp, Homo sapiens
tcccctgccctggtcca

SEQ ID NO: 3784300 - DNA, 15 bp, Homo sapiens
tcccctgttcactct

SEQ ID NO: 3784301 - DNA, 13 bp, Homo sapiens
tccccttcactcc

SEQ ID NO: 3784302 - DNA, 15 bp, Homo sapiens
tccccttccctgcaa

SEQ ID NO: 3784303 - DNA, 19 bp, Homo sapiens
tccccttcgcgtatttcag

SEQ ID NO: 3784304 - DNA, 13 bp, Homo sapiens
tccccttgcccag

SEQ ID NO: 3784305 - DNA, 15 bp, Homo sapiens
tccccttgcccaggg

SEQ ID NO: 3784306 - DNA, 24 bp, Homo sapiens
tcccctttgcttcattcaagtcag

SEQ ID NO: 3784307 - DNA, 16 bp, Homo sapiens
tcccgaatagctggga

SEQ ID NO: 3784308 - DNA, 20 bp, Homo sapiens
tcccgaatagctgggactac

SEQ ID NO: 3784309 - DNA, 15 bp, Homo sapiens
tcccgagtagctggg

SEQ ID NO: 3784310 - DNA, 20 bp, Homo sapiens
tcccgagtagctgggactac

SEQ ID NO: 3784311 - DNA, 19 bp, Homo sapiens
tcccgattcaccctgtcca

SEQ ID NO: 3784312 - DNA, 16 bp, Homo sapiens
tccctacctcaacctg

SEQ ID NO: 3784313 - DNA, 16 bp, Homo sapiens
tccctacttcctgtga

SEQ ID NO: 3784314 - DNA, 17 bp, Homo sapiens
tccctagagggttcctg

SEQ ID NO: 3784315 - DNA, 16 bp, Homo sapiens
tccctagtaaaaatac

SEQ ID NO: 3784316 - DNA, 16 bp, Homo sapiens
tccctataatgctgga

SEQ ID NO: 3784317 - DNA, 21 bp, Homo sapiens
tccctatcactgaagcttttt

SEQ ID NO: 3784318 - DNA, 18 bp, Homo sapiens
tccctattagagaagaga

SEQ ID NO: 3784319 - DNA, 18 bp, Homo sapiens
tccctcaaagcttccatt

SEQ ID NO: 3784320 - DNA, 20 bp, Homo sapiens
tccctcagtctggcccttcc

SEQ ID NO: 3784321 - DNA, 18 bp, Homo sapiens
tccctccacgttcacccc

SEQ ID NO: 3784322 - DNA, 20 bp, Homo sapiens
tccctccacgttcacccctc

SEQ ID NO: 3784323 - DNA, 18 bp, Homo sapiens
tccctccccctgcccctt

SEQ ID NO: 3784324 - DNA, 14 bp, Homo sapiens
tccctcccctgccc

SEQ ID NO: 3784325 - DNA, 16 bp, Homo sapiens
tccctcccctgccctg

SEQ ID NO: 3784326 - DNA, 10 bp, Homo sapiens
tccctccctt

SEQ ID NO: 3784327 - DNA, 14 bp, Homo sapiens
tccctcctcacctc

SEQ ID NO: 3784328 - DNA, 16 bp, Homo sapiens
tccctcctcacctctg

SEQ ID NO: 3784329 - DNA, 14 bp, Homo sapiens
tccctcctgctact

SEQ ID NO: 3784330 - DNA, 19 bp, Homo sapiens
tccctcgctgcacaaatac

SEQ ID NO: 3784331 - DNA, 14 bp, Homo sapiens
tccctctaatttat

SEQ ID NO: 3784332 - DNA, 16 bp, Homo sapiens
tccctctaatttatct

SEQ ID NO: 3784333 - DNA, 19 bp, Homo sapiens
tccctctcaggcatgcctg

SEQ ID NO: 3784334 - DNA, 20 bp, Homo sapiens
tccctctcaggcatgcctgt

SEQ ID NO: 3784335 - DNA, 22 bp, Homo sapiens
tccctctcggaaggctggctgg

SEQ ID NO: 3784336 - DNA, 23 bp, Homo sapiens
tccctctcggaaggctggctggg

SEQ ID NO: 3784337 - DNA, 12 bp, Homo sapiens
tccctctctctg

SEQ ID NO: 3784338 - DNA, 18 bp, Homo sapiens
tccctctctcttctgctc

SEQ ID NO: 3784339 - DNA, 18 bp, Homo sapiens
tccctctgacctgcaggc

SEQ ID NO: 3784340 - DNA, 11 bp, Homo sapiens
tccctctgcct

SEQ ID NO: 3784341 - DNA, 20 bp, Homo sapiens
tccctctgcctgtccctctc

SEQ ID NO: 3784342 - DNA, 14 bp, Homo sapiens
tccctctttccctc

SEQ ID NO: 3784343 - DNA, 20 bp, Homo sapiens
tccctctttccctcccttcc

SEQ ID NO: 3784344 - DNA, 15 bp, Homo sapiens
tccctgaaaacccag

SEQ ID NO: 3784345 - DNA, 17 bp, Homo sapiens
tccctgaaaacccagag

SEQ ID NO: 3784346 - DNA, 15 bp, Homo sapiens
tccctgaaccatccc

SEQ ID NO: 3784347 - DNA, 16 bp, Homo sapiens
tccctgaccctgcaga

SEQ ID NO: 3784348 - DNA, 21 bp, Homo sapiens
tccctgacctccctctaattt

SEQ ID NO: 3784349 - DNA, 17 bp, Homo sapiens
tccctgactctctgtga

SEQ ID NO: 3784350 - DNA, 20 bp, Homo sapiens
tccctgcacttgcagactct

SEQ ID NO: 3784351 - DNA, 19 bp, Homo sapiens
tgattgctgtgtccaactc

SEQ ID NO: 3784352 - DNA, 17 bp, Homo sapiens
tgattggtgcaaccctt

SEQ ID NO: 3784353 - DNA, 19 bp, Homo sapiens
tgattggtgcaacccttac

SEQ ID NO: 3784354 - DNA, 19 bp, Homo sapiens
tgattgtacagaatcattg

SEQ ID NO: 3784355 - DNA, 19 bp, Homo sapiens
tgattgttaatttacagct

SEQ ID NO: 3784356 - DNA, 20 bp, Homo sapiens
tgatttaataacataacaaa

SEQ ID NO: 3784357 - DNA, 17 bp, Homo sapiens
tgatttagattgagtaa

SEQ ID NO: 3784358 - DNA, 20 bp, Homo sapiens
tgatttagattgagtaagat

SEQ ID NO: 3784359 - DNA, 17 bp, Homo sapiens
tgatttcatttcaactg

SEQ ID NO: 3784360 - DNA, 12 bp, Homo sapiens
tgattttaacaa

SEQ ID NO: 3784361 - DNA, 19 bp, Homo sapiens
tgattttaacaataactac

SEQ ID NO: 3784362 - DNA, 16 bp, Homo sapiens
tgatttttttttttca

SEQ ID NO: 3784363 - DNA, 17 bp, Homo sapiens
tgcaaaaatttttggat

SEQ ID NO: 3784364 - DNA, 18 bp, Homo sapiens
tgcaaaacatgctacctg

SEQ ID NO: 3784365 - DNA, 23 bp, Homo sapiens
tgcaaaaggttcactaaagcagt

SEQ ID NO: 3784366 - DNA, 15 bp, Homo sapiens
tgcaaaatttccagt

SEQ ID NO: 3784367 - DNA, 20 bp, Homo sapiens
tgcaaacataacaaaatcac

SEQ ID NO: 3784368 - DNA, 19 bp, Homo sapiens
tgcaaagaggcaagaggct

SEQ ID NO: 3784369 - DNA, 12 bp, Homo sapiens
tgcaaaggactg

SEQ ID NO: 3784370 - DNA, 21 bp, Homo sapiens
tgcaaagggtatcaggtgctg

SEQ ID NO: 3784371 - DNA, 17 bp, Homo sapiens
tgcaaatagaaaacagg

SEQ ID NO: 3784372 - DNA, 24 bp, Homo sapiens
tgcaaatggtggttgtttcttcca

SEQ ID NO: 3784373 - DNA, 15 bp, Homo sapiens
tgcaacaacatgtat

SEQ ID NO: 3784374 - DNA, 13 bp, Homo sapiens
tgcaacacacaga

SEQ ID NO: 3784375 - DNA, 15 bp, Homo sapiens
tgcaacacacagaca

SEQ ID NO: 3784376 - DNA, 19 bp, Homo sapiens
tgcaacaggctgggcttca

SEQ ID NO: 3784377 - DNA, 20 bp, Homo sapiens
tgcaacaggctgggcttcag

SEQ ID NO: 3784378 - DNA, 13 bp, Homo sapiens
tgcaacagtagca

SEQ ID NO: 3784379 - DNA, 20 bp, Homo sapiens
tgcaacctccgcctcttggg

SEQ ID NO: 3784380 - DNA, 21 bp, Homo sapiens
tgcaacctccgcctcttgggt

SEQ ID NO: 3784381 - DNA, 17 bp, Homo sapiens
tgcaacttctttttatt

SEQ ID NO: 3784382 - DNA, 18 bp, Homo sapiens
tgcaacttgtaaatgtgg

SEQ ID NO: 3784383 - DNA, 19 bp, Homo sapiens
tgcaaggaagccacagctg

SEQ ID NO: 3784384 - DNA, 12 bp, Homo sapiens
tgcaaggaagga

SEQ ID NO: 3784385 - DNA, 15 bp, Homo sapiens
tgcaaggaaggaaag

SEQ ID NO: 3784386 - DNA, 16 bp, Homo sapiens
tgcaaggaaggaaaga

SEQ ID NO: 3784387 - DNA, 18 bp, Homo sapiens
tgcaaggggaaaatctca

SEQ ID NO: 3784388 - DNA, 16 bp, Homo sapiens
tgcaaggtctttggtt

SEQ ID NO: 3784389 - DNA, 19 bp, Homo sapiens
tgcaagtactgctgtaaat

SEQ ID NO: 3784390 - DNA, 15 bp, Homo sapiens
tgcaagtatgtgagt

SEQ ID NO: 3784391 - DNA, 18 bp, Homo sapiens
tgcaagtatgtgagtgtg

SEQ ID NO: 3784392 - DNA, 19 bp, Homo sapiens
tgcaagtatgttttagcat

SEQ ID NO: 3784393 - DNA, 22 bp, Homo sapiens
tgcaagtatgttttagcatgtg

SEQ ID NO: 3784394 - DNA, 23 bp, Homo sapiens
tgcaagtgagcaaacctgcccca

SEQ ID NO: 3784395 - DNA, 16 bp, Homo sapiens
tgcaagtgtctgtgtg

SEQ ID NO: 3784396 - DNA, 19 bp, Homo sapiens
tgcaagtgtgtatgtgcgt

SEQ ID NO: 3784397 - DNA, 13 bp, Homo sapiens
tgcaagtgtgtgc

SEQ ID NO: 3784398 - DNA, 23 bp, Homo sapiens
tgcaagtgtgtgcacatgtgtgc

SEQ ID NO: 3784399 - DNA, 14 bp, Homo sapiens
tgcaatggcagcct

SEQ ID NO: 3784400 - DNA, 16 bp, Homo sapiens
tgcaatgtgctactga

SEQ ID NO: 3784401 - DNA, 22 bp, Homo sapiens
tgcaattgtaggggtgtgtgtg

SEQ ID NO: 3784402 - DNA, 17 bp, Homo sapiens
tgcaattttaacacaca

SEQ ID NO: 3784403 - DNA, 21 bp, Homo sapiens
tgcacaaatatttattttctt

SEQ ID NO: 3784404 - DNA, 21 bp, Homo sapiens
tgcacaagctgcaccctcagg

SEQ ID NO: 3784405 - DNA, 21 bp, Homo sapiens
tgcacacaccagagcccacct

SEQ ID NO: 3784406 - DNA, 22 bp, Homo sapiens
tgcacacaccagagcccacctt

SEQ ID NO: 3784407 - DNA, 19 bp, Homo sapiens
tgcacacattaggcattga

SEQ ID NO: 3784408 - DNA, 21 bp, Homo sapiens
tgcacactcccctgcactgga

SEQ ID NO: 3784409 - DNA, 19 bp, Homo sapiens
tgcacagacgtccctccac

SEQ ID NO: 3784410 - DNA, 19 bp, Homo sapiens
tgcacagatggatttgcct

SEQ ID NO: 3784411 - DNA, 15 bp, Homo sapiens
tgcacagtgcatctc

SEQ ID NO: 3784412 - DNA, 18 bp, Homo sapiens
tgcacagtgcatctcagc

SEQ ID NO: 3784413 - DNA, 20 bp, Homo sapiens
tgcacagtgcatctcagccc

SEQ ID NO: 3784414 - DNA, 15 bp, Homo sapiens
tgcacatacttgaga

SEQ ID NO: 3784415 - DNA, 14 bp, Homo sapiens
tgcaccactgcact

SEQ ID NO: 3784416 - DNA, 15 bp, Homo sapiens
tgcaccactgcactc

SEQ ID NO: 3784417 - DNA, 21 bp, Homo sapiens
tgcaccactgcactccagcct

SEQ ID NO: 3784418 - DNA, 13 bp, Homo sapiens
tgcaccagccctt

SEQ ID NO: 3784419 - DNA, 10 bp, Homo sapiens
tgcaccagga

SEQ ID NO: 3784420 - DNA, 15 bp, Homo sapiens
tgcaccattgctgct

SEQ ID NO: 3784421 - DNA, 21 bp, Homo sapiens
tgcacccactctgctttgact

SEQ ID NO: 3784422 - DNA, 14 bp, Homo sapiens
tgcaccccaagtcc

SEQ ID NO: 3784423 - DNA, 20 bp, Homo sapiens
tgcaccgccggccagctggg

SEQ ID NO: 3784424 - DNA, 14 bp, Homo sapiens
tgcaccgggccaca

SEQ ID NO: 3784425 - DNA, 15 bp, Homo sapiens
tgcaccgggccacag

SEQ ID NO: 3784426 - DNA, 17 bp, Homo sapiens
tgcaccgggccacagag

SEQ ID NO: 3784427 - DNA, 20 bp, Homo sapiens
tgcacctccccccactgcag

SEQ ID NO: 3784428 - DNA, 18 bp, Homo sapiens
tgcacctgcatccgtagt

SEQ ID NO: 3784429 - DNA, 20 bp, Homo sapiens
tgcacctgccagcctggctt

SEQ ID NO: 3784430 - DNA, 22 bp, Homo sapiens
tgcacctgccagcctggcttct

SEQ ID NO: 3784431 - DNA, 22 bp, Homo sapiens
tgcaccttatcttaaagcactt

SEQ ID NO: 3784432 - DNA, 17 bp, Homo sapiens
tgcacgcacactgtctg

SEQ ID NO: 3784433 - DNA, 16 bp, Homo sapiens
tgcacgtacacacaca

SEQ ID NO: 3784434 - DNA, 20 bp, Homo sapiens
tgcacgtggagagctggtgc

SEQ ID NO: 3784435 - DNA, 21 bp, Homo sapiens
tgcacgtggagagctggtgcc

SEQ ID NO: 3784436 - DNA, 12 bp, Homo sapiens
tgcacgtgtgca

SEQ ID NO: 3784437 - DNA, 14 bp, Homo sapiens
tgcacgtgtgtgca

SEQ ID NO: 3784438 - DNA, 15 bp, Homo sapiens
tgcacgtgtgtgcac

SEQ ID NO: 3784439 - DNA, 22 bp, Homo sapiens
tgcactatagcctaggtgacag

SEQ ID NO: 3784440 - DNA, 20 bp, Homo sapiens
tgcactccagcctgggcaac

SEQ ID NO: 3784441 - DNA, 19 bp, Homo sapiens
tgcactccagcctgggcga

SEQ ID NO: 3784442 - DNA, 18 bp, Homo sapiens
tgcactgacattgttggc

SEQ ID NO: 3784443 - DNA, 15 bp, Homo sapiens
tgcactggagtccag

SEQ ID NO: 3784444 - DNA, 20 bp, Homo sapiens
tgcactggagtccagtctct

SEQ ID NO: 3784445 - DNA, 16 bp, Homo sapiens
tgcactgtatgctgga

SEQ ID NO: 3784446 - DNA, 16 bp, Homo sapiens
tgcacttaaatatcaa

SEQ ID NO: 3784447 - DNA, 22 bp, Homo sapiens
tgcacttatttatgaacctgcc

SEQ ID NO: 3784448 - DNA, 15 bp, Homo sapiens
tgcacttggcctctg

SEQ ID NO: 3784449 - DNA, 14 bp, Homo sapiens
tgcagaaacagatt

SEQ ID NO: 3784450 - DNA, 13 bp, Homo sapiens
tgcagacaggcaa

SEQ ID NO: 3784451 - DNA, 23 bp, Homo sapiens
tgcagacaggccatgtgagccac

SEQ ID NO: 3784452 - DNA, 14 bp, Homo sapiens
tgcagactcagttt

SEQ ID NO: 3784453 - DNA, 15 bp, Homo sapiens
tgcagactcagtttg

SEQ ID NO: 3784454 - DNA, 20 bp, Homo sapiens
tgcagactctacagaggcca

SEQ ID NO: 3784455 - DNA, 22 bp, Homo sapiens
tgcagactctacagaggccatg

SEQ ID NO: 3784456 - DNA, 14 bp, Homo sapiens
tgcagactggaggg

SEQ ID NO: 3784457 - DNA, 20 bp, Homo sapiens
tgcagagacaggacctgact

SEQ ID NO: 3784458 - DNA, 13 bp, Homo sapiens
tgcagaggggaaa

SEQ ID NO: 3784459 - DNA, 22 bp, Homo sapiens
tgcagaggggctttctggagag

SEQ ID NO: 3784460 - DNA, 19 bp, Homo sapiens
tgcagagggtactttaaga

SEQ ID NO: 3784461 - DNA, 17 bp, Homo sapiens
tgcagagtcagcagaac

SEQ ID NO: 3784462 - DNA, 16 bp, Homo sapiens
tgcagatgccagagca

SEQ ID NO: 3784463 - DNA, 12 bp, Homo sapiens
tggagagagggg

SEQ ID NO: 3784464 - DNA, 11 bp, Homo sapiens
tggagagctgg

SEQ ID NO: 3784465 - DNA, 22 bp, Homo sapiens
tggagaggagggatgctgcctg

SEQ ID NO: 3784466 - DNA, 23 bp, Homo sapiens
tggagaggagggatgctgcctga

SEQ ID NO: 3784467 - DNA, 13 bp, Homo sapiens
tggagagggatga

SEQ ID NO: 3784468 - DNA, 21 bp, Homo sapiens
tggagagggatgaggtgctgg

SEQ ID NO: 3784469 - DNA, 20 bp, Homo sapiens
tggagataaagatttcttga

SEQ ID NO: 3784470 - DNA, 18 bp, Homo sapiens
tggagcacaaaagcctct

SEQ ID NO: 3784471 - DNA, 22 bp, Homo sapiens
tggagcactctgagtttaccat

SEQ ID NO: 3784472 - DNA, 17 bp, Homo sapiens
tggagccacctgtccca

SEQ ID NO: 3784473 - DNA, 15 bp, Homo sapiens
tggagcccagggagc

SEQ ID NO: 3784474 - DNA, 16 bp, Homo sapiens
tggagccccactgccc

SEQ ID NO: 3784475 - DNA, 22 bp, Homo sapiens
tggagccccactgcccttctca

SEQ ID NO: 3784476 - DNA, 18 bp, Homo sapiens
tggagcccgaggcaccag

SEQ ID NO: 3784477 - DNA, 17 bp, Homo sapiens
tggagcccgcaccccca

SEQ ID NO: 3784478 - DNA, 19 bp, Homo sapiens
tggagcccgcacccccacc

SEQ ID NO: 3784479 - DNA, 21 bp, Homo sapiens
tggagcgcacctgccccctgg

SEQ ID NO: 3784480 - DNA, 22 bp, Homo sapiens
tggagcgcacctgccccctggt

SEQ ID NO: 3784481 - DNA, 23 bp, Homo sapiens
tggagcttctctttaactcagga

SEQ ID NO: 3784482 - DNA, 23 bp, Homo sapiens
tggaggaaaaccaagccgtggct

SEQ ID NO: 3784483 - DNA, 21 bp, Homo sapiens
tggaggaaggggggttgcagt

SEQ ID NO: 3784484 - DNA, 16 bp, Homo sapiens
tggaggaatgctcccc

SEQ ID NO: 3784485 - DNA, 14 bp, Homo sapiens
tggaggagaagaat

SEQ ID NO: 3784486 - DNA, 15 bp, Homo sapiens
tggaggagagcctgg

SEQ ID NO: 3784487 - DNA, 19 bp, Homo sapiens
tggaggagctcaggacact

SEQ ID NO: 3784488 - DNA, 22 bp, Homo sapiens
tggaggagctcaggacactaat

SEQ ID NO: 3784489 - DNA, 22 bp, Homo sapiens
tggaggagcttgggggatgact

SEQ ID NO: 3784490 - DNA, 12 bp, Homo sapiens
tggaggaggagg

SEQ ID NO: 3784491 - DNA, 14 bp, Homo sapiens
tggaggaggaggca

SEQ ID NO: 3784492 - DNA, 14 bp, Homo sapiens
tggaggcctctggg

SEQ ID NO: 3784493 - DNA, 20 bp, Homo sapiens
tggaggggtggtcctgactc

SEQ ID NO: 3784494 - DNA, 20 bp, Homo sapiens
tggagggtgggagagcccag

SEQ ID NO: 3784495 - DNA, 14 bp, Homo sapiens
tggaggtacactct

SEQ ID NO: 3784496 - DNA, 16 bp, Homo sapiens
tggaggtggggcatgg

SEQ ID NO: 3784497 - DNA, 13 bp, Homo sapiens
tggagtggatgcc

SEQ ID NO: 3784498 - DNA, 20 bp, Homo sapiens
tggagtgtgtattgttccca

SEQ ID NO: 3784499 - DNA, 17 bp, Homo sapiens
tggagttttaactgtaa

SEQ ID NO: 3784500 - DNA, 14 bp, Homo sapiens
tggataattttgca

SEQ ID NO: 3784501 - DNA, 13 bp, Homo sapiens
tggatagatgccc

SEQ ID NO: 3784502 - DNA, 13 bp, Homo sapiens
tggatagcatgtc

SEQ ID NO: 3784503 - DNA, 16 bp, Homo sapiens
tggatagcatgtcttt

SEQ ID NO: 3784504 - DNA, 23 bp, Homo sapiens
tggatattttcaaattgtatcta

SEQ ID NO: 3784505 - DNA, 22 bp, Homo sapiens
tggatcaaaatctgtagagcag

SEQ ID NO: 3784506 - DNA, 19 bp, Homo sapiens
tggatcagtcctttgatca

SEQ ID NO: 3784507 - DNA, 17 bp, Homo sapiens
tggatccccagtgaaaa

SEQ ID NO: 3784508 - DNA, 19 bp, Homo sapiens
tggatccccagtgaaaact

SEQ ID NO: 3784509 - DNA, 19 bp, Homo sapiens
tggatctgggaccctttcc

SEQ ID NO: 3784510 - DNA, 20 bp, Homo sapiens
tggatctgggaccctttcct

SEQ ID NO: 3784511 - DNA, 12 bp, Homo sapiens
tggatgatgttt

SEQ ID NO: 3784512 - DNA, 19 bp, Homo sapiens
tggatgcctggtggcagct

SEQ ID NO: 3784513 - DNA, 21 bp, Homo sapiens
tggatgcctggtggcagctgc

SEQ ID NO: 3784514 - DNA, 12 bp, Homo sapiens
tggatgtaaata

SEQ ID NO: 3784515 - DNA, 12 bp, Homo sapiens
tggatgttctga

SEQ ID NO: 3784516 - DNA, 17 bp, Homo sapiens
tggattagcctggagca

SEQ ID NO: 3784517 - DNA, 12 bp, Homo sapiens
tggattctcaga

SEQ ID NO: 3784518 - DNA, 15 bp, Homo sapiens
tggattggccaaaca

SEQ ID NO: 3784519 - DNA, 22 bp, Homo sapiens
tggatttatgttgtatagatta

SEQ ID NO: 3784520 - DNA, 17 bp, Homo sapiens
tggatttgcctgtgcca

SEQ ID NO: 3784521 - DNA, 12 bp, Homo sapiens
tggcaaaaaggc

SEQ ID NO: 3784522 - DNA, 15 bp, Homo sapiens
tggcaaagcagaaaa

SEQ ID NO: 3784523 - DNA, 17 bp, Homo sapiens
tggcaagggttcacctg

SEQ ID NO: 3784524 - DNA, 15 bp, Homo sapiens
tggcaatagtgtgtt

SEQ ID NO: 3784525 - DNA, 17 bp, Homo sapiens
tggcaatagtgtgttct

SEQ ID NO: 3784526 - DNA, 13 bp, Homo sapiens
tggcaattttgta

SEQ ID NO: 3784527 - DNA, 20 bp, Homo sapiens
tggcacagcccaaagaagga

SEQ ID NO: 3784528 - DNA, 13 bp, Homo sapiens
tggcaccactctc

SEQ ID NO: 3784529 - DNA, 18 bp, Homo sapiens
tggcaccactgcactcca

SEQ ID NO: 3784530 - DNA, 19 bp, Homo sapiens
tggcaccactgcactccag

SEQ ID NO: 3784531 - DNA, 21 bp, Homo sapiens
tggcaccactgcactccagcc

SEQ ID NO: 3784532 - DNA, 18 bp, Homo sapiens
tggcaccagcagcctgga

SEQ ID NO: 3784533 - DNA, 16 bp, Homo sapiens
tggcacccggcccctg

SEQ ID NO: 3784534 - DNA, 19 bp, Homo sapiens
tggcacccggcccctgctg

SEQ ID NO: 3784535 - DNA, 15 bp, Homo sapiens
tggcaccgccttctc

SEQ ID NO: 3784536 - DNA, 16 bp, Homo sapiens
tggcaccgccttctct

SEQ ID NO: 3784537 - DNA, 12 bp, Homo sapiens
tggcacctccta

SEQ ID NO: 3784538 - DNA, 21 bp, Homo sapiens
tggcactataatgtaagctct

SEQ ID NO: 3784539 - DNA, 22 bp, Homo sapiens
tggcactataatgtaagctcta

SEQ ID NO: 3784540 - DNA, 21 bp, Homo sapiens
tggcagataatcagcctctta

SEQ ID NO: 3784541 - DNA, 20 bp, Homo sapiens
tggcagcaggcctgttgctt

SEQ ID NO: 3784542 - DNA, 11 bp, Homo sapiens
tggcagccctg

SEQ ID NO: 3784543 - DNA, 19 bp, Homo sapiens
tggcagccgtgccttcagc

SEQ ID NO: 3784544 - DNA, 20 bp, Homo sapiens
tggcagccgtgccttcagct

SEQ ID NO: 3784545 - DNA, 21 bp, Homo sapiens
tggcagccgtgccttcagctc

SEQ ID NO: 3784546 - DNA, 23 bp, Homo sapiens
tggcagccgtgccttcagctcta

SEQ ID NO: 3784547 - DNA, 22 bp, Homo sapiens
tggcagcctactagggacctgg

SEQ ID NO: 3784548 - DNA, 22 bp, Homo sapiens
tggcagctgcggtccacccagg

SEQ ID NO: 3784549 - DNA, 13 bp, Homo sapiens
tggcagctgcttt

SEQ ID NO: 3784550 - DNA, 24 bp, Homo sapiens
tggcaggggtggaggagagcctgg

SEQ ID NO: 3784551 - DNA, 23 bp, Homo sapiens
tggcatcaccttaggcagggaag

SEQ ID NO: 3784552 - DNA, 20 bp, Homo sapiens
tggcatctttgccttgggct

SEQ ID NO: 3784553 - DNA, 23 bp, Homo sapiens
tggcatctttgccttgggctgct

SEQ ID NO: 3784554 - DNA, 19 bp, Homo sapiens
tggcatgccttccagcacc

SEQ ID NO: 3784555 - DNA, 15 bp, Homo sapiens
tggcattaaaactta

SEQ ID NO: 3784556 - DNA, 19 bp, Homo sapiens
tggcattacagctggagaa

SEQ ID NO: 3784557 - DNA, 15 bp, Homo sapiens
tggcatttccctact

SEQ ID NO: 3784558 - DNA, 21 bp, Homo sapiens
tggcatttgtgatcatgagat

SEQ ID NO: 3784559 - DNA, 16 bp, Homo sapiens
tggccaaacatcagac

SEQ ID NO: 3784560 - DNA, 21 bp, Homo sapiens
tggccaaacatcagacctgtc

SEQ ID NO: 3784561 - DNA, 23 bp, Homo sapiens
tggccaaacatcagacctgtctt

SEQ ID NO: 3784562 - DNA, 20 bp, Homo sapiens
tggccagaagggggccatga

SEQ ID NO: 3784563 - DNA, 13 bp, Homo sapiens
tggccagagagcc

SEQ ID NO: 3784564 - DNA, 17 bp, Homo sapiens
tggccagatgcaccagc

SEQ ID NO: 3784565 - DNA, 12 bp, Homo sapiens
tggccagcagct

SEQ ID NO: 3784566 - DNA, 14 bp, Homo sapiens
tggccaggagctct

SEQ ID NO: 3784567 - DNA, 22 bp, Homo sapiens
tggccaggagctcttcaggcct

SEQ ID NO: 3784568 - DNA, 12 bp, Homo sapiens
tggccaggatgg

SEQ ID NO: 3784569 - DNA, 12 bp, Homo sapiens
tggccaggcaga

SEQ ID NO: 3784570 - DNA, 23 bp, Homo sapiens
tggccaggcagatctgtgcccca

SEQ ID NO: 3784571 - DNA, 13 bp, Homo sapiens
tggccaggctggt

SEQ ID NO: 3784572 - DNA, 15 bp, Homo sapiens
tggccaggctggtct

SEQ ID NO: 3784573 - DNA, 17 bp, Homo sapiens
tggccaggctggtctca

SEQ ID NO: 3784574 - DNA, 11 bp, Homo sapiens
tggccaggtgg

SEQ ID NO: 3784575 - DNA, 15 bp, Homo sapiens
tggccaggtggccac

SEQ ID NO: 3784576 - DNA, 20 bp, Homo sapiens
tgtaaaaacagcattgcttt

SEQ ID NO: 3784577 - DNA, 22 bp, Homo sapiens
tgtaaaaacagcattgctttct

SEQ ID NO: 3784578 - DNA, 23 bp, Homo sapiens
tgtaaaactttattttatataat

SEQ ID NO: 3784579 - DNA, 22 bp, Homo sapiens
tgtaaaatcttggcacagaaac

SEQ ID NO: 3784580 - DNA, 14 bp, Homo sapiens
tgtaaaatgaaatt

SEQ ID NO: 3784581 - DNA, 21 bp, Homo sapiens
tgtaaacaaactgtgtaactg

SEQ ID NO: 3784582 - DNA, 12 bp, Homo sapiens
tgtaaacagtgc

SEQ ID NO: 3784583 - DNA, 14 bp, Homo sapiens
tgtaaacagtgcct

SEQ ID NO: 3784584 - DNA, 16 bp, Homo sapiens
tgtaaacagtgcctgc

SEQ ID NO: 3784585 - DNA, 15 bp, Homo sapiens
tgtaaactcaaaata

SEQ ID NO: 3784586 - DNA, 19 bp, Homo sapiens
tgtaaactgtactagtctg

SEQ ID NO: 3784587 - DNA, 21 bp, Homo sapiens
tgtaaactgtactagtctgtg

SEQ ID NO: 3784588 - DNA, 23 bp, Homo sapiens
tgtaaactgtactagtctgtgtg

SEQ ID NO: 3784589 - DNA, 23 bp, Homo sapiens
tgtaaataaccccattctttgct

SEQ ID NO: 3784590 - DNA, 21 bp, Homo sapiens
tgtaaatacacatagcatgta

SEQ ID NO: 3784591 - DNA, 21 bp, Homo sapiens
tgtaaatactgtttttaacaa

SEQ ID NO: 3784592 - DNA, 19 bp, Homo sapiens
tgtaaatcctttttcttta

SEQ ID NO: 3784593 - DNA, 13 bp, Homo sapiens
tgtaacaagaaag

SEQ ID NO: 3784594 - DNA, 18 bp, Homo sapiens
tgtaacaagaaaggagag

SEQ ID NO: 3784595 - DNA, 17 bp, Homo sapiens
tgtaacaagccacccca

SEQ ID NO: 3784596 - DNA, 11 bp, Homo sapiens
tgtaacactgt

SEQ ID NO: 3784597 - DNA, 18 bp, Homo sapiens
tgtaacaggtctcctctt

SEQ ID NO: 3784598 - DNA, 14 bp, Homo sapiens
tgtaacatatgcaa

SEQ ID NO: 3784599 - DNA, 20 bp, Homo sapiens
tgtaacatccaataggaatg

SEQ ID NO: 3784600 - DNA, 22 bp, Homo sapiens
tgtaacctgagatggccctctg

SEQ ID NO: 3784601 - DNA, 23 bp, Homo sapiens
tgtaactgcattgagaactgcat

SEQ ID NO: 3784602 - DNA, 20 bp, Homo sapiens
tgtaacttttgtaagacaaa

SEQ ID NO: 3784603 - DNA, 15 bp, Homo sapiens
tgtaagattttgaaa

SEQ ID NO: 3784604 - DNA, 15 bp, Homo sapiens
tgtaagctctttgaa

SEQ ID NO: 3784605 - DNA, 19 bp, Homo sapiens
tgtaagctctttgaaacaa

SEQ ID NO: 3784606 - DNA, 15 bp, Homo sapiens
tgtaaggaatgcttg

SEQ ID NO: 3784607 - DNA, 19 bp, Homo sapiens
tgtaaggaatgcttggaat

SEQ ID NO: 3784608 - DNA, 17 bp, Homo sapiens
tgtaagtaaactgccct

SEQ ID NO: 3784609 - DNA, 18 bp, Homo sapiens
tgtaagtaaactgccctg

SEQ ID NO: 3784610 - DNA, 16 bp, Homo sapiens
tgtaagtaaatgtctg

SEQ ID NO: 3784611 - DNA, 17 bp, Homo sapiens
tgtaagtgtgagtaaga

SEQ ID NO: 3784612 - DNA, 21 bp, Homo sapiens
tgtaagtgtgagtaagagctg

SEQ ID NO: 3784613 - DNA, 16 bp, Homo sapiens
tgtaataaagtatata

SEQ ID NO: 3784614 - DNA, 19 bp, Homo sapiens
tgtaataaagtgttttcag

SEQ ID NO: 3784615 - DNA, 20 bp, Homo sapiens
tgtaataaagtgttttcaga

SEQ ID NO: 3784616 - DNA, 13 bp, Homo sapiens
tgtaataatgtga

SEQ ID NO: 3784617 - DNA, 21 bp, Homo sapiens
tgtaatcatttcttgggccct

SEQ ID NO: 3784618 - DNA, 20 bp, Homo sapiens
tgtaatcccagctactcggg

SEQ ID NO: 3784619 - DNA, 16 bp, Homo sapiens
tgtaatgtcaccacct

SEQ ID NO: 3784620 - DNA, 22 bp, Homo sapiens
tgtaatgttactgatcatgcat

SEQ ID NO: 3784621 - DNA, 18 bp, Homo sapiens
tgtaattaagtactatgt

SEQ ID NO: 3784622 - DNA, 21 bp, Homo sapiens
tgtaattaagtactatgtatc

SEQ ID NO: 3784623 - DNA, 23 bp, Homo sapiens
tgtaattaagtactatgtatcaa

SEQ ID NO: 3784624 - DNA, 15 bp, Homo sapiens
tgtaattctaaatga

SEQ ID NO: 3784625 - DNA, 15 bp, Homo sapiens
tgtaattgaataaag

SEQ ID NO: 3784626 - DNA, 17 bp, Homo sapiens
tgtaatttgtgtaataa

SEQ ID NO: 3784627 - DNA, 20 bp, Homo sapiens
tgtaatttgtgtaataaagt

SEQ ID NO: 3784628 - DNA, 20 bp, Homo sapiens
tgtacaaaatggaattcatt

SEQ ID NO: 3784629 - DNA, 17 bp, Homo sapiens
tgtacaatatttaaaat

SEQ ID NO: 3784630 - DNA, 19 bp, Homo sapiens
tgtacaatattttaagcat

SEQ ID NO: 3784631 - DNA, 21 bp, Homo sapiens
tgtacaatattttaagcatta

SEQ ID NO: 3784632 - DNA, 22 bp, Homo sapiens
tgtacacatgggagtttagtgt

SEQ ID NO: 3784633 - DNA, 12 bp, Homo sapiens
tgtacactgaat

SEQ ID NO: 3784634 - DNA, 15 bp, Homo sapiens
tgtacactgaatatt

SEQ ID NO: 3784635 - DNA, 20 bp, Homo sapiens
tgtacactgaatatttatat

SEQ ID NO: 3784636 - DNA, 18 bp, Homo sapiens
tgtacatagttatttatt

SEQ ID NO: 3784637 - DNA, 15 bp, Homo sapiens
tgtacatatgtaaaa

SEQ ID NO: 3784638 - DNA, 21 bp, Homo sapiens
tgtacatggaataacatgtaa

SEQ ID NO: 3784639 - DNA, 18 bp, Homo sapiens
tgtacatttccaaattca

SEQ ID NO: 3784640 - DNA, 21 bp, Homo sapiens
tgtacatttccaaattcacaa

SEQ ID NO: 3784641 - DNA, 13 bp, Homo sapiens
tgtacatttctga

SEQ ID NO: 3784642 - DNA, 15 bp, Homo sapiens
tgtacgtctgacagg

SEQ ID NO: 3784643 - DNA, 17 bp, Homo sapiens
tgtacgtctgacaggca

SEQ ID NO: 3784644 - DNA, 12 bp, Homo sapiens
tgtactacaatt

SEQ ID NO: 3784645 - DNA, 13 bp, Homo sapiens
tgtactctggcct

SEQ ID NO: 3784646 - DNA, 14 bp, Homo sapiens
tgtactctggcctc

SEQ ID NO: 3784647 - DNA, 15 bp, Homo sapiens
tgtactctggcctct

SEQ ID NO: 3784648 - DNA, 12 bp, Homo sapiens
tgtactgaaaaa

SEQ ID NO: 3784649 - DNA, 19 bp, Homo sapiens
tgtactgcatatgaaagga

SEQ ID NO: 3784650 - DNA, 16 bp, Homo sapiens
tgtactgtaaagaatt

SEQ ID NO: 3784651 - DNA, 12 bp, Homo sapiens
tgtactgtagtt

SEQ ID NO: 3784652 - DNA, 16 bp, Homo sapiens
tgtactgtagtttttc

SEQ ID NO: 3784653 - DNA, 16 bp, Homo sapiens
tgtacttgatgacaga

SEQ ID NO: 3784654 - DNA, 21 bp, Homo sapiens
tgtagaaggagacagagctgg

SEQ ID NO: 3784655 - DNA, 18 bp, Homo sapiens
tgtagaatgatttcatgc

SEQ ID NO: 3784656 - DNA, 21 bp, Homo sapiens
tgtagacctagggaggacctt

SEQ ID NO: 3784657 - DNA, 11 bp, Homo sapiens
tgtagactagt

SEQ ID NO: 3784658 - DNA, 16 bp, Homo sapiens
tgtagagcagggcaag

SEQ ID NO: 3784659 - DNA, 10 bp, Homo sapiens
tgtagccaag

SEQ ID NO: 3784660 - DNA, 17 bp, Homo sapiens
tgtagccccaagaaggc

SEQ ID NO: 3784661 - DNA, 22 bp, Homo sapiens
tgtagccccaagaaggctgggg

SEQ ID NO: 3784662 - DNA, 14 bp, Homo sapiens
tgtagctggtttcc

SEQ ID NO: 3784663 - DNA, 15 bp, Homo sapiens
tgtagctttgctctt

SEQ ID NO: 3784664 - DNA, 13 bp, Homo sapiens
tgtagggtttcta

SEQ ID NO: 3784665 - DNA, 19 bp, Homo sapiens
tgtagtaaactatttatct

SEQ ID NO: 3784666 - DNA, 13 bp, Homo sapiens
tgtagtaaagaaa

SEQ ID NO: 3784667 - DNA, 15 bp, Homo sapiens
tgtagttaggaaata

SEQ ID NO: 3784668 - DNA, 13 bp, Homo sapiens
tgtataaaaatag

SEQ ID NO: 3784669 - DNA, 23 bp, Homo sapiens
tgtataaatgaagtttatacagt

SEQ ID NO: 3784670 - DNA, 16 bp, Homo sapiens
tgtataagtccttgca

SEQ ID NO: 3784671 - DNA, 16 bp, Homo sapiens
tgtataagttgaggca

SEQ ID NO: 3784672 - DNA, 15 bp, Homo sapiens
tgtatacctgtaact

SEQ ID NO: 3784673 - DNA, 15 bp, Homo sapiens
tgtatagtactggca

SEQ ID NO: 3784674 - DNA, 17 bp, Homo sapiens
tgtatatatacataaca

SEQ ID NO: 3784675 - DNA, 17 bp, Homo sapiens
tgtatatatattaagag

SEQ ID NO: 3784676 - DNA, 18 bp, Homo sapiens
tgtatatatttcctatat

SEQ ID NO: 3784677 - DNA, 22 bp, Homo sapiens
tgtatatatttcctatattgtt

SEQ ID NO: 3784678 - DNA, 23 bp, Homo sapiens
tgtatattatggaagattttaaa

SEQ ID NO: 3784679 - DNA, 15 bp, Homo sapiens
tgtatcaaactagtg

SEQ ID NO: 3784680 - DNA, 17 bp, Homo sapiens
tgtatcatagaaatgta

SEQ ID NO: 3784681 - DNA, 19 bp, Homo sapiens
tgtatcccatgagcctcag

SEQ ID NO: 3784682 - DNA, 23 bp, Homo sapiens
tgtatcccatgagcctcagcatc

SEQ ID NO: 3784683 - DNA, 15 bp, Homo sapiens
tgtatcggagacagt

SEQ ID NO: 3784684 - DNA, 15 bp, Homo sapiens
tgtatcggatgcttt

SEQ ID NO: 3784685 - DNA, 21 bp, Homo sapiens
tgtatctagtgcagctgattt

SEQ ID NO: 3784686 - DNA, 13 bp, Homo sapiens
tgtatctgagcag

SEQ ID NO: 3784687 - DNA, 11 bp, Homo sapiens
tgtatctgtgt

SEQ ID NO: 3784688 - DNA, 16 bp, Homo sapiens
tgtatgactaaagaga

SEQ ID NO: 3784689 - DNA, 16 bp, Homo sapiens
tgtttaatattgagaa

SEQ ID NO: 3784690 - DNA, 14 bp, Homo sapiens
tgtttacactgtca

SEQ ID NO: 3784691 - DNA, 15 bp, Homo sapiens
tgtttatacagctca

SEQ ID NO: 3784692 - DNA, 14 bp, Homo sapiens
tgtttatcagcagt

SEQ ID NO: 3784693 - DNA, 19 bp, Homo sapiens
tgtttatcagcagttgtta

SEQ ID NO: 3784694 - DNA, 16 bp, Homo sapiens
tgtttatgagccagac

SEQ ID NO: 3784695 - DNA, 13 bp, Homo sapiens
tgtttatggcctc

SEQ ID NO: 3784696 - DNA, 23 bp, Homo sapiens
tgtttatggcctcagctgcctca

SEQ ID NO: 3784697 - DNA, 19 bp, Homo sapiens
tgtttattaacaaattatg

SEQ ID NO: 3784698 - DNA, 13 bp, Homo sapiens
tgtttatttacaa

SEQ ID NO: 3784699 - DNA, 15 bp, Homo sapiens
tgtttatttatcagt

SEQ ID NO: 3784700 - DNA, 14 bp, Homo sapiens
tgtttatttttata

SEQ ID NO: 3784701 - DNA, 14 bp, Homo sapiens
tgtttcccataatt

SEQ ID NO: 3784702 - DNA, 22 bp, Homo sapiens
tgtttcccataattttcttcat

SEQ ID NO: 3784703 - DNA, 11 bp, Homo sapiens
tgtttcctttt

SEQ ID NO: 3784704 - DNA, 21 bp, Homo sapiens
tgtttcgctgatatatgtgtt

SEQ ID NO: 3784705 - DNA, 22 bp, Homo sapiens
tgtttctagttgaggagtttcc

SEQ ID NO: 3784706 - DNA, 15 bp, Homo sapiens
tgtttctccccctgg

SEQ ID NO: 3784707 - DNA, 16 bp, Homo sapiens
tgtttctccccctggg

SEQ ID NO: 3784708 - DNA, 13 bp, Homo sapiens
tgtttctctgctg

SEQ ID NO: 3784709 - DNA, 14 bp, Homo sapiens
tgtttctctgctgt

SEQ ID NO: 3784710 - DNA, 15 bp, Homo sapiens
tgtttctctgctgtt

SEQ ID NO: 3784711 - DNA, 13 bp, Homo sapiens
tgtttctgaaaag

SEQ ID NO: 3784712 - DNA, 14 bp, Homo sapiens
tgtttctgaaaatt

SEQ ID NO: 3784713 - DNA, 18 bp, Homo sapiens
tgtttcttccaaagcaca

SEQ ID NO: 3784714 - DNA, 20 bp, Homo sapiens
tgtttctttaaatttcaaat

SEQ ID NO: 3784715 - DNA, 22 bp, Homo sapiens
tgtttctttaaatttcaaatgt

SEQ ID NO: 3784716 - DNA, 22 bp, Homo sapiens
tgtttgaaaatattatctttgt

SEQ ID NO: 3784717 - DNA, 20 bp, Homo sapiens
tgtttgccttctacttttaa

SEQ ID NO: 3784718 - DNA, 15 bp, Homo sapiens
tgtttgctcagaaca

SEQ ID NO: 3784719 - DNA, 15 bp, Homo sapiens
tgtttgcttattgtt

SEQ ID NO: 3784720 - DNA, 16 bp, Homo sapiens
tgtttgcttattgttc

SEQ ID NO: 3784721 - DNA, 18 bp, Homo sapiens
tgtttgcttattgttcca

SEQ ID NO: 3784722 - DNA, 23 bp, Homo sapiens
tgtttgcttattgttccaagaca

SEQ ID NO: 3784723 - DNA, 13 bp, Homo sapiens
tgtttgtaaataa

SEQ ID NO: 3784724 - DNA, 18 bp, Homo sapiens
tgtttgtaaataagagat

SEQ ID NO: 3784725 - DNA, 12 bp, Homo sapiens
tgtttgtggcct

SEQ ID NO: 3784726 - DNA, 14 bp, Homo sapiens
tgtttgtggcctca

SEQ ID NO: 3784727 - DNA, 17 bp, Homo sapiens
tgtttgttaaaactggc

SEQ ID NO: 3784728 - DNA, 21 bp, Homo sapiens
tgtttgttaaaactggcatct

SEQ ID NO: 3784729 - DNA, 16 bp, Homo sapiens
tgtttgttgtcagctg

SEQ ID NO: 3784730 - DNA, 17 bp, Homo sapiens
tgttttaaaataaggat

SEQ ID NO: 3784731 - DNA, 20 bp, Homo sapiens
tgttttaagaggcagggtct

SEQ ID NO: 3784732 - DNA, 14 bp, Homo sapiens
tgttttactgcttt

SEQ ID NO: 3784733 - DNA, 20 bp, Homo sapiens
tgttttcatgtaaataaata

SEQ ID NO: 3784734 - DNA, 16 bp, Homo sapiens
tgttttccctgacctc

SEQ ID NO: 3784735 - DNA, 20 bp, Homo sapiens
tgttttgatgtttgtggcct

SEQ ID NO: 3784736 - DNA, 17 bp, Homo sapiens
tgttttgttctttaaag

SEQ ID NO: 3784737 - DNA, 17 bp, Homo sapiens
tgtttttaaaaatcata

SEQ ID NO: 3784738 - DNA, 13 bp, Homo sapiens
tgtttttcacatt

SEQ ID NO: 3784739 - DNA, 14 bp, Homo sapiens
tgttttttatcttt

SEQ ID NO: 3784740 - DNA, 19 bp, Homo sapiens
tgttttttgaaaacatggt

SEQ ID NO: 3784741 - DNA, 18 bp, Homo sapiens
tgttttttttttccactt

SEQ ID NO: 3784742 - DNA, 19 bp, Homo sapiens
tgttttttttttccactta

SEQ ID NO: 3784743 - DNA, 12 bp, Homo sapiens
ttaaaaaaaata

SEQ ID NO: 3784744 - DNA, 13 bp, Homo sapiens
ttaaaaaaaataa

SEQ ID NO: 3784745 - DNA, 20 bp, Homo sapiens
ttaaaaaagtttaaaatgta

SEQ ID NO: 3784746 - DNA, 16 bp, Homo sapiens
ttaaaaaatgtccatg

SEQ ID NO: 3784747 - DNA, 22 bp, Homo sapiens
ttaaaaattggctagttgaatc

SEQ ID NO: 3784748 - DNA, 17 bp, Homo sapiens
ttaaaacaacactcaca

SEQ ID NO: 3784749 - DNA, 20 bp, Homo sapiens
ttaaaacaatattgtttcta

SEQ ID NO: 3784750 - DNA, 23 bp, Homo sapiens
ttaaaacttaaccgcatcagaag

SEQ ID NO: 3784751 - DNA, 14 bp, Homo sapiens
ttaaaactttaatc

SEQ ID NO: 3784752 - DNA, 16 bp, Homo sapiens
ttaaaagaaatctcta

SEQ ID NO: 3784753 - DNA, 21 bp, Homo sapiens
ttaaaagccatcatgtaaatt

SEQ ID NO: 3784754 - DNA, 15 bp, Homo sapiens
ttaaaataaggattt

SEQ ID NO: 3784755 - DNA, 20 bp, Homo sapiens
ttaaaatcactaacattata

SEQ ID NO: 3784756 - DNA, 21 bp, Homo sapiens
ttaaaatcactaacattatat

SEQ ID NO: 3784757 - DNA, 15 bp, Homo sapiens
ttaaacattgaagta

SEQ ID NO: 3784758 - DNA, 17 bp, Homo sapiens
ttaaacctatactcact

SEQ ID NO: 3784759 - DNA, 21 bp, Homo sapiens
ttaaagacaaagacaaattct

SEQ ID NO: 3784760 - DNA, 22 bp, Homo sapiens
ttaaagcacttacagataggcc

SEQ ID NO: 3784761 - DNA, 14 bp, Homo sapiens
ttaaagctgcctgt

SEQ ID NO: 3784762 - DNA, 17 bp, Homo sapiens
ttaaagctgcctgtagt

SEQ ID NO: 3784763 - DNA, 18 bp, Homo sapiens
ttaaagctgcctgtagtt

SEQ ID NO: 3784764 - DNA, 13 bp, Homo sapiens
ttaaagtatatat

SEQ ID NO: 3784765 - DNA, 19 bp, Homo sapiens
ttaaagtgtattataacag

SEQ ID NO: 3784766 - DNA, 21 bp, Homo sapiens
ttaaataaaagaaatgcacaa

SEQ ID NO: 3784767 - DNA, 13 bp, Homo sapiens
ttaaataaaagtg

SEQ ID NO: 3784768 - DNA, 14 bp, Homo sapiens
ttaaataaaagtga

SEQ ID NO: 3784769 - DNA, 13 bp, Homo sapiens
ttaaataaatcat

SEQ ID NO: 3784770 - DNA, 20 bp, Homo sapiens
ttaaataaatgtcattaaaa

SEQ ID NO: 3784771 - DNA, 19 bp, Homo sapiens
ttaaatagagtatatgcac

SEQ ID NO: 3784772 - DNA, 16 bp, Homo sapiens
ttaaatatatgtatgt

SEQ ID NO: 3784773 - DNA, 20 bp, Homo sapiens
ttaaatatatgtatgtaaaa

SEQ ID NO: 3784774 - DNA, 14 bp, Homo sapiens
ttaaatatttacat

SEQ ID NO: 3784775 - DNA, 18 bp, Homo sapiens
ttaaatatttacatatga

SEQ ID NO: 3784776 - DNA, 16 bp, Homo sapiens
ttaaatcctgttgaaa

SEQ ID NO: 3784777 - DNA, 12 bp, Homo sapiens
ttaaatgagaag

SEQ ID NO: 3784778 - DNA, 23 bp, Homo sapiens
ttaaatgggctactttgtccttt

SEQ ID NO: 3784779 - DNA, 21 bp, Homo sapiens
ttaaatgggtagagaaacact

SEQ ID NO: 3784780 - DNA, 17 bp, Homo sapiens
ttaaattataaggactg

SEQ ID NO: 3784781 - DNA, 20 bp, Homo sapiens
ttaaattataaggactgcat

SEQ ID NO: 3784782 - DNA, 15 bp, Homo sapiens
ttaaatttcaaatgt

SEQ ID NO: 3784783 - DNA, 20 bp, Homo sapiens
ttaacaataactactgtgtt

SEQ ID NO: 3784784 - DNA, 19 bp, Homo sapiens
ttaacactgcttgtgtttt

SEQ ID NO: 3784785 - DNA, 13 bp, Homo sapiens
ttaacagttttcc

SEQ ID NO: 3784786 - DNA, 14 bp, Homo sapiens
ttaacagttttcca

SEQ ID NO: 3784787 - DNA, 14 bp, Homo sapiens
ttaacattgaccaa

SEQ ID NO: 3784788 - DNA, 19 bp, Homo sapiens
ttaacattgaccaagaact

SEQ ID NO: 3784789 - DNA, 15 bp, Homo sapiens
ttaacatttctaact

SEQ ID NO: 3784790 - DNA, 19 bp, Homo sapiens
ttaacctcagtgtcattta

SEQ ID NO: 3784791 - DNA, 17 bp, Homo sapiens
ttaacctggtgctggat

SEQ ID NO: 3784792 - DNA, 15 bp, Homo sapiens
ttaactagaatttat

SEQ ID NO: 3784793 - DNA, 16 bp, Homo sapiens
ttaactagaatttatt

SEQ ID NO: 3784794 - DNA, 20 bp, Homo sapiens
ttaactctttgcctttgcca

SEQ ID NO: 3784795 - DNA, 22 bp, Homo sapiens
ttaacttaaattttaatttatt

SEQ ID NO: 3784796 - DNA, 18 bp, Homo sapiens
ttaactttatcacattat

SEQ ID NO: 3784797 - DNA, 17 bp, Homo sapiens
ttaagaaaatacaataa

SEQ ID NO: 3784798 - DNA, 12 bp, Homo sapiens
ttaagaaacact

SEQ ID NO: 3784799 - DNA, 14 bp, Homo sapiens
ttaagaaacactga

SEQ ID NO: 3784800 - DNA, 16 bp, Homo sapiens
ttaagaacacaaagcg

SEQ ID NO: 3784801 - DNA, 15 bp, Homo sapiens
ttaagaccagcctgg

SEQ ID NO: 3784802 - DNA, 16 bp, Homo sapiens
ttaagaggcagggtct

SEQ ID NO: 3784803 - DNA, 17 bp, Homo sapiens
ttcagctgacttttctg

SEQ ID NO: 3784804 - DNA, 23 bp, Homo sapiens
ttcagctgcccccgctcatgggc

SEQ ID NO: 3784805 - DNA, 16 bp, Homo sapiens
ttcagctgcttctctt

SEQ ID NO: 3784806 - DNA, 17 bp, Homo sapiens
ttcaggaacctggacca

SEQ ID NO: 3784807 - DNA, 18 bp, Homo sapiens
ttcaggacactcactaca

SEQ ID NO: 3784808 - DNA, 14 bp, Homo sapiens
ttcaggaggctgga

SEQ ID NO: 3784809 - DNA, 17 bp, Homo sapiens
ttcaggagtcccaagga

SEQ ID NO: 3784810 - DNA, 21 bp, Homo sapiens
ttcaggatactctgtcagatg

SEQ ID NO: 3784811 - DNA, 13 bp, Homo sapiens
ttcaggctgcttg

SEQ ID NO: 3784812 - DNA, 18 bp, Homo sapiens
ttcagggcagggctctga

SEQ ID NO: 3784813 - DNA, 16 bp, Homo sapiens
ttcaggggactcagcc

SEQ ID NO: 3784814 - DNA, 17 bp, Homo sapiens
ttcaggggactcagccc

SEQ ID NO: 3784815 - DNA, 23 bp, Homo sapiens
ttcaggggactcagccctgaggt

SEQ ID NO: 3784816 - DNA, 13 bp, Homo sapiens
ttcagggggccag

SEQ ID NO: 3784817 - DNA, 13 bp, Homo sapiens
ttcagggtcatag

SEQ ID NO: 3784818 - DNA, 14 bp, Homo sapiens
ttcagggttggccc

SEQ ID NO: 3784819 - DNA, 16 bp, Homo sapiens
ttcaggtaacaggcag

SEQ ID NO: 3784820 - DNA, 20 bp, Homo sapiens
ttcaggtgtttagttgcaga

SEQ ID NO: 3784821 - DNA, 14 bp, Homo sapiens
ttcagtcttttcct

SEQ ID NO: 3784822 - DNA, 10 bp, Homo sapiens
ttcagtgccc

SEQ ID NO: 3784823 - DNA, 14 bp, Homo sapiens
ttcagtgggagaaa

SEQ ID NO: 3784824 - DNA, 12 bp, Homo sapiens
ttcagtgtacat

SEQ ID NO: 3784825 - DNA, 17 bp, Homo sapiens
ttcagttaagaaaaaaa

SEQ ID NO: 3784826 - DNA, 18 bp, Homo sapiens
ttcagttaagaaaaaaat

SEQ ID NO: 3784827 - DNA, 16 bp, Homo sapiens
ttcagttgatcactgg

SEQ ID NO: 3784828 - DNA, 17 bp, Homo sapiens
ttcagttggtaagcttc

SEQ ID NO: 3784829 - DNA, 18 bp, Homo sapiens
ttcagttggtgtgttttt

SEQ ID NO: 3784830 - DNA, 15 bp, Homo sapiens
ttcataacagtgcca

SEQ ID NO: 3784831 - DNA, 18 bp, Homo sapiens
ttcataacagtgccattg

SEQ ID NO: 3784832 - DNA, 15 bp, Homo sapiens
ttcataacctagcct

SEQ ID NO: 3784833 - DNA, 17 bp, Homo sapiens
ttcataactttcattaa

SEQ ID NO: 3784834 - DNA, 18 bp, Homo sapiens
ttcatacacagcctgggc

SEQ ID NO: 3784835 - DNA, 20 bp, Homo sapiens
ttcatagctggttcctgcta

SEQ ID NO: 3784836 - DNA, 21 bp, Homo sapiens
ttcatatatgaggacttgtgt

SEQ ID NO: 3784837 - DNA, 20 bp, Homo sapiens
ttcatatgtaccatgtacat

SEQ ID NO: 3784838 - DNA, 21 bp, Homo sapiens
ttcatatttacttcttataca

SEQ ID NO: 3784839 - DNA, 22 bp, Homo sapiens
ttcatccaatcctcactgggtg

SEQ ID NO: 3784840 - DNA, 21 bp, Homo sapiens
ttcatcccactccaactcttc

SEQ ID NO: 3784841 - DNA, 18 bp, Homo sapiens
ttcatctatttctgagaa

SEQ ID NO: 3784842 - DNA, 16 bp, Homo sapiens
ttcatgaaaatcctac

SEQ ID NO: 3784843 - DNA, 14 bp, Homo sapiens
ttcatgcaatgaca

SEQ ID NO: 3784844 - DNA, 15 bp, Homo sapiens
ttcatgcaatgacat

SEQ ID NO: 3784845 - DNA, 22 bp, Homo sapiens
ttcatgccaccatggccagcca

SEQ ID NO: 3784846 - DNA, 14 bp, Homo sapiens
ttcatgcctttgta

SEQ ID NO: 3784847 - DNA, 15 bp, Homo sapiens
ttcatgcctttgtaa

SEQ ID NO: 3784848 - DNA, 17 bp, Homo sapiens
ttcatgcctttgtaagt

SEQ ID NO: 3784849 - DNA, 21 bp, Homo sapiens
ttcatgcctttgtaagttatt

SEQ ID NO: 3784850 - DNA, 13 bp, Homo sapiens
ttcattaaagcat

SEQ ID NO: 3784851 - DNA, 18 bp, Homo sapiens
ttcattattggaattaac

SEQ ID NO: 3784852 - DNA, 18 bp, Homo sapiens
ttcattcctaacacagca

SEQ ID NO: 3784853 - DNA, 13 bp, Homo sapiens
ttcattcttgaaa

SEQ ID NO: 3784854 - DNA, 21 bp, Homo sapiens
ttcattgccttaactggagcc

SEQ ID NO: 3784855 - DNA, 17 bp, Homo sapiens
ttcattgtaatgttact

SEQ ID NO: 3784856 - DNA, 23 bp, Homo sapiens
ttcattgtggttatttttataca

SEQ ID NO: 3784857 - DNA, 19 bp, Homo sapiens
ttccaaagcacattgaaag

SEQ ID NO: 3784858 - DNA, 15 bp, Homo sapiens
ttccaaattcacaag

SEQ ID NO: 3784859 - DNA, 23 bp, Homo sapiens
ttccaaattcacaagttgtgttt

SEQ ID NO: 3784860 - DNA, 15 bp, Homo sapiens
ttccaaattctgctt

SEQ ID NO: 3784861 - DNA, 23 bp, Homo sapiens
ttccaacagctcaagtcttccct

SEQ ID NO: 3784862 - DNA, 14 bp, Homo sapiens
ttccaagacattgt

SEQ ID NO: 3784863 - DNA, 13 bp, Homo sapiens
ttccaagagctga

SEQ ID NO: 3784864 - DNA, 19 bp, Homo sapiens
ttccaagcaaatgttacat

SEQ ID NO: 3784865 - DNA, 18 bp, Homo sapiens
ttccaaggagctgagaat

SEQ ID NO: 3784866 - DNA, 22 bp, Homo sapiens
ttccaaggagctgagaatagaa

SEQ ID NO: 3784867 - DNA, 11 bp, Homo sapiens
ttccacaaaat

SEQ ID NO: 3784868 - DNA, 11 bp, Homo sapiens
ttccaccagcc

SEQ ID NO: 3784869 - DNA, 15 bp, Homo sapiens
ttccaccccctccct

SEQ ID NO: 3784870 - DNA, 20 bp, Homo sapiens
ttccaccccctccctggcct

SEQ ID NO: 3784871 - DNA, 13 bp, Homo sapiens
ttccacctggaag

SEQ ID NO: 3784872 - DNA, 14 bp, Homo sapiens
ttccacgatgaaaa

SEQ ID NO: 3784873 - DNA, 15 bp, Homo sapiens
ttccactactgctac

SEQ ID NO: 3784874 - DNA, 22 bp, Homo sapiens
ttccagaaaggatatttaagaa

SEQ ID NO: 3784875 - DNA, 17 bp, Homo sapiens
ttccagagagtggctcc

SEQ ID NO: 3784876 - DNA, 18 bp, Homo sapiens
ttccagagagtggctcct

SEQ ID NO: 3784877 - DNA, 20 bp, Homo sapiens
ttccagagagtggctcctcc

SEQ ID NO: 3784878 - DNA, 19 bp, Homo sapiens
ttccagaggctattatttt

SEQ ID NO: 3784879 - DNA, 17 bp, Homo sapiens
ttccaggaaaaaggaca

SEQ ID NO: 3784880 - DNA, 21 bp, Homo sapiens
ttccaggctgcatagaaggag

SEQ ID NO: 3784881 - DNA, 22 bp, Homo sapiens
ttccaggtagctgaaaggggaa

SEQ ID NO: 3784882 - DNA, 21 bp, Homo sapiens
ttccagtgagcttatcatgct

SEQ ID NO: 3784883 - DNA, 19 bp, Homo sapiens
ttccagtgcaacactgaag

SEQ ID NO: 3784884 - DNA, 17 bp, Homo sapiens
ttccagtggcctggctc

SEQ ID NO: 3784885 - DNA, 20 bp, Homo sapiens
ttccagtttgtttattactt

SEQ ID NO: 3784886 - DNA, 18 bp, Homo sapiens
ttccataattatgacagt

SEQ ID NO: 3784887 - DNA, 14 bp, Homo sapiens
ttccatagtatatt

SEQ ID NO: 3784888 - DNA, 18 bp, Homo sapiens
ttccatagtatattaaaa

SEQ ID NO: 3784889 - DNA, 13 bp, Homo sapiens
ttccatgaaaacg

SEQ ID NO: 3784890 - DNA, 15 bp, Homo sapiens
ttccatgaaaatgca

SEQ ID NO: 3784891 - DNA, 24 bp, Homo sapiens
ttccatgaaaatgcaacaacatgt

SEQ ID NO: 3784892 - DNA, 12 bp, Homo sapiens
ttccatgaatgt

SEQ ID NO: 3784893 - DNA, 15 bp, Homo sapiens
ttccatgaatgtatc

SEQ ID NO: 3784894 - DNA, 18 bp, Homo sapiens
ttccatgactgcatttta

SEQ ID NO: 3784895 - DNA, 18 bp, Homo sapiens
ttccatgagaacagcagg

SEQ ID NO: 3784896 - DNA, 16 bp, Homo sapiens
ttccatgtcgcctctg

SEQ ID NO: 3784897 - DNA, 21 bp, Homo sapiens
ttccatgtcgcctctgcattc

SEQ ID NO: 3784898 - DNA, 16 bp, Homo sapiens
ttccattatgattctt

SEQ ID NO: 3784899 - DNA, 21 bp, Homo sapiens
ttccatttctctctccagtct

SEQ ID NO: 3784900 - DNA, 13 bp, Homo sapiens
ttcccaagctctg

SEQ ID NO: 3784901 - DNA, 18 bp, Homo sapiens
ttcccaagctctgctcct

SEQ ID NO: 3784902 - DNA, 12 bp, Homo sapiens
ttcccaataaat

SEQ ID NO: 3784903 - DNA, 14 bp, Homo sapiens
ttcccaattaggaa

SEQ ID NO: 3784904 - DNA, 18 bp, Homo sapiens
ttcccaccaggctgctca

SEQ ID NO: 3784905 - DNA, 15 bp, Homo sapiens
ttcccagagacagga

SEQ ID NO: 3784906 - DNA, 22 bp, Homo sapiens
ttcccagagacaggaaaatcct

SEQ ID NO: 3784907 - DNA, 23 bp, Homo sapiens
ttcccagagcaaaataattttaa

SEQ ID NO: 3784908 - DNA, 19 bp, Homo sapiens
ttcccagctctccctctgg

SEQ ID NO: 3784909 - DNA, 11 bp, Homo sapiens
ttcccataatt

SEQ ID NO: 3784910 - DNA, 18 bp, Homo sapiens
ttcccataattttcttca

SEQ ID NO: 3784911 - DNA, 18 bp, Homo sapiens
ttccccaaccacttcatt

SEQ ID NO: 3784912 - DNA, 18 bp, Homo sapiens
ttccccaacgaaaagcac

SEQ ID NO: 3784913 - DNA, 23 bp, Homo sapiens
ttccccactgacagcctcccacc

SEQ ID NO: 3784914 - DNA, 18 bp, Homo sapiens
ttccccactgcctgccca

SEQ ID NO: 3784915 - DNA, 16 bp, Homo sapiens
ttccccatactctgtc

SEQ ID NO: 3784916 - DNA, 15 bp, Homo sapiens
ttgccctagatgagc

SEQ ID NO: 3784917 - DNA, 17 bp, Homo sapiens
ttgcccttcacagtgtt

SEQ ID NO: 3784918 - DNA, 18 bp, Homo sapiens
ttgccctttctgtaccat

SEQ ID NO: 3784919 - DNA, 17 bp, Homo sapiens
ttgccgaaactggaagt

SEQ ID NO: 3784920 - DNA, 18 bp, Homo sapiens
ttgccgaaactggaagtt

SEQ ID NO: 3784921 - DNA, 18 bp, Homo sapiens
ttgcctaagtattccttt

SEQ ID NO: 3784922 - DNA, 21 bp, Homo sapiens
ttgcctaatacattaaagcag

SEQ ID NO: 3784923 - DNA, 22 bp, Homo sapiens
ttgcctaatacattaaagcagt

SEQ ID NO: 3784924 - DNA, 15 bp, Homo sapiens
ttgcctcctgtgtaa

SEQ ID NO: 3784925 - DNA, 14 bp, Homo sapiens
ttgcctctgcctct

SEQ ID NO: 3784926 - DNA, 12 bp, Homo sapiens
ttgcctgcaggc

SEQ ID NO: 3784927 - DNA, 18 bp, Homo sapiens
ttgcctgcggtcaaggcc

SEQ ID NO: 3784928 - DNA, 22 bp, Homo sapiens
ttgcgacggagagaaaaaagaa

SEQ ID NO: 3784929 - DNA, 22 bp, Homo sapiens
ttgctaaaggaaaaaaccatcc

SEQ ID NO: 3784930 - DNA, 16 bp, Homo sapiens
ttgctagctatgtgac

SEQ ID NO: 3784931 - DNA, 18 bp, Homo sapiens
ttgctcaaaaaatgagct

SEQ ID NO: 3784932 - DNA, 21 bp, Homo sapiens
ttgctcaagttcattgatgac

SEQ ID NO: 3784933 - DNA, 13 bp, Homo sapiens
ttgctcacctggg

SEQ ID NO: 3784934 - DNA, 20 bp, Homo sapiens
ttgctccaccccactcacag

SEQ ID NO: 3784935 - DNA, 16 bp, Homo sapiens
ttgctccccagtgaag

SEQ ID NO: 3784936 - DNA, 12 bp, Homo sapiens
ttgctccttgac

SEQ ID NO: 3784937 - DNA, 22 bp, Homo sapiens
ttgctgaatcggaatctctggg

SEQ ID NO: 3784938 - DNA, 15 bp, Homo sapiens
ttgctgattcttgag

SEQ ID NO: 3784939 - DNA, 14 bp, Homo sapiens
ttgctgcttgaggc

SEQ ID NO: 3784940 - DNA, 15 bp, Homo sapiens
ttgctggtcactgcc

SEQ ID NO: 3784941 - DNA, 20 bp, Homo sapiens
ttgctgtgagcaagaagtca

SEQ ID NO: 3784942 - DNA, 20 bp, Homo sapiens
ttgctgtgtcataccaggcc

SEQ ID NO: 3784943 - DNA, 15 bp, Homo sapiens
ttgctgtttcctttt

SEQ ID NO: 3784944 - DNA, 13 bp, Homo sapiens
ttgcttatttaat

SEQ ID NO: 3784945 - DNA, 16 bp, Homo sapiens
ttgcttatttaataaa

SEQ ID NO: 3784946 - DNA, 21 bp, Homo sapiens
ttgcttcatagctggttcctg

SEQ ID NO: 3784947 - DNA, 12 bp, Homo sapiens
ttgcttctgtag

SEQ ID NO: 3784948 - DNA, 14 bp, Homo sapiens
ttgcttctgtagta

SEQ ID NO: 3784949 - DNA, 21 bp, Homo sapiens
ttgcttctgtagtactcctta

SEQ ID NO: 3784950 - DNA, 23 bp, Homo sapiens
ttgcttcttcccttaaaatttat

SEQ ID NO: 3784951 - DNA, 15 bp, Homo sapiens
ttgcttgaaagaaaa

SEQ ID NO: 3784952 - DNA, 16 bp, Homo sapiens
ttgctttaattgttaa

SEQ ID NO: 3784953 - DNA, 18 bp, Homo sapiens
ttgctttaattgttaaga

SEQ ID NO: 3784954 - DNA, 16 bp, Homo sapiens
ttgctttgtatgcact

SEQ ID NO: 3784955 - DNA, 22 bp, Homo sapiens
ttggaaaagaatacagaaagat

SEQ ID NO: 3784956 - DNA, 19 bp, Homo sapiens
ttggaagctccgctttcta

SEQ ID NO: 3784957 - DNA, 16 bp, Homo sapiens
ttggaagttttcagga

SEQ ID NO: 3784958 - DNA, 15 bp, Homo sapiens
ttggaatctagaaga

SEQ ID NO: 3784959 - DNA, 22 bp, Homo sapiens
ttggaatctagaagaaatgaaa

SEQ ID NO: 3784960 - DNA, 16 bp, Homo sapiens
ttggacacacacagct

SEQ ID NO: 3784961 - DNA, 13 bp, Homo sapiens
ttggacagcaaaa

SEQ ID NO: 3784962 - DNA, 18 bp, Homo sapiens
ttggacagcaaaaccatt

SEQ ID NO: 3784963 - DNA, 23 bp, Homo sapiens
ttggacagcaaaaccattgcttc

SEQ ID NO: 3784964 - DNA, 18 bp, Homo sapiens
ttggacctcgtgctttaa

SEQ ID NO: 3784965 - DNA, 15 bp, Homo sapiens
ttggacgcacacagc

SEQ ID NO: 3784966 - DNA, 18 bp, Homo sapiens
ttggacttttcgttaaca

SEQ ID NO: 3784967 - DNA, 20 bp, Homo sapiens
ttggacttttcgttaacatt

SEQ ID NO: 3784968 - DNA, 15 bp, Homo sapiens
ttggagaatatcaaa

SEQ ID NO: 3784969 - DNA, 15 bp, Homo sapiens
ttggattgacagtaa

SEQ ID NO: 3784970 - DNA, 23 bp, Homo sapiens
ttggcacagaaacacaatatttt

SEQ ID NO: 3784971 - DNA, 16 bp, Homo sapiens
ttggccaaacatcaga

SEQ ID NO: 3784972 - DNA, 24 bp, Homo sapiens
ttggccaaagccaaagctaggcct

SEQ ID NO: 3784973 - DNA, 14 bp, Homo sapiens
ttggccaggctggt

SEQ ID NO: 3784974 - DNA, 16 bp, Homo sapiens
ttggcctgtctcatcc

SEQ ID NO: 3784975 - DNA, 13 bp, Homo sapiens
ttggctcaatcct

SEQ ID NO: 3784976 - DNA, 13 bp, Homo sapiens
ttggctgcaggga

SEQ ID NO: 3784977 - DNA, 14 bp, Homo sapiens
ttggctgcagggag

SEQ ID NO: 3784978 - DNA, 17 bp, Homo sapiens
ttggctgggcccagaag

SEQ ID NO: 3784979 - DNA, 11 bp, Homo sapiens
ttggctgggta

SEQ ID NO: 3784980 - DNA, 17 bp, Homo sapiens
ttggcttgtgatctggg

SEQ ID NO: 3784981 - DNA, 21 bp, Homo sapiens
ttggctttcatgaggaggcag

SEQ ID NO: 3784982 - DNA, 16 bp, Homo sapiens
ttggctttccagtcat

SEQ ID NO: 3784983 - DNA, 22 bp, Homo sapiens
ttggctttgggttgcaggacct

SEQ ID NO: 3784984 - DNA, 18 bp, Homo sapiens
ttgggatgatgcctcatg

SEQ ID NO: 3784985 - DNA, 13 bp, Homo sapiens
ttgggatgtctta

SEQ ID NO: 3784986 - DNA, 13 bp, Homo sapiens
ttgggattaatat

SEQ ID NO: 3784987 - DNA, 13 bp, Homo sapiens
ttggggaggggcg

SEQ ID NO: 3784988 - DNA, 20 bp, Homo sapiens
ttgggtgcaagagggagcac

SEQ ID NO: 3784989 - DNA, 20 bp, Homo sapiens
ttgggtgtaacaggtctcct

SEQ ID NO: 3784990 - DNA, 20 bp, Homo sapiens
ttgggttaggagaagtcaag

SEQ ID NO: 3784991 - DNA, 22 bp, Homo sapiens
ttgggttcaagcgattcttctg

SEQ ID NO: 3784992 - DNA, 17 bp, Homo sapiens
ttgggttcattattgga

SEQ ID NO: 3784993 - DNA, 18 bp, Homo sapiens
ttggtgcctttcctgttc

SEQ ID NO: 3784994 - DNA, 21 bp, Homo sapiens
ttggtgcctttcctgttcagc

SEQ ID NO: 3784995 - DNA, 20 bp, Homo sapiens
ttggtgcgggcacaataaat

SEQ ID NO: 3784996 - DNA, 16 bp, Homo sapiens
ttggtggagataaaga

SEQ ID NO: 3784997 - DNA, 21 bp, Homo sapiens
ttggttatacatgacactgaa

SEQ ID NO: 3784998 - DNA, 14 bp, Homo sapiens
ttggttcccttgtg

SEQ ID NO: 3784999 - DNA, 15 bp, Homo sapiens
ttggttctaatagaa

SEQ ID NO: 3785000 - DNA, 13 bp, Homo sapiens
ttggttctggggc

SEQ ID NO: 3785001 - DNA, 20 bp, Homo sapiens
ttggttttaattgaaggaaa

SEQ ID NO: 3785002 - DNA, 21 bp, Homo sapiens
ttgtaaaaacagcattgcttt

SEQ ID NO: 3785003 - DNA, 20 bp, Homo sapiens
ttgtaaacattagttctatt

SEQ ID NO: 3785004 - DNA, 14 bp, Homo sapiens
ttgtaaataagaga

SEQ ID NO: 3785005 - DNA, 23 bp, Homo sapiens
ttgtaaatacaagttctatttaa

SEQ ID NO: 3785006 - DNA, 14 bp, Homo sapiens
ttgtaaatacacat

SEQ ID NO: 3785007 - DNA, 13 bp, Homo sapiens
ttgtaaatattta

SEQ ID NO: 3785008 - DNA, 16 bp, Homo sapiens
ttgtaaatgtggtaaa

SEQ ID NO: 3785009 - DNA, 14 bp, Homo sapiens
ttgtaactccacca

SEQ ID NO: 3785010 - DNA, 23 bp, Homo sapiens
ttgtaagaaaccaatcaagataa

SEQ ID NO: 3785011 - DNA, 21 bp, Homo sapiens
ttgtaagacaaaggttttcct

SEQ ID NO: 3785012 - DNA, 22 bp, Homo sapiens
ttgtaagacaaaggttttcctc

SEQ ID NO: 3785013 - DNA, 18 bp, Homo sapiens
ttgtaagagctatacagt

SEQ ID NO: 3785014 - DNA, 16 bp, Homo sapiens
ttgtaagattttgaaa

SEQ ID NO: 3785015 - DNA, 19 bp, Homo sapiens
ttgtaagtaaactgccctg

SEQ ID NO: 3785016 - DNA, 18 bp, Homo sapiens
ttgtaataaagtatataa

SEQ ID NO: 3785017 - DNA, 20 bp, Homo sapiens
ttgtaataaagtatataatt

SEQ ID NO: 3785018 - DNA, 17 bp, Homo sapiens
ttgtaattctaaatgaa

SEQ ID NO: 3785019 - DNA, 23 bp, Homo sapiens
ttgtaattctaaatgaatgttta

SEQ ID NO: 3785020 - DNA, 12 bp, Homo sapiens
ttgtaattttct

SEQ ID NO: 3785021 - DNA, 12 bp, Homo sapiens
ttgtacaaaata

SEQ ID NO: 3785022 - DNA, 23 bp, Homo sapiens
ttgtacaaaataaacaaataaca

SEQ ID NO: 3785023 - DNA, 19 bp, Homo sapiens
ttgtacacaccttatattt

SEQ ID NO: 3785024 - DNA, 20 bp, Homo sapiens
ttgtacagaatcattgctta

SEQ ID NO: 3785025 - DNA, 21 bp, Homo sapiens
ttgtacagacgtatgcttatt

SEQ ID NO: 3785026 - DNA, 15 bp, Homo sapiens
ttgtacgtttaaagt

SEQ ID NO: 3785027 - DNA, 18 bp, Homo sapiens
ttgtacgtttaaagtgta

SEQ ID NO: 3785028 - DNA, 18 bp, Homo sapiens
ttgtactacagttctttt

SEQ ID NO: 3785029 - DNA, 23 bp, Homo sapiens
tttgccaaaataatgtcttgtta

SEQ ID NO: 3785030 - DNA, 21 bp, Homo sapiens
tttgccagaacagtttgtaca

SEQ ID NO: 3785031 - DNA, 16 bp, Homo sapiens
tttgccagtgggaact

SEQ ID NO: 3785032 - DNA, 18 bp, Homo sapiens
tttgccatgttggccagg

SEQ ID NO: 3785033 - DNA, 19 bp, Homo sapiens
tttgccctggtttcactgg

SEQ ID NO: 3785034 - DNA, 14 bp, Homo sapiens
tttgcggacgggct

SEQ ID NO: 3785035 - DNA, 18 bp, Homo sapiens
tttgctcagcttctccaa

SEQ ID NO: 3785036 - DNA, 10 bp, Homo sapiens
tttgctgcca

SEQ ID NO: 3785037 - DNA, 23 bp, Homo sapiens
tttgctgtttattaaaaatatat

SEQ ID NO: 3785038 - DNA, 17 bp, Homo sapiens
tttggaatctagaagaa

SEQ ID NO: 3785039 - DNA, 20 bp, Homo sapiens
tttggaatctagaagaaatg

SEQ ID NO: 3785040 - DNA, 14 bp, Homo sapiens
tttggaattttgtg

SEQ ID NO: 3785041 - DNA, 17 bp, Homo sapiens
tttggacacacacagct

SEQ ID NO: 3785042 - DNA, 22 bp, Homo sapiens
tttggagaacgccagtctccca

SEQ ID NO: 3785043 - DNA, 19 bp, Homo sapiens
tttggagactctgtggggc

SEQ ID NO: 3785044 - DNA, 12 bp, Homo sapiens
tttggcccccga

SEQ ID NO: 3785045 - DNA, 19 bp, Homo sapiens
tttggcgggccaaggactg

SEQ ID NO: 3785046 - DNA, 20 bp, Homo sapiens
tttggctttacgggtgtaaa

SEQ ID NO: 3785047 - DNA, 12 bp, Homo sapiens
tttgggatgtct

SEQ ID NO: 3785048 - DNA, 22 bp, Homo sapiens
tttgggatgtcttatttttaga

SEQ ID NO: 3785049 - DNA, 22 bp, Homo sapiens
tttgggggaaaatttagaaata

SEQ ID NO: 3785050 - DNA, 13 bp, Homo sapiens
tttgggtaaatca

SEQ ID NO: 3785051 - DNA, 15 bp, Homo sapiens
tttgggttaaaaaaa

SEQ ID NO: 3785052 - DNA, 14 bp, Homo sapiens
tttggtactaataa

SEQ ID NO: 3785053 - DNA, 21 bp, Homo sapiens
tttggtccttcaaaggcttgt

SEQ ID NO: 3785054 - DNA, 15 bp, Homo sapiens
tttggtggagataaa

SEQ ID NO: 3785055 - DNA, 16 bp, Homo sapiens
tttggtggatgtaaat

SEQ ID NO: 3785056 - DNA, 13 bp, Homo sapiens
tttggttctgggg

SEQ ID NO: 3785057 - DNA, 14 bp, Homo sapiens
tttggttctggggc

SEQ ID NO: 3785058 - DNA, 22 bp, Homo sapiens
tttgtaaaaacagcattgcttt

SEQ ID NO: 3785059 - DNA, 17 bp, Homo sapiens
tttgtaaactcaaaata

SEQ ID NO: 3785060 - DNA, 22 bp, Homo sapiens
tttgtaaataagagatttggag

SEQ ID NO: 3785061 - DNA, 14 bp, Homo sapiens
tttgtaataaagta

SEQ ID NO: 3785062 - DNA, 18 bp, Homo sapiens
tttgtaatcgttatgtgt

SEQ ID NO: 3785063 - DNA, 16 bp, Homo sapiens
tttgtaattttcttga

SEQ ID NO: 3785064 - DNA, 21 bp, Homo sapiens
tttgtacaattgaacttaaat

SEQ ID NO: 3785065 - DNA, 18 bp, Homo sapiens
tttgtacagacgtatgct

SEQ ID NO: 3785066 - DNA, 22 bp, Homo sapiens
tttgtacagacgtatgcttatt

SEQ ID NO: 3785067 - DNA, 19 bp, Homo sapiens
tttgtacatagttatttat

SEQ ID NO: 3785068 - DNA, 19 bp, Homo sapiens
tttgtacatatgtaaaata

SEQ ID NO: 3785069 - DNA, 15 bp, Homo sapiens
tttgtactgaaaaat

SEQ ID NO: 3785070 - DNA, 13 bp, Homo sapiens
tttgtataaaatg

SEQ ID NO: 3785071 - DNA, 17 bp, Homo sapiens
tttgtatagtaaagtga

SEQ ID NO: 3785072 - DNA, 12 bp, Homo sapiens
tttgtatgatat

SEQ ID NO: 3785073 - DNA, 14 bp, Homo sapiens
tttgtcaaactgta

SEQ ID NO: 3785074 - DNA, 16 bp, Homo sapiens
tttgtcaaactgtaga

SEQ ID NO: 3785075 - DNA, 23 bp, Homo sapiens
tttgtcaaactgtagaaatgatg

SEQ ID NO: 3785076 - DNA, 17 bp, Homo sapiens
tttgtcaatgacagttt

SEQ ID NO: 3785077 - DNA, 17 bp, Homo sapiens
tttgtcattttgaagct

SEQ ID NO: 3785078 - DNA, 19 bp, Homo sapiens
tttgtcattttgaagctaa

SEQ ID NO: 3785079 - DNA, 17 bp, Homo sapiens
tttgtctgtcttcatag

SEQ ID NO: 3785080 - DNA, 13 bp, Homo sapiens
tttgtcttaaaaa

SEQ ID NO: 3785081 - DNA, 14 bp, Homo sapiens
tttgtcttaaaaag

SEQ ID NO: 3785082 - DNA, 12 bp, Homo sapiens
tttgtgagagcg

SEQ ID NO: 3785083 - DNA, 11 bp, Homo sapiens
tttgtggaaaa

SEQ ID NO: 3785084 - DNA, 15 bp, Homo sapiens
tttgtgtaataaagt

SEQ ID NO: 3785085 - DNA, 14 bp, Homo sapiens
tttgtgtgagagac

SEQ ID NO: 3785086 - DNA, 19 bp, Homo sapiens
tttgtgttctgtttgttaa

SEQ ID NO: 3785087 - DNA, 21 bp, Homo sapiens
tttgttaaaactggcatctga

SEQ ID NO: 3785088 - DNA, 22 bp, Homo sapiens
tttgttaaatatttacatatga

SEQ ID NO: 3785089 - DNA, 13 bp, Homo sapiens
tttgttattctta

SEQ ID NO: 3785090 - DNA, 14 bp, Homo sapiens
tttgttgctgtttt

SEQ ID NO: 3785091 - DNA, 15 bp, Homo sapiens
tttgttgtcagctga

SEQ ID NO: 3785092 - DNA, 16 bp, Homo sapiens
tttgtttcttccaaag

SEQ ID NO: 3785093 - DNA, 11 bp, Homo sapiens
tttgttttgtt

SEQ ID NO: 3785094 - DNA, 13 bp, Homo sapiens
tttgtttttaatt

SEQ ID NO: 3785095 - DNA, 22 bp, Homo sapiens
ttttaaaacacttccataatct

SEQ ID NO: 3785096 - DNA, 20 bp, Homo sapiens
ttttaaaatcactaacatta

SEQ ID NO: 3785097 - DNA, 19 bp, Homo sapiens
ttttaaacagtgagcctga

SEQ ID NO: 3785098 - DNA, 17 bp, Homo sapiens
ttttaaataaaagcagc

SEQ ID NO: 3785099 - DNA, 19 bp, Homo sapiens
ttttaaatgggtagagaaa

SEQ ID NO: 3785100 - DNA, 18 bp, Homo sapiens
ttttaacacacataaagg

SEQ ID NO: 3785101 - DNA, 19 bp, Homo sapiens
ttttaacacacataaagga

SEQ ID NO: 3785102 - DNA, 13 bp, Homo sapiens
ttttaacatggaa

SEQ ID NO: 3785103 - DNA, 15 bp, Homo sapiens
ttttaagaggcaggg

SEQ ID NO: 3785104 - DNA, 22 bp, Homo sapiens
ttttaagataaattataagtta

SEQ ID NO: 3785105 - DNA, 19 bp, Homo sapiens
ttttaagcattactcttgt

SEQ ID NO: 3785106 - DNA, 23 bp, Homo sapiens
ttttaagggtttgtggaaaatga

SEQ ID NO: 3785107 - DNA, 17 bp, Homo sapiens
ttttaagtgctttgtaa

SEQ ID NO: 3785108 - DNA, 21 bp, Homo sapiens
ttttaatcgtacattttcata

SEQ ID NO: 3785109 - DNA, 20 bp, Homo sapiens
ttttaattattatttatata

SEQ ID NO: 3785110 - DNA, 14 bp, Homo sapiens
ttttaattattgtt

SEQ ID NO: 3785111 - DNA, 19 bp, Homo sapiens
ttttaatttgatgaaagct

SEQ ID NO: 3785112 - DNA, 20 bp, Homo sapiens
ttttaatttgatgaaagctg

SEQ ID NO: 3785113 - DNA, 10 bp, Homo sapiens
ttttacaaaa

SEQ ID NO: 3785114 - DNA, 15 bp, Homo sapiens
ttttacatactgctg

SEQ ID NO: 3785115 - DNA, 17 bp, Homo sapiens
ttttaccaagttatata

SEQ ID NO: 3785116 - DNA, 15 bp, Homo sapiens
ttttactactgtgga

SEQ ID NO: 3785117 - DNA, 13 bp, Homo sapiens
ttttactcccctt

SEQ ID NO: 3785118 - DNA, 14 bp, Homo sapiens
ttttagaaaacagc

SEQ ID NO: 3785119 - DNA, 12 bp, Homo sapiens
ttttagaaactt

SEQ ID NO: 3785120 - DNA, 17 bp, Homo sapiens
ttttagaacagaaaaca

SEQ ID NO: 3785121 - DNA, 21 bp, Homo sapiens
ttttagaccctattgctgctt

SEQ ID NO: 3785122 - DNA, 19 bp, Homo sapiens
ttttagatggttacactgt

SEQ ID NO: 3785123 - DNA, 21 bp, Homo sapiens
ttttataaaaaaaatgaaatg

SEQ ID NO: 3785124 - DNA, 20 bp, Homo sapiens
ttttataaaattaaagaaaa

SEQ ID NO: 3785125 - DNA, 12 bp, Homo sapiens
ttttataaatta

SEQ ID NO: 3785126 - DNA, 20 bp, Homo sapiens
ttttataactagtcctttac

SEQ ID NO: 3785127 - DNA, 23 bp, Homo sapiens
ttttatacagtagtgagaagaat

SEQ ID NO: 3785128 - DNA, 15 bp, Homo sapiens
ttttatactgtactt

SEQ ID NO: 3785129 - DNA, 16 bp, Homo sapiens
ttttatcttttctaca

SEQ ID NO: 3785130 - DNA, 23 bp, Homo sapiens
ttttatgaagaaaaaatacattt

SEQ ID NO: 3785131 - DNA, 11 bp, Homo sapiens
ttttatgatat

SEQ ID NO: 3785132 - DNA, 14 bp, Homo sapiens
ttttattatgcata

SEQ ID NO: 3785133 - DNA, 19 bp, Homo sapiens
ttttattatgcataactga

SEQ ID NO: 3785134 - DNA, 23 bp, Homo sapiens
ttttattatgcataactgacaaa

SEQ ID NO: 3785135 - DNA, 14 bp, Homo sapiens
ttttcaaaatggag

SEQ ID NO: 3785136 - DNA, 15 bp, Homo sapiens
ttttcaagaaactga

SEQ ID NO: 3785137 - DNA, 20 bp, Homo sapiens
ttttcaattcaaaaatgtac

SEQ ID NO: 3785138 - DNA, 22 bp, Homo sapiens
ttttcaattcaaaaatgtacaa

SEQ ID NO: 3785139 - DNA, 14 bp, Homo sapiens
ttttcaattttgca

SEQ ID NO: 3785140 - DNA, 19 bp, Homo sapiens
ttttcaccagatttgctaa

SEQ ID NO: 3785141 - DNA, 14 bp, Homo sapiens
ttttcagactcaga

SEQ ID NO: 3785142 - DNA, 19 bp, Homo sapiens
aattatagtgtagaaaaga

SEQ ID NO: 3785143 - DNA, 22 bp, Homo sapiens
aattatatcagtcctctttcaa

SEQ ID NO: 3785144 - DNA, 15 bp, Homo sapiens
aattatccagagttt

SEQ ID NO: 3785145 - DNA, 17 bp, Homo sapiens
aattatcggaagcagtg

SEQ ID NO: 3785146 - DNA, 19 bp, Homo sapiens
aattatcgggaacagtgtt

SEQ ID NO: 3785147 - DNA, 14 bp, Homo sapiens
aattatctatttgt

SEQ ID NO: 3785148 - DNA, 23 bp, Homo sapiens
aattatctatttgtatatataca

SEQ ID NO: 3785149 - DNA, 19 bp, Homo sapiens
aattatgagttatttttat

SEQ ID NO: 3785150 - DNA, 21 bp, Homo sapiens
aattattattcttcataacaa

SEQ ID NO: 3785151 - DNA, 18 bp, Homo sapiens
aattattatttatatatg

SEQ ID NO: 3785152 - DNA, 21 bp, Homo sapiens
aattattatttatatatgtat

SEQ ID NO: 3785153 - DNA, 18 bp, Homo sapiens
aattattcagttaagaaa

SEQ ID NO: 3785154 - DNA, 10 bp, Homo sapiens
aattattgtt

SEQ ID NO: 3785155 - DNA, 12 bp, Homo sapiens
aattattttaat

SEQ ID NO: 3785156 - DNA, 16 bp, Homo sapiens
aattattttaattagg

SEQ ID NO: 3785157 - DNA, 17 bp, Homo sapiens
aattattttaattaggt

SEQ ID NO: 3785158 - DNA, 17 bp, Homo sapiens
aattatttttaatatgt

SEQ ID NO: 3785159 - DNA, 16 bp, Homo sapiens
aattattttttttctt

SEQ ID NO: 3785160 - DNA, 22 bp, Homo sapiens
aattcaaaaatgtacaaaataa

SEQ ID NO: 3785161 - DNA, 21 bp, Homo sapiens
aattcaaccactgtaaaatga

SEQ ID NO: 3785162 - DNA, 20 bp, Homo sapiens
aattcagatatatttttcac

SEQ ID NO: 3785163 - DNA, 21 bp, Homo sapiens
aattccactggacttgagctt

SEQ ID NO: 3785164 - DNA, 14 bp, Homo sapiens
aattccactgtcaa

SEQ ID NO: 3785165 - DNA, 16 bp, Homo sapiens
aattcccattttgcaa

SEQ ID NO: 3785166 - DNA, 21 bp, Homo sapiens
aattcccattttgcaaaattt

SEQ ID NO: 3785167 - DNA, 21 bp, Homo sapiens
aattccttggcatgccttcca

SEQ ID NO: 3785168 - DNA, 18 bp, Homo sapiens
aattcgctgcaacctgtt

SEQ ID NO: 3785169 - DNA, 18 bp, Homo sapiens
aattctaaataaaatata

SEQ ID NO: 3785170 - DNA, 20 bp, Homo sapiens
aattctaaataaaatataat

SEQ ID NO: 3785171 - DNA, 22 bp, Homo sapiens
aattctaaataaaatataattg

SEQ ID NO: 3785172 - DNA, 13 bp, Homo sapiens
aattctaaatgaa

SEQ ID NO: 3785173 - DNA, 22 bp, Homo sapiens
aattctaaccagagcaagcttt

SEQ ID NO: 3785174 - DNA, 15 bp, Homo sapiens
aattctaatctaaca

SEQ ID NO: 3785175 - DNA, 23 bp, Homo sapiens
aattctaggcatcccaggggacc

SEQ ID NO: 3785176 - DNA, 17 bp, Homo sapiens
aattctgttcatttgtt

SEQ ID NO: 3785177 - DNA, 22 bp, Homo sapiens
aattctgttcatttgttattct

SEQ ID NO: 3785178 - DNA, 13 bp, Homo sapiens
aattctgtttctt

SEQ ID NO: 3785179 - DNA, 14 bp, Homo sapiens
aattctgtttttct

SEQ ID NO: 3785180 - DNA, 18 bp, Homo sapiens
aattcttcaggtggaaaa

SEQ ID NO: 3785181 - DNA, 13 bp, Homo sapiens
aattcttggaata

SEQ ID NO: 3785182 - DNA, 15 bp, Homo sapiens
aattcttggaatact

SEQ ID NO: 3785183 - DNA, 16 bp, Homo sapiens
aattcttgtatattat

SEQ ID NO: 3785184 - DNA, 18 bp, Homo sapiens
aattcttttttaaatttt

SEQ ID NO: 3785185 - DNA, 22 bp, Homo sapiens
aattgaatcactgctcacactg

SEQ ID NO: 3785186 - DNA, 14 bp, Homo sapiens
aattgaggtctgct

SEQ ID NO: 3785187 - DNA, 14 bp, Homo sapiens
aattgataataaac

SEQ ID NO: 3785188 - DNA, 17 bp, Homo sapiens
aattgcatgctgcttta

SEQ ID NO: 3785189 - DNA, 18 bp, Homo sapiens
aattgcatgctgctttaa

SEQ ID NO: 3785190 - DNA, 20 bp, Homo sapiens
aattgcattttttaaaacaa

SEQ ID NO: 3785191 - DNA, 21 bp, Homo sapiens
aattgctcatgcatagtccca

SEQ ID NO: 3785192 - DNA, 19 bp, Homo sapiens
aattgcttactcattaaaa

SEQ ID NO: 3785193 - DNA, 18 bp, Homo sapiens
aattggaccatcctattt

SEQ ID NO: 3785194 - DNA, 15 bp, Homo sapiens
aattggagcagggac

SEQ ID NO: 3785195 - DNA, 13 bp, Homo sapiens
aattgtaaactgt

SEQ ID NO: 3785196 - DNA, 24 bp, Homo sapiens
aattgtatcatttgaacaactagg

SEQ ID NO: 3785197 - DNA, 20 bp, Homo sapiens
aattgtgaattgataataaa

SEQ ID NO: 3785198 - DNA, 23 bp, Homo sapiens
aattgttgctaatcttcttatgc

SEQ ID NO: 3785199 - DNA, 16 bp, Homo sapiens
aatttaaaacaaacaa

SEQ ID NO: 3785200 - DNA, 12 bp, Homo sapiens
aatttaaaggct

SEQ ID NO: 3785201 - DNA, 13 bp, Homo sapiens
aatttaacaatgc

SEQ ID NO: 3785202 - DNA, 16 bp, Homo sapiens
aatttaacaatgcgaa

SEQ ID NO: 3785203 - DNA, 11 bp, Homo sapiens
aatttaagcat

SEQ ID NO: 3785204 - DNA, 21 bp, Homo sapiens
aatttaattaggggttgctaa

SEQ ID NO: 3785205 - DNA, 18 bp, Homo sapiens
aatttaattcatgtttct

SEQ ID NO: 3785206 - DNA, 19 bp, Homo sapiens
aatttaattcatgtttctt

SEQ ID NO: 3785207 - DNA, 23 bp, Homo sapiens
aatttaattcatgtttcttaaat

SEQ ID NO: 3785208 - DNA, 17 bp, Homo sapiens
aatttagaaatataatt

SEQ ID NO: 3785209 - DNA, 13 bp, Homo sapiens
aatttataatttt

SEQ ID NO: 3785210 - DNA, 16 bp, Homo sapiens
aatttataattttaag

SEQ ID NO: 3785211 - DNA, 17 bp, Homo sapiens
aatttatacaatatcat

SEQ ID NO: 3785212 - DNA, 15 bp, Homo sapiens
aatttatagtttata

SEQ ID NO: 3785213 - DNA, 16 bp, Homo sapiens
aatttatatgtatcca

SEQ ID NO: 3785214 - DNA, 19 bp, Homo sapiens
aatttatcctgaaatttca

SEQ ID NO: 3785215 - DNA, 19 bp, Homo sapiens
aatttatcttgtctctggg

SEQ ID NO: 3785216 - DNA, 20 bp, Homo sapiens
aatttatcttgtctctgggc

SEQ ID NO: 3785217 - DNA, 16 bp, Homo sapiens
aatttattgcacaaaa

SEQ ID NO: 3785218 - DNA, 16 bp, Homo sapiens
aatttatttattaaga

SEQ ID NO: 3785219 - DNA, 11 bp, Homo sapiens
aatttcaaatg

SEQ ID NO: 3785220 - DNA, 14 bp, Homo sapiens
aatttcaatttgtt

SEQ ID NO: 3785221 - DNA, 15 bp, Homo sapiens
aatttcatttatttt

SEQ ID NO: 3785222 - DNA, 21 bp, Homo sapiens
aatttccacaaaatctgtcca

SEQ ID NO: 3785223 - DNA, 22 bp, Homo sapiens
aatttctaaaaaacagaggcca

SEQ ID NO: 3785224 - DNA, 14 bp, Homo sapiens
aatttctctacaga

SEQ ID NO: 3785225 - DNA, 23 bp, Homo sapiens
aatttctctacagatgtcccatt

SEQ ID NO: 3785226 - DNA, 18 bp, Homo sapiens
aatttcttctcaaagggt

SEQ ID NO: 3785227 - DNA, 12 bp, Homo sapiens
aatttgaatgaa

SEQ ID NO: 3785228 - DNA, 18 bp, Homo sapiens
aatttgatcgttccagtt

SEQ ID NO: 3785229 - DNA, 22 bp, Homo sapiens
aatttgtaaaaacagcattgct

SEQ ID NO: 3785230 - DNA, 23 bp, Homo sapiens
aatttgtaaaaacagcattgctt

SEQ ID NO: 3785231 - DNA, 20 bp, Homo sapiens
aatttgtacatatgtaaaat

SEQ ID NO: 3785232 - DNA, 17 bp, Homo sapiens
aatttgtagggtttcta

SEQ ID NO: 3785233 - DNA, 14 bp, Homo sapiens
aatttgtataaaat

SEQ ID NO: 3785234 - DNA, 19 bp, Homo sapiens
aatttgtcattttgaagct

SEQ ID NO: 3785235 - DNA, 17 bp, Homo sapiens
aatttgtgtaataaagt

SEQ ID NO: 3785236 - DNA, 16 bp, Homo sapiens
aatttgttataatgaa

SEQ ID NO: 3785237 - DNA, 18 bp, Homo sapiens
aattttaagattcctttt

SEQ ID NO: 3785238 - DNA, 13 bp, Homo sapiens
aattttaatttat

SEQ ID NO: 3785239 - DNA, 23 bp, Homo sapiens
aattttaccaagttatataaaga

SEQ ID NO: 3785240 - DNA, 19 bp, Homo sapiens
aattttatagctcagttta

SEQ ID NO: 3785241 - DNA, 16 bp, Homo sapiens
aattttatctcttatt

SEQ ID NO: 3785242 - DNA, 12 bp, Homo sapiens
aattttatgaac

SEQ ID NO: 3785243 - DNA, 19 bp, Homo sapiens
aattttatgaactgcatgt

SEQ ID NO: 3785244 - DNA, 21 bp, Homo sapiens
aattttcttgatgactggaat

SEQ ID NO: 3785245 - DNA, 18 bp, Homo sapiens
aattttgcctaatacatt

SEQ ID NO: 3785246 - DNA, 12 bp, Homo sapiens
aattttgtaatt

SEQ ID NO: 3785247 - DNA, 13 bp, Homo sapiens
aatttttaaagta

SEQ ID NO: 3785248 - DNA, 19 bp, Homo sapiens
aatttttaaagtatatatt

SEQ ID NO: 3785249 - DNA, 20 bp, Homo sapiens
aatttttaaagtatatattt

SEQ ID NO: 3785250 - DNA, 22 bp, Homo sapiens
aatttttaaagtatatatttat

SEQ ID NO: 3785251 - DNA, 20 bp, Homo sapiens
aatttttaaatgtaaaacat

SEQ ID NO: 3785252 - DNA, 13 bp, Homo sapiens
aatttttaatgtt

SEQ ID NO: 3785253 - DNA, 16 bp, Homo sapiens
aatttttacagaattg

SEQ ID NO: 3785254 - DNA, 17 bp, Homo sapiens
aatttttattaaattat

SEQ ID NO: 3785255 - DNA, 17 bp, Homo sapiens
aatttttattatgcata

SEQ ID NO: 3785256 - DNA, 12 bp, Homo sapiens
acaatttatttt

SEQ ID NO: 3785257 - DNA, 18 bp, Homo sapiens
acacaaacgggctcagca

SEQ ID NO: 3785258 - DNA, 15 bp, Homo sapiens
acacaacaaaaattt

SEQ ID NO: 3785259 - DNA, 12 bp, Homo sapiens
acacaatacaat

SEQ ID NO: 3785260 - DNA, 14 bp, Homo sapiens
acacaatgtgtctg

SEQ ID NO: 3785261 - DNA, 22 bp, Homo sapiens
acacacaaattatcttaaaact

SEQ ID NO: 3785262 - DNA, 13 bp, Homo sapiens
acacacaacaaaa

SEQ ID NO: 3785263 - DNA, 15 bp, Homo sapiens
acacacaacaaaaat

SEQ ID NO: 3785264 - DNA, 14 bp, Homo sapiens
acacacaacaatta

SEQ ID NO: 3785265 - DNA, 15 bp, Homo sapiens
acacacacacacaca

SEQ ID NO: 3785266 - DNA, 14 bp, Homo sapiens
acacacacacacag

SEQ ID NO: 3785267 - DNA, 14 bp, Homo sapiens
acacacacaggagg

SEQ ID NO: 3785268 - DNA, 17 bp, Homo sapiens
acacacaccacacatac

SEQ ID NO: 3785269 - DNA, 12 bp, Homo sapiens
acacacagctct

SEQ ID NO: 3785270 - DNA, 12 bp, Homo sapiens
acacacataaag

SEQ ID NO: 3785271 - DNA, 21 bp, Homo sapiens
acacacatataaacatcacac

SEQ ID NO: 3785272 - DNA, 15 bp, Homo sapiens
acacaccacacatac

SEQ ID NO: 3785273 - DNA, 14 bp, Homo sapiens
acacaccagagccc

SEQ ID NO: 3785274 - DNA, 21 bp, Homo sapiens
acacacgcgtgcacacaccag

SEQ ID NO: 3785275 - DNA, 15 bp, Homo sapiens
acacactgaggcagg

SEQ ID NO: 3785276 - DNA, 13 bp, Homo sapiens
acacactttattt

SEQ ID NO: 3785277 - DNA, 14 bp, Homo sapiens
acacactttttaag

SEQ ID NO: 3785278 - DNA, 19 bp, Homo sapiens
acacactttttaagaaata

SEQ ID NO: 3785279 - DNA, 21 bp, Homo sapiens
acacagaggaagagcaggcac

SEQ ID NO: 3785280 - DNA, 16 bp, Homo sapiens
acacttcctgtccaga

SEQ ID NO: 3785281 - DNA, 21 bp, Homo sapiens
acacttgtaattttgtatctt

SEQ ID NO: 3785282 - DNA, 16 bp, Homo sapiens
acacttgtgtgtgggc

SEQ ID NO: 3785283 - DNA, 18 bp, Homo sapiens
acacttgtgtgtgggctg

SEQ ID NO: 3785284 - DNA, 13 bp, Homo sapiens
acactttatttac

SEQ ID NO: 3785285 - DNA, 14 bp, Homo sapiens
acagaaaaaaaaca

SEQ ID NO: 3785286 - DNA, 10 bp, Homo sapiens
acagaaaaca

SEQ ID NO: 3785287 - DNA, 11 bp, Homo sapiens
acagaaaacaa

SEQ ID NO: 3785288 - DNA, 19 bp, Homo sapiens
acagaaaacaacaaaaaat

SEQ ID NO: 3785289 - DNA, 13 bp, Homo sapiens
acagaaaactaga

SEQ ID NO: 3785290 - DNA, 18 bp, Homo sapiens
acagaaagagagcactga

SEQ ID NO: 3785291 - DNA, 17 bp, Homo sapiens
acagaaattagccgggc

SEQ ID NO: 3785292 - DNA, 14 bp, Homo sapiens
acagaacactgtct

SEQ ID NO: 3785293 - DNA, 16 bp, Homo sapiens
acagaagaaggcagca

SEQ ID NO: 3785294 - DNA, 21 bp, Homo sapiens
acagaagcctcactgcaagca

SEQ ID NO: 3785295 - DNA, 15 bp, Homo sapiens
acagaataatgaatg

SEQ ID NO: 3785296 - DNA, 17 bp, Homo sapiens
acagaattctgctacct

SEQ ID NO: 3785297 - DNA, 14 bp, Homo sapiens
acagacaacagaag

SEQ ID NO: 3785298 - DNA, 13 bp, Homo sapiens
acagacacacaca

SEQ ID NO: 3785299 - DNA, 14 bp, Homo sapiens
acagacacacacac

SEQ ID NO: 3785300 - DNA, 14 bp, Homo sapiens
acagacacacgcac

SEQ ID NO: 3785301 - DNA, 22 bp, Homo sapiens
acagacacaggcccggctccag

SEQ ID NO: 3785302 - DNA, 15 bp, Homo sapiens
acagacaggagaaat

SEQ ID NO: 3785303 - DNA, 23 bp, Homo sapiens
acagactgcgatttgtcccaggt

SEQ ID NO: 3785304 - DNA, 14 bp, Homo sapiens
acagactggaagca

SEQ ID NO: 3785305 - DNA, 22 bp, Homo sapiens
acagactggaagcacagcttca

SEQ ID NO: 3785306 - DNA, 17 bp, Homo sapiens
acagacttctccagacc

SEQ ID NO: 3785307 - DNA, 15 bp, Homo sapiens
acagacttgagaact

SEQ ID NO: 3785308 - DNA, 17 bp, Homo sapiens
gctgaacggggagaaaa

SEQ ID NO: 3785309 - DNA, 19 bp, Homo sapiens
gctgaatttataaaaatta

SEQ ID NO: 3785310 - DNA, 19 bp, Homo sapiens
gctgacaaccaccgctccc

SEQ ID NO: 3785311 - DNA, 15 bp, Homo sapiens
gctgacagacacagg

SEQ ID NO: 3785312 - DNA, 19 bp, Homo sapiens
gctgacagacacaggcccg

SEQ ID NO: 3785313 - DNA, 20 bp, Homo sapiens
gctgacagacacaggcccgg

SEQ ID NO: 3785314 - DNA, 14 bp, Homo sapiens
gctgaccaagagag

SEQ ID NO: 3785315 - DNA, 15 bp, Homo sapiens
gctgacccagtccct

SEQ ID NO: 3785316 - DNA, 16 bp, Homo sapiens
gctgacccagtccctg

SEQ ID NO: 3785317 - DNA, 21 bp, Homo sapiens
gctgacccccctcaggaccct

SEQ ID NO: 3785318 - DNA, 21 bp, Homo sapiens
gctgaccttgaactcctgggc

SEQ ID NO: 3785319 - DNA, 23 bp, Homo sapiens
gctgactctaggtgcccttggag

SEQ ID NO: 3785320 - DNA, 20 bp, Homo sapiens
gctgactgatgttgagggaa

SEQ ID NO: 3785321 - DNA, 18 bp, Homo sapiens
gctgactgtactcctccc

SEQ ID NO: 3785322 - DNA, 22 bp, Homo sapiens
gctgactgttttctcttgagag

SEQ ID NO: 3785323 - DNA, 14 bp, Homo sapiens
gctgagagaacctc

SEQ ID NO: 3785324 - DNA, 14 bp, Homo sapiens
gctgagagacccaa

SEQ ID NO: 3785325 - DNA, 15 bp, Homo sapiens
gctgagagacccaag

SEQ ID NO: 3785326 - DNA, 17 bp, Homo sapiens
gctgagagacccaagga

SEQ ID NO: 3785327 - DNA, 11 bp, Homo sapiens
gctgagccctg

SEQ ID NO: 3785328 - DNA, 20 bp, Homo sapiens
gctgaggatttcaagcctgc

SEQ ID NO: 3785329 - DNA, 14 bp, Homo sapiens
gctgaggcaattct

SEQ ID NO: 3785330 - DNA, 16 bp, Homo sapiens
gctgaggcagaagaat

SEQ ID NO: 3785331 - DNA, 18 bp, Homo sapiens
gctgagggtgagtgggtg

SEQ ID NO: 3785332 - DNA, 15 bp, Homo sapiens
gctgaggtgagagga

SEQ ID NO: 3785333 - DNA, 15 bp, Homo sapiens
gctgaggtgggagga

SEQ ID NO: 3785334 - DNA, 19 bp, Homo sapiens
gctgaggtgggaggatcac

SEQ ID NO: 3785335 - DNA, 21 bp, Homo sapiens
gctgagtcatgatctccctgc

SEQ ID NO: 3785336 - DNA, 22 bp, Homo sapiens
gctgagtcatgatctccctgcc

SEQ ID NO: 3785337 - DNA, 23 bp, Homo sapiens
gctgagtcatgatctccctgccg

SEQ ID NO: 3785338 - DNA, 17 bp, Homo sapiens
gctgagtctgcagatga

SEQ ID NO: 3785339 - DNA, 12 bp, Homo sapiens
gctgagtgagct

SEQ ID NO: 3785340 - DNA, 13 bp, Homo sapiens
gctgataaaagat

SEQ ID NO: 3785341 - DNA, 12 bp, Homo sapiens
gctgatctcagg

SEQ ID NO: 3785342 - DNA, 15 bp, Homo sapiens
gctgatgctcatggt

SEQ ID NO: 3785343 - DNA, 22 bp, Homo sapiens
gctgattactgtcaataaacag

SEQ ID NO: 3785344 - DNA, 15 bp, Homo sapiens
gctgattttaacaat

SEQ ID NO: 3785345 - DNA, 17 bp, Homo sapiens
gctgcaaaagtgagggc

SEQ ID NO: 3785346 - DNA, 23 bp, Homo sapiens
gctgcaaagggtatcaggtgctg

SEQ ID NO: 3785347 - DNA, 20 bp, Homo sapiens
gctgcaagtgacatctcttt

SEQ ID NO: 3785348 - DNA, 20 bp, Homo sapiens
gctgcacctgccagcctggc

SEQ ID NO: 3785349 - DNA, 21 bp, Homo sapiens
gctgcacctgccagcctggct

SEQ ID NO: 3785350 - DNA, 22 bp, Homo sapiens
gctgcacctgccagcctggctt

SEQ ID NO: 3785351 - DNA, 15 bp, Homo sapiens
gctgcagctgggctg

SEQ ID NO: 3785352 - DNA, 15 bp, Homo sapiens
gctgcatagaaggag

SEQ ID NO: 3785353 - DNA, 18 bp, Homo sapiens
gctgcatagaaggaggag

SEQ ID NO: 3785354 - DNA, 21 bp, Homo sapiens
gctgcatccgtgagcagtgtg

SEQ ID NO: 3785355 - DNA, 21 bp, Homo sapiens
gctgcattgcctgcggtcaag

SEQ ID NO: 3785356 - DNA, 14 bp, Homo sapiens
gctgccaagcccca

SEQ ID NO: 3785357 - DNA, 16 bp, Homo sapiens
gctgccaaggccagag

SEQ ID NO: 3785358 - DNA, 15 bp, Homo sapiens
gctgccacacttcag

SEQ ID NO: 3785359 - DNA, 18 bp, Homo sapiens
gctgccacacttcaggct

SEQ ID NO: 3785360 - DNA, 22 bp, Homo sapiens
gctgccacacttcaggctcttc

SEQ ID NO: 3785361 - DNA, 18 bp, Homo sapiens
gctgccagcacagagcgt

SEQ ID NO: 3785362 - DNA, 12 bp, Homo sapiens
gctgccatccag

SEQ ID NO: 3785363 - DNA, 17 bp, Homo sapiens
gctgccatccaggttca

SEQ ID NO: 3785364 - DNA, 22 bp, Homo sapiens
gctgccatggcgtgtccctctc

SEQ ID NO: 3785365 - DNA, 13 bp, Homo sapiens
gctgccatgtgaa

SEQ ID NO: 3785366 - DNA, 17 bp, Homo sapiens
gctgccatgtgaagagg

SEQ ID NO: 3785367 - DNA, 22 bp, Homo sapiens
gctgccccagctgactgtggcc

SEQ ID NO: 3785368 - DNA, 19 bp, Homo sapiens
gctgccccatgaagccaca

SEQ ID NO: 3785369 - DNA, 14 bp, Homo sapiens
gctgcccccgctca

SEQ ID NO: 3785370 - DNA, 14 bp, Homo sapiens
gctgcccctccctg

SEQ ID NO: 3785371 - DNA, 17 bp, Homo sapiens
gctgcccctggctctga

SEQ ID NO: 3785372 - DNA, 14 bp, Homo sapiens
gctgccctccatcc

SEQ ID NO: 3785373 - DNA, 15 bp, Homo sapiens
gctgccctccatccc

SEQ ID NO: 3785374 - DNA, 18 bp, Homo sapiens
gctgccctggtgctgcca

SEQ ID NO: 3785375 - DNA, 23 bp, Homo sapiens
gctgccctggtgctgccacactt

SEQ ID NO: 3785376 - DNA, 14 bp, Homo sapiens
gctgccgcacccca

SEQ ID NO: 3785377 - DNA, 18 bp, Homo sapiens
gctgccgcaccccagagt

SEQ ID NO: 3785378 - DNA, 22 bp, Homo sapiens
gctgccgcaccccagagtgtgg

SEQ ID NO: 3785379 - DNA, 13 bp, Homo sapiens
gctgccgcctccc

SEQ ID NO: 3785380 - DNA, 18 bp, Homo sapiens
gctgccgcctcccagcct

SEQ ID NO: 3785381 - DNA, 20 bp, Homo sapiens
gctgccgcctcccagcctgg

SEQ ID NO: 3785382 - DNA, 18 bp, Homo sapiens
gctgcctaagtggctgct

SEQ ID NO: 3785383 - DNA, 23 bp, Homo sapiens
gctgcctgagcacctcccagccc

SEQ ID NO: 3785384 - DNA, 17 bp, Homo sapiens
gctgcctggagccccac

SEQ ID NO: 3785385 - DNA, 21 bp, Homo sapiens
gctgcctggcccccagctgtg

SEQ ID NO: 3785386 - DNA, 22 bp, Homo sapiens
gctgcctggcccccagctgtgg

SEQ ID NO: 3785387 - DNA, 13 bp, Homo sapiens
gctgcctgtagtt

SEQ ID NO: 3785388 - DNA, 15 bp, Homo sapiens
gctgcctgtagttag

SEQ ID NO: 3785389 - DNA, 13 bp, Homo sapiens
gctgcctgttcag

SEQ ID NO: 3785390 - DNA, 20 bp, Homo sapiens
gctgcctgttcagctccagc

SEQ ID NO: 3785391 - DNA, 15 bp, Homo sapiens
gctgcgatactggca

SEQ ID NO: 3785392 - DNA, 14 bp, Homo sapiens
gctgcggcaccctt

SEQ ID NO: 3785393 - DNA, 14 bp, Homo sapiens
gctgcggtccaccc

SEQ ID NO: 3785394 - DNA, 17 bp, Homo sapiens
gctgcggtccacccagg

SEQ ID NO: 3785395 - DNA, 18 bp, Homo sapiens
gctgcggtccacccagga

SEQ ID NO: 3785396 - DNA, 19 bp, Homo sapiens
gctgcggtccacccaggag

SEQ ID NO: 3785397 - DNA, 21 bp, Homo sapiens
gctgctaaatctcctattttt

SEQ ID NO: 3785398 - DNA, 18 bp, Homo sapiens
gctgctaatcttcagggc

SEQ ID NO: 3785399 - DNA, 12 bp, Homo sapiens
gctgctacccag

SEQ ID NO: 3785400 - DNA, 14 bp, Homo sapiens
gctgctacccagaa

SEQ ID NO: 3785401 - DNA, 20 bp, Homo sapiens
gctgctagcacttggagcca

SEQ ID NO: 3785402 - DNA, 17 bp, Homo sapiens
gctgctccttagctgcc

SEQ ID NO: 3785403 - DNA, 18 bp, Homo sapiens
gctgctccttagctgcca

SEQ ID NO: 3785404 - DNA, 14 bp, Homo sapiens
gctgctctgcccag

SEQ ID NO: 3785405 - DNA, 16 bp, Homo sapiens
gctgctgactgatgtt

SEQ ID NO: 3785406 - DNA, 23 bp, Homo sapiens
gctgctgcctttagtcgctgagg

SEQ ID NO: 3785407 - DNA, 22 bp, Homo sapiens
gctgctggaggaaaactgagac

SEQ ID NO: 3785408 - DNA, 15 bp, Homo sapiens
gctgctggcttgcag

SEQ ID NO: 3785409 - DNA, 20 bp, Homo sapiens
gctgctgtggccatcaacct

SEQ ID NO: 3785410 - DNA, 15 bp, Homo sapiens
gctgcttccctctgc

SEQ ID NO: 3785411 - DNA, 23 bp, Homo sapiens
gctgctttaattgtgaattgata

SEQ ID NO: 3785412 - DNA, 18 bp, Homo sapiens
gctggaattttttattct

SEQ ID NO: 3785413 - DNA, 20 bp, Homo sapiens
gctggaattttttattcttg

SEQ ID NO: 3785414 - DNA, 15 bp, Homo sapiens
gctggacaggtctgg

SEQ ID NO: 3785415 - DNA, 18 bp, Homo sapiens
gctggactccagatctgc

SEQ ID NO: 3785416 - DNA, 20 bp, Homo sapiens
gctggactccagatctgcac

SEQ ID NO: 3785417 - DNA, 21 bp, Homo sapiens
gctggactccagatctgcacc

SEQ ID NO: 3785418 - DNA, 23 bp, Homo sapiens
gctggactccagatctgcaccgc

SEQ ID NO: 3785419 - DNA, 14 bp, Homo sapiens
gctggactggctgt

SEQ ID NO: 3785420 - DNA, 16 bp, Homo sapiens
gcgggctgggcagctg

SEQ ID NO: 3785421 - DNA, 15 bp, Homo sapiens
gcggggacagctcct

SEQ ID NO: 3785422 - DNA, 18 bp, Homo sapiens
gcggggacagctccttct

SEQ ID NO: 3785423 - DNA, 23 bp, Homo sapiens
gcggggacagctccttctgtcct

SEQ ID NO: 3785424 - DNA, 16 bp, Homo sapiens
gcggggagtacaaggc

SEQ ID NO: 3785425 - DNA, 19 bp, Homo sapiens
gcgggtggatcacctgagg

SEQ ID NO: 3785426 - DNA, 23 bp, Homo sapiens
gcggtccacccaggagccccgag

SEQ ID NO: 3785427 - DNA, 19 bp, Homo sapiens
gcggtcccctccgccaggc

SEQ ID NO: 3785428 - DNA, 18 bp, Homo sapiens
gcgtagagggtgctgccc

SEQ ID NO: 3785429 - DNA, 19 bp, Homo sapiens
gcgtcctgtcggagccctg

SEQ ID NO: 3785430 - DNA, 19 bp, Homo sapiens
gcgtctcatactcacctca

SEQ ID NO: 3785431 - DNA, 19 bp, Homo sapiens
gcgtgaaacacaccaggct

SEQ ID NO: 3785432 - DNA, 20 bp, Homo sapiens
gcgtgaaacacaccaggctg

SEQ ID NO: 3785433 - DNA, 23 bp, Homo sapiens
gcgtgaaacacaccaggctgtgg

SEQ ID NO: 3785434 - DNA, 18 bp, Homo sapiens
gcgtgagccactgcaccg

SEQ ID NO: 3785435 - DNA, 19 bp, Homo sapiens
gcgtgtcgtgggtgtgtgt

SEQ ID NO: 3785436 - DNA, 23 bp, Homo sapiens
gcgtgtgtccatgtgtgtgcaag

SEQ ID NO: 3785437 - DNA, 16 bp, Homo sapiens
gcgttactaattggcc

SEQ ID NO: 3785438 - DNA, 14 bp, Homo sapiens
gcgttggaattaaa

SEQ ID NO: 3785439 - DNA, 17 bp, Homo sapiens
gcgttggaattaaaaca

SEQ ID NO: 3785440 - DNA, 19 bp, Homo sapiens
gcgttggaattaaaacaat

SEQ ID NO: 3785441 - DNA, 19 bp, Homo sapiens
gcgtttgcccaaatctgcc

SEQ ID NO: 3785442 - DNA, 20 bp, Homo sapiens
gcgtttgcccaaatctgcct

SEQ ID NO: 3785443 - DNA, 16 bp, Homo sapiens
gctaaatctcctattt

SEQ ID NO: 3785444 - DNA, 19 bp, Homo sapiens
gctaaatggtcgcccagga

SEQ ID NO: 3785445 - DNA, 21 bp, Homo sapiens
gctaactagcttggaaactgg

SEQ ID NO: 3785446 - DNA, 12 bp, Homo sapiens
gctaactggaag

SEQ ID NO: 3785447 - DNA, 18 bp, Homo sapiens
gctaacttggagccccag

SEQ ID NO: 3785448 - DNA, 20 bp, Homo sapiens
gctaagagctagcgctgccg

SEQ ID NO: 3785449 - DNA, 16 bp, Homo sapiens
gctaaggacaggcagg

SEQ ID NO: 3785450 - DNA, 18 bp, Homo sapiens
gctaagtgaaaaggtcat

SEQ ID NO: 3785451 - DNA, 18 bp, Homo sapiens
gctaagtgatcctcccac

SEQ ID NO: 3785452 - DNA, 19 bp, Homo sapiens
gctaataaaatatcattca

SEQ ID NO: 3785453 - DNA, 20 bp, Homo sapiens
gctaataaaatatcattcag

SEQ ID NO: 3785454 - DNA, 14 bp, Homo sapiens
gctaatcagcattc

SEQ ID NO: 3785455 - DNA, 21 bp, Homo sapiens
gctaatcatgtgggtgagcca

SEQ ID NO: 3785456 - DNA, 14 bp, Homo sapiens
gctaattattttaa

SEQ ID NO: 3785457 - DNA, 15 bp, Homo sapiens
gctaattattttaat

SEQ ID NO: 3785458 - DNA, 23 bp, Homo sapiens
gctaattattttaattaggttaa

SEQ ID NO: 3785459 - DNA, 20 bp, Homo sapiens
gctacaggaagcaccccatg

SEQ ID NO: 3785460 - DNA, 23 bp, Homo sapiens
gctacaggaagcaccccatgcca

SEQ ID NO: 3785461 - DNA, 23 bp, Homo sapiens
gctacatgacgacaaagctgcta

SEQ ID NO: 3785462 - DNA, 20 bp, Homo sapiens
gctaccaaagcaccttagct

SEQ ID NO: 3785463 - DNA, 19 bp, Homo sapiens
gctacctgatcccactcct

SEQ ID NO: 3785464 - DNA, 15 bp, Homo sapiens
gctaccttattgtac

SEQ ID NO: 3785465 - DNA, 16 bp, Homo sapiens
gctactcaagaggctg

SEQ ID NO: 3785466 - DNA, 20 bp, Homo sapiens
gctactcaagaggctgaggc

SEQ ID NO: 3785467 - DNA, 24 bp, Homo sapiens
gctactcagcagccctcctcaccc

SEQ ID NO: 3785468 - DNA, 23 bp, Homo sapiens
gctactcaggaggctgaggcaga

SEQ ID NO: 3785469 - DNA, 19 bp, Homo sapiens
gctactgtcctacccaccc

SEQ ID NO: 3785470 - DNA, 17 bp, Homo sapiens
gctacttcctgcctggt

SEQ ID NO: 3785471 - DNA, 13 bp, Homo sapiens
gctacttgggagg

SEQ ID NO: 3785472 - DNA, 12 bp, Homo sapiens
gctactttgttt

SEQ ID NO: 3785473 - DNA, 22 bp, Homo sapiens
gctagagcttcaagtctgtgcc

SEQ ID NO: 3785474 - DNA, 16 bp, Homo sapiens
gctagagtcctcactc

SEQ ID NO: 3785475 - DNA, 23 bp, Homo sapiens
gctagatgagaattcagctgccc

SEQ ID NO: 3785476 - DNA, 22 bp, Homo sapiens
gctagcaaaagaagtaacaaga

SEQ ID NO: 3785477 - DNA, 15 bp, Homo sapiens
gctagcgctgccgca

SEQ ID NO: 3785478 - DNA, 18 bp, Homo sapiens
gctaggcatacaagtagg

SEQ ID NO: 3785479 - DNA, 17 bp, Homo sapiens
gctaggcctggccagat

SEQ ID NO: 3785480 - DNA, 23 bp, Homo sapiens
gctaggcctggccagatgcacca

SEQ ID NO: 3785481 - DNA, 14 bp, Homo sapiens
gctagggtggccct

SEQ ID NO: 3785482 - DNA, 14 bp, Homo sapiens
gctagtcagagaga

SEQ ID NO: 3785483 - DNA, 16 bp, Homo sapiens
gctagttgggcttcct

SEQ ID NO: 3785484 - DNA, 22 bp, Homo sapiens
gctagttttacagattgcctcc

SEQ ID NO: 3785485 - DNA, 20 bp, Homo sapiens
gctataactatgttgataaa

SEQ ID NO: 3785486 - DNA, 19 bp, Homo sapiens
gctatagacccgaggaaac

SEQ ID NO: 3785487 - DNA, 23 bp, Homo sapiens
gctatatccatgtactgtagttt

SEQ ID NO: 3785488 - DNA, 20 bp, Homo sapiens
gctatcaaaataaattgaaa

SEQ ID NO: 3785489 - DNA, 22 bp, Homo sapiens
gctatcaaaataaattgaaata

SEQ ID NO: 3785490 - DNA, 19 bp, Homo sapiens
gctatccagctatttttat

SEQ ID NO: 3785491 - DNA, 16 bp, Homo sapiens
gctatctctgtgtgca

SEQ ID NO: 3785492 - DNA, 20 bp, Homo sapiens
gctatctctgtgtgcacaaa

SEQ ID NO: 3785493 - DNA, 14 bp, Homo sapiens
gctatgggagcccc

SEQ ID NO: 3785494 - DNA, 21 bp, Homo sapiens
gctatgggagccccagggtct

SEQ ID NO: 3785495 - DNA, 22 bp, Homo sapiens
gctatgtatggaatacagtgtt

SEQ ID NO: 3785496 - DNA, 18 bp, Homo sapiens
gctattattttcactgta

SEQ ID NO: 3785497 - DNA, 21 bp, Homo sapiens
gctattattttcactgtagaa

SEQ ID NO: 3785498 - DNA, 19 bp, Homo sapiens
gctattcagtaataactct

SEQ ID NO: 3785499 - DNA, 18 bp, Homo sapiens
gctattttactgtcttaa

SEQ ID NO: 3785500 - DNA, 19 bp, Homo sapiens
gctcaaaaggaaaccaagt

SEQ ID NO: 3785501 - DNA, 14 bp, Homo sapiens
gctcaaaggcacag

SEQ ID NO: 3785502 - DNA, 16 bp, Homo sapiens
gctcaaaggcacagtg

SEQ ID NO: 3785503 - DNA, 21 bp, Homo sapiens
gctcaaaggcacagtgaaggc

SEQ ID NO: 3785504 - DNA, 23 bp, Homo sapiens
gctcaagcaatcctcctgagtga

SEQ ID NO: 3785505 - DNA, 18 bp, Homo sapiens
gctcaagtcctcttttct

SEQ ID NO: 3785506 - DNA, 19 bp, Homo sapiens
gctcaagtcctcttttctg

SEQ ID NO: 3785507 - DNA, 12 bp, Homo sapiens
gctcaagttcat

SEQ ID NO: 3785508 - DNA, 21 bp, Homo sapiens
gctcaatattcctgaatgaaa

SEQ ID NO: 3785509 - DNA, 22 bp, Homo sapiens
gctcacagaacccttggagcca

SEQ ID NO: 3785510 - DNA, 12 bp, Homo sapiens
gctcacagactg

SEQ ID NO: 3785511 - DNA, 19 bp, Homo sapiens
gctcacagttcctcgccct

SEQ ID NO: 3785512 - DNA, 22 bp, Homo sapiens
gctcacagttcctcgccctggg

SEQ ID NO: 3785513 - DNA, 19 bp, Homo sapiens
gctcaccagccccagtgcc

SEQ ID NO: 3785514 - DNA, 21 bp, Homo sapiens
gctcacgcctatgatcccagc

SEQ ID NO: 3785515 - DNA, 22 bp, Homo sapiens
gctcacgcctgtaatcccagca

SEQ ID NO: 3785516 - DNA, 14 bp, Homo sapiens
gctcacgtcacact

SEQ ID NO: 3785517 - DNA, 11 bp, Homo sapiens
gctcactgcag

SEQ ID NO: 3785518 - DNA, 14 bp, Homo sapiens
gctcactgcagcct

SEQ ID NO: 3785519 - DNA, 15 bp, Homo sapiens
gctcactgcagcctc

SEQ ID NO: 3785520 - DNA, 17 bp, Homo sapiens
gctcactgcagcctcaa

SEQ ID NO: 3785521 - DNA, 17 bp, Homo sapiens
gctcactgcagcctcga

SEQ ID NO: 3785522 - DNA, 19 bp, Homo sapiens
gctcagacccccactctca

SEQ ID NO: 3785523 - DNA, 18 bp, Homo sapiens
gctcagataatgcccaga

SEQ ID NO: 3785524 - DNA, 24 bp, Homo sapiens
gtgatccacccacctcagcctccc

SEQ ID NO: 3785525 - DNA, 19 bp, Homo sapiens
gtgatccatccatctccag

SEQ ID NO: 3785526 - DNA, 21 bp, Homo sapiens
gtgatccatccatctccaggg

SEQ ID NO: 3785527 - DNA, 14 bp, Homo sapiens
gtgatcctcccacc

SEQ ID NO: 3785528 - DNA, 18 bp, Homo sapiens
gtgatcctcccacctcag

SEQ ID NO: 3785529 - DNA, 22 bp, Homo sapiens
gtgatcctcccacctcagcctc

SEQ ID NO: 3785530 - DNA, 12 bp, Homo sapiens
gtgatctccata

SEQ ID NO: 3785531 - DNA, 13 bp, Homo sapiens
gtgatctccatat

SEQ ID NO: 3785532 - DNA, 12 bp, Homo sapiens
gtgatctgggaa

SEQ ID NO: 3785533 - DNA, 16 bp, Homo sapiens
aatgtcttgttaatat

SEQ ID NO: 3785534 - DNA, 17 bp, Homo sapiens
aatgtgaaaagaaaaat

SEQ ID NO: 3785535 - DNA, 19 bp, Homo sapiens
aatgtgaaaagaaaaatga

SEQ ID NO: 3785536 - DNA, 19 bp, Homo sapiens
aatgtgctactgattgttt

SEQ ID NO: 3785537 - DNA, 21 bp, Homo sapiens
aatgtgctgaatggttttcaa

SEQ ID NO: 3785538 - DNA, 20 bp, Homo sapiens
aatgttacatagtgtaggct

SEQ ID NO: 3785539 - DNA, 15 bp, Homo sapiens
aatgttacattgttt

SEQ ID NO: 3785540 - DNA, 13 bp, Homo sapiens
aatgttactgatc

SEQ ID NO: 3785541 - DNA, 21 bp, Homo sapiens
aatgttactgatcatgcattg

SEQ ID NO: 3785542 - DNA, 16 bp, Homo sapiens
aatgttatagtgaatt

SEQ ID NO: 3785543 - DNA, 22 bp, Homo sapiens
aatgttatgttgtgttctaata

SEQ ID NO: 3785544 - DNA, 21 bp, Homo sapiens
aatgttctctcttctccacct

SEQ ID NO: 3785545 - DNA, 14 bp, Homo sapiens
aatgttctgacatt

SEQ ID NO: 3785546 - DNA, 15 bp, Homo sapiens
aatgttgttatttaa

SEQ ID NO: 3785547 - DNA, 19 bp, Homo sapiens
aatgtttgcctctgcctct

SEQ ID NO: 3785548 - DNA, 17 bp, Homo sapiens
aatgttttatactgttt

SEQ ID NO: 3785549 - DNA, 17 bp, Homo sapiens
aattaaaaaatttccag

SEQ ID NO: 3785550 - DNA, 22 bp, Homo sapiens
aaggtgctgttgtcattgcttt

SEQ ID NO: 3785551 - DNA, 15 bp, Homo sapiens
aaggtggagtggatg

SEQ ID NO: 3785552 - DNA, 11 bp, Homo sapiens
aaggtgggagg

SEQ ID NO: 3785553 - DNA, 22 bp, Homo sapiens
aaggtgggccttgctacctcaa

SEQ ID NO: 3785554 - DNA, 18 bp, Homo sapiens
aaggtgggctgagccctg

SEQ ID NO: 3785555 - DNA, 19 bp, Homo sapiens
aaggtgggctgagccctgg

SEQ ID NO: 3785556 - DNA, 17 bp, Homo sapiens
aaggtggtatgtgtgtg

SEQ ID NO: 3785557 - DNA, 17 bp, Homo sapiens
aaggtgtaactctaatt

SEQ ID NO: 3785558 - DNA, 22 bp, Homo sapiens
aaggtgttcattcacttgcatt

SEQ ID NO: 3785559 - DNA, 17 bp, Homo sapiens
aaggttcttactgcttg

SEQ ID NO: 3785560 - DNA, 22 bp, Homo sapiens
aaggttgacaataaatgtgctt

SEQ ID NO: 3785561 - DNA, 13 bp, Homo sapiens
aaggttgtattgc

SEQ ID NO: 3785562 - DNA, 13 bp, Homo sapiens
aagtaaactgccc

SEQ ID NO: 3785563 - DNA, 15 bp, Homo sapiens
aagtaaatgtctgtg

SEQ ID NO: 3785564 - DNA, 15 bp, Homo sapiens
aagtaacttgtctta

SEQ ID NO: 3785565 - DNA, 21 bp, Homo sapiens
aagtaagaaagtgaagcaaat

SEQ ID NO: 3785566 - DNA, 23 bp, Homo sapiens
aagtaagcccttgaagatatctt

SEQ ID NO: 3785567 - DNA, 20 bp, Homo sapiens
aagtaagtaccactcaggcc

SEQ ID NO: 3785568 - DNA, 15 bp, Homo sapiens
aagtaattatcggga

SEQ ID NO: 3785569 - DNA, 16 bp, Homo sapiens
aagtaattgtgaaaaa

SEQ ID NO: 3785570 - DNA, 20 bp, Homo sapiens
aagtacatattaggaaaata

SEQ ID NO: 3785571 - DNA, 16 bp, Homo sapiens
aagtactgtgtacaga

SEQ ID NO: 3785572 - DNA, 18 bp, Homo sapiens
aagtacttctccaccctg

SEQ ID NO: 3785573 - DNA, 20 bp, Homo sapiens
aagtagaagtcttagatgta

SEQ ID NO: 3785574 - DNA, 21 bp, Homo sapiens
aagtagaagtcttagatgtat

SEQ ID NO: 3785575 - DNA, 23 bp, Homo sapiens
aagtagacttcatttttcctaac

SEQ ID NO: 3785576 - DNA, 15 bp, Homo sapiens
aagtaggcatgaggg

SEQ ID NO: 3785577 - DNA, 18 bp, Homo sapiens
aagtatataaattggctt

SEQ ID NO: 3785578 - DNA, 16 bp, Homo sapiens
aagtatatatagaatc

SEQ ID NO: 3785579 - DNA, 12 bp, Homo sapiens
aagtatcagaaa

SEQ ID NO: 3785580 - DNA, 17 bp, Homo sapiens
aagtatcatggaaatat

SEQ ID NO: 3785581 - DNA, 19 bp, Homo sapiens
aagtatcttcgttcttgtt

SEQ ID NO: 3785582 - DNA, 18 bp, Homo sapiens
aagtattccaccttaaat

SEQ ID NO: 3785583 - DNA, 22 bp, Homo sapiens
aagtattctgcctttgcagaaa

SEQ ID NO: 3785584 - DNA, 17 bp, Homo sapiens
aagtatttatatattta

SEQ ID NO: 3785585 - DNA, 22 bp, Homo sapiens
aagtatttatatatttataact

SEQ ID NO: 3785586 - DNA, 19 bp, Homo sapiens
aagtcaaaaggtgcctgtg

SEQ ID NO: 3785587 - DNA, 14 bp, Homo sapiens
aagtcaaagtaaaa

SEQ ID NO: 3785588 - DNA, 21 bp, Homo sapiens
aagtcaagtgaaaaaggagga

SEQ ID NO: 3785589 - DNA, 24 bp, Homo sapiens
aagtcacacagtattacttctgct

SEQ ID NO: 3785590 - DNA, 16 bp, Homo sapiens
aagtcacatcacagga

SEQ ID NO: 3785591 - DNA, 21 bp, Homo sapiens
aagtcacccggcccccatgca

SEQ ID NO: 3785592 - DNA, 16 bp, Homo sapiens
aagtcagactgctggg

SEQ ID NO: 3785593 - DNA, 18 bp, Homo sapiens
aagtcagctcttctccat

SEQ ID NO: 3785594 - DNA, 16 bp, Homo sapiens
aagtcaggtccaattt

SEQ ID NO: 3785595 - DNA, 16 bp, Homo sapiens
aagtcattttaacttt

SEQ ID NO: 3785596 - DNA, 19 bp, Homo sapiens
aagtccaggtcgggctcag

SEQ ID NO: 3785597 - DNA, 21 bp, Homo sapiens
aagtccaggtcgggctcagct

SEQ ID NO: 3785598 - DNA, 22 bp, Homo sapiens
aagtccccaggccccaggaagc

SEQ ID NO: 3785599 - DNA, 19 bp, Homo sapiens
aagtccctgactctctgtg

SEQ ID NO: 3785600 - DNA, 14 bp, Homo sapiens
aagtccctgccccc

SEQ ID NO: 3785601 - DNA, 18 bp, Homo sapiens
aagtcctcttttctgaga

SEQ ID NO: 3785602 - DNA, 12 bp, Homo sapiens
aagtcctggcta

SEQ ID NO: 3785603 - DNA, 19 bp, Homo sapiens
aagtcctggctacatccca

SEQ ID NO: 3785604 - DNA, 14 bp, Homo sapiens
aagtcggttagtgg

SEQ ID NO: 3785605 - DNA, 16 bp, Homo sapiens
aagtctaaatatttcc

SEQ ID NO: 3785606 - DNA, 22 bp, Homo sapiens
aagtctaggagctgggaggaaa

SEQ ID NO: 3785607 - DNA, 12 bp, Homo sapiens
aagtctccagcc

SEQ ID NO: 3785608 - DNA, 20 bp, Homo sapiens
aagtctctatttaaattctt

SEQ ID NO: 3785609 - DNA, 12 bp, Homo sapiens
aagtctctgtga

SEQ ID NO: 3785610 - DNA, 17 bp, Homo sapiens
aagtcttagatgtatat

SEQ ID NO: 3785611 - DNA, 12 bp, Homo sapiens
aagtcttcaggg

SEQ ID NO: 3785612 - DNA, 18 bp, Homo sapiens
aagtcttccctgatcaag

SEQ ID NO: 3785613 - DNA, 14 bp, Homo sapiens
aagtcttgtgacta

SEQ ID NO: 3785614 - DNA, 20 bp, Homo sapiens
aagtcttgtgactagtgctg

SEQ ID NO: 3785615 - DNA, 21 bp, Homo sapiens
aagtgaaaaaggaggaagaga

SEQ ID NO: 3785616 - DNA, 22 bp, Homo sapiens
aagtgaaatctgtgcaataaaa

SEQ ID NO: 3785617 - DNA, 14 bp, Homo sapiens
aagtgaataaaaat

SEQ ID NO: 3785618 - DNA, 15 bp, Homo sapiens
aagtgaataaaaatt

SEQ ID NO: 3785619 - DNA, 20 bp, Homo sapiens
aagtgaatttgaatgaaaaa

SEQ ID NO: 3785620 - DNA, 18 bp, Homo sapiens
aagtgacaaggccccaga

SEQ ID NO: 3785621 - DNA, 15 bp, Homo sapiens
aagtgataatttctg

SEQ ID NO: 3785622 - DNA, 13 bp, Homo sapiens
aagtgatcctccc

SEQ ID NO: 3785623 - DNA, 17 bp, Homo sapiens
aagtgattctcctgcct

SEQ ID NO: 3785624 - DNA, 18 bp, Homo sapiens
aagtgattctcctgcctc

SEQ ID NO: 3785625 - DNA, 19 bp, Homo sapiens
aagtgattctcctgcctca

SEQ ID NO: 3785626 - DNA, 20 bp, Homo sapiens
aagtgattctcctgcctcag

SEQ ID NO: 3785627 - DNA, 12 bp, Homo sapiens
aagtgcaggctg

SEQ ID NO: 3785628 - DNA, 21 bp, Homo sapiens
aagtgccactgcccgagctgg

SEQ ID NO: 3785629 - DNA, 12 bp, Homo sapiens
aagtgcccctgc

SEQ ID NO: 3785630 - DNA, 22 bp, Homo sapiens
aagtgcccctgctgcctcccca

SEQ ID NO: 3785631 - DNA, 19 bp, Homo sapiens
aagtggaaaaatagcctgc

SEQ ID NO: 3785632 - DNA, 13 bp, Homo sapiens
aagtggaaatgtt

SEQ ID NO: 3785633 - DNA, 20 bp, Homo sapiens
aagtggaccaggacaggacc

SEQ ID NO: 3785634 - DNA, 18 bp, Homo sapiens
aagtggcatgtgctgtga

SEQ ID NO: 3785635 - DNA, 12 bp, Homo sapiens
aagtggctgctg

SEQ ID NO: 3785636 - DNA, 14 bp, Homo sapiens
aagtggctgctgac

SEQ ID NO: 3785637 - DNA, 21 bp, Homo sapiens
aagtgggccaggacaggcccg

SEQ ID NO: 3785638 - DNA, 14 bp, Homo sapiens
aagtgtaacagctg

SEQ ID NO: 3785639 - DNA, 22 bp, Homo sapiens
aagtgtattttataaaattaaa

SEQ ID NO: 3785640 - DNA, 15 bp, Homo sapiens
aagtgtccgagaact

SEQ ID NO: 3785641 - DNA, 13 bp, Homo sapiens
aagtgtgagcaaa

SEQ ID NO: 3785642 - DNA, 18 bp, Homo sapiens
aagtgtgagtaagagctg

SEQ ID NO: 3785643 - DNA, 11 bp, Homo sapiens
aagtgtgtgtg

SEQ ID NO: 3785644 - DNA, 17 bp, Homo sapiens
aagtgttgtaaatattt

SEQ ID NO: 3785645 - DNA, 20 bp, Homo sapiens
aagtgtttccttcatttctg

SEQ ID NO: 3785646 - DNA, 21 bp, Homo sapiens
aagtgtttccttcatttctga

SEQ ID NO: 3785647 - DNA, 13 bp, Homo sapiens
aagtgttttcaga

SEQ ID NO: 3785648 - DNA, 18 bp, Homo sapiens
aagttaaacattgaagta

SEQ ID NO: 3785649 - DNA, 17 bp, Homo sapiens
aagttaaagtgaataac

SEQ ID NO: 3785650 - DNA, 23 bp, Homo sapiens
aagttaagaatgttcttatgttg

SEQ ID NO: 3785651 - DNA, 16 bp, Homo sapiens
aagttactatcctggc

SEQ ID NO: 3785652 - DNA, 13 bp, Homo sapiens
aagttagctcagg

SEQ ID NO: 3785653 - DNA, 15 bp, Homo sapiens
aagttagctcaggag

SEQ ID NO: 3785654 - DNA, 16 bp, Homo sapiens
aagttatataaagaga

SEQ ID NO: 3785655 - DNA, 17 bp, Homo sapiens
aagttattaatttcttc

SEQ ID NO: 3785656 - DNA, 13 bp, Homo sapiens
aagttatttcttg

SEQ ID NO: 3785657 - DNA, 11 bp, Homo sapiens
aagttcaagga

SEQ ID NO: 3785658 - DNA, 15 bp, Homo sapiens
aagttcaaggaccaa

SEQ ID NO: 3785659 - DNA, 21 bp, Homo sapiens
aagttcacgtaagatacaagt

SEQ ID NO: 3785660 - DNA, 15 bp, Homo sapiens
aagttctgagtgttt

SEQ ID NO: 3785661 - DNA, 16 bp, Homo sapiens
aagttctgtgtattta

SEQ ID NO: 3785662 - DNA, 17 bp, Homo sapiens
aagttcttagatatctt

SEQ ID NO: 3785663 - DNA, 16 bp, Homo sapiens
aatatcattcagcaac

SEQ ID NO: 3785664 - DNA, 23 bp, Homo sapiens
aatatcgatcagatgactagaaa

SEQ ID NO: 3785665 - DNA, 19 bp, Homo sapiens
aatatctgaaaatgtatgt

SEQ ID NO: 3785666 - DNA, 17 bp, Homo sapiens
aatatgacggaagaaca

SEQ ID NO: 3785667 - DNA, 18 bp, Homo sapiens
aatatgattagtaaagaa

SEQ ID NO: 3785668 - DNA, 19 bp, Homo sapiens
aatatgattagtaaagaaa

SEQ ID NO: 3785669 - DNA, 18 bp, Homo sapiens
aatatgcacacagtgctt

SEQ ID NO: 3785670 - DNA, 19 bp, Homo sapiens
aatatgtccatatctaacc

SEQ ID NO: 3785671 - DNA, 20 bp, Homo sapiens
aatatgttctttaaaaatat

SEQ ID NO: 3785672 - DNA, 17 bp, Homo sapiens
aatattaaaccctggat

SEQ ID NO: 3785673 - DNA, 13 bp, Homo sapiens
aatattaagaaag

SEQ ID NO: 3785674 - DNA, 11 bp, Homo sapiens
aatattatctt

SEQ ID NO: 3785675 - DNA, 12 bp, Homo sapiens
aatattatgcaa

SEQ ID NO: 3785676 - DNA, 17 bp, Homo sapiens
aatattatgcaaattcc

SEQ ID NO: 3785677 - DNA, 21 bp, Homo sapiens
aatattatgcaaattcccaga

SEQ ID NO: 3785678 - DNA, 12 bp, Homo sapiens
aatattcctgaa

SEQ ID NO: 3785679 - DNA, 17 bp, Homo sapiens
aatattgatatgcttat

SEQ ID NO: 3785680 - DNA, 15 bp, Homo sapiens
aatattgttcctaag

SEQ ID NO: 3785681 - DNA, 18 bp, Homo sapiens
aatattgttcctaagttc

SEQ ID NO: 3785682 - DNA, 23 bp, Homo sapiens
aatattgttcctaagttcttaga

SEQ ID NO: 3785683 - DNA, 13 bp, Homo sapiens
aatattgtttcta

SEQ ID NO: 3785684 - DNA, 15 bp, Homo sapiens
aatatttacatatga

SEQ ID NO: 3785685 - DNA, 15 bp, Homo sapiens
aatatttattacctc

SEQ ID NO: 3785686 - DNA, 17 bp, Homo sapiens
aatatttattacctctg

SEQ ID NO: 3785687 - DNA, 12 bp, Homo sapiens
aatatttattat

SEQ ID NO: 3785688 - DNA, 12 bp, Homo sapiens
aatatttgtaca

SEQ ID NO: 3785689 - DNA, 22 bp, Homo sapiens
aatatttgtcgatatttccatc

SEQ ID NO: 3785690 - DNA, 13 bp, Homo sapiens
aatattttaagca

SEQ ID NO: 3785691 - DNA, 23 bp, Homo sapiens
aatattttaagcattactcttgt

SEQ ID NO: 3785692 - DNA, 15 bp, Homo sapiens
aatattttattcaag

SEQ ID NO: 3785693 - DNA, 20 bp, Homo sapiens
aatattttattcaaggtaaa

SEQ ID NO: 3785694 - DNA, 18 bp, Homo sapiens
aatcaaaactctcctaca

SEQ ID NO: 3785695 - DNA, 19 bp, Homo sapiens
aatcaaatttgtagggttt

SEQ ID NO: 3785696 - DNA, 12 bp, Homo sapiens
aatcaagataaa

SEQ ID NO: 3785697 - DNA, 17 bp, Homo sapiens
aatcaagataaaggaca

SEQ ID NO: 3785698 - DNA, 22 bp, Homo sapiens
aatcaatccagcggttctcaaa

SEQ ID NO: 3785699 - DNA, 17 bp, Homo sapiens
aatcaatgtcacttaaa

SEQ ID NO: 3785700 - DNA, 19 bp, Homo sapiens
aatcacattcgagtgtttc

SEQ ID NO: 3785701 - DNA, 14 bp, Homo sapiens
aatcacttccatag

SEQ ID NO: 3785702 - DNA, 15 bp, Homo sapiens
aatcagattttcctg

SEQ ID NO: 3785703 - DNA, 18 bp, Homo sapiens
aatcagcattctcactcc

SEQ ID NO: 3785704 - DNA, 17 bp, Homo sapiens
aatcagcctacaggcct

SEQ ID NO: 3785705 - DNA, 18 bp, Homo sapiens
aatcagcctgctccagct

SEQ ID NO: 3785706 - DNA, 23 bp, Homo sapiens
aatcagctatttactgccaaagg

SEQ ID NO: 3785707 - DNA, 16 bp, Homo sapiens
aatcagtgtagcccca

SEQ ID NO: 3785708 - DNA, 17 bp, Homo sapiens
aatcataaactgtgtgc

SEQ ID NO: 3785709 - DNA, 18 bp, Homo sapiens
aatcatataataaatgta

SEQ ID NO: 3785710 - DNA, 15 bp, Homo sapiens
aatcatccaatgctc

SEQ ID NO: 3785711 - DNA, 16 bp, Homo sapiens
aatcatgaaatatgca

SEQ ID NO: 3785712 - DNA, 15 bp, Homo sapiens
aatcatggtttttct

SEQ ID NO: 3785713 - DNA, 19 bp, Homo sapiens
aatcatgtgggtgagccag

SEQ ID NO: 3785714 - DNA, 12 bp, Homo sapiens
aatcattattta

SEQ ID NO: 3785715 - DNA, 22 bp, Homo sapiens
aatcattatttattaaattttt

SEQ ID NO: 3785716 - DNA, 16 bp, Homo sapiens
aatcattttaattatt

SEQ ID NO: 3785717 - DNA, 17 bp, Homo sapiens
aatcattttaattatta

SEQ ID NO: 3785718 - DNA, 19 bp, Homo sapiens
aatcattttaattattatt

SEQ ID NO: 3785719 - DNA, 20 bp, Homo sapiens
aatcattttacccttggctc

SEQ ID NO: 3785720 - DNA, 17 bp, Homo sapiens
aatccaacccatgatga

SEQ ID NO: 3785721 - DNA, 17 bp, Homo sapiens
aatccagaaagaaaaaa

SEQ ID NO: 3785722 - DNA, 22 bp, Homo sapiens
aatccagaattgaccttttgac

SEQ ID NO: 3785723 - DNA, 17 bp, Homo sapiens
aatccagacccggctgc

SEQ ID NO: 3785724 - DNA, 19 bp, Homo sapiens
aatccagacccggctgcgt

SEQ ID NO: 3785725 - DNA, 22 bp, Homo sapiens
aatccatgttagtttttacttt

SEQ ID NO: 3785726 - DNA, 18 bp, Homo sapiens
aatcccattcataacttt

SEQ ID NO: 3785727 - DNA, 19 bp, Homo sapiens
aatccctgggcattgcttt

SEQ ID NO: 3785728 - DNA, 15 bp, Homo sapiens
aatcctaaaagaagc

SEQ ID NO: 3785729 - DNA, 16 bp, Homo sapiens
aatcctaacacattat

SEQ ID NO: 3785730 - DNA, 14 bp, Homo sapiens
aatcctacatacag

SEQ ID NO: 3785731 - DNA, 16 bp, Homo sapiens
aatcctagctgtgtgc

SEQ ID NO: 3785732 - DNA, 15 bp, Homo sapiens
aatcctcctgagtga

SEQ ID NO: 3785733 - DNA, 23 bp, Homo sapiens
aatcctcctgagtgatcccattt

SEQ ID NO: 3785734 - DNA, 11 bp, Homo sapiens
aatcctctggc

SEQ ID NO: 3785735 - DNA, 18 bp, Homo sapiens
aatcctgtcctcagcttc

SEQ ID NO: 3785736 - DNA, 21 bp, Homo sapiens
aatcctgtcctcagcttctta

SEQ ID NO: 3785737 - DNA, 22 bp, Homo sapiens
aatcctgtgtggtttagtgtaa

SEQ ID NO: 3785738 - DNA, 13 bp, Homo sapiens
aatcctttactgt

SEQ ID NO: 3785739 - DNA, 17 bp, Homo sapiens
aatcgaggaaccagagc

SEQ ID NO: 3785740 - DNA, 20 bp, Homo sapiens
aatcgatgggggatgcttca

SEQ ID NO: 3785741 - DNA, 15 bp, Homo sapiens
aatcgttatgtgtgt

SEQ ID NO: 3785742 - DNA, 17 bp, Homo sapiens
aatcgttatgtgtgtat

SEQ ID NO: 3785743 - DNA, 18 bp, Homo sapiens
aatcgttatgtgtgtata

SEQ ID NO: 3785744 - DNA, 12 bp, Homo sapiens
aatctagaagaa

SEQ ID NO: 3785745 - DNA, 18 bp, Homo sapiens
aatctagaagaaatgaaa

SEQ ID NO: 3785746 - DNA, 20 bp, Homo sapiens
aatctagaagaaatgaaatt

SEQ ID NO: 3785747 - DNA, 22 bp, Homo sapiens
aatctagaagaaatgaaatttt

SEQ ID NO: 3785748 - DNA, 16 bp, Homo sapiens
aatctattgggttcat

SEQ ID NO: 3785749 - DNA, 18 bp, Homo sapiens
aatctattgggttcatta

SEQ ID NO: 3785750 - DNA, 22 bp, Homo sapiens
aatctatttattggacatgtcc

SEQ ID NO: 3785751 - DNA, 13 bp, Homo sapiens
aatctcaaataac

SEQ ID NO: 3785752 - DNA, 12 bp, Homo sapiens
tgacctgtcacc

SEQ ID NO: 3785753 - DNA, 22 bp, Homo sapiens
tgacctgtgaccagcactgtct

SEQ ID NO: 3785754 - DNA, 17 bp, Homo sapiens
tgaccttctaggaagct

SEQ ID NO: 3785755 - DNA, 17 bp, Homo sapiens
tgaccttgaactcctgg

SEQ ID NO: 3785756 - DNA, 20 bp, Homo sapiens
tgacggcgcccccagtgtgc

SEQ ID NO: 3785757 - DNA, 18 bp, Homo sapiens
tgacgtgcacctgtactc

SEQ ID NO: 3785758 - DNA, 19 bp, Homo sapiens
tgacgtgcacctgtactca

SEQ ID NO: 3785759 - DNA, 23 bp, Homo sapiens
tgacgtgcacctgtactcaggag

SEQ ID NO: 3785760 - DNA, 15 bp, Homo sapiens
tgactaaaaaacaaa

SEQ ID NO: 3785761 - DNA, 22 bp, Homo sapiens
tgactaaaaaacaaagaagaca

SEQ ID NO: 3785762 - DNA, 16 bp, Homo sapiens
tgactaaagagagaat

SEQ ID NO: 3785763 - DNA, 17 bp, Homo sapiens
tgactaaagagagaatg

SEQ ID NO: 3785764 - DNA, 16 bp, Homo sapiens
tgactagaaagtgaat

SEQ ID NO: 3785765 - DNA, 21 bp, Homo sapiens
tgactagaagggccagtcctg

SEQ ID NO: 3785766 - DNA, 21 bp, Homo sapiens
tgactagaggcagggagggga

SEQ ID NO: 3785767 - DNA, 13 bp, Homo sapiens
tgactagtgctga

SEQ ID NO: 3785768 - DNA, 14 bp, Homo sapiens
tgactagtgctgaa

SEQ ID NO: 3785769 - DNA, 16 bp, Homo sapiens
tgactatcaaactgaa

SEQ ID NO: 3785770 - DNA, 22 bp, Homo sapiens
tgactattacagttgcattttt

SEQ ID NO: 3785771 - DNA, 14 bp, Homo sapiens
tgactcaacatgtt

SEQ ID NO: 3785772 - DNA, 11 bp, Homo sapiens
tgactcaccca

SEQ ID NO: 3785773 - DNA, 14 bp, Homo sapiens
tgactcacccaagc

SEQ ID NO: 3785774 - DNA, 15 bp, Homo sapiens
tgactcacccaagca

SEQ ID NO: 3785775 - DNA, 18 bp, Homo sapiens
tgactcacttatcccaag

SEQ ID NO: 3785776 - DNA, 17 bp, Homo sapiens
tgactcccaaagagctg

SEQ ID NO: 3785777 - DNA, 18 bp, Homo sapiens
tgactcccaaagagctgc

SEQ ID NO: 3785778 - DNA, 20 bp, Homo sapiens
tgactcccaaagagctgcct

SEQ ID NO: 3785779 - DNA, 22 bp, Homo sapiens
tgactcccaaagagctgcctaa

SEQ ID NO: 3785780 - DNA, 22 bp, Homo sapiens
tgactccttagagacatcaaaa

SEQ ID NO: 3785781 - DNA, 15 bp, Homo sapiens
tgactgagcagactg

SEQ ID NO: 3785782 - DNA, 19 bp, Homo sapiens
tgactgagcagactggtga

SEQ ID NO: 3785783 - DNA, 17 bp, Homo sapiens
tgactgccccaactcct

SEQ ID NO: 3785784 - DNA, 20 bp, Homo sapiens
tgactgccccaactcctgga

SEQ ID NO: 3785785 - DNA, 14 bp, Homo sapiens
tgactggaattttt

SEQ ID NO: 3785786 - DNA, 21 bp, Homo sapiens
tgactgggtttctctgtatag

SEQ ID NO: 3785787 - DNA, 23 bp, Homo sapiens
tgactgggtttctctgtatagta

SEQ ID NO: 3785788 - DNA, 16 bp, Homo sapiens
tgacttaactgcattt

SEQ ID NO: 3785789 - DNA, 14 bp, Homo sapiens
tgacttatgggccc

SEQ ID NO: 3785790 - DNA, 22 bp, Homo sapiens
tgacttccccgcattccaggct

SEQ ID NO: 3785791 - DNA, 19 bp, Homo sapiens
tgacttgacagaacactgt

SEQ ID NO: 3785792 - DNA, 13 bp, Homo sapiens
tgactttctcagc

SEQ ID NO: 3785793 - DNA, 16 bp, Homo sapiens
tgactttgctctttct

SEQ ID NO: 3785794 - DNA, 20 bp, Homo sapiens
tgacttttaaggctaaaact

SEQ ID NO: 3785795 - DNA, 21 bp, Homo sapiens
tgagaaaacgaaactgctcta

SEQ ID NO: 3785796 - DNA, 15 bp, Homo sapiens
tgagaaatgaataat

SEQ ID NO: 3785797 - DNA, 22 bp, Homo sapiens
tgagaaatgaataatttcccaa

SEQ ID NO: 3785798 - DNA, 19 bp, Homo sapiens
tgagaactactcagggaat

SEQ ID NO: 3785799 - DNA, 20 bp, Homo sapiens
tgagaactgcatatgtttcg

SEQ ID NO: 3785800 - DNA, 23 bp, Homo sapiens
tgagaaggggaggacctctgggc

SEQ ID NO: 3785801 - DNA, 16 bp, Homo sapiens
tgagaaggtccttaat

SEQ ID NO: 3785802 - DNA, 22 bp, Homo sapiens
tgagaagtcaaacatttcaaag

SEQ ID NO: 3785803 - DNA, 15 bp, Homo sapiens
tgagaatagaaggaa

SEQ ID NO: 3785804 - DNA, 16 bp, Homo sapiens
tgagaatagaaggaaa

SEQ ID NO: 3785805 - DNA, 18 bp, Homo sapiens
tgagaatagaaggaaact

SEQ ID NO: 3785806 - DNA, 20 bp, Homo sapiens
tgagaatcagatcatttcaa

SEQ ID NO: 3785807 - DNA, 23 bp, Homo sapiens
tgagaatctatatttaacaagat

SEQ ID NO: 3785808 - DNA, 16 bp, Homo sapiens
tgagaattcagctgcc

SEQ ID NO: 3785809 - DNA, 17 bp, Homo sapiens
tgagaattcagctgccc

SEQ ID NO: 3785810 - DNA, 13 bp, Homo sapiens
tgagaattttaaa

SEQ ID NO: 3785811 - DNA, 14 bp, Homo sapiens
tgagacaaaaatta

SEQ ID NO: 3785812 - DNA, 18 bp, Homo sapiens
tgagacaaatggaggcct

SEQ ID NO: 3785813 - DNA, 11 bp, Homo sapiens
tgagacagagt

SEQ ID NO: 3785814 - DNA, 21 bp, Homo sapiens
tgagacagagttttcactctt

SEQ ID NO: 3785815 - DNA, 18 bp, Homo sapiens
tgagacattccaaaacga

SEQ ID NO: 3785816 - DNA, 14 bp, Homo sapiens
tgagacccccacac

SEQ ID NO: 3785817 - DNA, 12 bp, Homo sapiens
tgagaccctgtc

SEQ ID NO: 3785818 - DNA, 19 bp, Homo sapiens
tgagacctcagccatgagg

SEQ ID NO: 3785819 - DNA, 20 bp, Homo sapiens
tgagactcagacaggaaagg

SEQ ID NO: 3785820 - DNA, 22 bp, Homo sapiens
tgagactgcgggatggtcctgg

SEQ ID NO: 3785821 - DNA, 14 bp, Homo sapiens
tgagagagacaaga

SEQ ID NO: 3785822 - DNA, 23 bp, Homo sapiens
tgagaggacttttctttgtggct

SEQ ID NO: 3785823 - DNA, 17 bp, Homo sapiens
tgagagggcatgcgcac

SEQ ID NO: 3785824 - DNA, 18 bp, Homo sapiens
tgagaggggaacagactg

SEQ ID NO: 3785825 - DNA, 15 bp, Homo sapiens
tgagatagaagaact

SEQ ID NO: 3785826 - DNA, 21 bp, Homo sapiens
tgagatagaagaactgcaaag

SEQ ID NO: 3785827 - DNA, 19 bp, Homo sapiens
tgagatagaagatgtttgc

SEQ ID NO: 3785828 - DNA, 15 bp, Homo sapiens
tgagatatttattgt

SEQ ID NO: 3785829 - DNA, 20 bp, Homo sapiens
tgagatatttattgtttatt

SEQ ID NO: 3785830 - DNA, 12 bp, Homo sapiens
tgagatggccct

SEQ ID NO: 3785831 - DNA, 15 bp, Homo sapiens
tgagatggccctctg

SEQ ID NO: 3785832 - DNA, 16 bp, Homo sapiens
tgagatggccctctgg

SEQ ID NO: 3785833 - DNA, 20 bp, Homo sapiens
tgagcaaacctgccccatcc

SEQ ID NO: 3785834 - DNA, 16 bp, Homo sapiens
tgagcaaatgtggctc

SEQ ID NO: 3785835 - DNA, 19 bp, Homo sapiens
tgagcaaatgtggctcctg

SEQ ID NO: 3785836 - DNA, 19 bp, Homo sapiens
tgagcaagaccctgtctct

SEQ ID NO: 3785837 - DNA, 13 bp, Homo sapiens
tgagcaccagggg

SEQ ID NO: 3785838 - DNA, 18 bp, Homo sapiens
tgagctcagacccccact

SEQ ID NO: 3785839 - DNA, 19 bp, Homo sapiens
tgagctcagacccccactc

SEQ ID NO: 3785840 - DNA, 14 bp, Homo sapiens
tgagctccagaccc

SEQ ID NO: 3785841 - DNA, 16 bp, Homo sapiens
tgagctccagaccccc

SEQ ID NO: 3785842 - DNA, 15 bp, Homo sapiens
tgagctccccaaaaa

SEQ ID NO: 3785843 - DNA, 15 bp, Homo sapiens
tgagctcctctgggc

SEQ ID NO: 3785844 - DNA, 18 bp, Homo sapiens
tgagctcctctgggcagg

SEQ ID NO: 3785845 - DNA, 14 bp, Homo sapiens
tgagctcggtggac

SEQ ID NO: 3785846 - DNA, 18 bp, Homo sapiens
tgagctggacctcaccaa

SEQ ID NO: 3785847 - DNA, 15 bp, Homo sapiens
tgagcttatcatgct

SEQ ID NO: 3785848 - DNA, 15 bp, Homo sapiens
tgagcttctctgtga

SEQ ID NO: 3785849 - DNA, 19 bp, Homo sapiens
tgagcttggcagctgaact

SEQ ID NO: 3785850 - DNA, 19 bp, Homo sapiens
tgagctttggacgcacaca

SEQ ID NO: 3785851 - DNA, 16 bp, Homo sapiens
tgaggaaaggccagct

SEQ ID NO: 3785852 - DNA, 18 bp, Homo sapiens
tgaggaaaggccagctgg

SEQ ID NO: 3785853 - DNA, 22 bp, Homo sapiens
tgaggaagcgtgaaggccgaga

SEQ ID NO: 3785854 - DNA, 19 bp, Homo sapiens
tgaggaagctccagtcctg

SEQ ID NO: 3785855 - DNA, 20 bp, Homo sapiens
tgaggaatcaacagggcagc

SEQ ID NO: 3785856 - DNA, 13 bp, Homo sapiens
tgaggaattttct

SEQ ID NO: 3785857 - DNA, 18 bp, Homo sapiens
tgaggaattttctttgtg

SEQ ID NO: 3785858 - DNA, 19 bp, Homo sapiens
tgaggacaaccattccaga

SEQ ID NO: 3785859 - DNA, 21 bp, Homo sapiens
tgaggacactaaccacgctgg

SEQ ID NO: 3785860 - DNA, 23 bp, Homo sapiens
tgaggacttaaaatattcctgca

SEQ ID NO: 3785861 - DNA, 15 bp, Homo sapiens
tgaggagctgctggc

SEQ ID NO: 3785862 - DNA, 13 bp, Homo sapiens
tgaggaggaagga

SEQ ID NO: 3785863 - DNA, 17 bp, Homo sapiens
tgaggaggcagaaagca

SEQ ID NO: 3785864 - DNA, 16 bp, Homo sapiens
tgaggagtgtgagaat

SEQ ID NO: 3785865 - DNA, 15 bp, Homo sapiens
tgaggatcagaaagt

SEQ ID NO: 3785866 - DNA, 16 bp, Homo sapiens
tgaggatgggaaggag

SEQ ID NO: 3785867 - DNA, 16 bp, Homo sapiens
tgaggatttcaagcct

SEQ ID NO: 3785868 - DNA, 20 bp, Homo sapiens
tgaggcaataaaaatcatag

SEQ ID NO: 3785869 - DNA, 12 bp, Homo sapiens
tgaggcagacag

SEQ ID NO: 3785870 - DNA, 13 bp, Homo sapiens
tgaggcaggagaa

SEQ ID NO: 3785871 - DNA, 14 bp, Homo sapiens
tgaggcagggaagt

SEQ ID NO: 3785872 - DNA, 22 bp, Homo sapiens
tgaggcagggaagtccccaggc

SEQ ID NO: 3785873 - DNA, 15 bp, Homo sapiens
tgaggcaggggcgga

SEQ ID NO: 3785874 - DNA, 14 bp, Homo sapiens
tgaggcccagggag

SEQ ID NO: 3785875 - DNA, 20 bp, Homo sapiens
tgaggcccagggagaggcca

SEQ ID NO: 3785876 - DNA, 16 bp, Homo sapiens
tgaggctctttctggg

SEQ ID NO: 3785877 - DNA, 17 bp, Homo sapiens
tgaggctctttctgggc

SEQ ID NO: 3785878 - DNA, 18 bp, Homo sapiens
tgaggctgagactgcggg

SEQ ID NO: 3785879 - DNA, 13 bp, Homo sapiens
tgaggctggactc

SEQ ID NO: 3785880 - DNA, 12 bp, Homo sapiens
tgaggctgggaa

SEQ ID NO: 3785881 - DNA, 16 bp, Homo sapiens
tgaggcttaacaatgt

SEQ ID NO: 3785882 - DNA, 20 bp, Homo sapiens
tgaggcttaacaatgtcttg

SEQ ID NO: 3785883 - DNA, 16 bp, Homo sapiens
tgagggaacagacagg

SEQ ID NO: 3785884 - DNA, 22 bp, Homo sapiens
tgagggaacagacaggagaaat

SEQ ID NO: 3785885 - DNA, 18 bp, Homo sapiens
tgagggaccagccaagag

SEQ ID NO: 3785886 - DNA, 16 bp, Homo sapiens
tgagggataagcaaaa

SEQ ID NO: 3785887 - DNA, 18 bp, Homo sapiens
tgagggccaagaaagagt

SEQ ID NO: 3785888 - DNA, 16 bp, Homo sapiens
tgaggggcccgagcag

SEQ ID NO: 3785889 - DNA, 20 bp, Homo sapiens
tgaggggtatatctgggctg

SEQ ID NO: 3785890 - DNA, 20 bp, Homo sapiens
tgaggggtctccaggaggag

SEQ ID NO: 3785891 - DNA, 12 bp, Homo sapiens
tgagggtcttct

SEQ ID NO: 3785892 - DNA, 20 bp, Homo sapiens
tgagggttgggctggtgtca

SEQ ID NO: 3785893 - DNA, 18 bp, Homo sapiens
tgaggtcagagcctgcag

SEQ ID NO: 3785894 - DNA, 15 bp, Homo sapiens
tgaggtctgaaatgg

SEQ ID NO: 3785895 - DNA, 16 bp, Homo sapiens
tgaggtctgctcggcc

SEQ ID NO: 3785896 - DNA, 19 bp, Homo sapiens
tgaggtcttttgacatgtg

SEQ ID NO: 3785897 - DNA, 17 bp, Homo sapiens
tgaggtgaaagggagct

SEQ ID NO: 3785898 - DNA, 21 bp, Homo sapiens
tgaggtgcagagtgcccagaa

SEQ ID NO: 3785899 - DNA, 16 bp, Homo sapiens
tgaggtgctgggaggg

SEQ ID NO: 3785900 - DNA, 17 bp, Homo sapiens
tgaggtgctgggaggga

SEQ ID NO: 3785901 - DNA, 20 bp, Homo sapiens
tgaggtggaagccctccttc

SEQ ID NO: 3785902 - DNA, 22 bp, Homo sapiens
tgaggtggaagccctccttcca

SEQ ID NO: 3785903 - DNA, 13 bp, Homo sapiens
tgaggtgggagga

SEQ ID NO: 3785904 - DNA, 18 bp, Homo sapiens
tgaggtggtctgaatgtt

SEQ ID NO: 3785905 - DNA, 13 bp, Homo sapiens
tgagtaagagctg

SEQ ID NO: 3785906 - DNA, 16 bp, Homo sapiens
tgagtaagagctggtg

SEQ ID NO: 3785907 - DNA, 17 bp, Homo sapiens
tgagtaagagctggtgt

SEQ ID NO: 3785908 - DNA, 16 bp, Homo sapiens
tgagtcaccaagccca

SEQ ID NO: 3785909 - DNA, 16 bp, Homo sapiens
tgagtcccttccaggc

SEQ ID NO: 3785910 - DNA, 16 bp, Homo sapiens
tgagtcgaggacaggg

SEQ ID NO: 3785911 - DNA, 19 bp, Homo sapiens
tgagtcgaggacagggagg

SEQ ID NO: 3785912 - DNA, 17 bp, Homo sapiens
tgagtgatcccatttct

SEQ ID NO: 3785913 - DNA, 18 bp, Homo sapiens
tgagtggatgatgtttcg

SEQ ID NO: 3785914 - DNA, 23 bp, Homo sapiens
tgagtggggagacacctcagagc

SEQ ID NO: 3785915 - DNA, 23 bp, Homo sapiens
tgagtgggggatcacagcctctg

SEQ ID NO: 3785916 - DNA, 17 bp, Homo sapiens
tgagtgtaacaagaaag

SEQ ID NO: 3785917 - DNA, 17 bp, Homo sapiens
tgagtgtgtccaagtgt

SEQ ID NO: 3785918 - DNA, 16 bp, Homo sapiens
tgagttgattcagctc

SEQ ID NO: 3785919 - DNA, 23 bp, Homo sapiens
tgagttgttttcagactcagact

SEQ ID NO: 3785920 - DNA, 18 bp, Homo sapiens
tgagtttaccatttgtaa

SEQ ID NO: 3785921 - DNA, 17 bp, Homo sapiens
tgagtttcctcaggctg

SEQ ID NO: 3785922 - DNA, 22 bp, Homo sapiens
tgagtttcctcaggctgctgga

SEQ ID NO: 3785923 - DNA, 18 bp, Homo sapiens
tgagtttttatggggctg

SEQ ID NO: 3785924 - DNA, 18 bp, Homo sapiens
tgagtttttgatagcttt

SEQ ID NO: 3785925 - DNA, 19 bp, Homo sapiens
tgagtttttgatagcttta

SEQ ID NO: 3785926 - DNA, 19 bp, Homo sapiens
tgagttttttctcttgggc

SEQ ID NO: 3785927 - DNA, 20 bp, Homo sapiens
tgataaaaaattttgtaatt

SEQ ID NO: 3785928 - DNA, 16 bp, Homo sapiens
tgataaaagatacatt

SEQ ID NO: 3785929 - DNA, 15 bp, Homo sapiens
tgataacagctacca

SEQ ID NO: 3785930 - DNA, 21 bp, Homo sapiens
tgataatgttgtggtttgttg

SEQ ID NO: 3785931 - DNA, 22 bp, Homo sapiens
tgatacttgttttcaaaccagt

SEQ ID NO: 3785932 - DNA, 14 bp, Homo sapiens
tgatagctttattt

SEQ ID NO: 3785933 - DNA, 23 bp, Homo sapiens
tgatagctttattttttaagtat

SEQ ID NO: 3785934 - DNA, 14 bp, Homo sapiens
tgatataaataaaa

SEQ ID NO: 3785935 - DNA, 13 bp, Homo sapiens
tgatatatgtgtt

SEQ ID NO: 3785936 - DNA, 21 bp, Homo sapiens
tgatatatgtgtttttcacat

SEQ ID NO: 3785937 - DNA, 19 bp, Homo sapiens
tgatatgaaaaatatgata

SEQ ID NO: 3785938 - DNA, 15 bp, Homo sapiens
tgatatgtaaacata

SEQ ID NO: 3785939 - DNA, 21 bp, Homo sapiens
tgatatgtaaacataattctt

SEQ ID NO: 3785940 - DNA, 19 bp, Homo sapiens
tgatatgttggtagattct

SEQ ID NO: 3785941 - DNA, 15 bp, Homo sapiens
tgatattccatagta

SEQ ID NO: 3785942 - DNA, 16 bp, Homo sapiens
tgatattccatgaatg

SEQ ID NO: 3785943 - DNA, 18 bp, Homo sapiens
tgatattccatgaatgta

SEQ ID NO: 3785944 - DNA, 22 bp, Homo sapiens
tgatatttattatatttttccc

SEQ ID NO: 3785945 - DNA, 15 bp, Homo sapiens
tgatatttttttaag

SEQ ID NO: 3785946 - DNA, 16 bp, Homo sapiens
tgatcaataaaatgtg

SEQ ID NO: 3785947 - DNA, 19 bp, Homo sapiens
tgatcaataaaatgtgatt

SEQ ID NO: 3785948 - DNA, 16 bp, Homo sapiens
tgatcaattaaatgta

SEQ ID NO: 3785949 - DNA, 19 bp, Homo sapiens
tgatcacggctcactgcag

SEQ ID NO: 3785950 - DNA, 22 bp, Homo sapiens
tgatcacggctcactgcagcct

SEQ ID NO: 3785951 - DNA, 18 bp, Homo sapiens
tgcccccttctcccacac

SEQ ID NO: 3785952 - DNA, 19 bp, Homo sapiens
tgccccgtcaccatctcag

SEQ ID NO: 3785953 - DNA, 21 bp, Homo sapiens
tgccccgtcaccatctcaggc

SEQ ID NO: 3785954 - DNA, 16 bp, Homo sapiens
tgccccgtgcagactg

SEQ ID NO: 3785955 - DNA, 12 bp, Homo sapiens
tgcccctcccag

SEQ ID NO: 3785956 - DNA, 22 bp, Homo sapiens
tgcccctcccccaacccccacc

SEQ ID NO: 3785957 - DNA, 17 bp, Homo sapiens
tgcccctgctgcctccc

SEQ ID NO: 3785958 - DNA, 18 bp, Homo sapiens
tgccccttctacactctc

SEQ ID NO: 3785959 - DNA, 23 bp, Homo sapiens
tgccccttctacactctcctggg

SEQ ID NO: 3785960 - DNA, 13 bp, Homo sapiens
tgcccgagctggt

SEQ ID NO: 3785961 - DNA, 23 bp, Homo sapiens
tgcccggagattggacggcctga

SEQ ID NO: 3785962 - DNA, 18 bp, Homo sapiens
tgcccggattctgggagg

SEQ ID NO: 3785963 - DNA, 16 bp, Homo sapiens
tgcccgtcttcagcct

SEQ ID NO: 3785964 - DNA, 18 bp, Homo sapiens
tgcccgtcttcagcctag

SEQ ID NO: 3785965 - DNA, 16 bp, Homo sapiens
tgccctcaatcccagc

SEQ ID NO: 3785966 - DNA, 18 bp, Homo sapiens
tgccctcattttatgtca

SEQ ID NO: 3785967 - DNA, 18 bp, Homo sapiens
tgccctccacagccgcag

SEQ ID NO: 3785968 - DNA, 21 bp, Homo sapiens
tgccctccactgccctctgtt

SEQ ID NO: 3785969 - DNA, 19 bp, Homo sapiens
tgccctcgggcgagtcact

SEQ ID NO: 3785970 - DNA, 11 bp, Homo sapiens
tgccctgcccc

SEQ ID NO: 3785971 - DNA, 19 bp, Homo sapiens
tgccctggaggaaccgaaa

SEQ ID NO: 3785972 - DNA, 21 bp, Homo sapiens
tgccctggggctgatctcagg

SEQ ID NO: 3785973 - DNA, 23 bp, Homo sapiens
tgccctggggctgatctcaggga

SEQ ID NO: 3785974 - DNA, 14 bp, Homo sapiens
tgccctggtgctgc

SEQ ID NO: 3785975 - DNA, 18 bp, Homo sapiens
tgccctggtgctgccaca

SEQ ID NO: 3785976 - DNA, 15 bp, Homo sapiens
tgcccttaaatcata

SEQ ID NO: 3785977 - DNA, 19 bp, Homo sapiens
tgcccttggaggccagcca

SEQ ID NO: 3785978 - DNA, 17 bp, Homo sapiens
tgcccttgtcccactca

SEQ ID NO: 3785979 - DNA, 15 bp, Homo sapiens
tgccgaccagagccc

SEQ ID NO: 3785980 - DNA, 22 bp, Homo sapiens
tgccgaccagagccccacacgg

SEQ ID NO: 3785981 - DNA, 23 bp, Homo sapiens
tgccgaccgaggctggagctggc

SEQ ID NO: 3785982 - DNA, 17 bp, Homo sapiens
tgccgacctcgtcctcc

SEQ ID NO: 3785983 - DNA, 13 bp, Homo sapiens
tgccgcctcccag

SEQ ID NO: 3785984 - DNA, 18 bp, Homo sapiens
tgccgggttttatatttt

SEQ ID NO: 3785985 - DNA, 20 bp, Homo sapiens
tgccgttgccaagaactgaa

SEQ ID NO: 3785986 - DNA, 21 bp, Homo sapiens
tgcctaatacattaaagcagt

SEQ ID NO: 3785987 - DNA, 22 bp, Homo sapiens
tgcctaatacattaaagcagtc

SEQ ID NO: 3785988 - DNA, 18 bp, Homo sapiens
tgcctaggctgaccttga

SEQ ID NO: 3785989 - DNA, 18 bp, Homo sapiens
tgcctatagtcccagcta

SEQ ID NO: 3785990 - DNA, 20 bp, Homo sapiens
tgcctatcacctcttatgca

SEQ ID NO: 3785991 - DNA, 23 bp, Homo sapiens
tgcctcaatgtgaatcagaccct

SEQ ID NO: 3785992 - DNA, 12 bp, Homo sapiens
tgcctcagaacg

SEQ ID NO: 3785993 - DNA, 12 bp, Homo sapiens
tgcctcagcctc

SEQ ID NO: 3785994 - DNA, 11 bp, Homo sapiens
tgcctccaccg

SEQ ID NO: 3785995 - DNA, 14 bp, Homo sapiens
tgcctccatggtgc

SEQ ID NO: 3785996 - DNA, 17 bp, Homo sapiens
tgcctccctgtccaccc

SEQ ID NO: 3785997 - DNA, 12 bp, Homo sapiens
tgcctcctcacc

SEQ ID NO: 3785998 - DNA, 19 bp, Homo sapiens
tgcctcctcacccccagct

SEQ ID NO: 3785999 - DNA, 13 bp, Homo sapiens
tgcctcctgtgta

SEQ ID NO: 3786000 - DNA, 18 bp, Homo sapiens
tgcctcgaactggctgca

SEQ ID NO: 3786001 - DNA, 19 bp, Homo sapiens
tgcctcgaactggctgcaa

SEQ ID NO: 3786002 - DNA, 18 bp, Homo sapiens
tgcctctccctggccctc

SEQ ID NO: 3786003 - DNA, 22 bp, Homo sapiens
tgcctctgacacacagctctgt

SEQ ID NO: 3786004 - DNA, 11 bp, Homo sapiens
tgcctctgcct

SEQ ID NO: 3786005 - DNA, 12 bp, Homo sapiens
tgcctctgcctc

SEQ ID NO: 3786006 - DNA, 14 bp, Homo sapiens
tgcctctgcctctg

SEQ ID NO: 3786007 - DNA, 16 bp, Homo sapiens
tgcctctgcctgcatt

SEQ ID NO: 3786008 - DNA, 14 bp, Homo sapiens
tgcctctgcctgtc

SEQ ID NO: 3786009 - DNA, 14 bp, Homo sapiens
tgcctctttcctgt

SEQ ID NO: 3786010 - DNA, 17 bp, Homo sapiens
tgcctgaagtcacacag

SEQ ID NO: 3786011 - DNA, 18 bp, Homo sapiens
tgcctgaagtcacacagt

SEQ ID NO: 3786012 - DNA, 23 bp, Homo sapiens
tgcctgaccctacttcttttgct

SEQ ID NO: 3786013 - DNA, 18 bp, Homo sapiens
tgcctgagcacctcccag

SEQ ID NO: 3786014 - DNA, 19 bp, Homo sapiens
tgcctgagtcacccatgaa

SEQ ID NO: 3786015 - DNA, 22 bp, Homo sapiens
tgcctgcagccccgcgcctcct

SEQ ID NO: 3786016 - DNA, 15 bp, Homo sapiens
tgcctgcccaggccc

SEQ ID NO: 3786017 - DNA, 17 bp, Homo sapiens
tgcctgcccaggcccct

SEQ ID NO: 3786018 - DNA, 19 bp, Homo sapiens
tgcctgcccaggcccctgc

SEQ ID NO: 3786019 - DNA, 22 bp, Homo sapiens
tgcctgcccaggcccctgccac

SEQ ID NO: 3786020 - DNA, 23 bp, Homo sapiens
tgcctgcccaggcccctgccacc

SEQ ID NO: 3786021 - DNA, 11 bp, Homo sapiens
tgcctggagct

SEQ ID NO: 3786022 - DNA, 16 bp, Homo sapiens
tgcctggagctcctgg

SEQ ID NO: 3786023 - DNA, 16 bp, Homo sapiens
tgcctggccaggcaga

SEQ ID NO: 3786024 - DNA, 18 bp, Homo sapiens
tgcctgggaaccttcctg

SEQ ID NO: 3786025 - DNA, 16 bp, Homo sapiens
tgcctgggtggggctg

SEQ ID NO: 3786026 - DNA, 17 bp, Homo sapiens
tgcctgggtggggctgc

SEQ ID NO: 3786027 - DNA, 19 bp, Homo sapiens
tgcctggtggcagctgcgg

SEQ ID NO: 3786028 - DNA, 13 bp, Homo sapiens
tgcctgtaaacat

SEQ ID NO: 3786029 - DNA, 22 bp, Homo sapiens
tgcctgtagttaggaaataaaa

SEQ ID NO: 3786030 - DNA, 15 bp, Homo sapiens
tgcctgtccagcctg

SEQ ID NO: 3786031 - DNA, 20 bp, Homo sapiens
tgcctgtccagcctgggcag

SEQ ID NO: 3786032 - DNA, 16 bp, Homo sapiens
tgcctgtgaggcaggg

SEQ ID NO: 3786033 - DNA, 11 bp, Homo sapiens
tgcctgtgcca

SEQ ID NO: 3786034 - DNA, 16 bp, Homo sapiens
tgcctgtgccacccac

SEQ ID NO: 3786035 - DNA, 20 bp, Homo sapiens
tgcctgttcagctccagctc

SEQ ID NO: 3786036 - DNA, 15 bp, Homo sapiens
tgccttaaaacttta

SEQ ID NO: 3786037 - DNA, 15 bp, Homo sapiens
tgccttacctcctgc

SEQ ID NO: 3786038 - DNA, 20 bp, Homo sapiens
tgccttacctcctgcccagg

SEQ ID NO: 3786039 - DNA, 21 bp, Homo sapiens
tgccttacctcctgcccagga

SEQ ID NO: 3786040 - DNA, 23 bp, Homo sapiens
tgccttacctcctgcccaggaga

SEQ ID NO: 3786041 - DNA, 18 bp, Homo sapiens
tgccttactttgtatgat

SEQ ID NO: 3786042 - DNA, 19 bp, Homo sapiens
tgccttactttgtatgata

SEQ ID NO: 3786043 - DNA, 14 bp, Homo sapiens
tgccttagaacctt

SEQ ID NO: 3786044 - DNA, 21 bp, Homo sapiens
tgccttccacgctgtctccag

SEQ ID NO: 3786045 - DNA, 18 bp, Homo sapiens
tgccttccagcaccctgc

SEQ ID NO: 3786046 - DNA, 16 bp, Homo sapiens
tgccttctacttttaa

SEQ ID NO: 3786047 - DNA, 15 bp, Homo sapiens
tgccttgggctgctc

SEQ ID NO: 3786048 - DNA, 16 bp, Homo sapiens
tgccttgggctgctcc

SEQ ID NO: 3786049 - DNA, 19 bp, Homo sapiens
tgcctttcctgttcagcat

SEQ ID NO: 3786050 - DNA, 19 bp, Homo sapiens
tgcctttgagtttcctcag

SEQ ID NO: 3786051 - DNA, 22 bp, Homo sapiens
tgcctttgagtttcctcaggct

SEQ ID NO: 3786052 - DNA, 14 bp, Homo sapiens
tgcctttgcagaaa

SEQ ID NO: 3786053 - DNA, 17 bp, Homo sapiens
tgcctttgcagaaacag

SEQ ID NO: 3786054 - DNA, 13 bp, Homo sapiens
tgcctttgtaagt

SEQ ID NO: 3786055 - DNA, 15 bp, Homo sapiens
tgcctttgtaagtta

SEQ ID NO: 3786056 - DNA, 13 bp, Homo sapiens
tgcgaaaggatga

SEQ ID NO: 3786057 - DNA, 19 bp, Homo sapiens
tgcgagtgtgtgcatgtgt

SEQ ID NO: 3786058 - DNA, 22 bp, Homo sapiens
tgcgagtgtgtgcatgtgtgtg

SEQ ID NO: 3786059 - DNA, 21 bp, Homo sapiens
tgcgatcatggctcactgcag

SEQ ID NO: 3786060 - DNA, 23 bp, Homo sapiens
tgcgatcatggctcactgcagcc

SEQ ID NO: 3786061 - DNA, 15 bp, Homo sapiens
tgcgatctgggttca

SEQ ID NO: 3786062 - DNA, 17 bp, Homo sapiens
tgcgccattgcactcca

SEQ ID NO: 3786063 - DNA, 22 bp, Homo sapiens
tgcgcctacaggagtgagcact

SEQ ID NO: 3786064 - DNA, 17 bp, Homo sapiens
tgctgcttttccttggg

SEQ ID NO: 3786065 - DNA, 20 bp, Homo sapiens
tgctggcccctcacctgggc

SEQ ID NO: 3786066 - DNA, 17 bp, Homo sapiens
tgctggccgggcacagc

SEQ ID NO: 3786067 - DNA, 14 bp, Homo sapiens
tgctggctgcctta

SEQ ID NO: 3786068 - DNA, 15 bp, Homo sapiens
tgctggctgccttag

SEQ ID NO: 3786069 - DNA, 21 bp, Homo sapiens
tgctggctgttggctgggggc

SEQ ID NO: 3786070 - DNA, 21 bp, Homo sapiens
tgctgggattacaagcgtgag

SEQ ID NO: 3786071 - DNA, 17 bp, Homo sapiens
tgctgggattacaggtg

SEQ ID NO: 3786072 - DNA, 20 bp, Homo sapiens
tgctgggattacaggtgtga

SEQ ID NO: 3786073 - DNA, 16 bp, Homo sapiens
tgctgggctctccacc

SEQ ID NO: 3786074 - DNA, 20 bp, Homo sapiens
tgctgggctctccacctcag

SEQ ID NO: 3786075 - DNA, 16 bp, Homo sapiens
tgctgggggccgccct

SEQ ID NO: 3786076 - DNA, 23 bp, Homo sapiens
tgctggttgtcatttttgcagta

SEQ ID NO: 3786077 - DNA, 14 bp, Homo sapiens
tgctgtattttctt

SEQ ID NO: 3786078 - DNA, 14 bp, Homo sapiens
tgctgtcctaggcc

SEQ ID NO: 3786079 - DNA, 14 bp, Homo sapiens
tgctgtctatgtgg

SEQ ID NO: 3786080 - DNA, 18 bp, Homo sapiens
tgctgtgaccatttataa

SEQ ID NO: 3786081 - DNA, 12 bp, Homo sapiens
tgctgtggcctg

SEQ ID NO: 3786082 - DNA, 22 bp, Homo sapiens
tgctgttgtcattgctttactg

SEQ ID NO: 3786083 - DNA, 19 bp, Homo sapiens
tgctgtttgtttgacaaag

SEQ ID NO: 3786084 - DNA, 18 bp, Homo sapiens
tgctgttttgatttgtac

SEQ ID NO: 3786085 - DNA, 13 bp, Homo sapiens
tgcttatacactt

SEQ ID NO: 3786086 - DNA, 19 bp, Homo sapiens
tgcttatgaatatttataa

SEQ ID NO: 3786087 - DNA, 21 bp, Homo sapiens
tgcttatgacatcacttgtac

SEQ ID NO: 3786088 - DNA, 14 bp, Homo sapiens
tgcttattgttcca

SEQ ID NO: 3786089 - DNA, 15 bp, Homo sapiens
tgcttattgttccaa

SEQ ID NO: 3786090 - DNA, 17 bp, Homo sapiens
tgcttattgttccaaga

SEQ ID NO: 3786091 - DNA, 21 bp, Homo sapiens
tgcttcaaactcaaacacaga

SEQ ID NO: 3786092 - DNA, 13 bp, Homo sapiens
tgcttcagcctcc

SEQ ID NO: 3786093 - DNA, 14 bp, Homo sapiens
tgcttcagcctccc

SEQ ID NO: 3786094 - DNA, 17 bp, Homo sapiens
tgcttcagcctgaggct

SEQ ID NO: 3786095 - DNA, 14 bp, Homo sapiens
tgcttcagcttgct

SEQ ID NO: 3786096 - DNA, 20 bp, Homo sapiens
tgcttcatgaaaatcctacc

SEQ ID NO: 3786097 - DNA, 18 bp, Homo sapiens
tgcttctaccaactggaa

SEQ ID NO: 3786098 - DNA, 16 bp, Homo sapiens
tgcttctctacagact

SEQ ID NO: 3786099 - DNA, 17 bp, Homo sapiens
tgcttcttaaccccagt

SEQ ID NO: 3786100 - DNA, 19 bp, Homo sapiens
tgcttcttaaccccagtaa

SEQ ID NO: 3786101 - DNA, 12 bp, Homo sapiens
tgcttgaacaca

SEQ ID NO: 3786102 - DNA, 14 bp, Homo sapiens
tgcttgaacacagt

SEQ ID NO: 3786103 - DNA, 17 bp, Homo sapiens
tgcttgaacacagtatt

SEQ ID NO: 3786104 - DNA, 19 bp, Homo sapiens
tgcttggacctcgtgcttt

SEQ ID NO: 3786105 - DNA, 23 bp, Homo sapiens
tgcttgtttgctcacctggggtg

SEQ ID NO: 3786106 - DNA, 15 bp, Homo sapiens
tgctttaattgtgaa

SEQ ID NO: 3786107 - DNA, 20 bp, Homo sapiens
tgctttctgaactcgcttct

SEQ ID NO: 3786108 - DNA, 13 bp, Homo sapiens
tgctttggaaatc

SEQ ID NO: 3786109 - DNA, 14 bp, Homo sapiens
tgctttgggctgcc

SEQ ID NO: 3786110 - DNA, 15 bp, Homo sapiens
tgctttgggctgccc

SEQ ID NO: 3786111 - DNA, 18 bp, Homo sapiens
tgctttgggctgccctgg

SEQ ID NO: 3786112 - DNA, 19 bp, Homo sapiens
tgctttgggctgccctggt

SEQ ID NO: 3786113 - DNA, 14 bp, Homo sapiens
tgcttttggtctgt

SEQ ID NO: 3786114 - DNA, 20 bp, Homo sapiens
tgcttttgtctatgggactc

SEQ ID NO: 3786115 - DNA, 23 bp, Homo sapiens
tgctttttaatattgatatgctt

SEQ ID NO: 3786116 - DNA, 15 bp, Homo sapiens
tgctttttcaccaga

SEQ ID NO: 3786117 - DNA, 17 bp, Homo sapiens
tggaaaaatagcctgcc

SEQ ID NO: 3786118 - DNA, 20 bp, Homo sapiens
tggaaaaggaagactagagg

SEQ ID NO: 3786119 - DNA, 15 bp, Homo sapiens
tggaaaataaattat

SEQ ID NO: 3786120 - DNA, 20 bp, Homo sapiens
tggaaacaaagtggaaggaa

SEQ ID NO: 3786121 - DNA, 23 bp, Homo sapiens
tggaaacaaagtggaaggaaaga

SEQ ID NO: 3786122 - DNA, 21 bp, Homo sapiens
tggaaactggatgaggtcata

SEQ ID NO: 3786123 - DNA, 14 bp, Homo sapiens
tggaaacttttctt

SEQ ID NO: 3786124 - DNA, 19 bp, Homo sapiens
tggaaagacagcttctcat

SEQ ID NO: 3786125 - DNA, 19 bp, Homo sapiens
tggaaagcatcacctcagg

SEQ ID NO: 3786126 - DNA, 20 bp, Homo sapiens
tggaaagcatcacctcaggc

SEQ ID NO: 3786127 - DNA, 12 bp, Homo sapiens
tggaaagcctct

SEQ ID NO: 3786128 - DNA, 18 bp, Homo sapiens
tggaaagcctctgctgcc

SEQ ID NO: 3786129 - DNA, 14 bp, Homo sapiens
tggaaagtgaattt

SEQ ID NO: 3786130 - DNA, 16 bp, Homo sapiens
tggaaagtgaatttga

SEQ ID NO: 3786131 - DNA, 21 bp, Homo sapiens
tggaaagtgaatttgaatgaa

SEQ ID NO: 3786132 - DNA, 14 bp, Homo sapiens
tggaaatacacagt

SEQ ID NO: 3786133 - DNA, 15 bp, Homo sapiens
tggaaatacacagtg

SEQ ID NO: 3786134 - DNA, 16 bp, Homo sapiens
tggaaatattatgcaa

SEQ ID NO: 3786135 - DNA, 19 bp, Homo sapiens
tggaaatattatgcaaatt

SEQ ID NO: 3786136 - DNA, 16 bp, Homo sapiens
tggaaattggaagagc

SEQ ID NO: 3786137 - DNA, 23 bp, Homo sapiens
tggaaatttgttataatgaatga

SEQ ID NO: 3786138 - DNA, 16 bp, Homo sapiens
tggaacagcgggagac

SEQ ID NO: 3786139 - DNA, 19 bp, Homo sapiens
tggaacccttttggccccc

SEQ ID NO: 3786140 - DNA, 21 bp, Homo sapiens
tggaacccttttggcccccga

SEQ ID NO: 3786141 - DNA, 20 bp, Homo sapiens
tggaactaggttttaataat

SEQ ID NO: 3786142 - DNA, 19 bp, Homo sapiens
tggaactcattcctgcctg

SEQ ID NO: 3786143 - DNA, 16 bp, Homo sapiens
tggaagcacagcttca

SEQ ID NO: 3786144 - DNA, 17 bp, Homo sapiens
tggaagcatgtaggaga

SEQ ID NO: 3786145 - DNA, 17 bp, Homo sapiens
tggaagccctccttcca

SEQ ID NO: 3786146 - DNA, 14 bp, Homo sapiens
tggaaggaaagatg

SEQ ID NO: 3786147 - DNA, 19 bp, Homo sapiens
tggaagtgagggtcagaga

SEQ ID NO: 3786148 - DNA, 19 bp, Homo sapiens
tggaagtttgtgttctgtt

SEQ ID NO: 3786149 - DNA, 14 bp, Homo sapiens
tggaagttttgcat

SEQ ID NO: 3786150 - DNA, 22 bp, Homo sapiens
tggaatacagtgttattttctt

SEQ ID NO: 3786151 - DNA, 14 bp, Homo sapiens
tggaatacatgaaa

SEQ ID NO: 3786152 - DNA, 14 bp, Homo sapiens
tggaatataaggaa

SEQ ID NO: 3786153 - DNA, 22 bp, Homo sapiens
tggaatatctgctgtatgtcaa

SEQ ID NO: 3786154 - DNA, 16 bp, Homo sapiens
tggaatctagaagaaa

SEQ ID NO: 3786155 - DNA, 19 bp, Homo sapiens
tggaatctagaagaaatga

SEQ ID NO: 3786156 - DNA, 22 bp, Homo sapiens
tggaatctagaagaaatgaaat

SEQ ID NO: 3786157 - DNA, 21 bp, Homo sapiens
tggaatcttctctttgacaat

SEQ ID NO: 3786158 - DNA, 17 bp, Homo sapiens
tggaatgaattaaataa

SEQ ID NO: 3786159 - DNA, 18 bp, Homo sapiens
tggaatgacatgtgtcaa

SEQ ID NO: 3786160 - DNA, 14 bp, Homo sapiens
tggaatgtaatcaa

SEQ ID NO: 3786161 - DNA, 17 bp, Homo sapiens
tggaattaaaacaatgt

SEQ ID NO: 3786162 - DNA, 11 bp, Homo sapiens
tggaattgctt

SEQ ID NO: 3786163 - DNA, 23 bp, Homo sapiens
tggaattgcttaccaaaggatag

SEQ ID NO: 3786164 - DNA, 19 bp, Homo sapiens
tggaatttttattatgcat

SEQ ID NO: 3786165 - DNA, 20 bp, Homo sapiens
tggaatttttattatgcata

SEQ ID NO: 3786166 - DNA, 12 bp, Homo sapiens
tggaatttttca

SEQ ID NO: 3786167 - DNA, 13 bp, Homo sapiens
tggacacagctct

SEQ ID NO: 3786168 - DNA, 12 bp, Homo sapiens
tggacagaagaa

SEQ ID NO: 3786169 - DNA, 15 bp, Homo sapiens
tggacagcaaaacca

SEQ ID NO: 3786170 - DNA, 17 bp, Homo sapiens
tggacagcaaaaccatt

SEQ ID NO: 3786171 - DNA, 20 bp, Homo sapiens
tggacagcaaaaccattgct

SEQ ID NO: 3786172 - DNA, 16 bp, Homo sapiens
tggacaggcatgttct

SEQ ID NO: 3786173 - DNA, 17 bp, Homo sapiens
tggacaggcatgttctc

SEQ ID NO: 3786174 - DNA, 14 bp, Homo sapiens
tggacaggtctggg

SEQ ID NO: 3786175 - DNA, 16 bp, Homo sapiens
tggacaggtctgggag

SEQ ID NO: 3786176 - DNA, 20 bp, Homo sapiens
tggacaggtctgggagaggc

SEQ ID NO: 3786177 - DNA, 19 bp, Homo sapiens
tggcagtgggagctgcctg

SEQ ID NO: 3786178 - DNA, 15 bp, Homo sapiens
tggcatcacagggca

SEQ ID NO: 3786179 - DNA, 11 bp, Homo sapiens
tgtaacacaag

SEQ ID NO: 3786180 - DNA, 22 bp, Homo sapiens
tgtaacaggtctcctcttaaaa

SEQ ID NO: 3786181 - DNA, 19 bp, Homo sapiens
tgtaacctgagatggccct

SEQ ID NO: 3786182 - DNA, 11 bp, Homo sapiens
tgtaactgccc

SEQ ID NO: 3786183 - DNA, 17 bp, Homo sapiens
tgtaagaaacacactga

SEQ ID NO: 3786184 - DNA, 18 bp, Homo sapiens
tgtaagaaaccaatcaag

SEQ ID NO: 3786185 - DNA, 24 bp, Homo sapiens
tgtaagaaaccaatcaagataaag

SEQ ID NO: 3786186 - DNA, 19 bp, Homo sapiens
tgtaagaagagactgggaa

SEQ ID NO: 3786187 - DNA, 20 bp, Homo sapiens
tgtaagacaaaggttttcct

SEQ ID NO: 3786188 - DNA, 17 bp, Homo sapiens
tgtaagagctatacagt

SEQ ID NO: 3786189 - DNA, 22 bp, Homo sapiens
tgtaagctctactgaggtgcta

SEQ ID NO: 3786190 - DNA, 14 bp, Homo sapiens
tgtaagtaattatc

SEQ ID NO: 3786191 - DNA, 19 bp, Homo sapiens
tgtaagtgaagtaaaactt

SEQ ID NO: 3786192 - DNA, 18 bp, Homo sapiens
tgtaagtgagagagacaa

SEQ ID NO: 3786193 - DNA, 14 bp, Homo sapiens
tgtaagtgtgagta

SEQ ID NO: 3786194 - DNA, 16 bp, Homo sapiens
tgtaagttatttcttg

SEQ ID NO: 3786195 - DNA, 20 bp, Homo sapiens
tgtaataaaaagtatatgtt

SEQ ID NO: 3786196 - DNA, 16 bp, Homo sapiens
tgtaataaagtgtttt

SEQ ID NO: 3786197 - DNA, 14 bp, Homo sapiens
tgtaatcaatgttt

SEQ ID NO: 3786198 - DNA, 20 bp, Homo sapiens
tgtaatcaatgtttcttcta

SEQ ID NO: 3786199 - DNA, 17 bp, Homo sapiens
tgtaatcatataataaa

SEQ ID NO: 3786200 - DNA, 15 bp, Homo sapiens
tgtaatcccagcact

SEQ ID NO: 3786201 - DNA, 16 bp, Homo sapiens
tgtaatcccagcactt

SEQ ID NO: 3786202 - DNA, 20 bp, Homo sapiens
tgtaatcccagctactcagg

SEQ ID NO: 3786203 - DNA, 16 bp, Homo sapiens
tgtaatcgttatgtgt

SEQ ID NO: 3786204 - DNA, 18 bp, Homo sapiens
tgtaatcgttatgtgtgt

SEQ ID NO: 3786205 - DNA, 19 bp, Homo sapiens
tgtaatcgttatgtgtgta

SEQ ID NO: 3786206 - DNA, 16 bp, Homo sapiens
tgtaatgttactgatc

SEQ ID NO: 3786207 - DNA, 17 bp, Homo sapiens
tgtaatgttactgatca

SEQ ID NO: 3786208 - DNA, 19 bp, Homo sapiens
tgtaatgttactgatcatg

SEQ ID NO: 3786209 - DNA, 19 bp, Homo sapiens
tgtaattaagtactatgta

SEQ ID NO: 3786210 - DNA, 13 bp, Homo sapiens
tgtaattctaaat

SEQ ID NO: 3786211 - DNA, 16 bp, Homo sapiens
tgtaattctaaatgaa

SEQ ID NO: 3786212 - DNA, 21 bp, Homo sapiens
tgtaattttaaataaaagtga

SEQ ID NO: 3786213 - DNA, 14 bp, Homo sapiens
tgtaattttcttga

SEQ ID NO: 3786214 - DNA, 22 bp, Homo sapiens
tgtacaaaagggacatgaaata

SEQ ID NO: 3786215 - DNA, 15 bp, Homo sapiens
tgtacaatatttaaa

SEQ ID NO: 3786216 - DNA, 15 bp, Homo sapiens
tgtacaatattttaa

SEQ ID NO: 3786217 - DNA, 22 bp, Homo sapiens
tgtacaattgaacttaaataaa

SEQ ID NO: 3786218 - DNA, 23 bp, Homo sapiens
tgtacaattgaacttaaataaat

SEQ ID NO: 3786219 - DNA, 18 bp, Homo sapiens
tgtacagacgtatgctta

SEQ ID NO: 3786220 - DNA, 19 bp, Homo sapiens
tgtacagacgtatgcttat

SEQ ID NO: 3786221 - DNA, 19 bp, Homo sapiens
tgtacagtgtgtaaagtgt

SEQ ID NO: 3786222 - DNA, 15 bp, Homo sapiens
tgtacagttgggaaa

SEQ ID NO: 3786223 - DNA, 18 bp, Homo sapiens
tgtacatatgtaaaataa

SEQ ID NO: 3786224 - DNA, 19 bp, Homo sapiens
tgtacatatgtaaaataaa

SEQ ID NO: 3786225 - DNA, 14 bp, Homo sapiens
tgtacatctggcct

SEQ ID NO: 3786226 - DNA, 10 bp, Homo sapiens
tgtacatttc

SEQ ID NO: 3786227 - DNA, 16 bp, Homo sapiens
tgtacatttctgaaat

SEQ ID NO: 3786228 - DNA, 21 bp, Homo sapiens
tgtaccatgaaacaaagctgc

SEQ ID NO: 3786229 - DNA, 21 bp, Homo sapiens
tgtacccagtattctaggtag

SEQ ID NO: 3786230 - DNA, 14 bp, Homo sapiens
tgtacctcttttag

SEQ ID NO: 3786231 - DNA, 14 bp, Homo sapiens
tgtacgtggagagg

SEQ ID NO: 3786232 - DNA, 15 bp, Homo sapiens
tgtacgtggagaggg

SEQ ID NO: 3786233 - DNA, 17 bp, Homo sapiens
tgtacgtttaaagtgta

SEQ ID NO: 3786234 - DNA, 15 bp, Homo sapiens
tgtactagtctgtgt

SEQ ID NO: 3786235 - DNA, 20 bp, Homo sapiens
tgtactgaaaaatggtaatt

SEQ ID NO: 3786236 - DNA, 19 bp, Homo sapiens
tgtactgagccttgtaatt

SEQ ID NO: 3786237 - DNA, 20 bp, Homo sapiens
tgtactgagccttgtaattc

SEQ ID NO: 3786238 - DNA, 12 bp, Homo sapiens
tgtactggagag

SEQ ID NO: 3786239 - DNA, 20 bp, Homo sapiens
tgtacttaataaattcagat

SEQ ID NO: 3786240 - DNA, 21 bp, Homo sapiens
tgtagaaatgatgatgtggaa

SEQ ID NO: 3786241 - DNA, 17 bp, Homo sapiens
tgtagaatgatttcatg

SEQ ID NO: 3786242 - DNA, 15 bp, Homo sapiens
tgtagagccagggtc

SEQ ID NO: 3786243 - DNA, 18 bp, Homo sapiens
tgtagagccagggtctca

SEQ ID NO: 3786244 - DNA, 14 bp, Homo sapiens
tgtagagtgggagc

SEQ ID NO: 3786245 - DNA, 21 bp, Homo sapiens
tgtagatattgtgaagtacat

SEQ ID NO: 3786246 - DNA, 12 bp, Homo sapiens
tgtagctttgct

SEQ ID NO: 3786247 - DNA, 17 bp, Homo sapiens
tgtaggctttacttagc

SEQ ID NO: 3786248 - DNA, 20 bp, Homo sapiens
tgtaggctttacttagctta

SEQ ID NO: 3786249 - DNA, 18 bp, Homo sapiens
tgtagggtaaggtgcctt

SEQ ID NO: 3786250 - DNA, 16 bp, Homo sapiens
tgtagggttataataa

SEQ ID NO: 3786251 - DNA, 15 bp, Homo sapiens
tgtaggtatcatttt

SEQ ID NO: 3786252 - DNA, 14 bp, Homo sapiens
tgtagtcccagcta

SEQ ID NO: 3786253 - DNA, 12 bp, Homo sapiens
tgtagttaggaa

SEQ ID NO: 3786254 - DNA, 13 bp, Homo sapiens
tgtataaagaaca

SEQ ID NO: 3786255 - DNA, 19 bp, Homo sapiens
tgtataagttgaggcattt

SEQ ID NO: 3786256 - DNA, 22 bp, Homo sapiens
tgtatagattagattatattga

SEQ ID NO: 3786257 - DNA, 23 bp, Homo sapiens
tgtatagattagattatattgag

SEQ ID NO: 3786258 - DNA, 14 bp, Homo sapiens
tgtatatatacata

SEQ ID NO: 3786259 - DNA, 13 bp, Homo sapiens
tgtatatttaagg

SEQ ID NO: 3786260 - DNA, 16 bp, Homo sapiens
tgtatcatagaaatgt

SEQ ID NO: 3786261 - DNA, 16 bp, Homo sapiens
tgtatccatgggggca

SEQ ID NO: 3786262 - DNA, 15 bp, Homo sapiens
tgtatcccatgagcc

SEQ ID NO: 3786263 - DNA, 21 bp, Homo sapiens
tgtatccttccaatttggaat

SEQ ID NO: 3786264 - DNA, 18 bp, Homo sapiens
tgtatcggagacagtgat

SEQ ID NO: 3786265 - DNA, 12 bp, Homo sapiens
tgtatctgtgta

SEQ ID NO: 3786266 - DNA, 13 bp, Homo sapiens
tgtatctgtgtag

SEQ ID NO: 3786267 - DNA, 16 bp, Homo sapiens
tgtatctgtgtagact

SEQ ID NO: 3786268 - DNA, 14 bp, Homo sapiens
tgtatgactaaaga

SEQ ID NO: 3786269 - DNA, 20 bp, Homo sapiens
tgtatgactaaagagagaat

SEQ ID NO: 3786270 - DNA, 20 bp, Homo sapiens
tgtatgccaagtgagaagat

SEQ ID NO: 3786271 - DNA, 18 bp, Homo sapiens
tgtatggaaataaatgta

SEQ ID NO: 3786272 - DNA, 12 bp, Homo sapiens
tgtatgtaaaaa

SEQ ID NO: 3786273 - DNA, 13 bp, Homo sapiens
tgtatgtacatat

SEQ ID NO: 3786274 - DNA, 19 bp, Homo sapiens
tgtatgttgtgaagatgtt

SEQ ID NO: 3786275 - DNA, 22 bp, Homo sapiens
tgtatgttgtgaagatgtttgc

SEQ ID NO: 3786276 - DNA, 20 bp, Homo sapiens
tgtatgtttacactgtcaaa

SEQ ID NO: 3786277 - DNA, 14 bp, Homo sapiens
tgtatgtttgcaca

SEQ ID NO: 3786278 - DNA, 18 bp, Homo sapiens
tgtattacataaataaat

SEQ ID NO: 3786279 - DNA, 18 bp, Homo sapiens
tgtattaggactggcttt

SEQ ID NO: 3786280 - DNA, 15 bp, Homo sapiens
tgtattataacagtg

SEQ ID NO: 3786281 - DNA, 16 bp, Homo sapiens
tgtattattctgcagc

SEQ ID NO: 3786282 - DNA, 17 bp, Homo sapiens
tgtattcccagttactt

SEQ ID NO: 3786283 - DNA, 22 bp, Homo sapiens
tgtattgaacttggaaagaaat

SEQ ID NO: 3786284 - DNA, 19 bp, Homo sapiens
tgtattgcatatatacata

SEQ ID NO: 3786285 - DNA, 13 bp, Homo sapiens
tgtattgttccca

SEQ ID NO: 3786286 - DNA, 15 bp, Homo sapiens
tgtattgttcccagt

SEQ ID NO: 3786287 - DNA, 23 bp, Homo sapiens
tgtatttaattgtaaactgtact

SEQ ID NO: 3786288 - DNA, 14 bp, Homo sapiens
tgtatttataaata

SEQ ID NO: 3786289 - DNA, 16 bp, Homo sapiens
tgtatttatgtgtgag

SEQ ID NO: 3786290 - DNA, 16 bp, Homo sapiens
tgtattttatgtatgt

SEQ ID NO: 3786291 - DNA, 18 bp, Homo sapiens
tgtattttatgtatgttt

SEQ ID NO: 3786292 - DNA, 14 bp, Homo sapiens
tgtcaaagaatcaa

SEQ ID NO: 3786293 - DNA, 15 bp, Homo sapiens
tgtcaactatgatat

SEQ ID NO: 3786294 - DNA, 21 bp, Homo sapiens
tgtggttttcttttgccatga

SEQ ID NO: 3786295 - DNA, 18 bp, Homo sapiens
tgtgtaataaagtgtttt

SEQ ID NO: 3786296 - DNA, 22 bp, Homo sapiens
tgtgtaataaagtgttttcaga

SEQ ID NO: 3786297 - DNA, 21 bp, Homo sapiens
tgtgtaatcatttcttgggcc

SEQ ID NO: 3786298 - DNA, 16 bp, Homo sapiens
tgtgtacgtggagagg

SEQ ID NO: 3786299 - DNA, 15 bp, Homo sapiens
tgtgtactctggcct

SEQ ID NO: 3786300 - DNA, 18 bp, Homo sapiens
tgtgtactctggcctctg

SEQ ID NO: 3786301 - DNA, 12 bp, Homo sapiens
tgtgtagggcgg

SEQ ID NO: 3786302 - DNA, 15 bp, Homo sapiens
tgtgtatgtacatat

SEQ ID NO: 3786303 - DNA, 19 bp, Homo sapiens
tgtgtatgtgcgtgtgtgc

SEQ ID NO: 3786304 - DNA, 21 bp, Homo sapiens
tgtgtatttaattgtaaactg

SEQ ID NO: 3786305 - DNA, 17 bp, Homo sapiens
tgtgtcaggtggggcag

SEQ ID NO: 3786306 - DNA, 20 bp, Homo sapiens
tgtgtcaggtggggcagctt

SEQ ID NO: 3786307 - DNA, 19 bp, Homo sapiens
tgtgtccaagtgtgtgtgc

SEQ ID NO: 3786308 - DNA, 16 bp, Homo sapiens
tgtgtccatcccagcg

SEQ ID NO: 3786309 - DNA, 14 bp, Homo sapiens
tgtgtccatgtgtg

SEQ ID NO: 3786310 - DNA, 16 bp, Homo sapiens
tgtgtccctctctctg

SEQ ID NO: 3786311 - DNA, 17 bp, Homo sapiens
tgtgtccctctctctgg

SEQ ID NO: 3786312 - DNA, 18 bp, Homo sapiens
tgtgtccttgcacctgca

SEQ ID NO: 3786313 - DNA, 20 bp, Homo sapiens
tgtgtccttgcacctgcatc

SEQ ID NO: 3786314 - DNA, 13 bp, Homo sapiens
tgtgtctcctgca

SEQ ID NO: 3786315 - DNA, 21 bp, Homo sapiens
tgtgtcttgcaatggcagcct

SEQ ID NO: 3786316 - DNA, 20 bp, Homo sapiens
tgtgtgaaataccagtgtgg

SEQ ID NO: 3786317 - DNA, 19 bp, Homo sapiens
tgtgtgcagactcaataaa

SEQ ID NO: 3786318 - DNA, 21 bp, Homo sapiens
tgtgtgcagtctctcttaccc

SEQ ID NO: 3786319 - DNA, 20 bp, Homo sapiens
tgtgtgcatgtgtgtgctca

SEQ ID NO: 3786320 - DNA, 19 bp, Homo sapiens
tgtgtgcgtcctgtcggag

SEQ ID NO: 3786321 - DNA, 17 bp, Homo sapiens
tgtgtgctcatgtatgt

SEQ ID NO: 3786322 - DNA, 20 bp, Homo sapiens
tgtgtggctttcagagcctc

SEQ ID NO: 3786323 - DNA, 14 bp, Homo sapiens
tgtgtgggactgta

SEQ ID NO: 3786324 - DNA, 13 bp, Homo sapiens
tgtgtgtatgcta

SEQ ID NO: 3786325 - DNA, 13 bp, Homo sapiens
tgtgtgtgtatgt

SEQ ID NO: 3786326 - DNA, 12 bp, Homo sapiens
tgtgtgtgtgca

SEQ ID NO: 3786327 - DNA, 14 bp, Homo sapiens
tgtgtgttgtctga

SEQ ID NO: 3786328 - DNA, 12 bp, Homo sapiens
tgtgttaagagt

SEQ ID NO: 3786329 - DNA, 14 bp, Homo sapiens
tgtgttatgaagca

SEQ ID NO: 3786330 - DNA, 10 bp, Homo sapiens
tgtgttcctg

SEQ ID NO: 3786331 - DNA, 18 bp, Homo sapiens
tgtgttctgtttgttaaa

SEQ ID NO: 3786332 - DNA, 21 bp, Homo sapiens
tgtgttctgtttgttaaaact

SEQ ID NO: 3786333 - DNA, 12 bp, Homo sapiens
tgtgttgtttga

SEQ ID NO: 3786334 - DNA, 14 bp, Homo sapiens
tgtgttgtttgaaa

SEQ ID NO: 3786335 - DNA, 13 bp, Homo sapiens
tgtgtttttgaaa

SEQ ID NO: 3786336 - DNA, 22 bp, Homo sapiens
tgtgtttttttttcgtttgttt

SEQ ID NO: 3786337 - DNA, 19 bp, Homo sapiens
tgttaaaactggcatctga

SEQ ID NO: 3786338 - DNA, 14 bp, Homo sapiens
tgttaaaataacta

SEQ ID NO: 3786339 - DNA, 19 bp, Homo sapiens
tgttaaaatctctctctgt

SEQ ID NO: 3786340 - DNA, 16 bp, Homo sapiens
tgttaaatatttacat

SEQ ID NO: 3786341 - DNA, 24 bp, Homo sapiens
tgttaaatcccattcataactttc

SEQ ID NO: 3786342 - DNA, 22 bp, Homo sapiens
tgttaacttaatagtatttatg

SEQ ID NO: 3786343 - DNA, 14 bp, Homo sapiens
tgttaatattcttt

SEQ ID NO: 3786344 - DNA, 18 bp, Homo sapiens
tgttaatattctttcaat

SEQ ID NO: 3786345 - DNA, 14 bp, Homo sapiens
tgttaatcctagct

SEQ ID NO: 3786346 - DNA, 14 bp, Homo sapiens
tgttaatgaaaatg

SEQ ID NO: 3786347 - DNA, 17 bp, Homo sapiens
tgttaatgaaaatgtca

SEQ ID NO: 3786348 - DNA, 13 bp, Homo sapiens
tgttacatagtgt

SEQ ID NO: 3786349 - DNA, 15 bp, Homo sapiens
tgttacattattatc

SEQ ID NO: 3786350 - DNA, 20 bp, Homo sapiens
tgttactgatcatgcattgt

SEQ ID NO: 3786351 - DNA, 21 bp, Homo sapiens
tgttagaacactattttcaga

SEQ ID NO: 3786352 - DNA, 22 bp, Homo sapiens
tgttagaacactattttcagaa

SEQ ID NO: 3786353 - DNA, 23 bp, Homo sapiens
tgttagaacactattttcagaat

SEQ ID NO: 3786354 - DNA, 17 bp, Homo sapiens
tgttagccccataattt

SEQ ID NO: 3786355 - DNA, 14 bp, Homo sapiens
tgttagctgttatt

SEQ ID NO: 3786356 - DNA, 14 bp, Homo sapiens
tgttaggctgggcc

SEQ ID NO: 3786357 - DNA, 18 bp, Homo sapiens
tgttaggctgggcccaga

SEQ ID NO: 3786358 - DNA, 20 bp, Homo sapiens
tgttagtagaaattttacaa

SEQ ID NO: 3786359 - DNA, 15 bp, Homo sapiens
tgttagtcatttgct

SEQ ID NO: 3786360 - DNA, 12 bp, Homo sapiens
tgttatgataaa

SEQ ID NO: 3786361 - DNA, 20 bp, Homo sapiens
tgttattacatccttgtggc

SEQ ID NO: 3786362 - DNA, 22 bp, Homo sapiens
tgttattattacttatttttga

SEQ ID NO: 3786363 - DNA, 16 bp, Homo sapiens
tgttattgaaaaaaat

SEQ ID NO: 3786364 - DNA, 21 bp, Homo sapiens
tgttatttctatttttgtaga

SEQ ID NO: 3786365 - DNA, 19 bp, Homo sapiens
tgttattttctttgaaatt

SEQ ID NO: 3786366 - DNA, 22 bp, Homo sapiens
tgttcagaaggttgctctagat

SEQ ID NO: 3786367 - DNA, 14 bp, Homo sapiens
tgttcagctccagc

SEQ ID NO: 3786368 - DNA, 15 bp, Homo sapiens
tgttcagctccagct

SEQ ID NO: 3786369 - DNA, 16 bp, Homo sapiens
tgttcagctccagctc

SEQ ID NO: 3786370 - DNA, 21 bp, Homo sapiens
tgttcagctccagctcaccag

SEQ ID NO: 3786371 - DNA, 22 bp, Homo sapiens
tgttcagctccagctcaccagc

SEQ ID NO: 3786372 - DNA, 11 bp, Homo sapiens
tgttcagctgg

SEQ ID NO: 3786373 - DNA, 22 bp, Homo sapiens
tgttcattaaagcatgaatggt

SEQ ID NO: 3786374 - DNA, 13 bp, Homo sapiens
tgttcattgtaat

SEQ ID NO: 3786375 - DNA, 19 bp, Homo sapiens
tgttcattgtaatgttact

SEQ ID NO: 3786376 - DNA, 20 bp, Homo sapiens
tgttcattgtaatgttactg

SEQ ID NO: 3786377 - DNA, 19 bp, Homo sapiens
tgttccaagacattgtcaa

SEQ ID NO: 3786378 - DNA, 20 bp, Homo sapiens
tgttcccaccaggctgctca

SEQ ID NO: 3786379 - DNA, 22 bp, Homo sapiens
tgttcccctttgcttcattcaa

SEQ ID NO: 3786380 - DNA, 18 bp, Homo sapiens
tgttccctctccctgttg

SEQ ID NO: 3786381 - DNA, 15 bp, Homo sapiens
tgttcctaagttctt

SEQ ID NO: 3786382 - DNA, 13 bp, Homo sapiens
tgttctctgagga

SEQ ID NO: 3786383 - DNA, 13 bp, Homo sapiens
tgttctgacatta

SEQ ID NO: 3786384 - DNA, 16 bp, Homo sapiens
tgttctgacattaaca

SEQ ID NO: 3786385 - DNA, 19 bp, Homo sapiens
tgttctgattagaaatgac

SEQ ID NO: 3786386 - DNA, 22 bp, Homo sapiens
tgttctgattagaaatgaccaa

SEQ ID NO: 3786387 - DNA, 15 bp, Homo sapiens
tgttctgggacacag

SEQ ID NO: 3786388 - DNA, 16 bp, Homo sapiens
tgttctgtttgttaaa

SEQ ID NO: 3786389 - DNA, 17 bp, Homo sapiens
tgttctgtttgttaaaa

SEQ ID NO: 3786390 - DNA, 21 bp, Homo sapiens
tgttctgtttgttaaaactgg

SEQ ID NO: 3786391 - DNA, 19 bp, Homo sapiens
tgttcttgccactgcactc

SEQ ID NO: 3786392 - DNA, 20 bp, Homo sapiens
tgttctttggaaatacacag

SEQ ID NO: 3786393 - DNA, 13 bp, Homo sapiens
tgttctttgggga

SEQ ID NO: 3786394 - DNA, 19 bp, Homo sapiens
tgttgaaaagccatgttta

SEQ ID NO: 3786395 - DNA, 23 bp, Homo sapiens
tgttgaaaagccatgtttaagat

SEQ ID NO: 3786396 - DNA, 14 bp, Homo sapiens
tgttgaaaatgttc

SEQ ID NO: 3786397 - DNA, 11 bp, Homo sapiens
tgttgaaagat

SEQ ID NO: 3786398 - DNA, 14 bp, Homo sapiens
tgttgacatgtgct

SEQ ID NO: 3786399 - DNA, 17 bp, Homo sapiens
tgttgagccaggcctgg

SEQ ID NO: 3786400 - DNA, 19 bp, Homo sapiens
tgttgataaattccactgg

SEQ ID NO: 3786401 - DNA, 12 bp, Homo sapiens
tgttgatcccaa

SEQ ID NO: 3786402 - DNA, 11 bp, Homo sapiens
tgttgattatt

SEQ ID NO: 3786403 - DNA, 16 bp, Homo sapiens
tgttgattattagcca

SEQ ID NO: 3786404 - DNA, 19 bp, Homo sapiens
tgttgcccaggcaggtctt

SEQ ID NO: 3786405 - DNA, 14 bp, Homo sapiens
ttaaattataagga

SEQ ID NO: 3786406 - DNA, 15 bp, Homo sapiens
ttaaattataaggac

SEQ ID NO: 3786407 - DNA, 19 bp, Homo sapiens
ttaaattataaggactgca

SEQ ID NO: 3786408 - DNA, 20 bp, Homo sapiens
ttaaattcttttttaaattt

SEQ ID NO: 3786409 - DNA, 22 bp, Homo sapiens
ttaacaaggaatgcctgtgcca

SEQ ID NO: 3786410 - DNA, 18 bp, Homo sapiens
ttaacaataactactgtg

SEQ ID NO: 3786411 - DNA, 19 bp, Homo sapiens
ttaacaataactactgtgt

SEQ ID NO: 3786412 - DNA, 23 bp, Homo sapiens
ttaacaataactactgtgttcct

SEQ ID NO: 3786413 - DNA, 18 bp, Homo sapiens
ttaacaatgcgaatggta

SEQ ID NO: 3786414 - DNA, 16 bp, Homo sapiens
ttaacaattccaaagg

SEQ ID NO: 3786415 - DNA, 16 bp, Homo sapiens
ttaacagttttccatg

SEQ ID NO: 3786416 - DNA, 17 bp, Homo sapiens
ttaacagttttccatga

SEQ ID NO: 3786417 - DNA, 23 bp, Homo sapiens
ttaacattgaccaagaactgcat

SEQ ID NO: 3786418 - DNA, 17 bp, Homo sapiens
ttaaccacttcagctga

SEQ ID NO: 3786419 - DNA, 13 bp, Homo sapiens
ttaaccagaataa

SEQ ID NO: 3786420 - DNA, 14 bp, Homo sapiens
ttaacctgcataaa

SEQ ID NO: 3786421 - DNA, 23 bp, Homo sapiens
ttaactaatctattgggttcatt

SEQ ID NO: 3786422 - DNA, 21 bp, Homo sapiens
ttaactagaatttattcaatt

SEQ ID NO: 3786423 - DNA, 23 bp, Homo sapiens
ttaactatgtacaatattttaag

SEQ ID NO: 3786424 - DNA, 19 bp, Homo sapiens
ttaactattttattttcta

SEQ ID NO: 3786425 - DNA, 12 bp, Homo sapiens
ttaactcaatat

SEQ ID NO: 3786426 - DNA, 18 bp, Homo sapiens
ttaactcaggactccagc

SEQ ID NO: 3786427 - DNA, 18 bp, Homo sapiens
ttaacttagcttgaagga

SEQ ID NO: 3786428 - DNA, 22 bp, Homo sapiens
ttaacttcagagggaaagtaaa

SEQ ID NO: 3786429 - DNA, 14 bp, Homo sapiens
ttaagaaaaaaata

SEQ ID NO: 3786430 - DNA, 15 bp, Homo sapiens
ttaagaaaaaaataa

SEQ ID NO: 3786431 - DNA, 22 bp, Homo sapiens
ttctcagtcagtaattgccaaa

SEQ ID NO: 3786432 - DNA, 14 bp, Homo sapiens
ttctcatagcatta

SEQ ID NO: 3786433 - DNA, 17 bp, Homo sapiens
ttctcatagcattaact

SEQ ID NO: 3786434 - DNA, 22 bp, Homo sapiens
ttctcatagcattaactaatct

SEQ ID NO: 3786435 - DNA, 15 bp, Homo sapiens
ttctcatcctgcagg

SEQ ID NO: 3786436 - DNA, 14 bp, Homo sapiens
ttctccaaatgaga

SEQ ID NO: 3786437 - DNA, 16 bp, Homo sapiens
ttctccaccctgctct

SEQ ID NO: 3786438 - DNA, 21 bp, Homo sapiens
ttctccacctcccacaaagga

SEQ ID NO: 3786439 - DNA, 12 bp, Homo sapiens
ttctccactgga

SEQ ID NO: 3786440 - DNA, 11 bp, Homo sapiens
ttctccaggct

SEQ ID NO: 3786441 - DNA, 18 bp, Homo sapiens
ttctccatctggcagggt

SEQ ID NO: 3786442 - DNA, 18 bp, Homo sapiens
ttctccccctgggctctg

SEQ ID NO: 3786443 - DNA, 21 bp, Homo sapiens
ttctcccgttcacgttgccta

SEQ ID NO: 3786444 - DNA, 22 bp, Homo sapiens
ttctccttccaactgctgcccc

SEQ ID NO: 3786445 - DNA, 23 bp, Homo sapiens
ttctccttgataacagctaccat

SEQ ID NO: 3786446 - DNA, 23 bp, Homo sapiens
ttctctaaatgaggggcctcagg

SEQ ID NO: 3786447 - DNA, 20 bp, Homo sapiens
ttctctagggaaggccacct

SEQ ID NO: 3786448 - DNA, 20 bp, Homo sapiens
ttctctcctgattatttatc

SEQ ID NO: 3786449 - DNA, 18 bp, Homo sapiens
ttctctctatggtaaaga

SEQ ID NO: 3786450 - DNA, 14 bp, Homo sapiens
ttctctgaggacac

SEQ ID NO: 3786451 - DNA, 21 bp, Homo sapiens
ttctctgcccattccccagcc

SEQ ID NO: 3786452 - DNA, 19 bp, Homo sapiens
ttctctgcttcagcttgct

SEQ ID NO: 3786453 - DNA, 21 bp, Homo sapiens
ttctctttaactcaggactcc

SEQ ID NO: 3786454 - DNA, 15 bp, Homo sapiens
ttctcttttcctttg

SEQ ID NO: 3786455 - DNA, 13 bp, Homo sapiens
ttctgacctcagc

SEQ ID NO: 3786456 - DNA, 23 bp, Homo sapiens
ttctgattttatgtaaaattttg

SEQ ID NO: 3786457 - DNA, 23 bp, Homo sapiens
ttctgcaaatagaaaacaggaaa

SEQ ID NO: 3786458 - DNA, 21 bp, Homo sapiens
ttctgcaagcacatctgcatt

SEQ ID NO: 3786459 - DNA, 15 bp, Homo sapiens
ttctgcaccttatct

SEQ ID NO: 3786460 - DNA, 16 bp, Homo sapiens
ttctgcaccttatctt

SEQ ID NO: 3786461 - DNA, 22 bp, Homo sapiens
ttctgcagcatgacctgtgacc

SEQ ID NO: 3786462 - DNA, 23 bp, Homo sapiens
ttctgcagcatgacctgtgacca

SEQ ID NO: 3786463 - DNA, 16 bp, Homo sapiens
ttctgccagggagctt

SEQ ID NO: 3786464 - DNA, 15 bp, Homo sapiens
ttctgccatattctg

SEQ ID NO: 3786465 - DNA, 17 bp, Homo sapiens
ttctgcctgcccaggcc

SEQ ID NO: 3786466 - DNA, 21 bp, Homo sapiens
ttctgcctgcccaggcccctg

SEQ ID NO: 3786467 - DNA, 16 bp, Homo sapiens
ttctgctccacccttg

SEQ ID NO: 3786468 - DNA, 18 bp, Homo sapiens
ttctgctccacccttggc

SEQ ID NO: 3786469 - DNA, 13 bp, Homo sapiens
ttctgctggataa

SEQ ID NO: 3786470 - DNA, 21 bp, Homo sapiens
ttctgctggataaaatgaggt

SEQ ID NO: 3786471 - DNA, 19 bp, Homo sapiens
ttctgcttcagcctcccga

SEQ ID NO: 3786472 - DNA, 19 bp, Homo sapiens
ttctggaatacatgaaata

SEQ ID NO: 3786473 - DNA, 15 bp, Homo sapiens
ttctggaatgtaatc

SEQ ID NO: 3786474 - DNA, 13 bp, Homo sapiens
ttctggagccctt

SEQ ID NO: 3786475 - DNA, 23 bp, Homo sapiens
ttctgggaaatggcttgaagcca

SEQ ID NO: 3786476 - DNA, 11 bp, Homo sapiens
ttctgggacac

SEQ ID NO: 3786477 - DNA, 22 bp, Homo sapiens
ttctgggacacagttcaattct

SEQ ID NO: 3786478 - DNA, 22 bp, Homo sapiens
ttctgggagacacccaaagggt

SEQ ID NO: 3786479 - DNA, 15 bp, Homo sapiens
ttctggggccccacc

SEQ ID NO: 3786480 - DNA, 14 bp, Homo sapiens
ttctggggcccctt

SEQ ID NO: 3786481 - DNA, 21 bp, Homo sapiens
ttctggggcccctttttactc

SEQ ID NO: 3786482 - DNA, 23 bp, Homo sapiens
ttctggggcccctttttactccc

SEQ ID NO: 3786483 - DNA, 21 bp, Homo sapiens
ttctggttcttgtgttggctg

SEQ ID NO: 3786484 - DNA, 22 bp, Homo sapiens
ttctgtcatctaccttttctct

SEQ ID NO: 3786485 - DNA, 13 bp, Homo sapiens
ttctgtgtattta

SEQ ID NO: 3786486 - DNA, 17 bp, Homo sapiens
ttctgtgtatttaattg

SEQ ID NO: 3786487 - DNA, 20 bp, Homo sapiens
ttctgtgtatttaattgtaa

SEQ ID NO: 3786488 - DNA, 16 bp, Homo sapiens
ttctgttcatttgtta

SEQ ID NO: 3786489 - DNA, 17 bp, Homo sapiens
ttctgttcatttgttat

SEQ ID NO: 3786490 - DNA, 14 bp, Homo sapiens
ttctgtttctagtt

SEQ ID NO: 3786491 - DNA, 20 bp, Homo sapiens
ttctgtttctattctctcct

SEQ ID NO: 3786492 - DNA, 22 bp, Homo sapiens
ttctgtttctattctctcctca

SEQ ID NO: 3786493 - DNA, 11 bp, Homo sapiens
ttctgtttctt

SEQ ID NO: 3786494 - DNA, 22 bp, Homo sapiens
ttcttaagtatgttattttctg

SEQ ID NO: 3786495 - DNA, 15 bp, Homo sapiens
ttcttacaaacatgt

SEQ ID NO: 3786496 - DNA, 13 bp, Homo sapiens
ttcttacatgttt

SEQ ID NO: 3786497 - DNA, 15 bp, Homo sapiens
ttcttacctgtatgt

SEQ ID NO: 3786498 - DNA, 14 bp, Homo sapiens
ttcttactgcttgg

SEQ ID NO: 3786499 - DNA, 23 bp, Homo sapiens
ttcttacttgatgagtgtaacaa

SEQ ID NO: 3786500 - DNA, 17 bp, Homo sapiens
ttcttagcctgtggcag

SEQ ID NO: 3786501 - DNA, 18 bp, Homo sapiens
ttcttagcctgtggcagt

SEQ ID NO: 3786502 - DNA, 23 bp, Homo sapiens
ttcttagcctgtggcagtaaaga

SEQ ID NO: 3786503 - DNA, 21 bp, Homo sapiens
ttcttcacctaagtctctgtg

SEQ ID NO: 3786504 - DNA, 18 bp, Homo sapiens
ttcttcataacaatttta

SEQ ID NO: 3786505 - DNA, 21 bp, Homo sapiens
ttcttcataacaattttagga

SEQ ID NO: 3786506 - DNA, 21 bp, Homo sapiens
ttcttcatccggcagcctgga

SEQ ID NO: 3786507 - DNA, 21 bp, Homo sapiens
ttcttccattcccatttcctg

SEQ ID NO: 3786508 - DNA, 13 bp, Homo sapiens
ttcttcctccctc

SEQ ID NO: 3786509 - DNA, 11 bp, Homo sapiens
ttcttcctctg

SEQ ID NO: 3786510 - DNA, 18 bp, Homo sapiens
ttcttccttaaactcctg

SEQ ID NO: 3786511 - DNA, 18 bp, Homo sapiens
ttcttctaggttctaaaa

SEQ ID NO: 3786512 - DNA, 21 bp, Homo sapiens
ttcttctaggttctaaaaatt

SEQ ID NO: 3786513 - DNA, 15 bp, Homo sapiens
ttcttctgcttcagc

SEQ ID NO: 3786514 - DNA, 20 bp, Homo sapiens
ttcttctgcttcagcctccc

SEQ ID NO: 3786515 - DNA, 15 bp, Homo sapiens
ttcttcttcagaaga

SEQ ID NO: 3786516 - DNA, 14 bp, Homo sapiens
ttcttgaaagctgt

SEQ ID NO: 3786517 - DNA, 14 bp, Homo sapiens
ttcttgaagtgaaa

SEQ ID NO: 3786518 - DNA, 22 bp, Homo sapiens
ttcttgatgactggaattttta

SEQ ID NO: 3786519 - DNA, 16 bp, Homo sapiens
ttcttgtcacaataaa

SEQ ID NO: 3786520 - DNA, 23 bp, Homo sapiens
ttcttgttagtactatatctgtt

SEQ ID NO: 3786521 - DNA, 16 bp, Homo sapiens
ttcttgttctgttttg

SEQ ID NO: 3786522 - DNA, 19 bp, Homo sapiens
ttctttaaatttcaaatgt

SEQ ID NO: 3786523 - DNA, 13 bp, Homo sapiens
ttctttataaact

SEQ ID NO: 3786524 - DNA, 14 bp, Homo sapiens
ttctttataaactt

SEQ ID NO: 3786525 - DNA, 12 bp, Homo sapiens
ttctttcagaaa

SEQ ID NO: 3786526 - DNA, 17 bp, Homo sapiens
ttctttccattatgatt

SEQ ID NO: 3786527 - DNA, 15 bp, Homo sapiens
ttctttcttcctctg

SEQ ID NO: 3786528 - DNA, 17 bp, Homo sapiens
ttctttgagactgggtc

SEQ ID NO: 3786529 - DNA, 16 bp, Homo sapiens
ttctttgcttgaacac

SEQ ID NO: 3786530 - DNA, 21 bp, Homo sapiens
ttctttgcttgaacacagtat

SEQ ID NO: 3786531 - DNA, 22 bp, Homo sapiens
ttctttgcttgaacacagtatt

SEQ ID NO: 3786532 - DNA, 18 bp, Homo sapiens
ttctttggtgcctttcct

SEQ ID NO: 3786533 - DNA, 19 bp, Homo sapiens
ttctttgtgtagctttgct

SEQ ID NO: 3786534 - DNA, 23 bp, Homo sapiens
ttcttttttaaattttcttcagt

SEQ ID NO: 3786535 - DNA, 21 bp, Homo sapiens
ttgaaaactacattttaacat

SEQ ID NO: 3786536 - DNA, 23 bp, Homo sapiens
ttgaaaatattatctttgtaatt

SEQ ID NO: 3786537 - DNA, 14 bp, Homo sapiens
ttgaaagagttaag

SEQ ID NO: 3786538 - DNA, 21 bp, Homo sapiens
ttgaaaggcattctctgaaga

SEQ ID NO: 3786539 - DNA, 20 bp, Homo sapiens
ttgaacaagttgtttcattg

SEQ ID NO: 3786540 - DNA, 13 bp, Homo sapiens
ttgaacacagtat

SEQ ID NO: 3786541 - DNA, 13 bp, Homo sapiens
ttgaacccaggag

SEQ ID NO: 3786542 - DNA, 16 bp, Homo sapiens
ttgaactcctggcctc

SEQ ID NO: 3786543 - DNA, 22 bp, Homo sapiens
ttgaacttaaataaatgtcatt

SEQ ID NO: 3786544 - DNA, 22 bp, Homo sapiens
ttgaagacactgaaatatacac

SEQ ID NO: 3786545 - DNA, 14 bp, Homo sapiens
ttgtagggtttcta

SEQ ID NO: 3786546 - DNA, 18 bp, Homo sapiens
ttgtagtaaagaaattta

SEQ ID NO: 3786547 - DNA, 13 bp, Homo sapiens
ttgtatctagtgc

SEQ ID NO: 3786548 - DNA, 21 bp, Homo sapiens
ttgtatctagtgcagctgatt

SEQ ID NO: 3786549 - DNA, 20 bp, Homo sapiens
ttgtatctcttttgaatcca

SEQ ID NO: 3786550 - DNA, 22 bp, Homo sapiens
ttgtcaaactgtagaaatgatg

SEQ ID NO: 3786551 - DNA, 18 bp, Homo sapiens
ttgtcacacactttggct

SEQ ID NO: 3786552 - DNA, 22 bp, Homo sapiens
ttgtcactcaacaaaagtgctt

SEQ ID NO: 3786553 - DNA, 20 bp, Homo sapiens
ttgtcagactttaaagaata

SEQ ID NO: 3786554 - DNA, 12 bp, Homo sapiens
ttgtcagctact

SEQ ID NO: 3786555 - DNA, 13 bp, Homo sapiens
ttgtcattgcttt

SEQ ID NO: 3786556 - DNA, 18 bp, Homo sapiens
ttgtcattgctttactgg

SEQ ID NO: 3786557 - DNA, 13 bp, Homo sapiens
ttgtccagagaca

SEQ ID NO: 3786558 - DNA, 11 bp, Homo sapiens
ttgtccccagt

SEQ ID NO: 3786559 - DNA, 18 bp, Homo sapiens
ttgtcccgattgtaactc

SEQ ID NO: 3786560 - DNA, 20 bp, Homo sapiens
ttgtctatgggactcaatgc

SEQ ID NO: 3786561 - DNA, 12 bp, Homo sapiens
ttgtctctgggc

SEQ ID NO: 3786562 - DNA, 22 bp, Homo sapiens
ttgtcttaaaaagtggaaaaat

SEQ ID NO: 3786563 - DNA, 13 bp, Homo sapiens
ttgtctttatatg

SEQ ID NO: 3786564 - DNA, 13 bp, Homo sapiens
ttgtgactagtgc

SEQ ID NO: 3786565 - DNA, 17 bp, Homo sapiens
ttgtgactagtgctgaa

SEQ ID NO: 3786566 - DNA, 15 bp, Homo sapiens
ttgtgagagcgaggc

SEQ ID NO: 3786567 - DNA, 15 bp, Homo sapiens
ttgtgctcagcatga

SEQ ID NO: 3786568 - DNA, 17 bp, Homo sapiens
ttgtggacacagctctt

SEQ ID NO: 3786569 - DNA, 19 bp, Homo sapiens
ttgtggcagaagtgtttca

SEQ ID NO: 3786570 - DNA, 11 bp, Homo sapiens
ttgtggcctca

SEQ ID NO: 3786571 - DNA, 16 bp, Homo sapiens
ttgtgtaataaagtgt

SEQ ID NO: 3786572 - DNA, 15 bp, Homo sapiens
ttgtgtactctggcc

SEQ ID NO: 3786573 - DNA, 15 bp, Homo sapiens
ttgtgtatatttaag

SEQ ID NO: 3786574 - DNA, 19 bp, Homo sapiens
ttgtgtgtgggctgtgagt

SEQ ID NO: 3786575 - DNA, 16 bp, Homo sapiens
ttgtgtgttatttaaa

SEQ ID NO: 3786576 - DNA, 13 bp, Homo sapiens
ttgtgttgtttga

SEQ ID NO: 3786577 - DNA, 17 bp, Homo sapiens
ttgtgtttttaatttat

SEQ ID NO: 3786578 - DNA, 14 bp, Homo sapiens
ttgttaaaactggc

SEQ ID NO: 3786579 - DNA, 13 bp, Homo sapiens
ttgttaatattct

SEQ ID NO: 3786580 - DNA, 14 bp, Homo sapiens
ttgttaatattctt

SEQ ID NO: 3786581 - DNA, 17 bp, Homo sapiens
ttgttaatgaaaatgtc

SEQ ID NO: 3786582 - DNA, 18 bp, Homo sapiens
ttgttaatgaaaatgtca

SEQ ID NO: 3786583 - DNA, 14 bp, Homo sapiens
ttgttatttataac

SEQ ID NO: 3786584 - DNA, 17 bp, Homo sapiens
ttgttccaagacattgt

SEQ ID NO: 3786585 - DNA, 11 bp, Homo sapiens
ttgttcccagt

SEQ ID NO: 3786586 - DNA, 14 bp, Homo sapiens
ttgttccctctccc

SEQ ID NO: 3786587 - DNA, 14 bp, Homo sapiens
ttgttctttcagaa

SEQ ID NO: 3786588 - DNA, 20 bp, Homo sapiens
ttgttgctcagcaaggggct

SEQ ID NO: 3786589 - DNA, 21 bp, Homo sapiens
ttgttggaaaagaatacagaa

SEQ ID NO: 3786590 - DNA, 13 bp, Homo sapiens
ttgttggaatgaa

SEQ ID NO: 3786591 - DNA, 12 bp, Homo sapiens
ttgtttaacata

SEQ ID NO: 3786592 - DNA, 17 bp, Homo sapiens
ttgtttctccccctggg

SEQ ID NO: 3786593 - DNA, 13 bp, Homo sapiens
ttgtttcttccaa

SEQ ID NO: 3786594 - DNA, 16 bp, Homo sapiens
ttgtttgaaaatatta

SEQ ID NO: 3786595 - DNA, 16 bp, Homo sapiens
ttgtttgggtatcctg

SEQ ID NO: 3786596 - DNA, 21 bp, Homo sapiens
tttataactcatcataaaata

SEQ ID NO: 3786597 - DNA, 22 bp, Homo sapiens
tttataactcatcataaaataa

SEQ ID NO: 3786598 - DNA, 21 bp, Homo sapiens
tttataattttaagattcctt

SEQ ID NO: 3786599 - DNA, 22 bp, Homo sapiens
tttataattttaagattccttt

SEQ ID NO: 3786600 - DNA, 16 bp, Homo sapiens
tttatacaatatcatc

SEQ ID NO: 3786601 - DNA, 15 bp, Homo sapiens
tttatacaggggaat

SEQ ID NO: 3786602 - DNA, 22 bp, Homo sapiens
tttatacagtagtgagaagaat

SEQ ID NO: 3786603 - DNA, 16 bp, Homo sapiens
tttatactgtttactg

SEQ ID NO: 3786604 - DNA, 16 bp, Homo sapiens
tttatagctcagttta

SEQ ID NO: 3786605 - DNA, 15 bp, Homo sapiens
tttatagtttataca

SEQ ID NO: 3786606 - DNA, 21 bp, Homo sapiens
tttatataataaagtattcca

SEQ ID NO: 3786607 - DNA, 17 bp, Homo sapiens
tttatataattatgtta

SEQ ID NO: 3786608 - DNA, 19 bp, Homo sapiens
tttatatagcttgaaacat

SEQ ID NO: 3786609 - DNA, 13 bp, Homo sapiens
tttatatatgtat

SEQ ID NO: 3786610 - DNA, 17 bp, Homo sapiens
tttatatgtatccagta

SEQ ID NO: 3786611 - DNA, 22 bp, Homo sapiens
tttatattttcaattcaaaaat

SEQ ID NO: 3786612 - DNA, 23 bp, Homo sapiens
tttatattttcaattcaaaaatg

SEQ ID NO: 3786613 - DNA, 13 bp, Homo sapiens
tttatcagtgaca

SEQ ID NO: 3786614 - DNA, 14 bp, Homo sapiens
tttatccttgaact

SEQ ID NO: 3786615 - DNA, 13 bp, Homo sapiens
tttatctattgta

SEQ ID NO: 3786616 - DNA, 17 bp, Homo sapiens
tttatctattgtaagat

SEQ ID NO: 3786617 - DNA, 21 bp, Homo sapiens
tttatctattgtaagataaaa

SEQ ID NO: 3786618 - DNA, 17 bp, Homo sapiens
tttatctgggattatgg

SEQ ID NO: 3786619 - DNA, 21 bp, Homo sapiens
tttatcttggactgacattta

SEQ ID NO: 3786620 - DNA, 14 bp, Homo sapiens
tttatcttgtctct

SEQ ID NO: 3786621 - DNA, 13 bp, Homo sapiens
tttatgaaaagag

SEQ ID NO: 3786622 - DNA, 21 bp, Homo sapiens
tttatgaaatggttaagaatt

SEQ ID NO: 3786623 - DNA, 18 bp, Homo sapiens
tttatgaagaaaaaatac

SEQ ID NO: 3786624 - DNA, 17 bp, Homo sapiens
tttatgaaggcaaaaaa

SEQ ID NO: 3786625 - DNA, 13 bp, Homo sapiens
tttatgcaataaa

SEQ ID NO: 3786626 - DNA, 22 bp, Homo sapiens
tttatgggtcagagttccgact

SEQ ID NO: 3786627 - DNA, 22 bp, Homo sapiens
tttatgtaaactgcattagaaa

SEQ ID NO: 3786628 - DNA, 18 bp, Homo sapiens
tttatgtgtgaggagctg

SEQ ID NO: 3786629 - DNA, 18 bp, Homo sapiens
tttatgttttgtttctga

SEQ ID NO: 3786630 - DNA, 12 bp, Homo sapiens
tttattaacaaa

SEQ ID NO: 3786631 - DNA, 12 bp, Homo sapiens
tttattaagatg

SEQ ID NO: 3786632 - DNA, 22 bp, Homo sapiens
tttattaagatggattctcaga

SEQ ID NO: 3786633 - DNA, 13 bp, Homo sapiens
tttattacctctg

SEQ ID NO: 3786634 - DNA, 20 bp, Homo sapiens
tttattacctctgatacctc

SEQ ID NO: 3786635 - DNA, 17 bp, Homo sapiens
tttattattttcacctg

SEQ ID NO: 3786636 - DNA, 14 bp, Homo sapiens
tttattccttgtga

SEQ ID NO: 3786637 - DNA, 17 bp, Homo sapiens
tttattcttgtgaatat

SEQ ID NO: 3786638 - DNA, 19 bp, Homo sapiens
tttattgatgtgcaaaaat

SEQ ID NO: 3786639 - DNA, 13 bp, Homo sapiens
tttattgcacaaa

SEQ ID NO: 3786640 - DNA, 17 bp, Homo sapiens
tttattgcacaaaatat

SEQ ID NO: 3786641 - DNA, 14 bp, Homo sapiens
tttattgctacttc

SEQ ID NO: 3786642 - DNA, 17 bp, Homo sapiens
tttattgtgtttttaat

SEQ ID NO: 3786643 - DNA, 17 bp, Homo sapiens
tttatttaatgttatgt

SEQ ID NO: 3786644 - DNA, 12 bp, Homo sapiens
tttatttacttc

SEQ ID NO: 3786645 - DNA, 15 bp, Homo sapiens
tttatttatactatt

SEQ ID NO: 3786646 - DNA, 14 bp, Homo sapiens
tttatttattaaga

SEQ ID NO: 3786647 - DNA, 11 bp, Homo sapiens
tttattttata

SEQ ID NO: 3786648 - DNA, 21 bp, Homo sapiens
tttattttcttttgtaaatgt

SEQ ID NO: 3786649 - DNA, 17 bp, Homo sapiens
tttattttttaagtatt

SEQ ID NO: 3786650 - DNA, 15 bp, Homo sapiens
tttattttttataca

SEQ ID NO: 3786651 - DNA, 16 bp, Homo sapiens
tttattttttatacag

SEQ ID NO: 3786652 - DNA, 15 bp, Homo sapiens
tttcaaaaatttgga

SEQ ID NO: 3786653 - DNA, 20 bp, Homo sapiens
tttcaaaactcatttcctat

SEQ ID NO: 3786654 - DNA, 16 bp, Homo sapiens
tttcaaattgagagaa

SEQ ID NO: 3786655 - DNA, 14 bp, Homo sapiens
tttcaaattgtatc

SEQ ID NO: 3786656 - DNA, 15 bp, Homo sapiens
tttcaacgcagccct

SEQ ID NO: 3786657 - DNA, 21 bp, Homo sapiens
tttcaacgcagccctgctttg

SEQ ID NO: 3786658 - DNA, 19 bp, Homo sapiens
tttcaagaaactgaggaat

SEQ ID NO: 3786659 - DNA, 13 bp, Homo sapiens
tttcaagcatctc

SEQ ID NO: 3786660 - DNA, 14 bp, Homo sapiens
tttcaagcatctcc

SEQ ID NO: 3786661 - DNA, 19 bp, Homo sapiens
tttcaattcaaaaatgtac

SEQ ID NO: 3786662 - DNA, 22 bp, Homo sapiens
tttcacaaccttctgtggctca

SEQ ID NO: 3786663 - DNA, 18 bp, Homo sapiens
ttgataaattccactgga

SEQ ID NO: 3786664 - DNA, 19 bp, Homo sapiens
ttgataaattccactggac

SEQ ID NO: 3786665 - DNA, 12 bp, Homo sapiens
ttgataacagct

SEQ ID NO: 3786666 - DNA, 18 bp, Homo sapiens
ttgatataaataaaacat

SEQ ID NO: 3786667 - DNA, 21 bp, Homo sapiens
ttgatataatttccatagtgt

SEQ ID NO: 3786668 - DNA, 20 bp, Homo sapiens
ttgatatacttttttcttat

SEQ ID NO: 3786669 - DNA, 16 bp, Homo sapiens
ttgatatgcttataca

SEQ ID NO: 3786670 - DNA, 19 bp, Homo sapiens
ttgatcattttccccccac

SEQ ID NO: 3786671 - DNA, 16 bp, Homo sapiens
ttgatctccgtggctt

SEQ ID NO: 3786672 - DNA, 20 bp, Homo sapiens
ttgatgactggaatttttat

SEQ ID NO: 3786673 - DNA, 18 bp, Homo sapiens
ttgatgtgcaaaaatttt

SEQ ID NO: 3786674 - DNA, 16 bp, Homo sapiens
ttgatgtttgtggcct

SEQ ID NO: 3786675 - DNA, 16 bp, Homo sapiens
ttgattcagctctgca

SEQ ID NO: 3786676 - DNA, 14 bp, Homo sapiens
ttgattccatctcc

SEQ ID NO: 3786677 - DNA, 13 bp, Homo sapiens
ttgattttacaat

SEQ ID NO: 3786678 - DNA, 11 bp, Homo sapiens
ttgcaaaattt

SEQ ID NO: 3786679 - DNA, 16 bp, Homo sapiens
ttgcaaaatttccagt

SEQ ID NO: 3786680 - DNA, 12 bp, Homo sapiens
ttgcaaggaagc

SEQ ID NO: 3786681 - DNA, 14 bp, Homo sapiens
ttgcaaggccgctg

SEQ ID NO: 3786682 - DNA, 22 bp, Homo sapiens
ttgcaagggccagatctgttaa

SEQ ID NO: 3786683 - DNA, 21 bp, Homo sapiens
ttgcaagtatgttttagcatg

SEQ ID NO: 3786684 - DNA, 22 bp, Homo sapiens
ttgcaagtatgttttagcatgt

SEQ ID NO: 3786685 - DNA, 16 bp, Homo sapiens
ttgcaatggcagcctt

SEQ ID NO: 3786686 - DNA, 17 bp, Homo sapiens
ttgcaatggcagccttg

SEQ ID NO: 3786687 - DNA, 20 bp, Homo sapiens
ttgcaattttaacacacata

SEQ ID NO: 3786688 - DNA, 17 bp, Homo sapiens
ttgcacactcccctgca

SEQ ID NO: 3786689 - DNA, 14 bp, Homo sapiens
ttgcactccagcct

SEQ ID NO: 3786690 - DNA, 16 bp, Homo sapiens
ttgcactccagcctgg

SEQ ID NO: 3786691 - DNA, 20 bp, Homo sapiens
ttgcagaagggggtctcttc

SEQ ID NO: 3786692 - DNA, 18 bp, Homo sapiens
ttgcagattcatttttct

SEQ ID NO: 3786693 - DNA, 23 bp, Homo sapiens
ttgcagctctccccttctctgta

SEQ ID NO: 3786694 - DNA, 14 bp, Homo sapiens
ttgcagctgggaga

SEQ ID NO: 3786695 - DNA, 18 bp, Homo sapiens
ttgcagctgggagaaggg

SEQ ID NO: 3786696 - DNA, 13 bp, Homo sapiens
ttgcagtgagcca

SEQ ID NO: 3786697 - DNA, 13 bp, Homo sapiens
ttgcagtggaaga

SEQ ID NO: 3786698 - DNA, 16 bp, Homo sapiens
ttgcagttcagcacca

SEQ ID NO: 3786699 - DNA, 13 bp, Homo sapiens
ttgcatcagaaat

SEQ ID NO: 3786700 - DNA, 17 bp, Homo sapiens
ttgcatgggttttgtag

SEQ ID NO: 3786701 - DNA, 13 bp, Homo sapiens
ttgccaccaggag

SEQ ID NO: 3786702 - DNA, 14 bp, Homo sapiens
ttgccaccaggaga

SEQ ID NO: 3786703 - DNA, 15 bp, Homo sapiens
ttgccaccaggagaa

SEQ ID NO: 3786704 - DNA, 14 bp, Homo sapiens
ttgccactgcctct

SEQ ID NO: 3786705 - DNA, 18 bp, Homo sapiens
ttgccactgcctcttcct

SEQ ID NO: 3786706 - DNA, 17 bp, Homo sapiens
ttgccagaaagcataaa

SEQ ID NO: 3786707 - DNA, 20 bp, Homo sapiens
ttgccagaaagcataaaatt

SEQ ID NO: 3786708 - DNA, 22 bp, Homo sapiens
ttgccagacatgtggtgggaca

SEQ ID NO: 3786709 - DNA, 13 bp, Homo sapiens
ttgccagtgtctt

SEQ ID NO: 3786710 - DNA, 14 bp, Homo sapiens
ttgccagtgtcttt

SEQ ID NO: 3786711 - DNA, 16 bp, Homo sapiens
ttgccagtgtctttct

SEQ ID NO: 3786712 - DNA, 20 bp, Homo sapiens
ttgccatgacaacttctaat

SEQ ID NO: 3786713 - DNA, 17 bp, Homo sapiens
ttgccatgttggccagg

SEQ ID NO: 3786714 - DNA, 18 bp, Homo sapiens
ttgccatgttggccaggc

SEQ ID NO: 3786715 - DNA, 21 bp, Homo sapiens
ttgccatgttggccaggctgg

SEQ ID NO: 3786716 - DNA, 17 bp, Homo sapiens
ttgcccaaatctgccta

SEQ ID NO: 3786717 - DNA, 19 bp, Homo sapiens
ttgcccaacctcagcaacc

SEQ ID NO: 3786718 - DNA, 23 bp, Homo sapiens
ttgcccacgctggagtgcagtga

SEQ ID NO: 3786719 - DNA, 18 bp, Homo sapiens
ttgcccagagatgcctcc

SEQ ID NO: 3786720 - DNA, 17 bp, Homo sapiens
tgtcttccataatgtat

SEQ ID NO: 3786721 - DNA, 13 bp, Homo sapiens
tgtcttcctgcat

SEQ ID NO: 3786722 - DNA, 23 bp, Homo sapiens
tgtcttctcaggctctgccctgc

SEQ ID NO: 3786723 - DNA, 15 bp, Homo sapiens
tgtcttgcaatggca

SEQ ID NO: 3786724 - DNA, 18 bp, Homo sapiens
tgtcttgcaatggcagcc

SEQ ID NO: 3786725 - DNA, 17 bp, Homo sapiens
tgtcttggtacttgctg

SEQ ID NO: 3786726 - DNA, 15 bp, Homo sapiens
tgtcttgtaagcaaa

SEQ ID NO: 3786727 - DNA, 16 bp, Homo sapiens
tgtcttgtgtttttgt

SEQ ID NO: 3786728 - DNA, 19 bp, Homo sapiens
tgtcttgttaatattcttt

SEQ ID NO: 3786729 - DNA, 15 bp, Homo sapiens
tgtctttcagataca

SEQ ID NO: 3786730 - DNA, 16 bp, Homo sapiens
tgtctttcagatacat

SEQ ID NO: 3786731 - DNA, 19 bp, Homo sapiens
tgtctttcagatacatggt

SEQ ID NO: 3786732 - DNA, 13 bp, Homo sapiens
tgtctttctttgg

SEQ ID NO: 3786733 - DNA, 17 bp, Homo sapiens
tttcctagccctctcac

SEQ ID NO: 3786734 - DNA, 21 bp, Homo sapiens
tttcctcaggctgctggagga

SEQ ID NO: 3786735 - DNA, 18 bp, Homo sapiens
tttcctcatttttataat

SEQ ID NO: 3786736 - DNA, 16 bp, Homo sapiens
tttcctccccagcagg

SEQ ID NO: 3786737 - DNA, 13 bp, Homo sapiens
tttcctccctcag

SEQ ID NO: 3786738 - DNA, 22 bp, Homo sapiens
tttcctcttctattttgtaaac

SEQ ID NO: 3786739 - DNA, 18 bp, Homo sapiens
tttcctgagcttggccag

SEQ ID NO: 3786740 - DNA, 16 bp, Homo sapiens
tttccttaaactgtgt

SEQ ID NO: 3786741 - DNA, 21 bp, Homo sapiens
tttccttcattcaacccacct

SEQ ID NO: 3786742 - DNA, 15 bp, Homo sapiens
tttccttctcatctg

SEQ ID NO: 3786743 - DNA, 16 bp, Homo sapiens
tttccttttttgttat

SEQ ID NO: 3786744 - DNA, 19 bp, Homo sapiens
tttcgccgttgaagaggaa

SEQ ID NO: 3786745 - DNA, 15 bp, Homo sapiens
tttcgttaacattga

SEQ ID NO: 3786746 - DNA, 12 bp, Homo sapiens
tttcgtttgttt

SEQ ID NO: 3786747 - DNA, 14 bp, Homo sapiens
tttctaaaaaacag

SEQ ID NO: 3786748 - DNA, 22 bp, Homo sapiens
tttctaacactagtctgtgtgc

SEQ ID NO: 3786749 - DNA, 16 bp, Homo sapiens
tttctaactctgatgt

SEQ ID NO: 3786750 - DNA, 18 bp, Homo sapiens
tttctaactctgatgtaa

SEQ ID NO: 3786751 - DNA, 15 bp, Homo sapiens
tttctaatgtgtgaa

SEQ ID NO: 3786752 - DNA, 15 bp, Homo sapiens
tttctacccagcgag

SEQ ID NO: 3786753 - DNA, 18 bp, Homo sapiens
tttctacccagcgagccc

SEQ ID NO: 3786754 - DNA, 16 bp, Homo sapiens
tttctaccttgaggtc

SEQ ID NO: 3786755 - DNA, 20 bp, Homo sapiens
tttctagaacatccctgcca

SEQ ID NO: 3786756 - DNA, 22 bp, Homo sapiens
tttctagaacatccctgccagc

SEQ ID NO: 3786757 - DNA, 21 bp, Homo sapiens
tttctagaatttatcacactt

SEQ ID NO: 3786758 - DNA, 23 bp, Homo sapiens
tttctcagccgcttctgactgct

SEQ ID NO: 3786759 - DNA, 12 bp, Homo sapiens
tttctcccagct

SEQ ID NO: 3786760 - DNA, 20 bp, Homo sapiens
tttctcccaggccaggctcc

SEQ ID NO: 3786761 - DNA, 15 bp, Homo sapiens
tttctccccctgggc

SEQ ID NO: 3786762 - DNA, 15 bp, Homo sapiens
tttctcctcccagga

SEQ ID NO: 3786763 - DNA, 20 bp, Homo sapiens
tttctccttagtcttctcat

SEQ ID NO: 3786764 - DNA, 21 bp, Homo sapiens
tttctctgcttcagcttgctt

SEQ ID NO: 3786765 - DNA, 17 bp, Homo sapiens
tttctgaaactaatgaa

SEQ ID NO: 3786766 - DNA, 18 bp, Homo sapiens
tttctgaaactaatgaaa

SEQ ID NO: 3786767 - DNA, 16 bp, Homo sapiens
tttctggcctgccttc

SEQ ID NO: 3786768 - DNA, 23 bp, Homo sapiens
tttctgtccttttggcactgaga

SEQ ID NO: 3786769 - DNA, 22 bp, Homo sapiens
tttcttcatgcaatgacatctt

SEQ ID NO: 3786770 - DNA, 16 bp, Homo sapiens
tttcttcctatttctg

SEQ ID NO: 3786771 - DNA, 13 bp, Homo sapiens
tttcttcctctgc

SEQ ID NO: 3786772 - DNA, 22 bp, Homo sapiens
tttcttgactcttgttttcagt

SEQ ID NO: 3786773 - DNA, 12 bp, Homo sapiens
tttctttaaatt

SEQ ID NO: 3786774 - DNA, 13 bp, Homo sapiens
tttctttgtggct

SEQ ID NO: 3786775 - DNA, 15 bp, Homo sapiens
tttctttgtgtagct

SEQ ID NO: 3786776 - DNA, 22 bp, Homo sapiens
tttcttttctggaatgtaatca

SEQ ID NO: 3786777 - DNA, 20 bp, Homo sapiens
tttgaaaaagcagacagaag

SEQ ID NO: 3786778 - DNA, 14 bp, Homo sapiens
tttgaaaactacat

SEQ ID NO: 3786779 - DNA, 14 bp, Homo sapiens
tttgaaataataaa

SEQ ID NO: 3786780 - DNA, 19 bp, Homo sapiens
tttgaaatagtctgtgtga

SEQ ID NO: 3786781 - DNA, 14 bp, Homo sapiens
tttgaaccaaaaca

SEQ ID NO: 3786782 - DNA, 22 bp, Homo sapiens
tttgaagatgccgcatttggat

SEQ ID NO: 3786783 - DNA, 16 bp, Homo sapiens
tttgaagctaattatt

SEQ ID NO: 3786784 - DNA, 18 bp, Homo sapiens
tttgaagctaattatttt

SEQ ID NO: 3786785 - DNA, 19 bp, Homo sapiens
tttgaagctaattatttta

SEQ ID NO: 3786786 - DNA, 23 bp, Homo sapiens
tttgaagctaattattttaatta

SEQ ID NO: 3786787 - DNA, 14 bp, Homo sapiens
tttgaatgaaaaat

SEQ ID NO: 3786788 - DNA, 15 bp, Homo sapiens
tttgaatgaaaaatt

SEQ ID NO: 3786789 - DNA, 21 bp, Homo sapiens
tttgaatgaaaaatttaagca

SEQ ID NO: 3786790 - DNA, 20 bp, Homo sapiens
tttgacaattcctagataaa

SEQ ID NO: 3786791 - DNA, 23 bp, Homo sapiens
tttgaggtcaagtaagaagacat

SEQ ID NO: 3786792 - DNA, 20 bp, Homo sapiens
tttgagtggatgatgtttcg

SEQ ID NO: 3786793 - DNA, 21 bp, Homo sapiens
tttgagtggatgatgtttcgt

SEQ ID NO: 3786794 - DNA, 16 bp, Homo sapiens
tttgatgaaagctgat

SEQ ID NO: 3786795 - DNA, 15 bp, Homo sapiens
tttgattctgtgtgt

SEQ ID NO: 3786796 - DNA, 12 bp, Homo sapiens
tttgcaaaattt

SEQ ID NO: 3786797 - DNA, 14 bp, Homo sapiens
tttgcaaggaagcc

SEQ ID NO: 3786798 - DNA, 21 bp, Homo sapiens
tttgcaaggaagccacagctg

SEQ ID NO: 3786799 - DNA, 17 bp, Homo sapiens
tttgcactgtatgctgg

SEQ ID NO: 3786800 - DNA, 14 bp, Homo sapiens
tttgcagaaacaga

SEQ ID NO: 3786801 - DNA, 23 bp, Homo sapiens
tttgcatagtaccaatcatttta

SEQ ID NO: 3786802 - DNA, 15 bp, Homo sapiens
tttgcatatgtatga

SEQ ID NO: 3786803 - DNA, 14 bp, Homo sapiens
tttgcattcctaca

SEQ ID NO: 3786804 - DNA, 22 bp, Homo sapiens
ttggagggtgggagagcccagc

SEQ ID NO: 3786805 - DNA, 22 bp, Homo sapiens
ttggataatgctgttgcctcat

SEQ ID NO: 3786806 - DNA, 18 bp, Homo sapiens
ttggattgacagtaactt

SEQ ID NO: 3786807 - DNA, 22 bp, Homo sapiens
ttggcactgagatatttattgt

SEQ ID NO: 3786808 - DNA, 21 bp, Homo sapiens
ttggcatcacagggcagagcc

SEQ ID NO: 3786809 - DNA, 13 bp, Homo sapiens
ttggcattcccca

SEQ ID NO: 3786810 - DNA, 19 bp, Homo sapiens
ttggcccccgagctggggg

SEQ ID NO: 3786811 - DNA, 14 bp, Homo sapiens
ttggctcaatcctc

SEQ ID NO: 3786812 - DNA, 18 bp, Homo sapiens
ttggctgggggcctcagt

SEQ ID NO: 3786813 - DNA, 21 bp, Homo sapiens
ttggctgtagaaggagacaga

SEQ ID NO: 3786814 - DNA, 23 bp, Homo sapiens
ttggcttcacggaagagccttgc

SEQ ID NO: 3786815 - DNA, 17 bp, Homo sapiens
ttgggagcttgggaatg

SEQ ID NO: 3786816 - DNA, 19 bp, Homo sapiens
ttgggagcttgggaatgga

SEQ ID NO: 3786817 - DNA, 12 bp, Homo sapiens
ttgggaggctga

SEQ ID NO: 3786818 - DNA, 17 bp, Homo sapiens
ttgggatgtcttatttt

SEQ ID NO: 3786819 - DNA, 13 bp, Homo sapiens
ttgggctgagact

SEQ ID NO: 3786820 - DNA, 22 bp, Homo sapiens
ttggggggctgaggtgggagga

SEQ ID NO: 3786821 - DNA, 17 bp, Homo sapiens
ttggggtacccactgct

SEQ ID NO: 3786822 - DNA, 22 bp, Homo sapiens
ttggggtacccactgctctggt

SEQ ID NO: 3786823 - DNA, 14 bp, Homo sapiens
ttgggtaggcggga

SEQ ID NO: 3786824 - DNA, 21 bp, Homo sapiens
ttgggtatcctgcccagtgtt

SEQ ID NO: 3786825 - DNA, 21 bp, Homo sapiens
ttgggtgtaacaggtctcctc

SEQ ID NO: 3786826 - DNA, 21 bp, Homo sapiens
ttgggttaaaaaaaaaaaaag

SEQ ID NO: 3786827 - DNA, 15 bp, Homo sapiens
ttggtaagcttccag

SEQ ID NO: 3786828 - DNA, 22 bp, Homo sapiens
ttggtatttatctattgtaaga

SEQ ID NO: 3786829 - DNA, 12 bp, Homo sapiens
ttggtcctcttg

SEQ ID NO: 3786830 - DNA, 17 bp, Homo sapiens
ttggtcctcttgccatc

SEQ ID NO: 3786831 - DNA, 15 bp, Homo sapiens
ttggtcttatttatt

SEQ ID NO: 3786832 - DNA, 16 bp, Homo sapiens
ttggtgcaacccttac

SEQ ID NO: 3786833 - DNA, 14 bp, Homo sapiens
ttggtgcctttcct

SEQ ID NO: 3786834 - DNA, 15 bp, Homo sapiens
ttggtggatgtaaat

SEQ ID NO: 3786835 - DNA, 16 bp, Homo sapiens
ttggtggatgtaaata

SEQ ID NO: 3786836 - DNA, 12 bp, Homo sapiens
ttggtggttttt

SEQ ID NO: 3786837 - DNA, 14 bp, Homo sapiens
ttggttatacatga

SEQ ID NO: 3786838 - DNA, 18 bp, Homo sapiens
ttggttatacatgacact

SEQ ID NO: 3786839 - DNA, 23 bp, Homo sapiens
ttggttatacatgacactgaaat

SEQ ID NO: 3786840 - DNA, 20 bp, Homo sapiens
ttggttcatcagtgttaaaa

SEQ ID NO: 3786841 - DNA, 14 bp, Homo sapiens
ttggttctggggcc

SEQ ID NO: 3786842 - DNA, 19 bp, Homo sapiens
ttggttttaattgaaggaa

SEQ ID NO: 3786843 - DNA, 20 bp, Homo sapiens
ttgtaaaaacagcattgctt

SEQ ID NO: 3786844 - DNA, 23 bp, Homo sapiens
ttgtaaaaacagcattgctttct

SEQ ID NO: 3786845 - DNA, 16 bp, Homo sapiens
ttgtaaacgtttcagt

SEQ ID NO: 3786846 - DNA, 16 bp, Homo sapiens
ttgtaaactcaaaata

SEQ ID NO: 3786847 - DNA, 13 bp, Homo sapiens
ttgtaaataagag

SEQ ID NO: 3786848 - DNA, 21 bp, Homo sapiens
ttgtaaataagagatttggag

SEQ ID NO: 3786849 - DNA, 17 bp, Homo sapiens
ttgtaaatagctcaggt

SEQ ID NO: 3786850 - DNA, 19 bp, Homo sapiens
ttgtaaatatttatgtaaa

SEQ ID NO: 3786851 - DNA, 21 bp, Homo sapiens
ttgtaaatgtggtaaagagtt

SEQ ID NO: 3786852 - DNA, 18 bp, Homo sapiens
ttgtaagacaaaggtttt

SEQ ID NO: 3786853 - DNA, 20 bp, Homo sapiens
ttgtaagagtggaaccaaca

SEQ ID NO: 3786854 - DNA, 15 bp, Homo sapiens
ttgtaagattttgaa

SEQ ID NO: 3786855 - DNA, 17 bp, Homo sapiens
ttgtaagattttgaaaa

SEQ ID NO: 3786856 - DNA, 20 bp, Homo sapiens
ttgtaatcgttatgtgtgta

SEQ ID NO: 3786857 - DNA, 14 bp, Homo sapiens
ttgtaattctaaat

SEQ ID NO: 3786858 - DNA, 22 bp, Homo sapiens
ttgtaattttcttgatgactgg

SEQ ID NO: 3786859 - DNA, 16 bp, Homo sapiens
ttgtacatagttattt

SEQ ID NO: 3786860 - DNA, 18 bp, Homo sapiens
ttgtacatatgtaaaata

SEQ ID NO: 3786861 - DNA, 11 bp, Homo sapiens
ttgtacctctc

SEQ ID NO: 3786862 - DNA, 17 bp, Homo sapiens
ttgtacgtttaaagtgt

SEQ ID NO: 3786863 - DNA, 22 bp, Homo sapiens
ttgtagaagggttatattttac

SEQ ID NO: 3786864 - DNA, 11 bp, Homo sapiens
aaaaaaacttt

SEQ ID NO: 3786865 - DNA, 12 bp, Homo sapiens
aaaaaaataata

SEQ ID NO: 3786866 - DNA, 13 bp, Homo sapiens
aaaaaaatgacta

SEQ ID NO: 3786867 - DNA, 12 bp, Homo sapiens
aaaaaagaatgt

SEQ ID NO: 3786868 - DNA, 14 bp, Homo sapiens
aaaaaatgctcaca

SEQ ID NO: 3786869 - DNA, 22 bp, Homo sapiens
aaaaaattagaaattggctgga

SEQ ID NO: 3786870 - DNA, 11 bp, Homo sapiens
aaaaaattttg

SEQ ID NO: 3786871 - DNA, 19 bp, Homo sapiens
aaaaaattttgtaattttc

SEQ ID NO: 3786872 - DNA, 15 bp, Homo sapiens
aaaaacagcattgct

SEQ ID NO: 3786873 - DNA, 12 bp, Homo sapiens
aaaaacttttat

SEQ ID NO: 3786874 - DNA, 21 bp, Homo sapiens
aaaaagaatctgcatttagca

SEQ ID NO: 3786875 - DNA, 22 bp, Homo sapiens
aaaaagatggcctttgcttatg

SEQ ID NO: 3786876 - DNA, 21 bp, Homo sapiens
aaaaagcagctaccaggtgtt

SEQ ID NO: 3786877 - DNA, 13 bp, Homo sapiens
aaaaagctggtgg

SEQ ID NO: 3786878 - DNA, 22 bp, Homo sapiens
aaaaagctggtgggtgaaagaa

SEQ ID NO: 3786879 - DNA, 13 bp, Homo sapiens
aaaaagcttcccc

SEQ ID NO: 3786880 - DNA, 14 bp, Homo sapiens
aaaaaggaggaaga

SEQ ID NO: 3786881 - DNA, 21 bp, Homo sapiens
aaaaagtctctatttaaattc

SEQ ID NO: 3786882 - DNA, 17 bp, Homo sapiens
aaaaataataaattgca

SEQ ID NO: 3786883 - DNA, 14 bp, Homo sapiens
aaaaatacatttta

SEQ ID NO: 3786884 - DNA, 14 bp, Homo sapiens
aaaaatactctaat

SEQ ID NO: 3786885 - DNA, 19 bp, Homo sapiens
aaaaatactctaattctaa

SEQ ID NO: 3786886 - DNA, 16 bp, Homo sapiens
aaaaatattataactt

SEQ ID NO: 3786887 - DNA, 15 bp, Homo sapiens
aaaaatccttctaat

SEQ ID NO: 3786888 - DNA, 16 bp, Homo sapiens
aaaaatccttctaatc

SEQ ID NO: 3786889 - DNA, 17 bp, Homo sapiens
aaaaatccttctaatct

SEQ ID NO: 3786890 - DNA, 10 bp, Homo sapiens
aaaaatgaaa

SEQ ID NO: 3786891 - DNA, 12 bp, Homo sapiens
aaaaatgaaagc

SEQ ID NO: 3786892 - DNA, 17 bp, Homo sapiens
aaaaatgacagatgttg

SEQ ID NO: 3786893 - DNA, 12 bp, Homo sapiens
aaaaatgagaac

SEQ ID NO: 3786894 - DNA, 17 bp, Homo sapiens
aaaaatgagaacatgtt

SEQ ID NO: 3786895 - DNA, 21 bp, Homo sapiens
aaaaatgagaacatgttggta

SEQ ID NO: 3786896 - DNA, 18 bp, Homo sapiens
aaaaatgcccttaaatca

SEQ ID NO: 3786897 - DNA, 13 bp, Homo sapiens
aaaaatggtaatt

SEQ ID NO: 3786898 - DNA, 22 bp, Homo sapiens
aaaaatgtcttgggtaggcggg

SEQ ID NO: 3786899 - DNA, 13 bp, Homo sapiens
aaaaattagctga

SEQ ID NO: 3786900 - DNA, 15 bp, Homo sapiens
aaaaatttaagcatt

SEQ ID NO: 3786901 - DNA, 22 bp, Homo sapiens
aaaaattttataaaattaagca

SEQ ID NO: 3786902 - DNA, 14 bp, Homo sapiens
aaaaattttgtaat

SEQ ID NO: 3786903 - DNA, 19 bp, Homo sapiens
aaaaattttgtaattttct

SEQ ID NO: 3786904 - DNA, 14 bp, Homo sapiens
aaaacaaaaaacaa

SEQ ID NO: 3786905 - DNA, 17 bp, Homo sapiens
aaaacaagaaagtttcc

SEQ ID NO: 3786906 - DNA, 17 bp, Homo sapiens
aaaacaatatttattgt

SEQ ID NO: 3786907 - DNA, 13 bp, Homo sapiens
aaaacaatgaaga

SEQ ID NO: 3786908 - DNA, 16 bp, Homo sapiens
aaaacagaaaaaaaac

SEQ ID NO: 3786909 - DNA, 20 bp, Homo sapiens
aaaacagtccttcaaacttc

SEQ ID NO: 3786910 - DNA, 17 bp, Homo sapiens
aaaacataaaaagttaa

SEQ ID NO: 3786911 - DNA, 16 bp, Homo sapiens
aaaacatccagataca

SEQ ID NO: 3786912 - DNA, 21 bp, Homo sapiens
aaaacatccagatacacccaa

SEQ ID NO: 3786913 - DNA, 14 bp, Homo sapiens
aaaacatggtagaa

SEQ ID NO: 3786914 - DNA, 22 bp, Homo sapiens
aaaacattccgtttacatttta

SEQ ID NO: 3786915 - DNA, 21 bp, Homo sapiens
aaaaccaatgttctctcttct

SEQ ID NO: 3786916 - DNA, 19 bp, Homo sapiens
aaaaccacagccctgtcag

SEQ ID NO: 3786917 - DNA, 14 bp, Homo sapiens
aaaaccattgcttc

SEQ ID NO: 3786918 - DNA, 13 bp, Homo sapiens
aaaacccagagag

SEQ ID NO: 3786919 - DNA, 15 bp, Homo sapiens
aaaacccagagagga

SEQ ID NO: 3786920 - DNA, 17 bp, Homo sapiens
aaaacccattgtcttta

SEQ ID NO: 3786921 - DNA, 20 bp, Homo sapiens
aaaacctttcaaatttcaca

SEQ ID NO: 3786922 - DNA, 13 bp, Homo sapiens
aaaacgcatggag

SEQ ID NO: 3786923 - DNA, 17 bp, Homo sapiens
aaaacgcatggagtgtg

SEQ ID NO: 3786924 - DNA, 16 bp, Homo sapiens
aaaacggttaaaactg

SEQ ID NO: 3786925 - DNA, 19 bp, Homo sapiens
aaaacgttttattgtgttt

SEQ ID NO: 3786926 - DNA, 23 bp, Homo sapiens
aaaacgttttgtttgaaaaagca

SEQ ID NO: 3786927 - DNA, 20 bp, Homo sapiens
aaaactgctgactgttttct

SEQ ID NO: 3786928 - DNA, 22 bp, Homo sapiens
aaaactgctgactgttttctct

SEQ ID NO: 3786929 - DNA, 22 bp, Homo sapiens
aaaacttgatgtgttatctctt

SEQ ID NO: 3786930 - DNA, 12 bp, Homo sapiens
aaaactttattt

SEQ ID NO: 3786931 - DNA, 16 bp, Homo sapiens
aaaactttattttata

SEQ ID NO: 3786932 - DNA, 23 bp, Homo sapiens
aaaactttattttatataataaa

SEQ ID NO: 3786933 - DNA, 15 bp, Homo sapiens
aaaagaaatgcacaa

SEQ ID NO: 3786934 - DNA, 21 bp, Homo sapiens
aaaagaatctgcatttagcac

SEQ ID NO: 3786935 - DNA, 20 bp, Homo sapiens
aaaagacacacttgtccaca

SEQ ID NO: 3786936 - DNA, 20 bp, Homo sapiens
aaaagatacgactttatttt

SEQ ID NO: 3786937 - DNA, 18 bp, Homo sapiens
aaaagatggcctttgctt

SEQ ID NO: 3786938 - DNA, 14 bp, Homo sapiens
aaaagccatcatgt

SEQ ID NO: 3786939 - DNA, 20 bp, Homo sapiens
aaaagccatcatgtaaatta

SEQ ID NO: 3786940 - DNA, 20 bp, Homo sapiens
aaaagccatgtttaagattt

SEQ ID NO: 3786941 - DNA, 21 bp, Homo sapiens
aaaagccatgtttaagattta

SEQ ID NO: 3786942 - DNA, 14 bp, Homo sapiens
aaaagctgggcagg

SEQ ID NO: 3786943 - DNA, 22 bp, Homo sapiens
aaaaggagccaatttaaagaaa

SEQ ID NO: 3786944 - DNA, 11 bp, Homo sapiens
aaaaggcagga

SEQ ID NO: 3786945 - DNA, 15 bp, Homo sapiens
aaaagggaacaggaa

SEQ ID NO: 3786946 - DNA, 19 bp, Homo sapiens
aaaaggtatgcaatcaaat

SEQ ID NO: 3786947 - DNA, 22 bp, Homo sapiens
aaaaggtgcctgtgaggcaggg

SEQ ID NO: 3786948 - DNA, 13 bp, Homo sapiens
aaaagtatatgtt

SEQ ID NO: 3786949 - DNA, 15 bp, Homo sapiens
aaaagtctctattta

SEQ ID NO: 3786950 - DNA, 19 bp, Homo sapiens
aaaagtctctatttaaatt

SEQ ID NO: 3786951 - DNA, 23 bp, Homo sapiens
aaaagtctctatttaaattcttt

SEQ ID NO: 3786952 - DNA, 12 bp, Homo sapiens
aaaagtctgatt

SEQ ID NO: 3786953 - DNA, 23 bp, Homo sapiens
aaaagtcttcaagggctgcttca

SEQ ID NO: 3786954 - DNA, 19 bp, Homo sapiens
aaaagtggcaagaccaaaa

SEQ ID NO: 3786955 - DNA, 12 bp, Homo sapiens
aaaagttattaa

SEQ ID NO: 3786956 - DNA, 20 bp, Homo sapiens
aaaagtttaaaatgtataag

SEQ ID NO: 3786957 - DNA, 17 bp, Homo sapiens
aaaagtttgccagaagt

SEQ ID NO: 3786958 - DNA, 12 bp, Homo sapiens
aaaataaataaa

SEQ ID NO: 3786959 - DNA, 14 bp, Homo sapiens
aaaataacacacat

SEQ ID NO: 3786960 - DNA, 16 bp, Homo sapiens
aaaataacttcaagca

SEQ ID NO: 3786961 - DNA, 13 bp, Homo sapiens
aaaataatgtctt

SEQ ID NO: 3786962 - DNA, 20 bp, Homo sapiens
aaaataatgtcttgttaata

SEQ ID NO: 3786963 - DNA, 22 bp, Homo sapiens
aaaataattgatttcaagacct

SEQ ID NO: 3786964 - DNA, 19 bp, Homo sapiens
aaaataattttaaacaaag

SEQ ID NO: 3786965 - DNA, 14 bp, Homo sapiens
aaaatacaataaac

SEQ ID NO: 3786966 - DNA, 16 bp, Homo sapiens
aaaatactctaattct

SEQ ID NO: 3786967 - DNA, 18 bp, Homo sapiens
aaaatactctaattctaa

SEQ ID NO: 3786968 - DNA, 20 bp, Homo sapiens
aaaatactctaattctaacc

SEQ ID NO: 3786969 - DNA, 14 bp, Homo sapiens
aaaatagaagaata

SEQ ID NO: 3786970 - DNA, 21 bp, Homo sapiens
aaaatagcaacactctatatt

SEQ ID NO: 3786971 - DNA, 20 bp, Homo sapiens
aaatgtgtatcggatgcttt

SEQ ID NO: 3786972 - DNA, 13 bp, Homo sapiens
aaatgtgtatttt

SEQ ID NO: 3786973 - DNA, 19 bp, Homo sapiens
aaatgttttgtaagaaacc

SEQ ID NO: 3786974 - DNA, 16 bp, Homo sapiens
aaatgtttttctgcca

SEQ ID NO: 3786975 - DNA, 15 bp, Homo sapiens
aaattaaacaattta

SEQ ID NO: 3786976 - DNA, 13 bp, Homo sapiens
aaattaaagaaaa

SEQ ID NO: 3786977 - DNA, 21 bp, Homo sapiens
aaattaacactgcttgtgttt

SEQ ID NO: 3786978 - DNA, 13 bp, Homo sapiens
aaattaagaatgt

SEQ ID NO: 3786979 - DNA, 23 bp, Homo sapiens
aaattaaggcaactgaacaaaaa

SEQ ID NO: 3786980 - DNA, 22 bp, Homo sapiens
aaattacacccaaagaggtatt

SEQ ID NO: 3786981 - DNA, 14 bp, Homo sapiens
aaattacagcttca

SEQ ID NO: 3786982 - DNA, 18 bp, Homo sapiens
aaattaccagtaaagtgt

SEQ ID NO: 3786983 - DNA, 20 bp, Homo sapiens
aaattaccagtaaagtgtaa

SEQ ID NO: 3786984 - DNA, 15 bp, Homo sapiens
aaattagccgggcgt

SEQ ID NO: 3786985 - DNA, 18 bp, Homo sapiens
aaattagctgtgtgaaat

SEQ ID NO: 3786986 - DNA, 19 bp, Homo sapiens
aaattagctgtgtgaaata

SEQ ID NO: 3786987 - DNA, 19 bp, Homo sapiens
aaattaggatttcatgatt

SEQ ID NO: 3786988 - DNA, 19 bp, Homo sapiens
aaattaggttttgtacaat

SEQ ID NO: 3786989 - DNA, 17 bp, Homo sapiens
aaattataacttaaaat

SEQ ID NO: 3786990 - DNA, 12 bp, Homo sapiens
aaattataagga

SEQ ID NO: 3786991 - DNA, 13 bp, Homo sapiens
aaattatctattt

SEQ ID NO: 3786992 - DNA, 20 bp, Homo sapiens
aaattatgttacatctgttt

SEQ ID NO: 3786993 - DNA, 23 bp, Homo sapiens
aaattattcagttaagaaaaaaa

SEQ ID NO: 3786994 - DNA, 15 bp, Homo sapiens
aaattattttaaatt

SEQ ID NO: 3786995 - DNA, 18 bp, Homo sapiens
aaattcacaagttgtgtt

SEQ ID NO: 3786996 - DNA, 21 bp, Homo sapiens
aaattccagaaaggatattta

SEQ ID NO: 3786997 - DNA, 16 bp, Homo sapiens
aaattccccaccctga

SEQ ID NO: 3786998 - DNA, 22 bp, Homo sapiens
aaattctaaataaaatataatt

SEQ ID NO: 3786999 - DNA, 22 bp, Homo sapiens
aaattctataggaacatatgaa

SEQ ID NO: 3787000 - DNA, 20 bp, Homo sapiens
aaattctcagtcagtaattg

SEQ ID NO: 3787001 - DNA, 14 bp, Homo sapiens
aaattctgtttctt

SEQ ID NO: 3787002 - DNA, 23 bp, Homo sapiens
aaattcttttttaaattttcttc

SEQ ID NO: 3787003 - DNA, 22 bp, Homo sapiens
aaattgaaaggcattctctgaa

SEQ ID NO: 3787004 - DNA, 13 bp, Homo sapiens
aaattgagagaat

SEQ ID NO: 3787005 - DNA, 22 bp, Homo sapiens
aaattgcatgggttttgtaggt

SEQ ID NO: 3787006 - DNA, 18 bp, Homo sapiens
aaattggattagcctgga

SEQ ID NO: 3787007 - DNA, 14 bp, Homo sapiens
aaattggcattaaa

SEQ ID NO: 3787008 - DNA, 18 bp, Homo sapiens
aaattggcattaaaactt

SEQ ID NO: 3787009 - DNA, 23 bp, Homo sapiens
aaatttaaaagacactgtttaca

SEQ ID NO: 3787010 - DNA, 17 bp, Homo sapiens
aaatttaattcatgttt

SEQ ID NO: 3787011 - DNA, 19 bp, Homo sapiens
aaatttataattttaagat

SEQ ID NO: 3787012 - DNA, 21 bp, Homo sapiens
aaatttataattttaagattc

SEQ ID NO: 3787013 - DNA, 12 bp, Homo sapiens
aaatttcagatt

SEQ ID NO: 3787014 - DNA, 16 bp, Homo sapiens
aaatttccagtacctt

SEQ ID NO: 3787015 - DNA, 10 bp, Homo sapiens
aaatttgaat

SEQ ID NO: 3787016 - DNA, 14 bp, Homo sapiens
aaattttaatttat

SEQ ID NO: 3787017 - DNA, 12 bp, Homo sapiens
aaattttattcc

SEQ ID NO: 3787018 - DNA, 17 bp, Homo sapiens
aaattttgcctaataca

SEQ ID NO: 3787019 - DNA, 17 bp, Homo sapiens
aaatttttcagatgctt

SEQ ID NO: 3787020 - DNA, 20 bp, Homo sapiens
aaatttttcagatgcttctg

SEQ ID NO: 3787021 - DNA, 13 bp, Homo sapiens
aaatttttgaaaa

SEQ ID NO: 3787022 - DNA, 15 bp, Homo sapiens
aaatttttggattga

SEQ ID NO: 3787023 - DNA, 15 bp, Homo sapiens
aacaaaaaacaatat

SEQ ID NO: 3787024 - DNA, 19 bp, Homo sapiens
aacaaaaacactaaaaata

SEQ ID NO: 3787025 - DNA, 14 bp, Homo sapiens
aacaaaaagcttcc

SEQ ID NO: 3787026 - DNA, 14 bp, Homo sapiens
aacaaaaatttgaa

SEQ ID NO: 3787027 - DNA, 17 bp, Homo sapiens
aacaaactgtgtaactg

SEQ ID NO: 3787028 - DNA, 20 bp, Homo sapiens
aacaaactgtgtaactgccc

SEQ ID NO: 3787029 - DNA, 17 bp, Homo sapiens
aacaaagaagacaacat

SEQ ID NO: 3787030 - DNA, 14 bp, Homo sapiens
aacaaagccagaag

SEQ ID NO: 3787031 - DNA, 17 bp, Homo sapiens
aacaaagccagaagctg

SEQ ID NO: 3787032 - DNA, 13 bp, Homo sapiens
aacaacatgtata

SEQ ID NO: 3787033 - DNA, 12 bp, Homo sapiens
aacaagaaaaca

SEQ ID NO: 3787034 - DNA, 16 bp, Homo sapiens
aacaagaaaggagagt

SEQ ID NO: 3787035 - DNA, 14 bp, Homo sapiens
aacaagctaggtgc

SEQ ID NO: 3787036 - DNA, 19 bp, Homo sapiens
aacaagctaggtgctaatt

SEQ ID NO: 3787037 - DNA, 20 bp, Homo sapiens
aacaaggaatgcctgtgcca

SEQ ID NO: 3787038 - DNA, 14 bp, Homo sapiens
aacaagggcagtgg

SEQ ID NO: 3787039 - DNA, 19 bp, Homo sapiens
aacaagggtggcatcccag

SEQ ID NO: 3787040 - DNA, 16 bp, Homo sapiens
aacaaggtagttttta

SEQ ID NO: 3787041 - DNA, 16 bp, Homo sapiens
aacaatgcgaatggta

SEQ ID NO: 3787042 - DNA, 21 bp, Homo sapiens
aacaatgtcaaggtgctgttg

SEQ ID NO: 3787043 - DNA, 22 bp, Homo sapiens
aacaatgtcaaggtgctgttgt

SEQ ID NO: 3787044 - DNA, 22 bp, Homo sapiens
aacaatttattttattttagca

SEQ ID NO: 3787045 - DNA, 14 bp, Homo sapiens
aacaattttctgca

SEQ ID NO: 3787046 - DNA, 19 bp, Homo sapiens
aacacaaacgggctcagca

SEQ ID NO: 3787047 - DNA, 23 bp, Homo sapiens
aacacaagtagatgcctgaactt

SEQ ID NO: 3787048 - DNA, 21 bp, Homo sapiens
aacacacacacacacaacaaa

SEQ ID NO: 3787049 - DNA, 15 bp, Homo sapiens
aacacaccaggctgt

SEQ ID NO: 3787050 - DNA, 19 bp, Homo sapiens
aacacactgaggcagggaa

SEQ ID NO: 3787051 - DNA, 18 bp, Homo sapiens
aacacagcatgtgtattt

SEQ ID NO: 3787052 - DNA, 14 bp, Homo sapiens
aacacagtattttc

SEQ ID NO: 3787053 - DNA, 18 bp, Homo sapiens
aacacatagattcacctg

SEQ ID NO: 3787054 - DNA, 22 bp, Homo sapiens
aacacatagattcacctgtaaa

SEQ ID NO: 3787055 - DNA, 21 bp, Homo sapiens
aacacattaagccttccacac

SEQ ID NO: 3787056 - DNA, 19 bp, Homo sapiens
aacacatttttaaagcttt

SEQ ID NO: 3787057 - DNA, 23 bp, Homo sapiens
aacacatttttaaagctttcccc

SEQ ID NO: 3787058 - DNA, 16 bp, Homo sapiens
aacacctagatcagaa

SEQ ID NO: 3787059 - DNA, 14 bp, Homo sapiens
aacactaaaaataa

SEQ ID NO: 3787060 - DNA, 15 bp, Homo sapiens
aacactaaaaataaa

SEQ ID NO: 3787061 - DNA, 18 bp, Homo sapiens
aacactaacatataatgt

SEQ ID NO: 3787062 - DNA, 15 bp, Homo sapiens
aacactataaaggtt

SEQ ID NO: 3787063 - DNA, 14 bp, Homo sapiens
aacactatatggca

SEQ ID NO: 3787064 - DNA, 12 bp, Homo sapiens
aacactattttc

SEQ ID NO: 3787065 - DNA, 18 bp, Homo sapiens
aacactattttcagaatc

SEQ ID NO: 3787066 - DNA, 19 bp, Homo sapiens
aacactattttcagaatct

SEQ ID NO: 3787067 - DNA, 21 bp, Homo sapiens
aacactcacatttattctgct

SEQ ID NO: 3787068 - DNA, 13 bp, Homo sapiens
aacactggcccct

SEQ ID NO: 3787069 - DNA, 11 bp, Homo sapiens
aacacttccat

SEQ ID NO: 3787070 - DNA, 15 bp, Homo sapiens
aacagaaaaaaaaca

SEQ ID NO: 3787071 - DNA, 16 bp, Homo sapiens
aacagaaaaaaaacac

SEQ ID NO: 3787072 - DNA, 17 bp, Homo sapiens
aacagaaaaaaaacaca

SEQ ID NO: 3787073 - DNA, 14 bp, Homo sapiens
aacagaaaacaaca

SEQ ID NO: 3787074 - DNA, 14 bp, Homo sapiens
aacagaagcttcca

SEQ ID NO: 3787075 - DNA, 18 bp, Homo sapiens
aacagacaaaaacagcct

SEQ ID NO: 3787076 - DNA, 15 bp, Homo sapiens
aacagacaggagaaa

SEQ ID NO: 3787077 - DNA, 19 bp, Homo sapiens
aacagaccccctctagaaa

SEQ ID NO: 3787078 - DNA, 13 bp, Homo sapiens
aacagagaaggca

SEQ ID NO: 3787079 - DNA, 21 bp, Homo sapiens
aacagatgcaatgtgctactg

SEQ ID NO: 3787080 - DNA, 13 bp, Homo sapiens
aacagcaggccca

SEQ ID NO: 3787081 - DNA, 17 bp, Homo sapiens
aacagcaggcccaccta

SEQ ID NO: 3787082 - DNA, 13 bp, Homo sapiens
aacagccgagtgg

SEQ ID NO: 3787083 - DNA, 23 bp, Homo sapiens
aacagccgagtggatagatgccc

SEQ ID NO: 3787084 - DNA, 18 bp, Homo sapiens
aagccaccctcccagctc

SEQ ID NO: 3787085 - DNA, 21 bp, Homo sapiens
aagccaccctcccagctctga

SEQ ID NO: 3787086 - DNA, 14 bp, Homo sapiens
aagccagaagctga

SEQ ID NO: 3787087 - DNA, 21 bp, Homo sapiens
aagccagctgcagctgggctg

SEQ ID NO: 3787088 - DNA, 23 bp, Homo sapiens
aagccagggatggggccacagcc

SEQ ID NO: 3787089 - DNA, 18 bp, Homo sapiens
aagccataattgttctta

SEQ ID NO: 3787090 - DNA, 12 bp, Homo sapiens
aagccatgttta

SEQ ID NO: 3787091 - DNA, 17 bp, Homo sapiens
aagccatgtttaagatt

SEQ ID NO: 3787092 - DNA, 19 bp, Homo sapiens
aagccatgtttaagattta

SEQ ID NO: 3787093 - DNA, 16 bp, Homo sapiens
aagcccaacctcctga

SEQ ID NO: 3787094 - DNA, 17 bp, Homo sapiens
aagcccaacctcctgac

SEQ ID NO: 3787095 - DNA, 18 bp, Homo sapiens
aagcccaatattataatt

SEQ ID NO: 3787096 - DNA, 14 bp, Homo sapiens
aagcccagctccag

SEQ ID NO: 3787097 - DNA, 16 bp, Homo sapiens
aagcccattcctctgc

SEQ ID NO: 3787098 - DNA, 20 bp, Homo sapiens
aagcccattcctctgccagg

SEQ ID NO: 3787099 - DNA, 14 bp, Homo sapiens
aagccccaggcagg

SEQ ID NO: 3787100 - DNA, 12 bp, Homo sapiens
aagccccatcct

SEQ ID NO: 3787101 - DNA, 9 bp, Homo sapiens
aagccctcc

SEQ ID NO: 3787102 - DNA, 11 bp, Homo sapiens
aagccctcctt

SEQ ID NO: 3787103 - DNA, 20 bp, Homo sapiens
aagcccttccatgtcgcctc

SEQ ID NO: 3787104 - DNA, 15 bp, Homo sapiens
aagccgccaggaccg

SEQ ID NO: 3787105 - DNA, 20 bp, Homo sapiens
aagcctagaagagcttctga

SEQ ID NO: 3787106 - DNA, 22 bp, Homo sapiens
aagcctcaactagtcatttttt

SEQ ID NO: 3787107 - DNA, 23 bp, Homo sapiens
aagcctctggctagaggccagcc

SEQ ID NO: 3787108 - DNA, 14 bp, Homo sapiens
aagcctgcaggagt

SEQ ID NO: 3787109 - DNA, 16 bp, Homo sapiens
aagccttccacactca

SEQ ID NO: 3787110 - DNA, 18 bp, Homo sapiens
aagcgaggtcaacagaga

SEQ ID NO: 3787111 - DNA, 16 bp, Homo sapiens
aagcgattcttctgct

SEQ ID NO: 3787112 - DNA, 21 bp, Homo sapiens
aagcgattcttctgcttcagc

SEQ ID NO: 3787113 - DNA, 15 bp, Homo sapiens
aagcgtgagccactg

SEQ ID NO: 3787114 - DNA, 20 bp, Homo sapiens
aagcgtgagccactgcaccg

SEQ ID NO: 3787115 - DNA, 21 bp, Homo sapiens
aagcgtgagccactgcaccgg

SEQ ID NO: 3787116 - DNA, 11 bp, Homo sapiens
aagctaaagag

SEQ ID NO: 3787117 - DNA, 21 bp, Homo sapiens
aagctaataaaatatcattca

SEQ ID NO: 3787118 - DNA, 12 bp, Homo sapiens
aagctaggcctg

SEQ ID NO: 3787119 - DNA, 22 bp, Homo sapiens
aagctagggtggcccttgcagt

SEQ ID NO: 3787120 - DNA, 23 bp, Homo sapiens
aagctcacagttcctcgccctgg

SEQ ID NO: 3787121 - DNA, 15 bp, Homo sapiens
aagctcagcccaccc

SEQ ID NO: 3787122 - DNA, 19 bp, Homo sapiens
aagctccagtcctgctctc

SEQ ID NO: 3787123 - DNA, 23 bp, Homo sapiens
aagctcctggtatgggtttctcc

SEQ ID NO: 3787124 - DNA, 19 bp, Homo sapiens
aagctcttgaagacactga

SEQ ID NO: 3787125 - DNA, 21 bp, Homo sapiens
aagctcttgaagacactgaaa

SEQ ID NO: 3787126 - DNA, 16 bp, Homo sapiens
aagctctttgaaacaa

SEQ ID NO: 3787127 - DNA, 13 bp, Homo sapiens
aagctgcaccctc

SEQ ID NO: 3787128 - DNA, 19 bp, Homo sapiens
aagctgcaccctcaggcag

SEQ ID NO: 3787129 - DNA, 20 bp, Homo sapiens
aagctgcaccctcaggcagg

SEQ ID NO: 3787130 - DNA, 19 bp, Homo sapiens
aagctgcctccctgtccac

SEQ ID NO: 3787131 - DNA, 22 bp, Homo sapiens
aagctgcctccctgtccacccc

SEQ ID NO: 3787132 - DNA, 19 bp, Homo sapiens
aagctgcctgtagttagga

SEQ ID NO: 3787133 - DNA, 21 bp, Homo sapiens
aagctgcctgtagttaggaaa

SEQ ID NO: 3787134 - DNA, 15 bp, Homo sapiens
aagctgctaaatctc

SEQ ID NO: 3787135 - DNA, 14 bp, Homo sapiens
aagctgctgacagt

SEQ ID NO: 3787136 - DNA, 21 bp, Homo sapiens
aagctgctttaaaaaaataca

SEQ ID NO: 3787137 - DNA, 11 bp, Homo sapiens
aagctgctttt

SEQ ID NO: 3787138 - DNA, 22 bp, Homo sapiens
aagctggccgagggtcctggct

SEQ ID NO: 3787139 - DNA, 21 bp, Homo sapiens
aagctggtcccactcagtcca

SEQ ID NO: 3787140 - DNA, 17 bp, Homo sapiens
aagctgtgaccctcaat

SEQ ID NO: 3787141 - DNA, 13 bp, Homo sapiens
aagctgtggccag

SEQ ID NO: 3787142 - DNA, 12 bp, Homo sapiens
aagctgtgtcct

SEQ ID NO: 3787143 - DNA, 20 bp, Homo sapiens
aagctgtgtccttgcacctg

SEQ ID NO: 3787144 - DNA, 22 bp, Homo sapiens
aagctgtgtccttgcacctgca

SEQ ID NO: 3787145 - DNA, 14 bp, Homo sapiens
aagcttagtataaa

SEQ ID NO: 3787146 - DNA, 18 bp, Homo sapiens
aagcttattaatgctaag

SEQ ID NO: 3787147 - DNA, 14 bp, Homo sapiens
aagcttatttaatt

SEQ ID NO: 3787148 - DNA, 18 bp, Homo sapiens
aagcttcaaactgcatga

SEQ ID NO: 3787149 - DNA, 23 bp, Homo sapiens
aagcttcctttgtttttttttcc

SEQ ID NO: 3787150 - DNA, 21 bp, Homo sapiens
aagcttggctgtagaaggaga

SEQ ID NO: 3787151 - DNA, 19 bp, Homo sapiens
aagctttctctgcttcagc

SEQ ID NO: 3787152 - DNA, 16 bp, Homo sapiens
aagctttgatttagat

SEQ ID NO: 3787153 - DNA, 22 bp, Homo sapiens
aaggaagatcactttgctctga

SEQ ID NO: 3787154 - DNA, 22 bp, Homo sapiens
aaggaagccacagctggtggta

SEQ ID NO: 3787155 - DNA, 17 bp, Homo sapiens
aaggaatgcctgtgcca

SEQ ID NO: 3787156 - DNA, 16 bp, Homo sapiens
aaggaattatcaatta

SEQ ID NO: 3787157 - DNA, 17 bp, Homo sapiens
aaggacaaagtctccag

SEQ ID NO: 3787158 - DNA, 20 bp, Homo sapiens
aaggacaggcagaaagagtt

SEQ ID NO: 3787159 - DNA, 13 bp, Homo sapiens
aaggacaggcagg

SEQ ID NO: 3787160 - DNA, 18 bp, Homo sapiens
aaggacattgcggacagc

SEQ ID NO: 3787161 - DNA, 12 bp, Homo sapiens
aaggaccaggac

SEQ ID NO: 3787162 - DNA, 21 bp, Homo sapiens
aaggacccggaggggcctggc

SEQ ID NO: 3787163 - DNA, 22 bp, Homo sapiens
aaggacccggaggggcctggca

SEQ ID NO: 3787164 - DNA, 17 bp, Homo sapiens
aaggacctatgtttgct

SEQ ID NO: 3787165 - DNA, 18 bp, Homo sapiens
aaggactggattggccaa

SEQ ID NO: 3787166 - DNA, 18 bp, Homo sapiens
aaggagatgtaagagctt

SEQ ID NO: 3787167 - DNA, 17 bp, Homo sapiens
aaggagctgagaataga

SEQ ID NO: 3787168 - DNA, 23 bp, Homo sapiens
aaggagctgagaatagaaggaaa

SEQ ID NO: 3787169 - DNA, 21 bp, Homo sapiens
aaggagcttacctcccacctt

SEQ ID NO: 3787170 - DNA, 11 bp, Homo sapiens
aaggaggaaaa

SEQ ID NO: 3787171 - DNA, 15 bp, Homo sapiens
aaggaggagagggaa

SEQ ID NO: 3787172 - DNA, 14 bp, Homo sapiens
aaggaggctggcag

SEQ ID NO: 3787173 - DNA, 15 bp, Homo sapiens
aaggagggagatgga

SEQ ID NO: 3787174 - DNA, 13 bp, Homo sapiens
aaggagtagaaaa

SEQ ID NO: 3787175 - DNA, 22 bp, Homo sapiens
aaggataaacttttagaaactt

SEQ ID NO: 3787176 - DNA, 20 bp, Homo sapiens
aaggatagtgcgatgtttca

SEQ ID NO: 3787177 - DNA, 17 bp, Homo sapiens
aaggatatttaagaaaa

SEQ ID NO: 3787178 - DNA, 18 bp, Homo sapiens
aaggatatttaagaaaat

SEQ ID NO: 3787179 - DNA, 23 bp, Homo sapiens
aaggatatttaagaaaatacaat

SEQ ID NO: 3787180 - DNA, 17 bp, Homo sapiens
aaggatgtaaacagtgc

SEQ ID NO: 3787181 - DNA, 20 bp, Homo sapiens
aaggcaaagcacgaaatgtt

SEQ ID NO: 3787182 - DNA, 21 bp, Homo sapiens
aaggcaactgaacaaaaaaat

SEQ ID NO: 3787183 - DNA, 19 bp, Homo sapiens
aaggcacccacaaataaat

SEQ ID NO: 3787184 - DNA, 13 bp, Homo sapiens
aaggcagcaggcg

SEQ ID NO: 3787185 - DNA, 21 bp, Homo sapiens
aaggcatgatgttaaccagaa

SEQ ID NO: 3787186 - DNA, 21 bp, Homo sapiens
aaggcatgcctggacaaaccc

SEQ ID NO: 3787187 - DNA, 14 bp, Homo sapiens
aaggcattctctga

SEQ ID NO: 3787188 - DNA, 20 bp, Homo sapiens
aaggccagagtggcctggcc

SEQ ID NO: 3787189 - DNA, 19 bp, Homo sapiens
aaggccagcaaggtggagt

SEQ ID NO: 3787190 - DNA, 19 bp, Homo sapiens
aaggccagctggcagcaga

SEQ ID NO: 3787191 - DNA, 15 bp, Homo sapiens
aaggccccagagact

SEQ ID NO: 3787192 - DNA, 22 bp, Homo sapiens
aaggccgaagaagggtccttcc

SEQ ID NO: 3787193 - DNA, 22 bp, Homo sapiens
aaggccgctgttcacccacagg

SEQ ID NO: 3787194 - DNA, 16 bp, Homo sapiens
aaggcctcttccttgc

SEQ ID NO: 3787195 - DNA, 23 bp, Homo sapiens
aaggcctgtccctggccatctct

SEQ ID NO: 3787196 - DNA, 21 bp, Homo sapiens
aatccgaccactaattgccaa

SEQ ID NO: 3787197 - DNA, 23 bp, Homo sapiens
aatcctgtgtggtttagtgtaaa

SEQ ID NO: 3787198 - DNA, 20 bp, Homo sapiens
aatcctgttgaaaagccatg

SEQ ID NO: 3787199 - DNA, 22 bp, Homo sapiens
aatcctgttgaaaagccatgtt

SEQ ID NO: 3787200 - DNA, 13 bp, Homo sapiens
aatccttgcttat

SEQ ID NO: 3787201 - DNA, 17 bp, Homo sapiens
aatccttgcttatgaca

SEQ ID NO: 3787202 - DNA, 18 bp, Homo sapiens
aatcgaggaaccagagcc

SEQ ID NO: 3787203 - DNA, 19 bp, Homo sapiens
aatcgaggaaccagagcca

SEQ ID NO: 3787204 - DNA, 23 bp, Homo sapiens
aatcgctccaccttgcagctctc

SEQ ID NO: 3787205 - DNA, 21 bp, Homo sapiens
aatcggatctggggctctggg

SEQ ID NO: 3787206 - DNA, 23 bp, Homo sapiens
aatcggatctggggctctgggat

SEQ ID NO: 3787207 - DNA, 18 bp, Homo sapiens
aatcggcccacagctccc

SEQ ID NO: 3787208 - DNA, 14 bp, Homo sapiens
aatctaacaatgga

SEQ ID NO: 3787209 - DNA, 12 bp, Homo sapiens
aatctaagggaa

SEQ ID NO: 3787210 - DNA, 14 bp, Homo sapiens
aatctagaagaaat

SEQ ID NO: 3787211 - DNA, 15 bp, Homo sapiens
aatctagaagaaatg

SEQ ID NO: 3787212 - DNA, 17 bp, Homo sapiens
aatctagaagaaatgaa

SEQ ID NO: 3787213 - DNA, 19 bp, Homo sapiens
aatctagaagaaatgaaat

SEQ ID NO: 3787214 - DNA, 21 bp, Homo sapiens
aatctagaagaaatgaaattt

SEQ ID NO: 3787215 - DNA, 19 bp, Homo sapiens
aatctattgggattttcta

SEQ ID NO: 3787216 - DNA, 22 bp, Homo sapiens
aatctcagaggtagggctgcca

SEQ ID NO: 3787217 - DNA, 18 bp, Homo sapiens
aatctctctctgttgtgt

SEQ ID NO: 3787218 - DNA, 12 bp, Homo sapiens
aatctgaatgta

SEQ ID NO: 3787219 - DNA, 16 bp, Homo sapiens
aatctgaatgtaattt

SEQ ID NO: 3787220 - DNA, 17 bp, Homo sapiens
aatctgaggcctcctct

SEQ ID NO: 3787221 - DNA, 19 bp, Homo sapiens
aatctgatcgttctttcta

SEQ ID NO: 3787222 - DNA, 22 bp, Homo sapiens
aatctgctttttaaagaatgct

SEQ ID NO: 3787223 - DNA, 20 bp, Homo sapiens
aatctggactcctctgtcca

SEQ ID NO: 3787224 - DNA, 17 bp, Homo sapiens
aatctgtgcaataaaat

SEQ ID NO: 3787225 - DNA, 22 bp, Homo sapiens
aatctgtgcaataaaataacag

SEQ ID NO: 3787226 - DNA, 13 bp, Homo sapiens
aatcttacaaaag

SEQ ID NO: 3787227 - DNA, 15 bp, Homo sapiens
aatcttatattccat

SEQ ID NO: 3787228 - DNA, 22 bp, Homo sapiens
aatcttcagttttatctttaat

SEQ ID NO: 3787229 - DNA, 15 bp, Homo sapiens
aatcttgctttcttt

SEQ ID NO: 3787230 - DNA, 16 bp, Homo sapiens
aatcttgtttctgaaa

SEQ ID NO: 3787231 - DNA, 19 bp, Homo sapiens
aatgaaaaatttaagcatt

SEQ ID NO: 3787232 - DNA, 16 bp, Homo sapiens
aatgaaagactgtaca

SEQ ID NO: 3787233 - DNA, 17 bp, Homo sapiens
aatgaaagactgtacaa

SEQ ID NO: 3787234 - DNA, 15 bp, Homo sapiens
aatgaaagcatgtgg

SEQ ID NO: 3787235 - DNA, 22 bp, Homo sapiens
aatgaaagcatgtggcatgttc

SEQ ID NO: 3787236 - DNA, 23 bp, Homo sapiens
aatgaaagtcttgtgactagtgc

SEQ ID NO: 3787237 - DNA, 15 bp, Homo sapiens
aatgaaagtttgcac

SEQ ID NO: 3787238 - DNA, 18 bp, Homo sapiens
aatgaaatgctctccttt

SEQ ID NO: 3787239 - DNA, 22 bp, Homo sapiens
aatgaaattttaccaagttata

SEQ ID NO: 3787240 - DNA, 19 bp, Homo sapiens
aatgaaccacatagacttt

SEQ ID NO: 3787241 - DNA, 23 bp, Homo sapiens
aatgaaccacatcttgctctgct

SEQ ID NO: 3787242 - DNA, 17 bp, Homo sapiens
aatgaaccccactgggt

SEQ ID NO: 3787243 - DNA, 22 bp, Homo sapiens
aatgaaggtgtcagaataataa

SEQ ID NO: 3787244 - DNA, 21 bp, Homo sapiens
aatgaagtaacttgtcttaaa

SEQ ID NO: 3787245 - DNA, 15 bp, Homo sapiens
aatgaataataatta

SEQ ID NO: 3787246 - DNA, 19 bp, Homo sapiens
aatgaatggactcaaactg

SEQ ID NO: 3787247 - DNA, 16 bp, Homo sapiens
aatgacagagccagtg

SEQ ID NO: 3787248 - DNA, 13 bp, Homo sapiens
aatgacatcttca

SEQ ID NO: 3787249 - DNA, 23 bp, Homo sapiens
aatgacatgtgtcaagctgcttg

SEQ ID NO: 3787250 - DNA, 16 bp, Homo sapiens
aatgacctcaagatgt

SEQ ID NO: 3787251 - DNA, 21 bp, Homo sapiens
aatgagatagaagatgtttgc

SEQ ID NO: 3787252 - DNA, 14 bp, Homo sapiens
aatgagcctggcaa

SEQ ID NO: 3787253 - DNA, 22 bp, Homo sapiens
aatgagctcgcatttgtcaatg

SEQ ID NO: 3787254 - DNA, 12 bp, Homo sapiens
aatgaggaggaa

SEQ ID NO: 3787255 - DNA, 16 bp, Homo sapiens
aatgaggtcagagcct

SEQ ID NO: 3787256 - DNA, 16 bp, Homo sapiens
aatgaggtcccaggca

SEQ ID NO: 3787257 - DNA, 18 bp, Homo sapiens
aatgataccctgaatttg

SEQ ID NO: 3787258 - DNA, 15 bp, Homo sapiens
aatgatagctactgt

SEQ ID NO: 3787259 - DNA, 21 bp, Homo sapiens
aatgatgatcctaggcatttg

SEQ ID NO: 3787260 - DNA, 12 bp, Homo sapiens
aatgatgatgac

SEQ ID NO: 3787261 - DNA, 14 bp, Homo sapiens
aatgatggcaattt

SEQ ID NO: 3787262 - DNA, 19 bp, Homo sapiens
aatgatggcaattttgtaa

SEQ ID NO: 3787263 - DNA, 13 bp, Homo sapiens
aatgatttcatgc

SEQ ID NO: 3787264 - DNA, 20 bp, Homo sapiens
aatgatttccaaagagaaaa

SEQ ID NO: 3787265 - DNA, 14 bp, Homo sapiens
aatgcacaatgtct

SEQ ID NO: 3787266 - DNA, 13 bp, Homo sapiens
aatgcacactagc

SEQ ID NO: 3787267 - DNA, 16 bp, Homo sapiens
aatgcataaaatgtta

SEQ ID NO: 3787268 - DNA, 14 bp, Homo sapiens
aatgcataaatgca

SEQ ID NO: 3787269 - DNA, 18 bp, Homo sapiens
aatgcatatcctgagcca

SEQ ID NO: 3787270 - DNA, 19 bp, Homo sapiens
aatgcatatcctgagccat

SEQ ID NO: 3787271 - DNA, 18 bp, Homo sapiens
aatgcatgttaggaaaat

SEQ ID NO: 3787272 - DNA, 12 bp, Homo sapiens
aatgcctgtgcc

SEQ ID NO: 3787273 - DNA, 21 bp, Homo sapiens
aatgccttactttgtatgata

SEQ ID NO: 3787274 - DNA, 21 bp, Homo sapiens
aatgctaaatgtaagaatcat

SEQ ID NO: 3787275 - DNA, 17 bp, Homo sapiens
aatgctaagggcaggcc

SEQ ID NO: 3787276 - DNA, 14 bp, Homo sapiens
aatgctctcctttc

SEQ ID NO: 3787277 - DNA, 19 bp, Homo sapiens
aatgctgcgcccttcccca

SEQ ID NO: 3787278 - DNA, 12 bp, Homo sapiens
aatgctggagcg

SEQ ID NO: 3787279 - DNA, 21 bp, Homo sapiens
aatgcttctgacttcatagat

SEQ ID NO: 3787280 - DNA, 12 bp, Homo sapiens
aatgcttggaat

SEQ ID NO: 3787281 - DNA, 19 bp, Homo sapiens
aatgcttggaatatctgct

SEQ ID NO: 3787282 - DNA, 22 bp, Homo sapiens
aatgcttggaatatctgctgta

SEQ ID NO: 3787283 - DNA, 18 bp, Homo sapiens
aatggaaggtttgtatat

SEQ ID NO: 3787284 - DNA, 15 bp, Homo sapiens
aatggaggaatatga

SEQ ID NO: 3787285 - DNA, 19 bp, Homo sapiens
aatggcacagcccaaagaa

SEQ ID NO: 3787286 - DNA, 14 bp, Homo sapiens
aatggcctgccttg

SEQ ID NO: 3787287 - DNA, 20 bp, Homo sapiens
aatggcctgccttgaagcca

SEQ ID NO: 3787288 - DNA, 17 bp, Homo sapiens
aatggtaaaattgcatg

SEQ ID NO: 3787289 - DNA, 19 bp, Homo sapiens
aatggtagtctaaccaaat

SEQ ID NO: 3787290 - DNA, 15 bp, Homo sapiens
aatggtcgcccagga

SEQ ID NO: 3787291 - DNA, 22 bp, Homo sapiens
aatggtctttctaatgtgtgaa

SEQ ID NO: 3787292 - DNA, 22 bp, Homo sapiens
aatggtgaaaataaaataaagc

SEQ ID NO: 3787293 - DNA, 22 bp, Homo sapiens
aatggtggggaactataaagaa

SEQ ID NO: 3787294 - DNA, 21 bp, Homo sapiens
aatggtggttgtttcttccaa

SEQ ID NO: 3787295 - DNA, 17 bp, Homo sapiens
aatggttgactgggttt

SEQ ID NO: 3787296 - DNA, 14 bp, Homo sapiens
aatggtttgaatat

SEQ ID NO: 3787297 - DNA, 17 bp, Homo sapiens
aatggtttgaatataaa

SEQ ID NO: 3787298 - DNA, 15 bp, Homo sapiens
aatgtaacttttgta

SEQ ID NO: 3787299 - DNA, 23 bp, Homo sapiens
aatgtaagaatcattgtaaacat

SEQ ID NO: 3787300 - DNA, 13 bp, Homo sapiens
aatgtaagctcta

SEQ ID NO: 3787301 - DNA, 14 bp, Homo sapiens
aatgtaatttgtgt

SEQ ID NO: 3787302 - DNA, 17 bp, Homo sapiens
aatgtaatttgtgtaat

SEQ ID NO: 3787303 - DNA, 23 bp, Homo sapiens
aatgtaatttgtgtaataaagtg

SEQ ID NO: 3787304 - DNA, 17 bp, Homo sapiens
aatgtacaaaataaagt

SEQ ID NO: 3787305 - DNA, 17 bp, Homo sapiens
aatgtatacctgtaact

SEQ ID NO: 3787306 - DNA, 20 bp, Homo sapiens
aatgtatacctgtaactgca

SEQ ID NO: 3787307 - DNA, 18 bp, Homo sapiens
aatgtatcatagaaatgt

SEQ ID NO: 3787308 - DNA, 20 bp, Homo sapiens
acacctcccaccccctgtat

SEQ ID NO: 3787309 - DNA, 13 bp, Homo sapiens
acacctccctgaa

SEQ ID NO: 3787310 - DNA, 22 bp, Homo sapiens
acacctccctgaaccatccctg

SEQ ID NO: 3787311 - DNA, 22 bp, Homo sapiens
acacctcgttagggaagagaaa

SEQ ID NO: 3787312 - DNA, 18 bp, Homo sapiens
acacctctgcacaagctg

SEQ ID NO: 3787313 - DNA, 14 bp, Homo sapiens
acacctgcacctcc

SEQ ID NO: 3787314 - DNA, 17 bp, Homo sapiens
acacctggccctggggc

SEQ ID NO: 3787315 - DNA, 21 bp, Homo sapiens
acacctgtagtcccagctact

SEQ ID NO: 3787316 - DNA, 16 bp, Homo sapiens
acaccttgacagggca

SEQ ID NO: 3787317 - DNA, 15 bp, Homo sapiens
acaccttttaactca

SEQ ID NO: 3787318 - DNA, 17 bp, Homo sapiens
acacgcgtgcacacacc

SEQ ID NO: 3787319 - DNA, 15 bp, Homo sapiens
acacggacactcaaa

SEQ ID NO: 3787320 - DNA, 18 bp, Homo sapiens
acacggaggcatctgcac

SEQ ID NO: 3787321 - DNA, 14 bp, Homo sapiens
acacgtccacccca

SEQ ID NO: 3787322 - DNA, 19 bp, Homo sapiens
acactaaccacgctggacc

SEQ ID NO: 3787323 - DNA, 13 bp, Homo sapiens
acactagcctctc

SEQ ID NO: 3787324 - DNA, 22 bp, Homo sapiens
acactagtaccttcagatccta

SEQ ID NO: 3787325 - DNA, 19 bp, Homo sapiens
acactatggtatttgagtg

SEQ ID NO: 3787326 - DNA, 16 bp, Homo sapiens
acactattcactaaaa

SEQ ID NO: 3787327 - DNA, 14 bp, Homo sapiens
acactattttcaga

SEQ ID NO: 3787328 - DNA, 19 bp, Homo sapiens
acactattttcagaatctg

SEQ ID NO: 3787329 - DNA, 20 bp, Homo sapiens
acactatttttttttctttt

SEQ ID NO: 3787330 - DNA, 21 bp, Homo sapiens
acactcaaaagctgggcaggt

SEQ ID NO: 3787331 - DNA, 20 bp, Homo sapiens
acactcacatttattctgct

SEQ ID NO: 3787332 - DNA, 16 bp, Homo sapiens
acactccagcctgagc

SEQ ID NO: 3787333 - DNA, 14 bp, Homo sapiens
acactccatcagct

SEQ ID NO: 3787334 - DNA, 15 bp, Homo sapiens
acactcccctgcact

SEQ ID NO: 3787335 - DNA, 17 bp, Homo sapiens
acactcccctgcactgg

SEQ ID NO: 3787336 - DNA, 11 bp, Homo sapiens
acactctcctg

SEQ ID NO: 3787337 - DNA, 12 bp, Homo sapiens
acactctttgta

SEQ ID NO: 3787338 - DNA, 17 bp, Homo sapiens
acactgaaatatacaca

SEQ ID NO: 3787339 - DNA, 21 bp, Homo sapiens
acactgaaatatacacacagc

SEQ ID NO: 3787340 - DNA, 15 bp, Homo sapiens
acactgaaatgcctt

SEQ ID NO: 3787341 - DNA, 14 bp, Homo sapiens
acactgaggcaggg

SEQ ID NO: 3787342 - DNA, 16 bp, Homo sapiens
acactgaggcagggaa

SEQ ID NO: 3787343 - DNA, 23 bp, Homo sapiens
acactgctaggtgggccagcccc

SEQ ID NO: 3787344 - DNA, 21 bp, Homo sapiens
acactggctcatattcctgca

SEQ ID NO: 3787345 - DNA, 15 bp, Homo sapiens
acactgggggagggg

SEQ ID NO: 3787346 - DNA, 13 bp, Homo sapiens
acactgtcttgaa

SEQ ID NO: 3787347 - DNA, 21 bp, Homo sapiens
acactgttagaacactatttt

SEQ ID NO: 3787348 - DNA, 14 bp, Homo sapiens
acacttaacagatg

SEQ ID NO: 3787349 - DNA, 16 bp, Homo sapiens
acacttaacagatgca

SEQ ID NO: 3787350 - DNA, 18 bp, Homo sapiens
acacttacactttatgca

SEQ ID NO: 3787351 - DNA, 14 bp, Homo sapiens
acacttattgcttt

SEQ ID NO: 3787352 - DNA, 18 bp, Homo sapiens
acacttcagagagctggt

SEQ ID NO: 3787353 - DNA, 15 bp, Homo sapiens
acacttccaccagcc

SEQ ID NO: 3787354 - DNA, 16 bp, Homo sapiens
acacttccaccagcct

SEQ ID NO: 3787355 - DNA, 14 bp, Homo sapiens
acacttccataatc

SEQ ID NO: 3787356 - DNA, 14 bp, Homo sapiens
acacttcctgtcca

SEQ ID NO: 3787357 - DNA, 23 bp, Homo sapiens
acacttctgtgagacccccacac

SEQ ID NO: 3787358 - DNA, 20 bp, Homo sapiens
acacttggttgggtcctcac

SEQ ID NO: 3787359 - DNA, 18 bp, Homo sapiens
acacttttgagacttttt

SEQ ID NO: 3787360 - DNA, 18 bp, Homo sapiens
acagaaaaaaaacacaca

SEQ ID NO: 3787361 - DNA, 17 bp, Homo sapiens
acagaaaacaacaaaaa

SEQ ID NO: 3787362 - DNA, 17 bp, Homo sapiens
acagaaacaaaaacact

SEQ ID NO: 3787363 - DNA, 16 bp, Homo sapiens
acagaaagagagcact

SEQ ID NO: 3787364 - DNA, 17 bp, Homo sapiens
acagaacccctacatga

SEQ ID NO: 3787365 - DNA, 16 bp, Homo sapiens
acagaatcattgctta

SEQ ID NO: 3787366 - DNA, 16 bp, Homo sapiens
acagaattgcttgttt

SEQ ID NO: 3787367 - DNA, 19 bp, Homo sapiens
acagacaaaaacagcctca

SEQ ID NO: 3787368 - DNA, 20 bp, Homo sapiens
acagacaaaaacagcctcac

SEQ ID NO: 3787369 - DNA, 21 bp, Homo sapiens
acagacaaggtagccctggcc

SEQ ID NO: 3787370 - DNA, 11 bp, Homo sapiens
acagacacagg

SEQ ID NO: 3787371 - DNA, 21 bp, Homo sapiens
acagacagagaaggcagcagg

SEQ ID NO: 3787372 - DNA, 11 bp, Homo sapiens
acagacaggag

SEQ ID NO: 3787373 - DNA, 17 bp, Homo sapiens
acagacattctgccagg

SEQ ID NO: 3787374 - DNA, 15 bp, Homo sapiens
acagacgtatgctta

SEQ ID NO: 3787375 - DNA, 20 bp, Homo sapiens
acagacgtatgcttatttta

SEQ ID NO: 3787376 - DNA, 19 bp, Homo sapiens
acagactggaagcacagct

SEQ ID NO: 3787377 - DNA, 18 bp, Homo sapiens
acagactggagacaatgc

SEQ ID NO: 3787378 - DNA, 17 bp, Homo sapiens
acagacttgagaacttg

SEQ ID NO: 3787379 - DNA, 17 bp, Homo sapiens
acagagaaagagagaga

SEQ ID NO: 3787380 - DNA, 19 bp, Homo sapiens
acagagaaggaatgtcttt

SEQ ID NO: 3787381 - DNA, 22 bp, Homo sapiens
acagagaaggaatgtctttggt

SEQ ID NO: 3787382 - DNA, 16 bp, Homo sapiens
acagagaaggcagcag

SEQ ID NO: 3787383 - DNA, 15 bp, Homo sapiens
acagagaaggcagga

SEQ ID NO: 3787384 - DNA, 16 bp, Homo sapiens
acagagacacctgcac

SEQ ID NO: 3787385 - DNA, 21 bp, Homo sapiens
acagagacaggcccaagagat

SEQ ID NO: 3787386 - DNA, 23 bp, Homo sapiens
acagagagacagacttgagaact

SEQ ID NO: 3787387 - DNA, 14 bp, Homo sapiens
acagagaggagaaa

SEQ ID NO: 3787388 - DNA, 16 bp, Homo sapiens
acagagaggagaaaca

SEQ ID NO: 3787389 - DNA, 20 bp, Homo sapiens
acagagaggagaaacacatc

SEQ ID NO: 3787390 - DNA, 21 bp, Homo sapiens
acagagagggggccacctccc

SEQ ID NO: 3787391 - DNA, 21 bp, Homo sapiens
acagagcaagtgagaccctgt

SEQ ID NO: 3787392 - DNA, 21 bp, Homo sapiens
acagagcctcgggacatcaaa

SEQ ID NO: 3787393 - DNA, 16 bp, Homo sapiens
acagagctgacaaaat

SEQ ID NO: 3787394 - DNA, 18 bp, Homo sapiens
acagagctgacaaaattt

SEQ ID NO: 3787395 - DNA, 21 bp, Homo sapiens
acagagctgggatgtttctgt

SEQ ID NO: 3787396 - DNA, 16 bp, Homo sapiens
acagaggaagagcagg

SEQ ID NO: 3787397 - DNA, 13 bp, Homo sapiens
acagaggcagccc

SEQ ID NO: 3787398 - DNA, 20 bp, Homo sapiens
acagagggaagaaaagagct

SEQ ID NO: 3787399 - DNA, 14 bp, Homo sapiens
acagagtctcactg

SEQ ID NO: 3787400 - DNA, 21 bp, Homo sapiens
acagagtgagactctgtctca

SEQ ID NO: 3787401 - DNA, 18 bp, Homo sapiens
acagagttttcactctta

SEQ ID NO: 3787402 - DNA, 20 bp, Homo sapiens
acagagttttcactcttatt

SEQ ID NO: 3787403 - DNA, 18 bp, Homo sapiens
acagataagcaagagaga

SEQ ID NO: 3787404 - DNA, 19 bp, Homo sapiens
acagataagcaagagagat

SEQ ID NO: 3787405 - DNA, 21 bp, Homo sapiens
acagatactggaagttttgca

SEQ ID NO: 3787406 - DNA, 20 bp, Homo sapiens
acagatgcaatgtgctactg

SEQ ID NO: 3787407 - DNA, 13 bp, Homo sapiens
acagatgccccag

SEQ ID NO: 3787408 - DNA, 17 bp, Homo sapiens
acagatggatttgcctg

SEQ ID NO: 3787409 - DNA, 14 bp, Homo sapiens
acagattgcctcct

SEQ ID NO: 3787410 - DNA, 16 bp, Homo sapiens
acagattgcctcctta

SEQ ID NO: 3787411 - DNA, 16 bp, Homo sapiens
acagattgctgcttct

SEQ ID NO: 3787412 - DNA, 22 bp, Homo sapiens
acagcaaaaccattgcttcact

SEQ ID NO: 3787413 - DNA, 22 bp, Homo sapiens
acagcaaatttataattttaag

SEQ ID NO: 3787414 - DNA, 16 bp, Homo sapiens
acagcagcctctgaag

SEQ ID NO: 3787415 - DNA, 17 bp, Homo sapiens
acagcagctcaggcaca

SEQ ID NO: 3787416 - DNA, 20 bp, Homo sapiens
acagcaggcccacctacctt

SEQ ID NO: 3787417 - DNA, 22 bp, Homo sapiens
acagcagggtagtctggtttct

SEQ ID NO: 3787418 - DNA, 19 bp, Homo sapiens
acagcattcttgtcacaat

SEQ ID NO: 3787419 - DNA, 16 bp, Homo sapiens
acagcccaaagaagga

SEQ ID NO: 3787420 - DNA, 17 bp, Homo sapiens
acagcccaaagaaggaa

SEQ ID NO: 3787421 - DNA, 14 bp, Homo sapiens
accacatcttgctc

SEQ ID NO: 3787422 - DNA, 16 bp, Homo sapiens
accacatcttgctctg

SEQ ID NO: 3787423 - DNA, 19 bp, Homo sapiens
accacatcttgctctgctg

SEQ ID NO: 3787424 - DNA, 21 bp, Homo sapiens
accacatcttgctctgctgac

SEQ ID NO: 3787425 - DNA, 15 bp, Homo sapiens
accaccacacccagc

SEQ ID NO: 3787426 - DNA, 20 bp, Homo sapiens
accaccacacccagcccact

SEQ ID NO: 3787427 - DNA, 17 bp, Homo sapiens
accaccaggtctcccgg

SEQ ID NO: 3787428 - DNA, 19 bp, Homo sapiens
accaccccagctgctcccc

SEQ ID NO: 3787429 - DNA, 19 bp, Homo sapiens
accaccgctccccagccca

SEQ ID NO: 3787430 - DNA, 23 bp, Homo sapiens
accaccgctccccagcccagggt

SEQ ID NO: 3787431 - DNA, 16 bp, Homo sapiens
accacctaggccactc

SEQ ID NO: 3787432 - DNA, 17 bp, Homo sapiens
accacctaggccactcc

SEQ ID NO: 3787433 - DNA, 20 bp, Homo sapiens
accacctaggccactcctcc

SEQ ID NO: 3787434 - DNA, 14 bp, Homo sapiens
accaccttcccagc

SEQ ID NO: 3787435 - DNA, 22 bp, Homo sapiens
accaccttcccagctctccctc

SEQ ID NO: 3787436 - DNA, 16 bp, Homo sapiens
accacgatgtggccct

SEQ ID NO: 3787437 - DNA, 17 bp, Homo sapiens
accacgatgtggccctg

SEQ ID NO: 3787438 - DNA, 18 bp, Homo sapiens
accacgatgtggccctgg

SEQ ID NO: 3787439 - DNA, 21 bp, Homo sapiens
accacgatgtggccctggcct

SEQ ID NO: 3787440 - DNA, 13 bp, Homo sapiens
accactagaactc

SEQ ID NO: 3787441 - DNA, 17 bp, Homo sapiens
accactgcactccagcc

SEQ ID NO: 3787442 - DNA, 18 bp, Homo sapiens
accactgcactccagcct

SEQ ID NO: 3787443 - DNA, 19 bp, Homo sapiens
accactgtaaaatgaaatt

SEQ ID NO: 3787444 - DNA, 13 bp, Homo sapiens
accacttcagctg

SEQ ID NO: 3787445 - DNA, 14 bp, Homo sapiens
accacttcagctga

SEQ ID NO: 3787446 - DNA, 14 bp, Homo sapiens
accagaagccaaag

SEQ ID NO: 3787447 - DNA, 23 bp, Homo sapiens
accagacaccttgacagggcaca

SEQ ID NO: 3787448 - DNA, 11 bp, Homo sapiens
accagacaggt

SEQ ID NO: 3787449 - DNA, 23 bp, Homo sapiens
accagactacttgggagcaccgc

SEQ ID NO: 3787450 - DNA, 14 bp, Homo sapiens
accagagcccacct

SEQ ID NO: 3787451 - DNA, 17 bp, Homo sapiens
accagagcccaccttgg

SEQ ID NO: 3787452 - DNA, 22 bp, Homo sapiens
accagagcccaccttggctcaa

SEQ ID NO: 3787453 - DNA, 20 bp, Homo sapiens
accagagccccacacggagg

SEQ ID NO: 3787454 - DNA, 23 bp, Homo sapiens
accagagctctggagccacctgt

SEQ ID NO: 3787455 - DNA, 20 bp, Homo sapiens
accagataagaatgctggtt

SEQ ID NO: 3787456 - DNA, 21 bp, Homo sapiens
accagataagaatgctggttt

SEQ ID NO: 3787457 - DNA, 15 bp, Homo sapiens
accagcagatcccag

SEQ ID NO: 3787458 - DNA, 13 bp, Homo sapiens
accagcagcctgg

SEQ ID NO: 3787459 - DNA, 17 bp, Homo sapiens
accagcagcctggaccc

SEQ ID NO: 3787460 - DNA, 20 bp, Homo sapiens
accagcctgaccaacatggt

SEQ ID NO: 3787461 - DNA, 20 bp, Homo sapiens
accagcctggccaacatggt

SEQ ID NO: 3787462 - DNA, 17 bp, Homo sapiens
accagcctttctcccag

SEQ ID NO: 3787463 - DNA, 16 bp, Homo sapiens
accagcttagatttta

SEQ ID NO: 3787464 - DNA, 20 bp, Homo sapiens
accaggaatgttaaagtcag

SEQ ID NO: 3787465 - DNA, 16 bp, Homo sapiens
accaggactccctcct

SEQ ID NO: 3787466 - DNA, 17 bp, Homo sapiens
accaggactccctcctc

SEQ ID NO: 3787467 - DNA, 21 bp, Homo sapiens
accaggactccctcctcacct

SEQ ID NO: 3787468 - DNA, 19 bp, Homo sapiens
accaggagaaccactacat

SEQ ID NO: 3787469 - DNA, 20 bp, Homo sapiens
accaggagaaccactacatg

SEQ ID NO: 3787470 - DNA, 20 bp, Homo sapiens
accaggcacgaacccacctg

SEQ ID NO: 3787471 - DNA, 16 bp, Homo sapiens
accaggccgccccagc

SEQ ID NO: 3787472 - DNA, 23 bp, Homo sapiens
accaggcgagagacttgtggcct

SEQ ID NO: 3787473 - DNA, 19 bp, Homo sapiens
accaggcttgcctgcaggc

SEQ ID NO: 3787474 - DNA, 19 bp, Homo sapiens
accaggtgttctacactca

SEQ ID NO: 3787475 - DNA, 17 bp, Homo sapiens
accagtaaagtgtaaca

SEQ ID NO: 3787476 - DNA, 18 bp, Homo sapiens
accagtaaagtgtaacat

SEQ ID NO: 3787477 - DNA, 19 bp, Homo sapiens
accagtaaagtgtaacata

SEQ ID NO: 3787478 - DNA, 16 bp, Homo sapiens
accagtgtagccttgc

SEQ ID NO: 3787479 - DNA, 23 bp, Homo sapiens
accataacccaggaatgaagata

SEQ ID NO: 3787480 - DNA, 15 bp, Homo sapiens
accataatgttacat

SEQ ID NO: 3787481 - DNA, 14 bp, Homo sapiens
accatcatgtctgg

SEQ ID NO: 3787482 - DNA, 23 bp, Homo sapiens
accatccactctaccctcccacc

SEQ ID NO: 3787483 - DNA, 14 bp, Homo sapiens
accatctcaggcca

SEQ ID NO: 3787484 - DNA, 21 bp, Homo sapiens
accatctcaggccacctgccc

SEQ ID NO: 3787485 - DNA, 15 bp, Homo sapiens
accatggccagccaa

SEQ ID NO: 3787486 - DNA, 21 bp, Homo sapiens
accatggctaaggcaccagcc

SEQ ID NO: 3787487 - DNA, 13 bp, Homo sapiens
accatgtaaaaca

SEQ ID NO: 3787488 - DNA, 14 bp, Homo sapiens
accatgtaaaacaa

SEQ ID NO: 3787489 - DNA, 15 bp, Homo sapiens
accatgtaaaacaaa

SEQ ID NO: 3787490 - DNA, 21 bp, Homo sapiens
accatgtaaaacaaaaaacaa

SEQ ID NO: 3787491 - DNA, 18 bp, Homo sapiens
accattatgaagaagaga

SEQ ID NO: 3787492 - DNA, 12 bp, Homo sapiens
accattgctgct

SEQ ID NO: 3787493 - DNA, 13 bp, Homo sapiens
accattgcttcac

SEQ ID NO: 3787494 - DNA, 21 bp, Homo sapiens
accattgcttcactacccatc

SEQ ID NO: 3787495 - DNA, 12 bp, Homo sapiens
accatttataat

SEQ ID NO: 3787496 - DNA, 20 bp, Homo sapiens
accatttcagagaggccttt

SEQ ID NO: 3787497 - DNA, 16 bp, Homo sapiens
acccaaacctggagat

SEQ ID NO: 3787498 - DNA, 22 bp, Homo sapiens
acccaattaagtcctactttac

SEQ ID NO: 3787499 - DNA, 13 bp, Homo sapiens
acccacaagtgcc

SEQ ID NO: 3787500 - DNA, 19 bp, Homo sapiens
acccacactgcaacaggaa

SEQ ID NO: 3787501 - DNA, 16 bp, Homo sapiens
acccacagaaagagag

SEQ ID NO: 3787502 - DNA, 12 bp, Homo sapiens
acccacagcctc

SEQ ID NO: 3787503 - DNA, 16 bp, Homo sapiens
acccacccagcaccca

SEQ ID NO: 3787504 - DNA, 16 bp, Homo sapiens
acccacctgagctttg

SEQ ID NO: 3787505 - DNA, 13 bp, Homo sapiens
acccactgctctg

SEQ ID NO: 3787506 - DNA, 20 bp, Homo sapiens
acccactgcttttggtctgt

SEQ ID NO: 3787507 - DNA, 15 bp, Homo sapiens
acccagcccacttct

SEQ ID NO: 3787508 - DNA, 16 bp, Homo sapiens
acccagcccacttctg

SEQ ID NO: 3787509 - DNA, 11 bp, Homo sapiens
acccaggaggt

SEQ ID NO: 3787510 - DNA, 17 bp, Homo sapiens
acccaggagtgtggcca

SEQ ID NO: 3787511 - DNA, 14 bp, Homo sapiens
acccagtccctggg

SEQ ID NO: 3787512 - DNA, 18 bp, Homo sapiens
acccatcacgcctgtgca

SEQ ID NO: 3787513 - DNA, 19 bp, Homo sapiens
acccatcagaaggagaagg

SEQ ID NO: 3787514 - DNA, 21 bp, Homo sapiens
acccatcggtgtccatttata

SEQ ID NO: 3787515 - DNA, 22 bp, Homo sapiens
acccatctgcacccccctgggc

SEQ ID NO: 3787516 - DNA, 19 bp, Homo sapiens
acccatgaagacaggacag

SEQ ID NO: 3787517 - DNA, 20 bp, Homo sapiens
acccatgatgagctcctctt

SEQ ID NO: 3787518 - DNA, 16 bp, Homo sapiens
accccaaagccccttg

SEQ ID NO: 3787519 - DNA, 17 bp, Homo sapiens
accccaaggagggagat

SEQ ID NO: 3787520 - DNA, 22 bp, Homo sapiens
accccacccccttcagtgccca

SEQ ID NO: 3787521 - DNA, 12 bp, Homo sapiens
accccagcctaa

SEQ ID NO: 3787522 - DNA, 13 bp, Homo sapiens
accccagcggctg

SEQ ID NO: 3787523 - DNA, 14 bp, Homo sapiens
accccagctctgct

SEQ ID NO: 3787524 - DNA, 19 bp, Homo sapiens
accccatagtgaccggctg

SEQ ID NO: 3787525 - DNA, 21 bp, Homo sapiens
accccatagtgaccggctgct

SEQ ID NO: 3787526 - DNA, 15 bp, Homo sapiens
accccatcccacacc

SEQ ID NO: 3787527 - DNA, 16 bp, Homo sapiens
accccatgccaaagct

SEQ ID NO: 3787528 - DNA, 16 bp, Homo sapiens
acccccaaggggcagt

SEQ ID NO: 3787529 - DNA, 17 bp, Homo sapiens
acccccacacctcagtt

SEQ ID NO: 3787530 - DNA, 14 bp, Homo sapiens
acccccaccccaca

SEQ ID NO: 3787531 - DNA, 17 bp, Homo sapiens
acccccaccccacactt

SEQ ID NO: 3787532 - DNA, 13 bp, Homo sapiens
acccccacccctt

SEQ ID NO: 3787533 - DNA, 20 bp, Homo sapiens
acccccaccccttccccact

SEQ ID NO: 3787534 - DNA, 18 bp, Homo sapiens
acgatttagaaagaagcc

SEQ ID NO: 3787535 - DNA, 12 bp, Homo sapiens
acgcacacacac

SEQ ID NO: 3787536 - DNA, 19 bp, Homo sapiens
acgcacacacacacacagg

SEQ ID NO: 3787537 - DNA, 20 bp, Homo sapiens
acgcacacacacacacagga

SEQ ID NO: 3787538 - DNA, 19 bp, Homo sapiens
acgcacctcccatcctaat

SEQ ID NO: 3787539 - DNA, 12 bp, Homo sapiens
acgcagccctgc

SEQ ID NO: 3787540 - DNA, 14 bp, Homo sapiens
acgcccatgtgtga

SEQ ID NO: 3787541 - DNA, 16 bp, Homo sapiens
acgcctgtaatcccag

SEQ ID NO: 3787542 - DNA, 19 bp, Homo sapiens
acgcctgtaatcccagcag

SEQ ID NO: 3787543 - DNA, 14 bp, Homo sapiens
acgccttgttcttg

SEQ ID NO: 3787544 - DNA, 18 bp, Homo sapiens
acgccttgttcttggcca

SEQ ID NO: 3787545 - DNA, 18 bp, Homo sapiens
acgcggtacaaaggaaaa

SEQ ID NO: 3787546 - DNA, 16 bp, Homo sapiens
acgctccctccccctg

SEQ ID NO: 3787547 - DNA, 19 bp, Homo sapiens
acgctccctccccctgccc

SEQ ID NO: 3787548 - DNA, 19 bp, Homo sapiens
acgctggagtgcagtgagc

SEQ ID NO: 3787549 - DNA, 23 bp, Homo sapiens
acgctgtccctagtaaaaataca

SEQ ID NO: 3787550 - DNA, 14 bp, Homo sapiens
acgctgtctccaga

SEQ ID NO: 3787551 - DNA, 17 bp, Homo sapiens
acgctgtctccagaccc

SEQ ID NO: 3787552 - DNA, 22 bp, Homo sapiens
acgctgtctccagacccccacc

SEQ ID NO: 3787553 - DNA, 21 bp, Homo sapiens
acgcttgacaggacagcatgg

SEQ ID NO: 3787554 - DNA, 15 bp, Homo sapiens
acggaaaatgccaat

SEQ ID NO: 3787555 - DNA, 19 bp, Homo sapiens
acggaaaatgccaatctct

SEQ ID NO: 3787556 - DNA, 14 bp, Homo sapiens
acggagatgtttca

SEQ ID NO: 3787557 - DNA, 22 bp, Homo sapiens
acggcaggacaacgaggaagcc

SEQ ID NO: 3787558 - DNA, 12 bp, Homo sapiens
acggccaggcca

SEQ ID NO: 3787559 - DNA, 16 bp, Homo sapiens
acggccaggccagagg

SEQ ID NO: 3787560 - DNA, 17 bp, Homo sapiens
acggctcactgcagcct

SEQ ID NO: 3787561 - DNA, 16 bp, Homo sapiens
acgggcagtagctgtg

SEQ ID NO: 3787562 - DNA, 12 bp, Homo sapiens
acggggagaaaa

SEQ ID NO: 3787563 - DNA, 13 bp, Homo sapiens
acgtacacacaca

SEQ ID NO: 3787564 - DNA, 12 bp, Homo sapiens
acgtccctccac

SEQ ID NO: 3787565 - DNA, 13 bp, Homo sapiens
acgtctgacaggc

SEQ ID NO: 3787566 - DNA, 15 bp, Homo sapiens
acgtctgacaggcaa

SEQ ID NO: 3787567 - DNA, 23 bp, Homo sapiens
acgtctgacaggcaatgctggct

SEQ ID NO: 3787568 - DNA, 22 bp, Homo sapiens
acgtctgaccctctccacccca

SEQ ID NO: 3787569 - DNA, 15 bp, Homo sapiens
acgtctgtcttcaca

SEQ ID NO: 3787570 - DNA, 16 bp, Homo sapiens
acgtgacagtgcctgg

SEQ ID NO: 3787571 - DNA, 17 bp, Homo sapiens
acgtgacagtgcctggg

SEQ ID NO: 3787572 - DNA, 18 bp, Homo sapiens
acgtgactgccccaactc

SEQ ID NO: 3787573 - DNA, 14 bp, Homo sapiens
acgtggagagctgg

SEQ ID NO: 3787574 - DNA, 15 bp, Homo sapiens
acgtggagagctggt

SEQ ID NO: 3787575 - DNA, 18 bp, Homo sapiens
acgtggagagctggtgcc

SEQ ID NO: 3787576 - DNA, 19 bp, Homo sapiens
acgtggagagctggtgccc

SEQ ID NO: 3787577 - DNA, 15 bp, Homo sapiens
acgtggcttctgatg

SEQ ID NO: 3787578 - DNA, 23 bp, Homo sapiens
acgtgggagttcagctgcttctc

SEQ ID NO: 3787579 - DNA, 16 bp, Homo sapiens
acgtgggcaaacaggc

SEQ ID NO: 3787580 - DNA, 19 bp, Homo sapiens
acgtgggcaaacaggcagt

SEQ ID NO: 3787581 - DNA, 14 bp, Homo sapiens
acgtggggcagcac

SEQ ID NO: 3787582 - DNA, 19 bp, Homo sapiens
acgtggggcagcacagaga

SEQ ID NO: 3787583 - DNA, 20 bp, Homo sapiens
acgtggggcagcacagagag

SEQ ID NO: 3787584 - DNA, 22 bp, Homo sapiens
acgtgggtcttcagggggccag

SEQ ID NO: 3787585 - DNA, 18 bp, Homo sapiens
acgtgtactacaatttaa

SEQ ID NO: 3787586 - DNA, 16 bp, Homo sapiens
acgttcacccctccac

SEQ ID NO: 3787587 - DNA, 19 bp, Homo sapiens
acgttggacttttcgttaa

SEQ ID NO: 3787588 - DNA, 21 bp, Homo sapiens
acgttggacttttcgttaaca

SEQ ID NO: 3787589 - DNA, 14 bp, Homo sapiens
acgtttaaagttct

SEQ ID NO: 3787590 - DNA, 17 bp, Homo sapiens
acgtttcagtaataaaa

SEQ ID NO: 3787591 - DNA, 19 bp, Homo sapiens
acgtttcagtaataaaaca

SEQ ID NO: 3787592 - DNA, 16 bp, Homo sapiens
acgttttattgtgttt

SEQ ID NO: 3787593 - DNA, 20 bp, Homo sapiens
acgttttgtttgaaaaagca

SEQ ID NO: 3787594 - DNA, 17 bp, Homo sapiens
actaaaaatacaaacaa

SEQ ID NO: 3787595 - DNA, 12 bp, Homo sapiens
actaaaagatcg

SEQ ID NO: 3787596 - DNA, 14 bp, Homo sapiens
actaaaatatttat

SEQ ID NO: 3787597 - DNA, 17 bp, Homo sapiens
actaaagcaggcctttt

SEQ ID NO: 3787598 - DNA, 20 bp, Homo sapiens
actaaagcagtggacaccag

SEQ ID NO: 3787599 - DNA, 13 bp, Homo sapiens
actaaagccaagg

SEQ ID NO: 3787600 - DNA, 18 bp, Homo sapiens
actaacaaccaaagacta

SEQ ID NO: 3787601 - DNA, 13 bp, Homo sapiens
actaacagataag

SEQ ID NO: 3787602 - DNA, 16 bp, Homo sapiens
actaacagataagcaa

SEQ ID NO: 3787603 - DNA, 12 bp, Homo sapiens
actaaccacgct

SEQ ID NO: 3787604 - DNA, 13 bp, Homo sapiens
actaaccacgctg

SEQ ID NO: 3787605 - DNA, 14 bp, Homo sapiens
actaagaaaagata

SEQ ID NO: 3787606 - DNA, 23 bp, Homo sapiens
actaataatcttgtttctgaaaa

SEQ ID NO: 3787607 - DNA, 22 bp, Homo sapiens
actaatctattgggttcattat

SEQ ID NO: 3787608 - DNA, 18 bp, Homo sapiens
actaattaacatataata

SEQ ID NO: 3787609 - DNA, 17 bp, Homo sapiens
actaatttgatgtttac

SEQ ID NO: 3787610 - DNA, 13 bp, Homo sapiens
actacaaaatttg

SEQ ID NO: 3787611 - DNA, 18 bp, Homo sapiens
actacaaaatttgaaatt

SEQ ID NO: 3787612 - DNA, 15 bp, Homo sapiens
actacacattcaata

SEQ ID NO: 3787613 - DNA, 18 bp, Homo sapiens
actacagacattaaataa

SEQ ID NO: 3787614 - DNA, 15 bp, Homo sapiens
actacaggcacccac

SEQ ID NO: 3787615 - DNA, 15 bp, Homo sapiens
actaccacaaggaaa

SEQ ID NO: 3787616 - DNA, 15 bp, Homo sapiens
actactcagggaatg

SEQ ID NO: 3787617 - DNA, 18 bp, Homo sapiens
actactgtggaaaaatat

SEQ ID NO: 3787618 - DNA, 19 bp, Homo sapiens
actactgtggaaaaatatt

SEQ ID NO: 3787619 - DNA, 13 bp, Homo sapiens
actactgtgttcc

SEQ ID NO: 3787620 - DNA, 15 bp, Homo sapiens
actagaaatctgcca

SEQ ID NO: 3787621 - DNA, 15 bp, Homo sapiens
actagaatttattca

SEQ ID NO: 3787622 - DNA, 22 bp, Homo sapiens
actagaatttcatttattttgt

SEQ ID NO: 3787623 - DNA, 16 bp, Homo sapiens
actagacctccagctg

SEQ ID NO: 3787624 - DNA, 16 bp, Homo sapiens
actagacgttcatttg

SEQ ID NO: 3787625 - DNA, 19 bp, Homo sapiens
actagctatctaggtggag

SEQ ID NO: 3787626 - DNA, 15 bp, Homo sapiens
actaggaaaattgga

SEQ ID NO: 3787627 - DNA, 16 bp, Homo sapiens
actaggactctgaggc

SEQ ID NO: 3787628 - DNA, 12 bp, Homo sapiens
actaggctgggt

SEQ ID NO: 3787629 - DNA, 13 bp, Homo sapiens
actaggctgggtg

SEQ ID NO: 3787630 - DNA, 19 bp, Homo sapiens
actaggctgggtgcccaca

SEQ ID NO: 3787631 - DNA, 20 bp, Homo sapiens
actaggctgggtgcccacag

SEQ ID NO: 3787632 - DNA, 22 bp, Homo sapiens
actaggctgggtgcccacagcc

SEQ ID NO: 3787633 - DNA, 14 bp, Homo sapiens
actagggacctggg

SEQ ID NO: 3787634 - DNA, 17 bp, Homo sapiens
actagggattcaggctg

SEQ ID NO: 3787635 - DNA, 18 bp, Homo sapiens
actagggattcaggctgc

SEQ ID NO: 3787636 - DNA, 19 bp, Homo sapiens
actagggattcaggctgct

SEQ ID NO: 3787637 - DNA, 21 bp, Homo sapiens
actagggattcaggctgcttg

SEQ ID NO: 3787638 - DNA, 17 bp, Homo sapiens
actagtgctgaagctta

SEQ ID NO: 3787639 - DNA, 22 bp, Homo sapiens
actagttacacatcttcaacag

SEQ ID NO: 3787640 - DNA, 20 bp, Homo sapiens
actatagcctaggtgacaga

SEQ ID NO: 3787641 - DNA, 22 bp, Homo sapiens
actatagcctaggtgacagagt

SEQ ID NO: 3787642 - DNA, 13 bp, Homo sapiens
actatatgtatgg

SEQ ID NO: 3787643 - DNA, 18 bp, Homo sapiens
actatattatcatgcaaa

SEQ ID NO: 3787644 - DNA, 19 bp, Homo sapiens
actatcaaactgaagccag

SEQ ID NO: 3787645 - DNA, 16 bp, Homo sapiens
actatctaaatgttga

SEQ ID NO: 3787646 - DNA, 16 bp, Homo sapiens
actatggtatttgagt

SEQ ID NO: 3787647 - DNA, 21 bp, Homo sapiens
actatgtacaatattttaagc

SEQ ID NO: 3787648 - DNA, 17 bp, Homo sapiens
acttgctgctattttac

SEQ ID NO: 3787649 - DNA, 21 bp, Homo sapiens
acttggaaaaatccagaaaga

SEQ ID NO: 3787650 - DNA, 19 bp, Homo sapiens
acttggagccaagggttca

SEQ ID NO: 3787651 - DNA, 20 bp, Homo sapiens
acttgggagacctgtaatca

SEQ ID NO: 3787652 - DNA, 15 bp, Homo sapiens
acttgggccactgtg

SEQ ID NO: 3787653 - DNA, 23 bp, Homo sapiens
acttggggggctgaggtgggagg

SEQ ID NO: 3787654 - DNA, 18 bp, Homo sapiens
acttggttgggtcctcac

SEQ ID NO: 3787655 - DNA, 18 bp, Homo sapiens
acttgtaaatgtggtaaa

SEQ ID NO: 3787656 - DNA, 18 bp, Homo sapiens
acttgtacaaaataaaca

SEQ ID NO: 3787657 - DNA, 16 bp, Homo sapiens
acttgtctttttctgg

SEQ ID NO: 3787658 - DNA, 17 bp, Homo sapiens
acttgtctttttctgga

SEQ ID NO: 3787659 - DNA, 22 bp, Homo sapiens
acttgtgctgatcgtgctaaat

SEQ ID NO: 3787660 - DNA, 22 bp, Homo sapiens
acttgtggacacagctcttctc

SEQ ID NO: 3787661 - DNA, 16 bp, Homo sapiens
acttgtgtctctgtgc

SEQ ID NO: 3787662 - DNA, 21 bp, Homo sapiens
acttgtgtctctgtgctttta

SEQ ID NO: 3787663 - DNA, 22 bp, Homo sapiens
acttgtgtgtgggctgtgagtg

SEQ ID NO: 3787664 - DNA, 17 bp, Homo sapiens
acttgtgttttaaaata

SEQ ID NO: 3787665 - DNA, 16 bp, Homo sapiens
acttgttagaaatgca

SEQ ID NO: 3787666 - DNA, 21 bp, Homo sapiens
acttgttcaaaatatgttctt

SEQ ID NO: 3787667 - DNA, 15 bp, Homo sapiens
acttgttccagctct

SEQ ID NO: 3787668 - DNA, 13 bp, Homo sapiens
actttaatatgta

SEQ ID NO: 3787669 - DNA, 21 bp, Homo sapiens
actttatcacattatttgcat

SEQ ID NO: 3787670 - DNA, 15 bp, Homo sapiens
actttatgcaataaa

SEQ ID NO: 3787671 - DNA, 19 bp, Homo sapiens
actttatgcagcttccttt

SEQ ID NO: 3787672 - DNA, 13 bp, Homo sapiens
actttatttactt

SEQ ID NO: 3787673 - DNA, 20 bp, Homo sapiens
actttattttatataataaa

SEQ ID NO: 3787674 - DNA, 15 bp, Homo sapiens
actttcacatagatg

SEQ ID NO: 3787675 - DNA, 20 bp, Homo sapiens
actttcacatagatgtccct

SEQ ID NO: 3787676 - DNA, 21 bp, Homo sapiens
actttcacatagatgtccctt

SEQ ID NO: 3787677 - DNA, 18 bp, Homo sapiens
actttcaggtactaaata

SEQ ID NO: 3787678 - DNA, 16 bp, Homo sapiens
actttcattgccagtg

SEQ ID NO: 3787679 - DNA, 17 bp, Homo sapiens
actttcattgccagtgt

SEQ ID NO: 3787680 - DNA, 16 bp, Homo sapiens
actttccaccccctcc

SEQ ID NO: 3787681 - DNA, 19 bp, Homo sapiens
actttccccatactctgtc

SEQ ID NO: 3787682 - DNA, 20 bp, Homo sapiens
actttcccttttgtaagttg

SEQ ID NO: 3787683 - DNA, 15 bp, Homo sapiens
actttgaagatgtca

SEQ ID NO: 3787684 - DNA, 17 bp, Homo sapiens
actttgctctttcttga

SEQ ID NO: 3787685 - DNA, 18 bp, Homo sapiens
actttggaagtttgtgtt

SEQ ID NO: 3787686 - DNA, 16 bp, Homo sapiens
actttgggaggccaag

SEQ ID NO: 3787687 - DNA, 19 bp, Homo sapiens
actttgggaggctgaggtg

SEQ ID NO: 3787688 - DNA, 19 bp, Homo sapiens
actttgggattctttccat

SEQ ID NO: 3787689 - DNA, 19 bp, Homo sapiens
actttggtacatggccagt

SEQ ID NO: 3787690 - DNA, 14 bp, Homo sapiens
actttgtatgatat

SEQ ID NO: 3787691 - DNA, 14 bp, Homo sapiens
actttgtgctacat

SEQ ID NO: 3787692 - DNA, 12 bp, Homo sapiens
acttttaaacag

SEQ ID NO: 3787693 - DNA, 14 bp, Homo sapiens
acttttaaggcagt

SEQ ID NO: 3787694 - DNA, 13 bp, Homo sapiens
acttttccttccc

SEQ ID NO: 3787695 - DNA, 22 bp, Homo sapiens
acttttcgttaacattgaccaa

SEQ ID NO: 3787696 - DNA, 17 bp, Homo sapiens
acttttctattaaaagt

SEQ ID NO: 3787697 - DNA, 14 bp, Homo sapiens
acttttctttgtgg

SEQ ID NO: 3787698 - DNA, 14 bp, Homo sapiens
acttttggaatcta

SEQ ID NO: 3787699 - DNA, 23 bp, Homo sapiens
acttttggaatctagaagaaatg

SEQ ID NO: 3787700 - DNA, 17 bp, Homo sapiens
acttttgtaagacaaag

SEQ ID NO: 3787701 - DNA, 14 bp, Homo sapiens
acttttgtgtgaaa

SEQ ID NO: 3787702 - DNA, 17 bp, Homo sapiens
actttttatattttata

SEQ ID NO: 3787703 - DNA, 12 bp, Homo sapiens
actttttcaaga

SEQ ID NO: 3787704 - DNA, 15 bp, Homo sapiens
actttttcaagattg

SEQ ID NO: 3787705 - DNA, 21 bp, Homo sapiens
actttttcaagattgatcatt

SEQ ID NO: 3787706 - DNA, 11 bp, Homo sapiens
actttttccag

SEQ ID NO: 3787707 - DNA, 22 bp, Homo sapiens
acttttttgagtggatgatgtt

SEQ ID NO: 3787708 - DNA, 23 bp, Homo sapiens
acttttttgctatccagctattt

SEQ ID NO: 3787709 - DNA, 19 bp, Homo sapiens
agaaaaaaaataacacaga

SEQ ID NO: 3787710 - DNA, 17 bp, Homo sapiens
agaaaaaaagatttatt

SEQ ID NO: 3787711 - DNA, 21 bp, Homo sapiens
agaaaaaaagtttgccagaag

SEQ ID NO: 3787712 - DNA, 14 bp, Homo sapiens
agaaaaaagaatgt

SEQ ID NO: 3787713 - DNA, 16 bp, Homo sapiens
agaaaaaagaatgtca

SEQ ID NO: 3787714 - DNA, 22 bp, Homo sapiens
agaaaaaagaatgtcagaaaaa

SEQ ID NO: 3787715 - DNA, 22 bp, Homo sapiens
agaaaaaatacattttatatta

SEQ ID NO: 3787716 - DNA, 17 bp, Homo sapiens
agaaaaaatattttcct

SEQ ID NO: 3787717 - DNA, 17 bp, Homo sapiens
agaaaaatgagcctggc

SEQ ID NO: 3787718 - DNA, 18 bp, Homo sapiens
agaaaaatgagcctggca

SEQ ID NO: 3787719 - DNA, 12 bp, Homo sapiens
agaaaacagaaa

SEQ ID NO: 3787720 - DNA, 19 bp, Homo sapiens
agaaaacagaaaaaaaaca

SEQ ID NO: 3787721 - DNA, 16 bp, Homo sapiens
agaaaacccttttcta

SEQ ID NO: 3787722 - DNA, 17 bp, Homo sapiens
agaaaagacatgaatat

SEQ ID NO: 3787723 - DNA, 16 bp, Homo sapiens
agaaaagcacctgccg

SEQ ID NO: 3787724 - DNA, 19 bp, Homo sapiens
agaaaataaaattaagaat

SEQ ID NO: 3787725 - DNA, 21 bp, Homo sapiens
agaaaataaaattaagaatgt

SEQ ID NO: 3787726 - DNA, 16 bp, Homo sapiens
agaaaattgaatttaa

SEQ ID NO: 3787727 - DNA, 18 bp, Homo sapiens
agaaaattgaatttaaca

SEQ ID NO: 3787728 - DNA, 20 bp, Homo sapiens
agaaaattgaatttaacaat

SEQ ID NO: 3787729 - DNA, 21 bp, Homo sapiens
agaaacatcagttactctgaa

SEQ ID NO: 3787730 - DNA, 18 bp, Homo sapiens
agaaaccaatcaagataa

SEQ ID NO: 3787731 - DNA, 21 bp, Homo sapiens
agaaaccagttatgtgaatga

SEQ ID NO: 3787732 - DNA, 16 bp, Homo sapiens
agaaaccgtcctcttt

SEQ ID NO: 3787733 - DNA, 16 bp, Homo sapiens
agaaactgaggaattt

SEQ ID NO: 3787734 - DNA, 18 bp, Homo sapiens
agaaactgaggaattttc

SEQ ID NO: 3787735 - DNA, 14 bp, Homo sapiens
agaaactgtagtct

SEQ ID NO: 3787736 - DNA, 20 bp, Homo sapiens
agaaactgtagtctcaggac

SEQ ID NO: 3787737 - DNA, 18 bp, Homo sapiens
agaaacttatcttacaaa

SEQ ID NO: 3787738 - DNA, 13 bp, Homo sapiens
agaaacttgtgaa

SEQ ID NO: 3787739 - DNA, 15 bp, Homo sapiens
agaaagaagatgaat

SEQ ID NO: 3787740 - DNA, 12 bp, Homo sapiens
agaaagaagccc

SEQ ID NO: 3787741 - DNA, 15 bp, Homo sapiens
agaaagacagagctg

SEQ ID NO: 3787742 - DNA, 12 bp, Homo sapiens
agaaagactgag

SEQ ID NO: 3787743 - DNA, 23 bp, Homo sapiens
agaaagagagagaattctttcaa

SEQ ID NO: 3787744 - DNA, 14 bp, Homo sapiens
agaaagcagaggct

SEQ ID NO: 3787745 - DNA, 15 bp, Homo sapiens
agaaagcagaggctg

SEQ ID NO: 3787746 - DNA, 16 bp, Homo sapiens
agaaagcagaggctgg

SEQ ID NO: 3787747 - DNA, 14 bp, Homo sapiens
agaaagcataaaat

SEQ ID NO: 3787748 - DNA, 20 bp, Homo sapiens
agaaagcccttaggaagaat

SEQ ID NO: 3787749 - DNA, 12 bp, Homo sapiens
agaaaggagagt

SEQ ID NO: 3787750 - DNA, 23 bp, Homo sapiens
agaaaggaggggatagagagaga

SEQ ID NO: 3787751 - DNA, 16 bp, Homo sapiens
agaaaggatatttaag

SEQ ID NO: 3787752 - DNA, 21 bp, Homo sapiens
agaaaggatatttaagaaaat

SEQ ID NO: 3787753 - DNA, 23 bp, Homo sapiens
agaaagtacttctccaccctgct

SEQ ID NO: 3787754 - DNA, 16 bp, Homo sapiens
agaaagtgaataaaaa

SEQ ID NO: 3787755 - DNA, 20 bp, Homo sapiens
agaaagtgaataaaaattaa

SEQ ID NO: 3787756 - DNA, 23 bp, Homo sapiens
agaaagtgtgagcaaactaactt

SEQ ID NO: 3787757 - DNA, 21 bp, Homo sapiens
agaaataaagttggtgacaga

SEQ ID NO: 3787758 - DNA, 23 bp, Homo sapiens
agaaataccaaaattatttcaga

SEQ ID NO: 3787759 - DNA, 18 bp, Homo sapiens
agaaatagacagtatatt

SEQ ID NO: 3787760 - DNA, 19 bp, Homo sapiens
agaaatatctgaaaatgta

SEQ ID NO: 3787761 - DNA, 20 bp, Homo sapiens
agactgctgctgaatttata

SEQ ID NO: 3787762 - DNA, 14 bp, Homo sapiens
agactgctgggact

SEQ ID NO: 3787763 - DNA, 19 bp, Homo sapiens
agactgctgggactggcca

SEQ ID NO: 3787764 - DNA, 17 bp, Homo sapiens
agactggaagcacagct

SEQ ID NO: 3787765 - DNA, 11 bp, Homo sapiens
agactggaggg

SEQ ID NO: 3787766 - DNA, 13 bp, Homo sapiens
agactggagggga

SEQ ID NO: 3787767 - DNA, 20 bp, Homo sapiens
agactggctggctgcagtga

SEQ ID NO: 3787768 - DNA, 22 bp, Homo sapiens
agactgggaagataggctctgc

SEQ ID NO: 3787769 - DNA, 15 bp, Homo sapiens
agactgtacaaagta

SEQ ID NO: 3787770 - DNA, 16 bp, Homo sapiens
agactgtacaaagtag

SEQ ID NO: 3787771 - DNA, 18 bp, Homo sapiens
agacttagtatattttct

SEQ ID NO: 3787772 - DNA, 19 bp, Homo sapiens
agacttagtatattttctt

SEQ ID NO: 3787773 - DNA, 21 bp, Homo sapiens
agacttcacactgcaagagcc

SEQ ID NO: 3787774 - DNA, 18 bp, Homo sapiens
agacttcccagcttctgc

SEQ ID NO: 3787775 - DNA, 14 bp, Homo sapiens
agacttgaaatact

SEQ ID NO: 3787776 - DNA, 22 bp, Homo sapiens
agacttggtgtcctttccctcc

SEQ ID NO: 3787777 - DNA, 14 bp, Homo sapiens
agactttaaagaat

SEQ ID NO: 3787778 - DNA, 18 bp, Homo sapiens
agactttatgcaataaat

SEQ ID NO: 3787779 - DNA, 19 bp, Homo sapiens
agactttttttaaatagta

SEQ ID NO: 3787780 - DNA, 17 bp, Homo sapiens
agagaaaaaagaagtgt

SEQ ID NO: 3787781 - DNA, 16 bp, Homo sapiens
agagaaaatgtaaata

SEQ ID NO: 3787782 - DNA, 20 bp, Homo sapiens
agagaaaccgtcctcttttt

SEQ ID NO: 3787783 - DNA, 21 bp, Homo sapiens
agagaaaccgtcctctttttc

SEQ ID NO: 3787784 - DNA, 13 bp, Homo sapiens
agagaactagtgg

SEQ ID NO: 3787785 - DNA, 12 bp, Homo sapiens
agagaaggcagg

SEQ ID NO: 3787786 - DNA, 12 bp, Homo sapiens
agagaaggggag

SEQ ID NO: 3787787 - DNA, 14 bp, Homo sapiens
agagaagtgcccct

SEQ ID NO: 3787788 - DNA, 15 bp, Homo sapiens
agagaagtgcccctg

SEQ ID NO: 3787789 - DNA, 17 bp, Homo sapiens
agagaatggaaaacaga

SEQ ID NO: 3787790 - DNA, 20 bp, Homo sapiens
agagacaaacacctcccagg

SEQ ID NO: 3787791 - DNA, 21 bp, Homo sapiens
agagacaaacacctcccagga

SEQ ID NO: 3787792 - DNA, 16 bp, Homo sapiens
agagacaagaagcaaa

SEQ ID NO: 3787793 - DNA, 15 bp, Homo sapiens
agagacaagacttcg

SEQ ID NO: 3787794 - DNA, 13 bp, Homo sapiens
agagacacctgca

SEQ ID NO: 3787795 - DNA, 14 bp, Homo sapiens
agagacacctgcac

SEQ ID NO: 3787796 - DNA, 18 bp, Homo sapiens
agagacacctgcacctcc

SEQ ID NO: 3787797 - DNA, 18 bp, Homo sapiens
agagacagacttgagaac

SEQ ID NO: 3787798 - DNA, 21 bp, Homo sapiens
agagacaggaaaatcctctgg

SEQ ID NO: 3787799 - DNA, 15 bp, Homo sapiens
agagacaggcccaag

SEQ ID NO: 3787800 - DNA, 20 bp, Homo sapiens
agagacaggcccaagagatg

SEQ ID NO: 3787801 - DNA, 12 bp, Homo sapiens
agagacccaagg

SEQ ID NO: 3787802 - DNA, 21 bp, Homo sapiens
agagacccccggaacaagcct

SEQ ID NO: 3787803 - DNA, 17 bp, Homo sapiens
agagacccttgtttgat

SEQ ID NO: 3787804 - DNA, 14 bp, Homo sapiens
agagactgtagatt

SEQ ID NO: 3787805 - DNA, 13 bp, Homo sapiens
agagagagaagtg

SEQ ID NO: 3787806 - DNA, 14 bp, Homo sapiens
agagagagtgtttg

SEQ ID NO: 3787807 - DNA, 11 bp, Homo sapiens
agagagctggt

SEQ ID NO: 3787808 - DNA, 23 bp, Homo sapiens
agagagctggtagttagtagcat

SEQ ID NO: 3787809 - DNA, 18 bp, Homo sapiens
agagaggagaaacacatc

SEQ ID NO: 3787810 - DNA, 18 bp, Homo sapiens
agagagggaattctcttg

SEQ ID NO: 3787811 - DNA, 22 bp, Homo sapiens
agagaggggaataatagaagaa

SEQ ID NO: 3787812 - DNA, 16 bp, Homo sapiens
agagagtggctcctcc

SEQ ID NO: 3787813 - DNA, 22 bp, Homo sapiens
agagagttaatcaactgaaagt

SEQ ID NO: 3787814 - DNA, 19 bp, Homo sapiens
agagataccaagatgccat

SEQ ID NO: 3787815 - DNA, 22 bp, Homo sapiens
agagataccaagatgccatctg

SEQ ID NO: 3787816 - DNA, 22 bp, Homo sapiens
agagatcaaccccttcgctcct

SEQ ID NO: 3787817 - DNA, 15 bp, Homo sapiens
agagatcatgagaaa

SEQ ID NO: 3787818 - DNA, 19 bp, Homo sapiens
agagatgaagagtgagagg

SEQ ID NO: 3787819 - DNA, 12 bp, Homo sapiens
agagatgcctcc

SEQ ID NO: 3787820 - DNA, 13 bp, Homo sapiens
agagatgcctccc

SEQ ID NO: 3787821 - DNA, 14 bp, Homo sapiens
agagatgcctccct

SEQ ID NO: 3787822 - DNA, 16 bp, Homo sapiens
agagatgcctccctga

SEQ ID NO: 3787823 - DNA, 18 bp, Homo sapiens
agagatggaggaggaggc

SEQ ID NO: 3787824 - DNA, 16 bp, Homo sapiens
agagatgggactggga

SEQ ID NO: 3787825 - DNA, 22 bp, Homo sapiens
agagatgggactgggagggccc

SEQ ID NO: 3787826 - DNA, 18 bp, Homo sapiens
agagcaaaataattttaa

SEQ ID NO: 3787827 - DNA, 23 bp, Homo sapiens
agagcagtttggtttctagcatg

SEQ ID NO: 3787828 - DNA, 14 bp, Homo sapiens
agagccagccctcc

SEQ ID NO: 3787829 - DNA, 21 bp, Homo sapiens
agagccagccctccctgtcct

SEQ ID NO: 3787830 - DNA, 19 bp, Homo sapiens
agagccatggactctacac

SEQ ID NO: 3787831 - DNA, 19 bp, Homo sapiens
agagcccaccttggctcaa

SEQ ID NO: 3787832 - DNA, 14 bp, Homo sapiens
agagcccagccatt

SEQ ID NO: 3787833 - DNA, 14 bp, Homo sapiens
agagccccacacgg

SEQ ID NO: 3787834 - DNA, 17 bp, Homo sapiens
agagccccacacggagg

SEQ ID NO: 3787835 - DNA, 21 bp, Homo sapiens
agagccctgtatcaacccaga

SEQ ID NO: 3787836 - DNA, 17 bp, Homo sapiens
agagccgtgatgcctcc

SEQ ID NO: 3787837 - DNA, 20 bp, Homo sapiens
agagcctgctcccccacccc

SEQ ID NO: 3787838 - DNA, 13 bp, Homo sapiens
agagcctgctgga

SEQ ID NO: 3787839 - DNA, 17 bp, Homo sapiens
agagccttggtgtccac

SEQ ID NO: 3787840 - DNA, 19 bp, Homo sapiens
agagccttggtgtccacct

SEQ ID NO: 3787841 - DNA, 23 bp, Homo sapiens
agagccttggtgtccacctggcc

SEQ ID NO: 3787842 - DNA, 18 bp, Homo sapiens
agagctgcctaagaggca

SEQ ID NO: 3787843 - DNA, 13 bp, Homo sapiens
agagctgggaggg

SEQ ID NO: 3787844 - DNA, 16 bp, Homo sapiens
agagctgggtgagtgg

SEQ ID NO: 3787845 - DNA, 19 bp, Homo sapiens
agagctgggtgtcaagagg

SEQ ID NO: 3787846 - DNA, 23 bp, Homo sapiens
agagctggtagttagtagcatgt

SEQ ID NO: 3787847 - DNA, 11 bp, Homo sapiens
agagctggtgt

SEQ ID NO: 3787848 - DNA, 22 bp, Homo sapiens
agagctggttgggaagacatgg

SEQ ID NO: 3787849 - DNA, 20 bp, Homo sapiens
agagctgttcccaaattttc

SEQ ID NO: 3787850 - DNA, 20 bp, Homo sapiens
agagctgtttatggcctcag

SEQ ID NO: 3787851 - DNA, 17 bp, Homo sapiens
agagctttacaaaaaga

SEQ ID NO: 3787852 - DNA, 22 bp, Homo sapiens
agagctttctgtccttttggca

SEQ ID NO: 3787853 - DNA, 23 bp, Homo sapiens
agagctttctgtccttttggcac

SEQ ID NO: 3787854 - DNA, 17 bp, Homo sapiens
agaggaaaaaaatgact

SEQ ID NO: 3787855 - DNA, 13 bp, Homo sapiens
agaggaactgggc

SEQ ID NO: 3787856 - DNA, 13 bp, Homo sapiens
agaggaagagcag

SEQ ID NO: 3787857 - DNA, 23 bp, Homo sapiens
agaggacacctgtactggagagc

SEQ ID NO: 3787858 - DNA, 14 bp, Homo sapiens
agaggacgtgggcg

SEQ ID NO: 3787859 - DNA, 14 bp, Homo sapiens
agaggagaaacaca

SEQ ID NO: 3787860 - DNA, 14 bp, Homo sapiens
agaggagtcagaga

SEQ ID NO: 3787861 - DNA, 19 bp, Homo sapiens
agaggcagaaccctggtga

SEQ ID NO: 3787862 - DNA, 13 bp, Homo sapiens
agaggcagcccca

SEQ ID NO: 3787863 - DNA, 23 bp, Homo sapiens
agaggcagccccattctgcctgc

SEQ ID NO: 3787864 - DNA, 13 bp, Homo sapiens
agaggccaatgcc

SEQ ID NO: 3787865 - DNA, 18 bp, Homo sapiens
agaggccagccccaccca

SEQ ID NO: 3787866 - DNA, 21 bp, Homo sapiens
agaggccagccccacccagga

SEQ ID NO: 3787867 - DNA, 15 bp, Homo sapiens
agaggccagcctggc

SEQ ID NO: 3787868 - DNA, 20 bp, Homo sapiens
agaggccatggcagaataat

SEQ ID NO: 3787869 - DNA, 19 bp, Homo sapiens
agaggccatgggcctcctg

SEQ ID NO: 3787870 - DNA, 13 bp, Homo sapiens
agaggctgaggac

SEQ ID NO: 3787871 - DNA, 13 bp, Homo sapiens
agaggctgaggca

SEQ ID NO: 3787872 - DNA, 17 bp, Homo sapiens
agaggctggaggcaggg

SEQ ID NO: 3787873 - DNA, 19 bp, Homo sapiens
agaggctggaggcagggcc

SEQ ID NO: 3787874 - DNA, 13 bp, Homo sapiens
agatgggtgggga

SEQ ID NO: 3787875 - DNA, 19 bp, Homo sapiens
agatggttacactgttaga

SEQ ID NO: 3787876 - DNA, 18 bp, Homo sapiens
agatggtttgagcctgag

SEQ ID NO: 3787877 - DNA, 20 bp, Homo sapiens
agatgtaagagctttacaaa

SEQ ID NO: 3787878 - DNA, 16 bp, Homo sapiens
agatgtcatcccattg

SEQ ID NO: 3787879 - DNA, 22 bp, Homo sapiens
agatgtctctggcgtgtgggta

SEQ ID NO: 3787880 - DNA, 14 bp, Homo sapiens
agatgtttcacgaa

SEQ ID NO: 3787881 - DNA, 19 bp, Homo sapiens
agatgtttgtcagatatga

SEQ ID NO: 3787882 - DNA, 16 bp, Homo sapiens
agattaaactgagtga

SEQ ID NO: 3787883 - DNA, 21 bp, Homo sapiens
agattaccccctcattgttta

SEQ ID NO: 3787884 - DNA, 16 bp, Homo sapiens
agattatattgagaca

SEQ ID NO: 3787885 - DNA, 15 bp, Homo sapiens
agattcacctgtaaa

SEQ ID NO: 3787886 - DNA, 16 bp, Homo sapiens
agattcatatttactt

SEQ ID NO: 3787887 - DNA, 22 bp, Homo sapiens
agattcatatttacttcttata

SEQ ID NO: 3787888 - DNA, 18 bp, Homo sapiens
agattccagagagtggct

SEQ ID NO: 3787889 - DNA, 19 bp, Homo sapiens
agattccagagagtggctc

SEQ ID NO: 3787890 - DNA, 22 bp, Homo sapiens
agattccagagagtggctcctc

SEQ ID NO: 3787891 - DNA, 16 bp, Homo sapiens
agattcctttcccttt

SEQ ID NO: 3787892 - DNA, 16 bp, Homo sapiens
agattgaaaaggaaga

SEQ ID NO: 3787893 - DNA, 22 bp, Homo sapiens
agattgagtaagatttacccag

SEQ ID NO: 3787894 - DNA, 19 bp, Homo sapiens
agattgatcatttttataa

SEQ ID NO: 3787895 - DNA, 16 bp, Homo sapiens
agattgcaccactgca

SEQ ID NO: 3787896 - DNA, 14 bp, Homo sapiens
agattgctgcttct

SEQ ID NO: 3787897 - DNA, 16 bp, Homo sapiens
agattgcttaaaatag

SEQ ID NO: 3787898 - DNA, 15 bp, Homo sapiens
agattgttaaaataa

SEQ ID NO: 3787899 - DNA, 16 bp, Homo sapiens
agatttaatttgccaa

SEQ ID NO: 3787900 - DNA, 21 bp, Homo sapiens
agatttacccagaatgtcaga

SEQ ID NO: 3787901 - DNA, 17 bp, Homo sapiens
agatttcagtcttttcc

SEQ ID NO: 3787902 - DNA, 19 bp, Homo sapiens
agatttctgattttatgta

SEQ ID NO: 3787903 - DNA, 22 bp, Homo sapiens
agatttctgattttatgtaaaa

SEQ ID NO: 3787904 - DNA, 19 bp, Homo sapiens
agatttcttgagttttgtt

SEQ ID NO: 3787905 - DNA, 20 bp, Homo sapiens
agatttgcccatttacactt

SEQ ID NO: 3787906 - DNA, 20 bp, Homo sapiens
agatttggtgaatttgaatc

SEQ ID NO: 3787907 - DNA, 19 bp, Homo sapiens
agattttaaattcacaata

SEQ ID NO: 3787908 - DNA, 14 bp, Homo sapiens
agattttaattttg

SEQ ID NO: 3787909 - DNA, 17 bp, Homo sapiens
agattttacaaaagatg

SEQ ID NO: 3787910 - DNA, 18 bp, Homo sapiens
agattttacaaaagatgt

SEQ ID NO: 3787911 - DNA, 23 bp, Homo sapiens
agattttgaaaactacattttaa

SEQ ID NO: 3787912 - DNA, 21 bp, Homo sapiens
agattttgaaatttttattaa

SEQ ID NO: 3787913 - DNA, 19 bp, Homo sapiens
agcaaaaacgaaagctggg

SEQ ID NO: 3787914 - DNA, 17 bp, Homo sapiens
agcaaaaccattgcttc

SEQ ID NO: 3787915 - DNA, 18 bp, Homo sapiens
agcaaaaccattgcttca

SEQ ID NO: 3787916 - DNA, 17 bp, Homo sapiens
agcaaaactccatctca

SEQ ID NO: 3787917 - DNA, 13 bp, Homo sapiens
agcaaacacatta

SEQ ID NO: 3787918 - DNA, 19 bp, Homo sapiens
agcaaactaacttgacttt

SEQ ID NO: 3787919 - DNA, 23 bp, Homo sapiens
agcaaaggagtagaaagacagag

SEQ ID NO: 3787920 - DNA, 19 bp, Homo sapiens
agcaaataaactaggaaat

SEQ ID NO: 3787921 - DNA, 15 bp, Homo sapiens
agcaaatgtgacctg

SEQ ID NO: 3787922 - DNA, 18 bp, Homo sapiens
agcaaatttataatttta

SEQ ID NO: 3787923 - DNA, 15 bp, Homo sapiens
agcaacttgtctttt

SEQ ID NO: 3787924 - DNA, 15 bp, Homo sapiens
agcaagagagatgtt

SEQ ID NO: 3787925 - DNA, 15 bp, Homo sapiens
agcaaggatctttca

SEQ ID NO: 3787926 - DNA, 14 bp, Homo sapiens
agcaaggtggagtg

SEQ ID NO: 3787927 - DNA, 19 bp, Homo sapiens
agcaaggtggagtggatgc

SEQ ID NO: 3787928 - DNA, 15 bp, Homo sapiens
agcaagtgagagctg

SEQ ID NO: 3787929 - DNA, 16 bp, Homo sapiens
agcaagttacagtgat

SEQ ID NO: 3787930 - DNA, 18 bp, Homo sapiens
agcaatatttaaggagat

SEQ ID NO: 3787931 - DNA, 23 bp, Homo sapiens
agcaatccatgttagtttttact

SEQ ID NO: 3787932 - DNA, 17 bp, Homo sapiens
agcaatcctcctgagtg

SEQ ID NO: 3787933 - DNA, 16 bp, Homo sapiens
agcacagaaaactaga

SEQ ID NO: 3787934 - DNA, 12 bp, Homo sapiens
agcacagagagg

SEQ ID NO: 3787935 - DNA, 20 bp, Homo sapiens
agcacagagagggggccacc

SEQ ID NO: 3787936 - DNA, 16 bp, Homo sapiens
agcacagagcgtcctt

SEQ ID NO: 3787937 - DNA, 15 bp, Homo sapiens
agcacatctgcattt

SEQ ID NO: 3787938 - DNA, 16 bp, Homo sapiens
agcacatctgcatttt

SEQ ID NO: 3787939 - DNA, 20 bp, Homo sapiens
agcaccaccaggtctcccgg

SEQ ID NO: 3787940 - DNA, 12 bp, Homo sapiens
agcaccacccta

SEQ ID NO: 3787941 - DNA, 23 bp, Homo sapiens
agcaccaccctagtcccttcccc

SEQ ID NO: 3787942 - DNA, 14 bp, Homo sapiens
agcaccaggcacga

SEQ ID NO: 3787943 - DNA, 23 bp, Homo sapiens
agcaccaggcacgaacccacctg

SEQ ID NO: 3787944 - DNA, 14 bp, Homo sapiens
agcacctcctgcct

SEQ ID NO: 3787945 - DNA, 16 bp, Homo sapiens
agcacctcctgcctcg

SEQ ID NO: 3787946 - DNA, 20 bp, Homo sapiens
agcacctgccgacctcgtcc

SEQ ID NO: 3787947 - DNA, 17 bp, Homo sapiens
agcacgaaatgttattt

SEQ ID NO: 3787948 - DNA, 18 bp, Homo sapiens
agcacgaaatgttatttt

SEQ ID NO: 3787949 - DNA, 17 bp, Homo sapiens
agcacgtggtaaaacac

SEQ ID NO: 3787950 - DNA, 17 bp, Homo sapiens
agcacgtttaaagttct

SEQ ID NO: 3787951 - DNA, 23 bp, Homo sapiens
agcactaaagcagtggacaccag

SEQ ID NO: 3787952 - DNA, 13 bp, Homo sapiens
agcactcacatgc

SEQ ID NO: 3787953 - DNA, 14 bp, Homo sapiens
agcactcgtgtgca

SEQ ID NO: 3787954 - DNA, 23 bp, Homo sapiens
agcactctgagtttaccatttgt

SEQ ID NO: 3787955 - DNA, 17 bp, Homo sapiens
agcactgggttgacttt

SEQ ID NO: 3787956 - DNA, 22 bp, Homo sapiens
agcactttcattgccagtgtct

SEQ ID NO: 3787957 - DNA, 12 bp, Homo sapiens
agcactttggga

SEQ ID NO: 3787958 - DNA, 21 bp, Homo sapiens
agcactttgggaggctgaggc

SEQ ID NO: 3787959 - DNA, 22 bp, Homo sapiens
agcactttgggaggctgaggtg

SEQ ID NO: 3787960 - DNA, 15 bp, Homo sapiens
agcagaaatctagaa

SEQ ID NO: 3787961 - DNA, 20 bp, Homo sapiens
agcagaacagttaagcagcc

SEQ ID NO: 3787962 - DNA, 14 bp, Homo sapiens
agcagactggtgag

SEQ ID NO: 3787963 - DNA, 16 bp, Homo sapiens
agcagagaaggccagg

SEQ ID NO: 3787964 - DNA, 21 bp, Homo sapiens
agcagagaattctcttatcca

SEQ ID NO: 3787965 - DNA, 18 bp, Homo sapiens
agcagagggactttgtat

SEQ ID NO: 3787966 - DNA, 14 bp, Homo sapiens
agcagatgcaaaga

SEQ ID NO: 3787967 - DNA, 18 bp, Homo sapiens
agcagatttaacaattcc

SEQ ID NO: 3787968 - DNA, 15 bp, Homo sapiens
agcagcacttataaa

SEQ ID NO: 3787969 - DNA, 18 bp, Homo sapiens
agcagcacttataaatca

SEQ ID NO: 3787970 - DNA, 16 bp, Homo sapiens
agcagcagggagggct

SEQ ID NO: 3787971 - DNA, 18 bp, Homo sapiens
agcagcatctgctaataa

SEQ ID NO: 3787972 - DNA, 21 bp, Homo sapiens
agcagccaagctccttgggag

SEQ ID NO: 3787973 - DNA, 22 bp, Homo sapiens
agcagccaagctccttgggagg

SEQ ID NO: 3787974 - DNA, 13 bp, Homo sapiens
agcagccagctct

SEQ ID NO: 3787975 - DNA, 15 bp, Homo sapiens
agcagccagctctca

SEQ ID NO: 3787976 - DNA, 17 bp, Homo sapiens
agcagccagctctcagc

SEQ ID NO: 3787977 - DNA, 18 bp, Homo sapiens
agcagccagctctcagcc

SEQ ID NO: 3787978 - DNA, 23 bp, Homo sapiens
agcagccagctctcagccaacga

SEQ ID NO: 3787979 - DNA, 17 bp, Homo sapiens
agcagccctcctcaccc

SEQ ID NO: 3787980 - DNA, 14 bp, Homo sapiens
agcagcctctgaag

SEQ ID NO: 3787981 - DNA, 15 bp, Homo sapiens
agcagcggacttcaa

SEQ ID NO: 3787982 - DNA, 11 bp, Homo sapiens
agcagctacca

SEQ ID NO: 3787983 - DNA, 12 bp, Homo sapiens
agcagctcaggc

SEQ ID NO: 3787984 - DNA, 14 bp, Homo sapiens
agcagctcaggcac

SEQ ID NO: 3787985 - DNA, 21 bp, Homo sapiens
agcagctcaggcacacttctt

SEQ ID NO: 3787986 - DNA, 15 bp, Homo sapiens
agcagcttgctgcac

SEQ ID NO: 3787987 - DNA, 17 bp, Homo sapiens
agctctccctctggccc

SEQ ID NO: 3787988 - DNA, 23 bp, Homo sapiens
agctctccctctggccctgcctt

SEQ ID NO: 3787989 - DNA, 17 bp, Homo sapiens
agctctggagccacctg

SEQ ID NO: 3787990 - DNA, 15 bp, Homo sapiens
agctctggctcacag

SEQ ID NO: 3787991 - DNA, 12 bp, Homo sapiens
agctctggcttc

SEQ ID NO: 3787992 - DNA, 19 bp, Homo sapiens
agctctggtgacaccagcc

SEQ ID NO: 3787993 - DNA, 16 bp, Homo sapiens
agctctgtcctgggag

SEQ ID NO: 3787994 - DNA, 12 bp, Homo sapiens
agctctgtctgt

SEQ ID NO: 3787995 - DNA, 23 bp, Homo sapiens
agctctgtgttgccatgtgtgct

SEQ ID NO: 3787996 - DNA, 16 bp, Homo sapiens
agctcttctccaggct

SEQ ID NO: 3787997 - DNA, 17 bp, Homo sapiens
agctcttctccaggctg

SEQ ID NO: 3787998 - DNA, 21 bp, Homo sapiens
agctcttctgccggccctggg

SEQ ID NO: 3787999 - DNA, 19 bp, Homo sapiens
agctcttgaagacactgaa

SEQ ID NO: 3788000 - DNA, 15 bp, Homo sapiens
agctgaacctgggta

SEQ ID NO: 3788001 - DNA, 18 bp, Homo sapiens
agctgaatacattctgct

SEQ ID NO: 3788002 - DNA, 17 bp, Homo sapiens
agctgacgaggctgggc

SEQ ID NO: 3788003 - DNA, 20 bp, Homo sapiens
agctgacgaggctgggccaa

SEQ ID NO: 3788004 - DNA, 11 bp, Homo sapiens
agctgactgtg

SEQ ID NO: 3788005 - DNA, 18 bp, Homo sapiens
agctgactgtggccccct

SEQ ID NO: 3788006 - DNA, 14 bp, Homo sapiens
agctgagaatagaa

SEQ ID NO: 3788007 - DNA, 17 bp, Homo sapiens
agctgagaatagaagga

SEQ ID NO: 3788008 - DNA, 20 bp, Homo sapiens
agctgattactgtcaataaa

SEQ ID NO: 3788009 - DNA, 19 bp, Homo sapiens
agctgattttaacaataac

SEQ ID NO: 3788010 - DNA, 20 bp, Homo sapiens
agctgcaccctcaggcaggt

SEQ ID NO: 3788011 - DNA, 21 bp, Homo sapiens
agctgcacctgccagcctggc

SEQ ID NO: 3788012 - DNA, 22 bp, Homo sapiens
agctgcacctgccagcctggct

SEQ ID NO: 3788013 - DNA, 15 bp, Homo sapiens
agctgcagagacaga

SEQ ID NO: 3788014 - DNA, 15 bp, Homo sapiens
agctgcatctactca

SEQ ID NO: 3788015 - DNA, 16 bp, Homo sapiens
agctgccaagccccat

SEQ ID NO: 3788016 - DNA, 15 bp, Homo sapiens
agctgccaagtaaat

SEQ ID NO: 3788017 - DNA, 18 bp, Homo sapiens
agctgcccccgctcatgg

SEQ ID NO: 3788018 - DNA, 19 bp, Homo sapiens
agctgcccccgctcatggg

SEQ ID NO: 3788019 - DNA, 14 bp, Homo sapiens
agctgcccctggct

SEQ ID NO: 3788020 - DNA, 20 bp, Homo sapiens
agctgcctctcggtggccag

SEQ ID NO: 3788021 - DNA, 20 bp, Homo sapiens
agctgcctggaagagcagcc

SEQ ID NO: 3788022 - DNA, 18 bp, Homo sapiens
agctgcctgtagttagga

SEQ ID NO: 3788023 - DNA, 22 bp, Homo sapiens
agctgcctgtagttaggaaata

SEQ ID NO: 3788024 - DNA, 16 bp, Homo sapiens
agctgcctgttcagct

SEQ ID NO: 3788025 - DNA, 21 bp, Homo sapiens
agctgcctgttcagctccagc

SEQ ID NO: 3788026 - DNA, 13 bp, Homo sapiens
agctgcggtccac

SEQ ID NO: 3788027 - DNA, 17 bp, Homo sapiens
agctgcggtccacccag

SEQ ID NO: 3788028 - DNA, 19 bp, Homo sapiens
agctgcggtccacccagga

SEQ ID NO: 3788029 - DNA, 23 bp, Homo sapiens
agctgcggtccacccaggagccc

SEQ ID NO: 3788030 - DNA, 13 bp, Homo sapiens
agctgctaaatct

SEQ ID NO: 3788031 - DNA, 14 bp, Homo sapiens
agctgctaaatctc

SEQ ID NO: 3788032 - DNA, 12 bp, Homo sapiens
agctgctcccct

SEQ ID NO: 3788033 - DNA, 17 bp, Homo sapiens
agctgctctgcccagag

SEQ ID NO: 3788034 - DNA, 18 bp, Homo sapiens
agctgctctgcccagagc

SEQ ID NO: 3788035 - DNA, 14 bp, Homo sapiens
agctgctggcttgc

SEQ ID NO: 3788036 - DNA, 17 bp, Homo sapiens
agctgctggcttgcagt

SEQ ID NO: 3788037 - DNA, 22 bp, Homo sapiens
agctgcttggacctcgtgcttt

SEQ ID NO: 3788038 - DNA, 23 bp, Homo sapiens
agctgcttggacctcgtgcttta

SEQ ID NO: 3788039 - DNA, 22 bp, Homo sapiens
agctgcttttgtctatgggact

SEQ ID NO: 3788040 - DNA, 16 bp, Homo sapiens
agctggacctcaccaa

SEQ ID NO: 3788041 - DNA, 21 bp, Homo sapiens
agctggcattacagctggaga

SEQ ID NO: 3788042 - DNA, 15 bp, Homo sapiens
agctgggactacagg

SEQ ID NO: 3788043 - DNA, 18 bp, Homo sapiens
agctgggactacaggcac

SEQ ID NO: 3788044 - DNA, 23 bp, Homo sapiens
agctgggactacaggcacccacc

SEQ ID NO: 3788045 - DNA, 19 bp, Homo sapiens
agctgggactacaggtgtg

SEQ ID NO: 3788046 - DNA, 12 bp, Homo sapiens
agctgggaggaa

SEQ ID NO: 3788047 - DNA, 14 bp, Homo sapiens
agctgggatctgac

SEQ ID NO: 3788048 - DNA, 16 bp, Homo sapiens
agctgggatctgactg

SEQ ID NO: 3788049 - DNA, 17 bp, Homo sapiens
agctgggatgtttctgt

SEQ ID NO: 3788050 - DNA, 16 bp, Homo sapiens
agctgggcagaaggcc

SEQ ID NO: 3788051 - DNA, 20 bp, Homo sapiens
agctggggaagcttcttaaa

SEQ ID NO: 3788052 - DNA, 17 bp, Homo sapiens
agctgggtgtcaagagg

SEQ ID NO: 3788053 - DNA, 16 bp, Homo sapiens
agctgggttggaaaac

SEQ ID NO: 3788054 - DNA, 20 bp, Homo sapiens
agctgggttggaaaacagta

SEQ ID NO: 3788055 - DNA, 10 bp, Homo sapiens
agctggtgca

SEQ ID NO: 3788056 - DNA, 14 bp, Homo sapiens
agctggtgcattac

SEQ ID NO: 3788057 - DNA, 20 bp, Homo sapiens
agctggtgggtgaaagaaat

SEQ ID NO: 3788058 - DNA, 23 bp, Homo sapiens
agctggtgggtgaaagaaatcat

SEQ ID NO: 3788059 - DNA, 16 bp, Homo sapiens
agctggttcctgctag

SEQ ID NO: 3788060 - DNA, 21 bp, Homo sapiens
agctggtttcctcattcctga

SEQ ID NO: 3788061 - DNA, 17 bp, Homo sapiens
agctgtaagaagagact

SEQ ID NO: 3788062 - DNA, 18 bp, Homo sapiens
agctgtaagaagagactg

SEQ ID NO: 3788063 - DNA, 22 bp, Homo sapiens
agctgtaagaagagactgggaa

SEQ ID NO: 3788064 - DNA, 14 bp, Homo sapiens
agctgtccctgtca

SEQ ID NO: 3788065 - DNA, 15 bp, Homo sapiens
agctgtccctgtcac

SEQ ID NO: 3788066 - DNA, 22 bp, Homo sapiens
agctgtccctgtcaccaagctc

SEQ ID NO: 3788067 - DNA, 19 bp, Homo sapiens
agctgtctcaaacctccaa

SEQ ID NO: 3788068 - DNA, 11 bp, Homo sapiens
agctgtctgct

SEQ ID NO: 3788069 - DNA, 17 bp, Homo sapiens
agctgtgctctggacag

SEQ ID NO: 3788070 - DNA, 18 bp, Homo sapiens
agctgtgtccttgcacct

SEQ ID NO: 3788071 - DNA, 20 bp, Homo sapiens
agctgtgtccttgcacctgc

SEQ ID NO: 3788072 - DNA, 21 bp, Homo sapiens
agctgtgtccttgcacctgca

SEQ ID NO: 3788073 - DNA, 24 bp, Homo sapiens
agctgtgtccttgcacctgcatcc

SEQ ID NO: 3788074 - DNA, 19 bp, Homo sapiens
agctgttactgtcttcagt

SEQ ID NO: 3788075 - DNA, 19 bp, Homo sapiens
agctgttatttctattttt

SEQ ID NO: 3788076 - DNA, 14 bp, Homo sapiens
agctgttcagctgg

SEQ ID NO: 3788077 - DNA, 13 bp, Homo sapiens
agctgttgagctg

SEQ ID NO: 3788078 - DNA, 14 bp, Homo sapiens
agctgttgagctgt

SEQ ID NO: 3788079 - DNA, 16 bp, Homo sapiens
agctgttgagctgttt

SEQ ID NO: 3788080 - DNA, 17 bp, Homo sapiens
agctgtttatggcctca

SEQ ID NO: 3788081 - DNA, 14 bp, Homo sapiens
agctgtttccatag

SEQ ID NO: 3788082 - DNA, 15 bp, Homo sapiens
agctgttttccctga

SEQ ID NO: 3788083 - DNA, 14 bp, Homo sapiens
agcttaaaaaaaac

SEQ ID NO: 3788084 - DNA, 20 bp, Homo sapiens
agcttaaaggggctagagtg

SEQ ID NO: 3788085 - DNA, 16 bp, Homo sapiens
agcttacatgagaaca

SEQ ID NO: 3788086 - DNA, 14 bp, Homo sapiens
agcttagacctcag

SEQ ID NO: 3788087 - DNA, 15 bp, Homo sapiens
agcttagacctcagc

SEQ ID NO: 3788088 - DNA, 16 bp, Homo sapiens
agcttagacctcagcc

SEQ ID NO: 3788089 - DNA, 19 bp, Homo sapiens
agcttagacctcagcctgt

SEQ ID NO: 3788090 - DNA, 20 bp, Homo sapiens
agcttagacctcagcctgtg

SEQ ID NO: 3788091 - DNA, 17 bp, Homo sapiens
agcttagccaatgtggg

SEQ ID NO: 3788092 - DNA, 15 bp, Homo sapiens
agcttatcatgctgt

SEQ ID NO: 3788093 - DNA, 12 bp, Homo sapiens
agcttatctcag

SEQ ID NO: 3788094 - DNA, 16 bp, Homo sapiens
agcttattaatgctaa

SEQ ID NO: 3788095 - DNA, 16 bp, Homo sapiens
agcttcaagtctgtgc

SEQ ID NO: 3788096 - DNA, 17 bp, Homo sapiens
agcttcagccaggagct

SEQ ID NO: 3788097 - DNA, 20 bp, Homo sapiens
agcttcatgcctttgtaagt

SEQ ID NO: 3788098 - DNA, 18 bp, Homo sapiens
agcttcatttcctgtgtc

SEQ ID NO: 3788099 - DNA, 22 bp, Homo sapiens
agcttccaggaaaaaggacagg

SEQ ID NO: 3788100 - DNA, 22 bp, Homo sapiens
aggcagggccttgcccagagat

SEQ ID NO: 3788101 - DNA, 19 bp, Homo sapiens
aggcagggtcaggagaggg

SEQ ID NO: 3788102 - DNA, 20 bp, Homo sapiens
aggcagggtcaggagagggg

SEQ ID NO: 3788103 - DNA, 19 bp, Homo sapiens
aggcagggtctcactctgt

SEQ ID NO: 3788104 - DNA, 21 bp, Homo sapiens
aggcagggtctcactctgtcg

SEQ ID NO: 3788105 - DNA, 22 bp, Homo sapiens
aggcagggtctcactctgtcgc

SEQ ID NO: 3788106 - DNA, 14 bp, Homo sapiens
aggcaggtccaggg

SEQ ID NO: 3788107 - DNA, 21 bp, Homo sapiens
aggcaggtcttgaactcctgg

SEQ ID NO: 3788108 - DNA, 22 bp, Homo sapiens
aggcaggtcttgaactcctggc

SEQ ID NO: 3788109 - DNA, 17 bp, Homo sapiens
aggcaggtgacagtgag

SEQ ID NO: 3788110 - DNA, 21 bp, Homo sapiens
aggcaggtgcccctctctcca

SEQ ID NO: 3788111 - DNA, 17 bp, Homo sapiens
aggcaggtgggatggat

SEQ ID NO: 3788112 - DNA, 19 bp, Homo sapiens
aggcagtgatgctggatgc

SEQ ID NO: 3788113 - DNA, 18 bp, Homo sapiens
aggcagttagagatgcct

SEQ ID NO: 3788114 - DNA, 21 bp, Homo sapiens
aggcagttagagatgcctccc

SEQ ID NO: 3788115 - DNA, 13 bp, Homo sapiens
aggcataggcctg

SEQ ID NO: 3788116 - DNA, 16 bp, Homo sapiens
aggcatcccaggggac

SEQ ID NO: 3788117 - DNA, 12 bp, Homo sapiens
aggcatgttctc

SEQ ID NO: 3788118 - DNA, 20 bp, Homo sapiens
aggcatttgctgaatacaga

SEQ ID NO: 3788119 - DNA, 22 bp, Homo sapiens
aggccaacccaaaataagcagg

SEQ ID NO: 3788120 - DNA, 16 bp, Homo sapiens
aggccaaggtgggagg

SEQ ID NO: 3788121 - DNA, 14 bp, Homo sapiens
aggccaagtgcagg

SEQ ID NO: 3788122 - DNA, 22 bp, Homo sapiens
aggccacaccatctcctttcag

SEQ ID NO: 3788123 - DNA, 22 bp, Homo sapiens
aggccaccatattcagtgctgt

SEQ ID NO: 3788124 - DNA, 14 bp, Homo sapiens
aggccacctgcagg

SEQ ID NO: 3788125 - DNA, 18 bp, Homo sapiens
aggccacctgcccccttc

SEQ ID NO: 3788126 - DNA, 14 bp, Homo sapiens
aggccactcctcca

SEQ ID NO: 3788127 - DNA, 19 bp, Homo sapiens
aggccactcctccaaagga

SEQ ID NO: 3788128 - DNA, 20 bp, Homo sapiens
aggccagagggagtgacaga

SEQ ID NO: 3788129 - DNA, 16 bp, Homo sapiens
aggccagagtggcctg

SEQ ID NO: 3788130 - DNA, 17 bp, Homo sapiens
aggccagagtggcctgg

SEQ ID NO: 3788131 - DNA, 17 bp, Homo sapiens
aggccagcaaggtggag

SEQ ID NO: 3788132 - DNA, 24 bp, Homo sapiens
aggccagcaaggtggagtggatgc

SEQ ID NO: 3788133 - DNA, 17 bp, Homo sapiens
aggccagccccacccag

SEQ ID NO: 3788134 - DNA, 14 bp, Homo sapiens
aggccagctggcag

SEQ ID NO: 3788135 - DNA, 20 bp, Homo sapiens
aggccagctgtggttttctt

SEQ ID NO: 3788136 - DNA, 21 bp, Homo sapiens
aggccagctgtggttttcttt

SEQ ID NO: 3788137 - DNA, 11 bp, Homo sapiens
aggccaggagt

SEQ ID NO: 3788138 - DNA, 17 bp, Homo sapiens
aggccaggctccttcct

SEQ ID NO: 3788139 - DNA, 13 bp, Homo sapiens
aggccaggggctt

SEQ ID NO: 3788140 - DNA, 12 bp, Homo sapiens
aggccatggctc

SEQ ID NO: 3788141 - DNA, 18 bp, Homo sapiens
aggccatgggcctcctgt

SEQ ID NO: 3788142 - DNA, 16 bp, Homo sapiens
aggccatgtgagccac

SEQ ID NO: 3788143 - DNA, 22 bp, Homo sapiens
aggccatgtgagccaccgctgc

SEQ ID NO: 3788144 - DNA, 20 bp, Homo sapiens
aggcccaagagatgaagagt

SEQ ID NO: 3788145 - DNA, 14 bp, Homo sapiens
aggccccagagact

SEQ ID NO: 3788146 - DNA, 22 bp, Homo sapiens
aggccccagagactcagaggga

SEQ ID NO: 3788147 - DNA, 16 bp, Homo sapiens
aggccccctgcatcta

SEQ ID NO: 3788148 - DNA, 17 bp, Homo sapiens
aggccccgcttgtccag

SEQ ID NO: 3788149 - DNA, 21 bp, Homo sapiens
aggccccgcttgtccagcgcc

SEQ ID NO: 3788150 - DNA, 21 bp, Homo sapiens
aggcccctgccaccctgggga

SEQ ID NO: 3788151 - DNA, 13 bp, Homo sapiens
aggcccggctcca

SEQ ID NO: 3788152 - DNA, 21 bp, Homo sapiens
aggcccggctccaggctcctt

SEQ ID NO: 3788153 - DNA, 13 bp, Homo sapiens
aggcccggggctg

SEQ ID NO: 3788154 - DNA, 14 bp, Homo sapiens
aggcccggggctgg

SEQ ID NO: 3788155 - DNA, 17 bp, Homo sapiens
aggcccttcctctccac

SEQ ID NO: 3788156 - DNA, 19 bp, Homo sapiens
aggcccttcctctccactg

SEQ ID NO: 3788157 - DNA, 22 bp, Homo sapiens
aggcccttcctctccactgcct

SEQ ID NO: 3788158 - DNA, 18 bp, Homo sapiens
aggccgaagaagggtcct

SEQ ID NO: 3788159 - DNA, 18 bp, Homo sapiens
aggccgccccagcctctg

SEQ ID NO: 3788160 - DNA, 20 bp, Homo sapiens
aggccgtggctgcccacaca

SEQ ID NO: 3788161 - DNA, 17 bp, Homo sapiens
aggcctagtcagccaca

SEQ ID NO: 3788162 - DNA, 20 bp, Homo sapiens
aggcctagtcagccacatgg

SEQ ID NO: 3788163 - DNA, 17 bp, Homo sapiens
aggcctccagctcagca

SEQ ID NO: 3788164 - DNA, 15 bp, Homo sapiens
aggcctccctctctc

SEQ ID NO: 3788165 - DNA, 18 bp, Homo sapiens
aggcctctgggcctcctc

SEQ ID NO: 3788166 - DNA, 21 bp, Homo sapiens
aggcctggcatggcacctgtc

SEQ ID NO: 3788167 - DNA, 17 bp, Homo sapiens
aggcctggccagatgca

SEQ ID NO: 3788168 - DNA, 12 bp, Homo sapiens
aggcctggggac

SEQ ID NO: 3788169 - DNA, 12 bp, Homo sapiens
aggcctgggtgc

SEQ ID NO: 3788170 - DNA, 16 bp, Homo sapiens
aggcctgggtgctggc

SEQ ID NO: 3788171 - DNA, 17 bp, Homo sapiens
aggcctgtccctggcca

SEQ ID NO: 3788172 - DNA, 22 bp, Homo sapiens
aggcctgtccctggccatctct

SEQ ID NO: 3788173 - DNA, 22 bp, Homo sapiens
aggcctgtcctgacctgtctca

SEQ ID NO: 3788174 - DNA, 23 bp, Homo sapiens
aggcgatccacctgtctcagcct

SEQ ID NO: 3788175 - DNA, 14 bp, Homo sapiens
aggcgggaaggagg

SEQ ID NO: 3788176 - DNA, 15 bp, Homo sapiens
aggcgggaaggaggg

SEQ ID NO: 3788177 - DNA, 14 bp, Homo sapiens
aggcgtgaggatgg

SEQ ID NO: 3788178 - DNA, 19 bp, Homo sapiens
aggcgttcttcgaggtgga

SEQ ID NO: 3788179 - DNA, 14 bp, Homo sapiens
aggctaagctgccg

SEQ ID NO: 3788180 - DNA, 16 bp, Homo sapiens
aggctaccttattgta

SEQ ID NO: 3788181 - DNA, 23 bp, Homo sapiens
aggctatacttgtcttgttcacc

SEQ ID NO: 3788182 - DNA, 19 bp, Homo sapiens
aggctattattttcactgt

SEQ ID NO: 3788183 - DNA, 13 bp, Homo sapiens
aggctcaggccat

SEQ ID NO: 3788184 - DNA, 19 bp, Homo sapiens
aggctcagtctcaggagca

SEQ ID NO: 3788185 - DNA, 23 bp, Homo sapiens
aggctcagtctcaggagcatggg

SEQ ID NO: 3788186 - DNA, 20 bp, Homo sapiens
aggctcatagggaagacctg

SEQ ID NO: 3788187 - DNA, 19 bp, Homo sapiens
aggctcctttagcgcccag

SEQ ID NO: 3788188 - DNA, 15 bp, Homo sapiens
aggctctgcacagat

SEQ ID NO: 3788189 - DNA, 11 bp, Homo sapiens
aggctctgccc

SEQ ID NO: 3788190 - DNA, 14 bp, Homo sapiens
aggctctgccctgc

SEQ ID NO: 3788191 - DNA, 17 bp, Homo sapiens
aggctctgccctgccct

SEQ ID NO: 3788192 - DNA, 18 bp, Homo sapiens
aggctctttctgggccaa

SEQ ID NO: 3788193 - DNA, 17 bp, Homo sapiens
aggctgaaagaggccaa

SEQ ID NO: 3788194 - DNA, 14 bp, Homo sapiens
aggctgaccaagag

SEQ ID NO: 3788195 - DNA, 15 bp, Homo sapiens
aggctgaccaagaga

SEQ ID NO: 3788196 - DNA, 22 bp, Homo sapiens
aggctgaccaagagagaaagaa

SEQ ID NO: 3788197 - DNA, 22 bp, Homo sapiens
aggctgaccttgaactcctggg

SEQ ID NO: 3788198 - DNA, 22 bp, Homo sapiens
aggctgaggaaaggccagctgg

SEQ ID NO: 3788199 - DNA, 11 bp, Homo sapiens
aggctgaggca

SEQ ID NO: 3788200 - DNA, 17 bp, Homo sapiens
aggctgaggcaggagga

SEQ ID NO: 3788201 - DNA, 18 bp, Homo sapiens
aggctgcctctcccatca

SEQ ID NO: 3788202 - DNA, 23 bp, Homo sapiens
aggctgcctgagcacctcccagc

SEQ ID NO: 3788203 - DNA, 17 bp, Homo sapiens
aggctgctcagggctgg

SEQ ID NO: 3788204 - DNA, 16 bp, Homo sapiens
aggctgctctgcctgt

SEQ ID NO: 3788205 - DNA, 13 bp, Homo sapiens
aggctgctggagg

SEQ ID NO: 3788206 - DNA, 17 bp, Homo sapiens
aggctggactccagatc

SEQ ID NO: 3788207 - DNA, 22 bp, Homo sapiens
aggctggactccagatctgcac

SEQ ID NO: 3788208 - DNA, 15 bp, Homo sapiens
aggctggagcccagg

SEQ ID NO: 3788209 - DNA, 18 bp, Homo sapiens
aggctggagctggcgtct

SEQ ID NO: 3788210 - DNA, 19 bp, Homo sapiens
aggctggcaccgccttctc

SEQ ID NO: 3788211 - DNA, 13 bp, Homo sapiens
aggctggcgtgca

SEQ ID NO: 3788212 - DNA, 18 bp, Homo sapiens
aggctggcgtgcagtggt

SEQ ID NO: 3788213 - DNA, 20 bp, Homo sapiens
aggtggaggctgcagtgagc

SEQ ID NO: 3788214 - DNA, 13 bp, Homo sapiens
aggtggaggtggg

SEQ ID NO: 3788215 - DNA, 13 bp, Homo sapiens
aggtggcagccct

SEQ ID NO: 3788216 - DNA, 14 bp, Homo sapiens
aggtggcagccctg

SEQ ID NO: 3788217 - DNA, 20 bp, Homo sapiens
aggtggctgacccagtccct

SEQ ID NO: 3788218 - DNA, 21 bp, Homo sapiens
aggtggctgacccagtccctg

SEQ ID NO: 3788219 - DNA, 22 bp, Homo sapiens
aggtggctgacccagtccctgg

SEQ ID NO: 3788220 - DNA, 23 bp, Homo sapiens
aggtggctgacccagtccctggg

SEQ ID NO: 3788221 - DNA, 23 bp, Homo sapiens
aggtgggatatccctatgctgcc

SEQ ID NO: 3788222 - DNA, 14 bp, Homo sapiens
aggtgggccagccc

SEQ ID NO: 3788223 - DNA, 16 bp, Homo sapiens
aggtgggccagcccct

SEQ ID NO: 3788224 - DNA, 19 bp, Homo sapiens
aggtgggccagcccctccc

SEQ ID NO: 3788225 - DNA, 21 bp, Homo sapiens
aggtgggccagcccctcccac

SEQ ID NO: 3788226 - DNA, 22 bp, Homo sapiens
aggtgggccagcccctcccacc

SEQ ID NO: 3788227 - DNA, 19 bp, Homo sapiens
aggtgggctgagccctggc

SEQ ID NO: 3788228 - DNA, 16 bp, Homo sapiens
aggtggggcagcttga

SEQ ID NO: 3788229 - DNA, 20 bp, Homo sapiens
aggtgggggttggctgggta

SEQ ID NO: 3788230 - DNA, 23 bp, Homo sapiens
aggtgggttttcttcccatcact

SEQ ID NO: 3788231 - DNA, 15 bp, Homo sapiens
aggtggtatgtgtgt

SEQ ID NO: 3788232 - DNA, 17 bp, Homo sapiens
aggtggtctgaatgttc

SEQ ID NO: 3788233 - DNA, 18 bp, Homo sapiens
aggtggtctgaatgttct

SEQ ID NO: 3788234 - DNA, 19 bp, Homo sapiens
aggtggtctgaatgttctg

SEQ ID NO: 3788235 - DNA, 20 bp, Homo sapiens
aggtggtctgaatgttctga

SEQ ID NO: 3788236 - DNA, 21 bp, Homo sapiens
aggtggtctgaatgttctgac

SEQ ID NO: 3788237 - DNA, 17 bp, Homo sapiens
aggtggttatggagagg

SEQ ID NO: 3788238 - DNA, 20 bp, Homo sapiens
aggtgtccctgcacttgcag

SEQ ID NO: 3788239 - DNA, 22 bp, Homo sapiens
aggtgtgaaccaccacacccag

SEQ ID NO: 3788240 - DNA, 22 bp, Homo sapiens
aggtgtgagtcaccaagcccag

SEQ ID NO: 3788241 - DNA, 12 bp, Homo sapiens
aggtgtgctctg

SEQ ID NO: 3788242 - DNA, 15 bp, Homo sapiens
aggtgtgctctgatc

SEQ ID NO: 3788243 - DNA, 17 bp, Homo sapiens
aggtgttctacactcat

SEQ ID NO: 3788244 - DNA, 17 bp, Homo sapiens
aggttaaggctgaggaa

SEQ ID NO: 3788245 - DNA, 24 bp, Homo sapiens
aggttaaggctgaggaaaggccag

SEQ ID NO: 3788246 - DNA, 15 bp, Homo sapiens
aggttaataaagtaa

SEQ ID NO: 3788247 - DNA, 21 bp, Homo sapiens
aggttaccctgtaacatgcaa

SEQ ID NO: 3788248 - DNA, 21 bp, Homo sapiens
aggttaggagttcgagaccag

SEQ ID NO: 3788249 - DNA, 17 bp, Homo sapiens
aggttataggtcactcc

SEQ ID NO: 3788250 - DNA, 16 bp, Homo sapiens
aggttcactaaagcag

SEQ ID NO: 3788251 - DNA, 13 bp, Homo sapiens
aggttcagcttgt

SEQ ID NO: 3788252 - DNA, 20 bp, Homo sapiens
aggttctggttagctcagcc

SEQ ID NO: 3788253 - DNA, 22 bp, Homo sapiens
aggttctggttagctcagcccc

SEQ ID NO: 3788254 - DNA, 14 bp, Homo sapiens
aggttcttactgct

SEQ ID NO: 3788255 - DNA, 23 bp, Homo sapiens
aggttcttcccttttacatactg

SEQ ID NO: 3788256 - DNA, 12 bp, Homo sapiens
aggttgaaagac

SEQ ID NO: 3788257 - DNA, 21 bp, Homo sapiens
aggttgacaataaatgtgctt

SEQ ID NO: 3788258 - DNA, 17 bp, Homo sapiens
aggttgaggggctcctg

SEQ ID NO: 3788259 - DNA, 20 bp, Homo sapiens
aggttgaggggctcctggaa

SEQ ID NO: 3788260 - DNA, 18 bp, Homo sapiens
aggttgcagggagccgag

SEQ ID NO: 3788261 - DNA, 19 bp, Homo sapiens
aggttgcagtgagccaaga

SEQ ID NO: 3788262 - DNA, 16 bp, Homo sapiens
aggttggggtgtacta

SEQ ID NO: 3788263 - DNA, 14 bp, Homo sapiens
aggttggtgggggc

SEQ ID NO: 3788264 - DNA, 16 bp, Homo sapiens
aggttgtctgaagtca

SEQ ID NO: 3788265 - DNA, 20 bp, Homo sapiens
aggtttgtatattgtcagat

SEQ ID NO: 3788266 - DNA, 10 bp, Homo sapiens
aggtttgtga

SEQ ID NO: 3788267 - DNA, 23 bp, Homo sapiens
aggttttatgatatttttttaag

SEQ ID NO: 3788268 - DNA, 21 bp, Homo sapiens
aggtttttttgtatagtaaag

SEQ ID NO: 3788269 - DNA, 15 bp, Homo sapiens
agtaaaaataaaatt

SEQ ID NO: 3788270 - DNA, 12 bp, Homo sapiens
agtaaaaataca

SEQ ID NO: 3788271 - DNA, 13 bp, Homo sapiens
agtaaaaatacaa

SEQ ID NO: 3788272 - DNA, 16 bp, Homo sapiens
agtaaactaatgagtt

SEQ ID NO: 3788273 - DNA, 19 bp, Homo sapiens
agtaaactaatgagtttct

SEQ ID NO: 3788274 - DNA, 14 bp, Homo sapiens
agtaaactgccctg

SEQ ID NO: 3788275 - DNA, 15 bp, Homo sapiens
agtaaagagaaactt

SEQ ID NO: 3788276 - DNA, 22 bp, Homo sapiens
agtaaagagaaactttgtgcta

SEQ ID NO: 3788277 - DNA, 15 bp, Homo sapiens
agtaaagtgtaacat

SEQ ID NO: 3788278 - DNA, 22 bp, Homo sapiens
agtaaagtgtaacatatgcaaa

SEQ ID NO: 3788279 - DNA, 14 bp, Homo sapiens
agtaaatatttcag

SEQ ID NO: 3788280 - DNA, 21 bp, Homo sapiens
agtaacaagagtgattcttgc

SEQ ID NO: 3788281 - DNA, 14 bp, Homo sapiens
agtaactgacaact

SEQ ID NO: 3788282 - DNA, 15 bp, Homo sapiens
agtaacttgtcttaa

SEQ ID NO: 3788283 - DNA, 20 bp, Homo sapiens
agtaacttgtcttaaataaa

SEQ ID NO: 3788284 - DNA, 14 bp, Homo sapiens
agtaagaagacatg

SEQ ID NO: 3788285 - DNA, 15 bp, Homo sapiens
agtaagaagacatga

SEQ ID NO: 3788286 - DNA, 21 bp, Homo sapiens
agtaagaccggaagctcctgg

SEQ ID NO: 3788287 - DNA, 22 bp, Homo sapiens
agtaagaccggaagctcctggt

SEQ ID NO: 3788288 - DNA, 12 bp, Homo sapiens
agtaagagctgg

SEQ ID NO: 3788289 - DNA, 22 bp, Homo sapiens
agtaagcccttgaagatatctt

SEQ ID NO: 3788290 - DNA, 17 bp, Homo sapiens
agtaagtaccactcagg

SEQ ID NO: 3788291 - DNA, 19 bp, Homo sapiens
agtaagtaccactcaggcc

SEQ ID NO: 3788292 - DNA, 15 bp, Homo sapiens
agtaagtatcttcgt

SEQ ID NO: 3788293 - DNA, 19 bp, Homo sapiens
agtaatctgatcgttcttt

SEQ ID NO: 3788294 - DNA, 20 bp, Homo sapiens
agtaattatcgggaacagtg

SEQ ID NO: 3788295 - DNA, 14 bp, Homo sapiens
agtaattattttct

SEQ ID NO: 3788296 - DNA, 15 bp, Homo sapiens
agtaattgtgaaaaa

SEQ ID NO: 3788297 - DNA, 16 bp, Homo sapiens
agtaattgtgaaaaag

SEQ ID NO: 3788298 - DNA, 22 bp, Homo sapiens
agtaatttattgtttttccttg

SEQ ID NO: 3788299 - DNA, 23 bp, Homo sapiens
agtacaggtaaggtgagggaata

SEQ ID NO: 3788300 - DNA, 18 bp, Homo sapiens
agtacatattaggaaaat

SEQ ID NO: 3788301 - DNA, 15 bp, Homo sapiens
agtaccatctgaata

SEQ ID NO: 3788302 - DNA, 16 bp, Homo sapiens
agtacccacctgagct

SEQ ID NO: 3788303 - DNA, 22 bp, Homo sapiens
agtacccacctgagctttggac

SEQ ID NO: 3788304 - DNA, 15 bp, Homo sapiens
agtacctccaagcaa

SEQ ID NO: 3788305 - DNA, 12 bp, Homo sapiens
agtacctgctgc

SEQ ID NO: 3788306 - DNA, 13 bp, Homo sapiens
agtacctgctgcc

SEQ ID NO: 3788307 - DNA, 17 bp, Homo sapiens
agtacctgctgccccag

SEQ ID NO: 3788308 - DNA, 16 bp, Homo sapiens
agtaccttcagatcct

SEQ ID NO: 3788309 - DNA, 17 bp, Homo sapiens
agtacctttgctcttgc

SEQ ID NO: 3788310 - DNA, 15 bp, Homo sapiens
agtacctttgtcaca

SEQ ID NO: 3788311 - DNA, 18 bp, Homo sapiens
agtacgtgctaacaggct

SEQ ID NO: 3788312 - DNA, 12 bp, Homo sapiens
agtactatgtat

SEQ ID NO: 3788313 - DNA, 19 bp, Homo sapiens
agtactcctgcaaaatttt

SEQ ID NO: 3788314 - DNA, 21 bp, Homo sapiens
agtactcctgcaaaattttat

SEQ ID NO: 3788315 - DNA, 15 bp, Homo sapiens
agtactccttaagaa

SEQ ID NO: 3788316 - DNA, 15 bp, Homo sapiens
agtactggcatggta

SEQ ID NO: 3788317 - DNA, 19 bp, Homo sapiens
agtacttctccaccctgct

SEQ ID NO: 3788318 - DNA, 21 bp, Homo sapiens
agtagaaagacagagctggga

SEQ ID NO: 3788319 - DNA, 18 bp, Homo sapiens
agtagaaataatatgcat

SEQ ID NO: 3788320 - DNA, 16 bp, Homo sapiens
agtagacccctggctg

SEQ ID NO: 3788321 - DNA, 20 bp, Homo sapiens
agtagagatggggaaagaat

SEQ ID NO: 3788322 - DNA, 16 bp, Homo sapiens
agtagagtcatctcca

SEQ ID NO: 3788323 - DNA, 20 bp, Homo sapiens
agtagcatgttgagccaggc

SEQ ID NO: 3788324 - DNA, 16 bp, Homo sapiens
agtagccgagagcctg

SEQ ID NO: 3788325 - DNA, 19 bp, Homo sapiens
agtagccgagagcctgctc

SEQ ID NO: 3788326 - DNA, 21 bp, Homo sapiens
agtgggtttcacaagtgaaaa

SEQ ID NO: 3788327 - DNA, 22 bp, Homo sapiens
agtggtcgcttactttgagtga

SEQ ID NO: 3788328 - DNA, 14 bp, Homo sapiens
agtggtggctctga

SEQ ID NO: 3788329 - DNA, 21 bp, Homo sapiens
agtggttctacaatctattta

SEQ ID NO: 3788330 - DNA, 17 bp, Homo sapiens
agtgtaaaaatgagaac

SEQ ID NO: 3788331 - DNA, 14 bp, Homo sapiens
agtgtaaatccttt

SEQ ID NO: 3788332 - DNA, 20 bp, Homo sapiens
agtgtaacaagaaaggagag

SEQ ID NO: 3788333 - DNA, 13 bp, Homo sapiens
agtgtaacagctg

SEQ ID NO: 3788334 - DNA, 14 bp, Homo sapiens
agtgtaacagctga

SEQ ID NO: 3788335 - DNA, 22 bp, Homo sapiens
agtgtagaaaagaactggaaac

SEQ ID NO: 3788336 - DNA, 17 bp, Homo sapiens
agtgtagccttgcccgg

SEQ ID NO: 3788337 - DNA, 18 bp, Homo sapiens
agtgtaggctttacttag

SEQ ID NO: 3788338 - DNA, 19 bp, Homo sapiens
agtgtaggctttacttagc

SEQ ID NO: 3788339 - DNA, 21 bp, Homo sapiens
agtgtatggaaataaatgtat

SEQ ID NO: 3788340 - DNA, 22 bp, Homo sapiens
agtgtatggaaataaatgtatc

SEQ ID NO: 3788341 - DNA, 15 bp, Homo sapiens
agtgtattataacag

SEQ ID NO: 3788342 - DNA, 19 bp, Homo sapiens
agtgtcacttacctagatt

SEQ ID NO: 3788343 - DNA, 14 bp, Homo sapiens
agtgtcaggaggaa

SEQ ID NO: 3788344 - DNA, 14 bp, Homo sapiens
agtgtctaaaaaca

SEQ ID NO: 3788345 - DNA, 18 bp, Homo sapiens
agtgtctcagtccacctg

SEQ ID NO: 3788346 - DNA, 22 bp, Homo sapiens
agtgtctgtgtgcaagtgtgtg

SEQ ID NO: 3788347 - DNA, 14 bp, Homo sapiens
agtgtcttccataa

SEQ ID NO: 3788348 - DNA, 17 bp, Homo sapiens
agtgtgagtaagagctg

SEQ ID NO: 3788349 - DNA, 19 bp, Homo sapiens
agtgtgagtaagagctggt

SEQ ID NO: 3788350 - DNA, 16 bp, Homo sapiens
agtgtgcacgagtggg

SEQ ID NO: 3788351 - DNA, 20 bp, Homo sapiens
agtgtgcctgaagtcccaga

SEQ ID NO: 3788352 - DNA, 15 bp, Homo sapiens
agtgtgggaagggag

SEQ ID NO: 3788353 - DNA, 16 bp, Homo sapiens
agtgtgtattgttccc

SEQ ID NO: 3788354 - DNA, 19 bp, Homo sapiens
agtgtgtctcctgcatgca

SEQ ID NO: 3788355 - DNA, 16 bp, Homo sapiens
agtgtgtgcatgtgtg

SEQ ID NO: 3788356 - DNA, 17 bp, Homo sapiens
agtgtgtgcatgtgtgc

SEQ ID NO: 3788357 - DNA, 17 bp, Homo sapiens
agtgtgtgcatgtgtgt

SEQ ID NO: 3788358 - DNA, 18 bp, Homo sapiens
agtgtgtgcatgtgtgtg

SEQ ID NO: 3788359 - DNA, 20 bp, Homo sapiens
agtgtgtttccttcagtgca

SEQ ID NO: 3788360 - DNA, 16 bp, Homo sapiens
agtgttgaaaatgttc

SEQ ID NO: 3788361 - DNA, 17 bp, Homo sapiens
agtgttgaaaatgttca

SEQ ID NO: 3788362 - DNA, 18 bp, Homo sapiens
agtgttgtttgtaaataa

SEQ ID NO: 3788363 - DNA, 19 bp, Homo sapiens
agtgttgtttgtaaataag

SEQ ID NO: 3788364 - DNA, 12 bp, Homo sapiens
agtgttttcaga

SEQ ID NO: 3788365 - DNA, 15 bp, Homo sapiens
agttaaaaaaaataa

SEQ ID NO: 3788366 - DNA, 19 bp, Homo sapiens
agttaaaaaaaataataaa

SEQ ID NO: 3788367 - DNA, 12 bp, Homo sapiens
agttaaataaat

SEQ ID NO: 3788368 - DNA, 21 bp, Homo sapiens
agttaaatagagtatatgcac

SEQ ID NO: 3788369 - DNA, 13 bp, Homo sapiens
agttaacaaggaa

SEQ ID NO: 3788370 - DNA, 14 bp, Homo sapiens
agttaacaaggaat

SEQ ID NO: 3788371 - DNA, 16 bp, Homo sapiens
agttaacaaggaatgc

SEQ ID NO: 3788372 - DNA, 14 bp, Homo sapiens
agttaagaaaaaaa

SEQ ID NO: 3788373 - DNA, 18 bp, Homo sapiens
agttaatcttgctttctt

SEQ ID NO: 3788374 - DNA, 18 bp, Homo sapiens
agttacactaaaaggtga

SEQ ID NO: 3788375 - DNA, 16 bp, Homo sapiens
agttactatcctggct

SEQ ID NO: 3788376 - DNA, 12 bp, Homo sapiens
agttactcagcc

SEQ ID NO: 3788377 - DNA, 13 bp, Homo sapiens
agttactcagccc

SEQ ID NO: 3788378 - DNA, 14 bp, Homo sapiens
agttactcagccct

SEQ ID NO: 3788379 - DNA, 17 bp, Homo sapiens
agttactcagccctggg

SEQ ID NO: 3788380 - DNA, 19 bp, Homo sapiens
agttactttgtcagaggca

SEQ ID NO: 3788381 - DNA, 19 bp, Homo sapiens
agttagaggccagcctggc

SEQ ID NO: 3788382 - DNA, 13 bp, Homo sapiens
agttaggaaataa

SEQ ID NO: 3788383 - DNA, 15 bp, Homo sapiens
agttaggaaataaaa

SEQ ID NO: 3788384 - DNA, 17 bp, Homo sapiens
agttaggaaataaaacc

SEQ ID NO: 3788385 - DNA, 20 bp, Homo sapiens
agttaggaaataaaaccttt

SEQ ID NO: 3788386 - DNA, 14 bp, Homo sapiens
agttagtagcatgt

SEQ ID NO: 3788387 - DNA, 17 bp, Homo sapiens
agttagtagcatgttga

SEQ ID NO: 3788388 - DNA, 18 bp, Homo sapiens
agttatggcctatacact

SEQ ID NO: 3788389 - DNA, 15 bp, Homo sapiens
agttatggtgccgaa

SEQ ID NO: 3788390 - DNA, 14 bp, Homo sapiens
agttatgtgaatga

SEQ ID NO: 3788391 - DNA, 17 bp, Homo sapiens
agttattaatttcttca

SEQ ID NO: 3788392 - DNA, 17 bp, Homo sapiens
agttattgacaaactct

SEQ ID NO: 3788393 - DNA, 18 bp, Homo sapiens
agttattgacaaactctc

SEQ ID NO: 3788394 - DNA, 18 bp, Homo sapiens
agttatttcttgtttgtt

SEQ ID NO: 3788395 - DNA, 16 bp, Homo sapiens
agttcaagaccagcct

SEQ ID NO: 3788396 - DNA, 21 bp, Homo sapiens
agttcactataaatggtgttt

SEQ ID NO: 3788397 - DNA, 17 bp, Homo sapiens
agttcagcaccacccta

SEQ ID NO: 3788398 - DNA, 15 bp, Homo sapiens
agttcagctgcttct

SEQ ID NO: 3788399 - DNA, 19 bp, Homo sapiens
agttcaggtaacaggcaga

SEQ ID NO: 3788400 - DNA, 20 bp, Homo sapiens
agttcaggtagctgcccctg

SEQ ID NO: 3788401 - DNA, 18 bp, Homo sapiens
agttcataacagtgccat

SEQ ID NO: 3788402 - DNA, 19 bp, Homo sapiens
agttcataacagtgccatt

SEQ ID NO: 3788403 - DNA, 22 bp, Homo sapiens
agttcatatgtaccatgtacat

SEQ ID NO: 3788404 - DNA, 19 bp, Homo sapiens
agttcatcagagttatggt

SEQ ID NO: 3788405 - DNA, 20 bp, Homo sapiens
agttcatcagagttatggtg

SEQ ID NO: 3788406 - DNA, 16 bp, Homo sapiens
agttcatccaatcctc

SEQ ID NO: 3788407 - DNA, 22 bp, Homo sapiens
agttcatccaatcctcactggg

SEQ ID NO: 3788408 - DNA, 15 bp, Homo sapiens
agttcccatgttaaa

SEQ ID NO: 3788409 - DNA, 18 bp, Homo sapiens
agttcctaacaggatgaa

SEQ ID NO: 3788410 - DNA, 15 bp, Homo sapiens
agttcctcgccctgg

SEQ ID NO: 3788411 - DNA, 16 bp, Homo sapiens
agttcctcgccctggg

SEQ ID NO: 3788412 - DNA, 20 bp, Homo sapiens
agttccttcagcttccattt

SEQ ID NO: 3788413 - DNA, 14 bp, Homo sapiens
agttcgagaccagc

SEQ ID NO: 3788414 - DNA, 18 bp, Homo sapiens
agttcgagaccagcctgg

SEQ ID NO: 3788415 - DNA, 15 bp, Homo sapiens
agttctatttaagtg

SEQ ID NO: 3788416 - DNA, 14 bp, Homo sapiens
agttctatttctat

SEQ ID NO: 3788417 - DNA, 20 bp, Homo sapiens
agttctgcaaatagaaaaca

SEQ ID NO: 3788418 - DNA, 13 bp, Homo sapiens
agttctgtgtatt

SEQ ID NO: 3788419 - DNA, 22 bp, Homo sapiens
agttcttaaggattgtgatatt

SEQ ID NO: 3788420 - DNA, 18 bp, Homo sapiens
agttcttagatatctttt

SEQ ID NO: 3788421 - DNA, 17 bp, Homo sapiens
agttgaaaaacagctga

SEQ ID NO: 3788422 - DNA, 16 bp, Homo sapiens
agttgaagctaagatt

SEQ ID NO: 3788423 - DNA, 14 bp, Homo sapiens
agttgaatctattg

SEQ ID NO: 3788424 - DNA, 22 bp, Homo sapiens
agttgacttgacagaacactgt

SEQ ID NO: 3788425 - DNA, 16 bp, Homo sapiens
agttgaggagtttcct

SEQ ID NO: 3788426 - DNA, 18 bp, Homo sapiens
agttgcaattgaattaaa

SEQ ID NO: 3788427 - DNA, 20 bp, Homo sapiens
agttgcaattgaattaaatt

SEQ ID NO: 3788428 - DNA, 20 bp, Homo sapiens
agttgcacttggcctctgga

SEQ ID NO: 3788429 - DNA, 16 bp, Homo sapiens
agttgcagactcagtt

SEQ ID NO: 3788430 - DNA, 18 bp, Homo sapiens
agttgcagactcagtttg

SEQ ID NO: 3788431 - DNA, 23 bp, Homo sapiens
agttgcagactcagtttgtcaga

SEQ ID NO: 3788432 - DNA, 13 bp, Homo sapiens
agttggactgggt

SEQ ID NO: 3788433 - DNA, 19 bp, Homo sapiens
agttggagtgagtgtggct

SEQ ID NO: 3788434 - DNA, 16 bp, Homo sapiens
agttggccagagagcc

SEQ ID NO: 3788435 - DNA, 19 bp, Homo sapiens
agttggcttctgtttctag

SEQ ID NO: 3788436 - DNA, 17 bp, Homo sapiens
agttgggtggatgcctg

SEQ ID NO: 3788437 - DNA, 21 bp, Homo sapiens
agttgggtggatgcctggtgg

SEQ ID NO: 3788438 - DNA, 22 bp, Homo sapiens
agttggtaagcttccaggaaaa

SEQ ID NO: 3788439 - DNA, 16 bp, Homo sapiens
atattcattgtataaa

SEQ ID NO: 3788440 - DNA, 23 bp, Homo sapiens
atattcattgtataaaaatagaa

SEQ ID NO: 3788441 - DNA, 13 bp, Homo sapiens
atattcatttcaa

SEQ ID NO: 3788442 - DNA, 12 bp, Homo sapiens
atattccatagt

SEQ ID NO: 3788443 - DNA, 20 bp, Homo sapiens
atattccatagtatattaaa

SEQ ID NO: 3788444 - DNA, 22 bp, Homo sapiens
atattccatagtatattaaaaa

SEQ ID NO: 3788445 - DNA, 18 bp, Homo sapiens
atattccatatattagca

SEQ ID NO: 3788446 - DNA, 18 bp, Homo sapiens
atattcctgaatgaaata

SEQ ID NO: 3788447 - DNA, 22 bp, Homo sapiens
atattctcacgggcagtagctg

SEQ ID NO: 3788448 - DNA, 20 bp, Homo sapiens
atattgttattatataatta

SEQ ID NO: 3788449 - DNA, 18 bp, Homo sapiens
atattgttcctaagttct

SEQ ID NO: 3788450 - DNA, 20 bp, Homo sapiens
atattgttttcagtgtacat

SEQ ID NO: 3788451 - DNA, 19 bp, Homo sapiens
atatttaagaaaatacaat

SEQ ID NO: 3788452 - DNA, 20 bp, Homo sapiens
atatttacatatgaaattta

SEQ ID NO: 3788453 - DNA, 17 bp, Homo sapiens
atatttataactcatca

SEQ ID NO: 3788454 - DNA, 15 bp, Homo sapiens
atatttatagtcaca

SEQ ID NO: 3788455 - DNA, 22 bp, Homo sapiens
atatttatataattatgttatt

SEQ ID NO: 3788456 - DNA, 15 bp, Homo sapiens
atatttatatttcac

SEQ ID NO: 3788457 - DNA, 19 bp, Homo sapiens
atatttatggggggagaac

SEQ ID NO: 3788458 - DNA, 20 bp, Homo sapiens
atatttatgtagatgtgcat

SEQ ID NO: 3788459 - DNA, 21 bp, Homo sapiens
atatttattttctttctgtaa

SEQ ID NO: 3788460 - DNA, 21 bp, Homo sapiens
atatttccttaaactgtgtgg

SEQ ID NO: 3788461 - DNA, 12 bp, Homo sapiens
atatttgtacat

SEQ ID NO: 3788462 - DNA, 13 bp, Homo sapiens
atatttgtacata

SEQ ID NO: 3788463 - DNA, 14 bp, Homo sapiens
atattttaagcatt

SEQ ID NO: 3788464 - DNA, 17 bp, Homo sapiens
atattttaagcattact

SEQ ID NO: 3788465 - DNA, 20 bp, Homo sapiens
atattttatgtgagagaaag

SEQ ID NO: 3788466 - DNA, 23 bp, Homo sapiens
atattttcaattcaaaaatgtac

SEQ ID NO: 3788467 - DNA, 19 bp, Homo sapiens
atattttcttccaagcaaa

SEQ ID NO: 3788468 - DNA, 13 bp, Homo sapiens
atattttgtttct

SEQ ID NO: 3788469 - DNA, 15 bp, Homo sapiens
atatttttaattaaa

SEQ ID NO: 3788470 - DNA, 16 bp, Homo sapiens
atatttttattttatt

SEQ ID NO: 3788471 - DNA, 19 bp, Homo sapiens
atatttttgtttgttttgt

SEQ ID NO: 3788472 - DNA, 19 bp, Homo sapiens
atcaaaataaattgaaata

SEQ ID NO: 3788473 - DNA, 14 bp, Homo sapiens
atcaaacagctcag

SEQ ID NO: 3788474 - DNA, 15 bp, Homo sapiens
atcaaactgaagcca

SEQ ID NO: 3788475 - DNA, 19 bp, Homo sapiens
atcaaagaggttttaaaaa

SEQ ID NO: 3788476 - DNA, 20 bp, Homo sapiens
atcaaagaggttttaaaaaa

SEQ ID NO: 3788477 - DNA, 20 bp, Homo sapiens
atcaaatttcacgtcgtctt

SEQ ID NO: 3788478 - DNA, 13 bp, Homo sapiens
atcaactctaata

SEQ ID NO: 3788479 - DNA, 15 bp, Homo sapiens
atcaagaaagtgttg

SEQ ID NO: 3788480 - DNA, 16 bp, Homo sapiens
atcaagcacagaagga

SEQ ID NO: 3788481 - DNA, 13 bp, Homo sapiens
atcaagctaataa

SEQ ID NO: 3788482 - DNA, 14 bp, Homo sapiens
atcaaggtcgtttt

SEQ ID NO: 3788483 - DNA, 23 bp, Homo sapiens
atcaagttggcttctaatcaaag

SEQ ID NO: 3788484 - DNA, 20 bp, Homo sapiens
atcaagtttccaagcaaatg

SEQ ID NO: 3788485 - DNA, 21 bp, Homo sapiens
atcaagtttccaagcaaatgt

SEQ ID NO: 3788486 - DNA, 23 bp, Homo sapiens
atcaatcctgtgtggtttagtgt

SEQ ID NO: 3788487 - DNA, 14 bp, Homo sapiens
atcaattaaatgta

SEQ ID NO: 3788488 - DNA, 11 bp, Homo sapiens
atcacacacac

SEQ ID NO: 3788489 - DNA, 16 bp, Homo sapiens
atcacacttctgtgag

SEQ ID NO: 3788490 - DNA, 18 bp, Homo sapiens
atcacacttctgtgagac

SEQ ID NO: 3788491 - DNA, 21 bp, Homo sapiens
atcacagcttcagccaggagc

SEQ ID NO: 3788492 - DNA, 19 bp, Homo sapiens
atcacagggcagagccggg

SEQ ID NO: 3788493 - DNA, 20 bp, Homo sapiens
atcacagggcagagccggga

SEQ ID NO: 3788494 - DNA, 18 bp, Homo sapiens
atcacagggttgggccca

SEQ ID NO: 3788495 - DNA, 20 bp, Homo sapiens
atcacagggttgggcccaga

SEQ ID NO: 3788496 - DNA, 14 bp, Homo sapiens
atcacctcaggcca

SEQ ID NO: 3788497 - DNA, 15 bp, Homo sapiens
atcacctcaggccag

SEQ ID NO: 3788498 - DNA, 12 bp, Homo sapiens
atcacctgaggt

SEQ ID NO: 3788499 - DNA, 17 bp, Homo sapiens
atcaccttaggcaggga

SEQ ID NO: 3788500 - DNA, 13 bp, Homo sapiens
atcacgccactgc

SEQ ID NO: 3788501 - DNA, 14 bp, Homo sapiens
atcacgccactgca

SEQ ID NO: 3788502 - DNA, 15 bp, Homo sapiens
atcacgccactgcac

SEQ ID NO: 3788503 - DNA, 17 bp, Homo sapiens
atcacgccactgcactc

SEQ ID NO: 3788504 - DNA, 23 bp, Homo sapiens
atcacgccactgcactccagcct

SEQ ID NO: 3788505 - DNA, 19 bp, Homo sapiens
atcacggctcactgcagcc

SEQ ID NO: 3788506 - DNA, 13 bp, Homo sapiens
atcactaacatta

SEQ ID NO: 3788507 - DNA, 14 bp, Homo sapiens
atcactaacattat

SEQ ID NO: 3788508 - DNA, 18 bp, Homo sapiens
atcactaacattatattg

SEQ ID NO: 3788509 - DNA, 16 bp, Homo sapiens
atcactgctcacactg

SEQ ID NO: 3788510 - DNA, 15 bp, Homo sapiens
atcactggagcccag

SEQ ID NO: 3788511 - DNA, 16 bp, Homo sapiens
atcactggagcccagg

SEQ ID NO: 3788512 - DNA, 18 bp, Homo sapiens
atcactggcaatgaaaaa

SEQ ID NO: 3788513 - DNA, 16 bp, Homo sapiens
atcacttgtacaaaat

SEQ ID NO: 3788514 - DNA, 22 bp, Homo sapiens
atcagaaagtaatttcttctca

SEQ ID NO: 3788515 - DNA, 14 bp, Homo sapiens
atcagaacagcaga

SEQ ID NO: 3788516 - DNA, 18 bp, Homo sapiens
atcagaagcctattgtaa

SEQ ID NO: 3788517 - DNA, 16 bp, Homo sapiens
atcagaccctacccca

SEQ ID NO: 3788518 - DNA, 19 bp, Homo sapiens
atcagaccctaccccacca

SEQ ID NO: 3788519 - DNA, 13 bp, Homo sapiens
atcagacctgtct

SEQ ID NO: 3788520 - DNA, 18 bp, Homo sapiens
atcagacttcacactgca

SEQ ID NO: 3788521 - DNA, 14 bp, Homo sapiens
atcagaggacacct

SEQ ID NO: 3788522 - DNA, 23 bp, Homo sapiens
atcagatgactagaaagtgaata

SEQ ID NO: 3788523 - DNA, 13 bp, Homo sapiens
atcagccagtgac

SEQ ID NO: 3788524 - DNA, 23 bp, Homo sapiens
atcagccctgcccttcagcatcc

SEQ ID NO: 3788525 - DNA, 15 bp, Homo sapiens
atcagcctcttaaag

SEQ ID NO: 3788526 - DNA, 13 bp, Homo sapiens
atcagctgctact

SEQ ID NO: 3788527 - DNA, 23 bp, Homo sapiens
atcagctgctactactcctgtag

SEQ ID NO: 3788528 - DNA, 16 bp, Homo sapiens
atcaggcctgccagac

SEQ ID NO: 3788529 - DNA, 15 bp, Homo sapiens
atcaggctatgtatg

SEQ ID NO: 3788530 - DNA, 14 bp, Homo sapiens
atcaggtgctgcca

SEQ ID NO: 3788531 - DNA, 15 bp, Homo sapiens
atcaggtgctgccat

SEQ ID NO: 3788532 - DNA, 17 bp, Homo sapiens
atcaggtgctgccatcc

SEQ ID NO: 3788533 - DNA, 13 bp, Homo sapiens
atcaggtggggag

SEQ ID NO: 3788534 - DNA, 18 bp, Homo sapiens
atcagtagccagcatctg

SEQ ID NO: 3788535 - DNA, 22 bp, Homo sapiens
atcagtggcatggctccagtct

SEQ ID NO: 3788536 - DNA, 17 bp, Homo sapiens
atcagttactcagccct

SEQ ID NO: 3788537 - DNA, 19 bp, Homo sapiens
atcagttcccccagtacct

SEQ ID NO: 3788538 - DNA, 20 bp, Homo sapiens
atcagttcccccagtacctc

SEQ ID NO: 3788539 - DNA, 22 bp, Homo sapiens
atcagttgaggccaggagttta

SEQ ID NO: 3788540 - DNA, 15 bp, Homo sapiens
atcataaaacttgat

SEQ ID NO: 3788541 - DNA, 12 bp, Homo sapiens
atcataaaataa

SEQ ID NO: 3788542 - DNA, 18 bp, Homo sapiens
atcatagatttctgattt

SEQ ID NO: 3788543 - DNA, 23 bp, Homo sapiens
atcatagatttctgattttatgt

SEQ ID NO: 3788544 - DNA, 23 bp, Homo sapiens
atcatagtggcttaaaacaacac

SEQ ID NO: 3788545 - DNA, 21 bp, Homo sapiens
atcatccactgtgccatgtgc

SEQ ID NO: 3788546 - DNA, 21 bp, Homo sapiens
atcatctattgctggcaaaga

SEQ ID NO: 3788547 - DNA, 14 bp, Homo sapiens
atcatgaaatatgc

SEQ ID NO: 3788548 - DNA, 16 bp, Homo sapiens
atcatgaaatatgcat

SEQ ID NO: 3788549 - DNA, 18 bp, Homo sapiens
atcatgaaatatgcatct

SEQ ID NO: 3788550 - DNA, 15 bp, Homo sapiens
atcatgagattgatg

SEQ ID NO: 3788551 - DNA, 17 bp, Homo sapiens
atcatgagattgatgca

SEQ ID NO: 3788552 - DNA, 14 bp, Homo sapiens
atgaaagaaaggcc

SEQ ID NO: 3788553 - DNA, 16 bp, Homo sapiens
atgaaagactgtacaa

SEQ ID NO: 3788554 - DNA, 20 bp, Homo sapiens
atgaaagactgtacaaagta

SEQ ID NO: 3788555 - DNA, 21 bp, Homo sapiens
atgaaaggtttacattgtcaa

SEQ ID NO: 3788556 - DNA, 18 bp, Homo sapiens
atgaaagtcttgtgacta

SEQ ID NO: 3788557 - DNA, 17 bp, Homo sapiens
atgaaataaatgcccca

SEQ ID NO: 3788558 - DNA, 15 bp, Homo sapiens
atgaaatatgcatct

SEQ ID NO: 3788559 - DNA, 12 bp, Homo sapiens
atgaaatgtttt

SEQ ID NO: 3788560 - DNA, 20 bp, Homo sapiens
atgaaattgtctagcagagc

SEQ ID NO: 3788561 - DNA, 18 bp, Homo sapiens
atgaaattttaccaagtt

SEQ ID NO: 3788562 - DNA, 21 bp, Homo sapiens
atgaaattttaccaagttata

SEQ ID NO: 3788563 - DNA, 18 bp, Homo sapiens
atgaacacatcagctagc

SEQ ID NO: 3788564 - DNA, 17 bp, Homo sapiens
atgaacatatatttttt

SEQ ID NO: 3788565 - DNA, 13 bp, Homo sapiens
atgaaccacatct

SEQ ID NO: 3788566 - DNA, 23 bp, Homo sapiens
atgaaccacatcttgctctgctg

SEQ ID NO: 3788567 - DNA, 15 bp, Homo sapiens
atgaacggtgagcat

SEQ ID NO: 3788568 - DNA, 13 bp, Homo sapiens
atgaactgcatgt

SEQ ID NO: 3788569 - DNA, 19 bp, Homo sapiens
atgaactgcatgtataaat

SEQ ID NO: 3788570 - DNA, 17 bp, Homo sapiens
atgaagaaaaaatacat

SEQ ID NO: 3788571 - DNA, 22 bp, Homo sapiens
atgaagaaaaaatacattttat

SEQ ID NO: 3788572 - DNA, 21 bp, Homo sapiens
atgaagatgtctaatagttat

SEQ ID NO: 3788573 - DNA, 14 bp, Homo sapiens
atgaagcaaacaca

SEQ ID NO: 3788574 - DNA, 15 bp, Homo sapiens
atgaagcaaacacat

SEQ ID NO: 3788575 - DNA, 17 bp, Homo sapiens
atgaagccacagcccag

SEQ ID NO: 3788576 - DNA, 15 bp, Homo sapiens
atgaataatttccca

SEQ ID NO: 3788577 - DNA, 15 bp, Homo sapiens
atgaatatttataac

SEQ ID NO: 3788578 - DNA, 18 bp, Homo sapiens
atgaatatttataacagc

SEQ ID NO: 3788579 - DNA, 17 bp, Homo sapiens
atgaatgaaacattttg

SEQ ID NO: 3788580 - DNA, 19 bp, Homo sapiens
atgaatgaggtcccaggca

SEQ ID NO: 3788581 - DNA, 13 bp, Homo sapiens
atgaatgtatcag

SEQ ID NO: 3788582 - DNA, 16 bp, Homo sapiens
atgaatgtatcaggaa

SEQ ID NO: 3788583 - DNA, 11 bp, Homo sapiens
atgaatgttta

SEQ ID NO: 3788584 - DNA, 13 bp, Homo sapiens
atgaatttctcta

SEQ ID NO: 3788585 - DNA, 21 bp, Homo sapiens
atgaatttggagactctgtgg

SEQ ID NO: 3788586 - DNA, 14 bp, Homo sapiens
atgacaacttctaa

SEQ ID NO: 3788587 - DNA, 19 bp, Homo sapiens
atgacaacttctaattgcc

SEQ ID NO: 3788588 - DNA, 20 bp, Homo sapiens
atgacaacttctaattgcca

SEQ ID NO: 3788589 - DNA, 19 bp, Homo sapiens
atgacaagtgagacaaaaa

SEQ ID NO: 3788590 - DNA, 16 bp, Homo sapiens
atgacactgaaatgcc

SEQ ID NO: 3788591 - DNA, 21 bp, Homo sapiens
atgacactgagaacagatctc

SEQ ID NO: 3788592 - DNA, 16 bp, Homo sapiens
atgacagctgtccctg

SEQ ID NO: 3788593 - DNA, 14 bp, Homo sapiens
atgacatcacttgt

SEQ ID NO: 3788594 - DNA, 17 bp, Homo sapiens
atgaccatactgaggga

SEQ ID NO: 3788595 - DNA, 18 bp, Homo sapiens
atgacccaggctgcctga

SEQ ID NO: 3788596 - DNA, 11 bp, Homo sapiens
atgacccctcc

SEQ ID NO: 3788597 - DNA, 17 bp, Homo sapiens
atgaccttctaggaagc

SEQ ID NO: 3788598 - DNA, 19 bp, Homo sapiens
atgacggaagaacatagaa

SEQ ID NO: 3788599 - DNA, 12 bp, Homo sapiens
atgactaaagag

SEQ ID NO: 3788600 - DNA, 20 bp, Homo sapiens
atgactagaaagtgaataaa

SEQ ID NO: 3788601 - DNA, 13 bp, Homo sapiens
atgactggaattt

SEQ ID NO: 3788602 - DNA, 22 bp, Homo sapiens
atgactggaatttttattatgc

SEQ ID NO: 3788603 - DNA, 21 bp, Homo sapiens
atgagaaaggttgaagcacca

SEQ ID NO: 3788604 - DNA, 22 bp, Homo sapiens
atgagaaaggttgaagcaccaa

SEQ ID NO: 3788605 - DNA, 17 bp, Homo sapiens
atgagaacatgttggta

SEQ ID NO: 3788606 - DNA, 18 bp, Homo sapiens
atgagaaggaatttgagt

SEQ ID NO: 3788607 - DNA, 16 bp, Homo sapiens
atgagaattcagctgc

SEQ ID NO: 3788608 - DNA, 19 bp, Homo sapiens
atgagaattcagctgcccc

SEQ ID NO: 3788609 - DNA, 18 bp, Homo sapiens
atgagaccactgttatca

SEQ ID NO: 3788610 - DNA, 22 bp, Homo sapiens
atgagatctaggtgaggattga

SEQ ID NO: 3788611 - DNA, 15 bp, Homo sapiens
atgagcagaagctct

SEQ ID NO: 3788612 - DNA, 11 bp, Homo sapiens
atgagccagac

SEQ ID NO: 3788613 - DNA, 12 bp, Homo sapiens
atgagcctcagc

SEQ ID NO: 3788614 - DNA, 17 bp, Homo sapiens
atgagcctcagcatcct

SEQ ID NO: 3788615 - DNA, 14 bp, Homo sapiens
atgagctccagacc

SEQ ID NO: 3788616 - DNA, 15 bp, Homo sapiens
atgagctccagaccc

SEQ ID NO: 3788617 - DNA, 17 bp, Homo sapiens
atgagctccagaccccc

SEQ ID NO: 3788618 - DNA, 20 bp, Homo sapiens
atgagctccagacccccagc

SEQ ID NO: 3788619 - DNA, 21 bp, Homo sapiens
atgagctcgcatttgtcaatg

SEQ ID NO: 3788620 - DNA, 18 bp, Homo sapiens
atgaggagtgaacatttg

SEQ ID NO: 3788621 - DNA, 18 bp, Homo sapiens
atgaggcaatgtcaggaa

SEQ ID NO: 3788622 - DNA, 18 bp, Homo sapiens
atgaggtcagagcctgca

SEQ ID NO: 3788623 - DNA, 19 bp, Homo sapiens
atgaggtcagagcctgcag

SEQ ID NO: 3788624 - DNA, 18 bp, Homo sapiens
atgaggtcccaggcagag

SEQ ID NO: 3788625 - DNA, 14 bp, Homo sapiens
atgaggtgctggga

SEQ ID NO: 3788626 - DNA, 16 bp, Homo sapiens
atgagtgtaacaagaa

SEQ ID NO: 3788627 - DNA, 20 bp, Homo sapiens
atgagttgttttcagactca

SEQ ID NO: 3788628 - DNA, 22 bp, Homo sapiens
atgagttgttttcagactcaga

SEQ ID NO: 3788629 - DNA, 15 bp, Homo sapiens
atgagtttgccctgg

SEQ ID NO: 3788630 - DNA, 21 bp, Homo sapiens
atgagtttttgatagctttat

SEQ ID NO: 3788631 - DNA, 21 bp, Homo sapiens
atgataaaaaattttgtaatt

SEQ ID NO: 3788632 - DNA, 15 bp, Homo sapiens
atgataaaacacaaa

SEQ ID NO: 3788633 - DNA, 14 bp, Homo sapiens
atgatattccatag

SEQ ID NO: 3788634 - DNA, 19 bp, Homo sapiens
atgatattccatagtatat

SEQ ID NO: 3788635 - DNA, 18 bp, Homo sapiens
atgatcacggctcactgc

SEQ ID NO: 3788636 - DNA, 18 bp, Homo sapiens
atgatcagctgtttgtca

SEQ ID NO: 3788637 - DNA, 16 bp, Homo sapiens
atgatcctaggcattt

SEQ ID NO: 3788638 - DNA, 14 bp, Homo sapiens
atgatctctctgaa

SEQ ID NO: 3788639 - DNA, 14 bp, Homo sapiens
atgatctctgatga

SEQ ID NO: 3788640 - DNA, 14 bp, Homo sapiens
atgatcttctttat

SEQ ID NO: 3788641 - DNA, 18 bp, Homo sapiens
atgatcttctttataatt

SEQ ID NO: 3788642 - DNA, 15 bp, Homo sapiens
atgatcttgtgacat

SEQ ID NO: 3788643 - DNA, 17 bp, Homo sapiens
atgatctttgcagacag

SEQ ID NO: 3788644 - DNA, 21 bp, Homo sapiens
atgatctttgcagacaggcaa

SEQ ID NO: 3788645 - DNA, 18 bp, Homo sapiens
atgatgaaatgaggtcag

SEQ ID NO: 3788646 - DNA, 11 bp, Homo sapiens
atgatgcacat

SEQ ID NO: 3788647 - DNA, 21 bp, Homo sapiens
atgatgcttgtaacaagaaaa

SEQ ID NO: 3788648 - DNA, 19 bp, Homo sapiens
atgatgtgggtcaaggaat

SEQ ID NO: 3788649 - DNA, 17 bp, Homo sapiens
atgatgttgaatatttg

SEQ ID NO: 3788650 - DNA, 21 bp, Homo sapiens
atgatgtttcgtgaagtatac

SEQ ID NO: 3788651 - DNA, 16 bp, Homo sapiens
atgattaattcacctt

SEQ ID NO: 3788652 - DNA, 23 bp, Homo sapiens
atgattagcaagttacagtgatg

SEQ ID NO: 3788653 - DNA, 15 bp, Homo sapiens
atgatttactcatta

SEQ ID NO: 3788654 - DNA, 18 bp, Homo sapiens
atgatttagagtgctgtc

SEQ ID NO: 3788655 - DNA, 20 bp, Homo sapiens
atgatttcatgctatctctg

SEQ ID NO: 3788656 - DNA, 21 bp, Homo sapiens
atgcaacaacatgtataatat

SEQ ID NO: 3788657 - DNA, 15 bp, Homo sapiens
atgcaaggaaggaaa

SEQ ID NO: 3788658 - DNA, 13 bp, Homo sapiens
atgcaataaataa

SEQ ID NO: 3788659 - DNA, 19 bp, Homo sapiens
atgcaatgacatcttcaaa

SEQ ID NO: 3788660 - DNA, 22 bp, Homo sapiens
atgcacactagcctctccagga

SEQ ID NO: 3788661 - DNA, 14 bp, Homo sapiens
atgcacatccctgg

SEQ ID NO: 3788662 - DNA, 24 bp, Homo sapiens
atgcacctgaatgttagatagtta

SEQ ID NO: 3788663 - DNA, 16 bp, Homo sapiens
atgcagatgccagagc

SEQ ID NO: 3788664 - DNA, 13 bp, Homo sapiens
atgcagcagcttg

SEQ ID NO: 3788665 - DNA, 21 bp, Homo sapiens
atgttaacctcagtgtcattt

SEQ ID NO: 3788666 - DNA, 18 bp, Homo sapiens
atgttaatcctagctgtg

SEQ ID NO: 3788667 - DNA, 20 bp, Homo sapiens
atgttacataagataaatgt

SEQ ID NO: 3788668 - DNA, 13 bp, Homo sapiens
atgttactgacca

SEQ ID NO: 3788669 - DNA, 16 bp, Homo sapiens
atgttactgatcatgc

SEQ ID NO: 3788670 - DNA, 19 bp, Homo sapiens
atgttactgatcatgcatt

SEQ ID NO: 3788671 - DNA, 21 bp, Homo sapiens
atgttactgatcatgcattgt

SEQ ID NO: 3788672 - DNA, 15 bp, Homo sapiens
atgttagcaaagagt

SEQ ID NO: 3788673 - DNA, 16 bp, Homo sapiens
atgttagggtgctctg

SEQ ID NO: 3788674 - DNA, 15 bp, Homo sapiens
atgttatagtgaatt

SEQ ID NO: 3788675 - DNA, 23 bp, Homo sapiens
atgttatcttggtgtgttaagag

SEQ ID NO: 3788676 - DNA, 23 bp, Homo sapiens
atgttatgataaaaaattttgta

SEQ ID NO: 3788677 - DNA, 17 bp, Homo sapiens
atgttatgcataaagtc

SEQ ID NO: 3788678 - DNA, 22 bp, Homo sapiens
atgttcattgtaatgttactga

SEQ ID NO: 3788679 - DNA, 17 bp, Homo sapiens
atgttctctcttctcca

SEQ ID NO: 3788680 - DNA, 17 bp, Homo sapiens
atgttctgacattaaca

SEQ ID NO: 3788681 - DNA, 18 bp, Homo sapiens
atgttctgacattaacag

SEQ ID NO: 3788682 - DNA, 20 bp, Homo sapiens
atgttctgacattaacagtt

SEQ ID NO: 3788683 - DNA, 13 bp, Homo sapiens
atgttctgggaca

SEQ ID NO: 3788684 - DNA, 20 bp, Homo sapiens
atgttcttagtggatgttct

SEQ ID NO: 3788685 - DNA, 12 bp, Homo sapiens
atgttgaaagat

SEQ ID NO: 3788686 - DNA, 12 bp, Homo sapiens
atgttgcccagg

SEQ ID NO: 3788687 - DNA, 13 bp, Homo sapiens
atgttgcccaggc

SEQ ID NO: 3788688 - DNA, 14 bp, Homo sapiens
atgttgcccaggca

SEQ ID NO: 3788689 - DNA, 15 bp, Homo sapiens
atgttgcccaggcag

SEQ ID NO: 3788690 - DNA, 16 bp, Homo sapiens
atgttgcccaggcagg

SEQ ID NO: 3788691 - DNA, 15 bp, Homo sapiens
atgttgctggactgt

SEQ ID NO: 3788692 - DNA, 19 bp, Homo sapiens
atgttgctggactgtcata

SEQ ID NO: 3788693 - DNA, 14 bp, Homo sapiens
atgttggccaggct

SEQ ID NO: 3788694 - DNA, 17 bp, Homo sapiens
atgttggccaggctggt

SEQ ID NO: 3788695 - DNA, 21 bp, Homo sapiens
atgttggtatttatctattgt

SEQ ID NO: 3788696 - DNA, 14 bp, Homo sapiens
atgttgtgaagatg

SEQ ID NO: 3788697 - DNA, 16 bp, Homo sapiens
atgttgtggtttgttg

SEQ ID NO: 3788698 - DNA, 15 bp, Homo sapiens
atgttgttatttaaa

SEQ ID NO: 3788699 - DNA, 16 bp, Homo sapiens
atgtttaaaaaagttt

SEQ ID NO: 3788700 - DNA, 17 bp, Homo sapiens
atgtttaaaaaagttta

SEQ ID NO: 3788701 - DNA, 21 bp, Homo sapiens
atgtttaagatttaatttgcc

SEQ ID NO: 3788702 - DNA, 18 bp, Homo sapiens
atgtttacactctttgta

SEQ ID NO: 3788703 - DNA, 19 bp, Homo sapiens
atgtttacactctttgtaa

SEQ ID NO: 3788704 - DNA, 14 bp, Homo sapiens
atgtttatgagcca

SEQ ID NO: 3788705 - DNA, 21 bp, Homo sapiens
atgtttatgagccagacaaat

SEQ ID NO: 3788706 - DNA, 19 bp, Homo sapiens
atgtttcacgaagtttgtt

SEQ ID NO: 3788707 - DNA, 18 bp, Homo sapiens
atgtttcaggaggctgga

SEQ ID NO: 3788708 - DNA, 15 bp, Homo sapiens
atgtttcttctaggt

SEQ ID NO: 3788709 - DNA, 15 bp, Homo sapiens
atgtttgcctctgcc

SEQ ID NO: 3788710 - DNA, 22 bp, Homo sapiens
atgtttgcctctgcctctgaca

SEQ ID NO: 3788711 - DNA, 16 bp, Homo sapiens
atgtttgctcagaaca

SEQ ID NO: 3788712 - DNA, 23 bp, Homo sapiens
atgtttgggagactgctgagtca

SEQ ID NO: 3788713 - DNA, 16 bp, Homo sapiens
atgttttaagaggcag

SEQ ID NO: 3788714 - DNA, 18 bp, Homo sapiens
atgttttctttgctttaa

SEQ ID NO: 3788715 - DNA, 16 bp, Homo sapiens
atgtttttaaatatat

SEQ ID NO: 3788716 - DNA, 17 bp, Homo sapiens
atgtttttaaatatatt

SEQ ID NO: 3788717 - DNA, 22 bp, Homo sapiens
atgtttttctgccagggagctt

SEQ ID NO: 3788718 - DNA, 12 bp, Homo sapiens
attaaaaaattt

SEQ ID NO: 3788719 - DNA, 17 bp, Homo sapiens
attaaaaaatttccagt

SEQ ID NO: 3788720 - DNA, 11 bp, Homo sapiens
attaaaacaat

SEQ ID NO: 3788721 - DNA, 13 bp, Homo sapiens
attaaaacaatgt

SEQ ID NO: 3788722 - DNA, 17 bp, Homo sapiens
attaaacaatttatttt

SEQ ID NO: 3788723 - DNA, 14 bp, Homo sapiens
attaaaccctggat

SEQ ID NO: 3788724 - DNA, 13 bp, Homo sapiens
attaaagaaaata

SEQ ID NO: 3788725 - DNA, 15 bp, Homo sapiens
attaaagcatttact

SEQ ID NO: 3788726 - DNA, 18 bp, Homo sapiens
attaaagctaaagtatct

SEQ ID NO: 3788727 - DNA, 15 bp, Homo sapiens
attaaatatatgtat

SEQ ID NO: 3788728 - DNA, 16 bp, Homo sapiens
attaaatatatgtatg

SEQ ID NO: 3788729 - DNA, 18 bp, Homo sapiens
attaaatatatgtatgta

SEQ ID NO: 3788730 - DNA, 20 bp, Homo sapiens
attaaatatgttagcaaaga

SEQ ID NO: 3788731 - DNA, 18 bp, Homo sapiens
attaaattaggaataaat

SEQ ID NO: 3788732 - DNA, 16 bp, Homo sapiens
attaaatttttcctta

SEQ ID NO: 3788733 - DNA, 14 bp, Homo sapiens
attaacaaattatg

SEQ ID NO: 3788734 - DNA, 19 bp, Homo sapiens
attaacagttttccatgaa

SEQ ID NO: 3788735 - DNA, 20 bp, Homo sapiens
attaacatataatatatgtt

SEQ ID NO: 3788736 - DNA, 17 bp, Homo sapiens
attaacctggtgctgga

SEQ ID NO: 3788737 - DNA, 14 bp, Homo sapiens
attaagaaagacta

SEQ ID NO: 3788738 - DNA, 18 bp, Homo sapiens
attaagaatgttctcaat

SEQ ID NO: 3788739 - DNA, 13 bp, Homo sapiens
attaaggaagaca

SEQ ID NO: 3788740 - DNA, 16 bp, Homo sapiens
attaaggcaactgaac

SEQ ID NO: 3788741 - DNA, 19 bp, Homo sapiens
attaaggtctctctttgga

SEQ ID NO: 3788742 - DNA, 21 bp, Homo sapiens
attaaggtctctctttggact

SEQ ID NO: 3788743 - DNA, 14 bp, Homo sapiens
attaagtactatgt

SEQ ID NO: 3788744 - DNA, 20 bp, Homo sapiens
attaatatggggatgcagca

SEQ ID NO: 3788745 - DNA, 17 bp, Homo sapiens
attaatattcattgtat

SEQ ID NO: 3788746 - DNA, 19 bp, Homo sapiens
attaattcaccttccagtg

SEQ ID NO: 3788747 - DNA, 22 bp, Homo sapiens
attacaagcgtgagccactgca

SEQ ID NO: 3788748 - DNA, 18 bp, Homo sapiens
attacacaaatacttatt

SEQ ID NO: 3788749 - DNA, 14 bp, Homo sapiens
attacacccaaaga

SEQ ID NO: 3788750 - DNA, 17 bp, Homo sapiens
attacagagaggagaaa

SEQ ID NO: 3788751 - DNA, 18 bp, Homo sapiens
attacagagaggagaaac

SEQ ID NO: 3788752 - DNA, 21 bp, Homo sapiens
attacagagaggagaaacaca

SEQ ID NO: 3788753 - DNA, 22 bp, Homo sapiens
attacagagaggagaaacacat

SEQ ID NO: 3788754 - DNA, 21 bp, Homo sapiens
attacagatgggcaaattaag

SEQ ID NO: 3788755 - DNA, 18 bp, Homo sapiens
attacatccttgtggcac

SEQ ID NO: 3788756 - DNA, 16 bp, Homo sapiens
attacatctttcacat

SEQ ID NO: 3788757 - DNA, 16 bp, Homo sapiens
attacatgtaaaacat

SEQ ID NO: 3788758 - DNA, 14 bp, Homo sapiens
attaccactgaaga

SEQ ID NO: 3788759 - DNA, 13 bp, Homo sapiens
attaccatggaga

SEQ ID NO: 3788760 - DNA, 15 bp, Homo sapiens
attacccttctttcc

SEQ ID NO: 3788761 - DNA, 13 bp, Homo sapiens
attacctctgata

SEQ ID NO: 3788762 - DNA, 15 bp, Homo sapiens
attacggctcctctc

SEQ ID NO: 3788763 - DNA, 15 bp, Homo sapiens
attactctgaaattg

SEQ ID NO: 3788764 - DNA, 12 bp, Homo sapiens
attactcttgta

SEQ ID NO: 3788765 - DNA, 15 bp, Homo sapiens
attactcttgtaaga

SEQ ID NO: 3788766 - DNA, 16 bp, Homo sapiens
attactcttgtaagat

SEQ ID NO: 3788767 - DNA, 21 bp, Homo sapiens
attactcttgtaagattttga

SEQ ID NO: 3788768 - DNA, 22 bp, Homo sapiens
attactcttgtaagattttgaa

SEQ ID NO: 3788769 - DNA, 13 bp, Homo sapiens
attactgtcaata

SEQ ID NO: 3788770 - DNA, 19 bp, Homo sapiens
attacttatttttgacagt

SEQ ID NO: 3788771 - DNA, 12 bp, Homo sapiens
attacttctgct

SEQ ID NO: 3788772 - DNA, 16 bp, Homo sapiens
attagaaatagacagt

SEQ ID NO: 3788773 - DNA, 11 bp, Homo sapiens
attagaaatga

SEQ ID NO: 3788774 - DNA, 20 bp, Homo sapiens
attagaaattagctgtgtga

SEQ ID NO: 3788775 - DNA, 17 bp, Homo sapiens
attagaaattggctgga

SEQ ID NO: 3788776 - DNA, 14 bp, Homo sapiens
attagaagtgttaa

SEQ ID NO: 3788777 - DNA, 13 bp, Homo sapiens
attagagaagaga

SEQ ID NO: 3788778 - DNA, 17 bp, Homo sapiens
attagccacaaaattgg

SEQ ID NO: 3788779 - DNA, 22 bp, Homo sapiens
atttaaaggctaccttattgta

SEQ ID NO: 3788780 - DNA, 21 bp, Homo sapiens
atttaacaatgcgaatggtag

SEQ ID NO: 3788781 - DNA, 15 bp, Homo sapiens
atttaagataattat

SEQ ID NO: 3788782 - DNA, 12 bp, Homo sapiens
atttaagcattg

SEQ ID NO: 3788783 - DNA, 11 bp, Homo sapiens
atttaataaag

SEQ ID NO: 3788784 - DNA, 14 bp, Homo sapiens
atttaatatagcta

SEQ ID NO: 3788785 - DNA, 14 bp, Homo sapiens
atttaatgaaagac

SEQ ID NO: 3788786 - DNA, 15 bp, Homo sapiens
atttaattcatgttt

SEQ ID NO: 3788787 - DNA, 13 bp, Homo sapiens
atttaattgtaaa

SEQ ID NO: 3788788 - DNA, 15 bp, Homo sapiens
atttaattgtaaact

SEQ ID NO: 3788789 - DNA, 16 bp, Homo sapiens
atttaattgtaaactg

SEQ ID NO: 3788790 - DNA, 17 bp, Homo sapiens
atttaattgtaaactgt

SEQ ID NO: 3788791 - DNA, 17 bp, Homo sapiens
atttaatttgccaaaat

SEQ ID NO: 3788792 - DNA, 19 bp, Homo sapiens
atttacccttcttttctga

SEQ ID NO: 3788793 - DNA, 13 bp, Homo sapiens
atttactcattat

SEQ ID NO: 3788794 - DNA, 17 bp, Homo sapiens
atttacttcttatacat

SEQ ID NO: 3788795 - DNA, 19 bp, Homo sapiens
atttacttcttatacattt

SEQ ID NO: 3788796 - DNA, 18 bp, Homo sapiens
atttagcgtagctaagtg

SEQ ID NO: 3788797 - DNA, 22 bp, Homo sapiens
atttaggcagattgaaaaggac

SEQ ID NO: 3788798 - DNA, 23 bp, Homo sapiens
atttaggtttttgtttgtttcct

SEQ ID NO: 3788799 - DNA, 14 bp, Homo sapiens
atttataactcatc

SEQ ID NO: 3788800 - DNA, 16 bp, Homo sapiens
atttataatgttagta

SEQ ID NO: 3788801 - DNA, 19 bp, Homo sapiens
atttataattttaagattc

SEQ ID NO: 3788802 - DNA, 20 bp, Homo sapiens
atttatagtttatacagttt

SEQ ID NO: 3788803 - DNA, 15 bp, Homo sapiens
atttatataattatg

SEQ ID NO: 3788804 - DNA, 16 bp, Homo sapiens
atttatataattatgt

SEQ ID NO: 3788805 - DNA, 14 bp, Homo sapiens
atttatatatgtat

SEQ ID NO: 3788806 - DNA, 20 bp, Homo sapiens
atttatatatttataactca

SEQ ID NO: 3788807 - DNA, 22 bp, Homo sapiens
atttatatgtatccagtacatt

SEQ ID NO: 3788808 - DNA, 13 bp, Homo sapiens
atttatatttcac

SEQ ID NO: 3788809 - DNA, 13 bp, Homo sapiens
atttatatttttg

SEQ ID NO: 3788810 - DNA, 14 bp, Homo sapiens
atttatcacacaaa

SEQ ID NO: 3788811 - DNA, 19 bp, Homo sapiens
atttatcacacaaagcaga

SEQ ID NO: 3788812 - DNA, 16 bp, Homo sapiens
atttatcacacttctg

SEQ ID NO: 3788813 - DNA, 14 bp, Homo sapiens
atttatcagtgaca

SEQ ID NO: 3788814 - DNA, 15 bp, Homo sapiens
atttatcagtgacag

SEQ ID NO: 3788815 - DNA, 20 bp, Homo sapiens
atttatcctgaaatttcaga

SEQ ID NO: 3788816 - DNA, 23 bp, Homo sapiens
atttatctattgtaagataaaaa

SEQ ID NO: 3788817 - DNA, 19 bp, Homo sapiens
atttatctgagtcaactcc

SEQ ID NO: 3788818 - DNA, 16 bp, Homo sapiens
atttatctgtgcaaat

SEQ ID NO: 3788819 - DNA, 13 bp, Homo sapiens
atttatgaaaaga

SEQ ID NO: 3788820 - DNA, 15 bp, Homo sapiens
atttatgagtttttg

SEQ ID NO: 3788821 - DNA, 12 bp, Homo sapiens
atttatggagga

SEQ ID NO: 3788822 - DNA, 12 bp, Homo sapiens
atttatgtaaac

SEQ ID NO: 3788823 - DNA, 13 bp, Homo sapiens
atttatgtgtgag

SEQ ID NO: 3788824 - DNA, 21 bp, Homo sapiens
atttattaagatggattctca

SEQ ID NO: 3788825 - DNA, 23 bp, Homo sapiens
atttattaagatggattctcaga

SEQ ID NO: 3788826 - DNA, 14 bp, Homo sapiens
atttattcaagaaa

SEQ ID NO: 3788827 - DNA, 13 bp, Homo sapiens
atttattctgctc

SEQ ID NO: 3788828 - DNA, 14 bp, Homo sapiens
atttattgcacaaa

SEQ ID NO: 3788829 - DNA, 22 bp, Homo sapiens
atttattgctgtgtaacactgt

SEQ ID NO: 3788830 - DNA, 20 bp, Homo sapiens
atttattgtttatttatcag

SEQ ID NO: 3788831 - DNA, 17 bp, Homo sapiens
atttatttaatgttatg

SEQ ID NO: 3788832 - DNA, 20 bp, Homo sapiens
atttattttattttagcagt

SEQ ID NO: 3788833 - DNA, 14 bp, Homo sapiens
atttcaaaaatttg

SEQ ID NO: 3788834 - DNA, 20 bp, Homo sapiens
atttcaaaaatttggaattc

SEQ ID NO: 3788835 - DNA, 22 bp, Homo sapiens
atttcactatttttatttatat

SEQ ID NO: 3788836 - DNA, 22 bp, Homo sapiens
atttcagagaggccttttggaa

SEQ ID NO: 3788837 - DNA, 14 bp, Homo sapiens
atttcagatgcttt

SEQ ID NO: 3788838 - DNA, 18 bp, Homo sapiens
atttcagattcccagagc

SEQ ID NO: 3788839 - DNA, 15 bp, Homo sapiens
atttcagatttgtga

SEQ ID NO: 3788840 - DNA, 22 bp, Homo sapiens
atttcaggggtcgtcaccacct

SEQ ID NO: 3788841 - DNA, 20 bp, Homo sapiens
atttcaggttttgtaaagat

SEQ ID NO: 3788842 - DNA, 14 bp, Homo sapiens
atttcagtcttttc

SEQ ID NO: 3788843 - DNA, 14 bp, Homo sapiens
atttcatctatttc

SEQ ID NO: 3788844 - DNA, 18 bp, Homo sapiens
atttcatctatttctgag

SEQ ID NO: 3788845 - DNA, 14 bp, Homo sapiens
atttcattcctaac

SEQ ID NO: 3788846 - DNA, 20 bp, Homo sapiens
atttccagtacctttgtcac

SEQ ID NO: 3788847 - DNA, 15 bp, Homo sapiens
atttccattatttat

SEQ ID NO: 3788848 - DNA, 14 bp, Homo sapiens
atttcccaagctgg

SEQ ID NO: 3788849 - DNA, 17 bp, Homo sapiens
atttcccaattaggaag

SEQ ID NO: 3788850 - DNA, 16 bp, Homo sapiens
atttctaactctgatg

SEQ ID NO: 3788851 - DNA, 12 bp, Homo sapiens
atttctatttat

SEQ ID NO: 3788852 - DNA, 13 bp, Homo sapiens
atttctatttatt

SEQ ID NO: 3788853 - DNA, 16 bp, Homo sapiens
atttctatttatttac

SEQ ID NO: 3788854 - DNA, 18 bp, Homo sapiens
atttctatttttgtagaa

SEQ ID NO: 3788855 - DNA, 15 bp, Homo sapiens
atttctccatacgca

SEQ ID NO: 3788856 - DNA, 13 bp, Homo sapiens
atttcttaaacaa

SEQ ID NO: 3788857 - DNA, 21 bp, Homo sapiens
atttcttaaacaaatgtatga

SEQ ID NO: 3788858 - DNA, 20 bp, Homo sapiens
atttcttgggccctcctgaa

SEQ ID NO: 3788859 - DNA, 11 bp, Homo sapiens
atttgaaattt

SEQ ID NO: 3788860 - DNA, 15 bp, Homo sapiens
atttgaaatttagct

SEQ ID NO: 3788861 - DNA, 17 bp, Homo sapiens
atttgaaggtcttgatt

SEQ ID NO: 3788862 - DNA, 11 bp, Homo sapiens
atttgaatgaa

SEQ ID NO: 3788863 - DNA, 13 bp, Homo sapiens
atttgaatgaaaa

SEQ ID NO: 3788864 - DNA, 16 bp, Homo sapiens
atttgaatgaaaaatt

SEQ ID NO: 3788865 - DNA, 17 bp, Homo sapiens
atttgaatgggtccatt

SEQ ID NO: 3788866 - DNA, 15 bp, Homo sapiens
atttgagacattcca

SEQ ID NO: 3788867 - DNA, 13 bp, Homo sapiens
atttgaggtcaag

SEQ ID NO: 3788868 - DNA, 22 bp, Homo sapiens
atttgaggtcaagtaagaagac

SEQ ID NO: 3788869 - DNA, 19 bp, Homo sapiens
atttgagtgttttaagata

SEQ ID NO: 3788870 - DNA, 11 bp, Homo sapiens
atttgatgaaa

SEQ ID NO: 3788871 - DNA, 15 bp, Homo sapiens
atttgatgaaagctg

SEQ ID NO: 3788872 - DNA, 20 bp, Homo sapiens
atttgatgtttacaggtgga

SEQ ID NO: 3788873 - DNA, 15 bp, Homo sapiens
atttgcccatttaca

SEQ ID NO: 3788874 - DNA, 20 bp, Homo sapiens
atttgcccatttacactttt

SEQ ID NO: 3788875 - DNA, 15 bp, Homo sapiens
atttgcctgtgccac

SEQ ID NO: 3788876 - DNA, 21 bp, Homo sapiens
atttgcctgtttctgcttgct

SEQ ID NO: 3788877 - DNA, 11 bp, Homo sapiens
atttggagact

SEQ ID NO: 3788878 - DNA, 17 bp, Homo sapiens
atttggagactctgtgg

SEQ ID NO: 3788879 - DNA, 17 bp, Homo sapiens
atttggggttgcatcag

SEQ ID NO: 3788880 - DNA, 23 bp, Homo sapiens
atttggggttgcatcagaaatgt

SEQ ID NO: 3788881 - DNA, 19 bp, Homo sapiens
atttggtgaatttgaatct

SEQ ID NO: 3788882 - DNA, 22 bp, Homo sapiens
atttgtaaaaacagcattgctt

SEQ ID NO: 3788883 - DNA, 21 bp, Homo sapiens
atttgtacatagttatttatt

SEQ ID NO: 3788884 - DNA, 16 bp, Homo sapiens
atttgtacatatgtaa

SEQ ID NO: 3788885 - DNA, 16 bp, Homo sapiens
atttgtagggtttcta

SEQ ID NO: 3788886 - DNA, 15 bp, Homo sapiens
atttgtcaacaaagt

SEQ ID NO: 3788887 - DNA, 14 bp, Homo sapiens
atttgtcaatgaca

SEQ ID NO: 3788888 - DNA, 15 bp, Homo sapiens
atttgtcattttgaa

SEQ ID NO: 3788889 - DNA, 18 bp, Homo sapiens
atttgttttagaatgatg

SEQ ID NO: 3788890 - DNA, 18 bp, Homo sapiens
attttaaaattttatctc

SEQ ID NO: 3788891 - DNA, 13 bp, Homo sapiens
attttaaacaaag

SEQ ID NO: 3788892 - DNA, 22 bp, Homo sapiens
attttaaacaaaggttgagatg

SEQ ID NO: 3788893 - DNA, 22 bp, Homo sapiens
caaatggtggttgtttcttcca

SEQ ID NO: 3788894 - DNA, 19 bp, Homo sapiens
caaatgtggcatttgtgat

SEQ ID NO: 3788895 - DNA, 15 bp, Homo sapiens
caaatgttacatagt

SEQ ID NO: 3788896 - DNA, 16 bp, Homo sapiens
caaatgttttgcaaac

SEQ ID NO: 3788897 - DNA, 19 bp, Homo sapiens
caaattgagagaatggaaa

SEQ ID NO: 3788898 - DNA, 17 bp, Homo sapiens
caaattgcttgaaagaa

SEQ ID NO: 3788899 - DNA, 15 bp, Homo sapiens
caaatttaaaacaaa

SEQ ID NO: 3788900 - DNA, 16 bp, Homo sapiens
caaatttataatttta

SEQ ID NO: 3788901 - DNA, 19 bp, Homo sapiens
caaatttgtagggtttcta

SEQ ID NO: 3788902 - DNA, 16 bp, Homo sapiens
caacaaaaagcttccc

SEQ ID NO: 3788903 - DNA, 12 bp, Homo sapiens
caacaaaaattt

SEQ ID NO: 3788904 - DNA, 22 bp, Homo sapiens
caacaacatgtataatattttt

SEQ ID NO: 3788905 - DNA, 19 bp, Homo sapiens
caacaagggcagtggaggt

SEQ ID NO: 3788906 - DNA, 11 bp, Homo sapiens
caacacacaga

SEQ ID NO: 3788907 - DNA, 13 bp, Homo sapiens
caacacgttacta

SEQ ID NO: 3788908 - DNA, 20 bp, Homo sapiens
caacagaagtcatgaagccc

SEQ ID NO: 3788909 - DNA, 17 bp, Homo sapiens
caacagagaaggcagga

SEQ ID NO: 3788910 - DNA, 14 bp, Homo sapiens
caacagatactgga

SEQ ID NO: 3788911 - DNA, 15 bp, Homo sapiens
caacaggagctggga

SEQ ID NO: 3788912 - DNA, 21 bp, Homo sapiens
caacaggagctgggatcctaa

SEQ ID NO: 3788913 - DNA, 22 bp, Homo sapiens
caacaggagctgggatcctaag

SEQ ID NO: 3788914 - DNA, 13 bp, Homo sapiens
caacaggctgggc

SEQ ID NO: 3788915 - DNA, 18 bp, Homo sapiens
caacagtcaaaacagaga

SEQ ID NO: 3788916 - DNA, 13 bp, Homo sapiens
caacatcaatgtt

SEQ ID NO: 3788917 - DNA, 15 bp, Homo sapiens
caacatcccattgcc

SEQ ID NO: 3788918 - DNA, 18 bp, Homo sapiens
caacatggtgaaaccccg

SEQ ID NO: 3788919 - DNA, 13 bp, Homo sapiens
caacatgtataat

SEQ ID NO: 3788920 - DNA, 17 bp, Homo sapiens
caacatgtataatattt

SEQ ID NO: 3788921 - DNA, 23 bp, Homo sapiens
caacatgtataatatttttaatt

SEQ ID NO: 3788922 - DNA, 18 bp, Homo sapiens
caacatgttactgaccag

SEQ ID NO: 3788923 - DNA, 18 bp, Homo sapiens
caaccaagtcatgtgcat

SEQ ID NO: 3788924 - DNA, 20 bp, Homo sapiens
caaccagattgtcagctcct

SEQ ID NO: 3788925 - DNA, 16 bp, Homo sapiens
caaccattccagactg

SEQ ID NO: 3788926 - DNA, 22 bp, Homo sapiens
caaccattccagactgcttcca

SEQ ID NO: 3788927 - DNA, 18 bp, Homo sapiens
caacccaaacctggagat

SEQ ID NO: 3788928 - DNA, 19 bp, Homo sapiens
caacccatctacccctgga

SEQ ID NO: 3788929 - DNA, 14 bp, Homo sapiens
caacccccacccca

SEQ ID NO: 3788930 - DNA, 17 bp, Homo sapiens
caacccccaccccacac

SEQ ID NO: 3788931 - DNA, 14 bp, Homo sapiens
caacccccagcctg

SEQ ID NO: 3788932 - DNA, 16 bp, Homo sapiens
caacccccagcctgct

SEQ ID NO: 3788933 - DNA, 17 bp, Homo sapiens
caacccccagcctgcta

SEQ ID NO: 3788934 - DNA, 22 bp, Homo sapiens
caaccccccatcacaaacttaa

SEQ ID NO: 3788935 - DNA, 22 bp, Homo sapiens
caacccctgtggagcccgcacc

SEQ ID NO: 3788936 - DNA, 19 bp, Homo sapiens
caaccccttcgctcctgtg

SEQ ID NO: 3788937 - DNA, 13 bp, Homo sapiens
caaccctcagagc

SEQ ID NO: 3788938 - DNA, 15 bp, Homo sapiens
caaccctgcccctgc

SEQ ID NO: 3788939 - DNA, 19 bp, Homo sapiens
caacccttaccccttagcc

SEQ ID NO: 3788940 - DNA, 17 bp, Homo sapiens
caaccgatgctccagcc

SEQ ID NO: 3788941 - DNA, 19 bp, Homo sapiens
caaccggggagcccccgcc

SEQ ID NO: 3788942 - DNA, 18 bp, Homo sapiens
caaccgttggaaacataa

SEQ ID NO: 3788943 - DNA, 18 bp, Homo sapiens
caacctaacccctttcct

SEQ ID NO: 3788944 - DNA, 14 bp, Homo sapiens
caacctcctgggct

SEQ ID NO: 3788945 - DNA, 15 bp, Homo sapiens
caacctgaccaacat

SEQ ID NO: 3788946 - DNA, 20 bp, Homo sapiens
caacctgaccaacatggaga

SEQ ID NO: 3788947 - DNA, 18 bp, Homo sapiens
caacctgctctcctcttg

SEQ ID NO: 3788948 - DNA, 16 bp, Homo sapiens
caacctggtcacagga

SEQ ID NO: 3788949 - DNA, 12 bp, Homo sapiens
caacctgtaaat

SEQ ID NO: 3788950 - DNA, 13 bp, Homo sapiens
caacctgtaaatt

SEQ ID NO: 3788951 - DNA, 23 bp, Homo sapiens
caaccttacttacagcataaggg

SEQ ID NO: 3788952 - DNA, 17 bp, Homo sapiens
caaccttctgtggctca

SEQ ID NO: 3788953 - DNA, 19 bp, Homo sapiens
caaccttctgtggctcaca

SEQ ID NO: 3788954 - DNA, 13 bp, Homo sapiens
caacgaagaaaaa

SEQ ID NO: 3788955 - DNA, 12 bp, Homo sapiens
caacgaggaagc

SEQ ID NO: 3788956 - DNA, 18 bp, Homo sapiens
caacgcagccctgctttg

SEQ ID NO: 3788957 - DNA, 14 bp, Homo sapiens
caacggcaagacag

SEQ ID NO: 3788958 - DNA, 12 bp, Homo sapiens
caacgtggggca

SEQ ID NO: 3788959 - DNA, 13 bp, Homo sapiens
caactaacaagaa

SEQ ID NO: 3788960 - DNA, 22 bp, Homo sapiens
caactatgatatggtaaaagtt

SEQ ID NO: 3788961 - DNA, 17 bp, Homo sapiens
caactatgatttggaaa

SEQ ID NO: 3788962 - DNA, 22 bp, Homo sapiens
caactatgatttggaaaataaa

SEQ ID NO: 3788963 - DNA, 18 bp, Homo sapiens
caactcaaaaaacattgt

SEQ ID NO: 3788964 - DNA, 13 bp, Homo sapiens
caactgaaaagac

SEQ ID NO: 3788965 - DNA, 15 bp, Homo sapiens
caactgaccagcctc

SEQ ID NO: 3788966 - DNA, 19 bp, Homo sapiens
caactgaccagcctccatg

SEQ ID NO: 3788967 - DNA, 22 bp, Homo sapiens
caactgcaagtcacaaaggaat

SEQ ID NO: 3788968 - DNA, 20 bp, Homo sapiens
caactgctgatgctcatggt

SEQ ID NO: 3788969 - DNA, 14 bp, Homo sapiens
caactgctgcccca

SEQ ID NO: 3788970 - DNA, 21 bp, Homo sapiens
caactgctgccccaaaggaag

SEQ ID NO: 3788971 - DNA, 19 bp, Homo sapiens
caactggacattgtctgcg

SEQ ID NO: 3788972 - DNA, 14 bp, Homo sapiens
caactggccctctt

SEQ ID NO: 3788973 - DNA, 23 bp, Homo sapiens
caactggccctcttcttacttga

SEQ ID NO: 3788974 - DNA, 19 bp, Homo sapiens
caactgttgattgcaggaa

SEQ ID NO: 3788975 - DNA, 15 bp, Homo sapiens
caacttaaaaagtct

SEQ ID NO: 3788976 - DNA, 19 bp, Homo sapiens
caacttaaaaagtctgcat

SEQ ID NO: 3788977 - DNA, 19 bp, Homo sapiens
caacttgagcatgttactg

SEQ ID NO: 3788978 - DNA, 13 bp, Homo sapiens
caacttttctatt

SEQ ID NO: 3788979 - DNA, 12 bp, Homo sapiens
caagaaaacata

SEQ ID NO: 3788980 - DNA, 18 bp, Homo sapiens
caagaaactgaggaattt

SEQ ID NO: 3788981 - DNA, 19 bp, Homo sapiens
caagaaagccagtcttaac

SEQ ID NO: 3788982 - DNA, 12 bp, Homo sapiens
caagaaaggaga

SEQ ID NO: 3788983 - DNA, 14 bp, Homo sapiens
caagaaaggagagt

SEQ ID NO: 3788984 - DNA, 17 bp, Homo sapiens
caagaacagcaggccca

SEQ ID NO: 3788985 - DNA, 21 bp, Homo sapiens
caagaacagcaggcccaccta

SEQ ID NO: 3788986 - DNA, 14 bp, Homo sapiens
caagaactctgggc

SEQ ID NO: 3788987 - DNA, 15 bp, Homo sapiens
caagaactgaaaaca

SEQ ID NO: 3788988 - DNA, 16 bp, Homo sapiens
caagaactgaaaacat

SEQ ID NO: 3788989 - DNA, 16 bp, Homo sapiens
caagaactgcatggac

SEQ ID NO: 3788990 - DNA, 18 bp, Homo sapiens
caagaactgcatggacct

SEQ ID NO: 3788991 - DNA, 13 bp, Homo sapiens
caagaaggctggg

SEQ ID NO: 3788992 - DNA, 19 bp, Homo sapiens
caagaatcagtgcaaagat

SEQ ID NO: 3788993 - DNA, 21 bp, Homo sapiens
caagaattctccaaaacaatt

SEQ ID NO: 3788994 - DNA, 23 bp, Homo sapiens
caagaatttcttggtaagaagcc

SEQ ID NO: 3788995 - DNA, 16 bp, Homo sapiens
caagacagatgcccca

SEQ ID NO: 3788996 - DNA, 21 bp, Homo sapiens
caagacagatgccccagagct

SEQ ID NO: 3788997 - DNA, 11 bp, Homo sapiens
caagacattgt

SEQ ID NO: 3788998 - DNA, 13 bp, Homo sapiens
caagacattgtca

SEQ ID NO: 3788999 - DNA, 17 bp, Homo sapiens
caagacattgtcaataa

SEQ ID NO: 3789000 - DNA, 15 bp, Homo sapiens
caagaccagcctggc

SEQ ID NO: 3789001 - DNA, 15 bp, Homo sapiens
caagacccctgtctt

SEQ ID NO: 3789002 - DNA, 15 bp, Homo sapiens
caagaccctgtctct

SEQ ID NO: 3789003 - DNA, 17 bp, Homo sapiens
caagacttgaaggtgcc

SEQ ID NO: 3789004 - DNA, 15 bp, Homo sapiens
caagacttttctttg

SEQ ID NO: 3789005 - DNA, 22 bp, Homo sapiens
caagagaattgcttgaacccag

SEQ ID NO: 3789006 - DNA, 23 bp, Homo sapiens
caagagatgaagagtgagagggc

SEQ ID NO: 3789007 - DNA, 22 bp, Homo sapiens
cacaatcctaacacattatcgg

SEQ ID NO: 3789008 - DNA, 23 bp, Homo sapiens
cacaatcctaacacattatcggg

SEQ ID NO: 3789009 - DNA, 14 bp, Homo sapiens
cacaatgtcttggt

SEQ ID NO: 3789010 - DNA, 17 bp, Homo sapiens
cacacaaagagagttaa

SEQ ID NO: 3789011 - DNA, 13 bp, Homo sapiens
cacacaacaaaaa

SEQ ID NO: 3789012 - DNA, 15 bp, Homo sapiens
cacacacaacaaaaa

SEQ ID NO: 3789013 - DNA, 15 bp, Homo sapiens
cacacacacaacaaa

SEQ ID NO: 3789014 - DNA, 12 bp, Homo sapiens
cacacacacaca

SEQ ID NO: 3789015 - DNA, 13 bp, Homo sapiens
cacacacacacac

SEQ ID NO: 3789016 - DNA, 15 bp, Homo sapiens
cacacacacacacaa

SEQ ID NO: 3789017 - DNA, 13 bp, Homo sapiens
cacacacacagga

SEQ ID NO: 3789018 - DNA, 23 bp, Homo sapiens
cacacacagaggaagagcaggca

SEQ ID NO: 3789019 - DNA, 13 bp, Homo sapiens
cacacacaggcaa

SEQ ID NO: 3789020 - DNA, 15 bp, Homo sapiens
cacacacctgtagtc

SEQ ID NO: 3789021 - DNA, 17 bp, Homo sapiens
cacacacgcgtgcacac

SEQ ID NO: 3789022 - DNA, 18 bp, Homo sapiens
cacacagaggaagagcag

SEQ ID NO: 3789023 - DNA, 19 bp, Homo sapiens
cacacagaggctgcctctc

SEQ ID NO: 3789024 - DNA, 15 bp, Homo sapiens
cacacagagtggtct

SEQ ID NO: 3789025 - DNA, 20 bp, Homo sapiens
cacacagagtggtctttctg

SEQ ID NO: 3789026 - DNA, 15 bp, Homo sapiens
cacacagcagcagtt

SEQ ID NO: 3789027 - DNA, 15 bp, Homo sapiens
cacacagctctgtcc

SEQ ID NO: 3789028 - DNA, 17 bp, Homo sapiens
cacacagctctgtcctg

SEQ ID NO: 3789029 - DNA, 20 bp, Homo sapiens
cacacagctctgtcctggga

SEQ ID NO: 3789030 - DNA, 21 bp, Homo sapiens
cacacagtgagtcgaggacag

SEQ ID NO: 3789031 - DNA, 13 bp, Homo sapiens
cacacataaagga

SEQ ID NO: 3789032 - DNA, 19 bp, Homo sapiens
cacacatgcttttcttcct

SEQ ID NO: 3789033 - DNA, 12 bp, Homo sapiens
cacaccagagcc

SEQ ID NO: 3789034 - DNA, 22 bp, Homo sapiens
cacaccagagcccaccttggct

SEQ ID NO: 3789035 - DNA, 22 bp, Homo sapiens
cacaccaggctgtgggcctcaa

SEQ ID NO: 3789036 - DNA, 13 bp, Homo sapiens
cacacccagccca

SEQ ID NO: 3789037 - DNA, 17 bp, Homo sapiens
cacaccgggcactcaga

SEQ ID NO: 3789038 - DNA, 17 bp, Homo sapiens
cacacctcagttccctt

SEQ ID NO: 3789039 - DNA, 14 bp, Homo sapiens
cacacctccctgaa

SEQ ID NO: 3789040 - DNA, 19 bp, Homo sapiens
cacacctggccctggggcc

SEQ ID NO: 3789041 - DNA, 16 bp, Homo sapiens
cacacctgtagtccca

SEQ ID NO: 3789042 - DNA, 19 bp, Homo sapiens
cacacctgtagtcccagct

SEQ ID NO: 3789043 - DNA, 20 bp, Homo sapiens
cacacctgtagtcccagcta

SEQ ID NO: 3789044 - DNA, 16 bp, Homo sapiens
cacacgcacacacaca

SEQ ID NO: 3789045 - DNA, 23 bp, Homo sapiens
cacacgcacacacacacacagga

SEQ ID NO: 3789046 - DNA, 20 bp, Homo sapiens
cacacgtctgaccctctcca

SEQ ID NO: 3789047 - DNA, 21 bp, Homo sapiens
cacactaacctgggttccctt

SEQ ID NO: 3789048 - DNA, 20 bp, Homo sapiens
cacactcagcacccccttct

SEQ ID NO: 3789049 - DNA, 22 bp, Homo sapiens
cacactcagcacccccttctct

SEQ ID NO: 3789050 - DNA, 14 bp, Homo sapiens
cacactccatcagc

SEQ ID NO: 3789051 - DNA, 15 bp, Homo sapiens
cacactccatcagct

SEQ ID NO: 3789052 - DNA, 17 bp, Homo sapiens
cacactccatcagctta

SEQ ID NO: 3789053 - DNA, 13 bp, Homo sapiens
cacactgaggcag

SEQ ID NO: 3789054 - DNA, 16 bp, Homo sapiens
cacactgaggcaggga

SEQ ID NO: 3789055 - DNA, 17 bp, Homo sapiens
cacactgcaacaggaac

SEQ ID NO: 3789056 - DNA, 20 bp, Homo sapiens
cacactgcaagagccttggt

SEQ ID NO: 3789057 - DNA, 21 bp, Homo sapiens
cacactgcaagagccttggtg

SEQ ID NO: 3789058 - DNA, 23 bp, Homo sapiens
cacactgctaggtgggccagccc

SEQ ID NO: 3789059 - DNA, 23 bp, Homo sapiens
cacacttcctgtccagagagaga

SEQ ID NO: 3789060 - DNA, 22 bp, Homo sapiens
cacacttctgtgagacccccac

SEQ ID NO: 3789061 - DNA, 22 bp, Homo sapiens
cacacttggttgggtcctcaca

SEQ ID NO: 3789062 - DNA, 17 bp, Homo sapiens
cacacttgttccagctc

SEQ ID NO: 3789063 - DNA, 19 bp, Homo sapiens
cacacttgttccagctctt

SEQ ID NO: 3789064 - DNA, 20 bp, Homo sapiens
cacacttgttccagctcttt

SEQ ID NO: 3789065 - DNA, 15 bp, Homo sapiens
cacagaaaactagaa

SEQ ID NO: 3789066 - DNA, 18 bp, Homo sapiens
cacagaaagactgagctc

SEQ ID NO: 3789067 - DNA, 20 bp, Homo sapiens
cacagaaatcagaggagaga

SEQ ID NO: 3789068 - DNA, 19 bp, Homo sapiens
cacagaagacttcccagct

SEQ ID NO: 3789069 - DNA, 20 bp, Homo sapiens
cacagaagacttcccagctt

SEQ ID NO: 3789070 - DNA, 19 bp, Homo sapiens
cacagacgccttactggca

SEQ ID NO: 3789071 - DNA, 12 bp, Homo sapiens
cacagagaaagt

SEQ ID NO: 3789072 - DNA, 19 bp, Homo sapiens
cacagagaaagtacttctc

SEQ ID NO: 3789073 - DNA, 23 bp, Homo sapiens
cacagagaactagtggtggctct

SEQ ID NO: 3789074 - DNA, 20 bp, Homo sapiens
cacagagagacagacttgag

SEQ ID NO: 3789075 - DNA, 22 bp, Homo sapiens
cacagagagggggccacctccc

SEQ ID NO: 3789076 - DNA, 16 bp, Homo sapiens
cacagaggaagagcag

SEQ ID NO: 3789077 - DNA, 19 bp, Homo sapiens
cacagatggatttgcctgt

SEQ ID NO: 3789078 - DNA, 23 bp, Homo sapiens
cacagatggatttgcctgtgcca

SEQ ID NO: 3789079 - DNA, 16 bp, Homo sapiens
cacagcaattcctcag

SEQ ID NO: 3789080 - DNA, 16 bp, Homo sapiens
cacagccagaaccccg

SEQ ID NO: 3789081 - DNA, 11 bp, Homo sapiens
cacagccctgt

SEQ ID NO: 3789082 - DNA, 13 bp, Homo sapiens
cacagccctgtca

SEQ ID NO: 3789083 - DNA, 23 bp, Homo sapiens
cacagccctgtcagtgcagcccg

SEQ ID NO: 3789084 - DNA, 22 bp, Homo sapiens
cacagccggggcctgcctagca

SEQ ID NO: 3789085 - DNA, 11 bp, Homo sapiens
cacagcctctg

SEQ ID NO: 3789086 - DNA, 17 bp, Homo sapiens
cacagcgagactccgtc

SEQ ID NO: 3789087 - DNA, 15 bp, Homo sapiens
cacagctacctcttc

SEQ ID NO: 3789088 - DNA, 16 bp, Homo sapiens
cacagctcaggaacta

SEQ ID NO: 3789089 - DNA, 14 bp, Homo sapiens
cacagctcccaccc

SEQ ID NO: 3789090 - DNA, 17 bp, Homo sapiens
cacagctcccaccccac

SEQ ID NO: 3789091 - DNA, 20 bp, Homo sapiens
cacagctctccggtctctct

SEQ ID NO: 3789092 - DNA, 16 bp, Homo sapiens
cacagctctgtcctgg

SEQ ID NO: 3789093 - DNA, 14 bp, Homo sapiens
cacagctcttctcc

SEQ ID NO: 3789094 - DNA, 16 bp, Homo sapiens
cacagcttcccctctc

SEQ ID NO: 3789095 - DNA, 22 bp, Homo sapiens
cacagcttcccctctctcctcc

SEQ ID NO: 3789096 - DNA, 18 bp, Homo sapiens
cacagcttggggccatcg

SEQ ID NO: 3789097 - DNA, 14 bp, Homo sapiens
cacaggatagataa

SEQ ID NO: 3789098 - DNA, 15 bp, Homo sapiens
cacaggatcagtctg

SEQ ID NO: 3789099 - DNA, 17 bp, Homo sapiens
cacaggatcagtctgat

SEQ ID NO: 3789100 - DNA, 17 bp, Homo sapiens
cacaggcaactgaggca

SEQ ID NO: 3789101 - DNA, 20 bp, Homo sapiens
cacaggcaactgaggcagac

SEQ ID NO: 3789102 - DNA, 22 bp, Homo sapiens
cacaggcaactgaggcagacag

SEQ ID NO: 3789103 - DNA, 11 bp, Homo sapiens
cacaggcaggt

SEQ ID NO: 3789104 - DNA, 15 bp, Homo sapiens
cacaggcaggtccag

SEQ ID NO: 3789105 - DNA, 15 bp, Homo sapiens
cacaggcccttcctc

SEQ ID NO: 3789106 - DNA, 16 bp, Homo sapiens
cacaggcccttcctct

SEQ ID NO: 3789107 - DNA, 17 bp, Homo sapiens
cacagggcagagccggg

SEQ ID NO: 3789108 - DNA, 19 bp, Homo sapiens
cacagggccccagaaggca

SEQ ID NO: 3789109 - DNA, 18 bp, Homo sapiens
cacagggttgggcccaga

SEQ ID NO: 3789110 - DNA, 14 bp, Homo sapiens
cacaggtgtcccca

SEQ ID NO: 3789111 - DNA, 22 bp, Homo sapiens
cacagtctctttaatcttcagt

SEQ ID NO: 3789112 - DNA, 18 bp, Homo sapiens
cacagtgagtcgaggaca

SEQ ID NO: 3789113 - DNA, 18 bp, Homo sapiens
cacagtgcatctcagccc

SEQ ID NO: 3789114 - DNA, 22 bp, Homo sapiens
cacagtgctttccgtggcactg

SEQ ID NO: 3789115 - DNA, 22 bp, Homo sapiens
cacagtggaaagacagcttctc

SEQ ID NO: 3789116 - DNA, 17 bp, Homo sapiens
cacagttcaattctcat

SEQ ID NO: 3789117 - DNA, 17 bp, Homo sapiens
cacatacacacacacgc

SEQ ID NO: 3789118 - DNA, 16 bp, Homo sapiens
cacatagattcacctg

SEQ ID NO: 3789119 - DNA, 21 bp, Homo sapiens
cacatagtgatggttcccctg

SEQ ID NO: 3789120 - DNA, 23 bp, Homo sapiens
cacttatgttactggtgtccagc

SEQ ID NO: 3789121 - DNA, 20 bp, Homo sapiens
cacttatttatgaacctgcc

SEQ ID NO: 3789122 - DNA, 18 bp, Homo sapiens
cacttcactccagcctgg

SEQ ID NO: 3789123 - DNA, 15 bp, Homo sapiens
cacttcagagagctg

SEQ ID NO: 3789124 - DNA, 17 bp, Homo sapiens
cacttcagagagctggt

SEQ ID NO: 3789125 - DNA, 18 bp, Homo sapiens
cacttcagagagctggta

SEQ ID NO: 3789126 - DNA, 14 bp, Homo sapiens
cacttccaccagcc

SEQ ID NO: 3789127 - DNA, 16 bp, Homo sapiens
cacttccaccagcctg

SEQ ID NO: 3789128 - DNA, 17 bp, Homo sapiens
cacttccaccagcctgc

SEQ ID NO: 3789129 - DNA, 19 bp, Homo sapiens
cacttctgaccacacttcc

SEQ ID NO: 3789130 - DNA, 22 bp, Homo sapiens
cacttctgccatattctgttgg

SEQ ID NO: 3789131 - DNA, 18 bp, Homo sapiens
cacttcttgttccccact

SEQ ID NO: 3789132 - DNA, 19 bp, Homo sapiens
cacttgaagccatctaaag

SEQ ID NO: 3789133 - DNA, 18 bp, Homo sapiens
cacttgaggtcaggagtt

SEQ ID NO: 3789134 - DNA, 14 bp, Homo sapiens
cacttgcagactct

SEQ ID NO: 3789135 - DNA, 18 bp, Homo sapiens
cacttgcagactctacag

SEQ ID NO: 3789136 - DNA, 19 bp, Homo sapiens
cacttgcagactctacaga

SEQ ID NO: 3789137 - DNA, 18 bp, Homo sapiens
cacttgcccctgttacct

SEQ ID NO: 3789138 - DNA, 16 bp, Homo sapiens
cacttggttgggtcct

SEQ ID NO: 3789139 - DNA, 14 bp, Homo sapiens
cacttgtgtgtggg

SEQ ID NO: 3789140 - DNA, 17 bp, Homo sapiens
cacttgtgtgtgggctg

SEQ ID NO: 3789141 - DNA, 21 bp, Homo sapiens
cacttgtgtgtgggctgtgag

SEQ ID NO: 3789142 - DNA, 13 bp, Homo sapiens
cacttgttccagc

SEQ ID NO: 3789143 - DNA, 14 bp, Homo sapiens
cactttatttactt

SEQ ID NO: 3789144 - DNA, 17 bp, Homo sapiens
cactttatttacttcgt

SEQ ID NO: 3789145 - DNA, 17 bp, Homo sapiens
cactttcacatagatgt

SEQ ID NO: 3789146 - DNA, 17 bp, Homo sapiens
cactttcaggaacactc

SEQ ID NO: 3789147 - DNA, 12 bp, Homo sapiens
cactttgggagg

SEQ ID NO: 3789148 - DNA, 23 bp, Homo sapiens
cactttgggaggccaaggagggc

SEQ ID NO: 3789149 - DNA, 14 bp, Homo sapiens
cagaaaaacaataa

SEQ ID NO: 3789150 - DNA, 16 bp, Homo sapiens
cagaaaacaacaaaaa

SEQ ID NO: 3789151 - DNA, 18 bp, Homo sapiens
cagaaaacaacaaaaaat

SEQ ID NO: 3789152 - DNA, 20 bp, Homo sapiens
cagaaaacaacaaaaaataa

SEQ ID NO: 3789153 - DNA, 13 bp, Homo sapiens
cagaaaacagaaa

SEQ ID NO: 3789154 - DNA, 14 bp, Homo sapiens
cagaaaacagaaaa

SEQ ID NO: 3789155 - DNA, 14 bp, Homo sapiens
cagaaaaccccagc

SEQ ID NO: 3789156 - DNA, 18 bp, Homo sapiens
cagaaaactagaatttca

SEQ ID NO: 3789157 - DNA, 19 bp, Homo sapiens
cagaaaagcacctgccgac

SEQ ID NO: 3789158 - DNA, 18 bp, Homo sapiens
cagaaacaaaaacactaa

SEQ ID NO: 3789159 - DNA, 20 bp, Homo sapiens
cagaaacacctagatcagaa

SEQ ID NO: 3789160 - DNA, 23 bp, Homo sapiens
cagaaacatcagttactctgaag

SEQ ID NO: 3789161 - DNA, 20 bp, Homo sapiens
cagaaagactgagctcaagg

SEQ ID NO: 3789162 - DNA, 15 bp, Homo sapiens
cagaaagcagaggct

SEQ ID NO: 3789163 - DNA, 22 bp, Homo sapiens
cagaaagcagaggctggcctca

SEQ ID NO: 3789164 - DNA, 16 bp, Homo sapiens
cagaaaggatatttaa

SEQ ID NO: 3789165 - DNA, 20 bp, Homo sapiens
cagaaaggatatttaagaaa

SEQ ID NO: 3789166 - DNA, 22 bp, Homo sapiens
cagaaagtggccatgccaccct

SEQ ID NO: 3789167 - DNA, 23 bp, Homo sapiens
cagaaataccaaaattatttcag

SEQ ID NO: 3789168 - DNA, 15 bp, Homo sapiens
cagaaatcagaggag

SEQ ID NO: 3789169 - DNA, 18 bp, Homo sapiens
cagaaatcagaggagaga

SEQ ID NO: 3789170 - DNA, 19 bp, Homo sapiens
cagaaatctagaagactgt

SEQ ID NO: 3789171 - DNA, 11 bp, Homo sapiens
cagaacactgt

SEQ ID NO: 3789172 - DNA, 14 bp, Homo sapiens
cagaacagcagagg

SEQ ID NO: 3789173 - DNA, 20 bp, Homo sapiens
cagaacagccgctcctgtct

SEQ ID NO: 3789174 - DNA, 18 bp, Homo sapiens
cagaacctcttccccaga

SEQ ID NO: 3789175 - DNA, 21 bp, Homo sapiens
cagaacctcttccccagaaag

SEQ ID NO: 3789176 - DNA, 16 bp, Homo sapiens
cagaactgagctcctc

SEQ ID NO: 3789177 - DNA, 20 bp, Homo sapiens
cagaactgagctcctctggg

SEQ ID NO: 3789178 - DNA, 13 bp, Homo sapiens
cagaactgcttta

SEQ ID NO: 3789179 - DNA, 18 bp, Homo sapiens
cagaactggactcaggat

SEQ ID NO: 3789180 - DNA, 14 bp, Homo sapiens
cagaagaaggcagc

SEQ ID NO: 3789181 - DNA, 21 bp, Homo sapiens
cagaagacactgatgggcaac

SEQ ID NO: 3789182 - DNA, 14 bp, Homo sapiens
cagaagcaggatag

SEQ ID NO: 3789183 - DNA, 20 bp, Homo sapiens
cagaagcctcactgcaagca

SEQ ID NO: 3789184 - DNA, 13 bp, Homo sapiens
cagaagcctctgg

SEQ ID NO: 3789185 - DNA, 16 bp, Homo sapiens
cagaagctgagcacca

SEQ ID NO: 3789186 - DNA, 19 bp, Homo sapiens
cagaagctgagcaccaggg

SEQ ID NO: 3789187 - DNA, 12 bp, Homo sapiens
cagaagcttcca

SEQ ID NO: 3789188 - DNA, 14 bp, Homo sapiens
cagaaggacctcct

SEQ ID NO: 3789189 - DNA, 14 bp, Homo sapiens
cagaaggaggagga

SEQ ID NO: 3789190 - DNA, 17 bp, Homo sapiens
cagaaggatgaatgagg

SEQ ID NO: 3789191 - DNA, 13 bp, Homo sapiens
cagaaggcaggga

SEQ ID NO: 3789192 - DNA, 14 bp, Homo sapiens
cagaaggccaagag

SEQ ID NO: 3789193 - DNA, 18 bp, Homo sapiens
cagaaggccaagaggctg

SEQ ID NO: 3789194 - DNA, 16 bp, Homo sapiens
cagaagggaaacagtc

SEQ ID NO: 3789195 - DNA, 15 bp, Homo sapiens
cagaaggtattcctt

SEQ ID NO: 3789196 - DNA, 23 bp, Homo sapiens
cagaaggttgctctagattgaga

SEQ ID NO: 3789197 - DNA, 17 bp, Homo sapiens
cagaagtgtttcatgca

SEQ ID NO: 3789198 - DNA, 15 bp, Homo sapiens
cagaagtttctcagc

SEQ ID NO: 3789199 - DNA, 22 bp, Homo sapiens
cagaagtttgagatcagcctgg

SEQ ID NO: 3789200 - DNA, 17 bp, Homo sapiens
cagaataatctttgggt

SEQ ID NO: 3789201 - DNA, 14 bp, Homo sapiens
cagaatagtatttt

SEQ ID NO: 3789202 - DNA, 23 bp, Homo sapiens
cagaatcgctccaccttgcagct

SEQ ID NO: 3789203 - DNA, 17 bp, Homo sapiens
cagaatctcaaataact

SEQ ID NO: 3789204 - DNA, 18 bp, Homo sapiens
cagaatctcaaataacta

SEQ ID NO: 3789205 - DNA, 18 bp, Homo sapiens
cagaatggggtgcatgaa

SEQ ID NO: 3789206 - DNA, 21 bp, Homo sapiens
cagaattctgctacctcactg

SEQ ID NO: 3789207 - DNA, 18 bp, Homo sapiens
cagacaaaaacagcctca

SEQ ID NO: 3789208 - DNA, 22 bp, Homo sapiens
cagacaaatgtggttacacact

SEQ ID NO: 3789209 - DNA, 14 bp, Homo sapiens
cagacaacagaagt

SEQ ID NO: 3789210 - DNA, 15 bp, Homo sapiens
cagacaacagaagtc

SEQ ID NO: 3789211 - DNA, 22 bp, Homo sapiens
cagacaacagaagtcatgaagc

SEQ ID NO: 3789212 - DNA, 13 bp, Homo sapiens
cagacacaaacaa

SEQ ID NO: 3789213 - DNA, 14 bp, Homo sapiens
cagacacacacaca

SEQ ID NO: 3789214 - DNA, 13 bp, Homo sapiens
cagacacaggccc

SEQ ID NO: 3789215 - DNA, 17 bp, Homo sapiens
cagacacaggcccggct

SEQ ID NO: 3789216 - DNA, 22 bp, Homo sapiens
cagacacaggcccggctccagg

SEQ ID NO: 3789217 - DNA, 21 bp, Homo sapiens
cagacactgaccatccactct

SEQ ID NO: 3789218 - DNA, 14 bp, Homo sapiens
cagacactttggaa

SEQ ID NO: 3789219 - DNA, 15 bp, Homo sapiens
cagacactttggaag

SEQ ID NO: 3789220 - DNA, 14 bp, Homo sapiens
cagacagacacaca

SEQ ID NO: 3789221 - DNA, 17 bp, Homo sapiens
cagacagcagctcaggc

SEQ ID NO: 3789222 - DNA, 11 bp, Homo sapiens
cagacagctcc

SEQ ID NO: 3789223 - DNA, 17 bp, Homo sapiens
cagacagctccctctgc

SEQ ID NO: 3789224 - DNA, 23 bp, Homo sapiens
cagacaggaaagggaaggcccca

SEQ ID NO: 3789225 - DNA, 11 bp, Homo sapiens
cagacaggcaa

SEQ ID NO: 3789226 - DNA, 22 bp, Homo sapiens
cagacaggcaagcacctcctgc

SEQ ID NO: 3789227 - DNA, 23 bp, Homo sapiens
cagacaggcaagcacctcctgcc

SEQ ID NO: 3789228 - DNA, 20 bp, Homo sapiens
cagacaggccatgtgagcca

SEQ ID NO: 3789229 - DNA, 15 bp, Homo sapiens
cagacagggtctgaa

SEQ ID NO: 3789230 - DNA, 13 bp, Homo sapiens
cagaccagagctc

SEQ ID NO: 3789231 - DNA, 17 bp, Homo sapiens
cagaccagagctctgga

SEQ ID NO: 3789232 - DNA, 16 bp, Homo sapiens
cagaccataatgttac

SEQ ID NO: 3789233 - DNA, 13 bp, Homo sapiens
cagccctgctttg

SEQ ID NO: 3789234 - DNA, 19 bp, Homo sapiens
cagccctgctttgggctgc

SEQ ID NO: 3789235 - DNA, 13 bp, Homo sapiens
cagccctgggccc

SEQ ID NO: 3789236 - DNA, 21 bp, Homo sapiens
cagccctgggccccaccacct

SEQ ID NO: 3789237 - DNA, 23 bp, Homo sapiens
cagccctgggccccaccacctag

SEQ ID NO: 3789238 - DNA, 12 bp, Homo sapiens
cagccctgtcag

SEQ ID NO: 3789239 - DNA, 13 bp, Homo sapiens
cagccctgttctg

SEQ ID NO: 3789240 - DNA, 15 bp, Homo sapiens
cagcccttagcaggg

SEQ ID NO: 3789241 - DNA, 16 bp, Homo sapiens
cagcccttagcaggga

SEQ ID NO: 3789242 - DNA, 20 bp, Homo sapiens
cagcccttgagctccccaaa

SEQ ID NO: 3789243 - DNA, 17 bp, Homo sapiens
cagccgccattgccacc

SEQ ID NO: 3789244 - DNA, 19 bp, Homo sapiens
cagccgccattgccaccag

SEQ ID NO: 3789245 - DNA, 14 bp, Homo sapiens
cagccgctcctgtc

SEQ ID NO: 3789246 - DNA, 16 bp, Homo sapiens
cagccgctcctgtctg

SEQ ID NO: 3789247 - DNA, 19 bp, Homo sapiens
cagccgctcctgtctgcca

SEQ ID NO: 3789248 - DNA, 16 bp, Homo sapiens
cagccgtgccttcagc

SEQ ID NO: 3789249 - DNA, 17 bp, Homo sapiens
cagcctagccgacctca

SEQ ID NO: 3789250 - DNA, 14 bp, Homo sapiens
cagcctcacagaag

SEQ ID NO: 3789251 - DNA, 14 bp, Homo sapiens
cagcctccatgctg

SEQ ID NO: 3789252 - DNA, 21 bp, Homo sapiens
cagcctcccaaagtgctggga

SEQ ID NO: 3789253 - DNA, 16 bp, Homo sapiens
cagcctcccaccccca

SEQ ID NO: 3789254 - DNA, 21 bp, Homo sapiens
cagcctcccgaatagctggga

SEQ ID NO: 3789255 - DNA, 23 bp, Homo sapiens
cagcctcccgaatagctgggact

SEQ ID NO: 3789256 - DNA, 21 bp, Homo sapiens
cagcctcccgagtagctggga

SEQ ID NO: 3789257 - DNA, 22 bp, Homo sapiens
cagcctcccgagtagctgggac

SEQ ID NO: 3789258 - DNA, 14 bp, Homo sapiens
cagcctccctctga

SEQ ID NO: 3789259 - DNA, 15 bp, Homo sapiens
cagcctccctctgac

SEQ ID NO: 3789260 - DNA, 22 bp, Homo sapiens
cagcctccctctgacctgcagg

SEQ ID NO: 3789261 - DNA, 18 bp, Homo sapiens
cagcctccgtatttcaga

SEQ ID NO: 3789262 - DNA, 18 bp, Homo sapiens
cagcctcgaactcctggg

SEQ ID NO: 3789263 - DNA, 23 bp, Homo sapiens
cagcctcgaactcctgggctcaa

SEQ ID NO: 3789264 - DNA, 17 bp, Homo sapiens
cagcctctcttcctatc

SEQ ID NO: 3789265 - DNA, 20 bp, Homo sapiens
cagcctctcttcctatccca

SEQ ID NO: 3789266 - DNA, 21 bp, Homo sapiens
cagcctctcttcctatcccat

SEQ ID NO: 3789267 - DNA, 18 bp, Homo sapiens
cagcctcttggccccaga

SEQ ID NO: 3789268 - DNA, 19 bp, Homo sapiens
cagcctgaggctgagactg

SEQ ID NO: 3789269 - DNA, 14 bp, Homo sapiens
cagcctgcctggag

SEQ ID NO: 3789270 - DNA, 14 bp, Homo sapiens
cagcctgcgtggct

SEQ ID NO: 3789271 - DNA, 16 bp, Homo sapiens
cagcctgcgtggctga

SEQ ID NO: 3789272 - DNA, 19 bp, Homo sapiens
cagcctgcgtggctgaccc

SEQ ID NO: 3789273 - DNA, 23 bp, Homo sapiens
cagcctgcgtggctgacccccct

SEQ ID NO: 3789274 - DNA, 15 bp, Homo sapiens
cagcctgctccagct

SEQ ID NO: 3789275 - DNA, 16 bp, Homo sapiens
cagcctgctccagctg

SEQ ID NO: 3789276 - DNA, 12 bp, Homo sapiens
cagcctggaggc

SEQ ID NO: 3789277 - DNA, 13 bp, Homo sapiens
cagcctggaggcc

SEQ ID NO: 3789278 - DNA, 10 bp, Homo sapiens
cagcctggca

SEQ ID NO: 3789279 - DNA, 13 bp, Homo sapiens
cagcctggcacag

SEQ ID NO: 3789280 - DNA, 18 bp, Homo sapiens
cagcctggccaacatggt

SEQ ID NO: 3789281 - DNA, 14 bp, Homo sapiens
cagcctggcttctg

SEQ ID NO: 3789282 - DNA, 17 bp, Homo sapiens
cagcctggcttctggag

SEQ ID NO: 3789283 - DNA, 20 bp, Homo sapiens
cagcctggcttctggagccc

SEQ ID NO: 3789284 - DNA, 19 bp, Homo sapiens
cagcctgggcaacagagca

SEQ ID NO: 3789285 - DNA, 20 bp, Homo sapiens
cagcctgggcagcatagcaa

SEQ ID NO: 3789286 - DNA, 18 bp, Homo sapiens
cagcctgggcagccaggc

SEQ ID NO: 3789287 - DNA, 19 bp, Homo sapiens
cagcctgggcagccaggct

SEQ ID NO: 3789288 - DNA, 15 bp, Homo sapiens
cagcctggtgggcct

SEQ ID NO: 3789289 - DNA, 17 bp, Homo sapiens
cagcctggtgggcctcc

SEQ ID NO: 3789290 - DNA, 18 bp, Homo sapiens
cagcctggtgggcctcct

SEQ ID NO: 3789291 - DNA, 20 bp, Homo sapiens
cagcctgtggcggtgcctgg

SEQ ID NO: 3789292 - DNA, 12 bp, Homo sapiens
cagcctgtggtt

SEQ ID NO: 3789293 - DNA, 19 bp, Homo sapiens
cagcctgtggttacagtgc

SEQ ID NO: 3789294 - DNA, 20 bp, Homo sapiens
cagcctgtggttacagtgca

SEQ ID NO: 3789295 - DNA, 22 bp, Homo sapiens
cagcctgtggttacagtgcaga

SEQ ID NO: 3789296 - DNA, 21 bp, Homo sapiens
cagccttccccctcccagggc

SEQ ID NO: 3789297 - DNA, 19 bp, Homo sapiens
cagcctttctcccaggcca

SEQ ID NO: 3789298 - DNA, 17 bp, Homo sapiens
cagcctttgcctccccg

SEQ ID NO: 3789299 - DNA, 22 bp, Homo sapiens
cagcgcctagtggggtctccct

SEQ ID NO: 3789300 - DNA, 19 bp, Homo sapiens
cagcgctgggtccacccca

SEQ ID NO: 3789301 - DNA, 16 bp, Homo sapiens
cagcggggacagctcc

SEQ ID NO: 3789302 - DNA, 17 bp, Homo sapiens
cagcggggacagctcct

SEQ ID NO: 3789303 - DNA, 18 bp, Homo sapiens
cagcggggacagctcctt

SEQ ID NO: 3789304 - DNA, 18 bp, Homo sapiens
cagctaagctaggaatga

SEQ ID NO: 3789305 - DNA, 19 bp, Homo sapiens
cagctaaggacatttccca

SEQ ID NO: 3789306 - DNA, 19 bp, Homo sapiens
cagctaatcagcattctca

SEQ ID NO: 3789307 - DNA, 18 bp, Homo sapiens
cagctaccaggtgttcta

SEQ ID NO: 3789308 - DNA, 17 bp, Homo sapiens
cagctactaatgatgtt

SEQ ID NO: 3789309 - DNA, 19 bp, Homo sapiens
cagctactaatgatgtttt

SEQ ID NO: 3789310 - DNA, 23 bp, Homo sapiens
cagctactcaagaggctgaggca

SEQ ID NO: 3789311 - DNA, 16 bp, Homo sapiens
cagctactcagaagcc

SEQ ID NO: 3789312 - DNA, 13 bp, Homo sapiens
cagctactcagga

SEQ ID NO: 3789313 - DNA, 16 bp, Homo sapiens
cagctactcaggaggc

SEQ ID NO: 3789314 - DNA, 15 bp, Homo sapiens
cagctactccggagg

SEQ ID NO: 3789315 - DNA, 17 bp, Homo sapiens
cagctatctctcagtga

SEQ ID NO: 3789316 - DNA, 15 bp, Homo sapiens
cagctatgggagccc

SEQ ID NO: 3789317 - DNA, 18 bp, Homo sapiens
cagctattgatataaata

SEQ ID NO: 3789318 - DNA, 15 bp, Homo sapiens
cagctcaaaggcaca

SEQ ID NO: 3789319 - DNA, 13 bp, Homo sapiens
cagctcaccagcc

SEQ ID NO: 3789320 - DNA, 15 bp, Homo sapiens
cagctcaccagcccc

SEQ ID NO: 3789321 - DNA, 22 bp, Homo sapiens
cagctcaccagccccagtgccc

SEQ ID NO: 3789322 - DNA, 12 bp, Homo sapiens
cagctcaggcac

SEQ ID NO: 3789323 - DNA, 23 bp, Homo sapiens
cagctcaggcacacttcttcttg

SEQ ID NO: 3789324 - DNA, 12 bp, Homo sapiens
cagctcagtccc

SEQ ID NO: 3789325 - DNA, 16 bp, Homo sapiens
cagctcagtcttccct

SEQ ID NO: 3789326 - DNA, 19 bp, Homo sapiens
cagctccactctgactggc

SEQ ID NO: 3789327 - DNA, 14 bp, Homo sapiens
cagctccagctcac

SEQ ID NO: 3789328 - DNA, 17 bp, Homo sapiens
cagctccagctcaccag

SEQ ID NO: 3789329 - DNA, 22 bp, Homo sapiens
cagctccagctcaccagcccca

SEQ ID NO: 3789330 - DNA, 14 bp, Homo sapiens
cagctcccacccca

SEQ ID NO: 3789331 - DNA, 15 bp, Homo sapiens
cagctcccaccccac

SEQ ID NO: 3789332 - DNA, 23 bp, Homo sapiens
cagctcccaccccacccccttca

SEQ ID NO: 3789333 - DNA, 18 bp, Homo sapiens
cagctccctaggagacca

SEQ ID NO: 3789334 - DNA, 15 bp, Homo sapiens
cagctccctctgcct

SEQ ID NO: 3789335 - DNA, 12 bp, Homo sapiens
cagctctcagcc

SEQ ID NO: 3789336 - DNA, 18 bp, Homo sapiens
cagctctccctctggccc

SEQ ID NO: 3789337 - DNA, 23 bp, Homo sapiens
cagctctccctctggccctgcct

SEQ ID NO: 3789338 - DNA, 21 bp, Homo sapiens
cagctctgcaagaattgaagc

SEQ ID NO: 3789339 - DNA, 13 bp, Homo sapiens
cagctctggctca

SEQ ID NO: 3789340 - DNA, 17 bp, Homo sapiens
cagctctggctcacaga

SEQ ID NO: 3789341 - DNA, 12 bp, Homo sapiens
cagctctgtcct

SEQ ID NO: 3789342 - DNA, 16 bp, Homo sapiens
cagctctgtcctggga

SEQ ID NO: 3789343 - DNA, 23 bp, Homo sapiens
cagctctgtcctgggagtgagct

SEQ ID NO: 3789344 - DNA, 14 bp, Homo sapiens
cagctcttctccag

SEQ ID NO: 3789345 - DNA, 15 bp, Homo sapiens
cagctcttctccagg

SEQ ID NO: 3789346 - DNA, 12 bp, Homo sapiens
cagggcagagcc

SEQ ID NO: 3789347 - DNA, 15 bp, Homo sapiens
cagggcagagccggg

SEQ ID NO: 3789348 - DNA, 15 bp, Homo sapiens
cagggcagggctctg

SEQ ID NO: 3789349 - DNA, 19 bp, Homo sapiens
cagggcatgcattttgcag

SEQ ID NO: 3789350 - DNA, 18 bp, Homo sapiens
cagggccacgtgccaggc

SEQ ID NO: 3789351 - DNA, 20 bp, Homo sapiens
cagggccacgtgccaggccc

SEQ ID NO: 3789352 - DNA, 12 bp, Homo sapiens
cagggccagggc

SEQ ID NO: 3789353 - DNA, 13 bp, Homo sapiens
cagggccagggcc

SEQ ID NO: 3789354 - DNA, 18 bp, Homo sapiens
cagggccagggccctgca

SEQ ID NO: 3789355 - DNA, 13 bp, Homo sapiens
cagggccccagaa

SEQ ID NO: 3789356 - DNA, 17 bp, Homo sapiens
cagggccccagaaggca

SEQ ID NO: 3789357 - DNA, 21 bp, Homo sapiens
cagggccccagaaggcaggga

SEQ ID NO: 3789358 - DNA, 14 bp, Homo sapiens
cagggccccagcac

SEQ ID NO: 3789359 - DNA, 22 bp, Homo sapiens
cagggccccagcactaaagcag

SEQ ID NO: 3789360 - DNA, 14 bp, Homo sapiens
cagggccttgccca

SEQ ID NO: 3789361 - DNA, 16 bp, Homo sapiens
cagggccttgcccaga

SEQ ID NO: 3789362 - DNA, 15 bp, Homo sapiens
cagggccttgctaat

SEQ ID NO: 3789363 - DNA, 17 bp, Homo sapiens
cagggctaagagctagc

SEQ ID NO: 3789364 - DNA, 17 bp, Homo sapiens
caggggaaaatcagcct

SEQ ID NO: 3789365 - DNA, 20 bp, Homo sapiens
caggggaaaatcagcctgct

SEQ ID NO: 3789366 - DNA, 18 bp, Homo sapiens
caggggaatattttattc

SEQ ID NO: 3789367 - DNA, 23 bp, Homo sapiens
caggggaatattttattcaaggt

SEQ ID NO: 3789368 - DNA, 17 bp, Homo sapiens
caggggaccacacctcc

SEQ ID NO: 3789369 - DNA, 18 bp, Homo sapiens
caggggactcagccctga

SEQ ID NO: 3789370 - DNA, 21 bp, Homo sapiens
caggggactcagccctgaggt

SEQ ID NO: 3789371 - DNA, 19 bp, Homo sapiens
cagggggccaggtgcacag

SEQ ID NO: 3789372 - DNA, 20 bp, Homo sapiens
caggggtcccagccaccccg

SEQ ID NO: 3789373 - DNA, 20 bp, Homo sapiens
cagggtattccagagtgggg

SEQ ID NO: 3789374 - DNA, 21 bp, Homo sapiens
cagggtattccagagtgggga

SEQ ID NO: 3789375 - DNA, 23 bp, Homo sapiens
cagggtctcactctgtcgcccag

SEQ ID NO: 3789376 - DNA, 17 bp, Homo sapiens
cagggtcttccctacct

SEQ ID NO: 3789377 - DNA, 21 bp, Homo sapiens
cagggtcttccctacctcagg

SEQ ID NO: 3789378 - DNA, 22 bp, Homo sapiens
cagggtcttccctacctcaggc

SEQ ID NO: 3789379 - DNA, 17 bp, Homo sapiens
cagggtgggatggagga

SEQ ID NO: 3789380 - DNA, 18 bp, Homo sapiens
cagggtgggatggaggag

SEQ ID NO: 3789381 - DNA, 20 bp, Homo sapiens
cagggtgttgtcagcatctt

SEQ ID NO: 3789382 - DNA, 20 bp, Homo sapiens
cagggttcccccagccctgt

SEQ ID NO: 3789383 - DNA, 17 bp, Homo sapiens
cagggttctcctctccc

SEQ ID NO: 3789384 - DNA, 16 bp, Homo sapiens
cagggttggcccctgc

SEQ ID NO: 3789385 - DNA, 21 bp, Homo sapiens
cagggttggcccctgcccggc

SEQ ID NO: 3789386 - DNA, 13 bp, Homo sapiens
cagggttgggccc

SEQ ID NO: 3789387 - DNA, 14 bp, Homo sapiens
cagggttgggccca

SEQ ID NO: 3789388 - DNA, 21 bp, Homo sapiens
cagggttgggcccagatctgg

SEQ ID NO: 3789389 - DNA, 16 bp, Homo sapiens
cagggttttatctctg

SEQ ID NO: 3789390 - DNA, 17 bp, Homo sapiens
cagggttttatctctgt

SEQ ID NO: 3789391 - DNA, 16 bp, Homo sapiens
caggtaacaggcagat

SEQ ID NO: 3789392 - DNA, 20 bp, Homo sapiens
caggtaacaggcagatacag

SEQ ID NO: 3789393 - DNA, 21 bp, Homo sapiens
caggtaacaggcagatacagg

SEQ ID NO: 3789394 - DNA, 19 bp, Homo sapiens
caggtaatgtgaataaatt

SEQ ID NO: 3789395 - DNA, 20 bp, Homo sapiens
caggtaccccagctctgctt

SEQ ID NO: 3789396 - DNA, 18 bp, Homo sapiens
caggtagctgaaagggga

SEQ ID NO: 3789397 - DNA, 15 bp, Homo sapiens
caggtagctgcccct

SEQ ID NO: 3789398 - DNA, 16 bp, Homo sapiens
caggtagctgcccctg

SEQ ID NO: 3789399 - DNA, 23 bp, Homo sapiens
caggtagctgcccctggctctga

SEQ ID NO: 3789400 - DNA, 18 bp, Homo sapiens
caggtagttgcaattgaa

SEQ ID NO: 3789401 - DNA, 22 bp, Homo sapiens
caggtcaatacagtacaggcag

SEQ ID NO: 3789402 - DNA, 19 bp, Homo sapiens
caggtcatctcctttcatc

SEQ ID NO: 3789403 - DNA, 15 bp, Homo sapiens
caggtcctcagagaa

SEQ ID NO: 3789404 - DNA, 20 bp, Homo sapiens
caggtcctcagagaatttct

SEQ ID NO: 3789405 - DNA, 13 bp, Homo sapiens
caggtcgggctca

SEQ ID NO: 3789406 - DNA, 18 bp, Homo sapiens
caggtcgggctcagctct

SEQ ID NO: 3789407 - DNA, 19 bp, Homo sapiens
caggtcgggctcagctctg

SEQ ID NO: 3789408 - DNA, 20 bp, Homo sapiens
caggtctcagaatctttcct

SEQ ID NO: 3789409 - DNA, 20 bp, Homo sapiens
caggtctgggagaggcagag

SEQ ID NO: 3789410 - DNA, 20 bp, Homo sapiens
caggtcttgaactcctggcc

SEQ ID NO: 3789411 - DNA, 20 bp, Homo sapiens
caggtgacagtgaggtcctg

SEQ ID NO: 3789412 - DNA, 21 bp, Homo sapiens
caggtgagaagcagaggaagg

SEQ ID NO: 3789413 - DNA, 15 bp, Homo sapiens
caggtgcacagacgt

SEQ ID NO: 3789414 - DNA, 23 bp, Homo sapiens
caggtgcacagacgtccctccac

SEQ ID NO: 3789415 - DNA, 12 bp, Homo sapiens
caggtgcagtgg

SEQ ID NO: 3789416 - DNA, 15 bp, Homo sapiens
caggtgcagtggctc

SEQ ID NO: 3789417 - DNA, 16 bp, Homo sapiens
caggtgcccctctctc

SEQ ID NO: 3789418 - DNA, 16 bp, Homo sapiens
caggtggccactccag

SEQ ID NO: 3789419 - DNA, 20 bp, Homo sapiens
caggtggctgacccagtccc

SEQ ID NO: 3789420 - DNA, 22 bp, Homo sapiens
caggtggctgacccagtccctg

SEQ ID NO: 3789421 - DNA, 23 bp, Homo sapiens
caggtggggagtcagggacccct

SEQ ID NO: 3789422 - DNA, 19 bp, Homo sapiens
caggtgtccccagcccact

SEQ ID NO: 3789423 - DNA, 16 bp, Homo sapiens
caggtgtgaaccacca

SEQ ID NO: 3789424 - DNA, 19 bp, Homo sapiens
caggtgtgaaccaccacac

SEQ ID NO: 3789425 - DNA, 16 bp, Homo sapiens
caggtgtgagtcacca

SEQ ID NO: 3789426 - DNA, 12 bp, Homo sapiens
caggttcagctt

SEQ ID NO: 3789427 - DNA, 13 bp, Homo sapiens
caggttcagcttg

SEQ ID NO: 3789428 - DNA, 20 bp, Homo sapiens
caggttgaggggctcctgga

SEQ ID NO: 3789429 - DNA, 18 bp, Homo sapiens
caggttgtagtaaagaaa

SEQ ID NO: 3789430 - DNA, 19 bp, Homo sapiens
caggttgtagtaaagaaat

SEQ ID NO: 3789431 - DNA, 14 bp, Homo sapiens
caggtttaagctgt

SEQ ID NO: 3789432 - DNA, 15 bp, Homo sapiens
caggttttgtaaaga

SEQ ID NO: 3789433 - DNA, 23 bp, Homo sapiens
caggtttttggtctgacccactg

SEQ ID NO: 3789434 - DNA, 23 bp, Homo sapiens
cagtaaagagaaactttgtgcta

SEQ ID NO: 3789435 - DNA, 20 bp, Homo sapiens
cagtaacagggccttgctaa

SEQ ID NO: 3789436 - DNA, 17 bp, Homo sapiens
cagtaagaccggaagct

SEQ ID NO: 3789437 - DNA, 22 bp, Homo sapiens
cagtaagaccggaagctcctgg

SEQ ID NO: 3789438 - DNA, 13 bp, Homo sapiens
cagtaataaaaca

SEQ ID NO: 3789439 - DNA, 17 bp, Homo sapiens
cagtaataaaacatctt

SEQ ID NO: 3789440 - DNA, 12 bp, Homo sapiens
cagtacaggcag

SEQ ID NO: 3789441 - DNA, 19 bp, Homo sapiens
cagtacaggcagcacagag

SEQ ID NO: 3789442 - DNA, 12 bp, Homo sapiens
cagtaccacatg

SEQ ID NO: 3789443 - DNA, 15 bp, Homo sapiens
cagtacccacctgag

SEQ ID NO: 3789444 - DNA, 19 bp, Homo sapiens
cagtagaaataatatgcat

SEQ ID NO: 3789445 - DNA, 15 bp, Homo sapiens
cagtagagtcatctc

SEQ ID NO: 3789446 - DNA, 16 bp, Homo sapiens
cagtagagtcatctcc

SEQ ID NO: 3789447 - DNA, 13 bp, Homo sapiens
cagtatatttata

SEQ ID NO: 3789448 - DNA, 14 bp, Homo sapiens
cagtatatttatag

SEQ ID NO: 3789449 - DNA, 22 bp, Homo sapiens
cagtatatttatagtcacaaga

SEQ ID NO: 3789450 - DNA, 24 bp, Homo sapiens
cagtatcaggcctgccagacggca

SEQ ID NO: 3789451 - DNA, 15 bp, Homo sapiens
cagtatctcagggcc

SEQ ID NO: 3789452 - DNA, 15 bp, Homo sapiens
cagtattctaggtag

SEQ ID NO: 3789453 - DNA, 21 bp, Homo sapiens
cagtattctaggtagtgccct

SEQ ID NO: 3789454 - DNA, 15 bp, Homo sapiens
cagtatttcagactg

SEQ ID NO: 3789455 - DNA, 21 bp, Homo sapiens
cagtattttcccaatagcact

SEQ ID NO: 3789456 - DNA, 23 bp, Homo sapiens
cagtattttcccaatagcacttt

SEQ ID NO: 3789457 - DNA, 22 bp, Homo sapiens
cagtatttttgttgtgttctgt

SEQ ID NO: 3789458 - DNA, 23 bp, Homo sapiens
catccaatgctcaagaaacaact

SEQ ID NO: 3789459 - DNA, 17 bp, Homo sapiens
catccactctaccctcc

SEQ ID NO: 3789460 - DNA, 13 bp, Homo sapiens
catccatctccag

SEQ ID NO: 3789461 - DNA, 22 bp, Homo sapiens
catccatctccagggagcaaga

SEQ ID NO: 3789462 - DNA, 22 bp, Homo sapiens
catccatggccgggcttggtgg

SEQ ID NO: 3789463 - DNA, 19 bp, Homo sapiens
catccatgttccgagaaga

SEQ ID NO: 3789464 - DNA, 14 bp, Homo sapiens
catccattcctcag

SEQ ID NO: 3789465 - DNA, 16 bp, Homo sapiens
catccattcctcaggg

SEQ ID NO: 3789466 - DNA, 18 bp, Homo sapiens
catccattcctcagggac

SEQ ID NO: 3789467 - DNA, 14 bp, Homo sapiens
catcccacaccctg

SEQ ID NO: 3789468 - DNA, 15 bp, Homo sapiens
catcccagcctgtgg

SEQ ID NO: 3789469 - DNA, 18 bp, Homo sapiens
catcccagcctgtggtta

SEQ ID NO: 3789470 - DNA, 14 bp, Homo sapiens
catcccaggggacc

SEQ ID NO: 3789471 - DNA, 12 bp, Homo sapiens
catcccatcatc

SEQ ID NO: 3789472 - DNA, 12 bp, Homo sapiens
catcccatccca

SEQ ID NO: 3789473 - DNA, 14 bp, Homo sapiens
catcccatcccatc

SEQ ID NO: 3789474 - DNA, 17 bp, Homo sapiens
catcccatcccatccca

SEQ ID NO: 3789475 - DNA, 18 bp, Homo sapiens
catcccatcccatcccgc

SEQ ID NO: 3789476 - DNA, 12 bp, Homo sapiens
catccccacctt

SEQ ID NO: 3789477 - DNA, 21 bp, Homo sapiens
catccccaggggtcccagcca

SEQ ID NO: 3789478 - DNA, 16 bp, Homo sapiens
catcccgctcttttcc

SEQ ID NO: 3789479 - DNA, 21 bp, Homo sapiens
catcccgtgcaaaacatgcta

SEQ ID NO: 3789480 - DNA, 13 bp, Homo sapiens
catccgaggcagg

SEQ ID NO: 3789481 - DNA, 23 bp, Homo sapiens
catccgaggcagggtcaggagag

SEQ ID NO: 3789482 - DNA, 23 bp, Homo sapiens
catccggaggagaagaaggaaat

SEQ ID NO: 3789483 - DNA, 16 bp, Homo sapiens
catccggcagcctgga

SEQ ID NO: 3789484 - DNA, 18 bp, Homo sapiens
catccgtagttccctgaa

SEQ ID NO: 3789485 - DNA, 23 bp, Homo sapiens
catccgtgagcagtgtgtctcct

SEQ ID NO: 3789486 - DNA, 20 bp, Homo sapiens
catcctaatcatccaatgct

SEQ ID NO: 3789487 - DNA, 13 bp, Homo sapiens
catcctccccttc

SEQ ID NO: 3789488 - DNA, 14 bp, Homo sapiens
catcctccccttcc

SEQ ID NO: 3789489 - DNA, 15 bp, Homo sapiens
catcctccccttccc

SEQ ID NO: 3789490 - DNA, 16 bp, Homo sapiens
catcctccccttccct

SEQ ID NO: 3789491 - DNA, 15 bp, Homo sapiens
catcctgtgtttcta

SEQ ID NO: 3789492 - DNA, 21 bp, Homo sapiens
catcctgtgtttctagggaaa

SEQ ID NO: 3789493 - DNA, 17 bp, Homo sapiens
catcggtcctgtctccc

SEQ ID NO: 3789494 - DNA, 21 bp, Homo sapiens
catcggtgaaactaacagata

SEQ ID NO: 3789495 - DNA, 22 bp, Homo sapiens
catcggtgaaactaacagataa

SEQ ID NO: 3789496 - DNA, 17 bp, Homo sapiens
catcggtgtccatttat

SEQ ID NO: 3789497 - DNA, 18 bp, Homo sapiens
catcggtgtccatttata

SEQ ID NO: 3789498 - DNA, 15 bp, Homo sapiens
catcgtaggtgattt

SEQ ID NO: 3789499 - DNA, 21 bp, Homo sapiens
catcgtataacacaatatgaa

SEQ ID NO: 3789500 - DNA, 15 bp, Homo sapiens
catctaaactttaat

SEQ ID NO: 3789501 - DNA, 20 bp, Homo sapiens
catctaaactttaatatgta

SEQ ID NO: 3789502 - DNA, 16 bp, Homo sapiens
catctacccctggatg

SEQ ID NO: 3789503 - DNA, 16 bp, Homo sapiens
catctaccttttctct

SEQ ID NO: 3789504 - DNA, 18 bp, Homo sapiens
catctaccttttctcttc

SEQ ID NO: 3789505 - DNA, 14 bp, Homo sapiens
catctagcaaatgt

SEQ ID NO: 3789506 - DNA, 15 bp, Homo sapiens
catctatttctgaga

SEQ ID NO: 3789507 - DNA, 16 bp, Homo sapiens
catctatttctgagaa

SEQ ID NO: 3789508 - DNA, 14 bp, Homo sapiens
catctcaaccatcc

SEQ ID NO: 3789509 - DNA, 16 bp, Homo sapiens
catctcaaccatcccc

SEQ ID NO: 3789510 - DNA, 13 bp, Homo sapiens
catctcagcccac

SEQ ID NO: 3789511 - DNA, 15 bp, Homo sapiens
catctcaggccacct

SEQ ID NO: 3789512 - DNA, 17 bp, Homo sapiens
catctcaggccacctgc

SEQ ID NO: 3789513 - DNA, 15 bp, Homo sapiens
catctcatccatcaa

SEQ ID NO: 3789514 - DNA, 14 bp, Homo sapiens
catctccactccag

SEQ ID NO: 3789515 - DNA, 16 bp, Homo sapiens
catctccagggagcaa

SEQ ID NO: 3789516 - DNA, 14 bp, Homo sapiens
catctccatcagct

SEQ ID NO: 3789517 - DNA, 15 bp, Homo sapiens
catctccatcagctg

SEQ ID NO: 3789518 - DNA, 20 bp, Homo sapiens
catctcctccatactcagga

SEQ ID NO: 3789519 - DNA, 15 bp, Homo sapiens
catctcctgtgcatg

SEQ ID NO: 3789520 - DNA, 22 bp, Homo sapiens
catctctactaaaaatacaaac

SEQ ID NO: 3789521 - DNA, 14 bp, Homo sapiens
catctctctttaat

SEQ ID NO: 3789522 - DNA, 20 bp, Homo sapiens
catctcttgaggccaggagt

SEQ ID NO: 3789523 - DNA, 16 bp, Homo sapiens
catctgaaagccacgt

SEQ ID NO: 3789524 - DNA, 16 bp, Homo sapiens
catctgacacaaaaaa

SEQ ID NO: 3789525 - DNA, 18 bp, Homo sapiens
catctgcacccccctggg

SEQ ID NO: 3789526 - DNA, 23 bp, Homo sapiens
catctgcaccctcgatgaagccc

SEQ ID NO: 3789527 - DNA, 16 bp, Homo sapiens
catctgcccctccccc

SEQ ID NO: 3789528 - DNA, 18 bp, Homo sapiens
catctgcccctcccccaa

SEQ ID NO: 3789529 - DNA, 18 bp, Homo sapiens
catctgctactgtgtcag

SEQ ID NO: 3789530 - DNA, 17 bp, Homo sapiens
catctggaaaataaaag

SEQ ID NO: 3789531 - DNA, 11 bp, Homo sapiens
catctggcctt

SEQ ID NO: 3789532 - DNA, 14 bp, Homo sapiens
catctggccttaca

SEQ ID NO: 3789533 - DNA, 16 bp, Homo sapiens
catctgtctggagggg

SEQ ID NO: 3789534 - DNA, 22 bp, Homo sapiens
catcttaggttggcaaaaaggc

SEQ ID NO: 3789535 - DNA, 21 bp, Homo sapiens
catcttccacaggtctcagaa

SEQ ID NO: 3789536 - DNA, 22 bp, Homo sapiens
catcttccctagagggttcctg

SEQ ID NO: 3789537 - DNA, 17 bp, Homo sapiens
catcttctcactccctt

SEQ ID NO: 3789538 - DNA, 17 bp, Homo sapiens
catcttctccatctggc

SEQ ID NO: 3789539 - DNA, 18 bp, Homo sapiens
catcttgaccaagcagga

SEQ ID NO: 3789540 - DNA, 20 bp, Homo sapiens
catcttgcccgctcaggctg

SEQ ID NO: 3789541 - DNA, 20 bp, Homo sapiens
catcttgcctccatggtgcc

SEQ ID NO: 3789542 - DNA, 16 bp, Homo sapiens
catcttgctctgctga

SEQ ID NO: 3789543 - DNA, 20 bp, Homo sapiens
catcttgctctgctgacaga

SEQ ID NO: 3789544 - DNA, 14 bp, Homo sapiens
catctttcacactt

SEQ ID NO: 3789545 - DNA, 12 bp, Homo sapiens
catctttcacat

SEQ ID NO: 3789546 - DNA, 13 bp, Homo sapiens
catctttcacatt

SEQ ID NO: 3789547 - DNA, 21 bp, Homo sapiens
catctttcttctattttattc

SEQ ID NO: 3789548 - DNA, 17 bp, Homo sapiens
catctttgccttgggct

SEQ ID NO: 3789549 - DNA, 22 bp, Homo sapiens
catctttgccttgggctgctcc

SEQ ID NO: 3789550 - DNA, 23 bp, Homo sapiens
catctttgccttgggctgctcct

SEQ ID NO: 3789551 - DNA, 12 bp, Homo sapiens
catgaaaaagca

SEQ ID NO: 3789552 - DNA, 18 bp, Homo sapiens
catgaaaaagcagctacc

SEQ ID NO: 3789553 - DNA, 19 bp, Homo sapiens
catgaaaaagcagctacca

SEQ ID NO: 3789554 - DNA, 23 bp, Homo sapiens
catgaaaaagcagctaccaggtg

SEQ ID NO: 3789555 - DNA, 21 bp, Homo sapiens
catgaaaaccattacctgact

SEQ ID NO: 3789556 - DNA, 19 bp, Homo sapiens
catgaaaacgttttattgt

SEQ ID NO: 3789557 - DNA, 21 bp, Homo sapiens
catgaaaatcctaccaacctc

SEQ ID NO: 3789558 - DNA, 22 bp, Homo sapiens
catgaaaatcctaccaacctct

SEQ ID NO: 3789559 - DNA, 13 bp, Homo sapiens
catgaaacaaagc

SEQ ID NO: 3789560 - DNA, 16 bp, Homo sapiens
catgaagacaggacag

SEQ ID NO: 3789561 - DNA, 17 bp, Homo sapiens
catgaagccacagccca

SEQ ID NO: 3789562 - DNA, 22 bp, Homo sapiens
catgaagccacagcccaggcct

SEQ ID NO: 3789563 - DNA, 22 bp, Homo sapiens
catgaatggtatggaactctct

SEQ ID NO: 3789564 - DNA, 16 bp, Homo sapiens
catgacaacttctaat

SEQ ID NO: 3789565 - DNA, 14 bp, Homo sapiens
catgacaagcccca

SEQ ID NO: 3789566 - DNA, 16 bp, Homo sapiens
catgacaagccccagg

SEQ ID NO: 3789567 - DNA, 14 bp, Homo sapiens
catgacactgaaat

SEQ ID NO: 3789568 - DNA, 16 bp, Homo sapiens
catgacactgaaatgc

SEQ ID NO: 3789569 - DNA, 18 bp, Homo sapiens
catgaccagaagggaaac

SEQ ID NO: 3789570 - DNA, 18 bp, Homo sapiens
catgaccatactgaggga

SEQ ID NO: 3789571 - DNA, 17 bp, Homo sapiens
cattgtggttattttta

SEQ ID NO: 3789572 - DNA, 21 bp, Homo sapiens
cattgtggttatttttataca

SEQ ID NO: 3789573 - DNA, 16 bp, Homo sapiens
cattgttgaggtggtc

SEQ ID NO: 3789574 - DNA, 18 bp, Homo sapiens
cattgtttgtctgtcttc

SEQ ID NO: 3789575 - DNA, 22 bp, Homo sapiens
cattgtttgtctgtcttcatag

SEQ ID NO: 3789576 - DNA, 15 bp, Homo sapiens
catttaaaaaaaatc

SEQ ID NO: 3789577 - DNA, 17 bp, Homo sapiens
catttactttgtgttca

SEQ ID NO: 3789578 - DNA, 14 bp, Homo sapiens
catttatgtttatt

SEQ ID NO: 3789579 - DNA, 15 bp, Homo sapiens
catttattctgctca

SEQ ID NO: 3789580 - DNA, 19 bp, Homo sapiens
catttattttttacattat

SEQ ID NO: 3789581 - DNA, 16 bp, Homo sapiens
catttcatctatttct

SEQ ID NO: 3789582 - DNA, 18 bp, Homo sapiens
catttcatctatttctga

SEQ ID NO: 3789583 - DNA, 17 bp, Homo sapiens
catttccaaattcacaa

SEQ ID NO: 3789584 - DNA, 19 bp, Homo sapiens
catttcctatgtaactgca

SEQ ID NO: 3789585 - DNA, 17 bp, Homo sapiens
catttcgcccctcattt

SEQ ID NO: 3789586 - DNA, 17 bp, Homo sapiens
catttctaaaggcctct

SEQ ID NO: 3789587 - DNA, 18 bp, Homo sapiens
catttctaaaggcctctt

SEQ ID NO: 3789588 - DNA, 19 bp, Homo sapiens
catttctaactctgatgta

SEQ ID NO: 3789589 - DNA, 14 bp, Homo sapiens
catttctatttatt

SEQ ID NO: 3789590 - DNA, 18 bp, Homo sapiens
catttctatttatttact

SEQ ID NO: 3789591 - DNA, 17 bp, Homo sapiens
catttgagcagggctca

SEQ ID NO: 3789592 - DNA, 18 bp, Homo sapiens
catttgagcagggctcag

SEQ ID NO: 3789593 - DNA, 20 bp, Homo sapiens
catttgagcagggctcagcg

SEQ ID NO: 3789594 - DNA, 15 bp, Homo sapiens
catttgatgctaaat

SEQ ID NO: 3789595 - DNA, 13 bp, Homo sapiens
catttgctgaata

SEQ ID NO: 3789596 - DNA, 17 bp, Homo sapiens
catttggggtagctaga

SEQ ID NO: 3789597 - DNA, 15 bp, Homo sapiens
catttgggtaaatca

SEQ ID NO: 3789598 - DNA, 13 bp, Homo sapiens
catttgtaataaa

SEQ ID NO: 3789599 - DNA, 18 bp, Homo sapiens
catttgtaataaagtata

SEQ ID NO: 3789600 - DNA, 23 bp, Homo sapiens
catttgtatgttgtgaagatgtt

SEQ ID NO: 3789601 - DNA, 17 bp, Homo sapiens
catttgtcacacacttt

SEQ ID NO: 3789602 - DNA, 16 bp, Homo sapiens
catttgtgaaatgatg

SEQ ID NO: 3789603 - DNA, 15 bp, Homo sapiens
catttgtgaggccca

SEQ ID NO: 3789604 - DNA, 17 bp, Homo sapiens
cattttaattattattc

SEQ ID NO: 3789605 - DNA, 19 bp, Homo sapiens
cattttcatatgcttcaaa

SEQ ID NO: 3789606 - DNA, 12 bp, Homo sapiens
cattttcccaga

SEQ ID NO: 3789607 - DNA, 21 bp, Homo sapiens
cattttctgggttctgggtgg

SEQ ID NO: 3789608 - DNA, 16 bp, Homo sapiens
cattttgaagctaatt

SEQ ID NO: 3789609 - DNA, 14 bp, Homo sapiens
cattttgacctact

SEQ ID NO: 3789610 - DNA, 17 bp, Homo sapiens
cattttgcaaaatttcc

SEQ ID NO: 3789611 - DNA, 16 bp, Homo sapiens
cattttgcagcagtga

SEQ ID NO: 3789612 - DNA, 18 bp, Homo sapiens
cattttggaagttttcag

SEQ ID NO: 3789613 - DNA, 20 bp, Homo sapiens
cattttggggtacccactgc

SEQ ID NO: 3789614 - DNA, 18 bp, Homo sapiens
catttttagtagagacag

SEQ ID NO: 3789615 - DNA, 19 bp, Homo sapiens
catttttagtagagacagg

SEQ ID NO: 3789616 - DNA, 18 bp, Homo sapiens
catttttgaatacaggca

SEQ ID NO: 3789617 - DNA, 16 bp, Homo sapiens
cattttttaaaacaag

SEQ ID NO: 3789618 - DNA, 22 bp, Homo sapiens
catttttttttttaattttgta

SEQ ID NO: 3789619 - DNA, 13 bp, Homo sapiens
ccaaaaaaataag

SEQ ID NO: 3789620 - DNA, 18 bp, Homo sapiens
ccaaaaaaataaggtgta

SEQ ID NO: 3789621 - DNA, 15 bp, Homo sapiens
ccaaacatcagacct

SEQ ID NO: 3789622 - DNA, 12 bp, Homo sapiens
ccaaactgccta

SEQ ID NO: 3789623 - DNA, 19 bp, Homo sapiens
ccaaactgcctaagccctc

SEQ ID NO: 3789624 - DNA, 12 bp, Homo sapiens
ccaaagagctgc

SEQ ID NO: 3789625 - DNA, 16 bp, Homo sapiens
ccaaagagctgcctaa

SEQ ID NO: 3789626 - DNA, 21 bp, Homo sapiens
ccaaagctaggcctggccaga

SEQ ID NO: 3789627 - DNA, 18 bp, Homo sapiens
ccaaagctagggtggccc

SEQ ID NO: 3789628 - DNA, 23 bp, Homo sapiens
ccaaagctagggtggcccttgca

SEQ ID NO: 3789629 - DNA, 20 bp, Homo sapiens
ccaaagctgacgaggctggg

SEQ ID NO: 3789630 - DNA, 21 bp, Homo sapiens
ccaaagctgacgaggctgggc

SEQ ID NO: 3789631 - DNA, 21 bp, Homo sapiens
ccaaagctgttggtctgtccc

SEQ ID NO: 3789632 - DNA, 12 bp, Homo sapiens
ccaaaggaggct

SEQ ID NO: 3789633 - DNA, 23 bp, Homo sapiens
ccaaagggtgaagctatttatct

SEQ ID NO: 3789634 - DNA, 16 bp, Homo sapiens
ccaaagtggtttcagc

SEQ ID NO: 3789635 - DNA, 19 bp, Homo sapiens
ccaaatgcatcaatcctgt

SEQ ID NO: 3789636 - DNA, 19 bp, Homo sapiens
ccaaattatcaagctaata

SEQ ID NO: 3789637 - DNA, 15 bp, Homo sapiens
ccaaattccctcctc

SEQ ID NO: 3789638 - DNA, 22 bp, Homo sapiens
ccaaattctttcagtggctacc

SEQ ID NO: 3789639 - DNA, 16 bp, Homo sapiens
ccaacaagggcagtgg

SEQ ID NO: 3789640 - DNA, 13 bp, Homo sapiens
ccaacaccaggga

SEQ ID NO: 3789641 - DNA, 12 bp, Homo sapiens
ccaacagttcct

SEQ ID NO: 3789642 - DNA, 13 bp, Homo sapiens
ccaacccccaccc

SEQ ID NO: 3789643 - DNA, 17 bp, Homo sapiens
ccaacccgaggcccgca

SEQ ID NO: 3789644 - DNA, 14 bp, Homo sapiens
ccaaccctgcccct

SEQ ID NO: 3789645 - DNA, 15 bp, Homo sapiens
ccaacccttccctga

SEQ ID NO: 3789646 - DNA, 12 bp, Homo sapiens
ccaacctcagca

SEQ ID NO: 3789647 - DNA, 14 bp, Homo sapiens
ccaacctggacaac

SEQ ID NO: 3789648 - DNA, 21 bp, Homo sapiens
ccaacggagagcgcctgcccc

SEQ ID NO: 3789649 - DNA, 11 bp, Homo sapiens
ccaactccagt

SEQ ID NO: 3789650 - DNA, 21 bp, Homo sapiens
ccaactccagtactggagctt

SEQ ID NO: 3789651 - DNA, 15 bp, Homo sapiens
ccaactcctggaagc

SEQ ID NO: 3789652 - DNA, 15 bp, Homo sapiens
ccaactgctgcccca

SEQ ID NO: 3789653 - DNA, 17 bp, Homo sapiens
ccaactggaagcacaga

SEQ ID NO: 3789654 - DNA, 11 bp, Homo sapiens
ccaacttgtaa

SEQ ID NO: 3789655 - DNA, 23 bp, Homo sapiens
ccaacttgtattaaagacagagg

SEQ ID NO: 3789656 - DNA, 11 bp, Homo sapiens
ccaacttttct

SEQ ID NO: 3789657 - DNA, 14 bp, Homo sapiens
ccaacttttctatt

SEQ ID NO: 3789658 - DNA, 13 bp, Homo sapiens
ccaagaaagcagg

SEQ ID NO: 3789659 - DNA, 20 bp, Homo sapiens
ccaagaatagatgctgactg

SEQ ID NO: 3789660 - DNA, 18 bp, Homo sapiens
ccaagacagatgccccag

SEQ ID NO: 3789661 - DNA, 16 bp, Homo sapiens
ccaagacattgtcaat

SEQ ID NO: 3789662 - DNA, 20 bp, Homo sapiens
ccaagacttggtgtcctttc

SEQ ID NO: 3789663 - DNA, 22 bp, Homo sapiens
ccaagacttggtgtcctttccc

SEQ ID NO: 3789664 - DNA, 14 bp, Homo sapiens
ccaagagagaaaga

SEQ ID NO: 3789665 - DNA, 12 bp, Homo sapiens
ccaagagatgaa

SEQ ID NO: 3789666 - DNA, 18 bp, Homo sapiens
ccaagatgcttttcaaac

SEQ ID NO: 3789667 - DNA, 14 bp, Homo sapiens
ccaagcaagtagct

SEQ ID NO: 3789668 - DNA, 13 bp, Homo sapiens
ccaagcatagaga

SEQ ID NO: 3789669 - DNA, 22 bp, Homo sapiens
ccaagcccacaggtgtccccag

SEQ ID NO: 3789670 - DNA, 13 bp, Homo sapiens
ccaagccgtggct

SEQ ID NO: 3789671 - DNA, 20 bp, Homo sapiens
ccaagcgaggtcaacagaga

SEQ ID NO: 3789672 - DNA, 13 bp, Homo sapiens
ccaagctcacagt

SEQ ID NO: 3789673 - DNA, 19 bp, Homo sapiens
ccaagctcacagttcctcg

SEQ ID NO: 3789674 - DNA, 14 bp, Homo sapiens
ccaagctccatctc

SEQ ID NO: 3789675 - DNA, 17 bp, Homo sapiens
ccaagctccttgggagg

SEQ ID NO: 3789676 - DNA, 19 bp, Homo sapiens
ccaagctccttgggaggcc

SEQ ID NO: 3789677 - DNA, 12 bp, Homo sapiens
ccaagctctgct

SEQ ID NO: 3789678 - DNA, 14 bp, Homo sapiens
ccaagctctgctcc

SEQ ID NO: 3789679 - DNA, 20 bp, Homo sapiens
ccaagctgtgaccctcaatt

SEQ ID NO: 3789680 - DNA, 17 bp, Homo sapiens
ccaagctgttttcttct

SEQ ID NO: 3789681 - DNA, 18 bp, Homo sapiens
ccaagctgttttcttcta

SEQ ID NO: 3789682 - DNA, 16 bp, Homo sapiens
ccaaggacccctcacc

SEQ ID NO: 3789683 - DNA, 22 bp, Homo sapiens
ccaaggagaccaagtcctggct

SEQ ID NO: 3789684 - DNA, 20 bp, Homo sapiens
ccaaggagctgagaatagaa

SEQ ID NO: 3789685 - DNA, 16 bp, Homo sapiens
ccagacggcacccacc

SEQ ID NO: 3789686 - DNA, 16 bp, Homo sapiens
ccagacggttcaccag

SEQ ID NO: 3789687 - DNA, 18 bp, Homo sapiens
ccagacggttcaccagcc

SEQ ID NO: 3789688 - DNA, 16 bp, Homo sapiens
ccagactacttgggag

SEQ ID NO: 3789689 - DNA, 14 bp, Homo sapiens
ccagacttgctgaa

SEQ ID NO: 3789690 - DNA, 23 bp, Homo sapiens
ccagagacaggaaaatcctctgg

SEQ ID NO: 3789691 - DNA, 15 bp, Homo sapiens
ccagagactcagagg

SEQ ID NO: 3789692 - DNA, 14 bp, Homo sapiens
ccagagagagaagt

SEQ ID NO: 3789693 - DNA, 16 bp, Homo sapiens
ccagagaggaatcaga

SEQ ID NO: 3789694 - DNA, 16 bp, Homo sapiens
ccagagagtggctcct

SEQ ID NO: 3789695 - DNA, 16 bp, Homo sapiens
ccagagatgcctccac

SEQ ID NO: 3789696 - DNA, 21 bp, Homo sapiens
ccagagatgggactgggaggg

SEQ ID NO: 3789697 - DNA, 22 bp, Homo sapiens
ccagagatgggactgggagggc

SEQ ID NO: 3789698 - DNA, 23 bp, Homo sapiens
ccagagatgggactgggagggcc

SEQ ID NO: 3789699 - DNA, 13 bp, Homo sapiens
ccagagcaaaata

SEQ ID NO: 3789700 - DNA, 18 bp, Homo sapiens
ccagagcaaagggccagg

SEQ ID NO: 3789701 - DNA, 13 bp, Homo sapiens
ccagagcactgta

SEQ ID NO: 3789702 - DNA, 13 bp, Homo sapiens
ccagagccatgga

SEQ ID NO: 3789703 - DNA, 21 bp, Homo sapiens
ccagagccatggactctacac

SEQ ID NO: 3789704 - DNA, 22 bp, Homo sapiens
ccagagcccaccttggctcaag

SEQ ID NO: 3789705 - DNA, 13 bp, Homo sapiens
ccagagctctgga

SEQ ID NO: 3789706 - DNA, 21 bp, Homo sapiens
ccagagctctggagccacctg

SEQ ID NO: 3789707 - DNA, 14 bp, Homo sapiens
ccagagctgggtga

SEQ ID NO: 3789708 - DNA, 20 bp, Homo sapiens
ccagagctgggtgagtgggg

SEQ ID NO: 3789709 - DNA, 24 bp, Homo sapiens
ccagagctgtttatggcctcagct

SEQ ID NO: 3789710 - DNA, 18 bp, Homo sapiens
ccagaggcagaaccctgg

SEQ ID NO: 3789711 - DNA, 17 bp, Homo sapiens
ccagagggcccaggcag

SEQ ID NO: 3789712 - DNA, 21 bp, Homo sapiens
ccagatacacccaaagtatca

SEQ ID NO: 3789713 - DNA, 21 bp, Homo sapiens
ccagatacttcccattttgga

SEQ ID NO: 3789714 - DNA, 17 bp, Homo sapiens
ccagatcccagaaggac

SEQ ID NO: 3789715 - DNA, 19 bp, Homo sapiens
ccagatctggtcccttgca

SEQ ID NO: 3789716 - DNA, 18 bp, Homo sapiens
ccagatgcacatccctgg

SEQ ID NO: 3789717 - DNA, 13 bp, Homo sapiens
ccagatgcaccag

SEQ ID NO: 3789718 - DNA, 17 bp, Homo sapiens
ccagatgcaccagccct

SEQ ID NO: 3789719 - DNA, 18 bp, Homo sapiens
ccagatgccttctccaga

SEQ ID NO: 3789720 - DNA, 22 bp, Homo sapiens
ccagattgcaacaggctgggct

SEQ ID NO: 3789721 - DNA, 23 bp, Homo sapiens
ccagattgcaacaggctgggctt

SEQ ID NO: 3789722 - DNA, 23 bp, Homo sapiens
ccagatttgaagacaaaaatact

SEQ ID NO: 3789723 - DNA, 15 bp, Homo sapiens
ccagcaaccctccta

SEQ ID NO: 3789724 - DNA, 15 bp, Homo sapiens
ccagcaactccaact

SEQ ID NO: 3789725 - DNA, 17 bp, Homo sapiens
ccagcaccaccaggtct

SEQ ID NO: 3789726 - DNA, 14 bp, Homo sapiens
ccagcacccagcaa

SEQ ID NO: 3789727 - DNA, 18 bp, Homo sapiens
ccagcacccagcaactcc

SEQ ID NO: 3789728 - DNA, 13 bp, Homo sapiens
ccagcacccccac

SEQ ID NO: 3789729 - DNA, 18 bp, Homo sapiens
ccagcacccccacgccct

SEQ ID NO: 3789730 - DNA, 20 bp, Homo sapiens
ccagcacccccacgccctca

SEQ ID NO: 3789731 - DNA, 24 bp, Homo sapiens
ccagcactaaagcagtggacacca

SEQ ID NO: 3789732 - DNA, 15 bp, Homo sapiens
ccagcactgtctcag

SEQ ID NO: 3789733 - DNA, 16 bp, Homo sapiens
ccagcagatcccagct

SEQ ID NO: 3789734 - DNA, 18 bp, Homo sapiens
ccagcagatcccagctca

SEQ ID NO: 3789735 - DNA, 19 bp, Homo sapiens
ccagcagatcccagctcac

SEQ ID NO: 3789736 - DNA, 16 bp, Homo sapiens
ccagcagccagctctc

SEQ ID NO: 3789737 - DNA, 21 bp, Homo sapiens
ccagcagccagctctcagcca

SEQ ID NO: 3789738 - DNA, 13 bp, Homo sapiens
ccagcagcctgga

SEQ ID NO: 3789739 - DNA, 19 bp, Homo sapiens
ccagcagcctggaccctgt

SEQ ID NO: 3789740 - DNA, 15 bp, Homo sapiens
ccagcaggtggggag

SEQ ID NO: 3789741 - DNA, 21 bp, Homo sapiens
ccagccaccccgggctctctg

SEQ ID NO: 3789742 - DNA, 22 bp, Homo sapiens
ccagccaccccgggctctctgc

SEQ ID NO: 3789743 - DNA, 16 bp, Homo sapiens
ccagccagcagccagc

SEQ ID NO: 3789744 - DNA, 19 bp, Homo sapiens
ccagccagcagccagctct

SEQ ID NO: 3789745 - DNA, 20 bp, Homo sapiens
ccagccagtgacctgaggaa

SEQ ID NO: 3789746 - DNA, 23 bp, Homo sapiens
ccagccagtgacctgaggaagcg

SEQ ID NO: 3789747 - DNA, 16 bp, Homo sapiens
ccagcccacttctgcc

SEQ ID NO: 3789748 - DNA, 14 bp, Homo sapiens
ccagcccagcccag

SEQ ID NO: 3789749 - DNA, 15 bp, Homo sapiens
ccagcccagcccagc

SEQ ID NO: 3789750 - DNA, 23 bp, Homo sapiens
ccagcccagctgctctgcccaga

SEQ ID NO: 3789751 - DNA, 19 bp, Homo sapiens
ccagcccatcttgcctcca

SEQ ID NO: 3789752 - DNA, 21 bp, Homo sapiens
ccagcccattctctctcctgt

SEQ ID NO: 3789753 - DNA, 15 bp, Homo sapiens
ccagccccacccagg

SEQ ID NO: 3789754 - DNA, 12 bp, Homo sapiens
ccagcccctccc

SEQ ID NO: 3789755 - DNA, 15 bp, Homo sapiens
ccagcccctcccacc

SEQ ID NO: 3789756 - DNA, 21 bp, Homo sapiens
ccagcccctcccaccacagca

SEQ ID NO: 3789757 - DNA, 15 bp, Homo sapiens
ccagccctccctgtc

SEQ ID NO: 3789758 - DNA, 21 bp, Homo sapiens
ccagccctccctgtcctcctc

SEQ ID NO: 3789759 - DNA, 13 bp, Homo sapiens
ccagccctgttct

SEQ ID NO: 3789760 - DNA, 19 bp, Homo sapiens
ccagccgccatgctcctgg

SEQ ID NO: 3789761 - DNA, 16 bp, Homo sapiens
ccagcctccatgctgc

SEQ ID NO: 3789762 - DNA, 21 bp, Homo sapiens
ccagcctctcttcctatccca

SEQ ID NO: 3789763 - DNA, 19 bp, Homo sapiens
ccagcctctgagcccctgg

SEQ ID NO: 3789764 - DNA, 12 bp, Homo sapiens
ccagcctgagca

SEQ ID NO: 3789765 - DNA, 19 bp, Homo sapiens
ccagcctggcttctggagc

SEQ ID NO: 3789766 - DNA, 21 bp, Homo sapiens
ccagcctggcttctggagccc

SEQ ID NO: 3789767 - DNA, 22 bp, Homo sapiens
ccagcctgggcagccaggctgc

SEQ ID NO: 3789768 - DNA, 13 bp, Homo sapiens
ccagcctgtggtt

SEQ ID NO: 3789769 - DNA, 15 bp, Homo sapiens
ccagcctttctccca

SEQ ID NO: 3789770 - DNA, 18 bp, Homo sapiens
ccagcctttctcccaggc

SEQ ID NO: 3789771 - DNA, 21 bp, Homo sapiens
ccagcgagccctggtggcagt

SEQ ID NO: 3789772 - DNA, 15 bp, Homo sapiens
ccagctactcaggag

SEQ ID NO: 3789773 - DNA, 15 bp, Homo sapiens
ccagctcagcagtga

SEQ ID NO: 3789774 - DNA, 22 bp, Homo sapiens
ccagctcagtcccatcagagag

SEQ ID NO: 3789775 - DNA, 12 bp, Homo sapiens
ccagctccaggg

SEQ ID NO: 3789776 - DNA, 15 bp, Homo sapiens
ccagctccagggcca

SEQ ID NO: 3789777 - DNA, 16 bp, Homo sapiens
ccagctccagggccag

SEQ ID NO: 3789778 - DNA, 13 bp, Homo sapiens
ccagctctcagcc

SEQ ID NO: 3789779 - DNA, 14 bp, Homo sapiens
ccagctctccctct

SEQ ID NO: 3789780 - DNA, 18 bp, Homo sapiens
ccagctctccctctggcc

SEQ ID NO: 3789781 - DNA, 20 bp, Homo sapiens
ccagctctccctctggccct

SEQ ID NO: 3789782 - DNA, 23 bp, Homo sapiens
ccagctctccctctggccctgcc

SEQ ID NO: 3789783 - DNA, 15 bp, Homo sapiens
ccagctctgcttgcc

SEQ ID NO: 3789784 - DNA, 12 bp, Homo sapiens
ccagctctggct

SEQ ID NO: 3789785 - DNA, 15 bp, Homo sapiens
ccagctgactgtggc

SEQ ID NO: 3789786 - DNA, 16 bp, Homo sapiens
ccagctgactgtggcc

SEQ ID NO: 3789787 - DNA, 20 bp, Homo sapiens
ccagctgactgtggccccct

SEQ ID NO: 3789788 - DNA, 17 bp, Homo sapiens
ccagctgcccctccctg

SEQ ID NO: 3789789 - DNA, 21 bp, Homo sapiens
ccagctgctcccctccctcct

SEQ ID NO: 3789790 - DNA, 18 bp, Homo sapiens
ccagctgctctgcccaga

SEQ ID NO: 3789791 - DNA, 19 bp, Homo sapiens
ccagctgctctgcccagag

SEQ ID NO: 3789792 - DNA, 13 bp, Homo sapiens
ccagctggcagca

SEQ ID NO: 3789793 - DNA, 16 bp, Homo sapiens
ccagctggcagcagag

SEQ ID NO: 3789794 - DNA, 18 bp, Homo sapiens
ccagctgggatctgactg

SEQ ID NO: 3789795 - DNA, 23 bp, Homo sapiens
ccagctgggatctgactgcacgt

SEQ ID NO: 3789796 - DNA, 16 bp, Homo sapiens
ccagctgggttggaaa

SEQ ID NO: 3789797 - DNA, 13 bp, Homo sapiens
ccagctgtctgtg

SEQ ID NO: 3789798 - DNA, 14 bp, Homo sapiens
cccaagctctgctc

SEQ ID NO: 3789799 - DNA, 15 bp, Homo sapiens
cccaagctctgctcc

SEQ ID NO: 3789800 - DNA, 17 bp, Homo sapiens
cccaagctctgctcctc

SEQ ID NO: 3789801 - DNA, 11 bp, Homo sapiens
cccaagctgga

SEQ ID NO: 3789802 - DNA, 19 bp, Homo sapiens
cccaaggaaagccccagca

SEQ ID NO: 3789803 - DNA, 22 bp, Homo sapiens
cccaaggaggaaaaacagacaa

SEQ ID NO: 3789804 - DNA, 12 bp, Homo sapiens
cccaatattata

SEQ ID NO: 3789805 - DNA, 17 bp, Homo sapiens
cccaatattataatttt

SEQ ID NO: 3789806 - DNA, 21 bp, Homo sapiens
cccacaaaggagagctagcag

SEQ ID NO: 3789807 - DNA, 13 bp, Homo sapiens
cccacacacccca

SEQ ID NO: 3789808 - DNA, 14 bp, Homo sapiens
cccacacaccccaa

SEQ ID NO: 3789809 - DNA, 12 bp, Homo sapiens
cccacaccctgg

SEQ ID NO: 3789810 - DNA, 12 bp, Homo sapiens
cccacacctggc

SEQ ID NO: 3789811 - DNA, 14 bp, Homo sapiens
cccacacctggccc

SEQ ID NO: 3789812 - DNA, 19 bp, Homo sapiens
cccacacctggccctgggg

SEQ ID NO: 3789813 - DNA, 21 bp, Homo sapiens
cccacagaaagactgagctca

SEQ ID NO: 3789814 - DNA, 14 bp, Homo sapiens
cccacagcctctgc

SEQ ID NO: 3789815 - DNA, 12 bp, Homo sapiens
cccacagctccc

SEQ ID NO: 3789816 - DNA, 13 bp, Homo sapiens
cccacagcttggg

SEQ ID NO: 3789817 - DNA, 17 bp, Homo sapiens
cccacaggatcagtctg

SEQ ID NO: 3789818 - DNA, 18 bp, Homo sapiens
cccacaggcccttcctct

SEQ ID NO: 3789819 - DNA, 17 bp, Homo sapiens
cccacatgtgtccatcc

SEQ ID NO: 3789820 - DNA, 14 bp, Homo sapiens
cccacattggaccc

SEQ ID NO: 3789821 - DNA, 12 bp, Homo sapiens
cccaccacagca

SEQ ID NO: 3789822 - DNA, 19 bp, Homo sapiens
cccaccacctaggccactc

SEQ ID NO: 3789823 - DNA, 20 bp, Homo sapiens
cccaccacgatgtggccctg

SEQ ID NO: 3789824 - DNA, 23 bp, Homo sapiens
cccaccactaggactctgaggct

SEQ ID NO: 3789825 - DNA, 12 bp, Homo sapiens
cccacccaggag

SEQ ID NO: 3789826 - DNA, 15 bp, Homo sapiens
cccaccccaccccct

SEQ ID NO: 3789827 - DNA, 13 bp, Homo sapiens
cccacccccctca

SEQ ID NO: 3789828 - DNA, 19 bp, Homo sapiens
cccaccccctccccagggg

SEQ ID NO: 3789829 - DNA, 18 bp, Homo sapiens
cccaccctgaaagccctg

SEQ ID NO: 3789830 - DNA, 18 bp, Homo sapiens
cccaccggttgcttctgg

SEQ ID NO: 3789831 - DNA, 14 bp, Homo sapiens
cccacctaccttca

SEQ ID NO: 3789832 - DNA, 21 bp, Homo sapiens
cccacctcaaatgggtctggg

SEQ ID NO: 3789833 - DNA, 15 bp, Homo sapiens
cccacctcagcctcc

SEQ ID NO: 3789834 - DNA, 12 bp, Homo sapiens
cccacctgagct

SEQ ID NO: 3789835 - DNA, 21 bp, Homo sapiens
cccacctgccactaggctggg

SEQ ID NO: 3789836 - DNA, 23 bp, Homo sapiens
cccacctgcccatcacagggttg

SEQ ID NO: 3789837 - DNA, 12 bp, Homo sapiens
cccacctgctga

SEQ ID NO: 3789838 - DNA, 15 bp, Homo sapiens
cccaccttggctcaa

SEQ ID NO: 3789839 - DNA, 14 bp, Homo sapiens
cccaccttggctgc

SEQ ID NO: 3789840 - DNA, 16 bp, Homo sapiens
cccaccttggctgcag

SEQ ID NO: 3789841 - DNA, 12 bp, Homo sapiens
cccacctttggt

SEQ ID NO: 3789842 - DNA, 14 bp, Homo sapiens
cccacgctggagtg

SEQ ID NO: 3789843 - DNA, 21 bp, Homo sapiens
cccacgctggagtgcagtgag

SEQ ID NO: 3789844 - DNA, 17 bp, Homo sapiens
cccactcaagccaagca

SEQ ID NO: 3789845 - DNA, 20 bp, Homo sapiens
cccactcaagccaagcagcc

SEQ ID NO: 3789846 - DNA, 22 bp, Homo sapiens
cccactccctggctctcagaag

SEQ ID NO: 3789847 - DNA, 19 bp, Homo sapiens
cccactcctaggacatgtt

SEQ ID NO: 3789848 - DNA, 21 bp, Homo sapiens
cccactctcattccccaggtg

SEQ ID NO: 3789849 - DNA, 17 bp, Homo sapiens
cccactctccccacact

SEQ ID NO: 3789850 - DNA, 16 bp, Homo sapiens
cccactgacagcctcc

SEQ ID NO: 3789851 - DNA, 15 bp, Homo sapiens
cccactgcaggcccc

SEQ ID NO: 3789852 - DNA, 23 bp, Homo sapiens
cccactgcaggccccgcttgtcc

SEQ ID NO: 3789853 - DNA, 13 bp, Homo sapiens
cccactgcctgcc

SEQ ID NO: 3789854 - DNA, 21 bp, Homo sapiens
cccactggctgtgggctccct

SEQ ID NO: 3789855 - DNA, 15 bp, Homo sapiens
cccagaaaggagact

SEQ ID NO: 3789856 - DNA, 19 bp, Homo sapiens
cccagaactggactcagga

SEQ ID NO: 3789857 - DNA, 18 bp, Homo sapiens
cccagaatgtcagattcc

SEQ ID NO: 3789858 - DNA, 16 bp, Homo sapiens
cccagacagctccctc

SEQ ID NO: 3789859 - DNA, 21 bp, Homo sapiens
cccagagaggaatcagacttc

SEQ ID NO: 3789860 - DNA, 14 bp, Homo sapiens
cccagagatgcctc

SEQ ID NO: 3789861 - DNA, 16 bp, Homo sapiens
cccagagatgcctcca

SEQ ID NO: 3789862 - DNA, 19 bp, Homo sapiens
cccagagatgcctccaccg

SEQ ID NO: 3789863 - DNA, 18 bp, Homo sapiens
cccagagctgggtgagtg

SEQ ID NO: 3789864 - DNA, 23 bp, Homo sapiens
cccagagctgtttatggcctcag

SEQ ID NO: 3789865 - DNA, 10 bp, Homo sapiens
cccagaggca

SEQ ID NO: 3789866 - DNA, 15 bp, Homo sapiens
cccagaggcacagcc

SEQ ID NO: 3789867 - DNA, 23 bp, Homo sapiens
cccagagggcccaggcaggccac

SEQ ID NO: 3789868 - DNA, 22 bp, Homo sapiens
cccagattgcaacaggctgggc

SEQ ID NO: 3789869 - DNA, 23 bp, Homo sapiens
cccagattgcaacaggctgggct

SEQ ID NO: 3789870 - DNA, 15 bp, Homo sapiens
cccagatttcagtct

SEQ ID NO: 3789871 - DNA, 19 bp, Homo sapiens
cccagcaaccctcctatca

SEQ ID NO: 3789872 - DNA, 21 bp, Homo sapiens
cccagcaaccctcctatcacc

SEQ ID NO: 3789873 - DNA, 16 bp, Homo sapiens
cccagcaagtgagagc

SEQ ID NO: 3789874 - DNA, 19 bp, Homo sapiens
cccagcaagtgagagctgg

SEQ ID NO: 3789875 - DNA, 21 bp, Homo sapiens
cccagcaagtgagagctgggt

SEQ ID NO: 3789876 - DNA, 23 bp, Homo sapiens
cccagcaagtgagagctgggtgt

SEQ ID NO: 3789877 - DNA, 17 bp, Homo sapiens
cccagcactaaagcagt

SEQ ID NO: 3789878 - DNA, 15 bp, Homo sapiens
cccagcactttggga

SEQ ID NO: 3789879 - DNA, 21 bp, Homo sapiens
cccagcactttgggaggctga

SEQ ID NO: 3789880 - DNA, 13 bp, Homo sapiens
cccagcagggcct

SEQ ID NO: 3789881 - DNA, 19 bp, Homo sapiens
cccagcaggtggggagggg

SEQ ID NO: 3789882 - DNA, 17 bp, Homo sapiens
cccagccaaaccctgtc

SEQ ID NO: 3789883 - DNA, 14 bp, Homo sapiens
cccagccaccccgg

SEQ ID NO: 3789884 - DNA, 22 bp, Homo sapiens
cccagccaccccgggctctctg

SEQ ID NO: 3789885 - DNA, 10 bp, Homo sapiens
cccagccatt

SEQ ID NO: 3789886 - DNA, 18 bp, Homo sapiens
cccagcccagctggtggg

SEQ ID NO: 3789887 - DNA, 22 bp, Homo sapiens
cccagcccattctctctcctgt

SEQ ID NO: 3789888 - DNA, 23 bp, Homo sapiens
cccagcccctgcccctcatgcca

SEQ ID NO: 3789889 - DNA, 15 bp, Homo sapiens
cccagccctgtggaa

SEQ ID NO: 3789890 - DNA, 21 bp, Homo sapiens
cccagcctcttctagagccgt

SEQ ID NO: 3789891 - DNA, 22 bp, Homo sapiens
cccagcggctggtgcagggcct

SEQ ID NO: 3789892 - DNA, 14 bp, Homo sapiens
cccagctactcagg

SEQ ID NO: 3789893 - DNA, 15 bp, Homo sapiens
cccagctacttggga

SEQ ID NO: 3789894 - DNA, 15 bp, Homo sapiens
cccagctcagagggt

SEQ ID NO: 3789895 - DNA, 15 bp, Homo sapiens
cccagctccctagga

SEQ ID NO: 3789896 - DNA, 14 bp, Homo sapiens
cccagctctagaca

SEQ ID NO: 3789897 - DNA, 23 bp, Homo sapiens
cccagctctagacaaccctgcaa

SEQ ID NO: 3789898 - DNA, 13 bp, Homo sapiens
cccagctctccct

SEQ ID NO: 3789899 - DNA, 14 bp, Homo sapiens
cccagctctccctc

SEQ ID NO: 3789900 - DNA, 21 bp, Homo sapiens
cccagctctccctctggccct

SEQ ID NO: 3789901 - DNA, 13 bp, Homo sapiens
cccagctctgctt

SEQ ID NO: 3789902 - DNA, 13 bp, Homo sapiens
cccagctctggct

SEQ ID NO: 3789903 - DNA, 14 bp, Homo sapiens
cccagctgactgtg

SEQ ID NO: 3789904 - DNA, 21 bp, Homo sapiens
cccagctgactgtggccccct

SEQ ID NO: 3789905 - DNA, 12 bp, Homo sapiens
cccagctgcacc

SEQ ID NO: 3789906 - DNA, 15 bp, Homo sapiens
cccagctgctctgcc

SEQ ID NO: 3789907 - DNA, 17 bp, Homo sapiens
cccagctgctctgccca

SEQ ID NO: 3789908 - DNA, 16 bp, Homo sapiens
cccagctggtgggaag

SEQ ID NO: 3789909 - DNA, 15 bp, Homo sapiens
cccagctgtctgtgt

SEQ ID NO: 3789910 - DNA, 16 bp, Homo sapiens
cccagctgtctgtgtc

SEQ ID NO: 3789911 - DNA, 21 bp, Homo sapiens
cccagctgtgctctggacagg

SEQ ID NO: 3789912 - DNA, 15 bp, Homo sapiens
ccccatgcctgtcca

SEQ ID NO: 3789913 - DNA, 20 bp, Homo sapiens
ccccatgcctgtccagcctg

SEQ ID NO: 3789914 - DNA, 23 bp, Homo sapiens
ccccatgcctgtccagcctgggc

SEQ ID NO: 3789915 - DNA, 17 bp, Homo sapiens
ccccatgtctctcagaa

SEQ ID NO: 3789916 - DNA, 18 bp, Homo sapiens
ccccatgtgcctgcacca

SEQ ID NO: 3789917 - DNA, 13 bp, Homo sapiens
ccccattctgcct

SEQ ID NO: 3789918 - DNA, 14 bp, Homo sapiens
ccccattctgcctg

SEQ ID NO: 3789919 - DNA, 15 bp, Homo sapiens
ccccattctgcctgc

SEQ ID NO: 3789920 - DNA, 16 bp, Homo sapiens
ccccattcttcctagt

SEQ ID NO: 3789921 - DNA, 22 bp, Homo sapiens
ccccattctttgcttgaacaca

SEQ ID NO: 3789922 - DNA, 20 bp, Homo sapiens
ccccatttctatttatttac

SEQ ID NO: 3789923 - DNA, 14 bp, Homo sapiens
cccccacacctggc

SEQ ID NO: 3789924 - DNA, 16 bp, Homo sapiens
cccccacacctggccc

SEQ ID NO: 3789925 - DNA, 15 bp, Homo sapiens
cccccaccactagga

SEQ ID NO: 3789926 - DNA, 21 bp, Homo sapiens
cccccactctcattccccagg

SEQ ID NO: 3789927 - DNA, 16 bp, Homo sapiens
cccccagcaaccctcc

SEQ ID NO: 3789928 - DNA, 12 bp, Homo sapiens
cccccagcctgc

SEQ ID NO: 3789929 - DNA, 14 bp, Homo sapiens
cccccagctgtggg

SEQ ID NO: 3789930 - DNA, 15 bp, Homo sapiens
cccccagtacctcca

SEQ ID NO: 3789931 - DNA, 19 bp, Homo sapiens
cccccatcctccccttccc

SEQ ID NO: 3789932 - DNA, 11 bp, Homo sapiens
ccccccactct

SEQ ID NO: 3789933 - DNA, 13 bp, Homo sapiens
cccccgagctggg

SEQ ID NO: 3789934 - DNA, 11 bp, Homo sapiens
cccccgccccg

SEQ ID NO: 3789935 - DNA, 18 bp, Homo sapiens
cccccgccccgccccaca

SEQ ID NO: 3789936 - DNA, 12 bp, Homo sapiens
ccccctccttcc

SEQ ID NO: 3789937 - DNA, 14 bp, Homo sapiens
ccccctgccagtgc

SEQ ID NO: 3789938 - DNA, 23 bp, Homo sapiens
ccccctgccccttctacactctc

SEQ ID NO: 3789939 - DNA, 10 bp, Homo sapiens
ccccctgggc

SEQ ID NO: 3789940 - DNA, 11 bp, Homo sapiens
ccccctgggct

SEQ ID NO: 3789941 - DNA, 13 bp, Homo sapiens
ccccctgggctct

SEQ ID NO: 3789942 - DNA, 19 bp, Homo sapiens
ccccctggtggacagtcct

SEQ ID NO: 3789943 - DNA, 14 bp, Homo sapiens
cccccttctcccac

SEQ ID NO: 3789944 - DNA, 16 bp, Homo sapiens
cccccttctctgctcc

SEQ ID NO: 3789945 - DNA, 16 bp, Homo sapiens
ccccgcaaaacccact

SEQ ID NO: 3789946 - DNA, 17 bp, Homo sapiens
ccccgcattccaggctc

SEQ ID NO: 3789947 - DNA, 20 bp, Homo sapiens
ccccgccccacattccgaca

SEQ ID NO: 3789948 - DNA, 23 bp, Homo sapiens
ccccgctcatgggcccctctgac

SEQ ID NO: 3789949 - DNA, 14 bp, Homo sapiens
ccccgcttctgcct

SEQ ID NO: 3789950 - DNA, 16 bp, Homo sapiens
ccccgggctctctgct

SEQ ID NO: 3789951 - DNA, 18 bp, Homo sapiens
ccccgggtttggcgggcc

SEQ ID NO: 3789952 - DNA, 15 bp, Homo sapiens
ccccggtcccttgag

SEQ ID NO: 3789953 - DNA, 16 bp, Homo sapiens
ccccggtcccttgaga

SEQ ID NO: 3789954 - DNA, 18 bp, Homo sapiens
ccccggtgtgcggtgcat

SEQ ID NO: 3789955 - DNA, 14 bp, Homo sapiens
ccccgtctctacta

SEQ ID NO: 3789956 - DNA, 22 bp, Homo sapiens
ccccgtctggggttcagcccct

SEQ ID NO: 3789957 - DNA, 17 bp, Homo sapiens
cccctatccacccagcc

SEQ ID NO: 3789958 - DNA, 20 bp, Homo sapiens
cccctatccacccagcccat

SEQ ID NO: 3789959 - DNA, 15 bp, Homo sapiens
cccctcacctgggca

SEQ ID NO: 3789960 - DNA, 13 bp, Homo sapiens
cccctcaccttgc

SEQ ID NO: 3789961 - DNA, 11 bp, Homo sapiens
cccctcccaga

SEQ ID NO: 3789962 - DNA, 15 bp, Homo sapiens
cccctccccagggga

SEQ ID NO: 3789963 - DNA, 16 bp, Homo sapiens
cccctcccccaacccc

SEQ ID NO: 3789964 - DNA, 12 bp, Homo sapiens
cccctccctacc

SEQ ID NO: 3789965 - DNA, 15 bp, Homo sapiens
cccctccctacctca

SEQ ID NO: 3789966 - DNA, 17 bp, Homo sapiens
cccctccctacctcaac

SEQ ID NO: 3789967 - DNA, 12 bp, Homo sapiens
cccctccctggc

SEQ ID NO: 3789968 - DNA, 16 bp, Homo sapiens
cccctccctggcctgt

SEQ ID NO: 3789969 - DNA, 14 bp, Homo sapiens
cccctccctggctc

SEQ ID NO: 3789970 - DNA, 22 bp, Homo sapiens
cccctccctggctcccatgacc

SEQ ID NO: 3789971 - DNA, 13 bp, Homo sapiens
cccctcctctgcc

SEQ ID NO: 3789972 - DNA, 17 bp, Homo sapiens
cccctccttcccagctg

SEQ ID NO: 3789973 - DNA, 20 bp, Homo sapiens
cccctccttcccagctgccc

SEQ ID NO: 3789974 - DNA, 18 bp, Homo sapiens
cccctccttgcctcctgt

SEQ ID NO: 3789975 - DNA, 20 bp, Homo sapiens
cccctccttgcctcctgtgt

SEQ ID NO: 3789976 - DNA, 15 bp, Homo sapiens
cccctgccccgtcac

SEQ ID NO: 3789977 - DNA, 13 bp, Homo sapiens
cccctgccctggt

SEQ ID NO: 3789978 - DNA, 13 bp, Homo sapiens
cccctgctggttc

SEQ ID NO: 3789979 - DNA, 15 bp, Homo sapiens
cccctgctggttcag

SEQ ID NO: 3789980 - DNA, 14 bp, Homo sapiens
cccctggatgaagt

SEQ ID NO: 3789981 - DNA, 22 bp, Homo sapiens
cccctggcttttcactgctggc

SEQ ID NO: 3789982 - DNA, 15 bp, Homo sapiens
cccctgggctctgcc

SEQ ID NO: 3789983 - DNA, 20 bp, Homo sapiens
cccctggtggacagtcctgg

SEQ ID NO: 3789984 - DNA, 18 bp, Homo sapiens
ccccttcacaccataact

SEQ ID NO: 3789985 - DNA, 12 bp, Homo sapiens
ccccttccccct

SEQ ID NO: 3789986 - DNA, 18 bp, Homo sapiens
ccccttccctgcaaacat

SEQ ID NO: 3789987 - DNA, 14 bp, Homo sapiens
ccccttcgctcctg

SEQ ID NO: 3789988 - DNA, 20 bp, Homo sapiens
ccccttctacactctcctgg

SEQ ID NO: 3789989 - DNA, 13 bp, Homo sapiens
ccccttctctgct

SEQ ID NO: 3789990 - DNA, 14 bp, Homo sapiens
ccccttctctgctc

SEQ ID NO: 3789991 - DNA, 23 bp, Homo sapiens
ccccttgcccagggctcagcctg

SEQ ID NO: 3789992 - DNA, 22 bp, Homo sapiens
ccccttgctctcccctgccctg

SEQ ID NO: 3789993 - DNA, 16 bp, Homo sapiens
cccgaatagctgggac

SEQ ID NO: 3789994 - DNA, 22 bp, Homo sapiens
cccgaatagctgggactacagg

SEQ ID NO: 3789995 - DNA, 11 bp, Homo sapiens
cccgagctggg

SEQ ID NO: 3789996 - DNA, 20 bp, Homo sapiens
cccgaggccttctctgaagg

SEQ ID NO: 3789997 - DNA, 17 bp, Homo sapiens
cccgaggtggctgcctg

SEQ ID NO: 3789998 - DNA, 22 bp, Homo sapiens
cccgaggtggctgcctggagcc

SEQ ID NO: 3789999 - DNA, 14 bp, Homo sapiens
cccgagtagctggg

SEQ ID NO: 3790000 - DNA, 16 bp, Homo sapiens
cccgagtagctgggac

SEQ ID NO: 3790001 - DNA, 14 bp, Homo sapiens
cccgattgtaactc

SEQ ID NO: 3790002 - DNA, 18 bp, Homo sapiens
cccgcaatgtgcccccag

SEQ ID NO: 3790003 - DNA, 22 bp, Homo sapiens
cccgcaggtaccccagctctgc

SEQ ID NO: 3790004 - DNA, 20 bp, Homo sapiens
cccgcatgcagcagcttgct

SEQ ID NO: 3790005 - DNA, 13 bp, Homo sapiens
cccgcccagctgc

SEQ ID NO: 3790006 - DNA, 13 bp, Homo sapiens
cccgctcagccct

SEQ ID NO: 3790007 - DNA, 14 bp, Homo sapiens
cccgctcagccctc

SEQ ID NO: 3790008 - DNA, 20 bp, Homo sapiens
cccggagctaacactggccc

SEQ ID NO: 3790009 - DNA, 17 bp, Homo sapiens
cccggaggggcctggca

SEQ ID NO: 3790010 - DNA, 16 bp, Homo sapiens
cccggcccctgctggt

SEQ ID NO: 3790011 - DNA, 19 bp, Homo sapiens
cccggcgcggtggctcacg

SEQ ID NO: 3790012 - DNA, 11 bp, Homo sapiens
cccggctccag

SEQ ID NO: 3790013 - DNA, 12 bp, Homo sapiens
cccggctccagg

SEQ ID NO: 3790014 - DNA, 13 bp, Homo sapiens
cccggctccaggc

SEQ ID NO: 3790015 - DNA, 23 bp, Homo sapiens
cccgggactcactggcagcccca

SEQ ID NO: 3790016 - DNA, 23 bp, Homo sapiens
cccgggaggcagaggttgcagtg

SEQ ID NO: 3790017 - DNA, 21 bp, Homo sapiens
cccgggcaagacttttctttg

SEQ ID NO: 3790018 - DNA, 17 bp, Homo sapiens
cccgggctctctgctgt

SEQ ID NO: 3790019 - DNA, 21 bp, Homo sapiens
cccgtctggggttcagcccct

SEQ ID NO: 3790020 - DNA, 23 bp, Homo sapiens
cccgtctggggttcagcccctcc

SEQ ID NO: 3790021 - DNA, 13 bp, Homo sapiens
cccgtcttcagcc

SEQ ID NO: 3790022 - DNA, 18 bp, Homo sapiens
cccgtgcaaaacatgcta

SEQ ID NO: 3790023 - DNA, 15 bp, Homo sapiens
cccgtgcagactgga

SEQ ID NO: 3790024 - DNA, 18 bp, Homo sapiens
cccgtgcagactggaggg

SEQ ID NO: 3790025 - DNA, 14 bp, Homo sapiens
cccgtgtggcccct

SEQ ID NO: 3790026 - DNA, 23 bp, Homo sapiens
ccgtctggggttcagcccctcct

SEQ ID NO: 3790027 - DNA, 21 bp, Homo sapiens
ccgtgagcagtgtgtctcctg

SEQ ID NO: 3790028 - DNA, 14 bp, Homo sapiens
ccgtgccttcagct

SEQ ID NO: 3790029 - DNA, 20 bp, Homo sapiens
ccgtgcttgtttgctcacct

SEQ ID NO: 3790030 - DNA, 14 bp, Homo sapiens
ccgtggctgcggca

SEQ ID NO: 3790031 - DNA, 16 bp, Homo sapiens
ccgtgtggccccttca

SEQ ID NO: 3790032 - DNA, 16 bp, Homo sapiens
cctaaaattcagtgga

SEQ ID NO: 3790033 - DNA, 19 bp, Homo sapiens
cctaaagtagacttcattt

SEQ ID NO: 3790034 - DNA, 17 bp, Homo sapiens
cctaacattcgatctca

SEQ ID NO: 3790035 - DNA, 13 bp, Homo sapiens
cctaagccaaggg

SEQ ID NO: 3790036 - DNA, 21 bp, Homo sapiens
cctaagccaagggcctcttgc

SEQ ID NO: 3790037 - DNA, 23 bp, Homo sapiens
cctaaggcacccacaaataaatg

SEQ ID NO: 3790038 - DNA, 16 bp, Homo sapiens
cctaagtccctgcccc

SEQ ID NO: 3790039 - DNA, 14 bp, Homo sapiens
cctaagtggctgct

SEQ ID NO: 3790040 - DNA, 18 bp, Homo sapiens
cctaagttcttagatatc

SEQ ID NO: 3790041 - DNA, 20 bp, Homo sapiens
cctaagtttcagttgatttt

SEQ ID NO: 3790042 - DNA, 22 bp, Homo sapiens
cctaatccctgggcattgcttt

SEQ ID NO: 3790043 - DNA, 17 bp, Homo sapiens
cctaatgtggcagctgt

SEQ ID NO: 3790044 - DNA, 18 bp, Homo sapiens
cctaatgtttatgagcca

SEQ ID NO: 3790045 - DNA, 14 bp, Homo sapiens
cctaattagagcag

SEQ ID NO: 3790046 - DNA, 23 bp, Homo sapiens
cctaattagagcagatgacccct

SEQ ID NO: 3790047 - DNA, 18 bp, Homo sapiens
cctacaagagcagcctgt

SEQ ID NO: 3790048 - DNA, 21 bp, Homo sapiens
cctacagaatactagccagag

SEQ ID NO: 3790049 - DNA, 14 bp, Homo sapiens
cctacagatgaact

SEQ ID NO: 3790050 - DNA, 22 bp, Homo sapiens
cctacagttgaaaaacagctga

SEQ ID NO: 3790051 - DNA, 19 bp, Homo sapiens
cctacatgaaacagaaaca

SEQ ID NO: 3790052 - DNA, 15 bp, Homo sapiens
cctaccacagtgtct

SEQ ID NO: 3790053 - DNA, 18 bp, Homo sapiens
cctaccacctccccagcc

SEQ ID NO: 3790054 - DNA, 13 bp, Homo sapiens
cctacccaccctc

SEQ ID NO: 3790055 - DNA, 11 bp, Homo sapiens
cctaccccacc

SEQ ID NO: 3790056 - DNA, 17 bp, Homo sapiens
cctaccgagtctcttct

SEQ ID NO: 3790057 - DNA, 20 bp, Homo sapiens
cctaccgagtctcttctcca

SEQ ID NO: 3790058 - DNA, 20 bp, Homo sapiens
cctacctcaacctgtaaatt

SEQ ID NO: 3790059 - DNA, 14 bp, Homo sapiens
cctacctcagccta

SEQ ID NO: 3790060 - DNA, 16 bp, Homo sapiens
cctacctcagcctaga

SEQ ID NO: 3790061 - DNA, 15 bp, Homo sapiens
cctacctcaggcagg

SEQ ID NO: 3790062 - DNA, 12 bp, Homo sapiens
cctacctggtaa

SEQ ID NO: 3790063 - DNA, 16 bp, Homo sapiens
cctacttttccttccc

SEQ ID NO: 3790064 - DNA, 21 bp, Homo sapiens
cctagaaattccccaccctga

SEQ ID NO: 3790065 - DNA, 15 bp, Homo sapiens
cctagagcacactgt

SEQ ID NO: 3790066 - DNA, 17 bp, Homo sapiens
cctagataaaaagatgg

SEQ ID NO: 3790067 - DNA, 19 bp, Homo sapiens
cctagatccacacacagag

SEQ ID NO: 3790068 - DNA, 18 bp, Homo sapiens
cctagcactcacatgctg

SEQ ID NO: 3790069 - DNA, 17 bp, Homo sapiens
cctagcactttgggagg

SEQ ID NO: 3790070 - DNA, 13 bp, Homo sapiens
cctagccctctca

SEQ ID NO: 3790071 - DNA, 20 bp, Homo sapiens
cctagccctctcacatttat

SEQ ID NO: 3790072 - DNA, 14 bp, Homo sapiens
cctagccgacctca

SEQ ID NO: 3790073 - DNA, 19 bp, Homo sapiens
cctagccttagaagtcaca

SEQ ID NO: 3790074 - DNA, 13 bp, Homo sapiens
cctagctgtgtgc

SEQ ID NO: 3790075 - DNA, 20 bp, Homo sapiens
cctagcttgggaggcttccc

SEQ ID NO: 3790076 - DNA, 21 bp, Homo sapiens
cctagcttgggaggcttcccc

SEQ ID NO: 3790077 - DNA, 17 bp, Homo sapiens
cctaggaattcccagcc

SEQ ID NO: 3790078 - DNA, 23 bp, Homo sapiens
cctaggcatttgctgaatacaga

SEQ ID NO: 3790079 - DNA, 17 bp, Homo sapiens
cctaggctgaccttgaa

SEQ ID NO: 3790080 - DNA, 15 bp, Homo sapiens
cctaggggtcaggga

SEQ ID NO: 3790081 - DNA, 15 bp, Homo sapiens
cctagtcccttcccc

SEQ ID NO: 3790082 - DNA, 18 bp, Homo sapiens
cctagtggggtctccctc

SEQ ID NO: 3790083 - DNA, 20 bp, Homo sapiens
cctagtggggtctccctctc

SEQ ID NO: 3790084 - DNA, 16 bp, Homo sapiens
cctagttttctcctcc

SEQ ID NO: 3790085 - DNA, 20 bp, Homo sapiens
cctagttttctcctcccagg

SEQ ID NO: 3790086 - DNA, 20 bp, Homo sapiens
cctataaaacaggtcaatac

SEQ ID NO: 3790087 - DNA, 23 bp, Homo sapiens
cctataaaacaggtcaatacagt

SEQ ID NO: 3790088 - DNA, 13 bp, Homo sapiens
cctataatgctgg

SEQ ID NO: 3790089 - DNA, 15 bp, Homo sapiens
cctatagtcccagct

SEQ ID NO: 3790090 - DNA, 18 bp, Homo sapiens
cctatagtcccagctact

SEQ ID NO: 3790091 - DNA, 22 bp, Homo sapiens
cctatattgttttcagtgtaca

SEQ ID NO: 3790092 - DNA, 16 bp, Homo sapiens
cctatcacctcccctc

SEQ ID NO: 3790093 - DNA, 14 bp, Homo sapiens
cctatccacccagc

SEQ ID NO: 3790094 - DNA, 18 bp, Homo sapiens
cctatccacccagcccat

SEQ ID NO: 3790095 - DNA, 11 bp, Homo sapiens
cctatgtttgc

SEQ ID NO: 3790096 - DNA, 17 bp, Homo sapiens
cctattagagaagagat

SEQ ID NO: 3790097 - DNA, 16 bp, Homo sapiens
cctatttcaaaaattt

SEQ ID NO: 3790098 - DNA, 22 bp, Homo sapiens
cctatttcaaaaatttggaatt

SEQ ID NO: 3790099 - DNA, 18 bp, Homo sapiens
cctcaaagcttccattcc

SEQ ID NO: 3790100 - DNA, 23 bp, Homo sapiens
cctcaaccctccctcagcccctc

SEQ ID NO: 3790101 - DNA, 15 bp, Homo sapiens
cctcaacctcctggg

SEQ ID NO: 3790102 - DNA, 20 bp, Homo sapiens
cctcaacctgtaaattattt

SEQ ID NO: 3790103 - DNA, 23 bp, Homo sapiens
cctcaacctgtaaattattttaa

SEQ ID NO: 3790104 - DNA, 19 bp, Homo sapiens
cctcaaggacttgaaagca

SEQ ID NO: 3790105 - DNA, 23 bp, Homo sapiens
cctcaaggacttgaaagcatcca

SEQ ID NO: 3790106 - DNA, 19 bp, Homo sapiens
cctcaagggggactgtctt

SEQ ID NO: 3790107 - DNA, 20 bp, Homo sapiens
cctcaagtgattctcctgcc

SEQ ID NO: 3790108 - DNA, 23 bp, Homo sapiens
cctcaagtgattctcctgcctca

SEQ ID NO: 3790109 - DNA, 21 bp, Homo sapiens
cctcaatgtgaatcagaccct

SEQ ID NO: 3790110 - DNA, 15 bp, Homo sapiens
cctcaattcatcaat

SEQ ID NO: 3790111 - DNA, 15 bp, Homo sapiens
cctcacatctttcac

SEQ ID NO: 3790112 - DNA, 16 bp, Homo sapiens
cctcaccccgtctggg

SEQ ID NO: 3790113 - DNA, 18 bp, Homo sapiens
cctcacctctggactggc

SEQ ID NO: 3790114 - DNA, 14 bp, Homo sapiens
cctcacctgggcac

SEQ ID NO: 3790115 - DNA, 18 bp, Homo sapiens
cctcacctgggcacctgg

SEQ ID NO: 3790116 - DNA, 19 bp, Homo sapiens
cctcaccttgcaacacaca

SEQ ID NO: 3790117 - DNA, 21 bp, Homo sapiens
cctcaccttgcaacacacaga

SEQ ID NO: 3790118 - DNA, 22 bp, Homo sapiens
cctcaccttgcaacacacagac

SEQ ID NO: 3790119 - DNA, 18 bp, Homo sapiens
cctcactctgttgctcag

SEQ ID NO: 3790120 - DNA, 20 bp, Homo sapiens
cctcactggggtcctggggc

SEQ ID NO: 3790121 - DNA, 23 bp, Homo sapiens
cctcactggggtcctggggcctc

SEQ ID NO: 3790122 - DNA, 13 bp, Homo sapiens
cctcactgggtgg

SEQ ID NO: 3790123 - DNA, 14 bp, Homo sapiens
cctcagactgctca

SEQ ID NO: 3790124 - DNA, 19 bp, Homo sapiens
cctcagagtccaggcccca

SEQ ID NO: 3790125 - DNA, 22 bp, Homo sapiens
cctcagcaacctgtaagactga

SEQ ID NO: 3790126 - DNA, 16 bp, Homo sapiens
cctcagcccctcttgc

SEQ ID NO: 3790127 - DNA, 18 bp, Homo sapiens
cctcagcccctcttgccc

SEQ ID NO: 3790128 - DNA, 20 bp, Homo sapiens
cctcagcccctcttgccccc

SEQ ID NO: 3790129 - DNA, 23 bp, Homo sapiens
cctcagcccctcttgccccccac

SEQ ID NO: 3790130 - DNA, 23 bp, Homo sapiens
cctcagcctcccaaagtgctggg

SEQ ID NO: 3790131 - DNA, 13 bp, Homo sapiens
cctcagctgcctc

SEQ ID NO: 3790132 - DNA, 16 bp, Homo sapiens
cctcaggaccctcgct

SEQ ID NO: 3790133 - DNA, 21 bp, Homo sapiens
cctcaggaccctcgctggccc

SEQ ID NO: 3790134 - DNA, 15 bp, Homo sapiens
cctcaggcaggaagg

SEQ ID NO: 3790135 - DNA, 21 bp, Homo sapiens
cctcaggccaggtgcagtggc

SEQ ID NO: 3790136 - DNA, 23 bp, Homo sapiens
cctcagggacagagacacctgca

SEQ ID NO: 3790137 - DNA, 20 bp, Homo sapiens
cctcagggcagcctgcctgg

SEQ ID NO: 3790138 - DNA, 13 bp, Homo sapiens
cctgccccatccc

SEQ ID NO: 3790139 - DNA, 16 bp, Homo sapiens
cctgcccccacacctg

SEQ ID NO: 3790140 - DNA, 19 bp, Homo sapiens
cctgcccccacacctggcc

SEQ ID NO: 3790141 - DNA, 21 bp, Homo sapiens
cctgcccccacacctggccct

SEQ ID NO: 3790142 - DNA, 15 bp, Homo sapiens
cctgccccctggtgg

SEQ ID NO: 3790143 - DNA, 23 bp, Homo sapiens
cctgcccccttctcccacactgc

SEQ ID NO: 3790144 - DNA, 11 bp, Homo sapiens
cctgcccctgc

SEQ ID NO: 3790145 - DNA, 18 bp, Homo sapiens
cctgccctagagcacact

SEQ ID NO: 3790146 - DNA, 22 bp, Homo sapiens
cctgccctagagcacactgtag

SEQ ID NO: 3790147 - DNA, 20 bp, Homo sapiens
cctgccctgctgccgcctcc

SEQ ID NO: 3790148 - DNA, 17 bp, Homo sapiens
cctgcccttcagcatcc

SEQ ID NO: 3790149 - DNA, 19 bp, Homo sapiens
cctgcccttgtcccactca

SEQ ID NO: 3790150 - DNA, 11 bp, Homo sapiens
cctgcctcagc

SEQ ID NO: 3790151 - DNA, 12 bp, Homo sapiens
cctgcctcagcc

SEQ ID NO: 3790152 - DNA, 13 bp, Homo sapiens
cctgcctcagcct

SEQ ID NO: 3790153 - DNA, 21 bp, Homo sapiens
cctgcctcgaactggctgcaa

SEQ ID NO: 3790154 - DNA, 14 bp, Homo sapiens
cctgcctcttaaat

SEQ ID NO: 3790155 - DNA, 15 bp, Homo sapiens
cctgcctcttctcta

SEQ ID NO: 3790156 - DNA, 18 bp, Homo sapiens
cctgcctggccaggcaga

SEQ ID NO: 3790157 - DNA, 23 bp, Homo sapiens
cctgcctggccaggcagatctgt

SEQ ID NO: 3790158 - DNA, 18 bp, Homo sapiens
cctgccttcttcggggaa

SEQ ID NO: 3790159 - DNA, 13 bp, Homo sapiens
cctgccttgaagc

SEQ ID NO: 3790160 - DNA, 16 bp, Homo sapiens
cctgccttgaagccac

SEQ ID NO: 3790161 - DNA, 19 bp, Homo sapiens
cctgcgaaggggccctggt

SEQ ID NO: 3790162 - DNA, 20 bp, Homo sapiens
cctgcgaaggggccctggtc

SEQ ID NO: 3790163 - DNA, 16 bp, Homo sapiens
cctgcggcctgctgga

SEQ ID NO: 3790164 - DNA, 12 bp, Homo sapiens
cctgcgggctgc

SEQ ID NO: 3790165 - DNA, 17 bp, Homo sapiens
cctgcggtcaaggccag

SEQ ID NO: 3790166 - DNA, 23 bp, Homo sapiens
cctgcgtctcatactcacctcac

SEQ ID NO: 3790167 - DNA, 16 bp, Homo sapiens
cctgcgtggctgaccc

SEQ ID NO: 3790168 - DNA, 23 bp, Homo sapiens
cctgcgtggctgacccccctcag

SEQ ID NO: 3790169 - DNA, 21 bp, Homo sapiens
cctgctaattccccagattgc

SEQ ID NO: 3790170 - DNA, 13 bp, Homo sapiens
cctgctagaaatg

SEQ ID NO: 3790171 - DNA, 19 bp, Homo sapiens
cctgctctcctcttgccac

SEQ ID NO: 3790172 - DNA, 21 bp, Homo sapiens
cctgctctcctcttgccactg

SEQ ID NO: 3790173 - DNA, 15 bp, Homo sapiens
cctgctctctaccca

SEQ ID NO: 3790174 - DNA, 23 bp, Homo sapiens
cctgctgaatgatttccaaagag

SEQ ID NO: 3790175 - DNA, 17 bp, Homo sapiens
cctgctgagagacccaa

SEQ ID NO: 3790176 - DNA, 17 bp, Homo sapiens
cctgctgatgtggcaac

SEQ ID NO: 3790177 - DNA, 10 bp, Homo sapiens
cctgctgcat

SEQ ID NO: 3790178 - DNA, 15 bp, Homo sapiens
cctgctgccgcctcc

SEQ ID NO: 3790179 - DNA, 17 bp, Homo sapiens
cctgctgcctccccaac

SEQ ID NO: 3790180 - DNA, 19 bp, Homo sapiens
cctgctgcctccccaaccc

SEQ ID NO: 3790181 - DNA, 13 bp, Homo sapiens
cctgctggatctc

SEQ ID NO: 3790182 - DNA, 16 bp, Homo sapiens
cctgctggatctccca

SEQ ID NO: 3790183 - DNA, 21 bp, Homo sapiens
cctgctggatctcccagggct

SEQ ID NO: 3790184 - DNA, 22 bp, Homo sapiens
cctgctggatctcccagggcta

SEQ ID NO: 3790185 - DNA, 14 bp, Homo sapiens
cctgctggcccctc

SEQ ID NO: 3790186 - DNA, 12 bp, Homo sapiens
cctgctgggctc

SEQ ID NO: 3790187 - DNA, 18 bp, Homo sapiens
cctgctgggctctccacc

SEQ ID NO: 3790188 - DNA, 20 bp, Homo sapiens
cctgctgggctctccacctc

SEQ ID NO: 3790189 - DNA, 21 bp, Homo sapiens
cctgctgggctctccacctca

SEQ ID NO: 3790190 - DNA, 22 bp, Homo sapiens
cctgctttcaagacccctgtct

SEQ ID NO: 3790191 - DNA, 22 bp, Homo sapiens
cctgctttgggctgccctggtg

SEQ ID NO: 3790192 - DNA, 15 bp, Homo sapiens
cctggaaaggctcag

SEQ ID NO: 3790193 - DNA, 17 bp, Homo sapiens
cctggaaaggctcagtc

SEQ ID NO: 3790194 - DNA, 20 bp, Homo sapiens
cctggaagctgtgtccttgc

SEQ ID NO: 3790195 - DNA, 13 bp, Homo sapiens
cctggaccctgtg

SEQ ID NO: 3790196 - DNA, 15 bp, Homo sapiens
cctggagatggggag

SEQ ID NO: 3790197 - DNA, 16 bp, Homo sapiens
cctggagatggggaga

SEQ ID NO: 3790198 - DNA, 17 bp, Homo sapiens
cctggagccccactgcc

SEQ ID NO: 3790199 - DNA, 16 bp, Homo sapiens
cctggaggaaccgaaa

SEQ ID NO: 3790200 - DNA, 16 bp, Homo sapiens
cctggaggatttcatc

SEQ ID NO: 3790201 - DNA, 22 bp, Homo sapiens
cctggatctaccagcataaata

SEQ ID NO: 3790202 - DNA, 19 bp, Homo sapiens
cctggcaatagtgtgttct

SEQ ID NO: 3790203 - DNA, 18 bp, Homo sapiens
cctggcacagggcagtgg

SEQ ID NO: 3790204 - DNA, 21 bp, Homo sapiens
cctggcacccggcccctgctg

SEQ ID NO: 3790205 - DNA, 13 bp, Homo sapiens
cctggcagaactg

SEQ ID NO: 3790206 - DNA, 14 bp, Homo sapiens
cctggcagaactga

SEQ ID NO: 3790207 - DNA, 23 bp, Homo sapiens
cctggcagaactgagctcctctg

SEQ ID NO: 3790208 - DNA, 18 bp, Homo sapiens
cctggcagccgtgccttc

SEQ ID NO: 3790209 - DNA, 17 bp, Homo sapiens
cctggcaggatgaccct

SEQ ID NO: 3790210 - DNA, 22 bp, Homo sapiens
cctggcaggatgaccctgcgaa

SEQ ID NO: 3790211 - DNA, 17 bp, Homo sapiens
cctggcatggcacctgt

SEQ ID NO: 3790212 - DNA, 14 bp, Homo sapiens
cctggccaggagct

SEQ ID NO: 3790213 - DNA, 15 bp, Homo sapiens
cctggccccatgtct

SEQ ID NO: 3790214 - DNA, 21 bp, Homo sapiens
cctggccccatgtctctcaga

SEQ ID NO: 3790215 - DNA, 16 bp, Homo sapiens
cctggccctggggcct

SEQ ID NO: 3790216 - DNA, 22 bp, Homo sapiens
cctggcctcaagtgattctcct

SEQ ID NO: 3790217 - DNA, 19 bp, Homo sapiens
cctggcctgttctgttttg

SEQ ID NO: 3790218 - DNA, 18 bp, Homo sapiens
cctggctacatcccagcc

SEQ ID NO: 3790219 - DNA, 19 bp, Homo sapiens
cctggctacatcccagcct

SEQ ID NO: 3790220 - DNA, 15 bp, Homo sapiens
cctggctcccatgac

SEQ ID NO: 3790221 - DNA, 18 bp, Homo sapiens
cctggctccgctgtgtgg

SEQ ID NO: 3790222 - DNA, 19 bp, Homo sapiens
cctggctccgctgtgtgga

SEQ ID NO: 3790223 - DNA, 15 bp, Homo sapiens
cctggctcctgaggg

SEQ ID NO: 3790224 - DNA, 20 bp, Homo sapiens
cctggctctgaccgaaacag

SEQ ID NO: 3790225 - DNA, 14 bp, Homo sapiens
cctggcttctggag

SEQ ID NO: 3790226 - DNA, 20 bp, Homo sapiens
cctggcttctggagcccttg

SEQ ID NO: 3790227 - DNA, 22 bp, Homo sapiens
cctggcttctggagcccttggg

SEQ ID NO: 3790228 - DNA, 15 bp, Homo sapiens
cctggctttgcccaa

SEQ ID NO: 3790229 - DNA, 20 bp, Homo sapiens
cctggctttgcccaacctca

SEQ ID NO: 3790230 - DNA, 22 bp, Homo sapiens
cctggctttgcccaacctcagc

SEQ ID NO: 3790231 - DNA, 23 bp, Homo sapiens
cctggctttgcccaacctcagca

SEQ ID NO: 3790232 - DNA, 17 bp, Homo sapiens
cctggcttttcactgct

SEQ ID NO: 3790233 - DNA, 18 bp, Homo sapiens
cctggcttttcactgctg

SEQ ID NO: 3790234 - DNA, 20 bp, Homo sapiens
cctggcttttcactgctggc

SEQ ID NO: 3790235 - DNA, 21 bp, Homo sapiens
cctggcttttcactgctggct

SEQ ID NO: 3790236 - DNA, 22 bp, Homo sapiens
cctggcttttcactgctggctg

SEQ ID NO: 3790237 - DNA, 21 bp, Homo sapiens
cctgggaaggctactcacctt

SEQ ID NO: 3790238 - DNA, 14 bp, Homo sapiens
cctgggaatgtatt

SEQ ID NO: 3790239 - DNA, 18 bp, Homo sapiens
cctgggagaacctcaggc

SEQ ID NO: 3790240 - DNA, 19 bp, Homo sapiens
cctgggaggaaatttgaat

SEQ ID NO: 3790241 - DNA, 22 bp, Homo sapiens
cctgggaggtcaaggctgcagt

SEQ ID NO: 3790242 - DNA, 19 bp, Homo sapiens
cctgggcagccaggctgcc

SEQ ID NO: 3790243 - DNA, 14 bp, Homo sapiens
cctgggcattgctt

SEQ ID NO: 3790244 - DNA, 14 bp, Homo sapiens
cctgggccccacca

SEQ ID NO: 3790245 - DNA, 21 bp, Homo sapiens
cctgggccccaccacctaggc

SEQ ID NO: 3790246 - DNA, 20 bp, Homo sapiens
cctgggcccctccctacctc

SEQ ID NO: 3790247 - DNA, 20 bp, Homo sapiens
cctgggctctgccccagctc

SEQ ID NO: 3790248 - DNA, 18 bp, Homo sapiens
cctggggagtgggacaga

SEQ ID NO: 3790249 - DNA, 19 bp, Homo sapiens
cctggggcagtcacctgcc

SEQ ID NO: 3790250 - DNA, 11 bp, Homo sapiens
cctttggcttc

SEQ ID NO: 3790251 - DNA, 12 bp, Homo sapiens
cctttgtaagtt

SEQ ID NO: 3790252 - DNA, 22 bp, Homo sapiens
ccttttaaatcctgttgaaaag

SEQ ID NO: 3790253 - DNA, 18 bp, Homo sapiens
ccttttacatactgctgt

SEQ ID NO: 3790254 - DNA, 15 bp, Homo sapiens
ccttttcactacacc

SEQ ID NO: 3790255 - DNA, 21 bp, Homo sapiens
ccttttcttgtttatcagcag

SEQ ID NO: 3790256 - DNA, 22 bp, Homo sapiens
ccttttgagggacaaatttaaa

SEQ ID NO: 3790257 - DNA, 12 bp, Homo sapiens
ccttttggcact

SEQ ID NO: 3790258 - DNA, 21 bp, Homo sapiens
ccttttggcccccgagctggg

SEQ ID NO: 3790259 - DNA, 15 bp, Homo sapiens
ccttttgggtttctg

SEQ ID NO: 3790260 - DNA, 15 bp, Homo sapiens
cgaaactggaagtta

SEQ ID NO: 3790261 - DNA, 20 bp, Homo sapiens
cgaaaggatgaaagtgacca

SEQ ID NO: 3790262 - DNA, 13 bp, Homo sapiens
cgaaatgttattt

SEQ ID NO: 3790263 - DNA, 22 bp, Homo sapiens
cgaacaccctcgaagcgcgcca

SEQ ID NO: 3790264 - DNA, 20 bp, Homo sapiens
cgaacatggaactcattcct

SEQ ID NO: 3790265 - DNA, 23 bp, Homo sapiens
cgaacatgtttttcttctccctc

SEQ ID NO: 3790266 - DNA, 18 bp, Homo sapiens
cgaacccacactgcaaca

SEQ ID NO: 3790267 - DNA, 16 bp, Homo sapiens
cgaacccacctgctga

SEQ ID NO: 3790268 - DNA, 18 bp, Homo sapiens
cgaagaagggtccttccc

SEQ ID NO: 3790269 - DNA, 11 bp, Homo sapiens
cgaagcgcgcc

SEQ ID NO: 3790270 - DNA, 13 bp, Homo sapiens
cgaagctcagccc

SEQ ID NO: 3790271 - DNA, 16 bp, Homo sapiens
cgaagctcagcccacc

SEQ ID NO: 3790272 - DNA, 17 bp, Homo sapiens
cgaagctcagcccaccc

SEQ ID NO: 3790273 - DNA, 14 bp, Homo sapiens
cgaatagctgggac

SEQ ID NO: 3790274 - DNA, 19 bp, Homo sapiens
cgacatggacccggagcta

SEQ ID NO: 3790275 - DNA, 15 bp, Homo sapiens
cgaccgaggctggag

SEQ ID NO: 3790276 - DNA, 17 bp, Homo sapiens
cgactgtgacctgtggg

SEQ ID NO: 3790277 - DNA, 13 bp, Homo sapiens
cgagaagcaagaa

SEQ ID NO: 3790278 - DNA, 13 bp, Homo sapiens
cgagaccagcctg

SEQ ID NO: 3790279 - DNA, 16 bp, Homo sapiens
cgagaccagcctggcc

SEQ ID NO: 3790280 - DNA, 17 bp, Homo sapiens
cgagaccagcctggcca

SEQ ID NO: 3790281 - DNA, 14 bp, Homo sapiens
cgagagcctgctcc

SEQ ID NO: 3790282 - DNA, 21 bp, Homo sapiens
cgagagcctgctcccccaccc

SEQ ID NO: 3790283 - DNA, 18 bp, Homo sapiens
cgagatcacgccactgca

SEQ ID NO: 3790284 - DNA, 17 bp, Homo sapiens
cgagcagtcctgcctca

SEQ ID NO: 3790285 - DNA, 12 bp, Homo sapiens
cgagctgggggc

SEQ ID NO: 3790286 - DNA, 16 bp, Homo sapiens
cgagctgggggccatg

SEQ ID NO: 3790287 - DNA, 22 bp, Homo sapiens
cgagctggtgcattacagagag

SEQ ID NO: 3790288 - DNA, 11 bp, Homo sapiens
cgaggaagccc

SEQ ID NO: 3790289 - DNA, 13 bp, Homo sapiens
cgaggacagggag

SEQ ID NO: 3790290 - DNA, 18 bp, Homo sapiens
cgaggccttctctgaagg

SEQ ID NO: 3790291 - DNA, 13 bp, Homo sapiens
cgaggctgggcca

SEQ ID NO: 3790292 - DNA, 14 bp, Homo sapiens
cgaggctgggccaa

SEQ ID NO: 3790293 - DNA, 16 bp, Homo sapiens
cgaggctgggccaagc

SEQ ID NO: 3790294 - DNA, 17 bp, Homo sapiens
cgagggatgtggagcac

SEQ ID NO: 3790295 - DNA, 18 bp, Homo sapiens
cgaggggagggtggcagg

SEQ ID NO: 3790296 - DNA, 16 bp, Homo sapiens
cgagggtcctggctcc

SEQ ID NO: 3790297 - DNA, 23 bp, Homo sapiens
cgagggtcctggctcctgagggg

SEQ ID NO: 3790298 - DNA, 23 bp, Homo sapiens
cgaggtcaacagagaaggcagga

SEQ ID NO: 3790299 - DNA, 23 bp, Homo sapiens
cgaggtggatcacagaggcttct

SEQ ID NO: 3790300 - DNA, 15 bp, Homo sapiens
cgaggtggctgcctg

SEQ ID NO: 3790301 - DNA, 14 bp, Homo sapiens
cgagtagctgggac

SEQ ID NO: 3790302 - DNA, 20 bp, Homo sapiens
cgagtcaatcccctcattca

SEQ ID NO: 3790303 - DNA, 15 bp, Homo sapiens
cgagtcactgcctct

SEQ ID NO: 3790304 - DNA, 20 bp, Homo sapiens
cgagtggatagatgccctgc

SEQ ID NO: 3790305 - DNA, 23 bp, Homo sapiens
cgatcatggctcactgcagcctc

SEQ ID NO: 3790306 - DNA, 22 bp, Homo sapiens
cgatccacctgtctcagcctcc

SEQ ID NO: 3790307 - DNA, 11 bp, Homo sapiens
cgatgtggccc

SEQ ID NO: 3790308 - DNA, 16 bp, Homo sapiens
cgatgtggccctggcc

SEQ ID NO: 3790309 - DNA, 18 bp, Homo sapiens
cgatgtggccctggcctg

SEQ ID NO: 3790310 - DNA, 13 bp, Homo sapiens
cgattcttctgct

SEQ ID NO: 3790311 - DNA, 16 bp, Homo sapiens
cgcacaaggctgacca

SEQ ID NO: 3790312 - DNA, 20 bp, Homo sapiens
cgcacacacacacacaggag

SEQ ID NO: 3790313 - DNA, 12 bp, Homo sapiens
cgcacctcccat

SEQ ID NO: 3790314 - DNA, 17 bp, Homo sapiens
cgcacctgccccctggt

SEQ ID NO: 3790315 - DNA, 13 bp, Homo sapiens
cgcagccctgctt

SEQ ID NO: 3790316 - DNA, 24 bp, Homo sapiens
cgcagccctgctttgggctgccct

SEQ ID NO: 3790317 - DNA, 15 bp, Homo sapiens
cgcaggaagctgctc

SEQ ID NO: 3790318 - DNA, 11 bp, Homo sapiens
cgcaggaatgg

SEQ ID NO: 3790319 - DNA, 19 bp, Homo sapiens
cgcagtgcttctctacaga

SEQ ID NO: 3790320 - DNA, 13 bp, Homo sapiens
cgcatcttctcca

SEQ ID NO: 3790321 - DNA, 15 bp, Homo sapiens
cgcatcttctccatc

SEQ ID NO: 3790322 - DNA, 16 bp, Homo sapiens
cgcatcttctccatct

SEQ ID NO: 3790323 - DNA, 13 bp, Homo sapiens
cgcatgcagcagc

SEQ ID NO: 3790324 - DNA, 14 bp, Homo sapiens
cgcatgcagcagct

SEQ ID NO: 3790325 - DNA, 16 bp, Homo sapiens
cgcatgcagcagcttg

SEQ ID NO: 3790326 - DNA, 14 bp, Homo sapiens
cgcattccaggctc

SEQ ID NO: 3790327 - DNA, 12 bp, Homo sapiens
cgccaaggctgg

SEQ ID NO: 3790328 - DNA, 19 bp, Homo sapiens
cgccacatccccgctggct

SEQ ID NO: 3790329 - DNA, 15 bp, Homo sapiens
cgccactcgcttccc

SEQ ID NO: 3790330 - DNA, 21 bp, Homo sapiens
cgccactgcactctagccgga

SEQ ID NO: 3790331 - DNA, 20 bp, Homo sapiens
cgccaggaccgccaaagaat

SEQ ID NO: 3790332 - DNA, 15 bp, Homo sapiens
cgccatgctcctggc

SEQ ID NO: 3790333 - DNA, 17 bp, Homo sapiens
cgccatgctcctggccc

SEQ ID NO: 3790334 - DNA, 14 bp, Homo sapiens
cgccattgccacca

SEQ ID NO: 3790335 - DNA, 17 bp, Homo sapiens
cgccattgccaccagga

SEQ ID NO: 3790336 - DNA, 18 bp, Homo sapiens
cgccattgccaccaggag

SEQ ID NO: 3790337 - DNA, 18 bp, Homo sapiens
cgcccagctgcacctgcc

SEQ ID NO: 3790338 - DNA, 11 bp, Homo sapiens
cgcccaggaga

SEQ ID NO: 3790339 - DNA, 22 bp, Homo sapiens
cgcccagttgggtggatgcctg

SEQ ID NO: 3790340 - DNA, 12 bp, Homo sapiens
cgcccccagtgt

SEQ ID NO: 3790341 - DNA, 16 bp, Homo sapiens
cgccctaggcctggca

SEQ ID NO: 3790342 - DNA, 23 bp, Homo sapiens
cgccctaggcctggcatggcacc

SEQ ID NO: 3790343 - DNA, 18 bp, Homo sapiens
cgccctcattacggctcc

SEQ ID NO: 3790344 - DNA, 22 bp, Homo sapiens
cgccctcattacggctcctctc

SEQ ID NO: 3790345 - DNA, 14 bp, Homo sapiens
cgcctacaggagtg

SEQ ID NO: 3790346 - DNA, 20 bp, Homo sapiens
cgcctagtggggtctccctc

SEQ ID NO: 3790347 - DNA, 16 bp, Homo sapiens
cgcctatgatcccagc

SEQ ID NO: 3790348 - DNA, 14 bp, Homo sapiens
cgcctcccagcctg

SEQ ID NO: 3790349 - DNA, 20 bp, Homo sapiens
cgcctccctcccctgccctc

SEQ ID NO: 3790350 - DNA, 13 bp, Homo sapiens
cgcctctgctggc

SEQ ID NO: 3790351 - DNA, 20 bp, Homo sapiens
cgcctggcagaactgagctc

SEQ ID NO: 3790352 - DNA, 18 bp, Homo sapiens
cgcctgtaatcccagcac

SEQ ID NO: 3790353 - DNA, 20 bp, Homo sapiens
cgcctgtaatcccagcactt

SEQ ID NO: 3790354 - DNA, 20 bp, Homo sapiens
cgcctgtaatcccagctact

SEQ ID NO: 3790355 - DNA, 20 bp, Homo sapiens
cgcctgtagtcccagctact

SEQ ID NO: 3790356 - DNA, 12 bp, Homo sapiens
cgccttgttctt

SEQ ID NO: 3790357 - DNA, 22 bp, Homo sapiens
cgcgccactacactccagcctg

SEQ ID NO: 3790358 - DNA, 23 bp, Homo sapiens
cgcgccactacactccagcctga

SEQ ID NO: 3790359 - DNA, 22 bp, Homo sapiens
cgcgccactcgcttcccccata

SEQ ID NO: 3790360 - DNA, 17 bp, Homo sapiens
cgcggtacaaaggaaaa

SEQ ID NO: 3790361 - DNA, 18 bp, Homo sapiens
cgctagaggaagcagcca

SEQ ID NO: 3790362 - DNA, 12 bp, Homo sapiens
cgctcagccctc

SEQ ID NO: 3790363 - DNA, 16 bp, Homo sapiens
cgctcagccctccctg

SEQ ID NO: 3790364 - DNA, 16 bp, Homo sapiens
ctagccgacctcagcc

SEQ ID NO: 3790365 - DNA, 19 bp, Homo sapiens
ctagccgacctcagccttc

SEQ ID NO: 3790366 - DNA, 20 bp, Homo sapiens
ctagccgacctcagccttcc

SEQ ID NO: 3790367 - DNA, 23 bp, Homo sapiens
ctagccttagaagtcacacagta

SEQ ID NO: 3790368 - DNA, 19 bp, Homo sapiens
ctagccttgaggagtgtga

SEQ ID NO: 3790369 - DNA, 12 bp, Homo sapiens
ctagcgctgccg

SEQ ID NO: 3790370 - DNA, 22 bp, Homo sapiens
ctagcgctgccgcaccccagag

SEQ ID NO: 3790371 - DNA, 21 bp, Homo sapiens
ctagctggaattttttattct

SEQ ID NO: 3790372 - DNA, 22 bp, Homo sapiens
ctagctggaattttttattctt

SEQ ID NO: 3790373 - DNA, 12 bp, Homo sapiens
ctagctgtgtgc

SEQ ID NO: 3790374 - DNA, 20 bp, Homo sapiens
ctagcttgggaggcttcccc

SEQ ID NO: 3790375 - DNA, 16 bp, Homo sapiens
ctaggaatgaaatcct

SEQ ID NO: 3790376 - DNA, 17 bp, Homo sapiens
ctaggaatgaaatcctg

SEQ ID NO: 3790377 - DNA, 14 bp, Homo sapiens
ctaggactctgagg

SEQ ID NO: 3790378 - DNA, 22 bp, Homo sapiens
ctaggactctgaggctctttct

SEQ ID NO: 3790379 - DNA, 20 bp, Homo sapiens
ctaggagaccaaggcgggag

SEQ ID NO: 3790380 - DNA, 15 bp, Homo sapiens
ctaggagctgggagg

SEQ ID NO: 3790381 - DNA, 18 bp, Homo sapiens
ctaggcatcccaggggac

SEQ ID NO: 3790382 - DNA, 17 bp, Homo sapiens
ctaggccactcctccaa

SEQ ID NO: 3790383 - DNA, 20 bp, Homo sapiens
ctaggcctggcatggcacct

SEQ ID NO: 3790384 - DNA, 19 bp, Homo sapiens
ctaggcctggccagatgca

SEQ ID NO: 3790385 - DNA, 15 bp, Homo sapiens
ctaggctggagccca

SEQ ID NO: 3790386 - DNA, 20 bp, Homo sapiens
ctaggctggagcccagggag

SEQ ID NO: 3790387 - DNA, 13 bp, Homo sapiens
ctaggctgggtgc

SEQ ID NO: 3790388 - DNA, 21 bp, Homo sapiens
ctaggctgggtgcccacagcc

SEQ ID NO: 3790389 - DNA, 22 bp, Homo sapiens
ctaggctgggtgcccacagccc

SEQ ID NO: 3790390 - DNA, 21 bp, Homo sapiens
ctagggaaaaaccagcgtgtg

SEQ ID NO: 3790391 - DNA, 17 bp, Homo sapiens
ctagggaaggccacctg

SEQ ID NO: 3790392 - DNA, 18 bp, Homo sapiens
ctagggaaggccacctgc

SEQ ID NO: 3790393 - DNA, 21 bp, Homo sapiens
ctagggaaggccacctgcagg

SEQ ID NO: 3790394 - DNA, 18 bp, Homo sapiens
ctagggacctggggaagc

SEQ ID NO: 3790395 - DNA, 21 bp, Homo sapiens
ctagggaggaccttatctgtg

SEQ ID NO: 3790396 - DNA, 20 bp, Homo sapiens
ctagggattcaggctgcttg

SEQ ID NO: 3790397 - DNA, 16 bp, Homo sapiens
ctaggtcaaggcctgt

SEQ ID NO: 3790398 - DNA, 17 bp, Homo sapiens
ctaggtcagcttgctgc

SEQ ID NO: 3790399 - DNA, 13 bp, Homo sapiens
ctaggtgggccag

SEQ ID NO: 3790400 - DNA, 21 bp, Homo sapiens
ctaggtgggccagcccctccc

SEQ ID NO: 3790401 - DNA, 16 bp, Homo sapiens
ctagtaaaaatacaaa

SEQ ID NO: 3790402 - DNA, 13 bp, Homo sapiens
ctagtcagagaga

SEQ ID NO: 3790403 - DNA, 16 bp, Homo sapiens
ctagtcagccacatgg

SEQ ID NO: 3790404 - DNA, 22 bp, Homo sapiens
ctagtcccttcccctccctggc

SEQ ID NO: 3790405 - DNA, 20 bp, Homo sapiens
ctagtctgtgtgggactgta

SEQ ID NO: 3790406 - DNA, 23 bp, Homo sapiens
ctagtctgtgtgggactgtacac

SEQ ID NO: 3790407 - DNA, 23 bp, Homo sapiens
ctagtgatttctggggccccacc

SEQ ID NO: 3790408 - DNA, 20 bp, Homo sapiens
ctagtgcagctgattttaac

SEQ ID NO: 3790409 - DNA, 23 bp, Homo sapiens
ctagtgccctccacagccgcagc

SEQ ID NO: 3790410 - DNA, 16 bp, Homo sapiens
ctagtgctgaagctta

SEQ ID NO: 3790411 - DNA, 18 bp, Homo sapiens
ctagtggggtctccctct

SEQ ID NO: 3790412 - DNA, 12 bp, Homo sapiens
ctagtggtggct

SEQ ID NO: 3790413 - DNA, 14 bp, Homo sapiens
ctagtgttgcttgg

SEQ ID NO: 3790414 - DNA, 12 bp, Homo sapiens
ctagttcatcca

SEQ ID NO: 3790415 - DNA, 19 bp, Homo sapiens
ctagttcatccaatcctca

SEQ ID NO: 3790416 - DNA, 21 bp, Homo sapiens
ctagttcatccaatcctcact

SEQ ID NO: 3790417 - DNA, 22 bp, Homo sapiens
ctagttcatccaatcctcactg

SEQ ID NO: 3790418 - DNA, 20 bp, Homo sapiens
ctagttcctgatgacccagg

SEQ ID NO: 3790419 - DNA, 20 bp, Homo sapiens
ctagtttgtgagaaacatct

SEQ ID NO: 3790420 - DNA, 16 bp, Homo sapiens
ctagttttctcctccc

SEQ ID NO: 3790421 - DNA, 18 bp, Homo sapiens
ctagttttctcctcccag

SEQ ID NO: 3790422 - DNA, 20 bp, Homo sapiens
ctagttttctcctcccagga

SEQ ID NO: 3790423 - DNA, 16 bp, Homo sapiens
ctataatgtaagctct

SEQ ID NO: 3790424 - DNA, 22 bp, Homo sapiens
ctataattccctatcttttagt

SEQ ID NO: 3790425 - DNA, 20 bp, Homo sapiens
ctataccccttacttagcat

SEQ ID NO: 3790426 - DNA, 17 bp, Homo sapiens
ctatagcctaggtgaca

SEQ ID NO: 3790427 - DNA, 19 bp, Homo sapiens
ctatagcctaggtgacaga

SEQ ID NO: 3790428 - DNA, 12 bp, Homo sapiens
ctatatccatgt

SEQ ID NO: 3790429 - DNA, 15 bp, Homo sapiens
ctatatccatgtact

SEQ ID NO: 3790430 - DNA, 21 bp, Homo sapiens
ctatatccatgtactgtagtt

SEQ ID NO: 3790431 - DNA, 16 bp, Homo sapiens
ctatatggaattgctt

SEQ ID NO: 3790432 - DNA, 21 bp, Homo sapiens
ctatatgtagtataaagaaaa

SEQ ID NO: 3790433 - DNA, 18 bp, Homo sapiens
ctatatttaagtattcaa

SEQ ID NO: 3790434 - DNA, 17 bp, Homo sapiens
ctatcacctcccctcct

SEQ ID NO: 3790435 - DNA, 19 bp, Homo sapiens
ctatcacctcccctccttg

SEQ ID NO: 3790436 - DNA, 18 bp, Homo sapiens
ctatcagagtatccactg

SEQ ID NO: 3790437 - DNA, 14 bp, Homo sapiens
ctatccacccagcc

SEQ ID NO: 3790438 - DNA, 17 bp, Homo sapiens
ctatccacccagcccat

SEQ ID NO: 3790439 - DNA, 13 bp, Homo sapiens
ctatcccatccca

SEQ ID NO: 3790440 - DNA, 12 bp, Homo sapiens
ctatcctggctt

SEQ ID NO: 3790441 - DNA, 18 bp, Homo sapiens
ctatcgagtttgcaatgt

SEQ ID NO: 3790442 - DNA, 14 bp, Homo sapiens
ctatctcacagcac

SEQ ID NO: 3790443 - DNA, 17 bp, Homo sapiens
ctatctctgtgtgcaca

SEQ ID NO: 3790444 - DNA, 21 bp, Homo sapiens
ctatcttatatagtttactat

SEQ ID NO: 3790445 - DNA, 21 bp, Homo sapiens
ctatgacctcgccctccacaa

SEQ ID NO: 3790446 - DNA, 21 bp, Homo sapiens
ctatgatcccagcactttggg

SEQ ID NO: 3790447 - DNA, 15 bp, Homo sapiens
ctatgatttggaaaa

SEQ ID NO: 3790448 - DNA, 19 bp, Homo sapiens
ctatgctgcctaggctgac

SEQ ID NO: 3790449 - DNA, 15 bp, Homo sapiens
ctatggatggcttct

SEQ ID NO: 3790450 - DNA, 16 bp, Homo sapiens
ctatggatggcttcta

SEQ ID NO: 3790451 - DNA, 13 bp, Homo sapiens
ctatgggagcccc

SEQ ID NO: 3790452 - DNA, 15 bp, Homo sapiens
ctatgggagccccag

SEQ ID NO: 3790453 - DNA, 19 bp, Homo sapiens
ctatgggagccccagggtc

SEQ ID NO: 3790454 - DNA, 21 bp, Homo sapiens
ctatggggagaaaagacatga

SEQ ID NO: 3790455 - DNA, 15 bp, Homo sapiens
ctatgtaactgcatt

SEQ ID NO: 3790456 - DNA, 19 bp, Homo sapiens
ctatgtacaatattttaag

SEQ ID NO: 3790457 - DNA, 22 bp, Homo sapiens
ctatgtacaatattttaagcat

SEQ ID NO: 3790458 - DNA, 19 bp, Homo sapiens
ctatgtatcaatgagtaac

SEQ ID NO: 3790459 - DNA, 14 bp, Homo sapiens
ctatgtatggaata

SEQ ID NO: 3790460 - DNA, 22 bp, Homo sapiens
ctatgtatggaatacagtgtta

SEQ ID NO: 3790461 - DNA, 12 bp, Homo sapiens
ctatgtgacaat

SEQ ID NO: 3790462 - DNA, 16 bp, Homo sapiens
ctatgttgcccaggca

SEQ ID NO: 3790463 - DNA, 21 bp, Homo sapiens
ctatgttgcccaggcaggtct

SEQ ID NO: 3790464 - DNA, 21 bp, Homo sapiens
ctattaagcagtaaaaactgt

SEQ ID NO: 3790465 - DNA, 22 bp, Homo sapiens
ctattaagcagtaaaaactgtt

SEQ ID NO: 3790466 - DNA, 16 bp, Homo sapiens
ctattaccactgaaga

SEQ ID NO: 3790467 - DNA, 21 bp, Homo sapiens
ctattaccactgaagatagaa

SEQ ID NO: 3790468 - DNA, 18 bp, Homo sapiens
ctattagactttagaaat

SEQ ID NO: 3790469 - DNA, 21 bp, Homo sapiens
ctattagactttagaaataaa

SEQ ID NO: 3790470 - DNA, 15 bp, Homo sapiens
ctattagagaagaga

SEQ ID NO: 3790471 - DNA, 17 bp, Homo sapiens
ctattcagtaataactc

SEQ ID NO: 3790472 - DNA, 14 bp, Homo sapiens
ctattctctcctca

SEQ ID NO: 3790473 - DNA, 16 bp, Homo sapiens
ctattgctgcttgagg

SEQ ID NO: 3790474 - DNA, 20 bp, Homo sapiens
ctattgtaagataaaaaagc

SEQ ID NO: 3790475 - DNA, 23 bp, Homo sapiens
ctatttagcatgacaagccccag

SEQ ID NO: 3790476 - DNA, 15 bp, Homo sapiens
ctccaggctccttta

SEQ ID NO: 3790477 - DNA, 23 bp, Homo sapiens
ctccaggctgtatcccatgagcc

SEQ ID NO: 3790478 - DNA, 17 bp, Homo sapiens
ctccaggctgtctttca

SEQ ID NO: 3790479 - DNA, 11 bp, Homo sapiens
ctccagggcca

SEQ ID NO: 3790480 - DNA, 18 bp, Homo sapiens
ctccagggccacgtgcca

SEQ ID NO: 3790481 - DNA, 14 bp, Homo sapiens
ctccagtcctgctc

SEQ ID NO: 3790482 - DNA, 16 bp, Homo sapiens
ctccagtcctgctctc

SEQ ID NO: 3790483 - DNA, 17 bp, Homo sapiens
ctccagtcctgctctct

SEQ ID NO: 3790484 - DNA, 20 bp, Homo sapiens
ctccagtcctgctctctacc

SEQ ID NO: 3790485 - DNA, 20 bp, Homo sapiens
ctccagtctgctgccctcca

SEQ ID NO: 3790486 - DNA, 14 bp, Homo sapiens
ctccatactcagga

SEQ ID NO: 3790487 - DNA, 21 bp, Homo sapiens
ctccatgagacacatctcctc

SEQ ID NO: 3790488 - DNA, 16 bp, Homo sapiens
ctccatggtgcctctg

SEQ ID NO: 3790489 - DNA, 17 bp, Homo sapiens
ctccatggtgcctctgg

SEQ ID NO: 3790490 - DNA, 20 bp, Homo sapiens
ctccattcctggagcccgag

SEQ ID NO: 3790491 - DNA, 20 bp, Homo sapiens
ctccattctgaccatttcag

SEQ ID NO: 3790492 - DNA, 17 bp, Homo sapiens
ctcccaaagagctgcct

SEQ ID NO: 3790493 - DNA, 21 bp, Homo sapiens
ctcccaaagagctgcctaaga

SEQ ID NO: 3790494 - DNA, 17 bp, Homo sapiens
ctcccaaagtgctggga

SEQ ID NO: 3790495 - DNA, 12 bp, Homo sapiens
ctcccaccccac

SEQ ID NO: 3790496 - DNA, 23 bp, Homo sapiens
ctcccaccccacccccttcagtg

SEQ ID NO: 3790497 - DNA, 14 bp, Homo sapiens
ctcccacctcagcc

SEQ ID NO: 3790498 - DNA, 15 bp, Homo sapiens
ctcccagctctagac

SEQ ID NO: 3790499 - DNA, 18 bp, Homo sapiens
ctcccagctctagacaac

SEQ ID NO: 3790500 - DNA, 16 bp, Homo sapiens
ctcccagctctgagga

SEQ ID NO: 3790501 - DNA, 22 bp, Homo sapiens
ctcccaggccaggctccttcct

SEQ ID NO: 3790502 - DNA, 15 bp, Homo sapiens
ctcccaggccccctg

SEQ ID NO: 3790503 - DNA, 14 bp, Homo sapiens
ctcccaggcgcccc

SEQ ID NO: 3790504 - DNA, 20 bp, Homo sapiens
ctcccaggcgccccttcccc

SEQ ID NO: 3790505 - DNA, 14 bp, Homo sapiens
ctcccagggccatg

SEQ ID NO: 3790506 - DNA, 12 bp, Homo sapiens
ctcccagggcta

SEQ ID NO: 3790507 - DNA, 20 bp, Homo sapiens
ctcccagttctctagggaag

SEQ ID NO: 3790508 - DNA, 16 bp, Homo sapiens
ctcccatcacttccct

SEQ ID NO: 3790509 - DNA, 17 bp, Homo sapiens
ctcccatcttaactctt

SEQ ID NO: 3790510 - DNA, 12 bp, Homo sapiens
ctccccaaaaac

SEQ ID NO: 3790511 - DNA, 12 bp, Homo sapiens
ctccccaaccct

SEQ ID NO: 3790512 - DNA, 15 bp, Homo sapiens
ctccccaaccctgcc

SEQ ID NO: 3790513 - DNA, 17 bp, Homo sapiens
ctccccaaccctgcccc

SEQ ID NO: 3790514 - DNA, 20 bp, Homo sapiens
ctccccaaccctgcccctgc

SEQ ID NO: 3790515 - DNA, 12 bp, Homo sapiens
ctccccagcaag

SEQ ID NO: 3790516 - DNA, 15 bp, Homo sapiens
ctccccagcaggtgg

SEQ ID NO: 3790517 - DNA, 16 bp, Homo sapiens
ctccccatgtgcctgc

SEQ ID NO: 3790518 - DNA, 23 bp, Homo sapiens
ctccccatgtgcctgcaccagga

SEQ ID NO: 3790519 - DNA, 21 bp, Homo sapiens
ctcccccaacccccaccccac

SEQ ID NO: 3790520 - DNA, 14 bp, Homo sapiens
ctcccccaccccct

SEQ ID NO: 3790521 - DNA, 19 bp, Homo sapiens
ctcccccaccccctcccca

SEQ ID NO: 3790522 - DNA, 11 bp, Homo sapiens
ctcccccatcc

SEQ ID NO: 3790523 - DNA, 17 bp, Homo sapiens
ctcccccatcctcccct

SEQ ID NO: 3790524 - DNA, 13 bp, Homo sapiens
ctccccccactgc

SEQ ID NO: 3790525 - DNA, 14 bp, Homo sapiens
ctccccccactgca

SEQ ID NO: 3790526 - DNA, 15 bp, Homo sapiens
ctccccccactgcag

SEQ ID NO: 3790527 - DNA, 22 bp, Homo sapiens
ctccccctagtttgtgagaaac

SEQ ID NO: 3790528 - DNA, 13 bp, Homo sapiens
ctccccctccttc

SEQ ID NO: 3790529 - DNA, 17 bp, Homo sapiens
ctccccctccttcccag

SEQ ID NO: 3790530 - DNA, 17 bp, Homo sapiens
ctccccctgccagtgcc

SEQ ID NO: 3790531 - DNA, 18 bp, Homo sapiens
ctccccctgccagtgcct

SEQ ID NO: 3790532 - DNA, 19 bp, Homo sapiens
ctccccctgccagtgcctt

SEQ ID NO: 3790533 - DNA, 21 bp, Homo sapiens
ctcccctatccacccagccca

SEQ ID NO: 3790534 - DNA, 23 bp, Homo sapiens
ctcccctatccacccagcccatt

SEQ ID NO: 3790535 - DNA, 13 bp, Homo sapiens
ctcccctcaagga

SEQ ID NO: 3790536 - DNA, 21 bp, Homo sapiens
ctcccctgcactggagtccag

SEQ ID NO: 3790537 - DNA, 13 bp, Homo sapiens
ctcccctgccctc

SEQ ID NO: 3790538 - DNA, 14 bp, Homo sapiens
ctcccctgccctgc

SEQ ID NO: 3790539 - DNA, 15 bp, Homo sapiens
ctccccttccctgca

SEQ ID NO: 3790540 - DNA, 14 bp, Homo sapiens
ctccccttgagctg

SEQ ID NO: 3790541 - DNA, 17 bp, Homo sapiens
ctcccgaatagctggga

SEQ ID NO: 3790542 - DNA, 18 bp, Homo sapiens
ctcccgaatagctgggac

SEQ ID NO: 3790543 - DNA, 19 bp, Homo sapiens
ctcccgagtagctgggact

SEQ ID NO: 3790544 - DNA, 16 bp, Homo sapiens
ctcccgggactcactg

SEQ ID NO: 3790545 - DNA, 15 bp, Homo sapiens
ctccctaccacctcc

SEQ ID NO: 3790546 - DNA, 17 bp, Homo sapiens
ctccctacctcaacctg

SEQ ID NO: 3790547 - DNA, 18 bp, Homo sapiens
ctccctacctcaacctgt

SEQ ID NO: 3790548 - DNA, 17 bp, Homo sapiens
ctccctataatgctgga

SEQ ID NO: 3790549 - DNA, 18 bp, Homo sapiens
ctccctccccctgcccct

SEQ ID NO: 3790550 - DNA, 15 bp, Homo sapiens
ctccctcccctgcca

SEQ ID NO: 3790551 - DNA, 18 bp, Homo sapiens
ctccctcccctgccctgg

SEQ ID NO: 3790552 - DNA, 14 bp, Homo sapiens
ctccctcctcacct

SEQ ID NO: 3790553 - DNA, 15 bp, Homo sapiens
ctccctcctcacctc

SEQ ID NO: 3790554 - DNA, 17 bp, Homo sapiens
ctccctcctcacctctg

SEQ ID NO: 3790555 - DNA, 15 bp, Homo sapiens
ctccctcctctgtcc

SEQ ID NO: 3790556 - DNA, 13 bp, Homo sapiens
ctccctctcctgc

SEQ ID NO: 3790557 - DNA, 15 bp, Homo sapiens
ctccctctctcttct

SEQ ID NO: 3790558 - DNA, 21 bp, Homo sapiens
ctccctctctcttctgctcca

SEQ ID NO: 3790559 - DNA, 17 bp, Homo sapiens
ctccctctgacctgcag

SEQ ID NO: 3790560 - DNA, 22 bp, Homo sapiens
ctccctctgcctgaaccttcca

SEQ ID NO: 3790561 - DNA, 21 bp, Homo sapiens
ctccctgaaaatgtttttctg

SEQ ID NO: 3790562 - DNA, 14 bp, Homo sapiens
ctccctgcccctcc

SEQ ID NO: 3790563 - DNA, 17 bp, Homo sapiens
ctccctgcccctccctt

SEQ ID NO: 3790564 - DNA, 20 bp, Homo sapiens
ctccctgcccctcccttcaa

SEQ ID NO: 3790565 - DNA, 19 bp, Homo sapiens
ctccctgccgcctcaatgt

SEQ ID NO: 3790566 - DNA, 15 bp, Homo sapiens
ctccctggctcccat

SEQ ID NO: 3790567 - DNA, 18 bp, Homo sapiens
ctccctggctctcagaag

SEQ ID NO: 3790568 - DNA, 11 bp, Homo sapiens
ctccctgtcct

SEQ ID NO: 3790569 - DNA, 13 bp, Homo sapiens
ctccctgtcctcc

SEQ ID NO: 3790570 - DNA, 19 bp, Homo sapiens
ctccctgttgaagctctgg

SEQ ID NO: 3790571 - DNA, 20 bp, Homo sapiens
ctcccttcaaccattcccca

SEQ ID NO: 3790572 - DNA, 17 bp, Homo sapiens
ctcccttcccataagct

SEQ ID NO: 3790573 - DNA, 21 bp, Homo sapiens
ctcccttctccttgataacag

SEQ ID NO: 3790574 - DNA, 22 bp, Homo sapiens
ctccgaacaccctcgaagcgcg

SEQ ID NO: 3790575 - DNA, 15 bp, Homo sapiens
ctccgaccagacacc

SEQ ID NO: 3790576 - DNA, 23 bp, Homo sapiens
ctccgccaggcgagatggggtgg

SEQ ID NO: 3790577 - DNA, 16 bp, Homo sapiens
ctccgcctctgctggc

SEQ ID NO: 3790578 - DNA, 18 bp, Homo sapiens
ctccgccttcactccggt

SEQ ID NO: 3790579 - DNA, 22 bp, Homo sapiens
ctccgctttctacccagcgagc

SEQ ID NO: 3790580 - DNA, 23 bp, Homo sapiens
ctccgctttctacccagcgagcc

SEQ ID NO: 3790581 - DNA, 18 bp, Homo sapiens
ctccggtgtgcctgcagc

SEQ ID NO: 3790582 - DNA, 21 bp, Homo sapiens
ctccgtgatccatccatctcc

SEQ ID NO: 3790583 - DNA, 13 bp, Homo sapiens
ctcctacctcagc

SEQ ID NO: 3790584 - DNA, 14 bp, Homo sapiens
ctcctacctcagcc

SEQ ID NO: 3790585 - DNA, 16 bp, Homo sapiens
ctcctacctcagccta

SEQ ID NO: 3790586 - DNA, 12 bp, Homo sapiens
ctcctagactga

SEQ ID NO: 3790587 - DNA, 19 bp, Homo sapiens
ctcctatcacctcccctcc

SEQ ID NO: 3790588 - DNA, 22 bp, Homo sapiens
ctcctcacctctggactggcta

SEQ ID NO: 3790589 - DNA, 11 bp, Homo sapiens
ctcctcagact

SEQ ID NO: 3790590 - DNA, 13 bp, Homo sapiens
ctgaccctgcaga

SEQ ID NO: 3790591 - DNA, 23 bp, Homo sapiens
ctgaccctgcttcaaatatttcc

SEQ ID NO: 3790592 - DNA, 20 bp, Homo sapiens
ctgaccgaaacagcgctggg

SEQ ID NO: 3790593 - DNA, 13 bp, Homo sapiens
ctgacctccacag

SEQ ID NO: 3790594 - DNA, 14 bp, Homo sapiens
ctgacctccacagc

SEQ ID NO: 3790595 - DNA, 16 bp, Homo sapiens
ctgacctccacagctt

SEQ ID NO: 3790596 - DNA, 16 bp, Homo sapiens
ctgacctccccctcct

SEQ ID NO: 3790597 - DNA, 21 bp, Homo sapiens
ctgacctccccctccttccca

SEQ ID NO: 3790598 - DNA, 18 bp, Homo sapiens
ctgacctccctctaattt

SEQ ID NO: 3790599 - DNA, 22 bp, Homo sapiens
ctgaccttgaactcctgggctc

SEQ ID NO: 3790600 - DNA, 14 bp, Homo sapiens
ctgacgaggctggg

SEQ ID NO: 3790601 - DNA, 18 bp, Homo sapiens
ctgactcaacatgttact

SEQ ID NO: 3790602 - DNA, 14 bp, Homo sapiens
ctgactctctgtga

SEQ ID NO: 3790603 - DNA, 18 bp, Homo sapiens
ctgactctctgtgacctg

SEQ ID NO: 3790604 - DNA, 19 bp, Homo sapiens
ctgactgatgttgagggaa

SEQ ID NO: 3790605 - DNA, 12 bp, Homo sapiens
ctgactgtggcc

SEQ ID NO: 3790606 - DNA, 18 bp, Homo sapiens
ctgactgttttctcttga

SEQ ID NO: 3790607 - DNA, 14 bp, Homo sapiens
ctgactttgctctt

SEQ ID NO: 3790608 - DNA, 22 bp, Homo sapiens
ctgagaacagatctccaaagct

SEQ ID NO: 3790609 - DNA, 16 bp, Homo sapiens
ctgagaaggggaggac

SEQ ID NO: 3790610 - DNA, 21 bp, Homo sapiens
ctgagaaggggaggacctctg

SEQ ID NO: 3790611 - DNA, 22 bp, Homo sapiens
ctgagaaggggaggacctctgg

SEQ ID NO: 3790612 - DNA, 17 bp, Homo sapiens
ctgagaaggtccttaat

SEQ ID NO: 3790613 - DNA, 15 bp, Homo sapiens
ctgagaatagaagga

SEQ ID NO: 3790614 - DNA, 16 bp, Homo sapiens
ctgagaatagaaggaa

SEQ ID NO: 3790615 - DNA, 18 bp, Homo sapiens
ctgagaatagaaggaaac

SEQ ID NO: 3790616 - DNA, 17 bp, Homo sapiens
ctgagactcagacagga

SEQ ID NO: 3790617 - DNA, 14 bp, Homo sapiens
ctgagactgcggga

SEQ ID NO: 3790618 - DNA, 21 bp, Homo sapiens
ctgagaggacttttctttgtg

SEQ ID NO: 3790619 - DNA, 17 bp, Homo sapiens
ctgagatggccctctgg

SEQ ID NO: 3790620 - DNA, 23 bp, Homo sapiens
ctgagcaacagagtgagaccctg

SEQ ID NO: 3790621 - DNA, 18 bp, Homo sapiens
ctgagcaagaccctgtct

SEQ ID NO: 3790622 - DNA, 17 bp, Homo sapiens
ctgagcacctcccagcc

SEQ ID NO: 3790623 - DNA, 18 bp, Homo sapiens
ctgagcacctcccagccc

SEQ ID NO: 3790624 - DNA, 22 bp, Homo sapiens
ctgagcacctcccagcccctgc

SEQ ID NO: 3790625 - DNA, 21 bp, Homo sapiens
ctgagcagactggtgagcaga

SEQ ID NO: 3790626 - DNA, 16 bp, Homo sapiens
ctgagccagtgtcagg

SEQ ID NO: 3790627 - DNA, 19 bp, Homo sapiens
ctgagcccctgggactgct

SEQ ID NO: 3790628 - DNA, 22 bp, Homo sapiens
ctgagcccctgggactgctgct

SEQ ID NO: 3790629 - DNA, 11 bp, Homo sapiens
ctgagccctgg

SEQ ID NO: 3790630 - DNA, 21 bp, Homo sapiens
ctgagccttgtaattctaaat

SEQ ID NO: 3790631 - DNA, 16 bp, Homo sapiens
ctgagctcctctgggc

SEQ ID NO: 3790632 - DNA, 17 bp, Homo sapiens
ctgagctcctctgggca

SEQ ID NO: 3790633 - DNA, 18 bp, Homo sapiens
ctgagctcctctgggcag

SEQ ID NO: 3790634 - DNA, 20 bp, Homo sapiens
ctgagctcctctgggcagga

SEQ ID NO: 3790635 - DNA, 23 bp, Homo sapiens
ctgagctcctctgggcaggacct

SEQ ID NO: 3790636 - DNA, 17 bp, Homo sapiens
ctgagctcggtggaccc

SEQ ID NO: 3790637 - DNA, 20 bp, Homo sapiens
ctgagctcggtggacccagg

SEQ ID NO: 3790638 - DNA, 16 bp, Homo sapiens
ctgagcttctctgtga

SEQ ID NO: 3790639 - DNA, 12 bp, Homo sapiens
ctgagcttggcc

SEQ ID NO: 3790640 - DNA, 15 bp, Homo sapiens
ctgagcttggccaga

SEQ ID NO: 3790641 - DNA, 19 bp, Homo sapiens
ctgaggaaaggccagctgg

SEQ ID NO: 3790642 - DNA, 23 bp, Homo sapiens
ctgaggactgcaccattgctgct

SEQ ID NO: 3790643 - DNA, 22 bp, Homo sapiens
ctgaggacttaaaatattcctg

SEQ ID NO: 3790644 - DNA, 14 bp, Homo sapiens
ctgaggagcagcag

SEQ ID NO: 3790645 - DNA, 16 bp, Homo sapiens
ctgaggatcagaaagt

SEQ ID NO: 3790646 - DNA, 16 bp, Homo sapiens
ctgaggcaagagaatt

SEQ ID NO: 3790647 - DNA, 13 bp, Homo sapiens
ctgaggcacgagc

SEQ ID NO: 3790648 - DNA, 14 bp, Homo sapiens
ctgaggcagacagc

SEQ ID NO: 3790649 - DNA, 14 bp, Homo sapiens
ctgaggcaggagaa

SEQ ID NO: 3790650 - DNA, 14 bp, Homo sapiens
ctgaggcagggaag

SEQ ID NO: 3790651 - DNA, 16 bp, Homo sapiens
ctgaggcagggaagtc

SEQ ID NO: 3790652 - DNA, 20 bp, Homo sapiens
ctgaggcagggaagtcccca

SEQ ID NO: 3790653 - DNA, 14 bp, Homo sapiens
ctgaggctggactc

SEQ ID NO: 3790654 - DNA, 12 bp, Homo sapiens
ctgagggaccaa

SEQ ID NO: 3790655 - DNA, 19 bp, Homo sapiens
ctgagggaccaactgggcc

SEQ ID NO: 3790656 - DNA, 18 bp, Homo sapiens
ctgagggaccagccaaga

SEQ ID NO: 3790657 - DNA, 19 bp, Homo sapiens
ctgaggggcaacgaagaaa

SEQ ID NO: 3790658 - DNA, 16 bp, Homo sapiens
ctgaggtctcttgagg

SEQ ID NO: 3790659 - DNA, 19 bp, Homo sapiens
ctgaggtctcttgagggag

SEQ ID NO: 3790660 - DNA, 12 bp, Homo sapiens
ctgaggtgggag

SEQ ID NO: 3790661 - DNA, 14 bp, Homo sapiens
ctgaggtgggcaga

SEQ ID NO: 3790662 - DNA, 22 bp, Homo sapiens
ctgagtatctcctcgcaagctg

SEQ ID NO: 3790663 - DNA, 13 bp, Homo sapiens
ctgagtatgtgga

SEQ ID NO: 3790664 - DNA, 18 bp, Homo sapiens
ctgagtatgtggaaggca

SEQ ID NO: 3790665 - DNA, 22 bp, Homo sapiens
ctgagtcacccatgaagacagg

SEQ ID NO: 3790666 - DNA, 22 bp, Homo sapiens
ctgagtcaccctacctgtgcct

SEQ ID NO: 3790667 - DNA, 19 bp, Homo sapiens
ctgagtcatgatctccctg

SEQ ID NO: 3790668 - DNA, 20 bp, Homo sapiens
ctgagtcatgatctccctgc

SEQ ID NO: 3790669 - DNA, 21 bp, Homo sapiens
ctgagtcatgatctccctgcc

SEQ ID NO: 3790670 - DNA, 21 bp, Homo sapiens
ctgagttggtgttgacatgtg

SEQ ID NO: 3790671 - DNA, 19 bp, Homo sapiens
ctgagtttaccatttgtaa

SEQ ID NO: 3790672 - DNA, 12 bp, Homo sapiens
ctgatacctcaa

SEQ ID NO: 3790673 - DNA, 22 bp, Homo sapiens
ctgatatagatcacataacaga

SEQ ID NO: 3790674 - DNA, 18 bp, Homo sapiens
ctgatattccatgaatgt

SEQ ID NO: 3790675 - DNA, 22 bp, Homo sapiens
ctgatcaagtcaccggagcttt

SEQ ID NO: 3790676 - DNA, 17 bp, Homo sapiens
ctgatcccactcctagg

SEQ ID NO: 3790677 - DNA, 18 bp, Homo sapiens
ctgatcccactcctagga

SEQ ID NO: 3790678 - DNA, 21 bp, Homo sapiens
ctgatcgtgctaaattttcag

SEQ ID NO: 3790679 - DNA, 15 bp, Homo sapiens
ctgatcgttctttct

SEQ ID NO: 3790680 - DNA, 12 bp, Homo sapiens
ctgatctcaggg

SEQ ID NO: 3790681 - DNA, 14 bp, Homo sapiens
ctgatgacactgag

SEQ ID NO: 3790682 - DNA, 13 bp, Homo sapiens
ctgatgacccagg

SEQ ID NO: 3790683 - DNA, 15 bp, Homo sapiens
ctgatgacccaggct

SEQ ID NO: 3790684 - DNA, 12 bp, Homo sapiens
ctgatgctccct

SEQ ID NO: 3790685 - DNA, 14 bp, Homo sapiens
ctgatgctccctcc

SEQ ID NO: 3790686 - DNA, 19 bp, Homo sapiens
ctgatgctccctcccctgc

SEQ ID NO: 3790687 - DNA, 23 bp, Homo sapiens
ctgatgctccctcccctgccctg

SEQ ID NO: 3790688 - DNA, 18 bp, Homo sapiens
ctgatggaaacaaagtgg

SEQ ID NO: 3790689 - DNA, 23 bp, Homo sapiens
ctgatgggcaacccccagcctgc

SEQ ID NO: 3790690 - DNA, 18 bp, Homo sapiens
ctgatgtacagttgggaa

SEQ ID NO: 3790691 - DNA, 21 bp, Homo sapiens
ctgatgttaggctgggcccag

SEQ ID NO: 3790692 - DNA, 20 bp, Homo sapiens
ctgattactgtcaataaaca

SEQ ID NO: 3790693 - DNA, 23 bp, Homo sapiens
ctgattagaaatgaccaatatta

SEQ ID NO: 3790694 - DNA, 19 bp, Homo sapiens
ctgattcccaagctctgct

SEQ ID NO: 3790695 - DNA, 17 bp, Homo sapiens
ctgattggtgcaaccct

SEQ ID NO: 3790696 - DNA, 12 bp, Homo sapiens
ctgatttcagga

SEQ ID NO: 3790697 - DNA, 14 bp, Homo sapiens
ctgcaaaatgagac

SEQ ID NO: 3790698 - DNA, 23 bp, Homo sapiens
ctgcaaacatggggttggctggg

SEQ ID NO: 3790699 - DNA, 13 bp, Homo sapiens
ctgcaaaggactg

SEQ ID NO: 3790700 - DNA, 22 bp, Homo sapiens
ctgcaaagggtatcaggtgctg

SEQ ID NO: 3790701 - DNA, 17 bp, Homo sapiens
ctgcaaatagaaaacag

SEQ ID NO: 3790702 - DNA, 20 bp, Homo sapiens
ctgcaaatagaaaacaggaa

SEQ ID NO: 3790703 - DNA, 15 bp, Homo sapiens
ctggagctcctggga

SEQ ID NO: 3790704 - DNA, 18 bp, Homo sapiens
ctggagctcctgggaagg

SEQ ID NO: 3790705 - DNA, 19 bp, Homo sapiens
ctggagctggcgtctgtct

SEQ ID NO: 3790706 - DNA, 14 bp, Homo sapiens
ctggagcttctctt

SEQ ID NO: 3790707 - DNA, 22 bp, Homo sapiens
ctggaggcagggccttgcccag

SEQ ID NO: 3790708 - DNA, 23 bp, Homo sapiens
ctggaggcagggccttgcccaga

SEQ ID NO: 3790709 - DNA, 21 bp, Homo sapiens
ctggaggccgggtgctcaggg

SEQ ID NO: 3790710 - DNA, 12 bp, Homo sapiens
ctggaggcctct

SEQ ID NO: 3790711 - DNA, 22 bp, Homo sapiens
ctggaggggcatggccagcagc

SEQ ID NO: 3790712 - DNA, 14 bp, Homo sapiens
ctggagtgcagtga

SEQ ID NO: 3790713 - DNA, 13 bp, Homo sapiens
ctggataattttg

SEQ ID NO: 3790714 - DNA, 21 bp, Homo sapiens
ctggataattttgcataaaat

SEQ ID NO: 3790715 - DNA, 13 bp, Homo sapiens
ctggatattttca

SEQ ID NO: 3790716 - DNA, 16 bp, Homo sapiens
ctggatattttcaaat

SEQ ID NO: 3790717 - DNA, 21 bp, Homo sapiens
ctggatcagtcctttgatcag

SEQ ID NO: 3790718 - DNA, 20 bp, Homo sapiens
ctggatctccattctctcag

SEQ ID NO: 3790719 - DNA, 16 bp, Homo sapiens
ctggatctcccagggc

SEQ ID NO: 3790720 - DNA, 18 bp, Homo sapiens
ctggatctcccagggcta

SEQ ID NO: 3790721 - DNA, 16 bp, Homo sapiens
ctggatgctccttcca

SEQ ID NO: 3790722 - DNA, 12 bp, Homo sapiens
ctggattggcca

SEQ ID NO: 3790723 - DNA, 16 bp, Homo sapiens
ctggcaaacatgaaaa

SEQ ID NO: 3790724 - DNA, 18 bp, Homo sapiens
ctggcaaagacagaagcc

SEQ ID NO: 3790725 - DNA, 16 bp, Homo sapiens
ctggcacagggcagtg

SEQ ID NO: 3790726 - DNA, 12 bp, Homo sapiens
ctggcacagtct

SEQ ID NO: 3790727 - DNA, 22 bp, Homo sapiens
ctggcacatttccccagacctg

SEQ ID NO: 3790728 - DNA, 20 bp, Homo sapiens
ctggcacccggcccctgctg

SEQ ID NO: 3790729 - DNA, 17 bp, Homo sapiens
ctggcaccgccttctct

SEQ ID NO: 3790730 - DNA, 21 bp, Homo sapiens
ctggcacggtggctcaggcct

SEQ ID NO: 3790731 - DNA, 20 bp, Homo sapiens
ctggcactgactgggcatag

SEQ ID NO: 3790732 - DNA, 18 bp, Homo sapiens
ctggcagaactgagctcc

SEQ ID NO: 3790733 - DNA, 21 bp, Homo sapiens
ctggcagaactgagctcctct

SEQ ID NO: 3790734 - DNA, 13 bp, Homo sapiens
ctggcagccccag

SEQ ID NO: 3790735 - DNA, 18 bp, Homo sapiens
ctggcagccgtgccttca

SEQ ID NO: 3790736 - DNA, 20 bp, Homo sapiens
ctggcagccgtgccttcagc

SEQ ID NO: 3790737 - DNA, 16 bp, Homo sapiens
ctggcattacagctgg

SEQ ID NO: 3790738 - DNA, 22 bp, Homo sapiens
ctggccagatgcaccagccctt

SEQ ID NO: 3790739 - DNA, 12 bp, Homo sapiens
ctggccaggatg

SEQ ID NO: 3790740 - DNA, 13 bp, Homo sapiens
ctggcccactgca

SEQ ID NO: 3790741 - DNA, 21 bp, Homo sapiens
ctggcccccactggctgtggg

SEQ ID NO: 3790742 - DNA, 15 bp, Homo sapiens
ctggcccccagctgt

SEQ ID NO: 3790743 - DNA, 18 bp, Homo sapiens
ctggcccctagaatcagc

SEQ ID NO: 3790744 - DNA, 18 bp, Homo sapiens
ctggcccgtcatgttcct

SEQ ID NO: 3790745 - DNA, 21 bp, Homo sapiens
ctggcccgtcatgttcctcaa

SEQ ID NO: 3790746 - DNA, 19 bp, Homo sapiens
ctggccctcacccctgccc

SEQ ID NO: 3790747 - DNA, 23 bp, Homo sapiens
ctggccctcacccctgccctggg

SEQ ID NO: 3790748 - DNA, 16 bp, Homo sapiens
ctggccctcttcttac

SEQ ID NO: 3790749 - DNA, 13 bp, Homo sapiens
ctggccctggggc

SEQ ID NO: 3790750 - DNA, 16 bp, Homo sapiens
ctggccctggggcctg

SEQ ID NO: 3790751 - DNA, 20 bp, Homo sapiens
ctggccgagggtcctggctc

SEQ ID NO: 3790752 - DNA, 17 bp, Homo sapiens
ctggccgggcacagctg

SEQ ID NO: 3790753 - DNA, 22 bp, Homo sapiens
ctggcctcaagtgattctcctg

SEQ ID NO: 3790754 - DNA, 12 bp, Homo sapiens
ctggcctcagac

SEQ ID NO: 3790755 - DNA, 20 bp, Homo sapiens
ctggcggctactcagcagcc

SEQ ID NO: 3790756 - DNA, 22 bp, Homo sapiens
ctggcggctactcagcagccct

SEQ ID NO: 3790757 - DNA, 13 bp, Homo sapiens
ctggcgtctgtct

SEQ ID NO: 3790758 - DNA, 14 bp, Homo sapiens
ctggcgtctgtctt

SEQ ID NO: 3790759 - DNA, 15 bp, Homo sapiens
ctggcgtctgtcttc

SEQ ID NO: 3790760 - DNA, 14 bp, Homo sapiens
ctggcgtgcagtgg

SEQ ID NO: 3790761 - DNA, 13 bp, Homo sapiens
ctggcgtgtgggt

SEQ ID NO: 3790762 - DNA, 17 bp, Homo sapiens
ctggctaactggaagca

SEQ ID NO: 3790763 - DNA, 12 bp, Homo sapiens
ctggctacatcc

SEQ ID NO: 3790764 - DNA, 16 bp, Homo sapiens
ctggctacatcccagc

SEQ ID NO: 3790765 - DNA, 20 bp, Homo sapiens
ctggctagaggccagcccca

SEQ ID NO: 3790766 - DNA, 21 bp, Homo sapiens
ctggctagaggccagccccac

SEQ ID NO: 3790767 - DNA, 17 bp, Homo sapiens
ctggctagagtcctcac

SEQ ID NO: 3790768 - DNA, 19 bp, Homo sapiens
ctggctcatattcctgcag

SEQ ID NO: 3790769 - DNA, 22 bp, Homo sapiens
ctggctcatattcctgcagcct

SEQ ID NO: 3790770 - DNA, 15 bp, Homo sapiens
ctggctcccagggcc

SEQ ID NO: 3790771 - DNA, 16 bp, Homo sapiens
ctggctcctgaggggc

SEQ ID NO: 3790772 - DNA, 14 bp, Homo sapiens
ctggctctgtggct

SEQ ID NO: 3790773 - DNA, 18 bp, Homo sapiens
ctggctctgtggcttgct

SEQ ID NO: 3790774 - DNA, 17 bp, Homo sapiens
ctggctgggcatggacg

SEQ ID NO: 3790775 - DNA, 18 bp, Homo sapiens
ctggctggtaagggccaa

SEQ ID NO: 3790776 - DNA, 19 bp, Homo sapiens
ctggctggtaagggccaag

SEQ ID NO: 3790777 - DNA, 15 bp, Homo sapiens
ctggctgtgggctcc

SEQ ID NO: 3790778 - DNA, 17 bp, Homo sapiens
ctggctgtgggctccct

SEQ ID NO: 3790779 - DNA, 22 bp, Homo sapiens
ctggctgtgggctcccttcctc

SEQ ID NO: 3790780 - DNA, 20 bp, Homo sapiens
ctggctgttggctgggggcc

SEQ ID NO: 3790781 - DNA, 17 bp, Homo sapiens
ctggcttgtaactccac

SEQ ID NO: 3790782 - DNA, 15 bp, Homo sapiens
ctggctttgcccaac

SEQ ID NO: 3790783 - DNA, 16 bp, Homo sapiens
ctggctttgcccaacc

SEQ ID NO: 3790784 - DNA, 21 bp, Homo sapiens
ctggctttgcccaacctcagc

SEQ ID NO: 3790785 - DNA, 19 bp, Homo sapiens
ctggctttgtcccacagct

SEQ ID NO: 3790786 - DNA, 15 bp, Homo sapiens
ctggcttttcactgc

SEQ ID NO: 3790787 - DNA, 20 bp, Homo sapiens
ctggcttttcactgctggct

SEQ ID NO: 3790788 - DNA, 20 bp, Homo sapiens
ctgggaaagggattttcagc

SEQ ID NO: 3790789 - DNA, 19 bp, Homo sapiens
ctgggaactcccaagaaca

SEQ ID NO: 3790790 - DNA, 18 bp, Homo sapiens
ctgggaagataggctctg

SEQ ID NO: 3790791 - DNA, 24 bp, Homo sapiens
ctgggaagataggctctgcacaga

SEQ ID NO: 3790792 - DNA, 19 bp, Homo sapiens
ctgggaaggctactcacct

SEQ ID NO: 3790793 - DNA, 19 bp, Homo sapiens
ctgggaatgtattattctg

SEQ ID NO: 3790794 - DNA, 12 bp, Homo sapiens
ctgggacacagt

SEQ ID NO: 3790795 - DNA, 13 bp, Homo sapiens
ctgggacacagtt

SEQ ID NO: 3790796 - DNA, 19 bp, Homo sapiens
ctgggacacttaacagatg

SEQ ID NO: 3790797 - DNA, 13 bp, Homo sapiens
ctgggactacagg

SEQ ID NO: 3790798 - DNA, 17 bp, Homo sapiens
ctgggactacaggcacc

SEQ ID NO: 3790799 - DNA, 17 bp, Homo sapiens
ctgggactacaggtgtg

SEQ ID NO: 3790800 - DNA, 12 bp, Homo sapiens
ctgggagaacct

SEQ ID NO: 3790801 - DNA, 17 bp, Homo sapiens
ctgggagaacctcaggc

SEQ ID NO: 3790802 - DNA, 18 bp, Homo sapiens
ctgggagaacctcaggct

SEQ ID NO: 3790803 - DNA, 13 bp, Homo sapiens
ctgggagctctgc

SEQ ID NO: 3790804 - DNA, 22 bp, Homo sapiens
ctgggaggaaaagaaaagaggg

SEQ ID NO: 3790805 - DNA, 15 bp, Homo sapiens
ctgggaggaagcagg

SEQ ID NO: 3790806 - DNA, 15 bp, Homo sapiens
ctgggaggcagaggt

SEQ ID NO: 3790807 - DNA, 23 bp, Homo sapiens
ctgggaggcagaggttgcagtga

SEQ ID NO: 3790808 - DNA, 23 bp, Homo sapiens
ctgggagggatagaggggggctg

SEQ ID NO: 3790809 - DNA, 22 bp, Homo sapiens
ctgggaggggttttcgaagctc

SEQ ID NO: 3790810 - DNA, 12 bp, Homo sapiens
ctgggagtgagc

SEQ ID NO: 3790811 - DNA, 16 bp, Homo sapiens
ctgggagtgagctggt

SEQ ID NO: 3790812 - DNA, 17 bp, Homo sapiens
ctgggatcctaagggct

SEQ ID NO: 3790813 - DNA, 19 bp, Homo sapiens
ctgggatgtttctgtcaca

SEQ ID NO: 3790814 - DNA, 21 bp, Homo sapiens
ctgggattacaagcgtgagcc

SEQ ID NO: 3790815 - DNA, 11 bp, Homo sapiens
ctgggattagg

SEQ ID NO: 3790816 - DNA, 16 bp, Homo sapiens
cttcatttttcctaac

SEQ ID NO: 3790817 - DNA, 13 bp, Homo sapiens
cttccaaagcaca

SEQ ID NO: 3790818 - DNA, 13 bp, Homo sapiens
cttccaagacctg

SEQ ID NO: 3790819 - DNA, 16 bp, Homo sapiens
cttccaagcaaaggtg

SEQ ID NO: 3790820 - DNA, 20 bp, Homo sapiens
cttccaaggagaccaagtcc

SEQ ID NO: 3790821 - DNA, 15 bp, Homo sapiens
cttccacattttccc

SEQ ID NO: 3790822 - DNA, 23 bp, Homo sapiens
cttccaccaagttggaacatcct

SEQ ID NO: 3790823 - DNA, 12 bp, Homo sapiens
cttccaccagcc

SEQ ID NO: 3790824 - DNA, 14 bp, Homo sapiens
cttccaccagcctg

SEQ ID NO: 3790825 - DNA, 15 bp, Homo sapiens
cttccaccagcctgc

SEQ ID NO: 3790826 - DNA, 17 bp, Homo sapiens
cttccaccagcctgcac

SEQ ID NO: 3790827 - DNA, 17 bp, Homo sapiens
cttccactgatggaaac

SEQ ID NO: 3790828 - DNA, 16 bp, Homo sapiens
cttccaggccatcaga

SEQ ID NO: 3790829 - DNA, 16 bp, Homo sapiens
cttccaggcccccacc

SEQ ID NO: 3790830 - DNA, 21 bp, Homo sapiens
cttccaggctgcatagaagga

SEQ ID NO: 3790831 - DNA, 21 bp, Homo sapiens
cttccataatctggactcctc

SEQ ID NO: 3790832 - DNA, 11 bp, Homo sapiens
cttccataatg

SEQ ID NO: 3790833 - DNA, 14 bp, Homo sapiens
cttccataattatg

SEQ ID NO: 3790834 - DNA, 16 bp, Homo sapiens
cttccatccaaagaat

SEQ ID NO: 3790835 - DNA, 12 bp, Homo sapiens
cttccatcccta

SEQ ID NO: 3790836 - DNA, 14 bp, Homo sapiens
cttccatccctacc

SEQ ID NO: 3790837 - DNA, 15 bp, Homo sapiens
cttccatccctaccc

SEQ ID NO: 3790838 - DNA, 21 bp, Homo sapiens
cttccatgagaacagcagggt

SEQ ID NO: 3790839 - DNA, 18 bp, Homo sapiens
cttccatgtcgcctctgc

SEQ ID NO: 3790840 - DNA, 20 bp, Homo sapiens
cttccatgtcgcctctgcat

SEQ ID NO: 3790841 - DNA, 16 bp, Homo sapiens
cttccatttgtgtgtg

SEQ ID NO: 3790842 - DNA, 15 bp, Homo sapiens
cttcccaactgcaag

SEQ ID NO: 3790843 - DNA, 16 bp, Homo sapiens
cttcccaactgcaagt

SEQ ID NO: 3790844 - DNA, 22 bp, Homo sapiens
cttcccagctctccctctggcc

SEQ ID NO: 3790845 - DNA, 18 bp, Homo sapiens
cttcccagctgcccctcc

SEQ ID NO: 3790846 - DNA, 19 bp, Homo sapiens
cttccccagaaaggagact

SEQ ID NO: 3790847 - DNA, 20 bp, Homo sapiens
cttcccccgcaatgtgcccc

SEQ ID NO: 3790848 - DNA, 16 bp, Homo sapiens
cttccccctcccaggg

SEQ ID NO: 3790849 - DNA, 18 bp, Homo sapiens
cttccccctctcccagtt

SEQ ID NO: 3790850 - DNA, 12 bp, Homo sapiens
cttcccctcact

SEQ ID NO: 3790851 - DNA, 16 bp, Homo sapiens
cttcccctccctggct

SEQ ID NO: 3790852 - DNA, 20 bp, Homo sapiens
cttcccctccctggctccca

SEQ ID NO: 3790853 - DNA, 19 bp, Homo sapiens
cttcccctctaatgctcac

SEQ ID NO: 3790854 - DNA, 20 bp, Homo sapiens
cttcccctctctcctcctgc

SEQ ID NO: 3790855 - DNA, 16 bp, Homo sapiens
cttccccttgcccagg

SEQ ID NO: 3790856 - DNA, 19 bp, Homo sapiens
cttccccttgcccagggct

SEQ ID NO: 3790857 - DNA, 23 bp, Homo sapiens
cttccctagagggttcctgtaga

SEQ ID NO: 3790858 - DNA, 16 bp, Homo sapiens
cttccctagggctggg

SEQ ID NO: 3790859 - DNA, 21 bp, Homo sapiens
cttccctcaaagcttccattc

SEQ ID NO: 3790860 - DNA, 23 bp, Homo sapiens
cttccctcaaagcttccattcca

SEQ ID NO: 3790861 - DNA, 24 bp, Homo sapiens
cttccctcaaagcttccattccac

SEQ ID NO: 3790862 - DNA, 15 bp, Homo sapiens
cttccctcacaccgc

SEQ ID NO: 3790863 - DNA, 16 bp, Homo sapiens
cttccctctgcctgtc

SEQ ID NO: 3790864 - DNA, 18 bp, Homo sapiens
cttccctctgcctgtccc

SEQ ID NO: 3790865 - DNA, 11 bp, Homo sapiens
cttccctggct

SEQ ID NO: 3790866 - DNA, 14 bp, Homo sapiens
cttccggagatgta

SEQ ID NO: 3790867 - DNA, 17 bp, Homo sapiens
cttcctagttttctcct

SEQ ID NO: 3790868 - DNA, 23 bp, Homo sapiens
cttcctagttttctcctcccagg

SEQ ID NO: 3790869 - DNA, 12 bp, Homo sapiens
cttcctccctcc

SEQ ID NO: 3790870 - DNA, 14 bp, Homo sapiens
cttcctctccactg

SEQ ID NO: 3790871 - DNA, 15 bp, Homo sapiens
cttcctctccactgc

SEQ ID NO: 3790872 - DNA, 16 bp, Homo sapiens
cttcctctccactgcc

SEQ ID NO: 3790873 - DNA, 15 bp, Homo sapiens
cttcctgcctggtct

SEQ ID NO: 3790874 - DNA, 16 bp, Homo sapiens
cttcctgcctggtctc

SEQ ID NO: 3790875 - DNA, 15 bp, Homo sapiens
cttcctgtccagaga

SEQ ID NO: 3790876 - DNA, 22 bp, Homo sapiens
cttcctgtccgccctcttcccc

SEQ ID NO: 3790877 - DNA, 14 bp, Homo sapiens
cttccttccctggc

SEQ ID NO: 3790878 - DNA, 17 bp, Homo sapiens
cttccttccctggcttg

SEQ ID NO: 3790879 - DNA, 14 bp, Homo sapiens
cttccttgaccagc

SEQ ID NO: 3790880 - DNA, 22 bp, Homo sapiens
cttccttgaccagcagatccca

SEQ ID NO: 3790881 - DNA, 19 bp, Homo sapiens
cttccttgctgtcctaggc

SEQ ID NO: 3790882 - DNA, 22 bp, Homo sapiens
cttcctttgtttttttttcctg

SEQ ID NO: 3790883 - DNA, 20 bp, Homo sapiens
cttcgaaagcatcattattt

SEQ ID NO: 3790884 - DNA, 21 bp, Homo sapiens
cttcggcattggttccctttg

SEQ ID NO: 3790885 - DNA, 13 bp, Homo sapiens
cttctaaatgcat

SEQ ID NO: 3790886 - DNA, 15 bp, Homo sapiens
cttctaaatgcatat

SEQ ID NO: 3790887 - DNA, 14 bp, Homo sapiens
cttctaatctgcta

SEQ ID NO: 3790888 - DNA, 16 bp, Homo sapiens
cttctaatctgctatg

SEQ ID NO: 3790889 - DNA, 21 bp, Homo sapiens
cttctaatctgctatgcttga

SEQ ID NO: 3790890 - DNA, 22 bp, Homo sapiens
cttctaatctgctatgcttgaa

SEQ ID NO: 3790891 - DNA, 14 bp, Homo sapiens
cttctacactctcc

SEQ ID NO: 3790892 - DNA, 15 bp, Homo sapiens
cttctaccaactgga

SEQ ID NO: 3790893 - DNA, 17 bp, Homo sapiens
cttctaccaactggaag

SEQ ID NO: 3790894 - DNA, 22 bp, Homo sapiens
cttctacttacacatcttccac

SEQ ID NO: 3790895 - DNA, 21 bp, Homo sapiens
cttctcactgccatgccagct

SEQ ID NO: 3790896 - DNA, 15 bp, Homo sapiens
cttctcatagcatta

SEQ ID NO: 3790897 - DNA, 15 bp, Homo sapiens
cttctcatcctgcag

SEQ ID NO: 3790898 - DNA, 16 bp, Homo sapiens
cttctcatcctgcagg

SEQ ID NO: 3790899 - DNA, 17 bp, Homo sapiens
cttctccaccctgctct

SEQ ID NO: 3790900 - DNA, 17 bp, Homo sapiens
cttctccactggatgga

SEQ ID NO: 3790901 - DNA, 14 bp, Homo sapiens
cttctccatctggc

SEQ ID NO: 3790902 - DNA, 15 bp, Homo sapiens
cttctcccaattcat

SEQ ID NO: 3790903 - DNA, 16 bp, Homo sapiens
cttctctgcccattcc

SEQ ID NO: 3790904 - DNA, 11 bp, Homo sapiens
cttctctgctc

SEQ ID NO: 3790905 - DNA, 14 bp, Homo sapiens
cttctctgctccac

SEQ ID NO: 3790906 - DNA, 22 bp, Homo sapiens
cttctctgtattcctagaaact

SEQ ID NO: 3790907 - DNA, 16 bp, Homo sapiens
cttctcttaatttaat

SEQ ID NO: 3790908 - DNA, 19 bp, Homo sapiens
cttctctttaactcaggac

SEQ ID NO: 3790909 - DNA, 21 bp, Homo sapiens
cttctctttaactcaggactc

SEQ ID NO: 3790910 - DNA, 14 bp, Homo sapiens
cttctgaccacact

SEQ ID NO: 3790911 - DNA, 15 bp, Homo sapiens
cttctgacctcagca

SEQ ID NO: 3790912 - DNA, 17 bp, Homo sapiens
cttctgatgaatcttgc

SEQ ID NO: 3790913 - DNA, 19 bp, Homo sapiens
cttctgatgaatcttgcgt

SEQ ID NO: 3790914 - DNA, 16 bp, Homo sapiens
cttctgcaccttatct

SEQ ID NO: 3790915 - DNA, 21 bp, Homo sapiens
cttctgccatattctgttggc

SEQ ID NO: 3790916 - DNA, 15 bp, Homo sapiens
cttctgcccttgcca

SEQ ID NO: 3790917 - DNA, 17 bp, Homo sapiens
cttctgccggccctggg

SEQ ID NO: 3790918 - DNA, 18 bp, Homo sapiens
cttctgccggccctgggg

SEQ ID NO: 3790919 - DNA, 19 bp, Homo sapiens
cttctgccggccctggggc

SEQ ID NO: 3790920 - DNA, 10 bp, Homo sapiens
cttctgctcc

SEQ ID NO: 3790921 - DNA, 14 bp, Homo sapiens
cttctgctccaccc

SEQ ID NO: 3790922 - DNA, 15 bp, Homo sapiens
cttctgctccaccct

SEQ ID NO: 3790923 - DNA, 17 bp, Homo sapiens
cttctgctccacccttg

SEQ ID NO: 3790924 - DNA, 18 bp, Homo sapiens
cttctgcttcagcctccc

SEQ ID NO: 3790925 - DNA, 20 bp, Homo sapiens
cttctgtacgtctgacaggc

SEQ ID NO: 3790926 - DNA, 18 bp, Homo sapiens
cttctgtagtactcctta

SEQ ID NO: 3790927 - DNA, 19 bp, Homo sapiens
cttctgtgagacccccaca

SEQ ID NO: 3790928 - DNA, 21 bp, Homo sapiens
cttctgtgagacccccacacc

SEQ ID NO: 3790929 - DNA, 22 bp, Homo sapiens
cttctgtgagacccccacacct

SEQ ID NO: 3790930 - DNA, 14 bp, Homo sapiens
gaacacactccatc

SEQ ID NO: 3790931 - DNA, 13 bp, Homo sapiens
gaacactattttc

SEQ ID NO: 3790932 - DNA, 13 bp, Homo sapiens
gaacagaaaacaa

SEQ ID NO: 3790933 - DNA, 17 bp, Homo sapiens
gaacagacaggagaaat

SEQ ID NO: 3790934 - DNA, 19 bp, Homo sapiens
gaacagatctccaaagctt

SEQ ID NO: 3790935 - DNA, 14 bp, Homo sapiens
gaacagcaggccca

SEQ ID NO: 3790936 - DNA, 19 bp, Homo sapiens
gaacagtgattttttttta

SEQ ID NO: 3790937 - DNA, 21 bp, Homo sapiens
gaacagtgatttttttttaga

SEQ ID NO: 3790938 - DNA, 14 bp, Homo sapiens
gaacatcacagctt

SEQ ID NO: 3790939 - DNA, 23 bp, Homo sapiens
gaacatgaaaacagaaaacggtt

SEQ ID NO: 3790940 - DNA, 16 bp, Homo sapiens
gaacattgattgctgt

SEQ ID NO: 3790941 - DNA, 15 bp, Homo sapiens
gaaccaacactaaca

SEQ ID NO: 3790942 - DNA, 18 bp, Homo sapiens
gaaccacatcttgctctg

SEQ ID NO: 3790943 - DNA, 16 bp, Homo sapiens
gaaccaccacacccag

SEQ ID NO: 3790944 - DNA, 20 bp, Homo sapiens
gaaccaccacacccagccca

SEQ ID NO: 3790945 - DNA, 23 bp, Homo sapiens
gaaccaccacacccagcccactt

SEQ ID NO: 3790946 - DNA, 19 bp, Homo sapiens
gaaccagagccatggactc

SEQ ID NO: 3790947 - DNA, 23 bp, Homo sapiens
gaaccagagccatggactctaca

SEQ ID NO: 3790948 - DNA, 13 bp, Homo sapiens
gaacccacactgc

SEQ ID NO: 3790949 - DNA, 13 bp, Homo sapiens
gaacccacctgct

SEQ ID NO: 3790950 - DNA, 17 bp, Homo sapiens
gaacccttttggccccc

SEQ ID NO: 3790951 - DNA, 19 bp, Homo sapiens
gaacccttttggcccccga

SEQ ID NO: 3790952 - DNA, 23 bp, Homo sapiens
gaacccttttggcccccgagctg

SEQ ID NO: 3790953 - DNA, 16 bp, Homo sapiens
gaaccgcaggaagctg

SEQ ID NO: 3790954 - DNA, 20 bp, Homo sapiens
gaaccgcaggaagctgctcc

SEQ ID NO: 3790955 - DNA, 17 bp, Homo sapiens
gaacctcacgcacctcc

SEQ ID NO: 3790956 - DNA, 11 bp, Homo sapiens
gaacctcaggc

SEQ ID NO: 3790957 - DNA, 17 bp, Homo sapiens
gaacctcttccccagaa

SEQ ID NO: 3790958 - DNA, 16 bp, Homo sapiens
gaacctggaccaaagc

SEQ ID NO: 3790959 - DNA, 15 bp, Homo sapiens
gaacggggagaaaag

SEQ ID NO: 3790960 - DNA, 15 bp, Homo sapiens
gaacggtaaatttct

SEQ ID NO: 3790961 - DNA, 23 bp, Homo sapiens
gaacgtgggagttcagctgcttc

SEQ ID NO: 3790962 - DNA, 22 bp, Homo sapiens
gaactagaggttttatgatatt

SEQ ID NO: 3790963 - DNA, 14 bp, Homo sapiens
gaactcccaagaac

SEQ ID NO: 3790964 - DNA, 20 bp, Homo sapiens
gaactcccaagaacagcagg

SEQ ID NO: 3790965 - DNA, 11 bp, Homo sapiens
gaactcctggg

SEQ ID NO: 3790966 - DNA, 14 bp, Homo sapiens
gaactcctgggctc

SEQ ID NO: 3790967 - DNA, 13 bp, Homo sapiens
gaactgaaaacat

SEQ ID NO: 3790968 - DNA, 15 bp, Homo sapiens
gaactgaaaacataa

SEQ ID NO: 3790969 - DNA, 18 bp, Homo sapiens
gaactgaaaacataaaaa

SEQ ID NO: 3790970 - DNA, 19 bp, Homo sapiens
gaactgaaaacataaaaag

SEQ ID NO: 3790971 - DNA, 17 bp, Homo sapiens
gaactgagctcctctgg

SEQ ID NO: 3790972 - DNA, 14 bp, Homo sapiens
gaactgcatggacc

SEQ ID NO: 3790973 - DNA, 22 bp, Homo sapiens
gaactgcatggacctaacattc

SEQ ID NO: 3790974 - DNA, 17 bp, Homo sapiens
gaactgcatgtataaat

SEQ ID NO: 3790975 - DNA, 12 bp, Homo sapiens
gaactggctgca

SEQ ID NO: 3790976 - DNA, 17 bp, Homo sapiens
gaactgggcctgttgcc

SEQ ID NO: 3790977 - DNA, 22 bp, Homo sapiens
gaactgggtacttgtggacaca

SEQ ID NO: 3790978 - DNA, 17 bp, Homo sapiens
gaactgtgcctttgagt

SEQ ID NO: 3790979 - DNA, 19 bp, Homo sapiens
gaacttggaaagaaatgcc

SEQ ID NO: 3790980 - DNA, 20 bp, Homo sapiens
gaagaaaagtgggccagtgt

SEQ ID NO: 3790981 - DNA, 18 bp, Homo sapiens
gaagaatacaaacatatt

SEQ ID NO: 3790982 - DNA, 19 bp, Homo sapiens
gaagaatacaaacatattt

SEQ ID NO: 3790983 - DNA, 13 bp, Homo sapiens
gaagaatattgtt

SEQ ID NO: 3790984 - DNA, 13 bp, Homo sapiens
gaagaattatttt

SEQ ID NO: 3790985 - DNA, 17 bp, Homo sapiens
gaagaattttcagaccc

SEQ ID NO: 3790986 - DNA, 20 bp, Homo sapiens
gaagaattttcagaccccag

SEQ ID NO: 3790987 - DNA, 17 bp, Homo sapiens
gaagacaaaaatactct

SEQ ID NO: 3790988 - DNA, 21 bp, Homo sapiens
gaagacacagactgcgatttg

SEQ ID NO: 3790989 - DNA, 21 bp, Homo sapiens
gaagacactgaaatatacaca

SEQ ID NO: 3790990 - DNA, 18 bp, Homo sapiens
gaagactcattcttctgt

SEQ ID NO: 3790991 - DNA, 13 bp, Homo sapiens
gaagactgtggct

SEQ ID NO: 3790992 - DNA, 13 bp, Homo sapiens
gaagagaaacagg

SEQ ID NO: 3790993 - DNA, 12 bp, Homo sapiens
gaagagaaacca

SEQ ID NO: 3790994 - DNA, 16 bp, Homo sapiens
gaagagactgggaaga

SEQ ID NO: 3790995 - DNA, 23 bp, Homo sapiens
gaagagcaggcacatggaggagc

SEQ ID NO: 3790996 - DNA, 16 bp, Homo sapiens
gaagagtctggaggga

SEQ ID NO: 3790997 - DNA, 17 bp, Homo sapiens
gaagagtgggtttcaca

SEQ ID NO: 3790998 - DNA, 16 bp, Homo sapiens
gaagataggctctgca

SEQ ID NO: 3790999 - DNA, 17 bp, Homo sapiens
gaagataggctctgcac

SEQ ID NO: 3791000 - DNA, 19 bp, Homo sapiens
gaagatcactttgctctga

SEQ ID NO: 3791001 - DNA, 21 bp, Homo sapiens
gaagatttgcccatttacact

SEQ ID NO: 3791002 - DNA, 23 bp, Homo sapiens
gaagattttgaaatttttattaa

SEQ ID NO: 3791003 - DNA, 19 bp, Homo sapiens
gaagcaaaaacgaaagctg

SEQ ID NO: 3791004 - DNA, 17 bp, Homo sapiens
gaagcaaacacattaag

SEQ ID NO: 3791005 - DNA, 14 bp, Homo sapiens
gaagcacagcttca

SEQ ID NO: 3791006 - DNA, 21 bp, Homo sapiens
gaagcaccccatgccaaagct

SEQ ID NO: 3791007 - DNA, 23 bp, Homo sapiens
gaagcactttgggattctttcca

SEQ ID NO: 3791008 - DNA, 21 bp, Homo sapiens
gaagcagatgcaaagaggcaa

SEQ ID NO: 3791009 - DNA, 19 bp, Homo sapiens
gaagcaggttgaggggctc

SEQ ID NO: 3791010 - DNA, 14 bp, Homo sapiens
gaagcatccaggca

SEQ ID NO: 3791011 - DNA, 16 bp, Homo sapiens
gaagcatgaaaaagca

SEQ ID NO: 3791012 - DNA, 16 bp, Homo sapiens
gaagcatgtaggagaa

SEQ ID NO: 3791013 - DNA, 19 bp, Homo sapiens
gaagccacagcccaggcct

SEQ ID NO: 3791014 - DNA, 19 bp, Homo sapiens
gaagccaccctcccagctc

SEQ ID NO: 3791015 - DNA, 15 bp, Homo sapiens
gaagccactgaagct

SEQ ID NO: 3791016 - DNA, 16 bp, Homo sapiens
gaagcccaagtgaaat

SEQ ID NO: 3791017 - DNA, 16 bp, Homo sapiens
gaagcccagctccagg

SEQ ID NO: 3791018 - DNA, 20 bp, Homo sapiens
gaagcccattcctctgccag

SEQ ID NO: 3791019 - DNA, 18 bp, Homo sapiens
gaagccctaactcagcca

SEQ ID NO: 3791020 - DNA, 12 bp, Homo sapiens
gaagccctcctt

SEQ ID NO: 3791021 - DNA, 19 bp, Homo sapiens
gaagccctccttccacgga

SEQ ID NO: 3791022 - DNA, 22 bp, Homo sapiens
gaagccctggatttcagaaaga

SEQ ID NO: 3791023 - DNA, 23 bp, Homo sapiens
gaagccgccaggaccgccaaaga

SEQ ID NO: 3791024 - DNA, 17 bp, Homo sapiens
gaagccgtgccctgccc

SEQ ID NO: 3791025 - DNA, 19 bp, Homo sapiens
gaagccgtgccctgccccc

SEQ ID NO: 3791026 - DNA, 14 bp, Homo sapiens
gaagcctattgtaa

SEQ ID NO: 3791027 - DNA, 16 bp, Homo sapiens
gaagcctattgtaaat

SEQ ID NO: 3791028 - DNA, 12 bp, Homo sapiens
gaagcctgaggc

SEQ ID NO: 3791029 - DNA, 13 bp, Homo sapiens
gaagcctgaggct

SEQ ID NO: 3791030 - DNA, 22 bp, Homo sapiens
gaagcgcgccactcgcttcccc

SEQ ID NO: 3791031 - DNA, 14 bp, Homo sapiens
gaagcggctggcag

SEQ ID NO: 3791032 - DNA, 21 bp, Homo sapiens
gaagctaattattttaattag

SEQ ID NO: 3791033 - DNA, 22 bp, Homo sapiens
gaagctaattattttaattagg

SEQ ID NO: 3791034 - DNA, 19 bp, Homo sapiens
gaagctactttgtttttaa

SEQ ID NO: 3791035 - DNA, 14 bp, Homo sapiens
gaagctcagactgg

SEQ ID NO: 3791036 - DNA, 12 bp, Homo sapiens
gaagctcagccc

SEQ ID NO: 3791037 - DNA, 21 bp, Homo sapiens
gaagctcagcccacccccctc

SEQ ID NO: 3791038 - DNA, 22 bp, Homo sapiens
gaagctcagcccacccccctca

SEQ ID NO: 3791039 - DNA, 13 bp, Homo sapiens
gaagctcctggta

SEQ ID NO: 3791040 - DNA, 16 bp, Homo sapiens
gaagctctgaagtcac

SEQ ID NO: 3791041 - DNA, 20 bp, Homo sapiens
gaagctctgaagtcacatca

SEQ ID NO: 3791042 - DNA, 23 bp, Homo sapiens
gaagctggccgagggtcctggct

SEQ ID NO: 3791043 - DNA, 18 bp, Homo sapiens
gacccggaggggcctggc

SEQ ID NO: 3791044 - DNA, 20 bp, Homo sapiens
gacccggaggggcctggcag

SEQ ID NO: 3791045 - DNA, 14 bp, Homo sapiens
gaccctacaggaga

SEQ ID NO: 3791046 - DNA, 18 bp, Homo sapiens
gaccctcgctggccccca

SEQ ID NO: 3791047 - DNA, 12 bp, Homo sapiens
gaccctgtctca

SEQ ID NO: 3791048 - DNA, 23 bp, Homo sapiens
gaccctgtctcaaaaaaagaaaa

SEQ ID NO: 3791049 - DNA, 14 bp, Homo sapiens
gaccctttccttcc

SEQ ID NO: 3791050 - DNA, 20 bp, Homo sapiens
gaccctttccttccttccct

SEQ ID NO: 3791051 - DNA, 18 bp, Homo sapiens
gacccttttgggtttctg

SEQ ID NO: 3791052 - DNA, 14 bp, Homo sapiens
gaccggaagctcct

SEQ ID NO: 3791053 - DNA, 17 bp, Homo sapiens
gaccggaagctcctggt

SEQ ID NO: 3791054 - DNA, 17 bp, Homo sapiens
gacctaacattcgatct

SEQ ID NO: 3791055 - DNA, 21 bp, Homo sapiens
gacctaacctaagcaaaacca

SEQ ID NO: 3791056 - DNA, 20 bp, Homo sapiens
gacctagggatgttctggcc

SEQ ID NO: 3791057 - DNA, 23 bp, Homo sapiens
gacctagggatgttctggccctc

SEQ ID NO: 3791058 - DNA, 13 bp, Homo sapiens
gacctatgtttgc

SEQ ID NO: 3791059 - DNA, 21 bp, Homo sapiens
gacctcaccaagctgctgtgg

SEQ ID NO: 3791060 - DNA, 16 bp, Homo sapiens
gacctcactgtgacct

SEQ ID NO: 3791061 - DNA, 11 bp, Homo sapiens
gacctcagcca

SEQ ID NO: 3791062 - DNA, 14 bp, Homo sapiens
gacctcagcctgtg

SEQ ID NO: 3791063 - DNA, 20 bp, Homo sapiens
gacctcagccttccccttgc

SEQ ID NO: 3791064 - DNA, 19 bp, Homo sapiens
gacctcaggtgagaagcag

SEQ ID NO: 3791065 - DNA, 20 bp, Homo sapiens
gacctcaggtgatccaccca

SEQ ID NO: 3791066 - DNA, 16 bp, Homo sapiens
gacctccccctccttc

SEQ ID NO: 3791067 - DNA, 13 bp, Homo sapiens
gacctcgtcctcc

SEQ ID NO: 3791068 - DNA, 15 bp, Homo sapiens
gacctcgtcctcccc

SEQ ID NO: 3791069 - DNA, 16 bp, Homo sapiens
gacctcgtcctccccc

SEQ ID NO: 3791070 - DNA, 18 bp, Homo sapiens
gacctcgtcctccccctg

SEQ ID NO: 3791071 - DNA, 22 bp, Homo sapiens
gacctcgtcctccccctgccag

SEQ ID NO: 3791072 - DNA, 15 bp, Homo sapiens
gacctcgtgctttaa

SEQ ID NO: 3791073 - DNA, 11 bp, Homo sapiens
gacctctgggc

SEQ ID NO: 3791074 - DNA, 13 bp, Homo sapiens
gacctgcaggcca

SEQ ID NO: 3791075 - DNA, 21 bp, Homo sapiens
gacctgctgagggaccagcca

SEQ ID NO: 3791076 - DNA, 18 bp, Homo sapiens
gacctggcactggatgca

SEQ ID NO: 3791077 - DNA, 17 bp, Homo sapiens
gacctgtaacttttgta

SEQ ID NO: 3791078 - DNA, 12 bp, Homo sapiens
gacctgtaatca

SEQ ID NO: 3791079 - DNA, 12 bp, Homo sapiens
gacctgtgacca

SEQ ID NO: 3791080 - DNA, 13 bp, Homo sapiens
gacctgtgctagt

SEQ ID NO: 3791081 - DNA, 19 bp, Homo sapiens
gacctgtgctagttttaca

SEQ ID NO: 3791082 - DNA, 14 bp, Homo sapiens
gaccttgaactggg

SEQ ID NO: 3791083 - DNA, 13 bp, Homo sapiens
gacgcaggaatgg

SEQ ID NO: 3791084 - DNA, 16 bp, Homo sapiens
gacgcaggaatggaaa

SEQ ID NO: 3791085 - DNA, 22 bp, Homo sapiens
gacgcatgccctcaatcccagc

SEQ ID NO: 3791086 - DNA, 15 bp, Homo sapiens
gacggagagaaaaaa

SEQ ID NO: 3791087 - DNA, 18 bp, Homo sapiens
gacggagtcccaccttgg

SEQ ID NO: 3791088 - DNA, 19 bp, Homo sapiens
gacggcacccacccagcac

SEQ ID NO: 3791089 - DNA, 23 bp, Homo sapiens
gacggcctgatgctccctcccct

SEQ ID NO: 3791090 - DNA, 17 bp, Homo sapiens
gacggcgcccccagtgt

SEQ ID NO: 3791091 - DNA, 21 bp, Homo sapiens
gacggtgggcatttgtgaggc

SEQ ID NO: 3791092 - DNA, 20 bp, Homo sapiens
gacgtaggaacggtaaattt

SEQ ID NO: 3791093 - DNA, 18 bp, Homo sapiens
gacgtcctgccacctggg

SEQ ID NO: 3791094 - DNA, 21 bp, Homo sapiens
gacgtcctgccacctggggca

SEQ ID NO: 3791095 - DNA, 10 bp, Homo sapiens
gactaaagag

SEQ ID NO: 3791096 - DNA, 13 bp, Homo sapiens
gactaaagagaga

SEQ ID NO: 3791097 - DNA, 18 bp, Homo sapiens
gactacaggcacccacca

SEQ ID NO: 3791098 - DNA, 18 bp, Homo sapiens
gactagaaagtgaataaa

SEQ ID NO: 3791099 - DNA, 23 bp, Homo sapiens
gactagaagggccagtcctgcct

SEQ ID NO: 3791100 - DNA, 19 bp, Homo sapiens
gactagacctccagctgtt

SEQ ID NO: 3791101 - DNA, 22 bp, Homo sapiens
gactagagaaaccgtcctcttt

SEQ ID NO: 3791102 - DNA, 16 bp, Homo sapiens
gactagaggcagggag

SEQ ID NO: 3791103 - DNA, 14 bp, Homo sapiens
gactaggagcactg

SEQ ID NO: 3791104 - DNA, 20 bp, Homo sapiens
gactagggattcaggctgct

SEQ ID NO: 3791105 - DNA, 12 bp, Homo sapiens
gactagtgctga

SEQ ID NO: 3791106 - DNA, 14 bp, Homo sapiens
gactagtgctgaag

SEQ ID NO: 3791107 - DNA, 18 bp, Homo sapiens
gactatattgtacacacc

SEQ ID NO: 3791108 - DNA, 18 bp, Homo sapiens
gactatcaaactgaagcc

SEQ ID NO: 3791109 - DNA, 16 bp, Homo sapiens
gactattgacatcagc

SEQ ID NO: 3791110 - DNA, 22 bp, Homo sapiens
gactatttgcttatttaataaa

SEQ ID NO: 3791111 - DNA, 12 bp, Homo sapiens
gactcacctctg

SEQ ID NO: 3791112 - DNA, 14 bp, Homo sapiens
gactcacctctgcc

SEQ ID NO: 3791113 - DNA, 22 bp, Homo sapiens
gactcactggcagccccagcac

SEQ ID NO: 3791114 - DNA, 23 bp, Homo sapiens
gactcagacaggaaagggaaggc

SEQ ID NO: 3791115 - DNA, 16 bp, Homo sapiens
gactcaggatgcccag

SEQ ID NO: 3791116 - DNA, 18 bp, Homo sapiens
gactcagggccccagcac

SEQ ID NO: 3791117 - DNA, 12 bp, Homo sapiens
gactcagtgttc

SEQ ID NO: 3791118 - DNA, 15 bp, Homo sapiens
gactcagtttgtcag

SEQ ID NO: 3791119 - DNA, 15 bp, Homo sapiens
gactcattcttctgt

SEQ ID NO: 3791120 - DNA, 21 bp, Homo sapiens
gactcattgcttcacaaccca

SEQ ID NO: 3791121 - DNA, 15 bp, Homo sapiens
gactccagatctgca

SEQ ID NO: 3791122 - DNA, 16 bp, Homo sapiens
gactccagatctgcac

SEQ ID NO: 3791123 - DNA, 19 bp, Homo sapiens
gactcccaaagagctgcct

SEQ ID NO: 3791124 - DNA, 14 bp, Homo sapiens
gactccctcctcac

SEQ ID NO: 3791125 - DNA, 19 bp, Homo sapiens
gactccctcctcacctctg

SEQ ID NO: 3791126 - DNA, 11 bp, Homo sapiens
gactcctctgt

SEQ ID NO: 3791127 - DNA, 21 bp, Homo sapiens
gactctacagaggccatgggc

SEQ ID NO: 3791128 - DNA, 23 bp, Homo sapiens
gactctacctcatatcagtttgc

SEQ ID NO: 3791129 - DNA, 22 bp, Homo sapiens
gactctcccctcttatgtacct

SEQ ID NO: 3791130 - DNA, 22 bp, Homo sapiens
gactctgaggctctttctgggc

SEQ ID NO: 3791131 - DNA, 12 bp, Homo sapiens
gactctgtctca

SEQ ID NO: 3791132 - DNA, 9 bp, Homo sapiens
gactcttgt

SEQ ID NO: 3791133 - DNA, 19 bp, Homo sapiens
gactcttgttttcagtttc

SEQ ID NO: 3791134 - DNA, 16 bp, Homo sapiens
gactgaccctgatcag

SEQ ID NO: 3791135 - DNA, 18 bp, Homo sapiens
gactgagcaagaccctgt

SEQ ID NO: 3791136 - DNA, 21 bp, Homo sapiens
gactgagcaagaccctgtctc

SEQ ID NO: 3791137 - DNA, 14 bp, Homo sapiens
gactgagcagactg

SEQ ID NO: 3791138 - DNA, 15 bp, Homo sapiens
gactgagcagactgg

SEQ ID NO: 3791139 - DNA, 22 bp, Homo sapiens
gactgagtcctcgtagccatct

SEQ ID NO: 3791140 - DNA, 23 bp, Homo sapiens
gactgatgttaggctgggcccag

SEQ ID NO: 3791141 - DNA, 21 bp, Homo sapiens
gactgatgttgagggaacaga

SEQ ID NO: 3791142 - DNA, 17 bp, Homo sapiens
gactgcaagtgagcaaa

SEQ ID NO: 3791143 - DNA, 20 bp, Homo sapiens
gactgcattttactgtacag

SEQ ID NO: 3791144 - DNA, 20 bp, Homo sapiens
gactgccagtccccctgccc

SEQ ID NO: 3791145 - DNA, 13 bp, Homo sapiens
gactgcccggcag

SEQ ID NO: 3791146 - DNA, 15 bp, Homo sapiens
gactgcccggcaggg

SEQ ID NO: 3791147 - DNA, 22 bp, Homo sapiens
gactgcgggatggtcctggggc

SEQ ID NO: 3791148 - DNA, 12 bp, Homo sapiens
gactgctgggac

SEQ ID NO: 3791149 - DNA, 19 bp, Homo sapiens
gactgctgggactggccag

SEQ ID NO: 3791150 - DNA, 14 bp, Homo sapiens
gactggaattttta

SEQ ID NO: 3791151 - DNA, 22 bp, Homo sapiens
gactggaatttttattatgcat

SEQ ID NO: 3791152 - DNA, 23 bp, Homo sapiens
gactggagacaatgcagatgcca

SEQ ID NO: 3791153 - DNA, 22 bp, Homo sapiens
gactggatagtccgtctctgct

SEQ ID NO: 3791154 - DNA, 14 bp, Homo sapiens
gactggcctgagga

SEQ ID NO: 3791155 - DNA, 17 bp, Homo sapiens
gactggctagagtcctc

SEQ ID NO: 3791156 - DNA, 17 bp, Homo sapiens
gaggtcaagcccaggag

SEQ ID NO: 3791157 - DNA, 19 bp, Homo sapiens
gaggtcaagcccaggagga

SEQ ID NO: 3791158 - DNA, 16 bp, Homo sapiens
gaggtcaagtaagaag

SEQ ID NO: 3791159 - DNA, 14 bp, Homo sapiens
gaggtcccaggcag

SEQ ID NO: 3791160 - DNA, 14 bp, Homo sapiens
gaggtcctgggggc

SEQ ID NO: 3791161 - DNA, 16 bp, Homo sapiens
gaggtcctgggggcct

SEQ ID NO: 3791162 - DNA, 18 bp, Homo sapiens
gaggtcctgggggcctga

SEQ ID NO: 3791163 - DNA, 23 bp, Homo sapiens
gaggtcctgggggcctgacctcc

SEQ ID NO: 3791164 - DNA, 15 bp, Homo sapiens
gaggtcgaggcagga

SEQ ID NO: 3791165 - DNA, 20 bp, Homo sapiens
gaggtcgggagttcgagacc

SEQ ID NO: 3791166 - DNA, 14 bp, Homo sapiens
gaggtctcttgagg

SEQ ID NO: 3791167 - DNA, 14 bp, Homo sapiens
gaggtctgaaatgg

SEQ ID NO: 3791168 - DNA, 23 bp, Homo sapiens
gaggtctgctcggccgtcttcac

SEQ ID NO: 3791169 - DNA, 19 bp, Homo sapiens
gaggtcttttgacatgtgg

SEQ ID NO: 3791170 - DNA, 16 bp, Homo sapiens
gaggtgaaagggagct

SEQ ID NO: 3791171 - DNA, 19 bp, Homo sapiens
gaggtgcagagtgcccaga

SEQ ID NO: 3791172 - DNA, 16 bp, Homo sapiens
gaggtgctgggaggga

SEQ ID NO: 3791173 - DNA, 20 bp, Homo sapiens
gaggtggaggttgcagtgag

SEQ ID NO: 3791174 - DNA, 20 bp, Homo sapiens
gaggtggatcacagaggctt

SEQ ID NO: 3791175 - DNA, 18 bp, Homo sapiens
gaggtggcagccctgtag

SEQ ID NO: 3791176 - DNA, 13 bp, Homo sapiens
gaggtggctgcct

SEQ ID NO: 3791177 - DNA, 20 bp, Homo sapiens
gaggtgggaggatcttttga

SEQ ID NO: 3791178 - DNA, 13 bp, Homo sapiens
gaggtggtctgaa

SEQ ID NO: 3791179 - DNA, 19 bp, Homo sapiens
gaggttataggtcactcct

SEQ ID NO: 3791180 - DNA, 19 bp, Homo sapiens
gaggttgcagggagccgag

SEQ ID NO: 3791181 - DNA, 13 bp, Homo sapiens
gaggttgcagtga

SEQ ID NO: 3791182 - DNA, 19 bp, Homo sapiens
gaggttgcagtgagccaag

SEQ ID NO: 3791183 - DNA, 13 bp, Homo sapiens
gaggttgcagtgt

SEQ ID NO: 3791184 - DNA, 19 bp, Homo sapiens
gaggtttaggtcaagaaga

SEQ ID NO: 3791185 - DNA, 19 bp, Homo sapiens
gaggttttaaaaaaatccc

SEQ ID NO: 3791186 - DNA, 12 bp, Homo sapiens
gagtaagagctg

SEQ ID NO: 3791187 - DNA, 16 bp, Homo sapiens
gagtaatttattgttt

SEQ ID NO: 3791188 - DNA, 18 bp, Homo sapiens
gagtacctgctgccccag

SEQ ID NO: 3791189 - DNA, 18 bp, Homo sapiens
gagtagacccctggctgg

SEQ ID NO: 3791190 - DNA, 17 bp, Homo sapiens
gagtagccgagagcctg

SEQ ID NO: 3791191 - DNA, 23 bp, Homo sapiens
gagtatctcctcgcaagctgggt

SEQ ID NO: 3791192 - DNA, 20 bp, Homo sapiens
gagtcaatcccctcattcag

SEQ ID NO: 3791193 - DNA, 12 bp, Homo sapiens
gagtcacactca

SEQ ID NO: 3791194 - DNA, 20 bp, Homo sapiens
gagtcacccatgaagacagg

SEQ ID NO: 3791195 - DNA, 15 bp, Homo sapiens
gagtcactgcctctc

SEQ ID NO: 3791196 - DNA, 17 bp, Homo sapiens
gagtcagggacccctgc

SEQ ID NO: 3791197 - DNA, 22 bp, Homo sapiens
gagtcagggacccctgcccttg

SEQ ID NO: 3791198 - DNA, 18 bp, Homo sapiens
gagtcaggtttggggttc

SEQ ID NO: 3791199 - DNA, 13 bp, Homo sapiens
gagtcatctccat

SEQ ID NO: 3791200 - DNA, 16 bp, Homo sapiens
gagtcatgatctccct

SEQ ID NO: 3791201 - DNA, 16 bp, Homo sapiens
gagtcccaccttggct

SEQ ID NO: 3791202 - DNA, 19 bp, Homo sapiens
gagtccgaaagggacttgg

SEQ ID NO: 3791203 - DNA, 17 bp, Homo sapiens
gagtcctcactcccagt

SEQ ID NO: 3791204 - DNA, 15 bp, Homo sapiens
gagtcgaggacaggg

SEQ ID NO: 3791205 - DNA, 17 bp, Homo sapiens
gagtcgaggacagggag

SEQ ID NO: 3791206 - DNA, 14 bp, Homo sapiens
gagtgacagaggca

SEQ ID NO: 3791207 - DNA, 20 bp, Homo sapiens
gagtgaggatatgagtagcc

SEQ ID NO: 3791208 - DNA, 18 bp, Homo sapiens
gagtgcagtgagccgaga

SEQ ID NO: 3791209 - DNA, 18 bp, Homo sapiens
gagtggatagatgccctg

SEQ ID NO: 3791210 - DNA, 20 bp, Homo sapiens
gagtggatagatgccctgct

SEQ ID NO: 3791211 - DNA, 16 bp, Homo sapiens
gagtggatgcctcaga

SEQ ID NO: 3791212 - DNA, 10 bp, Homo sapiens
gagtggcctg

SEQ ID NO: 3791213 - DNA, 14 bp, Homo sapiens
gagtggcctggcca

SEQ ID NO: 3791214 - DNA, 17 bp, Homo sapiens
gagtgggaaggacttgg

SEQ ID NO: 3791215 - DNA, 13 bp, Homo sapiens
gagtgggtgaata

SEQ ID NO: 3791216 - DNA, 18 bp, Homo sapiens
gagtgtaacaagaaagga

SEQ ID NO: 3791217 - DNA, 20 bp, Homo sapiens
gagtgtgcctgaagtcccag

SEQ ID NO: 3791218 - DNA, 18 bp, Homo sapiens
gagtgtgtattgttccca

SEQ ID NO: 3791219 - DNA, 11 bp, Homo sapiens
gagtgtgtgca

SEQ ID NO: 3791220 - DNA, 19 bp, Homo sapiens
gagtgtgtgcatgtgtgtg

SEQ ID NO: 3791221 - DNA, 17 bp, Homo sapiens
gagttaaaaagggcagg

SEQ ID NO: 3791222 - DNA, 20 bp, Homo sapiens
gagttagaggccagcctggc

SEQ ID NO: 3791223 - DNA, 16 bp, Homo sapiens
gagttaggtgggggtg

SEQ ID NO: 3791224 - DNA, 19 bp, Homo sapiens
gagttaggtttaacataaa

SEQ ID NO: 3791225 - DNA, 22 bp, Homo sapiens
gagttcagcctttaagatacct

SEQ ID NO: 3791226 - DNA, 19 bp, Homo sapiens
gagttcaggtagctgcccc

SEQ ID NO: 3791227 - DNA, 21 bp, Homo sapiens
gagttcaggtagctgcccctg

SEQ ID NO: 3791228 - DNA, 22 bp, Homo sapiens
gagttcaggtagctgcccctgg

SEQ ID NO: 3791229 - DNA, 20 bp, Homo sapiens
gagttcataccctgttacca

SEQ ID NO: 3791230 - DNA, 21 bp, Homo sapiens
gagttccttgatctgtatata

SEQ ID NO: 3791231 - DNA, 17 bp, Homo sapiens
gagttcgagaccagcct

SEQ ID NO: 3791232 - DNA, 19 bp, Homo sapiens
gagttcgagaccagcctgg

SEQ ID NO: 3791233 - DNA, 21 bp, Homo sapiens
gagttcgagaccagcctggcc

SEQ ID NO: 3791234 - DNA, 21 bp, Homo sapiens
gagttcttaaggattgtgata

SEQ ID NO: 3791235 - DNA, 23 bp, Homo sapiens
gagttgacttgacagaacactgt

SEQ ID NO: 3791236 - DNA, 20 bp, Homo sapiens
gagttgtggaaagcctctgc

SEQ ID NO: 3791237 - DNA, 22 bp, Homo sapiens
gagtttaccatttgtaataaag

SEQ ID NO: 3791238 - DNA, 16 bp, Homo sapiens
gagtttcctcaggctg

SEQ ID NO: 3791239 - DNA, 17 bp, Homo sapiens
gagtttgcaatgtcaca

SEQ ID NO: 3791240 - DNA, 19 bp, Homo sapiens
gagttttgttttaaaatta

SEQ ID NO: 3791241 - DNA, 18 bp, Homo sapiens
gagtttttatggggctga

SEQ ID NO: 3791242 - DNA, 13 bp, Homo sapiens
gataaaaaatttt

SEQ ID NO: 3791243 - DNA, 23 bp, Homo sapiens
gataaaaaattttgtaattttct

SEQ ID NO: 3791244 - DNA, 14 bp, Homo sapiens
gataaaaagatggc

SEQ ID NO: 3791245 - DNA, 16 bp, Homo sapiens
gataaattccactgga

SEQ ID NO: 3791246 - DNA, 20 bp, Homo sapiens
gataacagctaccatgacaa

SEQ ID NO: 3791247 - DNA, 15 bp, Homo sapiens
gataactctttggat

SEQ ID NO: 3791248 - DNA, 22 bp, Homo sapiens
gataagaatgctggttttccta

SEQ ID NO: 3791249 - DNA, 16 bp, Homo sapiens
gataatcagcctctta

SEQ ID NO: 3791250 - DNA, 18 bp, Homo sapiens
gataatcttagctgccaa

SEQ ID NO: 3791251 - DNA, 20 bp, Homo sapiens
gatacaacttcaagtgcatg

SEQ ID NO: 3791252 - DNA, 22 bp, Homo sapiens
gatacaagtttcagacagggtc

SEQ ID NO: 3791253 - DNA, 21 bp, Homo sapiens
gatacaggaaaagctgctgac

SEQ ID NO: 3791254 - DNA, 23 bp, Homo sapiens
gatacaggaaaagctgctgacag

SEQ ID NO: 3791255 - DNA, 20 bp, Homo sapiens
gataccaggttgaaagacct

SEQ ID NO: 3791256 - DNA, 21 bp, Homo sapiens
gataccatcagcaaagaattt

SEQ ID NO: 3791257 - DNA, 13 bp, Homo sapiens
gatacgactttat

SEQ ID NO: 3791258 - DNA, 21 bp, Homo sapiens
gatacgagttttggccgggtg

SEQ ID NO: 3791259 - DNA, 15 bp, Homo sapiens
gatactgcccggggc

SEQ ID NO: 3791260 - DNA, 20 bp, Homo sapiens
gatactggcaaagcagaaaa

SEQ ID NO: 3791261 - DNA, 18 bp, Homo sapiens
gatactttgatattttca

SEQ ID NO: 3791262 - DNA, 14 bp, Homo sapiens
gatagaaataaata

SEQ ID NO: 3791263 - DNA, 20 bp, Homo sapiens
gatagaaataaatagctata

SEQ ID NO: 3791264 - DNA, 17 bp, Homo sapiens
gatagaagatgtttgct

SEQ ID NO: 3791265 - DNA, 12 bp, Homo sapiens
gatagagggggg

SEQ ID NO: 3791266 - DNA, 14 bp, Homo sapiens
gatagataactctt

SEQ ID NO: 3791267 - DNA, 14 bp, Homo sapiens
gatagatgccctgc

SEQ ID NO: 3791268 - DNA, 19 bp, Homo sapiens
gatagcactgagcaaagca

SEQ ID NO: 3791269 - DNA, 21 bp, Homo sapiens
gatgccatctgtgtcctggtt

SEQ ID NO: 3791270 - DNA, 15 bp, Homo sapiens
gatgcccactgagga

SEQ ID NO: 3791271 - DNA, 19 bp, Homo sapiens
gatgcccagagggcccagg

SEQ ID NO: 3791272 - DNA, 23 bp, Homo sapiens
gatgcccagagggcccaggcagg

SEQ ID NO: 3791273 - DNA, 22 bp, Homo sapiens
gatgcccagggccactctgcct

SEQ ID NO: 3791274 - DNA, 12 bp, Homo sapiens
gatgcctcagaa

SEQ ID NO: 3791275 - DNA, 13 bp, Homo sapiens
gatgcctccaccg

SEQ ID NO: 3791276 - DNA, 18 bp, Homo sapiens
gatgcctccctgaccctg

SEQ ID NO: 3791277 - DNA, 16 bp, Homo sapiens
gatgcctggtggcagc

SEQ ID NO: 3791278 - DNA, 20 bp, Homo sapiens
gatgcctggtggcagctgcg

SEQ ID NO: 3791279 - DNA, 18 bp, Homo sapiens
gatgctatggtcaggtta

SEQ ID NO: 3791280 - DNA, 17 bp, Homo sapiens
gatgctccagccaaccc

SEQ ID NO: 3791281 - DNA, 22 bp, Homo sapiens
gatgctccagccaacccctgtg

SEQ ID NO: 3791282 - DNA, 23 bp, Homo sapiens
gatgctccagccaacccctgtgg

SEQ ID NO: 3791283 - DNA, 23 bp, Homo sapiens
gatgctccctcccctgccctggt

SEQ ID NO: 3791284 - DNA, 14 bp, Homo sapiens
gatgctggatgctc

SEQ ID NO: 3791285 - DNA, 16 bp, Homo sapiens
gatgctgtgctatgaa

SEQ ID NO: 3791286 - DNA, 19 bp, Homo sapiens
gatgcttcatgtgaacgtg

SEQ ID NO: 3791287 - DNA, 15 bp, Homo sapiens
gatgcttctgggaga

SEQ ID NO: 3791288 - DNA, 17 bp, Homo sapiens
gatggaaaaggaagact

SEQ ID NO: 3791289 - DNA, 14 bp, Homo sapiens
gatggaaacaaagt

SEQ ID NO: 3791290 - DNA, 16 bp, Homo sapiens
gatggaaacaaagtgg

SEQ ID NO: 3791291 - DNA, 17 bp, Homo sapiens
gatggaaccgcaggaag

SEQ ID NO: 3791292 - DNA, 18 bp, Homo sapiens
gatggaaccgcaggaagc

SEQ ID NO: 3791293 - DNA, 19 bp, Homo sapiens
gatggaaccgcaggaagct

SEQ ID NO: 3791294 - DNA, 20 bp, Homo sapiens
gatggaaccgcaggaagctg

SEQ ID NO: 3791295 - DNA, 21 bp, Homo sapiens
gatggaagttgcagtgagctg

SEQ ID NO: 3791296 - DNA, 22 bp, Homo sapiens
gatggagactccatgagaagcc

SEQ ID NO: 3791297 - DNA, 16 bp, Homo sapiens
gatggagcgcacctgc

SEQ ID NO: 3791298 - DNA, 22 bp, Homo sapiens
gatggagcgcacctgccccctg

SEQ ID NO: 3791299 - DNA, 19 bp, Homo sapiens
gatggaggttctctcggag

SEQ ID NO: 3791300 - DNA, 18 bp, Homo sapiens
gatggattctcagatatt

SEQ ID NO: 3791301 - DNA, 22 bp, Homo sapiens
gatggattctcagatatttata

SEQ ID NO: 3791302 - DNA, 18 bp, Homo sapiens
gatggcaaccagaccatt

SEQ ID NO: 3791303 - DNA, 15 bp, Homo sapiens
gatggccctctggta

SEQ ID NO: 3791304 - DNA, 21 bp, Homo sapiens
gatggctaaaaccatcatagt

SEQ ID NO: 3791305 - DNA, 20 bp, Homo sapiens
gatggctgtgcctctgcctg

SEQ ID NO: 3791306 - DNA, 23 bp, Homo sapiens
gatggcttttgtttcttcccttc

SEQ ID NO: 3791307 - DNA, 21 bp, Homo sapiens
gatgggaacgcagatgatcca

SEQ ID NO: 3791308 - DNA, 16 bp, Homo sapiens
gatgggcccaattctt

SEQ ID NO: 3791309 - DNA, 20 bp, Homo sapiens
gatggggagatcggggccag

SEQ ID NO: 3791310 - DNA, 21 bp, Homo sapiens
gatggggagatcggggccaga

SEQ ID NO: 3791311 - DNA, 23 bp, Homo sapiens
gatggggtctcacagtgttgccc

SEQ ID NO: 3791312 - DNA, 18 bp, Homo sapiens
gatgggtttgacaaggtt

SEQ ID NO: 3791313 - DNA, 13 bp, Homo sapiens
gatggtcctgggg

SEQ ID NO: 3791314 - DNA, 15 bp, Homo sapiens
gatggttacactgtt

SEQ ID NO: 3791315 - DNA, 18 bp, Homo sapiens
gatggttacactgttaga

SEQ ID NO: 3791316 - DNA, 18 bp, Homo sapiens
gatggttcccctgttcac

SEQ ID NO: 3791317 - DNA, 21 bp, Homo sapiens
gatgtaaacagtgcctgctga

SEQ ID NO: 3791318 - DNA, 13 bp, Homo sapiens
gatgtaaatgaag

SEQ ID NO: 3791319 - DNA, 21 bp, Homo sapiens
gatgtagggtaaggtgccttc

SEQ ID NO: 3791320 - DNA, 17 bp, Homo sapiens
gatgtccacagatgcct

SEQ ID NO: 3791321 - DNA, 17 bp, Homo sapiens
gatgtcccaacttgtaa

SEQ ID NO: 3791322 - DNA, 20 bp, Homo sapiens
gatgtccctttcttggccag

SEQ ID NO: 3791323 - DNA, 18 bp, Homo sapiens
gatgtcttatttttagat

SEQ ID NO: 3791324 - DNA, 12 bp, Homo sapiens
gatgtctttgtt

SEQ ID NO: 3791325 - DNA, 16 bp, Homo sapiens
gatgtctttgttaaga

SEQ ID NO: 3791326 - DNA, 16 bp, Homo sapiens
gatgtgcaaaaatttt

SEQ ID NO: 3791327 - DNA, 17 bp, Homo sapiens
gatgtgggtcaaggaat

SEQ ID NO: 3791328 - DNA, 23 bp, Homo sapiens
gatgttgaatgcccacaggcaaa

SEQ ID NO: 3791329 - DNA, 15 bp, Homo sapiens
gatgtttgtggcctc

SEQ ID NO: 3791330 - DNA, 16 bp, Homo sapiens
gatgtttgtggcctca

SEQ ID NO: 3791331 - DNA, 16 bp, Homo sapiens
gattaaggtctctctt

SEQ ID NO: 3791332 - DNA, 18 bp, Homo sapiens
gattaatatggggatgca

SEQ ID NO: 3791333 - DNA, 21 bp, Homo sapiens
gattacaagcgtgagccactg

SEQ ID NO: 3791334 - DNA, 22 bp, Homo sapiens
gattacctagtagtcatttcat

SEQ ID NO: 3791335 - DNA, 20 bp, Homo sapiens
gattataggagtgagccacc

SEQ ID NO: 3791336 - DNA, 19 bp, Homo sapiens
gattatattgagacaaaaa

SEQ ID NO: 3791337 - DNA, 15 bp, Homo sapiens
gattatggttttgtg

SEQ ID NO: 3791338 - DNA, 21 bp, Homo sapiens
gattcaccctgtccaaactgc

SEQ ID NO: 3791339 - DNA, 18 bp, Homo sapiens
gattcacctgtaaaactt

SEQ ID NO: 3791340 - DNA, 13 bp, Homo sapiens
gattcagctctgc

SEQ ID NO: 3791341 - DNA, 18 bp, Homo sapiens
gattcatatttacttctt

SEQ ID NO: 3791342 - DNA, 19 bp, Homo sapiens
gattcatatttacttctta

SEQ ID NO: 3791343 - DNA, 14 bp, Homo sapiens
gattcccattgaaa

SEQ ID NO: 3791344 - DNA, 21 bp, Homo sapiens
gattccctcctgctactctgt

SEQ ID NO: 3791345 - DNA, 15 bp, Homo sapiens
gattcctgagccagt

SEQ ID NO: 3791346 - DNA, 20 bp, Homo sapiens
gattcctttccctttagcac

SEQ ID NO: 3791347 - DNA, 15 bp, Homo sapiens
gattccttttcttgt

SEQ ID NO: 3791348 - DNA, 16 bp, Homo sapiens
gattccttttcttgtt

SEQ ID NO: 3791349 - DNA, 21 bp, Homo sapiens
gattcgagctatatttaagta

SEQ ID NO: 3791350 - DNA, 14 bp, Homo sapiens
gattctcctgcctc

SEQ ID NO: 3791351 - DNA, 18 bp, Homo sapiens
gattctcctgcctcagcc

SEQ ID NO: 3791352 - DNA, 15 bp, Homo sapiens
gattctgggaggaag

SEQ ID NO: 3791353 - DNA, 12 bp, Homo sapiens
gattcttctgct

SEQ ID NO: 3791354 - DNA, 19 bp, Homo sapiens
gattctttaatagaagttt

SEQ ID NO: 3791355 - DNA, 19 bp, Homo sapiens
gattctttccattatgatt

SEQ ID NO: 3791356 - DNA, 16 bp, Homo sapiens
gattgcaacaggctgg

SEQ ID NO: 3791357 - DNA, 17 bp, Homo sapiens
gattgcaacaggctggg

SEQ ID NO: 3791358 - DNA, 20 bp, Homo sapiens
gattgcaacaggctgggctt

SEQ ID NO: 3791359 - DNA, 21 bp, Homo sapiens
gattgcaacaggctgggcttc

SEQ ID NO: 3791360 - DNA, 16 bp, Homo sapiens
gattgcaccactgcac

SEQ ID NO: 3791361 - DNA, 15 bp, Homo sapiens
gattgctatgaatga

SEQ ID NO: 3791362 - DNA, 18 bp, Homo sapiens
gattgctgtgtccaactc

SEQ ID NO: 3791363 - DNA, 19 bp, Homo sapiens
gattgctgtgtccaactcc

SEQ ID NO: 3791364 - DNA, 22 bp, Homo sapiens
gattgctgtgtccaactccagt

SEQ ID NO: 3791365 - DNA, 18 bp, Homo sapiens
gattgcttaaaatagcaa

SEQ ID NO: 3791366 - DNA, 23 bp, Homo sapiens
gattggacggcctgatgctccct

SEQ ID NO: 3791367 - DNA, 23 bp, Homo sapiens
gattgtgggaattaaggaagtga

SEQ ID NO: 3791368 - DNA, 14 bp, Homo sapiens
gattgttaaaataa

SEQ ID NO: 3791369 - DNA, 16 bp, Homo sapiens
gattgttaaaataact

SEQ ID NO: 3791370 - DNA, 22 bp, Homo sapiens
gatttaagggatggaaaaggaa

SEQ ID NO: 3791371 - DNA, 15 bp, Homo sapiens
gatttaatttgccaa

SEQ ID NO: 3791372 - DNA, 21 bp, Homo sapiens
gatttacccagaatgtcagat

SEQ ID NO: 3791373 - DNA, 15 bp, Homo sapiens
gatttatcacacaaa

SEQ ID NO: 3791374 - DNA, 15 bp, Homo sapiens
gatttcaagcctgcc

SEQ ID NO: 3791375 - DNA, 17 bp, Homo sapiens
gatttcagtcttttcct

SEQ ID NO: 3791376 - DNA, 16 bp, Homo sapiens
gatttcatgctatctc

SEQ ID NO: 3791377 - DNA, 22 bp, Homo sapiens
gatttcccttcttctgtcatct

SEQ ID NO: 3791378 - DNA, 20 bp, Homo sapiens
gatttctcccagctctagac

SEQ ID NO: 3791379 - DNA, 17 bp, Homo sapiens
gatttgaaggtcttgat

SEQ ID NO: 3791380 - DNA, 21 bp, Homo sapiens
gatttgtccttggggacatct

SEQ ID NO: 3791381 - DNA, 19 bp, Homo sapiens
gcattcctacaaagatgtt

SEQ ID NO: 3791382 - DNA, 13 bp, Homo sapiens
gcattctcactcc

SEQ ID NO: 3791383 - DNA, 22 bp, Homo sapiens
gcattctgccgtgtgccctcgg

SEQ ID NO: 3791384 - DNA, 16 bp, Homo sapiens
gcattgaatatattat

SEQ ID NO: 3791385 - DNA, 21 bp, Homo sapiens
gcattgagaactgcatatgtt

SEQ ID NO: 3791386 - DNA, 18 bp, Homo sapiens
gcattgatggggaaggag

SEQ ID NO: 3791387 - DNA, 12 bp, Homo sapiens
gcattgcattta

SEQ ID NO: 3791388 - DNA, 17 bp, Homo sapiens
gcattggttccctttgc

SEQ ID NO: 3791389 - DNA, 23 bp, Homo sapiens
gcattgtttgcttattgttccaa

SEQ ID NO: 3791390 - DNA, 13 bp, Homo sapiens
gcatttgtgaggc

SEQ ID NO: 3791391 - DNA, 15 bp, Homo sapiens
gcattttttaaaaca

SEQ ID NO: 3791392 - DNA, 17 bp, Homo sapiens
gcattttttaaaacaag

SEQ ID NO: 3791393 - DNA, 18 bp, Homo sapiens
gcattttttaaaacaaga

SEQ ID NO: 3791394 - DNA, 15 bp, Homo sapiens
gccaaacagccacac

SEQ ID NO: 3791395 - DNA, 17 bp, Homo sapiens
gccaaactctgccagcc

SEQ ID NO: 3791396 - DNA, 18 bp, Homo sapiens
gccaaactctgccagcca

SEQ ID NO: 3791397 - DNA, 16 bp, Homo sapiens
gccaaagataatctct

SEQ ID NO: 3791398 - DNA, 19 bp, Homo sapiens
gccaaagggaaatatcatt

SEQ ID NO: 3791399 - DNA, 16 bp, Homo sapiens
gccaagagcagaggca

SEQ ID NO: 3791400 - DNA, 20 bp, Homo sapiens
gccaagagcagaggcagcga

SEQ ID NO: 3791401 - DNA, 15 bp, Homo sapiens
gccaagccccatcct

SEQ ID NO: 3791402 - DNA, 21 bp, Homo sapiens
gccaagccccatcctgccgcc

SEQ ID NO: 3791403 - DNA, 19 bp, Homo sapiens
gccaagctccttgggaggc

SEQ ID NO: 3791404 - DNA, 21 bp, Homo sapiens
gccaaggccagagtggcctgg

SEQ ID NO: 3791405 - DNA, 21 bp, Homo sapiens
gccaaggctgggggaagaagc

SEQ ID NO: 3791406 - DNA, 14 bp, Homo sapiens
gccaaggtgggagg

SEQ ID NO: 3791407 - DNA, 19 bp, Homo sapiens
gccaaggtgggctgagccc

SEQ ID NO: 3791408 - DNA, 23 bp, Homo sapiens
gccaaggtgggctgagccctggc

SEQ ID NO: 3791409 - DNA, 22 bp, Homo sapiens
gccaagtcagctttgccttcca

SEQ ID NO: 3791410 - DNA, 15 bp, Homo sapiens
gccaagtgcaggctg

SEQ ID NO: 3791411 - DNA, 17 bp, Homo sapiens
gccaagtttatatacaa

SEQ ID NO: 3791412 - DNA, 20 bp, Homo sapiens
gccaagtttatatacaatta

SEQ ID NO: 3791413 - DNA, 23 bp, Homo sapiens
gccaatctcttctaaaaaaaaac

SEQ ID NO: 3791414 - DNA, 21 bp, Homo sapiens
gccacaaccctgttttatact

SEQ ID NO: 3791415 - DNA, 22 bp, Homo sapiens
gccacacttcaggctcttctcc

SEQ ID NO: 3791416 - DNA, 17 bp, Homo sapiens
gccacagcagcctctga

SEQ ID NO: 3791417 - DNA, 16 bp, Homo sapiens
gccacagcccaggcct

SEQ ID NO: 3791418 - DNA, 16 bp, Homo sapiens
gccaccaactggccct

SEQ ID NO: 3791419 - DNA, 19 bp, Homo sapiens
gccaccaactggccctctt

SEQ ID NO: 3791420 - DNA, 16 bp, Homo sapiens
gccaccatggccagcc

SEQ ID NO: 3791421 - DNA, 18 bp, Homo sapiens
gccaccatggccagccaa

SEQ ID NO: 3791422 - DNA, 19 bp, Homo sapiens
gccaccctggggagaaagt

SEQ ID NO: 3791423 - DNA, 15 bp, Homo sapiens
gccaccgctgccagc

SEQ ID NO: 3791424 - DNA, 15 bp, Homo sapiens
gccacctccccaggc

SEQ ID NO: 3791425 - DNA, 15 bp, Homo sapiens
gccacctcccctatc

SEQ ID NO: 3791426 - DNA, 16 bp, Homo sapiens
gccacctgcaggtcac

SEQ ID NO: 3791427 - DNA, 13 bp, Homo sapiens
gccacctgccccc

SEQ ID NO: 3791428 - DNA, 14 bp, Homo sapiens
gccacctgccccct

SEQ ID NO: 3791429 - DNA, 18 bp, Homo sapiens
gccacctgcccccttctc

SEQ ID NO: 3791430 - DNA, 23 bp, Homo sapiens
gccacctgcccccttctcccaca

SEQ ID NO: 3791431 - DNA, 14 bp, Homo sapiens
gccacctggggcag

SEQ ID NO: 3791432 - DNA, 19 bp, Homo sapiens
gccacctgtcccacctcaa

SEQ ID NO: 3791433 - DNA, 13 bp, Homo sapiens
gccacggcagcct

SEQ ID NO: 3791434 - DNA, 17 bp, Homo sapiens
gccacggccaggccaga

SEQ ID NO: 3791435 - DNA, 13 bp, Homo sapiens
gccacgtgccagg

SEQ ID NO: 3791436 - DNA, 21 bp, Homo sapiens
gccacgttccttactgcagaa

SEQ ID NO: 3791437 - DNA, 13 bp, Homo sapiens
gccactaggctgg

SEQ ID NO: 3791438 - DNA, 14 bp, Homo sapiens
gccactaggctggg

SEQ ID NO: 3791439 - DNA, 18 bp, Homo sapiens
gccactccagacccctgg

SEQ ID NO: 3791440 - DNA, 19 bp, Homo sapiens
gccactccagacccctggc

SEQ ID NO: 3791441 - DNA, 20 bp, Homo sapiens
gccactccagacccctggct

SEQ ID NO: 3791442 - DNA, 22 bp, Homo sapiens
gccactctgcctctgcctgcat

SEQ ID NO: 3791443 - DNA, 19 bp, Homo sapiens
gccactgaagctgggattc

SEQ ID NO: 3791444 - DNA, 22 bp, Homo sapiens
gccactgcaccgggccacagag

SEQ ID NO: 3791445 - DNA, 12 bp, Homo sapiens
gccactgcactc

SEQ ID NO: 3791446 - DNA, 18 bp, Homo sapiens
gccactgcactccagcct

SEQ ID NO: 3791447 - DNA, 22 bp, Homo sapiens
gccactgcactccagcctgggc

SEQ ID NO: 3791448 - DNA, 16 bp, Homo sapiens
gccactgcccgagctg

SEQ ID NO: 3791449 - DNA, 17 bp, Homo sapiens
gccactgcctcttcctc

SEQ ID NO: 3791450 - DNA, 12 bp, Homo sapiens
gccagaaataaa

SEQ ID NO: 3791451 - DNA, 18 bp, Homo sapiens
gccagaacagtttgtaca

SEQ ID NO: 3791452 - DNA, 20 bp, Homo sapiens
gccagaaccccgagccctac

SEQ ID NO: 3791453 - DNA, 17 bp, Homo sapiens
gccagaccagagctctg

SEQ ID NO: 3791454 - DNA, 23 bp, Homo sapiens
gccagacggcacccacccagcac

SEQ ID NO: 3791455 - DNA, 21 bp, Homo sapiens
gccagagggagtgacagaggc

SEQ ID NO: 3791456 - DNA, 14 bp, Homo sapiens
gccagagtggcctg

SEQ ID NO: 3791457 - DNA, 17 bp, Homo sapiens
gccagatgcaccagccc

SEQ ID NO: 3791458 - DNA, 18 bp, Homo sapiens
gccagatgcaccagccct

SEQ ID NO: 3791459 - DNA, 15 bp, Homo sapiens
gccagattgccatcc

SEQ ID NO: 3791460 - DNA, 13 bp, Homo sapiens
gccagcacagagc

SEQ ID NO: 3791461 - DNA, 12 bp, Homo sapiens
gccagcagccag

SEQ ID NO: 3791462 - DNA, 17 bp, Homo sapiens
gccagcagccagctctc

SEQ ID NO: 3791463 - DNA, 13 bp, Homo sapiens
gccagccagcagc

SEQ ID NO: 3791464 - DNA, 15 bp, Homo sapiens
gccagccccacccag

SEQ ID NO: 3791465 - DNA, 17 bp, Homo sapiens
gccagcccctcccacca

SEQ ID NO: 3791466 - DNA, 21 bp, Homo sapiens
gccagcccctcccaccacagc

SEQ ID NO: 3791467 - DNA, 10 bp, Homo sapiens
gccagccctc

SEQ ID NO: 3791468 - DNA, 16 bp, Homo sapiens
gccagcctggcttctg

SEQ ID NO: 3791469 - DNA, 18 bp, Homo sapiens
gccagcctggcttctgga

SEQ ID NO: 3791470 - DNA, 19 bp, Homo sapiens
gccagcctggcttctggag

SEQ ID NO: 3791471 - DNA, 13 bp, Homo sapiens
gccagctctcagc

SEQ ID NO: 3791472 - DNA, 19 bp, Homo sapiens
gccagctgcatctactcag

SEQ ID NO: 3791473 - DNA, 22 bp, Homo sapiens
gccagctgcatctactcaggcc

SEQ ID NO: 3791474 - DNA, 15 bp, Homo sapiens
gccagctgccgacca

SEQ ID NO: 3791475 - DNA, 18 bp, Homo sapiens
gccagctggcagcagagt

SEQ ID NO: 3791476 - DNA, 19 bp, Homo sapiens
gccagctgggatctgactg

SEQ ID NO: 3791477 - DNA, 20 bp, Homo sapiens
gccagctgtggttttctttt

SEQ ID NO: 3791478 - DNA, 22 bp, Homo sapiens
gccaggagctgggcagaaggcc

SEQ ID NO: 3791479 - DNA, 12 bp, Homo sapiens
gccaggccagag

SEQ ID NO: 3791480 - DNA, 21 bp, Homo sapiens
gccaggcctgggtctgtgtct

SEQ ID NO: 3791481 - DNA, 15 bp, Homo sapiens
gccaggctccttcct

SEQ ID NO: 3791482 - DNA, 20 bp, Homo sapiens
gccaggctccttcctgtctt

SEQ ID NO: 3791483 - DNA, 21 bp, Homo sapiens
gccaggctccttcctgtcttc

SEQ ID NO: 3791484 - DNA, 20 bp, Homo sapiens
gccagggatggggccacagc

SEQ ID NO: 3791485 - DNA, 21 bp, Homo sapiens
gccagggatggggccacagcc

SEQ ID NO: 3791486 - DNA, 16 bp, Homo sapiens
gccaggggcttttgct

SEQ ID NO: 3791487 - DNA, 15 bp, Homo sapiens
gccaggtaatgtgaa

SEQ ID NO: 3791488 - DNA, 22 bp, Homo sapiens
gccaggtttctgcccacattgg

SEQ ID NO: 3791489 - DNA, 11 bp, Homo sapiens
gccagtcttaa

SEQ ID NO: 3791490 - DNA, 19 bp, Homo sapiens
gccagtgccttacctcctg

SEQ ID NO: 3791491 - DNA, 21 bp, Homo sapiens
gccagtgccttacctcctgcc

SEQ ID NO: 3791492 - DNA, 14 bp, Homo sapiens
gccatctaaagtaa

SEQ ID NO: 3791493 - DNA, 12 bp, Homo sapiens
gccatctgtggg

SEQ ID NO: 3791494 - DNA, 13 bp, Homo sapiens
gcctgcccaggcc

SEQ ID NO: 3791495 - DNA, 14 bp, Homo sapiens
gcctgcccaggccc

SEQ ID NO: 3791496 - DNA, 18 bp, Homo sapiens
gcctgcccaggcccctgc

SEQ ID NO: 3791497 - DNA, 20 bp, Homo sapiens
gcctgcccaggcccctgcca

SEQ ID NO: 3791498 - DNA, 17 bp, Homo sapiens
gcctgccccaaacaaat

SEQ ID NO: 3791499 - DNA, 14 bp, Homo sapiens
gcctgcccctccca

SEQ ID NO: 3791500 - DNA, 15 bp, Homo sapiens
gcctgcccctcccag

SEQ ID NO: 3791501 - DNA, 17 bp, Homo sapiens
gcctgcctagcactcac

SEQ ID NO: 3791502 - DNA, 14 bp, Homo sapiens
gcctgcgtggctga

SEQ ID NO: 3791503 - DNA, 17 bp, Homo sapiens
gcctgctaattccccag

SEQ ID NO: 3791504 - DNA, 23 bp, Homo sapiens
gcctgctaattccccagattgca

SEQ ID NO: 3791505 - DNA, 18 bp, Homo sapiens
gcctgctccagctgttca

SEQ ID NO: 3791506 - DNA, 17 bp, Homo sapiens
gcctgctcccccacccc

SEQ ID NO: 3791507 - DNA, 13 bp, Homo sapiens
gcctgctggatct

SEQ ID NO: 3791508 - DNA, 20 bp, Homo sapiens
gcctgctgggctctccacct

SEQ ID NO: 3791509 - DNA, 24 bp, Homo sapiens
gcctgctgggctctccacctcagc

SEQ ID NO: 3791510 - DNA, 22 bp, Homo sapiens
gcctgctttagaatgttttcct

SEQ ID NO: 3791511 - DNA, 14 bp, Homo sapiens
gcctggagccccac

SEQ ID NO: 3791512 - DNA, 18 bp, Homo sapiens
gcctggagccccactgcc

SEQ ID NO: 3791513 - DNA, 20 bp, Homo sapiens
gcctggagccccactgccct

SEQ ID NO: 3791514 - DNA, 12 bp, Homo sapiens
gcctggagctcc

SEQ ID NO: 3791515 - DNA, 15 bp, Homo sapiens
gcctggagctcctgg

SEQ ID NO: 3791516 - DNA, 14 bp, Homo sapiens
gcctggcacagggc

SEQ ID NO: 3791517 - DNA, 18 bp, Homo sapiens
gcctggcacagggcagtg

SEQ ID NO: 3791518 - DNA, 22 bp, Homo sapiens
gcctggcagccgtgccttcagc

SEQ ID NO: 3791519 - DNA, 21 bp, Homo sapiens
gcctggccagatgcaccagcc

SEQ ID NO: 3791520 - DNA, 15 bp, Homo sapiens
gcctggcccccagct

SEQ ID NO: 3791521 - DNA, 19 bp, Homo sapiens
gcctggctccgctgtgtgg

SEQ ID NO: 3791522 - DNA, 13 bp, Homo sapiens
gcctggcttctgg

SEQ ID NO: 3791523 - DNA, 18 bp, Homo sapiens
gcctggcttctggagccc

SEQ ID NO: 3791524 - DNA, 22 bp, Homo sapiens
gcctggcttctggagcccttgg

SEQ ID NO: 3791525 - DNA, 19 bp, Homo sapiens
gcctgggcaacagagcaag

SEQ ID NO: 3791526 - DNA, 22 bp, Homo sapiens
gcctgggcaacatagtgagacc

SEQ ID NO: 3791527 - DNA, 12 bp, Homo sapiens
gcctgggcaaga

SEQ ID NO: 3791528 - DNA, 19 bp, Homo sapiens
gcctgggcagcatagcaag

SEQ ID NO: 3791529 - DNA, 18 bp, Homo sapiens
gcctgggcagccaggctg

SEQ ID NO: 3791530 - DNA, 14 bp, Homo sapiens
gcctgggtctgtgt

SEQ ID NO: 3791531 - DNA, 20 bp, Homo sapiens
gcctgggtgacagagcaaga

SEQ ID NO: 3791532 - DNA, 14 bp, Homo sapiens
gcctgggtgctggc

SEQ ID NO: 3791533 - DNA, 21 bp, Homo sapiens
gcctgggtgctggctgcccag

SEQ ID NO: 3791534 - DNA, 16 bp, Homo sapiens
gcctgggtggggctgc

SEQ ID NO: 3791535 - DNA, 19 bp, Homo sapiens
gcctgggtggggctgctcc

SEQ ID NO: 3791536 - DNA, 13 bp, Homo sapiens
gcctggtggcagc

SEQ ID NO: 3791537 - DNA, 15 bp, Homo sapiens
gcctggtggcagctg

SEQ ID NO: 3791538 - DNA, 15 bp, Homo sapiens
gcctggtgggcctcc

SEQ ID NO: 3791539 - DNA, 16 bp, Homo sapiens
gcctgtaatcccagca

SEQ ID NO: 3791540 - DNA, 18 bp, Homo sapiens
gcctgtaatcccagcact

SEQ ID NO: 3791541 - DNA, 17 bp, Homo sapiens
gcctgtaatcccagcag

SEQ ID NO: 3791542 - DNA, 15 bp, Homo sapiens
gcctgtaatcctagc

SEQ ID NO: 3791543 - DNA, 20 bp, Homo sapiens
gcctgtaatcctagcacttt

SEQ ID NO: 3791544 - DNA, 16 bp, Homo sapiens
gcctgtagttaggaaa

SEQ ID NO: 3791545 - DNA, 13 bp, Homo sapiens
gcctgtccagcct

SEQ ID NO: 3791546 - DNA, 14 bp, Homo sapiens
gcctgtccagcctg

SEQ ID NO: 3791547 - DNA, 17 bp, Homo sapiens
gcctgtccagcctgggc

SEQ ID NO: 3791548 - DNA, 18 bp, Homo sapiens
gcctgtccctctcaggca

SEQ ID NO: 3791549 - DNA, 21 bp, Homo sapiens
gcctgtcgtgccagtcctggg

SEQ ID NO: 3791550 - DNA, 22 bp, Homo sapiens
gcctgtctcatccccaggggtc

SEQ ID NO: 3791551 - DNA, 21 bp, Homo sapiens
gcctgtctcctttgcaggctc

SEQ ID NO: 3791552 - DNA, 19 bp, Homo sapiens
gcctgtgcctcctcacccc

SEQ ID NO: 3791553 - DNA, 19 bp, Homo sapiens
gcctgtggcagtaaagaga

SEQ ID NO: 3791554 - DNA, 19 bp, Homo sapiens
gcctgtggttacagtgcag

SEQ ID NO: 3791555 - DNA, 21 bp, Homo sapiens
gcctgttagcatgctggtgag

SEQ ID NO: 3791556 - DNA, 17 bp, Homo sapiens
gcctgttcagctccagc

SEQ ID NO: 3791557 - DNA, 14 bp, Homo sapiens
gccttacctcctgc

SEQ ID NO: 3791558 - DNA, 15 bp, Homo sapiens
gccttacctcctgcc

SEQ ID NO: 3791559 - DNA, 17 bp, Homo sapiens
gccttacctcctgccca

SEQ ID NO: 3791560 - DNA, 13 bp, Homo sapiens
gccttactttgta

SEQ ID NO: 3791561 - DNA, 15 bp, Homo sapiens
gccttactttgtatg

SEQ ID NO: 3791562 - DNA, 16 bp, Homo sapiens
gccttcagctctacag

SEQ ID NO: 3791563 - DNA, 18 bp, Homo sapiens
gccttccagcaccctgca

SEQ ID NO: 3791564 - DNA, 15 bp, Homo sapiens
gccttccataattat

SEQ ID NO: 3791565 - DNA, 22 bp, Homo sapiens
gccttcgatacaccgggcctgg

SEQ ID NO: 3791566 - DNA, 15 bp, Homo sapiens
gccttctctgaagga

SEQ ID NO: 3791567 - DNA, 18 bp, Homo sapiens
gccttcttattctcactc

SEQ ID NO: 3791568 - DNA, 23 bp, Homo sapiens
gccttcttattctcactccacca

SEQ ID NO: 3791569 - DNA, 23 bp, Homo sapiens
gccttcttcggggaactcctgga

SEQ ID NO: 3791570 - DNA, 21 bp, Homo sapiens
gccttcttgtgatcttgctct

SEQ ID NO: 3791571 - DNA, 14 bp, Homo sapiens
gccttgcccagaga

SEQ ID NO: 3791572 - DNA, 19 bp, Homo sapiens
gccttggataatgctgttg

SEQ ID NO: 3791573 - DNA, 22 bp, Homo sapiens
gccttgggctgctcctcatggt

SEQ ID NO: 3791574 - DNA, 16 bp, Homo sapiens
gccttggtgtccacct

SEQ ID NO: 3791575 - DNA, 18 bp, Homo sapiens
gccttggtgtccacctgg

SEQ ID NO: 3791576 - DNA, 17 bp, Homo sapiens
gccttgtaattctaaat

SEQ ID NO: 3791577 - DNA, 21 bp, Homo sapiens
gcctttccataaggaatgtag

SEQ ID NO: 3791578 - DNA, 13 bp, Homo sapiens
gcctttcctgttc

SEQ ID NO: 3791579 - DNA, 19 bp, Homo sapiens
gcctttcctgttcagcatt

SEQ ID NO: 3791580 - DNA, 15 bp, Homo sapiens
gcctttgcagaaaca

SEQ ID NO: 3791581 - DNA, 11 bp, Homo sapiens
gcctttgtaag

SEQ ID NO: 3791582 - DNA, 16 bp, Homo sapiens
gccttttatttcttaa

SEQ ID NO: 3791583 - DNA, 13 bp, Homo sapiens
gccttttgacagc

SEQ ID NO: 3791584 - DNA, 11 bp, Homo sapiens
gcgaatggtag

SEQ ID NO: 3791585 - DNA, 22 bp, Homo sapiens
gcgaatggtagtctaaccaaat

SEQ ID NO: 3791586 - DNA, 16 bp, Homo sapiens
gcgagactctgtctca

SEQ ID NO: 3791587 - DNA, 16 bp, Homo sapiens
gcgagagtctgtctca

SEQ ID NO: 3791588 - DNA, 21 bp, Homo sapiens
gcgagatcggggtagaaatgc

SEQ ID NO: 3791589 - DNA, 15 bp, Homo sapiens
gcgagccctggtggc

SEQ ID NO: 3791590 - DNA, 17 bp, Homo sapiens
gcgaggtcaacagagaa

SEQ ID NO: 3791591 - DNA, 20 bp, Homo sapiens
gcgagtgtgtgcatgtgtgt

SEQ ID NO: 3791592 - DNA, 21 bp, Homo sapiens
gcgatcatggctcactgcagc

SEQ ID NO: 3791593 - DNA, 16 bp, Homo sapiens
gcgatccacctgtctc

SEQ ID NO: 3791594 - DNA, 17 bp, Homo sapiens
gcgatccacctgtctca

SEQ ID NO: 3791595 - DNA, 13 bp, Homo sapiens
gcgattcttctgc

SEQ ID NO: 3791596 - DNA, 13 bp, Homo sapiens
gcgcaaaactgaa

SEQ ID NO: 3791597 - DNA, 22 bp, Homo sapiens
gcgcaagcctgtaatcccagct

SEQ ID NO: 3791598 - DNA, 23 bp, Homo sapiens
gcgcaagcctgtaatcccagcta

SEQ ID NO: 3791599 - DNA, 19 bp, Homo sapiens
gcgcacctgccccctggtg

SEQ ID NO: 3791600 - DNA, 18 bp, Homo sapiens
gcgccactcgcttccccc

SEQ ID NO: 3791601 - DNA, 16 bp, Homo sapiens
gcgccattgcactcca

SEQ ID NO: 3791602 - DNA, 21 bp, Homo sapiens
gcgcctagtggggtctccctc

SEQ ID NO: 3791603 - DNA, 16 bp, Homo sapiens
gcgcctgcccctccca

SEQ ID NO: 3791604 - DNA, 16 bp, Homo sapiens
gcgctgccgcacccca

SEQ ID NO: 3791605 - DNA, 17 bp, Homo sapiens
gcgctgccgcaccccag

SEQ ID NO: 3791606 - DNA, 23 bp, Homo sapiens
gcgctgctcttatgccatttgtt

SEQ ID NO: 3791607 - DNA, 21 bp, Homo sapiens
gctgacagacacaggcccggc

SEQ ID NO: 3791608 - DNA, 15 bp, Homo sapiens
gctgaccaagagaga

SEQ ID NO: 3791609 - DNA, 16 bp, Homo sapiens
gctgaccaagagagaa

SEQ ID NO: 3791610 - DNA, 12 bp, Homo sapiens
gctgaccagaca

SEQ ID NO: 3791611 - DNA, 17 bp, Homo sapiens
gctgacccagtccctgg

SEQ ID NO: 3791612 - DNA, 19 bp, Homo sapiens
gctgacccccctcaggacc

SEQ ID NO: 3791613 - DNA, 14 bp, Homo sapiens
gctgacctccacag

SEQ ID NO: 3791614 - DNA, 17 bp, Homo sapiens
gctgacctccacagctt

SEQ ID NO: 3791615 - DNA, 18 bp, Homo sapiens
gctgacctcccagtgacc

SEQ ID NO: 3791616 - DNA, 23 bp, Homo sapiens
gctgaccttgaactcctgggctc

SEQ ID NO: 3791617 - DNA, 15 bp, Homo sapiens
gctgactagaagggc

SEQ ID NO: 3791618 - DNA, 21 bp, Homo sapiens
gctgactgtactcctcccagg

SEQ ID NO: 3791619 - DNA, 23 bp, Homo sapiens
gctgactgtggccccctccgtga

SEQ ID NO: 3791620 - DNA, 20 bp, Homo sapiens
gctgagagacccaaggagga

SEQ ID NO: 3791621 - DNA, 16 bp, Homo sapiens
gctgagaggagagaga

SEQ ID NO: 3791622 - DNA, 22 bp, Homo sapiens
gctgagaggcagacttccctga

SEQ ID NO: 3791623 - DNA, 13 bp, Homo sapiens
gctgagccctggc

SEQ ID NO: 3791624 - DNA, 14 bp, Homo sapiens
gctgagccctggca

SEQ ID NO: 3791625 - DNA, 23 bp, Homo sapiens
gctgaggaaaggccagctggcag

SEQ ID NO: 3791626 - DNA, 15 bp, Homo sapiens
gctgaggcagaagaa

SEQ ID NO: 3791627 - DNA, 15 bp, Homo sapiens
gctgagggaccagcc

SEQ ID NO: 3791628 - DNA, 15 bp, Homo sapiens
gctgagtgagctgaa

SEQ ID NO: 3791629 - DNA, 22 bp, Homo sapiens
gctgagtgggggatcacagcct

SEQ ID NO: 3791630 - DNA, 18 bp, Homo sapiens
gctgatatatgtgttttt

SEQ ID NO: 3791631 - DNA, 16 bp, Homo sapiens
gctgatctcagggaag

SEQ ID NO: 3791632 - DNA, 21 bp, Homo sapiens
gctgatctcagggaagcccag

SEQ ID NO: 3791633 - DNA, 20 bp, Homo sapiens
gctgattactgtcaataaac

SEQ ID NO: 3791634 - DNA, 14 bp, Homo sapiens
gctgattttaacaa

SEQ ID NO: 3791635 - DNA, 20 bp, Homo sapiens
gctgattttaacaataacta

SEQ ID NO: 3791636 - DNA, 22 bp, Homo sapiens
gctgcaaagggtatcaggtgct

SEQ ID NO: 3791637 - DNA, 18 bp, Homo sapiens
gctgcaccctcaggcagg

SEQ ID NO: 3791638 - DNA, 18 bp, Homo sapiens
gctgcacctgccagcctg

SEQ ID NO: 3791639 - DNA, 20 bp, Homo sapiens
gctgcagtgacgtgcacctg

SEQ ID NO: 3791640 - DNA, 13 bp, Homo sapiens
gctgcatagaagg

SEQ ID NO: 3791641 - DNA, 14 bp, Homo sapiens
gctgcatagaagga

SEQ ID NO: 3791642 - DNA, 15 bp, Homo sapiens
gctgccaaggccaga

SEQ ID NO: 3791643 - DNA, 18 bp, Homo sapiens
gctgccaaggccagagtg

SEQ ID NO: 3791644 - DNA, 23 bp, Homo sapiens
gctgccaaggccagagtggcctg

SEQ ID NO: 3791645 - DNA, 21 bp, Homo sapiens
gctgccacacttcaggctctt

SEQ ID NO: 3791646 - DNA, 23 bp, Homo sapiens
gctgccatccaggttcagcttgt

SEQ ID NO: 3791647 - DNA, 23 bp, Homo sapiens
gctgccccatgaagccacagccc

SEQ ID NO: 3791648 - DNA, 18 bp, Homo sapiens
gctgcccctccctgccag

SEQ ID NO: 3791649 - DNA, 22 bp, Homo sapiens
gctgcccctccctgccagcacc

SEQ ID NO: 3791650 - DNA, 16 bp, Homo sapiens
gctgcccgtcttcagc

SEQ ID NO: 3791651 - DNA, 21 bp, Homo sapiens
gctgcccgtcttcagcctagc

SEQ ID NO: 3791652 - DNA, 15 bp, Homo sapiens
gctgccctaggctcc

SEQ ID NO: 3791653 - DNA, 16 bp, Homo sapiens
gctgccctaggctccg

SEQ ID NO: 3791654 - DNA, 21 bp, Homo sapiens
gctgccctccatcccgacatg

SEQ ID NO: 3791655 - DNA, 15 bp, Homo sapiens
gctgccctgccactt

SEQ ID NO: 3791656 - DNA, 14 bp, Homo sapiens
gctgccctggtgct

SEQ ID NO: 3791657 - DNA, 20 bp, Homo sapiens
gctgccctggtgctgccaca

SEQ ID NO: 3791658 - DNA, 22 bp, Homo sapiens
gctgccctggtgctgccacact

SEQ ID NO: 3791659 - DNA, 16 bp, Homo sapiens
gctgccgaccagagcc

SEQ ID NO: 3791660 - DNA, 15 bp, Homo sapiens
gctgccgcaccccag

SEQ ID NO: 3791661 - DNA, 15 bp, Homo sapiens
gctgccgcctcccag

SEQ ID NO: 3791662 - DNA, 16 bp, Homo sapiens
gctgccgcctcccagc

SEQ ID NO: 3791663 - DNA, 19 bp, Homo sapiens
gctgccgcctcccagcctg

SEQ ID NO: 3791664 - DNA, 16 bp, Homo sapiens
gctgcctaagtggctg

SEQ ID NO: 3791665 - DNA, 15 bp, Homo sapiens
gctgcctccccaacc

SEQ ID NO: 3791666 - DNA, 19 bp, Homo sapiens
gctgcctccccaaccctgc

SEQ ID NO: 3791667 - DNA, 20 bp, Homo sapiens
gctgcctccccaaccctgcc

SEQ ID NO: 3791668 - DNA, 21 bp, Homo sapiens
gctgcctccccaaccctgccc

SEQ ID NO: 3791669 - DNA, 19 bp, Homo sapiens
gctgcctccctgtccaccc

SEQ ID NO: 3791670 - DNA, 18 bp, Homo sapiens
gctgcctgagcacctccc

SEQ ID NO: 3791671 - DNA, 20 bp, Homo sapiens
gctgcctggaagagcagccc

SEQ ID NO: 3791672 - DNA, 13 bp, Homo sapiens
gctgcctggagcc

SEQ ID NO: 3791673 - DNA, 14 bp, Homo sapiens
gctgcctggagccc

SEQ ID NO: 3791674 - DNA, 16 bp, Homo sapiens
gctgcctggagcccca

SEQ ID NO: 3791675 - DNA, 19 bp, Homo sapiens
gctgcctgttcagctccag

SEQ ID NO: 3791676 - DNA, 20 bp, Homo sapiens
gctgcctttagtcgctgagg

SEQ ID NO: 3791677 - DNA, 15 bp, Homo sapiens
gctgcggtccaccca

SEQ ID NO: 3791678 - DNA, 22 bp, Homo sapiens
gctgcggtccacccaggagccc

SEQ ID NO: 3791679 - DNA, 23 bp, Homo sapiens
gctgctagcacttggagccaagg

SEQ ID NO: 3791680 - DNA, 12 bp, Homo sapiens
gctgctcccctc

SEQ ID NO: 3791681 - DNA, 20 bp, Homo sapiens
gctgctcccctccctcctct

SEQ ID NO: 3791682 - DNA, 13 bp, Homo sapiens
gctgctcctcatg

SEQ ID NO: 3791683 - DNA, 12 bp, Homo sapiens
gctgctcctcca

SEQ ID NO: 3791684 - DNA, 18 bp, Homo sapiens
gctgctcctccagggcca

SEQ ID NO: 3791685 - DNA, 23 bp, Homo sapiens
gctgctcctccagggccacgtgc

SEQ ID NO: 3791686 - DNA, 20 bp, Homo sapiens
gctgctccttagctgccaag

SEQ ID NO: 3791687 - DNA, 23 bp, Homo sapiens
gctgctccttagctgccaagccc

SEQ ID NO: 3791688 - DNA, 22 bp, Homo sapiens
gctgctcttatgccatttgttt

SEQ ID NO: 3791689 - DNA, 19 bp, Homo sapiens
gctgctgaactaatttctg

SEQ ID NO: 3791690 - DNA, 20 bp, Homo sapiens
gctgctgctaatcttcaggg

SEQ ID NO: 3791691 - DNA, 14 bp, Homo sapiens
gctgctgctgctgc

SEQ ID NO: 3791692 - DNA, 11 bp, Homo sapiens
gctgctggctt

SEQ ID NO: 3791693 - DNA, 20 bp, Homo sapiens
gctgcttccctctgcctgtc

SEQ ID NO: 3791694 - DNA, 22 bp, Homo sapiens
gctgcttccctctgcctgtccc

SEQ ID NO: 3791695 - DNA, 23 bp, Homo sapiens
gctgcttccctctgcctgtccct

SEQ ID NO: 3791696 - DNA, 23 bp, Homo sapiens
gctgcttggacctcgtgctttaa

SEQ ID NO: 3791697 - DNA, 22 bp, Homo sapiens
gctgcttttccttggggcaggc

SEQ ID NO: 3791698 - DNA, 22 bp, Homo sapiens
gctgcttttgtctatgggactc

SEQ ID NO: 3791699 - DNA, 16 bp, Homo sapiens
gctggaattttttatt

SEQ ID NO: 3791700 - DNA, 20 bp, Homo sapiens
gctggaccagtggtgccttg

SEQ ID NO: 3791701 - DNA, 15 bp, Homo sapiens
gctggaccttgaact

SEQ ID NO: 3791702 - DNA, 16 bp, Homo sapiens
gctggaccttgaactg

SEQ ID NO: 3791703 - DNA, 21 bp, Homo sapiens
gctggaccttgaactgggtac

SEQ ID NO: 3791704 - DNA, 22 bp, Homo sapiens
gctggaccttgaactgggtact

SEQ ID NO: 3791705 - DNA, 16 bp, Homo sapiens
gctggacggcattcct

SEQ ID NO: 3791706 - DNA, 17 bp, Homo sapiens
gctggactccagatctg

SEQ ID NO: 3791707 - DNA, 16 bp, Homo sapiens
gctggagcccagggag

SEQ ID NO: 3791708 - DNA, 13 bp, Homo sapiens
gctggaggcaggg

SEQ ID NO: 3791709 - DNA, 14 bp, Homo sapiens
gctggaggcagggc

SEQ ID NO: 3791710 - DNA, 15 bp, Homo sapiens
gctggaggcagggcc

SEQ ID NO: 3791711 - DNA, 12 bp, Homo sapiens
gctggagtgcag

SEQ ID NO: 3791712 - DNA, 15 bp, Homo sapiens
gctggagtgcagtga

SEQ ID NO: 3791713 - DNA, 17 bp, Homo sapiens
gctggagtgcagtgagc

SEQ ID NO: 3791714 - DNA, 22 bp, Homo sapiens
gctggagtgcagtgagccgaga

SEQ ID NO: 3791715 - DNA, 15 bp, Homo sapiens
gctggataaaatgag

SEQ ID NO: 3791716 - DNA, 17 bp, Homo sapiens
gctggcaccgccttctc

SEQ ID NO: 3791717 - DNA, 15 bp, Homo sapiens
gctggcagcagagtg

SEQ ID NO: 3791718 - DNA, 16 bp, Homo sapiens
gctggcatttgcacct

SEQ ID NO: 3791719 - DNA, 15 bp, Homo sapiens
ggacttggcgcgccc

SEQ ID NO: 3791720 - DNA, 17 bp, Homo sapiens
ggactttccaccccctc

SEQ ID NO: 3791721 - DNA, 20 bp, Homo sapiens
ggactttccaccccctccct

SEQ ID NO: 3791722 - DNA, 18 bp, Homo sapiens
ggacttttcgttaacatt

SEQ ID NO: 3791723 - DNA, 22 bp, Homo sapiens
ggacttttcgttaacattgacc

SEQ ID NO: 3791724 - DNA, 13 bp, Homo sapiens
ggagaaaacactt

SEQ ID NO: 3791725 - DNA, 14 bp, Homo sapiens
ggagaaacagagac

SEQ ID NO: 3791726 - DNA, 23 bp, Homo sapiens
ggagaaatgcatccattcctcag

SEQ ID NO: 3791727 - DNA, 13 bp, Homo sapiens
ggagaactagaga

SEQ ID NO: 3791728 - DNA, 15 bp, Homo sapiens
ggagaagcagtgagc

SEQ ID NO: 3791729 - DNA, 18 bp, Homo sapiens
ggagaagcatgaaaaagc

SEQ ID NO: 3791730 - DNA, 21 bp, Homo sapiens
ggagaagggatggaggtcaca

SEQ ID NO: 3791731 - DNA, 19 bp, Homo sapiens
ggagacaatgcagatgcca

SEQ ID NO: 3791732 - DNA, 14 bp, Homo sapiens
ggagacacctcaga

SEQ ID NO: 3791733 - DNA, 13 bp, Homo sapiens
ggagactcacctc

SEQ ID NO: 3791734 - DNA, 18 bp, Homo sapiens
ggagactcacctctgcct

SEQ ID NO: 3791735 - DNA, 18 bp, Homo sapiens
ggagactccatgagaagc

SEQ ID NO: 3791736 - DNA, 16 bp, Homo sapiens
ggagactgtctcaaga

SEQ ID NO: 3791737 - DNA, 20 bp, Homo sapiens
ggagagacggtgttgggagc

SEQ ID NO: 3791738 - DNA, 11 bp, Homo sapiens
ggagagcccag

SEQ ID NO: 3791739 - DNA, 22 bp, Homo sapiens
ggagagcgcctgcccctcccag

SEQ ID NO: 3791740 - DNA, 15 bp, Homo sapiens
ggagagctggtgccc

SEQ ID NO: 3791741 - DNA, 14 bp, Homo sapiens
ggagagggatgagg

SEQ ID NO: 3791742 - DNA, 14 bp, Homo sapiens
ggagaggggcagaa

SEQ ID NO: 3791743 - DNA, 14 bp, Homo sapiens
ggagagggtctgga

SEQ ID NO: 3791744 - DNA, 17 bp, Homo sapiens
ggagagggtctggagaa

SEQ ID NO: 3791745 - DNA, 21 bp, Homo sapiens
ggagaggttataggtcactcc

SEQ ID NO: 3791746 - DNA, 23 bp, Homo sapiens
ggagaggttataggtcactcctg

SEQ ID NO: 3791747 - DNA, 17 bp, Homo sapiens
ggagagtcttgcagtga

SEQ ID NO: 3791748 - DNA, 23 bp, Homo sapiens
ggagatatttatggggggagaac

SEQ ID NO: 3791749 - DNA, 17 bp, Homo sapiens
ggagatcggggccagag

SEQ ID NO: 3791750 - DNA, 19 bp, Homo sapiens
ggagatgaagcaaacacat

SEQ ID NO: 3791751 - DNA, 18 bp, Homo sapiens
ggagatgggccttttgga

SEQ ID NO: 3791752 - DNA, 16 bp, Homo sapiens
ggagatggggagaaac

SEQ ID NO: 3791753 - DNA, 17 bp, Homo sapiens
ggagatggggagaaacc

SEQ ID NO: 3791754 - DNA, 16 bp, Homo sapiens
ggagcagagaaggcca

SEQ ID NO: 3791755 - DNA, 18 bp, Homo sapiens
ggagcagggacagatcat

SEQ ID NO: 3791756 - DNA, 16 bp, Homo sapiens
ggagcatctcttgagg

SEQ ID NO: 3791757 - DNA, 16 bp, Homo sapiens
ggagccaatggagact

SEQ ID NO: 3791758 - DNA, 15 bp, Homo sapiens
ggagccactctgttc

SEQ ID NO: 3791759 - DNA, 13 bp, Homo sapiens
ggagccagggctg

SEQ ID NO: 3791760 - DNA, 14 bp, Homo sapiens
ggagccccagtgcc

SEQ ID NO: 3791761 - DNA, 22 bp, Homo sapiens
ggagccccgaggccttctctga

SEQ ID NO: 3791762 - DNA, 16 bp, Homo sapiens
ggagcccgcaccccca

SEQ ID NO: 3791763 - DNA, 20 bp, Homo sapiens
ggagcccgcacccccaccct

SEQ ID NO: 3791764 - DNA, 21 bp, Homo sapiens
ggagcccgcacccccaccctt

SEQ ID NO: 3791765 - DNA, 19 bp, Homo sapiens
ggagcctcatccgaggcag

SEQ ID NO: 3791766 - DNA, 20 bp, Homo sapiens
ggagcctcatccgaggcagg

SEQ ID NO: 3791767 - DNA, 19 bp, Homo sapiens
ggagcgcacctgccccctg

SEQ ID NO: 3791768 - DNA, 14 bp, Homo sapiens
ggagcggaaagcag

SEQ ID NO: 3791769 - DNA, 15 bp, Homo sapiens
ggagcggaaagcagc

SEQ ID NO: 3791770 - DNA, 18 bp, Homo sapiens
ggagctaacactggcccc

SEQ ID NO: 3791771 - DNA, 15 bp, Homo sapiens
ggagctatcaggaac

SEQ ID NO: 3791772 - DNA, 22 bp, Homo sapiens
ggagctatcaggaacagctatg

SEQ ID NO: 3791773 - DNA, 20 bp, Homo sapiens
ggagctcttcaggcctccct

SEQ ID NO: 3791774 - DNA, 22 bp, Homo sapiens
ggagctgcctgttcagctccag

SEQ ID NO: 3791775 - DNA, 18 bp, Homo sapiens
ggagctggttagaaatgc

SEQ ID NO: 3791776 - DNA, 23 bp, Homo sapiens
ggagctggttagaaatgcagaat

SEQ ID NO: 3791777 - DNA, 15 bp, Homo sapiens
ggagcttacctccca

SEQ ID NO: 3791778 - DNA, 22 bp, Homo sapiens
ggaggaaaaccaagccgtggct

SEQ ID NO: 3791779 - DNA, 23 bp, Homo sapiens
ggaggaaatttgaatgggtccat

SEQ ID NO: 3791780 - DNA, 18 bp, Homo sapiens
ggaggaacactgcactct

SEQ ID NO: 3791781 - DNA, 19 bp, Homo sapiens
ggaggaagcaggttgaggg

SEQ ID NO: 3791782 - DNA, 21 bp, Homo sapiens
ggaggaaggcttacacccaca

SEQ ID NO: 3791783 - DNA, 17 bp, Homo sapiens
ggaggaatgctccccca

SEQ ID NO: 3791784 - DNA, 15 bp, Homo sapiens
ggaggaatttctgag

SEQ ID NO: 3791785 - DNA, 17 bp, Homo sapiens
ggaggaccaaaaaaata

SEQ ID NO: 3791786 - DNA, 15 bp, Homo sapiens
ggaggacctctgggc

SEQ ID NO: 3791787 - DNA, 11 bp, Homo sapiens
ggaggagagcc

SEQ ID NO: 3791788 - DNA, 15 bp, Homo sapiens
ggaggagagcctggt

SEQ ID NO: 3791789 - DNA, 14 bp, Homo sapiens
ggaggaggaggcaa

SEQ ID NO: 3791790 - DNA, 21 bp, Homo sapiens
ggaggatcactggagcccagg

SEQ ID NO: 3791791 - DNA, 22 bp, Homo sapiens
ggaggatcactggagcccagga

SEQ ID NO: 3791792 - DNA, 21 bp, Homo sapiens
ggaggatggagagaggggaat

SEQ ID NO: 3791793 - DNA, 21 bp, Homo sapiens
ggaggatgttctgggacacag

SEQ ID NO: 3791794 - DNA, 17 bp, Homo sapiens
ggaggattctatgaggc

SEQ ID NO: 3791795 - DNA, 17 bp, Homo sapiens
ggaggcacacagctgca

SEQ ID NO: 3791796 - DNA, 18 bp, Homo sapiens
ggaggcagggccttgccc

SEQ ID NO: 3791797 - DNA, 19 bp, Homo sapiens
ggaggcagggccttgccca

SEQ ID NO: 3791798 - DNA, 21 bp, Homo sapiens
ggaggcagggccttgcccaga

SEQ ID NO: 3791799 - DNA, 14 bp, Homo sapiens
ggaggcatctgcac

SEQ ID NO: 3791800 - DNA, 18 bp, Homo sapiens
ggaggccaaggtgggagg

SEQ ID NO: 3791801 - DNA, 16 bp, Homo sapiens
ggaggccagccagtga

SEQ ID NO: 3791802 - DNA, 17 bp, Homo sapiens
ggaggcccgtccggcag

SEQ ID NO: 3791803 - DNA, 18 bp, Homo sapiens
ggaggccgggtgctcagg

SEQ ID NO: 3791804 - DNA, 13 bp, Homo sapiens
ggaggcctctggg

SEQ ID NO: 3791805 - DNA, 12 bp, Homo sapiens
ggaggctgaggc

SEQ ID NO: 3791806 - DNA, 14 bp, Homo sapiens
ggaggctgaggcag

SEQ ID NO: 3791807 - DNA, 17 bp, Homo sapiens
ggaggctgaggcaggag

SEQ ID NO: 3791808 - DNA, 19 bp, Homo sapiens
ggaggctgaggtgggcaga

SEQ ID NO: 3791809 - DNA, 12 bp, Homo sapiens
ggaggctggagg

SEQ ID NO: 3791810 - DNA, 13 bp, Homo sapiens
ggaggctggcagg

SEQ ID NO: 3791811 - DNA, 16 bp, Homo sapiens
ggaggcttgtcagagc

SEQ ID NO: 3791812 - DNA, 15 bp, Homo sapiens
ggagggaattgaggt

SEQ ID NO: 3791813 - DNA, 19 bp, Homo sapiens
ggagggaattgaggtctgc

SEQ ID NO: 3791814 - DNA, 20 bp, Homo sapiens
ggagggatagaggggggctg

SEQ ID NO: 3791815 - DNA, 21 bp, Homo sapiens
ggagggatgctgcctgagtca

SEQ ID NO: 3791816 - DNA, 16 bp, Homo sapiens
ggagggccctacctga

SEQ ID NO: 3791817 - DNA, 17 bp, Homo sapiens
ggagggcgtgactcacc

SEQ ID NO: 3791818 - DNA, 20 bp, Homo sapiens
ggaggggactatttatgaag

SEQ ID NO: 3791819 - DNA, 21 bp, Homo sapiens
ggaggggcctggcagccgtgc

SEQ ID NO: 3791820 - DNA, 17 bp, Homo sapiens
ggaggggcggcaggagg

SEQ ID NO: 3791821 - DNA, 15 bp, Homo sapiens
ggagggggagggggt

SEQ ID NO: 3791822 - DNA, 17 bp, Homo sapiens
ggaggggtggtcctgac

SEQ ID NO: 3791823 - DNA, 15 bp, Homo sapiens
ggagggtcaggaagg

SEQ ID NO: 3791824 - DNA, 19 bp, Homo sapiens
ggagggtgggagagcccag

SEQ ID NO: 3791825 - DNA, 22 bp, Homo sapiens
ggaggtcgaccccaaagcccct

SEQ ID NO: 3791826 - DNA, 14 bp, Homo sapiens
ggaggtcgaggcag

SEQ ID NO: 3791827 - DNA, 20 bp, Homo sapiens
ggaggtggaggctgcagtga

SEQ ID NO: 3791828 - DNA, 19 bp, Homo sapiens
ggaggtggaggttgcagtg

SEQ ID NO: 3791829 - DNA, 15 bp, Homo sapiens
ggaggtggcagccct

SEQ ID NO: 3791830 - DNA, 17 bp, Homo sapiens
ggaggttaaggctgagg

SEQ ID NO: 3791831 - DNA, 17 bp, Homo sapiens
ggaggttgcagggagcc

SEQ ID NO: 3791832 - DNA, 22 bp, Homo sapiens
ggctgcagtgacgtgcacctgt

SEQ ID NO: 3791833 - DNA, 13 bp, Homo sapiens
ggctgccaccaag

SEQ ID NO: 3791834 - DNA, 17 bp, Homo sapiens
ggctgcccacacacccc

SEQ ID NO: 3791835 - DNA, 18 bp, Homo sapiens
ggctgcccactatggtca

SEQ ID NO: 3791836 - DNA, 22 bp, Homo sapiens
ggctgccctggaggaaccgaaa

SEQ ID NO: 3791837 - DNA, 15 bp, Homo sapiens
ggctgcctggagccc

SEQ ID NO: 3791838 - DNA, 16 bp, Homo sapiens
ggctgcctggccccca

SEQ ID NO: 3791839 - DNA, 16 bp, Homo sapiens
ggctgccttagaacct

SEQ ID NO: 3791840 - DNA, 22 bp, Homo sapiens
ggctgcggaatgaaccacatct

SEQ ID NO: 3791841 - DNA, 15 bp, Homo sapiens
ggctgctcctccagg

SEQ ID NO: 3791842 - DNA, 23 bp, Homo sapiens
ggctgctcctccagggccacgtg

SEQ ID NO: 3791843 - DNA, 13 bp, Homo sapiens
ggctgctggagga

SEQ ID NO: 3791844 - DNA, 15 bp, Homo sapiens
ggctgctggaggaaa

SEQ ID NO: 3791845 - DNA, 23 bp, Homo sapiens
ggctggagcccagggagcggaaa

SEQ ID NO: 3791846 - DNA, 13 bp, Homo sapiens
ggctggagctggc

SEQ ID NO: 3791847 - DNA, 17 bp, Homo sapiens
ggctggaggcagggcct

SEQ ID NO: 3791848 - DNA, 23 bp, Homo sapiens
ggctggaggcagggccttgccca

SEQ ID NO: 3791849 - DNA, 18 bp, Homo sapiens
ggctggatgtggtggcat

SEQ ID NO: 3791850 - DNA, 20 bp, Homo sapiens
ggctggcgtgcagtggtgcg

SEQ ID NO: 3791851 - DNA, 14 bp, Homo sapiens
ggctggctgcagtg

SEQ ID NO: 3791852 - DNA, 13 bp, Homo sapiens
ggctgggcccaga

SEQ ID NO: 3791853 - DNA, 14 bp, Homo sapiens
ggctgggcccagaa

SEQ ID NO: 3791854 - DNA, 12 bp, Homo sapiens
ggctgggcttca

SEQ ID NO: 3791855 - DNA, 18 bp, Homo sapiens
ggctgggcttcagtggca

SEQ ID NO: 3791856 - DNA, 21 bp, Homo sapiens
ggctgggcttcagtggcagct

SEQ ID NO: 3791857 - DNA, 16 bp, Homo sapiens
ggctgggggcaggagg

SEQ ID NO: 3791858 - DNA, 14 bp, Homo sapiens
ggctgggttggagg

SEQ ID NO: 3791859 - DNA, 15 bp, Homo sapiens
ggctggtgggcacca

SEQ ID NO: 3791860 - DNA, 15 bp, Homo sapiens
ggctgtagaaggaga

SEQ ID NO: 3791861 - DNA, 22 bp, Homo sapiens
ggctgtatcccatgagcctcag

SEQ ID NO: 3791862 - DNA, 15 bp, Homo sapiens
ggctgtcagcaggaa

SEQ ID NO: 3791863 - DNA, 13 bp, Homo sapiens
ggctgtcctttcc

SEQ ID NO: 3791864 - DNA, 19 bp, Homo sapiens
ggctgtcttctcaggctct

SEQ ID NO: 3791865 - DNA, 23 bp, Homo sapiens
ggctgtcttctcaggctctgccc

SEQ ID NO: 3791866 - DNA, 16 bp, Homo sapiens
ggctgtgcctctgcct

SEQ ID NO: 3791867 - DNA, 21 bp, Homo sapiens
ggctgtgggcctcaaggactt

SEQ ID NO: 3791868 - DNA, 15 bp, Homo sapiens
ggctgtgggctccct

SEQ ID NO: 3791869 - DNA, 16 bp, Homo sapiens
ggctgttggctggggg

SEQ ID NO: 3791870 - DNA, 22 bp, Homo sapiens
ggctgtttttgggtgcaagagg

SEQ ID NO: 3791871 - DNA, 20 bp, Homo sapiens
ggcttcagcatatttatagc

SEQ ID NO: 3791872 - DNA, 18 bp, Homo sapiens
ggcttcaggggagtcccg

SEQ ID NO: 3791873 - DNA, 16 bp, Homo sapiens
ggcttcagtggcagct

SEQ ID NO: 3791874 - DNA, 21 bp, Homo sapiens
ggcttcctcagttcctgccct

SEQ ID NO: 3791875 - DNA, 16 bp, Homo sapiens
ggcttcctcatagtat

SEQ ID NO: 3791876 - DNA, 11 bp, Homo sapiens
ggcttctgatg

SEQ ID NO: 3791877 - DNA, 19 bp, Homo sapiens
ggcttctgatgaatcttgc

SEQ ID NO: 3791878 - DNA, 18 bp, Homo sapiens
ggcttctggagcccttgg

SEQ ID NO: 3791879 - DNA, 14 bp, Homo sapiens
ggcttgcctgcagg

SEQ ID NO: 3791880 - DNA, 15 bp, Homo sapiens
ggcttgtaactccac

SEQ ID NO: 3791881 - DNA, 15 bp, Homo sapiens
ggcttgtcagagctg

SEQ ID NO: 3791882 - DNA, 17 bp, Homo sapiens
ggcttgtcagagctggg

SEQ ID NO: 3791883 - DNA, 18 bp, Homo sapiens
ggctttgattccatctcc

SEQ ID NO: 3791884 - DNA, 24 bp, Homo sapiens
ggctttgattccatctccttgtct

SEQ ID NO: 3791885 - DNA, 15 bp, Homo sapiens
ggctttgtcccacag

SEQ ID NO: 3791886 - DNA, 19 bp, Homo sapiens
gggaacaagggtggcatcc

SEQ ID NO: 3791887 - DNA, 19 bp, Homo sapiens
gggaacagacaacagaagt

SEQ ID NO: 3791888 - DNA, 14 bp, Homo sapiens
gggaacagacagga

SEQ ID NO: 3791889 - DNA, 15 bp, Homo sapiens
gggaacagacaggag

SEQ ID NO: 3791890 - DNA, 16 bp, Homo sapiens
gggaacagacaggaga

SEQ ID NO: 3791891 - DNA, 18 bp, Homo sapiens
gggaacatatttaaggaa

SEQ ID NO: 3791892 - DNA, 14 bp, Homo sapiens
gggaacgtgactgc

SEQ ID NO: 3791893 - DNA, 18 bp, Homo sapiens
gggaacgtgactgcccca

SEQ ID NO: 3791894 - DNA, 19 bp, Homo sapiens
gggaagaaaagagctttct

SEQ ID NO: 3791895 - DNA, 19 bp, Homo sapiens
gggaagagaaatacaagat

SEQ ID NO: 3791896 - DNA, 13 bp, Homo sapiens
gggaagcccagct

SEQ ID NO: 3791897 - DNA, 20 bp, Homo sapiens
gggaaggagggttagggagg

SEQ ID NO: 3791898 - DNA, 21 bp, Homo sapiens
gggaagtgacaaggccccaga

SEQ ID NO: 3791899 - DNA, 21 bp, Homo sapiens
gggaatgtattattctgcagc

SEQ ID NO: 3791900 - DNA, 17 bp, Homo sapiens
gggaattaaataaataa

SEQ ID NO: 3791901 - DNA, 18 bp, Homo sapiens
gggacaaatttaaaacaa

SEQ ID NO: 3791902 - DNA, 22 bp, Homo sapiens
gggacaaatttaaaacaaacaa

SEQ ID NO: 3791903 - DNA, 17 bp, Homo sapiens
gggacagatcatagatt

SEQ ID NO: 3791904 - DNA, 13 bp, Homo sapiens
gggaccaaggacc

SEQ ID NO: 3791905 - DNA, 17 bp, Homo sapiens
gggaccaaggacccctc

SEQ ID NO: 3791906 - DNA, 17 bp, Homo sapiens
gggactcaatgcactga

SEQ ID NO: 3791907 - DNA, 19 bp, Homo sapiens
gggactcaatgcactgaca

SEQ ID NO: 3791908 - DNA, 23 bp, Homo sapiens
gggactcaatgcactgacattgt

SEQ ID NO: 3791909 - DNA, 21 bp, Homo sapiens
gggactcactggcagccccag

SEQ ID NO: 3791910 - DNA, 17 bp, Homo sapiens
gggactcagccctgagg

SEQ ID NO: 3791911 - DNA, 23 bp, Homo sapiens
gggactgccagtccccctgcccc

SEQ ID NO: 3791912 - DNA, 14 bp, Homo sapiens
gggactgggagggc

SEQ ID NO: 3791913 - DNA, 15 bp, Homo sapiens
gggagaacctcaggc

SEQ ID NO: 3791914 - DNA, 15 bp, Homo sapiens
gggagacacctcaga

SEQ ID NO: 3791915 - DNA, 21 bp, Homo sapiens
gggagacacctcagagccccg

SEQ ID NO: 3791916 - DNA, 20 bp, Homo sapiens
gggagatcggggccagaggc

SEQ ID NO: 3791917 - DNA, 14 bp, Homo sapiens
gggagcaagacaga

SEQ ID NO: 3791918 - DNA, 13 bp, Homo sapiens
gggagccccaggg

SEQ ID NO: 3791919 - DNA, 16 bp, Homo sapiens
gggagcccccgccccg

SEQ ID NO: 3791920 - DNA, 14 bp, Homo sapiens
gggagctctgtctg

SEQ ID NO: 3791921 - DNA, 22 bp, Homo sapiens
gggagctgcctgttcagctcca

SEQ ID NO: 3791922 - DNA, 19 bp, Homo sapiens
gggagctggttagaaatgc

SEQ ID NO: 3791923 - DNA, 14 bp, Homo sapiens
gggaggagaatgag

SEQ ID NO: 3791924 - DNA, 23 bp, Homo sapiens
gggaggatcactggagcccagga

SEQ ID NO: 3791925 - DNA, 23 bp, Homo sapiens
gggaggatctcttgagcctggga

SEQ ID NO: 3791926 - DNA, 19 bp, Homo sapiens
gggaggccaaggtgggagg

SEQ ID NO: 3791927 - DNA, 18 bp, Homo sapiens
gggaggccccactgggga

SEQ ID NO: 3791928 - DNA, 10 bp, Homo sapiens
gggaggctga

SEQ ID NO: 3791929 - DNA, 22 bp, Homo sapiens
gggaggggtaaaattccttagc

SEQ ID NO: 3791930 - DNA, 14 bp, Homo sapiens
gggaggtggctggg

SEQ ID NO: 3791931 - DNA, 13 bp, Homo sapiens
gggagtacctgct

SEQ ID NO: 3791932 - DNA, 23 bp, Homo sapiens
gggagtacctgctgccccagctg

SEQ ID NO: 3791933 - DNA, 21 bp, Homo sapiens
gggagtcatctcaaccatccc

SEQ ID NO: 3791934 - DNA, 15 bp, Homo sapiens
gggagtcccgtcagg

SEQ ID NO: 3791935 - DNA, 17 bp, Homo sapiens
gggagtgacagaggcag

SEQ ID NO: 3791936 - DNA, 19 bp, Homo sapiens
gggagtgaggcaggtgaca

SEQ ID NO: 3791937 - DNA, 20 bp, Homo sapiens
gggagtgggacagagtctgg

SEQ ID NO: 3791938 - DNA, 19 bp, Homo sapiens
gggatagtcaccttttaaa

SEQ ID NO: 3791939 - DNA, 21 bp, Homo sapiens
gggatatgatttaaatcagcc

SEQ ID NO: 3791940 - DNA, 19 bp, Homo sapiens
gggatgactaaaatattta

SEQ ID NO: 3791941 - DNA, 18 bp, Homo sapiens
gggatggaggagaagaat

SEQ ID NO: 3791942 - DNA, 12 bp, Homo sapiens
gggatgggaggt

SEQ ID NO: 3791943 - DNA, 13 bp, Homo sapiens
gggatgttctggc

SEQ ID NO: 3791944 - DNA, 18 bp, Homo sapiens
gggcaaacacctgctgat

SEQ ID NO: 3791945 - DNA, 15 bp, Homo sapiens
ggggtgggagaggtc

SEQ ID NO: 3791946 - DNA, 16 bp, Homo sapiens
ggggttattttctggt

SEQ ID NO: 3791947 - DNA, 17 bp, Homo sapiens
ggggttcagcccctcct

SEQ ID NO: 3791948 - DNA, 22 bp, Homo sapiens
ggggttcagcccctcctctgcc

SEQ ID NO: 3791949 - DNA, 20 bp, Homo sapiens
ggggttctttcttcctctgc

SEQ ID NO: 3791950 - DNA, 23 bp, Homo sapiens
gggtacttgtggacacagctctt

SEQ ID NO: 3791951 - DNA, 20 bp, Homo sapiens
gggtatccaagttggactgg

SEQ ID NO: 3791952 - DNA, 14 bp, Homo sapiens
gggtcaggagaggg

SEQ ID NO: 3791953 - DNA, 18 bp, Homo sapiens
gggtccttccctctcccc

SEQ ID NO: 3791954 - DNA, 20 bp, Homo sapiens
gggtcgtcaccacctctcct

SEQ ID NO: 3791955 - DNA, 14 bp, Homo sapiens
gggtctcactctgt

SEQ ID NO: 3791956 - DNA, 18 bp, Homo sapiens
gggtctccctctcctgcc

SEQ ID NO: 3791957 - DNA, 20 bp, Homo sapiens
gggtctccctctcctgccta

SEQ ID NO: 3791958 - DNA, 20 bp, Homo sapiens
gggtcttcagggggccaggt

SEQ ID NO: 3791959 - DNA, 23 bp, Homo sapiens
gggtcttccctacctcaggcagg

SEQ ID NO: 3791960 - DNA, 13 bp, Homo sapiens
gggtgaaagaaat

SEQ ID NO: 3791961 - DNA, 15 bp, Homo sapiens
gggtgaggaccactc

SEQ ID NO: 3791962 - DNA, 13 bp, Homo sapiens
gggtgcccacagc

SEQ ID NO: 3791963 - DNA, 15 bp, Homo sapiens
gggtggcaccagcag

SEQ ID NO: 3791964 - DNA, 16 bp, Homo sapiens
gggtgtgggaggcccg

SEQ ID NO: 3791965 - DNA, 12 bp, Homo sapiens
gggttacaaact

SEQ ID NO: 3791966 - DNA, 16 bp, Homo sapiens
gggttcaaaatgtctg

SEQ ID NO: 3791967 - DNA, 22 bp, Homo sapiens
gggttcagcccctcctctgcca

SEQ ID NO: 3791968 - DNA, 18 bp, Homo sapiens
gggttccctttccttcca

SEQ ID NO: 3791969 - DNA, 18 bp, Homo sapiens
gggttctcctctcccctc

SEQ ID NO: 3791970 - DNA, 14 bp, Homo sapiens
gggttctttcttcc

SEQ ID NO: 3791971 - DNA, 16 bp, Homo sapiens
gggttctttcttcctc

SEQ ID NO: 3791972 - DNA, 19 bp, Homo sapiens
gggttgcagtggagaggga

SEQ ID NO: 3791973 - DNA, 19 bp, Homo sapiens
gggttggcccctgcccggc

SEQ ID NO: 3791974 - DNA, 14 bp, Homo sapiens
gggttgggcccaga

SEQ ID NO: 3791975 - DNA, 19 bp, Homo sapiens
gggtttctgccctgcccac

SEQ ID NO: 3791976 - DNA, 13 bp, Homo sapiens
ggtaaaacacttg

SEQ ID NO: 3791977 - DNA, 14 bp, Homo sapiens
ggtaaaattctaaa

SEQ ID NO: 3791978 - DNA, 13 bp, Homo sapiens
ggtaacaggcaga

SEQ ID NO: 3791979 - DNA, 14 bp, Homo sapiens
ggtaacaggcagat

SEQ ID NO: 3791980 - DNA, 22 bp, Homo sapiens
ggtaattgttgctaatcttctt

SEQ ID NO: 3791981 - DNA, 18 bp, Homo sapiens
ggtacagagaaggaatgt

SEQ ID NO: 3791982 - DNA, 12 bp, Homo sapiens
ggtaccttgaac

SEQ ID NO: 3791983 - DNA, 17 bp, Homo sapiens
ggtacttgtggacacag

SEQ ID NO: 3791984 - DNA, 20 bp, Homo sapiens
ggtagaaagagatacagagg

SEQ ID NO: 3791985 - DNA, 22 bp, Homo sapiens
ggtagaaatatctgaaaatgta

SEQ ID NO: 3791986 - DNA, 11 bp, Homo sapiens
ggtagaaatgc

SEQ ID NO: 3791987 - DNA, 17 bp, Homo sapiens
ggtagagatggaggagg

SEQ ID NO: 3791988 - DNA, 18 bp, Homo sapiens
ggtagatcacgagatcaa

SEQ ID NO: 3791989 - DNA, 20 bp, Homo sapiens
ggtagccctggccagaggct

SEQ ID NO: 3791990 - DNA, 17 bp, Homo sapiens
ggtagctagaggaacca

SEQ ID NO: 3791991 - DNA, 15 bp, Homo sapiens
ggtagctgcccctgg

SEQ ID NO: 3791992 - DNA, 13 bp, Homo sapiens
ggtaggggttggg

SEQ ID NO: 3791993 - DNA, 13 bp, Homo sapiens
ggtatattcattt

SEQ ID NO: 3791994 - DNA, 18 bp, Homo sapiens
ggtatcaaacagctcagg

SEQ ID NO: 3791995 - DNA, 19 bp, Homo sapiens
ggtatcaggtgctgccatc

SEQ ID NO: 3791996 - DNA, 15 bp, Homo sapiens
ggtatcctgcccagt

SEQ ID NO: 3791997 - DNA, 17 bp, Homo sapiens
ggtatcctgcccagtgt

SEQ ID NO: 3791998 - DNA, 18 bp, Homo sapiens
ggtatcctgcccagtgtt

SEQ ID NO: 3791999 - DNA, 15 bp, Homo sapiens
ggtatggaactctct

SEQ ID NO: 3792000 - DNA, 21 bp, Homo sapiens
ggtatttatctattgtaagat

SEQ ID NO: 3792001 - DNA, 19 bp, Homo sapiens
ggtcaacatggtgaaaccc

SEQ ID NO: 3792002 - DNA, 13 bp, Homo sapiens
ggtcaagcccagg

SEQ ID NO: 3792003 - DNA, 17 bp, Homo sapiens
ggtcaagcccaggagga

SEQ ID NO: 3792004 - DNA, 20 bp, Homo sapiens
ggtcaatacagtacaggcag

SEQ ID NO: 3792005 - DNA, 17 bp, Homo sapiens
ggtcaatcctgtgggtg

SEQ ID NO: 3792006 - DNA, 16 bp, Homo sapiens
ggtcacaggactctgc

SEQ ID NO: 3792007 - DNA, 15 bp, Homo sapiens
ggtcactgccatgga

SEQ ID NO: 3792008 - DNA, 12 bp, Homo sapiens
ggtcagagcctg

SEQ ID NO: 3792009 - DNA, 14 bp, Homo sapiens
ggtcagagggccca

SEQ ID NO: 3792010 - DNA, 22 bp, Homo sapiens
ggtcaggaaggatgagcattta

SEQ ID NO: 3792011 - DNA, 21 bp, Homo sapiens
ggtcaggagttcctaaccagc

SEQ ID NO: 3792012 - DNA, 20 bp, Homo sapiens
ggtcagtacccacctgagct

SEQ ID NO: 3792013 - DNA, 19 bp, Homo sapiens
ggtcagtgaggcccaggga

SEQ ID NO: 3792014 - DNA, 18 bp, Homo sapiens
ggtccagcttgctcttca

SEQ ID NO: 3792015 - DNA, 23 bp, Homo sapiens
ggtcccaaggcaaggggtgcctg

SEQ ID NO: 3792016 - DNA, 22 bp, Homo sapiens
ggtcccactcagtccatagcag

SEQ ID NO: 3792017 - DNA, 17 bp, Homo sapiens
ggtccggtgtccttttc

SEQ ID NO: 3792018 - DNA, 21 bp, Homo sapiens
ggtcctcagagaatttctacc

SEQ ID NO: 3792019 - DNA, 14 bp, Homo sapiens
ggtcctggctcctg

SEQ ID NO: 3792020 - DNA, 12 bp, Homo sapiens
ggtcctggggcc

SEQ ID NO: 3792021 - DNA, 12 bp, Homo sapiens
ggtcctggggct

SEQ ID NO: 3792022 - DNA, 10 bp, Homo sapiens
ggtccttcaa

SEQ ID NO: 3792023 - DNA, 13 bp, Homo sapiens
ggtcgaggcagga

SEQ ID NO: 3792024 - DNA, 22 bp, Homo sapiens
ggtcgcttactttgagtgatcc

SEQ ID NO: 3792025 - DNA, 14 bp, Homo sapiens
ggtcgggctcagct

SEQ ID NO: 3792026 - DNA, 19 bp, Homo sapiens
ggtctcacagtgttgccca

SEQ ID NO: 3792027 - DNA, 20 bp, Homo sapiens
ggtctcacagtgttgcccag

SEQ ID NO: 3792028 - DNA, 12 bp, Homo sapiens
ggtctcactctg

SEQ ID NO: 3792029 - DNA, 17 bp, Homo sapiens
ggtctccctctcctgcc

SEQ ID NO: 3792030 - DNA, 12 bp, Homo sapiens
ggtctctctttg

SEQ ID NO: 3792031 - DNA, 12 bp, Homo sapiens
ggtctgaatgtt

SEQ ID NO: 3792032 - DNA, 17 bp, Homo sapiens
ggtctgaatgttctgac

SEQ ID NO: 3792033 - DNA, 22 bp, Homo sapiens
ggtctgaatgttctgacattaa

SEQ ID NO: 3792034 - DNA, 14 bp, Homo sapiens
ggtctgacccactg

SEQ ID NO: 3792035 - DNA, 15 bp, Homo sapiens
ggtctgacccactgc

SEQ ID NO: 3792036 - DNA, 16 bp, Homo sapiens
ggtctgacccactgct

SEQ ID NO: 3792037 - DNA, 19 bp, Homo sapiens
ggtctgaggaatccagacc

SEQ ID NO: 3792038 - DNA, 15 bp, Homo sapiens
ggtctgtcccaccag

SEQ ID NO: 3792039 - DNA, 18 bp, Homo sapiens
ggtctgtgtctcttttct

SEQ ID NO: 3792040 - DNA, 19 bp, Homo sapiens
ggtcttcagggggccaggt

SEQ ID NO: 3792041 - DNA, 17 bp, Homo sapiens
ggtcttccctacctcag

SEQ ID NO: 3792042 - DNA, 21 bp, Homo sapiens
ggtcttgaactcctggcctca

SEQ ID NO: 3792043 - DNA, 13 bp, Homo sapiens
ggtcttgtaagag

SEQ ID NO: 3792044 - DNA, 16 bp, Homo sapiens
ggtgaaagaaatcatg

SEQ ID NO: 3792045 - DNA, 17 bp, Homo sapiens
ggtgaaagaaatcatgt

SEQ ID NO: 3792046 - DNA, 19 bp, Homo sapiens
ggtgaagatgggaacgcag

SEQ ID NO: 3792047 - DNA, 16 bp, Homo sapiens
ggtgaagggagagcca

SEQ ID NO: 3792048 - DNA, 18 bp, Homo sapiens
ggtgaagggagagccagc

SEQ ID NO: 3792049 - DNA, 13 bp, Homo sapiens
ggtgacaccagcc

SEQ ID NO: 3792050 - DNA, 16 bp, Homo sapiens
ggtgacctctgcctga

SEQ ID NO: 3792051 - DNA, 18 bp, Homo sapiens
ggtgagcagactggtggg

SEQ ID NO: 3792052 - DNA, 12 bp, Homo sapiens
ggtgagccagtg

SEQ ID NO: 3792053 - DNA, 13 bp, Homo sapiens
ggtgaggagcaca

SEQ ID NO: 3792054 - DNA, 18 bp, Homo sapiens
ggtgatccacccacctca

SEQ ID NO: 3792055 - DNA, 16 bp, Homo sapiens
ggtgcaacccttaccc

SEQ ID NO: 3792056 - DNA, 15 bp, Homo sapiens
ggtgcaagagggagc

SEQ ID NO: 3792057 - DNA, 20 bp, Homo sapiens
ggtgcacagacgtccctcca

SEQ ID NO: 3792058 - DNA, 22 bp, Homo sapiens
ggtgcatacacccccacctcct

SEQ ID NO: 3792059 - DNA, 22 bp, Homo sapiens
gtcatttgctgagcatgtactg

SEQ ID NO: 3792060 - DNA, 18 bp, Homo sapiens
gtcattttgcttcatagc

SEQ ID NO: 3792061 - DNA, 14 bp, Homo sapiens
gtccaaaggaggct

SEQ ID NO: 3792062 - DNA, 22 bp, Homo sapiens
gtccaaatgtcctccagaagcc

SEQ ID NO: 3792063 - DNA, 18 bp, Homo sapiens
gtccaacgtggggcagca

SEQ ID NO: 3792064 - DNA, 17 bp, Homo sapiens
gtccaagtgtgtgtgcg

SEQ ID NO: 3792065 - DNA, 15 bp, Homo sapiens
gtccacccaggagcc

SEQ ID NO: 3792066 - DNA, 16 bp, Homo sapiens
gtccacccaggagccc

SEQ ID NO: 3792067 - DNA, 22 bp, Homo sapiens
gtccacctgagctgccatccag

SEQ ID NO: 3792068 - DNA, 21 bp, Homo sapiens
gtccacctggccccatgtctc

SEQ ID NO: 3792069 - DNA, 22 bp, Homo sapiens
gtccagccgccattgccaccag

SEQ ID NO: 3792070 - DNA, 17 bp, Homo sapiens
gtccagcttgctcttca

SEQ ID NO: 3792071 - DNA, 15 bp, Homo sapiens
gtccagggaagctgg

SEQ ID NO: 3792072 - DNA, 19 bp, Homo sapiens
gtccaggtcgggctcagct

SEQ ID NO: 3792073 - DNA, 22 bp, Homo sapiens
gtccaggtcgggctcagctctg

SEQ ID NO: 3792074 - DNA, 13 bp, Homo sapiens
gtccatgtgtgtg

SEQ ID NO: 3792075 - DNA, 14 bp, Homo sapiens
gtccatgtgtgtgc

SEQ ID NO: 3792076 - DNA, 16 bp, Homo sapiens
gtcccaaggaaagccc

SEQ ID NO: 3792077 - DNA, 23 bp, Homo sapiens
gtcccaaggaaagccccagcact

SEQ ID NO: 3792078 - DNA, 23 bp, Homo sapiens
gtcccaccggttgcttctgggaa

SEQ ID NO: 3792079 - DNA, 15 bp, Homo sapiens
gtcccaccttggctg

SEQ ID NO: 3792080 - DNA, 18 bp, Homo sapiens
gtcccaccttggctgcag

SEQ ID NO: 3792081 - DNA, 19 bp, Homo sapiens
gtcccaccttggctgcagg

SEQ ID NO: 3792082 - DNA, 12 bp, Homo sapiens
gtcccactcaag

SEQ ID NO: 3792083 - DNA, 18 bp, Homo sapiens
gtcccactcaagccaagc

SEQ ID NO: 3792084 - DNA, 21 bp, Homo sapiens
gtcccactcaagccaagcagc

SEQ ID NO: 3792085 - DNA, 14 bp, Homo sapiens
gtcccactcagtcc

SEQ ID NO: 3792086 - DNA, 15 bp, Homo sapiens
gtcccactcagtcca

SEQ ID NO: 3792087 - DNA, 23 bp, Homo sapiens
gtcccagccaccccgggctctct

SEQ ID NO: 3792088 - DNA, 13 bp, Homo sapiens
gtccccagcccac

SEQ ID NO: 3792089 - DNA, 19 bp, Homo sapiens
gtccccaggccccaggaag

SEQ ID NO: 3792090 - DNA, 16 bp, Homo sapiens
gtcccgattgtaactc

SEQ ID NO: 3792091 - DNA, 19 bp, Homo sapiens
gtcccgtcaggacgttgag

SEQ ID NO: 3792092 - DNA, 21 bp, Homo sapiens
gtccctacacccctcccctgc

SEQ ID NO: 3792093 - DNA, 21 bp, Homo sapiens
gtccctaccgagtctcttctc

SEQ ID NO: 3792094 - DNA, 15 bp, Homo sapiens
gtccctatgcatatc

SEQ ID NO: 3792095 - DNA, 19 bp, Homo sapiens
gtccctccacgttcacccc

SEQ ID NO: 3792096 - DNA, 14 bp, Homo sapiens
gtccctctcaggca

SEQ ID NO: 3792097 - DNA, 16 bp, Homo sapiens
gtccctctcaggcatg

SEQ ID NO: 3792098 - DNA, 16 bp, Homo sapiens
gtccctgcacttgcag

SEQ ID NO: 3792099 - DNA, 14 bp, Homo sapiens
gtccctgccccctc

SEQ ID NO: 3792100 - DNA, 19 bp, Homo sapiens
gtccctgggggaagccctg

SEQ ID NO: 3792101 - DNA, 21 bp, Homo sapiens
gtccctgggggaagccctgga

SEQ ID NO: 3792102 - DNA, 23 bp, Homo sapiens
gtccctgggggaagccctggatt

SEQ ID NO: 3792103 - DNA, 22 bp, Homo sapiens
gtcccttcccctccctggctcc

SEQ ID NO: 3792104 - DNA, 17 bp, Homo sapiens
gtcccttgagacctcag

SEQ ID NO: 3792105 - DNA, 15 bp, Homo sapiens
gtccctttcttggcc

SEQ ID NO: 3792106 - DNA, 21 bp, Homo sapiens
gtccgaaagggacttggaagc

SEQ ID NO: 3792107 - DNA, 15 bp, Homo sapiens
gtccgatctttgact

SEQ ID NO: 3792108 - DNA, 18 bp, Homo sapiens
gtcctaagtccctgcccc

SEQ ID NO: 3792109 - DNA, 13 bp, Homo sapiens
gtcctactctgtg

SEQ ID NO: 3792110 - DNA, 23 bp, Homo sapiens
gtcctactctgtgtcaggtgggg

SEQ ID NO: 3792111 - DNA, 18 bp, Homo sapiens
gtcctcactcccagtcca

SEQ ID NO: 3792112 - DNA, 19 bp, Homo sapiens
gtcctccagaagcctctgg

SEQ ID NO: 3792113 - DNA, 16 bp, Homo sapiens
gtcctcccctcaagga

SEQ ID NO: 3792114 - DNA, 19 bp, Homo sapiens
gtcctctttcagaaaacag

SEQ ID NO: 3792115 - DNA, 15 bp, Homo sapiens
gtcctgacctgtctc

SEQ ID NO: 3792116 - DNA, 17 bp, Homo sapiens
gtcctgcctcagcctcc

SEQ ID NO: 3792117 - DNA, 13 bp, Homo sapiens
gtcctgcctggcc

SEQ ID NO: 3792118 - DNA, 21 bp, Homo sapiens
gtcctgctatttcccaagctg

SEQ ID NO: 3792119 - DNA, 17 bp, Homo sapiens
gtcctggctacatccca

SEQ ID NO: 3792120 - DNA, 20 bp, Homo sapiens
gtcctggctacatcccagcc

SEQ ID NO: 3792121 - DNA, 14 bp, Homo sapiens
gtcctggctcctga

SEQ ID NO: 3792122 - DNA, 20 bp, Homo sapiens
gtcctgggagaacctcaggc

SEQ ID NO: 3792123 - DNA, 18 bp, Homo sapiens
gtcctgggagtgagctgg

SEQ ID NO: 3792124 - DNA, 16 bp, Homo sapiens
gtcctgtctcccctct

SEQ ID NO: 3792125 - DNA, 17 bp, Homo sapiens
gtcctgtctcccctctg

SEQ ID NO: 3792126 - DNA, 18 bp, Homo sapiens
gtccttgcacctgcatcc

SEQ ID NO: 3792127 - DNA, 18 bp, Homo sapiens
gtccttggggacatctca

SEQ ID NO: 3792128 - DNA, 22 bp, Homo sapiens
gtcctttccagtggcctggctc

SEQ ID NO: 3792129 - DNA, 13 bp, Homo sapiens
gtcctttccctcc

SEQ ID NO: 3792130 - DNA, 15 bp, Homo sapiens
gtccttttcactaca

SEQ ID NO: 3792131 - DNA, 18 bp, Homo sapiens
gtccttttcactacacca

SEQ ID NO: 3792132 - DNA, 16 bp, Homo sapiens
gtcgaggacagggagg

SEQ ID NO: 3792133 - DNA, 23 bp, Homo sapiens
gtcgcccagtctggaatgcagtg

SEQ ID NO: 3792134 - DNA, 12 bp, Homo sapiens
gtcgcctctgca

SEQ ID NO: 3792135 - DNA, 12 bp, Homo sapiens
gtcggagccctg

SEQ ID NO: 3792136 - DNA, 20 bp, Homo sapiens
gtcgtagccaaggtgggctg

SEQ ID NO: 3792137 - DNA, 23 bp, Homo sapiens
gtcgtggcagataatcagcctct

SEQ ID NO: 3792138 - DNA, 16 bp, Homo sapiens
gtctaaaatcctgctt

SEQ ID NO: 3792139 - DNA, 13 bp, Homo sapiens
gtctaaatatttc

SEQ ID NO: 3792140 - DNA, 13 bp, Homo sapiens
gtctaaatttctt

SEQ ID NO: 3792141 - DNA, 21 bp, Homo sapiens
gtctaggagctgggaggaaaa

SEQ ID NO: 3792142 - DNA, 17 bp, Homo sapiens
gtctcaaaaaaagaaaa

SEQ ID NO: 3792143 - DNA, 22 bp, Homo sapiens
gtctcaaactcttgacctcagg

SEQ ID NO: 3792144 - DNA, 19 bp, Homo sapiens
gtctcacagtgttgcccag

SEQ ID NO: 3792145 - DNA, 11 bp, Homo sapiens
gtctcactctg

SEQ ID NO: 3792146 - DNA, 16 bp, Homo sapiens
gtctcactgttgccca

SEQ ID NO: 3792147 - DNA, 21 bp, Homo sapiens
gtctcactgttgcccaggctg

SEQ ID NO: 3792148 - DNA, 15 bp, Homo sapiens
gtctcaggacctagg

SEQ ID NO: 3792149 - DNA, 15 bp, Homo sapiens
gtctcaggtccctgc

SEQ ID NO: 3792150 - DNA, 16 bp, Homo sapiens
gtctcaggtccctgca

SEQ ID NO: 3792151 - DNA, 13 bp, Homo sapiens
gtctcatccccag

SEQ ID NO: 3792152 - DNA, 16 bp, Homo sapiens
gtctcatccccagggg

SEQ ID NO: 3792153 - DNA, 15 bp, Homo sapiens
gtctccagaccccca

SEQ ID NO: 3792154 - DNA, 17 bp, Homo sapiens
gtctccagacccccacc

SEQ ID NO: 3792155 - DNA, 19 bp, Homo sapiens
gtctcccagggccttaaaa

SEQ ID NO: 3792156 - DNA, 14 bp, Homo sapiens
gtctcccctctgct

SEQ ID NO: 3792157 - DNA, 19 bp, Homo sapiens
gtctcccctctgctggccg

SEQ ID NO: 3792158 - DNA, 15 bp, Homo sapiens
gtctccctctcctgc

SEQ ID NO: 3792159 - DNA, 16 bp, Homo sapiens
gtctccctctcctgcc

SEQ ID NO: 3792160 - DNA, 17 bp, Homo sapiens
gtctccctctcctgcct

SEQ ID NO: 3792161 - DNA, 18 bp, Homo sapiens
gtctccctctcctgccta

SEQ ID NO: 3792162 - DNA, 20 bp, Homo sapiens
gtctccctctcctgcctact

SEQ ID NO: 3792163 - DNA, 14 bp, Homo sapiens
gtctcctcttaaaa

SEQ ID NO: 3792164 - DNA, 23 bp, Homo sapiens
gtctcctcttaaaaaataaaaac

SEQ ID NO: 3792165 - DNA, 23 bp, Homo sapiens
gtctcctgcccccacacctggcc

SEQ ID NO: 3792166 - DNA, 18 bp, Homo sapiens
gtctcctttgcaggctca

SEQ ID NO: 3792167 - DNA, 11 bp, Homo sapiens
gtctctattta

SEQ ID NO: 3792168 - DNA, 19 bp, Homo sapiens
gtctctatttaaattcttt

SEQ ID NO: 3792169 - DNA, 12 bp, Homo sapiens
gtctctcagaat

SEQ ID NO: 3792170 - DNA, 15 bp, Homo sapiens
gtctctctctctcta

SEQ ID NO: 3792171 - DNA, 19 bp, Homo sapiens
gtctctctctctctacaaa

SEQ ID NO: 3792172 - DNA, 18 bp, Homo sapiens
gtgtctcttttctctttc

SEQ ID NO: 3792173 - DNA, 19 bp, Homo sapiens
gtgtctcttttctctttct

SEQ ID NO: 3792174 - DNA, 16 bp, Homo sapiens
gtgtctgagagattca

SEQ ID NO: 3792175 - DNA, 12 bp, Homo sapiens
gtgtcttccata

SEQ ID NO: 3792176 - DNA, 18 bp, Homo sapiens
gtgtgaaagtcagatgcc

SEQ ID NO: 3792177 - DNA, 23 bp, Homo sapiens
gtgtgaaccaccacacccagccc

SEQ ID NO: 3792178 - DNA, 20 bp, Homo sapiens
gtgtgacatcagtggcatgg

SEQ ID NO: 3792179 - DNA, 17 bp, Homo sapiens
gtgtgactactccccca

SEQ ID NO: 3792180 - DNA, 20 bp, Homo sapiens
gtgtgagtcaccaagcccag

SEQ ID NO: 3792181 - DNA, 16 bp, Homo sapiens
gtgtgcaacagacaag

SEQ ID NO: 3792182 - DNA, 16 bp, Homo sapiens
gtgtgcaagtatgtga

SEQ ID NO: 3792183 - DNA, 16 bp, Homo sapiens
gtgtgcaagtgtgtgc

SEQ ID NO: 3792184 - DNA, 22 bp, Homo sapiens
gtgtgcacacacaccacacata

SEQ ID NO: 3792185 - DNA, 18 bp, Homo sapiens
gtgtgcatgtgtgtgctc

SEQ ID NO: 3792186 - DNA, 16 bp, Homo sapiens
gtgtgcctgcagcccc

SEQ ID NO: 3792187 - DNA, 18 bp, Homo sapiens
gtgtggactcaagtcctt

SEQ ID NO: 3792188 - DNA, 16 bp, Homo sapiens
gtgtggactgtgatgc

SEQ ID NO: 3792189 - DNA, 13 bp, Homo sapiens
gtgtggagaagcg

SEQ ID NO: 3792190 - DNA, 21 bp, Homo sapiens
gtgtggagaagcggctggcag

SEQ ID NO: 3792191 - DNA, 15 bp, Homo sapiens
gtgtggccccttcac

SEQ ID NO: 3792192 - DNA, 15 bp, Homo sapiens
gtgtggctcccctct

SEQ ID NO: 3792193 - DNA, 17 bp, Homo sapiens
gtgtgggactgtacaca

SEQ ID NO: 3792194 - DNA, 14 bp, Homo sapiens
gtgtgggctgtgtc

SEQ ID NO: 3792195 - DNA, 18 bp, Homo sapiens
gtgtggtttagtgtaaaa

SEQ ID NO: 3792196 - DNA, 21 bp, Homo sapiens
gtgtgtatgactaaagagaga

SEQ ID NO: 3792197 - DNA, 15 bp, Homo sapiens
gtgtgtattgttccc

SEQ ID NO: 3792198 - DNA, 16 bp, Homo sapiens
gtgtgtctcctgcatg

SEQ ID NO: 3792199 - DNA, 15 bp, Homo sapiens
gtgtgtctgctcagt

SEQ ID NO: 3792200 - DNA, 15 bp, Homo sapiens
gtgtgtctgttcact

SEQ ID NO: 3792201 - DNA, 21 bp, Homo sapiens
gtgtgtgcgcctacaggagtg

SEQ ID NO: 3792202 - DNA, 17 bp, Homo sapiens
gtgtgtgtatgtttgca

SEQ ID NO: 3792203 - DNA, 14 bp, Homo sapiens
gtgtgtttgtgatt

SEQ ID NO: 3792204 - DNA, 18 bp, Homo sapiens
gtgtgttttcataataaa

SEQ ID NO: 3792205 - DNA, 19 bp, Homo sapiens
gtgtgtttttgggatgtct

SEQ ID NO: 3792206 - DNA, 18 bp, Homo sapiens
gtgttcctggcaatagtg

SEQ ID NO: 3792207 - DNA, 16 bp, Homo sapiens
gtgttctgattagaaa

SEQ ID NO: 3792208 - DNA, 16 bp, Homo sapiens
gtgttgaaaatgttca

SEQ ID NO: 3792209 - DNA, 17 bp, Homo sapiens
gtgttgaaaatgttcag

SEQ ID NO: 3792210 - DNA, 15 bp, Homo sapiens
gtgttgatcccaaga

SEQ ID NO: 3792211 - DNA, 13 bp, Homo sapiens
gtgttgcagaagg

SEQ ID NO: 3792212 - DNA, 21 bp, Homo sapiens
gtgttggctaatgaagggaaa

SEQ ID NO: 3792213 - DNA, 22 bp, Homo sapiens
gtgtttatcctatctctccaac

SEQ ID NO: 3792214 - DNA, 15 bp, Homo sapiens
gtgtttcccataatt

SEQ ID NO: 3792215 - DNA, 16 bp, Homo sapiens
gtgttttaaagagaat

SEQ ID NO: 3792216 - DNA, 12 bp, Homo sapiens
gtgttttcagag

SEQ ID NO: 3792217 - DNA, 16 bp, Homo sapiens
gtgttttcataataaa

SEQ ID NO: 3792218 - DNA, 15 bp, Homo sapiens
gtgtttttgggatgt

SEQ ID NO: 3792219 - DNA, 16 bp, Homo sapiens
gttaaaaaaaataata

SEQ ID NO: 3792220 - DNA, 15 bp, Homo sapiens
gttaaaattccatcc

SEQ ID NO: 3792221 - DNA, 19 bp, Homo sapiens
gttaaatagagtatatgca

SEQ ID NO: 3792222 - DNA, 20 bp, Homo sapiens
gttaaatagagtatatgcac

SEQ ID NO: 3792223 - DNA, 21 bp, Homo sapiens
gttaaatagagtatatgcact

SEQ ID NO: 3792224 - DNA, 12 bp, Homo sapiens
gttaaatattta

SEQ ID NO: 3792225 - DNA, 19 bp, Homo sapiens
gttaacaaggaatgcctgt

SEQ ID NO: 3792226 - DNA, 15 bp, Homo sapiens
gttaacattgaccaa

SEQ ID NO: 3792227 - DNA, 12 bp, Homo sapiens
gttaacctacct

SEQ ID NO: 3792228 - DNA, 17 bp, Homo sapiens
gttaacctcagtgtcat

SEQ ID NO: 3792229 - DNA, 19 bp, Homo sapiens
gttaactatgtacaatatt

SEQ ID NO: 3792230 - DNA, 12 bp, Homo sapiens
gttaagaaaaaa

SEQ ID NO: 3792231 - DNA, 16 bp, Homo sapiens
gttaagaaaaaaataa

SEQ ID NO: 3792232 - DNA, 17 bp, Homo sapiens
gttaaggctgaggaaag

SEQ ID NO: 3792233 - DNA, 22 bp, Homo sapiens
gttaagtctaaatatttcctta

SEQ ID NO: 3792234 - DNA, 13 bp, Homo sapiens
gttaatcttgctt

SEQ ID NO: 3792235 - DNA, 18 bp, Homo sapiens
gttaatgatagctactgt

SEQ ID NO: 3792236 - DNA, 15 bp, Homo sapiens
gttacaaactgcaat

SEQ ID NO: 3792237 - DNA, 21 bp, Homo sapiens
gttacacactttttaagaaat

SEQ ID NO: 3792238 - DNA, 15 bp, Homo sapiens
gttacactaaaaggt

SEQ ID NO: 3792239 - DNA, 15 bp, Homo sapiens
gttacagtgcagaca

SEQ ID NO: 3792240 - DNA, 15 bp, Homo sapiens
gttacctcctataaa

SEQ ID NO: 3792241 - DNA, 13 bp, Homo sapiens
gttactatatgcc

SEQ ID NO: 3792242 - DNA, 12 bp, Homo sapiens
gttactcagccc

SEQ ID NO: 3792243 - DNA, 15 bp, Homo sapiens
gttactcagccctgg

SEQ ID NO: 3792244 - DNA, 13 bp, Homo sapiens
gttagaacactat

SEQ ID NO: 3792245 - DNA, 19 bp, Homo sapiens
gttagaacactattttcag

SEQ ID NO: 3792246 - DNA, 22 bp, Homo sapiens
gttagaacactattttcagaat

SEQ ID NO: 3792247 - DNA, 15 bp, Homo sapiens
gttagaatgaggagg

SEQ ID NO: 3792248 - DNA, 18 bp, Homo sapiens
gttaggaaataaaacctt

SEQ ID NO: 3792249 - DNA, 19 bp, Homo sapiens
gttaggaaataaaaccttt

SEQ ID NO: 3792250 - DNA, 21 bp, Homo sapiens
gttaggaaataaaacctttca

SEQ ID NO: 3792251 - DNA, 14 bp, Homo sapiens
gttagggaagagaa

SEQ ID NO: 3792252 - DNA, 15 bp, Homo sapiens
gttagggaagagaaa

SEQ ID NO: 3792253 - DNA, 18 bp, Homo sapiens
gttaggtagagggagttg

SEQ ID NO: 3792254 - DNA, 20 bp, Homo sapiens
gttaggtttaacataaaggt

SEQ ID NO: 3792255 - DNA, 13 bp, Homo sapiens
gttagtagaaatt

SEQ ID NO: 3792256 - DNA, 17 bp, Homo sapiens
gttagtatctaacatgt

SEQ ID NO: 3792257 - DNA, 16 bp, Homo sapiens
gttagtttctttggga

SEQ ID NO: 3792258 - DNA, 15 bp, Homo sapiens
gttatacatgacact

SEQ ID NO: 3792259 - DNA, 19 bp, Homo sapiens
gttatactgtcggtttttt

SEQ ID NO: 3792260 - DNA, 19 bp, Homo sapiens
gttatataaagagaaaatt

SEQ ID NO: 3792261 - DNA, 22 bp, Homo sapiens
gttatgataaaaaattttgtaa

SEQ ID NO: 3792262 - DNA, 19 bp, Homo sapiens
gttatgtgtatgtgccatt

SEQ ID NO: 3792263 - DNA, 14 bp, Homo sapiens
gttatgtgtgtata

SEQ ID NO: 3792264 - DNA, 19 bp, Homo sapiens
gttatgtgtgtatatgtat

SEQ ID NO: 3792265 - DNA, 16 bp, Homo sapiens
gttattgacaaactct

SEQ ID NO: 3792266 - DNA, 10 bp, Homo sapiens
gttatttaaa

SEQ ID NO: 3792267 - DNA, 13 bp, Homo sapiens
gttatttaaatga

SEQ ID NO: 3792268 - DNA, 14 bp, Homo sapiens
gttatttcttgttt

SEQ ID NO: 3792269 - DNA, 13 bp, Homo sapiens
gttattttctcct

SEQ ID NO: 3792270 - DNA, 17 bp, Homo sapiens
gttatttttatacagta

SEQ ID NO: 3792271 - DNA, 23 bp, Homo sapiens
gttatttttatttatttaaattt

SEQ ID NO: 3792272 - DNA, 22 bp, Homo sapiens
gttatttttgtttcttccaaag

SEQ ID NO: 3792273 - DNA, 17 bp, Homo sapiens
gttcaagaccagcctgg

SEQ ID NO: 3792274 - DNA, 20 bp, Homo sapiens
gttcaagcgattcttctgct

SEQ ID NO: 3792275 - DNA, 14 bp, Homo sapiens
gttcaaggaccaac

SEQ ID NO: 3792276 - DNA, 23 bp, Homo sapiens
gttcaaggaccaacaagggcagt

SEQ ID NO: 3792277 - DNA, 16 bp, Homo sapiens
gttcaattctcatttg

SEQ ID NO: 3792278 - DNA, 23 bp, Homo sapiens
gttcaattctcatttgtcacaca

SEQ ID NO: 3792279 - DNA, 16 bp, Homo sapiens
gttcacccctccaccc

SEQ ID NO: 3792280 - DNA, 19 bp, Homo sapiens
gttcactgcaacctccgcc

SEQ ID NO: 3792281 - DNA, 17 bp, Homo sapiens
gttcagagactcagggc

SEQ ID NO: 3792282 - DNA, 17 bp, Homo sapiens
gttcagcaccaccctag

SEQ ID NO: 3792283 - DNA, 22 bp, Homo sapiens
gttcagcattcttagcctgtgg

SEQ ID NO: 3792284 - DNA, 16 bp, Homo sapiens
gttcagcccctcctct

SEQ ID NO: 3792285 - DNA, 17 bp, Homo sapiens
gttcagcccctcctctg

SEQ ID NO: 3792286 - DNA, 17 bp, Homo sapiens
taactgaccctcccttc

SEQ ID NO: 3792287 - DNA, 21 bp, Homo sapiens
taactgcccaaagcagcactt

SEQ ID NO: 3792288 - DNA, 18 bp, Homo sapiens
taactgccttaaaacttt

SEQ ID NO: 3792289 - DNA, 18 bp, Homo sapiens
taactggagccccatcag

SEQ ID NO: 3792290 - DNA, 22 bp, Homo sapiens
taactgtgtatgtacatatata

SEQ ID NO: 3792291 - DNA, 22 bp, Homo sapiens
taacttggttatacatgacact

SEQ ID NO: 3792292 - DNA, 15 bp, Homo sapiens
taactttgggttaaa

SEQ ID NO: 3792293 - DNA, 16 bp, Homo sapiens
taagaaaacatcactg

SEQ ID NO: 3792294 - DNA, 23 bp, Homo sapiens
taagaaacacactgaggcaggga

SEQ ID NO: 3792295 - DNA, 21 bp, Homo sapiens
taagaaaccaatcaagataaa

SEQ ID NO: 3792296 - DNA, 24 bp, Homo sapiens
taagaaagactatctaaatgttga

SEQ ID NO: 3792297 - DNA, 14 bp, Homo sapiens
taagaagagactgg

SEQ ID NO: 3792298 - DNA, 12 bp, Homo sapiens
taagaatgttct

SEQ ID NO: 3792299 - DNA, 19 bp, Homo sapiens
taagaccacctcaaattta

SEQ ID NO: 3792300 - DNA, 22 bp, Homo sapiens
taagaccacctcaaatttaaag

SEQ ID NO: 3792301 - DNA, 16 bp, Homo sapiens
taagaccggaagctcc

SEQ ID NO: 3792302 - DNA, 18 bp, Homo sapiens
taagactaaatctgtaag

SEQ ID NO: 3792303 - DNA, 23 bp, Homo sapiens
taagactaaatctgtaagctctt

SEQ ID NO: 3792304 - DNA, 21 bp, Homo sapiens
taagactctgtctcaaaaata

SEQ ID NO: 3792305 - DNA, 17 bp, Homo sapiens
taagagctggtgtctga

SEQ ID NO: 3792306 - DNA, 15 bp, Homo sapiens
taagagctttacaaa

SEQ ID NO: 3792307 - DNA, 20 bp, Homo sapiens
taagagctttacaaaaagac

SEQ ID NO: 3792308 - DNA, 12 bp, Homo sapiens
taagaggcaggg

SEQ ID NO: 3792309 - DNA, 15 bp, Homo sapiens
taagaggcagggtct

SEQ ID NO: 3792310 - DNA, 22 bp, Homo sapiens
taagaggcagggtctcactctg

SEQ ID NO: 3792311 - DNA, 14 bp, Homo sapiens
taagataaatgtgc

SEQ ID NO: 3792312 - DNA, 17 bp, Homo sapiens
taagataaatgtgctga

SEQ ID NO: 3792313 - DNA, 22 bp, Homo sapiens
taagatacaagtttcagacagg

SEQ ID NO: 3792314 - DNA, 16 bp, Homo sapiens
taagatgtgtcttcaa

SEQ ID NO: 3792315 - DNA, 22 bp, Homo sapiens
taagatttacccagaatgtcag

SEQ ID NO: 3792316 - DNA, 16 bp, Homo sapiens
taagatttattttgtt

SEQ ID NO: 3792317 - DNA, 23 bp, Homo sapiens
taagcaaagggagcactgggttg

SEQ ID NO: 3792318 - DNA, 18 bp, Homo sapiens
taagcaagagagatgttt

SEQ ID NO: 3792319 - DNA, 21 bp, Homo sapiens
taagcagatttaacaattcca

SEQ ID NO: 3792320 - DNA, 13 bp, Homo sapiens
taagcatcacaaa

SEQ ID NO: 3792321 - DNA, 21 bp, Homo sapiens
taagcattactcttgtaagat

SEQ ID NO: 3792322 - DNA, 22 bp, Homo sapiens
taagcattactcttgtaagatt

SEQ ID NO: 3792323 - DNA, 17 bp, Homo sapiens
taagcattgtttgctta

SEQ ID NO: 3792324 - DNA, 23 bp, Homo sapiens
taagcattgtttgcttattgttc

SEQ ID NO: 3792325 - DNA, 14 bp, Homo sapiens
taagccaagggcct

SEQ ID NO: 3792326 - DNA, 14 bp, Homo sapiens
taagcccttgaaga

SEQ ID NO: 3792327 - DNA, 14 bp, Homo sapiens
taagcctccattta

SEQ ID NO: 3792328 - DNA, 15 bp, Homo sapiens
taagcctttccataa

SEQ ID NO: 3792329 - DNA, 22 bp, Homo sapiens
taagctgttactgtcttcagta

SEQ ID NO: 3792330 - DNA, 17 bp, Homo sapiens
taagcttaaaaaaaact

SEQ ID NO: 3792331 - DNA, 18 bp, Homo sapiens
taagcttatttaattaaa

SEQ ID NO: 3792332 - DNA, 18 bp, Homo sapiens
taaggaaagcaataaatg

SEQ ID NO: 3792333 - DNA, 14 bp, Homo sapiens
taaggacaggcagg

SEQ ID NO: 3792334 - DNA, 14 bp, Homo sapiens
taaggactgcatgg

SEQ ID NO: 3792335 - DNA, 17 bp, Homo sapiens
taaggatactttacatg

SEQ ID NO: 3792336 - DNA, 16 bp, Homo sapiens
taaggatgggaaggag

SEQ ID NO: 3792337 - DNA, 17 bp, Homo sapiens
taaggatttttctctta

SEQ ID NO: 3792338 - DNA, 19 bp, Homo sapiens
taaggcaactgaacaaaaa

SEQ ID NO: 3792339 - DNA, 20 bp, Homo sapiens
taaggctgaggaaaggccag

SEQ ID NO: 3792340 - DNA, 22 bp, Homo sapiens
taagggctggtctctgctgaag

SEQ ID NO: 3792341 - DNA, 13 bp, Homo sapiens
taagggttttaga

SEQ ID NO: 3792342 - DNA, 18 bp, Homo sapiens
taaggtcattaccacagg

SEQ ID NO: 3792343 - DNA, 23 bp, Homo sapiens
taagtaattatcgggaacagtgt

SEQ ID NO: 3792344 - DNA, 18 bp, Homo sapiens
taagtaccactcaggcca

SEQ ID NO: 3792345 - DNA, 19 bp, Homo sapiens
taagtactatgtatcaatg

SEQ ID NO: 3792346 - DNA, 14 bp, Homo sapiens
taagtatgttattt

SEQ ID NO: 3792347 - DNA, 19 bp, Homo sapiens
taagtattcttatttaatg

SEQ ID NO: 3792348 - DNA, 13 bp, Homo sapiens
taagtatttatat

SEQ ID NO: 3792349 - DNA, 19 bp, Homo sapiens
taagtatttatatatttat

SEQ ID NO: 3792350 - DNA, 23 bp, Homo sapiens
taagtatttatatatttataact

SEQ ID NO: 3792351 - DNA, 20 bp, Homo sapiens
taagtatttcagatgcttta

SEQ ID NO: 3792352 - DNA, 20 bp, Homo sapiens
taagtgacagtttaactttt

SEQ ID NO: 3792353 - DNA, 24 bp, Homo sapiens
taagtgagagagacaagaagcaaa

SEQ ID NO: 3792354 - DNA, 15 bp, Homo sapiens
taagtgcctacatta

SEQ ID NO: 3792355 - DNA, 20 bp, Homo sapiens
taagttcttagatatctttt

SEQ ID NO: 3792356 - DNA, 13 bp, Homo sapiens
taataaaacatct

SEQ ID NO: 3792357 - DNA, 17 bp, Homo sapiens
taataaaatatcattca

SEQ ID NO: 3792358 - DNA, 20 bp, Homo sapiens
taataaaatatcattcagca

SEQ ID NO: 3792359 - DNA, 21 bp, Homo sapiens
taataaaatatcattcagcaa

SEQ ID NO: 3792360 - DNA, 12 bp, Homo sapiens
taataaactcat

SEQ ID NO: 3792361 - DNA, 22 bp, Homo sapiens
taataaagtattccaccttaaa

SEQ ID NO: 3792362 - DNA, 10 bp, Homo sapiens
taataaagtg

SEQ ID NO: 3792363 - DNA, 18 bp, Homo sapiens
taataaagtgttttcaga

SEQ ID NO: 3792364 - DNA, 15 bp, Homo sapiens
taataaattcagata

SEQ ID NO: 3792365 - DNA, 21 bp, Homo sapiens
taataaattgcatgctgcttt

SEQ ID NO: 3792366 - DNA, 13 bp, Homo sapiens
taataacataaca

SEQ ID NO: 3792367 - DNA, 18 bp, Homo sapiens
taataagctaaagaggct

SEQ ID NO: 3792368 - DNA, 11 bp, Homo sapiens
taataatacaa

SEQ ID NO: 3792369 - DNA, 18 bp, Homo sapiens
taataatcttgtttctga

SEQ ID NO: 3792370 - DNA, 15 bp, Homo sapiens
taataatgtttaata

SEQ ID NO: 3792371 - DNA, 22 bp, Homo sapiens
taataattttaggcacccatcc

SEQ ID NO: 3792372 - DNA, 12 bp, Homo sapiens
taatagaagaac

SEQ ID NO: 3792373 - DNA, 14 bp, Homo sapiens
taatataaagttgg

SEQ ID NO: 3792374 - DNA, 16 bp, Homo sapiens
taatatgctgccaaat

SEQ ID NO: 3792375 - DNA, 16 bp, Homo sapiens
taatatggggatgcag

SEQ ID NO: 3792376 - DNA, 20 bp, Homo sapiens
taatatgttaacctcagtgt

SEQ ID NO: 3792377 - DNA, 16 bp, Homo sapiens
taatattcattgtata

SEQ ID NO: 3792378 - DNA, 17 bp, Homo sapiens
taatattctttcaataa

SEQ ID NO: 3792379 - DNA, 15 bp, Homo sapiens
taatatttttaatta

SEQ ID NO: 3792380 - DNA, 14 bp, Homo sapiens
taatcagcctctta

SEQ ID NO: 3792381 - DNA, 22 bp, Homo sapiens
taatccctgggcattgctttcc

SEQ ID NO: 3792382 - DNA, 22 bp, Homo sapiens
taatcggcccacagctcccacc

SEQ ID NO: 3792383 - DNA, 17 bp, Homo sapiens
taatcgttatgtgtgta

SEQ ID NO: 3792384 - DNA, 16 bp, Homo sapiens
taatctattgggttca

SEQ ID NO: 3792385 - DNA, 15 bp, Homo sapiens
taatctgctatgctt

SEQ ID NO: 3792386 - DNA, 17 bp, Homo sapiens
taatctggactcctctg

SEQ ID NO: 3792387 - DNA, 22 bp, Homo sapiens
taatctggactcctctgtccag

SEQ ID NO: 3792388 - DNA, 18 bp, Homo sapiens
taatctgtttatttacaa

SEQ ID NO: 3792389 - DNA, 15 bp, Homo sapiens
taatgaaaatgtcag

SEQ ID NO: 3792390 - DNA, 16 bp, Homo sapiens
taatgaatttttatga

SEQ ID NO: 3792391 - DNA, 21 bp, Homo sapiens
taatgaatttttatgatattc

SEQ ID NO: 3792392 - DNA, 17 bp, Homo sapiens
taatgatgtcgtttgaa

SEQ ID NO: 3792393 - DNA, 11 bp, Homo sapiens
taatgatgttt

SEQ ID NO: 3792394 - DNA, 22 bp, Homo sapiens
taatgctaaatgtaagaatcat

SEQ ID NO: 3792395 - DNA, 17 bp, Homo sapiens
taatgctgttgcctcat

SEQ ID NO: 3792396 - DNA, 18 bp, Homo sapiens
taatggtgtaacctgaga

SEQ ID NO: 3792397 - DNA, 16 bp, Homo sapiens
taatgtaagctctact

SEQ ID NO: 3792398 - DNA, 15 bp, Homo sapiens
tagtcaagattgtgt

SEQ ID NO: 3792399 - DNA, 15 bp, Homo sapiens
tagtcatagaagaac

SEQ ID NO: 3792400 - DNA, 15 bp, Homo sapiens
tagtcccagctactc

SEQ ID NO: 3792401 - DNA, 20 bp, Homo sapiens
tagtcccagctactcaggag

SEQ ID NO: 3792402 - DNA, 18 bp, Homo sapiens
tagtctaaccaaatgcat

SEQ ID NO: 3792403 - DNA, 12 bp, Homo sapiens
tagtctggtttc

SEQ ID NO: 3792404 - DNA, 18 bp, Homo sapiens
tagtctgtgtgaaggtga

SEQ ID NO: 3792405 - DNA, 15 bp, Homo sapiens
tagtcttcaagcaga

SEQ ID NO: 3792406 - DNA, 14 bp, Homo sapiens
tagtcttctcatag

SEQ ID NO: 3792407 - DNA, 24 bp, Homo sapiens
tagtgaaaccccatctctactgaa

SEQ ID NO: 3792408 - DNA, 13 bp, Homo sapiens
tagtgagaagaat

SEQ ID NO: 3792409 - DNA, 16 bp, Homo sapiens
tagtgagaagaatatt

SEQ ID NO: 3792410 - DNA, 14 bp, Homo sapiens
tagtgatggttccc

SEQ ID NO: 3792411 - DNA, 17 bp, Homo sapiens
tagtgcagctgatttta

SEQ ID NO: 3792412 - DNA, 19 bp, Homo sapiens
tagtgcggacaagttttaa

SEQ ID NO: 3792413 - DNA, 16 bp, Homo sapiens
tagtggccagaccaga

SEQ ID NO: 3792414 - DNA, 17 bp, Homo sapiens
tagtggccagaccagag

SEQ ID NO: 3792415 - DNA, 20 bp, Homo sapiens
tagtggcttaaaacaacact

SEQ ID NO: 3792416 - DNA, 21 bp, Homo sapiens
tagtggggtctccctctcctg

SEQ ID NO: 3792417 - DNA, 22 bp, Homo sapiens
tagtggggtctccctctcctgc

SEQ ID NO: 3792418 - DNA, 13 bp, Homo sapiens
tagtggtggctct

SEQ ID NO: 3792419 - DNA, 17 bp, Homo sapiens
tagtggtggctctgaga

SEQ ID NO: 3792420 - DNA, 17 bp, Homo sapiens
tagtgtaaaaatgagaa

SEQ ID NO: 3792421 - DNA, 23 bp, Homo sapiens
tagtgtaggctttacttagctta

SEQ ID NO: 3792422 - DNA, 20 bp, Homo sapiens
tagtgtttgggtatattcat

SEQ ID NO: 3792423 - DNA, 18 bp, Homo sapiens
tagttaggaaataaaacc

SEQ ID NO: 3792424 - DNA, 21 bp, Homo sapiens
tagttaggaaataaaaccttt

SEQ ID NO: 3792425 - DNA, 16 bp, Homo sapiens
tagttagtagcatgtt

SEQ ID NO: 3792426 - DNA, 19 bp, Homo sapiens
tagttcagacactttggaa

SEQ ID NO: 3792427 - DNA, 18 bp, Homo sapiens
tagttcaggtaacaggca

SEQ ID NO: 3792428 - DNA, 20 bp, Homo sapiens
tagttcatccaatcctcact

SEQ ID NO: 3792429 - DNA, 20 bp, Homo sapiens
tagttcctcattagcatttt

SEQ ID NO: 3792430 - DNA, 14 bp, Homo sapiens
tagttgcaattgaa

SEQ ID NO: 3792431 - DNA, 17 bp, Homo sapiens
tagttgcagaaacattt

SEQ ID NO: 3792432 - DNA, 23 bp, Homo sapiens
tagttgcagactcagtttgtcag

SEQ ID NO: 3792433 - DNA, 18 bp, Homo sapiens
tagttgtgtactctggcc

SEQ ID NO: 3792434 - DNA, 18 bp, Homo sapiens
tagtttaggagaaaccag

SEQ ID NO: 3792435 - DNA, 18 bp, Homo sapiens
tagtttatacagttttaa

SEQ ID NO: 3792436 - DNA, 14 bp, Homo sapiens
tagtttgtgagaaa

SEQ ID NO: 3792437 - DNA, 15 bp, Homo sapiens
tagtttgtgagaaac

SEQ ID NO: 3792438 - DNA, 15 bp, Homo sapiens
tagttttgtcaaact

SEQ ID NO: 3792439 - DNA, 23 bp, Homo sapiens
tataaaaaaaatgaaatgtttta

SEQ ID NO: 3792440 - DNA, 20 bp, Homo sapiens
tataaaaaccccaaactgtt

SEQ ID NO: 3792441 - DNA, 16 bp, Homo sapiens
tataaaattaaagaaa

SEQ ID NO: 3792442 - DNA, 15 bp, Homo sapiens
tataaaattaagcaa

SEQ ID NO: 3792443 - DNA, 17 bp, Homo sapiens
tataaacatcacacaca

SEQ ID NO: 3792444 - DNA, 23 bp, Homo sapiens
tataaacttagtgcggacaagtt

SEQ ID NO: 3792445 - DNA, 14 bp, Homo sapiens
tataaagagaaaat

SEQ ID NO: 3792446 - DNA, 17 bp, Homo sapiens
tataaagagaaaattga

SEQ ID NO: 3792447 - DNA, 21 bp, Homo sapiens
tataaagagaaaattgaattt

SEQ ID NO: 3792448 - DNA, 17 bp, Homo sapiens
tataaagatggctgact

SEQ ID NO: 3792449 - DNA, 17 bp, Homo sapiens
tataaagcatctaaact

SEQ ID NO: 3792450 - DNA, 20 bp, Homo sapiens
tataaatgaagtttatacag

SEQ ID NO: 3792451 - DNA, 16 bp, Homo sapiens
tataaatggtgttttt

SEQ ID NO: 3792452 - DNA, 16 bp, Homo sapiens
tataaccaatgtttaa

SEQ ID NO: 3792453 - DNA, 17 bp, Homo sapiens
tataaccaatgtttaaa

SEQ ID NO: 3792454 - DNA, 16 bp, Homo sapiens
tataactcatcataaa

SEQ ID NO: 3792455 - DNA, 21 bp, Homo sapiens
tataactcatcataaaataaa

SEQ ID NO: 3792456 - DNA, 18 bp, Homo sapiens
tataacttaaaaaaatga

SEQ ID NO: 3792457 - DNA, 22 bp, Homo sapiens
tataacttaaaaaaatgacaga

SEQ ID NO: 3792458 - DNA, 16 bp, Homo sapiens
tataagcatggagaac

SEQ ID NO: 3792459 - DNA, 15 bp, Homo sapiens
tataaggactgcatg

SEQ ID NO: 3792460 - DNA, 16 bp, Homo sapiens
tataagtagcaggcca

SEQ ID NO: 3792461 - DNA, 20 bp, Homo sapiens
tataatatactatatttatg

SEQ ID NO: 3792462 - DNA, 20 bp, Homo sapiens
tataatcttccatacttctt

SEQ ID NO: 3792463 - DNA, 20 bp, Homo sapiens
tataatgaatgaaacatttt

SEQ ID NO: 3792464 - DNA, 15 bp, Homo sapiens
tataatggttgactg

SEQ ID NO: 3792465 - DNA, 17 bp, Homo sapiens
tataatgtcattaaaca

SEQ ID NO: 3792466 - DNA, 22 bp, Homo sapiens
tataattatgttattgaaaaaa

SEQ ID NO: 3792467 - DNA, 18 bp, Homo sapiens
tataattgttttttatct

SEQ ID NO: 3792468 - DNA, 11 bp, Homo sapiens
tataatttaat

SEQ ID NO: 3792469 - DNA, 16 bp, Homo sapiens
tataatttaatgcatg

SEQ ID NO: 3792470 - DNA, 22 bp, Homo sapiens
tataattttatgaatgtctttg

SEQ ID NO: 3792471 - DNA, 13 bp, Homo sapiens
tatacaagataag

SEQ ID NO: 3792472 - DNA, 19 bp, Homo sapiens
tatacaagataagcttcca

SEQ ID NO: 3792473 - DNA, 20 bp, Homo sapiens
tatacaagataagcttccag

SEQ ID NO: 3792474 - DNA, 15 bp, Homo sapiens
tatacaataacataa

SEQ ID NO: 3792475 - DNA, 12 bp, Homo sapiens
tatacacacagc

SEQ ID NO: 3792476 - DNA, 22 bp, Homo sapiens
tatacacttacactttatgcac

SEQ ID NO: 3792477 - DNA, 16 bp, Homo sapiens
tatacagtacagtggt

SEQ ID NO: 3792478 - DNA, 16 bp, Homo sapiens
tatacagttttaaaga

SEQ ID NO: 3792479 - DNA, 21 bp, Homo sapiens
tatacataacagggtaaatta

SEQ ID NO: 3792480 - DNA, 17 bp, Homo sapiens
tataccagcaatatatc

SEQ ID NO: 3792481 - DNA, 22 bp, Homo sapiens
tataccccgtgaagcatccagg

SEQ ID NO: 3792482 - DNA, 15 bp, Homo sapiens
tatagaatatttatt

SEQ ID NO: 3792483 - DNA, 21 bp, Homo sapiens
tatagaatatttattacctct

SEQ ID NO: 3792484 - DNA, 17 bp, Homo sapiens
tatagaatttttaatgt

SEQ ID NO: 3792485 - DNA, 16 bp, Homo sapiens
tatagacaaataataa

SEQ ID NO: 3792486 - DNA, 13 bp, Homo sapiens
tatagcaatccat

SEQ ID NO: 3792487 - DNA, 15 bp, Homo sapiens
tataggatcatttgt

SEQ ID NO: 3792488 - DNA, 14 bp, Homo sapiens
tataggtcactcct

SEQ ID NO: 3792489 - DNA, 17 bp, Homo sapiens
tatagtttactatttta

SEQ ID NO: 3792490 - DNA, 19 bp, Homo sapiens
tatagtttattgacaataa

SEQ ID NO: 3792491 - DNA, 18 bp, Homo sapiens
tatataaagagaaaattg

SEQ ID NO: 3792492 - DNA, 19 bp, Homo sapiens
tatataaagagaaaattga

SEQ ID NO: 3792493 - DNA, 22 bp, Homo sapiens
tatataatttttttatgttttg

SEQ ID NO: 3792494 - DNA, 16 bp, Homo sapiens
tatatacaataacata

SEQ ID NO: 3792495 - DNA, 22 bp, Homo sapiens
tatatacacacacaaagagagt

SEQ ID NO: 3792496 - DNA, 14 bp, Homo sapiens
tatatagcttgaaa

SEQ ID NO: 3792497 - DNA, 17 bp, Homo sapiens
tatatagtacctttgct

SEQ ID NO: 3792498 - DNA, 18 bp, Homo sapiens
tatatagtacctttgctc

SEQ ID NO: 3792499 - DNA, 22 bp, Homo sapiens
tatatagtttattgacaataat

SEQ ID NO: 3792500 - DNA, 12 bp, Homo sapiens
tatatatacata

SEQ ID NO: 3792501 - DNA, 12 bp, Homo sapiens
tatatatagaat

SEQ ID NO: 3792502 - DNA, 15 bp, Homo sapiens
tatatatttataact

SEQ ID NO: 3792503 - DNA, 15 bp, Homo sapiens
tatatccatgtactg

SEQ ID NO: 3792504 - DNA, 12 bp, Homo sapiens
tatatgtatgtg

SEQ ID NO: 3792505 - DNA, 12 bp, Homo sapiens
tatatgttttaa

SEQ ID NO: 3792506 - DNA, 16 bp, Homo sapiens
tatattaaaaatggta

SEQ ID NO: 3792507 - DNA, 19 bp, Homo sapiens
tatattaaaaatggtaaaa

SEQ ID NO: 3792508 - DNA, 16 bp, Homo sapiens
tatattagcatttagt

SEQ ID NO: 3792509 - DNA, 16 bp, Homo sapiens
tatattagtatgtatg

SEQ ID NO: 3792510 - DNA, 21 bp, Homo sapiens
tatattccatatattagcatt

SEQ ID NO: 3792511 - DNA, 21 bp, Homo sapiens
tcactcttattgcccacgctg

SEQ ID NO: 3792512 - DNA, 23 bp, Homo sapiens
tcactcttattgcccacgctgga

SEQ ID NO: 3792513 - DNA, 23 bp, Homo sapiens
tcactgaatgcttctgacttcat

SEQ ID NO: 3792514 - DNA, 18 bp, Homo sapiens
tcactgcaacctccgcct

SEQ ID NO: 3792515 - DNA, 20 bp, Homo sapiens
tcactgcacagtgcatctca

SEQ ID NO: 3792516 - DNA, 14 bp, Homo sapiens
tcactgcagcctcg

SEQ ID NO: 3792517 - DNA, 16 bp, Homo sapiens
tcactgctggctgcct

SEQ ID NO: 3792518 - DNA, 22 bp, Homo sapiens
tcactgctggctgccttagaac

SEQ ID NO: 3792519 - DNA, 18 bp, Homo sapiens
tcactggaccactgggca

SEQ ID NO: 3792520 - DNA, 15 bp, Homo sapiens
tcactggagcccagg

SEQ ID NO: 3792521 - DNA, 16 bp, Homo sapiens
tcactggcatctttgc

SEQ ID NO: 3792522 - DNA, 16 bp, Homo sapiens
tcactggggtcctggg

SEQ ID NO: 3792523 - DNA, 19 bp, Homo sapiens
tcactggggtcctggggcc

SEQ ID NO: 3792524 - DNA, 20 bp, Homo sapiens
tcactggtagaccaaaataa

SEQ ID NO: 3792525 - DNA, 21 bp, Homo sapiens
tcactgtagaatgatttcatg

SEQ ID NO: 3792526 - DNA, 15 bp, Homo sapiens
tcactgttgcccagg

SEQ ID NO: 3792527 - DNA, 19 bp, Homo sapiens
tcactgttgcccaggctgg

SEQ ID NO: 3792528 - DNA, 17 bp, Homo sapiens
tcactgtttctctgctg

SEQ ID NO: 3792529 - DNA, 17 bp, Homo sapiens
tcacttaaatgttacca

SEQ ID NO: 3792530 - DNA, 17 bp, Homo sapiens
tcacttctgaccacact

SEQ ID NO: 3792531 - DNA, 13 bp, Homo sapiens
tcacttgaatgtg

SEQ ID NO: 3792532 - DNA, 14 bp, Homo sapiens
tcacttgagcccag

SEQ ID NO: 3792533 - DNA, 22 bp, Homo sapiens
tcacttgaggtcaggagttcct

SEQ ID NO: 3792534 - DNA, 15 bp, Homo sapiens
tcacttgtacaaaat

SEQ ID NO: 3792535 - DNA, 18 bp, Homo sapiens
tcactttcacatagatgt

SEQ ID NO: 3792536 - DNA, 11 bp, Homo sapiens
tcagaaaacag

SEQ ID NO: 3792537 - DNA, 17 bp, Homo sapiens
tcagaaaacagaaaaaa

SEQ ID NO: 3792538 - DNA, 20 bp, Homo sapiens
tcagaaaacagaaaaaaaac

SEQ ID NO: 3792539 - DNA, 22 bp, Homo sapiens
tcagaaacatcagttactctga

SEQ ID NO: 3792540 - DNA, 14 bp, Homo sapiens
tcagaaagagcaag

SEQ ID NO: 3792541 - DNA, 23 bp, Homo sapiens
tcagaaagagcaagtctggatct

SEQ ID NO: 3792542 - DNA, 12 bp, Homo sapiens
tcagaaatatgt

SEQ ID NO: 3792543 - DNA, 18 bp, Homo sapiens
tcagaaatgtacaacttt

SEQ ID NO: 3792544 - DNA, 23 bp, Homo sapiens
tcagaaatttaattcatgtttct

SEQ ID NO: 3792545 - DNA, 12 bp, Homo sapiens
tcagaacacatt

SEQ ID NO: 3792546 - DNA, 17 bp, Homo sapiens
tcagaacctcttcccca

SEQ ID NO: 3792547 - DNA, 13 bp, Homo sapiens
tcagaagacactg

SEQ ID NO: 3792548 - DNA, 16 bp, Homo sapiens
tcagaagcctattgta

SEQ ID NO: 3792549 - DNA, 13 bp, Homo sapiens
tcagaagcctgag

SEQ ID NO: 3792550 - DNA, 14 bp, Homo sapiens
tcagaaggagaagg

SEQ ID NO: 3792551 - DNA, 16 bp, Homo sapiens
tcagaaggagaaggaa

SEQ ID NO: 3792552 - DNA, 19 bp, Homo sapiens
tcagaatctcaaataacta

SEQ ID NO: 3792553 - DNA, 17 bp, Homo sapiens
tcagaatctgaatgtaa

SEQ ID NO: 3792554 - DNA, 22 bp, Homo sapiens
tcagaatctgaatgtaatttgt

SEQ ID NO: 3792555 - DNA, 10 bp, Homo sapiens
tcagaattct

SEQ ID NO: 3792556 - DNA, 12 bp, Homo sapiens
tcagaattctca

SEQ ID NO: 3792557 - DNA, 21 bp, Homo sapiens
tcagaattgatcattttcccc

SEQ ID NO: 3792558 - DNA, 19 bp, Homo sapiens
tcagacacaaacaaacaag

SEQ ID NO: 3792559 - DNA, 13 bp, Homo sapiens
tcagaccccagcg

SEQ ID NO: 3792560 - DNA, 18 bp, Homo sapiens
tcagacccccactctcat

SEQ ID NO: 3792561 - DNA, 22 bp, Homo sapiens
tcagacccccactctcattccc

SEQ ID NO: 3792562 - DNA, 16 bp, Homo sapiens
tcagactgctgggact

SEQ ID NO: 3792563 - DNA, 14 bp, Homo sapiens
tcagactggctggc

SEQ ID NO: 3792564 - DNA, 20 bp, Homo sapiens
tcagactggctggctgcagt

SEQ ID NO: 3792565 - DNA, 16 bp, Homo sapiens
tcagactttaaagaat

SEQ ID NO: 3792566 - DNA, 17 bp, Homo sapiens
tcagactttaaagaata

SEQ ID NO: 3792567 - DNA, 12 bp, Homo sapiens
tcagagaatttc

SEQ ID NO: 3792568 - DNA, 13 bp, Homo sapiens
tcagagagctggt

SEQ ID NO: 3792569 - DNA, 16 bp, Homo sapiens
tcagagataggcctgt

SEQ ID NO: 3792570 - DNA, 21 bp, Homo sapiens
tcagagccacccctaaagaga

SEQ ID NO: 3792571 - DNA, 21 bp, Homo sapiens
tcagagcctcctttctggctt

SEQ ID NO: 3792572 - DNA, 18 bp, Homo sapiens
tcagaggcacaaaagggt

SEQ ID NO: 3792573 - DNA, 18 bp, Homo sapiens
tcagagtaagctgctttt

SEQ ID NO: 3792574 - DNA, 19 bp, Homo sapiens
tcagagtaagctgcttttg

SEQ ID NO: 3792575 - DNA, 17 bp, Homo sapiens
tcagagtccaggcccca

SEQ ID NO: 3792576 - DNA, 23 bp, Homo sapiens
tcagatatatttttcacagtttt

SEQ ID NO: 3792577 - DNA, 23 bp, Homo sapiens
tcagatattttttcagaaatatg

SEQ ID NO: 3792578 - DNA, 15 bp, Homo sapiens
tcagatgggaagaca

SEQ ID NO: 3792579 - DNA, 14 bp, Homo sapiens
tcagattcccagag

SEQ ID NO: 3792580 - DNA, 22 bp, Homo sapiens
tcagattcccagagcaaaataa

SEQ ID NO: 3792581 - DNA, 15 bp, Homo sapiens
tcagattcctttccc

SEQ ID NO: 3792582 - DNA, 12 bp, Homo sapiens
tcagatttgaac

SEQ ID NO: 3792583 - DNA, 20 bp, Homo sapiens
tcagcaaggggctctgccct

SEQ ID NO: 3792584 - DNA, 14 bp, Homo sapiens
tcagcaccacccta

SEQ ID NO: 3792585 - DNA, 14 bp, Homo sapiens
tcagcacccccttc

SEQ ID NO: 3792586 - DNA, 23 bp, Homo sapiens
tcagcacttgggggatctgttgt

SEQ ID NO: 3792587 - DNA, 18 bp, Homo sapiens
tcagcagccctcctcacc

SEQ ID NO: 3792588 - DNA, 21 bp, Homo sapiens
tcagcagttgttattacatcc

SEQ ID NO: 3792589 - DNA, 16 bp, Homo sapiens
tcagccaaatgtaatt

SEQ ID NO: 3792590 - DNA, 17 bp, Homo sapiens
tcagccaaccttactta

SEQ ID NO: 3792591 - DNA, 22 bp, Homo sapiens
tcagccaaccttacttacagca

SEQ ID NO: 3792592 - DNA, 21 bp, Homo sapiens
tcagccaacgagtaatttatt

SEQ ID NO: 3792593 - DNA, 13 bp, Homo sapiens
tcagccaggagct

SEQ ID NO: 3792594 - DNA, 13 bp, Homo sapiens
tcagcccaccccc

SEQ ID NO: 3792595 - DNA, 14 bp, Homo sapiens
tcagcccacccccc

SEQ ID NO: 3792596 - DNA, 17 bp, Homo sapiens
tcagcccacccccctca

SEQ ID NO: 3792597 - DNA, 12 bp, Homo sapiens
tcagccccagcc

SEQ ID NO: 3792598 - DNA, 15 bp, Homo sapiens
tcagccccagcccag

SEQ ID NO: 3792599 - DNA, 22 bp, Homo sapiens
tcagccccagcccagcccagct

SEQ ID NO: 3792600 - DNA, 13 bp, Homo sapiens
tcagcccctcctc

SEQ ID NO: 3792601 - DNA, 14 bp, Homo sapiens
tcagcccctcctct

SEQ ID NO: 3792602 - DNA, 16 bp, Homo sapiens
tcagcccctcctctgc

SEQ ID NO: 3792603 - DNA, 22 bp, Homo sapiens
tcagcccctcctctgccacctc

SEQ ID NO: 3792604 - DNA, 12 bp, Homo sapiens
tcagccctcaga

SEQ ID NO: 3792605 - DNA, 14 bp, Homo sapiens
tcagccctcagaat

SEQ ID NO: 3792606 - DNA, 15 bp, Homo sapiens
tcagccctccctgcc

SEQ ID NO: 3792607 - DNA, 16 bp, Homo sapiens
tcagccctccctgccc

SEQ ID NO: 3792608 - DNA, 19 bp, Homo sapiens
tcagccctccctgcccctc

SEQ ID NO: 3792609 - DNA, 13 bp, Homo sapiens
tcagccctgaggt

SEQ ID NO: 3792610 - DNA, 21 bp, Homo sapiens
tcagcctagccgacctcagcc

SEQ ID NO: 3792611 - DNA, 18 bp, Homo sapiens
tcagcctaggggtcaggg

SEQ ID NO: 3792612 - DNA, 12 bp, Homo sapiens
tcagcctcccaa

SEQ ID NO: 3792613 - DNA, 19 bp, Homo sapiens
tcagcctcccaaagtgctg

SEQ ID NO: 3792614 - DNA, 21 bp, Homo sapiens
tcagcctcccgagtagctggg

SEQ ID NO: 3792615 - DNA, 16 bp, Homo sapiens
tcagcctcctgtgtag

SEQ ID NO: 3792616 - DNA, 13 bp, Homo sapiens
tcagcctgaggct

SEQ ID NO: 3792617 - DNA, 20 bp, Homo sapiens
tcagcctgaggctgagactg

SEQ ID NO: 3792618 - DNA, 18 bp, Homo sapiens
tcagcctgctccagctgt

SEQ ID NO: 3792619 - DNA, 17 bp, Homo sapiens
tcagcctggtgggcctc

SEQ ID NO: 3792620 - DNA, 12 bp, Homo sapiens
tcagcctgtgct

SEQ ID NO: 3792621 - DNA, 21 bp, Homo sapiens
tcagccttccccctcccaggg

SEQ ID NO: 3792622 - DNA, 21 bp, Homo sapiens
tcagccttccccttgcccagg

SEQ ID NO: 3792623 - DNA, 22 bp, Homo sapiens
tcagccttggataatgctgttg

SEQ ID NO: 3792624 - DNA, 20 bp, Homo sapiens
tcccaccggttgcttctggg

SEQ ID NO: 3792625 - DNA, 22 bp, Homo sapiens
tcccacctcaaatgggtctggg

SEQ ID NO: 3792626 - DNA, 15 bp, Homo sapiens
tcccacctcagcctc

SEQ ID NO: 3792627 - DNA, 21 bp, Homo sapiens
tcccaccttggctgcagggag

SEQ ID NO: 3792628 - DNA, 17 bp, Homo sapiens
tcccactcaagccaagc

SEQ ID NO: 3792629 - DNA, 18 bp, Homo sapiens
tcccactcaagccaagca

SEQ ID NO: 3792630 - DNA, 17 bp, Homo sapiens
tcccacttggaggcctt

SEQ ID NO: 3792631 - DNA, 12 bp, Homo sapiens
tcccacttgtca

SEQ ID NO: 3792632 - DNA, 20 bp, Homo sapiens
tcccagaaggacctcctgag

SEQ ID NO: 3792633 - DNA, 16 bp, Homo sapiens
tcccagagacaggaaa

SEQ ID NO: 3792634 - DNA, 17 bp, Homo sapiens
tcccagagacaggaaaa

SEQ ID NO: 3792635 - DNA, 18 bp, Homo sapiens
tcccagagacaggaaaat

SEQ ID NO: 3792636 - DNA, 15 bp, Homo sapiens
tcccagagtgctggg

SEQ ID NO: 3792637 - DNA, 13 bp, Homo sapiens
tcccagccacccc

SEQ ID NO: 3792638 - DNA, 18 bp, Homo sapiens
tcccagcggctggtgcag

SEQ ID NO: 3792639 - DNA, 22 bp, Homo sapiens
tcccagcggctggtgcagggcc

SEQ ID NO: 3792640 - DNA, 13 bp, Homo sapiens
tcccagctactca

SEQ ID NO: 3792641 - DNA, 14 bp, Homo sapiens
tcccagctactcag

SEQ ID NO: 3792642 - DNA, 21 bp, Homo sapiens
tcccagctactcagaagcctg

SEQ ID NO: 3792643 - DNA, 15 bp, Homo sapiens
tcccagctactcagg

SEQ ID NO: 3792644 - DNA, 17 bp, Homo sapiens
tcccagctcacgtcaca

SEQ ID NO: 3792645 - DNA, 21 bp, Homo sapiens
tcccagctctagacaaccctg

SEQ ID NO: 3792646 - DNA, 18 bp, Homo sapiens
tcccagctctccctctgg

SEQ ID NO: 3792647 - DNA, 21 bp, Homo sapiens
tcccagctctccctctggccc

SEQ ID NO: 3792648 - DNA, 17 bp, Homo sapiens
tcccagctgaaatactg

SEQ ID NO: 3792649 - DNA, 16 bp, Homo sapiens
tcccagctgcccctcc

SEQ ID NO: 3792650 - DNA, 19 bp, Homo sapiens
tcccagctgcccctccctg

SEQ ID NO: 3792651 - DNA, 22 bp, Homo sapiens
tcccagctgcccctccctgcca

SEQ ID NO: 3792652 - DNA, 22 bp, Homo sapiens
tcccagctgtctgtgtcagcct

SEQ ID NO: 3792653 - DNA, 22 bp, Homo sapiens
tcccagctgtgctctggacagg

SEQ ID NO: 3792654 - DNA, 16 bp, Homo sapiens
tcccaggaactgggcc

SEQ ID NO: 3792655 - DNA, 15 bp, Homo sapiens
tcccaggagacagtt

SEQ ID NO: 3792656 - DNA, 15 bp, Homo sapiens
tcccaggccaggctc

SEQ ID NO: 3792657 - DNA, 21 bp, Homo sapiens
tcccaggccaggctccttcct

SEQ ID NO: 3792658 - DNA, 17 bp, Homo sapiens
tcccaggccccctgcat

SEQ ID NO: 3792659 - DNA, 18 bp, Homo sapiens
tcccaggccccctgcatc

SEQ ID NO: 3792660 - DNA, 19 bp, Homo sapiens
tcccaggccccctgcatct

SEQ ID NO: 3792661 - DNA, 20 bp, Homo sapiens
tcccaggcgccccttccccc

SEQ ID NO: 3792662 - DNA, 21 bp, Homo sapiens
tcccaggcgccccttccccct

SEQ ID NO: 3792663 - DNA, 17 bp, Homo sapiens
tcccagggccagggccc

SEQ ID NO: 3792664 - DNA, 23 bp, Homo sapiens
tcccagggccagggccctgcaga

SEQ ID NO: 3792665 - DNA, 19 bp, Homo sapiens
tcccagggctactcactca

SEQ ID NO: 3792666 - DNA, 17 bp, Homo sapiens
tcccaggggaccacacc

SEQ ID NO: 3792667 - DNA, 19 bp, Homo sapiens
tcccagtgccgagaaggaa

SEQ ID NO: 3792668 - DNA, 20 bp, Homo sapiens
tcccagttcaggagtcccaa

SEQ ID NO: 3792669 - DNA, 23 bp, Homo sapiens
tcccagttcaggagtcccaagga

SEQ ID NO: 3792670 - DNA, 17 bp, Homo sapiens
tcccagttctctaggga

SEQ ID NO: 3792671 - DNA, 22 bp, Homo sapiens
tcccataattttcttcatgcaa

SEQ ID NO: 3792672 - DNA, 22 bp, Homo sapiens
tcccatcactggagcaccaggc

SEQ ID NO: 3792673 - DNA, 16 bp, Homo sapiens
tcccatcccagctgaa

SEQ ID NO: 3792674 - DNA, 20 bp, Homo sapiens
tcccatcccatcccatccca

SEQ ID NO: 3792675 - DNA, 19 bp, Homo sapiens
tcccatcccgctcttttcc

SEQ ID NO: 3792676 - DNA, 16 bp, Homo sapiens
tcccatgagcctcagc

SEQ ID NO: 3792677 - DNA, 20 bp, Homo sapiens
tcccatttcctgtcattttt

SEQ ID NO: 3792678 - DNA, 21 bp, Homo sapiens
tcccatttctaaaggcctctt

SEQ ID NO: 3792679 - DNA, 24 bp, Homo sapiens
tcccatttctaaaggcctcttcct

SEQ ID NO: 3792680 - DNA, 21 bp, Homo sapiens
tcccattttcagactgcttta

SEQ ID NO: 3792681 - DNA, 22 bp, Homo sapiens
tcccattttcagactgctttaa

SEQ ID NO: 3792682 - DNA, 23 bp, Homo sapiens
tcccattttcagactgctttaaa

SEQ ID NO: 3792683 - DNA, 21 bp, Homo sapiens
tcccattttgcaaaatttcca

SEQ ID NO: 3792684 - DNA, 20 bp, Homo sapiens
tcccattttggaagttttca

SEQ ID NO: 3792685 - DNA, 18 bp, Homo sapiens
tccccaaccctgcccctg

SEQ ID NO: 3792686 - DNA, 21 bp, Homo sapiens
tccccaccagtgaatgaaagt

SEQ ID NO: 3792687 - DNA, 18 bp, Homo sapiens
tccccaccttcaattcct

SEQ ID NO: 3792688 - DNA, 22 bp, Homo sapiens
tccccactccctggctctcaga

SEQ ID NO: 3792689 - DNA, 22 bp, Homo sapiens
tccccacttgagaattaccctt

SEQ ID NO: 3792690 - DNA, 17 bp, Homo sapiens
tccccagaaaggagact

SEQ ID NO: 3792691 - DNA, 16 bp, Homo sapiens
tccccagacctgagct

SEQ ID NO: 3792692 - DNA, 22 bp, Homo sapiens
tccccagcaagtgagagctggg

SEQ ID NO: 3792693 - DNA, 10 bp, Homo sapiens
tccccagcag

SEQ ID NO: 3792694 - DNA, 16 bp, Homo sapiens
tccccagcctctcttc

SEQ ID NO: 3792695 - DNA, 22 bp, Homo sapiens
tccccagcctctcttcctatcc

SEQ ID NO: 3792696 - DNA, 11 bp, Homo sapiens
tccccaggccc

SEQ ID NO: 3792697 - DNA, 10 bp, Homo sapiens
tccccagggg

SEQ ID NO: 3792698 - DNA, 18 bp, Homo sapiens
tccccaggtggctgaccc

SEQ ID NO: 3792699 - DNA, 22 bp, Homo sapiens
tccccaggtggctgacccagtc

SEQ ID NO: 3792700 - DNA, 15 bp, Homo sapiens
tccccagtgaaaact

SEQ ID NO: 3792701 - DNA, 15 bp, Homo sapiens
tccccatactctgtc

SEQ ID NO: 3792702 - DNA, 19 bp, Homo sapiens
tccccattagagtcagcct

SEQ ID NO: 3792703 - DNA, 15 bp, Homo sapiens
tcccccaacccccac

SEQ ID NO: 3792704 - DNA, 16 bp, Homo sapiens
tcccccaacccccacc

SEQ ID NO: 3792705 - DNA, 22 bp, Homo sapiens
tcccccaccagctaaggacatt

SEQ ID NO: 3792706 - DNA, 19 bp, Homo sapiens
tcccccaccccctccccag

SEQ ID NO: 3792707 - DNA, 20 bp, Homo sapiens
tcccccaccccctccccagg

SEQ ID NO: 3792708 - DNA, 14 bp, Homo sapiens
tcccccatagccac

SEQ ID NO: 3792709 - DNA, 12 bp, Homo sapiens
tccccccactgc

SEQ ID NO: 3792710 - DNA, 17 bp, Homo sapiens
tccccctcccagggcca

SEQ ID NO: 3792711 - DNA, 19 bp, Homo sapiens
tccccctcccagggccagg

SEQ ID NO: 3792712 - DNA, 12 bp, Homo sapiens
tccccctccttc

SEQ ID NO: 3792713 - DNA, 18 bp, Homo sapiens
tccccctccttcccagct

SEQ ID NO: 3792714 - DNA, 19 bp, Homo sapiens
tccccctccttcccagctg

SEQ ID NO: 3792715 - DNA, 22 bp, Homo sapiens
tccccctgggctctgccccagc

SEQ ID NO: 3792716 - DNA, 23 bp, Homo sapiens
tccccctgggctctgccccagct

SEQ ID NO: 3792717 - DNA, 13 bp, Homo sapiens
tccccgctggctg

SEQ ID NO: 3792718 - DNA, 18 bp, Homo sapiens
tccccgcttctgcctgca

SEQ ID NO: 3792719 - DNA, 22 bp, Homo sapiens
tccccggtcccttgagacctca

SEQ ID NO: 3792720 - DNA, 14 bp, Homo sapiens
tcccctaacctcat

SEQ ID NO: 3792721 - DNA, 13 bp, Homo sapiens
tcccctaatgcct

SEQ ID NO: 3792722 - DNA, 16 bp, Homo sapiens
tcccctatccacccag

SEQ ID NO: 3792723 - DNA, 20 bp, Homo sapiens
tcccctatccacccagccca

SEQ ID NO: 3792724 - DNA, 23 bp, Homo sapiens
tcccctcaaggacaaagtctcca

SEQ ID NO: 3792725 - DNA, 24 bp, Homo sapiens
tcccctcaaggacaaagtctccag

SEQ ID NO: 3792726 - DNA, 19 bp, Homo sapiens
tcccctccctggctcccat

SEQ ID NO: 3792727 - DNA, 17 bp, Homo sapiens
tcccctccgccaggcga

SEQ ID NO: 3792728 - DNA, 18 bp, Homo sapiens
tcccctccttctcccttt

SEQ ID NO: 3792729 - DNA, 18 bp, Homo sapiens
tcccctccttgcctcctg

SEQ ID NO: 3792730 - DNA, 21 bp, Homo sapiens
tcccctccttgcctcctgtgt

SEQ ID NO: 3792731 - DNA, 17 bp, Homo sapiens
tcccctctatttagcat

SEQ ID NO: 3792732 - DNA, 16 bp, Homo sapiens
tcccctgccctgctgc

SEQ ID NO: 3792733 - DNA, 19 bp, Homo sapiens
tcccctgtagagtgggagc

SEQ ID NO: 3792734 - DNA, 17 bp, Homo sapiens
tccccttgcccagggct

SEQ ID NO: 3792735 - DNA, 16 bp, Homo sapiens
tcccctttcgcccaca

SEQ ID NO: 3792736 - DNA, 22 bp, Homo sapiens
tctaatagaactcagttttaac

SEQ ID NO: 3792737 - DNA, 21 bp, Homo sapiens
tctaattcccattttgcaaaa

SEQ ID NO: 3792738 - DNA, 22 bp, Homo sapiens
tctaatttatcttgtctctggg

SEQ ID NO: 3792739 - DNA, 23 bp, Homo sapiens
tctaatttatcttgtctctgggc

SEQ ID NO: 3792740 - DNA, 15 bp, Homo sapiens
tctacactcatctta

SEQ ID NO: 3792741 - DNA, 11 bp, Homo sapiens
tctacactctc

SEQ ID NO: 3792742 - DNA, 14 bp, Homo sapiens
tctacactctcctg

SEQ ID NO: 3792743 - DNA, 18 bp, Homo sapiens
tctacactctcctgggcc

SEQ ID NO: 3792744 - DNA, 16 bp, Homo sapiens
tctacagacttctcca

SEQ ID NO: 3792745 - DNA, 15 bp, Homo sapiens
tctacagaggccatg

SEQ ID NO: 3792746 - DNA, 16 bp, Homo sapiens
tctacagatgtcccat

SEQ ID NO: 3792747 - DNA, 16 bp, Homo sapiens
tctacagcaaatttat

SEQ ID NO: 3792748 - DNA, 22 bp, Homo sapiens
tctacagcaaatttataatttt

SEQ ID NO: 3792749 - DNA, 15 bp, Homo sapiens
tctacatattcttta

SEQ ID NO: 3792750 - DNA, 15 bp, Homo sapiens
tctaccaactggaag

SEQ ID NO: 3792751 - DNA, 12 bp, Homo sapiens
tctaccatctcc

SEQ ID NO: 3792752 - DNA, 18 bp, Homo sapiens
tctaccatttcagagagg

SEQ ID NO: 3792753 - DNA, 12 bp, Homo sapiens
tctacccagccc

SEQ ID NO: 3792754 - DNA, 15 bp, Homo sapiens
tctacccagcccatc

SEQ ID NO: 3792755 - DNA, 19 bp, Homo sapiens
tctacccagcgagccctgg

SEQ ID NO: 3792756 - DNA, 15 bp, Homo sapiens
tctacccatattaca

SEQ ID NO: 3792757 - DNA, 21 bp, Homo sapiens
tctaccctcttagaaaaacca

SEQ ID NO: 3792758 - DNA, 19 bp, Homo sapiens
tctaccctggcactataat

SEQ ID NO: 3792759 - DNA, 21 bp, Homo sapiens
tctaccctggcactataatgt

SEQ ID NO: 3792760 - DNA, 16 bp, Homo sapiens
tctaccttgaggtctt

SEQ ID NO: 3792761 - DNA, 17 bp, Homo sapiens
tctaccttgaggtcttt

SEQ ID NO: 3792762 - DNA, 20 bp, Homo sapiens
tctactaaaaatacaaaaat

SEQ ID NO: 3792763 - DNA, 19 bp, Homo sapiens
tctactcctacctcagcct

SEQ ID NO: 3792764 - DNA, 19 bp, Homo sapiens
tctactgaggtgctatgtt

SEQ ID NO: 3792765 - DNA, 16 bp, Homo sapiens
tctactggtcttgtgg

SEQ ID NO: 3792766 - DNA, 20 bp, Homo sapiens
tctactggtcttgtggaatt

SEQ ID NO: 3792767 - DNA, 17 bp, Homo sapiens
tctagaacacaggcaaa

SEQ ID NO: 3792768 - DNA, 18 bp, Homo sapiens
tctagaacttgaccccct

SEQ ID NO: 3792769 - DNA, 14 bp, Homo sapiens
tctagaagaaatga

SEQ ID NO: 3792770 - DNA, 15 bp, Homo sapiens
tctagaagaaatgaa

SEQ ID NO: 3792771 - DNA, 16 bp, Homo sapiens
tctagaagaaatgaaa

SEQ ID NO: 3792772 - DNA, 13 bp, Homo sapiens
tctagacaaccct

SEQ ID NO: 3792773 - DNA, 16 bp, Homo sapiens
tctagagatagtacat

SEQ ID NO: 3792774 - DNA, 20 bp, Homo sapiens
tctagagatagtacataaag

SEQ ID NO: 3792775 - DNA, 19 bp, Homo sapiens
tctagagcctgctggatct

SEQ ID NO: 3792776 - DNA, 12 bp, Homo sapiens
tctagcatgaag

SEQ ID NO: 3792777 - DNA, 20 bp, Homo sapiens
tctagctaatggaaaatgat

SEQ ID NO: 3792778 - DNA, 12 bp, Homo sapiens
tctagggaaaaa

SEQ ID NO: 3792779 - DNA, 23 bp, Homo sapiens
tctagggatagtcaccttttaaa

SEQ ID NO: 3792780 - DNA, 23 bp, Homo sapiens
tctaggttctaaaaattgtgatc

SEQ ID NO: 3792781 - DNA, 14 bp, Homo sapiens
tctagtgcagctga

SEQ ID NO: 3792782 - DNA, 21 bp, Homo sapiens
tctagttcctgatgacccagg

SEQ ID NO: 3792783 - DNA, 20 bp, Homo sapiens
tctagttgaggagtttccta

SEQ ID NO: 3792784 - DNA, 13 bp, Homo sapiens
tctagttttgtca

SEQ ID NO: 3792785 - DNA, 21 bp, Homo sapiens
tctataggaacatatgaaaat

SEQ ID NO: 3792786 - DNA, 17 bp, Homo sapiens
tctattgggttcattat

SEQ ID NO: 3792787 - DNA, 13 bp, Homo sapiens
tctatttaaattc

SEQ ID NO: 3792788 - DNA, 17 bp, Homo sapiens
tctatttaaattctttt

SEQ ID NO: 3792789 - DNA, 13 bp, Homo sapiens
tctatttattgga

SEQ ID NO: 3792790 - DNA, 15 bp, Homo sapiens
tctatttatttactg

SEQ ID NO: 3792791 - DNA, 12 bp, Homo sapiens
tctatttctgag

SEQ ID NO: 3792792 - DNA, 13 bp, Homo sapiens
tctatttctgaga

SEQ ID NO: 3792793 - DNA, 22 bp, Homo sapiens
tctcaaacggtacacagactat

SEQ ID NO: 3792794 - DNA, 22 bp, Homo sapiens
tctcaagccgcatcccagactt

SEQ ID NO: 3792795 - DNA, 20 bp, Homo sapiens
tctcaaggtgggccttgcta

SEQ ID NO: 3792796 - DNA, 18 bp, Homo sapiens
tctcacagcacactcagc

SEQ ID NO: 3792797 - DNA, 19 bp, Homo sapiens
tctcaccccatcccacacc

SEQ ID NO: 3792798 - DNA, 17 bp, Homo sapiens
tctcactatgttgccca

SEQ ID NO: 3792799 - DNA, 21 bp, Homo sapiens
tctcactatgttgcccaggca

SEQ ID NO: 3792800 - DNA, 13 bp, Homo sapiens
tctcactccacca

SEQ ID NO: 3792801 - DNA, 18 bp, Homo sapiens
tctcactccaccacccaa

SEQ ID NO: 3792802 - DNA, 13 bp, Homo sapiens
tctcactcccctc

SEQ ID NO: 3792803 - DNA, 20 bp, Homo sapiens
tctcactcccttctccttga

SEQ ID NO: 3792804 - DNA, 17 bp, Homo sapiens
tctcactcctacctggt

SEQ ID NO: 3792805 - DNA, 18 bp, Homo sapiens
tctcactctgtcgcccag

SEQ ID NO: 3792806 - DNA, 17 bp, Homo sapiens
tctcactgttgcccagg

SEQ ID NO: 3792807 - DNA, 18 bp, Homo sapiens
tctcactgttgcccaggc

SEQ ID NO: 3792808 - DNA, 21 bp, Homo sapiens
tctcactgttgcccaggctgg

SEQ ID NO: 3792809 - DNA, 17 bp, Homo sapiens
tctcacttttctccatg

SEQ ID NO: 3792810 - DNA, 17 bp, Homo sapiens
tctcagaatctcaaata

SEQ ID NO: 3792811 - DNA, 21 bp, Homo sapiens
tctcagaatctcaaataacta

SEQ ID NO: 3792812 - DNA, 16 bp, Homo sapiens
tctcagaatctttcct

SEQ ID NO: 3792813 - DNA, 16 bp, Homo sapiens
tctcagatatttatat

SEQ ID NO: 3792814 - DNA, 20 bp, Homo sapiens
tctcagatatttatattttt

SEQ ID NO: 3792815 - DNA, 12 bp, Homo sapiens
tctcagcctccc

SEQ ID NO: 3792816 - DNA, 13 bp, Homo sapiens
tctcagcctccca

SEQ ID NO: 3792817 - DNA, 20 bp, Homo sapiens
tctcaggatcaagaaagtgt

SEQ ID NO: 3792818 - DNA, 19 bp, Homo sapiens
tctcaggccacctgccccc

SEQ ID NO: 3792819 - DNA, 17 bp, Homo sapiens
tctcaggctctgccctg

SEQ ID NO: 3792820 - DNA, 19 bp, Homo sapiens
tctcaggctctgccctgcc

SEQ ID NO: 3792821 - DNA, 17 bp, Homo sapiens
tctcagggaagcccagc

SEQ ID NO: 3792822 - DNA, 19 bp, Homo sapiens
tctcagggaagcccagctc

SEQ ID NO: 3792823 - DNA, 12 bp, Homo sapiens
tctcagggcctg

SEQ ID NO: 3792824 - DNA, 15 bp, Homo sapiens
tctcagggcctggtc

SEQ ID NO: 3792825 - DNA, 22 bp, Homo sapiens
tctcatccccaggggtcccagc

SEQ ID NO: 3792826 - DNA, 21 bp, Homo sapiens
tctcatccttttctcctatct

SEQ ID NO: 3792827 - DNA, 17 bp, Homo sapiens
tctcatctgtgattccc

SEQ ID NO: 3792828 - DNA, 14 bp, Homo sapiens
tctcattccccagg

SEQ ID NO: 3792829 - DNA, 14 bp, Homo sapiens
tctcatttgtcaca

SEQ ID NO: 3792830 - DNA, 16 bp, Homo sapiens
tctcatttgtcacaca

SEQ ID NO: 3792831 - DNA, 12 bp, Homo sapiens
tctccaaagctt

SEQ ID NO: 3792832 - DNA, 24 bp, Homo sapiens
tctccaaatgagatctaagccttt

SEQ ID NO: 3792833 - DNA, 16 bp, Homo sapiens
tctccaccctgctctc

SEQ ID NO: 3792834 - DNA, 12 bp, Homo sapiens
tctccacctcag

SEQ ID NO: 3792835 - DNA, 14 bp, Homo sapiens
tctccacctcagcc

SEQ ID NO: 3792836 - DNA, 19 bp, Homo sapiens
tctccacctcagccttgga

SEQ ID NO: 3792837 - DNA, 16 bp, Homo sapiens
tctccaggctgtatcc

SEQ ID NO: 3792838 - DNA, 20 bp, Homo sapiens
tctccagggagcaagacaga

SEQ ID NO: 3792839 - DNA, 15 bp, Homo sapiens
tctccagtgcacctg

SEQ ID NO: 3792840 - DNA, 14 bp, Homo sapiens
tctccatatgttac

SEQ ID NO: 3792841 - DNA, 13 bp, Homo sapiens
tctccatcagctg

SEQ ID NO: 3792842 - DNA, 17 bp, Homo sapiens
tctccatcagctgtaag

SEQ ID NO: 3792843 - DNA, 12 bp, Homo sapiens
tctcccaggccc

SEQ ID NO: 3792844 - DNA, 10 bp, Homo sapiens
tctccccaca

SEQ ID NO: 3792845 - DNA, 11 bp, Homo sapiens
tctccccacac

SEQ ID NO: 3792846 - DNA, 23 bp, Homo sapiens
tctccccagcaagtgagagctgg

SEQ ID NO: 3792847 - DNA, 13 bp, Homo sapiens
tctccccctgggc

SEQ ID NO: 3792848 - DNA, 12 bp, Homo sapiens
tctcccctctta

SEQ ID NO: 3792849 - DNA, 20 bp, Homo sapiens
tctcccgggaagccaccctc

SEQ ID NO: 3792850 - DNA, 18 bp, Homo sapiens
tcttgttttttttttcca

SEQ ID NO: 3792851 - DNA, 21 bp, Homo sapiens
tcttgttttttttttccactt

SEQ ID NO: 3792852 - DNA, 21 bp, Homo sapiens
tctttaaccagtctgaagttt

SEQ ID NO: 3792853 - DNA, 22 bp, Homo sapiens
tctttaatgtcacaggcaggtc

SEQ ID NO: 3792854 - DNA, 16 bp, Homo sapiens
tctttatatgaacata

SEQ ID NO: 3792855 - DNA, 18 bp, Homo sapiens
tctttcaaattgagagaa

SEQ ID NO: 3792856 - DNA, 22 bp, Homo sapiens
tctttcaaattgagagaatgga

SEQ ID NO: 3792857 - DNA, 19 bp, Homo sapiens
tctttcaagtgaatctaaa

SEQ ID NO: 3792858 - DNA, 21 bp, Homo sapiens
tctttcacacttccaccagcc

SEQ ID NO: 3792859 - DNA, 16 bp, Homo sapiens
tctttcagaaaacaga

SEQ ID NO: 3792860 - DNA, 19 bp, Homo sapiens
tctttccattatgattctt

SEQ ID NO: 3792861 - DNA, 12 bp, Homo sapiens
tctttccctccc

SEQ ID NO: 3792862 - DNA, 13 bp, Homo sapiens
tctttccctccct

SEQ ID NO: 3792863 - DNA, 21 bp, Homo sapiens
tctttctaactccagtgaagt

SEQ ID NO: 3792864 - DNA, 18 bp, Homo sapiens
tctttctaatgtgtgaat

SEQ ID NO: 3792865 - DNA, 19 bp, Homo sapiens
tctttctaatgtgtgaatc

SEQ ID NO: 3792866 - DNA, 18 bp, Homo sapiens
tctttctccttagtcttc

SEQ ID NO: 3792867 - DNA, 18 bp, Homo sapiens
tctttctggcctgccttc

SEQ ID NO: 3792868 - DNA, 14 bp, Homo sapiens
tctttcttcctctg

SEQ ID NO: 3792869 - DNA, 22 bp, Homo sapiens
tctttgacaattcctagataaa

SEQ ID NO: 3792870 - DNA, 22 bp, Homo sapiens
tctttgagatagaagaactgca

SEQ ID NO: 3792871 - DNA, 13 bp, Homo sapiens
tctttgcagacag

SEQ ID NO: 3792872 - DNA, 14 bp, Homo sapiens
tctttgccttgggc

SEQ ID NO: 3792873 - DNA, 20 bp, Homo sapiens
tctttgccttgggctgctcc

SEQ ID NO: 3792874 - DNA, 21 bp, Homo sapiens
tctttgccttgggctgctcct

SEQ ID NO: 3792875 - DNA, 19 bp, Homo sapiens
tctttgcttgaacacagta

SEQ ID NO: 3792876 - DNA, 15 bp, Homo sapiens
tctttggtgcctttc

SEQ ID NO: 3792877 - DNA, 18 bp, Homo sapiens
tctttggtgcctttcctg

SEQ ID NO: 3792878 - DNA, 23 bp, Homo sapiens
tctttgtaatcgttatgtgtgta

SEQ ID NO: 3792879 - DNA, 18 bp, Homo sapiens
tctttgttaagactgctg

SEQ ID NO: 3792880 - DNA, 18 bp, Homo sapiens
tcttttcccccaaagtgg

SEQ ID NO: 3792881 - DNA, 22 bp, Homo sapiens
tcttttcgccgtggctgcggca

SEQ ID NO: 3792882 - DNA, 19 bp, Homo sapiens
tcttttctacagcaaattt

SEQ ID NO: 3792883 - DNA, 15 bp, Homo sapiens
tcttttgacatgtgg

SEQ ID NO: 3792884 - DNA, 17 bp, Homo sapiens
tcttttgacatgtggaa

SEQ ID NO: 3792885 - DNA, 22 bp, Homo sapiens
tctttttattgatgtgcaaaaa

SEQ ID NO: 3792886 - DNA, 21 bp, Homo sapiens
tctttttattttttaattatt

SEQ ID NO: 3792887 - DNA, 15 bp, Homo sapiens
tcttttttagcataa

SEQ ID NO: 3792888 - DNA, 16 bp, Homo sapiens
tcttttttagcataaa

SEQ ID NO: 3792889 - DNA, 18 bp, Homo sapiens
tgaaaaatcggcttacca

SEQ ID NO: 3792890 - DNA, 13 bp, Homo sapiens
tgaaaaattctca

SEQ ID NO: 3792891 - DNA, 20 bp, Homo sapiens
tgaaaaatttaagcattgtt

SEQ ID NO: 3792892 - DNA, 16 bp, Homo sapiens
tgaaaacccagagagg

SEQ ID NO: 3792893 - DNA, 15 bp, Homo sapiens
tgaaaactacatttt

SEQ ID NO: 3792894 - DNA, 20 bp, Homo sapiens
tgaaaactacattttaacat

SEQ ID NO: 3792895 - DNA, 21 bp, Homo sapiens
tgaaaactacattttaacatg

SEQ ID NO: 3792896 - DNA, 16 bp, Homo sapiens
tgaaaagatgttgtgt

SEQ ID NO: 3792897 - DNA, 12 bp, Homo sapiens
tgaaaatacaac

SEQ ID NO: 3792898 - DNA, 23 bp, Homo sapiens
tgaaaatacaacttaaataataa

SEQ ID NO: 3792899 - DNA, 16 bp, Homo sapiens
tgaaaatcgtgacaac

SEQ ID NO: 3792900 - DNA, 16 bp, Homo sapiens
tgaaaattaacactgc

SEQ ID NO: 3792901 - DNA, 22 bp, Homo sapiens
tgaaacacaccaggctgtgggc

SEQ ID NO: 3792902 - DNA, 16 bp, Homo sapiens
tgaaacagaaacaaaa

SEQ ID NO: 3792903 - DNA, 20 bp, Homo sapiens
tgaaactagacttgaggaaa

SEQ ID NO: 3792904 - DNA, 16 bp, Homo sapiens
tgaaacttacacacaa

SEQ ID NO: 3792905 - DNA, 20 bp, Homo sapiens
tgaaagaaaatatgcatcta

SEQ ID NO: 3792906 - DNA, 14 bp, Homo sapiens
tgaaagaaacagtt

SEQ ID NO: 3792907 - DNA, 22 bp, Homo sapiens
tgaaagaaacagttaactttca

SEQ ID NO: 3792908 - DNA, 13 bp, Homo sapiens
tgaaagagaacca

SEQ ID NO: 3792909 - DNA, 16 bp, Homo sapiens
tgaaagagaaccagtt

SEQ ID NO: 3792910 - DNA, 16 bp, Homo sapiens
tgaaagagttaagaat

SEQ ID NO: 3792911 - DNA, 18 bp, Homo sapiens
tgaaagatggctgtgcct

SEQ ID NO: 3792912 - DNA, 22 bp, Homo sapiens
tgaaagatggctgtgcctctgc

SEQ ID NO: 3792913 - DNA, 18 bp, Homo sapiens
tgaaagccctgagctttc

SEQ ID NO: 3792914 - DNA, 17 bp, Homo sapiens
tgaaagggcccagagag

SEQ ID NO: 3792915 - DNA, 18 bp, Homo sapiens
tgaaagggcccagagagg

SEQ ID NO: 3792916 - DNA, 15 bp, Homo sapiens
tgaaagtcagatgcc

SEQ ID NO: 3792917 - DNA, 17 bp, Homo sapiens
tgaaagtcatgaacaca

SEQ ID NO: 3792918 - DNA, 18 bp, Homo sapiens
tgaaagtcatgaacacat

SEQ ID NO: 3792919 - DNA, 19 bp, Homo sapiens
tgaaagtcatgaacacatc

SEQ ID NO: 3792920 - DNA, 23 bp, Homo sapiens
tgaaagtcttgtgactagtgctg

SEQ ID NO: 3792921 - DNA, 11 bp, Homo sapiens
tgaaagtgact

SEQ ID NO: 3792922 - DNA, 14 bp, Homo sapiens
tgaaataccagtgt

SEQ ID NO: 3792923 - DNA, 16 bp, Homo sapiens
tgaaataccagtgtgg

SEQ ID NO: 3792924 - DNA, 16 bp, Homo sapiens
tgaaatagtctgtgtg

SEQ ID NO: 3792925 - DNA, 17 bp, Homo sapiens
tgaaatagtctgtgtga

SEQ ID NO: 3792926 - DNA, 20 bp, Homo sapiens
tgaaatcctcaattcatcaa

SEQ ID NO: 3792927 - DNA, 13 bp, Homo sapiens
tgaaatctgtgca

SEQ ID NO: 3792928 - DNA, 19 bp, Homo sapiens
tgaaatgaggtcagagcct

SEQ ID NO: 3792929 - DNA, 19 bp, Homo sapiens
tgaaatgcagagtcaatga

SEQ ID NO: 3792930 - DNA, 15 bp, Homo sapiens
tgaaatgccttactt

SEQ ID NO: 3792931 - DNA, 16 bp, Homo sapiens
tgaaatgctctccttt

SEQ ID NO: 3792932 - DNA, 17 bp, Homo sapiens
tgaaatgctctcctttc

SEQ ID NO: 3792933 - DNA, 20 bp, Homo sapiens
tgaaattactacaaaatttg

SEQ ID NO: 3792934 - DNA, 18 bp, Homo sapiens
tgaaattgtttaagtgtt

SEQ ID NO: 3792935 - DNA, 12 bp, Homo sapiens
tgaaatttcaga

SEQ ID NO: 3792936 - DNA, 15 bp, Homo sapiens
tgaaattttaccaag

SEQ ID NO: 3792937 - DNA, 17 bp, Homo sapiens
tgaaattttaccaagtt

SEQ ID NO: 3792938 - DNA, 19 bp, Homo sapiens
tgaaatttttattaaatta

SEQ ID NO: 3792939 - DNA, 14 bp, Homo sapiens
tgaacaaaaaaatg

SEQ ID NO: 3792940 - DNA, 14 bp, Homo sapiens
tgaacaagaattgg

SEQ ID NO: 3792941 - DNA, 20 bp, Homo sapiens
tgaacaagttgtttcattga

SEQ ID NO: 3792942 - DNA, 22 bp, Homo sapiens
tgaacaagttgtttcattgact

SEQ ID NO: 3792943 - DNA, 13 bp, Homo sapiens
tgaacacagtatt

SEQ ID NO: 3792944 - DNA, 19 bp, Homo sapiens
tgaacacagtattttccca

SEQ ID NO: 3792945 - DNA, 18 bp, Homo sapiens
tgaacacatcagctagca

SEQ ID NO: 3792946 - DNA, 20 bp, Homo sapiens
tgaacacatcagctagcaaa

SEQ ID NO: 3792947 - DNA, 22 bp, Homo sapiens
tgaacactgggggaggggacat

SEQ ID NO: 3792948 - DNA, 15 bp, Homo sapiens
tgaacacttattgct

SEQ ID NO: 3792949 - DNA, 19 bp, Homo sapiens
tgaacatttgggtaaatca

SEQ ID NO: 3792950 - DNA, 21 bp, Homo sapiens
tgaaccaaaacattccgttta

SEQ ID NO: 3792951 - DNA, 20 bp, Homo sapiens
tgaaccacatcttgctctgc

SEQ ID NO: 3792952 - DNA, 21 bp, Homo sapiens
tgaaccacatcttgctctgct

SEQ ID NO: 3792953 - DNA, 21 bp, Homo sapiens
tgaaccaccacacccagccca

SEQ ID NO: 3792954 - DNA, 14 bp, Homo sapiens
tgaacccaggaggt

SEQ ID NO: 3792955 - DNA, 15 bp, Homo sapiens
tgaacggtgagcatt

SEQ ID NO: 3792956 - DNA, 15 bp, Homo sapiens
tgaactaatttctgt

SEQ ID NO: 3792957 - DNA, 19 bp, Homo sapiens
tgaactagctggaattttt

SEQ ID NO: 3792958 - DNA, 14 bp, Homo sapiens
tgaactcctggcct

SEQ ID NO: 3792959 - DNA, 16 bp, Homo sapiens
tgaactcctggcctca

SEQ ID NO: 3792960 - DNA, 17 bp, Homo sapiens
tgaactcctggcctcaa

SEQ ID NO: 3792961 - DNA, 15 bp, Homo sapiens
tgaactcttcaatct

SEQ ID NO: 3792962 - DNA, 14 bp, Homo sapiens
tgaactctttctgg

SEQ ID NO: 3792963 - DNA, 21 bp, Homo sapiens
tgatacttttgacaacaaatt

SEQ ID NO: 3792964 - DNA, 18 bp, Homo sapiens
tgatataatttccatagt

SEQ ID NO: 3792965 - DNA, 11 bp, Homo sapiens
tgatatgaaaa

SEQ ID NO: 3792966 - DNA, 20 bp, Homo sapiens
tgatattccatgaatgtatc

SEQ ID NO: 3792967 - DNA, 22 bp, Homo sapiens
tgatattccatgaatgtatcag

SEQ ID NO: 3792968 - DNA, 19 bp, Homo sapiens
tgatatttattatattttt

SEQ ID NO: 3792969 - DNA, 14 bp, Homo sapiens
tgatcacggctcac

SEQ ID NO: 3792970 - DNA, 15 bp, Homo sapiens
tgatcacggctcact

SEQ ID NO: 3792971 - DNA, 18 bp, Homo sapiens
tgatcacggctcactgca

SEQ ID NO: 3792972 - DNA, 20 bp, Homo sapiens
tgatcacggctcactgcagc

SEQ ID NO: 3792973 - DNA, 16 bp, Homo sapiens
tgatcagctgtttgtc

SEQ ID NO: 3792974 - DNA, 17 bp, Homo sapiens
tgatcagctgtttgtca

SEQ ID NO: 3792975 - DNA, 17 bp, Homo sapiens
tgatcattttcccccca

SEQ ID NO: 3792976 - DNA, 22 bp, Homo sapiens
tgatcattttccccccactctc

SEQ ID NO: 3792977 - DNA, 13 bp, Homo sapiens
tgatccaagctgg

SEQ ID NO: 3792978 - DNA, 17 bp, Homo sapiens
tgatccaagctggtccc

SEQ ID NO: 3792979 - DNA, 16 bp, Homo sapiens
tgatccacccacctca

SEQ ID NO: 3792980 - DNA, 22 bp, Homo sapiens
tgatccacccacctcagcctcc

SEQ ID NO: 3792981 - DNA, 18 bp, Homo sapiens
tgatccatccatctccag

SEQ ID NO: 3792982 - DNA, 21 bp, Homo sapiens
tgatccatgagtttgccctgg

SEQ ID NO: 3792983 - DNA, 19 bp, Homo sapiens
tgatcctcccacctcagcc

SEQ ID NO: 3792984 - DNA, 21 bp, Homo sapiens
tgatcctcccacctcagcctc

SEQ ID NO: 3792985 - DNA, 14 bp, Homo sapiens
tgatctcagggaag

SEQ ID NO: 3792986 - DNA, 21 bp, Homo sapiens
tgatctccatatgttacacta

SEQ ID NO: 3792987 - DNA, 15 bp, Homo sapiens
tgatctccctgccgc

SEQ ID NO: 3792988 - DNA, 18 bp, Homo sapiens
tgatctgggaactcccaa

SEQ ID NO: 3792989 - DNA, 20 bp, Homo sapiens
tgatcttctttataattcta

SEQ ID NO: 3792990 - DNA, 21 bp, Homo sapiens
tgatcttggcttactgcagcc

SEQ ID NO: 3792991 - DNA, 15 bp, Homo sapiens
tgatcttgtgctcag

SEQ ID NO: 3792992 - DNA, 16 bp, Homo sapiens
tgatcttgtgctcagc

SEQ ID NO: 3792993 - DNA, 20 bp, Homo sapiens
tgatctttgcagacaggcaa

SEQ ID NO: 3792994 - DNA, 15 bp, Homo sapiens
tgatgaaaaatagca

SEQ ID NO: 3792995 - DNA, 13 bp, Homo sapiens
tgatgaaagctga

SEQ ID NO: 3792996 - DNA, 14 bp, Homo sapiens
tgatgacagacact

SEQ ID NO: 3792997 - DNA, 22 bp, Homo sapiens
tgatgacccaggctgcctgagc

SEQ ID NO: 3792998 - DNA, 23 bp, Homo sapiens
tgatgactggaatttttattatg

SEQ ID NO: 3792999 - DNA, 20 bp, Homo sapiens
tgatgatcctaggcatttgc

SEQ ID NO: 3793000 - DNA, 20 bp, Homo sapiens
tgatgatctttgcagacagg

SEQ ID NO: 3793001 - DNA, 21 bp, Homo sapiens
tgatgatctttgcagacaggc

SEQ ID NO: 3793002 - DNA, 23 bp, Homo sapiens
tgatgatctttgcagacaggcaa

SEQ ID NO: 3793003 - DNA, 14 bp, Homo sapiens
tgatgcacatttca

SEQ ID NO: 3793004 - DNA, 14 bp, Homo sapiens
tgatgcctccctgt

SEQ ID NO: 3793005 - DNA, 11 bp, Homo sapiens
tgatgctaaat

SEQ ID NO: 3793006 - DNA, 20 bp, Homo sapiens
tgatgctccctcccctgccc

SEQ ID NO: 3793007 - DNA, 17 bp, Homo sapiens
tgatggcaattttgtaa

SEQ ID NO: 3793008 - DNA, 14 bp, Homo sapiens
tgatggggaaggag

SEQ ID NO: 3793009 - DNA, 15 bp, Homo sapiens
tgatggtcagacaca

SEQ ID NO: 3793010 - DNA, 17 bp, Homo sapiens
tgatggtgatgaaatgt

SEQ ID NO: 3793011 - DNA, 21 bp, Homo sapiens
tgatgtaaatgaagtaacttg

SEQ ID NO: 3793012 - DNA, 18 bp, Homo sapiens
tgatgtaccatgaaacaa

SEQ ID NO: 3793013 - DNA, 20 bp, Homo sapiens
tgatgtagggtaaggtgcct

SEQ ID NO: 3793014 - DNA, 16 bp, Homo sapiens
tgatgtgcaaaaattt

SEQ ID NO: 3793015 - DNA, 16 bp, Homo sapiens
tgatgtggcaactgct

SEQ ID NO: 3793016 - DNA, 18 bp, Homo sapiens
tgatgtgggtcaaggaat

SEQ ID NO: 3793017 - DNA, 22 bp, Homo sapiens
tgatgttaaccagaataaagtt

SEQ ID NO: 3793018 - DNA, 11 bp, Homo sapiens
tgatgtttgtg

SEQ ID NO: 3793019 - DNA, 18 bp, Homo sapiens
tgatgtttgtggcctcag

SEQ ID NO: 3793020 - DNA, 20 bp, Homo sapiens
tgatgtttgtggcctcagaa

SEQ ID NO: 3793021 - DNA, 18 bp, Homo sapiens
tgatgttttcctataata

SEQ ID NO: 3793022 - DNA, 20 bp, Homo sapiens
tgattaaccacttcagctga

SEQ ID NO: 3793023 - DNA, 20 bp, Homo sapiens
tgattaaggtctctctttgg

SEQ ID NO: 3793024 - DNA, 22 bp, Homo sapiens
tgattaaggtctctctttggac

SEQ ID NO: 3793025 - DNA, 14 bp, Homo sapiens
tgattactgtcaat

SEQ ID NO: 3793026 - DNA, 17 bp, Homo sapiens
tgattactgtcaataaa

SEQ ID NO: 3793027 - DNA, 18 bp, Homo sapiens
tgattactgtcaataaac

SEQ ID NO: 3793028 - DNA, 16 bp, Homo sapiens
tgattagtaaagaaat

SEQ ID NO: 3793029 - DNA, 17 bp, Homo sapiens
tgattagtaaagaaatg

SEQ ID NO: 3793030 - DNA, 15 bp, Homo sapiens
tgattatgactgttt

SEQ ID NO: 3793031 - DNA, 21 bp, Homo sapiens
tgattcgcccaaagccagaca

SEQ ID NO: 3793032 - DNA, 13 bp, Homo sapiens
tgattctcctgcc

SEQ ID NO: 3793033 - DNA, 13 bp, Homo sapiens
tgattctgtgtgt

SEQ ID NO: 3793034 - DNA, 15 bp, Homo sapiens
tgattctgtgtgttt

SEQ ID NO: 3793035 - DNA, 19 bp, Homo sapiens
tgattctttgttacaggca

SEQ ID NO: 3793036 - DNA, 22 bp, Homo sapiens
tgattgctgtgtccaactccag

SEQ ID NO: 3793037 - DNA, 16 bp, Homo sapiens
tgattgtttgctctga

SEQ ID NO: 3793038 - DNA, 16 bp, Homo sapiens
tgatttatcacacaaa

SEQ ID NO: 3793039 - DNA, 19 bp, Homo sapiens
tgatttcaggatactctgt

SEQ ID NO: 3793040 - DNA, 21 bp, Homo sapiens
tgatttcagtgctgctgaact

SEQ ID NO: 3793041 - DNA, 15 bp, Homo sapiens
tgatttcattaatac

SEQ ID NO: 3793042 - DNA, 16 bp, Homo sapiens
tgatttgttttagaat

SEQ ID NO: 3793043 - DNA, 16 bp, Homo sapiens
tgattttaacaataac

SEQ ID NO: 3793044 - DNA, 19 bp, Homo sapiens
tgattttacaattgaaatg

SEQ ID NO: 3793045 - DNA, 13 bp, Homo sapiens
tgattttcattgc

SEQ ID NO: 3793046 - DNA, 15 bp, Homo sapiens
tgattttcattgctg

SEQ ID NO: 3793047 - DNA, 14 bp, Homo sapiens
tgatttttatccaa

SEQ ID NO: 3793048 - DNA, 13 bp, Homo sapiens
tgatttttttcca

SEQ ID NO: 3793049 - DNA, 17 bp, Homo sapiens
tgcaaaatgagaccctc

SEQ ID NO: 3793050 - DNA, 14 bp, Homo sapiens
tgcaaaatttccag

SEQ ID NO: 3793051 - DNA, 21 bp, Homo sapiens
tgcaaaatttccagtaccttt

SEQ ID NO: 3793052 - DNA, 16 bp, Homo sapiens
tgcaaagaaaatcaga

SEQ ID NO: 3793053 - DNA, 13 bp, Homo sapiens
tgcaaagaggcaa

SEQ ID NO: 3793054 - DNA, 21 bp, Homo sapiens
tgcaaatgctatgagatgcat

SEQ ID NO: 3793055 - DNA, 22 bp, Homo sapiens
tgcaaatggtggttgtttcttc

SEQ ID NO: 3793056 - DNA, 14 bp, Homo sapiens
tgcaacaggctggg

SEQ ID NO: 3793057 - DNA, 17 bp, Homo sapiens
tgcaacaggctgggctt

SEQ ID NO: 3793058 - DNA, 17 bp, Homo sapiens
tgcaacccttacccctt

SEQ ID NO: 3793059 - DNA, 18 bp, Homo sapiens
tgcaacctccgcctcttg

SEQ ID NO: 3793060 - DNA, 16 bp, Homo sapiens
tgcaacttgtaaatgt

SEQ ID NO: 3793061 - DNA, 14 bp, Homo sapiens
tgcaagagccttgg

SEQ ID NO: 3793062 - DNA, 19 bp, Homo sapiens
tgcaaggaaggaaagaaag

SEQ ID NO: 3793063 - DNA, 14 bp, Homo sapiens
tgcaaggaccagga

SEQ ID NO: 3793064 - DNA, 15 bp, Homo sapiens
tgcaaggaccaggac

SEQ ID NO: 3793065 - DNA, 24 bp, Homo sapiens
tgcaaggccgctgttcacccacag

SEQ ID NO: 3793066 - DNA, 15 bp, Homo sapiens
tgcaagtactgctgt

SEQ ID NO: 3793067 - DNA, 21 bp, Homo sapiens
tgcaagtatgttttagcatgt

SEQ ID NO: 3793068 - DNA, 22 bp, Homo sapiens
tgcaagtgagcaaacctgcccc

SEQ ID NO: 3793069 - DNA, 17 bp, Homo sapiens
tgcaagtgtctgtgtgc

SEQ ID NO: 3793070 - DNA, 22 bp, Homo sapiens
tgcaagtgtgtatgtgcgtgtg

SEQ ID NO: 3793071 - DNA, 21 bp, Homo sapiens
tgcaagtgtgtgcacatgtgt

SEQ ID NO: 3793072 - DNA, 14 bp, Homo sapiens
tgcaatagagactg

SEQ ID NO: 3793073 - DNA, 15 bp, Homo sapiens
tgcaatgaaggaaat

SEQ ID NO: 3793074 - DNA, 15 bp, Homo sapiens
tgcaatggcagcctt

SEQ ID NO: 3793075 - DNA, 16 bp, Homo sapiens
tgcaatggcagccttg

SEQ ID NO: 3793076 - DNA, 12 bp, Homo sapiens
tgctgctgctgc

SEQ ID NO: 3793077 - DNA, 16 bp, Homo sapiens
tgctgcttccctctgc

SEQ ID NO: 3793078 - DNA, 12 bp, Homo sapiens
tgctgcttgagg

SEQ ID NO: 3793079 - DNA, 19 bp, Homo sapiens
tgctggacaggtctgggag

SEQ ID NO: 3793080 - DNA, 14 bp, Homo sapiens
tgctggactgtcat

SEQ ID NO: 3793081 - DNA, 15 bp, Homo sapiens
tgctggactgtcata

SEQ ID NO: 3793082 - DNA, 13 bp, Homo sapiens
tgctggagcggct

SEQ ID NO: 3793083 - DNA, 17 bp, Homo sapiens
tgctggataaaatgagg

SEQ ID NO: 3793084 - DNA, 16 bp, Homo sapiens
tgctggatattttcaa

SEQ ID NO: 3793085 - DNA, 18 bp, Homo sapiens
tgctggccgggcacagct

SEQ ID NO: 3793086 - DNA, 15 bp, Homo sapiens
tgctggctcccaggg

SEQ ID NO: 3793087 - DNA, 21 bp, Homo sapiens
tgctggctgcccagacccctc

SEQ ID NO: 3793088 - DNA, 18 bp, Homo sapiens
tgctggctgttggctggg

SEQ ID NO: 3793089 - DNA, 19 bp, Homo sapiens
tgctgggattacaagcgtg

SEQ ID NO: 3793090 - DNA, 15 bp, Homo sapiens
tgctgggctctccac

SEQ ID NO: 3793091 - DNA, 18 bp, Homo sapiens
tgctgggctctccacctc

SEQ ID NO: 3793092 - DNA, 18 bp, Homo sapiens
tgctggtgagccaagcag

SEQ ID NO: 3793093 - DNA, 14 bp, Homo sapiens
tgctggttttccta

SEQ ID NO: 3793094 - DNA, 22 bp, Homo sapiens
tgctggttttcctaaatgcagt

SEQ ID NO: 3793095 - DNA, 17 bp, Homo sapiens
tgctgtaaaaactgtgg

SEQ ID NO: 3793096 - DNA, 16 bp, Homo sapiens
tgctgtcctaggccac

SEQ ID NO: 3793097 - DNA, 23 bp, Homo sapiens
tgctgtcctaggccacaccatct

SEQ ID NO: 3793098 - DNA, 14 bp, Homo sapiens
tgctgtggcctggg

SEQ ID NO: 3793099 - DNA, 15 bp, Homo sapiens
tgctgtggcctgggc

SEQ ID NO: 3793100 - DNA, 16 bp, Homo sapiens
tgctgtggcctgggca

SEQ ID NO: 3793101 - DNA, 19 bp, Homo sapiens
tgctgtgtccaactccagt

SEQ ID NO: 3793102 - DNA, 12 bp, Homo sapiens
tgctgtttcctt

SEQ ID NO: 3793103 - DNA, 14 bp, Homo sapiens
tgctgtttcctttt

SEQ ID NO: 3793104 - DNA, 17 bp, Homo sapiens
tgcttaaaaatcattga

SEQ ID NO: 3793105 - DNA, 12 bp, Homo sapiens
tgcttaatgaaa

SEQ ID NO: 3793106 - DNA, 14 bp, Homo sapiens
tgcttaatgaaaag

SEQ ID NO: 3793107 - DNA, 16 bp, Homo sapiens
tgcttactcattaaaa

SEQ ID NO: 3793108 - DNA, 23 bp, Homo sapiens
tgcttattgttccaagacattgt

SEQ ID NO: 3793109 - DNA, 15 bp, Homo sapiens
tgcttattttaaaat

SEQ ID NO: 3793110 - DNA, 12 bp, Homo sapiens
tgcttcagcctg

SEQ ID NO: 3793111 - DNA, 15 bp, Homo sapiens
tgcttcagcctgagg

SEQ ID NO: 3793112 - DNA, 22 bp, Homo sapiens
tgcttcagcctgaggctgagac

SEQ ID NO: 3793113 - DNA, 15 bp, Homo sapiens
tgcttcagcttgctt

SEQ ID NO: 3793114 - DNA, 16 bp, Homo sapiens
tgcttcatgaaaatcc

SEQ ID NO: 3793115 - DNA, 21 bp, Homo sapiens
tgcttcatgaaaatcctacca

SEQ ID NO: 3793116 - DNA, 15 bp, Homo sapiens
tgcttccaattttct

SEQ ID NO: 3793117 - DNA, 13 bp, Homo sapiens
tgcttccctctgc

SEQ ID NO: 3793118 - DNA, 12 bp, Homo sapiens
tgcttctgggaa

SEQ ID NO: 3793119 - DNA, 21 bp, Homo sapiens
tgcttcttcccttaaaattta

SEQ ID NO: 3793120 - DNA, 17 bp, Homo sapiens
tgcttgaacccaggaga

SEQ ID NO: 3793121 - DNA, 20 bp, Homo sapiens
tgcttgacataatttcactg

SEQ ID NO: 3793122 - DNA, 15 bp, Homo sapiens
tgcttgagctcagga

SEQ ID NO: 3793123 - DNA, 14 bp, Homo sapiens
tgcttgcctagggc

SEQ ID NO: 3793124 - DNA, 19 bp, Homo sapiens
tgcttgcctgcgttttgga

SEQ ID NO: 3793125 - DNA, 20 bp, Homo sapiens
tgcttgtaacaagaaaacat

SEQ ID NO: 3793126 - DNA, 21 bp, Homo sapiens
tgcttgtaacaagaaaacata

SEQ ID NO: 3793127 - DNA, 16 bp, Homo sapiens
tgcttgttccctctcc

SEQ ID NO: 3793128 - DNA, 19 bp, Homo sapiens
tgctttaattgttaagata

SEQ ID NO: 3793129 - DNA, 11 bp, Homo sapiens
tgctttactgg

SEQ ID NO: 3793130 - DNA, 17 bp, Homo sapiens
tgctttccgtggcactg

SEQ ID NO: 3793131 - DNA, 21 bp, Homo sapiens
tgctttccgtggcactgcata

SEQ ID NO: 3793132 - DNA, 12 bp, Homo sapiens
tgctttctgaaa

SEQ ID NO: 3793133 - DNA, 13 bp, Homo sapiens
tgctttctgaaat

SEQ ID NO: 3793134 - DNA, 20 bp, Homo sapiens
tgctttgaaactagacttga

SEQ ID NO: 3793135 - DNA, 17 bp, Homo sapiens
tgctttgggctgccctg

SEQ ID NO: 3793136 - DNA, 22 bp, Homo sapiens
tgcttttccttggggcaggcag

SEQ ID NO: 3793137 - DNA, 17 bp, Homo sapiens
tgctttttaagtgttaa

SEQ ID NO: 3793138 - DNA, 12 bp, Homo sapiens
tggaaaaatatt

SEQ ID NO: 3793139 - DNA, 22 bp, Homo sapiens
tggaaaaggaagactagaggct

SEQ ID NO: 3793140 - DNA, 15 bp, Homo sapiens
tggaaaataaatcaa

SEQ ID NO: 3793141 - DNA, 13 bp, Homo sapiens
tggaaacaaagtg

SEQ ID NO: 3793142 - DNA, 24 bp, Homo sapiens
tggaaacaaagtggaaggaaagat

SEQ ID NO: 3793143 - DNA, 17 bp, Homo sapiens
tggaaactgttgccaga

SEQ ID NO: 3793144 - DNA, 21 bp, Homo sapiens
tggaaactgttgccagagatg

SEQ ID NO: 3793145 - DNA, 15 bp, Homo sapiens
tggaaagcctctgct

SEQ ID NO: 3793146 - DNA, 23 bp, Homo sapiens
tggaaagggtgctgcttccctct

SEQ ID NO: 3793147 - DNA, 20 bp, Homo sapiens
tggaaagtgaatttgaatga

SEQ ID NO: 3793148 - DNA, 13 bp, Homo sapiens
tggaaataaatgt

SEQ ID NO: 3793149 - DNA, 15 bp, Homo sapiens
tggaaatattaagaa

SEQ ID NO: 3793150 - DNA, 20 bp, Homo sapiens
tggaaatattaagaaagact

SEQ ID NO: 3793151 - DNA, 15 bp, Homo sapiens
tggaaatattatgca

SEQ ID NO: 3793152 - DNA, 23 bp, Homo sapiens
tggaaatattatgcaaattccca

SEQ ID NO: 3793153 - DNA, 23 bp, Homo sapiens
tggaaccgcaggaagctgctccg

SEQ ID NO: 3793154 - DNA, 16 bp, Homo sapiens
tggaacgaactttcca

SEQ ID NO: 3793155 - DNA, 16 bp, Homo sapiens
tggaactcattcctgc

SEQ ID NO: 3793156 - DNA, 23 bp, Homo sapiens
tggaagatttgcccatttacact

SEQ ID NO: 3793157 - DNA, 14 bp, Homo sapiens
tggaagattttaaa

SEQ ID NO: 3793158 - DNA, 22 bp, Homo sapiens
tggaagcatgtaggagaatcca

SEQ ID NO: 3793159 - DNA, 19 bp, Homo sapiens
tggaagccctccttccacg

SEQ ID NO: 3793160 - DNA, 13 bp, Homo sapiens
tggaagctccgct

SEQ ID NO: 3793161 - DNA, 18 bp, Homo sapiens
tggaagctgccctgccca

SEQ ID NO: 3793162 - DNA, 15 bp, Homo sapiens
tggaagctgtgtcct

SEQ ID NO: 3793163 - DNA, 17 bp, Homo sapiens
tggaagggaagaaaagg

SEQ ID NO: 3793164 - DNA, 15 bp, Homo sapiens
tggaagggactagga

SEQ ID NO: 3793165 - DNA, 15 bp, Homo sapiens
tggaagggtttgtgg

SEQ ID NO: 3793166 - DNA, 21 bp, Homo sapiens
tggaaggtttgtatattgtca

SEQ ID NO: 3793167 - DNA, 13 bp, Homo sapiens
tggaagttttcag

SEQ ID NO: 3793168 - DNA, 14 bp, Homo sapiens
tggaataacatgta

SEQ ID NO: 3793169 - DNA, 14 bp, Homo sapiens
tggaatacagtgtt

SEQ ID NO: 3793170 - DNA, 15 bp, Homo sapiens
tggaatacatgaaat

SEQ ID NO: 3793171 - DNA, 22 bp, Homo sapiens
tggaatactaaaaatcatgaga

SEQ ID NO: 3793172 - DNA, 18 bp, Homo sapiens
tggaatataaggaaagca

SEQ ID NO: 3793173 - DNA, 21 bp, Homo sapiens
tggaatataaggaaagcaata

SEQ ID NO: 3793174 - DNA, 23 bp, Homo sapiens
tggaatattcccctatctctaga

SEQ ID NO: 3793175 - DNA, 18 bp, Homo sapiens
tggaatctagaagaaatg

SEQ ID NO: 3793176 - DNA, 23 bp, Homo sapiens
tggaatgtggcccctgaacaaga

SEQ ID NO: 3793177 - DNA, 14 bp, Homo sapiens
tggaattaaaacaa

SEQ ID NO: 3793178 - DNA, 16 bp, Homo sapiens
tggaattaaaacaatg

SEQ ID NO: 3793179 - DNA, 15 bp, Homo sapiens
tggaattttttattc

SEQ ID NO: 3793180 - DNA, 19 bp, Homo sapiens
tggacaaacccttctttta

SEQ ID NO: 3793181 - DNA, 14 bp, Homo sapiens
tggacacagctctt

SEQ ID NO: 3793182 - DNA, 15 bp, Homo sapiens
tggacacagctcttc

SEQ ID NO: 3793183 - DNA, 18 bp, Homo sapiens
tggacacagctcttctcc

SEQ ID NO: 3793184 - DNA, 21 bp, Homo sapiens
tggacacagctcttctccagg

SEQ ID NO: 3793185 - DNA, 22 bp, Homo sapiens
tggacacagctcttctccaggc

SEQ ID NO: 3793186 - DNA, 20 bp, Homo sapiens
tggacaccaggagtccctgg

SEQ ID NO: 3793187 - DNA, 21 bp, Homo sapiens
tggacagcaaaaccattgctt

SEQ ID NO: 3793188 - DNA, 18 bp, Homo sapiens
tggacaggcatgttctct

SEQ ID NO: 3793189 - DNA, 18 bp, Homo sapiens
tgggtgcccacagcccgc

SEQ ID NO: 3793190 - DNA, 17 bp, Homo sapiens
tgggtggcaccagcagc

SEQ ID NO: 3793191 - DNA, 13 bp, Homo sapiens
tgggtggggctgc

SEQ ID NO: 3793192 - DNA, 20 bp, Homo sapiens
tgggtgtattaggactggct

SEQ ID NO: 3793193 - DNA, 20 bp, Homo sapiens
tgggtgtatttattttcctc

SEQ ID NO: 3793194 - DNA, 24 bp, Homo sapiens
tgggttcaggggactcagccctga

SEQ ID NO: 3793195 - DNA, 11 bp, Homo sapiens
tgggttcatta

SEQ ID NO: 3793196 - DNA, 16 bp, Homo sapiens
tgggttcattattgga

SEQ ID NO: 3793197 - DNA, 18 bp, Homo sapiens
tgggttccaatcctggct

SEQ ID NO: 3793198 - DNA, 20 bp, Homo sapiens
tgggttccctttccttccat

SEQ ID NO: 3793199 - DNA, 17 bp, Homo sapiens
tgggttggaaaacagta

SEQ ID NO: 3793200 - DNA, 17 bp, Homo sapiens
tggtaaagatattattc

SEQ ID NO: 3793201 - DNA, 18 bp, Homo sapiens
tggtaaagatattattca

SEQ ID NO: 3793202 - DNA, 21 bp, Homo sapiens
tggtaaattagtatttattta

SEQ ID NO: 3793203 - DNA, 20 bp, Homo sapiens
tggtaagcttccaggaaaaa

SEQ ID NO: 3793204 - DNA, 13 bp, Homo sapiens
tggtaagggaaaa

SEQ ID NO: 3793205 - DNA, 16 bp, Homo sapiens
tggtaagggccaagtc

SEQ ID NO: 3793206 - DNA, 23 bp, Homo sapiens
tggtaatttatagtttatacagt

SEQ ID NO: 3793207 - DNA, 20 bp, Homo sapiens
tggtactactagatgtcttt

SEQ ID NO: 3793208 - DNA, 18 bp, Homo sapiens
tggtacttgctgctattt

SEQ ID NO: 3793209 - DNA, 19 bp, Homo sapiens
tggtacttgctgctatttt

SEQ ID NO: 3793210 - DNA, 20 bp, Homo sapiens
tggtagaattggagagtaaa

SEQ ID NO: 3793211 - DNA, 21 bp, Homo sapiens
tggtagcttttcccttctttt

SEQ ID NO: 3793212 - DNA, 20 bp, Homo sapiens
tggtagttagtagcatgttg

SEQ ID NO: 3793213 - DNA, 19 bp, Homo sapiens
tggtatggaactctctcca

SEQ ID NO: 3793214 - DNA, 19 bp, Homo sapiens
tggtatgggtttctcccag

SEQ ID NO: 3793215 - DNA, 17 bp, Homo sapiens
tggtatgtgtgtgtatg

SEQ ID NO: 3793216 - DNA, 19 bp, Homo sapiens
tggtatgtgtgtgtatgct

SEQ ID NO: 3793217 - DNA, 20 bp, Homo sapiens
tggtatttatctattgtaag

SEQ ID NO: 3793218 - DNA, 15 bp, Homo sapiens
tggtcaagattttga

SEQ ID NO: 3793219 - DNA, 22 bp, Homo sapiens
tggtcaagattttgaatgcttc

SEQ ID NO: 3793220 - DNA, 22 bp, Homo sapiens
tggtcaatccgaagtatgaggg

SEQ ID NO: 3793221 - DNA, 22 bp, Homo sapiens
tggtcacaggactctgcctcct

SEQ ID NO: 3793222 - DNA, 23 bp, Homo sapiens
tggtcaccaaatcagctgctact

SEQ ID NO: 3793223 - DNA, 22 bp, Homo sapiens
tggtcactgccatggaggcaca

SEQ ID NO: 3793224 - DNA, 16 bp, Homo sapiens
tggtcagatttgaact

SEQ ID NO: 3793225 - DNA, 22 bp, Homo sapiens
tggtcagtttggttgtgtaaga

SEQ ID NO: 3793226 - DNA, 15 bp, Homo sapiens
tggtccagcttgctc

SEQ ID NO: 3793227 - DNA, 22 bp, Homo sapiens
tggtccagcttgctcttcagtg

SEQ ID NO: 3793228 - DNA, 17 bp, Homo sapiens
tggtccagggaagctgg

SEQ ID NO: 3793229 - DNA, 13 bp, Homo sapiens
tggtcccactcag

SEQ ID NO: 3793230 - DNA, 14 bp, Homo sapiens
tggtccccaagacc

SEQ ID NO: 3793231 - DNA, 15 bp, Homo sapiens
tggtccggtgtcctt

SEQ ID NO: 3793232 - DNA, 21 bp, Homo sapiens
tggtcctaagtccctgccccc

SEQ ID NO: 3793233 - DNA, 14 bp, Homo sapiens
tggtcctcttgcca

SEQ ID NO: 3793234 - DNA, 19 bp, Homo sapiens
tggtcctgactcaacatgt

SEQ ID NO: 3793235 - DNA, 14 bp, Homo sapiens
tggtcctggggctc

SEQ ID NO: 3793236 - DNA, 19 bp, Homo sapiens
tggtcctggggctctgtgc

SEQ ID NO: 3793237 - DNA, 23 bp, Homo sapiens
tggtccttccaggcccccaccac

SEQ ID NO: 3793238 - DNA, 14 bp, Homo sapiens
tggtcgcccaggag

SEQ ID NO: 3793239 - DNA, 16 bp, Homo sapiens
tggtctcaaactcttg

SEQ ID NO: 3793240 - DNA, 12 bp, Homo sapiens
tggtctgaatgt

SEQ ID NO: 3793241 - DNA, 22 bp, Homo sapiens
tggtctgaatgttctgacatta

SEQ ID NO: 3793242 - DNA, 23 bp, Homo sapiens
tggtcttgtaagagctatacagt

SEQ ID NO: 3793243 - DNA, 16 bp, Homo sapiens
tggtcttgtggaattg

SEQ ID NO: 3793244 - DNA, 14 bp, Homo sapiens
tggtctttctggag

SEQ ID NO: 3793245 - DNA, 18 bp, Homo sapiens
tggtgacaccagcctttc

SEQ ID NO: 3793246 - DNA, 15 bp, Homo sapiens
tggtgacctctgcct

SEQ ID NO: 3793247 - DNA, 23 bp, Homo sapiens
tggtgagaactactcagggaatg

SEQ ID NO: 3793248 - DNA, 19 bp, Homo sapiens
tggtgaggcttaacaatgt

SEQ ID NO: 3793249 - DNA, 22 bp, Homo sapiens
tggtgatttagcaggaagctgt

SEQ ID NO: 3793250 - DNA, 14 bp, Homo sapiens
tggtgcaaatccta

SEQ ID NO: 3793251 - DNA, 13 bp, Homo sapiens
tggtgcattacag

SEQ ID NO: 3793252 - DNA, 22 bp, Homo sapiens
tggtgcctttcctgttcagcat

SEQ ID NO: 3793253 - DNA, 19 bp, Homo sapiens
tggtgcgggcacaataaat

SEQ ID NO: 3793254 - DNA, 18 bp, Homo sapiens
tggtggacagtcctggga

SEQ ID NO: 3793255 - DNA, 15 bp, Homo sapiens
tggtggatgtaaata

SEQ ID NO: 3793256 - DNA, 19 bp, Homo sapiens
tggtggcagattttacaaa

SEQ ID NO: 3793257 - DNA, 13 bp, Homo sapiens
tggtggcagctgc

SEQ ID NO: 3793258 - DNA, 14 bp, Homo sapiens
tggtggcagctgcg

SEQ ID NO: 3793259 - DNA, 21 bp, Homo sapiens
tggtggcccgacagcctggca

SEQ ID NO: 3793260 - DNA, 17 bp, Homo sapiens
tggtggcgcaagcctgt

SEQ ID NO: 3793261 - DNA, 18 bp, Homo sapiens
tggtgggggcctcggtgt

SEQ ID NO: 3793262 - DNA, 19 bp, Homo sapiens
tggtgggttcaggggactc

SEQ ID NO: 3793263 - DNA, 13 bp, Homo sapiens
tggtgtccacctg

SEQ ID NO: 3793264 - DNA, 13 bp, Homo sapiens
tggtgttgcagaa

SEQ ID NO: 3793265 - DNA, 17 bp, Homo sapiens
tggtgttgcagaaggtt

SEQ ID NO: 3793266 - DNA, 13 bp, Homo sapiens
tggttacactgtt

SEQ ID NO: 3793267 - DNA, 21 bp, Homo sapiens
tggttacactgttagaacact

SEQ ID NO: 3793268 - DNA, 22 bp, Homo sapiens
tggttacactgttagaacacta

SEQ ID NO: 3793269 - DNA, 19 bp, Homo sapiens
tggttacagtgcagacagg

SEQ ID NO: 3793270 - DNA, 15 bp, Homo sapiens
tggttagctcagccc

SEQ ID NO: 3793271 - DNA, 16 bp, Homo sapiens
tggttagctcagcccc

SEQ ID NO: 3793272 - DNA, 21 bp, Homo sapiens
tggttagctcagccccagccc

SEQ ID NO: 3793273 - DNA, 23 bp, Homo sapiens
tggttagctcagccccagcccag

SEQ ID NO: 3793274 - DNA, 14 bp, Homo sapiens
tggttatggagagg

SEQ ID NO: 3793275 - DNA, 16 bp, Homo sapiens
tggttcagctaagcta

SEQ ID NO: 3793276 - DNA, 20 bp, Homo sapiens
tggttcagggttggcccctg

SEQ ID NO: 3793277 - DNA, 11 bp, Homo sapiens
tggttcccctg

SEQ ID NO: 3793278 - DNA, 23 bp, Homo sapiens
tggttcccctgttcactctactt

SEQ ID NO: 3793279 - DNA, 21 bp, Homo sapiens
tggttccctttgctccacccc

SEQ ID NO: 3793280 - DNA, 20 bp, Homo sapiens
tggttccggaatcctgtcct

SEQ ID NO: 3793281 - DNA, 14 bp, Homo sapiens
tggttctacaatct

SEQ ID NO: 3793282 - DNA, 12 bp, Homo sapiens
tggttctggggc

SEQ ID NO: 3793283 - DNA, 15 bp, Homo sapiens
tggttcttcatttat

SEQ ID NO: 3793284 - DNA, 17 bp, Homo sapiens
tggttgagaaatgaata

SEQ ID NO: 3793285 - DNA, 22 bp, Homo sapiens
tggttgaggtggaagccctcct

SEQ ID NO: 3793286 - DNA, 22 bp, Homo sapiens
tggttgagttcaggtagctgcc

SEQ ID NO: 3793287 - DNA, 15 bp, Homo sapiens
tggttgtttcttcca

SEQ ID NO: 3793288 - DNA, 20 bp, Homo sapiens
tggttgtttcttccaagact

SEQ ID NO: 3793289 - DNA, 13 bp, Homo sapiens
tggtttagtgtaa

SEQ ID NO: 3793290 - DNA, 16 bp, Homo sapiens
tggtttcactggccca

SEQ ID NO: 3793291 - DNA, 18 bp, Homo sapiens
tggtttcactggcccaag

SEQ ID NO: 3793292 - DNA, 13 bp, Homo sapiens
tggtttcagcaat

SEQ ID NO: 3793293 - DNA, 17 bp, Homo sapiens
tggtttccaaggagctg

SEQ ID NO: 3793294 - DNA, 22 bp, Homo sapiens
tggtttccaaggagctgagaat

SEQ ID NO: 3793295 - DNA, 21 bp, Homo sapiens
tggtttccacgatgaaaaact

SEQ ID NO: 3793296 - DNA, 15 bp, Homo sapiens
tggtttctagcatga

SEQ ID NO: 3793297 - DNA, 17 bp, Homo sapiens
tggtttgcaaggaagcc

SEQ ID NO: 3793298 - DNA, 15 bp, Homo sapiens
tggtttgcagagctt

SEQ ID NO: 3793299 - DNA, 20 bp, Homo sapiens
tggttttaattgaaggaaag

SEQ ID NO: 3793300 - DNA, 21 bp, Homo sapiens
tggttttaattgaaggaaaga

SEQ ID NO: 3793301 - DNA, 20 bp, Homo sapiens
tgtgtactctggcctctgtc

SEQ ID NO: 3793302 - DNA, 16 bp, Homo sapiens
tgtgtatgtacatata

SEQ ID NO: 3793303 - DNA, 13 bp, Homo sapiens
tgtgtattgttcc

SEQ ID NO: 3793304 - DNA, 17 bp, Homo sapiens
tgtgtatttaattgtaa

SEQ ID NO: 3793305 - DNA, 19 bp, Homo sapiens
tgtgtatttaattgtaaac

SEQ ID NO: 3793306 - DNA, 20 bp, Homo sapiens
tgtgtatttaattgtaaact

SEQ ID NO: 3793307 - DNA, 23 bp, Homo sapiens
tgtgtatttaattgtaaactgta

SEQ ID NO: 3793308 - DNA, 15 bp, Homo sapiens
tgtgtcaagctgctt

SEQ ID NO: 3793309 - DNA, 15 bp, Homo sapiens
tgtgtccatcccagc

SEQ ID NO: 3793310 - DNA, 18 bp, Homo sapiens
tgtgtccatgtgtgtgca

SEQ ID NO: 3793311 - DNA, 14 bp, Homo sapiens
tgtgtccttgcacc

SEQ ID NO: 3793312 - DNA, 14 bp, Homo sapiens
tgtgtctcttttct

SEQ ID NO: 3793313 - DNA, 14 bp, Homo sapiens
tgtgtctgctcagt

SEQ ID NO: 3793314 - DNA, 17 bp, Homo sapiens
tgtgtcttcaatttgta

SEQ ID NO: 3793315 - DNA, 16 bp, Homo sapiens
tgtgtcttgtgttttt

SEQ ID NO: 3793316 - DNA, 22 bp, Homo sapiens
tgtgtgctgtggttcctggggt

SEQ ID NO: 3793317 - DNA, 17 bp, Homo sapiens
tgtgtggactcaagtcc

SEQ ID NO: 3793318 - DNA, 17 bp, Homo sapiens
tgtgtgggactgtacac

SEQ ID NO: 3793319 - DNA, 14 bp, Homo sapiens
tgtgtggtcagtgg

SEQ ID NO: 3793320 - DNA, 22 bp, Homo sapiens
tgtgtggtttagtgtaaaaatg

SEQ ID NO: 3793321 - DNA, 19 bp, Homo sapiens
tgtgtgtatgtttgcacac

SEQ ID NO: 3793322 - DNA, 15 bp, Homo sapiens
tgtgtgtgtgtatga

SEQ ID NO: 3793323 - DNA, 15 bp, Homo sapiens
tgtgtgtttgtgctg

SEQ ID NO: 3793324 - DNA, 16 bp, Homo sapiens
tgtgtgtttgtgctga

SEQ ID NO: 3793325 - DNA, 13 bp, Homo sapiens
tgtgttatttaaa

SEQ ID NO: 3793326 - DNA, 15 bp, Homo sapiens
tgtgttcctggcaat

SEQ ID NO: 3793327 - DNA, 17 bp, Homo sapiens
tgtgttcgttcttgttc

SEQ ID NO: 3793328 - DNA, 17 bp, Homo sapiens
tgtgttctgattagaaa

SEQ ID NO: 3793329 - DNA, 20 bp, Homo sapiens
tgtgtttctatgtgacaatt

SEQ ID NO: 3793330 - DNA, 18 bp, Homo sapiens
tgtgtttggttctggggc

SEQ ID NO: 3793331 - DNA, 13 bp, Homo sapiens
tgtgtttgtgtga

SEQ ID NO: 3793332 - DNA, 19 bp, Homo sapiens
tgtgtttttgggatgtctt

SEQ ID NO: 3793333 - DNA, 18 bp, Homo sapiens
tgttaaaaaatttttgaa

SEQ ID NO: 3793334 - DNA, 14 bp, Homo sapiens
tgttaacttagctt

SEQ ID NO: 3793335 - DNA, 17 bp, Homo sapiens
tgttaatattctttcaa

SEQ ID NO: 3793336 - DNA, 20 bp, Homo sapiens
tgttaatcctagctgtgtgc

SEQ ID NO: 3793337 - DNA, 23 bp, Homo sapiens
tgttacaggcaccgagaatgttg

SEQ ID NO: 3793338 - DNA, 14 bp, Homo sapiens
tgttacatagtgta

SEQ ID NO: 3793339 - DNA, 15 bp, Homo sapiens
tgttactgaccagca

SEQ ID NO: 3793340 - DNA, 13 bp, Homo sapiens
tgttactgatcat

SEQ ID NO: 3793341 - DNA, 14 bp, Homo sapiens
tgttactgatcatg

SEQ ID NO: 3793342 - DNA, 17 bp, Homo sapiens
tgttagaacactatttt

SEQ ID NO: 3793343 - DNA, 19 bp, Homo sapiens
tgttagaacactattttca

SEQ ID NO: 3793344 - DNA, 20 bp, Homo sapiens
tgttagaacactattttcag

SEQ ID NO: 3793345 - DNA, 21 bp, Homo sapiens
tgttagcatgctggtgagcca

SEQ ID NO: 3793346 - DNA, 16 bp, Homo sapiens
tgttaggctgggccca

SEQ ID NO: 3793347 - DNA, 22 bp, Homo sapiens
tgttagtactatatctgtttta

SEQ ID NO: 3793348 - DNA, 14 bp, Homo sapiens
tgttatcttggtgt

SEQ ID NO: 3793349 - DNA, 15 bp, Homo sapiens
tgttatgataaaaaa

SEQ ID NO: 3793350 - DNA, 19 bp, Homo sapiens
tgttatgataaaaaatttt

SEQ ID NO: 3793351 - DNA, 14 bp, Homo sapiens
tgttatggaaactg

SEQ ID NO: 3793352 - DNA, 18 bp, Homo sapiens
tgttatggcttaatgaca

SEQ ID NO: 3793353 - DNA, 17 bp, Homo sapiens
tgttattacatccttgt

SEQ ID NO: 3793354 - DNA, 12 bp, Homo sapiens
tgttattatata

SEQ ID NO: 3793355 - DNA, 21 bp, Homo sapiens
tgttatttttgtttcttccaa

SEQ ID NO: 3793356 - DNA, 23 bp, Homo sapiens
tgttcaagaccagcctgaccaac

SEQ ID NO: 3793357 - DNA, 16 bp, Homo sapiens
tgttcaatgtttaatg

SEQ ID NO: 3793358 - DNA, 16 bp, Homo sapiens
tgttcacttttcctcc

SEQ ID NO: 3793359 - DNA, 19 bp, Homo sapiens
tgttcacttttcctccctc

SEQ ID NO: 3793360 - DNA, 12 bp, Homo sapiens
tgttcattgtaa

SEQ ID NO: 3793361 - DNA, 18 bp, Homo sapiens
tgttcattgtaatgttac

SEQ ID NO: 3793362 - DNA, 18 bp, Homo sapiens
tgttcatttgttattctt

SEQ ID NO: 3793363 - DNA, 11 bp, Homo sapiens
tgttccaagac

SEQ ID NO: 3793364 - DNA, 14 bp, Homo sapiens
tgttccagctcttt

SEQ ID NO: 3793365 - DNA, 18 bp, Homo sapiens
tgttctactcatatatat

SEQ ID NO: 3793366 - DNA, 22 bp, Homo sapiens
tgttctcctagactgaccctga

SEQ ID NO: 3793367 - DNA, 17 bp, Homo sapiens
tgttctgacattaacag

SEQ ID NO: 3793368 - DNA, 22 bp, Homo sapiens
tgttctgacattaacagttttc

SEQ ID NO: 3793369 - DNA, 15 bp, Homo sapiens
tgttctgaccctgct

SEQ ID NO: 3793370 - DNA, 18 bp, Homo sapiens
tgttctgaccctgcttca

SEQ ID NO: 3793371 - DNA, 14 bp, Homo sapiens
tgttctgattagaa

SEQ ID NO: 3793372 - DNA, 13 bp, Homo sapiens
tgttctggccctc

SEQ ID NO: 3793373 - DNA, 15 bp, Homo sapiens
tgttctggccctcac

SEQ ID NO: 3793374 - DNA, 12 bp, Homo sapiens
tgttctgggaca

SEQ ID NO: 3793375 - DNA, 20 bp, Homo sapiens
tgttctgtttgttaaaactg

SEQ ID NO: 3793376 - DNA, 18 bp, Homo sapiens
tgttctgttttgttttgt

SEQ ID NO: 3793377 - DNA, 15 bp, Homo sapiens
tgttctttcagaaag

SEQ ID NO: 3793378 - DNA, 21 bp, Homo sapiens
tgttcttttcccccaaagtgg

SEQ ID NO: 3793379 - DNA, 23 bp, Homo sapiens
tgttgaaaaaaaagtttcagaga

SEQ ID NO: 3793380 - DNA, 22 bp, Homo sapiens
tgttgaatgcccacaggcaaat

SEQ ID NO: 3793381 - DNA, 17 bp, Homo sapiens
tgttgacatccaagctt

SEQ ID NO: 3793382 - DNA, 13 bp, Homo sapiens
tgttgagctgttt

SEQ ID NO: 3793383 - DNA, 16 bp, Homo sapiens
tgttgatcccaagaca

SEQ ID NO: 3793384 - DNA, 19 bp, Homo sapiens
tgttgcaagtactgctgta

SEQ ID NO: 3793385 - DNA, 18 bp, Homo sapiens
tgttgcccaggcaggtct

SEQ ID NO: 3793386 - DNA, 15 bp, Homo sapiens
tgttgccctttctgt

SEQ ID NO: 3793387 - DNA, 11 bp, Homo sapiens
tgttggccagg

SEQ ID NO: 3793388 - DNA, 17 bp, Homo sapiens
tgttggctgggggcctc

SEQ ID NO: 3793389 - DNA, 20 bp, Homo sapiens
tgttgggattataggagtga

SEQ ID NO: 3793390 - DNA, 18 bp, Homo sapiens
tgttggtatttatctatt

SEQ ID NO: 3793391 - DNA, 15 bp, Homo sapiens
tgttgtaaagagttg

SEQ ID NO: 3793392 - DNA, 17 bp, Homo sapiens
tgttgtcagcatcttct

SEQ ID NO: 3793393 - DNA, 17 bp, Homo sapiens
tgttgtcattgctttac

SEQ ID NO: 3793394 - DNA, 15 bp, Homo sapiens
tgttgtttaacataa

SEQ ID NO: 3793395 - DNA, 17 bp, Homo sapiens
tgttgtttgaaaatatt

SEQ ID NO: 3793396 - DNA, 14 bp, Homo sapiens
tgttgtttgtaaat

SEQ ID NO: 3793397 - DNA, 17 bp, Homo sapiens
tgtttaaaaaagtttaa

SEQ ID NO: 3793398 - DNA, 19 bp, Homo sapiens
tgtttaaaaaagtttaaaa

SEQ ID NO: 3793399 - DNA, 15 bp, Homo sapiens
tgtttatattttcaa

SEQ ID NO: 3793400 - DNA, 21 bp, Homo sapiens
tgtttatgagccagacaaatg

SEQ ID NO: 3793401 - DNA, 14 bp, Homo sapiens
tgtttattaacaaa

SEQ ID NO: 3793402 - DNA, 23 bp, Homo sapiens
tgtttatttataagcagatttaa

SEQ ID NO: 3793403 - DNA, 16 bp, Homo sapiens
tgtttcaaaataaaaa

SEQ ID NO: 3793404 - DNA, 18 bp, Homo sapiens
tgtttcacgaagtttgtt

SEQ ID NO: 3793405 - DNA, 15 bp, Homo sapiens
tgtttccttcagtgc

SEQ ID NO: 3793406 - DNA, 20 bp, Homo sapiens
tgtttcgtgaagtatactgt

SEQ ID NO: 3793407 - DNA, 16 bp, Homo sapiens
tgtttctagttgagga

SEQ ID NO: 3793408 - DNA, 17 bp, Homo sapiens
tgtttctccccctgggc

SEQ ID NO: 3793409 - DNA, 16 bp, Homo sapiens
tgtttctgacccactg

SEQ ID NO: 3793410 - DNA, 17 bp, Homo sapiens
tgtttcttccaaagcac

SEQ ID NO: 3793411 - DNA, 19 bp, Homo sapiens
tgtttcttccaaagcacat

SEQ ID NO: 3793412 - DNA, 13 bp, Homo sapiens
tgtttctttaaat

SEQ ID NO: 3793413 - DNA, 16 bp, Homo sapiens
tgtttgaaaatattat

SEQ ID NO: 3793414 - DNA, 21 bp, Homo sapiens
tgtttgacaaagaaacccaag

SEQ ID NO: 3793415 - DNA, 17 bp, Homo sapiens
ttattaagatggattct

SEQ ID NO: 3793416 - DNA, 15 bp, Homo sapiens
ttattaatgctaagg

SEQ ID NO: 3793417 - DNA, 12 bp, Homo sapiens
ttattaatttga

SEQ ID NO: 3793418 - DNA, 12 bp, Homo sapiens
ttattacctctg

SEQ ID NO: 3793419 - DNA, 22 bp, Homo sapiens
ttattagccaggtaatgtgaat

SEQ ID NO: 3793420 - DNA, 20 bp, Homo sapiens
ttattatgcataactgacaa

SEQ ID NO: 3793421 - DNA, 16 bp, Homo sapiens
ttattattttcacctg

SEQ ID NO: 3793422 - DNA, 11 bp, Homo sapiens
ttattcaaggt

SEQ ID NO: 3793423 - DNA, 18 bp, Homo sapiens
ttattcaattcctctggg

SEQ ID NO: 3793424 - DNA, 16 bp, Homo sapiens
ttattcagttaagaaa

SEQ ID NO: 3793425 - DNA, 20 bp, Homo sapiens
ttattccccattcttcctag

SEQ ID NO: 3793426 - DNA, 16 bp, Homo sapiens
ttattccctgtacaat

SEQ ID NO: 3793427 - DNA, 13 bp, Homo sapiens
ttattctagatta

SEQ ID NO: 3793428 - DNA, 14 bp, Homo sapiens
ttattctcaaagca

SEQ ID NO: 3793429 - DNA, 22 bp, Homo sapiens
ttattgacaataatttcaggtt

SEQ ID NO: 3793430 - DNA, 13 bp, Homo sapiens
ttattgagaattt

SEQ ID NO: 3793431 - DNA, 13 bp, Homo sapiens
ttattgcattata

SEQ ID NO: 3793432 - DNA, 12 bp, Homo sapiens
ttattgctgttg

SEQ ID NO: 3793433 - DNA, 12 bp, Homo sapiens
ttattgtacctc

SEQ ID NO: 3793434 - DNA, 17 bp, Homo sapiens
ttattgtacctctctta

SEQ ID NO: 3793435 - DNA, 21 bp, Homo sapiens
ttattgtacgtttaaagtgta

SEQ ID NO: 3793436 - DNA, 22 bp, Homo sapiens
ttattgttccaagacattgtca

SEQ ID NO: 3793437 - DNA, 17 bp, Homo sapiens
ttatttactgagcttct

SEQ ID NO: 3793438 - DNA, 21 bp, Homo sapiens
ttatttagggaactgcttgac

SEQ ID NO: 3793439 - DNA, 15 bp, Homo sapiens
ttatttattaagatg

SEQ ID NO: 3793440 - DNA, 23 bp, Homo sapiens
ttatttcaaaatatacattcaaa

SEQ ID NO: 3793441 - DNA, 21 bp, Homo sapiens
ttatttggggttgcatcagaa

SEQ ID NO: 3793442 - DNA, 20 bp, Homo sapiens
ttattttagcagttctgcaa

SEQ ID NO: 3793443 - DNA, 21 bp, Homo sapiens
ttattttagcagttctgcaaa

SEQ ID NO: 3793444 - DNA, 15 bp, Homo sapiens
ttattttcctcccca

SEQ ID NO: 3793445 - DNA, 13 bp, Homo sapiens
ttatttttataca

SEQ ID NO: 3793446 - DNA, 21 bp, Homo sapiens
ttcaaaaagtctacgctctcc

SEQ ID NO: 3793447 - DNA, 17 bp, Homo sapiens
ttcaaaaatgtacaaaa

SEQ ID NO: 3793448 - DNA, 16 bp, Homo sapiens
ttcaaaagttgaaatt

SEQ ID NO: 3793449 - DNA, 17 bp, Homo sapiens
ttcaaaagttgaaatta

SEQ ID NO: 3793450 - DNA, 17 bp, Homo sapiens
ttcaaaataaaaatgag

SEQ ID NO: 3793451 - DNA, 22 bp, Homo sapiens
ttcaaaccagtatacaagataa

SEQ ID NO: 3793452 - DNA, 20 bp, Homo sapiens
ttcaaactaacacattttta

SEQ ID NO: 3793453 - DNA, 22 bp, Homo sapiens
ttcaaagctttttccagaggct

SEQ ID NO: 3793454 - DNA, 23 bp, Homo sapiens
ttcaacagaccccctctagaaat

SEQ ID NO: 3793455 - DNA, 22 bp, Homo sapiens
ttcaacatcaatgttcattgta

SEQ ID NO: 3793456 - DNA, 15 bp, Homo sapiens
ttcaaccattcccca

SEQ ID NO: 3793457 - DNA, 20 bp, Homo sapiens
ttcaaccattccccatggga

SEQ ID NO: 3793458 - DNA, 16 bp, Homo sapiens
ttcaacgcagccctgc

SEQ ID NO: 3793459 - DNA, 12 bp, Homo sapiens
ttcaagaaactg

SEQ ID NO: 3793460 - DNA, 23 bp, Homo sapiens
ttcaagaaactgaggaattttct

SEQ ID NO: 3793461 - DNA, 22 bp, Homo sapiens
ttcaagaaagccagtcttaaca

SEQ ID NO: 3793462 - DNA, 17 bp, Homo sapiens
ttcaagaccagcctggc

SEQ ID NO: 3793463 - DNA, 17 bp, Homo sapiens
ttcaagcagattggaga

SEQ ID NO: 3793464 - DNA, 15 bp, Homo sapiens
ttcaaggtaaaattc

SEQ ID NO: 3793465 - DNA, 20 bp, Homo sapiens
ttcaagtctgtgcctggagc

SEQ ID NO: 3793466 - DNA, 17 bp, Homo sapiens
ttcaagtgaatctaaaa

SEQ ID NO: 3793467 - DNA, 19 bp, Homo sapiens
ttcaattcaaaaatgtaca

SEQ ID NO: 3793468 - DNA, 16 bp, Homo sapiens
ttcaattcctgggccc

SEQ ID NO: 3793469 - DNA, 16 bp, Homo sapiens
ttcaatttattcaaga

SEQ ID NO: 3793470 - DNA, 12 bp, Homo sapiens
ttcaatttgttc

SEQ ID NO: 3793471 - DNA, 19 bp, Homo sapiens
ttcaatttgttcagtcttt

SEQ ID NO: 3793472 - DNA, 17 bp, Homo sapiens
ttcacaagctgcctccc

SEQ ID NO: 3793473 - DNA, 20 bp, Homo sapiens
ttcacaatgaaatgctctcc

SEQ ID NO: 3793474 - DNA, 12 bp, Homo sapiens
ttcacacttcca

SEQ ID NO: 3793475 - DNA, 15 bp, Homo sapiens
ttcacacttccacca

SEQ ID NO: 3793476 - DNA, 15 bp, Homo sapiens
ttcacagctctgtgt

SEQ ID NO: 3793477 - DNA, 18 bp, Homo sapiens
ttcacatcctgtgtttct

SEQ ID NO: 3793478 - DNA, 21 bp, Homo sapiens
ttcacatcctgtgtttctagg

SEQ ID NO: 3793479 - DNA, 18 bp, Homo sapiens
ttcaccagatttgctaat

SEQ ID NO: 3793480 - DNA, 12 bp, Homo sapiens
ttcaccatgtaa

SEQ ID NO: 3793481 - DNA, 17 bp, Homo sapiens
ttcaccatgtaaaacaa

SEQ ID NO: 3793482 - DNA, 20 bp, Homo sapiens
ttcaccatgtaaaacaaaaa

SEQ ID NO: 3793483 - DNA, 21 bp, Homo sapiens
ttcaccatgtaaaacaaaaaa

SEQ ID NO: 3793484 - DNA, 23 bp, Homo sapiens
ttcaccatgtaaaacaaaaaaca

SEQ ID NO: 3793485 - DNA, 14 bp, Homo sapiens
ttcacccacagaaa

SEQ ID NO: 3793486 - DNA, 22 bp, Homo sapiens
ttcaccctgtcaagttaacaag

SEQ ID NO: 3793487 - DNA, 21 bp, Homo sapiens
ttcacctaagtctctgtgaat

SEQ ID NO: 3793488 - DNA, 18 bp, Homo sapiens
ttcacctatttcaaaaat

SEQ ID NO: 3793489 - DNA, 17 bp, Homo sapiens
ttcacctgtaaaacttt

SEQ ID NO: 3793490 - DNA, 22 bp, Homo sapiens
ttcacctgtttttaagctgttt

SEQ ID NO: 3793491 - DNA, 22 bp, Homo sapiens
ttcaccttgggatgatgcctca

SEQ ID NO: 3793492 - DNA, 13 bp, Homo sapiens
ttcacggaagagc

SEQ ID NO: 3793493 - DNA, 18 bp, Homo sapiens
ttcacggaagagccttgc

SEQ ID NO: 3793494 - DNA, 20 bp, Homo sapiens
ttcacgtaagatacaagttt

SEQ ID NO: 3793495 - DNA, 22 bp, Homo sapiens
ttcacgtgcagcagcaacacaa

SEQ ID NO: 3793496 - DNA, 21 bp, Homo sapiens
ttcactccggtgtgcctgcag

SEQ ID NO: 3793497 - DNA, 23 bp, Homo sapiens
ttcactccggtgtgcctgcagcc

SEQ ID NO: 3793498 - DNA, 19 bp, Homo sapiens
ttcactgaagttctcctga

SEQ ID NO: 3793499 - DNA, 15 bp, Homo sapiens
ttcactgctggctgc

SEQ ID NO: 3793500 - DNA, 17 bp, Homo sapiens
ttcagaaaacagaaaaa

SEQ ID NO: 3793501 - DNA, 23 bp, Homo sapiens
ttcagaaaacccttttctacagt

SEQ ID NO: 3793502 - DNA, 13 bp, Homo sapiens
ttcagaaatatgt

SEQ ID NO: 3793503 - DNA, 12 bp, Homo sapiens
ttcagaacctct

SEQ ID NO: 3793504 - DNA, 15 bp, Homo sapiens
ttcagaacctcttcc

SEQ ID NO: 3793505 - DNA, 17 bp, Homo sapiens
ttcagaacctcttcccc

SEQ ID NO: 3793506 - DNA, 16 bp, Homo sapiens
ttcagaagacactgca

SEQ ID NO: 3793507 - DNA, 18 bp, Homo sapiens
ttcagaatctgaatgtaa

SEQ ID NO: 3793508 - DNA, 15 bp, Homo sapiens
ttcagacactttgga

SEQ ID NO: 3793509 - DNA, 10 bp, Homo sapiens
ttcagacagg

SEQ ID NO: 3793510 - DNA, 17 bp, Homo sapiens
ttcagacagggtctgaa

SEQ ID NO: 3793511 - DNA, 13 bp, Homo sapiens
ttcagaccccagc

SEQ ID NO: 3793512 - DNA, 14 bp, Homo sapiens
ttcagactcagact

SEQ ID NO: 3793513 - DNA, 14 bp, Homo sapiens
ttcagagagctggt

SEQ ID NO: 3793514 - DNA, 22 bp, Homo sapiens
ttcagagcctcctttctggctt

SEQ ID NO: 3793515 - DNA, 16 bp, Homo sapiens
ttcagaggctgaggtg

SEQ ID NO: 3793516 - DNA, 12 bp, Homo sapiens
ttcagatcctac

SEQ ID NO: 3793517 - DNA, 15 bp, Homo sapiens
ttcagatgcttctgg

SEQ ID NO: 3793518 - DNA, 13 bp, Homo sapiens
ttcagcattctta

SEQ ID NO: 3793519 - DNA, 12 bp, Homo sapiens
ttcagccaggag

SEQ ID NO: 3793520 - DNA, 14 bp, Homo sapiens
ttcagcccctcctc

SEQ ID NO: 3793521 - DNA, 18 bp, Homo sapiens
ttcagcccctcctctgcc

SEQ ID NO: 3793522 - DNA, 21 bp, Homo sapiens
ttcagcctagccgacctcagc

SEQ ID NO: 3793523 - DNA, 22 bp, Homo sapiens
ttcagcctagccgacctcagcc

SEQ ID NO: 3793524 - DNA, 14 bp, Homo sapiens
ttcagctaagctag

SEQ ID NO: 3793525 - DNA, 15 bp, Homo sapiens
ttcagctccagctca

SEQ ID NO: 3793526 - DNA, 12 bp, Homo sapiens
ttcagctgcccc

SEQ ID NO: 3793527 - DNA, 22 bp, Homo sapiens
ttcaggaacctggaccaaagct

SEQ ID NO: 3793528 - DNA, 15 bp, Homo sapiens
ttgaagtcacccggc

SEQ ID NO: 3793529 - DNA, 12 bp, Homo sapiens
ttgaataaataa

SEQ ID NO: 3793530 - DNA, 15 bp, Homo sapiens
ttgaatataaacact

SEQ ID NO: 3793531 - DNA, 13 bp, Homo sapiens
ttgaatatattat

SEQ ID NO: 3793532 - DNA, 21 bp, Homo sapiens
ttgaatctattgggattttct

SEQ ID NO: 3793533 - DNA, 18 bp, Homo sapiens
ttgaatgaaaaatttaag

SEQ ID NO: 3793534 - DNA, 17 bp, Homo sapiens
ttgaattaaattaggaa

SEQ ID NO: 3793535 - DNA, 23 bp, Homo sapiens
ttgaattaaattaggaataaata

SEQ ID NO: 3793536 - DNA, 23 bp, Homo sapiens
ttgaattgcattttttaaaacaa

SEQ ID NO: 3793537 - DNA, 22 bp, Homo sapiens
ttgacaagtcattttaacttta

SEQ ID NO: 3793538 - DNA, 18 bp, Homo sapiens
ttgacaataatttcaggt

SEQ ID NO: 3793539 - DNA, 19 bp, Homo sapiens
ttgacaattcctagataaa

SEQ ID NO: 3793540 - DNA, 17 bp, Homo sapiens
ttgacagaacactgtct

SEQ ID NO: 3793541 - DNA, 19 bp, Homo sapiens
ttgacagggcacaccgggc

SEQ ID NO: 3793542 - DNA, 22 bp, Homo sapiens
ttgacagtaacttggttataca

SEQ ID NO: 3793543 - DNA, 15 bp, Homo sapiens
ttgaccaagaactgc

SEQ ID NO: 3793544 - DNA, 18 bp, Homo sapiens
ttgaccaagaactgcatg

SEQ ID NO: 3793545 - DNA, 16 bp, Homo sapiens
ttgaccaagcaggaag

SEQ ID NO: 3793546 - DNA, 15 bp, Homo sapiens
ttgacctcaggtgat

SEQ ID NO: 3793547 - DNA, 21 bp, Homo sapiens
ttgacctcaggtgatccaccc

SEQ ID NO: 3793548 - DNA, 21 bp, Homo sapiens
ttgactcttttgccattaaac

SEQ ID NO: 3793549 - DNA, 23 bp, Homo sapiens
ttgactgggtttctctgtatagt

SEQ ID NO: 3793550 - DNA, 16 bp, Homo sapiens
ttgacttgattagtgc

SEQ ID NO: 3793551 - DNA, 14 bp, Homo sapiens
ttgactttcaggta

SEQ ID NO: 3793552 - DNA, 17 bp, Homo sapiens
ttgagaagcgtatgttt

SEQ ID NO: 3793553 - DNA, 13 bp, Homo sapiens
ttgagaattttaa

SEQ ID NO: 3793554 - DNA, 15 bp, Homo sapiens
ttgagacaaaaatta

SEQ ID NO: 3793555 - DNA, 23 bp, Homo sapiens
ttgagacaaaaattatctatttg

SEQ ID NO: 3793556 - DNA, 13 bp, Homo sapiens
ttgagacattcca

SEQ ID NO: 3793557 - DNA, 16 bp, Homo sapiens
ttgagactttttggtg

SEQ ID NO: 3793558 - DNA, 18 bp, Homo sapiens
ttgagatagaagaactgc

SEQ ID NO: 3793559 - DNA, 13 bp, Homo sapiens
ttgagccaggcct

SEQ ID NO: 3793560 - DNA, 18 bp, Homo sapiens
ttgagctgttttccctga

SEQ ID NO: 3793561 - DNA, 18 bp, Homo sapiens
ttgagcttagtgaaatta

SEQ ID NO: 3793562 - DNA, 13 bp, Homo sapiens
ttgaggagtgtga

SEQ ID NO: 3793563 - DNA, 15 bp, Homo sapiens
ttgaggagtttccta

SEQ ID NO: 3793564 - DNA, 15 bp, Homo sapiens
ttgaggggctcctgg

SEQ ID NO: 3793565 - DNA, 13 bp, Homo sapiens
ttgagggttgggc

SEQ ID NO: 3793566 - DNA, 17 bp, Homo sapiens
ttgaggtctgctcggcc

SEQ ID NO: 3793567 - DNA, 22 bp, Homo sapiens
ttgaggtcttttgacatgtgga

SEQ ID NO: 3793568 - DNA, 23 bp, Homo sapiens
ttgaggtcttttgacatgtggaa

SEQ ID NO: 3793569 - DNA, 21 bp, Homo sapiens
ttgaggtggtctgaatgttct

SEQ ID NO: 3793570 - DNA, 15 bp, Homo sapiens
ttgagtcccttccag

SEQ ID NO: 3793571 - DNA, 21 bp, Homo sapiens
ttgagtgctgtctccatgttt

SEQ ID NO: 3793572 - DNA, 17 bp, Homo sapiens
ttgagtgttttaagata

SEQ ID NO: 3793573 - DNA, 19 bp, Homo sapiens
ttgagtttcctcaggctgc

SEQ ID NO: 3793574 - DNA, 22 bp, Homo sapiens
ttgagtttcctcaggctgctgg

SEQ ID NO: 3793575 - DNA, 13 bp, Homo sapiens
ttgataacagcta

SEQ ID NO: 3793576 - DNA, 11 bp, Homo sapiens
ttgataataaa

SEQ ID NO: 3793577 - DNA, 16 bp, Homo sapiens
ttgatacttgttcaaa

SEQ ID NO: 3793578 - DNA, 14 bp, Homo sapiens
ttgatagctttatt

SEQ ID NO: 3793579 - DNA, 19 bp, Homo sapiens
ttgatagctttatttttta

SEQ ID NO: 3793580 - DNA, 16 bp, Homo sapiens
ttgatatgaaaaatat

SEQ ID NO: 3793581 - DNA, 22 bp, Homo sapiens
ttgatattttcaacgcagccct

SEQ ID NO: 3793582 - DNA, 14 bp, Homo sapiens
ttgatcagtataat

SEQ ID NO: 3793583 - DNA, 18 bp, Homo sapiens
ttgatcattttcccccca

SEQ ID NO: 3793584 - DNA, 22 bp, Homo sapiens
ttgatcattttccccccactct

SEQ ID NO: 3793585 - DNA, 15 bp, Homo sapiens
ttgatgaaagctgat

SEQ ID NO: 3793586 - DNA, 16 bp, Homo sapiens
ttgatgaaagctgatt

SEQ ID NO: 3793587 - DNA, 17 bp, Homo sapiens
ttgatgacccccaacca

SEQ ID NO: 3793588 - DNA, 22 bp, Homo sapiens
ttgatgagtgtaacaagaaagg

SEQ ID NO: 3793589 - DNA, 16 bp, Homo sapiens
ttgatgatctttgcag

SEQ ID NO: 3793590 - DNA, 12 bp, Homo sapiens
ttgatggtttat

SEQ ID NO: 3793591 - DNA, 19 bp, Homo sapiens
ttgatgtttgtggcctcag

SEQ ID NO: 3793592 - DNA, 22 bp, Homo sapiens
ttgatgtttgtggcctcagaat

SEQ ID NO: 3793593 - DNA, 13 bp, Homo sapiens
ttgattgctgtgt

SEQ ID NO: 3793594 - DNA, 15 bp, Homo sapiens
ttgattgctgtgtcc

SEQ ID NO: 3793595 - DNA, 12 bp, Homo sapiens
ttgcaaatagtc

SEQ ID NO: 3793596 - DNA, 15 bp, Homo sapiens
ttgcaacacacagac

SEQ ID NO: 3793597 - DNA, 17 bp, Homo sapiens
ttgcaacaggctgggct

SEQ ID NO: 3793598 - DNA, 17 bp, Homo sapiens
ttgcaaggccgctgttc

SEQ ID NO: 3793599 - DNA, 13 bp, Homo sapiens
ttgcaatgaagga

SEQ ID NO: 3793600 - DNA, 21 bp, Homo sapiens
ttgcaccactgcactccagcc

SEQ ID NO: 3793601 - DNA, 17 bp, Homo sapiens
ttgcacgcccatgtgtg

SEQ ID NO: 3793602 - DNA, 17 bp, Homo sapiens
ttgcagaaaagcacctg

SEQ ID NO: 3793603 - DNA, 18 bp, Homo sapiens
ttgcagaaaagcacctgc

SEQ ID NO: 3793604 - DNA, 20 bp, Homo sapiens
ttgcagaaaagcacctgccg

SEQ ID NO: 3793605 - DNA, 15 bp, Homo sapiens
ttgcagaaacatttt

SEQ ID NO: 3793606 - DNA, 19 bp, Homo sapiens
ttgcagcgattaataacag

SEQ ID NO: 3793607 - DNA, 20 bp, Homo sapiens
ttgcagtgtggtgagatcat

SEQ ID NO: 3793608 - DNA, 14 bp, Homo sapiens
ttgcatatgtatga

SEQ ID NO: 3793609 - DNA, 14 bp, Homo sapiens
ttgcatcagaaatg

SEQ ID NO: 3793610 - DNA, 15 bp, Homo sapiens
ttgcatcagaaatgt

SEQ ID NO: 3793611 - DNA, 22 bp, Homo sapiens
ttgcatcagaaatgtctggaga

SEQ ID NO: 3793612 - DNA, 15 bp, Homo sapiens
ttgcatgctgcttta

SEQ ID NO: 3793613 - DNA, 21 bp, Homo sapiens
ttgcatgctgctttaattgtg

SEQ ID NO: 3793614 - DNA, 16 bp, Homo sapiens
ttgcatgggttttgta

SEQ ID NO: 3793615 - DNA, 14 bp, Homo sapiens
ttgcattgaatata

SEQ ID NO: 3793616 - DNA, 22 bp, Homo sapiens
ttgccaaaataatgtcttgtta

SEQ ID NO: 3793617 - DNA, 23 bp, Homo sapiens
ttgccaaaataatgtcttgttaa

SEQ ID NO: 3793618 - DNA, 15 bp, Homo sapiens
ttgccacaaccctgt

SEQ ID NO: 3793619 - DNA, 22 bp, Homo sapiens
ttgccactgagagatctgctgt

SEQ ID NO: 3793620 - DNA, 15 bp, Homo sapiens
ttgccagtgtctttc

SEQ ID NO: 3793621 - DNA, 17 bp, Homo sapiens
ttgccagtgtctttctt

SEQ ID NO: 3793622 - DNA, 23 bp, Homo sapiens
ttgccatgacaacttctaattgc

SEQ ID NO: 3793623 - DNA, 16 bp, Homo sapiens
ttgccatgttggccag

SEQ ID NO: 3793624 - DNA, 20 bp, Homo sapiens
ttgccatgttggccaggctg

SEQ ID NO: 3793625 - DNA, 15 bp, Homo sapiens
ttgcccaacctcagc

SEQ ID NO: 3793626 - DNA, 12 bp, Homo sapiens
ttgcccagagat

SEQ ID NO: 3793627 - DNA, 20 bp, Homo sapiens
ttgcccagggctcagcctgg

SEQ ID NO: 3793628 - DNA, 15 bp, Homo sapiens
ttgcccatttacact

SEQ ID NO: 3793629 - DNA, 18 bp, Homo sapiens
ttgcccttcacagtgttt

SEQ ID NO: 3793630 - DNA, 20 bp, Homo sapiens
ttgccctttctgtaccattt

SEQ ID NO: 3793631 - DNA, 15 bp, Homo sapiens
ttgccgaaactggaa

SEQ ID NO: 3793632 - DNA, 18 bp, Homo sapiens
ttgcctaatacattaaag

SEQ ID NO: 3793633 - DNA, 23 bp, Homo sapiens
ttgcctaatacattaaagcagtc

SEQ ID NO: 3793634 - DNA, 20 bp, Homo sapiens
ttgcctccatggtgcctctg

SEQ ID NO: 3793635 - DNA, 18 bp, Homo sapiens
ttgcctctgcctctgaca

SEQ ID NO: 3793636 - DNA, 21 bp, Homo sapiens
ttgccttccacgctgtctcca

SEQ ID NO: 3793637 - DNA, 18 bp, Homo sapiens
ttgcgacggagagaaaaa

SEQ ID NO: 3793638 - DNA, 19 bp, Homo sapiens
ttgcgacggagagaaaaaa

SEQ ID NO: 3793639 - DNA, 20 bp, Homo sapiens
ttgcgacggagagaaaaaag

SEQ ID NO: 3793640 - DNA, 18 bp, Homo sapiens
ttgctaatcgggttgtca

SEQ ID NO: 3793641 - DNA, 15 bp, Homo sapiens
tttcccccaaagtgg

SEQ ID NO: 3793642 - DNA, 23 bp, Homo sapiens
tttccccccactctccccacact

SEQ ID NO: 3793643 - DNA, 18 bp, Homo sapiens
tttccccggtcccttgag

SEQ ID NO: 3793644 - DNA, 20 bp, Homo sapiens
tttcccctgcccccagacct

SEQ ID NO: 3793645 - DNA, 19 bp, Homo sapiens
tttccctccactccttcct

SEQ ID NO: 3793646 - DNA, 22 bp, Homo sapiens
tttccctgcttaatgaaaagct

SEQ ID NO: 3793647 - DNA, 18 bp, Homo sapiens
tttcctgttcagcattct

SEQ ID NO: 3793648 - DNA, 16 bp, Homo sapiens
tttccttccttccctg

SEQ ID NO: 3793649 - DNA, 18 bp, Homo sapiens
tttccttctcatctgtga

SEQ ID NO: 3793650 - DNA, 21 bp, Homo sapiens
tttccttttaaaacacttcca

SEQ ID NO: 3793651 - DNA, 13 bp, Homo sapiens
tttcgttaacatt

SEQ ID NO: 3793652 - DNA, 19 bp, Homo sapiens
tttctaaaggcctcttcct

SEQ ID NO: 3793653 - DNA, 22 bp, Homo sapiens
tttctacagcaaatttataatt

SEQ ID NO: 3793654 - DNA, 22 bp, Homo sapiens
tttctacccagcgagccctggt

SEQ ID NO: 3793655 - DNA, 15 bp, Homo sapiens
tttctagggaaatga

SEQ ID NO: 3793656 - DNA, 23 bp, Homo sapiens
tttctaggtcaaggcctgtccct

SEQ ID NO: 3793657 - DNA, 14 bp, Homo sapiens
tttctagttgagga

SEQ ID NO: 3793658 - DNA, 16 bp, Homo sapiens
tttctagttgaggagt

SEQ ID NO: 3793659 - DNA, 13 bp, Homo sapiens
tttctcctatctt

SEQ ID NO: 3793660 - DNA, 22 bp, Homo sapiens
tttctctaacttcaaggcccat

SEQ ID NO: 3793661 - DNA, 18 bp, Homo sapiens
tttctctgcttcagcttg

SEQ ID NO: 3793662 - DNA, 17 bp, Homo sapiens
tttctctgtatagtact

SEQ ID NO: 3793663 - DNA, 13 bp, Homo sapiens
tttctcttgggct

SEQ ID NO: 3793664 - DNA, 12 bp, Homo sapiens
tttctctttctc

SEQ ID NO: 3793665 - DNA, 14 bp, Homo sapiens
tttctctttctcct

SEQ ID NO: 3793666 - DNA, 13 bp, Homo sapiens
tttctgaaaagat

SEQ ID NO: 3793667 - DNA, 19 bp, Homo sapiens
tttctgaaaattaacactg

SEQ ID NO: 3793668 - DNA, 18 bp, Homo sapiens
tttctgaaaattccagaa

SEQ ID NO: 3793669 - DNA, 21 bp, Homo sapiens
tttctgaaaattccagaaagg

SEQ ID NO: 3793670 - DNA, 22 bp, Homo sapiens
tttctgaaaattccagaaagga

SEQ ID NO: 3793671 - DNA, 16 bp, Homo sapiens
tttctgaggagaaaca

SEQ ID NO: 3793672 - DNA, 14 bp, Homo sapiens
tttctgatatagaa

SEQ ID NO: 3793673 - DNA, 16 bp, Homo sapiens
tttctgccagggagct

SEQ ID NO: 3793674 - DNA, 12 bp, Homo sapiens
tttctgccctgc

SEQ ID NO: 3793675 - DNA, 13 bp, Homo sapiens
tttctgccctgcc

SEQ ID NO: 3793676 - DNA, 20 bp, Homo sapiens
tttctggaatacatgaaata

SEQ ID NO: 3793677 - DNA, 21 bp, Homo sapiens
tttctggaatacatgaaatat

SEQ ID NO: 3793678 - DNA, 23 bp, Homo sapiens
tttctggactgaagcctgcagga

SEQ ID NO: 3793679 - DNA, 16 bp, Homo sapiens
tttctgggataagtaa

SEQ ID NO: 3793680 - DNA, 19 bp, Homo sapiens
tttctggtagatagaaata

SEQ ID NO: 3793681 - DNA, 13 bp, Homo sapiens
tttctgtaccatt

SEQ ID NO: 3793682 - DNA, 16 bp, Homo sapiens
tttcttaaacaaatgt

SEQ ID NO: 3793683 - DNA, 18 bp, Homo sapiens
tttcttcaacatcaatgt

SEQ ID NO: 3793684 - DNA, 21 bp, Homo sapiens
tttcttcaacatcaatgttca

SEQ ID NO: 3793685 - DNA, 12 bp, Homo sapiens
tttcttctattt

SEQ ID NO: 3793686 - DNA, 13 bp, Homo sapiens
tttcttctccctc

SEQ ID NO: 3793687 - DNA, 23 bp, Homo sapiens
tttcttgccaatgaggtctgaaa

SEQ ID NO: 3793688 - DNA, 20 bp, Homo sapiens
tttcttgtttatcagcagtt

SEQ ID NO: 3793689 - DNA, 20 bp, Homo sapiens
tttctttaaatttcaaatgt

SEQ ID NO: 3793690 - DNA, 16 bp, Homo sapiens
tttctttggtgccttt

SEQ ID NO: 3793691 - DNA, 21 bp, Homo sapiens
tttctttggtgcctttcctgt

SEQ ID NO: 3793692 - DNA, 16 bp, Homo sapiens
tttcttttgtaaatgt

SEQ ID NO: 3793693 - DNA, 18 bp, Homo sapiens
tttgaaaactacatttta

SEQ ID NO: 3793694 - DNA, 17 bp, Homo sapiens
tttgaatataaacacta

SEQ ID NO: 3793695 - DNA, 18 bp, Homo sapiens
tttgaatataaacactat

SEQ ID NO: 3793696 - DNA, 22 bp, Homo sapiens
tttgaatgaaaaatttaagcat

SEQ ID NO: 3793697 - DNA, 23 bp, Homo sapiens
tttgaatgaaaaatttaagcatt

SEQ ID NO: 3793698 - DNA, 17 bp, Homo sapiens
tttgacatgtggaaagt

SEQ ID NO: 3793699 - DNA, 21 bp, Homo sapiens
tttgactagggattcaggctg

SEQ ID NO: 3793700 - DNA, 13 bp, Homo sapiens
tttgagacagagt

SEQ ID NO: 3793701 - DNA, 13 bp, Homo sapiens
tttgagacaggag

SEQ ID NO: 3793702 - DNA, 23 bp, Homo sapiens
tttgagggacaaatttaaaacaa

SEQ ID NO: 3793703 - DNA, 16 bp, Homo sapiens
tttgagtggatgatgt

SEQ ID NO: 3793704 - DNA, 14 bp, Homo sapiens
tttgagtgttttaa

SEQ ID NO: 3793705 - DNA, 23 bp, Homo sapiens
tttgatatccaaagctgaataca

SEQ ID NO: 3793706 - DNA, 18 bp, Homo sapiens
tttgatcaggtggggagt

SEQ ID NO: 3793707 - DNA, 15 bp, Homo sapiens
tttgatccaagctgg

SEQ ID NO: 3793708 - DNA, 20 bp, Homo sapiens
tttgcagaaaagcacctgcc

SEQ ID NO: 3793709 - DNA, 14 bp, Homo sapiens
tttgcagacaggca

SEQ ID NO: 3793710 - DNA, 22 bp, Homo sapiens
tttgccatgacaacttctaatt

SEQ ID NO: 3793711 - DNA, 18 bp, Homo sapiens
tttgcccatttacacttt

SEQ ID NO: 3793712 - DNA, 19 bp, Homo sapiens
tttgcccatttacactttt

SEQ ID NO: 3793713 - DNA, 11 bp, Homo sapiens
tttgcctgtgc

SEQ ID NO: 3793714 - DNA, 21 bp, Homo sapiens
tttgccttgggctgctcctca

SEQ ID NO: 3793715 - DNA, 22 bp, Homo sapiens
tttgctaactagcttggaaact

SEQ ID NO: 3793716 - DNA, 19 bp, Homo sapiens
tttgctccaccccactcac

SEQ ID NO: 3793717 - DNA, 13 bp, Homo sapiens
tttgctctttctt

SEQ ID NO: 3793718 - DNA, 15 bp, Homo sapiens
tttgcttattgttcc

SEQ ID NO: 3793719 - DNA, 17 bp, Homo sapiens
tttgcttattgttccaa

SEQ ID NO: 3793720 - DNA, 16 bp, Homo sapiens
tttgcttctctctcta

SEQ ID NO: 3793721 - DNA, 14 bp, Homo sapiens
tttgcttgaacaca

SEQ ID NO: 3793722 - DNA, 19 bp, Homo sapiens
tttgcttgaacacagtatt

SEQ ID NO: 3793723 - DNA, 22 bp, Homo sapiens
tttgcttttcctttgtttttat

SEQ ID NO: 3793724 - DNA, 18 bp, Homo sapiens
tttggaagtttgtgttct

SEQ ID NO: 3793725 - DNA, 13 bp, Homo sapiens
tttggaataaagt

SEQ ID NO: 3793726 - DNA, 21 bp, Homo sapiens
tttggaattttgtgcccccat

SEQ ID NO: 3793727 - DNA, 16 bp, Homo sapiens
tttggacgcacacagc

SEQ ID NO: 3793728 - DNA, 19 bp, Homo sapiens
tttggagaacgccagtctc

SEQ ID NO: 3793729 - DNA, 15 bp, Homo sapiens
tttggatagcatgtc

SEQ ID NO: 3793730 - DNA, 23 bp, Homo sapiens
tttggattgacagtaacttggtt

SEQ ID NO: 3793731 - DNA, 22 bp, Homo sapiens
tttggattggatgaattccaaa

SEQ ID NO: 3793732 - DNA, 22 bp, Homo sapiens
tttggcaggggcagaaaactct

SEQ ID NO: 3793733 - DNA, 17 bp, Homo sapiens
tttggcgggccaaggac

SEQ ID NO: 3793734 - DNA, 16 bp, Homo sapiens
tttggctagtccttgt

SEQ ID NO: 3793735 - DNA, 17 bp, Homo sapiens
tttgggaggctgaggcg

SEQ ID NO: 3793736 - DNA, 15 bp, Homo sapiens
tttgggatgtcttat

SEQ ID NO: 3793737 - DNA, 17 bp, Homo sapiens
tttgggatgtcttattt

SEQ ID NO: 3793738 - DNA, 21 bp, Homo sapiens
tttggggtacccactgctctg

SEQ ID NO: 3793739 - DNA, 16 bp, Homo sapiens
tttgggtttctgccct

SEQ ID NO: 3793740 - DNA, 22 bp, Homo sapiens
tttggtcctaagtccctgcccc

SEQ ID NO: 3793741 - DNA, 15 bp, Homo sapiens
tttggttaagttggc

SEQ ID NO: 3793742 - DNA, 13 bp, Homo sapiens
tttggtttctagc

SEQ ID NO: 3793743 - DNA, 21 bp, Homo sapiens
tttgtaaaaacagcattgctt

SEQ ID NO: 3793744 - DNA, 15 bp, Homo sapiens
tttgtaaataagaga

SEQ ID NO: 3793745 - DNA, 13 bp, Homo sapiens
tttgtaagaaacc

SEQ ID NO: 3793746 - DNA, 13 bp, Homo sapiens
tttgtaagttatt

SEQ ID NO: 3793747 - DNA, 14 bp, Homo sapiens
tttgtaccatggtg

SEQ ID NO: 3793748 - DNA, 17 bp, Homo sapiens
tttgtaccatggtgtga

SEQ ID NO: 3793749 - DNA, 16 bp, Homo sapiens
tttgtagggtttctag

SEQ ID NO: 3793750 - DNA, 14 bp, Homo sapiens
tttgtaggtacttt

SEQ ID NO: 3793751 - DNA, 16 bp, Homo sapiens
tttgtaggtacttttg

SEQ ID NO: 3793752 - DNA, 16 bp, Homo sapiens
tttgtagtcttaactt

SEQ ID NO: 3793753 - DNA, 16 bp, Homo sapiens
tttgtatagtaaagtg

SEQ ID NO: 3793754 - DNA, 14 bp, Homo sapiens
aaaagcagctacca

SEQ ID NO: 3793755 - DNA, 13 bp, Homo sapiens
aaaagcataaatg

SEQ ID NO: 3793756 - DNA, 15 bp, Homo sapiens
aaaagcataaatgca

SEQ ID NO: 3793757 - DNA, 14 bp, Homo sapiens
aaaagccatgttta

SEQ ID NO: 3793758 - DNA, 20 bp, Homo sapiens
aaaaggcggtactagttcag

SEQ ID NO: 3793759 - DNA, 14 bp, Homo sapiens
aaaagggacatgaa

SEQ ID NO: 3793760 - DNA, 23 bp, Homo sapiens
aaaagggcagggcatctcctgtg

SEQ ID NO: 3793761 - DNA, 14 bp, Homo sapiens
aaaaggtaaaactt

SEQ ID NO: 3793762 - DNA, 23 bp, Homo sapiens
aaaaggtaaaactttttatattt

SEQ ID NO: 3793763 - DNA, 15 bp, Homo sapiens
aaaaggtattaaatt

SEQ ID NO: 3793764 - DNA, 20 bp, Homo sapiens
aaaaggtgcctgtgaggcag

SEQ ID NO: 3793765 - DNA, 16 bp, Homo sapiens
aaaaggttaataaagt

SEQ ID NO: 3793766 - DNA, 17 bp, Homo sapiens
aaaaggttaataaagta

SEQ ID NO: 3793767 - DNA, 19 bp, Homo sapiens
aaaaggttcactaaagcag

SEQ ID NO: 3793768 - DNA, 15 bp, Homo sapiens
aaaagtacaatttac

SEQ ID NO: 3793769 - DNA, 22 bp, Homo sapiens
aaaagtatcgggggctggggca

SEQ ID NO: 3793770 - DNA, 22 bp, Homo sapiens
aaaagtctgattggttttaatt

SEQ ID NO: 3793771 - DNA, 14 bp, Homo sapiens
aaaagtctgcatta

SEQ ID NO: 3793772 - DNA, 18 bp, Homo sapiens
aaaagtctgcattacatt

SEQ ID NO: 3793773 - DNA, 23 bp, Homo sapiens
aaaagtgatcaataaaatgtgat

SEQ ID NO: 3793774 - DNA, 12 bp, Homo sapiens
aaaagttataac

SEQ ID NO: 3793775 - DNA, 17 bp, Homo sapiens
aaaagttattaatattt

SEQ ID NO: 3793776 - DNA, 12 bp, Homo sapiens
aaaagttgaaat

SEQ ID NO: 3793777 - DNA, 14 bp, Homo sapiens
aaaagttgaaatta

SEQ ID NO: 3793778 - DNA, 16 bp, Homo sapiens
aaaagtttgccagaag

SEQ ID NO: 3793779 - DNA, 13 bp, Homo sapiens
aaaataaaaatgg

SEQ ID NO: 3793780 - DNA, 13 bp, Homo sapiens
aaaataaaattaa

SEQ ID NO: 3793781 - DNA, 14 bp, Homo sapiens
aaaataaacaaata

SEQ ID NO: 3793782 - DNA, 16 bp, Homo sapiens
aaaataaagttacatt

SEQ ID NO: 3793783 - DNA, 12 bp, Homo sapiens
aaaataaattat

SEQ ID NO: 3793784 - DNA, 12 bp, Homo sapiens
aaaataaattga

SEQ ID NO: 3793785 - DNA, 18 bp, Homo sapiens
aaaataattttatgaact

SEQ ID NO: 3793786 - DNA, 12 bp, Homo sapiens
aaaatacatttt

SEQ ID NO: 3793787 - DNA, 13 bp, Homo sapiens
aaaatacatttta

SEQ ID NO: 3793788 - DNA, 14 bp, Homo sapiens
aaaatacattttat

SEQ ID NO: 3793789 - DNA, 23 bp, Homo sapiens
aaaatagcaacctttttatctcc

SEQ ID NO: 3793790 - DNA, 15 bp, Homo sapiens
aaaataggagagaga

SEQ ID NO: 3793791 - DNA, 18 bp, Homo sapiens
aaaataggtatacagtgg

SEQ ID NO: 3793792 - DNA, 18 bp, Homo sapiens
aaaatataaagcatctaa

SEQ ID NO: 3793793 - DNA, 12 bp, Homo sapiens
aaaatataattg

SEQ ID NO: 3793794 - DNA, 19 bp, Homo sapiens
aaaatataattgtttttta

SEQ ID NO: 3793795 - DNA, 24 bp, Homo sapiens
aaaatataattttttagagagctg

SEQ ID NO: 3793796 - DNA, 13 bp, Homo sapiens
aaaatatcattca

SEQ ID NO: 3793797 - DNA, 16 bp, Homo sapiens
aaaatatcattcagca

SEQ ID NO: 3793798 - DNA, 11 bp, Homo sapiens
aaaatatgcat

SEQ ID NO: 3793799 - DNA, 16 bp, Homo sapiens
aaaatattataactta

SEQ ID NO: 3793800 - DNA, 17 bp, Homo sapiens
aaaatattatctttgta

SEQ ID NO: 3793801 - DNA, 15 bp, Homo sapiens
aaaatattcctgcat

SEQ ID NO: 3793802 - DNA, 15 bp, Homo sapiens
aaaatatttgtacat

SEQ ID NO: 3793803 - DNA, 13 bp, Homo sapiens
aaaatattttata

SEQ ID NO: 3793804 - DNA, 13 bp, Homo sapiens
aaaatcagcctgc

SEQ ID NO: 3793805 - DNA, 21 bp, Homo sapiens
aaaatcagcctgctccagctg

SEQ ID NO: 3793806 - DNA, 22 bp, Homo sapiens
aaaatcataaactgtgtgcaga

SEQ ID NO: 3793807 - DNA, 12 bp, Homo sapiens
aaaatcatgaga

SEQ ID NO: 3793808 - DNA, 12 bp, Homo sapiens
aaaatcattgat

SEQ ID NO: 3793809 - DNA, 22 bp, Homo sapiens
aaaatcccttacctcggtgcct

SEQ ID NO: 3793810 - DNA, 12 bp, Homo sapiens
aaaatcctacca

SEQ ID NO: 3793811 - DNA, 14 bp, Homo sapiens
aaaatccttctaat

SEQ ID NO: 3793812 - DNA, 16 bp, Homo sapiens
aaaatctctctctgtt

SEQ ID NO: 3793813 - DNA, 16 bp, Homo sapiens
aaaatctgtggtggtc

SEQ ID NO: 3793814 - DNA, 9 bp, Homo sapiens
aaaatgaaa

SEQ ID NO: 3793815 - DNA, 22 bp, Homo sapiens
aaaatgaaagcatgtctcaata

SEQ ID NO: 3793816 - DNA, 15 bp, Homo sapiens
aaaatgaagattatt

SEQ ID NO: 3793817 - DNA, 23 bp, Homo sapiens
aaaatgaagattattttttatga

SEQ ID NO: 3793818 - DNA, 15 bp, Homo sapiens
aaaatgacagatgtt

SEQ ID NO: 3793819 - DNA, 18 bp, Homo sapiens
aaaatgacagatgttgaa

SEQ ID NO: 3793820 - DNA, 21 bp, Homo sapiens
aaaatgagcctggcaagaatg

SEQ ID NO: 3793821 - DNA, 19 bp, Homo sapiens
aaaatggccatttgctttt

SEQ ID NO: 3793822 - DNA, 23 bp, Homo sapiens
aaaatggccatttgctttttcac

SEQ ID NO: 3793823 - DNA, 17 bp, Homo sapiens
aaaatggtaaaattgca

SEQ ID NO: 3793824 - DNA, 23 bp, Homo sapiens
aaaatggtgttttcatgtaaata

SEQ ID NO: 3793825 - DNA, 23 bp, Homo sapiens
aaaatgtaagtaaatgtctgtgg

SEQ ID NO: 3793826 - DNA, 21 bp, Homo sapiens
aaaatgtagggttataataat

SEQ ID NO: 3793827 - DNA, 21 bp, Homo sapiens
aaaatgtctgtagctcctcaa

SEQ ID NO: 3793828 - DNA, 18 bp, Homo sapiens
aaaatgtgatttttctga

SEQ ID NO: 3793829 - DNA, 20 bp, Homo sapiens
aaaatgttttgtaagaaacc

SEQ ID NO: 3793830 - DNA, 14 bp, Homo sapiens
aaaattagaaattg

SEQ ID NO: 3793831 - DNA, 15 bp, Homo sapiens
aaaattagccaagtg

SEQ ID NO: 3793832 - DNA, 13 bp, Homo sapiens
aaaattcagtgga

SEQ ID NO: 3793833 - DNA, 16 bp, Homo sapiens
aaaattgaatttaaca

SEQ ID NO: 3793834 - DNA, 16 bp, Homo sapiens
aaaatttaagcattgt

SEQ ID NO: 3793835 - DNA, 23 bp, Homo sapiens
aaaatttccagtacctttgtcac

SEQ ID NO: 3793836 - DNA, 19 bp, Homo sapiens
aaaatttgaaccaaaacat

SEQ ID NO: 3793837 - DNA, 22 bp, Homo sapiens
aaaatttgaaccaaaacattcc

SEQ ID NO: 3793838 - DNA, 23 bp, Homo sapiens
aaaatttttggattgacagtaac

SEQ ID NO: 3793839 - DNA, 13 bp, Homo sapiens
aaacaaaaaacaa

SEQ ID NO: 3793840 - DNA, 13 bp, Homo sapiens
aaacaaaaacact

SEQ ID NO: 3793841 - DNA, 20 bp, Homo sapiens
aaacaaaaattcacaagctg

SEQ ID NO: 3793842 - DNA, 15 bp, Homo sapiens
aaacaaacaagctag

SEQ ID NO: 3793843 - DNA, 12 bp, Homo sapiens
aaacaaagccag

SEQ ID NO: 3793844 - DNA, 14 bp, Homo sapiens
aaacaaatatgcaa

SEQ ID NO: 3793845 - DNA, 17 bp, Homo sapiens
aaacaaatatgcaaaag

SEQ ID NO: 3793846 - DNA, 17 bp, Homo sapiens
aaacaactttctcttgt

SEQ ID NO: 3793847 - DNA, 15 bp, Homo sapiens
aaacaagaaagtttc

SEQ ID NO: 3793848 - DNA, 22 bp, Homo sapiens
aaacaagagttttcttccttgt

SEQ ID NO: 3793849 - DNA, 16 bp, Homo sapiens
aaacaatattgtttct

SEQ ID NO: 3793850 - DNA, 17 bp, Homo sapiens
aaacaatattgtttcta

SEQ ID NO: 3793851 - DNA, 19 bp, Homo sapiens
aaacacatagattcacctg

SEQ ID NO: 3793852 - DNA, 22 bp, Homo sapiens
aaacacatagattcacctgtaa

SEQ ID NO: 3793853 - DNA, 16 bp, Homo sapiens
aaacacatcttcccta

SEQ ID NO: 3793854 - DNA, 23 bp, Homo sapiens
aaacactatttttttttcttttg

SEQ ID NO: 3793855 - DNA, 24 bp, Homo sapiens
aaacacttgcggatattctggact

SEQ ID NO: 3793856 - DNA, 22 bp, Homo sapiens
aaacagagacaggcccaagaga

SEQ ID NO: 3793857 - DNA, 16 bp, Homo sapiens
aaacagagatgtgata

SEQ ID NO: 3793858 - DNA, 20 bp, Homo sapiens
aaacagaggccatggcagaa

SEQ ID NO: 3793859 - DNA, 20 bp, Homo sapiens
aaacagatttggtgaatttg

SEQ ID NO: 3793860 - DNA, 16 bp, Homo sapiens
aaacagcattgctttc

SEQ ID NO: 3793861 - DNA, 17 bp, Homo sapiens
aaacagctaatgggaca

SEQ ID NO: 3793862 - DNA, 22 bp, Homo sapiens
aaacagcttcatgcctttgtaa

SEQ ID NO: 3793863 - DNA, 15 bp, Homo sapiens
aaacaggaaaaaaac

SEQ ID NO: 3793864 - DNA, 11 bp, Homo sapiens
aaacaggcagt

SEQ ID NO: 3793865 - DNA, 21 bp, Homo sapiens
aaacagggtgttgtcagcatc

SEQ ID NO: 3793866 - DNA, 23 bp, Homo sapiens
aaacagggtgttgtcagcatctt

SEQ ID NO: 3793867 - DNA, 23 bp, Homo sapiens
aaattgaaaggcattctctgaag

SEQ ID NO: 3793868 - DNA, 13 bp, Homo sapiens
aaattgaatttaa

SEQ ID NO: 3793869 - DNA, 15 bp, Homo sapiens
aaattgaatttaaca

SEQ ID NO: 3793870 - DNA, 17 bp, Homo sapiens
aaattgagagaatggaa

SEQ ID NO: 3793871 - DNA, 16 bp, Homo sapiens
aaattgcatgctgctt

SEQ ID NO: 3793872 - DNA, 17 bp, Homo sapiens
aaattgcatgctgcttt

SEQ ID NO: 3793873 - DNA, 14 bp, Homo sapiens
aaattgctccttga

SEQ ID NO: 3793874 - DNA, 16 bp, Homo sapiens
aaattggctagttgaa

SEQ ID NO: 3793875 - DNA, 22 bp, Homo sapiens
aaattgtttaagtgttgtaaat

SEQ ID NO: 3793876 - DNA, 21 bp, Homo sapiens
aaattgtttcaaaataaaaac

SEQ ID NO: 3793877 - DNA, 13 bp, Homo sapiens
aaatttaaaacaa

SEQ ID NO: 3793878 - DNA, 13 bp, Homo sapiens
aaatttaagcatt

SEQ ID NO: 3793879 - DNA, 20 bp, Homo sapiens
aaatttaatatagctatttt

SEQ ID NO: 3793880 - DNA, 18 bp, Homo sapiens
aaatttaattcatgtttc

SEQ ID NO: 3793881 - DNA, 14 bp, Homo sapiens
aaatttataatttt

SEQ ID NO: 3793882 - DNA, 19 bp, Homo sapiens
aaatttccagtgagcttat

SEQ ID NO: 3793883 - DNA, 12 bp, Homo sapiens
aaatttggaatt

SEQ ID NO: 3793884 - DNA, 18 bp, Homo sapiens
aaattttcacataaaata

SEQ ID NO: 3793885 - DNA, 14 bp, Homo sapiens
aaattttcttcagt

SEQ ID NO: 3793886 - DNA, 17 bp, Homo sapiens
aaattttcttcagttgg

SEQ ID NO: 3793887 - DNA, 18 bp, Homo sapiens
aaattttggccaaagtgt

SEQ ID NO: 3793888 - DNA, 17 bp, Homo sapiens
aaattttgtaattttct

SEQ ID NO: 3793889 - DNA, 18 bp, Homo sapiens
aaattttgtaattttctt

SEQ ID NO: 3793890 - DNA, 19 bp, Homo sapiens
aaattttgtaattttcttg

SEQ ID NO: 3793891 - DNA, 21 bp, Homo sapiens
aaatttttcagatgcttctgg

SEQ ID NO: 3793892 - DNA, 17 bp, Homo sapiens
aaatttttccttagcat

SEQ ID NO: 3793893 - DNA, 17 bp, Homo sapiens
aaatttttggattgaca

SEQ ID NO: 3793894 - DNA, 19 bp, Homo sapiens
aaatttttggattgacagt

SEQ ID NO: 3793895 - DNA, 21 bp, Homo sapiens
aacaaaccctcgtttctgatt

SEQ ID NO: 3793896 - DNA, 11 bp, Homo sapiens
aacaaagccag

SEQ ID NO: 3793897 - DNA, 12 bp, Homo sapiens
aacaaagccaga

SEQ ID NO: 3793898 - DNA, 16 bp, Homo sapiens
aacaaaggttgagatg

SEQ ID NO: 3793899 - DNA, 19 bp, Homo sapiens
aacaaagtggaaggaaaga

SEQ ID NO: 3793900 - DNA, 12 bp, Homo sapiens
aacaaatatgca

SEQ ID NO: 3793901 - DNA, 13 bp, Homo sapiens
aacaaatatgcaa

SEQ ID NO: 3793902 - DNA, 18 bp, Homo sapiens
aacaaccccccatcacaa

SEQ ID NO: 3793903 - DNA, 17 bp, Homo sapiens
aacaacttctttgtaat

SEQ ID NO: 3793904 - DNA, 14 bp, Homo sapiens
aacaagaaaacata

SEQ ID NO: 3793905 - DNA, 16 bp, Homo sapiens
aacaagaaagtttccc

SEQ ID NO: 3793906 - DNA, 19 bp, Homo sapiens
aacaagagcgaaactccgt

SEQ ID NO: 3793907 - DNA, 19 bp, Homo sapiens
aacaagatctttcaggaaa

SEQ ID NO: 3793908 - DNA, 18 bp, Homo sapiens
aacaagggcagtggaggt

SEQ ID NO: 3793909 - DNA, 20 bp, Homo sapiens
aacaataactactgtgttcc

SEQ ID NO: 3793910 - DNA, 12 bp, Homo sapiens
aacaatatttat

SEQ ID NO: 3793911 - DNA, 23 bp, Homo sapiens
aacaattttaggaggaccagagc

SEQ ID NO: 3793912 - DNA, 15 bp, Homo sapiens
aacacaaggtgggca

SEQ ID NO: 3793913 - DNA, 13 bp, Homo sapiens
aacacaatgttat

SEQ ID NO: 3793914 - DNA, 17 bp, Homo sapiens
aacacaatgttattcgt

SEQ ID NO: 3793915 - DNA, 14 bp, Homo sapiens
aacacacaaaggta

SEQ ID NO: 3793916 - DNA, 12 bp, Homo sapiens
aacacacagaca

SEQ ID NO: 3793917 - DNA, 14 bp, Homo sapiens
aacacacataaagg

SEQ ID NO: 3793918 - DNA, 16 bp, Homo sapiens
aacacaccaggctgtg

SEQ ID NO: 3793919 - DNA, 21 bp, Homo sapiens
aacacactgaggcagggaagt

SEQ ID NO: 3793920 - DNA, 20 bp, Homo sapiens
aacacagacattctgccagg

SEQ ID NO: 3793921 - DNA, 15 bp, Homo sapiens
aacacaggcaaaatc

SEQ ID NO: 3793922 - DNA, 21 bp, Homo sapiens
aacacattatcgggagcagtg

SEQ ID NO: 3793923 - DNA, 20 bp, Homo sapiens
aacacatttgattctgtgtg

SEQ ID NO: 3793924 - DNA, 18 bp, Homo sapiens
aacacctagatcagaaca

SEQ ID NO: 3793925 - DNA, 14 bp, Homo sapiens
aacactgcttgtgt

SEQ ID NO: 3793926 - DNA, 17 bp, Homo sapiens
aacactgcttgtgtttt

SEQ ID NO: 3793927 - DNA, 12 bp, Homo sapiens
aacactggcccc

SEQ ID NO: 3793928 - DNA, 17 bp, Homo sapiens
aacactgggggagggga

SEQ ID NO: 3793929 - DNA, 23 bp, Homo sapiens
aacactggtggaggatggaaagg

SEQ ID NO: 3793930 - DNA, 22 bp, Homo sapiens
aacacttaagggttttagaaaa

SEQ ID NO: 3793931 - DNA, 12 bp, Homo sapiens
aacagaaaaaaa

SEQ ID NO: 3793932 - DNA, 13 bp, Homo sapiens
aacagaaacaaaa

SEQ ID NO: 3793933 - DNA, 18 bp, Homo sapiens
aacagacaacagaagtca

SEQ ID NO: 3793934 - DNA, 18 bp, Homo sapiens
aacagaccccctctagaa

SEQ ID NO: 3793935 - DNA, 16 bp, Homo sapiens
aacagagaaggcagga

SEQ ID NO: 3793936 - DNA, 18 bp, Homo sapiens
aacagataagcaagagag

SEQ ID NO: 3793937 - DNA, 23 bp, Homo sapiens
aacagatgcaatgtgctactgat

SEQ ID NO: 3793938 - DNA, 22 bp, Homo sapiens
aacagatttggtgaatttgaat

SEQ ID NO: 3793939 - DNA, 16 bp, Homo sapiens
aacagcattgctttct

SEQ ID NO: 3793940 - DNA, 17 bp, Homo sapiens
aacagcattgctttctg

SEQ ID NO: 3793941 - DNA, 22 bp, Homo sapiens
aacagccgagtggatagatgcc

SEQ ID NO: 3793942 - DNA, 21 bp, Homo sapiens
aacagccgctcctgtctgcca

SEQ ID NO: 3793943 - DNA, 13 bp, Homo sapiens
aacagcctcacag

SEQ ID NO: 3793944 - DNA, 14 bp, Homo sapiens
aacagcctcacaga

SEQ ID NO: 3793945 - DNA, 19 bp, Homo sapiens
aacagctgaggtctcttga

SEQ ID NO: 3793946 - DNA, 14 bp, Homo sapiens
aacaggaaaagaaa

SEQ ID NO: 3793947 - DNA, 22 bp, Homo sapiens
aacaggaaaggctcgaaataca

SEQ ID NO: 3793948 - DNA, 20 bp, Homo sapiens
aacaggctcaatattcctga

SEQ ID NO: 3793949 - DNA, 15 bp, Homo sapiens
aacagggccttgcta

SEQ ID NO: 3793950 - DNA, 15 bp, Homo sapiens
aacaggtctcctctt

SEQ ID NO: 3793951 - DNA, 19 bp, Homo sapiens
aacaggtctcctcttaaaa

SEQ ID NO: 3793952 - DNA, 20 bp, Homo sapiens
aacaggtctcctcttaaaaa

SEQ ID NO: 3793953 - DNA, 18 bp, Homo sapiens
aacagtcttactgcaggc

SEQ ID NO: 3793954 - DNA, 21 bp, Homo sapiens
aacagtgagcctgaattttgt

SEQ ID NO: 3793955 - DNA, 14 bp, Homo sapiens
aacagtgcctgctg

SEQ ID NO: 3793956 - DNA, 15 bp, Homo sapiens
aacagtgcctgctga

SEQ ID NO: 3793957 - DNA, 15 bp, Homo sapiens
aacagtggaatataa

SEQ ID NO: 3793958 - DNA, 13 bp, Homo sapiens
aacagtgtttccc

SEQ ID NO: 3793959 - DNA, 19 bp, Homo sapiens
aacagtgtttcccataatt

SEQ ID NO: 3793960 - DNA, 21 bp, Homo sapiens
aacagtgtttcccataatttt

SEQ ID NO: 3793961 - DNA, 17 bp, Homo sapiens
aacagttaactttcaga

SEQ ID NO: 3793962 - DNA, 14 bp, Homo sapiens
aacagttccttcag

SEQ ID NO: 3793963 - DNA, 14 bp, Homo sapiens
aacagtttgtacag

SEQ ID NO: 3793964 - DNA, 18 bp, Homo sapiens
aacagttttccatgaaaa

SEQ ID NO: 3793965 - DNA, 13 bp, Homo sapiens
aacataaaaagtt

SEQ ID NO: 3793966 - DNA, 12 bp, Homo sapiens
aacataaaggtt

SEQ ID NO: 3793967 - DNA, 14 bp, Homo sapiens
aacataacaaataa

SEQ ID NO: 3793968 - DNA, 21 bp, Homo sapiens
aacataaccattacagggagc

SEQ ID NO: 3793969 - DNA, 20 bp, Homo sapiens
aacatagactagagaaaccg

SEQ ID NO: 3793970 - DNA, 21 bp, Homo sapiens
aacatataatatatgttttaa

SEQ ID NO: 3793971 - DNA, 18 bp, Homo sapiens
aacatataatgttgttat

SEQ ID NO: 3793972 - DNA, 21 bp, Homo sapiens
aacatataatgttgttattta

SEQ ID NO: 3793973 - DNA, 22 bp, Homo sapiens
aacatataatgttgttatttaa

SEQ ID NO: 3793974 - DNA, 15 bp, Homo sapiens
aacatatttaagaaa

SEQ ID NO: 3793975 - DNA, 16 bp, Homo sapiens
aacatatttaaggaac

SEQ ID NO: 3793976 - DNA, 20 bp, Homo sapiens
aacatatttgttaaatattt

SEQ ID NO: 3793977 - DNA, 12 bp, Homo sapiens
aacatcaatgtt

SEQ ID NO: 3793978 - DNA, 14 bp, Homo sapiens
aacatcaatgttca

SEQ ID NO: 3793979 - DNA, 15 bp, Homo sapiens
aacatcagacctgtc

SEQ ID NO: 3793980 - DNA, 22 bp, Homo sapiens
aacatccaaggagaaacagaga

SEQ ID NO: 3793981 - DNA, 23 bp, Homo sapiens
aagcattgtttgcttattgttcc

SEQ ID NO: 3793982 - DNA, 15 bp, Homo sapiens
aagccaaactctgcc

SEQ ID NO: 3793983 - DNA, 20 bp, Homo sapiens
aagccaaactctgccagcca

SEQ ID NO: 3793984 - DNA, 17 bp, Homo sapiens
aagccaaagctaggcct

SEQ ID NO: 3793985 - DNA, 20 bp, Homo sapiens
aagccaaagctaggcctggc

SEQ ID NO: 3793986 - DNA, 22 bp, Homo sapiens
aagccaaagctaggcctggcca

SEQ ID NO: 3793987 - DNA, 16 bp, Homo sapiens
aagccaacgacaaagc

SEQ ID NO: 3793988 - DNA, 13 bp, Homo sapiens
aagccaagcagcc

SEQ ID NO: 3793989 - DNA, 18 bp, Homo sapiens
aagccacagcccaggcct

SEQ ID NO: 3793990 - DNA, 15 bp, Homo sapiens
aagccaccctcccag

SEQ ID NO: 3793991 - DNA, 17 bp, Homo sapiens
aagccactgaagctggg

SEQ ID NO: 3793992 - DNA, 17 bp, Homo sapiens
aagccagaagctgagca

SEQ ID NO: 3793993 - DNA, 20 bp, Homo sapiens
aagccagaagctgagcacca

SEQ ID NO: 3793994 - DNA, 21 bp, Homo sapiens
aagccagctgccgaccagagc

SEQ ID NO: 3793995 - DNA, 23 bp, Homo sapiens
aagccaggtgtggtggtatgtgc

SEQ ID NO: 3793996 - DNA, 12 bp, Homo sapiens
aagccagtctta

SEQ ID NO: 3793997 - DNA, 15 bp, Homo sapiens
aagccatgtttaaga

SEQ ID NO: 3793998 - DNA, 20 bp, Homo sapiens
aagccattctaaggaaatta

SEQ ID NO: 3793999 - DNA, 15 bp, Homo sapiens
aagcccagctccagg

SEQ ID NO: 3794000 - DNA, 21 bp, Homo sapiens
aagcccagctccagggccaga

SEQ ID NO: 3794001 - DNA, 22 bp, Homo sapiens
aagcccatcaattatagaaagc

SEQ ID NO: 3794002 - DNA, 19 bp, Homo sapiens
aagcccattcctctgccag

SEQ ID NO: 3794003 - DNA, 17 bp, Homo sapiens
aagccccaggcaggctg

SEQ ID NO: 3794004 - DNA, 12 bp, Homo sapiens
aagccctccttc

SEQ ID NO: 3794005 - DNA, 23 bp, Homo sapiens
aagccctgattgtgtatattcat

SEQ ID NO: 3794006 - DNA, 15 bp, Homo sapiens
aagcccttccatgtc

SEQ ID NO: 3794007 - DNA, 23 bp, Homo sapiens
aagcccttccatgtcgcctctgc

SEQ ID NO: 3794008 - DNA, 14 bp, Homo sapiens
aagccgggaacaga

SEQ ID NO: 3794009 - DNA, 14 bp, Homo sapiens
aagccgtgccctgc

SEQ ID NO: 3794010 - DNA, 13 bp, Homo sapiens
aagccgtggcttc

SEQ ID NO: 3794011 - DNA, 12 bp, Homo sapiens
aagcctctggct

SEQ ID NO: 3794012 - DNA, 23 bp, Homo sapiens
aagcctgcctaggaattcccagc

SEQ ID NO: 3794013 - DNA, 14 bp, Homo sapiens
aagcctttccataa

SEQ ID NO: 3794014 - DNA, 21 bp, Homo sapiens
aagcggaggttgcagggagcc

SEQ ID NO: 3794015 - DNA, 21 bp, Homo sapiens
aagcggagttcctaacaggat

SEQ ID NO: 3794016 - DNA, 23 bp, Homo sapiens
aagcgtgaaggccgagaagcaag

SEQ ID NO: 3794017 - DNA, 17 bp, Homo sapiens
aagcgtgagccactgca

SEQ ID NO: 3794018 - DNA, 18 bp, Homo sapiens
aagctaataattcttcac

SEQ ID NO: 3794019 - DNA, 20 bp, Homo sapiens
aagctatagacccgaggaaa

SEQ ID NO: 3794020 - DNA, 11 bp, Homo sapiens
aagctcacagt

SEQ ID NO: 3794021 - DNA, 13 bp, Homo sapiens
aagctcagcccac

SEQ ID NO: 3794022 - DNA, 21 bp, Homo sapiens
aagctcagcccacccccctca

SEQ ID NO: 3794023 - DNA, 18 bp, Homo sapiens
aagctccagtcctgctct

SEQ ID NO: 3794024 - DNA, 14 bp, Homo sapiens
aagctccatctcca

SEQ ID NO: 3794025 - DNA, 19 bp, Homo sapiens
aagctcctggtcttgagat

SEQ ID NO: 3794026 - DNA, 12 bp, Homo sapiens
aagctctgaagt

SEQ ID NO: 3794027 - DNA, 15 bp, Homo sapiens
aagctgaagccgcca

SEQ ID NO: 3794028 - DNA, 22 bp, Homo sapiens
aagctgcaccctcaggcaggtg

SEQ ID NO: 3794029 - DNA, 15 bp, Homo sapiens
aagctgccctgccca

SEQ ID NO: 3794030 - DNA, 14 bp, Homo sapiens
aagctgcctccctg

SEQ ID NO: 3794031 - DNA, 18 bp, Homo sapiens
aagctgcctccctgtcca

SEQ ID NO: 3794032 - DNA, 16 bp, Homo sapiens
aagctgcctgtagtta

SEQ ID NO: 3794033 - DNA, 22 bp, Homo sapiens
aagctgctaaatctcctatttt

SEQ ID NO: 3794034 - DNA, 21 bp, Homo sapiens
aagctggccgagggtcctggc

SEQ ID NO: 3794035 - DNA, 11 bp, Homo sapiens
aagctgggcag

SEQ ID NO: 3794036 - DNA, 21 bp, Homo sapiens
aagctggtgggtgaaagaaat

SEQ ID NO: 3794037 - DNA, 23 bp, Homo sapiens
aagctggtgggtgaaagaaatca

SEQ ID NO: 3794038 - DNA, 18 bp, Homo sapiens
aagctgttactgtcttca

SEQ ID NO: 3794039 - DNA, 15 bp, Homo sapiens
aagctgtttccatag

SEQ ID NO: 3794040 - DNA, 15 bp, Homo sapiens
aagcttaaaaaaaac

SEQ ID NO: 3794041 - DNA, 13 bp, Homo sapiens
aagcttactaaag

SEQ ID NO: 3794042 - DNA, 17 bp, Homo sapiens
aagcttattaatgctaa

SEQ ID NO: 3794043 - DNA, 16 bp, Homo sapiens
aagcttccattccaca

SEQ ID NO: 3794044 - DNA, 20 bp, Homo sapiens
aagcttcttaaatgagaagg

SEQ ID NO: 3794045 - DNA, 13 bp, Homo sapiens
aagctttcctgga

SEQ ID NO: 3794046 - DNA, 19 bp, Homo sapiens
aagctttgaatactaaatt

SEQ ID NO: 3794047 - DNA, 17 bp, Homo sapiens
aagcttttttatttttt

SEQ ID NO: 3794048 - DNA, 22 bp, Homo sapiens
aagcttttttattttttataca

SEQ ID NO: 3794049 - DNA, 17 bp, Homo sapiens
aaggaaaatagtaatgt

SEQ ID NO: 3794050 - DNA, 22 bp, Homo sapiens
aaggaaaccaagtggtcaggag

SEQ ID NO: 3794051 - DNA, 13 bp, Homo sapiens
aaggaaagcaata

SEQ ID NO: 3794052 - DNA, 20 bp, Homo sapiens
aaggaaagcaataaatgaat

SEQ ID NO: 3794053 - DNA, 20 bp, Homo sapiens
aaggaaataaaaaagtctct

SEQ ID NO: 3794054 - DNA, 16 bp, Homo sapiens
aaggaaatctcacccc

SEQ ID NO: 3794055 - DNA, 13 bp, Homo sapiens
aaggaagactaga

SEQ ID NO: 3794056 - DNA, 19 bp, Homo sapiens
aaggaagctttctctgctt

SEQ ID NO: 3794057 - DNA, 11 bp, Homo sapiens
aaggaaggaaa

SEQ ID NO: 3794058 - DNA, 12 bp, Homo sapiens
aaggaaggaaag

SEQ ID NO: 3794059 - DNA, 20 bp, Homo sapiens
aaggaaggagactcacctct

SEQ ID NO: 3794060 - DNA, 22 bp, Homo sapiens
aaggaagttactgttatagagg

SEQ ID NO: 3794061 - DNA, 19 bp, Homo sapiens
aaggaatgcctgtgccaat

SEQ ID NO: 3794062 - DNA, 16 bp, Homo sapiens
aaggacaaagtctcca

SEQ ID NO: 3794063 - DNA, 18 bp, Homo sapiens
aaggacaggcagaaagag

SEQ ID NO: 3794064 - DNA, 22 bp, Homo sapiens
aaggacctatgtttgctcagaa

SEQ ID NO: 3794065 - DNA, 17 bp, Homo sapiens
aaggactggattggcca

SEQ ID NO: 3794066 - DNA, 12 bp, Homo sapiens
aaggacttgaaa

SEQ ID NO: 3794067 - DNA, 19 bp, Homo sapiens
aaggacttgaaagcatcca

SEQ ID NO: 3794068 - DNA, 19 bp, Homo sapiens
aaggagaaacagagacagg

SEQ ID NO: 3794069 - DNA, 22 bp, Homo sapiens
aaggagactcacctctgcctca

SEQ ID NO: 3794070 - DNA, 11 bp, Homo sapiens
aaggagagcta

SEQ ID NO: 3794071 - DNA, 15 bp, Homo sapiens
aaggagagtcttgca

SEQ ID NO: 3794072 - DNA, 21 bp, Homo sapiens
aaggagagtcttgcagtgatt

SEQ ID NO: 3794073 - DNA, 15 bp, Homo sapiens
aaggagatgaagcaa

SEQ ID NO: 3794074 - DNA, 17 bp, Homo sapiens
aaggaggagagggaaaa

SEQ ID NO: 3794075 - DNA, 23 bp, Homo sapiens
aaggaggatggcatataatacaa

SEQ ID NO: 3794076 - DNA, 20 bp, Homo sapiens
aaggaggggatagagagaga

SEQ ID NO: 3794077 - DNA, 21 bp, Homo sapiens
aaggagggtggatcacctgag

SEQ ID NO: 3794078 - DNA, 18 bp, Homo sapiens
aaggagggttagggaggg

SEQ ID NO: 3794079 - DNA, 15 bp, Homo sapiens
aaggatctgttttta

SEQ ID NO: 3794080 - DNA, 23 bp, Homo sapiens
aaggatctgtttttaaaaatcat

SEQ ID NO: 3794081 - DNA, 23 bp, Homo sapiens
aaggatctttcacccacagaaag

SEQ ID NO: 3794082 - DNA, 23 bp, Homo sapiens
aaggatgaatgaggtcccaggca

SEQ ID NO: 3794083 - DNA, 15 bp, Homo sapiens
aaggatgtacatttc

SEQ ID NO: 3794084 - DNA, 16 bp, Homo sapiens
aaggattcatgtggaa

SEQ ID NO: 3794085 - DNA, 15 bp, Homo sapiens
aaggattgctactgt

SEQ ID NO: 3794086 - DNA, 12 bp, Homo sapiens
aaggatttttct

SEQ ID NO: 3794087 - DNA, 20 bp, Homo sapiens
aaggcaactgaacaaaaaaa

SEQ ID NO: 3794088 - DNA, 15 bp, Homo sapiens
aaggcaccagccggg

SEQ ID NO: 3794089 - DNA, 18 bp, Homo sapiens
aaggcagggaaaggctct

SEQ ID NO: 3794090 - DNA, 23 bp, Homo sapiens
aaggcatgcctggacaaaccctt

SEQ ID NO: 3794091 - DNA, 12 bp, Homo sapiens
aaggcattctct

SEQ ID NO: 3794092 - DNA, 17 bp, Homo sapiens
aaggcattctctgaaga

SEQ ID NO: 3794093 - DNA, 12 bp, Homo sapiens
aaggccacctgc

SEQ ID NO: 3794094 - DNA, 19 bp, Homo sapiens
aatctattgggttcattat

SEQ ID NO: 3794095 - DNA, 13 bp, Homo sapiens
aatctcaccccat

SEQ ID NO: 3794096 - DNA, 14 bp, Homo sapiens
aatctcctattttt

SEQ ID NO: 3794097 - DNA, 15 bp, Homo sapiens
aatctcctcttttat

SEQ ID NO: 3794098 - DNA, 18 bp, Homo sapiens
aatctcctcttttatctt

SEQ ID NO: 3794099 - DNA, 21 bp, Homo sapiens
aatctcttctaaaaaaaaaca

SEQ ID NO: 3794100 - DNA, 14 bp, Homo sapiens
aatctgaatgtaat

SEQ ID NO: 3794101 - DNA, 19 bp, Homo sapiens
aatctgcctattgcagctg

SEQ ID NO: 3794102 - DNA, 18 bp, Homo sapiens
aatctgtaagctctttga

SEQ ID NO: 3794103 - DNA, 21 bp, Homo sapiens
aatctgtccaaaggaggctgg

SEQ ID NO: 3794104 - DNA, 14 bp, Homo sapiens
aatctgtgcaataa

SEQ ID NO: 3794105 - DNA, 15 bp, Homo sapiens
aatctgtgcaataaa

SEQ ID NO: 3794106 - DNA, 16 bp, Homo sapiens
aatctgtgcaataaaa

SEQ ID NO: 3794107 - DNA, 14 bp, Homo sapiens
aatgaaaaattctc

SEQ ID NO: 3794108 - DNA, 17 bp, Homo sapiens
aatgaaaaattctcagt

SEQ ID NO: 3794109 - DNA, 18 bp, Homo sapiens
aatgaaaaatttaagcat

SEQ ID NO: 3794110 - DNA, 23 bp, Homo sapiens
aatgaaaatgtcagaaaccagtt

SEQ ID NO: 3794111 - DNA, 17 bp, Homo sapiens
aatgaaacattttgtca

SEQ ID NO: 3794112 - DNA, 21 bp, Homo sapiens
aatgaaagactgtacaaagta

SEQ ID NO: 3794113 - DNA, 17 bp, Homo sapiens
aatgaaagtataactga

SEQ ID NO: 3794114 - DNA, 17 bp, Homo sapiens
aatgaaatgctctcctt

SEQ ID NO: 3794115 - DNA, 12 bp, Homo sapiens
aatgaaatgttt

SEQ ID NO: 3794116 - DNA, 12 bp, Homo sapiens
aatgaaatttta

SEQ ID NO: 3794117 - DNA, 13 bp, Homo sapiens
aatgaaattttac

SEQ ID NO: 3794118 - DNA, 14 bp, Homo sapiens
aatgaaattttacc

SEQ ID NO: 3794119 - DNA, 17 bp, Homo sapiens
aatgaaccacatcttgc

SEQ ID NO: 3794120 - DNA, 15 bp, Homo sapiens
aatgaagtttataca

SEQ ID NO: 3794121 - DNA, 16 bp, Homo sapiens
aatgaataatttccca

SEQ ID NO: 3794122 - DNA, 14 bp, Homo sapiens
aatgaatgaaacat

SEQ ID NO: 3794123 - DNA, 17 bp, Homo sapiens
aatgaatgcataaaatg

SEQ ID NO: 3794124 - DNA, 23 bp, Homo sapiens
aatgaatgtttacactctttgta

SEQ ID NO: 3794125 - DNA, 14 bp, Homo sapiens
aatgaccaatatta

SEQ ID NO: 3794126 - DNA, 20 bp, Homo sapiens
aatgactaaaaaacaaagaa

SEQ ID NO: 3794127 - DNA, 17 bp, Homo sapiens
aatgactaaaaatatta

SEQ ID NO: 3794128 - DNA, 17 bp, Homo sapiens
aatgagaaggaatttga

SEQ ID NO: 3794129 - DNA, 19 bp, Homo sapiens
aatgagaccctcgtggcct

SEQ ID NO: 3794130 - DNA, 16 bp, Homo sapiens
aatgagatagtagcat

SEQ ID NO: 3794131 - DNA, 17 bp, Homo sapiens
aatgagatcccgcctct

SEQ ID NO: 3794132 - DNA, 18 bp, Homo sapiens
aatgaggaggaaggagag

SEQ ID NO: 3794133 - DNA, 14 bp, Homo sapiens
aatgagggccaaga

SEQ ID NO: 3794134 - DNA, 19 bp, Homo sapiens
aatgaggtctgaaatggag

SEQ ID NO: 3794135 - DNA, 15 bp, Homo sapiens
aatgagtttctttta

SEQ ID NO: 3794136 - DNA, 22 bp, Homo sapiens
aatgatctctctgaatcctaag

SEQ ID NO: 3794137 - DNA, 17 bp, Homo sapiens
aatgatcttttcaagtt

SEQ ID NO: 3794138 - DNA, 23 bp, Homo sapiens
aatgatgatgacgacgacaacga

SEQ ID NO: 3794139 - DNA, 18 bp, Homo sapiens
aatgatgatgataatgat

SEQ ID NO: 3794140 - DNA, 12 bp, Homo sapiens
aatgatgcacat

SEQ ID NO: 3794141 - DNA, 17 bp, Homo sapiens
aatgatggcaattttgt

SEQ ID NO: 3794142 - DNA, 14 bp, Homo sapiens
aatgcaaattctca

SEQ ID NO: 3794143 - DNA, 14 bp, Homo sapiens
aatgcaatatgtat

SEQ ID NO: 3794144 - DNA, 19 bp, Homo sapiens
aatgcacaatgtcttggta

SEQ ID NO: 3794145 - DNA, 17 bp, Homo sapiens
aatgcacactagcctct

SEQ ID NO: 3794146 - DNA, 13 bp, Homo sapiens
aatgcataaaatg

SEQ ID NO: 3794147 - DNA, 20 bp, Homo sapiens
aatgcatcaatcctgtgtgg

SEQ ID NO: 3794148 - DNA, 21 bp, Homo sapiens
aatgcatcaatcctgtgtggt

SEQ ID NO: 3794149 - DNA, 23 bp, Homo sapiens
aatgcatccattcctcagggaca

SEQ ID NO: 3794150 - DNA, 21 bp, Homo sapiens
aatgccatggacagaagaagg

SEQ ID NO: 3794151 - DNA, 12 bp, Homo sapiens
aatgcctcctcc

SEQ ID NO: 3794152 - DNA, 14 bp, Homo sapiens
aatgcctcctccct

SEQ ID NO: 3794153 - DNA, 14 bp, Homo sapiens
aatgcctgtgccaa

SEQ ID NO: 3794154 - DNA, 19 bp, Homo sapiens
aatgcctgtgccaataaaa

SEQ ID NO: 3794155 - DNA, 17 bp, Homo sapiens
aatgccttactttgtat

SEQ ID NO: 3794156 - DNA, 19 bp, Homo sapiens
aatgccttactttgtatga

SEQ ID NO: 3794157 - DNA, 11 bp, Homo sapiens
aatgctccccc

SEQ ID NO: 3794158 - DNA, 21 bp, Homo sapiens
aatgctggttttcctaaatgc

SEQ ID NO: 3794159 - DNA, 20 bp, Homo sapiens
aatgcttatcatctaaagat

SEQ ID NO: 3794160 - DNA, 21 bp, Homo sapiens
aatgcttggaatatctgctgt

SEQ ID NO: 3794161 - DNA, 23 bp, Homo sapiens
aatggaagatttgcccatttaca

SEQ ID NO: 3794162 - DNA, 20 bp, Homo sapiens
aatggatccccagtgaaaac

SEQ ID NO: 3794163 - DNA, 22 bp, Homo sapiens
aatggatccccagtgaaaacta

SEQ ID NO: 3794164 - DNA, 17 bp, Homo sapiens
aatggcacagcccaaag

SEQ ID NO: 3794165 - DNA, 12 bp, Homo sapiens
aatggcagcctt

SEQ ID NO: 3794166 - DNA, 13 bp, Homo sapiens
aatggtaaaattg

SEQ ID NO: 3794167 - DNA, 24 bp, Homo sapiens
aatggtagtctaaccaaatgcatc

SEQ ID NO: 3794168 - DNA, 18 bp, Homo sapiens
aatggtgctcatttcatg

SEQ ID NO: 3794169 - DNA, 18 bp, Homo sapiens
aatggtttgcaaggaagc

SEQ ID NO: 3794170 - DNA, 15 bp, Homo sapiens
aatgtaaagacaaaa

SEQ ID NO: 3794171 - DNA, 22 bp, Homo sapiens
aatgtaaataaaggatttctag

SEQ ID NO: 3794172 - DNA, 16 bp, Homo sapiens
aatgtaacttttgtaa

SEQ ID NO: 3794173 - DNA, 22 bp, Homo sapiens
aatgtaacttttgtaagacaaa

SEQ ID NO: 3794174 - DNA, 15 bp, Homo sapiens
aatgtaagctctact

SEQ ID NO: 3794175 - DNA, 17 bp, Homo sapiens
aatgtaagtaaatgtct

SEQ ID NO: 3794176 - DNA, 19 bp, Homo sapiens
aatgtaatcaatgtttctt

SEQ ID NO: 3794177 - DNA, 16 bp, Homo sapiens
aatgtaatttgtgtaa

SEQ ID NO: 3794178 - DNA, 18 bp, Homo sapiens
aatgtaatttgtgtaata

SEQ ID NO: 3794179 - DNA, 15 bp, Homo sapiens
aatgtacaaaataaa

SEQ ID NO: 3794180 - DNA, 20 bp, Homo sapiens
aatgtaggtatgaataagtt

SEQ ID NO: 3794181 - DNA, 14 bp, Homo sapiens
aatgtataagttga

SEQ ID NO: 3794182 - DNA, 13 bp, Homo sapiens
aatgtatcaggaa

SEQ ID NO: 3794183 - DNA, 14 bp, Homo sapiens
aatgtatcaggaaa

SEQ ID NO: 3794184 - DNA, 15 bp, Homo sapiens
aatgtatcaggaaat

SEQ ID NO: 3794185 - DNA, 18 bp, Homo sapiens
aatgtatcaggaaatata

SEQ ID NO: 3794186 - DNA, 22 bp, Homo sapiens
aatgtatcatagaaatgtaact

SEQ ID NO: 3794187 - DNA, 16 bp, Homo sapiens
aatgtattataacttt

SEQ ID NO: 3794188 - DNA, 18 bp, Homo sapiens
aatgtattattctgcagc

SEQ ID NO: 3794189 - DNA, 16 bp, Homo sapiens
aatgtattctatctct

SEQ ID NO: 3794190 - DNA, 19 bp, Homo sapiens
aatgtcacaggcaggtcca

SEQ ID NO: 3794191 - DNA, 19 bp, Homo sapiens
aatgtcaccaccttcccag

SEQ ID NO: 3794192 - DNA, 22 bp, Homo sapiens
aatgtcagaaaaacaataagag

SEQ ID NO: 3794193 - DNA, 18 bp, Homo sapiens
aatgtcaggaacagaagg

SEQ ID NO: 3794194 - DNA, 23 bp, Homo sapiens
aatgtcctccagaagcctctggc

SEQ ID NO: 3794195 - DNA, 20 bp, Homo sapiens
aatgtctctttaatgtcaca

SEQ ID NO: 3794196 - DNA, 22 bp, Homo sapiens
aatgtctggagaataattcttt

SEQ ID NO: 3794197 - DNA, 19 bp, Homo sapiens
aatgtcttggtacttgctg

SEQ ID NO: 3794198 - DNA, 17 bp, Homo sapiens
aatgtcttgtaagcaaa

SEQ ID NO: 3794199 - DNA, 17 bp, Homo sapiens
aatgtcttgttaatatt

SEQ ID NO: 3794200 - DNA, 18 bp, Homo sapiens
aatgtcttgttaatattc

SEQ ID NO: 3794201 - DNA, 15 bp, Homo sapiens
aatgtgaaaagaaaa

SEQ ID NO: 3794202 - DNA, 16 bp, Homo sapiens
aatgtgatttttctga

SEQ ID NO: 3794203 - DNA, 13 bp, Homo sapiens
aatgtgcccccag

SEQ ID NO: 3794204 - DNA, 16 bp, Homo sapiens
aatgtggcagctgtct

SEQ ID NO: 3794205 - DNA, 17 bp, Homo sapiens
aatgtggcctaaaaatg

SEQ ID NO: 3794206 - DNA, 18 bp, Homo sapiens
aatgtgggagcagcggtt

SEQ ID NO: 3794207 - DNA, 17 bp, Homo sapiens
acagcgagactccgtct

SEQ ID NO: 3794208 - DNA, 20 bp, Homo sapiens
acagcgggagacctgtgcta

SEQ ID NO: 3794209 - DNA, 16 bp, Homo sapiens
acagcggggccccagg

SEQ ID NO: 3794210 - DNA, 17 bp, Homo sapiens
acagctaatgggacact

SEQ ID NO: 3794211 - DNA, 15 bp, Homo sapiens
acagctcccacccca

SEQ ID NO: 3794212 - DNA, 16 bp, Homo sapiens
acagctcccaccccac

SEQ ID NO: 3794213 - DNA, 22 bp, Homo sapiens
acagctcccaccccaccccctt

SEQ ID NO: 3794214 - DNA, 17 bp, Homo sapiens
acagctccctctgcctg

SEQ ID NO: 3794215 - DNA, 14 bp, Homo sapiens
acagctctgtcctg

SEQ ID NO: 3794216 - DNA, 16 bp, Homo sapiens
acagctcttctccagg

SEQ ID NO: 3794217 - DNA, 20 bp, Homo sapiens
acagctcttctccaggctgt

SEQ ID NO: 3794218 - DNA, 16 bp, Homo sapiens
acagctgcctgcagta

SEQ ID NO: 3794219 - DNA, 21 bp, Homo sapiens
acagctgtgctgtaacacaag

SEQ ID NO: 3794220 - DNA, 23 bp, Homo sapiens
acagctgtggtgaggttgggcag

SEQ ID NO: 3794221 - DNA, 21 bp, Homo sapiens
acagcttcaccctgtcaagtt

SEQ ID NO: 3794222 - DNA, 21 bp, Homo sapiens
acagcttcagccaggagctgg

SEQ ID NO: 3794223 - DNA, 19 bp, Homo sapiens
acagcttcatgcctttgta

SEQ ID NO: 3794224 - DNA, 20 bp, Homo sapiens
acagcttcccctctctcctc

SEQ ID NO: 3794225 - DNA, 20 bp, Homo sapiens
acagctttcatgattagcaa

SEQ ID NO: 3794226 - DNA, 19 bp, Homo sapiens
acagcttttagtacccacc

SEQ ID NO: 3794227 - DNA, 17 bp, Homo sapiens
acaggaaaaaaactttt

SEQ ID NO: 3794228 - DNA, 22 bp, Homo sapiens
acaggaaaaaaacttttataaa

SEQ ID NO: 3794229 - DNA, 17 bp, Homo sapiens
acaggaaaagctgctga

SEQ ID NO: 3794230 - DNA, 23 bp, Homo sapiens
acaggaaaatcctctggctggct

SEQ ID NO: 3794231 - DNA, 20 bp, Homo sapiens
acaggaaaattttaaaaata

SEQ ID NO: 3794232 - DNA, 22 bp, Homo sapiens
acaggacagtgcttcagcctga

SEQ ID NO: 3794233 - DNA, 14 bp, Homo sapiens
acaggagacctggc

SEQ ID NO: 3794234 - DNA, 18 bp, Homo sapiens
acaggagagaaaggggat

SEQ ID NO: 3794235 - DNA, 16 bp, Homo sapiens
acaggagtgagcacta

SEQ ID NO: 3794236 - DNA, 15 bp, Homo sapiens
acaggatcagtctga

SEQ ID NO: 3794237 - DNA, 15 bp, Homo sapiens
acaggattagacagt

SEQ ID NO: 3794238 - DNA, 16 bp, Homo sapiens
acaggcaactgaggca

SEQ ID NO: 3794239 - DNA, 19 bp, Homo sapiens
acaggcaactgaggcagac

SEQ ID NO: 3794240 - DNA, 17 bp, Homo sapiens
acaggcagcacagagac

SEQ ID NO: 3794241 - DNA, 14 bp, Homo sapiens
acaggcaggtccag

SEQ ID NO: 3794242 - DNA, 16 bp, Homo sapiens
acaggcaggtccaggg

SEQ ID NO: 3794243 - DNA, 15 bp, Homo sapiens
acaggcatgttctct

SEQ ID NO: 3794244 - DNA, 19 bp, Homo sapiens
acaggcatgttctctgagg

SEQ ID NO: 3794245 - DNA, 20 bp, Homo sapiens
acaggcatgttctctgagga

SEQ ID NO: 3794246 - DNA, 17 bp, Homo sapiens
acaggccatgtgagcca

SEQ ID NO: 3794247 - DNA, 18 bp, Homo sapiens
acaggccatgtgagccac

SEQ ID NO: 3794248 - DNA, 22 bp, Homo sapiens
acaggcccggcgcggtggctca

SEQ ID NO: 3794249 - DNA, 22 bp, Homo sapiens
acaggcccggctccaggctcct

SEQ ID NO: 3794250 - DNA, 13 bp, Homo sapiens
acaggcccttcct

SEQ ID NO: 3794251 - DNA, 14 bp, Homo sapiens
acaggctcaatatt

SEQ ID NO: 3794252 - DNA, 12 bp, Homo sapiens
acaggctgggct

SEQ ID NO: 3794253 - DNA, 21 bp, Homo sapiens
acaggctgggcttcagtggca

SEQ ID NO: 3794254 - DNA, 22 bp, Homo sapiens
acaggctgggcttcagtggcag

SEQ ID NO: 3794255 - DNA, 23 bp, Homo sapiens
acaggctgggcttcagtggcagc

SEQ ID NO: 3794256 - DNA, 16 bp, Homo sapiens
acagggagctgggaca

SEQ ID NO: 3794257 - DNA, 20 bp, Homo sapiens
acagggcacaccgggcactc

SEQ ID NO: 3794258 - DNA, 14 bp, Homo sapiens
acagggtcctgcta

SEQ ID NO: 3794259 - DNA, 21 bp, Homo sapiens
acagggtgttgtcagcatctt

SEQ ID NO: 3794260 - DNA, 16 bp, Homo sapiens
acagggttcaaaatgt

SEQ ID NO: 3794261 - DNA, 19 bp, Homo sapiens
acagggttttgccatgttg

SEQ ID NO: 3794262 - DNA, 22 bp, Homo sapiens
acaggtcaatacagtacaggca

SEQ ID NO: 3794263 - DNA, 16 bp, Homo sapiens
acaggtctgggagagg

SEQ ID NO: 3794264 - DNA, 19 bp, Homo sapiens
acaggtgtgaaccaccaca

SEQ ID NO: 3794265 - DNA, 14 bp, Homo sapiens
acagtacaggcagc

SEQ ID NO: 3794266 - DNA, 16 bp, Homo sapiens
acagtacaggcagcac

SEQ ID NO: 3794267 - DNA, 15 bp, Homo sapiens
acagtaccatctgaa

SEQ ID NO: 3794268 - DNA, 18 bp, Homo sapiens
acagtagtgagaagaata

SEQ ID NO: 3794269 - DNA, 23 bp, Homo sapiens
acagtatggtaactttgcaaatg

SEQ ID NO: 3794270 - DNA, 16 bp, Homo sapiens
acagtattacttctgc

SEQ ID NO: 3794271 - DNA, 17 bp, Homo sapiens
acagtcaaggagtggct

SEQ ID NO: 3794272 - DNA, 17 bp, Homo sapiens
acagtcatttgcgcaca

SEQ ID NO: 3794273 - DNA, 21 bp, Homo sapiens
acagtcatttgcgcacaactt

SEQ ID NO: 3794274 - DNA, 20 bp, Homo sapiens
acagtctctttaatcttcag

SEQ ID NO: 3794275 - DNA, 16 bp, Homo sapiens
acagtgaggtcctggg

SEQ ID NO: 3794276 - DNA, 22 bp, Homo sapiens
acagtgaggtcctgggggcctg

SEQ ID NO: 3794277 - DNA, 22 bp, Homo sapiens
acagtgagtcgaggacagggag

SEQ ID NO: 3794278 - DNA, 23 bp, Homo sapiens
acagtgagtcgaggacagggagg

SEQ ID NO: 3794279 - DNA, 19 bp, Homo sapiens
acagtgatctccatatgtt

SEQ ID NO: 3794280 - DNA, 14 bp, Homo sapiens
acagtgcagacagg

SEQ ID NO: 3794281 - DNA, 15 bp, Homo sapiens
acagtgcagacaggc

SEQ ID NO: 3794282 - DNA, 17 bp, Homo sapiens
acagtgcatctcagccc

SEQ ID NO: 3794283 - DNA, 18 bp, Homo sapiens
acagtgcatctcagccca

SEQ ID NO: 3794284 - DNA, 18 bp, Homo sapiens
acagtgccattgtcttta

SEQ ID NO: 3794285 - DNA, 14 bp, Homo sapiens
acagtgcctgggaa

SEQ ID NO: 3794286 - DNA, 20 bp, Homo sapiens
acagtgctgaccagacagcc

SEQ ID NO: 3794287 - DNA, 17 bp, Homo sapiens
acagtgcttcagcctga

SEQ ID NO: 3794288 - DNA, 20 bp, Homo sapiens
acagtgcttcagcctgaggc

SEQ ID NO: 3794289 - DNA, 22 bp, Homo sapiens
acagtgcttcagcctgaggctg

SEQ ID NO: 3794290 - DNA, 18 bp, Homo sapiens
acagtggaatataaggaa

SEQ ID NO: 3794291 - DNA, 23 bp, Homo sapiens
acagtgtctgtatcggagacagt

SEQ ID NO: 3794292 - DNA, 20 bp, Homo sapiens
acagtgtggtagttaataaa

SEQ ID NO: 3794293 - DNA, 20 bp, Homo sapiens
acagtgttattttctttgaa

SEQ ID NO: 3794294 - DNA, 22 bp, Homo sapiens
acagtgttattttctttgaaat

SEQ ID NO: 3794295 - DNA, 9 bp, Homo sapiens
acagtgttt

SEQ ID NO: 3794296 - DNA, 16 bp, Homo sapiens
acagtgtttcccataa

SEQ ID NO: 3794297 - DNA, 18 bp, Homo sapiens
acagtgtttcccataatt

SEQ ID NO: 3794298 - DNA, 23 bp, Homo sapiens
acagtgtttcccataattttctt

SEQ ID NO: 3794299 - DNA, 14 bp, Homo sapiens
acagttaactttca

SEQ ID NO: 3794300 - DNA, 16 bp, Homo sapiens
acagttaactttcaga

SEQ ID NO: 3794301 - DNA, 12 bp, Homo sapiens
acagttcaagaa

SEQ ID NO: 3794302 - DNA, 16 bp, Homo sapiens
acagttcaagaaagct

SEQ ID NO: 3794303 - DNA, 20 bp, Homo sapiens
acagttcaattctcatttgt

SEQ ID NO: 3794304 - DNA, 16 bp, Homo sapiens
acagttcctcgccctg

SEQ ID NO: 3794305 - DNA, 20 bp, Homo sapiens
acagttgaaaaacagctgag

SEQ ID NO: 3794306 - DNA, 14 bp, Homo sapiens
acagttttccatga

SEQ ID NO: 3794307 - DNA, 16 bp, Homo sapiens
acagttttccatgaaa

SEQ ID NO: 3794308 - DNA, 17 bp, Homo sapiens
acagttttccatgaaaa

SEQ ID NO: 3794309 - DNA, 14 bp, Homo sapiens
acagttttccttct

SEQ ID NO: 3794310 - DNA, 17 bp, Homo sapiens
acataaaaagttaaaaa

SEQ ID NO: 3794311 - DNA, 22 bp, Homo sapiens
acataaaaagttaaaaaaaata

SEQ ID NO: 3794312 - DNA, 17 bp, Homo sapiens
acataaaggataaactt

SEQ ID NO: 3794313 - DNA, 23 bp, Homo sapiens
acataaaggttattttctcctga

SEQ ID NO: 3794314 - DNA, 22 bp, Homo sapiens
acataacaaaatcacttccata

SEQ ID NO: 3794315 - DNA, 14 bp, Homo sapiens
acataacaaataac

SEQ ID NO: 3794316 - DNA, 16 bp, Homo sapiens
acataagataaatgtg

SEQ ID NO: 3794317 - DNA, 22 bp, Homo sapiens
acatacaattatttttacagtt

SEQ ID NO: 3794318 - DNA, 22 bp, Homo sapiens
acatagactttatgcaataaat

SEQ ID NO: 3794319 - DNA, 11 bp, Homo sapiens
accttttctct

SEQ ID NO: 3794320 - DNA, 14 bp, Homo sapiens
acgaaactgctcta

SEQ ID NO: 3794321 - DNA, 15 bp, Homo sapiens
acgaacccacctgct

SEQ ID NO: 3794322 - DNA, 12 bp, Homo sapiens
acgacaaagctg

SEQ ID NO: 3794323 - DNA, 15 bp, Homo sapiens
acgactgcccggcag

SEQ ID NO: 3794324 - DNA, 22 bp, Homo sapiens
acgacttcagggcagggctctg

SEQ ID NO: 3794325 - DNA, 19 bp, Homo sapiens
acgagggatgtggagcaca

SEQ ID NO: 3794326 - DNA, 16 bp, Homo sapiens
acgagtaatttattgt

SEQ ID NO: 3794327 - DNA, 18 bp, Homo sapiens
acgcacacacacacacag

SEQ ID NO: 3794328 - DNA, 20 bp, Homo sapiens
acgcacgtgggtcttcaggg

SEQ ID NO: 3794329 - DNA, 15 bp, Homo sapiens
acgcagatgatccat

SEQ ID NO: 3794330 - DNA, 17 bp, Homo sapiens
acgcagatgatccatga

SEQ ID NO: 3794331 - DNA, 18 bp, Homo sapiens
acgccactgcactatagc

SEQ ID NO: 3794332 - DNA, 21 bp, Homo sapiens
acgccactgcactccagcctg

SEQ ID NO: 3794333 - DNA, 23 bp, Homo sapiens
acgccactgcactccagcctggg

SEQ ID NO: 3794334 - DNA, 23 bp, Homo sapiens
acgccaggggaaaatcagcctgc

SEQ ID NO: 3794335 - DNA, 17 bp, Homo sapiens
acgcctatgatcccagc

SEQ ID NO: 3794336 - DNA, 21 bp, Homo sapiens
acgcctgcttgtccctgccca

SEQ ID NO: 3794337 - DNA, 20 bp, Homo sapiens
acgcctgtaatcccagcact

SEQ ID NO: 3794338 - DNA, 20 bp, Homo sapiens
acgcgtgcacacaccagagc

SEQ ID NO: 3794339 - DNA, 23 bp, Homo sapiens
acgctggaccttgaactgggtac

SEQ ID NO: 3794340 - DNA, 18 bp, Homo sapiens
acgctggagtgcagtgag

SEQ ID NO: 3794341 - DNA, 19 bp, Homo sapiens
acgctggtagagatggagg

SEQ ID NO: 3794342 - DNA, 20 bp, Homo sapiens
acgctggtagagatggagga

SEQ ID NO: 3794343 - DNA, 11 bp, Homo sapiens
acgctgtctcc

SEQ ID NO: 3794344 - DNA, 19 bp, Homo sapiens
acgctgtctccagaccccc

SEQ ID NO: 3794345 - DNA, 20 bp, Homo sapiens
acgctgtctccagaccccca

SEQ ID NO: 3794346 - DNA, 14 bp, Homo sapiens
acgctgtgggcagg

SEQ ID NO: 3794347 - DNA, 15 bp, Homo sapiens
acgctgtgggcaggt

SEQ ID NO: 3794348 - DNA, 17 bp, Homo sapiens
acgctttctagctgttg

SEQ ID NO: 3794349 - DNA, 16 bp, Homo sapiens
acggaagagccttgcg

SEQ ID NO: 3794350 - DNA, 19 bp, Homo sapiens
acggacactcaaaagctgg

SEQ ID NO: 3794351 - DNA, 14 bp, Homo sapiens
acggagagaaaaaa

SEQ ID NO: 3794352 - DNA, 13 bp, Homo sapiens
acggagagcgcct

SEQ ID NO: 3794353 - DNA, 19 bp, Homo sapiens
acggagagcgcctgcccct

SEQ ID NO: 3794354 - DNA, 19 bp, Homo sapiens
acggagtcccaccttggct

SEQ ID NO: 3794355 - DNA, 21 bp, Homo sapiens
acggatccatgtagcaggact

SEQ ID NO: 3794356 - DNA, 16 bp, Homo sapiens
acggcactgtggcctt

SEQ ID NO: 3794357 - DNA, 15 bp, Homo sapiens
acggcctgatgctcc

SEQ ID NO: 3794358 - DNA, 18 bp, Homo sapiens
acggcctgatgctccctc

SEQ ID NO: 3794359 - DNA, 16 bp, Homo sapiens
acggcgcccccagtgt

SEQ ID NO: 3794360 - DNA, 14 bp, Homo sapiens
acggctcactgcag

SEQ ID NO: 3794361 - DNA, 18 bp, Homo sapiens
acggctcactgcagcctc

SEQ ID NO: 3794362 - DNA, 14 bp, Homo sapiens
acgggctgccctgc

SEQ ID NO: 3794363 - DNA, 19 bp, Homo sapiens
acggtgggcatttgtgagg

SEQ ID NO: 3794364 - DNA, 14 bp, Homo sapiens
acgtactctggtta

SEQ ID NO: 3794365 - DNA, 16 bp, Homo sapiens
acgtacttagcagcta

SEQ ID NO: 3794366 - DNA, 14 bp, Homo sapiens
acgtcaaacatgaa

SEQ ID NO: 3794367 - DNA, 17 bp, Homo sapiens
acgtcaaacatgaagtg

SEQ ID NO: 3794368 - DNA, 17 bp, Homo sapiens
acgtcaagtctccttcc

SEQ ID NO: 3794369 - DNA, 21 bp, Homo sapiens
acgtcactggaccactgggca

SEQ ID NO: 3794370 - DNA, 16 bp, Homo sapiens
acgtcctgccacctgg

SEQ ID NO: 3794371 - DNA, 19 bp, Homo sapiens
acgtgacagtgcctgggaa

SEQ ID NO: 3794372 - DNA, 14 bp, Homo sapiens
acgtgactgcccca

SEQ ID NO: 3794373 - DNA, 21 bp, Homo sapiens
acgtgactgtggcacacgcct

SEQ ID NO: 3794374 - DNA, 14 bp, Homo sapiens
acgtgagagtgtct

SEQ ID NO: 3794375 - DNA, 23 bp, Homo sapiens
acgtgagagtgtcttcacggcag

SEQ ID NO: 3794376 - DNA, 20 bp, Homo sapiens
acgtgcacctgtactcagga

SEQ ID NO: 3794377 - DNA, 23 bp, Homo sapiens
acgtgcacctgtactcaggaggc

SEQ ID NO: 3794378 - DNA, 16 bp, Homo sapiens
acgtgcacgcacactg

SEQ ID NO: 3794379 - DNA, 13 bp, Homo sapiens
acgtgccaggccc

SEQ ID NO: 3794380 - DNA, 14 bp, Homo sapiens
acgtgccaggcccg

SEQ ID NO: 3794381 - DNA, 18 bp, Homo sapiens
acgtgccaggcccggggc

SEQ ID NO: 3794382 - DNA, 19 bp, Homo sapiens
acgtgccaggcccggggct

SEQ ID NO: 3794383 - DNA, 13 bp, Homo sapiens
acgtggagaggga

SEQ ID NO: 3794384 - DNA, 15 bp, Homo sapiens
acgtggcccagagaa

SEQ ID NO: 3794385 - DNA, 15 bp, Homo sapiens
acgtgggcggcagag

SEQ ID NO: 3794386 - DNA, 16 bp, Homo sapiens
acgtgtgtgactcaga

SEQ ID NO: 3794387 - DNA, 15 bp, Homo sapiens
acgttaccaggcagg

SEQ ID NO: 3794388 - DNA, 13 bp, Homo sapiens
acgttcacccctc

SEQ ID NO: 3794389 - DNA, 14 bp, Homo sapiens
acgttcacccctcc

SEQ ID NO: 3794390 - DNA, 14 bp, Homo sapiens
acgttcggggcatg

SEQ ID NO: 3794391 - DNA, 22 bp, Homo sapiens
acgtttaaagttctgtgtattt

SEQ ID NO: 3794392 - DNA, 14 bp, Homo sapiens
acgttttattgtgt

SEQ ID NO: 3794393 - DNA, 12 bp, Homo sapiens
actaaaaataca

SEQ ID NO: 3794394 - DNA, 23 bp, Homo sapiens
actaaactggtttgttgcagcca

SEQ ID NO: 3794395 - DNA, 22 bp, Homo sapiens
actaaagttagaaagttgattt

SEQ ID NO: 3794396 - DNA, 18 bp, Homo sapiens
actaaatctgtaagctct

SEQ ID NO: 3794397 - DNA, 23 bp, Homo sapiens
actaaatctgtaagctctttgaa

SEQ ID NO: 3794398 - DNA, 17 bp, Homo sapiens
actaacttgacttttaa

SEQ ID NO: 3794399 - DNA, 18 bp, Homo sapiens
actaagatgttcactgtg

SEQ ID NO: 3794400 - DNA, 22 bp, Homo sapiens
actaataaaagcataaatgcaa

SEQ ID NO: 3794401 - DNA, 15 bp, Homo sapiens
actaattaacatata

SEQ ID NO: 3794402 - DNA, 17 bp, Homo sapiens
actacactccagcctga

SEQ ID NO: 3794403 - DNA, 20 bp, Homo sapiens
actacatgcagcccatgccc

SEQ ID NO: 3794404 - DNA, 14 bp, Homo sapiens
actacattttaaca

SEQ ID NO: 3794405 - DNA, 16 bp, Homo sapiens
actacattttaacatg

SEQ ID NO: 3794406 - DNA, 15 bp, Homo sapiens
actacgtgactgtgg

SEQ ID NO: 3794407 - DNA, 17 bp, Homo sapiens
actactcccccaggtgg

SEQ ID NO: 3794408 - DNA, 20 bp, Homo sapiens
actactgtggaaaaatattt

SEQ ID NO: 3794409 - DNA, 23 bp, Homo sapiens
actagaagggccagtcctgcctg

SEQ ID NO: 3794410 - DNA, 19 bp, Homo sapiens
actagactcccaagctgga

SEQ ID NO: 3794411 - DNA, 20 bp, Homo sapiens
actagacttgaggaaaccag

SEQ ID NO: 3794412 - DNA, 15 bp, Homo sapiens
actagaggcagggag

SEQ ID NO: 3794413 - DNA, 15 bp, Homo sapiens
actagcctctccagg

SEQ ID NO: 3794414 - DNA, 23 bp, Homo sapiens
actagctagaagtgggccaggac

SEQ ID NO: 3794415 - DNA, 22 bp, Homo sapiens
actagctggaattttttattct

SEQ ID NO: 3794416 - DNA, 21 bp, Homo sapiens
actaggctgggtgcccacagc

SEQ ID NO: 3794417 - DNA, 23 bp, Homo sapiens
actaggctgggtgcccacagccc

SEQ ID NO: 3794418 - DNA, 21 bp, Homo sapiens
actagggaagaaagcagaaca

SEQ ID NO: 3794419 - DNA, 14 bp, Homo sapiens
actagtctgtgtgc

SEQ ID NO: 3794420 - DNA, 15 bp, Homo sapiens
actagtctgtgtgct

SEQ ID NO: 3794421 - DNA, 23 bp, Homo sapiens
actagtgacaagctcctggtctt

SEQ ID NO: 3794422 - DNA, 19 bp, Homo sapiens
actagtgctgaagcttatt

SEQ ID NO: 3794423 - DNA, 18 bp, Homo sapiens
actagttacacatcttca

SEQ ID NO: 3794424 - DNA, 12 bp, Homo sapiens
actataatgtaa

SEQ ID NO: 3794425 - DNA, 14 bp, Homo sapiens
actataatgtaagc

SEQ ID NO: 3794426 - DNA, 18 bp, Homo sapiens
actatagcctaggtgaca

SEQ ID NO: 3794427 - DNA, 16 bp, Homo sapiens
actatatctgttttac

SEQ ID NO: 3794428 - DNA, 23 bp, Homo sapiens
actatatctgttttactgctttt

SEQ ID NO: 3794429 - DNA, 19 bp, Homo sapiens
actatattagtatgtatgt

SEQ ID NO: 3794430 - DNA, 15 bp, Homo sapiens
actatattgtacaca

SEQ ID NO: 3794431 - DNA, 16 bp, Homo sapiens
actatcttggtgaatt

SEQ ID NO: 3794432 - DNA, 21 bp, Homo sapiens
acttgtgtgtgggctgtgagt

SEQ ID NO: 3794433 - DNA, 17 bp, Homo sapiens
acttgttttatgctcag

SEQ ID NO: 3794434 - DNA, 15 bp, Homo sapiens
actttaaaataaaat

SEQ ID NO: 3794435 - DNA, 14 bp, Homo sapiens
actttatcacatta

SEQ ID NO: 3794436 - DNA, 12 bp, Homo sapiens
actttatttact

SEQ ID NO: 3794437 - DNA, 24 bp, Homo sapiens
actttattttctggtagatagaaa

SEQ ID NO: 3794438 - DNA, 17 bp, Homo sapiens
actttcacatagatgtc

SEQ ID NO: 3794439 - DNA, 21 bp, Homo sapiens
actttcaggtactaaatacct

SEQ ID NO: 3794440 - DNA, 18 bp, Homo sapiens
actttcattgccagtgtc

SEQ ID NO: 3794441 - DNA, 20 bp, Homo sapiens
actttcattgccagtgtctt

SEQ ID NO: 3794442 - DNA, 21 bp, Homo sapiens
actttccccatactctgtctc

SEQ ID NO: 3794443 - DNA, 15 bp, Homo sapiens
actttctcttgtaaa

SEQ ID NO: 3794444 - DNA, 19 bp, Homo sapiens
actttctgttgccacaacc

SEQ ID NO: 3794445 - DNA, 21 bp, Homo sapiens
actttggaagtttgtgttctg

SEQ ID NO: 3794446 - DNA, 14 bp, Homo sapiens
actttgggaggcca

SEQ ID NO: 3794447 - DNA, 20 bp, Homo sapiens
actttgtatgatattccata

SEQ ID NO: 3794448 - DNA, 16 bp, Homo sapiens
actttgtgttcacctt

SEQ ID NO: 3794449 - DNA, 18 bp, Homo sapiens
actttgtgttcaccttgt

SEQ ID NO: 3794450 - DNA, 15 bp, Homo sapiens
acttttaaacagtga

SEQ ID NO: 3794451 - DNA, 16 bp, Homo sapiens
acttttataaattaaa

SEQ ID NO: 3794452 - DNA, 18 bp, Homo sapiens
acttttataaattaaata

SEQ ID NO: 3794453 - DNA, 21 bp, Homo sapiens
acttttataaattaaatatat

SEQ ID NO: 3794454 - DNA, 20 bp, Homo sapiens
acttttcataacctagcctt

SEQ ID NO: 3794455 - DNA, 17 bp, Homo sapiens
acttttcctccctcagt

SEQ ID NO: 3794456 - DNA, 16 bp, Homo sapiens
acttttcgttaacatt

SEQ ID NO: 3794457 - DNA, 15 bp, Homo sapiens
acttttctccatgag

SEQ ID NO: 3794458 - DNA, 11 bp, Homo sapiens
acttttctgta

SEQ ID NO: 3794459 - DNA, 21 bp, Homo sapiens
actttttatattttatacatt

SEQ ID NO: 3794460 - DNA, 14 bp, Homo sapiens
actttttggtggat

SEQ ID NO: 3794461 - DNA, 17 bp, Homo sapiens
actttttggtggatgta

SEQ ID NO: 3794462 - DNA, 21 bp, Homo sapiens
actttttggtggatgtaaata

SEQ ID NO: 3794463 - DNA, 17 bp, Homo sapiens
agaaaaaaaataacaca

SEQ ID NO: 3794464 - DNA, 14 bp, Homo sapiens
agaaaaaaataatt

SEQ ID NO: 3794465 - DNA, 11 bp, Homo sapiens
agaaaaaatac

SEQ ID NO: 3794466 - DNA, 16 bp, Homo sapiens
agaaaaaatacatttt

SEQ ID NO: 3794467 - DNA, 18 bp, Homo sapiens
agaaaaaatacattttat

SEQ ID NO: 3794468 - DNA, 13 bp, Homo sapiens
agaaaaagaaaaa

SEQ ID NO: 3794469 - DNA, 20 bp, Homo sapiens
agaaaacaggaaaaaaactt

SEQ ID NO: 3794470 - DNA, 23 bp, Homo sapiens
agaaaacaggaaaaaaactttta

SEQ ID NO: 3794471 - DNA, 20 bp, Homo sapiens
agaaaacggttaaaactgtc

SEQ ID NO: 3794472 - DNA, 19 bp, Homo sapiens
agaaaactagaatttcatt

SEQ ID NO: 3794473 - DNA, 22 bp, Homo sapiens
agaaaataaaattaagaatgtt

SEQ ID NO: 3794474 - DNA, 15 bp, Homo sapiens
agaaaatacaataaa

SEQ ID NO: 3794475 - DNA, 16 bp, Homo sapiens
agaaaatacaataaac

SEQ ID NO: 3794476 - DNA, 17 bp, Homo sapiens
agaaaatacaataaact

SEQ ID NO: 3794477 - DNA, 19 bp, Homo sapiens
agaaaattgaatttaacaa

SEQ ID NO: 3794478 - DNA, 15 bp, Homo sapiens
agaaacacactgagg

SEQ ID NO: 3794479 - DNA, 17 bp, Homo sapiens
agaaacacactgaggca

SEQ ID NO: 3794480 - DNA, 20 bp, Homo sapiens
agaaacacctagatcagaac

SEQ ID NO: 3794481 - DNA, 11 bp, Homo sapiens
agaaacagatt

SEQ ID NO: 3794482 - DNA, 17 bp, Homo sapiens
agaaacagggtgttgtc

SEQ ID NO: 3794483 - DNA, 13 bp, Homo sapiens
agaaacagttaac

SEQ ID NO: 3794484 - DNA, 16 bp, Homo sapiens
agaaacccgacagagg

SEQ ID NO: 3794485 - DNA, 18 bp, Homo sapiens
agaaacccgacagaggga

SEQ ID NO: 3794486 - DNA, 20 bp, Homo sapiens
agaaacctacagaatactag

SEQ ID NO: 3794487 - DNA, 20 bp, Homo sapiens
agaaaccttattgtacctct

SEQ ID NO: 3794488 - DNA, 22 bp, Homo sapiens
agaaactcacccccaaggggca

SEQ ID NO: 3794489 - DNA, 16 bp, Homo sapiens
agaaacttatcttaca

SEQ ID NO: 3794490 - DNA, 22 bp, Homo sapiens
agaaacttatcttacaaagtgt

SEQ ID NO: 3794491 - DNA, 20 bp, Homo sapiens
agaaagaaacccgacagagg

SEQ ID NO: 3794492 - DNA, 18 bp, Homo sapiens
agaaagaaggaagtgaag

SEQ ID NO: 3794493 - DNA, 18 bp, Homo sapiens
agaaagacagagctggga

SEQ ID NO: 3794494 - DNA, 22 bp, Homo sapiens
agaaagactatctaaatgttga

SEQ ID NO: 3794495 - DNA, 21 bp, Homo sapiens
agaaagcctcagagaattgct

SEQ ID NO: 3794496 - DNA, 11 bp, Homo sapiens
agaaaggagac

SEQ ID NO: 3794497 - DNA, 18 bp, Homo sapiens
agaaaggagagtcttgca

SEQ ID NO: 3794498 - DNA, 20 bp, Homo sapiens
agaaaggaggggatagagag

SEQ ID NO: 3794499 - DNA, 14 bp, Homo sapiens
agaaaggatattta

SEQ ID NO: 3794500 - DNA, 18 bp, Homo sapiens
agaaaggatatttaagaa

SEQ ID NO: 3794501 - DNA, 21 bp, Homo sapiens
agaaaggggcaggagctcaga

SEQ ID NO: 3794502 - DNA, 23 bp, Homo sapiens
agaaaggggcaggagctcagatg

SEQ ID NO: 3794503 - DNA, 15 bp, Homo sapiens
agaaataaagtttct

SEQ ID NO: 3794504 - DNA, 15 bp, Homo sapiens
agaaataaatagcta

SEQ ID NO: 3794505 - DNA, 19 bp, Homo sapiens
agaaataaatagctatatc

SEQ ID NO: 3794506 - DNA, 14 bp, Homo sapiens
agaaataatatgca

SEQ ID NO: 3794507 - DNA, 21 bp, Homo sapiens
agaaatatgcacaatagcagt

SEQ ID NO: 3794508 - DNA, 14 bp, Homo sapiens
agaaatatgtggtt

SEQ ID NO: 3794509 - DNA, 18 bp, Homo sapiens
agaaatcatgttatgata

SEQ ID NO: 3794510 - DNA, 21 bp, Homo sapiens
agaaatcatgttatgataaaa

SEQ ID NO: 3794511 - DNA, 21 bp, Homo sapiens
agaaatccccctttctctaat

SEQ ID NO: 3794512 - DNA, 14 bp, Homo sapiens
agaaatctagaaga

SEQ ID NO: 3794513 - DNA, 17 bp, Homo sapiens
agaaatctctagctcag

SEQ ID NO: 3794514 - DNA, 23 bp, Homo sapiens
agaaatgaccaatattatactaa

SEQ ID NO: 3794515 - DNA, 22 bp, Homo sapiens
agaaattccctggaccagatgc

SEQ ID NO: 3794516 - DNA, 14 bp, Homo sapiens
agaaattggctgga

SEQ ID NO: 3794517 - DNA, 18 bp, Homo sapiens
agaaatttaaaagacact

SEQ ID NO: 3794518 - DNA, 17 bp, Homo sapiens
agaaatttttcagatgc

SEQ ID NO: 3794519 - DNA, 21 bp, Homo sapiens
agaaatttttcagatgcttct

SEQ ID NO: 3794520 - DNA, 22 bp, Homo sapiens
agaaatttttcagatgcttctg

SEQ ID NO: 3794521 - DNA, 19 bp, Homo sapiens
agaacaaggtagtttttac

SEQ ID NO: 3794522 - DNA, 20 bp, Homo sapiens
agaacacagcaattcctcag

SEQ ID NO: 3794523 - DNA, 17 bp, Homo sapiens
agaacactattttcaga

SEQ ID NO: 3794524 - DNA, 19 bp, Homo sapiens
agaacactattttcagaat

SEQ ID NO: 3794525 - DNA, 10 bp, Homo sapiens
agaacagaaa

SEQ ID NO: 3794526 - DNA, 14 bp, Homo sapiens
agaacagaaaacaa

SEQ ID NO: 3794527 - DNA, 18 bp, Homo sapiens
agaacagcagaggttctt

SEQ ID NO: 3794528 - DNA, 13 bp, Homo sapiens
agaacagcaggcc

SEQ ID NO: 3794529 - DNA, 17 bp, Homo sapiens
agaacagcaggcccacc

SEQ ID NO: 3794530 - DNA, 20 bp, Homo sapiens
agaacagttaagcagccgcc

SEQ ID NO: 3794531 - DNA, 21 bp, Homo sapiens
agaacatgttggtatttatct

SEQ ID NO: 3794532 - DNA, 20 bp, Homo sapiens
agaaccctggtgaggaagct

SEQ ID NO: 3794533 - DNA, 21 bp, Homo sapiens
agaacctcacgcacctcccat

SEQ ID NO: 3794534 - DNA, 12 bp, Homo sapiens
agaacctcaggc

SEQ ID NO: 3794535 - DNA, 13 bp, Homo sapiens
agaacctgtcctt

SEQ ID NO: 3794536 - DNA, 19 bp, Homo sapiens
agaactactcagggaatga

SEQ ID NO: 3794537 - DNA, 22 bp, Homo sapiens
agaactactcagggaatgaagg

SEQ ID NO: 3794538 - DNA, 18 bp, Homo sapiens
agaactagccttatttct

SEQ ID NO: 3794539 - DNA, 14 bp, Homo sapiens
agaactcctagggt

SEQ ID NO: 3794540 - DNA, 13 bp, Homo sapiens
agaactgaaaaca

SEQ ID NO: 3794541 - DNA, 14 bp, Homo sapiens
agaactgaaaacat

SEQ ID NO: 3794542 - DNA, 16 bp, Homo sapiens
agaactgaaaacataa

SEQ ID NO: 3794543 - DNA, 12 bp, Homo sapiens
agaactgagctc

SEQ ID NO: 3794544 - DNA, 22 bp, Homo sapiens
agaactgagctcctctgggcag

SEQ ID NO: 3794545 - DNA, 22 bp, Homo sapiens
agataagaatgctggttttcct

SEQ ID NO: 3794546 - DNA, 17 bp, Homo sapiens
agataatatgagaatca

SEQ ID NO: 3794547 - DNA, 14 bp, Homo sapiens
agataatcagcctc

SEQ ID NO: 3794548 - DNA, 15 bp, Homo sapiens
agataatcagcctct

SEQ ID NO: 3794549 - DNA, 17 bp, Homo sapiens
agataatcagcctctta

SEQ ID NO: 3794550 - DNA, 18 bp, Homo sapiens
agataattctagctttga

SEQ ID NO: 3794551 - DNA, 15 bp, Homo sapiens
agatacaagtttcag

SEQ ID NO: 3794552 - DNA, 17 bp, Homo sapiens
agatacaagtttcagac

SEQ ID NO: 3794553 - DNA, 21 bp, Homo sapiens
agatacatggttgtgacctga

SEQ ID NO: 3794554 - DNA, 22 bp, Homo sapiens
agataccatcagcaaagaattt

SEQ ID NO: 3794555 - DNA, 20 bp, Homo sapiens
agatacgactttattttctg

SEQ ID NO: 3794556 - DNA, 19 bp, Homo sapiens
agatactggaagttttgca

SEQ ID NO: 3794557 - DNA, 11 bp, Homo sapiens
agatagaaata

SEQ ID NO: 3794558 - DNA, 22 bp, Homo sapiens
agatagaaataaatagctatat

SEQ ID NO: 3794559 - DNA, 14 bp, Homo sapiens
agatagaagaaaaa

SEQ ID NO: 3794560 - DNA, 12 bp, Homo sapiens
agataggcctgt

SEQ ID NO: 3794561 - DNA, 15 bp, Homo sapiens
agatagttactatat

SEQ ID NO: 3794562 - DNA, 23 bp, Homo sapiens
agatagttttgccagaacagttt

SEQ ID NO: 3794563 - DNA, 17 bp, Homo sapiens
agatatggcagcgaaag

SEQ ID NO: 3794564 - DNA, 20 bp, Homo sapiens
agatattattcaccatgtaa

SEQ ID NO: 3794565 - DNA, 12 bp, Homo sapiens
agatattcaagt

SEQ ID NO: 3794566 - DNA, 18 bp, Homo sapiens
agatattgtgaagtacat

SEQ ID NO: 3794567 - DNA, 17 bp, Homo sapiens
agatatttatattttta

SEQ ID NO: 3794568 - DNA, 23 bp, Homo sapiens
agatatttattgtttatttatca

SEQ ID NO: 3794569 - DNA, 18 bp, Homo sapiens
agatattttttcagaaat

SEQ ID NO: 3794570 - DNA, 19 bp, Homo sapiens
agatattttttcagaaata

SEQ ID NO: 3794571 - DNA, 22 bp, Homo sapiens
agatattttttcagaaatatgt

SEQ ID NO: 3794572 - DNA, 18 bp, Homo sapiens
agatcaaaaggttaataa

SEQ ID NO: 3794573 - DNA, 14 bp, Homo sapiens
agatcaaatttcac

SEQ ID NO: 3794574 - DNA, 19 bp, Homo sapiens
agatcaaccccttcgctcc

SEQ ID NO: 3794575 - DNA, 18 bp, Homo sapiens
agatcacataacagaatg

SEQ ID NO: 3794576 - DNA, 20 bp, Homo sapiens
agatcacataacagaatgca

SEQ ID NO: 3794577 - DNA, 13 bp, Homo sapiens
agatcacgaggtc

SEQ ID NO: 3794578 - DNA, 15 bp, Homo sapiens
agatcactttgctct

SEQ ID NO: 3794579 - DNA, 15 bp, Homo sapiens
agatcagcctgggca

SEQ ID NO: 3794580 - DNA, 20 bp, Homo sapiens
agatcatagatttctgattt

SEQ ID NO: 3794581 - DNA, 21 bp, Homo sapiens
agatcatagatttctgatttt

SEQ ID NO: 3794582 - DNA, 14 bp, Homo sapiens
agatccacacacag

SEQ ID NO: 3794583 - DNA, 17 bp, Homo sapiens
agatccacacacagagg

SEQ ID NO: 3794584 - DNA, 21 bp, Homo sapiens
agatccccaaaacaggccagg

SEQ ID NO: 3794585 - DNA, 22 bp, Homo sapiens
agatcccgcctcttcttcttca

SEQ ID NO: 3794586 - DNA, 14 bp, Homo sapiens
agatcgcagtttgc

SEQ ID NO: 3794587 - DNA, 16 bp, Homo sapiens
agatcgttagtatcta

SEQ ID NO: 3794588 - DNA, 17 bp, Homo sapiens
agatcgttagtatctaa

SEQ ID NO: 3794589 - DNA, 19 bp, Homo sapiens
agatctaggtgaggattga

SEQ ID NO: 3794590 - DNA, 14 bp, Homo sapiens
agatctccaaagct

SEQ ID NO: 3794591 - DNA, 15 bp, Homo sapiens
agatctccaaagctt

SEQ ID NO: 3794592 - DNA, 21 bp, Homo sapiens
agatctccaaagctttcctgg

SEQ ID NO: 3794593 - DNA, 22 bp, Homo sapiens
agatctccaaagctttcctgga

SEQ ID NO: 3794594 - DNA, 21 bp, Homo sapiens
agatctgcagggggtgtgtct

SEQ ID NO: 3794595 - DNA, 13 bp, Homo sapiens
agatctgtgcccc

SEQ ID NO: 3794596 - DNA, 14 bp, Homo sapiens
agatctgtgcccca

SEQ ID NO: 3794597 - DNA, 13 bp, Homo sapiens
agatctttcagga

SEQ ID NO: 3794598 - DNA, 19 bp, Homo sapiens
agatgaagagtgagagggc

SEQ ID NO: 3794599 - DNA, 17 bp, Homo sapiens
agatgaagcaaacacat

SEQ ID NO: 3794600 - DNA, 18 bp, Homo sapiens
agatgaagcaaacacatt

SEQ ID NO: 3794601 - DNA, 14 bp, Homo sapiens
agatgactgagtcc

SEQ ID NO: 3794602 - DNA, 21 bp, Homo sapiens
agatgagcccagccctgttct

SEQ ID NO: 3794603 - DNA, 20 bp, Homo sapiens
agatgcaaagaggcaagagg

SEQ ID NO: 3794604 - DNA, 18 bp, Homo sapiens
agatgcaaggaccaggac

SEQ ID NO: 3794605 - DNA, 13 bp, Homo sapiens
agatgcacatgag

SEQ ID NO: 3794606 - DNA, 16 bp, Homo sapiens
agatgcacatgagctg

SEQ ID NO: 3794607 - DNA, 13 bp, Homo sapiens
agatgccagagca

SEQ ID NO: 3794608 - DNA, 17 bp, Homo sapiens
agatgcctccaccgctg

SEQ ID NO: 3794609 - DNA, 22 bp, Homo sapiens
agatgcctccctgaccctgcag

SEQ ID NO: 3794610 - DNA, 18 bp, Homo sapiens
agatgctgaaacaggaga

SEQ ID NO: 3794611 - DNA, 18 bp, Homo sapiens
agatgcttctcactgcca

SEQ ID NO: 3794612 - DNA, 12 bp, Homo sapiens
agatgcttctgg

SEQ ID NO: 3794613 - DNA, 14 bp, Homo sapiens
agatgcttttcaaa

SEQ ID NO: 3794614 - DNA, 15 bp, Homo sapiens
agatgcttttcaaac

SEQ ID NO: 3794615 - DNA, 17 bp, Homo sapiens
agatgcttttcaaactg

SEQ ID NO: 3794616 - DNA, 21 bp, Homo sapiens
agatggaaccgcaggaagctg

SEQ ID NO: 3794617 - DNA, 16 bp, Homo sapiens
agatggaggaggaggc

SEQ ID NO: 3794618 - DNA, 13 bp, Homo sapiens
agatggagtccct

SEQ ID NO: 3794619 - DNA, 11 bp, Homo sapiens
agatggattct

SEQ ID NO: 3794620 - DNA, 18 bp, Homo sapiens
agatggattggtgtaaaa

SEQ ID NO: 3794621 - DNA, 14 bp, Homo sapiens
agatggcctttgct

SEQ ID NO: 3794622 - DNA, 18 bp, Homo sapiens
agatggctgtgcctctgc

SEQ ID NO: 3794623 - DNA, 22 bp, Homo sapiens
agatggctgtgcctctgcctgt

SEQ ID NO: 3794624 - DNA, 23 bp, Homo sapiens
agatggctgtgcctctgcctgtc

SEQ ID NO: 3794625 - DNA, 16 bp, Homo sapiens
agatgggcttgttttc

SEQ ID NO: 3794626 - DNA, 17 bp, Homo sapiens
agatgggcttgttttct

SEQ ID NO: 3794627 - DNA, 19 bp, Homo sapiens
agatggtatatttggtact

SEQ ID NO: 3794628 - DNA, 16 bp, Homo sapiens
agatggttacactgtt

SEQ ID NO: 3794629 - DNA, 17 bp, Homo sapiens
agatgtaaaaggtatta

SEQ ID NO: 3794630 - DNA, 12 bp, Homo sapiens
agatgtatcctt

SEQ ID NO: 3794631 - DNA, 17 bp, Homo sapiens
agatgtatccttccaat

SEQ ID NO: 3794632 - DNA, 15 bp, Homo sapiens
agatgtcagactggc

SEQ ID NO: 3794633 - DNA, 17 bp, Homo sapiens
agatgtgataaggatca

SEQ ID NO: 3794634 - DNA, 17 bp, Homo sapiens
agatgtgtcttcaattt

SEQ ID NO: 3794635 - DNA, 15 bp, Homo sapiens
agatgttcacccaac

SEQ ID NO: 3794636 - DNA, 24 bp, Homo sapiens
agatgtttgtcagatatgatatgt

SEQ ID NO: 3794637 - DNA, 21 bp, Homo sapiens
agattatattgagacaaaaat

SEQ ID NO: 3794638 - DNA, 11 bp, Homo sapiens
agattcaattt

SEQ ID NO: 3794639 - DNA, 17 bp, Homo sapiens
agattcacctgtaaaac

SEQ ID NO: 3794640 - DNA, 19 bp, Homo sapiens
agattcacctgtaaaactt

SEQ ID NO: 3794641 - DNA, 13 bp, Homo sapiens
agattcccagaga

SEQ ID NO: 3794642 - DNA, 14 bp, Homo sapiens
agattcccagagac

SEQ ID NO: 3794643 - DNA, 16 bp, Homo sapiens
agattcccagagcaaa

SEQ ID NO: 3794644 - DNA, 22 bp, Homo sapiens
agattgatcatttttataacca

SEQ ID NO: 3794645 - DNA, 17 bp, Homo sapiens
agattgcaacaggctgg

SEQ ID NO: 3794646 - DNA, 21 bp, Homo sapiens
agattgcaacaggctgggctt

SEQ ID NO: 3794647 - DNA, 21 bp, Homo sapiens
agattgcgccattgcactcca

SEQ ID NO: 3794648 - DNA, 15 bp, Homo sapiens
agattgctgcttctg

SEQ ID NO: 3794649 - DNA, 15 bp, Homo sapiens
agattgcttctgtag

SEQ ID NO: 3794650 - DNA, 17 bp, Homo sapiens
agattgcttctgtagta

SEQ ID NO: 3794651 - DNA, 15 bp, Homo sapiens
agatttattttgtta

SEQ ID NO: 3794652 - DNA, 20 bp, Homo sapiens
agatttgaagacaaaaatac

SEQ ID NO: 3794653 - DNA, 16 bp, Homo sapiens
agatttggagcactct

SEQ ID NO: 3794654 - DNA, 14 bp, Homo sapiens
agatttgttttgtg

SEQ ID NO: 3794655 - DNA, 16 bp, Homo sapiens
agattttaatcaaatt

SEQ ID NO: 3794656 - DNA, 13 bp, Homo sapiens
agattttcctgtg

SEQ ID NO: 3794657 - DNA, 14 bp, Homo sapiens
agattttgaatgct

SEQ ID NO: 3794658 - DNA, 17 bp, Homo sapiens
agcggaaagcagctcaa

SEQ ID NO: 3794659 - DNA, 17 bp, Homo sapiens
agcgggagacctgtgct

SEQ ID NO: 3794660 - DNA, 13 bp, Homo sapiens
agcgggcgcctgt

SEQ ID NO: 3794661 - DNA, 14 bp, Homo sapiens
agcggggggagggt

SEQ ID NO: 3794662 - DNA, 23 bp, Homo sapiens
agcgtgtctgtatttatgtgtga

SEQ ID NO: 3794663 - DNA, 15 bp, Homo sapiens
agctaaagaggctga

SEQ ID NO: 3794664 - DNA, 18 bp, Homo sapiens
agctaagctaggaatgaa

SEQ ID NO: 3794665 - DNA, 19 bp, Homo sapiens
agctaaggacatttcccag

SEQ ID NO: 3794666 - DNA, 19 bp, Homo sapiens
agctaagtgaaaaggtcat

SEQ ID NO: 3794667 - DNA, 15 bp, Homo sapiens
agctaataaaatatc

SEQ ID NO: 3794668 - DNA, 18 bp, Homo sapiens
agctaataaaatatcatt

SEQ ID NO: 3794669 - DNA, 18 bp, Homo sapiens
agctactaatgatgtttt

SEQ ID NO: 3794670 - DNA, 21 bp, Homo sapiens
agctactcaagaggctgaggc

SEQ ID NO: 3794671 - DNA, 15 bp, Homo sapiens
agctactcagaagcc

SEQ ID NO: 3794672 - DNA, 18 bp, Homo sapiens
agctactcagaagcctga

SEQ ID NO: 3794673 - DNA, 14 bp, Homo sapiens
agctacttgggagg

SEQ ID NO: 3794674 - DNA, 13 bp, Homo sapiens
agctactttgttt

SEQ ID NO: 3794675 - DNA, 19 bp, Homo sapiens
agctagaagtgggccagga

SEQ ID NO: 3794676 - DNA, 15 bp, Homo sapiens
agctagagcttcaag

SEQ ID NO: 3794677 - DNA, 20 bp, Homo sapiens
agctagaggaaccaaccccc

SEQ ID NO: 3794678 - DNA, 23 bp, Homo sapiens
agctagcaaaagaagtaacaaga

SEQ ID NO: 3794679 - DNA, 21 bp, Homo sapiens
agctagcgctgccgcacccca

SEQ ID NO: 3794680 - DNA, 13 bp, Homo sapiens
agctaggaatgaa

SEQ ID NO: 3794681 - DNA, 14 bp, Homo sapiens
agctaggcctggcc

SEQ ID NO: 3794682 - DNA, 13 bp, Homo sapiens
agctatacagttt

SEQ ID NO: 3794683 - DNA, 15 bp, Homo sapiens
agctatatccatgta

SEQ ID NO: 3794684 - DNA, 18 bp, Homo sapiens
agctatatttaagtattc

SEQ ID NO: 3794685 - DNA, 19 bp, Homo sapiens
agctatgggagccccaggg

SEQ ID NO: 3794686 - DNA, 15 bp, Homo sapiens
agctcaaaggcacag

SEQ ID NO: 3794687 - DNA, 23 bp, Homo sapiens
agctcaagtcttccctgatcaag

SEQ ID NO: 3794688 - DNA, 15 bp, Homo sapiens
agctcaccagcccca

SEQ ID NO: 3794689 - DNA, 23 bp, Homo sapiens
agctcaccagccccagtgcccac

SEQ ID NO: 3794690 - DNA, 19 bp, Homo sapiens
agctcagcccacccccctc

SEQ ID NO: 3794691 - DNA, 22 bp, Homo sapiens
agctcagcccacccccctcatt

SEQ ID NO: 3794692 - DNA, 18 bp, Homo sapiens
agctcagccccagcccag

SEQ ID NO: 3794693 - DNA, 17 bp, Homo sapiens
agctcaggaggcttgga

SEQ ID NO: 3794694 - DNA, 18 bp, Homo sapiens
agctcaggtgtccctgca

SEQ ID NO: 3794695 - DNA, 20 bp, Homo sapiens
agctcaggtgtccctgcact

SEQ ID NO: 3794696 - DNA, 18 bp, Homo sapiens
agctcagtcttccctagg

SEQ ID NO: 3794697 - DNA, 21 bp, Homo sapiens
agctcagtcttccctagggct

SEQ ID NO: 3794698 - DNA, 22 bp, Homo sapiens
agctcagtcttccctagggctg

SEQ ID NO: 3794699 - DNA, 21 bp, Homo sapiens
agctcattataatgtcattaa

SEQ ID NO: 3794700 - DNA, 19 bp, Homo sapiens
agctccagacccccagcaa

SEQ ID NO: 3794701 - DNA, 13 bp, Homo sapiens
agctccagctcac

SEQ ID NO: 3794702 - DNA, 17 bp, Homo sapiens
agctccagctcaccagc

SEQ ID NO: 3794703 - DNA, 18 bp, Homo sapiens
agctccagctcaccagcc

SEQ ID NO: 3794704 - DNA, 15 bp, Homo sapiens
agctccagggccaga

SEQ ID NO: 3794705 - DNA, 13 bp, Homo sapiens
agctccagttcga

SEQ ID NO: 3794706 - DNA, 15 bp, Homo sapiens
agctccatctccact

SEQ ID NO: 3794707 - DNA, 14 bp, Homo sapiens
agctccccaccacc

SEQ ID NO: 3794708 - DNA, 20 bp, Homo sapiens
agctccccgcttctgcctgc

SEQ ID NO: 3794709 - DNA, 13 bp, Homo sapiens
agctccctctgcc

SEQ ID NO: 3794710 - DNA, 23 bp, Homo sapiens
agctccgctttctacccagcgag

SEQ ID NO: 3794711 - DNA, 23 bp, Homo sapiens
agctcctcaactcacctaatgtt

SEQ ID NO: 3794712 - DNA, 22 bp, Homo sapiens
agctcctccttgtcttggcagc

SEQ ID NO: 3794713 - DNA, 14 bp, Homo sapiens
agctcctctgggca

SEQ ID NO: 3794714 - DNA, 17 bp, Homo sapiens
agctcctctgggcagga

SEQ ID NO: 3794715 - DNA, 20 bp, Homo sapiens
agctcctggtcttgagatgt

SEQ ID NO: 3794716 - DNA, 12 bp, Homo sapiens
agctccttctgt

SEQ ID NO: 3794717 - DNA, 13 bp, Homo sapiens
agctccttctgtc

SEQ ID NO: 3794718 - DNA, 15 bp, Homo sapiens
agctccttctgtcct

SEQ ID NO: 3794719 - DNA, 22 bp, Homo sapiens
agctccttctgtcctactctgt

SEQ ID NO: 3794720 - DNA, 22 bp, Homo sapiens
agctccttgagggcaagagcca

SEQ ID NO: 3794721 - DNA, 15 bp, Homo sapiens
agctccttgggaggc

SEQ ID NO: 3794722 - DNA, 20 bp, Homo sapiens
agctccttgggaggccccac

SEQ ID NO: 3794723 - DNA, 12 bp, Homo sapiens
agctcggtggac

SEQ ID NO: 3794724 - DNA, 15 bp, Homo sapiens
agctcggtggaccca

SEQ ID NO: 3794725 - DNA, 17 bp, Homo sapiens
agctctagacaaccctg

SEQ ID NO: 3794726 - DNA, 19 bp, Homo sapiens
agctctccctctggccctg

SEQ ID NO: 3794727 - DNA, 20 bp, Homo sapiens
agctctccctctggccctgc

SEQ ID NO: 3794728 - DNA, 18 bp, Homo sapiens
agctctccggtctctctc

SEQ ID NO: 3794729 - DNA, 21 bp, Homo sapiens
agctctgaagtcacatcacag

SEQ ID NO: 3794730 - DNA, 23 bp, Homo sapiens
agctctgaagtcacatcacagga

SEQ ID NO: 3794731 - DNA, 21 bp, Homo sapiens
agctctgcagagcaggaaaca

SEQ ID NO: 3794732 - DNA, 15 bp, Homo sapiens
agctctgcttgccga

SEQ ID NO: 3794733 - DNA, 12 bp, Homo sapiens
agctctggctca

SEQ ID NO: 3794734 - DNA, 17 bp, Homo sapiens
agctctggtgacaccag

SEQ ID NO: 3794735 - DNA, 14 bp, Homo sapiens
agctctgtcctggg

SEQ ID NO: 3794736 - DNA, 23 bp, Homo sapiens
agctctgtcctgggagtgagctg

SEQ ID NO: 3794737 - DNA, 15 bp, Homo sapiens
agctctgtgttgcca

SEQ ID NO: 3794738 - DNA, 16 bp, Homo sapiens
agctctgtgttgccat

SEQ ID NO: 3794739 - DNA, 18 bp, Homo sapiens
agctcttcaggcctccct

SEQ ID NO: 3794740 - DNA, 18 bp, Homo sapiens
agctcttctccaggctgt

SEQ ID NO: 3794741 - DNA, 14 bp, Homo sapiens
agctcttctccatc

SEQ ID NO: 3794742 - DNA, 22 bp, Homo sapiens
agctcttctgccggccctgggg

SEQ ID NO: 3794743 - DNA, 19 bp, Homo sapiens
agctgaagccgccaggacc

SEQ ID NO: 3794744 - DNA, 16 bp, Homo sapiens
agctgacaaaattttg

SEQ ID NO: 3794745 - DNA, 15 bp, Homo sapiens
agctgacgaggctgg

SEQ ID NO: 3794746 - DNA, 15 bp, Homo sapiens
agctgacttttctgt

SEQ ID NO: 3794747 - DNA, 21 bp, Homo sapiens
agctgacttttctgtccgagc

SEQ ID NO: 3794748 - DNA, 16 bp, Homo sapiens
agctgagaatagaagg

SEQ ID NO: 3794749 - DNA, 18 bp, Homo sapiens
agctgagaatagaaggaa

SEQ ID NO: 3794750 - DNA, 23 bp, Homo sapiens
agctgagaatagaaggaaactag

SEQ ID NO: 3794751 - DNA, 15 bp, Homo sapiens
agctgagcagggaga

SEQ ID NO: 3794752 - DNA, 17 bp, Homo sapiens
agctgaggcaattctaa

SEQ ID NO: 3794753 - DNA, 19 bp, Homo sapiens
agctgattactgtcaataa

SEQ ID NO: 3794754 - DNA, 21 bp, Homo sapiens
agctgattactgtcaataaac

SEQ ID NO: 3794755 - DNA, 22 bp, Homo sapiens
agctgattactgtcaataaaca

SEQ ID NO: 3794756 - DNA, 14 bp, Homo sapiens
agctgattttaaca

SEQ ID NO: 3794757 - DNA, 15 bp, Homo sapiens
agctgattttaacaa

SEQ ID NO: 3794758 - DNA, 20 bp, Homo sapiens
agctgattttaacaataact

SEQ ID NO: 3794759 - DNA, 15 bp, Homo sapiens
agctgcaagtgacat

SEQ ID NO: 3794760 - DNA, 19 bp, Homo sapiens
agctgcaccctcaggcagg

SEQ ID NO: 3794761 - DNA, 19 bp, Homo sapiens
agctgcagagacagagagg

SEQ ID NO: 3794762 - DNA, 13 bp, Homo sapiens
agctgccagagaa

SEQ ID NO: 3794763 - DNA, 16 bp, Homo sapiens
agctgcccctccctgc

SEQ ID NO: 3794764 - DNA, 17 bp, Homo sapiens
agctgccgaccagagcc

SEQ ID NO: 3794765 - DNA, 13 bp, Homo sapiens
agctgcctaagag

SEQ ID NO: 3794766 - DNA, 13 bp, Homo sapiens
agctgcctgttca

SEQ ID NO: 3794767 - DNA, 20 bp, Homo sapiens
agctgcggtccacccaggag

SEQ ID NO: 3794768 - DNA, 21 bp, Homo sapiens
agctgcggtccacccaggagc

SEQ ID NO: 3794769 - DNA, 15 bp, Homo sapiens
agctgctaaatctcc

SEQ ID NO: 3794770 - DNA, 22 bp, Homo sapiens
agctgctaaatctcctattttt

SEQ ID NO: 3794771 - DNA, 17 bp, Homo sapiens
agggacttaaaaaactt

SEQ ID NO: 3794772 - DNA, 13 bp, Homo sapiens
agggagagagaga

SEQ ID NO: 3794773 - DNA, 14 bp, Homo sapiens
agggagagcggggc

SEQ ID NO: 3794774 - DNA, 17 bp, Homo sapiens
agggagcccctttgatg

SEQ ID NO: 3794775 - DNA, 16 bp, Homo sapiens
agggagcgagggagaa

SEQ ID NO: 3794776 - DNA, 22 bp, Homo sapiens
agggaggaatcgaggaaccaga

SEQ ID NO: 3794777 - DNA, 17 bp, Homo sapiens
agggagtacctgctgcc

SEQ ID NO: 3794778 - DNA, 19 bp, Homo sapiens
agggagtacctgctgcccc

SEQ ID NO: 3794779 - DNA, 20 bp, Homo sapiens
agggagtccgaaagggactt

SEQ ID NO: 3794780 - DNA, 16 bp, Homo sapiens
agggatagaggggggc

SEQ ID NO: 3794781 - DNA, 20 bp, Homo sapiens
agggatagtcaccttttaaa

SEQ ID NO: 3794782 - DNA, 21 bp, Homo sapiens
agggatagtcaccttttaaat

SEQ ID NO: 3794783 - DNA, 15 bp, Homo sapiens
agggatcacagggcc

SEQ ID NO: 3794784 - DNA, 17 bp, Homo sapiens
agggatcacagggcccc

SEQ ID NO: 3794785 - DNA, 15 bp, Homo sapiens
agggatgactaaaat

SEQ ID NO: 3794786 - DNA, 22 bp, Homo sapiens
agggatgactaaaatatttatt

SEQ ID NO: 3794787 - DNA, 18 bp, Homo sapiens
agggatgctgcctgagtc

SEQ ID NO: 3794788 - DNA, 17 bp, Homo sapiens
agggatggggccacagc

SEQ ID NO: 3794789 - DNA, 14 bp, Homo sapiens
agggattcaggctg

SEQ ID NO: 3794790 - DNA, 19 bp, Homo sapiens
agggattcaggctgcttgg

SEQ ID NO: 3794791 - DNA, 17 bp, Homo sapiens
agggcacaccgggcact

SEQ ID NO: 3794792 - DNA, 16 bp, Homo sapiens
agggcactgctgctgc

SEQ ID NO: 3794793 - DNA, 14 bp, Homo sapiens
agggcactggtggc

SEQ ID NO: 3794794 - DNA, 14 bp, Homo sapiens
agggcagcagatct

SEQ ID NO: 3794795 - DNA, 13 bp, Homo sapiens
agggcagggcatc

SEQ ID NO: 3794796 - DNA, 21 bp, Homo sapiens
agggcatctcctgtgcatggg

SEQ ID NO: 3794797 - DNA, 17 bp, Homo sapiens
agggcatgcgcacaagg

SEQ ID NO: 3794798 - DNA, 15 bp, Homo sapiens
agggccacgtgccag

SEQ ID NO: 3794799 - DNA, 16 bp, Homo sapiens
agggccagtcctgcct

SEQ ID NO: 3794800 - DNA, 17 bp, Homo sapiens
agggccagtcctgcctg

SEQ ID NO: 3794801 - DNA, 19 bp, Homo sapiens
agggccagtcctgcctggc

SEQ ID NO: 3794802 - DNA, 15 bp, Homo sapiens
agggccatgaacttt

SEQ ID NO: 3794803 - DNA, 15 bp, Homo sapiens
agggcccacttgtat

SEQ ID NO: 3794804 - DNA, 13 bp, Homo sapiens
agggcccagagag

SEQ ID NO: 3794805 - DNA, 18 bp, Homo sapiens
agggcccagagagggtgg

SEQ ID NO: 3794806 - DNA, 23 bp, Homo sapiens
agggcccagagagggtggtgacc

SEQ ID NO: 3794807 - DNA, 15 bp, Homo sapiens
agggcccaggcaggc

SEQ ID NO: 3794808 - DNA, 12 bp, Homo sapiens
agggccctgcag

SEQ ID NO: 3794809 - DNA, 13 bp, Homo sapiens
agggccctgcaga

SEQ ID NO: 3794810 - DNA, 20 bp, Homo sapiens
agggcctcactctgttgctc

SEQ ID NO: 3794811 - DNA, 15 bp, Homo sapiens
agggcctccagccct

SEQ ID NO: 3794812 - DNA, 20 bp, Homo sapiens
agggcctccattcctggagc

SEQ ID NO: 3794813 - DNA, 17 bp, Homo sapiens
agggcctggtccctggg

SEQ ID NO: 3794814 - DNA, 21 bp, Homo sapiens
agggcctggtccctgggagga

SEQ ID NO: 3794815 - DNA, 23 bp, Homo sapiens
agggccttaaaagccatcatgta

SEQ ID NO: 3794816 - DNA, 12 bp, Homo sapiens
agggccttgccc

SEQ ID NO: 3794817 - DNA, 14 bp, Homo sapiens
agggccttgcccag

SEQ ID NO: 3794818 - DNA, 15 bp, Homo sapiens
agggccttgcccaga

SEQ ID NO: 3794819 - DNA, 23 bp, Homo sapiens
agggccttgcccagagatgcctc

SEQ ID NO: 3794820 - DNA, 12 bp, Homo sapiens
agggccttgcta

SEQ ID NO: 3794821 - DNA, 23 bp, Homo sapiens
agggcgaggggagggtggcaggt

SEQ ID NO: 3794822 - DNA, 17 bp, Homo sapiens
agggcgtgactcaccca

SEQ ID NO: 3794823 - DNA, 13 bp, Homo sapiens
agggctaagagct

SEQ ID NO: 3794824 - DNA, 22 bp, Homo sapiens
agggctaagagctagcgctgcc

SEQ ID NO: 3794825 - DNA, 23 bp, Homo sapiens
agggctaagagctagcgctgccg

SEQ ID NO: 3794826 - DNA, 22 bp, Homo sapiens
agggctcagcggggacagctcc

SEQ ID NO: 3794827 - DNA, 21 bp, Homo sapiens
agggctccctatgttgcccag

SEQ ID NO: 3794828 - DNA, 18 bp, Homo sapiens
aggggaaaatcagcctgc

SEQ ID NO: 3794829 - DNA, 20 bp, Homo sapiens
aggggaaaccagtgtagcct

SEQ ID NO: 3794830 - DNA, 14 bp, Homo sapiens
aggggaacagactg

SEQ ID NO: 3794831 - DNA, 19 bp, Homo sapiens
aggggaataatagaagaac

SEQ ID NO: 3794832 - DNA, 19 bp, Homo sapiens
aggggaatgtttgcctctg

SEQ ID NO: 3794833 - DNA, 14 bp, Homo sapiens
aggggactcagccc

SEQ ID NO: 3794834 - DNA, 22 bp, Homo sapiens
aggggactcagccctgaggtga

SEQ ID NO: 3794835 - DNA, 13 bp, Homo sapiens
aggggaggagggc

SEQ ID NO: 3794836 - DNA, 22 bp, Homo sapiens
aggggatgtatccatgggggca

SEQ ID NO: 3794837 - DNA, 19 bp, Homo sapiens
aggggcaacgaagaaaaaa

SEQ ID NO: 3794838 - DNA, 20 bp, Homo sapiens
aggggcaacgaagaaaaaaa

SEQ ID NO: 3794839 - DNA, 14 bp, Homo sapiens
aggggcagaacagc

SEQ ID NO: 3794840 - DNA, 14 bp, Homo sapiens
aggggcaggagctc

SEQ ID NO: 3794841 - DNA, 17 bp, Homo sapiens
aggggcatctgcccctc

SEQ ID NO: 3794842 - DNA, 23 bp, Homo sapiens
aggggccaaatatattctctttg

SEQ ID NO: 3794843 - DNA, 21 bp, Homo sapiens
aggggcccgagcagaagcagg

SEQ ID NO: 3794844 - DNA, 14 bp, Homo sapiens
aggggcccgtggga

SEQ ID NO: 3794845 - DNA, 20 bp, Homo sapiens
aggggcggcaggagggaggt

SEQ ID NO: 3794846 - DNA, 15 bp, Homo sapiens
aggggctggactggc

SEQ ID NO: 3794847 - DNA, 10 bp, Homo sapiens
agggggccac

SEQ ID NO: 3794848 - DNA, 19 bp, Homo sapiens
agggggccacctccccagg

SEQ ID NO: 3794849 - DNA, 20 bp, Homo sapiens
aggggggttgcagtggagag

SEQ ID NO: 3794850 - DNA, 14 bp, Homo sapiens
agggggttacaaac

SEQ ID NO: 3794851 - DNA, 21 bp, Homo sapiens
aggggtgggttcctcttcccc

SEQ ID NO: 3794852 - DNA, 19 bp, Homo sapiens
aggggttggttgaggtgga

SEQ ID NO: 3794853 - DNA, 21 bp, Homo sapiens
aggggttttcgaagctcagcc

SEQ ID NO: 3794854 - DNA, 20 bp, Homo sapiens
agggtacttccactgatgga

SEQ ID NO: 3794855 - DNA, 16 bp, Homo sapiens
agggtatcaggtgctg

SEQ ID NO: 3794856 - DNA, 21 bp, Homo sapiens
agggtatcaggtgctgccatc

SEQ ID NO: 3794857 - DNA, 13 bp, Homo sapiens
agggtcaggaagg

SEQ ID NO: 3794858 - DNA, 21 bp, Homo sapiens
agggtcaggaaggatgagcat

SEQ ID NO: 3794859 - DNA, 22 bp, Homo sapiens
agggtcaggaaggatgagcatt

SEQ ID NO: 3794860 - DNA, 14 bp, Homo sapiens
agggtcaggagagg

SEQ ID NO: 3794861 - DNA, 18 bp, Homo sapiens
agggtcaggagaggggca

SEQ ID NO: 3794862 - DNA, 21 bp, Homo sapiens
agggtcctggctcctgagggg

SEQ ID NO: 3794863 - DNA, 14 bp, Homo sapiens
agggtccttccctc

SEQ ID NO: 3794864 - DNA, 16 bp, Homo sapiens
agggtccttccctctc

SEQ ID NO: 3794865 - DNA, 23 bp, Homo sapiens
agggtctagggagagacccttgt

SEQ ID NO: 3794866 - DNA, 22 bp, Homo sapiens
agggtctcactatgttgcccag

SEQ ID NO: 3794867 - DNA, 15 bp, Homo sapiens
agggtctcactctgt

SEQ ID NO: 3794868 - DNA, 16 bp, Homo sapiens
agggtctcactctgtc

SEQ ID NO: 3794869 - DNA, 13 bp, Homo sapiens
agggtctggagaa

SEQ ID NO: 3794870 - DNA, 15 bp, Homo sapiens
agggtctggagaagc

SEQ ID NO: 3794871 - DNA, 19 bp, Homo sapiens
agggtctggagaagcagtg

SEQ ID NO: 3794872 - DNA, 21 bp, Homo sapiens
agggtgctgcttccctctgcc

SEQ ID NO: 3794873 - DNA, 18 bp, Homo sapiens
agggtggcccttgcagtt

SEQ ID NO: 3794874 - DNA, 21 bp, Homo sapiens
agggtggctgggtccagggga

SEQ ID NO: 3794875 - DNA, 18 bp, Homo sapiens
agggtgggagagcccagc

SEQ ID NO: 3794876 - DNA, 17 bp, Homo sapiens
agggtgggatggaggag

SEQ ID NO: 3794877 - DNA, 18 bp, Homo sapiens
agggtgggatggaggaga

SEQ ID NO: 3794878 - DNA, 18 bp, Homo sapiens
agggtggtgacctctgcc

SEQ ID NO: 3794879 - DNA, 22 bp, Homo sapiens
agggttcaaaatgtctgtagct

SEQ ID NO: 3794880 - DNA, 20 bp, Homo sapiens
agggttctcctctcccctct

SEQ ID NO: 3794881 - DNA, 21 bp, Homo sapiens
agggttgagttacttcctatc

SEQ ID NO: 3794882 - DNA, 13 bp, Homo sapiens
agggttggcccct

SEQ ID NO: 3794883 - DNA, 18 bp, Homo sapiens
agggttggcccctgcccg

SEQ ID NO: 3794884 - DNA, 19 bp, Homo sapiens
agtgccttacctcctgccc

SEQ ID NO: 3794885 - DNA, 21 bp, Homo sapiens
agtgccttacctcctgcccag

SEQ ID NO: 3794886 - DNA, 13 bp, Homo sapiens
agtgccttccata

SEQ ID NO: 3794887 - DNA, 15 bp, Homo sapiens
agtgccttccataat

SEQ ID NO: 3794888 - DNA, 18 bp, Homo sapiens
agtgcgatgtttcaggag

SEQ ID NO: 3794889 - DNA, 15 bp, Homo sapiens
agtgctgaagcttat

SEQ ID NO: 3794890 - DNA, 21 bp, Homo sapiens
agtgctgaagcttattaatgc

SEQ ID NO: 3794891 - DNA, 20 bp, Homo sapiens
agtgctgggattacaagcgt

SEQ ID NO: 3794892 - DNA, 19 bp, Homo sapiens
agtgctgggattacaggtg

SEQ ID NO: 3794893 - DNA, 17 bp, Homo sapiens
agtgctgtggcctgggc

SEQ ID NO: 3794894 - DNA, 18 bp, Homo sapiens
agtgctgtggcctgggca

SEQ ID NO: 3794895 - DNA, 20 bp, Homo sapiens
agtgctgtggcctgggcaag

SEQ ID NO: 3794896 - DNA, 16 bp, Homo sapiens
agtgcttaaaaatcat

SEQ ID NO: 3794897 - DNA, 21 bp, Homo sapiens
agtgcttcttactattaagca

SEQ ID NO: 3794898 - DNA, 16 bp, Homo sapiens
agtggaacagcgggag

SEQ ID NO: 3794899 - DNA, 16 bp, Homo sapiens
agtggaagaagaaaac

SEQ ID NO: 3794900 - DNA, 15 bp, Homo sapiens
agtggactttccacc

SEQ ID NO: 3794901 - DNA, 23 bp, Homo sapiens
agtggaggttaaggctgaggaaa

SEQ ID NO: 3794902 - DNA, 15 bp, Homo sapiens
agtggatgatgtttc

SEQ ID NO: 3794903 - DNA, 21 bp, Homo sapiens
agtggcaagaccaaaatgaca

SEQ ID NO: 3794904 - DNA, 14 bp, Homo sapiens
agtggcagctgctt

SEQ ID NO: 3794905 - DNA, 20 bp, Homo sapiens
agtggcagctgcttttgtct

SEQ ID NO: 3794906 - DNA, 19 bp, Homo sapiens
agtggccagaccagagctc

SEQ ID NO: 3794907 - DNA, 22 bp, Homo sapiens
agtggccagaccagagctctgg

SEQ ID NO: 3794908 - DNA, 18 bp, Homo sapiens
agtggcctggccaggagc

SEQ ID NO: 3794909 - DNA, 21 bp, Homo sapiens
agtggctcctcccggtgccca

SEQ ID NO: 3794910 - DNA, 14 bp, Homo sapiens
agtggctgctgact

SEQ ID NO: 3794911 - DNA, 16 bp, Homo sapiens
agtggctgtcatcagc

SEQ ID NO: 3794912 - DNA, 20 bp, Homo sapiens
agtgggaacgtgactgcccc

SEQ ID NO: 3794913 - DNA, 21 bp, Homo sapiens
agtgggacagggcatggccag

SEQ ID NO: 3794914 - DNA, 14 bp, Homo sapiens
agtgggccagtgtg

SEQ ID NO: 3794915 - DNA, 20 bp, Homo sapiens
agtggggagacacctcagag

SEQ ID NO: 3794916 - DNA, 18 bp, Homo sapiens
agtgggggatcacagcct

SEQ ID NO: 3794917 - DNA, 20 bp, Homo sapiens
agtggggtctccctctcctg

SEQ ID NO: 3794918 - DNA, 13 bp, Homo sapiens
agtgggtgaataa

SEQ ID NO: 3794919 - DNA, 23 bp, Homo sapiens
agtggtcaggagttgtttctgac

SEQ ID NO: 3794920 - DNA, 13 bp, Homo sapiens
agtggtctttctg

SEQ ID NO: 3794921 - DNA, 16 bp, Homo sapiens
agtggtctttctggag

SEQ ID NO: 3794922 - DNA, 18 bp, Homo sapiens
agtggtctttctggagag

SEQ ID NO: 3794923 - DNA, 20 bp, Homo sapiens
agtggtctttctggagaggt

SEQ ID NO: 3794924 - DNA, 17 bp, Homo sapiens
agtggtgcgatctgggt

SEQ ID NO: 3794925 - DNA, 17 bp, Homo sapiens
agtggtgttttaaagag

SEQ ID NO: 3794926 - DNA, 22 bp, Homo sapiens
agtggtttcataggagacacat

SEQ ID NO: 3794927 - DNA, 15 bp, Homo sapiens
agtgtaaaaatgaga

SEQ ID NO: 3794928 - DNA, 16 bp, Homo sapiens
agtgtaaaaatgagaa

SEQ ID NO: 3794929 - DNA, 13 bp, Homo sapiens
agtgtaacaagaa

SEQ ID NO: 3794930 - DNA, 19 bp, Homo sapiens
agtgtaacaagaaaggaga

SEQ ID NO: 3794931 - DNA, 19 bp, Homo sapiens
agtgtagatttgttttgtg

SEQ ID NO: 3794932 - DNA, 13 bp, Homo sapiens
agtgtagccttgc

SEQ ID NO: 3794933 - DNA, 15 bp, Homo sapiens
agtgtagccttgccc

SEQ ID NO: 3794934 - DNA, 17 bp, Homo sapiens
agtgtatgcacgtgtgc

SEQ ID NO: 3794935 - DNA, 19 bp, Homo sapiens
agtgtcttcacggcaggac

SEQ ID NO: 3794936 - DNA, 21 bp, Homo sapiens
agtgtctttctttggtgcctt

SEQ ID NO: 3794937 - DNA, 15 bp, Homo sapiens
agtgtgaaatagaca

SEQ ID NO: 3794938 - DNA, 23 bp, Homo sapiens
agtgtgacaaggattgctactgt

SEQ ID NO: 3794939 - DNA, 18 bp, Homo sapiens
agtgtgagtaagagctgg

SEQ ID NO: 3794940 - DNA, 19 bp, Homo sapiens
agtgtgcacgagtgggaag

SEQ ID NO: 3794941 - DNA, 21 bp, Homo sapiens
agtgtgcctgaagtcccagat

SEQ ID NO: 3794942 - DNA, 14 bp, Homo sapiens
agtgtggctcccct

SEQ ID NO: 3794943 - DNA, 16 bp, Homo sapiens
agtgtggctcccctct

SEQ ID NO: 3794944 - DNA, 21 bp, Homo sapiens
agtgtggctcccctctattta

SEQ ID NO: 3794945 - DNA, 17 bp, Homo sapiens
agtgtgggaagggagag

SEQ ID NO: 3794946 - DNA, 19 bp, Homo sapiens
agtgtgtatgtgcgtgtgt

SEQ ID NO: 3794947 - DNA, 20 bp, Homo sapiens
agtgtgtatgtgcgtgtgtg

SEQ ID NO: 3794948 - DNA, 21 bp, Homo sapiens
agtgtgtccaagtgtgtgtgc

SEQ ID NO: 3794949 - DNA, 13 bp, Homo sapiens
agtgtgtctcctg

SEQ ID NO: 3794950 - DNA, 15 bp, Homo sapiens
agtgtgtctcctgca

SEQ ID NO: 3794951 - DNA, 17 bp, Homo sapiens
agtgtgtgcaagtatgt

SEQ ID NO: 3794952 - DNA, 12 bp, Homo sapiens
agtgtgtgtgcg

SEQ ID NO: 3794953 - DNA, 17 bp, Homo sapiens
agtgtgttctgattaga

SEQ ID NO: 3794954 - DNA, 19 bp, Homo sapiens
agtgtgtttccttcagtgc

SEQ ID NO: 3794955 - DNA, 13 bp, Homo sapiens
agtgttgtttgta

SEQ ID NO: 3794956 - DNA, 21 bp, Homo sapiens
agtgttgtttgtaaataagag

SEQ ID NO: 3794957 - DNA, 22 bp, Homo sapiens
agtgttgtttgtaaataagaga

SEQ ID NO: 3794958 - DNA, 20 bp, Homo sapiens
agtgttttaagataaattat

SEQ ID NO: 3794959 - DNA, 13 bp, Homo sapiens
agtgttttctggg

SEQ ID NO: 3794960 - DNA, 16 bp, Homo sapiens
agttaaaaaaaataat

SEQ ID NO: 3794961 - DNA, 17 bp, Homo sapiens
agttaacaaggaatgcc

SEQ ID NO: 3794962 - DNA, 19 bp, Homo sapiens
agttaacagacaacacgtt

SEQ ID NO: 3794963 - DNA, 12 bp, Homo sapiens
agttaacagaga

SEQ ID NO: 3794964 - DNA, 14 bp, Homo sapiens
agttaactttcaga

SEQ ID NO: 3794965 - DNA, 14 bp, Homo sapiens
agttaatcttgctt

SEQ ID NO: 3794966 - DNA, 15 bp, Homo sapiens
agttaatcttgcttt

SEQ ID NO: 3794967 - DNA, 20 bp, Homo sapiens
agttacaaattgcttgaaag

SEQ ID NO: 3794968 - DNA, 23 bp, Homo sapiens
agttactatcatgtcaaacgtga

SEQ ID NO: 3794969 - DNA, 17 bp, Homo sapiens
agttactatcctggctt

SEQ ID NO: 3794970 - DNA, 15 bp, Homo sapiens
agttactcagccctg

SEQ ID NO: 3794971 - DNA, 16 bp, Homo sapiens
agttactcagccctgg

SEQ ID NO: 3794972 - DNA, 18 bp, Homo sapiens
agttactcagccctgggc

SEQ ID NO: 3794973 - DNA, 19 bp, Homo sapiens
agttactcagccctgggcc

SEQ ID NO: 3794974 - DNA, 17 bp, Homo sapiens
agttactgttatagagg

SEQ ID NO: 3794975 - DNA, 14 bp, Homo sapiens
agttacttcctatc

SEQ ID NO: 3794976 - DNA, 18 bp, Homo sapiens
agttagagatgcctccct

SEQ ID NO: 3794977 - DNA, 14 bp, Homo sapiens
agttagctcaggag

SEQ ID NO: 3794978 - DNA, 14 bp, Homo sapiens
agttaggaaataaa

SEQ ID NO: 3794979 - DNA, 21 bp, Homo sapiens
agttaggaaataaaacctttc

SEQ ID NO: 3794980 - DNA, 18 bp, Homo sapiens
agttaggctattcacaac

SEQ ID NO: 3794981 - DNA, 17 bp, Homo sapiens
agttagggaatggcaca

SEQ ID NO: 3794982 - DNA, 18 bp, Homo sapiens
agttaggtttaacataaa

SEQ ID NO: 3794983 - DNA, 23 bp, Homo sapiens
agttaggtttaacataaaggtta

SEQ ID NO: 3794984 - DNA, 16 bp, Homo sapiens
agttagtagcatgttg

SEQ ID NO: 3794985 - DNA, 16 bp, Homo sapiens
agttagtttctttggg

SEQ ID NO: 3794986 - DNA, 19 bp, Homo sapiens
agttatataaagagaaaat

SEQ ID NO: 3794987 - DNA, 21 bp, Homo sapiens
agttatataaagagaaaattg

SEQ ID NO: 3794988 - DNA, 22 bp, Homo sapiens
agttatataaagagaaaattga

SEQ ID NO: 3794989 - DNA, 21 bp, Homo sapiens
agttatggcctatacactatt

SEQ ID NO: 3794990 - DNA, 15 bp, Homo sapiens
agttatgtgaatgat

SEQ ID NO: 3794991 - DNA, 13 bp, Homo sapiens
agttcaaacaaga

SEQ ID NO: 3794992 - DNA, 13 bp, Homo sapiens
agttcaaggacca

SEQ ID NO: 3794993 - DNA, 22 bp, Homo sapiens
agttcacctatttcaaaaattt

SEQ ID NO: 3794994 - DNA, 14 bp, Homo sapiens
agttcacttgcagt

SEQ ID NO: 3794995 - DNA, 19 bp, Homo sapiens
agttcaggtagctgcccct

SEQ ID NO: 3794996 - DNA, 20 bp, Homo sapiens
agttcagtaagaccggaagc

SEQ ID NO: 3794997 - DNA, 20 bp, Homo sapiens
atatattttttaatttgatg

SEQ ID NO: 3794998 - DNA, 17 bp, Homo sapiens
atatcagttactcagcc

SEQ ID NO: 3794999 - DNA, 21 bp, Homo sapiens
atatcagttactcagccctgg

SEQ ID NO: 3795000 - DNA, 13 bp, Homo sapiens
atatcagtttgct

SEQ ID NO: 3795001 - DNA, 13 bp, Homo sapiens
atatcattcagca

SEQ ID NO: 3795002 - DNA, 15 bp, Homo sapiens
atatcattcagcaac

SEQ ID NO: 3795003 - DNA, 21 bp, Homo sapiens
atatcatttattttttacatt

SEQ ID NO: 3795004 - DNA, 23 bp, Homo sapiens
atatcatttattttttacattat

SEQ ID NO: 3795005 - DNA, 12 bp, Homo sapiens
atatccatgtac

SEQ ID NO: 3795006 - DNA, 15 bp, Homo sapiens
atatctatcagagta

SEQ ID NO: 3795007 - DNA, 20 bp, Homo sapiens
atatctatcttatatagttt

SEQ ID NO: 3795008 - DNA, 17 bp, Homo sapiens
atatctgaaaatgtatg

SEQ ID NO: 3795009 - DNA, 20 bp, Homo sapiens
atatctgaaaatgtatgtgt

SEQ ID NO: 3795010 - DNA, 22 bp, Homo sapiens
atatctgaaaatgtatgtgtaa

SEQ ID NO: 3795011 - DNA, 19 bp, Homo sapiens
atatcttctgatttgtccc

SEQ ID NO: 3795012 - DNA, 15 bp, Homo sapiens
atatcttgaaatgaa

SEQ ID NO: 3795013 - DNA, 15 bp, Homo sapiens
atatctttttattga

SEQ ID NO: 3795014 - DNA, 16 bp, Homo sapiens
atatctttttattgat

SEQ ID NO: 3795015 - DNA, 14 bp, Homo sapiens
atatgaaaaatatg

SEQ ID NO: 3795016 - DNA, 13 bp, Homo sapiens
atatgaacatata

SEQ ID NO: 3795017 - DNA, 22 bp, Homo sapiens
atatgaatacagggcatgcatt

SEQ ID NO: 3795018 - DNA, 21 bp, Homo sapiens
atatgacagctgtccctgtca

SEQ ID NO: 3795019 - DNA, 20 bp, Homo sapiens
atatgacggaagaacataga

SEQ ID NO: 3795020 - DNA, 23 bp, Homo sapiens
atatgaggatgcagagtcagcag

SEQ ID NO: 3795021 - DNA, 16 bp, Homo sapiens
atatgatattgcatat

SEQ ID NO: 3795022 - DNA, 15 bp, Homo sapiens
atatgcacaatagca

SEQ ID NO: 3795023 - DNA, 18 bp, Homo sapiens
atatggactcagttttct

SEQ ID NO: 3795024 - DNA, 18 bp, Homo sapiens
atatggatattagtcata

SEQ ID NO: 3795025 - DNA, 16 bp, Homo sapiens
atatggggatgcagca

SEQ ID NO: 3795026 - DNA, 22 bp, Homo sapiens
atatgggttgcatttggtcaag

SEQ ID NO: 3795027 - DNA, 12 bp, Homo sapiens
atatgtaaaata

SEQ ID NO: 3795028 - DNA, 14 bp, Homo sapiens
atatgtaaaataaa

SEQ ID NO: 3795029 - DNA, 15 bp, Homo sapiens
atatgtaaaataaaa

SEQ ID NO: 3795030 - DNA, 20 bp, Homo sapiens
atatgtaaaataaaattatg

SEQ ID NO: 3795031 - DNA, 19 bp, Homo sapiens
atatgtaccatgtacatga

SEQ ID NO: 3795032 - DNA, 18 bp, Homo sapiens
atatgtatccagtacatt

SEQ ID NO: 3795033 - DNA, 14 bp, Homo sapiens
atatgtatggtttt

SEQ ID NO: 3795034 - DNA, 13 bp, Homo sapiens
atatgtatgtaaa

SEQ ID NO: 3795035 - DNA, 18 bp, Homo sapiens
atatgtgcttgcctcagt

SEQ ID NO: 3795036 - DNA, 20 bp, Homo sapiens
atatgtgtgtgtatgtttgc

SEQ ID NO: 3795037 - DNA, 19 bp, Homo sapiens
atatgtgtttttcacattt

SEQ ID NO: 3795038 - DNA, 15 bp, Homo sapiens
atatgttcaactgga

SEQ ID NO: 3795039 - DNA, 17 bp, Homo sapiens
atatgttttaaatatag

SEQ ID NO: 3795040 - DNA, 14 bp, Homo sapiens
atattaaaaatggt

SEQ ID NO: 3795041 - DNA, 19 bp, Homo sapiens
atattaaaaatggtaaaat

SEQ ID NO: 3795042 - DNA, 20 bp, Homo sapiens
atattaaaaatggtaaaatt

SEQ ID NO: 3795043 - DNA, 23 bp, Homo sapiens
atattaaaaatggtaaaattgca

SEQ ID NO: 3795044 - DNA, 14 bp, Homo sapiens
atattaaaaattgg

SEQ ID NO: 3795045 - DNA, 23 bp, Homo sapiens
atattacacaaatacttattcat

SEQ ID NO: 3795046 - DNA, 18 bp, Homo sapiens
atattagaagtgttaact

SEQ ID NO: 3795047 - DNA, 15 bp, Homo sapiens
atattagtatgtatg

SEQ ID NO: 3795048 - DNA, 19 bp, Homo sapiens
atattagtcatagaagaac

SEQ ID NO: 3795049 - DNA, 13 bp, Homo sapiens
atattatctttgt

SEQ ID NO: 3795050 - DNA, 20 bp, Homo sapiens
atattattcaccatgtaaaa

SEQ ID NO: 3795051 - DNA, 23 bp, Homo sapiens
atattccatagtatattaaaaat

SEQ ID NO: 3795052 - DNA, 23 bp, Homo sapiens
atattcctgaatgaaatatcaga

SEQ ID NO: 3795053 - DNA, 21 bp, Homo sapiens
atattcctgcagcctggaggc

SEQ ID NO: 3795054 - DNA, 21 bp, Homo sapiens
atattcctgcatttgtgaaat

SEQ ID NO: 3795055 - DNA, 17 bp, Homo sapiens
atattctggctgataaa

SEQ ID NO: 3795056 - DNA, 14 bp, Homo sapiens
atattcttatgtat

SEQ ID NO: 3795057 - DNA, 12 bp, Homo sapiens
atattctttcaa

SEQ ID NO: 3795058 - DNA, 15 bp, Homo sapiens
atattctttcaataa

SEQ ID NO: 3795059 - DNA, 12 bp, Homo sapiens
atattgcaatga

SEQ ID NO: 3795060 - DNA, 16 bp, Homo sapiens
atattgtcagatattt

SEQ ID NO: 3795061 - DNA, 19 bp, Homo sapiens
atattgttcctaagttctt

SEQ ID NO: 3795062 - DNA, 15 bp, Homo sapiens
atatttaagtattca

SEQ ID NO: 3795063 - DNA, 19 bp, Homo sapiens
atatttaagtattcaagaa

SEQ ID NO: 3795064 - DNA, 16 bp, Homo sapiens
atatttacatatgaaa

SEQ ID NO: 3795065 - DNA, 18 bp, Homo sapiens
atatttacatatgaaatt

SEQ ID NO: 3795066 - DNA, 19 bp, Homo sapiens
atatttacttcttatacat

SEQ ID NO: 3795067 - DNA, 19 bp, Homo sapiens
atatttagattgttaaaat

SEQ ID NO: 3795068 - DNA, 13 bp, Homo sapiens
atatttataactc

SEQ ID NO: 3795069 - DNA, 15 bp, Homo sapiens
atatttataactcat

SEQ ID NO: 3795070 - DNA, 22 bp, Homo sapiens
atatttataactcatcataaaa

SEQ ID NO: 3795071 - DNA, 14 bp, Homo sapiens
atatttatataatt

SEQ ID NO: 3795072 - DNA, 14 bp, Homo sapiens
atatttatatttca

SEQ ID NO: 3795073 - DNA, 14 bp, Homo sapiens
atatttattacctc

SEQ ID NO: 3795074 - DNA, 16 bp, Homo sapiens
atatttattacctctg

SEQ ID NO: 3795075 - DNA, 13 bp, Homo sapiens
atatttattgtat

SEQ ID NO: 3795076 - DNA, 23 bp, Homo sapiens
atatttattgtttatttatcagt

SEQ ID NO: 3795077 - DNA, 15 bp, Homo sapiens
atatttcgaaagctg

SEQ ID NO: 3795078 - DNA, 13 bp, Homo sapiens
atatttgttaaat

SEQ ID NO: 3795079 - DNA, 23 bp, Homo sapiens
atattttaagcattactcttgta

SEQ ID NO: 3795080 - DNA, 11 bp, Homo sapiens
atattttaatt

SEQ ID NO: 3795081 - DNA, 14 bp, Homo sapiens
atattttataattt

SEQ ID NO: 3795082 - DNA, 12 bp, Homo sapiens
atattttattca

SEQ ID NO: 3795083 - DNA, 16 bp, Homo sapiens
atattttattcaaggt

SEQ ID NO: 3795084 - DNA, 24 bp, Homo sapiens
atattttcaaattgtatctagtgc

SEQ ID NO: 3795085 - DNA, 18 bp, Homo sapiens
atattttccatgaaaatg

SEQ ID NO: 3795086 - DNA, 18 bp, Homo sapiens
atattttgtttctttaaa

SEQ ID NO: 3795087 - DNA, 13 bp, Homo sapiens
atatttttataga

SEQ ID NO: 3795088 - DNA, 15 bp, Homo sapiens
atatttttgtttgtt

SEQ ID NO: 3795089 - DNA, 16 bp, Homo sapiens
atatttttgtttgttt

SEQ ID NO: 3795090 - DNA, 20 bp, Homo sapiens
atattttttaatttgatgaa

SEQ ID NO: 3795091 - DNA, 12 bp, Homo sapiens
atattttttagt

SEQ ID NO: 3795092 - DNA, 17 bp, Homo sapiens
atatttttttaagtctt

SEQ ID NO: 3795093 - DNA, 23 bp, Homo sapiens
atcaaaatgacctcaccattttt

SEQ ID NO: 3795094 - DNA, 21 bp, Homo sapiens
atcaaatagaaccactatgaa

SEQ ID NO: 3795095 - DNA, 22 bp, Homo sapiens
atcaaatttcacgtcgtcttct

SEQ ID NO: 3795096 - DNA, 12 bp, Homo sapiens
atcaacagggca

SEQ ID NO: 3795097 - DNA, 15 bp, Homo sapiens
atcaagataaaggac

SEQ ID NO: 3795098 - DNA, 16 bp, Homo sapiens
atcaagataaaggaca

SEQ ID NO: 3795099 - DNA, 15 bp, Homo sapiens
atcaagctaataaaa

SEQ ID NO: 3795100 - DNA, 17 bp, Homo sapiens
atcaagtggcatgtgct

SEQ ID NO: 3795101 - DNA, 22 bp, Homo sapiens
atcaagttattgacaaactctc

SEQ ID NO: 3795102 - DNA, 23 bp, Homo sapiens
atcaagtttccaagcaaatgtta

SEQ ID NO: 3795103 - DNA, 15 bp, Homo sapiens
atcaataaaatgtga

SEQ ID NO: 3795104 - DNA, 16 bp, Homo sapiens
atcaataaaatgtgat

SEQ ID NO: 3795105 - DNA, 17 bp, Homo sapiens
atcaataaaatgtgatt

SEQ ID NO: 3795106 - DNA, 13 bp, Homo sapiens
atcaatgttcatt

SEQ ID NO: 3795107 - DNA, 18 bp, Homo sapiens
atcaatgttcattgtaat

SEQ ID NO: 3795108 - DNA, 19 bp, Homo sapiens
atcaatgtttcttctaggt

SEQ ID NO: 3795109 - DNA, 13 bp, Homo sapiens
atcaattaaatgt

SEQ ID NO: 3795110 - DNA, 21 bp, Homo sapiens
atgaggcaatgtcaggaacag

SEQ ID NO: 3795111 - DNA, 18 bp, Homo sapiens
atgaggcctcagtggact

SEQ ID NO: 3795112 - DNA, 16 bp, Homo sapiens
atgagggatcacaggg

SEQ ID NO: 3795113 - DNA, 16 bp, Homo sapiens
atgaggtcagagcctg

SEQ ID NO: 3795114 - DNA, 22 bp, Homo sapiens
atgaggtcagagcctgcagtta

SEQ ID NO: 3795115 - DNA, 15 bp, Homo sapiens
atgaggtcccaggca

SEQ ID NO: 3795116 - DNA, 17 bp, Homo sapiens
atgaggtcccaggcaga

SEQ ID NO: 3795117 - DNA, 17 bp, Homo sapiens
atgaggtgctgggaggg

SEQ ID NO: 3795118 - DNA, 18 bp, Homo sapiens
atgaggtgctgggaggga

SEQ ID NO: 3795119 - DNA, 19 bp, Homo sapiens
atgagtgtaacaagaaagg

SEQ ID NO: 3795120 - DNA, 21 bp, Homo sapiens
atgagtgtaacaagaaaggag

SEQ ID NO: 3795121 - DNA, 22 bp, Homo sapiens
atgagtgtaacaagaaaggaga

SEQ ID NO: 3795122 - DNA, 18 bp, Homo sapiens
atgatattgcatatgcat

SEQ ID NO: 3795123 - DNA, 23 bp, Homo sapiens
atgatcacggctcactgcagcct

SEQ ID NO: 3795124 - DNA, 20 bp, Homo sapiens
atgatcagctgtttgtcata

SEQ ID NO: 3795125 - DNA, 22 bp, Homo sapiens
atgatccatgagtttgccctgg

SEQ ID NO: 3795126 - DNA, 12 bp, Homo sapiens
atgatctccctg

SEQ ID NO: 3795127 - DNA, 15 bp, Homo sapiens
atgatctccctgccg

SEQ ID NO: 3795128 - DNA, 14 bp, Homo sapiens
atgatcttgtgaca

SEQ ID NO: 3795129 - DNA, 19 bp, Homo sapiens
atgatctttgcagacaggc

SEQ ID NO: 3795130 - DNA, 15 bp, Homo sapiens
atgatcttttcaagt

SEQ ID NO: 3795131 - DNA, 17 bp, Homo sapiens
atgatgacgacgacaac

SEQ ID NO: 3795132 - DNA, 15 bp, Homo sapiens
atgatggagtcaggt

SEQ ID NO: 3795133 - DNA, 19 bp, Homo sapiens
atgatggcaattttgtaac

SEQ ID NO: 3795134 - DNA, 21 bp, Homo sapiens
atgattaaccacttcagctga

SEQ ID NO: 3795135 - DNA, 14 bp, Homo sapiens
atgattagcaagtt

SEQ ID NO: 3795136 - DNA, 14 bp, Homo sapiens
atgatttcatttca

SEQ ID NO: 3795137 - DNA, 14 bp, Homo sapiens
atgattttacttag

SEQ ID NO: 3795138 - DNA, 21 bp, Homo sapiens
atgattttacttagcaatgtt

SEQ ID NO: 3795139 - DNA, 14 bp, Homo sapiens
atgcaaagaggcaa

SEQ ID NO: 3795140 - DNA, 16 bp, Homo sapiens
atgcaacaacatgtat

SEQ ID NO: 3795141 - DNA, 14 bp, Homo sapiens
atgcaaggaaggaa

SEQ ID NO: 3795142 - DNA, 20 bp, Homo sapiens
atgcaaggaaggaaagaaag

SEQ ID NO: 3795143 - DNA, 21 bp, Homo sapiens
atgcaaggcactgtactaggc

SEQ ID NO: 3795144 - DNA, 16 bp, Homo sapiens
atgcaataaataacag

SEQ ID NO: 3795145 - DNA, 13 bp, Homo sapiens
atgcaatatgtat

SEQ ID NO: 3795146 - DNA, 14 bp, Homo sapiens
atgcaatatgtatt

SEQ ID NO: 3795147 - DNA, 13 bp, Homo sapiens
atgcaatgtgcta

SEQ ID NO: 3795148 - DNA, 17 bp, Homo sapiens
atgcaatgtgctactga

SEQ ID NO: 3795149 - DNA, 17 bp, Homo sapiens
atgcaatttcctttttt

SEQ ID NO: 3795150 - DNA, 20 bp, Homo sapiens
atgcacactagcctctccag

SEQ ID NO: 3795151 - DNA, 14 bp, Homo sapiens
atgcaccagccctt

SEQ ID NO: 3795152 - DNA, 15 bp, Homo sapiens
atgcagatgccagag

SEQ ID NO: 3795153 - DNA, 11 bp, Homo sapiens
atgcagcagct

SEQ ID NO: 3795154 - DNA, 19 bp, Homo sapiens
atgcagcagcttgctgcac

SEQ ID NO: 3795155 - DNA, 15 bp, Homo sapiens
atgcagcccatgccc

SEQ ID NO: 3795156 - DNA, 17 bp, Homo sapiens
atgcagtgcctttcttc

SEQ ID NO: 3795157 - DNA, 15 bp, Homo sapiens
atgcataaagtcagt

SEQ ID NO: 3795158 - DNA, 14 bp, Homo sapiens
atgcataaatgcat

SEQ ID NO: 3795159 - DNA, 23 bp, Homo sapiens
atgcatacatacacatatataca

SEQ ID NO: 3795160 - DNA, 17 bp, Homo sapiens
atgcatccattcctcag

SEQ ID NO: 3795161 - DNA, 16 bp, Homo sapiens
atgcattgttgaggtg

SEQ ID NO: 3795162 - DNA, 13 bp, Homo sapiens
atgcattttgcag

SEQ ID NO: 3795163 - DNA, 22 bp, Homo sapiens
atgccaattagcaattgactgt

SEQ ID NO: 3795164 - DNA, 18 bp, Homo sapiens
atgccacacagagtggtc

SEQ ID NO: 3795165 - DNA, 20 bp, Homo sapiens
atgccaccctgttttcagct

SEQ ID NO: 3795166 - DNA, 18 bp, Homo sapiens
atgccatggacagaagaa

SEQ ID NO: 3795167 - DNA, 14 bp, Homo sapiens
atgccatttgttta

SEQ ID NO: 3795168 - DNA, 16 bp, Homo sapiens
atgccatttgtttatt

SEQ ID NO: 3795169 - DNA, 17 bp, Homo sapiens
atgcccaagccctgaga

SEQ ID NO: 3795170 - DNA, 19 bp, Homo sapiens
atgcccacctgcccatcac

SEQ ID NO: 3795171 - DNA, 21 bp, Homo sapiens
atgcccacctgcccatcacag

SEQ ID NO: 3795172 - DNA, 20 bp, Homo sapiens
atgcccagagggcccaggca

SEQ ID NO: 3795173 - DNA, 16 bp, Homo sapiens
atgcccagctcagagg

SEQ ID NO: 3795174 - DNA, 12 bp, Homo sapiens
atgcctccaccg

SEQ ID NO: 3795175 - DNA, 21 bp, Homo sapiens
atgcctccaccgctgcctaag

SEQ ID NO: 3795176 - DNA, 14 bp, Homo sapiens
atgcctccctgacc

SEQ ID NO: 3795177 - DNA, 15 bp, Homo sapiens
atgcctggtggcagc

SEQ ID NO: 3795178 - DNA, 16 bp, Homo sapiens
atgcctggtggcagct

SEQ ID NO: 3795179 - DNA, 17 bp, Homo sapiens
atgcctggtggcagctg

SEQ ID NO: 3795180 - DNA, 16 bp, Homo sapiens
atgcctgtccagcctg

SEQ ID NO: 3795181 - DNA, 18 bp, Homo sapiens
atgccttactttgtatga

SEQ ID NO: 3795182 - DNA, 23 bp, Homo sapiens
atgccttactttgtatgatattc

SEQ ID NO: 3795183 - DNA, 19 bp, Homo sapiens
atgccttccagcaccctgc

SEQ ID NO: 3795184 - DNA, 18 bp, Homo sapiens
atgcggcaagaaggaatt

SEQ ID NO: 3795185 - DNA, 20 bp, Homo sapiens
atgcggcccaggatggcttt

SEQ ID NO: 3795186 - DNA, 21 bp, Homo sapiens
atgcgtacgtttcctgagaag

SEQ ID NO: 3795187 - DNA, 19 bp, Homo sapiens
atgctaccatgcctctcca

SEQ ID NO: 3795188 - DNA, 21 bp, Homo sapiens
atgctactacaaaaaagttgt

SEQ ID NO: 3795189 - DNA, 16 bp, Homo sapiens
atgctcacgctcccaa

SEQ ID NO: 3795190 - DNA, 19 bp, Homo sapiens
atgctcatggtccccatgg

SEQ ID NO: 3795191 - DNA, 19 bp, Homo sapiens
atgctccagccaacccctg

SEQ ID NO: 3795192 - DNA, 18 bp, Homo sapiens
atgctcccccatcctccc

SEQ ID NO: 3795193 - DNA, 21 bp, Homo sapiens
atgctcccccatcctcccctt

SEQ ID NO: 3795194 - DNA, 18 bp, Homo sapiens
atgctccctcccctgccc

SEQ ID NO: 3795195 - DNA, 20 bp, Homo sapiens
atgctccctcccctgccctg

SEQ ID NO: 3795196 - DNA, 22 bp, Homo sapiens
atgctccctcccctgccctggt

SEQ ID NO: 3795197 - DNA, 14 bp, Homo sapiens
atgctcctggccca

SEQ ID NO: 3795198 - DNA, 18 bp, Homo sapiens
atgctctgcatgttacat

SEQ ID NO: 3795199 - DNA, 23 bp, Homo sapiens
atgctctgtgcgagggttactat

SEQ ID NO: 3795200 - DNA, 19 bp, Homo sapiens
atgctgactgtactcctcc

SEQ ID NO: 3795201 - DNA, 21 bp, Homo sapiens
atgctgactgtactcctccca

SEQ ID NO: 3795202 - DNA, 13 bp, Homo sapiens
atgctgcctgagt

SEQ ID NO: 3795203 - DNA, 18 bp, Homo sapiens
atgctggacaggtctggg

SEQ ID NO: 3795204 - DNA, 19 bp, Homo sapiens
atgctggctgttggctggg

SEQ ID NO: 3795205 - DNA, 20 bp, Homo sapiens
atgctggctgttggctgggg

SEQ ID NO: 3795206 - DNA, 22 bp, Homo sapiens
atgctggctgttggctgggggc

SEQ ID NO: 3795207 - DNA, 21 bp, Homo sapiens
atgctggttttcctaaatgca

SEQ ID NO: 3795208 - DNA, 19 bp, Homo sapiens
atgctgtattcttctttgg

SEQ ID NO: 3795209 - DNA, 18 bp, Homo sapiens
atgctgtgctatgaattt

SEQ ID NO: 3795210 - DNA, 18 bp, Homo sapiens
atgctgttgcctcatcta

SEQ ID NO: 3795211 - DNA, 14 bp, Homo sapiens
atgcttattttaaa

SEQ ID NO: 3795212 - DNA, 20 bp, Homo sapiens
atgcttcaaactaacacatt

SEQ ID NO: 3795213 - DNA, 18 bp, Homo sapiens
atgcttcatgaaaatcct

SEQ ID NO: 3795214 - DNA, 11 bp, Homo sapiens
atgcttgccta

SEQ ID NO: 3795215 - DNA, 21 bp, Homo sapiens
atgcttggaatatctgctgta

SEQ ID NO: 3795216 - DNA, 18 bp, Homo sapiens
atgcttgtaacaagaaaa

SEQ ID NO: 3795217 - DNA, 22 bp, Homo sapiens
atgctttctgaactcgcttctc

SEQ ID NO: 3795218 - DNA, 14 bp, Homo sapiens
atggaaaaggaaga

SEQ ID NO: 3795219 - DNA, 23 bp, Homo sapiens
atggaaacaaagtggaaggaaag

SEQ ID NO: 3795220 - DNA, 17 bp, Homo sapiens
atggaaatattatgcaa

SEQ ID NO: 3795221 - DNA, 19 bp, Homo sapiens
atggaaccgcaggaagctg

SEQ ID NO: 3795222 - DNA, 16 bp, Homo sapiens
atgtctgtggccttgt

SEQ ID NO: 3795223 - DNA, 21 bp, Homo sapiens
atgtctgtggccttgttctct

SEQ ID NO: 3795224 - DNA, 18 bp, Homo sapiens
atgtcttgtaagcaaaag

SEQ ID NO: 3795225 - DNA, 18 bp, Homo sapiens
atgtcttgttaatattct

SEQ ID NO: 3795226 - DNA, 20 bp, Homo sapiens
atgtcttgttaatattcttt

SEQ ID NO: 3795227 - DNA, 23 bp, Homo sapiens
atgtctttgttggaaaagaatac

SEQ ID NO: 3795228 - DNA, 16 bp, Homo sapiens
atgtctttttaagctt

SEQ ID NO: 3795229 - DNA, 18 bp, Homo sapiens
atgtctttttaagcttat

SEQ ID NO: 3795230 - DNA, 20 bp, Homo sapiens
atgtctttttaagcttattt

SEQ ID NO: 3795231 - DNA, 14 bp, Homo sapiens
atgtgaactagctg

SEQ ID NO: 3795232 - DNA, 19 bp, Homo sapiens
atgtgaactagctggaatt

SEQ ID NO: 3795233 - DNA, 21 bp, Homo sapiens
atgtgaatcagaccctacccc

SEQ ID NO: 3795234 - DNA, 20 bp, Homo sapiens
atgtgaatgatctctctgaa

SEQ ID NO: 3795235 - DNA, 18 bp, Homo sapiens
atgtgacaattttgtaca

SEQ ID NO: 3795236 - DNA, 21 bp, Homo sapiens
atgtgagccaccgctgccagc

SEQ ID NO: 3795237 - DNA, 14 bp, Homo sapiens
atgtgatttttctg

SEQ ID NO: 3795238 - DNA, 15 bp, Homo sapiens
atgtgcaaaaatttt

SEQ ID NO: 3795239 - DNA, 21 bp, Homo sapiens
atgtgcatttttgtgaaatga

SEQ ID NO: 3795240 - DNA, 22 bp, Homo sapiens
atgtgccaggtttttggtctga

SEQ ID NO: 3795241 - DNA, 15 bp, Homo sapiens
atgtgcctgcaccag

SEQ ID NO: 3795242 - DNA, 19 bp, Homo sapiens
atgtgcctgcaccaggaga

SEQ ID NO: 3795243 - DNA, 20 bp, Homo sapiens
atgtgctactgattgtttca

SEQ ID NO: 3795244 - DNA, 17 bp, Homo sapiens
atgtggaatataaagat

SEQ ID NO: 3795245 - DNA, 16 bp, Homo sapiens
atgtggcagctgtctc

SEQ ID NO: 3795246 - DNA, 16 bp, Homo sapiens
atgtggcatttgtgat

SEQ ID NO: 3795247 - DNA, 20 bp, Homo sapiens
atgtggcccctgaacaagaa

SEQ ID NO: 3795248 - DNA, 14 bp, Homo sapiens
atgtggccctggcc

SEQ ID NO: 3795249 - DNA, 15 bp, Homo sapiens
atgtggccctggcct

SEQ ID NO: 3795250 - DNA, 18 bp, Homo sapiens
atgtgtatcggatgcttt

SEQ ID NO: 3795251 - DNA, 19 bp, Homo sapiens
atgtgtgaggagctgctgg

SEQ ID NO: 3795252 - DNA, 15 bp, Homo sapiens
atgtgtgcgagtgtg

SEQ ID NO: 3795253 - DNA, 14 bp, Homo sapiens
atgtgtgtatatgt

SEQ ID NO: 3795254 - DNA, 16 bp, Homo sapiens
atgtgtgttttgctaa

SEQ ID NO: 3795255 - DNA, 23 bp, Homo sapiens
atgtgtgttttgctaaaggaaaa

SEQ ID NO: 3795256 - DNA, 14 bp, Homo sapiens
atgtgttgaaaaaa

SEQ ID NO: 3795257 - DNA, 20 bp, Homo sapiens
atgttaaatcccattcataa

SEQ ID NO: 3795258 - DNA, 23 bp, Homo sapiens
atgttaaccagaataaagttctg

SEQ ID NO: 3795259 - DNA, 18 bp, Homo sapiens
atgttaacctcagtgtca

SEQ ID NO: 3795260 - DNA, 17 bp, Homo sapiens
atgttacactaagggtg

SEQ ID NO: 3795261 - DNA, 14 bp, Homo sapiens
atgttacattgttt

SEQ ID NO: 3795262 - DNA, 21 bp, Homo sapiens
atgttacctcctataaactta

SEQ ID NO: 3795263 - DNA, 13 bp, Homo sapiens
atgttactgatca

SEQ ID NO: 3795264 - DNA, 18 bp, Homo sapiens
atgttactgatcatgcat

SEQ ID NO: 3795265 - DNA, 18 bp, Homo sapiens
atgttaggaaaatttcac

SEQ ID NO: 3795266 - DNA, 19 bp, Homo sapiens
atgttaggaaaatttcaca

SEQ ID NO: 3795267 - DNA, 20 bp, Homo sapiens
atgttaggctgggcccagag

SEQ ID NO: 3795268 - DNA, 16 bp, Homo sapiens
atgttatgataaaaaa

SEQ ID NO: 3795269 - DNA, 17 bp, Homo sapiens
atgttattttttaatta

SEQ ID NO: 3795270 - DNA, 21 bp, Homo sapiens
atgttcatcatcctaagctat

SEQ ID NO: 3795271 - DNA, 14 bp, Homo sapiens
atgttcccttctcc

SEQ ID NO: 3795272 - DNA, 21 bp, Homo sapiens
atgttctagtctgctttggta

SEQ ID NO: 3795273 - DNA, 17 bp, Homo sapiens
atgttctctgaggacac

SEQ ID NO: 3795274 - DNA, 16 bp, Homo sapiens
atgttctgacattaac

SEQ ID NO: 3795275 - DNA, 19 bp, Homo sapiens
atgttctgacattaacagt

SEQ ID NO: 3795276 - DNA, 12 bp, Homo sapiens
atgttctgggac

SEQ ID NO: 3795277 - DNA, 15 bp, Homo sapiens
atgttctgggacaca

SEQ ID NO: 3795278 - DNA, 12 bp, Homo sapiens
atgttgaatatt

SEQ ID NO: 3795279 - DNA, 22 bp, Homo sapiens
atgttgaatgcccacaggcaaa

SEQ ID NO: 3795280 - DNA, 18 bp, Homo sapiens
atgttgagccaggcctgg

SEQ ID NO: 3795281 - DNA, 17 bp, Homo sapiens
atgttgcccaggcaggt

SEQ ID NO: 3795282 - DNA, 20 bp, Homo sapiens
atgttgcccaggcaggtctt

SEQ ID NO: 3795283 - DNA, 13 bp, Homo sapiens
atgttggccaggc

SEQ ID NO: 3795284 - DNA, 15 bp, Homo sapiens
atgttggtatttatc

SEQ ID NO: 3795285 - DNA, 16 bp, Homo sapiens
atgttgtgttctaata

SEQ ID NO: 3795286 - DNA, 12 bp, Homo sapiens
atgttgttattt

SEQ ID NO: 3795287 - DNA, 13 bp, Homo sapiens
atgttgttattta

SEQ ID NO: 3795288 - DNA, 16 bp, Homo sapiens
atgttgtttaacataa

SEQ ID NO: 3795289 - DNA, 13 bp, Homo sapiens
atgtttaagattt

SEQ ID NO: 3795290 - DNA, 14 bp, Homo sapiens
atgtttaagattta

SEQ ID NO: 3795291 - DNA, 16 bp, Homo sapiens
atgtttacactctttg

SEQ ID NO: 3795292 - DNA, 21 bp, Homo sapiens
atgtttacactctttgtaaga

SEQ ID NO: 3795293 - DNA, 16 bp, Homo sapiens
atgtttatgagccaga

SEQ ID NO: 3795294 - DNA, 20 bp, Homo sapiens
atgtttatgagccagacaaa

SEQ ID NO: 3795295 - DNA, 18 bp, Homo sapiens
atgtttatgcaaggaagg

SEQ ID NO: 3795296 - DNA, 13 bp, Homo sapiens
atgtttatttata

SEQ ID NO: 3795297 - DNA, 22 bp, Homo sapiens
atgtttcgctgatatatgtgtt

SEQ ID NO: 3795298 - DNA, 22 bp, Homo sapiens
atgtttcttctaggttctaaaa

SEQ ID NO: 3795299 - DNA, 18 bp, Homo sapiens
atgtttgtggcctcagaa

SEQ ID NO: 3795300 - DNA, 18 bp, Homo sapiens
atgttttaagaggcaggg

SEQ ID NO: 3795301 - DNA, 15 bp, Homo sapiens
atgttttaaggcttc

SEQ ID NO: 3795302 - DNA, 16 bp, Homo sapiens
atgttttgtttctgaa

SEQ ID NO: 3795303 - DNA, 13 bp, Homo sapiens
attaaaaatggta

SEQ ID NO: 3795304 - DNA, 14 bp, Homo sapiens
attaaaaatggtaa

SEQ ID NO: 3795305 - DNA, 17 bp, Homo sapiens
attaaaaatggtaaaat

SEQ ID NO: 3795306 - DNA, 18 bp, Homo sapiens
attaaaaatggtaaaatt

SEQ ID NO: 3795307 - DNA, 21 bp, Homo sapiens
attaaaaatggtaaaattgca

SEQ ID NO: 3795308 - DNA, 23 bp, Homo sapiens
attaaaaatggtaaaattgcatg

SEQ ID NO: 3795309 - DNA, 20 bp, Homo sapiens
attaaaaattggctagttga

SEQ ID NO: 3795310 - DNA, 18 bp, Homo sapiens
attaaaacaatattgttt

SEQ ID NO: 3795311 - DNA, 11 bp, Homo sapiens
attaaaatctt

SEQ ID NO: 3795312 - DNA, 12 bp, Homo sapiens
attaaaatctta

SEQ ID NO: 3795313 - DNA, 15 bp, Homo sapiens
attaaaatcttaaac

SEQ ID NO: 3795314 - DNA, 13 bp, Homo sapiens
attaaagacagag

SEQ ID NO: 3795315 - DNA, 23 bp, Homo sapiens
attaaagcagtcacttttcctgt

SEQ ID NO: 3795316 - DNA, 20 bp, Homo sapiens
attaaagcatttactttgaa

SEQ ID NO: 3795317 - DNA, 17 bp, Homo sapiens
attaaagctaaagtatc

SEQ ID NO: 3795318 - DNA, 15 bp, Homo sapiens
attaaatataatatg

SEQ ID NO: 3795319 - DNA, 19 bp, Homo sapiens
attaaatatatgtatgtaa

SEQ ID NO: 3795320 - DNA, 21 bp, Homo sapiens
attaaatatatgtatgtaaaa

SEQ ID NO: 3795321 - DNA, 15 bp, Homo sapiens
attaaatttaattag

SEQ ID NO: 3795322 - DNA, 13 bp, Homo sapiens
attaaatttttcc

SEQ ID NO: 3795323 - DNA, 12 bp, Homo sapiens
attaacagtttt

SEQ ID NO: 3795324 - DNA, 22 bp, Homo sapiens
attaacagttttccatgaaaac

SEQ ID NO: 3795325 - DNA, 14 bp, Homo sapiens
attaacatataata

SEQ ID NO: 3795326 - DNA, 18 bp, Homo sapiens
attaaccacttcagctga

SEQ ID NO: 3795327 - DNA, 20 bp, Homo sapiens
attaaccacttcagctgact

SEQ ID NO: 3795328 - DNA, 17 bp, Homo sapiens
attaactaatctattgg

SEQ ID NO: 3795329 - DNA, 20 bp, Homo sapiens
attaagatggattctcagat

SEQ ID NO: 3795330 - DNA, 24 bp, Homo sapiens
attaagatggattctcagatattt

SEQ ID NO: 3795331 - DNA, 14 bp, Homo sapiens
attaagcatcacaa

SEQ ID NO: 3795332 - DNA, 15 bp, Homo sapiens
attaagccttccaca

SEQ ID NO: 3795333 - DNA, 19 bp, Homo sapiens
attaaggcaactgaacaaa

SEQ ID NO: 3795334 - DNA, 16 bp, Homo sapiens
attaaggtctctcttt

SEQ ID NO: 3795335 - DNA, 17 bp, Homo sapiens
atttccaaattcacaag

SEQ ID NO: 3795336 - DNA, 16 bp, Homo sapiens
atttccaagagctgag

SEQ ID NO: 3795337 - DNA, 15 bp, Homo sapiens
atttcccagggttaa

SEQ ID NO: 3795338 - DNA, 22 bp, Homo sapiens
atttcccagtaattattttctt

SEQ ID NO: 3795339 - DNA, 15 bp, Homo sapiens
atttccccagacctg

SEQ ID NO: 3795340 - DNA, 20 bp, Homo sapiens
atttcctatgtaactgcatt

SEQ ID NO: 3795341 - DNA, 14 bp, Homo sapiens
atttcctgtgtctt

SEQ ID NO: 3795342 - DNA, 18 bp, Homo sapiens
atttccttaaactgtgtg

SEQ ID NO: 3795343 - DNA, 19 bp, Homo sapiens
atttccttttttgttatta

SEQ ID NO: 3795344 - DNA, 15 bp, Homo sapiens
atttctaactctgat

SEQ ID NO: 3795345 - DNA, 18 bp, Homo sapiens
atttctaactctgatgta

SEQ ID NO: 3795346 - DNA, 17 bp, Homo sapiens
atttctaccatttcaga

SEQ ID NO: 3795347 - DNA, 23 bp, Homo sapiens
atttctagaacatccctgccagc

SEQ ID NO: 3795348 - DNA, 13 bp, Homo sapiens
atttctatcccaa

SEQ ID NO: 3795349 - DNA, 17 bp, Homo sapiens
atttctctacagatgtc

SEQ ID NO: 3795350 - DNA, 13 bp, Homo sapiens
atttctctctcca

SEQ ID NO: 3795351 - DNA, 18 bp, Homo sapiens
atttctgatatagaattg

SEQ ID NO: 3795352 - DNA, 13 bp, Homo sapiens
atttctgatttta

SEQ ID NO: 3795353 - DNA, 15 bp, Homo sapiens
atttctggaatggaa

SEQ ID NO: 3795354 - DNA, 16 bp, Homo sapiens
atttctgtgggagaat

SEQ ID NO: 3795355 - DNA, 13 bp, Homo sapiens
atttcttctcaaa

SEQ ID NO: 3795356 - DNA, 16 bp, Homo sapiens
atttcttgggccctcc

SEQ ID NO: 3795357 - DNA, 13 bp, Homo sapiens
atttcttgtttgt

SEQ ID NO: 3795358 - DNA, 14 bp, Homo sapiens
atttcttgtttgtt

SEQ ID NO: 3795359 - DNA, 17 bp, Homo sapiens
atttgaaccaaaacatt

SEQ ID NO: 3795360 - DNA, 20 bp, Homo sapiens
atttgaaccaaaacattccg

SEQ ID NO: 3795361 - DNA, 21 bp, Homo sapiens
atttgaagacaaaaatactct

SEQ ID NO: 3795362 - DNA, 16 bp, Homo sapiens
atttgaatctcaattt

SEQ ID NO: 3795363 - DNA, 14 bp, Homo sapiens
atttgaatgaaaaa

SEQ ID NO: 3795364 - DNA, 15 bp, Homo sapiens
atttgaatgaaaaat

SEQ ID NO: 3795365 - DNA, 18 bp, Homo sapiens
atttgaatgggtccattt

SEQ ID NO: 3795366 - DNA, 16 bp, Homo sapiens
atttgagcagggctca

SEQ ID NO: 3795367 - DNA, 17 bp, Homo sapiens
atttgagcagggctcag

SEQ ID NO: 3795368 - DNA, 22 bp, Homo sapiens
atttgaggacaaccattccaga

SEQ ID NO: 3795369 - DNA, 14 bp, Homo sapiens
atttgatgctaaat

SEQ ID NO: 3795370 - DNA, 19 bp, Homo sapiens
atttgcagagacaggacct

SEQ ID NO: 3795371 - DNA, 21 bp, Homo sapiens
atttgcccatttacacttttg

SEQ ID NO: 3795372 - DNA, 15 bp, Homo sapiens
atttgcgaatggttc

SEQ ID NO: 3795373 - DNA, 17 bp, Homo sapiens
atttgctatcaaaataa

SEQ ID NO: 3795374 - DNA, 18 bp, Homo sapiens
atttgcttatttaataaa

SEQ ID NO: 3795375 - DNA, 22 bp, Homo sapiens
atttggggttgcatcagaaatg

SEQ ID NO: 3795376 - DNA, 21 bp, Homo sapiens
atttggtaaattagtatttat

SEQ ID NO: 3795377 - DNA, 15 bp, Homo sapiens
atttggtgaatttga

SEQ ID NO: 3795378 - DNA, 19 bp, Homo sapiens
atttgtacatatgtaaaat

SEQ ID NO: 3795379 - DNA, 18 bp, Homo sapiens
atttgtactacagttctt

SEQ ID NO: 3795380 - DNA, 20 bp, Homo sapiens
atttgtagaagggttatatt

SEQ ID NO: 3795381 - DNA, 14 bp, Homo sapiens
atttgtataaaatg

SEQ ID NO: 3795382 - DNA, 15 bp, Homo sapiens
atttgtatatataca

SEQ ID NO: 3795383 - DNA, 18 bp, Homo sapiens
atttgtatatatacataa

SEQ ID NO: 3795384 - DNA, 18 bp, Homo sapiens
atttgtatgttgtgaaga

SEQ ID NO: 3795385 - DNA, 14 bp, Homo sapiens
atttgtcattttga

SEQ ID NO: 3795386 - DNA, 16 bp, Homo sapiens
atttgtcattttgaag

SEQ ID NO: 3795387 - DNA, 23 bp, Homo sapiens
atttgtgaaatgatggtgaaagt

SEQ ID NO: 3795388 - DNA, 17 bp, Homo sapiens
atttgtgtaataaagtg

SEQ ID NO: 3795389 - DNA, 18 bp, Homo sapiens
atttgtgtaataaagtgt

SEQ ID NO: 3795390 - DNA, 21 bp, Homo sapiens
atttgtgtaataaagtgtttt

SEQ ID NO: 3795391 - DNA, 22 bp, Homo sapiens
atttgtgtaataaagtgttttc

SEQ ID NO: 3795392 - DNA, 14 bp, Homo sapiens
atttgtgtgtgtgc

SEQ ID NO: 3795393 - DNA, 15 bp, Homo sapiens
atttgtgtgtgtgca

SEQ ID NO: 3795394 - DNA, 15 bp, Homo sapiens
atttgttaaatattt

SEQ ID NO: 3795395 - DNA, 17 bp, Homo sapiens
atttgttaaatatttac

SEQ ID NO: 3795396 - DNA, 17 bp, Homo sapiens
atttgttattcttaaga

SEQ ID NO: 3795397 - DNA, 13 bp, Homo sapiens
atttgttggaatg

SEQ ID NO: 3795398 - DNA, 14 bp, Homo sapiens
atttgttggaatga

SEQ ID NO: 3795399 - DNA, 23 bp, Homo sapiens
atttgtttatttttatatagctt

SEQ ID NO: 3795400 - DNA, 22 bp, Homo sapiens
attttaaaaatacagatagata

SEQ ID NO: 3795401 - DNA, 22 bp, Homo sapiens
attttaaagttaaacattttta

SEQ ID NO: 3795402 - DNA, 20 bp, Homo sapiens
attttaaataaaagtgatca

SEQ ID NO: 3795403 - DNA, 21 bp, Homo sapiens
attttaaataaaagtgatcaa

SEQ ID NO: 3795404 - DNA, 13 bp, Homo sapiens
attttaaattata

SEQ ID NO: 3795405 - DNA, 20 bp, Homo sapiens
attttaaattataaggactg

SEQ ID NO: 3795406 - DNA, 17 bp, Homo sapiens
attttaacacacataaa

SEQ ID NO: 3795407 - DNA, 18 bp, Homo sapiens
attttaacacacataaag

SEQ ID NO: 3795408 - DNA, 20 bp, Homo sapiens
attttaacacacataaagga

SEQ ID NO: 3795409 - DNA, 17 bp, Homo sapiens
attttaactttatcaca

SEQ ID NO: 3795410 - DNA, 15 bp, Homo sapiens
attttaagattcctt

SEQ ID NO: 3795411 - DNA, 17 bp, Homo sapiens
attttaagattcctttt

SEQ ID NO: 3795412 - DNA, 23 bp, Homo sapiens
attttaagcattactcttgtaag

SEQ ID NO: 3795413 - DNA, 12 bp, Homo sapiens
attttaagtgct

SEQ ID NO: 3795414 - DNA, 20 bp, Homo sapiens
attttaattaggttaactat

SEQ ID NO: 3795415 - DNA, 23 bp, Homo sapiens
attttaattattattcttcataa

SEQ ID NO: 3795416 - DNA, 18 bp, Homo sapiens
attttaatttatgagttt

SEQ ID NO: 3795417 - DNA, 15 bp, Homo sapiens
attttacaaaagatg

SEQ ID NO: 3795418 - DNA, 20 bp, Homo sapiens
attttacaataggtgcttat

SEQ ID NO: 3795419 - DNA, 18 bp, Homo sapiens
attttaccaagttatata

SEQ ID NO: 3795420 - DNA, 23 bp, Homo sapiens
attttaccaagttatataaagag

SEQ ID NO: 3795421 - DNA, 17 bp, Homo sapiens
attttactactgtggaa

SEQ ID NO: 3795422 - DNA, 13 bp, Homo sapiens
attttactgtctt

SEQ ID NO: 3795423 - DNA, 20 bp, Homo sapiens
attttagacaaatctaaggg

SEQ ID NO: 3795424 - DNA, 22 bp, Homo sapiens
attttagtatatttatataatt

SEQ ID NO: 3795425 - DNA, 17 bp, Homo sapiens
attttataaaattaaag

SEQ ID NO: 3795426 - DNA, 21 bp, Homo sapiens
attttataaaattaaagaaaa

SEQ ID NO: 3795427 - DNA, 15 bp, Homo sapiens
attttatacattaac

SEQ ID NO: 3795428 - DNA, 18 bp, Homo sapiens
attttatagctcagttta

SEQ ID NO: 3795429 - DNA, 19 bp, Homo sapiens
attttatataataaagtat

SEQ ID NO: 3795430 - DNA, 19 bp, Homo sapiens
attttatattagaagtgtt

SEQ ID NO: 3795431 - DNA, 20 bp, Homo sapiens
attttatattagaagtgtta

SEQ ID NO: 3795432 - DNA, 20 bp, Homo sapiens
attttatgccttttatttct

SEQ ID NO: 3795433 - DNA, 17 bp, Homo sapiens
attttatttttttctac

SEQ ID NO: 3795434 - DNA, 22 bp, Homo sapiens
attttcaagcatctcctgagga

SEQ ID NO: 3795435 - DNA, 20 bp, Homo sapiens
attttcaattcaaaaatgta

SEQ ID NO: 3795436 - DNA, 16 bp, Homo sapiens
attttcaccccaccct

SEQ ID NO: 3795437 - DNA, 13 bp, Homo sapiens
attttcactgtag

SEQ ID NO: 3795438 - DNA, 17 bp, Homo sapiens
attttcagaatctgaat

SEQ ID NO: 3795439 - DNA, 11 bp, Homo sapiens
attttcagtat

SEQ ID NO: 3795440 - DNA, 18 bp, Homo sapiens
attttcatatgcttcaaa

SEQ ID NO: 3795441 - DNA, 17 bp, Homo sapiens
attttcatgtatatgtg

SEQ ID NO: 3795442 - DNA, 20 bp, Homo sapiens
attttccacaagattcccag

SEQ ID NO: 3795443 - DNA, 21 bp, Homo sapiens
attttccatttttatttcaaa

SEQ ID NO: 3795444 - DNA, 15 bp, Homo sapiens
attttctgaaactaa

SEQ ID NO: 3795445 - DNA, 20 bp, Homo sapiens
attttctggtagatagaaat

SEQ ID NO: 3795446 - DNA, 17 bp, Homo sapiens
attttcttcagttggtg

SEQ ID NO: 3795447 - DNA, 21 bp, Homo sapiens
attttcttcatgcaatgacat

SEQ ID NO: 3795448 - DNA, 15 bp, Homo sapiens
caaggactgcaggga

SEQ ID NO: 3795449 - DNA, 16 bp, Homo sapiens
caaggacttgaaagca

SEQ ID NO: 3795450 - DNA, 23 bp, Homo sapiens
caaggagatgaagcaaacacatt

SEQ ID NO: 3795451 - DNA, 22 bp, Homo sapiens
caaggagctgagaatagaagga

SEQ ID NO: 3795452 - DNA, 23 bp, Homo sapiens
caaggagctgagaatagaaggaa

SEQ ID NO: 3795453 - DNA, 21 bp, Homo sapiens
caaggcaaggggtgcctggga

SEQ ID NO: 3795454 - DNA, 14 bp, Homo sapiens
caaggccagagtgg

SEQ ID NO: 3795455 - DNA, 18 bp, Homo sapiens
caaggccagagtggcctg

SEQ ID NO: 3795456 - DNA, 15 bp, Homo sapiens
caaggccccagagac

SEQ ID NO: 3795457 - DNA, 21 bp, Homo sapiens
caaggccccagagactcagag

SEQ ID NO: 3795458 - DNA, 17 bp, Homo sapiens
caaggcctgtccctggc

SEQ ID NO: 3795459 - DNA, 18 bp, Homo sapiens
caaggcctgtccctggcc

SEQ ID NO: 3795460 - DNA, 19 bp, Homo sapiens
caaggcgggagcatctctt

SEQ ID NO: 3795461 - DNA, 18 bp, Homo sapiens
caaggctgaccaagagag

SEQ ID NO: 3795462 - DNA, 21 bp, Homo sapiens
caaggctgaccaagagagaaa

SEQ ID NO: 3795463 - DNA, 17 bp, Homo sapiens
caaggctgcagtgagcc

SEQ ID NO: 3795464 - DNA, 18 bp, Homo sapiens
caaggctgggggaagaag

SEQ ID NO: 3795465 - DNA, 21 bp, Homo sapiens
caagggcttacacgtggagga

SEQ ID NO: 3795466 - DNA, 16 bp, Homo sapiens
caaggggaaaatctca

SEQ ID NO: 3795467 - DNA, 16 bp, Homo sapiens
caaggggcagtctgga

SEQ ID NO: 3795468 - DNA, 18 bp, Homo sapiens
caaggggcagtctggagg

SEQ ID NO: 3795469 - DNA, 19 bp, Homo sapiens
caaggggcagtctggaggg

SEQ ID NO: 3795470 - DNA, 13 bp, Homo sapiens
caaggtaaaattc

SEQ ID NO: 3795471 - DNA, 16 bp, Homo sapiens
caaggtaaaattctaa

SEQ ID NO: 3795472 - DNA, 16 bp, Homo sapiens
caaggtagccctggcc

SEQ ID NO: 3795473 - DNA, 23 bp, Homo sapiens
caaggtagccctggccagaggct

SEQ ID NO: 3795474 - DNA, 16 bp, Homo sapiens
caaggtcggtaagttg

SEQ ID NO: 3795475 - DNA, 14 bp, Homo sapiens
caaggtctttggtt

SEQ ID NO: 3795476 - DNA, 14 bp, Homo sapiens
caaggtggagtgga

SEQ ID NO: 3795477 - DNA, 21 bp, Homo sapiens
caaggtgggcagggaggcacc

SEQ ID NO: 3795478 - DNA, 12 bp, Homo sapiens
caaggtgggctg

SEQ ID NO: 3795479 - DNA, 18 bp, Homo sapiens
caaggtgggctgagccct

SEQ ID NO: 3795480 - DNA, 24 bp, Homo sapiens
caaggtgggctgagccctggcagg

SEQ ID NO: 3795481 - DNA, 13 bp, Homo sapiens
caagtcaagtgaa

SEQ ID NO: 3795482 - DNA, 19 bp, Homo sapiens
caagtcagctttgccttcc

SEQ ID NO: 3795483 - DNA, 13 bp, Homo sapiens
caagtcatgtgca

SEQ ID NO: 3795484 - DNA, 17 bp, Homo sapiens
caagtcattttaacttt

SEQ ID NO: 3795485 - DNA, 14 bp, Homo sapiens
caagtcctcttttc

SEQ ID NO: 3795486 - DNA, 12 bp, Homo sapiens
caagtcctggct

SEQ ID NO: 3795487 - DNA, 22 bp, Homo sapiens
caagtccttacctcttccggag

SEQ ID NO: 3795488 - DNA, 18 bp, Homo sapiens
caagtctggatctgggac

SEQ ID NO: 3795489 - DNA, 19 bp, Homo sapiens
caagtctggatctgggacc

SEQ ID NO: 3795490 - DNA, 14 bp, Homo sapiens
caagtctgtgcctg

SEQ ID NO: 3795491 - DNA, 23 bp, Homo sapiens
caagtctgtgcctggagctcctg

SEQ ID NO: 3795492 - DNA, 19 bp, Homo sapiens
caagtgaaaaaggaggaag

SEQ ID NO: 3795493 - DNA, 16 bp, Homo sapiens
caagtgacatctcttt

SEQ ID NO: 3795494 - DNA, 14 bp, Homo sapiens
caagtgagagctgg

SEQ ID NO: 3795495 - DNA, 18 bp, Homo sapiens
caagtgagagctgggtgt

SEQ ID NO: 3795496 - DNA, 16 bp, Homo sapiens
caagtgagcaaacctg

SEQ ID NO: 3795497 - DNA, 19 bp, Homo sapiens
caagtgagcaaacctgccc

SEQ ID NO: 3795498 - DNA, 21 bp, Homo sapiens
caagtgagcaaacctgcccca

SEQ ID NO: 3795499 - DNA, 16 bp, Homo sapiens
caagtgattctcctgc

SEQ ID NO: 3795500 - DNA, 20 bp, Homo sapiens
caagtgattctcctgcctca

SEQ ID NO: 3795501 - DNA, 22 bp, Homo sapiens
caagtgattctcctgcctcagc

SEQ ID NO: 3795502 - DNA, 20 bp, Homo sapiens
caagtgcaggctggcaccgc

SEQ ID NO: 3795503 - DNA, 17 bp, Homo sapiens
caagtgcatgctctctg

SEQ ID NO: 3795504 - DNA, 19 bp, Homo sapiens
caagtggaccttgagacca

SEQ ID NO: 3795505 - DNA, 20 bp, Homo sapiens
caagtgggggcagagggcag

SEQ ID NO: 3795506 - DNA, 20 bp, Homo sapiens
caagtgtctcagtccacctg

SEQ ID NO: 3795507 - DNA, 14 bp, Homo sapiens
caagtgtgtgcaca

SEQ ID NO: 3795508 - DNA, 20 bp, Homo sapiens
caagtgtgtgcacatgtgtg

SEQ ID NO: 3795509 - DNA, 21 bp, Homo sapiens
caagtgtgtgcacatgtgtgc

SEQ ID NO: 3795510 - DNA, 18 bp, Homo sapiens
caagttaaagtgaataac

SEQ ID NO: 3795511 - DNA, 18 bp, Homo sapiens
caagttaacaaggaatgc

SEQ ID NO: 3795512 - DNA, 17 bp, Homo sapiens
caagttagctcaggagg

SEQ ID NO: 3795513 - DNA, 22 bp, Homo sapiens
caagtttccaagcaaatgttac

SEQ ID NO: 3795514 - DNA, 14 bp, Homo sapiens
caataaaaatcata

SEQ ID NO: 3795515 - DNA, 15 bp, Homo sapiens
caataaaatcatgta

SEQ ID NO: 3795516 - DNA, 16 bp, Homo sapiens
caataaaatgtgattt

SEQ ID NO: 3795517 - DNA, 14 bp, Homo sapiens
caataactactgtg

SEQ ID NO: 3795518 - DNA, 15 bp, Homo sapiens
caataactactgtgt

SEQ ID NO: 3795519 - DNA, 19 bp, Homo sapiens
caataactactgtgttcct

SEQ ID NO: 3795520 - DNA, 21 bp, Homo sapiens
caataactactgtgttcctgg

SEQ ID NO: 3795521 - DNA, 19 bp, Homo sapiens
caatacagtacaggcagca

SEQ ID NO: 3795522 - DNA, 23 bp, Homo sapiens
caatagaaactcaccatgtaaaa

SEQ ID NO: 3795523 - DNA, 23 bp, Homo sapiens
caatagaaggatgtacatttcca

SEQ ID NO: 3795524 - DNA, 16 bp, Homo sapiens
caataggaatgctaac

SEQ ID NO: 3795525 - DNA, 16 bp, Homo sapiens
caatagtgtgttctga

SEQ ID NO: 3795526 - DNA, 14 bp, Homo sapiens
caatatcctcgctc

SEQ ID NO: 3795527 - DNA, 16 bp, Homo sapiens
caatatgtattaatat

SEQ ID NO: 3795528 - DNA, 14 bp, Homo sapiens
caatattataattt

SEQ ID NO: 3795529 - DNA, 22 bp, Homo sapiens
caatattatactaagaaaagat

SEQ ID NO: 3795530 - DNA, 23 bp, Homo sapiens
caatattatactaagaaaagata

SEQ ID NO: 3795531 - DNA, 13 bp, Homo sapiens
caatattcctgaa

SEQ ID NO: 3795532 - DNA, 22 bp, Homo sapiens
caatatttaaggagatgtaaga

SEQ ID NO: 3795533 - DNA, 14 bp, Homo sapiens
caatatttattgta

SEQ ID NO: 3795534 - DNA, 14 bp, Homo sapiens
caatatttgtagaa

SEQ ID NO: 3795535 - DNA, 15 bp, Homo sapiens
caatatttgtagaag

SEQ ID NO: 3795536 - DNA, 23 bp, Homo sapiens
caatattttaagcattactcttg

SEQ ID NO: 3795537 - DNA, 18 bp, Homo sapiens
caatcaaaggaaaatagt

SEQ ID NO: 3795538 - DNA, 12 bp, Homo sapiens
caatcaagataa

SEQ ID NO: 3795539 - DNA, 17 bp, Homo sapiens
caatcaagataaaggac

SEQ ID NO: 3795540 - DNA, 17 bp, Homo sapiens
caatcatgaaatatgca

SEQ ID NO: 3795541 - DNA, 17 bp, Homo sapiens
caatcattttaattatt

SEQ ID NO: 3795542 - DNA, 17 bp, Homo sapiens
caatccagcggttctca

SEQ ID NO: 3795543 - DNA, 21 bp, Homo sapiens
caatccatgttagtttttact

SEQ ID NO: 3795544 - DNA, 22 bp, Homo sapiens
caatcccaccaaccctcagagc

SEQ ID NO: 3795545 - DNA, 21 bp, Homo sapiens
caatcccctcattcaggaaaa

SEQ ID NO: 3795546 - DNA, 17 bp, Homo sapiens
caatcctaacacattat

SEQ ID NO: 3795547 - DNA, 18 bp, Homo sapiens
caatcctcactgggtggg

SEQ ID NO: 3795548 - DNA, 13 bp, Homo sapiens
caatcctctaagc

SEQ ID NO: 3795549 - DNA, 22 bp, Homo sapiens
caatcctgtgtggtttagtgta

SEQ ID NO: 3795550 - DNA, 22 bp, Homo sapiens
caatgagatagaagatgtttgc

SEQ ID NO: 3795551 - DNA, 18 bp, Homo sapiens
caatgaggtctgaaatgg

SEQ ID NO: 3795552 - DNA, 19 bp, Homo sapiens
caatgatgatgataatgat

SEQ ID NO: 3795553 - DNA, 16 bp, Homo sapiens
caatgatggcaatttt

SEQ ID NO: 3795554 - DNA, 13 bp, Homo sapiens
caatgatggtcac

SEQ ID NO: 3795555 - DNA, 14 bp, Homo sapiens
caatgcagatgcca

SEQ ID NO: 3795556 - DNA, 17 bp, Homo sapiens
caatgcagatgccagag

SEQ ID NO: 3795557 - DNA, 16 bp, Homo sapiens
caatgcagtgcctttc

SEQ ID NO: 3795558 - DNA, 12 bp, Homo sapiens
caatgctggctg

SEQ ID NO: 3795559 - DNA, 20 bp, Homo sapiens
caatgctggctgttggctgg

SEQ ID NO: 3795560 - DNA, 22 bp, Homo sapiens
cacctgctggcccctcacctgg

SEQ ID NO: 3795561 - DNA, 11 bp, Homo sapiens
cacctggcccc

SEQ ID NO: 3795562 - DNA, 15 bp, Homo sapiens
cacctggccccatgt

SEQ ID NO: 3795563 - DNA, 22 bp, Homo sapiens
cacctggccccatgtctctcag

SEQ ID NO: 3795564 - DNA, 14 bp, Homo sapiens
cacctggggagtgg

SEQ ID NO: 3795565 - DNA, 20 bp, Homo sapiens
cacctggttccggaatcctg

SEQ ID NO: 3795566 - DNA, 21 bp, Homo sapiens
cacctggttccggaatcctgt

SEQ ID NO: 3795567 - DNA, 23 bp, Homo sapiens
cacctggttccggaatcctgtcc

SEQ ID NO: 3795568 - DNA, 13 bp, Homo sapiens
cacctgtaaaact

SEQ ID NO: 3795569 - DNA, 17 bp, Homo sapiens
cacctgtaaaactttat

SEQ ID NO: 3795570 - DNA, 16 bp, Homo sapiens
cacctgtactggagag

SEQ ID NO: 3795571 - DNA, 16 bp, Homo sapiens
cacctgtagtcccagc

SEQ ID NO: 3795572 - DNA, 13 bp, Homo sapiens
cacctgtcaaaca

SEQ ID NO: 3795573 - DNA, 20 bp, Homo sapiens
cacctgtcaaacaaagccag

SEQ ID NO: 3795574 - DNA, 21 bp, Homo sapiens
cacctgtcaaacaaagccaga

SEQ ID NO: 3795575 - DNA, 13 bp, Homo sapiens
cacctgtcccacc

SEQ ID NO: 3795576 - DNA, 15 bp, Homo sapiens
cacctgtcccacctc

SEQ ID NO: 3795577 - DNA, 16 bp, Homo sapiens
caccttaaattaaaca

SEQ ID NO: 3795578 - DNA, 19 bp, Homo sapiens
caccttatcttaaagcact

SEQ ID NO: 3795579 - DNA, 17 bp, Homo sapiens
caccttcccagctctcc

SEQ ID NO: 3795580 - DNA, 21 bp, Homo sapiens
caccttcccagctctccctct

SEQ ID NO: 3795581 - DNA, 22 bp, Homo sapiens
caccttcccagctctccctctg

SEQ ID NO: 3795582 - DNA, 19 bp, Homo sapiens
caccttgacagggcacacc

SEQ ID NO: 3795583 - DNA, 13 bp, Homo sapiens
caccttgcagctc

SEQ ID NO: 3795584 - DNA, 22 bp, Homo sapiens
caccttgcagctctccccttct

SEQ ID NO: 3795585 - DNA, 13 bp, Homo sapiens
caccttggctcaa

SEQ ID NO: 3795586 - DNA, 19 bp, Homo sapiens
caccttgggatgatgcctc

SEQ ID NO: 3795587 - DNA, 14 bp, Homo sapiens
cacctttattaaaa

SEQ ID NO: 3795588 - DNA, 15 bp, Homo sapiens
cacctttattaaaat

SEQ ID NO: 3795589 - DNA, 15 bp, Homo sapiens
cacgaaatgttattt

SEQ ID NO: 3795590 - DNA, 17 bp, Homo sapiens
cacgaaatgttattttt

SEQ ID NO: 3795591 - DNA, 22 bp, Homo sapiens
cacgaacccacctgctgagaga

SEQ ID NO: 3795592 - DNA, 16 bp, Homo sapiens
cacgactgcccggcag

SEQ ID NO: 3795593 - DNA, 23 bp, Homo sapiens
cacgagcaaagtgaagacactgg

SEQ ID NO: 3795594 - DNA, 22 bp, Homo sapiens
cacgatgtggccctggcctgct

SEQ ID NO: 3795595 - DNA, 15 bp, Homo sapiens
cacgcacacacacac

SEQ ID NO: 3795596 - DNA, 15 bp, Homo sapiens
cacgcacctcccatc

SEQ ID NO: 3795597 - DNA, 17 bp, Homo sapiens
cacgcacttcgggaggt

SEQ ID NO: 3795598 - DNA, 15 bp, Homo sapiens
cacgccactgcacta

SEQ ID NO: 3795599 - DNA, 14 bp, Homo sapiens
cacgcccatgtgtg

SEQ ID NO: 3795600 - DNA, 20 bp, Homo sapiens
cacgccctcattacggctcc

SEQ ID NO: 3795601 - DNA, 21 bp, Homo sapiens
cacgcctatgatcccagcact

SEQ ID NO: 3795602 - DNA, 14 bp, Homo sapiens
cacgcctgtaatcc

SEQ ID NO: 3795603 - DNA, 20 bp, Homo sapiens
cacgcctgtaatcccagcac

SEQ ID NO: 3795604 - DNA, 20 bp, Homo sapiens
cacgcctgtaatcccagcag

SEQ ID NO: 3795605 - DNA, 12 bp, Homo sapiens
cacgcctgtgca

SEQ ID NO: 3795606 - DNA, 15 bp, Homo sapiens
cacgcgtgcacacac

SEQ ID NO: 3795607 - DNA, 16 bp, Homo sapiens
cacgcgtgcacacacc

SEQ ID NO: 3795608 - DNA, 21 bp, Homo sapiens
cacgcgtgcacacaccagagc

SEQ ID NO: 3795609 - DNA, 17 bp, Homo sapiens
cacgctggaccttgaac

SEQ ID NO: 3795610 - DNA, 15 bp, Homo sapiens
cacgctgtctccaga

SEQ ID NO: 3795611 - DNA, 17 bp, Homo sapiens
cacgctgtctccagacc

SEQ ID NO: 3795612 - DNA, 19 bp, Homo sapiens
cacgctgtctccagacccc

SEQ ID NO: 3795613 - DNA, 16 bp, Homo sapiens
cacgctgtgggcaggt

SEQ ID NO: 3795614 - DNA, 18 bp, Homo sapiens
cacgctgtgggcaggtgg

SEQ ID NO: 3795615 - DNA, 22 bp, Homo sapiens
cacggaagagccttgcggaagg

SEQ ID NO: 3795616 - DNA, 21 bp, Homo sapiens
cacggaggcatctgcaccctc

SEQ ID NO: 3795617 - DNA, 20 bp, Homo sapiens
cacggatccatgtagcagga

SEQ ID NO: 3795618 - DNA, 22 bp, Homo sapiens
cacggccagctgcatctactca

SEQ ID NO: 3795619 - DNA, 14 bp, Homo sapiens
cacggccaggccag

SEQ ID NO: 3795620 - DNA, 16 bp, Homo sapiens
cacggccaggccagag

SEQ ID NO: 3795621 - DNA, 22 bp, Homo sapiens
cacgtaagatacaagtttcaga

SEQ ID NO: 3795622 - DNA, 19 bp, Homo sapiens
cacgtacacacacatacac

SEQ ID NO: 3795623 - DNA, 16 bp, Homo sapiens
cacgtacttaaatgaa

SEQ ID NO: 3795624 - DNA, 23 bp, Homo sapiens
cacgtagcccccaggctgctgga

SEQ ID NO: 3795625 - DNA, 17 bp, Homo sapiens
cacgtagtagggtcagg

SEQ ID NO: 3795626 - DNA, 17 bp, Homo sapiens
cacgtctgaccctctcc

SEQ ID NO: 3795627 - DNA, 16 bp, Homo sapiens
cacgtggcttctgatg

SEQ ID NO: 3795628 - DNA, 21 bp, Homo sapiens
cacgtggcttctgatgaatct

SEQ ID NO: 3795629 - DNA, 18 bp, Homo sapiens
cacgtggtaaaacacttg

SEQ ID NO: 3795630 - DNA, 12 bp, Homo sapiens
cactaaagcagt

SEQ ID NO: 3795631 - DNA, 14 bp, Homo sapiens
cactaaccacgctg

SEQ ID NO: 3795632 - DNA, 16 bp, Homo sapiens
cactaaccacgctgga

SEQ ID NO: 3795633 - DNA, 17 bp, Homo sapiens
cactaaggtgtgctctg

SEQ ID NO: 3795634 - DNA, 20 bp, Homo sapiens
cactacactccagcctgagc

SEQ ID NO: 3795635 - DNA, 15 bp, Homo sapiens
cactacatgcagccc

SEQ ID NO: 3795636 - DNA, 21 bp, Homo sapiens
cactacatgcagcccatgccc

SEQ ID NO: 3795637 - DNA, 22 bp, Homo sapiens
cactacccatcggtgtccattt

SEQ ID NO: 3795638 - DNA, 17 bp, Homo sapiens
cactactcacagtctct

SEQ ID NO: 3795639 - DNA, 21 bp, Homo sapiens
cactactgctaccacaactat

SEQ ID NO: 3795640 - DNA, 17 bp, Homo sapiens
cactagaactctccatc

SEQ ID NO: 3795641 - DNA, 14 bp, Homo sapiens
cactagcctctcca

SEQ ID NO: 3795642 - DNA, 16 bp, Homo sapiens
cactaggactctgagg

SEQ ID NO: 3795643 - DNA, 17 bp, Homo sapiens
cactaggactctgaggc

SEQ ID NO: 3795644 - DNA, 18 bp, Homo sapiens
cactaggactctgaggct

SEQ ID NO: 3795645 - DNA, 14 bp, Homo sapiens
cactaggctgggtg

SEQ ID NO: 3795646 - DNA, 15 bp, Homo sapiens
cactagtctgtgtgc

SEQ ID NO: 3795647 - DNA, 12 bp, Homo sapiens
cactataaatgg

SEQ ID NO: 3795648 - DNA, 14 bp, Homo sapiens
cactatgaagatgt

SEQ ID NO: 3795649 - DNA, 12 bp, Homo sapiens
cactatgcattt

SEQ ID NO: 3795650 - DNA, 15 bp, Homo sapiens
cactatgttgcccag

SEQ ID NO: 3795651 - DNA, 17 bp, Homo sapiens
cactatgttgcccaggc

SEQ ID NO: 3795652 - DNA, 18 bp, Homo sapiens
cactatgttgcccaggca

SEQ ID NO: 3795653 - DNA, 13 bp, Homo sapiens
cactattttcaga

SEQ ID NO: 3795654 - DNA, 14 bp, Homo sapiens
cactattttcagaa

SEQ ID NO: 3795655 - DNA, 18 bp, Homo sapiens
cactattttcagaatctg

SEQ ID NO: 3795656 - DNA, 22 bp, Homo sapiens
cactatttttatttatattttt

SEQ ID NO: 3795657 - DNA, 20 bp, Homo sapiens
cactcaaaagctgggcaggt

SEQ ID NO: 3795658 - DNA, 22 bp, Homo sapiens
cactcaacaaaagtgctttgga

SEQ ID NO: 3795659 - DNA, 12 bp, Homo sapiens
cactcaagccaa

SEQ ID NO: 3795660 - DNA, 16 bp, Homo sapiens
cactcaagccaagcag

SEQ ID NO: 3795661 - DNA, 18 bp, Homo sapiens
cactcaagccaagcagcc

SEQ ID NO: 3795662 - DNA, 16 bp, Homo sapiens
cactcaagttcaagga

SEQ ID NO: 3795663 - DNA, 17 bp, Homo sapiens
cactcacagagacacag

SEQ ID NO: 3795664 - DNA, 14 bp, Homo sapiens
cactcacatgctgg

SEQ ID NO: 3795665 - DNA, 20 bp, Homo sapiens
cactcacatttattctgctc

SEQ ID NO: 3795666 - DNA, 12 bp, Homo sapiens
cactcagaagac

SEQ ID NO: 3795667 - DNA, 17 bp, Homo sapiens
cactcagaagacactga

SEQ ID NO: 3795668 - DNA, 19 bp, Homo sapiens
cactcagaagacactgatg

SEQ ID NO: 3795669 - DNA, 14 bp, Homo sapiens
cactcagcaccccc

SEQ ID NO: 3795670 - DNA, 20 bp, Homo sapiens
cactcaggaggctgaggcag

SEQ ID NO: 3795671 - DNA, 16 bp, Homo sapiens
cactcagtccatagca

SEQ ID NO: 3795672 - DNA, 10 bp, Homo sapiens
cactccacca

SEQ ID NO: 3795673 - DNA, 21 bp, Homo sapiens
cagatatttatatttttattt

SEQ ID NO: 3795674 - DNA, 14 bp, Homo sapiens
cagatcacgaggtc

SEQ ID NO: 3795675 - DNA, 20 bp, Homo sapiens
cagatcatagatttctgatt

SEQ ID NO: 3795676 - DNA, 21 bp, Homo sapiens
cagatcatagatttctgattt

SEQ ID NO: 3795677 - DNA, 15 bp, Homo sapiens
cagatctgcaccgcc

SEQ ID NO: 3795678 - DNA, 18 bp, Homo sapiens
cagatgacccctccccta

SEQ ID NO: 3795679 - DNA, 20 bp, Homo sapiens
cagatgagcagaagctctcg

SEQ ID NO: 3795680 - DNA, 14 bp, Homo sapiens
cagatgatccatga

SEQ ID NO: 3795681 - DNA, 17 bp, Homo sapiens
cagatgcaccagccctt

SEQ ID NO: 3795682 - DNA, 13 bp, Homo sapiens
cagatgccccaga

SEQ ID NO: 3795683 - DNA, 15 bp, Homo sapiens
cagatgccccagagc

SEQ ID NO: 3795684 - DNA, 22 bp, Homo sapiens
cagatgcctccaccccccagaa

SEQ ID NO: 3795685 - DNA, 13 bp, Homo sapiens
cagattcaatttt

SEQ ID NO: 3795686 - DNA, 15 bp, Homo sapiens
cagattcatttttct

SEQ ID NO: 3795687 - DNA, 21 bp, Homo sapiens
cagattccaggcgatgtgcaa

SEQ ID NO: 3795688 - DNA, 18 bp, Homo sapiens
cagattcccagagcaaaa

SEQ ID NO: 3795689 - DNA, 12 bp, Homo sapiens
cagattgaaaag

SEQ ID NO: 3795690 - DNA, 14 bp, Homo sapiens
cagattgaaaagga

SEQ ID NO: 3795691 - DNA, 18 bp, Homo sapiens
cagattgcaacaggctgg

SEQ ID NO: 3795692 - DNA, 20 bp, Homo sapiens
cagattgcaacaggctgggc

SEQ ID NO: 3795693 - DNA, 21 bp, Homo sapiens
cagattgcaacaggctgggct

SEQ ID NO: 3795694 - DNA, 15 bp, Homo sapiens
cagattgctgcttct

SEQ ID NO: 3795695 - DNA, 18 bp, Homo sapiens
cagattggagaaaccctt

SEQ ID NO: 3795696 - DNA, 14 bp, Homo sapiens
cagattgtcagctc

SEQ ID NO: 3795697 - DNA, 21 bp, Homo sapiens
cagatttgaagacaaaaatac

SEQ ID NO: 3795698 - DNA, 20 bp, Homo sapiens
cagatttgctaatttatcct

SEQ ID NO: 3795699 - DNA, 15 bp, Homo sapiens
cagattttaattttg

SEQ ID NO: 3795700 - DNA, 23 bp, Homo sapiens
cagattttaattttgaataaata

SEQ ID NO: 3795701 - DNA, 16 bp, Homo sapiens
cagattttacaaaaga

SEQ ID NO: 3795702 - DNA, 22 bp, Homo sapiens
cagattttttacagctgcctgc

SEQ ID NO: 3795703 - DNA, 12 bp, Homo sapiens
cagcaaaaccat

SEQ ID NO: 3795704 - DNA, 13 bp, Homo sapiens
cagcaaaaccatt

SEQ ID NO: 3795705 - DNA, 18 bp, Homo sapiens
cagcaaaaccattgcttc

SEQ ID NO: 3795706 - DNA, 20 bp, Homo sapiens
cagcaaaaccattgcttcac

SEQ ID NO: 3795707 - DNA, 14 bp, Homo sapiens
cagcaaatttataa

SEQ ID NO: 3795708 - DNA, 19 bp, Homo sapiens
cagcaaatttataatttta

SEQ ID NO: 3795709 - DNA, 14 bp, Homo sapiens
cagcaaccagagca

SEQ ID NO: 3795710 - DNA, 15 bp, Homo sapiens
cagcaaccagagcac

SEQ ID NO: 3795711 - DNA, 18 bp, Homo sapiens
cagcaaccagagcactgt

SEQ ID NO: 3795712 - DNA, 19 bp, Homo sapiens
cagcaaccagagcactgta

SEQ ID NO: 3795713 - DNA, 18 bp, Homo sapiens
cagcaacttgtctttttc

SEQ ID NO: 3795714 - DNA, 20 bp, Homo sapiens
cagcaacttgtctttttctg

SEQ ID NO: 3795715 - DNA, 22 bp, Homo sapiens
cagcaacttgtctttttctgga

SEQ ID NO: 3795716 - DNA, 17 bp, Homo sapiens
cagcaaggggctctgcc

SEQ ID NO: 3795717 - DNA, 14 bp, Homo sapiens
cagcaaggtggagt

SEQ ID NO: 3795718 - DNA, 13 bp, Homo sapiens
cagcaatatttaa

SEQ ID NO: 3795719 - DNA, 19 bp, Homo sapiens
cagcaatatttaaggagat

SEQ ID NO: 3795720 - DNA, 16 bp, Homo sapiens
cagcacagagaccccc

SEQ ID NO: 3795721 - DNA, 17 bp, Homo sapiens
cagcacagagagggggc

SEQ ID NO: 3795722 - DNA, 21 bp, Homo sapiens
cagcaccaccaggtctcccgg

SEQ ID NO: 3795723 - DNA, 22 bp, Homo sapiens
cagcaccaccaggtctcccggg

SEQ ID NO: 3795724 - DNA, 14 bp, Homo sapiens
cagcacccccacgc

SEQ ID NO: 3795725 - DNA, 12 bp, Homo sapiens
cagcaccctgca

SEQ ID NO: 3795726 - DNA, 14 bp, Homo sapiens
cagcactaaagcag

SEQ ID NO: 3795727 - DNA, 17 bp, Homo sapiens
cagcactaaagcagtgg

SEQ ID NO: 3795728 - DNA, 19 bp, Homo sapiens
cagcactaaagcagtggac

SEQ ID NO: 3795729 - DNA, 10 bp, Homo sapiens
cagcactaac

SEQ ID NO: 3795730 - DNA, 23 bp, Homo sapiens
cagcactttgggaggccaaggag

SEQ ID NO: 3795731 - DNA, 18 bp, Homo sapiens
cagcactttgggaggctg

SEQ ID NO: 3795732 - DNA, 22 bp, Homo sapiens
cagcactttgggaggctgaggt

SEQ ID NO: 3795733 - DNA, 18 bp, Homo sapiens
cagcagccagctctcagc

SEQ ID NO: 3795734 - DNA, 21 bp, Homo sapiens
cagcagccagctctcagccaa

SEQ ID NO: 3795735 - DNA, 23 bp, Homo sapiens
cagcagcccctgcacaaagccct

SEQ ID NO: 3795736 - DNA, 13 bp, Homo sapiens
cagcagccctcct

SEQ ID NO: 3795737 - DNA, 15 bp, Homo sapiens
cagcagccctcctca

SEQ ID NO: 3795738 - DNA, 17 bp, Homo sapiens
cagcagccctcctcacc

SEQ ID NO: 3795739 - DNA, 18 bp, Homo sapiens
cagcagccctcctcaccc

SEQ ID NO: 3795740 - DNA, 16 bp, Homo sapiens
cagcagcctctgaagt

SEQ ID NO: 3795741 - DNA, 18 bp, Homo sapiens
cagcagcctctgaagttg

SEQ ID NO: 3795742 - DNA, 12 bp, Homo sapiens
cagcagcctgga

SEQ ID NO: 3795743 - DNA, 22 bp, Homo sapiens
cagcagcctggaccctgtggat

SEQ ID NO: 3795744 - DNA, 15 bp, Homo sapiens
cagcagctcaggcac

SEQ ID NO: 3795745 - DNA, 16 bp, Homo sapiens
cagcagctcaggcaca

SEQ ID NO: 3795746 - DNA, 15 bp, Homo sapiens
cagcagcttgctgca

SEQ ID NO: 3795747 - DNA, 21 bp, Homo sapiens
cagcaggcctgttgctttttt

SEQ ID NO: 3795748 - DNA, 20 bp, Homo sapiens
cagcagggagggcttctgcc

SEQ ID NO: 3795749 - DNA, 15 bp, Homo sapiens
cagcagggcctcaaa

SEQ ID NO: 3795750 - DNA, 17 bp, Homo sapiens
cagcataagggagcgta

SEQ ID NO: 3795751 - DNA, 17 bp, Homo sapiens
cagcatagaagtaactt

SEQ ID NO: 3795752 - DNA, 14 bp, Homo sapiens
cagcatatttatag

SEQ ID NO: 3795753 - DNA, 15 bp, Homo sapiens
cagcatcctggcacc

SEQ ID NO: 3795754 - DNA, 22 bp, Homo sapiens
cagcatccttaagtatcagaaa

SEQ ID NO: 3795755 - DNA, 23 bp, Homo sapiens
cagcatccttttctgcagagggg

SEQ ID NO: 3795756 - DNA, 13 bp, Homo sapiens
cagcatcttctca

SEQ ID NO: 3795757 - DNA, 14 bp, Homo sapiens
cagcattctcactc

SEQ ID NO: 3795758 - DNA, 21 bp, Homo sapiens
cagcattcttagcctgtggca

SEQ ID NO: 3795759 - DNA, 13 bp, Homo sapiens
cagcattgctttc

SEQ ID NO: 3795760 - DNA, 14 bp, Homo sapiens
cagcattgctttct

SEQ ID NO: 3795761 - DNA, 16 bp, Homo sapiens
cagcattgctttctga

SEQ ID NO: 3795762 - DNA, 15 bp, Homo sapiens
cagccaaaccctgtc

SEQ ID NO: 3795763 - DNA, 17 bp, Homo sapiens
cagccaaagataatctc

SEQ ID NO: 3795764 - DNA, 20 bp, Homo sapiens
cagccaaagataatctctca

SEQ ID NO: 3795765 - DNA, 15 bp, Homo sapiens
cagccaaagcctcct

SEQ ID NO: 3795766 - DNA, 18 bp, Homo sapiens
cagccaaagcctcctcca

SEQ ID NO: 3795767 - DNA, 12 bp, Homo sapiens
cagccaacccct

SEQ ID NO: 3795768 - DNA, 22 bp, Homo sapiens
cagccaagtcggttagtggaag

SEQ ID NO: 3795769 - DNA, 11 bp, Homo sapiens
cagccaccccg

SEQ ID NO: 3795770 - DNA, 21 bp, Homo sapiens
cagccaccccgggctctctgc

SEQ ID NO: 3795771 - DNA, 18 bp, Homo sapiens
cagccacggccaggccag

SEQ ID NO: 3795772 - DNA, 22 bp, Homo sapiens
cagccagaaccccgagccctac

SEQ ID NO: 3795773 - DNA, 12 bp, Homo sapiens
cagccagcagcc

SEQ ID NO: 3795774 - DNA, 14 bp, Homo sapiens
cagccagcagccag

SEQ ID NO: 3795775 - DNA, 11 bp, Homo sapiens
cagccagccca

SEQ ID NO: 3795776 - DNA, 17 bp, Homo sapiens
cagccagctctcagcca

SEQ ID NO: 3795777 - DNA, 18 bp, Homo sapiens
cagccagctctcagccaa

SEQ ID NO: 3795778 - DNA, 12 bp, Homo sapiens
cagccaggagct

SEQ ID NO: 3795779 - DNA, 12 bp, Homo sapiens
cagccaggctgc

SEQ ID NO: 3795780 - DNA, 22 bp, Homo sapiens
cagccaggctgccaaggccaga

SEQ ID NO: 3795781 - DNA, 22 bp, Homo sapiens
cagccatgaggagttgctgttt

SEQ ID NO: 3795782 - DNA, 16 bp, Homo sapiens
cagccattaccatgga

SEQ ID NO: 3795783 - DNA, 17 bp, Homo sapiens
cagcccaaagaaggaaa

SEQ ID NO: 3795784 - DNA, 12 bp, Homo sapiens
cagcccaccccc

SEQ ID NO: 3795785 - DNA, 20 bp, Homo sapiens
cagcccactggatcagaaag

SEQ ID NO: 3795786 - DNA, 13 bp, Homo sapiens
cagcccagcccag

SEQ ID NO: 3795787 - DNA, 17 bp, Homo sapiens
caggctgtgggcctcaa

SEQ ID NO: 3795788 - DNA, 17 bp, Homo sapiens
caggcttgcctgcaggc

SEQ ID NO: 3795789 - DNA, 18 bp, Homo sapiens
caggcttgcctgcaggca

SEQ ID NO: 3795790 - DNA, 22 bp, Homo sapiens
cagggaaacagctaatgggaca

SEQ ID NO: 3795791 - DNA, 23 bp, Homo sapiens
cagggaaaggctctgaaagccag

SEQ ID NO: 3795792 - DNA, 13 bp, Homo sapiens
cagggaagcccag

SEQ ID NO: 3795793 - DNA, 14 bp, Homo sapiens
cagggaagcccagc

SEQ ID NO: 3795794 - DNA, 19 bp, Homo sapiens
cagggaagcccagctccag

SEQ ID NO: 3795795 - DNA, 23 bp, Homo sapiens
cagggaagcccagctccagggcc

SEQ ID NO: 3795796 - DNA, 16 bp, Homo sapiens
cagggaagtccccagg

SEQ ID NO: 3795797 - DNA, 23 bp, Homo sapiens
cagggaagtccccaggccccagg

SEQ ID NO: 3795798 - DNA, 21 bp, Homo sapiens
cagggaagtgtaagaaacaca

SEQ ID NO: 3795799 - DNA, 17 bp, Homo sapiens
cagggacagagacacct

SEQ ID NO: 3795800 - DNA, 19 bp, Homo sapiens
cagggacagagacacctgc

SEQ ID NO: 3795801 - DNA, 21 bp, Homo sapiens
cagggacagagacacctgcac

SEQ ID NO: 3795802 - DNA, 23 bp, Homo sapiens
cagggacagagacacctgcacct

SEQ ID NO: 3795803 - DNA, 15 bp, Homo sapiens
cagggagcaagacag

SEQ ID NO: 3795804 - DNA, 16 bp, Homo sapiens
cagggagcaagacaga

SEQ ID NO: 3795805 - DNA, 19 bp, Homo sapiens
cagggagcaagacagagac

SEQ ID NO: 3795806 - DNA, 17 bp, Homo sapiens
cagggagcggaaagcag

SEQ ID NO: 3795807 - DNA, 22 bp, Homo sapiens
cagggagcggaaagcagctcaa

SEQ ID NO: 3795808 - DNA, 15 bp, Homo sapiens
cagggagctgggaca

SEQ ID NO: 3795809 - DNA, 19 bp, Homo sapiens
cagggaggaggtggcagcc

SEQ ID NO: 3795810 - DNA, 12 bp, Homo sapiens
cagggaggggac

SEQ ID NO: 3795811 - DNA, 17 bp, Homo sapiens
cagggatggggccacag

SEQ ID NO: 3795812 - DNA, 20 bp, Homo sapiens
cagggatttgtccttgggga

SEQ ID NO: 3795813 - DNA, 22 bp, Homo sapiens
cagggcacaccgggcactcaga

SEQ ID NO: 3795814 - DNA, 19 bp, Homo sapiens
cagggcaccaagcccacag

SEQ ID NO: 3795815 - DNA, 17 bp, Homo sapiens
cagggcagcctgcctgg

SEQ ID NO: 3795816 - DNA, 16 bp, Homo sapiens
cagggcagggctctga

SEQ ID NO: 3795817 - DNA, 17 bp, Homo sapiens
cagggcagggctctgat

SEQ ID NO: 3795818 - DNA, 19 bp, Homo sapiens
cagggcagggctctgatat

SEQ ID NO: 3795819 - DNA, 16 bp, Homo sapiens
cagggccacgtgccag

SEQ ID NO: 3795820 - DNA, 17 bp, Homo sapiens
cagggccactctgcctc

SEQ ID NO: 3795821 - DNA, 20 bp, Homo sapiens
cagggccactctgcctctgc

SEQ ID NO: 3795822 - DNA, 22 bp, Homo sapiens
cagggccagatgagcagaagct

SEQ ID NO: 3795823 - DNA, 15 bp, Homo sapiens
cagggccccagaagg

SEQ ID NO: 3795824 - DNA, 15 bp, Homo sapiens
cagggccccagcact

SEQ ID NO: 3795825 - DNA, 21 bp, Homo sapiens
cagggccctgagctcggtgga

SEQ ID NO: 3795826 - DNA, 13 bp, Homo sapiens
cagggccctgcag

SEQ ID NO: 3795827 - DNA, 15 bp, Homo sapiens
cagggccctgcagag

SEQ ID NO: 3795828 - DNA, 19 bp, Homo sapiens
cagggccttgcccagagat

SEQ ID NO: 3795829 - DNA, 20 bp, Homo sapiens
cagggccttgcccagagatg

SEQ ID NO: 3795830 - DNA, 24 bp, Homo sapiens
cagggccttgcccagagatgcctc

SEQ ID NO: 3795831 - DNA, 15 bp, Homo sapiens
cagggctaccctccc

SEQ ID NO: 3795832 - DNA, 15 bp, Homo sapiens
cagggctcagcctgg

SEQ ID NO: 3795833 - DNA, 20 bp, Homo sapiens
cagggctcagcggggacagc

SEQ ID NO: 3795834 - DNA, 15 bp, Homo sapiens
caggggactcagccc

SEQ ID NO: 3795835 - DNA, 17 bp, Homo sapiens
caggggactcagccctg

SEQ ID NO: 3795836 - DNA, 20 bp, Homo sapiens
caggggactcagccctgagg

SEQ ID NO: 3795837 - DNA, 11 bp, Homo sapiens
cagggggccag

SEQ ID NO: 3795838 - DNA, 13 bp, Homo sapiens
cagggggccaggt

SEQ ID NO: 3795839 - DNA, 14 bp, Homo sapiens
cagggtaaattatt

SEQ ID NO: 3795840 - DNA, 14 bp, Homo sapiens
cagggtcaggagag

SEQ ID NO: 3795841 - DNA, 22 bp, Homo sapiens
cagggtctcactatgttgccca

SEQ ID NO: 3795842 - DNA, 23 bp, Homo sapiens
cagggtctcactatgttgcccag

SEQ ID NO: 3795843 - DNA, 15 bp, Homo sapiens
cagggtctcactctg

SEQ ID NO: 3795844 - DNA, 16 bp, Homo sapiens
cagggtctcactctgt

SEQ ID NO: 3795845 - DNA, 21 bp, Homo sapiens
cagggtctctaccatcccctg

SEQ ID NO: 3795846 - DNA, 14 bp, Homo sapiens
cagggtgaggatgg

SEQ ID NO: 3795847 - DNA, 20 bp, Homo sapiens
cagggtgggatggaggagaa

SEQ ID NO: 3795848 - DNA, 17 bp, Homo sapiens
cagggttcccccagccc

SEQ ID NO: 3795849 - DNA, 18 bp, Homo sapiens
cagggttcccccagccct

SEQ ID NO: 3795850 - DNA, 21 bp, Homo sapiens
cagggttcccccagccctgtg

SEQ ID NO: 3795851 - DNA, 21 bp, Homo sapiens
cagggttctcctctcccctct

SEQ ID NO: 3795852 - DNA, 17 bp, Homo sapiens
cagggttggcccctgcc

SEQ ID NO: 3795853 - DNA, 19 bp, Homo sapiens
cagggtttatcttttgaga

SEQ ID NO: 3795854 - DNA, 16 bp, Homo sapiens
cagggttttgccatgt

SEQ ID NO: 3795855 - DNA, 15 bp, Homo sapiens
caggtaacaggcaga

SEQ ID NO: 3795856 - DNA, 13 bp, Homo sapiens
caggtaatgtgaa

SEQ ID NO: 3795857 - DNA, 14 bp, Homo sapiens
caggtacagagaag

SEQ ID NO: 3795858 - DNA, 19 bp, Homo sapiens
caggtagaacacaaggtca

SEQ ID NO: 3795859 - DNA, 18 bp, Homo sapiens
caggtagctgcccctggc

SEQ ID NO: 3795860 - DNA, 20 bp, Homo sapiens
caggtagctgcccctggctc

SEQ ID NO: 3795861 - DNA, 23 bp, Homo sapiens
caggtagttgcaattgaattaaa

SEQ ID NO: 3795862 - DNA, 16 bp, Homo sapiens
caggtcagggtgagga

SEQ ID NO: 3795863 - DNA, 17 bp, Homo sapiens
caggtcgggctcagctc

SEQ ID NO: 3795864 - DNA, 13 bp, Homo sapiens
caggtctcctctt

SEQ ID NO: 3795865 - DNA, 14 bp, Homo sapiens
caggtctcctctta

SEQ ID NO: 3795866 - DNA, 17 bp, Homo sapiens
caggtctgggagaggca

SEQ ID NO: 3795867 - DNA, 18 bp, Homo sapiens
caggtctgggagaggcag

SEQ ID NO: 3795868 - DNA, 21 bp, Homo sapiens
caggtgacagtgaggtcctgg

SEQ ID NO: 3795869 - DNA, 17 bp, Homo sapiens
caggtgaccttctggga

SEQ ID NO: 3795870 - DNA, 20 bp, Homo sapiens
caggtgatccacccacctca

SEQ ID NO: 3795871 - DNA, 22 bp, Homo sapiens
caggtgatccacccacctcagc

SEQ ID NO: 3795872 - DNA, 13 bp, Homo sapiens
caggtgcagtggc

SEQ ID NO: 3795873 - DNA, 13 bp, Homo sapiens
caggtgctgccat

SEQ ID NO: 3795874 - DNA, 15 bp, Homo sapiens
caggtggccactcca

SEQ ID NO: 3795875 - DNA, 19 bp, Homo sapiens
caggtggccactccagacc

SEQ ID NO: 3795876 - DNA, 21 bp, Homo sapiens
caggtggccactccagacccc

SEQ ID NO: 3795877 - DNA, 15 bp, Homo sapiens
caggtggctgaccca

SEQ ID NO: 3795878 - DNA, 15 bp, Homo sapiens
caggtggggcagctt

SEQ ID NO: 3795879 - DNA, 16 bp, Homo sapiens
caggtggggcagcttg

SEQ ID NO: 3795880 - DNA, 17 bp, Homo sapiens
caggtggggcagcttga

SEQ ID NO: 3795881 - DNA, 18 bp, Homo sapiens
caggtggttatggagagg

SEQ ID NO: 3795882 - DNA, 17 bp, Homo sapiens
caggtgtccccagccca

SEQ ID NO: 3795883 - DNA, 11 bp, Homo sapiens
caggtgtccct

SEQ ID NO: 3795884 - DNA, 14 bp, Homo sapiens
caggtgtccctgca

SEQ ID NO: 3795885 - DNA, 16 bp, Homo sapiens
caggtgtccctgcact

SEQ ID NO: 3795886 - DNA, 20 bp, Homo sapiens
caggtgtgagtcaccaagcc

SEQ ID NO: 3795887 - DNA, 23 bp, Homo sapiens
caggtgtgagtcaccaagcccag

SEQ ID NO: 3795888 - DNA, 21 bp, Homo sapiens
caggttctggttagctcagcc

SEQ ID NO: 3795889 - DNA, 21 bp, Homo sapiens
caggttgaggggctcctggaa

SEQ ID NO: 3795890 - DNA, 21 bp, Homo sapiens
caggttggtgggggcctcggt

SEQ ID NO: 3795891 - DNA, 17 bp, Homo sapiens
cagtaaagagaaacttt

SEQ ID NO: 3795892 - DNA, 14 bp, Homo sapiens
cagtaacttggtta

SEQ ID NO: 3795893 - DNA, 16 bp, Homo sapiens
cagtaacttggttata

SEQ ID NO: 3795894 - DNA, 18 bp, Homo sapiens
cagtaacttggttataca

SEQ ID NO: 3795895 - DNA, 21 bp, Homo sapiens
cagtaagaccggaagctcctg

SEQ ID NO: 3795896 - DNA, 15 bp, Homo sapiens
cagtaataaaacatc

SEQ ID NO: 3795897 - DNA, 14 bp, Homo sapiens
cagtacaggcagca

SEQ ID NO: 3795898 - DNA, 16 bp, Homo sapiens
cagtacatttaattga

SEQ ID NO: 3795899 - DNA, 14 bp, Homo sapiens
cagtaccatctgaa

SEQ ID NO: 3795900 - DNA, 18 bp, Homo sapiens
catgaatgtatcaggaaa

SEQ ID NO: 3795901 - DNA, 21 bp, Homo sapiens
catgaatttttttcatcttct

SEQ ID NO: 3795902 - DNA, 16 bp, Homo sapiens
catgacctgtgaccag

SEQ ID NO: 3795903 - DNA, 17 bp, Homo sapiens
catgacctgtgaccagc

SEQ ID NO: 3795904 - DNA, 20 bp, Homo sapiens
catgactcgtatatgtctca

SEQ ID NO: 3795905 - DNA, 20 bp, Homo sapiens
catgagaacagactggcctg

SEQ ID NO: 3795906 - DNA, 23 bp, Homo sapiens
catgagaacagactggcctgagg

SEQ ID NO: 3795907 - DNA, 17 bp, Homo sapiens
catgagaccactgttat

SEQ ID NO: 3795908 - DNA, 12 bp, Homo sapiens
catgagcctcag

SEQ ID NO: 3795909 - DNA, 22 bp, Homo sapiens
catgagcctcagcatcctggca

SEQ ID NO: 3795910 - DNA, 13 bp, Homo sapiens
catgagctccaga

SEQ ID NO: 3795911 - DNA, 14 bp, Homo sapiens
catgagctccagac

SEQ ID NO: 3795912 - DNA, 15 bp, Homo sapiens
catgagctccagacc

SEQ ID NO: 3795913 - DNA, 16 bp, Homo sapiens
catgagctccagaccc

SEQ ID NO: 3795914 - DNA, 20 bp, Homo sapiens
catgaggacatgatggagcg

SEQ ID NO: 3795915 - DNA, 24 bp, Homo sapiens
catgaggcaatgtcaggaacagaa

SEQ ID NO: 3795916 - DNA, 20 bp, Homo sapiens
catgagggatcacagggccc

SEQ ID NO: 3795917 - DNA, 19 bp, Homo sapiens
catgagttttttctcttgg

SEQ ID NO: 3795918 - DNA, 22 bp, Homo sapiens
catgagttttttctcttgggct

SEQ ID NO: 3795919 - DNA, 13 bp, Homo sapiens
catgatctccctg

SEQ ID NO: 3795920 - DNA, 17 bp, Homo sapiens
catgatctccctgccgc

SEQ ID NO: 3795921 - DNA, 21 bp, Homo sapiens
catgatctccctgccgcctca

SEQ ID NO: 3795922 - DNA, 21 bp, Homo sapiens
catgatcttgtgacatattat

SEQ ID NO: 3795923 - DNA, 15 bp, Homo sapiens
catgatgagctcctc

SEQ ID NO: 3795924 - DNA, 12 bp, Homo sapiens
catgatggagtc

SEQ ID NO: 3795925 - DNA, 23 bp, Homo sapiens
catgatggagtcaggtttggggt

SEQ ID NO: 3795926 - DNA, 19 bp, Homo sapiens
catgatgttaaccagaata

SEQ ID NO: 3795927 - DNA, 23 bp, Homo sapiens
catgattaaccacttcagctgac

SEQ ID NO: 3795928 - DNA, 24 bp, Homo sapiens
catgattaaccacttcagctgact

SEQ ID NO: 3795929 - DNA, 16 bp, Homo sapiens
catgattcatgccaat

SEQ ID NO: 3795930 - DNA, 21 bp, Homo sapiens
catgattcatgccaattagca

SEQ ID NO: 3795931 - DNA, 14 bp, Homo sapiens
catgcaaatgctgt

SEQ ID NO: 3795932 - DNA, 20 bp, Homo sapiens
catgcaaggggaaaatctca

SEQ ID NO: 3795933 - DNA, 20 bp, Homo sapiens
catgcaccctcatacacaga

SEQ ID NO: 3795934 - DNA, 13 bp, Homo sapiens
catgcagcagctt

SEQ ID NO: 3795935 - DNA, 14 bp, Homo sapiens
catgcagcagcttg

SEQ ID NO: 3795936 - DNA, 16 bp, Homo sapiens
catgcagcccatgccc

SEQ ID NO: 3795937 - DNA, 20 bp, Homo sapiens
catgcagcccatgcccacct

SEQ ID NO: 3795938 - DNA, 17 bp, Homo sapiens
catgcatagtcccagct

SEQ ID NO: 3795939 - DNA, 14 bp, Homo sapiens
catgcatcttactg

SEQ ID NO: 3795940 - DNA, 22 bp, Homo sapiens
catgcattgttgaggtggtctg

SEQ ID NO: 3795941 - DNA, 20 bp, Homo sapiens
catgcattttgcagcagtga

SEQ ID NO: 3795942 - DNA, 20 bp, Homo sapiens
catgccagcttatctcaggg

SEQ ID NO: 3795943 - DNA, 13 bp, Homo sapiens
catgcccacctgc

SEQ ID NO: 3795944 - DNA, 16 bp, Homo sapiens
catgcctgctttagaa

SEQ ID NO: 3795945 - DNA, 17 bp, Homo sapiens
catgcctgctttagaat

SEQ ID NO: 3795946 - DNA, 23 bp, Homo sapiens
catgcctgtgtgacatcagtggc

SEQ ID NO: 3795947 - DNA, 19 bp, Homo sapiens
catgccttccagcaccctg

SEQ ID NO: 3795948 - DNA, 16 bp, Homo sapiens
catgcggcccaggatg

SEQ ID NO: 3795949 - DNA, 18 bp, Homo sapiens
catgcgggctgggcagct

SEQ ID NO: 3795950 - DNA, 17 bp, Homo sapiens
catgctcctggcccact

SEQ ID NO: 3795951 - DNA, 20 bp, Homo sapiens
catgctcctggcccactgca

SEQ ID NO: 3795952 - DNA, 13 bp, Homo sapiens
catgctctctgca

SEQ ID NO: 3795953 - DNA, 22 bp, Homo sapiens
catgctggacaggtctgggaga

SEQ ID NO: 3795954 - DNA, 23 bp, Homo sapiens
catgcttcatgaaaatcctacca

SEQ ID NO: 3795955 - DNA, 13 bp, Homo sapiens
catggaaatatta

SEQ ID NO: 3795956 - DNA, 18 bp, Homo sapiens
catggacatgatcttctt

SEQ ID NO: 3795957 - DNA, 15 bp, Homo sapiens
catggacctaacatt

SEQ ID NO: 3795958 - DNA, 21 bp, Homo sapiens
catggactctacactgtgaac

SEQ ID NO: 3795959 - DNA, 22 bp, Homo sapiens
catggaggagcttgggggatga

SEQ ID NO: 3795960 - DNA, 19 bp, Homo sapiens
catggcaccaaagccacca

SEQ ID NO: 3795961 - DNA, 20 bp, Homo sapiens
catggcaccaaagccaccag

SEQ ID NO: 3795962 - DNA, 15 bp, Homo sapiens
catggccaggtggcc

SEQ ID NO: 3795963 - DNA, 17 bp, Homo sapiens
catggctaagcttaaaa

SEQ ID NO: 3795964 - DNA, 20 bp, Homo sapiens
catggctaagcttaaaaaaa

SEQ ID NO: 3795965 - DNA, 22 bp, Homo sapiens
catggctaaggcaccagccggg

SEQ ID NO: 3795966 - DNA, 15 bp, Homo sapiens
catggctcactgcag

SEQ ID NO: 3795967 - DNA, 14 bp, Homo sapiens
catggctccagtct

SEQ ID NO: 3795968 - DNA, 22 bp, Homo sapiens
catggctccagtctgctgccct

SEQ ID NO: 3795969 - DNA, 19 bp, Homo sapiens
catggcttgccacagctct

SEQ ID NO: 3795970 - DNA, 19 bp, Homo sapiens
catgggcccctctgactcc

SEQ ID NO: 3795971 - DNA, 14 bp, Homo sapiens
catgggggcagggc

SEQ ID NO: 3795972 - DNA, 19 bp, Homo sapiens
catggggttggctgggccc

SEQ ID NO: 3795973 - DNA, 22 bp, Homo sapiens
catgggtagcttctgacctcag

SEQ ID NO: 3795974 - DNA, 19 bp, Homo sapiens
catgggtgaagggagagcc

SEQ ID NO: 3795975 - DNA, 23 bp, Homo sapiens
catgggttttgtaggtacttttg

SEQ ID NO: 3795976 - DNA, 14 bp, Homo sapiens
catggtatttgaga

SEQ ID NO: 3795977 - DNA, 16 bp, Homo sapiens
catggtatttgagaca

SEQ ID NO: 3795978 - DNA, 20 bp, Homo sapiens
catggtccggtgtccttttc

SEQ ID NO: 3795979 - DNA, 21 bp, Homo sapiens
catggtgaggcttaacaatgt

SEQ ID NO: 3795980 - DNA, 16 bp, Homo sapiens
catggtgcctctggag

SEQ ID NO: 3795981 - DNA, 12 bp, Homo sapiens
catggtggcgca

SEQ ID NO: 3795982 - DNA, 20 bp, Homo sapiens
catggtggcgcaagcctgta

SEQ ID NO: 3795983 - DNA, 22 bp, Homo sapiens
catggtgtgaaagtcagatgcc

SEQ ID NO: 3795984 - DNA, 16 bp, Homo sapiens
catgtaaaacaaaaaa

SEQ ID NO: 3795985 - DNA, 18 bp, Homo sapiens
catgtaaaacaaaaaaca

SEQ ID NO: 3795986 - DNA, 18 bp, Homo sapiens
catgtaattaagtactat

SEQ ID NO: 3795987 - DNA, 20 bp, Homo sapiens
catgtacatgaagaagctaa

SEQ ID NO: 3795988 - DNA, 19 bp, Homo sapiens
catgtactgagccttgtaa

SEQ ID NO: 3795989 - DNA, 23 bp, Homo sapiens
catgtactgagccttgtaattct

SEQ ID NO: 3795990 - DNA, 14 bp, Homo sapiens
catgtactgtagtt

SEQ ID NO: 3795991 - DNA, 21 bp, Homo sapiens
catgtactgttactgtgtcag

SEQ ID NO: 3795992 - DNA, 20 bp, Homo sapiens
catgtagcaggactgaattg

SEQ ID NO: 3795993 - DNA, 17 bp, Homo sapiens
catgtccctacacccct

SEQ ID NO: 3795994 - DNA, 17 bp, Homo sapiens
catgtctctcagaattc

SEQ ID NO: 3795995 - DNA, 17 bp, Homo sapiens
catgtctttctccaggg

SEQ ID NO: 3795996 - DNA, 17 bp, Homo sapiens
catgtgagccaccgctg

SEQ ID NO: 3795997 - DNA, 18 bp, Homo sapiens
catgtgagccaccgctgc

SEQ ID NO: 3795998 - DNA, 20 bp, Homo sapiens
catgtgagccaccgctgcca

SEQ ID NO: 3795999 - DNA, 14 bp, Homo sapiens
catgtgcacatgca

SEQ ID NO: 3796000 - DNA, 21 bp, Homo sapiens
catgtgccaggtttttggtct

SEQ ID NO: 3796001 - DNA, 14 bp, Homo sapiens
catgtgcccagtta

SEQ ID NO: 3796002 - DNA, 16 bp, Homo sapiens
catgtgcctgcaccag

SEQ ID NO: 3796003 - DNA, 17 bp, Homo sapiens
catgtgcctgcaccagg

SEQ ID NO: 3796004 - DNA, 21 bp, Homo sapiens
catgtggaaaaaaaaaagatg

SEQ ID NO: 3796005 - DNA, 18 bp, Homo sapiens
catgtggaaagtgaattt

SEQ ID NO: 3796006 - DNA, 17 bp, Homo sapiens
catgtggttaatgccat

SEQ ID NO: 3796007 - DNA, 14 bp, Homo sapiens
catgtgtggactca

SEQ ID NO: 3796008 - DNA, 14 bp, Homo sapiens
catgtgttgaaaaa

SEQ ID NO: 3796009 - DNA, 19 bp, Homo sapiens
catgtgtttggttctgggg

SEQ ID NO: 3796010 - DNA, 17 bp, Homo sapiens
catgttaatcctagctg

SEQ ID NO: 3796011 - DNA, 17 bp, Homo sapiens
catgttacataagataa

SEQ ID NO: 3796012 - DNA, 22 bp, Homo sapiens
ccaagttataaatcaatgtcac

SEQ ID NO: 3796013 - DNA, 20 bp, Homo sapiens
ccaagttatataaagagaaa

SEQ ID NO: 3796014 - DNA, 22 bp, Homo sapiens
ccaataaaagttttctccaact

SEQ ID NO: 3796015 - DNA, 20 bp, Homo sapiens
ccaatatcctcgctcccggg

SEQ ID NO: 3796016 - DNA, 14 bp, Homo sapiens
ccaatcattttaat

SEQ ID NO: 3796017 - DNA, 15 bp, Homo sapiens
ccaatcctcactggg

SEQ ID NO: 3796018 - DNA, 17 bp, Homo sapiens
ccaatcctcactgggtg

SEQ ID NO: 3796019 - DNA, 20 bp, Homo sapiens
ccaatgttctctcttctcca

SEQ ID NO: 3796020 - DNA, 17 bp, Homo sapiens
ccaattaggaagtgtaa

SEQ ID NO: 3796021 - DNA, 13 bp, Homo sapiens
ccacacaccccaa

SEQ ID NO: 3796022 - DNA, 14 bp, Homo sapiens
ccacacccagccca

SEQ ID NO: 3796023 - DNA, 15 bp, Homo sapiens
ccacacccagcccac

SEQ ID NO: 3796024 - DNA, 20 bp, Homo sapiens
ccacacccagcccacttctg

SEQ ID NO: 3796025 - DNA, 21 bp, Homo sapiens
ccacacccagcccacttctgc

SEQ ID NO: 3796026 - DNA, 22 bp, Homo sapiens
ccacacccagcccacttctgcc

SEQ ID NO: 3796027 - DNA, 15 bp, Homo sapiens
ccacaccgcagaagc

SEQ ID NO: 3796028 - DNA, 22 bp, Homo sapiens
ccacacctcagttcccttggcc

SEQ ID NO: 3796029 - DNA, 14 bp, Homo sapiens
ccacacctccctga

SEQ ID NO: 3796030 - DNA, 17 bp, Homo sapiens
ccacacctccctgaacc

SEQ ID NO: 3796031 - DNA, 14 bp, Homo sapiens
ccacacctggccct

SEQ ID NO: 3796032 - DNA, 20 bp, Homo sapiens
ccacacctggccctggggcc

SEQ ID NO: 3796033 - DNA, 23 bp, Homo sapiens
ccacactaacctgggttcccttt

SEQ ID NO: 3796034 - DNA, 23 bp, Homo sapiens
ccacactgctaggtgggccagcc

SEQ ID NO: 3796035 - DNA, 22 bp, Homo sapiens
ccacacttcaggctcttctcct

SEQ ID NO: 3796036 - DNA, 13 bp, Homo sapiens
ccacacttcctgt

SEQ ID NO: 3796037 - DNA, 20 bp, Homo sapiens
ccacacttcctgtccagaga

SEQ ID NO: 3796038 - DNA, 21 bp, Homo sapiens
ccacacttgttccagctcttt

SEQ ID NO: 3796039 - DNA, 14 bp, Homo sapiens
ccacagaaagagag

SEQ ID NO: 3796040 - DNA, 15 bp, Homo sapiens
ccacagaaagagagc

SEQ ID NO: 3796041 - DNA, 19 bp, Homo sapiens
ccacagcagcctctgaagt

SEQ ID NO: 3796042 - DNA, 12 bp, Homo sapiens
ccacagcaggtg

SEQ ID NO: 3796043 - DNA, 23 bp, Homo sapiens
ccacagccagaaccccgagccct

SEQ ID NO: 3796044 - DNA, 15 bp, Homo sapiens
ccacagcccaggcct

SEQ ID NO: 3796045 - DNA, 16 bp, Homo sapiens
ccacagctcccacccc

SEQ ID NO: 3796046 - DNA, 19 bp, Homo sapiens
ccacagcttggggccatcg

SEQ ID NO: 3796047 - DNA, 17 bp, Homo sapiens
ccacaggcccttcctct

SEQ ID NO: 3796048 - DNA, 14 bp, Homo sapiens
ccacagggctaaga

SEQ ID NO: 3796049 - DNA, 22 bp, Homo sapiens
ccacagggttcaaaatgtctgt

SEQ ID NO: 3796050 - DNA, 23 bp, Homo sapiens
ccacaggtgtttatacagctcag

SEQ ID NO: 3796051 - DNA, 22 bp, Homo sapiens
ccacaggttcatgccaccatgg

SEQ ID NO: 3796052 - DNA, 21 bp, Homo sapiens
ccacatccccgctggctgggg

SEQ ID NO: 3796053 - DNA, 19 bp, Homo sapiens
ccacatcctccgtccagcc

SEQ ID NO: 3796054 - DNA, 20 bp, Homo sapiens
ccacatcttgctctgctgac

SEQ ID NO: 3796055 - DNA, 23 bp, Homo sapiens
ccacatcttgctctgctgacaga

SEQ ID NO: 3796056 - DNA, 20 bp, Homo sapiens
ccacatgtgtccatcccagc

SEQ ID NO: 3796057 - DNA, 15 bp, Homo sapiens
ccaccaactggccct

SEQ ID NO: 3796058 - DNA, 17 bp, Homo sapiens
ccaccaagacttgtttt

SEQ ID NO: 3796059 - DNA, 17 bp, Homo sapiens
ccaccacacccagccca

SEQ ID NO: 3796060 - DNA, 11 bp, Homo sapiens
ccaccacccaa

SEQ ID NO: 3796061 - DNA, 12 bp, Homo sapiens
ccaccacctagg

SEQ ID NO: 3796062 - DNA, 18 bp, Homo sapiens
ccaccacctaggccactc

SEQ ID NO: 3796063 - DNA, 21 bp, Homo sapiens
ccaccacctaggccactcctc

SEQ ID NO: 3796064 - DNA, 14 bp, Homo sapiens
ccaccagcctgcac

SEQ ID NO: 3796065 - DNA, 23 bp, Homo sapiens
ccaccaggtctcccgggaagcca

SEQ ID NO: 3796066 - DNA, 22 bp, Homo sapiens
ccaccatattcagtgctgtggc

SEQ ID NO: 3796067 - DNA, 16 bp, Homo sapiens
ccaccatggccagcca

SEQ ID NO: 3796068 - DNA, 23 bp, Homo sapiens
ccacccaggagccccgaggcctt

SEQ ID NO: 3796069 - DNA, 14 bp, Homo sapiens
ccacccaggaggga

SEQ ID NO: 3796070 - DNA, 12 bp, Homo sapiens
ccaccccacact

SEQ ID NO: 3796071 - DNA, 17 bp, Homo sapiens
ccaccccacccccttca

SEQ ID NO: 3796072 - DNA, 19 bp, Homo sapiens
ccaccccctccccagggga

SEQ ID NO: 3796073 - DNA, 12 bp, Homo sapiens
ccacccccttca

SEQ ID NO: 3796074 - DNA, 23 bp, Homo sapiens
ccacccccttctctgctccacca

SEQ ID NO: 3796075 - DNA, 16 bp, Homo sapiens
ccacccctccttcctt

SEQ ID NO: 3796076 - DNA, 15 bp, Homo sapiens
ccacccgtggagatg

SEQ ID NO: 3796077 - DNA, 14 bp, Homo sapiens
ccaccctcctttca

SEQ ID NO: 3796078 - DNA, 12 bp, Homo sapiens
ccaccctgctct

SEQ ID NO: 3796079 - DNA, 19 bp, Homo sapiens
ccaccgggctgggagctct

SEQ ID NO: 3796080 - DNA, 20 bp, Homo sapiens
ccaccggttgcttctgggaa

SEQ ID NO: 3796081 - DNA, 19 bp, Homo sapiens
ccacctaccttcaaagctg

SEQ ID NO: 3796082 - DNA, 17 bp, Homo sapiens
ccacctaggccactcct

SEQ ID NO: 3796083 - DNA, 10 bp, Homo sapiens
ccacctcagc

SEQ ID NO: 3796084 - DNA, 16 bp, Homo sapiens
ccacctcagcctcctg

SEQ ID NO: 3796085 - DNA, 19 bp, Homo sapiens
ccacctcccctatccaccc

SEQ ID NO: 3796086 - DNA, 12 bp, Homo sapiens
ccacctgagctt

SEQ ID NO: 3796087 - DNA, 23 bp, Homo sapiens
ccacctgccactaggctgggtgc

SEQ ID NO: 3796088 - DNA, 15 bp, Homo sapiens
ccacctgcccatcac

SEQ ID NO: 3796089 - DNA, 23 bp, Homo sapiens
ccacctgcccatcacagggttgg

SEQ ID NO: 3796090 - DNA, 12 bp, Homo sapiens
ccacctgccccc

SEQ ID NO: 3796091 - DNA, 18 bp, Homo sapiens
ccacctgcccccttctcc

SEQ ID NO: 3796092 - DNA, 20 bp, Homo sapiens
ccacctgcccccttctccca

SEQ ID NO: 3796093 - DNA, 15 bp, Homo sapiens
ccacctgctgagaga

SEQ ID NO: 3796094 - DNA, 21 bp, Homo sapiens
ccacctggttccggaatcctg

SEQ ID NO: 3796095 - DNA, 15 bp, Homo sapiens
ccacctgtcccacct

SEQ ID NO: 3796096 - DNA, 16 bp, Homo sapiens
ccacctgtcccacctc

SEQ ID NO: 3796097 - DNA, 23 bp, Homo sapiens
ccacctgtctcagcctcccagag

SEQ ID NO: 3796098 - DNA, 19 bp, Homo sapiens
ccaccttcaattcctgggc

SEQ ID NO: 3796099 - DNA, 19 bp, Homo sapiens
ccaccttggctgcagggag

SEQ ID NO: 3796100 - DNA, 20 bp, Homo sapiens
ccacgatgtggccctggcct

SEQ ID NO: 3796101 - DNA, 21 bp, Homo sapiens
ccacgccctcattacggctcc

SEQ ID NO: 3796102 - DNA, 23 bp, Homo sapiens
ccacgccctcattacggctcctc

SEQ ID NO: 3796103 - DNA, 18 bp, Homo sapiens
ccacgctggaccttgaac

SEQ ID NO: 3796104 - DNA, 14 bp, Homo sapiens
ccacggccaggcca

SEQ ID NO: 3796105 - DNA, 17 bp, Homo sapiens
ccacgtactgcagcctc

SEQ ID NO: 3796106 - DNA, 14 bp, Homo sapiens
ccacgtgccaggcc

SEQ ID NO: 3796107 - DNA, 23 bp, Homo sapiens
ccacgtgccaggcccggggctgg

SEQ ID NO: 3796108 - DNA, 17 bp, Homo sapiens
ccacgttcacccctcca

SEQ ID NO: 3796109 - DNA, 14 bp, Homo sapiens
ccacgttctctctg

SEQ ID NO: 3796110 - DNA, 22 bp, Homo sapiens
ccactaaaagatcgcagtttgc

SEQ ID NO: 3796111 - DNA, 14 bp, Homo sapiens
ccactacactccag

SEQ ID NO: 3796112 - DNA, 19 bp, Homo sapiens
ccactacactccagcctga

SEQ ID NO: 3796113 - DNA, 21 bp, Homo sapiens
ccactagaactctccatctta

SEQ ID NO: 3796114 - DNA, 20 bp, Homo sapiens
ccactaggactctgaggctc

SEQ ID NO: 3796115 - DNA, 20 bp, Homo sapiens
ccactaggctgggtgcccac

SEQ ID NO: 3796116 - DNA, 20 bp, Homo sapiens
ccactcacaacagctgcctg

SEQ ID NO: 3796117 - DNA, 13 bp, Homo sapiens
ccactcaggccaa

SEQ ID NO: 3796118 - DNA, 20 bp, Homo sapiens
ccactccagacccctggctt

SEQ ID NO: 3796119 - DNA, 12 bp, Homo sapiens
ccactcctccaa

SEQ ID NO: 3796120 - DNA, 15 bp, Homo sapiens
ccactcctgtacact

SEQ ID NO: 3796121 - DNA, 18 bp, Homo sapiens
ccactcgcttcccccata

SEQ ID NO: 3796122 - DNA, 21 bp, Homo sapiens
ccactctaccctcccaccccc

SEQ ID NO: 3796123 - DNA, 14 bp, Homo sapiens
ccactctccccaca

SEQ ID NO: 3796124 - DNA, 23 bp, Homo sapiens
ccatgtcaccggatcctgggtgg

SEQ ID NO: 3796125 - DNA, 12 bp, Homo sapiens
ccatgtcgcctc

SEQ ID NO: 3796126 - DNA, 13 bp, Homo sapiens
ccatgtgccaggt

SEQ ID NO: 3796127 - DNA, 15 bp, Homo sapiens
ccatgtgcctgcacc

SEQ ID NO: 3796128 - DNA, 19 bp, Homo sapiens
ccatgtgcctgcaccagga

SEQ ID NO: 3796129 - DNA, 20 bp, Homo sapiens
ccatgtgcctgcaccaggag

SEQ ID NO: 3796130 - DNA, 11 bp, Homo sapiens
ccatgtgtgag

SEQ ID NO: 3796131 - DNA, 10 bp, Homo sapiens
ccatgtgtgt

SEQ ID NO: 3796132 - DNA, 13 bp, Homo sapiens
ccatgttggccag

SEQ ID NO: 3796133 - DNA, 13 bp, Homo sapiens
ccatgttggctag

SEQ ID NO: 3796134 - DNA, 17 bp, Homo sapiens
ccatgtttaagatttaa

SEQ ID NO: 3796135 - DNA, 18 bp, Homo sapiens
ccatgttttgtttacggt

SEQ ID NO: 3796136 - DNA, 23 bp, Homo sapiens
ccattaaccagggcaccaagccc

SEQ ID NO: 3796137 - DNA, 21 bp, Homo sapiens
ccattcaggaacctggaccaa

SEQ ID NO: 3796138 - DNA, 18 bp, Homo sapiens
ccattccccagcctctct

SEQ ID NO: 3796139 - DNA, 19 bp, Homo sapiens
ccattccccagcctctctt

SEQ ID NO: 3796140 - DNA, 16 bp, Homo sapiens
ccattcctggagcccg

SEQ ID NO: 3796141 - DNA, 17 bp, Homo sapiens
ccattctcaagccctgc

SEQ ID NO: 3796142 - DNA, 17 bp, Homo sapiens
ccattctgcctgcccag

SEQ ID NO: 3796143 - DNA, 20 bp, Homo sapiens
ccattctttattcttttact

SEQ ID NO: 3796144 - DNA, 13 bp, Homo sapiens
ccattctttgctt

SEQ ID NO: 3796145 - DNA, 15 bp, Homo sapiens
ccattgccaccagga

SEQ ID NO: 3796146 - DNA, 16 bp, Homo sapiens
ccattgccaccaggag

SEQ ID NO: 3796147 - DNA, 17 bp, Homo sapiens
ccattgccaccaggaga

SEQ ID NO: 3796148 - DNA, 15 bp, Homo sapiens
ccattgctgctcctt

SEQ ID NO: 3796149 - DNA, 10 bp, Homo sapiens
ccattgcttc

SEQ ID NO: 3796150 - DNA, 12 bp, Homo sapiens
ccattgcttcac

SEQ ID NO: 3796151 - DNA, 14 bp, Homo sapiens
ccattgtctttata

SEQ ID NO: 3796152 - DNA, 13 bp, Homo sapiens
ccatttacacttt

SEQ ID NO: 3796153 - DNA, 16 bp, Homo sapiens
ccatttcatctatttc

SEQ ID NO: 3796154 - DNA, 17 bp, Homo sapiens
ccatttcatctatttct

SEQ ID NO: 3796155 - DNA, 21 bp, Homo sapiens
ccatttcatctatttctgaga

SEQ ID NO: 3796156 - DNA, 12 bp, Homo sapiens
ccatttctattt

SEQ ID NO: 3796157 - DNA, 16 bp, Homo sapiens
ccatttgctttttcac

SEQ ID NO: 3796158 - DNA, 18 bp, Homo sapiens
ccatttgtaataaagtat

SEQ ID NO: 3796159 - DNA, 22 bp, Homo sapiens
ccattttggggtacccactgct

SEQ ID NO: 3796160 - DNA, 14 bp, Homo sapiens
cccaaaaccacagc

SEQ ID NO: 3796161 - DNA, 20 bp, Homo sapiens
cccaaacaaatatgcaaaag

SEQ ID NO: 3796162 - DNA, 12 bp, Homo sapiens
cccaaacctgga

SEQ ID NO: 3796163 - DNA, 12 bp, Homo sapiens
cccaaagaagga

SEQ ID NO: 3796164 - DNA, 12 bp, Homo sapiens
cccaaagagctg

SEQ ID NO: 3796165 - DNA, 14 bp, Homo sapiens
cccaaagccagaca

SEQ ID NO: 3796166 - DNA, 21 bp, Homo sapiens
cccaaaggaagctttctctgc

SEQ ID NO: 3796167 - DNA, 16 bp, Homo sapiens
cccaaagtgctgggat

SEQ ID NO: 3796168 - DNA, 15 bp, Homo sapiens
cccaaccctgcccct

SEQ ID NO: 3796169 - DNA, 21 bp, Homo sapiens
cccaacctgctctcctcttgc

SEQ ID NO: 3796170 - DNA, 14 bp, Homo sapiens
cccaagaacagcag

SEQ ID NO: 3796171 - DNA, 22 bp, Homo sapiens
cccaagaacagcaggcccacct

SEQ ID NO: 3796172 - DNA, 14 bp, Homo sapiens
cccaagaaggctgg

SEQ ID NO: 3796173 - DNA, 16 bp, Homo sapiens
cccaagaaggctgggg

SEQ ID NO: 3796174 - DNA, 18 bp, Homo sapiens
cccaagacagatgcccca

SEQ ID NO: 3796175 - DNA, 20 bp, Homo sapiens
cccaagacagatgccccaga

SEQ ID NO: 3796176 - DNA, 17 bp, Homo sapiens
cccaagagatgaagagt

SEQ ID NO: 3796177 - DNA, 19 bp, Homo sapiens
cccaagctgttttcttcta

SEQ ID NO: 3796178 - DNA, 23 bp, Homo sapiens
cccaaggcaaggggtgcctggga

SEQ ID NO: 3796179 - DNA, 17 bp, Homo sapiens
cccaaggctctgagcaa

SEQ ID NO: 3796180 - DNA, 12 bp, Homo sapiens
cccaaggggcag

SEQ ID NO: 3796181 - DNA, 21 bp, Homo sapiens
cccaaggggcagtctggaggg

SEQ ID NO: 3796182 - DNA, 21 bp, Homo sapiens
cccaagtccaggtcgggctca

SEQ ID NO: 3796183 - DNA, 23 bp, Homo sapiens
cccaagtgggggcagagggcaga

SEQ ID NO: 3796184 - DNA, 19 bp, Homo sapiens
cccaataagatacatcaca

SEQ ID NO: 3796185 - DNA, 22 bp, Homo sapiens
cccaatatcctcgctcccggga

SEQ ID NO: 3796186 - DNA, 15 bp, Homo sapiens
cccaattaggaagtg

SEQ ID NO: 3796187 - DNA, 19 bp, Homo sapiens
cccaattaggaagtgtaac

SEQ ID NO: 3796188 - DNA, 13 bp, Homo sapiens
cccacacctcagt

SEQ ID NO: 3796189 - DNA, 15 bp, Homo sapiens
cccacacctggccct

SEQ ID NO: 3796190 - DNA, 14 bp, Homo sapiens
cccacactaacctg

SEQ ID NO: 3796191 - DNA, 17 bp, Homo sapiens
cccacacttgttccagc

SEQ ID NO: 3796192 - DNA, 12 bp, Homo sapiens
cccacagaaaga

SEQ ID NO: 3796193 - DNA, 13 bp, Homo sapiens
cccacagaaagag

SEQ ID NO: 3796194 - DNA, 16 bp, Homo sapiens
cccacagaaagagagc

SEQ ID NO: 3796195 - DNA, 18 bp, Homo sapiens
cccacagcctctgcctgt

SEQ ID NO: 3796196 - DNA, 18 bp, Homo sapiens
cccacatgaggacatgat

SEQ ID NO: 3796197 - DNA, 15 bp, Homo sapiens
cccaccaccccagct

SEQ ID NO: 3796198 - DNA, 20 bp, Homo sapiens
cccaccacctaggccactcc

SEQ ID NO: 3796199 - DNA, 16 bp, Homo sapiens
cccaccaggctgctca

SEQ ID NO: 3796200 - DNA, 22 bp, Homo sapiens
cccaccaggctgctcagggctg

SEQ ID NO: 3796201 - DNA, 18 bp, Homo sapiens
cccaccatcatgtctggc

SEQ ID NO: 3796202 - DNA, 13 bp, Homo sapiens
cccaccccacact

SEQ ID NO: 3796203 - DNA, 12 bp, Homo sapiens
cccacccccatc

SEQ ID NO: 3796204 - DNA, 23 bp, Homo sapiens
cccacccccttcagtgcccacca

SEQ ID NO: 3796205 - DNA, 22 bp, Homo sapiens
cccacccccttctctgctccac

SEQ ID NO: 3796206 - DNA, 17 bp, Homo sapiens
cccaccccttccccact

SEQ ID NO: 3796207 - DNA, 22 bp, Homo sapiens
cccaccccttccccactgcctg

SEQ ID NO: 3796208 - DNA, 23 bp, Homo sapiens
cccaccgggctgggagctctgca

SEQ ID NO: 3796209 - DNA, 17 bp, Homo sapiens
cccaccggttgcttctg

SEQ ID NO: 3796210 - DNA, 21 bp, Homo sapiens
cccacctcagcctcccaaagt

SEQ ID NO: 3796211 - DNA, 13 bp, Homo sapiens
cccacctcctgca

SEQ ID NO: 3796212 - DNA, 13 bp, Homo sapiens
cccacctgagctt

SEQ ID NO: 3796213 - DNA, 17 bp, Homo sapiens
cccacctgagctttgga

SEQ ID NO: 3796214 - DNA, 13 bp, Homo sapiens
cccacctgcccat

SEQ ID NO: 3796215 - DNA, 21 bp, Homo sapiens
cccacctttattaaaatctta

SEQ ID NO: 3796216 - DNA, 21 bp, Homo sapiens
cccacgactgcccggcagggt

SEQ ID NO: 3796217 - DNA, 22 bp, Homo sapiens
cccacgccctcattacggctcc

SEQ ID NO: 3796218 - DNA, 17 bp, Homo sapiens
cccacgttctctctgcc

SEQ ID NO: 3796219 - DNA, 23 bp, Homo sapiens
cccacgttctctctgcctgtgag

SEQ ID NO: 3796220 - DNA, 23 bp, Homo sapiens
cccactcaagccaagcagccaag

SEQ ID NO: 3796221 - DNA, 11 bp, Homo sapiens
cccactctccc

SEQ ID NO: 3796222 - DNA, 14 bp, Homo sapiens
cccactctccccac

SEQ ID NO: 3796223 - DNA, 19 bp, Homo sapiens
cccactgcaggccccgctt

SEQ ID NO: 3796224 - DNA, 15 bp, Homo sapiens
cccactgcctgccca

SEQ ID NO: 3796225 - DNA, 16 bp, Homo sapiens
cccactgcctgcccac

SEQ ID NO: 3796226 - DNA, 12 bp, Homo sapiens
cccactgctctg

SEQ ID NO: 3796227 - DNA, 19 bp, Homo sapiens
cccactgcttttggtctgt

SEQ ID NO: 3796228 - DNA, 22 bp, Homo sapiens
cccactgcttttggtctgtgtg

SEQ ID NO: 3796229 - DNA, 12 bp, Homo sapiens
cccactggctgt

SEQ ID NO: 3796230 - DNA, 15 bp, Homo sapiens
cccactggctgtggg

SEQ ID NO: 3796231 - DNA, 23 bp, Homo sapiens
cccactggctgtgggctcccttc

SEQ ID NO: 3796232 - DNA, 14 bp, Homo sapiens
cccagaacacactc

SEQ ID NO: 3796233 - DNA, 18 bp, Homo sapiens
cccagaacacactccatc

SEQ ID NO: 3796234 - DNA, 15 bp, Homo sapiens
cccagaacctgtcct

SEQ ID NO: 3796235 - DNA, 19 bp, Homo sapiens
cccagaaggacctcctgag

SEQ ID NO: 3796236 - DNA, 21 bp, Homo sapiens
cccagaatgtcagattccttt

SEQ ID NO: 3796237 - DNA, 17 bp, Homo sapiens
cccagaattcccagctg

SEQ ID NO: 3796238 - DNA, 23 bp, Homo sapiens
cccttgtgcgtgggtgaagccgc

SEQ ID NO: 3796239 - DNA, 21 bp, Homo sapiens
ccctttccttccttccctggc

SEQ ID NO: 3796240 - DNA, 15 bp, Homo sapiens
ccctttcttggccag

SEQ ID NO: 3796241 - DNA, 24 bp, Homo sapiens
ccctttggagaacgccagtctccc

SEQ ID NO: 3796242 - DNA, 16 bp, Homo sapiens
ccctttgggaggctga

SEQ ID NO: 3796243 - DNA, 16 bp, Homo sapiens
cccttttgttccccag

SEQ ID NO: 3796244 - DNA, 16 bp, Homo sapiens
ccctttttactcccct

SEQ ID NO: 3796245 - DNA, 19 bp, Homo sapiens
ccgaaagggacttggaagc

SEQ ID NO: 3796246 - DNA, 19 bp, Homo sapiens
ccgaagaagggtccttccc

SEQ ID NO: 3796247 - DNA, 15 bp, Homo sapiens
ccgacaaccgatgct

SEQ ID NO: 3796248 - DNA, 15 bp, Homo sapiens
ccgaccacctgccca

SEQ ID NO: 3796249 - DNA, 18 bp, Homo sapiens
ccgaccagacaccttgac

SEQ ID NO: 3796250 - DNA, 19 bp, Homo sapiens
ccgaccgaggctggagctg

SEQ ID NO: 3796251 - DNA, 12 bp, Homo sapiens
ccgacctcagcc

SEQ ID NO: 3796252 - DNA, 13 bp, Homo sapiens
ccgagaagaacag

SEQ ID NO: 3796253 - DNA, 17 bp, Homo sapiens
ccgagaaggaagcctcc

SEQ ID NO: 3796254 - DNA, 13 bp, Homo sapiens
ccgagagcctgct

SEQ ID NO: 3796255 - DNA, 14 bp, Homo sapiens
ccgagagcctgctc

SEQ ID NO: 3796256 - DNA, 16 bp, Homo sapiens
ccgagagtagccgaga

SEQ ID NO: 3796257 - DNA, 20 bp, Homo sapiens
ccgagagtagccgagagcct

SEQ ID NO: 3796258 - DNA, 11 bp, Homo sapiens
ccgagctgggg

SEQ ID NO: 3796259 - DNA, 16 bp, Homo sapiens
ccgagctggtgcatta

SEQ ID NO: 3796260 - DNA, 14 bp, Homo sapiens
ccgaggaaactcag

SEQ ID NO: 3796261 - DNA, 19 bp, Homo sapiens
ccgaggcaccagtgtcctc

SEQ ID NO: 3796262 - DNA, 20 bp, Homo sapiens
ccgaggcagggtcaggagag

SEQ ID NO: 3796263 - DNA, 14 bp, Homo sapiens
ccgagtagctggga

SEQ ID NO: 3796264 - DNA, 14 bp, Homo sapiens
ccgagtctcttctc

SEQ ID NO: 3796265 - DNA, 20 bp, Homo sapiens
ccgagtctcttctccactgg

SEQ ID NO: 3796266 - DNA, 14 bp, Homo sapiens
ccgatgctccagcc

SEQ ID NO: 3796267 - DNA, 21 bp, Homo sapiens
ccgcaatgtgcccccagacgc

SEQ ID NO: 3796268 - DNA, 13 bp, Homo sapiens
ccgcaccccagag

SEQ ID NO: 3796269 - DNA, 15 bp, Homo sapiens
ccgcacccccaccct

SEQ ID NO: 3796270 - DNA, 13 bp, Homo sapiens
ccgcaggaagctg

SEQ ID NO: 3796271 - DNA, 14 bp, Homo sapiens
ccgcaggaagctgc

SEQ ID NO: 3796272 - DNA, 19 bp, Homo sapiens
ccgcatcttctccatctgg

SEQ ID NO: 3796273 - DNA, 20 bp, Homo sapiens
ccgcatcttctccatctggc

SEQ ID NO: 3796274 - DNA, 16 bp, Homo sapiens
ccgcatgcggcccagg

SEQ ID NO: 3796275 - DNA, 17 bp, Homo sapiens
ccgcatgcggcccagga

SEQ ID NO: 3796276 - DNA, 14 bp, Homo sapiens
ccgcattccaggct

SEQ ID NO: 3796277 - DNA, 13 bp, Homo sapiens
ccgcattccctga

SEQ ID NO: 3796278 - DNA, 14 bp, Homo sapiens
ccgcattccctgag

SEQ ID NO: 3796279 - DNA, 12 bp, Homo sapiens
ccgccaggcgag

SEQ ID NO: 3796280 - DNA, 17 bp, Homo sapiens
ccgcccagctgcacctg

SEQ ID NO: 3796281 - DNA, 22 bp, Homo sapiens
ccgcccagctgcacctgccagc

SEQ ID NO: 3796282 - DNA, 13 bp, Homo sapiens
ccgccccacattc

SEQ ID NO: 3796283 - DNA, 14 bp, Homo sapiens
ccgccccgccccac

SEQ ID NO: 3796284 - DNA, 19 bp, Homo sapiens
ccgcccgaggtggctgcct

SEQ ID NO: 3796285 - DNA, 16 bp, Homo sapiens
ccgccctgtaccctct

SEQ ID NO: 3796286 - DNA, 14 bp, Homo sapiens
ccgcctcccagcct

SEQ ID NO: 3796287 - DNA, 15 bp, Homo sapiens
ccgcctcccagcctg

SEQ ID NO: 3796288 - DNA, 16 bp, Homo sapiens
ccgcgcctccttcctt

SEQ ID NO: 3796289 - DNA, 19 bp, Homo sapiens
ccgctcagccctccctgcc

SEQ ID NO: 3796290 - DNA, 17 bp, Homo sapiens
ccgctcctgtctgccag

SEQ ID NO: 3796291 - DNA, 16 bp, Homo sapiens
ccgctgccagcacaga

SEQ ID NO: 3796292 - DNA, 19 bp, Homo sapiens
ccgctgcctaagtggctgc

SEQ ID NO: 3796293 - DNA, 22 bp, Homo sapiens
ccgctggctgggggcctcactc

SEQ ID NO: 3796294 - DNA, 18 bp, Homo sapiens
ccgctgttcacccacagg

SEQ ID NO: 3796295 - DNA, 19 bp, Homo sapiens
ccgctgttcacccacaggg

SEQ ID NO: 3796296 - DNA, 21 bp, Homo sapiens
ccgctgttcacccacagggct

SEQ ID NO: 3796297 - DNA, 19 bp, Homo sapiens
ccgctttctacccagcgag

SEQ ID NO: 3796298 - DNA, 19 bp, Homo sapiens
ccggagattggacggcctg

SEQ ID NO: 3796299 - DNA, 20 bp, Homo sapiens
ccggagattggacggcctga

SEQ ID NO: 3796300 - DNA, 21 bp, Homo sapiens
ccggagattggacggcctgat

SEQ ID NO: 3796301 - DNA, 20 bp, Homo sapiens
ccggagctaacactggcccc

SEQ ID NO: 3796302 - DNA, 15 bp, Homo sapiens
ccggaggggcctggc

SEQ ID NO: 3796303 - DNA, 16 bp, Homo sapiens
ccggaggggcctggca

SEQ ID NO: 3796304 - DNA, 17 bp, Homo sapiens
ccggaggggcctggcag

SEQ ID NO: 3796305 - DNA, 14 bp, Homo sapiens
ccggccagctggga

SEQ ID NO: 3796306 - DNA, 13 bp, Homo sapiens
ccggcccctgctg

SEQ ID NO: 3796307 - DNA, 14 bp, Homo sapiens
ccggcccctgctgg

SEQ ID NO: 3796308 - DNA, 23 bp, Homo sapiens
ccggctatgggggcactgaggac

SEQ ID NO: 3796309 - DNA, 13 bp, Homo sapiens
ccgggccacagag

SEQ ID NO: 3796310 - DNA, 20 bp, Homo sapiens
ccgggcgcggtggctcacgc

SEQ ID NO: 3796311 - DNA, 16 bp, Homo sapiens
ccgggctctctgctgt

SEQ ID NO: 3796312 - DNA, 19 bp, Homo sapiens
ccggggcagctgccagaga

SEQ ID NO: 3796313 - DNA, 17 bp, Homo sapiens
ccggggcctgcctagca

SEQ ID NO: 3796314 - DNA, 19 bp, Homo sapiens
ccggggctggcggctactc

SEQ ID NO: 3796315 - DNA, 21 bp, Homo sapiens
ccgggtttggcgggccaagga

SEQ ID NO: 3796316 - DNA, 15 bp, Homo sapiens
ccggtggaaggcctt

SEQ ID NO: 3796317 - DNA, 11 bp, Homo sapiens
ccggtgtcctt

SEQ ID NO: 3796318 - DNA, 14 bp, Homo sapiens
ccggttgcttctgg

SEQ ID NO: 3796319 - DNA, 15 bp, Homo sapiens
ccggttgcttctggg

SEQ ID NO: 3796320 - DNA, 16 bp, Homo sapiens
ccggttgcttctggga

SEQ ID NO: 3796321 - DNA, 18 bp, Homo sapiens
ccgtacattcaatgttta

SEQ ID NO: 3796322 - DNA, 20 bp, Homo sapiens
ccgtagaaatccccctttct

SEQ ID NO: 3796323 - DNA, 17 bp, Homo sapiens
ccgtcagccaaatgtaa

SEQ ID NO: 3796324 - DNA, 16 bp, Homo sapiens
ccgtcatgttcctcaa

SEQ ID NO: 3796325 - DNA, 17 bp, Homo sapiens
ccgtcatgttcctcaaa

SEQ ID NO: 3796326 - DNA, 17 bp, Homo sapiens
ccgtctggggttcagcc

SEQ ID NO: 3796327 - DNA, 20 bp, Homo sapiens
ccgtctggggttcagcccct

SEQ ID NO: 3796328 - DNA, 13 bp, Homo sapiens
ccgtctgtgaatt

SEQ ID NO: 3796329 - DNA, 14 bp, Homo sapiens
ccgtgaggatgtca

SEQ ID NO: 3796330 - DNA, 20 bp, Homo sapiens
ccgtgatccatccatctcca

SEQ ID NO: 3796331 - DNA, 23 bp, Homo sapiens
ccgtgatccatccatctccaggg

SEQ ID NO: 3796332 - DNA, 14 bp, Homo sapiens
ccgtgcagactgga

SEQ ID NO: 3796333 - DNA, 17 bp, Homo sapiens
ccgtgcagactggaggg

SEQ ID NO: 3796334 - DNA, 19 bp, Homo sapiens
ccgtgcagactggagggga

SEQ ID NO: 3796335 - DNA, 15 bp, Homo sapiens
ccgtgccttcagctc

SEQ ID NO: 3796336 - DNA, 16 bp, Homo sapiens
ccgtgccttcagctct

SEQ ID NO: 3796337 - DNA, 22 bp, Homo sapiens
ccgtgcttgtttgctcacctgg

SEQ ID NO: 3796338 - DNA, 23 bp, Homo sapiens
ccgtgcttgtttgctcacctggg

SEQ ID NO: 3796339 - DNA, 11 bp, Homo sapiens
ccgtggcttcc

SEQ ID NO: 3796340 - DNA, 16 bp, Homo sapiens
ccgtgtgccctcgggc

SEQ ID NO: 3796341 - DNA, 13 bp, Homo sapiens
ccgtgtggcccct

SEQ ID NO: 3796342 - DNA, 14 bp, Homo sapiens
ccgttactctccaa

SEQ ID NO: 3796343 - DNA, 22 bp, Homo sapiens
ccgttactctccaacctggaca

SEQ ID NO: 3796344 - DNA, 19 bp, Homo sapiens
ccgtttccaggtgtttata

SEQ ID NO: 3796345 - DNA, 23 bp, Homo sapiens
cctaaaaggaaatctcaccccat

SEQ ID NO: 3796346 - DNA, 19 bp, Homo sapiens
cctaaataaacacatagat

SEQ ID NO: 3796347 - DNA, 18 bp, Homo sapiens
cctaacacagcatgtgta

SEQ ID NO: 3796348 - DNA, 12 bp, Homo sapiens
cctaaccccttt

SEQ ID NO: 3796349 - DNA, 15 bp, Homo sapiens
cctaacccctttcct

SEQ ID NO: 3796350 - DNA, 19 bp, Homo sapiens
cctaagggctcaccgtggc

SEQ ID NO: 3796351 - DNA, 18 bp, Homo sapiens
cctaagtccctgccccct

SEQ ID NO: 3796352 - DNA, 19 bp, Homo sapiens
cctgcattcacccagacag

SEQ ID NO: 3796353 - DNA, 16 bp, Homo sapiens
cctgccaccctgggga

SEQ ID NO: 3796354 - DNA, 16 bp, Homo sapiens
cctgccacctgctgct

SEQ ID NO: 3796355 - DNA, 19 bp, Homo sapiens
cctgccactaggctgggtg

SEQ ID NO: 3796356 - DNA, 13 bp, Homo sapiens
cctgccagcaccc

SEQ ID NO: 3796357 - DNA, 14 bp, Homo sapiens
cctgccagcacccc

SEQ ID NO: 3796358 - DNA, 13 bp, Homo sapiens
cctgccagcctgg

SEQ ID NO: 3796359 - DNA, 13 bp, Homo sapiens
cctgccagtgcct

SEQ ID NO: 3796360 - DNA, 22 bp, Homo sapiens
cctgccagtgccttacctcctg

SEQ ID NO: 3796361 - DNA, 17 bp, Homo sapiens
cctgccatttgcaccct

SEQ ID NO: 3796362 - DNA, 13 bp, Homo sapiens
cctgcccacccgt

SEQ ID NO: 3796363 - DNA, 13 bp, Homo sapiens
cctgcccacctgt

SEQ ID NO: 3796364 - DNA, 18 bp, Homo sapiens
cctgcccagatcccagaa

SEQ ID NO: 3796365 - DNA, 20 bp, Homo sapiens
cctgcccaggagagccagcc

SEQ ID NO: 3796366 - DNA, 13 bp, Homo sapiens
cctgcccaggccc

SEQ ID NO: 3796367 - DNA, 21 bp, Homo sapiens
cctgcccaggcccctgccacc

SEQ ID NO: 3796368 - DNA, 22 bp, Homo sapiens
cctgcccaggcccctgccaccc

SEQ ID NO: 3796369 - DNA, 12 bp, Homo sapiens
cctgcccagtgt

SEQ ID NO: 3796370 - DNA, 13 bp, Homo sapiens
cctgcccagtgtt

SEQ ID NO: 3796371 - DNA, 23 bp, Homo sapiens
cctgcccagtgttgtttgtaaat

SEQ ID NO: 3796372 - DNA, 20 bp, Homo sapiens
cctgcccccacacctggccc

SEQ ID NO: 3796373 - DNA, 22 bp, Homo sapiens
cctgcccccagaccttttatcc

SEQ ID NO: 3796374 - DNA, 18 bp, Homo sapiens
cctgcccccttctcccac

SEQ ID NO: 3796375 - DNA, 21 bp, Homo sapiens
cctgcccccttctcccacact

SEQ ID NO: 3796376 - DNA, 22 bp, Homo sapiens
cctgccccgtcaccatctcagg

SEQ ID NO: 3796377 - DNA, 15 bp, Homo sapiens
cctgcccctcccttc

SEQ ID NO: 3796378 - DNA, 17 bp, Homo sapiens
cctgcccctgccccgtc

SEQ ID NO: 3796379 - DNA, 19 bp, Homo sapiens
cctgccccttctacactct

SEQ ID NO: 3796380 - DNA, 22 bp, Homo sapiens
cctgccccttctacactctcct

SEQ ID NO: 3796381 - DNA, 14 bp, Homo sapiens
cctgccctagctcc

SEQ ID NO: 3796382 - DNA, 16 bp, Homo sapiens
cctgccctagctccac

SEQ ID NO: 3796383 - DNA, 16 bp, Homo sapiens
cctgcccttcagcatc

SEQ ID NO: 3796384 - DNA, 16 bp, Homo sapiens
cctgcccttgtcccac

SEQ ID NO: 3796385 - DNA, 21 bp, Homo sapiens
cctgccgcccgaggtggctgc

SEQ ID NO: 3796386 - DNA, 15 bp, Homo sapiens
cctgcctagcactca

SEQ ID NO: 3796387 - DNA, 21 bp, Homo sapiens
cctgcctagcactcacatgct

SEQ ID NO: 3796388 - DNA, 14 bp, Homo sapiens
cctgcctcagcctc

SEQ ID NO: 3796389 - DNA, 21 bp, Homo sapiens
cctgcctcttaaataaacctt

SEQ ID NO: 3796390 - DNA, 11 bp, Homo sapiens
cctgcctggcc

SEQ ID NO: 3796391 - DNA, 13 bp, Homo sapiens
cctgcctggccag

SEQ ID NO: 3796392 - DNA, 15 bp, Homo sapiens
cctgcgaaggggccc

SEQ ID NO: 3796393 - DNA, 13 bp, Homo sapiens
cctgcgtggctga

SEQ ID NO: 3796394 - DNA, 19 bp, Homo sapiens
cctgcgtggctgacccccc

SEQ ID NO: 3796395 - DNA, 22 bp, Homo sapiens
cctgcgttttggaagctctgaa

SEQ ID NO: 3796396 - DNA, 14 bp, Homo sapiens
cctgctatttccca

SEQ ID NO: 3796397 - DNA, 20 bp, Homo sapiens
cctgctatttcccaagctgg

SEQ ID NO: 3796398 - DNA, 12 bp, Homo sapiens
cctgctccagct

SEQ ID NO: 3796399 - DNA, 13 bp, Homo sapiens
cctgctccagctg

SEQ ID NO: 3796400 - DNA, 22 bp, Homo sapiens
cctgctccagctgttcagctgg

SEQ ID NO: 3796401 - DNA, 16 bp, Homo sapiens
cctgctcccccacccc

SEQ ID NO: 3796402 - DNA, 18 bp, Homo sapiens
cctgctcccccaccccct

SEQ ID NO: 3796403 - DNA, 18 bp, Homo sapiens
cctgctctcctcttgcca

SEQ ID NO: 3796404 - DNA, 22 bp, Homo sapiens
cctgctctcctcttgccactgc

SEQ ID NO: 3796405 - DNA, 14 bp, Homo sapiens
cctgctctctaccc

SEQ ID NO: 3796406 - DNA, 19 bp, Homo sapiens
cctgctctctacccagccc

SEQ ID NO: 3796407 - DNA, 21 bp, Homo sapiens
cctgctctctacccagcccat

SEQ ID NO: 3796408 - DNA, 17 bp, Homo sapiens
cctgctgagggaccagc

SEQ ID NO: 3796409 - DNA, 17 bp, Homo sapiens
cctgctgccccagctga

SEQ ID NO: 3796410 - DNA, 14 bp, Homo sapiens
cctgctgccgcctc

SEQ ID NO: 3796411 - DNA, 18 bp, Homo sapiens
cctgctgccgcctcccag

SEQ ID NO: 3796412 - DNA, 21 bp, Homo sapiens
cctgctgccgcctcccagcct

SEQ ID NO: 3796413 - DNA, 15 bp, Homo sapiens
cctgctgcctcccca

SEQ ID NO: 3796414 - DNA, 20 bp, Homo sapiens
cctgctgcctccccaaccct

SEQ ID NO: 3796415 - DNA, 15 bp, Homo sapiens
cctgctggatctccc

SEQ ID NO: 3796416 - DNA, 13 bp, Homo sapiens
cctgctggcccct

SEQ ID NO: 3796417 - DNA, 15 bp, Homo sapiens
cctgctggcccctca

SEQ ID NO: 3796418 - DNA, 17 bp, Homo sapiens
cctgctggcccctcacc

SEQ ID NO: 3796419 - DNA, 18 bp, Homo sapiens
cctgctggcccctcacct

SEQ ID NO: 3796420 - DNA, 21 bp, Homo sapiens
cctgctggcccctcacctggg

SEQ ID NO: 3796421 - DNA, 12 bp, Homo sapiens
cctgctggtcaa

SEQ ID NO: 3796422 - DNA, 14 bp, Homo sapiens
cctgcttcaaatat

SEQ ID NO: 3796423 - DNA, 15 bp, Homo sapiens
cctgcttgtccctgc

SEQ ID NO: 3796424 - DNA, 18 bp, Homo sapiens
cctgctttgggctgccct

SEQ ID NO: 3796425 - DNA, 19 bp, Homo sapiens
cctgctttgggctgccctg

SEQ ID NO: 3796426 - DNA, 20 bp, Homo sapiens
cctgctttgggctgccctgg

SEQ ID NO: 3796427 - DNA, 23 bp, Homo sapiens
cctgctttgggctgccctggtgc

SEQ ID NO: 3796428 - DNA, 21 bp, Homo sapiens
cctggaaaggctcagtctcag

SEQ ID NO: 3796429 - DNA, 22 bp, Homo sapiens
cctggaaatatcagttactcag

SEQ ID NO: 3796430 - DNA, 17 bp, Homo sapiens
cctggaagctgtgtcct

SEQ ID NO: 3796431 - DNA, 20 bp, Homo sapiens
cctggaaggacatccatgtt

SEQ ID NO: 3796432 - DNA, 16 bp, Homo sapiens
cctggaccagatgctg

SEQ ID NO: 3796433 - DNA, 14 bp, Homo sapiens
cctggaccctgtgg

SEQ ID NO: 3796434 - DNA, 17 bp, Homo sapiens
cctggactggtggcccc

SEQ ID NO: 3796435 - DNA, 22 bp, Homo sapiens
cctggactggtggcccctgcct

SEQ ID NO: 3796436 - DNA, 13 bp, Homo sapiens
cctggagaactag

SEQ ID NO: 3796437 - DNA, 14 bp, Homo sapiens
cctggagcccgagg

SEQ ID NO: 3796438 - DNA, 20 bp, Homo sapiens
cctggagcccgaggcaccag

SEQ ID NO: 3796439 - DNA, 13 bp, Homo sapiens
cctggagctcctg

SEQ ID NO: 3796440 - DNA, 22 bp, Homo sapiens
cctggaggaaccgaaaggccaa

SEQ ID NO: 3796441 - DNA, 22 bp, Homo sapiens
cctggatgaagttatctggctt

SEQ ID NO: 3796442 - DNA, 18 bp, Homo sapiens
cctggcacccggcccctg

SEQ ID NO: 3796443 - DNA, 22 bp, Homo sapiens
cctggcacccggcccctgctgg

SEQ ID NO: 3796444 - DNA, 22 bp, Homo sapiens
cctggcactataatgtaagctc

SEQ ID NO: 3796445 - DNA, 12 bp, Homo sapiens
cctggcagccgt

SEQ ID NO: 3796446 - DNA, 21 bp, Homo sapiens
cctggcagccgtgccttcagc

SEQ ID NO: 3796447 - DNA, 22 bp, Homo sapiens
cctggcagccgtgccttcagct

SEQ ID NO: 3796448 - DNA, 15 bp, Homo sapiens
cctggcatggcacct

SEQ ID NO: 3796449 - DNA, 18 bp, Homo sapiens
cctggcatggcacctgtc

SEQ ID NO: 3796450 - DNA, 14 bp, Homo sapiens
cctggccaacatgg

SEQ ID NO: 3796451 - DNA, 12 bp, Homo sapiens
cctggccagagg

SEQ ID NO: 3796452 - DNA, 15 bp, Homo sapiens
cctggccagatgcac

SEQ ID NO: 3796453 - DNA, 21 bp, Homo sapiens
cctggccagatgcaccagccc

SEQ ID NO: 3796454 - DNA, 18 bp, Homo sapiens
cctggccaggagctcttc

SEQ ID NO: 3796455 - DNA, 19 bp, Homo sapiens
cctggccaggagctcttca

SEQ ID NO: 3796456 - DNA, 20 bp, Homo sapiens
cctggccaggagctcttcag

SEQ ID NO: 3796457 - DNA, 21 bp, Homo sapiens
cctggccaggagctcttcagg

SEQ ID NO: 3796458 - DNA, 22 bp, Homo sapiens
cctggccaggagctcttcaggc

SEQ ID NO: 3796459 - DNA, 14 bp, Homo sapiens
cctggccaggcaga

SEQ ID NO: 3796460 - DNA, 14 bp, Homo sapiens
cctggccatctctg

SEQ ID NO: 3796461 - DNA, 13 bp, Homo sapiens
cctggcccactgc

SEQ ID NO: 3796462 - DNA, 16 bp, Homo sapiens
cctggcccactgcatc

SEQ ID NO: 3796463 - DNA, 14 bp, Homo sapiens
cctggccccatgtc

SEQ ID NO: 3796464 - DNA, 17 bp, Homo sapiens
cctggccccatgtctct

SEQ ID NO: 3796465 - DNA, 21 bp, Homo sapiens
ccttgcccagggctcagcctg

SEQ ID NO: 3796466 - DNA, 14 bp, Homo sapiens
ccttgcctcctgtg

SEQ ID NO: 3796467 - DNA, 15 bp, Homo sapiens
ccttgcctcctgtgt

SEQ ID NO: 3796468 - DNA, 12 bp, Homo sapiens
ccttgctacctc

SEQ ID NO: 3796469 - DNA, 17 bp, Homo sapiens
ccttgctacctcaaggg

SEQ ID NO: 3796470 - DNA, 18 bp, Homo sapiens
ccttgcttatgacatcac

SEQ ID NO: 3796471 - DNA, 12 bp, Homo sapiens
ccttggaggcca

SEQ ID NO: 3796472 - DNA, 16 bp, Homo sapiens
ccttggaggccagcca

SEQ ID NO: 3796473 - DNA, 19 bp, Homo sapiens
ccttggcatcacagggcag

SEQ ID NO: 3796474 - DNA, 21 bp, Homo sapiens
ccttggcatgccttccagcac

SEQ ID NO: 3796475 - DNA, 13 bp, Homo sapiens
ccttggcctcaga

SEQ ID NO: 3796476 - DNA, 14 bp, Homo sapiens
ccttggcctcagaa

SEQ ID NO: 3796477 - DNA, 22 bp, Homo sapiens
ccttggcctgtctcatccccag

SEQ ID NO: 3796478 - DNA, 18 bp, Homo sapiens
ccttggctcaatcctcta

SEQ ID NO: 3796479 - DNA, 19 bp, Homo sapiens
ccttgggaggccccactgg

SEQ ID NO: 3796480 - DNA, 14 bp, Homo sapiens
ccttggggcaggca

SEQ ID NO: 3796481 - DNA, 14 bp, Homo sapiens
ccttggtctaactt

SEQ ID NO: 3796482 - DNA, 15 bp, Homo sapiens
ccttggtgtccacct

SEQ ID NO: 3796483 - DNA, 21 bp, Homo sapiens
ccttggtgtccacctggcccc

SEQ ID NO: 3796484 - DNA, 15 bp, Homo sapiens
ccttgtggcacattt

SEQ ID NO: 3796485 - DNA, 22 bp, Homo sapiens
ccttgtttgattttagctgcag

SEQ ID NO: 3796486 - DNA, 20 bp, Homo sapiens
ccttgttttgtgacattttt

SEQ ID NO: 3796487 - DNA, 21 bp, Homo sapiens
cctttagcacgtttaaagttc

SEQ ID NO: 3796488 - DNA, 23 bp, Homo sapiens
cctttagcacgtttaaagttctg

SEQ ID NO: 3796489 - DNA, 21 bp, Homo sapiens
cctttcacagagcagagtctg

SEQ ID NO: 3796490 - DNA, 20 bp, Homo sapiens
cctttcagggaatttcagga

SEQ ID NO: 3796491 - DNA, 20 bp, Homo sapiens
cctttccagtggcctggctc

SEQ ID NO: 3796492 - DNA, 20 bp, Homo sapiens
cctttccctccactccttcc

SEQ ID NO: 3796493 - DNA, 12 bp, Homo sapiens
cctttcccttta

SEQ ID NO: 3796494 - DNA, 11 bp, Homo sapiens
cctttcctgtt

SEQ ID NO: 3796495 - DNA, 12 bp, Homo sapiens
cctttccttcct

SEQ ID NO: 3796496 - DNA, 13 bp, Homo sapiens
cctttccttcctt

SEQ ID NO: 3796497 - DNA, 19 bp, Homo sapiens
cctttcgcccacagtctga

SEQ ID NO: 3796498 - DNA, 14 bp, Homo sapiens
cctttctcccaggc

SEQ ID NO: 3796499 - DNA, 13 bp, Homo sapiens
cctttcttggcca

SEQ ID NO: 3796500 - DNA, 19 bp, Homo sapiens
cctttgctccaccccactc

SEQ ID NO: 3796501 - DNA, 20 bp, Homo sapiens
cctttgctccaccccactca

SEQ ID NO: 3796502 - DNA, 14 bp, Homo sapiens
cctttgctcttgca

SEQ ID NO: 3796503 - DNA, 21 bp, Homo sapiens
cctttggagaacgccagtctc

SEQ ID NO: 3796504 - DNA, 18 bp, Homo sapiens
cctttggggggggcccgc

SEQ ID NO: 3796505 - DNA, 14 bp, Homo sapiens
cctttgttgctcag

SEQ ID NO: 3796506 - DNA, 19 bp, Homo sapiens
cctttgtttttatgaagaa

SEQ ID NO: 3796507 - DNA, 21 bp, Homo sapiens
ccttttagcctagttcatcca

SEQ ID NO: 3796508 - DNA, 20 bp, Homo sapiens
ccttttcgcaggattcttcc

SEQ ID NO: 3796509 - DNA, 13 bp, Homo sapiens
ccttttctcttca

SEQ ID NO: 3796510 - DNA, 12 bp, Homo sapiens
ccttttggcccc

SEQ ID NO: 3796511 - DNA, 19 bp, Homo sapiens
ccttttggcccccgagctg

SEQ ID NO: 3796512 - DNA, 20 bp, Homo sapiens
ccttttggcccccgagctgg

SEQ ID NO: 3796513 - DNA, 19 bp, Homo sapiens
ccttttgtaccatggtgtg

SEQ ID NO: 3796514 - DNA, 15 bp, Homo sapiens
cctttttactcccct

SEQ ID NO: 3796515 - DNA, 23 bp, Homo sapiens
cctttttactccccttgagctga

SEQ ID NO: 3796516 - DNA, 22 bp, Homo sapiens
cgaaaatcatataatcttacaa

SEQ ID NO: 3796517 - DNA, 14 bp, Homo sapiens
cgaaaccccatctc

SEQ ID NO: 3796518 - DNA, 13 bp, Homo sapiens
cgaaactggaagt

SEQ ID NO: 3796519 - DNA, 18 bp, Homo sapiens
cgaaactggaagttattt

SEQ ID NO: 3796520 - DNA, 19 bp, Homo sapiens
cgaaagctgggcaacatgc

SEQ ID NO: 3796521 - DNA, 19 bp, Homo sapiens
cgaaagggacttggaagct

SEQ ID NO: 3796522 - DNA, 22 bp, Homo sapiens
cgaacatggaactcattcctgc

SEQ ID NO: 3796523 - DNA, 12 bp, Homo sapiens
cgaactggctgc

SEQ ID NO: 3796524 - DNA, 15 bp, Homo sapiens
cgaagctcagcccac

SEQ ID NO: 3796525 - DNA, 23 bp, Homo sapiens
cgaaggaaaagggctttctcaat

SEQ ID NO: 3796526 - DNA, 13 bp, Homo sapiens
cgaaggggccctg

SEQ ID NO: 3796527 - DNA, 16 bp, Homo sapiens
cgaatagctgggacta

SEQ ID NO: 3796528 - DNA, 21 bp, Homo sapiens
cgaatcacgaggtcaggagtt

SEQ ID NO: 3796529 - DNA, 18 bp, Homo sapiens
cgaatcagctatttactg

SEQ ID NO: 3796530 - DNA, 21 bp, Homo sapiens
cgacaaagctgctaaatctcc

SEQ ID NO: 3796531 - DNA, 22 bp, Homo sapiens
cgacagagggaagaaaagagct

SEQ ID NO: 3796532 - DNA, 13 bp, Homo sapiens
cgacagcctggca

SEQ ID NO: 3796533 - DNA, 14 bp, Homo sapiens
cgacagcctggcac

SEQ ID NO: 3796534 - DNA, 15 bp, Homo sapiens
cgaccagagccccac

SEQ ID NO: 3796535 - DNA, 13 bp, Homo sapiens
cgacctcagcctt

SEQ ID NO: 3796536 - DNA, 17 bp, Homo sapiens
cgactgccatcttggac

SEQ ID NO: 3796537 - DNA, 19 bp, Homo sapiens
cgactgtgacctgtgggga

SEQ ID NO: 3796538 - DNA, 15 bp, Homo sapiens
cgagaccagcctggc

SEQ ID NO: 3796539 - DNA, 15 bp, Homo sapiens
cgagactctgtctca

SEQ ID NO: 3796540 - DNA, 18 bp, Homo sapiens
cgagacttggtttcaaaa

SEQ ID NO: 3796541 - DNA, 14 bp, Homo sapiens
cgagagtctgtctc

SEQ ID NO: 3796542 - DNA, 15 bp, Homo sapiens
cgagagtctgtctca

SEQ ID NO: 3796543 - DNA, 16 bp, Homo sapiens
cgagatcacgccactg

SEQ ID NO: 3796544 - DNA, 20 bp, Homo sapiens
cgagattgcaccactgcact

SEQ ID NO: 3796545 - DNA, 23 bp, Homo sapiens
cgagcagtcctgcctcagcctcc

SEQ ID NO: 3796546 - DNA, 13 bp, Homo sapiens
cgagctgggggcc

SEQ ID NO: 3796547 - DNA, 15 bp, Homo sapiens
cgagctggtgcatta

SEQ ID NO: 3796548 - DNA, 16 bp, Homo sapiens
cgaggaaccagagcca

SEQ ID NO: 3796549 - DNA, 19 bp, Homo sapiens
cgaggaaccagagccatgg

SEQ ID NO: 3796550 - DNA, 14 bp, Homo sapiens
cgaggcagggtcag

SEQ ID NO: 3796551 - DNA, 13 bp, Homo sapiens
cgaggcccgcatg

SEQ ID NO: 3796552 - DNA, 16 bp, Homo sapiens
cgaggctggagctggc

SEQ ID NO: 3796553 - DNA, 17 bp, Homo sapiens
cgaggctgggccaagcc

SEQ ID NO: 3796554 - DNA, 19 bp, Homo sapiens
cgaggggagggtggcaggt

SEQ ID NO: 3796555 - DNA, 14 bp, Homo sapiens
cgagggtcctggct

SEQ ID NO: 3796556 - DNA, 15 bp, Homo sapiens
cgagggtcctggctc

SEQ ID NO: 3796557 - DNA, 20 bp, Homo sapiens
cgaggtggatcacagaggct

SEQ ID NO: 3796558 - DNA, 16 bp, Homo sapiens
cgagtagctgggacta

SEQ ID NO: 3796559 - DNA, 16 bp, Homo sapiens
cgagtcaatcccctca

SEQ ID NO: 3796560 - DNA, 12 bp, Homo sapiens
cgagtcactgcc

SEQ ID NO: 3796561 - DNA, 18 bp, Homo sapiens
cgagtctcttctccactg

SEQ ID NO: 3796562 - DNA, 17 bp, Homo sapiens
cgagtggatagatgccc

SEQ ID NO: 3796563 - DNA, 21 bp, Homo sapiens
cgagtggatagatgccctgct

SEQ ID NO: 3796564 - DNA, 13 bp, Homo sapiens
cgagtgggaagga

SEQ ID NO: 3796565 - DNA, 18 bp, Homo sapiens
cgagtgtgtgcatgtgtg

SEQ ID NO: 3796566 - DNA, 22 bp, Homo sapiens
cgagttgtggaaagcctctgct

SEQ ID NO: 3796567 - DNA, 20 bp, Homo sapiens
cgatacaccgggcctggaga

SEQ ID NO: 3796568 - DNA, 21 bp, Homo sapiens
cgatacaccgggcctggagaa

SEQ ID NO: 3796569 - DNA, 19 bp, Homo sapiens
cgatcatggctcactgcag

SEQ ID NO: 3796570 - DNA, 20 bp, Homo sapiens
cgatcatggctcactgcagc

SEQ ID NO: 3796571 - DNA, 23 bp, Homo sapiens
cgatgaatttggagactctgtgg

SEQ ID NO: 3796572 - DNA, 20 bp, Homo sapiens
cgatgatgcttgtaacaaga

SEQ ID NO: 3796573 - DNA, 21 bp, Homo sapiens
cgatgatgcttgtaacaagaa

SEQ ID NO: 3796574 - DNA, 18 bp, Homo sapiens
cgatgctccagccaaccc

SEQ ID NO: 3796575 - DNA, 20 bp, Homo sapiens
cgatgctccagccaacccct

SEQ ID NO: 3796576 - DNA, 21 bp, Homo sapiens
cgatgggcccaattcttacaa

SEQ ID NO: 3796577 - DNA, 18 bp, Homo sapiens
cgatgggggatgcttcat

SEQ ID NO: 3796578 - DNA, 15 bp, Homo sapiens
ctacttcctgcactg

SEQ ID NO: 3796579 - DNA, 15 bp, Homo sapiens
ctacttcctgcctgg

SEQ ID NO: 3796580 - DNA, 15 bp, Homo sapiens
ctacttgagaggctg

SEQ ID NO: 3796581 - DNA, 21 bp, Homo sapiens
ctagaacacaggcaaaatcct

SEQ ID NO: 3796582 - DNA, 13 bp, Homo sapiens
ctagaagaaatga

SEQ ID NO: 3796583 - DNA, 15 bp, Homo sapiens
ctagaagaaatgaaa

SEQ ID NO: 3796584 - DNA, 16 bp, Homo sapiens
ctagaagaaatgaaat

SEQ ID NO: 3796585 - DNA, 21 bp, Homo sapiens
ctagaagaaatgaaattttac

SEQ ID NO: 3796586 - DNA, 23 bp, Homo sapiens
ctagaagggccagtcctgcctgg

SEQ ID NO: 3796587 - DNA, 17 bp, Homo sapiens
ctagaagtgggccagga

SEQ ID NO: 3796588 - DNA, 19 bp, Homo sapiens
ctagaagtgggccaggaca

SEQ ID NO: 3796589 - DNA, 15 bp, Homo sapiens
ctagaatttattcaa

SEQ ID NO: 3796590 - DNA, 13 bp, Homo sapiens
ctagacaaccctg

SEQ ID NO: 3796591 - DNA, 15 bp, Homo sapiens
ctagacaaccctgca

SEQ ID NO: 3796592 - DNA, 22 bp, Homo sapiens
ctagagcttcaagtctgtgcct

SEQ ID NO: 3796593 - DNA, 23 bp, Homo sapiens
ctagagcttcaagtctgtgcctg

SEQ ID NO: 3796594 - DNA, 19 bp, Homo sapiens
ctagagtcctcactcccag

SEQ ID NO: 3796595 - DNA, 13 bp, Homo sapiens
ctagataaaaaga

SEQ ID NO: 3796596 - DNA, 16 bp, Homo sapiens
ctagataaaaagatgg

SEQ ID NO: 3796597 - DNA, 15 bp, Homo sapiens
ctagatcagaacagg

SEQ ID NO: 3796598 - DNA, 17 bp, Homo sapiens
ctagatccacacacaga

SEQ ID NO: 3796599 - DNA, 18 bp, Homo sapiens
ctagatccacacacagag

SEQ ID NO: 3796600 - DNA, 19 bp, Homo sapiens
ctagatccacacacagagg

SEQ ID NO: 3796601 - DNA, 23 bp, Homo sapiens
ctagatgagcccagccctgttct

SEQ ID NO: 3796602 - DNA, 16 bp, Homo sapiens
ctagcactcacatgct

SEQ ID NO: 3796603 - DNA, 17 bp, Homo sapiens
ctagcactcacatgctg

SEQ ID NO: 3796604 - DNA, 21 bp, Homo sapiens
ctagcactcacatgctggaca

SEQ ID NO: 3796605 - DNA, 16 bp, Homo sapiens
ctagcacttggagcca

SEQ ID NO: 3796606 - DNA, 19 bp, Homo sapiens
ctagccctctcacatttat

SEQ ID NO: 3796607 - DNA, 17 bp, Homo sapiens
ctagccgacctcagcct

SEQ ID NO: 3796608 - DNA, 18 bp, Homo sapiens
ctagccgacctcagcctt

SEQ ID NO: 3796609 - DNA, 19 bp, Homo sapiens
ctagcctgtgcctctggga

SEQ ID NO: 3796610 - DNA, 22 bp, Homo sapiens
ctagctaatggaaaatgatttt

SEQ ID NO: 3796611 - DNA, 19 bp, Homo sapiens
ctagctggaattttttatt

SEQ ID NO: 3796612 - DNA, 24 bp, Homo sapiens
ctagctggaattttttattcttgt

SEQ ID NO: 3796613 - DNA, 15 bp, Homo sapiens
ctaggactctgaggc

SEQ ID NO: 3796614 - DNA, 16 bp, Homo sapiens
ctaggactctgaggct

SEQ ID NO: 3796615 - DNA, 13 bp, Homo sapiens
ctaggagcactgt

SEQ ID NO: 3796616 - DNA, 16 bp, Homo sapiens
ctaggagctgggagga

SEQ ID NO: 3796617 - DNA, 19 bp, Homo sapiens
ctaggagctgggaggaaaa

SEQ ID NO: 3796618 - DNA, 20 bp, Homo sapiens
ctaggatgttgctcagaagt

SEQ ID NO: 3796619 - DNA, 22 bp, Homo sapiens
ctaggcagttagagatgcctcc

SEQ ID NO: 3796620 - DNA, 15 bp, Homo sapiens
ctaggcatcccaggg

SEQ ID NO: 3796621 - DNA, 19 bp, Homo sapiens
ctaggcatcccaggggacc

SEQ ID NO: 3796622 - DNA, 19 bp, Homo sapiens
ctaggccacaccatctcct

SEQ ID NO: 3796623 - DNA, 13 bp, Homo sapiens
ctaggcctggcca

SEQ ID NO: 3796624 - DNA, 14 bp, Homo sapiens
ctaggcctggccag

SEQ ID NO: 3796625 - DNA, 15 bp, Homo sapiens
ctaggcctggccaga

SEQ ID NO: 3796626 - DNA, 17 bp, Homo sapiens
ctaggctggagcccagg

SEQ ID NO: 3796627 - DNA, 23 bp, Homo sapiens
ctaggcttcagcatatttatagc

SEQ ID NO: 3796628 - DNA, 19 bp, Homo sapiens
ctagggaaaaaccagcgtg

SEQ ID NO: 3796629 - DNA, 14 bp, Homo sapiens
ctagggaaggccac

SEQ ID NO: 3796630 - DNA, 16 bp, Homo sapiens
ctagggaaggccacct

SEQ ID NO: 3796631 - DNA, 23 bp, Homo sapiens
ctagggaggaccttatctgtgcg

SEQ ID NO: 3796632 - DNA, 19 bp, Homo sapiens
ctagggatgttctggccct

SEQ ID NO: 3796633 - DNA, 16 bp, Homo sapiens
ctagggattcaggctg

SEQ ID NO: 3796634 - DNA, 18 bp, Homo sapiens
ctagggattcaggctgct

SEQ ID NO: 3796635 - DNA, 15 bp, Homo sapiens
ctaggtcaaggcctg

SEQ ID NO: 3796636 - DNA, 20 bp, Homo sapiens
ctaggtcaaggcctgtccct

SEQ ID NO: 3796637 - DNA, 19 bp, Homo sapiens
ctaggtcagtacccacctg

SEQ ID NO: 3796638 - DNA, 20 bp, Homo sapiens
ctaggtcagtacccacctga

SEQ ID NO: 3796639 - DNA, 17 bp, Homo sapiens
ctaggtgggccagcccc

SEQ ID NO: 3796640 - DNA, 23 bp, Homo sapiens
ctaggtgggccagcccctcccac

SEQ ID NO: 3796641 - DNA, 22 bp, Homo sapiens
ctagtacttgggagacctgtaa

SEQ ID NO: 3796642 - DNA, 18 bp, Homo sapiens
ctagtcagagagagtgtt

SEQ ID NO: 3796643 - DNA, 13 bp, Homo sapiens
ctagtctgtgtgc

SEQ ID NO: 3796644 - DNA, 15 bp, Homo sapiens
ctagtgatggtcaga

SEQ ID NO: 3796645 - DNA, 19 bp, Homo sapiens
ctagtgcagctgattttaa

SEQ ID NO: 3796646 - DNA, 22 bp, Homo sapiens
ctagtgcagctgattttaacaa

SEQ ID NO: 3796647 - DNA, 18 bp, Homo sapiens
ctagtgccctccacagcc

SEQ ID NO: 3796648 - DNA, 13 bp, Homo sapiens
ctagtgctgaagc

SEQ ID NO: 3796649 - DNA, 20 bp, Homo sapiens
ctagtgctgaagcttattaa

SEQ ID NO: 3796650 - DNA, 22 bp, Homo sapiens
ctagtgctgaagcttattaatg

SEQ ID NO: 3796651 - DNA, 21 bp, Homo sapiens
ctagtggggtctccctctcct

SEQ ID NO: 3796652 - DNA, 22 bp, Homo sapiens
ctagtggggtctccctctcctg

SEQ ID NO: 3796653 - DNA, 23 bp, Homo sapiens
ctagtggggtctccctctcctgc

SEQ ID NO: 3796654 - DNA, 19 bp, Homo sapiens
ctagtggtggctctgagaa

SEQ ID NO: 3796655 - DNA, 20 bp, Homo sapiens
ctagttcagacactttggaa

SEQ ID NO: 3796656 - DNA, 20 bp, Homo sapiens
ctagttcatccaatcctcac

SEQ ID NO: 3796657 - DNA, 21 bp, Homo sapiens
ctagttcttcatcccactcca

SEQ ID NO: 3796658 - DNA, 13 bp, Homo sapiens
ctataaaacaggt

SEQ ID NO: 3796659 - DNA, 16 bp, Homo sapiens
ctataaatggtgtttt

SEQ ID NO: 3796660 - DNA, 21 bp, Homo sapiens
ctataatgtaagctctactga

SEQ ID NO: 3796661 - DNA, 20 bp, Homo sapiens
ctataattccctatctttta

SEQ ID NO: 3796662 - DNA, 19 bp, Homo sapiens
ctataccccttacttagca

SEQ ID NO: 3796663 - DNA, 13 bp, Homo sapiens
ctatactgcctct

SEQ ID NO: 3796664 - DNA, 20 bp, Homo sapiens
ctatagcctaggtgacagag

SEQ ID NO: 3796665 - DNA, 14 bp, Homo sapiens
ctatagtcccagct

SEQ ID NO: 3796666 - DNA, 16 bp, Homo sapiens
ctatatagtttattga

SEQ ID NO: 3796667 - DNA, 22 bp, Homo sapiens
ctatatagtttattgacaataa

SEQ ID NO: 3796668 - DNA, 22 bp, Homo sapiens
ctatatctgttttactgctttt

SEQ ID NO: 3796669 - DNA, 23 bp, Homo sapiens
ctatatctgttttactgctttta

SEQ ID NO: 3796670 - DNA, 14 bp, Homo sapiens
ctatattgtacaca

SEQ ID NO: 3796671 - DNA, 22 bp, Homo sapiens
ctatattgttttcagtgtacat

SEQ ID NO: 3796672 - DNA, 16 bp, Homo sapiens
ctatatttaacaagat

SEQ ID NO: 3796673 - DNA, 13 bp, Homo sapiens
ctatatttaagta

SEQ ID NO: 3796674 - DNA, 22 bp, Homo sapiens
ctatatttagattgttaaaata

SEQ ID NO: 3796675 - DNA, 16 bp, Homo sapiens
ctatcaaactgaagcc

SEQ ID NO: 3796676 - DNA, 21 bp, Homo sapiens
ctatcaaactgaagccagaaa

SEQ ID NO: 3796677 - DNA, 14 bp, Homo sapiens
ctatcacctcccct

SEQ ID NO: 3796678 - DNA, 15 bp, Homo sapiens
ctatcacctcccctc

SEQ ID NO: 3796679 - DNA, 16 bp, Homo sapiens
ctatcacctcccctcc

SEQ ID NO: 3796680 - DNA, 13 bp, Homo sapiens
ctatccacccagc

SEQ ID NO: 3796681 - DNA, 16 bp, Homo sapiens
ctatccacccagccca

SEQ ID NO: 3796682 - DNA, 19 bp, Homo sapiens
ctatccacccagcccattc

SEQ ID NO: 3796683 - DNA, 12 bp, Homo sapiens
ctatcccatccc

SEQ ID NO: 3796684 - DNA, 13 bp, Homo sapiens
ctatcctggcttt

SEQ ID NO: 3796685 - DNA, 18 bp, Homo sapiens
ctatcctggctttgccca

SEQ ID NO: 3796686 - DNA, 19 bp, Homo sapiens
ctatcctggctttgcccaa

SEQ ID NO: 3796687 - DNA, 22 bp, Homo sapiens
ctatcctggctttgcccaacct

SEQ ID NO: 3796688 - DNA, 14 bp, Homo sapiens
ctatcgagtttgca

SEQ ID NO: 3796689 - DNA, 17 bp, Homo sapiens
ctatggaagcatattgt

SEQ ID NO: 3796690 - DNA, 18 bp, Homo sapiens
ctccctgaccctgcagag

SEQ ID NO: 3796691 - DNA, 12 bp, Homo sapiens
ctccctgatgta

SEQ ID NO: 3796692 - DNA, 18 bp, Homo sapiens
ctccctgcccctcccttc

SEQ ID NO: 3796693 - DNA, 15 bp, Homo sapiens
ctccctgccgcctca

SEQ ID NO: 3796694 - DNA, 16 bp, Homo sapiens
ctccctgccgcctcaa

SEQ ID NO: 3796695 - DNA, 12 bp, Homo sapiens
ctccctggccct

SEQ ID NO: 3796696 - DNA, 21 bp, Homo sapiens
ctccctggcctgttctgtttt

SEQ ID NO: 3796697 - DNA, 11 bp, Homo sapiens
ctccctggctc

SEQ ID NO: 3796698 - DNA, 15 bp, Homo sapiens
ctccctggctctcag

SEQ ID NO: 3796699 - DNA, 14 bp, Homo sapiens
ctccctgtccaccc

SEQ ID NO: 3796700 - DNA, 23 bp, Homo sapiens
ctcccttcaaccattccccatgg

SEQ ID NO: 3796701 - DNA, 14 bp, Homo sapiens
ctcccttcctccca

SEQ ID NO: 3796702 - DNA, 14 bp, Homo sapiens
ctcccttcctcttt

SEQ ID NO: 3796703 - DNA, 15 bp, Homo sapiens
ctccgcagttcctgt

SEQ ID NO: 3796704 - DNA, 23 bp, Homo sapiens
ctccgccattctcaagccctgca

SEQ ID NO: 3796705 - DNA, 15 bp, Homo sapiens
ctccgcctctgctgg

SEQ ID NO: 3796706 - DNA, 19 bp, Homo sapiens
ctccgccttcactccggtg

SEQ ID NO: 3796707 - DNA, 21 bp, Homo sapiens
ctccgccttcactccggtgtg

SEQ ID NO: 3796708 - DNA, 22 bp, Homo sapiens
ctccggaggctgaggcaggaga

SEQ ID NO: 3796709 - DNA, 13 bp, Homo sapiens
ctccggtgtgcct

SEQ ID NO: 3796710 - DNA, 15 bp, Homo sapiens
ctccgtccagccgcc

SEQ ID NO: 3796711 - DNA, 18 bp, Homo sapiens
ctccgtccaggagcctgg

SEQ ID NO: 3796712 - DNA, 22 bp, Homo sapiens
ctccgtcttagaagtggaccag

SEQ ID NO: 3796713 - DNA, 15 bp, Homo sapiens
ctcctacctcagcct

SEQ ID NO: 3796714 - DNA, 13 bp, Homo sapiens
ctcctacctggta

SEQ ID NO: 3796715 - DNA, 22 bp, Homo sapiens
ctcctagcctgtgcctctggga

SEQ ID NO: 3796716 - DNA, 14 bp, Homo sapiens
ctcctatcttcata

SEQ ID NO: 3796717 - DNA, 16 bp, Homo sapiens
ctcctatttttttaaa

SEQ ID NO: 3796718 - DNA, 18 bp, Homo sapiens
ctcctatttttttaaaat

SEQ ID NO: 3796719 - DNA, 14 bp, Homo sapiens
ctcctcaactcacc

SEQ ID NO: 3796720 - DNA, 14 bp, Homo sapiens
ctcctcacccccag

SEQ ID NO: 3796721 - DNA, 15 bp, Homo sapiens
ctcctcacccccagc

SEQ ID NO: 3796722 - DNA, 18 bp, Homo sapiens
ctcctcaccccgtctggg

SEQ ID NO: 3796723 - DNA, 13 bp, Homo sapiens
ctcctcacctctg

SEQ ID NO: 3796724 - DNA, 21 bp, Homo sapiens
ctcctcacctctggactggct

SEQ ID NO: 3796725 - DNA, 15 bp, Homo sapiens
ctcctccagccgcca

SEQ ID NO: 3796726 - DNA, 22 bp, Homo sapiens
ctcctccagccgccatgctcct

SEQ ID NO: 3796727 - DNA, 13 bp, Homo sapiens
ctcctccagggcc

SEQ ID NO: 3796728 - DNA, 20 bp, Homo sapiens
ctcctccagggccacgtgcc

SEQ ID NO: 3796729 - DNA, 12 bp, Homo sapiens
ctcctcccagga

SEQ ID NO: 3796730 - DNA, 17 bp, Homo sapiens
ctcctcccaggcgcccc

SEQ ID NO: 3796731 - DNA, 22 bp, Homo sapiens
ctcctcccaggcgccccttccc

SEQ ID NO: 3796732 - DNA, 15 bp, Homo sapiens
ctcctccctgatgta

SEQ ID NO: 3796733 - DNA, 14 bp, Homo sapiens
ctcctcgcaagctg

SEQ ID NO: 3796734 - DNA, 15 bp, Homo sapiens
ctcctctccccagca

SEQ ID NO: 3796735 - DNA, 22 bp, Homo sapiens
ctcctctccccagcaagtgaga

SEQ ID NO: 3796736 - DNA, 11 bp, Homo sapiens
ctcctctgcca

SEQ ID NO: 3796737 - DNA, 17 bp, Homo sapiens
ctcctctgccacctccc

SEQ ID NO: 3796738 - DNA, 15 bp, Homo sapiens
ctcctctgggcagga

SEQ ID NO: 3796739 - DNA, 12 bp, Homo sapiens
ctcctctgtcca

SEQ ID NO: 3796740 - DNA, 15 bp, Homo sapiens
ctcctctgtccaggg

SEQ ID NO: 3796741 - DNA, 16 bp, Homo sapiens
ctcctctgtccagggc

SEQ ID NO: 3796742 - DNA, 23 bp, Homo sapiens
ctcctcttaaaaaataaaaactg

SEQ ID NO: 3796743 - DNA, 18 bp, Homo sapiens
ctcctcttcaactgacca

SEQ ID NO: 3796744 - DNA, 20 bp, Homo sapiens
ctcctctttgttttgtttta

SEQ ID NO: 3796745 - DNA, 16 bp, Homo sapiens
ctcctgacctgtcacc

SEQ ID NO: 3796746 - DNA, 20 bp, Homo sapiens
ctcctgaggatcagaaagta

SEQ ID NO: 3796747 - DNA, 22 bp, Homo sapiens
ctcctgaggggcatctgcccct

SEQ ID NO: 3796748 - DNA, 12 bp, Homo sapiens
ctcctgcatgca

SEQ ID NO: 3796749 - DNA, 13 bp, Homo sapiens
ctcctgcccagga

SEQ ID NO: 3796750 - DNA, 15 bp, Homo sapiens
ctcctgcccccacac

SEQ ID NO: 3796751 - DNA, 16 bp, Homo sapiens
ctcctgcctactcacg

SEQ ID NO: 3796752 - DNA, 21 bp, Homo sapiens
ctcctgcctcgaactggctgc

SEQ ID NO: 3796753 - DNA, 14 bp, Homo sapiens
ctcctgcctgtgct

SEQ ID NO: 3796754 - DNA, 18 bp, Homo sapiens
ctcctgcctgtgctgtga

SEQ ID NO: 3796755 - DNA, 17 bp, Homo sapiens
ctcctggaaaggctcag

SEQ ID NO: 3796756 - DNA, 20 bp, Homo sapiens
ctcctggaaaggctcagtct

SEQ ID NO: 3796757 - DNA, 23 bp, Homo sapiens
ctcctggaaaggctcagtctcag

SEQ ID NO: 3796758 - DNA, 15 bp, Homo sapiens
ctcctggaagctgtg

SEQ ID NO: 3796759 - DNA, 20 bp, Homo sapiens
ctcctgggcccctccctacc

SEQ ID NO: 3796760 - DNA, 22 bp, Homo sapiens
ctcctgggcccctccctacctc

SEQ ID NO: 3796761 - DNA, 14 bp, Homo sapiens
ctcctgggctcaag

SEQ ID NO: 3796762 - DNA, 22 bp, Homo sapiens
ctcctgggggttctttcttcct

SEQ ID NO: 3796763 - DNA, 13 bp, Homo sapiens
ctcctgtctgcca

SEQ ID NO: 3796764 - DNA, 14 bp, Homo sapiens
ctcctgtctgccag

SEQ ID NO: 3796765 - DNA, 15 bp, Homo sapiens
ctcctgtctgccagc

SEQ ID NO: 3796766 - DNA, 17 bp, Homo sapiens
ctcctgtgcaactttcc

SEQ ID NO: 3796767 - DNA, 20 bp, Homo sapiens
ctcctgtgcatgggtgaagg

SEQ ID NO: 3796768 - DNA, 11 bp, Homo sapiens
ctcctgtgtgt

SEQ ID NO: 3796769 - DNA, 14 bp, Homo sapiens
ctcctgtgtgtgcg

SEQ ID NO: 3796770 - DNA, 20 bp, Homo sapiens
ctcctgtgtgtgcgcctaca

SEQ ID NO: 3796771 - DNA, 21 bp, Homo sapiens
ctcctgtgtgtgcgcctacag

SEQ ID NO: 3796772 - DNA, 23 bp, Homo sapiens
ctcctgtgtgtgcgcctacagga

SEQ ID NO: 3796773 - DNA, 21 bp, Homo sapiens
ctccttagagacatcaaaatc

SEQ ID NO: 3796774 - DNA, 15 bp, Homo sapiens
ctccttagctgccaa

SEQ ID NO: 3796775 - DNA, 15 bp, Homo sapiens
ctccttccaactgct

SEQ ID NO: 3796776 - DNA, 19 bp, Homo sapiens
ctccttccaactgctgccc

SEQ ID NO: 3796777 - DNA, 13 bp, Homo sapiens
ctccttcccagct

SEQ ID NO: 3796778 - DNA, 14 bp, Homo sapiens
ctccttcctgtctt

SEQ ID NO: 3796779 - DNA, 22 bp, Homo sapiens
ctccttgagggcaagagccaca

SEQ ID NO: 3796780 - DNA, 17 bp, Homo sapiens
ctccttgataacagcta

SEQ ID NO: 3796781 - DNA, 18 bp, Homo sapiens
ctccttgcctcctgtgta

SEQ ID NO: 3796782 - DNA, 13 bp, Homo sapiens
ctccttgggaggc

SEQ ID NO: 3796783 - DNA, 16 bp, Homo sapiens
ctccttgggaggcccc

SEQ ID NO: 3796784 - DNA, 20 bp, Homo sapiens
ctcctttaccctcatctgtc

SEQ ID NO: 3796785 - DNA, 17 bp, Homo sapiens
ctcctttcacaaccttc

SEQ ID NO: 3796786 - DNA, 23 bp, Homo sapiens
ctcgaacatggaactcattcctg

SEQ ID NO: 3796787 - DNA, 15 bp, Homo sapiens
ctcgaacccacactg

SEQ ID NO: 3796788 - DNA, 14 bp, Homo sapiens
ctcgaactcctggg

SEQ ID NO: 3796789 - DNA, 13 bp, Homo sapiens
ctcgaactggctg

SEQ ID NO: 3796790 - DNA, 22 bp, Homo sapiens
ctcgactggaggaccacactca

SEQ ID NO: 3796791 - DNA, 23 bp, Homo sapiens
ctcgagcagtcctgcctcagcct

SEQ ID NO: 3796792 - DNA, 21 bp, Homo sapiens
ctcgcatttgtcaatgacagt

SEQ ID NO: 3796793 - DNA, 15 bp, Homo sapiens
ctcgccctgggtcta

SEQ ID NO: 3796794 - DNA, 16 bp, Homo sapiens
ctcgctggcccccact

SEQ ID NO: 3796795 - DNA, 17 bp, Homo sapiens
ctcgctggcccccactg

SEQ ID NO: 3796796 - DNA, 22 bp, Homo sapiens
ctcgctggcccccactggctgt

SEQ ID NO: 3796797 - DNA, 20 bp, Homo sapiens
ctcggaaggctggctgggca

SEQ ID NO: 3796798 - DNA, 21 bp, Homo sapiens
ctcggagtatctgggaactgt

SEQ ID NO: 3796799 - DNA, 20 bp, Homo sapiens
ctcggatcaccgagagtagc

SEQ ID NO: 3796800 - DNA, 23 bp, Homo sapiens
ctcggtgtggagaagcggctggc

SEQ ID NO: 3796801 - DNA, 14 bp, Homo sapiens
ctcgtagccatctc

SEQ ID NO: 3796802 - DNA, 18 bp, Homo sapiens
ctcgtatatgtctcaggt

SEQ ID NO: 3796803 - DNA, 21 bp, Homo sapiens
ctgagatcaaaacggttttac

SEQ ID NO: 3796804 - DNA, 19 bp, Homo sapiens
ctgagattattttaatcta

SEQ ID NO: 3796805 - DNA, 20 bp, Homo sapiens
ctgagcaaatgtggctcctg

SEQ ID NO: 3796806 - DNA, 24 bp, Homo sapiens
ctgagcaacagagtgagaccctgt

SEQ ID NO: 3796807 - DNA, 13 bp, Homo sapiens
ctgagcacctccc

SEQ ID NO: 3796808 - DNA, 16 bp, Homo sapiens
ctgagcagactggtga

SEQ ID NO: 3796809 - DNA, 13 bp, Homo sapiens
ctgagcagggaga

SEQ ID NO: 3796810 - DNA, 14 bp, Homo sapiens
ctgagccacactga

SEQ ID NO: 3796811 - DNA, 19 bp, Homo sapiens
ctgagccacactgaaaagg

SEQ ID NO: 3796812 - DNA, 22 bp, Homo sapiens
ctgagccagtgtcaggaggaag

SEQ ID NO: 3796813 - DNA, 16 bp, Homo sapiens
ctgagcccctgggact

SEQ ID NO: 3796814 - DNA, 12 bp, Homo sapiens
ctgagccctggc

SEQ ID NO: 3796815 - DNA, 15 bp, Homo sapiens
ctgagccctggcagg

SEQ ID NO: 3796816 - DNA, 15 bp, Homo sapiens
ctgagccttgtaatt

SEQ ID NO: 3796817 - DNA, 16 bp, Homo sapiens
ctgagccttgtaattc

SEQ ID NO: 3796818 - DNA, 14 bp, Homo sapiens
ctgagctcctctgg

SEQ ID NO: 3796819 - DNA, 18 bp, Homo sapiens
ctgagcttggccagaagg

SEQ ID NO: 3796820 - DNA, 15 bp, Homo sapiens
ctgagctttctgcta

SEQ ID NO: 3796821 - DNA, 21 bp, Homo sapiens
ctgagctttggacacacacag

SEQ ID NO: 3796822 - DNA, 22 bp, Homo sapiens
ctgagctttggacgcacacagc

SEQ ID NO: 3796823 - DNA, 23 bp, Homo sapiens
ctgagctttggacgcacacagct

SEQ ID NO: 3796824 - DNA, 15 bp, Homo sapiens
ctgaggaaaggccag

SEQ ID NO: 3796825 - DNA, 22 bp, Homo sapiens
ctgaggaaaggccagctggcag

SEQ ID NO: 3796826 - DNA, 19 bp, Homo sapiens
ctgaggaatcaacagggca

SEQ ID NO: 3796827 - DNA, 21 bp, Homo sapiens
ctgaggaatccagacccggct

SEQ ID NO: 3796828 - DNA, 23 bp, Homo sapiens
ctgaggaatccagacccggctgc

SEQ ID NO: 3796829 - DNA, 20 bp, Homo sapiens
ctgaggacactaaccacgct

SEQ ID NO: 3796830 - DNA, 14 bp, Homo sapiens
ctgaggaccagcca

SEQ ID NO: 3796831 - DNA, 11 bp, Homo sapiens
ctgaggagaaa

SEQ ID NO: 3796832 - DNA, 19 bp, Homo sapiens
ctgaggatcagaaagtaat

SEQ ID NO: 3796833 - DNA, 17 bp, Homo sapiens
ctgaggatttcaagcct

SEQ ID NO: 3796834 - DNA, 13 bp, Homo sapiens
ctgaggcagacag

SEQ ID NO: 3796835 - DNA, 16 bp, Homo sapiens
ctgaggcagacagcag

SEQ ID NO: 3796836 - DNA, 22 bp, Homo sapiens
ctgaggcagacagcagctcagg

SEQ ID NO: 3796837 - DNA, 21 bp, Homo sapiens
ctgaggcagggaagtccccag

SEQ ID NO: 3796838 - DNA, 18 bp, Homo sapiens
ctgaggctctttctgggc

SEQ ID NO: 3796839 - DNA, 15 bp, Homo sapiens
ctgaggctgagactg

SEQ ID NO: 3796840 - DNA, 13 bp, Homo sapiens
ctgagggaccagc

SEQ ID NO: 3796841 - DNA, 15 bp, Homo sapiens
ctgagggaccagcca

SEQ ID NO: 3796842 - DNA, 22 bp, Homo sapiens
ctgaggggaggatcactggagc

SEQ ID NO: 3796843 - DNA, 17 bp, Homo sapiens
ctgaggggcatctgccc

SEQ ID NO: 3796844 - DNA, 19 bp, Homo sapiens
ctgaggggcatctgcccct

SEQ ID NO: 3796845 - DNA, 14 bp, Homo sapiens
ctgagtcaccagga

SEQ ID NO: 3796846 - DNA, 18 bp, Homo sapiens
ctgagtcatgatctccct

SEQ ID NO: 3796847 - DNA, 22 bp, Homo sapiens
ctgagtcatgatctccctgccg

SEQ ID NO: 3796848 - DNA, 16 bp, Homo sapiens
ctgagtgagctgaaga

SEQ ID NO: 3796849 - DNA, 22 bp, Homo sapiens
ctgagtgggggatcacagcctc

SEQ ID NO: 3796850 - DNA, 17 bp, Homo sapiens
ctgagttcaagggctgt

SEQ ID NO: 3796851 - DNA, 15 bp, Homo sapiens
ctgagtttaccattt

SEQ ID NO: 3796852 - DNA, 21 bp, Homo sapiens
ctgagtttaccatttgtaata

SEQ ID NO: 3796853 - DNA, 22 bp, Homo sapiens
ctgagtttttaaaaatggacaa

SEQ ID NO: 3796854 - DNA, 21 bp, Homo sapiens
ctgatatatgtgtttttcaca

SEQ ID NO: 3796855 - DNA, 19 bp, Homo sapiens
ctgatattccatgaatgta

SEQ ID NO: 3796856 - DNA, 20 bp, Homo sapiens
ctgatcactatgcattttaa

SEQ ID NO: 3796857 - DNA, 13 bp, Homo sapiens
ctgatcagtctaa

SEQ ID NO: 3796858 - DNA, 19 bp, Homo sapiens
ctgatcagtctaagatggg

SEQ ID NO: 3796859 - DNA, 14 bp, Homo sapiens
ctgatcatgcattg

SEQ ID NO: 3796860 - DNA, 16 bp, Homo sapiens
ctgatcatgcattgtt

SEQ ID NO: 3796861 - DNA, 15 bp, Homo sapiens
ctgatcccactccta

SEQ ID NO: 3796862 - DNA, 13 bp, Homo sapiens
ctgatctcaggga

SEQ ID NO: 3796863 - DNA, 15 bp, Homo sapiens
ctgatctcagggaag

SEQ ID NO: 3796864 - DNA, 20 bp, Homo sapiens
ctgatctgatgcaagcaaga

SEQ ID NO: 3796865 - DNA, 16 bp, Homo sapiens
ctgatcttgtgctcag

SEQ ID NO: 3796866 - DNA, 21 bp, Homo sapiens
ctgatgaactcttaatcaaat

SEQ ID NO: 3796867 - DNA, 15 bp, Homo sapiens
ctgatgaatcttgcg

SEQ ID NO: 3796868 - DNA, 19 bp, Homo sapiens
ctgatgacccaggctgcct

SEQ ID NO: 3796869 - DNA, 23 bp, Homo sapiens
ctgatgagaatttataaattatt

SEQ ID NO: 3796870 - DNA, 21 bp, Homo sapiens
ctgatgatttagagtgctgtc

SEQ ID NO: 3796871 - DNA, 18 bp, Homo sapiens
ctgatgggcaacccccag

SEQ ID NO: 3796872 - DNA, 21 bp, Homo sapiens
ctgatgggcaacccccagcct

SEQ ID NO: 3796873 - DNA, 15 bp, Homo sapiens
ctgatgttaggctgg

SEQ ID NO: 3796874 - DNA, 16 bp, Homo sapiens
ctgatgttaggctggg

SEQ ID NO: 3796875 - DNA, 19 bp, Homo sapiens
ctgatgttaggctgggccc

SEQ ID NO: 3796876 - DNA, 22 bp, Homo sapiens
ctgatgttaggctgggcccaga

SEQ ID NO: 3796877 - DNA, 23 bp, Homo sapiens
ctgatgttaggctgggcccagag

SEQ ID NO: 3796878 - DNA, 13 bp, Homo sapiens
ctgattactgtca

SEQ ID NO: 3796879 - DNA, 11 bp, Homo sapiens
ctgattagaaa

SEQ ID NO: 3796880 - DNA, 22 bp, Homo sapiens
ctgattcccaagctctgctcct

SEQ ID NO: 3796881 - DNA, 17 bp, Homo sapiens
ctgattgtttcattgcg

SEQ ID NO: 3796882 - DNA, 14 bp, Homo sapiens
ctgatttcttgctt

SEQ ID NO: 3796883 - DNA, 12 bp, Homo sapiens
ctgattttaaca

SEQ ID NO: 3796884 - DNA, 17 bp, Homo sapiens
ctgattttaacaataac

SEQ ID NO: 3796885 - DNA, 11 bp, Homo sapiens
ctgcaaaattt

SEQ ID NO: 3796886 - DNA, 21 bp, Homo sapiens
ctgcaaagggtatcaggtgct

SEQ ID NO: 3796887 - DNA, 20 bp, Homo sapiens
ctgcaacctccgcctcttgg

SEQ ID NO: 3796888 - DNA, 22 bp, Homo sapiens
ctgcaacctccgcctcttgggt

SEQ ID NO: 3796889 - DNA, 18 bp, Homo sapiens
ctgcaacttgtaaatgtg

SEQ ID NO: 3796890 - DNA, 20 bp, Homo sapiens
ctgcaagaattgaagcagga

SEQ ID NO: 3796891 - DNA, 19 bp, Homo sapiens
ctgcaagtgagcaaacctg

SEQ ID NO: 3796892 - DNA, 15 bp, Homo sapiens
ctgcaatagagactg

SEQ ID NO: 3796893 - DNA, 19 bp, Homo sapiens
ctgcaatagagactgtaga

SEQ ID NO: 3796894 - DNA, 18 bp, Homo sapiens
ctgcacaagctgcaccct

SEQ ID NO: 3796895 - DNA, 14 bp, Homo sapiens
ctgcaccattgctg

SEQ ID NO: 3796896 - DNA, 17 bp, Homo sapiens
ctgcaccattgctgctc

SEQ ID NO: 3796897 - DNA, 14 bp, Homo sapiens
ctgcaccctcaggc

SEQ ID NO: 3796898 - DNA, 17 bp, Homo sapiens
ctgcaccctcaggcagg

SEQ ID NO: 3796899 - DNA, 11 bp, Homo sapiens
ctgcacctccc

SEQ ID NO: 3796900 - DNA, 19 bp, Homo sapiens
ctgcacctccccccactgc

SEQ ID NO: 3796901 - DNA, 18 bp, Homo sapiens
ctgcacctgccagcctgg

SEQ ID NO: 3796902 - DNA, 16 bp, Homo sapiens
ctgcactatagcctag

SEQ ID NO: 3796903 - DNA, 15 bp, Homo sapiens
ctgcactccagcctg

SEQ ID NO: 3796904 - DNA, 17 bp, Homo sapiens
ctgcactccagcctggg

SEQ ID NO: 3796905 - DNA, 18 bp, Homo sapiens
ctgcactccagcctgggt

SEQ ID NO: 3796906 - DNA, 21 bp, Homo sapiens
ctgcactggagtccagtctct

SEQ ID NO: 3796907 - DNA, 21 bp, Homo sapiens
ctgcagaacgtattggtccag

SEQ ID NO: 3796908 - DNA, 20 bp, Homo sapiens
ctgcagagcaggaaacatga

SEQ ID NO: 3796909 - DNA, 23 bp, Homo sapiens
ctgcagaggggaaaccagtgtag

SEQ ID NO: 3796910 - DNA, 22 bp, Homo sapiens
ctgcagaggggctttctggaga

SEQ ID NO: 3796911 - DNA, 17 bp, Homo sapiens
ctgcagcatgacctgtg

SEQ ID NO: 3796912 - DNA, 22 bp, Homo sapiens
ctgcagcatgacctgtgaccag

SEQ ID NO: 3796913 - DNA, 14 bp, Homo sapiens
ctgcagccagccca

SEQ ID NO: 3796914 - DNA, 19 bp, Homo sapiens
ctgcagcctcaacctcctg

SEQ ID NO: 3796915 - DNA, 14 bp, Homo sapiens
ctgctgctgctgtg

SEQ ID NO: 3796916 - DNA, 15 bp, Homo sapiens
ctgctggcccagcca

SEQ ID NO: 3796917 - DNA, 11 bp, Homo sapiens
ctgctggcccc

SEQ ID NO: 3796918 - DNA, 17 bp, Homo sapiens
ctgctggcccctcacct

SEQ ID NO: 3796919 - DNA, 13 bp, Homo sapiens
ctgctggctgcct

SEQ ID NO: 3796920 - DNA, 15 bp, Homo sapiens
ctgctggctgcctta

SEQ ID NO: 3796921 - DNA, 17 bp, Homo sapiens
ctgctgggctctccacc

SEQ ID NO: 3796922 - DNA, 19 bp, Homo sapiens
ctgctgggctctccacctc

SEQ ID NO: 3796923 - DNA, 21 bp, Homo sapiens
ctgctgggctctccacctcag

SEQ ID NO: 3796924 - DNA, 17 bp, Homo sapiens
ctgctggtcttcaatta

SEQ ID NO: 3796925 - DNA, 13 bp, Homo sapiens
ctgctggttcagg

SEQ ID NO: 3796926 - DNA, 23 bp, Homo sapiens
ctgcttatcaataaacctgtttg

SEQ ID NO: 3796927 - DNA, 14 bp, Homo sapiens
ctgcttcaaatatt

SEQ ID NO: 3796928 - DNA, 13 bp, Homo sapiens
ctgcttcagcctc

SEQ ID NO: 3796929 - DNA, 23 bp, Homo sapiens
ctgcttcagcctcccgagtagct

SEQ ID NO: 3796930 - DNA, 21 bp, Homo sapiens
ctgcttccctctgcctgtccc

SEQ ID NO: 3796931 - DNA, 23 bp, Homo sapiens
ctgcttccctctgcctgtccctc

SEQ ID NO: 3796932 - DNA, 20 bp, Homo sapiens
ctgcttctaccaactggaag

SEQ ID NO: 3796933 - DNA, 14 bp, Homo sapiens
ctgcttctgcacct

SEQ ID NO: 3796934 - DNA, 16 bp, Homo sapiens
ctgcttcttaacccca

SEQ ID NO: 3796935 - DNA, 21 bp, Homo sapiens
ctgcttgaggcaactcatctt

SEQ ID NO: 3796936 - DNA, 18 bp, Homo sapiens
ctgcttgccgaaactgga

SEQ ID NO: 3796937 - DNA, 21 bp, Homo sapiens
ctgcttgtccctgcccagaat

SEQ ID NO: 3796938 - DNA, 13 bp, Homo sapiens
ctgctttggaaat

SEQ ID NO: 3796939 - DNA, 18 bp, Homo sapiens
ctgcttttccctaagcca

SEQ ID NO: 3796940 - DNA, 19 bp, Homo sapiens
ctggaaaataaaaggtcta

SEQ ID NO: 3796941 - DNA, 14 bp, Homo sapiens
ctggaaaggctcag

SEQ ID NO: 3796942 - DNA, 13 bp, Homo sapiens
ctggaagagagga

SEQ ID NO: 3796943 - DNA, 12 bp, Homo sapiens
ctggaagcacag

SEQ ID NO: 3796944 - DNA, 15 bp, Homo sapiens
ctggaagcacagaaa

SEQ ID NO: 3796945 - DNA, 22 bp, Homo sapiens
ctggaagcacagaaaactagaa

SEQ ID NO: 3796946 - DNA, 14 bp, Homo sapiens
ctggaagcacagct

SEQ ID NO: 3796947 - DNA, 15 bp, Homo sapiens
ctggaagcacagctt

SEQ ID NO: 3796948 - DNA, 16 bp, Homo sapiens
ctggaagttatttatt

SEQ ID NO: 3796949 - DNA, 20 bp, Homo sapiens
ctggaagttttgcatttatg

SEQ ID NO: 3796950 - DNA, 18 bp, Homo sapiens
ctggaatacatgaaatat

SEQ ID NO: 3796951 - DNA, 20 bp, Homo sapiens
ctggaatgtaatcaatgttt

SEQ ID NO: 3796952 - DNA, 15 bp, Homo sapiens
ctggaattttttatt

SEQ ID NO: 3796953 - DNA, 20 bp, Homo sapiens
ctggaattttttattcttgt

SEQ ID NO: 3796954 - DNA, 21 bp, Homo sapiens
ctggaattttttattcttgtg

SEQ ID NO: 3796955 - DNA, 17 bp, Homo sapiens
ctggacaggcatgttct

SEQ ID NO: 3796956 - DNA, 13 bp, Homo sapiens
ctggacaggtctg

SEQ ID NO: 3796957 - DNA, 15 bp, Homo sapiens
ctggaccactgggca

SEQ ID NO: 3796958 - DNA, 15 bp, Homo sapiens
ctggaccagatgctg

SEQ ID NO: 3796959 - DNA, 17 bp, Homo sapiens
ctggaccttgaactggg

SEQ ID NO: 3796960 - DNA, 21 bp, Homo sapiens
ctggaccttgaactgggtact

SEQ ID NO: 3796961 - DNA, 13 bp, Homo sapiens
ctggactcaggat

SEQ ID NO: 3796962 - DNA, 15 bp, Homo sapiens
ctggactccagatct

SEQ ID NO: 3796963 - DNA, 16 bp, Homo sapiens
ctggactgaagcctgc

SEQ ID NO: 3796964 - DNA, 19 bp, Homo sapiens
ctggactgaagcctgcagg

SEQ ID NO: 3796965 - DNA, 23 bp, Homo sapiens
ctggactgaagcctgcaggagtt

SEQ ID NO: 3796966 - DNA, 19 bp, Homo sapiens
ctggagaataattctttga

SEQ ID NO: 3796967 - DNA, 21 bp, Homo sapiens
ctggagacaatgcagatgcca

SEQ ID NO: 3796968 - DNA, 16 bp, Homo sapiens
ctggagagtctcactc

SEQ ID NO: 3796969 - DNA, 15 bp, Homo sapiens
ctggagatcaccagt

SEQ ID NO: 3796970 - DNA, 13 bp, Homo sapiens
ctggagccacctg

SEQ ID NO: 3796971 - DNA, 18 bp, Homo sapiens
ctggagccacctgtccca

SEQ ID NO: 3796972 - DNA, 23 bp, Homo sapiens
ctggagccacctgtcccacctca

SEQ ID NO: 3796973 - DNA, 20 bp, Homo sapiens
ctggagcccgaggcaccagt

SEQ ID NO: 3796974 - DNA, 16 bp, Homo sapiens
ctggagctcctgggaa

SEQ ID NO: 3796975 - DNA, 11 bp, Homo sapiens
ctggagctggc

SEQ ID NO: 3796976 - DNA, 19 bp, Homo sapiens
ctggaggaaaactgagact

SEQ ID NO: 3796977 - DNA, 22 bp, Homo sapiens
ctggaggaaggggggttgcagt

SEQ ID NO: 3796978 - DNA, 19 bp, Homo sapiens
ctggaggcagggccttgcc

SEQ ID NO: 3796979 - DNA, 20 bp, Homo sapiens
ctggaggcagggccttgccc

SEQ ID NO: 3796980 - DNA, 13 bp, Homo sapiens
ctggaggcctctg

SEQ ID NO: 3796981 - DNA, 17 bp, Homo sapiens
ctggaggcctctgggcc

SEQ ID NO: 3796982 - DNA, 21 bp, Homo sapiens
ctggaggcctctgggcctcct

SEQ ID NO: 3796983 - DNA, 14 bp, Homo sapiens
ctggaggggcatgg

SEQ ID NO: 3796984 - DNA, 23 bp, Homo sapiens
ctggaggggcatggccagcagct

SEQ ID NO: 3796985 - DNA, 15 bp, Homo sapiens
ctggagtcaaaacac

SEQ ID NO: 3796986 - DNA, 19 bp, Homo sapiens
ctggatagtccgtctctgc

SEQ ID NO: 3796987 - DNA, 15 bp, Homo sapiens
ctggatattttcaaa

SEQ ID NO: 3796988 - DNA, 21 bp, Homo sapiens
ctggatattttcaaattgtat

SEQ ID NO: 3796989 - DNA, 22 bp, Homo sapiens
ctggatattttcaaattgtatc

SEQ ID NO: 3796990 - DNA, 17 bp, Homo sapiens
ctggatcagtcctttga

SEQ ID NO: 3796991 - DNA, 21 bp, Homo sapiens
ctggatctgggaccctttcct

SEQ ID NO: 3796992 - DNA, 20 bp, Homo sapiens
ctggatgaagttatctggct

SEQ ID NO: 3796993 - DNA, 23 bp, Homo sapiens
ctggatgaagttatctggcttca

SEQ ID NO: 3796994 - DNA, 19 bp, Homo sapiens
ctggcaaacttcagactga

SEQ ID NO: 3796995 - DNA, 14 bp, Homo sapiens
ctggcaagaatgtg

SEQ ID NO: 3796996 - DNA, 20 bp, Homo sapiens
ctggcaatagtgtgttctga

SEQ ID NO: 3796997 - DNA, 21 bp, Homo sapiens
ctggcaatgaaaaattctcag

SEQ ID NO: 3796998 - DNA, 22 bp, Homo sapiens
ctggcaatgaaaaattctcagt

SEQ ID NO: 3796999 - DNA, 19 bp, Homo sapiens
ctggcacccggcccctgct

SEQ ID NO: 3797000 - DNA, 22 bp, Homo sapiens
ctggcacccggcccctgctggt

SEQ ID NO: 3797001 - DNA, 15 bp, Homo sapiens
ctggcactataatgt

SEQ ID NO: 3797002 - DNA, 22 bp, Homo sapiens
ctggcactataatgtaagctct

SEQ ID NO: 3797003 - DNA, 21 bp, Homo sapiens
ctggcacttggagacttgtat

SEQ ID NO: 3797004 - DNA, 21 bp, Homo sapiens
ctggcagaaagcaaatgtgac

SEQ ID NO: 3797005 - DNA, 16 bp, Homo sapiens
ctggcagaactgagct

SEQ ID NO: 3797006 - DNA, 19 bp, Homo sapiens
ctggcagaactgagctcct

SEQ ID NO: 3797007 - DNA, 20 bp, Homo sapiens
ctggcagaactgagctcctc

SEQ ID NO: 3797008 - DNA, 11 bp, Homo sapiens
ctggcagccca

SEQ ID NO: 3797009 - DNA, 16 bp, Homo sapiens
ctggcagccccagcac

SEQ ID NO: 3797010 - DNA, 13 bp, Homo sapiens
ctggcagccgtgc

SEQ ID NO: 3797011 - DNA, 19 bp, Homo sapiens
ctggcagccgtgccttcag

SEQ ID NO: 3797012 - DNA, 21 bp, Homo sapiens
ctggcagccgtgccttcagct

SEQ ID NO: 3797013 - DNA, 17 bp, Homo sapiens
ctggcagggtgggatgg

SEQ ID NO: 3797014 - DNA, 19 bp, Homo sapiens
ctggcagtggaactaagaa

SEQ ID NO: 3797015 - DNA, 18 bp, Homo sapiens
ctggcatctgacacaaaa

SEQ ID NO: 3797016 - DNA, 19 bp, Homo sapiens
ctggcatctgacacaaaaa

SEQ ID NO: 3797017 - DNA, 22 bp, Homo sapiens
ctggcatctttgctatggggac

SEQ ID NO: 3797018 - DNA, 23 bp, Homo sapiens
ctggcatctttgctatggggaca

SEQ ID NO: 3797019 - DNA, 15 bp, Homo sapiens
ctggcatggcacctg

SEQ ID NO: 3797020 - DNA, 17 bp, Homo sapiens
ctggcatggcacctgtc

SEQ ID NO: 3797021 - DNA, 16 bp, Homo sapiens
ctggccagatgcacca

SEQ ID NO: 3797022 - DNA, 20 bp, Homo sapiens
ctggccaggagctcttcagg

SEQ ID NO: 3797023 - DNA, 13 bp, Homo sapiens
ctggccatctctg

SEQ ID NO: 3797024 - DNA, 22 bp, Homo sapiens
ctggccatctctgaacttcagc

SEQ ID NO: 3797025 - DNA, 12 bp, Homo sapiens
ctggcccactgc

SEQ ID NO: 3797026 - DNA, 15 bp, Homo sapiens
ctggcccactgcatc

SEQ ID NO: 3797027 - DNA, 17 bp, Homo sapiens
ctggcccagccaaaccc

SEQ ID NO: 3797028 - DNA, 14 bp, Homo sapiens
ctgtctcagcctcc

SEQ ID NO: 3797029 - DNA, 16 bp, Homo sapiens
ctgtctcagtttcact

SEQ ID NO: 3797030 - DNA, 14 bp, Homo sapiens
ctgtctcatcccca

SEQ ID NO: 3797031 - DNA, 13 bp, Homo sapiens
ctgtctccagacc

SEQ ID NO: 3797032 - DNA, 19 bp, Homo sapiens
ctgtctccagacccccacc

SEQ ID NO: 3797033 - DNA, 22 bp, Homo sapiens
ctgtctccagacccccacccct

SEQ ID NO: 3797034 - DNA, 15 bp, Homo sapiens
ctgtctcccctctgc

SEQ ID NO: 3797035 - DNA, 19 bp, Homo sapiens
ctgtctcctacctctgctc

SEQ ID NO: 3797036 - DNA, 20 bp, Homo sapiens
ctgtctcctctctctgtaat

SEQ ID NO: 3797037 - DNA, 14 bp, Homo sapiens
ctgtctgccagcca

SEQ ID NO: 3797038 - DNA, 16 bp, Homo sapiens
ctgtctgccagccagc

SEQ ID NO: 3797039 - DNA, 21 bp, Homo sapiens
ctgtctgccagccagcagcca

SEQ ID NO: 3797040 - DNA, 15 bp, Homo sapiens
ctgtctgctcagaca

SEQ ID NO: 3797041 - DNA, 18 bp, Homo sapiens
ctgtcttcagtaagccgt

SEQ ID NO: 3797042 - DNA, 20 bp, Homo sapiens
ctgtctttcagatacatggt

SEQ ID NO: 3797043 - DNA, 22 bp, Homo sapiens
ctgtgaacgatttagaaagaag

SEQ ID NO: 3797044 - DNA, 16 bp, Homo sapiens
ctgtgaacttggggaa

SEQ ID NO: 3797045 - DNA, 16 bp, Homo sapiens
ctgtgacctgtgggga

SEQ ID NO: 3797046 - DNA, 21 bp, Homo sapiens
ctgtgactgatgttaggctgg

SEQ ID NO: 3797047 - DNA, 22 bp, Homo sapiens
ctgtgactgatgttaggctggg

SEQ ID NO: 3797048 - DNA, 15 bp, Homo sapiens
ctgtgagacccccac

SEQ ID NO: 3797049 - DNA, 16 bp, Homo sapiens
ctgtgagacccccaca

SEQ ID NO: 3797050 - DNA, 20 bp, Homo sapiens
ctgtgagacccccacacctc

SEQ ID NO: 3797051 - DNA, 14 bp, Homo sapiens
ctgtgagccagtct

SEQ ID NO: 3797052 - DNA, 22 bp, Homo sapiens
ctgtgaggtgcagagtgcccag

SEQ ID NO: 3797053 - DNA, 23 bp, Homo sapiens
ctgtgaggtgcagagtgcccaga

SEQ ID NO: 3797054 - DNA, 17 bp, Homo sapiens
ctgtgatgccacacaga

SEQ ID NO: 3797055 - DNA, 15 bp, Homo sapiens
ctgtgcagggaggag

SEQ ID NO: 3797056 - DNA, 22 bp, Homo sapiens
ctgtgcagggaggaggtggcag

SEQ ID NO: 3797057 - DNA, 13 bp, Homo sapiens
ctgtgccacccac

SEQ ID NO: 3797058 - DNA, 11 bp, Homo sapiens
ctgtgcccagc

SEQ ID NO: 3797059 - DNA, 12 bp, Homo sapiens
ctgtgcccagct

SEQ ID NO: 3797060 - DNA, 13 bp, Homo sapiens
ctgtgcctcctca

SEQ ID NO: 3797061 - DNA, 16 bp, Homo sapiens
ctgtgcctcctcaccc

SEQ ID NO: 3797062 - DNA, 14 bp, Homo sapiens
ctgtgcctctggga

SEQ ID NO: 3797063 - DNA, 18 bp, Homo sapiens
ctgtgcctctgggactgg

SEQ ID NO: 3797064 - DNA, 18 bp, Homo sapiens
ctgtgcctggagctcctg

SEQ ID NO: 3797065 - DNA, 14 bp, Homo sapiens
ctgtgcgctgacaa

SEQ ID NO: 3797066 - DNA, 17 bp, Homo sapiens
ctgtgcgttactaattg

SEQ ID NO: 3797067 - DNA, 20 bp, Homo sapiens
ctgtgctagttttacagatt

SEQ ID NO: 3797068 - DNA, 13 bp, Homo sapiens
ctgtgctatgaat

SEQ ID NO: 3797069 - DNA, 18 bp, Homo sapiens
ctgtgctctggacaggca

SEQ ID NO: 3797070 - DNA, 14 bp, Homo sapiens
ctgtggaaaaatat

SEQ ID NO: 3797071 - DNA, 19 bp, Homo sapiens
ctgtggaaaaatatttaag

SEQ ID NO: 3797072 - DNA, 22 bp, Homo sapiens
ctgtggagcccgcacccccacc

SEQ ID NO: 3797073 - DNA, 23 bp, Homo sapiens
ctgtggagcccgcacccccaccc

SEQ ID NO: 3797074 - DNA, 22 bp, Homo sapiens
ctgtggaggtacactcttatag

SEQ ID NO: 3797075 - DNA, 18 bp, Homo sapiens
ctgtggcaggccagctgt

SEQ ID NO: 3797076 - DNA, 21 bp, Homo sapiens
ctgtggcagtaaagagaaact

SEQ ID NO: 3797077 - DNA, 13 bp, Homo sapiens
ctgtggccaaagg

SEQ ID NO: 3797078 - DNA, 22 bp, Homo sapiens
ctgtggccagcttgttatttat

SEQ ID NO: 3797079 - DNA, 23 bp, Homo sapiens
ctgtggccatggtccccaagacc

SEQ ID NO: 3797080 - DNA, 14 bp, Homo sapiens
ctgtggcctgggca

SEQ ID NO: 3797081 - DNA, 20 bp, Homo sapiens
ctgtgggcctcaaggacttg

SEQ ID NO: 3797082 - DNA, 13 bp, Homo sapiens
ctgtgggctccct

SEQ ID NO: 3797083 - DNA, 18 bp, Homo sapiens
ctgtgggctcccttcctc

SEQ ID NO: 3797084 - DNA, 21 bp, Homo sapiens
ctgtggggatttctcccagct

SEQ ID NO: 3797085 - DNA, 23 bp, Homo sapiens
ctgtggtagtactcctgcaaaat

SEQ ID NO: 3797086 - DNA, 17 bp, Homo sapiens
ctgtggttacagtgcag

SEQ ID NO: 3797087 - DNA, 21 bp, Homo sapiens
ctgtggttcctggggtgccct

SEQ ID NO: 3797088 - DNA, 21 bp, Homo sapiens
ctgtggtttccaaggagctga

SEQ ID NO: 3797089 - DNA, 11 bp, Homo sapiens
ctgtgtaactg

SEQ ID NO: 3797090 - DNA, 13 bp, Homo sapiens
ctgtgtaactgcc

SEQ ID NO: 3797091 - DNA, 15 bp, Homo sapiens
ctgtgtaactgccca

SEQ ID NO: 3797092 - DNA, 19 bp, Homo sapiens
ctgtgtaatcatttcttgg

SEQ ID NO: 3797093 - DNA, 21 bp, Homo sapiens
ctgtgtatttaattgtaaact

SEQ ID NO: 3797094 - DNA, 23 bp, Homo sapiens
ctgtgtatttaattgtaaactgt

SEQ ID NO: 3797095 - DNA, 14 bp, Homo sapiens
ctgtgtcactacgt

SEQ ID NO: 3797096 - DNA, 19 bp, Homo sapiens
ctgtgtcagcatagaagta

SEQ ID NO: 3797097 - DNA, 20 bp, Homo sapiens
ctgtgtcagcatagaagtaa

SEQ ID NO: 3797098 - DNA, 23 bp, Homo sapiens
ctgtgtcagggaacatatttaag

SEQ ID NO: 3797099 - DNA, 21 bp, Homo sapiens
ctgtgtcaggtggggcagctt

SEQ ID NO: 3797100 - DNA, 22 bp, Homo sapiens
ctgtgtcaggtggggcagcttg

SEQ ID NO: 3797101 - DNA, 22 bp, Homo sapiens
ctgtgtcatttggctttccagt

SEQ ID NO: 3797102 - DNA, 20 bp, Homo sapiens
ctgtgtccctctctctggaa

SEQ ID NO: 3797103 - DNA, 14 bp, Homo sapiens
ctgtgtccttgcac

SEQ ID NO: 3797104 - DNA, 16 bp, Homo sapiens
ctgtgtctaaatttct

SEQ ID NO: 3797105 - DNA, 17 bp, Homo sapiens
ctgtgtctcttttctct

SEQ ID NO: 3797106 - DNA, 14 bp, Homo sapiens
ctgtgtcttgcaat

SEQ ID NO: 3797107 - DNA, 20 bp, Homo sapiens
ctgtgtcttgcaatggcagc

SEQ ID NO: 3797108 - DNA, 23 bp, Homo sapiens
ctgtgtcttgcaatggcagcctt

SEQ ID NO: 3797109 - DNA, 20 bp, Homo sapiens
ctgtgtcttttttcactaca

SEQ ID NO: 3797110 - DNA, 19 bp, Homo sapiens
ctgtgtgacatcagtggca

SEQ ID NO: 3797111 - DNA, 18 bp, Homo sapiens
ctgtgtggactgtgatgc

SEQ ID NO: 3797112 - DNA, 11 bp, Homo sapiens
ctgtgtggttg

SEQ ID NO: 3797113 - DNA, 16 bp, Homo sapiens
ctgtgtgttttcataa

SEQ ID NO: 3797114 - DNA, 12 bp, Homo sapiens
ctgtgttcctgg

SEQ ID NO: 3797115 - DNA, 18 bp, Homo sapiens
ctgtgttgcgtgtcgtgg

SEQ ID NO: 3797116 - DNA, 20 bp, Homo sapiens
ctgtgttgcgtgtcgtgggt

SEQ ID NO: 3797117 - DNA, 14 bp, Homo sapiens
ctgttaagagagga

SEQ ID NO: 3797118 - DNA, 17 bp, Homo sapiens
ctgttactgtcttcagt

SEQ ID NO: 3797119 - DNA, 13 bp, Homo sapiens
ctgttagaacact

SEQ ID NO: 3797120 - DNA, 19 bp, Homo sapiens
ctgttagaacactattttc

SEQ ID NO: 3797121 - DNA, 22 bp, Homo sapiens
ctgttagaacactattttcaga

SEQ ID NO: 3797122 - DNA, 13 bp, Homo sapiens
ctgttagtcattt

SEQ ID NO: 3797123 - DNA, 14 bp, Homo sapiens
ctgttagtcatttg

SEQ ID NO: 3797124 - DNA, 15 bp, Homo sapiens
ctgttagtcatttgc

SEQ ID NO: 3797125 - DNA, 17 bp, Homo sapiens
ctgttcaatgtttaatg

SEQ ID NO: 3797126 - DNA, 12 bp, Homo sapiens
ctgttcacccac

SEQ ID NO: 3797127 - DNA, 17 bp, Homo sapiens
ctgttcacttttcctcc

SEQ ID NO: 3797128 - DNA, 17 bp, Homo sapiens
ctgttcagcattcttag

SEQ ID NO: 3797129 - DNA, 13 bp, Homo sapiens
ctgttcagctcca

SEQ ID NO: 3797130 - DNA, 22 bp, Homo sapiens
ctgttcagctccagctcaccag

SEQ ID NO: 3797131 - DNA, 19 bp, Homo sapiens
ctgttcagctggttgaggt

SEQ ID NO: 3797132 - DNA, 21 bp, Homo sapiens
ctgttcagctggttgaggttt

SEQ ID NO: 3797133 - DNA, 16 bp, Homo sapiens
ctgttcagtaacaggg

SEQ ID NO: 3797134 - DNA, 12 bp, Homo sapiens
ctgttcattgta

SEQ ID NO: 3797135 - DNA, 21 bp, Homo sapiens
ctgttcctggctcagcctcaa

SEQ ID NO: 3797136 - DNA, 15 bp, Homo sapiens
ctgttccttcacatc

SEQ ID NO: 3797137 - DNA, 22 bp, Homo sapiens
ctgttgaaaagccatgtttaag

SEQ ID NO: 3797138 - DNA, 20 bp, Homo sapiens
ctgttgacatccaagcttcc

SEQ ID NO: 3797139 - DNA, 23 bp, Homo sapiens
ctgttgacatccaagcttccttt

SEQ ID NO: 3797140 - DNA, 15 bp, Homo sapiens
ctgttgagctgtttt

SEQ ID NO: 3797141 - DNA, 14 bp, Homo sapiens
cttgctgtcctagg

SEQ ID NO: 3797142 - DNA, 17 bp, Homo sapiens
cttgctgtcctaggcca

SEQ ID NO: 3797143 - DNA, 16 bp, Homo sapiens
cttgctgtggtctctt

SEQ ID NO: 3797144 - DNA, 20 bp, Homo sapiens
cttggaaaaatccagaaaga

SEQ ID NO: 3797145 - DNA, 23 bp, Homo sapiens
cttggaaagcatcacctcaggcc

SEQ ID NO: 3797146 - DNA, 14 bp, Homo sapiens
cttggaagctccgc

SEQ ID NO: 3797147 - DNA, 19 bp, Homo sapiens
cttggaatatctgctgtat

SEQ ID NO: 3797148 - DNA, 15 bp, Homo sapiens
cttggaggccagcca

SEQ ID NO: 3797149 - DNA, 15 bp, Homo sapiens
cttggaggctgtctt

SEQ ID NO: 3797150 - DNA, 15 bp, Homo sapiens
cttggagggataagc

SEQ ID NO: 3797151 - DNA, 15 bp, Homo sapiens
cttggatgtatatgt

SEQ ID NO: 3797152 - DNA, 20 bp, Homo sapiens
cttggcatgccttccagcac

SEQ ID NO: 3797153 - DNA, 11 bp, Homo sapiens
cttggcctcag

SEQ ID NO: 3797154 - DNA, 12 bp, Homo sapiens
cttggcctcaga

SEQ ID NO: 3797155 - DNA, 23 bp, Homo sapiens
cttggcctcagaattcacaaaat

SEQ ID NO: 3797156 - DNA, 18 bp, Homo sapiens
cttggcgtggagccaggg

SEQ ID NO: 3797157 - DNA, 23 bp, Homo sapiens
cttggctcaagtcctcttttctg

SEQ ID NO: 3797158 - DNA, 14 bp, Homo sapiens
cttggctgcaggga

SEQ ID NO: 3797159 - DNA, 17 bp, Homo sapiens
cttggctgtagaaggag

SEQ ID NO: 3797160 - DNA, 20 bp, Homo sapiens
cttggcttcaggggagtccc

SEQ ID NO: 3797161 - DNA, 15 bp, Homo sapiens
cttgggaggccccac

SEQ ID NO: 3797162 - DNA, 19 bp, Homo sapiens
cttgggaggccccactggg

SEQ ID NO: 3797163 - DNA, 21 bp, Homo sapiens
cttgggaggccccactgggga

SEQ ID NO: 3797164 - DNA, 16 bp, Homo sapiens
cttgggaggcttcccc

SEQ ID NO: 3797165 - DNA, 20 bp, Homo sapiens
cttgggatgatgcctcatga

SEQ ID NO: 3797166 - DNA, 14 bp, Homo sapiens
cttgggccctcctg

SEQ ID NO: 3797167 - DNA, 14 bp, Homo sapiens
cttgggctgagact

SEQ ID NO: 3797168 - DNA, 14 bp, Homo sapiens
cttggggcaggcag

SEQ ID NO: 3797169 - DNA, 13 bp, Homo sapiens
cttggggccatcg

SEQ ID NO: 3797170 - DNA, 16 bp, Homo sapiens
cttggggggctgaggt

SEQ ID NO: 3797171 - DNA, 23 bp, Homo sapiens
cttggtactactagatgtcttta

SEQ ID NO: 3797172 - DNA, 19 bp, Homo sapiens
cttggtacttgctgctatt

SEQ ID NO: 3797173 - DNA, 22 bp, Homo sapiens
cttggtctaacttttgtgtgaa

SEQ ID NO: 3797174 - DNA, 20 bp, Homo sapiens
cttggtgaatttttttttcc

SEQ ID NO: 3797175 - DNA, 15 bp, Homo sapiens
cttggtgtccacctg

SEQ ID NO: 3797176 - DNA, 19 bp, Homo sapiens
cttggtgtccacctggccc

SEQ ID NO: 3797177 - DNA, 21 bp, Homo sapiens
cttggtgtcctttccctccac

SEQ ID NO: 3797178 - DNA, 17 bp, Homo sapiens
cttggttcccttgtgtg

SEQ ID NO: 3797179 - DNA, 17 bp, Homo sapiens
cttggttgggtcctcac

SEQ ID NO: 3797180 - DNA, 18 bp, Homo sapiens
cttgtaaaaattaaaagt

SEQ ID NO: 3797181 - DNA, 16 bp, Homo sapiens
cttgtaaatagctcag

SEQ ID NO: 3797182 - DNA, 18 bp, Homo sapiens
cttgtaagattttgaaaa

SEQ ID NO: 3797183 - DNA, 18 bp, Homo sapiens
cttgtatttaaatattaa

SEQ ID NO: 3797184 - DNA, 20 bp, Homo sapiens
cttgtatttaaatattaaat

SEQ ID NO: 3797185 - DNA, 17 bp, Homo sapiens
cttgtcacaataaatgt

SEQ ID NO: 3797186 - DNA, 22 bp, Homo sapiens
cttgtcactggtagaccaaaat

SEQ ID NO: 3797187 - DNA, 20 bp, Homo sapiens
cttgtccaacccgaggcccg

SEQ ID NO: 3797188 - DNA, 14 bp, Homo sapiens
cttgtccagcgcct

SEQ ID NO: 3797189 - DNA, 18 bp, Homo sapiens
cttgtccagcgcctagtg

SEQ ID NO: 3797190 - DNA, 19 bp, Homo sapiens
cttgtcccactcaagccaa

SEQ ID NO: 3797191 - DNA, 21 bp, Homo sapiens
cttgtcccactcaagccaagc

SEQ ID NO: 3797192 - DNA, 18 bp, Homo sapiens
cttgtcctagcttgggag

SEQ ID NO: 3797193 - DNA, 23 bp, Homo sapiens
cttgtccttttgtaccatggtgt

SEQ ID NO: 3797194 - DNA, 13 bp, Homo sapiens
cttgtctgtagat

SEQ ID NO: 3797195 - DNA, 18 bp, Homo sapiens
cttgtcttaaataaaaga

SEQ ID NO: 3797196 - DNA, 12 bp, Homo sapiens
cttgtgacatat

SEQ ID NO: 3797197 - DNA, 14 bp, Homo sapiens
cttgtgactagtgc

SEQ ID NO: 3797198 - DNA, 17 bp, Homo sapiens
cttgtgactagtgctga

SEQ ID NO: 3797199 - DNA, 19 bp, Homo sapiens
cttgtgactagtgctgaag

SEQ ID NO: 3797200 - DNA, 15 bp, Homo sapiens
cttgtgatctgggaa

SEQ ID NO: 3797201 - DNA, 16 bp, Homo sapiens
cttgtgatctgggaac

SEQ ID NO: 3797202 - DNA, 15 bp, Homo sapiens
cttgtgcagtgttga

SEQ ID NO: 3797203 - DNA, 17 bp, Homo sapiens
cttgtggacacagctct

SEQ ID NO: 3797204 - DNA, 18 bp, Homo sapiens
cttgtggacacagctctt

SEQ ID NO: 3797205 - DNA, 14 bp, Homo sapiens
cttgtggcctggga

SEQ ID NO: 3797206 - DNA, 15 bp, Homo sapiens
cttgtgtctctgtgc

SEQ ID NO: 3797207 - DNA, 17 bp, Homo sapiens
cttgtgtctctgtgctt

SEQ ID NO: 3797208 - DNA, 18 bp, Homo sapiens
cttgtgtctctgtgcttt

SEQ ID NO: 3797209 - DNA, 21 bp, Homo sapiens
cttgtgtctctgtgcttttaa

SEQ ID NO: 3797210 - DNA, 19 bp, Homo sapiens
cttgtgtgtgggctgtgag

SEQ ID NO: 3797211 - DNA, 21 bp, Homo sapiens
cttgtgtgtgggctgtgagtg

SEQ ID NO: 3797212 - DNA, 17 bp, Homo sapiens
cttgtgttggctgtggc

SEQ ID NO: 3797213 - DNA, 14 bp, Homo sapiens
cttgttaatattct

SEQ ID NO: 3797214 - DNA, 15 bp, Homo sapiens
cttgttatttataac

SEQ ID NO: 3797215 - DNA, 20 bp, Homo sapiens
cttgttcaaaatatgttctt

SEQ ID NO: 3797216 - DNA, 16 bp, Homo sapiens
cttgttccagctcttt

SEQ ID NO: 3797217 - DNA, 22 bp, Homo sapiens
cttgttctctctatggtaaaga

SEQ ID NO: 3797218 - DNA, 15 bp, Homo sapiens
cttgttctgttttgt

SEQ ID NO: 3797219 - DNA, 14 bp, Homo sapiens
cttgtttatcagca

SEQ ID NO: 3797220 - DNA, 22 bp, Homo sapiens
cttgtttcaattccacctgcaa

SEQ ID NO: 3797221 - DNA, 22 bp, Homo sapiens
cttgtttgattttagctgcaga

SEQ ID NO: 3797222 - DNA, 16 bp, Homo sapiens
cttgtttgctcacctg

SEQ ID NO: 3797223 - DNA, 20 bp, Homo sapiens
cttgtttgctcacctggggt

SEQ ID NO: 3797224 - DNA, 14 bp, Homo sapiens
cttgttttcagttt

SEQ ID NO: 3797225 - DNA, 21 bp, Homo sapiens
cttgttttttttttccactta

SEQ ID NO: 3797226 - DNA, 20 bp, Homo sapiens
ctttaaaaaaaatccttcta

SEQ ID NO: 3797227 - DNA, 12 bp, Homo sapiens
ctttaatataaa

SEQ ID NO: 3797228 - DNA, 21 bp, Homo sapiens
ctttaatcttcagttttatct

SEQ ID NO: 3797229 - DNA, 22 bp, Homo sapiens
ctttaatcttcagttttatctt

SEQ ID NO: 3797230 - DNA, 17 bp, Homo sapiens
ctttaatgtcacaggca

SEQ ID NO: 3797231 - DNA, 19 bp, Homo sapiens
ctttaatgtcacaggcagg

SEQ ID NO: 3797232 - DNA, 22 bp, Homo sapiens
ctttaatgtcacaggcaggtcc

SEQ ID NO: 3797233 - DNA, 22 bp, Homo sapiens
ctttaattgtgaattgataata

SEQ ID NO: 3797234 - DNA, 12 bp, Homo sapiens
ctttacaaaaag

SEQ ID NO: 3797235 - DNA, 13 bp, Homo sapiens
ctttacaaaaaga

SEQ ID NO: 3797236 - DNA, 20 bp, Homo sapiens
ctttacatggggttttcaat

SEQ ID NO: 3797237 - DNA, 20 bp, Homo sapiens
ctttaccctcatctgtctgg

SEQ ID NO: 3797238 - DNA, 14 bp, Homo sapiens
ctttacgtagtgta

SEQ ID NO: 3797239 - DNA, 20 bp, Homo sapiens
ctttagaattaatttattaa

SEQ ID NO: 3797240 - DNA, 13 bp, Homo sapiens
ctttagagtagca

SEQ ID NO: 3797241 - DNA, 13 bp, Homo sapiens
ctttagcacgttt

SEQ ID NO: 3797242 - DNA, 17 bp, Homo sapiens
ctttagcacgtttaaag

SEQ ID NO: 3797243 - DNA, 19 bp, Homo sapiens
ctttagcacgtttaaagtt

SEQ ID NO: 3797244 - DNA, 20 bp, Homo sapiens
ctttagcacgtttaaagttc

SEQ ID NO: 3797245 - DNA, 18 bp, Homo sapiens
ctttagcagaatcaaaat

SEQ ID NO: 3797246 - DNA, 19 bp, Homo sapiens
ctttatatgaacatagact

SEQ ID NO: 3797247 - DNA, 22 bp, Homo sapiens
ctttatgaatgaaaaaacagtc

SEQ ID NO: 3797248 - DNA, 13 bp, Homo sapiens
ctttatgcaataa

SEQ ID NO: 3797249 - DNA, 14 bp, Homo sapiens
ctttatgcaataaa

SEQ ID NO: 3797250 - DNA, 16 bp, Homo sapiens
ctttatgtaataatgt

SEQ ID NO: 3797251 - DNA, 18 bp, Homo sapiens
ctttattttttaagtatt

SEQ ID NO: 3797252 - DNA, 19 bp, Homo sapiens
ctttcacagtaccatctga

SEQ ID NO: 3797253 - DNA, 16 bp, Homo sapiens
ctttcacatagatgtc

SEQ ID NO: 3797254 - DNA, 17 bp, Homo sapiens
ctttcacccacagaaag

SEQ ID NO: 3797255 - DNA, 10 bp, Homo sapiens
ctttcagaaa

SEQ ID NO: 3797256 - DNA, 19 bp, Homo sapiens
ctttcagatacatggttgt

SEQ ID NO: 3797257 - DNA, 15 bp, Homo sapiens
ctttcagggcctcca

SEQ ID NO: 3797258 - DNA, 16 bp, Homo sapiens
ctttcatccccacctt

SEQ ID NO: 3797259 - DNA, 19 bp, Homo sapiens
ctttccaaatgcccagctt

SEQ ID NO: 3797260 - DNA, 22 bp, Homo sapiens
ctttccacatttgtcacagaaa

SEQ ID NO: 3797261 - DNA, 16 bp, Homo sapiens
ctttccaccccctccc

SEQ ID NO: 3797262 - DNA, 21 bp, Homo sapiens
ctttccaccccctccctggcc

SEQ ID NO: 3797263 - DNA, 17 bp, Homo sapiens
ctttccctaaagaccct

SEQ ID NO: 3797264 - DNA, 19 bp, Homo sapiens
ctttccgtggcactgcata

SEQ ID NO: 3797265 - DNA, 16 bp, Homo sapiens
ctttcctgttcagcat

SEQ ID NO: 3797266 - DNA, 16 bp, Homo sapiens
ctttccttccttccct

SEQ ID NO: 3797267 - DNA, 17 bp, Homo sapiens
ctttctaatgtgtgaat

SEQ ID NO: 3797268 - DNA, 18 bp, Homo sapiens
ctttctcaataagcctca

SEQ ID NO: 3797269 - DNA, 20 bp, Homo sapiens
ctttctcagcctctgaatat

SEQ ID NO: 3797270 - DNA, 13 bp, Homo sapiens
ctttctcccaggc

SEQ ID NO: 3797271 - DNA, 21 bp, Homo sapiens
ctttctcccaggccaggctcc

SEQ ID NO: 3797272 - DNA, 20 bp, Homo sapiens
ctttctccttagtcttctca

SEQ ID NO: 3797273 - DNA, 21 bp, Homo sapiens
ctttctccttagtcttctcat

SEQ ID NO: 3797274 - DNA, 16 bp, Homo sapiens
ctttctgtaaccataa

SEQ ID NO: 3797275 - DNA, 11 bp, Homo sapiens
ctttcttcctc

SEQ ID NO: 3797276 - DNA, 12 bp, Homo sapiens
ctttcttcctct

SEQ ID NO: 3797277 - DNA, 14 bp, Homo sapiens
ctttcttcctctgc

SEQ ID NO: 3797278 - DNA, 15 bp, Homo sapiens
ctttcttctatttta

SEQ ID NO: 3797279 - DNA, 16 bp, Homo sapiens
ctttcttgctggttgt

SEQ ID NO: 3797280 - DNA, 23 bp, Homo sapiens
ctttctttggtgcctttcctgtt

SEQ ID NO: 3797281 - DNA, 18 bp, Homo sapiens
ctttctttgtttggctgg

SEQ ID NO: 3797282 - DNA, 21 bp, Homo sapiens
ctttcttttcgccgtggctgc

SEQ ID NO: 3797283 - DNA, 21 bp, Homo sapiens
ctttgaaatagtctgtgtgaa

SEQ ID NO: 3797284 - DNA, 16 bp, Homo sapiens
ctttgaaatgaatata

SEQ ID NO: 3797285 - DNA, 18 bp, Homo sapiens
ctttgacctcaacctgtg

SEQ ID NO: 3797286 - DNA, 16 bp, Homo sapiens
ctttgactgagcagac

SEQ ID NO: 3797287 - DNA, 18 bp, Homo sapiens
ctttgagatagaagaact

SEQ ID NO: 3797288 - DNA, 19 bp, Homo sapiens
ctttgagatagaagaactg

SEQ ID NO: 3797289 - DNA, 20 bp, Homo sapiens
ctttgagatagaagaactgc

SEQ ID NO: 3797290 - DNA, 13 bp, Homo sapiens
ctttgagtgatcc

SEQ ID NO: 3797291 - DNA, 17 bp, Homo sapiens
ctttgagtttcctcagg

SEQ ID NO: 3797292 - DNA, 18 bp, Homo sapiens
ctttgagtttcctcaggc

SEQ ID NO: 3797293 - DNA, 22 bp, Homo sapiens
ctttgatattttcaacgcagcc

SEQ ID NO: 3797294 - DNA, 15 bp, Homo sapiens
ctttgcagaaacaga

SEQ ID NO: 3797295 - DNA, 14 bp, Homo sapiens
ctttgcagacaggc

SEQ ID NO: 3797296 - DNA, 15 bp, Homo sapiens
ctttgcccaacctca

SEQ ID NO: 3797297 - DNA, 15 bp, Homo sapiens
ctttgcggacgggct

SEQ ID NO: 3797298 - DNA, 21 bp, Homo sapiens
ctttgctatggggacattcca

SEQ ID NO: 3797299 - DNA, 12 bp, Homo sapiens
ctttgcttcatt

SEQ ID NO: 3797300 - DNA, 22 bp, Homo sapiens
ctttgcttgaacacagtatttt

SEQ ID NO: 3797301 - DNA, 23 bp, Homo sapiens
ctttgcttgaacacagtattttc

SEQ ID NO: 3797302 - DNA, 21 bp, Homo sapiens
ctttggacacacacagcttct

SEQ ID NO: 3797303 - DNA, 17 bp, Homo sapiens
ctttggacgcacacagc

SEQ ID NO: 3797304 - DNA, 18 bp, Homo sapiens
ctttggacgcacacagct

SEQ ID NO: 3797305 - DNA, 17 bp, Homo sapiens
ctttggccattccaaca

SEQ ID NO: 3797306 - DNA, 19 bp, Homo sapiens
ctttggctattagagatca

SEQ ID NO: 3797307 - DNA, 22 bp, Homo sapiens
ctttgggaaaggagaagttaag

SEQ ID NO: 3797308 - DNA, 14 bp, Homo sapiens
ctttgggctgccct

SEQ ID NO: 3797309 - DNA, 20 bp, Homo sapiens
ctttgggctgccctggtgct

SEQ ID NO: 3797310 - DNA, 14 bp, Homo sapiens
ctttggtagaaaag

SEQ ID NO: 3797311 - DNA, 15 bp, Homo sapiens
ctttggtgcctttcc

SEQ ID NO: 3797312 - DNA, 19 bp, Homo sapiens
ctttggtgcctttcctgtt

SEQ ID NO: 3797313 - DNA, 20 bp, Homo sapiens
ctttggtgtacaaaatggaa

SEQ ID NO: 3797314 - DNA, 17 bp, Homo sapiens
ctttgtaatgtcaccac

SEQ ID NO: 3797315 - DNA, 22 bp, Homo sapiens
ctttgtaatgtcaccaccttcc

SEQ ID NO: 3797316 - DNA, 16 bp, Homo sapiens
ctttgtcaaaaggaag

SEQ ID NO: 3797317 - DNA, 14 bp, Homo sapiens
ctttgtcccacagc

SEQ ID NO: 3797318 - DNA, 15 bp, Homo sapiens
ctttgtcccacagct

SEQ ID NO: 3797319 - DNA, 14 bp, Homo sapiens
ctttgtcccatttc

SEQ ID NO: 3797320 - DNA, 15 bp, Homo sapiens
ctttgtcccggggct

SEQ ID NO: 3797321 - DNA, 19 bp, Homo sapiens
ctttgtgagagtgagctgt

SEQ ID NO: 3797322 - DNA, 18 bp, Homo sapiens
ctttgtgtagctttgctc

SEQ ID NO: 3797323 - DNA, 22 bp, Homo sapiens
ctttgttatttttgtttcttcc

SEQ ID NO: 3797324 - DNA, 23 bp, Homo sapiens
cttttaaaggggcagaaaaactc

SEQ ID NO: 3797325 - DNA, 19 bp, Homo sapiens
cttttaaatcctgttgaaa

SEQ ID NO: 3797326 - DNA, 20 bp, Homo sapiens
cttttaagatgtgtcttcaa

SEQ ID NO: 3797327 - DNA, 16 bp, Homo sapiens
cttttaatacagggta

SEQ ID NO: 3797328 - DNA, 14 bp, Homo sapiens
cttttacatactgc

SEQ ID NO: 3797329 - DNA, 17 bp, Homo sapiens
cttttacatactgctgt

SEQ ID NO: 3797330 - DNA, 15 bp, Homo sapiens
cttttagtacccacc

SEQ ID NO: 3797331 - DNA, 16 bp, Homo sapiens
cttttagtacccacct

SEQ ID NO: 3797332 - DNA, 17 bp, Homo sapiens
cttttagtacccacctg

SEQ ID NO: 3797333 - DNA, 18 bp, Homo sapiens
cttttataaattaaatat

SEQ ID NO: 3797334 - DNA, 17 bp, Homo sapiens
cttttatccacttacct

SEQ ID NO: 3797335 - DNA, 17 bp, Homo sapiens
cttttatttcttaaaca

SEQ ID NO: 3797336 - DNA, 20 bp, Homo sapiens
cttttcactgctggctgcct

SEQ ID NO: 3797337 - DNA, 17 bp, Homo sapiens
cttttcccccaaagtgg

SEQ ID NO: 3797338 - DNA, 19 bp, Homo sapiens
cttttcccccaaagtggtt

SEQ ID NO: 3797339 - DNA, 21 bp, Homo sapiens
cttttcctacttttccttccc

SEQ ID NO: 3797340 - DNA, 13 bp, Homo sapiens
cttttccttccct

SEQ ID NO: 3797341 - DNA, 20 bp, Homo sapiens
cttttccttccctcaaagct

SEQ ID NO: 3797342 - DNA, 13 bp, Homo sapiens
cttttccttgggg

SEQ ID NO: 3797343 - DNA, 21 bp, Homo sapiens
cttttccttggggcaggcagt

SEQ ID NO: 3797344 - DNA, 20 bp, Homo sapiens
cttttcgcaggattcttcct

SEQ ID NO: 3797345 - DNA, 15 bp, Homo sapiens
cttttcgttaacatt

SEQ ID NO: 3797346 - DNA, 13 bp, Homo sapiens
cttttctacagca

SEQ ID NO: 3797347 - DNA, 18 bp, Homo sapiens
cttttctggaatgtaatc

SEQ ID NO: 3797348 - DNA, 19 bp, Homo sapiens
cttttctggaatgtaatca

SEQ ID NO: 3797349 - DNA, 23 bp, Homo sapiens
cttttctgtccgagctttgaaaa

SEQ ID NO: 3797350 - DNA, 21 bp, Homo sapiens
cttttcttgtttatcagcagt

SEQ ID NO: 3797351 - DNA, 23 bp, Homo sapiens
cttttctttgaaggatgactaca

SEQ ID NO: 3797352 - DNA, 13 bp, Homo sapiens
cttttgaacccag

SEQ ID NO: 3797353 - DNA, 20 bp, Homo sapiens
cttttgaacccaggagttca

SEQ ID NO: 3797354 - DNA, 23 bp, Homo sapiens
cttttgaatccatgcttgggtgt

SEQ ID NO: 3797355 - DNA, 14 bp, Homo sapiens
cttttgacatgtgg

SEQ ID NO: 3797356 - DNA, 18 bp, Homo sapiens
cttttgagaacttttggt

SEQ ID NO: 3797357 - DNA, 15 bp, Homo sapiens
cttttgagacttttt

SEQ ID NO: 3797358 - DNA, 18 bp, Homo sapiens
cttttgagactttttggt

SEQ ID NO: 3797359 - DNA, 16 bp, Homo sapiens
cttttgatattaaatt

SEQ ID NO: 3797360 - DNA, 17 bp, Homo sapiens
cttttgccattaaactt

SEQ ID NO: 3797361 - DNA, 13 bp, Homo sapiens
cttttggcccccg

SEQ ID NO: 3797362 - DNA, 15 bp, Homo sapiens
cttttggtctgtgtg

SEQ ID NO: 3797363 - DNA, 17 bp, Homo sapiens
cttttgtctatgggact

SEQ ID NO: 3797364 - DNA, 22 bp, Homo sapiens
cttttgttcagggctgtgatcg

SEQ ID NO: 3797365 - DNA, 20 bp, Homo sapiens
cttttgtttcttcccttcaa

SEQ ID NO: 3797366 - DNA, 22 bp, Homo sapiens
cttttgtttcttcccttcaagg

SEQ ID NO: 3797367 - DNA, 15 bp, Homo sapiens
gaataatagaagaac

SEQ ID NO: 3797368 - DNA, 15 bp, Homo sapiens
gaataatctttgggt

SEQ ID NO: 3797369 - DNA, 14 bp, Homo sapiens
gaataatgaatgga

SEQ ID NO: 3797370 - DNA, 16 bp, Homo sapiens
gaataattctttgatt

SEQ ID NO: 3797371 - DNA, 16 bp, Homo sapiens
gaatacaaacatattt

SEQ ID NO: 3797372 - DNA, 13 bp, Homo sapiens
gaatacagtgtta

SEQ ID NO: 3797373 - DNA, 11 bp, Homo sapiens
gaatagaagga

SEQ ID NO: 3797374 - DNA, 15 bp, Homo sapiens
gaatagctgggacta

SEQ ID NO: 3797375 - DNA, 12 bp, Homo sapiens
gaatataattat

SEQ ID NO: 3797376 - DNA, 13 bp, Homo sapiens
gaatataattatc

SEQ ID NO: 3797377 - DNA, 12 bp, Homo sapiens
gaatatattata

SEQ ID NO: 3797378 - DNA, 15 bp, Homo sapiens
gaatatgacggaaga

SEQ ID NO: 3797379 - DNA, 19 bp, Homo sapiens
gaatatgacggaagaacat

SEQ ID NO: 3797380 - DNA, 19 bp, Homo sapiens
gaatatgagctttatgtaa

SEQ ID NO: 3797381 - DNA, 19 bp, Homo sapiens
gaatatgattagtaaagaa

SEQ ID NO: 3797382 - DNA, 13 bp, Homo sapiens
gaatatttataac

SEQ ID NO: 3797383 - DNA, 18 bp, Homo sapiens
gaatatttataacagcat

SEQ ID NO: 3797384 - DNA, 12 bp, Homo sapiens
gaatatttatta

SEQ ID NO: 3797385 - DNA, 20 bp, Homo sapiens
gaatatttgtcgatatttcc

SEQ ID NO: 3797386 - DNA, 14 bp, Homo sapiens
gaatattttattca

SEQ ID NO: 3797387 - DNA, 20 bp, Homo sapiens
gaatattttattcaaggtaa

SEQ ID NO: 3797388 - DNA, 23 bp, Homo sapiens
gaatattttgttttgtgcagaga

SEQ ID NO: 3797389 - DNA, 14 bp, Homo sapiens
gaatcaaaactctc

SEQ ID NO: 3797390 - DNA, 15 bp, Homo sapiens
gaatcaaaactctcc

SEQ ID NO: 3797391 - DNA, 15 bp, Homo sapiens
gaatcaacagggcag

SEQ ID NO: 3797392 - DNA, 22 bp, Homo sapiens
gaatcagaccctaccccaccac

SEQ ID NO: 3797393 - DNA, 12 bp, Homo sapiens
gaatcattgctt

SEQ ID NO: 3797394 - DNA, 18 bp, Homo sapiens
gaatccctgttcattgta

SEQ ID NO: 3797395 - DNA, 22 bp, Homo sapiens
gaatcctgtcctcagcttctta

SEQ ID NO: 3797396 - DNA, 16 bp, Homo sapiens
gaatcgaggaaccaga

SEQ ID NO: 3797397 - DNA, 19 bp, Homo sapiens
gaatcgaggaaccagagcc

SEQ ID NO: 3797398 - DNA, 22 bp, Homo sapiens
gaatcgatgggggatgcttcat

SEQ ID NO: 3797399 - DNA, 17 bp, Homo sapiens
gaatctatatttaacaa

SEQ ID NO: 3797400 - DNA, 16 bp, Homo sapiens
gaatgaaattgctgaa

SEQ ID NO: 3797401 - DNA, 23 bp, Homo sapiens
gaatgaaccacatcttgctctgc

SEQ ID NO: 3797402 - DNA, 14 bp, Homo sapiens
gaatgaattaaata

SEQ ID NO: 3797403 - DNA, 16 bp, Homo sapiens
gaatgaattaaataaa

SEQ ID NO: 3797404 - DNA, 17 bp, Homo sapiens
gaatgaggtcccaggca

SEQ ID NO: 3797405 - DNA, 19 bp, Homo sapiens
gaatgaggtcccaggcaga

SEQ ID NO: 3797406 - DNA, 11 bp, Homo sapiens
gaatgcagtgg

SEQ ID NO: 3797407 - DNA, 17 bp, Homo sapiens
gaatgcccacaggcaaa

SEQ ID NO: 3797408 - DNA, 15 bp, Homo sapiens
gaatgcctgtgccaa

SEQ ID NO: 3797409 - DNA, 21 bp, Homo sapiens
gaatgctcccccatcctcccc

SEQ ID NO: 3797410 - DNA, 22 bp, Homo sapiens
gaatgctcccccatcctcccct

SEQ ID NO: 3797411 - DNA, 18 bp, Homo sapiens
gaatgcttctgacttcat

SEQ ID NO: 3797412 - DNA, 21 bp, Homo sapiens
gaatgcttctgacttcataga

SEQ ID NO: 3797413 - DNA, 14 bp, Homo sapiens
gaatgcttggaata

SEQ ID NO: 3797414 - DNA, 17 bp, Homo sapiens
gaatggcacagcccaaa

SEQ ID NO: 3797415 - DNA, 22 bp, Homo sapiens
gaatggcacagcccaaagaagg

SEQ ID NO: 3797416 - DNA, 21 bp, Homo sapiens
gaatggcctgccttgaagcca

SEQ ID NO: 3797417 - DNA, 18 bp, Homo sapiens
gaatggtagtctaaccaa

SEQ ID NO: 3797418 - DNA, 20 bp, Homo sapiens
gaatggtagtctaaccaaat

SEQ ID NO: 3797419 - DNA, 23 bp, Homo sapiens
gaatggtagtctaaccaaatgca

SEQ ID NO: 3797420 - DNA, 15 bp, Homo sapiens
gaatgtagctggttt

SEQ ID NO: 3797421 - DNA, 17 bp, Homo sapiens
gaatgtatcaggaaata

SEQ ID NO: 3797422 - DNA, 20 bp, Homo sapiens
gaatgttacattgtttgtct

SEQ ID NO: 3797423 - DNA, 16 bp, Homo sapiens
gaatgttctgacatta

SEQ ID NO: 3797424 - DNA, 19 bp, Homo sapiens
gaatgttctgacattaaca

SEQ ID NO: 3797425 - DNA, 15 bp, Homo sapiens
gaatgtttgcctctg

SEQ ID NO: 3797426 - DNA, 18 bp, Homo sapiens
gaatgtttgcctctgcct

SEQ ID NO: 3797427 - DNA, 15 bp, Homo sapiens
gaatgttttccttct

SEQ ID NO: 3797428 - DNA, 15 bp, Homo sapiens
gaattaaaacaatgt

SEQ ID NO: 3797429 - DNA, 12 bp, Homo sapiens
gaattaaataaa

SEQ ID NO: 3797430 - DNA, 20 bp, Homo sapiens
gaattaaattaggaataaat

SEQ ID NO: 3797431 - DNA, 15 bp, Homo sapiens
gaattaacctggtgc

SEQ ID NO: 3797432 - DNA, 18 bp, Homo sapiens
gaattaagttagggaatg

SEQ ID NO: 3797433 - DNA, 21 bp, Homo sapiens
gaattaagttagggaatggca

SEQ ID NO: 3797434 - DNA, 21 bp, Homo sapiens
gaattacatgtaaaacattat

SEQ ID NO: 3797435 - DNA, 22 bp, Homo sapiens
gaattacatgtaaaacattatc

SEQ ID NO: 3797436 - DNA, 18 bp, Homo sapiens
gaattatcccttttcttg

SEQ ID NO: 3797437 - DNA, 16 bp, Homo sapiens
gaattattttttttct

SEQ ID NO: 3797438 - DNA, 21 bp, Homo sapiens
gaattcattctggtctctcta

SEQ ID NO: 3797439 - DNA, 14 bp, Homo sapiens
gaattctgttcatt

SEQ ID NO: 3797440 - DNA, 19 bp, Homo sapiens
gaattcttacatgttttct

SEQ ID NO: 3797441 - DNA, 18 bp, Homo sapiens
gaattgaacccaggaggt

SEQ ID NO: 3797442 - DNA, 17 bp, Homo sapiens
gaattgggagcttggga

SEQ ID NO: 3797443 - DNA, 20 bp, Homo sapiens
gaatttatcacacttctgtg

SEQ ID NO: 3797444 - DNA, 13 bp, Homo sapiens
gaatttattcaat

SEQ ID NO: 3797445 - DNA, 17 bp, Homo sapiens
gaatttattcaattcct

SEQ ID NO: 3797446 - DNA, 17 bp, Homo sapiens
gaatttgaatgaaaaat

SEQ ID NO: 3797447 - DNA, 19 bp, Homo sapiens
gaatttgaatgaaaaattt

SEQ ID NO: 3797448 - DNA, 15 bp, Homo sapiens
gaattttaagtgctt

SEQ ID NO: 3797449 - DNA, 23 bp, Homo sapiens
gaattttcagaccccagcggctg

SEQ ID NO: 3797450 - DNA, 21 bp, Homo sapiens
gaattttctttgtgtagcttt

SEQ ID NO: 3797451 - DNA, 20 bp, Homo sapiens
gaattttgtgcccccatgta

SEQ ID NO: 3797452 - DNA, 22 bp, Homo sapiens
gaatttttttttcctagccctc

SEQ ID NO: 3797453 - DNA, 17 bp, Homo sapiens
gacaaaaacagcctcac

SEQ ID NO: 3797454 - DNA, 18 bp, Homo sapiens
gacaaaaacagcctcaca

SEQ ID NO: 3797455 - DNA, 21 bp, Homo sapiens
gacaaaaatactctaattcta

SEQ ID NO: 3797456 - DNA, 16 bp, Homo sapiens
gacaaacacctcccag

SEQ ID NO: 3797457 - DNA, 17 bp, Homo sapiens
gacaaacacctcccagg

SEQ ID NO: 3797458 - DNA, 18 bp, Homo sapiens
gacaaagctgctaaatct

SEQ ID NO: 3797459 - DNA, 19 bp, Homo sapiens
gacaaagctgctaaatctc

SEQ ID NO: 3797460 - DNA, 18 bp, Homo sapiens
gacaaaggttttcctctt

SEQ ID NO: 3797461 - DNA, 19 bp, Homo sapiens
gacaaagtctccagcccac

SEQ ID NO: 3797462 - DNA, 13 bp, Homo sapiens
gacaaatcaagtt

SEQ ID NO: 3797463 - DNA, 14 bp, Homo sapiens
gacaaatcaagttt

SEQ ID NO: 3797464 - DNA, 15 bp, Homo sapiens
gacaaatcaagtttc

SEQ ID NO: 3797465 - DNA, 20 bp, Homo sapiens
gacaaatcaagtttccaagc

SEQ ID NO: 3797466 - DNA, 22 bp, Homo sapiens
gacaaatgtgtatcggatgctt

SEQ ID NO: 3797467 - DNA, 17 bp, Homo sapiens
gacaaattctgtttctt

SEQ ID NO: 3797468 - DNA, 22 bp, Homo sapiens
gacaacagaagtcatgaagccc

SEQ ID NO: 3797469 - DNA, 22 bp, Homo sapiens
gacaaccaccgctccccagccc

SEQ ID NO: 3797470 - DNA, 12 bp, Homo sapiens
gacaaccatgac

SEQ ID NO: 3797471 - DNA, 21 bp, Homo sapiens
gacaaccgatgctccagccaa

SEQ ID NO: 3797472 - DNA, 13 bp, Homo sapiens
gacaagaagcaaa

SEQ ID NO: 3797473 - DNA, 16 bp, Homo sapiens
gacaagccccaggcag

SEQ ID NO: 3797474 - DNA, 21 bp, Homo sapiens
gacaaggattgctactgtcct

SEQ ID NO: 3797475 - DNA, 14 bp, Homo sapiens
gacaaggccccaga

SEQ ID NO: 3797476 - DNA, 14 bp, Homo sapiens
gacaaggtagccct

SEQ ID NO: 3797477 - DNA, 20 bp, Homo sapiens
gacaatgatgatgataatga

SEQ ID NO: 3797478 - DNA, 18 bp, Homo sapiens
gacaatgtgaaaagaaaa

SEQ ID NO: 3797479 - DNA, 21 bp, Homo sapiens
gacaattcctagataaaaaga

SEQ ID NO: 3797480 - DNA, 21 bp, Homo sapiens
gacccctccatgtgggctagt

SEQ ID NO: 3797481 - DNA, 13 bp, Homo sapiens
gacccctctggcc

SEQ ID NO: 3797482 - DNA, 23 bp, Homo sapiens
gacccggagctaacactggcccc

SEQ ID NO: 3797483 - DNA, 11 bp, Homo sapiens
gaccctacccc

SEQ ID NO: 3797484 - DNA, 14 bp, Homo sapiens
gaccctaccccacc

SEQ ID NO: 3797485 - DNA, 16 bp, Homo sapiens
gaccctaccccaccac

SEQ ID NO: 3797486 - DNA, 11 bp, Homo sapiens
gaccctccctt

SEQ ID NO: 3797487 - DNA, 19 bp, Homo sapiens
gaccctcctcctcccccag

SEQ ID NO: 3797488 - DNA, 18 bp, Homo sapiens
gaccctcgtggccttccc

SEQ ID NO: 3797489 - DNA, 15 bp, Homo sapiens
gaccctctccacccc

SEQ ID NO: 3797490 - DNA, 12 bp, Homo sapiens
gaccctgtctct

SEQ ID NO: 3797491 - DNA, 13 bp, Homo sapiens
gacctactctcat

SEQ ID NO: 3797492 - DNA, 17 bp, Homo sapiens
gacctagggaggacctt

SEQ ID NO: 3797493 - DNA, 21 bp, Homo sapiens
gacctcagagtccaggcccca

SEQ ID NO: 3797494 - DNA, 10 bp, Homo sapiens
gacctcagcc

SEQ ID NO: 3797495 - DNA, 11 bp, Homo sapiens
gacctcagcct

SEQ ID NO: 3797496 - DNA, 18 bp, Homo sapiens
gacctcaggtgagaagca

SEQ ID NO: 3797497 - DNA, 20 bp, Homo sapiens
gacctcagttttatcatttt

SEQ ID NO: 3797498 - DNA, 21 bp, Homo sapiens
gacctcagttttatcattttc

SEQ ID NO: 3797499 - DNA, 14 bp, Homo sapiens
gacctccccctcct

SEQ ID NO: 3797500 - DNA, 10 bp, Homo sapiens
gacctctggg

SEQ ID NO: 3797501 - DNA, 15 bp, Homo sapiens
gacctgactcaggca

SEQ ID NO: 3797502 - DNA, 16 bp, Homo sapiens
gacctgagctccccac

SEQ ID NO: 3797503 - DNA, 13 bp, Homo sapiens
gacctgaggaagc

SEQ ID NO: 3797504 - DNA, 20 bp, Homo sapiens
gacctgcaggccaagagcag

SEQ ID NO: 3797505 - DNA, 21 bp, Homo sapiens
gacctgccccgcccagctgca

SEQ ID NO: 3797506 - DNA, 20 bp, Homo sapiens
gacctgctgagggaccagcc

SEQ ID NO: 3797507 - DNA, 17 bp, Homo sapiens
gacctgtcttccaagga

SEQ ID NO: 3797508 - DNA, 17 bp, Homo sapiens
gacctgtgaccagcact

SEQ ID NO: 3797509 - DNA, 21 bp, Homo sapiens
gacctgtggggatttctccca

SEQ ID NO: 3797510 - DNA, 23 bp, Homo sapiens
gacctgtggggatttctcccagc

SEQ ID NO: 3797511 - DNA, 19 bp, Homo sapiens
gacctgtgtcactacgtga

SEQ ID NO: 3797512 - DNA, 15 bp, Homo sapiens
gaccttctaggaagc

SEQ ID NO: 3797513 - DNA, 23 bp, Homo sapiens
gaccttgaactgggtacttgtgg

SEQ ID NO: 3797514 - DNA, 21 bp, Homo sapiens
gacctttgtcatctttcttct

SEQ ID NO: 3797515 - DNA, 23 bp, Homo sapiens
gacgatactccaaccatatggat

SEQ ID NO: 3797516 - DNA, 14 bp, Homo sapiens
gacgcacacagctt

SEQ ID NO: 3797517 - DNA, 18 bp, Homo sapiens
gacgctggtagagatgga

SEQ ID NO: 3797518 - DNA, 20 bp, Homo sapiens
gacgctggtagagatggagg

SEQ ID NO: 3797519 - DNA, 21 bp, Homo sapiens
gacggagtcccaccttggctg

SEQ ID NO: 3797520 - DNA, 23 bp, Homo sapiens
gacggagtcccaccttggctgca

SEQ ID NO: 3797521 - DNA, 15 bp, Homo sapiens
gacggttcaccagcc

SEQ ID NO: 3797522 - DNA, 17 bp, Homo sapiens
gacggttcaccagcctc

SEQ ID NO: 3797523 - DNA, 18 bp, Homo sapiens
gacggttcaccagcctct

SEQ ID NO: 3797524 - DNA, 18 bp, Homo sapiens
gacgtcaagtctccttcc

SEQ ID NO: 3797525 - DNA, 12 bp, Homo sapiens
gacgtccctcca

SEQ ID NO: 3797526 - DNA, 21 bp, Homo sapiens
gacgttcggggcatgctgggg

SEQ ID NO: 3797527 - DNA, 18 bp, Homo sapiens
gactaaaaatattataac

SEQ ID NO: 3797528 - DNA, 13 bp, Homo sapiens
gactacaggcacc

SEQ ID NO: 3797529 - DNA, 15 bp, Homo sapiens
gactagaagggccag

SEQ ID NO: 3797530 - DNA, 12 bp, Homo sapiens
gactagagaaac

SEQ ID NO: 3797531 - DNA, 17 bp, Homo sapiens
gactagggattcaggct

SEQ ID NO: 3797532 - DNA, 19 bp, Homo sapiens
gactagtgccgtagggagt

SEQ ID NO: 3797533 - DNA, 15 bp, Homo sapiens
gactagtgctgaagc

SEQ ID NO: 3797534 - DNA, 22 bp, Homo sapiens
gactatctaaatgttgaaagat

SEQ ID NO: 3797535 - DNA, 16 bp, Homo sapiens
gactcaagtgtctcag

SEQ ID NO: 3797536 - DNA, 15 bp, Homo sapiens
gactcaataaaatca

SEQ ID NO: 3797537 - DNA, 17 bp, Homo sapiens
gactcaataaaatcatg

SEQ ID NO: 3797538 - DNA, 17 bp, Homo sapiens
gactcaatgcactgaca

SEQ ID NO: 3797539 - DNA, 12 bp, Homo sapiens
gactcacccaag

SEQ ID NO: 3797540 - DNA, 15 bp, Homo sapiens
gactcagccctgagg

SEQ ID NO: 3797541 - DNA, 15 bp, Homo sapiens
gactcaggatgccca

SEQ ID NO: 3797542 - DNA, 17 bp, Homo sapiens
gactcaggatgcccagg

SEQ ID NO: 3797543 - DNA, 19 bp, Homo sapiens
gactcaggatgcccagggc

SEQ ID NO: 3797544 - DNA, 15 bp, Homo sapiens
gactcaggttgtctg

SEQ ID NO: 3797545 - DNA, 23 bp, Homo sapiens
gactccatgagaagccgtgggtg

SEQ ID NO: 3797546 - DNA, 16 bp, Homo sapiens
gactcccaaagagctg

SEQ ID NO: 3797547 - DNA, 12 bp, Homo sapiens
gactccctcctc

SEQ ID NO: 3797548 - DNA, 13 bp, Homo sapiens
gactccctcctca

SEQ ID NO: 3797549 - DNA, 16 bp, Homo sapiens
gactccctcctcacct

SEQ ID NO: 3797550 - DNA, 20 bp, Homo sapiens
gactccctcctcacctctgg

SEQ ID NO: 3797551 - DNA, 23 bp, Homo sapiens
gactccctcctcacctctggact

SEQ ID NO: 3797552 - DNA, 22 bp, Homo sapiens
gactcctgtggagatgacttgg

SEQ ID NO: 3797553 - DNA, 16 bp, Homo sapiens
gactctacactgtgaa

SEQ ID NO: 3797554 - DNA, 15 bp, Homo sapiens
gactctacagaggcc

SEQ ID NO: 3797555 - DNA, 17 bp, Homo sapiens
gactctaggtgcccttg

SEQ ID NO: 3797556 - DNA, 12 bp, Homo sapiens
gactctctgtga

SEQ ID NO: 3797557 - DNA, 13 bp, Homo sapiens
gactctctgtgac

SEQ ID NO: 3797558 - DNA, 14 bp, Homo sapiens
gactctctgtgacc

SEQ ID NO: 3797559 - DNA, 19 bp, Homo sapiens
gactctctgtgacctgccc

SEQ ID NO: 3797560 - DNA, 18 bp, Homo sapiens
gactctgtggggccttgg

SEQ ID NO: 3797561 - DNA, 19 bp, Homo sapiens
gactgagcagactggtgag

SEQ ID NO: 3797562 - DNA, 21 bp, Homo sapiens
gactgatgttaggctgggccc

SEQ ID NO: 3797563 - DNA, 19 bp, Homo sapiens
gactgcaccattgctgctc

SEQ ID NO: 3797564 - DNA, 18 bp, Homo sapiens
gactgccccaactcctgg

SEQ ID NO: 3797565 - DNA, 15 bp, Homo sapiens
gactgccccgtgcag

SEQ ID NO: 3797566 - DNA, 23 bp, Homo sapiens
gactgccccgtgcagactggagg

SEQ ID NO: 3797567 - DNA, 23 bp, Homo sapiens
gactgccgaccgaggctggagct

SEQ ID NO: 3797568 - DNA, 14 bp, Homo sapiens
gactgctgggactg

SEQ ID NO: 3797569 - DNA, 16 bp, Homo sapiens
gactggagacaatgca

SEQ ID NO: 3797570 - DNA, 22 bp, Homo sapiens
gactggatactgcccggggcag

SEQ ID NO: 3797571 - DNA, 16 bp, Homo sapiens
gactggatagtccgtc

SEQ ID NO: 3797572 - DNA, 17 bp, Homo sapiens
gactggatagtccgtct

SEQ ID NO: 3797573 - DNA, 23 bp, Homo sapiens
gactgggaagataggctctgcac

SEQ ID NO: 3797574 - DNA, 15 bp, Homo sapiens
gactgggagggccca

SEQ ID NO: 3797575 - DNA, 14 bp, Homo sapiens
gactggtgagcaga

SEQ ID NO: 3797576 - DNA, 22 bp, Homo sapiens
gactgtacaaagtagaagtctt

SEQ ID NO: 3797577 - DNA, 23 bp, Homo sapiens
gactgtactcctcccaggcgccc

SEQ ID NO: 3797578 - DNA, 21 bp, Homo sapiens
gactgtagattgcttctgtag

SEQ ID NO: 3797579 - DNA, 14 bp, Homo sapiens
gactgtatctgtgt

SEQ ID NO: 3797580 - DNA, 15 bp, Homo sapiens
gactgtatctgtgta

SEQ ID NO: 3797581 - DNA, 16 bp, Homo sapiens
gactgtatctgtgtag

SEQ ID NO: 3797582 - DNA, 17 bp, Homo sapiens
gactgtatctgtgtaga

SEQ ID NO: 3797583 - DNA, 15 bp, Homo sapiens
gactgtcatagaaat

SEQ ID NO: 3797584 - DNA, 22 bp, Homo sapiens
gactgtctcaagagggcactgg

SEQ ID NO: 3797585 - DNA, 22 bp, Homo sapiens
gactgtgtattctagttttgtc

SEQ ID NO: 3797586 - DNA, 16 bp, Homo sapiens
gactgttttctcttga

SEQ ID NO: 3797587 - DNA, 18 bp, Homo sapiens
gactgttttctcttgaga

SEQ ID NO: 3797588 - DNA, 14 bp, Homo sapiens
gactgttttttcct

SEQ ID NO: 3797589 - DNA, 14 bp, Homo sapiens
gacttcagggcagg

SEQ ID NO: 3797590 - DNA, 18 bp, Homo sapiens
gacttcagggcagggctc

SEQ ID NO: 3797591 - DNA, 22 bp, Homo sapiens
gacttcagggcagggctctgat

SEQ ID NO: 3797592 - DNA, 15 bp, Homo sapiens
gacttcatttttcct

SEQ ID NO: 3797593 - DNA, 15 bp, Homo sapiens
gaggttgcagtgagc

SEQ ID NO: 3797594 - DNA, 17 bp, Homo sapiens
gaggttggggtgtacta

SEQ ID NO: 3797595 - DNA, 16 bp, Homo sapiens
gaggtttcaaacctcc

SEQ ID NO: 3797596 - DNA, 14 bp, Homo sapiens
gagtaagctgcttt

SEQ ID NO: 3797597 - DNA, 20 bp, Homo sapiens
gagtaatctgatcgttcttt

SEQ ID NO: 3797598 - DNA, 19 bp, Homo sapiens
gagtagccgagagcctgct

SEQ ID NO: 3797599 - DNA, 21 bp, Homo sapiens
gagtagccgagagcctgctcc

SEQ ID NO: 3797600 - DNA, 14 bp, Homo sapiens
gagtagctgggact

SEQ ID NO: 3797601 - DNA, 22 bp, Homo sapiens
gagtagctgggactacaggcac

SEQ ID NO: 3797602 - DNA, 12 bp, Homo sapiens
gagtatatgcac

SEQ ID NO: 3797603 - DNA, 11 bp, Homo sapiens
gagtatatgtc

SEQ ID NO: 3797604 - DNA, 17 bp, Homo sapiens
gagtcaaaacacttgta

SEQ ID NO: 3797605 - DNA, 15 bp, Homo sapiens
gagtcaccaagccca

SEQ ID NO: 3797606 - DNA, 16 bp, Homo sapiens
gagtcaccaagcccag

SEQ ID NO: 3797607 - DNA, 18 bp, Homo sapiens
gagtcatgatctccctgc

SEQ ID NO: 3797608 - DNA, 14 bp, Homo sapiens
gagtccaggcccca

SEQ ID NO: 3797609 - DNA, 14 bp, Homo sapiens
gagtcccttccagg

SEQ ID NO: 3797610 - DNA, 14 bp, Homo sapiens
gagtcgaggacagg

SEQ ID NO: 3797611 - DNA, 21 bp, Homo sapiens
gagtctcactgttgcccaggc

SEQ ID NO: 3797612 - DNA, 22 bp, Homo sapiens
gagtctcactgttgcccaggct

SEQ ID NO: 3797613 - DNA, 16 bp, Homo sapiens
gagtctcttctccact

SEQ ID NO: 3797614 - DNA, 23 bp, Homo sapiens
gagtctgaagcagatgcaaagag

SEQ ID NO: 3797615 - DNA, 12 bp, Homo sapiens
gagtctgtctca

SEQ ID NO: 3797616 - DNA, 15 bp, Homo sapiens
gagtgacagaggcag

SEQ ID NO: 3797617 - DNA, 14 bp, Homo sapiens
gagtgactagacgt

SEQ ID NO: 3797618 - DNA, 18 bp, Homo sapiens
gagtgagactctgtctca

SEQ ID NO: 3797619 - DNA, 16 bp, Homo sapiens
gagtgcaacagtagca

SEQ ID NO: 3797620 - DNA, 11 bp, Homo sapiens
gagtgcagtga

SEQ ID NO: 3797621 - DNA, 14 bp, Homo sapiens
gagtgccccacctg

SEQ ID NO: 3797622 - DNA, 21 bp, Homo sapiens
gagtgctcagtagtcagactg

SEQ ID NO: 3797623 - DNA, 18 bp, Homo sapiens
gagtggcctggccaggag

SEQ ID NO: 3797624 - DNA, 20 bp, Homo sapiens
gagtggcctggccaggagct

SEQ ID NO: 3797625 - DNA, 13 bp, Homo sapiens
gagtggctcctcc

SEQ ID NO: 3797626 - DNA, 20 bp, Homo sapiens
gagtggggagacacctcaga

SEQ ID NO: 3797627 - DNA, 23 bp, Homo sapiens
gagtgggggatcacagcctctga

SEQ ID NO: 3797628 - DNA, 14 bp, Homo sapiens
gagtggtctttctg

SEQ ID NO: 3797629 - DNA, 21 bp, Homo sapiens
gagtgtaacaagaaaggagag

SEQ ID NO: 3797630 - DNA, 23 bp, Homo sapiens
gagtgtcctaggagtatcctcat

SEQ ID NO: 3797631 - DNA, 17 bp, Homo sapiens
gagtgtggctcccctct

SEQ ID NO: 3797632 - DNA, 17 bp, Homo sapiens
gagtgtgtattgttccc

SEQ ID NO: 3797633 - DNA, 17 bp, Homo sapiens
gagtgtgtttgtcaccg

SEQ ID NO: 3797634 - DNA, 22 bp, Homo sapiens
gagttaaatagagtatatgcac

SEQ ID NO: 3797635 - DNA, 14 bp, Homo sapiens
gagttagaggccag

SEQ ID NO: 3797636 - DNA, 16 bp, Homo sapiens
gagttagaggccagcc

SEQ ID NO: 3797637 - DNA, 17 bp, Homo sapiens
gagttaggctattcaca

SEQ ID NO: 3797638 - DNA, 18 bp, Homo sapiens
gagttagtttctttggga

SEQ ID NO: 3797639 - DNA, 16 bp, Homo sapiens
gagttcagctgcttct

SEQ ID NO: 3797640 - DNA, 15 bp, Homo sapiens
gagttgattcagctc

SEQ ID NO: 3797641 - DNA, 16 bp, Homo sapiens
gagttgtgttgttctt

SEQ ID NO: 3797642 - DNA, 22 bp, Homo sapiens
gagttgttttcagactcagact

SEQ ID NO: 3797643 - DNA, 14 bp, Homo sapiens
gagtttaccatttg

SEQ ID NO: 3797644 - DNA, 20 bp, Homo sapiens
gagtttcctcaggctgctgg

SEQ ID NO: 3797645 - DNA, 21 bp, Homo sapiens
gagtttcctcaggctgctgga

SEQ ID NO: 3797646 - DNA, 23 bp, Homo sapiens
gagtttcctcaggctgctggagg

SEQ ID NO: 3797647 - DNA, 14 bp, Homo sapiens
gataaaaaattttg

SEQ ID NO: 3797648 - DNA, 19 bp, Homo sapiens
gataaaaaattttgtaatt

SEQ ID NO: 3797649 - DNA, 16 bp, Homo sapiens
gataaaagatacattt

SEQ ID NO: 3797650 - DNA, 18 bp, Homo sapiens
gataaaatgaggttcaac

SEQ ID NO: 3797651 - DNA, 18 bp, Homo sapiens
gataaacttttagaaact

SEQ ID NO: 3797652 - DNA, 14 bp, Homo sapiens
gataaagaaaagaa

SEQ ID NO: 3797653 - DNA, 16 bp, Homo sapiens
gataaagatttcttga

SEQ ID NO: 3797654 - DNA, 12 bp, Homo sapiens
gataaattataa

SEQ ID NO: 3797655 - DNA, 15 bp, Homo sapiens
gataacaagatcttt

SEQ ID NO: 3797656 - DNA, 15 bp, Homo sapiens
gataacagctaccat

SEQ ID NO: 3797657 - DNA, 17 bp, Homo sapiens
gataagaatgctggttt

SEQ ID NO: 3797658 - DNA, 14 bp, Homo sapiens
gataatcagcctct

SEQ ID NO: 3797659 - DNA, 15 bp, Homo sapiens
gataatcagcctctt

SEQ ID NO: 3797660 - DNA, 18 bp, Homo sapiens
gataattctagctttgag

SEQ ID NO: 3797661 - DNA, 12 bp, Homo sapiens
gataattttgca

SEQ ID NO: 3797662 - DNA, 19 bp, Homo sapiens
gatacaggaaaagctgctg

SEQ ID NO: 3797663 - DNA, 20 bp, Homo sapiens
gatacaggaaaagctgctga

SEQ ID NO: 3797664 - DNA, 20 bp, Homo sapiens
gatacccatagcttccatga

SEQ ID NO: 3797665 - DNA, 13 bp, Homo sapiens
gatactctgtcag

SEQ ID NO: 3797666 - DNA, 14 bp, Homo sapiens
gatactggaagttt

SEQ ID NO: 3797667 - DNA, 20 bp, Homo sapiens
gatactggaagttttgcatt

SEQ ID NO: 3797668 - DNA, 15 bp, Homo sapiens
gatacttgttttcaa

SEQ ID NO: 3797669 - DNA, 17 bp, Homo sapiens
gatagaagaaaaaagaa

SEQ ID NO: 3797670 - DNA, 16 bp, Homo sapiens
gatagaagatgtttgc

SEQ ID NO: 3797671 - DNA, 16 bp, Homo sapiens
gataggccttcttgtg

SEQ ID NO: 3797672 - DNA, 13 bp, Homo sapiens
gataggctctgca

SEQ ID NO: 3797673 - DNA, 17 bp, Homo sapiens
gataggctctgcacaga

SEQ ID NO: 3797674 - DNA, 18 bp, Homo sapiens
gatatacttttttcttat

SEQ ID NO: 3797675 - DNA, 20 bp, Homo sapiens
gatatagatcacataacaga

SEQ ID NO: 3797676 - DNA, 17 bp, Homo sapiens
gatatcttgaaatgaaa

SEQ ID NO: 3797677 - DNA, 16 bp, Homo sapiens
gatatctttttattga

SEQ ID NO: 3797678 - DNA, 14 bp, Homo sapiens
gatatgaaaaatat

SEQ ID NO: 3797679 - DNA, 16 bp, Homo sapiens
gatatttaagaaaata

SEQ ID NO: 3797680 - DNA, 21 bp, Homo sapiens
gatattttcaacgcagccctg

SEQ ID NO: 3797681 - DNA, 15 bp, Homo sapiens
gatatttttttaagt

SEQ ID NO: 3797682 - DNA, 14 bp, Homo sapiens
gatcaataaaatgt

SEQ ID NO: 3797683 - DNA, 13 bp, Homo sapiens
gatcacagaggct

SEQ ID NO: 3797684 - DNA, 21 bp, Homo sapiens
gatcacagcttcagccaggag

SEQ ID NO: 3797685 - DNA, 19 bp, Homo sapiens
gatcacataacagaatgca

SEQ ID NO: 3797686 - DNA, 14 bp, Homo sapiens
gatcacctgaggtc

SEQ ID NO: 3797687 - DNA, 15 bp, Homo sapiens
gatcacgccactgca

SEQ ID NO: 3797688 - DNA, 24 bp, Homo sapiens
gatcacgccactgcactccagcct

SEQ ID NO: 3797689 - DNA, 16 bp, Homo sapiens
gatcacggctcactgc

SEQ ID NO: 3797690 - DNA, 18 bp, Homo sapiens
gatcactatgcattttaa

SEQ ID NO: 3797691 - DNA, 18 bp, Homo sapiens
gatcactggagcccagga

SEQ ID NO: 3797692 - DNA, 15 bp, Homo sapiens
gatcactttgctctg

SEQ ID NO: 3797693 - DNA, 11 bp, Homo sapiens
gatcagaaagt

SEQ ID NO: 3797694 - DNA, 16 bp, Homo sapiens
gatcagaccataatgt

SEQ ID NO: 3797695 - DNA, 15 bp, Homo sapiens
gatcagcctgggcaa

SEQ ID NO: 3797696 - DNA, 22 bp, Homo sapiens
gatcagtctgattcccaagctc

SEQ ID NO: 3797697 - DNA, 13 bp, Homo sapiens
gatcatccactgt

SEQ ID NO: 3797698 - DNA, 16 bp, Homo sapiens
gatcatccactgtgcc

SEQ ID NO: 3797699 - DNA, 12 bp, Homo sapiens
gatccaagctgg

SEQ ID NO: 3797700 - DNA, 21 bp, Homo sapiens
gatccaagctggtcccactca

SEQ ID NO: 3797701 - DNA, 17 bp, Homo sapiens
gatccacacacagagga

SEQ ID NO: 3797702 - DNA, 18 bp, Homo sapiens
gatccacacacagaggaa

SEQ ID NO: 3797703 - DNA, 18 bp, Homo sapiens
gatccacccacctcagcc

SEQ ID NO: 3797704 - DNA, 21 bp, Homo sapiens
gatccacccacctcagcctcc

SEQ ID NO: 3797705 - DNA, 16 bp, Homo sapiens
gatccatccatctcca

SEQ ID NO: 3797706 - DNA, 19 bp, Homo sapiens
gatcccagctcacgtcaca

SEQ ID NO: 3797707 - DNA, 20 bp, Homo sapiens
gcagagaatcatacttagca

SEQ ID NO: 3797708 - DNA, 23 bp, Homo sapiens
gcagagaatgaaagggcccagag

SEQ ID NO: 3797709 - DNA, 13 bp, Homo sapiens
gcagagacactaa

SEQ ID NO: 3797710 - DNA, 12 bp, Homo sapiens
gcagaggctggc

SEQ ID NO: 3797711 - DNA, 14 bp, Homo sapiens
gcagaggctggcct

SEQ ID NO: 3797712 - DNA, 19 bp, Homo sapiens
gcagaggctggcctcagac

SEQ ID NO: 3797713 - DNA, 16 bp, Homo sapiens
gcagagggcagaggct

SEQ ID NO: 3797714 - DNA, 12 bp, Homo sapiens
gcagaggggctt

SEQ ID NO: 3797715 - DNA, 21 bp, Homo sapiens
gcagaggggctttctggagag

SEQ ID NO: 3797716 - DNA, 21 bp, Homo sapiens
gcagaggttgcagtgagctga

SEQ ID NO: 3797717 - DNA, 17 bp, Homo sapiens
gcagagtgccccacctg

SEQ ID NO: 3797718 - DNA, 18 bp, Homo sapiens
gcagataatcagcctctt

SEQ ID NO: 3797719 - DNA, 16 bp, Homo sapiens
gcagatgacccctccc

SEQ ID NO: 3797720 - DNA, 14 bp, Homo sapiens
gcagatgccagagc

SEQ ID NO: 3797721 - DNA, 18 bp, Homo sapiens
gcagatgtccttgatgct

SEQ ID NO: 3797722 - DNA, 17 bp, Homo sapiens
gcagattgaaaaggaca

SEQ ID NO: 3797723 - DNA, 23 bp, Homo sapiens
gcagatttagtgaaagctagaga

SEQ ID NO: 3797724 - DNA, 12 bp, Homo sapiens
gcagcagcttgc

SEQ ID NO: 3797725 - DNA, 19 bp, Homo sapiens
gcagcagggagggcttctg

SEQ ID NO: 3797726 - DNA, 20 bp, Homo sapiens
gcagcagggagggcttctgc

SEQ ID NO: 3797727 - DNA, 20 bp, Homo sapiens
gcagcaggtggcagaatggg

SEQ ID NO: 3797728 - DNA, 21 bp, Homo sapiens
gcagcagtgagtctcttcaga

SEQ ID NO: 3797729 - DNA, 13 bp, Homo sapiens
gcagccagcccag

SEQ ID NO: 3797730 - DNA, 21 bp, Homo sapiens
gcagccagcccagcccagctg

SEQ ID NO: 3797731 - DNA, 13 bp, Homo sapiens
gcagccagctctc

SEQ ID NO: 3797732 - DNA, 15 bp, Homo sapiens
gcagccagctctcag

SEQ ID NO: 3797733 - DNA, 18 bp, Homo sapiens
gcagccagctctcagcca

SEQ ID NO: 3797734 - DNA, 14 bp, Homo sapiens
gcagccaggctgcc

SEQ ID NO: 3797735 - DNA, 24 bp, Homo sapiens
gcagccccattctgcctgcccagg

SEQ ID NO: 3797736 - DNA, 17 bp, Homo sapiens
gcagcccgtgtggcccc

SEQ ID NO: 3797737 - DNA, 18 bp, Homo sapiens
gcagcccgtgtggcccct

SEQ ID NO: 3797738 - DNA, 19 bp, Homo sapiens
gcagcccgtgtggcccctt

SEQ ID NO: 3797739 - DNA, 20 bp, Homo sapiens
gcagcccgtgtggccccttc

SEQ ID NO: 3797740 - DNA, 19 bp, Homo sapiens
gcagcctcaacctcctggg

SEQ ID NO: 3797741 - DNA, 21 bp, Homo sapiens
gcagcctcaacctcctgggct

SEQ ID NO: 3797742 - DNA, 18 bp, Homo sapiens
gcagcctcgaactcctgg

SEQ ID NO: 3797743 - DNA, 22 bp, Homo sapiens
gcagcctctgaagttggacagc

SEQ ID NO: 3797744 - DNA, 13 bp, Homo sapiens
gcagcctgcctgg

SEQ ID NO: 3797745 - DNA, 15 bp, Homo sapiens
gcagcctgcgtggct

SEQ ID NO: 3797746 - DNA, 14 bp, Homo sapiens
gcagcctggaccct

SEQ ID NO: 3797747 - DNA, 22 bp, Homo sapiens
gcagcgagctatgatcgcgcca

SEQ ID NO: 3797748 - DNA, 17 bp, Homo sapiens
gcagctcaaaggcacag

SEQ ID NO: 3797749 - DNA, 20 bp, Homo sapiens
gcagctgagaaaatgagtga

SEQ ID NO: 3797750 - DNA, 15 bp, Homo sapiens
gcagctgattttaac

SEQ ID NO: 3797751 - DNA, 14 bp, Homo sapiens
gcagctgccagaga

SEQ ID NO: 3797752 - DNA, 19 bp, Homo sapiens
gcagctgcggtccacccag

SEQ ID NO: 3797753 - DNA, 12 bp, Homo sapiens
gcagctgggctg

SEQ ID NO: 3797754 - DNA, 14 bp, Homo sapiens
gcagctgttagagt

SEQ ID NO: 3797755 - DNA, 19 bp, Homo sapiens
gcagcttgagggttgggct

SEQ ID NO: 3797756 - DNA, 21 bp, Homo sapiens
gcagcttgagggttgggctgg

SEQ ID NO: 3797757 - DNA, 17 bp, Homo sapiens
gcaggaagctcagactg

SEQ ID NO: 3797758 - DNA, 13 bp, Homo sapiens
gcaggaaggagag

SEQ ID NO: 3797759 - DNA, 15 bp, Homo sapiens
gcaggaaggagagcc

SEQ ID NO: 3797760 - DNA, 23 bp, Homo sapiens
gcaggaaggagagcctgctgcat

SEQ ID NO: 3797761 - DNA, 20 bp, Homo sapiens
gcaggaaggctgagaggaga

SEQ ID NO: 3797762 - DNA, 10 bp, Homo sapiens
gcaggaatgg

SEQ ID NO: 3797763 - DNA, 19 bp, Homo sapiens
gcaggaattggtggcagat

SEQ ID NO: 3797764 - DNA, 17 bp, Homo sapiens
gcaggacaacgaggaag

SEQ ID NO: 3797765 - DNA, 23 bp, Homo sapiens
gcaggacctcagagtccaggccc

SEQ ID NO: 3797766 - DNA, 20 bp, Homo sapiens
gcaggaggatcacttgagtc

SEQ ID NO: 3797767 - DNA, 23 bp, Homo sapiens
gcaggaggatcacttgagtccag

SEQ ID NO: 3797768 - DNA, 14 bp, Homo sapiens
gcaggaggattgct

SEQ ID NO: 3797769 - DNA, 11 bp, Homo sapiens
gcaggagggag

SEQ ID NO: 3797770 - DNA, 18 bp, Homo sapiens
gcaggagggccctacctg

SEQ ID NO: 3797771 - DNA, 22 bp, Homo sapiens
gcaggatagttgctccgcctct

SEQ ID NO: 3797772 - DNA, 20 bp, Homo sapiens
gcaggccaagagcagaggca

SEQ ID NO: 3797773 - DNA, 12 bp, Homo sapiens
gcaggcccacct

SEQ ID NO: 3797774 - DNA, 16 bp, Homo sapiens
gcaggctggcaccgcc

SEQ ID NO: 3797775 - DNA, 18 bp, Homo sapiens
gcaggctggcaccgcctt

SEQ ID NO: 3797776 - DNA, 22 bp, Homo sapiens
gcagggagccgagatcacgcca

SEQ ID NO: 3797777 - DNA, 16 bp, Homo sapiens
gcagggagggcttctg

SEQ ID NO: 3797778 - DNA, 13 bp, Homo sapiens
gcagggaggggac

SEQ ID NO: 3797779 - DNA, 19 bp, Homo sapiens
gcagggccttgcccagaga

SEQ ID NO: 3797780 - DNA, 22 bp, Homo sapiens
gcagggctcagcggggacagct

SEQ ID NO: 3797781 - DNA, 20 bp, Homo sapiens
gcaggggcaaacacctgctg

SEQ ID NO: 3797782 - DNA, 15 bp, Homo sapiens
gcagggtcaggagag

SEQ ID NO: 3797783 - DNA, 17 bp, Homo sapiens
gcagggtctcactctgt

SEQ ID NO: 3797784 - DNA, 22 bp, Homo sapiens
gcaggtgtcatatatggggggc

SEQ ID NO: 3797785 - DNA, 22 bp, Homo sapiens
gcaggttgaggggctcctggaa

SEQ ID NO: 3797786 - DNA, 18 bp, Homo sapiens
gcagtagagtcatctcca

SEQ ID NO: 3797787 - DNA, 23 bp, Homo sapiens
gcagtcatcttgaccaagcagga

SEQ ID NO: 3797788 - DNA, 16 bp, Homo sapiens
gcagtctacccacctc

SEQ ID NO: 3797789 - DNA, 15 bp, Homo sapiens
gcagtctctcttacc

SEQ ID NO: 3797790 - DNA, 12 bp, Homo sapiens
gcagtctggagg

SEQ ID NO: 3797791 - DNA, 13 bp, Homo sapiens
gcagtctggaggg

SEQ ID NO: 3797792 - DNA, 21 bp, Homo sapiens
gcagtgaattgtgaccaagtt

SEQ ID NO: 3797793 - DNA, 18 bp, Homo sapiens
gcagtgactgtggccatg

SEQ ID NO: 3797794 - DNA, 20 bp, Homo sapiens
gcagtgagccaagattgcgc

SEQ ID NO: 3797795 - DNA, 14 bp, Homo sapiens
gcagtgattaaggt

SEQ ID NO: 3797796 - DNA, 16 bp, Homo sapiens
gcagtgcagcaaccag

SEQ ID NO: 3797797 - DNA, 22 bp, Homo sapiens
gcagtgcagcaaccagagcact

SEQ ID NO: 3797798 - DNA, 22 bp, Homo sapiens
gcagtgccttccataattatga

SEQ ID NO: 3797799 - DNA, 15 bp, Homo sapiens
gcagtggagagggac

SEQ ID NO: 3797800 - DNA, 12 bp, Homo sapiens
gcagtgggagct

SEQ ID NO: 3797801 - DNA, 13 bp, Homo sapiens
gcagtgggagctg

SEQ ID NO: 3797802 - DNA, 16 bp, Homo sapiens
gcagtgggagctgcct

SEQ ID NO: 3797803 - DNA, 18 bp, Homo sapiens
gcagtgggagctgcctgt

SEQ ID NO: 3797804 - DNA, 20 bp, Homo sapiens
gcagtggtgcgatctgggtt

SEQ ID NO: 3797805 - DNA, 15 bp, Homo sapiens
gcagtgtcttccata

SEQ ID NO: 3797806 - DNA, 19 bp, Homo sapiens
gcagttcagcaccacccta

SEQ ID NO: 3797807 - DNA, 14 bp, Homo sapiens
gcagttggccagag

SEQ ID NO: 3797808 - DNA, 18 bp, Homo sapiens
gcataactgacaaatcaa

SEQ ID NO: 3797809 - DNA, 16 bp, Homo sapiens
gcataggcctgggtgc

SEQ ID NO: 3797810 - DNA, 21 bp, Homo sapiens
gcatatgtttcgctgatatat

SEQ ID NO: 3797811 - DNA, 13 bp, Homo sapiens
gcatcaatcctgt

SEQ ID NO: 3797812 - DNA, 17 bp, Homo sapiens
gcatcacagggcagagc

SEQ ID NO: 3797813 - DNA, 22 bp, Homo sapiens
gcatcacagggcagagccggga

SEQ ID NO: 3797814 - DNA, 13 bp, Homo sapiens
gcatcacctcagg

SEQ ID NO: 3797815 - DNA, 15 bp, Homo sapiens
gcatcacctcaggcc

SEQ ID NO: 3797816 - DNA, 17 bp, Homo sapiens
gcatcacctcaggccag

SEQ ID NO: 3797817 - DNA, 18 bp, Homo sapiens
gcatcaccttaggcaggg

SEQ ID NO: 3797818 - DNA, 12 bp, Homo sapiens
gcatcagaaatg

SEQ ID NO: 3797819 - DNA, 14 bp, Homo sapiens
gcatcatctgtaga

SEQ ID NO: 3797820 - DNA, 22 bp, Homo sapiens
gccccgtgcagactggagggga

SEQ ID NO: 3797821 - DNA, 20 bp, Homo sapiens
gcccctagaatcagcctagg

SEQ ID NO: 3797822 - DNA, 14 bp, Homo sapiens
gcccctcccaccac

SEQ ID NO: 3797823 - DNA, 14 bp, Homo sapiens
gcccctccctacct

SEQ ID NO: 3797824 - DNA, 15 bp, Homo sapiens
gcccctcccttcaac

SEQ ID NO: 3797825 - DNA, 12 bp, Homo sapiens
gcccctcctctg

SEQ ID NO: 3797826 - DNA, 13 bp, Homo sapiens
gcccctcctctgc

SEQ ID NO: 3797827 - DNA, 17 bp, Homo sapiens
gcccctcctctgccacc

SEQ ID NO: 3797828 - DNA, 18 bp, Homo sapiens
gcccctcctctgccacct

SEQ ID NO: 3797829 - DNA, 21 bp, Homo sapiens
gcccctcctctgccacctccc

SEQ ID NO: 3797830 - DNA, 19 bp, Homo sapiens
gcccctcttgccccccacc

SEQ ID NO: 3797831 - DNA, 16 bp, Homo sapiens
gcccctgccaccctgg

SEQ ID NO: 3797832 - DNA, 17 bp, Homo sapiens
gcccctgccaccctggg

SEQ ID NO: 3797833 - DNA, 22 bp, Homo sapiens
gcccctgccccgtcaccatctc

SEQ ID NO: 3797834 - DNA, 14 bp, Homo sapiens
gcccctgcccctca

SEQ ID NO: 3797835 - DNA, 15 bp, Homo sapiens
gcccctgcccggctg

SEQ ID NO: 3797836 - DNA, 16 bp, Homo sapiens
gcccctgctgcctccc

SEQ ID NO: 3797837 - DNA, 16 bp, Homo sapiens
gcccctgctggttcag

SEQ ID NO: 3797838 - DNA, 22 bp, Homo sapiens
gcccctgctggttcagggttgg

SEQ ID NO: 3797839 - DNA, 23 bp, Homo sapiens
gccccttcacttctgaccacact

SEQ ID NO: 3797840 - DNA, 18 bp, Homo sapiens
gccccttctacactctcc

SEQ ID NO: 3797841 - DNA, 20 bp, Homo sapiens
gccccttctacactctcctg

SEQ ID NO: 3797842 - DNA, 23 bp, Homo sapiens
gccccttctacactctcctgggc

SEQ ID NO: 3797843 - DNA, 16 bp, Homo sapiens
gcccctttttactccc

SEQ ID NO: 3797844 - DNA, 19 bp, Homo sapiens
gcccctttttactcccctt

SEQ ID NO: 3797845 - DNA, 12 bp, Homo sapiens
gcccgacagcct

SEQ ID NO: 3797846 - DNA, 14 bp, Homo sapiens
gcccgacagcctgg

SEQ ID NO: 3797847 - DNA, 15 bp, Homo sapiens
gcccgacagcctggc

SEQ ID NO: 3797848 - DNA, 17 bp, Homo sapiens
gcccgacagcctggcac

SEQ ID NO: 3797849 - DNA, 15 bp, Homo sapiens
gcccgaggcaccagt

SEQ ID NO: 3797850 - DNA, 19 bp, Homo sapiens
gcccgaggtggctgcctgg

SEQ ID NO: 3797851 - DNA, 17 bp, Homo sapiens
gcccgcacccccaccct

SEQ ID NO: 3797852 - DNA, 19 bp, Homo sapiens
gcccgcacccccacccttt

SEQ ID NO: 3797853 - DNA, 21 bp, Homo sapiens
gcccgcacccccaccctttgg

SEQ ID NO: 3797854 - DNA, 14 bp, Homo sapiens
gcccgcatgcagca

SEQ ID NO: 3797855 - DNA, 17 bp, Homo sapiens
gcccgcatgcggcccag

SEQ ID NO: 3797856 - DNA, 21 bp, Homo sapiens
gcccggagattggacggcctg

SEQ ID NO: 3797857 - DNA, 18 bp, Homo sapiens
gcccggggcagctgccag

SEQ ID NO: 3797858 - DNA, 18 bp, Homo sapiens
gcccgtcatgttcctcaa

SEQ ID NO: 3797859 - DNA, 16 bp, Homo sapiens
gcccgtcttcagccta

SEQ ID NO: 3797860 - DNA, 20 bp, Homo sapiens
gcccgtgacatccccaccct

SEQ ID NO: 3797861 - DNA, 13 bp, Homo sapiens
gcccgtgtggccc

SEQ ID NO: 3797862 - DNA, 16 bp, Homo sapiens
gcccgtgtggcccctt

SEQ ID NO: 3797863 - DNA, 17 bp, Homo sapiens
gccctagagcacactgt

SEQ ID NO: 3797864 - DNA, 19 bp, Homo sapiens
gccctagagcacactgtag

SEQ ID NO: 3797865 - DNA, 21 bp, Homo sapiens
gccctagagcacactgtagca

SEQ ID NO: 3797866 - DNA, 19 bp, Homo sapiens
gccctcaaaatgacagcca

SEQ ID NO: 3797867 - DNA, 17 bp, Homo sapiens
gccctcattacggctcc

SEQ ID NO: 3797868 - DNA, 23 bp, Homo sapiens
gccctccacagccgcagcctccc

SEQ ID NO: 3797869 - DNA, 17 bp, Homo sapiens
gccctccacatccctga

SEQ ID NO: 3797870 - DNA, 22 bp, Homo sapiens
gccctccatcccgacatggacc

SEQ ID NO: 3797871 - DNA, 21 bp, Homo sapiens
gccctccctgcccctcccttc

SEQ ID NO: 3797872 - DNA, 14 bp, Homo sapiens
gccctccctgtcct

SEQ ID NO: 3797873 - DNA, 16 bp, Homo sapiens
gccctccctgtcctcc

SEQ ID NO: 3797874 - DNA, 10 bp, Homo sapiens
gccctccttc

SEQ ID NO: 3797875 - DNA, 21 bp, Homo sapiens
gccctcttcccctctaatgct

SEQ ID NO: 3797876 - DNA, 13 bp, Homo sapiens
gccctgagctcgg

SEQ ID NO: 3797877 - DNA, 15 bp, Homo sapiens
gccctgagctcggtg

SEQ ID NO: 3797878 - DNA, 14 bp, Homo sapiens
gccctgagctttct

SEQ ID NO: 3797879 - DNA, 16 bp, Homo sapiens
gccctgagctttctgc

SEQ ID NO: 3797880 - DNA, 20 bp, Homo sapiens
gccctgcccttcagcatcct

SEQ ID NO: 3797881 - DNA, 22 bp, Homo sapiens
gccctgctgccgcctcccagcc

SEQ ID NO: 3797882 - DNA, 16 bp, Homo sapiens
gccctgctttgggctg

SEQ ID NO: 3797883 - DNA, 20 bp, Homo sapiens
gccctgctttgggctgccct

SEQ ID NO: 3797884 - DNA, 23 bp, Homo sapiens
gccctgctttgggctgccctggt

SEQ ID NO: 3797885 - DNA, 19 bp, Homo sapiens
gccctggcaggatgaccct

SEQ ID NO: 3797886 - DNA, 15 bp, Homo sapiens
gccctggccagaggc

SEQ ID NO: 3797887 - DNA, 16 bp, Homo sapiens
gccctggccagaggct

SEQ ID NO: 3797888 - DNA, 14 bp, Homo sapiens
gccctggcctgctg

SEQ ID NO: 3797889 - DNA, 17 bp, Homo sapiens
gccctggcctgctgggc

SEQ ID NO: 3797890 - DNA, 15 bp, Homo sapiens
gccctgggccccacc

SEQ ID NO: 3797891 - DNA, 18 bp, Homo sapiens
gccctgggccccaccacc

SEQ ID NO: 3797892 - DNA, 20 bp, Homo sapiens
gccctggggctgatctcagg

SEQ ID NO: 3797893 - DNA, 15 bp, Homo sapiens
gccctggtgctgcca

SEQ ID NO: 3797894 - DNA, 17 bp, Homo sapiens
gccctggtgctgccaca

SEQ ID NO: 3797895 - DNA, 18 bp, Homo sapiens
gccctggtggcagtggga

SEQ ID NO: 3797896 - DNA, 19 bp, Homo sapiens
gccctggtggcagtgggag

SEQ ID NO: 3797897 - DNA, 20 bp, Homo sapiens
gccctggtggcagtgggagc

SEQ ID NO: 3797898 - DNA, 16 bp, Homo sapiens
gccctggtttcactgg

SEQ ID NO: 3797899 - DNA, 20 bp, Homo sapiens
gccctggtttcactggccca

SEQ ID NO: 3797900 - DNA, 19 bp, Homo sapiens
gcccttagcagggaaacag

SEQ ID NO: 3797901 - DNA, 20 bp, Homo sapiens
gcccttagcagggaaacagc

SEQ ID NO: 3797902 - DNA, 18 bp, Homo sapiens
gcccttattttcaagaaa

SEQ ID NO: 3797903 - DNA, 20 bp, Homo sapiens
gcccttattttcaagaaact

SEQ ID NO: 3797904 - DNA, 20 bp, Homo sapiens
gcccttcctctccactgcct

SEQ ID NO: 3797905 - DNA, 22 bp, Homo sapiens
gcccttgagctccccaaaaacc

SEQ ID NO: 3797906 - DNA, 22 bp, Homo sapiens
gcccttgcagttcagcaccacc

SEQ ID NO: 3797907 - DNA, 12 bp, Homo sapiens
gcccttgtccca

SEQ ID NO: 3797908 - DNA, 21 bp, Homo sapiens
gcccttgtcccactcaagcca

SEQ ID NO: 3797909 - DNA, 24 bp, Homo sapiens
gcccttgtcccactcaagccaagc

SEQ ID NO: 3797910 - DNA, 16 bp, Homo sapiens
gccctttctgtaccat

SEQ ID NO: 3797911 - DNA, 13 bp, Homo sapiens
gccctttggagaa

SEQ ID NO: 3797912 - DNA, 21 bp, Homo sapiens
gccctttgggaggctgaggcg

SEQ ID NO: 3797913 - DNA, 13 bp, Homo sapiens
gccgaaactggaa

SEQ ID NO: 3797914 - DNA, 22 bp, Homo sapiens
gccgaccgaggctggagctggc

SEQ ID NO: 3797915 - DNA, 15 bp, Homo sapiens
gccgacctcagcctt

SEQ ID NO: 3797916 - DNA, 13 bp, Homo sapiens
gccgagaagcaag

SEQ ID NO: 3797917 - DNA, 12 bp, Homo sapiens
gccgagagcctg

SEQ ID NO: 3797918 - DNA, 16 bp, Homo sapiens
gccgagagcctgctcc

SEQ ID NO: 3797919 - DNA, 22 bp, Homo sapiens
gccgagagcctgctcccccacc

SEQ ID NO: 3797920 - DNA, 22 bp, Homo sapiens
gccgagatcacgccactgcact

SEQ ID NO: 3797921 - DNA, 17 bp, Homo sapiens
gccgagattgcaccact

SEQ ID NO: 3797922 - DNA, 21 bp, Homo sapiens
gccgagtggatagatgccctg

SEQ ID NO: 3797923 - DNA, 13 bp, Homo sapiens
gccgcaccccaga

SEQ ID NO: 3797924 - DNA, 17 bp, Homo sapiens
gccgcatcttctccatc

SEQ ID NO: 3797925 - DNA, 20 bp, Homo sapiens
gccgcatcttctccatctgg

SEQ ID NO: 3797926 - DNA, 14 bp, Homo sapiens
gccgcattccctga

SEQ ID NO: 3797927 - DNA, 16 bp, Homo sapiens
gccgcctcccagcctg

SEQ ID NO: 3797928 - DNA, 19 bp, Homo sapiens
gccgcctcccagcctgggg

SEQ ID NO: 3797929 - DNA, 21 bp, Homo sapiens
gccgctcctgtctgccagcca

SEQ ID NO: 3797930 - DNA, 23 bp, Homo sapiens
gccgctcctgtctgccagccagc

SEQ ID NO: 3797931 - DNA, 15 bp, Homo sapiens
gccgctgttcaccca

SEQ ID NO: 3797932 - DNA, 12 bp, Homo sapiens
gccggccctggg

SEQ ID NO: 3797933 - DNA, 20 bp, Homo sapiens
gcctgcgttttggaagctct

SEQ ID NO: 3797934 - DNA, 13 bp, Homo sapiens
gcctgctccccca

SEQ ID NO: 3797935 - DNA, 15 bp, Homo sapiens
gcctgctcccccacc

SEQ ID NO: 3797936 - DNA, 19 bp, Homo sapiens
gcctgctcccccaccccct

SEQ ID NO: 3797937 - DNA, 23 bp, Homo sapiens
gcctgctgaatgatttccaaaga

SEQ ID NO: 3797938 - DNA, 10 bp, Homo sapiens
gcctgctgca

SEQ ID NO: 3797939 - DNA, 16 bp, Homo sapiens
gcctgctgggctctcc

SEQ ID NO: 3797940 - DNA, 18 bp, Homo sapiens
gcctgctgggctctccac

SEQ ID NO: 3797941 - DNA, 22 bp, Homo sapiens
gcctggaggccgggtgctcagg

SEQ ID NO: 3797942 - DNA, 13 bp, Homo sapiens
gcctggcacaggg

SEQ ID NO: 3797943 - DNA, 13 bp, Homo sapiens
gcctggcagaact

SEQ ID NO: 3797944 - DNA, 12 bp, Homo sapiens
gcctggcagccg

SEQ ID NO: 3797945 - DNA, 17 bp, Homo sapiens
gcctggcatggcacctg

SEQ ID NO: 3797946 - DNA, 14 bp, Homo sapiens
gcctggccagatgc

SEQ ID NO: 3797947 - DNA, 16 bp, Homo sapiens
gcctggccagatgcac

SEQ ID NO: 3797948 - DNA, 22 bp, Homo sapiens
gcctggccagatgcaccagccc

SEQ ID NO: 3797949 - DNA, 19 bp, Homo sapiens
gcctggcgacagagcgaga

SEQ ID NO: 3797950 - DNA, 17 bp, Homo sapiens
gcctggctccgctgtgt

SEQ ID NO: 3797951 - DNA, 16 bp, Homo sapiens
gcctggctccgtccag

SEQ ID NO: 3797952 - DNA, 14 bp, Homo sapiens
gcctggcttctgga

SEQ ID NO: 3797953 - DNA, 16 bp, Homo sapiens
gcctggcttctggagc

SEQ ID NO: 3797954 - DNA, 23 bp, Homo sapiens
gcctgggaatgtattattctgca

SEQ ID NO: 3797955 - DNA, 21 bp, Homo sapiens
gcctgggaggtcaaggctgca

SEQ ID NO: 3797956 - DNA, 22 bp, Homo sapiens
gcctgggaggtcaaggctgcag

SEQ ID NO: 3797957 - DNA, 16 bp, Homo sapiens
gcctgggcaacagagc

SEQ ID NO: 3797958 - DNA, 19 bp, Homo sapiens
gcctgggtctgtgtctctt

SEQ ID NO: 3797959 - DNA, 15 bp, Homo sapiens
gcctgggtgctggct

SEQ ID NO: 3797960 - DNA, 14 bp, Homo sapiens
gcctggtccctggg

SEQ ID NO: 3797961 - DNA, 12 bp, Homo sapiens
gcctggtctcct

SEQ ID NO: 3797962 - DNA, 16 bp, Homo sapiens
gcctggtctcctgccc

SEQ ID NO: 3797963 - DNA, 13 bp, Homo sapiens
gcctggtgcagtg

SEQ ID NO: 3797964 - DNA, 13 bp, Homo sapiens
gcctggtgctgct

SEQ ID NO: 3797965 - DNA, 14 bp, Homo sapiens
gcctggtggcagct

SEQ ID NO: 3797966 - DNA, 13 bp, Homo sapiens
gcctggtgggcct

SEQ ID NO: 3797967 - DNA, 18 bp, Homo sapiens
gcctgtaatcccagcagt

SEQ ID NO: 3797968 - DNA, 23 bp, Homo sapiens
gcctgtagttaggaaataaaacc

SEQ ID NO: 3797969 - DNA, 13 bp, Homo sapiens
gcctgtccccctg

SEQ ID NO: 3797970 - DNA, 18 bp, Homo sapiens
gcctgtccctggccatct

SEQ ID NO: 3797971 - DNA, 20 bp, Homo sapiens
gcctgtccctggccatctct

SEQ ID NO: 3797972 - DNA, 20 bp, Homo sapiens
gcctgtcctgacctgtctca

SEQ ID NO: 3797973 - DNA, 15 bp, Homo sapiens
gcctgtcgtgccagt

SEQ ID NO: 3797974 - DNA, 18 bp, Homo sapiens
gcctgtcgtgccagtcct

SEQ ID NO: 3797975 - DNA, 19 bp, Homo sapiens
gcctgtctcatccccaggg

SEQ ID NO: 3797976 - DNA, 15 bp, Homo sapiens
gcctgtgagccagtc

SEQ ID NO: 3797977 - DNA, 17 bp, Homo sapiens
gcctgtgaggtgcagag

SEQ ID NO: 3797978 - DNA, 24 bp, Homo sapiens
gcctgtgaggtgcagagtgcccag

SEQ ID NO: 3797979 - DNA, 12 bp, Homo sapiens
gcctgtgcagtg

SEQ ID NO: 3797980 - DNA, 18 bp, Homo sapiens
gcctgtgcctctgggact

SEQ ID NO: 3797981 - DNA, 19 bp, Homo sapiens
gcctgtgcctctgggactg

SEQ ID NO: 3797982 - DNA, 23 bp, Homo sapiens
gcctgtgctgcccgtcttcagcc

SEQ ID NO: 3797983 - DNA, 13 bp, Homo sapiens
gcctgtgctgtga

SEQ ID NO: 3797984 - DNA, 14 bp, Homo sapiens
gcctgtgctgtgac

SEQ ID NO: 3797985 - DNA, 21 bp, Homo sapiens
gcctgtggttacagtgcagac

SEQ ID NO: 3797986 - DNA, 16 bp, Homo sapiens
gcctgttcagctccag

SEQ ID NO: 3797987 - DNA, 23 bp, Homo sapiens
gcctgttcccattcttgcatggc

SEQ ID NO: 3797988 - DNA, 13 bp, Homo sapiens
gccttaaaacttt

SEQ ID NO: 3797989 - DNA, 12 bp, Homo sapiens
gccttacctcct

SEQ ID NO: 3797990 - DNA, 19 bp, Homo sapiens
gccttacctcctgcccagg

SEQ ID NO: 3797991 - DNA, 21 bp, Homo sapiens
gccttacctcctgcccaggag

SEQ ID NO: 3797992 - DNA, 19 bp, Homo sapiens
gccttactttgtatgatat

SEQ ID NO: 3797993 - DNA, 16 bp, Homo sapiens
gccttagaacctttct

SEQ ID NO: 3797994 - DNA, 17 bp, Homo sapiens
gccttagaacctttctt

SEQ ID NO: 3797995 - DNA, 17 bp, Homo sapiens
gccttagaagtcacaca

SEQ ID NO: 3797996 - DNA, 18 bp, Homo sapiens
gccttagaagtcacacag

SEQ ID NO: 3797997 - DNA, 20 bp, Homo sapiens
gccttcactccggtgtgcct

SEQ ID NO: 3797998 - DNA, 13 bp, Homo sapiens
gccttcagctcta

SEQ ID NO: 3797999 - DNA, 19 bp, Homo sapiens
gccttccacgctgtctcca

SEQ ID NO: 3798000 - DNA, 23 bp, Homo sapiens
gccttccacgctgtctccagacc

SEQ ID NO: 3798001 - DNA, 14 bp, Homo sapiens
gccttccccagcct

SEQ ID NO: 3798002 - DNA, 18 bp, Homo sapiens
gccttccccttgcccagg

SEQ ID NO: 3798003 - DNA, 18 bp, Homo sapiens
gccttcgatacaccgggc

SEQ ID NO: 3798004 - DNA, 16 bp, Homo sapiens
gccttctctgaaggac

SEQ ID NO: 3798005 - DNA, 15 bp, Homo sapiens
gccttgaagccactg

SEQ ID NO: 3798006 - DNA, 16 bp, Homo sapiens
gccttgcccagagatg

SEQ ID NO: 3798007 - DNA, 20 bp, Homo sapiens
gccttgcccagagatgcctc

SEQ ID NO: 3798008 - DNA, 19 bp, Homo sapiens
gccttgctacctcaagggg

SEQ ID NO: 3798009 - DNA, 18 bp, Homo sapiens
gccttgggctgctcctca

SEQ ID NO: 3798010 - DNA, 17 bp, Homo sapiens
gccttggtgtccacctg

SEQ ID NO: 3798011 - DNA, 19 bp, Homo sapiens
gccttggttcatcagtgtt

SEQ ID NO: 3798012 - DNA, 18 bp, Homo sapiens
gcctttcctgttcagcat

SEQ ID NO: 3798013 - DNA, 22 bp, Homo sapiens
gcctttctcccaggccaggctc

SEQ ID NO: 3798014 - DNA, 23 bp, Homo sapiens
gcctttctcccaggccaggctcc

SEQ ID NO: 3798015 - DNA, 17 bp, Homo sapiens
gcctttgatcaggtggg

SEQ ID NO: 3798016 - DNA, 23 bp, Homo sapiens
gcctttgccaccaactggccctc

SEQ ID NO: 3798017 - DNA, 13 bp, Homo sapiens
gcctttggcttca

SEQ ID NO: 3798018 - DNA, 15 bp, Homo sapiens
gcctttgtaagttat

SEQ ID NO: 3798019 - DNA, 15 bp, Homo sapiens
gcctttgttgctcag

SEQ ID NO: 3798020 - DNA, 23 bp, Homo sapiens
gcgaaaggatgtaaacagtgcct

SEQ ID NO: 3798021 - DNA, 20 bp, Homo sapiens
gcgaagtatataaattggct

SEQ ID NO: 3798022 - DNA, 20 bp, Homo sapiens
gcgaatggtagtctaaccaa

SEQ ID NO: 3798023 - DNA, 23 bp, Homo sapiens
gcgacagagcgagagtctgtctc

SEQ ID NO: 3798024 - DNA, 21 bp, Homo sapiens
gcgactctatagactctagga

SEQ ID NO: 3798025 - DNA, 17 bp, Homo sapiens
gcgagccctggtggcag

SEQ ID NO: 3798026 - DNA, 19 bp, Homo sapiens
gcgaggtcaacagagaagg

SEQ ID NO: 3798027 - DNA, 22 bp, Homo sapiens
gcgatcatggctcactgcagcc

SEQ ID NO: 3798028 - DNA, 22 bp, Homo sapiens
gcgatctgggttcactgcaacc

SEQ ID NO: 3798029 - DNA, 21 bp, Homo sapiens
gcgatgtttcaggaggctgga

SEQ ID NO: 3798030 - DNA, 23 bp, Homo sapiens
gcgatgtttcaggaggctggagg

SEQ ID NO: 3798031 - DNA, 21 bp, Homo sapiens
gcgccactacactccagcctg

SEQ ID NO: 3798032 - DNA, 24 bp, Homo sapiens
gcgccactacactccagcctgagc

SEQ ID NO: 3798033 - DNA, 16 bp, Homo sapiens
gcgccactcgcttccc

SEQ ID NO: 3798034 - DNA, 23 bp, Homo sapiens
gcgcccagttgggtggatgcctg

SEQ ID NO: 3798035 - DNA, 13 bp, Homo sapiens
gcgcccccagtgt

SEQ ID NO: 3798036 - DNA, 15 bp, Homo sapiens
gcgcctacaggagtg

SEQ ID NO: 3798037 - DNA, 20 bp, Homo sapiens
gcgcctagtggggtctccct

SEQ ID NO: 3798038 - DNA, 20 bp, Homo sapiens
gcgcgccctcccttggcgtg

SEQ ID NO: 3798039 - DNA, 16 bp, Homo sapiens
gcgctacccacttcta

SEQ ID NO: 3798040 - DNA, 19 bp, Homo sapiens
gcgctgccgcaccccagag

SEQ ID NO: 3798041 - DNA, 17 bp, Homo sapiens
gcgcttttgctggtcac

SEQ ID NO: 3798042 - DNA, 15 bp, Homo sapiens
gcggaaagcagctca

SEQ ID NO: 3798043 - DNA, 11 bp, Homo sapiens
gcggacagcca

SEQ ID NO: 3798044 - DNA, 13 bp, Homo sapiens
gcggacagccacg

SEQ ID NO: 3798045 - DNA, 15 bp, Homo sapiens
gcggacagccacggc

SEQ ID NO: 3798046 - DNA, 19 bp, Homo sapiens
gctggccgagggtcctggc

SEQ ID NO: 3798047 - DNA, 24 bp, Homo sapiens
gctggccgagggtcctggctcctg

SEQ ID NO: 3798048 - DNA, 21 bp, Homo sapiens
gctggccgggcacagctgtgg

SEQ ID NO: 3798049 - DNA, 13 bp, Homo sapiens
gctggcctcagac

SEQ ID NO: 3798050 - DNA, 20 bp, Homo sapiens
gctggcggctactcagcagc

SEQ ID NO: 3798051 - DNA, 21 bp, Homo sapiens
gctggcggctactcagcagcc

SEQ ID NO: 3798052 - DNA, 18 bp, Homo sapiens
gctggcgtgcagtggtgc

SEQ ID NO: 3798053 - DNA, 19 bp, Homo sapiens
gctggctcccagggccatg

SEQ ID NO: 3798054 - DNA, 13 bp, Homo sapiens
gctggctgcagtg

SEQ ID NO: 3798055 - DNA, 14 bp, Homo sapiens
gctggctgcagtga

SEQ ID NO: 3798056 - DNA, 15 bp, Homo sapiens
gctggctgttggctg

SEQ ID NO: 3798057 - DNA, 16 bp, Homo sapiens
gctggctgttggctgg

SEQ ID NO: 3798058 - DNA, 20 bp, Homo sapiens
gctgggactacaggcaccca

SEQ ID NO: 3798059 - DNA, 16 bp, Homo sapiens
gctgggagctctgcag

SEQ ID NO: 3798060 - DNA, 19 bp, Homo sapiens
gctgggagggatagagggg

SEQ ID NO: 3798061 - DNA, 21 bp, Homo sapiens
gctgggagggatagagggggg

SEQ ID NO: 3798062 - DNA, 20 bp, Homo sapiens
gctgggatctgactgcacgt

SEQ ID NO: 3798063 - DNA, 18 bp, Homo sapiens
gctgggattacaggtgtg

SEQ ID NO: 3798064 - DNA, 19 bp, Homo sapiens
gctgggattacaggtgtga

SEQ ID NO: 3798065 - DNA, 13 bp, Homo sapiens
gctgggcagaagg

SEQ ID NO: 3798066 - DNA, 19 bp, Homo sapiens
gctgggcagaaggccaaga

SEQ ID NO: 3798067 - DNA, 12 bp, Homo sapiens
gctgggcccaga

SEQ ID NO: 3798068 - DNA, 21 bp, Homo sapiens
gctgggcccagaggcacagcc

SEQ ID NO: 3798069 - DNA, 21 bp, Homo sapiens
gctgggctctccacctcagcc

SEQ ID NO: 3798070 - DNA, 18 bp, Homo sapiens
gctgggcttcagtggcag

SEQ ID NO: 3798071 - DNA, 13 bp, Homo sapiens
gctgggggcagga

SEQ ID NO: 3798072 - DNA, 20 bp, Homo sapiens
gctgggggcctcactccagg

SEQ ID NO: 3798073 - DNA, 14 bp, Homo sapiens
gctgggggcctcag

SEQ ID NO: 3798074 - DNA, 14 bp, Homo sapiens
gctgggttggaggg

SEQ ID NO: 3798075 - DNA, 18 bp, Homo sapiens
gctggtaagggccaagtc

SEQ ID NO: 3798076 - DNA, 23 bp, Homo sapiens
gctggtaagggccaagtcccacc

SEQ ID NO: 3798077 - DNA, 17 bp, Homo sapiens
gctggtagagatggagg

SEQ ID NO: 3798078 - DNA, 13 bp, Homo sapiens
gctggtcactgcc

SEQ ID NO: 3798079 - DNA, 20 bp, Homo sapiens
gctggtcccactcagtccat

SEQ ID NO: 3798080 - DNA, 17 bp, Homo sapiens
gctggtgcattacagag

SEQ ID NO: 3798081 - DNA, 17 bp, Homo sapiens
gctggtggctaatggtg

SEQ ID NO: 3798082 - DNA, 13 bp, Homo sapiens
gctggtgggcacc

SEQ ID NO: 3798083 - DNA, 15 bp, Homo sapiens
gctggtgggcaccaa

SEQ ID NO: 3798084 - DNA, 24 bp, Homo sapiens
gctggttgtcatttttgcagtaga

SEQ ID NO: 3798085 - DNA, 14 bp, Homo sapiens
gctgtatcttgttt

SEQ ID NO: 3798086 - DNA, 18 bp, Homo sapiens
gctgtcataagaatgaat

SEQ ID NO: 3798087 - DNA, 13 bp, Homo sapiens
gctgtccctcact

SEQ ID NO: 3798088 - DNA, 15 bp, Homo sapiens
gctgtccctgtcacc

SEQ ID NO: 3798089 - DNA, 18 bp, Homo sapiens
gctgtccctgtcaccaag

SEQ ID NO: 3798090 - DNA, 22 bp, Homo sapiens
gctgtgaccatttataatgtta

SEQ ID NO: 3798091 - DNA, 18 bp, Homo sapiens
gctgtgagtgtaagtgtg

SEQ ID NO: 3798092 - DNA, 15 bp, Homo sapiens
gctgtgcctctgcct

SEQ ID NO: 3798093 - DNA, 16 bp, Homo sapiens
gctgtgcctctgcctg

SEQ ID NO: 3798094 - DNA, 21 bp, Homo sapiens
gctgtgctctggacaggcatg

SEQ ID NO: 3798095 - DNA, 18 bp, Homo sapiens
gctgtgggcctcaaggac

SEQ ID NO: 3798096 - DNA, 18 bp, Homo sapiens
gctgtgtccaactccagt

SEQ ID NO: 3798097 - DNA, 14 bp, Homo sapiens
gctgttggctgggg

SEQ ID NO: 3798098 - DNA, 15 bp, Homo sapiens
gctgttggctggggg

SEQ ID NO: 3798099 - DNA, 16 bp, Homo sapiens
gctgttggctgggggc

SEQ ID NO: 3798100 - DNA, 14 bp, Homo sapiens
gctgtttatggcct

SEQ ID NO: 3798101 - DNA, 13 bp, Homo sapiens
gctgtttccatag

SEQ ID NO: 3798102 - DNA, 11 bp, Homo sapiens
gctgtttcctt

SEQ ID NO: 3798103 - DNA, 21 bp, Homo sapiens
gctgtttgtttgacaaagaaa

SEQ ID NO: 3798104 - DNA, 13 bp, Homo sapiens
gcttaaaaaaaac

SEQ ID NO: 3798105 - DNA, 16 bp, Homo sapiens
gcttaaaacttttcaa

SEQ ID NO: 3798106 - DNA, 18 bp, Homo sapiens
gcttaatgacactagcta

SEQ ID NO: 3798107 - DNA, 15 bp, Homo sapiens
gcttacctcccacct

SEQ ID NO: 3798108 - DNA, 17 bp, Homo sapiens
gcttagacctcagcctg

SEQ ID NO: 3798109 - DNA, 20 bp, Homo sapiens
gcttatcaatttgtcatttt

SEQ ID NO: 3798110 - DNA, 22 bp, Homo sapiens
gcttatcaatttgtcattttga

SEQ ID NO: 3798111 - DNA, 23 bp, Homo sapiens
gcttatcatgctgtctttacatg

SEQ ID NO: 3798112 - DNA, 17 bp, Homo sapiens
gcttatccttccacgga

SEQ ID NO: 3798113 - DNA, 19 bp, Homo sapiens
gcttatctcaggggtgtgc

SEQ ID NO: 3798114 - DNA, 18 bp, Homo sapiens
gcttatgacatcacttgt

SEQ ID NO: 3798115 - DNA, 15 bp, Homo sapiens
gcttattaatgctaa

SEQ ID NO: 3798116 - DNA, 20 bp, Homo sapiens
gcttattaatgctaagggca

SEQ ID NO: 3798117 - DNA, 16 bp, Homo sapiens
gcttattctcaaagca

SEQ ID NO: 3798118 - DNA, 18 bp, Homo sapiens
gcttattctcaaagcagg

SEQ ID NO: 3798119 - DNA, 22 bp, Homo sapiens
gcttattgttccaagacattgt

SEQ ID NO: 3798120 - DNA, 17 bp, Homo sapiens
gcttatttcctcatttt

SEQ ID NO: 3798121 - DNA, 12 bp, Homo sapiens
gcttattttaaa

SEQ ID NO: 3798122 - DNA, 21 bp, Homo sapiens
gcttcaaactaacacattttt

SEQ ID NO: 3798123 - DNA, 20 bp, Homo sapiens
gcttcaatttattgcacaaa

SEQ ID NO: 3798124 - DNA, 19 bp, Homo sapiens
gcttcagcatatttatagc

SEQ ID NO: 3798125 - DNA, 15 bp, Homo sapiens
gcttcagccaggagc

SEQ ID NO: 3798126 - DNA, 19 bp, Homo sapiens
gcttcagccaggagctggg

SEQ ID NO: 3798127 - DNA, 14 bp, Homo sapiens
gcttcagcctgagg

SEQ ID NO: 3798128 - DNA, 15 bp, Homo sapiens
gcttcagcctgaggc

SEQ ID NO: 3798129 - DNA, 20 bp, Homo sapiens
gcttcagcctgaggctgaga

SEQ ID NO: 3798130 - DNA, 18 bp, Homo sapiens
gcttcagtggcagctgct

SEQ ID NO: 3798131 - DNA, 18 bp, Homo sapiens
gcttcatgaaaatcctac

SEQ ID NO: 3798132 - DNA, 12 bp, Homo sapiens
gcttccaatttt

SEQ ID NO: 3798133 - DNA, 19 bp, Homo sapiens
gcttccagaaaaccccagc

SEQ ID NO: 3798134 - DNA, 12 bp, Homo sapiens
gcttccattcca

SEQ ID NO: 3798135 - DNA, 14 bp, Homo sapiens
gcttcccccatagc

SEQ ID NO: 3798136 - DNA, 14 bp, Homo sapiens
gcttcccctctctc

SEQ ID NO: 3798137 - DNA, 16 bp, Homo sapiens
gcttcccgctcagccc

SEQ ID NO: 3798138 - DNA, 18 bp, Homo sapiens
gcttcccgctcagccctc

SEQ ID NO: 3798139 - DNA, 15 bp, Homo sapiens
gcttccctctgcctg

SEQ ID NO: 3798140 - DNA, 17 bp, Homo sapiens
gcttccctctgcctgtc

SEQ ID NO: 3798141 - DNA, 19 bp, Homo sapiens
gcttccctctgcctgtccc

SEQ ID NO: 3798142 - DNA, 23 bp, Homo sapiens
gcttccctctgcctgtccctctc

SEQ ID NO: 3798143 - DNA, 22 bp, Homo sapiens
gcttcctttgtttttttttcct

SEQ ID NO: 3798144 - DNA, 17 bp, Homo sapiens
gcttctaccaactggaa

SEQ ID NO: 3798145 - DNA, 22 bp, Homo sapiens
gcttctaccaactggaagcaca

SEQ ID NO: 3798146 - DNA, 17 bp, Homo sapiens
gcttctcactgccatgc

SEQ ID NO: 3798147 - DNA, 16 bp, Homo sapiens
gcttctcatcctgcag

SEQ ID NO: 3798148 - DNA, 14 bp, Homo sapiens
gcttctctacagac

SEQ ID NO: 3798149 - DNA, 23 bp, Homo sapiens
gcttctctttaactcaggactcc

SEQ ID NO: 3798150 - DNA, 20 bp, Homo sapiens
gcttctgatgaatcttgcgt

SEQ ID NO: 3798151 - DNA, 12 bp, Homo sapiens
gcttctggagcc

SEQ ID NO: 3798152 - DNA, 15 bp, Homo sapiens
gcttctgtttctagt

SEQ ID NO: 3798153 - DNA, 19 bp, Homo sapiens
gcttcttaatataactgcc

SEQ ID NO: 3798154 - DNA, 18 bp, Homo sapiens
gcttcttactattaagca

SEQ ID NO: 3798155 - DNA, 11 bp, Homo sapiens
gcttgaacaca

SEQ ID NO: 3798156 - DNA, 12 bp, Homo sapiens
gcttgaacacag

SEQ ID NO: 3798157 - DNA, 13 bp, Homo sapiens
gcttgaacccagg

SEQ ID NO: 3798158 - DNA, 16 bp, Homo sapiens
gcttgaacccaggagg

SEQ ID NO: 3798159 - DNA, 22 bp, Homo sapiens
ggcaatataaccaatgtttaaa

SEQ ID NO: 3798160 - DNA, 11 bp, Homo sapiens
ggcacaataaa

SEQ ID NO: 3798161 - DNA, 13 bp, Homo sapiens
ggcacacacctgt

SEQ ID NO: 3798162 - DNA, 21 bp, Homo sapiens
ggcacagccggggcctgccta

SEQ ID NO: 3798163 - DNA, 12 bp, Homo sapiens
ggcacatagaga

SEQ ID NO: 3798164 - DNA, 20 bp, Homo sapiens
ggcacatttccccagacctg

SEQ ID NO: 3798165 - DNA, 15 bp, Homo sapiens
ggcaccagcagcctg

SEQ ID NO: 3798166 - DNA, 16 bp, Homo sapiens
ggcacccacaaataaa

SEQ ID NO: 3798167 - DNA, 20 bp, Homo sapiens
ggcacccacaagtgccactg

SEQ ID NO: 3798168 - DNA, 15 bp, Homo sapiens
ggcaccgagaatgtt

SEQ ID NO: 3798169 - DNA, 17 bp, Homo sapiens
ggcacctataaaacagg

SEQ ID NO: 3798170 - DNA, 14 bp, Homo sapiens
ggcacctggggagt

SEQ ID NO: 3798171 - DNA, 17 bp, Homo sapiens
ggcacctggggagtggg

SEQ ID NO: 3798172 - DNA, 16 bp, Homo sapiens
ggcacctgtcgcccag

SEQ ID NO: 3798173 - DNA, 18 bp, Homo sapiens
ggcacgaacccacctgct

SEQ ID NO: 3798174 - DNA, 18 bp, Homo sapiens
ggcactcagaagacactg

SEQ ID NO: 3798175 - DNA, 19 bp, Homo sapiens
ggcactcagaagacactga

SEQ ID NO: 3798176 - DNA, 22 bp, Homo sapiens
ggcagaaagcaaatgtgacctg

SEQ ID NO: 3798177 - DNA, 14 bp, Homo sapiens
ggcagaaagtggcc

SEQ ID NO: 3798178 - DNA, 15 bp, Homo sapiens
ggcagaaccctggtg

SEQ ID NO: 3798179 - DNA, 14 bp, Homo sapiens
ggcagaactgagct

SEQ ID NO: 3798180 - DNA, 19 bp, Homo sapiens
ggcagacagcagctcaggc

SEQ ID NO: 3798181 - DNA, 14 bp, Homo sapiens
ggcagagggcagag

SEQ ID NO: 3798182 - DNA, 16 bp, Homo sapiens
ggcagagtgccccacc

SEQ ID NO: 3798183 - DNA, 15 bp, Homo sapiens
ggcagataatcagcc

SEQ ID NO: 3798184 - DNA, 18 bp, Homo sapiens
ggcagataatcagcctct

SEQ ID NO: 3798185 - DNA, 19 bp, Homo sapiens
ggcagataatcagcctctt

SEQ ID NO: 3798186 - DNA, 18 bp, Homo sapiens
ggcagatcaccagaggtc

SEQ ID NO: 3798187 - DNA, 15 bp, Homo sapiens
ggcagatctgtgccc

SEQ ID NO: 3798188 - DNA, 16 bp, Homo sapiens
ggcagatctgtgcccc

SEQ ID NO: 3798189 - DNA, 20 bp, Homo sapiens
ggcagatctgtgccccatgc

SEQ ID NO: 3798190 - DNA, 21 bp, Homo sapiens
ggcagattttacaaaagatgt

SEQ ID NO: 3798191 - DNA, 14 bp, Homo sapiens
ggcagcacagagac

SEQ ID NO: 3798192 - DNA, 13 bp, Homo sapiens
ggcagccaggctg

SEQ ID NO: 3798193 - DNA, 14 bp, Homo sapiens
ggcagccccagcac

SEQ ID NO: 3798194 - DNA, 16 bp, Homo sapiens
ggcagccccattctgc

SEQ ID NO: 3798195 - DNA, 21 bp, Homo sapiens
ggcagccgtgccttcagctct

SEQ ID NO: 3798196 - DNA, 19 bp, Homo sapiens
ggcagcctactagggacct

SEQ ID NO: 3798197 - DNA, 16 bp, Homo sapiens
ggcagcctgcgtggct

SEQ ID NO: 3798198 - DNA, 21 bp, Homo sapiens
ggcagctgaactattggaggg

SEQ ID NO: 3798199 - DNA, 17 bp, Homo sapiens
ggcagctgccagagaag

SEQ ID NO: 3798200 - DNA, 19 bp, Homo sapiens
ggcagctgcggtccaccca

SEQ ID NO: 3798201 - DNA, 15 bp, Homo sapiens
ggcaggaaggagagc

SEQ ID NO: 3798202 - DNA, 23 bp, Homo sapiens
ggcaggaaggagagcctgctgca

SEQ ID NO: 3798203 - DNA, 14 bp, Homo sapiens
ggcaggaaggctga

SEQ ID NO: 3798204 - DNA, 18 bp, Homo sapiens
ggcaggaggatcacttga

SEQ ID NO: 3798205 - DNA, 14 bp, Homo sapiens
ggcaggagggccct

SEQ ID NO: 3798206 - DNA, 15 bp, Homo sapiens
ggcaggatgaccctg

SEQ ID NO: 3798207 - DNA, 15 bp, Homo sapiens
ggcaggatgacttta

SEQ ID NO: 3798208 - DNA, 15 bp, Homo sapiens
ggcagggaggcacca

SEQ ID NO: 3798209 - DNA, 23 bp, Homo sapiens
ggcaggggtggaggagagcctgg

SEQ ID NO: 3798210 - DNA, 19 bp, Homo sapiens
ggcagggtctcactctgtc

SEQ ID NO: 3798211 - DNA, 20 bp, Homo sapiens
ggcagggtctcactctgtcg

SEQ ID NO: 3798212 - DNA, 23 bp, Homo sapiens
ggcagggtgggatggaggagaag

SEQ ID NO: 3798213 - DNA, 20 bp, Homo sapiens
ggcagggttttatctctgtc

SEQ ID NO: 3798214 - DNA, 13 bp, Homo sapiens
ggcaggtccaggg

SEQ ID NO: 3798215 - DNA, 21 bp, Homo sapiens
ggcaggtgacagtgaggtcct

SEQ ID NO: 3798216 - DNA, 16 bp, Homo sapiens
ggcagtaaagagaaac

SEQ ID NO: 3798217 - DNA, 23 bp, Homo sapiens
ggcagtagctgtggtgaggtggg

SEQ ID NO: 3798218 - DNA, 22 bp, Homo sapiens
ggcagtgcagcaaccagagcac

SEQ ID NO: 3798219 - DNA, 11 bp, Homo sapiens
ggcagtggagg

SEQ ID NO: 3798220 - DNA, 13 bp, Homo sapiens
ggcagtgggagct

SEQ ID NO: 3798221 - DNA, 21 bp, Homo sapiens
ggcagttctgggtgctcccta

SEQ ID NO: 3798222 - DNA, 15 bp, Homo sapiens
ggcataggcctgggt

SEQ ID NO: 3798223 - DNA, 17 bp, Homo sapiens
ggcataggcctgggtgc

SEQ ID NO: 3798224 - DNA, 23 bp, Homo sapiens
ggcatcatgcatcttactgaagg

SEQ ID NO: 3798225 - DNA, 18 bp, Homo sapiens
ggcatcccagtggcctca

SEQ ID NO: 3798226 - DNA, 21 bp, Homo sapiens
ggcatctcctgtgcatgggtg

SEQ ID NO: 3798227 - DNA, 16 bp, Homo sapiens
ggcatctgcccctccc

SEQ ID NO: 3798228 - DNA, 19 bp, Homo sapiens
ggcatctgcccctccccca

SEQ ID NO: 3798229 - DNA, 22 bp, Homo sapiens
ggcatctttgccttgggctgct

SEQ ID NO: 3798230 - DNA, 15 bp, Homo sapiens
ggcatgcctggacaa

SEQ ID NO: 3798231 - DNA, 13 bp, Homo sapiens
ggcatgcctgtgt

SEQ ID NO: 3798232 - DNA, 13 bp, Homo sapiens
ggcatgctggggc

SEQ ID NO: 3798233 - DNA, 19 bp, Homo sapiens
ggcatggtatttgagacat

SEQ ID NO: 3798234 - DNA, 19 bp, Homo sapiens
ggcatggtggcgcaagcct

SEQ ID NO: 3798235 - DNA, 13 bp, Homo sapiens
ggcatgtgaaggg

SEQ ID NO: 3798236 - DNA, 23 bp, Homo sapiens
ggccaaacatcagacctgtcttc

SEQ ID NO: 3798237 - DNA, 13 bp, Homo sapiens
ggccaaagtgtta

SEQ ID NO: 3798238 - DNA, 13 bp, Homo sapiens
ggccaaattccct

SEQ ID NO: 3798239 - DNA, 18 bp, Homo sapiens
ggccaacaccagggatgg

SEQ ID NO: 3798240 - DNA, 17 bp, Homo sapiens
ggccaaccccaaagaag

SEQ ID NO: 3798241 - DNA, 13 bp, Homo sapiens
ggccaagatgctt

SEQ ID NO: 3798242 - DNA, 19 bp, Homo sapiens
ggccaagatgcttttcaaa

SEQ ID NO: 3798243 - DNA, 13 bp, Homo sapiens
ggccaaggactgc

SEQ ID NO: 3798244 - DNA, 17 bp, Homo sapiens
ggccaaggactgccgac

SEQ ID NO: 3798245 - DNA, 10 bp, Homo sapiens
ggccacctgc

SEQ ID NO: 3798246 - DNA, 13 bp, Homo sapiens
ggccacctgcagg

SEQ ID NO: 3798247 - DNA, 22 bp, Homo sapiens
ggccacctgcccccttctccca

SEQ ID NO: 3798248 - DNA, 17 bp, Homo sapiens
ggccactccagacccct

SEQ ID NO: 3798249 - DNA, 13 bp, Homo sapiens
ggccactcctcca

SEQ ID NO: 3798250 - DNA, 21 bp, Homo sapiens
ggccactctgcctctgcctgc

SEQ ID NO: 3798251 - DNA, 22 bp, Homo sapiens
ggccactctgcctctgcctgca

SEQ ID NO: 3798252 - DNA, 16 bp, Homo sapiens
ggccactgtgaagaga

SEQ ID NO: 3798253 - DNA, 19 bp, Homo sapiens
ggccagaccagagctctgg

SEQ ID NO: 3798254 - DNA, 17 bp, Homo sapiens
ggccagagggagtgaca

SEQ ID NO: 3798255 - DNA, 19 bp, Homo sapiens
ggccagagggagtgacaga

SEQ ID NO: 3798256 - DNA, 23 bp, Homo sapiens
ggccagagggagtgacagaggca

SEQ ID NO: 3798257 - DNA, 21 bp, Homo sapiens
ggccagatctgttaagtggtt

SEQ ID NO: 3798258 - DNA, 20 bp, Homo sapiens
ggccagatgcaccagccctt

SEQ ID NO: 3798259 - DNA, 14 bp, Homo sapiens
ggccagccccaccc

SEQ ID NO: 3798260 - DNA, 14 bp, Homo sapiens
ggccagcccctccc

SEQ ID NO: 3798261 - DNA, 16 bp, Homo sapiens
ggccagcccctcccac

SEQ ID NO: 3798262 - DNA, 16 bp, Homo sapiens
ggccaggacaggcccg

SEQ ID NO: 3798263 - DNA, 19 bp, Homo sapiens
ggccaggagtttgagacca

SEQ ID NO: 3798264 - DNA, 15 bp, Homo sapiens
ggccaggcagatctg

SEQ ID NO: 3798265 - DNA, 22 bp, Homo sapiens
ggccaggcagatctgtgcccca

SEQ ID NO: 3798266 - DNA, 14 bp, Homo sapiens
ggccaggtgcacag

SEQ ID NO: 3798267 - DNA, 14 bp, Homo sapiens
ggccaggtgcagtg

SEQ ID NO: 3798268 - DNA, 18 bp, Homo sapiens
ggccagtcctgcctggcc

SEQ ID NO: 3798269 - DNA, 19 bp, Homo sapiens
ggccagtcctgcctggcca

SEQ ID NO: 3798270 - DNA, 19 bp, Homo sapiens
ggccagtgtgatcccaagt

SEQ ID NO: 3798271 - DNA, 17 bp, Homo sapiens
ggccatcggtcctgtct

SEQ ID NO: 3798272 - DNA, 18 bp, Homo sapiens
ggctctccacctcagcct

SEQ ID NO: 3798273 - DNA, 14 bp, Homo sapiens
ggctctgaaagcca

SEQ ID NO: 3798274 - DNA, 12 bp, Homo sapiens
ggctctgcccca

SEQ ID NO: 3798275 - DNA, 23 bp, Homo sapiens
ggctctgccccagctctggcttc

SEQ ID NO: 3798276 - DNA, 15 bp, Homo sapiens
ggctctgtgcaggga

SEQ ID NO: 3798277 - DNA, 17 bp, Homo sapiens
ggctgacccagtccctg

SEQ ID NO: 3798278 - DNA, 19 bp, Homo sapiens
ggctgacccagtccctggg

SEQ ID NO: 3798279 - DNA, 22 bp, Homo sapiens
ggctgacccagtccctggggga

SEQ ID NO: 3798280 - DNA, 17 bp, Homo sapiens
ggctgacccccctcagg

SEQ ID NO: 3798281 - DNA, 22 bp, Homo sapiens
ggctgactagaagggccagtcc

SEQ ID NO: 3798282 - DNA, 24 bp, Homo sapiens
ggctgactagaagggccagtcctg

SEQ ID NO: 3798283 - DNA, 21 bp, Homo sapiens
ggctgagactgcgggatggtc

SEQ ID NO: 3798284 - DNA, 12 bp, Homo sapiens
ggctgagactgg

SEQ ID NO: 3798285 - DNA, 18 bp, Homo sapiens
ggctgaggcaggagaatc

SEQ ID NO: 3798286 - DNA, 19 bp, Homo sapiens
ggctgaggggcaacgaaga

SEQ ID NO: 3798287 - DNA, 13 bp, Homo sapiens
ggctgaggtggga

SEQ ID NO: 3798288 - DNA, 22 bp, Homo sapiens
ggctgagtcatgatctccctgc

SEQ ID NO: 3798289 - DNA, 13 bp, Homo sapiens
ggctgatctcagg

SEQ ID NO: 3798290 - DNA, 19 bp, Homo sapiens
ggctgatctcagggaagcc

SEQ ID NO: 3798291 - DNA, 18 bp, Homo sapiens
ggctgcaaagggtatcag

SEQ ID NO: 3798292 - DNA, 22 bp, Homo sapiens
ggctgcaaagggtatcaggtgc

SEQ ID NO: 3798293 - DNA, 12 bp, Homo sapiens
ggctgcagggag

SEQ ID NO: 3798294 - DNA, 14 bp, Homo sapiens
ggctgccctggtgc

SEQ ID NO: 3798295 - DNA, 12 bp, Homo sapiens
ggctgctcctcc

SEQ ID NO: 3798296 - DNA, 20 bp, Homo sapiens
ggctggactccagatctgca

SEQ ID NO: 3798297 - DNA, 19 bp, Homo sapiens
ggctggaggcagggccttg

SEQ ID NO: 3798298 - DNA, 20 bp, Homo sapiens
ggctggagtgcggtggtgtg

SEQ ID NO: 3798299 - DNA, 19 bp, Homo sapiens
ggctggagtggagtggcgt

SEQ ID NO: 3798300 - DNA, 15 bp, Homo sapiens
ggctggatgtggtgg

SEQ ID NO: 3798301 - DNA, 19 bp, Homo sapiens
ggctggatgtggtggcata

SEQ ID NO: 3798302 - DNA, 21 bp, Homo sapiens
ggctggattttgaattttctt

SEQ ID NO: 3798303 - DNA, 14 bp, Homo sapiens
ggctggcaggtatg

SEQ ID NO: 3798304 - DNA, 14 bp, Homo sapiens
ggctggcgtgcagt

SEQ ID NO: 3798305 - DNA, 16 bp, Homo sapiens
ggctggcgtgcagtgg

SEQ ID NO: 3798306 - DNA, 15 bp, Homo sapiens
ggctggctgcagtga

SEQ ID NO: 3798307 - DNA, 13 bp, Homo sapiens
ggctggctgggca

SEQ ID NO: 3798308 - DNA, 15 bp, Homo sapiens
ggctgggagctctgc

SEQ ID NO: 3798309 - DNA, 22 bp, Homo sapiens
ggctgggccaagccagggatgg

SEQ ID NO: 3798310 - DNA, 14 bp, Homo sapiens
ggctgggcccagag

SEQ ID NO: 3798311 - DNA, 15 bp, Homo sapiens
ggctgggcccagagg

SEQ ID NO: 3798312 - DNA, 16 bp, Homo sapiens
ggctgggcccagaggc

SEQ ID NO: 3798313 - DNA, 22 bp, Homo sapiens
ggctgggcttcagtggcagctg

SEQ ID NO: 3798314 - DNA, 16 bp, Homo sapiens
ggctgggggaagaagc

SEQ ID NO: 3798315 - DNA, 17 bp, Homo sapiens
ggctgggggcaggaggg

SEQ ID NO: 3798316 - DNA, 17 bp, Homo sapiens
ggctgggggcctcagtg

SEQ ID NO: 3798317 - DNA, 19 bp, Homo sapiens
ggctgggtggcaccagcag

SEQ ID NO: 3798318 - DNA, 14 bp, Homo sapiens
ggctggtgcagggc

SEQ ID NO: 3798319 - DNA, 18 bp, Homo sapiens
ggctgtatcccatgagcc

SEQ ID NO: 3798320 - DNA, 19 bp, Homo sapiens
ggctgtatcccatgagcct

SEQ ID NO: 3798321 - DNA, 20 bp, Homo sapiens
ggctgtatcccatgagcctc

SEQ ID NO: 3798322 - DNA, 16 bp, Homo sapiens
ggctgtcagcaggaag

SEQ ID NO: 3798323 - DNA, 19 bp, Homo sapiens
ggctgtcctttccagtggc

SEQ ID NO: 3798324 - DNA, 11 bp, Homo sapiens
ggctgtgagtg

SEQ ID NO: 3798325 - DNA, 22 bp, Homo sapiens
ggctgtgggcctcaaggacttg

SEQ ID NO: 3798326 - DNA, 22 bp, Homo sapiens
ggctgtgggctcccttcctccc

SEQ ID NO: 3798327 - DNA, 14 bp, Homo sapiens
ggctgttggctggg

SEQ ID NO: 3798328 - DNA, 20 bp, Homo sapiens
ggctgttggctgggggcctc

SEQ ID NO: 3798329 - DNA, 13 bp, Homo sapiens
ggcttacacccac

SEQ ID NO: 3798330 - DNA, 17 bp, Homo sapiens
ggcttacacgtggagga

SEQ ID NO: 3798331 - DNA, 22 bp, Homo sapiens
ggcttactacatgtgggagctt

SEQ ID NO: 3798332 - DNA, 12 bp, Homo sapiens
ggcttcacagat

SEQ ID NO: 3798333 - DNA, 17 bp, Homo sapiens
ggcttcagcatatttat

SEQ ID NO: 3798334 - DNA, 15 bp, Homo sapiens
ggcttcagtggcagc

SEQ ID NO: 3798335 - DNA, 22 bp, Homo sapiens
ggcttccatttgtgtgtgtgca

SEQ ID NO: 3798336 - DNA, 14 bp, Homo sapiens
ggcttcccgctcag

SEQ ID NO: 3798337 - DNA, 16 bp, Homo sapiens
ggcttcccgctcagcc

SEQ ID NO: 3798338 - DNA, 18 bp, Homo sapiens
ggcttcccgctcagccct

SEQ ID NO: 3798339 - DNA, 21 bp, Homo sapiens
ggcttcccgctcagccctccc

SEQ ID NO: 3798340 - DNA, 20 bp, Homo sapiens
ggcttctggagcccttgggt

SEQ ID NO: 3798341 - DNA, 20 bp, Homo sapiens
ggcttctgtttctagttgag

SEQ ID NO: 3798342 - DNA, 20 bp, Homo sapiens
ggcttcttcagatcagtgct

SEQ ID NO: 3798343 - DNA, 16 bp, Homo sapiens
ggcttgccacagctct

SEQ ID NO: 3798344 - DNA, 15 bp, Homo sapiens
ggcttggggcttcct

SEQ ID NO: 3798345 - DNA, 21 bp, Homo sapiens
ggcttggtggctcacgcctgt

SEQ ID NO: 3798346 - DNA, 17 bp, Homo sapiens
ggcttgtaactccacca

SEQ ID NO: 3798347 - DNA, 18 bp, Homo sapiens
ggcttgtaactccaccaa

SEQ ID NO: 3798348 - DNA, 16 bp, Homo sapiens
ggcttgtcagagctgg

SEQ ID NO: 3798349 - DNA, 20 bp, Homo sapiens
ggctttcatgaggaggcaga

SEQ ID NO: 3798350 - DNA, 12 bp, Homo sapiens
ggctttctggag

SEQ ID NO: 3798351 - DNA, 19 bp, Homo sapiens
ggctttgcccaacctcagc

SEQ ID NO: 3798352 - DNA, 16 bp, Homo sapiens
ggctttgtcccacagc

SEQ ID NO: 3798353 - DNA, 14 bp, Homo sapiens
ggcttttcactgct

SEQ ID NO: 3798354 - DNA, 15 bp, Homo sapiens
ggcttttcactgctg

SEQ ID NO: 3798355 - DNA, 19 bp, Homo sapiens
ggcttttcactgctggctg

SEQ ID NO: 3798356 - DNA, 22 bp, Homo sapiens
ggcttttcactgctggctgcct

SEQ ID NO: 3798357 - DNA, 23 bp, Homo sapiens
gggaaaagggaacaggaaaagaa

SEQ ID NO: 3798358 - DNA, 23 bp, Homo sapiens
gggaaaatcagcctgctccagct

SEQ ID NO: 3798359 - DNA, 16 bp, Homo sapiens
gggaaaatgttttgta

SEQ ID NO: 3798360 - DNA, 21 bp, Homo sapiens
gggaaaatgttttgtaagaaa

SEQ ID NO: 3798361 - DNA, 15 bp, Homo sapiens
gggaaaggatatttt

SEQ ID NO: 3798362 - DNA, 22 bp, Homo sapiens
gggaaaggctctgaaagccagc

SEQ ID NO: 3798363 - DNA, 18 bp, Homo sapiens
gggaacagacaggagaaa

SEQ ID NO: 3798364 - DNA, 14 bp, Homo sapiens
gggaacagactgga

SEQ ID NO: 3798365 - DNA, 12 bp, Homo sapiens
gggaacagtgtt

SEQ ID NO: 3798366 - DNA, 17 bp, Homo sapiens
gggaacgtgactgcccc

SEQ ID NO: 3798367 - DNA, 15 bp, Homo sapiens
gggaactcccaagaa

SEQ ID NO: 3798368 - DNA, 22 bp, Homo sapiens
gggaactcccaagaacagcagg

SEQ ID NO: 3798369 - DNA, 13 bp, Homo sapiens
gggaactcctgga

SEQ ID NO: 3798370 - DNA, 19 bp, Homo sapiens
gggaagcccagctccaggg

SEQ ID NO: 3798371 - DNA, 20 bp, Homo sapiens
gggaagcttcttaaatgaga

SEQ ID NO: 3798372 - DNA, 17 bp, Homo sapiens
gggaaggaggctggctt

SEQ ID NO: 3798373 - DNA, 13 bp, Homo sapiens
gggaagggagagc

SEQ ID NO: 3798374 - DNA, 16 bp, Homo sapiens
gggaatggcacagccc

SEQ ID NO: 3798375 - DNA, 20 bp, Homo sapiens
gggacagagacacctgcacc

SEQ ID NO: 3798376 - DNA, 15 bp, Homo sapiens
gggacagagtctggg

SEQ ID NO: 3798377 - DNA, 12 bp, Homo sapiens
gggacagctcct

SEQ ID NO: 3798378 - DNA, 16 bp, Homo sapiens
gggacagctccttctg

SEQ ID NO: 3798379 - DNA, 13 bp, Homo sapiens
gggacatgtggaa

SEQ ID NO: 3798380 - DNA, 17 bp, Homo sapiens
gggactacaggcaccca

SEQ ID NO: 3798381 - DNA, 17 bp, Homo sapiens
gggacttggaagctccg

SEQ ID NO: 3798382 - DNA, 18 bp, Homo sapiens
gggacttggaagctccgc

SEQ ID NO: 3798383 - DNA, 10 bp, Homo sapiens
gggagaaaac

SEQ ID NO: 3798384 - DNA, 15 bp, Homo sapiens
gggagaaaagacatg

SEQ ID NO: 3798385 - DNA, 16 bp, Homo sapiens
ggttgcaaggccgctg

SEQ ID NO: 3798386 - DNA, 21 bp, Homo sapiens
ggttgcgtcctgacggcgccc

SEQ ID NO: 3798387 - DNA, 22 bp, Homo sapiens
ggttggaagtgagggtcagaga

SEQ ID NO: 3798388 - DNA, 13 bp, Homo sapiens
ggttggtgggggc

SEQ ID NO: 3798389 - DNA, 15 bp, Homo sapiens
ggtttatttcccagt

SEQ ID NO: 3798390 - DNA, 13 bp, Homo sapiens
ggtttctgaaaat

SEQ ID NO: 3798391 - DNA, 17 bp, Homo sapiens
ggtttctgccctgccca

SEQ ID NO: 3798392 - DNA, 18 bp, Homo sapiens
ggtttctgccctgcccac

SEQ ID NO: 3798393 - DNA, 13 bp, Homo sapiens
ggtttgtatattg

SEQ ID NO: 3798394 - DNA, 11 bp, Homo sapiens
ggttttgtaca

SEQ ID NO: 3798395 - DNA, 15 bp, Homo sapiens
ggttttgtaggtact

SEQ ID NO: 3798396 - DNA, 13 bp, Homo sapiens
gtaaaactgaggc

SEQ ID NO: 3798397 - DNA, 15 bp, Homo sapiens
gtaaaactttatttt

SEQ ID NO: 3798398 - DNA, 17 bp, Homo sapiens
gtaaaaggtattaaatt

SEQ ID NO: 3798399 - DNA, 14 bp, Homo sapiens
gtaaaattctaaat

SEQ ID NO: 3798400 - DNA, 20 bp, Homo sapiens
gtaaacagtgcctgctgaat

SEQ ID NO: 3798401 - DNA, 20 bp, Homo sapiens
gtaaacgctgtccctagtaa

SEQ ID NO: 3798402 - DNA, 21 bp, Homo sapiens
gtaaactatttatctgtgttt

SEQ ID NO: 3798403 - DNA, 21 bp, Homo sapiens
gtaaagaaatttaaaagacac

SEQ ID NO: 3798404 - DNA, 16 bp, Homo sapiens
gtaaagactgtagaag

SEQ ID NO: 3798405 - DNA, 15 bp, Homo sapiens
gtaaagagaaacttt

SEQ ID NO: 3798406 - DNA, 17 bp, Homo sapiens
gtaaagtgataatttct

SEQ ID NO: 3798407 - DNA, 23 bp, Homo sapiens
gtaaagtgataatttctggaatt

SEQ ID NO: 3798408 - DNA, 17 bp, Homo sapiens
gtaaagtgtaacatatg

SEQ ID NO: 3798409 - DNA, 20 bp, Homo sapiens
gtaaataaccccattctttg

SEQ ID NO: 3798410 - DNA, 11 bp, Homo sapiens
gtaaataagag

SEQ ID NO: 3798411 - DNA, 13 bp, Homo sapiens
gtaaataagagat

SEQ ID NO: 3798412 - DNA, 16 bp, Homo sapiens
gtaaataagagatttg

SEQ ID NO: 3798413 - DNA, 11 bp, Homo sapiens
gtaaatattta

SEQ ID NO: 3798414 - DNA, 23 bp, Homo sapiens
gtaaatgaagtaacttgtcttaa

SEQ ID NO: 3798415 - DNA, 17 bp, Homo sapiens
gtaaatgtttaggtttt

SEQ ID NO: 3798416 - DNA, 20 bp, Homo sapiens
gtaaattattcagttaagaa

SEQ ID NO: 3798417 - DNA, 14 bp, Homo sapiens
gtaaattattttaa

SEQ ID NO: 3798418 - DNA, 18 bp, Homo sapiens
gtaaattattttaaatta

SEQ ID NO: 3798419 - DNA, 22 bp, Homo sapiens
gtaaattattttaaattataag

SEQ ID NO: 3798420 - DNA, 14 bp, Homo sapiens
gtaacaagagtgat

SEQ ID NO: 3798421 - DNA, 19 bp, Homo sapiens
gtaacaggaaaattttaaa

SEQ ID NO: 3798422 - DNA, 21 bp, Homo sapiens
gtaacaggtctcctcttaaaa

SEQ ID NO: 3798423 - DNA, 14 bp, Homo sapiens
gtaacatatgcaaa

SEQ ID NO: 3798424 - DNA, 19 bp, Homo sapiens
gtaacatatgcaaacataa

SEQ ID NO: 3798425 - DNA, 19 bp, Homo sapiens
gtaactgcattgagaactg

SEQ ID NO: 3798426 - DNA, 14 bp, Homo sapiens
gtaacttgtcttaa

SEQ ID NO: 3798427 - DNA, 15 bp, Homo sapiens
gtaacttttgtaaga

SEQ ID NO: 3798428 - DNA, 15 bp, Homo sapiens
gtaagaagacatgaa

SEQ ID NO: 3798429 - DNA, 13 bp, Homo sapiens
gtaagaatcattg

SEQ ID NO: 3798430 - DNA, 14 bp, Homo sapiens
gtaagagctggtgt

SEQ ID NO: 3798431 - DNA, 18 bp, Homo sapiens
gtaagatacaagtttcag

SEQ ID NO: 3798432 - DNA, 17 bp, Homo sapiens
gtaagcttccaggaaaa

SEQ ID NO: 3798433 - DNA, 17 bp, Homo sapiens
gtaagtaaactgccctg

SEQ ID NO: 3798434 - DNA, 22 bp, Homo sapiens
gtaagtattcttatttaatgaa

SEQ ID NO: 3798435 - DNA, 14 bp, Homo sapiens
gtaataaagtatat

SEQ ID NO: 3798436 - DNA, 12 bp, Homo sapiens
gtaataaagtgt

SEQ ID NO: 3798437 - DNA, 20 bp, Homo sapiens
gtaataaagtgttttcagag

SEQ ID NO: 3798438 - DNA, 23 bp, Homo sapiens
gtaatcatttcttgggccctcct

SEQ ID NO: 3798439 - DNA, 12 bp, Homo sapiens
gtaatcccagca

SEQ ID NO: 3798440 - DNA, 20 bp, Homo sapiens
gtaatcccagcactttggga

SEQ ID NO: 3798441 - DNA, 17 bp, Homo sapiens
gtaatcccagctactca

SEQ ID NO: 3798442 - DNA, 16 bp, Homo sapiens
gtaatcccagctactt

SEQ ID NO: 3798443 - DNA, 20 bp, Homo sapiens
gtaatcccagctacttggga

SEQ ID NO: 3798444 - DNA, 12 bp, Homo sapiens
gtaatgtcacca

SEQ ID NO: 3798445 - DNA, 19 bp, Homo sapiens
gtaatgtcaccaccttccc

SEQ ID NO: 3798446 - DNA, 16 bp, Homo sapiens
gtaatgtgaataaatt

SEQ ID NO: 3798447 - DNA, 14 bp, Homo sapiens
gtaatgttactgat

SEQ ID NO: 3798448 - DNA, 17 bp, Homo sapiens
gtaatgttactgatcat

SEQ ID NO: 3798449 - DNA, 20 bp, Homo sapiens
gtaatgttactgatcatgca

SEQ ID NO: 3798450 - DNA, 21 bp, Homo sapiens
gtaatgttactgatcatgcat

SEQ ID NO: 3798451 - DNA, 22 bp, Homo sapiens
gtaatgttactgatcatgcatt

SEQ ID NO: 3798452 - DNA, 20 bp, Homo sapiens
gtaattaagtactatgtatc

SEQ ID NO: 3798453 - DNA, 22 bp, Homo sapiens
gtaattatcgggaacagtgttt

SEQ ID NO: 3798454 - DNA, 15 bp, Homo sapiens
gtaattctaaatgaa

SEQ ID NO: 3798455 - DNA, 18 bp, Homo sapiens
gtaattctaaatgaatgt

SEQ ID NO: 3798456 - DNA, 13 bp, Homo sapiens
gtaattgtgaaaa

SEQ ID NO: 3798457 - DNA, 14 bp, Homo sapiens
gtaattgtgaaaaa

SEQ ID NO: 3798458 - DNA, 20 bp, Homo sapiens
gtaatttatagtttatacag

SEQ ID NO: 3798459 - DNA, 11 bp, Homo sapiens
gtaatttattt

SEQ ID NO: 3798460 - DNA, 23 bp, Homo sapiens
gtaattttgggtggggagaagag

SEQ ID NO: 3798461 - DNA, 12 bp, Homo sapiens
gtacaaaataaa

SEQ ID NO: 3798462 - DNA, 12 bp, Homo sapiens
gtacaatattta

SEQ ID NO: 3798463 - DNA, 18 bp, Homo sapiens
gtacaatatttaaaattt

SEQ ID NO: 3798464 - DNA, 15 bp, Homo sapiens
gtacaatattttaag

SEQ ID NO: 3798465 - DNA, 17 bp, Homo sapiens
gtacaatattttaagca

SEQ ID NO: 3798466 - DNA, 20 bp, Homo sapiens
gtacaatattttaagcatta

SEQ ID NO: 3798467 - DNA, 22 bp, Homo sapiens
gtacaatattttaagcattact

SEQ ID NO: 3798468 - DNA, 14 bp, Homo sapiens
gtacagagaaggaa

SEQ ID NO: 3798469 - DNA, 12 bp, Homo sapiens
gtacaggcagca

SEQ ID NO: 3798470 - DNA, 17 bp, Homo sapiens
gtacaggcagcacagag

SEQ ID NO: 3798471 - DNA, 23 bp, Homo sapiens
gtacataaaggtggtatgtgtgt

SEQ ID NO: 3798472 - DNA, 14 bp, Homo sapiens
gtacataggcagca

SEQ ID NO: 3798473 - DNA, 17 bp, Homo sapiens
gtacatagttatttatt

SEQ ID NO: 3798474 - DNA, 18 bp, Homo sapiens
gtacattcaatgtttatg

SEQ ID NO: 3798475 - DNA, 16 bp, Homo sapiens
gtacatttaattgaga

SEQ ID NO: 3798476 - DNA, 17 bp, Homo sapiens
gtacatttaattgagaa

SEQ ID NO: 3798477 - DNA, 23 bp, Homo sapiens
gtacatttaattgagaagcgtat

SEQ ID NO: 3798478 - DNA, 16 bp, Homo sapiens
gtacccacctgagctt

SEQ ID NO: 3798479 - DNA, 12 bp, Homo sapiens
gtacccactgct

SEQ ID NO: 3798480 - DNA, 19 bp, Homo sapiens
gtaccccagctctgcttgc

SEQ ID NO: 3798481 - DNA, 15 bp, Homo sapiens
gtacctgatgtacct

SEQ ID NO: 3798482 - DNA, 23 bp, Homo sapiens
gtaccttgaacactgggggaggg

SEQ ID NO: 3798483 - DNA, 13 bp, Homo sapiens
gtacctttgtcac

SEQ ID NO: 3798484 - DNA, 17 bp, Homo sapiens
gtactagttacacatct

SEQ ID NO: 3798485 - DNA, 16 bp, Homo sapiens
gtactatatctgtttt

SEQ ID NO: 3798486 - DNA, 17 bp, Homo sapiens
gtactatgtatcaatga

SEQ ID NO: 3798487 - DNA, 23 bp, Homo sapiens
gtactcaggaggctgaggggagg

SEQ ID NO: 3798488 - DNA, 16 bp, Homo sapiens
gtactcctgcaaaatt

SEQ ID NO: 3798489 - DNA, 16 bp, Homo sapiens
gtactgagccttgtaa

SEQ ID NO: 3798490 - DNA, 16 bp, Homo sapiens
gtactggcatggtacg

SEQ ID NO: 3798491 - DNA, 16 bp, Homo sapiens
gtacttagcagctatc

SEQ ID NO: 3798492 - DNA, 15 bp, Homo sapiens
gtacttctccaccct

SEQ ID NO: 3798493 - DNA, 16 bp, Homo sapiens
gtacttctccaccctg

SEQ ID NO: 3798494 - DNA, 17 bp, Homo sapiens
gtacttctccaccctgc

SEQ ID NO: 3798495 - DNA, 19 bp, Homo sapiens
gtacttctccaccctgctc

SEQ ID NO: 3798496 - DNA, 21 bp, Homo sapiens
gtacttgtggacacagctctt

SEQ ID NO: 3798497 - DNA, 21 bp, Homo sapiens
gtagaaagacagagctgggat

SEQ ID NO: 3798498 - DNA, 17 bp, Homo sapiens
gtagaaataatatgcat

SEQ ID NO: 3798499 - DNA, 22 bp, Homo sapiens
gtcttagaagtggaccaggaca

SEQ ID NO: 3798500 - DNA, 23 bp, Homo sapiens
gtcttagacttgaaatactactt

SEQ ID NO: 3798501 - DNA, 24 bp, Homo sapiens
gtcttagacttgaaatactactta

SEQ ID NO: 3798502 - DNA, 13 bp, Homo sapiens
gtcttcagcctag

SEQ ID NO: 3798503 - DNA, 16 bp, Homo sapiens
gtcttcagtaagccgt

SEQ ID NO: 3798504 - DNA, 19 bp, Homo sapiens
gtcttccaaggagaccaag

SEQ ID NO: 3798505 - DNA, 15 bp, Homo sapiens
gtcttccctacctca

SEQ ID NO: 3798506 - DNA, 18 bp, Homo sapiens
gtcttccctacctcaggc

SEQ ID NO: 3798507 - DNA, 18 bp, Homo sapiens
gtcttccctagggctggg

SEQ ID NO: 3798508 - DNA, 20 bp, Homo sapiens
gtcttccctagggctgggtg

SEQ ID NO: 3798509 - DNA, 21 bp, Homo sapiens
gtcttccctagggctgggtgt

SEQ ID NO: 3798510 - DNA, 15 bp, Homo sapiens
gtcttctcaggctct

SEQ ID NO: 3798511 - DNA, 19 bp, Homo sapiens
gtcttctcaggctctgccc

SEQ ID NO: 3798512 - DNA, 22 bp, Homo sapiens
gtcttctcaggctctgccctgc

SEQ ID NO: 3798513 - DNA, 17 bp, Homo sapiens
gtcttctcatagcatta

SEQ ID NO: 3798514 - DNA, 16 bp, Homo sapiens
gtcttgaactcctggc

SEQ ID NO: 3798515 - DNA, 20 bp, Homo sapiens
gtcttgaactcctggcctca

SEQ ID NO: 3798516 - DNA, 17 bp, Homo sapiens
gtcttgcaatggcagcc

SEQ ID NO: 3798517 - DNA, 21 bp, Homo sapiens
gtcttgcaatggcagccttgg

SEQ ID NO: 3798518 - DNA, 21 bp, Homo sapiens
gtcttgcagtgattaaggtct

SEQ ID NO: 3798519 - DNA, 15 bp, Homo sapiens
gtcttggtacttgct

SEQ ID NO: 3798520 - DNA, 21 bp, Homo sapiens
gtcttggtacttgctgctatt

SEQ ID NO: 3798521 - DNA, 12 bp, Homo sapiens
gtcttgtaagag

SEQ ID NO: 3798522 - DNA, 16 bp, Homo sapiens
gtcttgttaatattct

SEQ ID NO: 3798523 - DNA, 22 bp, Homo sapiens
gtcttgttaatattctttcaat

SEQ ID NO: 3798524 - DNA, 17 bp, Homo sapiens
gtctttaggcagcagct

SEQ ID NO: 3798525 - DNA, 22 bp, Homo sapiens
gtctttgtaatgtcaccacctt

SEQ ID NO: 3798526 - DNA, 14 bp, Homo sapiens
gtctttttttctgt

SEQ ID NO: 3798527 - DNA, 20 bp, Homo sapiens
gtcttttttttttttgtcta

SEQ ID NO: 3798528 - DNA, 19 bp, Homo sapiens
gtgaaaataggtatacagt

SEQ ID NO: 3798529 - DNA, 23 bp, Homo sapiens
gtgaaacacaccaggctgtgggc

SEQ ID NO: 3798530 - DNA, 19 bp, Homo sapiens
gtgaaactaacagataagc

SEQ ID NO: 3798531 - DNA, 14 bp, Homo sapiens
gtgaaagaaatcat

SEQ ID NO: 3798532 - DNA, 19 bp, Homo sapiens
gtgaaagaaatcatgttat

SEQ ID NO: 3798533 - DNA, 21 bp, Homo sapiens
gtgaaagggagctatcaggaa

SEQ ID NO: 3798534 - DNA, 17 bp, Homo sapiens
gtgaaatagttcaaagc

SEQ ID NO: 3798535 - DNA, 14 bp, Homo sapiens
gtgaaatctgtgca

SEQ ID NO: 3798536 - DNA, 20 bp, Homo sapiens
gtgaaatctgtgcaataaaa

SEQ ID NO: 3798537 - DNA, 23 bp, Homo sapiens
gtgaaccaccacacccagcccac

SEQ ID NO: 3798538 - DNA, 14 bp, Homo sapiens
gtgaacgatttaga

SEQ ID NO: 3798539 - DNA, 17 bp, Homo sapiens
gtgaacttgggccactg

SEQ ID NO: 3798540 - DNA, 18 bp, Homo sapiens
gtgaagactgggtgagga

SEQ ID NO: 3798541 - DNA, 13 bp, Homo sapiens
gtgaagatgtttg

SEQ ID NO: 3798542 - DNA, 20 bp, Homo sapiens
gtgaaggccgagaagcaaga

SEQ ID NO: 3798543 - DNA, 15 bp, Homo sapiens
gtgaatcagacccta

SEQ ID NO: 3798544 - DNA, 14 bp, Homo sapiens
gtgaatcagagcac

SEQ ID NO: 3798545 - DNA, 22 bp, Homo sapiens
gtgaatgaaagtcttgtgacta

SEQ ID NO: 3798546 - DNA, 13 bp, Homo sapiens
gtgaattgataat

SEQ ID NO: 3798547 - DNA, 17 bp, Homo sapiens
gtgaattgataataaac

SEQ ID NO: 3798548 - DNA, 13 bp, Homo sapiens
gtgaatttgaatc

SEQ ID NO: 3798549 - DNA, 16 bp, Homo sapiens
gtgaatttgaatgaaa

SEQ ID NO: 3798550 - DNA, 16 bp, Homo sapiens
gtgacaacacttgtgt

SEQ ID NO: 3798551 - DNA, 20 bp, Homo sapiens
gtgacaaggattgctactgt

SEQ ID NO: 3798552 - DNA, 17 bp, Homo sapiens
gtgacaaggccccagag

SEQ ID NO: 3798553 - DNA, 18 bp, Homo sapiens
gtgacacttcagagagct

SEQ ID NO: 3798554 - DNA, 15 bp, Homo sapiens
gtgacagaggcagcc

SEQ ID NO: 3798555 - DNA, 23 bp, Homo sapiens
gtgacagaggcagccccattctg

SEQ ID NO: 3798556 - DNA, 15 bp, Homo sapiens
gtgacagtgcctggg

SEQ ID NO: 3798557 - DNA, 17 bp, Homo sapiens
gtgaccaggcatcctcc

SEQ ID NO: 3798558 - DNA, 18 bp, Homo sapiens
gtgaccatgttttgttta

SEQ ID NO: 3798559 - DNA, 12 bp, Homo sapiens
gtgaccccaggt

SEQ ID NO: 3798560 - DNA, 13 bp, Homo sapiens
gtgacctctgcct

SEQ ID NO: 3798561 - DNA, 14 bp, Homo sapiens
gtgacctctgcctg

SEQ ID NO: 3798562 - DNA, 15 bp, Homo sapiens
gtgacctctgcctga

SEQ ID NO: 3798563 - DNA, 15 bp, Homo sapiens
gtgactagtgctgaa

SEQ ID NO: 3798564 - DNA, 18 bp, Homo sapiens
gtgactagtgctgaagct

SEQ ID NO: 3798565 - DNA, 23 bp, Homo sapiens
gtgactgagcaagaccctgtctc

SEQ ID NO: 3798566 - DNA, 19 bp, Homo sapiens
gtgactgatgttaggctgg

SEQ ID NO: 3798567 - DNA, 19 bp, Homo sapiens
gtgactgtatctgtgtaga

SEQ ID NO: 3798568 - DNA, 18 bp, Homo sapiens
gtgactgtggcacacgcc

SEQ ID NO: 3798569 - DNA, 11 bp, Homo sapiens
gtgagaagaat

SEQ ID NO: 3798570 - DNA, 15 bp, Homo sapiens
gtgagaagaatattg

SEQ ID NO: 3798571 - DNA, 14 bp, Homo sapiens
gtgagacccccaca

SEQ ID NO: 3798572 - DNA, 16 bp, Homo sapiens
gtgagacccctgtctc

SEQ ID NO: 3798573 - DNA, 16 bp, Homo sapiens
gtgagaccctgtctct

SEQ ID NO: 3798574 - DNA, 13 bp, Homo sapiens
gtgagagctgggt

SEQ ID NO: 3798575 - DNA, 23 bp, Homo sapiens
gtgagagggcatgcgcacaaggc

SEQ ID NO: 3798576 - DNA, 21 bp, Homo sapiens
gtgagcaagaagtcaaagtaa

SEQ ID NO: 3798577 - DNA, 21 bp, Homo sapiens
gtgagcagtgtgtctcctgca

SEQ ID NO: 3798578 - DNA, 15 bp, Homo sapiens
gtgagccaccgctgc

SEQ ID NO: 3798579 - DNA, 20 bp, Homo sapiens
gtgagccactgcaccgggcc

SEQ ID NO: 3798580 - DNA, 12 bp, Homo sapiens
gtgagccgcatc

SEQ ID NO: 3798581 - DNA, 16 bp, Homo sapiens
gtgagctcctaagcca

SEQ ID NO: 3798582 - DNA, 11 bp, Homo sapiens
gtgaggagctg

SEQ ID NO: 3798583 - DNA, 12 bp, Homo sapiens
gtgaggcagggg

SEQ ID NO: 3798584 - DNA, 16 bp, Homo sapiens
gtgaggcaggtgacag

SEQ ID NO: 3798585 - DNA, 13 bp, Homo sapiens
gtgaggtcctggg

SEQ ID NO: 3798586 - DNA, 19 bp, Homo sapiens
gtgaggtgcagagtgccca

SEQ ID NO: 3798587 - DNA, 16 bp, Homo sapiens
gtgaggttgggcagct

SEQ ID NO: 3798588 - DNA, 15 bp, Homo sapiens
gtgagtaagagctgg

SEQ ID NO: 3798589 - DNA, 17 bp, Homo sapiens
gtgagtcaccaagccca

SEQ ID NO: 3798590 - DNA, 15 bp, Homo sapiens
gtgagtcgaggacag

SEQ ID NO: 3798591 - DNA, 16 bp, Homo sapiens
gtgagtgtaagtgtga

SEQ ID NO: 3798592 - DNA, 22 bp, Homo sapiens
gtgagtgtgtccaagtgtgtgt

SEQ ID NO: 3798593 - DNA, 23 bp, Homo sapiens
gtgagtgtgtccaagtgtgtgtg

SEQ ID NO: 3798594 - DNA, 17 bp, Homo sapiens
gtgatcaataaaatgtg

SEQ ID NO: 3798595 - DNA, 17 bp, Homo sapiens
gtgatcaattaaatgta

SEQ ID NO: 3798596 - DNA, 18 bp, Homo sapiens
gtgatccacccacctcag

SEQ ID NO: 3798597 - DNA, 20 bp, Homo sapiens
gtgatccacccacctcagcc

SEQ ID NO: 3798598 - DNA, 23 bp, Homo sapiens
gtgatccacccacctcagcctcc

SEQ ID NO: 3798599 - DNA, 20 bp, Homo sapiens
gtgatcctcccacctcagcc

SEQ ID NO: 3798600 - DNA, 18 bp, Homo sapiens
gtgatcttgctctatctc

SEQ ID NO: 3798601 - DNA, 22 bp, Homo sapiens
gtgatgaagaaaagtgggccag

SEQ ID NO: 3798602 - DNA, 14 bp, Homo sapiens
gtgatggttcccct

SEQ ID NO: 3798603 - DNA, 23 bp, Homo sapiens
gtgatggttcccctgttcactct

SEQ ID NO: 3798604 - DNA, 20 bp, Homo sapiens
gtgattcacagtgtgaatct

SEQ ID NO: 3798605 - DNA, 14 bp, Homo sapiens
gtgattctcctgcc

SEQ ID NO: 3798606 - DNA, 18 bp, Homo sapiens
gtgattctcctgcctcag

SEQ ID NO: 3798607 - DNA, 19 bp, Homo sapiens
gtgattctcctgcctcagc

SEQ ID NO: 3798608 - DNA, 22 bp, Homo sapiens
gtgattctcctgcctcagcctc

SEQ ID NO: 3798609 - DNA, 15 bp, Homo sapiens
gtgatttgaaggtct

SEQ ID NO: 3798610 - DNA, 12 bp, Homo sapiens
gtgattttcatt

SEQ ID NO: 3798611 - DNA, 19 bp, Homo sapiens
gtgcaaaaatttttggatt

SEQ ID NO: 3798612 - DNA, 15 bp, Homo sapiens
gttctgcaaatagaa

SEQ ID NO: 3798613 - DNA, 21 bp, Homo sapiens
gttctggccctcacccctgcc

SEQ ID NO: 3798614 - DNA, 23 bp, Homo sapiens
gttctgggacacagttcaattct

SEQ ID NO: 3798615 - DNA, 18 bp, Homo sapiens
gttctgggtggttgccct

SEQ ID NO: 3798616 - DNA, 17 bp, Homo sapiens
gttctggttagctcagc

SEQ ID NO: 3798617 - DNA, 21 bp, Homo sapiens
gttctggttagctcagcccca

SEQ ID NO: 3798618 - DNA, 16 bp, Homo sapiens
gttctgttttgttttg

SEQ ID NO: 3798619 - DNA, 23 bp, Homo sapiens
gttctgttttgttttgtttttta

SEQ ID NO: 3798620 - DNA, 17 bp, Homo sapiens
gttcttagtttgcagtt

SEQ ID NO: 3798621 - DNA, 19 bp, Homo sapiens
gttcttctaccacccacca

SEQ ID NO: 3798622 - DNA, 19 bp, Homo sapiens
gttcttgccactgcactcc

SEQ ID NO: 3798623 - DNA, 15 bp, Homo sapiens
gttctttcttcctct

SEQ ID NO: 3798624 - DNA, 19 bp, Homo sapiens
gttctttcttcctctgctg

SEQ ID NO: 3798625 - DNA, 16 bp, Homo sapiens
gttcttttgttgtaaa

SEQ ID NO: 3798626 - DNA, 13 bp, Homo sapiens
gttgaagctctgg

SEQ ID NO: 3798627 - DNA, 12 bp, Homo sapiens
gttgagaaatga

SEQ ID NO: 3798628 - DNA, 15 bp, Homo sapiens
gttgagccaggcctg

SEQ ID NO: 3798629 - DNA, 21 bp, Homo sapiens
gttgaggagtttcctaaaagt

SEQ ID NO: 3798630 - DNA, 23 bp, Homo sapiens
gttgagggaacagacaggagaaa

SEQ ID NO: 3798631 - DNA, 16 bp, Homo sapiens
gttgaggggctcctgg

SEQ ID NO: 3798632 - DNA, 22 bp, Homo sapiens
gttgagttcaggtagctgcccc

SEQ ID NO: 3798633 - DNA, 16 bp, Homo sapiens
gttgcaaggccgctgt

SEQ ID NO: 3798634 - DNA, 19 bp, Homo sapiens
gttgcacttggcctctgga

SEQ ID NO: 3798635 - DNA, 16 bp, Homo sapiens
gttgcatcagaaatgt

SEQ ID NO: 3798636 - DNA, 17 bp, Homo sapiens
gttgccaagaactgaaa

SEQ ID NO: 3798637 - DNA, 15 bp, Homo sapiens
gttgccagagatgga

SEQ ID NO: 3798638 - DNA, 12 bp, Homo sapiens
gttgcccaggca

SEQ ID NO: 3798639 - DNA, 19 bp, Homo sapiens
gttgcccaggcaggtcttg

SEQ ID NO: 3798640 - DNA, 16 bp, Homo sapiens
gttgcccaggctggcg

SEQ ID NO: 3798641 - DNA, 15 bp, Homo sapiens
gttgcgacggagaga

SEQ ID NO: 3798642 - DNA, 16 bp, Homo sapiens
gttgcgacggagagaa

SEQ ID NO: 3798643 - DNA, 22 bp, Homo sapiens
gttgctaagaagcgagcactga

SEQ ID NO: 3798644 - DNA, 18 bp, Homo sapiens
gttgctccgcctctgctg

SEQ ID NO: 3798645 - DNA, 20 bp, Homo sapiens
gttggaaaagaatacagaaa

SEQ ID NO: 3798646 - DNA, 13 bp, Homo sapiens
gttggaagaaata

SEQ ID NO: 3798647 - DNA, 17 bp, Homo sapiens
gttggaattaaaacaat

SEQ ID NO: 3798648 - DNA, 21 bp, Homo sapiens
gttggacttttcgttaacatt

SEQ ID NO: 3798649 - DNA, 19 bp, Homo sapiens
gttggagccactctgttcc

SEQ ID NO: 3798650 - DNA, 23 bp, Homo sapiens
gttggccaaagccaaagctaggc

SEQ ID NO: 3798651 - DNA, 19 bp, Homo sapiens
gttggccaggctggtctca

SEQ ID NO: 3798652 - DNA, 12 bp, Homo sapiens
gttggctggggg

SEQ ID NO: 3798653 - DNA, 23 bp, Homo sapiens
gttggcttctgtttctagttgag

SEQ ID NO: 3798654 - DNA, 16 bp, Homo sapiens
gttgggcccagatctg

SEQ ID NO: 3798655 - DNA, 14 bp, Homo sapiens
gttggtgtgttttt

SEQ ID NO: 3798656 - DNA, 17 bp, Homo sapiens
gttgtgaagatgtttgc

SEQ ID NO: 3798657 - DNA, 15 bp, Homo sapiens
gttgtgtaagagaat

SEQ ID NO: 3798658 - DNA, 17 bp, Homo sapiens
gttgtgtaagagaatgt

SEQ ID NO: 3798659 - DNA, 16 bp, Homo sapiens
gttgtgtactctggcc

SEQ ID NO: 3798660 - DNA, 17 bp, Homo sapiens
gttgttaatgaaaatgt

SEQ ID NO: 3798661 - DNA, 19 bp, Homo sapiens
gttgttaatgaaaatgtca

SEQ ID NO: 3798662 - DNA, 15 bp, Homo sapiens
gttgttctttcagaa

SEQ ID NO: 3798663 - DNA, 24 bp, Homo sapiens
gttgttgttaatgaaaatgtcaga

SEQ ID NO: 3798664 - DNA, 15 bp, Homo sapiens
gttgtttctgaccca

SEQ ID NO: 3798665 - DNA, 23 bp, Homo sapiens
gttgtttgaaaatattatctttg

SEQ ID NO: 3798666 - DNA, 13 bp, Homo sapiens
gttgtttgtaaat

SEQ ID NO: 3798667 - DNA, 19 bp, Homo sapiens
gttgttttttgaaaacatg

SEQ ID NO: 3798668 - DNA, 21 bp, Homo sapiens
gtttaaaaaagtttaaaatgt

SEQ ID NO: 3798669 - DNA, 23 bp, Homo sapiens
gtttaaaagacacacttgtccac

SEQ ID NO: 3798670 - DNA, 16 bp, Homo sapiens
gtttaaactgattcat

SEQ ID NO: 3798671 - DNA, 21 bp, Homo sapiens
gtttaaactgattcataataa

SEQ ID NO: 3798672 - DNA, 19 bp, Homo sapiens
gtttaaagtgtattataac

SEQ ID NO: 3798673 - DNA, 21 bp, Homo sapiens
gtttaaagtgtattataacag

SEQ ID NO: 3798674 - DNA, 13 bp, Homo sapiens
gtttaaagttctg

SEQ ID NO: 3798675 - DNA, 17 bp, Homo sapiens
gtttaaagttctgtgta

SEQ ID NO: 3798676 - DNA, 20 bp, Homo sapiens
gtttaaagttctgtgtattt

SEQ ID NO: 3798677 - DNA, 22 bp, Homo sapiens
gtttaacggcactgtggccttg

SEQ ID NO: 3798678 - DNA, 23 bp, Homo sapiens
gtttaagaaaaaataacacacat

SEQ ID NO: 3798679 - DNA, 19 bp, Homo sapiens
gtttaatattgagaaagaa

SEQ ID NO: 3798680 - DNA, 16 bp, Homo sapiens
gtttacactctttgta

SEQ ID NO: 3798681 - DNA, 15 bp, Homo sapiens
gtttacactgtcaaa

SEQ ID NO: 3798682 - DNA, 18 bp, Homo sapiens
gtttaccatttgtaataa

SEQ ID NO: 3798683 - DNA, 20 bp, Homo sapiens
gtttaccatttgtaataaag

SEQ ID NO: 3798684 - DNA, 13 bp, Homo sapiens
gtttactatttta

SEQ ID NO: 3798685 - DNA, 15 bp, Homo sapiens
gtttagtgtaaaaat

SEQ ID NO: 3798686 - DNA, 13 bp, Homo sapiens
gtttatgagccag

SEQ ID NO: 3798687 - DNA, 17 bp, Homo sapiens
gtttatgcaaggaagga

SEQ ID NO: 3798688 - DNA, 15 bp, Homo sapiens
gtttatggcctcagc

SEQ ID NO: 3798689 - DNA, 18 bp, Homo sapiens
gtttatggcctcagctgc

SEQ ID NO: 3798690 - DNA, 13 bp, Homo sapiens
gtttattaacaaa

SEQ ID NO: 3798691 - DNA, 18 bp, Homo sapiens
gtttattaacaaattatg

SEQ ID NO: 3798692 - DNA, 23 bp, Homo sapiens
gtttattaacaaattatgttaca

SEQ ID NO: 3798693 - DNA, 16 bp, Homo sapiens
gtttatttatcagtga

SEQ ID NO: 3798694 - DNA, 15 bp, Homo sapiens
gtttcaaaataaaaa

SEQ ID NO: 3798695 - DNA, 16 bp, Homo sapiens
gtttcaaaataaaaac

SEQ ID NO: 3798696 - DNA, 23 bp, Homo sapiens
gtttcaaccaagtcatgtgcatt

SEQ ID NO: 3798697 - DNA, 12 bp, Homo sapiens
gtttcagacagg

SEQ ID NO: 3798698 - DNA, 16 bp, Homo sapiens
gtttcagtaataaaac

SEQ ID NO: 3798699 - DNA, 20 bp, Homo sapiens
gtttcattgcgaatcttttt

SEQ ID NO: 3798700 - DNA, 14 bp, Homo sapiens
gtttccaaggagct

SEQ ID NO: 3798701 - DNA, 19 bp, Homo sapiens
gtttccaaggagctgagaa

SEQ ID NO: 3798702 - DNA, 20 bp, Homo sapiens
gtttccaaggagctgagaat

SEQ ID NO: 3798703 - DNA, 22 bp, Homo sapiens
gtttccacgatgaaaaacttcc

SEQ ID NO: 3798704 - DNA, 13 bp, Homo sapiens
gtttcccataatt

SEQ ID NO: 3798705 - DNA, 20 bp, Homo sapiens
gtttcccataattttcttca

SEQ ID NO: 3798706 - DNA, 21 bp, Homo sapiens
gtttcccataattttcttcat

SEQ ID NO: 3798707 - DNA, 20 bp, Homo sapiens
gtttccccaccagtgaatga

SEQ ID NO: 3798708 - DNA, 16 bp, Homo sapiens
gtttcctcaggctgct

SEQ ID NO: 3798709 - DNA, 20 bp, Homo sapiens
gtttcgtgaagtatactgta

SEQ ID NO: 3798710 - DNA, 23 bp, Homo sapiens
gtttctaacactagtctgtgtgc

SEQ ID NO: 3798711 - DNA, 19 bp, Homo sapiens
gtttctagagcctgctgga

SEQ ID NO: 3798712 - DNA, 19 bp, Homo sapiens
gtttctatgtgtagggcgg

SEQ ID NO: 3798713 - DNA, 14 bp, Homo sapiens
gtttctcagctccc

SEQ ID NO: 3798714 - DNA, 14 bp, Homo sapiens
gtttctccccctgg

SEQ ID NO: 3798715 - DNA, 12 bp, Homo sapiens
gtttctctgctg

SEQ ID NO: 3798716 - DNA, 21 bp, Homo sapiens
gtttctgcccacattggaccc

SEQ ID NO: 3798717 - DNA, 23 bp, Homo sapiens
gtttcttcatccggcagcctgga

SEQ ID NO: 3798718 - DNA, 13 bp, Homo sapiens
gtttgaaaatatt

SEQ ID NO: 3798719 - DNA, 19 bp, Homo sapiens
gtttgaatataaacactat

SEQ ID NO: 3798720 - DNA, 13 bp, Homo sapiens
gtttgagctcaga

SEQ ID NO: 3798721 - DNA, 13 bp, Homo sapiens
gtttgcaaggaag

SEQ ID NO: 3798722 - DNA, 16 bp, Homo sapiens
gtttgcttattgttcc

SEQ ID NO: 3798723 - DNA, 22 bp, Homo sapiens
gtttggggaatgcggccgcatt

SEQ ID NO: 3798724 - DNA, 15 bp, Homo sapiens
gtttggggagcagag

SEQ ID NO: 3798725 - DNA, 14 bp, Homo sapiens
gtttggttctgggg

SEQ ID NO: 3798726 - DNA, 19 bp, Homo sapiens
gtttgtggaaaatgaaaat

SEQ ID NO: 3798727 - DNA, 12 bp, Homo sapiens
gtttgtggcctc

SEQ ID NO: 3798728 - DNA, 15 bp, Homo sapiens
gtttgtggcctcaga

SEQ ID NO: 3798729 - DNA, 17 bp, Homo sapiens
gtttgttaaaactggca

SEQ ID NO: 3798730 - DNA, 17 bp, Homo sapiens
gtttgttttgtttttta

SEQ ID NO: 3798731 - DNA, 12 bp, Homo sapiens
gttttaaaatta

SEQ ID NO: 3798732 - DNA, 16 bp, Homo sapiens
gttttaagaggcaggg

SEQ ID NO: 3798733 - DNA, 18 bp, Homo sapiens
gttttaaggaagaaaaat

SEQ ID NO: 3798734 - DNA, 16 bp, Homo sapiens
gttttaattgaaggaa

SEQ ID NO: 3798735 - DNA, 21 bp, Homo sapiens
gttttagttgcagaaacattt

SEQ ID NO: 3798736 - DNA, 19 bp, Homo sapiens
gttttatatttttatagac

SEQ ID NO: 3798737 - DNA, 17 bp, Homo sapiens
gttttatctctgtctac

SEQ ID NO: 3798738 - DNA, 19 bp, Homo sapiens
gttttcagaacctcttccc

SEQ ID NO: 3798739 - DNA, 14 bp, Homo sapiens
gttttcataataaa

SEQ ID NO: 3798740 - DNA, 14 bp, Homo sapiens
gttttccaccctgg

SEQ ID NO: 3798741 - DNA, 20 bp, Homo sapiens
gttttccaggtttaagctgt

SEQ ID NO: 3798742 - DNA, 15 bp, Homo sapiens
gttttccatgaaaac

SEQ ID NO: 3798743 - DNA, 21 bp, Homo sapiens
gttttccctgacctccctcta

SEQ ID NO: 3798744 - DNA, 16 bp, Homo sapiens
gttttcctaaatgcag

SEQ ID NO: 3798745 - DNA, 13 bp, Homo sapiens
gttttcctgaaat

SEQ ID NO: 3798746 - DNA, 18 bp, Homo sapiens
gttttcgaagctcagccc

SEQ ID NO: 3798747 - DNA, 20 bp, Homo sapiens
gttttcgaagctcagcccac

SEQ ID NO: 3798748 - DNA, 23 bp, Homo sapiens
gttttctcaacaaatggaatgcc

SEQ ID NO: 3798749 - DNA, 20 bp, Homo sapiens
gttttctcctgcctgtgctg

SEQ ID NO: 3798750 - DNA, 19 bp, Homo sapiens
gttttctcttgagagggtg

SEQ ID NO: 3798751 - DNA, 17 bp, Homo sapiens
gttttgaactaataaaa

SEQ ID NO: 3798752 - DNA, 23 bp, Homo sapiens
gttttgatgtttgtggcctcaga

SEQ ID NO: 3798753 - DNA, 19 bp, Homo sapiens
gttttgatttgtactgaaa

SEQ ID NO: 3798754 - DNA, 20 bp, Homo sapiens
gttttgccatgttggccagg

SEQ ID NO: 3798755 - DNA, 21 bp, Homo sapiens
gttttgccatgttggccaggc

SEQ ID NO: 3798756 - DNA, 15 bp, Homo sapiens
gttttgtaggtactt

SEQ ID NO: 3798757 - DNA, 15 bp, Homo sapiens
gttttgtttctgaaa

SEQ ID NO: 3798758 - DNA, 19 bp, Homo sapiens
gtttttaactcaatatttt

SEQ ID NO: 3798759 - DNA, 18 bp, Homo sapiens
gtttttaatcgtacattt

SEQ ID NO: 3798760 - DNA, 21 bp, Homo sapiens
gtttttacctaccacagtgtc

SEQ ID NO: 3798761 - DNA, 22 bp, Homo sapiens
gtttttacctaccacagtgtct

SEQ ID NO: 3798762 - DNA, 16 bp, Homo sapiens
gtttttagagacaggg

SEQ ID NO: 3798763 - DNA, 21 bp, Homo sapiens
gtttttatgaagaaaaaatac

SEQ ID NO: 3798764 - DNA, 16 bp, Homo sapiens
gtttttattccttgtg

SEQ ID NO: 3798765 - DNA, 16 bp, Homo sapiens
gtttttccactactgc

SEQ ID NO: 3798766 - DNA, 15 bp, Homo sapiens
gtttttcttctccct

SEQ ID NO: 3798767 - DNA, 19 bp, Homo sapiens
gtttttgggtgcaagaggg

SEQ ID NO: 3798768 - DNA, 21 bp, Homo sapiens
gttttttaaagtcttgctgtg

SEQ ID NO: 3798769 - DNA, 22 bp, Homo sapiens
gttttttatcttttctacagca

SEQ ID NO: 3798770 - DNA, 21 bp, Homo sapiens
gttttttcctgagcttggcca

SEQ ID NO: 3798771 - DNA, 19 bp, Homo sapiens
gtttttttgtatagtaaag

SEQ ID NO: 3798772 - DNA, 20 bp, Homo sapiens
gttttttttaaataaaagca

SEQ ID NO: 3798773 - DNA, 17 bp, Homo sapiens
taaaaaaaatgaaatgt

SEQ ID NO: 3798774 - DNA, 22 bp, Homo sapiens
taaaaaaatacagtattctgta

SEQ ID NO: 3798775 - DNA, 16 bp, Homo sapiens
taaaaaagtctctatt

SEQ ID NO: 3798776 - DNA, 17 bp, Homo sapiens
taaaaaagtctctattt

SEQ ID NO: 3798777 - DNA, 21 bp, Homo sapiens
taaaaaagtctctatttaaat

SEQ ID NO: 3798778 - DNA, 13 bp, Homo sapiens
taaaaaatgtcca

SEQ ID NO: 3798779 - DNA, 17 bp, Homo sapiens
taaaaaattttgtaatt

SEQ ID NO: 3798780 - DNA, 17 bp, Homo sapiens
taaaaacagcattgctt

SEQ ID NO: 3798781 - DNA, 18 bp, Homo sapiens
taaaaacagcattgcttt

SEQ ID NO: 3798782 - DNA, 22 bp, Homo sapiens
taaaaacagcattgctttctga

SEQ ID NO: 3798783 - DNA, 16 bp, Homo sapiens
taaaaactgactcctt

SEQ ID NO: 3798784 - DNA, 19 bp, Homo sapiens
taaaaaggcacctataaaa

SEQ ID NO: 3798785 - DNA, 16 bp, Homo sapiens
taaaaagtatatgtta

SEQ ID NO: 3798786 - DNA, 16 bp, Homo sapiens
taaaaagtctgcatta

SEQ ID NO: 3798787 - DNA, 12 bp, Homo sapiens
taaaaatacaaa

SEQ ID NO: 3798788 - DNA, 17 bp, Homo sapiens
taaaaatcattgattgt

SEQ ID NO: 3798789 - DNA, 15 bp, Homo sapiens
taaaaatggtaaaat

SEQ ID NO: 3798790 - DNA, 18 bp, Homo sapiens
taaaaatggtaaaattgc

SEQ ID NO: 3798791 - DNA, 21 bp, Homo sapiens
taaaaatgttctattttaatt

SEQ ID NO: 3798792 - DNA, 15 bp, Homo sapiens
taaaacaacactcac

SEQ ID NO: 3798793 - DNA, 17 bp, Homo sapiens
taaaacaagaaagtttc

SEQ ID NO: 3798794 - DNA, 18 bp, Homo sapiens
taaaacaatattgtttct

SEQ ID NO: 3798795 - DNA, 11 bp, Homo sapiens
taaaacacttg

SEQ ID NO: 3798796 - DNA, 15 bp, Homo sapiens
taaaacattttcaca

SEQ ID NO: 3798797 - DNA, 19 bp, Homo sapiens
taaaactggcatctgacac

SEQ ID NO: 3798798 - DNA, 13 bp, Homo sapiens
taaaactgtccct

SEQ ID NO: 3798799 - DNA, 16 bp, Homo sapiens
taaaacttaagatatt

SEQ ID NO: 3798800 - DNA, 22 bp, Homo sapiens
taaaacttgatgtgttatctct

SEQ ID NO: 3798801 - DNA, 13 bp, Homo sapiens
taaaacttgctgc

SEQ ID NO: 3798802 - DNA, 13 bp, Homo sapiens
taaaactttattt

SEQ ID NO: 3798803 - DNA, 15 bp, Homo sapiens
taaaactttgctgcc

SEQ ID NO: 3798804 - DNA, 21 bp, Homo sapiens
taaaagaaagcctcagagaat

SEQ ID NO: 3798805 - DNA, 22 bp, Homo sapiens
taaaagaaagcctcagagaatt

SEQ ID NO: 3798806 - DNA, 17 bp, Homo sapiens
taaaagaaatgcacaat

SEQ ID NO: 3798807 - DNA, 20 bp, Homo sapiens
taaaagaaatgcacaatgtc

SEQ ID NO: 3798808 - DNA, 23 bp, Homo sapiens
taaaagacactgtttacaagaaa

SEQ ID NO: 3798809 - DNA, 11 bp, Homo sapiens
taaaagcagca

SEQ ID NO: 3798810 - DNA, 21 bp, Homo sapiens
taaaagcagcatctgctaata

SEQ ID NO: 3798811 - DNA, 18 bp, Homo sapiens
taaaagccatcatgtaaa

SEQ ID NO: 3798812 - DNA, 21 bp, Homo sapiens
taaaaggaaatctcaccccat

SEQ ID NO: 3798813 - DNA, 12 bp, Homo sapiens
taaaaggtgacc

SEQ ID NO: 3798814 - DNA, 19 bp, Homo sapiens
taaaaggtgaccaatgatg

SEQ ID NO: 3798815 - DNA, 12 bp, Homo sapiens
taaaagttactt

SEQ ID NO: 3798816 - DNA, 17 bp, Homo sapiens
taaaagttattaatatt

SEQ ID NO: 3798817 - DNA, 17 bp, Homo sapiens
taaaataaagtatatat

SEQ ID NO: 3798818 - DNA, 22 bp, Homo sapiens
taaaatagaaatatagccaaaa

SEQ ID NO: 3798819 - DNA, 21 bp, Homo sapiens
taaaatagcaacactctatat

SEQ ID NO: 3798820 - DNA, 21 bp, Homo sapiens
taaaatagccacttaccttca

SEQ ID NO: 3798821 - DNA, 14 bp, Homo sapiens
taaaatatcattca

SEQ ID NO: 3798822 - DNA, 19 bp, Homo sapiens
taaaatatcattcagcaac

SEQ ID NO: 3798823 - DNA, 13 bp, Homo sapiens
taaaatatttatt

SEQ ID NO: 3798824 - DNA, 17 bp, Homo sapiens
taaaatcactaacatta

SEQ ID NO: 3798825 - DNA, 18 bp, Homo sapiens
taaaatcactaacattat

SEQ ID NO: 3798826 - DNA, 19 bp, Homo sapiens
taaaatcactaacattata

SEQ ID NO: 3798827 - DNA, 18 bp, Homo sapiens
taaaatcactctcagtgc

SEQ ID NO: 3798828 - DNA, 20 bp, Homo sapiens
taaaatcctgcttaaaactt

SEQ ID NO: 3798829 - DNA, 16 bp, Homo sapiens
taaaatcttgaaaatg

SEQ ID NO: 3798830 - DNA, 14 bp, Homo sapiens
taaaatgaaattac

SEQ ID NO: 3798831 - DNA, 20 bp, Homo sapiens
taaaatgaggttcaactgtt

SEQ ID NO: 3798832 - DNA, 14 bp, Homo sapiens
taaaattaaagcta

SEQ ID NO: 3798833 - DNA, 18 bp, Homo sapiens
taaaattaaagctgaaaa

SEQ ID NO: 3798834 - DNA, 12 bp, Homo sapiens
taaaattgcatg

SEQ ID NO: 3798835 - DNA, 13 bp, Homo sapiens
taaaattgcatgg

SEQ ID NO: 3798836 - DNA, 12 bp, Homo sapiens
taaacaaatgta

SEQ ID NO: 3798837 - DNA, 19 bp, Homo sapiens
taattttaggcacccatcc

SEQ ID NO: 3798838 - DNA, 18 bp, Homo sapiens
taattttatgaatgtctt

SEQ ID NO: 3798839 - DNA, 13 bp, Homo sapiens
taattttcttgat

SEQ ID NO: 3798840 - DNA, 14 bp, Homo sapiens
taattttcttgatg

SEQ ID NO: 3798841 - DNA, 23 bp, Homo sapiens
taattttcttgatgactggaatt

SEQ ID NO: 3798842 - DNA, 15 bp, Homo sapiens
taattttgcataaaa

SEQ ID NO: 3798843 - DNA, 13 bp, Homo sapiens
taatttttaaagt

SEQ ID NO: 3798844 - DNA, 22 bp, Homo sapiens
taatttttacagaattgcttgt

SEQ ID NO: 3798845 - DNA, 17 bp, Homo sapiens
taatttttttatgtttt

SEQ ID NO: 3798846 - DNA, 18 bp, Homo sapiens
taatttttttgagacaga

SEQ ID NO: 3798847 - DNA, 20 bp, Homo sapiens
tacaaaaagcataaaaatta

SEQ ID NO: 3798848 - DNA, 13 bp, Homo sapiens
tacaaaaattcct

SEQ ID NO: 3798849 - DNA, 19 bp, Homo sapiens
tacaaaacctgatgttaaa

SEQ ID NO: 3798850 - DNA, 16 bp, Homo sapiens
tacaaaagaagatgaa

SEQ ID NO: 3798851 - DNA, 17 bp, Homo sapiens
tacaaacatgtggttaa

SEQ ID NO: 3798852 - DNA, 11 bp, Homo sapiens
tacaaactgca

SEQ ID NO: 3798853 - DNA, 13 bp, Homo sapiens
tacaaaggaaaaa

SEQ ID NO: 3798854 - DNA, 18 bp, Homo sapiens
tacaaaggcttattaatt

SEQ ID NO: 3798855 - DNA, 18 bp, Homo sapiens
tacaactcaaaaaacatt

SEQ ID NO: 3798856 - DNA, 18 bp, Homo sapiens
tacaagttctatttaagt

SEQ ID NO: 3798857 - DNA, 11 bp, Homo sapiens
tacaataaact

SEQ ID NO: 3798858 - DNA, 12 bp, Homo sapiens
tacaatatttaa

SEQ ID NO: 3798859 - DNA, 14 bp, Homo sapiens
tacaatatttaaaa

SEQ ID NO: 3798860 - DNA, 16 bp, Homo sapiens
tacaatatttaaaatt

SEQ ID NO: 3798861 - DNA, 16 bp, Homo sapiens
tacaatattttaagca

SEQ ID NO: 3798862 - DNA, 18 bp, Homo sapiens
tacaatattttaagcatt

SEQ ID NO: 3798863 - DNA, 20 bp, Homo sapiens
tacaatattttaagcattac

SEQ ID NO: 3798864 - DNA, 23 bp, Homo sapiens
tacaatgaaaaggactttataga

SEQ ID NO: 3798865 - DNA, 19 bp, Homo sapiens
tacaattatatcagtcctc

SEQ ID NO: 3798866 - DNA, 18 bp, Homo sapiens
tacaattctacattgtca

SEQ ID NO: 3798867 - DNA, 22 bp, Homo sapiens
tacacaagactttccccatact

SEQ ID NO: 3798868 - DNA, 17 bp, Homo sapiens
tacacacacaaagagag

SEQ ID NO: 3798869 - DNA, 21 bp, Homo sapiens
tacacacacacgcgtgcacac

SEQ ID NO: 3798870 - DNA, 22 bp, Homo sapiens
tacacagatcacagcttcagcc

SEQ ID NO: 3798871 - DNA, 18 bp, Homo sapiens
tacacattcaataagcat

SEQ ID NO: 3798872 - DNA, 24 bp, Homo sapiens
tacaccatgtttgagctcagaccc

SEQ ID NO: 3798873 - DNA, 14 bp, Homo sapiens
tacacccaaagagg

SEQ ID NO: 3798874 - DNA, 15 bp, Homo sapiens
tacactaaaaggtga

SEQ ID NO: 3798875 - DNA, 20 bp, Homo sapiens
tacactaagggtgtaagtaa

SEQ ID NO: 3798876 - DNA, 15 bp, Homo sapiens
tacactccagcctga

SEQ ID NO: 3798877 - DNA, 17 bp, Homo sapiens
tacactctcctgggccc

SEQ ID NO: 3798878 - DNA, 22 bp, Homo sapiens
tacactctcctgggcccctccc

SEQ ID NO: 3798879 - DNA, 16 bp, Homo sapiens
tacactgttagaacac

SEQ ID NO: 3798880 - DNA, 17 bp, Homo sapiens
tacactgttagaacact

SEQ ID NO: 3798881 - DNA, 20 bp, Homo sapiens
tacactgttagaacactatt

SEQ ID NO: 3798882 - DNA, 23 bp, Homo sapiens
tacactgttagaacactattttc

SEQ ID NO: 3798883 - DNA, 16 bp, Homo sapiens
tacagaatcattgctt

SEQ ID NO: 3798884 - DNA, 17 bp, Homo sapiens
tacagaatcattgctta

SEQ ID NO: 3798885 - DNA, 18 bp, Homo sapiens
tacagaatcattgcttat

SEQ ID NO: 3798886 - DNA, 14 bp, Homo sapiens
tacagagaaggaat

SEQ ID NO: 3798887 - DNA, 23 bp, Homo sapiens
tacagagaaggaatgtctttggt

SEQ ID NO: 3798888 - DNA, 17 bp, Homo sapiens
tacagagaggagaaaca

SEQ ID NO: 3798889 - DNA, 18 bp, Homo sapiens
tacagagaggagaaacac

SEQ ID NO: 3798890 - DNA, 17 bp, Homo sapiens
tacagataggccttctt

SEQ ID NO: 3798891 - DNA, 17 bp, Homo sapiens
tacagattgctgcttct

SEQ ID NO: 3798892 - DNA, 15 bp, Homo sapiens
tacagcaaatttata

SEQ ID NO: 3798893 - DNA, 19 bp, Homo sapiens
tacaggaaaagctgctgac

SEQ ID NO: 3798894 - DNA, 21 bp, Homo sapiens
tacaggaagcaccccatgcca

SEQ ID NO: 3798895 - DNA, 18 bp, Homo sapiens
tacaggaaggtagaaata

SEQ ID NO: 3798896 - DNA, 14 bp, Homo sapiens
tacaggcaccgaga

SEQ ID NO: 3798897 - DNA, 19 bp, Homo sapiens
tacaggcaccgagaatgtt

SEQ ID NO: 3798898 - DNA, 20 bp, Homo sapiens
tacaggcaccgagaatgttg

SEQ ID NO: 3798899 - DNA, 15 bp, Homo sapiens
tacaggcagcacaga

SEQ ID NO: 3798900 - DNA, 21 bp, Homo sapiens
tacagggcatgcattttgcag

SEQ ID NO: 3798901 - DNA, 16 bp, Homo sapiens
tacaggtgtgagtcac

SEQ ID NO: 3798902 - DNA, 15 bp, Homo sapiens
tacagtatctcaggg

SEQ ID NO: 3798903 - DNA, 18 bp, Homo sapiens
tacagtatctcagggcct

SEQ ID NO: 3798904 - DNA, 19 bp, Homo sapiens
tacagttgaaaaacagctg

SEQ ID NO: 3798905 - DNA, 14 bp, Homo sapiens
tacagttttaaaga

SEQ ID NO: 3798906 - DNA, 15 bp, Homo sapiens
tacagttttcctaaa

SEQ ID NO: 3798907 - DNA, 21 bp, Homo sapiens
tacataaaggtggtatgtgtg

SEQ ID NO: 3798908 - DNA, 19 bp, Homo sapiens
tacataacagggtaaatta

SEQ ID NO: 3798909 - DNA, 23 bp, Homo sapiens
tacatacacatatatacacacac

SEQ ID NO: 3798910 - DNA, 15 bp, Homo sapiens
tacatactttttcaa

SEQ ID NO: 3798911 - DNA, 17 bp, Homo sapiens
tacatagtgtaggcttt

SEQ ID NO: 3798912 - DNA, 14 bp, Homo sapiens
tacatatatatatt

SEQ ID NO: 3798913 - DNA, 20 bp, Homo sapiens
tacatatgtaaaataaaatt

SEQ ID NO: 3798914 - DNA, 15 bp, Homo sapiens
tacatattctttaaa

SEQ ID NO: 3798915 - DNA, 15 bp, Homo sapiens
tacatcgccctccac

SEQ ID NO: 3798916 - DNA, 12 bp, Homo sapiens
tacatgaaacag

SEQ ID NO: 3798917 - DNA, 15 bp, Homo sapiens
tacatgacactgaaa

SEQ ID NO: 3798918 - DNA, 18 bp, Homo sapiens
tacatgacgacaaagctg

SEQ ID NO: 3798919 - DNA, 13 bp, Homo sapiens
tacatgagaacag

SEQ ID NO: 3798920 - DNA, 17 bp, Homo sapiens
tacatgagaacagactg

SEQ ID NO: 3798921 - DNA, 14 bp, Homo sapiens
tacatgcagcccat

SEQ ID NO: 3798922 - DNA, 17 bp, Homo sapiens
tacatgcagcccatgcc

SEQ ID NO: 3798923 - DNA, 22 bp, Homo sapiens
tacatggaataacatgtaatta

SEQ ID NO: 3798924 - DNA, 16 bp, Homo sapiens
tacatggccagtgtga

SEQ ID NO: 3798925 - DNA, 16 bp, Homo sapiens
tacatggttgtgacct

SEQ ID NO: 3798926 - DNA, 16 bp, Homo sapiens
tacatgtggcccaaca

SEQ ID NO: 3798927 - DNA, 19 bp, Homo sapiens
tacattagcagtttgcttt

SEQ ID NO: 3798928 - DNA, 20 bp, Homo sapiens
tacattagcagtttgctttg

SEQ ID NO: 3798929 - DNA, 19 bp, Homo sapiens
tacattgctggtcttgtaa

SEQ ID NO: 3798930 - DNA, 21 bp, Homo sapiens
tacattgctggtcttgtaaga

SEQ ID NO: 3798931 - DNA, 17 bp, Homo sapiens
tacatttaattgagaag

SEQ ID NO: 3798932 - DNA, 14 bp, Homo sapiens
tacatttctgaaat

SEQ ID NO: 3798933 - DNA, 17 bp, Homo sapiens
tacatttgtatgttgtg

SEQ ID NO: 3798934 - DNA, 16 bp, Homo sapiens
tacattttagacagta

SEQ ID NO: 3798935 - DNA, 14 bp, Homo sapiens
tacattttcatatg

SEQ ID NO: 3798936 - DNA, 21 bp, Homo sapiens
taccaagatgccatctgtgtc

SEQ ID NO: 3798937 - DNA, 14 bp, Homo sapiens
taccacaaggaaaa

SEQ ID NO: 3798938 - DNA, 14 bp, Homo sapiens
taccacagtgtctg

SEQ ID NO: 3798939 - DNA, 14 bp, Homo sapiens
taccactcaggcca

SEQ ID NO: 3798940 - DNA, 22 bp, Homo sapiens
taccagacggttcaccagcctc

SEQ ID NO: 3798941 - DNA, 21 bp, Homo sapiens
taccagcctccgtatttcaga

SEQ ID NO: 3798942 - DNA, 16 bp, Homo sapiens
taccaggttgaaagac

SEQ ID NO: 3798943 - DNA, 16 bp, Homo sapiens
taccagtaaagtgtaa

SEQ ID NO: 3798944 - DNA, 11 bp, Homo sapiens
taccagtgtgg

SEQ ID NO: 3798945 - DNA, 13 bp, Homo sapiens
taccatctccctc

SEQ ID NO: 3798946 - DNA, 15 bp, Homo sapiens
taccatttcagagag

SEQ ID NO: 3798947 - DNA, 16 bp, Homo sapiens
taccatttcagagagg

SEQ ID NO: 3798948 - DNA, 17 bp, Homo sapiens
taccatttgtaataaag

SEQ ID NO: 3798949 - DNA, 23 bp, Homo sapiens
taccatttgtaataaagtatata

SEQ ID NO: 3798950 - DNA, 13 bp, Homo sapiens
tatccatgtactg

SEQ ID NO: 3798951 - DNA, 14 bp, Homo sapiens
tatccatgtactgt

SEQ ID NO: 3798952 - DNA, 18 bp, Homo sapiens
tatccatgtactgtagtt

SEQ ID NO: 3798953 - DNA, 16 bp, Homo sapiens
tatcccacggaaaatg

SEQ ID NO: 3798954 - DNA, 12 bp, Homo sapiens
tatcccatccca

SEQ ID NO: 3798955 - DNA, 18 bp, Homo sapiens
tatccggacagagcacgt

SEQ ID NO: 3798956 - DNA, 17 bp, Homo sapiens
tatcctgaaatttcaga

SEQ ID NO: 3798957 - DNA, 19 bp, Homo sapiens
tatcctggctttgcccaac

SEQ ID NO: 3798958 - DNA, 21 bp, Homo sapiens
tatcctggctttgcccaacct

SEQ ID NO: 3798959 - DNA, 16 bp, Homo sapiens
tatcggagacagtgat

SEQ ID NO: 3798960 - DNA, 14 bp, Homo sapiens
tatcgggagcagtg

SEQ ID NO: 3798961 - DNA, 17 bp, Homo sapiens
tatcgggagcagtgtct

SEQ ID NO: 3798962 - DNA, 15 bp, Homo sapiens
tatctaaatgttgaa

SEQ ID NO: 3798963 - DNA, 21 bp, Homo sapiens
tatctaatatgtaacaagcca

SEQ ID NO: 3798964 - DNA, 14 bp, Homo sapiens
tatctagtgcagct

SEQ ID NO: 3798965 - DNA, 19 bp, Homo sapiens
tatctagtgcagctgattt

SEQ ID NO: 3798966 - DNA, 21 bp, Homo sapiens
tatctatatagtacctttgct

SEQ ID NO: 3798967 - DNA, 15 bp, Homo sapiens
tatctattgtaagat

SEQ ID NO: 3798968 - DNA, 20 bp, Homo sapiens
tatctatttgtatatataca

SEQ ID NO: 3798969 - DNA, 14 bp, Homo sapiens
tatctcacagcaca

SEQ ID NO: 3798970 - DNA, 18 bp, Homo sapiens
tatctcctcgcaagctgg

SEQ ID NO: 3798971 - DNA, 16 bp, Homo sapiens
tatctctgtgtgcaca

SEQ ID NO: 3798972 - DNA, 17 bp, Homo sapiens
tatctctgtgtgcacaa

SEQ ID NO: 3798973 - DNA, 14 bp, Homo sapiens
tatctgaaaatgta

SEQ ID NO: 3798974 - DNA, 20 bp, Homo sapiens
tatctgaaaatgtatgtgta

SEQ ID NO: 3798975 - DNA, 21 bp, Homo sapiens
tatctgaggcacatgtcagca

SEQ ID NO: 3798976 - DNA, 18 bp, Homo sapiens
tatctgggaactgtgcct

SEQ ID NO: 3798977 - DNA, 17 bp, Homo sapiens
tatctgtgcgtgaaaca

SEQ ID NO: 3798978 - DNA, 19 bp, Homo sapiens
tatctgtgcgtgaaacaca

SEQ ID NO: 3798979 - DNA, 20 bp, Homo sapiens
tatctgtgcgtgaaacacac

SEQ ID NO: 3798980 - DNA, 18 bp, Homo sapiens
tatcttgtttttccacta

SEQ ID NO: 3798981 - DNA, 16 bp, Homo sapiens
tatcttttctacagca

SEQ ID NO: 3798982 - DNA, 18 bp, Homo sapiens
tatctttttattgatgtg

SEQ ID NO: 3798983 - DNA, 18 bp, Homo sapiens
tatgaaaaatatgatatt

SEQ ID NO: 3798984 - DNA, 22 bp, Homo sapiens
tatgaaatttaatatagctatt

SEQ ID NO: 3798985 - DNA, 13 bp, Homo sapiens
tatgaagaaaaaa

SEQ ID NO: 3798986 - DNA, 15 bp, Homo sapiens
tatgaagaaaaaata

SEQ ID NO: 3798987 - DNA, 16 bp, Homo sapiens
tatgaagaaaaaatac

SEQ ID NO: 3798988 - DNA, 20 bp, Homo sapiens
tatgaagaaaaaatacattt

SEQ ID NO: 3798989 - DNA, 18 bp, Homo sapiens
tatgaataaagacaccta

SEQ ID NO: 3798990 - DNA, 16 bp, Homo sapiens
tatgaatacagggcat

SEQ ID NO: 3798991 - DNA, 21 bp, Homo sapiens
tatgaatctctacgcaaaaaa

SEQ ID NO: 3798992 - DNA, 16 bp, Homo sapiens
tatgacagctgtccct

SEQ ID NO: 3798993 - DNA, 20 bp, Homo sapiens
tatgacagctgtccctgtca

SEQ ID NO: 3798994 - DNA, 23 bp, Homo sapiens
tatgacgcggctcaaaaggaaac

SEQ ID NO: 3798995 - DNA, 20 bp, Homo sapiens
tatgacggaagaacatagaa

SEQ ID NO: 3798996 - DNA, 15 bp, Homo sapiens
tatgactaaagagag

SEQ ID NO: 3798997 - DNA, 15 bp, Homo sapiens
tatgagaggcaatga

SEQ ID NO: 3798998 - DNA, 16 bp, Homo sapiens
tatgagctttatgtaa

SEQ ID NO: 3798999 - DNA, 14 bp, Homo sapiens
tatgaggatgcaga

SEQ ID NO: 3799000 - DNA, 22 bp, Homo sapiens
tatgaggcaaccacaggcagca

SEQ ID NO: 3799001 - DNA, 15 bp, Homo sapiens
tatgaggtctaggaa

SEQ ID NO: 3799002 - DNA, 23 bp, Homo sapiens
tatgagtttttgatagctttatt

SEQ ID NO: 3799003 - DNA, 16 bp, Homo sapiens
tatgataaaaaatttt

SEQ ID NO: 3799004 - DNA, 14 bp, Homo sapiens
tatgatattccata

SEQ ID NO: 3799005 - DNA, 16 bp, Homo sapiens
tatgatattccatagt

SEQ ID NO: 3799006 - DNA, 23 bp, Homo sapiens
tatgatcacggctcactgcagcc

SEQ ID NO: 3799007 - DNA, 17 bp, Homo sapiens
tatgcaaggaaggaaag

SEQ ID NO: 3799008 - DNA, 20 bp, Homo sapiens
tatgcaaggaaggaaagaaa

SEQ ID NO: 3799009 - DNA, 16 bp, Homo sapiens
tatgcaatttcctttt

SEQ ID NO: 3799010 - DNA, 22 bp, Homo sapiens
tatgcaggggcaaacacctgct

SEQ ID NO: 3799011 - DNA, 17 bp, Homo sapiens
tatgcatctaataaaaa

SEQ ID NO: 3799012 - DNA, 18 bp, Homo sapiens
tatgctctgcatgttaca

SEQ ID NO: 3799013 - DNA, 20 bp, Homo sapiens
tatgctgccaaattttggcc

SEQ ID NO: 3799014 - DNA, 20 bp, Homo sapiens
tatgctgtattttcttttta

SEQ ID NO: 3799015 - DNA, 15 bp, Homo sapiens
tatgcttatacactt

SEQ ID NO: 3799016 - DNA, 13 bp, Homo sapiens
tatgcttatttta

SEQ ID NO: 3799017 - DNA, 17 bp, Homo sapiens
tatggaactctctccac

SEQ ID NO: 3799018 - DNA, 22 bp, Homo sapiens
tatggaagcatattgttattat

SEQ ID NO: 3799019 - DNA, 19 bp, Homo sapiens
tatggaagggtttgtggct

SEQ ID NO: 3799020 - DNA, 18 bp, Homo sapiens
tatggaattacatgtaaa

SEQ ID NO: 3799021 - DNA, 20 bp, Homo sapiens
tatggaatttttcattgata

SEQ ID NO: 3799022 - DNA, 12 bp, Homo sapiens
tatggcctcagc

SEQ ID NO: 3799023 - DNA, 23 bp, Homo sapiens
tatggcctcagctgcctcacttc

SEQ ID NO: 3799024 - DNA, 16 bp, Homo sapiens
tatgggactcaatgca

SEQ ID NO: 3799025 - DNA, 23 bp, Homo sapiens
tatgggactcaatgcactgacat

SEQ ID NO: 3799026 - DNA, 22 bp, Homo sapiens
tatggggagaaaagacatgaat

SEQ ID NO: 3799027 - DNA, 15 bp, Homo sapiens
tatggtaaagatatt

SEQ ID NO: 3799028 - DNA, 13 bp, Homo sapiens
tatggtataatgg

SEQ ID NO: 3799029 - DNA, 10 bp, Homo sapiens
tatgtaaaaa

SEQ ID NO: 3799030 - DNA, 19 bp, Homo sapiens
tatgtaaactgcattagaa

SEQ ID NO: 3799031 - DNA, 16 bp, Homo sapiens
tatgtaataatgtgaa

SEQ ID NO: 3799032 - DNA, 21 bp, Homo sapiens
tatgtacaatattttaagcat

SEQ ID NO: 3799033 - DNA, 16 bp, Homo sapiens
tatgtaccatgtacat

SEQ ID NO: 3799034 - DNA, 20 bp, Homo sapiens
tatgtactcctctttacact

SEQ ID NO: 3799035 - DNA, 12 bp, Homo sapiens
tatgtagatgtg

SEQ ID NO: 3799036 - DNA, 16 bp, Homo sapiens
tatgtatgtgaaagtt

SEQ ID NO: 3799037 - DNA, 13 bp, Homo sapiens
tatgtatgtgtgt

SEQ ID NO: 3799038 - DNA, 14 bp, Homo sapiens
tatgtatgtgtgta

SEQ ID NO: 3799039 - DNA, 17 bp, Homo sapiens
tatgtatgtgtgtatgg

SEQ ID NO: 3799040 - DNA, 18 bp, Homo sapiens
tatgtatgtttacactgt

SEQ ID NO: 3799041 - DNA, 12 bp, Homo sapiens
tatgtatttata

SEQ ID NO: 3799042 - DNA, 16 bp, Homo sapiens
tatgtattttatgtat

SEQ ID NO: 3799043 - DNA, 15 bp, Homo sapiens
tatgtcccttgctgt

SEQ ID NO: 3799044 - DNA, 12 bp, Homo sapiens
tatgtgaatgat

SEQ ID NO: 3799045 - DNA, 18 bp, Homo sapiens
tatgtgtatgtgccattt

SEQ ID NO: 3799046 - DNA, 19 bp, Homo sapiens
tatgtgtgtgtatgtttgc

SEQ ID NO: 3799047 - DNA, 19 bp, Homo sapiens
tatgttacatctgttttaa

SEQ ID NO: 3799048 - DNA, 16 bp, Homo sapiens
tatgttcaaagtcaaa

SEQ ID NO: 3799049 - DNA, 13 bp, Homo sapiens
tatgttgcccagg

SEQ ID NO: 3799050 - DNA, 21 bp, Homo sapiens
tatgttgcccaggcaggtctt

SEQ ID NO: 3799051 - DNA, 18 bp, Homo sapiens
tatgttggtagattctaa

SEQ ID NO: 3799052 - DNA, 16 bp, Homo sapiens
tatgttgtgaagatgt

SEQ ID NO: 3799053 - DNA, 18 bp, Homo sapiens
tatgtttacactgtcaaa

SEQ ID NO: 3799054 - DNA, 23 bp, Homo sapiens
tatgtttgctcagaacacattct

SEQ ID NO: 3799055 - DNA, 14 bp, Homo sapiens
tatgttttagcatg

SEQ ID NO: 3799056 - DNA, 16 bp, Homo sapiens
tatgttttagcatgtg

SEQ ID NO: 3799057 - DNA, 14 bp, Homo sapiens
tatgtttttgtgta

SEQ ID NO: 3799058 - DNA, 12 bp, Homo sapiens
tattaaaaatgg

SEQ ID NO: 3799059 - DNA, 12 bp, Homo sapiens
tattaaattatg

SEQ ID NO: 3799060 - DNA, 20 bp, Homo sapiens
tattaagcagtaaaaactgt

SEQ ID NO: 3799061 - DNA, 12 bp, Homo sapiens
tattaatgctaa

SEQ ID NO: 3799062 - DNA, 13 bp, Homo sapiens
tattaatgctaag

SEQ ID NO: 3799063 - DNA, 19 bp, Homo sapiens
tcaggagttagaggccagc

SEQ ID NO: 3799064 - DNA, 20 bp, Homo sapiens
tcaggatgatacactatgaa

SEQ ID NO: 3799065 - DNA, 14 bp, Homo sapiens
tcaggatgcccagg

SEQ ID NO: 3799066 - DNA, 18 bp, Homo sapiens
tcaggcaggtgggatgga

SEQ ID NO: 3799067 - DNA, 15 bp, Homo sapiens
tcaggcataggcctg

SEQ ID NO: 3799068 - DNA, 17 bp, Homo sapiens
tcaggcataggcctggg

SEQ ID NO: 3799069 - DNA, 18 bp, Homo sapiens
tcaggcataggcctgggt

SEQ ID NO: 3799070 - DNA, 19 bp, Homo sapiens
tcaggcataggcctgggtg

SEQ ID NO: 3799071 - DNA, 17 bp, Homo sapiens
tcaggcatgcctgtgtg

SEQ ID NO: 3799072 - DNA, 15 bp, Homo sapiens
tcaggctgctggagg

SEQ ID NO: 3799073 - DNA, 15 bp, Homo sapiens
tcaggcttccttggc

SEQ ID NO: 3799074 - DNA, 14 bp, Homo sapiens
tcagggaagcccag

SEQ ID NO: 3799075 - DNA, 16 bp, Homo sapiens
tcagggaagcccagct

SEQ ID NO: 3799076 - DNA, 23 bp, Homo sapiens
tcagggacagagacacctgcacc

SEQ ID NO: 3799077 - DNA, 14 bp, Homo sapiens
tcagggacccctgc

SEQ ID NO: 3799078 - DNA, 15 bp, Homo sapiens
tcagggaggtcattt

SEQ ID NO: 3799079 - DNA, 22 bp, Homo sapiens
tcagggcactgctgctgccttt

SEQ ID NO: 3799080 - DNA, 15 bp, Homo sapiens
tcagggcagcctgcc

SEQ ID NO: 3799081 - DNA, 18 bp, Homo sapiens
tcagggcagcctgcctgg

SEQ ID NO: 3799082 - DNA, 16 bp, Homo sapiens
tcagggccccagcact

SEQ ID NO: 3799083 - DNA, 15 bp, Homo sapiens
tcagggttctcctct

SEQ ID NO: 3799084 - DNA, 17 bp, Homo sapiens
tcagggttggcccctgc

SEQ ID NO: 3799085 - DNA, 15 bp, Homo sapiens
tcaggtaacaggcag

SEQ ID NO: 3799086 - DNA, 21 bp, Homo sapiens
tcaggtaacaggcagatacag

SEQ ID NO: 3799087 - DNA, 22 bp, Homo sapiens
tcaggtaacaggcagatacagg

SEQ ID NO: 3799088 - DNA, 13 bp, Homo sapiens
tcaggtagctgcc

SEQ ID NO: 3799089 - DNA, 19 bp, Homo sapiens
tcaggtagttgcaattgaa

SEQ ID NO: 3799090 - DNA, 16 bp, Homo sapiens
tcaggtcaggagttcg

SEQ ID NO: 3799091 - DNA, 12 bp, Homo sapiens
tcaggtccctgc

SEQ ID NO: 3799092 - DNA, 15 bp, Homo sapiens
tcaggtgctgccatc

SEQ ID NO: 3799093 - DNA, 15 bp, Homo sapiens
tcaggtgtccctgca

SEQ ID NO: 3799094 - DNA, 17 bp, Homo sapiens
tcaggtgtccctgcact

SEQ ID NO: 3799095 - DNA, 18 bp, Homo sapiens
tcaggtgtccctgcactt

SEQ ID NO: 3799096 - DNA, 22 bp, Homo sapiens
tcaggtgtccctgcacttgcag

SEQ ID NO: 3799097 - DNA, 17 bp, Homo sapiens
tcaggttgtagtaaaga

SEQ ID NO: 3799098 - DNA, 18 bp, Homo sapiens
tcaggtttgcctgagggc

SEQ ID NO: 3799099 - DNA, 13 bp, Homo sapiens
tcaggtttggggt

SEQ ID NO: 3799100 - DNA, 13 bp, Homo sapiens
tcagtaagccgtg

SEQ ID NO: 3799101 - DNA, 14 bp, Homo sapiens
tcagtaatttgagg

SEQ ID NO: 3799102 - DNA, 15 bp, Homo sapiens
tcagtaatttgagga

SEQ ID NO: 3799103 - DNA, 13 bp, Homo sapiens
tcagtagtcagac

SEQ ID NO: 3799104 - DNA, 13 bp, Homo sapiens
tcagtatcaggcc

SEQ ID NO: 3799105 - DNA, 22 bp, Homo sapiens
tcagtattaaaggggggagggg

SEQ ID NO: 3799106 - DNA, 23 bp, Homo sapiens
tcagtctgattaaaggtggtgcc

SEQ ID NO: 3799107 - DNA, 19 bp, Homo sapiens
tcagtctgattcccaagct

SEQ ID NO: 3799108 - DNA, 22 bp, Homo sapiens
tcagtctgattcccaagctctg

SEQ ID NO: 3799109 - DNA, 17 bp, Homo sapiens
tcagtctgcacttaaat

SEQ ID NO: 3799110 - DNA, 15 bp, Homo sapiens
tcagtgcagcccgtg

SEQ ID NO: 3799111 - DNA, 9 bp, Homo sapiens
tcagtgccc

SEQ ID NO: 3799112 - DNA, 22 bp, Homo sapiens
tcagtgcccaccaacatcccat

SEQ ID NO: 3799113 - DNA, 19 bp, Homo sapiens
tcagtgctgtggcctgggc

SEQ ID NO: 3799114 - DNA, 21 bp, Homo sapiens
tcagtggactttccaccccct

SEQ ID NO: 3799115 - DNA, 12 bp, Homo sapiens
tcagtggcagct

SEQ ID NO: 3799116 - DNA, 23 bp, Homo sapiens
tcagtgggaacgtgactgcccca

SEQ ID NO: 3799117 - DNA, 11 bp, Homo sapiens
tcagtgtacat

SEQ ID NO: 3799118 - DNA, 20 bp, Homo sapiens
tcagtgtacatggaataaca

SEQ ID NO: 3799119 - DNA, 20 bp, Homo sapiens
tcagtgttccctttcctact

SEQ ID NO: 3799120 - DNA, 16 bp, Homo sapiens
tcagttaagaaaaaaa

SEQ ID NO: 3799121 - DNA, 19 bp, Homo sapiens
tcagttaagaaaaaaataa

SEQ ID NO: 3799122 - DNA, 14 bp, Homo sapiens
tcagttactcagcc

SEQ ID NO: 3799123 - DNA, 19 bp, Homo sapiens
tcagttactcagccctggg

SEQ ID NO: 3799124 - DNA, 16 bp, Homo sapiens
tcagttcccttggcct

SEQ ID NO: 3799125 - DNA, 18 bp, Homo sapiens
tcagttcccttggcctca

SEQ ID NO: 3799126 - DNA, 19 bp, Homo sapiens
tcagttcccttggcctcag

SEQ ID NO: 3799127 - DNA, 20 bp, Homo sapiens
tcagttcctgcagcagagcc

SEQ ID NO: 3799128 - DNA, 14 bp, Homo sapiens
tcagttggctgact

SEQ ID NO: 3799129 - DNA, 17 bp, Homo sapiens
tcagttttatcattttc

SEQ ID NO: 3799130 - DNA, 14 bp, Homo sapiens
tcataaactgtgtg

SEQ ID NO: 3799131 - DNA, 17 bp, Homo sapiens
tcataacagtgccattg

SEQ ID NO: 3799132 - DNA, 14 bp, Homo sapiens
tcataacctagcct

SEQ ID NO: 3799133 - DNA, 13 bp, Homo sapiens
tcatacacagaaa

SEQ ID NO: 3799134 - DNA, 16 bp, Homo sapiens
tcatagatttctgatt

SEQ ID NO: 3799135 - DNA, 14 bp, Homo sapiens
tcatagcattaact

SEQ ID NO: 3799136 - DNA, 15 bp, Homo sapiens
tcatagtatggtggc

SEQ ID NO: 3799137 - DNA, 18 bp, Homo sapiens
tcatagtatggtggctgg

SEQ ID NO: 3799138 - DNA, 21 bp, Homo sapiens
tcatagtatggtggctgggtt

SEQ ID NO: 3799139 - DNA, 16 bp, Homo sapiens
tcatataccagcaata

SEQ ID NO: 3799140 - DNA, 22 bp, Homo sapiens
tcatatgtaccatgtacatgaa

SEQ ID NO: 3799141 - DNA, 17 bp, Homo sapiens
tcatattcctgcagcct

SEQ ID NO: 3799142 - DNA, 16 bp, Homo sapiens
tcatatttacttctta

SEQ ID NO: 3799143 - DNA, 21 bp, Homo sapiens
tcatatttacttcttatacat

SEQ ID NO: 3799144 - DNA, 17 bp, Homo sapiens
tcatcaaccctaaaaag

SEQ ID NO: 3799145 - DNA, 19 bp, Homo sapiens
tcatcagtgttaaaaaatt

SEQ ID NO: 3799146 - DNA, 14 bp, Homo sapiens
tcatcataaaataa

SEQ ID NO: 3799147 - DNA, 14 bp, Homo sapiens
tcatcattccttga

SEQ ID NO: 3799148 - DNA, 15 bp, Homo sapiens
tcatccaatcctcac

SEQ ID NO: 3799149 - DNA, 18 bp, Homo sapiens
tcatccaatcctcactgg

SEQ ID NO: 3799150 - DNA, 20 bp, Homo sapiens
tcatccaatcctcactgggt

SEQ ID NO: 3799151 - DNA, 14 bp, Homo sapiens
tcatccactgtgcc

SEQ ID NO: 3799152 - DNA, 12 bp, Homo sapiens
tcatcccactcc

SEQ ID NO: 3799153 - DNA, 14 bp, Homo sapiens
tcatcccattgtct

SEQ ID NO: 3799154 - DNA, 15 bp, Homo sapiens
tcatcccattgtctt

SEQ ID NO: 3799155 - DNA, 20 bp, Homo sapiens
tcatccccaggggtcccagc

SEQ ID NO: 3799156 - DNA, 15 bp, Homo sapiens
tcatccgaggcaggg

SEQ ID NO: 3799157 - DNA, 15 bp, Homo sapiens
tcatcctaagctatt

SEQ ID NO: 3799158 - DNA, 20 bp, Homo sapiens
tcatctaccattttctggtt

SEQ ID NO: 3799159 - DNA, 18 bp, Homo sapiens
tcatctaccttttctctt

SEQ ID NO: 3799160 - DNA, 16 bp, Homo sapiens
tcatctctctttaata

SEQ ID NO: 3799161 - DNA, 13 bp, Homo sapiens
tcatctgtagata

SEQ ID NO: 3799162 - DNA, 17 bp, Homo sapiens
tcatctgtagatactag

SEQ ID NO: 3799163 - DNA, 16 bp, Homo sapiens
tcatcttgaccaagca

SEQ ID NO: 3799164 - DNA, 19 bp, Homo sapiens
tcatcttgaccaagcagga

SEQ ID NO: 3799165 - DNA, 23 bp, Homo sapiens
tcatcttgaccaagcaggaagct

SEQ ID NO: 3799166 - DNA, 16 bp, Homo sapiens
tcatgaaaatcctacc

SEQ ID NO: 3799167 - DNA, 15 bp, Homo sapiens
tcatgaaatatgcat

SEQ ID NO: 3799168 - DNA, 13 bp, Homo sapiens
tcatgaagcccaa

SEQ ID NO: 3799169 - DNA, 16 bp, Homo sapiens
tcatgagctgagcagg

SEQ ID NO: 3799170 - DNA, 16 bp, Homo sapiens
tcatgattagcaagtt

SEQ ID NO: 3799171 - DNA, 11 bp, Homo sapiens
tcatgattttt

SEQ ID NO: 3799172 - DNA, 20 bp, Homo sapiens
tcatgcaaatgctgtattct

SEQ ID NO: 3799173 - DNA, 13 bp, Homo sapiens
tcatggaaatatt

SEQ ID NO: 3799174 - DNA, 19 bp, Homo sapiens
tcatggaaatattatgcaa

SEQ ID NO: 3799175 - DNA, 23 bp, Homo sapiens
tcatggctaagcttaaaaaaaac

SEQ ID NO: 3799176 - DNA, 15 bp, Homo sapiens
tcatggctcactgca

SEQ ID NO: 3799177 - DNA, 18 bp, Homo sapiens
tccctgccagcaccccca

SEQ ID NO: 3799178 - DNA, 23 bp, Homo sapiens
tccctgcccagaattcccagctg

SEQ ID NO: 3799179 - DNA, 19 bp, Homo sapiens
tccctggaccagatgctga

SEQ ID NO: 3799180 - DNA, 21 bp, Homo sapiens
tccctggagcctccactgcct

SEQ ID NO: 3799181 - DNA, 19 bp, Homo sapiens
tccctggctctcagaaggt

SEQ ID NO: 3799182 - DNA, 11 bp, Homo sapiens
tccctggcttg

SEQ ID NO: 3799183 - DNA, 22 bp, Homo sapiens
tccctggcttgtaactccacca

SEQ ID NO: 3799184 - DNA, 19 bp, Homo sapiens
tccctgggaggaaatttga

SEQ ID NO: 3799185 - DNA, 21 bp, Homo sapiens
tccctgggggaagccctggat

SEQ ID NO: 3799186 - DNA, 21 bp, Homo sapiens
tccctggtaataagtactgtg

SEQ ID NO: 3799187 - DNA, 12 bp, Homo sapiens
tccctgtccacc

SEQ ID NO: 3799188 - DNA, 22 bp, Homo sapiens
tccctgtttcttccacagtgcc

SEQ ID NO: 3799189 - DNA, 21 bp, Homo sapiens
tcccttcaaccattccccatg

SEQ ID NO: 3799190 - DNA, 16 bp, Homo sapiens
tcccttcccataagct

SEQ ID NO: 3799191 - DNA, 17 bp, Homo sapiens
tcccttcccccataagc

SEQ ID NO: 3799192 - DNA, 21 bp, Homo sapiens
tcccttcccctccctggctcc

SEQ ID NO: 3799193 - DNA, 17 bp, Homo sapiens
tcccttctactgcttct

SEQ ID NO: 3799194 - DNA, 21 bp, Homo sapiens
tcccttctccttgataacagc

SEQ ID NO: 3799195 - DNA, 17 bp, Homo sapiens
tcccttgagacctcagc

SEQ ID NO: 3799196 - DNA, 18 bp, Homo sapiens
tcccttgagacctcagcc

SEQ ID NO: 3799197 - DNA, 19 bp, Homo sapiens
tcccttgagacctcagcca

SEQ ID NO: 3799198 - DNA, 12 bp, Homo sapiens
tcccttggcctc

SEQ ID NO: 3799199 - DNA, 16 bp, Homo sapiens
tcccttggcctcagaa

SEQ ID NO: 3799200 - DNA, 16 bp, Homo sapiens
tcccttgtgcgtgggt

SEQ ID NO: 3799201 - DNA, 13 bp, Homo sapiens
tcccttgtgtgtg

SEQ ID NO: 3799202 - DNA, 22 bp, Homo sapiens
tccctttccaaatgcccagctt

SEQ ID NO: 3799203 - DNA, 17 bp, Homo sapiens
tccctttccttccatcc

SEQ ID NO: 3799204 - DNA, 13 bp, Homo sapiens
tccctttcttggc

SEQ ID NO: 3799205 - DNA, 17 bp, Homo sapiens
tccctttcttggccagt

SEQ ID NO: 3799206 - DNA, 13 bp, Homo sapiens
tccctttgctcca

SEQ ID NO: 3799207 - DNA, 16 bp, Homo sapiens
tccctttgctccaccc

SEQ ID NO: 3799208 - DNA, 19 bp, Homo sapiens
tccctttgctccaccccac

SEQ ID NO: 3799209 - DNA, 22 bp, Homo sapiens
tccgaaagggacttggaagctc

SEQ ID NO: 3799210 - DNA, 21 bp, Homo sapiens
tccgaagtatgagggaaaatg

SEQ ID NO: 3799211 - DNA, 12 bp, Homo sapiens
tccgagaactaa

SEQ ID NO: 3799212 - DNA, 12 bp, Homo sapiens
tccgaggcaggg

SEQ ID NO: 3799213 - DNA, 16 bp, Homo sapiens
tccgctttctacccag

SEQ ID NO: 3799214 - DNA, 18 bp, Homo sapiens
tccgctttctacccagcg

SEQ ID NO: 3799215 - DNA, 18 bp, Homo sapiens
tccggaatcctgtcctca

SEQ ID NO: 3799216 - DNA, 21 bp, Homo sapiens
tccggaggagaagaaggaaat

SEQ ID NO: 3799217 - DNA, 18 bp, Homo sapiens
tccggtggaaggccttct

SEQ ID NO: 3799218 - DNA, 12 bp, Homo sapiens
tccggtgtgcct

SEQ ID NO: 3799219 - DNA, 17 bp, Homo sapiens
tccggtgtgcctgcagc

SEQ ID NO: 3799220 - DNA, 18 bp, Homo sapiens
tccggtgtgcctgcagcc

SEQ ID NO: 3799221 - DNA, 19 bp, Homo sapiens
tccggtgtgcctgcagccc

SEQ ID NO: 3799222 - DNA, 15 bp, Homo sapiens
tccgtagttccctga

SEQ ID NO: 3799223 - DNA, 14 bp, Homo sapiens
tccgtatttcagac

SEQ ID NO: 3799224 - DNA, 22 bp, Homo sapiens
tccgtctaagtcatgagctgag

SEQ ID NO: 3799225 - DNA, 14 bp, Homo sapiens
tcctaacaggatga

SEQ ID NO: 3799226 - DNA, 22 bp, Homo sapiens
tcctaatgaatgcataaaatgt

SEQ ID NO: 3799227 - DNA, 14 bp, Homo sapiens
tcctacaaagatgt

SEQ ID NO: 3799228 - DNA, 15 bp, Homo sapiens
tcctacaaagatgtt

SEQ ID NO: 3799229 - DNA, 18 bp, Homo sapiens
tcctacccaccctccttt

SEQ ID NO: 3799230 - DNA, 16 bp, Homo sapiens
tcctacctcagcctag

SEQ ID NO: 3799231 - DNA, 15 bp, Homo sapiens
tcctactctgtgtca

SEQ ID NO: 3799232 - DNA, 16 bp, Homo sapiens
tcctagataaaaagat

SEQ ID NO: 3799233 - DNA, 13 bp, Homo sapiens
tcctagccactca

SEQ ID NO: 3799234 - DNA, 17 bp, Homo sapiens
tcctagccactcaggag

SEQ ID NO: 3799235 - DNA, 12 bp, Homo sapiens
tcctagctgtgt

SEQ ID NO: 3799236 - DNA, 15 bp, Homo sapiens
tcctagctgtgtgca

SEQ ID NO: 3799237 - DNA, 18 bp, Homo sapiens
tcctaggagtatcctcat

SEQ ID NO: 3799238 - DNA, 14 bp, Homo sapiens
tcctaggcatttgc

SEQ ID NO: 3799239 - DNA, 13 bp, Homo sapiens
tcctaggccacac

SEQ ID NO: 3799240 - DNA, 20 bp, Homo sapiens
tcctaggctccaccccatcc

SEQ ID NO: 3799241 - DNA, 22 bp, Homo sapiens
tcctaggctccaccccatccag

SEQ ID NO: 3799242 - DNA, 16 bp, Homo sapiens
tcctagttcttcatcc

SEQ ID NO: 3799243 - DNA, 20 bp, Homo sapiens
tcctataattccctatcttt

SEQ ID NO: 3799244 - DNA, 21 bp, Homo sapiens
tcctatattgttttcagtgta

SEQ ID NO: 3799245 - DNA, 14 bp, Homo sapiens
tcctatcacctccc

SEQ ID NO: 3799246 - DNA, 16 bp, Homo sapiens
tcctatcacctcccct

SEQ ID NO: 3799247 - DNA, 16 bp, Homo sapiens
tcctatcccatcccat

SEQ ID NO: 3799248 - DNA, 22 bp, Homo sapiens
tcctatcttcatatctatcaga

SEQ ID NO: 3799249 - DNA, 15 bp, Homo sapiens
tcctatttcttatag

SEQ ID NO: 3799250 - DNA, 20 bp, Homo sapiens
tcctcacatctttcacactt

SEQ ID NO: 3799251 - DNA, 20 bp, Homo sapiens
tcctcacccccagctttgct

SEQ ID NO: 3799252 - DNA, 20 bp, Homo sapiens
tcctcaccccgtctggggtt

SEQ ID NO: 3799253 - DNA, 20 bp, Homo sapiens
tcctcacctctggactggct

SEQ ID NO: 3799254 - DNA, 13 bp, Homo sapiens
tcctcactcccag

SEQ ID NO: 3799255 - DNA, 17 bp, Homo sapiens
tcctcactcccagtcca

SEQ ID NO: 3799256 - DNA, 17 bp, Homo sapiens
tcctcactcccttccca

SEQ ID NO: 3799257 - DNA, 21 bp, Homo sapiens
tcctcactcccttcccataag

SEQ ID NO: 3799258 - DNA, 13 bp, Homo sapiens
tcctcactgggtg

SEQ ID NO: 3799259 - DNA, 20 bp, Homo sapiens
tcctcagagaatttctacca

SEQ ID NO: 3799260 - DNA, 18 bp, Homo sapiens
tcctcagggacagagaca

SEQ ID NO: 3799261 - DNA, 18 bp, Homo sapiens
tcctcagttcctgcagca

SEQ ID NO: 3799262 - DNA, 22 bp, Homo sapiens
tcctcatagtatggtggctggg

SEQ ID NO: 3799263 - DNA, 14 bp, Homo sapiens
tcctcattcctgaa

SEQ ID NO: 3799264 - DNA, 19 bp, Homo sapiens
tcctcattgtaaacaaact

SEQ ID NO: 3799265 - DNA, 19 bp, Homo sapiens
tcctcatttggggtagcta

SEQ ID NO: 3799266 - DNA, 23 bp, Homo sapiens
tcctccaaaggaagtctaggagc

SEQ ID NO: 3799267 - DNA, 19 bp, Homo sapiens
tcctccagaagcctctggc

SEQ ID NO: 3799268 - DNA, 20 bp, Homo sapiens
tcctccagaagcctctggct

SEQ ID NO: 3799269 - DNA, 21 bp, Homo sapiens
tcctccagaagcctctggcta

SEQ ID NO: 3799270 - DNA, 22 bp, Homo sapiens
tcctccagaagcctctggctag

SEQ ID NO: 3799271 - DNA, 21 bp, Homo sapiens
tcctccagggatgatcaacag

SEQ ID NO: 3799272 - DNA, 23 bp, Homo sapiens
tcctccagggccacgtgccaggc

SEQ ID NO: 3799273 - DNA, 14 bp, Homo sapiens
tcctcccacctcag

SEQ ID NO: 3799274 - DNA, 13 bp, Homo sapiens
tcctcccaggcgc

SEQ ID NO: 3799275 - DNA, 19 bp, Homo sapiens
tcctcccaggcgccccttc

SEQ ID NO: 3799276 - DNA, 14 bp, Homo sapiens
tcctccccctgcca

SEQ ID NO: 3799277 - DNA, 17 bp, Homo sapiens
tcctccccctgccagtg

SEQ ID NO: 3799278 - DNA, 15 bp, Homo sapiens
tcctccctcagtgcc

SEQ ID NO: 3799279 - DNA, 11 bp, Homo sapiens
tcctccctccc

SEQ ID NO: 3799280 - DNA, 22 bp, Homo sapiens
tcctcctgagtgatcccatttc

SEQ ID NO: 3799281 - DNA, 23 bp, Homo sapiens
tcctcctgagtgatcccatttct

SEQ ID NO: 3799282 - DNA, 21 bp, Homo sapiens
tcctctaacaggggctggtgg

SEQ ID NO: 3799283 - DNA, 22 bp, Homo sapiens
tcctctaacaggggctggtggg

SEQ ID NO: 3799284 - DNA, 18 bp, Homo sapiens
tcctctacttaatgagat

SEQ ID NO: 3799285 - DNA, 20 bp, Homo sapiens
tcctctcatccttttctcct

SEQ ID NO: 3799286 - DNA, 14 bp, Homo sapiens
tcctctccactgcc

SEQ ID NO: 3799287 - DNA, 18 bp, Homo sapiens
tcctctccactgccttcg

SEQ ID NO: 3799288 - DNA, 12 bp, Homo sapiens
tcctctccccag

SEQ ID NO: 3799289 - DNA, 15 bp, Homo sapiens
tcctctccccagcaa

SEQ ID NO: 3799290 - DNA, 23 bp, Homo sapiens
tgagagtatttaggcagattgaa

SEQ ID NO: 3799291 - DNA, 22 bp, Homo sapiens
tgagagtgtcttcacggcagga

SEQ ID NO: 3799292 - DNA, 16 bp, Homo sapiens
tgagatagaagatgtt

SEQ ID NO: 3799293 - DNA, 23 bp, Homo sapiens
tgagatagtagcatacatttata

SEQ ID NO: 3799294 - DNA, 15 bp, Homo sapiens
tgagatcaaaacggt

SEQ ID NO: 3799295 - DNA, 20 bp, Homo sapiens
tgagatctaagcctttccat

SEQ ID NO: 3799296 - DNA, 21 bp, Homo sapiens
tgagatctaagcctttccata

SEQ ID NO: 3799297 - DNA, 16 bp, Homo sapiens
tgagcaaacctgcccc

SEQ ID NO: 3799298 - DNA, 21 bp, Homo sapiens
tgagcaaacctgccccatccc

SEQ ID NO: 3799299 - DNA, 16 bp, Homo sapiens
tgagcaccaggggatg

SEQ ID NO: 3799300 - DNA, 14 bp, Homo sapiens
tgagcacctcccag

SEQ ID NO: 3799301 - DNA, 20 bp, Homo sapiens
tgagcactaaggtgtgctct

SEQ ID NO: 3799302 - DNA, 23 bp, Homo sapiens
tgagcactaaggtgtgctctgat

SEQ ID NO: 3799303 - DNA, 21 bp, Homo sapiens
tgagcagactggtgagcagac

SEQ ID NO: 3799304 - DNA, 23 bp, Homo sapiens
tgagcagactggtgagcagactg

SEQ ID NO: 3799305 - DNA, 18 bp, Homo sapiens
tgagcagtgtgtctcctg

SEQ ID NO: 3799306 - DNA, 16 bp, Homo sapiens
tgagcatgttactgac

SEQ ID NO: 3799307 - DNA, 12 bp, Homo sapiens
tgagccactgca

SEQ ID NO: 3799308 - DNA, 18 bp, Homo sapiens
tgagccactgcaccgggc

SEQ ID NO: 3799309 - DNA, 21 bp, Homo sapiens
tgagccactgcaccgggccac

SEQ ID NO: 3799310 - DNA, 20 bp, Homo sapiens
tgagccagacaaatggagga

SEQ ID NO: 3799311 - DNA, 14 bp, Homo sapiens
tgagcccctgggac

SEQ ID NO: 3799312 - DNA, 15 bp, Homo sapiens
tgagcccctgggact

SEQ ID NO: 3799313 - DNA, 23 bp, Homo sapiens
tgagccgcatcttctccatctgg

SEQ ID NO: 3799314 - DNA, 18 bp, Homo sapiens
tgagcctcagcatcctgg

SEQ ID NO: 3799315 - DNA, 21 bp, Homo sapiens
tgagcctcagcatcctggcac

SEQ ID NO: 3799316 - DNA, 22 bp, Homo sapiens
tgagcctcagcatcctggcacc

SEQ ID NO: 3799317 - DNA, 14 bp, Homo sapiens
tgagcctgagcaga

SEQ ID NO: 3799318 - DNA, 14 bp, Homo sapiens
tgagcctgggaggt

SEQ ID NO: 3799319 - DNA, 13 bp, Homo sapiens
tgagccttcagtc

SEQ ID NO: 3799320 - DNA, 14 bp, Homo sapiens
tgagccttcagtct

SEQ ID NO: 3799321 - DNA, 13 bp, Homo sapiens
tgagctccagacc

SEQ ID NO: 3799322 - DNA, 17 bp, Homo sapiens
tgagctccagaccccca

SEQ ID NO: 3799323 - DNA, 20 bp, Homo sapiens
tgagctccagacccccagca

SEQ ID NO: 3799324 - DNA, 21 bp, Homo sapiens
tgagctccagacccccagcaa

SEQ ID NO: 3799325 - DNA, 21 bp, Homo sapiens
tgagctccccaaaaacctcac

SEQ ID NO: 3799326 - DNA, 22 bp, Homo sapiens
tgagctccccaccaccccagct

SEQ ID NO: 3799327 - DNA, 16 bp, Homo sapiens
tgagctcctctgggca

SEQ ID NO: 3799328 - DNA, 21 bp, Homo sapiens
tgagctcggtggacccaggga

SEQ ID NO: 3799329 - DNA, 19 bp, Homo sapiens
tgagctgagatcgtgccgt

SEQ ID NO: 3799330 - DNA, 20 bp, Homo sapiens
tgagctgcctgtaacttgag

SEQ ID NO: 3799331 - DNA, 15 bp, Homo sapiens
tgagctgtgttcttg

SEQ ID NO: 3799332 - DNA, 23 bp, Homo sapiens
tgagcttaagaattttgagcagg

SEQ ID NO: 3799333 - DNA, 19 bp, Homo sapiens
tgagcttggccagaagggg

SEQ ID NO: 3799334 - DNA, 21 bp, Homo sapiens
tgagcttggccagaagggggc

SEQ ID NO: 3799335 - DNA, 22 bp, Homo sapiens
tgagctttatgtaataatgtga

SEQ ID NO: 3799336 - DNA, 15 bp, Homo sapiens
tgagctttggacaca

SEQ ID NO: 3799337 - DNA, 21 bp, Homo sapiens
tgagctttggacacacacagc

SEQ ID NO: 3799338 - DNA, 22 bp, Homo sapiens
tgagctttggacacacacagct

SEQ ID NO: 3799339 - DNA, 22 bp, Homo sapiens
tgagctttggacgcacacagct

SEQ ID NO: 3799340 - DNA, 20 bp, Homo sapiens
tgaggaagctccagtcctgc

SEQ ID NO: 3799341 - DNA, 16 bp, Homo sapiens
tgaggaatgatgaagc

SEQ ID NO: 3799342 - DNA, 14 bp, Homo sapiens
tgaggaattttctt

SEQ ID NO: 3799343 - DNA, 12 bp, Homo sapiens
tgaggagctgct

SEQ ID NO: 3799344 - DNA, 14 bp, Homo sapiens
tgaggagctgctgg

SEQ ID NO: 3799345 - DNA, 23 bp, Homo sapiens
tgaggaggcagaaagcagaggct

SEQ ID NO: 3799346 - DNA, 21 bp, Homo sapiens
tgaggagtttcctaaaagttc

SEQ ID NO: 3799347 - DNA, 18 bp, Homo sapiens
tgaggatgcagagtcagc

SEQ ID NO: 3799348 - DNA, 12 bp, Homo sapiens
tgaggatgggaa

SEQ ID NO: 3799349 - DNA, 14 bp, Homo sapiens
tgaggcaagagaat

SEQ ID NO: 3799350 - DNA, 17 bp, Homo sapiens
tgaggcacatgtcagca

SEQ ID NO: 3799351 - DNA, 13 bp, Homo sapiens
tgaggcagaagaa

SEQ ID NO: 3799352 - DNA, 13 bp, Homo sapiens
tgaggcagacagc

SEQ ID NO: 3799353 - DNA, 15 bp, Homo sapiens
tgaggcagacagcag

SEQ ID NO: 3799354 - DNA, 16 bp, Homo sapiens
tgaggcagacagcagc

SEQ ID NO: 3799355 - DNA, 20 bp, Homo sapiens
tgaggcagacagcagctcag

SEQ ID NO: 3799356 - DNA, 24 bp, Homo sapiens
tgaggcagacagcagctcaggcac

SEQ ID NO: 3799357 - DNA, 12 bp, Homo sapiens
tgaggcaggaga

SEQ ID NO: 3799358 - DNA, 13 bp, Homo sapiens
tgaggcagggaag

SEQ ID NO: 3799359 - DNA, 18 bp, Homo sapiens
tgaggcaggtgacagtga

SEQ ID NO: 3799360 - DNA, 20 bp, Homo sapiens
tgaggcaggtgacagtgagg

SEQ ID NO: 3799361 - DNA, 22 bp, Homo sapiens
tgaggcatttgggtggtaagag

SEQ ID NO: 3799362 - DNA, 12 bp, Homo sapiens
tgaggccaggag

SEQ ID NO: 3799363 - DNA, 13 bp, Homo sapiens
tgaggccaggagt

SEQ ID NO: 3799364 - DNA, 13 bp, Homo sapiens
tgaggcccaggga

SEQ ID NO: 3799365 - DNA, 17 bp, Homo sapiens
tgaggcccagggagagg

SEQ ID NO: 3799366 - DNA, 15 bp, Homo sapiens
tgaggcctcagtgga

SEQ ID NO: 3799367 - DNA, 13 bp, Homo sapiens
tgaggctgagact

SEQ ID NO: 3799368 - DNA, 13 bp, Homo sapiens
tgaggctgcagcg

SEQ ID NO: 3799369 - DNA, 21 bp, Homo sapiens
tgaggctggactccagatctg

SEQ ID NO: 3799370 - DNA, 13 bp, Homo sapiens
tgagggaccagcc

SEQ ID NO: 3799371 - DNA, 17 bp, Homo sapiens
tgagggatcacagggcc

SEQ ID NO: 3799372 - DNA, 18 bp, Homo sapiens
tgagggatcacagggccc

SEQ ID NO: 3799373 - DNA, 21 bp, Homo sapiens
tgaggggaggatcactggagc

SEQ ID NO: 3799374 - DNA, 14 bp, Homo sapiens
tgaggggctcctgg

SEQ ID NO: 3799375 - DNA, 21 bp, Homo sapiens
tgagggtgcttgttccctctc

SEQ ID NO: 3799376 - DNA, 16 bp, Homo sapiens
tgaggtcaggagttcc

SEQ ID NO: 3799377 - DNA, 18 bp, Homo sapiens
tgaggtcatagcagtgct

SEQ ID NO: 3799378 - DNA, 15 bp, Homo sapiens
tgaggtcctgggggc

SEQ ID NO: 3799379 - DNA, 17 bp, Homo sapiens
tgaggtcttttgacatg

SEQ ID NO: 3799380 - DNA, 22 bp, Homo sapiens
tgaggtcttttgacatgtggaa

SEQ ID NO: 3799381 - DNA, 16 bp, Homo sapiens
tgaggtgaaagggagc

SEQ ID NO: 3799382 - DNA, 18 bp, Homo sapiens
tgaggtgaaagggagcta

SEQ ID NO: 3799383 - DNA, 15 bp, Homo sapiens
tgaggtgctatgttc

SEQ ID NO: 3799384 - DNA, 16 bp, Homo sapiens
tgaggtgctatgttct

SEQ ID NO: 3799385 - DNA, 15 bp, Homo sapiens
tgaggtgctgggagg

SEQ ID NO: 3799386 - DNA, 15 bp, Homo sapiens
tgaggtggaagccct

SEQ ID NO: 3799387 - DNA, 17 bp, Homo sapiens
tgaggtggaagccctcc

SEQ ID NO: 3799388 - DNA, 21 bp, Homo sapiens
tgaggtggaagccctccttcc

SEQ ID NO: 3799389 - DNA, 12 bp, Homo sapiens
tgaggtgggagg

SEQ ID NO: 3799390 - DNA, 21 bp, Homo sapiens
tgaggtgggaggatctcttga

SEQ ID NO: 3799391 - DNA, 20 bp, Homo sapiens
tgaggtgggcagatcacgag

SEQ ID NO: 3799392 - DNA, 21 bp, Homo sapiens
tgaggtgggttttcttcccat

SEQ ID NO: 3799393 - DNA, 20 bp, Homo sapiens
tgaggtggtctgaatgttct

SEQ ID NO: 3799394 - DNA, 21 bp, Homo sapiens
tgaggtggtctgaatgttctg

SEQ ID NO: 3799395 - DNA, 20 bp, Homo sapiens
tgagtaaaaagtttctaaag

SEQ ID NO: 3799396 - DNA, 18 bp, Homo sapiens
tgagtaagagctggtgtc

SEQ ID NO: 3799397 - DNA, 20 bp, Homo sapiens
tgagtagagagcaagggaag

SEQ ID NO: 3799398 - DNA, 20 bp, Homo sapiens
tgagtcatgatctccctgcc

SEQ ID NO: 3799399 - DNA, 14 bp, Homo sapiens
tgagtcccttccag

SEQ ID NO: 3799400 - DNA, 14 bp, Homo sapiens
tgagtcgaggacag

SEQ ID NO: 3799401 - DNA, 15 bp, Homo sapiens
tgagtctcttcagaa

SEQ ID NO: 3799402 - DNA, 20 bp, Homo sapiens
tgccagtgtctttctttggt

SEQ ID NO: 3799403 - DNA, 18 bp, Homo sapiens
tgccatctgtgggcacgc

SEQ ID NO: 3799404 - DNA, 17 bp, Homo sapiens
tgccatggaggcacaca

SEQ ID NO: 3799405 - DNA, 18 bp, Homo sapiens
tgccatggaggcacacag

SEQ ID NO: 3799406 - DNA, 23 bp, Homo sapiens
tgccatggaggcacacagctgca

SEQ ID NO: 3799407 - DNA, 17 bp, Homo sapiens
tgccatgtgtgctgaac

SEQ ID NO: 3799408 - DNA, 15 bp, Homo sapiens
tgccatgttggccag

SEQ ID NO: 3799409 - DNA, 21 bp, Homo sapiens
tgccatgttggccaggctggt

SEQ ID NO: 3799410 - DNA, 16 bp, Homo sapiens
tgccattgtctttata

SEQ ID NO: 3799411 - DNA, 17 bp, Homo sapiens
tgccattgtctttatat

SEQ ID NO: 3799412 - DNA, 18 bp, Homo sapiens
tgccattgtctttatatg

SEQ ID NO: 3799413 - DNA, 15 bp, Homo sapiens
tgcccaacctcagca

SEQ ID NO: 3799414 - DNA, 17 bp, Homo sapiens
tgcccaacctcagcaac

SEQ ID NO: 3799415 - DNA, 18 bp, Homo sapiens
tgcccaacctcagcaacc

SEQ ID NO: 3799416 - DNA, 23 bp, Homo sapiens
tgcccaacctgctctcctcttgc

SEQ ID NO: 3799417 - DNA, 16 bp, Homo sapiens
tgcccaagccctgaga

SEQ ID NO: 3799418 - DNA, 18 bp, Homo sapiens
tgcccaagccctgagagt

SEQ ID NO: 3799419 - DNA, 16 bp, Homo sapiens
tgcccacacaccccaa

SEQ ID NO: 3799420 - DNA, 21 bp, Homo sapiens
tgcccacagcccgcatgcagc

SEQ ID NO: 3799421 - DNA, 14 bp, Homo sapiens
tgcccacaggatca

SEQ ID NO: 3799422 - DNA, 19 bp, Homo sapiens
tgcccacatgtgtccatcc

SEQ ID NO: 3799423 - DNA, 19 bp, Homo sapiens
tgcccacccgtggagatgg

SEQ ID NO: 3799424 - DNA, 22 bp, Homo sapiens
tgcccaccctctggagaaggtg

SEQ ID NO: 3799425 - DNA, 14 bp, Homo sapiens
tgcccacctgccca

SEQ ID NO: 3799426 - DNA, 15 bp, Homo sapiens
tgcccacctgcccat

SEQ ID NO: 3799427 - DNA, 17 bp, Homo sapiens
tgcccacctgcccatca

SEQ ID NO: 3799428 - DNA, 21 bp, Homo sapiens
tgcccagaattcccagctgtc

SEQ ID NO: 3799429 - DNA, 22 bp, Homo sapiens
tgcccagacatttttttccctt

SEQ ID NO: 3799430 - DNA, 15 bp, Homo sapiens
tgcccagaccacacg

SEQ ID NO: 3799431 - DNA, 18 bp, Homo sapiens
tgcccagacccctctggc

SEQ ID NO: 3799432 - DNA, 22 bp, Homo sapiens
tgcccagacccctctggccagg

SEQ ID NO: 3799433 - DNA, 16 bp, Homo sapiens
tgcccagagatgcctc

SEQ ID NO: 3799434 - DNA, 17 bp, Homo sapiens
tgcccagagatgcctcc

SEQ ID NO: 3799435 - DNA, 18 bp, Homo sapiens
tgcccagagatgcctcca

SEQ ID NO: 3799436 - DNA, 20 bp, Homo sapiens
tgcccagagatgcctccacc

SEQ ID NO: 3799437 - DNA, 12 bp, Homo sapiens
tgcccagagctg

SEQ ID NO: 3799438 - DNA, 13 bp, Homo sapiens
tgcccagagctgg

SEQ ID NO: 3799439 - DNA, 14 bp, Homo sapiens
tgcccagagctggg

SEQ ID NO: 3799440 - DNA, 15 bp, Homo sapiens
tgcccagagctgggt

SEQ ID NO: 3799441 - DNA, 19 bp, Homo sapiens
tgcccagagggcccaggca

SEQ ID NO: 3799442 - DNA, 20 bp, Homo sapiens
tgcccagagggcccaggcag

SEQ ID NO: 3799443 - DNA, 15 bp, Homo sapiens
tgcccagctcagtct

SEQ ID NO: 3799444 - DNA, 18 bp, Homo sapiens
tgcccaggagagccagcc

SEQ ID NO: 3799445 - DNA, 19 bp, Homo sapiens
tgcccaggagagccagccc

SEQ ID NO: 3799446 - DNA, 20 bp, Homo sapiens
tgcccaggagagccagccct

SEQ ID NO: 3799447 - DNA, 22 bp, Homo sapiens
tgcccaggagagccagccctcc

SEQ ID NO: 3799448 - DNA, 14 bp, Homo sapiens
tgcccaggcaggtc

SEQ ID NO: 3799449 - DNA, 15 bp, Homo sapiens
tgcccaggcaggtct

SEQ ID NO: 3799450 - DNA, 17 bp, Homo sapiens
tgcccaggcaggtcttg

SEQ ID NO: 3799451 - DNA, 17 bp, Homo sapiens
tgcccaggcccctgcca

SEQ ID NO: 3799452 - DNA, 20 bp, Homo sapiens
tgcccaggcccctgccaccc

SEQ ID NO: 3799453 - DNA, 22 bp, Homo sapiens
tgcccaggcccctgccaccctg

SEQ ID NO: 3799454 - DNA, 15 bp, Homo sapiens
tgcccaggcctgcct

SEQ ID NO: 3799455 - DNA, 11 bp, Homo sapiens
tgcccaggctg

SEQ ID NO: 3799456 - DNA, 18 bp, Homo sapiens
tgcccaggctggcgtgca

SEQ ID NO: 3799457 - DNA, 19 bp, Homo sapiens
tgcccaggctggcgtgcag

SEQ ID NO: 3799458 - DNA, 23 bp, Homo sapiens
tgcccaggctggcgtgcagtggt

SEQ ID NO: 3799459 - DNA, 17 bp, Homo sapiens
tgcccaggctggtctca

SEQ ID NO: 3799460 - DNA, 18 bp, Homo sapiens
tgcccagggctcagcctg

SEQ ID NO: 3799461 - DNA, 19 bp, Homo sapiens
tgcccagggctcagcctgg

SEQ ID NO: 3799462 - DNA, 20 bp, Homo sapiens
tgcccaggttggtctcgaac

SEQ ID NO: 3799463 - DNA, 12 bp, Homo sapiens
tgcccagtgttg

SEQ ID NO: 3799464 - DNA, 18 bp, Homo sapiens
tgcccagtgttgtttgta

SEQ ID NO: 3799465 - DNA, 21 bp, Homo sapiens
tgcccagtgttgtttgtaaat

SEQ ID NO: 3799466 - DNA, 22 bp, Homo sapiens
tgcccagtgttgtttgtaaata

SEQ ID NO: 3799467 - DNA, 20 bp, Homo sapiens
tgcccatcacagggttgggc

SEQ ID NO: 3799468 - DNA, 16 bp, Homo sapiens
tgcccattccccagcc

SEQ ID NO: 3799469 - DNA, 21 bp, Homo sapiens
tgccccaaaggaagctttctc

SEQ ID NO: 3799470 - DNA, 13 bp, Homo sapiens
tgccccaactcct

SEQ ID NO: 3799471 - DNA, 13 bp, Homo sapiens
tgccccacctgcc

SEQ ID NO: 3799472 - DNA, 17 bp, Homo sapiens
tgccccacctgccacta

SEQ ID NO: 3799473 - DNA, 21 bp, Homo sapiens
tgccccacctttattaaaatc

SEQ ID NO: 3799474 - DNA, 18 bp, Homo sapiens
tgccccagctctggcttc

SEQ ID NO: 3799475 - DNA, 21 bp, Homo sapiens
tgccccatgaagccacagccc

SEQ ID NO: 3799476 - DNA, 15 bp, Homo sapiens
tgccccatgcctgtc

SEQ ID NO: 3799477 - DNA, 23 bp, Homo sapiens
tgccccatgcctgtccagcctgg

SEQ ID NO: 3799478 - DNA, 18 bp, Homo sapiens
tgcccccacacctggccc

SEQ ID NO: 3799479 - DNA, 22 bp, Homo sapiens
tgcccccacacctggccctggg

SEQ ID NO: 3799480 - DNA, 12 bp, Homo sapiens
tgccccccaccc

SEQ ID NO: 3799481 - DNA, 13 bp, Homo sapiens
tgccccccacccc

SEQ ID NO: 3799482 - DNA, 13 bp, Homo sapiens
tgccccctggtgg

SEQ ID NO: 3799483 - DNA, 22 bp, Homo sapiens
tgccccctggtggacagtcctg

SEQ ID NO: 3799484 - DNA, 23 bp, Homo sapiens
tgccccgaacatgtttttcttct

SEQ ID NO: 3799485 - DNA, 21 bp, Homo sapiens
tgcccctcccagaacacactc

SEQ ID NO: 3799486 - DNA, 17 bp, Homo sapiens
tgcccctcccccaaccc

SEQ ID NO: 3799487 - DNA, 23 bp, Homo sapiens
tgcccctcccccaacccccaccc

SEQ ID NO: 3799488 - DNA, 13 bp, Homo sapiens
tgcccctcccttc

SEQ ID NO: 3799489 - DNA, 13 bp, Homo sapiens
tgcccctctctcc

SEQ ID NO: 3799490 - DNA, 15 bp, Homo sapiens
tgcccctctctccat

SEQ ID NO: 3799491 - DNA, 14 bp, Homo sapiens
tgcccctgctgcct

SEQ ID NO: 3799492 - DNA, 16 bp, Homo sapiens
tgcccctgctgcctcc

SEQ ID NO: 3799493 - DNA, 20 bp, Homo sapiens
tgccccttctacactctcct

SEQ ID NO: 3799494 - DNA, 22 bp, Homo sapiens
tgcccggattctgggaggaagc

SEQ ID NO: 3799495 - DNA, 12 bp, Homo sapiens
tgcccggctgcg

SEQ ID NO: 3799496 - DNA, 14 bp, Homo sapiens
tgcccggctgcgga

SEQ ID NO: 3799497 - DNA, 17 bp, Homo sapiens
tgccctagagcacactg

SEQ ID NO: 3799498 - DNA, 13 bp, Homo sapiens
tgccctagctcca

SEQ ID NO: 3799499 - DNA, 14 bp, Homo sapiens
tgccctaggctccg

SEQ ID NO: 3799500 - DNA, 16 bp, Homo sapiens
tgccctccactgccct

SEQ ID NO: 3799501 - DNA, 19 bp, Homo sapiens
tgccctccactgccctctg

SEQ ID NO: 3799502 - DNA, 13 bp, Homo sapiens
tgccctccatccc

SEQ ID NO: 3799503 - DNA, 20 bp, Homo sapiens
tgccctccatcccgacatgg

SEQ ID NO: 3799504 - DNA, 15 bp, Homo sapiens
tgccctccctccttc

SEQ ID NO: 3799505 - DNA, 22 bp, Homo sapiens
tgccctcgggcgagtcactgcc

SEQ ID NO: 3799506 - DNA, 11 bp, Homo sapiens
tgccctctgtt

SEQ ID NO: 3799507 - DNA, 16 bp, Homo sapiens
tgccctgccctagctc

SEQ ID NO: 3799508 - DNA, 21 bp, Homo sapiens
tgccctgctgccgcctcccag

SEQ ID NO: 3799509 - DNA, 22 bp, Homo sapiens
tgccctggggctgatctcaggg

SEQ ID NO: 3799510 - DNA, 12 bp, Homo sapiens
tgccctggtgct

SEQ ID NO: 3799511 - DNA, 20 bp, Homo sapiens
tgccctggtgctgccacact

SEQ ID NO: 3799512 - DNA, 23 bp, Homo sapiens
tgcccttcagcatcctcagttcc

SEQ ID NO: 3799513 - DNA, 16 bp, Homo sapiens
tgcccttgtcccactc

SEQ ID NO: 3799514 - DNA, 16 bp, Homo sapiens
tgccgaaactggaagt

SEQ ID NO: 3799515 - DNA, 16 bp, Homo sapiens
tgccgaccgaggctgg

SEQ ID NO: 3799516 - DNA, 14 bp, Homo sapiens
tgccgacctcgtcc

SEQ ID NO: 3799517 - DNA, 15 bp, Homo sapiens
tgccgacctcgtcct

SEQ ID NO: 3799518 - DNA, 21 bp, Homo sapiens
tgccgacctcgtcctccccct

SEQ ID NO: 3799519 - DNA, 22 bp, Homo sapiens
tgccgacctcgtcctccccctg

SEQ ID NO: 3799520 - DNA, 13 bp, Homo sapiens
tgccgcaccccag

SEQ ID NO: 3799521 - DNA, 18 bp, Homo sapiens
tgccgcaccccagagtgt

SEQ ID NO: 3799522 - DNA, 16 bp, Homo sapiens
tgccgcctcccagcct

SEQ ID NO: 3799523 - DNA, 14 bp, Homo sapiens
tgccggccctgggg

SEQ ID NO: 3799524 - DNA, 15 bp, Homo sapiens
tgccggccctggggc

SEQ ID NO: 3799525 - DNA, 16 bp, Homo sapiens
tgccggctctggctct

SEQ ID NO: 3799526 - DNA, 14 bp, Homo sapiens
tgccgggttttata

SEQ ID NO: 3799527 - DNA, 20 bp, Homo sapiens
tgccgtgggcctgtcgtgcc

SEQ ID NO: 3799528 - DNA, 20 bp, Homo sapiens
tgccgtgtgccctcgggcga

SEQ ID NO: 3799529 - DNA, 16 bp, Homo sapiens
tgccgttactctccaa

SEQ ID NO: 3799530 - DNA, 22 bp, Homo sapiens
tgccgttactctccaacctgga

SEQ ID NO: 3799531 - DNA, 15 bp, Homo sapiens
tgcctaagtggctgc

SEQ ID NO: 3799532 - DNA, 14 bp, Homo sapiens
tgcctaggctgacc

SEQ ID NO: 3799533 - DNA, 14 bp, Homo sapiens
tgcctatagtccca

SEQ ID NO: 3799534 - DNA, 14 bp, Homo sapiens
tgcctcagcctccg

SEQ ID NO: 3799535 - DNA, 18 bp, Homo sapiens
tgcctccaccccccagaa

SEQ ID NO: 3799536 - DNA, 17 bp, Homo sapiens
tgcctccaccgctgcct

SEQ ID NO: 3799537 - DNA, 18 bp, Homo sapiens
tgcctccatggtgcctct

SEQ ID NO: 3799538 - DNA, 16 bp, Homo sapiens
tgcctccccaaccctg

SEQ ID NO: 3799539 - DNA, 21 bp, Homo sapiens
tgcctccccaaccctgcccct

SEQ ID NO: 3799540 - DNA, 22 bp, Homo sapiens
tgcctccccaaccctgcccctg

SEQ ID NO: 3799541 - DNA, 16 bp, Homo sapiens
tgcctcctcttcaact

SEQ ID NO: 3799542 - DNA, 18 bp, Homo sapiens
tgcctctgcctctgacac

SEQ ID NO: 3799543 - DNA, 20 bp, Homo sapiens
tgcctctgcctctgacacac

SEQ ID NO: 3799544 - DNA, 20 bp, Homo sapiens
tgcctctggaggcctctggg

SEQ ID NO: 3799545 - DNA, 14 bp, Homo sapiens
tgcctctgggactg

SEQ ID NO: 3799546 - DNA, 13 bp, Homo sapiens
tgcctcttcctcc

SEQ ID NO: 3799547 - DNA, 16 bp, Homo sapiens
tgcctgaaccttccat

SEQ ID NO: 3799548 - DNA, 22 bp, Homo sapiens
tgcctgaagtcacacagtgagt

SEQ ID NO: 3799549 - DNA, 19 bp, Homo sapiens
tgcctgagggcgaggggag

SEQ ID NO: 3799550 - DNA, 15 bp, Homo sapiens
tgcctgcaccaggag

SEQ ID NO: 3799551 - DNA, 18 bp, Homo sapiens
tgcctgcaccaggagaca

SEQ ID NO: 3799552 - DNA, 20 bp, Homo sapiens
tgcctgcaccaggagacaga

SEQ ID NO: 3799553 - DNA, 11 bp, Homo sapiens
tgcctgcagcc

SEQ ID NO: 3799554 - DNA, 14 bp, Homo sapiens
tgcctgcccacccg

SEQ ID NO: 3799555 - DNA, 16 bp, Homo sapiens
tgcctgcccacccgtg

SEQ ID NO: 3799556 - DNA, 13 bp, Homo sapiens
tgcctgcccaggc

SEQ ID NO: 3799557 - DNA, 16 bp, Homo sapiens
tgcctgcccaggcccc

SEQ ID NO: 3799558 - DNA, 19 bp, Homo sapiens
tgcctgcggagttgtgcac

SEQ ID NO: 3799559 - DNA, 18 bp, Homo sapiens
tgcctgcggtcaaggcca

SEQ ID NO: 3799560 - DNA, 19 bp, Homo sapiens
tgcctgcggtcaaggccag

SEQ ID NO: 3799561 - DNA, 10 bp, Homo sapiens
tgcctgctga

SEQ ID NO: 3799562 - DNA, 23 bp, Homo sapiens
tgcctgctgaatgatttccaaag

SEQ ID NO: 3799563 - DNA, 20 bp, Homo sapiens
tgcctggaagagcagcccta

SEQ ID NO: 3799564 - DNA, 14 bp, Homo sapiens
tgcctggagcccca

SEQ ID NO: 3799565 - DNA, 18 bp, Homo sapiens
tgcctggagctcctggga

SEQ ID NO: 3799566 - DNA, 20 bp, Homo sapiens
tgcctggccaggcagatctg

SEQ ID NO: 3799567 - DNA, 16 bp, Homo sapiens
tgcctggcccccagct

SEQ ID NO: 3799568 - DNA, 14 bp, Homo sapiens
tgcctgggaatgta

SEQ ID NO: 3799569 - DNA, 19 bp, Homo sapiens
tgcctgggtggggctgctc

SEQ ID NO: 3799570 - DNA, 22 bp, Homo sapiens
tgcctgggtggggctgctcctc

SEQ ID NO: 3799571 - DNA, 18 bp, Homo sapiens
tgcctggtctcctgcccc

SEQ ID NO: 3799572 - DNA, 21 bp, Homo sapiens
tgcctggtctcctgcccccac

SEQ ID NO: 3799573 - DNA, 16 bp, Homo sapiens
tgcctggtggcagctg

SEQ ID NO: 3799574 - DNA, 15 bp, Homo sapiens
tgcctgtaaacatag

SEQ ID NO: 3799575 - DNA, 15 bp, Homo sapiens
tgcctgtaacttgag

SEQ ID NO: 3799576 - DNA, 17 bp, Homo sapiens
tgcctgtagtcccaggc

SEQ ID NO: 3799577 - DNA, 13 bp, Homo sapiens
tgcctgtagttag

SEQ ID NO: 3799578 - DNA, 18 bp, Homo sapiens
tgcctgtagttaggaaat

SEQ ID NO: 3799579 - DNA, 20 bp, Homo sapiens
tgcctgtagttaggaaataa

SEQ ID NO: 3799580 - DNA, 18 bp, Homo sapiens
tgcctgtccagcctgggc

SEQ ID NO: 3799581 - DNA, 11 bp, Homo sapiens
tgcctgtccct

SEQ ID NO: 3799582 - DNA, 14 bp, Homo sapiens
tgcctgtccctctc

SEQ ID NO: 3799583 - DNA, 16 bp, Homo sapiens
tgcctgtgagccagtc

SEQ ID NO: 3799584 - DNA, 20 bp, Homo sapiens
tgcctgtgcacggccagctg

SEQ ID NO: 3799585 - DNA, 21 bp, Homo sapiens
tgcctgtgcacggccagctgc

SEQ ID NO: 3799586 - DNA, 14 bp, Homo sapiens
tgcctgtgccaata

SEQ ID NO: 3799587 - DNA, 14 bp, Homo sapiens
tgcctgtgccaccc

SEQ ID NO: 3799588 - DNA, 20 bp, Homo sapiens
tgcctgtgccacccaccagg

SEQ ID NO: 3799589 - DNA, 15 bp, Homo sapiens
tgcctgttcagctcc

SEQ ID NO: 3799590 - DNA, 16 bp, Homo sapiens
tgcctgttcagctcca

SEQ ID NO: 3799591 - DNA, 16 bp, Homo sapiens
tgccttacctcctgcc

SEQ ID NO: 3799592 - DNA, 17 bp, Homo sapiens
tgccttagaacctttct

SEQ ID NO: 3799593 - DNA, 17 bp, Homo sapiens
tgccttcagctctacag

SEQ ID NO: 3799594 - DNA, 22 bp, Homo sapiens
tgccttcgttaactgtgtatgt

SEQ ID NO: 3799595 - DNA, 23 bp, Homo sapiens
tgccttctccagacaaaccagaa

SEQ ID NO: 3799596 - DNA, 21 bp, Homo sapiens
tgccttcttattctcactcca

SEQ ID NO: 3799597 - DNA, 14 bp, Homo sapiens
tgccttgaagccac

SEQ ID NO: 3799598 - DNA, 15 bp, Homo sapiens
tgccttgaagccact

SEQ ID NO: 3799599 - DNA, 13 bp, Homo sapiens
tgccttggcttca

SEQ ID NO: 3799600 - DNA, 11 bp, Homo sapiens
tgccttgggct

SEQ ID NO: 3799601 - DNA, 12 bp, Homo sapiens
tgcctttcctgt

SEQ ID NO: 3799602 - DNA, 14 bp, Homo sapiens
tgcctttcctgttc

SEQ ID NO: 3799603 - DNA, 16 bp, Homo sapiens
tgcctttcctgttcag

SEQ ID NO: 3799604 - DNA, 20 bp, Homo sapiens
tgcctttcctgttcagcatt

SEQ ID NO: 3799605 - DNA, 15 bp, Homo sapiens
tgcctttgcagaaac

SEQ ID NO: 3799606 - DNA, 11 bp, Homo sapiens
tgcctttgtaa

SEQ ID NO: 3799607 - DNA, 16 bp, Homo sapiens
tgcgaaggggccctgg

SEQ ID NO: 3799608 - DNA, 21 bp, Homo sapiens
tgcgaaggggccctggtcctt

SEQ ID NO: 3799609 - DNA, 22 bp, Homo sapiens
tgcgaatggtagtctaaccaaa

SEQ ID NO: 3799610 - DNA, 23 bp, Homo sapiens
tgcgaatggtagtctaaccaaat

SEQ ID NO: 3799611 - DNA, 19 bp, Homo sapiens
tgcgacggagagaaaaaag

SEQ ID NO: 3799612 - DNA, 19 bp, Homo sapiens
tgcgatctgggttcactgc

SEQ ID NO: 3799613 - DNA, 16 bp, Homo sapiens
tgcgcctacaggagtg

SEQ ID NO: 3799614 - DNA, 17 bp, Homo sapiens
tgcgcttttgctggtca

SEQ ID NO: 3799615 - DNA, 18 bp, Homo sapiens
tgcgcttttgctggtcac

SEQ ID NO: 3799616 - DNA, 18 bp, Homo sapiens
tgcggccgcattccctga

SEQ ID NO: 3799617 - DNA, 19 bp, Homo sapiens
tgcggcctttggcttcacg

SEQ ID NO: 3799618 - DNA, 19 bp, Homo sapiens
tgcgggatggtcctggggc

SEQ ID NO: 3799619 - DNA, 17 bp, Homo sapiens
tgcgggcacaataaatc

SEQ ID NO: 3799620 - DNA, 14 bp, Homo sapiens
tgcggtccacccag

SEQ ID NO: 3799621 - DNA, 15 bp, Homo sapiens
tgcggtccacccagg

SEQ ID NO: 3799622 - DNA, 17 bp, Homo sapiens
tgcggtccacccaggag

SEQ ID NO: 3799623 - DNA, 23 bp, Homo sapiens
tgcgtcttagcagtgatttttat

SEQ ID NO: 3799624 - DNA, 14 bp, Homo sapiens
tgcgtggctgaccc

SEQ ID NO: 3799625 - DNA, 19 bp, Homo sapiens
tgcgttagaatgaggagga

SEQ ID NO: 3799626 - DNA, 12 bp, Homo sapiens
tgctaaatctcc

SEQ ID NO: 3799627 - DNA, 15 bp, Homo sapiens
tgctaaattttcagt

SEQ ID NO: 3799628 - DNA, 19 bp, Homo sapiens
tgctaacttggagccccag

SEQ ID NO: 3799629 - DNA, 19 bp, Homo sapiens
tggccaggtggccactcca

SEQ ID NO: 3799630 - DNA, 23 bp, Homo sapiens
tggccagtgtgacaaggattgct

SEQ ID NO: 3799631 - DNA, 16 bp, Homo sapiens
tggccagttatccctt

SEQ ID NO: 3799632 - DNA, 16 bp, Homo sapiens
tggccagttggaacca

SEQ ID NO: 3799633 - DNA, 11 bp, Homo sapiens
tggccatctct

SEQ ID NO: 3799634 - DNA, 13 bp, Homo sapiens
tggcccacgcact

SEQ ID NO: 3799635 - DNA, 13 bp, Homo sapiens
tggcccactgcat

SEQ ID NO: 3799636 - DNA, 19 bp, Homo sapiens
tggccccatgtctctcaga

SEQ ID NO: 3799637 - DNA, 21 bp, Homo sapiens
tggccccatgtctctcagaat

SEQ ID NO: 3799638 - DNA, 13 bp, Homo sapiens
tggcccccactgg

SEQ ID NO: 3799639 - DNA, 15 bp, Homo sapiens
tggcccccgagctgg

SEQ ID NO: 3799640 - DNA, 15 bp, Homo sapiens
tggccccctccgtga

SEQ ID NO: 3799641 - DNA, 21 bp, Homo sapiens
tggcccctcacctgggcacct

SEQ ID NO: 3799642 - DNA, 20 bp, Homo sapiens
tggcccctgaacaagaattg

SEQ ID NO: 3799643 - DNA, 11 bp, Homo sapiens
tggccccttca

SEQ ID NO: 3799644 - DNA, 15 bp, Homo sapiens
tggcccgacagcctg

SEQ ID NO: 3799645 - DNA, 16 bp, Homo sapiens
tggcccgacagcctgg

SEQ ID NO: 3799646 - DNA, 18 bp, Homo sapiens
tggccctcacccctgccc

SEQ ID NO: 3799647 - DNA, 15 bp, Homo sapiens
tggccctctggtaga

SEQ ID NO: 3799648 - DNA, 14 bp, Homo sapiens
tggccctcttctta

SEQ ID NO: 3799649 - DNA, 16 bp, Homo sapiens
tggccctcttcttact

SEQ ID NO: 3799650 - DNA, 11 bp, Homo sapiens
tggccctgcct

SEQ ID NO: 3799651 - DNA, 13 bp, Homo sapiens
tggccctggcctg

SEQ ID NO: 3799652 - DNA, 16 bp, Homo sapiens
tggccctggcctgctg

SEQ ID NO: 3799653 - DNA, 13 bp, Homo sapiens
tggccctggggcc

SEQ ID NO: 3799654 - DNA, 15 bp, Homo sapiens
tggccctggggcctg

SEQ ID NO: 3799655 - DNA, 19 bp, Homo sapiens
tggccgagggtcctggctc

SEQ ID NO: 3799656 - DNA, 14 bp, Homo sapiens
tggccgggcacagc

SEQ ID NO: 3799657 - DNA, 15 bp, Homo sapiens
tggcctcaaccctcc

SEQ ID NO: 3799658 - DNA, 18 bp, Homo sapiens
tggcctcaagtgattctc

SEQ ID NO: 3799659 - DNA, 23 bp, Homo sapiens
tggcctcaagtgattctcctgcc

SEQ ID NO: 3799660 - DNA, 17 bp, Homo sapiens
tggcctcagaattcaca

SEQ ID NO: 3799661 - DNA, 13 bp, Homo sapiens
tggcctcagctgc

SEQ ID NO: 3799662 - DNA, 16 bp, Homo sapiens
tggcctgcactaattt

SEQ ID NO: 3799663 - DNA, 21 bp, Homo sapiens
tggcctgctgggctctccacc

SEQ ID NO: 3799664 - DNA, 13 bp, Homo sapiens
tggcctggccagg

SEQ ID NO: 3799665 - DNA, 17 bp, Homo sapiens
tggcctggccaggagct

SEQ ID NO: 3799666 - DNA, 13 bp, Homo sapiens
tggcctgggagag

SEQ ID NO: 3799667 - DNA, 17 bp, Homo sapiens
tggcctgggagagctgg

SEQ ID NO: 3799668 - DNA, 11 bp, Homo sapiens
tggcctgggca

SEQ ID NO: 3799669 - DNA, 14 bp, Homo sapiens
tggcctgtctcatc

SEQ ID NO: 3799670 - DNA, 18 bp, Homo sapiens
tggcctgtctcatcccca

SEQ ID NO: 3799671 - DNA, 24 bp, Homo sapiens
tggcctgtctcatccccaggggtc

SEQ ID NO: 3799672 - DNA, 13 bp, Homo sapiens
tggcctgttctgt

SEQ ID NO: 3799673 - DNA, 16 bp, Homo sapiens
tggccttccccagcct

SEQ ID NO: 3799674 - DNA, 17 bp, Homo sapiens
tggccttccccagcctc

SEQ ID NO: 3799675 - DNA, 22 bp, Homo sapiens
tggccttgttctctctatggta

SEQ ID NO: 3799676 - DNA, 17 bp, Homo sapiens
tggcgggccaaggactg

SEQ ID NO: 3799677 - DNA, 13 bp, Homo sapiens
tggcggtgcctgg

SEQ ID NO: 3799678 - DNA, 18 bp, Homo sapiens
tggcgtgtccctctcgga

SEQ ID NO: 3799679 - DNA, 17 bp, Homo sapiens
tggctaagcttaaaaaa

SEQ ID NO: 3799680 - DNA, 22 bp, Homo sapiens
tggctacatcccagcctgtggt

SEQ ID NO: 3799681 - DNA, 19 bp, Homo sapiens
tggctagaggccagcccca

SEQ ID NO: 3799682 - DNA, 21 bp, Homo sapiens
tggctagaggccagccccacc

SEQ ID NO: 3799683 - DNA, 23 bp, Homo sapiens
tggctagaggccagccccaccca

SEQ ID NO: 3799684 - DNA, 15 bp, Homo sapiens
tggctagagtcctca

SEQ ID NO: 3799685 - DNA, 21 bp, Homo sapiens
tggctagagtcctcactccca

SEQ ID NO: 3799686 - DNA, 16 bp, Homo sapiens
tggctcaatcctctaa

SEQ ID NO: 3799687 - DNA, 14 bp, Homo sapiens
tggctcacagactg

SEQ ID NO: 3799688 - DNA, 15 bp, Homo sapiens
tggctcactgcagcc

SEQ ID NO: 3799689 - DNA, 21 bp, Homo sapiens
tggctcatattcctgcagcct

SEQ ID NO: 3799690 - DNA, 15 bp, Homo sapiens
tggctccagtctgct

SEQ ID NO: 3799691 - DNA, 19 bp, Homo sapiens
tggctccagtctgctgccc

SEQ ID NO: 3799692 - DNA, 20 bp, Homo sapiens
tggctcccacaggcccttcc

SEQ ID NO: 3799693 - DNA, 15 bp, Homo sapiens
tggctcccagggcca

SEQ ID NO: 3799694 - DNA, 20 bp, Homo sapiens
tggctcccatgaccatactg

SEQ ID NO: 3799695 - DNA, 23 bp, Homo sapiens
tggctcccatgaccatactgagg

SEQ ID NO: 3799696 - DNA, 16 bp, Homo sapiens
tggctcctcccggtgc

SEQ ID NO: 3799697 - DNA, 23 bp, Homo sapiens
tggctcctgaggggcatctgccc

SEQ ID NO: 3799698 - DNA, 16 bp, Homo sapiens
tggctctcagaaggta

SEQ ID NO: 3799699 - DNA, 22 bp, Homo sapiens
tggctcttttacccaataagat

SEQ ID NO: 3799700 - DNA, 17 bp, Homo sapiens
tggctgacccagtccct

SEQ ID NO: 3799701 - DNA, 19 bp, Homo sapiens
tggctgacccagtccctgg

SEQ ID NO: 3799702 - DNA, 12 bp, Homo sapiens
tggctgcaaagg

SEQ ID NO: 3799703 - DNA, 14 bp, Homo sapiens
tggctgcagggagt

SEQ ID NO: 3799704 - DNA, 15 bp, Homo sapiens
tggctgcagggagtc

SEQ ID NO: 3799705 - DNA, 15 bp, Homo sapiens
tggctgcctggagcc

SEQ ID NO: 3799706 - DNA, 17 bp, Homo sapiens
tggctgcggcacccttg

SEQ ID NO: 3799707 - DNA, 14 bp, Homo sapiens
tggctgctagcact

SEQ ID NO: 3799708 - DNA, 17 bp, Homo sapiens
tggctggcccgtcatgt

SEQ ID NO: 3799709 - DNA, 14 bp, Homo sapiens
tggctggctgcagt

SEQ ID NO: 3799710 - DNA, 20 bp, Homo sapiens
tggctgtagaaggagacaga

SEQ ID NO: 3799711 - DNA, 14 bp, Homo sapiens
tggctgtcagcagg

SEQ ID NO: 3799712 - DNA, 17 bp, Homo sapiens
tggctgtcagcaggaag

SEQ ID NO: 3799713 - DNA, 23 bp, Homo sapiens
tggctgttggctgggggcctcag

SEQ ID NO: 3799714 - DNA, 17 bp, Homo sapiens
tggcttaaaacaacact

SEQ ID NO: 3799715 - DNA, 23 bp, Homo sapiens
tggcttactacatgtgggagctt

SEQ ID NO: 3799716 - DNA, 17 bp, Homo sapiens
tggcttcacggaagagc

SEQ ID NO: 3799717 - DNA, 22 bp, Homo sapiens
tggcttcacggaagagccttgc

SEQ ID NO: 3799718 - DNA, 23 bp, Homo sapiens
tggcttccagaaaaccccagcat

SEQ ID NO: 3799719 - DNA, 15 bp, Homo sapiens
tggcttcccgctcag

SEQ ID NO: 3799720 - DNA, 22 bp, Homo sapiens
tggcttcccgctcagccctccc

SEQ ID NO: 3799721 - DNA, 22 bp, Homo sapiens
tggcttcctaaaattcagtgga

SEQ ID NO: 3799722 - DNA, 16 bp, Homo sapiens
tggcttctgtttctag

SEQ ID NO: 3799723 - DNA, 20 bp, Homo sapiens
tggcttgaagccaagtcagc

SEQ ID NO: 3799724 - DNA, 17 bp, Homo sapiens
tggcttgccacagctct

SEQ ID NO: 3799725 - DNA, 23 bp, Homo sapiens
tggcttgggactaaatgccctgc

SEQ ID NO: 3799726 - DNA, 18 bp, Homo sapiens
tggcttgtgatctgggaa

SEQ ID NO: 3799727 - DNA, 22 bp, Homo sapiens
tggctttgcccaacctcagcaa

SEQ ID NO: 3799728 - DNA, 17 bp, Homo sapiens
tggctttgtcccacagc

SEQ ID NO: 3799729 - DNA, 19 bp, Homo sapiens
tggcttttcactgctggct

SEQ ID NO: 3799730 - DNA, 21 bp, Homo sapiens
tggcttttcactgctggctgc

SEQ ID NO: 3799731 - DNA, 20 bp, Homo sapiens
tgggaaccccttcatcctct

SEQ ID NO: 3799732 - DNA, 13 bp, Homo sapiens
tgggaactagact

SEQ ID NO: 3799733 - DNA, 17 bp, Homo sapiens
tgggaactcccaagaac

SEQ ID NO: 3799734 - DNA, 21 bp, Homo sapiens
tgggaagacatggggaggaag

SEQ ID NO: 3799735 - DNA, 21 bp, Homo sapiens
tgggaagggagagcggggcag

SEQ ID NO: 3799736 - DNA, 15 bp, Homo sapiens
tgggaaggggtttct

SEQ ID NO: 3799737 - DNA, 16 bp, Homo sapiens
tgggaatgcggcaaga

SEQ ID NO: 3799738 - DNA, 21 bp, Homo sapiens
tgggaatgtattattctgcag

SEQ ID NO: 3799739 - DNA, 18 bp, Homo sapiens
tgggactacaggcaccca

SEQ ID NO: 3799740 - DNA, 19 bp, Homo sapiens
tgggactagcctggcttgg

SEQ ID NO: 3799741 - DNA, 23 bp, Homo sapiens
tgggactggccaggtttctgccc

SEQ ID NO: 3799742 - DNA, 21 bp, Homo sapiens
tgtatgactaaagagagaatg

SEQ ID NO: 3799743 - DNA, 14 bp, Homo sapiens
tgtatgcactttgt

SEQ ID NO: 3799744 - DNA, 23 bp, Homo sapiens
tgtatggaaataaatgtatcata

SEQ ID NO: 3799745 - DNA, 19 bp, Homo sapiens
tgtatggaatacagtgtta

SEQ ID NO: 3799746 - DNA, 23 bp, Homo sapiens
tgtatgggtgtgtgtttgtgtga

SEQ ID NO: 3799747 - DNA, 16 bp, Homo sapiens
tgtatgtgccatttat

SEQ ID NO: 3799748 - DNA, 14 bp, Homo sapiens
tgtatgttgtgaag

SEQ ID NO: 3799749 - DNA, 23 bp, Homo sapiens
tgtatgttgtgaagatgtttgca

SEQ ID NO: 3799750 - DNA, 17 bp, Homo sapiens
tgtatgtttacactgtc

SEQ ID NO: 3799751 - DNA, 18 bp, Homo sapiens
tgtatgtttacactgtca

SEQ ID NO: 3799752 - DNA, 16 bp, Homo sapiens
tgtatgtttgcacact

SEQ ID NO: 3799753 - DNA, 23 bp, Homo sapiens
tgtattcacgtgcagcagcaaca

SEQ ID NO: 3799754 - DNA, 17 bp, Homo sapiens
tgtatttaattgtaaac

SEQ ID NO: 3799755 - DNA, 18 bp, Homo sapiens
tgtatttaattgtaaact

SEQ ID NO: 3799756 - DNA, 21 bp, Homo sapiens
tgtatttataaatatatttaa

SEQ ID NO: 3799757 - DNA, 17 bp, Homo sapiens
tgtatttatgtgtgagg

SEQ ID NO: 3799758 - DNA, 22 bp, Homo sapiens
tgtattttataaaattaaagaa

SEQ ID NO: 3799759 - DNA, 19 bp, Homo sapiens
tgtattttatgtatgttta

SEQ ID NO: 3799760 - DNA, 21 bp, Homo sapiens
tgtattttatttttttctctc

SEQ ID NO: 3799761 - DNA, 16 bp, Homo sapiens
tgtcaaacaaagccag

SEQ ID NO: 3799762 - DNA, 21 bp, Homo sapiens
tgtcaaacaaagccagaagct

SEQ ID NO: 3799763 - DNA, 16 bp, Homo sapiens
tgtcaaactgtagaaa

SEQ ID NO: 3799764 - DNA, 16 bp, Homo sapiens
tgtcaagtctctgctg

SEQ ID NO: 3799765 - DNA, 14 bp, Homo sapiens
tgtcacagaaatca

SEQ ID NO: 3799766 - DNA, 19 bp, Homo sapiens
tgtcacagaaatcagagga

SEQ ID NO: 3799767 - DNA, 17 bp, Homo sapiens
tgtcacaggcaggtcca

SEQ ID NO: 3799768 - DNA, 19 bp, Homo sapiens
tgtcaccaccttcccagct

SEQ ID NO: 3799769 - DNA, 21 bp, Homo sapiens
tgtcaccaccttcccagctct

SEQ ID NO: 3799770 - DNA, 23 bp, Homo sapiens
tgtcaccaccttcccagctctcc

SEQ ID NO: 3799771 - DNA, 19 bp, Homo sapiens
tgtcaccggatcctgggtg

SEQ ID NO: 3799772 - DNA, 16 bp, Homo sapiens
tgtcaccgtgagcagc

SEQ ID NO: 3799773 - DNA, 22 bp, Homo sapiens
tgtcactactcacagtctcttt

SEQ ID NO: 3799774 - DNA, 13 bp, Homo sapiens
tgtcactgtttct

SEQ ID NO: 3799775 - DNA, 17 bp, Homo sapiens
tgtcactgtttctctgc

SEQ ID NO: 3799776 - DNA, 21 bp, Homo sapiens
tgtcagaaaccagttatgtga

SEQ ID NO: 3799777 - DNA, 12 bp, Homo sapiens
tgtcagacttta

SEQ ID NO: 3799778 - DNA, 11 bp, Homo sapiens
tgtcagagctg

SEQ ID NO: 3799779 - DNA, 13 bp, Homo sapiens
tgtcagagctggg

SEQ ID NO: 3799780 - DNA, 14 bp, Homo sapiens
tgtcagagctggga

SEQ ID NO: 3799781 - DNA, 15 bp, Homo sapiens
tgtcagatatgatat

SEQ ID NO: 3799782 - DNA, 23 bp, Homo sapiens
tgtcagatattttttcagaaata

SEQ ID NO: 3799783 - DNA, 11 bp, Homo sapiens
tgtcagattcc

SEQ ID NO: 3799784 - DNA, 14 bp, Homo sapiens
tgtcagattccttt

SEQ ID NO: 3799785 - DNA, 17 bp, Homo sapiens
tgtcagattcctttccc

SEQ ID NO: 3799786 - DNA, 13 bp, Homo sapiens
tgtcagcaggaag

SEQ ID NO: 3799787 - DNA, 15 bp, Homo sapiens
tgtcagcatagaagt

SEQ ID NO: 3799788 - DNA, 18 bp, Homo sapiens
tgtcagctactaatgatg

SEQ ID NO: 3799789 - DNA, 21 bp, Homo sapiens
tgtcagctactaatgatgttt

SEQ ID NO: 3799790 - DNA, 16 bp, Homo sapiens
tgtcagctgaacctgg

SEQ ID NO: 3799791 - DNA, 19 bp, Homo sapiens
tgtcagctgaacctgggta

SEQ ID NO: 3799792 - DNA, 17 bp, Homo sapiens
tgtcaggaacagaagga

SEQ ID NO: 3799793 - DNA, 20 bp, Homo sapiens
tgtcaggaacagaaggatga

SEQ ID NO: 3799794 - DNA, 22 bp, Homo sapiens
tgtcagggaacatatttaagga

SEQ ID NO: 3799795 - DNA, 13 bp, Homo sapiens
tgtcagtctgctt

SEQ ID NO: 3799796 - DNA, 16 bp, Homo sapiens
tgtcagtgcagcccgt

SEQ ID NO: 3799797 - DNA, 15 bp, Homo sapiens
tgtcataagaatgaa

SEQ ID NO: 3799798 - DNA, 16 bp, Homo sapiens
tgtcataagaatgaat

SEQ ID NO: 3799799 - DNA, 17 bp, Homo sapiens
tgtcatcccattgtctt

SEQ ID NO: 3799800 - DNA, 15 bp, Homo sapiens
tgtcattaaacatga

SEQ ID NO: 3799801 - DNA, 13 bp, Homo sapiens
tgtcattgcttta

SEQ ID NO: 3799802 - DNA, 22 bp, Homo sapiens
tgtcattttgaagctaattatt

SEQ ID NO: 3799803 - DNA, 17 bp, Homo sapiens
tgtccaaactgcctaag

SEQ ID NO: 3799804 - DNA, 15 bp, Homo sapiens
tgtccaacctaaccc

SEQ ID NO: 3799805 - DNA, 23 bp, Homo sapiens
tgtccaactccagtactggagct

SEQ ID NO: 3799806 - DNA, 19 bp, Homo sapiens
tgtccacagatgcctccac

SEQ ID NO: 3799807 - DNA, 17 bp, Homo sapiens
tgtccacataggtttag

SEQ ID NO: 3799808 - DNA, 17 bp, Homo sapiens
tgtccacccccgcctcc

SEQ ID NO: 3799809 - DNA, 14 bp, Homo sapiens
tgtccacctggccc

SEQ ID NO: 3799810 - DNA, 15 bp, Homo sapiens
tgtccacctggcccc

SEQ ID NO: 3799811 - DNA, 12 bp, Homo sapiens
tgtccagagaca

SEQ ID NO: 3799812 - DNA, 11 bp, Homo sapiens
tgtccagagag

SEQ ID NO: 3799813 - DNA, 19 bp, Homo sapiens
tgtccagcctgggcagcca

SEQ ID NO: 3799814 - DNA, 17 bp, Homo sapiens
tgtccagggccctgagc

SEQ ID NO: 3799815 - DNA, 13 bp, Homo sapiens
tgtccatgtgtgt

SEQ ID NO: 3799816 - DNA, 20 bp, Homo sapiens
tgtcccacagcttggggcca

SEQ ID NO: 3799817 - DNA, 20 bp, Homo sapiens
tgtcccactcaagccaagca

SEQ ID NO: 3799818 - DNA, 14 bp, Homo sapiens
tgtcccaggtcctc

SEQ ID NO: 3799819 - DNA, 20 bp, Homo sapiens
tgtcccatttctaaaggcct

SEQ ID NO: 3799820 - DNA, 23 bp, Homo sapiens
tgtccccctgagatcagagtcct

SEQ ID NO: 3799821 - DNA, 19 bp, Homo sapiens
tgtccctacacccctcccc

SEQ ID NO: 3799822 - DNA, 14 bp, Homo sapiens
tgtccctctcaggc

SEQ ID NO: 3799823 - DNA, 15 bp, Homo sapiens
tgtccctctctctgg

SEQ ID NO: 3799824 - DNA, 15 bp, Homo sapiens
tgtccctggccatct

SEQ ID NO: 3799825 - DNA, 17 bp, Homo sapiens
tgtccctggccatctct

SEQ ID NO: 3799826 - DNA, 22 bp, Homo sapiens
tgtccctggccatctctgaact

SEQ ID NO: 3799827 - DNA, 16 bp, Homo sapiens
tgtccctgtcaccaag

SEQ ID NO: 3799828 - DNA, 16 bp, Homo sapiens
tgtccctttcttggcc

SEQ ID NO: 3799829 - DNA, 13 bp, Homo sapiens
tgtccgagaacta

SEQ ID NO: 3799830 - DNA, 18 bp, Homo sapiens
tgtcctccagaagcctct

SEQ ID NO: 3799831 - DNA, 23 bp, Homo sapiens
tgtcctccagaagcctctggcta

SEQ ID NO: 3799832 - DNA, 17 bp, Homo sapiens
tgtcctcccctcaagga

SEQ ID NO: 3799833 - DNA, 10 bp, Homo sapiens
tgtcctcctc

SEQ ID NO: 3799834 - DNA, 20 bp, Homo sapiens
tgtcctgggagtgagctggt

SEQ ID NO: 3799835 - DNA, 20 bp, Homo sapiens
tgtccttacccatctgcacc

SEQ ID NO: 3799836 - DNA, 18 bp, Homo sapiens
tgtccttctctcacctcc

SEQ ID NO: 3799837 - DNA, 19 bp, Homo sapiens
tgtccttctctcacctcct

SEQ ID NO: 3799838 - DNA, 16 bp, Homo sapiens
tgtccttgcacctgca

SEQ ID NO: 3799839 - DNA, 13 bp, Homo sapiens
tgtcctttccctc

SEQ ID NO: 3799840 - DNA, 16 bp, Homo sapiens
tgtcctttttgttatt

SEQ ID NO: 3799841 - DNA, 17 bp, Homo sapiens
tgtcctttttgttatta

SEQ ID NO: 3799842 - DNA, 17 bp, Homo sapiens
tgtcgcccagtgccctg

SEQ ID NO: 3799843 - DNA, 13 bp, Homo sapiens
tgtcgcctctgca

SEQ ID NO: 3799844 - DNA, 13 bp, Homo sapiens
tgtctaaaaacac

SEQ ID NO: 3799845 - DNA, 14 bp, Homo sapiens
tgtctaccatctcc

SEQ ID NO: 3799846 - DNA, 21 bp, Homo sapiens
tgtctaggtcagtacccacct

SEQ ID NO: 3799847 - DNA, 16 bp, Homo sapiens
tgtctatgggactcaa

SEQ ID NO: 3799848 - DNA, 12 bp, Homo sapiens
tgtctcaaaaaa

SEQ ID NO: 3799849 - DNA, 23 bp, Homo sapiens
tgtctcaagagggcactggtggc

SEQ ID NO: 3799850 - DNA, 14 bp, Homo sapiens
tgtctcagcctccc

SEQ ID NO: 3799851 - DNA, 13 bp, Homo sapiens
tgtctcatcccca

SEQ ID NO: 3799852 - DNA, 12 bp, Homo sapiens
tgtctccagacc

SEQ ID NO: 3799853 - DNA, 14 bp, Homo sapiens
tgtctccagacccc

SEQ ID NO: 3799854 - DNA, 17 bp, Homo sapiens
tgtctccagacccccac

SEQ ID NO: 3799855 - DNA, 20 bp, Homo sapiens
tgtctccagacccccacccc

SEQ ID NO: 3799856 - DNA, 14 bp, Homo sapiens
ttaagatatgatgt

SEQ ID NO: 3799857 - DNA, 19 bp, Homo sapiens
ttaagatttaatttgccaa

SEQ ID NO: 3799858 - DNA, 19 bp, Homo sapiens
ttaagcattactcttgtaa

SEQ ID NO: 3799859 - DNA, 22 bp, Homo sapiens
ttaagcattactcttgtaagat

SEQ ID NO: 3799860 - DNA, 20 bp, Homo sapiens
ttaagcattgggtgggtaaa

SEQ ID NO: 3799861 - DNA, 23 bp, Homo sapiens
ttaagcattgtttgcttattgtt

SEQ ID NO: 3799862 - DNA, 18 bp, Homo sapiens
ttaaggaagaaaaatcag

SEQ ID NO: 3799863 - DNA, 19 bp, Homo sapiens
ttaaggagatgtaagagct

SEQ ID NO: 3799864 - DNA, 22 bp, Homo sapiens
ttaaggcaactgaacaaaaaaa

SEQ ID NO: 3799865 - DNA, 23 bp, Homo sapiens
ttaaggctgaggaaaggccagct

SEQ ID NO: 3799866 - DNA, 21 bp, Homo sapiens
ttaagggatggaaaaggaaga

SEQ ID NO: 3799867 - DNA, 16 bp, Homo sapiens
ttaagtatttatatat

SEQ ID NO: 3799868 - DNA, 23 bp, Homo sapiens
ttaagttggcttctgtttctagt

SEQ ID NO: 3799869 - DNA, 15 bp, Homo sapiens
ttaataaaaaggcac

SEQ ID NO: 3799870 - DNA, 20 bp, Homo sapiens
ttaataacccttgaaagtca

SEQ ID NO: 3799871 - DNA, 17 bp, Homo sapiens
ttaataagtttcactga

SEQ ID NO: 3799872 - DNA, 23 bp, Homo sapiens
ttaatatgtattttatgtatgtt

SEQ ID NO: 3799873 - DNA, 19 bp, Homo sapiens
ttaatatttgctgacagct

SEQ ID NO: 3799874 - DNA, 21 bp, Homo sapiens
ttaatcctagctgtgtgcagt

SEQ ID NO: 3799875 - DNA, 22 bp, Homo sapiens
ttaatcttcagttttatcttta

SEQ ID NO: 3799876 - DNA, 15 bp, Homo sapiens
ttaatgaaaatgtca

SEQ ID NO: 3799877 - DNA, 16 bp, Homo sapiens
ttaatgaaaatgtcag

SEQ ID NO: 3799878 - DNA, 18 bp, Homo sapiens
ttaatgtttttaaatata

SEQ ID NO: 3799879 - DNA, 20 bp, Homo sapiens
ttaattaggggttgctaaga

SEQ ID NO: 3799880 - DNA, 17 bp, Homo sapiens
ttaattaggttaactat

SEQ ID NO: 3799881 - DNA, 14 bp, Homo sapiens
ttaattattattct

SEQ ID NO: 3799882 - DNA, 17 bp, Homo sapiens
ttaattattattcttca

SEQ ID NO: 3799883 - DNA, 13 bp, Homo sapiens
ttaattcatgttt

SEQ ID NO: 3799884 - DNA, 15 bp, Homo sapiens
ttaattgaaggaaag

SEQ ID NO: 3799885 - DNA, 18 bp, Homo sapiens
ttaatttgatgaaagctg

SEQ ID NO: 3799886 - DNA, 13 bp, Homo sapiens
ttaatttgccaaa

SEQ ID NO: 3799887 - DNA, 20 bp, Homo sapiens
ttaatttgccaaaataatgt

SEQ ID NO: 3799888 - DNA, 13 bp, Homo sapiens
ttaattttcagta

SEQ ID NO: 3799889 - DNA, 12 bp, Homo sapiens
ttacaaactgca

SEQ ID NO: 3799890 - DNA, 23 bp, Homo sapiens
ttacaaactgcaatagagactgt

SEQ ID NO: 3799891 - DNA, 14 bp, Homo sapiens
ttacaaattggagc

SEQ ID NO: 3799892 - DNA, 16 bp, Homo sapiens
ttacaagggaagattt

SEQ ID NO: 3799893 - DNA, 20 bp, Homo sapiens
ttacaagggaagatttatgt

SEQ ID NO: 3799894 - DNA, 20 bp, Homo sapiens
ttacaataggtgcttattct

SEQ ID NO: 3799895 - DNA, 19 bp, Homo sapiens
ttacacaaatacttattca

SEQ ID NO: 3799896 - DNA, 17 bp, Homo sapiens
ttacacatcttcaacag

SEQ ID NO: 3799897 - DNA, 19 bp, Homo sapiens
ttacactgttagaacacta

SEQ ID NO: 3799898 - DNA, 18 bp, Homo sapiens
ttacagataggccttctt

SEQ ID NO: 3799899 - DNA, 17 bp, Homo sapiens
ttacagcctcacttgaa

SEQ ID NO: 3799900 - DNA, 13 bp, Homo sapiens
ttacagctgcctg

SEQ ID NO: 3799901 - DNA, 14 bp, Homo sapiens
ttacataaataaat

SEQ ID NO: 3799902 - DNA, 20 bp, Homo sapiens
ttacataagataaatgtgct

SEQ ID NO: 3799903 - DNA, 20 bp, Homo sapiens
ttacatagtgtaggctttac

SEQ ID NO: 3799904 - DNA, 17 bp, Homo sapiens
ttacatccttgtggcac

SEQ ID NO: 3799905 - DNA, 14 bp, Homo sapiens
ttacatctgtttta

SEQ ID NO: 3799906 - DNA, 18 bp, Homo sapiens
ttacattccttgataatg

SEQ ID NO: 3799907 - DNA, 13 bp, Homo sapiens
ttaccactgaaga

SEQ ID NO: 3799908 - DNA, 22 bp, Homo sapiens
ttaccagacggttcaccagcct

SEQ ID NO: 3799909 - DNA, 20 bp, Homo sapiens
ttaccagcctccgtatttca

SEQ ID NO: 3799910 - DNA, 13 bp, Homo sapiens
ttaccatttgtaa

SEQ ID NO: 3799911 - DNA, 23 bp, Homo sapiens
ttaccatttgtaataaagtatat

SEQ ID NO: 3799912 - DNA, 14 bp, Homo sapiens
ttacccctctacca

SEQ ID NO: 3799913 - DNA, 14 bp, Homo sapiens
ttaccccttagcct

SEQ ID NO: 3799914 - DNA, 13 bp, Homo sapiens
ttacctaattaga

SEQ ID NO: 3799915 - DNA, 20 bp, Homo sapiens
ttacctagtagtcatttcat

SEQ ID NO: 3799916 - DNA, 13 bp, Homo sapiens
ttacctcctgccc

SEQ ID NO: 3799917 - DNA, 19 bp, Homo sapiens
ttacctcctgcccaggaga

SEQ ID NO: 3799918 - DNA, 14 bp, Homo sapiens
ttaccttcaataaa

SEQ ID NO: 3799919 - DNA, 16 bp, Homo sapiens
ttaccttcaataaagt

SEQ ID NO: 3799920 - DNA, 18 bp, Homo sapiens
ttaccttcaataaagtat

SEQ ID NO: 3799921 - DNA, 20 bp, Homo sapiens
ttactacaaaatttgaaatt

SEQ ID NO: 3799922 - DNA, 16 bp, Homo sapiens
ttactatgcacaattt

SEQ ID NO: 3799923 - DNA, 19 bp, Homo sapiens
ttactattaagcagtaaaa

SEQ ID NO: 3799924 - DNA, 23 bp, Homo sapiens
ttactattaagcagtaaaaactg

SEQ ID NO: 3799925 - DNA, 22 bp, Homo sapiens
ttactcagccctgggccccacc

SEQ ID NO: 3799926 - DNA, 13 bp, Homo sapiens
ttactctgaaggg

SEQ ID NO: 3799927 - DNA, 22 bp, Homo sapiens
ttactctgaagggcatcatgca

SEQ ID NO: 3799928 - DNA, 14 bp, Homo sapiens
ttactcttgtaaga

SEQ ID NO: 3799929 - DNA, 17 bp, Homo sapiens
ttactcttgtaagattt

SEQ ID NO: 3799930 - DNA, 18 bp, Homo sapiens
ttactcttgtaagatttt

SEQ ID NO: 3799931 - DNA, 23 bp, Homo sapiens
ttactcttgtaagattttgaaaa

SEQ ID NO: 3799932 - DNA, 19 bp, Homo sapiens
ttactgaaggtaaaattga

SEQ ID NO: 3799933 - DNA, 16 bp, Homo sapiens
ttactgagcttctctg

SEQ ID NO: 3799934 - DNA, 18 bp, Homo sapiens
ttactgagcttctctgtg

SEQ ID NO: 3799935 - DNA, 14 bp, Homo sapiens
ttactgatcatgca

SEQ ID NO: 3799936 - DNA, 22 bp, Homo sapiens
ttactgcagcctttgcctcccc

SEQ ID NO: 3799937 - DNA, 15 bp, Homo sapiens
ttactgcagctttgt

SEQ ID NO: 3799938 - DNA, 11 bp, Homo sapiens
ttactgtctta

SEQ ID NO: 3799939 - DNA, 18 bp, Homo sapiens
ttactgtcttaattaagt

SEQ ID NO: 3799940 - DNA, 19 bp, Homo sapiens
ttactgtcttaattaagta

SEQ ID NO: 3799941 - DNA, 21 bp, Homo sapiens
ttacttaaaccgccaaggctg

SEQ ID NO: 3799942 - DNA, 14 bp, Homo sapiens
ttacttacagcata

SEQ ID NO: 3799943 - DNA, 19 bp, Homo sapiens
ttacttagcttatcaattt

SEQ ID NO: 3799944 - DNA, 18 bp, Homo sapiens
ttacttattatcttcagg

SEQ ID NO: 3799945 - DNA, 15 bp, Homo sapiens
ttacttcctatcaag

SEQ ID NO: 3799946 - DNA, 18 bp, Homo sapiens
ttactttaaaaggagcca

SEQ ID NO: 3799947 - DNA, 11 bp, Homo sapiens
ttactttctgt

SEQ ID NO: 3799948 - DNA, 12 bp, Homo sapiens
ttactttgtatg

SEQ ID NO: 3799949 - DNA, 11 bp, Homo sapiens
ttagaaatata

SEQ ID NO: 3799950 - DNA, 12 bp, Homo sapiens
ttagaaatataa

SEQ ID NO: 3799951 - DNA, 13 bp, Homo sapiens
ttagaaatgcaaa

SEQ ID NO: 3799952 - DNA, 13 bp, Homo sapiens
ttagaagtgttaa

SEQ ID NO: 3799953 - DNA, 23 bp, Homo sapiens
ttagacagtcaaggagtggctta

SEQ ID NO: 3799954 - DNA, 11 bp, Homo sapiens
ttagacctcag

SEQ ID NO: 3799955 - DNA, 17 bp, Homo sapiens
ttagaggaaaaaaatga

SEQ ID NO: 3799956 - DNA, 19 bp, Homo sapiens
ttagaggaaaaaaatgact

SEQ ID NO: 3799957 - DNA, 12 bp, Homo sapiens
ttagaggccagc

SEQ ID NO: 3799958 - DNA, 13 bp, Homo sapiens
ttagcaaagagtt

SEQ ID NO: 3799959 - DNA, 19 bp, Homo sapiens
ttagcaaagagttaatata

SEQ ID NO: 3799960 - DNA, 18 bp, Homo sapiens
ttagcaaattctgttttt

SEQ ID NO: 3799961 - DNA, 17 bp, Homo sapiens
ttagcacaaaaaaaatt

SEQ ID NO: 3799962 - DNA, 18 bp, Homo sapiens
ttagcacgtttaaagttc

SEQ ID NO: 3799963 - DNA, 18 bp, Homo sapiens
ttagcaggaagctgtgag

SEQ ID NO: 3799964 - DNA, 22 bp, Homo sapiens
ttagcatgacaagccccaggca

SEQ ID NO: 3799965 - DNA, 22 bp, Homo sapiens
ttagcatttagtccaatgtctt

SEQ ID NO: 3799966 - DNA, 14 bp, Homo sapiens
ttagccccataatt

SEQ ID NO: 3799967 - DNA, 13 bp, Homo sapiens
ttagccgggcgtg

SEQ ID NO: 3799968 - DNA, 12 bp, Homo sapiens
ttagctcagccc

SEQ ID NO: 3799969 - DNA, 18 bp, Homo sapiens
ttgaacacagtattttcc

SEQ ID NO: 3799970 - DNA, 20 bp, Homo sapiens
ttgaacacagtattttccca

SEQ ID NO: 3799971 - DNA, 13 bp, Homo sapiens
ttgaacactgggg

SEQ ID NO: 3799972 - DNA, 14 bp, Homo sapiens
ttgaaccaaaacat

SEQ ID NO: 3799973 - DNA, 15 bp, Homo sapiens
ttgaagacactgaaa

SEQ ID NO: 3799974 - DNA, 21 bp, Homo sapiens
ttgaagccactgaagctggga

SEQ ID NO: 3799975 - DNA, 16 bp, Homo sapiens
ttgaagccatctaaag

SEQ ID NO: 3799976 - DNA, 15 bp, Homo sapiens
ttgaagctaattatt

SEQ ID NO: 3799977 - DNA, 13 bp, Homo sapiens
ttgaagctctggt

SEQ ID NO: 3799978 - DNA, 23 bp, Homo sapiens
ttgaagctctggtgacaccagcc

SEQ ID NO: 3799979 - DNA, 17 bp, Homo sapiens
ttgaaggaaagatttgt

SEQ ID NO: 3799980 - DNA, 12 bp, Homo sapiens
ttgaagtaatga

SEQ ID NO: 3799981 - DNA, 21 bp, Homo sapiens
ttgaataaagcctgcttttta

SEQ ID NO: 3799982 - DNA, 19 bp, Homo sapiens
ttgaatatattataatctt

SEQ ID NO: 3799983 - DNA, 16 bp, Homo sapiens
ttgaatgcttcctgac

SEQ ID NO: 3799984 - DNA, 18 bp, Homo sapiens
ttgaatggcctgccttga

SEQ ID NO: 3799985 - DNA, 13 bp, Homo sapiens
ttgaatttaacaa

SEQ ID NO: 3799986 - DNA, 20 bp, Homo sapiens
ttgaatttaacaatgcgaat

SEQ ID NO: 3799987 - DNA, 16 bp, Homo sapiens
ttgaattttcaagcat

SEQ ID NO: 3799988 - DNA, 18 bp, Homo sapiens
ttgaattttcaagcatct

SEQ ID NO: 3799989 - DNA, 23 bp, Homo sapiens
ttgaattttcaagcatctcctga

SEQ ID NO: 3799990 - DNA, 14 bp, Homo sapiens
ttgacaacaaatta

SEQ ID NO: 3799991 - DNA, 21 bp, Homo sapiens
ttgacaagttgcgacggagag

SEQ ID NO: 3799992 - DNA, 15 bp, Homo sapiens
ttgacaattcctaga

SEQ ID NO: 3799993 - DNA, 15 bp, Homo sapiens
ttgacagaacactgt

SEQ ID NO: 3799994 - DNA, 19 bp, Homo sapiens
ttgacaggattattggaaa

SEQ ID NO: 3799995 - DNA, 10 bp, Homo sapiens
ttgacagggc

SEQ ID NO: 3799996 - DNA, 12 bp, Homo sapiens
ttgacagggcac

SEQ ID NO: 3799997 - DNA, 19 bp, Homo sapiens
ttgacagtaacttggttat

SEQ ID NO: 3799998 - DNA, 19 bp, Homo sapiens
ttgacagtgttgaaaatgt

SEQ ID NO: 3799999 - DNA, 19 bp, Homo sapiens
ttgactagggattcaggct

SEQ ID NO: 3800000 - DNA, 17 bp, Homo sapiens
ttgactatcaaactgaa

SEQ ID NO: 3800001 - DNA, 15 bp, Homo sapiens
ttgactcttttgcca

SEQ ID NO: 3800002 - DNA, 20 bp, Homo sapiens
ttgacttgacagaacactgt

SEQ ID NO: 3800003 - DNA, 12 bp, Homo sapiens
ttgactttcagg

SEQ ID NO: 3800004 - DNA, 10 bp, Homo sapiens
ttgagaaacc

SEQ ID NO: 3800005 - DNA, 16 bp, Homo sapiens
ttgagaaatgaataat

SEQ ID NO: 3800006 - DNA, 19 bp, Homo sapiens
ttgagaactgcatatgttt

SEQ ID NO: 3800007 - DNA, 17 bp, Homo sapiens
ttgagacaaaaattatc

SEQ ID NO: 3800008 - DNA, 12 bp, Homo sapiens
ttgagacagagt

SEQ ID NO: 3800009 - DNA, 13 bp, Homo sapiens
ttgagaccagcct

SEQ ID NO: 3800010 - DNA, 15 bp, Homo sapiens
ttgagaccagcctgg

SEQ ID NO: 3800011 - DNA, 14 bp, Homo sapiens
ttgagacctcagcc

SEQ ID NO: 3800012 - DNA, 17 bp, Homo sapiens
ttgagacctcagccatg

SEQ ID NO: 3800013 - DNA, 15 bp, Homo sapiens
ttgagactttttggt

SEQ ID NO: 3800014 - DNA, 16 bp, Homo sapiens
ttgagatcagcctggg

SEQ ID NO: 3800015 - DNA, 11 bp, Homo sapiens
ttgagcctggg

SEQ ID NO: 3800016 - DNA, 14 bp, Homo sapiens
ttgagcctgggagg

SEQ ID NO: 3800017 - DNA, 14 bp, Homo sapiens
ttgagctgagatgg

SEQ ID NO: 3800018 - DNA, 22 bp, Homo sapiens
ttgagggacaaatttaaaacaa

SEQ ID NO: 3800019 - DNA, 22 bp, Homo sapiens
ttgaggtcaagtaagaagacat

SEQ ID NO: 3800020 - DNA, 19 bp, Homo sapiens
ttgaggtggaagccctcct

SEQ ID NO: 3800021 - DNA, 22 bp, Homo sapiens
ttgaggtggaagccctccttcc

SEQ ID NO: 3800022 - DNA, 20 bp, Homo sapiens
ttgagtagagagcaagggaa

SEQ ID NO: 3800023 - DNA, 16 bp, Homo sapiens
ttgagttcaggtagct

SEQ ID NO: 3800024 - DNA, 11 bp, Homo sapiens
ttgataacagc

SEQ ID NO: 3800025 - DNA, 13 bp, Homo sapiens
ttgatacttgttt

SEQ ID NO: 3800026 - DNA, 21 bp, Homo sapiens
ttgatatacttttttcttatt

SEQ ID NO: 3800027 - DNA, 13 bp, Homo sapiens
ttgatatgaaaaa

SEQ ID NO: 3800028 - DNA, 22 bp, Homo sapiens
ttgatatgaaaaatatgatatt

SEQ ID NO: 3800029 - DNA, 13 bp, Homo sapiens
ttgatgactggaa

SEQ ID NO: 3800030 - DNA, 15 bp, Homo sapiens
ttgatgactggaatt

SEQ ID NO: 3800031 - DNA, 18 bp, Homo sapiens
ttgatgagtgtaacaaga

SEQ ID NO: 3800032 - DNA, 19 bp, Homo sapiens
ttgatgagtgtaacaagaa

SEQ ID NO: 3800033 - DNA, 14 bp, Homo sapiens
ttgatggggaagga

SEQ ID NO: 3800034 - DNA, 23 bp, Homo sapiens
ttgatggtgatgaaatgtaaata

SEQ ID NO: 3800035 - DNA, 13 bp, Homo sapiens
ttgatgtttgtgg

SEQ ID NO: 3800036 - DNA, 15 bp, Homo sapiens
ttgatgtttgtggcc

SEQ ID NO: 3800037 - DNA, 17 bp, Homo sapiens
ttgatttcccttcttct

SEQ ID NO: 3800038 - DNA, 21 bp, Homo sapiens
ttgcaaaatttccagtacctt

SEQ ID NO: 3800039 - DNA, 22 bp, Homo sapiens
ttgcaaaatttccagtaccttt

SEQ ID NO: 3800040 - DNA, 23 bp, Homo sapiens
ttgcaaaatttccagtacctttg

SEQ ID NO: 3800041 - DNA, 13 bp, Homo sapiens
ttgcaaggaagcc

SEQ ID NO: 3800042 - DNA, 14 bp, Homo sapiens
ttgcaatggcagcc

SEQ ID NO: 3800043 - DNA, 22 bp, Homo sapiens
ttgcaatgtcacaacctctctg

SEQ ID NO: 3800044 - DNA, 19 bp, Homo sapiens
ttgcacaaaccaattaaac

SEQ ID NO: 3800045 - DNA, 22 bp, Homo sapiens
ttgcacactcccctgcactgga

SEQ ID NO: 3800046 - DNA, 17 bp, Homo sapiens
ttgcacctacctcacag

SEQ ID NO: 3800047 - DNA, 22 bp, Homo sapiens
ttgcagaaacattttgtggtca

SEQ ID NO: 3800048 - DNA, 16 bp, Homo sapiens
ttgcagacaggcaagc

SEQ ID NO: 3800049 - DNA, 23 bp, Homo sapiens
ttgcagacaggcaagcacctcct

SEQ ID NO: 3800050 - DNA, 18 bp, Homo sapiens
ttgcagagaagccttggt

SEQ ID NO: 3800051 - DNA, 14 bp, Homo sapiens
ttgcagagacagga

SEQ ID NO: 3800052 - DNA, 19 bp, Homo sapiens
ttgcagagacaggacctga

SEQ ID NO: 3800053 - DNA, 12 bp, Homo sapiens
ttgcagcagtga

SEQ ID NO: 3800054 - DNA, 14 bp, Homo sapiens
ttgcagcagtgagt

SEQ ID NO: 3800055 - DNA, 18 bp, Homo sapiens
ttgcagcgattaataaca

SEQ ID NO: 3800056 - DNA, 17 bp, Homo sapiens
ttgcagctgggagaagg

SEQ ID NO: 3800057 - DNA, 17 bp, Homo sapiens
ttgcagtctgcttctgc

SEQ ID NO: 3800058 - DNA, 15 bp, Homo sapiens
ttgcataataagcta

SEQ ID NO: 3800059 - DNA, 23 bp, Homo sapiens
ttgcatagtaccaatcattttaa

SEQ ID NO: 3800060 - DNA, 14 bp, Homo sapiens
ttgcatatatacat

SEQ ID NO: 3800061 - DNA, 22 bp, Homo sapiens
ttgcatgctgctttaattgtga

SEQ ID NO: 3800062 - DNA, 15 bp, Homo sapiens
ttgcatttggtcaag

SEQ ID NO: 3800063 - DNA, 18 bp, Homo sapiens
ttgcattttttaaaacaa

SEQ ID NO: 3800064 - DNA, 13 bp, Homo sapiens
ttgccaaaataat

SEQ ID NO: 3800065 - DNA, 19 bp, Homo sapiens
ttgccaccaactggccctc

SEQ ID NO: 3800066 - DNA, 21 bp, Homo sapiens
ttgccaccaactggccctctt

SEQ ID NO: 3800067 - DNA, 15 bp, Homo sapiens
ttgccagaaagcata

SEQ ID NO: 3800068 - DNA, 14 bp, Homo sapiens
ttgccagagatgga

SEQ ID NO: 3800069 - DNA, 18 bp, Homo sapiens
ttgccagtgtctttcttt

SEQ ID NO: 3800070 - DNA, 19 bp, Homo sapiens
ttgccatgttggccaggct

SEQ ID NO: 3800071 - DNA, 13 bp, Homo sapiens
ttgcccaacctca

SEQ ID NO: 3800072 - DNA, 17 bp, Homo sapiens
ttgcccaacctcagcaa

SEQ ID NO: 3800073 - DNA, 17 bp, Homo sapiens
ttgcccagagatgcctc

SEQ ID NO: 3800074 - DNA, 22 bp, Homo sapiens
ttgcccagagatgcctccaccg

SEQ ID NO: 3800075 - DNA, 11 bp, Homo sapiens
ttgcccaggca

SEQ ID NO: 3800076 - DNA, 18 bp, Homo sapiens
ttgcccaggcaggtcttg

SEQ ID NO: 3800077 - DNA, 12 bp, Homo sapiens
ttgcccaggctg

SEQ ID NO: 3800078 - DNA, 23 bp, Homo sapiens
ttgcccaggctggcgtgcagtgg

SEQ ID NO: 3800079 - DNA, 19 bp, Homo sapiens
ttgcccagggctcagcctg

SEQ ID NO: 3800080 - DNA, 13 bp, Homo sapiens
ttgcccctgagac

SEQ ID NO: 3800081 - DNA, 17 bp, Homo sapiens
ttgcccggattctggga

SEQ ID NO: 3800082 - DNA, 19 bp, Homo sapiens
ttgcccggattctgggagg

SEQ ID NO: 3800083 - DNA, 16 bp, Homo sapiens
tttaagtattcaagaa

SEQ ID NO: 3800084 - DNA, 18 bp, Homo sapiens
tttaagtatttaggtttt

SEQ ID NO: 3800085 - DNA, 11 bp, Homo sapiens
tttaataaaag

SEQ ID NO: 3800086 - DNA, 15 bp, Homo sapiens
tttaatataaagcct

SEQ ID NO: 3800087 - DNA, 14 bp, Homo sapiens
tttaatatagctat

SEQ ID NO: 3800088 - DNA, 15 bp, Homo sapiens
tttaatatagctatt

SEQ ID NO: 3800089 - DNA, 16 bp, Homo sapiens
tttaatatagctattt

SEQ ID NO: 3800090 - DNA, 14 bp, Homo sapiens
tttaatatgtattt

SEQ ID NO: 3800091 - DNA, 17 bp, Homo sapiens
tttaatcaaatttgtag

SEQ ID NO: 3800092 - DNA, 14 bp, Homo sapiens
tttaatccagaatt

SEQ ID NO: 3800093 - DNA, 13 bp, Homo sapiens
tttaatcttcagt

SEQ ID NO: 3800094 - DNA, 16 bp, Homo sapiens
tttaattcatgtttct

SEQ ID NO: 3800095 - DNA, 17 bp, Homo sapiens
tttaattgtaaactgta

SEQ ID NO: 3800096 - DNA, 18 bp, Homo sapiens
tttaattgttaagatatg

SEQ ID NO: 3800097 - DNA, 20 bp, Homo sapiens
tttaatttatttattaagat

SEQ ID NO: 3800098 - DNA, 21 bp, Homo sapiens
tttaatttgatgaaagctgat

SEQ ID NO: 3800099 - DNA, 22 bp, Homo sapiens
tttaatttgatgaaagctgatt

SEQ ID NO: 3800100 - DNA, 21 bp, Homo sapiens
tttaatttgccaaaataatgt

SEQ ID NO: 3800101 - DNA, 11 bp, Homo sapiens
tttacaaaaga

SEQ ID NO: 3800102 - DNA, 12 bp, Homo sapiens
tttacaagaaaa

SEQ ID NO: 3800103 - DNA, 15 bp, Homo sapiens
tttacaattgaaatg

SEQ ID NO: 3800104 - DNA, 21 bp, Homo sapiens
tttacaccagttcctttcaat

SEQ ID NO: 3800105 - DNA, 15 bp, Homo sapiens
tttacacttttgaga

SEQ ID NO: 3800106 - DNA, 19 bp, Homo sapiens
tttacagaattgcttgttt

SEQ ID NO: 3800107 - DNA, 20 bp, Homo sapiens
tttacagcctcacttgaatg

SEQ ID NO: 3800108 - DNA, 13 bp, Homo sapiens
tttacagctgcct

SEQ ID NO: 3800109 - DNA, 23 bp, Homo sapiens
tttacagctttcatgattagcaa

SEQ ID NO: 3800110 - DNA, 15 bp, Homo sapiens
tttacatactgctgt

SEQ ID NO: 3800111 - DNA, 21 bp, Homo sapiens
tttaccaagttatataaagag

SEQ ID NO: 3800112 - DNA, 23 bp, Homo sapiens
tttaccagcctccgtatttcaga

SEQ ID NO: 3800113 - DNA, 16 bp, Homo sapiens
tttaccatttgtaata

SEQ ID NO: 3800114 - DNA, 19 bp, Homo sapiens
tttaccatttgtaataaag

SEQ ID NO: 3800115 - DNA, 22 bp, Homo sapiens
tttacccagaatgtcagattcc

SEQ ID NO: 3800116 - DNA, 18 bp, Homo sapiens
tttacctaccacagtgtc

SEQ ID NO: 3800117 - DNA, 15 bp, Homo sapiens
tttacctgtgaaata

SEQ ID NO: 3800118 - DNA, 13 bp, Homo sapiens
tttacgtagtgta

SEQ ID NO: 3800119 - DNA, 14 bp, Homo sapiens
tttactgagcttct

SEQ ID NO: 3800120 - DNA, 12 bp, Homo sapiens
tttactgctttt

SEQ ID NO: 3800121 - DNA, 13 bp, Homo sapiens
tttacttcttata

SEQ ID NO: 3800122 - DNA, 14 bp, Homo sapiens
tttacttcttatac

SEQ ID NO: 3800123 - DNA, 18 bp, Homo sapiens
tttacttgcattgaatat

SEQ ID NO: 3800124 - DNA, 17 bp, Homo sapiens
tttagaacagaaaacaa

SEQ ID NO: 3800125 - DNA, 17 bp, Homo sapiens
tttagatggttacactg

SEQ ID NO: 3800126 - DNA, 13 bp, Homo sapiens
tttagcaccccca

SEQ ID NO: 3800127 - DNA, 21 bp, Homo sapiens
tttagcacgtttaaagttctg

SEQ ID NO: 3800128 - DNA, 15 bp, Homo sapiens
tttagcagttctgca

SEQ ID NO: 3800129 - DNA, 21 bp, Homo sapiens
tttagcagttctgcaaataga

SEQ ID NO: 3800130 - DNA, 16 bp, Homo sapiens
tttagcataaaatttt

SEQ ID NO: 3800131 - DNA, 20 bp, Homo sapiens
tttagcatgacaagccccag

SEQ ID NO: 3800132 - DNA, 16 bp, Homo sapiens
tttaggagaaaccagc

SEQ ID NO: 3800133 - DNA, 19 bp, Homo sapiens
tttagtacccacctgagct

SEQ ID NO: 3800134 - DNA, 17 bp, Homo sapiens
tttagtgtaaaaatgag

SEQ ID NO: 3800135 - DNA, 22 bp, Homo sapiens
tttagtgtaaaaatgagaacat

SEQ ID NO: 3800136 - DNA, 20 bp, Homo sapiens
tttataaaaaaaatgaaatg

SEQ ID NO: 3800137 - DNA, 13 bp, Homo sapiens
tttataaattaaa

SEQ ID NO: 3800138 - DNA, 19 bp, Homo sapiens
tttataactagtcctttac

SEQ ID NO: 3800139 - DNA, 18 bp, Homo sapiens
tttataattttaagattc

SEQ ID NO: 3800140 - DNA, 18 bp, Homo sapiens
tttatacagtagtgagaa

SEQ ID NO: 3800141 - DNA, 18 bp, Homo sapiens
tttatagtttatacagtt

SEQ ID NO: 3800142 - DNA, 12 bp, Homo sapiens
tttatataataa

SEQ ID NO: 3800143 - DNA, 15 bp, Homo sapiens
tttatataataaagt

SEQ ID NO: 3800144 - DNA, 20 bp, Homo sapiens
tttatataataaagtattcc

SEQ ID NO: 3800145 - DNA, 19 bp, Homo sapiens
tttatataattatgttatt

SEQ ID NO: 3800146 - DNA, 16 bp, Homo sapiens
tttatatagcttgaaa

SEQ ID NO: 3800147 - DNA, 14 bp, Homo sapiens
tttatatttaaatg

SEQ ID NO: 3800148 - DNA, 18 bp, Homo sapiens
tttatcacacttctgtga

SEQ ID NO: 3800149 - DNA, 18 bp, Homo sapiens
tttatcagtgacagagtt

SEQ ID NO: 3800150 - DNA, 16 bp, Homo sapiens
tttatcctatctctcc

SEQ ID NO: 3800151 - DNA, 19 bp, Homo sapiens
tttatcctgaaatttcaga

SEQ ID NO: 3800152 - DNA, 12 bp, Homo sapiens
tttatcttttct

SEQ ID NO: 3800153 - DNA, 17 bp, Homo sapiens
tttatgagccagacaaa

SEQ ID NO: 3800154 - DNA, 16 bp, Homo sapiens
tttatgagctcatgta

SEQ ID NO: 3800155 - DNA, 23 bp, Homo sapiens
tttatgagctcatgtagcaatca

SEQ ID NO: 3800156 - DNA, 19 bp, Homo sapiens
tttatgatttactcattat

SEQ ID NO: 3800157 - DNA, 15 bp, Homo sapiens
tttatgcaaggaagg

SEQ ID NO: 3800158 - DNA, 17 bp, Homo sapiens
tttatgcaaggaaggaa

SEQ ID NO: 3800159 - DNA, 18 bp, Homo sapiens
tttatgcaaggaaggaaa

SEQ ID NO: 3800160 - DNA, 11 bp, Homo sapiens
tttatgcaata

SEQ ID NO: 3800161 - DNA, 23 bp, Homo sapiens
tttatggaggatggagagagggg

SEQ ID NO: 3800162 - DNA, 12 bp, Homo sapiens
tttatggcctca

SEQ ID NO: 3800163 - DNA, 13 bp, Homo sapiens
tttatggcctcag

SEQ ID NO: 3800164 - DNA, 20 bp, Homo sapiens
tttatgtatgtttacactgt

SEQ ID NO: 3800165 - DNA, 21 bp, Homo sapiens
tttatgtatgtttacactgtc

SEQ ID NO: 3800166 - DNA, 17 bp, Homo sapiens
tttatgttttgtttctg

SEQ ID NO: 3800167 - DNA, 13 bp, Homo sapiens
tttattaaaatct

SEQ ID NO: 3800168 - DNA, 15 bp, Homo sapiens
tttattaagatggat

SEQ ID NO: 3800169 - DNA, 16 bp, Homo sapiens
tttattacatctttca

SEQ ID NO: 3800170 - DNA, 20 bp, Homo sapiens
tttattatgcataactgaca

SEQ ID NO: 3800171 - DNA, 12 bp, Homo sapiens
tttattcaaggt

SEQ ID NO: 3800172 - DNA, 20 bp, Homo sapiens
tttattcaaggtaaaattct

SEQ ID NO: 3800173 - DNA, 12 bp, Homo sapiens
tttattgacaat

SEQ ID NO: 3800174 - DNA, 15 bp, Homo sapiens
tttattgatgtgcaa

SEQ ID NO: 3800175 - DNA, 16 bp, Homo sapiens
tttattgatgtgcaaa

SEQ ID NO: 3800176 - DNA, 21 bp, Homo sapiens
tttattgcacaaaatataaag

SEQ ID NO: 3800177 - DNA, 19 bp, Homo sapiens
tttattgctgtgtaacact

SEQ ID NO: 3800178 - DNA, 14 bp, Homo sapiens
tttatttatcagtg

SEQ ID NO: 3800179 - DNA, 19 bp, Homo sapiens
tttattttagcagttctgc

SEQ ID NO: 3800180 - DNA, 22 bp, Homo sapiens
tttattttctggtagatagaaa

SEQ ID NO: 3800181 - DNA, 15 bp, Homo sapiens
tttattttgttaaaa

SEQ ID NO: 3800182 - DNA, 14 bp, Homo sapiens
tttatttttttcta

SEQ ID NO: 3800183 - DNA, 22 bp, Homo sapiens
tttcaaaaatttggaattctgt

SEQ ID NO: 3800184 - DNA, 17 bp, Homo sapiens
tttcaaagggagagaga

SEQ ID NO: 3800185 - DNA, 15 bp, Homo sapiens
tttcaaagtacataa

SEQ ID NO: 3800186 - DNA, 20 bp, Homo sapiens
tttcaacgcagccctgcttt

SEQ ID NO: 3800187 - DNA, 17 bp, Homo sapiens
tttcaagaaactgagga

SEQ ID NO: 3800188 - DNA, 18 bp, Homo sapiens
tttcaagacccctgtctt

SEQ ID NO: 3800189 - DNA, 21 bp, Homo sapiens
tttcaagattgatcattttta

SEQ ID NO: 3800190 - DNA, 17 bp, Homo sapiens
tttcaagcatctcctga

SEQ ID NO: 3800191 - DNA, 21 bp, Homo sapiens
tttcaagtgaatctaaaagct

SEQ ID NO: 3800192 - DNA, 21 bp, Homo sapiens
tttcaatggtttgcaaggaag

SEQ ID NO: 3800193 - DNA, 17 bp, Homo sapiens
tttcaattcaaaaatgt

SEQ ID NO: 3800194 - DNA, 18 bp, Homo sapiens
tttcaattcaaaaatgta

SEQ ID NO: 3800195 - DNA, 22 bp, Homo sapiens
tttcaattccacctgcaatcaa

SEQ ID NO: 3800196 - DNA, 13 bp, Homo sapiens
gacagaacactgt

SEQ ID NO: 3800197 - DNA, 13 bp, Homo sapiens
gacagaagaaggc

SEQ ID NO: 3800198 - DNA, 17 bp, Homo sapiens
gacttaggaggctgagg

SEQ ID NO: 3800199 - DNA, 17 bp, Homo sapiens
gacttcaatttcccacc

SEQ ID NO: 3800200 - DNA, 19 bp, Homo sapiens
gacttcaatttcccaccca

SEQ ID NO: 3800201 - DNA, 16 bp, Homo sapiens
gacttgacagaacact

SEQ ID NO: 3800202 - DNA, 18 bp, Homo sapiens
gagaaaatccccattgaa

SEQ ID NO: 3800203 - DNA, 15 bp, Homo sapiens
gagaagggcaggaga

SEQ ID NO: 3800204 - DNA, 13 bp, Homo sapiens
gagaccagcctgg

SEQ ID NO: 3800205 - DNA, 20 bp, Homo sapiens
gagcgaaactccatctcaaa

SEQ ID NO: 3800206 - DNA, 17 bp, Homo sapiens
gagctcaggacactaat

SEQ ID NO: 3800207 - DNA, 12 bp, Homo sapiens
gaggctctctct

SEQ ID NO: 3800208 - DNA, 14 bp, Homo sapiens
gaggctgaggtggg

SEQ ID NO: 3800209 - DNA, 20 bp, Homo sapiens
gagggctccctgctccctcc

SEQ ID NO: 3800210 - DNA, 17 bp, Homo sapiens
gagtagaaagacagagc

SEQ ID NO: 3800211 - DNA, 12 bp, Homo sapiens
gagtttgagacc

SEQ ID NO: 3800212 - DNA, 21 bp, Homo sapiens
gatcaatctgcagtttgtgaa

SEQ ID NO: 3800213 - DNA, 16 bp, Homo sapiens
gatcccagcccaccct

SEQ ID NO: 3800214 - DNA, 17 bp, Homo sapiens
gatcccagcccaccctg

SEQ ID NO: 3800215 - DNA, 20 bp, Homo sapiens
gatcccagcccaccctgccc

SEQ ID NO: 3800216 - DNA, 16 bp, Homo sapiens
gatcttttcaagttaa

SEQ ID NO: 3800217 - DNA, 16 bp, Homo sapiens
gatgcagcattatgat

SEQ ID NO: 3800218 - DNA, 22 bp, Homo sapiens
gattttgaaaaagtaggctgcc

SEQ ID NO: 3800219 - DNA, 19 bp, Homo sapiens
gcaacatagtgagaccctg

SEQ ID NO: 3800220 - DNA, 22 bp, Homo sapiens
gcaccgacttcaatttcccacc

SEQ ID NO: 3800221 - DNA, 13 bp, Homo sapiens
gcactgcccatcc

SEQ ID NO: 3800222 - DNA, 18 bp, Homo sapiens
gcactgcccatcccaccc

SEQ ID NO: 3800223 - DNA, 20 bp, Homo sapiens
gcagatcccagcccaccctg

SEQ ID NO: 3800224 - DNA, 12 bp, Homo sapiens
gcaggagaggaa

SEQ ID NO: 3800225 - DNA, 14 bp, Homo sapiens
gcaggaggaaaggg

SEQ ID NO: 3800226 - DNA, 16 bp, Homo sapiens
gcagtttgtgaacttc

SEQ ID NO: 3800227 - DNA, 19 bp, Homo sapiens
gcatggtgggagctggttg

SEQ ID NO: 3800228 - DNA, 24 bp, Homo sapiens
gcattatgatcccttccccctgct

SEQ ID NO: 3800229 - DNA, 15 bp, Homo sapiens
gccagtgaaatagaa

SEQ ID NO: 3800230 - DNA, 13 bp, Homo sapiens
gcccacaggttta

SEQ ID NO: 3800231 - DNA, 16 bp, Homo sapiens
gcccagcactgcccat

SEQ ID NO: 3800232 - DNA, 14 bp, Homo sapiens
gcccatcccacccc

SEQ ID NO: 3800233 - DNA, 14 bp, Homo sapiens
gcccctttcttccc

SEQ ID NO: 3800234 - DNA, 15 bp, Homo sapiens
gcccctttcttcccc

SEQ ID NO: 3800235 - DNA, 21 bp, Homo sapiens
gccgcagtccaggggtcagca

SEQ ID NO: 3800236 - DNA, 15 bp, Homo sapiens
gcctggccgcagtcc

SEQ ID NO: 3800237 - DNA, 20 bp, Homo sapiens
gcctgggcaacatagtgaga

SEQ ID NO: 3800238 - DNA, 22 bp, Homo sapiens
gcctgggcaacatagtgagacc

SEQ ID NO: 3800239 - DNA, 16 bp, Homo sapiens
gcctgtaatcccagca

SEQ ID NO: 3800240 - DNA, 12 bp, Homo sapiens
gccttgaagtgt

SEQ ID NO: 3800241 - DNA, 12 bp, Homo sapiens
gccttgctgacc

SEQ ID NO: 3800242 - DNA, 19 bp, Homo sapiens
gcctttctaaggctcagcc

SEQ ID NO: 3800243 - DNA, 16 bp, Homo sapiens
gccttttatttcttaa

SEQ ID NO: 3800244 - DNA, 17 bp, Homo sapiens
gctactagggaggctga

SEQ ID NO: 3800245 - DNA, 23 bp, Homo sapiens
gctcacgcctgtaatcccagcac

SEQ ID NO: 3800246 - DNA, 17 bp, Homo sapiens
gctcaggccagtaatcc

SEQ ID NO: 3800247 - DNA, 21 bp, Homo sapiens
gctcaggccagtaatcccagt

SEQ ID NO: 3800248 - DNA, 24 bp, Homo sapiens
gctcaggccagtaatcccagtgac

SEQ ID NO: 3800249 - DNA, 14 bp, Homo sapiens
gctgaggcaattct

SEQ ID NO: 3800250 - DNA, 12 bp, Homo sapiens
gctgaggctgcc

SEQ ID NO: 3800251 - DNA, 20 bp, Homo sapiens
gctgatcaatctgcagtttg

SEQ ID NO: 3800252 - DNA, 22 bp, Homo sapiens
gctgatcaatctgcagtttgtg

SEQ ID NO: 3800253 - DNA, 14 bp, Homo sapiens
gctgccgccaccac

SEQ ID NO: 3800254 - DNA, 12 bp, Homo sapiens
gctgggcatggt

SEQ ID NO: 3800255 - DNA, 14 bp, Homo sapiens
gctgggtaggcagg

SEQ ID NO: 3800256 - DNA, 14 bp, Homo sapiens
ggaaaccctcttct

SEQ ID NO: 3800257 - DNA, 18 bp, Homo sapiens
ggactctggtggctgcca

SEQ ID NO: 3800258 - DNA, 17 bp, Homo sapiens
ggagctggttgaattgt

SEQ ID NO: 3800259 - DNA, 14 bp, Homo sapiens
ggattacttgaaac

SEQ ID NO: 3800260 - DNA, 20 bp, Homo sapiens
ggcagaggttgcagtgagtc

SEQ ID NO: 3800261 - DNA, 16 bp, Homo sapiens
ggcaggtgtcttggac

SEQ ID NO: 3800262 - DNA, 18 bp, Homo sapiens
ggcattatgatcccttcc

SEQ ID NO: 3800263 - DNA, 16 bp, Homo sapiens
ggcccagcactgccca

SEQ ID NO: 3800264 - DNA, 14 bp, Homo sapiens
ggccctcaggccca

SEQ ID NO: 3800265 - DNA, 12 bp, Homo sapiens
ggccttgaagtg

SEQ ID NO: 3800266 - DNA, 18 bp, Homo sapiens
ggcggatcacctgaggtc

SEQ ID NO: 3800267 - DNA, 18 bp, Homo sapiens
ggctccctgctccctccc

SEQ ID NO: 3800268 - DNA, 22 bp, Homo sapiens
ggctccctgctccctccctcca

SEQ ID NO: 3800269 - DNA, 13 bp, Homo sapiens
ggctgaggcagga

SEQ ID NO: 3800270 - DNA, 15 bp, Homo sapiens
ggctgggtaggcagg

SEQ ID NO: 3800271 - DNA, 18 bp, Homo sapiens
ggctgggtaggcaggtgt

SEQ ID NO: 3800272 - DNA, 16 bp, Homo sapiens
ggctgtagccaggaaa

SEQ ID NO: 3800273 - DNA, 16 bp, Homo sapiens
gggaggccaaggcggg

SEQ ID NO: 3800274 - DNA, 21 bp, Homo sapiens
gggctccctgctccctccctc

SEQ ID NO: 3800275 - DNA, 21 bp, Homo sapiens
ggtacatgcctgtaatcccag

SEQ ID NO: 3800276 - DNA, 21 bp, Homo sapiens
ggtatgaccttctaggaagct

SEQ ID NO: 3800277 - DNA, 13 bp, Homo sapiens
ggtcaagaaatgt

SEQ ID NO: 3800278 - DNA, 14 bp, Homo sapiens
ggtcccccctccat

SEQ ID NO: 3800279 - DNA, 18 bp, Homo sapiens
ggtcccccctccattccc

SEQ ID NO: 3800280 - DNA, 17 bp, Homo sapiens
ggtcgccagtgaaatag

SEQ ID NO: 3800281 - DNA, 16 bp, Homo sapiens
ggtgctgacctatagt

SEQ ID NO: 3800282 - DNA, 18 bp, Homo sapiens
ggtttgaatataaacact

SEQ ID NO: 3800283 - DNA, 14 bp, Homo sapiens
gtaatcccagcact

SEQ ID NO: 3800284 - DNA, 12 bp, Homo sapiens
gtactacaattt

SEQ ID NO: 3800285 - DNA, 15 bp, Homo sapiens
gtactacaatttaaa

SEQ ID NO: 3800286 - DNA, 16 bp, Homo sapiens
gtagtgcttattgttt

SEQ ID NO: 3800287 - DNA, 12 bp, Homo sapiens
gtataatatttt

SEQ ID NO: 3800288 - DNA, 20 bp, Homo sapiens
gtcaagaaatgtgacttggc

SEQ ID NO: 3800289 - DNA, 17 bp, Homo sapiens
gtcgccagtgaaataga

SEQ ID NO: 3800290 - DNA, 14 bp, Homo sapiens
gtctccctgaagag

SEQ ID NO: 3800291 - DNA, 17 bp, Homo sapiens
gtctctactaaaaatac

SEQ ID NO: 3800292 - DNA, 20 bp, Homo sapiens
gtgaaagcatcacttgggat

SEQ ID NO: 3800293 - DNA, 15 bp, Homo sapiens
gtgagagtttggtga

SEQ ID NO: 3800294 - DNA, 22 bp, Homo sapiens
gtgcatgaaggtttctgaaaat

SEQ ID NO: 3800295 - DNA, 23 bp, Homo sapiens
gtggttaatgccatggacagaag

SEQ ID NO: 3800296 - DNA, 11 bp, Homo sapiens
gtgtcttgttc

SEQ ID NO: 3800297 - DNA, 21 bp, Homo sapiens
gtgttttcatattgcttctcc

SEQ ID NO: 3800298 - DNA, 15 bp, Homo sapiens
gttctgctgtctccc

SEQ ID NO: 3800299 - DNA, 19 bp, Homo sapiens
gttgacttgacagaacact

SEQ ID NO: 3800300 - DNA, 15 bp, Homo sapiens
gttgagacccaggcc

SEQ ID NO: 3800301 - DNA, 21 bp, Homo sapiens
gtttctgaaaattaacactgc

SEQ ID NO: 3800302 - DNA, 13 bp, Homo sapiens
gtttgaatataaa

SEQ ID NO: 3800303 - DNA, 17 bp, Homo sapiens
gttttcatattgcttct

SEQ ID NO: 3800304 - DNA, 18 bp, Homo sapiens
gttttcatattgcttctc

SEQ ID NO: 3800305 - DNA, 16 bp, Homo sapiens
taatatggggatgcag

SEQ ID NO: 3800306 - DNA, 17 bp, Homo sapiens
tacaaacatgtggttaa

SEQ ID NO: 3800307 - DNA, 15 bp, Homo sapiens
tactagggaggctga

SEQ ID NO: 3800308 - DNA, 16 bp, Homo sapiens
tacttgaaacccacag

SEQ ID NO: 3800309 - DNA, 18 bp, Homo sapiens
tagccaggaaaccctctt

SEQ ID NO: 3800310 - DNA, 13 bp, Homo sapiens
tagctctgccctg

SEQ ID NO: 3800311 - DNA, 18 bp, Homo sapiens
taggaaattgattttgaa

SEQ ID NO: 3800312 - DNA, 24 bp, Homo sapiens
taggttttcttggcccagcactgc

SEQ ID NO: 3800313 - DNA, 18 bp, Homo sapiens
tatgaggtcaagaaatgt

SEQ ID NO: 3800314 - DNA, 16 bp, Homo sapiens
tatggccttgaagtgt

SEQ ID NO: 3800315 - DNA, 18 bp, Homo sapiens
tatgtttttgtgtatttg

SEQ ID NO: 3800316 - DNA, 20 bp, Homo sapiens
tatttgttaatggtttgaat

SEQ ID NO: 3800317 - DNA, 17 bp, Homo sapiens
tatttttatttgtttgt

SEQ ID NO: 3800318 - DNA, 17 bp, Homo sapiens
tcaatattttccatgaa

SEQ ID NO: 3800319 - DNA, 17 bp, Homo sapiens
tcaatggtttgcaagga

SEQ ID NO: 3800320 - DNA, 20 bp, Homo sapiens
tcaatttcccacccatctcc

SEQ ID NO: 3800321 - DNA, 14 bp, Homo sapiens
tcacataggctctc

SEQ ID NO: 3800322 - DNA, 18 bp, Homo sapiens
tcacgaggaatctgggcc

SEQ ID NO: 3800323 - DNA, 11 bp, Homo sapiens
tcactgcagca

SEQ ID NO: 3800324 - DNA, 13 bp, Homo sapiens
tcactgcagcatg

SEQ ID NO: 3800325 - DNA, 15 bp, Homo sapiens
tcagcaggaggaaag

SEQ ID NO: 3800326 - DNA, 15 bp, Homo sapiens
tcagccttgctgacc

SEQ ID NO: 3800327 - DNA, 17 bp, Homo sapiens
tcagccttgctgacctc

SEQ ID NO: 3800328 - DNA, 15 bp, Homo sapiens
tcatagccaaacagg

SEQ ID NO: 3800329 - DNA, 19 bp, Homo sapiens
tcattcagccttgctgacc

SEQ ID NO: 3800330 - DNA, 18 bp, Homo sapiens
tccactttcagtgaaagc

SEQ ID NO: 3800331 - DNA, 14 bp, Homo sapiens
tccagtaggaaatt

SEQ ID NO: 3800332 - DNA, 16 bp, Homo sapiens
tccatgaaaatgcaac

SEQ ID NO: 3800333 - DNA, 22 bp, Homo sapiens
tcccaccccatgaggctcactc

SEQ ID NO: 3800334 - DNA, 23 bp, Homo sapiens
tcccagtgacttaggaggctgag

SEQ ID NO: 3800335 - DNA, 13 bp, Homo sapiens
tccccctgctgat

SEQ ID NO: 3800336 - DNA, 14 bp, Homo sapiens
tccccctgctgatc

SEQ ID NO: 3800337 - DNA, 19 bp, Homo sapiens
tccctggtctggctctgct

SEQ ID NO: 3800338 - DNA, 14 bp, Homo sapiens
tccggaagtaaata

SEQ ID NO: 3800339 - DNA, 15 bp, Homo sapiens
tctacagtactgaca

SEQ ID NO: 3800340 - DNA, 18 bp, Homo sapiens
tctgaaaattaacactgc

SEQ ID NO: 3800341 - DNA, 17 bp, Homo sapiens
tctgatttactctttgg

SEQ ID NO: 3800342 - DNA, 18 bp, Homo sapiens
tctgatttactctttggg

SEQ ID NO: 3800343 - DNA, 14 bp, Homo sapiens
tctgccctggaacc

SEQ ID NO: 3800344 - DNA, 14 bp, Homo sapiens
tctggctctgctgg

SEQ ID NO: 3800345 - DNA, 14 bp, Homo sapiens
tctggtggctgcca

SEQ ID NO: 3800346 - DNA, 21 bp, Homo sapiens
tcttccagaaagcaaggactg

SEQ ID NO: 3800347 - DNA, 14 bp, Homo sapiens
tcttccccaccctg

SEQ ID NO: 3800348 - DNA, 19 bp, Homo sapiens
tctttgggatcttgaagaa

SEQ ID NO: 3800349 - DNA, 14 bp, Homo sapiens
tgaaaattaacact

SEQ ID NO: 3800350 - DNA, 18 bp, Homo sapiens
tgaaaattaacactgctt

SEQ ID NO: 3800351 - DNA, 12 bp, Homo sapiens
tgaaacccacag

SEQ ID NO: 3800352 - DNA, 15 bp, Homo sapiens
tgaatataaacacta

SEQ ID NO: 3800353 - DNA, 16 bp, Homo sapiens
tgaatataaacactat

SEQ ID NO: 3800354 - DNA, 15 bp, Homo sapiens
tgacagaaagcaagg

SEQ ID NO: 3800355 - DNA, 15 bp, Homo sapiens
tgacagaacactgtc

SEQ ID NO: 3800356 - DNA, 16 bp, Homo sapiens
tgacagaacactgtct

SEQ ID NO: 3800357 - DNA, 19 bp, Homo sapiens
tgacctatagtaagtgctt

SEQ ID NO: 3800358 - DNA, 15 bp, Homo sapiens
tgagaccagcctggg

SEQ ID NO: 3800359 - DNA, 19 bp, Homo sapiens
tgagaccagcctgggcaac

SEQ ID NO: 3800360 - DNA, 19 bp, Homo sapiens
tgagggctgggtaggcagg

SEQ ID NO: 3800361 - DNA, 20 bp, Homo sapiens
tgaggtcgggagtttgagac

SEQ ID NO: 3800362 - DNA, 23 bp, Homo sapiens
tgagttgacttgacagaacactg

SEQ ID NO: 3800363 - DNA, 23 bp, Homo sapiens
tgattttgaaaaagtaggctgcc

SEQ ID NO: 3800364 - DNA, 20 bp, Homo sapiens
tgcaaggaagccacagctgg

SEQ ID NO: 3800365 - DNA, 16 bp, Homo sapiens
tgcagtttgtgaactt

SEQ ID NO: 3800366 - DNA, 19 bp, Homo sapiens
tgcatagagccacgtatgt

SEQ ID NO: 3800367 - DNA, 13 bp, Homo sapiens
tgccagcttgtga

SEQ ID NO: 3800368 - DNA, 15 bp, Homo sapiens
tgccagttgaagtga

SEQ ID NO: 3800369 - DNA, 14 bp, Homo sapiens
tgcccttcattcag

SEQ ID NO: 3800370 - DNA, 20 bp, Homo sapiens
tgctaactagcttggaaact

SEQ ID NO: 3800371 - DNA, 15 bp, Homo sapiens
tgctgagttggtgtt

SEQ ID NO: 3800372 - DNA, 19 bp, Homo sapiens
tgcttaacatttgttgaat

SEQ ID NO: 3800373 - DNA, 21 bp, Homo sapiens
tggaaactggatgaggtcata

SEQ ID NO: 3800374 - DNA, 22 bp, Homo sapiens
tggaggagctcaggacactaat

SEQ ID NO: 3800375 - DNA, 23 bp, Homo sapiens
tggatgcggaacccaaattacgt

SEQ ID NO: 3800376 - DNA, 13 bp, Homo sapiens
tggccttgaagtg

SEQ ID NO: 3800377 - DNA, 18 bp, Homo sapiens
tggcggggtcccccctcc

SEQ ID NO: 3800378 - DNA, 18 bp, Homo sapiens
tggctcacgcctgtaatc

SEQ ID NO: 3800379 - DNA, 19 bp, Homo sapiens
tgggaggattacttgaaac

SEQ ID NO: 3800380 - DNA, 13 bp, Homo sapiens
tgggatcttgaag

SEQ ID NO: 3800381 - DNA, 18 bp, Homo sapiens
tggtgatactgtcaagcc

SEQ ID NO: 3800382 - DNA, 23 bp, Homo sapiens
tggtggctgccagcttgtgagct

SEQ ID NO: 3800383 - DNA, 20 bp, Homo sapiens
tggtggtacatgcctgtaat

SEQ ID NO: 3800384 - DNA, 17 bp, Homo sapiens
tggtttgcaaggaagcc

SEQ ID NO: 3800385 - DNA, 23 bp, Homo sapiens
tgtaatcccagcactttgggagg

SEQ ID NO: 3800386 - DNA, 16 bp, Homo sapiens
tgtaatcccagctact

SEQ ID NO: 3800387 - DNA, 12 bp, Homo sapiens
tgtactacaatt

SEQ ID NO: 3800388 - DNA, 15 bp, Homo sapiens
tgtataatattttta

SEQ ID NO: 3800389 - DNA, 19 bp, Homo sapiens
tgtattgcatatatacata

SEQ ID NO: 3800390 - DNA, 18 bp, Homo sapiens
tgtatttgttaatggttt

SEQ ID NO: 3800391 - DNA, 16 bp, Homo sapiens
tgtctccctgaagagt

SEQ ID NO: 3800392 - DNA, 21 bp, Homo sapiens
tgtgaacttcacaagaatggt

SEQ ID NO: 3800393 - DNA, 19 bp, Homo sapiens
tgtgcatagagccacgtat

SEQ ID NO: 3800394 - DNA, 16 bp, Homo sapiens
tgttcactgcagcatg

SEQ ID NO: 3800395 - DNA, 14 bp, Homo sapiens
ttaaagcaaaggag

SEQ ID NO: 3800396 - DNA, 16 bp, Homo sapiens
ttaaggctgaggctgc

SEQ ID NO: 3800397 - DNA, 16 bp, Homo sapiens
ttaatatggggatgca

SEQ ID NO: 3800398 - DNA, 22 bp, Homo sapiens
ttaatatggggatgcagcatta

SEQ ID NO: 3800399 - DNA, 12 bp, Homo sapiens
ttacaaacatgt

SEQ ID NO: 3800400 - DNA, 16 bp, Homo sapiens
ttatagccgaaatgat

SEQ ID NO: 3800401 - DNA, 19 bp, Homo sapiens
ttatgaggtcaagaaatgt

SEQ ID NO: 3800402 - DNA, 21 bp, Homo sapiens
ttatgatgtgggtcaaggaat

SEQ ID NO: 3800403 - DNA, 16 bp, Homo sapiens
ttatggccttgaagtg

SEQ ID NO: 3800404 - DNA, 19 bp, Homo sapiens
ttatttcttaaacaaatgt

SEQ ID NO: 3800405 - DNA, 20 bp, Homo sapiens
ttcaatggtttgcaaggaag

SEQ ID NO: 3800406 - DNA, 17 bp, Homo sapiens
ttcaatttccaagagct

SEQ ID NO: 3800407 - DNA, 19 bp, Homo sapiens
ttcaatttccaagagctga

SEQ ID NO: 3800408 - DNA, 16 bp, Homo sapiens
ttcagtgaaagcatca

SEQ ID NO: 3800409 - DNA, 13 bp, Homo sapiens
ttcagtgctggtg

SEQ ID NO: 3800410 - DNA, 15 bp, Homo sapiens
ttccatgaaaatgca

SEQ ID NO: 3800411 - DNA, 12 bp, Homo sapiens
ttcccacccatc

SEQ ID NO: 3800412 - DNA, 16 bp, Homo sapiens
ttcccacccatctcca

SEQ ID NO: 3800413 - DNA, 14 bp, Homo sapiens
ttccccctgctgat

SEQ ID NO: 3800414 - DNA, 23 bp, Homo sapiens
ttccctggtctggctctgctgga

SEQ ID NO: 3800415 - DNA, 20 bp, Homo sapiens
ttccggaagtaaatacagca

SEQ ID NO: 3800416 - DNA, 20 bp, Homo sapiens
ttcgatgggcccaattctta

SEQ ID NO: 3800417 - DNA, 17 bp, Homo sapiens
ttcttaaacaaatgtat

SEQ ID NO: 3800418 - DNA, 16 bp, Homo sapiens
ttgaaaaagtaggctg

SEQ ID NO: 3800419 - DNA, 17 bp, Homo sapiens
ttgaaaaagtaggctgc

SEQ ID NO: 3800420 - DNA, 16 bp, Homo sapiens
ttgacagaacactgtc

SEQ ID NO: 3800421 - DNA, 19 bp, Homo sapiens
ttgcacacagggaggctgt

SEQ ID NO: 3800422 - DNA, 18 bp, Homo sapiens
ttgggaggccaaggcggg

SEQ ID NO: 3800423 - DNA, 13 bp, Homo sapiens
ttggtgttgacat

SEQ ID NO: 3800424 - DNA, 16 bp, Homo sapiens
ttgtctacttgctcca

SEQ ID NO: 3800425 - DNA, 19 bp, Homo sapiens
ttgtgaacttcacaagaat

SEQ ID NO: 3800426 - DNA, 22 bp, Homo sapiens
ttgtggaggagctcaggacact

SEQ ID NO: 3800427 - DNA, 19 bp, Homo sapiens
tttagttctgctgtctccc

SEQ ID NO: 3800428 - DNA, 18 bp, Homo sapiens
tttatggccttgaagtgt

SEQ ID NO: 3800429 - DNA, 16 bp, Homo sapiens
tttccaagagctgagg

SEQ ID NO: 3800430 - DNA, 17 bp, Homo sapiens
tttccatgaaaatgcaa

SEQ ID NO: 3800431 - DNA, 23 bp, Homo sapiens
tttccggaagtaaatacagcaat

SEQ ID NO: 3800432 - DNA, 20 bp, Homo sapiens
tttctgaaaattaacactgc

SEQ ID NO: 3800433 - DNA, 16 bp, Homo sapiens
tttcttaaacaaatgt

SEQ ID NO: 3800434 - DNA, 14 bp, Homo sapiens
tttgcaaggaagcc

SEQ ID NO: 3800435 - DNA, 11 bp, Homo sapiens
tttgtctactt

SEQ ID NO: 3800436 - DNA, 13 bp, Homo sapiens
tttgtttgtgcat

SEQ ID NO: 3800437 - DNA, 13 bp, Homo sapiens
ttttaattaaata

SEQ ID NO: 3800438 - DNA, 13 bp, Homo sapiens
ttttaatttgata

SEQ ID NO: 3800439 - DNA, 19 bp, Homo sapiens
ttttatgccttttatttct

SEQ ID NO: 3800440 - DNA, 19 bp, Homo sapiens
tttttatttgtttgtgcat

SEQ ID NO: 3800441 - DNA, 17 bp, Homo sapiens
acccacagtttgagacc

SEQ ID NO: 3800442 - DNA, 14 bp, Homo sapiens
accctcttcttccc

SEQ ID NO: 3800443 - DNA, 20 bp, Homo sapiens
accctgcccctttcttcccc

SEQ ID NO: 3800444 - DNA, 21 bp, Homo sapiens
accgacttcaatttcccaccc

SEQ ID NO: 3800445 - DNA, 20 bp, Homo sapiens
acctaggtcgccagtgaaat

SEQ ID NO: 3800446 - DNA, 13 bp, Homo sapiens
acgcacaggtgct

SEQ ID NO: 3800447 - DNA, 20 bp, Homo sapiens
acgccattgcactccagcct

SEQ ID NO: 3800448 - DNA, 16 bp, Homo sapiens
acgcctgtaatcccag

SEQ ID NO: 3800449 - DNA, 18 bp, Homo sapiens
actcaatattttccatga

SEQ ID NO: 3800450 - DNA, 21 bp, Homo sapiens
actcaatattttccatgaaaa

SEQ ID NO: 3800451 - DNA, 23 bp, Homo sapiens
actcattgcagatcccagcccac

SEQ ID NO: 3800452 - DNA, 15 bp, Homo sapiens
actgcagcatgccca

SEQ ID NO: 3800453 - DNA, 18 bp, Homo sapiens
actgcttgtgtttttaac

SEQ ID NO: 3800454 - DNA, 18 bp, Homo sapiens
actttcagtgaaagcatc

SEQ ID NO: 3800455 - DNA, 15 bp, Homo sapiens
agaaagcaaggactg

SEQ ID NO: 3800456 - DNA, 21 bp, Homo sapiens
agaaatgtgacttggccgggc

SEQ ID NO: 3800457 - DNA, 13 bp, Homo sapiens
agaagaaggcagc

SEQ ID NO: 3800458 - DNA, 14 bp, Homo sapiens
agaagaaggcagca

SEQ ID NO: 3800459 - DNA, 22 bp, Homo sapiens
agaagagagtccatatttcaat

SEQ ID NO: 3800460 - DNA, 16 bp, Homo sapiens
agaaggaaaaggcagg

SEQ ID NO: 3800461 - DNA, 22 bp, Homo sapiens
agaagggttacttgctgctcac

SEQ ID NO: 3800462 - DNA, 18 bp, Homo sapiens
agaccagcctgggcaaca

SEQ ID NO: 3800463 - DNA, 22 bp, Homo sapiens
agagaagggcaggagaggaaga

SEQ ID NO: 3800464 - DNA, 17 bp, Homo sapiens
agatcccagcccaccct

SEQ ID NO: 3800465 - DNA, 20 bp, Homo sapiens
agatttgtctacttgctcca

SEQ ID NO: 3800466 - DNA, 18 bp, Homo sapiens
agcaaggactgcccttca

SEQ ID NO: 3800467 - DNA, 21 bp, Homo sapiens
agcactgcccatcccacccca

SEQ ID NO: 3800468 - DNA, 21 bp, Homo sapiens
agcactttgggaggccaaggc

SEQ ID NO: 3800469 - DNA, 17 bp, Homo sapiens
agcatcacttgggatta

SEQ ID NO: 3800470 - DNA, 14 bp, Homo sapiens
agcatgcccagtgc

SEQ ID NO: 3800471 - DNA, 16 bp, Homo sapiens
cagtcttccagaaagc

SEQ ID NO: 3800472 - DNA, 19 bp, Homo sapiens
cagtgacttaggaggctga

SEQ ID NO: 3800473 - DNA, 23 bp, Homo sapiens
cagtttgtgaacttcacaagaat

SEQ ID NO: 3800474 - DNA, 13 bp, Homo sapiens
catagccaaacag

SEQ ID NO: 3800475 - DNA, 12 bp, Homo sapiens
catatttcaatt

SEQ ID NO: 3800476 - DNA, 12 bp, Homo sapiens
catcccacccca

SEQ ID NO: 3800477 - DNA, 13 bp, Homo sapiens
catgaaaatgcaa

SEQ ID NO: 3800478 - DNA, 15 bp, Homo sapiens
catgaaaatgcaaca

SEQ ID NO: 3800479 - DNA, 18 bp, Homo sapiens
catgaaggtttctgaaaa

SEQ ID NO: 3800480 - DNA, 17 bp, Homo sapiens
catgaggctcactcatt

SEQ ID NO: 3800481 - DNA, 21 bp, Homo sapiens
catggacagaagaaggcagca

SEQ ID NO: 3800482 - DNA, 15 bp, Homo sapiens
catggtcgctcaggc

SEQ ID NO: 3800483 - DNA, 19 bp, Homo sapiens
cattaaagtgctttcagaa

SEQ ID NO: 3800484 - DNA, 15 bp, Homo sapiens
cattgcactccagcc

SEQ ID NO: 3800485 - DNA, 22 bp, Homo sapiens
cattgcagatcccagcccaccc

SEQ ID NO: 3800486 - DNA, 17 bp, Homo sapiens
ccaaacaccttcagtgc

SEQ ID NO: 3800487 - DNA, 22 bp, Homo sapiens
ccaagagctgaggcaattctaa

SEQ ID NO: 3800488 - DNA, 11 bp, Homo sapiens
ccaattcttac

SEQ ID NO: 3800489 - DNA, 13 bp, Homo sapiens
ccacccatctcca

SEQ ID NO: 3800490 - DNA, 22 bp, Homo sapiens
ccacggcattatgatcccttcc

SEQ ID NO: 3800491 - DNA, 21 bp, Homo sapiens
ccagaaagcaaggactgccct

SEQ ID NO: 3800492 - DNA, 17 bp, Homo sapiens
ccagcactgcccatccc

SEQ ID NO: 3800493 - DNA, 15 bp, Homo sapiens
ccagcccaccctgcc

SEQ ID NO: 3800494 - DNA, 15 bp, Homo sapiens
ccagtcttccagaaa

SEQ ID NO: 3800495 - DNA, 21 bp, Homo sapiens
ccagttcctttcaatggtttg

SEQ ID NO: 3800496 - DNA, 13 bp, Homo sapiens
ccagttgaagtga

SEQ ID NO: 3800497 - DNA, 14 bp, Homo sapiens
ccatcccaccccat

SEQ ID NO: 3800498 - DNA, 15 bp, Homo sapiens
ccatgaggctcactc

SEQ ID NO: 3800499 - DNA, 19 bp, Homo sapiens
ccattgcactccagcctgg

SEQ ID NO: 3800500 - DNA, 18 bp, Homo sapiens
cccagcactgcccatccc

SEQ ID NO: 3800501 - DNA, 20 bp, Homo sapiens
cccagcctttctaaggctca

SEQ ID NO: 3800502 - DNA, 13 bp, Homo sapiens
cccatcccacccc

SEQ ID NO: 3800503 - DNA, 14 bp, Homo sapiens
ccccatgaggctca

SEQ ID NO: 3800504 - DNA, 12 bp, Homo sapiens
ccccctgctgat

SEQ ID NO: 3800505 - DNA, 16 bp, Homo sapiens
cccgttccctggcgtg

SEQ ID NO: 3800506 - DNA, 17 bp, Homo sapiens
ccctgccagttgaagtg

SEQ ID NO: 3800507 - DNA, 21 bp, Homo sapiens
ccctgcccctttcttccccac

SEQ ID NO: 3800508 - DNA, 22 bp, Homo sapiens
cccttcattcagccttgctgac

SEQ ID NO: 3800509 - DNA, 16 bp, Homo sapiens
ccctttcttccccacc

SEQ ID NO: 3800510 - DNA, 20 bp, Homo sapiens
ccgacttcaatttcccaccc

SEQ ID NO: 3800511 - DNA, 22 bp, Homo sapiens
ccgacttcaatttcccacccat

SEQ ID NO: 3800512 - DNA, 14 bp, Homo sapiens
ccgccaccacggca

SEQ ID NO: 3800513 - DNA, 17 bp, Homo sapiens
cctaccagagcagagaa

SEQ ID NO: 3800514 - DNA, 15 bp, Homo sapiens
cctgccagttgaagt

SEQ ID NO: 3800515 - DNA, 19 bp, Homo sapiens
cctgcccctttcttcccca

SEQ ID NO: 3800516 - DNA, 13 bp, Homo sapiens
cctgctccctccc

SEQ ID NO: 3800517 - DNA, 18 bp, Homo sapiens
cctgctccctccctccac

SEQ ID NO: 3800518 - DNA, 13 bp, Homo sapiens
cctggaggctctc

SEQ ID NO: 3800519 - DNA, 16 bp, Homo sapiens
cctgtaatcccagcta

SEQ ID NO: 3800520 - DNA, 17 bp, Homo sapiens
cctgtaatcccagctac

SEQ ID NO: 3800521 - DNA, 14 bp, Homo sapiens
ccttctaggaagct

SEQ ID NO: 3800522 - DNA, 11 bp, Homo sapiens
ccttgaagtgt

SEQ ID NO: 3800523 - DNA, 20 bp, Homo sapiens
ccttgctgacctcccagcct

SEQ ID NO: 3800524 - DNA, 15 bp, Homo sapiens
cctttagttctgctg

SEQ ID NO: 3800525 - DNA, 18 bp, Homo sapiens
cctttcttccccaccctg

SEQ ID NO: 3800526 - DNA, 21 bp, Homo sapiens
cgatgggcccaattcttacaa

SEQ ID NO: 3800527 - DNA, 12 bp, Homo sapiens
cgcacaggtgct

SEQ ID NO: 3800528 - DNA, 21 bp, Homo sapiens
cgccattgcactccagcctgg

SEQ ID NO: 3800529 - DNA, 16 bp, Homo sapiens
cggggtcccccctcca

SEQ ID NO: 3800530 - DNA, 20 bp, Homo sapiens
ctaaaaaaataaaaatagaa

SEQ ID NO: 3800531 - DNA, 12 bp, Homo sapiens
ctaatacaccag

SEQ ID NO: 3800532 - DNA, 19 bp, Homo sapiens
ctatatacagatgcaagca

SEQ ID NO: 3800533 - DNA, 18 bp, Homo sapiens
ctcaatattttccatgaa

SEQ ID NO: 3800534 - DNA, 13 bp, Homo sapiens
ctccagcctgggc

SEQ ID NO: 3800535 - DNA, 16 bp, Homo sapiens
ctccctgaagagtgaa

SEQ ID NO: 3800536 - DNA, 19 bp, Homo sapiens
ctccctttagttctgctgt

SEQ ID NO: 3800537 - DNA, 16 bp, Homo sapiens
ctctgccctggaacct

SEQ ID NO: 3800538 - DNA, 17 bp, Homo sapiens
ctgaaaattaacactgc

SEQ ID NO: 3800539 - DNA, 18 bp, Homo sapiens
ctgacccttccacagtca

SEQ ID NO: 3800540 - DNA, 22 bp, Homo sapiens
ctgagcttagctctgccctgga

SEQ ID NO: 3800541 - DNA, 11 bp, Homo sapiens
ctgaggctgcc

SEQ ID NO: 3800542 - DNA, 23 bp, Homo sapiens
ctgatcaatctgcagtttgtgaa

SEQ ID NO: 3800543 - DNA, 23 bp, Homo sapiens
ctgcattggactgagggctgggt

SEQ ID NO: 3800544 - DNA, 16 bp, Homo sapiens
ctgccctgacccttcc

SEQ ID NO: 3800545 - DNA, 13 bp, Homo sapiens
ctggaacctacca

SEQ ID NO: 3800546 - DNA, 18 bp, Homo sapiens
ctggcggggtcccccctc

SEQ ID NO: 3800547 - DNA, 19 bp, Homo sapiens
ctgggatgtttctgtcaca

SEQ ID NO: 3800548 - DNA, 22 bp, Homo sapiens
ctgggcaacatagtgagaccct

SEQ ID NO: 3800549 - DNA, 17 bp, Homo sapiens
ctggggactgcattgga

SEQ ID NO: 3800550 - DNA, 14 bp, Homo sapiens
ctgggtaggcaggt

SEQ ID NO: 3800551 - DNA, 17 bp, Homo sapiens
ctgggtaggcaggtgtc

SEQ ID NO: 3800552 - DNA, 16 bp, Homo sapiens
ctgtctccctgaagag

SEQ ID NO: 3800553 - DNA, 14 bp, Homo sapiens
cttaaacaaatgta

SEQ ID NO: 3800554 - DNA, 19 bp, Homo sapiens
cttagctctgccctggaac

SEQ ID NO: 3800555 - DNA, 14 bp, Homo sapiens
cttcaatttcccac

SEQ ID NO: 3800556 - DNA, 17 bp, Homo sapiens
cttcaatttcccaccca

SEQ ID NO: 3800557 - DNA, 23 bp, Homo sapiens
cttcaatttcccacccatctcca

SEQ ID NO: 3800558 - DNA, 16 bp, Homo sapiens
cttccagaaagcaagg

SEQ ID NO: 3800559 - DNA, 11 bp, Homo sapiens
cttccccaccc

SEQ ID NO: 3800560 - DNA, 21 bp, Homo sapiens
cttccccaccctggaggctct

SEQ ID NO: 3800561 - DNA, 18 bp, Homo sapiens
cttctccctttagttctg

SEQ ID NO: 3800562 - DNA, 14 bp, Homo sapiens
cttgacagaacact

SEQ ID NO: 3800563 - DNA, 12 bp, Homo sapiens
cacccatctcca

SEQ ID NO: 3800564 - DNA, 22 bp, Homo sapiens
caccctgcccctttcttcccca

SEQ ID NO: 3800565 - DNA, 20 bp, Homo sapiens
caccgacttcaatttcccac

SEQ ID NO: 3800566 - DNA, 20 bp, Homo sapiens
cacctaggtcgccagtgaaa

SEQ ID NO: 3800567 - DNA, 13 bp, Homo sapiens
cacggcattatga

SEQ ID NO: 3800568 - DNA, 21 bp, Homo sapiens
cacggcattatgatcccttcc

SEQ ID NO: 3800569 - DNA, 22 bp, Homo sapiens
cacggcattatgatcccttccc

SEQ ID NO: 3800570 - DNA, 21 bp, Homo sapiens
cactcattgcagatcccagcc

SEQ ID NO: 3800571 - DNA, 12 bp, Homo sapiens
cactgcccatcc

SEQ ID NO: 3800572 - DNA, 13 bp, Homo sapiens
cactgcccatccc

SEQ ID NO: 3800573 - DNA, 16 bp, Homo sapiens
cactgcccatcccacc

SEQ ID NO: 3800574 - DNA, 17 bp, Homo sapiens
cactgcccatcccaccc

SEQ ID NO: 3800575 - DNA, 19 bp, Homo sapiens
cactttcagtgaaagcatc

SEQ ID NO: 3800576 - DNA, 15 bp, Homo sapiens
cagaagaaggcagca

SEQ ID NO: 3800577 - DNA, 17 bp, Homo sapiens
cagatcccagcccaccc

SEQ ID NO: 3800578 - DNA, 21 bp, Homo sapiens
cagcaattaataatgtttata

SEQ ID NO: 3800579 - DNA, 17 bp, Homo sapiens
cagcactgcccatccca

SEQ ID NO: 3800580 - DNA, 18 bp, Homo sapiens
cagcactgcccatcccac

SEQ ID NO: 3800581 - DNA, 17 bp, Homo sapiens
cagcccaaagaaggaaa

SEQ ID NO: 3800582 - DNA, 15 bp, Homo sapiens
cagcccaccctgccc

SEQ ID NO: 3800583 - DNA, 19 bp, Homo sapiens
cagcccgaccaacatggag

SEQ ID NO: 3800584 - DNA, 18 bp, Homo sapiens
caggaactagattataag

SEQ ID NO: 3800585 - DNA, 20 bp, Homo sapiens
caggaactagattataagcc

SEQ ID NO: 3800586 - DNA, 13 bp, Homo sapiens
caggagaggaaga

SEQ ID NO: 3800587 - DNA, 16 bp, Homo sapiens
caggcccacaggttta

SEQ ID NO: 3800588 - DNA, 20 bp, Homo sapiens
caggtatgaccttctaggaa

SEQ ID NO: 3800589 - DNA, 22 bp, Homo sapiens
caggtttaaggctgaggctgcc

SEQ ID NO: 3800590 - DNA, 17 bp, Homo sapiens
cagtaatcccagtgact

SEQ ID NO: 3800591 - DNA, 16 bp, Homo sapiens
cagtccaggggtcagc

SEQ ID NO: 3800592 - DNA, 17 bp, Homo sapiens
cagtcttccagaaagca

SEQ ID NO: 3800593 - DNA, 13 bp, Homo sapiens
cagtgaaagcatc

SEQ ID NO: 3800594 - DNA, 21 bp, Homo sapiens
cagtgacttaggaggctgagg

SEQ ID NO: 3800595 - DNA, 22 bp, Homo sapiens
cagtgctggtggccctcaggcc

SEQ ID NO: 3800596 - DNA, 20 bp, Homo sapiens
cagtttgagaccagcctggg

SEQ ID NO: 3800597 - DNA, 12 bp, Homo sapiens
cagtttgtgaac

SEQ ID NO: 3800598 - DNA, 15 bp, Homo sapiens
catagccaaacagga

SEQ ID NO: 3800599 - DNA, 21 bp, Homo sapiens
catagtgagaccctgtctcta

SEQ ID NO: 3800600 - DNA, 19 bp, Homo sapiens
catgcctgtaatcccagct

SEQ ID NO: 3800601 - DNA, 18 bp, Homo sapiens
cattcagccttgctgacc

SEQ ID NO: 3800602 - DNA, 17 bp, Homo sapiens
cattgcactccagcctg

SEQ ID NO: 3800603 - DNA, 19 bp, Homo sapiens
cattgcactccagcctggg

SEQ ID NO: 3800604 - DNA, 20 bp, Homo sapiens
catttcatagccaaacagga

SEQ ID NO: 3800605 - DNA, 14 bp, Homo sapiens
catttgttgaatag

SEQ ID NO: 3800606 - DNA, 18 bp, Homo sapiens
ccaattcttacaaacatg

SEQ ID NO: 3800607 - DNA, 19 bp, Homo sapiens
ccaattcttacaaacatgt

SEQ ID NO: 3800608 - DNA, 22 bp, Homo sapiens
ccacagtttgagaccagcctgg

SEQ ID NO: 3800609 - DNA, 17 bp, Homo sapiens
ccacgggactctggtgg

SEQ ID NO: 3800610 - DNA, 20 bp, Homo sapiens
ccagcactgcccatcccacc

SEQ ID NO: 3800611 - DNA, 17 bp, Homo sapiens
ccagcctttctaaggct

SEQ ID NO: 3800612 - DNA, 23 bp, Homo sapiens
ccagctactagggaggctgaggc

SEQ ID NO: 3800613 - DNA, 21 bp, Homo sapiens
ccaggaaaccctcttcttccc

SEQ ID NO: 3800614 - DNA, 14 bp, Homo sapiens
ccaggtagaacaca

SEQ ID NO: 3800615 - DNA, 23 bp, Homo sapiens
ccaggtgtggtggtacatgcctg

SEQ ID NO: 3800616 - DNA, 15 bp, Homo sapiens
ccagtgaaatagaac

SEQ ID NO: 3800617 - DNA, 20 bp, Homo sapiens
ccagtgacttaggaggctga

SEQ ID NO: 3800618 - DNA, 21 bp, Homo sapiens
ccagtgatgctaaaggttgta

SEQ ID NO: 3800619 - DNA, 15 bp, Homo sapiens
ccagtgccacgcaca

SEQ ID NO: 3800620 - DNA, 23 bp, Homo sapiens
ccagttcctttcaatggtttgca

SEQ ID NO: 3800621 - DNA, 18 bp, Homo sapiens
ccattgcactccagcctg

SEQ ID NO: 3800622 - DNA, 15 bp, Homo sapiens
cccacagtttgagac

SEQ ID NO: 3800623 - DNA, 22 bp, Homo sapiens
cccaccctgcccctttcttccc

SEQ ID NO: 3800624 - DNA, 22 bp, Homo sapiens
cccagcactgcccatcccaccc

SEQ ID NO: 3800625 - DNA, 15 bp, Homo sapiens
cccagggaagttttg

SEQ ID NO: 3800626 - DNA, 12 bp, Homo sapiens
cccatcccaccc

SEQ ID NO: 3800627 - DNA, 18 bp, Homo sapiens
cccatgaggctcactcat

SEQ ID NO: 3800628 - DNA, 16 bp, Homo sapiens
cccctttcttccccac

SEQ ID NO: 3800629 - DNA, 13 bp, Homo sapiens
ccctcttcttccc

SEQ ID NO: 3800630 - DNA, 22 bp, Homo sapiens
ccctgccagttgaagtgagagt

SEQ ID NO: 3800631 - DNA, 13 bp, Homo sapiens
ccctggaggctct

SEQ ID NO: 3800632 - DNA, 16 bp, Homo sapiens
ccctggtctggctctg

SEQ ID NO: 3800633 - DNA, 12 bp, Homo sapiens
cccttccccctg

SEQ ID NO: 3800634 - DNA, 18 bp, Homo sapiens
cccttccccctgctgatc

SEQ ID NO: 3800635 - DNA, 15 bp, Homo sapiens
ccctttagttctgct

SEQ ID NO: 3800636 - DNA, 19 bp, Homo sapiens
ccgacttcaatttcccacc

SEQ ID NO: 3800637 - DNA, 16 bp, Homo sapiens
cctaggtcgccagtga

SEQ ID NO: 3800638 - DNA, 11 bp, Homo sapiens
cctccattccc

SEQ ID NO: 3800639 - DNA, 16 bp, Homo sapiens
cctctagaacagccag

SEQ ID NO: 3800640 - DNA, 22 bp, Homo sapiens
cctgaggtcgggagtttgagac

SEQ ID NO: 3800641 - DNA, 22 bp, Homo sapiens
cctgcatggtgggagctggttg

SEQ ID NO: 3800642 - DNA, 20 bp, Homo sapiens
cctgctccctccctccaccg

SEQ ID NO: 3800643 - DNA, 12 bp, Homo sapiens
cctggaggctct

SEQ ID NO: 3800644 - DNA, 20 bp, Homo sapiens
cctggaggctctctctgcct

SEQ ID NO: 3800645 - DNA, 14 bp, Homo sapiens
cctgtaatcccagc

SEQ ID NO: 3800646 - DNA, 12 bp, Homo sapiens
ccttgaagtgtt

SEQ ID NO: 3800647 - DNA, 23 bp, Homo sapiens
ccttgctgacctcccagcctttc

SEQ ID NO: 3800648 - DNA, 17 bp, Homo sapiens
cctttcttccccaccct

SEQ ID NO: 3800649 - DNA, 14 bp, Homo sapiens
cgcacaggtgctga

SEQ ID NO: 3800650 - DNA, 17 bp, Homo sapiens
cgccattgcactccagc

SEQ ID NO: 3800651 - DNA, 14 bp, Homo sapiens
cgcctgtaatccca

SEQ ID NO: 3800652 - DNA, 18 bp, Homo sapiens
cgcctgtaatcccagcac

SEQ ID NO: 3800653 - DNA, 20 bp, Homo sapiens
cgctcaggccagtaatccca

SEQ ID NO: 3800654 - DNA, 20 bp, Homo sapiens
cgggaggcagaggttgcagt

SEQ ID NO: 3800655 - DNA, 14 bp, Homo sapiens
ctaaggctcagccc

SEQ ID NO: 3800656 - DNA, 18 bp, Homo sapiens
ctacagtactgacagaaa

SEQ ID NO: 3800657 - DNA, 21 bp, Homo sapiens
ctacagtactgacagaaagca

SEQ ID NO: 3800658 - DNA, 14 bp, Homo sapiens
ctagggaggctgag

SEQ ID NO: 3800659 - DNA, 15 bp, Homo sapiens
ctagggaggctgagg

SEQ ID NO: 3800660 - DNA, 16 bp, Homo sapiens
ctaggtcgccagtgaa

SEQ ID NO: 3800661 - DNA, 19 bp, Homo sapiens
ctaggtcgccagtgaaata

SEQ ID NO: 3800662 - DNA, 15 bp, Homo sapiens
ctatagtaagtgctt

SEQ ID NO: 3800663 - DNA, 14 bp, Homo sapiens
ctatattgtacaca

SEQ ID NO: 3800664 - DNA, 11 bp, Homo sapiens
ctcaatatttt

SEQ ID NO: 3800665 - DNA, 19 bp, Homo sapiens
ctcaatattttccatgaaa

SEQ ID NO: 3800666 - DNA, 13 bp, Homo sapiens
ctcacgcctgtaa

SEQ ID NO: 3800667 - DNA, 22 bp, Homo sapiens
ctcaggccagtaatcccagtga

SEQ ID NO: 3800668 - DNA, 19 bp, Homo sapiens
ctcattgcagatcccagcc

SEQ ID NO: 3800669 - DNA, 12 bp, Homo sapiens
ctccagcctggg

SEQ ID NO: 3800670 - DNA, 15 bp, Homo sapiens
ctccctccctccacc

SEQ ID NO: 3800671 - DNA, 18 bp, Homo sapiens
ctccctttagttctgctg

SEQ ID NO: 3800672 - DNA, 14 bp, Homo sapiens
ctctggtggctgcc

SEQ ID NO: 3800673 - DNA, 16 bp, Homo sapiens
ctgaaaattaacactg

SEQ ID NO: 3800674 - DNA, 12 bp, Homo sapiens
ctgaagagtgaa

SEQ ID NO: 3800675 - DNA, 20 bp, Homo sapiens
ctgagggctgggtaggcagg

SEQ ID NO: 3800676 - DNA, 21 bp, Homo sapiens
ctgagttggtgttgacatgtg

SEQ ID NO: 3800677 - DNA, 18 bp, Homo sapiens
ctgatttactctttggga

SEQ ID NO: 3800678 - DNA, 22 bp, Homo sapiens
caattaataatgtttataagct

SEQ ID NO: 3800679 - DNA, 17 bp, Homo sapiens
caattcttacaaacatg

SEQ ID NO: 3800680 - DNA, 18 bp, Homo sapiens
caattcttacaaacatgt

SEQ ID NO: 3800681 - DNA, 12 bp, Homo sapiens
caatttaaagca

SEQ ID NO: 3800682 - DNA, 18 bp, Homo sapiens
cacagaacaggaactaga

SEQ ID NO: 3800683 - DNA, 16 bp, Homo sapiens
caccaggtagaacaca

SEQ ID NO: 3800684 - DNA, 18 bp, Homo sapiens
caccagttcctttcaatg

SEQ ID NO: 3800685 - DNA, 22 bp, Homo sapiens
caccctggaggctctctctgcc

SEQ ID NO: 3800686 - DNA, 21 bp, Homo sapiens
caccgacttcaatttcccacc

SEQ ID NO: 3800687 - DNA, 11 bp, Homo sapiens
cacctgaaatg

SEQ ID NO: 3800688 - DNA, 18 bp, Homo sapiens
caccttcagtgctggtgg

SEQ ID NO: 3800689 - DNA, 19 bp, Homo sapiens
caccttcagtgctggtggc

SEQ ID NO: 3800690 - DNA, 19 bp, Homo sapiens
cacgccattgcactccagc

SEQ ID NO: 3800691 - DNA, 18 bp, Homo sapiens
cacgcctgtaatcccagc

SEQ ID NO: 3800692 - DNA, 15 bp, Homo sapiens
cactaatacaccagg

SEQ ID NO: 3800693 - DNA, 14 bp, Homo sapiens
cactccagcctggg

SEQ ID NO: 3800694 - DNA, 14 bp, Homo sapiens
cactgcccatccca

SEQ ID NO: 3800695 - DNA, 14 bp, Homo sapiens
cactgtcttgaaga

SEQ ID NO: 3800696 - DNA, 16 bp, Homo sapiens
cagaaagcaaggactg

SEQ ID NO: 3800697 - DNA, 11 bp, Homo sapiens
cagaacactgt

SEQ ID NO: 3800698 - DNA, 13 bp, Homo sapiens
cagagaagggcag

SEQ ID NO: 3800699 - DNA, 20 bp, Homo sapiens
cagagctgggatgtttctgt

SEQ ID NO: 3800700 - DNA, 15 bp, Homo sapiens
cagaggttgcagtga

SEQ ID NO: 3800701 - DNA, 17 bp, Homo sapiens
cagaggttgcagtgagt

SEQ ID NO: 3800702 - DNA, 15 bp, Homo sapiens
cagatcccagcccac

SEQ ID NO: 3800703 - DNA, 15 bp, Homo sapiens
cagcactgcccatcc

SEQ ID NO: 3800704 - DNA, 16 bp, Homo sapiens
cagcactgcccatccc

SEQ ID NO: 3800705 - DNA, 20 bp, Homo sapiens
cagcactgcccatcccaccc

SEQ ID NO: 3800706 - DNA, 18 bp, Homo sapiens
cagccttgctgacctccc

SEQ ID NO: 3800707 - DNA, 21 bp, Homo sapiens
caggaaaccctcttcttccct

SEQ ID NO: 3800708 - DNA, 23 bp, Homo sapiens
caggagacccctttgcaggactt

SEQ ID NO: 3800709 - DNA, 23 bp, Homo sapiens
caggagaggaagatttgtctact

SEQ ID NO: 3800710 - DNA, 20 bp, Homo sapiens
caggccagtaatcccagtga

SEQ ID NO: 3800711 - DNA, 19 bp, Homo sapiens
caggtagaacacaaggtca

SEQ ID NO: 3800712 - DNA, 18 bp, Homo sapiens
cagtaatcccagtgactt

SEQ ID NO: 3800713 - DNA, 17 bp, Homo sapiens
cagtactgacagaaagc

SEQ ID NO: 3800714 - DNA, 21 bp, Homo sapiens
cagtaggaaattgattttgaa

SEQ ID NO: 3800715 - DNA, 14 bp, Homo sapiens
cagtgacttaggag

SEQ ID NO: 3800716 - DNA, 18 bp, Homo sapiens
cagtgacttaggaggctg

SEQ ID NO: 3800717 - DNA, 19 bp, Homo sapiens
cagtgcttgattgcgtgga

SEQ ID NO: 3800718 - DNA, 15 bp, Homo sapiens
cagtttgagaccagc

SEQ ID NO: 3800719 - DNA, 18 bp, Homo sapiens
cagtttgagaccagcctg

SEQ ID NO: 3800720 - DNA, 14 bp, Homo sapiens
catagccaaacagg

SEQ ID NO: 3800721 - DNA, 14 bp, Homo sapiens
catctctctttaat

SEQ ID NO: 3800722 - DNA, 22 bp, Homo sapiens
catgaaaatgcaacaacatgta

SEQ ID NO: 3800723 - DNA, 15 bp, Homo sapiens
catgaaggtttctga

SEQ ID NO: 3800724 - DNA, 16 bp, Homo sapiens
catgaggctcactcat

SEQ ID NO: 3800725 - DNA, 14 bp, Homo sapiens
catgcctgtaatcc

SEQ ID NO: 3800726 - DNA, 21 bp, Homo sapiens
catggagaaaccctgtctcta

SEQ ID NO: 3800727 - DNA, 15 bp, Homo sapiens
catgtataatatttt

SEQ ID NO: 3800728 - DNA, 17 bp, Homo sapiens
catgtggttaatgccat

SEQ ID NO: 3800729 - DNA, 18 bp, Homo sapiens
cattatgatcccttcccc

SEQ ID NO: 3800730 - DNA, 19 bp, Homo sapiens
cattatgatcccttccccc

SEQ ID NO: 3800731 - DNA, 21 bp, Homo sapiens
cattatgatcccttccccctg

SEQ ID NO: 3800732 - DNA, 22 bp, Homo sapiens
cattatgatgtgggtcaaggaa

SEQ ID NO: 3800733 - DNA, 14 bp, Homo sapiens
cattgcactccagc

SEQ ID NO: 3800734 - DNA, 18 bp, Homo sapiens
cattgcactccagcctgg

SEQ ID NO: 3800735 - DNA, 21 bp, Homo sapiens
cattgcactccagcctgggca

SEQ ID NO: 3800736 - DNA, 20 bp, Homo sapiens
catttgctaactagcttgga

SEQ ID NO: 3800737 - DNA, 23 bp, Homo sapiens
catttgttgaataggggaaagaa

SEQ ID NO: 3800738 - DNA, 13 bp, Homo sapiens
ccaaacaccttca

SEQ ID NO: 3800739 - DNA, 23 bp, Homo sapiens
ccacagtttgagaccagcctggg

SEQ ID NO: 3800740 - DNA, 17 bp, Homo sapiens
ccaccacggcattatga

SEQ ID NO: 3800741 - DNA, 12 bp, Homo sapiens
ccacccatctcc

SEQ ID NO: 3800742 - DNA, 23 bp, Homo sapiens
ccacggcattatgatcccttccc

SEQ ID NO: 3800743 - DNA, 18 bp, Homo sapiens
ccacgggactctggtggc

SEQ ID NO: 3800744 - DNA, 15 bp, Homo sapiens
ccagcactgcccatc

SEQ ID NO: 3800745 - DNA, 21 bp, Homo sapiens
ccagcctttctaaggctcagc

SEQ ID NO: 3800746 - DNA, 20 bp, Homo sapiens
ccagctactagggaggctga

SEQ ID NO: 3800747 - DNA, 22 bp, Homo sapiens
ccagtaggaaattgattttgaa

SEQ ID NO: 3800748 - DNA, 17 bp, Homo sapiens
ccagtcttccagaaagc

SEQ ID NO: 3800749 - DNA, 18 bp, Homo sapiens
ccagtcttccagaaagca

SEQ ID NO: 3800750 - DNA, 20 bp, Homo sapiens
ccagtcttccagaaagcaag

SEQ ID NO: 3800751 - DNA, 22 bp, Homo sapiens
ccatgaaaatgcaacaacatgt

SEQ ID NO: 3800752 - DNA, 17 bp, Homo sapiens
ccattatgaagaagaga

SEQ ID NO: 3800753 - DNA, 16 bp, Homo sapiens
ccattgcactccagcc

SEQ ID NO: 3800754 - DNA, 17 bp, Homo sapiens
ccattgcactccagcct

SEQ ID NO: 3800755 - DNA, 13 bp, Homo sapiens
cccacccatctcc

SEQ ID NO: 3800756 - DNA, 22 bp, Homo sapiens
cccagtgacttaggaggctgag

SEQ ID NO: 3800757 - DNA, 22 bp, Homo sapiens
ccccatgaggctcactcattgc

SEQ ID NO: 3800758 - DNA, 20 bp, Homo sapiens
ccctcttcttccctggtctg

SEQ ID NO: 3800759 - DNA, 20 bp, Homo sapiens
ccctgcccctttcttcccca

SEQ ID NO: 3800760 - DNA, 22 bp, Homo sapiens
ccctgcccctttcttccccacc

SEQ ID NO: 3800761 - DNA, 13 bp, Homo sapiens
ccctgctccctcc

SEQ ID NO: 3800762 - DNA, 19 bp, Homo sapiens
ccctgctccctccctccac

SEQ ID NO: 3800763 - DNA, 21 bp, Homo sapiens
ccctggtctggctctgctgga

SEQ ID NO: 3800764 - DNA, 19 bp, Homo sapiens
ccctttcttccccaccctg

SEQ ID NO: 3800765 - DNA, 21 bp, Homo sapiens
ccggaagtaaatacagcaatt

SEQ ID NO: 3800766 - DNA, 20 bp, Homo sapiens
cctgacccttccacagtcat

SEQ ID NO: 3800767 - DNA, 15 bp, Homo sapiens
cctgctccctccctc

SEQ ID NO: 3800768 - DNA, 19 bp, Homo sapiens
cctgctccctccctccacc

SEQ ID NO: 3800769 - DNA, 17 bp, Homo sapiens
cctgtaatcccagcact

SEQ ID NO: 3800770 - DNA, 20 bp, Homo sapiens
cctgtaatcccagcactttg

SEQ ID NO: 3800771 - DNA, 15 bp, Homo sapiens
cctgtaatcccagct

SEQ ID NO: 3800772 - DNA, 22 bp, Homo sapiens
cctttctaaggctcagccccac

SEQ ID NO: 3800773 - DNA, 15 bp, Homo sapiens
cctttcttccccacc

SEQ ID NO: 3800774 - DNA, 19 bp, Homo sapiens
cgacttcaatttcccaccc

SEQ ID NO: 3800775 - DNA, 18 bp, Homo sapiens
cgccattgcactccagcc

SEQ ID NO: 3800776 - DNA, 13 bp, Homo sapiens
cgctcaggccagt

SEQ ID NO: 3800777 - DNA, 15 bp, Homo sapiens
cgctcaggccagtaa

SEQ ID NO: 3800778 - DNA, 21 bp, Homo sapiens
cgggagtttgagaccagcccg

SEQ ID NO: 3800779 - DNA, 19 bp, Homo sapiens
cgggcgcggtggctcacgc

SEQ ID NO: 3800780 - DNA, 18 bp, Homo sapiens
cgggtgggaaccaaacac

SEQ ID NO: 3800781 - DNA, 16 bp, Homo sapiens
ctacaatttaaagcaa

SEQ ID NO: 3800782 - DNA, 14 bp, Homo sapiens
ctacagtactgaca

SEQ ID NO: 3800783 - DNA, 15 bp, Homo sapiens
ctacagtactgacag

SEQ ID NO: 3800784 - DNA, 18 bp, Homo sapiens
ctaccagagcagagaagg

SEQ ID NO: 3800785 - DNA, 15 bp, Homo sapiens
ctactagggaggctg

SEQ ID NO: 3800786 - DNA, 17 bp, Homo sapiens
ctactagggaggctgag

SEQ ID NO: 3800787 - DNA, 20 bp, Homo sapiens
ctagggaggctgaggcagga

SEQ ID NO: 3800788 - DNA, 22 bp, Homo sapiens
ctatatacagatgcaagcaagg

SEQ ID NO: 3800789 - DNA, 21 bp, Homo sapiens
ctcacgcctgtaatcccagca

SEQ ID NO: 3800790 - DNA, 20 bp, Homo sapiens
ctcaggccagtaatcccagt

SEQ ID NO: 3800791 - DNA, 13 bp, Homo sapiens
ctccctccctcca

SEQ ID NO: 3800792 - DNA, 18 bp, Homo sapiens
acgcctgtaatcccagca

SEQ ID NO: 3800793 - DNA, 22 bp, Homo sapiens
acggcattatgatcccttcccc

SEQ ID NO: 3800794 - DNA, 18 bp, Homo sapiens
acgtgtactacaatttaa

SEQ ID NO: 3800795 - DNA, 18 bp, Homo sapiens
actagggaggctgaggca

SEQ ID NO: 3800796 - DNA, 15 bp, Homo sapiens
actatattgtacaca

SEQ ID NO: 3800797 - DNA, 15 bp, Homo sapiens
actcaatattttcca

SEQ ID NO: 3800798 - DNA, 23 bp, Homo sapiens
actcaatattttccatgaaaatg

SEQ ID NO: 3800799 - DNA, 16 bp, Homo sapiens
actcacatggctatgt

SEQ ID NO: 3800800 - DNA, 19 bp, Homo sapiens
actcacatggctatgtttt

SEQ ID NO: 3800801 - DNA, 13 bp, Homo sapiens
actccagcctggg

SEQ ID NO: 3800802 - DNA, 15 bp, Homo sapiens
actctggtggctgcc

SEQ ID NO: 3800803 - DNA, 18 bp, Homo sapiens
actgcccatcccacccca

SEQ ID NO: 3800804 - DNA, 20 bp, Homo sapiens
acttcaatttcccacccatc

SEQ ID NO: 3800805 - DNA, 17 bp, Homo sapiens
acttgacagaacactgt

SEQ ID NO: 3800806 - DNA, 14 bp, Homo sapiens
acttgctgctcaca

SEQ ID NO: 3800807 - DNA, 23 bp, Homo sapiens
acttttttgctatccagctattt

SEQ ID NO: 3800808 - DNA, 13 bp, Homo sapiens
agaaagcaaggac

SEQ ID NO: 3800809 - DNA, 20 bp, Homo sapiens
agaacacagaacaggaacta

SEQ ID NO: 3800810 - DNA, 21 bp, Homo sapiens
agaagggttacttgctgctca

SEQ ID NO: 3800811 - DNA, 12 bp, Homo sapiens
agacagagctgg

SEQ ID NO: 3800812 - DNA, 17 bp, Homo sapiens
agaccagcctgggcaac

SEQ ID NO: 3800813 - DNA, 17 bp, Homo sapiens
agactatattgtacaca

SEQ ID NO: 3800814 - DNA, 20 bp, Homo sapiens
agagtttggtgatactgtca

SEQ ID NO: 3800815 - DNA, 17 bp, Homo sapiens
agcactgcccatcccac

SEQ ID NO: 3800816 - DNA, 19 bp, Homo sapiens
agcactttgggaggccaag

SEQ ID NO: 3800817 - DNA, 12 bp, Homo sapiens
agccaaacagga

SEQ ID NO: 3800818 - DNA, 18 bp, Homo sapiens
agccaggaaaccctcttc

SEQ ID NO: 3800819 - DNA, 21 bp, Homo sapiens
agccttatgaggtcaagaaat

SEQ ID NO: 3800820 - DNA, 17 bp, Homo sapiens
agcgaaactccatctca

SEQ ID NO: 3800821 - DNA, 19 bp, Homo sapiens
agctgagcttagctctgcc

SEQ ID NO: 3800822 - DNA, 14 bp, Homo sapiens
agcttagctctgcc

SEQ ID NO: 3800823 - DNA, 23 bp, Homo sapiens
agcttggaaactggatgaggtca

SEQ ID NO: 3800824 - DNA, 18 bp, Homo sapiens
aggaaattgattttgaaa

SEQ ID NO: 3800825 - DNA, 19 bp, Homo sapiens
aggaagatttgtctacttg

SEQ ID NO: 3800826 - DNA, 15 bp, Homo sapiens
aggagaggaagattt

SEQ ID NO: 3800827 - DNA, 15 bp, Homo sapiens
aggattacttgaaac

SEQ ID NO: 3800828 - DNA, 13 bp, Homo sapiens
aggccaaggcggg

SEQ ID NO: 3800829 - DNA, 19 bp, Homo sapiens
aggccagtaatcccagtga

SEQ ID NO: 3800830 - DNA, 13 bp, Homo sapiens
aggctcagcccca

SEQ ID NO: 3800831 - DNA, 14 bp, Homo sapiens
aggctctcaggtgc

SEQ ID NO: 3800832 - DNA, 15 bp, Homo sapiens
agggaatggcacagc

SEQ ID NO: 3800833 - DNA, 18 bp, Homo sapiens
agggaggctgaggcagga

SEQ ID NO: 3800834 - DNA, 21 bp, Homo sapiens
agggctccctgctccctccct

SEQ ID NO: 3800835 - DNA, 20 bp, Homo sapiens
aggtatgaccttctaggaag

SEQ ID NO: 3800836 - DNA, 19 bp, Homo sapiens
aggtcgggagtttgagacc

SEQ ID NO: 3800837 - DNA, 14 bp, Homo sapiens
agtaaatacagcaa

SEQ ID NO: 3800838 - DNA, 12 bp, Homo sapiens
agtaagtgctta

SEQ ID NO: 3800839 - DNA, 11 bp, Homo sapiens
agtaatcccag

SEQ ID NO: 3800840 - DNA, 12 bp, Homo sapiens
agtaggctgccg

SEQ ID NO: 3800841 - DNA, 19 bp, Homo sapiens
agtaggctgccgccaccac

SEQ ID NO: 3800842 - DNA, 19 bp, Homo sapiens
agtcaagatcacgccattg

SEQ ID NO: 3800843 - DNA, 14 bp, Homo sapiens
agtctacagtactg

SEQ ID NO: 3800844 - DNA, 17 bp, Homo sapiens
agtctacagtactgaca

SEQ ID NO: 3800845 - DNA, 17 bp, Homo sapiens
agtcttccagaaagcaa

SEQ ID NO: 3800846 - DNA, 23 bp, Homo sapiens
agtcttccagaaagcaaggactg

SEQ ID NO: 3800847 - DNA, 19 bp, Homo sapiens
agtgccacgcacaggtgct

SEQ ID NO: 3800848 - DNA, 20 bp, Homo sapiens
agtgcttaacatttgttgaa

SEQ ID NO: 3800849 - DNA, 22 bp, Homo sapiens
agtgcttaacatttgttgaata

SEQ ID NO: 3800850 - DNA, 17 bp, Homo sapiens
agttagggaatggcaca

SEQ ID NO: 3800851 - DNA, 13 bp, Homo sapiens
agttctgctgtct

SEQ ID NO: 3800852 - DNA, 18 bp, Homo sapiens
agtttgagaccagcctgg

SEQ ID NO: 3800853 - DNA, 21 bp, Homo sapiens
agtttgagaccagcctgggca

SEQ ID NO: 3800854 - DNA, 20 bp, Homo sapiens
ataatatttttaattaaata

SEQ ID NO: 3800855 - DNA, 17 bp, Homo sapiens
atacagatgcaagcaag

SEQ ID NO: 3800856 - DNA, 15 bp, Homo sapiens
atagccaaacaggag

SEQ ID NO: 3800857 - DNA, 16 bp, Homo sapiens
ataggggaaagaaatt

SEQ ID NO: 3800858 - DNA, 13 bp, Homo sapiens
atagtaagtgctt

SEQ ID NO: 3800859 - DNA, 14 bp, Homo sapiens
atatatacatatat

SEQ ID NO: 3800860 - DNA, 13 bp, Homo sapiens
atatatattttaa

SEQ ID NO: 3800861 - DNA, 16 bp, Homo sapiens
atatggggatgcagca

SEQ ID NO: 3800862 - DNA, 14 bp, Homo sapiens
atatttacgtatga

SEQ ID NO: 3800863 - DNA, 15 bp, Homo sapiens
atatttttaattaaa

SEQ ID NO: 3800864 - DNA, 18 bp, Homo sapiens
atcccagcactttgggag

SEQ ID NO: 3800865 - DNA, 21 bp, Homo sapiens
atctgatttactctttgggat

SEQ ID NO: 3800866 - DNA, 15 bp, Homo sapiens
atctgcagtttgtga

SEQ ID NO: 3800867 - DNA, 16 bp, Homo sapiens
atctgcagtttgtgaa

SEQ ID NO: 3800868 - DNA, 20 bp, Homo sapiens
atgaaaatgcaacaacatgt

SEQ ID NO: 3800869 - DNA, 19 bp, Homo sapiens
atgaaggtttctgaaaatt

SEQ ID NO: 3800870 - DNA, 18 bp, Homo sapiens
atgaccttctaggaagct

SEQ ID NO: 3800871 - DNA, 17 bp, Homo sapiens
atgagctgagcttagct

SEQ ID NO: 3800872 - DNA, 19 bp, Homo sapiens
atgccatggacagaagaag

SEQ ID NO: 3800873 - DNA, 17 bp, Homo sapiens
atgcctgtaatcccagc

SEQ ID NO: 3800874 - DNA, 14 bp, Homo sapiens
atgccttttatttc

SEQ ID NO: 3800875 - DNA, 16 bp, Homo sapiens
atggtttgcaaggaag

SEQ ID NO: 3800876 - DNA, 17 bp, Homo sapiens
atggtttgcaaggaagc

SEQ ID NO: 3800877 - DNA, 18 bp, Homo sapiens
atggtttgcaaggaagcc

SEQ ID NO: 3800878 - DNA, 14 bp, Homo sapiens
atgtatgattacat

SEQ ID NO: 3800879 - DNA, 16 bp, Homo sapiens
atgtgggtcaaggaat

SEQ ID NO: 3800880 - DNA, 17 bp, Homo sapiens
atgtttttgtgtatttg

SEQ ID NO: 3800881 - DNA, 18 bp, Homo sapiens
attaaagtgctttcagaa

SEQ ID NO: 3800882 - DNA, 15 bp, Homo sapiens
attaacaaacaggat

SEQ ID NO: 3800883 - DNA, 15 bp, Homo sapiens
attaataatgtttat

SEQ ID NO: 3800884 - DNA, 20 bp, Homo sapiens
attaatatggggatgcagca

SEQ ID NO: 3800885 - DNA, 17 bp, Homo sapiens
attcagccttgctgacc

SEQ ID NO: 3800886 - DNA, 23 bp, Homo sapiens
attcatttcatagccaaacagga

SEQ ID NO: 3800887 - DNA, 16 bp, Homo sapiens
attcttacaaacatgt

SEQ ID NO: 3800888 - DNA, 17 bp, Homo sapiens
attgcactccagcctgg

SEQ ID NO: 3800889 - DNA, 19 bp, Homo sapiens
attgtacacaccttatatt

SEQ ID NO: 3800890 - DNA, 18 bp, Homo sapiens
atttcccacccatctcca

SEQ ID NO: 3800891 - DNA, 20 bp, Homo sapiens
attttatgccttttatttct

SEQ ID NO: 3800892 - DNA, 21 bp, Homo sapiens
caacaacatgtataatatttt

SEQ ID NO: 3800893 - DNA, 22 bp, Homo sapiens
caacaacatgtataatattttt

SEQ ID NO: 3800894 - DNA, 21 bp, Homo sapiens
caacaagagcgaaactccatc

SEQ ID NO: 3800895 - DNA, 18 bp, Homo sapiens
caacatggagaaaccctg

SEQ ID NO: 3800896 - DNA, 18 bp, Homo sapiens
caacatgtataatatttt

SEQ ID NO: 3800897 - DNA, 23 bp, Homo sapiens
caacatgtataatatttttaatt

SEQ ID NO: 3800898 - DNA, 22 bp, Homo sapiens
caaggcgggcggatcacctgag

SEQ ID NO: 3800899 - DNA, 18 bp, Homo sapiens
caatggcttactccagga

SEQ ID NO: 3800900 - DNA, 19 bp, Homo sapiens
caattcttacaaacatgtg

SEQ ID NO: 3800901 - DNA, 14 bp, Homo sapiens
caatttcccaccca

SEQ ID NO: 3800902 - DNA, 15 bp, Homo sapiens
caatttcccacccat

SEQ ID NO: 3800903 - DNA, 23 bp, Homo sapiens
cacaggtatgaccttctaggaag

SEQ ID NO: 3800904 - DNA, 21 bp, Homo sapiens
cacagtttgagaccagcctgg

SEQ ID NO: 3800905 - DNA, 19 bp, Homo sapiens
cacataggctctcaggtgc

SEQ ID NO: 3800906 - DNA, 17 bp, Homo sapiens
caccacggcattatgat

SEQ ID NO: 3800907 - DNA, 15 bp, Homo sapiens
tggtggtatctgagt

SEQ ID NO: 3800908 - DNA, 13 bp, Homo sapiens
tggttaatgccat

SEQ ID NO: 3800909 - DNA, 23 bp, Homo sapiens
tgtaagtttatggccttgaagtg

SEQ ID NO: 3800910 - DNA, 20 bp, Homo sapiens
tgtatttgttaatggtttga

SEQ ID NO: 3800911 - DNA, 19 bp, Homo sapiens
tgtcttgttcactgcagca

SEQ ID NO: 3800912 - DNA, 21 bp, Homo sapiens
tgtggtggtacatgcctgtaa

SEQ ID NO: 3800913 - DNA, 15 bp, Homo sapiens
tgtggttaatgccat

SEQ ID NO: 3800914 - DNA, 20 bp, Homo sapiens
tgtggttaatgccatggaca

SEQ ID NO: 3800915 - DNA, 22 bp, Homo sapiens
tgttgaataggggaaagaaatt

SEQ ID NO: 3800916 - DNA, 18 bp, Homo sapiens
ttaagttagggaatggca

SEQ ID NO: 3800917 - DNA, 18 bp, Homo sapiens
ttacatcaaggcttcaaa

SEQ ID NO: 3800918 - DNA, 12 bp, Homo sapiens
ttagctctgccc

SEQ ID NO: 3800919 - DNA, 18 bp, Homo sapiens
ttaggaggctgaggtggg

SEQ ID NO: 3800920 - DNA, 17 bp, Homo sapiens
ttcaagttaaattttat

SEQ ID NO: 3800921 - DNA, 14 bp, Homo sapiens
ttcacgaggaatct

SEQ ID NO: 3800922 - DNA, 24 bp, Homo sapiens
ttcactgcagcatgcccagtgcca

SEQ ID NO: 3800923 - DNA, 16 bp, Homo sapiens
ttcagccttgctgacc

SEQ ID NO: 3800924 - DNA, 12 bp, Homo sapiens
ttccaagagctg

SEQ ID NO: 3800925 - DNA, 16 bp, Homo sapiens
ttccccctgctgatca

SEQ ID NO: 3800926 - DNA, 13 bp, Homo sapiens
ttcttccccaccc

SEQ ID NO: 3800927 - DNA, 18 bp, Homo sapiens
ttgaaaaagtaggctgcc

SEQ ID NO: 3800928 - DNA, 12 bp, Homo sapiens
ttgaagtgagag

SEQ ID NO: 3800929 - DNA, 20 bp, Homo sapiens
ttgaataggggaaagaaatt

SEQ ID NO: 3800930 - DNA, 19 bp, Homo sapiens
ttgacttgacagaacactg

SEQ ID NO: 3800931 - DNA, 21 bp, Homo sapiens
ttgacttgacagaacactgtc

SEQ ID NO: 3800932 - DNA, 21 bp, Homo sapiens
ttgagaccagcccgaccaaca

SEQ ID NO: 3800933 - DNA, 15 bp, Homo sapiens
ttgagaccagcctgg

SEQ ID NO: 3800934 - DNA, 19 bp, Homo sapiens
ttgagaccagcctgggcaa

SEQ ID NO: 3800935 - DNA, 17 bp, Homo sapiens
ttgcactccagcctggg

SEQ ID NO: 3800936 - DNA, 21 bp, Homo sapiens
ttgcgtggaattgtgctgagt

SEQ ID NO: 3800937 - DNA, 21 bp, Homo sapiens
ttggccgggcgcggtggctca

SEQ ID NO: 3800938 - DNA, 13 bp, Homo sapiens
ttgggtatcaaca

SEQ ID NO: 3800939 - DNA, 18 bp, Homo sapiens
ttggtgatactgtcaagc

SEQ ID NO: 3800940 - DNA, 19 bp, Homo sapiens
ttgtacacaccttatattt

SEQ ID NO: 3800941 - DNA, 13 bp, Homo sapiens
tttaattaaataa

SEQ ID NO: 3800942 - DNA, 13 bp, Homo sapiens
tttatttcttaaa

SEQ ID NO: 3800943 - DNA, 20 bp, Homo sapiens
tttatttgtttgtgcatttg

SEQ ID NO: 3800944 - DNA, 13 bp, Homo sapiens
tttccaagagctg

SEQ ID NO: 3800945 - DNA, 14 bp, Homo sapiens
tttcttccccaccc

SEQ ID NO: 3800946 - DNA, 16 bp, Homo sapiens
tttcttccccaccctg

SEQ ID NO: 3800947 - DNA, 17 bp, Homo sapiens
tttgaatataaacacta

SEQ ID NO: 3800948 - DNA, 17 bp, Homo sapiens
tttgtctacttgctcca

SEQ ID NO: 3800949 - DNA, 18 bp, Homo sapiens
ttttccatgaaaatgcaa

SEQ ID NO: 3800950 - DNA, 22 bp, Homo sapiens
tttttaactcaatattttccat

SEQ ID NO: 3800951 - DNA, 12 bp, Homo sapiens
aaaaaaagtgtc

SEQ ID NO: 3800952 - DNA, 15 bp, Homo sapiens
aaaaagtaggctgcc

SEQ ID NO: 3800953 - DNA, 18 bp, Homo sapiens
aaaataaaaatagaaata

SEQ ID NO: 3800954 - DNA, 12 bp, Homo sapiens
aaaatagaaata

SEQ ID NO: 3800955 - DNA, 18 bp, Homo sapiens
aaaatgcaacaacatgta

SEQ ID NO: 3800956 - DNA, 14 bp, Homo sapiens
aaaattaacactgc

SEQ ID NO: 3800957 - DNA, 21 bp, Homo sapiens
aaagggttcacataggctctc

SEQ ID NO: 3800958 - DNA, 22 bp, Homo sapiens
aaagtagtgcttattgtttgca

SEQ ID NO: 3800959 - DNA, 13 bp, Homo sapiens
aaataaaaataga

SEQ ID NO: 3800960 - DNA, 12 bp, Homo sapiens
aaattaacactg

SEQ ID NO: 3800961 - DNA, 13 bp, Homo sapiens
aaattaacactgc

SEQ ID NO: 3800962 - DNA, 20 bp, Homo sapiens
aacactatatggcagtgtct

SEQ ID NO: 3800963 - DNA, 13 bp, Homo sapiens
aacatagtgagac

SEQ ID NO: 3800964 - DNA, 23 bp, Homo sapiens
aacatggagaaaccctgtctcta

SEQ ID NO: 3800965 - DNA, 17 bp, Homo sapiens
aacatgtataatatttt

SEQ ID NO: 3800966 - DNA, 22 bp, Homo sapiens
aacatttgttgaataggggaaa

SEQ ID NO: 3800967 - DNA, 16 bp, Homo sapiens
aacccacagtttgaga

SEQ ID NO: 3800968 - DNA, 18 bp, Homo sapiens
aactagcttggaaactgg

SEQ ID NO: 3800969 - DNA, 13 bp, Homo sapiens
aactcaatatttt

SEQ ID NO: 3800970 - DNA, 20 bp, Homo sapiens
aactcaatattttccatgaa

SEQ ID NO: 3800971 - DNA, 21 bp, Homo sapiens
aactcaatattttccatgaaa

SEQ ID NO: 3800972 - DNA, 21 bp, Homo sapiens
aagaaatttccggaagtaaat

SEQ ID NO: 3800973 - DNA, 19 bp, Homo sapiens
aagaaggcagcaggtggca

SEQ ID NO: 3800974 - DNA, 23 bp, Homo sapiens
aagacaatggcttactccaggag

SEQ ID NO: 3800975 - DNA, 15 bp, Homo sapiens
aagacagagctggga

SEQ ID NO: 3800976 - DNA, 11 bp, Homo sapiens
aagagctgagg

SEQ ID NO: 3800977 - DNA, 22 bp, Homo sapiens
aagccttatgaggtcaagaaat

SEQ ID NO: 3800978 - DNA, 22 bp, Homo sapiens
aaggaagccacagctggtggta

SEQ ID NO: 3800979 - DNA, 20 bp, Homo sapiens
aaggcagggagcgagggaga

SEQ ID NO: 3800980 - DNA, 16 bp, Homo sapiens
aaggctgaggctgccc

SEQ ID NO: 3800981 - DNA, 23 bp, Homo sapiens
aagggttacttgctgctcacact

SEQ ID NO: 3800982 - DNA, 13 bp, Homo sapiens
aaggttgtattgc

SEQ ID NO: 3800983 - DNA, 16 bp, Homo sapiens
aaggtttctgaaaatt

SEQ ID NO: 3800984 - DNA, 14 bp, Homo sapiens
aagttaaattttat

SEQ ID NO: 3800985 - DNA, 16 bp, Homo sapiens
aataaagtagtgctta

SEQ ID NO: 3800986 - DNA, 21 bp, Homo sapiens
aatacaccaggtagaacacaa

SEQ ID NO: 3800987 - DNA, 21 bp, Homo sapiens
aatattttccatgaaaatgca

SEQ ID NO: 3800988 - DNA, 16 bp, Homo sapiens
aatctgcagtttgtga

SEQ ID NO: 3800989 - DNA, 17 bp, Homo sapiens
aatctgcagtttgtgaa

SEQ ID NO: 3800990 - DNA, 17 bp, Homo sapiens
aatgatcttttcaagtt

SEQ ID NO: 3800991 - DNA, 21 bp, Homo sapiens
aatgccatggacagaagaagg

SEQ ID NO: 3800992 - DNA, 22 bp, Homo sapiens
aattaagttagggaatggcaca

SEQ ID NO: 3800993 - DNA, 14 bp, Homo sapiens
aattagccaggtgt

SEQ ID NO: 3800994 - DNA, 21 bp, Homo sapiens
aatttgatagtattgtgcata

SEQ ID NO: 3800995 - DNA, 17 bp, Homo sapiens
acaagaatggtgtgtgc

SEQ ID NO: 3800996 - DNA, 19 bp, Homo sapiens
acactgcttgtgtttttaa

SEQ ID NO: 3800997 - DNA, 23 bp, Homo sapiens
acactgcttgtgtttttaactca

SEQ ID NO: 3800998 - DNA, 14 bp, Homo sapiens
acagaacactgtct

SEQ ID NO: 3800999 - DNA, 20 bp, Homo sapiens
acagaagaaggcagcaggtg

SEQ ID NO: 3801000 - DNA, 21 bp, Homo sapiens
acagagctgggatgtttctgt

SEQ ID NO: 3801001 - DNA, 17 bp, Homo sapiens
acagcccaaagaaggaa

SEQ ID NO: 3801002 - DNA, 18 bp, Homo sapiens
acagcccaaagaaggaaa

SEQ ID NO: 3801003 - DNA, 23 bp, Homo sapiens
acaggtttaaggctgaggctgcc

SEQ ID NO: 3801004 - DNA, 18 bp, Homo sapiens
acagtactgacagaaagc

SEQ ID NO: 3801005 - DNA, 12 bp, Homo sapiens
acagtttgagac

SEQ ID NO: 3801006 - DNA, 21 bp, Homo sapiens
acatagtgagaccctgtctct

SEQ ID NO: 3801007 - DNA, 21 bp, Homo sapiens
acatggagaaaccctgtctct

SEQ ID NO: 3801008 - DNA, 18 bp, Homo sapiens
accattatgaagaagaga

SEQ ID NO: 3801009 - DNA, 17 bp, Homo sapiens
acccctttgcaggactt

SEQ ID NO: 3801010 - DNA, 19 bp, Homo sapiens
accctgcccctttcttccc

SEQ ID NO: 3801011 - DNA, 21 bp, Homo sapiens
accctgcccctttcttcccca

SEQ ID NO: 3801012 - DNA, 23 bp, Homo sapiens
accctgcccctttcttccccacc

SEQ ID NO: 3801013 - DNA, 15 bp, Homo sapiens
accctggaggctctc

SEQ ID NO: 3801014 - DNA, 23 bp, Homo sapiens
accctgtctctactaaaaataca

SEQ ID NO: 3801015 - DNA, 14 bp, Homo sapiens
acccttccacagtc

SEQ ID NO: 3801016 - DNA, 18 bp, Homo sapiens
gggtcccccctccattcc

SEQ ID NO: 3801017 - DNA, 19 bp, Homo sapiens
gggtcccccctccattccc

SEQ ID NO: 3801018 - DNA, 11 bp, Homo sapiens
ggtagaacaca

SEQ ID NO: 3801019 - DNA, 18 bp, Homo sapiens
ggtcgctcaggccagtaa

SEQ ID NO: 3801020 - DNA, 19 bp, Homo sapiens
ggtggtacatgcctgtaat

SEQ ID NO: 3801021 - DNA, 23 bp, Homo sapiens
ggtgtcttggacccacctgaaat

SEQ ID NO: 3801022 - DNA, 23 bp, Homo sapiens
gtaagtttatggccttgaagtgt

SEQ ID NO: 3801023 - DNA, 15 bp, Homo sapiens
gtaatcccagcactt

SEQ ID NO: 3801024 - DNA, 21 bp, Homo sapiens
gtacatgcctgtaatcccagc

SEQ ID NO: 3801025 - DNA, 22 bp, Homo sapiens
gtagaacacaaggtcatttgct

SEQ ID NO: 3801026 - DNA, 19 bp, Homo sapiens
gtaggaaattgattttgaa

SEQ ID NO: 3801027 - DNA, 19 bp, Homo sapiens
gtatgtttttgtgtatttg

SEQ ID NO: 3801028 - DNA, 23 bp, Homo sapiens
gtatgtttttgtgtatttgttaa

SEQ ID NO: 3801029 - DNA, 14 bp, Homo sapiens
gtatttgttaatgg

SEQ ID NO: 3801030 - DNA, 17 bp, Homo sapiens
gtcccccctccattccc

SEQ ID NO: 3801031 - DNA, 16 bp, Homo sapiens
gtcgccagtgaaatag

SEQ ID NO: 3801032 - DNA, 19 bp, Homo sapiens
gtctttattaacaaacagg

SEQ ID NO: 3801033 - DNA, 20 bp, Homo sapiens
gtctttattaacaaacagga

SEQ ID NO: 3801034 - DNA, 17 bp, Homo sapiens
gtgacttaggaggctga

SEQ ID NO: 3801035 - DNA, 22 bp, Homo sapiens
gtgatgctaaaggttgtattgc

SEQ ID NO: 3801036 - DNA, 18 bp, Homo sapiens
gtgcttaacatttgttga

SEQ ID NO: 3801037 - DNA, 16 bp, Homo sapiens
gtggaggagctcagga

SEQ ID NO: 3801038 - DNA, 23 bp, Homo sapiens
gtggaggagctcaggacactaat

SEQ ID NO: 3801039 - DNA, 17 bp, Homo sapiens
gtggctcacgcctgtaa

SEQ ID NO: 3801040 - DNA, 18 bp, Homo sapiens
gtggtggtacatgcctgt

SEQ ID NO: 3801041 - DNA, 20 bp, Homo sapiens
gtgtcttgttcactgcagca

SEQ ID NO: 3801042 - DNA, 20 bp, Homo sapiens
gtgttttcatattgcttctc

SEQ ID NO: 3801043 - DNA, 15 bp, Homo sapiens
gtgtttttaactcaa

SEQ ID NO: 3801044 - DNA, 13 bp, Homo sapiens
gttagggaatggc

SEQ ID NO: 3801045 - DNA, 14 bp, Homo sapiens
gttctgctgtctcc

SEQ ID NO: 3801046 - DNA, 12 bp, Homo sapiens
gttgaagtgaga

SEQ ID NO: 3801047 - DNA, 16 bp, Homo sapiens
gtttataagctgggca

SEQ ID NO: 3801048 - DNA, 15 bp, Homo sapiens
gtttgagaccagccc

SEQ ID NO: 3801049 - DNA, 15 bp, Homo sapiens
gtttgagaccagcct

SEQ ID NO: 3801050 - DNA, 18 bp, Homo sapiens
gtttgagaccagcctggg

SEQ ID NO: 3801051 - DNA, 13 bp, Homo sapiens
gtttgcaaggaag

SEQ ID NO: 3801052 - DNA, 15 bp, Homo sapiens
gtttttaactcaata

SEQ ID NO: 3801053 - DNA, 16 bp, Homo sapiens
taaaaatagaaataaa

SEQ ID NO: 3801054 - DNA, 19 bp, Homo sapiens
taaacaaatgtatgattac

SEQ ID NO: 3801055 - DNA, 16 bp, Homo sapiens
taaagtgctttcagaa

SEQ ID NO: 3801056 - DNA, 15 bp, Homo sapiens
taactagcttggaaa

SEQ ID NO: 3801057 - DNA, 15 bp, Homo sapiens
taatatttttaatta

SEQ ID NO: 3801058 - DNA, 15 bp, Homo sapiens
taatggtttgaatat

SEQ ID NO: 3801059 - DNA, 16 bp, Homo sapiens
tacaaaattagccagg

SEQ ID NO: 3801060 - DNA, 17 bp, Homo sapiens
tacaaaattagccaggt

SEQ ID NO: 3801061 - DNA, 15 bp, Homo sapiens
tactaaaaatacaaa

SEQ ID NO: 3801062 - DNA, 17 bp, Homo sapiens
tagaaagacagagctgg

SEQ ID NO: 3801063 - DNA, 18 bp, Homo sapiens
tagctctgccctggaacc

SEQ ID NO: 3801064 - DNA, 20 bp, Homo sapiens
tagcttggaaactggatgag

SEQ ID NO: 3801065 - DNA, 21 bp, Homo sapiens
tagggaatggcacagcccaaa

SEQ ID NO: 3801066 - DNA, 14 bp, Homo sapiens
tataaacactatat

SEQ ID NO: 3801067 - DNA, 15 bp, Homo sapiens
tatatacatatatat

SEQ ID NO: 3801068 - DNA, 14 bp, Homo sapiens
tatattttaatttg

SEQ ID NO: 3801069 - DNA, 15 bp, Homo sapiens
tatgaagaagagagt

SEQ ID NO: 3801070 - DNA, 18 bp, Homo sapiens
tatgatgtgggtcaagga

SEQ ID NO: 3801071 - DNA, 13 bp, Homo sapiens
tatggcagtgtct

SEQ ID NO: 3801072 - DNA, 16 bp, Homo sapiens
tcaaaaaaaaaaaagt

SEQ ID NO: 3801073 - DNA, 20 bp, Homo sapiens
tcaagaaatgtgacttggcc

SEQ ID NO: 3801074 - DNA, 15 bp, Homo sapiens
tcaatattttccatg

SEQ ID NO: 3801075 - DNA, 18 bp, Homo sapiens
tcaatattttccatgaaa

SEQ ID NO: 3801076 - DNA, 18 bp, Homo sapiens
tcaatggtttgcaaggaa

SEQ ID NO: 3801077 - DNA, 19 bp, Homo sapiens
tcaatggtttgcaaggaag

SEQ ID NO: 3801078 - DNA, 18 bp, Homo sapiens
tcaatttccaagagctga

SEQ ID NO: 3801079 - DNA, 15 bp, Homo sapiens
tcaatttcccaccca

SEQ ID NO: 3801080 - DNA, 21 bp, Homo sapiens
tcaatttcccacccatctcca

SEQ ID NO: 3801081 - DNA, 13 bp, Homo sapiens
tcacataggctct

SEQ ID NO: 3801082 - DNA, 13 bp, Homo sapiens
tcagccttgctga

SEQ ID NO: 3801083 - DNA, 14 bp, Homo sapiens
tcagccttgctgac

SEQ ID NO: 3801084 - DNA, 12 bp, Homo sapiens
tcaggacactaa

SEQ ID NO: 3801085 - DNA, 13 bp, Homo sapiens
tcaggacactaat

SEQ ID NO: 3801086 - DNA, 17 bp, Homo sapiens
tcaggcccacaggttta

SEQ ID NO: 3801087 - DNA, 16 bp, Homo sapiens
tcatagccaaacagga

SEQ ID NO: 3801088 - DNA, 18 bp, Homo sapiens
tcattcagccttgctgac

SEQ ID NO: 3801089 - DNA, 20 bp, Homo sapiens
tcattgcagatcccagccca

SEQ ID NO: 3801090 - DNA, 12 bp, Homo sapiens
tccaagagctga

SEQ ID NO: 3801091 - DNA, 15 bp, Homo sapiens
tccagcctgggcaac

SEQ ID NO: 3801092 - DNA, 12 bp, Homo sapiens
tccatgaaaatg

SEQ ID NO: 3801093 - DNA, 15 bp, Homo sapiens
tccatgaaaatgcaa

SEQ ID NO: 3801094 - DNA, 13 bp, Homo sapiens
tcccacccatctc

SEQ ID NO: 3801095 - DNA, 15 bp, Homo sapiens
tcccagcccaccctg

SEQ ID NO: 3801096 - DNA, 11 bp, Homo sapiens
tccccaccctg

SEQ ID NO: 3801097 - DNA, 21 bp, Homo sapiens
tccctggtctggctctgctgg

SEQ ID NO: 3801098 - DNA, 22 bp, Homo sapiens
tccctggtctggctctgctgga

SEQ ID NO: 3801099 - DNA, 18 bp, Homo sapiens
tcccttccccctgctgat

SEQ ID NO: 3801100 - DNA, 13 bp, Homo sapiens
tctaaaaaaataa

SEQ ID NO: 3801101 - DNA, 19 bp, Homo sapiens
tctacagtactgacagaaa

SEQ ID NO: 3801102 - DNA, 20 bp, Homo sapiens
tctacagtactgacagaaag

SEQ ID NO: 3801103 - DNA, 21 bp, Homo sapiens
tctacagtactgacagaaagc

SEQ ID NO: 3801104 - DNA, 19 bp, Homo sapiens
tctcaggtgccagtcttcc

SEQ ID NO: 3801105 - DNA, 14 bp, Homo sapiens
tctccctgaagagt

SEQ ID NO: 3801106 - DNA, 19 bp, Homo sapiens
tctccctttagttctgctg

SEQ ID NO: 3801107 - DNA, 13 bp, Homo sapiens
tctgcagtttgtg

SEQ ID NO: 3801108 - DNA, 17 bp, Homo sapiens
tctgcagtttgtgaact

SEQ ID NO: 3801109 - DNA, 16 bp, Homo sapiens
tctgctgtctccctga

SEQ ID NO: 3801110 - DNA, 15 bp, Homo sapiens
tctggtggctgccag

SEQ ID NO: 3801111 - DNA, 13 bp, Homo sapiens
tcttccagaaagc

SEQ ID NO: 3801112 - DNA, 19 bp, Homo sapiens
tctttattaacaaacagga

SEQ ID NO: 3801113 - DNA, 17 bp, Homo sapiens
tctttgggatcttgaag

SEQ ID NO: 3801114 - DNA, 17 bp, Homo sapiens
tgaaaaagtaggctgcc

SEQ ID NO: 3801115 - DNA, 15 bp, Homo sapiens
tgaaaattaacactg

SEQ ID NO: 3801116 - DNA, 16 bp, Homo sapiens
tgaaggtttctgaaaa

SEQ ID NO: 3801117 - DNA, 19 bp, Homo sapiens
tgaataggggaaagaaatt

SEQ ID NO: 3801118 - DNA, 17 bp, Homo sapiens
tgacttgacagaacact

SEQ ID NO: 3801119 - DNA, 19 bp, Homo sapiens
tgacttgacagaacactgt

SEQ ID NO: 3801120 - DNA, 16 bp, Homo sapiens
tgagaccagcctgggc

SEQ ID NO: 3801121 - DNA, 14 bp, Homo sapiens
tgagacccaggccc

SEQ ID NO: 3801122 - DNA, 20 bp, Homo sapiens
tgagcttagctctgccctgg

SEQ ID NO: 3801123 - DNA, 17 bp, Homo sapiens
tgaggcaggagaatcac

SEQ ID NO: 3801124 - DNA, 19 bp, Homo sapiens
tgagggctccctgctccct

SEQ ID NO: 3801125 - DNA, 16 bp, Homo sapiens
tgaggtcaagaaatgt

SEQ ID NO: 3801126 - DNA, 18 bp, Homo sapiens
tgaggtcatagcagtgct

SEQ ID NO: 3801127 - DNA, 21 bp, Homo sapiens
tgaggtcgggagtttgagacc

SEQ ID NO: 3801128 - DNA, 20 bp, Homo sapiens
tgagttggtgttgacatgtg

SEQ ID NO: 3801129 - DNA, 15 bp, Homo sapiens
tgataagatttacct

SEQ ID NO: 3801130 - DNA, 24 bp, Homo sapiens
tgatcaatctgcagtttgtgaact

SEQ ID NO: 3801131 - DNA, 15 bp, Homo sapiens
aaagcaaggacatgc

SEQ ID NO: 3801132 - DNA, 15 bp, Homo sapiens
aaagcaaggactgcc

SEQ ID NO: 3801133 - DNA, 13 bp, Homo sapiens
aaagtaggctgcc

SEQ ID NO: 3801134 - DNA, 14 bp, Homo sapiens
aaagtaggctgccg

SEQ ID NO: 3801135 - DNA, 16 bp, Homo sapiens
aaataaaaatagaaat

SEQ ID NO: 3801136 - DNA, 16 bp, Homo sapiens
aaatgatcttttcaag

SEQ ID NO: 3801137 - DNA, 18 bp, Homo sapiens
aaatgtatgattacatca

SEQ ID NO: 3801138 - DNA, 14 bp, Homo sapiens
aaatgtgacttggc

SEQ ID NO: 3801139 - DNA, 14 bp, Homo sapiens
aaattgattttgaa

SEQ ID NO: 3801140 - DNA, 11 bp, Homo sapiens
aacaaacagga

SEQ ID NO: 3801141 - DNA, 12 bp, Homo sapiens
aacaaacaggat

SEQ ID NO: 3801142 - DNA, 14 bp, Homo sapiens
aacactgcttgtgt

SEQ ID NO: 3801143 - DNA, 14 bp, Homo sapiens
aactcaatattttc

SEQ ID NO: 3801144 - DNA, 18 bp, Homo sapiens
aagagctgaggcaattct

SEQ ID NO: 3801145 - DNA, 15 bp, Homo sapiens
aaggctgaggctgcc

SEQ ID NO: 3801146 - DNA, 23 bp, Homo sapiens
aaggctgaggctgccctgaccct

SEQ ID NO: 3801147 - DNA, 12 bp, Homo sapiens
aagtaggctgcc

SEQ ID NO: 3801148 - DNA, 17 bp, Homo sapiens
aagtgcttaacatttgt

SEQ ID NO: 3801149 - DNA, 23 bp, Homo sapiens
aatagaacacagaacaggaacta

SEQ ID NO: 3801150 - DNA, 16 bp, Homo sapiens
aatcccagcactttgg

SEQ ID NO: 3801151 - DNA, 17 bp, Homo sapiens
aatggcacagcccaaag

SEQ ID NO: 3801152 - DNA, 17 bp, Homo sapiens
aatggtttgaatataaa

SEQ ID NO: 3801153 - DNA, 23 bp, Homo sapiens
aatggtttgaatataaacactat

SEQ ID NO: 3801154 - DNA, 19 bp, Homo sapiens
aatggtttgcaaggaagcc

SEQ ID NO: 3801155 - DNA, 14 bp, Homo sapiens
aattctaacttttt

SEQ ID NO: 3801156 - DNA, 12 bp, Homo sapiens
aatttaaagcaa

SEQ ID NO: 3801157 - DNA, 15 bp, Homo sapiens
aatttccggaagtaa

SEQ ID NO: 3801158 - DNA, 11 bp, Homo sapiens
acaaacaggat

SEQ ID NO: 3801159 - DNA, 13 bp, Homo sapiens
acaaatgtatgat

SEQ ID NO: 3801160 - DNA, 13 bp, Homo sapiens
acactgtcttgaa

SEQ ID NO: 3801161 - DNA, 15 bp, Homo sapiens
acagaacaggaacta

SEQ ID NO: 3801162 - DNA, 18 bp, Homo sapiens
acagagctgggatgtttc

SEQ ID NO: 3801163 - DNA, 22 bp, Homo sapiens
acagcaattaataatgtttata

SEQ ID NO: 3801164 - DNA, 21 bp, Homo sapiens
accagagcagagaagggcagg

SEQ ID NO: 3801165 - DNA, 20 bp, Homo sapiens
accagcccgaccaacatgga

SEQ ID NO: 3801166 - DNA, 18 bp, Homo sapiens
accagcctgggcaacata

SEQ ID NO: 3801167 - DNA, 22 bp, Homo sapiens
cacctaggtcgccagtgaaata

SEQ ID NO: 3801168 - DNA, 17 bp, Homo sapiens
cacctgaaatgcagtat

SEQ ID NO: 3801169 - DNA, 18 bp, Homo sapiens
cacgccattgcactccag

SEQ ID NO: 3801170 - DNA, 23 bp, Homo sapiens
cacgccattgcactccagcctgg

SEQ ID NO: 3801171 - DNA, 14 bp, Homo sapiens
cacgcctgtaatcc

SEQ ID NO: 3801172 - DNA, 19 bp, Homo sapiens
cacgcctgtaatcccagca

SEQ ID NO: 3801173 - DNA, 15 bp, Homo sapiens
cactccagcctgggc

SEQ ID NO: 3801174 - DNA, 18 bp, Homo sapiens
cactttcagtgaaagcat

SEQ ID NO: 3801175 - DNA, 14 bp, Homo sapiens
cagaagaaggcagc

SEQ ID NO: 3801176 - DNA, 19 bp, Homo sapiens
cagatcccagcccaccctg

SEQ ID NO: 3801177 - DNA, 19 bp, Homo sapiens
cagcactgcccatcccacc

SEQ ID NO: 3801178 - DNA, 21 bp, Homo sapiens
cagcactgcccatcccacccc

SEQ ID NO: 3801179 - DNA, 20 bp, Homo sapiens
cagcccaccctgcccctttc

SEQ ID NO: 3801180 - DNA, 13 bp, Homo sapiens
cagccccacggga

SEQ ID NO: 3801181 - DNA, 22 bp, Homo sapiens
cagcctttctaaggctcagccc

SEQ ID NO: 3801182 - DNA, 18 bp, Homo sapiens
cagctactagggaggctg

SEQ ID NO: 3801183 - DNA, 13 bp, Homo sapiens
cagctatttttat

SEQ ID NO: 3801184 - DNA, 19 bp, Homo sapiens
cagctggtggtatctgagt

SEQ ID NO: 3801185 - DNA, 13 bp, Homo sapiens
cagcttgtgagct

SEQ ID NO: 3801186 - DNA, 16 bp, Homo sapiens
caggaaaccctcttct

SEQ ID NO: 3801187 - DNA, 21 bp, Homo sapiens
caggaactagattataagcct

SEQ ID NO: 3801188 - DNA, 17 bp, Homo sapiens
caggagaggaagatttg

SEQ ID NO: 3801189 - DNA, 17 bp, Homo sapiens
caggtgtcttggaccca

SEQ ID NO: 3801190 - DNA, 21 bp, Homo sapiens
caggtgtcttggacccacctg

SEQ ID NO: 3801191 - DNA, 15 bp, Homo sapiens
cagtcttccagaaag

SEQ ID NO: 3801192 - DNA, 16 bp, Homo sapiens
cttgacagaacactgt

SEQ ID NO: 3801193 - DNA, 18 bp, Homo sapiens
cttgctgacctcccagcc

SEQ ID NO: 3801194 - DNA, 21 bp, Homo sapiens
cttggcccagcactgcccatc

SEQ ID NO: 3801195 - DNA, 22 bp, Homo sapiens
cttgtgtttttaactcaatatt

SEQ ID NO: 3801196 - DNA, 19 bp, Homo sapiens
cttgttcactgcagcatgc

SEQ ID NO: 3801197 - DNA, 17 bp, Homo sapiens
ctttcagtgaaagcatc

SEQ ID NO: 3801198 - DNA, 14 bp, Homo sapiens
ctttcttccccacc

SEQ ID NO: 3801199 - DNA, 17 bp, Homo sapiens
ctttgggaggccaaggc

SEQ ID NO: 3801200 - DNA, 21 bp, Homo sapiens
ctttggggcttttacaccagt

SEQ ID NO: 3801201 - DNA, 23 bp, Homo sapiens
gaaaaagtaggctgccgccacca

SEQ ID NO: 3801202 - DNA, 13 bp, Homo sapiens
gaaaattaacact

SEQ ID NO: 3801203 - DNA, 14 bp, Homo sapiens
gaaagacagagctg

SEQ ID NO: 3801204 - DNA, 20 bp, Homo sapiens
gaaatgtgacttggccgggc

SEQ ID NO: 3801205 - DNA, 16 bp, Homo sapiens
gaaattgattttgaaa

SEQ ID NO: 3801206 - DNA, 19 bp, Homo sapiens
gaaatttccggaagtaaat

SEQ ID NO: 3801207 - DNA, 22 bp, Homo sapiens
gaagatttgtctacttgctcca

SEQ ID NO: 3801208 - DNA, 17 bp, Homo sapiens
gaataggggaaagaaat

SEQ ID NO: 3801209 - DNA, 21 bp, Homo sapiens
gaatataaacactatatggca

SEQ ID NO: 3801210 - DNA, 18 bp, Homo sapiens
gaattaagttagggaatg

SEQ ID NO: 3801211 - DNA, 13 bp, Homo sapiens
agcgaaactccat

SEQ ID NO: 3801212 - DNA, 18 bp, Homo sapiens
agctactagggaggctga

SEQ ID NO: 3801213 - DNA, 22 bp, Homo sapiens
agctatttttatttgtttgtgc

SEQ ID NO: 3801214 - DNA, 16 bp, Homo sapiens
agcttagctctgccct

SEQ ID NO: 3801215 - DNA, 22 bp, Homo sapiens
agcttagctctgccctggaacc

SEQ ID NO: 3801216 - DNA, 17 bp, Homo sapiens
aggaaattgattttgaa

SEQ ID NO: 3801217 - DNA, 23 bp, Homo sapiens
aggaattaagttagggaatggca

SEQ ID NO: 3801218 - DNA, 15 bp, Homo sapiens
aggacatgcggcctg

SEQ ID NO: 3801219 - DNA, 20 bp, Homo sapiens
aggccagtaatcccagtgac

SEQ ID NO: 3801220 - DNA, 16 bp, Homo sapiens
aggcctggccgcagtc

SEQ ID NO: 3801221 - DNA, 14 bp, Homo sapiens
aggctcagccccac

SEQ ID NO: 3801222 - DNA, 14 bp, Homo sapiens
aggctgaggcagga

SEQ ID NO: 3801223 - DNA, 15 bp, Homo sapiens
aggctgccctgaccc

SEQ ID NO: 3801224 - DNA, 17 bp, Homo sapiens
aggctgtagccaggaaa

SEQ ID NO: 3801225 - DNA, 16 bp, Homo sapiens
agggagcgagggagaa

SEQ ID NO: 3801226 - DNA, 17 bp, Homo sapiens
agggaggctgaggcagg

SEQ ID NO: 3801227 - DNA, 19 bp, Homo sapiens
agggctgggtaggcaggtg

SEQ ID NO: 3801228 - DNA, 23 bp, Homo sapiens
aggtatgaccttctaggaagctc

SEQ ID NO: 3801229 - DNA, 18 bp, Homo sapiens
aggtcgggagtttgagac

SEQ ID NO: 3801230 - DNA, 20 bp, Homo sapiens
aggtgccagtcttccagaaa

SEQ ID NO: 3801231 - DNA, 13 bp, Homo sapiens
aggtgtcttggac

SEQ ID NO: 3801232 - DNA, 15 bp, Homo sapiens
aggtttctgaaaatt

SEQ ID NO: 3801233 - DNA, 14 bp, Homo sapiens
agtaaatgaaacta

SEQ ID NO: 3801234 - DNA, 16 bp, Homo sapiens
agtactgacagaaagc

SEQ ID NO: 3801235 - DNA, 21 bp, Homo sapiens
agtagaaagacagagctggga

SEQ ID NO: 3801236 - DNA, 21 bp, Homo sapiens
agtaggaaattgattttgaaa

SEQ ID NO: 3801237 - DNA, 11 bp, Homo sapiens
agtaggctgcc

SEQ ID NO: 3801238 - DNA, 24 bp, Homo sapiens
agtcttccagaaagcaaggactgc

SEQ ID NO: 3801239 - DNA, 14 bp, Homo sapiens
agtgaaagcatcac

SEQ ID NO: 3801240 - DNA, 18 bp, Homo sapiens
agtgttttcatattgctt

SEQ ID NO: 3801241 - DNA, 21 bp, Homo sapiens
agtgttttcatattgcttctc

SEQ ID NO: 3801242 - DNA, 21 bp, Homo sapiens
agttcgatgggcccaattctt

SEQ ID NO: 3801243 - DNA, 15 bp, Homo sapiens
agttctgctgtctcc

SEQ ID NO: 3801244 - DNA, 18 bp, Homo sapiens
agttctgctgtctccctg

SEQ ID NO: 3801245 - DNA, 22 bp, Homo sapiens
agttgacttgacagaacactgt

SEQ ID NO: 3801246 - DNA, 11 bp, Homo sapiens
agtttgagacc

SEQ ID NO: 3801247 - DNA, 13 bp, Homo sapiens
agtttgagaccag

SEQ ID NO: 3801248 - DNA, 20 bp, Homo sapiens
atacttattattgatgataa

SEQ ID NO: 3801249 - DNA, 20 bp, Homo sapiens
atatggggatgcagcattat

SEQ ID NO: 3801250 - DNA, 15 bp, Homo sapiens
atcatctgatttact

SEQ ID NO: 3801251 - DNA, 13 bp, Homo sapiens
atcccagctacta

SEQ ID NO: 3801252 - DNA, 17 bp, Homo sapiens
atcccagtgacttagga

SEQ ID NO: 3801253 - DNA, 18 bp, Homo sapiens
atcccagtgacttaggag

SEQ ID NO: 3801254 - DNA, 23 bp, Homo sapiens
atctcaaaaaaaaaaaagtgtct

SEQ ID NO: 3801255 - DNA, 17 bp, Homo sapiens
atgaccttctaggaagc

SEQ ID NO: 3801256 - DNA, 11 bp, Homo sapiens
atgaggctcac

SEQ ID NO: 3801257 - DNA, 15 bp, Homo sapiens
atgatcccttccccc

SEQ ID NO: 3801258 - DNA, 22 bp, Homo sapiens
atgatcccttccccctgctgat

SEQ ID NO: 3801259 - DNA, 24 bp, Homo sapiens
atgatcccttccccctgctgatca

SEQ ID NO: 3801260 - DNA, 19 bp, Homo sapiens
atgatgtgggtcaaggaat

SEQ ID NO: 3801261 - DNA, 16 bp, Homo sapiens
atgcaacaacatgtat

SEQ ID NO: 3801262 - DNA, 19 bp, Homo sapiens
atggacagaagaaggcagc

SEQ ID NO: 3801263 - DNA, 12 bp, Homo sapiens
atggccttgaag

SEQ ID NO: 3801264 - DNA, 14 bp, Homo sapiens
attaacaaacagga

SEQ ID NO: 3801265 - DNA, 11 bp, Homo sapiens
attaacactgc

SEQ ID NO: 3801266 - DNA, 16 bp, Homo sapiens
attcagccttgctgac

SEQ ID NO: 3801267 - DNA, 22 bp, Homo sapiens
attcatctctctttaatataaa

SEQ ID NO: 3801268 - DNA, 22 bp, Homo sapiens
attcatttcatagccaaacagg

SEQ ID NO: 3801269 - DNA, 19 bp, Homo sapiens
attctaacttttttgctat

SEQ ID NO: 3801270 - DNA, 18 bp, Homo sapiens
attgcactccagcctggg

SEQ ID NO: 3801271 - DNA, 21 bp, Homo sapiens
attgcagatcccagcccaccc

SEQ ID NO: 3801272 - DNA, 16 bp, Homo sapiens
attgcatatatacata

SEQ ID NO: 3801273 - DNA, 19 bp, Homo sapiens
atttcatagccaaacagga

SEQ ID NO: 3801274 - DNA, 15 bp, Homo sapiens
atttccaagagctga

SEQ ID NO: 3801275 - DNA, 16 bp, Homo sapiens
atttccaagagctgag

SEQ ID NO: 3801276 - DNA, 13 bp, Homo sapiens
atttcttaaacaa

SEQ ID NO: 3801277 - DNA, 20 bp, Homo sapiens
atttgatagtattgtgcata

SEQ ID NO: 3801278 - DNA, 22 bp, Homo sapiens
atttgttgaataggggaaagaa

SEQ ID NO: 3801279 - DNA, 21 bp, Homo sapiens
attttatgccttttatttctt

SEQ ID NO: 3801280 - DNA, 21 bp, Homo sapiens
attttgaaaaagtaggctgcc

SEQ ID NO: 3801281 - DNA, 14 bp, Homo sapiens
caaaattagccagg

SEQ ID NO: 3801282 - DNA, 21 bp, Homo sapiens
caaacaccttcagtgctggtg

SEQ ID NO: 3801283 - DNA, 18 bp, Homo sapiens
caaacatgtggttaatgc

SEQ ID NO: 3801284 - DNA, 19 bp, Homo sapiens
caaagaaggaaaaggcagg

SEQ ID NO: 3801285 - DNA, 13 bp, Homo sapiens
caacatgtataat

SEQ ID NO: 3801286 - DNA, 19 bp, Homo sapiens
caatattttccatgaaaat

SEQ ID NO: 3801287 - DNA, 22 bp, Homo sapiens
caatattttccatgaaaatgca

SEQ ID NO: 3801288 - DNA, 13 bp, Homo sapiens
caatttaaagcaa

SEQ ID NO: 3801289 - DNA, 16 bp, Homo sapiens
cacagtttgagaccag

SEQ ID NO: 3801290 - DNA, 20 bp, Homo sapiens
cacagtttgagaccagcctg

SEQ ID NO: 3801291 - DNA, 20 bp, Homo sapiens
cacataggctctcaggtgcc

SEQ ID NO: 3801292 - DNA, 24 bp, Homo sapiens
cacatcagctccactttcagtgaa

SEQ ID NO: 3801293 - DNA, 18 bp, Homo sapiens
cacatggctatgttttag

SEQ ID NO: 3801294 - DNA, 20 bp, Homo sapiens
caccccatgaggctcactca

SEQ ID NO: 3801295 - DNA, 20 bp, Homo sapiens
caccctgcccctttcttccc

SEQ ID NO: 3801296 - DNA, 21 bp, Homo sapiens
caccctgcccctttcttcccc

SEQ ID NO: 3801297 - DNA, 13 bp, Homo sapiens
aaaagtaggctgc

SEQ ID NO: 3801298 - DNA, 14 bp, Homo sapiens
aaaagtaggctgcc

SEQ ID NO: 3801299 - DNA, 16 bp, Homo sapiens
aaaagtgtcttgttca

SEQ ID NO: 3801300 - DNA, 20 bp, Homo sapiens
aaaccattatgaagaagaga

SEQ ID NO: 3801301 - DNA, 17 bp, Homo sapiens
aaaccctcttcttccct

SEQ ID NO: 3801302 - DNA, 23 bp, Homo sapiens
aaagaaatttccggaagtaaata

SEQ ID NO: 3801303 - DNA, 14 bp, Homo sapiens
aaatacagcaatta

SEQ ID NO: 3801304 - DNA, 21 bp, Homo sapiens
aaattaacactgcttgtgttt

SEQ ID NO: 3801305 - DNA, 15 bp, Homo sapiens
aaattgattttgaaa

SEQ ID NO: 3801306 - DNA, 19 bp, Homo sapiens
aaatttccggaagtaaata

SEQ ID NO: 3801307 - DNA, 22 bp, Homo sapiens
aacacctaggtcgccagtgaaa

SEQ ID NO: 3801308 - DNA, 23 bp, Homo sapiens
aacacctaggtcgccagtgaaat

SEQ ID NO: 3801309 - DNA, 18 bp, Homo sapiens
aacactatatggcagtgt

SEQ ID NO: 3801310 - DNA, 23 bp, Homo sapiens
aacatagtgagaccctgtctcta

SEQ ID NO: 3801311 - DNA, 22 bp, Homo sapiens
aacccaaattacgtgtactaca

SEQ ID NO: 3801312 - DNA, 15 bp, Homo sapiens
aagaatggtgtgtgc

SEQ ID NO: 3801313 - DNA, 16 bp, Homo sapiens
aagacagagctgggat

SEQ ID NO: 3801314 - DNA, 14 bp, Homo sapiens
aagccacagctggt

SEQ ID NO: 3801315 - DNA, 17 bp, Homo sapiens
aaggacatgcggcctgc

SEQ ID NO: 3801316 - DNA, 17 bp, Homo sapiens
aaggttgtattgcatat

SEQ ID NO: 3801317 - DNA, 13 bp, Homo sapiens
aagtaggctgccg

SEQ ID NO: 3801318 - DNA, 21 bp, Homo sapiens
aagtaggctgccgccaccacg

SEQ ID NO: 3801319 - DNA, 21 bp, Homo sapiens
aagtagtgcttattgtttgca

SEQ ID NO: 3801320 - DNA, 22 bp, Homo sapiens
aagtgttttcatattgcttctc

SEQ ID NO: 3801321 - DNA, 13 bp, Homo sapiens
aatataaacacta

SEQ ID NO: 3801322 - DNA, 14 bp, Homo sapiens
aatataaacactat

SEQ ID NO: 3801323 - DNA, 22 bp, Homo sapiens
aatcattaaagtgctttcagaa

SEQ ID NO: 3801324 - DNA, 14 bp, Homo sapiens
aatcccagtgactt

SEQ ID NO: 3801325 - DNA, 21 bp, Homo sapiens
aatctgcagtttgtgaacttc

SEQ ID NO: 3801326 - DNA, 15 bp, Homo sapiens
aatgcaacaacatgt

SEQ ID NO: 3801327 - DNA, 19 bp, Homo sapiens
aatggcacagcccaaagaa

SEQ ID NO: 3801328 - DNA, 20 bp, Homo sapiens
aatggcacagcccaaagaag

SEQ ID NO: 3801329 - DNA, 17 bp, Homo sapiens
aatggtttgcaaggaag

SEQ ID NO: 3801330 - DNA, 17 bp, Homo sapiens
aattcttacaaacatgt

SEQ ID NO: 3801331 - DNA, 13 bp, Homo sapiens
aatttcccaccca

SEQ ID NO: 3801332 - DNA, 18 bp, Homo sapiens
aatttcccacccatctcc

SEQ ID NO: 3801333 - DNA, 14 bp, Homo sapiens
acaacatgtataat

SEQ ID NO: 3801334 - DNA, 22 bp, Homo sapiens
acaacatgtataatatttttaa

SEQ ID NO: 3801335 - DNA, 17 bp, Homo sapiens
acacagaacaggaacta

SEQ ID NO: 3801336 - DNA, 17 bp, Homo sapiens
ctgaggcaggagaatca

SEQ ID NO: 3801337 - DNA, 19 bp, Homo sapiens
ctgcagcatgcccagtgcc

SEQ ID NO: 3801338 - DNA, 14 bp, Homo sapiens
ctgcagtttgtgaa

SEQ ID NO: 3801339 - DNA, 16 bp, Homo sapiens
ctgcagtttgtgaact

SEQ ID NO: 3801340 - DNA, 17 bp, Homo sapiens
ctgccagcttgtgagct

SEQ ID NO: 3801341 - DNA, 13 bp, Homo sapiens
ctgcctcttaact

SEQ ID NO: 3801342 - DNA, 16 bp, Homo sapiens
ctgcctcttaactcct

SEQ ID NO: 3801343 - DNA, 16 bp, Homo sapiens
ctgctccctccctcca

SEQ ID NO: 3801344 - DNA, 18 bp, Homo sapiens
ctggagggttgagaccca

SEQ ID NO: 3801345 - DNA, 16 bp, Homo sapiens
ctggcggggtcccccc

SEQ ID NO: 3801346 - DNA, 21 bp, Homo sapiens
ctggcggggtcccccctccat

SEQ ID NO: 3801347 - DNA, 14 bp, Homo sapiens
ctgggatgtttctg

SEQ ID NO: 3801348 - DNA, 14 bp, Homo sapiens
ctggggactgcatt

SEQ ID NO: 3801349 - DNA, 14 bp, Homo sapiens
ctggtctggctctg

SEQ ID NO: 3801350 - DNA, 11 bp, Homo sapiens
ctgtcaagccc

SEQ ID NO: 3801351 - DNA, 19 bp, Homo sapiens
cttaacatttgttgaatag

SEQ ID NO: 3801352 - DNA, 14 bp, Homo sapiens
cttactccaggaga

SEQ ID NO: 3801353 - DNA, 20 bp, Homo sapiens
cttagctctgccctggaacc

SEQ ID NO: 3801354 - DNA, 16 bp, Homo sapiens
cttcaatttcccaccc

SEQ ID NO: 3801355 - DNA, 13 bp, Homo sapiens
cttctaggaagct

SEQ ID NO: 3801356 - DNA, 17 bp, Homo sapiens
cttctccctttagttct

SEQ ID NO: 3801357 - DNA, 19 bp, Homo sapiens
cttgcacacagggaggctg

SEQ ID NO: 3801358 - DNA, 20 bp, Homo sapiens
cttgcacacagggaggctgt

SEQ ID NO: 3801359 - DNA, 20 bp, Homo sapiens
cttgctgacctcccagcctt

SEQ ID NO: 3801360 - DNA, 12 bp, Homo sapiens
ctttaatataaa

SEQ ID NO: 3801361 - DNA, 13 bp, Homo sapiens
ctttagtaaatga

SEQ ID NO: 3801362 - DNA, 14 bp, Homo sapiens
ctttagttctgctg

SEQ ID NO: 3801363 - DNA, 19 bp, Homo sapiens
ctttagttctgctgtctcc

SEQ ID NO: 3801364 - DNA, 21 bp, Homo sapiens
ctttagttctgctgtctccct

SEQ ID NO: 3801365 - DNA, 22 bp, Homo sapiens
ctttcaatggtttgcaaggaag

SEQ ID NO: 3801366 - DNA, 23 bp, Homo sapiens
ctttctaaggctcagccccacgg

SEQ ID NO: 3801367 - DNA, 17 bp, Homo sapiens
ctttcttccccaccctg

SEQ ID NO: 3801368 - DNA, 15 bp, Homo sapiens
gaaaaagtaggctgc

SEQ ID NO: 3801369 - DNA, 18 bp, Homo sapiens
gaaaatgcaacaacatgt

SEQ ID NO: 3801370 - DNA, 15 bp, Homo sapiens
gaaaattaacactgc

SEQ ID NO: 3801371 - DNA, 13 bp, Homo sapiens
gaaattgattttg

SEQ ID NO: 3801372 - DNA, 22 bp, Homo sapiens
gaaatttccggaagtaaataca

SEQ ID NO: 3801373 - DNA, 18 bp, Homo sapiens
gaaggaaaaggcagggag

SEQ ID NO: 3801374 - DNA, 20 bp, Homo sapiens
gaaggaaaaggcagggagcg

SEQ ID NO: 3801375 - DNA, 22 bp, Homo sapiens
gaagggcatgggctagaagagg

SEQ ID NO: 3801376 - DNA, 22 bp, Homo sapiens
gaagtgttttcatattgcttct

SEQ ID NO: 3801377 - DNA, 14 bp, Homo sapiens
gaatataaacacta

SEQ ID NO: 3801378 - DNA, 17 bp, Homo sapiens
gaatggcacagcccaaa

SEQ ID NO: 3801379 - DNA, 22 bp, Homo sapiens
gaatggcacagcccaaagaagg

SEQ ID NO: 3801380 - DNA, 21 bp, Homo sapiens
gaattaagttagggaatggca

SEQ ID NO: 3801381 - DNA, 15 bp, Homo sapiens
gacagaacactgtct

SEQ ID NO: 3801382 - DNA, 19 bp, Homo sapiens
gacatgcggcctgcatggt

SEQ ID NO: 3801383 - DNA, 12 bp, Homo sapiens
gaccagcctggg

SEQ ID NO: 3801384 - DNA, 18 bp, Homo sapiens
gacctatagtaagtgctt

SEQ ID NO: 3801385 - DNA, 14 bp, Homo sapiens
gactgcattggact

SEQ ID NO: 3801386 - DNA, 18 bp, Homo sapiens
gacttcaatttcccaccc

SEQ ID NO: 3801387 - DNA, 18 bp, Homo sapiens
gacttgacagaacactgt

SEQ ID NO: 3801388 - DNA, 21 bp, Homo sapiens
gacttgcacacagggaggctg

SEQ ID NO: 3801389 - DNA, 19 bp, Homo sapiens
gagaagggttacttgctgc

SEQ ID NO: 3801390 - DNA, 20 bp, Homo sapiens
gagacccctttgcaggactt

SEQ ID NO: 3801391 - DNA, 14 bp, Homo sapiens
gagctcaggacact

SEQ ID NO: 3801392 - DNA, 17 bp, Homo sapiens
gagctgaggcaattcta

SEQ ID NO: 3801393 - DNA, 18 bp, Homo sapiens
gaggaagatttgtctact

SEQ ID NO: 3801394 - DNA, 20 bp, Homo sapiens
gaggaagatttgtctacttg

SEQ ID NO: 3801395 - DNA, 22 bp, Homo sapiens
gaggaagatttgtctacttgct

SEQ ID NO: 3801396 - DNA, 14 bp, Homo sapiens
gaggccaaggcggg

SEQ ID NO: 3801397 - DNA, 22 bp, Homo sapiens
gagtagaaagacagagctggga

SEQ ID NO: 3801398 - DNA, 17 bp, Homo sapiens
gatcaatctgcagtttg

SEQ ID NO: 3801399 - DNA, 23 bp, Homo sapiens
gatcacgccattgcactccagcc

SEQ ID NO: 3801400 - DNA, 18 bp, Homo sapiens
gattaatatggggatgca

SEQ ID NO: 3801401 - DNA, 14 bp, Homo sapiens
gatttgtctacttg

SEQ ID NO: 3801402 - DNA, 17 bp, Homo sapiens
gcaaaggagtagaaaga

SEQ ID NO: 3801403 - DNA, 17 bp, Homo sapiens
gcacacagggaggctgt

SEQ ID NO: 3801404 - DNA, 23 bp, Homo sapiens
gcaccgacttcaatttcccaccc

SEQ ID NO: 3801405 - DNA, 14 bp, Homo sapiens
gcactccagcctgg

SEQ ID NO: 3801406 - DNA, 15 bp, Homo sapiens
gcactccagcctggg

SEQ ID NO: 3801407 - DNA, 17 bp, Homo sapiens
gcactgcccatcccacc

SEQ ID NO: 3801408 - DNA, 22 bp, Homo sapiens
gcagaggttgcagtgagtcaag

SEQ ID NO: 3801409 - DNA, 18 bp, Homo sapiens
gcagatcccagcccaccc

SEQ ID NO: 3801410 - DNA, 20 bp, Homo sapiens
gcagcaggtggcagaatggg

SEQ ID NO: 3801411 - DNA, 19 bp, Homo sapiens
gcaggacttgcacacaggg

SEQ ID NO: 3801412 - DNA, 13 bp, Homo sapiens
gcaggtgtcttgg

SEQ ID NO: 3801413 - DNA, 14 bp, Homo sapiens
gcagtatcatctga

SEQ ID NO: 3801414 - DNA, 22 bp, Homo sapiens
gccaggaaaccctcttcttccc

SEQ ID NO: 3801415 - DNA, 20 bp, Homo sapiens
gccagtcttccagaaagcaa

SEQ ID NO: 3801416 - DNA, 18 bp, Homo sapiens
gccatggacagaagaagg

SEQ ID NO: 3801417 - DNA, 18 bp, Homo sapiens
gcccagcactgcccatcc

SEQ ID NO: 3801418 - DNA, 22 bp, Homo sapiens
gcccagcactgcccatcccacc

SEQ ID NO: 3801419 - DNA, 23 bp, Homo sapiens
gcccagtgccacgcacaggtgct

SEQ ID NO: 3801420 - DNA, 12 bp, Homo sapiens
gcccatcccacc

SEQ ID NO: 3801421 - DNA, 13 bp, Homo sapiens
gcccatcccaccc

SEQ ID NO: 3801422 - DNA, 19 bp, Homo sapiens
gccccctgccagttgaagt

SEQ ID NO: 3801423 - DNA, 18 bp, Homo sapiens
gccctggaacctaccaga

SEQ ID NO: 3801424 - DNA, 16 bp, Homo sapiens
gcctgtaatcccagct

SEQ ID NO: 3801425 - DNA, 13 bp, Homo sapiens
gccttgctgacct

SEQ ID NO: 3801426 - DNA, 17 bp, Homo sapiens
gccttgctgacctccca

SEQ ID NO: 3801427 - DNA, 19 bp, Homo sapiens
gctatccagctatttttat

SEQ ID NO: 3801428 - DNA, 14 bp, Homo sapiens
gctcagccccacgg

SEQ ID NO: 3801429 - DNA, 15 bp, Homo sapiens
gctgaggcaattcta

SEQ ID NO: 3801430 - DNA, 17 bp, Homo sapiens
gctgccctgacccttcc

SEQ ID NO: 3801431 - DNA, 20 bp, Homo sapiens
gctggcggggtcccccctcc

SEQ ID NO: 3801432 - DNA, 18 bp, Homo sapiens
gcttggaaactggatgag

SEQ ID NO: 3801433 - DNA, 23 bp, Homo sapiens
ggaacctaccagagcagagaagg

SEQ ID NO: 3801434 - DNA, 10 bp, Homo sapiens
ggaggctctc

SEQ ID NO: 3801435 - DNA, 18 bp, Homo sapiens
ggagggttgagacccagg

SEQ ID NO: 3801436 - DNA, 12 bp, Homo sapiens
ggagtttgagac

SEQ ID NO: 3801437 - DNA, 15 bp, Homo sapiens
ggagtttgagaccag

SEQ ID NO: 3801438 - DNA, 23 bp, Homo sapiens
ggatgtttctgtcacatcagctc

SEQ ID NO: 3801439 - DNA, 22 bp, Homo sapiens
ggcattatgatcccttccccct

SEQ ID NO: 3801440 - DNA, 20 bp, Homo sapiens
ggcccagcactgcccatccc

SEQ ID NO: 3801441 - DNA, 22 bp, Homo sapiens
ggcccagcactgcccatcccac

SEQ ID NO: 3801442 - DNA, 22 bp, Homo sapiens
ggctcacgcctgtaatcccagc

SEQ ID NO: 3801443 - DNA, 16 bp, Homo sapiens
ggctgaggtgggagga

SEQ ID NO: 3801444 - DNA, 17 bp, Homo sapiens
ggctgccctgacccttc

SEQ ID NO: 3801445 - DNA, 14 bp, Homo sapiens
ggctgccgccacca

SEQ ID NO: 3801446 - DNA, 20 bp, Homo sapiens
ggctggcggggtcccccctc

SEQ ID NO: 3801447 - DNA, 22 bp, Homo sapiens
ggctggcggggtcccccctcca

SEQ ID NO: 3801448 - DNA, 16 bp, Homo sapiens
gggaatggcacagccc

SEQ ID NO: 3801449 - DNA, 20 bp, Homo sapiens
gggaggcagaggttgcagtg

SEQ ID NO: 3801450 - DNA, 14 bp, Homo sapiens
gggaggccaaggcg

SEQ ID NO: 3801451 - DNA, 15 bp, Homo sapiens
gggaggctgaggcag

SEQ ID NO: 3801452 - DNA, 15 bp, Homo sapiens
acacagggaggctgt

SEQ ID NO: 3801453 - DNA, 22 bp, Homo sapiens
acacctaggtcgccagtgaaat

SEQ ID NO: 3801454 - DNA, 23 bp, Homo sapiens
acacctaggtcgccagtgaaata

SEQ ID NO: 3801455 - DNA, 12 bp, Homo sapiens
acagaacactgt

SEQ ID NO: 3801456 - DNA, 16 bp, Homo sapiens
acagaagaaggcagca

SEQ ID NO: 3801457 - DNA, 10 bp, Homo sapiens
acagagctgg

SEQ ID NO: 3801458 - DNA, 16 bp, Homo sapiens
acagcccaaagaagga

SEQ ID NO: 3801459 - DNA, 19 bp, Homo sapiens
acagcccaaagaaggaaaa

SEQ ID NO: 3801460 - DNA, 14 bp, Homo sapiens
acagggaggctgta

SEQ ID NO: 3801461 - DNA, 22 bp, Homo sapiens
acaggtttaaggctgaggctgc

SEQ ID NO: 3801462 - DNA, 19 bp, Homo sapiens
acagtactgacagaaagca

SEQ ID NO: 3801463 - DNA, 22 bp, Homo sapiens
acatagtgagaccctgtctcta

SEQ ID NO: 3801464 - DNA, 19 bp, Homo sapiens
acatgcctgtaatcccagc

SEQ ID NO: 3801465 - DNA, 14 bp, Homo sapiens
acatgtataatatt

SEQ ID NO: 3801466 - DNA, 19 bp, Homo sapiens
acatgtataatatttttaa

SEQ ID NO: 3801467 - DNA, 11 bp, Homo sapiens
accagcctggg

SEQ ID NO: 3801468 - DNA, 20 bp, Homo sapiens
accagcctgggcaacatagt

SEQ ID NO: 3801469 - DNA, 16 bp, Homo sapiens
acccacagtttgagac

SEQ ID NO: 3801470 - DNA, 14 bp, Homo sapiens
acccacctgaaatg

SEQ ID NO: 3801471 - DNA, 12 bp, Homo sapiens
acccatctccag

SEQ ID NO: 3801472 - DNA, 17 bp, Homo sapiens
acgcctgtaatcccagc

SEQ ID NO: 3801473 - DNA, 23 bp, Homo sapiens
acggcattatgatcccttccccc

SEQ ID NO: 3801474 - DNA, 15 bp, Homo sapiens
acgggactctggtgg

SEQ ID NO: 3801475 - DNA, 20 bp, Homo sapiens
acgtatgtttttgtgtattt

SEQ ID NO: 3801476 - DNA, 22 bp, Homo sapiens
actacaatttaaagcaaaggag

SEQ ID NO: 3801477 - DNA, 12 bp, Homo sapiens
actcaatatttt

SEQ ID NO: 3801478 - DNA, 22 bp, Homo sapiens
actcaatattttccatgaaaat

SEQ ID NO: 3801479 - DNA, 20 bp, Homo sapiens
actcacatggctatgtttta

SEQ ID NO: 3801480 - DNA, 15 bp, Homo sapiens
actccagcctgggca

SEQ ID NO: 3801481 - DNA, 17 bp, Homo sapiens
actccagcctgggcaac

SEQ ID NO: 3801482 - DNA, 18 bp, Homo sapiens
actccagcctgggcaaca

SEQ ID NO: 3801483 - DNA, 21 bp, Homo sapiens
actctttgggatcttgaagaa

SEQ ID NO: 3801484 - DNA, 20 bp, Homo sapiens
actgcagcatgcccagtgcc

SEQ ID NO: 3801485 - DNA, 17 bp, Homo sapiens
actgcccatcccacccc

SEQ ID NO: 3801486 - DNA, 12 bp, Homo sapiens
actgtcaagccc

SEQ ID NO: 3801487 - DNA, 15 bp, Homo sapiens
acttgaaacccacag

SEQ ID NO: 3801488 - DNA, 18 bp, Homo sapiens
acttgacagaacactgtc

SEQ ID NO: 3801489 - DNA, 20 bp, Homo sapiens
acttgacagaacactgtctt

SEQ ID NO: 3801490 - DNA, 11 bp, Homo sapiens
acttgctgctc

SEQ ID NO: 3801491 - DNA, 15 bp, Homo sapiens
agaaagacagagctg

SEQ ID NO: 3801492 - DNA, 12 bp, Homo sapiens
agaaagcaagga

SEQ ID NO: 3801493 - DNA, 16 bp, Homo sapiens
agaacacaaggtcatt

SEQ ID NO: 3801494 - DNA, 23 bp, Homo sapiens
agaagggttacttgctgctcaca

SEQ ID NO: 3801495 - DNA, 15 bp, Homo sapiens
agaatggggtgcatg

SEQ ID NO: 3801496 - DNA, 13 bp, Homo sapiens
agaccagcctggg

SEQ ID NO: 3801497 - DNA, 11 bp, Homo sapiens
agagctgaggc

SEQ ID NO: 3801498 - DNA, 16 bp, Homo sapiens
agagtgagggctccct

SEQ ID NO: 3801499 - DNA, 13 bp, Homo sapiens
agatcccagccca

SEQ ID NO: 3801500 - DNA, 16 bp, Homo sapiens
agatcccagcccaccc

SEQ ID NO: 3801501 - DNA, 18 bp, Homo sapiens
agatcccagcccaccctg

SEQ ID NO: 3801502 - DNA, 18 bp, Homo sapiens
agcactgcccatcccacc

SEQ ID NO: 3801503 - DNA, 19 bp, Homo sapiens
agcactgcccatcccaccc

SEQ ID NO: 3801504 - DNA, 20 bp, Homo sapiens
agcactgcccatcccacccc

SEQ ID NO: 3801505 - DNA, 19 bp, Homo sapiens
agcattatgatgtgggtca

SEQ ID NO: 3801506 - DNA, 13 bp, Homo sapiens
agccacagctggt

SEQ ID NO: 3801507 - DNA, 23 bp, Homo sapiens
agccaggaaaccctcttcttccc

SEQ ID NO: 3801508 - DNA, 13 bp, Homo sapiens
agcccaaagaagg

SEQ ID NO: 3801509 - DNA, 15 bp, Homo sapiens
agcccaccctgcccc

SEQ ID NO: 3801510 - DNA, 23 bp, Homo sapiens
agcctttctaaggctcagcccca

SEQ ID NO: 3801511 - DNA, 12 bp, Homo sapiens
agctctgccctg

SEQ ID NO: 3801512 - DNA, 16 bp, Homo sapiens
agctgagcttagctct

SEQ ID NO: 3801513 - DNA, 17 bp, Homo sapiens
agctgaggcaattctaa

SEQ ID NO: 3801514 - DNA, 17 bp, Homo sapiens
agcttagctctgccctg

SEQ ID NO: 3801515 - DNA, 12 bp, Homo sapiens
agcttgtgagct

SEQ ID NO: 3801516 - DNA, 14 bp, Homo sapiens
aggagaatcactcg

SEQ ID NO: 3801517 - DNA, 22 bp, Homo sapiens
aggagacccctttgcaggactt

SEQ ID NO: 3801518 - DNA, 20 bp, Homo sapiens
aggcagaggttgcagtgagt

SEQ ID NO: 3801519 - DNA, 22 bp, Homo sapiens
aggcaggtgtcttggacccacc

SEQ ID NO: 3801520 - DNA, 21 bp, Homo sapiens
aggccccctgccagttgaagt

SEQ ID NO: 3801521 - DNA, 14 bp, Homo sapiens
aggctgaggctgcc

SEQ ID NO: 3801522 - DNA, 12 bp, Homo sapiens
aggctgaggtgg

SEQ ID NO: 3801523 - DNA, 17 bp, Homo sapiens
aggctgccgccaccacg

SEQ ID NO: 3801524 - DNA, 17 bp, Homo sapiens
agggctgggtaggcagg

SEQ ID NO: 3801525 - DNA, 14 bp, Homo sapiens
aggtcgccagtgaa

SEQ ID NO: 3801526 - DNA, 22 bp, Homo sapiens
aggtgggaggattacttgaaac

SEQ ID NO: 3801527 - DNA, 14 bp, Homo sapiens
aggtttaaggctga

SEQ ID NO: 3801528 - DNA, 23 bp, Homo sapiens
aggtttctgaaaattaacactgc

SEQ ID NO: 3801529 - DNA, 16 bp, Homo sapiens
agtaatcccagtgact

SEQ ID NO: 3801530 - DNA, 13 bp, Homo sapiens
agtgaaatagaac

SEQ ID NO: 3801531 - DNA, 18 bp, Homo sapiens
agtgacttaggaggctga

SEQ ID NO: 3801532 - DNA, 17 bp, Homo sapiens
agtgcttattgtttgca

SEQ ID NO: 3801533 - DNA, 17 bp, Homo sapiens
agttctgctgtctccct

SEQ ID NO: 3801534 - DNA, 23 bp, Homo sapiens
agttctgctgtctccctgaagag

SEQ ID NO: 3801535 - DNA, 15 bp, Homo sapiens
atactgtcaagccct

SEQ ID NO: 3801536 - DNA, 21 bp, Homo sapiens
atagaacacagaacaggaact

SEQ ID NO: 3801537 - DNA, 16 bp, Homo sapiens
atagtgagaccctgtc

SEQ ID NO: 3801538 - DNA, 13 bp, Homo sapiens
atataaacactat

SEQ ID NO: 3801539 - DNA, 13 bp, Homo sapiens
atatattttaatt

SEQ ID NO: 3801540 - DNA, 11 bp, Homo sapiens
atattgcttct

SEQ ID NO: 3801541 - DNA, 16 bp, Homo sapiens
atattgcttctccctt

SEQ ID NO: 3801542 - DNA, 16 bp, Homo sapiens
atattttccatgaaaa

SEQ ID NO: 3801543 - DNA, 16 bp, Homo sapiens
atcaatctgcagtttg

SEQ ID NO: 3801544 - DNA, 21 bp, Homo sapiens
atcaatctgcagtttgtgaac

SEQ ID NO: 3801545 - DNA, 22 bp, Homo sapiens
atcaatctgcagtttgtgaact

SEQ ID NO: 3801546 - DNA, 18 bp, Homo sapiens
atcagctccactttcagt

SEQ ID NO: 3801547 - DNA, 21 bp, Homo sapiens
atcatctgatttactctttgg

SEQ ID NO: 3801548 - DNA, 18 bp, Homo sapiens
atcattaaagtgctttca

SEQ ID NO: 3801549 - DNA, 13 bp, Homo sapiens
atcccagcccacc

SEQ ID NO: 3801550 - DNA, 15 bp, Homo sapiens
atcccttccccctgc

SEQ ID NO: 3801551 - DNA, 17 bp, Homo sapiens
atctctctttaatataa

SEQ ID NO: 3801552 - DNA, 18 bp, Homo sapiens
atctgcagtttgtgaact

SEQ ID NO: 3801553 - DNA, 17 bp, Homo sapiens
atgaaggtttctgaaaa

SEQ ID NO: 3801554 - DNA, 16 bp, Homo sapiens
atgaggtcaagaaatg

SEQ ID NO: 3801555 - DNA, 15 bp, Homo sapiens
atgatcttttcaagt

SEQ ID NO: 3801556 - DNA, 18 bp, Homo sapiens
atgccatggacagaagaa

SEQ ID NO: 3801557 - DNA, 16 bp, Homo sapiens
atgcctgtaatcccag

SEQ ID NO: 3801558 - DNA, 23 bp, Homo sapiens
atgctaaaggttgtattgcatat

SEQ ID NO: 3801559 - DNA, 20 bp, Homo sapiens
atggacagaagaaggcagca

SEQ ID NO: 3801560 - DNA, 23 bp, Homo sapiens
atggcacagcccaaagaaggaaa

SEQ ID NO: 3801561 - DNA, 14 bp, Homo sapiens
atggccttgaagtg

SEQ ID NO: 3801562 - DNA, 12 bp, Homo sapiens
atggggatgcag

SEQ ID NO: 3801563 - DNA, 14 bp, Homo sapiens
atgtataatatttt

SEQ ID NO: 3801564 - DNA, 18 bp, Homo sapiens
attacttgaaacccacag

SEQ ID NO: 3801565 - DNA, 11 bp, Homo sapiens
attagccaggt

SEQ ID NO: 3801566 - DNA, 19 bp, Homo sapiens
attatgatcccttccccct

SEQ ID NO: 3801567 - DNA, 15 bp, Homo sapiens
attcagccttgctga

SEQ ID NO: 3801568 - DNA, 17 bp, Homo sapiens
attcatctctctttaat

SEQ ID NO: 3801569 - DNA, 21 bp, Homo sapiens
attcttacaaacatgtggtta

SEQ ID NO: 3801570 - DNA, 23 bp, Homo sapiens
attgcagatcccagcccaccctg

SEQ ID NO: 3801571 - DNA, 18 bp, Homo sapiens
attggactgagggctggg

SEQ ID NO: 3801572 - DNA, 20 bp, Homo sapiens
atttcatagccaaacaggag

SEQ ID NO: 3801573 - DNA, 21 bp, Homo sapiens
atttcttaaacaaatgtatga

SEQ ID NO: 3801574 - DNA, 12 bp, Homo sapiens
atttgttaatgg

SEQ ID NO: 3801575 - DNA, 15 bp, Homo sapiens
caaaattagccaggt

SEQ ID NO: 3801576 - DNA, 22 bp, Homo sapiens
caaacgtgttatattccatact

SEQ ID NO: 3801577 - DNA, 16 bp, Homo sapiens
caaaggagtagaaaga

SEQ ID NO: 3801578 - DNA, 17 bp, Homo sapiens
caacatgtataatattt

SEQ ID NO: 3801579 - DNA, 22 bp, Homo sapiens
caagaaatgtgacttggccggg

SEQ ID NO: 3801580 - DNA, 12 bp, Homo sapiens
caagagctgagg

SEQ ID NO: 3801581 - DNA, 11 bp, Homo sapiens
caatattttcc

SEQ ID NO: 3801582 - DNA, 13 bp, Homo sapiens
caatggtttgcaa

SEQ ID NO: 3801583 - DNA, 20 bp, Homo sapiens
caatggtttgcaaggaagcc

SEQ ID NO: 3801584 - DNA, 17 bp, Homo sapiens
caatttccaagagctga

SEQ ID NO: 3801585 - DNA, 13 bp, Homo sapiens
caatttcccaccc

SEQ ID NO: 3801586 - DNA, 19 bp, Homo sapiens
cacaagaatggtgtgtgcc

SEQ ID NO: 3801587 - DNA, 19 bp, Homo sapiens
cacagcccaaagaaggaaa

SEQ ID NO: 3801588 - DNA, 15 bp, Homo sapiens
cacaggtttaaggct

SEQ ID NO: 3801589 - DNA, 19 bp, Homo sapiens
cacagtttgagaccagcct

SEQ ID NO: 3801590 - DNA, 21 bp, Homo sapiens
caccacggcattatgatccct

SEQ ID NO: 3801591 - DNA, 11 bp, Homo sapiens
cacccatctcc

SEQ ID NO: 3801592 - DNA, 15 bp, Homo sapiens
caccctggaggctct

SEQ ID NO: 3801593 - DNA, 22 bp, Homo sapiens
caccgacttcaatttcccaccc

SEQ ID NO: 3801594 - DNA, 15 bp, Homo sapiens
caccttatatttacg

SEQ ID NO: 3801595 - DNA, 20 bp, Homo sapiens
cacgcctgtaatcccagcac

SEQ ID NO: 3801596 - DNA, 24 bp, Homo sapiens
cactcattgcagatcccagcccac

SEQ ID NO: 3801597 - DNA, 15 bp, Homo sapiens
cactgcccatcccac

SEQ ID NO: 3801598 - DNA, 18 bp, Homo sapiens
cactgcccatcccacccc

SEQ ID NO: 3801599 - DNA, 20 bp, Homo sapiens
cactgcccatcccaccccat

SEQ ID NO: 3801600 - DNA, 17 bp, Homo sapiens
cactttcagtgaaagca

SEQ ID NO: 3801601 - DNA, 18 bp, Homo sapiens
cagaaagcaaggactgcc

SEQ ID NO: 3801602 - DNA, 18 bp, Homo sapiens
cagaatggggtgcatgaa

SEQ ID NO: 3801603 - DNA, 21 bp, Homo sapiens
cagagaagggcaggagaggaa

SEQ ID NO: 3801604 - DNA, 22 bp, Homo sapiens
cagagaagggcaggagaggaag

SEQ ID NO: 3801605 - DNA, 9 bp, Homo sapiens
cagagctgg

SEQ ID NO: 3801606 - DNA, 16 bp, Homo sapiens
cagatcccagcccacc

SEQ ID NO: 3801607 - DNA, 18 bp, Homo sapiens
cagatcccagcccaccct

SEQ ID NO: 3801608 - DNA, 23 bp, Homo sapiens
cagatcccagcccaccctgcccc

SEQ ID NO: 3801609 - DNA, 14 bp, Homo sapiens
cagatgcaagcaag

SEQ ID NO: 3801610 - DNA, 22 bp, Homo sapiens
cagcactgcccatcccacccca

SEQ ID NO: 3801611 - DNA, 15 bp, Homo sapiens
cagcatgcccagtgc

SEQ ID NO: 3801612 - DNA, 21 bp, Homo sapiens
cagcctttctaaggctcagcc

SEQ ID NO: 3801613 - DNA, 19 bp, Homo sapiens
cagctactagggaggctga

SEQ ID NO: 3801614 - DNA, 15 bp, Homo sapiens
caggagaatcactcg

SEQ ID NO: 3801615 - DNA, 22 bp, Homo sapiens
cagtaggaaattgattttgaaa

SEQ ID NO: 3801616 - DNA, 14 bp, Homo sapiens
cagtgaaagcatca

SEQ ID NO: 3801617 - DNA, 15 bp, Homo sapiens
cagttcctttcaatg

SEQ ID NO: 3801618 - DNA, 19 bp, Homo sapiens
cagtttgagaccagcctgg

SEQ ID NO: 3801619 - DNA, 21 bp, Homo sapiens
cagtttgagaccagcctgggc

SEQ ID NO: 3801620 - DNA, 15 bp, Homo sapiens
catgaggctcactca

SEQ ID NO: 3801621 - DNA, 15 bp, Homo sapiens
catggacagaagaag

SEQ ID NO: 3801622 - DNA, 18 bp, Homo sapiens
catgtataatatttttaa

SEQ ID NO: 3801623 - DNA, 20 bp, Homo sapiens
catgtataatatttttaatt

SEQ ID NO: 3801624 - DNA, 22 bp, Homo sapiens
catgtggttaatgccatggaca

SEQ ID NO: 3801625 - DNA, 21 bp, Homo sapiens
cattatgatgtgggtcaagga

SEQ ID NO: 3801626 - DNA, 23 bp, Homo sapiens
cattatgatgtgggtcaaggaat

SEQ ID NO: 3801627 - DNA, 16 bp, Homo sapiens
cattcagccttgctga

SEQ ID NO: 3801628 - DNA, 17 bp, Homo sapiens
cattgcagatcccagcc

SEQ ID NO: 3801629 - DNA, 18 bp, Homo sapiens
cattgcagatcccagccc

SEQ ID NO: 3801630 - DNA, 22 bp, Homo sapiens
ccaccacggcattatgatccct

SEQ ID NO: 3801631 - DNA, 17 bp, Homo sapiens
ccaccctggaggctctc

SEQ ID NO: 3801632 - DNA, 22 bp, Homo sapiens
ccacgggactctggtggctgcc

SEQ ID NO: 3801633 - DNA, 22 bp, Homo sapiens
ccagcactgcccatcccacccc

SEQ ID NO: 3801634 - DNA, 16 bp, Homo sapiens
ccagcctgggcaacaa

SEQ ID NO: 3801635 - DNA, 21 bp, Homo sapiens
ccagctactagggaggctgag

SEQ ID NO: 3801636 - DNA, 21 bp, Homo sapiens
ccagtaggaaattgattttga

SEQ ID NO: 3801637 - DNA, 21 bp, Homo sapiens
ccagtgacttaggaggctgag

SEQ ID NO: 3801638 - DNA, 22 bp, Homo sapiens
ccagtgccacgcacaggtgctg

SEQ ID NO: 3801639 - DNA, 22 bp, Homo sapiens
ccagttcctttcaatggtttgc

SEQ ID NO: 3801640 - DNA, 12 bp, Homo sapiens
ccatgaggctca

SEQ ID NO: 3801641 - DNA, 21 bp, Homo sapiens
ccattgcactccagcctgggc

SEQ ID NO: 3801642 - DNA, 12 bp, Homo sapiens
cccaaagaagga

SEQ ID NO: 3801643 - DNA, 21 bp, Homo sapiens
cccaattcttacaaacatgtg

SEQ ID NO: 3801644 - DNA, 20 bp, Homo sapiens
cccagcactgcccatcccac

SEQ ID NO: 3801645 - DNA, 21 bp, Homo sapiens
cccagcactgcccatcccacc

SEQ ID NO: 3801646 - DNA, 12 bp, Homo sapiens
cccagcccaccc

SEQ ID NO: 3801647 - DNA, 16 bp, Homo sapiens
ccctgctgatcaatct

SEQ ID NO: 3801648 - DNA, 13 bp, Homo sapiens
cctcttcttccct

SEQ ID NO: 3801649 - DNA, 21 bp, Homo sapiens
cctgcccctttcttccccacc

SEQ ID NO: 3801650 - DNA, 16 bp, Homo sapiens
cctgctgatcaatctg

SEQ ID NO: 3801651 - DNA, 15 bp, Homo sapiens
cctgtaatcccagca

SEQ ID NO: 3801652 - DNA, 16 bp, Homo sapiens
cctgtaatcccagcac

SEQ ID NO: 3801653 - DNA, 22 bp, Homo sapiens
cctgtaatcccagcactttggg

SEQ ID NO: 3801654 - DNA, 18 bp, Homo sapiens
cctgtaatcccagctact

SEQ ID NO: 3801655 - DNA, 21 bp, Homo sapiens
ccttgctgacctcccagcctt

SEQ ID NO: 3801656 - DNA, 22 bp, Homo sapiens
cctttagttctgctgtctccct

SEQ ID NO: 3801657 - DNA, 21 bp, Homo sapiens
cctttctaaggctcagcccca

SEQ ID NO: 3801658 - DNA, 13 bp, Homo sapiens
cctttcttcccca

SEQ ID NO: 3801659 - DNA, 18 bp, Homo sapiens
cgacttcaatttcccacc

SEQ ID NO: 3801660 - DNA, 20 bp, Homo sapiens
cgacttcaatttcccaccca

SEQ ID NO: 3801661 - DNA, 17 bp, Homo sapiens
cgcacaggtgctgacct

SEQ ID NO: 3801662 - DNA, 22 bp, Homo sapiens
cgcaccgacttcaatttcccac

SEQ ID NO: 3801663 - DNA, 14 bp, Homo sapiens
cgggagtttgagac

SEQ ID NO: 3801664 - DNA, 16 bp, Homo sapiens
cgggagtttgagacca

SEQ ID NO: 3801665 - DNA, 13 bp, Homo sapiens
cggggtcccccct

SEQ ID NO: 3801666 - DNA, 20 bp, Homo sapiens
cggtggctcacgcctgtaat

SEQ ID NO: 3801667 - DNA, 21 bp, Homo sapiens
ctaaaaaaataaaaatagaaa

SEQ ID NO: 3801668 - DNA, 23 bp, Homo sapiens
ctaaaaatacaaaattagccagg

SEQ ID NO: 3801669 - DNA, 13 bp, Homo sapiens
ctagggaggctga

SEQ ID NO: 3801670 - DNA, 21 bp, Homo sapiens
ctaggtcgccagtgaaataga

SEQ ID NO: 3801671 - DNA, 22 bp, Homo sapiens
ctaggtcgccagtgaaatagaa

SEQ ID NO: 3801672 - DNA, 13 bp, Homo sapiens
ctatattgtacac

SEQ ID NO: 3801673 - DNA, 15 bp, Homo sapiens
ctatattgtacacac

SEQ ID NO: 3801674 - DNA, 21 bp, Homo sapiens
ctcaaaaaaaaaaaagtgtct

SEQ ID NO: 3801675 - DNA, 13 bp, Homo sapiens
ctcaatattttcc

SEQ ID NO: 3801676 - DNA, 22 bp, Homo sapiens
ctcaatattttccatgaaaatg

SEQ ID NO: 3801677 - DNA, 23 bp, Homo sapiens
ctcacgcctgtaatcccagcact

SEQ ID NO: 3801678 - DNA, 23 bp, Homo sapiens
ctcattgcagatcccagcccacc

SEQ ID NO: 3801679 - DNA, 12 bp, Homo sapiens
ctccctccaccg

SEQ ID NO: 3801680 - DNA, 18 bp, Homo sapiens
ctccttcacgaggaatct

SEQ ID NO: 3801681 - DNA, 23 bp, Homo sapiens
ctctaaaaaaataaaaatagaaa

SEQ ID NO: 3801682 - DNA, 19 bp, Homo sapiens
ctctggtggctgccagctt

SEQ ID NO: 3801683 - DNA, 21 bp, Homo sapiens
ctctttgggatcttgaagaag

SEQ ID NO: 3801684 - DNA, 22 bp, Homo sapiens
gggcaacatagtgagaccctgt

SEQ ID NO: 3801685 - DNA, 16 bp, Homo sapiens
ggtcatagcagtgctt

SEQ ID NO: 3801686 - DNA, 13 bp, Homo sapiens
ggtttctgaaaat

SEQ ID NO: 3801687 - DNA, 22 bp, Homo sapiens
gtaagtttatggccttgaagtg

SEQ ID NO: 3801688 - DNA, 12 bp, Homo sapiens
gtaatcccagca

SEQ ID NO: 3801689 - DNA, 13 bp, Homo sapiens
gtaatcccagcac

SEQ ID NO: 3801690 - DNA, 20 bp, Homo sapiens
gtaatcccagtgacttagga

SEQ ID NO: 3801691 - DNA, 22 bp, Homo sapiens
gtacatgcctgtaatcccagct

SEQ ID NO: 3801692 - DNA, 18 bp, Homo sapiens
gtagaaagacagagctgg

SEQ ID NO: 3801693 - DNA, 21 bp, Homo sapiens
gtagaaagacagagctgggat

SEQ ID NO: 3801694 - DNA, 19 bp, Homo sapiens
gtaggcaggtgtcttggac

SEQ ID NO: 3801695 - DNA, 15 bp, Homo sapiens
gtataatatttttaa

SEQ ID NO: 3801696 - DNA, 22 bp, Homo sapiens
gtctacagtactgacagaaagc

SEQ ID NO: 3801697 - DNA, 18 bp, Homo sapiens
gtgacttaggaggctgag

SEQ ID NO: 3801698 - DNA, 18 bp, Homo sapiens
gtgagaccctgtctctaa

SEQ ID NO: 3801699 - DNA, 23 bp, Homo sapiens
gtgctgagttggtgttgacatgt

SEQ ID NO: 3801700 - DNA, 16 bp, Homo sapiens
gtgcttattgtttgca

SEQ ID NO: 3801701 - DNA, 20 bp, Homo sapiens
gtggaggagctcaggacact

SEQ ID NO: 3801702 - DNA, 17 bp, Homo sapiens
gtggccctcaggcccac

SEQ ID NO: 3801703 - DNA, 12 bp, Homo sapiens
gtgtaggcctgg

SEQ ID NO: 3801704 - DNA, 17 bp, Homo sapiens
gttacttgctgctcaca

SEQ ID NO: 3801705 - DNA, 19 bp, Homo sapiens
gttgaataggggaaagaaa

SEQ ID NO: 3801706 - DNA, 20 bp, Homo sapiens
gtttctgaaaattaacactg

SEQ ID NO: 3801707 - DNA, 17 bp, Homo sapiens
gtttgaatataaacact

SEQ ID NO: 3801708 - DNA, 19 bp, Homo sapiens
gtttgaatataaacactat

SEQ ID NO: 3801709 - DNA, 20 bp, Homo sapiens
gtttgagaccagcctgggca

SEQ ID NO: 3801710 - DNA, 17 bp, Homo sapiens
gtttgcaaggaagccac

SEQ ID NO: 3801711 - DNA, 19 bp, Homo sapiens
gttttgtggaggagctcag

SEQ ID NO: 3801712 - DNA, 19 bp, Homo sapiens
gtttttaactcaatatttt

SEQ ID NO: 3801713 - DNA, 12 bp, Homo sapiens
taaaaatagaaa

SEQ ID NO: 3801714 - DNA, 18 bp, Homo sapiens
taaaaatagaaataaagt

SEQ ID NO: 3801715 - DNA, 12 bp, Homo sapiens
taaacaaatgta

SEQ ID NO: 3801716 - DNA, 13 bp, Homo sapiens
taaatacagcaat

SEQ ID NO: 3801717 - DNA, 12 bp, Homo sapiens
taacaaacagga

SEQ ID NO: 3801718 - DNA, 14 bp, Homo sapiens
taactcaatatttt

SEQ ID NO: 3801719 - DNA, 14 bp, Homo sapiens
taatataaagttgg

SEQ ID NO: 3801720 - DNA, 19 bp, Homo sapiens
taatataaagttggatgcg

SEQ ID NO: 3801721 - DNA, 14 bp, Homo sapiens
taatatttttaatt

SEQ ID NO: 3801722 - DNA, 13 bp, Homo sapiens
taatcccagcact

SEQ ID NO: 3801723 - DNA, 15 bp, Homo sapiens
taatgtttataagct

SEQ ID NO: 3801724 - DNA, 18 bp, Homo sapiens
tacacaccttatatttac

SEQ ID NO: 3801725 - DNA, 17 bp, Homo sapiens
tacagatgcaagcaagg

SEQ ID NO: 3801726 - DNA, 12 bp, Homo sapiens
tacagtactgac

SEQ ID NO: 3801727 - DNA, 19 bp, Homo sapiens
tacagtactgacagaaagc

SEQ ID NO: 3801728 - DNA, 13 bp, Homo sapiens
tacctttatgtaa

SEQ ID NO: 3801729 - DNA, 19 bp, Homo sapiens
tactctttgggatcttgaa

SEQ ID NO: 3801730 - DNA, 18 bp, Homo sapiens
taggtcgccagtgaaata

SEQ ID NO: 3801731 - DNA, 13 bp, Homo sapiens
tagtgcttattgt

SEQ ID NO: 3801732 - DNA, 19 bp, Homo sapiens
tagttctgctgtctccctg

SEQ ID NO: 3801733 - DNA, 22 bp, Homo sapiens
tataatatttttaattaaataa

SEQ ID NO: 3801734 - DNA, 14 bp, Homo sapiens
tatatattttaatt

SEQ ID NO: 3801735 - DNA, 16 bp, Homo sapiens
tatgaccttctaggaa

SEQ ID NO: 3801736 - DNA, 18 bp, Homo sapiens
tatgaccttctaggaagc

SEQ ID NO: 3801737 - DNA, 16 bp, Homo sapiens
tattaacaaacaggat

SEQ ID NO: 3801738 - DNA, 22 bp, Homo sapiens
tatttcaatttccaagagctga

SEQ ID NO: 3801739 - DNA, 16 bp, Homo sapiens
tattttccatgaaaat

SEQ ID NO: 3801740 - DNA, 13 bp, Homo sapiens
tatttttatttgt

SEQ ID NO: 3801741 - DNA, 16 bp, Homo sapiens
tcaatattttccatga

SEQ ID NO: 3801742 - DNA, 22 bp, Homo sapiens
tcaatctgcagtttgtgaactt

SEQ ID NO: 3801743 - DNA, 13 bp, Homo sapiens
tcaatttccaaga

SEQ ID NO: 3801744 - DNA, 20 bp, Homo sapiens
tcaatttccaagagctgagg

SEQ ID NO: 3801745 - DNA, 19 bp, Homo sapiens
tcacgaggaatctgggcct

SEQ ID NO: 3801746 - DNA, 20 bp, Homo sapiens
tcacgccattgcactccagc

SEQ ID NO: 3801747 - DNA, 19 bp, Homo sapiens
tcacgcctgtaatcccagc

SEQ ID NO: 3801748 - DNA, 21 bp, Homo sapiens
tcactgcagcatgcccagtgc

SEQ ID NO: 3801749 - DNA, 18 bp, Homo sapiens
tcagctccactttcagtg

SEQ ID NO: 3801750 - DNA, 19 bp, Homo sapiens
tcaggccagtaatcccagt

SEQ ID NO: 3801751 - DNA, 16 bp, Homo sapiens
tcatctctctttaata

SEQ ID NO: 3801752 - DNA, 14 bp, Homo sapiens
tccagaaagcaagg

SEQ ID NO: 3801753 - DNA, 11 bp, Homo sapiens
tccagcctggg

SEQ ID NO: 3801754 - DNA, 21 bp, Homo sapiens
tccagctatttttatttgttt

SEQ ID NO: 3801755 - DNA, 22 bp, Homo sapiens
tccagtaggaaattgattttga

SEQ ID NO: 3801756 - DNA, 15 bp, Homo sapiens
tcccacccatctcca

SEQ ID NO: 3801757 - DNA, 22 bp, Homo sapiens
tcccagctactagggaggctga

SEQ ID NO: 3801758 - DNA, 22 bp, Homo sapiens
tcccagtgacttaggaggctga

SEQ ID NO: 3801759 - DNA, 11 bp, Homo sapiens
tcccttccccc

SEQ ID NO: 3801760 - DNA, 20 bp, Homo sapiens
tcccttccccctgctgatca

SEQ ID NO: 3801761 - DNA, 18 bp, Homo sapiens
tccctttagttctgctgt

SEQ ID NO: 3801762 - DNA, 19 bp, Homo sapiens
tcctttcaatggtttgcaa

SEQ ID NO: 3801763 - DNA, 21 bp, Homo sapiens
tctcaaaaaaaaaaaagtgtc

SEQ ID NO: 3801764 - DNA, 19 bp, Homo sapiens
tctgaaaattaacactgct

SEQ ID NO: 3801765 - DNA, 16 bp, Homo sapiens
tctgcagtttgtgaac

SEQ ID NO: 3801766 - DNA, 17 bp, Homo sapiens
tcttaaacaaatgtatg

SEQ ID NO: 3801767 - DNA, 12 bp, Homo sapiens
tcttccagaaag

SEQ ID NO: 3801768 - DNA, 15 bp, Homo sapiens
tcttggcccagcact

SEQ ID NO: 3801769 - DNA, 20 bp, Homo sapiens
tgaaaatgcaacaacatgta

SEQ ID NO: 3801770 - DNA, 23 bp, Homo sapiens
tgaaaatgcaacaacatgtataa

SEQ ID NO: 3801771 - DNA, 11 bp, Homo sapiens
tgaagaagaga

SEQ ID NO: 3801772 - DNA, 18 bp, Homo sapiens
tgaaggtttctgaaaatt

SEQ ID NO: 3801773 - DNA, 14 bp, Homo sapiens
tgaatataaacact

SEQ ID NO: 3801774 - DNA, 17 bp, Homo sapiens
tgacagaacactgtctt

SEQ ID NO: 3801775 - DNA, 21 bp, Homo sapiens
tgacagaacactgtcttgaag

SEQ ID NO: 3801776 - DNA, 14 bp, Homo sapiens
tgagaccagcctgg

SEQ ID NO: 3801777 - DNA, 22 bp, Homo sapiens
tgatcaatctgcagtttgtgaa

SEQ ID NO: 3801778 - DNA, 13 bp, Homo sapiens
tgatcccttcccc

SEQ ID NO: 3801779 - DNA, 16 bp, Homo sapiens
tgatcccttccccctg

SEQ ID NO: 3801780 - DNA, 23 bp, Homo sapiens
tgcagatcccagcccaccctgcc

SEQ ID NO: 3801781 - DNA, 22 bp, Homo sapiens
tgcagtgagtcaagatcacgcc

SEQ ID NO: 3801782 - DNA, 12 bp, Homo sapiens
tgcccatcccac

SEQ ID NO: 3801783 - DNA, 14 bp, Homo sapiens
tgcccatcccaccc

SEQ ID NO: 3801784 - DNA, 19 bp, Homo sapiens
tgcccctttcttccccacc

SEQ ID NO: 3801785 - DNA, 14 bp, Homo sapiens
tgccctggaaccta

SEQ ID NO: 3801786 - DNA, 17 bp, Homo sapiens
tgcctgtaatcccagct

SEQ ID NO: 3801787 - DNA, 19 bp, Homo sapiens
tgcctgtaatcccagctac

SEQ ID NO: 3801788 - DNA, 22 bp, Homo sapiens
tgctaactagcttggaaactgg

SEQ ID NO: 3801789 - DNA, 19 bp, Homo sapiens
tgctatccagctattttta

SEQ ID NO: 3801790 - DNA, 15 bp, Homo sapiens
tgcttattgtttgca

SEQ ID NO: 3801791 - DNA, 17 bp, Homo sapiens
tggactgagggctgggt

SEQ ID NO: 3801792 - DNA, 11 bp, Homo sapiens
tggaggctctc

SEQ ID NO: 3801793 - DNA, 20 bp, Homo sapiens
tggcacagcccaaagaagga

SEQ ID NO: 3801794 - DNA, 22 bp, Homo sapiens
tggcagaatggggtgcatgaag

SEQ ID NO: 3801795 - DNA, 20 bp, Homo sapiens
tggccttgaagtgttttcat

SEQ ID NO: 3801796 - DNA, 19 bp, Homo sapiens
tggctgccagcttgtgagc

SEQ ID NO: 3801797 - DNA, 20 bp, Homo sapiens
tggctggcggggtcccccct

SEQ ID NO: 3801798 - DNA, 19 bp, Homo sapiens
tgggagctggttgaattgt

SEQ ID NO: 3801799 - DNA, 12 bp, Homo sapiens
tgggaggattac

SEQ ID NO: 3801800 - DNA, 15 bp, Homo sapiens
tgggatcttgaagaa

SEQ ID NO: 3801801 - DNA, 18 bp, Homo sapiens
tggggactgcattggact

SEQ ID NO: 3801802 - DNA, 15 bp, Homo sapiens
tggtttgcaaggaag

SEQ ID NO: 3801803 - DNA, 15 bp, Homo sapiens
tgtaatcccagcact

SEQ ID NO: 3801804 - DNA, 19 bp, Homo sapiens
tgtaatcccagcactttgg

SEQ ID NO: 3801805 - DNA, 23 bp, Homo sapiens
tgtaatcccagctactagggagg

SEQ ID NO: 3801806 - DNA, 14 bp, Homo sapiens
tgtctacttgctcc

SEQ ID NO: 3801807 - DNA, 23 bp, Homo sapiens
tgtcttggacccacctgaaatgc

SEQ ID NO: 3801808 - DNA, 16 bp, Homo sapiens
tgtgacttggccgggc

SEQ ID NO: 3801809 - DNA, 15 bp, Homo sapiens
tgtgggtcaaggaat

SEQ ID NO: 3801810 - DNA, 17 bp, Homo sapiens
tgttaatggtttgaata

SEQ ID NO: 3801811 - DNA, 18 bp, Homo sapiens
tgtttataagctgggcat

SEQ ID NO: 3801812 - DNA, 17 bp, Homo sapiens
tgttttcatattgcttc

SEQ ID NO: 3801813 - DNA, 13 bp, Homo sapiens
ttaacaaacagga

SEQ ID NO: 3801814 - DNA, 14 bp, Homo sapiens
ttaacaaacaggat

SEQ ID NO: 3801815 - DNA, 16 bp, Homo sapiens
ttacttgctgctcaca

SEQ ID NO: 3801816 - DNA, 12 bp, Homo sapiens
ttaggaggctga

SEQ ID NO: 3801817 - DNA, 14 bp, Homo sapiens
ttatggccttgaag

SEQ ID NO: 3801818 - DNA, 15 bp, Homo sapiens
ttattaacaaacagg

SEQ ID NO: 3801819 - DNA, 16 bp, Homo sapiens
ttattaacaaacagga

SEQ ID NO: 3801820 - DNA, 24 bp, Homo sapiens
ttccatgaaaatgcaacaacatgt

SEQ ID NO: 3801821 - DNA, 11 bp, Homo sapiens
ttccccaccct

SEQ ID NO: 3801822 - DNA, 23 bp, Homo sapiens
ttccggaagtaaatacagcaatt

SEQ ID NO: 3801823 - DNA, 21 bp, Homo sapiens
ttcgatgggcccaattcttac

SEQ ID NO: 3801824 - DNA, 18 bp, Homo sapiens
ttctaaggctcagcccca

SEQ ID NO: 3801825 - DNA, 19 bp, Homo sapiens
ttctgaaaattaacactgc

SEQ ID NO: 3801826 - DNA, 14 bp, Homo sapiens
ttctgctgtctccc

SEQ ID NO: 3801827 - DNA, 15 bp, Homo sapiens
ttcttacaaacatgt

SEQ ID NO: 3801828 - DNA, 20 bp, Homo sapiens
ttcttccctggtctggctct

SEQ ID NO: 3801829 - DNA, 18 bp, Homo sapiens
ttcttggcccagcactgc

SEQ ID NO: 3801830 - DNA, 20 bp, Homo sapiens
ttgacttgacagaacactgt

SEQ ID NO: 3801831 - DNA, 12 bp, Homo sapiens
ttgcaaggaagc

SEQ ID NO: 3801832 - DNA, 13 bp, Homo sapiens
ttgcaaggaagcc

SEQ ID NO: 3801833 - DNA, 20 bp, Homo sapiens
ttgcactccagcctgggcaa

SEQ ID NO: 3801834 - DNA, 14 bp, Homo sapiens
ttgcatatatacat

SEQ ID NO: 3801835 - DNA, 19 bp, Homo sapiens
ttgttaatggtttgaatat

SEQ ID NO: 3801836 - DNA, 24 bp, Homo sapiens
tttaactcaatattttccatgaaa

SEQ ID NO: 3801837 - DNA, 21 bp, Homo sapiens
tttacaccagttcctttcaat

SEQ ID NO: 3801838 - DNA, 17 bp, Homo sapiens
tttcagtgaaagcatca

SEQ ID NO: 3801839 - DNA, 19 bp, Homo sapiens
tttctgaaaattaacactg

SEQ ID NO: 3801840 - DNA, 18 bp, Homo sapiens
tttgaatataaacactat

SEQ ID NO: 3801841 - DNA, 18 bp, Homo sapiens
tttgatagtattgtgcat

SEQ ID NO: 3801842 - DNA, 12 bp, Homo sapiens
tttgcaaggaag

SEQ ID NO: 3801843 - DNA, 12 bp, Homo sapiens
tttgcaggactt

SEQ ID NO: 3801844 - DNA, 19 bp, Homo sapiens
ttttccatgaaaatgcaac

SEQ ID NO: 3801845 - DNA, 19 bp, Homo sapiens
ttttcttggcccagcactg

SEQ ID NO: 3801846 - DNA, 14 bp, Homo sapiens
ctctgccctggaac

SEQ ID NO: 3801847 - DNA, 14 bp, Homo sapiens
ctctgcctagtcta

SEQ ID NO: 3801848 - DNA, 20 bp, Homo sapiens
ctctttgggatcttgaagaa

SEQ ID NO: 3801849 - DNA, 16 bp, Homo sapiens
ctgacagaaagcaagg

SEQ ID NO: 3801850 - DNA, 18 bp, Homo sapiens
ctgacctcccagcctttc

SEQ ID NO: 3801851 - DNA, 20 bp, Homo sapiens
ctgagttgacttgacagaac

SEQ ID NO: 3801852 - DNA, 21 bp, Homo sapiens
ctgcattggactgagggctgg

SEQ ID NO: 3801853 - DNA, 14 bp, Homo sapiens
ctgccagttgaagt

SEQ ID NO: 3801854 - DNA, 14 bp, Homo sapiens
ctgcccatcccacc

SEQ ID NO: 3801855 - DNA, 15 bp, Homo sapiens
ctgcccatcccaccc

SEQ ID NO: 3801856 - DNA, 17 bp, Homo sapiens
ctgcccctttcttcccc

SEQ ID NO: 3801857 - DNA, 21 bp, Homo sapiens
ctgcccctttcttccccaccc

SEQ ID NO: 3801858 - DNA, 17 bp, Homo sapiens
ctgcctcttaactcctt

SEQ ID NO: 3801859 - DNA, 17 bp, Homo sapiens
ctggcggggtcccccct

SEQ ID NO: 3801860 - DNA, 21 bp, Homo sapiens
ctgggtaggcaggtgtcttgg

SEQ ID NO: 3801861 - DNA, 22 bp, Homo sapiens
ctgggtaggcaggtgtcttgga

SEQ ID NO: 3801862 - DNA, 18 bp, Homo sapiens
ctggtctggctctgctgg

SEQ ID NO: 3801863 - DNA, 14 bp, Homo sapiens
ctgtagccaggaaa

SEQ ID NO: 3801864 - DNA, 17 bp, Homo sapiens
ctgtctccctgaagagt

SEQ ID NO: 3801865 - DNA, 15 bp, Homo sapiens
cttaggaggctgagg

SEQ ID NO: 3801866 - DNA, 19 bp, Homo sapiens
cttatgaggtcaagaaatg

SEQ ID NO: 3801867 - DNA, 23 bp, Homo sapiens
cttattattgatgataagattta

SEQ ID NO: 3801868 - DNA, 19 bp, Homo sapiens
cttcaatttcccacccatc

SEQ ID NO: 3801869 - DNA, 15 bp, Homo sapiens
cttccccctgctgat

SEQ ID NO: 3801870 - DNA, 22 bp, Homo sapiens
cttcttccctggtctggctctg

SEQ ID NO: 3801871 - DNA, 17 bp, Homo sapiens
cttgacagaacactgtc

SEQ ID NO: 3801872 - DNA, 19 bp, Homo sapiens
cttgctgacctcccagcct

SEQ ID NO: 3801873 - DNA, 13 bp, Homo sapiens
cttgctgctcaca

SEQ ID NO: 3801874 - DNA, 21 bp, Homo sapiens
cttggacccacctgaaatgca

SEQ ID NO: 3801875 - DNA, 17 bp, Homo sapiens
cttgggtcccagggaag

SEQ ID NO: 3801876 - DNA, 20 bp, Homo sapiens
ctttagttctgctgtctccc

SEQ ID NO: 3801877 - DNA, 17 bp, Homo sapiens
ctttatgtaagtttatg
